United States Patent 11,254,933 (CRISPR/CAS TRANSCRIPTIONAL MODULATION) - sequence listing, part 3

SEQ ID NO: 89246 - DNA, 20 bp, human
gtacagtggaaaacaaagac

SEQ ID NO: 89247 - DNA, 20 bp, human
gactcacaggtaagatctag

SEQ ID NO: 89248 - DNA, 20 bp, human
gtcaggcacattaataatgg

SEQ ID NO: 89249 - DNA, 20 bp, human
gaggcagagaagctaatgct

SEQ ID NO: 89250 - DNA, 20 bp, human
gcctataggaacagagtaca

SEQ ID NO: 89251 - DNA, 20 bp, human
gcagagaagctaatgctagg

SEQ ID NO: 89252 - DNA, 20 bp, human
gccacctgaaatctaaaatg

SEQ ID NO: 89253 - DNA, 20 bp, human
gctaggggcacaaaaatacg

SEQ ID NO: 89254 - DNA, 20 bp, human
gtccacccggaaacctcacc

SEQ ID NO: 89255 - DNA, 20 bp, human
gttatcctgctgcacaacac

SEQ ID NO: 89256 - DNA, 20 bp, human
gtgaggcggagactctcctg

SEQ ID NO: 89257 - DNA, 20 bp, human
gcagccccaaccagcccgtg

SEQ ID NO: 89258 - DNA, 20 bp, human
gagcgctcctgcgagaggga

SEQ ID NO: 89259 - DNA, 20 bp, human
ggtcgccgcacgggctggtt

SEQ ID NO: 89260 - DNA, 20 bp, human
gcggtcaaactcccagtccg

SEQ ID NO: 89261 - DNA, 20 bp, human
gccagcccgtgcggcgacga

SEQ ID NO: 89262 - DNA, 20 bp, human
gcacacgccgagccctgaac

SEQ ID NO: 89263 - DNA, 20 bp, human
gcgtgctgtgacagtagctg

SEQ ID NO: 89264 - DNA, 20 bp, human
gatctggcgaaatccccaag

SEQ ID NO: 89265 - DNA, 20 bp, human
ggcgtccctcgcacacccca

SEQ ID NO: 89266 - DNA, 20 bp, human
gagggagccccagcgtggag

SEQ ID NO: 89267 - DNA, 20 bp, human
ggaccctccggaggccagtg

SEQ ID NO: 89268 - DNA, 20 bp, human
gggactcccccaaggcgtag

SEQ ID NO: 89269 - DNA, 20 bp, human
gagccgcaggaacctcgagg

SEQ ID NO: 89270 - DNA, 20 bp, human
gcccacggcagcccgagagc

SEQ ID NO: 89271 - DNA, 20 bp, human
ggcccagcacgccggctctc

SEQ ID NO: 89272 - DNA, 20 bp, human
gggccagtggggtactgcaa

SEQ ID NO: 89273 - DNA, 20 bp, human
gcggcggactctacacaccg

SEQ ID NO: 89274 - DNA, 20 bp, human
gctcacgacccctggcactg

SEQ ID NO: 89275 - DNA, 20 bp, human
gctggaggcgcaagaggact

SEQ ID NO: 89276 - DNA, 20 bp, human
gccaggcaaaaccacaagaa

SEQ ID NO: 89277 - DNA, 20 bp, human
gcaaggctaacgtacctgct

SEQ ID NO: 89278 - DNA, 20 bp, human
gtgttcgtcacacagaaagc

SEQ ID NO: 89279 - DNA, 20 bp, human
gtcgatactctgttctatgt

SEQ ID NO: 89280 - DNA, 20 bp, human
ggataagctgtggatcttcc

SEQ ID NO: 89281 - DNA, 20 bp, human
gaactggtgctcatatgttt

SEQ ID NO: 89282 - DNA, 20 bp, human
gcataagacaccctttcttg

SEQ ID NO: 89283 - DNA, 20 bp, human
gtgtgcttctgttggataat

SEQ ID NO: 89284 - DNA, 20 bp, human
gacattagcaacaatgttct

SEQ ID NO: 89285 - DNA, 20 bp, human
gtgtgacagcagatattttg

SEQ ID NO: 89286 - DNA, 20 bp, human
ggagaggccagagggatttc

SEQ ID NO: 89287 - DNA, 20 bp, human
gcagccaccgacacccaagg

SEQ ID NO: 89288 - DNA, 20 bp, human
gccagggctgtaggtaagga

SEQ ID NO: 89289 - DNA, 20 bp, human
gggtgccagggctgtaggta

SEQ ID NO: 89290 - DNA, 20 bp, human
gtagtagtggctgcctgcgg

SEQ ID NO: 89291 - DNA, 20 bp, human
gcctggcacctataaaccga

SEQ ID NO: 89292 - DNA, 20 bp, human
ggaacgccgagggccttggg

SEQ ID NO: 89293 - DNA, 20 bp, human
gcggcggggctaaagggtgt

SEQ ID NO: 89294 - DNA, 20 bp, human
gccggcccatcccctcacct

SEQ ID NO: 89295 - DNA, 20 bp, human
ggcacctataaaccgagggt

SEQ ID NO: 89296 - DNA, 20 bp, human
gaccatgagcaagcggaacc

SEQ ID NO: 89297 - DNA, 20 bp, human
ggaaccaggtatcgtacgtg

SEQ ID NO: 89298 - DNA, 20 bp, human
ggcacccaccctccaagtag

SEQ ID NO: 89299 - DNA, 20 bp, human
gcagagctaccatgagcaag

SEQ ID NO: 89300 - DNA, 20 bp, human
gacctggttccgcttgctca

SEQ ID NO: 89301 - DNA, 20 bp, human
gggacccaccgtagagacta

SEQ ID NO: 89302 - DNA, 20 bp, human
gtcgagcgcgggtgaaaaga

SEQ ID NO: 89303 - DNA, 20 bp, human
gcggattcgcgacgatacag

SEQ ID NO: 89304 - DNA, 20 bp, human
gtatcgtcgcgaatccgtcg

SEQ ID NO: 89305 - DNA, 20 bp, human
gttgcctctacttggagggt

SEQ ID NO: 89306 - DNA, 20 bp, human
gccgcctcgcctagccatgg

SEQ ID NO: 89307 - DNA, 20 bp, human
ggctccgcctcgcctagcca

SEQ ID NO: 89308 - DNA, 20 bp, human
gtcctcagctctctccctcg

SEQ ID NO: 89309 - DNA, 20 bp, human
gggctgcagcagcacctccg

SEQ ID NO: 89310 - DNA, 20 bp, human
gccgcaccccgcaccagggc

SEQ ID NO: 89311 - DNA, 20 bp, human
ggctccaccatggctaggcg

SEQ ID NO: 89312 - DNA, 20 bp, human
gtgcagcagcacctccgggg

SEQ ID NO: 89313 - DNA, 20 bp, human
gggctgcggggcctgcggca

SEQ ID NO: 89314 - DNA, 20 bp, human
ggcggccctcacccgagcgg

SEQ ID NO: 89315 - DNA, 20 bp, human
gcctctcggagcggccccga

SEQ ID NO: 89316 - DNA, 20 bp, human
gcagggcgggacccgaggag

SEQ ID NO: 89317 - DNA, 20 bp, human
gcgccgcgcggggctctgtc

SEQ ID NO: 89318 - DNA, 20 bp, human
gcccgcccgactcaactgag

SEQ ID NO: 89319 - DNA, 20 bp, human
gagttggacacagttcccgg

SEQ ID NO: 89320 - DNA, 20 bp, human
gtggttcaagcgcaggggat

SEQ ID NO: 89321 - DNA, 20 bp, human
ggcccgactcaactgagggg

SEQ ID NO: 89322 - DNA, 20 bp, human
gggagcgagcctgaacacct

SEQ ID NO: 89323 - DNA, 20 bp, human
gcctcagaccagactagctg

SEQ ID NO: 89324 - DNA, 20 bp, human
gttacagcccggcagaagcg

SEQ ID NO: 89325 - DNA, 20 bp, human
gtgccagacagagccccgcg

SEQ ID NO: 89326 - DNA, 20 bp, human
ggtgctgcctgcccgctggg

SEQ ID NO: 89327 - DNA, 20 bp, human
gaaggtccccaagacccact

SEQ ID NO: 89328 - DNA, 20 bp, human
gcaagccattgtgagagcgg

SEQ ID NO: 89329 - DNA, 20 bp, human
gaggtagcagtaccacccag

SEQ ID NO: 89330 - DNA, 20 bp, human
gctgggctggtcccacgaag

SEQ ID NO: 89331 - DNA, 20 bp, human
gctggtcccacgaagcggag

SEQ ID NO: 89332 - DNA, 20 bp, human
ggcggaggggaagcccgtac

SEQ ID NO: 89333 - DNA, 20 bp, human
gtccctggctccgctctctg

SEQ ID NO: 89334 - DNA, 20 bp, human
gagagcggcggcgatttcga

SEQ ID NO: 89335 - DNA, 20 bp, human
gtgccctgcagctcccgtac

SEQ ID NO: 89336 - DNA, 20 bp, human
ggtctcggctacagacccag

SEQ ID NO: 89337 - DNA, 20 bp, human
gagagcctggcgagcgcaag

SEQ ID NO: 89338 - DNA, 20 bp, human
ggagcccagcgcggtgctat

SEQ ID NO: 89339 - DNA, 20 bp, human
gggtgctatcggacagagcc

SEQ ID NO: 89340 - DNA, 20 bp, human
ggccaggccctcttacctct

SEQ ID NO: 89341 - DNA, 20 bp, human
gaggtagactgcacagcaca

SEQ ID NO: 89342 - DNA, 20 bp, human
gtagctagtctgggaaatct

SEQ ID NO: 89343 - DNA, 20 bp, human
ggcgaggcgtgacactgtct

SEQ ID NO: 89344 - DNA, 20 bp, human
ggtcagcgaccagacgtccg

SEQ ID NO: 89345 - DNA, 20 bp, human
gtgtccatgcgtctgttgat

SEQ ID NO: 89346 - DNA, 20 bp, human
ggcccaggtgagccaggtag

SEQ ID NO: 89347 - DNA, 20 bp, human
gggaagccccgggaataact

SEQ ID NO: 89348 - DNA, 20 bp, human
gcctggccggcacccctacc

SEQ ID NO: 89349 - DNA, 20 bp, human
gtacgcggggaaatgagggc

SEQ ID NO: 89350 - DNA, 20 bp, human
gacccctgcaccaagtggta

SEQ ID NO: 89351 - DNA, 20 bp, human
gactctacgcggggaaatga

SEQ ID NO: 89352 - DNA, 20 bp, human
gaccaagtggtagggaatcg

SEQ ID NO: 89353 - DNA, 20 bp, human
ggggccggctggacgcctcg

SEQ ID NO: 89354 - DNA, 20 bp, human
ggctgggccaagctccccct

SEQ ID NO: 89355 - DNA, 20 bp, human
gttatataacagacagacca

SEQ ID NO: 89356 - DNA, 20 bp, human
gaatccacagacaagaagaa

SEQ ID NO: 89357 - DNA, 20 bp, human
gcggcacccggaacaacgaa

SEQ ID NO: 89358 - DNA, 20 bp, human
ggaccctggaagacaatcta

SEQ ID NO: 89359 - DNA, 20 bp, human
ggatctttggtggagtccca

SEQ ID NO: 89360 - DNA, 20 bp, human
gttggtggagtcccagggtg

SEQ ID NO: 89361 - DNA, 20 bp, human
gggatcccattccccaccct

SEQ ID NO: 89362 - DNA, 20 bp, human
gactccaccaaagatctgaa

SEQ ID NO: 89363 - DNA, 20 bp, human
gatgggatcccaaaggaagt

SEQ ID NO: 89364 - DNA, 20 bp, human
gggctgcacttccaagccta

SEQ ID NO: 89365 - DNA, 20 bp, human
ggagtcccagggtggggaat

SEQ ID NO: 89366 - DNA, 20 bp, human
ggtatgagtcaggtgagtgc

SEQ ID NO: 89367 - DNA, 20 bp, human
gctcacctgactcatactgt

SEQ ID NO: 89368 - DNA, 20 bp, human
gagcccagaaggtaagtgta

SEQ ID NO: 89369 - DNA, 20 bp, human
gattagtgctagtactggta

SEQ ID NO: 89370 - DNA, 20 bp, human
ggtgctaagaatcagtactt

SEQ ID NO: 89371 - DNA, 20 bp, human
gagctcctacagtatgagtc

SEQ ID NO: 89372 - DNA, 20 bp, human
gagtgcaggtactgttagat

SEQ ID NO: 89373 - DNA, 20 bp, human
ggttattattagtagtactt

SEQ ID NO: 89374 - DNA, 20 bp, human
gaggcttcaggcagcccaga

SEQ ID NO: 89375 - DNA, 20 bp, human
gctggtattagtgctagtac

SEQ ID NO: 89376 - DNA, 20 bp, human
ggcagaggccgtgaagccag

SEQ ID NO: 89377 - DNA, 20 bp, human
gcggcgagacgcgcagagaa

SEQ ID NO: 89378 - DNA, 20 bp, human
gcgctgacactaccctcccg

SEQ ID NO: 89379 - DNA, 20 bp, human
ggggcccctcggacccggag

SEQ ID NO: 89380 - DNA, 20 bp, human
ggccggggctagggggtcga

SEQ ID NO: 89381 - DNA, 20 bp, human
ggccaggggcccctcggacc

SEQ ID NO: 89382 - DNA, 20 bp, human
gcggccgaagagctggacgc

SEQ ID NO: 89383 - DNA, 20 bp, human
gagcgcgtccggctccccct

SEQ ID NO: 89384 - DNA, 20 bp, human
gtccagacagcccgggtctg

SEQ ID NO: 89385 - DNA, 20 bp, human
gtgcctcacagtggaaagtt

SEQ ID NO: 89386 - DNA, 20 bp, human
gcctagggacggagggccag

SEQ ID NO: 89387 - DNA, 20 bp, human
gttgcggcaggcagagacaa

SEQ ID NO: 89388 - DNA, 20 bp, human
gggacagacctagggacgga

SEQ ID NO: 89389 - DNA, 20 bp, human
gggacggacggacagaccta

SEQ ID NO: 89390 - DNA, 20 bp, human
gtctgtctgctgagtaagga

SEQ ID NO: 89391 - DNA, 20 bp, human
ggatccaagaggccccgcgc

SEQ ID NO: 89392 - DNA, 20 bp, human
ggaccgcagcttccattcat

SEQ ID NO: 89393 - DNA, 20 bp, human
gtagagaactgtgatttctt

SEQ ID NO: 89394 - DNA, 20 bp, human
gggctccagccacgggagaa

SEQ ID NO: 89395 - DNA, 20 bp, human
gttaggcttgactttatctc

SEQ ID NO: 89396 - DNA, 20 bp, human
gttgcggcaggcagagacaa

SEQ ID NO: 89397 - DNA, 20 bp, human
gggacagacctagggacgga

SEQ ID NO: 89398 - DNA, 20 bp, human
gcctagggacggagggccag

SEQ ID NO: 89399 - DNA, 20 bp, human
gcggagagcgcgcctgagga

SEQ ID NO: 89400 - DNA, 20 bp, human
gggacggacggacagaccta

SEQ ID NO: 89401 - DNA, 20 bp, human
gtctgagattaaagagatga

SEQ ID NO: 89402 - DNA, 20 bp, human
gtaaggccgagagccttcgc

SEQ ID NO: 89403 - DNA, 20 bp, human
gtctgtctgctgagtaagga

SEQ ID NO: 89404 - DNA, 20 bp, human
gccactgctgcaaaccaccg

SEQ ID NO: 89405 - DNA, 20 bp, human
gaagctcccagaaagcgcct

SEQ ID NO: 89406 - DNA, 20 bp, human
gacctgcgccaggagagata

SEQ ID NO: 89407 - DNA, 20 bp, human
ggcgtggggagcaaccggag

SEQ ID NO: 89408 - DNA, 20 bp, human
gatccgagcccgcctctctc

SEQ ID NO: 89409 - DNA, 20 bp, human
gcaggacgccagagacaatc

SEQ ID NO: 89410 - DNA, 20 bp, human
gaggcgggctcggataaagt

SEQ ID NO: 89411 - DNA, 20 bp, human
gttctgcgcccgagagaggc

SEQ ID NO: 89412 - DNA, 20 bp, human
gtaacttgcggcttagagga

SEQ ID NO: 89413 - DNA, 20 bp, human
gcgggcgcagaaataacttg

SEQ ID NO: 89414 - DNA, 20 bp, human
gcaagtctccagattgtctc

SEQ ID NO: 89415 - DNA, 20 bp, human
gagcgcgcgtggggagcaac

SEQ ID NO: 89416 - DNA, 20 bp, human
gagagtgaaagagaccggag

SEQ ID NO: 89417 - DNA, 20 bp, human
gggacagcggttcccgagga

SEQ ID NO: 89418 - DNA, 20 bp, human
ggtgaaagagaccggagggg

SEQ ID NO: 89419 - DNA, 20 bp, human
gcagcgccgggaccaggaga

SEQ ID NO: 89420 - DNA, 20 bp, human
gctggccctgggcgcctagg

SEQ ID NO: 89421 - DNA, 20 bp, human
gcggttcccgaggaaggttt

SEQ ID NO: 89422 - DNA, 20 bp, human
gcccacagggagagaagcgc

SEQ ID NO: 89423 - DNA, 20 bp, human
gtgggccctgggtaagcgtc

SEQ ID NO: 89424 - DNA, 20 bp, human
ggcggccgcctaggcgccca

SEQ ID NO: 89425 - DNA, 20 bp, human
gcgcctcgggaaattgatgt

SEQ ID NO: 89426 - DNA, 20 bp, human
gggtggctgtggatccggta

SEQ ID NO: 89427 - DNA, 20 bp, human
ggcggcggcaactcccgtac

SEQ ID NO: 89428 - DNA, 20 bp, human
ggcccaggtggctgtggatc

SEQ ID NO: 89429 - DNA, 20 bp, human
ggcagcggggagttggaccg

SEQ ID NO: 89430 - DNA, 20 bp, human
gcggacgctcctctcagtct

SEQ ID NO: 89431 - DNA, 20 bp, human
gtgcgagcggatgcgctggg

SEQ ID NO: 89432 - DNA, 20 bp, human
gaagcccggcgactgactcc

SEQ ID NO: 89433 - DNA, 20 bp, human
gtcttggagtctcttcgccc

SEQ ID NO: 89434 - DNA, 20 bp, human
ggtaccgccagcacctggag

SEQ ID NO: 89435 - DNA, 20 bp, human
ggagaggcaaaccaggccgg

SEQ ID NO: 89436 - DNA, 20 bp, human
ggctatggcgaacgttccgt

SEQ ID NO: 89437 - DNA, 20 bp, human
ggaggaaagccaggcagtag

SEQ ID NO: 89438 - DNA, 20 bp, human
gcaggcagtagaggccgcta

SEQ ID NO: 89439 - DNA, 20 bp, human
ggcctgaggacgaggatgag

SEQ ID NO: 89440 - DNA, 20 bp, human
ggtgtcgcaaagcagaagga

SEQ ID NO: 89441 - DNA, 20 bp, human
ggcacctggtgaaatgcctg

SEQ ID NO: 89442 - DNA, 20 bp, human
gtctcgcagacctctgccca

SEQ ID NO: 89443 - DNA, 20 bp, human
gatcgacacggaggagctgt

SEQ ID NO: 89444 - DNA, 20 bp, human
ggtcccgactgcaaacattg

SEQ ID NO: 89445 - DNA, 20 bp, human
ggcgctactggaagaggtca

SEQ ID NO: 89446 - DNA, 20 bp, human
gctcactcaggacaacgcta

SEQ ID NO: 89447 - DNA, 20 bp, human
gatctctccgccagagtcag

SEQ ID NO: 89448 - DNA, 20 bp, human
ggttcttcccctgactctgg

SEQ ID NO: 89449 - DNA, 20 bp, human
gccagtctggcgtcatgagg

SEQ ID NO: 89450 - DNA, 20 bp, human
gaaggtcccagccccaagaa

SEQ ID NO: 89451 - DNA, 20 bp, human
ggtacctgaactcagaatga

SEQ ID NO: 89452 - DNA, 20 bp, human
gcatgaggaggccagcacat

SEQ ID NO: 89453 - DNA, 20 bp, human
ggagggaagaggagccagtc

SEQ ID NO: 89454 - DNA, 20 bp, human
gaccaaagcgggatcgggta

SEQ ID NO: 89455 - DNA, 20 bp, human
gtcagttcttcccctgactc

SEQ ID NO: 89456 - DNA, 20 bp, human
gcagcagagctgtcagcggg

SEQ ID NO: 89457 - DNA, 20 bp, human
gctctccgggccagctacca

SEQ ID NO: 89458 - DNA, 20 bp, human
gaaatccaggcggggctcca

SEQ ID NO: 89459 - DNA, 20 bp, human
ggacgagcgcacagcagtcg

SEQ ID NO: 89460 - DNA, 20 bp, human
gtccggcgtgacgggagcat

SEQ ID NO: 89461 - DNA, 20 bp, human
gcccagcaaactccaggtag

SEQ ID NO: 89462 - DNA, 20 bp, human
gcggcaaggcagccttcccg

SEQ ID NO: 89463 - DNA, 20 bp, human
gcagccttcccggggtgcgg

SEQ ID NO: 89464 - DNA, 20 bp, human
gccagcagcaaatccaggcg

SEQ ID NO: 89465 - DNA, 20 bp, human
gagcgcccagcagcaaatcc

SEQ ID NO: 89466 - DNA, 20 bp, human
ggagcccagcacctagactg

SEQ ID NO: 89467 - DNA, 20 bp, human
gcgggcaaaggatacagtcc

SEQ ID NO: 89468 - DNA, 20 bp, human
ggggggcactctgacagggt

SEQ ID NO: 89469 - DNA, 20 bp, human
ggccggcgccctccacggga

SEQ ID NO: 89470 - DNA, 20 bp, human
ggtgggcagagggacctcgg

SEQ ID NO: 89471 - DNA, 20 bp, human
ggctagctcgaagttgaggg

SEQ ID NO: 89472 - DNA, 20 bp, human
gggcgcgacgccccgagtgg

SEQ ID NO: 89473 - DNA, 20 bp, human
gtcgcgtggcagtccgagag

SEQ ID NO: 89474 - DNA, 20 bp, human
ggaagctccgaactaacccc

SEQ ID NO: 89475 - DNA, 20 bp, human
gggcgccggcgccccctgtc

SEQ ID NO: 89476 - DNA, 20 bp, human
gcgccgggcaatagcagatg

SEQ ID NO: 89477 - DNA, 20 bp, human
gtcgctaccctggcagccac

SEQ ID NO: 89478 - DNA, 20 bp, human
ggcccccagaacctccctca

SEQ ID NO: 89479 - DNA, 20 bp, human
ggtagcggcgatggcagctg

SEQ ID NO: 89480 - DNA, 20 bp, human
ggcggcactggtgcctgtag

SEQ ID NO: 89481 - DNA, 20 bp, human
ggcctgagagacggagtgta

SEQ ID NO: 89482 - DNA, 20 bp, human
gccctcggccctcgggagag

SEQ ID NO: 89483 - DNA, 20 bp, human
gagagacggagtgtagggag

SEQ ID NO: 89484 - DNA, 20 bp, human
gaggataacagggtgatggg

SEQ ID NO: 89485 - DNA, 20 bp, human
ggacggcgcgtccttgacaa

SEQ ID NO: 89486 - DNA, 20 bp, human
gttgagaaggaccttccctg

SEQ ID NO: 89487 - DNA, 20 bp, human
ggtgtcagctcaggatgaag

SEQ ID NO: 89488 - DNA, 20 bp, human
gcaagttcgagcccgaacct

SEQ ID NO: 89489 - DNA, 20 bp, human
gaaatgctcctggcgcctca

SEQ ID NO: 89490 - DNA, 20 bp, human
gaattcccagcgtgacccgg

SEQ ID NO: 89491 - DNA, 20 bp, human
gtgcagctttggccgaggtt

SEQ ID NO: 89492 - DNA, 20 bp, human
gcagctcaggatgaagaggc

SEQ ID NO: 89493 - DNA, 20 bp, human
gtaatgcccatcggggtgaa

SEQ ID NO: 89494 - DNA, 20 bp, human
gcggaggcagcccgggcaga

SEQ ID NO: 89495 - DNA, 20 bp, human
gtttggggcggtcaaggcag

SEQ ID NO: 89496 - DNA, 20 bp, human
gacgcgatgctcacacagct

SEQ ID NO: 89497 - DNA, 20 bp, human
gccgcccgcggcaaacatgg

SEQ ID NO: 89498 - DNA, 20 bp, human
gccgcgggcggggaacaggg

SEQ ID NO: 89499 - DNA, 20 bp, human
gtccccgcccgcggcaaaca

SEQ ID NO: 89500 - DNA, 20 bp, human
gacacccgagcgctgaggta

SEQ ID NO: 89501 - DNA, 20 bp, human
ggagcatcgcgtctgaggga

SEQ ID NO: 89502 - DNA, 20 bp, human
ggcaaacatggcggtggact

SEQ ID NO: 89503 - DNA, 20 bp, human
gatggcggtggactcggcga

SEQ ID NO: 89504 - DNA, 20 bp, human
gacgtaaactgctcagactc

SEQ ID NO: 89505 - DNA, 20 bp, human
gcgagcgctgaggtaaggct

SEQ ID NO: 89506 - DNA, 20 bp, human
gggcgccgggagcccgttca

SEQ ID NO: 89507 - DNA, 20 bp, human
gcggcggcgagtactcgggg

SEQ ID NO: 89508 - DNA, 20 bp, human
gggttcgagtccctacaagt

SEQ ID NO: 89509 - DNA, 20 bp, human
ggaccgcgcccccacgacag

SEQ ID NO: 89510 - DNA, 20 bp, human
gcggcgctggcgcactcccg

SEQ ID NO: 89511 - DNA, 20 bp, human
ggcactcccgcggccctgaa

SEQ ID NO: 89512 - DNA, 20 bp, human
ggcgcccgcgcttccggagg

SEQ ID NO: 89513 - DNA, 20 bp, human
gcaggcggcggcgagtactc

SEQ ID NO: 89514 - DNA, 20 bp, human
gggaagaagtcgtcagggcc

SEQ ID NO: 89515 - DNA, 20 bp, human
gcgcgcgcccgcgcttccgg

SEQ ID NO: 89516 - DNA, 20 bp, human
ggctcggggcatctgcccgc

SEQ ID NO: 89517 - DNA, 20 bp, human
gacgcaaggctgcgcgacga

SEQ ID NO: 89518 - DNA, 20 bp, human
gaggtgggtctggcacgaag

SEQ ID NO: 89519 - DNA, 20 bp, human
gaggagtcctaggctctggg

SEQ ID NO: 89520 - DNA, 20 bp, human
ggtacctgcggccaattcgg

SEQ ID NO: 89521 - DNA, 20 bp, human
gacgaggacgcggactgcga

SEQ ID NO: 89522 - DNA, 20 bp, human
gaggcacccccaagctgacg

SEQ ID NO: 89523 - DNA, 20 bp, human
gacgaaggggcaggagtcct

SEQ ID NO: 89524 - DNA, 20 bp, human
gctcggccccgtcagcttgg

SEQ ID NO: 89525 - DNA, 20 bp, human
gggctctgggtggaagttgg

SEQ ID NO: 89526 - DNA, 20 bp, human
ggcggccgcggcgggaagaa

SEQ ID NO: 89527 - DNA, 20 bp, human
gcgccgaggcagcggatcta

SEQ ID NO: 89528 - DNA, 20 bp, human
gcgcagctaccggggatcgg

SEQ ID NO: 89529 - DNA, 20 bp, human
gagaggaaaaaatagacgga

SEQ ID NO: 89530 - DNA, 20 bp, human
gtttagagtgtgaggatgaa

SEQ ID NO: 89531 - DNA, 20 bp, human
gcactctaaaataggtcaag

SEQ ID NO: 89532 - DNA, 20 bp, human
gctttcgggaggcggcgctc

SEQ ID NO: 89533 - DNA, 20 bp, human
gcggcgcctccgggcagcga

SEQ ID NO: 89534 - DNA, 20 bp, human
ggccgccttcacctttcggg

SEQ ID NO: 89535 - DNA, 20 bp, human
ggcctccgggcagcgaaggc

SEQ ID NO: 89536 - DNA, 20 bp, human
ggacgccgggacttaccgag

SEQ ID NO: 89537 - DNA, 20 bp, human
ggggagggcgacttcgagag

SEQ ID NO: 89538 - DNA, 20 bp, human
gtgggagcggccctaatgga

SEQ ID NO: 89539 - DNA, 20 bp, human
gggagccgctcggtaagtcc

SEQ ID NO: 89540 - DNA, 20 bp, human
gtccgagcggggcacctgag

SEQ ID NO: 89541 - DNA, 20 bp, human
ggcggcgcgaggcggcatga

SEQ ID NO: 89542 - DNA, 20 bp, human
gagcggccctaatggacggt

SEQ ID NO: 89543 - DNA, 20 bp, human
gccggttccagccaccctgg

SEQ ID NO: 89544 - DNA, 20 bp, human
gggtgaggtccgcgagatct

SEQ ID NO: 89545 - DNA, 20 bp, human
gccgcgagatctgggcgcga

SEQ ID NO: 89546 - DNA, 20 bp, human
ggcgctcaagctgccgggta

SEQ ID NO: 89547 - DNA, 20 bp, human
gctggacagcacggtcgcca

SEQ ID NO: 89548 - DNA, 20 bp, human
gcaggtccagccaagacaga

SEQ ID NO: 89549 - DNA, 20 bp, human
gaagcatgcgactccttacc

SEQ ID NO: 89550 - DNA, 20 bp, human
gtgccaccagagggcgagag

SEQ ID NO: 89551 - DNA, 20 bp, human
gttgagcgccctggacagca

SEQ ID NO: 89552 - DNA, 20 bp, human
gcgcaccggggcctcagcca

SEQ ID NO: 89553 - DNA, 20 bp, human
gccagggcgctcaagctgcc

SEQ ID NO: 89554 - DNA, 20 bp, human
gcttggctggacctgggcgg

SEQ ID NO: 89555 - DNA, 20 bp, human
gccggtgttggaataagggg

SEQ ID NO: 89556 - DNA, 20 bp, human
gctaaggccacgggatcctg

SEQ ID NO: 89557 - DNA, 20 bp, human
gcgatggcgcctggaggtag

SEQ ID NO: 89558 - DNA, 20 bp, human
gagacaaggagtacgctcca

SEQ ID NO: 89559 - DNA, 20 bp, human
gggccgcgcactgcttccta

SEQ ID NO: 89560 - DNA, 20 bp, human
gccgtcggaaccagtcaggg

SEQ ID NO: 89561 - DNA, 20 bp, human
gggcccgtcggaaccagtca

SEQ ID NO: 89562 - DNA, 20 bp, human
gtcctgacaggataagatgg

SEQ ID NO: 89563 - DNA, 20 bp, human
gctgtcgccacaggatcccg

SEQ ID NO: 89564 - DNA, 20 bp, human
gcttatcctgtcaggagtgt

SEQ ID NO: 89565 - DNA, 20 bp, human
gagccgccgacgcctcccca

SEQ ID NO: 89566 - DNA, 20 bp, human
gtgcgatggtacgagagtgt

SEQ ID NO: 89567 - DNA, 20 bp, human
gtgtacggacacgcagacac

SEQ ID NO: 89568 - DNA, 20 bp, human
gagggaggcagcgagactcg

SEQ ID NO: 89569 - DNA, 20 bp, human
gcaacacccactcaaatgta

SEQ ID NO: 89570 - DNA, 20 bp, human
gcacggtaatacctacgggc

SEQ ID NO: 89571 - DNA, 20 bp, human
gggtggcgacgaccgcagta

SEQ ID NO: 89572 - DNA, 20 bp, human
gcgtacacggtaatacctac

SEQ ID NO: 89573 - DNA, 20 bp, human
ggggaggagggtccctactg

SEQ ID NO: 89574 - DNA, 20 bp, human
gggctcccgcacccgcaatg

SEQ ID NO: 89575 - DNA, 20 bp, human
gcgaagcggccggcaggtag

SEQ ID NO: 89576 - DNA, 20 bp, human
gcggcggccgcccccggcat

SEQ ID NO: 89577 - DNA, 20 bp, human
gaagggcaaaggccgaggta

SEQ ID NO: 89578 - DNA, 20 bp, human
gggtaaggcggtcggcacct

SEQ ID NO: 89579 - DNA, 20 bp, human
gcggcgggtcaggccccctg

SEQ ID NO: 89580 - DNA, 20 bp, human
gccccgggccaagaaggcgg

SEQ ID NO: 89581 - DNA, 20 bp, human
gaagcggcgcaagaagaagg

SEQ ID NO: 89582 - DNA, 20 bp, human
gggcaaaggccgaggtaagg

SEQ ID NO: 89583 - DNA, 20 bp, human
gctggaaagcgaagaggcca

SEQ ID NO: 89584 - DNA, 20 bp, human
gcggagaaaagtttgggcgg

SEQ ID NO: 89585 - DNA, 20 bp, human
gacaaggccaagagggccaa

SEQ ID NO: 89586 - DNA, 20 bp, human
gcgcggcgaaagctaaaggc

SEQ ID NO: 89587 - DNA, 20 bp, human
gctaaaggccggcgcacgct

SEQ ID NO: 89588 - DNA, 20 bp, human
gtctaggaaaagcgggagtg

SEQ ID NO: 89589 - DNA, 20 bp, human
gaaagcgcggcgaaagctaa

SEQ ID NO: 89590 - DNA, 20 bp, human
ggacgagggtgggttagcgg

SEQ ID NO: 89591 - DNA, 20 bp, human
gcggtggtggtccctaagcc

SEQ ID NO: 89592 - DNA, 20 bp, human
gagttcaggttgtttcgagt

SEQ ID NO: 89593 - DNA, 20 bp, human
gggagtggcggccccagcct

SEQ ID NO: 89594 - DNA, 20 bp, human
gaggagcaaggacttcaagc

SEQ ID NO: 89595 - DNA, 20 bp, human
gaaggccggcgcacgctggg

SEQ ID NO: 89596 - DNA, 20 bp, human
gcggctctcgggtccgggag

SEQ ID NO: 89597 - DNA, 20 bp, human
gttgttgggccccagaagaa

SEQ ID NO: 89598 - DNA, 20 bp, human
gtctggggcccaacaaataa

SEQ ID NO: 89599 - DNA, 20 bp, human
ggggccggaaccgaggacag

SEQ ID NO: 89600 - DNA, 20 bp, human
gcttccagaaaggacggcga

SEQ ID NO: 89601 - DNA, 20 bp, human
gaggaagcagcagccccggg

SEQ ID NO: 89602 - DNA, 20 bp, human
gcgcgttccgagggtctcgg

SEQ ID NO: 89603 - DNA, 20 bp, human
ggggagctggagaataaaag

SEQ ID NO: 89604 - DNA, 20 bp, human
gtctcggcggagcttacctg

SEQ ID NO: 89605 - DNA, 20 bp, human
gggcaaagcatcttccagaa

SEQ ID NO: 89606 - DNA, 20 bp, human
gtctgctggctcagagatga

SEQ ID NO: 89607 - DNA, 20 bp, human
gtgatggaatgaggtgagtc

SEQ ID NO: 89608 - DNA, 20 bp, human
gctacctccatcctcttcat

SEQ ID NO: 89609 - DNA, 20 bp, human
gcctggaagagtgcacaatg

SEQ ID NO: 89610 - DNA, 20 bp, human
gagcccctcatggtcaatgt

SEQ ID NO: 89611 - DNA, 20 bp, human
gaaaatgcccaggatctcat

SEQ ID NO: 89612 - DNA, 20 bp, human
gaccatgaggggcttccatc

SEQ ID NO: 89613 - DNA, 20 bp, human
ggggatgcctatgagatcct

SEQ ID NO: 89614 - DNA, 20 bp, human
gtccgagctgtccccaacag

SEQ ID NO: 89615 - DNA, 20 bp, human
gccagctttgatctgctggg

SEQ ID NO: 89616 - DNA, 20 bp, human
gcgtcccgccgtccgcccac

SEQ ID NO: 89617 - DNA, 20 bp, human
gagaggaccaccccggcaag

SEQ ID NO: 89618 - DNA, 20 bp, human
gggaaggcggagggacctcg

SEQ ID NO: 89619 - DNA, 20 bp, human
gaaagggaagaggaccaccc

SEQ ID NO: 89620 - DNA, 20 bp, human
gcggcaagcggggagaaaac

SEQ ID NO: 89621 - DNA, 20 bp, human
gcaagcggggagaaaaccgg

SEQ ID NO: 89622 - DNA, 20 bp, human
ggtgtgagacgagcaccccg

SEQ ID NO: 89623 - DNA, 20 bp, human
gggcccggcccagctccggt

SEQ ID NO: 89624 - DNA, 20 bp, human
ggcgcggtagaggtcgcgag

SEQ ID NO: 89625 - DNA, 20 bp, human
gcgcggctggtgaggcgggt

SEQ ID NO: 89626 - DNA, 20 bp, human
gggtggcggctgcggcagta

SEQ ID NO: 89627 - DNA, 20 bp, human
gctgcggcagtagggacagc

SEQ ID NO: 89628 - DNA, 20 bp, human
gtggcctcccagctcacgca

SEQ ID NO: 89629 - DNA, 20 bp, human
gcgcccctgcgtgagctggg

SEQ ID NO: 89630 - DNA, 20 bp, human
gacccgcccctgcgtgagct

SEQ ID NO: 89631 - DNA, 20 bp, human
gtttcgtctctttccgccag

SEQ ID NO: 89632 - DNA, 20 bp, human
gaggggagtggtggcggctg

SEQ ID NO: 89633 - DNA, 20 bp, human
ggggtcccggtagcgcgagg

SEQ ID NO: 89634 - DNA, 20 bp, human
gggcgggtcccggtagcgcg

SEQ ID NO: 89635 - DNA, 20 bp, human
gtcctcctggagtagataag

SEQ ID NO: 89636 - DNA, 20 bp, human
gggtggggccgggaataaaa

SEQ ID NO: 89637 - DNA, 20 bp, human
ggcacgcgggcgccaggtgt

SEQ ID NO: 89638 - DNA, 20 bp, human
gagaaaaagcaagatgccgg

SEQ ID NO: 89639 - DNA, 20 bp, human
gggcttgcggctccactacc

SEQ ID NO: 89640 - DNA, 20 bp, human
ggcttctccggcaaggaagg

SEQ ID NO: 89641 - DNA, 20 bp, human
gcagtctgaaggagcaaggt

SEQ ID NO: 89642 - DNA, 20 bp, human
gaagggacgaggattcagtg

SEQ ID NO: 89643 - DNA, 20 bp, human
ggctactgcggtgaccacgg

SEQ ID NO: 89644 - DNA, 20 bp, human
gtgcgtttgctggcgatcgg

SEQ ID NO: 89645 - DNA, 20 bp, human
gaggataacgcggagtgtcg

SEQ ID NO: 89646 - DNA, 20 bp, human
gccccgaatccggggccgga

SEQ ID NO: 89647 - DNA, 20 bp, human
ggcctctccgagggatggag

SEQ ID NO: 89648 - DNA, 20 bp, human
gcccccagtgagtatagagg

SEQ ID NO: 89649 - DNA, 20 bp, human
gcagcccccagtgagtatag

SEQ ID NO: 89650 - DNA, 20 bp, human
gcggcggcggccaaacccgc

SEQ ID NO: 89651 - DNA, 20 bp, human
gcggcggccaaacccgcggg

SEQ ID NO: 89652 - DNA, 20 bp, human
gccgcaggcctcgcccctcg

SEQ ID NO: 89653 - DNA, 20 bp, human
gtccacggcaaagccgtgaa

SEQ ID NO: 89654 - DNA, 20 bp, human
gggcatcagctgtccgttca

SEQ ID NO: 89655 - DNA, 20 bp, human
ggcctggcctctccgaggga

SEQ ID NO: 89656 - DNA, 20 bp, human
gacttggtcgagccttgtat

SEQ ID NO: 89657 - DNA, 20 bp, human
gggtcagcgtgaaggaacag

SEQ ID NO: 89658 - DNA, 20 bp, human
gagcaggctctgatctagag

SEQ ID NO: 89659 - DNA, 20 bp, human
ggcatctgtgcacccccaca

SEQ ID NO: 89660 - DNA, 20 bp, human
gtatgccagtggggcaagat

SEQ ID NO: 89661 - DNA, 20 bp, human
gaattcttgtcagcacacag

SEQ ID NO: 89662 - DNA, 20 bp, human
gtcacagggctcggcaggta

SEQ ID NO: 89663 - DNA, 20 bp, human
ggaggtgcccctgcacagtg

SEQ ID NO: 89664 - DNA, 20 bp, human
gaggctctgatctagagggg

SEQ ID NO: 89665 - DNA, 20 bp, human
gcacagaggccagcctgcgc

SEQ ID NO: 89666 - DNA, 20 bp, human
gcaggccggcgaagcctctg

SEQ ID NO: 89667 - DNA, 20 bp, human
gtccggctcccggcctgagg

SEQ ID NO: 89668 - DNA, 20 bp, human
gtccccgcaggcttctgggt

SEQ ID NO: 89669 - DNA, 20 bp, human
gctcttcgcttccaagatcc

SEQ ID NO: 89670 - DNA, 20 bp, human
ggctcccccagcccggatct

SEQ ID NO: 89671 - DNA, 20 bp, human
gcttggcagagggagtaacc

SEQ ID NO: 89672 - DNA, 20 bp, human
ggggcggaggaggccaagct

SEQ ID NO: 89673 - DNA, 20 bp, human
gtcagagagccccccagagg

SEQ ID NO: 89674 - DNA, 20 bp, human
gaggaagtaggtcctcgtca

SEQ ID NO: 89675 - DNA, 20 bp, human
gttggcagccacctcaggcc

SEQ ID NO: 89676 - DNA, 20 bp, human
gtgggagtcgatccctggag

SEQ ID NO: 89677 - DNA, 20 bp, human
gtcccgcacagggcaaccaa

SEQ ID NO: 89678 - DNA, 20 bp, human
gcagcgcccgatcccctcca

SEQ ID NO: 89679 - DNA, 20 bp, human
gctcccagggcaggtgccgc

SEQ ID NO: 89680 - DNA, 20 bp, human
gtcccaagtcgccaaccagg

SEQ ID NO: 89681 - DNA, 20 bp, human
gggatcacgtgccacctggt

SEQ ID NO: 89682 - DNA, 20 bp, human
gcagcaggctaggctgcgcg

SEQ ID NO: 89683 - DNA, 20 bp, human
gcaggtggcacgtgatccat

SEQ ID NO: 89684 - DNA, 20 bp, human
gctggcggtggctccacggt

SEQ ID NO: 89685 - DNA, 20 bp, human
gggagtctggggaaatcctc

SEQ ID NO: 89686 - DNA, 20 bp, human
gtatgcagcaacactgccct

SEQ ID NO: 89687 - DNA, 20 bp, human
gggcatcagaaatggcgtcc

SEQ ID NO: 89688 - DNA, 20 bp, human
gatacaagggcatgatatcc

SEQ ID NO: 89689 - DNA, 20 bp, human
gccaaaacagtgattggtag

SEQ ID NO: 89690 - DNA, 20 bp, human
ggatatccaggcatcagaaa

SEQ ID NO: 89691 - DNA, 20 bp, human
ggcttaaattaatcatacaa

SEQ ID NO: 89692 - DNA, 20 bp, human
gagtgttgctgcatattgca

SEQ ID NO: 89693 - DNA, 20 bp, human
gacactgtattgtttagcag

SEQ ID NO: 89694 - DNA, 20 bp, human
gcaaaattatcaatggagac

SEQ ID NO: 89695 - DNA, 20 bp, human
gcagcaacactgccctgggc

SEQ ID NO: 89696 - DNA, 20 bp, human
gctgctaggtttagcttcag

SEQ ID NO: 89697 - DNA, 20 bp, human
gggcaccagggctccaagac

SEQ ID NO: 89698 - DNA, 20 bp, human
gctaaacctagcagtctgaa

SEQ ID NO: 89699 - DNA, 20 bp, human
gcaaagctgctgcggcacca

SEQ ID NO: 89700 - DNA, 20 bp, human
gactggccgttcagactgct

SEQ ID NO: 89701 - DNA, 20 bp, human
gcctcacagcaggggctcta

SEQ ID NO: 89702 - DNA, 20 bp, human
gcagtctgaacggccagtct

SEQ ID NO: 89703 - DNA, 20 bp, human
gaggcccagaagggctctaa

SEQ ID NO: 89704 - DNA, 20 bp, human
ggggccagaggagaacgaca

SEQ ID NO: 89705 - DNA, 20 bp, human
ggttgccaaagagacacaac

SEQ ID NO: 89706 - DNA, 20 bp, human
gcggcttgtctctctgtcag

SEQ ID NO: 89707 - DNA, 20 bp, human
gggttctaggagattccggg

SEQ ID NO: 89708 - DNA, 20 bp, human
gcgcagagctctaggccact

SEQ ID NO: 89709 - DNA, 20 bp, human
gctcggttctaggagattcc

SEQ ID NO: 89710 - DNA, 20 bp, human
gcggtggcggccgagactgg

SEQ ID NO: 89711 - DNA, 20 bp, human
gagataagctcgacacaagt

SEQ ID NO: 89712 - DNA, 20 bp, human
ggaaactaccagccctagag

SEQ ID NO: 89713 - DNA, 20 bp, human
gtaggccacttggcaggagg

SEQ ID NO: 89714 - DNA, 20 bp, human
ggcaggaggcgggggcacca

SEQ ID NO: 89715 - DNA, 20 bp, human
gctggagcgcggggtttcat

SEQ ID NO: 89716 - DNA, 20 bp, human
gagctgggattgtattccgg

SEQ ID NO: 89717 - DNA, 20 bp, human
gtcggcgatggctctcccgc

SEQ ID NO: 89718 - DNA, 20 bp, human
gtctcccgcaggcgcagaaa

SEQ ID NO: 89719 - DNA, 20 bp, human
gcatgtccgcgggtgatctg

SEQ ID NO: 89720 - DNA, 20 bp, human
gtgatgggcaggagcttacc

SEQ ID NO: 89721 - DNA, 20 bp, human
gaggcgcagaaacggctgct

SEQ ID NO: 89722 - DNA, 20 bp, human
gcacggaagctccgcgacag

SEQ ID NO: 89723 - DNA, 20 bp, human
gggaagctccgcgacagggg

SEQ ID NO: 89724 - DNA, 20 bp, human
gaagcgcccctcccccgaca

SEQ ID NO: 89725 - DNA, 20 bp, human
gtgaatgacggaagtgacgg

SEQ ID NO: 89726 - DNA, 20 bp, human
gcccggccctaggtgagaaa

SEQ ID NO: 89727 - DNA, 20 bp, human
ggagctgagggccaagcaat

SEQ ID NO: 89728 - DNA, 20 bp, human
gggaaaggaggtggaagtag

SEQ ID NO: 89729 - DNA, 20 bp, human
gggacggagagccaaatggt

SEQ ID NO: 89730 - DNA, 20 bp, human
gagctccacgaccggcctgt

SEQ ID NO: 89731 - DNA, 20 bp, human
gatgcgcgagcacggccccg

SEQ ID NO: 89732 - DNA, 20 bp, human
gggcgccagaactagtaact

SEQ ID NO: 89733 - DNA, 20 bp, human
gtgggccctggtctagccct

SEQ ID NO: 89734 - DNA, 20 bp, human
gctgacccacaggccggtcg

SEQ ID NO: 89735 - DNA, 20 bp, human
ggagacacccagcgacgacg

SEQ ID NO: 89736 - DNA, 20 bp, human
gagaggacgcggccagagat

SEQ ID NO: 89737 - DNA, 20 bp, human
ggagacggcgagagacataa

SEQ ID NO: 89738 - DNA, 20 bp, human
ggaccccggcgtcatctcgg

SEQ ID NO: 89739 - DNA, 20 bp, human
gcaccccagcaggggttcaa

SEQ ID NO: 89740 - DNA, 20 bp, human
gcgcctagccctggagccag

SEQ ID NO: 89741 - DNA, 20 bp, human
ggcggcgcggctcctctcct

SEQ ID NO: 89742 - DNA, 20 bp, human
ggccctggagccaggggata

SEQ ID NO: 89743 - DNA, 20 bp, human
gagattcaggctcaggtcta

SEQ ID NO: 89744 - DNA, 20 bp, human
gaccgaccccggcgtcatct

SEQ ID NO: 89745 - DNA, 20 bp, human
gcagggctaggcgggaccga

SEQ ID NO: 89746 - DNA, 20 bp, human
ggcctgggcacgaccatggt

SEQ ID NO: 89747 - DNA, 20 bp, human
gcgcgggcgacgtcccacca

SEQ ID NO: 89748 - DNA, 20 bp, human
ggcgtcccaggctctggcta

SEQ ID NO: 89749 - DNA, 20 bp, human
ggccgcgctctatgactacg

SEQ ID NO: 89750 - DNA, 20 bp, human
ggctctggctaaggagcgcg

SEQ ID NO: 89751 - DNA, 20 bp, human
gccctcgtcgcccgacacgg

SEQ ID NO: 89752 - DNA, 20 bp, human
gcagccctcgtcgcccgaca

SEQ ID NO: 89753 - DNA, 20 bp, human
gtctatgactacgaggctcg

SEQ ID NO: 89754 - DNA, 20 bp, human
gtcggtgacggcagagatca

SEQ ID NO: 89755 - DNA, 20 bp, human
gtaggaatcgcgatcggtga

SEQ ID NO: 89756 - DNA, 20 bp, human
gaggcctctggcctaacaga

SEQ ID NO: 89757 - DNA, 20 bp, human
ggtctgcagggacatggacc

SEQ ID NO: 89758 - DNA, 20 bp, human
ggcagggacatggaccgggc

SEQ ID NO: 89759 - DNA, 20 bp, human
gcatggaccgggcgggtgac

SEQ ID NO: 89760 - DNA, 20 bp, human
ggccccgctcccgcccgtgg

SEQ ID NO: 89761 - DNA, 20 bp, human
gcctctggcctaacagaggg

SEQ ID NO: 89762 - DNA, 20 bp, human
ggttaccgccgccctctgtt

SEQ ID NO: 89763 - DNA, 20 bp, human
gcaccgagtcatcccggacc

SEQ ID NO: 89764 - DNA, 20 bp, human
gctggcctaacagagggcgg

SEQ ID NO: 89765 - DNA, 20 bp, human
gtgacgggacgcgggccagc

SEQ ID NO: 89766 - DNA, 20 bp, human
ggccgggcgcgcagaagctg

SEQ ID NO: 89767 - DNA, 20 bp, human
gcaccgcggggcgggaagtg

SEQ ID NO: 89768 - DNA, 20 bp, human
ggccccgctcccgcccgtgg

SEQ ID NO: 89769 - DNA, 20 bp, human
ggtgtgaggcgctgcggacg

SEQ ID NO: 89770 - DNA, 20 bp, human
gaggggcgcagagcggacaa

SEQ ID NO: 89771 - DNA, 20 bp, human
ggcccccgcccgcttgcagg

SEQ ID NO: 89772 - DNA, 20 bp, human
gggggttgcgggctcggtag

SEQ ID NO: 89773 - DNA, 20 bp, human
ggtctgcagggacatggacc

SEQ ID NO: 89774 - DNA, 20 bp, human
gcgggaagtgcggcatgggg

SEQ ID NO: 89775 - DNA, 20 bp, human
gggcagccgcggccctgtgg

SEQ ID NO: 89776 - DNA, 20 bp, human
gaggatctctctatcatccc

SEQ ID NO: 89777 - DNA, 20 bp, human
gtcttttggaactagggata

SEQ ID NO: 89778 - DNA, 20 bp, human
gagttccaaaagatgagtcg

SEQ ID NO: 89779 - DNA, 20 bp, human
ggatcatgtccaataccatt

SEQ ID NO: 89780 - DNA, 20 bp, human
gcaactgggaaactatagca

SEQ ID NO: 89781 - DNA, 20 bp, human
gtctgagggattccaattaa

SEQ ID NO: 89782 - DNA, 20 bp, human
gtttcaggagatattctggg

SEQ ID NO: 89783 - DNA, 20 bp, human
gttcccagttgatagtctga

SEQ ID NO: 89784 - DNA, 20 bp, human
gcctggattaacaccaaaag

SEQ ID NO: 89785 - DNA, 20 bp, human
gatccctcagactatcaact

SEQ ID NO: 89786 - DNA, 20 bp, human
gagcggaccgcccggaaccg

SEQ ID NO: 89787 - DNA, 20 bp, human
gcggaaccggggcagagaag

SEQ ID NO: 89788 - DNA, 20 bp, human
gcaggcacgggtgtccctcc

SEQ ID NO: 89789 - DNA, 20 bp, human
gcttttgccacgaacacctg

SEQ ID NO: 89790 - DNA, 20 bp, human
gtgggaccgggagcaagctg

SEQ ID NO: 89791 - DNA, 20 bp, human
ggccgccgagctggagttag

SEQ ID NO: 89792 - DNA, 20 bp, human
ggccgagctggagttagagg

SEQ ID NO: 89793 - DNA, 20 bp, human
gggcacgccgcaggtgttcg

SEQ ID NO: 89794 - DNA, 20 bp, human
gttagaggtggagctccgtg

SEQ ID NO: 89795 - DNA, 20 bp, human
gccggggctgcaacactccc

SEQ ID NO: 89796 - DNA, 20 bp, human
gccggcctcgctcccccgag

SEQ ID NO: 89797 - DNA, 20 bp, human
gccggcagctcgggtctcag

SEQ ID NO: 89798 - DNA, 20 bp, human
ggcagctcgggtctcagcgg

SEQ ID NO: 89799 - DNA, 20 bp, human
gggccgccccccacacaaag

SEQ ID NO: 89800 - DNA, 20 bp, human
gcaccgcgcggccgctgacg

SEQ ID NO: 89801 - DNA, 20 bp, human
ggcccggcgctgccgacgag

SEQ ID NO: 89802 - DNA, 20 bp, human
gtgtctgtgcgtctgtccat

SEQ ID NO: 89803 - DNA, 20 bp, human
gccagagggccgggcaccaa

SEQ ID NO: 89804 - DNA, 20 bp, human
gcgggtccctgccctcgctc

SEQ ID NO: 89805 - DNA, 20 bp, human
ggcgcagagacccccggtgg

SEQ ID NO: 89806 - DNA, 20 bp, human
ggaccgagggcgcagtgaga

SEQ ID NO: 89807 - DNA, 20 bp, human
gggacctgtctgactctcag

SEQ ID NO: 89808 - DNA, 20 bp, human
gccagctggcggatgatctg

SEQ ID NO: 89809 - DNA, 20 bp, human
gagccccgacaccctccggg

SEQ ID NO: 89810 - DNA, 20 bp, human
gatgatctggggcggaccga

SEQ ID NO: 89811 - DNA, 20 bp, human
gccggccgcccggagggtgt

SEQ ID NO: 89812 - DNA, 20 bp, human
gaagagagcacgaccctctc

SEQ ID NO: 89813 - DNA, 20 bp, human
gcaggcaatgagaaaatgac

SEQ ID NO: 89814 - DNA, 20 bp, human
gacccagccccgacaccctc

SEQ ID NO: 89815 - DNA, 20 bp, human
ggggagctctgcctgaccac

SEQ ID NO: 89816 - DNA, 20 bp, human
gctggaggccaccgagaaga

SEQ ID NO: 89817 - DNA, 20 bp, human
gccggctcaccgcgggacca

SEQ ID NO: 89818 - DNA, 20 bp, human
ggcttcctccttcttctcgg

SEQ ID NO: 89819 - DNA, 20 bp, human
gcacggcgacgcttgaccgc

SEQ ID NO: 89820 - DNA, 20 bp, human
ggaccgccggcgtcgtttga

SEQ ID NO: 89821 - DNA, 20 bp, human
gtccagccgtcaaacgacgc

SEQ ID NO: 89822 - DNA, 20 bp, human
gagccgtcaaacgacgccgg

SEQ ID NO: 89823 - DNA, 20 bp, human
ggcggcgcccggctcaccgc

SEQ ID NO: 89824 - DNA, 20 bp, human
gaccgcgggaccagggcagc

SEQ ID NO: 89825 - DNA, 20 bp, human
gccgtgtcttttacgacaga

SEQ ID NO: 89826 - DNA, 20 bp, human
gctcaaggccggagacccgg

SEQ ID NO: 89827 - DNA, 20 bp, human
gtgagggctcgggctcgcag

SEQ ID NO: 89828 - DNA, 20 bp, human
gcggtggccgcaaaaagagg

SEQ ID NO: 89829 - DNA, 20 bp, human
gcaccaggtgccgcacgcaa

SEQ ID NO: 89830 - DNA, 20 bp, human
ggccgcacgcaagggtcccc

SEQ ID NO: 89831 - DNA, 20 bp, human
gctgcggtggccgcaaaaag

SEQ ID NO: 89832 - DNA, 20 bp, human
gtctccggccttgagggctc

SEQ ID NO: 89833 - DNA, 20 bp, human
ggccctcaaggccggagacc

SEQ ID NO: 89834 - DNA, 20 bp, human
gcgcagtgcgagccccccac

SEQ ID NO: 89835 - DNA, 20 bp, human
gtgggtcatgatcccaggag

SEQ ID NO: 89836 - DNA, 20 bp, human
gggcccagcgtatggagctg

SEQ ID NO: 89837 - DNA, 20 bp, human
ggccacagcagtagcattag

SEQ ID NO: 89838 - DNA, 20 bp, human
ggagaggcgcgtccacctgg

SEQ ID NO: 89839 - DNA, 20 bp, human
gagaaggccaggaagctgta

SEQ ID NO: 89840 - DNA, 20 bp, human
gggctgcccggctgctccaa

SEQ ID NO: 89841 - DNA, 20 bp, human
gcgctaggtagctccagccg

SEQ ID NO: 89842 - DNA, 20 bp, human
gggagagaggcgcgtccacc

SEQ ID NO: 89843 - DNA, 20 bp, human
ggtcggcctgtgaggtgagt

SEQ ID NO: 89844 - DNA, 20 bp, human
gaggaggggggacgaggcag

SEQ ID NO: 89845 - DNA, 20 bp, human
gacctggcgggcccagcgta

SEQ ID NO: 89846 - DNA, 20 bp, human
gtacatggcgcgcgaggagg

SEQ ID NO: 89847 - DNA, 20 bp, human
gcgcaccggggatggcgaca

SEQ ID NO: 89848 - DNA, 20 bp, human
gacagctcttcccagccggg

SEQ ID NO: 89849 - DNA, 20 bp, human
ggtcccccgcaggtagaggg

SEQ ID NO: 89850 - DNA, 20 bp, human
gaggagagccaggcccgatg

SEQ ID NO: 89851 - DNA, 20 bp, human
gctctacctgcgggggacac

SEQ ID NO: 89852 - DNA, 20 bp, human
ggaggccctgtcgccatccc

SEQ ID NO: 89853 - DNA, 20 bp, human
gtacgcatgcgcaccgggga

SEQ ID NO: 89854 - DNA, 20 bp, human
gtggccggtgaagagcaggc

SEQ ID NO: 89855 - DNA, 20 bp, human
gccggcggggcggggttaca

SEQ ID NO: 89856 - DNA, 20 bp, human
gtcgccctcaccacacccgg

SEQ ID NO: 89857 - DNA, 20 bp, human
gtcgcggagagggaagaata

SEQ ID NO: 89858 - DNA, 20 bp, human
gcggctgcaggcgatgtcag

SEQ ID NO: 89859 - DNA, 20 bp, human
gtgcaggcgatgtcagagga

SEQ ID NO: 89860 - DNA, 20 bp, human
gagaatatggccgccgggtg

SEQ ID NO: 89861 - DNA, 20 bp, human
gatggccgccgggtgtggtg

SEQ ID NO: 89862 - DNA, 20 bp, human
gccaccagagactccaaggt

SEQ ID NO: 89863 - DNA, 20 bp, human
gggaccggcctccacactga

SEQ ID NO: 89864 - DNA, 20 bp, human
gtggtggtctgtctcctgag

SEQ ID NO: 89865 - DNA, 20 bp, human
gcctgaggggcccctcgggt

SEQ ID NO: 89866 - DNA, 20 bp, human
gcgcggacctgggcgctgtg

SEQ ID NO: 89867 - DNA, 20 bp, human
gtgctgggccccctactgcg

SEQ ID NO: 89868 - DNA, 20 bp, human
gacgccacggccagagtacc

SEQ ID NO: 89869 - DNA, 20 bp, human
gtggcgcgggacaaacgcca

SEQ ID NO: 89870 - DNA, 20 bp, human
gtagtttctggggattcggg

SEQ ID NO: 89871 - DNA, 20 bp, human
gggagacgagattagtgatt

SEQ ID NO: 89872 - DNA, 20 bp, human
gcgcggagaaccaagaaact

SEQ ID NO: 89873 - DNA, 20 bp, human
ggtgatttggcggctccgac

SEQ ID NO: 89874 - DNA, 20 bp, human
gcagcgcccgagagggacca

SEQ ID NO: 89875 - DNA, 20 bp, human
gcagaaactaagcaacgact

SEQ ID NO: 89876 - DNA, 20 bp, human
gtgggagaggaccactccgg

SEQ ID NO: 89877 - DNA, 20 bp, human
gagcaggacatggaagaacg

SEQ ID NO: 89878 - DNA, 20 bp, human
gacctgggagaggaccactc

SEQ ID NO: 89879 - DNA, 20 bp, human
gagaacgcgggtcacccgac

SEQ ID NO: 89880 - DNA, 20 bp, human
gctagggcaaagttgcctgg

SEQ ID NO: 89881 - DNA, 20 bp, human
ggaggcacctgggcgagaca

SEQ ID NO: 89882 - DNA, 20 bp, human
gggtaagcagatcttcagac

SEQ ID NO: 89883 - DNA, 20 bp, human
gaccctggggtccgacagaa

SEQ ID NO: 89884 - DNA, 20 bp, human
gctccgcgcgagatccctgt

SEQ ID NO: 89885 - DNA, 20 bp, human
gatccaggtggtgctcaggt

SEQ ID NO: 89886 - DNA, 20 bp, human
gaggcgcgcgggccatcccg

SEQ ID NO: 89887 - DNA, 20 bp, human
gctcggagctcacggcggag

SEQ ID NO: 89888 - DNA, 20 bp, human
gagcggggctccgtccctgg

SEQ ID NO: 89889 - DNA, 20 bp, human
gaggcggccgagcctggaga

SEQ ID NO: 89890 - DNA, 20 bp, human
gccaggctcggccgcctcca

SEQ ID NO: 89891 - DNA, 20 bp, human
gtccggcccatgaaccgacg

SEQ ID NO: 89892 - DNA, 20 bp, human
gttcatgggccggacccgga

SEQ ID NO: 89893 - DNA, 20 bp, human
ggcgagcgcagccaacatgt

SEQ ID NO: 89894 - DNA, 20 bp, human
ggctccgagaggcagcgccg

SEQ ID NO: 89895 - DNA, 20 bp, human
gcgctgcctctcggagctca

SEQ ID NO: 89896 - DNA, 20 bp, human
gagccgaacgagttcctcgg

SEQ ID NO: 89897 - DNA, 20 bp, human
ggactccaaagtgaaagtgg

SEQ ID NO: 89898 - DNA, 20 bp, human
gctcccccggaggttcccga

SEQ ID NO: 89899 - DNA, 20 bp, human
gagccgccgaggaactcgtt

SEQ ID NO: 89900 - DNA, 20 bp, human
gggaagccgaacgagttcct

SEQ ID NO: 89901 - DNA, 20 bp, human
gcgccctcgggaacctccgg

SEQ ID NO: 89902 - DNA, 20 bp, human
ggccccgccgctgactatag

SEQ ID NO: 89903 - DNA, 20 bp, human
gagagggcaaaagggcgcag

SEQ ID NO: 89904 - DNA, 20 bp, human
gacctccgggggagacgaga

SEQ ID NO: 89905 - DNA, 20 bp, human
ggaagagtcgccggtggccg

SEQ ID NO: 89906 - DNA, 20 bp, human
ggtgcggacgctttccctac

SEQ ID NO: 89907 - DNA, 20 bp, human
gccagcgccggctccccaga

SEQ ID NO: 89908 - DNA, 20 bp, human
gtggaggtggtgagtggcgt

SEQ ID NO: 89909 - DNA, 20 bp, human
ggcgtggggactgtgtcgag

SEQ ID NO: 89910 - DNA, 20 bp, human
ggaggactggaaggaataca

SEQ ID NO: 89911 - DNA, 20 bp, human
gatgctgaggaactgaatgg

SEQ ID NO: 89912 - DNA, 20 bp, human
gtgtgtcgagggggtcccca

SEQ ID NO: 89913 - DNA, 20 bp, human
gttcaaattgcggccttctg

SEQ ID NO: 89914 - DNA, 20 bp, human
gcccaaggtgccggaccctg

SEQ ID NO: 89915 - DNA, 20 bp, human
gccgccgacctggaatgctg

SEQ ID NO: 89916 - DNA, 20 bp, human
gctagcaagaaccttgcggg

SEQ ID NO: 89917 - DNA, 20 bp, human
gggcggaattcagtcgcgcg

SEQ ID NO: 89918 - DNA, 20 bp, human
gcggtgcagtcgggaggtgg

SEQ ID NO: 89919 - DNA, 20 bp, human
gcgcgcgcggtgcagtcggg

SEQ ID NO: 89920 - DNA, 20 bp, human
gtagagaggtagccctggtc

SEQ ID NO: 89921 - DNA, 20 bp, human
ggcgcggtgcagtcgggagg

SEQ ID NO: 89922 - DNA, 20 bp, human
ggtagccctggtcgggatgt

SEQ ID NO: 89923 - DNA, 20 bp, human
ggagacaaggatatctagag

SEQ ID NO: 89924 - DNA, 20 bp, human
gtcgaggggtgagggcgcta

SEQ ID NO: 89925 - DNA, 20 bp, human
gcagtcgcgcgcggtgcagt

SEQ ID NO: 89926 - DNA, 20 bp, human
gccactagcccagaactccg

SEQ ID NO: 89927 - DNA, 20 bp, human
gacgctggctactcagatcg

SEQ ID NO: 89928 - DNA, 20 bp, human
gccggcgaccgcggagttct

SEQ ID NO: 89929 - DNA, 20 bp, human
gccagcgtcgccggcgaccg

SEQ ID NO: 89930 - DNA, 20 bp, human
gggccggacctggagttccg

SEQ ID NO: 89931 - DNA, 20 bp, human
gggctagtgggaccccgcgc

SEQ ID NO: 89932 - DNA, 20 bp, human
gttcatgggccggaccctca

SEQ ID NO: 89933 - DNA, 20 bp, human
gtgagcgatggcatcggtca

SEQ ID NO: 89934 - DNA, 20 bp, human
gctggacttaaaagtgtcac

SEQ ID NO: 89935 - DNA, 20 bp, human
ggctggttcgggatgagcga

SEQ ID NO: 89936 - DNA, 20 bp, human
gcgcagtccacagtcaccac

SEQ ID NO: 89937 - DNA, 20 bp, human
ggctccgggctcgggttctg

SEQ ID NO: 89938 - DNA, 20 bp, human
ggcttgcgggcaggcggctg

SEQ ID NO: 89939 - DNA, 20 bp, human
gctcccgctggttcatggga

SEQ ID NO: 89940 - DNA, 20 bp, human
ggcgccgcgcccaggaccaa

SEQ ID NO: 89941 - DNA, 20 bp, human
gccagcaaccgcgaacgccg

SEQ ID NO: 89942 - DNA, 20 bp, human
gcagtgctgcatccagaacc

SEQ ID NO: 89943 - DNA, 20 bp, human
gcggcccgagcggggacgtg

SEQ ID NO: 89944 - DNA, 20 bp, human
ggtgacgtggtccacgtggt

SEQ ID NO: 89945 - DNA, 20 bp, human
ggccgcggcggtgagcttgc

SEQ ID NO: 89946 - DNA, 20 bp, human
ggcgccgcgcccaggaccaa

SEQ ID NO: 89947 - DNA, 20 bp, human
gggacgggaacaggtaggtc

SEQ ID NO: 89948 - DNA, 20 bp, human
gcgggaacaggtaggtccgg

SEQ ID NO: 89949 - DNA, 20 bp, human
ggacccggaggcgacattag

SEQ ID NO: 89950 - DNA, 20 bp, human
gcaggaggaaaggccctcga

SEQ ID NO: 89951 - DNA, 20 bp, human
gcaggcggacgggaacaggt

SEQ ID NO: 89952 - DNA, 20 bp, human
gccgccccgagagtccccag

SEQ ID NO: 89953 - DNA, 20 bp, human
ggggtcagctctggtcccgt

SEQ ID NO: 89954 - DNA, 20 bp, human
gctcccgctggttcatggga

SEQ ID NO: 89955 - DNA, 20 bp, human
ggtgacgtggtccacgtggt

SEQ ID NO: 89956 - DNA, 20 bp, human
gggcttgggtttgaatattg

SEQ ID NO: 89957 - DNA, 20 bp, human
gtgaagtggttgcggtaacc

SEQ ID NO: 89958 - DNA, 20 bp, human
gggcggacattaaagtgaag

SEQ ID NO: 89959 - DNA, 20 bp, human
gttgagtctgaagcgctggg

SEQ ID NO: 89960 - DNA, 20 bp, human
ggaaaaaagctgacactaca

SEQ ID NO: 89961 - DNA, 20 bp, human
ggtgagtgagaggcacatga

SEQ ID NO: 89962 - DNA, 20 bp, human
ggctgacactacaaggtgct

SEQ ID NO: 89963 - DNA, 20 bp, human
gcaggtctagaagaccaggt

SEQ ID NO: 89964 - DNA, 20 bp, human
gaacgaagcgctgaggaaag

SEQ ID NO: 89965 - DNA, 20 bp, human
gcacatataagcgtacccag

SEQ ID NO: 89966 - DNA, 20 bp, human
ggggcgctctctcccggtgt

SEQ ID NO: 89967 - DNA, 20 bp, human
ggagcaagcagcgacgccag

SEQ ID NO: 89968 - DNA, 20 bp, human
gcagacagcagtacccacac

SEQ ID NO: 89969 - DNA, 20 bp, human
gggcctggccctctgtacgt

SEQ ID NO: 89970 - DNA, 20 bp, human
ggcggcggagaaccgacgaa

SEQ ID NO: 89971 - DNA, 20 bp, human
gtctatgctggacctagact

SEQ ID NO: 89972 - DNA, 20 bp, human
gccagcatagatgagcggag

SEQ ID NO: 89973 - DNA, 20 bp, human
gagcaggaggacctttcacg

SEQ ID NO: 89974 - DNA, 20 bp, human
gtgtgctggacgtcaaggtg

SEQ ID NO: 89975 - DNA, 20 bp, human
gcaagcagcgacgccagcgg

SEQ ID NO: 89976 - DNA, 20 bp, human
gtgtcaggcagcgcgcgagg

SEQ ID NO: 89977 - DNA, 20 bp, human
ggcgggcagctagcagctgg

SEQ ID NO: 89978 - DNA, 20 bp, human
ggcgggatctcccaatggga

SEQ ID NO: 89979 - DNA, 20 bp, human
ggctggcggacgcgacccgg

SEQ ID NO: 89980 - DNA, 20 bp, human
gggccgactgaagtagacca

SEQ ID NO: 89981 - DNA, 20 bp, human
gagcgtgcgcagatgaatct

SEQ ID NO: 89982 - DNA, 20 bp, human
ggcagctggcggacgcgacc

SEQ ID NO: 89983 - DNA, 20 bp, human
ggcggcgggcagctagcagc

SEQ ID NO: 89984 - DNA, 20 bp, human
gcaatgggagggtggaaagg

SEQ ID NO: 89985 - DNA, 20 bp, human
gctaactgcccccagaagga

SEQ ID NO: 89986 - DNA, 20 bp, human
gactggcggcggccccgcat

SEQ ID NO: 89987 - DNA, 20 bp, human
ggccgggcgagccctcccga

SEQ ID NO: 89988 - DNA, 20 bp, human
gcagtgacgccggagaggta

SEQ ID NO: 89989 - DNA, 20 bp, human
gttccctggagaggagccac

SEQ ID NO: 89990 - DNA, 20 bp, human
ggcgctttgggcggcaacaa

SEQ ID NO: 89991 - DNA, 20 bp, human
gcgcgcagcccgtcacgcgg

SEQ ID NO: 89992 - DNA, 20 bp, human
gggaaggtctggaagtgaag

SEQ ID NO: 89993 - DNA, 20 bp, human
gtcggctgcagcgggaccct

SEQ ID NO: 89994 - DNA, 20 bp, human
gggcggcggccttacctctc

SEQ ID NO: 89995 - DNA, 20 bp, human
gaagcggaatagccggggaa

SEQ ID NO: 89996 - DNA, 20 bp, human
gtgacggcagcggtcctggg

SEQ ID NO: 89997 - DNA, 20 bp, human
gccgaagcggggcagtgtga

SEQ ID NO: 89998 - DNA, 20 bp, human
gtcgctgctggcctagggag

SEQ ID NO: 89999 - DNA, 20 bp, human
gggtgacggctgcggaggac

SEQ ID NO: 90000 - DNA, 20 bp, human
gctgcagcgcggctgaggta

SEQ ID NO: 90001 - DNA, 20 bp, human
gagtgtgacggcagcggtcc

SEQ ID NO: 90002 - DNA, 20 bp, human
gcgcgctgcagaccgacggg

SEQ ID NO: 90003 - DNA, 20 bp, human
gagtttcgcgagggccgaag

SEQ ID NO: 90004 - DNA, 20 bp, human
ggtctgaggggaggtagcgc

SEQ ID NO: 90005 - DNA, 20 bp, human
gcagcgcggctgaggtaagg

SEQ ID NO: 90006 - DNA, 20 bp, human
gctgcaccttgcccacccgg

SEQ ID NO: 90007 - DNA, 20 bp, human
gcccgcccggcctctcaggg

SEQ ID NO: 90008 - DNA, 20 bp, human
ggtacaaggaggatactggg

SEQ ID NO: 90009 - DNA, 20 bp, human
gcagctgtgaaggagccgtg

SEQ ID NO: 90010 - DNA, 20 bp, human
gctggacgcgcctccaacgg

SEQ ID NO: 90011 - DNA, 20 bp, human
gcacccggcggttctcacac

SEQ ID NO: 90012 - DNA, 20 bp, human
ggacctgtgtgagaaccgcc

SEQ ID NO: 90013 - DNA, 20 bp, human
ggcagagaggtgccaggccc

SEQ ID NO: 90014 - DNA, 20 bp, human
ggcccagcgagcgggaacgt

SEQ ID NO: 90015 - DNA, 20 bp, human
ggttccgcggaggcgcagag

SEQ ID NO: 90016 - DNA, 20 bp, human
gaagtccagcttcggcgact

SEQ ID NO: 90017 - DNA, 20 bp, human
gagtaagccagtatcccagg

SEQ ID NO: 90018 - DNA, 20 bp, human
gggctgcgaaagtccagctt

SEQ ID NO: 90019 - DNA, 20 bp, human
gtaacaaagctgcacctcgt

SEQ ID NO: 90020 - DNA, 20 bp, human
ggaaggctacgcctaaagta

SEQ ID NO: 90021 - DNA, 20 bp, human
gcgtgccacttgctcctcct

SEQ ID NO: 90022 - DNA, 20 bp, human
ggagcacaactccgcccacg

SEQ ID NO: 90023 - DNA, 20 bp, human
gaggtggtgtcaggatccct

SEQ ID NO: 90024 - DNA, 20 bp, human
gcctttgccgataattggag

SEQ ID NO: 90025 - DNA, 20 bp, human
ggggcaagagctggtaaccc

SEQ ID NO: 90026 - DNA, 20 bp, human
gactgaacgctgggagtagg

SEQ ID NO: 90027 - DNA, 20 bp, human
gctcgcgggtctggctagtc

SEQ ID NO: 90028 - DNA, 20 bp, human
gtgcggagcgatgcgaacac

SEQ ID NO: 90029 - DNA, 20 bp, human
ggcagtgctgctcgcgggtc

SEQ ID NO: 90030 - DNA, 20 bp, human
ggcgaagtttgcaggtgagg

SEQ ID NO: 90031 - DNA, 20 bp, human
gaacatcgcagtgctgctcg

SEQ ID NO: 90032 - DNA, 20 bp, human
gcgcactgaacgctgggagt

SEQ ID NO: 90033 - DNA, 20 bp, human
gcaggtgaggaggtgacccg

SEQ ID NO: 90034 - DNA, 20 bp, human
gagggctcataccccagtgg

SEQ ID NO: 90035 - DNA, 20 bp, human
gattcaaacaatggcggcca

SEQ ID NO: 90036 - DNA, 20 bp, human
ggccgcgctccagccatgtt

SEQ ID NO: 90037 - DNA, 20 bp, human
gactcgggcgcagtaggctg

SEQ ID NO: 90038 - DNA, 20 bp, human
ggttgggcgactgaatggaa

SEQ ID NO: 90039 - DNA, 20 bp, human
ggggcgactgaatggaaagg

SEQ ID NO: 90040 - DNA, 20 bp, human
ggccatgttgggcgactgaa

SEQ ID NO: 90041 - DNA, 20 bp, human
ggcaaacacagacggcgtga

SEQ ID NO: 90042 - DNA, 20 bp, human
ggaagtcaagacgcccccca

SEQ ID NO: 90043 - DNA, 20 bp, human
gaacacagacggcgtgaggg

SEQ ID NO: 90044 - DNA, 20 bp, human
gggacggaggggagtgacga

SEQ ID NO: 90045 - DNA, 20 bp, human
gtgcgggtggctgtcaggtg

SEQ ID NO: 90046 - DNA, 20 bp, human
gtgtgccgcgccgtagggag

SEQ ID NO: 90047 - DNA, 20 bp, human
gggagctagctgacagccgg

SEQ ID NO: 90048 - DNA, 20 bp, human
ggcctcctcgcgccatcggg

SEQ ID NO: 90049 - DNA, 20 bp, human
gctggagcctgcactcccgg

SEQ ID NO: 90050 - DNA, 20 bp, human
gcgcggagctagctgacagc

SEQ ID NO: 90051 - DNA, 20 bp, human
ggggtctgggcgtggatcag

SEQ ID NO: 90052 - DNA, 20 bp, human
ggccgtcaggtagggacccg

SEQ ID NO: 90053 - DNA, 20 bp, human
gcccgccgctccctacggcg

SEQ ID NO: 90054 - DNA, 20 bp, human
ggtgcaggctccagcccaag

SEQ ID NO: 90055 - DNA, 20 bp, human
ggccgcgccgtagggagcgg

SEQ ID NO: 90056 - DNA, 20 bp, human
gcagaggcgacgcgagatgg

SEQ ID NO: 90057 - DNA, 20 bp, human
ggggcggctcgacgcagcag

SEQ ID NO: 90058 - DNA, 20 bp, human
gcagcagaggcgacgcgaga

SEQ ID NO: 90059 - DNA, 20 bp, human
gggagtggaatggccgcggg

SEQ ID NO: 90060 - DNA, 20 bp, human
gcttattcaggtgatctcca

SEQ ID NO: 90061 - DNA, 20 bp, human
ggccacgaggacgagaagaa

SEQ ID NO: 90062 - DNA, 20 bp, human
gcggggaattcgaatgggag

SEQ ID NO: 90063 - DNA, 20 bp, human
gagaggcggccatggcgcag

SEQ ID NO: 90064 - DNA, 20 bp, human
gggcaccggggaattcgaat

SEQ ID NO: 90065 - DNA, 20 bp, human
gggggtcatggcctcatccc

SEQ ID NO: 90066 - DNA, 20 bp, human
gtggcgggacaggatcgata

SEQ ID NO: 90067 - DNA, 20 bp, human
gtgaagactgcggagatctc

SEQ ID NO: 90068 - DNA, 20 bp, human
ggggagatgagtgacacgca

SEQ ID NO: 90069 - DNA, 20 bp, human
gacgcgtggagggcataacg

SEQ ID NO: 90070 - DNA, 20 bp, human
ggggctcctagtcttggcag

SEQ ID NO: 90071 - DNA, 20 bp, human
gggtgctgggctcctagtct

SEQ ID NO: 90072 - DNA, 20 bp, human
gagaaggcccagctaatcgt

SEQ ID NO: 90073 - DNA, 20 bp, human
gagacagcgacgttagagag

SEQ ID NO: 90074 - DNA, 20 bp, human
gatcctgtcccgccaggtgg

SEQ ID NO: 90075 - DNA, 20 bp, human
ggccaatgcgctgaagactg

SEQ ID NO: 90076 - DNA, 20 bp, human
ggcgaagactgcgggacgtt

SEQ ID NO: 90077 - DNA, 20 bp, human
ggcggcgacgctaagagccc

SEQ ID NO: 90078 - DNA, 20 bp, human
ggactgcgggacgttaggac

SEQ ID NO: 90079 - DNA, 20 bp, human
ggaacttcgcggctaaggcg

SEQ ID NO: 90080 - DNA, 20 bp, human
gggcagccagcgagggagaa

SEQ ID NO: 90081 - DNA, 20 bp, human
gaggctgtcccgggaccccg

SEQ ID NO: 90082 - DNA, 20 bp, human
gctgtcccgggaccccgagg

SEQ ID NO: 90083 - DNA, 20 bp, human
ggtgcggcgtaaaacaaccc

SEQ ID NO: 90084 - DNA, 20 bp, human
gcggtgctctgcgaagccgg

SEQ ID NO: 90085 - DNA, 20 bp, human
ggctggctggcgaagactgc

SEQ ID NO: 90086 - DNA, 20 bp, human
gtgtccgcgggcaggcgcca

SEQ ID NO: 90087 - DNA, 20 bp, human
gtgacgggactgttaggttg

SEQ ID NO: 90088 - DNA, 20 bp, human
gcggtggctcccgggttgac

SEQ ID NO: 90089 - DNA, 20 bp, human
gccgggttgacgggactgtt

SEQ ID NO: 90090 - DNA, 20 bp, human
gccggaagtaaacaacccaa

SEQ ID NO: 90091 - DNA, 20 bp, human
ggaaagggcggggagaatag

SEQ ID NO: 90092 - DNA, 20 bp, human
gacccgggagccaccggcgg

SEQ ID NO: 90093 - DNA, 20 bp, human
gtctcagacagggcagaccg

SEQ ID NO: 90094 - DNA, 20 bp, human
gcctaaaagaggtgccggtc

SEQ ID NO: 90095 - DNA, 20 bp, human
gggatgaaagataggaaagt

SEQ ID NO: 90096 - DNA, 20 bp, human
gcactgcagagcatgcccat

SEQ ID NO: 90097 - DNA, 20 bp, human
gtggactccacttgcatccg

SEQ ID NO: 90098 - DNA, 20 bp, human
gtagtctccacggatgcaag

SEQ ID NO: 90099 - DNA, 20 bp, human
gccaagagagaagtgagtag

SEQ ID NO: 90100 - DNA, 20 bp, human
gatgcaagtggagtccatgc

SEQ ID NO: 90101 - DNA, 20 bp, human
ggcccatgggtcacccagca

SEQ ID NO: 90102 - DNA, 20 bp, human
gagggagggaagagcgggag

SEQ ID NO: 90103 - DNA, 20 bp, human
gatttccgcaccctgggaaa

SEQ ID NO: 90104 - DNA, 20 bp, human
gttatttttcaagataacag

SEQ ID NO: 90105 - DNA, 20 bp, human
ggaatcctgatggcgttggg

SEQ ID NO: 90106 - DNA, 20 bp, human
gggctctgcgaacttccgag

SEQ ID NO: 90107 - DNA, 20 bp, human
gtggcaagagcgtcacgctg

SEQ ID NO: 90108 - DNA, 20 bp, human
gagtgtcgcgaggagcgcgg

SEQ ID NO: 90109 - DNA, 20 bp, human
ggctacgtgatccggccccg

SEQ ID NO: 90110 - DNA, 20 bp, human
gtgcccagggctcctaactt

SEQ ID NO: 90111 - DNA, 20 bp, human
ggtgagcctgggacgtccgt

SEQ ID NO: 90112 - DNA, 20 bp, human
gcgcaggggtctggatccga

SEQ ID NO: 90113 - DNA, 20 bp, human
gtggatccgacggacgtccc

SEQ ID NO: 90114 - DNA, 20 bp, human
gcgctcctcgcgacactcgc

SEQ ID NO: 90115 - DNA, 20 bp, human
ggcgccgcggctacgtgatc

SEQ ID NO: 90116 - DNA, 20 bp, human
gcggccgctgccgggaaggt

SEQ ID NO: 90117 - DNA, 20 bp, human
ggccgagccgagtcagctgt

SEQ ID NO: 90118 - DNA, 20 bp, human
gggcttgcggtctccaccag

SEQ ID NO: 90119 - DNA, 20 bp, human
gaaagcgagggatacaatca

SEQ ID NO: 90120 - DNA, 20 bp, human
gcagttaccaagctcggtga

SEQ ID NO: 90121 - DNA, 20 bp, human
gcaagttcccacagctgact

SEQ ID NO: 90122 - DNA, 20 bp, human
gccagctaccgaattcatgg

SEQ ID NO: 90123 - DNA, 20 bp, human
gaccaggggcaagaaatacg

SEQ ID NO: 90124 - DNA, 20 bp, human
gcggctggaagaggcagaag

SEQ ID NO: 90125 - DNA, 20 bp, human
gtcccacagctgactcggct

SEQ ID NO: 90126 - DNA, 20 bp, human
gggagccggcgagcgactag

SEQ ID NO: 90127 - DNA, 20 bp, human
gcaacaaaagacgcggacgg

SEQ ID NO: 90128 - DNA, 20 bp, human
ggtgtggcagagcgaagctg

SEQ ID NO: 90129 - DNA, 20 bp, human
gaggcccgccgagcactgac

SEQ ID NO: 90130 - DNA, 20 bp, human
ggtccagcgctcgccgacag

SEQ ID NO: 90131 - DNA, 20 bp, human
ggcgacacgagacgaacaca

SEQ ID NO: 90132 - DNA, 20 bp, human
gggcagagcgccccttccgg

SEQ ID NO: 90133 - DNA, 20 bp, human
gacacagggtgcgctctgaa

SEQ ID NO: 90134 - DNA, 20 bp, human
gcgacaacaaaagacgcgga

SEQ ID NO: 90135 - DNA, 20 bp, human
gctcgcgacaacaaaagacg

SEQ ID NO: 90136 - DNA, 20 bp, human
gtgatggcaacggccaactt

SEQ ID NO: 90137 - DNA, 20 bp, human
ggagggagcgggcttcgtta

SEQ ID NO: 90138 - DNA, 20 bp, human
gccgagggagggggaccgga

SEQ ID NO: 90139 - DNA, 20 bp, human
gcggggacaccagcccggga

SEQ ID NO: 90140 - DNA, 20 bp, human
gacgaagcccgctccctccc

SEQ ID NO: 90141 - DNA, 20 bp, human
gagcagcagcagcgggccga

SEQ ID NO: 90142 - DNA, 20 bp, human
gcccggcgaagcaatcaatg

SEQ ID NO: 90143 - DNA, 20 bp, human
ggaaagggcccgggtgtcga

SEQ ID NO: 90144 - DNA, 20 bp, human
gcttcggcaagatccagatc

SEQ ID NO: 90145 - DNA, 20 bp, human
gagacggcgcggggtagagt

SEQ ID NO: 90146 - DNA, 20 bp, human
gcggcgcgctaggctcacaa

SEQ ID NO: 90147 - DNA, 20 bp, human
gggtccctgatggccgaaga

SEQ ID NO: 90148 - DNA, 20 bp, human
ggagggcgccagagccaagg

SEQ ID NO: 90149 - DNA, 20 bp, human
gccagagccaagggggataa

SEQ ID NO: 90150 - DNA, 20 bp, human
ggcggtacgctggtccctga

SEQ ID NO: 90151 - DNA, 20 bp, human
gggtatcagggagcgctcca

SEQ ID NO: 90152 - DNA, 20 bp, human
gggagcgctccagggccctt

SEQ ID NO: 90153 - DNA, 20 bp, human
gagcgcccggagcactgagc

SEQ ID NO: 90154 - DNA, 20 bp, human
gcctgctgctccaaccccaa

SEQ ID NO: 90155 - DNA, 20 bp, human
ggtgagtgatggaggtatca

SEQ ID NO: 90156 - DNA, 20 bp, human
ggcctgaagcgacgagtcca

SEQ ID NO: 90157 - DNA, 20 bp, human
ggcggggtccctaggtcaag

SEQ ID NO: 90158 - DNA, 20 bp, human
ggcggcgttaagacttcgta

SEQ ID NO: 90159 - DNA, 20 bp, human
ggccattcggagagtcagca

SEQ ID NO: 90160 - DNA, 20 bp, human
gcgaggtccccataagagca

SEQ ID NO: 90161 - DNA, 20 bp, human
gcgtagggttagcgaaattg

SEQ ID NO: 90162 - DNA, 20 bp, human
gcgacgagtccatggccatt

SEQ ID NO: 90163 - DNA, 20 bp, human
gtagacctcccagggaagtt

SEQ ID NO: 90164 - DNA, 20 bp, human
ggtcattcttgcctacacag

SEQ ID NO: 90165 - DNA, 20 bp, human
gcgtccccggacacacagat

SEQ ID NO: 90166 - DNA, 20 bp, human
ggatgcagcagcgacgaggg

SEQ ID NO: 90167 - DNA, 20 bp, human
gcggcctcgacagggacctg

SEQ ID NO: 90168 - DNA, 20 bp, human
gcgacaccgggtgcgcagaa

SEQ ID NO: 90169 - DNA, 20 bp, human
gggtgcagcccagcgacacc

SEQ ID NO: 90170 - DNA, 20 bp, human
gctcgagactgcggcttctc

SEQ ID NO: 90171 - DNA, 20 bp, human
ggttgacgctctcgagactg

SEQ ID NO: 90172 - DNA, 20 bp, human
gcgggatgcagcagcgacga

SEQ ID NO: 90173 - DNA, 20 bp, human
gggtccggccggcctcgaca

SEQ ID NO: 90174 - DNA, 20 bp, human
ggaggtgtttcggtagtctc

SEQ ID NO: 90175 - DNA, 20 bp, human
ggagcgtcaacgaggtgttt

SEQ ID NO: 90176 - DNA, 20 bp, human
gcccggatggggagagacag

SEQ ID NO: 90177 - DNA, 20 bp, human
gcatccggggcagcggggaa

SEQ ID NO: 90178 - DNA, 20 bp, human
ggagcctggggtccgaacct

SEQ ID NO: 90179 - DNA, 20 bp, human
gaggttgctaaggaagtgag

SEQ ID NO: 90180 - DNA, 20 bp, human
gaacaggtcagctaaggcca

SEQ ID NO: 90181 - DNA, 20 bp, human
gggcccgagccgaaagcggg

SEQ ID NO: 90182 - DNA, 20 bp, human
gaggccgtccggactaccaa

SEQ ID NO: 90183 - DNA, 20 bp, human
gtgaggcccgagccgaaagc

SEQ ID NO: 90184 - DNA, 20 bp, human
gtcgccgagccaggttgcta

SEQ ID NO: 90185 - DNA, 20 bp, human
ggcgccgaggttcggacccc

SEQ ID NO: 90186 - DNA, 20 bp, human
gccacgctatggatccctag

SEQ ID NO: 90187 - DNA, 20 bp, human
ggcaggacctgggtcggcac

SEQ ID NO: 90188 - DNA, 20 bp, human
gtgcgctgcacccgactggt

SEQ ID NO: 90189 - DNA, 20 bp, human
ggctatggatccctagagga

SEQ ID NO: 90190 - DNA, 20 bp, human
gccgaccgctccgggatgac

SEQ ID NO: 90191 - DNA, 20 bp, human
gcgaccggcagcccacgcta

SEQ ID NO: 90192 - DNA, 20 bp, human
ggctccgggatgacaggctc

SEQ ID NO: 90193 - DNA, 20 bp, human
gacccccggccgcccacgac

SEQ ID NO: 90194 - DNA, 20 bp, human
gcagccggtgcagagaggac

SEQ ID NO: 90195 - DNA, 20 bp, human
gtggctgcgctgcacccgac

SEQ ID NO: 90196 - DNA, 20 bp, human
gctgaggagggtcggaaccg

SEQ ID NO: 90197 - DNA, 20 bp, human
gtacgcacctgaggctctcc

SEQ ID NO: 90198 - DNA, 20 bp, human
gttagtttggtgagttacgg

SEQ ID NO: 90199 - DNA, 20 bp, human
gggcccagggagaacgggga

SEQ ID NO: 90200 - DNA, 20 bp, human
ggagtgcacgggcttctgaa

SEQ ID NO: 90201 - DNA, 20 bp, human
gcagcaccgtctctgcgagg

SEQ ID NO: 90202 - DNA, 20 bp, human
gtagggtactgggtaaaaac

SEQ ID NO: 90203 - DNA, 20 bp, human
gttggttggcgtctccggga

SEQ ID NO: 90204 - DNA, 20 bp, human
gggactctgctacgcacctg

SEQ ID NO: 90205 - DNA, 20 bp, human
gacgctccatgacttggcca

SEQ ID NO: 90206 - DNA, 20 bp, human
gagggacatttagtttgaga

SEQ ID NO: 90207 - DNA, 20 bp, human
gacagttggcattattccta

SEQ ID NO: 90208 - DNA, 20 bp, human
gcgggagaccccgggtgaac

SEQ ID NO: 90209 - DNA, 20 bp, human
ggggagactcaggtggtggt

SEQ ID NO: 90210 - DNA, 20 bp, human
ggaccccgggtgaacgggga

SEQ ID NO: 90211 - DNA, 20 bp, human
gacttcttcctgctcagtac

SEQ ID NO: 90212 - DNA, 20 bp, human
gggtgcatacactgcggagc

SEQ ID NO: 90213 - DNA, 20 bp, human
gtttgacccctgtactgagc

SEQ ID NO: 90214 - DNA, 20 bp, human
gtgtcccttccccgttcacc

SEQ ID NO: 90215 - DNA, 20 bp, human
gttcgtgcccggggagactc

SEQ ID NO: 90216 - DNA, 20 bp, human
ggcgcgctgtctctctcctg

SEQ ID NO: 90217 - DNA, 20 bp, human
gccgaaaggaccagacgccc

SEQ ID NO: 90218 - DNA, 20 bp, human
gagcgggatgcgggcgacct

SEQ ID NO: 90219 - DNA, 20 bp, human
gacgccggctaccaccatgg

SEQ ID NO: 90220 - DNA, 20 bp, human
gagagactaaggctctgcgg

SEQ ID NO: 90221 - DNA, 20 bp, human
ggagaggcagagagcccgaa

SEQ ID NO: 90222 - DNA, 20 bp, human
gtcgcccaggagggaattcg

SEQ ID NO: 90223 - DNA, 20 bp, human
gcccacgccggctaccacca

SEQ ID NO: 90224 - DNA, 20 bp, human
gggcgcccgggcgaagcctg

SEQ ID NO: 90225 - DNA, 20 bp, human
gcggcggggagggggagcaa

SEQ ID NO: 90226 - DNA, 20 bp, human
gggcggcctcaggagtgatc

SEQ ID NO: 90227 - DNA, 20 bp, human
gccggctgcgagaaagatgg

SEQ ID NO: 90228 - DNA, 20 bp, human
gtccctgcaagactgagcgg

SEQ ID NO: 90229 - DNA, 20 bp, human
ggccccggctgcgagaaaga

SEQ ID NO: 90230 - DNA, 20 bp, human
gccgccctgtcgcccaacgg

SEQ ID NO: 90231 - DNA, 20 bp, human
gtggtcgcgagggccgtgag

SEQ ID NO: 90232 - DNA, 20 bp, human
gcgttccctgcaagactgag

SEQ ID NO: 90233 - DNA, 20 bp, human
ggacggcagagcgggcggac

SEQ ID NO: 90234 - DNA, 20 bp, human
gcagcggacggcagagcggg

SEQ ID NO: 90235 - DNA, 20 bp, human
ggccggttcagataacccag

SEQ ID NO: 90236 - DNA, 20 bp, human
ggctccgagcccgggaaggt

SEQ ID NO: 90237 - DNA, 20 bp, human
gtcggccggcggtagggagg

SEQ ID NO: 90238 - DNA, 20 bp, human
gttcgttgaggggccggaac

SEQ ID NO: 90239 - DNA, 20 bp, human
gagcccgggaggtctgagcc

SEQ ID NO: 90240 - DNA, 20 bp, human
gcgctggtgctgatgcagga

SEQ ID NO: 90241 - DNA, 20 bp, human
gtcgcccggctcagacctcc

SEQ ID NO: 90242 - DNA, 20 bp, human
gcccgcgggaatgtccgagg

SEQ ID NO: 90243 - DNA, 20 bp, human
gcccacccggcgaacaatgg

SEQ ID NO: 90244 - DNA, 20 bp, human
gggatctccgcttcgttgag

SEQ ID NO: 90245 - DNA, 20 bp, human
gtccctaccgccggccgaga

SEQ ID NO: 90246 - DNA, 20 bp, human
ggtgggtcgccggaggtggt

SEQ ID NO: 90247 - DNA, 20 bp, human
gtaagactgtgggtcgccgg

SEQ ID NO: 90248 - DNA, 20 bp, human
ggactgtgggtcgccggagg

SEQ ID NO: 90249 - DNA, 20 bp, human
gcgggcctgagagaggtcaa

SEQ ID NO: 90250 - DNA, 20 bp, human
gggcacacgtgttcacgcgg

SEQ ID NO: 90251 - DNA, 20 bp, human
ggttgaagcgcacactatac

SEQ ID NO: 90252 - DNA, 20 bp, human
ggtcttagcaacagtagcta

SEQ ID NO: 90253 - DNA, 20 bp, human
gacctggcacagcgcagacc

SEQ ID NO: 90254 - DNA, 20 bp, human
gtgtccggaagcaccaacaa

SEQ ID NO: 90255 - DNA, 20 bp, human
gaggtggtgggagttagttt

SEQ ID NO: 90256 - DNA, 20 bp, human
gctgactgcctggcccggga

SEQ ID NO: 90257 - DNA, 20 bp, human
gtggctgcaagcgccgtccc

SEQ ID NO: 90258 - DNA, 20 bp, human
gatcggagcgcgccgcactg

SEQ ID NO: 90259 - DNA, 20 bp, human
gttaggggcgaggaccgggt

SEQ ID NO: 90260 - DNA, 20 bp, human
gtgtcagagcaccttcggag

SEQ ID NO: 90261 - DNA, 20 bp, human
gactcctgggagacctgacc

SEQ ID NO: 90262 - DNA, 20 bp, human
ggacggagctccatgaaagt

SEQ ID NO: 90263 - DNA, 20 bp, human
gcaggcgctattcggagccg

SEQ ID NO: 90264 - DNA, 20 bp, human
ggcctcagcccccagatgtc

SEQ ID NO: 90265 - DNA, 20 bp, human
gggtgctctgacaaccccgc

SEQ ID NO: 90266 - DNA, 20 bp, human
gcatgaaccaggaagcggag

SEQ ID NO: 90267 - DNA, 20 bp, human
gggatgcacatgcgaagtca

SEQ ID NO: 90268 - DNA, 20 bp, human
gctgaaacccaggcgaagga

SEQ ID NO: 90269 - DNA, 20 bp, human
ggtcaaggtcgagatagcga

SEQ ID NO: 90270 - DNA, 20 bp, human
gcagccaggcagccccgcgt

SEQ ID NO: 90271 - DNA, 20 bp, human
ggaaggagggctcgacgtcg

SEQ ID NO: 90272 - DNA, 20 bp, human
gtgatctagaaagacttcgg

SEQ ID NO: 90273 - DNA, 20 bp, human
gatcgggaagacgagagatg

SEQ ID NO: 90274 - DNA, 20 bp, human
ggtcgagccctccttcgcct

SEQ ID NO: 90275 - DNA, 20 bp, human
gcctggtgaacggtgagcag

SEQ ID NO: 90276 - DNA, 20 bp, human
gcagcggcgtggagaggatg

SEQ ID NO: 90277 - DNA, 20 bp, human
gctccgccgagtcaggtcaa

SEQ ID NO: 90278 - DNA, 20 bp, human
gagggagagaagtcaccgaa

SEQ ID NO: 90279 - DNA, 20 bp, human
ggggccctggcaaggagggt

SEQ ID NO: 90280 - DNA, 20 bp, human
gggagctggaggcttcaccg

SEQ ID NO: 90281 - DNA, 20 bp, human
gaaagtaccctcacacccag

SEQ ID NO: 90282 - DNA, 20 bp, human
gttcagggccctggcaagga

SEQ ID NO: 90283 - DNA, 20 bp, human
gagcggcgctgtggttacca

SEQ ID NO: 90284 - DNA, 20 bp, human
gtcctgaggcctgcaaggcg

SEQ ID NO: 90285 - DNA, 20 bp, human
ggctgccgccatgcaagggg

SEQ ID NO: 90286 - DNA, 20 bp, human
gacgcgagtcccaggatccc

SEQ ID NO: 90287 - DNA, 20 bp, human
ggacatgaaagttaagggag

SEQ ID NO: 90288 - DNA, 20 bp, human
gtcgcaggcgcaggagaggt

SEQ ID NO: 90289 - DNA, 20 bp, human
gtgcagagcgcggtgagagt

SEQ ID NO: 90290 - DNA, 20 bp, human
ggcagggtagagaactcgca

SEQ ID NO: 90291 - DNA, 20 bp, human
gtggatccgcaggtgagtag

SEQ ID NO: 90292 - DNA, 20 bp, human
gtagagaactcgcacggctc

SEQ ID NO: 90293 - DNA, 20 bp, human
gacgcgccgggggaatgcag

SEQ ID NO: 90294 - DNA, 20 bp, human
ggggcgcgacagcatcggag

SEQ ID NO: 90295 - DNA, 20 bp, human
gactggccaagcgaaactgg

SEQ ID NO: 90296 - DNA, 20 bp, human
ggactacgcggagggtggga

SEQ ID NO: 90297 - DNA, 20 bp, human
gaggctccgcgaaaccggag

SEQ ID NO: 90298 - DNA, 20 bp, human
ggcaggcggcgggagacgac

SEQ ID NO: 90299 - DNA, 20 bp, human
ggctcccgcgaccctcctct

SEQ ID NO: 90300 - DNA, 20 bp, human
ggggtgggagggattccgag

SEQ ID NO: 90301 - DNA, 20 bp, human
gcgcgaaaccggagcggtgg

SEQ ID NO: 90302 - DNA, 20 bp, human
ggccaccatccctgcggaag

SEQ ID NO: 90303 - DNA, 20 bp, human
gtgagatgggcggggctgta

SEQ ID NO: 90304 - DNA, 20 bp, human
gacgagtaaaaggcgtacat

SEQ ID NO: 90305 - DNA, 20 bp, human
gtgcctgcccccctcctcag

SEQ ID NO: 90306 - DNA, 20 bp, human
gcgcagaccctacccgggat

SEQ ID NO: 90307 - DNA, 20 bp, human
gtgacaagcccatcccgggt

SEQ ID NO: 90308 - DNA, 20 bp, human
ggcagaaggccctgctactg

SEQ ID NO: 90309 - DNA, 20 bp, human
ggccagcgcgtgcaaggaca

SEQ ID NO: 90310 - DNA, 20 bp, human
gacccaaaggcagccttcca

SEQ ID NO: 90311 - DNA, 20 bp, human
gactccccaagggacgtggt

SEQ ID NO: 90312 - DNA, 20 bp, human
gagccttccagggagccctg

SEQ ID NO: 90313 - DNA, 20 bp, human
gcgcgtgcaaggacacggta

SEQ ID NO: 90314 - DNA, 20 bp, human
gctggccagcgagtaggtgg

SEQ ID NO: 90315 - DNA, 20 bp, human
ggaagagcgcagaccctacc

SEQ ID NO: 90316 - DNA, 20 bp, human
gagtgccgggacgaggtgag

SEQ ID NO: 90317 - DNA, 20 bp, human
ggacttccccatggcgacca

SEQ ID NO: 90318 - DNA, 20 bp, human
gggttttgcacccctcacag

SEQ ID NO: 90319 - DNA, 20 bp, human
gatgaggggtcgcagaacac

SEQ ID NO: 90320 - DNA, 20 bp, human
gtcctgttggcgatagcctt

SEQ ID NO: 90321 - DNA, 20 bp, human
ggtatccccgcccctgtgag

SEQ ID NO: 90322 - DNA, 20 bp, human
gcggactggggaggaatgag

SEQ ID NO: 90323 - DNA, 20 bp, human
gcgctgccgtggtcgccatg

SEQ ID NO: 90324 - DNA, 20 bp, human
gcaacaggatcaagtccaag

SEQ ID NO: 90325 - DNA, 20 bp, human
ggccagccggaaacggaacc

SEQ ID NO: 90326 - DNA, 20 bp, human
gtggagtgatgggactgtag

SEQ ID NO: 90327 - DNA, 20 bp, human
gcgcggctgcctgtctgctc

SEQ ID NO: 90328 - DNA, 20 bp, human
gtggtgctgccggagcagac

SEQ ID NO: 90329 - DNA, 20 bp, human
ggggcctgaagtggagacat

SEQ ID NO: 90330 - DNA, 20 bp, human
gagtcctggaaagcaataga

SEQ ID NO: 90331 - DNA, 20 bp, human
ggggcctggagtggagtcat

SEQ ID NO: 90332 - DNA, 20 bp, human
gagtggagtcatgggcctgg

SEQ ID NO: 90333 - DNA, 20 bp, human
gggcagcaccatgtcgctct

SEQ ID NO: 90334 - DNA, 20 bp, human
gggcctatatctcgacctct

SEQ ID NO: 90335 - DNA, 20 bp, human
ggggactgtagtggagatct

SEQ ID NO: 90336 - DNA, 20 bp, human
gtggtgctgtctgtgcagac

SEQ ID NO: 90337 - DNA, 20 bp, human
gagtgcggggatggagatcg

SEQ ID NO: 90338 - DNA, 20 bp, human
gagtcctggaagggcatcga

SEQ ID NO: 90339 - DNA, 20 bp, human
gagtggagatatgggtctgg

SEQ ID NO: 90340 - DNA, 20 bp, human
ggggcctgcagtagagatag

SEQ ID NO: 90341 - DNA, 20 bp, human
gtagagatatgggcttgtag

SEQ ID NO: 90342 - DNA, 20 bp, human
gggagatcggggcccagagt

SEQ ID NO: 90343 - DNA, 20 bp, human
gggcccatatctcaacctcc

SEQ ID NO: 90344 - DNA, 20 bp, human
gggcccataactccacttcc

SEQ ID NO: 90345 - DNA, 20 bp, human
gaggcctatatctccaactc

SEQ ID NO: 90346 - DNA, 20 bp, human
ggagccgagtcactgcgtcc

SEQ ID NO: 90347 - DNA, 20 bp, human
gtcacccacggtcatcatcc

SEQ ID NO: 90348 - DNA, 20 bp, human
gatgccaggatgatgaccgt

SEQ ID NO: 90349 - DNA, 20 bp, human
gaccgtgggtgacatggaca

SEQ ID NO: 90350 - DNA, 20 bp, human
ggcacagagggtgggctgat

SEQ ID NO: 90351 - DNA, 20 bp, human
gatgatgaccgtgggtgaca

SEQ ID NO: 90352 - DNA, 20 bp, human
gggactcaccaagacatgcc

SEQ ID NO: 90353 - DNA, 20 bp, human
gtcatcatcctggcatgtct

SEQ ID NO: 90354 - DNA, 20 bp, human
gagtccagcgtggcgcccag

SEQ ID NO: 90355 - DNA, 20 bp, human
gtgatgggctgaccatggga

SEQ ID NO: 90356 - DNA, 20 bp, human
ggaggggaggtaggagccta

SEQ ID NO: 90357 - DNA, 20 bp, human
gtcgctcatggtcatcatca

SEQ ID NO: 90358 - DNA, 20 bp, human
gagataggaacctggagggg

SEQ ID NO: 90359 - DNA, 20 bp, human
gggagcctagggtggagata

SEQ ID NO: 90360 - DNA, 20 bp, human
gaggaacctggagtggagag

SEQ ID NO: 90361 - DNA, 20 bp, human
ggggaggtaggagcctaggg

SEQ ID NO: 90362 - DNA, 20 bp, human
gagtcccatatctccaccct

SEQ ID NO: 90363 - DNA, 20 bp, human
ggaatagagggagggagcgt

SEQ ID NO: 90364 - DNA, 20 bp, human
gtggagtggagatatggtcc

SEQ ID NO: 90365 - DNA, 20 bp, human
gaggaacctggaggagagat

SEQ ID NO: 90366 - DNA, 20 bp, human
gggcctagaagtggagcgat

SEQ ID NO: 90367 - DNA, 20 bp, human
ggatggagatctggacctgg

SEQ ID NO: 90368 - DNA, 20 bp, human
gggcccatcgctccacttct

SEQ ID NO: 90369 - DNA, 20 bp, human
gggggatggagatctggacc

SEQ ID NO: 90370 - DNA, 20 bp, human
gggggtggagatatgtgcct

SEQ ID NO: 90371 - DNA, 20 bp, human
gggtggagttatgggcctag

SEQ ID NO: 90372 - DNA, 20 bp, human
gggtaaagatatgggcctag

SEQ ID NO: 90373 - DNA, 20 bp, human
gggacctggaggtaaagata

SEQ ID NO: 90374 - DNA, 20 bp, human
ggtgcctggggtggagagat

SEQ ID NO: 90375 - DNA, 20 bp, human
gggcccatatctttacctcc

SEQ ID NO: 90376 - DNA, 20 bp, human
gtggcttggagtgcagatat

SEQ ID NO: 90377 - DNA, 20 bp, human
gaatcgagggagggagcggt

SEQ ID NO: 90378 - DNA, 20 bp, human
gggacctggaattgagatac

SEQ ID NO: 90379 - DNA, 20 bp, human
ggagcggtggggtggagatc

SEQ ID NO: 90380 - DNA, 20 bp, human
gaggcccgtatctcaattcc

SEQ ID NO: 90381 - DNA, 20 bp, human
ggtgctgctgaactgagctg

SEQ ID NO: 90382 - DNA, 20 bp, human
gtggagtggagatataggcc

SEQ ID NO: 90383 - DNA, 20 bp, human
gtggagtggagatattggct

SEQ ID NO: 90384 - DNA, 20 bp, human
gaggcccatatctctacttc

SEQ ID NO: 90385 - DNA, 20 bp, human
gtggagtgcagatatggacc

SEQ ID NO: 90386 - DNA, 20 bp, human
gggcctggaggtgtaaatat

SEQ ID NO: 90387 - DNA, 20 bp, human
gaggcccagatctcccctct

SEQ ID NO: 90388 - DNA, 20 bp, human
ggatggagatctcggcctag

SEQ ID NO: 90389 - DNA, 20 bp, human
gggaggtgtaaatatgggcc

SEQ ID NO: 90390 - DNA, 20 bp, human
ggggcctagaggggagatct

SEQ ID NO: 90391 - DNA, 20 bp, human
gtcgtcagcatggcgtgcgt

SEQ ID NO: 90392 - DNA, 20 bp, human
gcggcctagaggtaaagata

SEQ ID NO: 90393 - DNA, 20 bp, human
gggcccatatctttacctct

SEQ ID NO: 90394 - DNA, 20 bp, human
gagtggagatatgggcctgc

SEQ ID NO: 90395 - DNA, 20 bp, human
gggcccagatctccacctgc

SEQ ID NO: 90396 - DNA, 20 bp, human
gaatcgagggagggagcggt

SEQ ID NO: 90397 - DNA, 20 bp, human
gtggcttggagtgcagatat

SEQ ID NO: 90398 - DNA, 20 bp, human
gggacctggaattgagatac

SEQ ID NO: 90399 - DNA, 20 bp, human
ggagcggtggggtggagatc

SEQ ID NO: 90400 - DNA, 20 bp, human
gaggcccgtatctcaattcc

SEQ ID NO: 90401 - DNA, 20 bp, human
gtggagtggagatataggcc

SEQ ID NO: 90402 - DNA, 20 bp, human
gtggagtggagatattggct

SEQ ID NO: 90403 - DNA, 20 bp, human
gaggcccatatctctacttc

SEQ ID NO: 90404 - DNA, 20 bp, human
gtggagtgcagatatggacc

SEQ ID NO: 90405 - DNA, 20 bp, human
gttggcttggagtgcagata

SEQ ID NO: 90406 - DNA, 20 bp, human
gcagagggcgagggtcggta

SEQ ID NO: 90407 - DNA, 20 bp, human
ggagagtgaggatccagacg

SEQ ID NO: 90408 - DNA, 20 bp, human
gagtgaggatccagacgagg

SEQ ID NO: 90409 - DNA, 20 bp, human
gtggaggtccgagtaaaacg

SEQ ID NO: 90410 - DNA, 20 bp, human
gacgcctgagtccagcctaa

SEQ ID NO: 90411 - DNA, 20 bp, human
gtggctcgctcgccaactcc

SEQ ID NO: 90412 - DNA, 20 bp, human
ggaaagtatcggagagagtg

SEQ ID NO: 90413 - DNA, 20 bp, human
gtccggaaccccggcctcag

SEQ ID NO: 90414 - DNA, 20 bp, human
gcaggaggagaaaaaggtct

SEQ ID NO: 90415 - DNA, 20 bp, human
gactcaggcgtccggaaccc

SEQ ID NO: 90416 - DNA, 20 bp, human
gaggcgtttcagagcgtcag

SEQ ID NO: 90417 - DNA, 20 bp, human
gctcccagagacccaggccg

SEQ ID NO: 90418 - DNA, 20 bp, human
gttcagagcgtcagaggctg

SEQ ID NO: 90419 - DNA, 20 bp, human
ggagacccaggccgcggaac

SEQ ID NO: 90420 - DNA, 20 bp, human
gacgggcctaggagagttcg

SEQ ID NO: 90421 - DNA, 20 bp, human
gctggctgttgcaggaaatg

SEQ ID NO: 90422 - DNA, 20 bp, human
ggactcctgggtcctgaatg

SEQ ID NO: 90423 - DNA, 20 bp, human
gtgctctgggcgcctactgg

SEQ ID NO: 90424 - DNA, 20 bp, human
gggctgcggatgagcagact

SEQ ID NO: 90425 - DNA, 20 bp, human
gtcctgggtcctgaatgagg

SEQ ID NO: 90426 - DNA, 20 bp, human
ggatctcccggttccttgag

SEQ ID NO: 90427 - DNA, 20 bp, human
gcacttggaagagggtgaca

SEQ ID NO: 90428 - DNA, 20 bp, human
gccccgagcagcctgaagga

SEQ ID NO: 90429 - DNA, 20 bp, human
gcggcctggttgcccggcga

SEQ ID NO: 90430 - DNA, 20 bp, human
gcaaggtgcactcaagtgca

SEQ ID NO: 90431 - DNA, 20 bp, human
gagtctgagcctaagaacag

SEQ ID NO: 90432 - DNA, 20 bp, human
gcagccgtcgccgggcaacc

SEQ ID NO: 90433 - DNA, 20 bp, human
gactccgtgtccctaaatgg

SEQ ID NO: 90434 - DNA, 20 bp, human
ggccgggcaaccaggccgag

SEQ ID NO: 90435 - DNA, 20 bp, human
gtcagcgtctcagccagcaa

SEQ ID NO: 90436 - DNA, 20 bp, human
gaggctgtgggcaggaacgt

SEQ ID NO: 90437 - DNA, 20 bp, human
gtcccgaggcggctaagaac

SEQ ID NO: 90438 - DNA, 20 bp, human
gcaatcccggcttcccgagg

SEQ ID NO: 90439 - DNA, 20 bp, human
ggggacattgctgacaatcc

SEQ ID NO: 90440 - DNA, 20 bp, human
gtcggagaagatccattctc

SEQ ID NO: 90441 - DNA, 20 bp, human
ggaatggatcttctccgagt

SEQ ID NO: 90442 - DNA, 20 bp, human
gcgcagcgaaggaaagccgg

SEQ ID NO: 90443 - DNA, 20 bp, human
gagccacccggagggaccca

SEQ ID NO: 90444 - DNA, 20 bp, human
ggcgaacccgagaggaccgg

SEQ ID NO: 90445 - DNA, 20 bp, human
ggaaagccggcggggtaact

SEQ ID NO: 90446 - DNA, 20 bp, human
ggggtgaatgtccagagggt

SEQ ID NO: 90447 - DNA, 20 bp, human
gctgaggtgacgagaccacc

SEQ ID NO: 90448 - DNA, 20 bp, human
gacacgcttggatggaccta

SEQ ID NO: 90449 - DNA, 20 bp, human
ggatgcatccaggcaggcaa

SEQ ID NO: 90450 - DNA, 20 bp, human
gctccagtcacagagcccgg

SEQ ID NO: 90451 - DNA, 20 bp, human
ggagtctggcggagcctctg

SEQ ID NO: 90452 - DNA, 20 bp, human
gggacctagggaaccgctcg

SEQ ID NO: 90453 - DNA, 20 bp, human
gggtgacgagaccacctggc

SEQ ID NO: 90454 - DNA, 20 bp, human
ggtccatccaagcgtgtctg

SEQ ID NO: 90455 - DNA, 20 bp, human
gggggctcttgagagcaatg

SEQ ID NO: 90456 - DNA, 20 bp, human
gtggggtccgcagggtccag

SEQ ID NO: 90457 - DNA, 20 bp, human
gcgcctgtggaactcaggaa

SEQ ID NO: 90458 - DNA, 20 bp, human
ggcacctgctgccgtcccgg

SEQ ID NO: 90459 - DNA, 20 bp, human
gggctgcgcctgtggaactc

SEQ ID NO: 90460 - DNA, 20 bp, human
gagccaaggcgcgaactcta

SEQ ID NO: 90461 - DNA, 20 bp, human
ggcagctgtgctgggctcgg

SEQ ID NO: 90462 - DNA, 20 bp, human
gtcagcgccgcgaagaagag

SEQ ID NO: 90463 - DNA, 20 bp, human
gggtccgcatcggcttgtgg

SEQ ID NO: 90464 - DNA, 20 bp, human
gcactcaccgatgtagaagt

SEQ ID NO: 90465 - DNA, 20 bp, human
gctctaaggcctgtgaatat

SEQ ID NO: 90466 - DNA, 20 bp, human
gccgcgagcgcctctcatcg

SEQ ID NO: 90467 - DNA, 20 bp, human
gcccggaggctggaacgcac

SEQ ID NO: 90468 - DNA, 20 bp, human
gtgcgatgggatccgagctc

SEQ ID NO: 90469 - DNA, 20 bp, human
gtcgcagctaccgcgatgag

SEQ ID NO: 90470 - DNA, 20 bp, human
gtggaacgtggaccagagct

SEQ ID NO: 90471 - DNA, 20 bp, human
gttgggcgagagctggaacg

SEQ ID NO: 90472 - DNA, 20 bp, human
gtccgccccccgcgcaacgt

SEQ ID NO: 90473 - DNA, 20 bp, human
gtggcgggtaccaccctccc

SEQ ID NO: 90474 - DNA, 20 bp, human
gagggcgccggagagtccga

SEQ ID NO: 90475 - DNA, 20 bp, human
ggggccacctggagtctccc

SEQ ID NO: 90476 - DNA, 20 bp, human
gagaagcgctgcgggaagca

SEQ ID NO: 90477 - DNA, 20 bp, human
gcatattgcacgaacagcgg

SEQ ID NO: 90478 - DNA, 20 bp, human
ggaggctccaaacttgacac

SEQ ID NO: 90479 - DNA, 20 bp, human
gcccgcagcgcttctagtct

SEQ ID NO: 90480 - DNA, 20 bp, human
ggccgagactagaagcgctg

SEQ ID NO: 90481 - DNA, 20 bp, human
gcggcagatagtccacgcat

SEQ ID NO: 90482 - DNA, 20 bp, human
ggtgagacaagaggatgcgg

SEQ ID NO: 90483 - DNA, 20 bp, human
ggcctgccgggtgagacaag

SEQ ID NO: 90484 - DNA, 20 bp, human
gcagcatattgcacgaacag

SEQ ID NO: 90485 - DNA, 20 bp, human
gcgaggcggcgagcgaagcc

SEQ ID NO: 90486 - DNA, 20 bp, human
gccagcagcagcgacagcga

SEQ ID NO: 90487 - DNA, 20 bp, human
gccgcctaccagaccgaggg

SEQ ID NO: 90488 - DNA, 20 bp, human
gtcgctggctacgtccccgg

SEQ ID NO: 90489 - DNA, 20 bp, human
gcagccgccctcggtctggt

SEQ ID NO: 90490 - DNA, 20 bp, human
ggcgcagcgcctccgtgtcg

SEQ ID NO: 90491 - DNA, 20 bp, human
gccccgacgaagccgctcca

SEQ ID NO: 90492 - DNA, 20 bp, human
gctgccagccgccctcggtc

SEQ ID NO: 90493 - DNA, 20 bp, human
gcggcttcgtcggggagaaa

SEQ ID NO: 90494 - DNA, 20 bp, human
gagcactcgcgcccacgaga

SEQ ID NO: 90495 - DNA, 20 bp, human
ggctgctctcagaggacgcg

SEQ ID NO: 90496 - DNA, 20 bp, human
ggataagacagtccagcagt

SEQ ID NO: 90497 - DNA, 20 bp, human
ggagatcctgccgcacagcc

SEQ ID NO: 90498 - DNA, 20 bp, human
gaagacagtccagcagttgg

SEQ ID NO: 90499 - DNA, 20 bp, human
gtggagatggaagagctata

SEQ ID NO: 90500 - DNA, 20 bp, human
gtatcagccctggattttat

SEQ ID NO: 90501 - DNA, 20 bp, human
ggttggtggcaaatgaagcc

SEQ ID NO: 90502 - DNA, 20 bp, human
gttccatcggggaaaagcct

SEQ ID NO: 90503 - DNA, 20 bp, human
gattgcaagtggaagggagt

SEQ ID NO: 90504 - DNA, 20 bp, human
gtggagcattgcaagtggaa

SEQ ID NO: 90505 - DNA, 20 bp, human
gtggaaaaggaccttctata

SEQ ID NO: 90506 - DNA, 20 bp, human
ggcaggcggccgagcgggac

SEQ ID NO: 90507 - DNA, 20 bp, human
gtaccggggtgggaacggag

SEQ ID NO: 90508 - DNA, 20 bp, human
gcggccggggcggtgaactg

SEQ ID NO: 90509 - DNA, 20 bp, human
gaggggccgggacccaaacc

SEQ ID NO: 90510 - DNA, 20 bp, human
gctggggcgggtaccggggt

SEQ ID NO: 90511 - DNA, 20 bp, human
ggggactggctgggtcggct

SEQ ID NO: 90512 - DNA, 20 bp, human
gcgacccagccagtcccgct

SEQ ID NO: 90513 - DNA, 20 bp, human
gtgaactggggcgggtaccg

SEQ ID NO: 90514 - DNA, 20 bp, human
gactgagacgccattttcgg

SEQ ID NO: 90515 - DNA, 20 bp, human
gagaggagcgggacagggac

SEQ ID NO: 90516 - DNA, 20 bp, human
gcgggtccgggtgaagcggg

SEQ ID NO: 90517 - DNA, 20 bp, human
ggtgcgggtccgggtgaagc

SEQ ID NO: 90518 - DNA, 20 bp, human
gggaggcgctcccactagag

SEQ ID NO: 90519 - DNA, 20 bp, human
ggtcggctcgtcgggaggat

SEQ ID NO: 90520 - DNA, 20 bp, human
gacaggtatggggaacgtgg

SEQ ID NO: 90521 - DNA, 20 bp, human
gcaaaaggcaggccaagccg

SEQ ID NO: 90522 - DNA, 20 bp, human
ggctggcccgatcctcccac

SEQ ID NO: 90523 - DNA, 20 bp, human
ggtcgggaggatgggctccg

SEQ ID NO: 90524 - DNA, 20 bp, human
gctaggggaggggtcgtcgt

SEQ ID NO: 90525 - DNA, 20 bp, human
gtcccgacgagccgaccctg

SEQ ID NO: 90526 - DNA, 20 bp, human
ggccgggcgtctgggacctc

SEQ ID NO: 90527 - DNA, 20 bp, human
gcccggagagccccaggacg

SEQ ID NO: 90528 - DNA, 20 bp, human
gtgggcaggccagggtaagt

SEQ ID NO: 90529 - DNA, 20 bp, human
gtgcggggctgggccacgat

SEQ ID NO: 90530 - DNA, 20 bp, human
gcagccaggcctccagatcc

SEQ ID NO: 90531 - DNA, 20 bp, human
ggacgcgactgatcgcagtg

SEQ ID NO: 90532 - DNA, 20 bp, human
ggagccgcccgcggtcaggt

SEQ ID NO: 90533 - DNA, 20 bp, human
ggcacccacctgaccgcggg

SEQ ID NO: 90534 - DNA, 20 bp, human
gaggccagggtaagttggtg

SEQ ID NO: 90535 - DNA, 20 bp, human
gggagagccgcgatgatggg

SEQ ID NO: 90536 - DNA, 20 bp, human
ggcaagagcggcagccacac

SEQ ID NO: 90537 - DNA, 20 bp, human
gggggcagtaccggcaagag

SEQ ID NO: 90538 - DNA, 20 bp, human
ggcgctggagtgggtctcct

SEQ ID NO: 90539 - DNA, 20 bp, human
gaggtcactgagtcagtcgg

SEQ ID NO: 90540 - DNA, 20 bp, human
gtctgagaggaatcaccgta

SEQ ID NO: 90541 - DNA, 20 bp, human
ggaatgggaggtctgctgaa

SEQ ID NO: 90542 - DNA, 20 bp, human
ggccgggtcgcaaggaaccg

SEQ ID NO: 90543 - DNA, 20 bp, human
gggatttaaaggggcagtac

SEQ ID NO: 90544 - DNA, 20 bp, human
gagctccagcgaggacgtgg

SEQ ID NO: 90545 - DNA, 20 bp, human
gagccacaccggcagattgc

SEQ ID NO: 90546 - DNA, 20 bp, human
ggcggtcagtgtgctgatgg

SEQ ID NO: 90547 - DNA, 20 bp, human
ggctgtgatagccccttcga

SEQ ID NO: 90548 - DNA, 20 bp, human
gggccacagtcacagatctt

SEQ ID NO: 90549 - DNA, 20 bp, human
gagaggaggcttgaggccca

SEQ ID NO: 90550 - DNA, 20 bp, human
gagagttcacgaggcagccg

SEQ ID NO: 90551 - DNA, 20 bp, human
gatggagggcaaggcggtct

SEQ ID NO: 90552 - DNA, 20 bp, human
gtagaaaacgaaggtagcct

SEQ ID NO: 90553 - DNA, 20 bp, human
gggtacgctcagtccaggag

SEQ ID NO: 90554 - DNA, 20 bp, human
gagagacttaaccaggactg

SEQ ID NO: 90555 - DNA, 20 bp, human
gtagaaggtggggtctaggt

SEQ ID NO: 90556 - DNA, 20 bp, human
ggcgccggccaatgggctcg

SEQ ID NO: 90557 - DNA, 20 bp, human
gtgtgtgaggcgccggccaa

SEQ ID NO: 90558 - DNA, 20 bp, human
gtggctgcttggccacagac

SEQ ID NO: 90559 - DNA, 20 bp, human
ggatcttcagacagggacag

SEQ ID NO: 90560 - DNA, 20 bp, human
gctccgcatggagacccgag

SEQ ID NO: 90561 - DNA, 20 bp, human
ggtctccgtgcgcccgtctg

SEQ ID NO: 90562 - DNA, 20 bp, human
gccgccggcggcaagctgac

SEQ ID NO: 90563 - DNA, 20 bp, human
gttgctctagatgtactgag

SEQ ID NO: 90564 - DNA, 20 bp, human
ggccctctcgggtctccatg

SEQ ID NO: 90565 - DNA, 20 bp, human
gtgacgagcgggggaggagt

SEQ ID NO: 90566 - DNA, 20 bp, human
gaagagagcgtgagctggga

SEQ ID NO: 90567 - DNA, 20 bp, human
ggatgacaaaataacagcac

SEQ ID NO: 90568 - DNA, 20 bp, human
gtggggcgcgaggcaggaaa

SEQ ID NO: 90569 - DNA, 20 bp, human
ggggaaagagagcgtgagct

SEQ ID NO: 90570 - DNA, 20 bp, human
ggtcatcaagcagttcttta

SEQ ID NO: 90571 - DNA, 20 bp, human
gtccattgcagcttacataa

SEQ ID NO: 90572 - DNA, 20 bp, human
gggaaagggagtggggcgcg

SEQ ID NO: 90573 - DNA, 20 bp, human
gtactttgaccaaacgagtc

SEQ ID NO: 90574 - DNA, 20 bp, human
ggcctttatgtaagctgcaa

SEQ ID NO: 90575 - DNA, 20 bp, human
gaaaactgtccagactcgtt

SEQ ID NO: 90576 - DNA, 20 bp, human
ggcgcgcgcagtgagtggtg

SEQ ID NO: 90577 - DNA, 20 bp, human
gcgcagcagcggccgcacgt

SEQ ID NO: 90578 - DNA, 20 bp, human
gagcccgcccaggcccctac

SEQ ID NO: 90579 - DNA, 20 bp, human
ggtgccggccgcaggagctc

SEQ ID NO: 90580 - DNA, 20 bp, human
gcagacgagtagtcccgccg

SEQ ID NO: 90581 - DNA, 20 bp, human
gccgtcgggcgggttaagag

SEQ ID NO: 90582 - DNA, 20 bp, human
gtaggggccggggcaacgac

SEQ ID NO: 90583 - DNA, 20 bp, human
gcctaagcgtcgcgacctgg

SEQ ID NO: 90584 - DNA, 20 bp, human
gcgtccggctcacaggaccg

SEQ ID NO: 90585 - DNA, 20 bp, human
gaacccggagctcctgcggc

SEQ ID NO: 90586 - DNA, 20 bp, human
ggccccaccccggggctcgc

SEQ ID NO: 90587 - DNA, 20 bp, human
ggccccggggtaattcgatg

SEQ ID NO: 90588 - DNA, 20 bp, human
gaaatgtagggtgggccggt

SEQ ID NO: 90589 - DNA, 20 bp, human
gccgcctcctaatcctcggg

SEQ ID NO: 90590 - DNA, 20 bp, human
gggctccccacactagaccg

SEQ ID NO: 90591 - DNA, 20 bp, human
gagcccgcctcctaatcctc

SEQ ID NO: 90592 - DNA, 20 bp, human
gtcctaatcctcgggcggag

SEQ ID NO: 90593 - DNA, 20 bp, human
ggccgctccgcccgaggatt

SEQ ID NO: 90594 - DNA, 20 bp, human
gctcgggcggagcggctcgg

SEQ ID NO: 90595 - DNA, 20 bp, human
gcgagccccggtctagtgtg

SEQ ID NO: 90596 - DNA, 20 bp, human
ggcggcgaagtggtccacat

SEQ ID NO: 90597 - DNA, 20 bp, human
gggaccacctcgccaagtcg

SEQ ID NO: 90598 - DNA, 20 bp, human
ggcgaagtggtccacatagg

SEQ ID NO: 90599 - DNA, 20 bp, human
ggcggctcgacatggacacg

SEQ ID NO: 90600 - DNA, 20 bp, human
gaagtggtccacataggcgg

SEQ ID NO: 90601 - DNA, 20 bp, human
gcggttctaaggatgccgag

SEQ ID NO: 90602 - DNA, 20 bp, human
gatgccgagcggcaacgtta

SEQ ID NO: 90603 - DNA, 20 bp, human
ggcgcgccgcggctccgtgt

SEQ ID NO: 90604 - DNA, 20 bp, human
gcgcggcgcgccctctcctc

SEQ ID NO: 90605 - DNA, 20 bp, human
gggtccccgcgcggcgtcag

SEQ ID NO: 90606 - DNA, 20 bp, human
gggctcctgggagaactcgg

SEQ ID NO: 90607 - DNA, 20 bp, human
gccgccggcgagcgagaagc

SEQ ID NO: 90608 - DNA, 20 bp, human
gacggagcacgggatcgggt

SEQ ID NO: 90609 - DNA, 20 bp, human
gctggacggagcacgggatc

SEQ ID NO: 90610 - DNA, 20 bp, human
ggggtcggagaagccggacg

SEQ ID NO: 90611 - DNA, 20 bp, human
gtgcgcggcagctctggcga

SEQ ID NO: 90612 - DNA, 20 bp, human
gtcggagcacggggtctgga

SEQ ID NO: 90613 - DNA, 20 bp, human
gctcggcggcgaagtagtcc

SEQ ID NO: 90614 - DNA, 20 bp, human
gcggggtctggacggagcac

SEQ ID NO: 90615 - DNA, 20 bp, human
gtcgggagcgcagaccgccg

SEQ ID NO: 90616 - DNA, 20 bp, human
gcgagccagcgcaggacccg

SEQ ID NO: 90617 - DNA, 20 bp, human
ggccggccctcccatatggt

SEQ ID NO: 90618 - DNA, 20 bp, human
ggcgccggtgcccaccatat

SEQ ID NO: 90619 - DNA, 20 bp, human
gggcggctagactctcggtc

SEQ ID NO: 90620 - DNA, 20 bp, human
gcgcggccccgggtgatcag

SEQ ID NO: 90621 - DNA, 20 bp, human
ggctcccgcgcagctctcgg

SEQ ID NO: 90622 - DNA, 20 bp, human
ggcgtgcgccaagttcaggt

SEQ ID NO: 90623 - DNA, 20 bp, human
ggcctggccgggcgattccg

SEQ ID NO: 90624 - DNA, 20 bp, human
gcgagccgcgggtcctgcgc

SEQ ID NO: 90625 - DNA, 20 bp, human
gggctagactctcggtccgg

SEQ ID NO: 90626 - DNA, 20 bp, human
ggcggcggctgctcgagtgc

SEQ ID NO: 90627 - DNA, 20 bp, human
ggcggcgtccgtccggccgg

SEQ ID NO: 90628 - DNA, 20 bp, human
gccgccgacatgccgagcaa

SEQ ID NO: 90629 - DNA, 20 bp, human
ggtccgggaagggacagcgg

SEQ ID NO: 90630 - DNA, 20 bp, human
ggagatggccatgagcacgt

SEQ ID NO: 90631 - DNA, 20 bp, human
ggcggctgctcgagtgcggg

SEQ ID NO: 90632 - DNA, 20 bp, human
gggagcggcgtccgtccggc

SEQ ID NO: 90633 - DNA, 20 bp, human
gggcgggagcggcgtccgtc

SEQ ID NO: 90634 - DNA, 20 bp, human
ggctttggcgcagtccggga

SEQ ID NO: 90635 - DNA, 20 bp, human
ggacccggagccgccccggg

SEQ ID NO: 90636 - DNA, 20 bp, human
ggacagggaaccagccacca

SEQ ID NO: 90637 - DNA, 20 bp, human
gccgtacatgaagactgggt

SEQ ID NO: 90638 - DNA, 20 bp, human
gagggaagcagaaacccgag

SEQ ID NO: 90639 - DNA, 20 bp, human
gcgggcgggcccaggctagg

SEQ ID NO: 90640 - DNA, 20 bp, human
gcggcgtcgcaggcgggtat

SEQ ID NO: 90641 - DNA, 20 bp, human
gcccgcctgcgacgccgtgg

SEQ ID NO: 90642 - DNA, 20 bp, human
gtaattggagccctactaag

SEQ ID NO: 90643 - DNA, 20 bp, human
gcgaggggtagaaatccgag

SEQ ID NO: 90644 - DNA, 20 bp, human
gtggagccctactaagtggt

SEQ ID NO: 90645 - DNA, 20 bp, human
gactgctgggcgaacattgt

SEQ ID NO: 90646 - DNA, 20 bp, human
ggacccggggagaaaggacg

SEQ ID NO: 90647 - DNA, 20 bp, human
gggacggggacaccggtgag

SEQ ID NO: 90648 - DNA, 20 bp, human
gcgcgcgccgaacccgagtc

SEQ ID NO: 90649 - DNA, 20 bp, human
ggccagcgctgcgggcgaca

SEQ ID NO: 90650 - DNA, 20 bp, human
ggcgccgaacccgagtccgg

SEQ ID NO: 90651 - DNA, 20 bp, human
ggctcggggtagtagaacgt

SEQ ID NO: 90652 - DNA, 20 bp, human
ggtgccgccggactcgggtt

SEQ ID NO: 90653 - DNA, 20 bp, human
ggggactgcagactcaggag

SEQ ID NO: 90654 - DNA, 20 bp, human
ggcggggcggccgggaccgt

SEQ ID NO: 90655 - DNA, 20 bp, human
gcgggcggggacggctctgt

SEQ ID NO: 90656 - DNA, 20 bp, human
gctgcgggcttgggaaagtg

SEQ ID NO: 90657 - DNA, 20 bp, human
ggggctggcggggtaagtag

SEQ ID NO: 90658 - DNA, 20 bp, human
gcgggcttgggaaagtgtgg

SEQ ID NO: 90659 - DNA, 20 bp, human
gttaccccgccagccccggg

SEQ ID NO: 90660 - DNA, 20 bp, human
gccgggcagtcacatgacgc

SEQ ID NO: 90661 - DNA, 20 bp, human
ggttcgcggtgaaaagtgag

SEQ ID NO: 90662 - DNA, 20 bp, human
gtcgctctgcgagcctcccg

SEQ ID NO: 90663 - DNA, 20 bp, human
gctacacttagccggggtgg

SEQ ID NO: 90664 - DNA, 20 bp, human
gaagtagaggctgggacccg

SEQ ID NO: 90665 - DNA, 20 bp, human
gctccaggcagcccgtatcg

SEQ ID NO: 90666 - DNA, 20 bp, human
gcgcggagctgcgaactggt

SEQ ID NO: 90667 - DNA, 20 bp, human
gggagctgcgaactggtcgg

SEQ ID NO: 90668 - DNA, 20 bp, human
ggagagaacgaacgtgtctg

SEQ ID NO: 90669 - DNA, 20 bp, human
gagtgctgccgtgggcgcag

SEQ ID NO: 90670 - DNA, 20 bp, human
gggcgagtaagtaggtccgg

SEQ ID NO: 90671 - DNA, 20 bp, human
gcacggcagccagtctcacc

SEQ ID NO: 90672 - DNA, 20 bp, human
gggggcgggggagggtcact

SEQ ID NO: 90673 - DNA, 20 bp, human
gtctctggtcgggaaactgc

SEQ ID NO: 90674 - DNA, 20 bp, human
gcaaggcgagtaagtaggtc

SEQ ID NO: 90675 - DNA, 20 bp, human
gagggtcactcggcggctcc

SEQ ID NO: 90676 - DNA, 20 bp, human
ggactgcaccgcccagacat

SEQ ID NO: 90677 - DNA, 20 bp, human
gcgccgccgccaggtcatag

SEQ ID NO: 90678 - DNA, 20 bp, human
ggctgacgctgacgaggaca

SEQ ID NO: 90679 - DNA, 20 bp, human
gtggcagggccgctgctcga

SEQ ID NO: 90680 - DNA, 20 bp, human
ggacgctgacgaggacacgg

SEQ ID NO: 90681 - DNA, 20 bp, human
gctcgacggcgacgacgaag

SEQ ID NO: 90682 - DNA, 20 bp, human
gtcttcttcgacccgggagt

SEQ ID NO: 90683 - DNA, 20 bp, human
gggcggccgggaagcactgg

SEQ ID NO: 90684 - DNA, 20 bp, human
gaccagtccccatgtctggg

SEQ ID NO: 90685 - DNA, 20 bp, human
gctgaccagtccccatgtct

SEQ ID NO: 90686 - DNA, 20 bp, human
gagagcctgagagcacggtg

SEQ ID NO: 90687 - DNA, 20 bp, human
gctctcgcggaggtcggcgg

SEQ ID NO: 90688 - DNA, 20 bp, human
ggttctctcgcggaggtcgg

SEQ ID NO: 90689 - DNA, 20 bp, human
ggattcgcggcgcccagcac

SEQ ID NO: 90690 - DNA, 20 bp, human
ggggtggactcctcagacag

SEQ ID NO: 90691 - DNA, 20 bp, human
ggcttgagctgcgcgaacac

SEQ ID NO: 90692 - DNA, 20 bp, human
gtgcgctcgcggttctctcg

SEQ ID NO: 90693 - DNA, 20 bp, human
ggcgacgcggcgctcttccc

SEQ ID NO: 90694 - DNA, 20 bp, human
gcgagtgcccatggctacaa

SEQ ID NO: 90695 - DNA, 20 bp, human
ggtgcttcagctcctcgccg

SEQ ID NO: 90696 - DNA, 20 bp, human
gggccccgcgctgtcaccgg

SEQ ID NO: 90697 - DNA, 20 bp, human
ggccagtactcctccagaga

SEQ ID NO: 90698 - DNA, 20 bp, human
gagcctggaggatcgatcgg

SEQ ID NO: 90699 - DNA, 20 bp, human
gctggaggatcgatcggcgg

SEQ ID NO: 90700 - DNA, 20 bp, human
gagcggaccgcagagagcac

SEQ ID NO: 90701 - DNA, 20 bp, human
gctgggccccgcgctgtcac

SEQ ID NO: 90702 - DNA, 20 bp, human
gcggcgcccgcagggaaccg

SEQ ID NO: 90703 - DNA, 20 bp, human
ggctcgcagagacgcccggc

SEQ ID NO: 90704 - DNA, 20 bp, human
ggccggtctcgtgcacgatc

SEQ ID NO: 90705 - DNA, 20 bp, human
gcctggaagatgctgcacat

SEQ ID NO: 90706 - DNA, 20 bp, human
gtgctgccaggtctcctcca

SEQ ID NO: 90707 - DNA, 20 bp, human
gcgagcgcaagggacaggga

SEQ ID NO: 90708 - DNA, 20 bp, human
gaccatccctggaggagacc

SEQ ID NO: 90709 - DNA, 20 bp, human
gcagctcgtggatcaggaag

SEQ ID NO: 90710 - DNA, 20 bp, human
gggctctgccaggcatctag

SEQ ID NO: 90711 - DNA, 20 bp, human
gaggaggaagtgccacacaa

SEQ ID NO: 90712 - DNA, 20 bp, human
gggccctgaggctgacggtc

SEQ ID NO: 90713 - DNA, 20 bp, human
gtgctgccgggcaaaacggg

SEQ ID NO: 90714 - DNA, 20 bp, human
ggagtacgtgaggacctccc

SEQ ID NO: 90715 - DNA, 20 bp, human
gcccttcccgaactccccac

SEQ ID NO: 90716 - DNA, 20 bp, human
gcctgctaggcccaaaggag

SEQ ID NO: 90717 - DNA, 20 bp, human
gctctctgggcaacctgagt

SEQ ID NO: 90718 - DNA, 20 bp, human
gctggccctgctaggcccaa

SEQ ID NO: 90719 - DNA, 20 bp, human
gatcgtgaggactccaccta

SEQ ID NO: 90720 - DNA, 20 bp, human
ggagaggtgtgactatcgtg

SEQ ID NO: 90721 - DNA, 20 bp, human
ggtgaggactccacctaggg

SEQ ID NO: 90722 - DNA, 20 bp, human
gtaaggaactccaccctagg

SEQ ID NO: 90723 - DNA, 20 bp, human
gaactcgtgcgggtcctctg

SEQ ID NO: 90724 - DNA, 20 bp, human
gggcttggccggaactgaat

SEQ ID NO: 90725 - DNA, 20 bp, human
gtttaaaaggagagggccgg

SEQ ID NO: 90726 - DNA, 20 bp, human
gtgcggaccggccggagcag

SEQ ID NO: 90727 - DNA, 20 bp, human
gccggttacgtaaagatgag

SEQ ID NO: 90728 - DNA, 20 bp, human
gagagaatgccggaacggtg

SEQ ID NO: 90729 - DNA, 20 bp, human
gcaagggagccggctcagag

SEQ ID NO: 90730 - DNA, 20 bp, human
gatgccggaacggtgcggac

SEQ ID NO: 90731 - DNA, 20 bp, human
ggagcaagagaatgccggaa

SEQ ID NO: 90732 - DNA, 20 bp, human
gcggccggtccgcaccgttc

SEQ ID NO: 90733 - DNA, 20 bp, human
gaggctgtaggggtagcacg

SEQ ID NO: 90734 - DNA, 20 bp, human
gccgactcgcaggagcgccg

SEQ ID NO: 90735 - DNA, 20 bp, human
gagaggtgcgtctagaactg

SEQ ID NO: 90736 - DNA, 20 bp, human
gttcgtgcgtggagcagtcg

SEQ ID NO: 90737 - DNA, 20 bp, human
gccagcgacggcgcgaatgg

SEQ ID NO: 90738 - DNA, 20 bp, human
gaattgctggcaaagagggg

SEQ ID NO: 90739 - DNA, 20 bp, human
ggcaagcggcgggccagcga

SEQ ID NO: 90740 - DNA, 20 bp, human
gtgggccgcagcctcgggag

SEQ ID NO: 90741 - DNA, 20 bp, human
gactcgcgccgggagaccct

SEQ ID NO: 90742 - DNA, 20 bp, human
ggccagcaattcagtaacca

SEQ ID NO: 90743 - DNA, 20 bp, human
gctttgcattgggcaaaccg

SEQ ID NO: 90744 - DNA, 20 bp, human
ggttgtggcgcggcaagcgg

SEQ ID NO: 90745 - DNA, 20 bp, human
ggggccagcgacggcgcgaa

SEQ ID NO: 90746 - DNA, 20 bp, human
gcctgacccagcggaaccag

SEQ ID NO: 90747 - DNA, 20 bp, human
gacgcatagcagagggactg

SEQ ID NO: 90748 - DNA, 20 bp, human
gcccggagagttgcacgaag

SEQ ID NO: 90749 - DNA, 20 bp, human
ggtcaggcgctgacgggacc

SEQ ID NO: 90750 - DNA, 20 bp, human
gccgctgggtcaggcgctga

SEQ ID NO: 90751 - DNA, 20 bp, human
gcaggccccacgcatagcag

SEQ ID NO: 90752 - DNA, 20 bp, human
gcacctgccaggtgagtcgt

SEQ ID NO: 90753 - DNA, 20 bp, human
gaggctccgctggttccgct

SEQ ID NO: 90754 - DNA, 20 bp, human
gccctgtcccacgactcacc

SEQ ID NO: 90755 - DNA, 20 bp, human
gaccgcttcgtgcaactctc

SEQ ID NO: 90756 - DNA, 20 bp, human
ggggcagacgggctgcaata

SEQ ID NO: 90757 - DNA, 20 bp, human
gccgtggactgcaggaggcg

SEQ ID NO: 90758 - DNA, 20 bp, human
gatagggagccggcccgacg

SEQ ID NO: 90759 - DNA, 20 bp, human
ggcggcgcgaggcaaggaaa

SEQ ID NO: 90760 - DNA, 20 bp, human
gcgggactcggggcactgca

SEQ ID NO: 90761 - DNA, 20 bp, human
ggaagcggtccgcgtcgggc

SEQ ID NO: 90762 - DNA, 20 bp, human
gagggcctgcatcgactcta

SEQ ID NO: 90763 - DNA, 20 bp, human
gatggactcatagctctcga

SEQ ID NO: 90764 - DNA, 20 bp, human
gtccggccgcggcgtaaaca

SEQ ID NO: 90765 - DNA, 20 bp, human
ggcagggaagcggtccgcgt

SEQ ID NO: 90766 - DNA, 20 bp, human
gtaatggggaaagcagggct

SEQ ID NO: 90767 - DNA, 20 bp, human
gccgccggaagaaccgagct

SEQ ID NO: 90768 - DNA, 20 bp, human
gtggggactaaggcgtcggt

SEQ ID NO: 90769 - DNA, 20 bp, human
gtaggggaggccggaatgtc

SEQ ID NO: 90770 - DNA, 20 bp, human
gtacctgccaggccgagccg

SEQ ID NO: 90771 - DNA, 20 bp, human
gtcgttggggactaaggcgt

SEQ ID NO: 90772 - DNA, 20 bp, human
gagggcaagggagaattagg

SEQ ID NO: 90773 - DNA, 20 bp, human
gcaggcagctcgaggacccg

SEQ ID NO: 90774 - DNA, 20 bp, human
gttggcgcgcaacgggttct

SEQ ID NO: 90775 - DNA, 20 bp, human
gagggagctagggggatgat

SEQ ID NO: 90776 - DNA, 20 bp, human
gggcatgttgctgtaaccag

SEQ ID NO: 90777 - DNA, 20 bp, human
gggtgaagtctgccatccgt

SEQ ID NO: 90778 - DNA, 20 bp, human
ggctgtaaccagtggcccag

SEQ ID NO: 90779 - DNA, 20 bp, human
gcggtggacagtgcacctgg

SEQ ID NO: 90780 - DNA, 20 bp, human
gggatggcagacttcaccgg

SEQ ID NO: 90781 - DNA, 20 bp, human
gagtggcccaggggatgtta

SEQ ID NO: 90782 - DNA, 20 bp, human
ggtccaccgtaacatcccct

SEQ ID NO: 90783 - DNA, 20 bp, human
gtgggtccccacatcagggt

SEQ ID NO: 90784 - DNA, 20 bp, human
gggcccaggggatgttacgg

SEQ ID NO: 90785 - DNA, 20 bp, human
gagcgcatgtagggtaccac

SEQ ID NO: 90786 - DNA, 20 bp, human
gcaagccgcgacgggacacc

SEQ ID NO: 90787 - DNA, 20 bp, human
gccggcaagatgggcaagaa

SEQ ID NO: 90788 - DNA, 20 bp, human
ggcttgggacccggcaagat

SEQ ID NO: 90789 - DNA, 20 bp, human
gcacgtggagactcaggagg

SEQ ID NO: 90790 - DNA, 20 bp, human
gccgggtcccaagccgcgac

SEQ ID NO: 90791 - DNA, 20 bp, human
gaaagcaagcacgttaaagg

SEQ ID NO: 90792 - DNA, 20 bp, human
gagaagcggacagacacacg

SEQ ID NO: 90793 - DNA, 20 bp, human
gtcggaaacaggtgctcgtg

SEQ ID NO: 90794 - DNA, 20 bp, human
gctttcctggtgtcccgtcg

SEQ ID NO: 90795 - DNA, 20 bp, human
gaagcgctcgcggaaggagg

SEQ ID NO: 90796 - DNA, 20 bp, human
gtgcccaagcgggggaaatg

SEQ ID NO: 90797 - DNA, 20 bp, human
gccaagcgggggaaatgggg

SEQ ID NO: 90798 - DNA, 20 bp, human
gagcgggctgaagcaccaca

SEQ ID NO: 90799 - DNA, 20 bp, human
ggatatgcagctgaccggca

SEQ ID NO: 90800 - DNA, 20 bp, human
gccccgtgaccaggacatag

SEQ ID NO: 90801 - DNA, 20 bp, human
gcggttcgctgcccaagcgg

SEQ ID NO: 90802 - DNA, 20 bp, human
gcctgagggggccaagacgt

SEQ ID NO: 90803 - DNA, 20 bp, human
gggagaagcatgttccccag

SEQ ID NO: 90804 - DNA, 20 bp, human
gctacaggctgtacaagtcg

SEQ ID NO: 90805 - DNA, 20 bp, human
ggtccagctggggagctctt

SEQ ID NO: 90806 - DNA, 20 bp, human
gtcgcccacggaaggatcct

SEQ ID NO: 90807 - DNA, 20 bp, human
gggctttgacccgtcagctg

SEQ ID NO: 90808 - DNA, 20 bp, human
ggagctgggggatgaagcca

SEQ ID NO: 90809 - DNA, 20 bp, human
ggttacccaggatccttccg

SEQ ID NO: 90810 - DNA, 20 bp, human
gttgggctgaggctgaactt

SEQ ID NO: 90811 - DNA, 20 bp, human
gtggagctgaagttaagact

SEQ ID NO: 90812 - DNA, 20 bp, human
gatcccctgccccagctgac

SEQ ID NO: 90813 - DNA, 20 bp, human
gaggatcctgggtaacctcc

SEQ ID NO: 90814 - DNA, 20 bp, human
ggctgacgggtcaaagcctc

SEQ ID NO: 90815 - DNA, 20 bp, human
ggcggctgcagctggacttg

SEQ ID NO: 90816 - DNA, 20 bp, human
ggcaggccctcagaatgcca

SEQ ID NO: 90817 - DNA, 20 bp, human
ggagaggcgcggagacactg

SEQ ID NO: 90818 - DNA, 20 bp, human
gggcctttgcagctgagact

SEQ ID NO: 90819 - DNA, 20 bp, human
gctttgcagctgagactggg

SEQ ID NO: 90820 - DNA, 20 bp, human
gatcccagtcgatcagccag

SEQ ID NO: 90821 - DNA, 20 bp, human
gagagtcggcaaggtcccca

SEQ ID NO: 90822 - DNA, 20 bp, human
gcatgccagcctgtctacct

SEQ ID NO: 90823 - DNA, 20 bp, human
ggtggactcatcaattgtgg

SEQ ID NO: 90824 - DNA, 20 bp, human
ggagggacaagggtctccaa

SEQ ID NO: 90825 - DNA, 20 bp, human
gtgcctctggctgatcgact

SEQ ID NO: 90826 - DNA, 20 bp, human
gccagatcccgcgtcaacgg

SEQ ID NO: 90827 - DNA, 20 bp, human
gcagccagatcccgcgtcaa

SEQ ID NO: 90828 - DNA, 20 bp, human
ggatcccgcgtcaacggagg

SEQ ID NO: 90829 - DNA, 20 bp, human
ggtcaacggaggcggaacgg

SEQ ID NO: 90830 - DNA, 20 bp, human
gcgcgtcaacggaggcggaa

SEQ ID NO: 90831 - DNA, 20 bp, human
gggacctcgagaggagagtg

SEQ ID NO: 90832 - DNA, 20 bp, human
ggggggaggactaaacacca

SEQ ID NO: 90833 - DNA, 20 bp, human
gaacggcggaccccgtaccc

SEQ ID NO: 90834 - DNA, 20 bp, human
gaccccacttctggacacca

SEQ ID NO: 90835 - DNA, 20 bp, human
gcctggcagcatcggagcac

SEQ ID NO: 90836 - DNA, 20 bp, human
gccgcgcagtcaccacgacg

SEQ ID NO: 90837 - DNA, 20 bp, human
gagcctgcggcccgacccgg

SEQ ID NO: 90838 - DNA, 20 bp, human
gccgtacgattgggagcccg

SEQ ID NO: 90839 - DNA, 20 bp, human
gcccgggaacctccccctac

SEQ ID NO: 90840 - DNA, 20 bp, human
gagtggttgctgggcgacca

SEQ ID NO: 90841 - DNA, 20 bp, human
ggagagaaagccgggacttg

SEQ ID NO: 90842 - DNA, 20 bp, human
gccctaccggacgccagccg

SEQ ID NO: 90843 - DNA, 20 bp, human
ggcgaccacggagagaaagc

SEQ ID NO: 90844 - DNA, 20 bp, human
ggtccacgggtgccgcgtcg

SEQ ID NO: 90845 - DNA, 20 bp, human
gtgcctggcctgccatgtag

SEQ ID NO: 90846 - DNA, 20 bp, human
gtattctagcgcatataggg

SEQ ID NO: 90847 - DNA, 20 bp, human
ggcgaggtgggacaaccctt

SEQ ID NO: 90848 - DNA, 20 bp, human
gagatattctagcgcatata

SEQ ID NO: 90849 - DNA, 20 bp, human
ggcaggtgcaccaagagatc

SEQ ID NO: 90850 - DNA, 20 bp, human
gagagccccgtgttatggcg

SEQ ID NO: 90851 - DNA, 20 bp, human
gtaacacggggctctcgcgc

SEQ ID NO: 90852 - DNA, 20 bp, human
ggccttagtagggaaggtgg

SEQ ID NO: 90853 - DNA, 20 bp, human
gctcgcgcatctccagccta

SEQ ID NO: 90854 - DNA, 20 bp, human
gccccgtgttatggcgaggt

SEQ ID NO: 90855 - DNA, 20 bp, human
ggctggagatgcgcgaggga

SEQ ID NO: 90856 - DNA, 20 bp, human
ggagagaggctgctttccta

SEQ ID NO: 90857 - DNA, 20 bp, human
gaccctgggacagcggagag

SEQ ID NO: 90858 - DNA, 20 bp, human
gccatggcaccctgggacag

SEQ ID NO: 90859 - DNA, 20 bp, human
ggggacactgtcaaagctct

SEQ ID NO: 90860 - DNA, 20 bp, human
gctgctttcctagggtgtcg

SEQ ID NO: 90861 - DNA, 20 bp, human
ggtaggaactgcagctacag

SEQ ID NO: 90862 - DNA, 20 bp, human
gctacagaggatgttcttat

SEQ ID NO: 90863 - DNA, 20 bp, human
gaggagcgacagctggctaa

SEQ ID NO: 90864 - DNA, 20 bp, human
gagggaaaaggagcgacagc

SEQ ID NO: 90865 - DNA, 20 bp, human
gtgaggctggtggaaacgtg

SEQ ID NO: 90866 - DNA, 20 bp, human
gccacagcctcggaacgatg

SEQ ID NO: 90867 - DNA, 20 bp, human
gaggggcgtgaagtactcgg

SEQ ID NO: 90868 - DNA, 20 bp, human
gggcgtgaagtactcggtgg

SEQ ID NO: 90869 - DNA, 20 bp, human
gggcggcagccagtaccgag

SEQ ID NO: 90870 - DNA, 20 bp, human
gagcaggggcgtgaagtact

SEQ ID NO: 90871 - DNA, 20 bp, human
ggggcgcagcggcgtcaaga

SEQ ID NO: 90872 - DNA, 20 bp, human
ggggcccgaacccgacacag

SEQ ID NO: 90873 - DNA, 20 bp, human
gctgctcagagctgtcctgg

SEQ ID NO: 90874 - DNA, 20 bp, human
gcaacagccgcatcgttccg

SEQ ID NO: 90875 - DNA, 20 bp, human
ggggccggggatctctgcaa

SEQ ID NO: 90876 - DNA, 20 bp, human
gcgcaggggccagacccgga

SEQ ID NO: 90877 - DNA, 20 bp, human
gccagacccggaggctctgg

SEQ ID NO: 90878 - DNA, 20 bp, human
gcaccgccaggtggaggtat

SEQ ID NO: 90879 - DNA, 20 bp, human
gtatgcctggtggtattagg

SEQ ID NO: 90880 - DNA, 20 bp, human
gcggagttgacggacaggaa

SEQ ID NO: 90881 - DNA, 20 bp, human
gccggaggctctggaggctc

SEQ ID NO: 90882 - DNA, 20 bp, human
ggggaatgggtagtaaactc

SEQ ID NO: 90883 - DNA, 20 bp, human
gaggtggaggtatcggagag

SEQ ID NO: 90884 - DNA, 20 bp, human
ggagattcggggcagggaat

SEQ ID NO: 90885 - DNA, 20 bp, human
gttccacttcgggagattcg

SEQ ID NO: 90886 - DNA, 20 bp, human
gcacgcgggagaaaaagagg

SEQ ID NO: 90887 - DNA, 20 bp, human
gacaccctggtgaggtcagg

SEQ ID NO: 90888 - DNA, 20 bp, human
gcccacaccctggtgaggtc

SEQ ID NO: 90889 - DNA, 20 bp, human
ggagttgcgatctgtaccag

SEQ ID NO: 90890 - DNA, 20 bp, human
gccctggtgaggtcaggcgg

SEQ ID NO: 90891 - DNA, 20 bp, human
gttccaggcttcccaggaat

SEQ ID NO: 90892 - DNA, 20 bp, human
gcagcacgcgggagaaaaag

SEQ ID NO: 90893 - DNA, 20 bp, human
gccggcagaaagggatgcga

SEQ ID NO: 90894 - DNA, 20 bp, human
gcgcgcagcgccgggtccga

SEQ ID NO: 90895 - DNA, 20 bp, human
gtgcgaaggtgtaaggatga

SEQ ID NO: 90896 - DNA, 20 bp, human
gccagctccgactccacggg

SEQ ID NO: 90897 - DNA, 20 bp, human
ggtcagcagcttgtcgtcgg

SEQ ID NO: 90898 - DNA, 20 bp, human
ggcgccagctccgactccac

SEQ ID NO: 90899 - DNA, 20 bp, human
gcagccacagcacggacatc

SEQ ID NO: 90900 - DNA, 20 bp, human
ggactcgctgccgccccccg

SEQ ID NO: 90901 - DNA, 20 bp, human
gagcagcttgtcgtcggggg

SEQ ID NO: 90902 - DNA, 20 bp, human
gcaggttgttgatggcccgg

SEQ ID NO: 90903 - DNA, 20 bp, human
gaccctgtccctggacacgg

SEQ ID NO: 90904 - DNA, 20 bp, human
gctggccaacaagtacctgg

SEQ ID NO: 90905 - DNA, 20 bp, human
ggcagagcttggtgacctgg

SEQ ID NO: 90906 - DNA, 20 bp, human
gcactgacctgtctaaagag

SEQ ID NO: 90907 - DNA, 20 bp, human
gtaagctatacattactatg

SEQ ID NO: 90908 - DNA, 20 bp, human
ggctgaagtagactacttcg

SEQ ID NO: 90909 - DNA, 20 bp, human
gcagaagcctctctttagac

SEQ ID NO: 90910 - DNA, 20 bp, human
gaagaggccaaaatagcaca

SEQ ID NO: 90911 - DNA, 20 bp, human
gtatagtttaaatcggaata

SEQ ID NO: 90912 - DNA, 20 bp, human
ggatacaaatatggcaagca

SEQ ID NO: 90913 - DNA, 20 bp, human
gaacatctaaacgctgagtt

SEQ ID NO: 90914 - DNA, 20 bp, human
gaagaaagtgtgaacaactt

SEQ ID NO: 90915 - DNA, 20 bp, human
ggttttaatgtgaaattctg

SEQ ID NO: 90916 - DNA, 20 bp, human
gccgattcgcggaggacccg

SEQ ID NO: 90917 - DNA, 20 bp, human
gggacgcggagactgccgga

SEQ ID NO: 90918 - DNA, 20 bp, human
gtaacggacgcggagactgc

SEQ ID NO: 90919 - DNA, 20 bp, human
gccaccgccgagcagccctc

SEQ ID NO: 90920 - DNA, 20 bp, human
gcgctgcggtcccgagaggg

SEQ ID NO: 90921 - DNA, 20 bp, human
gggaggacccgcgggcttaa

SEQ ID NO: 90922 - DNA, 20 bp, human
gcgcgaatcggcggtgggtc

SEQ ID NO: 90923 - DNA, 20 bp, human
gcccgcgggcttaacggacg

SEQ ID NO: 90924 - DNA, 20 bp, human
ggggcggcgccgagaaacag

SEQ ID NO: 90925 - DNA, 20 bp, human
gagggcggctagggacgcgg

SEQ ID NO: 90926 - DNA, 20 bp, human
gcccttggagtgggagacac

SEQ ID NO: 90927 - DNA, 20 bp, human
ggaggcctgcgcagttgcag

SEQ ID NO: 90928 - DNA, 20 bp, human
gccgcttaggcccttggagt

SEQ ID NO: 90929 - DNA, 20 bp, human
ggccggctagacactaacca

SEQ ID NO: 90930 - DNA, 20 bp, human
gtcgagcggggagtaaaaag

SEQ ID NO: 90931 - DNA, 20 bp, human
gtctgcatgacagaaaaagg

SEQ ID NO: 90932 - DNA, 20 bp, human
gtgacgccgtagccgcgact

SEQ ID NO: 90933 - DNA, 20 bp, human
gcatgaaccaggaagcggag

SEQ ID NO: 90934 - DNA, 20 bp, human
gcggcgtcatggaggagatc

SEQ ID NO: 90935 - DNA, 20 bp, human
ggagaggtctagcagggaga

SEQ ID NO: 90936 - DNA, 20 bp, human
ggcgggagccgcgcagtaga

SEQ ID NO: 90937 - DNA, 20 bp, human
ggcgcgctccgtctactgcg

SEQ ID NO: 90938 - DNA, 20 bp, human
gacccttccccagaaatcct

SEQ ID NO: 90939 - DNA, 20 bp, human
gcgctcgcccgagtgcgggg

SEQ ID NO: 90940 - DNA, 20 bp, human
gtcactcacgcgggaggcag

SEQ ID NO: 90941 - DNA, 20 bp, human
ggcggcggcgacgggaccgg

SEQ ID NO: 90942 - DNA, 20 bp, human
gctcacgcgggaggcagcgg

SEQ ID NO: 90943 - DNA, 20 bp, human
gccgcagtcctgagcggacg

SEQ ID NO: 90944 - DNA, 20 bp, human
ggtcgccgccgccccgcact

SEQ ID NO: 90945 - DNA, 20 bp, human
ggcggcgcgcttatccgcag

SEQ ID NO: 90946 - DNA, 20 bp, human
gtggagggcggagtagacgg

SEQ ID NO: 90947 - DNA, 20 bp, human
gagtccagggagcttgaaca

SEQ ID NO: 90948 - DNA, 20 bp, human
gctatctcgggagccagagg

SEQ ID NO: 90949 - DNA, 20 bp, human
gaaggaaatagctctacgag

SEQ ID NO: 90950 - DNA, 20 bp, human
gtatgggccggtgaagggaa

SEQ ID NO: 90951 - DNA, 20 bp, human
ggcgaaaccccagcaccacc

SEQ ID NO: 90952 - DNA, 20 bp, human
gagggcggagtagacggagg

SEQ ID NO: 90953 - DNA, 20 bp, human
gctggctgacagcctatctc

SEQ ID NO: 90954 - DNA, 20 bp, human
ggaacagggcagggaaagta

SEQ ID NO: 90955 - DNA, 20 bp, human
gccaggcaggacaaagcccg

SEQ ID NO: 90956 - DNA, 20 bp, human
ggtcctcgacaacctatcga

SEQ ID NO: 90957 - DNA, 20 bp, human
gagaagggaagcacggccag

SEQ ID NO: 90958 - DNA, 20 bp, human
ggtgcgccaacaggtagaag

SEQ ID NO: 90959 - DNA, 20 bp, human
ggaaggcgccatggagcgac

SEQ ID NO: 90960 - DNA, 20 bp, human
ggcagctgcagcatgtcggg

SEQ ID NO: 90961 - DNA, 20 bp, human
gggtagaagcggcgcacgaa

SEQ ID NO: 90962 - DNA, 20 bp, human
ggctccatggcgccttcgat

SEQ ID NO: 90963 - DNA, 20 bp, human
gcgtgcgcggggtccgagaa

SEQ ID NO: 90964 - DNA, 20 bp, human
ggccccgcacgcctccttca

SEQ ID NO: 90965 - DNA, 20 bp, human
ggggaactgcagcaggtcgg

SEQ ID NO: 90966 - DNA, 20 bp, human
gggccgcactcgcagctgga

SEQ ID NO: 90967 - DNA, 20 bp, human
gggcccgatcgagggaactg

SEQ ID NO: 90968 - DNA, 20 bp, human
gagtccccgggcccgatcga

SEQ ID NO: 90969 - DNA, 20 bp, human
ggtgagccgaacgggccggg

SEQ ID NO: 90970 - DNA, 20 bp, human
ggctccagcgcggagggtcg

SEQ ID NO: 90971 - DNA, 20 bp, human
gcctgcggcaggtccgaatg

SEQ ID NO: 90972 - DNA, 20 bp, human
gctgcgagtgcggcctcggc

SEQ ID NO: 90973 - DNA, 20 bp, human
gtcacgcctcgcagctgacc

SEQ ID NO: 90974 - DNA, 20 bp, human
ggagggaactgaggctcgtc

SEQ ID NO: 90975 - DNA, 20 bp, human
gaaggccgcccgctccagcg

SEQ ID NO: 90976 - DNA, 20 bp, human
gcggtcgggctagagaagag

SEQ ID NO: 90977 - DNA, 20 bp, human
gcgtagccgaggaacaaggg

SEQ ID NO: 90978 - DNA, 20 bp, human
gaccatgcctcagaaaccaa

SEQ ID NO: 90979 - DNA, 20 bp, human
gagccgtagccgaggaacaa

SEQ ID NO: 90980 - DNA, 20 bp, human
gaggcatcggacccaatcgg

SEQ ID NO: 90981 - DNA, 20 bp, human
gccggctccaccccgagggt

SEQ ID NO: 90982 - DNA, 20 bp, human
gggtgctgcagttggcggtc

SEQ ID NO: 90983 - DNA, 20 bp, human
gccacccgcgaggagatctg

SEQ ID NO: 90984 - DNA, 20 bp, human
ggcatggtcaggactagatg

SEQ ID NO: 90985 - DNA, 20 bp, human
gtgcgagctgggcttgtgag

SEQ ID NO: 90986 - DNA, 20 bp, human
gctgggcgcgaggccactcg

SEQ ID NO: 90987 - DNA, 20 bp, human
gacagccccccgcacggtct

SEQ ID NO: 90988 - DNA, 20 bp, human
ggcctcgcgcccagaccgtg

SEQ ID NO: 90989 - DNA, 20 bp, human
ggccgccgggacaccaaaat

SEQ ID NO: 90990 - DNA, 20 bp, human
ggctccgcgcaggtgtggga

SEQ ID NO: 90991 - DNA, 20 bp, human
ggggagaggagcgcagacaa

SEQ ID NO: 90992 - DNA, 20 bp, human
gggccgaacgcgttgcgctg

SEQ ID NO: 90993 - DNA, 20 bp, human
gggagcggggctggactcga

SEQ ID NO: 90994 - DNA, 20 bp, human
gtcgcgcccagaccgtgcgg

SEQ ID NO: 90995 - DNA, 20 bp, human
gacccgaacagccccccgca

SEQ ID NO: 90996 - DNA, 20 bp, human
gtaaccccgcggtccctcag

SEQ ID NO: 90997 - DNA, 20 bp, human
gtgtgagctgcggcagagac

SEQ ID NO: 90998 - DNA, 20 bp, human
gccagcagtggctaaccccg

SEQ ID NO: 90999 - DNA, 20 bp, human
gtagctacagccctgaggga

SEQ ID NO: 91000 - DNA, 20 bp, human
gccccgcggtccctcagcgg

SEQ ID NO: 91001 - DNA, 20 bp, human
ggcactacggcccggaaccg

SEQ ID NO: 91002 - DNA, 20 bp, human
gggtacctctcggcgaacac

SEQ ID NO: 91003 - DNA, 20 bp, human
gtccgggccgtagtgccagg

SEQ ID NO: 91004 - DNA, 20 bp, human
gggctgtagctaccaagcgg

SEQ ID NO: 91005 - DNA, 20 bp, human
gagactggcggtctgcggag

SEQ ID NO: 91006 - DNA, 20 bp, human
gagctcaacaggctccgccg

SEQ ID NO: 91007 - DNA, 20 bp, human
gttgagctcgcgcgggctgc

SEQ ID NO: 91008 - DNA, 20 bp, human
gccgtcggccggctctccac

SEQ ID NO: 91009 - DNA, 20 bp, human
gctccctggggaaagagtag

SEQ ID NO: 91010 - DNA, 20 bp, human
gtctcgctgcgatacagcct

SEQ ID NO: 91011 - DNA, 20 bp, human
gtccccagcgcagggagcgg

SEQ ID NO: 91012 - DNA, 20 bp, human
gcgcgagggaatgaattgtt

SEQ ID NO: 91013 - DNA, 20 bp, human
gatgaatcaaccactccctg

SEQ ID NO: 91014 - DNA, 20 bp, human
ggccggagaaactagtttgt

SEQ ID NO: 91015 - DNA, 20 bp, human
gcggggccctgggacaatgg

SEQ ID NO: 91016 - DNA, 20 bp, human
gagtccggcggtagcagcgg

SEQ ID NO: 91017 - DNA, 20 bp, human
gcggagtccggcggtagcag

SEQ ID NO: 91018 - DNA, 20 bp, human
ggcagagagggcctgagcag

SEQ ID NO: 91019 - DNA, 20 bp, human
gggtctgaagggaaaccgag

SEQ ID NO: 91020 - DNA, 20 bp, human
ggagccgagggctactgagg

SEQ ID NO: 91021 - DNA, 20 bp, human
ggccatggccagtctgaggg

SEQ ID NO: 91022 - DNA, 20 bp, human
gtagggacctgagaatcctg

SEQ ID NO: 91023 - DNA, 20 bp, human
ggcaccaccgctgctaccgc

SEQ ID NO: 91024 - DNA, 20 bp, human
gtcactcgaacgcgcgacgg

SEQ ID NO: 91025 - DNA, 20 bp, human
gcagacgcctcgaggtcctg

SEQ ID NO: 91026 - DNA, 20 bp, human
ggcgacaggaggaggaaccg

SEQ ID NO: 91027 - DNA, 20 bp, human
gcccaggctccagttgtccg

SEQ ID NO: 91028 - DNA, 20 bp, human
gtcacacgggcagcgacagg

SEQ ID NO: 91029 - DNA, 20 bp, human
gtaatcacacgggcagcgac

SEQ ID NO: 91030 - DNA, 20 bp, human
gtgagtctcagtaatcacac

SEQ ID NO: 91031 - DNA, 20 bp, human
ggccccacccgtaagagtta

SEQ ID NO: 91032 - DNA, 20 bp, human
gaggaggaaccgcggacaac

SEQ ID NO: 91033 - DNA, 20 bp, human
gggtttgaccggagctagtg

SEQ ID NO: 91034 - DNA, 20 bp, human
ggtaagagttagggtttgac

SEQ ID NO: 91035 - DNA, 20 bp, human
gcttaaccctccggccgcag

SEQ ID NO: 91036 - DNA, 20 bp, human
gaagcagacggtacccggag

SEQ ID NO: 91037 - DNA, 20 bp, human
gggagcggagcgagccagaa

SEQ ID NO: 91038 - DNA, 20 bp, human
gggagctgcggcgagatccg

SEQ ID NO: 91039 - DNA, 20 bp, human
gcagcgccggcgggtagcgg

SEQ ID NO: 91040 - DNA, 20 bp, human
ggcctcccggcagcccaggg

SEQ ID NO: 91041 - DNA, 20 bp, human
gggagagcaggaacgcgagg

SEQ ID NO: 91042 - DNA, 20 bp, human
gcagcctgtgcggctatgag

SEQ ID NO: 91043 - DNA, 20 bp, human
gggacagcgccggcgggtag

SEQ ID NO: 91044 - DNA, 20 bp, human
gtgcggcgcggctctcatcg

SEQ ID NO: 91045 - DNA, 20 bp, human
gtgtgcggctatgagcggtg

SEQ ID NO: 91046 - DNA, 20 bp, human
ggctgctgcgagtaagtcag

SEQ ID NO: 91047 - DNA, 20 bp, human
gctggctgggcctcacacaa

SEQ ID NO: 91048 - DNA, 20 bp, human
gtttgcagcctagacagagg

SEQ ID NO: 91049 - DNA, 20 bp, human
gttctttgcagcctagacag

SEQ ID NO: 91050 - DNA, 20 bp, human
ggctgggcctcacacaatgg

SEQ ID NO: 91051 - DNA, 20 bp, human
gcttggtctcctaggaacgg

SEQ ID NO: 91052 - DNA, 20 bp, human
ggtctaggctgcaaagaatc

SEQ ID NO: 91053 - DNA, 20 bp, human
gctgcgagtaagtcagagga

SEQ ID NO: 91054 - DNA, 20 bp, human
gagcggagcaccctgaaaga

SEQ ID NO: 91055 - DNA, 20 bp, human
ggaggaaggaggattgagaa

SEQ ID NO: 91056 - DNA, 20 bp, human
gtaggcagtcctgctctctc

SEQ ID NO: 91057 - DNA, 20 bp, human
gcggagtgaggaagccgagt

SEQ ID NO: 91058 - DNA, 20 bp, human
gtccaggctgagtgagaggt

SEQ ID NO: 91059 - DNA, 20 bp, human
ggtgagaggtaggatccagg

SEQ ID NO: 91060 - DNA, 20 bp, human
gcggcagccaggggacacgg

SEQ ID NO: 91061 - DNA, 20 bp, human
gggcaccccgaggcccccag

SEQ ID NO: 91062 - DNA, 20 bp, human
gctgcctagccggcagccag

SEQ ID NO: 91063 - DNA, 20 bp, human
gcaagccaggctcctcaggg

SEQ ID NO: 91064 - DNA, 20 bp, human
ggagagcaggactgcctagc

SEQ ID NO: 91065 - DNA, 20 bp, human
gtgtcccctggctgccggct

SEQ ID NO: 91066 - DNA, 20 bp, human
ggctgctggtggctccccac

SEQ ID NO: 91067 - DNA, 20 bp, human
gggagaaggaaaatccggtg

SEQ ID NO: 91068 - DNA, 20 bp, human
ggctgcagccgggtcttgtc

SEQ ID NO: 91069 - DNA, 20 bp, human
gttagcaggagactcctctt

SEQ ID NO: 91070 - DNA, 20 bp, human
ggcagccgggtcttgtcagg

SEQ ID NO: 91071 - DNA, 20 bp, human
gcttgtcaggtggctgctgg

SEQ ID NO: 91072 - DNA, 20 bp, human
gaggagactcctcttgggaa

SEQ ID NO: 91073 - DNA, 20 bp, human
gacgtgttaggagaacttca

SEQ ID NO: 91074 - DNA, 20 bp, human
gtactttatagagaaggaga

SEQ ID NO: 91075 - DNA, 20 bp, human
gctgccacttcacccaagga

SEQ ID NO: 91076 - DNA, 20 bp, human
ggcataagtaacctgagtag

SEQ ID NO: 91077 - DNA, 20 bp, human
gtgctcccgttagacgacac

SEQ ID NO: 91078 - DNA, 20 bp, human
gctgctggtgcgccaagtgg

SEQ ID NO: 91079 - DNA, 20 bp, human
gctgggttaggtgccagaga

SEQ ID NO: 91080 - DNA, 20 bp, human
gcgttagacgacacgggcag

SEQ ID NO: 91081 - DNA, 20 bp, human
ggaaagggggagcgactcca

SEQ ID NO: 91082 - DNA, 20 bp, human
ggcagacctgaggaagaggg

SEQ ID NO: 91083 - DNA, 20 bp, human
gcccggagttgacatttcag

SEQ ID NO: 91084 - DNA, 20 bp, human
ggtgcctgcgctgccgtctc

SEQ ID NO: 91085 - DNA, 20 bp, human
gccacctgcagtgctggcta

SEQ ID NO: 91086 - DNA, 20 bp, human
ggatgtgctggccgcagcag

SEQ ID NO: 91087 - DNA, 20 bp, human
gacacctcgaggctgaaggg

SEQ ID NO: 91088 - DNA, 20 bp, human
ggcccagcagacatgcgaga

SEQ ID NO: 91089 - DNA, 20 bp, human
gcaatctgggatcctcgtcg

SEQ ID NO: 91090 - DNA, 20 bp, human
ggctcccagcgcctctgctg

SEQ ID NO: 91091 - DNA, 20 bp, human
gagactgttgctggacgaag

SEQ ID NO: 91092 - DNA, 20 bp, human
ggccagcacatccccctgcg

SEQ ID NO: 91093 - DNA, 20 bp, human
gagaggcgctgggagcgccc

SEQ ID NO: 91094 - DNA, 20 bp, human
gagcaccccctcataggcaa

SEQ ID NO: 91095 - DNA, 20 bp, human
ggggcagcagccttcacccg

SEQ ID NO: 91096 - DNA, 20 bp, human
gctctccggggtggacgagg

SEQ ID NO: 91097 - DNA, 20 bp, human
ggcggcgtcccgggagtgca

SEQ ID NO: 91098 - DNA, 20 bp, human
ggactctgacctctccgggg

SEQ ID NO: 91099 - DNA, 20 bp, human
gggaggcccctagtaacgga

SEQ ID NO: 91100 - DNA, 20 bp, human
gcgaggaggacgggttctgc

SEQ ID NO: 91101 - DNA, 20 bp, human
gcagcacccccggagtccac

SEQ ID NO: 91102 - DNA, 20 bp, human
ggacctctccggggtggacg

SEQ ID NO: 91103 - DNA, 20 bp, human
ggaggcttcccgggagtgtg

SEQ ID NO: 91104 - DNA, 20 bp, human
ggcccctggcgtgcaggtgt

SEQ ID NO: 91105 - DNA, 20 bp, human
gatgtccgacggcgcagatg

SEQ ID NO: 91106 - DNA, 20 bp, human
gagcaggcgggaagaacgga

SEQ ID NO: 91107 - DNA, 20 bp, human
gagcctcgagcagcagcggg

SEQ ID NO: 91108 - DNA, 20 bp, human
gagtaagcgggcgccagtag

SEQ ID NO: 91109 - DNA, 20 bp, human
ggccagcggggccagcgaga

SEQ ID NO: 91110 - DNA, 20 bp, human
gacggagggcgggaagctag

SEQ ID NO: 91111 - DNA, 20 bp, human
gtggcttgttaactcttcaa

SEQ ID NO: 91112 - DNA, 20 bp, human
gcggcgcagcgctaggctgt

SEQ ID NO: 91113 - DNA, 20 bp, human
ggatggcggccctacctccg

SEQ ID NO: 91114 - DNA, 20 bp, human
gtctaatgagggatagaaat

SEQ ID NO: 91115 - DNA, 20 bp, human
gcgcgagcctcgagcagcag

SEQ ID NO: 91116 - DNA, 20 bp, human
gcccgggttcaggagacccc

SEQ ID NO: 91117 - DNA, 20 bp, human
ggagctggcggagatcggga

SEQ ID NO: 91118 - DNA, 20 bp, human
gcaggcggaactcagcgcaa

SEQ ID NO: 91119 - DNA, 20 bp, human
ggggtccgagcgaacgacag

SEQ ID NO: 91120 - DNA, 20 bp, human
gtcggcctcgcacttcctgg

SEQ ID NO: 91121 - DNA, 20 bp, human
gccggctggagcctgctggg

SEQ ID NO: 91122 - DNA, 20 bp, human
gcgcccgccccggcaccaag

SEQ ID NO: 91123 - DNA, 20 bp, human
ggcacttcctggcggagcca

SEQ ID NO: 91124 - DNA, 20 bp, human
gccagcccgctgcgcagcca

SEQ ID NO: 91125 - DNA, 20 bp, human
ggactccgcctcctcgccgc

SEQ ID NO: 91126 - DNA, 20 bp, human
gttctcacgggacaacggag

SEQ ID NO: 91127 - DNA, 20 bp, human
gcgccggcggcagcttctca

SEQ ID NO: 91128 - DNA, 20 bp, human
ggcagcttctcacgggacaa

SEQ ID NO: 91129 - DNA, 20 bp, human
gtgacccccgctgtaaacag

SEQ ID NO: 91130 - DNA, 20 bp, human
gagttgtcaaggccccagag

SEQ ID NO: 91131 - DNA, 20 bp, human
gactgtgtcgcggtgctggg

SEQ ID NO: 91132 - DNA, 20 bp, human
gtcaaggccccagagaggta

SEQ ID NO: 91133 - DNA, 20 bp, human
gtcatacctataaagaagat

SEQ ID NO: 91134 - DNA, 20 bp, human
gtacctataaagaagattgg

SEQ ID NO: 91135 - DNA, 20 bp, human
gcgctgtaaacagtggatca

SEQ ID NO: 91136 - DNA, 20 bp, human
ggcctcccccgtatacacgt

SEQ ID NO: 91137 - DNA, 20 bp, human
gtaggagacgatctggtcca

SEQ ID NO: 91138 - DNA, 20 bp, human
gggaggcggcctccatcacg

SEQ ID NO: 91139 - DNA, 20 bp, human
gacggggaggacattgtcag

SEQ ID NO: 91140 - DNA, 20 bp, human
ggacatccgcaaacatcatg

SEQ ID NO: 91141 - DNA, 20 bp, human
gtcctacgtgtatacggggg

SEQ ID NO: 91142 - DNA, 20 bp, human
ggtgctggagggttcagctg

SEQ ID NO: 91143 - DNA, 20 bp, human
gatacacgtaggagacgatc

SEQ ID NO: 91144 - DNA, 20 bp, human
ggtctcctacgtgtatacgg

SEQ ID NO: 91145 - DNA, 20 bp, human
gggcggcctccatcacgggg

SEQ ID NO: 91146 - DNA, 20 bp, human
gacactgacatcgtagcagg

SEQ ID NO: 91147 - DNA, 20 bp, human
gaggttgaagagccactctc

SEQ ID NO: 91148 - DNA, 20 bp, human
ggccactctcgggacagaaa

SEQ ID NO: 91149 - DNA, 20 bp, human
gtatgagcatagagggaccc

SEQ ID NO: 91150 - DNA, 20 bp, human
gtttgttagttctacagaag

SEQ ID NO: 91151 - DNA, 20 bp, human
gttctgaacggctctctgat

SEQ ID NO: 91152 - DNA, 20 bp, human
gatagagggaccccggttca

SEQ ID NO: 91153 - DNA, 20 bp, human
gcagacactgacatcgtagc

SEQ ID NO: 91154 - DNA, 20 bp, human
gtgatgtgaaacagatccta

SEQ ID NO: 91155 - DNA, 20 bp, human
gcctaaggctacgctggagg

SEQ ID NO: 91156 - DNA, 20 bp, human
gaaagcgcgcccggaagtag

SEQ ID NO: 91157 - DNA, 20 bp, human
gcaagcagttggagaggcac

SEQ ID NO: 91158 - DNA, 20 bp, human
ggtacagagaggagccccct

SEQ ID NO: 91159 - DNA, 20 bp, human
gtgggtggcctagggtgcgg

SEQ ID NO: 91160 - DNA, 20 bp, human
gggcggccagcaccaggcga

SEQ ID NO: 91161 - DNA, 20 bp, human
gaggtggccgggtccctgta

SEQ ID NO: 91162 - DNA, 20 bp, human
gcagcaccaggcgatggcac

SEQ ID NO: 91163 - DNA, 20 bp, human
gatctggaagcggtgtgccg

SEQ ID NO: 91164 - DNA, 20 bp, human
ggtggcctagggtgcggtgg

SEQ ID NO: 91165 - DNA, 20 bp, human
ggtgcaggatttgttcgccg

SEQ ID NO: 91166 - DNA, 20 bp, human
gtctgtgagaaacctgggta

SEQ ID NO: 91167 - DNA, 20 bp, human
gagaaacctgggtaaggaag

SEQ ID NO: 91168 - DNA, 20 bp, human
gtccattctgtgagaaacct

SEQ ID NO: 91169 - DNA, 20 bp, human
gtcccagcgggaacttgcag

SEQ ID NO: 91170 - DNA, 20 bp, human
gggatggctagacagttacc

SEQ ID NO: 91171 - DNA, 20 bp, human
gagctgacaaaatcaatctg

SEQ ID NO: 91172 - DNA, 20 bp, human
ggctagacctgtgtgctgca

SEQ ID NO: 91173 - DNA, 20 bp, human
gccgtcattgagatcaatac

SEQ ID NO: 91174 - DNA, 20 bp, human
gaaaagtactcacggaagta

SEQ ID NO: 91175 - DNA, 20 bp, human
ggaggtagtgctagacaatg

SEQ ID NO: 91176 - DNA, 20 bp, human
gggccggcgcgcagatctgg

SEQ ID NO: 91177 - DNA, 20 bp, human
gctgctgtccgagctggtgg

SEQ ID NO: 91178 - DNA, 20 bp, human
gggaggccggcgcgcagatc

SEQ ID NO: 91179 - DNA, 20 bp, human
gcgccaggcggtacatctcc

SEQ ID NO: 91180 - DNA, 20 bp, human
gggaaccggcgcgcgcgtag

SEQ ID NO: 91181 - DNA, 20 bp, human
gaccatctcctcggccgaca

SEQ ID NO: 91182 - DNA, 20 bp, human
gtcggcgccccgcccggaac

SEQ ID NO: 91183 - DNA, 20 bp, human
gcggatctgcaccatctcct

SEQ ID NO: 91184 - DNA, 20 bp, human
gccgcctggcgcaggtgtac

SEQ ID NO: 91185 - DNA, 20 bp, human
gcggcgcgcgcgtaggggct

SEQ ID NO: 91186 - DNA, 20 bp, human
ggaggccctcgggtccggag

SEQ ID NO: 91187 - DNA, 20 bp, human
gaagacgctgcccctcccgg

SEQ ID NO: 91188 - DNA, 20 bp, human
gctcgcagccgcctccggga

SEQ ID NO: 91189 - DNA, 20 bp, human
ggcgcccctagaccctgtcc

SEQ ID NO: 91190 - DNA, 20 bp, human
gacgctgcccctcccggagg

SEQ ID NO: 91191 - DNA, 20 bp, human
gggggcgggcgagtaggtgg

SEQ ID NO: 91192 - DNA, 20 bp, human
gctgcccggacagggtctag

SEQ ID NO: 91193 - DNA, 20 bp, human
gtgcgccgcgccgggactga

SEQ ID NO: 91194 - DNA, 20 bp, human
ggcgaagacgctgcccctcc

SEQ ID NO: 91195 - DNA, 20 bp, human
gcggggccggcgagctgagt

SEQ ID NO: 91196 - DNA, 20 bp, human
gtgcggcaagcaccacgcgg

SEQ ID NO: 91197 - DNA, 20 bp, human
gctaggaccagagtcaaatt

SEQ ID NO: 91198 - DNA, 20 bp, human
gggtgcaagttgcaaggaag

SEQ ID NO: 91199 - DNA, 20 bp, human
gccatcaacatcgagactga

SEQ ID NO: 91200 - DNA, 20 bp, human
gaaaggggcgcctggaccat

SEQ ID NO: 91201 - DNA, 20 bp, human
gaccacatcacccatggtcc

SEQ ID NO: 91202 - DNA, 20 bp, human
ggtcaggcaggccccattgc

SEQ ID NO: 91203 - DNA, 20 bp, human
ggagcgcccaagtgtcaggc

SEQ ID NO: 91204 - DNA, 20 bp, human
ggatgtggtcgagaagagtt

SEQ ID NO: 91205 - DNA, 20 bp, human
gggctgcggcaagcaccacg

SEQ ID NO: 91206 - DNA, 20 bp, human
ggggagcgacgctaccaact

SEQ ID NO: 91207 - DNA, 20 bp, human
gcggccactgccgaaagaca

SEQ ID NO: 91208 - DNA, 20 bp, human
ggttccaccccgggaaccag

SEQ ID NO: 91209 - DNA, 20 bp, human
gccaactgggctgcgtcccc

SEQ ID NO: 91210 - DNA, 20 bp, human
ggcccccttagaaacgctca

SEQ ID NO: 91211 - DNA, 20 bp, human
ggcgaagtgcgcaggctcct

SEQ ID NO: 91212 - DNA, 20 bp, human
gcctgcgaaaacggaaggag

SEQ ID NO: 91213 - DNA, 20 bp, human
ggacggtgggaggtggtccg

SEQ ID NO: 91214 - DNA, 20 bp, human
gactgccgaaagacaaggcc

SEQ ID NO: 91215 - DNA, 20 bp, human
gtgggagtgacggacgacgg

SEQ ID NO: 91216 - DNA, 20 bp, human
ggagccccggccgccctcag

SEQ ID NO: 91217 - DNA, 20 bp, human
gaccccgcgcgagcacccgg

SEQ ID NO: 91218 - DNA, 20 bp, human
gagaggctggagctccccta

SEQ ID NO: 91219 - DNA, 20 bp, human
gctgctcctcccgccaatgg

SEQ ID NO: 91220 - DNA, 20 bp, human
ggccgtggaaggttgctcag

SEQ ID NO: 91221 - DNA, 20 bp, human
gatgctcccggctcccgtag

SEQ ID NO: 91222 - DNA, 20 bp, human
gccctcttcgaaagactggg

SEQ ID NO: 91223 - DNA, 20 bp, human
ggcccctgagcaaccttcca

SEQ ID NO: 91224 - DNA, 20 bp, human
ggggcgacaaaagccgtgga

SEQ ID NO: 91225 - DNA, 20 bp, human
gggacgcgcgctctcctgcg

SEQ ID NO: 91226 - DNA, 20 bp, human
gcaagggaaggcagtcactg

SEQ ID NO: 91227 - DNA, 20 bp, human
ggagcaagggccgggaacac

SEQ ID NO: 91228 - DNA, 20 bp, human
ggtggagccacagtacgtgg

SEQ ID NO: 91229 - DNA, 20 bp, human
gtccgcttcgggcaaggaag

SEQ ID NO: 91230 - DNA, 20 bp, human
gtcccaccccgtggtatcct

SEQ ID NO: 91231 - DNA, 20 bp, human
gctagtcccaggataccacg

SEQ ID NO: 91232 - DNA, 20 bp, human
gtaggcttttccggaaggag

SEQ ID NO: 91233 - DNA, 20 bp, human
gccggcctgtctttgagcaa

SEQ ID NO: 91234 - DNA, 20 bp, human
gggaaggagcggctcggtgt

SEQ ID NO: 91235 - DNA, 20 bp, human
ggccgtggagccacagtacg

SEQ ID NO: 91236 - DNA, 20 bp, human
ggtggccgcagggaactagg

SEQ ID NO: 91237 - DNA, 20 bp, human
gtggtgacagaggtgtccag

SEQ ID NO: 91238 - DNA, 20 bp, human
ggtctcaccagtccccccca

SEQ ID NO: 91239 - DNA, 20 bp, human
gaggaccccaaccctcccat

SEQ ID NO: 91240 - DNA, 20 bp, human
gccggactaggatagactgt

SEQ ID NO: 91241 - DNA, 20 bp, human
gtgacaacatggaggagcgg

SEQ ID NO: 91242 - DNA, 20 bp, human
gaccagtcccccccagggac

SEQ ID NO: 91243 - DNA, 20 bp, human
ggcaagatagataagagccg

SEQ ID NO: 91244 - DNA, 20 bp, human
ggtgcctcgccctgtccctg

SEQ ID NO: 91245 - DNA, 20 bp, human
gtaggtggccgcagggaact

SEQ ID NO: 91246 - DNA, 20 bp, human
gcacacccagatggacctaa

SEQ ID NO: 91247 - DNA, 20 bp, human
gaagggaggccccagagtaa

SEQ ID NO: 91248 - DNA, 20 bp, human
gtagggatgagggagcggtg

SEQ ID NO: 91249 - DNA, 20 bp, human
gcactggcctgtcaatcctg

SEQ ID NO: 91250 - DNA, 20 bp, human
gtgcatcagcgagtgagtag

SEQ ID NO: 91251 - DNA, 20 bp, human
ggcctcccttaggtccatct

SEQ ID NO: 91252 - DNA, 20 bp, human
gacccagatggacctaaggg

SEQ ID NO: 91253 - DNA, 20 bp, human
gggctggacacccctctcca

SEQ ID NO: 91254 - DNA, 20 bp, human
gcatcctggtgcaccgccag

SEQ ID NO: 91255 - DNA, 20 bp, human
gcaccaggatgcccccacac

SEQ ID NO: 91256 - DNA, 20 bp, human
gcctgggcagaggataccag

SEQ ID NO: 91257 - DNA, 20 bp, human
ggataccagcggcagaccac

SEQ ID NO: 91258 - DNA, 20 bp, human
gcagcggcagaccacaggca

SEQ ID NO: 91259 - DNA, 20 bp, human
ggagtcgccgataggaagga

SEQ ID NO: 91260 - DNA, 20 bp, human
gctgcagccgataaccccag

SEQ ID NO: 91261 - DNA, 20 bp, human
gtccgaggctcggagccagt

SEQ ID NO: 91262 - DNA, 20 bp, human
gctgggagtcgccgatagga

SEQ ID NO: 91263 - DNA, 20 bp, human
gggtgcaggtagcttcacct

SEQ ID NO: 91264 - DNA, 20 bp, human
gggagtgccagcctcaccca

SEQ ID NO: 91265 - DNA, 20 bp, human
gggtcccgccaggggtccct

SEQ ID NO: 91266 - DNA, 20 bp, human
gggcccagtggcggcggaga

SEQ ID NO: 91267 - DNA, 20 bp, human
gacccccacccaagcagaga

SEQ ID NO: 91268 - DNA, 20 bp, human
ggtctgctggaggggagtag

SEQ ID NO: 91269 - DNA, 20 bp, human
gggctgcggacagccatcgg

SEQ ID NO: 91270 - DNA, 20 bp, human
ggacagccatcggaggtgag

SEQ ID NO: 91271 - DNA, 20 bp, human
ggcttggctgtccttcaaaa

SEQ ID NO: 91272 - DNA, 20 bp, human
gctgaagccatggagattag

SEQ ID NO: 91273 - DNA, 20 bp, human
ggagggctgacacctggacg

SEQ ID NO: 91274 - DNA, 20 bp, human
gtcttcgcagcagagcgata

SEQ ID NO: 91275 - DNA, 20 bp, human
gggcaggggtttggcggaca

SEQ ID NO: 91276 - DNA, 20 bp, human
gtctctcccctgaccaggtg

SEQ ID NO: 91277 - DNA, 20 bp, human
gcctgaccaggtgtggagca

SEQ ID NO: 91278 - DNA, 20 bp, human
ggcacaggggcaggaccgga

SEQ ID NO: 91279 - DNA, 20 bp, human
gctcctttgcaaggagaggg

SEQ ID NO: 91280 - DNA, 20 bp, human
gctctccttgcaaaggagaa

SEQ ID NO: 91281 - DNA, 20 bp, human
gggaggccaggggcccacct

SEQ ID NO: 91282 - DNA, 20 bp, human
ggcaggggaagggtcagcag

SEQ ID NO: 91283 - DNA, 20 bp, human
ggctgggatgtcacacaggt

SEQ ID NO: 91284 - DNA, 20 bp, human
ggtgtggagcaaggcagggg

SEQ ID NO: 91285 - DNA, 20 bp, human
gggaagccgagtccaggaaa

SEQ ID NO: 91286 - DNA, 20 bp, human
gggccagcacatgagaagac

SEQ ID NO: 91287 - DNA, 20 bp, human
gaggtgcagagtggtagagt

SEQ ID NO: 91288 - DNA, 20 bp, human
gtggtggggcctcctcatgg

SEQ ID NO: 91289 - DNA, 20 bp, human
gcggagagatagcagcgacg

SEQ ID NO: 91290 - DNA, 20 bp, human
gggttgagcaacatgacagg

SEQ ID NO: 91291 - DNA, 20 bp, human
ggacagccacgtagaggatc

SEQ ID NO: 91292 - DNA, 20 bp, human
gaccggttgagcaacatgac

SEQ ID NO: 91293 - DNA, 20 bp, human
ggtctgccagatcctctacg

SEQ ID NO: 91294 - DNA, 20 bp, human
gagcacatgagaagacaggc

SEQ ID NO: 91295 - DNA, 20 bp, human
ggcagagtggtagagttggc

SEQ ID NO: 91296 - DNA, 20 bp, human
gcgggaaaccaggtcaccca

SEQ ID NO: 91297 - DNA, 20 bp, human
gctaggctactggctcaaag

SEQ ID NO: 91298 - DNA, 20 bp, human
gtcctgacaaggccaaggtc

SEQ ID NO: 91299 - DNA, 20 bp, human
gcatggctccgggatcggga

SEQ ID NO: 91300 - DNA, 20 bp, human
gctcggggccgggtccagtg

SEQ ID NO: 91301 - DNA, 20 bp, human
gggtcagggaggcgatcact

SEQ ID NO: 91302 - DNA, 20 bp, human
gcaacctcagccgggaaacc

SEQ ID NO: 91303 - DNA, 20 bp, human
gaaagcagctgctaggctac

SEQ ID NO: 91304 - DNA, 20 bp, human
gttacctcctgacaaggcca

SEQ ID NO: 91305 - DNA, 20 bp, human
gggccattcgggacaatggt

SEQ ID NO: 91306 - DNA, 20 bp, human
ggtcttgatgaaggaaggag

SEQ ID NO: 91307 - DNA, 20 bp, human
gggtgggaggatgtggagca

SEQ ID NO: 91308 - DNA, 20 bp, human
ggtagggaccagagacgagg

SEQ ID NO: 91309 - DNA, 20 bp, human
gtgagaggcagagacagcaa

SEQ ID NO: 91310 - DNA, 20 bp, human
ggaggtgctagggaattgtg

SEQ ID NO: 91311 - DNA, 20 bp, human
gggtcaccatgagcatccag

SEQ ID NO: 91312 - DNA, 20 bp, human
gaagacacagcagagaggta

SEQ ID NO: 91313 - DNA, 20 bp, human
gtataggtaagagaacggtt

SEQ ID NO: 91314 - DNA, 20 bp, human
ggaaccttcaacagaaccgg

SEQ ID NO: 91315 - DNA, 20 bp, human
gcttcatcaagacatcaagg

SEQ ID NO: 91316 - DNA, 20 bp, human
gagaggcgcagaatcctgtg

SEQ ID NO: 91317 - DNA, 20 bp, human
gcaccgcggggcgcacctgg

SEQ ID NO: 91318 - DNA, 20 bp, human
ggggcgcctgacaaacacca

SEQ ID NO: 91319 - DNA, 20 bp, human
ggccatcaggcggaagaaga

SEQ ID NO: 91320 - DNA, 20 bp, human
gtccgcctgatggcccctct

SEQ ID NO: 91321 - DNA, 20 bp, human
ggactcactggggaagacag

SEQ ID NO: 91322 - DNA, 20 bp, human
gtgtgaccgggggctcccag

SEQ ID NO: 91323 - DNA, 20 bp, human
gccgggtgggggcaacgcgt

SEQ ID NO: 91324 - DNA, 20 bp, human
gagagcctagaggggccatc

SEQ ID NO: 91325 - DNA, 20 bp, human
gtcttgggcggaggggacaa

SEQ ID NO: 91326 - DNA, 20 bp, human
gagactgtggtaggactgag

SEQ ID NO: 91327 - DNA, 20 bp, human
ggacacctgtgtcagcatgt

SEQ ID NO: 91328 - DNA, 20 bp, human
gaggaaaagtcagtagactg

SEQ ID NO: 91329 - DNA, 20 bp, human
gaggaggcagcccagtgata

SEQ ID NO: 91330 - DNA, 20 bp, human
gcaccccacagacaaggcga

SEQ ID NO: 91331 - DNA, 20 bp, human
gagcccagtgatagggtcca

SEQ ID NO: 91332 - DNA, 20 bp, human
gcaaggcgatggagagaacc

SEQ ID NO: 91333 - DNA, 20 bp, human
ggtgcactggtgagattggg

SEQ ID NO: 91334 - DNA, 20 bp, human
gaggtcccacatgctgacac

SEQ ID NO: 91335 - DNA, 20 bp, human
gcaaactcaccacctggccg

SEQ ID NO: 91336 - DNA, 20 bp, human
gaggaggtggaccagtgata

SEQ ID NO: 91337 - DNA, 20 bp, human
gccacgtcacggacagggtg

SEQ ID NO: 91338 - DNA, 20 bp, human
gagactgtgataggattgag

SEQ ID NO: 91339 - DNA, 20 bp, human
gccaatccacgtcacggaca

SEQ ID NO: 91340 - DNA, 20 bp, human
gctctcaccaatccacgtca

SEQ ID NO: 91341 - DNA, 20 bp, human
gacagggtgaggaagacaac

SEQ ID NO: 91342 - DNA, 20 bp, human
gggactgttgcaatatggag

SEQ ID NO: 91343 - DNA, 20 bp, human
gaagacaaccgggacccaca

SEQ ID NO: 91344 - DNA, 20 bp, human
gcatggtgacacagctctcc

SEQ ID NO: 91345 - DNA, 20 bp, human
gtggcattgagagaggtcct

SEQ ID NO: 91346 - DNA, 20 bp, human
gctgccagggctgcgagtgc

SEQ ID NO: 91347 - DNA, 20 bp, human
gtggcaggcggcactggtca

SEQ ID NO: 91348 - DNA, 20 bp, human
gcgtcctggtgcatccgcag

SEQ ID NO: 91349 - DNA, 20 bp, human
gggtgtttagcgaagagggt

SEQ ID NO: 91350 - DNA, 20 bp, human
ggaagtgagtgcagaggtag

SEQ ID NO: 91351 - DNA, 20 bp, human
gcacccactgcggatgcacc

SEQ ID NO: 91352 - DNA, 20 bp, human
gcatggttaagtagctctta

SEQ ID NO: 91353 - DNA, 20 bp, human
gagccaaatcataaacggcg

SEQ ID NO: 91354 - DNA, 20 bp, human
gtcactagagactcagcact

SEQ ID NO: 91355 - DNA, 20 bp, human
ggggggcggggcctaatatc

SEQ ID NO: 91356 - DNA, 20 bp, human
gtgccctgtcccccaggtag

SEQ ID NO: 91357 - DNA, 20 bp, human
ggcaagacccccctggatgt

SEQ ID NO: 91358 - DNA, 20 bp, human
ggcacagagcacccacatcc

SEQ ID NO: 91359 - DNA, 20 bp, human
ggctattgctaaggcccgat

SEQ ID NO: 91360 - DNA, 20 bp, human
gcacaaggacgggccaccat

SEQ ID NO: 91361 - DNA, 20 bp, human
gcagagcacccacatccagg

SEQ ID NO: 91362 - DNA, 20 bp, human
gcggcactgcgctgagaccc

SEQ ID NO: 91363 - DNA, 20 bp, human
gtgcccgggaatgtgcccca

SEQ ID NO: 91364 - DNA, 20 bp, human
gcctccagacagggcaagga

SEQ ID NO: 91365 - DNA, 20 bp, human
gcctggatggggaatgtcag

SEQ ID NO: 91366 - DNA, 20 bp, human
gcagcacacagagggaccta

SEQ ID NO: 91367 - DNA, 20 bp, human
gtcagggacctgagagacag

SEQ ID NO: 91368 - DNA, 20 bp, human
gtggctggctcgctctctcc

SEQ ID NO: 91369 - DNA, 20 bp, human
gatcctctgatggaagatgt

SEQ ID NO: 91370 - DNA, 20 bp, human
gtggggacacagaggtcggc

SEQ ID NO: 91371 - DNA, 20 bp, human
gccactggtccagtaaccca

SEQ ID NO: 91372 - DNA, 20 bp, human
ggactcacacacctgcccgt

SEQ ID NO: 91373 - DNA, 20 bp, human
gagaacgctagggcccccta

SEQ ID NO: 91374 - DNA, 20 bp, human
gagacaaattccggcctctg

SEQ ID NO: 91375 - DNA, 20 bp, human
gcacgctgtagctgtctccc

SEQ ID NO: 91376 - DNA, 20 bp, human
gatcctctcgaggtgagaag

SEQ ID NO: 91377 - DNA, 20 bp, human
gtgagaagaggcttcatcaa

SEQ ID NO: 91378 - DNA, 20 bp, human
ggtgatccaagttccgactt

SEQ ID NO: 91379 - DNA, 20 bp, human
gatcaagggtgcacctgtag

SEQ ID NO: 91380 - DNA, 20 bp, human
gccacagggaagggcaagat

SEQ ID NO: 91381 - DNA, 20 bp, human
gtgcaggcggagccgactct

SEQ ID NO: 91382 - DNA, 20 bp, human
ggccagcccaagtcggaact

SEQ ID NO: 91383 - DNA, 20 bp, human
gctagattcctgggtctcta

SEQ ID NO: 91384 - DNA, 20 bp, human
ggcctgactctgctctcgag

SEQ ID NO: 91385 - DNA, 20 bp, human
ggaaccgcaaatgcaggcgg

SEQ ID NO: 91386 - DNA, 20 bp, human
gaggcagccgagagtatctg

SEQ ID NO: 91387 - DNA, 20 bp, human
gacctcgtgcggccaagacg

SEQ ID NO: 91388 - DNA, 20 bp, human
gccactgggtccgaatcagt

SEQ ID NO: 91389 - DNA, 20 bp, human
gagcaggaacatccacgtct

SEQ ID NO: 91390 - DNA, 20 bp, human
gctcaccttccagaatccag

SEQ ID NO: 91391 - DNA, 20 bp, human
ggcggggccggtaaacagga

SEQ ID NO: 91392 - DNA, 20 bp, human
gcgaggtcgggggcgtccca

SEQ ID NO: 91393 - DNA, 20 bp, human
gggacgcccccgacctcgtg

SEQ ID NO: 91394 - DNA, 20 bp, human
gtcttggccgcacgaggtcg

SEQ ID NO: 91395 - DNA, 20 bp, human
gggcgtcccatggtgaggtc

SEQ ID NO: 91396 - DNA, 20 bp, human
gtcccagcttcatgacccct

SEQ ID NO: 91397 - DNA, 20 bp, human
gtccaggatccaggtgccca

SEQ ID NO: 91398 - DNA, 20 bp, human
gcccacagaagagccgagta

SEQ ID NO: 91399 - DNA, 20 bp, human
gcaggctggctgccccttca

SEQ ID NO: 91400 - DNA, 20 bp, human
gggcagaagcctgggatggg

SEQ ID NO: 91401 - DNA, 20 bp, human
gccttagtacagccgtgaag

SEQ ID NO: 91402 - DNA, 20 bp, human
gggtgcacgttccaggatcc

SEQ ID NO: 91403 - DNA, 20 bp, human
gagccagcggtcactgatga

SEQ ID NO: 91404 - DNA, 20 bp, human
ggagccgagtaaggtggaag

SEQ ID NO: 91405 - DNA, 20 bp, human
gacagaagagccgagtaagg

SEQ ID NO: 91406 - DNA, 20 bp, human
gaaacacaattgcttcttgg

SEQ ID NO: 91407 - DNA, 20 bp, human
gaaacacaacagtagtctgg

SEQ ID NO: 91408 - DNA, 20 bp, human
gtcttcaagctgttctaatg

SEQ ID NO: 91409 - DNA, 20 bp, human
gtggctagtaatgttggaaa

SEQ ID NO: 91410 - DNA, 20 bp, human
gaggtctcaatttgtatctt

SEQ ID NO: 91411 - DNA, 20 bp, human
gaataaacacaacagtagtc

SEQ ID NO: 91412 - DNA, 20 bp, human
gtgttctaatgtggcactgc

SEQ ID NO: 91413 - DNA, 20 bp, human
gctatactctctacatactc

SEQ ID NO: 91414 - DNA, 20 bp, human
gtttaaatatttctacataa

SEQ ID NO: 91415 - DNA, 20 bp, human
gttatgaaacctcttgattt

SEQ ID NO: 91416 - DNA, 20 bp, human
gccacgccgcggaaatctag

SEQ ID NO: 91417 - DNA, 20 bp, human
gtgcccagaaacccagccgg

SEQ ID NO: 91418 - DNA, 20 bp, human
gaccggggaagcgagaggtg

SEQ ID NO: 91419 - DNA, 20 bp, human
gaccggcccgagcaagcccc

SEQ ID NO: 91420 - DNA, 20 bp, human
gcggatgaggtgatacacgc

SEQ ID NO: 91421 - DNA, 20 bp, human
gctaggggtagaggcaaggg

SEQ ID NO: 91422 - DNA, 20 bp, human
gacccagccggaggcagggt

SEQ ID NO: 91423 - DNA, 20 bp, human
gagccccaggcagctacact

SEQ ID NO: 91424 - DNA, 20 bp, human
gacgctggcgacacaatagc

SEQ ID NO: 91425 - DNA, 20 bp, human
ggagttaccggggaagcgag

SEQ ID NO: 91426 - DNA, 20 bp, human
ggtccatggcagacagagga

SEQ ID NO: 91427 - DNA, 20 bp, human
gtagagcaggggtaaccaat

SEQ ID NO: 91428 - DNA, 20 bp, human
gtatattgcttgttggtcca

SEQ ID NO: 91429 - DNA, 20 bp, human
gtaccccgaggaagagatga

SEQ ID NO: 91430 - DNA, 20 bp, human
ggttcagagtcttttaacca

SEQ ID NO: 91431 - DNA, 20 bp, human
gtaacaggaagatctaattc

SEQ ID NO: 91432 - DNA, 20 bp, human
gcacttgtcttactgagcct

SEQ ID NO: 91433 - DNA, 20 bp, human
gcaaagttgtgattatctac

SEQ ID NO: 91434 - DNA, 20 bp, human
gtgaacactttaggctaccc

SEQ ID NO: 91435 - DNA, 20 bp, human
ggatcttcctgttacattta

SEQ ID NO: 91436 - DNA, 20 bp, human
gggcagtctgcgaagattgc

SEQ ID NO: 91437 - DNA, 20 bp, human
gactcactctgagccttcac

SEQ ID NO: 91438 - DNA, 20 bp, human
gaggtaggctagtagagagt

SEQ ID NO: 91439 - DNA, 20 bp, human
ggctatagctgtgtaataaa

SEQ ID NO: 91440 - DNA, 20 bp, human
ggctcagagtgagtcaagag

SEQ ID NO: 91441 - DNA, 20 bp, human
gttgtttgtggaaatctagt

SEQ ID NO: 91442 - DNA, 20 bp, human
gatcacccactaaatgaggt

SEQ ID NO: 91443 - DNA, 20 bp, human
ggctcaatatgatacaaagg

SEQ ID NO: 91444 - DNA, 20 bp, human
gagtgctcaatatgatacaa

SEQ ID NO: 91445 - DNA, 20 bp, human
ggttgatcaatatcgtttaa

SEQ ID NO: 91446 - DNA, 20 bp, human
gcacacactagtgtctcagg

SEQ ID NO: 91447 - DNA, 20 bp, human
ggccaaaaccatttgcccag

SEQ ID NO: 91448 - DNA, 20 bp, human
gctgaagtcaaactatgtat

SEQ ID NO: 91449 - DNA, 20 bp, human
gctggagatggaatcactgt

SEQ ID NO: 91450 - DNA, 20 bp, human
gctgaaacagccctctaact

SEQ ID NO: 91451 - DNA, 20 bp, human
gaaggcaagcacaggaggat

SEQ ID NO: 91452 - DNA, 20 bp, human
ggcatgaccaaggcctaaat

SEQ ID NO: 91453 - DNA, 20 bp, human
gacataatttgttatggcgg

SEQ ID NO: 91454 - DNA, 20 bp, human
gaagtcgacataatttgtta

SEQ ID NO: 91455 - DNA, 20 bp, human
gtccctaaaacaaccttcct

SEQ ID NO: 91456 - DNA, 20 bp, human
gtcccttgatgattcaggga

SEQ ID NO: 91457 - DNA, 20 bp, human
ggtaatctgcggtccactca

SEQ ID NO: 91458 - DNA, 20 bp, human
gattgttcaactgtaatctg

SEQ ID NO: 91459 - DNA, 20 bp, human
gatcaatcccttgatgattc

SEQ ID NO: 91460 - DNA, 20 bp, human
gtagagaacccacatgcaca

SEQ ID NO: 91461 - DNA, 20 bp, human
ggggagatagagagttgatt

SEQ ID NO: 91462 - DNA, 20 bp, human
gagaatcggagttcataatt

SEQ ID NO: 91463 - DNA, 20 bp, human
gtatgtttccctgtgcatgt

SEQ ID NO: 91464 - DNA, 20 bp, human
ggtttcctttgctgccgctt

SEQ ID NO: 91465 - DNA, 20 bp, human
ggaaacataatgataaactc

SEQ ID NO: 91466 - DNA, 20 bp, human
ggtaatctgcaatccactca

SEQ ID NO: 91467 - DNA, 20 bp, human
gagaatcagagttcataaat

SEQ ID NO: 91468 - DNA, 20 bp, human
gatcttcaatgttattgttc

SEQ ID NO: 91469 - DNA, 20 bp, human
ggtttcctttgctgccactt

SEQ ID NO: 91470 - DNA, 20 bp, human
ggaaacataatgataaactc

SEQ ID NO: 91471 - DNA, 20 bp, human
gtgcttctctgaatcatcaa

SEQ ID NO: 91472 - DNA, 20 bp, human
gaaatgtaatgttccatgag

SEQ ID NO: 91473 - DNA, 20 bp, human
gataaaatatatgactgcca

SEQ ID NO: 91474 - DNA, 20 bp, human
gcagaagactaattttattc

SEQ ID NO: 91475 - DNA, 20 bp, human
gattcagagaagcattttga

SEQ ID NO: 91476 - DNA, 20 bp, human
gtgcttcttcggatcatcaa

SEQ ID NO: 91477 - DNA, 20 bp, human
gagatagagagttgatgaga

SEQ ID NO: 91478 - DNA, 20 bp, human
ggcagttgaatgcagaaagg

SEQ ID NO: 91479 - DNA, 20 bp, human
gagaatcagaggtcaaagtc

SEQ ID NO: 91480 - DNA, 20 bp, human
gcaagagaactcacgtgcac

SEQ ID NO: 91481 - DNA, 20 bp, human
gatttgtgattaacaactca

SEQ ID NO: 91482 - DNA, 20 bp, human
gaaccttcaaaatgcttctt

SEQ ID NO: 91483 - DNA, 20 bp, human
gaggcagcaaaggaaactta

SEQ ID NO: 91484 - DNA, 20 bp, human
gttgcacttgtgagaatcag

SEQ ID NO: 91485 - DNA, 20 bp, human
gacaatgcctgaataaaatc

SEQ ID NO: 91486 - DNA, 20 bp, human
gttttacacaggtattctat

SEQ ID NO: 91487 - DNA, 20 bp, human
gtgcttcttcggatcatcaa

SEQ ID NO: 91488 - DNA, 20 bp, human
gagatagagagttgatgaga

SEQ ID NO: 91489 - DNA, 20 bp, human
ggcagttgaatgcagaaagg

SEQ ID NO: 91490 - DNA, 20 bp, human
gagaatcagaggtcaaagtc

SEQ ID NO: 91491 - DNA, 20 bp, human
gcaagagaactcacgtgcac

SEQ ID NO: 91492 - DNA, 20 bp, human
gatttgtgattaacaactca

SEQ ID NO: 91493 - DNA, 20 bp, human
gaaccttcaaaatgcttctt

SEQ ID NO: 91494 - DNA, 20 bp, human
gaggcagcaaaggaaactta

SEQ ID NO: 91495 - DNA, 20 bp, human
gttgcacttgtgagaatcag

SEQ ID NO: 91496 - DNA, 20 bp, human
gggttcctggaacacttcag

SEQ ID NO: 91497 - DNA, 20 bp, human
gatgttcttgaatcatctat

SEQ ID NO: 91498 - DNA, 20 bp, human
gtgaagagtggtttctgaca

SEQ ID NO: 91499 - DNA, 20 bp, human
gtttccacaggtttgaagag

SEQ ID NO: 91500 - DNA, 20 bp, human
gtccaagagcgaagtagaga

SEQ ID NO: 91501 - DNA, 20 bp, human
gaaaccactcttcaaacctg

SEQ ID NO: 91502 - DNA, 20 bp, human
gaaaaggacatgattaacag

SEQ ID NO: 91503 - DNA, 20 bp, human
gtgttgctcacaatttaacc

SEQ ID NO: 91504 - DNA, 20 bp, human
gagttatacaatgaagaatc

SEQ ID NO: 91505 - DNA, 20 bp, human
gggtaatgctttaagagaaa

SEQ ID NO: 91506 - DNA, 20 bp, human
gttcttaaggacattctctg

SEQ ID NO: 91507 - DNA, 20 bp, human
gaaacagtccaataacacaa

SEQ ID NO: 91508 - DNA, 20 bp, human
gacacaatggaacaggatac

SEQ ID NO: 91509 - DNA, 20 bp, human
gcaattggtgtgaattaaca

SEQ ID NO: 91510 - DNA, 20 bp, human
gttagttccacattgataaa

SEQ ID NO: 91511 - DNA, 20 bp, human
gtctgtatagtgccggaaac

SEQ ID NO: 91512 - DNA, 20 bp, human
gttaagtataacatgaaatg

SEQ ID NO: 91513 - DNA, 20 bp, human
ggtttcttaaatggtaagag

SEQ ID NO: 91514 - DNA, 20 bp, human
gtctctcccatttatcaatg

SEQ ID NO: 91515 - DNA, 20 bp, human
gactgtgaaaggacaatttg

SEQ ID NO: 91516 - DNA, 20 bp, human
ggaagcagaaatctaaaggt

SEQ ID NO: 91517 - DNA, 20 bp, human
gaaccttggatatgtctctt

SEQ ID NO: 91518 - DNA, 20 bp, human
gtggaaactaatctcaacct

SEQ ID NO: 91519 - DNA, 20 bp, human
gaacatcactttcgaagaaa

SEQ ID NO: 91520 - DNA, 20 bp, human
gaatcgaagcagaaatctaa

SEQ ID NO: 91521 - DNA, 20 bp, human
gcttaacattgatcataata

SEQ ID NO: 91522 - DNA, 20 bp, human
gctgcattttcagagccatg

SEQ ID NO: 91523 - DNA, 20 bp, human
gaaactttaagttttgtagg

SEQ ID NO: 91524 - DNA, 20 bp, human
gaattttaaatgcggtgatg

SEQ ID NO: 91525 - DNA, 20 bp, human
gtgccaaagagacatatcca

SEQ ID NO: 91526 - DNA, 20 bp, human
gtaacggcaatgccctaagt

SEQ ID NO: 91527 - DNA, 20 bp, human
gtctgggcttgggttgccgt

SEQ ID NO: 91528 - DNA, 20 bp, human
gcagtaggctatggatgaat

SEQ ID NO: 91529 - DNA, 20 bp, human
ggctaaagcgggaactttgt

SEQ ID NO: 91530 - DNA, 20 bp, human
gtccatgttagagttgccta

SEQ ID NO: 91531 - DNA, 20 bp, human
ggaagggatatgtatcagtg

SEQ ID NO: 91532 - DNA, 20 bp, human
gttctgactatggaatgagg

SEQ ID NO: 91533 - DNA, 20 bp, human
gtgtggtccatagtcattct

SEQ ID NO: 91534 - DNA, 20 bp, human
gtggtacaggatctgatctt

SEQ ID NO: 91535 - DNA, 20 bp, human
gcatcttagaaacccaactt

SEQ ID NO: 91536 - DNA, 20 bp, human
gccgccacccggagacgctg

SEQ ID NO: 91537 - DNA, 20 bp, human
gcgcgggatggaggagtctt

SEQ ID NO: 91538 - DNA, 20 bp, human
gatgtgcgcgtgaagcccgt

SEQ ID NO: 91539 - DNA, 20 bp, human
gcatctacctgcagctccat

SEQ ID NO: 91540 - DNA, 20 bp, human
gggaagcgcgtggagggcct

SEQ ID NO: 91541 - DNA, 20 bp, human
ggacgctgaggagcgcacct

SEQ ID NO: 91542 - DNA, 20 bp, human
gtggtcaagctgccccggaa

SEQ ID NO: 91543 - DNA, 20 bp, human
ggtgcgctcctcagcgtctc

SEQ ID NO: 91544 - DNA, 20 bp, human
gcgggcgcctcgccattccg

SEQ ID NO: 91545 - DNA, 20 bp, human
gacccggggcgaggcgaagg

SEQ ID NO: 91546 - DNA, 20 bp, human
gatgtaaagatgtgtatcaa

SEQ ID NO: 91547 - DNA, 20 bp, human
gaatagaactcctgaggata

SEQ ID NO: 91548 - DNA, 20 bp, human
gtgcttgaatagaactcctg

SEQ ID NO: 91549 - DNA, 20 bp, human
gaattctagatcaggaactg

SEQ ID NO: 91550 - DNA, 20 bp, human
gcctgatctagaattgaaag

SEQ ID NO: 91551 - DNA, 20 bp, human
ggagttttctgatgctgtag

SEQ ID NO: 91552 - DNA, 20 bp, human
gataagcattccgtatcctc

SEQ ID NO: 91553 - DNA, 20 bp, human
gagatcttccctctctgagc

SEQ ID NO: 91554 - DNA, 20 bp, human
gaaaatgaatctttacattt

SEQ ID NO: 91555 - DNA, 20 bp, human
gtatctgatgataggtaatt

SEQ ID NO: 91556 - DNA, 20 bp, human
gttatagccattaaatacaa

SEQ ID NO: 91557 - DNA, 20 bp, human
gggactcatctgtcattcaa

SEQ ID NO: 91558 - DNA, 20 bp, human
gcagcggcaatgtttagtca

SEQ ID NO: 91559 - DNA, 20 bp, human
gcatgaatgcactaggcttg

SEQ ID NO: 91560 - DNA, 20 bp, human
gtagagtgtctccaattgga

SEQ ID NO: 91561 - DNA, 20 bp, human
gaaaaagtagctgtcattgg

SEQ ID NO: 91562 - DNA, 20 bp, human
ggatggattactattgttgg

SEQ ID NO: 91563 - DNA, 20 bp, human
gcctaaaaacatagccaatt

SEQ ID NO: 91564 - DNA, 20 bp, human
gtcagatggattactattgt

SEQ ID NO: 91565 - DNA, 20 bp, human
gttgtactttggccaactaa

SEQ ID NO: 91566 - DNA, 20 bp, human
ggaacatggcgcacagctgt

SEQ ID NO: 91567 - DNA, 20 bp, human
gcccgacccgggaccaccgg

SEQ ID NO: 91568 - DNA, 20 bp, human
ggtgaagtgaagcagcgaga

SEQ ID NO: 91569 - DNA, 20 bp, human
gggcggcagcggagaggtaa

SEQ ID NO: 91570 - DNA, 20 bp, human
gtcacttcacggggcgaaca

SEQ ID NO: 91571 - DNA, 20 bp, human
ggtcgagaccccggacctgg

SEQ ID NO: 91572 - DNA, 20 bp, human
gtgcaggtctcggccgccat

SEQ ID NO: 91573 - DNA, 20 bp, human
ggagaggcgacaacacaggg

SEQ ID NO: 91574 - DNA, 20 bp, human
gcccaaacacggcccggaac

SEQ ID NO: 91575 - DNA, 20 bp, human
gccgcccgacccgggaccac

SEQ ID NO: 91576 - DNA, 20 bp, human
gagcagggccgtgtcctccc

SEQ ID NO: 91577 - DNA, 20 bp, human
gagccccagcaaacggagca

SEQ ID NO: 91578 - DNA, 20 bp, human
ggcctccccggcccctctca

SEQ ID NO: 91579 - DNA, 20 bp, human
gggaatccgacgaggaggtg

SEQ ID NO: 91580 - DNA, 20 bp, human
gtctctccgaaggaaccctg

SEQ ID NO: 91581 - DNA, 20 bp, human
gcatcttggcaccgtgagag

SEQ ID NO: 91582 - DNA, 20 bp, human
gaggcggttggaggcgtccc

SEQ ID NO: 91583 - DNA, 20 bp, human
ggggttccttcggagagacg

SEQ ID NO: 91584 - DNA, 20 bp, human
ggacggggaatccgacgagg

SEQ ID NO: 91585 - DNA, 20 bp, human
gccggcggagccccagcaaa

SEQ ID NO: 91586 - DNA, 20 bp, human
ggggccaaaaaagtaaagat

SEQ ID NO: 91587 - DNA, 20 bp, human
ggtggaggagatgtcgaagg

SEQ ID NO: 91588 - DNA, 20 bp, human
ggaacagaagctggatgacg

SEQ ID NO: 91589 - DNA, 20 bp, human
gtagaggtggtggggacact

SEQ ID NO: 91590 - DNA, 20 bp, human
gtgggactcgaatcaggtca

SEQ ID NO: 91591 - DNA, 20 bp, human
gaaaggggagcccaccacct

SEQ ID NO: 91592 - DNA, 20 bp, human
ggagcccaccacctcggccg

SEQ ID NO: 91593 - DNA, 20 bp, human
gcctgcccaagaggagcagg

SEQ ID NO: 91594 - DNA, 20 bp, human
gaacaaacttgatcacaaag

SEQ ID NO: 91595 - DNA, 20 bp, human
ggtgatcaagtttgtttcaa

SEQ ID NO: 91596 - DNA, 20 bp, human
ggcactcacacacatcggcg

SEQ ID NO: 91597 - DNA, 20 bp, human
gactaggatgtcgtcggagg

SEQ ID NO: 91598 - DNA, 20 bp, human
gcggcgccccccggcggggt

SEQ ID NO: 91599 - DNA, 20 bp, human
gcgcgcacctccgcgcgcag

SEQ ID NO: 91600 - DNA, 20 bp, human
ggggaagcgccatctttgcg

SEQ ID NO: 91601 - DNA, 20 bp, human
gagcgccatctttgcgaggc

SEQ ID NO: 91602 - DNA, 20 bp, human
ggggctgcgggaaatgcgag

SEQ ID NO: 91603 - DNA, 20 bp, human
gtcggaggaggacaagagcg

SEQ ID NO: 91604 - DNA, 20 bp, human
gccgggccggagctgtcacc

SEQ ID NO: 91605 - DNA, 20 bp, human
gtcccggtcctcctcctggg

SEQ ID NO: 91606 - DNA, 20 bp, human
gacagcaagggtccatggca

SEQ ID NO: 91607 - DNA, 20 bp, human
gcaccaacagcaagggtcca

SEQ ID NO: 91608 - DNA, 20 bp, human
gtcagggccttatgggacac

SEQ ID NO: 91609 - DNA, 20 bp, human
ggagtctgatgtcacacagt

SEQ ID NO: 91610 - DNA, 20 bp, human
gagcagggtcagggccttat

SEQ ID NO: 91611 - DNA, 20 bp, human
gatcagactctgctgaagat

SEQ ID NO: 91612 - DNA, 20 bp, human
gaggctttgctggcatgcca

SEQ ID NO: 91613 - DNA, 20 bp, human
gagacagtaaagttcgactc

SEQ ID NO: 91614 - DNA, 20 bp, human
ggctgctgtaaagagcccat

SEQ ID NO: 91615 - DNA, 20 bp, human
ggaccagcctgtgtcccata

SEQ ID NO: 91616 - DNA, 20 bp, human
gccgctcccgaactccggca

SEQ ID NO: 91617 - DNA, 20 bp, human
gagcgcgcagcctcttcacc

SEQ ID NO: 91618 - DNA, 20 bp, human
gtcgggagcggcaacagagt

SEQ ID NO: 91619 - DNA, 20 bp, human
ggacacctgagagtcaacgt

SEQ ID NO: 91620 - DNA, 20 bp, human
ggccgagtcggagaccgtgc

SEQ ID NO: 91621 - DNA, 20 bp, human
gtgttgccgctcccgaactc

SEQ ID NO: 91622 - DNA, 20 bp, human
gtccggcacggtctccgact

SEQ ID NO: 91623 - DNA, 20 bp, human
gggagaccgtgccggagttc

SEQ ID NO: 91624 - DNA, 20 bp, human
ggccattttcccagagcgag

SEQ ID NO: 91625 - DNA, 20 bp, human
ggacactgagcgggcgcagg

SEQ ID NO: 91626 - DNA, 20 bp, human
ggagaggcctcacctatggt

SEQ ID NO: 91627 - DNA, 20 bp, human
gcccaaatcaagcctaggtt

SEQ ID NO: 91628 - DNA, 20 bp, human
ggaaggggtaggccaagatg

SEQ ID NO: 91629 - DNA, 20 bp, human
gggacttcccttcccaacct

SEQ ID NO: 91630 - DNA, 20 bp, human
gcgttgccatgactacagaa

SEQ ID NO: 91631 - DNA, 20 bp, human
ggaatggctcagtaatcagg

SEQ ID NO: 91632 - DNA, 20 bp, human
gatcaagcctaggttgggaa

SEQ ID NO: 91633 - DNA, 20 bp, human
ggagacctaaaggaatgcag

SEQ ID NO: 91634 - DNA, 20 bp, human
gtggagactagatagcaaga

SEQ ID NO: 91635 - DNA, 20 bp, human
ggaaccgagccttcaggaag

SEQ ID NO: 91636 - DNA, 20 bp, human
gggacgcggtcagggatacg

SEQ ID NO: 91637 - DNA, 20 bp, human
gctctccgcggacccctcgg

SEQ ID NO: 91638 - DNA, 20 bp, human
gggaacccctcggccatgga

SEQ ID NO: 91639 - DNA, 20 bp, human
ggctgccgcagtgtctccag

SEQ ID NO: 91640 - DNA, 20 bp, human
gcctcccgggtcctcccccc

SEQ ID NO: 91641 - DNA, 20 bp, human
gacgcgggggctgagaacgg

SEQ ID NO: 91642 - DNA, 20 bp, human
ggcgcccggggggaggaccc

SEQ ID NO: 91643 - DNA, 20 bp, human
gcctcgtcctcggggagggt

SEQ ID NO: 91644 - DNA, 20 bp, human
ggcgtcccctggagacactg

SEQ ID NO: 91645 - DNA, 20 bp, human
gctaacgcgggggctgagaa

SEQ ID NO: 91646 - DNA, 20 bp, human
gaccagtgccctgagttctg

SEQ ID NO: 91647 - DNA, 20 bp, human
gctctctgcctcagaactca

SEQ ID NO: 91648 - DNA, 20 bp, human
gcaagaatcaagagccaact

SEQ ID NO: 91649 - DNA, 20 bp, human
ggcctcagaactcagggcac

SEQ ID NO: 91650 - DNA, 20 bp, human
gacccaggaatcacagtccg

SEQ ID NO: 91651 - DNA, 20 bp, human
gaatctccctctaggagctg

SEQ ID NO: 91652 - DNA, 20 bp, human
gtatgcggtacaatacaaac

SEQ ID NO: 91653 - DNA, 20 bp, human
gataactgaagccactaaga

SEQ ID NO: 91654 - DNA, 20 bp, human
gtcctcggactgtgattcct

SEQ ID NO: 91655 - DNA, 20 bp, human
gctagttgccttgttcccaa

SEQ ID NO: 91656 - DNA, 20 bp, human
ggcgccctggcactcaccgg

SEQ ID NO: 91657 - DNA, 20 bp, human
gcgcccaccggtgagtgcca

SEQ ID NO: 91658 - DNA, 20 bp, human
gttgctggctttggaaccta

SEQ ID NO: 91659 - DNA, 20 bp, human
ggcctccgcatcaacagact

SEQ ID NO: 91660 - DNA, 20 bp, human
gagactggaattccgcccac

SEQ ID NO: 91661 - DNA, 20 bp, human
ggcccgcctgcaacgcgccc

SEQ ID NO: 91662 - DNA, 20 bp, human
gagactgggagggattacgt

SEQ ID NO: 91663 - DNA, 20 bp, human
gaggcgggaaaactttctgg

SEQ ID NO: 91664 - DNA, 20 bp, human
gacaggctttggagtcctgt

SEQ ID NO: 91665 - DNA, 20 bp, human
ggtacctccaaggctcccat

SEQ ID NO: 91666 - DNA, 20 bp, human
gcgagagcgagaaggactgc

SEQ ID NO: 91667 - DNA, 20 bp, human
gaggcggccgacttagccgg

SEQ ID NO: 91668 - DNA, 20 bp, human
ggaaggactgcgggcaggac

SEQ ID NO: 91669 - DNA, 20 bp, human
gtacatagcctggttatagg

SEQ ID NO: 91670 - DNA, 20 bp, human
ggggagtgtggagatcgaat

SEQ ID NO: 91671 - DNA, 20 bp, human
ggcggccagccggcaggtga

SEQ ID NO: 91672 - DNA, 20 bp, human
gagggtccaagccacgcccg

SEQ ID NO: 91673 - DNA, 20 bp, human
gcccaggcggccgacttagc

SEQ ID NO: 91674 - DNA, 20 bp, human
gtggcacgacagttgctgca

SEQ ID NO: 91675 - DNA, 20 bp, human
ggctgaaccctggaaggtac

SEQ ID NO: 91676 - DNA, 20 bp, human
gcatggaacctaaagactag

SEQ ID NO: 91677 - DNA, 20 bp, human
gccaatttaagcctgtggca

SEQ ID NO: 91678 - DNA, 20 bp, human
gggaacctaaagactagagg

SEQ ID NO: 91679 - DNA, 20 bp, human
gttgtgtgagtcaggaagag

SEQ ID NO: 91680 - DNA, 20 bp, human
gtgctggcggcgatgtccag

SEQ ID NO: 91681 - DNA, 20 bp, human
gagaggaacactcagatatc

SEQ ID NO: 91682 - DNA, 20 bp, human
gagaggcggttgtgtgagtc

SEQ ID NO: 91683 - DNA, 20 bp, human
gctcagtacaaggggtagaa

SEQ ID NO: 91684 - DNA, 20 bp, human
gtcccgccaatttaagcctg

SEQ ID NO: 91685 - DNA, 20 bp, human
ggcgctgtgtagggaactgg

SEQ ID NO: 91686 - DNA, 20 bp, human
gcgcgcgtaggcgctcgggc

SEQ ID NO: 91687 - DNA, 20 bp, human
gagtctcgctgctcggtgcg

SEQ ID NO: 91688 - DNA, 20 bp, human
gctcgctgctcggtgcgagg

SEQ ID NO: 91689 - DNA, 20 bp, human
ggaagagctggcccgcgcct

SEQ ID NO: 91690 - DNA, 20 bp, human
gccctcccgccggcagatcc

SEQ ID NO: 91691 - DNA, 20 bp, human
gcgccccgcctagcctcgac

SEQ ID NO: 91692 - DNA, 20 bp, human
gcacaaggccggcggaggag

SEQ ID NO: 91693 - DNA, 20 bp, human
gtgatcgccatcgggaacgc

SEQ ID NO: 91694 - DNA, 20 bp, human
gccatcgggaacgccggtcg

SEQ ID NO: 91695 - DNA, 20 bp, human
ggcaggcgcactgcgaacgc

SEQ ID NO: 91696 - DNA, 20 bp, human
gtgatttctacaatacaagt

SEQ ID NO: 91697 - DNA, 20 bp, human
gaaagtggtatacaagaatg

SEQ ID NO: 91698 - DNA, 20 bp, human
gcgatgagatgcgcaggagg

SEQ ID NO: 91699 - DNA, 20 bp, human
ggatagtttcaggcttaaaa

SEQ ID NO: 91700 - DNA, 20 bp, human
gtcccgatgagatgcgcagg

SEQ ID NO: 91701 - DNA, 20 bp, human
ggaatcccgatgagatgcgc

SEQ ID NO: 91702 - DNA, 20 bp, human
gtgattttacaggggagaag

SEQ ID NO: 91703 - DNA, 20 bp, human
gaaaagtgttgattttacag

SEQ ID NO: 91704 - DNA, 20 bp, human
gcttcattttagcaaagttg

SEQ ID NO: 91705 - DNA, 20 bp, human
gatcaacacttttttggagt

SEQ ID NO: 91706 - DNA, 20 bp, human
ggcgatgcggggggaatcag

SEQ ID NO: 91707 - DNA, 20 bp, human
ggggggaatcagcggctgta

SEQ ID NO: 91708 - DNA, 20 bp, human
gcggtctttgagctgagtcg

SEQ ID NO: 91709 - DNA, 20 bp, human
gagcgggcctgggcttccac

SEQ ID NO: 91710 - DNA, 20 bp, human
ggtagggcgactgcgttcaa

SEQ ID NO: 91711 - DNA, 20 bp, human
ggaagatgcaacgagaaagg

SEQ ID NO: 91712 - DNA, 20 bp, human
gaaaggaggaggcgaaacca

SEQ ID NO: 91713 - DNA, 20 bp, human
gggctctgccaccaagtcgt

SEQ ID NO: 91714 - DNA, 20 bp, human
gtgcatcttccccggcgtgg

SEQ ID NO: 91715 - DNA, 20 bp, human
gactcagctcaaagaccgtg

SEQ ID NO: 91716 - DNA, 20 bp, human
gccggcggcggctactcctg

SEQ ID NO: 91717 - DNA, 20 bp, human
ggcggcggcgaatcttggag

SEQ ID NO: 91718 - DNA, 20 bp, human
gagggccgcccggatgaacg

SEQ ID NO: 91719 - DNA, 20 bp, human
gaccggacggaaggttgcac

SEQ ID NO: 91720 - DNA, 20 bp, human
gccatggctgcgcgcggctc

SEQ ID NO: 91721 - DNA, 20 bp, human
ggcggtggttctccaagctg

SEQ ID NO: 91722 - DNA, 20 bp, human
gcggcggcggcggcgaatct

SEQ ID NO: 91723 - DNA, 20 bp, human
gggacggaaggttgcaccgg

SEQ ID NO: 91724 - DNA, 20 bp, human
ggccaggcgggcccagaccg

SEQ ID NO: 91725 - DNA, 20 bp, human
gctgtgcggtcggagggccc

SEQ ID NO: 91726 - DNA, 20 bp, human
ggctccggcaaagacaactg

SEQ ID NO: 91727 - DNA, 20 bp, human
gatgtgctgccggctgagag

SEQ ID NO: 91728 - DNA, 20 bp, human
ggctgccggctgagaggggg

SEQ ID NO: 91729 - DNA, 20 bp, human
gtagcagaggcgtcacagac

SEQ ID NO: 91730 - DNA, 20 bp, human
gcgccggggccctcagatcg

SEQ ID NO: 91731 - DNA, 20 bp, human
gccgccgggaccccgagtgt

SEQ ID NO: 91732 - DNA, 20 bp, human
ggacgacgccggaggggtgg

SEQ ID NO: 91733 - DNA, 20 bp, human
gcgagtgtggggattagggg

SEQ ID NO: 91734 - DNA, 20 bp, human
gcttcccggcgcgctagcag

SEQ ID NO: 91735 - DNA, 20 bp, human
gaggcgacggaatgtgctgc

SEQ ID NO: 91736 - DNA, 20 bp, human
gtgtgtggcgggtaacagaa

SEQ ID NO: 91737 - DNA, 20 bp, human
gtccccagcggcgacgtgtg

SEQ ID NO: 91738 - DNA, 20 bp, human
ggaactaccgagaaacggtg

SEQ ID NO: 91739 - DNA, 20 bp, human
gcttcacgccaggggcggag

SEQ ID NO: 91740 - DNA, 20 bp, human
gtcgctacgcttcacgccag

SEQ ID NO: 91741 - DNA, 20 bp, human
gccagcggcgacgtgtgtgg

SEQ ID NO: 91742 - DNA, 20 bp, human
gagttcgcaatccaagatgg

SEQ ID NO: 91743 - DNA, 20 bp, human
gagggccgccactccgcccc

SEQ ID NO: 91744 - DNA, 20 bp, human
gaccgagaaacggtgaggcg

SEQ ID NO: 91745 - DNA, 20 bp, human
gcgtccgcaagggaaaggtc

SEQ ID NO: 91746 - DNA, 20 bp, human
gctgggggacgggctcccgg

SEQ ID NO: 91747 - DNA, 20 bp, human
gctcttggcggcggaggcaa

SEQ ID NO: 91748 - DNA, 20 bp, human
gtccgctcgctcactcttgg

SEQ ID NO: 91749 - DNA, 20 bp, human
ggggtccgctcgctcactct

SEQ ID NO: 91750 - DNA, 20 bp, human
gctgtcctgcgcccagactg

SEQ ID NO: 91751 - DNA, 20 bp, human
gtgggcgcaggacagagagt

SEQ ID NO: 91752 - DNA, 20 bp, human
ggctcgctcactcttggcgg

SEQ ID NO: 91753 - DNA, 20 bp, human
ggcaggcctgggcggcgcta

SEQ ID NO: 91754 - DNA, 20 bp, human
ggagcgagcggacccgcgat

SEQ ID NO: 91755 - DNA, 20 bp, human
gatatggcggatctgtagga

SEQ ID NO: 91756 - DNA, 20 bp, human
gcttagatgctccagaagag

SEQ ID NO: 91757 - DNA, 20 bp, human
gcttctggagcatctaaggt

SEQ ID NO: 91758 - DNA, 20 bp, human
gctaaggtcggcatattgac

SEQ ID NO: 91759 - DNA, 20 bp, human
gagggaggtggtggagagat

SEQ ID NO: 91760 - DNA, 20 bp, human
ggtccccaatagaagcaggt

SEQ ID NO: 91761 - DNA, 20 bp, human
ggaagtagtaagttacctgc

SEQ ID NO: 91762 - DNA, 20 bp, human
gggagaaaatttaagtaccg

SEQ ID NO: 91763 - DNA, 20 bp, human
gttgttgctgtccaacctgc

SEQ ID NO: 91764 - DNA, 20 bp, human
gactggtccccaatagaagc

SEQ ID NO: 91765 - DNA, 20 bp, human
gaaagcggggtgaagagacc

SEQ ID NO: 91766 - DNA, 20 bp, human
ggagtgagaggcggcgcgca

SEQ ID NO: 91767 - DNA, 20 bp, human
gggcggagggatattcggac

SEQ ID NO: 91768 - DNA, 20 bp, human
gcagctccagccgatctagg

SEQ ID NO: 91769 - DNA, 20 bp, human
gctccagccgatctaggggg

SEQ ID NO: 91770 - DNA, 20 bp, human
ggatctagggggaggaaagt

SEQ ID NO: 91771 - DNA, 20 bp, human
ggagcgcgctggtgctcggg

SEQ ID NO: 91772 - DNA, 20 bp, human
gcgcgctctgagctgccccc

SEQ ID NO: 91773 - DNA, 20 bp, human
gccgccagcagcccatttgg

SEQ ID NO: 91774 - DNA, 20 bp, human
gcgtgcggccgtggagaacc

SEQ ID NO: 91775 - DNA, 20 bp, human
ggaagaccgtgtctcccggt

SEQ ID NO: 91776 - DNA, 20 bp, human
gggagggtgagtctaggaac

SEQ ID NO: 91777 - DNA, 20 bp, human
gggactgcttgcctgtgagg

SEQ ID NO: 91778 - DNA, 20 bp, human
gcccagggaaatagatatgt

SEQ ID NO: 91779 - DNA, 20 bp, human
gcacaggcaagcagtccttc

SEQ ID NO: 91780 - DNA, 20 bp, human
ggcctcacgactgtgaacct

SEQ ID NO: 91781 - DNA, 20 bp, human
gcaagcagtccttcaggctg

SEQ ID NO: 91782 - DNA, 20 bp, human
gccttcaggctgaggcatct

SEQ ID NO: 91783 - DNA, 20 bp, human
ggcccaggttcacagtcgtg

SEQ ID NO: 91784 - DNA, 20 bp, human
ggggtggatgtgatgttcag

SEQ ID NO: 91785 - DNA, 20 bp, human
gataaggtcagggttatcaa

SEQ ID NO: 91786 - DNA, 20 bp, human
gcgggtgcccggccgttgcg

SEQ ID NO: 91787 - DNA, 20 bp, human
gaggtcgcttagagagtcgt

SEQ ID NO: 91788 - DNA, 20 bp, human
ggagagggtgcttaactgag

SEQ ID NO: 91789 - DNA, 20 bp, human
ggcttagagagtcgtaggtt

SEQ ID NO: 91790 - DNA, 20 bp, human
gtaactgaggggcatgatgg

SEQ ID NO: 91791 - DNA, 20 bp, human
gagtcgtaggttgggtagtg

SEQ ID NO: 91792 - DNA, 20 bp, human
ggtcaccgtgctggaagaat

SEQ ID NO: 91793 - DNA, 20 bp, human
gtgctggccgccacccttaa

SEQ ID NO: 91794 - DNA, 20 bp, human
gagggggtcactgggatcag

SEQ ID NO: 91795 - DNA, 20 bp, human
gtcaggatccctagtaccca

SEQ ID NO: 91796 - DNA, 20 bp, human
ggtccaggaagcagcaccag

SEQ ID NO: 91797 - DNA, 20 bp, human
gggccggctgcccctcggag

SEQ ID NO: 91798 - DNA, 20 bp, human
gttcagacgggcgtacgaga

SEQ ID NO: 91799 - DNA, 20 bp, human
gcgcccggccccgaactcat

SEQ ID NO: 91800 - DNA, 20 bp, human
ggctcgctcccagtccgaaa

SEQ ID NO: 91801 - DNA, 20 bp, human
gcgcccggcgccggcaaaga

SEQ ID NO: 91802 - DNA, 20 bp, human
gcgcaccccaccgctccgag

SEQ ID NO: 91803 - DNA, 20 bp, human
ggcgggagagaggtacggag

SEQ ID NO: 91804 - DNA, 20 bp, human
ggcctccagccgcggctctc

SEQ ID NO: 91805 - DNA, 20 bp, human
gggcgccggcaaagagggtc

SEQ ID NO: 91806 - DNA, 20 bp, human
ggtgggcatgaaggcctcgg

SEQ ID NO: 91807 - DNA, 20 bp, human
gcctgggccgccgccgacga

SEQ ID NO: 91808 - DNA, 20 bp, human
ggggcgcacgcgaccctcgt

SEQ ID NO: 91809 - DNA, 20 bp, human
gcgcacgcgaccctcgtcgg

SEQ ID NO: 91810 - DNA, 20 bp, human
gtacctggcgcgccatcccc

SEQ ID NO: 91811 - DNA, 20 bp, human
gcccaggtccgcgcaggaga

SEQ ID NO: 91812 - DNA, 20 bp, human
gcagcctccccgccactcct

SEQ ID NO: 91813 - DNA, 20 bp, human
gactgggccgtgggtaccgg

SEQ ID NO: 91814 - DNA, 20 bp, human
ggggcccgcgccggaaaccg

SEQ ID NO: 91815 - DNA, 20 bp, human
gcaagttatcctggtagagt

SEQ ID NO: 91816 - DNA, 20 bp, human
gctgcagactgaggaaggtc

SEQ ID NO: 91817 - DNA, 20 bp, human
ggaaagggacacaccagacg

SEQ ID NO: 91818 - DNA, 20 bp, human
gagactgaggaaggtcagga

SEQ ID NO: 91819 - DNA, 20 bp, human
gtattagcaaggtagagcag

SEQ ID NO: 91820 - DNA, 20 bp, human
gtacggccgagtctacgctt

SEQ ID NO: 91821 - DNA, 20 bp, human
gcagtctgcgaagtcagggt

SEQ ID NO: 91822 - DNA, 20 bp, human
ggggtaggaaggctacacaa

SEQ ID NO: 91823 - DNA, 20 bp, human
ggggattcagacgccgcgtc

SEQ ID NO: 91824 - DNA, 20 bp, human
gttcgtgggccctccaaagg

SEQ ID NO: 91825 - DNA, 20 bp, human
gggagcagtctgcgaagtca

SEQ ID NO: 91826 - DNA, 20 bp, human
gatccgggtcaaagacaagg

SEQ ID NO: 91827 - DNA, 20 bp, human
gacggtgagcgggtctgagg

SEQ ID NO: 91828 - DNA, 20 bp, human
gctgggtacagggaaacgag

SEQ ID NO: 91829 - DNA, 20 bp, human
gcgcatccgggtcaaagaca

SEQ ID NO: 91830 - DNA, 20 bp, human
ggtggaaactgacaagctga

SEQ ID NO: 91831 - DNA, 20 bp, human
gcctcgcgcgacaaaaacga

SEQ ID NO: 91832 - DNA, 20 bp, human
gcctgtggcccactcagagt

SEQ ID NO: 91833 - DNA, 20 bp, human
ggctctgtagcgtcgagatg

SEQ ID NO: 91834 - DNA, 20 bp, human
gcagggaccaactgaaaacg

SEQ ID NO: 91835 - DNA, 20 bp, human
gcccacggtgagcgggtctg

SEQ ID NO: 91836 - DNA, 20 bp, human
gctcttggcggtgaagtaag

SEQ ID NO: 91837 - DNA, 20 bp, human
gtgaagtaagagggacgcgg

SEQ ID NO: 91838 - DNA, 20 bp, human
gcggtgaagtaagagggacg

SEQ ID NO: 91839 - DNA, 20 bp, human
gtcacactggctgttgtcag

SEQ ID NO: 91840 - DNA, 20 bp, human
ggtgctccgctgacccggga

SEQ ID NO: 91841 - DNA, 20 bp, human
gagtaagagggacgcggagg

SEQ ID NO: 91842 - DNA, 20 bp, human
gcaacagccagtgtgaacta

SEQ ID NO: 91843 - DNA, 20 bp, human
ggaccctctgagccaggacc

SEQ ID NO: 91844 - DNA, 20 bp, human
ggaccctggtcctggctcag

SEQ ID NO: 91845 - DNA, 20 bp, human
gggaagtgctccgctgaccc

SEQ ID NO: 91846 - DNA, 20 bp, human
gggtcggagtgggaaactag

SEQ ID NO: 91847 - DNA, 20 bp, human
gggataagccgcggtggagg

SEQ ID NO: 91848 - DNA, 20 bp, human
gtcccatccagcctgctcgg

SEQ ID NO: 91849 - DNA, 20 bp, human
gccagccaggggataagccg

SEQ ID NO: 91850 - DNA, 20 bp, human
gttgcggaggaagccgaggt

SEQ ID NO: 91851 - DNA, 20 bp, human
ggccgccgagcaggctggat

SEQ ID NO: 91852 - DNA, 20 bp, human
gatctagacccggagcgtca

SEQ ID NO: 91853 - DNA, 20 bp, human
gctctccgccacctccaccg

SEQ ID NO: 91854 - DNA, 20 bp, human
gaggaagccgaggtcggagt

SEQ ID NO: 91855 - DNA, 20 bp, human
ggccaggggataagccgcgg

SEQ ID NO: 91856 - DNA, 20 bp, human
ggcgcggcccggggtaaagg

SEQ ID NO: 91857 - DNA, 20 bp, human
gcgggcccggtactgtcccc

SEQ ID NO: 91858 - DNA, 20 bp, human
ggtagcccgggtcccaggaa

SEQ ID NO: 91859 - DNA, 20 bp, human
gctgctcccatggccgcccc

SEQ ID NO: 91860 - DNA, 20 bp, human
gcggccatgggagcaggacg

SEQ ID NO: 91861 - DNA, 20 bp, human
ggggcgtcgctgaggagcac

SEQ ID NO: 91862 - DNA, 20 bp, human
ggcgctgccccctttacccc

SEQ ID NO: 91863 - DNA, 20 bp, human
gtgagcggagcccactcgag

SEQ ID NO: 91864 - DNA, 20 bp, human
gccggggcggggctacactc

SEQ ID NO: 91865 - DNA, 20 bp, human
ggcgccatgggccgtcagtg

SEQ ID NO: 91866 - DNA, 20 bp, human
ggacagagagacgcctctag

SEQ ID NO: 91867 - DNA, 20 bp, human
gggccaggcccccaaggcta

SEQ ID NO: 91868 - DNA, 20 bp, human
gagagacccgggtagggaca

SEQ ID NO: 91869 - DNA, 20 bp, human
gccccggagagacccgggta

SEQ ID NO: 91870 - DNA, 20 bp, human
gcaccgacctgagggagagg

SEQ ID NO: 91871 - DNA, 20 bp, human
gaggcccccaaggctaggga

SEQ ID NO: 91872 - DNA, 20 bp, human
ggaccccgaagcgaccccgg

SEQ ID NO: 91873 - DNA, 20 bp, human
gattccccccggagagaccc

SEQ ID NO: 91874 - DNA, 20 bp, human
gcccccggccagattccccc

SEQ ID NO: 91875 - DNA, 20 bp, human
gggtgggtaaatctctcctg

SEQ ID NO: 91876 - DNA, 20 bp, human
gtcgcagctgcgggtgaacg

SEQ ID NO: 91877 - DNA, 20 bp, human
gaggatgggacgctcccgca

SEQ ID NO: 91878 - DNA, 20 bp, human
gacggtagcatctcccctca

SEQ ID NO: 91879 - DNA, 20 bp, human
ggctcccgcagggcgctctg

SEQ ID NO: 91880 - DNA, 20 bp, human
gcaggtggggatcgtggcag

SEQ ID NO: 91881 - DNA, 20 bp, human
ggcagctgcgacgacccgcg

SEQ ID NO: 91882 - DNA, 20 bp, human
gccgcagtgaaggatcgcta

SEQ ID NO: 91883 - DNA, 20 bp, human
ggaccccgatgtagacgggg

SEQ ID NO: 91884 - DNA, 20 bp, human
gttcctcgcgctcccggtag

SEQ ID NO: 91885 - DNA, 20 bp, human
gcacatcagagtgggcaggt

SEQ ID NO: 91886 - DNA, 20 bp, human
ggcggccagagaggcactcg

SEQ ID NO: 91887 - DNA, 20 bp, human
gctccagcgagggaaaacgg

SEQ ID NO: 91888 - DNA, 20 bp, human
gcactcgcggcagcccgtac

SEQ ID NO: 91889 - DNA, 20 bp, human
ggtgtccttcgggaaacagg

SEQ ID NO: 91890 - DNA, 20 bp, human
gccgtacgggtgggacctct

SEQ ID NO: 91891 - DNA, 20 bp, human
gcgcggcagcccgtacgggt

SEQ ID NO: 91892 - DNA, 20 bp, human
gtttcccgaaggacaccgag

SEQ ID NO: 91893 - DNA, 20 bp, human
ggctgccgcgagtgcctctc

SEQ ID NO: 91894 - DNA, 20 bp, human
ggcgcaggaaaaaacctccc

SEQ ID NO: 91895 - DNA, 20 bp, human
gcgactccagcgagggaaaa

SEQ ID NO: 91896 - DNA, 20 bp, human
gctgggcccacaggaacggc

SEQ ID NO: 91897 - DNA, 20 bp, human
gagccgaagccggagaacca

SEQ ID NO: 91898 - DNA, 20 bp, human
gcgctggagcggccagaaaa

SEQ ID NO: 91899 - DNA, 20 bp, human
gagcggccagaaaaaggcgc

SEQ ID NO: 91900 - DNA, 20 bp, human
gcaaatggcgtctccctcgc

SEQ ID NO: 91901 - DNA, 20 bp, human
gatttgcaagctgcttccgg

SEQ ID NO: 91902 - DNA, 20 bp, human
gttggctgggcccacaggaa

SEQ ID NO: 91903 - DNA, 20 bp, human
gcggaatgaggaatagggtg

SEQ ID NO: 91904 - DNA, 20 bp, human
gatgaggaatagggtgaggt

SEQ ID NO: 91905 - DNA, 20 bp, human
ggtttcatttccggagccac

SEQ ID NO: 91906 - DNA, 20 bp, human
gtaggagcaaggtagagtaa

SEQ ID NO: 91907 - DNA, 20 bp, human
gagcaaggtagagtaaggga

SEQ ID NO: 91908 - DNA, 20 bp, human
gccacttcggtacccagacc

SEQ ID NO: 91909 - DNA, 20 bp, human
gctgggtaccgaagtggagg

SEQ ID NO: 91910 - DNA, 20 bp, human
gacagtttagttccaggtct

SEQ ID NO: 91911 - DNA, 20 bp, human
gttagagaaaagtaggagca

SEQ ID NO: 91912 - DNA, 20 bp, human
gaggggaagtctctatgctt

SEQ ID NO: 91913 - DNA, 20 bp, human
ggctttggtggttttggcag

SEQ ID NO: 91914 - DNA, 20 bp, human
ggaggaggtggacgtggtag

SEQ ID NO: 91915 - DNA, 20 bp, human
ggcagctccacacgccgcag

SEQ ID NO: 91916 - DNA, 20 bp, human
ggagctgtatcgaacagaca

SEQ ID NO: 91917 - DNA, 20 bp, human
gttggtagcaggcactccct

SEQ ID NO: 91918 - DNA, 20 bp, human
gcctcctcctccactgcggg

SEQ ID NO: 91919 - DNA, 20 bp, human
ggcccccaccagagctccca

SEQ ID NO: 91920 - DNA, 20 bp, human
gttagctcaggggggttcag

SEQ ID NO: 91921 - DNA, 20 bp, human
gactcttcctcccgcagtgg

SEQ ID NO: 91922 - DNA, 20 bp, human
gctagcagcaaaggctccct

SEQ ID NO: 91923 - DNA, 20 bp, human
ggctcaggggggttcagtgg

SEQ ID NO: 91924 - DNA, 20 bp, human
ggagctaaatcctccaccaa

SEQ ID NO: 91925 - DNA, 20 bp, human
gtggaggatttagctcaggg

SEQ ID NO: 91926 - DNA, 20 bp, human
gcaggcccagatatccgctc

SEQ ID NO: 91927 - DNA, 20 bp, human
ggcagcctgctagaaggaga

SEQ ID NO: 91928 - DNA, 20 bp, human
gtcttccagagcggatatct

SEQ ID NO: 91929 - DNA, 20 bp, human
gcctccttggcagaaacaga

SEQ ID NO: 91930 - DNA, 20 bp, human
gtctgccaaggaggcttcca

SEQ ID NO: 91931 - DNA, 20 bp, human
ggaagatgccagagaatgag

SEQ ID NO: 91932 - DNA, 20 bp, human
ggtgcagctctcacagattc

SEQ ID NO: 91933 - DNA, 20 bp, human
ggagggtagagtacagaaaa

SEQ ID NO: 91934 - DNA, 20 bp, human
gcattctctggcatcttctt

SEQ ID NO: 91935 - DNA, 20 bp, human
gaacattgttttcaaaggat

SEQ ID NO: 91936 - DNA, 20 bp, human
ggtgcgcactgagagtgaca

SEQ ID NO: 91937 - DNA, 20 bp, human
gaaggtggccacaactggag

SEQ ID NO: 91938 - DNA, 20 bp, human
gagccgccgggacagtccgg

SEQ ID NO: 91939 - DNA, 20 bp, human
ggagagccgccgggacagtc

SEQ ID NO: 91940 - DNA, 20 bp, human
gaaggtgcgagctctagaag

SEQ ID NO: 91941 - DNA, 20 bp, human
gtggggaaggtggccacaac

SEQ ID NO: 91942 - DNA, 20 bp, human
gggtggctccggaagttcca

SEQ ID NO: 91943 - DNA, 20 bp, human
gttagcttcctacctggata

SEQ ID NO: 91944 - DNA, 20 bp, human
gccggaactagaaccaaaca

SEQ ID NO: 91945 - DNA, 20 bp, human
ggcccaggaggtggctctct

SEQ ID NO: 91946 - DNA, 20 bp, human
gagaggagctctgcaggcgg

SEQ ID NO: 91947 - DNA, 20 bp, human
gtggcctgggccgaggactg

SEQ ID NO: 91948 - DNA, 20 bp, human
gccacctccatagctggcag

SEQ ID NO: 91949 - DNA, 20 bp, human
gataaaaggtgtccactctg

SEQ ID NO: 91950 - DNA, 20 bp, human
gatagaagcttgcttggcct

SEQ ID NO: 91951 - DNA, 20 bp, human
ggctcctctgccagctatgg

SEQ ID NO: 91952 - DNA, 20 bp, human
ggtgatggcggcctcctcac

SEQ ID NO: 91953 - DNA, 20 bp, human
gagagctcctctgccagcta

SEQ ID NO: 91954 - DNA, 20 bp, human
gatggaggcggcgtgagctg

SEQ ID NO: 91955 - DNA, 20 bp, human
gccgaaaccacctccatagc

SEQ ID NO: 91956 - DNA, 20 bp, human
ggcaggtggtcatggtgcag

SEQ ID NO: 91957 - DNA, 20 bp, human
gggtggtcatggtgcagagg

SEQ ID NO: 91958 - DNA, 20 bp, human
ggagaaatcttaaggtctca

SEQ ID NO: 91959 - DNA, 20 bp, human
gtgggaacaattcatgcccc

SEQ ID NO: 91960 - DNA, 20 bp, human
gtcttaaggtctcaggggcc

SEQ ID NO: 91961 - DNA, 20 bp, human
gttgttcctcaggtcctcaa

SEQ ID NO: 91962 - DNA, 20 bp, human
gttcacccaccttgttcctc

SEQ ID NO: 91963 - DNA, 20 bp, human
ggtcatggtgcagaggaggg

SEQ ID NO: 91964 - DNA, 20 bp, human
gcccccagaggagaagcggg

SEQ ID NO: 91965 - DNA, 20 bp, human
gcatcctcccgcttctcctc

SEQ ID NO: 91966 - DNA, 20 bp, human
ggggtttgctgagaactcac

SEQ ID NO: 91967 - DNA, 20 bp, human
gcctcctgccagcatctctt

SEQ ID NO: 91968 - DNA, 20 bp, human
gtgcagaaatgtggtggtca

SEQ ID NO: 91969 - DNA, 20 bp, human
gagggtcaggaggaggatat

SEQ ID NO: 91970 - DNA, 20 bp, human
ggcgatggtggtctcctctc

SEQ ID NO: 91971 - DNA, 20 bp, human
ggtggggggagtctctctgg

SEQ ID NO: 91972 - DNA, 20 bp, human
gagccaggagggaaccccct

SEQ ID NO: 91973 - DNA, 20 bp, human
gggggtggctcaacccgagg

SEQ ID NO: 91974 - DNA, 20 bp, human
gggggtggcatgagggtctg

SEQ ID NO: 91975 - DNA, 20 bp, human
gaccaggccaggctgcacgc

SEQ ID NO: 91976 - DNA, 20 bp, human
gctacagcagcggggctctg

SEQ ID NO: 91977 - DNA, 20 bp, human
gctcctcattagcaccaggt

SEQ ID NO: 91978 - DNA, 20 bp, human
gtttcctgattggtagacta

SEQ ID NO: 91979 - DNA, 20 bp, human
gtgctcactatggccctgag

SEQ ID NO: 91980 - DNA, 20 bp, human
ggaaactggcacagcatcct

SEQ ID NO: 91981 - DNA, 20 bp, human
ggcgaagataaagctctgtc

SEQ ID NO: 91982 - DNA, 20 bp, human
gtcattagcaccaggtggga

SEQ ID NO: 91983 - DNA, 20 bp, human
ggaggtgtgggagggttcta

SEQ ID NO: 91984 - DNA, 20 bp, human
gcagcccaggctgtagcccc

SEQ ID NO: 91985 - DNA, 20 bp, human
ggagcctcctcattagcacc

SEQ ID NO: 91986 - DNA, 20 bp, human
ggaaggctgagagcgtgctg

SEQ ID NO: 91987 - DNA, 20 bp, human
gtgagcagttggctgaaaga

SEQ ID NO: 91988 - DNA, 20 bp, human
gtctcctctcgcttctcctc

SEQ ID NO: 91989 - DNA, 20 bp, human
gcccccagaggagaagcgag

SEQ ID NO: 91990 - DNA, 20 bp, human
ggaaagaaggaaaggtgctc

SEQ ID NO: 91991 - DNA, 20 bp, human
ggctcctgcggcatcggagg

SEQ ID NO: 91992 - DNA, 20 bp, human
ggctttggtagtggcttcgg

SEQ ID NO: 91993 - DNA, 20 bp, human
gttggtagtggcttcggggg

SEQ ID NO: 91994 - DNA, 20 bp, human
ggcaggtggtcatggtgcca

SEQ ID NO: 91995 - DNA, 20 bp, human
gagttggctgaaagaaggaa

SEQ ID NO: 91996 - DNA, 20 bp, human
gaaaggaagcgggcgaaccc

SEQ ID NO: 91997 - DNA, 20 bp, human
gagctgagtcaggaacaaag

SEQ ID NO: 91998 - DNA, 20 bp, human
gggggacagcaagctgagtc

SEQ ID NO: 91999 - DNA, 20 bp, human
ggcttgctgtccccagaaaa

SEQ ID NO: 92000 - DNA, 20 bp, human
gcaggaacaaagaggccttg

SEQ ID NO: 92001 - DNA, 20 bp, human
ggttcgcccgcttcctttat

SEQ ID NO: 92002 - DNA, 20 bp, human
gctggagaggttgtaggatg

SEQ ID NO: 92003 - DNA, 20 bp, human
gcggcctgggcagcaccctc

SEQ ID NO: 92004 - DNA, 20 bp, human
gggctccaaggggctccaca

SEQ ID NO: 92005 - DNA, 20 bp, human
gggttgtaggatgaggcagg

SEQ ID NO: 92006 - DNA, 20 bp, human
gcaggctttgcggacgacgg

SEQ ID NO: 92007 - DNA, 20 bp, human
gtggccaccgggatagccgg

SEQ ID NO: 92008 - DNA, 20 bp, human
gagacccccggctatcccgg

SEQ ID NO: 92009 - DNA, 20 bp, human
gacctgagggctcaggtaag

SEQ ID NO: 92010 - DNA, 20 bp, human
ggctttgcggacgacggtgg

SEQ ID NO: 92011 - DNA, 20 bp, human
ggccctgaaagcagcctcga

SEQ ID NO: 92012 - DNA, 20 bp, human
ggctccgagccgtccacctg

SEQ ID NO: 92013 - DNA, 20 bp, human
gggccaaccgggcatggaca

SEQ ID NO: 92014 - DNA, 20 bp, human
gcgctcaccccccagaaacg

SEQ ID NO: 92015 - DNA, 20 bp, human
gcaggtgttgttggccctcg

SEQ ID NO: 92016 - DNA, 20 bp, human
gaggacctgcgggacaaggt

SEQ ID NO: 92017 - DNA, 20 bp, human
gggacgacgtggccgacgac

SEQ ID NO: 92018 - DNA, 20 bp, human
gagcacggacggagcaaccc

SEQ ID NO: 92019 - DNA, 20 bp, human
gatcgcagcttctgagacca

SEQ ID NO: 92020 - DNA, 20 bp, human
gctgcgattcgcgggaggag

SEQ ID NO: 92021 - DNA, 20 bp, human
gtagtagtggctgtagtcgc

SEQ ID NO: 92022 - DNA, 20 bp, human
gtagtggctgtagtcgcggg

SEQ ID NO: 92023 - DNA, 20 bp, human
ggcgcgcccagcattcacgg

SEQ ID NO: 92024 - DNA, 20 bp, human
gcgtccttcggaggcctggg

SEQ ID NO: 92025 - DNA, 20 bp, human
ggacgaggacacaaagcggg

SEQ ID NO: 92026 - DNA, 20 bp, human
ggtccagggaggaaagtcac

SEQ ID NO: 92027 - DNA, 20 bp, human
ggtggcagcggcttcagtgg

SEQ ID NO: 92028 - DNA, 20 bp, human
gatgatgcctttgtccaggg

SEQ ID NO: 92029 - DNA, 20 bp, human
ggcccccaaaacctccaaag

SEQ ID NO: 92030 - DNA, 20 bp, human
gactcaactgtgctgctggg

SEQ ID NO: 92031 - DNA, 20 bp, human
gctcatgatgcctttgtcca

SEQ ID NO: 92032 - DNA, 20 bp, human
ggtggtgttggaggtttagg

SEQ ID NO: 92033 - DNA, 20 bp, human
ggcgccgctggtggatttgg

SEQ ID NO: 92034 - DNA, 20 bp, human
ggaagctggaagttgatctc

SEQ ID NO: 92035 - DNA, 20 bp, human
gcctcctccagccacactaa

SEQ ID NO: 92036 - DNA, 20 bp, human
gagctacaggtgctccctcc

SEQ ID NO: 92037 - DNA, 20 bp, human
gggaggagctcaggcttctg

SEQ ID NO: 92038 - DNA, 20 bp, human
gagcacctgtagcttcagga

SEQ ID NO: 92039 - DNA, 20 bp, human
gggcctgcaaggaggagctc

SEQ ID NO: 92040 - DNA, 20 bp, human
gatgggagcgatctcacagg

SEQ ID NO: 92041 - DNA, 20 bp, human
gtccctcctggaatctccaa

SEQ ID NO: 92042 - DNA, 20 bp, human
gctgtagcttcaggatggtt

SEQ ID NO: 92043 - DNA, 20 bp, human
gatccattggagattccagg

SEQ ID NO: 92044 - DNA, 20 bp, human
gactatgggagcgatctcac

SEQ ID NO: 92045 - DNA, 20 bp, human
gttctgcgactgaaatccat

SEQ ID NO: 92046 - DNA, 20 bp, human
ggttcagttagccaaggtgg

SEQ ID NO: 92047 - DNA, 20 bp, human
gtcgataggatgagtcgctg

SEQ ID NO: 92048 - DNA, 20 bp, human
ggcgactcatcctatcgata

SEQ ID NO: 92049 - DNA, 20 bp, human
gacctcagagaggccgggac

SEQ ID NO: 92050 - DNA, 20 bp, human
ggataaggttcagttagcca

SEQ ID NO: 92051 - DNA, 20 bp, human
gacaggcaccttccagaata

SEQ ID NO: 92052 - DNA, 20 bp, human
ggggtcaacataccataaaa

SEQ ID NO: 92053 - DNA, 20 bp, human
gaggttcctatcattaacat

SEQ ID NO: 92054 - DNA, 20 bp, human
gcagctactcaatgagatca

SEQ ID NO: 92055 - DNA, 20 bp, human
gtcggtctgcgcggaaggca

SEQ ID NO: 92056 - DNA, 20 bp, human
gggcaccagcagagagatcc

SEQ ID NO: 92057 - DNA, 20 bp, human
gcagatgggaccatgaactc

SEQ ID NO: 92058 - DNA, 20 bp, human
ggtctggctgaagctgtgtc

SEQ ID NO: 92059 - DNA, 20 bp, human
ggaaccccaagaccctccag

SEQ ID NO: 92060 - DNA, 20 bp, human
ggaccctggagatccagatg

SEQ ID NO: 92061 - DNA, 20 bp, human
ggccatggaaggaggccgag

SEQ ID NO: 92062 - DNA, 20 bp, human
gcccatctgtgtttgggacg

SEQ ID NO: 92063 - DNA, 20 bp, human
gctccgcgtggtgaaggaca

SEQ ID NO: 92064 - DNA, 20 bp, human
ggaagcagccccctactagg

SEQ ID NO: 92065 - DNA, 20 bp, human
gggaaagccgcatcctgaaa

SEQ ID NO: 92066 - DNA, 20 bp, human
ggcgcgagacgagcaagaca

SEQ ID NO: 92067 - DNA, 20 bp, human
ggctatggtggtggtatggg

SEQ ID NO: 92068 - DNA, 20 bp, human
gttgtccaggcgaataggag

SEQ ID NO: 92069 - DNA, 20 bp, human
gtgagcttgtccaggcgaat

SEQ ID NO: 92070 - DNA, 20 bp, human
gaggtggtgttggcgatggg

SEQ ID NO: 92071 - DNA, 20 bp, human
gggagttctagattcagcag

SEQ ID NO: 92072 - DNA, 20 bp, human
ggcctgagtggggggtctag

SEQ ID NO: 92073 - DNA, 20 bp, human
gctggaggcttctacagcta

SEQ ID NO: 92074 - DNA, 20 bp, human
gaccgctagaccccccactc

SEQ ID NO: 92075 - DNA, 20 bp, human
ggaggcttctacagctatgg

SEQ ID NO: 92076 - DNA, 20 bp, human
gctggaaagtcgaagagaca

SEQ ID NO: 92077 - DNA, 20 bp, human
gtcgaagagacatggtatca

SEQ ID NO: 92078 - DNA, 20 bp, human
gtagagtctgagtgatccag

SEQ ID NO: 92079 - DNA, 20 bp, human
gctcatcgggaggaaacaca

SEQ ID NO: 92080 - DNA, 20 bp, human
gtcggaggcagctcatcggg

SEQ ID NO: 92081 - DNA, 20 bp, human
ggtgatccagtggtgggacg

SEQ ID NO: 92082 - DNA, 20 bp, human
ggcatgcacactgtccaggt

SEQ ID NO: 92083 - DNA, 20 bp, human
ggatcactcagactctatgg

SEQ ID NO: 92084 - DNA, 20 bp, human
ggacagtgtgcatgctctgg

SEQ ID NO: 92085 - DNA, 20 bp, human
gcgggaggaaacacaggggg

SEQ ID NO: 92086 - DNA, 20 bp, human
ggaaagtcgaaaagacatgg

SEQ ID NO: 92087 - DNA, 20 bp, human
gccagaaagtcgaaaagaca

SEQ ID NO: 92088 - DNA, 20 bp, human
gccaagggagctaacaagtg

SEQ ID NO: 92089 - DNA, 20 bp, human
ggttcgcgagcagatcctcc

SEQ ID NO: 92090 - DNA, 20 bp, human
ggcatgcacatggtccaggt

SEQ ID NO: 92091 - DNA, 20 bp, human
gcgtgttcccgggaagagcc

SEQ ID NO: 92092 - DNA, 20 bp, human
ggaggaagcttctgcaatag

SEQ ID NO: 92093 - DNA, 20 bp, human
gctcgcgaactgggtctggt

SEQ ID NO: 92094 - DNA, 20 bp, human
gcatgtgcatgctctagagg

SEQ ID NO: 92095 - DNA, 20 bp, human
ggaccatgtgcatgctctag

SEQ ID NO: 92096 - DNA, 20 bp, human
ggcacagacatggtgtccgg

SEQ ID NO: 92097 - DNA, 20 bp, human
gagcatcaccgcagaaacaa

SEQ ID NO: 92098 - DNA, 20 bp, human
ggaagaaaagcgcacagaca

SEQ ID NO: 92099 - DNA, 20 bp, human
gcaaggccacggcaagaacc

SEQ ID NO: 92100 - DNA, 20 bp, human
gagcgcacagacatggtgtc

SEQ ID NO: 92101 - DNA, 20 bp, human
ggtaatcatgatcaaggcca

SEQ ID NO: 92102 - DNA, 20 bp, human
gcttggagcagaagatcaag

SEQ ID NO: 92103 - DNA, 20 bp, human
ggtgatgctctgatggtgaa

SEQ ID NO: 92104 - DNA, 20 bp, human
ggctcatctgcaggaggcta

SEQ ID NO: 92105 - DNA, 20 bp, human
gcatctgcaggaggctatgg

SEQ ID NO: 92106 - DNA, 20 bp, human
gcaagtccacggcaagatcc

SEQ ID NO: 92107 - DNA, 20 bp, human
gatacaagcagcatttccaa

SEQ ID NO: 92108 - DNA, 20 bp, human
ggataatgtgcgagctctgg

SEQ ID NO: 92109 - DNA, 20 bp, human
gcaggcagcagtgcatgtgg

SEQ ID NO: 92110 - DNA, 20 bp, human
gctggataatgtgcgagctc

SEQ ID NO: 92111 - DNA, 20 bp, human
gctgtcagacccctcaatgg

SEQ ID NO: 92112 - DNA, 20 bp, human
gacggacctggatcttgccg

SEQ ID NO: 92113 - DNA, 20 bp, human
gatccaggtaggatgccaag

SEQ ID NO: 92114 - DNA, 20 bp, human
gtccaagggcaccaccagca

SEQ ID NO: 92115 - DNA, 20 bp, human
gggtatgaaaaatacggacc

SEQ ID NO: 92116 - DNA, 20 bp, human
ggaagagtgtaagttaagca

SEQ ID NO: 92117 - DNA, 20 bp, human
ggacaagccagcaagacatc

SEQ ID NO: 92118 - DNA, 20 bp, human
gttgggagcggctatggagg

SEQ ID NO: 92119 - DNA, 20 bp, human
ggctttgggagcggctatgg

SEQ ID NO: 92120 - DNA, 20 bp, human
ggagctggcggaggggccta

SEQ ID NO: 92121 - DNA, 20 bp, human
gctgctcatggtaaggagct

SEQ ID NO: 92122 - DNA, 20 bp, human
ggggcctatggcttccggag

SEQ ID NO: 92123 - DNA, 20 bp, human
ggctccgctccggaagccat

SEQ ID NO: 92124 - DNA, 20 bp, human
gccagcaagacatctggtgg

SEQ ID NO: 92125 - DNA, 20 bp, human
ggtggctttgggagcggcta

SEQ ID NO: 92126 - DNA, 20 bp, human
gtgtgggtctccttcctcta

SEQ ID NO: 92127 - DNA, 20 bp, human
gagttgtagggcatagtgct

SEQ ID NO: 92128 - DNA, 20 bp, human
gaaaataggactggtaactg

SEQ ID NO: 92129 - DNA, 20 bp, human
gtcctcaatggtcttaaaat

SEQ ID NO: 92130 - DNA, 20 bp, human
gcacagcaaactctcttgct

SEQ ID NO: 92131 - DNA, 20 bp, human
gaatggtcttaaaataggac

SEQ ID NO: 92132 - DNA, 20 bp, human
gtgtagggcatagtgctggg

SEQ ID NO: 92133 - DNA, 20 bp, human
gctccaagccacagagctgt

SEQ ID NO: 92134 - DNA, 20 bp, human
gttagactctgtcttcagcc

SEQ ID NO: 92135 - DNA, 20 bp, human
gtgggcaggcagaagttgta

SEQ ID NO: 92136 - DNA, 20 bp, human
gcagctacctgacgagggtg

SEQ ID NO: 92137 - DNA, 20 bp, human
gcagcaggaggatgtcatgt

SEQ ID NO: 92138 - DNA, 20 bp, human
gctggccagctacctgacga

SEQ ID NO: 92139 - DNA, 20 bp, human
gggagtcatggtgagcacct

SEQ ID NO: 92140 - DNA, 20 bp, human
gtggctggccggaaggtggt

SEQ ID NO: 92141 - DNA, 20 bp, human
gagagaggcttgcaagttgt

SEQ ID NO: 92142 - DNA, 20 bp, human
ggactggtagtcaggagtca

SEQ ID NO: 92143 - DNA, 20 bp, human
gcgggggcagctcttgagag

SEQ ID NO: 92144 - DNA, 20 bp, human
gacgccgctggaacagaccg

SEQ ID NO: 92145 - DNA, 20 bp, human
gggaggatgtcatgttggag

SEQ ID NO: 92146 - DNA, 20 bp, human
ggacccaccgctctacaacc

SEQ ID NO: 92147 - DNA, 20 bp, human
ggcgacacagtgcctccagt

SEQ ID NO: 92148 - DNA, 20 bp, human
ggacagagtccaaaatctcc

SEQ ID NO: 92149 - DNA, 20 bp, human
gcctccagtaggaagttgtc

SEQ ID NO: 92150 - DNA, 20 bp, human
gaaatctccaggttgtagag

SEQ ID NO: 92151 - DNA, 20 bp, human
gtctcccgacaacttcctac

SEQ ID NO: 92152 - DNA, 20 bp, human
gtggtagctggcacacacca

SEQ ID NO: 92153 - DNA, 20 bp, human
gctccaggttgtagagcggt

SEQ ID NO: 92154 - DNA, 20 bp, human
ggtaagacatggtgcaggga

SEQ ID NO: 92155 - DNA, 20 bp, human
gtcacagcagcaggagccct

SEQ ID NO: 92156 - DNA, 20 bp, human
gcagggaggcagtggagctc

SEQ ID NO: 92157 - DNA, 20 bp, human
gtaagccttggtcctttcca

SEQ ID NO: 92158 - DNA, 20 bp, human
gaaggaccaaggcttatccc

SEQ ID NO: 92159 - DNA, 20 bp, human
ggttcattaagctggcagtg

SEQ ID NO: 92160 - DNA, 20 bp, human
ggataagtagttcattaagc

SEQ ID NO: 92161 - DNA, 20 bp, human
gtgacatactaaactgtgaa

SEQ ID NO: 92162 - DNA, 20 bp, human
gaaacctgattccttttccc

SEQ ID NO: 92163 - DNA, 20 bp, human
gttttccctgggataagcct

SEQ ID NO: 92164 - DNA, 20 bp, human
gaaagccctggaaaggacca

SEQ ID NO: 92165 - DNA, 20 bp, human
ggcagttgctcacattggca

SEQ ID NO: 92166 - DNA, 20 bp, human
gaaagcaggtaagctgctgg

SEQ ID NO: 92167 - DNA, 20 bp, human
gctgctgctggccccccata

SEQ ID NO: 92168 - DNA, 20 bp, human
gggagaaactcatccaggag

SEQ ID NO: 92169 - DNA, 20 bp, human
ggagggggttggccatatgg

SEQ ID NO: 92170 - DNA, 20 bp, human
gataaaaggactgcagagga

SEQ ID NO: 92171 - DNA, 20 bp, human
gtggtgtgacataagctgaa

SEQ ID NO: 92172 - DNA, 20 bp, human
gcttcctgggtgctagtggt

SEQ ID NO: 92173 - DNA, 20 bp, human
gtttcatcagatggcttcat

SEQ ID NO: 92174 - DNA, 20 bp, human
gtcaccaaccactagcaccc

SEQ ID NO: 92175 - DNA, 20 bp, human
gggtgagggggttggccata

SEQ ID NO: 92176 - DNA, 20 bp, human
ggtagtcagggcacatgtag

SEQ ID NO: 92177 - DNA, 20 bp, human
gggagagccgcatccgtgag

SEQ ID NO: 92178 - DNA, 20 bp, human
gctgggcagaagcagctaca

SEQ ID NO: 92179 - DNA, 20 bp, human
gtgcaattgataggtctctg

SEQ ID NO: 92180 - DNA, 20 bp, human
gctgctgctcacaccactca

SEQ ID NO: 92181 - DNA, 20 bp, human
gctcacaccactcacggatg

SEQ ID NO: 92182 - DNA, 20 bp, human
gagaagagaagccggccttg

SEQ ID NO: 92183 - DNA, 20 bp, human
gcggatgcggctctccaggc

SEQ ID NO: 92184 - DNA, 20 bp, human
gtacattgcggacacacgag

SEQ ID NO: 92185 - DNA, 20 bp, human
gtcgctaccagctacagtgg

SEQ ID NO: 92186 - DNA, 20 bp, human
ggacccagtggagaaggtag

SEQ ID NO: 92187 - DNA, 20 bp, human
gaggcccttgatagacccag

SEQ ID NO: 92188 - DNA, 20 bp, human
ggtggccatggtgctagcag

SEQ ID NO: 92189 - DNA, 20 bp, human
gggtagtctgggcagatgta

SEQ ID NO: 92190 - DNA, 20 bp, human
gtggcactcagaagacaggt

SEQ ID NO: 92191 - DNA, 20 bp, human
gtctccactgggtctatcaa

SEQ ID NO: 92192 - DNA, 20 bp, human
gaaggtaggggtgcaggtct

SEQ ID NO: 92193 - DNA, 20 bp, human
gggtctatcaagggcctctg

SEQ ID NO: 92194 - DNA, 20 bp, human
ggtaccatgccaacacccaa

SEQ ID NO: 92195 - DNA, 20 bp, human
gctgctaggtcgggcctctc

SEQ ID NO: 92196 - DNA, 20 bp, human
ggtgctgtagaaggaggtca

SEQ ID NO: 92197 - DNA, 20 bp, human
gcaacccagagggcatgagg

SEQ ID NO: 92198 - DNA, 20 bp, human
gagaaggaggtcatggtgta

SEQ ID NO: 92199 - DNA, 20 bp, human
gcatgaggaggtgctgtaga

SEQ ID NO: 92200 - DNA, 20 bp, human
ggctggcacccaacatcgat

SEQ ID NO: 92201 - DNA, 20 bp, human
gaggcacatggaggcagcat

SEQ ID NO: 92202 - DNA, 20 bp, human
gaagcagtgtgactggttgg

SEQ ID NO: 92203 - DNA, 20 bp, human
ggacaagcagtgtgactggt

SEQ ID NO: 92204 - DNA, 20 bp, human
gatgttgccgggaatgtgac

SEQ ID NO: 92205 - DNA, 20 bp, human
gtgtctctcctatcgatgtt

SEQ ID NO: 92206 - DNA, 20 bp, human
ggaggagctgctgtaggaag

SEQ ID NO: 92207 - DNA, 20 bp, human
gtggcaagggacaagcagtg

SEQ ID NO: 92208 - DNA, 20 bp, human
ggctggcacccaatgtcgat

SEQ ID NO: 92209 - DNA, 20 bp, human
gcgttggccaaaaggcacat

SEQ ID NO: 92210 - DNA, 20 bp, human
gaggcacatgggggcaatgt

SEQ ID NO: 92211 - DNA, 20 bp, human
gcgacattgggtgccagcct

SEQ ID NO: 92212 - DNA, 20 bp, human
gatgtgccacgttggccaaa

SEQ ID NO: 92213 - DNA, 20 bp, human
gctgtctctcccatcgacat

SEQ ID NO: 92214 - DNA, 20 bp, human
gaagcagtgtggcaggtagg

SEQ ID NO: 92215 - DNA, 20 bp, human
ggttggcctctgccccaggc

SEQ ID NO: 92216 - DNA, 20 bp, human
gcacatactatggacaccaa

SEQ ID NO: 92217 - DNA, 20 bp, human
ggtaatcaggacatagaaca

SEQ ID NO: 92218 - DNA, 20 bp, human
gatcctggtgaccacagacc

SEQ ID NO: 92219 - DNA, 20 bp, human
gtaaagccagacacatacta

SEQ ID NO: 92220 - DNA, 20 bp, human
gacaaaagcgaggagtgggt

SEQ ID NO: 92221 - DNA, 20 bp, human
gcatggggttgaaggagaat

SEQ ID NO: 92222 - DNA, 20 bp, human
gtgcgacaaaagcgaggagt

SEQ ID NO: 92223 - DNA, 20 bp, human
gactgcagctggtatggtga

SEQ ID NO: 92224 - DNA, 20 bp, human
ggaacgagagaatgctgaac

SEQ ID NO: 92225 - DNA, 20 bp, human
ggaactggaatctaaaatcc

SEQ ID NO: 92226 - DNA, 20 bp, human
gtgagggctccagcactcac

SEQ ID NO: 92227 - DNA, 20 bp, human
gcactgctgtctggcaatca

SEQ ID NO: 92228 - DNA, 20 bp, human
gtggctgcagagagcgagct

SEQ ID NO: 92229 - DNA, 20 bp, human
gcctcggacacactgctgtc

SEQ ID NO: 92230 - DNA, 20 bp, human
ggtgtggctgggtcacgaca

SEQ ID NO: 92231 - DNA, 20 bp, human
gaagcctctacaacctcagg

SEQ ID NO: 92232 - DNA, 20 bp, human
gctccagcactcaccggcct

SEQ ID NO: 92233 - DNA, 20 bp, human
gagccacagctgaagccccg

SEQ ID NO: 92234 - DNA, 20 bp, human
ggagatccagaaagtccgga

SEQ ID NO: 92235 - DNA, 20 bp, human
gcccgctgggggaattcagg

SEQ ID NO: 92236 - DNA, 20 bp, human
gggaagcagctagatacctt

SEQ ID NO: 92237 - DNA, 20 bp, human
gtgaggtaggtctcaaagag

SEQ ID NO: 92238 - DNA, 20 bp, human
gtaccttgggcaatgacaaa

SEQ ID NO: 92239 - DNA, 20 bp, human
ggctctgaaggcgtctagga

SEQ ID NO: 92240 - DNA, 20 bp, human
gtccagtggcttagaatctc

SEQ ID NO: 92241 - DNA, 20 bp, human
gaccatgcaggacagcgtgg

SEQ ID NO: 92242 - DNA, 20 bp, human
gctgagaaaacgtgactatg

SEQ ID NO: 92243 - DNA, 20 bp, human
gcaagactaagtacatgggg

SEQ ID NO: 92244 - DNA, 20 bp, human
gcatgtgcccagccacaccc

SEQ ID NO: 92245 - DNA, 20 bp, human
gtcctccacgctgtcctgca

SEQ ID NO: 92246 - DNA, 20 bp, human
gaagccgtgccacaggactc

SEQ ID NO: 92247 - DNA, 20 bp, human
ggaagtaacgctgataatcc

SEQ ID NO: 92248 - DNA, 20 bp, human
gtgtgaacaggatatcccaa

SEQ ID NO: 92249 - DNA, 20 bp, human
gcagcccgcgagacctggat

SEQ ID NO: 92250 - DNA, 20 bp, human
gcaacgcagagctggaatcc

SEQ ID NO: 92251 - DNA, 20 bp, human
gcaaccggaagccgtgccac

SEQ ID NO: 92252 - DNA, 20 bp, human
ggataatccgggcacaccat

SEQ ID NO: 92253 - DNA, 20 bp, human
gggatgtagcacaggtaccg

SEQ ID NO: 92254 - DNA, 20 bp, human
gtaatagtccctgcttggtg

SEQ ID NO: 92255 - DNA, 20 bp, human
gcccagtaaagtagcatggc

SEQ ID NO: 92256 - DNA, 20 bp, human
ggccatccttcaagcttcgt

SEQ ID NO: 92257 - DNA, 20 bp, human
gtagtacctacgaagcttga

SEQ ID NO: 92258 - DNA, 20 bp, human
gagcctaggtggatgttgta

SEQ ID NO: 92259 - DNA, 20 bp, human
gtaccttacaacatccacct

SEQ ID NO: 92260 - DNA, 20 bp, human
gcgggtgattagcaactatc

SEQ ID NO: 92261 - DNA, 20 bp, human
ggtttgtgagacagaacatc

SEQ ID NO: 92262 - DNA, 20 bp, human
gaccagaagaaaggaacatt

SEQ ID NO: 92263 - DNA, 20 bp, human
gtgaaggatggctggagctt

SEQ ID NO: 92264 - DNA, 20 bp, human
ggtaaattggcaccaggtta

SEQ ID NO: 92265 - DNA, 20 bp, human
gatgctatagaaattgtcac

SEQ ID NO: 92266 - DNA, 20 bp, human
gaagagaaccaggcactagt

SEQ ID NO: 92267 - DNA, 20 bp, human
gcaggcactagtgggttggg

SEQ ID NO: 92268 - DNA, 20 bp, human
ggaaccaggcactagtgggt

SEQ ID NO: 92269 - DNA, 20 bp, human
gctagtgggttgggaggtgc

SEQ ID NO: 92270 - DNA, 20 bp, human
gtatccatcagcactagtgg

SEQ ID NO: 92271 - DNA, 20 bp, human
gctggtgcgggagacagacg

SEQ ID NO: 92272 - DNA, 20 bp, human
gcccccggaccgggacacgg

SEQ ID NO: 92273 - DNA, 20 bp, human
gcatggtggcttgttcctgg

SEQ ID NO: 92274 - DNA, 20 bp, human
gccggaaggacacacttgac

SEQ ID NO: 92275 - DNA, 20 bp, human
gggatatccatcagcactag

SEQ ID NO: 92276 - DNA, 20 bp, human
gggactaggaatcaggctcg

SEQ ID NO: 92277 - DNA, 20 bp, human
gcggggcagcagcttatata

SEQ ID NO: 92278 - DNA, 20 bp, human
gagggaagagaagcaggact

SEQ ID NO: 92279 - DNA, 20 bp, human
ggagctgaggagagtgtgag

SEQ ID NO: 92280 - DNA, 20 bp, human
gagaagcaggactaggaatc

SEQ ID NO: 92281 - DNA, 20 bp, human
gccccaggccatacagactg

SEQ ID NO: 92282 - DNA, 20 bp, human
gctcttggatgcctccaggg

SEQ ID NO: 92283 - DNA, 20 bp, human
ggcctgggtggtgcatgtgg

SEQ ID NO: 92284 - DNA, 20 bp, human
gctgctgtggctcctgatgg

SEQ ID NO: 92285 - DNA, 20 bp, human
gtgaggagagtgtgagaggc

SEQ ID NO: 92286 - DNA, 20 bp, human
gctcagaggcatgcaggacc

SEQ ID NO: 92287 - DNA, 20 bp, human
gcagctggacagcattgtcg

SEQ ID NO: 92288 - DNA, 20 bp, human
ggggtgaccagggccagaag

SEQ ID NO: 92289 - DNA, 20 bp, human
ggaagcaaaaatcgtctctt

SEQ ID NO: 92290 - DNA, 20 bp, human
gcgggaaaatgttgaatccc

SEQ ID NO: 92291 - DNA, 20 bp, human
gaagaacaagtgagttaaac

SEQ ID NO: 92292 - DNA, 20 bp, human
gtattacccccttctggccc

SEQ ID NO: 92293 - DNA, 20 bp, human
gtcctaacaacccatgtccg

SEQ ID NO: 92294 - DNA, 20 bp, human
gtcttcatttccacggacat

SEQ ID NO: 92295 - DNA, 20 bp, human
gtaggaatattacccccttc

SEQ ID NO: 92296 - DNA, 20 bp, human
gtccagtagcagcttatata

SEQ ID NO: 92297 - DNA, 20 bp, human
gtgagaggctggaggcgaga

SEQ ID NO: 92298 - DNA, 20 bp, human
ggagaagcaggacgaggaat

SEQ ID NO: 92299 - DNA, 20 bp, human
ggtggcctgggtggcgcatg

SEQ ID NO: 92300 - DNA, 20 bp, human
gtcctccacatgcgccaccc

SEQ ID NO: 92301 - DNA, 20 bp, human
gagggaggagaagcaggacg

SEQ ID NO: 92302 - DNA, 20 bp, human
ggggcttaggagagtgtgag

SEQ ID NO: 92303 - DNA, 20 bp, human
gcatggttccaggagatgag

SEQ ID NO: 92304 - DNA, 20 bp, human
gttaggagagtgtgagaggc

SEQ ID NO: 92305 - DNA, 20 bp, human
gccccaggccatacagactg

SEQ ID NO: 92306 - DNA, 20 bp, human
gggcgagcgttggaggctgg

SEQ ID NO: 92307 - DNA, 20 bp, human
gagagggctgtggcgagcgt

SEQ ID NO: 92308 - DNA, 20 bp, human
gtgtggcgagcgttggaggc

SEQ ID NO: 92309 - DNA, 20 bp, human
gattatgagagagcatgggc

SEQ ID NO: 92310 - DNA, 20 bp, human
gataatatataagctactgc

SEQ ID NO: 92311 - DNA, 20 bp, human
gtatatattatgagagagca

SEQ ID NO: 92312 - DNA, 20 bp, human
ggggctgtggcgagcgttgg

SEQ ID NO: 92313 - DNA, 20 bp, human
ggttggaggctggaggcgag

SEQ ID NO: 92314 - DNA, 20 bp, human
gcatggttccaggagatgag

SEQ ID NO: 92315 - DNA, 20 bp, human
gagaagcaggacaaggaatc

SEQ ID NO: 92316 - DNA, 20 bp, human
ggcgcaggcagggctagtta

SEQ ID NO: 92317 - DNA, 20 bp, human
ggagcgcgaggtgaataccg

SEQ ID NO: 92318 - DNA, 20 bp, human
ggagctgaagtggatggaca

SEQ ID NO: 92319 - DNA, 20 bp, human
gcccgccgctaggtccatcc

SEQ ID NO: 92320 - DNA, 20 bp, human
gcaggcagggctagttaggg

SEQ ID NO: 92321 - DNA, 20 bp, human
ggcgccgcggcccgagaagg

SEQ ID NO: 92322 - DNA, 20 bp, human
ggaataccggggagctgaag

SEQ ID NO: 92323 - DNA, 20 bp, human
ggacctagcggcgggcgagg

SEQ ID NO: 92324 - DNA, 20 bp, human
gtgaggcgccgaggccgtag

SEQ ID NO: 92325 - DNA, 20 bp, human
ggccgggatggacctagcgg

SEQ ID NO: 92326 - DNA, 20 bp, human
gaagctcagatgcaggaggg

SEQ ID NO: 92327 - DNA, 20 bp, human
gggtgtccggagcctcaatg

SEQ ID NO: 92328 - DNA, 20 bp, human
gcaactgtatgcccacctgg

SEQ ID NO: 92329 - DNA, 20 bp, human
ggacaccccccaggctgtag

SEQ ID NO: 92330 - DNA, 20 bp, human
gacaaagctcagatgcagga

SEQ ID NO: 92331 - DNA, 20 bp, human
ggtggcagcgggaagagtgg

SEQ ID NO: 92332 - DNA, 20 bp, human
gggcagctcatcctccttcc

SEQ ID NO: 92333 - DNA, 20 bp, human
ggcgggaagagtggaggcta

SEQ ID NO: 92334 - DNA, 20 bp, human
gctcattgacggtaacctgg

SEQ ID NO: 92335 - DNA, 20 bp, human
gggttctgctggttgtagtg

SEQ ID NO: 92336 - DNA, 20 bp, human
gatcccgccagagaggaccg

SEQ ID NO: 92337 - DNA, 20 bp, human
gacccgggcccggaatgagg

SEQ ID NO: 92338 - DNA, 20 bp, human
gcctccgtgtgcccacccgg

SEQ ID NO: 92339 - DNA, 20 bp, human
gctgagggatgcccccgggt

SEQ ID NO: 92340 - DNA, 20 bp, human
gtcccccgcggggagcgcct

SEQ ID NO: 92341 - DNA, 20 bp, human
gctcccacacagctcgccag

SEQ ID NO: 92342 - DNA, 20 bp, human
ggcgggggaaatgggtcagt

SEQ ID NO: 92343 - DNA, 20 bp, human
ggaagcccaggcgctccccg

SEQ ID NO: 92344 - DNA, 20 bp, human
ggctccgcggtcctctctgg

SEQ ID NO: 92345 - DNA, 20 bp, human
ggcgagctgtgtgggagcgt

SEQ ID NO: 92346 - DNA, 20 bp, human
ggtggacaggaacctagatg

SEQ ID NO: 92347 - DNA, 20 bp, human
ggaggaggttacttcatacc

SEQ ID NO: 92348 - DNA, 20 bp, human
gggagccaaagtgctgaagg

SEQ ID NO: 92349 - DNA, 20 bp, human
gcatacccggcctccaactc

SEQ ID NO: 92350 - DNA, 20 bp, human
gccaacacaccaggactatt

SEQ ID NO: 92351 - DNA, 20 bp, human
ggtaacctcctcctgagcct

SEQ ID NO: 92352 - DNA, 20 bp, human
gtgtgtgctaaaccaacacc

SEQ ID NO: 92353 - DNA, 20 bp, human
gtgttgggatggacttgcaa

SEQ ID NO: 92354 - DNA, 20 bp, human
gtaagagagaggagcagctg

SEQ ID NO: 92355 - DNA, 20 bp, human
ggggtgctgggctaagagag

SEQ ID NO: 92356 - DNA, 20 bp, human
gtcagttgccgactcatggt

SEQ ID NO: 92357 - DNA, 20 bp, human
gtgccgactcatggtgggaa

SEQ ID NO: 92358 - DNA, 20 bp, human
ggagcctctatagccttgga

SEQ ID NO: 92359 - DNA, 20 bp, human
gattccctccaaggctatag

SEQ ID NO: 92360 - DNA, 20 bp, human
gatgttcagttgccgactca

SEQ ID NO: 92361 - DNA, 20 bp, human
gtcggcagtggtgccaagga

SEQ ID NO: 92362 - DNA, 20 bp, human
gcttgttgacagtgacctgg

SEQ ID NO: 92363 - DNA, 20 bp, human
ggcgttcgggctggaggtta

SEQ ID NO: 92364 - DNA, 20 bp, human
gtcaggcctggctctgggta

SEQ ID NO: 92365 - DNA, 20 bp, human
gaatacgccgattccctcca

SEQ ID NO: 92366 - DNA, 20 bp, human
gaggactgccgagacatggt

SEQ ID NO: 92367 - DNA, 20 bp, human
ggccggcgagaaggcacctg

SEQ ID NO: 92368 - DNA, 20 bp, human
gacctgaggtgggctggtac

SEQ ID NO: 92369 - DNA, 20 bp, human
ggtgaggaaggccggcgaga

SEQ ID NO: 92370 - DNA, 20 bp, human
gggcgagaaggcacctgagg

SEQ ID NO: 92371 - DNA, 20 bp, human
gtccagtctggcagccgcag

SEQ ID NO: 92372 - DNA, 20 bp, human
gttgcaggtgaagaggagtc

SEQ ID NO: 92373 - DNA, 20 bp, human
gatggaggactgccgagaca

SEQ ID NO: 92374 - DNA, 20 bp, human
ggcctccagggggacacacg

SEQ ID NO: 92375 - DNA, 20 bp, human
gcataaaagccacgagacca

SEQ ID NO: 92376 - DNA, 20 bp, human
gtcatagtgagagagcttgg

SEQ ID NO: 92377 - DNA, 20 bp, human
ggtggcagaggagtaggtag

SEQ ID NO: 92378 - DNA, 20 bp, human
ggcaagagctgagagggata

SEQ ID NO: 92379 - DNA, 20 bp, human
ggtaggtagtggttttggag

SEQ ID NO: 92380 - DNA, 20 bp, human
gtttgcaagaaatccttcag

SEQ ID NO: 92381 - DNA, 20 bp, human
gtggtcctggtgtatttggt

SEQ ID NO: 92382 - DNA, 20 bp, human
gtgttcatagtgagagagct

SEQ ID NO: 92383 - DNA, 20 bp, human
gcaggaccaccaaagctgcc

SEQ ID NO: 92384 - DNA, 20 bp, human
ggctccgctcctgaagccac

SEQ ID NO: 92385 - DNA, 20 bp, human
gttggtggtcctggtgtatt

SEQ ID NO: 92386 - DNA, 20 bp, human
gcggagccagatcttttcaa

SEQ ID NO: 92387 - DNA, 20 bp, human
gtaatggggaggagcaccag

SEQ ID NO: 92388 - DNA, 20 bp, human
gtgcccccaggaggacaata

SEQ ID NO: 92389 - DNA, 20 bp, human
ggtggtggatatgggatcca

SEQ ID NO: 92390 - DNA, 20 bp, human
gctaggagcctctacaatct

SEQ ID NO: 92391 - DNA, 20 bp, human
gactgccacccagattgtag

SEQ ID NO: 92392 - DNA, 20 bp, human
gtttggggttggcagcaccg

SEQ ID NO: 92393 - DNA, 20 bp, human
gggatatgggatccatggaa

SEQ ID NO: 92394 - DNA, 20 bp, human
gcgcggactgagaactaaat

SEQ ID NO: 92395 - DNA, 20 bp, human
gtgtgtgttatgctcgaggg

SEQ ID NO: 92396 - DNA, 20 bp, human
gcggcatggggagagagaca

SEQ ID NO: 92397 - DNA, 20 bp, human
gctctcgtgggagtacctgg

SEQ ID NO: 92398 - DNA, 20 bp, human
ggtgcctggaaggctctcgt

SEQ ID NO: 92399 - DNA, 20 bp, human
gtctccctgtgccctccggg

SEQ ID NO: 92400 - DNA, 20 bp, human
gccccatgccgggcccagag

SEQ ID NO: 92401 - DNA, 20 bp, human
gggagtacctgggggtcagg

SEQ ID NO: 92402 - DNA, 20 bp, human
ggcccctctgggcccggcat

SEQ ID NO: 92403 - DNA, 20 bp, human
gacagtcacgcagctgcaga

SEQ ID NO: 92404 - DNA, 20 bp, human
gccttccaggcaccccccaa

SEQ ID NO: 92405 - DNA, 20 bp, human
gttcttggatgccccccgga

SEQ ID NO: 92406 - DNA, 20 bp, human
ggccggagggcaggatgaga

SEQ ID NO: 92407 - DNA, 20 bp, human
gtagctgcagaggggccgga

SEQ ID NO: 92408 - DNA, 20 bp, human
gggacctcatagctgcagag

SEQ ID NO: 92409 - DNA, 20 bp, human
gacagtggcccagcagctca

SEQ ID NO: 92410 - DNA, 20 bp, human
ggcgagtgcgcactcaggag

SEQ ID NO: 92411 - DNA, 20 bp, human
gctcatagctgcagaggggc

SEQ ID NO: 92412 - DNA, 20 bp, human
gtatgtttgccgagagacgg

SEQ ID NO: 92413 - DNA, 20 bp, human
ggtggccccccaagttatag

SEQ ID NO: 92414 - DNA, 20 bp, human
gctgctgacccccctccatg

SEQ ID NO: 92415 - DNA, 20 bp, human
gtgacggtgtctcggagcag

SEQ ID NO: 92416 - DNA, 20 bp, human
gttggatccaagcccttagg

SEQ ID NO: 92417 - DNA, 20 bp, human
gatcagtgagggacccatca

SEQ ID NO: 92418 - DNA, 20 bp, human
ggcccttaggaggctttaga

SEQ ID NO: 92419 - DNA, 20 bp, human
gagggtactgggctgattcg

SEQ ID NO: 92420 - DNA, 20 bp, human
gagtgggtcccatgcctgaa

SEQ ID NO: 92421 - DNA, 20 bp, human
gacccatcagggcttctgta

SEQ ID NO: 92422 - DNA, 20 bp, human
ggccttacagaagccctgat

SEQ ID NO: 92423 - DNA, 20 bp, human
gagtgaagatgtgtcaacag

SEQ ID NO: 92424 - DNA, 20 bp, human
gtcaagagctgccatctctt

SEQ ID NO: 92425 - DNA, 20 bp, human
gtctttggatccaagccctt

SEQ ID NO: 92426 - DNA, 20 bp, human
gggcacagtcagccacgcag

SEQ ID NO: 92427 - DNA, 20 bp, human
gccgggactaccaggagaaa

SEQ ID NO: 92428 - DNA, 20 bp, human
ggagaagctgcttcttggtg

SEQ ID NO: 92429 - DNA, 20 bp, human
gcatagggaccgggactacc

SEQ ID NO: 92430 - DNA, 20 bp, human
gggtgagggtcccccctgcg

SEQ ID NO: 92431 - DNA, 20 bp, human
gtggagatgtgcatagggac

SEQ ID NO: 92432 - DNA, 20 bp, human
ggggggctggagatgtgcat

SEQ ID NO: 92433 - DNA, 20 bp, human
ggcagcagcaactttcgcgg

SEQ ID NO: 92434 - DNA, 20 bp, human
gaggagctgatgcgggaacc

SEQ ID NO: 92435 - DNA, 20 bp, human
gaccaggagaaaggggctgc

SEQ ID NO: 92436 - DNA, 20 bp, human
gagggttgagagctttacag

SEQ ID NO: 92437 - DNA, 20 bp, human
gaggaagtggacagcatgga

SEQ ID NO: 92438 - DNA, 20 bp, human
gacagaggaagtggacagca

SEQ ID NO: 92439 - DNA, 20 bp, human
gtaaggaaaggcctgtaaag

SEQ ID NO: 92440 - DNA, 20 bp, human
gggaaaggcctgtaaagagg

SEQ ID NO: 92441 - DNA, 20 bp, human
gtggccaccgggatagccgg

SEQ ID NO: 92442 - DNA, 20 bp, human
ggaatgacggaaagaggcaa

SEQ ID NO: 92443 - DNA, 20 bp, human
gaagagcagcagctaggcat

SEQ ID NO: 92444 - DNA, 20 bp, human
gctggcggaatggggactat

SEQ ID NO: 92445 - DNA, 20 bp, human
gccccctcccggtggagtag

SEQ ID NO: 92446 - DNA, 20 bp, human
ggcaaggtgagcacaagtag

SEQ ID NO: 92447 - DNA, 20 bp, human
gagcctggggttgcgtcggg

SEQ ID NO: 92448 - DNA, 20 bp, human
gggtccaacttgacatccag

SEQ ID NO: 92449 - DNA, 20 bp, human
gtgccacccgacgcaacccc

SEQ ID NO: 92450 - DNA, 20 bp, human
ggtgagcctggggttgcgtc

SEQ ID NO: 92451 - DNA, 20 bp, human
gagggggtcccaaacatgaa

SEQ ID NO: 92452 - DNA, 20 bp, human
ggctgtgaggtgaccccggt

SEQ ID NO: 92453 - DNA, 20 bp, human
gtggcaggctctggttgctc

SEQ ID NO: 92454 - DNA, 20 bp, human
gtcggctggcactatctcca

SEQ ID NO: 92455 - DNA, 20 bp, human
ggtgctcaccttgccaatta

SEQ ID NO: 92456 - DNA, 20 bp, human
gtccctagggatgagaagag

SEQ ID NO: 92457 - DNA, 20 bp, human
ggctagacgtgtcagtggga

SEQ ID NO: 92458 - DNA, 20 bp, human
gtcatactgtgccttaatct

SEQ ID NO: 92459 - DNA, 20 bp, human
gtgcctgctagacgtgtcag

SEQ ID NO: 92460 - DNA, 20 bp, human
gtgcatcattgccgagatta

SEQ ID NO: 92461 - DNA, 20 bp, human
gccctctcttctcatcccta

SEQ ID NO: 92462 - DNA, 20 bp, human
gagggctgccaatctgaggt

SEQ ID NO: 92463 - DNA, 20 bp, human
gtctggggatgctggtccct

SEQ ID NO: 92464 - DNA, 20 bp, human
gacaccacagatgattttgc

SEQ ID NO: 92465 - DNA, 20 bp, human
gcgacattgtcacccgcagc

SEQ ID NO: 92466 - DNA, 20 bp, human
ggccctggaggaaagaaccg

SEQ ID NO: 92467 - DNA, 20 bp, human
gtggaaagagtggtacgaca

SEQ ID NO: 92468 - DNA, 20 bp, human
ggatagacccgactgtgcag

SEQ ID NO: 92469 - DNA, 20 bp, human
gagggtaaagagggatgaga

SEQ ID NO: 92470 - DNA, 20 bp, human
gcacacctggaggctacccg

SEQ ID NO: 92471 - DNA, 20 bp, human
gagggtacctccacacctgg

SEQ ID NO: 92472 - DNA, 20 bp, human
gcatagtgggtgaccatccg

SEQ ID NO: 92473 - DNA, 20 bp, human
gaagagtggtacgacatggc

SEQ ID NO: 92474 - DNA, 20 bp, human
gaggcagagaaatgcggccc

SEQ ID NO: 92475 - DNA, 20 bp, human
ggccccggttctttcctcca

SEQ ID NO: 92476 - DNA, 20 bp, human
gttaggaggtgtctgaacag

SEQ ID NO: 92477 - DNA, 20 bp, human
gaagccacaggtcatgacgg

SEQ ID NO: 92478 - DNA, 20 bp, human
gcctgtggcttcaactccat

SEQ ID NO: 92479 - DNA, 20 bp, human
gggtcatgacggaggttagg

SEQ ID NO: 92480 - DNA, 20 bp, human
ggacacagctgaagtttcca

SEQ ID NO: 92481 - DNA, 20 bp, human
gaagggcctgccatcagcca

SEQ ID NO: 92482 - DNA, 20 bp, human
gacaggtcatgacggaggtt

SEQ ID NO: 92483 - DNA, 20 bp, human
ggacaaggtgggtgtcgtcc

SEQ ID NO: 92484 - DNA, 20 bp, human
gctgcccctggcacataaaa

SEQ ID NO: 92485 - DNA, 20 bp, human
gcatgagtaggggttcagga

SEQ ID NO: 92486 - DNA, 20 bp, human
gtgaccagagctgactcggt

SEQ ID NO: 92487 - DNA, 20 bp, human
gagagctgactcggtaggag

SEQ ID NO: 92488 - DNA, 20 bp, human
ggtcacagctgtgatagatg

SEQ ID NO: 92489 - DNA, 20 bp, human
gtcagctctggtcaccgggt

SEQ ID NO: 92490 - DNA, 20 bp, human
gaccaaagcggactccacag

SEQ ID NO: 92491 - DNA, 20 bp, human
ggaatgggtgagctggagct

SEQ ID NO: 92492 - DNA, 20 bp, human
gctagggctgacagctgtgt

SEQ ID NO: 92493 - DNA, 20 bp, human
gcaccccggatagcagctgt

SEQ ID NO: 92494 - DNA, 20 bp, human
gagcctacagctgctatccg

SEQ ID NO: 92495 - DNA, 20 bp, human
gctggctttggttacagagt

SEQ ID NO: 92496 - DNA, 20 bp, human
gagcggcacgacatcgtgtg

SEQ ID NO: 92497 - DNA, 20 bp, human
ggagtctgagaggcagcgga

SEQ ID NO: 92498 - DNA, 20 bp, human
gagcaggacacccctcggta

SEQ ID NO: 92499 - DNA, 20 bp, human
gtcggtagcaggacacccct

SEQ ID NO: 92500 - DNA, 20 bp, human
gcctgctaccgagggctgac

SEQ ID NO: 92501 - DNA, 20 bp, human
ggtgcgggcggcagagtgcg

SEQ ID NO: 92502 - DNA, 20 bp, human
gcatcctgagctgatcctgt

SEQ ID NO: 92503 - DNA, 20 bp, human
ggcgggccccggatagctgt

SEQ ID NO: 92504 - DNA, 20 bp, human
gagccacctacagctatccg

SEQ ID NO: 92505 - DNA, 20 bp, human
gggccccggatagctgtagg

SEQ ID NO: 92506 - DNA, 20 bp, human
gcacccgaaactggaagctg

SEQ ID NO: 92507 - DNA, 20 bp, human
ggtactgtggagccacaggg

SEQ ID NO: 92508 - DNA, 20 bp, human
gggacggctggcatgaaagt

SEQ ID NO: 92509 - DNA, 20 bp, human
gtggctgggccacccgaaac

SEQ ID NO: 92510 - DNA, 20 bp, human
ggggcagcagcacatatgat

SEQ ID NO: 92511 - DNA, 20 bp, human
gtggcagctctgggcatggg

SEQ ID NO: 92512 - DNA, 20 bp, human
gtggggcagctgaacgtctg

SEQ ID NO: 92513 - DNA, 20 bp, human
gatgggtactgtggagccac

SEQ ID NO: 92514 - DNA, 20 bp, human
ggtgcctaggaccttagtgg

SEQ ID NO: 92515 - DNA, 20 bp, human
gggggaaatgtgtccctgat

SEQ ID NO: 92516 - DNA, 20 bp, human
ggacacagctggtagctcac

SEQ ID NO: 92517 - DNA, 20 bp, human
gcgggttgagaagcagtgat

SEQ ID NO: 92518 - DNA, 20 bp, human
gctgcggctcaagtaggacg

SEQ ID NO: 92519 - DNA, 20 bp, human
ggccccctgaggagctgaag

SEQ ID NO: 92520 - DNA, 20 bp, human
gccgccgctgcggctcaagt

SEQ ID NO: 92521 - DNA, 20 bp, human
gctaccggctcccaagtgca

SEQ ID NO: 92522 - DNA, 20 bp, human
ggctacggcggaggatctgg

SEQ ID NO: 92523 - DNA, 20 bp, human
ggcagtgataggagtgctac

SEQ ID NO: 92524 - DNA, 20 bp, human
gggaggctatagtagttctg

SEQ ID NO: 92525 - DNA, 20 bp, human
ggccgattcagctcttctag

SEQ ID NO: 92526 - DNA, 20 bp, human
gcaggagttgatctgaaggt

SEQ ID NO: 92527 - DNA, 20 bp, human
ggtgtcaggagttgatctga

SEQ ID NO: 92528 - DNA, 20 bp, human
gctggtctgacagcaggcca

SEQ ID NO: 92529 - DNA, 20 bp, human
gctagagtcacaagtcccac

SEQ ID NO: 92530 - DNA, 20 bp, human
gtcctagcttctcaaccggt

SEQ ID NO: 92531 - DNA, 20 bp, human
gtggctgcctattccactgc

SEQ ID NO: 92532 - DNA, 20 bp, human
gtcacagcagcgtggctggc

SEQ ID NO: 92533 - DNA, 20 bp, human
ggcagctcaccacgcagcag

SEQ ID NO: 92534 - DNA, 20 bp, human
gagatcaactcctgacacca

SEQ ID NO: 92535 - DNA, 20 bp, human
gtggaggagtttctgaatta

SEQ ID NO: 92536 - DNA, 20 bp, human
gtgggagctggtatgaagtc

SEQ ID NO: 92537 - DNA, 20 bp, human
ggtatgaagtctgggttgct

SEQ ID NO: 92538 - DNA, 20 bp, human
gtcctagcttctcaactagt

SEQ ID NO: 92539 - DNA, 20 bp, human
gagtttctgagttttggtga

SEQ ID NO: 92540 - DNA, 20 bp, human
gttggtgatggctgccacat

SEQ ID NO: 92541 - DNA, 20 bp, human
gggcagcaggtcatggtgtt

SEQ ID NO: 92542 - DNA, 20 bp, human
gaggtcatggtgttgggagc

SEQ ID NO: 92543 - DNA, 20 bp, human
ggctccaccagtgggacatg

SEQ ID NO: 92544 - DNA, 20 bp, human
ggcagctggcagcaggttgg

SEQ ID NO: 92545 - DNA, 20 bp, human
gctccacacggcagtctggg

SEQ ID NO: 92546 - DNA, 20 bp, human
gtggccagctgttccaccag

SEQ ID NO: 92547 - DNA, 20 bp, human
gctccacgtggcaatctggg

SEQ ID NO: 92548 - DNA, 20 bp, human
gcaggcaggtgccctccacg

SEQ ID NO: 92549 - DNA, 20 bp, human
gggccatggtgtcaggagtt

SEQ ID NO: 92550 - DNA, 20 bp, human
ggccctccacgtggcaatct

SEQ ID NO: 92551 - DNA, 20 bp, human
gcagcttaccaggtagcagg

SEQ ID NO: 92552 - DNA, 20 bp, human
gtcttaagcgatcagcaacc

SEQ ID NO: 92553 - DNA, 20 bp, human
ggatcgcttaagaatgaaag

SEQ ID NO: 92554 - DNA, 20 bp, human
gtgggggtgtgcagcttacc

SEQ ID NO: 92555 - DNA, 20 bp, human
gtaccaggtagcaggggggc

SEQ ID NO: 92556 - DNA, 20 bp, human
gctccacacgactgtctggg

SEQ ID NO: 92557 - DNA, 20 bp, human
ggccctccacacgactgtct

SEQ ID NO: 92558 - DNA, 20 bp, human
gtgccgcccagacagtcgtg

SEQ ID NO: 92559 - DNA, 20 bp, human
gtaagagttaggttgcttgg

SEQ ID NO: 92560 - DNA, 20 bp, human
gtcccactgatggagaagct

SEQ ID NO: 92561 - DNA, 20 bp, human
gggttaagagttaggttgct

SEQ ID NO: 92562 - DNA, 20 bp, human
gttcccagcttctcaaccag

SEQ ID NO: 92563 - DNA, 20 bp, human
gtgccaactgcaccatgccc

SEQ ID NO: 92564 - DNA, 20 bp, human
gatcccagcttctccatcag

SEQ ID NO: 92565 - DNA, 20 bp, human
gttggtggtgacttccacgt

SEQ ID NO: 92566 - DNA, 20 bp, human
ggggaagactcggagcaggt

SEQ ID NO: 92567 - DNA, 20 bp, human
gacacaggcttgttacagac

SEQ ID NO: 92568 - DNA, 20 bp, human
gcagcatgaaggggaagact

SEQ ID NO: 92569 - DNA, 20 bp, human
gacccgccaagagtcagtgc

SEQ ID NO: 92570 - DNA, 20 bp, human
ggaaggggaagactcggagc

SEQ ID NO: 92571 - DNA, 20 bp, human
gcgcctgcactgactcttgg

SEQ ID NO: 92572 - DNA, 20 bp, human
gccagcccccagcttgaccc

SEQ ID NO: 92573 - DNA, 20 bp, human
gtggtagcatggggttgtgc

SEQ ID NO: 92574 - DNA, 20 bp, human
ggtgtgagcctgtcagctgc

SEQ ID NO: 92575 - DNA, 20 bp, human
gaggtaggcacgaagcacac

SEQ ID NO: 92576 - DNA, 20 bp, human
ggctggcagcatgaagaaga

SEQ ID NO: 92577 - DNA, 20 bp, human
gacagcaggactgttgacac

SEQ ID NO: 92578 - DNA, 20 bp, human
gtggtggatgcagccgtgct

SEQ ID NO: 92579 - DNA, 20 bp, human
gcaggactgttgacacgggg

SEQ ID NO: 92580 - DNA, 20 bp, human
gtgagctgggggagctgaga

SEQ ID NO: 92581 - DNA, 20 bp, human
ggacgcggctgccatagctc

SEQ ID NO: 92582 - DNA, 20 bp, human
gtcacaggtcactcggcagc

SEQ ID NO: 92583 - DNA, 20 bp, human
ggccgtgctgggggttgagc

SEQ ID NO: 92584 - DNA, 20 bp, human
gagggggccggggcgcagca

SEQ ID NO: 92585 - DNA, 20 bp, human
gggagatgcagcaagctggc

SEQ ID NO: 92586 - DNA, 20 bp, human
ggtgagtgagtgatcgtgcc

SEQ ID NO: 92587 - DNA, 20 bp, human
gatcgtgccaggcctctgag

SEQ ID NO: 92588 - DNA, 20 bp, human
gggtgcagcctgactggcag

SEQ ID NO: 92589 - DNA, 20 bp, human
gcagacggacatggtagacg

SEQ ID NO: 92590 - DNA, 20 bp, human
gttccgaccactcagaggcc

SEQ ID NO: 92591 - DNA, 20 bp, human
ggacgtgagtgagtgagtgt

SEQ ID NO: 92592 - DNA, 20 bp, human
gtgccaggcctctgagtggt

SEQ ID NO: 92593 - DNA, 20 bp, human
gtcacagcagctctctgggc

SEQ ID NO: 92594 - DNA, 20 bp, human
gtgagtgtgggagtgagtga

SEQ ID NO: 92595 - DNA, 20 bp, human
gagacgggcacacagcagat

SEQ ID NO: 92596 - DNA, 20 bp, human
ggtggatgctgctgtgctgg

SEQ ID NO: 92597 - DNA, 20 bp, human
ggggttgagctgggggagat

SEQ ID NO: 92598 - DNA, 20 bp, human
gtgaggtgctcgggtttgtg

SEQ ID NO: 92599 - DNA, 20 bp, human
gtgagctgggggagatggga

SEQ ID NO: 92600 - DNA, 20 bp, human
gatggtggatgctgctgtgc

SEQ ID NO: 92601 - DNA, 20 bp, human
ggtgggtgagcgagtgagtg

SEQ ID NO: 92602 - DNA, 20 bp, human
gctgtgctgggggttgagct

SEQ ID NO: 92603 - DNA, 20 bp, human
ggacgcggctgctgtagctc

SEQ ID NO: 92604 - DNA, 20 bp, human
ggcgagtgagtgaggtgctc

SEQ ID NO: 92605 - DNA, 20 bp, human
gtcgcaggtcactgggcagc

SEQ ID NO: 92606 - DNA, 20 bp, human
ggggtggggaagacgtgagc

SEQ ID NO: 92607 - DNA, 20 bp, human
gtgctctgactcctggcgag

SEQ ID NO: 92608 - DNA, 20 bp, human
gacgccctcgtgctgccagc

SEQ ID NO: 92609 - DNA, 20 bp, human
ggggcagtcgtccactcgcc

SEQ ID NO: 92610 - DNA, 20 bp, human
gtgtgtgagtgagtgaagga

SEQ ID NO: 92611 - DNA, 20 bp, human
ggaagacgtgagctgggagc

SEQ ID NO: 92612 - DNA, 20 bp, human
gaagccggctggcagcacga

SEQ ID NO: 92613 - DNA, 20 bp, human
gggcagggggcggtgccgca

SEQ ID NO: 92614 - DNA, 20 bp, human
gaggaatccttagagcaggt

SEQ ID NO: 92615 - DNA, 20 bp, human
gtgaggtgctcagggctgtg

SEQ ID NO: 92616 - DNA, 20 bp, human
ggccatgctggggattgaac

SEQ ID NO: 92617 - DNA, 20 bp, human
gatgctggggattgaactgg

SEQ ID NO: 92618 - DNA, 20 bp, human
gtccctgagcacctaacaca

SEQ ID NO: 92619 - DNA, 20 bp, human
gactgtgtgcctgtctgcag

SEQ ID NO: 92620 - DNA, 20 bp, human
ggttaggtgctcagggatgt

SEQ ID NO: 92621 - DNA, 20 bp, human
gtccgtgtgttaggtgctca

SEQ ID NO: 92622 - DNA, 20 bp, human
gggaggagatgggagtgagt

SEQ ID NO: 92623 - DNA, 20 bp, human
gggattgaactggaggagat

SEQ ID NO: 92624 - DNA, 20 bp, human
ggtgagtgagtccgtgtgtt

SEQ ID NO: 92625 - DNA, 20 bp, human
gagacaggcacacagtacac

SEQ ID NO: 92626 - DNA, 20 bp, human
gcagcaggcgtcagccatgg

SEQ ID NO: 92627 - DNA, 20 bp, human
ggtgcagcaggcgtcagcca

SEQ ID NO: 92628 - DNA, 20 bp, human
ggtgctggtgtgaggtgtgt

SEQ ID NO: 92629 - DNA, 20 bp, human
gctcactggggcacagacca

SEQ ID NO: 92630 - DNA, 20 bp, human
ggcagcaatcacatacgtcc

SEQ ID NO: 92631 - DNA, 20 bp, human
gcgtcagccatggtgggtgc

SEQ ID NO: 92632 - DNA, 20 bp, human
gcatgaaggtgtgcaggagt

SEQ ID NO: 92633 - DNA, 20 bp, human
ggctgcgtgtccatctgctc

SEQ ID NO: 92634 - DNA, 20 bp, human
gacatacgtcctggtgcagc

SEQ ID NO: 92635 - DNA, 20 bp, human
gcacacgggcttgcagcagt

SEQ ID NO: 92636 - DNA, 20 bp, human
gagagatgccgcccactggt

SEQ ID NO: 92637 - DNA, 20 bp, human
gcagtagagatgccgcccac

SEQ ID NO: 92638 - DNA, 20 bp, human
ggctgtaggtagttgagcag

SEQ ID NO: 92639 - DNA, 20 bp, human
gatgtcagacagagggctgc

SEQ ID NO: 92640 - DNA, 20 bp, human
gacactggagatgcctccca

SEQ ID NO: 92641 - DNA, 20 bp, human
gagagcaagtcacctggcaa

SEQ ID NO: 92642 - DNA, 20 bp, human
ggctcttccaggcccattgg

SEQ ID NO: 92643 - DNA, 20 bp, human
gctggaagagcaatttcttg

SEQ ID NO: 92644 - DNA, 20 bp, human
gaagttcgccggtaacaggt

SEQ ID NO: 92645 - DNA, 20 bp, human
ggtgacattcacaactcagg

SEQ ID NO: 92646 - DNA, 20 bp, human
gggaggactggcagcccacg

SEQ ID NO: 92647 - DNA, 20 bp, human
gggggatgtaacaggatgcc

SEQ ID NO: 92648 - DNA, 20 bp, human
gcagtgaaccctctgaattc

SEQ ID NO: 92649 - DNA, 20 bp, human
gcatcctgttacatccccgt

SEQ ID NO: 92650 - DNA, 20 bp, human
gccaactgaggactcatcca

SEQ ID NO: 92651 - DNA, 20 bp, human
gcagaggactggcatctcac

SEQ ID NO: 92652 - DNA, 20 bp, human
gatgtgcagaagaccaactg

SEQ ID NO: 92653 - DNA, 20 bp, human
gtcatctgcactgggagcag

SEQ ID NO: 92654 - DNA, 20 bp, human
ggccacacctgtacactccc

SEQ ID NO: 92655 - DNA, 20 bp, human
gtccagggagtgtacaggtg

SEQ ID NO: 92656 - DNA, 20 bp, human
gcagctggtatgacacatgg

SEQ ID NO: 92657 - DNA, 20 bp, human
gcagcaggaagagatactgt

SEQ ID NO: 92658 - DNA, 20 bp, human
ggagcagctggtatgacaca

SEQ ID NO: 92659 - DNA, 20 bp, human
gcagctgacttgaagctcat

SEQ ID NO: 92660 - DNA, 20 bp, human
gctcacaggcacgcacaggg

SEQ ID NO: 92661 - DNA, 20 bp, human
gaagagatactgtaggagat

SEQ ID NO: 92662 - DNA, 20 bp, human
gcaggagctgggcacacaac

SEQ ID NO: 92663 - DNA, 20 bp, human
gagctgggcacacaacaggc

SEQ ID NO: 92664 - DNA, 20 bp, human
gacgcacagggaggactggc

SEQ ID NO: 92665 - DNA, 20 bp, human
ggagggggctgcacacacaa

SEQ ID NO: 92666 - DNA, 20 bp, human
gggctgtgtatgcagcaggt

SEQ ID NO: 92667 - DNA, 20 bp, human
gctggcagcaccccgaagat

SEQ ID NO: 92668 - DNA, 20 bp, human
gagctgctcctggtacacgg

SEQ ID NO: 92669 - DNA, 20 bp, human
gggaggaggatggtgatgtc

SEQ ID NO: 92670 - DNA, 20 bp, human
gtcacgggcacgcacacgga

SEQ ID NO: 92671 - DNA, 20 bp, human
gcccccagattgcacacata

SEQ ID NO: 92672 - DNA, 20 bp, human
gcaaggaaacctctgaactc

SEQ ID NO: 92673 - DNA, 20 bp, human
gagggagtcacatatatgat

SEQ ID NO: 92674 - DNA, 20 bp, human
ggaccctgggaaccccctca

SEQ ID NO: 92675 - DNA, 20 bp, human
ggccctatgtgtgcaatctg

SEQ ID NO: 92676 - DNA, 20 bp, human
gcattgggcagcccgaagag

SEQ ID NO: 92677 - DNA, 20 bp, human
ggcccgaagagtggctggtg

SEQ ID NO: 92678 - DNA, 20 bp, human
gtgatggagtgtggacaggt

SEQ ID NO: 92679 - DNA, 20 bp, human
gctggcagcacccagaggtt

SEQ ID NO: 92680 - DNA, 20 bp, human
gtggctggtgtggcacatga

SEQ ID NO: 92681 - DNA, 20 bp, human
gggagccagggcaggccatt

SEQ ID NO: 92682 - DNA, 20 bp, human
gtcgcacctacgagggtcat

SEQ ID NO: 92683 - DNA, 20 bp, human
gcacctacgagggtcatagg

SEQ ID NO: 92684 - DNA, 20 bp, human
gggtcccatagccctcgggt

SEQ ID NO: 92685 - DNA, 20 bp, human
gggcctcctatgaccctcgt

SEQ ID NO: 92686 - DNA, 20 bp, human
gtagtgcaggtagccaccac

SEQ ID NO: 92687 - DNA, 20 bp, human
gaatccaacgccatagccca

SEQ ID NO: 92688 - DNA, 20 bp, human
gagacccagagtaagttgtc

SEQ ID NO: 92689 - DNA, 20 bp, human
gctgccagacaacttactct

SEQ ID NO: 92690 - DNA, 20 bp, human
gcttccctgggctatggcgt

SEQ ID NO: 92691 - DNA, 20 bp, human
gtgagtttgcatgccacatc

SEQ ID NO: 92692 - DNA, 20 bp, human
gtaggaaaagccacaggagg

SEQ ID NO: 92693 - DNA, 20 bp, human
gaaagccacaggaggaggct

SEQ ID NO: 92694 - DNA, 20 bp, human
gaaatggtcctgtccagatg

SEQ ID NO: 92695 - DNA, 20 bp, human
gggactccacataggatgtc

SEQ ID NO: 92696 - DNA, 20 bp, human
gtagcgcaggtagtcaccac

SEQ ID NO: 92697 - DNA, 20 bp, human
ggagttcagctgagttatag

SEQ ID NO: 92698 - DNA, 20 bp, human
gaaagccacgtgaggatgct

SEQ ID NO: 92699 - DNA, 20 bp, human
gtgaggatgctgggtagcgc

SEQ ID NO: 92700 - DNA, 20 bp, human
ggctacccagcatcctcacg

SEQ ID NO: 92701 - DNA, 20 bp, human
ggagtttgaatgtcatagtc

SEQ ID NO: 92702 - DNA, 20 bp, human
gcttgcaagacgacttactc

SEQ ID NO: 92703 - DNA, 20 bp, human
ggggtaggaaaagccacgtg

SEQ ID NO: 92704 - DNA, 20 bp, human
gcccagggatctgacaccac

SEQ ID NO: 92705 - DNA, 20 bp, human
gagatccatagccgagggaa

SEQ ID NO: 92706 - DNA, 20 bp, human
gctataactctgggaagggg

SEQ ID NO: 92707 - DNA, 20 bp, human
ggtagtgcaagtaacccccg

SEQ ID NO: 92708 - DNA, 20 bp, human
gctcctggatccacagctca

SEQ ID NO: 92709 - DNA, 20 bp, human
ggatctataactctgggaag

SEQ ID NO: 92710 - DNA, 20 bp, human
gtaaaactcagaatcttccc

SEQ ID NO: 92711 - DNA, 20 bp, human
ggagttcagctgagtgtacc

SEQ ID NO: 92712 - DNA, 20 bp, human
ggtcctggggtagtagcagg

SEQ ID NO: 92713 - DNA, 20 bp, human
gcagctgttgggcctccagc

SEQ ID NO: 92714 - DNA, 20 bp, human
gggggttacttgcactaccc

SEQ ID NO: 92715 - DNA, 20 bp, human
gcacctcctgctactacccc

SEQ ID NO: 92716 - DNA, 20 bp, human
gtagtacaggtagcccccaa

SEQ ID NO: 92717 - DNA, 20 bp, human
ggtaggagcctgggtagtac

SEQ ID NO: 92718 - DNA, 20 bp, human
gcaggtagcccccaaaggag

SEQ ID NO: 92719 - DNA, 20 bp, human
gggacatgctgatgagagat

SEQ ID NO: 92720 - DNA, 20 bp, human
gcgctgggaaatggatccag

SEQ ID NO: 92721 - DNA, 20 bp, human
gagaagcgagatccacagat

SEQ ID NO: 92722 - DNA, 20 bp, human
gaatctggatccgtaactca

SEQ ID NO: 92723 - DNA, 20 bp, human
gtccagaagccaagtagttt

SEQ ID NO: 92724 - DNA, 20 bp, human
gtagtttgggtagcagaatc

SEQ ID NO: 92725 - DNA, 20 bp, human
gtcagattcctgaaatatgg

SEQ ID NO: 92726 - DNA, 20 bp, human
gccaaaaaggcgagacccaa

SEQ ID NO: 92727 - DNA, 20 bp, human
gggccaaagtgcaggatgtc

SEQ ID NO: 92728 - DNA, 20 bp, human
gggatgaaaaggtagttggg

SEQ ID NO: 92729 - DNA, 20 bp, human
gggacccacagtccagagat

SEQ ID NO: 92730 - DNA, 20 bp, human
gcctggatgaaaaggtagtt

SEQ ID NO: 92731 - DNA, 20 bp, human
gaaaggcgagacccaaaggc

SEQ ID NO: 92732 - DNA, 20 bp, human
gtaacaggagttctgagctc

SEQ ID NO: 92733 - DNA, 20 bp, human
gagtggaaactggatacctc

SEQ ID NO: 92734 - DNA, 20 bp, human
gtccacaaccaagagatcca

SEQ ID NO: 92735 - DNA, 20 bp, human
gagcactggcttccaatctc

SEQ ID NO: 92736 - DNA, 20 bp, human
gcaactgccagacatggtgg

SEQ ID NO: 92737 - DNA, 20 bp, human
gcggccacctccaccatgtc

SEQ ID NO: 92738 - DNA, 20 bp, human
gtcagggagctgtcacagtg

SEQ ID NO: 92739 - DNA, 20 bp, human
gagctgctcacggaacaaga

SEQ ID NO: 92740 - DNA, 20 bp, human
gcaagaaggctcacaaacgg

SEQ ID NO: 92741 - DNA, 20 bp, human
gtgacaggatcacagcacag

SEQ ID NO: 92742 - DNA, 20 bp, human
gggttgagcacagctgctca

SEQ ID NO: 92743 - DNA, 20 bp, human
gggcctcacagcacacgggt

SEQ ID NO: 92744 - DNA, 20 bp, human
gccactgaggtgagctgtgg

SEQ ID NO: 92745 - DNA, 20 bp, human
gaggagggctgacggcactg

SEQ ID NO: 92746 - DNA, 20 bp, human
gcgtcagtcgtggggaactc

SEQ ID NO: 92747 - DNA, 20 bp, human
gcgggcagcaccccatggtc

SEQ ID NO: 92748 - DNA, 20 bp, human
ggtccccctggagcagatgg

SEQ ID NO: 92749 - DNA, 20 bp, human
gggcccgtcagctcgcaggt

SEQ ID NO: 92750 - DNA, 20 bp, human
ggctgacgggcccggaccat

SEQ ID NO: 92751 - DNA, 20 bp, human
gggaaggttctggacacgag

SEQ ID NO: 92752 - DNA, 20 bp, human
gttcggtgggactgcatcag

SEQ ID NO: 92753 - DNA, 20 bp, human
gtaccgacctgcgagctgac

SEQ ID NO: 92754 - DNA, 20 bp, human
ggcatcagtggtggagggaa

SEQ ID NO: 92755 - DNA, 20 bp, human
ggcagatggaggctttcggt

SEQ ID NO: 92756 - DNA, 20 bp, human
gtagctgccgtagtgactca

SEQ ID NO: 92757 - DNA, 20 bp, human
gctattgccttcagcatcaa

SEQ ID NO: 92758 - DNA, 20 bp, human
ggatgctgaaggcaatagaa

SEQ ID NO: 92759 - DNA, 20 bp, human
gtcctccattgtacgatggg

SEQ ID NO: 92760 - DNA, 20 bp, human
gcatgctggcattcacactc

SEQ ID NO: 92761 - DNA, 20 bp, human
gatctctccattgatgctga

SEQ ID NO: 92762 - DNA, 20 bp, human
gtgtgaatgccagcatgtat

SEQ ID NO: 92763 - DNA, 20 bp, human
ggccgcccatcgtacaatgg

SEQ ID NO: 92764 - DNA, 20 bp, human
ggaatgccagcatgtatagg

SEQ ID NO: 92765 - DNA, 20 bp, human
gggacaggaccaaacacatt

SEQ ID NO: 92766 - DNA, 20 bp, human
ggctactagggcagctactg

SEQ ID NO: 92767 - DNA, 20 bp, human
ggatatggttgtggccacag

SEQ ID NO: 92768 - DNA, 20 bp, human
gtctgacaccgtgagctact

SEQ ID NO: 92769 - DNA, 20 bp, human
gatatcttctgtagcatgat

SEQ ID NO: 92770 - DNA, 20 bp, human
gtgtgctatggctacggctg

SEQ ID NO: 92771 - DNA, 20 bp, human
gacagaagatatagattcac

SEQ ID NO: 92772 - DNA, 20 bp, human
ggctatggctgcggctatga

SEQ ID NO: 92773 - DNA, 20 bp, human
gaaggatgcagatatggttg

SEQ ID NO: 92774 - DNA, 20 bp, human
gcagcatctgttattttgaa

SEQ ID NO: 92775 - DNA, 20 bp, human
ggcagctactgtggaggtct

SEQ ID NO: 92776 - DNA, 20 bp, human
ggagtttggtttgctgctca

SEQ ID NO: 92777 - DNA, 20 bp, human
gcagagctgacttcaatcat

SEQ ID NO: 92778 - DNA, 20 bp, human
ggctaccgcccatcatacta

SEQ ID NO: 92779 - DNA, 20 bp, human
gaccgcccatcatactatgg

SEQ ID NO: 92780 - DNA, 20 bp, human
gtggtttgctgctcaaggca

SEQ ID NO: 92781 - DNA, 20 bp, human
gtggacaacaaagatcatgc

SEQ ID NO: 92782 - DNA, 20 bp, human
gtgaatgttgacatctgtgc

SEQ ID NO: 92783 - DNA, 20 bp, human
gttcacacattgtgttgctg

SEQ ID NO: 92784 - DNA, 20 bp, human
gcaatgtgtgaaattataag

SEQ ID NO: 92785 - DNA, 20 bp, human
gagcaaaagtagagaatact

SEQ ID NO: 92786 - DNA, 20 bp, human
ggttaggaaagtataggtag

SEQ ID NO: 92787 - DNA, 20 bp, human
gcctgaggacacgatatcag

SEQ ID NO: 92788 - DNA, 20 bp, human
gtcaggagtggtgagttgtt

SEQ ID NO: 92789 - DNA, 20 bp, human
gatgccagtagacacgatat

SEQ ID NO: 92790 - DNA, 20 bp, human
gcatagtagctcatggcgtc

SEQ ID NO: 92791 - DNA, 20 bp, human
ggatatcgtgtcctcagggt

SEQ ID NO: 92792 - DNA, 20 bp, human
gctactgaaatcctaccctg

SEQ ID NO: 92793 - DNA, 20 bp, human
gactaagcaattacacagtt

SEQ ID NO: 92794 - DNA, 20 bp, human
gcaaatattgagtcaaacaa

SEQ ID NO: 92795 - DNA, 20 bp, human
gttgcctatatcgtgtctac

SEQ ID NO: 92796 - DNA, 20 bp, human
gtagttgccgtagtagttca

SEQ ID NO: 92797 - DNA, 20 bp, human
ggcctgggctacggctacgg

SEQ ID NO: 92798 - DNA, 20 bp, human
gagaaaccccacagttataa

SEQ ID NO: 92799 - DNA, 20 bp, human
gagagcagttagcatctaag

SEQ ID NO: 92800 - DNA, 20 bp, human
gtgagttggtatgctgctca

SEQ ID NO: 92801 - DNA, 20 bp, human
gtgtgaacaccagcatgtgt

SEQ ID NO: 92802 - DNA, 20 bp, human
ggcctccgtagccgtagccc

SEQ ID NO: 92803 - DNA, 20 bp, human
gccctcatgttaggttgtca

SEQ ID NO: 92804 - DNA, 20 bp, human
gacggaggcttcgatgacct

SEQ ID NO: 92805 - DNA, 20 bp, human
gttgatcttggcttgatcca

SEQ ID NO: 92806 - DNA, 20 bp, human
gaagcatacgggcaagatct

SEQ ID NO: 92807 - DNA, 20 bp, human
gtcgccttgctgaagcatac

SEQ ID NO: 92808 - DNA, 20 bp, human
ggaatcattacattgaatca

SEQ ID NO: 92809 - DNA, 20 bp, human
gcatcatgccgtgaaggata

SEQ ID NO: 92810 - DNA, 20 bp, human
gtgatgagtttcctgagtgt

SEQ ID NO: 92811 - DNA, 20 bp, human
gttaacttgaatagcaaaca

SEQ ID NO: 92812 - DNA, 20 bp, human
gttgcccgtatgcttcagca

SEQ ID NO: 92813 - DNA, 20 bp, human
gagagaatccatatccttca

SEQ ID NO: 92814 - DNA, 20 bp, human
ggccgcccatcatgccgtga

SEQ ID NO: 92815 - DNA, 20 bp, human
gactgatggctagttccttc

SEQ ID NO: 92816 - DNA, 20 bp, human
gctgacaacatgagctactc

SEQ ID NO: 92817 - DNA, 20 bp, human
gaggcctccatagtagctgc

SEQ ID NO: 92818 - DNA, 20 bp, human
gacggctgtggaggattcgg

SEQ ID NO: 92819 - DNA, 20 bp, human
gtagctcatgttgtcagaag

SEQ ID NO: 92820 - DNA, 20 bp, human
gagaagtggttagctgttgt

SEQ ID NO: 92821 - DNA, 20 bp, human
gaaagtttcttggaagaatt

SEQ ID NO: 92822 - DNA, 20 bp, human
gaacttgatcaactagatat

SEQ ID NO: 92823 - DNA, 20 bp, human
gaatctttcttagagtataa

SEQ ID NO: 92824 - DNA, 20 bp, human
gatcatgctatgggggatac

SEQ ID NO: 92825 - DNA, 20 bp, human
gatggaattccatatggtta

SEQ ID NO: 92826 - DNA, 20 bp, human
gagatgtgtttggaggtcaa

SEQ ID NO: 92827 - DNA, 20 bp, human
gctaggtcattctacaggaa

SEQ ID NO: 92828 - DNA, 20 bp, human
ggagggattcacagcttgaa

SEQ ID NO: 92829 - DNA, 20 bp, human
ggcttgaaaggtgggattct

SEQ ID NO: 92830 - DNA, 20 bp, human
ggattcacagcttgaaaggt

SEQ ID NO: 92831 - DNA, 20 bp, human
ggtggctgcgcaattcacag

SEQ ID NO: 92832 - DNA, 20 bp, human
gggattctaggtcattctac

SEQ ID NO: 92833 - DNA, 20 bp, human
ggctactacagaagctatta

SEQ ID NO: 92834 - DNA, 20 bp, human
gacagccatagcccaacctg

SEQ ID NO: 92835 - DNA, 20 bp, human
ggagttcactcttcagtaga

SEQ ID NO: 92836 - DNA, 20 bp, human
gtttcgtgcgttgagaggag

SEQ ID NO: 92837 - DNA, 20 bp, human
gaagggcccagagtggaacg

SEQ ID NO: 92838 - DNA, 20 bp, human
gcaacgcacgaaacattccc

SEQ ID NO: 92839 - DNA, 20 bp, human
ggaatgtttcgtgcgttgag

SEQ ID NO: 92840 - DNA, 20 bp, human
ggaatgtcctcgttccactc

SEQ ID NO: 92841 - DNA, 20 bp, human
ggtgcgttgagaggagaggt

SEQ ID NO: 92842 - DNA, 20 bp, human
gcggctggccgcagggaggc

SEQ ID NO: 92843 - DNA, 20 bp, human
gggagaggtggggtctcagc

SEQ ID NO: 92844 - DNA, 20 bp, human
gcctgctgccggcctccctg

SEQ ID NO: 92845 - DNA, 20 bp, human
ggaggtggggtctcagcagg

SEQ ID NO: 92846 - DNA, 20 bp, human
gatgggagcctttgaagaca

SEQ ID NO: 92847 - DNA, 20 bp, human
gactgcttgggtgccggtga

SEQ ID NO: 92848 - DNA, 20 bp, human
ggtctaatcgctctgccctt

SEQ ID NO: 92849 - DNA, 20 bp, human
gatgcccatgtgcattaata

SEQ ID NO: 92850 - DNA, 20 bp, human
gaataaggcaagtcactgct

SEQ ID NO: 92851 - DNA, 20 bp, human
gttgccttattaatgcacat

SEQ ID NO: 92852 - DNA, 20 bp, human
gtgctaattttagcgccaaa

SEQ ID NO: 92853 - DNA, 20 bp, human
gtgggttaggaatatttcaa

SEQ ID NO: 92854 - DNA, 20 bp, human
gaagatttagcattgactaa

SEQ ID NO: 92855 - DNA, 20 bp, human
ggcattgactaatggtattt

SEQ ID NO: 92856 - DNA, 20 bp, human
gtggtggctatgggtatggt

SEQ ID NO: 92857 - DNA, 20 bp, human
gattatggtggctatgggta

SEQ ID NO: 92858 - DNA, 20 bp, human
gcaactattatggtggctat

SEQ ID NO: 92859 - DNA, 20 bp, human
gggtatggtgggcttggctg

SEQ ID NO: 92860 - DNA, 20 bp, human
ggctatggctgtggttatcg

SEQ ID NO: 92861 - DNA, 20 bp, human
gatggtaagatggaaacctg

SEQ ID NO: 92862 - DNA, 20 bp, human
gtaaatcatggtgtcagaaa

SEQ ID NO: 92863 - DNA, 20 bp, human
gtgtcagaaatggatggttc

SEQ ID NO: 92864 - DNA, 20 bp, human
gaagagcagcatgagaatcc

SEQ ID NO: 92865 - DNA, 20 bp, human
ggttatcgtggctatggatg

SEQ ID NO: 92866 - DNA, 20 bp, human
gcacatggtttcaagagtgg

SEQ ID NO: 92867 - DNA, 20 bp, human
gtagcacatggtttcaagag

SEQ ID NO: 92868 - DNA, 20 bp, human
gaggatttggttgaggagca

SEQ ID NO: 92869 - DNA, 20 bp, human
ggttatggctatggagtcct

SEQ ID NO: 92870 - DNA, 20 bp, human
gactatggtggtctgcgtta

SEQ ID NO: 92871 - DNA, 20 bp, human
ggcttctactgagaaatatc

SEQ ID NO: 92872 - DNA, 20 bp, human
gatggaagatactggtcctg

SEQ ID NO: 92873 - DNA, 20 bp, human
gatctggcaactcaacctcg

SEQ ID NO: 92874 - DNA, 20 bp, human
ggccgtggctatggtggcta

SEQ ID NO: 92875 - DNA, 20 bp, human
gtgaatatccctatatgccc

SEQ ID NO: 92876 - DNA, 20 bp, human
gctaaaggcaccaaagccag

SEQ ID NO: 92877 - DNA, 20 bp, human
gccacagtccaggattctaa

SEQ ID NO: 92878 - DNA, 20 bp, human
ggcaactactacggaggact

SEQ ID NO: 92879 - DNA, 20 bp, human
gtacagatgtggctgtggtg

SEQ ID NO: 92880 - DNA, 20 bp, human
gccattttcttatgagacag

SEQ ID NO: 92881 - DNA, 20 bp, human
gaaacttatgctggcctctc

SEQ ID NO: 92882 - DNA, 20 bp, human
gtgtagcataatcatattgg

SEQ ID NO: 92883 - DNA, 20 bp, human
gcatagtagctcattgtgtc

SEQ ID NO: 92884 - DNA, 20 bp, human
gtttaagtctctagcctgag

SEQ ID NO: 92885 - DNA, 20 bp, human
gatgctacatgcttattatc

SEQ ID NO: 92886 - DNA, 20 bp, human
gtccataaccacagccataa

SEQ ID NO: 92887 - DNA, 20 bp, human
ggtgggtttggctcccatta

SEQ ID NO: 92888 - DNA, 20 bp, human
gcccattatggctgtggtta

SEQ ID NO: 92889 - DNA, 20 bp, human
gttggctcccattatggctg

SEQ ID NO: 92890 - DNA, 20 bp, human
ggtgggtatggctgtgggtt

SEQ ID NO: 92891 - DNA, 20 bp, human
gtggaactggctatggctgt

SEQ ID NO: 92892 - DNA, 20 bp, human
gtgaagataatgctgattca

SEQ ID NO: 92893 - DNA, 20 bp, human
ggctaaaacatcactgtcgg

SEQ ID NO: 92894 - DNA, 20 bp, human
ggatgacaccatggatccta

SEQ ID NO: 92895 - DNA, 20 bp, human
gatcatggccataggatcca

SEQ ID NO: 92896 - DNA, 20 bp, human
gtaagagaagctgttggcag

SEQ ID NO: 92897 - DNA, 20 bp, human
gaaaggtcttagaagagtag

SEQ ID NO: 92898 - DNA, 20 bp, human
gactacagaaactgctgtgg

SEQ ID NO: 92899 - DNA, 20 bp, human
gtctaagtaaaggttgacta

SEQ ID NO: 92900 - DNA, 20 bp, human
gtcttctgtagcaaagtggt

SEQ ID NO: 92901 - DNA, 20 bp, human
gatttcagttgaggtgtagg

SEQ ID NO: 92902 - DNA, 20 bp, human
gtcatcacatcgctgaagag

SEQ ID NO: 92903 - DNA, 20 bp, human
gtatcttcacatctaagtaa

SEQ ID NO: 92904 - DNA, 20 bp, human
gcatcactacaggtcatcct

SEQ ID NO: 92905 - DNA, 20 bp, human
ggatacagctctagctgctg

SEQ ID NO: 92906 - DNA, 20 bp, human
ggatcaactaatctacatag

SEQ ID NO: 92907 - DNA, 20 bp, human
gtaaccgttacagccacagt

SEQ ID NO: 92908 - DNA, 20 bp, human
gagtggtctggctttcaagg

SEQ ID NO: 92909 - DNA, 20 bp, human
ggtgagtcaacaccaatttg

SEQ ID NO: 92910 - DNA, 20 bp, human
gggtaaaacatgccccaaat

SEQ ID NO: 92911 - DNA, 20 bp, human
gtctctaacggagaactatc

SEQ ID NO: 92912 - DNA, 20 bp, human
gactaatctacatagtggtc

SEQ ID NO: 92913 - DNA, 20 bp, human
gcaattacaaaagtgtgtgt

SEQ ID NO: 92914 - DNA, 20 bp, human
gggagaactatcaggattga

SEQ ID NO: 92915 - DNA, 20 bp, human
gcatagtggtctggctttca

SEQ ID NO: 92916 - DNA, 20 bp, human
gggcatagccctggccacca

SEQ ID NO: 92917 - DNA, 20 bp, human
gttgataacaactaccatgg

SEQ ID NO: 92918 - DNA, 20 bp, human
gactagtaacacaacatcaa

SEQ ID NO: 92919 - DNA, 20 bp, human
gtcatggtttcaagaaaggt

SEQ ID NO: 92920 - DNA, 20 bp, human
ggaggcctgggctgcagcta

SEQ ID NO: 92921 - DNA, 20 bp, human
gtaacaccatgggcagtagc

SEQ ID NO: 92922 - DNA, 20 bp, human
gtagttgttatcaaagctca

SEQ ID NO: 92923 - DNA, 20 bp, human
gaagctcatggtttcaagaa

SEQ ID NO: 92924 - DNA, 20 bp, human
ggtggccagggctatgccaa

SEQ ID NO: 92925 - DNA, 20 bp, human
ggctatggctgtggtcttag

SEQ ID NO: 92926 - DNA, 20 bp, human
gcaggctaccataatagttg

SEQ ID NO: 92927 - DNA, 20 bp, human
ggccaataggaatcttccat

SEQ ID NO: 92928 - DNA, 20 bp, human
ggctactaccacaactatta

SEQ ID NO: 92929 - DNA, 20 bp, human
gagaagatggagttcaattg

SEQ ID NO: 92930 - DNA, 20 bp, human
ggcagctatggctctgaata

SEQ ID NO: 92931 - DNA, 20 bp, human
gtggactatggttgcagcta

SEQ ID NO: 92932 - DNA, 20 bp, human
gtaggagcacggaaagttgc

SEQ ID NO: 92933 - DNA, 20 bp, human
ggattttcccactaactggt

SEQ ID NO: 92934 - DNA, 20 bp, human
ggaatttcctaccagttagt

SEQ ID NO: 92935 - DNA, 20 bp, human
gtcctatggaagattcctat

SEQ ID NO: 92936 - DNA, 20 bp, human
gtagccctcacaggaatggg

SEQ ID NO: 92937 - DNA, 20 bp, human
gtagcacaggtagccctcac

SEQ ID NO: 92938 - DNA, 20 bp, human
gggagtagcctgagtagcac

SEQ ID NO: 92939 - DNA, 20 bp, human
ggcaggtgctgggagatcaa

SEQ ID NO: 92940 - DNA, 20 bp, human
gaggtagccctcacaggaat

SEQ ID NO: 92941 - DNA, 20 bp, human
gactcaggctactcccgtgg

SEQ ID NO: 92942 - DNA, 20 bp, human
gagggctacctgtgctactc

SEQ ID NO: 92943 - DNA, 20 bp, human
ggcagagcacggagcttctg

SEQ ID NO: 92944 - DNA, 20 bp, human
gtggtctgtaacaggaagac

SEQ ID NO: 92945 - DNA, 20 bp, human
ggctactcaggctactcccg

SEQ ID NO: 92946 - DNA, 20 bp, human
gtagtagacatggagcctgc

SEQ ID NO: 92947 - DNA, 20 bp, human
gtgtctactacaggctatcc

SEQ ID NO: 92948 - DNA, 20 bp, human
gggaaccgttgcggagggtt

SEQ ID NO: 92949 - DNA, 20 bp, human
gatgtggtactgcagacacc

SEQ ID NO: 92950 - DNA, 20 bp, human
ggagctaagagtaacagaag

SEQ ID NO: 92951 - DNA, 20 bp, human
gcctgccaaaccctccgcaa

SEQ ID NO: 92952 - DNA, 20 bp, human
gtttgacgggtcacaaccag

SEQ ID NO: 92953 - DNA, 20 bp, human
gctttggatgcatttcgagt

SEQ ID NO: 92954 - DNA, 20 bp, human
gtaagcagtgtccaaaggta

SEQ ID NO: 92955 - DNA, 20 bp, human
gagtaacagaagaggtcact

SEQ ID NO: 92956 - DNA, 20 bp, human
gcaatgcataacagatctca

SEQ ID NO: 92957 - DNA, 20 bp, human
gtctgttatgcattgaggat

SEQ ID NO: 92958 - DNA, 20 bp, human
gtgatcaagtaaaatggtac

SEQ ID NO: 92959 - DNA, 20 bp, human
gcataggagaaatagctcaa

SEQ ID NO: 92960 - DNA, 20 bp, human
gacctgaactataaacacaa

SEQ ID NO: 92961 - DNA, 20 bp, human
gttgacagccataagagaca

SEQ ID NO: 92962 - DNA, 20 bp, human
ggtgcatgaaggaaataggt

SEQ ID NO: 92963 - DNA, 20 bp, human
gctcaagggatagcaggtcc

SEQ ID NO: 92964 - DNA, 20 bp, human
gtggaaactgctgtgcatga

SEQ ID NO: 92965 - DNA, 20 bp, human
gcccaaaaccatgtctctta

SEQ ID NO: 92966 - DNA, 20 bp, human
gaaagggtcaagctaaggaa

SEQ ID NO: 92967 - DNA, 20 bp, human
gtgggcacacagtctcctat

SEQ ID NO: 92968 - DNA, 20 bp, human
gtggtctacaggatactgga

SEQ ID NO: 92969 - DNA, 20 bp, human
gtattgagcagcggcctcag

SEQ ID NO: 92970 - DNA, 20 bp, human
ggttggggcaagacatagtg

SEQ ID NO: 92971 - DNA, 20 bp, human
gcagcggctgtcgtccactg

SEQ ID NO: 92972 - DNA, 20 bp, human
gcgctggacacatacctctg

SEQ ID NO: 92973 - DNA, 20 bp, human
gctgggcacgtagtaagcag

SEQ ID NO: 92974 - DNA, 20 bp, human
ggctggtaactattgagcag

SEQ ID NO: 92975 - DNA, 20 bp, human
gagagctagtgggtaagtag

SEQ ID NO: 92976 - DNA, 20 bp, human
ggtggaagctcctgagtgaa

SEQ ID NO: 92977 - DNA, 20 bp, human
ggccaacctgcaagcctcaa

SEQ ID NO: 92978 - DNA, 20 bp, human
gtcccttgaggcttgcaggt

SEQ ID NO: 92979 - DNA, 20 bp, human
gagtagtttggacaactccg

SEQ ID NO: 92980 - DNA, 20 bp, human
gcactctctgccatcacaca

SEQ ID NO: 92981 - DNA, 20 bp, human
gtagacttagaagtcttggg

SEQ ID NO: 92982 - DNA, 20 bp, human
ggcttgcaggttggcagctc

SEQ ID NO: 92983 - DNA, 20 bp, human
gatccttaaagatggtcata

SEQ ID NO: 92984 - DNA, 20 bp, human
gctgctgagtgctttctgat

SEQ ID NO: 92985 - DNA, 20 bp, human
ggagtgctttctgattggca

SEQ ID NO: 92986 - DNA, 20 bp, human
gaggctgcgtgggagcacat

SEQ ID NO: 92987 - DNA, 20 bp, human
gatggtgggcacagctggaa

SEQ ID NO: 92988 - DNA, 20 bp, human
gtgcatgtctggatcatgtc

SEQ ID NO: 92989 - DNA, 20 bp, human
gtgcgtgggagcacataggt

SEQ ID NO: 92990 - DNA, 20 bp, human
gagcatcacagcagactgat

SEQ ID NO: 92991 - DNA, 20 bp, human
gccacatacccagttaaagg

SEQ ID NO: 92992 - DNA, 20 bp, human
ggagctttgctggcagggac

SEQ ID NO: 92993 - DNA, 20 bp, human
gacgttgctggaaggcgggt

SEQ ID NO: 92994 - DNA, 20 bp, human
gtggcagacggctgttgtcc

SEQ ID NO: 92995 - DNA, 20 bp, human
ggactgatagcaggctgcgt

SEQ ID NO: 92996 - DNA, 20 bp, human
gcggagagcacagcaataca

SEQ ID NO: 92997 - DNA, 20 bp, human
gagcaatacatggcaatggg

SEQ ID NO: 92998 - DNA, 20 bp, human
gatggccttagccttgatgt

SEQ ID NO: 92999 - DNA, 20 bp, human
gatacatggcaatgggaggt

SEQ ID NO: 93000 - DNA, 20 bp, human
gacattgggcagccacctca

SEQ ID NO: 93001 - DNA, 20 bp, human
gaaggaggctgatctcatgt

SEQ ID NO: 93002 - DNA, 20 bp, human
gactgcctacatcaaggcta

SEQ ID NO: 93003 - DNA, 20 bp, human
gggtggggacgctgcaggag

SEQ ID NO: 93004 - DNA, 20 bp, human
gcccgactcccggactgagt

SEQ ID NO: 93005 - DNA, 20 bp, human
gtaaggccatcccaatcccc

SEQ ID NO: 93006 - DNA, 20 bp, human
ggggacactgcagctgcgag

SEQ ID NO: 93007 - DNA, 20 bp, human
gaacatctggcaaactactg

SEQ ID NO: 93008 - DNA, 20 bp, human
ggaggcaagtgaatactgaa

SEQ ID NO: 93009 - DNA, 20 bp, human
gaaccagacgcccattgcca

SEQ ID NO: 93010 - DNA, 20 bp, human
gtctggtctaccttaacatc

SEQ ID NO: 93011 - DNA, 20 bp, human
ggatatgaagaacttacctt

SEQ ID NO: 93012 - DNA, 20 bp, human
gtcttcatatctgggtcatc

SEQ ID NO: 93013 - DNA, 20 bp, human
gttctggattcttcgttgtc

SEQ ID NO: 93014 - DNA, 20 bp, human
gacttacctttggttttaat

SEQ ID NO: 93015 - DNA, 20 bp, human
ggctttcagtttcttagatg

SEQ ID NO: 93016 - DNA, 20 bp, human
gccatggctattagagtctg

SEQ ID NO: 93017 - DNA, 20 bp, human
gtagttgtaggtactgagat

SEQ ID NO: 93018 - DNA, 20 bp, human
gagcagagtacattagttgt

SEQ ID NO: 93019 - DNA, 20 bp, human
gttagagtctgtggtattta

SEQ ID NO: 93020 - DNA, 20 bp, human
gtgttgactttttcaatctc

SEQ ID NO: 93021 - DNA, 20 bp, human
gtgctttagaaattggaaca

SEQ ID NO: 93022 - DNA, 20 bp, human
ggaatatctctcctttctct

SEQ ID NO: 93023 - DNA, 20 bp, human
gaagaaggataaggcttctg

SEQ ID NO: 93024 - DNA, 20 bp, human
gttagaaattggaacaagga

SEQ ID NO: 93025 - DNA, 20 bp, human
gatgggtttgattgaaaaga

SEQ ID NO: 93026 - DNA, 20 bp, human
gagtctgagagcaggatggg

SEQ ID NO: 93027 - DNA, 20 bp, human
gccacaacaagagttaacca

SEQ ID NO: 93028 - DNA, 20 bp, human
gcagcaggtagtctgagagc

SEQ ID NO: 93029 - DNA, 20 bp, human
gaagaggatccacagcagct

SEQ ID NO: 93030 - DNA, 20 bp, human
gcagtgagtttttcgaatgt

SEQ ID NO: 93031 - DNA, 20 bp, human
gcagcaagttgcacggcagc

SEQ ID NO: 93032 - DNA, 20 bp, human
gggtagtctgagagcaggat

SEQ ID NO: 93033 - DNA, 20 bp, human
ggactgggtggcagcagctg

SEQ ID NO: 93034 - DNA, 20 bp, human
gggtggtctgacagcagagt

SEQ ID NO: 93035 - DNA, 20 bp, human
gggggcggcagcaagttgca

SEQ ID NO: 93036 - DNA, 20 bp, human
gaggatctagttgggtttct

SEQ ID NO: 93037 - DNA, 20 bp, human
gttgtgtttggaagtctcct

SEQ ID NO: 93038 - DNA, 20 bp, human
ggagggtgaaggatctagtt

SEQ ID NO: 93039 - DNA, 20 bp, human
gccacaacaggagtttacca

SEQ ID NO: 93040 - DNA, 20 bp, human
ggggctggcagcacatagac

SEQ ID NO: 93041 - DNA, 20 bp, human
gatctggggcggcagcaagt

SEQ ID NO: 93042 - DNA, 20 bp, human
gcagcagctggggcgacagt

SEQ ID NO: 93043 - DNA, 20 bp, human
gcagctggggcgacagtagg

SEQ ID NO: 93044 - DNA, 20 bp, human
gagagtgaagttcttgtgtt

SEQ ID NO: 93045 - DNA, 20 bp, human
ggaggtctcggccacagcct

SEQ ID NO: 93046 - DNA, 20 bp, human
gaggcaggtgagtataggtg

SEQ ID NO: 93047 - DNA, 20 bp, human
gcagcaagagccactagagc

SEQ ID NO: 93048 - DNA, 20 bp, human
gaaggtgggtttggaaggtt

SEQ ID NO: 93049 - DNA, 20 bp, human
ggccactagagcaggttggg

SEQ ID NO: 93050 - DNA, 20 bp, human
gagagccactagagcaggtt

SEQ ID NO: 93051 - DNA, 20 bp, human
gaataaaggcaggtgagtat

SEQ ID NO: 93052 - DNA, 20 bp, human
gggtggatttccaggaaggt

SEQ ID NO: 93053 - DNA, 20 bp, human
ggccgcccaacctgctctag

SEQ ID NO: 93054 - DNA, 20 bp, human
gggtcctgcagcaagtggtc

SEQ ID NO: 93055 - DNA, 20 bp, human
gcactggggtctgaagcagc

SEQ ID NO: 93056 - DNA, 20 bp, human
ggagaccttgaccacagctc

SEQ ID NO: 93057 - DNA, 20 bp, human
gtccagaacctcattctcct

SEQ ID NO: 93058 - DNA, 20 bp, human
gtgtggtcaaggtctcggcc

SEQ ID NO: 93059 - DNA, 20 bp, human
gtcccaggagaatgaggttc

SEQ ID NO: 93060 - DNA, 20 bp, human
gctgtatctccagctgctac

SEQ ID NO: 93061 - DNA, 20 bp, human
ggagctgaccatggcgtcag

SEQ ID NO: 93062 - DNA, 20 bp, human
ggagcagacagagccacagc

SEQ ID NO: 93063 - DNA, 20 bp, human
gaggttctgggtgggttccc

SEQ ID NO: 93064 - DNA, 20 bp, human
gagctagagatacagcagga

SEQ ID NO: 93065 - DNA, 20 bp, human
gtctgctctgaccagagctg

SEQ ID NO: 93066 - DNA, 20 bp, human
gggtcctacagcaggtagtc

SEQ ID NO: 93067 - DNA, 20 bp, human
gaggtagtctggcagcattg

SEQ ID NO: 93068 - DNA, 20 bp, human
gaaggagggtttggaaggct

SEQ ID NO: 93069 - DNA, 20 bp, human
gggtgggtttccaggaagga

SEQ ID NO: 93070 - DNA, 20 bp, human
gattggggtctgcagcaggt

SEQ ID NO: 93071 - DNA, 20 bp, human
gagctggacacacagtagct

SEQ ID NO: 93072 - DNA, 20 bp, human
gccttccaaaccctccttcc

SEQ ID NO: 93073 - DNA, 20 bp, human
gctgccagactacctgctgt

SEQ ID NO: 93074 - DNA, 20 bp, human
gaggtggtctggcagtagct

SEQ ID NO: 93075 - DNA, 20 bp, human
ggggacggcagcagttctct

SEQ ID NO: 93076 - DNA, 20 bp, human
gagaatgaggttctcaagtt

SEQ ID NO: 93077 - DNA, 20 bp, human
gcaagtttggaagtgtcctt

SEQ ID NO: 93078 - DNA, 20 bp, human
ggtggatttctagaagaatg

SEQ ID NO: 93079 - DNA, 20 bp, human
gggattcacagcaatagggg

SEQ ID NO: 93080 - DNA, 20 bp, human
gcagctggattcacagcaat

SEQ ID NO: 93081 - DNA, 20 bp, human
gactggggcttgcagcagct

SEQ ID NO: 93082 - DNA, 20 bp, human
gacgcacgcagcagcagggg

SEQ ID NO: 93083 - DNA, 20 bp, human
gtggacgcacgcagcagcag

SEQ ID NO: 93084 - DNA, 20 bp, human
gtcagctctgagcagagctg

SEQ ID NO: 93085 - DNA, 20 bp, human
gtctgagcagagctgtggcc

SEQ ID NO: 93086 - DNA, 20 bp, human
gagagggtaaaggttctggg

SEQ ID NO: 93087 - DNA, 20 bp, human
gtgtcagagggtaaaggttc

SEQ ID NO: 93088 - DNA, 20 bp, human
ggagtgagtttcgtgagttt

SEQ ID NO: 93089 - DNA, 20 bp, human
ggctggatacacagcagcta

SEQ ID NO: 93090 - DNA, 20 bp, human
gccccagctgctgtgtgtcc

SEQ ID NO: 93091 - DNA, 20 bp, human
gagcagctgggacagcagct

SEQ ID NO: 93092 - DNA, 20 bp, human
gctcacgaaactcactctct

SEQ ID NO: 93093 - DNA, 20 bp, human
gggatacacagcagctaggg

SEQ ID NO: 93094 - DNA, 20 bp, human
ggagcagacggaaccacaac

SEQ ID NO: 93095 - DNA, 20 bp, human
ggggacggcagcaggttggc

SEQ ID NO: 93096 - DNA, 20 bp, human
gtgaagggggacgtgagcca

SEQ ID NO: 93097 - DNA, 20 bp, human
gggacgtgagccagggcagt

SEQ ID NO: 93098 - DNA, 20 bp, human
gtgggcgatagcaagtggtg

SEQ ID NO: 93099 - DNA, 20 bp, human
gagtggtgtggcaggagact

SEQ ID NO: 93100 - DNA, 20 bp, human
gcaggttgggcgatagcaag

SEQ ID NO: 93101 - DNA, 20 bp, human
gcgatagcaagtggtgtggc

SEQ ID NO: 93102 - DNA, 20 bp, human
gggtcgtctcacagcaggtg

SEQ ID NO: 93103 - DNA, 20 bp, human
gcagcacaaggggcggggac

SEQ ID NO: 93104 - DNA, 20 bp, human
gggacaggtggagatgacac

SEQ ID NO: 93105 - DNA, 20 bp, human
gagaggaggcacagcacaag

SEQ ID NO: 93106 - DNA, 20 bp, human
gggggcgggaacaagtgggt

SEQ ID NO: 93107 - DNA, 20 bp, human
gaagtgggttggcagcacgc

SEQ ID NO: 93108 - DNA, 20 bp, human
gagctggggcgggaacaagt

SEQ ID NO: 93109 - DNA, 20 bp, human
ggggttggcagcacgcaggc

SEQ ID NO: 93110 - DNA, 20 bp, human
ggaacggggaggatctgggt

SEQ ID NO: 93111 - DNA, 20 bp, human
gccatggtgtcagaacgggg

SEQ ID NO: 93112 - DNA, 20 bp, human
ggtcagaacggggaggatct

SEQ ID NO: 93113 - DNA, 20 bp, human
ggacgacctgctgccaccct

SEQ ID NO: 93114 - DNA, 20 bp, human
ggctgaccatggtgtcagaa

SEQ ID NO: 93115 - DNA, 20 bp, human
gggggcgacagcaagtgggt

SEQ ID NO: 93116 - DNA, 20 bp, human
ggagcagccgcaacagccca

SEQ ID NO: 93117 - DNA, 20 bp, human
ggcaggaacaggttggcaca

SEQ ID NO: 93118 - DNA, 20 bp, human
gccggaaccacagccaccct

SEQ ID NO: 93119 - DNA, 20 bp, human
gggggatccaaggggggttg

SEQ ID NO: 93120 - DNA, 20 bp, human
ggctgttgcggctgctccgg

SEQ ID NO: 93121 - DNA, 20 bp, human
gttggcacacggcagcacac

SEQ ID NO: 93122 - DNA, 20 bp, human
gggggctgtggctcttctgg

SEQ ID NO: 93123 - DNA, 20 bp, human
ggtggctgtggttccggctg

SEQ ID NO: 93124 - DNA, 20 bp, human
ggctgtggcaaagggggctg

SEQ ID NO: 93125 - DNA, 20 bp, human
ggctctggctgtggaggttc

SEQ ID NO: 93126 - DNA, 20 bp, human
gctcaatccgccagaatcat

SEQ ID NO: 93127 - DNA, 20 bp, human
gttgtgggagctccaagggt

SEQ ID NO: 93128 - DNA, 20 bp, human
gggcggattgagagtagagc

SEQ ID NO: 93129 - DNA, 20 bp, human
gcaggcttgcagcagcaaat

SEQ ID NO: 93130 - DNA, 20 bp, human
gcaagaaccacacccaccct

SEQ ID NO: 93131 - DNA, 20 bp, human
ggggcttgaagcagctagac

SEQ ID NO: 93132 - DNA, 20 bp, human
ggattggcagcagcagggtt

SEQ ID NO: 93133 - DNA, 20 bp, human
gttgagagtagagcaggtag

SEQ ID NO: 93134 - DNA, 20 bp, human
ggctgtggctccggcagtgg

SEQ ID NO: 93135 - DNA, 20 bp, human
gggcttacagcagttggact

SEQ ID NO: 93136 - DNA, 20 bp, human
gagctggaggagcagcagac

SEQ ID NO: 93137 - DNA, 20 bp, human
ggggtctgtggatttcgtgg

SEQ ID NO: 93138 - DNA, 20 bp, human
gagggggtctgtggatttcg

SEQ ID NO: 93139 - DNA, 20 bp, human
gtgtggagttctctgagccc

SEQ ID NO: 93140 - DNA, 20 bp, human
ggatttcgtgggggctccaa

SEQ ID NO: 93141 - DNA, 20 bp, human
gcaagagccacagaccccct

SEQ ID NO: 93142 - DNA, 20 bp, human
ggctgtggctccggctatgg

SEQ ID NO: 93143 - DNA, 20 bp, human
gtcttgtgggggctgcaagg

SEQ ID NO: 93144 - DNA, 20 bp, human
gggggctgtggctccggcta

SEQ ID NO: 93145 - DNA, 20 bp, human
gaggtgagagggaggtgtgc

SEQ ID NO: 93146 - DNA, 20 bp, human
ggcccccttggacaccccac

SEQ ID NO: 93147 - DNA, 20 bp, human
gcttgcgggggctccaagag

SEQ ID NO: 93148 - DNA, 20 bp, human
gtccggctgtggaggctgtg

SEQ ID NO: 93149 - DNA, 20 bp, human
ggaccccccacaggagccac

SEQ ID NO: 93150 - DNA, 20 bp, human
gtctcctgtggggtgtccaa

SEQ ID NO: 93151 - DNA, 20 bp, human
gtccggctgtgcgggctgtg

SEQ ID NO: 93152 - DNA, 20 bp, human
gaggggggctgtggttctta

SEQ ID NO: 93153 - DNA, 20 bp, human
ggggtgtccaagggggcctg

SEQ ID NO: 93154 - DNA, 20 bp, human
gggggctgtggctcttgcgg

SEQ ID NO: 93155 - DNA, 20 bp, human
ggctgtggctccggctgtgc

SEQ ID NO: 93156 - DNA, 20 bp, human
ggctgccagtgcaaaatctg

SEQ ID NO: 93157 - DNA, 20 bp, human
gagagcctcagattttgcac

SEQ ID NO: 93158 - DNA, 20 bp, human
gtttgcactggcagcaaatg

SEQ ID NO: 93159 - DNA, 20 bp, human
gtgcaagccctgctgttccc

SEQ ID NO: 93160 - DNA, 20 bp, human
gggtcacttcttgggtggtg

SEQ ID NO: 93161 - DNA, 20 bp, human
gggctctgactttggacctc

SEQ ID NO: 93162 - DNA, 20 bp, human
gaaatctgaggctctgactt

SEQ ID NO: 93163 - DNA, 20 bp, human
ggatatgctggactcacctg

SEQ ID NO: 93164 - DNA, 20 bp, human
gcaagagccacagcacccct

SEQ ID NO: 93165 - DNA, 20 bp, human
gagcctgaggaacagtagca

SEQ ID NO: 93166 - DNA, 20 bp, human
gaggaggaagggctcatact

SEQ ID NO: 93167 - DNA, 20 bp, human
gtccacaaggaaatcatctc

SEQ ID NO: 93168 - DNA, 20 bp, human
gcgcttgccacagctagagc

SEQ ID NO: 93169 - DNA, 20 bp, human
gcaaccggaaagagaaacaa

SEQ ID NO: 93170 - DNA, 20 bp, human
gggagctgtgtaacagcaac

SEQ ID NO: 93171 - DNA, 20 bp, human
gtgtgggatataaagagccg

SEQ ID NO: 93172 - DNA, 20 bp, human
gcaatggtgtgttcctatgt

SEQ ID NO: 93173 - DNA, 20 bp, human
gtggctatgttgatattttc

SEQ ID NO: 93174 - DNA, 20 bp, human
gtttcagtatgaattccaca

SEQ ID NO: 93175 - DNA, 20 bp, human
ggaaatcatctcaggaggaa

SEQ ID NO: 93176 - DNA, 20 bp, human
gtgatgaaaggagaactgac

SEQ ID NO: 93177 - DNA, 20 bp, human
gcccctggctatgggttctg

SEQ ID NO: 93178 - DNA, 20 bp, human
gggaaaatctcagaacatgt

SEQ ID NO: 93179 - DNA, 20 bp, human
ggaaactactatggcacccc

SEQ ID NO: 93180 - DNA, 20 bp, human
gctgcaatggaagtctaata

SEQ ID NO: 93181 - DNA, 20 bp, human
gagccacagaacccatagcc

SEQ ID NO: 93182 - DNA, 20 bp, human
gctatggcacccctggctat

SEQ ID NO: 93183 - DNA, 20 bp, human
gctattattgaggatgccat

SEQ ID NO: 93184 - DNA, 20 bp, human
gtccatcatgaaacgggata

SEQ ID NO: 93185 - DNA, 20 bp, human
gatggctcccgctccctctg

SEQ ID NO: 93186 - DNA, 20 bp, human
gagagaccacaggagttcat

SEQ ID NO: 93187 - DNA, 20 bp, human
gccacaaccatcacgatgtg

SEQ ID NO: 93188 - DNA, 20 bp, human
gtagatccagagggtactgg

SEQ ID NO: 93189 - DNA, 20 bp, human
gcccgagctcagagcatacg

SEQ ID NO: 93190 - DNA, 20 bp, human
gtagctgccgcacatcgtga

SEQ ID NO: 93191 - DNA, 20 bp, human
gactacggcgaccatggcta

SEQ ID NO: 93192 - DNA, 20 bp, human
gatagaggatgagtctccca

SEQ ID NO: 93193 - DNA, 20 bp, human
gtcccacccccagtaccctc

SEQ ID NO: 93194 - DNA, 20 bp, human
gatgggtgctgtggatacga

SEQ ID NO: 93195 - DNA, 20 bp, human
gttcatcctatgaactcctg

SEQ ID NO: 93196 - DNA, 20 bp, human
gggaaaggctcagagcatgt

SEQ ID NO: 93197 - DNA, 20 bp, human
ggctactacagaaactacaa

SEQ ID NO: 93198 - DNA, 20 bp, human
gccacagccacagaaggagt

SEQ ID NO: 93199 - DNA, 20 bp, human
gtggttgttgaggtcatcct

SEQ ID NO: 93200 - DNA, 20 bp, human
gatatcatcaatcaagggaa

SEQ ID NO: 93201 - DNA, 20 bp, human
ggcctgggctgtggttatgg

SEQ ID NO: 93202 - DNA, 20 bp, human
ggtggctgtggctataggtg

SEQ ID NO: 93203 - DNA, 20 bp, human
ggccgccataaccacagccc

SEQ ID NO: 93204 - DNA, 20 bp, human
gataggtgcggctctggcta

SEQ ID NO: 93205 - DNA, 20 bp, human
gggctgtggctacagaggcc

SEQ ID NO: 93206 - DNA, 20 bp, human
gcagaagtaacgagtcatgg

SEQ ID NO: 93207 - DNA, 20 bp, human
gcagcagaagtaacgagtca

SEQ ID NO: 93208 - DNA, 20 bp, human
gatggtggcagcaattgaga

SEQ ID NO: 93209 - DNA, 20 bp, human
gtgggctctcccctgaacta

SEQ ID NO: 93210 - DNA, 20 bp, human
gaagttggtcccatagaata

SEQ ID NO: 93211 - DNA, 20 bp, human
ggcacctactgatggaccaa

SEQ ID NO: 93212 - DNA, 20 bp, human
ggcaatggctacagctccct

SEQ ID NO: 93213 - DNA, 20 bp, human
gcccatagaatagggtatcc

SEQ ID NO: 93214 - DNA, 20 bp, human
gatgtatcacccaagcacat

SEQ ID NO: 93215 - DNA, 20 bp, human
ggatttagatggattgtgaa

SEQ ID NO: 93216 - DNA, 20 bp, human
ggcatggtgtcgggagtgga

SEQ ID NO: 93217 - DNA, 20 bp, human
gcccagagaacatcagccag

SEQ ID NO: 93218 - DNA, 20 bp, human
gtcctgggaagacagccccg

SEQ ID NO: 93219 - DNA, 20 bp, human
ggctgccccagtagcatcct

SEQ ID NO: 93220 - DNA, 20 bp, human
ggtagctcatgacaagtggg

SEQ ID NO: 93221 - DNA, 20 bp, human
gctgaaggagtggatacggg

SEQ ID NO: 93222 - DNA, 20 bp, human
gaaagtagctcatgacaagt

SEQ ID NO: 93223 - DNA, 20 bp, human
gaacttacctcgagtcccag

SEQ ID NO: 93224 - DNA, 20 bp, human
gttgtcgcagagcatggtgt

SEQ ID NO: 93225 - DNA, 20 bp, human
gctctgcgacaacttccccg

SEQ ID NO: 93226 - DNA, 20 bp, human
gggccgtgtgttttaaatga

SEQ ID NO: 93227 - DNA, 20 bp, human
gtccccattaatacacatga

SEQ ID NO: 93228 - DNA, 20 bp, human
gctccatcatgtgtattaat

SEQ ID NO: 93229 - DNA, 20 bp, human
gaagagtttcttattttcac

SEQ ID NO: 93230 - DNA, 20 bp, human
gaataagttgcataatattt

SEQ ID NO: 93231 - DNA, 20 bp, human
gtttaaatgaaggaacaaac

SEQ ID NO: 93232 - DNA, 20 bp, human
gttccttcatttaaaacaca

SEQ ID NO: 93233 - DNA, 20 bp, human
gtgaatagattagccagata

SEQ ID NO: 93234 - DNA, 20 bp, human
gtaaaacacacggccgggcg

SEQ ID NO: 93235 - DNA, 20 bp, human
gattttcactggcaacaaaa

SEQ ID NO: 93236 - DNA, 20 bp, human
gagcagctggccacacaagt

SEQ ID NO: 93237 - DNA, 20 bp, human
gtgctgccagcccacttgtg

SEQ ID NO: 93238 - DNA, 20 bp, human
ggatagtttgatagcaagtc

SEQ ID NO: 93239 - DNA, 20 bp, human
gagcaagtcgggtgacagca

SEQ ID NO: 93240 - DNA, 20 bp, human
gctgctgtcagcctatttgt

SEQ ID NO: 93241 - DNA, 20 bp, human
gctatcaaactatctgcttc

SEQ ID NO: 93242 - DNA, 20 bp, human
gagcaactggacccacaaat

SEQ ID NO: 93243 - DNA, 20 bp, human
gcagcaaggctgacagcaac

SEQ ID NO: 93244 - DNA, 20 bp, human
gagcaggagggctggcaaca

SEQ ID NO: 93245 - DNA, 20 bp, human
gtcatggtgtcaggggtgaa

SEQ ID NO: 93246 - DNA, 20 bp, human
gagcaggctgggcagtagca

SEQ ID NO: 93247 - DNA, 20 bp, human
ggctggacacacagcaggct

SEQ ID NO: 93248 - DNA, 20 bp, human
gttgctgcaggactacctgc

SEQ ID NO: 93249 - DNA, 20 bp, human
gggctgggcagtagcagggc

SEQ ID NO: 93250 - DNA, 20 bp, human
gcaggtaggctgacagccag

SEQ ID NO: 93251 - DNA, 20 bp, human
gcagtgggtcatgttgtcag

SEQ ID NO: 93252 - DNA, 20 bp, human
gtgcaggtggtcacaatggt

SEQ ID NO: 93253 - DNA, 20 bp, human
gctgctgcaggtggtcacaa

SEQ ID NO: 93254 - DNA, 20 bp, human
gagcaagttgggtggcagta

SEQ ID NO: 93255 - DNA, 20 bp, human
ggttcagaggtgagtttccc

SEQ ID NO: 93256 - DNA, 20 bp, human
gtgagtccaaccggcgcctc

SEQ ID NO: 93257 - DNA, 20 bp, human
gcggcgcctctggccaagaa

SEQ ID NO: 93258 - DNA, 20 bp, human
gcccctccagtggtgggtac

SEQ ID NO: 93259 - DNA, 20 bp, human
gaggtgcccgtacccaccac

SEQ ID NO: 93260 - DNA, 20 bp, human
ggcatgatgggtaacaggac

SEQ ID NO: 93261 - DNA, 20 bp, human
gccccaggaagtcctagagg

SEQ ID NO: 93262 - DNA, 20 bp, human
gtagcttgccggagggaggg

SEQ ID NO: 93263 - DNA, 20 bp, human
gaggcgagctgaaccgggtg

SEQ ID NO: 93264 - DNA, 20 bp, human
gggagaagggacggagagtc

SEQ ID NO: 93265 - DNA, 20 bp, human
gcgccggttggactcacggg

SEQ ID NO: 93266 - DNA, 20 bp, human
gcaagggtagccccagggta

SEQ ID NO: 93267 - DNA, 20 bp, human
gaaccgcgggcagtaggacg

SEQ ID NO: 93268 - DNA, 20 bp, human
gtgagcgcggcaggcgaccc

SEQ ID NO: 93269 - DNA, 20 bp, human
ggtctcgtctccttaccctg

SEQ ID NO: 93270 - DNA, 20 bp, human
ggagccgacagagatgacat

SEQ ID NO: 93271 - DNA, 20 bp, human
ggtcccacggaaacgctctg

SEQ ID NO: 93272 - DNA, 20 bp, human
ggggcagtaggacggggcaa

SEQ ID NO: 93273 - DNA, 20 bp, human
gcccaggtacagcggccctg

SEQ ID NO: 93274 - DNA, 20 bp, human
ggggaagtccctctcaccag

SEQ ID NO: 93275 - DNA, 20 bp, human
gcggggcaagggtagcccca

SEQ ID NO: 93276 - DNA, 20 bp, human
ggcagagtggagcaccagga

SEQ ID NO: 93277 - DNA, 20 bp, human
gggaaggaccgggatcttca

SEQ ID NO: 93278 - DNA, 20 bp, human
gactggagaacggcaatgtg

SEQ ID NO: 93279 - DNA, 20 bp, human
ggtgtgcagctggaacggaa

SEQ ID NO: 93280 - DNA, 20 bp, human
gggcatgtgtgcagctggaa

SEQ ID NO: 93281 - DNA, 20 bp, human
gaaactggggctctgaggaa

SEQ ID NO: 93282 - DNA, 20 bp, human
gccacccagggtggctccct

SEQ ID NO: 93283 - DNA, 20 bp, human
gcactcttgagagcccatgg

SEQ ID NO: 93284 - DNA, 20 bp, human
gactgaaccttgggactgag

SEQ ID NO: 93285 - DNA, 20 bp, human
gcttgacgccatgaagatcc

SEQ ID NO: 93286 - DNA, 20 bp, human
ggtggaagcggcagactcag

SEQ ID NO: 93287 - DNA, 20 bp, human
gggcagcaaagcgaaagccg

SEQ ID NO: 93288 - DNA, 20 bp, human
gcgcagccgtcgggtcgccg

SEQ ID NO: 93289 - DNA, 20 bp, human
gtttgctgccgcggctggga

SEQ ID NO: 93290 - DNA, 20 bp, human
ggaaagccgcggcgacccga

SEQ ID NO: 93291 - DNA, 20 bp, human
gtccgggagccgcagccgtc

SEQ ID NO: 93292 - DNA, 20 bp, human
gccctggaggtaagtgggtc

SEQ ID NO: 93293 - DNA, 20 bp, human
gcaggagtactggggcccgg

SEQ ID NO: 93294 - DNA, 20 bp, human
gaactcggccaggagtactg

SEQ ID NO: 93295 - DNA, 20 bp, human
gaagcggcagactcagcggc

SEQ ID NO: 93296 - DNA, 20 bp, human
gtgattgacaggcaagatgt

SEQ ID NO: 93297 - DNA, 20 bp, human
ggacaggcaagatgtcggtg

SEQ ID NO: 93298 - DNA, 20 bp, human
gtgtacacttagggaggagg

SEQ ID NO: 93299 - DNA, 20 bp, human
gaagatgtcggtgtggagcg

SEQ ID NO: 93300 - DNA, 20 bp, human
gttgcagcaaccgtcacccc

SEQ ID NO: 93301 - DNA, 20 bp, human
ggagtctctggtccctgaaa

SEQ ID NO: 93302 - DNA, 20 bp, human
ggctgtctgtacacttaggg

SEQ ID NO: 93303 - DNA, 20 bp, human
gtgtcaatcaaagggcgggg

SEQ ID NO: 93304 - DNA, 20 bp, human
ggtctgtacacttagggagg

SEQ ID NO: 93305 - DNA, 20 bp, human
gcgtgtccctgcaactggga

SEQ ID NO: 93306 - DNA, 20 bp, human
gcacgagcggcatcctctca

SEQ ID NO: 93307 - DNA, 20 bp, human
ggcccgcaaaacaccacgag

SEQ ID NO: 93308 - DNA, 20 bp, human
gcctctcagggagcgaccat

SEQ ID NO: 93309 - DNA, 20 bp, human
gccgatcgcgggacctcagg

SEQ ID NO: 93310 - DNA, 20 bp, human
ggccacgcgctgaggaggac

SEQ ID NO: 93311 - DNA, 20 bp, human
ggccggctcttgccgctgta

SEQ ID NO: 93312 - DNA, 20 bp, human
gatcgcgggacctcaggtgg

SEQ ID NO: 93313 - DNA, 20 bp, human
gggcgcagcgcggttgccaa

SEQ ID NO: 93314 - DNA, 20 bp, human
gcaggcagtagagctcgtaa

SEQ ID NO: 93315 - DNA, 20 bp, human
ggtccaggatgaccacgtcg

SEQ ID NO: 93316 - DNA, 20 bp, human
ggacggcacctgagcgactg

SEQ ID NO: 93317 - DNA, 20 bp, human
gggcacctgagcgactgcgg

SEQ ID NO: 93318 - DNA, 20 bp, human
gccgctcggcaggaaacggg

SEQ ID NO: 93319 - DNA, 20 bp, human
gacctgagcgactgcggcgg

SEQ ID NO: 93320 - DNA, 20 bp, human
gcccgaccccggctctgtcg

SEQ ID NO: 93321 - DNA, 20 bp, human
gttcctgccgagcggcgcga

SEQ ID NO: 93322 - DNA, 20 bp, human
ggccgccgccgcagtcgctc

SEQ ID NO: 93323 - DNA, 20 bp, human
gatgcccgaggcctacccag

SEQ ID NO: 93324 - DNA, 20 bp, human
gggagaccgggaagacgcgg

SEQ ID NO: 93325 - DNA, 20 bp, human
gggagagtcgtccttgggga

SEQ ID NO: 93326 - DNA, 20 bp, human
ggctgactcataaaactcca

SEQ ID NO: 93327 - DNA, 20 bp, human
gtgcctcgaagaagaaacca

SEQ ID NO: 93328 - DNA, 20 bp, human
ggtgacgcatcaaagattcc

SEQ ID NO: 93329 - DNA, 20 bp, human
gctcagagtcggattcatgg

SEQ ID NO: 93330 - DNA, 20 bp, human
gtgacctgctcttcaagcac

SEQ ID NO: 93331 - DNA, 20 bp, human
gttcgaggcagctgcttcag

SEQ ID NO: 93332 - DNA, 20 bp, human
gttactgtaataactattga

SEQ ID NO: 93333 - DNA, 20 bp, human
gcacattgacaaaagtacca

SEQ ID NO: 93334 - DNA, 20 bp, human
gggtgggctgtttagtaact

SEQ ID NO: 93335 - DNA, 20 bp, human
gggcagaagaagtctaaaaa

SEQ ID NO: 93336 - DNA, 20 bp, human
gctctcaaaatgttgattcc

SEQ ID NO: 93337 - DNA, 20 bp, human
ggccagactagcagtaatca

SEQ ID NO: 93338 - DNA, 20 bp, human
gtcggccccggcgtcggtag

SEQ ID NO: 93339 - DNA, 20 bp, human
gggatctggatccggatcag

SEQ ID NO: 93340 - DNA, 20 bp, human
gtaacctggatatagaaccg

SEQ ID NO: 93341 - DNA, 20 bp, human
gccaaactcggccccggcgt

SEQ ID NO: 93342 - DNA, 20 bp, human
ggcggcggcacctgcacatc

SEQ ID NO: 93343 - DNA, 20 bp, human
ggctctgaaaaaccccaagt

SEQ ID NO: 93344 - DNA, 20 bp, human
gcccaccccaaactcggccc

SEQ ID NO: 93345 - DNA, 20 bp, human
gacgcacgcaagcggctcca

SEQ ID NO: 93346 - DNA, 20 bp, human
gggcgcccaggtcggaaagg

SEQ ID NO: 93347 - DNA, 20 bp, human
ggcgcaagcagcctagcgtg

SEQ ID NO: 93348 - DNA, 20 bp, human
gtgcacagggagtgaaactg

SEQ ID NO: 93349 - DNA, 20 bp, human
gctctacacccgttagggag

SEQ ID NO: 93350 - DNA, 20 bp, human
ggtggcaacgcgcagtcccg

SEQ ID NO: 93351 - DNA, 20 bp, human
gactccctgtgcaggcctgt

SEQ ID NO: 93352 - DNA, 20 bp, human
gcggaaaggaggcggcatca

SEQ ID NO: 93353 - DNA, 20 bp, human
ggtgaaactggggcaatcac

SEQ ID NO: 93354 - DNA, 20 bp, human
gcacccgttagggagtggct

SEQ ID NO: 93355 - DNA, 20 bp, human
gggcgccgcggccgcacgct

SEQ ID NO: 93356 - DNA, 20 bp, human
gaggttcttggagagattct

SEQ ID NO: 93357 - DNA, 20 bp, human
gtaggtcaaactccagacga

SEQ ID NO: 93358 - DNA, 20 bp, human
gaggatcccaatggagtgtt

SEQ ID NO: 93359 - DNA, 20 bp, human
gaatgtacaggccagatctt

SEQ ID NO: 93360 - DNA, 20 bp, human
gtgggagccaaacactccat

SEQ ID NO: 93361 - DNA, 20 bp, human
ggaattccttgaaaatgtac

SEQ ID NO: 93362 - DNA, 20 bp, human
gaaacatggagtaaacatta

SEQ ID NO: 93363 - DNA, 20 bp, human
gatcctagctggtaagcttg

SEQ ID NO: 93364 - DNA, 20 bp, human
ggagtttaagcggtaagatt

SEQ ID NO: 93365 - DNA, 20 bp, human
gaatggtatgaccttcctaa

SEQ ID NO: 93366 - DNA, 20 bp, human
gcatcgcagacgcgctcggg

SEQ ID NO: 93367 - DNA, 20 bp, human
ggtctgcgatgccgatgctg

SEQ ID NO: 93368 - DNA, 20 bp, human
gcctgggcgggagaacaggg

SEQ ID NO: 93369 - DNA, 20 bp, human
ggccgctgctgccgcagcat

SEQ ID NO: 93370 - DNA, 20 bp, human
ggggagcgctcgacccgatc

SEQ ID NO: 93371 - DNA, 20 bp, human
ggtgtgtgcgtgtctgagaa

SEQ ID NO: 93372 - DNA, 20 bp, human
gccagggccacaccccacgg

SEQ ID NO: 93373 - DNA, 20 bp, human
gggagcccgacgcccggcat

SEQ ID NO: 93374 - DNA, 20 bp, human
gcccgacgcccggcatgggt

SEQ ID NO: 93375 - DNA, 20 bp, human
ggcccagcctccgcgcacgc

SEQ ID NO: 93376 - DNA, 20 bp, human
ggatctggataagcaggcag

SEQ ID NO: 93377 - DNA, 20 bp, human
gaggagatagccaggacgtt

SEQ ID NO: 93378 - DNA, 20 bp, human
gccgggggtacccaacgtcc

SEQ ID NO: 93379 - DNA, 20 bp, human
gggagtcagggtccggaaca

SEQ ID NO: 93380 - DNA, 20 bp, human
gcgtgtcaggaccatggaca

SEQ ID NO: 93381 - DNA, 20 bp, human
ggagtagctgaagggagcct

SEQ ID NO: 93382 - DNA, 20 bp, human
gaaagaggggcccaacatag

SEQ ID NO: 93383 - DNA, 20 bp, human
gggaggtagaagataaagag

SEQ ID NO: 93384 - DNA, 20 bp, human
gacgttagtgactaacatct

SEQ ID NO: 93385 - DNA, 20 bp, human
ggcggggcgtgtcaggacca

SEQ ID NO: 93386 - DNA, 20 bp, human
ggaatccgcctggacgactg

SEQ ID NO: 93387 - DNA, 20 bp, human
gctgaggagcgaacaaagtg

SEQ ID NO: 93388 - DNA, 20 bp, human
ggtgcgtggggcccgggtag

SEQ ID NO: 93389 - DNA, 20 bp, human
gcttgtaactaaggactgag

SEQ ID NO: 93390 - DNA, 20 bp, human
ggacagtaagggaaagagca

SEQ ID NO: 93391 - DNA, 20 bp, human
gcagccttacctggcgaaaa

SEQ ID NO: 93392 - DNA, 20 bp, human
gcgctcctcagtcgtccagg

SEQ ID NO: 93393 - DNA, 20 bp, human
gattgcgccacggacagtaa

SEQ ID NO: 93394 - DNA, 20 bp, human
ggtccgcagcgccccaagta

SEQ ID NO: 93395 - DNA, 20 bp, human
gggagcgaacaaagtgagga

SEQ ID NO: 93396 - DNA, 20 bp, human
gttcagagaactccagtagt

SEQ ID NO: 93397 - DNA, 20 bp, human
gggaaaagctacaatacctg

SEQ ID NO: 93398 - DNA, 20 bp, human
ggatgaaaggtcggctacca

SEQ ID NO: 93399 - DNA, 20 bp, human
gtacaaaaaacagggatggt

SEQ ID NO: 93400 - DNA, 20 bp, human
gtgaaactctgtcctactac

SEQ ID NO: 93401 - DNA, 20 bp, human
gatggtaagaaattacccca

SEQ ID NO: 93402 - DNA, 20 bp, human
gaacttcgtgattcaccctg

SEQ ID NO: 93403 - DNA, 20 bp, human
gcacgaagttacgaagtcat

SEQ ID NO: 93404 - DNA, 20 bp, human
gacctaaaagcagttttagg

SEQ ID NO: 93405 - DNA, 20 bp, human
gtctctgaattctttacctc

SEQ ID NO: 93406 - DNA, 20 bp, human
gagggaggggagcgtgcgta

SEQ ID NO: 93407 - DNA, 20 bp, human
ggcgggtcctcggccgtgga

SEQ ID NO: 93408 - DNA, 20 bp, human
gtcggccgtggagggtcaag

SEQ ID NO: 93409 - DNA, 20 bp, human
gcttctgagcgctgagggag

SEQ ID NO: 93410 - DNA, 20 bp, human
ggaagccacttgaccctcca

SEQ ID NO: 93411 - DNA, 20 bp, human
ggacagggaaatacgaacag

SEQ ID NO: 93412 - DNA, 20 bp, human
gcaccaggtgcctccgcgag

SEQ ID NO: 93413 - DNA, 20 bp, human
gaggcggcggggaggaccag

SEQ ID NO: 93414 - DNA, 20 bp, human
gtagaggtcgggagtagctc

SEQ ID NO: 93415 - DNA, 20 bp, human
gtatttacgggccggaggaa

SEQ ID NO: 93416 - DNA, 20 bp, human
ggcgtcgggggagacgagta

SEQ ID NO: 93417 - DNA, 20 bp, human
ggcgtccctggatcatgcgg

SEQ ID NO: 93418 - DNA, 20 bp, human
gggcggtcaccagcccgcag

SEQ ID NO: 93419 - DNA, 20 bp, human
gcaaggctgctgacacacgt

SEQ ID NO: 93420 - DNA, 20 bp, human
gagggctacagctccatgtg

SEQ ID NO: 93421 - DNA, 20 bp, human
gtctcccccgacgcagacca

SEQ ID NO: 93422 - DNA, 20 bp, human
gccgcggagtcagtgggtga

SEQ ID NO: 93423 - DNA, 20 bp, human
ggacggccgcagccacggac

SEQ ID NO: 93424 - DNA, 20 bp, human
ggggcttgaagccatagctg

SEQ ID NO: 93425 - DNA, 20 bp, human
ggatcatgcgggggcagccg

SEQ ID NO: 93426 - DNA, 20 bp, human
ggcctcaagactccacgcca

SEQ ID NO: 93427 - DNA, 20 bp, human
gatgcggagatggaccgagg

SEQ ID NO: 93428 - DNA, 20 bp, human
ggagtcttgaggcctgctga

SEQ ID NO: 93429 - DNA, 20 bp, human
gcccctggcgtggagtcttg

SEQ ID NO: 93430 - DNA, 20 bp, human
gggagtgaggccccctggcg

SEQ ID NO: 93431 - DNA, 20 bp, human
gagcttggagtgaggccccc

SEQ ID NO: 93432 - DNA, 20 bp, human
gcctggagtgagggtttggc

SEQ ID NO: 93433 - DNA, 20 bp, human
gcggagatggaccgaggcgg

SEQ ID NO: 93434 - DNA, 20 bp, human
gcccgcccccgaaccttctg

SEQ ID NO: 93435 - DNA, 20 bp, human
ggctggtgtagcttggagtg

SEQ ID NO: 93436 - DNA, 20 bp, human
gtacctgcctggccagccgg

SEQ ID NO: 93437 - DNA, 20 bp, human
ggccgcccagcgcctagcta

SEQ ID NO: 93438 - DNA, 20 bp, human
gaccgtagctaggcgctggg

SEQ ID NO: 93439 - DNA, 20 bp, human
gctaggcgctgggcggccac

SEQ ID NO: 93440 - DNA, 20 bp, human
gcccggctcggaccgtagct

SEQ ID NO: 93441 - DNA, 20 bp, human
ggcctagctacggtccgagc

SEQ ID NO: 93442 - DNA, 20 bp, human
gacgccggggaaagcggtct

SEQ ID NO: 93443 - DNA, 20 bp, human
ggcggcgcccaggggacgca

SEQ ID NO: 93444 - DNA, 20 bp, human
gcggaccgtagctaggcgct

SEQ ID NO: 93445 - DNA, 20 bp, human
gctcgccgccctggacggag

SEQ ID NO: 93446 - DNA, 20 bp, human
gacatgaggtgggaagtgaa

SEQ ID NO: 93447 - DNA, 20 bp, human
gttctcacctcaatactccg

SEQ ID NO: 93448 - DNA, 20 bp, human
gtggcgaaactgaggtctca

SEQ ID NO: 93449 - DNA, 20 bp, human
ggagaagccccggagtattg

SEQ ID NO: 93450 - DNA, 20 bp, human
gggtagttaaactgagccag

SEQ ID NO: 93451 - DNA, 20 bp, human
ggctctcgcggagagcgacg

SEQ ID NO: 93452 - DNA, 20 bp, human
gaggtctcatggagaagccc

SEQ ID NO: 93453 - DNA, 20 bp, human
ggtgacgcttggcgaaactg

SEQ ID NO: 93454 - DNA, 20 bp, human
ggcgacggggcaggccaata

SEQ ID NO: 93455 - DNA, 20 bp, human
gtcctgcacctggtgacgct

SEQ ID NO: 93456 - DNA, 20 bp, human
gggggtaagaagcggttgat

SEQ ID NO: 93457 - DNA, 20 bp, human
ggcgcgtagagtcagggctg

SEQ ID NO: 93458 - DNA, 20 bp, human
ggcatgtgcgcgtagagtca

SEQ ID NO: 93459 - DNA, 20 bp, human
gagtcctgacaaatggtcca

SEQ ID NO: 93460 - DNA, 20 bp, human
ggtcaggactactcgtgaga

SEQ ID NO: 93461 - DNA, 20 bp, human
ggtgagtgcgagtgtgaaag

SEQ ID NO: 93462 - DNA, 20 bp, human
gcagccctggaccatttgtc

SEQ ID NO: 93463 - DNA, 20 bp, human
gccagaggcgcagagaagtg

SEQ ID NO: 93464 - DNA, 20 bp, human
gcacgagtagtcctgacaaa

SEQ ID NO: 93465 - DNA, 20 bp, human
ggtcttgtgaaacagatcag

SEQ ID NO: 93466 - DNA, 20 bp, human
gcgaccgagctacaggcggg

SEQ ID NO: 93467 - DNA, 20 bp, human
gcagcgcagcctgggaccgg

SEQ ID NO: 93468 - DNA, 20 bp, human
gacgccgaccgagctacagg

SEQ ID NO: 93469 - DNA, 20 bp, human
gctacaggcggggggcgagt

SEQ ID NO: 93470 - DNA, 20 bp, human
gggccgcgcccgtccaaagt

SEQ ID NO: 93471 - DNA, 20 bp, human
gcctcccgccgggcaccgcg

SEQ ID NO: 93472 - DNA, 20 bp, human
ggcgcctcggtcagccgcga

SEQ ID NO: 93473 - DNA, 20 bp, human
ggcaacgccgaccgagctac

SEQ ID NO: 93474 - DNA, 20 bp, human
gctgccctcgcggctgaccg

SEQ ID NO: 93475 - DNA, 20 bp, human
gcatccccgggcaggtagag

SEQ ID NO: 93476 - DNA, 20 bp, human
ggtcggacaacgcacaccag

SEQ ID NO: 93477 - DNA, 20 bp, human
gcctgcccgggcacctccac

SEQ ID NO: 93478 - DNA, 20 bp, human
gaggctcaggacgagggacg

SEQ ID NO: 93479 - DNA, 20 bp, human
gctcaggacgagggacgggg

SEQ ID NO: 93480 - DNA, 20 bp, human
gtagaccggtgtgcaaccga

SEQ ID NO: 93481 - DNA, 20 bp, human
gcacagaggtcgccgtagac

SEQ ID NO: 93482 - DNA, 20 bp, human
ggatcccaggggaaacctga

SEQ ID NO: 93483 - DNA, 20 bp, human
ggggcggcaaattgtcacag

SEQ ID NO: 93484 - DNA, 20 bp, human
gcagctggcacgagggaacc

SEQ ID NO: 93485 - DNA, 20 bp, human
gccgacaggaagtcccgaat

SEQ ID NO: 93486 - DNA, 20 bp, human
gcagcgggctctgtgctaag

SEQ ID NO: 93487 - DNA, 20 bp, human
gacagggagggtaatcccag

SEQ ID NO: 93488 - DNA, 20 bp, human
gcctcgtacggagttcaaga

SEQ ID NO: 93489 - DNA, 20 bp, human
ggtaaccaagagcgaccagg

SEQ ID NO: 93490 - DNA, 20 bp, human
gcgtacggagttcaagatgg

SEQ ID NO: 93491 - DNA, 20 bp, human
gtccgtacgaggagaggaag

SEQ ID NO: 93492 - DNA, 20 bp, human
gttgaactccgtacgaggag

SEQ ID NO: 93493 - DNA, 20 bp, human
gagcgtccggaaggacggga

SEQ ID NO: 93494 - DNA, 20 bp, human
gttagagagctgaacctagt

SEQ ID NO: 93495 - DNA, 20 bp, human
gcaacacatctccctctcag

SEQ ID NO: 93496 - DNA, 20 bp, human
gcagggtgtcccctacacga

SEQ ID NO: 93497 - DNA, 20 bp, human
gtgcctgggcaccctcgtgt

SEQ ID NO: 93498 - DNA, 20 bp, human
gtgcttggcaagtagagtgt

SEQ ID NO: 93499 - DNA, 20 bp, human
gaggccacgtgtggagaact

SEQ ID NO: 93500 - DNA, 20 bp, human
ggcagaaggtctggggaata

SEQ ID NO: 93501 - DNA, 20 bp, human
gagtgtagctgaggcatagt

SEQ ID NO: 93502 - DNA, 20 bp, human
gaggcatagtgggtaaacaa

SEQ ID NO: 93503 - DNA, 20 bp, human
gcctgctcaactacatgcag

SEQ ID NO: 93504 - DNA, 20 bp, human
gcccctacacgagggtgccc

SEQ ID NO: 93505 - DNA, 20 bp, human
gggactgggaggactcttgt

SEQ ID NO: 93506 - DNA, 20 bp, human
ggtgcagagacgccatgtac

SEQ ID NO: 93507 - DNA, 20 bp, human
gcttgaggccaagcccccgg

SEQ ID NO: 93508 - DNA, 20 bp, human
gccgacagcaccgccgacag

SEQ ID NO: 93509 - DNA, 20 bp, human
ggctgacatgagccggtaca

SEQ ID NO: 93510 - DNA, 20 bp, human
ggcaccccgccgccccgggt

SEQ ID NO: 93511 - DNA, 20 bp, human
ggacctgctgcacaggatca

SEQ ID NO: 93512 - DNA, 20 bp, human
gcaaggtgcggccactggag

SEQ ID NO: 93513 - DNA, 20 bp, human
gagggtgtgcgtgagtttgg

SEQ ID NO: 93514 - DNA, 20 bp, human
gagtcactgctgacatgagc

SEQ ID NO: 93515 - DNA, 20 bp, human
ggctgcacaggatcaaggtg

SEQ ID NO: 93516 - DNA, 20 bp, human
gcgcgctggagtatccagat

SEQ ID NO: 93517 - DNA, 20 bp, human
gcgccggcgtgtcgcctatc

SEQ ID NO: 93518 - DNA, 20 bp, human
gatccagataggcgacacgc

SEQ ID NO: 93519 - DNA, 20 bp, human
gagagagctatcacctgggg

SEQ ID NO: 93520 - DNA, 20 bp, human
gcagcgcggaagaagccaac

SEQ ID NO: 93521 - DNA, 20 bp, human
gtaggcgacacgccggcggg

SEQ ID NO: 93522 - DNA, 20 bp, human
gcgggttgcgaggcatcacg

SEQ ID NO: 93523 - DNA, 20 bp, human
gggacgctactcgctatccc

SEQ ID NO: 93524 - DNA, 20 bp, human
gattagagagctatcacctg

SEQ ID NO: 93525 - DNA, 20 bp, human
gctcgctatccccggcctgt

SEQ ID NO: 93526 - DNA, 20 bp, human
gtacacactagaatcagggg

SEQ ID NO: 93527 - DNA, 20 bp, human
ggcaggaaggtcttgaaagg

SEQ ID NO: 93528 - DNA, 20 bp, human
ggagcctggagattccatca

SEQ ID NO: 93529 - DNA, 20 bp, human
gccctacacactagaatcag

SEQ ID NO: 93530 - DNA, 20 bp, human
gaccggtcttcagcttgggg

SEQ ID NO: 93531 - DNA, 20 bp, human
gtgctctcagtggtcatgac

SEQ ID NO: 93532 - DNA, 20 bp, human
ggctgcaggaaggtcttgaa

SEQ ID NO: 93533 - DNA, 20 bp, human
ggtgagagctggactcagaa

SEQ ID NO: 93534 - DNA, 20 bp, human
gctcaataggaacaactcac

SEQ ID NO: 93535 - DNA, 20 bp, human
gactcaccggtcttcagctt

SEQ ID NO: 93536 - DNA, 20 bp, human
gctccgccagagacacacgg

SEQ ID NO: 93537 - DNA, 20 bp, human
gcacacgggggcagtgagag

SEQ ID NO: 93538 - DNA, 20 bp, human
gcgggacccctgaggttaca

SEQ ID NO: 93539 - DNA, 20 bp, human
ggccaaactcgggacccctg

SEQ ID NO: 93540 - DNA, 20 bp, human
gtgtccaggtgagcgccgga

SEQ ID NO: 93541 - DNA, 20 bp, human
gcgaggccgcaagcactggg

SEQ ID NO: 93542 - DNA, 20 bp, human
gccagcgggcgtccagactg

SEQ ID NO: 93543 - DNA, 20 bp, human
ggaggcttctctcaggaatg

SEQ ID NO: 93544 - DNA, 20 bp, human
gcctctccgccagagacaca

SEQ ID NO: 93545 - DNA, 20 bp, human
gacccctgaggttacagggt

SEQ ID NO: 93546 - DNA, 20 bp, human
gcagagcaaagtggccgtcg

SEQ ID NO: 93547 - DNA, 20 bp, human
gctgctggtcccctcctgtg

SEQ ID NO: 93548 - DNA, 20 bp, human
gcagaccataggagagatgt

SEQ ID NO: 93549 - DNA, 20 bp, human
gtacctggagccacccaaag

SEQ ID NO: 93550 - DNA, 20 bp, human
gaccagaggccggaatccag

SEQ ID NO: 93551 - DNA, 20 bp, human
gggtggctccaggtaaaacg

SEQ ID NO: 93552 - DNA, 20 bp, human
gccacagagctaaggacctc

SEQ ID NO: 93553 - DNA, 20 bp, human
gtggccacagagatccctgc

SEQ ID NO: 93554 - DNA, 20 bp, human
ggggatctctgtggccacaa

SEQ ID NO: 93555 - DNA, 20 bp, human
gctctgtctgctctccgcca

SEQ ID NO: 93556 - DNA, 20 bp, human
gacctgagagggggcttcag

SEQ ID NO: 93557 - DNA, 20 bp, human
gggagaagctctgctaacgg

SEQ ID NO: 93558 - DNA, 20 bp, human
ggcaagaaggcctgagacat

SEQ ID NO: 93559 - DNA, 20 bp, human
ggcgaggtaaggagtgaagg

SEQ ID NO: 93560 - DNA, 20 bp, human
gtcagaggtggtcggaggag

SEQ ID NO: 93561 - DNA, 20 bp, human
ggcggcggtcatgcgggacg

SEQ ID NO: 93562 - DNA, 20 bp, human
gcggcgcggcggcggtcatg

SEQ ID NO: 93563 - DNA, 20 bp, human
gcagcgcacgcgccaggtcc

SEQ ID NO: 93564 - DNA, 20 bp, human
gtacggtcagaggtggtcgg

SEQ ID NO: 93565 - DNA, 20 bp, human
gagcagcccccagctcggaa

SEQ ID NO: 93566 - DNA, 20 bp, human
ggttgctgtggaagccccat

SEQ ID NO: 93567 - DNA, 20 bp, human
gggggctcgatggagctggg

SEQ ID NO: 93568 - DNA, 20 bp, human
gcctgaggcgcaccaatgca

SEQ ID NO: 93569 - DNA, 20 bp, human
gcgggggcctcctgcctatg

SEQ ID NO: 93570 - DNA, 20 bp, human
ggcagggcagtcttgggagg

SEQ ID NO: 93571 - DNA, 20 bp, human
gctgtcaaaagggggctcga

SEQ ID NO: 93572 - DNA, 20 bp, human
gcattggtgcgcctcaggcc

SEQ ID NO: 93573 - DNA, 20 bp, human
gctaggcccaggagggcggt

SEQ ID NO: 93574 - DNA, 20 bp, human
gaagggggctcgatggagct

SEQ ID NO: 93575 - DNA, 20 bp, human
gctggaggcagccgggaggc

SEQ ID NO: 93576 - DNA, 20 bp, human
ggttgctgtggaaaccccac

SEQ ID NO: 93577 - DNA, 20 bp, human
ggtgtctgctgcagagttct

SEQ ID NO: 93578 - DNA, 20 bp, human
ggcgggaaggactggaaagg

SEQ ID NO: 93579 - DNA, 20 bp, human
ggcaactgcctcacacaaga

SEQ ID NO: 93580 - DNA, 20 bp, human
gccgggggcctcctgcccgt

SEQ ID NO: 93581 - DNA, 20 bp, human
ggagcagtagggcagtcttg

SEQ ID NO: 93582 - DNA, 20 bp, human
gagtccttcccgctccctcc

SEQ ID NO: 93583 - DNA, 20 bp, human
gggcccctgtttttaggaca

SEQ ID NO: 93584 - DNA, 20 bp, human
gtggaaaccccacgggcagg

SEQ ID NO: 93585 - DNA, 20 bp, human
ggaaggactggaaagggggt

SEQ ID NO: 93586 - DNA, 20 bp, human
gggatgcccaccaggaacag

SEQ ID NO: 93587 - DNA, 20 bp, human
gttgcttggccaggatggca

SEQ ID NO: 93588 - DNA, 20 bp, human
gcttgggggtagccaaaatg

SEQ ID NO: 93589 - DNA, 20 bp, human
gttccatttcaggttcttgg

SEQ ID NO: 93590 - DNA, 20 bp, human
gtaattaagtaaaagtggag

SEQ ID NO: 93591 - DNA, 20 bp, human
gtggaggagagaagcgtatg

SEQ ID NO: 93592 - DNA, 20 bp, human
ggagagaagcgtatgaggaa

SEQ ID NO: 93593 - DNA, 20 bp, human
gtacccccaagaacctgaaa

SEQ ID NO: 93594 - DNA, 20 bp, human
gaagacatagatggttatgg

SEQ ID NO: 93595 - DNA, 20 bp, human
ggggacaaagaacctcattt

SEQ ID NO: 93596 - DNA, 20 bp, human
ggaagtcccgcaaaagccag

SEQ ID NO: 93597 - DNA, 20 bp, human
gccccagacccaccgagtgg

SEQ ID NO: 93598 - DNA, 20 bp, human
gcccgcctggaacgctccac

SEQ ID NO: 93599 - DNA, 20 bp, human
gtctccccagacccaccgag

SEQ ID NO: 93600 - DNA, 20 bp, human
ggcctccgccgccactcggt

SEQ ID NO: 93601 - DNA, 20 bp, human
gcgagacacccactccgagg

SEQ ID NO: 93602 - DNA, 20 bp, human
gtcgcgtagatggcgctcct

SEQ ID NO: 93603 - DNA, 20 bp, human
gtctacgcgagcagtgctgg

SEQ ID NO: 93604 - DNA, 20 bp, human
gggccgagacacccactccg

SEQ ID NO: 93605 - DNA, 20 bp, human
ggcggaggcgagatgcgcgg

SEQ ID NO: 93606 - DNA, 20 bp, human
ggcccggccaaagccagagg

SEQ ID NO: 93607 - DNA, 20 bp, human
gtccacttctcgggagccag

SEQ ID NO: 93608 - DNA, 20 bp, human
gcagcaaagaggtacagtcg

SEQ ID NO: 93609 - DNA, 20 bp, human
gcagcagcagcggcagtcac

SEQ ID NO: 93610 - DNA, 20 bp, human
gcatgagagcgtagtgtagg

SEQ ID NO: 93611 - DNA, 20 bp, human
gtcgctgccgccctgtcccc

SEQ ID NO: 93612 - DNA, 20 bp, human
gagaggtacagtcgaggcat

SEQ ID NO: 93613 - DNA, 20 bp, human
ggcggctcccggcatcgtag

SEQ ID NO: 93614 - DNA, 20 bp, human
gcgcgaccggatccacttct

SEQ ID NO: 93615 - DNA, 20 bp, human
gaagtcctgcaaaaggaacg

SEQ ID NO: 93616 - DNA, 20 bp, human
ggtgcccccgagcccctctg

SEQ ID NO: 93617 - DNA, 20 bp, human
ggcctgagccgtccgcagag

SEQ ID NO: 93618 - DNA, 20 bp, human
gcggccaggttgaagtaagt

SEQ ID NO: 93619 - DNA, 20 bp, human
ggcgctgtcagttcctgatc

SEQ ID NO: 93620 - DNA, 20 bp, human
gggctccgggcgactgggaa

SEQ ID NO: 93621 - DNA, 20 bp, human
ggcgaccgctcgggatcccg

SEQ ID NO: 93622 - DNA, 20 bp, human
gtcagctctggaacctgccg

SEQ ID NO: 93623 - DNA, 20 bp, human
ggcgcagccggggatatggg

SEQ ID NO: 93624 - DNA, 20 bp, human
ggaacctgccgcggctggag

SEQ ID NO: 93625 - DNA, 20 bp, human
gcctgcggggagaggggacc

SEQ ID NO: 93626 - DNA, 20 bp, human
ggtcccgaacggccagggag

SEQ ID NO: 93627 - DNA, 20 bp, human
gatggacggagcttacagta

SEQ ID NO: 93628 - DNA, 20 bp, human
gggagcaggcagcgctccag

SEQ ID NO: 93629 - DNA, 20 bp, human
ggcaccacgcgggagaccta

SEQ ID NO: 93630 - DNA, 20 bp, human
gccccagtcccgaacggcca

SEQ ID NO: 93631 - DNA, 20 bp, human
ggagcactactggatgtcag

SEQ ID NO: 93632 - DNA, 20 bp, human
gcgcagtccccagtcccgaa

SEQ ID NO: 93633 - DNA, 20 bp, human
gagaggaggtggcctagcgc

SEQ ID NO: 93634 - DNA, 20 bp, human
gagggaaagtgcgagagtaa

SEQ ID NO: 93635 - DNA, 20 bp, human
gagccctggaagagcactac

SEQ ID NO: 93636 - DNA, 20 bp, human
ggcgctgtccctggagctcg

SEQ ID NO: 93637 - DNA, 20 bp, human
gcctcggccaggttgaagta

SEQ ID NO: 93638 - DNA, 20 bp, human
gaacaccggcccgaccccag

SEQ ID NO: 93639 - DNA, 20 bp, human
gagccgggaagatggcgaag

SEQ ID NO: 93640 - DNA, 20 bp, human
gggccacggcgctccccctg

SEQ ID NO: 93641 - DNA, 20 bp, human
ggccgtggggcttcctcccg

SEQ ID NO: 93642 - DNA, 20 bp, human
gcggccaggttgaagtaggg

SEQ ID NO: 93643 - DNA, 20 bp, human
gtcctctccgcaggtcgcgg

SEQ ID NO: 93644 - DNA, 20 bp, human
gggccgcgtccccgagctcc

SEQ ID NO: 93645 - DNA, 20 bp, human
gcgggtcggggtgccttctt

SEQ ID NO: 93646 - DNA, 20 bp, human
gttagccttgggaggaacag

SEQ ID NO: 93647 - DNA, 20 bp, human
gagcccccaggatcccacga

SEQ ID NO: 93648 - DNA, 20 bp, human
ggccaccaccgaagcaaggg

SEQ ID NO: 93649 - DNA, 20 bp, human
gcggtggcgtttaatcccag

SEQ ID NO: 93650 - DNA, 20 bp, human
ggagcccccgagcccaaaga

SEQ ID NO: 93651 - DNA, 20 bp, human
ggctgcttgctcaccttcgt

SEQ ID NO: 93652 - DNA, 20 bp, human
gtcaccttcgtgggatcctg

SEQ ID NO: 93653 - DNA, 20 bp, human
gccagccaccaccgaagcaa

SEQ ID NO: 93654 - DNA, 20 bp, human
gtggcggtgctgaccgagga

SEQ ID NO: 93655 - DNA, 20 bp, human
gggtgcaaaaccctgagcgg

SEQ ID NO: 93656 - DNA, 20 bp, human
ggaacagccaggcacatccg

SEQ ID NO: 93657 - DNA, 20 bp, human
gccactggataggaactcag

SEQ ID NO: 93658 - DNA, 20 bp, human
gaaacaggccaaagacccac

SEQ ID NO: 93659 - DNA, 20 bp, human
gggcccagtcgaagttccca

SEQ ID NO: 93660 - DNA, 20 bp, human
gagaggggaacagggataag

SEQ ID NO: 93661 - DNA, 20 bp, human
gtgaggtggagccactggat

SEQ ID NO: 93662 - DNA, 20 bp, human
gagttcccaggtctgtccag

SEQ ID NO: 93663 - DNA, 20 bp, human
gagacctgggaactgacaga

SEQ ID NO: 93664 - DNA, 20 bp, human
gcccacaggcagagttgaca

SEQ ID NO: 93665 - DNA, 20 bp, human
gggtgactgacgatgcagta

SEQ ID NO: 93666 - DNA, 20 bp, human
gaggcgatctggagaaagaa

SEQ ID NO: 93667 - DNA, 20 bp, human
gggagacccccacattcaag

SEQ ID NO: 93668 - DNA, 20 bp, human
gtaaaagagtcatgggccca

SEQ ID NO: 93669 - DNA, 20 bp, human
ggaggagctttcaggcgatc

SEQ ID NO: 93670 - DNA, 20 bp, human
gaagagtcatgggcccaggg

SEQ ID NO: 93671 - DNA, 20 bp, human
gcctctcctaaaagagtcat

SEQ ID NO: 93672 - DNA, 20 bp, human
gggccacatgttccctccct

SEQ ID NO: 93673 - DNA, 20 bp, human
gcatttgataagcacctcag

SEQ ID NO: 93674 - DNA, 20 bp, human
gaagctcctcttgaatgtgg

SEQ ID NO: 93675 - DNA, 20 bp, human
gcatccggcccgcaccaggc

SEQ ID NO: 93676 - DNA, 20 bp, human
gggcaagacttaccaggatc

SEQ ID NO: 93677 - DNA, 20 bp, human
gcacaaagactcccagatcc

SEQ ID NO: 93678 - DNA, 20 bp, human
gctcccttcaaggtacagta

SEQ ID NO: 93679 - DNA, 20 bp, human
gaatttgctagtgagagagc

SEQ ID NO: 93680 - DNA, 20 bp, human
gacagtaaggctcaagttgt

SEQ ID NO: 93681 - DNA, 20 bp, human
gagccttactgtaccttgaa

SEQ ID NO: 93682 - DNA, 20 bp, human
gtaaactggctctaactttc

SEQ ID NO: 93683 - DNA, 20 bp, human
ggaaggtattagaatttagg

SEQ ID NO: 93684 - DNA, 20 bp, human
gtcatttgaagctcccttca

SEQ ID NO: 93685 - DNA, 20 bp, human
gacataaaacagtatccaat

SEQ ID NO: 93686 - DNA, 20 bp, human
gtgcaggctgctcccggggt

SEQ ID NO: 93687 - DNA, 20 bp, human
ggcacgcgctcggaagtcgg

SEQ ID NO: 93688 - DNA, 20 bp, human
gaggcggcgttgacgaactc

SEQ ID NO: 93689 - DNA, 20 bp, human
gtgggtcacggcgaaggcaa

SEQ ID NO: 93690 - DNA, 20 bp, human
ggtaggtgagggaagcgcgg

SEQ ID NO: 93691 - DNA, 20 bp, human
gggcgcgcgggggcagtggt

SEQ ID NO: 93692 - DNA, 20 bp, human
gtcgcgccggagagactgac

SEQ ID NO: 93693 - DNA, 20 bp, human
ggccggagagactgacgggt

SEQ ID NO: 93694 - DNA, 20 bp, human
gggcggagtcccacacgtgt

SEQ ID NO: 93695 - DNA, 20 bp, human
ggctgctcccggggtaggtg

SEQ ID NO: 93696 - DNA, 20 bp, human
ggagtgagaaccaccaaccg

SEQ ID NO: 93697 - DNA, 20 bp, human
gcgctgcccggcgcctcggt

SEQ ID NO: 93698 - DNA, 20 bp, human
gctggaggagccccagatag

SEQ ID NO: 93699 - DNA, 20 bp, human
ggcccgggccacctccagga

SEQ ID NO: 93700 - DNA, 20 bp, human
gaaccaccaaccgaggcgcc

SEQ ID NO: 93701 - DNA, 20 bp, human
gacaaagtgggaatcctcgg

SEQ ID NO: 93702 - DNA, 20 bp, human
gagacagagactgagcggcc

SEQ ID NO: 93703 - DNA, 20 bp, human
ggaggtacgttcagccatca

SEQ ID NO: 93704 - DNA, 20 bp, human
gccagagcgcaggcatggcg

SEQ ID NO: 93705 - DNA, 20 bp, human
gcccagccagagcgcaggca

SEQ ID NO: 93706 - DNA, 20 bp, human
gcagccgccgccatggtcaa

SEQ ID NO: 93707 - DNA, 20 bp, human
gggccccgctcggctagggt

SEQ ID NO: 93708 - DNA, 20 bp, human
gcagcccgcgcttacctagg

SEQ ID NO: 93709 - DNA, 20 bp, human
gtcggtgcccttgaccatgg

SEQ ID NO: 93710 - DNA, 20 bp, human
gccaggacgagagcacctgg

SEQ ID NO: 93711 - DNA, 20 bp, human
ggcgtcggtgcccttgacca

SEQ ID NO: 93712 - DNA, 20 bp, human
gcggagggtgatgttgaccg

SEQ ID NO: 93713 - DNA, 20 bp, human
ggtgcccttgaccatggcgg

SEQ ID NO: 93714 - DNA, 20 bp, human
gggtgatgttgaccgaggtg

SEQ ID NO: 93715 - DNA, 20 bp, human
gcctccgcctaggtaagcgc

SEQ ID NO: 93716 - DNA, 20 bp, human
gggcggggcgcgggcgccaa

SEQ ID NO: 93717 - DNA, 20 bp, human
ggggctggcgttagagacag

SEQ ID NO: 93718 - DNA, 20 bp, human
ggggtcggagcggagctcaa

SEQ ID NO: 93719 - DNA, 20 bp, human
gggcccggccactgcgacgc

SEQ ID NO: 93720 - DNA, 20 bp, human
ggacccgcgggacaacgacc

SEQ ID NO: 93721 - DNA, 20 bp, human
gcggggtcgtagggtcggag

SEQ ID NO: 93722 - DNA, 20 bp, human
gccaggacctggctcctcta

SEQ ID NO: 93723 - DNA, 20 bp, human
gcttcgtgccggcgtcgcag

SEQ ID NO: 93724 - DNA, 20 bp, human
ggaggtctcatcccaggacc

SEQ ID NO: 93725 - DNA, 20 bp, human
gacgaagaagacaccgcggc

SEQ ID NO: 93726 - DNA, 20 bp, human
gtaggacagtagagcctgag

SEQ ID NO: 93727 - DNA, 20 bp, human
ggggtggacgccgagggagt

SEQ ID NO: 93728 - DNA, 20 bp, human
gagaaggcctgaccgacgga

SEQ ID NO: 93729 - DNA, 20 bp, human
ggaaaaggctcgctggacct

SEQ ID NO: 93730 - DNA, 20 bp, human
gctagagaaggcctgaccga

SEQ ID NO: 93731 - DNA, 20 bp, human
gtagcttgggagaagtgtgt

SEQ ID NO: 93732 - DNA, 20 bp, human
ggccgagggagtaggctggg

SEQ ID NO: 93733 - DNA, 20 bp, human
gagggcccaggagagtaaga

SEQ ID NO: 93734 - DNA, 20 bp, human
gccaggcggacagactaatc

SEQ ID NO: 93735 - DNA, 20 bp, human
gagaaggggccggtaacggg

SEQ ID NO: 93736 - DNA, 20 bp, human
ggtccgggcaggccccgaat

SEQ ID NO: 93737 - DNA, 20 bp, human
gcggcacaggtaggtttctc

SEQ ID NO: 93738 - DNA, 20 bp, human
gtgagctgccggggcatggt

SEQ ID NO: 93739 - DNA, 20 bp, human
gggcgaggttctgcagcgtg

SEQ ID NO: 93740 - DNA, 20 bp, human
gtgcagcgtgcggcgaagtc

SEQ ID NO: 93741 - DNA, 20 bp, human
gtcgtttctccggcacaggt

SEQ ID NO: 93742 - DNA, 20 bp, human
ggtcccgggcgccacaggac

SEQ ID NO: 93743 - DNA, 20 bp, human
gaaacgcactctggagtccc

SEQ ID NO: 93744 - DNA, 20 bp, human
gcacaggacgggctgcgggt

SEQ ID NO: 93745 - DNA, 20 bp, human
ggcaggtggtttcgtttctc

SEQ ID NO: 93746 - DNA, 20 bp, human
gagagcaaatcggctcactg

SEQ ID NO: 93747 - DNA, 20 bp, human
gggaggaaaggaccgcacgg

SEQ ID NO: 93748 - DNA, 20 bp, human
gtcggctcactgcggaggaa

SEQ ID NO: 93749 - DNA, 20 bp, human
ggcaaatcggctcactgcgg

SEQ ID NO: 93750 - DNA, 20 bp, human
gtccgattgtgtggcaggag

SEQ ID NO: 93751 - DNA, 20 bp, human
gtgagcgcctagctaggact

SEQ ID NO: 93752 - DNA, 20 bp, human
ggcagccgtggaccgccgtg

SEQ ID NO: 93753 - DNA, 20 bp, human
ggcacagccggcctcattcg

SEQ ID NO: 93754 - DNA, 20 bp, human
ggccactcctgccacacaat

SEQ ID NO: 93755 - DNA, 20 bp, human
gaggaccgcacggcggtcca

SEQ ID NO: 93756 - DNA, 20 bp, human
gacccgcggcggcctcccgc

SEQ ID NO: 93757 - DNA, 20 bp, human
gaaagaaacctgcggaggac

SEQ ID NO: 93758 - DNA, 20 bp, human
gttcccggggacctagactg

SEQ ID NO: 93759 - DNA, 20 bp, human
gccggcccgaccccggccat

SEQ ID NO: 93760 - DNA, 20 bp, human
gtggaggggacagattacag

SEQ ID NO: 93761 - DNA, 20 bp, human
gtagcagcaccccatggccg

SEQ ID NO: 93762 - DNA, 20 bp, human
gcacggacgccgtccctcct

SEQ ID NO: 93763 - DNA, 20 bp, human
ggccgcctcagtcaataccc

SEQ ID NO: 93764 - DNA, 20 bp, human
ggctcaggccgcgccgagga

SEQ ID NO: 93765 - DNA, 20 bp, human
gaggcggggctcgggaatga

SEQ ID NO: 93766 - DNA, 20 bp, human
gggggtggggaaggatcacc

SEQ ID NO: 93767 - DNA, 20 bp, human
ggggaggcacctcggagatc

SEQ ID NO: 93768 - DNA, 20 bp, human
gagcaggccaacgggactac

SEQ ID NO: 93769 - DNA, 20 bp, human
ggcgtcccggagcaggccaa

SEQ ID NO: 93770 - DNA, 20 bp, human
gacgggactacgggaagcag

SEQ ID NO: 93771 - DNA, 20 bp, human
gccatcccaagtcccaccaa

SEQ ID NO: 93772 - DNA, 20 bp, human
ggcccagggttaggaaccgt

SEQ ID NO: 93773 - DNA, 20 bp, human
ggatagcgatgtgctcagag

SEQ ID NO: 93774 - DNA, 20 bp, human
gtctccgaggtgcctcccgc

SEQ ID NO: 93775 - DNA, 20 bp, human
gcggcccgcgggaggcacct

SEQ ID NO: 93776 - DNA, 20 bp, human
ggatttccggaggggcccgg

SEQ ID NO: 93777 - DNA, 20 bp, human
gcgccgtcgccctacgatac

SEQ ID NO: 93778 - DNA, 20 bp, human
gatgtgacggtggcttgagg

SEQ ID NO: 93779 - DNA, 20 bp, human
gtctctccgctgtcacttca

SEQ ID NO: 93780 - DNA, 20 bp, human
gcagggacagctttaaagac

SEQ ID NO: 93781 - DNA, 20 bp, human
ggaggtcatgaatcatgtga

SEQ ID NO: 93782 - DNA, 20 bp, human
gccaaagagggaagagtcac

SEQ ID NO: 93783 - DNA, 20 bp, human
ggccagctgagtacctgtgg

SEQ ID NO: 93784 - DNA, 20 bp, human
gcgcgtattaagttgtgggt

SEQ ID NO: 93785 - DNA, 20 bp, human
gacccccacaggtactcagc

SEQ ID NO: 93786 - DNA, 20 bp, human
gcggaagctacctatctggt

SEQ ID NO: 93787 - DNA, 20 bp, human
gccagcaccgaagactgcga

SEQ ID NO: 93788 - DNA, 20 bp, human
gagcccgggggcgagagtgg

SEQ ID NO: 93789 - DNA, 20 bp, human
ggaaggccaggggagcccgg

SEQ ID NO: 93790 - DNA, 20 bp, human
gaagactgcgatggtgagtg

SEQ ID NO: 93791 - DNA, 20 bp, human
gggggagctccctaccagat

SEQ ID NO: 93792 - DNA, 20 bp, human
gtattgaggaccatgtaggg

SEQ ID NO: 93793 - DNA, 20 bp, human
gcaggtcgggcggagacgaa

SEQ ID NO: 93794 - DNA, 20 bp, human
gcccttggggtagcaaaggt

SEQ ID NO: 93795 - DNA, 20 bp, human
gagcagagacgctgaacccc

SEQ ID NO: 93796 - DNA, 20 bp, human
gtcttccaagtgctgctcca

SEQ ID NO: 93797 - DNA, 20 bp, human
gtctgagccggagtggtcgg

SEQ ID NO: 93798 - DNA, 20 bp, human
gactccggctcagaacccag

SEQ ID NO: 93799 - DNA, 20 bp, human
gggctcagaacccagcggca

SEQ ID NO: 93800 - DNA, 20 bp, human
gtcccacccaccgaccactc

SEQ ID NO: 93801 - DNA, 20 bp, human
gtacggtcagggtggttctg

SEQ ID NO: 93802 - DNA, 20 bp, human
gtcgctcaagagggaatgtg

SEQ ID NO: 93803 - DNA, 20 bp, human
ggaagctgagggacatcggt

SEQ ID NO: 93804 - DNA, 20 bp, human
gtaagcaccaagtaactgat

SEQ ID NO: 93805 - DNA, 20 bp, human
gccgggagactcgctcaaga

SEQ ID NO: 93806 - DNA, 20 bp, human
ggagaggccagggccgagaa

SEQ ID NO: 93807 - DNA, 20 bp, human
gcgagaagggcttcaggacg

SEQ ID NO: 93808 - DNA, 20 bp, human
ggacaaacttaggccaagga

SEQ ID NO: 93809 - DNA, 20 bp, human
gcctcctggcaggaactggg

SEQ ID NO: 93810 - DNA, 20 bp, human
gaagggcttcaggacgcggg

SEQ ID NO: 93811 - DNA, 20 bp, human
gtatcctaaactcaccctcc

SEQ ID NO: 93812 - DNA, 20 bp, human
gctccccacggtgttcggaa

SEQ ID NO: 93813 - DNA, 20 bp, human
gggccatcgagccgtctcgg

SEQ ID NO: 93814 - DNA, 20 bp, human
gttactgggtagcagaagtg

SEQ ID NO: 93815 - DNA, 20 bp, human
gggcctcggccgagttgcga

SEQ ID NO: 93816 - DNA, 20 bp, human
gagaggctgaagctccacct

SEQ ID NO: 93817 - DNA, 20 bp, human
ggctagtctccgagggatgg

SEQ ID NO: 93818 - DNA, 20 bp, human
gctgcaaggctagtctccga

SEQ ID NO: 93819 - DNA, 20 bp, human
gggcctcgtagtccgggaag

SEQ ID NO: 93820 - DNA, 20 bp, human
ggaggcagaaatggaggaac

SEQ ID NO: 93821 - DNA, 20 bp, human
gagccgcgcttagggtccgt

SEQ ID NO: 93822 - DNA, 20 bp, human
ggggcgagaccatgtcaaag

SEQ ID NO: 93823 - DNA, 20 bp, human
gggcaaaggcgccaggaaca

SEQ ID NO: 93824 - DNA, 20 bp, human
gccctgctgcgccagcccaa

SEQ ID NO: 93825 - DNA, 20 bp, human
gccacggggaaggtgcgagg

SEQ ID NO: 93826 - DNA, 20 bp, human
ggccgccataaagccccccc

SEQ ID NO: 93827 - DNA, 20 bp, human
gaggagcttcccccactcgg

SEQ ID NO: 93828 - DNA, 20 bp, human
ggccagggggggctttatgg

SEQ ID NO: 93829 - DNA, 20 bp, human
gccttccccgccgcatacac

SEQ ID NO: 93830 - DNA, 20 bp, human
ggggggctagcgcctgccag

SEQ ID NO: 93831 - DNA, 20 bp, human
gcctgccagggggggcttta

SEQ ID NO: 93832 - DNA, 20 bp, human
gggctttatggcggcgtggc

SEQ ID NO: 93833 - DNA, 20 bp, human
gagcttcccccactcggggg

SEQ ID NO: 93834 - DNA, 20 bp, human
gagcccccgccgtcgcccct

SEQ ID NO: 93835 - DNA, 20 bp, human
gcgatggtggcggtgaccaa

SEQ ID NO: 93836 - DNA, 20 bp, human
gacatgacgaaggtgagagg

SEQ ID NO: 93837 - DNA, 20 bp, human
gccgcggaagtgaaaggtca

SEQ ID NO: 93838 - DNA, 20 bp, human
gctcgccccgcagccggaag

SEQ ID NO: 93839 - DNA, 20 bp, human
gtgacgaaggtgagaggcgg

SEQ ID NO: 93840 - DNA, 20 bp, human
gcggtcctggcagtaacccg

SEQ ID NO: 93841 - DNA, 20 bp, human
gagtaacccggggaaagacg

SEQ ID NO: 93842 - DNA, 20 bp, human
gaccttcgtcatgtctgcgg

SEQ ID NO: 93843 - DNA, 20 bp, human
gcacagggctccttcccccg

SEQ ID NO: 93844 - DNA, 20 bp, human
gcgcagccccagtagcccac

SEQ ID NO: 93845 - DNA, 20 bp, human
gcttcccccgcggaagtgaa

SEQ ID NO: 93846 - DNA, 20 bp, human
gggcgcgaagaagctggcag

SEQ ID NO: 93847 - DNA, 20 bp, human
gtgcgcaggcgcgaagaagc

SEQ ID NO: 93848 - DNA, 20 bp, human
gggtggagaacgtttgtcag

SEQ ID NO: 93849 - DNA, 20 bp, human
ggcaccgggacgatcatcct

SEQ ID NO: 93850 - DNA, 20 bp, human
gcaactctggatgaagtcca

SEQ ID NO: 93851 - DNA, 20 bp, human
gggggggcggtggtaagcat

SEQ ID NO: 93852 - DNA, 20 bp, human
ggtccccaggatgatcgtcc

SEQ ID NO: 93853 - DNA, 20 bp, human
gacctggtacatggtaaggc

SEQ ID NO: 93854 - DNA, 20 bp, human
gggggacctggtacatggta

SEQ ID NO: 93855 - DNA, 20 bp, human
ggcatggggagattgttctt

SEQ ID NO: 93856 - DNA, 20 bp, human
gggagcgaagggtaccgacc

SEQ ID NO: 93857 - DNA, 20 bp, human
gagctctcggggtatcgagg

SEQ ID NO: 93858 - DNA, 20 bp, human
gcggtcgccttcggagcgaa

SEQ ID NO: 93859 - DNA, 20 bp, human
gccgaaggcgaccgctgcag

SEQ ID NO: 93860 - DNA, 20 bp, human
gcggagctctcggggtatcg

SEQ ID NO: 93861 - DNA, 20 bp, human
gcagaagctcggagctctcg

SEQ ID NO: 93862 - DNA, 20 bp, human
gtaccgacccggcagaagct

SEQ ID NO: 93863 - DNA, 20 bp, human
gctccgagcttctgccgggt

SEQ ID NO: 93864 - DNA, 20 bp, human
ggggccagaagcccagctag

SEQ ID NO: 93865 - DNA, 20 bp, human
gagagctccgagcttctgcc

SEQ ID NO: 93866 - DNA, 20 bp, human
ggtggggctccgtagatgac

SEQ ID NO: 93867 - DNA, 20 bp, human
ggctgtgccccatctcacag

SEQ ID NO: 93868 - DNA, 20 bp, human
gcttcagtgtctcagaggag

SEQ ID NO: 93869 - DNA, 20 bp, human
gccgcaagagtgaggagtaa

SEQ ID NO: 93870 - DNA, 20 bp, human
ggcggacagtggacaagcgg

SEQ ID NO: 93871 - DNA, 20 bp, human
ggggatcttgggaggaacgt

SEQ ID NO: 93872 - DNA, 20 bp, human
gccagggtcccccagagagg

SEQ ID NO: 93873 - DNA, 20 bp, human
gctggcggacagtggacaag

SEQ ID NO: 93874 - DNA, 20 bp, human
gacatggtagatggccaggg

SEQ ID NO: 93875 - DNA, 20 bp, human
gctcttgcggcatctcccca

SEQ ID NO: 93876 - DNA, 20 bp, human
gcgagtcctggagagcggag

SEQ ID NO: 93877 - DNA, 20 bp, human
gccagcagaatgcgaaaggg

SEQ ID NO: 93878 - DNA, 20 bp, human
gcccttccaagaactagggt

SEQ ID NO: 93879 - DNA, 20 bp, human
gagcccagcagaatgcgaaa

SEQ ID NO: 93880 - DNA, 20 bp, human
ggctctccaggactcgagcg

SEQ ID NO: 93881 - DNA, 20 bp, human
gctgccccttccaagaacta

SEQ ID NO: 93882 - DNA, 20 bp, human
gggagaggtggagacccggg

SEQ ID NO: 93883 - DNA, 20 bp, human
gagggaaggcaaagacccgg

SEQ ID NO: 93884 - DNA, 20 bp, human
gcccagctcggtaaagccaa

SEQ ID NO: 93885 - DNA, 20 bp, human
ggctgtttacctaatctcag

SEQ ID NO: 93886 - DNA, 20 bp, human
gctgccctggcagactccca

SEQ ID NO: 93887 - DNA, 20 bp, human
gcctgtgggctccttcctcg

SEQ ID NO: 93888 - DNA, 20 bp, human
ggatgtacctaaaccctcca

SEQ ID NO: 93889 - DNA, 20 bp, human
gaggaggcagctgtgcgatc

SEQ ID NO: 93890 - DNA, 20 bp, human
gtgccagggcagctaggtat

SEQ ID NO: 93891 - DNA, 20 bp, human
gcctccctgggagtctgcca

SEQ ID NO: 93892 - DNA, 20 bp, human
gtccctaggggcagaaacct

SEQ ID NO: 93893 - DNA, 20 bp, human
ggctgaagggggccaggaca

SEQ ID NO: 93894 - DNA, 20 bp, human
gagggccacatagtgacccc

SEQ ID NO: 93895 - DNA, 20 bp, human
gggtcactatgtggccctgg

SEQ ID NO: 93896 - DNA, 20 bp, human
ggctcgcgcctccccaactc

SEQ ID NO: 93897 - DNA, 20 bp, human
gagctttacccgagttgggg

SEQ ID NO: 93898 - DNA, 20 bp, human
gggagccgcgagccctcacc

SEQ ID NO: 93899 - DNA, 20 bp, human
ggaatgggcggcgggcatcg

SEQ ID NO: 93900 - DNA, 20 bp, human
gcaactcgggtaaagctcct

SEQ ID NO: 93901 - DNA, 20 bp, human
gcgcgggcagttaccagctt

SEQ ID NO: 93902 - DNA, 20 bp, human
ggcggaggcgcagcacgccg

SEQ ID NO: 93903 - DNA, 20 bp, human
gggtgtcccggcggagagac

SEQ ID NO: 93904 - DNA, 20 bp, human
gaggcgcgagcagccaaagc

SEQ ID NO: 93905 - DNA, 20 bp, human
ggcgtggagacggcgaagag

SEQ ID NO: 93906 - DNA, 20 bp, human
gccagttggagttgcggcgg

SEQ ID NO: 93907 - DNA, 20 bp, human
gttccgcggcgtgtacggcc

SEQ ID NO: 93908 - DNA, 20 bp, human
gggtccactgccgggtggag

SEQ ID NO: 93909 - DNA, 20 bp, human
ggtgtggcggtgaggttcag

SEQ ID NO: 93910 - DNA, 20 bp, human
gcactctaggaagctatggg

SEQ ID NO: 93911 - DNA, 20 bp, human
gtgcggcggcgggaacgatt

SEQ ID NO: 93912 - DNA, 20 bp, human
gtgggaggtgaggcccgtag

SEQ ID NO: 93913 - DNA, 20 bp, human
gcgccccaattgctaggata

SEQ ID NO: 93914 - DNA, 20 bp, human
gtcccatatggacctcctaa

SEQ ID NO: 93915 - DNA, 20 bp, human
gtaggagagcaggagtgtag

SEQ ID NO: 93916 - DNA, 20 bp, human
gcgtcctgatcagaagtcat

SEQ ID NO: 93917 - DNA, 20 bp, human
ggaagtgtaatgctaacctc

SEQ ID NO: 93918 - DNA, 20 bp, human
gcagaagtcatgggctccac

SEQ ID NO: 93919 - DNA, 20 bp, human
ggagttctaaacaggaacac

SEQ ID NO: 93920 - DNA, 20 bp, human
gacttctgatcaggacgcta

SEQ ID NO: 93921 - DNA, 20 bp, human
gccgcagacgcagagagtcc

SEQ ID NO: 93922 - DNA, 20 bp, human
gacctcaggatgctgtaaaa

SEQ ID NO: 93923 - DNA, 20 bp, human
gaggacagcgctcatctggt

SEQ ID NO: 93924 - DNA, 20 bp, human
ggagcccatgacttctgatc

SEQ ID NO: 93925 - DNA, 20 bp, human
ggatcaggacgctaaggttg

SEQ ID NO: 93926 - DNA, 20 bp, human
gagtcagaaccggcccgtgg

SEQ ID NO: 93927 - DNA, 20 bp, human
ggccatggctcgcgggactg

SEQ ID NO: 93928 - DNA, 20 bp, human
gctgcgcgcgacaactcctc

SEQ ID NO: 93929 - DNA, 20 bp, human
gagccctgggagcctcggtt

SEQ ID NO: 93930 - DNA, 20 bp, human
gccttgcggcgtgaggaccc

SEQ ID NO: 93931 - DNA, 20 bp, human
gggcagcgactgcgacgagg

SEQ ID NO: 93932 - DNA, 20 bp, human
gctggcggccgggatctgag

SEQ ID NO: 93933 - DNA, 20 bp, human
gcccggagctgcttccccgg

SEQ ID NO: 93934 - DNA, 20 bp, human
gacaactcctcgggcagagg

SEQ ID NO: 93935 - DNA, 20 bp, human
gcgcccaaccgaggctccca

SEQ ID NO: 93936 - DNA, 20 bp, human
gggcccggcgtggggaggtt

SEQ ID NO: 93937 - DNA, 20 bp, human
ggggcgcgcccggcctatga

SEQ ID NO: 93938 - DNA, 20 bp, human
gaaccgagactatcaggatc

SEQ ID NO: 93939 - DNA, 20 bp, human
gcggagacggaaatgtccga

SEQ ID NO: 93940 - DNA, 20 bp, human
gcggcgtccttgcggaagta

SEQ ID NO: 93941 - DNA, 20 bp, human
gagctccaatctgcgaaata

SEQ ID NO: 93942 - DNA, 20 bp, human
ggcgcacgcgcaaaagtctt

SEQ ID NO: 93943 - DNA, 20 bp, human
gaatacagggtcaagtactg

SEQ ID NO: 93944 - DNA, 20 bp, human
ggaaagtaaccgagactatc

SEQ ID NO: 93945 - DNA, 20 bp, human
gtccgcaaggacgccgtcat

SEQ ID NO: 93946 - DNA, 20 bp, human
gcggactggccagtctctag

SEQ ID NO: 93947 - DNA, 20 bp, human
gaccctggcgacctccacaa

SEQ ID NO: 93948 - DNA, 20 bp, human
gtggcatccccgagagggag

SEQ ID NO: 93949 - DNA, 20 bp, human
ggaggcctggcatccccgag

SEQ ID NO: 93950 - DNA, 20 bp, human
gacctgctgaggcaatcatc

SEQ ID NO: 93951 - DNA, 20 bp, human
ggcgtgtgctttagtttcgt

SEQ ID NO: 93952 - DNA, 20 bp, human
gggcgacctccacaaaggag

SEQ ID NO: 93953 - DNA, 20 bp, human
gatggagagcccctagagac

SEQ ID NO: 93954 - DNA, 20 bp, human
gcggctgggcggtgcaatgg

SEQ ID NO: 93955 - DNA, 20 bp, human
ggagcgagaagaatccgcag

SEQ ID NO: 93956 - DNA, 20 bp, human
gcccggcagtgctcgcctaa

SEQ ID NO: 93957 - DNA, 20 bp, human
gcgacacagacagacggggg

SEQ ID NO: 93958 - DNA, 20 bp, human
gctgccgggccacggaccat

SEQ ID NO: 93959 - DNA, 20 bp, human
gcgacctgtgggccccagag

SEQ ID NO: 93960 - DNA, 20 bp, human
gggcagtgctcgcctaaagg

SEQ ID NO: 93961 - DNA, 20 bp, human
gcgcctaaaggtggagaacg

SEQ ID NO: 93962 - DNA, 20 bp, human
gggtccaaacccctagtccg

SEQ ID NO: 93963 - DNA, 20 bp, human
gtggcggcgcccatggtccg

SEQ ID NO: 93964 - DNA, 20 bp, human
gcaagggatgaccttcaact

SEQ ID NO: 93965 - DNA, 20 bp, human
ggagcaaagatctggggtag

SEQ ID NO: 93966 - DNA, 20 bp, human
gacatactgagctcaacaac

SEQ ID NO: 93967 - DNA, 20 bp, human
gcggtggcggttcggagtga

SEQ ID NO: 93968 - DNA, 20 bp, human
gagtatgtcgtgggaatccg

SEQ ID NO: 93969 - DNA, 20 bp, human
ggccaggtctaggttcccag

SEQ ID NO: 93970 - DNA, 20 bp, human
gaggcgacttaggggaagac

SEQ ID NO: 93971 - DNA, 20 bp, human
ggttgagctcagtatgtcgt

SEQ ID NO: 93972 - DNA, 20 bp, human
gacgggattagcgcaagaga

SEQ ID NO: 93973 - DNA, 20 bp, human
gcgatgccgtgggccgagag

SEQ ID NO: 93974 - DNA, 20 bp, human
gcacacgagatccatcccct

SEQ ID NO: 93975 - DNA, 20 bp, human
gtgacgaccataagttgcag

SEQ ID NO: 93976 - DNA, 20 bp, human
ggccgcggctgcaactacac

SEQ ID NO: 93977 - DNA, 20 bp, human
gactacacaggcagcagcga

SEQ ID NO: 93978 - DNA, 20 bp, human
gccgcagtgctccgaatcca

SEQ ID NO: 93979 - DNA, 20 bp, human
ggtcccggggttgggaggac

SEQ ID NO: 93980 - DNA, 20 bp, human
gctcccgccagctcgcctcg

SEQ ID NO: 93981 - DNA, 20 bp, human
ggcgggaagtccacgcgtag

SEQ ID NO: 93982 - DNA, 20 bp, human
gacgcgcgtcctgttccccg

SEQ ID NO: 93983 - DNA, 20 bp, human
gggataaggcggcaaagacc

SEQ ID NO: 93984 - DNA, 20 bp, human
ggcgctctccgggcgacgtg

SEQ ID NO: 93985 - DNA, 20 bp, human
gtgggatcgcggggataagg

SEQ ID NO: 93986 - DNA, 20 bp, human
ggcacccctaggcccctcaa

SEQ ID NO: 93987 - DNA, 20 bp, human
ggggcctgggctgaagtcgg

SEQ ID NO: 93988 - DNA, 20 bp, human
gaggtagggctgggacgcag

SEQ ID NO: 93989 - DNA, 20 bp, human
gctcccagggtggtcagacc

SEQ ID NO: 93990 - DNA, 20 bp, human
gagaggcgctgggatcagga

SEQ ID NO: 93991 - DNA, 20 bp, human
gcaggtgagtgggaaactgg

SEQ ID NO: 93992 - DNA, 20 bp, human
gggccctggtctgaccaccc

SEQ ID NO: 93993 - DNA, 20 bp, human
gcgccgaggaggggcaggta

SEQ ID NO: 93994 - DNA, 20 bp, human
gcagggcccagggacaccga

SEQ ID NO: 93995 - DNA, 20 bp, human
gacagagccaggacagacac

SEQ ID NO: 93996 - DNA, 20 bp, human
gggactgtaaccccctacac

SEQ ID NO: 93997 - DNA, 20 bp, human
gggtgtgcgggctcaggatg

SEQ ID NO: 93998 - DNA, 20 bp, human
gtggccgagagccaaaacag

SEQ ID NO: 93999 - DNA, 20 bp, human
gtgaggactgaggcacccct

SEQ ID NO: 94000 - DNA, 20 bp, human
gagtccagggttcctcacca

SEQ ID NO: 94001 - DNA, 20 bp, human
gaggcttacctgagagtcca

SEQ ID NO: 94002 - DNA, 20 bp, human
gactgaggcacccctgggaa

SEQ ID NO: 94003 - DNA, 20 bp, human
gggctacacaggctggacag

SEQ ID NO: 94004 - DNA, 20 bp, human
gctggtgccagggtgagagt

SEQ ID NO: 94005 - DNA, 20 bp, human
gcggccgtggtgaggaaccc

SEQ ID NO: 94006 - DNA, 20 bp, human
ggcggtggcctggtgttaag

SEQ ID NO: 94007 - DNA, 20 bp, human
gtccgaggccgaaaagcctg

SEQ ID NO: 94008 - DNA, 20 bp, human
ggtggaaggcaaaatggcgg

SEQ ID NO: 94009 - DNA, 20 bp, human
gcagccccggacctacctgg

SEQ ID NO: 94010 - DNA, 20 bp, human
gaacctgcagcggagtgcgg

SEQ ID NO: 94011 - DNA, 20 bp, human
gggaaacctgcagcggagtg

SEQ ID NO: 94012 - DNA, 20 bp, human
gcccaggggtcgtgaggacc

SEQ ID NO: 94013 - DNA, 20 bp, human
ggccagcgcggcccgtccca

SEQ ID NO: 94014 - DNA, 20 bp, human
gagccaagtcaggcccggag

SEQ ID NO: 94015 - DNA, 20 bp, human
gccgccaactcgagcactgg

SEQ ID NO: 94016 - DNA, 20 bp, human
gccaaagcgcagacccaagt

SEQ ID NO: 94017 - DNA, 20 bp, human
gcggtcgccgcacaacaaag

SEQ ID NO: 94018 - DNA, 20 bp, human
gcagggcgcagggctccgtc

SEQ ID NO: 94019 - DNA, 20 bp, human
ggctcgtagtccaggccgta

SEQ ID NO: 94020 - DNA, 20 bp, human
gcggctccgcgggctccgta

SEQ ID NO: 94021 - DNA, 20 bp, human
gcccgcggagccggttccag

SEQ ID NO: 94022 - DNA, 20 bp, human
gcgactgctccatcttcccg

SEQ ID NO: 94023 - DNA, 20 bp, human
gactacgagccgccgggcgg

SEQ ID NO: 94024 - DNA, 20 bp, human
gcgccggcctccaacttccc

SEQ ID NO: 94025 - DNA, 20 bp, human
ggcgcggtctacaccctcgg

SEQ ID NO: 94026 - DNA, 20 bp, human
gctgccaagaggctcaagag

SEQ ID NO: 94027 - DNA, 20 bp, human
gagagggggaaactgccaag

SEQ ID NO: 94028 - DNA, 20 bp, human
gacaggtgagtgactcaggg

SEQ ID NO: 94029 - DNA, 20 bp, human
gaaggaagacgagcttctca

SEQ ID NO: 94030 - DNA, 20 bp, human
gtggacaggtgagtgactca

SEQ ID NO: 94031 - DNA, 20 bp, human
gcagaggtagacacgagata

SEQ ID NO: 94032 - DNA, 20 bp, human
gaggttcctgatacaatgga

SEQ ID NO: 94033 - DNA, 20 bp, human
gtgcagagtgctggactcca

SEQ ID NO: 94034 - DNA, 20 bp, human
gtttctggtggaaacgtgag

SEQ ID NO: 94035 - DNA, 20 bp, human
gacaatcagagggaggacct

SEQ ID NO: 94036 - DNA, 20 bp, human
gtgcgcgacaactgcaaccg

SEQ ID NO: 94037 - DNA, 20 bp, human
gggccaccgacggaccgcac

SEQ ID NO: 94038 - DNA, 20 bp, human
ggaacgcaagagactccgaa

SEQ ID NO: 94039 - DNA, 20 bp, human
gtacgtggcgacccagaaga

SEQ ID NO: 94040 - DNA, 20 bp, human
ggcggggcggcaaaagaggt

SEQ ID NO: 94041 - DNA, 20 bp, human
gagcatctctaggccaccga

SEQ ID NO: 94042 - DNA, 20 bp, human
gggagaatgtaggagaggtg

SEQ ID NO: 94043 - DNA, 20 bp, human
gcgacactcgggcgctacgg

SEQ ID NO: 94044 - DNA, 20 bp, human
gcaccgacggaccgcacggg

SEQ ID NO: 94045 - DNA, 20 bp, human
gcaaccccgcagaagagacg

SEQ ID NO: 94046 - DNA, 20 bp, human
ggccccacggctagcgacgt

SEQ ID NO: 94047 - DNA, 20 bp, human
ggctagcgacgtcggcaagg

SEQ ID NO: 94048 - DNA, 20 bp, human
gggagccctcacctaagtga

SEQ ID NO: 94049 - DNA, 20 bp, human
gccggccgtcacttaggtga

SEQ ID NO: 94050 - DNA, 20 bp, human
gcgtgcaggagtcaacgtca

SEQ ID NO: 94051 - DNA, 20 bp, human
gacggctagcgacgtcggca

SEQ ID NO: 94052 - DNA, 20 bp, human
ggctgtcctgggaaggcgga

SEQ ID NO: 94053 - DNA, 20 bp, human
gatatagacatgaagtccta

SEQ ID NO: 94054 - DNA, 20 bp, human
gaaccctccggccgtcactt

SEQ ID NO: 94055 - DNA, 20 bp, human
ggtcaacgtcaaggttgcaa

SEQ ID NO: 94056 - DNA, 20 bp, human
gagccacctgacccagaagg

SEQ ID NO: 94057 - DNA, 20 bp, human
gccagagcagcctggagcgt

SEQ ID NO: 94058 - DNA, 20 bp, human
gagaccggaccctctccctg

SEQ ID NO: 94059 - DNA, 20 bp, human
gagaaggtggcactgcccca

SEQ ID NO: 94060 - DNA, 20 bp, human
ggggaatcggtactgagatg

SEQ ID NO: 94061 - DNA, 20 bp, human
ggccctgccgtccatactgc

SEQ ID NO: 94062 - DNA, 20 bp, human
gagcagcaatgccagcagta

SEQ ID NO: 94063 - DNA, 20 bp, human
gatcggtactgagatgagga

SEQ ID NO: 94064 - DNA, 20 bp, human
gtcgccaggatcaccgacaa

SEQ ID NO: 94065 - DNA, 20 bp, human
gctgcttacgtccaccccag

SEQ ID NO: 94066 - DNA, 20 bp, human
gtagtcgcacagcaacccgg

SEQ ID NO: 94067 - DNA, 20 bp, human
ggccgcgccgccaacatgga

SEQ ID NO: 94068 - DNA, 20 bp, human
ggaatagtcgcacagcaacc

SEQ ID NO: 94069 - DNA, 20 bp, human
ggcgcggcgcggctgtggag

SEQ ID NO: 94070 - DNA, 20 bp, human
ggttccggcggtgacacgga

SEQ ID NO: 94071 - DNA, 20 bp, human
ggtcagacgggcgctcggag

SEQ ID NO: 94072 - DNA, 20 bp, human
gcggcgcggctgtggagcgg

SEQ ID NO: 94073 - DNA, 20 bp, human
gccgggagccaggctgcggt

SEQ ID NO: 94074 - DNA, 20 bp, human
gcacctgcgccaggttccgg

SEQ ID NO: 94075 - DNA, 20 bp, human
gccacgcgcgcgacgctacc

SEQ ID NO: 94076 - DNA, 20 bp, human
gtggggcttccagcaatccg

SEQ ID NO: 94077 - DNA, 20 bp, human
gcgggaagagggcgctgacg

SEQ ID NO: 94078 - DNA, 20 bp, human
gtgttggagttggcaggcgg

SEQ ID NO: 94079 - DNA, 20 bp, human
gccggccgggaccccgaaca

SEQ ID NO: 94080 - DNA, 20 bp, human
ggcccgcgccctgcccagtg

SEQ ID NO: 94081 - DNA, 20 bp, human
gttagcgcggcggctgagga

SEQ ID NO: 94082 - DNA, 20 bp, human
ggtgtcaggtggctcggcag

SEQ ID NO: 94083 - DNA, 20 bp, human
gggatgtcctcgatgctgaa

SEQ ID NO: 94084 - DNA, 20 bp, human
gtgaggaggggagaacagcg

SEQ ID NO: 94085 - DNA, 20 bp, human
ggcggggccgattagcgcgg

SEQ ID NO: 94086 - DNA, 20 bp, human
gtgcactgcgtctcccaagg

SEQ ID NO: 94087 - DNA, 20 bp, human
gcccatagacccgggacgag

SEQ ID NO: 94088 - DNA, 20 bp, human
gggccagcttcagccacctt

SEQ ID NO: 94089 - DNA, 20 bp, human
gtggcggcaggaccacccca

SEQ ID NO: 94090 - DNA, 20 bp, human
gagctgcactgcgtctccca

SEQ ID NO: 94091 - DNA, 20 bp, human
gtggtcttgtctgtcagcag

SEQ ID NO: 94092 - DNA, 20 bp, human
ggcctggccagtctttccca

SEQ ID NO: 94093 - DNA, 20 bp, human
gggaatggacccatagaccc

SEQ ID NO: 94094 - DNA, 20 bp, human
gctttggcacagaggaggac

SEQ ID NO: 94095 - DNA, 20 bp, human
gcaaaggcgggagcaaatcc

SEQ ID NO: 94096 - DNA, 20 bp, human
ggtggcagcggcggtaacct

SEQ ID NO: 94097 - DNA, 20 bp, human
gggcgaggatcggggctcct

SEQ ID NO: 94098 - DNA, 20 bp, human
gctgggctccagggtaacgg

SEQ ID NO: 94099 - DNA, 20 bp, human
ggggacagaggcgaggatcg

SEQ ID NO: 94100 - DNA, 20 bp, human
gggcggtaacctgggctcca

SEQ ID NO: 94101 - DNA, 20 bp, human
ggcgaggagaaggaagacct

SEQ ID NO: 94102 - DNA, 20 bp, human
ggttaccgccgctgccaccc

SEQ ID NO: 94103 - DNA, 20 bp, human
gagagggtcccgaggaaggg

SEQ ID NO: 94104 - DNA, 20 bp, human
gtgctgaagagcctgcgggt

SEQ ID NO: 94105 - DNA, 20 bp, human
gccgaggaagggaggttgac

SEQ ID NO: 94106 - DNA, 20 bp, human
gaacagcgcggagcaggtaa

SEQ ID NO: 94107 - DNA, 20 bp, human
gcgcagtcgtgggaacagcg

SEQ ID NO: 94108 - DNA, 20 bp, human
gaaccggctgagggggacga

SEQ ID NO: 94109 - DNA, 20 bp, human
ggcggcgttggcgcagtcgt

SEQ ID NO: 94110 - DNA, 20 bp, human
gcagagctggggctgtaaca

SEQ ID NO: 94111 - DNA, 20 bp, human
gtaagcagaggcaaaatcgg

SEQ ID NO: 94112 - DNA, 20 bp, human
gacagggtaaccggctgagg

SEQ ID NO: 94113 - DNA, 20 bp, human
gccccaaagttccctcggtg

SEQ ID NO: 94114 - DNA, 20 bp, human
ggtagcaggagggtccggaa

SEQ ID NO: 94115 - DNA, 20 bp, human
gccgcgcgcgggtttccatg

SEQ ID NO: 94116 - DNA, 20 bp, human
gtctctggcagtaggcacca

SEQ ID NO: 94117 - DNA, 20 bp, human
gttgaggagccagaaggggg

SEQ ID NO: 94118 - DNA, 20 bp, human
gcttggcccagagtctggtg

SEQ ID NO: 94119 - DNA, 20 bp, human
gcagttgtctaacccagggg

SEQ ID NO: 94120 - DNA, 20 bp, human
gtgcctactgccagagaaag

SEQ ID NO: 94121 - DNA, 20 bp, human
gcccggctccccatggcagt

SEQ ID NO: 94122 - DNA, 20 bp, human
gccagaagggggcggcagga

SEQ ID NO: 94123 - DNA, 20 bp, human
ggctggggcatcacaagctg

SEQ ID NO: 94124 - DNA, 20 bp, human
gcagcgtcacccactgccat

SEQ ID NO: 94125 - DNA, 20 bp, human
gcggggggaagagcacattg

SEQ ID NO: 94126 - DNA, 20 bp, human
gcagagggatgcccagacca

SEQ ID NO: 94127 - DNA, 20 bp, human
gaatggagaccggagaccag

SEQ ID NO: 94128 - DNA, 20 bp, human
gggacgcttaccgaggtcac

SEQ ID NO: 94129 - DNA, 20 bp, human
gtcccagtggacgcttaccg

SEQ ID NO: 94130 - DNA, 20 bp, human
gggagtgagttagtcatgag

SEQ ID NO: 94131 - DNA, 20 bp, human
ggtaagcgtccactgggaaa

SEQ ID NO: 94132 - DNA, 20 bp, human
gcactcctgatgaaggtgta

SEQ ID NO: 94133 - DNA, 20 bp, human
gggagcaggggttccacaga

SEQ ID NO: 94134 - DNA, 20 bp, human
gactaactcactcctgatga

SEQ ID NO: 94135 - DNA, 20 bp, human
gtgataaacacagagataca

SEQ ID NO: 94136 - DNA, 20 bp, human
ggcaagttagacccaggtag

SEQ ID NO: 94137 - DNA, 20 bp, human
gacccaggtagaggccaccc

SEQ ID NO: 94138 - DNA, 20 bp, human
gcagacagcaagttagaccc

SEQ ID NO: 94139 - DNA, 20 bp, human
gaaagggcaagaataggccg

SEQ ID NO: 94140 - DNA, 20 bp, human
ggggcaagaataggccgggg

SEQ ID NO: 94141 - DNA, 20 bp, human
ggccggggtggcctctacct

SEQ ID NO: 94142 - DNA, 20 bp, human
gggaaacagtcattctctct

SEQ ID NO: 94143 - DNA, 20 bp, human
gagcattaggttcaaaacag

SEQ ID NO: 94144 - DNA, 20 bp, human
gtctagattaccttgttgta

SEQ ID NO: 94145 - DNA, 20 bp, human
gagcagttcatcaaaatgta

SEQ ID NO: 94146 - DNA, 20 bp, human
ggaacacttaccggggtcac

SEQ ID NO: 94147 - DNA, 20 bp, human
ggtggagtagagataattaa

SEQ ID NO: 94148 - DNA, 20 bp, human
gtctcaaagaacacttaccg

SEQ ID NO: 94149 - DNA, 20 bp, human
gtccatccactcacctcccg

SEQ ID NO: 94150 - DNA, 20 bp, human
ggaaggaggatgtgctcagg

SEQ ID NO: 94151 - DNA, 20 bp, human
gtctttgagaatagttgctg

SEQ ID NO: 94152 - DNA, 20 bp, human
gacagagggagttgaagccc

SEQ ID NO: 94153 - DNA, 20 bp, human
gataattaatggatctttta

SEQ ID NO: 94154 - DNA, 20 bp, human
gcttatctctagattcaaat

SEQ ID NO: 94155 - DNA, 20 bp, human
gtagcagagtctatttgcct

SEQ ID NO: 94156 - DNA, 20 bp, human
gctgttcttaccggagtcac

SEQ ID NO: 94157 - DNA, 20 bp, human
ggctagggccatgttgtcag

SEQ ID NO: 94158 - DNA, 20 bp, human
gaccctgtctctgcctgcaa

SEQ ID NO: 94159 - DNA, 20 bp, human
ggacagggttgtatcttcag

SEQ ID NO: 94160 - DNA, 20 bp, human
gggtgtgtcctaaccaagct

SEQ ID NO: 94161 - DNA, 20 bp, human
ggggatgctcagaacagagc

SEQ ID NO: 94162 - DNA, 20 bp, human
gcatgggactaaagactctt

SEQ ID NO: 94163 - DNA, 20 bp, human
gactccggtaagaacagagc

SEQ ID NO: 94164 - DNA, 20 bp, human
gtgtttcctctagagttcaa

SEQ ID NO: 94165 - DNA, 20 bp, human
gaggtgggcttccctcctgt

SEQ ID NO: 94166 - DNA, 20 bp, human
gggacacataccaaagtcac

SEQ ID NO: 94167 - DNA, 20 bp, human
ggagctggagccatggacag

SEQ ID NO: 94168 - DNA, 20 bp, human
ggcatggtgagtctcaggtt

SEQ ID NO: 94169 - DNA, 20 bp, human
gcctcaggaagtgagtgaat

SEQ ID NO: 94170 - DNA, 20 bp, human
gcccagacccataaaagtgt

SEQ ID NO: 94171 - DNA, 20 bp, human
gggagcagtcctctcaggat

SEQ ID NO: 94172 - DNA, 20 bp, human
ggcctctggtcccctgtcca

SEQ ID NO: 94173 - DNA, 20 bp, human
ggaagcaggggattccacag

SEQ ID NO: 94174 - DNA, 20 bp, human
ggtcggttccataagcccaa

SEQ ID NO: 94175 - DNA, 20 bp, human
gcccctgcttctgttcccag

SEQ ID NO: 94176 - DNA, 20 bp, human
gggcgcacagatggaatcag

SEQ ID NO: 94177 - DNA, 20 bp, human
gagcagctggagcccgctga

SEQ ID NO: 94178 - DNA, 20 bp, human
gggacctacgccgtctgtgg

SEQ ID NO: 94179 - DNA, 20 bp, human
gtggggggcacttcggtgtg

SEQ ID NO: 94180 - DNA, 20 bp, human
gtaggtcggaggaatcttcc

SEQ ID NO: 94181 - DNA, 20 bp, human
ggagccaccacagacggcgt

SEQ ID NO: 94182 - DNA, 20 bp, human
gagcaacacagtcagtccca

SEQ ID NO: 94183 - DNA, 20 bp, human
ggtgggacctacgccgtctg

SEQ ID NO: 94184 - DNA, 20 bp, human
gcccaggccaggcgcacaga

SEQ ID NO: 94185 - DNA, 20 bp, human
ggctccagctgctgcggagg

SEQ ID NO: 94186 - DNA, 20 bp, human
gcaggggaatgggaagatta

SEQ ID NO: 94187 - DNA, 20 bp, human
gtaggctcaggcttggctct

SEQ ID NO: 94188 - DNA, 20 bp, human
gatatgtcttttataggctc

SEQ ID NO: 94189 - DNA, 20 bp, human
gtcaaaaatggatactttgt

SEQ ID NO: 94190 - DNA, 20 bp, human
gggagcacagacacgtcctg

SEQ ID NO: 94191 - DNA, 20 bp, human
gtggcaacctgggagccaga

SEQ ID NO: 94192 - DNA, 20 bp, human
gccagagggcacaggggaat

SEQ ID NO: 94193 - DNA, 20 bp, human
gcatctgctctgacttcccc

SEQ ID NO: 94194 - DNA, 20 bp, human
ggtcagagcagatgaggtgc

SEQ ID NO: 94195 - DNA, 20 bp, human
gtatctgacagtttcatcaa

SEQ ID NO: 94196 - DNA, 20 bp, human
gggcctaccggaggtcgtat

SEQ ID NO: 94197 - DNA, 20 bp, human
gaggctgtgaggcctaccgg

SEQ ID NO: 94198 - DNA, 20 bp, human
gaccggaggtcgtataggtg

SEQ ID NO: 94199 - DNA, 20 bp, human
gtgttgcaggacacaccagg

SEQ ID NO: 94200 - DNA, 20 bp, human
gcaacacgcagctggtcctt

SEQ ID NO: 94201 - DNA, 20 bp, human
ggcgtgttgcaggacacacc

SEQ ID NO: 94202 - DNA, 20 bp, human
gctttttccagaggacctcc

SEQ ID NO: 94203 - DNA, 20 bp, human
gtccccacctatacgacctc

SEQ ID NO: 94204 - DNA, 20 bp, human
gcttgtgttctgccatactg

SEQ ID NO: 94205 - DNA, 20 bp, human
ggtgtcctgcaacacgcagc

SEQ ID NO: 94206 - DNA, 20 bp, human
gggcctaccggagctcatat

SEQ ID NO: 94207 - DNA, 20 bp, human
ggtgttgcaggacataccaa

SEQ ID NO: 94208 - DNA, 20 bp, human
gaccggagctcatataggtg

SEQ ID NO: 94209 - DNA, 20 bp, human
gcaagccctaaggacaagct

SEQ ID NO: 94210 - DNA, 20 bp, human
ggacataccaaggggtcctc

SEQ ID NO: 94211 - DNA, 20 bp, human
gcaacacccagcttgtcctt

SEQ ID NO: 94212 - DNA, 20 bp, human
gtccccacctatatgagctc

SEQ ID NO: 94213 - DNA, 20 bp, human
gttaaaggaataggtacttc

SEQ ID NO: 94214 - DNA, 20 bp, human
ggcctcaacagattcgaggc

SEQ ID NO: 94215 - DNA, 20 bp, human
gtattttccagaggacccct

SEQ ID NO: 94216 - DNA, 20 bp, human
gggcctaccggagctcatat

SEQ ID NO: 94217 - DNA, 20 bp, human
ggtgttgcaggacataccaa

SEQ ID NO: 94218 - DNA, 20 bp, human
gaccggagctcatataggtg

SEQ ID NO: 94219 - DNA, 20 bp, human
gcaagccctaaggacaagct

SEQ ID NO: 94220 - DNA, 20 bp, human
ggacataccaaggggtcctc

SEQ ID NO: 94221 - DNA, 20 bp, human
gcaacacccagcttgtcctt

SEQ ID NO: 94222 - DNA, 20 bp, human
gtccccacctatatgagctc

SEQ ID NO: 94223 - DNA, 20 bp, human
gttaaaggaataggtacttc

SEQ ID NO: 94224 - DNA, 20 bp, human
ggcctcaacagattcgaggc

SEQ ID NO: 94225 - DNA, 20 bp, human
gtattttccagaggacccct

SEQ ID NO: 94226 - DNA, 20 bp, human
gagacagagttgggaaagat

SEQ ID NO: 94227 - DNA, 20 bp, human
gcaagccccagcgcccagat

SEQ ID NO: 94228 - DNA, 20 bp, human
gtaccagaagggtattagca

SEQ ID NO: 94229 - DNA, 20 bp, human
gaagggtattagcaaggtag

SEQ ID NO: 94230 - DNA, 20 bp, human
gagacacaccagggatcctc

SEQ ID NO: 94231 - DNA, 20 bp, human
ggtgcttttgcatgtgacca

SEQ ID NO: 94232 - DNA, 20 bp, human
ggggcttgtattaagagaac

SEQ ID NO: 94233 - DNA, 20 bp, human
gatcccagcttccctctgaa

SEQ ID NO: 94234 - DNA, 20 bp, human
gtgctggagctcacgtagaa

SEQ ID NO: 94235 - DNA, 20 bp, human
gtgggtgctgtagacacacc

SEQ ID NO: 94236 - DNA, 20 bp, human
ggcagcagcccgcagaactg

SEQ ID NO: 94237 - DNA, 20 bp, human
gccagcaggataaatcccct

SEQ ID NO: 94238 - DNA, 20 bp, human
gacggcaacggtgagacctg

SEQ ID NO: 94239 - DNA, 20 bp, human
gctgtgctgggctctttgca

SEQ ID NO: 94240 - DNA, 20 bp, human
gggagctctggcaacggcaa

SEQ ID NO: 94241 - DNA, 20 bp, human
ggcaaagaagcaccaggcta

SEQ ID NO: 94242 - DNA, 20 bp, human
ggagtacttgaaactcatca

SEQ ID NO: 94243 - DNA, 20 bp, human
ggacatctaggcaggaggtc

SEQ ID NO: 94244 - DNA, 20 bp, human
gtcagtaggaaagaggagac

SEQ ID NO: 94245 - DNA, 20 bp, human
ggctgtggccacagttctgc

SEQ ID NO: 94246 - DNA, 20 bp, human
ggagccatagccacagtcgg

SEQ ID NO: 94247 - DNA, 20 bp, human
gacgatcttggaaaacacat

SEQ ID NO: 94248 - DNA, 20 bp, human
gatcttggaaaacacatggg

SEQ ID NO: 94249 - DNA, 20 bp, human
gccagagccatagccacagt

SEQ ID NO: 94250 - DNA, 20 bp, human
gcaccacagcacccaggtct

SEQ ID NO: 94251 - DNA, 20 bp, human
gataacattgtcaggaggaa

SEQ ID NO: 94252 - DNA, 20 bp, human
ggaggcagtggtcagcaaga

SEQ ID NO: 94253 - DNA, 20 bp, human
gaagatggtgcctccgactg

SEQ ID NO: 94254 - DNA, 20 bp, human
ggtgcctccgactgtggcta

SEQ ID NO: 94255 - DNA, 20 bp, human
gccaggtcttggagcacagc

SEQ ID NO: 94256 - DNA, 20 bp, human
gcaccagatgcagaggaggt

SEQ ID NO: 94257 - DNA, 20 bp, human
gggccactcaccagatgcag

SEQ ID NO: 94258 - DNA, 20 bp, human
gtctcatccacagcatcctt

SEQ ID NO: 94259 - DNA, 20 bp, human
gtagaaagtggcttcatcaa

SEQ ID NO: 94260 - DNA, 20 bp, human
gagaatgtgaaggaatccta

SEQ ID NO: 94261 - DNA, 20 bp, human
gcagatcttggcttagaaag

SEQ ID NO: 94262 - DNA, 20 bp, human
ggcaaaacccgcaggacctt

SEQ ID NO: 94263 - DNA, 20 bp, human
ggctccaaacaagaatgtga

SEQ ID NO: 94264 - DNA, 20 bp, human
gtcctcagctgggagtgttt

SEQ ID NO: 94265 - DNA, 20 bp, human
ggagaggcccagaactgaaa

SEQ ID NO: 94266 - DNA, 20 bp, human
gacggtggatgaggagccca

SEQ ID NO: 94267 - DNA, 20 bp, human
gtgagtgtccagcaggggat

SEQ ID NO: 94268 - DNA, 20 bp, human
ggcagagagggtaccaatgt

SEQ ID NO: 94269 - DNA, 20 bp, human
gtctggagaatggagatcat

SEQ ID NO: 94270 - DNA, 20 bp, human
gcctgaggagacggtggatg

SEQ ID NO: 94271 - DNA, 20 bp, human
gatgttggaacagaaaacta

SEQ ID NO: 94272 - DNA, 20 bp, human
gctggccccagttcccacat

SEQ ID NO: 94273 - DNA, 20 bp, human
gtacattcctagaggctctt

SEQ ID NO: 94274 - DNA, 20 bp, human
gggtaccaatgtgggaactg

SEQ ID NO: 94275 - DNA, 20 bp, human
gctaaggtcatagcaggaga

SEQ ID NO: 94276 - DNA, 20 bp, human
gcctggtaagtattcagcag

SEQ ID NO: 94277 - DNA, 20 bp, human
gaggggacagggcttgatat

SEQ ID NO: 94278 - DNA, 20 bp, human
gctgaggcaagagctgcaag

SEQ ID NO: 94279 - DNA, 20 bp, human
gttaccaggtgcagagaggc

SEQ ID NO: 94280 - DNA, 20 bp, human
gcaaaagggtgcattcccta

SEQ ID NO: 94281 - DNA, 20 bp, human
ggcattccctaggggttctt

SEQ ID NO: 94282 - DNA, 20 bp, human
ggaaacaaagacccagatac

SEQ ID NO: 94283 - DNA, 20 bp, human
gtctgtagaatggatgttac

SEQ ID NO: 94284 - DNA, 20 bp, human
ggtttctccaaagaacccct

SEQ ID NO: 94285 - DNA, 20 bp, human
ggaaaaagaattctgtagaa

SEQ ID NO: 94286 - DNA, 20 bp, human
gacttggggataggacactt

SEQ ID NO: 94287 - DNA, 20 bp, human
ggggataggacacttgggag

SEQ ID NO: 94288 - DNA, 20 bp, human
gaattgatggggctacagaa

SEQ ID NO: 94289 - DNA, 20 bp, human
ggtgaaggaggtaaaacacc

SEQ ID NO: 94290 - DNA, 20 bp, human
ggctccaattgctatggcag

SEQ ID NO: 94291 - DNA, 20 bp, human
gcatagcaattggagctctt

SEQ ID NO: 94292 - DNA, 20 bp, human
gcagcaccaaaggaattagt

SEQ ID NO: 94293 - DNA, 20 bp, human
gattggagctcttgggtctg

SEQ ID NO: 94294 - DNA, 20 bp, human
gcatgtttattcaattgatg

SEQ ID NO: 94295 - DNA, 20 bp, human
ggctgttgctgacctggacc

SEQ ID NO: 94296 - DNA, 20 bp, human
gggaccagcaggccaaccat

SEQ ID NO: 94297 - DNA, 20 bp, human
gaggaagagatgaaaccagg

SEQ ID NO: 94298 - DNA, 20 bp, human
gagtgccgaagaggctatct

SEQ ID NO: 94299 - DNA, 20 bp, human
gagcaggccaaccattggta

SEQ ID NO: 94300 - DNA, 20 bp, human
gctcaggaagagatgaaacc

SEQ ID NO: 94301 - DNA, 20 bp, human
ggaaggccagaagtagtagt

SEQ ID NO: 94302 - DNA, 20 bp, human
gtagcctcttcggcactagt

SEQ ID NO: 94303 - DNA, 20 bp, human
ggcttcccagatagcctctt

SEQ ID NO: 94304 - DNA, 20 bp, human
gtggctgttgcacaagtgtg

SEQ ID NO: 94305 - DNA, 20 bp, human
ggacaaagcaggaaccaacc

SEQ ID NO: 94306 - DNA, 20 bp, human
ggcactgcagcagatcactc

SEQ ID NO: 94307 - DNA, 20 bp, human
gtcaggagacaggtagactg

SEQ ID NO: 94308 - DNA, 20 bp, human
gtcctgagaagcactctacc

SEQ ID NO: 94309 - DNA, 20 bp, human
gtagagtgcttctcaggacc

SEQ ID NO: 94310 - DNA, 20 bp, human
ggaagcactctacctggttc

SEQ ID NO: 94311 - DNA, 20 bp, human
gcaggaccaggatgaactct

SEQ ID NO: 94312 - DNA, 20 bp, human
gagcagatcactcaggagac

SEQ ID NO: 94313 - DNA, 20 bp, human
gttgggcagaaagagcccct

SEQ ID NO: 94314 - DNA, 20 bp, human
gttactggtcttgggagact

SEQ ID NO: 94315 - DNA, 20 bp, human
gaaaatatggagttactagg

SEQ ID NO: 94316 - DNA, 20 bp, human
gtatcccaggaggagtctgg

SEQ ID NO: 94317 - DNA, 20 bp, human
ggtccacacatcttccacta

SEQ ID NO: 94318 - DNA, 20 bp, human
gcacatcttccactagggta

SEQ ID NO: 94319 - DNA, 20 bp, human
gagaagtagccttaccctag

SEQ ID NO: 94320 - DNA, 20 bp, human
gacttaaccaggtggacatt

SEQ ID NO: 94321 - DNA, 20 bp, human
gattagtaagtgagtcccct

SEQ ID NO: 94322 - DNA, 20 bp, human
gagtcagacttaggagtctg

SEQ ID NO: 94323 - DNA, 20 bp, human
ggtaaggctacttctggctg

SEQ ID NO: 94324 - DNA, 20 bp, human
gagatgggacagtcagactt

SEQ ID NO: 94325 - DNA, 20 bp, human
gtccacctggttaagtgcaa

SEQ ID NO: 94326 - DNA, 20 bp, human
gtggtcctcctggcctaacc

SEQ ID NO: 94327 - DNA, 20 bp, human
gctgtccaggcagccaggtt

SEQ ID NO: 94328 - DNA, 20 bp, human
gtgccttgctgagaaaccgt

SEQ ID NO: 94329 - DNA, 20 bp, human
gagacaggtggtggctacga

SEQ ID NO: 94330 - DNA, 20 bp, human
gtcctcgctcaaggtcaggt

SEQ ID NO: 94331 - DNA, 20 bp, human
gctggtggacagcacgacag

SEQ ID NO: 94332 - DNA, 20 bp, human
gtggtggctacgacggcgaa

SEQ ID NO: 94333 - DNA, 20 bp, human
gtgcgggcccaggctcccta

SEQ ID NO: 94334 - DNA, 20 bp, human
gcaggcagccaggttaggcc

SEQ ID NO: 94335 - DNA, 20 bp, human
gtcgctcaaggtcaggtggg

SEQ ID NO: 94336 - DNA, 20 bp, human
gcgacgccgagtggggtgcg

SEQ ID NO: 94337 - DNA, 20 bp, human
gggcaagctggggctccgta

SEQ ID NO: 94338 - DNA, 20 bp, human
gcttccgggacgcattacta

SEQ ID NO: 94339 - DNA, 20 bp, human
gaggggtcacaacctccgtg

SEQ ID NO: 94340 - DNA, 20 bp, human
ggcgttacgggatgaattaa

SEQ ID NO: 94341 - DNA, 20 bp, human
gtacggcgcgaggaaaatgg

SEQ ID NO: 94342 - DNA, 20 bp, human
gggcggccgggggatctcag

SEQ ID NO: 94343 - DNA, 20 bp, human
ggcggggaagcgactcctgg

SEQ ID NO: 94344 - DNA, 20 bp, human
gaattcatcccgtaacgcgg

SEQ ID NO: 94345 - DNA, 20 bp, human
gttacgggatgaattaacgg

SEQ ID NO: 94346 - DNA, 20 bp, human
gaagagggtagggccctacc

SEQ ID NO: 94347 - DNA, 20 bp, human
ggctgcgacgcagacgacga

SEQ ID NO: 94348 - DNA, 20 bp, human
gctccgtgcacttcacaggt

SEQ ID NO: 94349 - DNA, 20 bp, human
gcctgctccgtgcacttcac

SEQ ID NO: 94350 - DNA, 20 bp, human
ggaacagcaggaggtgatag

SEQ ID NO: 94351 - DNA, 20 bp, human
gtctgcgtcgcagctcgagg

SEQ ID NO: 94352 - DNA, 20 bp, human
gctgggagctgtgtccgcca

SEQ ID NO: 94353 - DNA, 20 bp, human
gtgtgcaagaggtgcctgtc

SEQ ID NO: 94354 - DNA, 20 bp, human
gcagcctgggtatcgtcgat

SEQ ID NO: 94355 - DNA, 20 bp, human
ggctgtgtccgccagggaca

SEQ ID NO: 94356 - DNA, 20 bp, human
ggaggtgtgtgctaaccaag

SEQ ID NO: 94357 - DNA, 20 bp, human
gcacctcacggacctcggta

SEQ ID NO: 94358 - DNA, 20 bp, human
gcaggaatggcagtctgtca

SEQ ID NO: 94359 - DNA, 20 bp, human
gccatggccagaagagactc

SEQ ID NO: 94360 - DNA, 20 bp, human
gccccctaccgaggtccgtg

SEQ ID NO: 94361 - DNA, 20 bp, human
gtgagggccgcggcactctc

SEQ ID NO: 94362 - DNA, 20 bp, human
gggcgcaaagcagaaaggat

SEQ ID NO: 94363 - DNA, 20 bp, human
gggcgcggcgcaaagcagaa

SEQ ID NO: 94364 - DNA, 20 bp, human
ggcgcaccgctcattcaccg

SEQ ID NO: 94365 - DNA, 20 bp, human
ggcacacacctcacggacct

SEQ ID NO: 94366 - DNA, 20 bp, human
gcggccgtggactcagactc

SEQ ID NO: 94367 - DNA, 20 bp, human
gcagcaagcgacctgtcagg

SEQ ID NO: 94368 - DNA, 20 bp, human
ggctggagccaccttcaagt

SEQ ID NO: 94369 - DNA, 20 bp, human
gcgccaggcccacttgaagg

SEQ ID NO: 94370 - DNA, 20 bp, human
gacaagccagccaggaccac

SEQ ID NO: 94371 - DNA, 20 bp, human
gcctcgccaggcccacttga

SEQ ID NO: 94372 - DNA, 20 bp, human
ggagtccacggccgcctgac

SEQ ID NO: 94373 - DNA, 20 bp, human
gcctgccctgagggaatggt

SEQ ID NO: 94374 - DNA, 20 bp, human
gccccagcaagcgacctgtc

SEQ ID NO: 94375 - DNA, 20 bp, human
gcaaggggcgaggctgagac

SEQ ID NO: 94376 - DNA, 20 bp, human
gaagaatccctgggcatcag

SEQ ID NO: 94377 - DNA, 20 bp, human
gcggactggggcctgtccca

SEQ ID NO: 94378 - DNA, 20 bp, human
gccactgccactgatgccca

SEQ ID NO: 94379 - DNA, 20 bp, human
gtcctgggccccacacgggt

SEQ ID NO: 94380 - DNA, 20 bp, human
ggcttcctcttgtccctggc

SEQ ID NO: 94381 - DNA, 20 bp, human
gcagggattcttgccggcca

SEQ ID NO: 94382 - DNA, 20 bp, human
ggatgcccagggattcttgc

SEQ ID NO: 94383 - DNA, 20 bp, human
ggacaggccccagtccgaat

SEQ ID NO: 94384 - DNA, 20 bp, human
gcggggctggaaaggagtct

SEQ ID NO: 94385 - DNA, 20 bp, human
gtcagggttctggtacattc

SEQ ID NO: 94386 - DNA, 20 bp, human
gccacacagcagcctcatcc

SEQ ID NO: 94387 - DNA, 20 bp, human
gcacgcacagagggagcgat

SEQ ID NO: 94388 - DNA, 20 bp, human
ggaactacagaggcggtggt

SEQ ID NO: 94389 - DNA, 20 bp, human
ggcctactctgggtctggca

SEQ ID NO: 94390 - DNA, 20 bp, human
gccccctggaactacagagg

SEQ ID NO: 94391 - DNA, 20 bp, human
gcaagaaccagagcctactc

SEQ ID NO: 94392 - DNA, 20 bp, human
gattccccctggaactacag

SEQ ID NO: 94393 - DNA, 20 bp, human
gggtatgtgcatgaagaggt

SEQ ID NO: 94394 - DNA, 20 bp, human
gggcccagcgcagaccttcc

SEQ ID NO: 94395 - DNA, 20 bp, human
gcggctggtcctggctctct

SEQ ID NO: 94396 - DNA, 20 bp, human
gcttggggactcagcaccag

SEQ ID NO: 94397 - DNA, 20 bp, human
ggaggcctgagaactgccgg

SEQ ID NO: 94398 - DNA, 20 bp, human
gaccctgctctgggcgccca

SEQ ID NO: 94399 - DNA, 20 bp, human
gctgcgggtgactaagcccc

SEQ ID NO: 94400 - DNA, 20 bp, human
ggtggacaggaactcatctt

SEQ ID NO: 94401 - DNA, 20 bp, human
gcatggagaccacgtaccag

SEQ ID NO: 94402 - DNA, 20 bp, human
gagagcaagcgccccaggaa

SEQ ID NO: 94403 - DNA, 20 bp, human
gctctgggcgcccacggctc

SEQ ID NO: 94404 - DNA, 20 bp, human
gagaacctcagcctgagccg

SEQ ID NO: 94405 - DNA, 20 bp, human
gctcggagtggccatgtctt

SEQ ID NO: 94406 - DNA, 20 bp, human
gccagccacaggagacctag

SEQ ID NO: 94407 - DNA, 20 bp, human
ggccgaggaagcaggcgctg

SEQ ID NO: 94408 - DNA, 20 bp, human
ggtctgttcaggctgagagg

SEQ ID NO: 94409 - DNA, 20 bp, human
gagaggggatgtggacctgg

SEQ ID NO: 94410 - DNA, 20 bp, human
gcatgcccctaggtctcctg

SEQ ID NO: 94411 - DNA, 20 bp, human
ggcgagtgagaggctcacct

SEQ ID NO: 94412 - DNA, 20 bp, human
ggcaggactctaggagtcca

SEQ ID NO: 94413 - DNA, 20 bp, human
ggcagagggaccttgctcag

SEQ ID NO: 94414 - DNA, 20 bp, human
gtccaggacaaccaagtaag

SEQ ID NO: 94415 - DNA, 20 bp, human
ggacctgggggagtctgttc

SEQ ID NO: 94416 - DNA, 20 bp, human
gagtgtagacctgggaggat

SEQ ID NO: 94417 - DNA, 20 bp, human
gggcgcagtgtagacctggg

SEQ ID NO: 94418 - DNA, 20 bp, human
gtgcctgtgggactccccaa

SEQ ID NO: 94419 - DNA, 20 bp, human
ggcaggccgcccatcctccc

SEQ ID NO: 94420 - DNA, 20 bp, human
gtggagggactgcacatcct

SEQ ID NO: 94421 - DNA, 20 bp, human
gagcccttggggagtcccac

SEQ ID NO: 94422 - DNA, 20 bp, human
gactgcacatcctgggcctg

SEQ ID NO: 94423 - DNA, 20 bp, human
gggaggactgtacctgctca

SEQ ID NO: 94424 - DNA, 20 bp, human
gctgtgtggccttaaaggag

SEQ ID NO: 94425 - DNA, 20 bp, human
gcccagaccagcatgagcag

SEQ ID NO: 94426 - DNA, 20 bp, human
ggtccagccaaggtccccat

SEQ ID NO: 94427 - DNA, 20 bp, human
ggaagctctggcctcactgc

SEQ ID NO: 94428 - DNA, 20 bp, human
gactcagggtcaagaccccg

SEQ ID NO: 94429 - DNA, 20 bp, human
ggaccttggctggacctcac

SEQ ID NO: 94430 - DNA, 20 bp, human
gaagagaagcccctggacag

SEQ ID NO: 94431 - DNA, 20 bp, human
ggtggctgtctacaggtaca

SEQ ID NO: 94432 - DNA, 20 bp, human
gaacaggtttccgggcatcg

SEQ ID NO: 94433 - DNA, 20 bp, human
ggggcgaggggcctgtttag

SEQ ID NO: 94434 - DNA, 20 bp, human
gcgtggccgtcagactcaca

SEQ ID NO: 94435 - DNA, 20 bp, human
gctgtttagtggctgtctac

SEQ ID NO: 94436 - DNA, 20 bp, human
ggcagccggcacagactcag

SEQ ID NO: 94437 - DNA, 20 bp, human
gccaggctaacccctgcggt

SEQ ID NO: 94438 - DNA, 20 bp, human
gacacccacgcccaccgcag

SEQ ID NO: 94439 - DNA, 20 bp, human
ggctggcagctcagagacgt

SEQ ID NO: 94440 - DNA, 20 bp, human
gtaacaggaagtgtctagcc

SEQ ID NO: 94441 - DNA, 20 bp, human
gagctgcggaacagtcccta

SEQ ID NO: 94442 - DNA, 20 bp, human
gcgctgtccatatgccagga

SEQ ID NO: 94443 - DNA, 20 bp, human
gcccggtgtggggagctcgt

SEQ ID NO: 94444 - DNA, 20 bp, human
gggctgccgtgcaccatcct

SEQ ID NO: 94445 - DNA, 20 bp, human
ggagcaccacgaggacaccc

SEQ ID NO: 94446 - DNA, 20 bp, human
ggaactcctgggctgcgatg

SEQ ID NO: 94447 - DNA, 20 bp, human
gccgagggctgaggcgtcca

SEQ ID NO: 94448 - DNA, 20 bp, human
gtactccgggagggtcgggt

SEQ ID NO: 94449 - DNA, 20 bp, human
ggaagtataggggagaccta

SEQ ID NO: 94450 - DNA, 20 bp, human
gaggggttcctagaagtata

SEQ ID NO: 94451 - DNA, 20 bp, human
gatgcagaggaactacaacg

SEQ ID NO: 94452 - DNA, 20 bp, human
ggggagacctagggaaaaga

SEQ ID NO: 94453 - DNA, 20 bp, human
ggaggcgtccacggcaaaga

SEQ ID NO: 94454 - DNA, 20 bp, human
gggacagagggggacctgga

SEQ ID NO: 94455 - DNA, 20 bp, human
gtggagcgggggaccttgag

SEQ ID NO: 94456 - DNA, 20 bp, human
gtgcaggatgaagcctgagt

SEQ ID NO: 94457 - DNA, 20 bp, human
gggattaacgcactgagatt

SEQ ID NO: 94458 - DNA, 20 bp, human
gcatcctgcacaataaactc

SEQ ID NO: 94459 - DNA, 20 bp, human
gtactgctgagggggtgaca

SEQ ID NO: 94460 - DNA, 20 bp, human
gcctcagcagtaaaggcctg

SEQ ID NO: 94461 - DNA, 20 bp, human
gaggggcacacgactgtgtg

SEQ ID NO: 94462 - DNA, 20 bp, human
gctgagattgggcagagata

SEQ ID NO: 94463 - DNA, 20 bp, human
ggaggagctttggacctgtt

SEQ ID NO: 94464 - DNA, 20 bp, human
ggatgacagcgcagacagcc

SEQ ID NO: 94465 - DNA, 20 bp, human
gggcacacgactgtgtgggg

SEQ ID NO: 94466 - DNA, 20 bp, human
gtgcggctccggccaatccc

SEQ ID NO: 94467 - DNA, 20 bp, human
ggaagatggcgagggtgtgt

SEQ ID NO: 94468 - DNA, 20 bp, human
gcgaaagccgcgtctctcaa

SEQ ID NO: 94469 - DNA, 20 bp, human
gccgggcgggcggcagaaga

SEQ ID NO: 94470 - DNA, 20 bp, human
gaagcgtgaggtggagatgg

SEQ ID NO: 94471 - DNA, 20 bp, human
ggcggccggcgggaccataa

SEQ ID NO: 94472 - DNA, 20 bp, human
gcgccggtcgccccagacca

SEQ ID NO: 94473 - DNA, 20 bp, human
gacgctcgagccaaagaggg

SEQ ID NO: 94474 - DNA, 20 bp, human
gcagagggaaacgggacctt

SEQ ID NO: 94475 - DNA, 20 bp, human
gagtcgccacaataagccgg

SEQ ID NO: 94476 - DNA, 20 bp, human
ggcgggacgcagatggacaa

SEQ ID NO: 94477 - DNA, 20 bp, human
ggggctccggcactgagcgg

SEQ ID NO: 94478 - DNA, 20 bp, human
gcgggcgccgaggagtttcg

SEQ ID NO: 94479 - DNA, 20 bp, human
gcgccgcgcaccgagggctc

SEQ ID NO: 94480 - DNA, 20 bp, human
gccaagagctgggaaggcga

SEQ ID NO: 94481 - DNA, 20 bp, human
ggtccaccctgacaggacgg

SEQ ID NO: 94482 - DNA, 20 bp, human
gggtgcgcggcggagagaag

SEQ ID NO: 94483 - DNA, 20 bp, human
gcagcgcaggcacgaggcag

SEQ ID NO: 94484 - DNA, 20 bp, human
gtctctccgccgcgcaccga

SEQ ID NO: 94485 - DNA, 20 bp, human
ggtcctgtcagggtggacgg

SEQ ID NO: 94486 - DNA, 20 bp, human
ggtcctggccagttagacag

SEQ ID NO: 94487 - DNA, 20 bp, human
gaagctgtccttggtagtac

SEQ ID NO: 94488 - DNA, 20 bp, human
gtcatacaccagtactacca

SEQ ID NO: 94489 - DNA, 20 bp, human
gggatggccacgcgaggtgg

SEQ ID NO: 94490 - DNA, 20 bp, human
ggaggtggcggcagatgtcc

SEQ ID NO: 94491 - DNA, 20 bp, human
ggaacagctttgtcaagcct

SEQ ID NO: 94492 - DNA, 20 bp, human
gctcgcgtggccatccaaga

SEQ ID NO: 94493 - DNA, 20 bp, human
gaacccagcccagagagccg

SEQ ID NO: 94494 - DNA, 20 bp, human
gcgaggtgctccatcttgga

SEQ ID NO: 94495 - DNA, 20 bp, human
gctattgctctatttcacgg

SEQ ID NO: 94496 - DNA, 20 bp, human
ggctacgccagaaaagacat

SEQ ID NO: 94497 - DNA, 20 bp, human
gagatagcaatggaacccta

SEQ ID NO: 94498 - DNA, 20 bp, human
ggcatgggcgcttcacccat

SEQ ID NO: 94499 - DNA, 20 bp, human
gaagacatcggctccaacag

SEQ ID NO: 94500 - DNA, 20 bp, human
gcatggtcaggaaaactcag

SEQ ID NO: 94501 - DNA, 20 bp, human
gccctgtggaacacccctgt

SEQ ID NO: 94502 - DNA, 20 bp, human
gccaggacctctgagcgaaa

SEQ ID NO: 94503 - DNA, 20 bp, human
gtgagttccggagagaagga

SEQ ID NO: 94504 - DNA, 20 bp, human
gccacagggtagctgggagt

SEQ ID NO: 94505 - DNA, 20 bp, human
ggctcaaatccagagctcgg

SEQ ID NO: 94506 - DNA, 20 bp, human
gggtggtgcaggatgaccat

SEQ ID NO: 94507 - DNA, 20 bp, human
gtcatgctgggggtcagact

SEQ ID NO: 94508 - DNA, 20 bp, human
gagtattctggcaggaaagt

SEQ ID NO: 94509 - DNA, 20 bp, human
gtcattggttagaggaccag

SEQ ID NO: 94510 - DNA, 20 bp, human
gaaggagtggaaggcgaatg

SEQ ID NO: 94511 - DNA, 20 bp, human
gaggtccccgaaggagtgga

SEQ ID NO: 94512 - DNA, 20 bp, human
gcagcatgaaaaacttagca

SEQ ID NO: 94513 - DNA, 20 bp, human
gaaggcttcggttctccgga

SEQ ID NO: 94514 - DNA, 20 bp, human
gtcggttctccggagggtgc

SEQ ID NO: 94515 - DNA, 20 bp, human
gtgtggcatagtcggcgaag

SEQ ID NO: 94516 - DNA, 20 bp, human
gggagccacagcacagccga

SEQ ID NO: 94517 - DNA, 20 bp, human
gcctctccaactgaccccca

SEQ ID NO: 94518 - DNA, 20 bp, human
gagagccttcggctgtgctg

SEQ ID NO: 94519 - DNA, 20 bp, human
gatcagacaggagccaaggt

SEQ ID NO: 94520 - DNA, 20 bp, human
gttagatagaggccactcag

SEQ ID NO: 94521 - DNA, 20 bp, human
gctctctcaggggacagcgt

SEQ ID NO: 94522 - DNA, 20 bp, human
gggagccaaggtagggagaa

SEQ ID NO: 94523 - DNA, 20 bp, human
gtccctcgtgtgcaggacag

SEQ ID NO: 94524 - DNA, 20 bp, human
gggggacagcgtaggccctg

SEQ ID NO: 94525 - DNA, 20 bp, human
gacacccccagagcagtcgc

SEQ ID NO: 94526 - DNA, 20 bp, human
gcacacggacacacactccg

SEQ ID NO: 94527 - DNA, 20 bp, human
gagccaggcaggaaggcgag

SEQ ID NO: 94528 - DNA, 20 bp, human
ggcgcgcgggtgtgagtccg

SEQ ID NO: 94529 - DNA, 20 bp, human
gtgtcaggcgcggagcagac

SEQ ID NO: 94530 - DNA, 20 bp, human
ggcagcagcccagaaacacg

SEQ ID NO: 94531 - DNA, 20 bp, human
ggcgtagcccttccagcccc

SEQ ID NO: 94532 - DNA, 20 bp, human
gggcccctcgccgcagccag

SEQ ID NO: 94533 - DNA, 20 bp, human
ggcgatgtgaagatgtcagt

SEQ ID NO: 94534 - DNA, 20 bp, human
gacacggggaggagacgctg

SEQ ID NO: 94535 - DNA, 20 bp, human
gtgggggcccagccgagtca

SEQ ID NO: 94536 - DNA, 20 bp, human
ggaggctcggagagagcgag

SEQ ID NO: 94537 - DNA, 20 bp, human
gctctcagaatgaggcccca

SEQ ID NO: 94538 - DNA, 20 bp, human
gctcatgtcccgagtgggac

SEQ ID NO: 94539 - DNA, 20 bp, human
gcagcagctcatgtcccgag

SEQ ID NO: 94540 - DNA, 20 bp, human
gactgggagctccagtccgc

SEQ ID NO: 94541 - DNA, 20 bp, human
gccgagcctctctcagaatg

SEQ ID NO: 94542 - DNA, 20 bp, human
gtgggacgggcaggcccgac

SEQ ID NO: 94543 - DNA, 20 bp, human
gacacacacgcagcgcccgc

SEQ ID NO: 94544 - DNA, 20 bp, human
ggggcctgcccgtcccactc

SEQ ID NO: 94545 - DNA, 20 bp, human
gctttgtgcggccggcggac

SEQ ID NO: 94546 - DNA, 20 bp, human
ggagccctctatagcaggag

SEQ ID NO: 94547 - DNA, 20 bp, human
gacgtccatgcagagcacat

SEQ ID NO: 94548 - DNA, 20 bp, human
ggaattcagccagaaaccct

SEQ ID NO: 94549 - DNA, 20 bp, human
ggctggctgggaactgctgt

SEQ ID NO: 94550 - DNA, 20 bp, human
ggtacgtggtagtatcaagt

SEQ ID NO: 94551 - DNA, 20 bp, human
gcaggctgaacacgctggct

SEQ ID NO: 94552 - DNA, 20 bp, human
gactctggctgtaccatgta

SEQ ID NO: 94553 - DNA, 20 bp, human
gaggaggcatacaccataca

SEQ ID NO: 94554 - DNA, 20 bp, human
gcaaactcgtggattcatcc

SEQ ID NO: 94555 - DNA, 20 bp, human
gggtttctggctgaattcta

SEQ ID NO: 94556 - DNA, 20 bp, human
ggctgcgtggagctcttgag

SEQ ID NO: 94557 - DNA, 20 bp, human
gaggaccaggccagtcccag

SEQ ID NO: 94558 - DNA, 20 bp, human
gtcacccgggagatagtgag

SEQ ID NO: 94559 - DNA, 20 bp, human
ggggcagcaagggacagaac

SEQ ID NO: 94560 - DNA, 20 bp, human
gcagcccggctgggcagcaa

SEQ ID NO: 94561 - DNA, 20 bp, human
gcagggcccgggcccagtca

SEQ ID NO: 94562 - DNA, 20 bp, human
gttcgctcccagctattctt

SEQ ID NO: 94563 - DNA, 20 bp, human
ggaggctcctaagaatagct

SEQ ID NO: 94564 - DNA, 20 bp, human
gcacagcctggcacccgatg

SEQ ID NO: 94565 - DNA, 20 bp, human
gagagcatgccccatcccct

SEQ ID NO: 94566 - DNA, 20 bp, human
gcacgtcgggcggtcgtcgg

SEQ ID NO: 94567 - DNA, 20 bp, human
gcaatgagatccggaatcgg

SEQ ID NO: 94568 - DNA, 20 bp, human
gcgtaccgggaatgcacgtc

SEQ ID NO: 94569 - DNA, 20 bp, human
gcgcagggccctaccgtacc

SEQ ID NO: 94570 - DNA, 20 bp, human
gcctctgggctcgaaatcgg

SEQ ID NO: 94571 - DNA, 20 bp, human
ggtgcattcccggtacggta

SEQ ID NO: 94572 - DNA, 20 bp, human
ggcacagcccagagacgtct

SEQ ID NO: 94573 - DNA, 20 bp, human
gcgcacggcgccagagggat

SEQ ID NO: 94574 - DNA, 20 bp, human
ggcgggcggtgcaaaactcg

SEQ ID NO: 94575 - DNA, 20 bp, human
gaccgggaatgcacgtcggg

SEQ ID NO: 94576 - DNA, 20 bp, human
gacctggacctgcggacccc

SEQ ID NO: 94577 - DNA, 20 bp, human
ggcccggggtccgcaggtcc

SEQ ID NO: 94578 - DNA, 20 bp, human
gtccaggtgagaggtacttc

SEQ ID NO: 94579 - DNA, 20 bp, human
gtacctctcacctggacctg

SEQ ID NO: 94580 - DNA, 20 bp, human
gccgcgcagctgcagtaagg

SEQ ID NO: 94581 - DNA, 20 bp, human
gcagctccaggactgcgccc

SEQ ID NO: 94582 - DNA, 20 bp, human
gcggaccccgggcgcagtcc

SEQ ID NO: 94583 - DNA, 20 bp, human
gcatccatgaagcggaccag

SEQ ID NO: 94584 - DNA, 20 bp, human
gcgacccggcgtctgttagt

SEQ ID NO: 94585 - DNA, 20 bp, human
gtcatggccactcactcaag

SEQ ID NO: 94586 - DNA, 20 bp, human
ggtcctgccaacggctctct

SEQ ID NO: 94587 - DNA, 20 bp, human
gctcttggcgtctcaacgtt

SEQ ID NO: 94588 - DNA, 20 bp, human
gcagggccatccccaggcat

SEQ ID NO: 94589 - DNA, 20 bp, human
gagagccaggtgccgttgag

SEQ ID NO: 94590 - DNA, 20 bp, human
gacctgccgtagagtgctga

SEQ ID NO: 94591 - DNA, 20 bp, human
gggatgcgcgttgcttgacg

SEQ ID NO: 94592 - DNA, 20 bp, human
ggttgcttgacgcggacaca

SEQ ID NO: 94593 - DNA, 20 bp, human
gcgccaagagagccgttggc

SEQ ID NO: 94594 - DNA, 20 bp, human
gaccttcagcactctacggc

SEQ ID NO: 94595 - DNA, 20 bp, human
gctgtgatgaacgggcttct

SEQ ID NO: 94596 - DNA, 20 bp, human
ggcaagcctgatgggacgtg

SEQ ID NO: 94597 - DNA, 20 bp, human
ggccggatgctcagagctaa

SEQ ID NO: 94598 - DNA, 20 bp, human
ggacctctgtaacagtcgtg

SEQ ID NO: 94599 - DNA, 20 bp, human
gcagctgcgtgcgtctcctc

SEQ ID NO: 94600 - DNA, 20 bp, human
gctccgcacgactgttacag

SEQ ID NO: 94601 - DNA, 20 bp, human
gaacccaccaaggacaagta

SEQ ID NO: 94602 - DNA, 20 bp, human
gtcagagctaaaggccgcgg

SEQ ID NO: 94603 - DNA, 20 bp, human
gacacgtgcccgagtagctg

SEQ ID NO: 94604 - DNA, 20 bp, human
gccctgcgccccaaactgag

SEQ ID NO: 94605 - DNA, 20 bp, human
gtcccgccagcaggccgtgg

SEQ ID NO: 94606 - DNA, 20 bp, human
gcttctgtgccttccttcaa

SEQ ID NO: 94607 - DNA, 20 bp, human
ggagtgagaagcccatcctg

SEQ ID NO: 94608 - DNA, 20 bp, human
gacggagggcaaccgtcgac

SEQ ID NO: 94609 - DNA, 20 bp, human
ggtgtctcgagtcgcacgga

SEQ ID NO: 94610 - DNA, 20 bp, human
gcagtctaccaggcaatggg

SEQ ID NO: 94611 - DNA, 20 bp, human
gtcagtacagatgacccaca

SEQ ID NO: 94612 - DNA, 20 bp, human
gatagcacaagccatgccta

SEQ ID NO: 94613 - DNA, 20 bp, human
gacgcataagagccgagcgg

SEQ ID NO: 94614 - DNA, 20 bp, human
gttagcgcctcaactgtcgt

SEQ ID NO: 94615 - DNA, 20 bp, human
gaagcaaggcccagtctacc

SEQ ID NO: 94616 - DNA, 20 bp, human
gagagggtgtgagcactggg

SEQ ID NO: 94617 - DNA, 20 bp, human
ggccagagggtgtgagcact

SEQ ID NO: 94618 - DNA, 20 bp, human
ggagcagtcgggccatagcc

SEQ ID NO: 94619 - DNA, 20 bp, human
gtcgggccatagccaggcac

SEQ ID NO: 94620 - DNA, 20 bp, human
gccccaggcaacgtagagtg

SEQ ID NO: 94621 - DNA, 20 bp, human
ggcgccccgccccccacgaa

SEQ ID NO: 94622 - DNA, 20 bp, human
gagaaatggaggccaagtta

SEQ ID NO: 94623 - DNA, 20 bp, human
gctggaataaaacacacctg

SEQ ID NO: 94624 - DNA, 20 bp, human
gcacagagcccaggaaactt

SEQ ID NO: 94625 - DNA, 20 bp, human
gcttctgggcccttcgtggg

SEQ ID NO: 94626 - DNA, 20 bp, human
gttacctgcagtccccgccg

SEQ ID NO: 94627 - DNA, 20 bp, human
ggtgcaatcgcgggaagcca

SEQ ID NO: 94628 - DNA, 20 bp, human
gctgcgagcatggggccctg

SEQ ID NO: 94629 - DNA, 20 bp, human
gacacagcaggtcgtgatcc

SEQ ID NO: 94630 - DNA, 20 bp, human
gagcaggtcgtgatccgggt

SEQ ID NO: 94631 - DNA, 20 bp, human
gcccaagtctccacagggtg

SEQ ID NO: 94632 - DNA, 20 bp, human
ggatgcggtccctcaccctg

SEQ ID NO: 94633 - DNA, 20 bp, human
ggggccccgagtgcaatcgc

SEQ ID NO: 94634 - DNA, 20 bp, human
gtggcagaggctgcgagcat

SEQ ID NO: 94635 - DNA, 20 bp, human
gcatccctgggagacttgtg

SEQ ID NO: 94636 - DNA, 20 bp, human
gggcttgggcagcgactcct

SEQ ID NO: 94637 - DNA, 20 bp, human
gagtgctggtatggaaacag

SEQ ID NO: 94638 - DNA, 20 bp, human
gactggggaggagggtatca

SEQ ID NO: 94639 - DNA, 20 bp, human
ggtttcctgctgcccgactg

SEQ ID NO: 94640 - DNA, 20 bp, human
gtcttgggagagcaaacctt

SEQ ID NO: 94641 - DNA, 20 bp, human
gtgaccaggctcctgatctt

SEQ ID NO: 94642 - DNA, 20 bp, human
gaccctgggagtgagccccg

SEQ ID NO: 94643 - DNA, 20 bp, human
gatgaacaaggtcttccccc

SEQ ID NO: 94644 - DNA, 20 bp, human
gagagcggccagttttactg

SEQ ID NO: 94645 - DNA, 20 bp, human
ggctcactcccagggtgtag

SEQ ID NO: 94646 - DNA, 20 bp, human
gcaaatgaagaggatctgga

SEQ ID NO: 94647 - DNA, 20 bp, human
gctggtgggacacaaggaga

SEQ ID NO: 94648 - DNA, 20 bp, human
ggaggctgggaaactgtgtc

SEQ ID NO: 94649 - DNA, 20 bp, human
gggagacaggtaagtatcag

SEQ ID NO: 94650 - DNA, 20 bp, human
ggaaccaaatgaagaggatc

SEQ ID NO: 94651 - DNA, 20 bp, human
ggtgggcaggacagccctca

SEQ ID NO: 94652 - DNA, 20 bp, human
gagttctgaaccaaatgaag

SEQ ID NO: 94653 - DNA, 20 bp, human
gggttcagaactgtgtccag

SEQ ID NO: 94654 - DNA, 20 bp, human
gactcctgcttctaggtgac

SEQ ID NO: 94655 - DNA, 20 bp, human
gcagatccaagccttccaga

SEQ ID NO: 94656 - DNA, 20 bp, human
gcgacgccgggcagcgggag

SEQ ID NO: 94657 - DNA, 20 bp, human
gcagcaacgacgccgggcag

SEQ ID NO: 94658 - DNA, 20 bp, human
gtgtgtgtgttgaggaacgg

SEQ ID NO: 94659 - DNA, 20 bp, human
gctcgagctacgcccaatcg

SEQ ID NO: 94660 - DNA, 20 bp, human
gtaggacggctcgcaccccg

SEQ ID NO: 94661 - DNA, 20 bp, human
gcgcgcgcgaccaggcgtct

SEQ ID NO: 94662 - DNA, 20 bp, human
gccccagcagccacatggcg

SEQ ID NO: 94663 - DNA, 20 bp, human
gcgtctgggaagatgagacc

SEQ ID NO: 94664 - DNA, 20 bp, human
ggagcggcggccgcgccatg

SEQ ID NO: 94665 - DNA, 20 bp, human
gcccggcggctgccccgatt

SEQ ID NO: 94666 - DNA, 20 bp, human
gctgggtctccgagccccgg

SEQ ID NO: 94667 - DNA, 20 bp, human
gacgaggtgtccctccaggt

SEQ ID NO: 94668 - DNA, 20 bp, human
ggtacaccggtggaagacag

SEQ ID NO: 94669 - DNA, 20 bp, human
ggacacctcgtcgccagtca

SEQ ID NO: 94670 - DNA, 20 bp, human
gtccgagccccggaggaagc

SEQ ID NO: 94671 - DNA, 20 bp, human
ggcgcgccctgtgagtacac

SEQ ID NO: 94672 - DNA, 20 bp, human
ggacgacagggacgcatggt

SEQ ID NO: 94673 - DNA, 20 bp, human
gagggcagaccccttcacaa

SEQ ID NO: 94674 - DNA, 20 bp, human
gacacacgcctgcttcctcc

SEQ ID NO: 94675 - DNA, 20 bp, human
gacagggacgcatggtgggt

SEQ ID NO: 94676 - DNA, 20 bp, human
gtcgatgccgctgcgaggag

SEQ ID NO: 94677 - DNA, 20 bp, human
ggcgctgcccctcctcgcag

SEQ ID NO: 94678 - DNA, 20 bp, human
gacctgaggaccccgagctc

SEQ ID NO: 94679 - DNA, 20 bp, human
gccgcagccaaaactccgtc

SEQ ID NO: 94680 - DNA, 20 bp, human
gggtgcagccggcatggggt

SEQ ID NO: 94681 - DNA, 20 bp, human
gcccatgccggctgcacctg

SEQ ID NO: 94682 - DNA, 20 bp, human
gcccggagtgcggccaagtt

SEQ ID NO: 94683 - DNA, 20 bp, human
gggaggcaggcgctcgtcgt

SEQ ID NO: 94684 - DNA, 20 bp, human
ggccatggacgcgctcaagt

SEQ ID NO: 94685 - DNA, 20 bp, human
ggaggaaggagcccgagctc

SEQ ID NO: 94686 - DNA, 20 bp, human
ggcaggagtgggacccccct

SEQ ID NO: 94687 - DNA, 20 bp, human
gcgagactctgagcggtgaa

SEQ ID NO: 94688 - DNA, 20 bp, human
gtcccagcccaggcaggagt

SEQ ID NO: 94689 - DNA, 20 bp, human
gggaccaaggcacaacatgt

SEQ ID NO: 94690 - DNA, 20 bp, human
gtgaggcaggaagtcggtcc

SEQ ID NO: 94691 - DNA, 20 bp, human
gaccgggcaggggtgattag

SEQ ID NO: 94692 - DNA, 20 bp, human
gggggttgcgcttcacccag

SEQ ID NO: 94693 - DNA, 20 bp, human
gaaggccctggggtcagacc

SEQ ID NO: 94694 - DNA, 20 bp, human
gagcggtggccaacctcaag

SEQ ID NO: 94695 - DNA, 20 bp, human
gagagctgtgagtcctgacg

SEQ ID NO: 94696 - DNA, 20 bp, human
gggctatccatctcgatgta

SEQ ID NO: 94697 - DNA, 20 bp, human
gtagggcaccacccactcct

SEQ ID NO: 94698 - DNA, 20 bp, human
ggaaggcccggtaatcacct

SEQ ID NO: 94699 - DNA, 20 bp, human
gcgcaggaagtgcgtgtcca

SEQ ID NO: 94700 - DNA, 20 bp, human
gaggaagtgcgtgtccacgg

SEQ ID NO: 94701 - DNA, 20 bp, human
gtggccaccaagcgcctccg

SEQ ID NO: 94702 - DNA, 20 bp, human
gccggtaatcacctaggatg

SEQ ID NO: 94703 - DNA, 20 bp, human
ggacaggactcggctcggtt

SEQ ID NO: 94704 - DNA, 20 bp, human
gtccgtccgaatggcctcgt

SEQ ID NO: 94705 - DNA, 20 bp, human
ggtgcgcacggaggcctcgc

SEQ ID NO: 94706 - DNA, 20 bp, human
gagccgagggcccgagagag

SEQ ID NO: 94707 - DNA, 20 bp, human
gtgggcccctgtagaaatgg

SEQ ID NO: 94708 - DNA, 20 bp, human
gggcagtgtggggtgcacga

SEQ ID NO: 94709 - DNA, 20 bp, human
gaccggggccgaagtcccta

SEQ ID NO: 94710 - DNA, 20 bp, human
gccgccggccgtgaccaaga

SEQ ID NO: 94711 - DNA, 20 bp, human
ggactacggagccagacggg

SEQ ID NO: 94712 - DNA, 20 bp, human
gacgcgtacctggggtctcg

SEQ ID NO: 94713 - DNA, 20 bp, human
gaccaagatggcccgcgcgg

SEQ ID NO: 94714 - DNA, 20 bp, human
ggggtctcgcggttcctccg

SEQ ID NO: 94715 - DNA, 20 bp, human
gtcccccgcgcgggccatct

SEQ ID NO: 94716 - DNA, 20 bp, human
gtcctccccctgtcaagatg

SEQ ID NO: 94717 - DNA, 20 bp, human
gaggtgccacatcttgacag

SEQ ID NO: 94718 - DNA, 20 bp, human
gctgttgggccaggtaagga

SEQ ID NO: 94719 - DNA, 20 bp, human
gctgggcagaggagtgacaa

SEQ ID NO: 94720 - DNA, 20 bp, human
gcccggcaggaggctccaat

SEQ ID NO: 94721 - DNA, 20 bp, human
gtacctggcccaacagcaac

SEQ ID NO: 94722 - DNA, 20 bp, human
ggggagccatctatctgtaa

SEQ ID NO: 94723 - DNA, 20 bp, human
ggaggactgcacaaagtttg

SEQ ID NO: 94724 - DNA, 20 bp, human
gtgcaggtactccctgaacc

SEQ ID NO: 94725 - DNA, 20 bp, human
ggaggctccaataggcctga

SEQ ID NO: 94726 - DNA, 20 bp, human
gggcagcgggacagatccca

SEQ ID NO: 94727 - DNA, 20 bp, human
gtgaaatgccctgcacgtcg

SEQ ID NO: 94728 - DNA, 20 bp, human
ggagactccctgggcaccct

SEQ ID NO: 94729 - DNA, 20 bp, human
gtgcagtcgggcgtggaagt

SEQ ID NO: 94730 - DNA, 20 bp, human
gcccgctgccccgacgtgca

SEQ ID NO: 94731 - DNA, 20 bp, human
gcgccaacacacccattcgg

SEQ ID NO: 94732 - DNA, 20 bp, human
gttccacagttcggactcag

SEQ ID NO: 94733 - DNA, 20 bp, human
gcaggacctgcaccctctac

SEQ ID NO: 94734 - DNA, 20 bp, human
gcagctcgcccgggctccta

SEQ ID NO: 94735 - DNA, 20 bp, human
gactgcaaaggaccctcggg

SEQ ID NO: 94736 - DNA, 20 bp, human
gtattcttcaaagagagtgt

SEQ ID NO: 94737 - DNA, 20 bp, human
gattctaaggctaaatagct

SEQ ID NO: 94738 - DNA, 20 bp, human
gtgggggcaactctaatcag

SEQ ID NO: 94739 - DNA, 20 bp, human
ggacccagactcagactgaa

SEQ ID NO: 94740 - DNA, 20 bp, human
gggaatgacacatggtcctg

SEQ ID NO: 94741 - DNA, 20 bp, human
gaatcagaccagccaaaagg

SEQ ID NO: 94742 - DNA, 20 bp, human
gtgttccggttctttaatga

SEQ ID NO: 94743 - DNA, 20 bp, human
ggagacacaaaaagtttaag

SEQ ID NO: 94744 - DNA, 20 bp, human
gggcttcttcttcagatcaa

SEQ ID NO: 94745 - DNA, 20 bp, human
ggtcaagttctaatattcca

SEQ ID NO: 94746 - DNA, 20 bp, human
gtctgccattgggatagaga

SEQ ID NO: 94747 - DNA, 20 bp, human
ggagcactcgggtgttaagt

SEQ ID NO: 94748 - DNA, 20 bp, human
ggagaggctgctctacaaat

SEQ ID NO: 94749 - DNA, 20 bp, human
gccgctcaaactggattcaa

SEQ ID NO: 94750 - DNA, 20 bp, human
gtcaaacacgtgcaaatcag

SEQ ID NO: 94751 - DNA, 20 bp, human
gggtgagtacgaattttgaa

SEQ ID NO: 94752 - DNA, 20 bp, human
gcgtactcacctctgccatt

SEQ ID NO: 94753 - DNA, 20 bp, human
gctctacaaataggagagtt

SEQ ID NO: 94754 - DNA, 20 bp, human
gttcgaatccgagagcactc

SEQ ID NO: 94755 - DNA, 20 bp, human
gcgggtgttaagtgggcatg

SEQ ID NO: 94756 - DNA, 20 bp, human
gtcgagccgggaacaaagag

SEQ ID NO: 94757 - DNA, 20 bp, human
gctcggccgggcgaactcaa

SEQ ID NO: 94758 - DNA, 20 bp, human
ggctctcgggccgaggaacc

SEQ ID NO: 94759 - DNA, 20 bp, human
gtccgcagtggagggcactg

SEQ ID NO: 94760 - DNA, 20 bp, human
gccggcggaggcgtgcagag

SEQ ID NO: 94761 - DNA, 20 bp, human
ggccgggaacaaagaggggt

SEQ ID NO: 94762 - DNA, 20 bp, human
ggcggggactccgcagtgga

SEQ ID NO: 94763 - DNA, 20 bp, human
gagggcactgcggagtctcg

SEQ ID NO: 94764 - DNA, 20 bp, human
gcgggcgcgtcctggttcct

SEQ ID NO: 94765 - DNA, 20 bp, human
ggaagaaaaaccgaagcgaa

SEQ ID NO: 94766 - DNA, 20 bp, human
ggtgagggccacggtctaag

SEQ ID NO: 94767 - DNA, 20 bp, human
gccctcctgcagccttctca

SEQ ID NO: 94768 - DNA, 20 bp, human
gccttgcagaggtctgtggg

SEQ ID NO: 94769 - DNA, 20 bp, human
gctggacagggccgacatgg

SEQ ID NO: 94770 - DNA, 20 bp, human
gcatgcagtcaggactccgg

SEQ ID NO: 94771 - DNA, 20 bp, human
gcacgtgagggcccagtacg

SEQ ID NO: 94772 - DNA, 20 bp, human
gaggtcagatgtgcccactc

SEQ ID NO: 94773 - DNA, 20 bp, human
gctgcagcagggccacgtac

SEQ ID NO: 94774 - DNA, 20 bp, human
gcctttgacaccaccggagt

SEQ ID NO: 94775 - DNA, 20 bp, human
ggcggggcctcagcatgcag

SEQ ID NO: 94776 - DNA, 20 bp, human
gtgtcggccctgtccagtac

SEQ ID NO: 94777 - DNA, 20 bp, human
gccactctggaggtgtcgaa

SEQ ID NO: 94778 - DNA, 20 bp, human
ggaggttgaaggagggtctc

SEQ ID NO: 94779 - DNA, 20 bp, human
ggaggtgcccgtactggaca

SEQ ID NO: 94780 - DNA, 20 bp, human
gccgcagcaggactacatac

SEQ ID NO: 94781 - DNA, 20 bp, human
gtgtcctctagggaggttga

SEQ ID NO: 94782 - DNA, 20 bp, human
gtggccttttgggactctgt

SEQ ID NO: 94783 - DNA, 20 bp, human
ggccccggtcccatggtcgg

SEQ ID NO: 94784 - DNA, 20 bp, human
gaggccggttgtgcccactc

SEQ ID NO: 94785 - DNA, 20 bp, human
gccggcctgcccccgaccat

SEQ ID NO: 94786 - DNA, 20 bp, human
gcccacaacgagcaggtcag

SEQ ID NO: 94787 - DNA, 20 bp, human
ggagcaaggggtgataggta

SEQ ID NO: 94788 - DNA, 20 bp, human
gcctcgacttcgactaggac

SEQ ID NO: 94789 - DNA, 20 bp, human
gctgcagtggccggaagagg

SEQ ID NO: 94790 - DNA, 20 bp, human
gctagtcgaagtcgaggtga

SEQ ID NO: 94791 - DNA, 20 bp, human
ggactaggacgggtgtgaaa

SEQ ID NO: 94792 - DNA, 20 bp, human
gaccgggtcatcccaggctg

SEQ ID NO: 94793 - DNA, 20 bp, human
gggctggcagacaccaggaa

SEQ ID NO: 94794 - DNA, 20 bp, human
gccccagagcaaggggtgat

SEQ ID NO: 94795 - DNA, 20 bp, human
gacataggccccagagcaag

SEQ ID NO: 94796 - DNA, 20 bp, human
gatctgggcagaggaaccaa

SEQ ID NO: 94797 - DNA, 20 bp, human
gccagatctgaggaagctgg

SEQ ID NO: 94798 - DNA, 20 bp, human
gtaactcctagatatggaca

SEQ ID NO: 94799 - DNA, 20 bp, human
gttgagtgaggtggatgtta

SEQ ID NO: 94800 - DNA, 20 bp, human
gcttgacaagcagttgagtg

SEQ ID NO: 94801 - DNA, 20 bp, human
ggctcagggcaaaactcaac

SEQ ID NO: 94802 - DNA, 20 bp, human
ggttcctctgcccagatctg

SEQ ID NO: 94803 - DNA, 20 bp, human
gggatgttatggctgtgcct

SEQ ID NO: 94804 - DNA, 20 bp, human
ggttcaccaccaacacagag

SEQ ID NO: 94805 - DNA, 20 bp, human
ggtacttcaggtcactccca

SEQ ID NO: 94806 - DNA, 20 bp, human
gggcaggaagtggctctgcg

SEQ ID NO: 94807 - DNA, 20 bp, human
ggcggactgcgagggaaagg

SEQ ID NO: 94808 - DNA, 20 bp, human
gggcagctactccctggcag

SEQ ID NO: 94809 - DNA, 20 bp, human
gtggggcgtggagcttctcg

SEQ ID NO: 94810 - DNA, 20 bp, human
gtctgcggggaattgtgagg

SEQ ID NO: 94811 - DNA, 20 bp, human
gaaacaggttgcttctacca

SEQ ID NO: 94812 - DNA, 20 bp, human
gattgtgaggcggactgcga

SEQ ID NO: 94813 - DNA, 20 bp, human
gtggggctgagggtacagtt

SEQ ID NO: 94814 - DNA, 20 bp, human
ggatggcccaaagttcaggt

SEQ ID NO: 94815 - DNA, 20 bp, human
ggccccagggcaacacttgc

SEQ ID NO: 94816 - DNA, 20 bp, human
ggtcggacctggaactgcgg

SEQ ID NO: 94817 - DNA, 20 bp, human
gtgcgccgggcgggcaggat

SEQ ID NO: 94818 - DNA, 20 bp, human
gtcggagctgccccggaccg

SEQ ID NO: 94819 - DNA, 20 bp, human
ggagggccggatatcaccgt

SEQ ID NO: 94820 - DNA, 20 bp, human
gttgcggtagacatcccggg

SEQ ID NO: 94821 - DNA, 20 bp, human
ggcggcgtcctggccatggc

SEQ ID NO: 94822 - DNA, 20 bp, human
ggacgcccggacgcccgaca

SEQ ID NO: 94823 - DNA, 20 bp, human
gggcgccgcgcctcggtccg

SEQ ID NO: 94824 - DNA, 20 bp, human
gtggtgtcggtgatgggtcc

SEQ ID NO: 94825 - DNA, 20 bp, human
gctcgcggcccgccgctggt

SEQ ID NO: 94826 - DNA, 20 bp, human
gtccgggagacaggccgtaa

SEQ ID NO: 94827 - DNA, 20 bp, human
gcggagcttgtaaaacaccc

SEQ ID NO: 94828 - DNA, 20 bp, human
ggggccgcggcaacaagacg

SEQ ID NO: 94829 - DNA, 20 bp, human
ggtcgcagccgcgggaccag

SEQ ID NO: 94830 - DNA, 20 bp, human
gtcggacgagtcggacgtgg

SEQ ID NO: 94831 - DNA, 20 bp, human
ggggagacaggccgtaacgg

SEQ ID NO: 94832 - DNA, 20 bp, human
gccctcccaggaggctctct

SEQ ID NO: 94833 - DNA, 20 bp, human
gcggcggcgggaggaaagac

SEQ ID NO: 94834 - DNA, 20 bp, human
gggcttcagctcggacgagt

SEQ ID NO: 94835 - DNA, 20 bp, human
gtgggccagaggccgagatt

SEQ ID NO: 94836 - DNA, 20 bp, human
gcctccgaggaagaagggta

SEQ ID NO: 94837 - DNA, 20 bp, human
gtgtgtccggggctgcatgt

SEQ ID NO: 94838 - DNA, 20 bp, human
gtggctggcatcgctcaggt

SEQ ID NO: 94839 - DNA, 20 bp, human
ggtctcgaggggcccctccg

SEQ ID NO: 94840 - DNA, 20 bp, human
gcatgtgggcaacagttccg

SEQ ID NO: 94841 - DNA, 20 bp, human
gcgcagcccagtgtctcgag

SEQ ID NO: 94842 - DNA, 20 bp, human
ggctgtgcttgaccaaggat

SEQ ID NO: 94843 - DNA, 20 bp, human
gcagttccgaggaagggtgt

SEQ ID NO: 94844 - DNA, 20 bp, human
ggggcaacagttccgaggaa

SEQ ID NO: 94845 - DNA, 20 bp, human
gggggcccctccgaggaaga

SEQ ID NO: 94846 - DNA, 20 bp, human
gggacgtgccagctcttctt

SEQ ID NO: 94847 - DNA, 20 bp, human
gttcttgggcaagatattca

SEQ ID NO: 94848 - DNA, 20 bp, human
ggccaatcggaagtgcaaag

SEQ ID NO: 94849 - DNA, 20 bp, human
gatggcgtcgtagctgtcca

SEQ ID NO: 94850 - DNA, 20 bp, human
gtatcttgcccaagaagagc

SEQ ID NO: 94851 - DNA, 20 bp, human
gatttccttgaactgtccaa

SEQ ID NO: 94852 - DNA, 20 bp, human
gaatcggaagtgcaaagagg

SEQ ID NO: 94853 - DNA, 20 bp, human
gcgcttccggcccccaaccg

SEQ ID NO: 94854 - DNA, 20 bp, human
gggacaatgtcgcccgcgtg

SEQ ID NO: 94855 - DNA, 20 bp, human
ggcctcgtcacgccgcacgc

SEQ ID NO: 94856 - DNA, 20 bp, human
gacccaggcgatcagcaaca

SEQ ID NO: 94857 - DNA, 20 bp, human
gggggccccgagaactccaa

SEQ ID NO: 94858 - DNA, 20 bp, human
ggacacgccaacaaccaccc

SEQ ID NO: 94859 - DNA, 20 bp, human
gcgcgagcgtcgacagggtg

SEQ ID NO: 94860 - DNA, 20 bp, human
ggccgtgttgctgatcgcct

SEQ ID NO: 94861 - DNA, 20 bp, human
ggcaggctgggcgaaggcaa

SEQ ID NO: 94862 - DNA, 20 bp, human
ggctcctgcgcgtctttctg

SEQ ID NO: 94863 - DNA, 20 bp, human
gcccggtcaacggcgagtga

SEQ ID NO: 94864 - DNA, 20 bp, human
gcggggcaacacccggtcaa

SEQ ID NO: 94865 - DNA, 20 bp, human
gggctgggcgaaggcaaagg

SEQ ID NO: 94866 - DNA, 20 bp, human
gaggaaagcaagctgcgtaa

SEQ ID NO: 94867 - DNA, 20 bp, human
gatgcgctggatgacgtccg

SEQ ID NO: 94868 - DNA, 20 bp, human
gtcaggctctccaccaagga

SEQ ID NO: 94869 - DNA, 20 bp, human
gtgggccagagtcctcgcga

SEQ ID NO: 94870 - DNA, 20 bp, human
gggccgctgacgccactgtc

SEQ ID NO: 94871 - DNA, 20 bp, human
gccgcggctgtgcgcagcgg

SEQ ID NO: 94872 - DNA, 20 bp, human
gcacggagggcggctcccca

SEQ ID NO: 94873 - DNA, 20 bp, human
ggtcccagagcagcggtgtc

SEQ ID NO: 94874 - DNA, 20 bp, human
gcgaggtcgccccgcacgga

SEQ ID NO: 94875 - DNA, 20 bp, human
gtgaggctcggtgcatccat

SEQ ID NO: 94876 - DNA, 20 bp, human
gcgggagctgcccctaaccg

SEQ ID NO: 94877 - DNA, 20 bp, human
gccgctgctgcctcggttag

SEQ ID NO: 94878 - DNA, 20 bp, human
gacaggccagcgtagagtaa

SEQ ID NO: 94879 - DNA, 20 bp, human
gcagcggacgtgagcgataa

SEQ ID NO: 94880 - DNA, 20 bp, human
gcggacgtgagcgataatgg

SEQ ID NO: 94881 - DNA, 20 bp, human
gtggcctgtgcaaggcaagg

SEQ ID NO: 94882 - DNA, 20 bp, human
gtgagcgataatggcggata

SEQ ID NO: 94883 - DNA, 20 bp, human
ggcgataatggcggatatgg

SEQ ID NO: 94884 - DNA, 20 bp, human
gctctacgctggcctgtgca

SEQ ID NO: 94885 - DNA, 20 bp, human
gcggatatggaggatctctt

SEQ ID NO: 94886 - DNA, 20 bp, human
gcgccagcggttgcaaggta

SEQ ID NO: 94887 - DNA, 20 bp, human
gcgcagagcaaggcaatgtc

SEQ ID NO: 94888 - DNA, 20 bp, human
ggatcgggccgctataagag

SEQ ID NO: 94889 - DNA, 20 bp, human
gggcaggcatggagccccgt

SEQ ID NO: 94890 - DNA, 20 bp, human
gcggttgcaaggtaaggccc

SEQ ID NO: 94891 - DNA, 20 bp, human
ggtaggaatcgcagcgccag

SEQ ID NO: 94892 - DNA, 20 bp, human
gcgggccgctataagagggg

SEQ ID NO: 94893 - DNA, 20 bp, human
gtctgaaggagataaagttg

SEQ ID NO: 94894 - DNA, 20 bp, human
ggctctgcgggtaggaattc

SEQ ID NO: 94895 - DNA, 20 bp, human
gaccgggagctggggagcgt

SEQ ID NO: 94896 - DNA, 20 bp, human
gcccagttcgggagacatgg

SEQ ID NO: 94897 - DNA, 20 bp, human
gggccccagttcgggagaca

SEQ ID NO: 94898 - DNA, 20 bp, human
gcaaataggaaactgcggag

SEQ ID NO: 94899 - DNA, 20 bp, human
gccacaccccaagggacgaa

SEQ ID NO: 94900 - DNA, 20 bp, human
gccccaagggacgaagggag

SEQ ID NO: 94901 - DNA, 20 bp, human
gaggctgcccgggccgtggc

SEQ ID NO: 94902 - DNA, 20 bp, human
ggggcgttaaaggtacatcg

SEQ ID NO: 94903 - DNA, 20 bp, human
ggagacatggcgggcgttaa

SEQ ID NO: 94904 - DNA, 20 bp, human
gggcttgaccggaacggagg

SEQ ID NO: 94905 - DNA, 20 bp, human
gcagaagaaaggcgttaggg

SEQ ID NO: 94906 - DNA, 20 bp, human
gaggtctgagggagcgatgg

SEQ ID NO: 94907 - DNA, 20 bp, human
gatcgctccctcagacctaa

SEQ ID NO: 94908 - DNA, 20 bp, human
gggtggctggcggttccgtt

SEQ ID NO: 94909 - DNA, 20 bp, human
ggcggttccgttaggtctga

SEQ ID NO: 94910 - DNA, 20 bp, human
gggtaggactccggccttgg

SEQ ID NO: 94911 - DNA, 20 bp, human
gcaggtctgcaccttgaagt

SEQ ID NO: 94912 - DNA, 20 bp, human
gtcgagtccgaggcaggatg

SEQ ID NO: 94913 - DNA, 20 bp, human
ggtcggcggcacactgggtg

SEQ ID NO: 94914 - DNA, 20 bp, human
gaggactccggccttggtgg

SEQ ID NO: 94915 - DNA, 20 bp, human
ggcgacctgagcttcttcgg

SEQ ID NO: 94916 - DNA, 20 bp, human
ggagcgccggcggtcacctg

SEQ ID NO: 94917 - DNA, 20 bp, human
gcggcgctccgcgtactgag

SEQ ID NO: 94918 - DNA, 20 bp, human
gcgctccgcgtactgagagg

SEQ ID NO: 94919 - DNA, 20 bp, human
gctgcagcgggcctacatca

SEQ ID NO: 94920 - DNA, 20 bp, human
ggcctccgcctctcagtacg

SEQ ID NO: 94921 - DNA, 20 bp, human
ggactgaacagagatgacgg

SEQ ID NO: 94922 - DNA, 20 bp, human
ggcgcggccgcctactacag

SEQ ID NO: 94923 - DNA, 20 bp, human
ggagcgtgtgagagccgcag

SEQ ID NO: 94924 - DNA, 20 bp, human
gcagcgcgcccgccccaaca

SEQ ID NO: 94925 - DNA, 20 bp, human
gtggcgtagagcaggtcgaa

SEQ ID NO: 94926 - DNA, 20 bp, human
gggtcaggcagtctgcgcgg

SEQ ID NO: 94927 - DNA, 20 bp, human
gcggcagccgaggggaaatg

SEQ ID NO: 94928 - DNA, 20 bp, human
ggacccagtgcgcagcacgg

SEQ ID NO: 94929 - DNA, 20 bp, human
ggtagttgtagggctcccga

SEQ ID NO: 94930 - DNA, 20 bp, human
gctgggtcaggcagtctgcg

SEQ ID NO: 94931 - DNA, 20 bp, human
gacagctgggtcaggccggg

SEQ ID NO: 94932 - DNA, 20 bp, human
ggttgtagggctcccgacgg

SEQ ID NO: 94933 - DNA, 20 bp, human
gcgagctgcgcggccgatcc

SEQ ID NO: 94934 - DNA, 20 bp, human
gggcgcggcgcgcttcgcgt

SEQ ID NO: 94935 - DNA, 20 bp, human
gcggctcccgcatttcccct

SEQ ID NO: 94936 - DNA, 20 bp, human
gcgtagtgcaggtactggta

SEQ ID NO: 94937 - DNA, 20 bp, human
ggcagctgccgcggcgggta

SEQ ID NO: 94938 - DNA, 20 bp, human
ggagagcgcgcgctacctgg

SEQ ID NO: 94939 - DNA, 20 bp, human
gccaggtgccctacccgccg

SEQ ID NO: 94940 - DNA, 20 bp, human
gcatggctcgggtggcgtgg

SEQ ID NO: 94941 - DNA, 20 bp, human
gggcggctcgctccaggacg

SEQ ID NO: 94942 - DNA, 20 bp, human
gcagcgcgtagtgcaggtac

SEQ ID NO: 94943 - DNA, 20 bp, human
gcagcccgagacaggtcccc

SEQ ID NO: 94944 - DNA, 20 bp, human
gggagcgagccgcctgcctg

SEQ ID NO: 94945 - DNA, 20 bp, human
gcggccaagcccgatcccga

SEQ ID NO: 94946 - DNA, 20 bp, human
ggggcgttaaaggtacatcg

SEQ ID NO: 94947 - DNA, 20 bp, human
gcccagttcgggagacatgg

SEQ ID NO: 94948 - DNA, 20 bp, human
gggccccagttcgggagaca

SEQ ID NO: 94949 - DNA, 20 bp, human
gcaaataggaaactgcggag

SEQ ID NO: 94950 - DNA, 20 bp, human
gccacaccccaagggacgaa

SEQ ID NO: 94951 - DNA, 20 bp, human
gccccaagggacgaagggag

SEQ ID NO: 94952 - DNA, 20 bp, human
gcagaagaaaggcgttaggg

SEQ ID NO: 94953 - DNA, 20 bp, human
gttagggtggcgtcaagaag

SEQ ID NO: 94954 - DNA, 20 bp, human
gggcttgaccggaacggagg

SEQ ID NO: 94955 - DNA, 20 bp, human
ggccccaggcttgaccggaa

SEQ ID NO: 94956 - DNA, 20 bp, human
gccacctccgggccaagcgc

SEQ ID NO: 94957 - DNA, 20 bp, human
gctggctccacgacccgagg

SEQ ID NO: 94958 - DNA, 20 bp, human
gctcctggctccacgacccg

SEQ ID NO: 94959 - DNA, 20 bp, human
gagagaggcaggcagagcgt

SEQ ID NO: 94960 - DNA, 20 bp, human
gggagacccaagacgcgcta

SEQ ID NO: 94961 - DNA, 20 bp, human
gaggagcgacgtcaccgcca

SEQ ID NO: 94962 - DNA, 20 bp, human
gggagagaggctgccgaaat

SEQ ID NO: 94963 - DNA, 20 bp, human
ggagtttgcatccgagagag

SEQ ID NO: 94964 - DNA, 20 bp, human
ggcagagcgtgggattgaga

SEQ ID NO: 94965 - DNA, 20 bp, human
gcgaaatcggcagaaagtgg

SEQ ID NO: 94966 - DNA, 20 bp, human
gaccagcggcggccttgtcc

SEQ ID NO: 94967 - DNA, 20 bp, human
gctcaaggacccggcaccag

SEQ ID NO: 94968 - DNA, 20 bp, human
gccgcgcggacggctgacag

SEQ ID NO: 94969 - DNA, 20 bp, human
gcgcggacggctgacagagg

SEQ ID NO: 94970 - DNA, 20 bp, human
gcagcccgcgacgagacccg

SEQ ID NO: 94971 - DNA, 20 bp, human
gtccggaggccgggaccacc

SEQ ID NO: 94972 - DNA, 20 bp, human
gggacgtctgtgccgggaca

SEQ ID NO: 94973 - DNA, 20 bp, human
gcgcctaaggtcacaacaca

SEQ ID NO: 94974 - DNA, 20 bp, human
gtcccggcacagacgtccgg

SEQ ID NO: 94975 - DNA, 20 bp, human
gaaggacccggcaccagcgg

SEQ ID NO: 94976 - DNA, 20 bp, human
gagcccggccgaggaggtag

SEQ ID NO: 94977 - DNA, 20 bp, human
gcgggacccccaagctagaa

SEQ ID NO: 94978 - DNA, 20 bp, human
gtctggtgcggaggtgggac

SEQ ID NO: 94979 - DNA, 20 bp, human
gcgccgggcgaggaagccga

SEQ ID NO: 94980 - DNA, 20 bp, human
gcgaccctcgtggatgatcg

SEQ ID NO: 94981 - DNA, 20 bp, human
gtcggccgggctccgcggaa

SEQ ID NO: 94982 - DNA, 20 bp, human
gaggcggaaccgtagagact

SEQ ID NO: 94983 - DNA, 20 bp, human
gtagcttgggggtcccggga

SEQ ID NO: 94984 - DNA, 20 bp, human
ggacctaggcggccgttccg

SEQ ID NO: 94985 - DNA, 20 bp, human
gtcgggcccttctagcttgg

SEQ ID NO: 94986 - DNA, 20 bp, human
gtgccactggagaacgggag

SEQ ID NO: 94987 - DNA, 20 bp, human
gaggtcctgccactggagaa

SEQ ID NO: 94988 - DNA, 20 bp, human
gagatgaccgcggatcactc

SEQ ID NO: 94989 - DNA, 20 bp, human
gttcccctcccgttctccag

SEQ ID NO: 94990 - DNA, 20 bp, human
gtggcaggacctccacctga

SEQ ID NO: 94991 - DNA, 20 bp, human
gcagggagggtagatgaccg

SEQ ID NO: 94992 - DNA, 20 bp, human
gagggacgttctccttcagg

SEQ ID NO: 94993 - DNA, 20 bp, human
gccagagccagagtgatccg

SEQ ID NO: 94994 - DNA, 20 bp, human
ggtgcgggacaggagcaaaa

SEQ ID NO: 94995 - DNA, 20 bp, human
gtactcacctccccactgag

SEQ ID NO: 94996 - DNA, 20 bp, human
gctgggctcggtcggctgtg

SEQ ID NO: 94997 - DNA, 20 bp, human
gttggggggcccctcggtga

SEQ ID NO: 94998 - DNA, 20 bp, human
ggtgaagatggcgctctcca

SEQ ID NO: 94999 - DNA, 20 bp, human
gagggtgtgctgggctcggt

SEQ ID NO: 95000 - DNA, 20 bp, human
gtgcaggctaagtcagaaag

SEQ ID NO: 95001 - DNA, 20 bp, human
gggtggaatcgagatagcag

SEQ ID NO: 95002 - DNA, 20 bp, human
ggcgctctccagggtgtgct

SEQ ID NO: 95003 - DNA, 20 bp, human
gaacctgagccgaaaaagtg

SEQ ID NO: 95004 - DNA, 20 bp, human
gtcttcacagcgagagaagc

SEQ ID NO: 95005 - DNA, 20 bp, human
gtggggcactgagagtacag

SEQ ID NO: 95006 - DNA, 20 bp, human
gtgacaggcaggttccacgg

SEQ ID NO: 95007 - DNA, 20 bp, human
ggcctgacaggcaggttcca

SEQ ID NO: 95008 - DNA, 20 bp, human
ggaaaggccaaccaaggtcg

SEQ ID NO: 95009 - DNA, 20 bp, human
ggttgtgggagaggaatatc

SEQ ID NO: 95010 - DNA, 20 bp, human
gcaggttccacggaggcatg

SEQ ID NO: 95011 - DNA, 20 bp, human
gttccaggtgcccgcctgac

SEQ ID NO: 95012 - DNA, 20 bp, human
gtatcgggaaaagctcaaac

SEQ ID NO: 95013 - DNA, 20 bp, human
gcaacacacctcaactacag

SEQ ID NO: 95014 - DNA, 20 bp, human
gaggtgcccgcctgacaggc

SEQ ID NO: 95015 - DNA, 20 bp, human
gtaagaggccactgtagttg

SEQ ID NO: 95016 - DNA, 20 bp, human
gggagcgacgggcttcgggt

SEQ ID NO: 95017 - DNA, 20 bp, human
gcgcagcgcttgagcatggt

SEQ ID NO: 95018 - DNA, 20 bp, human
gactgcgccgccggagcgac

SEQ ID NO: 95019 - DNA, 20 bp, human
gcagcgatgaagacgtctcg

SEQ ID NO: 95020 - DNA, 20 bp, human
gagacgtctcggggcgcgag

SEQ ID NO: 95021 - DNA, 20 bp, human
gccgaagcccgtcgctccgg

SEQ ID NO: 95022 - DNA, 20 bp, human
gaccagctggaccagatggt

SEQ ID NO: 95023 - DNA, 20 bp, human
gcgcccacagatggccctag

SEQ ID NO: 95024 - DNA, 20 bp, human
ggctggtggcagtgtcccat

SEQ ID NO: 95025 - DNA, 20 bp, human
gcggtgcaaggcaggcgcac

SEQ ID NO: 95026 - DNA, 20 bp, human
ggaagggtgtggccaactgg

SEQ ID NO: 95027 - DNA, 20 bp, human
gatcctcctggactcaatca

SEQ ID NO: 95028 - DNA, 20 bp, human
ggactccacccgagagagat

SEQ ID NO: 95029 - DNA, 20 bp, human
gacagctggtgcgcctgccc

SEQ ID NO: 95030 - DNA, 20 bp, human
gaaagggtgggagcgtccgg

SEQ ID NO: 95031 - DNA, 20 bp, human
ggtgaccgggacagctgcag

SEQ ID NO: 95032 - DNA, 20 bp, human
gggggcccatctctctcggg

SEQ ID NO: 95033 - DNA, 20 bp, human
ggctgcagaatgtcaaccct

SEQ ID NO: 95034 - DNA, 20 bp, human
gagccatgattgagtccagg

SEQ ID NO: 95035 - DNA, 20 bp, human
ggagtccaggaggatgttcc

SEQ ID NO: 95036 - DNA, 20 bp, human
gctggaggccatcaactaca

SEQ ID NO: 95037 - DNA, 20 bp, human
ggatggcctccaggttgagg

SEQ ID NO: 95038 - DNA, 20 bp, human
gcccaaccgcctcaacctgg

SEQ ID NO: 95039 - DNA, 20 bp, human
gctgtgtgctagggcccact

SEQ ID NO: 95040 - DNA, 20 bp, human
gagcccatggcccccaataa

SEQ ID NO: 95041 - DNA, 20 bp, human
gttccccaaccgcctcaacc

SEQ ID NO: 95042 - DNA, 20 bp, human
gtcaactacatggcagctga

SEQ ID NO: 95043 - DNA, 20 bp, human
gggcagcttgacggtcaggt

SEQ ID NO: 95044 - DNA, 20 bp, human
gacccagcggaagacgtcat

SEQ ID NO: 95045 - DNA, 20 bp, human
gtagtgacggggcagaagac

SEQ ID NO: 95046 - DNA, 20 bp, human
gcattgcagagagaagccag

SEQ ID NO: 95047 - DNA, 20 bp, human
gtgtgctgcagacccggagt

SEQ ID NO: 95048 - DNA, 20 bp, human
gtcaccgggtggaagactgg

SEQ ID NO: 95049 - DNA, 20 bp, human
gaagagcccagagaccgagg

SEQ ID NO: 95050 - DNA, 20 bp, human
gagagtgacaactcaccggg

SEQ ID NO: 95051 - DNA, 20 bp, human
ggtcgcccgctgccctccta

SEQ ID NO: 95052 - DNA, 20 bp, human
gagatgagtcagcccagtgg

SEQ ID NO: 95053 - DNA, 20 bp, human
ggggaagagcccagagaccg

SEQ ID NO: 95054 - DNA, 20 bp, human
gcccggagtgggtagttagt

SEQ ID NO: 95055 - DNA, 20 bp, human
gtggccatgtgctgcagacc

SEQ ID NO: 95056 - DNA, 20 bp, human
gagactggactcaattctga

SEQ ID NO: 95057 - DNA, 20 bp, human
gattctgaaggtcgccaaga

SEQ ID NO: 95058 - DNA, 20 bp, human
gggacgagcaggtgtgtgaa

SEQ ID NO: 95059 - DNA, 20 bp, human
ggtgtgtgaatggagagtaa

SEQ ID NO: 95060 - DNA, 20 bp, human
gacttagagctattgaggtg

SEQ ID NO: 95061 - DNA, 20 bp, human
gcactcaccgaaggttacac

SEQ ID NO: 95062 - DNA, 20 bp, human
gaccacctcacactcaccga

SEQ ID NO: 95063 - DNA, 20 bp, human
gcacacctgctcgtcctggt

SEQ ID NO: 95064 - DNA, 20 bp, human
gctgatgagcataaactctg

SEQ ID NO: 95065 - DNA, 20 bp, human
gacatactcacatcatagac

SEQ ID NO: 95066 - DNA, 20 bp, human
gctccttctgggcagctctt

SEQ ID NO: 95067 - DNA, 20 bp, human
gtctgtgtgaatctctgagt

SEQ ID NO: 95068 - DNA, 20 bp, human
gacacacttgccggtcctgg

SEQ ID NO: 95069 - DNA, 20 bp, human
ggtggtatctgagatgattg

SEQ ID NO: 95070 - DNA, 20 bp, human
gctcacacacttgccggtcc

SEQ ID NO: 95071 - DNA, 20 bp, human
gacctcccctgtttctttct

SEQ ID NO: 95072 - DNA, 20 bp, human
gagtgtgtgagtgagtgtaa

SEQ ID NO: 95073 - DNA, 20 bp, human
gccagtgtaaccctctgtga

SEQ ID NO: 95074 - DNA, 20 bp, human
gcaccaccacaccctcacag

SEQ ID NO: 95075 - DNA, 20 bp, human
gaccctctgtgagggtgtgg

SEQ ID NO: 95076 - DNA, 20 bp, human
ggaaggtcgcccagaaggag

SEQ ID NO: 95077 - DNA, 20 bp, human
gagactggacacaattccga

SEQ ID NO: 95078 - DNA, 20 bp, human
gttctaactgtgagttgaaa

SEQ ID NO: 95079 - DNA, 20 bp, human
gtgagatgcttgtagcatgt

SEQ ID NO: 95080 - DNA, 20 bp, human
gcagagggttacatttgtcc

SEQ ID NO: 95081 - DNA, 20 bp, human
gatggcacaccaggtcaagc

SEQ ID NO: 95082 - DNA, 20 bp, human
ggcatgtgggttgtggatcc

SEQ ID NO: 95083 - DNA, 20 bp, human
ggggaggtggatggcacacc

SEQ ID NO: 95084 - DNA, 20 bp, human
gcacaaacacctgcttgacc

SEQ ID NO: 95085 - DNA, 20 bp, human
gaaataccccacatctttct

SEQ ID NO: 95086 - DNA, 20 bp, human
gatgcaggcggggagacaca

SEQ ID NO: 95087 - DNA, 20 bp, human
gtcatggtgacagctcctgg

SEQ ID NO: 95088 - DNA, 20 bp, human
gtccctcaaggtcctaggtg

SEQ ID NO: 95089 - DNA, 20 bp, human
ggcccagagagggacagcaa

SEQ ID NO: 95090 - DNA, 20 bp, human
gtcctcacctaggaccttga

SEQ ID NO: 95091 - DNA, 20 bp, human
ggtactgggagatgcaggcg

SEQ ID NO: 95092 - DNA, 20 bp, human
gcccagtacccagcacaaac

SEQ ID NO: 95093 - DNA, 20 bp, human
gcagcaaagaagttggacag

SEQ ID NO: 95094 - DNA, 20 bp, human
ggctagtgtcctcaccgtca

SEQ ID NO: 95095 - DNA, 20 bp, human
gttaactccctcaaggtcct

SEQ ID NO: 95096 - DNA, 20 bp, human
gtccggagccagccaacgag

SEQ ID NO: 95097 - DNA, 20 bp, human
gcgcgcagctcaccgctcgt

SEQ ID NO: 95098 - DNA, 20 bp, human
gccgccgccccgctcctgga

SEQ ID NO: 95099 - DNA, 20 bp, human
gccctcgcagcgggacctgg

SEQ ID NO: 95100 - DNA, 20 bp, human
gccagactgcggctcgtcac

SEQ ID NO: 95101 - DNA, 20 bp, human
gcagcgccctcgataatcaa

SEQ ID NO: 95102 - DNA, 20 bp, human
gccggatggggcttactctg

SEQ ID NO: 95103 - DNA, 20 bp, human
ggacgtgtgtgggtctcgta

SEQ ID NO: 95104 - DNA, 20 bp, human
gtgcggctcgtcaccggatg

SEQ ID NO: 95105 - DNA, 20 bp, human
gaccgctcgttggctggctc

SEQ ID NO: 95106 - DNA, 20 bp, human
ggcctgaccacgctccatac

SEQ ID NO: 95107 - DNA, 20 bp, human
gggagaggcttctgggtcaa

SEQ ID NO: 95108 - DNA, 20 bp, human
gcccagtatggagcgtggtc

SEQ ID NO: 95109 - DNA, 20 bp, human
gccagaagcctctcccagta

SEQ ID NO: 95110 - DNA, 20 bp, human
gctgcctctagctctcaggt

SEQ ID NO: 95111 - DNA, 20 bp, human
ggaagcgaggaggctccaca

SEQ ID NO: 95112 - DNA, 20 bp, human
gcttgcctgtgtagagagag

SEQ ID NO: 95113 - DNA, 20 bp, human
gtgcagagggatcctgtggc

SEQ ID NO: 95114 - DNA, 20 bp, human
gcctctcccagtatggagcg

SEQ ID NO: 95115 - DNA, 20 bp, human
gggtagctgcaacggccgtg

SEQ ID NO: 95116 - DNA, 20 bp, human
gtcccgggcgggctcaacgt

SEQ ID NO: 95117 - DNA, 20 bp, human
gggacataggccatcgctcg

SEQ ID NO: 95118 - DNA, 20 bp, human
gcagggtaggagtaaatcga

SEQ ID NO: 95119 - DNA, 20 bp, human
gtcgctcgaggctgcgctag

SEQ ID NO: 95120 - DNA, 20 bp, human
gtagcccggtgcggggacat

SEQ ID NO: 95121 - DNA, 20 bp, human
gccgggatgggctggtagta

SEQ ID NO: 95122 - DNA, 20 bp, human
gatctcaccgggttgtaggt

SEQ ID NO: 95123 - DNA, 20 bp, human
ggcctgagctggcatctcac

SEQ ID NO: 95124 - DNA, 20 bp, human
gaaggcagcgtctggagaag

SEQ ID NO: 95125 - DNA, 20 bp, human
gtcgaggctgcgctagtggc

SEQ ID NO: 95126 - DNA, 20 bp, human
gggtgaggccccaggcccta

SEQ ID NO: 95127 - DNA, 20 bp, human
ggggcctcacctgctggcat

SEQ ID NO: 95128 - DNA, 20 bp, human
gcacagcccaggccagtccg

SEQ ID NO: 95129 - DNA, 20 bp, human
gtgagactggcagaaatcag

SEQ ID NO: 95130 - DNA, 20 bp, human
gtgagtgctccaggggcccg

SEQ ID NO: 95131 - DNA, 20 bp, human
gccctcagaggagccgacca

SEQ ID NO: 95132 - DNA, 20 bp, human
gtgccagggcggatgccctc

SEQ ID NO: 95133 - DNA, 20 bp, human
gcccagaggaagccacaaag

SEQ ID NO: 95134 - DNA, 20 bp, human
gatgtccgtgagtgctccag

SEQ ID NO: 95135 - DNA, 20 bp, human
gcggtgagaccgaaggaggg

SEQ ID NO: 95136 - DNA, 20 bp, human
gtgagtgctccaggggcccg

SEQ ID NO: 95137 - DNA, 20 bp, human
gtgagactggcagaaatcag

SEQ ID NO: 95138 - DNA, 20 bp, human
gcacagcccaggccagtccg

SEQ ID NO: 95139 - DNA, 20 bp, human
gcctggagcactcacggaca

SEQ ID NO: 95140 - DNA, 20 bp, human
gacatggctgggaccgggtt

SEQ ID NO: 95141 - DNA, 20 bp, human
gcggtctcaccggctcacag

SEQ ID NO: 95142 - DNA, 20 bp, human
gcgggcagtgaggacttgtg

SEQ ID NO: 95143 - DNA, 20 bp, human
gccctcagaggagccgacca

SEQ ID NO: 95144 - DNA, 20 bp, human
gcggtgagaccgaaggaggg

SEQ ID NO: 95145 - DNA, 20 bp, human
gctgcaagagtggggtgcag

SEQ ID NO: 95146 - DNA, 20 bp, human
gccagagccgggaaccctga

SEQ ID NO: 95147 - DNA, 20 bp, human
gcagcagctaagtgccgtca

SEQ ID NO: 95148 - DNA, 20 bp, human
gctgcaggcgaggcgctccg

SEQ ID NO: 95149 - DNA, 20 bp, human
gcggctctggcgtccgtggg

SEQ ID NO: 95150 - DNA, 20 bp, human
gtcccggctctggcgtccgt

SEQ ID NO: 95151 - DNA, 20 bp, human
gtaagtgccgtcagggttcc

SEQ ID NO: 95152 - DNA, 20 bp, human
ggctcggcctcaggctagga

SEQ ID NO: 95153 - DNA, 20 bp, human
gctccaagtggaggaatctg

SEQ ID NO: 95154 - DNA, 20 bp, human
ggcgcgactcacccaaagac

SEQ ID NO: 95155 - DNA, 20 bp, human
ggacccgccggtcctcaccg

SEQ ID NO: 95156 - DNA, 20 bp, human
gaactcactggactcaggta

SEQ ID NO: 95157 - DNA, 20 bp, human
gctacaaaggacttcctagt

SEQ ID NO: 95158 - DNA, 20 bp, human
ggaagacatgtagagcgggg

SEQ ID NO: 95159 - DNA, 20 bp, human
gatatcagaggaggtcatcc

SEQ ID NO: 95160 - DNA, 20 bp, human
gtaagtcgttccctctacaa

SEQ ID NO: 95161 - DNA, 20 bp, human
gcggggtggttcatgtaaag

SEQ ID NO: 95162 - DNA, 20 bp, human
gcaggggaagacatgtagag

SEQ ID NO: 95163 - DNA, 20 bp, human
gtgtcaaagccatgactcgt

SEQ ID NO: 95164 - DNA, 20 bp, human
gagggcagaaatatcagagg

SEQ ID NO: 95165 - DNA, 20 bp, human
gtgtcttcccctgagcacac

SEQ ID NO: 95166 - DNA, 20 bp, human
gcggtggagatggccttcag

SEQ ID NO: 95167 - DNA, 20 bp, human
gctcctgggtggcaggagac

SEQ ID NO: 95168 - DNA, 20 bp, human
gtgtcaaacccatgattcat

SEQ ID NO: 95169 - DNA, 20 bp, human
gactgcctggcaggtgtgaa

SEQ ID NO: 95170 - DNA, 20 bp, human
gaactcactgggctcagata

SEQ ID NO: 95171 - DNA, 20 bp, human
gcaggtgtgaaaggcagcgg

SEQ ID NO: 95172 - DNA, 20 bp, human
gccttctgcaaaggactgcc

SEQ ID NO: 95173 - DNA, 20 bp, human
gtagttaagggtgcgtactg

SEQ ID NO: 95174 - DNA, 20 bp, human
gcacggccctggaactcact

SEQ ID NO: 95175 - DNA, 20 bp, human
ggccacagaggcggtggaga

SEQ ID NO: 95176 - DNA, 20 bp, human
gactgcctggcaggtgtcaa

SEQ ID NO: 95177 - DNA, 20 bp, human
gtcctgggtggcaggagata

SEQ ID NO: 95178 - DNA, 20 bp, human
gactgcctttgacacctgcc

SEQ ID NO: 95179 - DNA, 20 bp, human
gatggccttcagcggttgcc

SEQ ID NO: 95180 - DNA, 20 bp, human
ggccagggggacacagttct

SEQ ID NO: 95181 - DNA, 20 bp, human
gccagtgagttccggggccg

SEQ ID NO: 95182 - DNA, 20 bp, human
gaactcactgggctcagata

SEQ ID NO: 95183 - DNA, 20 bp, human
gcaggtgtcaaaggcagtgg

SEQ ID NO: 95184 - DNA, 20 bp, human
gcacagaggcggtggagaga

SEQ ID NO: 95185 - DNA, 20 bp, human
gccttctgcaaaggactgcc

SEQ ID NO: 95186 - DNA, 20 bp, human
ggctgcccgaccaagaaaag

SEQ ID NO: 95187 - DNA, 20 bp, human
gccccggacccgggccgacg

SEQ ID NO: 95188 - DNA, 20 bp, human
gggcgcgcgcacacacgagg

SEQ ID NO: 95189 - DNA, 20 bp, human
gcggcagcaagcagccccgt

SEQ ID NO: 95190 - DNA, 20 bp, human
gtgcttgccgcggcccagaa

SEQ ID NO: 95191 - DNA, 20 bp, human
ggccgcgccgggcaagaaga

SEQ ID NO: 95192 - DNA, 20 bp, human
ggaggcagcgcgagctggga

SEQ ID NO: 95193 - DNA, 20 bp, human
ggccgacagcgatgccgtgg

SEQ ID NO: 95194 - DNA, 20 bp, human
ggcggcggagtgcgggacgg

SEQ ID NO: 95195 - DNA, 20 bp, human
gttcccgagccgggccccgg

SEQ ID NO: 95196 - DNA, 20 bp, human
gccagcaatgcactgctcgg

SEQ ID NO: 95197 - DNA, 20 bp, human
gtcgggggaagagacctgtg

SEQ ID NO: 95198 - DNA, 20 bp, human
gtgaggtactgtgagatggg

SEQ ID NO: 95199 - DNA, 20 bp, human
gacggtgcgtggaatggatc

SEQ ID NO: 95200 - DNA, 20 bp, human
gggaggaacggtgcgtggaa

SEQ ID NO: 95201 - DNA, 20 bp, human
gctctaagaacaggtcacat

SEQ ID NO: 95202 - DNA, 20 bp, human
ggagataacatcaggaggaa

SEQ ID NO: 95203 - DNA, 20 bp, human
gggagggatccaactgctgg

SEQ ID NO: 95204 - DNA, 20 bp, human
gaagcgcagataagagacat

SEQ ID NO: 95205 - DNA, 20 bp, human
ggcagtgcattgctggagcg

SEQ ID NO: 95206 - DNA, 20 bp, human
gtgtcgcccggcacgatcct

SEQ ID NO: 95207 - DNA, 20 bp, human
ggggcgcgagtgctgatgtc

SEQ ID NO: 95208 - DNA, 20 bp, human
gtgtcaggcaggcgcgagtg

SEQ ID NO: 95209 - DNA, 20 bp, human
ggccagaggcaactccctcg

SEQ ID NO: 95210 - DNA, 20 bp, human
gtggaggggtcccactcaca

SEQ ID NO: 95211 - DNA, 20 bp, human
gccgctgctggcgaggacta

SEQ ID NO: 95212 - DNA, 20 bp, human
ggccacttgcagctgtacca

SEQ ID NO: 95213 - DNA, 20 bp, human
gaggagtctatcatctgcgt

SEQ ID NO: 95214 - DNA, 20 bp, human
gagaggcaactccctcgcgg

SEQ ID NO: 95215 - DNA, 20 bp, human
ggacctgagccccagaatct

SEQ ID NO: 95216 - DNA, 20 bp, human
gacagggagatgacctccga

SEQ ID NO: 95217 - DNA, 20 bp, human
gggccccagggagagatcgc

SEQ ID NO: 95218 - DNA, 20 bp, human
ggccttctgcgtggactcaa

SEQ ID NO: 95219 - DNA, 20 bp, human
gcgctcccgcgatccggctc

SEQ ID NO: 95220 - DNA, 20 bp, human
gtctctcccgagccggatcg

SEQ ID NO: 95221 - DNA, 20 bp, human
gcctgctcgctcccgcgatc

SEQ ID NO: 95222 - DNA, 20 bp, human
gcaacccccaaggccagggc

SEQ ID NO: 95223 - DNA, 20 bp, human
gcccaggaacctgccctcgg

SEQ ID NO: 95224 - DNA, 20 bp, human
gtcgcgggagcgagcagggg

SEQ ID NO: 95225 - DNA, 20 bp, human
gtgcccgcgatctctccctg

SEQ ID NO: 95226 - DNA, 20 bp, human
gtccggggagccctcacaca

SEQ ID NO: 95227 - DNA, 20 bp, human
gtggcctggagacccccaaa

SEQ ID NO: 95228 - DNA, 20 bp, human
gaagcgggtgcctcagagtg

SEQ ID NO: 95229 - DNA, 20 bp, human
ggtgccagcaggcggatgga

SEQ ID NO: 95230 - DNA, 20 bp, human
gaagctgacgggcaggtccg

SEQ ID NO: 95231 - DNA, 20 bp, human
gctgctggcacgctcggccc

SEQ ID NO: 95232 - DNA, 20 bp, human
gttagagcaggagcagcgca

SEQ ID NO: 95233 - DNA, 20 bp, human
gcaaagacatacgaacaggg

SEQ ID NO: 95234 - DNA, 20 bp, human
gggtggaggaggagacgtag

SEQ ID NO: 95235 - DNA, 20 bp, human
gaagacagcgccctgtgtga

SEQ ID NO: 95236 - DNA, 20 bp, human
ggcgggaccgtgagaactcg

SEQ ID NO: 95237 - DNA, 20 bp, human
gcaccaaacacccacgacgt

SEQ ID NO: 95238 - DNA, 20 bp, human
gggaccgtgagaactcgcgg

SEQ ID NO: 95239 - DNA, 20 bp, human
gacagcagtgccgacgtcgt

SEQ ID NO: 95240 - DNA, 20 bp, human
ggagccgccgcgagttctca

SEQ ID NO: 95241 - DNA, 20 bp, human
gctgtggcaggcgaccgtgg

SEQ ID NO: 95242 - DNA, 20 bp, human
gctggaagggctcagtgctc

SEQ ID NO: 95243 - DNA, 20 bp, human
gcaagccccagtcccagtag

SEQ ID NO: 95244 - DNA, 20 bp, human
ggcagccaagggcccctact

SEQ ID NO: 95245 - DNA, 20 bp, human
ggtggcccttaagcgaggag

SEQ ID NO: 95246 - DNA, 20 bp, human
gagagcgtgcaaccctagaa

SEQ ID NO: 95247 - DNA, 20 bp, human
gacgggaagagattgagccg

SEQ ID NO: 95248 - DNA, 20 bp, human
gggcggcgggggacatcgga

SEQ ID NO: 95249 - DNA, 20 bp, human
ggagacagcgagccagagtc

SEQ ID NO: 95250 - DNA, 20 bp, human
gtgcaaccctagaagggaaa

SEQ ID NO: 95251 - DNA, 20 bp, human
ggctcgctgtctcccagccg

SEQ ID NO: 95252 - DNA, 20 bp, human
gagcaatgccgggcccgcta

SEQ ID NO: 95253 - DNA, 20 bp, human
gcgcacaaacacccagactc

SEQ ID NO: 95254 - DNA, 20 bp, human
gtgcataagccagcggccgg

SEQ ID NO: 95255 - DNA, 20 bp, human
gctgctccatggacgcgcag

SEQ ID NO: 95256 - DNA, 20 bp, human
gtgctgcagctggcgaccgg

SEQ ID NO: 95257 - DNA, 20 bp, human
gggtggactgctccgacctg

SEQ ID NO: 95258 - DNA, 20 bp, human
ggacggcaggatgttgctca

SEQ ID NO: 95259 - DNA, 20 bp, human
gagaagcgcggcggggacag

SEQ ID NO: 95260 - DNA, 20 bp, human
ggccacggcccgtagcagtc

SEQ ID NO: 95261 - DNA, 20 bp, human
gctgctgctcgcggcctgag

SEQ ID NO: 95262 - DNA, 20 bp, human
ggccacgagccggacgcggg

SEQ ID NO: 95263 - DNA, 20 bp, human
ggaggtgaagacgctgaggt

SEQ ID NO: 95264 - DNA, 20 bp, human
gtctctcccggagtgacgtg

SEQ ID NO: 95265 - DNA, 20 bp, human
gccatggtgcccgaagtagg

SEQ ID NO: 95266 - DNA, 20 bp, human
gccgccccaggggctctatt

SEQ ID NO: 95267 - DNA, 20 bp, human
gccccaggggctctattggg

SEQ ID NO: 95268 - DNA, 20 bp, human
ggccgcccaatagagcccct

SEQ ID NO: 95269 - DNA, 20 bp, human
ggggctctattgggcggcgg

SEQ ID NO: 95270 - DNA, 20 bp, human
gccctgctgaggccgggact

SEQ ID NO: 95271 - DNA, 20 bp, human
ggcagcccgcaggaccaggc

SEQ ID NO: 95272 - DNA, 20 bp, human
ggggtccaggtcccccggaa

SEQ ID NO: 95273 - DNA, 20 bp, human
gctccgggaagcgcacagcg

SEQ ID NO: 95274 - DNA, 20 bp, human
gtccaggtcccccggaacgg

SEQ ID NO: 95275 - DNA, 20 bp, human
gtcacaggtaagccgtcagg

SEQ ID NO: 95276 - DNA, 20 bp, human
gtaatgcggaagcccctgaa

SEQ ID NO: 95277 - DNA, 20 bp, human
gtgcggaagcccctgaaagg

SEQ ID NO: 95278 - DNA, 20 bp, human
gcaccacaaccgcctttcag

SEQ ID NO: 95279 - DNA, 20 bp, human
ggaagctcccagactgaagg

SEQ ID NO: 95280 - DNA, 20 bp, human
gagcccctgaaaggcggttg

SEQ ID NO: 95281 - DNA, 20 bp, human
ggtgatgtgatcccaagaaa

SEQ ID NO: 95282 - DNA, 20 bp, human
gttcccattccttggcctgt

SEQ ID NO: 95283 - DNA, 20 bp, human
gagatactgcgtagcaggcg

SEQ ID NO: 95284 - DNA, 20 bp, human
gctaactgatgctcctaatg

SEQ ID NO: 95285 - DNA, 20 bp, human
gggagaggggaactctttta

SEQ ID NO: 95286 - DNA, 20 bp, human
ggagattaaatgactaaagg

SEQ ID NO: 95287 - DNA, 20 bp, human
gttcactgtgtagtacagaa

SEQ ID NO: 95288 - DNA, 20 bp, human
ggcttcatacctcctgcaga

SEQ ID NO: 95289 - DNA, 20 bp, human
gtttgagattaaatgactaa

SEQ ID NO: 95290 - DNA, 20 bp, human
gatgctgcccttattcttac

SEQ ID NO: 95291 - DNA, 20 bp, human
gacttgttatatgtccactc

SEQ ID NO: 95292 - DNA, 20 bp, human
gtcatctaggaaagctcatt

SEQ ID NO: 95293 - DNA, 20 bp, human
gttgaatgccagtaagaata

SEQ ID NO: 95294 - DNA, 20 bp, human
gcaattcaaaatattcatct

SEQ ID NO: 95295 - DNA, 20 bp, human
gatgttgaatgcatttgttg

SEQ ID NO: 95296 - DNA, 20 bp, human
gtgctccaggtaagactaca

SEQ ID NO: 95297 - DNA, 20 bp, human
ggtatatagccagatacacg

SEQ ID NO: 95298 - DNA, 20 bp, human
ggccatcctggctgtcgaga

SEQ ID NO: 95299 - DNA, 20 bp, human
gcaccccatcaatgccatcc

SEQ ID NO: 95300 - DNA, 20 bp, human
gaaggaggcctctttctgga

SEQ ID NO: 95301 - DNA, 20 bp, human
gatcccctgcctcgtgtatc

SEQ ID NO: 95302 - DNA, 20 bp, human
gcgaggcaggggatgcacca

SEQ ID NO: 95303 - DNA, 20 bp, human
gtcctggctgtcgagaagga

SEQ ID NO: 95304 - DNA, 20 bp, human
gccaaggatggagatgctcc

SEQ ID NO: 95305 - DNA, 20 bp, human
gggtggcaccatggccgaag

SEQ ID NO: 95306 - DNA, 20 bp, human
gcagaggccgtccaagacac

SEQ ID NO: 95307 - DNA, 20 bp, human
gccggccacagccccaacca

SEQ ID NO: 95308 - DNA, 20 bp, human
gcgctgcttgaagggaatat

SEQ ID NO: 95309 - DNA, 20 bp, human
gcaaccaggggtaaagaatg

SEQ ID NO: 95310 - DNA, 20 bp, human
ggccgagaaccgctgcttca

SEQ ID NO: 95311 - DNA, 20 bp, human
gaactattcaggaacctcag

SEQ ID NO: 95312 - DNA, 20 bp, human
gatggagggtcctgcatcaa

SEQ ID NO: 95313 - DNA, 20 bp, human
gcacgcagttgcagggctca

SEQ ID NO: 95314 - DNA, 20 bp, human
ggcttcatggccggcgaact

SEQ ID NO: 95315 - DNA, 20 bp, human
gaggtggcatagagcgatgg

SEQ ID NO: 95316 - DNA, 20 bp, human
gcagcggagacccccactcc

SEQ ID NO: 95317 - DNA, 20 bp, human
gactcccggcgagtccgcgg

SEQ ID NO: 95318 - DNA, 20 bp, human
ggggatcgcacgcagaggag

SEQ ID NO: 95319 - DNA, 20 bp, human
gcggctctggacgaagggag

SEQ ID NO: 95320 - DNA, 20 bp, human
gggagcccgggagaaagcag

SEQ ID NO: 95321 - DNA, 20 bp, human
gagctctggcggagcgctgt

SEQ ID NO: 95322 - DNA, 20 bp, human
gccgccgagctcaggaagtc

SEQ ID NO: 95323 - DNA, 20 bp, human
gcttggcgtctgcctccggg

SEQ ID NO: 95324 - DNA, 20 bp, human
gctgccccggagccggagtt

SEQ ID NO: 95325 - DNA, 20 bp, human
ggcccgacctggaagagcag

SEQ ID NO: 95326 - DNA, 20 bp, human
gcaggttaccaactcccctg

SEQ ID NO: 95327 - DNA, 20 bp, human
gcagcttgttagacaaggat

SEQ ID NO: 95328 - DNA, 20 bp, human
ggctgccctcgggtagaaaa

SEQ ID NO: 95329 - DNA, 20 bp, human
ggagatctgagcctgaagag

SEQ ID NO: 95330 - DNA, 20 bp, human
gacaggcacttcatctcctc

SEQ ID NO: 95331 - DNA, 20 bp, human
ggaagccgttttctacccga

SEQ ID NO: 95332 - DNA, 20 bp, human
gcaactagcacttaaccctt

SEQ ID NO: 95333 - DNA, 20 bp, human
gccttgtctaacaagctgta

SEQ ID NO: 95334 - DNA, 20 bp, human
gaacccagcctcagacatac

SEQ ID NO: 95335 - DNA, 20 bp, human
gttagcctctgtgcaaacaa

SEQ ID NO: 95336 - DNA, 20 bp, human
gggagaggggggcaacgcaa

SEQ ID NO: 95337 - DNA, 20 bp, human
gcgctcggcgcggtctccca

SEQ ID NO: 95338 - DNA, 20 bp, human
gagggaggggagagggtccg

SEQ ID NO: 95339 - DNA, 20 bp, human
gctagcactcggggagaggg

SEQ ID NO: 95340 - DNA, 20 bp, human
gtggcgcgggaacttcgctt

SEQ ID NO: 95341 - DNA, 20 bp, human
gcaacgcaagggaggggaga

SEQ ID NO: 95342 - DNA, 20 bp, human
ggagcgaggtggctgcgagg

SEQ ID NO: 95343 - DNA, 20 bp, human
gaggagagcgagaggagagc

SEQ ID NO: 95344 - DNA, 20 bp, human
gcgcagccttccccaagtca

SEQ ID NO: 95345 - DNA, 20 bp, human
gtctccccgagtgctagccc

SEQ ID NO: 95346 - DNA, 20 bp, human
ggaggtgagcgcgcactcac

SEQ ID NO: 95347 - DNA, 20 bp, human
ggtgagcgcgcactcaccgg

SEQ ID NO: 95348 - DNA, 20 bp, human
gccggaggtgagctgcatcc

SEQ ID NO: 95349 - DNA, 20 bp, human
ggagaggccgataaagaagg

SEQ ID NO: 95350 - DNA, 20 bp, human
ggcgatgctcccggctcagg

SEQ ID NO: 95351 - DNA, 20 bp, human
gtgagccgggagcatcgcgg

SEQ ID NO: 95352 - DNA, 20 bp, human
gtgcgcgctcacctccgcgg

SEQ ID NO: 95353 - DNA, 20 bp, human
gtaggcggcttggctcgcag

SEQ ID NO: 95354 - DNA, 20 bp, human
gtagttggtgtggtacagct

SEQ ID NO: 95355 - DNA, 20 bp, human
gcgcgcaggagacacactca

SEQ ID NO: 95356 - DNA, 20 bp, human
gggctcggcgctcccagcag

SEQ ID NO: 95357 - DNA, 20 bp, human
gacagctagagcgggatcgg

SEQ ID NO: 95358 - DNA, 20 bp, human
ggagcggccgggcccgagta

SEQ ID NO: 95359 - DNA, 20 bp, human
gaccctggcccgccaatcct

SEQ ID NO: 95360 - DNA, 20 bp, human
gctggtatgagggtctaaga

SEQ ID NO: 95361 - DNA, 20 bp, human
ggaggcagcggatccgggac

SEQ ID NO: 95362 - DNA, 20 bp, human
gagggcaaagtggcagaatt

SEQ ID NO: 95363 - DNA, 20 bp, human
gcttgctcgggttctccccg

SEQ ID NO: 95364 - DNA, 20 bp, human
gccaggcggcggcctctgcg

SEQ ID NO: 95365 - DNA, 20 bp, human
ggacacggggcgaggaaggg

SEQ ID NO: 95366 - DNA, 20 bp, human
ggagccgtgggcgtgatgtg

SEQ ID NO: 95367 - DNA, 20 bp, human
gtacggagaagcagatggtg

SEQ ID NO: 95368 - DNA, 20 bp, human
gaccagtacggagaagcaga

SEQ ID NO: 95369 - DNA, 20 bp, human
gcctcggctagagcggacac

SEQ ID NO: 95370 - DNA, 20 bp, human
ggaagcaggtcactccccag

SEQ ID NO: 95371 - DNA, 20 bp, human
gtgcggaactcgcgagccgt

SEQ ID NO: 95372 - DNA, 20 bp, human
ggtaccccacatcacgccca

SEQ ID NO: 95373 - DNA, 20 bp, human
gggccgaagtagcctgcctg

SEQ ID NO: 95374 - DNA, 20 bp, human
ggacagcgtcaacacaccgc

SEQ ID NO: 95375 - DNA, 20 bp, human
ggagacagcctcggctagag

SEQ ID NO: 95376 - DNA, 20 bp, human
gcgggcgccatggcaccgtg

SEQ ID NO: 95377 - DNA, 20 bp, human
gagggctgcgcggtcagaca

SEQ ID NO: 95378 - DNA, 20 bp, human
gcagccagccgcttgcccca

SEQ ID NO: 95379 - DNA, 20 bp, human
gcagcagcgcacgtaccagg

SEQ ID NO: 95380 - DNA, 20 bp, human
gcatggcaccgtggggcaag

SEQ ID NO: 95381 - DNA, 20 bp, human
gcgggcgtgctgtacgacag

SEQ ID NO: 95382 - DNA, 20 bp, human
ggggtgctgcttgacatctc

SEQ ID NO: 95383 - DNA, 20 bp, human
ggcaccgtggggcaagcggc

SEQ ID NO: 95384 - DNA, 20 bp, human
ggtgattctagcacttgcag

SEQ ID NO: 95385 - DNA, 20 bp, human
gggtgggaagggggagaccg

SEQ ID NO: 95386 - DNA, 20 bp, human
ggcgctgcattaaggcgagg

SEQ ID NO: 95387 - DNA, 20 bp, human
gcaagccccggagaactcag

SEQ ID NO: 95388 - DNA, 20 bp, human
gcgcgggagaagggaaagag

SEQ ID NO: 95389 - DNA, 20 bp, human
gcgactgtggggttagacgg

SEQ ID NO: 95390 - DNA, 20 bp, human
gagagagggacaactccgtg

SEQ ID NO: 95391 - DNA, 20 bp, human
gtgactgggctggggcggta

SEQ ID NO: 95392 - DNA, 20 bp, human
ggagggacaactccgtgcgg

SEQ ID NO: 95393 - DNA, 20 bp, human
gagcgccgctgagttctccg

SEQ ID NO: 95394 - DNA, 20 bp, human
ggagggtcgccctgaggaca

SEQ ID NO: 95395 - DNA, 20 bp, human
gggcgaggaaaagaagtctc

SEQ ID NO: 95396 - DNA, 20 bp, human
ggccaaagccagggtcacaa

SEQ ID NO: 95397 - DNA, 20 bp, human
ggccaccgggagaattgaag

SEQ ID NO: 95398 - DNA, 20 bp, human
ggcctcccgccgaggcgcag

SEQ ID NO: 95399 - DNA, 20 bp, human
gtgagtcggcgactggagta

SEQ ID NO: 95400 - DNA, 20 bp, human
gagcccaaggcgaccctctt

SEQ ID NO: 95401 - DNA, 20 bp, human
gaccctcttgggcgctgagt

SEQ ID NO: 95402 - DNA, 20 bp, human
ggagcaggagactaggacag

SEQ ID NO: 95403 - DNA, 20 bp, human
gtcctcttcaattctcccgg

SEQ ID NO: 95404 - DNA, 20 bp, human
gttctcccggtggctcgact

SEQ ID NO: 95405 - DNA, 20 bp, human
ggccgactcagcgcccaaga

SEQ ID NO: 95406 - DNA, 20 bp, human
ggctctcgggggtccagggt

SEQ ID NO: 95407 - DNA, 20 bp, human
gccggcgtccaagcgactcc

SEQ ID NO: 95408 - DNA, 20 bp, human
gccccgcaatagccccgaac

SEQ ID NO: 95409 - DNA, 20 bp, human
gcccctggcctgggttgtca

SEQ ID NO: 95410 - DNA, 20 bp, human
gtggacccccgagagctccc

SEQ ID NO: 95411 - DNA, 20 bp, human
gcgctgggcccgggaaagtt

SEQ ID NO: 95412 - DNA, 20 bp, human
gaaagttcgggactggagag

SEQ ID NO: 95413 - DNA, 20 bp, human
gggcaggagctagaggatct

SEQ ID NO: 95414 - DNA, 20 bp, human
gagcagcacccggagtcgct

SEQ ID NO: 95415 - DNA, 20 bp, human
gcccccgagagctccctggc

SEQ ID NO: 95416 - DNA, 20 bp, human
gggagccccgaaccctccag

SEQ ID NO: 95417 - DNA, 20 bp, human
gtaggtcagcgtcccctgga

SEQ ID NO: 95418 - DNA, 20 bp, human
gaggcccctagaaaaaaagg

SEQ ID NO: 95419 - DNA, 20 bp, human
gctccctgccccgcacgacg

SEQ ID NO: 95420 - DNA, 20 bp, human
ggcacgacgcggcgggactt

SEQ ID NO: 95421 - DNA, 20 bp, human
gctgcaagagtgcgggacag

SEQ ID NO: 95422 - DNA, 20 bp, human
ggggcgatggggccgaccaa

SEQ ID NO: 95423 - DNA, 20 bp, human
ggcgtcccctggagggttcg

SEQ ID NO: 95424 - DNA, 20 bp, human
gacgctggcctgcaagagtg

SEQ ID NO: 95425 - DNA, 20 bp, human
gcgcgagacgcgctcctcct

SEQ ID NO: 95426 - DNA, 20 bp, human
gctggaaacagactggggac

SEQ ID NO: 95427 - DNA, 20 bp, human
gccccggagagcgagatcaa

SEQ ID NO: 95428 - DNA, 20 bp, human
gagaggcggtcacagggcag

SEQ ID NO: 95429 - DNA, 20 bp, human
gagggactggaaacagactg

SEQ ID NO: 95430 - DNA, 20 bp, human
gctgggatgtgcaccaaccc

SEQ ID NO: 95431 - DNA, 20 bp, human
ggggcgcagaggcggtcaca

SEQ ID NO: 95432 - DNA, 20 bp, human
ggcccctcccggcccctgag

SEQ ID NO: 95433 - DNA, 20 bp, human
gagagcgagatcaaagggac

SEQ ID NO: 95434 - DNA, 20 bp, human
gagcaacagcgtctcaacct

SEQ ID NO: 95435 - DNA, 20 bp, human
gcgggccggacgccgctcag

SEQ ID NO: 95436 - DNA, 20 bp, human
gccggaccgcttgaaagtgg

SEQ ID NO: 95437 - DNA, 20 bp, human
gtggcctcggcgctgcggag

SEQ ID NO: 95438 - DNA, 20 bp, human
ggcagaaagcggtcgaggat

SEQ ID NO: 95439 - DNA, 20 bp, human
ggagcggctttccccggtgg

SEQ ID NO: 95440 - DNA, 20 bp, human
ggatccggaccgcttgaaag

SEQ ID NO: 95441 - DNA, 20 bp, human
gcagcacgttcagcagaaag

SEQ ID NO: 95442 - DNA, 20 bp, human
ggattgcccaaggactggac

SEQ ID NO: 95443 - DNA, 20 bp, human
ggctgcggagcggctttccc

SEQ ID NO: 95444 - DNA, 20 bp, human
gtaaggatgcgcgaattacg

SEQ ID NO: 95445 - DNA, 20 bp, human
gtgaaagtgggggaaagtgc

SEQ ID NO: 95446 - DNA, 20 bp, human
gggaccttcttccgaggcag

SEQ ID NO: 95447 - DNA, 20 bp, human
gccttcttccgaggcagcgg

SEQ ID NO: 95448 - DNA, 20 bp, human
gttgtcgggaccttcttccg

SEQ ID NO: 95449 - DNA, 20 bp, human
ggcaggaaggaggggtacga

SEQ ID NO: 95450 - DNA, 20 bp, human
gggtgagccggcgaacgact

SEQ ID NO: 95451 - DNA, 20 bp, human
gcagccctcgggcaacgccg

SEQ ID NO: 95452 - DNA, 20 bp, human
gggttccccggcccatgtac

SEQ ID NO: 95453 - DNA, 20 bp, human
gccgccccggcgttgcccga

SEQ ID NO: 95454 - DNA, 20 bp, human
gacatgggccggggaacctc

SEQ ID NO: 95455 - DNA, 20 bp, human
gggtcccgacaaacttggag

SEQ ID NO: 95456 - DNA, 20 bp, human
gctgcagcgtctgagcgtcg

SEQ ID NO: 95457 - DNA, 20 bp, human
gagaagctggcggacatgac

SEQ ID NO: 95458 - DNA, 20 bp, human
ggctgctgaacggggtgtag

SEQ ID NO: 95459 - DNA, 20 bp, human
gtcccacctggatgactctc

SEQ ID NO: 95460 - DNA, 20 bp, human
gtagtggatgtcgtcggaca

SEQ ID NO: 95461 - DNA, 20 bp, human
gcgctcggggctgctgaacg

SEQ ID NO: 95462 - DNA, 20 bp, human
gcagcctcgaggaaaagagt

SEQ ID NO: 95463 - DNA, 20 bp, human
ggctcagacgctgcagaagc

SEQ ID NO: 95464 - DNA, 20 bp, human
gcacccagtgccgccctcgg

SEQ ID NO: 95465 - DNA, 20 bp, human
gcccgccccgcaggttatgc

SEQ ID NO: 95466 - DNA, 20 bp, human
gggacgagctaccagcgctc

SEQ ID NO: 95467 - DNA, 20 bp, human
gcgagctaccagcgctcggg

SEQ ID NO: 95468 - DNA, 20 bp, human
gcctgcagcagacagaggac

SEQ ID NO: 95469 - DNA, 20 bp, human
gcgtcacggcgcctgagccc

SEQ ID NO: 95470 - DNA, 20 bp, human
ggcagcgcgtgcagccgtca

SEQ ID NO: 95471 - DNA, 20 bp, human
gcagggccgcaagacttctg

SEQ ID NO: 95472 - DNA, 20 bp, human
ggacactgcggagtaggagg

SEQ ID NO: 95473 - DNA, 20 bp, human
ggacggggcggagagggtct

SEQ ID NO: 95474 - DNA, 20 bp, human
ggtccgaataggtcaggggt

SEQ ID NO: 95475 - DNA, 20 bp, human
gggcgcgcagcctccttcgc

SEQ ID NO: 95476 - DNA, 20 bp, human
ggcgtctctgcgctcctaca

SEQ ID NO: 95477 - DNA, 20 bp, human
gcagctcatccgagtgaagg

SEQ ID NO: 95478 - DNA, 20 bp, human
gatccgagtgaaggaggcaa

SEQ ID NO: 95479 - DNA, 20 bp, human
gagagacgctcgaggatgga

SEQ ID NO: 95480 - DNA, 20 bp, human
gcggatgagctgaaagcccc

SEQ ID NO: 95481 - DNA, 20 bp, human
gagtccccaacccaatctac

SEQ ID NO: 95482 - DNA, 20 bp, human
ggcgcagagacgctcgagga

SEQ ID NO: 95483 - DNA, 20 bp, human
gcagtgcctgtagattgggt

SEQ ID NO: 95484 - DNA, 20 bp, human
gaggagcgcagagacgctcg

SEQ ID NO: 95485 - DNA, 20 bp, human
ggggaacttgcaagcagcca

SEQ ID NO: 95486 - DNA, 20 bp, human
gttgagggatcgctaactcc

SEQ ID NO: 95487 - DNA, 20 bp, human
ggatcgctaactcccgggaa

SEQ ID NO: 95488 - DNA, 20 bp, human
gcctgtccgctaggcttcag

SEQ ID NO: 95489 - DNA, 20 bp, human
gggatgcagcccgcaccctg

SEQ ID NO: 95490 - DNA, 20 bp, human
ggtctgccgctgaagcctag

SEQ ID NO: 95491 - DNA, 20 bp, human
gcactgcgctagtcctaaag

SEQ ID NO: 95492 - DNA, 20 bp, human
gaggaaatgtctctacgctg

SEQ ID NO: 95493 - DNA, 20 bp, human
gatgggcgctctgaagggat

SEQ ID NO: 95494 - DNA, 20 bp, human
gccccatgatatagagtctc

SEQ ID NO: 95495 - DNA, 20 bp, human
ggtgttctctgcggctagag

SEQ ID NO: 95496 - DNA, 20 bp, human
gagagagggagagtgaatct

SEQ ID NO: 95497 - DNA, 20 bp, human
gcccataatgaaggtcttgg

SEQ ID NO: 95498 - DNA, 20 bp, human
gtggaggaaacctcagatgc

SEQ ID NO: 95499 - DNA, 20 bp, human
ggctgcacttcagagggcct

SEQ ID NO: 95500 - DNA, 20 bp, human
gcccgggaccgcggttggaa

SEQ ID NO: 95501 - DNA, 20 bp, human
ggcgagtgtccggagcgagg

SEQ ID NO: 95502 - DNA, 20 bp, human
gagcagcccgggaccgcggt

SEQ ID NO: 95503 - DNA, 20 bp, human
gttatgggctgcacttcaga

SEQ ID NO: 95504 - DNA, 20 bp, human
gaatctgggagaaagcgcag

SEQ ID NO: 95505 - DNA, 20 bp, human
gagatgccggcagttttcag

SEQ ID NO: 95506 - DNA, 20 bp, human
gctcccagaggcaacggtaa

SEQ ID NO: 95507 - DNA, 20 bp, human
gccccgagcggggtccccag

SEQ ID NO: 95508 - DNA, 20 bp, human
gagatcccacagccgcccgg

SEQ ID NO: 95509 - DNA, 20 bp, human
ggctctgcggagcgtcctag

SEQ ID NO: 95510 - DNA, 20 bp, human
gggacacgagggtgacccaa

SEQ ID NO: 95511 - DNA, 20 bp, human
gggctggagcgactcggccg

SEQ ID NO: 95512 - DNA, 20 bp, human
gggccgttaccgttgcctct

SEQ ID NO: 95513 - DNA, 20 bp, human
gagcgactcggccgtggcgg

SEQ ID NO: 95514 - DNA, 20 bp, human
gcgcgtcccccaggacacga

SEQ ID NO: 95515 - DNA, 20 bp, human
gcgttgcctctgggaggctc

SEQ ID NO: 95516 - DNA, 20 bp, human
gcgcgaacttgggactgcag

SEQ ID NO: 95517 - DNA, 20 bp, human
gcgtctgcgcgcgaatgccg

SEQ ID NO: 95518 - DNA, 20 bp, human
gaatgccgtggcgcgaactt

SEQ ID NO: 95519 - DNA, 20 bp, human
gatcggaaggccccccgagg

SEQ ID NO: 95520 - DNA, 20 bp, human
gactgcagaggcgcgcctgg

SEQ ID NO: 95521 - DNA, 20 bp, human
ggggggggggaaaactgtgt

SEQ ID NO: 95522 - DNA, 20 bp, human
ggagaggccaaatggaactg

SEQ ID NO: 95523 - DNA, 20 bp, human
gcagtcccaagttcgcgcca

SEQ ID NO: 95524 - DNA, 20 bp, human
ggccaaatggaactgagggg

SEQ ID NO: 95525 - DNA, 20 bp, human
gccgtccgcaagcagatggg

SEQ ID NO: 95526 - DNA, 20 bp, human
gagcgctcgggtgggactca

SEQ ID NO: 95527 - DNA, 20 bp, human
gcggctccggcgctcaccgt

SEQ ID NO: 95528 - DNA, 20 bp, human
gcaggcgctccaaccgtcgt

SEQ ID NO: 95529 - DNA, 20 bp, human
gcgcaggcgggaagtgatca

SEQ ID NO: 95530 - DNA, 20 bp, human
ggcctgcgtcccggacccgg

SEQ ID NO: 95531 - DNA, 20 bp, human
ggcgggcagcccacgacggt

SEQ ID NO: 95532 - DNA, 20 bp, human
gctcggaacttgctcattac

SEQ ID NO: 95533 - DNA, 20 bp, human
ggaggacgcacgccgggcca

SEQ ID NO: 95534 - DNA, 20 bp, human
ggaaccgggagcgctcgggt

SEQ ID NO: 95535 - DNA, 20 bp, human
ggagcaagttccgaggccta

SEQ ID NO: 95536 - DNA, 20 bp, human
ggcgccagcttccggcttag

SEQ ID NO: 95537 - DNA, 20 bp, human
gttcaggcttgacgtcaggt

SEQ ID NO: 95538 - DNA, 20 bp, human
gggcgagcagctggcggaac

SEQ ID NO: 95539 - DNA, 20 bp, human
gaggcggcgagaagtctgtg

SEQ ID NO: 95540 - DNA, 20 bp, human
gcgtcaggtgggaagggtgt

SEQ ID NO: 95541 - DNA, 20 bp, human
gagctggcgccagaagatgc

SEQ ID NO: 95542 - DNA, 20 bp, human
gctgtggggcaacagaccgg

SEQ ID NO: 95543 - DNA, 20 bp, human
gctgcgcggcgagcagctgg

SEQ ID NO: 95544 - DNA, 20 bp, human
ggagcttcaggcttgacgtc

SEQ ID NO: 95545 - DNA, 20 bp, human
gcgtcaggttagggtctgtg

SEQ ID NO: 95546 - DNA, 20 bp, human
ggtggaaggccaagatccct

SEQ ID NO: 95547 - DNA, 20 bp, human
ggacggaaaagatacctcgg

SEQ ID NO: 95548 - DNA, 20 bp, human
gggccaagatccctaggtcc

SEQ ID NO: 95549 - DNA, 20 bp, human
gtaccgaggtacacgaccat

SEQ ID NO: 95550 - DNA, 20 bp, human
gccggacggaaaagatacct

SEQ ID NO: 95551 - DNA, 20 bp, human
gcttgagaggggccctaacg

SEQ ID NO: 95552 - DNA, 20 bp, human
gatccctaggtcctggagca

SEQ ID NO: 95553 - DNA, 20 bp, human
gcctcgggtacggaactgga

SEQ ID NO: 95554 - DNA, 20 bp, human
ggagtcctggtgctcggagg

SEQ ID NO: 95555 - DNA, 20 bp, human
ggctccctgctccaggacct

SEQ ID NO: 95556 - DNA, 20 bp, human
gttccagatgagggtaacgg

SEQ ID NO: 95557 - DNA, 20 bp, human
ggaagcagaactaccctacc

SEQ ID NO: 95558 - DNA, 20 bp, human
gccgagtgtccacactgggt

SEQ ID NO: 95559 - DNA, 20 bp, human
gagccgacctctagtcccta

SEQ ID NO: 95560 - DNA, 20 bp, human
ggcctccgagtgtccacact

SEQ ID NO: 95561 - DNA, 20 bp, human
gggactagaggtcggctgtg

SEQ ID NO: 95562 - DNA, 20 bp, human
gagcctccgttaccctcatc

SEQ ID NO: 95563 - DNA, 20 bp, human
gtcctcttctcactgagaga

SEQ ID NO: 95564 - DNA, 20 bp, human
gggtagttctgcttcctgtg

SEQ ID NO: 95565 - DNA, 20 bp, human
ggggtctccttagggactag

SEQ ID NO: 95566 - DNA, 20 bp, human
gagtaatgcagggtctacca

SEQ ID NO: 95567 - DNA, 20 bp, human
gctgaggctggaatgctaag

SEQ ID NO: 95568 - DNA, 20 bp, human
gtgaggtgggtgaaggctag

SEQ ID NO: 95569 - DNA, 20 bp, human
gcatctggaagggcagacgc

SEQ ID NO: 95570 - DNA, 20 bp, human
gtgggaggaatacttcggcc

SEQ ID NO: 95571 - DNA, 20 bp, human
ggcctctgctcaccctcatc

SEQ ID NO: 95572 - DNA, 20 bp, human
gctgctcaccctcatctgga

SEQ ID NO: 95573 - DNA, 20 bp, human
ggtctcaaaaggggaaatgc

SEQ ID NO: 95574 - DNA, 20 bp, human
gtctgagtctaactgcagca

SEQ ID NO: 95575 - DNA, 20 bp, human
gccctaaaggtatgacagcc

SEQ ID NO: 95576 - DNA, 20 bp, human
ggagggacttgggacagcta

SEQ ID NO: 95577 - DNA, 20 bp, human
ggcaggacagaggacacaca

SEQ ID NO: 95578 - DNA, 20 bp, human
gctcggtgctggcaggacag

SEQ ID NO: 95579 - DNA, 20 bp, human
gcccatccccagctgcacag

SEQ ID NO: 95580 - DNA, 20 bp, human
gacagggtgtggacacttgg

SEQ ID NO: 95581 - DNA, 20 bp, human
gacagaggacacacagggtg

SEQ ID NO: 95582 - DNA, 20 bp, human
gtggccccttgtccccggtg

SEQ ID NO: 95583 - DNA, 20 bp, human
gatccccagctgcacagggg

SEQ ID NO: 95584 - DNA, 20 bp, human
gcatccacagagcagtgcag

SEQ ID NO: 95585 - DNA, 20 bp, human
gcggtgaggaggagggactt

SEQ ID NO: 95586 - DNA, 20 bp, human
gctggctcggcccacaggat

SEQ ID NO: 95587 - DNA, 20 bp, human
gtgagggttgaggacatctt

SEQ ID NO: 95588 - DNA, 20 bp, human
ggagcaggcttgtgagaatg

SEQ ID NO: 95589 - DNA, 20 bp, human
gggaggagagaccctagtct

SEQ ID NO: 95590 - DNA, 20 bp, human
ggtcaattagggcatcccag

SEQ ID NO: 95591 - DNA, 20 bp, human
gagacctgctcaggcttcgg

SEQ ID NO: 95592 - DNA, 20 bp, human
ggggtctctctcctagacta

SEQ ID NO: 95593 - DNA, 20 bp, human
gtctgtgtctacgggcaccg

SEQ ID NO: 95594 - DNA, 20 bp, human
gggttatgccaggtgatcac

SEQ ID NO: 95595 - DNA, 20 bp, human
gctacccaaacccatcctgt

SEQ ID NO: 95596 - DNA, 20 bp, human
gagatgcaggtccatgccac

SEQ ID NO: 95597 - DNA, 20 bp, human
gaggcagagcagaaccatga

SEQ ID NO: 95598 - DNA, 20 bp, human
gcagagacacatctgacacc

SEQ ID NO: 95599 - DNA, 20 bp, human
gctagggtgccccttccctg

SEQ ID NO: 95600 - DNA, 20 bp, human
gggagtttcctgatagacaa

SEQ ID NO: 95601 - DNA, 20 bp, human
ggaggcttccaatctcaccg

SEQ ID NO: 95602 - DNA, 20 bp, human
gtggatgagaccatggtgcc

SEQ ID NO: 95603 - DNA, 20 bp, human
gagagcagttcccctttctg

SEQ ID NO: 95604 - DNA, 20 bp, human
gtctgtcctgccaggcacca

SEQ ID NO: 95605 - DNA, 20 bp, human
gtgggaacctcctaaaaccc

SEQ ID NO: 95606 - DNA, 20 bp, human
gagagcgcggggtcaccgga

SEQ ID NO: 95607 - DNA, 20 bp, human
ggagggggagatccgagtct

SEQ ID NO: 95608 - DNA, 20 bp, human
ggcgtcatggcgtctccttc

SEQ ID NO: 95609 - DNA, 20 bp, human
gggccctagatggaaatcag

SEQ ID NO: 95610 - DNA, 20 bp, human
gggagctgggatctgagcgt

SEQ ID NO: 95611 - DNA, 20 bp, human
ggctgtgagggcgggcgtca

SEQ ID NO: 95612 - DNA, 20 bp, human
gccatcttgaaatctcacca

SEQ ID NO: 95613 - DNA, 20 bp, human
gctgcagagcgcggggtcac

SEQ ID NO: 95614 - DNA, 20 bp, human
gggatgatggggaagtcctg

SEQ ID NO: 95615 - DNA, 20 bp, human
gcctgtcccagtgaggagta

SEQ ID NO: 95616 - DNA, 20 bp, human
gacagagtgtggccaatcgg

SEQ ID NO: 95617 - DNA, 20 bp, human
gttcctgacgagggtagcgg

SEQ ID NO: 95618 - DNA, 20 bp, human
gaggaagggcagacacagga

SEQ ID NO: 95619 - DNA, 20 bp, human
gcccttcctgacgagggtag

SEQ ID NO: 95620 - DNA, 20 bp, human
gtgcctccgctaccctcgtc

SEQ ID NO: 95621 - DNA, 20 bp, human
gcacacagagtgtggccaat

SEQ ID NO: 95622 - DNA, 20 bp, human
gtctcattccattagggctg

SEQ ID NO: 95623 - DNA, 20 bp, human
gagtgtggccaatcggaggc

SEQ ID NO: 95624 - DNA, 20 bp, human
gccctctgcatcatttcaga

SEQ ID NO: 95625 - DNA, 20 bp, human
gcatcatttcagatggtaat

SEQ ID NO: 95626 - DNA, 20 bp, human
gacctggacggcacagccag

SEQ ID NO: 95627 - DNA, 20 bp, human
gacacgcagctcaacctgga

SEQ ID NO: 95628 - DNA, 20 bp, human
ggcctctgagtgtccacaca

SEQ ID NO: 95629 - DNA, 20 bp, human
ggcctctggctgtgccgtcc

SEQ ID NO: 95630 - DNA, 20 bp, human
gcccggctctcggtgagacg

SEQ ID NO: 95631 - DNA, 20 bp, human
gtctgagtgtccacacaggg

SEQ ID NO: 95632 - DNA, 20 bp, human
gggatggggattagaagttc

SEQ ID NO: 95633 - DNA, 20 bp, human
gtcctcgtctcaccgagagc

SEQ ID NO: 95634 - DNA, 20 bp, human
gttcctgatgagggtagcag

SEQ ID NO: 95635 - DNA, 20 bp, human
gcaacgctgtgctgatggat

SEQ ID NO: 95636 - DNA, 20 bp, human
gtgcagagcgcggggtcacc

SEQ ID NO: 95637 - DNA, 20 bp, human
gagagcgcggggtcaccggg

SEQ ID NO: 95638 - DNA, 20 bp, human
ggcgtcatggcgtctcctcc

SEQ ID NO: 95639 - DNA, 20 bp, human
ggagggggagatctgagtct

SEQ ID NO: 95640 - DNA, 20 bp, human
gggccctagatggaaatcag

SEQ ID NO: 95641 - DNA, 20 bp, human
gggagctgggatctgagcgt

SEQ ID NO: 95642 - DNA, 20 bp, human
ggctgtgagggcgggcgtca

SEQ ID NO: 95643 - DNA, 20 bp, human
gccatcttgaaatctcacca

SEQ ID NO: 95644 - DNA, 20 bp, human
gggatgatggggaagtcctg

SEQ ID NO: 95645 - DNA, 20 bp, human
gcctgtcccagtgaggagta

SEQ ID NO: 95646 - DNA, 20 bp, human
gtcatggcgtctcctcccag

SEQ ID NO: 95647 - DNA, 20 bp, human
gaggcagagcagagccgtga

SEQ ID NO: 95648 - DNA, 20 bp, human
ggccgtgaaggtggggatca

SEQ ID NO: 95649 - DNA, 20 bp, human
gctgcacagctggggcccct

SEQ ID NO: 95650 - DNA, 20 bp, human
gcagagcagagccgtgaagg

SEQ ID NO: 95651 - DNA, 20 bp, human
gccctctttaaatctcaccg

SEQ ID NO: 95652 - DNA, 20 bp, human
gaggagactcaaaaatctca

SEQ ID NO: 95653 - DNA, 20 bp, human
gggaggggagacccgagtct

SEQ ID NO: 95654 - DNA, 20 bp, human
gctttgtcctgccggcactg

SEQ ID NO: 95655 - DNA, 20 bp, human
gatgagtcctcagtgccggc

SEQ ID NO: 95656 - DNA, 20 bp, human
gcaaggacgggggcctacag

SEQ ID NO: 95657 - DNA, 20 bp, human
gagccagagcccaaggacgg

SEQ ID NO: 95658 - DNA, 20 bp, human
gcactgggaggtactgatcg

SEQ ID NO: 95659 - DNA, 20 bp, human
gggcagcccctggaggacgt

SEQ ID NO: 95660 - DNA, 20 bp, human
gggacgggggcctacagagg

SEQ ID NO: 95661 - DNA, 20 bp, human
gtcctccaacactggcgtca

SEQ ID NO: 95662 - DNA, 20 bp, human
gaggaaattgggggacccgt

SEQ ID NO: 95663 - DNA, 20 bp, human
ggctctggctcggcagcccc

SEQ ID NO: 95664 - DNA, 20 bp, human
ggtactgatcggggtcttgg

SEQ ID NO: 95665 - DNA, 20 bp, human
ggggacccgtgggctgatgg

SEQ ID NO: 95666 - DNA, 20 bp, human
ggtgcctagaatggaatcag

SEQ ID NO: 95667 - DNA, 20 bp, human
gtcatggcgtcagctcccac

SEQ ID NO: 95668 - DNA, 20 bp, human
gctatcagaggctccgaggg

SEQ ID NO: 95669 - DNA, 20 bp, human
gctgcacagctgagtccagt

SEQ ID NO: 95670 - DNA, 20 bp, human
gaggcaaatcaggactgaga

SEQ ID NO: 95671 - DNA, 20 bp, human
ggagctggaatctgagggat

SEQ ID NO: 95672 - DNA, 20 bp, human
gatcaggactgagagggtga

SEQ ID NO: 95673 - DNA, 20 bp, human
gagagaatctggtctatcag

SEQ ID NO: 95674 - DNA, 20 bp, human
ggggtggagatagctgttct

SEQ ID NO: 95675 - DNA, 20 bp, human
gcggatgagaccacggtgcc

SEQ ID NO: 95676 - DNA, 20 bp, human
gcgcctggtgcctacctgag

SEQ ID NO: 95677 - DNA, 20 bp, human
gcttgaagggaggaactggg

SEQ ID NO: 95678 - DNA, 20 bp, human
gaggggccgtggcagaagga

SEQ ID NO: 95679 - DNA, 20 bp, human
gctgagggaggaggatggta

SEQ ID NO: 95680 - DNA, 20 bp, human
ggggctacaggtctcacgcc

SEQ ID NO: 95681 - DNA, 20 bp, human
gagtgggatgccaagtgctt

SEQ ID NO: 95682 - DNA, 20 bp, human
gcgggcaggctctgccactc

SEQ ID NO: 95683 - DNA, 20 bp, human
ggatggagacctagacgcct

SEQ ID NO: 95684 - DNA, 20 bp, human
gtctgggaagaaaaggccgg

SEQ ID NO: 95685 - DNA, 20 bp, human
gcctgagtcctaggtgagaa

SEQ ID NO: 95686 - DNA, 20 bp, human
gggatatcgaccctgaacga

SEQ ID NO: 95687 - DNA, 20 bp, human
ggaagaagtgggagaaccca

SEQ ID NO: 95688 - DNA, 20 bp, human
gatccacccggcagagggag

SEQ ID NO: 95689 - DNA, 20 bp, human
gcatggagaaagcatccacc

SEQ ID NO: 95690 - DNA, 20 bp, human
ggaaagcatccacccggcag

SEQ ID NO: 95691 - DNA, 20 bp, human
gtgacctgagtctagatctg

SEQ ID NO: 95692 - DNA, 20 bp, human
gcctgagtctagatctgggg

SEQ ID NO: 95693 - DNA, 20 bp, human
gccccacatcaaggacggtg

SEQ ID NO: 95694 - DNA, 20 bp, human
ggatatccccacatcaagga

SEQ ID NO: 95695 - DNA, 20 bp, human
gggtcgatatccccacatca

SEQ ID NO: 95696 - DNA, 20 bp, human
gtggtagcagcgcagaggaa

SEQ ID NO: 95697 - DNA, 20 bp, human
ggagcgccgggacctgtgac

SEQ ID NO: 95698 - DNA, 20 bp, human
gctgctaccagccctgtcac

SEQ ID NO: 95699 - DNA, 20 bp, human
gccgggacctgtgacagggc

SEQ ID NO: 95700 - DNA, 20 bp, human
gttagcagcttggtcgcgac

SEQ ID NO: 95701 - DNA, 20 bp, human
gtggtcgcgacaggtgcgct

SEQ ID NO: 95702 - DNA, 20 bp, human
gggtgcgctaggtagagcgc

SEQ ID NO: 95703 - DNA, 20 bp, human
gttcagctggcgtaatggaa

SEQ ID NO: 95704 - DNA, 20 bp, human
gtccctggaaggagggtatt

SEQ ID NO: 95705 - DNA, 20 bp, human
gagggctggtagcagcgcag

SEQ ID NO: 95706 - DNA, 20 bp, human
gcggcgcttgagaggacgcg

SEQ ID NO: 95707 - DNA, 20 bp, human
ggcggcggccgtcctcatcc

SEQ ID NO: 95708 - DNA, 20 bp, human
gagagcttccagaccgagag

SEQ ID NO: 95709 - DNA, 20 bp, human
gtcaagcgccgggatgagga

SEQ ID NO: 95710 - DNA, 20 bp, human
gccttggcagcgcctggaag

SEQ ID NO: 95711 - DNA, 20 bp, human
gagctggcaaaagaaagtgg

SEQ ID NO: 95712 - DNA, 20 bp, human
ggcttgtcccgctctcggtc

SEQ ID NO: 95713 - DNA, 20 bp, human
ggctagcactgcgcttccct

SEQ ID NO: 95714 - DNA, 20 bp, human
gtgcgcgcgtgagggcagga

SEQ ID NO: 95715 - DNA, 20 bp, human
gcctctcaagcgccgggatg

SEQ ID NO: 95716 - DNA, 20 bp, human
gccgtcccgggcctgctcag

SEQ ID NO: 95717 - DNA, 20 bp, human
gccaacaaggacgtctccag

SEQ ID NO: 95718 - DNA, 20 bp, human
ggcggcccattgtccgatgg

SEQ ID NO: 95719 - DNA, 20 bp, human
gctggcggcccattgtccga

SEQ ID NO: 95720 - DNA, 20 bp, human
gtccttgttggggtagctgg

SEQ ID NO: 95721 - DNA, 20 bp, human
gagccggcgagcgagcagca

SEQ ID NO: 95722 - DNA, 20 bp, human
gcattgtccgatggcggcgg

SEQ ID NO: 95723 - DNA, 20 bp, human
gggccgggatcgcagctccg

SEQ ID NO: 95724 - DNA, 20 bp, human
ggccaccagctaccccaaca

SEQ ID NO: 95725 - DNA, 20 bp, human
gagcaaggcagcagccgact

SEQ ID NO: 95726 - DNA, 20 bp, human
ggggcgcacgggtacgagga

SEQ ID NO: 95727 - DNA, 20 bp, human
ggacctcgggcgctgtccag

SEQ ID NO: 95728 - DNA, 20 bp, human
ggcggtggctcggggaccac

SEQ ID NO: 95729 - DNA, 20 bp, human
ggggcgggatcggtctccgg

SEQ ID NO: 95730 - DNA, 20 bp, human
gagactcgccgggaccccac

SEQ ID NO: 95731 - DNA, 20 bp, human
ggaagcctcgggtggagaag

SEQ ID NO: 95732 - DNA, 20 bp, human
gtcggtctccgggggcgcac

SEQ ID NO: 95733 - DNA, 20 bp, human
gacgggtacgaggagggcgc

SEQ ID NO: 95734 - DNA, 20 bp, human
gctcaggacgccaaaggcgg

SEQ ID NO: 95735 - DNA, 20 bp, human
ggcccgcgggacgcacacgg

SEQ ID NO: 95736 - DNA, 20 bp, human
gcgctgcggagcccagaact

SEQ ID NO: 95737 - DNA, 20 bp, human
gcagaactgggaagagctgg

SEQ ID NO: 95738 - DNA, 20 bp, human
gtccgcagcgagcggcttgg

SEQ ID NO: 95739 - DNA, 20 bp, human
gagggcacttaccaagccca

SEQ ID NO: 95740 - DNA, 20 bp, human
ggctgaggacccctggccgt

SEQ ID NO: 95741 - DNA, 20 bp, human
gcctgccccagacagagctg

SEQ ID NO: 95742 - DNA, 20 bp, human
gttaccaagcccacggccag

SEQ ID NO: 95743 - DNA, 20 bp, human
gaggggtcctcagctctgtc

SEQ ID NO: 95744 - DNA, 20 bp, human
ggcccagaactgggaagagc

SEQ ID NO: 95745 - DNA, 20 bp, human
ggcttggtaagtgccctcct

SEQ ID NO: 95746 - DNA, 20 bp, human
gtggacacctccagccagtg

SEQ ID NO: 95747 - DNA, 20 bp, human
ggagacaggaagccaacccg

SEQ ID NO: 95748 - DNA, 20 bp, human
ggggcgcaggagatccatgc

SEQ ID NO: 95749 - DNA, 20 bp, human
ggtggacgtcctgtactcca

SEQ ID NO: 95750 - DNA, 20 bp, human
gggcatactcggccaccaca

SEQ ID NO: 95751 - DNA, 20 bp, human
gtgcggtccggtgatgtccc

SEQ ID NO: 95752 - DNA, 20 bp, human
gcagacccgctggaccccaa

SEQ ID NO: 95753 - DNA, 20 bp, human
gcaggaagccaacccgagga

SEQ ID NO: 95754 - DNA, 20 bp, human
gggtctgcaagcctaaaagg

SEQ ID NO: 95755 - DNA, 20 bp, human
gctcctgcgcccacactggc

SEQ ID NO: 95756 - DNA, 20 bp, human
gcctggagggaagaacgtat

SEQ ID NO: 95757 - DNA, 20 bp, human
gggcgcctctcggacaccgg

SEQ ID NO: 95758 - DNA, 20 bp, human
ggggggcgcctctcggacac

SEQ ID NO: 95759 - DNA, 20 bp, human
gttccccgccggtgtccgag

SEQ ID NO: 95760 - DNA, 20 bp, human
gcaggagggcagctcgccgg

SEQ ID NO: 95761 - DNA, 20 bp, human
gcggacaccggcggggaaac

SEQ ID NO: 95762 - DNA, 20 bp, human
ggccgagccggtttccccgc

SEQ ID NO: 95763 - DNA, 20 bp, human
ggacgagctcatcccggagg

SEQ ID NO: 95764 - DNA, 20 bp, human
gatggaggccgacgcggggt

SEQ ID NO: 95765 - DNA, 20 bp, human
gccgggccgggggcgcctct

SEQ ID NO: 95766 - DNA, 20 bp, human
ggctctggaggtctaaggga

SEQ ID NO: 95767 - DNA, 20 bp, human
gctggagcccaggacaagta

SEQ ID NO: 95768 - DNA, 20 bp, human
gcacttacttagccctctgg

SEQ ID NO: 95769 - DNA, 20 bp, human
gtagccacagaggatgctgt

SEQ ID NO: 95770 - DNA, 20 bp, human
gaggaagcggcgtcttcttg

SEQ ID NO: 95771 - DNA, 20 bp, human
ggaagggggaggcacccgga

SEQ ID NO: 95772 - DNA, 20 bp, human
gcacccggagggcatgaaag

SEQ ID NO: 95773 - DNA, 20 bp, human
ggcccaggacaagtagggag

SEQ ID NO: 95774 - DNA, 20 bp, human
gatcctctgtggctacactg

SEQ ID NO: 95775 - DNA, 20 bp, human
gaagacgccgcttcctccag

SEQ ID NO: 95776 - DNA, 20 bp, human
gggagacagagggctccgag

SEQ ID NO: 95777 - DNA, 20 bp, human
gggtcttcccgcgcctgagg

SEQ ID NO: 95778 - DNA, 20 bp, human
gtgggactccgggaatgggg

SEQ ID NO: 95779 - DNA, 20 bp, human
gccggggaggaagagattct

SEQ ID NO: 95780 - DNA, 20 bp, human
gcgcgctggcgggtaaggaa

SEQ ID NO: 95781 - DNA, 20 bp, human
gcctcccagggcgccgtagg

SEQ ID NO: 95782 - DNA, 20 bp, human
ggaacgggatgcaccgccta

SEQ ID NO: 95783 - DNA, 20 bp, human
ggaaaccggctgtctctcgg

SEQ ID NO: 95784 - DNA, 20 bp, human
gagataacagcgggacaggg

SEQ ID NO: 95785 - DNA, 20 bp, human
gcacagccccaggcgcgaac

SEQ ID NO: 95786 - DNA, 20 bp, human
gagcggcgccgggagacgag

SEQ ID NO: 95787 - DNA, 20 bp, human
ggcggcgagggactaggacg

SEQ ID NO: 95788 - DNA, 20 bp, human
ggactaggacgcggctggag

SEQ ID NO: 95789 - DNA, 20 bp, human
gcgccgcggccggctactgg

SEQ ID NO: 95790 - DNA, 20 bp, human
gttctagcagtagggatcag

SEQ ID NO: 95791 - DNA, 20 bp, human
gctccgggcccgccagtagc

SEQ ID NO: 95792 - DNA, 20 bp, human
ggcccgccagtagccggccg

SEQ ID NO: 95793 - DNA, 20 bp, human
gggtcctctagtcccaagag

SEQ ID NO: 95794 - DNA, 20 bp, human
gaactctcggagcagcgggg

SEQ ID NO: 95795 - DNA, 20 bp, human
gcactcccgggtgtccgcgg

SEQ ID NO: 95796 - DNA, 20 bp, human
gagcagcagagggagacccg

SEQ ID NO: 95797 - DNA, 20 bp, human
gcggcaaccccggcaaccca

SEQ ID NO: 95798 - DNA, 20 bp, human
ggggagacccgcggcaaccc

SEQ ID NO: 95799 - DNA, 20 bp, human
gaaggtcagacaccaaccac

SEQ ID NO: 95800 - DNA, 20 bp, human
ggcgccgcggggctgtacga

SEQ ID NO: 95801 - DNA, 20 bp, human
ggcgtcgctgccaccatgac

SEQ ID NO: 95802 - DNA, 20 bp, human
gccacgggcaaaaggttcaa

SEQ ID NO: 95803 - DNA, 20 bp, human
gtgctcacaaccgacgccca

SEQ ID NO: 95804 - DNA, 20 bp, human
gagaatccgacgcgccaggg

SEQ ID NO: 95805 - DNA, 20 bp, human
gggcgagcagagcccgggtt

SEQ ID NO: 95806 - DNA, 20 bp, human
gggcctgagaaggccatcgt

SEQ ID NO: 95807 - DNA, 20 bp, human
ggttctctgggataatgcag

SEQ ID NO: 95808 - DNA, 20 bp, human
ggcagcgacacgcagatggg

SEQ ID NO: 95809 - DNA, 20 bp, human
ggaagagggcactccaggag

SEQ ID NO: 95810 - DNA, 20 bp, human
gcgccatgctctcacagtga

SEQ ID NO: 95811 - DNA, 20 bp, human
gcacccacgatggccttctc

SEQ ID NO: 95812 - DNA, 20 bp, human
gagctctcaagcacccacga

SEQ ID NO: 95813 - DNA, 20 bp, human
gagggtggtagggctccgag

SEQ ID NO: 95814 - DNA, 20 bp, human
ggctgcatgtcttaccgaca

SEQ ID NO: 95815 - DNA, 20 bp, human
gcatgcagcgacacgcagat

SEQ ID NO: 95816 - DNA, 20 bp, human
gggcctgagaaggccatcgt

SEQ ID NO: 95817 - DNA, 20 bp, human
ggttctctgggataatgcag

SEQ ID NO: 95818 - DNA, 20 bp, human
gcgccatgctctcacagtga

SEQ ID NO: 95819 - DNA, 20 bp, human
ggaagagggcactccaggag

SEQ ID NO: 95820 - DNA, 20 bp, human
ggcagcgacacgcagatggg

SEQ ID NO: 95821 - DNA, 20 bp, human
gcacccacgatggccttctc

SEQ ID NO: 95822 - DNA, 20 bp, human
gagctctcaagcacccacga

SEQ ID NO: 95823 - DNA, 20 bp, human
ggcctcgtggacagtgttaa

SEQ ID NO: 95824 - DNA, 20 bp, human
gagggtggtagggctccgag

SEQ ID NO: 95825 - DNA, 20 bp, human
gcatgcagcgacacgcagat

SEQ ID NO: 95826 - DNA, 20 bp, human
gcaagtggacagccaggagg

SEQ ID NO: 95827 - DNA, 20 bp, human
gtacgctaggggaacgcggg

SEQ ID NO: 95828 - DNA, 20 bp, human
gctgtcccggtgtacgctag

SEQ ID NO: 95829 - DNA, 20 bp, human
gcgcgggaggcgaccgggat

SEQ ID NO: 95830 - DNA, 20 bp, human
gaagtccgaaggcaaagggt

SEQ ID NO: 95831 - DNA, 20 bp, human
ggtgtacgctaggggaacgc

SEQ ID NO: 95832 - DNA, 20 bp, human
gttgccttcggacttctccg

SEQ ID NO: 95833 - DNA, 20 bp, human
gtgagtcctaggctgcccaa

SEQ ID NO: 95834 - DNA, 20 bp, human
gcttggtagctgccccctcc

SEQ ID NO: 95835 - DNA, 20 bp, human
ggaagagaagaaacctatcc

SEQ ID NO: 95836 - DNA, 20 bp, human
gatcacaaatttagctcgca

SEQ ID NO: 95837 - DNA, 20 bp, human
gccagccccttaaggatacg

SEQ ID NO: 95838 - DNA, 20 bp, human
gctctccggcgggcacgagg

SEQ ID NO: 95839 - DNA, 20 bp, human
gtctcaggcggggctagcaa

SEQ ID NO: 95840 - DNA, 20 bp, human
ggcggggctagcaaaggtgg

SEQ ID NO: 95841 - DNA, 20 bp, human
gctactagttaaggcacatg

SEQ ID NO: 95842 - DNA, 20 bp, human
gtgtgatcgatagaacagtg

SEQ ID NO: 95843 - DNA, 20 bp, human
ggggacggtctaagaagggt

SEQ ID NO: 95844 - DNA, 20 bp, human
gtcagcgaaactattctctc

SEQ ID NO: 95845 - DNA, 20 bp, human
ggagggcccgtggggcaaca

SEQ ID NO: 95846 - DNA, 20 bp, human
gccaggctggacacaaccaa

SEQ ID NO: 95847 - DNA, 20 bp, human
gggctggacacaaccaaagg

SEQ ID NO: 95848 - DNA, 20 bp, human
gggcctagggtcacaagtca

SEQ ID NO: 95849 - DNA, 20 bp, human
gaccaaaggcggaggacccg

SEQ ID NO: 95850 - DNA, 20 bp, human
gaaggggcccgcccacagaa

SEQ ID NO: 95851 - DNA, 20 bp, human
gtggacacaaccaaaggcgg

SEQ ID NO: 95852 - DNA, 20 bp, human
gacgtgcgtggtaggacatg

SEQ ID NO: 95853 - DNA, 20 bp, human
ggttcaaagatgagcttcgt

SEQ ID NO: 95854 - DNA, 20 bp, human
ggtggccaccacccttctgt

SEQ ID NO: 95855 - DNA, 20 bp, human
gaagtcaaggcgggagaagg

SEQ ID NO: 95856 - DNA, 20 bp, human
gagatggcgtctcccacaga

SEQ ID NO: 95857 - DNA, 20 bp, human
gtcccacagacggtaagagc

SEQ ID NO: 95858 - DNA, 20 bp, human
gtggccacgtcacgtgacat

SEQ ID NO: 95859 - DNA, 20 bp, human
ggccggctcttaccgtctgt

SEQ ID NO: 95860 - DNA, 20 bp, human
gcacgtcacgtgacatgggt

SEQ ID NO: 95861 - DNA, 20 bp, human
gacgtgacgtggccaaccgt

SEQ ID NO: 95862 - DNA, 20 bp, human
ggcgaggctgagggtcgagg

SEQ ID NO: 95863 - DNA, 20 bp, human
gccttggggtacccattgaa

SEQ ID NO: 95864 - DNA, 20 bp, human
ggttcccagtagagcaaaga

SEQ ID NO: 95865 - DNA, 20 bp, human
gtctgggtaaaaggacaggg

SEQ ID NO: 95866 - DNA, 20 bp, human
ggcgccgcgcgaccaggagg

SEQ ID NO: 95867 - DNA, 20 bp, human
gcgctgctgctgggagccca

SEQ ID NO: 95868 - DNA, 20 bp, human
gtgacactcaccaaagccgg

SEQ ID NO: 95869 - DNA, 20 bp, human
ggcccggcggtctggagtaa

SEQ ID NO: 95870 - DNA, 20 bp, human
gcggccagccgcctgcccgg

SEQ ID NO: 95871 - DNA, 20 bp, human
gggagcgccgcgcgaccagg

SEQ ID NO: 95872 - DNA, 20 bp, human
gaccggcccgggctcccgga

SEQ ID NO: 95873 - DNA, 20 bp, human
gcgacccaacaagccacccg

SEQ ID NO: 95874 - DNA, 20 bp, human
gcgcctccgagacacagacc

SEQ ID NO: 95875 - DNA, 20 bp, human
ggcccttactccagaccgcc

SEQ ID NO: 95876 - DNA, 20 bp, human
gagggggaggttactggtgg

SEQ ID NO: 95877 - DNA, 20 bp, human
gccggcccctgacataccag

SEQ ID NO: 95878 - DNA, 20 bp, human
ggccgcctctggtatgtcag

SEQ ID NO: 95879 - DNA, 20 bp, human
ggcccgggctccggctgtcg

SEQ ID NO: 95880 - DNA, 20 bp, human
gagctgtgatggtgatgacg

SEQ ID NO: 95881 - DNA, 20 bp, human
gaggaggatggggtacccga

SEQ ID NO: 95882 - DNA, 20 bp, human
gggtgatgacgaggtgaaaa

SEQ ID NO: 95883 - DNA, 20 bp, human
gcggcagccgctggaggtag

SEQ ID NO: 95884 - DNA, 20 bp, human
gagaattgcgcggtggatca

SEQ ID NO: 95885 - DNA, 20 bp, human
gcccctacctcggagcccga

SEQ ID NO: 95886 - DNA, 20 bp, human
ggacatggcgacattgacag

SEQ ID NO: 95887 - DNA, 20 bp, human
gggacggctataggcgccag

SEQ ID NO: 95888 - DNA, 20 bp, human
gagcgtcacttcggctccca

SEQ ID NO: 95889 - DNA, 20 bp, human
gaggggcagcgggaacgtag

SEQ ID NO: 95890 - DNA, 20 bp, human
gctcaccctggacagaggta

SEQ ID NO: 95891 - DNA, 20 bp, human
ggtggtccagccgctcaccc

SEQ ID NO: 95892 - DNA, 20 bp, human
gcgccaagcaagctgacagg

SEQ ID NO: 95893 - DNA, 20 bp, human
gcagaggaccggagacgacc

SEQ ID NO: 95894 - DNA, 20 bp, human
gtccctcgccggtctcctct

SEQ ID NO: 95895 - DNA, 20 bp, human
gtataggcgccaggggctcg

SEQ ID NO: 95896 - DNA, 20 bp, human
gtgtaggccgcggcccgggt

SEQ ID NO: 95897 - DNA, 20 bp, human
gggcagctgtggcgccgaca

SEQ ID NO: 95898 - DNA, 20 bp, human
gaggccgagcgcacagtccg

SEQ ID NO: 95899 - DNA, 20 bp, human
gcaccccgcagagtccaggg

SEQ ID NO: 95900 - DNA, 20 bp, human
gcccgagacgcagagaagca

SEQ ID NO: 95901 - DNA, 20 bp, human
gtaggtgtgggaggctccct

SEQ ID NO: 95902 - DNA, 20 bp, human
gccgggcggtcgctaggtgt

SEQ ID NO: 95903 - DNA, 20 bp, human
gcccgcagacgtgtcccggg

SEQ ID NO: 95904 - DNA, 20 bp, human
gtcggggtctctgacactcg

SEQ ID NO: 95905 - DNA, 20 bp, human
gggcggttgagctcctcgag

SEQ ID NO: 95906 - DNA, 20 bp, human
gaacccgtgcggctggagag

SEQ ID NO: 95907 - DNA, 20 bp, human
gcagcacgagaacggacaca

SEQ ID NO: 95908 - DNA, 20 bp, human
ggagccaggcacagagacaa

SEQ ID NO: 95909 - DNA, 20 bp, human
ggagtgcagccgaggctcgg

SEQ ID NO: 95910 - DNA, 20 bp, human
ggcccacctccgccgagcct

SEQ ID NO: 95911 - DNA, 20 bp, human
gccaggcacagagacaacgg

SEQ ID NO: 95912 - DNA, 20 bp, human
gctgtgcctggctctaggaa

SEQ ID NO: 95913 - DNA, 20 bp, human
gtgcagccgaggctcggcgg

SEQ ID NO: 95914 - DNA, 20 bp, human
gcctgtgggtctgtaggtta

SEQ ID NO: 95915 - DNA, 20 bp, human
gggagaagatggcggcgcta

SEQ ID NO: 95916 - DNA, 20 bp, human
gagcagcaggcgggaaaagg

SEQ ID NO: 95917 - DNA, 20 bp, human
gggtgctactcactctcgtc

SEQ ID NO: 95918 - DNA, 20 bp, human
gcggtctcgggaaaagtgag

SEQ ID NO: 95919 - DNA, 20 bp, human
gggaggcgcccaagcaacgt

SEQ ID NO: 95920 - DNA, 20 bp, human
gcgcggctcgttcaagatgg

SEQ ID NO: 95921 - DNA, 20 bp, human
gggacagcccccgcgcccag

SEQ ID NO: 95922 - DNA, 20 bp, human
gttccgagtggagaacggga

SEQ ID NO: 95923 - DNA, 20 bp, human
gcaccggagtgggaggacta

SEQ ID NO: 95924 - DNA, 20 bp, human
gccgagccgggcgggaggaa

SEQ ID NO: 95925 - DNA, 20 bp, human
gcggcgcggctcgttcaaga

SEQ ID NO: 95926 - DNA, 20 bp, human
ggcatcggatggctcacgga

SEQ ID NO: 95927 - DNA, 20 bp, human
gcacacatgcaggcatcgga

SEQ ID NO: 95928 - DNA, 20 bp, human
ggctccaacaataatgatga

SEQ ID NO: 95929 - DNA, 20 bp, human
gcagcctctccgggtatctg

SEQ ID NO: 95930 - DNA, 20 bp, human
gtacagaggagtatcaggaa

SEQ ID NO: 95931 - DNA, 20 bp, human
ggttccccagatacccggag

SEQ ID NO: 95932 - DNA, 20 bp, human
gagagctcaccttctagctg

SEQ ID NO: 95933 - DNA, 20 bp, human
gcaggactgggtaacaagaa

SEQ ID NO: 95934 - DNA, 20 bp, human
gctgtgaagctgccaggagc

SEQ ID NO: 95935 - DNA, 20 bp, human
gagctcaagtacccaggact

SEQ ID NO: 95936 - DNA, 20 bp, human
gactaggagcgagccaggga

SEQ ID NO: 95937 - DNA, 20 bp, human
gcgggctccgcgctctgcag

SEQ ID NO: 95938 - DNA, 20 bp, human
ggagcactaggagcgagcca

SEQ ID NO: 95939 - DNA, 20 bp, human
gggcgcggggagggagcact

SEQ ID NO: 95940 - DNA, 20 bp, human
ggactgccgggcggaggtgt

SEQ ID NO: 95941 - DNA, 20 bp, human
gtgccgggcggaggtgtcgg

SEQ ID NO: 95942 - DNA, 20 bp, human
gcgctcaggccgcgggacag

SEQ ID NO: 95943 - DNA, 20 bp, human
gagggaggagggatcgaggg

SEQ ID NO: 95944 - DNA, 20 bp, human
gcgggcggaggtgtcggagg

SEQ ID NO: 95945 - DNA, 20 bp, human
gcccgcgcggggcggacaga

SEQ ID NO: 95946 - DNA, 20 bp, human
gcagaggatgaagaccaagg

SEQ ID NO: 95947 - DNA, 20 bp, human
gggcaacaggagactggatg

SEQ ID NO: 95948 - DNA, 20 bp, human
gatacctgtgtagattacag

SEQ ID NO: 95949 - DNA, 20 bp, human
gttgcaaatgtatccaccta

SEQ ID NO: 95950 - DNA, 20 bp, human
gaaccccctgtaatctacac

SEQ ID NO: 95951 - DNA, 20 bp, human
gatatctattatgccttagg

SEQ ID NO: 95952 - DNA, 20 bp, human
gaatcctccaggtgccttta

SEQ ID NO: 95953 - DNA, 20 bp, human
gagtaaaggcaacaggagac

SEQ ID NO: 95954 - DNA, 20 bp, human
gtaaactccttaaaggcacc

SEQ ID NO: 95955 - DNA, 20 bp, human
gagaataaacagaagttcct

SEQ ID NO: 95956 - DNA, 20 bp, human
ggcacttctaaagtgtccag

SEQ ID NO: 95957 - DNA, 20 bp, human
gtcatgatacagctttctga

SEQ ID NO: 95958 - DNA, 20 bp, human
gtttggggctaacaaattag

SEQ ID NO: 95959 - DNA, 20 bp, human
gtaacttcctccagtcactt

SEQ ID NO: 95960 - DNA, 20 bp, human
gtcaccctcttgttatttgt

SEQ ID NO: 95961 - DNA, 20 bp, human
gatattagaacatgctaaaa

SEQ ID NO: 95962 - DNA, 20 bp, human
gtaatatacatttgaaagtg

SEQ ID NO: 95963 - DNA, 20 bp, human
gaattcctacaaataacaag

SEQ ID NO: 95964 - DNA, 20 bp, human
gcatgttgacaatccactgc

SEQ ID NO: 95965 - DNA, 20 bp, human
gttttattataccaaggaag

SEQ ID NO: 95966 - DNA, 20 bp, human
gacccggctcgggggagaca

SEQ ID NO: 95967 - DNA, 20 bp, human
gcggcggcggctgctcgtgt

SEQ ID NO: 95968 - DNA, 20 bp, human
gccccaggctggaccagacc

SEQ ID NO: 95969 - DNA, 20 bp, human
ggcagcccgcgccgtgtccg

SEQ ID NO: 95970 - DNA, 20 bp, human
gggagcgatgagcccgggag

SEQ ID NO: 95971 - DNA, 20 bp, human
gaaggagcggggaatcgggt

SEQ ID NO: 95972 - DNA, 20 bp, human
gtggaccagacccggctcgg

SEQ ID NO: 95973 - DNA, 20 bp, human
gagatgaagggggcactggt

SEQ ID NO: 95974 - DNA, 20 bp, human
gtcgggtgggcatctccccg

SEQ ID NO: 95975 - DNA, 20 bp, human
gcacctgggcggctccgccg

SEQ ID NO: 95976 - DNA, 20 bp, human
ggccgctgctgccaagactg

SEQ ID NO: 95977 - DNA, 20 bp, human
gacctcagtcttggcagcag

SEQ ID NO: 95978 - DNA, 20 bp, human
gcaagtacccctgggtggaa

SEQ ID NO: 95979 - DNA, 20 bp, human
gtggagaaaaacccttccag

SEQ ID NO: 95980 - DNA, 20 bp, human
gtccgagacaggccagacta

SEQ ID NO: 95981 - DNA, 20 bp, human
gtctttgggacagagagtgg

SEQ ID NO: 95982 - DNA, 20 bp, human
gtatcccaagtacccctggg

SEQ ID NO: 95983 - DNA, 20 bp, human
ggcttccccttcctctggaa

SEQ ID NO: 95984 - DNA, 20 bp, human
gccagtgcttccccttcctc

SEQ ID NO: 95985 - DNA, 20 bp, human
gcttggagcccttccaccca

SEQ ID NO: 95986 - DNA, 20 bp, human
gaactacggtggcccagagc

SEQ ID NO: 95987 - DNA, 20 bp, human
gtctgacaagcgctgaacag

SEQ ID NO: 95988 - DNA, 20 bp, human
gcggttacctgcctgggatc

SEQ ID NO: 95989 - DNA, 20 bp, human
gctccaggaagcgagtagag

SEQ ID NO: 95990 - DNA, 20 bp, human
gcggtcccggttacctgcct

SEQ ID NO: 95991 - DNA, 20 bp, human
gccagcacggcggccggtcc

SEQ ID NO: 95992 - DNA, 20 bp, human
gtcccctgctgccagcacgg

SEQ ID NO: 95993 - DNA, 20 bp, human
gcctgaaaggatagcaacgt

SEQ ID NO: 95994 - DNA, 20 bp, human
gcctgtgaatgaatggagag

SEQ ID NO: 95995 - DNA, 20 bp, human
ggcgggttcctgtgaatgaa

SEQ ID NO: 95996 - DNA, 20 bp, human
gtcgcagtgccagctctcag

SEQ ID NO: 95997 - DNA, 20 bp, human
gggcatccgccctcccgaca

SEQ ID NO: 95998 - DNA, 20 bp, human
ggcactgcgactcgagacag

SEQ ID NO: 95999 - DNA, 20 bp, human
gcgtggtcgaaagcagactt

SEQ ID NO: 96000 - DNA, 20 bp, human
gctcgcggtccaggagcact

SEQ ID NO: 96001 - DNA, 20 bp, human
gcctcccgacaaggcagacc

SEQ ID NO: 96002 - DNA, 20 bp, human
gaggggccggggtgcggata

SEQ ID NO: 96003 - DNA, 20 bp, human
gcaaatagtccgagggtggt

SEQ ID NO: 96004 - DNA, 20 bp, human
gtgccagctctcaggggccg

SEQ ID NO: 96005 - DNA, 20 bp, human
gcgccgttggctaacaagag

SEQ ID NO: 96006 - DNA, 20 bp, human
gcgcctgatgagaattgcca

SEQ ID NO: 96007 - DNA, 20 bp, human
gtttgctctcatgacgggta

SEQ ID NO: 96008 - DNA, 20 bp, human
gtgccttggcaattctcatc

SEQ ID NO: 96009 - DNA, 20 bp, human
gagttatttgctctcatgac

SEQ ID NO: 96010 - DNA, 20 bp, human
gtggcagttagaaagcaagt

SEQ ID NO: 96011 - DNA, 20 bp, human
ggcctttttagaagctctca

SEQ ID NO: 96012 - DNA, 20 bp, human
gtttagttaattaagtgctt

SEQ ID NO: 96013 - DNA, 20 bp, human
gccatccaaagcaagtttct

SEQ ID NO: 96014 - DNA, 20 bp, human
gctatgatagacattatgtc

SEQ ID NO: 96015 - DNA, 20 bp, human
gcagtgagtgattcctgaca

SEQ ID NO: 96016 - DNA, 20 bp, human
gcccgggtgaaacggagaaa

SEQ ID NO: 96017 - DNA, 20 bp, human
gaccaagaaagcctggaccc

SEQ ID NO: 96018 - DNA, 20 bp, human
gggtcgtgtatagaaccacc

SEQ ID NO: 96019 - DNA, 20 bp, human
gcaacagaatggagaaacac

SEQ ID NO: 96020 - DNA, 20 bp, human
gtgtgtcacaaagaatccag

SEQ ID NO: 96021 - DNA, 20 bp, human
ggcctggaccccgggtgaaa

SEQ ID NO: 96022 - DNA, 20 bp, human
gcatgctaaaagttattcag

SEQ ID NO: 96023 - DNA, 20 bp, human
gatcttcctgagagttaatg

SEQ ID NO: 96024 - DNA, 20 bp, human
ggtgtccctgtgaacctgtg

SEQ ID NO: 96025 - DNA, 20 bp, human
gatgcataaaaccaacagaa

SEQ ID NO: 96026 - DNA, 20 bp, human
gacagccgagaggcccaccc

SEQ ID NO: 96027 - DNA, 20 bp, human
ggctcgggattgggtaatag

SEQ ID NO: 96028 - DNA, 20 bp, human
gctcgctacacactactgtc

SEQ ID NO: 96029 - DNA, 20 bp, human
gtgtgccagggtgggcctct

SEQ ID NO: 96030 - DNA, 20 bp, human
ggaagagcaagctcgggatt

SEQ ID NO: 96031 - DNA, 20 bp, human
gcggcggtggcgaaaagaca

SEQ ID NO: 96032 - DNA, 20 bp, human
gagggagaccagaattggtt

SEQ ID NO: 96033 - DNA, 20 bp, human
gggcggagcacggcagcgga

SEQ ID NO: 96034 - DNA, 20 bp, human
ggactagctgacgcccggat

SEQ ID NO: 96035 - DNA, 20 bp, human
gtcggcttgggagcagagtc

SEQ ID NO: 96036 - DNA, 20 bp, human
gatcctcccaccaaagaaag

SEQ ID NO: 96037 - DNA, 20 bp, human
gcccgtgagggaaataacaa

SEQ ID NO: 96038 - DNA, 20 bp, human
gagagttcattacttagtgg

SEQ ID NO: 96039 - DNA, 20 bp, human
gagcccagaaggatagaacc

SEQ ID NO: 96040 - DNA, 20 bp, human
gtgggctctaggttccttct

SEQ ID NO: 96041 - DNA, 20 bp, human
ggtcagtgtctaggtcagac

SEQ ID NO: 96042 - DNA, 20 bp, human
gcacagagttcattacttag

SEQ ID NO: 96043 - DNA, 20 bp, human
gcactccatcctagcatcac

SEQ ID NO: 96044 - DNA, 20 bp, human
ggggttataggcctctggtg

SEQ ID NO: 96045 - DNA, 20 bp, human
gtcagcatcatgttgtgcag

SEQ ID NO: 96046 - DNA, 20 bp, human
gaatgtatctgtttaaatta

SEQ ID NO: 96047 - DNA, 20 bp, human
gagtttcctcagaaatagtt

SEQ ID NO: 96048 - DNA, 20 bp, human
ggacatgagactcttaatta

SEQ ID NO: 96049 - DNA, 20 bp, human
gtaatctagtgacatataat

SEQ ID NO: 96050 - DNA, 20 bp, human
gctttaaaaatgcatcactt

SEQ ID NO: 96051 - DNA, 20 bp, human
gaggattctgtttctctggc

SEQ ID NO: 96052 - DNA, 20 bp, human
gaattcaacagcagttgatt

SEQ ID NO: 96053 - DNA, 20 bp, human
gattatgagactttcacatt

SEQ ID NO: 96054 - DNA, 20 bp, human
ggagactagactttcacatt

SEQ ID NO: 96055 - DNA, 20 bp, human
gaattatggcttattcctct

SEQ ID NO: 96056 - DNA, 20 bp, human
gtcccggcggctcaggacga

SEQ ID NO: 96057 - DNA, 20 bp, human
gggcagggagcgagtgtcaa

SEQ ID NO: 96058 - DNA, 20 bp, human
ggcgagtccttgcctcccgg

SEQ ID NO: 96059 - DNA, 20 bp, human
ggagggcagatctcgttctg

SEQ ID NO: 96060 - DNA, 20 bp, human
ggcagcgagtccttgcctcc

SEQ ID NO: 96061 - DNA, 20 bp, human
gatgggcagcgcagtgggaa

SEQ ID NO: 96062 - DNA, 20 bp, human
gtgctgtcacgctcctatag

SEQ ID NO: 96063 - DNA, 20 bp, human
gggactccaaggtggattgg

SEQ ID NO: 96064 - DNA, 20 bp, human
gcgcagcaaagcaatagcag

SEQ ID NO: 96065 - DNA, 20 bp, human
gggtggactccaaggtggat

SEQ ID NO: 96066 - DNA, 20 bp, human
ggtgagctcagacgactcag

SEQ ID NO: 96067 - DNA, 20 bp, human
gtgtgagcaaaatcccacag

SEQ ID NO: 96068 - DNA, 20 bp, human
gctcagacgactcagaggtg

SEQ ID NO: 96069 - DNA, 20 bp, human
gagaatgatttacttcgcag

SEQ ID NO: 96070 - DNA, 20 bp, human
ggacaacaggaagttcccta

SEQ ID NO: 96071 - DNA, 20 bp, human
gatggacttaagttcaccga

SEQ ID NO: 96072 - DNA, 20 bp, human
ggcttaagagtttccactgt

SEQ ID NO: 96073 - DNA, 20 bp, human
gtgcctgcagtcagtcccta

SEQ ID NO: 96074 - DNA, 20 bp, human
gtcagaggtgtggtgacaac

SEQ ID NO: 96075 - DNA, 20 bp, human
gttccctagggactgactgc

SEQ ID NO: 96076 - DNA, 20 bp, human
ggaaattccgtaactcattg

SEQ ID NO: 96077 - DNA, 20 bp, human
ggagaaacctcaatgagtta

SEQ ID NO: 96078 - DNA, 20 bp, human
gtggtaggatcatcacaggc

SEQ ID NO: 96079 - DNA, 20 bp, human
gtctttggtaggatcatcac

SEQ ID NO: 96080 - DNA, 20 bp, human
gactcattgaggtttctctt

SEQ ID NO: 96081 - DNA, 20 bp, human
gtgatgtgctgggtgagatc

SEQ ID NO: 96082 - DNA, 20 bp, human
gagcactcaattcaccaaaa

SEQ ID NO: 96083 - DNA, 20 bp, human
gatagtgtggtctgtattct

SEQ ID NO: 96084 - DNA, 20 bp, human
gaggatcatcacaggctggc

SEQ ID NO: 96085 - DNA, 20 bp, human
gtttctagttactaattatc

SEQ ID NO: 96086 - DNA, 20 bp, human
ggaattctcagagactatga

SEQ ID NO: 96087 - DNA, 20 bp, human
gtgtatttggattaacgtat

SEQ ID NO: 96088 - DNA, 20 bp, human
gtcactaacaacctctgtag

SEQ ID NO: 96089 - DNA, 20 bp, human
gtaaatgaagatagaccgga

SEQ ID NO: 96090 - DNA, 20 bp, human
gtggattaacgtatgggaaa

SEQ ID NO: 96091 - DNA, 20 bp, human
gtacttaaatgaagatagac

SEQ ID NO: 96092 - DNA, 20 bp, human
gatccaactgaattaccatc

SEQ ID NO: 96093 - DNA, 20 bp, human
ggaccggatggtaattcagt

SEQ ID NO: 96094 - DNA, 20 bp, human
ggcagtctataatgacttaa

SEQ ID NO: 96095 - DNA, 20 bp, human
gaagatatacaagacttttg

SEQ ID NO: 96096 - DNA, 20 bp, human
gcctaggcagatcccaaatg

SEQ ID NO: 96097 - DNA, 20 bp, human
gccatatcaagaaacaggag

SEQ ID NO: 96098 - DNA, 20 bp, human
ggcacagacttagtcactgg

SEQ ID NO: 96099 - DNA, 20 bp, human
gcatgctggatgcttcttct

SEQ ID NO: 96100 - DNA, 20 bp, human
gttaggaagccaccactgga

SEQ ID NO: 96101 - DNA, 20 bp, human
gggtttgaactaccatccag

SEQ ID NO: 96102 - DNA, 20 bp, human
ggcttttagcagcagcatgc

SEQ ID NO: 96103 - DNA, 20 bp, human
gttgaactaccatccagtgg

SEQ ID NO: 96104 - DNA, 20 bp, human
gaatattcatattagcttca

SEQ ID NO: 96105 - DNA, 20 bp, human
gtttgggatctgcctaggaa

SEQ ID NO: 96106 - DNA, 20 bp, human
gactggatgtcagtagacct

SEQ ID NO: 96107 - DNA, 20 bp, human
gctgggtccacagctttagt

SEQ ID NO: 96108 - DNA, 20 bp, human
gtaggcaagcttagttggta

SEQ ID NO: 96109 - DNA, 20 bp, human
gatttgtgtgaggagacccc

SEQ ID NO: 96110 - DNA, 20 bp, human
gcaaattaggcaagcttagt

SEQ ID NO: 96111 - DNA, 20 bp, human
gcatatgccaactaaagctg

SEQ ID NO: 96112 - DNA, 20 bp, human
ggcctaatttgcttcagaat

SEQ ID NO: 96113 - DNA, 20 bp, human
gttagaattagttgttacat

SEQ ID NO: 96114 - DNA, 20 bp, human
gtccaattctgaagcaaatt

SEQ ID NO: 96115 - DNA, 20 bp, human
gacacaaatttagtaaactt

SEQ ID NO: 96116 - DNA, 20 bp, human
gagatctaggatggacactc

SEQ ID NO: 96117 - DNA, 20 bp, human
ggagtaatgcctgccataag

SEQ ID NO: 96118 - DNA, 20 bp, human
gaagctactgagtcccctta

SEQ ID NO: 96119 - DNA, 20 bp, human
ggtgcaagagctctgcagtg

SEQ ID NO: 96120 - DNA, 20 bp, human
gagaggtgagagatctagga

SEQ ID NO: 96121 - DNA, 20 bp, human
gaggtgaagctcatctaact

SEQ ID NO: 96122 - DNA, 20 bp, human
gtactgagtccccttatggc

SEQ ID NO: 96123 - DNA, 20 bp, human
gataaggagtccttgtgagc

SEQ ID NO: 96124 - DNA, 20 bp, human
gaagatctatcataaccagg

SEQ ID NO: 96125 - DNA, 20 bp, human
gaacttttgcttttgacatc

SEQ ID NO: 96126 - DNA, 20 bp, human
gcgtacccacggcctcgtga

SEQ ID NO: 96127 - DNA, 20 bp, human
gcggcttccggtcgtaccca

SEQ ID NO: 96128 - DNA, 20 bp, human
gacgaggccgtgggtacgac

SEQ ID NO: 96129 - DNA, 20 bp, human
ggctacggcccgcaacatcc

SEQ ID NO: 96130 - DNA, 20 bp, human
gacgaccggaagccgcaggt

SEQ ID NO: 96131 - DNA, 20 bp, human
gcgagccctcacgaggccgt

SEQ ID NO: 96132 - DNA, 20 bp, human
ggcgcgcgcccaagacccca

SEQ ID NO: 96133 - DNA, 20 bp, human
gtccagctcgagccctcacg

SEQ ID NO: 96134 - DNA, 20 bp, human
ggagaggggacaaaataata

SEQ ID NO: 96135 - DNA, 20 bp, human
gacctctgcactgccaaaca

SEQ ID NO: 96136 - DNA, 20 bp, human
ggccgtacgccgagctactg

SEQ ID NO: 96137 - DNA, 20 bp, human
ggccccgcggacgcaacggt

SEQ ID NO: 96138 - DNA, 20 bp, human
gaggcgcaccaaccgaacgg

SEQ ID NO: 96139 - DNA, 20 bp, human
gctagccagacgccagtgta

SEQ ID NO: 96140 - DNA, 20 bp, human
ggccccagtagctcggcgta

SEQ ID NO: 96141 - DNA, 20 bp, human
gcgcggcccccgccctacac

SEQ ID NO: 96142 - DNA, 20 bp, human
gtgagcgccgcggagcaggg

SEQ ID NO: 96143 - DNA, 20 bp, human
gcggttggtgcgcctgggtc

SEQ ID NO: 96144 - DNA, 20 bp, human
gcaggccctggagctcgcac

SEQ ID NO: 96145 - DNA, 20 bp, human
ggccagacgccagtgtaggg

SEQ ID NO: 96146 - DNA, 20 bp, human
ggacctcccggctcgacagg

SEQ ID NO: 96147 - DNA, 20 bp, human
gcgccgcctgtcgagccggg

SEQ ID NO: 96148 - DNA, 20 bp, human
ggccggggcgcggggaccag

SEQ ID NO: 96149 - DNA, 20 bp, human
gcccggagaggacggcccct

SEQ ID NO: 96150 - DNA, 20 bp, human
gaccagcgggagacagcggg

SEQ ID NO: 96151 - DNA, 20 bp, human
gtcagacctcccggctcgac

SEQ ID NO: 96152 - DNA, 20 bp, human
gttccagaaatatcccccgg

SEQ ID NO: 96153 - DNA, 20 bp, human
gccgcgccgcctgtcgagcc

SEQ ID NO: 96154 - DNA, 20 bp, human
gcagcaggtgctggcgccac

SEQ ID NO: 96155 - DNA, 20 bp, human
gcgattctctctagtgactc

SEQ ID NO: 96156 - DNA, 20 bp, human
ggaatctaaagacccctcag

SEQ ID NO: 96157 - DNA, 20 bp, human
gctgtacaggaggctcacac

SEQ ID NO: 96158 - DNA, 20 bp, human
gtgggaagagggccccctga

SEQ ID NO: 96159 - DNA, 20 bp, human
ggataagtgagcctgggaag

SEQ ID NO: 96160 - DNA, 20 bp, human
gctagagccggatctctgtg

SEQ ID NO: 96161 - DNA, 20 bp, human
gcgttcttctggctgaagtc

SEQ ID NO: 96162 - DNA, 20 bp, human
gaacaaagataagtgagcct

SEQ ID NO: 96163 - DNA, 20 bp, human
gtctctgtgaggcaagactt

SEQ ID NO: 96164 - DNA, 20 bp, human
gcccaagatggacagaacct

SEQ ID NO: 96165 - DNA, 20 bp, human
gcccagtgcctaatgcctgt

SEQ ID NO: 96166 - DNA, 20 bp, human
gtgcgcgacaccctctgtaa

SEQ ID NO: 96167 - DNA, 20 bp, human
gaagcgatccggaggactgt

SEQ ID NO: 96168 - DNA, 20 bp, human
gaggcgctagctgactgggg

SEQ ID NO: 96169 - DNA, 20 bp, human
gccccaggcgctagctgact

SEQ ID NO: 96170 - DNA, 20 bp, human
gcgccaatggagtagcgccc

SEQ ID NO: 96171 - DNA, 20 bp, human
ggagcaaggctcccttacag

SEQ ID NO: 96172 - DNA, 20 bp, human
gtgccagcctgccgagctaa

SEQ ID NO: 96173 - DNA, 20 bp, human
gtctccatcccggccgccaa

SEQ ID NO: 96174 - DNA, 20 bp, human
gctccggggcgctactccat

SEQ ID NO: 96175 - DNA, 20 bp, human
ggtggttgggaccgttagct

SEQ ID NO: 96176 - DNA, 20 bp, human
ggagccacgtcgggcccggg

SEQ ID NO: 96177 - DNA, 20 bp, human
gggccgcgcggcgcatcctg

SEQ ID NO: 96178 - DNA, 20 bp, human
gagcggcccgcagagactcg

SEQ ID NO: 96179 - DNA, 20 bp, human
gggtcagcggcggagaaaga

SEQ ID NO: 96180 - DNA, 20 bp, human
ggggcgagacagccggtcag

SEQ ID NO: 96181 - DNA, 20 bp, human
gagcttctcgcgctgcgggt

SEQ ID NO: 96182 - DNA, 20 bp, human
gcgagacagccggtcagcgg

SEQ ID NO: 96183 - DNA, 20 bp, human
gccgctctggctcggactct

SEQ ID NO: 96184 - DNA, 20 bp, human
ggcccgcgccttaggacccg

SEQ ID NO: 96185 - DNA, 20 bp, human
gcgcggccccgcgggtccta

SEQ ID NO: 96186 - DNA, 20 bp, human
gcggccgcccagcagcccgt

SEQ ID NO: 96187 - DNA, 20 bp, human
ggcgccggaggtgagcagga

SEQ ID NO: 96188 - DNA, 20 bp, human
gagcagcccgtgggcaggcg

SEQ ID NO: 96189 - DNA, 20 bp, human
gagcacagcgacgcggacag

SEQ ID NO: 96190 - DNA, 20 bp, human
gtggcctggcgcctgcacgt

SEQ ID NO: 96191 - DNA, 20 bp, human
ggctccgccgcgcctgccca

SEQ ID NO: 96192 - DNA, 20 bp, human
gctgtcgggccagggcggga

SEQ ID NO: 96193 - DNA, 20 bp, human
gcttaggagagcaggagaac

SEQ ID NO: 96194 - DNA, 20 bp, human
gcgagggacgccgaggcctc

SEQ ID NO: 96195 - DNA, 20 bp, human
gccctggcccgacagcccag

SEQ ID NO: 96196 - DNA, 20 bp, human
gcctgacagttgccagggta

SEQ ID NO: 96197 - DNA, 20 bp, human
ggaagcagtgaaggcaagga

SEQ ID NO: 96198 - DNA, 20 bp, human
ggaaaggcgaagccctaccc

SEQ ID NO: 96199 - DNA, 20 bp, human
gtgggagcaactccatagaa

SEQ ID NO: 96200 - DNA, 20 bp, human
gcggccaggtgagggacctg

SEQ ID NO: 96201 - DNA, 20 bp, human
gggcagcctgacagttgcca

SEQ ID NO: 96202 - DNA, 20 bp, human
ggggctccgtagctaggagt

SEQ ID NO: 96203 - DNA, 20 bp, human
gctcctgcccggccaggtga

SEQ ID NO: 96204 - DNA, 20 bp, human
gaggccagtgacctgatccc

SEQ ID NO: 96205 - DNA, 20 bp, human
gcttttgcagctcaggatca

SEQ ID NO: 96206 - DNA, 20 bp, human
gcggcgtgagcgtgaggtgt

SEQ ID NO: 96207 - DNA, 20 bp, human
gatgtgtcactggaccggtg

SEQ ID NO: 96208 - DNA, 20 bp, human
gaagtgcaaagacttccggt

SEQ ID NO: 96209 - DNA, 20 bp, human
gtccggtcggcgtgagcgtg

SEQ ID NO: 96210 - DNA, 20 bp, human
ggtcccatgtgtcactggac

SEQ ID NO: 96211 - DNA, 20 bp, human
gcagcgggagtgaacgacag

SEQ ID NO: 96212 - DNA, 20 bp, human
ggggagtgaacgacaggggt

SEQ ID NO: 96213 - DNA, 20 bp, human
gggtgagttcggttcctcac

SEQ ID NO: 96214 - DNA, 20 bp, human
gtagactccacgaaggtaga

SEQ ID NO: 96215 - DNA, 20 bp, human
gggttgagttatgtagacaa

SEQ ID NO: 96216 - DNA, 20 bp, human
gtccaggcaaaggggtctcc

SEQ ID NO: 96217 - DNA, 20 bp, human
gtccccgcgtgggcccagaa

SEQ ID NO: 96218 - DNA, 20 bp, human
gcgggtgagagagaacagaa

SEQ ID NO: 96219 - DNA, 20 bp, human
ggtgcgaaccaggagggacc

SEQ ID NO: 96220 - DNA, 20 bp, human
gcgggaacctcagcacacca

SEQ ID NO: 96221 - DNA, 20 bp, human
gtaccgacgagatcaaagaa

SEQ ID NO: 96222 - DNA, 20 bp, human
ggggtctccgggccagagtt

SEQ ID NO: 96223 - DNA, 20 bp, human
gcagaacagcggccgaactc

SEQ ID NO: 96224 - DNA, 20 bp, human
gtggcgggatccaggcaaag

SEQ ID NO: 96225 - DNA, 20 bp, human
gtgggtgagggaaagactcg

SEQ ID NO: 96226 - DNA, 20 bp, human
gcaggtcagaggtagaggaa

SEQ ID NO: 96227 - DNA, 20 bp, human
ggacctggaccactgaccgc

SEQ ID NO: 96228 - DNA, 20 bp, human
gctgaccgccggcatcgtga

SEQ ID NO: 96229 - DNA, 20 bp, human
gctgtgtgttcacaggtcag

SEQ ID NO: 96230 - DNA, 20 bp, human
ggttcacaggtcagaggtag

SEQ ID NO: 96231 - DNA, 20 bp, human
ggcctgaagtctgggccccg

SEQ ID NO: 96232 - DNA, 20 bp, human
ggaaggcagaataagggacc

SEQ ID NO: 96233 - DNA, 20 bp, human
gaggaggacaccccgtctca

SEQ ID NO: 96234 - DNA, 20 bp, human
gggcgccttcacgatgccgg

SEQ ID NO: 96235 - DNA, 20 bp, human
gccagctatgatctaccccg

SEQ ID NO: 96236 - DNA, 20 bp, human
gccggaaggcggaagttcta

SEQ ID NO: 96237 - DNA, 20 bp, human
ggtgagggcgaggctgaaca

SEQ ID NO: 96238 - DNA, 20 bp, human
ggaggagaggagaatggcgg

SEQ ID NO: 96239 - DNA, 20 bp, human
gcaagggcttcaccttggta

SEQ ID NO: 96240 - DNA, 20 bp, human
ggacccctgtgggaagagac

SEQ ID NO: 96241 - DNA, 20 bp, human
gaggggtcagacgtacgtac

SEQ ID NO: 96242 - DNA, 20 bp, human
ggctgccctggaagtcccag

SEQ ID NO: 96243 - DNA, 20 bp, human
gagctggaaccgacccctgt

SEQ ID NO: 96244 - DNA, 20 bp, human
ggaaggcggaagttctaggg

SEQ ID NO: 96245 - DNA, 20 bp, human
gtagggcggaagtggccgag

SEQ ID NO: 96246 - DNA, 20 bp, human
gtcgttggtgggaaagatgg

SEQ ID NO: 96247 - DNA, 20 bp, human
gcactgctgccacgacccaa

SEQ ID NO: 96248 - DNA, 20 bp, human
gggcgactctgggacccctt

SEQ ID NO: 96249 - DNA, 20 bp, human
gactccaggcctagtactag

SEQ ID NO: 96250 - DNA, 20 bp, human
ggggtcgttggtgggaaaga

SEQ ID NO: 96251 - DNA, 20 bp, human
gtgggcgcctcaccctggta

SEQ ID NO: 96252 - DNA, 20 bp, human
gggaagtttccagtaggtaa

SEQ ID NO: 96253 - DNA, 20 bp, human
gaggtgtgcctgccaagctc

SEQ ID NO: 96254 - DNA, 20 bp, human
ggaaagatggcggcgactct

SEQ ID NO: 96255 - DNA, 20 bp, human
gcgctgtcgaagccctacca

SEQ ID NO: 96256 - DNA, 20 bp, human
gagtcagagctgctcgtctg

SEQ ID NO: 96257 - DNA, 20 bp, human
gggcaggcagaggaagcgaa

SEQ ID NO: 96258 - DNA, 20 bp, human
ggacgagcagctctgactaa

SEQ ID NO: 96259 - DNA, 20 bp, human
gccgcgagccgtgttggaac

SEQ ID NO: 96260 - DNA, 20 bp, human
gagcagctctgactaaggga

SEQ ID NO: 96261 - DNA, 20 bp, human
gaggctgctgaggcgacggc

SEQ ID NO: 96262 - DNA, 20 bp, human
gacgggcccgcgagccgtgt

SEQ ID NO: 96263 - DNA, 20 bp, human
ggaacggagggagcgcgagg

SEQ ID NO: 96264 - DNA, 20 bp, human
gcgggcacgcgggactgtca

SEQ ID NO: 96265 - DNA, 20 bp, human
gcgcggtacctgttccaaca

SEQ ID NO: 96266 - DNA, 20 bp, human
ggctgcgaggaaaggcccct

SEQ ID NO: 96267 - DNA, 20 bp, human
gagcctgcgacagaaactcg

SEQ ID NO: 96268 - DNA, 20 bp, human
gagaaactcggggcagtctg

SEQ ID NO: 96269 - DNA, 20 bp, human
gacccagctgatcccatcta

SEQ ID NO: 96270 - DNA, 20 bp, human
gcggcactctgagaccaggt

SEQ ID NO: 96271 - DNA, 20 bp, human
gggctagcgatcccctagat

SEQ ID NO: 96272 - DNA, 20 bp, human
gctccgtccgggcagaaggg

SEQ ID NO: 96273 - DNA, 20 bp, human
gccccggcgaggagaagcgg

SEQ ID NO: 96274 - DNA, 20 bp, human
gagacgcgctgggtgagggg

SEQ ID NO: 96275 - DNA, 20 bp, human
gctcgtagcgagcctagtgg

SEQ ID NO: 96276 - DNA, 20 bp, human
gctgcacccgcgcaccctaa

SEQ ID NO: 96277 - DNA, 20 bp, human
ggcccaagcccccaacacta

SEQ ID NO: 96278 - DNA, 20 bp, human
gctgcaaccctagacgtcat

SEQ ID NO: 96279 - DNA, 20 bp, human
gccaccccgggcgctcaggt

SEQ ID NO: 96280 - DNA, 20 bp, human
gcgcaccctaaaggttaaag

SEQ ID NO: 96281 - DNA, 20 bp, human
gagaccaacctgagcgcccg

SEQ ID NO: 96282 - DNA, 20 bp, human
gacggcaagagcttccaaaa

SEQ ID NO: 96283 - DNA, 20 bp, human
gtctggaccggaagcgaaga

SEQ ID NO: 96284 - DNA, 20 bp, human
gaccctaaaggttaaagggg

SEQ ID NO: 96285 - DNA, 20 bp, human
gctcggggttgagaagtatg

SEQ ID NO: 96286 - DNA, 20 bp, human
gtcagccgctggactgtaga

SEQ ID NO: 96287 - DNA, 20 bp, human
gaaatccgtctacagtccag

SEQ ID NO: 96288 - DNA, 20 bp, human
ggcctgcgggctcccgagaa

SEQ ID NO: 96289 - DNA, 20 bp, human
ggccgccttctccccgacgg

SEQ ID NO: 96290 - DNA, 20 bp, human
gggcggcgctacggctgact

SEQ ID NO: 96291 - DNA, 20 bp, human
ggaaggcggccctaagaatt

SEQ ID NO: 96292 - DNA, 20 bp, human
ggcggaagcgggcggcgcta

SEQ ID NO: 96293 - DNA, 20 bp, human
gactgggaaatgtcagccgc

SEQ ID NO: 96294 - DNA, 20 bp, human
gccgttggaacgagagacaa

SEQ ID NO: 96295 - DNA, 20 bp, human
gaaggacttgggccccgcag

SEQ ID NO: 96296 - DNA, 20 bp, human
gttctcaggcagaggcgcga

SEQ ID NO: 96297 - DNA, 20 bp, human
gccaagttcgcgggcctggg

SEQ ID NO: 96298 - DNA, 20 bp, human
gggctgaatggccaagttcg

SEQ ID NO: 96299 - DNA, 20 bp, human
gtccgcgaacagatgggaag

SEQ ID NO: 96300 - DNA, 20 bp, human
gggggacagcggcggctgaa

SEQ ID NO: 96301 - DNA, 20 bp, human
ggaagtttccgcgaacagat

SEQ ID NO: 96302 - DNA, 20 bp, human
gtggccaagttcgcgggcct

SEQ ID NO: 96303 - DNA, 20 bp, human
gcctttgccatcctcttctg

SEQ ID NO: 96304 - DNA, 20 bp, human
gcgcctctgcctgagaagcc

SEQ ID NO: 96305 - DNA, 20 bp, human
gaggatggcaaaggtggcta

SEQ ID NO: 96306 - DNA, 20 bp, human
gggagccccgggaaaggaag

SEQ ID NO: 96307 - DNA, 20 bp, human
gctgcctgcggtccaggaca

SEQ ID NO: 96308 - DNA, 20 bp, human
gctttcccggggctccagag

SEQ ID NO: 96309 - DNA, 20 bp, human
gctgcggacagcgcacgtcc

SEQ ID NO: 96310 - DNA, 20 bp, human
ggtgcgctgtccgcagactc

SEQ ID NO: 96311 - DNA, 20 bp, human
gctccagagaggggagctcc

SEQ ID NO: 96312 - DNA, 20 bp, human
gcgcggcgcccgcagaggag

SEQ ID NO: 96313 - DNA, 20 bp, human
gtgccccgcttcctttcccg

SEQ ID NO: 96314 - DNA, 20 bp, human
gagccgcgcggcgcccgcag

SEQ ID NO: 96315 - DNA, 20 bp, human
gtccacgctcgcactcgtat

SEQ ID NO: 96316 - DNA, 20 bp, human
ggctgaggaggcggaagact

SEQ ID NO: 96317 - DNA, 20 bp, human
gaggctcgaggcggcgacag

SEQ ID NO: 96318 - DNA, 20 bp, human
gcgccctgacagcccaacaa

SEQ ID NO: 96319 - DNA, 20 bp, human
ggcctcctcagcgactccgc

SEQ ID NO: 96320 - DNA, 20 bp, human
ggcgcggccgtgcaacttcg

SEQ ID NO: 96321 - DNA, 20 bp, human
gcggccgcgcctgccaggac

SEQ ID NO: 96322 - DNA, 20 bp, human
gaagactgggtactcggatc

SEQ ID NO: 96323 - DNA, 20 bp, human
gctccggcccatctccacac

SEQ ID NO: 96324 - DNA, 20 bp, human
gtggtgcgcggaggtgacac

SEQ ID NO: 96325 - DNA, 20 bp, human
gcatagccccgagccggtcc

SEQ ID NO: 96326 - DNA, 20 bp, human
ggtgggacaggtaggagatc

SEQ ID NO: 96327 - DNA, 20 bp, human
gaggagatcgggctgagacc

SEQ ID NO: 96328 - DNA, 20 bp, human
ggccgcgtagcggacatggc

SEQ ID NO: 96329 - DNA, 20 bp, human
ggctctagcgggccgcgtag

SEQ ID NO: 96330 - DNA, 20 bp, human
ggcgggccgcgtagcggaca

SEQ ID NO: 96331 - DNA, 20 bp, human
gacagaactctgagagaggt

SEQ ID NO: 96332 - DNA, 20 bp, human
gcctggaggaagagctgccg

SEQ ID NO: 96333 - DNA, 20 bp, human
gctgtcccaccaggtctggg

SEQ ID NO: 96334 - DNA, 20 bp, human
gtcgggctgagacctggaag

SEQ ID NO: 96335 - DNA, 20 bp, human
ggcagtgggctctgctgggt

SEQ ID NO: 96336 - DNA, 20 bp, human
ggtctcgtagtggtaggtga

SEQ ID NO: 96337 - DNA, 20 bp, human
gaggtggtgtgcgaaccagg

SEQ ID NO: 96338 - DNA, 20 bp, human
gtggtgtgcgaaccaggcgg

SEQ ID NO: 96339 - DNA, 20 bp, human
gagccacgctgtccccaaca

SEQ ID NO: 96340 - DNA, 20 bp, human
gcactgggtctcgtagtggt

SEQ ID NO: 96341 - DNA, 20 bp, human
gtgagcttgtgcagccagac

SEQ ID NO: 96342 - DNA, 20 bp, human
gtggtcgtccagcagcgcag

SEQ ID NO: 96343 - DNA, 20 bp, human
gggcaggtggtgtgcgaacc

SEQ ID NO: 96344 - DNA, 20 bp, human
gtacaaggccttcccaacag

SEQ ID NO: 96345 - DNA, 20 bp, human
gcgaaccaggcggcgggcgt

SEQ ID NO: 96346 - DNA, 20 bp, human
gcgaagatggcggccgaatg

SEQ ID NO: 96347 - DNA, 20 bp, human
gacgctcggcccgaagatgg

SEQ ID NO: 96348 - DNA, 20 bp, human
ggcggaggagtgggttactc

SEQ ID NO: 96349 - DNA, 20 bp, human
gacgacgctcggcccgaaga

SEQ ID NO: 96350 - DNA, 20 bp, human
gcactgaggtagggcgacat

SEQ ID NO: 96351 - DNA, 20 bp, human
gccgaatggggcggaggagt

SEQ ID NO: 96352 - DNA, 20 bp, human
gagatggcggccgaatgggg

SEQ ID NO: 96353 - DNA, 20 bp, human
gagcagtagccctcgaggag

SEQ ID NO: 96354 - DNA, 20 bp, human
gcccctctgacactgaggta

SEQ ID NO: 96355 - DNA, 20 bp, human
gagaggcgtcacgcactcca

SEQ ID NO: 96356 - DNA, 20 bp, human
gcggacctcgggatctgggt

SEQ ID NO: 96357 - DNA, 20 bp, human
gccgggcgctgtcggacctc

SEQ ID NO: 96358 - DNA, 20 bp, human
gtgatgcgggtgggcgacag

SEQ ID NO: 96359 - DNA, 20 bp, human
gccgagctcggcctcgtagg

SEQ ID NO: 96360 - DNA, 20 bp, human
gccagccaacccagatcccg

SEQ ID NO: 96361 - DNA, 20 bp, human
gtggtcagccgcgaggtgtc

SEQ ID NO: 96362 - DNA, 20 bp, human
gcatggagaccccgtcccag

SEQ ID NO: 96363 - DNA, 20 bp, human
ggacagagactgctcggagt

SEQ ID NO: 96364 - DNA, 20 bp, human
gcgcatcaccgagtctgaag

SEQ ID NO: 96365 - DNA, 20 bp, human
ggcagccgggtgatgcgggt

SEQ ID NO: 96366 - DNA, 20 bp, human
gacaggcgcgtggggctcag

SEQ ID NO: 96367 - DNA, 20 bp, human
ggcgggaaaatgcaagacga

SEQ ID NO: 96368 - DNA, 20 bp, human
gcagcgcggctgcccatccg

SEQ ID NO: 96369 - DNA, 20 bp, human
gtggcgggcggcggagacag

SEQ ID NO: 96370 - DNA, 20 bp, human
ggcgggaccgtgataaggag

SEQ ID NO: 96371 - DNA, 20 bp, human
gcgcgagcgggaccgtgata

SEQ ID NO: 96372 - DNA, 20 bp, human
gccgctccgtgcagcctgag

SEQ ID NO: 96373 - DNA, 20 bp, human
ggagccgcgacaggcgcgtg

SEQ ID NO: 96374 - DNA, 20 bp, human
ggaccgtgataaggagggga

SEQ ID NO: 96375 - DNA, 20 bp, human
gcccccgtgccgccgcggat

SEQ ID NO: 96376 - DNA, 20 bp, human
gcggcctgcgctgctcccga

SEQ ID NO: 96377 - DNA, 20 bp, human
ggaatgagcccgccgagccc

SEQ ID NO: 96378 - DNA, 20 bp, human
gcctgcgctgctcccgacgg

SEQ ID NO: 96379 - DNA, 20 bp, human
gacggcggcccgggctcggc

SEQ ID NO: 96380 - DNA, 20 bp, human
gacaggcgcgtgggcgacag

SEQ ID NO: 96381 - DNA, 20 bp, human
ggctggagctggagaacgac

SEQ ID NO: 96382 - DNA, 20 bp, human
gggcgccatcttgcagccgg

SEQ ID NO: 96383 - DNA, 20 bp, human
gcgattgcccaccccgcggt

SEQ ID NO: 96384 - DNA, 20 bp, human
gggacgggccccggcttcgg

SEQ ID NO: 96385 - DNA, 20 bp, human
gccagcgattgcccaccccg

SEQ ID NO: 96386 - DNA, 20 bp, human
gcactctgctgaggcgagta

SEQ ID NO: 96387 - DNA, 20 bp, human
ggagtccaccccgctagcgg

SEQ ID NO: 96388 - DNA, 20 bp, human
gggacgtggggcggagactg

SEQ ID NO: 96389 - DNA, 20 bp, human
gctgctgaggcgagtacggc

SEQ ID NO: 96390 - DNA, 20 bp, human
gggaggcccgcgggtgctga

SEQ ID NO: 96391 - DNA, 20 bp, human
ggcctcctccggctgatggg

SEQ ID NO: 96392 - DNA, 20 bp, human
ggcggagtccaccccgctag

SEQ ID NO: 96393 - DNA, 20 bp, human
ggaggcgagtacggccggcg

SEQ ID NO: 96394 - DNA, 20 bp, human
ggcccggtgccggtgcccgg

SEQ ID NO: 96395 - DNA, 20 bp, human
gtctgccgccgctagcgggg

SEQ ID NO: 96396 - DNA, 20 bp, human
gctaggctcggccgggagaa

SEQ ID NO: 96397 - DNA, 20 bp, human
gctcggggcgcgctttggag

SEQ ID NO: 96398 - DNA, 20 bp, human
gccgctagctgcccgaagac

SEQ ID NO: 96399 - DNA, 20 bp, human
gggagaaaggcagcgggaga

SEQ ID NO: 96400 - DNA, 20 bp, human
gggaggggcggccggtcttc

SEQ ID NO: 96401 - DNA, 20 bp, human
gattatattcaaagagatgg

SEQ ID NO: 96402 - DNA, 20 bp, human
gaagagatgggggaatctcg

SEQ ID NO: 96403 - DNA, 20 bp, human
gcgggagaagggcgccgact

SEQ ID NO: 96404 - DNA, 20 bp, human
ggtagttccttccaattctg

SEQ ID NO: 96405 - DNA, 20 bp, human
gggggcgcgctttggagggg

SEQ ID NO: 96406 - DNA, 20 bp, human
gcccgggccgaaggtgcgag

SEQ ID NO: 96407 - DNA, 20 bp, human
gggcgcccgagcacccgagg

SEQ ID NO: 96408 - DNA, 20 bp, human
gggagcgccggagcaagcgg

SEQ ID NO: 96409 - DNA, 20 bp, human
gtcgccgccgagggcagaga

SEQ ID NO: 96410 - DNA, 20 bp, human
ggccagccccgcgccacaaa

SEQ ID NO: 96411 - DNA, 20 bp, human
gtcgatggccgaggacattg

SEQ ID NO: 96412 - DNA, 20 bp, human
ggcaccttcggcccgggtcg

SEQ ID NO: 96413 - DNA, 20 bp, human
gggcggcgcccgagcacccg

SEQ ID NO: 96414 - DNA, 20 bp, human
ggcgcgcgagagggaccggg

SEQ ID NO: 96415 - DNA, 20 bp, human
ggcgcgctgctcgccgccga

SEQ ID NO: 96416 - DNA, 20 bp, human
gggccgttcagtaagcacag

SEQ ID NO: 96417 - DNA, 20 bp, human
ggtcttgacaagcgctgcct

SEQ ID NO: 96418 - DNA, 20 bp, human
gagcgctgcctgggctccgc

SEQ ID NO: 96419 - DNA, 20 bp, human
gcctaaaaggaggacacctg

SEQ ID NO: 96420 - DNA, 20 bp, human
gtcagttattagtgagccgg

SEQ ID NO: 96421 - DNA, 20 bp, human
ggacacctgtggctcagatg

SEQ ID NO: 96422 - DNA, 20 bp, human
gcaactgtgtacacacgcgt

SEQ ID NO: 96423 - DNA, 20 bp, human
gaattaagcgatacaggggg

SEQ ID NO: 96424 - DNA, 20 bp, human
gctcaattaagcgatacagg

SEQ ID NO: 96425 - DNA, 20 bp, human
gtcaaggatacgccaagcaa

SEQ ID NO: 96426 - DNA, 20 bp, human
ggaggtggggtagaacagtg

SEQ ID NO: 96427 - DNA, 20 bp, human
gggagaggaaagcaaaccac

SEQ ID NO: 96428 - DNA, 20 bp, human
gagtggggagctgtgcggat

SEQ ID NO: 96429 - DNA, 20 bp, human
ggttgacttgttctgtacat

SEQ ID NO: 96430 - DNA, 20 bp, human
gagagctagattaaaactga

SEQ ID NO: 96431 - DNA, 20 bp, human
gtagcttaaatactcatggg

SEQ ID NO: 96432 - DNA, 20 bp, human
gtggcttttctggcccgtct

SEQ ID NO: 96433 - DNA, 20 bp, human
gtatgagccttcaaaaggga

SEQ ID NO: 96434 - DNA, 20 bp, human
gacagaacaagtcaactaag

SEQ ID NO: 96435 - DNA, 20 bp, human
gcatgtatgcctgcctagac

SEQ ID NO: 96436 - DNA, 20 bp, human
gggcttcaggcgcggcgcag

SEQ ID NO: 96437 - DNA, 20 bp, human
gcatgtgtaagagccgcgga

SEQ ID NO: 96438 - DNA, 20 bp, human
ggagcgagcgagccggctag

SEQ ID NO: 96439 - DNA, 20 bp, human
gcgcggcgcggcttcaggcg

SEQ ID NO: 96440 - DNA, 20 bp, human
ggacacaacagccccgggag

SEQ ID NO: 96441 - DNA, 20 bp, human
gctgttgctgcccggctcgg

SEQ ID NO: 96442 - DNA, 20 bp, human
ggctgctcgcgcgcagtcgg

SEQ ID NO: 96443 - DNA, 20 bp, human
gtgcaatttgggacggtcag

SEQ ID NO: 96444 - DNA, 20 bp, human
gtctcgcagaagcaggaaag

SEQ ID NO: 96445 - DNA, 20 bp, human
gggagcggcggcggacggtg

SEQ ID NO: 96446 - DNA, 20 bp, human
gcaggacgcgggaagcgaag

SEQ ID NO: 96447 - DNA, 20 bp, human
gccgaggcagtcaacacctg

SEQ ID NO: 96448 - DNA, 20 bp, human
gggtgccgcgcgctgccgct

SEQ ID NO: 96449 - DNA, 20 bp, human
ggaagtccaaactgtcgtcg

SEQ ID NO: 96450 - DNA, 20 bp, human
gccatggctaggacaaggga

SEQ ID NO: 96451 - DNA, 20 bp, human
gcgcgggcctcccacaactc

SEQ ID NO: 96452 - DNA, 20 bp, human
ggcagtcaacacctgcggaa

SEQ ID NO: 96453 - DNA, 20 bp, human
gcgcggggacccgggcagtc

SEQ ID NO: 96454 - DNA, 20 bp, human
ggagcggaagccggagttgt

SEQ ID NO: 96455 - DNA, 20 bp, human
gccttccatggctaggacaa

SEQ ID NO: 96456 - DNA, 20 bp, human
gagaagccaatccccaagct

SEQ ID NO: 96457 - DNA, 20 bp, human
gcaatccccaagctgggggc

SEQ ID NO: 96458 - DNA, 20 bp, human
gcaggtgctgaagtgttcac

SEQ ID NO: 96459 - DNA, 20 bp, human
ggggctatcagagtcctggt

SEQ ID NO: 96460 - DNA, 20 bp, human
gagacggagaaacagtccac

SEQ ID NO: 96461 - DNA, 20 bp, human
ggcccagggctagtggaccc

SEQ ID NO: 96462 - DNA, 20 bp, human
gacgggtgtgtacaaccggg

SEQ ID NO: 96463 - DNA, 20 bp, human
gtccacgggtgtgtacaacc

SEQ ID NO: 96464 - DNA, 20 bp, human
gtgatctggatgcagcgagt

SEQ ID NO: 96465 - DNA, 20 bp, human
gccccggctggtctaatcag

SEQ ID NO: 96466 - DNA, 20 bp, human
gaaggaccaggcattcaagg

SEQ ID NO: 96467 - DNA, 20 bp, human
gattcaaggcggccagaagc

SEQ ID NO: 96468 - DNA, 20 bp, human
gcggtagccaaaggtagaca

SEQ ID NO: 96469 - DNA, 20 bp, human
gtagccccacgggaaggttg

SEQ ID NO: 96470 - DNA, 20 bp, human
gttgccttagccccacggga

SEQ ID NO: 96471 - DNA, 20 bp, human
ggatgaggattgagaagtta

SEQ ID NO: 96472 - DNA, 20 bp, human
gttagggaaaacaagtgtct

SEQ ID NO: 96473 - DNA, 20 bp, human
gagtcctcttcggtagccaa

SEQ ID NO: 96474 - DNA, 20 bp, human
gggtccttcaagctccttct

SEQ ID NO: 96475 - DNA, 20 bp, human
gtgtggaaaggtaggctctc

SEQ ID NO: 96476 - DNA, 20 bp, human
ggccctgcttaatatagatc

SEQ ID NO: 96477 - DNA, 20 bp, human
ggttacctcggatttcacaa

SEQ ID NO: 96478 - DNA, 20 bp, human
ggcaaaccactgaggttcct

SEQ ID NO: 96479 - DNA, 20 bp, human
gctcaagggtgtgttaactt

SEQ ID NO: 96480 - DNA, 20 bp, human
gaaactgacaagccaccgac

SEQ ID NO: 96481 - DNA, 20 bp, human
ggattgaagtttcctgtcgg

SEQ ID NO: 96482 - DNA, 20 bp, human
gctgaatcattcccacggga

SEQ ID NO: 96483 - DNA, 20 bp, human
gtcggttgtacacaaatctc

SEQ ID NO: 96484 - DNA, 20 bp, human
gtaactgggggaccttcttg

SEQ ID NO: 96485 - DNA, 20 bp, human
gcattcccacgggaaggctg

SEQ ID NO: 96486 - DNA, 20 bp, human
gcgccagcagccctgcggag

SEQ ID NO: 96487 - DNA, 20 bp, human
gcacatgacgcagcccatca

SEQ ID NO: 96488 - DNA, 20 bp, human
ggcgctcccgccgccatgat

SEQ ID NO: 96489 - DNA, 20 bp, human
gccaggcccgccgctccgca

SEQ ID NO: 96490 - DNA, 20 bp, human
gtggcgttgctgctgttgag

SEQ ID NO: 96491 - DNA, 20 bp, human
ggaatcggagggcctgccgg

SEQ ID NO: 96492 - DNA, 20 bp, human
gtgctgctgttgagaggcgg

SEQ ID NO: 96493 - DNA, 20 bp, human
gctcggcgccgaggaatcgg

SEQ ID NO: 96494 - DNA, 20 bp, human
gggaggcaggatcgactgac

SEQ ID NO: 96495 - DNA, 20 bp, human
gctgatcgccggcagtgctg

SEQ ID NO: 96496 - DNA, 20 bp, human
gagaggtccgcgcccagggt

SEQ ID NO: 96497 - DNA, 20 bp, human
gacctgcgaggcgttcccct

SEQ ID NO: 96498 - DNA, 20 bp, human
ggtgctcacggacgatggag

SEQ ID NO: 96499 - DNA, 20 bp, human
gaaacgctgcggacgatacc

SEQ ID NO: 96500 - DNA, 20 bp, human
ggtaaccgcacgggaaacgt

SEQ ID NO: 96501 - DNA, 20 bp, human
ggtgggatgtgaccccgaga

SEQ ID NO: 96502 - DNA, 20 bp, human
gaacgcctcgcaggtgctca

SEQ ID NO: 96503 - DNA, 20 bp, human
gcatacataagcacagacat

SEQ ID NO: 96504 - DNA, 20 bp, human
gatggagaggtccgcgccca

SEQ ID NO: 96505 - DNA, 20 bp, human
gcgttcccctgggtgaggct

SEQ ID NO: 96506 - DNA, 20 bp, human
ggactcgcacccaggaccct

SEQ ID NO: 96507 - DNA, 20 bp, human
ggaagctgcaggatccgccc

SEQ ID NO: 96508 - DNA, 20 bp, human
gcctccggctgcagtctcgg

SEQ ID NO: 96509 - DNA, 20 bp, human
ggctgcccgtgcctaggctg

SEQ ID NO: 96510 - DNA, 20 bp, human
gtgcttctccaaggctagga

SEQ ID NO: 96511 - DNA, 20 bp, human
gggcgctccgaagccgaggg

SEQ ID NO: 96512 - DNA, 20 bp, human
ggcactgtaagggacccgga

SEQ ID NO: 96513 - DNA, 20 bp, human
gcctgccccaggtcgagaag

SEQ ID NO: 96514 - DNA, 20 bp, human
gtgggacctggtccgcgata

SEQ ID NO: 96515 - DNA, 20 bp, human
gcaaaagagtcgcctcgggg

SEQ ID NO: 96516 - DNA, 20 bp, human
ggccccagctctaaacccgg

SEQ ID NO: 96517 - DNA, 20 bp, human
gtctaaacccggcggctcag

SEQ ID NO: 96518 - DNA, 20 bp, human
gtgtcagtcccggaacccgg

SEQ ID NO: 96519 - DNA, 20 bp, human
gcgcggccctggaaccgggg

SEQ ID NO: 96520 - DNA, 20 bp, human
gagcgggcgcaccatggcac

SEQ ID NO: 96521 - DNA, 20 bp, human
ggccgccgggtttagagctg

SEQ ID NO: 96522 - DNA, 20 bp, human
gactgacaagcaggtgacag

SEQ ID NO: 96523 - DNA, 20 bp, human
ggcccccggcgatcgtggag

SEQ ID NO: 96524 - DNA, 20 bp, human
gcagtcccggaacccggcgg

SEQ ID NO: 96525 - DNA, 20 bp, human
gcggcggagagcgggtggac

SEQ ID NO: 96526 - DNA, 20 bp, human
gaccgtgctaacggccacag

SEQ ID NO: 96527 - DNA, 20 bp, human
gcgcgtgcccgagaaaccaa

SEQ ID NO: 96528 - DNA, 20 bp, human
gccgggttaagggaaagcgt

SEQ ID NO: 96529 - DNA, 20 bp, human
gacggccacagaggttcaag

SEQ ID NO: 96530 - DNA, 20 bp, human
ggcggatcagagcgagatgt

SEQ ID NO: 96531 - DNA, 20 bp, human
gggcgctcaagagatccgag

SEQ ID NO: 96532 - DNA, 20 bp, human
gggcacctcttgaacctctg

SEQ ID NO: 96533 - DNA, 20 bp, human
ggcgatggcagaagactagg

SEQ ID NO: 96534 - DNA, 20 bp, human
gggtcgctgtggctcatcgt

SEQ ID NO: 96535 - DNA, 20 bp, human
ggttataggggagatagcga

SEQ ID NO: 96536 - DNA, 20 bp, human
gctgctgtgcgcagaggagt

SEQ ID NO: 96537 - DNA, 20 bp, human
ggagtgggcagtgggaaagt

SEQ ID NO: 96538 - DNA, 20 bp, human
gtcggcagcccactcaccat

SEQ ID NO: 96539 - DNA, 20 bp, human
gacgccggcagctcactgaa

SEQ ID NO: 96540 - DNA, 20 bp, human
ggtgcctcaggagggcggtg

SEQ ID NO: 96541 - DNA, 20 bp, human
gccgcctcagctctcggagt

SEQ ID NO: 96542 - DNA, 20 bp, human
gctcctgaggcactctgatg

SEQ ID NO: 96543 - DNA, 20 bp, human
gtcactgctcgaaggaccga

SEQ ID NO: 96544 - DNA, 20 bp, human
gtgcccagcgcggcctccaa

SEQ ID NO: 96545 - DNA, 20 bp, human
ggtaggaagctcgggcgctc

SEQ ID NO: 96546 - DNA, 20 bp, human
gcccctgagggatctgaaca

SEQ ID NO: 96547 - DNA, 20 bp, human
gcccagacagtcgcttgaag

SEQ ID NO: 96548 - DNA, 20 bp, human
ggagggcctgggaaacaacc

SEQ ID NO: 96549 - DNA, 20 bp, human
gctggacacgtgctgtgctc

SEQ ID NO: 96550 - DNA, 20 bp, human
gtgaatacctgcaagcaggt

SEQ ID NO: 96551 - DNA, 20 bp, human
gttagaccactggcccctga

SEQ ID NO: 96552 - DNA, 20 bp, human
gttgaggctggtcacaactc

SEQ ID NO: 96553 - DNA, 20 bp, human
gcaagtacgaggacaagcac

SEQ ID NO: 96554 - DNA, 20 bp, human
ggtgaaccgagcagctcctt

SEQ ID NO: 96555 - DNA, 20 bp, human
gtgacttcagatctgaacac

SEQ ID NO: 96556 - DNA, 20 bp, human
gctggtccaggagggagagt

SEQ ID NO: 96557 - DNA, 20 bp, human
gtgagaagtgaagtcttggc

SEQ ID NO: 96558 - DNA, 20 bp, human
gcctggcaaaaagcaaactc

SEQ ID NO: 96559 - DNA, 20 bp, human
gcggcggcggcgattcctgg

SEQ ID NO: 96560 - DNA, 20 bp, human
gagacagccgcgaaggacca

SEQ ID NO: 96561 - DNA, 20 bp, human
gtttgccaggaaatccgcgg

SEQ ID NO: 96562 - DNA, 20 bp, human
gagagggcgcgcagcgaggc

SEQ ID NO: 96563 - DNA, 20 bp, human
gctttttgccaggaaatccg

SEQ ID NO: 96564 - DNA, 20 bp, human
gccgcggcccgctgagggag

SEQ ID NO: 96565 - DNA, 20 bp, human
gctgacgcccgcacctgagg

SEQ ID NO: 96566 - DNA, 20 bp, human
gctgataacaaggtctctgg

SEQ ID NO: 96567 - DNA, 20 bp, human
gggtgaaggctggggattca

SEQ ID NO: 96568 - DNA, 20 bp, human
gctggagctgcccggggtga

SEQ ID NO: 96569 - DNA, 20 bp, human
gccaggtactgagggccgtc

SEQ ID NO: 96570 - DNA, 20 bp, human
gcagggaaatgtcccatacc

SEQ ID NO: 96571 - DNA, 20 bp, human
gcatacctggaagcccaaaa

SEQ ID NO: 96572 - DNA, 20 bp, human
gaaaggcttcaggggatgag

SEQ ID NO: 96573 - DNA, 20 bp, human
gagctgcccggggtgaaggc

SEQ ID NO: 96574 - DNA, 20 bp, human
gttagatgaaaaggcttcag

SEQ ID NO: 96575 - DNA, 20 bp, human
gctccagccccaggggtcta

SEQ ID NO: 96576 - DNA, 20 bp, human
gtccacagttcctccaagta

SEQ ID NO: 96577 - DNA, 20 bp, human
gaagtttctgccttacttgg

SEQ ID NO: 96578 - DNA, 20 bp, human
gaaaaagtttctgccttact

SEQ ID NO: 96579 - DNA, 20 bp, human
ggccttacttggaggaactg

SEQ ID NO: 96580 - DNA, 20 bp, human
gagttctagaccagcccggt

SEQ ID NO: 96581 - DNA, 20 bp, human
ggtttgaggtgggtgagctt

SEQ ID NO: 96582 - DNA, 20 bp, human
gacaaaaaacaagaccctca

SEQ ID NO: 96583 - DNA, 20 bp, human
gcctgttgcccccaccgggc

SEQ ID NO: 96584 - DNA, 20 bp, human
gctggctgctcaggaagctt

SEQ ID NO: 96585 - DNA, 20 bp, human
gggaggaactgtggacatca

SEQ ID NO: 96586 - DNA, 20 bp, human
ggccgcactgcaccgagcgg

SEQ ID NO: 96587 - DNA, 20 bp, human
gcgcgccgcactgcaccgag

SEQ ID NO: 96588 - DNA, 20 bp, human
gggcaggacggtaagcaaag

SEQ ID NO: 96589 - DNA, 20 bp, human
ggaggccgttagcttagtca

SEQ ID NO: 96590 - DNA, 20 bp, human
gcggcggcagcggcaagctt

SEQ ID NO: 96591 - DNA, 20 bp, human
ggcactctcgcgagactgtg

SEQ ID NO: 96592 - DNA, 20 bp, human
ggctccgctagcagctaaga

SEQ ID NO: 96593 - DNA, 20 bp, human
gtgctagcggagctcctcag

SEQ ID NO: 96594 - DNA, 20 bp, human
gccgtacgaggtgggtgtcg

SEQ ID NO: 96595 - DNA, 20 bp, human
gggcgcggcggagcagccaa

SEQ ID NO: 96596 - DNA, 20 bp, human
gcaggtacaggccctcttaa

SEQ ID NO: 96597 - DNA, 20 bp, human
gttgtgagacaagggagtga

SEQ ID NO: 96598 - DNA, 20 bp, human
ggtggaacgaggtagaggac

SEQ ID NO: 96599 - DNA, 20 bp, human
gcggagttgccgatagggtt

SEQ ID NO: 96600 - DNA, 20 bp, human
gtcgccacaccgaaccctat

SEQ ID NO: 96601 - DNA, 20 bp, human
gacccgcgggtcggccacaa

SEQ ID NO: 96602 - DNA, 20 bp, human
ggtggctgcgaggcagcagg

SEQ ID NO: 96603 - DNA, 20 bp, human
gtgtcgcggagttgccgata

SEQ ID NO: 96604 - DNA, 20 bp, human
ggtgccccgtgccattaaga

SEQ ID NO: 96605 - DNA, 20 bp, human
gatgaagtcctcaggaacgg

SEQ ID NO: 96606 - DNA, 20 bp, human
gggcgggaagaaacacgcag

SEQ ID NO: 96607 - DNA, 20 bp, human
ggcccgcgaaggcggagtta

SEQ ID NO: 96608 - DNA, 20 bp, human
gtggggtgcagggcccgcga

SEQ ID NO: 96609 - DNA, 20 bp, human
gggtgcagggcccgcgaagg

SEQ ID NO: 96610 - DNA, 20 bp, human
ggcggagttagggagaggcc

SEQ ID NO: 96611 - DNA, 20 bp, human
ggagttccagcagagatccc

SEQ ID NO: 96612 - DNA, 20 bp, human
ggcgcagatgctgtcctcgg

SEQ ID NO: 96613 - DNA, 20 bp, human
ggatcccaggcctgaagcag

SEQ ID NO: 96614 - DNA, 20 bp, human
gcacacccgcggccatccaa

SEQ ID NO: 96615 - DNA, 20 bp, human
gtgtaatgtaaaacacacta

SEQ ID NO: 96616 - DNA, 20 bp, human
gggccagcctcactcaccaa

SEQ ID NO: 96617 - DNA, 20 bp, human
gctgggctcactgcctccat

SEQ ID NO: 96618 - DNA, 20 bp, human
ggagtgaggctggcccatgg

SEQ ID NO: 96619 - DNA, 20 bp, human
ggctacatggccagagccat

SEQ ID NO: 96620 - DNA, 20 bp, human
gtcttgtcttaggtttggag

SEQ ID NO: 96621 - DNA, 20 bp, human
gtctggcatacgaacgtctt

SEQ ID NO: 96622 - DNA, 20 bp, human
gagtgtaaggtgtacaaatg

SEQ ID NO: 96623 - DNA, 20 bp, human
ggctcttgtccagaccagat

SEQ ID NO: 96624 - DNA, 20 bp, human
gttgggactagagtttatca

SEQ ID NO: 96625 - DNA, 20 bp, human
gtgatcacctttggtgagtg

SEQ ID NO: 96626 - DNA, 20 bp, human
ggagatgctgctgcagagac

SEQ ID NO: 96627 - DNA, 20 bp, human
gaacagagacagtactgcaa

SEQ ID NO: 96628 - DNA, 20 bp, human
gtttcaacagtgctgatgag

SEQ ID NO: 96629 - DNA, 20 bp, human
gaattcaccagaagttcctt

SEQ ID NO: 96630 - DNA, 20 bp, human
gaaaatcaaacaactgccaa

SEQ ID NO: 96631 - DNA, 20 bp, human
gtcacactccgttttataaa

SEQ ID NO: 96632 - DNA, 20 bp, human
gaagtctcacatttgatttc

SEQ ID NO: 96633 - DNA, 20 bp, human
ggtatttttttcatcaggca

SEQ ID NO: 96634 - DNA, 20 bp, human
gcaactgccaaaggaacttc

SEQ ID NO: 96635 - DNA, 20 bp, human
ggaaaatgccatttataaaa

SEQ ID NO: 96636 - DNA, 20 bp, human
gtccatgggcaacactgcag

SEQ ID NO: 96637 - DNA, 20 bp, human
gagacaggaagagtaaacca

SEQ ID NO: 96638 - DNA, 20 bp, human
gccccctgccacactggaca

SEQ ID NO: 96639 - DNA, 20 bp, human
gcactgcagaggaaggcaaa

SEQ ID NO: 96640 - DNA, 20 bp, human
gactgacaccttgtccagtg

SEQ ID NO: 96641 - DNA, 20 bp, human
gccctggggtccatggtcct

SEQ ID NO: 96642 - DNA, 20 bp, human
ggactggcttgtcctcttct

SEQ ID NO: 96643 - DNA, 20 bp, human
gcagggtagatgcatcttaa

SEQ ID NO: 96644 - DNA, 20 bp, human
gagcaatggtatctccacat

SEQ ID NO: 96645 - DNA, 20 bp, human
gtggaaatagtggatgatca

SEQ ID NO: 96646 - DNA, 20 bp, human
ggccttagggccacacggaa

SEQ ID NO: 96647 - DNA, 20 bp, human
gtgggagccttagggccaca

SEQ ID NO: 96648 - DNA, 20 bp, human
ggcacgaggcgcatagctag

SEQ ID NO: 96649 - DNA, 20 bp, human
gagctggaggtagtgttcct

SEQ ID NO: 96650 - DNA, 20 bp, human
gctgggagcaggaatctctg

SEQ ID NO: 96651 - DNA, 20 bp, human
gacccttccgtgtggcccta

SEQ ID NO: 96652 - DNA, 20 bp, human
gggaggtctcggcagtccag

SEQ ID NO: 96653 - DNA, 20 bp, human
gttcctgggtatagcatgat

SEQ ID NO: 96654 - DNA, 20 bp, human
ggacccttggctgaggttgg

SEQ ID NO: 96655 - DNA, 20 bp, human
gaggtgccagaccaggaccg

SEQ ID NO: 96656 - DNA, 20 bp, human
gtcagagacgacaacgaagt

SEQ ID NO: 96657 - DNA, 20 bp, human
gagcgtctggtagctcccct

SEQ ID NO: 96658 - DNA, 20 bp, human
gccaagctgcttgggtagga

SEQ ID NO: 96659 - DNA, 20 bp, human
gaaaaccaagctgcttgggt

SEQ ID NO: 96660 - DNA, 20 bp, human
ggaagtgggaaagaaattac

SEQ ID NO: 96661 - DNA, 20 bp, human
gtgggcaagaatcaagagaa

SEQ ID NO: 96662 - DNA, 20 bp, human
gtaagcatctgaggagcgtc

SEQ ID NO: 96663 - DNA, 20 bp, human
gcagggaaaactactagaaa

SEQ ID NO: 96664 - DNA, 20 bp, human
gagagctcgggcgcagctct

SEQ ID NO: 96665 - DNA, 20 bp, human
gggttccatatactaagact

SEQ ID NO: 96666 - DNA, 20 bp, human
gtcggccgcaggcaactcgg

SEQ ID NO: 96667 - DNA, 20 bp, human
gctgccatccatacaaaccc

SEQ ID NO: 96668 - DNA, 20 bp, human
ggcgggtgggaggcgggata

SEQ ID NO: 96669 - DNA, 20 bp, human
gatagggaggcggggagact

SEQ ID NO: 96670 - DNA, 20 bp, human
gcgcaggcaactcggaggag

SEQ ID NO: 96671 - DNA, 20 bp, human
gtacccagggtgacaccatg

SEQ ID NO: 96672 - DNA, 20 bp, human
gctccacatggtgtcaccct

SEQ ID NO: 96673 - DNA, 20 bp, human
gtcaggagggcctcgggagt

SEQ ID NO: 96674 - DNA, 20 bp, human
gcgcagaaggcgctcaccag

SEQ ID NO: 96675 - DNA, 20 bp, human
gctgcgtgcctgggtttgta

SEQ ID NO: 96676 - DNA, 20 bp, human
gtaccgcccctggaagtcgt

SEQ ID NO: 96677 - DNA, 20 bp, human
gcatctcccacgacttccag

SEQ ID NO: 96678 - DNA, 20 bp, human
ggcagggtgggcagtttgag

SEQ ID NO: 96679 - DNA, 20 bp, human
gggaagaggtatcgcgtctc

SEQ ID NO: 96680 - DNA, 20 bp, human
gctcccacgacttccagggg

SEQ ID NO: 96681 - DNA, 20 bp, human
ggcagggctcgggtgatagg

SEQ ID NO: 96682 - DNA, 20 bp, human
gcctggtgccactccttccc

SEQ ID NO: 96683 - DNA, 20 bp, human
gcccgagccctgctgtatga

SEQ ID NO: 96684 - DNA, 20 bp, human
gatgttgagctgccgtgaca

SEQ ID NO: 96685 - DNA, 20 bp, human
gtcaccaccagcttcacgta

SEQ ID NO: 96686 - DNA, 20 bp, human
ggcctcagctagactggagt

SEQ ID NO: 96687 - DNA, 20 bp, human
gacccactccagtctagctg

SEQ ID NO: 96688 - DNA, 20 bp, human
gatgcgggtttgcagaggag

SEQ ID NO: 96689 - DNA, 20 bp, human
gcgactctcctgaaagggaa

SEQ ID NO: 96690 - DNA, 20 bp, human
gacacaatgcaagtgaaaca

SEQ ID NO: 96691 - DNA, 20 bp, human
gaaggggcacttaaaacaga

SEQ ID NO: 96692 - DNA, 20 bp, human
gaaggaaggaatgtgttatg

SEQ ID NO: 96693 - DNA, 20 bp, human
gaaggtatgcgggtttgcag

SEQ ID NO: 96694 - DNA, 20 bp, human
gcctgaaagggaaaggtatg

SEQ ID NO: 96695 - DNA, 20 bp, human
gcaaactagtttgcatcaag

SEQ ID NO: 96696 - DNA, 20 bp, human
gtgaagggtgctagagtgag

SEQ ID NO: 96697 - DNA, 20 bp, human
gagggagcccctggtcacag

SEQ ID NO: 96698 - DNA, 20 bp, human
gctgctccgggcctaatgga

SEQ ID NO: 96699 - DNA, 20 bp, human
gcgcgagccgacagatccct

SEQ ID NO: 96700 - DNA, 20 bp, human
gggcttcccactgtgaccag

SEQ ID NO: 96701 - DNA, 20 bp, human
gccaggcttgggggaccgag

SEQ ID NO: 96702 - DNA, 20 bp, human
ggctggaagcacgggatcgg

SEQ ID NO: 96703 - DNA, 20 bp, human
gtagggccttcagcactcag

SEQ ID NO: 96704 - DNA, 20 bp, human
ggccgacagatccctgggag

SEQ ID NO: 96705 - DNA, 20 bp, human
gacccctgctccgggcctaa

SEQ ID NO: 96706 - DNA, 20 bp, human
gggcagcacagatgcctcac

SEQ ID NO: 96707 - DNA, 20 bp, human
gtcctagtagaagtgtgatg

SEQ ID NO: 96708 - DNA, 20 bp, human
ggaacgtgaattggctcctg

SEQ ID NO: 96709 - DNA, 20 bp, human
gagcacagatgcctcacagg

SEQ ID NO: 96710 - DNA, 20 bp, human
gtcctcatcacacttctact

SEQ ID NO: 96711 - DNA, 20 bp, human
gatcaagagctttccaacta

SEQ ID NO: 96712 - DNA, 20 bp, human
gcagagaacaaccgcatgaa

SEQ ID NO: 96713 - DNA, 20 bp, human
gcaagttggtgctgattcac

SEQ ID NO: 96714 - DNA, 20 bp, human
gaattgctggcacagcgtta

SEQ ID NO: 96715 - DNA, 20 bp, human
gacagcgttaaggcttgcga

SEQ ID NO: 96716 - DNA, 20 bp, human
ggtaccaaagaagagaaaca

SEQ ID NO: 96717 - DNA, 20 bp, human
gatagttcttgattccaact

SEQ ID NO: 96718 - DNA, 20 bp, human
ggggacgcctagaccggaag

SEQ ID NO: 96719 - DNA, 20 bp, human
gattccaactcggtagtgga

SEQ ID NO: 96720 - DNA, 20 bp, human
gcttgattccaactcggtag

SEQ ID NO: 96721 - DNA, 20 bp, human
gcttccatccactaccgagt

SEQ ID NO: 96722 - DNA, 20 bp, human
gccaaagaagagaaacatgg

SEQ ID NO: 96723 - DNA, 20 bp, human
gaagcaaacagctatcatca

SEQ ID NO: 96724 - DNA, 20 bp, human
gttgtgactttaataccaaa

SEQ ID NO: 96725 - DNA, 20 bp, human
gaatgattgtagaagtctat

SEQ ID NO: 96726 - DNA, 20 bp, human
ggtaccaaagaagagaaaca

SEQ ID NO: 96727 - DNA, 20 bp, human
gatagttcttgattccaact

SEQ ID NO: 96728 - DNA, 20 bp, human
ggggacgcctagaccggaag

SEQ ID NO: 96729 - DNA, 20 bp, human
gattccaactcggtagtgga

SEQ ID NO: 96730 - DNA, 20 bp, human
gcttgattccaactcggtag

SEQ ID NO: 96731 - DNA, 20 bp, human
gcttccatccactaccgagt

SEQ ID NO: 96732 - DNA, 20 bp, human
gccaaagaagagaaacatgg

SEQ ID NO: 96733 - DNA, 20 bp, human
gttgtgactttaataccaaa

SEQ ID NO: 96734 - DNA, 20 bp, human
gaagcaaacagctatcatca

SEQ ID NO: 96735 - DNA, 20 bp, human
gaatgattgtagaagtctat

SEQ ID NO: 96736 - DNA, 20 bp, human
ggctgaagaaaagcaagaca

SEQ ID NO: 96737 - DNA, 20 bp, human
gtatcaaagcctgaagtggg

SEQ ID NO: 96738 - DNA, 20 bp, human
gagcaagacagggtaagtta

SEQ ID NO: 96739 - DNA, 20 bp, human
ggtttacagaaagccaagaa

SEQ ID NO: 96740 - DNA, 20 bp, human
gaaaagagagtaacagagtt

SEQ ID NO: 96741 - DNA, 20 bp, human
gagtaacagagttgggtatc

SEQ ID NO: 96742 - DNA, 20 bp, human
gcttgcttttcttcagcacc

SEQ ID NO: 96743 - DNA, 20 bp, human
gtacatttccagcagtaacc

SEQ ID NO: 96744 - DNA, 20 bp, human
gaagttgcggaaaactagcg

SEQ ID NO: 96745 - DNA, 20 bp, human
ggttcatgtttgcaaatcaa

SEQ ID NO: 96746 - DNA, 20 bp, human
ggccacggcgccaaagctgt

SEQ ID NO: 96747 - DNA, 20 bp, human
ggggctctcgcagtgtggag

SEQ ID NO: 96748 - DNA, 20 bp, human
gagggaacttgcccattacc

SEQ ID NO: 96749 - DNA, 20 bp, human
ggccttcgcctgaaccatcc

SEQ ID NO: 96750 - DNA, 20 bp, human
gcgccgtggcttctgcttca

SEQ ID NO: 96751 - DNA, 20 bp, human
gtgcggggctgccaggtaat

SEQ ID NO: 96752 - DNA, 20 bp, human
ggtgctcgctggcgcgtggt

SEQ ID NO: 96753 - DNA, 20 bp, human
ggtgtgccagtggctcgtgt

SEQ ID NO: 96754 - DNA, 20 bp, human
gagtcccccacacgagccac

SEQ ID NO: 96755 - DNA, 20 bp, human
ggcttcagggagtgtgccag

SEQ ID NO: 96756 - DNA, 20 bp, human
gctatgtaaggaattgtcgg

SEQ ID NO: 96757 - DNA, 20 bp, human
ggtactatgtaaggaattgt

SEQ ID NO: 96758 - DNA, 20 bp, human
gtactgtccaagatcaacgc

SEQ ID NO: 96759 - DNA, 20 bp, human
ggacacatccatcaatccac

SEQ ID NO: 96760 - DNA, 20 bp, human
gaattgtcggtggctggcga

SEQ ID NO: 96761 - DNA, 20 bp, human
gctggcgacggtatcttagc

SEQ ID NO: 96762 - DNA, 20 bp, human
gtctttttggaactcaagtt

SEQ ID NO: 96763 - DNA, 20 bp, human
gggtaaagatgctattctac

SEQ ID NO: 96764 - DNA, 20 bp, human
gggaaaaggatcagctggta

SEQ ID NO: 96765 - DNA, 20 bp, human
gccagaggaaaaggatcagc

SEQ ID NO: 96766 - DNA, 20 bp, human
gccctccttccagactccac

SEQ ID NO: 96767 - DNA, 20 bp, human
gtgcatcagagatagactgt

SEQ ID NO: 96768 - DNA, 20 bp, human
gcgctctctctcacgtccaa

SEQ ID NO: 96769 - DNA, 20 bp, human
gtgctcctgtggagtctgga

SEQ ID NO: 96770 - DNA, 20 bp, human
gcatttctcaagtcccctga

SEQ ID NO: 96771 - DNA, 20 bp, human
gactgagctgtgtctttagc

SEQ ID NO: 96772 - DNA, 20 bp, human
ggactgtgggactctgccta

SEQ ID NO: 96773 - DNA, 20 bp, human
gctgctgcaagagaaggttt

SEQ ID NO: 96774 - DNA, 20 bp, human
gccgatcctgctgcaagaga

SEQ ID NO: 96775 - DNA, 20 bp, human
ggggctggtcagtggagcac

SEQ ID NO: 96776 - DNA, 20 bp, human
ggtcaggcggggtctccacc

SEQ ID NO: 96777 - DNA, 20 bp, human
gctgccggcggggtagtcgt

SEQ ID NO: 96778 - DNA, 20 bp, human
gacgccgacgactaccccgc

SEQ ID NO: 96779 - DNA, 20 bp, human
gatgtagctgcggagcccgg

SEQ ID NO: 96780 - DNA, 20 bp, human
gccatcccgcaggacgccgt

SEQ ID NO: 96781 - DNA, 20 bp, human
gtcttcgtcggagctgccgg

SEQ ID NO: 96782 - DNA, 20 bp, human
gaggacgccgtggggcgcag

SEQ ID NO: 96783 - DNA, 20 bp, human
gcctccgcctctgcgcccca

SEQ ID NO: 96784 - DNA, 20 bp, human
gggagaccccgcctgacccc

SEQ ID NO: 96785 - DNA, 20 bp, human
ggtgagcctcttgtcttcgt

SEQ ID NO: 96786 - DNA, 20 bp, human
ggaggagaggatccatccta

SEQ ID NO: 96787 - DNA, 20 bp, human
ggcccgtggacgtagaggag

SEQ ID NO: 96788 - DNA, 20 bp, human
gacgaggcccgtggacgtag

SEQ ID NO: 96789 - DNA, 20 bp, human
gaagggcgaagactgaaaat

SEQ ID NO: 96790 - DNA, 20 bp, human
ggagaggatccatcctatgg

SEQ ID NO: 96791 - DNA, 20 bp, human
ggatccatcctatggtggta

SEQ ID NO: 96792 - DNA, 20 bp, human
gtgccgtcataaactcacag

SEQ ID NO: 96793 - DNA, 20 bp, human
gtcttcgcccttaccaccat

SEQ ID NO: 96794 - DNA, 20 bp, human
gcgcccttaccaccatagga

SEQ ID NO: 96795 - DNA, 20 bp, human
gcacgcaggcgattccaggg

SEQ ID NO: 96796 - DNA, 20 bp, human
gcctccaggcgggtcacggt

SEQ ID NO: 96797 - DNA, 20 bp, human
gggaagctccaggagcgcgg

SEQ ID NO: 96798 - DNA, 20 bp, human
gaatgaccggaggaaacagt

SEQ ID NO: 96799 - DNA, 20 bp, human
gtggactgcacattgaccca

SEQ ID NO: 96800 - DNA, 20 bp, human
gggcgacctgaagggcatcc

SEQ ID NO: 96801 - DNA, 20 bp, human
gccacctgcggcaccgtcgt

SEQ ID NO: 96802 - DNA, 20 bp, human
ggcgatgttcggccttgggt

SEQ ID NO: 96803 - DNA, 20 bp, human
ggagcttccgttggccccag

SEQ ID NO: 96804 - DNA, 20 bp, human
gctctggggatgaaggaagt

SEQ ID NO: 96805 - DNA, 20 bp, human
gtgcacattgacccagggta

SEQ ID NO: 96806 - DNA, 20 bp, human
ggaagaggcgcaggaagcca

SEQ ID NO: 96807 - DNA, 20 bp, human
gctcgggagcagaacagctt

SEQ ID NO: 96808 - DNA, 20 bp, human
gcccgagaaggacccccgcc

SEQ ID NO: 96809 - DNA, 20 bp, human
gtgcggcccagggttcacgc

SEQ ID NO: 96810 - DNA, 20 bp, human
gacccggcccgcgtgaaccc

SEQ ID NO: 96811 - DNA, 20 bp, human
ggggctggacgctgactgcc

SEQ ID NO: 96812 - DNA, 20 bp, human
gtacggggcaaatccaggcg

SEQ ID NO: 96813 - DNA, 20 bp, human
ggtgtgtgtcctcggcggcc

SEQ ID NO: 96814 - DNA, 20 bp, human
gatcgcttgctctcgttccc

SEQ ID NO: 96815 - DNA, 20 bp, human
gggcgccggccgtcgctgta

SEQ ID NO: 96816 - DNA, 20 bp, human
ggccaccagactgtatactg

SEQ ID NO: 96817 - DNA, 20 bp, human
gctggaccacaacagcgagg

SEQ ID NO: 96818 - DNA, 20 bp, human
ggaccacaacagcgaggagg

SEQ ID NO: 96819 - DNA, 20 bp, human
gtgtgccccagtatacagtc

SEQ ID NO: 96820 - DNA, 20 bp, human
gcccactggggacaacccaa

SEQ ID NO: 96821 - DNA, 20 bp, human
ggccccagtatacagtctgg

SEQ ID NO: 96822 - DNA, 20 bp, human
ggcccttgggttgtccccag

SEQ ID NO: 96823 - DNA, 20 bp, human
gggactggaccacaacagcg

SEQ ID NO: 96824 - DNA, 20 bp, human
gtactggggcacaagtcctg

SEQ ID NO: 96825 - DNA, 20 bp, human
gacccaagggccctcttctt

SEQ ID NO: 96826 - DNA, 20 bp, human
ggccacgaacaggaccaagt

SEQ ID NO: 96827 - DNA, 20 bp, human
gcggactccccaacacccgg

SEQ ID NO: 96828 - DNA, 20 bp, human
gtggcccggagacaacatgg

SEQ ID NO: 96829 - DNA, 20 bp, human
ggaggcgcggcgccacgaac

SEQ ID NO: 96830 - DNA, 20 bp, human
gtgggaggccgaagcggagg

SEQ ID NO: 96831 - DNA, 20 bp, human
gagaccacgcgccagaaacg

SEQ ID NO: 96832 - DNA, 20 bp, human
gacagggaaacgagccctag

SEQ ID NO: 96833 - DNA, 20 bp, human
gaagtggcccggagacaaca

SEQ ID NO: 96834 - DNA, 20 bp, human
ggcgccgccatgttgtctcc

SEQ ID NO: 96835 - DNA, 20 bp, human
gggcggtgtccccgcgacta

SEQ ID NO: 96836 - DNA, 20 bp, human
gacagcccccgctatcgcct

SEQ ID NO: 96837 - DNA, 20 bp, human
gctttcccaggcgatagcgg

SEQ ID NO: 96838 - DNA, 20 bp, human
ggccctttcccaggcgatag

SEQ ID NO: 96839 - DNA, 20 bp, human
ggtggttgcggccgtgacag

SEQ ID NO: 96840 - DNA, 20 bp, human
ggagttgaggcatcagggag

SEQ ID NO: 96841 - DNA, 20 bp, human
ggactagagttgaggcatca

SEQ ID NO: 96842 - DNA, 20 bp, human
gcaaggccaggaggggcagc

SEQ ID NO: 96843 - DNA, 20 bp, human
ggtgtgaagaacggaccaga

SEQ ID NO: 96844 - DNA, 20 bp, human
ggccgaaacgggtgcgcagg

SEQ ID NO: 96845 - DNA, 20 bp, human
ggaggggcgacgggtgtgag

SEQ ID NO: 96846 - DNA, 20 bp, human
gcaaccatgcctgcatatca

SEQ ID NO: 96847 - DNA, 20 bp, human
ggctccagaaggcaacccaa

SEQ ID NO: 96848 - DNA, 20 bp, human
ggaatgctgccctgatatgc

SEQ ID NO: 96849 - DNA, 20 bp, human
gcaaagcccaaagcaaaaat

SEQ ID NO: 96850 - DNA, 20 bp, human
ggcaggcatggttggcacca

SEQ ID NO: 96851 - DNA, 20 bp, human
ggcagcattctatgatccca

SEQ ID NO: 96852 - DNA, 20 bp, human
gtctgtcgatgtgagagcca

SEQ ID NO: 96853 - DNA, 20 bp, human
gctgccctgatatgcaggca

SEQ ID NO: 96854 - DNA, 20 bp, human
ggcattggcgcttctgtatg

SEQ ID NO: 96855 - DNA, 20 bp, human
gtgactgtaacttctgtgag

SEQ ID NO: 96856 - DNA, 20 bp, human
gccgcgcacgccaaacctac

SEQ ID NO: 96857 - DNA, 20 bp, human
ggctagagcaggcggttcct

SEQ ID NO: 96858 - DNA, 20 bp, human
ggcgggtttctgcagatcta

SEQ ID NO: 96859 - DNA, 20 bp, human
gtaacaggccacgactgtaa

SEQ ID NO: 96860 - DNA, 20 bp, human
gcacgactgtaagggaaaga

SEQ ID NO: 96861 - DNA, 20 bp, human
gcccgggacgctagagcagg

SEQ ID NO: 96862 - DNA, 20 bp, human
gtctcccgggacgctagagc

SEQ ID NO: 96863 - DNA, 20 bp, human
gtgggctgctccggtaggtt

SEQ ID NO: 96864 - DNA, 20 bp, human
ggcatgcgcgcctgtctccc

SEQ ID NO: 96865 - DNA, 20 bp, human
gtctgcaagaaaggcctaag

SEQ ID NO: 96866 - DNA, 20 bp, human
ggaatcgaaactggctccgt

SEQ ID NO: 96867 - DNA, 20 bp, human
gcctccttgctgccgagtca

SEQ ID NO: 96868 - DNA, 20 bp, human
gaaacctcgtcagcatgcag

SEQ ID NO: 96869 - DNA, 20 bp, human
ggagaggggtggggacatgt

SEQ ID NO: 96870 - DNA, 20 bp, human
gcaacctcgggacagatggt

SEQ ID NO: 96871 - DNA, 20 bp, human
gggagaggaagggcaactcg

SEQ ID NO: 96872 - DNA, 20 bp, human
gggtggccctgagcaaaggt

SEQ ID NO: 96873 - DNA, 20 bp, human
gtggctgaccacgttcacag

SEQ ID NO: 96874 - DNA, 20 bp, human
ggagcctctgcatgctgacg

SEQ ID NO: 96875 - DNA, 20 bp, human
gtacagcagtgagaggggtg

SEQ ID NO: 96876 - DNA, 20 bp, human
gacaccgctgggaagtgcta

SEQ ID NO: 96877 - DNA, 20 bp, human
ggctctatgtggaagacata

SEQ ID NO: 96878 - DNA, 20 bp, human
ggtaccatagcacttcccag

SEQ ID NO: 96879 - DNA, 20 bp, human
gtggtcaagatcacaccgct

SEQ ID NO: 96880 - DNA, 20 bp, human
gtcccttcttgcagtttcac

SEQ ID NO: 96881 - DNA, 20 bp, human
gactatgaaaggagagaacc

SEQ ID NO: 96882 - DNA, 20 bp, human
ggagtgtgttcatgcatgag

SEQ ID NO: 96883 - DNA, 20 bp, human
gtgccagtgaaactgcaaga

SEQ ID NO: 96884 - DNA, 20 bp, human
ggaacacactccaaataaag

SEQ ID NO: 96885 - DNA, 20 bp, human
gtacatggaattaatgaagg

SEQ ID NO: 96886 - DNA, 20 bp, human
gccggaaagccacagcccaa

SEQ ID NO: 96887 - DNA, 20 bp, human
gctcgccggcctgaggtcca

SEQ ID NO: 96888 - DNA, 20 bp, human
gctcggaggtcagggttgag

SEQ ID NO: 96889 - DNA, 20 bp, human
ggcggccttggacctcaggc

SEQ ID NO: 96890 - DNA, 20 bp, human
gcaactgaaatgccacaccc

SEQ ID NO: 96891 - DNA, 20 bp, human
gtttcagttgggccaggtgt

SEQ ID NO: 96892 - DNA, 20 bp, human
gtcagaggggaagtctcaga

SEQ ID NO: 96893 - DNA, 20 bp, human
gcagaggggtgggccatgtc

SEQ ID NO: 96894 - DNA, 20 bp, human
gccgtatgaggtagcttgga

SEQ ID NO: 96895 - DNA, 20 bp, human
gtttccagggaaaccgtatg

SEQ ID NO: 96896 - DNA, 20 bp, human
gtacagctaaaggaaggaca

SEQ ID NO: 96897 - DNA, 20 bp, human
gccgccggagttacagctaa

SEQ ID NO: 96898 - DNA, 20 bp, human
ggttcgggccctacacataa

SEQ ID NO: 96899 - DNA, 20 bp, human
ggagccaagagcgacactgg

SEQ ID NO: 96900 - DNA, 20 bp, human
gtaactccggcgggcgtgtt

SEQ ID NO: 96901 - DNA, 20 bp, human
gacgcaataagcgggtgcag

SEQ ID NO: 96902 - DNA, 20 bp, human
gggaagcaatgaaatgccga

SEQ ID NO: 96903 - DNA, 20 bp, human
ggttcgagcatgcccgaagg

SEQ ID NO: 96904 - DNA, 20 bp, human
gagcaatgaaatgccgaggg

SEQ ID NO: 96905 - DNA, 20 bp, human
ggtgcagtggaggtagaaac

SEQ ID NO: 96906 - DNA, 20 bp, human
gggccggacccaaccagtca

SEQ ID NO: 96907 - DNA, 20 bp, human
ggcgagggcccacactccac

SEQ ID NO: 96908 - DNA, 20 bp, human
gggccgccgtgccctctggg

SEQ ID NO: 96909 - DNA, 20 bp, human
gccgcagcagtgctgagtaa

SEQ ID NO: 96910 - DNA, 20 bp, human
ggaaagagggcagaagccgc

SEQ ID NO: 96911 - DNA, 20 bp, human
gtggtccgcgcgtgctccag

SEQ ID NO: 96912 - DNA, 20 bp, human
ggtgcctcagctgccacaaa

SEQ ID NO: 96913 - DNA, 20 bp, human
ggcgtgctccagtggagtgt

SEQ ID NO: 96914 - DNA, 20 bp, human
gcagcctcacaaccgcccag

SEQ ID NO: 96915 - DNA, 20 bp, human
gccccacccgcggcaattcg

SEQ ID NO: 96916 - DNA, 20 bp, human
gacagagcaaccgggaccaa

SEQ ID NO: 96917 - DNA, 20 bp, human
gggctggtaacagagcaacc

SEQ ID NO: 96918 - DNA, 20 bp, human
gccgtggccccggctcagga

SEQ ID NO: 96919 - DNA, 20 bp, human
gcaagggacaacaagagctc

SEQ ID NO: 96920 - DNA, 20 bp, human
gcgagatctgtagatgcaca

SEQ ID NO: 96921 - DNA, 20 bp, human
gtccgctcagacaagaagga

SEQ ID NO: 96922 - DNA, 20 bp, human
gccagagagtagacaatcca

SEQ ID NO: 96923 - DNA, 20 bp, human
gtctgaccaccccttctcaa

SEQ ID NO: 96924 - DNA, 20 bp, human
gatctgtagatgcacacggc

SEQ ID NO: 96925 - DNA, 20 bp, human
ggtcctggcccagcttcccg

SEQ ID NO: 96926 - DNA, 20 bp, human
gagccccgcagtggtctcag

SEQ ID NO: 96927 - DNA, 20 bp, human
gttacagctgatgcaaccgg

SEQ ID NO: 96928 - DNA, 20 bp, human
gtaagcacccagcctaggtc

SEQ ID NO: 96929 - DNA, 20 bp, human
gcaagagggccccggagagt

SEQ ID NO: 96930 - DNA, 20 bp, human
ggattggggacccctgacct

SEQ ID NO: 96931 - DNA, 20 bp, human
gctggctggctactcatagc

SEQ ID NO: 96932 - DNA, 20 bp, human
gggcccctgagaccactgcg

SEQ ID NO: 96933 - DNA, 20 bp, human
gcgtgggttcgcaaggccag

SEQ ID NO: 96934 - DNA, 20 bp, human
gctgggtgcttaggatcttg

SEQ ID NO: 96935 - DNA, 20 bp, human
ggctgtaagccccccacgtg

SEQ ID NO: 96936 - DNA, 20 bp, human
gttggctagatgaagagcag

SEQ ID NO: 96937 - DNA, 20 bp, human
gtctggtctggtggagggtt

SEQ ID NO: 96938 - DNA, 20 bp, human
gtatgagcatccgcgtaagg

SEQ ID NO: 96939 - DNA, 20 bp, human
gagagctccgaggaacgtct

SEQ ID NO: 96940 - DNA, 20 bp, human
gccctgggctcttcacgtgg

SEQ ID NO: 96941 - DNA, 20 bp, human
gctagatgaagagcagggga

SEQ ID NO: 96942 - DNA, 20 bp, human
gtggctgactcaaaccagtt

SEQ ID NO: 96943 - DNA, 20 bp, human
gctgtatgagcatccgcgta

SEQ ID NO: 96944 - DNA, 20 bp, human
gaatcagaagcctccttacg

SEQ ID NO: 96945 - DNA, 20 bp, human
gaggaacgtctaggaaccga

SEQ ID NO: 96946 - DNA, 20 bp, human
gtagcttggactagggtagt

SEQ ID NO: 96947 - DNA, 20 bp, human
gatgggaagctagaggtgga

SEQ ID NO: 96948 - DNA, 20 bp, human
gagcggcagggccatgaaac

SEQ ID NO: 96949 - DNA, 20 bp, human
gccacttagtgtctagcggt

SEQ ID NO: 96950 - DNA, 20 bp, human
gattctacgaggggaaatca

SEQ ID NO: 96951 - DNA, 20 bp, human
gctcctccttggggtttgag

SEQ ID NO: 96952 - DNA, 20 bp, human
gagcgccacttagtgtctag

SEQ ID NO: 96953 - DNA, 20 bp, human
gccctgccgctcaaacccca

SEQ ID NO: 96954 - DNA, 20 bp, human
gatttcatgaggactagtct

SEQ ID NO: 96955 - DNA, 20 bp, human
gagtctaggagcttctaaac

SEQ ID NO: 96956 - DNA, 20 bp, human
gccgtggaggggttgaccta

SEQ ID NO: 96957 - DNA, 20 bp, human
ggatcagactcaccgtggag

SEQ ID NO: 96958 - DNA, 20 bp, human
gggaatgcatcatcctatca

SEQ ID NO: 96959 - DNA, 20 bp, human
gctgaggatcagactcaccg

SEQ ID NO: 96960 - DNA, 20 bp, human
gttagaatgagtggtctcag

SEQ ID NO: 96961 - DNA, 20 bp, human
gggtgtctgcggcttctctg

SEQ ID NO: 96962 - DNA, 20 bp, human
ggaatgagtggtctcagggg

SEQ ID NO: 96963 - DNA, 20 bp, human
ggagagcgcactcttgagta

SEQ ID NO: 96964 - DNA, 20 bp, human
ggagtgggcgacaaatatgg

SEQ ID NO: 96965 - DNA, 20 bp, human
ggagggtcgttactgaggta

SEQ ID NO: 96966 - DNA, 20 bp, human
gaggtgagaggtgttcatag

SEQ ID NO: 96967 - DNA, 20 bp, human
gcgtcctcgtggccctggag

SEQ ID NO: 96968 - DNA, 20 bp, human
gacgaggacgagcgagagga

SEQ ID NO: 96969 - DNA, 20 bp, human
ggaccgtcaccgacatgcac

SEQ ID NO: 96970 - DNA, 20 bp, human
gggccacgaggacgagcgag

SEQ ID NO: 96971 - DNA, 20 bp, human
ggagaccctctgcaagatgt

SEQ ID NO: 96972 - DNA, 20 bp, human
gatgcctctccagggccacg

SEQ ID NO: 96973 - DNA, 20 bp, human
ggaaggccgacatcttgcag

SEQ ID NO: 96974 - DNA, 20 bp, human
gatgagctgatgcctctcca

SEQ ID NO: 96975 - DNA, 20 bp, human
gcacatgaggaagtcagaga

SEQ ID NO: 96976 - DNA, 20 bp, human
gggcccccgaaggatctcgg

SEQ ID NO: 96977 - DNA, 20 bp, human
gccgggcccccgaaggatct

SEQ ID NO: 96978 - DNA, 20 bp, human
gcgcctccgagatccttcgg

SEQ ID NO: 96979 - DNA, 20 bp, human
gggctcaggtatcatcacat

SEQ ID NO: 96980 - DNA, 20 bp, human
gatggaacaaccaaaggacg

SEQ ID NO: 96981 - DNA, 20 bp, human
ggtggagatggaacaaccaa

SEQ ID NO: 96982 - DNA, 20 bp, human
gggacggggctgggcctgaa

SEQ ID NO: 96983 - DNA, 20 bp, human
gcaggcccagccccgtcctt

SEQ ID NO: 96984 - DNA, 20 bp, human
gtcgggggcccgggaaggtt

SEQ ID NO: 96985 - DNA, 20 bp, human
gttgctagaagatacgtaag

SEQ ID NO: 96986 - DNA, 20 bp, human
ggttgtgaaatggaccacag

SEQ ID NO: 96987 - DNA, 20 bp, human
gaggtgagagaaatcccctg

SEQ ID NO: 96988 - DNA, 20 bp, human
gtctaagcaccacctgaggg

SEQ ID NO: 96989 - DNA, 20 bp, human
gacaccatcattgggcacaa

SEQ ID NO: 96990 - DNA, 20 bp, human
ggccacatttaagcaacaag

SEQ ID NO: 96991 - DNA, 20 bp, human
gtggtatccgtgcctccctc

SEQ ID NO: 96992 - DNA, 20 bp, human
gagagtttcacaccatcatt

SEQ ID NO: 96993 - DNA, 20 bp, human
gtcccaggtgaaatataaag

SEQ ID NO: 96994 - DNA, 20 bp, human
gctgttctgccaacagatga

SEQ ID NO: 96995 - DNA, 20 bp, human
gggaaaagacctgcctctgt

SEQ ID NO: 96996 - DNA, 20 bp, human
ggaggcggcggataatgcca

SEQ ID NO: 96997 - DNA, 20 bp, human
gagggagcggcgggtaccct

SEQ ID NO: 96998 - DNA, 20 bp, human
gggcggataatgccagggac

SEQ ID NO: 96999 - DNA, 20 bp, human
gggaaaagcagtgcacagac

SEQ ID NO: 97000 - DNA, 20 bp, human
gaacaacgcgacggcgacca

SEQ ID NO: 97001 - DNA, 20 bp, human
gcccgcggcgggaaaggagg

SEQ ID NO: 97002 - DNA, 20 bp, human
ggcgcgctcaaccccgtccc

SEQ ID NO: 97003 - DNA, 20 bp, human
gccgcgcctaccccggtcag

SEQ ID NO: 97004 - DNA, 20 bp, human
gggtgtgctggggacccacg

SEQ ID NO: 97005 - DNA, 20 bp, human
gcgcccgcgctggcactggg

SEQ ID NO: 97006 - DNA, 20 bp, human
ggagggcttcctgagagtga

SEQ ID NO: 97007 - DNA, 20 bp, human
gctgatttggctcaaaatga

SEQ ID NO: 97008 - DNA, 20 bp, human
gtcagtaggaggaccacgct

SEQ ID NO: 97009 - DNA, 20 bp, human
ggcagaaagggtttgtacca

SEQ ID NO: 97010 - DNA, 20 bp, human
gtactctttgacaaacatgg

SEQ ID NO: 97011 - DNA, 20 bp, human
gagcatgatgtgtgtctcag

SEQ ID NO: 97012 - DNA, 20 bp, human
gattttgagccaaatcagat

SEQ ID NO: 97013 - DNA, 20 bp, human
gctgctttcacttcagagtt

SEQ ID NO: 97014 - DNA, 20 bp, human
gtgaaagttactggaagtaa

SEQ ID NO: 97015 - DNA, 20 bp, human
ggaaatccgcttctgagaga

SEQ ID NO: 97016 - DNA, 20 bp, human
ggactgaaagttggactcgt

SEQ ID NO: 97017 - DNA, 20 bp, human
gggtactgagcgtcttgttg

SEQ ID NO: 97018 - DNA, 20 bp, human
ggccaggaagcaccacaagt

SEQ ID NO: 97019 - DNA, 20 bp, human
gacacttggagactgaaagt

SEQ ID NO: 97020 - DNA, 20 bp, human
ggaggcccaggcattgcatc

SEQ ID NO: 97021 - DNA, 20 bp, human
gcccagggctggatgggagc

SEQ ID NO: 97022 - DNA, 20 bp, human
gaagcaccacaagttggaag

SEQ ID NO: 97023 - DNA, 20 bp, human
gctttgacccagggctggat

SEQ ID NO: 97024 - DNA, 20 bp, human
gtgctctgtatgctcacact

SEQ ID NO: 97025 - DNA, 20 bp, human
ggtcacagctaagaaatgcc

SEQ ID NO: 97026 - DNA, 20 bp, human
gacgcggagaggaaacgctc

SEQ ID NO: 97027 - DNA, 20 bp, human
ggagagttccctcgagtacg

SEQ ID NO: 97028 - DNA, 20 bp, human
gcaggctgctcccgagcgag

SEQ ID NO: 97029 - DNA, 20 bp, human
gcacggtagcctccaggacg

SEQ ID NO: 97030 - DNA, 20 bp, human
gtggggacagccactcgctc

SEQ ID NO: 97031 - DNA, 20 bp, human
gttccctcgagtacgcggag

SEQ ID NO: 97032 - DNA, 20 bp, human
gctccaggacgcggaagctg

SEQ ID NO: 97033 - DNA, 20 bp, human
ggttcgagggaacccggaag

SEQ ID NO: 97034 - DNA, 20 bp, human
gccacgcgttcgagggaacc

SEQ ID NO: 97035 - DNA, 20 bp, human
ggtagagccgccgagtcagg

SEQ ID NO: 97036 - DNA, 20 bp, human
gcacagccatgggataaagt

SEQ ID NO: 97037 - DNA, 20 bp, human
gctgctgcataacctatggc

SEQ ID NO: 97038 - DNA, 20 bp, human
gtaggttatgcagcagcagt

SEQ ID NO: 97039 - DNA, 20 bp, human
ggggaagccagcaagtgcta

SEQ ID NO: 97040 - DNA, 20 bp, human
gctatggcgggcacagccat

SEQ ID NO: 97041 - DNA, 20 bp, human
ggggagcctcgaatgcccag

SEQ ID NO: 97042 - DNA, 20 bp, human
gttaagggttaaacccccag

SEQ ID NO: 97043 - DNA, 20 bp, human
ggggagtgttcaccatgcaa

SEQ ID NO: 97044 - DNA, 20 bp, human
gttgggtaggggcacgaggt

SEQ ID NO: 97045 - DNA, 20 bp, human
gcagatgacatgaaaaccca

SEQ ID NO: 97046 - DNA, 20 bp, human
gtcacccaggaacttgatag

SEQ ID NO: 97047 - DNA, 20 bp, human
gggcccagggaccactgtat

SEQ ID NO: 97048 - DNA, 20 bp, human
gttctacagttctcagtgta

SEQ ID NO: 97049 - DNA, 20 bp, human
gccaaggatgaactgaaagc

SEQ ID NO: 97050 - DNA, 20 bp, human
gaccactgtatgggaatcac

SEQ ID NO: 97051 - DNA, 20 bp, human
ggtagaatatgcaaggcaca

SEQ ID NO: 97052 - DNA, 20 bp, human
gtagccaagagtgcttctct

SEQ ID NO: 97053 - DNA, 20 bp, human
ggcattaggacagatgtata

SEQ ID NO: 97054 - DNA, 20 bp, human
gcttggtgaggcttagagtg

SEQ ID NO: 97055 - DNA, 20 bp, human
gcttgaccaagtcacagcac

SEQ ID NO: 97056 - DNA, 20 bp, human
gctccaatggggagaagggg

SEQ ID NO: 97057 - DNA, 20 bp, human
ggagcactgggagactccaa

SEQ ID NO: 97058 - DNA, 20 bp, human
gggttctcctaggtcactgg

SEQ ID NO: 97059 - DNA, 20 bp, human
gagaccaaggactgagcact

SEQ ID NO: 97060 - DNA, 20 bp, human
gcctggttctcctaggtcac

SEQ ID NO: 97061 - DNA, 20 bp, human
gtggtcttggaaattgtgaa

SEQ ID NO: 97062 - DNA, 20 bp, human
gctggggttataattatcat

SEQ ID NO: 97063 - DNA, 20 bp, human
gttgactctccttgtgggta

SEQ ID NO: 97064 - DNA, 20 bp, human
gtaaatgtaagcctaaaatg

SEQ ID NO: 97065 - DNA, 20 bp, human
ggtgggtagggatggtccct

SEQ ID NO: 97066 - DNA, 20 bp, human
gcagcttccaggtgaccgag

SEQ ID NO: 97067 - DNA, 20 bp, human
gctgccaccttccaagggag

SEQ ID NO: 97068 - DNA, 20 bp, human
gaaggatcctgcggttccag

SEQ ID NO: 97069 - DNA, 20 bp, human
gctgaccaaggtcacatcgt

SEQ ID NO: 97070 - DNA, 20 bp, human
gtccatctgccaccttccaa

SEQ ID NO: 97071 - DNA, 20 bp, human
gttggagtgccagagatggt

SEQ ID NO: 97072 - DNA, 20 bp, human
gtggaagccactggaaccgc

SEQ ID NO: 97073 - DNA, 20 bp, human
gcagggaggaagtctgacca

SEQ ID NO: 97074 - DNA, 20 bp, human
ggcccctccctgggtaaagg

SEQ ID NO: 97075 - DNA, 20 bp, human
gtggcggtacccaccatctc

SEQ ID NO: 97076 - DNA, 20 bp, human
gaaggagagagacacatacc

SEQ ID NO: 97077 - DNA, 20 bp, human
gtgatacaactaacacaccc

SEQ ID NO: 97078 - DNA, 20 bp, human
ggacagaggtttagataatg

SEQ ID NO: 97079 - DNA, 20 bp, human
gggttttggtggattgatgg

SEQ ID NO: 97080 - DNA, 20 bp, human
gtcactagggaaaagacaaa

SEQ ID NO: 97081 - DNA, 20 bp, human
ggtgtctctctccttggttt

SEQ ID NO: 97082 - DNA, 20 bp, human
gtagataatgaggatttaat

SEQ ID NO: 97083 - DNA, 20 bp, human
ggtctttgtaactttgagaa

SEQ ID NO: 97084 - DNA, 20 bp, human
gagacaaaaggaactacgtt

SEQ ID NO: 97085 - DNA, 20 bp, human
gtataagccctcgttaataa

SEQ ID NO: 97086 - DNA, 20 bp, human
gtaaccaagccagcattgaa

SEQ ID NO: 97087 - DNA, 20 bp, human
gtggcttggttaaacttcca

SEQ ID NO: 97088 - DNA, 20 bp, human
gcttggttaaacttccatgg

SEQ ID NO: 97089 - DNA, 20 bp, human
gacttgtctttgagtagagt

SEQ ID NO: 97090 - DNA, 20 bp, human
gaatcttttctgcatttcgc

SEQ ID NO: 97091 - DNA, 20 bp, human
gaatgaattcctttcaatgc

SEQ ID NO: 97092 - DNA, 20 bp, human
gattcctttcaatgctggct

SEQ ID NO: 97093 - DNA, 20 bp, human
gttaattttactgtgtcaaa

SEQ ID NO: 97094 - DNA, 20 bp, human
gggcaagagagagctacaag

SEQ ID NO: 97095 - DNA, 20 bp, human
gctttgctttgagacatccc

SEQ ID NO: 97096 - DNA, 20 bp, human
gtccctcccgtgacaggggt

SEQ ID NO: 97097 - DNA, 20 bp, human
gagccccctcagtaagaggg

SEQ ID NO: 97098 - DNA, 20 bp, human
ggcccacccctgtcacggga

SEQ ID NO: 97099 - DNA, 20 bp, human
gagtaagagggtggcaggtt

SEQ ID NO: 97100 - DNA, 20 bp, human
ggggcagccccctcagtaag

SEQ ID NO: 97101 - DNA, 20 bp, human
gcccctccctcccgtgacag

SEQ ID NO: 97102 - DNA, 20 bp, human
ggcagtgggcccacagtgga

SEQ ID NO: 97103 - DNA, 20 bp, human
gggagcctcgccctccactg

SEQ ID NO: 97104 - DNA, 20 bp, human
gccctcagtaagagggtggc

SEQ ID NO: 97105 - DNA, 20 bp, human
gagccctgccagggatttgt

SEQ ID NO: 97106 - DNA, 20 bp, human
ggaggtggaggaccaagagt

SEQ ID NO: 97107 - DNA, 20 bp, human
ggccccacggtccgctccta

SEQ ID NO: 97108 - DNA, 20 bp, human
gcgctcctacggccccccca

SEQ ID NO: 97109 - DNA, 20 bp, human
gggccgtaggagcggaccgt

SEQ ID NO: 97110 - DNA, 20 bp, human
gctcggcctcagccaggcac

SEQ ID NO: 97111 - DNA, 20 bp, human
ggcggcgcacgcgaaggagg

SEQ ID NO: 97112 - DNA, 20 bp, human
ggagggcgaggccgaggtcg

SEQ ID NO: 97113 - DNA, 20 bp, human
gtgctggagtgggtgaaaaa

SEQ ID NO: 97114 - DNA, 20 bp, human
gggcggctgcagagttggca

SEQ ID NO: 97115 - DNA, 20 bp, human
gagggcggcgcacgcgaagg

SEQ ID NO: 97116 - DNA, 20 bp, human
gagccagtcgggctacgtct

SEQ ID NO: 97117 - DNA, 20 bp, human
ggaaattcgtgtgcagctct

SEQ ID NO: 97118 - DNA, 20 bp, human
ggtcacgttcacaagctgag

SEQ ID NO: 97119 - DNA, 20 bp, human
ggggacagggatcccagtac

SEQ ID NO: 97120 - DNA, 20 bp, human
gaccccagacgtagcccgac

SEQ ID NO: 97121 - DNA, 20 bp, human
gagggacctcggcctgtact

SEQ ID NO: 97122 - DNA, 20 bp, human
gaaaaagctggagataccca

SEQ ID NO: 97123 - DNA, 20 bp, human
gtccctggggaaagggatcg

SEQ ID NO: 97124 - DNA, 20 bp, human
ggagcttggcctgcggaatg

SEQ ID NO: 97125 - DNA, 20 bp, human
gcccgactggctccagcttc

SEQ ID NO: 97126 - DNA, 20 bp, human
gggcgctgctgccccaacac

SEQ ID NO: 97127 - DNA, 20 bp, human
gagagtgcccgcctgtgttg

SEQ ID NO: 97128 - DNA, 20 bp, human
gacacagagcgcggcctggg

SEQ ID NO: 97129 - DNA, 20 bp, human
gctcgggtcctctcccccta

SEQ ID NO: 97130 - DNA, 20 bp, human
gcacaggcgggcactctctg

SEQ ID NO: 97131 - DNA, 20 bp, human
gcctgggaggcggagctctg

SEQ ID NO: 97132 - DNA, 20 bp, human
ggcccctgaggtgctaggac

SEQ ID NO: 97133 - DNA, 20 bp, human
ggactccctcccccactcag

SEQ ID NO: 97134 - DNA, 20 bp, human
gccacccatcaagggcatag

SEQ ID NO: 97135 - DNA, 20 bp, human
gcaccctgagggtcagcccg

SEQ ID NO: 97136 - DNA, 20 bp, human
gtcgtccgtcagctcccggt

SEQ ID NO: 97137 - DNA, 20 bp, human
gctggcccaggaaactgctg

SEQ ID NO: 97138 - DNA, 20 bp, human
ggtcgtcgtccgtcagctcc

SEQ ID NO: 97139 - DNA, 20 bp, human
gtttaagtgaggccacgtgt

SEQ ID NO: 97140 - DNA, 20 bp, human
gcgagcgagagggaaccggc

SEQ ID NO: 97141 - DNA, 20 bp, human
gcccggtaggcaggacgccg

SEQ ID NO: 97142 - DNA, 20 bp, human
gtgacgacgccaaacagccg

SEQ ID NO: 97143 - DNA, 20 bp, human
gggcaggtcatgaaaatcgg

SEQ ID NO: 97144 - DNA, 20 bp, human
gccctcgctactccccccag

SEQ ID NO: 97145 - DNA, 20 bp, human
ggagcgcccgccaggtacgg

SEQ ID NO: 97146 - DNA, 20 bp, human
ggctcttgactcccacgctg

SEQ ID NO: 97147 - DNA, 20 bp, human
gttaggggtgttcgtcatta

SEQ ID NO: 97148 - DNA, 20 bp, human
gccacgtctttcttctcgct

SEQ ID NO: 97149 - DNA, 20 bp, human
gaaggttctggaccttgaga

SEQ ID NO: 97150 - DNA, 20 bp, human
gcatcttccaggccatctca

SEQ ID NO: 97151 - DNA, 20 bp, human
gattggtgcggattcctgtg

SEQ ID NO: 97152 - DNA, 20 bp, human
gcagtataggccttccccac

SEQ ID NO: 97153 - DNA, 20 bp, human
gcaggggtgggagtgtaatg

SEQ ID NO: 97154 - DNA, 20 bp, human
gagacaagctccaaagtagt

SEQ ID NO: 97155 - DNA, 20 bp, human
gaaggtccagaaccttgaga

SEQ ID NO: 97156 - DNA, 20 bp, human
gcccgagagcagcagaagca

SEQ ID NO: 97157 - DNA, 20 bp, human
gtcactcacaggcctcactc

SEQ ID NO: 97158 - DNA, 20 bp, human
ggaggagacagggaccgcca

SEQ ID NO: 97159 - DNA, 20 bp, human
gtgaacctgcggaccctgag

SEQ ID NO: 97160 - DNA, 20 bp, human
ggcagcagaagcagggttcg

SEQ ID NO: 97161 - DNA, 20 bp, human
ggtagccgctcagggtccgc

SEQ ID NO: 97162 - DNA, 20 bp, human
gctgggaagaatcggagtcc

SEQ ID NO: 97163 - DNA, 20 bp, human
gcgattcttcccagtcgccg

SEQ ID NO: 97164 - DNA, 20 bp, human
ggacaccatcctcggcgact

SEQ ID NO: 97165 - DNA, 20 bp, human
ggacgccacgagtcccagga

SEQ ID NO: 97166 - DNA, 20 bp, human
gggctctcggaagaccgctg

SEQ ID NO: 97167 - DNA, 20 bp, human
ggcggtcttccgagagccct

SEQ ID NO: 97168 - DNA, 20 bp, human
gggcaggctatcgggaagga

SEQ ID NO: 97169 - DNA, 20 bp, human
gtgcggcatgacaggcgagg

SEQ ID NO: 97170 - DNA, 20 bp, human
gcggacgctactgggaggag

SEQ ID NO: 97171 - DNA, 20 bp, human
ggagaaggaaaccgtgccca

SEQ ID NO: 97172 - DNA, 20 bp, human
gaagaccgctgcggcatgac

SEQ ID NO: 97173 - DNA, 20 bp, human
gagccgcggacgctactggg

SEQ ID NO: 97174 - DNA, 20 bp, human
gggagaatcggcagtcacta

SEQ ID NO: 97175 - DNA, 20 bp, human
ggcctgcgactgagctgaga

SEQ ID NO: 97176 - DNA, 20 bp, human
ggagccgcgggtccgcccag

SEQ ID NO: 97177 - DNA, 20 bp, human
ggcgccgccgccctgagggt

SEQ ID NO: 97178 - DNA, 20 bp, human
gactcggagctgagagccgg

SEQ ID NO: 97179 - DNA, 20 bp, human
gaggctgaagaggtacccgg

SEQ ID NO: 97180 - DNA, 20 bp, human
ggcctcgtcgacccaggatg

SEQ ID NO: 97181 - DNA, 20 bp, human
gcccggcgacctggcaaggt

SEQ ID NO: 97182 - DNA, 20 bp, human
gagaccgggagtctggactt

SEQ ID NO: 97183 - DNA, 20 bp, human
gctctcagctccgagtgcag

SEQ ID NO: 97184 - DNA, 20 bp, human
gcggagcagtggggacccat

SEQ ID NO: 97185 - DNA, 20 bp, human
gggagagcggctcataggtg

SEQ ID NO: 97186 - DNA, 20 bp, human
ggccctcggggcggcatggt

SEQ ID NO: 97187 - DNA, 20 bp, human
ggccccagctaggtgaggca

SEQ ID NO: 97188 - DNA, 20 bp, human
ggagggcaatgaggatcatg

SEQ ID NO: 97189 - DNA, 20 bp, human
gcggcatggtgggcgtccaa

SEQ ID NO: 97190 - DNA, 20 bp, human
gcacagcgccttggacccgt

SEQ ID NO: 97191 - DNA, 20 bp, human
gtgggcgtccaacgggtcca

SEQ ID NO: 97192 - DNA, 20 bp, human
ggggcaggcagtgcacccag

SEQ ID NO: 97193 - DNA, 20 bp, human
ggcaccgagaccctccaagg

SEQ ID NO: 97194 - DNA, 20 bp, human
gggtccccgcgtgggttata

SEQ ID NO: 97195 - DNA, 20 bp, human
gccctccccatcccacccgg

SEQ ID NO: 97196 - DNA, 20 bp, human
gatggttcagagacagagac

SEQ ID NO: 97197 - DNA, 20 bp, human
gaagataaaaggggactgtt

SEQ ID NO: 97198 - DNA, 20 bp, human
gagagcaaggtgcaaaacac

SEQ ID NO: 97199 - DNA, 20 bp, human
gggtggtgacaatcctgaag

SEQ ID NO: 97200 - DNA, 20 bp, human
gttaaggttaagtttgagaa

SEQ ID NO: 97201 - DNA, 20 bp, human
gtagctttcttgcccacttc

SEQ ID NO: 97202 - DNA, 20 bp, human
gaagaatttctcgtctatta

SEQ ID NO: 97203 - DNA, 20 bp, human
ggttcagagacagagactgg

SEQ ID NO: 97204 - DNA, 20 bp, human
gagcctccatttcagagagt

SEQ ID NO: 97205 - DNA, 20 bp, human
gttcttccaactctctgaaa

SEQ ID NO: 97206 - DNA, 20 bp, human
gcacgccactggccagaggg

SEQ ID NO: 97207 - DNA, 20 bp, human
gagagggaggaggcttccac

SEQ ID NO: 97208 - DNA, 20 bp, human
ggcatccggatggacctggg

SEQ ID NO: 97209 - DNA, 20 bp, human
gcaggtaggaaggcgcccac

SEQ ID NO: 97210 - DNA, 20 bp, human
ggccagaacggccgagggca

SEQ ID NO: 97211 - DNA, 20 bp, human
ggaggcttccacaggtagga

SEQ ID NO: 97212 - DNA, 20 bp, human
gaggcccgaggcggagactg

SEQ ID NO: 97213 - DNA, 20 bp, human
gggacacgccactggccaga

SEQ ID NO: 97214 - DNA, 20 bp, human
gagctagcgtcgaggagcag

SEQ ID NO: 97215 - DNA, 20 bp, human
gcgagggcagggcatccgga

SEQ ID NO: 97216 - DNA, 20 bp, human
ggaagagacgaagactgagc

SEQ ID NO: 97217 - DNA, 20 bp, human
gtcatttcagaattcttgtt

SEQ ID NO: 97218 - DNA, 20 bp, human
gggtgtgaaacgatcagcag

SEQ ID NO: 97219 - DNA, 20 bp, human
ggacgaagactgagctggtt

SEQ ID NO: 97220 - DNA, 20 bp, human
gcaggttaatatctacaacc

SEQ ID NO: 97221 - DNA, 20 bp, human
ggttgtcaagaaatcggatg

SEQ ID NO: 97222 - DNA, 20 bp, human
gtacggggagaaactgactg

SEQ ID NO: 97223 - DNA, 20 bp, human
gctcctactgccgggttcta

SEQ ID NO: 97224 - DNA, 20 bp, human
gccaaaaacaggaggcggga

SEQ ID NO: 97225 - DNA, 20 bp, human
gagaaactgactgcggctcg

SEQ ID NO: 97226 - DNA, 20 bp, human
gccccagtggcacagactca

SEQ ID NO: 97227 - DNA, 20 bp, human
gtgagactgctggcatgaag

SEQ ID NO: 97228 - DNA, 20 bp, human
gtcacggcagatgcagaaca

SEQ ID NO: 97229 - DNA, 20 bp, human
gcagatgcagaacagggtga

SEQ ID NO: 97230 - DNA, 20 bp, human
gaatgttctggaaaccccag

SEQ ID NO: 97231 - DNA, 20 bp, human
gggagcagctaagattaagg

SEQ ID NO: 97232 - DNA, 20 bp, human
gcggtgaggcataaaatccc

SEQ ID NO: 97233 - DNA, 20 bp, human
gatcccgggattctggctgg

SEQ ID NO: 97234 - DNA, 20 bp, human
gggtcaggtcaggctggact

SEQ ID NO: 97235 - DNA, 20 bp, human
gctgcttctgtcacagaagt

SEQ ID NO: 97236 - DNA, 20 bp, human
ggaaagagcccgtcagccat

SEQ ID NO: 97237 - DNA, 20 bp, human
gcagccatgggcaggatcgc

SEQ ID NO: 97238 - DNA, 20 bp, human
gcatgggcaggatcgcgggt

SEQ ID NO: 97239 - DNA, 20 bp, human
ggaatctgctcgagacccca

SEQ ID NO: 97240 - DNA, 20 bp, human
gggcaggatcgcgggtaggt

SEQ ID NO: 97241 - DNA, 20 bp, human
gtaggtgggtcagccgggtc

SEQ ID NO: 97242 - DNA, 20 bp, human
ggatcctgcccatggctgac

SEQ ID NO: 97243 - DNA, 20 bp, human
gggccagcgcgggacggggt

SEQ ID NO: 97244 - DNA, 20 bp, human
gagcagccctcgtccagtgg

SEQ ID NO: 97245 - DNA, 20 bp, human
ggggtgggcgcaggaccgag

SEQ ID NO: 97246 - DNA, 20 bp, human
gtcacagggagtcagcgtcc

SEQ ID NO: 97247 - DNA, 20 bp, human
ggggcaagaaacctacccac

SEQ ID NO: 97248 - DNA, 20 bp, human
gggatcagggctaagtcaca

SEQ ID NO: 97249 - DNA, 20 bp, human
gggacccccccgaagccggt

SEQ ID NO: 97250 - DNA, 20 bp, human
gtcgctggagagcctaggtc

SEQ ID NO: 97251 - DNA, 20 bp, human
ggcccggcggctccagttct

SEQ ID NO: 97252 - DNA, 20 bp, human
gtcaccccgacgccagacct

SEQ ID NO: 97253 - DNA, 20 bp, human
ggagagggcggcacgtttca

SEQ ID NO: 97254 - DNA, 20 bp, human
gtctcttcgaacctgagaga

SEQ ID NO: 97255 - DNA, 20 bp, human
ggaggcttctgggaaaacgg

SEQ ID NO: 97256 - DNA, 20 bp, human
ggacagtgtgccagggtcaa

SEQ ID NO: 97257 - DNA, 20 bp, human
gcgcagccgccagctccgga

SEQ ID NO: 97258 - DNA, 20 bp, human
gcagctagagtggcccaacc

SEQ ID NO: 97259 - DNA, 20 bp, human
ggcgttaggacagtgtgcca

SEQ ID NO: 97260 - DNA, 20 bp, human
gcagcctgggaccgggtcct

SEQ ID NO: 97261 - DNA, 20 bp, human
gtgacaggtgggtacagatg

SEQ ID NO: 97262 - DNA, 20 bp, human
gcgacctcccgcagctagag

SEQ ID NO: 97263 - DNA, 20 bp, human
gctcggtggcgtagagaagg

SEQ ID NO: 97264 - DNA, 20 bp, human
gtggcggctgcgctcccggt

SEQ ID NO: 97265 - DNA, 20 bp, human
ggcgggaggtcgcttctcgg

SEQ ID NO: 97266 - DNA, 20 bp, human
ggtcttgccggggactcgtg

SEQ ID NO: 97267 - DNA, 20 bp, human
ggcatctggatgtaatggat

SEQ ID NO: 97268 - DNA, 20 bp, human
gaagttaccccacgagtccc

SEQ ID NO: 97269 - DNA, 20 bp, human
gtggccaaactgtggttctt

SEQ ID NO: 97270 - DNA, 20 bp, human
ggttctttggtagaatttcc

SEQ ID NO: 97271 - DNA, 20 bp, human
ggtgggctctagtcttgccg

SEQ ID NO: 97272 - DNA, 20 bp, human
gtatctgcatctggatgtaa

SEQ ID NO: 97273 - DNA, 20 bp, human
gctaccaaagaaccacagtt

SEQ ID NO: 97274 - DNA, 20 bp, human
gcgtggggtaacttgttctt

SEQ ID NO: 97275 - DNA, 20 bp, human
gactgtgcctggccaaactg

SEQ ID NO: 97276 - DNA, 20 bp, human
gcgaaagtaagggtgagaag

SEQ ID NO: 97277 - DNA, 20 bp, human
gtcgctgacggttgaagagt

SEQ ID NO: 97278 - DNA, 20 bp, human
gcacgatgtttggacacctc

SEQ ID NO: 97279 - DNA, 20 bp, human
gaggtttcttcctcgagggg

SEQ ID NO: 97280 - DNA, 20 bp, human
ggcgcaggtttcttcctcga

SEQ ID NO: 97281 - DNA, 20 bp, human
gtggacacctcaggcccctg

SEQ ID NO: 97282 - DNA, 20 bp, human
ggggcaccatcccacctgtc

SEQ ID NO: 97283 - DNA, 20 bp, human
gacggttgaagagtgggaaa

SEQ ID NO: 97284 - DNA, 20 bp, human
gtgtgcacagacgaaagtaa

SEQ ID NO: 97285 - DNA, 20 bp, human
gtgagacgagggatcctcag

SEQ ID NO: 97286 - DNA, 20 bp, human
gttgaagacaccatggaagt

SEQ ID NO: 97287 - DNA, 20 bp, human
gcagccctgcctgggaaatc

SEQ ID NO: 97288 - DNA, 20 bp, human
gattacacttctgaggaagg

SEQ ID NO: 97289 - DNA, 20 bp, human
gggcgccggcctgatttccc

SEQ ID NO: 97290 - DNA, 20 bp, human
gcctgcctgggaaatcaggc

SEQ ID NO: 97291 - DNA, 20 bp, human
ggtcaggaagatcagggcgc

SEQ ID NO: 97292 - DNA, 20 bp, human
gtctgctttcagccctgcct

SEQ ID NO: 97293 - DNA, 20 bp, human
gcagggagtgtggaggatgt

SEQ ID NO: 97294 - DNA, 20 bp, human
gcttctgaggaaggtggtca

SEQ ID NO: 97295 - DNA, 20 bp, human
gggcccccgagcaagcagag

SEQ ID NO: 97296 - DNA, 20 bp, human
gggcacccccttgacagaca

SEQ ID NO: 97297 - DNA, 20 bp, human
gacccccttgacagacaagg

SEQ ID NO: 97298 - DNA, 20 bp, human
gttgaagacaccatggaagt

SEQ ID NO: 97299 - DNA, 20 bp, human
gggccaccttgtctgtcaag

SEQ ID NO: 97300 - DNA, 20 bp, human
gtagagatgggcttttccaa

SEQ ID NO: 97301 - DNA, 20 bp, human
gggcttcacatgcaggctct

SEQ ID NO: 97302 - DNA, 20 bp, human
gtctaccctccttgaggacc

SEQ ID NO: 97303 - DNA, 20 bp, human
gagcccatctctagtgcttg

SEQ ID NO: 97304 - DNA, 20 bp, human
gcccccgaggttggtcaatg

SEQ ID NO: 97305 - DNA, 20 bp, human
gctgaaaacccaggtcctca

SEQ ID NO: 97306 - DNA, 20 bp, human
gtaactaaattccctacgaa

SEQ ID NO: 97307 - DNA, 20 bp, human
ggatggaactgtctggacaa

SEQ ID NO: 97308 - DNA, 20 bp, human
ggcattacctgtggaagaaa

SEQ ID NO: 97309 - DNA, 20 bp, human
gctgggcatattttgctgac

SEQ ID NO: 97310 - DNA, 20 bp, human
gtttatccagaagataaggc

SEQ ID NO: 97311 - DNA, 20 bp, human
gatagtttatccagaagata

SEQ ID NO: 97312 - DNA, 20 bp, human
gtacattattggaaagttaa

SEQ ID NO: 97313 - DNA, 20 bp, human
gtgtctggacaaaggttgga

SEQ ID NO: 97314 - DNA, 20 bp, human
gcatttgtgatggaactgtc

SEQ ID NO: 97315 - DNA, 20 bp, human
gttgtttatctgcttcttcg

SEQ ID NO: 97316 - DNA, 20 bp, human
ggcgcgcagtcagccgtcat

SEQ ID NO: 97317 - DNA, 20 bp, human
gcgcagtcagccgtcatggg

SEQ ID NO: 97318 - DNA, 20 bp, human
gaggctcgcgtgctagcgta

SEQ ID NO: 97319 - DNA, 20 bp, human
ggcccccgaggacgcaggta

SEQ ID NO: 97320 - DNA, 20 bp, human
gcagccccaggtagatctag

SEQ ID NO: 97321 - DNA, 20 bp, human
ggggaggtgtagtctcccag

SEQ ID NO: 97322 - DNA, 20 bp, human
ggcgagagacagtaactgga

SEQ ID NO: 97323 - DNA, 20 bp, human
ggcacacagatgcggacggt

SEQ ID NO: 97324 - DNA, 20 bp, human
ggtaaaggcgctccgaggaa

SEQ ID NO: 97325 - DNA, 20 bp, human
gtttggtgaggcctcgggag

SEQ ID NO: 97326 - DNA, 20 bp, human
ggcggcacgcgggggaatag

SEQ ID NO: 97327 - DNA, 20 bp, human
gtagctctcccgctaggagg

SEQ ID NO: 97328 - DNA, 20 bp, human
gacgcagaagagaagacggg

SEQ ID NO: 97329 - DNA, 20 bp, human
gagggaccgagagacacccc

SEQ ID NO: 97330 - DNA, 20 bp, human
gcctagcgggagagctacac

SEQ ID NO: 97331 - DNA, 20 bp, human
gcgcggaacggggagatcgt

SEQ ID NO: 97332 - DNA, 20 bp, human
gaccgagagacaccccagga

SEQ ID NO: 97333 - DNA, 20 bp, human
ggctaggaggcggcacgcgg

SEQ ID NO: 97334 - DNA, 20 bp, human
ggaaggaaggtgctgccgag

SEQ ID NO: 97335 - DNA, 20 bp, human
gccgagcaggcggccctagg

SEQ ID NO: 97336 - DNA, 20 bp, human
gctccttccgggacgcagat

SEQ ID NO: 97337 - DNA, 20 bp, human
gggccgggcggtcaccgctc

SEQ ID NO: 97338 - DNA, 20 bp, human
gccgggagccctaagagaac

SEQ ID NO: 97339 - DNA, 20 bp, human
gcggcgccgctttcactcac

SEQ ID NO: 97340 - DNA, 20 bp, human
ggagaaccggcagatgacac

SEQ ID NO: 97341 - DNA, 20 bp, human
gccaccgctgtcggcaccat

SEQ ID NO: 97342 - DNA, 20 bp, human
gctgcccatggtgccgacag

SEQ ID NO: 97343 - DNA, 20 bp, human
gtccctgaccctagtctggg

SEQ ID NO: 97344 - DNA, 20 bp, human
gcttccgggacgcagatggg

SEQ ID NO: 97345 - DNA, 20 bp, human
gaggttaggacaccgacctg

SEQ ID NO: 97346 - DNA, 20 bp, human
ggggctatggcggcgagcac

SEQ ID NO: 97347 - DNA, 20 bp, human
gtgcgggtgatggcgatgag

SEQ ID NO: 97348 - DNA, 20 bp, human
gcagtatggccgggctatgg

SEQ ID NO: 97349 - DNA, 20 bp, human
gctggctacgtgcgactgtg

SEQ ID NO: 97350 - DNA, 20 bp, human
gtacgtgcgactgtggggag

SEQ ID NO: 97351 - DNA, 20 bp, human
gcaggtgcggaaacacatcg

SEQ ID NO: 97352 - DNA, 20 bp, human
gtgataaagcgcgggaacac

SEQ ID NO: 97353 - DNA, 20 bp, human
ggcggaggcgcattctcggg

SEQ ID NO: 97354 - DNA, 20 bp, human
ggttgtgtgagccgccagta

SEQ ID NO: 97355 - DNA, 20 bp, human
ggtgggaacccgccccccgg

SEQ ID NO: 97356 - DNA, 20 bp, human
gggcagcaggacgccctcgt

SEQ ID NO: 97357 - DNA, 20 bp, human
gtgcggagccgccttctgaa

SEQ ID NO: 97358 - DNA, 20 bp, human
ggcaagtgatagcaccagag

SEQ ID NO: 97359 - DNA, 20 bp, human
gagtgatagcaccagagagg

SEQ ID NO: 97360 - DNA, 20 bp, human
gcagcagcgggaggcgactg

SEQ ID NO: 97361 - DNA, 20 bp, human
gcgctgctgctcacccacga

SEQ ID NO: 97362 - DNA, 20 bp, human
gtggcagcctttcgcactgg

SEQ ID NO: 97363 - DNA, 20 bp, human
gtggaggcgggtctgaggtt

SEQ ID NO: 97364 - DNA, 20 bp, human
gtgacagcccccagtgcgaa

SEQ ID NO: 97365 - DNA, 20 bp, human
gtcgcgctcaaggcaggccg

SEQ ID NO: 97366 - DNA, 20 bp, human
gccacttcagcaatgggata

SEQ ID NO: 97367 - DNA, 20 bp, human
gtgccgtttccagattgtac

SEQ ID NO: 97368 - DNA, 20 bp, human
gcactggccgttcaggttgt

SEQ ID NO: 97369 - DNA, 20 bp, human
gagggtaggccaatatgtcc

SEQ ID NO: 97370 - DNA, 20 bp, human
gtaagatatggtgaatctgt

SEQ ID NO: 97371 - DNA, 20 bp, human
gacagagtgtagtggggctt

SEQ ID NO: 97372 - DNA, 20 bp, human
gtcaggttgtgggcagtaac

SEQ ID NO: 97373 - DNA, 20 bp, human
ggagcagttggaccgacttg

SEQ ID NO: 97374 - DNA, 20 bp, human
gactacactctgttgattac

SEQ ID NO: 97375 - DNA, 20 bp, human
gaaatcattccaggacatat

SEQ ID NO: 97376 - DNA, 20 bp, human
gggaggctccgggaccgtgg

SEQ ID NO: 97377 - DNA, 20 bp, human
gagaggacatggcccgcgga

SEQ ID NO: 97378 - DNA, 20 bp, human
gcggttgcaggcgctgacgg

SEQ ID NO: 97379 - DNA, 20 bp, human
gcgctgggcggccacctgaa

SEQ ID NO: 97380 - DNA, 20 bp, human
ggagttccctccgcaggcag

SEQ ID NO: 97381 - DNA, 20 bp, human
gaggcatctgaggagcccgc

SEQ ID NO: 97382 - DNA, 20 bp, human
gcagcgccagcagctccccg

SEQ ID NO: 97383 - DNA, 20 bp, human
gcctgctcgcgggccgcgtg

SEQ ID NO: 97384 - DNA, 20 bp, human
gggccacagggcacggtcac

SEQ ID NO: 97385 - DNA, 20 bp, human
gcgggccatgtcctctccgg

SEQ ID NO: 97386 - DNA, 20 bp, human
gctgagaggccgctgcgcgt

SEQ ID NO: 97387 - DNA, 20 bp, human
gcgcgcgggcgactacgaga

SEQ ID NO: 97388 - DNA, 20 bp, human
gccgccggcttaggtaaccc

SEQ ID NO: 97389 - DNA, 20 bp, human
gagcggcctctcagtcccgc

SEQ ID NO: 97390 - DNA, 20 bp, human
gagcccctgcccacgcgcag

SEQ ID NO: 97391 - DNA, 20 bp, human
gcgacctgggttacctaagc

SEQ ID NO: 97392 - DNA, 20 bp, human
gtgcgttaccgcagcgacct

SEQ ID NO: 97393 - DNA, 20 bp, human
gctctcagtcccgccggctt

SEQ ID NO: 97394 - DNA, 20 bp, human
gagcagccacgcgcgtctgg

SEQ ID NO: 97395 - DNA, 20 bp, human
ggggccgggacaggcaccgc

SEQ ID NO: 97396 - DNA, 20 bp, human
gggaccggggacacgaagca

SEQ ID NO: 97397 - DNA, 20 bp, human
gcagagcaagagcagtctcc

SEQ ID NO: 97398 - DNA, 20 bp, human
gtggcagctggaggaaatcg

SEQ ID NO: 97399 - DNA, 20 bp, human
gcgcccagtggccaccatca

SEQ ID NO: 97400 - DNA, 20 bp, human
gccagtggccaccatcaagg

SEQ ID NO: 97401 - DNA, 20 bp, human
ggtatagacagctctccgag

SEQ ID NO: 97402 - DNA, 20 bp, human
gggggacacgaagcaaggag

SEQ ID NO: 97403 - DNA, 20 bp, human
gcatggagctcccggaggcg

SEQ ID NO: 97404 - DNA, 20 bp, human
ggacatgggcccccacccaa

SEQ ID NO: 97405 - DNA, 20 bp, human
gcagcggcccaagtagacat

SEQ ID NO: 97406 - DNA, 20 bp, human
gccctatgcgggtgccagag

SEQ ID NO: 97407 - DNA, 20 bp, human
gagccactctcaagagagta

SEQ ID NO: 97408 - DNA, 20 bp, human
gaccttgtgaacctgtcagg

SEQ ID NO: 97409 - DNA, 20 bp, human
gctccctactctcttgagag

SEQ ID NO: 97410 - DNA, 20 bp, human
gatctaatctagtcaggcct

SEQ ID NO: 97411 - DNA, 20 bp, human
gtttagagggcggtcaggaa

SEQ ID NO: 97412 - DNA, 20 bp, human
gtgcagatgggagggatttc

SEQ ID NO: 97413 - DNA, 20 bp, human
ggaggagcactgatctcctg

SEQ ID NO: 97414 - DNA, 20 bp, human
ggcctctctggcacccgcat

SEQ ID NO: 97415 - DNA, 20 bp, human
gagactatctcctgcctctc

SEQ ID NO: 97416 - DNA, 20 bp, human
gtggcgccagcagatccaat

SEQ ID NO: 97417 - DNA, 20 bp, human
gcagtgtctggagtgaagga

SEQ ID NO: 97418 - DNA, 20 bp, human
gaccccgctcgaggaggacg

SEQ ID NO: 97419 - DNA, 20 bp, human
gtcagtcctggaaggcaacg

SEQ ID NO: 97420 - DNA, 20 bp, human
gaggcgcccggagccgccgg

SEQ ID NO: 97421 - DNA, 20 bp, human
gcctggaaggcaacggggag

SEQ ID NO: 97422 - DNA, 20 bp, human
gcgagcagccgccttgactg

SEQ ID NO: 97423 - DNA, 20 bp, human
gcggggctcaaatcacgtga

SEQ ID NO: 97424 - DNA, 20 bp, human
gcgggcagtgtctggagtga

SEQ ID NO: 97425 - DNA, 20 bp, human
gccggagagcgggcagtgtc

SEQ ID NO: 97426 - DNA, 20 bp, human
ggcctgcgagcgctgggaga

SEQ ID NO: 97427 - DNA, 20 bp, human
ggccccagaagaaaaggcgg

SEQ ID NO: 97428 - DNA, 20 bp, human
gtccagtctggtccccgagt

SEQ ID NO: 97429 - DNA, 20 bp, human
gtggtgcagctggctgcggt

SEQ ID NO: 97430 - DNA, 20 bp, human
gacctactcggggaccagac

SEQ ID NO: 97431 - DNA, 20 bp, human
gctgttccactgagaatcgg

SEQ ID NO: 97432 - DNA, 20 bp, human
gttctggggcatcattctgt

SEQ ID NO: 97433 - DNA, 20 bp, human
gcggggaccagactggaacg

SEQ ID NO: 97434 - DNA, 20 bp, human
gttcctggccctgtacgaag

SEQ ID NO: 97435 - DNA, 20 bp, human
gttcaggagctggagaacat

SEQ ID NO: 97436 - DNA, 20 bp, human
gtacatggccagccccgcac

SEQ ID NO: 97437 - DNA, 20 bp, human
gctggcggcagctgatccag

SEQ ID NO: 97438 - DNA, 20 bp, human
gcacggcctcgaggacagga

SEQ ID NO: 97439 - DNA, 20 bp, human
gctcggaccccgcccgctgg

SEQ ID NO: 97440 - DNA, 20 bp, human
gaccgcctgtgggccttaca

SEQ ID NO: 97441 - DNA, 20 bp, human
gcctgtgcgtgctggtgcac

SEQ ID NO: 97442 - DNA, 20 bp, human
gtctccgcagggcaccgggc

SEQ ID NO: 97443 - DNA, 20 bp, human
ggccatgtaaggcccacagg

SEQ ID NO: 97444 - DNA, 20 bp, human
gctctcaggagtggccccct

SEQ ID NO: 97445 - DNA, 20 bp, human
gctggccatgtaaggcccac

SEQ ID NO: 97446 - DNA, 20 bp, human
gaagcggagggggaccaccg

SEQ ID NO: 97447 - DNA, 20 bp, human
ggaaagcaagcaccaagcgt

SEQ ID NO: 97448 - DNA, 20 bp, human
ggggcgctcgggacgatcca

SEQ ID NO: 97449 - DNA, 20 bp, human
gcccctttctcgagcagagg

SEQ ID NO: 97450 - DNA, 20 bp, human
ggaagcctggagaccccata

SEQ ID NO: 97451 - DNA, 20 bp, human
ggcacacaccgagacttgac

SEQ ID NO: 97452 - DNA, 20 bp, human
gggctctggtctccgatggc

SEQ ID NO: 97453 - DNA, 20 bp, human
gctttctcgagcagaggggg

SEQ ID NO: 97454 - DNA, 20 bp, human
gacccccaggcactgtcgag

SEQ ID NO: 97455 - DNA, 20 bp, human
ggcccaaccccacctcgtac

SEQ ID NO: 97456 - DNA, 20 bp, human
ggtcctgctcggccaaggta

SEQ ID NO: 97457 - DNA, 20 bp, human
gagtgagacagagtacacgg

SEQ ID NO: 97458 - DNA, 20 bp, human
gcggaggaggcacataccgg

SEQ ID NO: 97459 - DNA, 20 bp, human
gccgcagagggaatgagtag

SEQ ID NO: 97460 - DNA, 20 bp, human
gacacggaggaggcacatac

SEQ ID NO: 97461 - DNA, 20 bp, human
ggctgaggcacaggtcatag

SEQ ID NO: 97462 - DNA, 20 bp, human
gggtcctggagatcagtcct

SEQ ID NO: 97463 - DNA, 20 bp, human
gaacgggaggccaggcgcta

SEQ ID NO: 97464 - DNA, 20 bp, human
ggcaagtgagacagagtaca

SEQ ID NO: 97465 - DNA, 20 bp, human
gttagggtcctgctcggcca

SEQ ID NO: 97466 - DNA, 20 bp, human
gcagcaagaggcagaccaag

SEQ ID NO: 97467 - DNA, 20 bp, human
gatggagcgcggacagtccg

SEQ ID NO: 97468 - DNA, 20 bp, human
gggcctgggcgcaccactca

SEQ ID NO: 97469 - DNA, 20 bp, human
gcagctccggtctggatagt

SEQ ID NO: 97470 - DNA, 20 bp, human
gaacgaaccagggctgatct

SEQ ID NO: 97471 - DNA, 20 bp, human
ggctctccaactatccagac

SEQ ID NO: 97472 - DNA, 20 bp, human
gcgttagcgctgctccgccg

SEQ ID NO: 97473 - DNA, 20 bp, human
gagaccaagaggcagacgcg

SEQ ID NO: 97474 - DNA, 20 bp, human
ggggctcaccagatggagcg

SEQ ID NO: 97475 - DNA, 20 bp, human
gcttgggggacaacgaacca

SEQ ID NO: 97476 - DNA, 20 bp, human
ggccagactggccatcatgt

SEQ ID NO: 97477 - DNA, 20 bp, human
ggcctacatgatggccagtc

SEQ ID NO: 97478 - DNA, 20 bp, human
gcaccgtgacagtcttcacg

SEQ ID NO: 97479 - DNA, 20 bp, human
ggtcaacaatgtcctgggat

SEQ ID NO: 97480 - DNA, 20 bp, human
gtgtaagtcaacaatgtcct

SEQ ID NO: 97481 - DNA, 20 bp, human
gatttatttttcagccagac

SEQ ID NO: 97482 - DNA, 20 bp, human
gatatacaagattttgaact

SEQ ID NO: 97483 - DNA, 20 bp, human
gaaagagtgtgcctacatga

SEQ ID NO: 97484 - DNA, 20 bp, human
gtttgcatagttagctacaa

SEQ ID NO: 97485 - DNA, 20 bp, human
gcttgctagtgaggggagca

SEQ ID NO: 97486 - DNA, 20 bp, human
gggcagtaggggccgactgg

SEQ ID NO: 97487 - DNA, 20 bp, human
gcccctgggcgcgaagccag

SEQ ID NO: 97488 - DNA, 20 bp, human
ggagacggagtcgccactca

SEQ ID NO: 97489 - DNA, 20 bp, human
gtccggcccgcgctccgcag

SEQ ID NO: 97490 - DNA, 20 bp, human
gcgcgcacccacactctcac

SEQ ID NO: 97491 - DNA, 20 bp, human
gcaaccacaaagcccgtccg

SEQ ID NO: 97492 - DNA, 20 bp, human
gcggcctgaagccagcccgg

SEQ ID NO: 97493 - DNA, 20 bp, human
gcgccaaagccgggcagtag

SEQ ID NO: 97494 - DNA, 20 bp, human
gggcccgcccagtgacacgt

SEQ ID NO: 97495 - DNA, 20 bp, human
gctcggaggtgcaagtccag

SEQ ID NO: 97496 - DNA, 20 bp, human
gcgggagcgtgtgcacacaa

SEQ ID NO: 97497 - DNA, 20 bp, human
ggtctccgggacaaagacag

SEQ ID NO: 97498 - DNA, 20 bp, human
ggtgatcggagtggacagag

SEQ ID NO: 97499 - DNA, 20 bp, human
gcgggagcggtagagcgtcc

SEQ ID NO: 97500 - DNA, 20 bp, human
gggcggccccagaagttagt

SEQ ID NO: 97501 - DNA, 20 bp, human
gggcgtggaggtgatcggag

SEQ ID NO: 97502 - DNA, 20 bp, human
ggcgtgtgcacacaagggtg

SEQ ID NO: 97503 - DNA, 20 bp, human
gttgctagaaccctgcgagg

SEQ ID NO: 97504 - DNA, 20 bp, human
ggccgaggcgtggaggtgat

SEQ ID NO: 97505 - DNA, 20 bp, human
gcctgtgcgggttgctgaga

SEQ ID NO: 97506 - DNA, 20 bp, human
ggccgggcgcggagaagcag

SEQ ID NO: 97507 - DNA, 20 bp, human
ggtcgcaggggtcgctggag

SEQ ID NO: 97508 - DNA, 20 bp, human
gggctctggacgcgtcgcag

SEQ ID NO: 97509 - DNA, 20 bp, human
ggactctcccggcgggtgta

SEQ ID NO: 97510 - DNA, 20 bp, human
gacgcacgccctggtgactg

SEQ ID NO: 97511 - DNA, 20 bp, human
gccccgggacaagactctcc

SEQ ID NO: 97512 - DNA, 20 bp, human
gcgagcgcgacggggcgacc

SEQ ID NO: 97513 - DNA, 20 bp, human
gccccgagccgcagtcacca

SEQ ID NO: 97514 - DNA, 20 bp, human
gctcctagcggggaaaaagg

SEQ ID NO: 97515 - DNA, 20 bp, human
gccgtcgcgctcgaccccga

SEQ ID NO: 97516 - DNA, 20 bp, human
gggctacagcattcaagaga

SEQ ID NO: 97517 - DNA, 20 bp, human
gagagggagtcgttaacaaa

SEQ ID NO: 97518 - DNA, 20 bp, human
gctgatgctttgagagtgta

SEQ ID NO: 97519 - DNA, 20 bp, human
ggacggccaggggaactctt

SEQ ID NO: 97520 - DNA, 20 bp, human
gaagtccgagctggagccga

SEQ ID NO: 97521 - DNA, 20 bp, human
gtttgtgtcctgtttgctaa

SEQ ID NO: 97522 - DNA, 20 bp, human
gggtttgcagtaaaaagctg

SEQ ID NO: 97523 - DNA, 20 bp, human
gcaaggatcttcgtgatgaa

SEQ ID NO: 97524 - DNA, 20 bp, human
gagctggagccgacggccag

SEQ ID NO: 97525 - DNA, 20 bp, human
gaaaggcctgaagtccgagc

SEQ ID NO: 97526 - DNA, 20 bp, human
gttaagtatccttagctgct

SEQ ID NO: 97527 - DNA, 20 bp, human
gacacggagcacaggtatgg

SEQ ID NO: 97528 - DNA, 20 bp, human
ggcaacacggagcacaggta

SEQ ID NO: 97529 - DNA, 20 bp, human
gtccccagagggccctccct

SEQ ID NO: 97530 - DNA, 20 bp, human
gaactgcacagggagcacaa

SEQ ID NO: 97531 - DNA, 20 bp, human
ggctctgcgctgccccaagc

SEQ ID NO: 97532 - DNA, 20 bp, human
ggcgagatgccccagagtgg

SEQ ID NO: 97533 - DNA, 20 bp, human
gcccctctaggcccccactg

SEQ ID NO: 97534 - DNA, 20 bp, human
gctacaccacacatccccca

SEQ ID NO: 97535 - DNA, 20 bp, human
gcaggcagcggaagccagct

SEQ ID NO: 97536 - DNA, 20 bp, human
gttggggtgggtgatataga

SEQ ID NO: 97537 - DNA, 20 bp, human
gcccagctcagagggcaaat

SEQ ID NO: 97538 - DNA, 20 bp, human
gggcccccggatgtgtacat

SEQ ID NO: 97539 - DNA, 20 bp, human
ggctgaaggacggagaccca

SEQ ID NO: 97540 - DNA, 20 bp, human
ggtcggcacacactgatgtc

SEQ ID NO: 97541 - DNA, 20 bp, human
gcctgaggaggtaagtaacc

SEQ ID NO: 97542 - DNA, 20 bp, human
ggtgaccacgacacacacag

SEQ ID NO: 97543 - DNA, 20 bp, human
gttcccatgtacacatccgg

SEQ ID NO: 97544 - DNA, 20 bp, human
gctgagttctatgttactag

SEQ ID NO: 97545 - DNA, 20 bp, human
gcaggcagcttcacaagcat

SEQ ID NO: 97546 - DNA, 20 bp, human
gaagatacaactggcaactg

SEQ ID NO: 97547 - DNA, 20 bp, human
gagcgacctcaagatacaac

SEQ ID NO: 97548 - DNA, 20 bp, human
gttcctgttgaagaacccag

SEQ ID NO: 97549 - DNA, 20 bp, human
ggttagctcttgttgaattg

SEQ ID NO: 97550 - DNA, 20 bp, human
ggcagtggatcccagattgt

SEQ ID NO: 97551 - DNA, 20 bp, human
gaacaagagctaacaagctt

SEQ ID NO: 97552 - DNA, 20 bp, human
gaagtaaaatgggacaaatt

SEQ ID NO: 97553 - DNA, 20 bp, human
gttccgctgggttcttcaac

SEQ ID NO: 97554 - DNA, 20 bp, human
gcataaagaaacattaactt

SEQ ID NO: 97555 - DNA, 20 bp, human
gtacaagtttagaagacaag

SEQ ID NO: 97556 - DNA, 20 bp, human
gtagctgggcgcgggtctcg

SEQ ID NO: 97557 - DNA, 20 bp, human
ggaagccggcgccgagaccg

SEQ ID NO: 97558 - DNA, 20 bp, human
gggcggggacgcgaactgag

SEQ ID NO: 97559 - DNA, 20 bp, human
gggggacgcgaactgagggg

SEQ ID NO: 97560 - DNA, 20 bp, human
ggcgggccgaggatgcgcgg

SEQ ID NO: 97561 - DNA, 20 bp, human
gggcgccgagaccgaggcat

SEQ ID NO: 97562 - DNA, 20 bp, human
ggcacccgatgcctcggtct

SEQ ID NO: 97563 - DNA, 20 bp, human
ggaagcggggaccccgagga

SEQ ID NO: 97564 - DNA, 20 bp, human
gccgaggcatcgggtgcggg

SEQ ID NO: 97565 - DNA, 20 bp, human
gagcggggccggggctagct

SEQ ID NO: 97566 - DNA, 20 bp, human
gtgaggatggccgcctcggt

SEQ ID NO: 97567 - DNA, 20 bp, human
gaagccgccggcgaaccaca

SEQ ID NO: 97568 - DNA, 20 bp, human
gccaccgggtggccgtgaag

SEQ ID NO: 97569 - DNA, 20 bp, human
ggttcgccggcggcttccac

SEQ ID NO: 97570 - DNA, 20 bp, human
ggggtccctcactcccggta

SEQ ID NO: 97571 - DNA, 20 bp, human
gcggcaggcgctgcccaccg

SEQ ID NO: 97572 - DNA, 20 bp, human
gagcgtgaggatggccgcct

SEQ ID NO: 97573 - DNA, 20 bp, human
gcgtcgaagtaggacgagtg

SEQ ID NO: 97574 - DNA, 20 bp, human
gagcgcctgccgccccttca

SEQ ID NO: 97575 - DNA, 20 bp, human
gccctccctgctaggaatga

SEQ ID NO: 97576 - DNA, 20 bp, human
gctactagagtcccagccta

SEQ ID NO: 97577 - DNA, 20 bp, human
gcggccgaagcgatctacgc

SEQ ID NO: 97578 - DNA, 20 bp, human
gtgggactctagtaggtctt

SEQ ID NO: 97579 - DNA, 20 bp, human
gcgaggcgggcgagagtctg

SEQ ID NO: 97580 - DNA, 20 bp, human
ggcgggcgagagtctgagga

SEQ ID NO: 97581 - DNA, 20 bp, human
gttgagccgggcgtagaacc

SEQ ID NO: 97582 - DNA, 20 bp, human
ggcgcccgcgtagatcgctt

SEQ ID NO: 97583 - DNA, 20 bp, human
ggagtgaggtggtccgaggc

SEQ ID NO: 97584 - DNA, 20 bp, human
gtaggtcttcggctcagttt

SEQ ID NO: 97585 - DNA, 20 bp, human
gccagcctagggcgacgctg

SEQ ID NO: 97586 - DNA, 20 bp, human
gctccgcgcgccccgaatgc

SEQ ID NO: 97587 - DNA, 20 bp, human
gggccccgagccggaattgg

SEQ ID NO: 97588 - DNA, 20 bp, human
gggtagagcctggcacaaga

SEQ ID NO: 97589 - DNA, 20 bp, human
ggcacaccaacagctactga

SEQ ID NO: 97590 - DNA, 20 bp, human
ggaggacgccatcttaactc

SEQ ID NO: 97591 - DNA, 20 bp, human
gagacaggtcgtgggagcaa

SEQ ID NO: 97592 - DNA, 20 bp, human
gttaactccgggagccccac

SEQ ID NO: 97593 - DNA, 20 bp, human
gggcaggagggtccttaccc

SEQ ID NO: 97594 - DNA, 20 bp, human
gtgggagcaagggtagagcc

SEQ ID NO: 97595 - DNA, 20 bp, human
ggttaagatggcgtcctcag

SEQ ID NO: 97596 - DNA, 20 bp, human
ggctcatggcgggagaaggt

SEQ ID NO: 97597 - DNA, 20 bp, human
ggtgggccggatgcagaggc

SEQ ID NO: 97598 - DNA, 20 bp, human
gggcgtcggaaggacccgtg

SEQ ID NO: 97599 - DNA, 20 bp, human
gacccagcaagcgcagatcg

SEQ ID NO: 97600 - DNA, 20 bp, human
gcggggtgaggctcttgggt

SEQ ID NO: 97601 - DNA, 20 bp, human
gacccactcccactccgagg

SEQ ID NO: 97602 - DNA, 20 bp, human
gcctggctcatggcgggaga

SEQ ID NO: 97603 - DNA, 20 bp, human
gcattaccttaaccctctgg

SEQ ID NO: 97604 - DNA, 20 bp, human
gttgcggagcgggagtccgg

SEQ ID NO: 97605 - DNA, 20 bp, human
gttgggttggtaggcaggga

SEQ ID NO: 97606 - DNA, 20 bp, human
ggccgagactcggtccccaa

SEQ ID NO: 97607 - DNA, 20 bp, human
gcccgcccgggtgacaggtc

SEQ ID NO: 97608 - DNA, 20 bp, human
gtggcgccctactcccctcg

SEQ ID NO: 97609 - DNA, 20 bp, human
gcggagccggaggttacctc

SEQ ID NO: 97610 - DNA, 20 bp, human
gcggccgcgttcgcccggac

SEQ ID NO: 97611 - DNA, 20 bp, human
gccgccagtccgggcgaacg

SEQ ID NO: 97612 - DNA, 20 bp, human
gaagcaggggatgatgaaag

SEQ ID NO: 97613 - DNA, 20 bp, human
ggcagcggcctgagggacga

SEQ ID NO: 97614 - DNA, 20 bp, human
ggcccttggggaccgagtct

SEQ ID NO: 97615 - DNA, 20 bp, human
gggatgtggaagggtcgtgg

SEQ ID NO: 97616 - DNA, 20 bp, human
gccgccgccgaccaaaaatt

SEQ ID NO: 97617 - DNA, 20 bp, human
gtttggtcggcggcggtgct

SEQ ID NO: 97618 - DNA, 20 bp, human
gggcctgtcctggccgcgag

SEQ ID NO: 97619 - DNA, 20 bp, human
gtttcctaatttttggtcgg

SEQ ID NO: 97620 - DNA, 20 bp, human
gggaggtggcgggacgaggg

SEQ ID NO: 97621 - DNA, 20 bp, human
ggtaggaggtggcgggacga

SEQ ID NO: 97622 - DNA, 20 bp, human
ggggctggggggaagcgggt

SEQ ID NO: 97623 - DNA, 20 bp, human
gccacgcgcgggcacactcg

SEQ ID NO: 97624 - DNA, 20 bp, human
ggtgcggacgggctaccgca

SEQ ID NO: 97625 - DNA, 20 bp, human
gctggggggaagcgggtagg

SEQ ID NO: 97626 - DNA, 20 bp, human
gtgagggacagcgcaagaga

SEQ ID NO: 97627 - DNA, 20 bp, human
gatggaagagtgcatgaatg

SEQ ID NO: 97628 - DNA, 20 bp, human
gtggcacaatggcaaaaaga

SEQ ID NO: 97629 - DNA, 20 bp, human
ggttaagtaacaaaagcgtg

SEQ ID NO: 97630 - DNA, 20 bp, human
gaccttgaaaagacagatgg

SEQ ID NO: 97631 - DNA, 20 bp, human
gagagaaacagacacgagat

SEQ ID NO: 97632 - DNA, 20 bp, human
gaaccaggcattgagagcca

SEQ ID NO: 97633 - DNA, 20 bp, human
gtttgataatgagcagacag

SEQ ID NO: 97634 - DNA, 20 bp, human
gtcggagagcgtggataagc

SEQ ID NO: 97635 - DNA, 20 bp, human
ggacacgagatcggagagcg

SEQ ID NO: 97636 - DNA, 20 bp, human
gcagcagccgagggacccag

SEQ ID NO: 97637 - DNA, 20 bp, human
gagaaccgaagagacagcgg

SEQ ID NO: 97638 - DNA, 20 bp, human
gccaagagcgagcgaggcac

SEQ ID NO: 97639 - DNA, 20 bp, human
gcatgcggcagtcatagctg

SEQ ID NO: 97640 - DNA, 20 bp, human
gcatcgctcccgctccgagg

SEQ ID NO: 97641 - DNA, 20 bp, human
gcgggagcgatggaataggt

SEQ ID NO: 97642 - DNA, 20 bp, human
gggagcgggagcgatggaat

SEQ ID NO: 97643 - DNA, 20 bp, human
gtgtgaagcgaggaacgtaa

SEQ ID NO: 97644 - DNA, 20 bp, human
gagcggcagctattaacatg

SEQ ID NO: 97645 - DNA, 20 bp, human
gccttccccggtgcacggag

SEQ ID NO: 97646 - DNA, 20 bp, human
ggcggcggctactcaccgag

SEQ ID NO: 97647 - DNA, 20 bp, human
gcggctggagctagtccccg

SEQ ID NO: 97648 - DNA, 20 bp, human
ggcctcccgctgtggagcag

SEQ ID NO: 97649 - DNA, 20 bp, human
gctgggtgtttgcaatacaa

SEQ ID NO: 97650 - DNA, 20 bp, human
ggcccctgctccacagcggg

SEQ ID NO: 97651 - DNA, 20 bp, human
gcggcttggctgatctcgag

SEQ ID NO: 97652 - DNA, 20 bp, human
gatacaaaggcggccacgcg

SEQ ID NO: 97653 - DNA, 20 bp, human
gagtccccggcgcaaagctg

SEQ ID NO: 97654 - DNA, 20 bp, human
gacgtccccggggccctcta

SEQ ID NO: 97655 - DNA, 20 bp, human
gggcctcgcgagcatccctc

SEQ ID NO: 97656 - DNA, 20 bp, human
gccgggagcggagcccctgt

SEQ ID NO: 97657 - DNA, 20 bp, human
gggagcccctgtgggtaagt

SEQ ID NO: 97658 - DNA, 20 bp, human
gcgcgcccacttacccacag

SEQ ID NO: 97659 - DNA, 20 bp, human
gtctcgggtaaccatcccca

SEQ ID NO: 97660 - DNA, 20 bp, human
gcgggtaaccatccccaggg

SEQ ID NO: 97661 - DNA, 20 bp, human
gcctccgcgccccaaaccca

SEQ ID NO: 97662 - DNA, 20 bp, human
gcctcgcaggcgtccctccg

SEQ ID NO: 97663 - DNA, 20 bp, human
gccgccgccgcaggacggac

SEQ ID NO: 97664 - DNA, 20 bp, human
gggcggcggctggactgcga

SEQ ID NO: 97665 - DNA, 20 bp, human
gaggccgggaccctccgggg

SEQ ID NO: 97666 - DNA, 20 bp, human
gaggtagggcccaactcggg

SEQ ID NO: 97667 - DNA, 20 bp, human
gagacgtcgaaacctcccag

SEQ ID NO: 97668 - DNA, 20 bp, human
gctacgtgcacaggctccac

SEQ ID NO: 97669 - DNA, 20 bp, human
gactaggatcgtagaaggag

SEQ ID NO: 97670 - DNA, 20 bp, human
gctgtgcacgtaggtagagg

SEQ ID NO: 97671 - DNA, 20 bp, human
ggccgcactaggatcgtaga

SEQ ID NO: 97672 - DNA, 20 bp, human
gagcctgtgcacgtaggtag

SEQ ID NO: 97673 - DNA, 20 bp, human
gcgtcgaaacctcccagggg

SEQ ID NO: 97674 - DNA, 20 bp, human
ggtggagcctgggcagattg

SEQ ID NO: 97675 - DNA, 20 bp, human
ggtaggatggcaggacagat

SEQ ID NO: 97676 - DNA, 20 bp, human
gtggcagggcagctagaagt

SEQ ID NO: 97677 - DNA, 20 bp, human
gggtcccagccagagtggaa

SEQ ID NO: 97678 - DNA, 20 bp, human
ggcgccgccgcttcacgatc

SEQ ID NO: 97679 - DNA, 20 bp, human
gccgaaacggtccccggagt

SEQ ID NO: 97680 - DNA, 20 bp, human
gagagggacgcgccccgaga

SEQ ID NO: 97681 - DNA, 20 bp, human
ggcgggaggcggtcagactc

SEQ ID NO: 97682 - DNA, 20 bp, human
gctgggctctagccccgaaa

SEQ ID NO: 97683 - DNA, 20 bp, human
ggccagagtcagcacgagca

SEQ ID NO: 97684 - DNA, 20 bp, human
ggccactgccacccgaactg

SEQ ID NO: 97685 - DNA, 20 bp, human
gcccctcctggatcccactc

SEQ ID NO: 97686 - DNA, 20 bp, human
gtggctgccgtgaaaagaca

SEQ ID NO: 97687 - DNA, 20 bp, human
gcgtgaaaagacaaggcact

SEQ ID NO: 97688 - DNA, 20 bp, human
gtccaagcagagcaactccc

SEQ ID NO: 97689 - DNA, 20 bp, human
gggtggataagagaggtcta

SEQ ID NO: 97690 - DNA, 20 bp, human
gtctggcctctccactatag

SEQ ID NO: 97691 - DNA, 20 bp, human
gtaaacaaggtggataagag

SEQ ID NO: 97692 - DNA, 20 bp, human
ggattttgcagtgttttaag

SEQ ID NO: 97693 - DNA, 20 bp, human
ggccatggggtggctaaagc

SEQ ID NO: 97694 - DNA, 20 bp, human
gtctcagttcctaaacaagg

SEQ ID NO: 97695 - DNA, 20 bp, human
gagctttctgagaagacgtt

SEQ ID NO: 97696 - DNA, 20 bp, human
gctgaggcctaacttgagtt

SEQ ID NO: 97697 - DNA, 20 bp, human
gctgtaagaagtactcccct

SEQ ID NO: 97698 - DNA, 20 bp, human
ggacacgttgctgggagtgc

SEQ ID NO: 97699 - DNA, 20 bp, human
gtgtctgtggacatgtaggg

SEQ ID NO: 97700 - DNA, 20 bp, human
gcacaaggtattccagaccg

SEQ ID NO: 97701 - DNA, 20 bp, human
gcccaggccctgaagacaga

SEQ ID NO: 97702 - DNA, 20 bp, human
gggctcacttgcatggtgat

SEQ ID NO: 97703 - DNA, 20 bp, human
gaagttaggcctcagatgag

SEQ ID NO: 97704 - DNA, 20 bp, human
ggtgggctggctcacttgca

SEQ ID NO: 97705 - DNA, 20 bp, human
gacctggggcttacagcctg

SEQ ID NO: 97706 - DNA, 20 bp, human
gtgccaaatgagaaagaagg

SEQ ID NO: 97707 - DNA, 20 bp, human
gccctctgatgagcgtccag

SEQ ID NO: 97708 - DNA, 20 bp, human
gagtatgggcatcagtaact

SEQ ID NO: 97709 - DNA, 20 bp, human
ggtggtagcattgaacttgg

SEQ ID NO: 97710 - DNA, 20 bp, human
gttgaacttggaggaaaatt

SEQ ID NO: 97711 - DNA, 20 bp, human
gcagtgtttgggcatttaca

SEQ ID NO: 97712 - DNA, 20 bp, human
gaaggaggcaatacaattgc

SEQ ID NO: 97713 - DNA, 20 bp, human
gtgttttccacttaaagtat

SEQ ID NO: 97714 - DNA, 20 bp, human
ggtgcgggactcaccaattg

SEQ ID NO: 97715 - DNA, 20 bp, human
gatgtcactgaacagtgttt

SEQ ID NO: 97716 - DNA, 20 bp, human
gtctctgcaccggggcagta

SEQ ID NO: 97717 - DNA, 20 bp, human
gctggcgctgcagcttgcac

SEQ ID NO: 97718 - DNA, 20 bp, human
gtggggaagtctctgcaccg

SEQ ID NO: 97719 - DNA, 20 bp, human
gacacccacaagcaaggcat

SEQ ID NO: 97720 - DNA, 20 bp, human
ggagcaagccggcgagcgag

SEQ ID NO: 97721 - DNA, 20 bp, human
gggtgtcgaggtgcagatga

SEQ ID NO: 97722 - DNA, 20 bp, human
gaacaggagatcctgaaacc

SEQ ID NO: 97723 - DNA, 20 bp, human
gggagccggacggcccagta

SEQ ID NO: 97724 - DNA, 20 bp, human
gacacctgcgccgccgggtc

SEQ ID NO: 97725 - DNA, 20 bp, human
ggtcgaggtgcagatgaagg

SEQ ID NO: 97726 - DNA, 20 bp, human
gagacgcgaagaccgagacg

SEQ ID NO: 97727 - DNA, 20 bp, human
gggcagtctaggcggagcgg

SEQ ID NO: 97728 - DNA, 20 bp, human
gctcgacgcggtgagaggag

SEQ ID NO: 97729 - DNA, 20 bp, human
gcgcgccggggcagtctagg

SEQ ID NO: 97730 - DNA, 20 bp, human
gaaccggagaccgacaccgg

SEQ ID NO: 97731 - DNA, 20 bp, human
gcgccgcgcagactccgagg

SEQ ID NO: 97732 - DNA, 20 bp, human
ggcgaagaccgagacgcggt

SEQ ID NO: 97733 - DNA, 20 bp, human
ggccgaggagccagcaccgg

SEQ ID NO: 97734 - DNA, 20 bp, human
gcgccgcgccggggcagtct

SEQ ID NO: 97735 - DNA, 20 bp, human
ggagccagcaccggtggtga

SEQ ID NO: 97736 - DNA, 20 bp, human
gcctcgttggtctccacgta

SEQ ID NO: 97737 - DNA, 20 bp, human
gtcttcaagccggccaaggt

SEQ ID NO: 97738 - DNA, 20 bp, human
gcctcggtgcccacagggag

SEQ ID NO: 97739 - DNA, 20 bp, human
ggagagtgcggtcatagcac

SEQ ID NO: 97740 - DNA, 20 bp, human
gagcgggatgagctcctcgt

SEQ ID NO: 97741 - DNA, 20 bp, human
ggcctgtgggcactgcagat

SEQ ID NO: 97742 - DNA, 20 bp, human
gttggccggcttgaagaggt

SEQ ID NO: 97743 - DNA, 20 bp, human
gtgatctgccaacagggagg

SEQ ID NO: 97744 - DNA, 20 bp, human
gctcaggcctcggtgcccac

SEQ ID NO: 97745 - DNA, 20 bp, human
ggtgcaggtgctcaccgagg

SEQ ID NO: 97746 - DNA, 20 bp, human
gcgggtctgcgtcctccccc

SEQ ID NO: 97747 - DNA, 20 bp, human
gctgtgcacacctcgcccgg

SEQ ID NO: 97748 - DNA, 20 bp, human
ggagctgctgtgaaatctag

SEQ ID NO: 97749 - DNA, 20 bp, human
ggcacacaggcactacagga

SEQ ID NO: 97750 - DNA, 20 bp, human
ggcggggaatgtgacatcag

SEQ ID NO: 97751 - DNA, 20 bp, human
gggtgtgcacagcgcagctg

SEQ ID NO: 97752 - DNA, 20 bp, human
gtagcggacgttgtgcacac

SEQ ID NO: 97753 - DNA, 20 bp, human
gggcataatgcagatcctct

SEQ ID NO: 97754 - DNA, 20 bp, human
gcgggctgacaggtattcac

SEQ ID NO: 97755 - DNA, 20 bp, human
gcggcgaaggagaggccaaa

SEQ ID NO: 97756 - DNA, 20 bp, human
ggcgagtagaggagcacggg

SEQ ID NO: 97757 - DNA, 20 bp, human
gcccggcggccagcgagtag

SEQ ID NO: 97758 - DNA, 20 bp, human
gccgccgaggcagccaccgg

SEQ ID NO: 97759 - DNA, 20 bp, human
ggtgctcgtggtaagcccgg

SEQ ID NO: 97760 - DNA, 20 bp, human
gcgggaggacgaggcacggg

SEQ ID NO: 97761 - DNA, 20 bp, human
gaaggcgaggggcgagatca

SEQ ID NO: 97762 - DNA, 20 bp, human
gtgagcgccgcgggcagcag

SEQ ID NO: 97763 - DNA, 20 bp, human
gtgtcctccgggcccgggta

SEQ ID NO: 97764 - DNA, 20 bp, human
gatcagggactcggcgacga

SEQ ID NO: 97765 - DNA, 20 bp, human
gagaggggcctcaaccccga

SEQ ID NO: 97766 - DNA, 20 bp, human
gggaggtcactggagatcaa

SEQ ID NO: 97767 - DNA, 20 bp, human
gaggccgtgaggaacagctt

SEQ ID NO: 97768 - DNA, 20 bp, human
gtcttgtctcacaggccgtg

SEQ ID NO: 97769 - DNA, 20 bp, human
gaagaggaccgcaaaggaac

SEQ ID NO: 97770 - DNA, 20 bp, human
gatctccagtgacctccaaa

SEQ ID NO: 97771 - DNA, 20 bp, human
gatgccaaagctgttcctca

SEQ ID NO: 97772 - DNA, 20 bp, human
gctgtgagacaagagcatct

SEQ ID NO: 97773 - DNA, 20 bp, human
gcatcttggatgtaggacaa

SEQ ID NO: 97774 - DNA, 20 bp, human
gaccccaccacacaaggaga

SEQ ID NO: 97775 - DNA, 20 bp, human
gtttgccctttggaggtcac

SEQ ID NO: 97776 - DNA, 20 bp, human
gaccaaaccaaggcaagtct

SEQ ID NO: 97777 - DNA, 20 bp, human
gtacgcagacaccccgagaa

SEQ ID NO: 97778 - DNA, 20 bp, human
gcgttggcgtacctttctcg

SEQ ID NO: 97779 - DNA, 20 bp, human
gcggtgcctgacctagaggg

SEQ ID NO: 97780 - DNA, 20 bp, human
gcctacaccgagaagctgaa

SEQ ID NO: 97781 - DNA, 20 bp, human
gcgagggcccaaggacccca

SEQ ID NO: 97782 - DNA, 20 bp, human
gatgcggtgcctgacctaga

SEQ ID NO: 97783 - DNA, 20 bp, human
gtaactgcccagacttgcct

SEQ ID NO: 97784 - DNA, 20 bp, human
gaggtgagtgactcacacac

SEQ ID NO: 97785 - DNA, 20 bp, human
ggacctagagggaggcgaaa

SEQ ID NO: 97786 - DNA, 20 bp, human
gctgcaggccaggtgaggta

SEQ ID NO: 97787 - DNA, 20 bp, human
gcccaggtgcgctccttctc

SEQ ID NO: 97788 - DNA, 20 bp, human
ggcgccgcgggcgaagacaa

SEQ ID NO: 97789 - DNA, 20 bp, human
gtgctacaagcagccggaga

SEQ ID NO: 97790 - DNA, 20 bp, human
gaggaaccggtggctgacgg

SEQ ID NO: 97791 - DNA, 20 bp, human
gcacctgggggccgtgccgg

SEQ ID NO: 97792 - DNA, 20 bp, human
gtgaggtacggcgcaaagta

SEQ ID NO: 97793 - DNA, 20 bp, human
gtcgcctcggtggaaagagc

SEQ ID NO: 97794 - DNA, 20 bp, human
ggagacggataaggaaccgg

SEQ ID NO: 97795 - DNA, 20 bp, human
ggccggagaaggagcgcacc

SEQ ID NO: 97796 - DNA, 20 bp, human
gggcccacaagctatcacag

SEQ ID NO: 97797 - DNA, 20 bp, human
gacctgcacgagagtggggg

SEQ ID NO: 97798 - DNA, 20 bp, human
gaggtggcggcggagatcca

SEQ ID NO: 97799 - DNA, 20 bp, human
gaggagcagcgagaccgagg

SEQ ID NO: 97800 - DNA, 20 bp, human
gcccaggagcagcgagaccg

SEQ ID NO: 97801 - DNA, 20 bp, human
gagcagcgagaccgaggtgg

SEQ ID NO: 97802 - DNA, 20 bp, human
gggagtgaagcacctctctc

SEQ ID NO: 97803 - DNA, 20 bp, human
ggcgcccgtagcgccagcag

SEQ ID NO: 97804 - DNA, 20 bp, human
ggcactcggcgctgtcatgg

SEQ ID NO: 97805 - DNA, 20 bp, human
gggacgagtccggagtatct

SEQ ID NO: 97806 - DNA, 20 bp, human
gggcaggcgcgtagaatggg

SEQ ID NO: 97807 - DNA, 20 bp, human
ggctccagaccccggttcaa

SEQ ID NO: 97808 - DNA, 20 bp, human
gggaggcggccaactccggg

SEQ ID NO: 97809 - DNA, 20 bp, human
gcgcagtccttagcttcccg

SEQ ID NO: 97810 - DNA, 20 bp, human
ggccgcagtgctccaccgaa

SEQ ID NO: 97811 - DNA, 20 bp, human
gctggagcgcgcgcttgagg

SEQ ID NO: 97812 - DNA, 20 bp, human
gaagcgcgcgctccagaccc

SEQ ID NO: 97813 - DNA, 20 bp, human
gtcctgtccccgggaagcta

SEQ ID NO: 97814 - DNA, 20 bp, human
gccgaaagggccgggacgaa

SEQ ID NO: 97815 - DNA, 20 bp, human
gtccgagaggtcgtgcccgg

SEQ ID NO: 97816 - DNA, 20 bp, human
ggaggaggcggtaacagtgg

SEQ ID NO: 97817 - DNA, 20 bp, human
gacatggcggcgagtcaggg

SEQ ID NO: 97818 - DNA, 20 bp, human
gggaacatggcggcgagtca

SEQ ID NO: 97819 - DNA, 20 bp, human
gaggctgacagtattgtcgg

SEQ ID NO: 97820 - DNA, 20 bp, human
gagggaggaggcggtaacag

SEQ ID NO: 97821 - DNA, 20 bp, human
gaagcaggtgacaggacggg

SEQ ID NO: 97822 - DNA, 20 bp, human
gcacaggctgacagtattgt

SEQ ID NO: 97823 - DNA, 20 bp, human
gggctcctcacggtgtgctg

SEQ ID NO: 97824 - DNA, 20 bp, human
gacggctgaccgaaaagagt

SEQ ID NO: 97825 - DNA, 20 bp, human
ggaggcggtaacagtggggg

SEQ ID NO: 97826 - DNA, 20 bp, human
gcagcggctgccgagtactc

SEQ ID NO: 97827 - DNA, 20 bp, human
ggctaccgtgccagagtact

SEQ ID NO: 97828 - DNA, 20 bp, human
ggttgtcggctgggaaatgg

SEQ ID NO: 97829 - DNA, 20 bp, human
gccggcgccgggtctccgac

SEQ ID NO: 97830 - DNA, 20 bp, human
ggaggaggcggcggtcactg

SEQ ID NO: 97831 - DNA, 20 bp, human
gggcttggtcgctgtggcag

SEQ ID NO: 97832 - DNA, 20 bp, human
gaggcgccgggtccggaccc

SEQ ID NO: 97833 - DNA, 20 bp, human
ggccgcgggcttggtcgctg

SEQ ID NO: 97834 - DNA, 20 bp, human
gggtaacggggagaagccga

SEQ ID NO: 97835 - DNA, 20 bp, human
gcgggcggcggcatctctcg

SEQ ID NO: 97836 - DNA, 20 bp, human
gcgccgccatccgctcccgg

SEQ ID NO: 97837 - DNA, 20 bp, human
gggtcccgtcagtcaggcag

SEQ ID NO: 97838 - DNA, 20 bp, human
gacggccggtcccgtcagtc

SEQ ID NO: 97839 - DNA, 20 bp, human
gggccgccgccatccgctcc

SEQ ID NO: 97840 - DNA, 20 bp, human
ggcggcgagtggagccgcta

SEQ ID NO: 97841 - DNA, 20 bp, human
gtacggcggctccaaggagg

SEQ ID NO: 97842 - DNA, 20 bp, human
ggctcccgctgcctgactga

SEQ ID NO: 97843 - DNA, 20 bp, human
gggtttagggcaatcaggag

SEQ ID NO: 97844 - DNA, 20 bp, human
gccctggccgccaggtgaag

SEQ ID NO: 97845 - DNA, 20 bp, human
gggcccgccccttcacctgg

SEQ ID NO: 97846 - DNA, 20 bp, human
gccctacctgaggttgaggt

SEQ ID NO: 97847 - DNA, 20 bp, human
ggcagctggcagatgtaggg

SEQ ID NO: 97848 - DNA, 20 bp, human
gcaggcagcgggaccttcta

SEQ ID NO: 97849 - DNA, 20 bp, human
gggggcagctggcagatgta

SEQ ID NO: 97850 - DNA, 20 bp, human
gcctgaggttgaggtaggtg

SEQ ID NO: 97851 - DNA, 20 bp, human
gcaggcatctcaggcaattg

SEQ ID NO: 97852 - DNA, 20 bp, human
gtgtgagattccccaaggct

SEQ ID NO: 97853 - DNA, 20 bp, human
gtctcaggcaattgtggtag

SEQ ID NO: 97854 - DNA, 20 bp, human
gagcgggaccttctaggggg

SEQ ID NO: 97855 - DNA, 20 bp, human
gggccgagccagggccacgt

SEQ ID NO: 97856 - DNA, 20 bp, human
gcagcagcccctctgtgtag

SEQ ID NO: 97857 - DNA, 20 bp, human
gccgccgcagggtcgatcct

SEQ ID NO: 97858 - DNA, 20 bp, human
ggtctcacctctacacagag

SEQ ID NO: 97859 - DNA, 20 bp, human
gcgcctgacggaaaaaggta

SEQ ID NO: 97860 - DNA, 20 bp, human
gtggtttcgcagacgatcta

SEQ ID NO: 97861 - DNA, 20 bp, human
gcagctgcgtggacattcag

SEQ ID NO: 97862 - DNA, 20 bp, human
ggctcaaaacatgaaagctg

SEQ ID NO: 97863 - DNA, 20 bp, human
gggcagcccggcagtacgct

SEQ ID NO: 97864 - DNA, 20 bp, human
gctgtcctcggggtgtcaat

SEQ ID NO: 97865 - DNA, 20 bp, human
ggcagagaagtacccagagc

SEQ ID NO: 97866 - DNA, 20 bp, human
ggtggacaggaaggcgtcaa

SEQ ID NO: 97867 - DNA, 20 bp, human
gtcctccacggtggacagga

SEQ ID NO: 97868 - DNA, 20 bp, human
gcagatccgccgggtggagt

SEQ ID NO: 97869 - DNA, 20 bp, human
gatccgccgggtggagtcgg

SEQ ID NO: 97870 - DNA, 20 bp, human
gcagtgtgggcgccacgttc

SEQ ID NO: 97871 - DNA, 20 bp, human
gtctgggcgggggcatctcg

SEQ ID NO: 97872 - DNA, 20 bp, human
gagatccaggtcctccacgg

SEQ ID NO: 97873 - DNA, 20 bp, human
gggtgttccgggagagagtg

SEQ ID NO: 97874 - DNA, 20 bp, human
gagatgcagcggccggggca

SEQ ID NO: 97875 - DNA, 20 bp, human
gaaaggccgccgactccacc

SEQ ID NO: 97876 - DNA, 20 bp, human
gcgccggcgaccactcacct

SEQ ID NO: 97877 - DNA, 20 bp, human
ggcgaggcagcatctacccc

SEQ ID NO: 97878 - DNA, 20 bp, human
gctcggtgccacccagccgg

SEQ ID NO: 97879 - DNA, 20 bp, human
gctcgagctaaaccctccgg

SEQ ID NO: 97880 - DNA, 20 bp, human
gtcctaccggcatcctccta

SEQ ID NO: 97881 - DNA, 20 bp, human
gctcgggcatcttggaatgt

SEQ ID NO: 97882 - DNA, 20 bp, human
gcaagatgcccgaggttcct

SEQ ID NO: 97883 - DNA, 20 bp, human
gcaaagttcccggttccctc

SEQ ID NO: 97884 - DNA, 20 bp, human
gaggttcctgggaatgcctg

SEQ ID NO: 97885 - DNA, 20 bp, human
gcacacatacacaacccggc

SEQ ID NO: 97886 - DNA, 20 bp, human
ggggtgctggtcccagatca

SEQ ID NO: 97887 - DNA, 20 bp, human
ggccgtggaaccccaagatc

SEQ ID NO: 97888 - DNA, 20 bp, human
gggaccagcaccccgagatc

SEQ ID NO: 97889 - DNA, 20 bp, human
ggcctgaaccccagtatatg

SEQ ID NO: 97890 - DNA, 20 bp, human
gccctgggttgccggcgagg

SEQ ID NO: 97891 - DNA, 20 bp, human
gcccagggcagcgcgcgcac

SEQ ID NO: 97892 - DNA, 20 bp, human
gccgcgggagcgcctggacc

SEQ ID NO: 97893 - DNA, 20 bp, human
gcgagcctggaaccctgatc

SEQ ID NO: 97894 - DNA, 20 bp, human
gggttccacggccggatctc

SEQ ID NO: 97895 - DNA, 20 bp, human
gctgccctgggttgccggcg

SEQ ID NO: 97896 - DNA, 20 bp, human
gcacgtggagggtccccaac

SEQ ID NO: 97897 - DNA, 20 bp, human
gttcccggcgcggttagcgg

SEQ ID NO: 97898 - DNA, 20 bp, human
gcgtgggtgcagggacgtgt

SEQ ID NO: 97899 - DNA, 20 bp, human
gcgtgtgtctgtgaacgcaa

SEQ ID NO: 97900 - DNA, 20 bp, human
ggcatcaccgagtcacgtgg

SEQ ID NO: 97901 - DNA, 20 bp, human
gccgggaaccgagcgagccg

SEQ ID NO: 97902 - DNA, 20 bp, human
gccgagcgccatgggcccga

SEQ ID NO: 97903 - DNA, 20 bp, human
gtgcgctcggccctgcccgt

SEQ ID NO: 97904 - DNA, 20 bp, human
gagagggccgccagagatga

SEQ ID NO: 97905 - DNA, 20 bp, human
ggacgaggcccggggatgac

SEQ ID NO: 97906 - DNA, 20 bp, human
gcaagaacccgggcatgaag

SEQ ID NO: 97907 - DNA, 20 bp, human
gggaagggttgggtatccaa

SEQ ID NO: 97908 - DNA, 20 bp, human
gggaggagggagccgagaaa

SEQ ID NO: 97909 - DNA, 20 bp, human
gtagatacacggaaacaaga

SEQ ID NO: 97910 - DNA, 20 bp, human
ggctgcccgcaggtcgctct

SEQ ID NO: 97911 - DNA, 20 bp, human
ggcggagccgcgggtttcat

SEQ ID NO: 97912 - DNA, 20 bp, human
gcccgcaggtcgctctgggt

SEQ ID NO: 97913 - DNA, 20 bp, human
gaatcgccccatgaaacccg

SEQ ID NO: 97914 - DNA, 20 bp, human
gagaagaaggtgtagataca

SEQ ID NO: 97915 - DNA, 20 bp, human
ggcatcgtagggaatcggaa

SEQ ID NO: 97916 - DNA, 20 bp, human
gtgcctaggacaggtagtgt

SEQ ID NO: 97917 - DNA, 20 bp, human
ggagcagacagcgaccaaaa

SEQ ID NO: 97918 - DNA, 20 bp, human
gagacagcgaccaaaaaggt

SEQ ID NO: 97919 - DNA, 20 bp, human
gcccagtccaggcaggtata

SEQ ID NO: 97920 - DNA, 20 bp, human
gggtcgctgtctgctccaag

SEQ ID NO: 97921 - DNA, 20 bp, human
ggttcaaacctgcctaggac

SEQ ID NO: 97922 - DNA, 20 bp, human
gcccacctgggcttctgtag

SEQ ID NO: 97923 - DNA, 20 bp, human
gcgggccagggaagccctgg

SEQ ID NO: 97924 - DNA, 20 bp, human
gcagagctaccatgtcctct

SEQ ID NO: 97925 - DNA, 20 bp, human
gctggcgttcaaacctgcct

SEQ ID NO: 97926 - DNA, 20 bp, human
gctcaggagagccctctcgg

SEQ ID NO: 97927 - DNA, 20 bp, human
gcccaagcctctcaggagag

SEQ ID NO: 97928 - DNA, 20 bp, human
gaagatggcgacctccgaga

SEQ ID NO: 97929 - DNA, 20 bp, human
gtgcctaggagactgacccc

SEQ ID NO: 97930 - DNA, 20 bp, human
gagctgccgctgaagtaaca

SEQ ID NO: 97931 - DNA, 20 bp, human
ggaggcgagagagcctgaga

SEQ ID NO: 97932 - DNA, 20 bp, human
gaaaacggggtaaaagacag

SEQ ID NO: 97933 - DNA, 20 bp, human
gccatggggcagaagacgaa

SEQ ID NO: 97934 - DNA, 20 bp, human
ggcaaccccgctaaacaaga

SEQ ID NO: 97935 - DNA, 20 bp, human
gcgagtccagctcctgatag

SEQ ID NO: 97936 - DNA, 20 bp, human
gttgtcgtaggctctgaggg

SEQ ID NO: 97937 - DNA, 20 bp, human
gtcgcgcaccgcgcagaaac

SEQ ID NO: 97938 - DNA, 20 bp, human
gcgacagcgggctctcgaga

SEQ ID NO: 97939 - DNA, 20 bp, human
ggcaccgcgcagaaaccgga

SEQ ID NO: 97940 - DNA, 20 bp, human
ggacctcgtcccgaagcctg

SEQ ID NO: 97941 - DNA, 20 bp, human
gtctcagcgtagggctgtga

SEQ ID NO: 97942 - DNA, 20 bp, human
ggcctgggtggcgcactctg

SEQ ID NO: 97943 - DNA, 20 bp, human
ggctgtgtcaggctctaaag

SEQ ID NO: 97944 - DNA, 20 bp, human
ggcagaaaccggaaggctcc

SEQ ID NO: 97945 - DNA, 20 bp, human
gcgggaagcgcttgtctccg

SEQ ID NO: 97946 - DNA, 20 bp, human
ggccgctccggagcacccgg

SEQ ID NO: 97947 - DNA, 20 bp, human
gcccgccgggtgctccggag

SEQ ID NO: 97948 - DNA, 20 bp, human
gcgggccgctccggagcacc

SEQ ID NO: 97949 - DNA, 20 bp, human
gcagcaagcggctgattgtt

SEQ ID NO: 97950 - DNA, 20 bp, human
gccgccccaagttctctctg

SEQ ID NO: 97951 - DNA, 20 bp, human
gcgagtgccgctaccgacac

SEQ ID NO: 97952 - DNA, 20 bp, human
gcgcagcctcgggttccgca

SEQ ID NO: 97953 - DNA, 20 bp, human
gcgcggagcgcggagcctag

SEQ ID NO: 97954 - DNA, 20 bp, human
gggctctagactccgcaccg

SEQ ID NO: 97955 - DNA, 20 bp, human
ggattgttcggctgcgaggt

SEQ ID NO: 97956 - DNA, 20 bp, human
ggtcgacggcctgggacaca

SEQ ID NO: 97957 - DNA, 20 bp, human
gtgaaggctgtaccatctaa

SEQ ID NO: 97958 - DNA, 20 bp, human
gagcagacgcagcgcgacag

SEQ ID NO: 97959 - DNA, 20 bp, human
gcgctctactcacaggatag

SEQ ID NO: 97960 - DNA, 20 bp, human
gcgagctggagggcgctgtc

SEQ ID NO: 97961 - DNA, 20 bp, human
gttgcccgcaccgagctgga

SEQ ID NO: 97962 - DNA, 20 bp, human
gagcgcgacagcggggtcga

SEQ ID NO: 97963 - DNA, 20 bp, human
gcacaggatagcggtgtcgg

SEQ ID NO: 97964 - DNA, 20 bp, human
ggtggggaggggcggacgag

SEQ ID NO: 97965 - DNA, 20 bp, human
gcctgccccctgtagaggga

SEQ ID NO: 97966 - DNA, 20 bp, human
ggcgctggccggtcagacag

SEQ ID NO: 97967 - DNA, 20 bp, human
ggaactcgggcagccctctg

SEQ ID NO: 97968 - DNA, 20 bp, human
ggagcgacccaggacgggag

SEQ ID NO: 97969 - DNA, 20 bp, human
gcagccgagcgacccaggac

SEQ ID NO: 97970 - DNA, 20 bp, human
ggctcggcggctaccccaga

SEQ ID NO: 97971 - DNA, 20 bp, human
ggttgcagcttgagcagcgt

SEQ ID NO: 97972 - DNA, 20 bp, human
ggagcttcgggtagagacct

SEQ ID NO: 97973 - DNA, 20 bp, human
gactggctgcaggtagacca

SEQ ID NO: 97974 - DNA, 20 bp, human
gcgaggcagcggcaggtagt

SEQ ID NO: 97975 - DNA, 20 bp, human
gctggccggtcagacagcgg

SEQ ID NO: 97976 - DNA, 20 bp, human
gctggaccgctccgtcccac

SEQ ID NO: 97977 - DNA, 20 bp, human
gacacatgggcccgagggtg

SEQ ID NO: 97978 - DNA, 20 bp, human
gtctatacacatgggcccga

SEQ ID NO: 97979 - DNA, 20 bp, human
gaccaggtatctatacacat

SEQ ID NO: 97980 - DNA, 20 bp, human
gctagctggcaaagcaatgg

SEQ ID NO: 97981 - DNA, 20 bp, human
gtatccgatggcctcaggag

SEQ ID NO: 97982 - DNA, 20 bp, human
gcctggaggaggacttagga

SEQ ID NO: 97983 - DNA, 20 bp, human
gtgaggaccagggatcctat

SEQ ID NO: 97984 - DNA, 20 bp, human
gcaaggccaggtatggtacc

SEQ ID NO: 97985 - DNA, 20 bp, human
ggggggtgactctattcgag

SEQ ID NO: 97986 - DNA, 20 bp, human
gctcttcagaaaggttccca

SEQ ID NO: 97987 - DNA, 20 bp, human
gcagaaagaccagaactaac

SEQ ID NO: 97988 - DNA, 20 bp, human
gcctctgagcaagtgcatcc

SEQ ID NO: 97989 - DNA, 20 bp, human
gtctccttgggaaagatccc

SEQ ID NO: 97990 - DNA, 20 bp, human
ggctttaagataaacaacag

SEQ ID NO: 97991 - DNA, 20 bp, human
gagtggggtcaggctgatcc

SEQ ID NO: 97992 - DNA, 20 bp, human
gcaacaggggactgaaaagt

SEQ ID NO: 97993 - DNA, 20 bp, human
gttgcttgaactcttcagaa

SEQ ID NO: 97994 - DNA, 20 bp, human
gcagatgttagagggttatg

SEQ ID NO: 97995 - DNA, 20 bp, human
gctgctggccagatgttaga

SEQ ID NO: 97996 - DNA, 20 bp, human
ggattatagaaaggctaaga

SEQ ID NO: 97997 - DNA, 20 bp, human
gctaagagggcaggctgaac

SEQ ID NO: 97998 - DNA, 20 bp, human
gattatcacggcagaaatga

SEQ ID NO: 97999 - DNA, 20 bp, human
gtttctgccgtgataatcac

SEQ ID NO: 98000 - DNA, 20 bp, human
gcactccttccaaaaagcta

SEQ ID NO: 98001 - DNA, 20 bp, human
gttgtccttagctttttgga

SEQ ID NO: 98002 - DNA, 20 bp, human
gctcaaaacgaaaacagtga

SEQ ID NO: 98003 - DNA, 20 bp, human
gacggcagaaatgacggctc

SEQ ID NO: 98004 - DNA, 20 bp, human
ggatgcattgctccttttag

SEQ ID NO: 98005 - DNA, 20 bp, human
gcaaaggcctctcaaggtat

SEQ ID NO: 98006 - DNA, 20 bp, human
gctgagggtggacaaaaact

SEQ ID NO: 98007 - DNA, 20 bp, human
gagtggctaggtgcatgcat

SEQ ID NO: 98008 - DNA, 20 bp, human
ggtgctggattgtagcagtg

SEQ ID NO: 98009 - DNA, 20 bp, human
gtagtcctatgccccgcctg

SEQ ID NO: 98010 - DNA, 20 bp, human
gactatccatgtccagggta

SEQ ID NO: 98011 - DNA, 20 bp, human
gaccgctgtagaaatagctc

SEQ ID NO: 98012 - DNA, 20 bp, human
gcagtgagcagaggaagtaa

SEQ ID NO: 98013 - DNA, 20 bp, human
ggaattatcgaacacttgcc

SEQ ID NO: 98014 - DNA, 20 bp, human
gtcgatccttaccctggaca

SEQ ID NO: 98015 - DNA, 20 bp, human
ggggggagttgtaagagagg

SEQ ID NO: 98016 - DNA, 20 bp, human
ggctccaggcccatgcactg

SEQ ID NO: 98017 - DNA, 20 bp, human
gactgaggaggcggaaacaa

SEQ ID NO: 98018 - DNA, 20 bp, human
gacttcagtccggggaacag

SEQ ID NO: 98019 - DNA, 20 bp, human
gcatccgtatgcaggagtgg

SEQ ID NO: 98020 - DNA, 20 bp, human
ggggcttgatggagctctgg

SEQ ID NO: 98021 - DNA, 20 bp, human
gcggaggcggctccgagatg

SEQ ID NO: 98022 - DNA, 20 bp, human
gttcaccccccccagttggg

SEQ ID NO: 98023 - DNA, 20 bp, human
gcttcggcaaagcgcaccag

SEQ ID NO: 98024 - DNA, 20 bp, human
ggctggactgggataacaaa

SEQ ID NO: 98025 - DNA, 20 bp, human
gggggaccccccaactgggg

SEQ ID NO: 98026 - DNA, 20 bp, human
gcagccagcggagcgcgaca

SEQ ID NO: 98027 - DNA, 20 bp, human
ggagcgcgacagggaagcgg

SEQ ID NO: 98028 - DNA, 20 bp, human
gggtagaccacagaagctcc

SEQ ID NO: 98029 - DNA, 20 bp, human
gggctccgccgcgaccccat

SEQ ID NO: 98030 - DNA, 20 bp, human
gccctggtgccgcctcccca

SEQ ID NO: 98031 - DNA, 20 bp, human
gccgggagagaagagtgcgg

SEQ ID NO: 98032 - DNA, 20 bp, human
gctgtccagaggtgccggaa

SEQ ID NO: 98033 - DNA, 20 bp, human
ggcggagcgcgacagggaag

SEQ ID NO: 98034 - DNA, 20 bp, human
gagaagctccgggacccttc

SEQ ID NO: 98035 - DNA, 20 bp, human
ggccccagtgccgagacccg

SEQ ID NO: 98036 - DNA, 20 bp, human
ggcgctgggtggcgacgagt

SEQ ID NO: 98037 - DNA, 20 bp, human
gccatggcgacgagagccaa

SEQ ID NO: 98038 - DNA, 20 bp, human
gctggtgctgatcaacgccg

SEQ ID NO: 98039 - DNA, 20 bp, human
ggcgcgtgcagttcggacag

SEQ ID NO: 98040 - DNA, 20 bp, human
gcgcgcagcgccccgtgacg

SEQ ID NO: 98041 - DNA, 20 bp, human
ggcagcgccccgtgacgcgg

SEQ ID NO: 98042 - DNA, 20 bp, human
gaccaggtgtgtgcgaacag

SEQ ID NO: 98043 - DNA, 20 bp, human
gagccaagggcagcgagccg

SEQ ID NO: 98044 - DNA, 20 bp, human
gagggcagcgagccgaggcg

SEQ ID NO: 98045 - DNA, 20 bp, human
gcgcaccaaggactccctgg

SEQ ID NO: 98046 - DNA, 20 bp, human
ggcgccagcgcgagacgaga

SEQ ID NO: 98047 - DNA, 20 bp, human
gcgctcagtctggcgagtgg

SEQ ID NO: 98048 - DNA, 20 bp, human
gccagcgcgagacgagaggg

SEQ ID NO: 98049 - DNA, 20 bp, human
ggatgggcgcgcgctcagtc

SEQ ID NO: 98050 - DNA, 20 bp, human
ggcgcgctcagtctggcgag

SEQ ID NO: 98051 - DNA, 20 bp, human
ggcaacgcagacctccaccg

SEQ ID NO: 98052 - DNA, 20 bp, human
gtctccgcgggagtctccag

SEQ ID NO: 98053 - DNA, 20 bp, human
ggattgccgatcgcacggat

SEQ ID NO: 98054 - DNA, 20 bp, human
ggcgcgagacgagagggtgg

SEQ ID NO: 98055 - DNA, 20 bp, human
gaccctcgggtggtggagag

SEQ ID NO: 98056 - DNA, 20 bp, human
gcgcgcgtgcgggagagagg

SEQ ID NO: 98057 - DNA, 20 bp, human
gtgcgctggagactgctcgg

SEQ ID NO: 98058 - DNA, 20 bp, human
gcaggcaggagaaggctgac

SEQ ID NO: 98059 - DNA, 20 bp, human
ggtgcgctggccctgtgcgg

SEQ ID NO: 98060 - DNA, 20 bp, human
gcggtggtcacccggtcccg

SEQ ID NO: 98061 - DNA, 20 bp, human
gcttggagcctggaatcgag

SEQ ID NO: 98062 - DNA, 20 bp, human
gacattgtggtcgcccggta

SEQ ID NO: 98063 - DNA, 20 bp, human
gtgaccgtgggagccgaccg

SEQ ID NO: 98064 - DNA, 20 bp, human
gagtaaggcgaggagaaact

SEQ ID NO: 98065 - DNA, 20 bp, human
gtggagggatgcgcgcgtgc

SEQ ID NO: 98066 - DNA, 20 bp, human
gtcgctcgccaggaactgag

SEQ ID NO: 98067 - DNA, 20 bp, human
gcgcgcgtagcacaccgcac

SEQ ID NO: 98068 - DNA, 20 bp, human
gaaggagcgttcgctagcag

SEQ ID NO: 98069 - DNA, 20 bp, human
ggttcctggcgagcgaagag

SEQ ID NO: 98070 - DNA, 20 bp, human
ggcgctgtcaccgaaactgg

SEQ ID NO: 98071 - DNA, 20 bp, human
gcgggatgcctcgggcgtgg

SEQ ID NO: 98072 - DNA, 20 bp, human
gacaaagacagggtctccgt

SEQ ID NO: 98073 - DNA, 20 bp, human
gcacctccgccagctcctag

SEQ ID NO: 98074 - DNA, 20 bp, human
ggcctcgccgttccttcccc

SEQ ID NO: 98075 - DNA, 20 bp, human
ggcccagccagagcctctcg

SEQ ID NO: 98076 - DNA, 20 bp, human
ggcagcagcgcagtgcacag

SEQ ID NO: 98077 - DNA, 20 bp, human
ggacgcttagggagagtcta

SEQ ID NO: 98078 - DNA, 20 bp, human
ggcgactgcgcgcgaggtaa

SEQ ID NO: 98079 - DNA, 20 bp, human
gcccgagggcccctccacaa

SEQ ID NO: 98080 - DNA, 20 bp, human
gagtgcacagcggcttctga

SEQ ID NO: 98081 - DNA, 20 bp, human
gtctgaaggcggcgtcgacg

SEQ ID NO: 98082 - DNA, 20 bp, human
gcggcgagcgcgaactcgag

SEQ ID NO: 98083 - DNA, 20 bp, human
gcttcacctcccgggttggg

SEQ ID NO: 98084 - DNA, 20 bp, human
gggaatcactaaaaatgtag

SEQ ID NO: 98085 - DNA, 20 bp, human
gcacccgcggggccggacag

SEQ ID NO: 98086 - DNA, 20 bp, human
gccgccggtagagcgtccgt

SEQ ID NO: 98087 - DNA, 20 bp, human
gagacccacggacgctctac

SEQ ID NO: 98088 - DNA, 20 bp, human
gctaccggcggcacccggcc

SEQ ID NO: 98089 - DNA, 20 bp, human
gggcgtcacgggccctgcgg

SEQ ID NO: 98090 - DNA, 20 bp, human
ggtggcggtgcaggcccgta

SEQ ID NO: 98091 - DNA, 20 bp, human
gagggcgcgcgcggccacat

SEQ ID NO: 98092 - DNA, 20 bp, human
gcgtgacgccgcggccgatg

SEQ ID NO: 98093 - DNA, 20 bp, human
gacgacggccagctgcgccc

SEQ ID NO: 98094 - DNA, 20 bp, human
gagctggccgtcgtctgtct

SEQ ID NO: 98095 - DNA, 20 bp, human
gacgctctaccggcggcacc

SEQ ID NO: 98096 - DNA, 20 bp, human
ggtccgagcgggggcatcag

SEQ ID NO: 98097 - DNA, 20 bp, human
ggctccagcagtccgagcgg

SEQ ID NO: 98098 - DNA, 20 bp, human
ggcgtcggctctggcagcac

SEQ ID NO: 98099 - DNA, 20 bp, human
gccggctccagcagtccgag

SEQ ID NO: 98100 - DNA, 20 bp, human
gggcggggcagcgtcggctc

SEQ ID NO: 98101 - DNA, 20 bp, human
gcgagcgggggcatcagcgg

SEQ ID NO: 98102 - DNA, 20 bp, human
gaagcgtcccgggtgcacgg

SEQ ID NO: 98103 - DNA, 20 bp, human
ggggccacggctaggagcga

SEQ ID NO: 98104 - DNA, 20 bp, human
gcctgcagcggccggaccca

SEQ ID NO: 98105 - DNA, 20 bp, human
gtcccctggcggggcagcgt

SEQ ID NO: 98106 - DNA, 20 bp, human
ggcgcccgctccgccaggtg

SEQ ID NO: 98107 - DNA, 20 bp, human
gtcactcgggctccatggcg

SEQ ID NO: 98108 - DNA, 20 bp, human
ggggctccatggcgcggcgg

SEQ ID NO: 98109 - DNA, 20 bp, human
gtggtccgcggcgcccgagg

SEQ ID NO: 98110 - DNA, 20 bp, human
gcaagtcgcttccgagacgg

SEQ ID NO: 98111 - DNA, 20 bp, human
gtcggctcccggcttcccgc

SEQ ID NO: 98112 - DNA, 20 bp, human
gcgtcccgggctggcgagga

SEQ ID NO: 98113 - DNA, 20 bp, human
gggcccgggtggggagacaa

SEQ ID NO: 98114 - DNA, 20 bp, human
gctgcctccatgttgtccgg

SEQ ID NO: 98115 - DNA, 20 bp, human
gagcgcggcgcgggcccgtc

SEQ ID NO: 98116 - DNA, 20 bp, human
gtggtccgcggcgcccaacg

SEQ ID NO: 98117 - DNA, 20 bp, human
gctcgggctccacagcgcgg

SEQ ID NO: 98118 - DNA, 20 bp, human
gcgtcccgggccggtgagga

SEQ ID NO: 98119 - DNA, 20 bp, human
gccgcgggctgctagtacaa

SEQ ID NO: 98120 - DNA, 20 bp, human
gagatgcagggacacgcgcg

SEQ ID NO: 98121 - DNA, 20 bp, human
ggggctccacagcgcggcgg

SEQ ID NO: 98122 - DNA, 20 bp, human
gccgggccgggcaccaagtt

SEQ ID NO: 98123 - DNA, 20 bp, human
gctcacctgcccgcgcccgt

SEQ ID NO: 98124 - DNA, 20 bp, human
gcgggcaggtgaggaccggc

SEQ ID NO: 98125 - DNA, 20 bp, human
ggccgcgtcccgggccggtg

SEQ ID NO: 98126 - DNA, 20 bp, human
gagcggcgcagggatacggt

SEQ ID NO: 98127 - DNA, 20 bp, human
gtgaatgaggagctgcgcgg

SEQ ID NO: 98128 - DNA, 20 bp, human
ggcgaggggtggccagaagt

SEQ ID NO: 98129 - DNA, 20 bp, human
gtcgcggcgaccctaggagg

SEQ ID NO: 98130 - DNA, 20 bp, human
gacgcgagaagggaagatgg

SEQ ID NO: 98131 - DNA, 20 bp, human
ggcgggatggaagcagacgc

SEQ ID NO: 98132 - DNA, 20 bp, human
gtcctgagaggtgggaagag

SEQ ID NO: 98133 - DNA, 20 bp, human
gccgagcggcgcggtagaga

SEQ ID NO: 98134 - DNA, 20 bp, human
gctgtgtgctcctgagaggt

SEQ ID NO: 98135 - DNA, 20 bp, human
gcagcctctgcctcgcgcag

SEQ ID NO: 98136 - DNA, 20 bp, human
ggcagagccgagtcagagac

SEQ ID NO: 98137 - DNA, 20 bp, human
gcagaacccggggctatcgg

SEQ ID NO: 98138 - DNA, 20 bp, human
gggacaggctccacgcgaag

SEQ ID NO: 98139 - DNA, 20 bp, human
gggcagagccctcaacaccg

SEQ ID NO: 98140 - DNA, 20 bp, human
gcggcgccgcggcaaggact

SEQ ID NO: 98141 - DNA, 20 bp, human
gtctgggcagcggatcttgg

SEQ ID NO: 98142 - DNA, 20 bp, human
ggtgcagccggtctctgact

SEQ ID NO: 98143 - DNA, 20 bp, human
ggccctccgagtccttgccg

SEQ ID NO: 98144 - DNA, 20 bp, human
gcagcgccagaagccggaga

SEQ ID NO: 98145 - DNA, 20 bp, human
gcggggaggggtccagaacc

SEQ ID NO: 98146 - DNA, 20 bp, human
ggaaacgacctgaccctccg

SEQ ID NO: 98147 - DNA, 20 bp, human
gcgcgcagcgccagtcgcag

SEQ ID NO: 98148 - DNA, 20 bp, human
gcgccagtcgcagaggaaga

SEQ ID NO: 98149 - DNA, 20 bp, human
gcgacgccgtgtgaagcagg

SEQ ID NO: 98150 - DNA, 20 bp, human
gggaggctgtgccaaggaca

SEQ ID NO: 98151 - DNA, 20 bp, human
gagggcgacactgaccctcg

SEQ ID NO: 98152 - DNA, 20 bp, human
gctcccccaagtgtcaggtg

SEQ ID NO: 98153 - DNA, 20 bp, human
ggtggcggccggcaccccga

SEQ ID NO: 98154 - DNA, 20 bp, human
gggcctgctgacccgagcgt

SEQ ID NO: 98155 - DNA, 20 bp, human
gggcccgctgcgagccacgg

SEQ ID NO: 98156 - DNA, 20 bp, human
gcagggtcccccggggtcgt

SEQ ID NO: 98157 - DNA, 20 bp, human
ggcgcgagcggcgggcagat

SEQ ID NO: 98158 - DNA, 20 bp, human
gcaacgcgcggatctcagca

SEQ ID NO: 98159 - DNA, 20 bp, human
gcccgagggcagtaaggtcc

SEQ ID NO: 98160 - DNA, 20 bp, human
gaagcgccttcagaaggtca

SEQ ID NO: 98161 - DNA, 20 bp, human
gtgcggggacgttcgagcaa

SEQ ID NO: 98162 - DNA, 20 bp, human
gtggtcaacgaagatgaggg

SEQ ID NO: 98163 - DNA, 20 bp, human
gttgaccatgggtaccccga

SEQ ID NO: 98164 - DNA, 20 bp, human
gcgagcggcgggcagatagg

SEQ ID NO: 98165 - DNA, 20 bp, human
gcacgctccgccagaaggac

SEQ ID NO: 98166 - DNA, 20 bp, human
gtgcgcgaggaccccgatgg

SEQ ID NO: 98167 - DNA, 20 bp, human
ggaagacgcacaggaccctg

SEQ ID NO: 98168 - DNA, 20 bp, human
ggcgtgcgcgaggaccccga

SEQ ID NO: 98169 - DNA, 20 bp, human
gcaacaggcaggcagatcag

SEQ ID NO: 98170 - DNA, 20 bp, human
gtgagcaggaaggctcggac

SEQ ID NO: 98171 - DNA, 20 bp, human
gctggggtcgggctgatggt

SEQ ID NO: 98172 - DNA, 20 bp, human
ggagatgaagctacactgtg

SEQ ID NO: 98173 - DNA, 20 bp, human
gggtcctgtgcgtcttccta

SEQ ID NO: 98174 - DNA, 20 bp, human
gggccacaaccacgtcaagc

SEQ ID NO: 98175 - DNA, 20 bp, human
ggcaggaaggctcggaccgg

SEQ ID NO: 98176 - DNA, 20 bp, human
ggaggccggacccttacctc

SEQ ID NO: 98177 - DNA, 20 bp, human
gctccaggctccgggcatag

SEQ ID NO: 98178 - DNA, 20 bp, human
gccgcgagctgcccgaggta

SEQ ID NO: 98179 - DNA, 20 bp, human
ggaagggacagcagacgagc

SEQ ID NO: 98180 - DNA, 20 bp, human
gcgcctagccgggtcccgag

SEQ ID NO: 98181 - DNA, 20 bp, human
ggacgtagaccagcgagcag

SEQ ID NO: 98182 - DNA, 20 bp, human
ggagagggcagcggactgag

SEQ ID NO: 98183 - DNA, 20 bp, human
gccgcgcggcggctgcgagt

SEQ ID NO: 98184 - DNA, 20 bp, human
ggcatagcggtagatctcct

SEQ ID NO: 98185 - DNA, 20 bp, human
gagtaggaagctccgcgcgg

SEQ ID NO: 98186 - DNA, 20 bp, human
gaatgaaaaaaggttgataa

SEQ ID NO: 98187 - DNA, 20 bp, human
gatccccaagttataatggg

SEQ ID NO: 98188 - DNA, 20 bp, human
ggatggtgttccccatgcgg

SEQ ID NO: 98189 - DNA, 20 bp, human
ggcagggatgaaggccacga

SEQ ID NO: 98190 - DNA, 20 bp, human
gttccccatgcggaggctgg

SEQ ID NO: 98191 - DNA, 20 bp, human
gatgcccccagcctccgcat

SEQ ID NO: 98192 - DNA, 20 bp, human
ggtagctgccccagctccgg

SEQ ID NO: 98193 - DNA, 20 bp, human
gtcaaggtgcacaccacctg

SEQ ID NO: 98194 - DNA, 20 bp, human
gcggaggcaggctattgagg

SEQ ID NO: 98195 - DNA, 20 bp, human
gcaacggtcagcagggatga

SEQ ID NO: 98196 - DNA, 20 bp, human
gctagccagtcggcctccgg

SEQ ID NO: 98197 - DNA, 20 bp, human
gcggcggcggtgccccaagt

SEQ ID NO: 98198 - DNA, 20 bp, human
gcctccggcggaggcaacgg

SEQ ID NO: 98199 - DNA, 20 bp, human
ggccagtcggcctccggcgg

SEQ ID NO: 98200 - DNA, 20 bp, human
gaccctagccagtcggcctc

SEQ ID NO: 98201 - DNA, 20 bp, human
gcggcctccggcggaggcaa

SEQ ID NO: 98202 - DNA, 20 bp, human
gccggcggaggcaacggggg

SEQ ID NO: 98203 - DNA, 20 bp, human
gaggcaacgggggaggcccg

SEQ ID NO: 98204 - DNA, 20 bp, human
gcagaggagcagctgcgcag

SEQ ID NO: 98205 - DNA, 20 bp, human
gccgggaggaggcacccact

SEQ ID NO: 98206 - DNA, 20 bp, human
gcagacggcctgcccaccaa

SEQ ID NO: 98207 - DNA, 20 bp, human
gggtgcctgcctcccttggt

SEQ ID NO: 98208 - DNA, 20 bp, human
gcccggccgcccgcgctcac

SEQ ID NO: 98209 - DNA, 20 bp, human
ggtggctgcggttgcgggac

SEQ ID NO: 98210 - DNA, 20 bp, human
gccggccgcagggaacgcga

SEQ ID NO: 98211 - DNA, 20 bp, human
ggagcggcggacggtctagg

SEQ ID NO: 98212 - DNA, 20 bp, human
gttgcgggaccggtgagcgc

SEQ ID NO: 98213 - DNA, 20 bp, human
gcgcgaaacgcaggcgaccg

SEQ ID NO: 98214 - DNA, 20 bp, human
gcgctcgggaggcgaaagag

SEQ ID NO: 98215 - DNA, 20 bp, human
gggagacgcatccgacctgg

SEQ ID NO: 98216 - DNA, 20 bp, human
gccggaccctcggcgaagag

SEQ ID NO: 98217 - DNA, 20 bp, human
gtgactgcggcccggaacag

SEQ ID NO: 98218 - DNA, 20 bp, human
gaggagccggaagggcacgc

SEQ ID NO: 98219 - DNA, 20 bp, human
gcggcgccggcgacagatca

SEQ ID NO: 98220 - DNA, 20 bp, human
gggacactcggcatccgaca

SEQ ID NO: 98221 - DNA, 20 bp, human
gggacgcgttgaccaggagc

SEQ ID NO: 98222 - DNA, 20 bp, human
gagtgcgaggcctccaacgc

SEQ ID NO: 98223 - DNA, 20 bp, human
gttcgccgagggtccggcgg

SEQ ID NO: 98224 - DNA, 20 bp, human
gtccaagccgctcttcgccg

SEQ ID NO: 98225 - DNA, 20 bp, human
gctgccgggacgcgttgacc

SEQ ID NO: 98226 - DNA, 20 bp, human
ggcccagcgccctcccgcac

SEQ ID NO: 98227 - DNA, 20 bp, human
gccctcagtgacgaagaggt

SEQ ID NO: 98228 - DNA, 20 bp, human
ggctgtccgcccggaacgag

SEQ ID NO: 98229 - DNA, 20 bp, human
ggtcggcgaggacctcgacg

SEQ ID NO: 98230 - DNA, 20 bp, human
gagctaaagataggcgtgaa

SEQ ID NO: 98231 - DNA, 20 bp, human
gcagcggtgcccgtgcggga

SEQ ID NO: 98232 - DNA, 20 bp, human
gcgccttggggaaagtcgtg

SEQ ID NO: 98233 - DNA, 20 bp, human
gtggggagcggtcctgtctc

SEQ ID NO: 98234 - DNA, 20 bp, human
gtctgtcgcgcaggtcctgg

SEQ ID NO: 98235 - DNA, 20 bp, human
gtcgggccatggacacaatg

SEQ ID NO: 98236 - DNA, 20 bp, human
gcaagagggagcctgagagg

SEQ ID NO: 98237 - DNA, 20 bp, human
gcaaggctgcagcatgagtg

SEQ ID NO: 98238 - DNA, 20 bp, human
gcgtccctcgtcctcctctc

SEQ ID NO: 98239 - DNA, 20 bp, human
ggaggacgagggacggctca

SEQ ID NO: 98240 - DNA, 20 bp, human
gcccgcccgccgtggacaag

SEQ ID NO: 98241 - DNA, 20 bp, human
gtcaggctccctcttgtcca

SEQ ID NO: 98242 - DNA, 20 bp, human
gtggaatctagatccactgg

SEQ ID NO: 98243 - DNA, 20 bp, human
gtggctcgcctaagctgtcc

SEQ ID NO: 98244 - DNA, 20 bp, human
gctgtcccgagagcatcccc

SEQ ID NO: 98245 - DNA, 20 bp, human
ggctccctcttgtccacggc

SEQ ID NO: 98246 - DNA, 20 bp, human
gtaggtgcggcgcggaggct

SEQ ID NO: 98247 - DNA, 20 bp, human
gagaggtgaggagtacgcag

SEQ ID NO: 98248 - DNA, 20 bp, human
ggcgccgcacctacagccct

SEQ ID NO: 98249 - DNA, 20 bp, human
gtacagggcaaccatgaccg

SEQ ID NO: 98250 - DNA, 20 bp, human
gcgccttccgctttcaccta

SEQ ID NO: 98251 - DNA, 20 bp, human
gctacagccctaggtgaaag

SEQ ID NO: 98252 - DNA, 20 bp, human
gggctgggcgggagctacgc

SEQ ID NO: 98253 - DNA, 20 bp, human
gacgttcccagggagttgat

SEQ ID NO: 98254 - DNA, 20 bp, human
gccggcggctgaataaggag

SEQ ID NO: 98255 - DNA, 20 bp, human
gagccctaggtgaaagcgga

SEQ ID NO: 98256 - DNA, 20 bp, human
gacgccgagagtcagcccca

SEQ ID NO: 98257 - DNA, 20 bp, human
gccgcggcacatgctagacc

SEQ ID NO: 98258 - DNA, 20 bp, human
gtcagccccagggagcgcca

SEQ ID NO: 98259 - DNA, 20 bp, human
gccgagcccgctccggtcag

SEQ ID NO: 98260 - DNA, 20 bp, human
gagcccgctccggtcagggg

SEQ ID NO: 98261 - DNA, 20 bp, human
gcagccgcccctgaccggag

SEQ ID NO: 98262 - DNA, 20 bp, human
gtggacgcttcgccgagggt

SEQ ID NO: 98263 - DNA, 20 bp, human
gaagcggggactctccggat

SEQ ID NO: 98264 - DNA, 20 bp, human
gagttccctggcgctccctg

SEQ ID NO: 98265 - DNA, 20 bp, human
gctgtcaccgaagggcggga

SEQ ID NO: 98266 - DNA, 20 bp, human
gcagcattagtataacgtga

SEQ ID NO: 98267 - DNA, 20 bp, human
ggagactacagtgttatata

SEQ ID NO: 98268 - DNA, 20 bp, human
ggcctgaaaagacaaaagag

SEQ ID NO: 98269 - DNA, 20 bp, human
gtcacttgaaatgtattaca

SEQ ID NO: 98270 - DNA, 20 bp, human
ggaagactgaaagacaaacc

SEQ ID NO: 98271 - DNA, 20 bp, human
ggcagacggttcacagacaa

SEQ ID NO: 98272 - DNA, 20 bp, human
gaccgcagcacacttttcag

SEQ ID NO: 98273 - DNA, 20 bp, human
gacctctgaaaagtgtgctg

SEQ ID NO: 98274 - DNA, 20 bp, human
gctctctacctgttaattaa

SEQ ID NO: 98275 - DNA, 20 bp, human
ggttatactaatgctgtgca

SEQ ID NO: 98276 - DNA, 20 bp, human
gggagaagctgggactagca

SEQ ID NO: 98277 - DNA, 20 bp, human
gcagctagctagggcacagt

SEQ ID NO: 98278 - DNA, 20 bp, human
gcctgagccccagtcaggaa

SEQ ID NO: 98279 - DNA, 20 bp, human
gcttagaggggtgactggtc

SEQ ID NO: 98280 - DNA, 20 bp, human
gcagttgaggaggagaagct

SEQ ID NO: 98281 - DNA, 20 bp, human
gtgctgctctacaggctagg

SEQ ID NO: 98282 - DNA, 20 bp, human
gagagatccaagcagttgtt

SEQ ID NO: 98283 - DNA, 20 bp, human
ggcacagtgggcatcctcgg

SEQ ID NO: 98284 - DNA, 20 bp, human
gcagcttagtttccttagag

SEQ ID NO: 98285 - DNA, 20 bp, human
gagctgcttactcaaaggag

SEQ ID NO: 98286 - DNA, 20 bp, human
gtacctgagacatggccaaa

SEQ ID NO: 98287 - DNA, 20 bp, human
gtctaagacttgtgtgctaa

SEQ ID NO: 98288 - DNA, 20 bp, human
gcactaatctaaaagccaat

SEQ ID NO: 98289 - DNA, 20 bp, human
gttgtattctaactttattt

SEQ ID NO: 98290 - DNA, 20 bp, human
gtaagtaattgttttgcggg

SEQ ID NO: 98291 - DNA, 20 bp, human
ggtaattgttttgcgggggg

SEQ ID NO: 98292 - DNA, 20 bp, human
gatatgattatattttcaca

SEQ ID NO: 98293 - DNA, 20 bp, human
gtactaagtaattgttttgc

SEQ ID NO: 98294 - DNA, 20 bp, human
ggaaattaactctgtttcaa

SEQ ID NO: 98295 - DNA, 20 bp, human
ggaccctttggccatgtctc

SEQ ID NO: 98296 - DNA, 20 bp, human
ggccggagcagtacgcgcag

SEQ ID NO: 98297 - DNA, 20 bp, human
ggttagcgcacaggcacggg

SEQ ID NO: 98298 - DNA, 20 bp, human
ggcaggtcaccaaggcacag

SEQ ID NO: 98299 - DNA, 20 bp, human
gagtcctggcctgcccgccg

SEQ ID NO: 98300 - DNA, 20 bp, human
ggggcgggcactgacagtcc

SEQ ID NO: 98301 - DNA, 20 bp, human
gtatggtgggaaggcgagaa

SEQ ID NO: 98302 - DNA, 20 bp, human
gcgagaaaggagagagcgtg

SEQ ID NO: 98303 - DNA, 20 bp, human
gcaatctgccggagcgacag

SEQ ID NO: 98304 - DNA, 20 bp, human
ggaaaggagagagcgtgggg

SEQ ID NO: 98305 - DNA, 20 bp, human
gccgcgagtgaatcttgctc

SEQ ID NO: 98306 - DNA, 20 bp, human
gcagcagcctctccaagcaa

SEQ ID NO: 98307 - DNA, 20 bp, human
gcgctgcgcagggcgctagg

SEQ ID NO: 98308 - DNA, 20 bp, human
ggaggcgcccttgcttggag

SEQ ID NO: 98309 - DNA, 20 bp, human
gccggctcggaactcgcctg

SEQ ID NO: 98310 - DNA, 20 bp, human
gacccggtggaaaagagcag

SEQ ID NO: 98311 - DNA, 20 bp, human
ggaggaatggaggcccgcct

SEQ ID NO: 98312 - DNA, 20 bp, human
gcgcctcccgcgaggaatgg

SEQ ID NO: 98313 - DNA, 20 bp, human
gagcagcggtgcaccagcgg

SEQ ID NO: 98314 - DNA, 20 bp, human
gaagagcagcggtgcaccag

SEQ ID NO: 98315 - DNA, 20 bp, human
ggcagaggtgccagggaata

SEQ ID NO: 98316 - DNA, 20 bp, human
ggccaccgttgagagtagag

SEQ ID NO: 98317 - DNA, 20 bp, human
gagaggaggaggaattggta

SEQ ID NO: 98318 - DNA, 20 bp, human
ggtcgccgctctactctcaa

SEQ ID NO: 98319 - DNA, 20 bp, human
gctgatgcgcaaatcagccg

SEQ ID NO: 98320 - DNA, 20 bp, human
gggaaagtggcgtggtaacc

SEQ ID NO: 98321 - DNA, 20 bp, human
gcgtcccgggaacccggatg

SEQ ID NO: 98322 - DNA, 20 bp, human
gtactgatcaatcccctccc

SEQ ID NO: 98323 - DNA, 20 bp, human
gtggagagcatggcttaagg

SEQ ID NO: 98324 - DNA, 20 bp, human
gatgcgcaaatcagccgggg

SEQ ID NO: 98325 - DNA, 20 bp, human
ggccgctctactctcaacgg

SEQ ID NO: 98326 - DNA, 20 bp, human
gctgcgcccgaggcagacac

SEQ ID NO: 98327 - DNA, 20 bp, human
gccctcacctgacgctcccg

SEQ ID NO: 98328 - DNA, 20 bp, human
ggaggcagtgacagtcgtcg

SEQ ID NO: 98329 - DNA, 20 bp, human
gccccacgcctggtgacctt

SEQ ID NO: 98330 - DNA, 20 bp, human
gacgcctggtgaccttgggt

SEQ ID NO: 98331 - DNA, 20 bp, human
gcggctctcgtgggtagcag

SEQ ID NO: 98332 - DNA, 20 bp, human
gcccagcccggcgactgctc

SEQ ID NO: 98333 - DNA, 20 bp, human
gaaaatcaaccggctctcgt

SEQ ID NO: 98334 - DNA, 20 bp, human
gccgggcccgagcagtcgcc

SEQ ID NO: 98335 - DNA, 20 bp, human
gtcgagacgtcaggcactgg

SEQ ID NO: 98336 - DNA, 20 bp, human
gctgcacccagcgactcagg

SEQ ID NO: 98337 - DNA, 20 bp, human
gaaaggaggcgaccagactg

SEQ ID NO: 98338 - DNA, 20 bp, human
ggtcccgtcctggccaacga

SEQ ID NO: 98339 - DNA, 20 bp, human
ggcagcccaccagccaaagg

SEQ ID NO: 98340 - DNA, 20 bp, human
gagcgaccccagcagcgctg

SEQ ID NO: 98341 - DNA, 20 bp, human
gctggacacgggggccgcag

SEQ ID NO: 98342 - DNA, 20 bp, human
gaccgtccgcagcgctgctg

SEQ ID NO: 98343 - DNA, 20 bp, human
gggaaggcgaggaggagatc

SEQ ID NO: 98344 - DNA, 20 bp, human
gaccccagcagcgctgcgga

SEQ ID NO: 98345 - DNA, 20 bp, human
gggaagaggaactggtgtct

SEQ ID NO: 98346 - DNA, 20 bp, human
gacgggctccagggacgcac

SEQ ID NO: 98347 - DNA, 20 bp, human
gccgcggacgacgggctcca

SEQ ID NO: 98348 - DNA, 20 bp, human
ggtgcaggcgccgcaggaac

SEQ ID NO: 98349 - DNA, 20 bp, human
gaccaggaagggccccgcat

SEQ ID NO: 98350 - DNA, 20 bp, human
ggcgctgcgcaacctctcat

SEQ ID NO: 98351 - DNA, 20 bp, human
gaacgggctccgcggacgac

SEQ ID NO: 98352 - DNA, 20 bp, human
gcctggacctgcgcgagaac

SEQ ID NO: 98353 - DNA, 20 bp, human
gcctgtctgggcccaggtgt

SEQ ID NO: 98354 - DNA, 20 bp, human
gccgaggccgcgaccaggaa

SEQ ID NO: 98355 - DNA, 20 bp, human
gcacacctcggggcagtccg

SEQ ID NO: 98356 - DNA, 20 bp, human
ggagagcagcagcccgacaa

SEQ ID NO: 98357 - DNA, 20 bp, human
gctgggtggcctccattgtc

SEQ ID NO: 98358 - DNA, 20 bp, human
gggacgcggcaggtgagacg

SEQ ID NO: 98359 - DNA, 20 bp, human
gctgggccctgtgtgagtcc

SEQ ID NO: 98360 - DNA, 20 bp, human
gcgcctgcgggattccgtac

SEQ ID NO: 98361 - DNA, 20 bp, human
gggctcgccagcgcttcagt

SEQ ID NO: 98362 - DNA, 20 bp, human
ggccgcgatgctgaccgcaa

SEQ ID NO: 98363 - DNA, 20 bp, human
ggtctccatggcgaccgcgt

SEQ ID NO: 98364 - DNA, 20 bp, human
gcaggcagcgcaggctccgt

SEQ ID NO: 98365 - DNA, 20 bp, human
gcgccatggagacgccggta

SEQ ID NO: 98366 - DNA, 20 bp, human
gcagctgtggtaacaaacac

SEQ ID NO: 98367 - DNA, 20 bp, human
gggcgctggaagccaagcgg

SEQ ID NO: 98368 - DNA, 20 bp, human
gcagcgctccggagcgcaag

SEQ ID NO: 98369 - DNA, 20 bp, human
gccgcgggccgcagagtggg

SEQ ID NO: 98370 - DNA, 20 bp, human
gagcggcgctggaagccaag

SEQ ID NO: 98371 - DNA, 20 bp, human
gcctcgtcgggtgattcaag

SEQ ID NO: 98372 - DNA, 20 bp, human
gcggcagctgtggccacccg

SEQ ID NO: 98373 - DNA, 20 bp, human
gctggaagccaagcggggga

SEQ ID NO: 98374 - DNA, 20 bp, human
gcaaacactggcagagtctt

SEQ ID NO: 98375 - DNA, 20 bp, human
gtagagctgtccgcctcgtc

SEQ ID NO: 98376 - DNA, 20 bp, human
gtaagggcggccatcactag

SEQ ID NO: 98377 - DNA, 20 bp, human
gcacggagtgaaagaggtaa

SEQ ID NO: 98378 - DNA, 20 bp, human
gtcatcccaagggaccaatg

SEQ ID NO: 98379 - DNA, 20 bp, human
gtgtccagagctaggcctga

SEQ ID NO: 98380 - DNA, 20 bp, human
ggcggagtcgctgcccctgg

SEQ ID NO: 98381 - DNA, 20 bp, human
ggaggagacagccacttcaa

SEQ ID NO: 98382 - DNA, 20 bp, human
gacccttcgggacgatgaga

SEQ ID NO: 98383 - DNA, 20 bp, human
gggaggcggcagggatgcga

SEQ ID NO: 98384 - DNA, 20 bp, human
ggacggtcccccaagctaaa

SEQ ID NO: 98385 - DNA, 20 bp, human
gagaaagccttgcgcagtgg

SEQ ID NO: 98386 - DNA, 20 bp, human
gtcgcggcctccccagctag

SEQ ID NO: 98387 - DNA, 20 bp, human
ggtcgcgggcgcggtcgcag

SEQ ID NO: 98388 - DNA, 20 bp, human
gccgcgaccactagctgggg

SEQ ID NO: 98389 - DNA, 20 bp, human
ggaagcagtgcagtccactc

SEQ ID NO: 98390 - DNA, 20 bp, human
ggtccaccctgaggagggag

SEQ ID NO: 98391 - DNA, 20 bp, human
ggacacgcgagcctctgcta

SEQ ID NO: 98392 - DNA, 20 bp, human
gaggagccgcggctcgcacc

SEQ ID NO: 98393 - DNA, 20 bp, human
gctagggccggagggtctaa

SEQ ID NO: 98394 - DNA, 20 bp, human
ggccagccctaaaggagccg

SEQ ID NO: 98395 - DNA, 20 bp, human
gcagcaccgctggggaccaa

SEQ ID NO: 98396 - DNA, 20 bp, human
ggagctgtgcctgttcccca

SEQ ID NO: 98397 - DNA, 20 bp, human
ggtatctgagacaggtccct

SEQ ID NO: 98398 - DNA, 20 bp, human
ggcttcagcctggtcacgag

SEQ ID NO: 98399 - DNA, 20 bp, human
gcaagccccacagaaagtcg

SEQ ID NO: 98400 - DNA, 20 bp, human
gcagaggagagtgactagaa

SEQ ID NO: 98401 - DNA, 20 bp, human
gagaaaacacctaaaccctg

SEQ ID NO: 98402 - DNA, 20 bp, human
ggaccaggctgaagctgacg

SEQ ID NO: 98403 - DNA, 20 bp, human
gggcctgatcaagactctcc

SEQ ID NO: 98404 - DNA, 20 bp, human
gcgcggtccctgctgaagcg

SEQ ID NO: 98405 - DNA, 20 bp, human
gccttgcaggtatctgagac

SEQ ID NO: 98406 - DNA, 20 bp, human
ggtggggggcagtcatgtag

SEQ ID NO: 98407 - DNA, 20 bp, human
gagacagccacctcagagac

SEQ ID NO: 98408 - DNA, 20 bp, human
gagcagcttaccagtctctg

SEQ ID NO: 98409 - DNA, 20 bp, human
gaggtggtgcggcagggagt

SEQ ID NO: 98410 - DNA, 20 bp, human
gaacaggaagatgtcttatt

SEQ ID NO: 98411 - DNA, 20 bp, human
gtgtatccagtcgctgggtt

SEQ ID NO: 98412 - DNA, 20 bp, human
gcttcaccatgagtcaaaca

SEQ ID NO: 98413 - DNA, 20 bp, human
gtgactcatggtgaagttga

SEQ ID NO: 98414 - DNA, 20 bp, human
gtgattcccaacccagcgac

SEQ ID NO: 98415 - DNA, 20 bp, human
gggaagaaaacttcctcaga

SEQ ID NO: 98416 - DNA, 20 bp, human
gactcccagggaccgaggga

SEQ ID NO: 98417 - DNA, 20 bp, human
ggagcgcgggggctccggtg

SEQ ID NO: 98418 - DNA, 20 bp, human
ggggaactcccagggaccga

SEQ ID NO: 98419 - DNA, 20 bp, human
ggagcgctggggaactccca

SEQ ID NO: 98420 - DNA, 20 bp, human
gtcctcgggccgtgaccccg

SEQ ID NO: 98421 - DNA, 20 bp, human
gtctagcgagcgcaaggcgg

SEQ ID NO: 98422 - DNA, 20 bp, human
gaccgagggagggtcagccc

SEQ ID NO: 98423 - DNA, 20 bp, human
gggcacccaccgctctccaa

SEQ ID NO: 98424 - DNA, 20 bp, human
gtaagtcagctgaggccgag

SEQ ID NO: 98425 - DNA, 20 bp, human
gaggcgggggctggtcccaa

SEQ ID NO: 98426 - DNA, 20 bp, human
gcagtgggtgagaggagcat

SEQ ID NO: 98427 - DNA, 20 bp, human
gagcatggggagctcccggg

SEQ ID NO: 98428 - DNA, 20 bp, human
gtccagcgcggtaagaagta

SEQ ID NO: 98429 - DNA, 20 bp, human
gtctcacccactggccgcgg

SEQ ID NO: 98430 - DNA, 20 bp, human
gcgtgcgccggccaggtccc

SEQ ID NO: 98431 - DNA, 20 bp, human
gcccggagtactggcctgag

SEQ ID NO: 98432 - DNA, 20 bp, human
gtgagtggaggcccaagccg

SEQ ID NO: 98433 - DNA, 20 bp, human
ggacctggccggcgcacggg

SEQ ID NO: 98434 - DNA, 20 bp, human
gttggggcgcccagaaacga

SEQ ID NO: 98435 - DNA, 20 bp, human
ggcgcaaagggcggacccac

SEQ ID NO: 98436 - DNA, 20 bp, human
gaatgggagctggacgagga

SEQ ID NO: 98437 - DNA, 20 bp, human
ggtgcgccgggtggtctcgc

SEQ ID NO: 98438 - DNA, 20 bp, human
gcacagagaagcggtacctg

SEQ ID NO: 98439 - DNA, 20 bp, human
gcgccgggtggtctcgcggg

SEQ ID NO: 98440 - DNA, 20 bp, human
gggcggggaacctgagatag

SEQ ID NO: 98441 - DNA, 20 bp, human
gaagaggggagtgtgaagta

SEQ ID NO: 98442 - DNA, 20 bp, human
gcaggtgacagaactgcggg

SEQ ID NO: 98443 - DNA, 20 bp, human
ggaacctgagatagaggcga

SEQ ID NO: 98444 - DNA, 20 bp, human
gcaccgcccgcgagaccacc

SEQ ID NO: 98445 - DNA, 20 bp, human
gggagaaacaaggttaacag

SEQ ID NO: 98446 - DNA, 20 bp, human
gtgataatctggccctcagt

SEQ ID NO: 98447 - DNA, 20 bp, human
gacaggaatgtacccactga

SEQ ID NO: 98448 - DNA, 20 bp, human
gtgttcacaggttatagata

SEQ ID NO: 98449 - DNA, 20 bp, human
gcatctggaggcaaaaaccg

SEQ ID NO: 98450 - DNA, 20 bp, human
gattaggaccagtctcatct

SEQ ID NO: 98451 - DNA, 20 bp, human
gatcttggtgtgttagagac

SEQ ID NO: 98452 - DNA, 20 bp, human
gatgaccgaactgtacgtga

SEQ ID NO: 98453 - DNA, 20 bp, human
gctctaaagttgttgttcac

SEQ ID NO: 98454 - DNA, 20 bp, human
ggtacagttcggtcatctgg

SEQ ID NO: 98455 - DNA, 20 bp, human
gttgtaagaatcctcagatc

SEQ ID NO: 98456 - DNA, 20 bp, human
gtagtgcctggcatagacat

SEQ ID NO: 98457 - DNA, 20 bp, human
ggacatagggtgcatagtga

SEQ ID NO: 98458 - DNA, 20 bp, human
gtaggtaagaacggctgtgg

SEQ ID NO: 98459 - DNA, 20 bp, human
gacacatggagaagaggctt

SEQ ID NO: 98460 - DNA, 20 bp, human
ggctgtgggggaagtcagct

SEQ ID NO: 98461 - DNA, 20 bp, human
gtggctttaaaattgaaggg

SEQ ID NO: 98462 - DNA, 20 bp, human
gaaataggtaagaacggctg

SEQ ID NO: 98463 - DNA, 20 bp, human
gttctccatgtgtgcacaca

SEQ ID NO: 98464 - DNA, 20 bp, human
gcagcatgtaaactccaaga

SEQ ID NO: 98465 - DNA, 20 bp, human
gtgccagacagtaataaaat

SEQ ID NO: 98466 - DNA, 20 bp, human
gcgtgaccgcgctccggtaa

SEQ ID NO: 98467 - DNA, 20 bp, human
gcctcatgttggaaccgagg

SEQ ID NO: 98468 - DNA, 20 bp, human
ggcccctcatgttggaaccg

SEQ ID NO: 98469 - DNA, 20 bp, human
gatcttgtttcttccgttac

SEQ ID NO: 98470 - DNA, 20 bp, human
gaatggctggggcctcactg

SEQ ID NO: 98471 - DNA, 20 bp, human
gcccggcctgcggaagcggt

SEQ ID NO: 98472 - DNA, 20 bp, human
ggcctgcggaagcggttgga

SEQ ID NO: 98473 - DNA, 20 bp, human
gcgcgagcggaaccccggat

SEQ ID NO: 98474 - DNA, 20 bp, human
ggcggaaccccggatgggtc

SEQ ID NO: 98475 - DNA, 20 bp, human
gggtgccgcgagcggaaccc

SEQ ID NO: 98476 - DNA, 20 bp, human
ggcctgggctccaacaagag

SEQ ID NO: 98477 - DNA, 20 bp, human
ggacaactaggaggatgaca

SEQ ID NO: 98478 - DNA, 20 bp, human
gcttgttggagcccaggcgg

SEQ ID NO: 98479 - DNA, 20 bp, human
gggagaagggaaagctgacg

SEQ ID NO: 98480 - DNA, 20 bp, human
ggggctccaacaagaggggc

SEQ ID NO: 98481 - DNA, 20 bp, human
ggaggacgccagttactcca

SEQ ID NO: 98482 - DNA, 20 bp, human
gggctcccctcgccgatacg

SEQ ID NO: 98483 - DNA, 20 bp, human
gcgatacgcggtagtagccg

SEQ ID NO: 98484 - DNA, 20 bp, human
gctttagaggggaaatggga

SEQ ID NO: 98485 - DNA, 20 bp, human
gaagggaaagctgacgggga

SEQ ID NO: 98486 - DNA, 20 bp, human
gtggaggagggcacgttcag

SEQ ID NO: 98487 - DNA, 20 bp, human
gcgctgcgctcgctggagga

SEQ ID NO: 98488 - DNA, 20 bp, human
gagacgccgcgcgcaccggg

SEQ ID NO: 98489 - DNA, 20 bp, human
ggcagctgatttccgagatc

SEQ ID NO: 98490 - DNA, 20 bp, human
gctgcagagcccgagcgccg

SEQ ID NO: 98491 - DNA, 20 bp, human
gagtggccgtcgccaaaacg

SEQ ID NO: 98492 - DNA, 20 bp, human
ggcgtcttactgccagatct

SEQ ID NO: 98493 - DNA, 20 bp, human
gagcgagccctggcgcggga

SEQ ID NO: 98494 - DNA, 20 bp, human
gtctcggaaatcagctgcca

SEQ ID NO: 98495 - DNA, 20 bp, human
gcagtccacggtgtgcgggt

SEQ ID NO: 98496 - DNA, 20 bp, human
gacttggttacagctgactg

SEQ ID NO: 98497 - DNA, 20 bp, human
ggttaagagtagattgcagg

SEQ ID NO: 98498 - DNA, 20 bp, human
ggcacataatgtgacaagtg

SEQ ID NO: 98499 - DNA, 20 bp, human
gttgacttgtgtttccctag

SEQ ID NO: 98500 - DNA, 20 bp, human
gcgctaactttggttatgtg

SEQ ID NO: 98501 - DNA, 20 bp, human
gaggggaagttggttgttat

SEQ ID NO: 98502 - DNA, 20 bp, human
gggggaaatctatcttccag

SEQ ID NO: 98503 - DNA, 20 bp, human
gttggaatgtccaaacaaac

SEQ ID NO: 98504 - DNA, 20 bp, human
gactggggattttaatcatt

SEQ ID NO: 98505 - DNA, 20 bp, human
gacctatactgtgtctgtat

SEQ ID NO: 98506 - DNA, 20 bp, human
gccgggactggcgcaaggta

SEQ ID NO: 98507 - DNA, 20 bp, human
gaggaagagcagacaaagac

SEQ ID NO: 98508 - DNA, 20 bp, human
gagggacggcctaggtaccc

SEQ ID NO: 98509 - DNA, 20 bp, human
ggcttgcccagagatgcagt

SEQ ID NO: 98510 - DNA, 20 bp, human
gtgctcttcctgcaaggcta

SEQ ID NO: 98511 - DNA, 20 bp, human
gggtccggaatggagagagg

SEQ ID NO: 98512 - DNA, 20 bp, human
gtggctcagggaggaggcgt

SEQ ID NO: 98513 - DNA, 20 bp, human
gtacctaggccgtccctcca

SEQ ID NO: 98514 - DNA, 20 bp, human
gggccggcccggtcccaggt

SEQ ID NO: 98515 - DNA, 20 bp, human
gggtggctgctccatcctcg

SEQ ID NO: 98516 - DNA, 20 bp, human
gaccgaactggagatagtgt

SEQ ID NO: 98517 - DNA, 20 bp, human
ggtgtcacagagactagggg

SEQ ID NO: 98518 - DNA, 20 bp, human
gaagatgaggtcatacgcat

SEQ ID NO: 98519 - DNA, 20 bp, human
gggggtgtcacagagactag

SEQ ID NO: 98520 - DNA, 20 bp, human
gacttacacgaaggaagatg

SEQ ID NO: 98521 - DNA, 20 bp, human
ggtgggtaggatggtgccat

SEQ ID NO: 98522 - DNA, 20 bp, human
gtgccataggaggcaccatg

SEQ ID NO: 98523 - DNA, 20 bp, human
ggactatgggtgaccaggac

SEQ ID NO: 98524 - DNA, 20 bp, human
gccggtctgcaaactaagga

SEQ ID NO: 98525 - DNA, 20 bp, human
gggtggatatacttacacga

SEQ ID NO: 98526 - DNA, 20 bp, human
ggccccttcagagagtccgg

SEQ ID NO: 98527 - DNA, 20 bp, human
gggagtgagcgtcaagtgag

SEQ ID NO: 98528 - DNA, 20 bp, human
gggcgcgaggaggagacggt

SEQ ID NO: 98529 - DNA, 20 bp, human
ggggctcgcggtgttgcagg

SEQ ID NO: 98530 - DNA, 20 bp, human
gcgcccccggactctctgaa

SEQ ID NO: 98531 - DNA, 20 bp, human
gagtccccgctggctagcgg

SEQ ID NO: 98532 - DNA, 20 bp, human
gctggcggcgcggccactga

SEQ ID NO: 98533 - DNA, 20 bp, human
gcgccagcggactgctgcag

SEQ ID NO: 98534 - DNA, 20 bp, human
ggcggctgcgggaaacgctc

SEQ ID NO: 98535 - DNA, 20 bp, human
gcgctccgctcgtctagagg

SEQ ID NO: 98536 - DNA, 20 bp, human
gtcgcgcctgaagcggatag

SEQ ID NO: 98537 - DNA, 20 bp, human
ggaacatgtcgcgcctgaag

SEQ ID NO: 98538 - DNA, 20 bp, human
gggctgcagcttctggacct

SEQ ID NO: 98539 - DNA, 20 bp, human
gaaggagcggggcatcccaa

SEQ ID NO: 98540 - DNA, 20 bp, human
ggcgacatgttcaaagtcct

SEQ ID NO: 98541 - DNA, 20 bp, human
ggctagcagtctgagaaagg

SEQ ID NO: 98542 - DNA, 20 bp, human
gcacccgtgacgcttaaagg

SEQ ID NO: 98543 - DNA, 20 bp, human
gcggtacctcggtaccccaa

SEQ ID NO: 98544 - DNA, 20 bp, human
gcctgggaaggaactgaact

SEQ ID NO: 98545 - DNA, 20 bp, human
gtgcttatcccacagaatgt

SEQ ID NO: 98546 - DNA, 20 bp, human
gcgcccgcacagctcgaaca

SEQ ID NO: 98547 - DNA, 20 bp, human
gatggaggccacgtcccggg

SEQ ID NO: 98548 - DNA, 20 bp, human
gccgaggccgagctcttcgc

SEQ ID NO: 98549 - DNA, 20 bp, human
gaccatggaggccacgtccc

SEQ ID NO: 98550 - DNA, 20 bp, human
gggccgcgcgaactgacact

SEQ ID NO: 98551 - DNA, 20 bp, human
ggtagcggcggcaacgacca

SEQ ID NO: 98552 - DNA, 20 bp, human
ggcggcggcaacgaccatgg

SEQ ID NO: 98553 - DNA, 20 bp, human
ggaggccacgtcccgggagg

SEQ ID NO: 98554 - DNA, 20 bp, human
gaacctcggcccctgcccta

SEQ ID NO: 98555 - DNA, 20 bp, human
gtctcggatgtcgaaccggt

SEQ ID NO: 98556 - DNA, 20 bp, human
gcccgggttgcgtgtgggag

SEQ ID NO: 98557 - DNA, 20 bp, human
ggtttggaactcgcagaggt

SEQ ID NO: 98558 - DNA, 20 bp, human
gggtgggacacagtgaaggt

SEQ ID NO: 98559 - DNA, 20 bp, human
gcgccggtcccgcggtccca

SEQ ID NO: 98560 - DNA, 20 bp, human
gcgccgtgggaccgcgggac

SEQ ID NO: 98561 - DNA, 20 bp, human
gggatgaggtatactggtgg

SEQ ID NO: 98562 - DNA, 20 bp, human
gggaggaaacgagataggat

SEQ ID NO: 98563 - DNA, 20 bp, human
gagcggcagctcctcggtga

SEQ ID NO: 98564 - DNA, 20 bp, human
gtggggttcggggcctgggt

SEQ ID NO: 98565 - DNA, 20 bp, human
gattagcctgggtggactcg

SEQ ID NO: 98566 - DNA, 20 bp, human
gcctgaggcagtgtgagagg

SEQ ID NO: 98567 - DNA, 20 bp, human
gtaggactctggagacaggg

SEQ ID NO: 98568 - DNA, 20 bp, human
ggagtccgagtccgagtctg

SEQ ID NO: 98569 - DNA, 20 bp, human
gcgagtccgagtctgaggcc

SEQ ID NO: 98570 - DNA, 20 bp, human
gacgtcttcaagtcagggag

SEQ ID NO: 98571 - DNA, 20 bp, human
gtgagcacatcagctgacct

SEQ ID NO: 98572 - DNA, 20 bp, human
gtgttgacgtcttcaagtca

SEQ ID NO: 98573 - DNA, 20 bp, human
gcgccggggccggaactctg

SEQ ID NO: 98574 - DNA, 20 bp, human
gaccggctgcggggaggcac

SEQ ID NO: 98575 - DNA, 20 bp, human
gccccgcgcacgcgtcctag

SEQ ID NO: 98576 - DNA, 20 bp, human
gggatactgaggccccgacg

SEQ ID NO: 98577 - DNA, 20 bp, human
gccgcctgtgcagggagagt

SEQ ID NO: 98578 - DNA, 20 bp, human
gggcggagagcaatccgagt

SEQ ID NO: 98579 - DNA, 20 bp, human
gcccgacgcggctgtcgcga

SEQ ID NO: 98580 - DNA, 20 bp, human
ggccacgcaaagcctgacgg

SEQ ID NO: 98581 - DNA, 20 bp, human
gtagttcccgcggcctctcc

SEQ ID NO: 98582 - DNA, 20 bp, human
ggaacaaggcgcgccgggag

SEQ ID NO: 98583 - DNA, 20 bp, human
ggcgccgggtacaggagacg

SEQ ID NO: 98584 - DNA, 20 bp, human
ggccctcgcgacagccgcgt

SEQ ID NO: 98585 - DNA, 20 bp, human
gccaggtccagccggcccct

SEQ ID NO: 98586 - DNA, 20 bp, human
gcccactgcttccggccccg

SEQ ID NO: 98587 - DNA, 20 bp, human
gggagtcgttgctaagagac

SEQ ID NO: 98588 - DNA, 20 bp, human
gacgccgagtggggaggtaa

SEQ ID NO: 98589 - DNA, 20 bp, human
gggtaaggcctccaagagtg

SEQ ID NO: 98590 - DNA, 20 bp, human
gagagactggacgccgagtg

SEQ ID NO: 98591 - DNA, 20 bp, human
gtagagcagttggaaaacag

SEQ ID NO: 98592 - DNA, 20 bp, human
gtgtctggaggtgagtaggg

SEQ ID NO: 98593 - DNA, 20 bp, human
gcagcaagctggggtgttgt

SEQ ID NO: 98594 - DNA, 20 bp, human
gtcatgtctggaggtgagta

SEQ ID NO: 98595 - DNA, 20 bp, human
gtcttggcggcccctaagga

SEQ ID NO: 98596 - DNA, 20 bp, human
gagcagctgaggcgccatgg

SEQ ID NO: 98597 - DNA, 20 bp, human
gggcagcggtgtcagagtct

SEQ ID NO: 98598 - DNA, 20 bp, human
gagctgaggcgccatggcgg

SEQ ID NO: 98599 - DNA, 20 bp, human
ggccagcagctgaggcgcca

SEQ ID NO: 98600 - DNA, 20 bp, human
ggacaggtcgagcacccgaa

SEQ ID NO: 98601 - DNA, 20 bp, human
ggcggtgtcagagtcttggc

SEQ ID NO: 98602 - DNA, 20 bp, human
gcgcagcgcgccaggtcggc

SEQ ID NO: 98603 - DNA, 20 bp, human
gccggaagcaccctggtggg

SEQ ID NO: 98604 - DNA, 20 bp, human
gtcagagtcttggccggagc

SEQ ID NO: 98605 - DNA, 20 bp, human
gcgcgagctgccagccgacc

SEQ ID NO: 98606 - DNA, 20 bp, human
gagaagcggcagagtgtgtc

SEQ ID NO: 98607 - DNA, 20 bp, human
gtacccaacagcgcacggta

SEQ ID NO: 98608 - DNA, 20 bp, human
gcccaaggggacaatctatc

SEQ ID NO: 98609 - DNA, 20 bp, human
ggagtgtgtcgggcctgcac

SEQ ID NO: 98610 - DNA, 20 bp, human
gcctcaggatgggacaggac

SEQ ID NO: 98611 - DNA, 20 bp, human
ggtgggcagcgtgcctggtg

SEQ ID NO: 98612 - DNA, 20 bp, human
gggccatctagatgacagac

SEQ ID NO: 98613 - DNA, 20 bp, human
ggtggccctcaggatgggac

SEQ ID NO: 98614 - DNA, 20 bp, human
gcttgcttagagcagcacca

SEQ ID NO: 98615 - DNA, 20 bp, human
gcagcatgcggcactccccc

SEQ ID NO: 98616 - DNA, 20 bp, human
gtcaagcgctgggaactcgg

SEQ ID NO: 98617 - DNA, 20 bp, human
ggtcagaagggagacatcct

SEQ ID NO: 98618 - DNA, 20 bp, human
gccccttagcaaccaagtcg

SEQ ID NO: 98619 - DNA, 20 bp, human
gttctgggaaaagttatcag

SEQ ID NO: 98620 - DNA, 20 bp, human
ggagttcccagcgcttgaga

SEQ ID NO: 98621 - DNA, 20 bp, human
ggccgcgacttggttgctaa

SEQ ID NO: 98622 - DNA, 20 bp, human
gggaaccaagcgccgcgact

SEQ ID NO: 98623 - DNA, 20 bp, human
gtcatagaaagagaggtacc

SEQ ID NO: 98624 - DNA, 20 bp, human
gacgcagcagacgcgtctcc

SEQ ID NO: 98625 - DNA, 20 bp, human
ggcttgagaaggtgagacct

SEQ ID NO: 98626 - DNA, 20 bp, human
gcgctgtagcgtcacctgga

SEQ ID NO: 98627 - DNA, 20 bp, human
gtcatgataggagacagtcc

SEQ ID NO: 98628 - DNA, 20 bp, human
gggagctggtctgctgtgaa

SEQ ID NO: 98629 - DNA, 20 bp, human
gagcctgaggtactaactag

SEQ ID NO: 98630 - DNA, 20 bp, human
gatttcccgggaatcatgat

SEQ ID NO: 98631 - DNA, 20 bp, human
gaccagggtttgaggttcgt

SEQ ID NO: 98632 - DNA, 20 bp, human
gatctcaatgagacaggtga

SEQ ID NO: 98633 - DNA, 20 bp, human
ggcccacgaacctcaaaccc

SEQ ID NO: 98634 - DNA, 20 bp, human
gatagcttgagtagacccag

SEQ ID NO: 98635 - DNA, 20 bp, human
gagtcagaaagagtaccagt

SEQ ID NO: 98636 - DNA, 20 bp, human
ggcccccgcctcggacggtg

SEQ ID NO: 98637 - DNA, 20 bp, human
gcgagagcagccgagagcgg

SEQ ID NO: 98638 - DNA, 20 bp, human
ggtcgctgccgcaccgtccg

SEQ ID NO: 98639 - DNA, 20 bp, human
ggagaggggttccttccggg

SEQ ID NO: 98640 - DNA, 20 bp, human
ggctgccgcaccgtccgagg

SEQ ID NO: 98641 - DNA, 20 bp, human
gagcatgcccggcccgtggg

SEQ ID NO: 98642 - DNA, 20 bp, human
gggctactcacagcgaggag

SEQ ID NO: 98643 - DNA, 20 bp, human
ggccgcaccgtccgaggcgg

SEQ ID NO: 98644 - DNA, 20 bp, human
gagccgagagcggcggagac

SEQ ID NO: 98645 - DNA, 20 bp, human
gcccgacccgtgccccttgg

SEQ ID NO: 98646 - DNA, 20 bp, human
gaaatggtaagaggaatggg

SEQ ID NO: 98647 - DNA, 20 bp, human
gtaagccaaaaactcatcaa

SEQ ID NO: 98648 - DNA, 20 bp, human
gaatgttagataaacaagag

SEQ ID NO: 98649 - DNA, 20 bp, human
gccataaagaaggtaagtca

SEQ ID NO: 98650 - DNA, 20 bp, human
ggtagtgcacggcaagctag

SEQ ID NO: 98651 - DNA, 20 bp, human
gaacaagagaggtacaaaaa

SEQ ID NO: 98652 - DNA, 20 bp, human
gctcagaagaactcagtgtg

SEQ ID NO: 98653 - DNA, 20 bp, human
gctcttggacacgtttttgc

SEQ ID NO: 98654 - DNA, 20 bp, human
gaaatttagagagtattgca

SEQ ID NO: 98655 - DNA, 20 bp, human
gttagagagtattgcaaggc

SEQ ID NO: 98656 - DNA, 20 bp, human
gaaggcgactgcagtccgaa

SEQ ID NO: 98657 - DNA, 20 bp, human
ggaccctaagcgtcaggacg

SEQ ID NO: 98658 - DNA, 20 bp, human
gtgagaagagccagcgatta

SEQ ID NO: 98659 - DNA, 20 bp, human
gcgcagggagccgtgagcca

SEQ ID NO: 98660 - DNA, 20 bp, human
gagggcgatggcgctaaggg

SEQ ID NO: 98661 - DNA, 20 bp, human
gagtggatggaaggggactg

SEQ ID NO: 98662 - DNA, 20 bp, human
ggccaacgggaaccaacttg

SEQ ID NO: 98663 - DNA, 20 bp, human
gaatgctctcccagcaccgg

SEQ ID NO: 98664 - DNA, 20 bp, human
gattggtcgagagaaagcct

SEQ ID NO: 98665 - DNA, 20 bp, human
gctgatcacaagcagagaaa

SEQ ID NO: 98666 - DNA, 20 bp, human
gacagcctccgggtgttcag

SEQ ID NO: 98667 - DNA, 20 bp, human
gacttgcaaacgcagggaaa

SEQ ID NO: 98668 - DNA, 20 bp, human
gcatacccctgaacacccgg

SEQ ID NO: 98669 - DNA, 20 bp, human
gccggcagccttcggatcag

SEQ ID NO: 98670 - DNA, 20 bp, human
gggagagccacatgacaatg

SEQ ID NO: 98671 - DNA, 20 bp, human
gcccgcaggaaggtgaaagg

SEQ ID NO: 98672 - DNA, 20 bp, human
gccaagaagtaatctgcaca

SEQ ID NO: 98673 - DNA, 20 bp, human
gcctttcaaagctgccaagt

SEQ ID NO: 98674 - DNA, 20 bp, human
ggttcaggggtatgtcaagg

SEQ ID NO: 98675 - DNA, 20 bp, human
gatcagaggacagagcccgc

SEQ ID NO: 98676 - DNA, 20 bp, human
gcctgtgagggaccataaag

SEQ ID NO: 98677 - DNA, 20 bp, human
gggcatgactcgaacctgtg

SEQ ID NO: 98678 - DNA, 20 bp, human
ggaatctctacattaaaagg

SEQ ID NO: 98679 - DNA, 20 bp, human
gaggttcgagtcatgcccca

SEQ ID NO: 98680 - DNA, 20 bp, human
ggctggacagttaactcagt

SEQ ID NO: 98681 - DNA, 20 bp, human
gcatggagctagggataata

SEQ ID NO: 98682 - DNA, 20 bp, human
gaacaggcaacactgcaggg

SEQ ID NO: 98683 - DNA, 20 bp, human
gaacactgcagggtggctca

SEQ ID NO: 98684 - DNA, 20 bp, human
gctatttcaataaagactgg

SEQ ID NO: 98685 - DNA, 20 bp, human
gctttattgaaatagccctg

SEQ ID NO: 98686 - DNA, 20 bp, human
gccatggacacagtcctcat

SEQ ID NO: 98687 - DNA, 20 bp, human
gcccaagtgtcacccatctt

SEQ ID NO: 98688 - DNA, 20 bp, human
gaggcaacagcagtgctgga

SEQ ID NO: 98689 - DNA, 20 bp, human
gtgggcctcctggaacatgt

SEQ ID NO: 98690 - DNA, 20 bp, human
ggttgcctgctgcctaagat

SEQ ID NO: 98691 - DNA, 20 bp, human
gacatgccgtaaccaggtgg

SEQ ID NO: 98692 - DNA, 20 bp, human
ggcgcttggcatggaggaag

SEQ ID NO: 98693 - DNA, 20 bp, human
gagcatgtgaggtagccagg

SEQ ID NO: 98694 - DNA, 20 bp, human
gccttaatggagctgccccg

SEQ ID NO: 98695 - DNA, 20 bp, human
gaggaaggcagctacatctg

SEQ ID NO: 98696 - DNA, 20 bp, human
gaggagacagcgcctggagg

SEQ ID NO: 98697 - DNA, 20 bp, human
gcggaagaacagcctggagt

SEQ ID NO: 98698 - DNA, 20 bp, human
gctgccagggccggacacct

SEQ ID NO: 98699 - DNA, 20 bp, human
gtggaggtggagggcgccca

SEQ ID NO: 98700 - DNA, 20 bp, human
gtggaggcaagggtcctcag

SEQ ID NO: 98701 - DNA, 20 bp, human
gctgctgcgggcgatcccag

SEQ ID NO: 98702 - DNA, 20 bp, human
gatggctacccaccagggaa

SEQ ID NO: 98703 - DNA, 20 bp, human
gcgcccaggccgcaaccccg

SEQ ID NO: 98704 - DNA, 20 bp, human
gccaggccgcaaccccgcgg

SEQ ID NO: 98705 - DNA, 20 bp, human
ggcgctcggctctcacctga

SEQ ID NO: 98706 - DNA, 20 bp, human
ggctccgcaggtgaagaccc

SEQ ID NO: 98707 - DNA, 20 bp, human
gggctgaccgaggtgagact

SEQ ID NO: 98708 - DNA, 20 bp, human
gcccgcccgggactaagccg

SEQ ID NO: 98709 - DNA, 20 bp, human
gcttcacctgcggagcctta

SEQ ID NO: 98710 - DNA, 20 bp, human
ggagccttacggcagctgag

SEQ ID NO: 98711 - DNA, 20 bp, human
gactgggagggacacgacca

SEQ ID NO: 98712 - DNA, 20 bp, human
gtgaccgaggtgagactggg

SEQ ID NO: 98713 - DNA, 20 bp, human
gggtcctgggtcttcacctg

SEQ ID NO: 98714 - DNA, 20 bp, human
gaaggaccgagggctgaccg

SEQ ID NO: 98715 - DNA, 20 bp, human
gctttcagcttaaggaccga

SEQ ID NO: 98716 - DNA, 20 bp, human
gtccaggtgctcaacctcag

SEQ ID NO: 98717 - DNA, 20 bp, human
gagcgccgcgcgcggtccag

SEQ ID NO: 98718 - DNA, 20 bp, human
gggcccagtgcgctgcccaa

SEQ ID NO: 98719 - DNA, 20 bp, human
ggcgactgggccaggccctt

SEQ ID NO: 98720 - DNA, 20 bp, human
ggaccgcgcgcggcgctctg

SEQ ID NO: 98721 - DNA, 20 bp, human
ggccccggaacctgaaccga

SEQ ID NO: 98722 - DNA, 20 bp, human
gcgcgcgcggtccagaggcc

SEQ ID NO: 98723 - DNA, 20 bp, human
ggccctcggttcaggttccg

SEQ ID NO: 98724 - DNA, 20 bp, human
gcgcggcgctctggggaatc

SEQ ID NO: 98725 - DNA, 20 bp, human
gctccatcctggccaccgca

SEQ ID NO: 98726 - DNA, 20 bp, human
gtcgtcgtcgcggcaccggt

SEQ ID NO: 98727 - DNA, 20 bp, human
gggaggcggtctcgcatcgg

SEQ ID NO: 98728 - DNA, 20 bp, human
gacatcccgggaagaacctt

SEQ ID NO: 98729 - DNA, 20 bp, human
gtgaccaaggccggtagcaa

SEQ ID NO: 98730 - DNA, 20 bp, human
ggctggacgcggcctcctag

SEQ ID NO: 98731 - DNA, 20 bp, human
gcgggcgctggcccctacgt

SEQ ID NO: 98732 - DNA, 20 bp, human
gacggaagtggtcgtcgtcg

SEQ ID NO: 98733 - DNA, 20 bp, human
gtgggactaagtcccctagg

SEQ ID NO: 98734 - DNA, 20 bp, human
gggcggaggcggtctcgcat

SEQ ID NO: 98735 - DNA, 20 bp, human
gaagtaagtggcccacgtag

SEQ ID NO: 98736 - DNA, 20 bp, human
gtggccaggacaggatccag

SEQ ID NO: 98737 - DNA, 20 bp, human
ggacctgaaggataaccccc

SEQ ID NO: 98738 - DNA, 20 bp, human
gggagtgtataaggagccac

SEQ ID NO: 98739 - DNA, 20 bp, human
gctgtttgacaggctcatag

SEQ ID NO: 98740 - DNA, 20 bp, human
ggggcacctggagctttgtg

SEQ ID NO: 98741 - DNA, 20 bp, human
gctgaagtggttggacctga

SEQ ID NO: 98742 - DNA, 20 bp, human
gtgccctaggagggaaaaac

SEQ ID NO: 98743 - DNA, 20 bp, human
gaaatcccagggagtgtata

SEQ ID NO: 98744 - DNA, 20 bp, human
gcttcaggttctaaagagat

SEQ ID NO: 98745 - DNA, 20 bp, human
gagctccaggtgccctagga

SEQ ID NO: 98746 - DNA, 20 bp, human
gtgaccccgcaagccggacc

SEQ ID NO: 98747 - DNA, 20 bp, human
gcgaactggagaggcgccat

SEQ ID NO: 98748 - DNA, 20 bp, human
gaggcagtgtagcctaatgg

SEQ ID NO: 98749 - DNA, 20 bp, human
gcggggtcagcgaactggag

SEQ ID NO: 98750 - DNA, 20 bp, human
gccttactggctgtgaacgt

SEQ ID NO: 98751 - DNA, 20 bp, human
gggaatgagtccgaagattg

SEQ ID NO: 98752 - DNA, 20 bp, human
gcggccaagtggctccttac

SEQ ID NO: 98753 - DNA, 20 bp, human
gctggagaggcgccatgggc

SEQ ID NO: 98754 - DNA, 20 bp, human
ggcttgcggggtcagcgaac

SEQ ID NO: 98755 - DNA, 20 bp, human
ggatcgaggacggaaggtgg

SEQ ID NO: 98756 - DNA, 20 bp, human
gtcggcacagagggagagat

SEQ ID NO: 98757 - DNA, 20 bp, human
ggaatccagagcgcccacta

SEQ ID NO: 98758 - DNA, 20 bp, human
gagggcagttctcggcacag

SEQ ID NO: 98759 - DNA, 20 bp, human
ggcacgctggccaacaagtt

SEQ ID NO: 98760 - DNA, 20 bp, human
gcgccgaggttcagggaagg

SEQ ID NO: 98761 - DNA, 20 bp, human
gcgccgaaacacactgggag

SEQ ID NO: 98762 - DNA, 20 bp, human
gcctggccaaaggccgtagt

SEQ ID NO: 98763 - DNA, 20 bp, human
gccctcgcgccgaaacacac

SEQ ID NO: 98764 - DNA, 20 bp, human
gcacgcggcccaggggtcag

SEQ ID NO: 98765 - DNA, 20 bp, human
gtcacggccgtgctcagaga

SEQ ID NO: 98766 - DNA, 20 bp, human
gcctagagggtggggatccg

SEQ ID NO: 98767 - DNA, 20 bp, human
gtagcggaccccggttgcta

SEQ ID NO: 98768 - DNA, 20 bp, human
gtccttggcctcctagaggg

SEQ ID NO: 98769 - DNA, 20 bp, human
gttccgtagtacccaaagag

SEQ ID NO: 98770 - DNA, 20 bp, human
gtgttcccgaagaagcacca

SEQ ID NO: 98771 - DNA, 20 bp, human
gagacacaccctagcaaccg

SEQ ID NO: 98772 - DNA, 20 bp, human
gttgctagggtgtgtctcct

SEQ ID NO: 98773 - DNA, 20 bp, human
gcgaggtaaaggtccagcga

SEQ ID NO: 98774 - DNA, 20 bp, human
gttatcctaaagggtagtgt

SEQ ID NO: 98775 - DNA, 20 bp, human
ggcctgcgcgtcaagtggct

SEQ ID NO: 98776 - DNA, 20 bp, human
gttcatcccaaagcacactg

SEQ ID NO: 98777 - DNA, 20 bp, human
gggaaagtgtgatatacctg

SEQ ID NO: 98778 - DNA, 20 bp, human
ggaagtctttaatcttggta

SEQ ID NO: 98779 - DNA, 20 bp, human
ggagtcattaccatagttat

SEQ ID NO: 98780 - DNA, 20 bp, human
gggtaatgactctgaaatag

SEQ ID NO: 98781 - DNA, 20 bp, human
gtcggaaagttatcttgtct

SEQ ID NO: 98782 - DNA, 20 bp, human
gagaaaatacatattcagtt

SEQ ID NO: 98783 - DNA, 20 bp, human
gttcactccacagtgtgctt

SEQ ID NO: 98784 - DNA, 20 bp, human
gaatgtttgatttcttactg

SEQ ID NO: 98785 - DNA, 20 bp, human
gtgtattttctgaaaaatca

SEQ ID NO: 98786 - DNA, 20 bp, human
ggtcccctgactccagatgt

SEQ ID NO: 98787 - DNA, 20 bp, human
gggcccacatctggagtcag

SEQ ID NO: 98788 - DNA, 20 bp, human
gaccacatggaattccctaa

SEQ ID NO: 98789 - DNA, 20 bp, human
ggcctctaaaaagatgagtg

SEQ ID NO: 98790 - DNA, 20 bp, human
gatgcaacttgacccaggtg

SEQ ID NO: 98791 - DNA, 20 bp, human
gttgctggagaggcatcaga

SEQ ID NO: 98792 - DNA, 20 bp, human
gtaataaaagcattgagtgg

SEQ ID NO: 98793 - DNA, 20 bp, human
ggagttatgcaacttgaccc

SEQ ID NO: 98794 - DNA, 20 bp, human
gaacatctctccctaccaca

SEQ ID NO: 98795 - DNA, 20 bp, human
gtgttaataaaagcattgag

SEQ ID NO: 98796 - DNA, 20 bp, human
gcgaagttaaagacctcctt

SEQ ID NO: 98797 - DNA, 20 bp, human
gggttgtcaaaagttacctt

SEQ ID NO: 98798 - DNA, 20 bp, human
gctataaaaatatagagtag

SEQ ID NO: 98799 - DNA, 20 bp, human
gtaatggtaatgtgaactat

SEQ ID NO: 98800 - DNA, 20 bp, human
gggtagttcttcaatttgat

SEQ ID NO: 98801 - DNA, 20 bp, human
gaacttcgaacgaacattag

SEQ ID NO: 98802 - DNA, 20 bp, human
gcacctcggaaacatcggca

SEQ ID NO: 98803 - DNA, 20 bp, human
gcaaattgaagaactaccca

SEQ ID NO: 98804 - DNA, 20 bp, human
gttcttcacctcggaaacat

SEQ ID NO: 98805 - DNA, 20 bp, human
gacttgtcagttacctagat

SEQ ID NO: 98806 - DNA, 20 bp, human
gcactcagctgattcagtaa

SEQ ID NO: 98807 - DNA, 20 bp, human
gtagcaaaaaataatgagta

SEQ ID NO: 98808 - DNA, 20 bp, human
gactatcataaatcatacca

SEQ ID NO: 98809 - DNA, 20 bp, human
gttaactccagtttgttctg

SEQ ID NO: 98810 - DNA, 20 bp, human
gtgatttatgatagtattat

SEQ ID NO: 98811 - DNA, 20 bp, human
gaaggaaccaatgtgaagag

SEQ ID NO: 98812 - DNA, 20 bp, human
ggaaacaccactcttcacat

SEQ ID NO: 98813 - DNA, 20 bp, human
gttacaattgattacaacac

SEQ ID NO: 98814 - DNA, 20 bp, human
ggtggtgtttcctgagcaaa

SEQ ID NO: 98815 - DNA, 20 bp, human
gtagaattattaacatgatc

SEQ ID NO: 98816 - DNA, 20 bp, human
ggtcttggagagggacgcgt

SEQ ID NO: 98817 - DNA, 20 bp, human
gagattcaggaactcaacgt

SEQ ID NO: 98818 - DNA, 20 bp, human
gcggatccggtccctggacg

SEQ ID NO: 98819 - DNA, 20 bp, human
gaccggatccgacccgtccg

SEQ ID NO: 98820 - DNA, 20 bp, human
gggatccgacccgtccgcgg

SEQ ID NO: 98821 - DNA, 20 bp, human
gtacgccaccgcggacgggt

SEQ ID NO: 98822 - DNA, 20 bp, human
gcatgaggccagatatgtca

SEQ ID NO: 98823 - DNA, 20 bp, human
ggagtagctagtgggaaccc

SEQ ID NO: 98824 - DNA, 20 bp, human
gtatgtcacggaggagaacg

SEQ ID NO: 98825 - DNA, 20 bp, human
gacgggtcggatccggtccc

SEQ ID NO: 98826 - DNA, 20 bp, human
ggtggcaccgaagagagact

SEQ ID NO: 98827 - DNA, 20 bp, human
gggatgtgaacagctacgag

SEQ ID NO: 98828 - DNA, 20 bp, human
gacccggcgactgctctgta

SEQ ID NO: 98829 - DNA, 20 bp, human
gacgggaatgcggtaactgt

SEQ ID NO: 98830 - DNA, 20 bp, human
gatccggcctcgcccgccgg

SEQ ID NO: 98831 - DNA, 20 bp, human
gcgatgctggcgcctacgga

SEQ ID NO: 98832 - DNA, 20 bp, human
gggattaggacctctagccc

SEQ ID NO: 98833 - DNA, 20 bp, human
gaggtcctaatcccctgggt

SEQ ID NO: 98834 - DNA, 20 bp, human
ggaagcagcggtgattaatc

SEQ ID NO: 98835 - DNA, 20 bp, human
gacatgggcggccgaagcag

SEQ ID NO: 98836 - DNA, 20 bp, human
ggccggctccggctcagtcc

SEQ ID NO: 98837 - DNA, 20 bp, human
ggctccccccgaccaccccg

SEQ ID NO: 98838 - DNA, 20 bp, human
ggctccagagagcgagcggg

SEQ ID NO: 98839 - DNA, 20 bp, human
gagcgggcggcgagttccca

SEQ ID NO: 98840 - DNA, 20 bp, human
gcgcgggccgggctgaagtg

SEQ ID NO: 98841 - DNA, 20 bp, human
gccggagccggccagaggtg

SEQ ID NO: 98842 - DNA, 20 bp, human
ggctctctctgccagccgtg

SEQ ID NO: 98843 - DNA, 20 bp, human
gagaggtgcggaggcgtcca

SEQ ID NO: 98844 - DNA, 20 bp, human
ggcgggcctggccgcacggc

SEQ ID NO: 98845 - DNA, 20 bp, human
ggcagcgcctgcccaacccc

SEQ ID NO: 98846 - DNA, 20 bp, human
ggtaggccgaacaccgcggg

SEQ ID NO: 98847 - DNA, 20 bp, human
gtgtgtaagtgggtttcgag

SEQ ID NO: 98848 - DNA, 20 bp, human
gaggcgccggagcagcgctg

SEQ ID NO: 98849 - DNA, 20 bp, human
ggtgagggacaaacaaaagg

SEQ ID NO: 98850 - DNA, 20 bp, human
ggcccagaggtggaacctct

SEQ ID NO: 98851 - DNA, 20 bp, human
ggacaaacaaaaggaggcgc

SEQ ID NO: 98852 - DNA, 20 bp, human
gaggtggaacctctaggaac

SEQ ID NO: 98853 - DNA, 20 bp, human
gacaccgcgggaggtcccca

SEQ ID NO: 98854 - DNA, 20 bp, human
gactcaggagaagacagcta

SEQ ID NO: 98855 - DNA, 20 bp, human
gccaccccgtccactcacct

SEQ ID NO: 98856 - DNA, 20 bp, human
gggaggaggaggaccggata

SEQ ID NO: 98857 - DNA, 20 bp, human
ggctcgccctcctggaaccg

SEQ ID NO: 98858 - DNA, 20 bp, human
gtccggcagccgggaaagtg

SEQ ID NO: 98859 - DNA, 20 bp, human
ggaaagagaggtgaccgtct

SEQ ID NO: 98860 - DNA, 20 bp, human
gtacggggacgcagcaggtg

SEQ ID NO: 98861 - DNA, 20 bp, human
ggccccgaggactcacgctc

SEQ ID NO: 98862 - DNA, 20 bp, human
gcgagccgcgccgaccgagg

SEQ ID NO: 98863 - DNA, 20 bp, human
gcatttggagcaagaggtgt

SEQ ID NO: 98864 - DNA, 20 bp, human
ggcgcggctgcagagacgag

SEQ ID NO: 98865 - DNA, 20 bp, human
gcaatggagccggtcggagg

SEQ ID NO: 98866 - DNA, 20 bp, human
ggcccgcgaagagaagtagg

SEQ ID NO: 98867 - DNA, 20 bp, human
gggctagcgcggattgggtg

SEQ ID NO: 98868 - DNA, 20 bp, human
ggcgcattgtgagggatgag

SEQ ID NO: 98869 - DNA, 20 bp, human
gcgccaggtgggcgtctcag

SEQ ID NO: 98870 - DNA, 20 bp, human
gagcgaggtggtctctgcag

SEQ ID NO: 98871 - DNA, 20 bp, human
gcggactctgagggaggatt

SEQ ID NO: 98872 - DNA, 20 bp, human
gggccgcggccgcagtgctc

SEQ ID NO: 98873 - DNA, 20 bp, human
gctctcgcgcccggaggtaa

SEQ ID NO: 98874 - DNA, 20 bp, human
gacctggcggactctgaggg

SEQ ID NO: 98875 - DNA, 20 bp, human
gcaatccgcgctagcccgag

SEQ ID NO: 98876 - DNA, 20 bp, human
gccgcgggccgtctccgggt

SEQ ID NO: 98877 - DNA, 20 bp, human
gccgtctccgggttgggtac

SEQ ID NO: 98878 - DNA, 20 bp, human
gcacatgactctgtaacgag

SEQ ID NO: 98879 - DNA, 20 bp, human
gaggtggcggcgagcggagt

SEQ ID NO: 98880 - DNA, 20 bp, human
gcggaggagccggggcacca

SEQ ID NO: 98881 - DNA, 20 bp, human
gacgctcagactgcagaaag

SEQ ID NO: 98882 - DNA, 20 bp, human
gggccctggcggcagcaaac

SEQ ID NO: 98883 - DNA, 20 bp, human
gcagctcggccgccaagcca

SEQ ID NO: 98884 - DNA, 20 bp, human
gctcattcggggacgtccgg

SEQ ID NO: 98885 - DNA, 20 bp, human
gagaggtgcgcaccaacctt

SEQ ID NO: 98886 - DNA, 20 bp, human
ggagcgggtcgggaagtctg

SEQ ID NO: 98887 - DNA, 20 bp, human
gaccccgggtgagaagccag

SEQ ID NO: 98888 - DNA, 20 bp, human
gcgccggcccgaacccaggg

SEQ ID NO: 98889 - DNA, 20 bp, human
gaccacgcgggcagccggtg

SEQ ID NO: 98890 - DNA, 20 bp, human
gcggtgcggcggggtcgcca

SEQ ID NO: 98891 - DNA, 20 bp, human
gcgccacctcggcaccacgc

SEQ ID NO: 98892 - DNA, 20 bp, human
gtgcccgcgtggtgccgagg

SEQ ID NO: 98893 - DNA, 20 bp, human
gcacggagcactgctagtgt

SEQ ID NO: 98894 - DNA, 20 bp, human
ggctagagagatccaagtgt

SEQ ID NO: 98895 - DNA, 20 bp, human
gttccgccggcccgaaccca

SEQ ID NO: 98896 - DNA, 20 bp, human
ggggaactctgcgggagtcg

SEQ ID NO: 98897 - DNA, 20 bp, human
ggacgctgggcccaactcct

SEQ ID NO: 98898 - DNA, 20 bp, human
ggggccgcgagggtgagtca

SEQ ID NO: 98899 - DNA, 20 bp, human
gccctcccggaacggtgagt

SEQ ID NO: 98900 - DNA, 20 bp, human
ggcccgcccgggaactctgc

SEQ ID NO: 98901 - DNA, 20 bp, human
gactcctgggtctctgggag

SEQ ID NO: 98902 - DNA, 20 bp, human
gcccaggacgggcacctcgt

SEQ ID NO: 98903 - DNA, 20 bp, human
gcacctcgtggggtgtccag

SEQ ID NO: 98904 - DNA, 20 bp, human
gtgaacccaccccaagtggt

SEQ ID NO: 98905 - DNA, 20 bp, human
ggagctctgagagtctcccg

SEQ ID NO: 98906 - DNA, 20 bp, human
gcggggagcggggtcttaac

SEQ ID NO: 98907 - DNA, 20 bp, human
gggtggaggacaaggtcctg

SEQ ID NO: 98908 - DNA, 20 bp, human
ggcctcccggaagcgcggaa

SEQ ID NO: 98909 - DNA, 20 bp, human
ggccgccgcctccatagcac

SEQ ID NO: 98910 - DNA, 20 bp, human
gagctcacggacccctcgct

SEQ ID NO: 98911 - DNA, 20 bp, human
gacgggcgggaaggcatcca

SEQ ID NO: 98912 - DNA, 20 bp, human
ggaggcttgtcccaagctca

SEQ ID NO: 98913 - DNA, 20 bp, human
gaagagtggtcagaagctgg

SEQ ID NO: 98914 - DNA, 20 bp, human
gtagcactggcgacggggag

SEQ ID NO: 98915 - DNA, 20 bp, human
gttaaccggcacccagcgag

SEQ ID NO: 98916 - DNA, 20 bp, human
gccggagaggcgtcagtgct

SEQ ID NO: 98917 - DNA, 20 bp, human
gcaattgcgaggacctccgc

SEQ ID NO: 98918 - DNA, 20 bp, human
gtccttcgcaggaccggtag

SEQ ID NO: 98919 - DNA, 20 bp, human
ggttgagtccagcaattgcg

SEQ ID NO: 98920 - DNA, 20 bp, human
gaggccacaggtgaagcgaa

SEQ ID NO: 98921 - DNA, 20 bp, human
gtgctgggctgcgcctgcgg

SEQ ID NO: 98922 - DNA, 20 bp, human
gcgctttcggcctgggaaag

SEQ ID NO: 98923 - DNA, 20 bp, human
ggtacaggctaacgtaacgt

SEQ ID NO: 98924 - DNA, 20 bp, human
gtgcggctccttcgcaggac

SEQ ID NO: 98925 - DNA, 20 bp, human
gccccctaccggtcctgcga

SEQ ID NO: 98926 - DNA, 20 bp, human
gagtcgggctcggggtggaa

SEQ ID NO: 98927 - DNA, 20 bp, human
gcagctcgttccgaggtcaa

SEQ ID NO: 98928 - DNA, 20 bp, human
gccgctcgccgggccactca

SEQ ID NO: 98929 - DNA, 20 bp, human
gctctggcgggaccccagcg

SEQ ID NO: 98930 - DNA, 20 bp, human
ggccacctccaaggacgaaa

SEQ ID NO: 98931 - DNA, 20 bp, human
gaggtggccgcgggctgagt

SEQ ID NO: 98932 - DNA, 20 bp, human
gagcccggaagcgcagaagc

SEQ ID NO: 98933 - DNA, 20 bp, human
ggtgggcgcgggtccgtgag

SEQ ID NO: 98934 - DNA, 20 bp, human
gccgagcccgactcagcccg

SEQ ID NO: 98935 - DNA, 20 bp, human
gggctcgggcgcggccgaca

SEQ ID NO: 98936 - DNA, 20 bp, human
gcgcggcgcagagggcacat

SEQ ID NO: 98937 - DNA, 20 bp, human
ggttcccgctgtctcagccg

SEQ ID NO: 98938 - DNA, 20 bp, human
gcagcctgagcggccgactg

SEQ ID NO: 98939 - DNA, 20 bp, human
gctgagaacgccgcaggcag

SEQ ID NO: 98940 - DNA, 20 bp, human
gccctagccgaggtcggagg

SEQ ID NO: 98941 - DNA, 20 bp, human
gagacagcgggaaccggccc

SEQ ID NO: 98942 - DNA, 20 bp, human
ggcactggcagccggctagt

SEQ ID NO: 98943 - DNA, 20 bp, human
gggcagccggctagtcggtc

SEQ ID NO: 98944 - DNA, 20 bp, human
gctgcgtcgctgtccgggaa

SEQ ID NO: 98945 - DNA, 20 bp, human
gcctgagcggccgactgagg

SEQ ID NO: 98946 - DNA, 20 bp, human
gaaggaatctcgctgctgag

SEQ ID NO: 98947 - DNA, 20 bp, human
gctgtcttacaacaaagcca

SEQ ID NO: 98948 - DNA, 20 bp, human
ggaaaggagggcgacaagaa

SEQ ID NO: 98949 - DNA, 20 bp, human
ggagccggggtcttaagact

SEQ ID NO: 98950 - DNA, 20 bp, human
gaatcccagtcttaagaccc

SEQ ID NO: 98951 - DNA, 20 bp, human
ggctacacaaagcgtatcca

SEQ ID NO: 98952 - DNA, 20 bp, human
gtcaacccctgtaaagaaag

SEQ ID NO: 98953 - DNA, 20 bp, human
ggctgctgaggggtgagccg

SEQ ID NO: 98954 - DNA, 20 bp, human
gcagcaaagggagagaccgc

SEQ ID NO: 98955 - DNA, 20 bp, human
gctctcccctttctttacag

SEQ ID NO: 98956 - DNA, 20 bp, human
gcgcccggaaaaccatgatg

SEQ ID NO: 98957 - DNA, 20 bp, human
ggccagccaaggcgctccgg

SEQ ID NO: 98958 - DNA, 20 bp, human
gaaccatgatgtggagaact

SEQ ID NO: 98959 - DNA, 20 bp, human
gaaccgacccgctaaggata

SEQ ID NO: 98960 - DNA, 20 bp, human
gcaacggtctcaggagcaga

SEQ ID NO: 98961 - DNA, 20 bp, human
gtctaggaaccacaaactta

SEQ ID NO: 98962 - DNA, 20 bp, human
gggcggttcgtcctaactgg

SEQ ID NO: 98963 - DNA, 20 bp, human
gtccgggggcgtggttacgt

SEQ ID NO: 98964 - DNA, 20 bp, human
ggcccacgtaaccacgcccc

SEQ ID NO: 98965 - DNA, 20 bp, human
ggcccccggagcgccttggc

SEQ ID NO: 98966 - DNA, 20 bp, human
gcagtccgagcagctcgaga

SEQ ID NO: 98967 - DNA, 20 bp, human
ggagcagctcgagatggtgg

SEQ ID NO: 98968 - DNA, 20 bp, human
gtccgagcagctcgagatgg

SEQ ID NO: 98969 - DNA, 20 bp, human
gaggaagctgacaacgacaa

SEQ ID NO: 98970 - DNA, 20 bp, human
gaagctgacaacgacaaggg

SEQ ID NO: 98971 - DNA, 20 bp, human
gtcgagctgctcggactgac

SEQ ID NO: 98972 - DNA, 20 bp, human
gtgaatgtgaagatctccaa

SEQ ID NO: 98973 - DNA, 20 bp, human
gcttgggcagacatttcagg

SEQ ID NO: 98974 - DNA, 20 bp, human
ggttgttcttatccaggtag

SEQ ID NO: 98975 - DNA, 20 bp, human
gtagagccggagctcgcgca

SEQ ID NO: 98976 - DNA, 20 bp, human
gcggcgcggggggcagacgg

SEQ ID NO: 98977 - DNA, 20 bp, human
gcggggccgggcggacacac

SEQ ID NO: 98978 - DNA, 20 bp, human
ggaaccccgaaaccccgtcc

SEQ ID NO: 98979 - DNA, 20 bp, human
gcgggaaagctgggaagcgg

SEQ ID NO: 98980 - DNA, 20 bp, human
gggccgggcggacacactgg

SEQ ID NO: 98981 - DNA, 20 bp, human
ggagcggcgcttacctgagg

SEQ ID NO: 98982 - DNA, 20 bp, human
gaaaggcagaggaaacctat

SEQ ID NO: 98983 - DNA, 20 bp, human
ggaggcaagagacacgagtc

SEQ ID NO: 98984 - DNA, 20 bp, human
gaggaaacctatgggctccc

SEQ ID NO: 98985 - DNA, 20 bp, human
gtcccgaccctgcccggacg

SEQ ID NO: 98986 - DNA, 20 bp, human
gctgctcagggaaccggcag

SEQ ID NO: 98987 - DNA, 20 bp, human
gcgccggccacagctccccg

SEQ ID NO: 98988 - DNA, 20 bp, human
gctgccctaaggaaaggata

SEQ ID NO: 98989 - DNA, 20 bp, human
gcgtccgctgctcagggaac

SEQ ID NO: 98990 - DNA, 20 bp, human
gtggaggctggaaaacaagt

SEQ ID NO: 98991 - DNA, 20 bp, human
gcagctgccactagccatgg

SEQ ID NO: 98992 - DNA, 20 bp, human
ggtcaggctgaacaatgtcc

SEQ ID NO: 98993 - DNA, 20 bp, human
gtgcggctccttaagagtcc

SEQ ID NO: 98994 - DNA, 20 bp, human
gcgggtttgagcagggtcaa

SEQ ID NO: 98995 - DNA, 20 bp, human
gcatgaacgtccgctgctca

SEQ ID NO: 98996 - DNA, 20 bp, human
ggcggacccggcacccacgg

SEQ ID NO: 98997 - DNA, 20 bp, human
gggcaacgagccggtgaacg

SEQ ID NO: 98998 - DNA, 20 bp, human
gcggccagggacttaccccg

SEQ ID NO: 98999 - DNA, 20 bp, human
ggtgcacctggtgtaagcaa

SEQ ID NO: 99000 - DNA, 20 bp, human
ggcgggcgccggcaacgagc

SEQ ID NO: 99001 - DNA, 20 bp, human
gcgcgcggacccggcaccca

SEQ ID NO: 99002 - DNA, 20 bp, human
gcgggcctcgcctcgttcac

SEQ ID NO: 99003 - DNA, 20 bp, human
gctgcggggagcacaaagcg

SEQ ID NO: 99004 - DNA, 20 bp, human
ggggctcagtcggctctcag

SEQ ID NO: 99005 - DNA, 20 bp, human
gagtcggctctcagaggcca

SEQ ID NO: 99006 - DNA, 20 bp, human
gggcgctctcaaggagcgcc

SEQ ID NO: 99007 - DNA, 20 bp, human
gctccggccgcgacgcgccc

SEQ ID NO: 99008 - DNA, 20 bp, human
gagcgcgaagccgggaagag

SEQ ID NO: 99009 - DNA, 20 bp, human
gtccagggcccagccggtga

SEQ ID NO: 99010 - DNA, 20 bp, human
gagcggcggagaagcgagtg

SEQ ID NO: 99011 - DNA, 20 bp, human
gcccagaagcggccagggag

SEQ ID NO: 99012 - DNA, 20 bp, human
gggagggcgagcgcgaagcc

SEQ ID NO: 99013 - DNA, 20 bp, human
gcccaacgtggagttatcct

SEQ ID NO: 99014 - DNA, 20 bp, human
gtatcctgggagcggctcca

SEQ ID NO: 99015 - DNA, 20 bp, human
gcggggaatcgtggacaccg

SEQ ID NO: 99016 - DNA, 20 bp, human
ggacaagaagaagacatcaa

SEQ ID NO: 99017 - DNA, 20 bp, human
gcagcacgcaaggacatcgg

SEQ ID NO: 99018 - DNA, 20 bp, human
ggatgcaccactaaccacca

SEQ ID NO: 99019 - DNA, 20 bp, human
ggaagagagatcctgtgagc

SEQ ID NO: 99020 - DNA, 20 bp, human
ggtcagtgtgacaactgatc

SEQ ID NO: 99021 - DNA, 20 bp, human
gacgcaaggacatcggaggt

SEQ ID NO: 99022 - DNA, 20 bp, human
gagacatcaaaggaggattt

SEQ ID NO: 99023 - DNA, 20 bp, human
gttgtttccatggtggttag

SEQ ID NO: 99024 - DNA, 20 bp, human
gtcacaggatctctcttcac

SEQ ID NO: 99025 - DNA, 20 bp, human
gatccagcacgcaaggacat

SEQ ID NO: 99026 - DNA, 20 bp, human
ggatcaagcagaggaagatc

SEQ ID NO: 99027 - DNA, 20 bp, human
gcagctaggagatcaagcag

SEQ ID NO: 99028 - DNA, 20 bp, human
gactcagctatgaactccag

SEQ ID NO: 99029 - DNA, 20 bp, human
gaggaagatccggcagccat

SEQ ID NO: 99030 - DNA, 20 bp, human
gagcagtgacctcatggcca

SEQ ID NO: 99031 - DNA, 20 bp, human
gccatgggctagcttgggag

SEQ ID NO: 99032 - DNA, 20 bp, human
gagctgacctgtgcaaccct

SEQ ID NO: 99033 - DNA, 20 bp, human
gatatggagcagtgacctca

SEQ ID NO: 99034 - DNA, 20 bp, human
gcaacccccatccactgaga

SEQ ID NO: 99035 - DNA, 20 bp, human
ggagttgctgtccaaatcag

SEQ ID NO: 99036 - DNA, 20 bp, human
ggagggatccccaagatctc

SEQ ID NO: 99037 - DNA, 20 bp, human
gcagcacagcctgagatctt

SEQ ID NO: 99038 - DNA, 20 bp, human
gtgcatcaaggcctacccac

SEQ ID NO: 99039 - DNA, 20 bp, human
gtccaccagctgacgtctgt

SEQ ID NO: 99040 - DNA, 20 bp, human
gcaaggcctacccactggtg

SEQ ID NO: 99041 - DNA, 20 bp, human
gacccacagacgtcagctgg

SEQ ID NO: 99042 - DNA, 20 bp, human
gtctgtgggtgttaggctga

SEQ ID NO: 99043 - DNA, 20 bp, human
ggctgacgtctgtgggtgtt

SEQ ID NO: 99044 - DNA, 20 bp, human
gtttgcacagatagcaggtg

SEQ ID NO: 99045 - DNA, 20 bp, human
ggcacagatagcaggtgggg

SEQ ID NO: 99046 - DNA, 20 bp, human
ggctcgcgccgcacactgcc

SEQ ID NO: 99047 - DNA, 20 bp, human
ggctcggctcggggctgcaa

SEQ ID NO: 99048 - DNA, 20 bp, human
gcggcaggaaggcgaagctc

SEQ ID NO: 99049 - DNA, 20 bp, human
gggctgcctcggaaacacag

SEQ ID NO: 99050 - DNA, 20 bp, human
gaagggcggccggcaaggcg

SEQ ID NO: 99051 - DNA, 20 bp, human
gacgacactcagtgagcagt

SEQ ID NO: 99052 - DNA, 20 bp, human
gaaaaggtggcgccggtcag

SEQ ID NO: 99053 - DNA, 20 bp, human
gggtggggaggtgcggacgg

SEQ ID NO: 99054 - DNA, 20 bp, human
ggtttccgcggagtaaaagg

SEQ ID NO: 99055 - DNA, 20 bp, human
ggtgcgcctgccagatccgc

SEQ ID NO: 99056 - DNA, 20 bp, human
gtggaggctgcattcagtcg

SEQ ID NO: 99057 - DNA, 20 bp, human
gccgagaaacggcacaagaa

SEQ ID NO: 99058 - DNA, 20 bp, human
ggaaaagcttttccgagaaa

SEQ ID NO: 99059 - DNA, 20 bp, human
gtaacttgttgatggcagat

SEQ ID NO: 99060 - DNA, 20 bp, human
gcccattcttctgagcacat

SEQ ID NO: 99061 - DNA, 20 bp, human
gattcttctgagcacattgg

SEQ ID NO: 99062 - DNA, 20 bp, human
gcttggtcttaacttgttga

SEQ ID NO: 99063 - DNA, 20 bp, human
gaatgcactcatgctgctcc

SEQ ID NO: 99064 - DNA, 20 bp, human
gtttccagagggatatccta

SEQ ID NO: 99065 - DNA, 20 bp, human
ggtaaaaggctctaacatgt

SEQ ID NO: 99066 - DNA, 20 bp, human
gagctgcgttggagcccaga

SEQ ID NO: 99067 - DNA, 20 bp, human
ggctgcactgtagtgagtca

SEQ ID NO: 99068 - DNA, 20 bp, human
gactacagtgcagctgacag

SEQ ID NO: 99069 - DNA, 20 bp, human
gaaatcggtccatctcccaa

SEQ ID NO: 99070 - DNA, 20 bp, human
ggggctccaacgcagctctg

SEQ ID NO: 99071 - DNA, 20 bp, human
gctcatcacgggaactgctg

SEQ ID NO: 99072 - DNA, 20 bp, human
gtgagcgtgtgcgcggtacg

SEQ ID NO: 99073 - DNA, 20 bp, human
gagccaaagcaaaagaccta

SEQ ID NO: 99074 - DNA, 20 bp, human
gttcagccacagagctgcgt

SEQ ID NO: 99075 - DNA, 20 bp, human
gggggtatggaatacagatg

SEQ ID NO: 99076 - DNA, 20 bp, human
gccgttggggggatagggat

SEQ ID NO: 99077 - DNA, 20 bp, human
ggcagggaaaaggaagccgt

SEQ ID NO: 99078 - DNA, 20 bp, human
gggaagccgttggggggata

SEQ ID NO: 99079 - DNA, 20 bp, human
gtaaaaaatcagcacagggt

SEQ ID NO: 99080 - DNA, 20 bp, human
gtctgagcatcatcagtctc

SEQ ID NO: 99081 - DNA, 20 bp, human
ggggaaaaggaagccgttgg

SEQ ID NO: 99082 - DNA, 20 bp, human
ggagctacagcccatctcgg

SEQ ID NO: 99083 - DNA, 20 bp, human
gggcaaaagccagcacaata

SEQ ID NO: 99084 - DNA, 20 bp, human
gtctctggtgaattacacaa

SEQ ID NO: 99085 - DNA, 20 bp, human
ggcacagggtgggatggttg

SEQ ID NO: 99086 - DNA, 20 bp, human
gggggtgacactcacgataa

SEQ ID NO: 99087 - DNA, 20 bp, human
gcaggggtcgccgcggtact

SEQ ID NO: 99088 - DNA, 20 bp, human
ggctggcaagcagggcaccg

SEQ ID NO: 99089 - DNA, 20 bp, human
ggacccgcgggtgcacccga

SEQ ID NO: 99090 - DNA, 20 bp, human
gggagtctggtctccttcaa

SEQ ID NO: 99091 - DNA, 20 bp, human
gggctgacggctggcaagca

SEQ ID NO: 99092 - DNA, 20 bp, human
gggcgcctgaggctgacggc

SEQ ID NO: 99093 - DNA, 20 bp, human
gggcaggccgatcactcgga

SEQ ID NO: 99094 - DNA, 20 bp, human
gagctagagattccgaaagg

SEQ ID NO: 99095 - DNA, 20 bp, human
ggccgcagaccacccggcac

SEQ ID NO: 99096 - DNA, 20 bp, human
ggtgcagagcaacacacgaa

SEQ ID NO: 99097 - DNA, 20 bp, human
ggagcaacacacgaagggca

SEQ ID NO: 99098 - DNA, 20 bp, human
gagatggtatcccctcacaa

SEQ ID NO: 99099 - DNA, 20 bp, human
gttgaagaaaagcaagggca

SEQ ID NO: 99100 - DNA, 20 bp, human
gttccaacgggaattgatca

SEQ ID NO: 99101 - DNA, 20 bp, human
gtatgtagttggcatgtcac

SEQ ID NO: 99102 - DNA, 20 bp, human
gcccctcacaaaggtatctg

SEQ ID NO: 99103 - DNA, 20 bp, human
ggttccacttttccccccaa

SEQ ID NO: 99104 - DNA, 20 bp, human
gcatgacatgaatatgtagt

SEQ ID NO: 99105 - DNA, 20 bp, human
ggaaacatggtgcttgtagt

SEQ ID NO: 99106 - DNA, 20 bp, human
gcgcagcacacagcaccagg

SEQ ID NO: 99107 - DNA, 20 bp, human
gaggcacctgagcatcccaa

SEQ ID NO: 99108 - DNA, 20 bp, human
ggactgcttgtggcagacgg

SEQ ID NO: 99109 - DNA, 20 bp, human
gctcttgtccccagcactgt

SEQ ID NO: 99110 - DNA, 20 bp, human
gcccaaaggtgcacgacact

SEQ ID NO: 99111 - DNA, 20 bp, human
gctccactcagcgggagcag

SEQ ID NO: 99112 - DNA, 20 bp, human
gccaggagggtcttactgga

SEQ ID NO: 99113 - DNA, 20 bp, human
gaagacgggtgagtaccgag

SEQ ID NO: 99114 - DNA, 20 bp, human
gccaggaggtggactgcttg

SEQ ID NO: 99115 - DNA, 20 bp, human
gaatcccaggagggtcttac

SEQ ID NO: 99116 - DNA, 20 bp, human
gtgggacgccaagactggag

SEQ ID NO: 99117 - DNA, 20 bp, human
gggcagtgggacgccaagac

SEQ ID NO: 99118 - DNA, 20 bp, human
gaagcgactgcgggtgagtc

SEQ ID NO: 99119 - DNA, 20 bp, human
gctggagaggaagcgactgc

SEQ ID NO: 99120 - DNA, 20 bp, human
ggttactcagagcaactcca

SEQ ID NO: 99121 - DNA, 20 bp, human
ggtcgcttcctctccagtct

SEQ ID NO: 99122 - DNA, 20 bp, human
gttggcgtcccactgcctca

SEQ ID NO: 99123 - DNA, 20 bp, human
gcgactgcgggtgagtcggg

SEQ ID NO: 99124 - DNA, 20 bp, human
ggtgagtcgggcgggaaaac

SEQ ID NO: 99125 - DNA, 20 bp, human
gcactcacatgggacagact

SEQ ID NO: 99126 - DNA, 20 bp, human
gtggccgactgggtcagcgc

SEQ ID NO: 99127 - DNA, 20 bp, human
gctcctgggctcagttaccg

SEQ ID NO: 99128 - DNA, 20 bp, human
ggtctcctggagcccggcac

SEQ ID NO: 99129 - DNA, 20 bp, human
gccaggccctctaacgatag

SEQ ID NO: 99130 - DNA, 20 bp, human
gagggagcccggacagttag

SEQ ID NO: 99131 - DNA, 20 bp, human
gctgtccgggctcccttcag

SEQ ID NO: 99132 - DNA, 20 bp, human
gtaccgcggacgccagtgcc

SEQ ID NO: 99133 - DNA, 20 bp, human
gggtgtggagtcgggagtag

SEQ ID NO: 99134 - DNA, 20 bp, human
gtagcagccgcgccgagagg

SEQ ID NO: 99135 - DNA, 20 bp, human
gagggcgacgccacacgccg

SEQ ID NO: 99136 - DNA, 20 bp, human
ggcaatctcagtaggaccag

SEQ ID NO: 99137 - DNA, 20 bp, human
gtccgcggggtgctctggag

SEQ ID NO: 99138 - DNA, 20 bp, human
ggcgcgctgctcgcgaggag

SEQ ID NO: 99139 - DNA, 20 bp, human
ggctgtttctgtacactcac

SEQ ID NO: 99140 - DNA, 20 bp, human
ggtggatgaaagccccgtgt

SEQ ID NO: 99141 - DNA, 20 bp, human
gcccgccagcctgggaaagt

SEQ ID NO: 99142 - DNA, 20 bp, human
gggctgaactctcctgacca

SEQ ID NO: 99143 - DNA, 20 bp, human
gtgaactctcctgaccatgg

SEQ ID NO: 99144 - DNA, 20 bp, human
gtggtggccacgccgaggtg

SEQ ID NO: 99145 - DNA, 20 bp, human
gtccacagcgagcgcagagc

SEQ ID NO: 99146 - DNA, 20 bp, human
gcccatggcaacacgaccgc

SEQ ID NO: 99147 - DNA, 20 bp, human
ggccgggaagcttcgtccag

SEQ ID NO: 99148 - DNA, 20 bp, human
gagcacttcagtggcttcta

SEQ ID NO: 99149 - DNA, 20 bp, human
ggaagttccaagcacttcag

SEQ ID NO: 99150 - DNA, 20 bp, human
gaccggccggggctctcctc

SEQ ID NO: 99151 - DNA, 20 bp, human
gaccgctggacgaagcttcc

SEQ ID NO: 99152 - DNA, 20 bp, human
gcccagcgacccaccggccg

SEQ ID NO: 99153 - DNA, 20 bp, human
gcccaaacgtactcaagacc

SEQ ID NO: 99154 - DNA, 20 bp, human
gaggcccagaacacaaaggt

SEQ ID NO: 99155 - DNA, 20 bp, human
gtatgcgccatcagactcag

SEQ ID NO: 99156 - DNA, 20 bp, human
gtagcagcaggctactgggt

SEQ ID NO: 99157 - DNA, 20 bp, human
ggaagtgggtaagggtaata

SEQ ID NO: 99158 - DNA, 20 bp, human
gggaggaagggtctaacccc

SEQ ID NO: 99159 - DNA, 20 bp, human
ggtgggtaagggtaatatgg

SEQ ID NO: 99160 - DNA, 20 bp, human
gggctcaccagctagagggc

SEQ ID NO: 99161 - DNA, 20 bp, human
ggaagtagcagcaggctact

SEQ ID NO: 99162 - DNA, 20 bp, human
gagaagtgctggtctcggtc

SEQ ID NO: 99163 - DNA, 20 bp, human
gtctaaccccgggctccacc

SEQ ID NO: 99164 - DNA, 20 bp, human
ggctgtggaggacatcgacg

SEQ ID NO: 99165 - DNA, 20 bp, human
ggctggtgagccccaagcga

SEQ ID NO: 99166 - DNA, 20 bp, human
gagaaaccatgccggcgacc

SEQ ID NO: 99167 - DNA, 20 bp, human
gctgcgcccggaggacagag

SEQ ID NO: 99168 - DNA, 20 bp, human
gtggactggctgcctcccgc

SEQ ID NO: 99169 - DNA, 20 bp, human
gtgacgcactctgcgcccgg

SEQ ID NO: 99170 - DNA, 20 bp, human
gaccgggccgctctgtcctc

SEQ ID NO: 99171 - DNA, 20 bp, human
gccgggcctgactcgaggtc

SEQ ID NO: 99172 - DNA, 20 bp, human
gagaacccgggcctgactcg

SEQ ID NO: 99173 - DNA, 20 bp, human
gtgatcgccctcctaggagg

SEQ ID NO: 99174 - DNA, 20 bp, human
ggactgcaaagagcagtcac

SEQ ID NO: 99175 - DNA, 20 bp, human
gcaggcccgggttctagaac

SEQ ID NO: 99176 - DNA, 20 bp, human
gcccgcaagccgaggccgat

SEQ ID NO: 99177 - DNA, 20 bp, human
gcccggcccgcggactcaca

SEQ ID NO: 99178 - DNA, 20 bp, human
ggaacgaagccgccagaggg

SEQ ID NO: 99179 - DNA, 20 bp, human
gccgcaggagcgggccggag

SEQ ID NO: 99180 - DNA, 20 bp, human
gcgtctcatggtggccaaag

SEQ ID NO: 99181 - DNA, 20 bp, human
gtcctcaggaccggagtccg

SEQ ID NO: 99182 - DNA, 20 bp, human
gcttgcgggcctttcaaaca

SEQ ID NO: 99183 - DNA, 20 bp, human
gcgcctccgccgtctcatgg

SEQ ID NO: 99184 - DNA, 20 bp, human
gaaacatggaggagcgggag

SEQ ID NO: 99185 - DNA, 20 bp, human
gggccaccatgagacggcgg

SEQ ID NO: 99186 - DNA, 20 bp, human
gggcagcagcgggcgaaagc

SEQ ID NO: 99187 - DNA, 20 bp, human
gcgcggctgcactcccaaga

SEQ ID NO: 99188 - DNA, 20 bp, human
ggtggaggagggcttgacac

SEQ ID NO: 99189 - DNA, 20 bp, human
ggggctttaccgaggatcag

SEQ ID NO: 99190 - DNA, 20 bp, human
gcccgcaaagagagagagac

SEQ ID NO: 99191 - DNA, 20 bp, human
gttgggagtgcagccgcggc

SEQ ID NO: 99192 - DNA, 20 bp, human
gagctgaccgaagggcccgc

SEQ ID NO: 99193 - DNA, 20 bp, human
gtcctccacccactgatcct

SEQ ID NO: 99194 - DNA, 20 bp, human
ggatccccaaagctgaccga

SEQ ID NO: 99195 - DNA, 20 bp, human
gccgggccggcgtgtaggtg

SEQ ID NO: 99196 - DNA, 20 bp, human
gcgtgcggagcgggcgacag

SEQ ID NO: 99197 - DNA, 20 bp, human
gcggcggcggcgccatgagc

SEQ ID NO: 99198 - DNA, 20 bp, human
gcgccatgttgggtctgaag

SEQ ID NO: 99199 - DNA, 20 bp, human
gcaggcgcggacattccggg

SEQ ID NO: 99200 - DNA, 20 bp, human
gtaggcgccgacggagcgag

SEQ ID NO: 99201 - DNA, 20 bp, human
gcggagctcgacggagggag

SEQ ID NO: 99202 - DNA, 20 bp, human
gaaaccagggagccgcgggg

SEQ ID NO: 99203 - DNA, 20 bp, human
ggagcgggcgacagtggcgt

SEQ ID NO: 99204 - DNA, 20 bp, human
gtcccgcgtacctttggcaa

SEQ ID NO: 99205 - DNA, 20 bp, human
ggcctcccggagctcgacgg

SEQ ID NO: 99206 - DNA, 20 bp, human
gcaccgagcgaaccaagaag

SEQ ID NO: 99207 - DNA, 20 bp, human
gcccgcgcaggcccctcggg

SEQ ID NO: 99208 - DNA, 20 bp, human
gcctcaggcaccccgtatct

SEQ ID NO: 99209 - DNA, 20 bp, human
gccagtcgcgcgccccttct

SEQ ID NO: 99210 - DNA, 20 bp, human
gggcgcgggcaggggatctc

SEQ ID NO: 99211 - DNA, 20 bp, human
gtggcgctcgccaaaggtag

SEQ ID NO: 99212 - DNA, 20 bp, human
gcggcgcgaggccccggatg

SEQ ID NO: 99213 - DNA, 20 bp, human
ggcgtccggggtgaaggcgc

SEQ ID NO: 99214 - DNA, 20 bp, human
gcctcctcgccaccgcccga

SEQ ID NO: 99215 - DNA, 20 bp, human
ggatcttgctgcccagatac

SEQ ID NO: 99216 - DNA, 20 bp, human
gacagcagggtgctgcgagc

SEQ ID NO: 99217 - DNA, 20 bp, human
ggaaagctccaagcgctgac

SEQ ID NO: 99218 - DNA, 20 bp, human
gcaagctgggtagagtagag

SEQ ID NO: 99219 - DNA, 20 bp, human
gctggcagagaagtgctctg

SEQ ID NO: 99220 - DNA, 20 bp, human
ggccggaccgggaagacagc

SEQ ID NO: 99221 - DNA, 20 bp, human
gaaccatgcgaggtccccga

SEQ ID NO: 99222 - DNA, 20 bp, human
ggtaccgtgacgtcaaaagg

SEQ ID NO: 99223 - DNA, 20 bp, human
gggtgctgcgagcaggtctg

SEQ ID NO: 99224 - DNA, 20 bp, human
gccctgagagagattcagtg

SEQ ID NO: 99225 - DNA, 20 bp, human
ggacgtcacggtacccacca

SEQ ID NO: 99226 - DNA, 20 bp, human
gcgttctagcgcatcgcggc

SEQ ID NO: 99227 - DNA, 20 bp, human
gtctcgcgagaggcgggaaa

SEQ ID NO: 99228 - DNA, 20 bp, human
gatggcggacgacgtagacc

SEQ ID NO: 99229 - DNA, 20 bp, human
ggtgagaatagtcatcaggt

SEQ ID NO: 99230 - DNA, 20 bp, human
ggctcttgtgttctcgcgag

SEQ ID NO: 99231 - DNA, 20 bp, human
gggcactgttctaagggcca

SEQ ID NO: 99232 - DNA, 20 bp, human
gcgaaggagcttcttgtact

SEQ ID NO: 99233 - DNA, 20 bp, human
gatggttaggcactgttcta

SEQ ID NO: 99234 - DNA, 20 bp, human
gacatcagctttgtatggtt

SEQ ID NO: 99235 - DNA, 20 bp, human
gggcctacggcaaaattcgg

SEQ ID NO: 99236 - DNA, 20 bp, human
ggtgagggcagggcaactgc

SEQ ID NO: 99237 - DNA, 20 bp, human
ggcggcgcggcgacgaccgc

SEQ ID NO: 99238 - DNA, 20 bp, human
gcccgccggcaccatggtga

SEQ ID NO: 99239 - DNA, 20 bp, human
ggactgggcccgaagcgtaa

SEQ ID NO: 99240 - DNA, 20 bp, human
gccgctgcacacgctcccgg

SEQ ID NO: 99241 - DNA, 20 bp, human
gactagagtgctgggaagta

SEQ ID NO: 99242 - DNA, 20 bp, human
gcggcggggaccgggctcgc

SEQ ID NO: 99243 - DNA, 20 bp, human
gcctgccctcaccatggtgc

SEQ ID NO: 99244 - DNA, 20 bp, human
gactgcggggtctcaccggg

SEQ ID NO: 99245 - DNA, 20 bp, human
gggcaactgcggggtctcac

SEQ ID NO: 99246 - DNA, 20 bp, human
ggtagtagcgttagccgcca

SEQ ID NO: 99247 - DNA, 20 bp, human
ggcctgccttcattgatggt

SEQ ID NO: 99248 - DNA, 20 bp, human
gggcagcagctgcgacgggt

SEQ ID NO: 99249 - DNA, 20 bp, human
gaaggacggcgattacctaa

SEQ ID NO: 99250 - DNA, 20 bp, human
gtaagggcagcagctgcgac

SEQ ID NO: 99251 - DNA, 20 bp, human
gacatggtctatctaatctg

SEQ ID NO: 99252 - DNA, 20 bp, human
gacttccggcgtagccatgg

SEQ ID NO: 99253 - DNA, 20 bp, human
ggtcgtcccaccatcaatga

SEQ ID NO: 99254 - DNA, 20 bp, human
gtaaggctcattccggacca

SEQ ID NO: 99255 - DNA, 20 bp, human
ggccacttccggcgtagcca

SEQ ID NO: 99256 - DNA, 20 bp, human
gcaggtcccgcggacaccac

SEQ ID NO: 99257 - DNA, 20 bp, human
ggccgcacctccaggtcccg

SEQ ID NO: 99258 - DNA, 20 bp, human
ggcagagcctgtggtgtccg

SEQ ID NO: 99259 - DNA, 20 bp, human
gacgggggccacagaggcaa

SEQ ID NO: 99260 - DNA, 20 bp, human
gaatccagggaggaaaaagc

SEQ ID NO: 99261 - DNA, 20 bp, human
gataaggacgggggccacag

SEQ ID NO: 99262 - DNA, 20 bp, human
gtgtgccacgccgcacctcc

SEQ ID NO: 99263 - DNA, 20 bp, human
gggggcttacgtgacccggg

SEQ ID NO: 99264 - DNA, 20 bp, human
gtgctttgagattgaatcca

SEQ ID NO: 99265 - DNA, 20 bp, human
ggacttgacgaggagcggcg

SEQ ID NO: 99266 - DNA, 20 bp, human
ggcggtgcggctcacctcgc

SEQ ID NO: 99267 - DNA, 20 bp, human
gtgagggttctggttcccgc

SEQ ID NO: 99268 - DNA, 20 bp, human
gttttggctgggatcatccg

SEQ ID NO: 99269 - DNA, 20 bp, human
gtggctgggatcatccgcgg

SEQ ID NO: 99270 - DNA, 20 bp, human
gcgcggcggccgggctcgtg

SEQ ID NO: 99271 - DNA, 20 bp, human
gaccgaaagcgccgaggcag

SEQ ID NO: 99272 - DNA, 20 bp, human
gtcgtggggcgcctggagtg

SEQ ID NO: 99273 - DNA, 20 bp, human
gttagcgtcggggctccctg

SEQ ID NO: 99274 - DNA, 20 bp, human
gctgggagaggtctgatggt

SEQ ID NO: 99275 - DNA, 20 bp, human
gaggttgttgaagttcccca

SEQ ID NO: 99276 - DNA, 20 bp, human
gaagcagagcgcatgagacc

SEQ ID NO: 99277 - DNA, 20 bp, human
ggcccgagctccacgccccc

SEQ ID NO: 99278 - DNA, 20 bp, human
ggtgcctgcgaagagccaca

SEQ ID NO: 99279 - DNA, 20 bp, human
gacacggcgcgacaagatgg

SEQ ID NO: 99280 - DNA, 20 bp, human
ggccacacggcgcgacaaga

SEQ ID NO: 99281 - DNA, 20 bp, human
ggtgagcgcgcggcggaatc

SEQ ID NO: 99282 - DNA, 20 bp, human
ggatggcggtgagcgcgcgg

SEQ ID NO: 99283 - DNA, 20 bp, human
gcagggaggccgcgaaggtg

SEQ ID NO: 99284 - DNA, 20 bp, human
gcgatccgggtaaagttcca

SEQ ID NO: 99285 - DNA, 20 bp, human
gaaagagggggtaccgacag

SEQ ID NO: 99286 - DNA, 20 bp, human
gtcagttaccaactaaatca

SEQ ID NO: 99287 - DNA, 20 bp, human
gtaccaactaaatcagggca

SEQ ID NO: 99288 - DNA, 20 bp, human
gcaccatgccctgatttagt

SEQ ID NO: 99289 - DNA, 20 bp, human
gatttagttggtaactgatg

SEQ ID NO: 99290 - DNA, 20 bp, human
gagccccaggatgaaactgt

SEQ ID NO: 99291 - DNA, 20 bp, human
gtggggcttatgggtctcat

SEQ ID NO: 99292 - DNA, 20 bp, human
gatgtgaagaggcattgact

SEQ ID NO: 99293 - DNA, 20 bp, human
ggaccaacagtttcatcctg

SEQ ID NO: 99294 - DNA, 20 bp, human
ggaattatgattctcgagtc

SEQ ID NO: 99295 - DNA, 20 bp, human
gtgaagttaccgtccttatc

SEQ ID NO: 99296 - DNA, 20 bp, human
gggcagtcgggggccaatga

SEQ ID NO: 99297 - DNA, 20 bp, human
gctacaggctgtgctcaggt

SEQ ID NO: 99298 - DNA, 20 bp, human
gtgctactggatgccatcat

SEQ ID NO: 99299 - DNA, 20 bp, human
gtggcatccagtagcaggac

SEQ ID NO: 99300 - DNA, 20 bp, human
ggactggacaaatgcagcag

SEQ ID NO: 99301 - DNA, 20 bp, human
gcagggcctgaggtgacaag

SEQ ID NO: 99302 - DNA, 20 bp, human
gtaggagagggtgaccatga

SEQ ID NO: 99303 - DNA, 20 bp, human
gggcaagcagtgggcagtcg

SEQ ID NO: 99304 - DNA, 20 bp, human
gagagggtgaccatgaggga

SEQ ID NO: 99305 - DNA, 20 bp, human
gaaccggccaggcagctgac

SEQ ID NO: 99306 - DNA, 20 bp, human
ggggagcacttgtgatcgga

SEQ ID NO: 99307 - DNA, 20 bp, human
gaaaatttagcacacggcgc

SEQ ID NO: 99308 - DNA, 20 bp, human
gaaggcaatctgggccttgc

SEQ ID NO: 99309 - DNA, 20 bp, human
gtgtcaaaaaatttagcaca

SEQ ID NO: 99310 - DNA, 20 bp, human
gactggctgttttgttaatg

SEQ ID NO: 99311 - DNA, 20 bp, human
gtagcacacggcgcgggcgc

SEQ ID NO: 99312 - DNA, 20 bp, human
gaatcagagtcatagcttgg

SEQ ID NO: 99313 - DNA, 20 bp, human
gtggaatcagagtcatagct

SEQ ID NO: 99314 - DNA, 20 bp, human
gcaggcgcggagaggcgcac

SEQ ID NO: 99315 - DNA, 20 bp, human
gccagctgtgaaaggaccgc

SEQ ID NO: 99316 - DNA, 20 bp, human
gggcttaggggtgagcggcg

SEQ ID NO: 99317 - DNA, 20 bp, human
gacacaagggtgggagccga

SEQ ID NO: 99318 - DNA, 20 bp, human
gtggccggcgggctctccag

SEQ ID NO: 99319 - DNA, 20 bp, human
gtggacggtgagacccggag

SEQ ID NO: 99320 - DNA, 20 bp, human
ggttcggcccaggtacacaa

SEQ ID NO: 99321 - DNA, 20 bp, human
gcggcctgcggcggccgggt

SEQ ID NO: 99322 - DNA, 20 bp, human
ggtgcgcccaagtcccatcc

SEQ ID NO: 99323 - DNA, 20 bp, human
gcaagacccaggggatcgga

SEQ ID NO: 99324 - DNA, 20 bp, human
gcctgggccgaaccattcac

SEQ ID NO: 99325 - DNA, 20 bp, human
gacgccggagggaactgtag

SEQ ID NO: 99326 - DNA, 20 bp, human
ggcgagctcgggaccctgag

SEQ ID NO: 99327 - DNA, 20 bp, human
gctgcagcagcaatgacgga

SEQ ID NO: 99328 - DNA, 20 bp, human
ggacatctggcagctggcag

SEQ ID NO: 99329 - DNA, 20 bp, human
gggtcccgggtgcggacatc

SEQ ID NO: 99330 - DNA, 20 bp, human
gagtcgccagcggccgaggt

SEQ ID NO: 99331 - DNA, 20 bp, human
gccgcgaacgcagttcccgt

SEQ ID NO: 99332 - DNA, 20 bp, human
gagagaaaacgtgctcctca

SEQ ID NO: 99333 - DNA, 20 bp, human
ggctccgcggaagcaactta

SEQ ID NO: 99334 - DNA, 20 bp, human
gagcactgcagcagcaatga

SEQ ID NO: 99335 - DNA, 20 bp, human
ggcggagcgtcagcgagctc

SEQ ID NO: 99336 - DNA, 20 bp, human
gggatggacagactccaaac

SEQ ID NO: 99337 - DNA, 20 bp, human
gcaaactggccagtgctgtc

SEQ ID NO: 99338 - DNA, 20 bp, human
gaccctcaaacaggaaccag

SEQ ID NO: 99339 - DNA, 20 bp, human
gtggaggccataagggccgt

SEQ ID NO: 99340 - DNA, 20 bp, human
gctcttcagccagacagcac

SEQ ID NO: 99341 - DNA, 20 bp, human
gatgctgctagggctgaagt

SEQ ID NO: 99342 - DNA, 20 bp, human
ggaaccagtggttggagggg

SEQ ID NO: 99343 - DNA, 20 bp, human
gtcaaacaggaaccagtggt

SEQ ID NO: 99344 - DNA, 20 bp, human
gcctagcagcatctgcctgt

SEQ ID NO: 99345 - DNA, 20 bp, human
ggaggggaggaagtgcctga

SEQ ID NO: 99346 - DNA, 20 bp, human
gtaggtcagggatcagggac

SEQ ID NO: 99347 - DNA, 20 bp, human
gccgcgataacattaggtca

SEQ ID NO: 99348 - DNA, 20 bp, human
gggatcagggactggcctgg

SEQ ID NO: 99349 - DNA, 20 bp, human
gcagctggtacaggagggaa

SEQ ID NO: 99350 - DNA, 20 bp, human
ggggaagagggctcaaggtt

SEQ ID NO: 99351 - DNA, 20 bp, human
gagaaacctggtaagaggtg

SEQ ID NO: 99352 - DNA, 20 bp, human
gaaggaccactgccagaagc

SEQ ID NO: 99353 - DNA, 20 bp, human
gtgtgttggctgcatcgaag

SEQ ID NO: 99354 - DNA, 20 bp, human
gaaagctgcaaccaaccagg

SEQ ID NO: 99355 - DNA, 20 bp, human
gaagatatatgtatctacgg

SEQ ID NO: 99356 - DNA, 20 bp, human
gagtccaaagcacgaagcac

SEQ ID NO: 99357 - DNA, 20 bp, human
gcctgagcgtccgggcccag

SEQ ID NO: 99358 - DNA, 20 bp, human
ggaacgtctcttcctcccaa

SEQ ID NO: 99359 - DNA, 20 bp, human
ggagagcctcacctgctgtg

SEQ ID NO: 99360 - DNA, 20 bp, human
gggtgccacacacccttggg

SEQ ID NO: 99361 - DNA, 20 bp, human
ggacgttcaggtggtgtcat

SEQ ID NO: 99362 - DNA, 20 bp, human
gggtggtgccacacaccctt

SEQ ID NO: 99363 - DNA, 20 bp, human
ggagagagagacagtgagcg

SEQ ID NO: 99364 - DNA, 20 bp, human
gggaggaagagacgttcagg

SEQ ID NO: 99365 - DNA, 20 bp, human
ggcagagggcaggacactgc

SEQ ID NO: 99366 - DNA, 20 bp, human
gggtgctgtgagagatctgg

SEQ ID NO: 99367 - DNA, 20 bp, human
gaacaggtatccactatctc

SEQ ID NO: 99368 - DNA, 20 bp, human
gcgtaagcggggttgagaag

SEQ ID NO: 99369 - DNA, 20 bp, human
gtgcgcagcctggtacagtg

SEQ ID NO: 99370 - DNA, 20 bp, human
gcgcaaggactagggtcgag

SEQ ID NO: 99371 - DNA, 20 bp, human
gctcgtcgatagagaacctg

SEQ ID NO: 99372 - DNA, 20 bp, human
gggttctctatcgacgagtc

SEQ ID NO: 99373 - DNA, 20 bp, human
ggagacatacgtataagtgg

SEQ ID NO: 99374 - DNA, 20 bp, human
gaggggtgctgtgagagatc

SEQ ID NO: 99375 - DNA, 20 bp, human
gagaggatccaggcgagggg

SEQ ID NO: 99376 - DNA, 20 bp, human
gcaggggtgggaggctccag

SEQ ID NO: 99377 - DNA, 20 bp, human
gcctgccacagctagcagga

SEQ ID NO: 99378 - DNA, 20 bp, human
gtgctggtaggagaaacccc

SEQ ID NO: 99379 - DNA, 20 bp, human
gagagggggcaaaagaccac

SEQ ID NO: 99380 - DNA, 20 bp, human
gggagaaacagatgtacctc

SEQ ID NO: 99381 - DNA, 20 bp, human
gtagtgccccaggatcaggg

SEQ ID NO: 99382 - DNA, 20 bp, human
gaagcaaggcataggtactt

SEQ ID NO: 99383 - DNA, 20 bp, human
gcaaggcataggtacttggg

SEQ ID NO: 99384 - DNA, 20 bp, human
gacggagacggccgaccccg

SEQ ID NO: 99385 - DNA, 20 bp, human
ggaccacaggcacaaccaga

SEQ ID NO: 99386 - DNA, 20 bp, human
gcggggcagcagatctccag

SEQ ID NO: 99387 - DNA, 20 bp, human
gcggtgaagacgtagagcac

SEQ ID NO: 99388 - DNA, 20 bp, human
gggaaacggggacctgcccg

SEQ ID NO: 99389 - DNA, 20 bp, human
gagagccgcgtgaggaaacg

SEQ ID NO: 99390 - DNA, 20 bp, human
gcccaggctcctccaaactg

SEQ ID NO: 99391 - DNA, 20 bp, human
ggcggcaatggagacccggg

SEQ ID NO: 99392 - DNA, 20 bp, human
ggccgcggcaatggagaccc

SEQ ID NO: 99393 - DNA, 20 bp, human
gtccaaactgagggattatg

SEQ ID NO: 99394 - DNA, 20 bp, human
ggccttcgaagagccgcgtg

SEQ ID NO: 99395 - DNA, 20 bp, human
gtcctcacgcggctcttcga

SEQ ID NO: 99396 - DNA, 20 bp, human
gtccttctgggcctacaggt

SEQ ID NO: 99397 - DNA, 20 bp, human
gggcatggcaccttctcatc

SEQ ID NO: 99398 - DNA, 20 bp, human
gggttaagcagcagtaggcg

SEQ ID NO: 99399 - DNA, 20 bp, human
gcgccacagagggcgttcag

SEQ ID NO: 99400 - DNA, 20 bp, human
gcgtggaagtcaggactccc

SEQ ID NO: 99401 - DNA, 20 bp, human
gccttctcatcgggcatcac

SEQ ID NO: 99402 - DNA, 20 bp, human
gggccagactagaggagtgg

SEQ ID NO: 99403 - DNA, 20 bp, human
gtaccctctgcaaatgtgat

SEQ ID NO: 99404 - DNA, 20 bp, human
ggcgccttccacccacctgt

SEQ ID NO: 99405 - DNA, 20 bp, human
gaggctgcagggaagtaagg

SEQ ID NO: 99406 - DNA, 20 bp, human
gacagcagtgtgaatggagg

SEQ ID NO: 99407 - DNA, 20 bp, human
gacagagcagcgagcactga

SEQ ID NO: 99408 - DNA, 20 bp, human
gagagagcccacaacccgac

SEQ ID NO: 99409 - DNA, 20 bp, human
gcagacagcagtgtgaatgg

SEQ ID NO: 99410 - DNA, 20 bp, human
gctcgctgctctgtattcag

SEQ ID NO: 99411 - DNA, 20 bp, human
ggtgtctctgaaacaggagt

SEQ ID NO: 99412 - DNA, 20 bp, human
gcggccacgaacttccgagt

SEQ ID NO: 99413 - DNA, 20 bp, human
gggttactcactaggagcgg

SEQ ID NO: 99414 - DNA, 20 bp, human
gaagcagacagcagtgtgaa

SEQ ID NO: 99415 - DNA, 20 bp, human
ggtaaagtgacctgcaccaa

SEQ ID NO: 99416 - DNA, 20 bp, human
gtgcccaaagggaccccgta

SEQ ID NO: 99417 - DNA, 20 bp, human
gcgtctgaaggggacccgga

SEQ ID NO: 99418 - DNA, 20 bp, human
ggcacagggaggaggcgcga

SEQ ID NO: 99419 - DNA, 20 bp, human
ggtgcctgcagccgtctgaa

SEQ ID NO: 99420 - DNA, 20 bp, human
gcccgtagggagatacgagc

SEQ ID NO: 99421 - DNA, 20 bp, human
gtcaccctggctctcttcgt

SEQ ID NO: 99422 - DNA, 20 bp, human
gtgccgggtagctgccccca

SEQ ID NO: 99423 - DNA, 20 bp, human
ggccggctcgtatctcccta

SEQ ID NO: 99424 - DNA, 20 bp, human
gtggagacgcgaatcgactg

SEQ ID NO: 99425 - DNA, 20 bp, human
ggcggcaggaagcctctcca

SEQ ID NO: 99426 - DNA, 20 bp, human
gaactcaggcaggagcgagg

SEQ ID NO: 99427 - DNA, 20 bp, human
gaggaggccggagcaagttg

SEQ ID NO: 99428 - DNA, 20 bp, human
gaggccggagcaagttgagg

SEQ ID NO: 99429 - DNA, 20 bp, human
gccgcgcccgaagggagtag

SEQ ID NO: 99430 - DNA, 20 bp, human
gctgggcggcagggtcgagg

SEQ ID NO: 99431 - DNA, 20 bp, human
gagccccgggagagggtagg

SEQ ID NO: 99432 - DNA, 20 bp, human
gaggtccgcttgcagatcac

SEQ ID NO: 99433 - DNA, 20 bp, human
gtggtctgggcttcgtcctg

SEQ ID NO: 99434 - DNA, 20 bp, human
gcggatgcccgggccccgag

SEQ ID NO: 99435 - DNA, 20 bp, human
ggcccgcgagcgcttcaagg

SEQ ID NO: 99436 - DNA, 20 bp, human
gtagtgcaagggaatatcag

SEQ ID NO: 99437 - DNA, 20 bp, human
ggcggcgctgcagccatggc

SEQ ID NO: 99438 - DNA, 20 bp, human
gccctcacgtgggacatcac

SEQ ID NO: 99439 - DNA, 20 bp, human
ggagcgcggcgctgcagcca

SEQ ID NO: 99440 - DNA, 20 bp, human
gctgctctgggtgtcgctat

SEQ ID NO: 99441 - DNA, 20 bp, human
gggtgctgctggcgcagcta

SEQ ID NO: 99442 - DNA, 20 bp, human
gtggaggagacagtcctcca

SEQ ID NO: 99443 - DNA, 20 bp, human
gggtggtggtcccgagagag

SEQ ID NO: 99444 - DNA, 20 bp, human
ggcgcaggccgcacacgacc

SEQ ID NO: 99445 - DNA, 20 bp, human
gtcaggggctatttgaggaa

SEQ ID NO: 99446 - DNA, 20 bp, human
ggaggagagtcagaaggggg

SEQ ID NO: 99447 - DNA, 20 bp, human
gatcgcagtcccggacacag

SEQ ID NO: 99448 - DNA, 20 bp, human
gcctgcttcccagacttagg

SEQ ID NO: 99449 - DNA, 20 bp, human
gtcccttggggactgaggag

SEQ ID NO: 99450 - DNA, 20 bp, human
gctacagagatacggtgaga

SEQ ID NO: 99451 - DNA, 20 bp, human
gcagtcccggacacagcggt

SEQ ID NO: 99452 - DNA, 20 bp, human
gcaggagaagattggggtag

SEQ ID NO: 99453 - DNA, 20 bp, human
gtgtccgggactgcgatcct

SEQ ID NO: 99454 - DNA, 20 bp, human
gcaagatgggggatacaaag

SEQ ID NO: 99455 - DNA, 20 bp, human
ggcgctagcgaaggcgggtg

SEQ ID NO: 99456 - DNA, 20 bp, human
gggttctccgacgcatatgg

SEQ ID NO: 99457 - DNA, 20 bp, human
ggagcctgggacgggactca

SEQ ID NO: 99458 - DNA, 20 bp, human
ggcctccagggctcccatgg

SEQ ID NO: 99459 - DNA, 20 bp, human
gtcggagaaccagacctgca

SEQ ID NO: 99460 - DNA, 20 bp, human
gggagagaagaattagtcag

SEQ ID NO: 99461 - DNA, 20 bp, human
gacgtcctgggcagcggtgg

SEQ ID NO: 99462 - DNA, 20 bp, human
gctggccgctcccggccctg

SEQ ID NO: 99463 - DNA, 20 bp, human
gtccgccatgggagccctgg

SEQ ID NO: 99464 - DNA, 20 bp, human
ggcaggaggcccgacgtcct

SEQ ID NO: 99465 - DNA, 20 bp, human
gccgatgtgcaccccagggc

SEQ ID NO: 99466 - DNA, 20 bp, human
ggcccgtgccaccacaccga

SEQ ID NO: 99467 - DNA, 20 bp, human
gaagcagagccagggaatgg

SEQ ID NO: 99468 - DNA, 20 bp, human
ggtcctctgagcagcagacg

SEQ ID NO: 99469 - DNA, 20 bp, human
gccacgtggtcccagtatgg

SEQ ID NO: 99470 - DNA, 20 bp, human
ggacggtaccatgaaggacg

SEQ ID NO: 99471 - DNA, 20 bp, human
ggcccaagctggaagagggt

SEQ ID NO: 99472 - DNA, 20 bp, human
gaccacgtggagcagggtag

SEQ ID NO: 99473 - DNA, 20 bp, human
gcatggtaccgtcggtgtgg

SEQ ID NO: 99474 - DNA, 20 bp, human
gggactttcagggaactggg

SEQ ID NO: 99475 - DNA, 20 bp, human
ggcaagcggcccccattccc

SEQ ID NO: 99476 - DNA, 20 bp, human
gcccgaggaacagcaggacg

SEQ ID NO: 99477 - DNA, 20 bp, human
gaggcacctgcactcaccga

SEQ ID NO: 99478 - DNA, 20 bp, human
ggaggcgacttggcaaacga

SEQ ID NO: 99479 - DNA, 20 bp, human
gctgcggtctggaggcgact

SEQ ID NO: 99480 - DNA, 20 bp, human
gcctcgcaggagctaggatc

SEQ ID NO: 99481 - DNA, 20 bp, human
gcccagcgcctacagccggg

SEQ ID NO: 99482 - DNA, 20 bp, human
ggcactcaccgagggccccg

SEQ ID NO: 99483 - DNA, 20 bp, human
ggcaggagacgcccatcagg

SEQ ID NO: 99484 - DNA, 20 bp, human
gagctaggcgtgccccgatc

SEQ ID NO: 99485 - DNA, 20 bp, human
ggcgggacacaaagggacag

SEQ ID NO: 99486 - DNA, 20 bp, human
gccctggccaccacttacag

SEQ ID NO: 99487 - DNA, 20 bp, human
gggcagcacacccctgtaag

SEQ ID NO: 99488 - DNA, 20 bp, human
gccggggagtgtctcgccag

SEQ ID NO: 99489 - DNA, 20 bp, human
ggttgaggaaagcattgggg

SEQ ID NO: 99490 - DNA, 20 bp, human
gtcaacaggccaggtgtcag

SEQ ID NO: 99491 - DNA, 20 bp, human
gcaggggaccgtccagcctg

SEQ ID NO: 99492 - DNA, 20 bp, human
gtggtggccccgccccaagg

SEQ ID NO: 99493 - DNA, 20 bp, human
ggggccaccaatctaagttg

SEQ ID NO: 99494 - DNA, 20 bp, human
gtggatcacgcagcttggga

SEQ ID NO: 99495 - DNA, 20 bp, human
ggtcaactttaggttgacag

SEQ ID NO: 99496 - DNA, 20 bp, human
gggaacctgagggtgagcgg

SEQ ID NO: 99497 - DNA, 20 bp, human
gacagctgcaaccgcgacca

SEQ ID NO: 99498 - DNA, 20 bp, human
gctgcaaccgcgaccatggg

SEQ ID NO: 99499 - DNA, 20 bp, human
gtctgcggtaacctccacag

SEQ ID NO: 99500 - DNA, 20 bp, human
gactctgagcactcagaccc

SEQ ID NO: 99501 - DNA, 20 bp, human
gggacgcacacacaacagag

SEQ ID NO: 99502 - DNA, 20 bp, human
ggtcccggacgtgtcaaccg

SEQ ID NO: 99503 - DNA, 20 bp, human
ggaacaagcagcgaactaaa

SEQ ID NO: 99504 - DNA, 20 bp, human
gaaaggagaggcacaatctg

SEQ ID NO: 99505 - DNA, 20 bp, human
gtctggccgaggtagcgggt

SEQ ID NO: 99506 - DNA, 20 bp, human
gaagtccggcggggagacca

SEQ ID NO: 99507 - DNA, 20 bp, human
ggcggcgctcacccccaaca

SEQ ID NO: 99508 - DNA, 20 bp, human
ggagaccaaggtccagctga

SEQ ID NO: 99509 - DNA, 20 bp, human
gtgacaccctcgaagtccgg

SEQ ID NO: 99510 - DNA, 20 bp, human
gacgttatcgccgggtcctg

SEQ ID NO: 99511 - DNA, 20 bp, human
gctctccgggccacatccca

SEQ ID NO: 99512 - DNA, 20 bp, human
gcgatgacaccctcgaagtc

SEQ ID NO: 99513 - DNA, 20 bp, human
gtctccccgccggacttcga

SEQ ID NO: 99514 - DNA, 20 bp, human
gacatcccagggaggctcgg

SEQ ID NO: 99515 - DNA, 20 bp, human
gtccgggccacatcccaggg

SEQ ID NO: 99516 - DNA, 20 bp, human
gcggacatggtagccggcgg

SEQ ID NO: 99517 - DNA, 20 bp, human
gtcgggacggtgagtcagag

SEQ ID NO: 99518 - DNA, 20 bp, human
gacttctctcaggcaggcgg

SEQ ID NO: 99519 - DNA, 20 bp, human
gccctgctggaccagctcat

SEQ ID NO: 99520 - DNA, 20 bp, human
gagcaggacggtacatagga

SEQ ID NO: 99521 - DNA, 20 bp, human
gtcaagcgctggctacacag

SEQ ID NO: 99522 - DNA, 20 bp, human
ggcggccgtgggtccaggtc

SEQ ID NO: 99523 - DNA, 20 bp, human
ggaggctgaagccccatcca

SEQ ID NO: 99524 - DNA, 20 bp, human
gcagcggcgtcgacaaacga

SEQ ID NO: 99525 - DNA, 20 bp, human
gaagtagcaggacggtacat

SEQ ID NO: 99526 - DNA, 20 bp, human
gggcgtcagagcttgagggg

SEQ ID NO: 99527 - DNA, 20 bp, human
gcgatgctggaccagttgat

SEQ ID NO: 99528 - DNA, 20 bp, human
ggagcggcgtcagagcttga

SEQ ID NO: 99529 - DNA, 20 bp, human
gggacggtaagtctctgcca

SEQ ID NO: 99530 - DNA, 20 bp, human
gcttgggacagaagcgacac

SEQ ID NO: 99531 - DNA, 20 bp, human
gagagacttaccgtcccggg

SEQ ID NO: 99532 - DNA, 20 bp, human
gacggggacggcgaagggaa

SEQ ID NO: 99533 - DNA, 20 bp, human
gtggcgggtggcggtgttga

SEQ ID NO: 99534 - DNA, 20 bp, human
gcgaagggaaggggttccga

SEQ ID NO: 99535 - DNA, 20 bp, human
gctttccgcacgcctcgagg

SEQ ID NO: 99536 - DNA, 20 bp, human
ggtgtgcgacggggacccta

SEQ ID NO: 99537 - DNA, 20 bp, human
gctccgagcgtggtgcccaa

SEQ ID NO: 99538 - DNA, 20 bp, human
ggtcagcctgtcctgcagag

SEQ ID NO: 99539 - DNA, 20 bp, human
gagggtcgtaggacgccgtt

SEQ ID NO: 99540 - DNA, 20 bp, human
gccgtcccgaaggatttcat

SEQ ID NO: 99541 - DNA, 20 bp, human
gtcggggaccaaaggaccag

SEQ ID NO: 99542 - DNA, 20 bp, human
gaccacgctcggagaaggac

SEQ ID NO: 99543 - DNA, 20 bp, human
gcctcgaaaagtgtgcgacg

SEQ ID NO: 99544 - DNA, 20 bp, human
gggaccaaaggaccagcggg

SEQ ID NO: 99545 - DNA, 20 bp, human
gtgccagagcatggagccta

SEQ ID NO: 99546 - DNA, 20 bp, human
gtcggctcctgtgtgtagga

SEQ ID NO: 99547 - DNA, 20 bp, human
gcttgtcggctcctgtgtgt

SEQ ID NO: 99548 - DNA, 20 bp, human
gcacccgccaacgaaaacac

SEQ ID NO: 99549 - DNA, 20 bp, human
ggagagcgggccgaggagat

SEQ ID NO: 99550 - DNA, 20 bp, human
gcgagaagcgcagcaacgtg

SEQ ID NO: 99551 - DNA, 20 bp, human
ggggatttcggcctgagagc

SEQ ID NO: 99552 - DNA, 20 bp, human
gacaccgtcgccaatctcct

SEQ ID NO: 99553 - DNA, 20 bp, human
gaggatgctgtccggacccg

SEQ ID NO: 99554 - DNA, 20 bp, human
gcgaaatccctcctacacac

SEQ ID NO: 99555 - DNA, 20 bp, human
ggggccgaggagattggcga

SEQ ID NO: 99556 - DNA, 20 bp, human
gtagtattggaccctaatac

SEQ ID NO: 99557 - DNA, 20 bp, human
gcagagttcacagcatatat

SEQ ID NO: 99558 - DNA, 20 bp, human
gaagcagtgtcaagacagta

SEQ ID NO: 99559 - DNA, 20 bp, human
gtcttaaagcagatgcacta

SEQ ID NO: 99560 - DNA, 20 bp, human
gagttcacagcatatattgg

SEQ ID NO: 99561 - DNA, 20 bp, human
gaactctgtcaggacggaac

SEQ ID NO: 99562 - DNA, 20 bp, human
gtagttatatatgttagtat

SEQ ID NO: 99563 - DNA, 20 bp, human
gtttctttgctccagtatta

SEQ ID NO: 99564 - DNA, 20 bp, human
gtcttgtatcactcagaatc

SEQ ID NO: 99565 - DNA, 20 bp, human
gatatgctgtgaactctgtc

SEQ ID NO: 99566 - DNA, 20 bp, human
ggcgggcccaagcctgaaaa

SEQ ID NO: 99567 - DNA, 20 bp, human
gccctcccggccctacacta

SEQ ID NO: 99568 - DNA, 20 bp, human
gctccacggtcccctccatg

SEQ ID NO: 99569 - DNA, 20 bp, human
gagtgtgagctgggaacctc

SEQ ID NO: 99570 - DNA, 20 bp, human
ggggcaggaagacccctgaa

SEQ ID NO: 99571 - DNA, 20 bp, human
ggccggggaccggctcccgg

SEQ ID NO: 99572 - DNA, 20 bp, human
gtcccagagttaagctggag

SEQ ID NO: 99573 - DNA, 20 bp, human
ggggattctgagcagttagg

SEQ ID NO: 99574 - DNA, 20 bp, human
ggcccaagcctgaaaagggc

SEQ ID NO: 99575 - DNA, 20 bp, human
gctttagcagcggcgaaggg

SEQ ID NO: 99576 - DNA, 20 bp, human
gtggatcaaacagcctaaat

SEQ ID NO: 99577 - DNA, 20 bp, human
gagtgtcggaggagtcgcag

SEQ ID NO: 99578 - DNA, 20 bp, human
ggtgtcgcgtagtaccagat

SEQ ID NO: 99579 - DNA, 20 bp, human
gtaaagtttccgaggctcag

SEQ ID NO: 99580 - DNA, 20 bp, human
gagcggcgcagggatgtgaa

SEQ ID NO: 99581 - DNA, 20 bp, human
gtcagaggaacacaatgact

SEQ ID NO: 99582 - DNA, 20 bp, human
gggacatttttgctgcatca

SEQ ID NO: 99583 - DNA, 20 bp, human
gaacagcctaaatgggaaga

SEQ ID NO: 99584 - DNA, 20 bp, human
gagacagagggggaataaag

SEQ ID NO: 99585 - DNA, 20 bp, human
gggaggagtcgcagcggact

SEQ ID NO: 99586 - DNA, 20 bp, human
gggccggtcccgggtgaggt

SEQ ID NO: 99587 - DNA, 20 bp, human
ggcgcagccgaggagagatg

SEQ ID NO: 99588 - DNA, 20 bp, human
gccggtcgctggcagctgag

SEQ ID NO: 99589 - DNA, 20 bp, human
ggcagaggtgagggtccgtg

SEQ ID NO: 99590 - DNA, 20 bp, human
ggaggtgagggtccgtgagg

SEQ ID NO: 99591 - DNA, 20 bp, human
ggagcggcggaacccttcgc

SEQ ID NO: 99592 - DNA, 20 bp, human
ggtcagtcccgcggagccag

SEQ ID NO: 99593 - DNA, 20 bp, human
ggcgcggttcggggccgcag

SEQ ID NO: 99594 - DNA, 20 bp, human
gccgcgggactgacaatgag

SEQ ID NO: 99595 - DNA, 20 bp, human
gtctgaggagacttcttggt

SEQ ID NO: 99596 - DNA, 20 bp, human
gggctgggataactaggaaa

SEQ ID NO: 99597 - DNA, 20 bp, human
gggcggcgccgaacaatccc

SEQ ID NO: 99598 - DNA, 20 bp, human
gtcggaagagcgctcatcac

SEQ ID NO: 99599 - DNA, 20 bp, human
gacgaacggacgcctgggga

SEQ ID NO: 99600 - DNA, 20 bp, human
gctcttccgaggcggaaagg

SEQ ID NO: 99601 - DNA, 20 bp, human
gtcttcaggagtgatgtcac

SEQ ID NO: 99602 - DNA, 20 bp, human
ggcgctcttccgaggcggaa

SEQ ID NO: 99603 - DNA, 20 bp, human
gaagcaagagggacgctgta

SEQ ID NO: 99604 - DNA, 20 bp, human
ggaagtgccttggcccccac

SEQ ID NO: 99605 - DNA, 20 bp, human
ggccccctggagaaagtctt

SEQ ID NO: 99606 - DNA, 20 bp, human
gcatggcgccacacactccg

SEQ ID NO: 99607 - DNA, 20 bp, human
gtggtacacgcgccctacct

SEQ ID NO: 99608 - DNA, 20 bp, human
gtgtgtggcgccatgatgca

SEQ ID NO: 99609 - DNA, 20 bp, human
gcgccctacctcggagtgtg

SEQ ID NO: 99610 - DNA, 20 bp, human
gtagttaggtatcaattctt

SEQ ID NO: 99611 - DNA, 20 bp, human
ggcgccacacactccgaggt

SEQ ID NO: 99612 - DNA, 20 bp, human
ggtgcggagatgccctgaag

SEQ ID NO: 99613 - DNA, 20 bp, human
gaggctgaccagaagcgcgt

SEQ ID NO: 99614 - DNA, 20 bp, human
ggattaaggattgctgaaag

SEQ ID NO: 99615 - DNA, 20 bp, human
gcccagggttcgtcagggtg

SEQ ID NO: 99616 - DNA, 20 bp, human
gtgtcaagaggtgaaaacaa

SEQ ID NO: 99617 - DNA, 20 bp, human
gacatcactgaactaaaata

SEQ ID NO: 99618 - DNA, 20 bp, human
ggggactgatactcagattg

SEQ ID NO: 99619 - DNA, 20 bp, human
gcaaatttttaggggagggt

SEQ ID NO: 99620 - DNA, 20 bp, human
gacatcctcattgaaaatgg

SEQ ID NO: 99621 - DNA, 20 bp, human
gctatcaacgtagtgcaaca

SEQ ID NO: 99622 - DNA, 20 bp, human
gtttaggggagggtgggtta

SEQ ID NO: 99623 - DNA, 20 bp, human
gaacatagcattctacagca

SEQ ID NO: 99624 - DNA, 20 bp, human
gaatgcagcctattaagagt

SEQ ID NO: 99625 - DNA, 20 bp, human
ggtaggaaaattacagggtt

SEQ ID NO: 99626 - DNA, 20 bp, human
gtgagaccgcgggtgagtgg

SEQ ID NO: 99627 - DNA, 20 bp, human
gcccgctgcaggcagtagtg

SEQ ID NO: 99628 - DNA, 20 bp, human
ggtcaaacaagccagcatgg

SEQ ID NO: 99629 - DNA, 20 bp, human
ggagtagcagatgagaaacg

SEQ ID NO: 99630 - DNA, 20 bp, human
ggtgtcctaaaacagaaggt

SEQ ID NO: 99631 - DNA, 20 bp, human
gggaacacgctctaggtaag

SEQ ID NO: 99632 - DNA, 20 bp, human
gcccagggctctcggatgca

SEQ ID NO: 99633 - DNA, 20 bp, human
gccggagtcggaaggagctg

SEQ ID NO: 99634 - DNA, 20 bp, human
gaggctgggtagttggtcgg

SEQ ID NO: 99635 - DNA, 20 bp, human
gcacccaaaggctgagaccg

SEQ ID NO: 99636 - DNA, 20 bp, human
gggccctgtagccacagcca

SEQ ID NO: 99637 - DNA, 20 bp, human
gtgcaacacaccctagacag

SEQ ID NO: 99638 - DNA, 20 bp, human
ggacggagctaaggccccgg

SEQ ID NO: 99639 - DNA, 20 bp, human
ggctgctctgagcctatgac

SEQ ID NO: 99640 - DNA, 20 bp, human
gcctgccctgcccctgtcta

SEQ ID NO: 99641 - DNA, 20 bp, human
ggcctgggccggcttggaag

SEQ ID NO: 99642 - DNA, 20 bp, human
gtgcattgccaaggccttat

SEQ ID NO: 99643 - DNA, 20 bp, human
gtcccctgaggctgcactca

SEQ ID NO: 99644 - DNA, 20 bp, human
gggagacctggggaccggga

SEQ ID NO: 99645 - DNA, 20 bp, human
gagccctggctgtggctaca

SEQ ID NO: 99646 - DNA, 20 bp, human
gccgcccggcggtgagtccg

SEQ ID NO: 99647 - DNA, 20 bp, human
gtccctcccggcccacgtag

SEQ ID NO: 99648 - DNA, 20 bp, human
ggagcctcccggccgcccca

SEQ ID NO: 99649 - DNA, 20 bp, human
gtctctggggaccaacccac

SEQ ID NO: 99650 - DNA, 20 bp, human
gtcctctacgtgggccggga

SEQ ID NO: 99651 - DNA, 20 bp, human
gcagtggctgcgcagccctg

SEQ ID NO: 99652 - DNA, 20 bp, human
gcctcgcgcgctctggaccg

SEQ ID NO: 99653 - DNA, 20 bp, human
ggccaggagcgtctggagtt

SEQ ID NO: 99654 - DNA, 20 bp, human
ggctcctggctcctctacgt

SEQ ID NO: 99655 - DNA, 20 bp, human
ggcgtctggagttgggtgat

SEQ ID NO: 99656 - DNA, 20 bp, human
gcagagaggcctcaccatct

SEQ ID NO: 99657 - DNA, 20 bp, human
gatctgggcgatgccacggt

SEQ ID NO: 99658 - DNA, 20 bp, human
ggcaggtagatgtaaagaag

SEQ ID NO: 99659 - DNA, 20 bp, human
gtgaatacaatggaaggggt

SEQ ID NO: 99660 - DNA, 20 bp, human
gcaccatctgggcgatgcca

SEQ ID NO: 99661 - DNA, 20 bp, human
gggcgatgccacggttggta

SEQ ID NO: 99662 - DNA, 20 bp, human
ggctacatccttaccaaccg

SEQ ID NO: 99663 - DNA, 20 bp, human
gggacagagtggtatgggtt

SEQ ID NO: 99664 - DNA, 20 bp, human
ggggaaaggaaagcaccgtg

SEQ ID NO: 99665 - DNA, 20 bp, human
gaggggcctctggacagagg

SEQ ID NO: 99666 - DNA, 20 bp, human
gggacatccggagcccgaag

SEQ ID NO: 99667 - DNA, 20 bp, human
gcgcgtcgggacccaagcgt

SEQ ID NO: 99668 - DNA, 20 bp, human
gcccaagcgtcgggccccag

SEQ ID NO: 99669 - DNA, 20 bp, human
ggtaggcttgcacaaggaag

SEQ ID NO: 99670 - DNA, 20 bp, human
ggggctccggatgtccgctg

SEQ ID NO: 99671 - DNA, 20 bp, human
gtgctgttggactgaacgag

SEQ ID NO: 99672 - DNA, 20 bp, human
ggaaagtgcgaaccgcgcgt

SEQ ID NO: 99673 - DNA, 20 bp, human
ggaactccggtaggacgggg

SEQ ID NO: 99674 - DNA, 20 bp, human
gtcgggccccagcggacatc

SEQ ID NO: 99675 - DNA, 20 bp, human
ggggtatgagaagtgggact

SEQ ID NO: 99676 - DNA, 20 bp, human
ggcgagggtcctgagaatgg

SEQ ID NO: 99677 - DNA, 20 bp, human
ggacagggtgagcagcataa

SEQ ID NO: 99678 - DNA, 20 bp, human
gcagcagagcagaacagaca

SEQ ID NO: 99679 - DNA, 20 bp, human
gtactgagcacagcagatag

SEQ ID NO: 99680 - DNA, 20 bp, human
ggagcaaggaggctgtcata

SEQ ID NO: 99681 - DNA, 20 bp, human
gtagggaagcctggtcttgg

SEQ ID NO: 99682 - DNA, 20 bp, human
ggaggagacaccttggagtg

SEQ ID NO: 99683 - DNA, 20 bp, human
gtccagctctaggagttgag

SEQ ID NO: 99684 - DNA, 20 bp, human
ggataccagagtttccaagg

SEQ ID NO: 99685 - DNA, 20 bp, human
ggccactcaactcctagagc

SEQ ID NO: 99686 - DNA, 20 bp, human
ggtagaggcggtcctgacac

SEQ ID NO: 99687 - DNA, 20 bp, human
gggggctgccttgggtaagg

SEQ ID NO: 99688 - DNA, 20 bp, human
gctaggggctgccttgggta

SEQ ID NO: 99689 - DNA, 20 bp, human
gggtctgccctcgccacagg

SEQ ID NO: 99690 - DNA, 20 bp, human
ggagcagtctgtaccccttc

SEQ ID NO: 99691 - DNA, 20 bp, human
gaaggactgtgggcctctca

SEQ ID NO: 99692 - DNA, 20 bp, human
gccctcgccacaggtggtca

SEQ ID NO: 99693 - DNA, 20 bp, human
ggaatgcggtgctacaactg

SEQ ID NO: 99694 - DNA, 20 bp, human
ggcctgtgtgagaagctagc

SEQ ID NO: 99695 - DNA, 20 bp, human
ggatgaaaccccagtttgtt

SEQ ID NO: 99696 - DNA, 20 bp, human
ggaagacccagaggcaacga

SEQ ID NO: 99697 - DNA, 20 bp, human
ggggagttccacataggaac

SEQ ID NO: 99698 - DNA, 20 bp, human
ggtcttggagcaagagaact

SEQ ID NO: 99699 - DNA, 20 bp, human
ggggtcttccctagtgtcag

SEQ ID NO: 99700 - DNA, 20 bp, human
gggaggaataagactgccat

SEQ ID NO: 99701 - DNA, 20 bp, human
ggctacaaaaataagacagg

SEQ ID NO: 99702 - DNA, 20 bp, human
gcctcctgcctctgacacta

SEQ ID NO: 99703 - DNA, 20 bp, human
gagacctggtgtccccaggg

SEQ ID NO: 99704 - DNA, 20 bp, human
gagaccccctcactggctgg

SEQ ID NO: 99705 - DNA, 20 bp, human
gccagaggcaacgagggtcc

SEQ ID NO: 99706 - DNA, 20 bp, human
gggtccgcagggagaccgaa

SEQ ID NO: 99707 - DNA, 20 bp, human
gcccgcgccggcacctgtgt

SEQ ID NO: 99708 - DNA, 20 bp, human
gtccctgcggaccggaatcc

SEQ ID NO: 99709 - DNA, 20 bp, human
ggggctcactcacatcccgg

SEQ ID NO: 99710 - DNA, 20 bp, human
gggcggacgctctggagaag

SEQ ID NO: 99711 - DNA, 20 bp, human
ggtgtccgcactccgggctc

SEQ ID NO: 99712 - DNA, 20 bp, human
gatccccgccgggagacgtc

SEQ ID NO: 99713 - DNA, 20 bp, human
gagctgtcacctcgccccag

SEQ ID NO: 99714 - DNA, 20 bp, human
gcggccccctacccaggcgt

SEQ ID NO: 99715 - DNA, 20 bp, human
gggacaggaatgagcggcag

SEQ ID NO: 99716 - DNA, 20 bp, human
gccgcgcgctgaccctccct

SEQ ID NO: 99717 - DNA, 20 bp, human
ggcagcgccatcgtccccag

SEQ ID NO: 99718 - DNA, 20 bp, human
ggtgagcccgtgctcttcag

SEQ ID NO: 99719 - DNA, 20 bp, human
gtgagctaaaagctattcag

SEQ ID NO: 99720 - DNA, 20 bp, human
ggtggccggcggccaggtag

SEQ ID NO: 99721 - DNA, 20 bp, human
gtggcgtctgtccacacccg

SEQ ID NO: 99722 - DNA, 20 bp, human
gcgtctccttgaggacccca

SEQ ID NO: 99723 - DNA, 20 bp, human
gacgcagcccctgagcccaa

SEQ ID NO: 99724 - DNA, 20 bp, human
gcccctaccggccagacccg

SEQ ID NO: 99725 - DNA, 20 bp, human
gccgagaggacagggccggg

SEQ ID NO: 99726 - DNA, 20 bp, human
gcctccgtgcgcctactcta

SEQ ID NO: 99727 - DNA, 20 bp, human
gacgcggtgcaccgtagagt

SEQ ID NO: 99728 - DNA, 20 bp, human
gcccccagaggcctagacag

SEQ ID NO: 99729 - DNA, 20 bp, human
gttggccgcagccacccaca

SEQ ID NO: 99730 - DNA, 20 bp, human
gctcaggatgaggacaggct

SEQ ID NO: 99731 - DNA, 20 bp, human
ggtgagtcgcaggggaggtc

SEQ ID NO: 99732 - DNA, 20 bp, human
ggtgcgcccgaggacccggc

SEQ ID NO: 99733 - DNA, 20 bp, human
gaccacagtgcgccaggcag

SEQ ID NO: 99734 - DNA, 20 bp, human
ggtgctcacttcctcctccg

SEQ ID NO: 99735 - DNA, 20 bp, human
gaggagggcgcggtggatgt

SEQ ID NO: 99736 - DNA, 20 bp, human
gcctccgtgcgcctactcta

SEQ ID NO: 99737 - DNA, 20 bp, human
gacgcggtgcaccgtagagt

SEQ ID NO: 99738 - DNA, 20 bp, human
gcccccagaggcctagacag

SEQ ID NO: 99739 - DNA, 20 bp, human
gttggccgcagccacccaca

SEQ ID NO: 99740 - DNA, 20 bp, human
gctcaggatgaggacaggct

SEQ ID NO: 99741 - DNA, 20 bp, human
ggtgagtcgcaggggaggtc

SEQ ID NO: 99742 - DNA, 20 bp, human
ggtgcgcccgaggacccggc

SEQ ID NO: 99743 - DNA, 20 bp, human
gaccacagtgcgccaggcag

SEQ ID NO: 99744 - DNA, 20 bp, human
ggtgctcacttcctcctccg

SEQ ID NO: 99745 - DNA, 20 bp, human
gaggagggcgcggtggatgt

SEQ ID NO: 99746 - DNA, 20 bp, human
gtacaggcccccaccatgaa

SEQ ID NO: 99747 - DNA, 20 bp, human
gactagcggctcacatctgt

SEQ ID NO: 99748 - DNA, 20 bp, human
ggctgtgaaacccttcatgg

SEQ ID NO: 99749 - DNA, 20 bp, human
gacgtggtctgtagcgacag

SEQ ID NO: 99750 - DNA, 20 bp, human
ggttctgtggtgttagtaaa

SEQ ID NO: 99751 - DNA, 20 bp, human
gcacagccactctcttcctc

SEQ ID NO: 99752 - DNA, 20 bp, human
gacacatgggtgtactgcaa

SEQ ID NO: 99753 - DNA, 20 bp, human
gcgctacagaccacgtgtgt

SEQ ID NO: 99754 - DNA, 20 bp, human
ggctcagttggagttggggt

SEQ ID NO: 99755 - DNA, 20 bp, human
gaactccaactgagcactag

SEQ ID NO: 99756 - DNA, 20 bp, human
ggcttactggagaaaggccc

SEQ ID NO: 99757 - DNA, 20 bp, human
gcacagatgactgggctcct

SEQ ID NO: 99758 - DNA, 20 bp, human
gaagagtcacacagatgact

SEQ ID NO: 99759 - DNA, 20 bp, human
gtttctccagtaagccacag

SEQ ID NO: 99760 - DNA, 20 bp, human
gagaagtggtggccataaag

SEQ ID NO: 99761 - DNA, 20 bp, human
ggcgtgagcccagttcttgt

SEQ ID NO: 99762 - DNA, 20 bp, human
gtgctactgcggttcttctg

SEQ ID NO: 99763 - DNA, 20 bp, human
gcccaggcagggaatgcaac

SEQ ID NO: 99764 - DNA, 20 bp, human
gagttcttgttggtaaaatc

SEQ ID NO: 99765 - DNA, 20 bp, human
gacaaaaaaaagaatctccc

SEQ ID NO: 99766 - DNA, 20 bp, human
gggtcgagaacattctcatg

SEQ ID NO: 99767 - DNA, 20 bp, human
gggtagagaaagatgacgca

SEQ ID NO: 99768 - DNA, 20 bp, human
gcagcaggaaaagcaatagc

SEQ ID NO: 99769 - DNA, 20 bp, human
ggactcacaagctctgtgag

SEQ ID NO: 99770 - DNA, 20 bp, human
ggaagaactagtaagtgtca

SEQ ID NO: 99771 - DNA, 20 bp, human
ggaagctcagaagcagtatt

SEQ ID NO: 99772 - DNA, 20 bp, human
gcgagaaccgtacactgttg

SEQ ID NO: 99773 - DNA, 20 bp, human
gaatgggcagaaccaaaaac

SEQ ID NO: 99774 - DNA, 20 bp, human
ggtatttcatacacctactg

SEQ ID NO: 99775 - DNA, 20 bp, human
gtagagcagaaatcaactcc

SEQ ID NO: 99776 - DNA, 20 bp, human
gctgcaccgcgaagcctgag

SEQ ID NO: 99777 - DNA, 20 bp, human
gcctgagaggcaggtagctg

SEQ ID NO: 99778 - DNA, 20 bp, human
gaggaggccttaggatgtag

SEQ ID NO: 99779 - DNA, 20 bp, human
gagatcagtccctaaagagg

SEQ ID NO: 99780 - DNA, 20 bp, human
ggcaagcctgaagcccagtc

SEQ ID NO: 99781 - DNA, 20 bp, human
gacctgcctctcaggcttcg

SEQ ID NO: 99782 - DNA, 20 bp, human
gagcaggagtgagatctgaa

SEQ ID NO: 99783 - DNA, 20 bp, human
gtctggaccgctacatccta

SEQ ID NO: 99784 - DNA, 20 bp, human
gtttagggactgatctccca

SEQ ID NO: 99785 - DNA, 20 bp, human
ggggctcagagagtgagtag

SEQ ID NO: 99786 - DNA, 20 bp, human
gaaatactccgaacttatat

SEQ ID NO: 99787 - DNA, 20 bp, human
gacaggtgagtgtgaagcag

SEQ ID NO: 99788 - DNA, 20 bp, human
gaggagcactgactgaagac

SEQ ID NO: 99789 - DNA, 20 bp, human
gaggatgaaaatccagtgta

SEQ ID NO: 99790 - DNA, 20 bp, human
gaggcatggatcttacactc

SEQ ID NO: 99791 - DNA, 20 bp, human
ggcatgtgcaaatcgaataa

SEQ ID NO: 99792 - DNA, 20 bp, human
ggggctcaccacctctaagg

SEQ ID NO: 99793 - DNA, 20 bp, human
gcttaactgtagctgtaata

SEQ ID NO: 99794 - DNA, 20 bp, human
gccagtgtatggtgatcagt

SEQ ID NO: 99795 - DNA, 20 bp, human
gtgagtgtgaagcagaggca

SEQ ID NO: 99796 - DNA, 20 bp, human
ggacctttgcaaacagagag

SEQ ID NO: 99797 - DNA, 20 bp, human
gaactgatccttgaagccag

SEQ ID NO: 99798 - DNA, 20 bp, human
ggatccttgaagccaggggt

SEQ ID NO: 99799 - DNA, 20 bp, human
gcttataccagggtctccgt

SEQ ID NO: 99800 - DNA, 20 bp, human
gggagaccctggtataagaa

SEQ ID NO: 99801 - DNA, 20 bp, human
gtagttattcaccctacccc

SEQ ID NO: 99802 - DNA, 20 bp, human
gtataagaatggaaacaccc

SEQ ID NO: 99803 - DNA, 20 bp, human
gcacgttctcatgctcctgt

SEQ ID NO: 99804 - DNA, 20 bp, human
ggaatggaaacacccaggca

SEQ ID NO: 99805 - DNA, 20 bp, human
gaggggagattttctctgta

SEQ ID NO: 99806 - DNA, 20 bp, human
ggccctcattggtaagtcac

SEQ ID NO: 99807 - DNA, 20 bp, human
ggccagtgacttaccaatga

SEQ ID NO: 99808 - DNA, 20 bp, human
gaccacggaggataacatgg

SEQ ID NO: 99809 - DNA, 20 bp, human
gagtccccaaaacaccacgg

SEQ ID NO: 99810 - DNA, 20 bp, human
gattagtccccaaaacacca

SEQ ID NO: 99811 - DNA, 20 bp, human
ggagttcaatgtgtataggt

SEQ ID NO: 99812 - DNA, 20 bp, human
gttcaaatcagagcaggtcc

SEQ ID NO: 99813 - DNA, 20 bp, human
gcccgccatgttatcctccg

SEQ ID NO: 99814 - DNA, 20 bp, human
gggctggataccttaccgag

SEQ ID NO: 99815 - DNA, 20 bp, human
gggggactaattgccctcat

SEQ ID NO: 99816 - DNA, 20 bp, human
gaggctctgctgtctcgcga

SEQ ID NO: 99817 - DNA, 20 bp, human
gctccttatcaggcgcggcc

SEQ ID NO: 99818 - DNA, 20 bp, human
ggctggcccagtgcagataa

SEQ ID NO: 99819 - DNA, 20 bp, human
gtgcgccgccaggggtgaga

SEQ ID NO: 99820 - DNA, 20 bp, human
ggcagggacccactagtgag

SEQ ID NO: 99821 - DNA, 20 bp, human
gggcctggcccctcactagt

SEQ ID NO: 99822 - DNA, 20 bp, human
ggtttcctccctctcacccc

SEQ ID NO: 99823 - DNA, 20 bp, human
gtccggccgctgcgccgcca

SEQ ID NO: 99824 - DNA, 20 bp, human
gtgcctggccgcgcctgata

SEQ ID NO: 99825 - DNA, 20 bp, human
gtccgcgtaggtccccccca

SEQ ID NO: 99826 - DNA, 20 bp, human
gcccgggcccggtcacccgt

SEQ ID NO: 99827 - DNA, 20 bp, human
gagaggaactggctgtctct

SEQ ID NO: 99828 - DNA, 20 bp, human
gcttcgccgccggagcccag

SEQ ID NO: 99829 - DNA, 20 bp, human
gtgcagcgcgtctggcccgg

SEQ ID NO: 99830 - DNA, 20 bp, human
gcgggcgcagggtagactcg

SEQ ID NO: 99831 - DNA, 20 bp, human
ggtctggcccggaggcgcca

SEQ ID NO: 99832 - DNA, 20 bp, human
gcaccgcctctgggctccgg

SEQ ID NO: 99833 - DNA, 20 bp, human
ggacttgagttcagagtggg

SEQ ID NO: 99834 - DNA, 20 bp, human
gtgccaccagccggagtccc

SEQ ID NO: 99835 - DNA, 20 bp, human
gccgcaccgcctctgggctc

SEQ ID NO: 99836 - DNA, 20 bp, human
gcctgcctgagtctaatcgt

SEQ ID NO: 99837 - DNA, 20 bp, human
gcgcgcctgggagtcacccg

SEQ ID NO: 99838 - DNA, 20 bp, human
gcggtgagcatcaggcgatg

SEQ ID NO: 99839 - DNA, 20 bp, human
gcacgcctacgattagactc

SEQ ID NO: 99840 - DNA, 20 bp, human
ggaccgagggccgagtatcc

SEQ ID NO: 99841 - DNA, 20 bp, human
gcaggcgcggcggtacctca

SEQ ID NO: 99842 - DNA, 20 bp, human
ggcgcggcggtacctcacgg

SEQ ID NO: 99843 - DNA, 20 bp, human
ggggccgagtatcccggcag

SEQ ID NO: 99844 - DNA, 20 bp, human
gggcgcgagcgggactatca

SEQ ID NO: 99845 - DNA, 20 bp, human
gcctccaggacggagaccga

SEQ ID NO: 99846 - DNA, 20 bp, human
gtctcagccgccaactccgg

SEQ ID NO: 99847 - DNA, 20 bp, human
gagcaccgcgcctccggagt

SEQ ID NO: 99848 - DNA, 20 bp, human
ggagagggcaagcgcatcag

SEQ ID NO: 99849 - DNA, 20 bp, human
gtccaggtgagaatacccag

SEQ ID NO: 99850 - DNA, 20 bp, human
gcgccccggggcaccagtcg

SEQ ID NO: 99851 - DNA, 20 bp, human
gccccaaggcgcccacctcg

SEQ ID NO: 99852 - DNA, 20 bp, human
gagggcaagcgcatcagagg

SEQ ID NO: 99853 - DNA, 20 bp, human
ggcggccgccaactcccgct

SEQ ID NO: 99854 - DNA, 20 bp, human
gctgagactgaaggaactac

SEQ ID NO: 99855 - DNA, 20 bp, human
gctcggcccgggagcgcgag

SEQ ID NO: 99856 - DNA, 20 bp, human
gtatggaacgatctctgcag

SEQ ID NO: 99857 - DNA, 20 bp, human
gcagccagaggccgagtccg

SEQ ID NO: 99858 - DNA, 20 bp, human
gagcagagctggtctgtaaa

SEQ ID NO: 99859 - DNA, 20 bp, human
gagtatgtgctaataatcgg

SEQ ID NO: 99860 - DNA, 20 bp, human
ggccatcccagcctcggact

SEQ ID NO: 99861 - DNA, 20 bp, human
ggatgctccctaaggatgtg

SEQ ID NO: 99862 - DNA, 20 bp, human
gcctgctgcaaggctcggga

SEQ ID NO: 99863 - DNA, 20 bp, human
ggcgtttgggagacaaggaa

SEQ ID NO: 99864 - DNA, 20 bp, human
gtcccacgtcctctcctgaa

SEQ ID NO: 99865 - DNA, 20 bp, human
gagagagctgcccccagaag

SEQ ID NO: 99866 - DNA, 20 bp, human
gcagcagacaccaagtgagg

SEQ ID NO: 99867 - DNA, 20 bp, human
ggtccccgccaggcaagcct

SEQ ID NO: 99868 - DNA, 20 bp, human
gccagaagggccttgagcgg

SEQ ID NO: 99869 - DNA, 20 bp, human
ggcccccccgccataaggag

SEQ ID NO: 99870 - DNA, 20 bp, human
gcagtgtgaatgtcagtggg

SEQ ID NO: 99871 - DNA, 20 bp, human
gtgagggggacgcctaatga

SEQ ID NO: 99872 - DNA, 20 bp, human
gacacccaggctggtgctca

SEQ ID NO: 99873 - DNA, 20 bp, human
gggtgtctgctgtccccgcc

SEQ ID NO: 99874 - DNA, 20 bp, human
ggggagggcgccccaggaag

SEQ ID NO: 99875 - DNA, 20 bp, human
gaagtgaggtggcgacagac

SEQ ID NO: 99876 - DNA, 20 bp, human
gtcggaggcggcacatccag

SEQ ID NO: 99877 - DNA, 20 bp, human
ggcgcccggcctaggaacag

SEQ ID NO: 99878 - DNA, 20 bp, human
gtaagagggcccgagctcgg

SEQ ID NO: 99879 - DNA, 20 bp, human
gcagcctgcagtccagatca

SEQ ID NO: 99880 - DNA, 20 bp, human
gcccccatcctaagcaaggg

SEQ ID NO: 99881 - DNA, 20 bp, human
gacatccaggggggacgcca

SEQ ID NO: 99882 - DNA, 20 bp, human
ggggcgaggttactcatcct

SEQ ID NO: 99883 - DNA, 20 bp, human
gggatccccacataagcaga

SEQ ID NO: 99884 - DNA, 20 bp, human
gaggtgcccaggccatgatc

SEQ ID NO: 99885 - DNA, 20 bp, human
gtcctaagcaagggaggcag

SEQ ID NO: 99886 - DNA, 20 bp, human
gcgaggtacaaggcaaggga

SEQ ID NO: 99887 - DNA, 20 bp, human
gggcaacccgtgcacagacc

SEQ ID NO: 99888 - DNA, 20 bp, human
gtacacagaggagcccccag

SEQ ID NO: 99889 - DNA, 20 bp, human
gcgcgcgaagtcgaggtaca

SEQ ID NO: 99890 - DNA, 20 bp, human
ggaaggcgacgattacacag

SEQ ID NO: 99891 - DNA, 20 bp, human
gcaagccacgcgcgaagtcg

SEQ ID NO: 99892 - DNA, 20 bp, human
gccaagcccggtctgtgcac

SEQ ID NO: 99893 - DNA, 20 bp, human
gcaagagttcgcccctctgg

SEQ ID NO: 99894 - DNA, 20 bp, human
gggcttggtcaacgccccag

SEQ ID NO: 99895 - DNA, 20 bp, human
gctcttgaggaagatgaacg

SEQ ID NO: 99896 - DNA, 20 bp, human
gcggcagtgcgggtaagggt

SEQ ID NO: 99897 - DNA, 20 bp, human
gttacccgcactgccgactg

SEQ ID NO: 99898 - DNA, 20 bp, human
ggcggaacccaagaatcact

SEQ ID NO: 99899 - DNA, 20 bp, human
gggaaggagacatcgaagca

SEQ ID NO: 99900 - DNA, 20 bp, human
gcgaggcgcagagggcgttg

SEQ ID NO: 99901 - DNA, 20 bp, human
gaagcagggcgaggcgcaga

SEQ ID NO: 99902 - DNA, 20 bp, human
ggagacatcgaagcagggcg

SEQ ID NO: 99903 - DNA, 20 bp, human
gtgcggactcatgccccagt

SEQ ID NO: 99904 - DNA, 20 bp, human
gctccttccgaaactacacg

SEQ ID NO: 99905 - DNA, 20 bp, human
gtgtgatggaccgtccgtgg

SEQ ID NO: 99906 - DNA, 20 bp, human
gactgatgggagaagaacaa

SEQ ID NO: 99907 - DNA, 20 bp, human
ggccaggcagcacatcacag

SEQ ID NO: 99908 - DNA, 20 bp, human
gggcagcacatcacagcggg

SEQ ID NO: 99909 - DNA, 20 bp, human
gggatgcttaggactcagta

SEQ ID NO: 99910 - DNA, 20 bp, human
gtcagtaaggagaaccagcc

SEQ ID NO: 99911 - DNA, 20 bp, human
ggcagagcagaatgactctg

SEQ ID NO: 99912 - DNA, 20 bp, human
gctgggtggccgggatgctt

SEQ ID NO: 99913 - DNA, 20 bp, human
gtgcccaacccccaattcaa

SEQ ID NO: 99914 - DNA, 20 bp, human
ggtatttccagggagccctc

SEQ ID NO: 99915 - DNA, 20 bp, human
gctcctgcccaccaagaccc

SEQ ID NO: 99916 - DNA, 20 bp, human
gaaggagcgagggagcgcag

SEQ ID NO: 99917 - DNA, 20 bp, human
ggaagctccgaacccaggga

SEQ ID NO: 99918 - DNA, 20 bp, human
gagcctggacgggtccagag

SEQ ID NO: 99919 - DNA, 20 bp, human
ggtcgcgcacaggaaggtat

SEQ ID NO: 99920 - DNA, 20 bp, human
ggaggctggcggctagggag

SEQ ID NO: 99921 - DNA, 20 bp, human
ggcccccagagtgtgcaatg

SEQ ID NO: 99922 - DNA, 20 bp, human
ggctagggagaggcgccagg

SEQ ID NO: 99923 - DNA, 20 bp, human
gtcaggagctgccaagttca

SEQ ID NO: 99924 - DNA, 20 bp, human
gtttcgcggggcccagggga

SEQ ID NO: 99925 - DNA, 20 bp, human
gcgcggggcccaggggatgg

SEQ ID NO: 99926 - DNA, 20 bp, human
ggcctctcggcgccctcacc

SEQ ID NO: 99927 - DNA, 20 bp, human
gtgacttcggcagagccgag

SEQ ID NO: 99928 - DNA, 20 bp, human
gccgaggggagaggagatac

SEQ ID NO: 99929 - DNA, 20 bp, human
ggccccagcgcgcccagaag

SEQ ID NO: 99930 - DNA, 20 bp, human
gagggcgccgagaggctcgg

SEQ ID NO: 99931 - DNA, 20 bp, human
ggccgggtgagggcgccgag

SEQ ID NO: 99932 - DNA, 20 bp, human
gagcagccaacgccggcccc

SEQ ID NO: 99933 - DNA, 20 bp, human
ggcgcggtagcagccaacgc

SEQ ID NO: 99934 - DNA, 20 bp, human
gcgaagtcactggccccgca

SEQ ID NO: 99935 - DNA, 20 bp, human
ggctcccagcgcacccgcct

SEQ ID NO: 99936 - DNA, 20 bp, human
gcagcagtccccgaagaagg

SEQ ID NO: 99937 - DNA, 20 bp, human
gcaggtggcgttactgacgt

SEQ ID NO: 99938 - DNA, 20 bp, human
gaatgcatcaggacagattt

SEQ ID NO: 99939 - DNA, 20 bp, human
gctaagagtctcgtgctgaa

SEQ ID NO: 99940 - DNA, 20 bp, human
ggagggtgtcagcaccgcag

SEQ ID NO: 99941 - DNA, 20 bp, human
gcttactgggcagttaaacg

SEQ ID NO: 99942 - DNA, 20 bp, human
gaggtccagagcaccccctg

SEQ ID NO: 99943 - DNA, 20 bp, human
ggggcagcagtccccgaaga

SEQ ID NO: 99944 - DNA, 20 bp, human
ggcccagcccagaatgcatc

SEQ ID NO: 99945 - DNA, 20 bp, human
gccacctgtcagttcctgtc

SEQ ID NO: 99946 - DNA, 20 bp, human
gccgcgcgaggggcaaccac

SEQ ID NO: 99947 - DNA, 20 bp, human
gcgcgccggctgtgaccccc

SEQ ID NO: 99948 - DNA, 20 bp, human
gacccccgcgggccggccta

SEQ ID NO: 99949 - DNA, 20 bp, human
gaggcagaaacacgctgcag

SEQ ID NO: 99950 - DNA, 20 bp, human
gcctacgccactcaccgcag

SEQ ID NO: 99951 - DNA, 20 bp, human
gttgtgaggtgccgagggag

SEQ ID NO: 99952 - DNA, 20 bp, human
gagagtgcgaggtgacaata

SEQ ID NO: 99953 - DNA, 20 bp, human
gcgcgggccggcctagggca

SEQ ID NO: 99954 - DNA, 20 bp, human
ggcccggaaggccaccgctg

SEQ ID NO: 99955 - DNA, 20 bp, human
gccactgggccggccaccgg

SEQ ID NO: 99956 - DNA, 20 bp, human
gagcgggagatcctgggtca

SEQ ID NO: 99957 - DNA, 20 bp, human
gctgggtacctccactccct

SEQ ID NO: 99958 - DNA, 20 bp, human
ggaacttctgttctgaccaa

SEQ ID NO: 99959 - DNA, 20 bp, human
gagtggaggtacccagccgg

SEQ ID NO: 99960 - DNA, 20 bp, human
gtgggttcccgggactcgaa

SEQ ID NO: 99961 - DNA, 20 bp, human
gactcgaacggaagttccgg

SEQ ID NO: 99962 - DNA, 20 bp, human
gcactgggtagggtgacctt

SEQ ID NO: 99963 - DNA, 20 bp, human
gcaggtgggagtcctgggtc

SEQ ID NO: 99964 - DNA, 20 bp, human
ggatctcccgctccccacaa

SEQ ID NO: 99965 - DNA, 20 bp, human
ggtcagggtggaagttctca

SEQ ID NO: 99966 - DNA, 20 bp, human
gggaaccgcatgactggcag

SEQ ID NO: 99967 - DNA, 20 bp, human
gtatcgtgtcgccggcaggg

SEQ ID NO: 99968 - DNA, 20 bp, human
ggccccgcgcggcaacgcag

SEQ ID NO: 99969 - DNA, 20 bp, human
ggccccggctgtagatgcac

SEQ ID NO: 99970 - DNA, 20 bp, human
gctggcagtggcatcagcga

SEQ ID NO: 99971 - DNA, 20 bp, human
gatggcggctgcgtcggggt

SEQ ID NO: 99972 - DNA, 20 bp, human
gcttggggcgaggaatgggg

SEQ ID NO: 99973 - DNA, 20 bp, human
gaggcgctatgcctccctgc

SEQ ID NO: 99974 - DNA, 20 bp, human
gaggggcggaaccgcatgac

SEQ ID NO: 99975 - DNA, 20 bp, human
ggtgtcgccgggcccaaata

SEQ ID NO: 99976 - DNA, 20 bp, human
ggccgtggccgaccgagcac

SEQ ID NO: 99977 - DNA, 20 bp, human
gcctgtacgggacctggtgt

SEQ ID NO: 99978 - DNA, 20 bp, human
gagaagcgcgcagcccgcgg

SEQ ID NO: 99979 - DNA, 20 bp, human
ggagcacaggctggtccagt

SEQ ID NO: 99980 - DNA, 20 bp, human
ggcctgtgctcggtcggcca

SEQ ID NO: 99981 - DNA, 20 bp, human
ggcgggctgcgcgcttctgt

SEQ ID NO: 99982 - DNA, 20 bp, human
gaccaggtcccgtacaggaa

SEQ ID NO: 99983 - DNA, 20 bp, human
gggaccagcctgtgctcggt

SEQ ID NO: 99984 - DNA, 20 bp, human
gtggctcgcgcgtccaagag

SEQ ID NO: 99985 - DNA, 20 bp, human
gggtcggccacggctctgct

SEQ ID NO: 99986 - DNA, 20 bp, human
gggcggacctctggtggaca

SEQ ID NO: 99987 - DNA, 20 bp, human
gctgcgcgctgaggctccgg

SEQ ID NO: 99988 - DNA, 20 bp, human
gctccgcggggcctgacggg

SEQ ID NO: 99989 - DNA, 20 bp, human
gctgcctaccgggctgaaaa

SEQ ID NO: 99990 - DNA, 20 bp, human
gggcatcgggccaatctcag

SEQ ID NO: 99991 - DNA, 20 bp, human
gctcctgcgcgctgaggctc

SEQ ID NO: 99992 - DNA, 20 bp, human
gggctccggcggacctctgg

SEQ ID NO: 99993 - DNA, 20 bp, human
gacgcgatcgcaccaaacca

SEQ ID NO: 99994 - DNA, 20 bp, human
gtgaggctccggcggacctc

SEQ ID NO: 99995 - DNA, 20 bp, human
gctaacgttaaagcaggtac

SEQ ID NO: 99996 - DNA, 20 bp, human
ggcactggaagagttgagag

SEQ ID NO: 99997 - DNA, 20 bp, human
gaacacttgtgcgcgactgg

SEQ ID NO: 99998 - DNA, 20 bp, human
gctgggtcacctgtaattgt

SEQ ID NO: 99999 - DNA, 20 bp, human
ggcggctgcgaggcaaggac

SEQ ID NO: 100000 - DNA, 20 bp, human
ggctctctctcagcatcgcc

SEQ ID NO: 100001 - DNA, 20 bp, human
ggtgtggcctctgagacctc

SEQ ID NO: 100002 - DNA, 20 bp, human
gcaactcttccagtgctcaa

SEQ ID NO: 100003 - DNA, 20 bp, human
gtctcccctggtagaaagaa

SEQ ID NO: 100004 - DNA, 20 bp, human
ggaagagttgagagtggaag

SEQ ID NO: 100005 - DNA, 20 bp, human
ggcaggagcacgcttttcga

SEQ ID NO: 100006 - DNA, 20 bp, human
gacggacagaggagtcgtag

SEQ ID NO: 100007 - DNA, 20 bp, human
gcttcgcagtagacggacag

SEQ ID NO: 100008 - DNA, 20 bp, human
gagaggagtcgtagcggtcg

SEQ ID NO: 100009 - DNA, 20 bp, human
gcaccccgcttcgcagtaga

SEQ ID NO: 100010 - DNA, 20 bp, human
gtaagttggctccagagggt

SEQ ID NO: 100011 - DNA, 20 bp, human
gcatgcagcggacacccggt

SEQ ID NO: 100012 - DNA, 20 bp, human
gagcagaaagaagaatccga

SEQ ID NO: 100013 - DNA, 20 bp, human
gtagggcgctcttaggaaaa

SEQ ID NO: 100014 - DNA, 20 bp, human
ggcggcactcacgcactttc

SEQ ID NO: 100015 - DNA, 20 bp, human
gggcaacctgtcagtaaagg

SEQ ID NO: 100016 - DNA, 20 bp, human
gcccatggctctcctcaccg

SEQ ID NO: 100017 - DNA, 20 bp, human
gacgggcagtcaaggtgaca

SEQ ID NO: 100018 - DNA, 20 bp, human
ggtgaggagagccatgggac

SEQ ID NO: 100019 - DNA, 20 bp, human
gggctactcgactgctctgg

SEQ ID NO: 100020 - DNA, 20 bp, human
ggaagtataggagacgccaa

SEQ ID NO: 100021 - DNA, 20 bp, human
gcggtctgaagatgaaacga

SEQ ID NO: 100022 - DNA, 20 bp, human
gtcatatccctgggaagtat

SEQ ID NO: 100023 - DNA, 20 bp, human
ggagcaacagcagttcaatg

SEQ ID NO: 100024 - DNA, 20 bp, human
ggattggttgctgagaggcg

SEQ ID NO: 100025 - DNA, 20 bp, human
ggcgtctcctatacttccca

SEQ ID NO: 100026 - DNA, 20 bp, human
gctctgcccgcggcacccgg

SEQ ID NO: 100027 - DNA, 20 bp, human
gggtgcactcagctctccgg

SEQ ID NO: 100028 - DNA, 20 bp, human
gtccaggggaacgccagccc

SEQ ID NO: 100029 - DNA, 20 bp, human
gaggcccgtgagcctctgag

SEQ ID NO: 100030 - DNA, 20 bp, human
gggcggccggagccactggg

SEQ ID NO: 100031 - DNA, 20 bp, human
gggaagagcgcagaccgcaa

SEQ ID NO: 100032 - DNA, 20 bp, human
ggcaggcgcactcgtcgccg

SEQ ID NO: 100033 - DNA, 20 bp, human
ggggcagagggacggtggag

SEQ ID NO: 100034 - DNA, 20 bp, human
gccagccccggacgccgccg

SEQ ID NO: 100035 - DNA, 20 bp, human
gccaggcctgcgtcaagccc

SEQ ID NO: 100036 - DNA, 20 bp, human
gttgcatcttggcggatctg

SEQ ID NO: 100037 - DNA, 20 bp, human
gccgccaagatgcaagggcc

SEQ ID NO: 100038 - DNA, 20 bp, human
gggtgcttaggggagaatta

SEQ ID NO: 100039 - DNA, 20 bp, human
ggatccaggcccttgcatct

SEQ ID NO: 100040 - DNA, 20 bp, human
ggggagggactgaatactca

SEQ ID NO: 100041 - DNA, 20 bp, human
gatgtagcgaggagttgtgg

SEQ ID NO: 100042 - DNA, 20 bp, human
gttgccgctcaactggatcc

SEQ ID NO: 100043 - DNA, 20 bp, human
gcggatctgaggcgtttgga

SEQ ID NO: 100044 - DNA, 20 bp, human
gggggagtccaaagtcggag

SEQ ID NO: 100045 - DNA, 20 bp, human
gcctctccgttggaatagta

SEQ ID NO: 100046 - DNA, 20 bp, human
ggcggcctcggcaggaccca

SEQ ID NO: 100047 - DNA, 20 bp, human
gcgggcgaggaatccgccat

SEQ ID NO: 100048 - DNA, 20 bp, human
gacggccgtgcgtccccggg

SEQ ID NO: 100049 - DNA, 20 bp, human
gcttggcaagctccccgacc

SEQ ID NO: 100050 - DNA, 20 bp, human
gagggaagtacccttggcat

SEQ ID NO: 100051 - DNA, 20 bp, human
ggctggggaatcaataaagg

SEQ ID NO: 100052 - DNA, 20 bp, human
gcctgctggggaatcaataa

SEQ ID NO: 100053 - DNA, 20 bp, human
ggcgctgctggccaccgcag

SEQ ID NO: 100054 - DNA, 20 bp, human
gtccattggcgatagagccc

SEQ ID NO: 100055 - DNA, 20 bp, human
ggcggacccggtgctccaca

SEQ ID NO: 100056 - DNA, 20 bp, human
ggcccggaaggcggagacgt

SEQ ID NO: 100057 - DNA, 20 bp, human
gcggaaggcggagacgttgg

SEQ ID NO: 100058 - DNA, 20 bp, human
ggctgtcccgggtaagttca

SEQ ID NO: 100059 - DNA, 20 bp, human
gaacttacccgggacagcgg

SEQ ID NO: 100060 - DNA, 20 bp, human
ggccccagctgcgtcctcac

SEQ ID NO: 100061 - DNA, 20 bp, human
gcggcgtacggcccggaagg

SEQ ID NO: 100062 - DNA, 20 bp, human
gccagctgcgtcctcacggg

SEQ ID NO: 100063 - DNA, 20 bp, human
gcggcggcgtacggcccgga

SEQ ID NO: 100064 - DNA, 20 bp, human
gcacgccaacataaagtcgt

SEQ ID NO: 100065 - DNA, 20 bp, human
gcctacctgctggattacct

SEQ ID NO: 100066 - DNA, 20 bp, human
gtcgcgtccgagctcagggg

SEQ ID NO: 100067 - DNA, 20 bp, human
gccttcgcgtccgagctcag

SEQ ID NO: 100068 - DNA, 20 bp, human
gttcgcagaagggacttgga

SEQ ID NO: 100069 - DNA, 20 bp, human
gtcccttctgcgaaaagatg

SEQ ID NO: 100070 - DNA, 20 bp, human
gtaccggggcctggacgagg

SEQ ID NO: 100071 - DNA, 20 bp, human
gagtcgccggtcgccggtcg

SEQ ID NO: 100072 - DNA, 20 bp, human
gcggctccctagccagaccg

SEQ ID NO: 100073 - DNA, 20 bp, human
gagccaatccgcaggcgcgg

SEQ ID NO: 100074 - DNA, 20 bp, human
gcggtgaccgcgactgtcgt

SEQ ID NO: 100075 - DNA, 20 bp, human
gcgctcctgagcctgcccgg

SEQ ID NO: 100076 - DNA, 20 bp, human
ggctgggctgagtagtgcag

SEQ ID NO: 100077 - DNA, 20 bp, human
ggctgccacaaaccaggtaa

SEQ ID NO: 100078 - DNA, 20 bp, human
gaggtcgagcaggctgacgg

SEQ ID NO: 100079 - DNA, 20 bp, human
gctgagtagtgcagcggcac

SEQ ID NO: 100080 - DNA, 20 bp, human
ggcgaggtcgagcaggctga

SEQ ID NO: 100081 - DNA, 20 bp, human
ggccgcagctgccacaaacc

SEQ ID NO: 100082 - DNA, 20 bp, human
gcccggcggccgcctttacc

SEQ ID NO: 100083 - DNA, 20 bp, human
gcgtcggctcggggttctcc

SEQ ID NO: 100084 - DNA, 20 bp, human
ggccacaaaccaggtaaagg

SEQ ID NO: 100085 - DNA, 20 bp, human
gcagagaggacgccccgagc

SEQ ID NO: 100086 - DNA, 20 bp, human
gtggccactggtgatatgag

SEQ ID NO: 100087 - DNA, 20 bp, human
gctgcctctcatatcaccag

SEQ ID NO: 100088 - DNA, 20 bp, human
ggccagggaaacacctcaga

SEQ ID NO: 100089 - DNA, 20 bp, human
gagatgctcaataactagtc

SEQ ID NO: 100090 - DNA, 20 bp, human
gtagtccggatggagagttc

SEQ ID NO: 100091 - DNA, 20 bp, human
gtccctggctctgaaggggt

SEQ ID NO: 100092 - DNA, 20 bp, human
ggagttctggaactatgttg

SEQ ID NO: 100093 - DNA, 20 bp, human
gccatagtcaacagcttagg

SEQ ID NO: 100094 - DNA, 20 bp, human
gggatgtctcggttatgaag

SEQ ID NO: 100095 - DNA, 20 bp, human
ggctcaataactagtccgga

SEQ ID NO: 100096 - DNA, 20 bp, human
ggacctagcagtcaacatga

SEQ ID NO: 100097 - DNA, 20 bp, human
gcagagtgctaggctgacca

SEQ ID NO: 100098 - DNA, 20 bp, human
gtacgtatggaacagacact

SEQ ID NO: 100099 - DNA, 20 bp, human
gcgataaaggaatacgggca

SEQ ID NO: 100100 - DNA, 20 bp, human
gtctgttacggtccagggca

SEQ ID NO: 100101 - DNA, 20 bp, human
gatacccgataaaggaatac

SEQ ID NO: 100102 - DNA, 20 bp, human
gactgctaggtcagagtgct

SEQ ID NO: 100103 - DNA, 20 bp, human
gacatgtgccattgaatctc

SEQ ID NO: 100104 - DNA, 20 bp, human
gtcctttctgttacggtcca

SEQ ID NO: 100105 - DNA, 20 bp, human
ggttgtactgttctagtgct

SEQ ID NO: 100106 - DNA, 20 bp, human
gctcttatgagaaccagcaa

SEQ ID NO: 100107 - DNA, 20 bp, human
gcattgctgcgggttttctt

SEQ ID NO: 100108 - DNA, 20 bp, human
gtgagatcagtaaaattcta

SEQ ID NO: 100109 - DNA, 20 bp, human
gcagtaaaattctaaggcag

SEQ ID NO: 100110 - DNA, 20 bp, human
gcaactgagaagtcagcctc

SEQ ID NO: 100111 - DNA, 20 bp, human
gcagagcttacaaatagagt

SEQ ID NO: 100112 - DNA, 20 bp, human
gaaaattctaaggcagggga

SEQ ID NO: 100113 - DNA, 20 bp, human
ggccatgtctgattctaacg

SEQ ID NO: 100114 - DNA, 20 bp, human
gcttggggttatcattgctg

SEQ ID NO: 100115 - DNA, 20 bp, human
gtcggtgacaggcagctcag

SEQ ID NO: 100116 - DNA, 20 bp, human
gtgtccctgagaaccagcaa

SEQ ID NO: 100117 - DNA, 20 bp, human
ggagatcagttaacattcta

SEQ ID NO: 100118 - DNA, 20 bp, human
gagttaacattctaaggcag

SEQ ID NO: 100119 - DNA, 20 bp, human
gctgccattgctggttctca

SEQ ID NO: 100120 - DNA, 20 bp, human
gcagagcttacaaataaggt

SEQ ID NO: 100121 - DNA, 20 bp, human
ggactgtggtcccacctgtt

SEQ ID NO: 100122 - DNA, 20 bp, human
gaacattctaaggcagagga

SEQ ID NO: 100123 - DNA, 20 bp, human
ggggaggatcttttaaggct

SEQ ID NO: 100124 - DNA, 20 bp, human
ggccatgtctgattctaaca

SEQ ID NO: 100125 - DNA, 20 bp, human
gttcctggtgcctgccgcag

SEQ ID NO: 100126 - DNA, 20 bp, human
gaacccaaggaaccaaatgt

SEQ ID NO: 100127 - DNA, 20 bp, human
gactcttgggtgcagacaag

SEQ ID NO: 100128 - DNA, 20 bp, human
gtggtaggcgggtatatggt

SEQ ID NO: 100129 - DNA, 20 bp, human
ggtagcatctgaaaaaccca

SEQ ID NO: 100130 - DNA, 20 bp, human
gggtgcttacactcaggtat

SEQ ID NO: 100131 - DNA, 20 bp, human
gccaaggaaccaaatgtagg

SEQ ID NO: 100132 - DNA, 20 bp, human
gattcctggtgcttacactc

SEQ ID NO: 100133 - DNA, 20 bp, human
ggcatgtcatggagaactct

SEQ ID NO: 100134 - DNA, 20 bp, human
gtcttcccctccccttggaa

SEQ ID NO: 100135 - DNA, 20 bp, human
gggaatgcagaaacctggtc

SEQ ID NO: 100136 - DNA, 20 bp, human
ggaacaaggctgtctacagt

SEQ ID NO: 100137 - DNA, 20 bp, human
gtgggaggatctgtagaaca

SEQ ID NO: 100138 - DNA, 20 bp, human
gggcagggctgaagtgtatg

SEQ ID NO: 100139 - DNA, 20 bp, human
gggctgaagtgtatgtggtg

SEQ ID NO: 100140 - DNA, 20 bp, human
ggctctgggggtagaatgat

SEQ ID NO: 100141 - DNA, 20 bp, human
gggaccctcctgagtcagtg

SEQ ID NO: 100142 - DNA, 20 bp, human
gctcacgtttaaggagatcg

SEQ ID NO: 100143 - DNA, 20 bp, human
gactccacactgactcagga

SEQ ID NO: 100144 - DNA, 20 bp, human
gttgaggggaccctgagagg

SEQ ID NO: 100145 - DNA, 20 bp, human
gcagaaatctctgggccagg

SEQ ID NO: 100146 - DNA, 20 bp, human
gtgccaacgagttaatcttt

SEQ ID NO: 100147 - DNA, 20 bp, human
gttcggggaccatgggttta

SEQ ID NO: 100148 - DNA, 20 bp, human
ggggatggcgtcaaacccag

SEQ ID NO: 100149 - DNA, 20 bp, human
gccgccaggccagtgccctc

SEQ ID NO: 100150 - DNA, 20 bp, human
gccctaaactctgggactgg

SEQ ID NO: 100151 - DNA, 20 bp, human
gagaggcttggaaaaggtaa

SEQ ID NO: 100152 - DNA, 20 bp, human
gtggccctaaactctgggac

SEQ ID NO: 100153 - DNA, 20 bp, human
gggcacagggggaatcccgg

SEQ ID NO: 100154 - DNA, 20 bp, human
ggctaggaagaaactcagaa

SEQ ID NO: 100155 - DNA, 20 bp, human
gaggccccaattgccaccag

SEQ ID NO: 100156 - DNA, 20 bp, human
gggtttccgttagcaaccag

SEQ ID NO: 100157 - DNA, 20 bp, human
gccaagcctgggatcgccga

SEQ ID NO: 100158 - DNA, 20 bp, human
ggagccaaggcacaactctt

SEQ ID NO: 100159 - DNA, 20 bp, human
gccaaggcacaactcttagg

SEQ ID NO: 100160 - DNA, 20 bp, human
gtctgtggtccaactaccct

SEQ ID NO: 100161 - DNA, 20 bp, human
gtgggatcgccgagggtagt

SEQ ID NO: 100162 - DNA, 20 bp, human
gccacagaaaatggggaagg

SEQ ID NO: 100163 - DNA, 20 bp, human
gcggcggcagcctaaaggaa

SEQ ID NO: 100164 - DNA, 20 bp, human
gctggagacactgagcgggt

SEQ ID NO: 100165 - DNA, 20 bp, human
gcctgccgtgcaccttaggc

SEQ ID NO: 100166 - DNA, 20 bp, human
ggcgctgtaagcccaacttg

SEQ ID NO: 100167 - DNA, 20 bp, human
ggcaggggagagggttccga

SEQ ID NO: 100168 - DNA, 20 bp, human
gttctccagccggcccgggg

SEQ ID NO: 100169 - DNA, 20 bp, human
ggacccgggatggctggacc

SEQ ID NO: 100170 - DNA, 20 bp, human
gatccggcgtggacccggga

SEQ ID NO: 100171 - DNA, 20 bp, human
ggcttacagcgcggccgatc

SEQ ID NO: 100172 - DNA, 20 bp, human
gctgcccggtccagccatcc

SEQ ID NO: 100173 - DNA, 20 bp, human
gaccccaggacaccaccccc

SEQ ID NO: 100174 - DNA, 20 bp, human
gtggaccgggcagcacgggg

SEQ ID NO: 100175 - DNA, 20 bp, human
gtcgggctctgggactccct

SEQ ID NO: 100176 - DNA, 20 bp, human
gcccactcactggccgaggc

SEQ ID NO: 100177 - DNA, 20 bp, human
gggtctcccctctgcagggt

SEQ ID NO: 100178 - DNA, 20 bp, human
gctgggccgggccggagaag

SEQ ID NO: 100179 - DNA, 20 bp, human
gtctccgcgtggagctgtca

SEQ ID NO: 100180 - DNA, 20 bp, human
gggagctggcgggttggcag

SEQ ID NO: 100181 - DNA, 20 bp, human
gctgcgcgggatgcagctcc

SEQ ID NO: 100182 - DNA, 20 bp, human
gaggcgggcagagaaacttt

SEQ ID NO: 100183 - DNA, 20 bp, human
ggcccgcctcggccagtgag

SEQ ID NO: 100184 - DNA, 20 bp, human
gggatctcctcgcccctgga

SEQ ID NO: 100185 - DNA, 20 bp, human
gtggcgggttggcagcggcc

SEQ ID NO: 100186 - DNA, 20 bp, human
gtgggccgggcagctccgag

SEQ ID NO: 100187 - DNA, 20 bp, human
gagtgggctgaggagagcag

SEQ ID NO: 100188 - DNA, 20 bp, human
gtcctcagcccactaaaagg

SEQ ID NO: 100189 - DNA, 20 bp, human
gccccccttccagaaagtgg

SEQ ID NO: 100190 - DNA, 20 bp, human
gggagcaccccccttttagt

SEQ ID NO: 100191 - DNA, 20 bp, human
gtggcccgcgcgccgccact

SEQ ID NO: 100192 - DNA, 20 bp, human
gactctggagaatgggtcag

SEQ ID NO: 100193 - DNA, 20 bp, human
gcgcggtggaatccagccgg

SEQ ID NO: 100194 - DNA, 20 bp, human
gtggtccttggagtttgggt

SEQ ID NO: 100195 - DNA, 20 bp, human
ggagggctggagctggttca

SEQ ID NO: 100196 - DNA, 20 bp, human
gcagcgggcagggcactctg

SEQ ID NO: 100197 - DNA, 20 bp, human
ggcccgcgcggacccacagc

SEQ ID NO: 100198 - DNA, 20 bp, human
gccgcttctagggaagctag

SEQ ID NO: 100199 - DNA, 20 bp, human
ggagttcggaacctagagtt

SEQ ID NO: 100200 - DNA, 20 bp, human
gtagagttcggagccggcta

SEQ ID NO: 100201 - DNA, 20 bp, human
gccgccccgctccaccaggt

SEQ ID NO: 100202 - DNA, 20 bp, human
gaacacacatgcactcggaa

SEQ ID NO: 100203 - DNA, 20 bp, human
gacaacgccggctccctagc

SEQ ID NO: 100204 - DNA, 20 bp, human
gacgcgtgtgtggggcccgt

SEQ ID NO: 100205 - DNA, 20 bp, human
gcggaaaggacgcgcccagt

SEQ ID NO: 100206 - DNA, 20 bp, human
gcaacgcgtgtggccccggg

SEQ ID NO: 100207 - DNA, 20 bp, human
gggcgcggggtctccgacac

SEQ ID NO: 100208 - DNA, 20 bp, human
gcagcccgaagcacgcccgg

SEQ ID NO: 100209 - DNA, 20 bp, human
gcccgctgctagggtcccaa

SEQ ID NO: 100210 - DNA, 20 bp, human
gtactcgctgcctcagggtc

SEQ ID NO: 100211 - DNA, 20 bp, human
gcgcagtgcagcaggcacgg

SEQ ID NO: 100212 - DNA, 20 bp, human
gtctccgacacgggcgccac

SEQ ID NO: 100213 - DNA, 20 bp, human
ggcgcagcccgaagcacgcc

SEQ ID NO: 100214 - DNA, 20 bp, human
gtgatagagaccccagccac

SEQ ID NO: 100215 - DNA, 20 bp, human
gccccttgggaccctagcag

SEQ ID NO: 100216 - DNA, 20 bp, human
ggcgcacgctgagagccggg

SEQ ID NO: 100217 - DNA, 20 bp, human
gccatgccgagggaccacgg

SEQ ID NO: 100218 - DNA, 20 bp, human
ggctgagagccgggaggacc

SEQ ID NO: 100219 - DNA, 20 bp, human
gcgtcttccgaagacaggta

SEQ ID NO: 100220 - DNA, 20 bp, human
gggagaaccgtacctgtctt

SEQ ID NO: 100221 - DNA, 20 bp, human
gagccgcgccggcctgaggg

SEQ ID NO: 100222 - DNA, 20 bp, human
ggcctccgtcttccgaagac

SEQ ID NO: 100223 - DNA, 20 bp, human
ggcgggcgcacgctgagagc

SEQ ID NO: 100224 - DNA, 20 bp, human
gctgatccgccaggcacggt

SEQ ID NO: 100225 - DNA, 20 bp, human
gcgagctcgggccagtcctc

SEQ ID NO: 100226 - DNA, 20 bp, human
gggcacagcgaggcgctagg

SEQ ID NO: 100227 - DNA, 20 bp, human
ggaggcgctagggggaacgc

SEQ ID NO: 100228 - DNA, 20 bp, human
ggacttccaagaccagagag

SEQ ID NO: 100229 - DNA, 20 bp, human
gcccagagtggggcacagcg

SEQ ID NO: 100230 - DNA, 20 bp, human
ggggagacggggccagctag

SEQ ID NO: 100231 - DNA, 20 bp, human
gtgtttccggttcccagagt

SEQ ID NO: 100232 - DNA, 20 bp, human
gccccaagtatggagtccgt

SEQ ID NO: 100233 - DNA, 20 bp, human
gggcctctgaaactagctct

SEQ ID NO: 100234 - DNA, 20 bp, human
gagccctaagggtagaatgg

SEQ ID NO: 100235 - DNA, 20 bp, human
gtggctagaaccatggtcaa

SEQ ID NO: 100236 - DNA, 20 bp, human
gcccgccagcaagggaccag

SEQ ID NO: 100237 - DNA, 20 bp, human
ggccggcgcgcagggatagg

SEQ ID NO: 100238 - DNA, 20 bp, human
gcccgaccaaggacaaccgt

SEQ ID NO: 100239 - DNA, 20 bp, human
gtgggcctggggctcctcga

SEQ ID NO: 100240 - DNA, 20 bp, human
gtaggaggcgacggacgcgg

SEQ ID NO: 100241 - DNA, 20 bp, human
ggtcgcctcctaggccaggt

SEQ ID NO: 100242 - DNA, 20 bp, human
gcagctccgagccctccagg

SEQ ID NO: 100243 - DNA, 20 bp, human
gaggtgggctcccagatggt

SEQ ID NO: 100244 - DNA, 20 bp, human
ggtgcacgtcgctatggtaa

SEQ ID NO: 100245 - DNA, 20 bp, human
gcccgctggtcccttgctgg

SEQ ID NO: 100246 - DNA, 20 bp, human
gctagagctggagccaactt

SEQ ID NO: 100247 - DNA, 20 bp, human
ggagctggagccaacttcgg

SEQ ID NO: 100248 - DNA, 20 bp, human
gtaagctgtgggatccaatg

SEQ ID NO: 100249 - DNA, 20 bp, human
ggggccgcaacactcagaaa

SEQ ID NO: 100250 - DNA, 20 bp, human
gacgctgcagcacttccgaa

SEQ ID NO: 100251 - DNA, 20 bp, human
gtgtgctgagtgtgtgtccg

SEQ ID NO: 100252 - DNA, 20 bp, human
gtgtcagaagaagctgctgt

SEQ ID NO: 100253 - DNA, 20 bp, human
gggagtctcgcagtaagctg

SEQ ID NO: 100254 - DNA, 20 bp, human
gccaacttcggtggagaaac

SEQ ID NO: 100255 - DNA, 20 bp, human
gatggagagatcaccttctc

SEQ ID NO: 100256 - DNA, 20 bp, human
gggacttcttcgctcagtgt

SEQ ID NO: 100257 - DNA, 20 bp, human
ggagcgagcacgaggaaggg

SEQ ID NO: 100258 - DNA, 20 bp, human
gagcggggcgagaaagaggt

SEQ ID NO: 100259 - DNA, 20 bp, human
gccaacacgctgagactgtg

SEQ ID NO: 100260 - DNA, 20 bp, human
ggttgcttgcgttgcatctg

SEQ ID NO: 100261 - DNA, 20 bp, human
gtggtctcgtctcttctcgg

SEQ ID NO: 100262 - DNA, 20 bp, human
gagagagcgagcacgaggaa

SEQ ID NO: 100263 - DNA, 20 bp, human
gcgacttcgtcacactaaaa

SEQ ID NO: 100264 - DNA, 20 bp, human
ggtgtagttataacgattca

SEQ ID NO: 100265 - DNA, 20 bp, human
gcccaaatggaaggtgcagg

SEQ ID NO: 100266 - DNA, 20 bp, human
ggtgggcagcacttacaggt

SEQ ID NO: 100267 - DNA, 20 bp, human
ggaggccccaaatagtgcag

SEQ ID NO: 100268 - DNA, 20 bp, human
gatagtgcagtggcctttgt

SEQ ID NO: 100269 - DNA, 20 bp, human
ggggcacacacccacaggaa

SEQ ID NO: 100270 - DNA, 20 bp, human
gggaagatatgcaaacgctg

SEQ ID NO: 100271 - DNA, 20 bp, human
gagccccagccagcccaact

SEQ ID NO: 100272 - DNA, 20 bp, human
gctttgtgggcagcacttac

SEQ ID NO: 100273 - DNA, 20 bp, human
gaaggccactgcactatttg

SEQ ID NO: 100274 - DNA, 20 bp, human
gttgaagctggtaaacatca

SEQ ID NO: 100275 - DNA, 20 bp, human
gtcgagggaacactcacgtc

SEQ ID NO: 100276 - DNA, 20 bp, human
ggaagtcactctaccaaacc

SEQ ID NO: 100277 - DNA, 20 bp, human
gaggtcacattaaccatcaa

SEQ ID NO: 100278 - DNA, 20 bp, human
gtttgaagagtacccgggtt

SEQ ID NO: 100279 - DNA, 20 bp, human
ggcagttgcctgcctgcata

SEQ ID NO: 100280 - DNA, 20 bp, human
gggcatgtttgaagagtacc

SEQ ID NO: 100281 - DNA, 20 bp, human
gcttcttcagttcagacaca

SEQ ID NO: 100282 - DNA, 20 bp, human
gcctgcctgcatacggagca

SEQ ID NO: 100283 - DNA, 20 bp, human
gaaggtaactggtattctgt

SEQ ID NO: 100284 - DNA, 20 bp, human
gaatatctcaaaaagcatac

SEQ ID NO: 100285 - DNA, 20 bp, human
gtaaaaaaaaggaggaaccc

SEQ ID NO: 100286 - DNA, 20 bp, human
ggtgcgagcggactgaggag

SEQ ID NO: 100287 - DNA, 20 bp, human
gctggagcggtacaaaggta

SEQ ID NO: 100288 - DNA, 20 bp, human
ggctcgcgctccgccggtcc

SEQ ID NO: 100289 - DNA, 20 bp, human
ggccgggtgcgagcggactg

SEQ ID NO: 100290 - DNA, 20 bp, human
gtcggagccggtcggctcgg

SEQ ID NO: 100291 - DNA, 20 bp, human
gagcgcgccgactgccccgg

SEQ ID NO: 100292 - DNA, 20 bp, human
gctcagggccaagccccgcg

SEQ ID NO: 100293 - DNA, 20 bp, human
gcgtggccttcggagccggt

SEQ ID NO: 100294 - DNA, 20 bp, human
gccttctcgccgagccccgg

SEQ ID NO: 100295 - DNA, 20 bp, human
gcctgagctgctgcttctcg

SEQ ID NO: 100296 - DNA, 20 bp, human
gccggtcccagagtaaataa

SEQ ID NO: 100297 - DNA, 20 bp, human
gagcacctccaccgactgga

SEQ ID NO: 100298 - DNA, 20 bp, human
gggtggcgactgccagccag

SEQ ID NO: 100299 - DNA, 20 bp, human
gtgtaagtgtaagcacgagg

SEQ ID NO: 100300 - DNA, 20 bp, human
gagccgggaagctccacgtg

SEQ ID NO: 100301 - DNA, 20 bp, human
gacctccaccgactggaagg

SEQ ID NO: 100302 - DNA, 20 bp, human
gcagccagcggcgacctgct

SEQ ID NO: 100303 - DNA, 20 bp, human
gtaagcacgagggggcgcga

SEQ ID NO: 100304 - DNA, 20 bp, human
gttcgcctccttccagtcgg

SEQ ID NO: 100305 - DNA, 20 bp, human
gcctgagcacctccaccgac

SEQ ID NO: 100306 - DNA, 20 bp, human
gacctagttgacaggctctg

SEQ ID NO: 100307 - DNA, 20 bp, human
gacacacggacaccggaggg

SEQ ID NO: 100308 - DNA, 20 bp, human
ggaggcgtgacctagttgac

SEQ ID NO: 100309 - DNA, 20 bp, human
ggtgtacacacggacaccgg

SEQ ID NO: 100310 - DNA, 20 bp, human
gcgcgagctgcaggtgccca

SEQ ID NO: 100311 - DNA, 20 bp, human
ggagggaggcggcaccggcc

SEQ ID NO: 100312 - DNA, 20 bp, human
gcgggtgttaggttagcgcg

SEQ ID NO: 100313 - DNA, 20 bp, human
gccggcccgtcgagtcctgg

SEQ ID NO: 100314 - DNA, 20 bp, human
ggcgtgcacgcgccgcccct

SEQ ID NO: 100315 - DNA, 20 bp, human
gaggcgggagctcgggcgga

SEQ ID NO: 100316 - DNA, 20 bp, human
gcggagggagatccgagcgg

SEQ ID NO: 100317 - DNA, 20 bp, human
ggcggcaagctggctgcgag

SEQ ID NO: 100318 - DNA, 20 bp, human
ggcccggggacccacacggt

SEQ ID NO: 100319 - DNA, 20 bp, human
ggcgcctggtggagaagtcg

SEQ ID NO: 100320 - DNA, 20 bp, human
gagggagatccgagcggcgg

SEQ ID NO: 100321 - DNA, 20 bp, human
gtaagcggcccggctcgcgc

SEQ ID NO: 100322 - DNA, 20 bp, human
gtgccggcgcgccgaggaag

SEQ ID NO: 100323 - DNA, 20 bp, human
ggcgccggcaccctagcccg

SEQ ID NO: 100324 - DNA, 20 bp, human
gggacccacacggtaggcag

SEQ ID NO: 100325 - DNA, 20 bp, human
gggtaggcagcgggaccccg

SEQ ID NO: 100326 - DNA, 20 bp, human
ggtcctgtatcggaaagtaa

SEQ ID NO: 100327 - DNA, 20 bp, human
ggtggttgctgtccgcggag

SEQ ID NO: 100328 - DNA, 20 bp, human
gagcacgcgcttccactccg

SEQ ID NO: 100329 - DNA, 20 bp, human
gccgctgtggttgctgtccg

SEQ ID NO: 100330 - DNA, 20 bp, human
gtgtatcggaaagtaagggg

SEQ ID NO: 100331 - DNA, 20 bp, human
ggctgctggggcctacctcg

SEQ ID NO: 100332 - DNA, 20 bp, human
ggcgcaggccaatatatcgg

SEQ ID NO: 100333 - DNA, 20 bp, human
gtacaggacacggtgtgact

SEQ ID NO: 100334 - DNA, 20 bp, human
gcttaaaggaagaaacgctc

SEQ ID NO: 100335 - DNA, 20 bp, human
gggacacggtgtgactgggg

SEQ ID NO: 100336 - DNA, 20 bp, human
gtgtaggacacccggaagac

SEQ ID NO: 100337 - DNA, 20 bp, human
gaatggatggcgcggcggta

SEQ ID NO: 100338 - DNA, 20 bp, human
gcacgccttaccagggactg

SEQ ID NO: 100339 - DNA, 20 bp, human
gctgccacggcccatactgt

SEQ ID NO: 100340 - DNA, 20 bp, human
gtcagccgcagtccctggta

SEQ ID NO: 100341 - DNA, 20 bp, human
gagcggaggggaggtcgtga

SEQ ID NO: 100342 - DNA, 20 bp, human
gttctaaccgcaaggagtag

SEQ ID NO: 100343 - DNA, 20 bp, human
gttggccccacgccttacca

SEQ ID NO: 100344 - DNA, 20 bp, human
gaccgcaaggagtagcggag

SEQ ID NO: 100345 - DNA, 20 bp, human
gggaggggaggtcgtgatgg

SEQ ID NO: 100346 - DNA, 20 bp, human
gcggacgcagagggaaacag

SEQ ID NO: 100347 - DNA, 20 bp, human
gcccgcttcgcacaggctca

SEQ ID NO: 100348 - DNA, 20 bp, human
ggccgaggccccgggttgag

SEQ ID NO: 100349 - DNA, 20 bp, human
ggaggcgcgatcggtccggt

SEQ ID NO: 100350 - DNA, 20 bp, human
ggccgcggggagccaccgac

SEQ ID NO: 100351 - DNA, 20 bp, human
ggcgggaggcgcgatcggtc

SEQ ID NO: 100352 - DNA, 20 bp, human
gcgccgtgaacgtcaccgag

SEQ ID NO: 100353 - DNA, 20 bp, human
gatcggccaccactgcaggg

SEQ ID NO: 100354 - DNA, 20 bp, human
gaggacctcccgcttcgcac

SEQ ID NO: 100355 - DNA, 20 bp, human
ggcgggcggccagtggatag

SEQ ID NO: 100356 - DNA, 20 bp, human
ggcacccgcggaaaaggagg

SEQ ID NO: 100357 - DNA, 20 bp, human
gggaggcactaaccctaacg

SEQ ID NO: 100358 - DNA, 20 bp, human
gtgagctgcacccgcggaaa

SEQ ID NO: 100359 - DNA, 20 bp, human
gagaatgtcatcagcaggga

SEQ ID NO: 100360 - DNA, 20 bp, human
gggctggatcgagcacggtc

SEQ ID NO: 100361 - DNA, 20 bp, human
gtagggttagtgcctcctgg

SEQ ID NO: 100362 - DNA, 20 bp, human
gtttcgggtgcagcacaccc

SEQ ID NO: 100363 - DNA, 20 bp, human
gacccgggctggatcgagca

SEQ ID NO: 100364 - DNA, 20 bp, human
gcgagggtgggtcaagggta

SEQ ID NO: 100365 - DNA, 20 bp, human
gctggtcagctgcgccctgc

SEQ ID NO: 100366 - DNA, 20 bp, human
gggtggagcctaccaatcct

SEQ ID NO: 100367 - DNA, 20 bp, human
gaactggcgcccgctcggag

SEQ ID NO: 100368 - DNA, 20 bp, human
ggttccgcgtctgcactggg

SEQ ID NO: 100369 - DNA, 20 bp, human
gtaccaatcctgggcagcgg

SEQ ID NO: 100370 - DNA, 20 bp, human
ggcgcggcgccgctccgagc

SEQ ID NO: 100371 - DNA, 20 bp, human
ggcccgtcaggaagtctcag

SEQ ID NO: 100372 - DNA, 20 bp, human
gggccgacctcgggagacag

SEQ ID NO: 100373 - DNA, 20 bp, human
gagggaagccggctgccgag

SEQ ID NO: 100374 - DNA, 20 bp, human
gtcggagcggcgccgcgctg

SEQ ID NO: 100375 - DNA, 20 bp, human
gcgcccggtggaggtaaccg

SEQ ID NO: 100376 - DNA, 20 bp, human
gaagatggcggtgcaggagt

SEQ ID NO: 100377 - DNA, 20 bp, human
gggccgtgcgggcttctcag

SEQ ID NO: 100378 - DNA, 20 bp, human
gagtacccgaccctcaaggt

SEQ ID NO: 100379 - DNA, 20 bp, human
gtttggccgcttcaagatgg

SEQ ID NO: 100380 - DNA, 20 bp, human
ggcgcaggcgcccaccttga

SEQ ID NO: 100381 - DNA, 20 bp, human
ggccgagccagcgacgactc

SEQ ID NO: 100382 - DNA, 20 bp, human
ggaagcggccaaaacattag

SEQ ID NO: 100383 - DNA, 20 bp, human
ggggtactcctggaccttca

SEQ ID NO: 100384 - DNA, 20 bp, human
gtccatgaccctgaaggtcc

SEQ ID NO: 100385 - DNA, 20 bp, human
gactctggcagcgctaaggg

SEQ ID NO: 100386 - DNA, 20 bp, human
gtgtggaccctgagagccac

SEQ ID NO: 100387 - DNA, 20 bp, human
gaggagtaagcggctggatg

SEQ ID NO: 100388 - DNA, 20 bp, human
ggtgggaggagcgtgcgcag

SEQ ID NO: 100389 - DNA, 20 bp, human
gctccctgccagtggctctc

SEQ ID NO: 100390 - DNA, 20 bp, human
gggcctgaggagtaagcggc

SEQ ID NO: 100391 - DNA, 20 bp, human
gtcttgtgaggcgcctgcac

SEQ ID NO: 100392 - DNA, 20 bp, human
gattagaccattagacaaag

SEQ ID NO: 100393 - DNA, 20 bp, human
gtcctccgcgcgagcgaggg

SEQ ID NO: 100394 - DNA, 20 bp, human
gctgacgctgctcaggcaca

SEQ ID NO: 100395 - DNA, 20 bp, human
gcgggccgtccgcctcaccg

SEQ ID NO: 100396 - DNA, 20 bp, human
gctagagcacgggatcctca

SEQ ID NO: 100397 - DNA, 20 bp, human
gctcagacagaacaaagcac

SEQ ID NO: 100398 - DNA, 20 bp, human
ggcagcgcggtcaaacttcc

SEQ ID NO: 100399 - DNA, 20 bp, human
gctcccgccctaagtaacag

SEQ ID NO: 100400 - DNA, 20 bp, human
gcgccctaagtaacagaggt

SEQ ID NO: 100401 - DNA, 20 bp, human
gcctgcgggccctagagcac

SEQ ID NO: 100402 - DNA, 20 bp, human
gcagatgctggggcattaca

SEQ ID NO: 100403 - DNA, 20 bp, human
gctcctcagactgggcggta

SEQ ID NO: 100404 - DNA, 20 bp, human
ggctgccatgccgaaccgta

SEQ ID NO: 100405 - DNA, 20 bp, human
gtctgaggagcagtaaggga

SEQ ID NO: 100406 - DNA, 20 bp, human
ggaagtcctggggaaagacg

SEQ ID NO: 100407 - DNA, 20 bp, human
gactcttcttgctggatcag

SEQ ID NO: 100408 - DNA, 20 bp, human
ggcgcgctttgcataaggaa

SEQ ID NO: 100409 - DNA, 20 bp, human
gagaggtgcagcccgactgg

SEQ ID NO: 100410 - DNA, 20 bp, human
gtgtagctcgggctgcttgt

SEQ ID NO: 100411 - DNA, 20 bp, human
gccgccaccgcagctcgcgg

SEQ ID NO: 100412 - DNA, 20 bp, human
gccttatgcaaagcgcgcag

SEQ ID NO: 100413 - DNA, 20 bp, human
ggatcctccgcgagctgcgg

SEQ ID NO: 100414 - DNA, 20 bp, human
ggcagcccgactggaggaga

SEQ ID NO: 100415 - DNA, 20 bp, human
ggaagatcctccgcgagctg

SEQ ID NO: 100416 - DNA, 20 bp, human
gtcgccggagcgctctgtgg

SEQ ID NO: 100417 - DNA, 20 bp, human
ggactcgccggagcgctctg

SEQ ID NO: 100418 - DNA, 20 bp, human
ggccgcgcgaggcctgctgg

SEQ ID NO: 100419 - DNA, 20 bp, human
gtcgggcaccagccaagccg

SEQ ID NO: 100420 - DNA, 20 bp, human
ggttgttgtccggccggggg

SEQ ID NO: 100421 - DNA, 20 bp, human
ggcggacgcttgttgttgtc

SEQ ID NO: 100422 - DNA, 20 bp, human
gagcgctctgtggcggtcgg

SEQ ID NO: 100423 - DNA, 20 bp, human
gcggagcgctctgtggcggt

SEQ ID NO: 100424 - DNA, 20 bp, human
gggatacagtgcggcccgag

SEQ ID NO: 100425 - DNA, 20 bp, human
ggcgggctcttcaagatcgg

SEQ ID NO: 100426 - DNA, 20 bp, human
gtcgaggacagcgagcctgg

SEQ ID NO: 100427 - DNA, 20 bp, human
gagaagcgctcggcctcggg

SEQ ID NO: 100428 - DNA, 20 bp, human
ggtgaagaaggagcctcccg

SEQ ID NO: 100429 - DNA, 20 bp, human
gcgagcctggcggcaggcgg

SEQ ID NO: 100430 - DNA, 20 bp, human
gaggagcagggcgtgctgag

SEQ ID NO: 100431 - DNA, 20 bp, human
gcagcgagcctggcggcagg

SEQ ID NO: 100432 - DNA, 20 bp, human
gaccgctggccaggtgtctc

SEQ ID NO: 100433 - DNA, 20 bp, human
gcttcgcgtttagccgtggg

SEQ ID NO: 100434 - DNA, 20 bp, human
gcgcccagcccgggcaccgg

SEQ ID NO: 100435 - DNA, 20 bp, human
gaggtgtctcgggcgacccc

SEQ ID NO: 100436 - DNA, 20 bp, human
gggcgcgccggagagtcccg

SEQ ID NO: 100437 - DNA, 20 bp, human
gccgccgcgtccccagacaa

SEQ ID NO: 100438 - DNA, 20 bp, human
gtgcaccgccgagctgcgag

SEQ ID NO: 100439 - DNA, 20 bp, human
gaggcagcctcgggactctc

SEQ ID NO: 100440 - DNA, 20 bp, human
gcgtgaagaaggagccactg

SEQ ID NO: 100441 - DNA, 20 bp, human
ggaccgggccgggtagagtc

SEQ ID NO: 100442 - DNA, 20 bp, human
ggagctagagagcgagcaac

SEQ ID NO: 100443 - DNA, 20 bp, human
gggtgcagctgtgctggatc

SEQ ID NO: 100444 - DNA, 20 bp, human
gtggggctgaggggaggcgt

SEQ ID NO: 100445 - DNA, 20 bp, human
ggcagctgtgctggatccgg

SEQ ID NO: 100446 - DNA, 20 bp, human
ggagcggaggggagactgac

SEQ ID NO: 100447 - DNA, 20 bp, human
gcccggttcagagcgacctg

SEQ ID NO: 100448 - DNA, 20 bp, human
gtgctcctacgtgactcggt

SEQ ID NO: 100449 - DNA, 20 bp, human
ggcccgggcccgatccgtcg

SEQ ID NO: 100450 - DNA, 20 bp, human
ggcggcggcgccgggaggaa

SEQ ID NO: 100451 - DNA, 20 bp, human
ggaccaagcgggcccagaag

SEQ ID NO: 100452 - DNA, 20 bp, human
ggaggccgcgcggagttgta

SEQ ID NO: 100453 - DNA, 20 bp, human
ggacggtgcgcgggacccca

SEQ ID NO: 100454 - DNA, 20 bp, human
gactgaccggagcgcggatc

SEQ ID NO: 100455 - DNA, 20 bp, human
ggccgcaggtcgctctgaac

SEQ ID NO: 100456 - DNA, 20 bp, human
gcgggccgagcgcactggga

SEQ ID NO: 100457 - DNA, 20 bp, human
ggcgcccgggtactggaggt

SEQ ID NO: 100458 - DNA, 20 bp, human
ggcggatcccgagcctggtc

SEQ ID NO: 100459 - DNA, 20 bp, human
gcctggcgcccgggtactgg

SEQ ID NO: 100460 - DNA, 20 bp, human
gtgtgacgtctgtggagcgg

SEQ ID NO: 100461 - DNA, 20 bp, human
ggccgggccggaccaggctc

SEQ ID NO: 100462 - DNA, 20 bp, human
gccgcccgcctagctccggg

SEQ ID NO: 100463 - DNA, 20 bp, human
gcactggacggcgggaggaa

SEQ ID NO: 100464 - DNA, 20 bp, human
ggcggcagacccgaaaccag

SEQ ID NO: 100465 - DNA, 20 bp, human
ggagacccgggcgtcctgga

SEQ ID NO: 100466 - DNA, 20 bp, human
ggcccgggcggcacgtgcag

SEQ ID NO: 100467 - DNA, 20 bp, human
ggcggcaagcatggcccggg

SEQ ID NO: 100468 - DNA, 20 bp, human
gccaggcggccgtgactcag

SEQ ID NO: 100469 - DNA, 20 bp, human
gccccagacctgggaggacg

SEQ ID NO: 100470 - DNA, 20 bp, human
ggagagagcctcgcgtcccg

SEQ ID NO: 100471 - DNA, 20 bp, human
gcgcggaccccagacctggg

SEQ ID NO: 100472 - DNA, 20 bp, human
ggggcgcggaccccagacct

SEQ ID NO: 100473 - DNA, 20 bp, human
gagatgctggggagccgggc

SEQ ID NO: 100474 - DNA, 20 bp, human
ggacgaggatccacgcgggt

SEQ ID NO: 100475 - DNA, 20 bp, human
gctacctggccgctgagtca

SEQ ID NO: 100476 - DNA, 20 bp, human
gtgagtccaagtgagtatgg

SEQ ID NO: 100477 - DNA, 20 bp, human
gtgggctcggaccatcgctg

SEQ ID NO: 100478 - DNA, 20 bp, human
gcaagtgggggcctagaccc

SEQ ID NO: 100479 - DNA, 20 bp, human
gaactgagtccaagtgagta

SEQ ID NO: 100480 - DNA, 20 bp, human
gcccgcactcgggaacccca

SEQ ID NO: 100481 - DNA, 20 bp, human
gcatctggccgaagaatgga

SEQ ID NO: 100482 - DNA, 20 bp, human
gccacaaggggtgctgaggg

SEQ ID NO: 100483 - DNA, 20 bp, human
gcctgaccctgctcacgtct

SEQ ID NO: 100484 - DNA, 20 bp, human
gccaagtgagtatggtggca

SEQ ID NO: 100485 - DNA, 20 bp, human
gtgactgcattctagcacct

SEQ ID NO: 100486 - DNA, 20 bp, human
gggccgaaggaacctgaccc

SEQ ID NO: 100487 - DNA, 20 bp, human
gggtggtcaggtgacggagt

SEQ ID NO: 100488 - DNA, 20 bp, human
gtgagggacggcgtagagtt

SEQ ID NO: 100489 - DNA, 20 bp, human
gagcctgggtcaggttcctt

SEQ ID NO: 100490 - DNA, 20 bp, human
gcaggtgacggagtaggagt

SEQ ID NO: 100491 - DNA, 20 bp, human
gcactgacttgcgcattgtg

SEQ ID NO: 100492 - DNA, 20 bp, human
ggagcttggggagaagaacc

SEQ ID NO: 100493 - DNA, 20 bp, human
ggatcagcacccaagaggga

SEQ ID NO: 100494 - DNA, 20 bp, human
gaagcgaggtttccattctg

SEQ ID NO: 100495 - DNA, 20 bp, human
gcggcgtagagttcggccga

SEQ ID NO: 100496 - DNA, 20 bp, human
gttcccagggccgacatcag

SEQ ID NO: 100497 - DNA, 20 bp, human
gggcatctgaggctgacgta

SEQ ID NO: 100498 - DNA, 20 bp, human
gccagctctggaccacctga

SEQ ID NO: 100499 - DNA, 20 bp, human
gtgagatcggctgaagagag

SEQ ID NO: 100500 - DNA, 20 bp, human
gatgtcgggacgctcaggga

SEQ ID NO: 100501 - DNA, 20 bp, human
gccctgggaagccctggtca

SEQ ID NO: 100502 - DNA, 20 bp, human
gcttaagcggcgggagagag

SEQ ID NO: 100503 - DNA, 20 bp, human
gggttctcgttctgagggac

SEQ ID NO: 100504 - DNA, 20 bp, human
gagggctctgcccctgatgt

SEQ ID NO: 100505 - DNA, 20 bp, human
gctgaggctgacgtagggaa

SEQ ID NO: 100506 - DNA, 20 bp, human
gttcccagggccgacatcag

SEQ ID NO: 100507 - DNA, 20 bp, human
gggcatctgaggctgacgta

SEQ ID NO: 100508 - DNA, 20 bp, human
gccagctctggaccacctga

SEQ ID NO: 100509 - DNA, 20 bp, human
gtgagatcggctgaagagag

SEQ ID NO: 100510 - DNA, 20 bp, human
gatgtcgggacgctcaggga

SEQ ID NO: 100511 - DNA, 20 bp, human
gccctgggaagccctggtca

SEQ ID NO: 100512 - DNA, 20 bp, human
gcttaagcggcgggagagag

SEQ ID NO: 100513 - DNA, 20 bp, human
gggttctcgttctgagggac

SEQ ID NO: 100514 - DNA, 20 bp, human
gagggctctgcccctgatgt

SEQ ID NO: 100515 - DNA, 20 bp, human
gctgaggctgacgtagggaa

SEQ ID NO: 100516 - DNA, 20 bp, human
gcagaggcggaagccaatgg

SEQ ID NO: 100517 - DNA, 20 bp, human
gtcccagaggcggaagccaa

SEQ ID NO: 100518 - DNA, 20 bp, human
gggccggatgtgacctccat

SEQ ID NO: 100519 - DNA, 20 bp, human
gctgcggagttgcacattag

SEQ ID NO: 100520 - DNA, 20 bp, human
ggcggcttgtgacctgctga

SEQ ID NO: 100521 - DNA, 20 bp, human
ggcagaggcagttccataaa

SEQ ID NO: 100522 - DNA, 20 bp, human
gggcagagggcagcgggtcc

SEQ ID NO: 100523 - DNA, 20 bp, human
gaagcgaaagcgtctttctg

SEQ ID NO: 100524 - DNA, 20 bp, human
gaactccgcagtaccaagcc

SEQ ID NO: 100525 - DNA, 20 bp, human
ggggacaaggatggactttg

SEQ ID NO: 100526 - DNA, 20 bp, human
ggaggacacaatgctgctca

SEQ ID NO: 100527 - DNA, 20 bp, human
gaatgctgctcagggagaac

SEQ ID NO: 100528 - DNA, 20 bp, human
gaggcctcagaaggagacct

SEQ ID NO: 100529 - DNA, 20 bp, human
gaccagctctaagacaggtg

SEQ ID NO: 100530 - DNA, 20 bp, human
gataagaatgtcaggaatca

SEQ ID NO: 100531 - DNA, 20 bp, human
gaacagcttcggaatagtaa

SEQ ID NO: 100532 - DNA, 20 bp, human
gcaagatctataagaatgtc

SEQ ID NO: 100533 - DNA, 20 bp, human
gtttccgaggtctccttctg

SEQ ID NO: 100534 - DNA, 20 bp, human
gagcttcggaatagtaaagg

SEQ ID NO: 100535 - DNA, 20 bp, human
gtgactgtttttagtttcta

SEQ ID NO: 100536 - DNA, 20 bp, human
gcgattctgccaggatgggt

SEQ ID NO: 100537 - DNA, 20 bp, human
gaccatcgctcaaacatcaa

SEQ ID NO: 100538 - DNA, 20 bp, human
gatgtttgagcgatggtggt

SEQ ID NO: 100539 - DNA, 20 bp, human
ggatgggaatcggggtttgg

SEQ ID NO: 100540 - DNA, 20 bp, human
gcccgttgatgtttgagcga

SEQ ID NO: 100541 - DNA, 20 bp, human
ggcaaagctccgattctgcc

SEQ ID NO: 100542 - DNA, 20 bp, human
gggggatgggaatcggggtt

SEQ ID NO: 100543 - DNA, 20 bp, human
gtgccaggatgggtggggat

SEQ ID NO: 100544 - DNA, 20 bp, human
gatgggtggggatgggaatc

SEQ ID NO: 100545 - DNA, 20 bp, human
gacggcctgacgtcggtgga

SEQ ID NO: 100546 - DNA, 20 bp, human
gagatgggaatggggtttgg

SEQ ID NO: 100547 - DNA, 20 bp, human
ggttggtgtttgagggatgg

SEQ ID NO: 100548 - DNA, 20 bp, human
ggattggtagtgagggtagg

SEQ ID NO: 100549 - DNA, 20 bp, human
gtgggattggtagtgagggt

SEQ ID NO: 100550 - DNA, 20 bp, human
ggggtggggttggtgtttga

SEQ ID NO: 100551 - DNA, 20 bp, human
gggggatgggattggtagtg

SEQ ID NO: 100552 - DNA, 20 bp, human
gggggttggtgtttgaggga

SEQ ID NO: 100553 - DNA, 20 bp, human
gccattcccggagcttccgt

SEQ ID NO: 100554 - DNA, 20 bp, human
gttccgtgggttgattgcag

SEQ ID NO: 100555 - DNA, 20 bp, human
gggcagcgctggattattgg

SEQ ID NO: 100556 - DNA, 20 bp, human
ggaatggggaatgggggatg

SEQ ID NO: 100557 - DNA, 20 bp, human
gagccggcccaggctcggtg

SEQ ID NO: 100558 - DNA, 20 bp, human
ggaccccgagagggaactga

SEQ ID NO: 100559 - DNA, 20 bp, human
gttagccacggggaactctg

SEQ ID NO: 100560 - DNA, 20 bp, human
gtgcccctggtatcaagtca

SEQ ID NO: 100561 - DNA, 20 bp, human
ggaggtcagggcccacgctg

SEQ ID NO: 100562 - DNA, 20 bp, human
gggccgtcgctcgttgctca

SEQ ID NO: 100563 - DNA, 20 bp, human
gaggccctctgtctgaggtg

SEQ ID NO: 100564 - DNA, 20 bp, human
gttccgtgacttgataccag

SEQ ID NO: 100565 - DNA, 20 bp, human
gggtcggcggggtgaggtag

SEQ ID NO: 100566 - DNA, 20 bp, human
gggatgggaatgggggatgg

SEQ ID NO: 100567 - DNA, 20 bp, human
ggggctggttagaagaggtc

SEQ ID NO: 100568 - DNA, 20 bp, human
gaggccctctgtctgaggtg

SEQ ID NO: 100569 - DNA, 20 bp, human
ggaccccgagagggaactga

SEQ ID NO: 100570 - DNA, 20 bp, human
gagccggcccaggctcggtg

SEQ ID NO: 100571 - DNA, 20 bp, human
ggaggtcagggcccacgctg

SEQ ID NO: 100572 - DNA, 20 bp, human
gttagccacggggaactctg

SEQ ID NO: 100573 - DNA, 20 bp, human
gctgtccccagagttccccg

SEQ ID NO: 100574 - DNA, 20 bp, human
ggccaggcacgtgagtcctg

SEQ ID NO: 100575 - DNA, 20 bp, human
gtgcccctggtatcaagtca

SEQ ID NO: 100576 - DNA, 20 bp, human
gactcgcagcttgagactgg

SEQ ID NO: 100577 - DNA, 20 bp, human
gctgactcgcagcttgagac

SEQ ID NO: 100578 - DNA, 20 bp, human
gagcccgcccaggctctata

SEQ ID NO: 100579 - DNA, 20 bp, human
gggaggatgggagtgtagat

SEQ ID NO: 100580 - DNA, 20 bp, human
gtggcggtatgaaggtggtg

SEQ ID NO: 100581 - DNA, 20 bp, human
gctccttatagagcctgggc

SEQ ID NO: 100582 - DNA, 20 bp, human
gggagatggcggtatgaagg

SEQ ID NO: 100583 - DNA, 20 bp, human
gcgcagcttgagactggcgg

SEQ ID NO: 100584 - DNA, 20 bp, human
gtgggtttgtgagtgcgaat

SEQ ID NO: 100585 - DNA, 20 bp, human
gcgggatgggaatagcggtg

SEQ ID NO: 100586 - DNA, 20 bp, human
ggaatggggaatgggggatg

SEQ ID NO: 100587 - DNA, 20 bp, human
gctggaagtcttcccctgcg

SEQ ID NO: 100588 - DNA, 20 bp, human
gagccggcccaggctcggtg

SEQ ID NO: 100589 - DNA, 20 bp, human
gaggccctctgtctgaggtg

SEQ ID NO: 100590 - DNA, 20 bp, human
ggaccccgagagggaactga

SEQ ID NO: 100591 - DNA, 20 bp, human
gtgcccctggtatcaagtca

SEQ ID NO: 100592 - DNA, 20 bp, human
ggaggtcagggcccacgctg

SEQ ID NO: 100593 - DNA, 20 bp, human
gttagccacggggaactctg

SEQ ID NO: 100594 - DNA, 20 bp, human
ggccaggcacgtgagtcctg

SEQ ID NO: 100595 - DNA, 20 bp, human
gttccgtgacttgataccag

SEQ ID NO: 100596 - DNA, 20 bp, human
gatccccgcggccacgtcag

SEQ ID NO: 100597 - DNA, 20 bp, human
gtgcccggccgccatgccta

SEQ ID NO: 100598 - DNA, 20 bp, human
gagcgagggcctggttctga

SEQ ID NO: 100599 - DNA, 20 bp, human
gcttcccagggctgacagta

SEQ ID NO: 100600 - DNA, 20 bp, human
gtgaggggtcggcttgagat

SEQ ID NO: 100601 - DNA, 20 bp, human
gaggcccccacccctcatat

SEQ ID NO: 100602 - DNA, 20 bp, human
gagacaagtctgccccctgg

SEQ ID NO: 100603 - DNA, 20 bp, human
gcggggctgatgcagcaaag

SEQ ID NO: 100604 - DNA, 20 bp, human
gagcagggctggttagcaga

SEQ ID NO: 100605 - DNA, 20 bp, human
gtgagatcggctgagggaag

SEQ ID NO: 100606 - DNA, 20 bp, human
gggagaggcctccttctgag

SEQ ID NO: 100607 - DNA, 20 bp, human
gcaagccgcccctcagaagg

SEQ ID NO: 100608 - DNA, 20 bp, human
gctgaggggcggcttgatac

SEQ ID NO: 100609 - DNA, 20 bp, human
gtcggccagcttacctccac

SEQ ID NO: 100610 - DNA, 20 bp, human
gaggggcggcttgataccgg

SEQ ID NO: 100611 - DNA, 20 bp, human
gcactgggggtcagagagaa

SEQ ID NO: 100612 - DNA, 20 bp, human
ggaggcctccttctgagggg

SEQ ID NO: 100613 - DNA, 20 bp, human
gggcggcttgataccggtgg

SEQ ID NO: 100614 - DNA, 20 bp, human
ggtagagtggagctgaggat

SEQ ID NO: 100615 - DNA, 20 bp, human
gaggtgctgagggaagactg

SEQ ID NO: 100616 - DNA, 20 bp, human
gggagaggcctccttctgag

SEQ ID NO: 100617 - DNA, 20 bp, human
gcaagccgcccctcagaagg

SEQ ID NO: 100618 - DNA, 20 bp, human
gctgaggggcggcttgatac

SEQ ID NO: 100619 - DNA, 20 bp, human
gtcggccagcttacctccac

SEQ ID NO: 100620 - DNA, 20 bp, human
gaggggcggcttgataccgg

SEQ ID NO: 100621 - DNA, 20 bp, human
gcactgggggtcagagagaa

SEQ ID NO: 100622 - DNA, 20 bp, human
ggaggcctccttctgagggg

SEQ ID NO: 100623 - DNA, 20 bp, human
gggcggcttgataccggtgg

SEQ ID NO: 100624 - DNA, 20 bp, human
ggtagagtggagctgaggat

SEQ ID NO: 100625 - DNA, 20 bp, human
gaggtgctgagggaagactg

SEQ ID NO: 100626 - DNA, 20 bp, human
gaggaccccagcgagcgtaa

SEQ ID NO: 100627 - DNA, 20 bp, human
ggtcgctgaagagacagtca

SEQ ID NO: 100628 - DNA, 20 bp, human
gaggcctcaggtaaccagat

SEQ ID NO: 100629 - DNA, 20 bp, human
gcagcgactcagggagacga

SEQ ID NO: 100630 - DNA, 20 bp, human
ggactcaggtcaatagaggg

SEQ ID NO: 100631 - DNA, 20 bp, human
gtaagggcgcagtgtccgcc

SEQ ID NO: 100632 - DNA, 20 bp, human
gctgctgacccaaatccgcc

SEQ ID NO: 100633 - DNA, 20 bp, human
gtgcgcccttacgctcgctg

SEQ ID NO: 100634 - DNA, 20 bp, human
gtatagactcaggtcaatag

SEQ ID NO: 100635 - DNA, 20 bp, human
ggggcgcagtgtccgcctgg

SEQ ID NO: 100636 - DNA, 20 bp, human
gccactccttgtgaagtctg

SEQ ID NO: 100637 - DNA, 20 bp, human
ggatctagaacaagataata

SEQ ID NO: 100638 - DNA, 20 bp, human
gcaataaagttggtgggacc

SEQ ID NO: 100639 - DNA, 20 bp, human
ggttcccaccaactcccctt

SEQ ID NO: 100640 - DNA, 20 bp, human
gacagtgttgcaactgggcc

SEQ ID NO: 100641 - DNA, 20 bp, human
gcagagacagtgttgcaact

SEQ ID NO: 100642 - DNA, 20 bp, human
gatatacctcagacttcaca

SEQ ID NO: 100643 - DNA, 20 bp, human
gagagccaaaggggagttgg

SEQ ID NO: 100644 - DNA, 20 bp, human
gtggctctccattaattaga

SEQ ID NO: 100645 - DNA, 20 bp, human
gaattaccttgcaataaagt

SEQ ID NO: 100646 - DNA, 20 bp, human
ggtatctggtcagcagagaa

SEQ ID NO: 100647 - DNA, 20 bp, human
gtactactccataacaaagg

SEQ ID NO: 100648 - DNA, 20 bp, human
ggttctaagaccccaatctc

SEQ ID NO: 100649 - DNA, 20 bp, human
ggcttaaggccgaggccgga

SEQ ID NO: 100650 - DNA, 20 bp, human
gctaagaccccaatctctgg

SEQ ID NO: 100651 - DNA, 20 bp, human
ggcatcaagccaccagagat

SEQ ID NO: 100652 - DNA, 20 bp, human
gggccttgcagtgaggcgat

SEQ ID NO: 100653 - DNA, 20 bp, human
gacactgaatagcatttgag

SEQ ID NO: 100654 - DNA, 20 bp, human
gtagcattgggctaaggtgc

SEQ ID NO: 100655 - DNA, 20 bp, human
gtggatatacttcctagagg

SEQ ID NO: 100656 - DNA, 20 bp, human
gggtgcaccctagtcatcag

SEQ ID NO: 100657 - DNA, 20 bp, human
gcgcctgcggagtctgaagg

SEQ ID NO: 100658 - DNA, 20 bp, human
gctgcaaggcttgggggcaa

SEQ ID NO: 100659 - DNA, 20 bp, human
gactcagaagaggaaatccg

SEQ ID NO: 100660 - DNA, 20 bp, human
gactgtgacgaccttatctg

SEQ ID NO: 100661 - DNA, 20 bp, human
gtggcggacacactgagtga

SEQ ID NO: 100662 - DNA, 20 bp, human
gctcgttcctctgatgacta

SEQ ID NO: 100663 - DNA, 20 bp, human
gtgacgaccttatctgagga

SEQ ID NO: 100664 - DNA, 20 bp, human
ggatataggcagtgtcgtgt

SEQ ID NO: 100665 - DNA, 20 bp, human
gcagtcctcggactcagaag

SEQ ID NO: 100666 - DNA, 20 bp, human
gcagaaccccaagactggtt

SEQ ID NO: 100667 - DNA, 20 bp, human
ggggttctggtagcctgagg

SEQ ID NO: 100668 - DNA, 20 bp, human
gcaagactggttgggtatca

SEQ ID NO: 100669 - DNA, 20 bp, human
ggtctgagggacgccacctc

SEQ ID NO: 100670 - DNA, 20 bp, human
gtgggaagctgccggaagtg

SEQ ID NO: 100671 - DNA, 20 bp, human
ggagggaggtgggtacccgg

SEQ ID NO: 100672 - DNA, 20 bp, human
gctggttgggtatcaaggta

SEQ ID NO: 100673 - DNA, 20 bp, human
gggacacagggtggtcgcct

SEQ ID NO: 100674 - DNA, 20 bp, human
gaaggtaaggaccctgatcg

SEQ ID NO: 100675 - DNA, 20 bp, human
ggcctgactggagcctcccg

SEQ ID NO: 100676 - DNA, 20 bp, human
gtaagctgggagagcaaagt

SEQ ID NO: 100677 - DNA, 20 bp, human
gggccgcatgtttcagacca

SEQ ID NO: 100678 - DNA, 20 bp, human
ggctgttacgggcgaaacct

SEQ ID NO: 100679 - DNA, 20 bp, human
gcataaggcaggagcggggt

SEQ ID NO: 100680 - DNA, 20 bp, human
gggccagagaaataaatctc

SEQ ID NO: 100681 - DNA, 20 bp, human
gtcaagagaaccaggagagg

SEQ ID NO: 100682 - DNA, 20 bp, human
gggtgggactgttctgtggg

SEQ ID NO: 100683 - DNA, 20 bp, human
gggaacccataaggcaggag

SEQ ID NO: 100684 - DNA, 20 bp, human
gccgtaacagcttgatgatg

SEQ ID NO: 100685 - DNA, 20 bp, human
ggcctcaagtcaacagacgg

SEQ ID NO: 100686 - DNA, 20 bp, human
gaggacccgagcgagtgtag

SEQ ID NO: 100687 - DNA, 20 bp, human
gcgggtcctcgcctccaaag

SEQ ID NO: 100688 - DNA, 20 bp, human
gcgagcgagtgtagggggtg

SEQ ID NO: 100689 - DNA, 20 bp, human
gccctgaagacggctctggg

SEQ ID NO: 100690 - DNA, 20 bp, human
gtcagggacgagacttagtg

SEQ ID NO: 100691 - DNA, 20 bp, human
gggatgagccacatccgctc

SEQ ID NO: 100692 - DNA, 20 bp, human
gctcctacccttaacaaagg

SEQ ID NO: 100693 - DNA, 20 bp, human
gtaagtctcgtccctgaaga

SEQ ID NO: 100694 - DNA, 20 bp, human
ggtgaggccacctttgttaa

SEQ ID NO: 100695 - DNA, 20 bp, human
gctcattctgcacgtagggt

SEQ ID NO: 100696 - DNA, 20 bp, human
gtcaaggtcctccgagatct

SEQ ID NO: 100697 - DNA, 20 bp, human
gggatgtttgggtcctgtga

SEQ ID NO: 100698 - DNA, 20 bp, human
gaaacatccctggcctaatg

SEQ ID NO: 100699 - DNA, 20 bp, human
gctccgctgtctgccctcac

SEQ ID NO: 100700 - DNA, 20 bp, human
gacttcagcctagatctcgg

SEQ ID NO: 100701 - DNA, 20 bp, human
ggagggcagacagcggagtc

SEQ ID NO: 100702 - DNA, 20 bp, human
gcaagccggtgcggcatctc

SEQ ID NO: 100703 - DNA, 20 bp, human
gcagcggagtcgggtttcta

SEQ ID NO: 100704 - DNA, 20 bp, human
gaaaacttcagcctagatct

SEQ ID NO: 100705 - DNA, 20 bp, human
gttcagcctggcggatctca

SEQ ID NO: 100706 - DNA, 20 bp, human
gcagcaggcagatactacct

SEQ ID NO: 100707 - DNA, 20 bp, human
gggcaggagtgtaggcagaa

SEQ ID NO: 100708 - DNA, 20 bp, human
gggcgacgagagccaagatg

SEQ ID NO: 100709 - DNA, 20 bp, human
gctgcagcagcagaggtggt

SEQ ID NO: 100710 - DNA, 20 bp, human
gtcaaggaatcctgcagagg

SEQ ID NO: 100711 - DNA, 20 bp, human
gcatgcactggatctgataa

SEQ ID NO: 100712 - DNA, 20 bp, human
gagatcctgggtctgaccac

SEQ ID NO: 100713 - DNA, 20 bp, human
ggcctgctgaaggtgttctc

SEQ ID NO: 100714 - DNA, 20 bp, human
gtggtgggtggctctctctg

SEQ ID NO: 100715 - DNA, 20 bp, human
gtcctgagaacaccttcagc

SEQ ID NO: 100716 - DNA, 20 bp, human
gagggctaacagtagagatg

SEQ ID NO: 100717 - DNA, 20 bp, human
ggagtacccatgttcctcag

SEQ ID NO: 100718 - DNA, 20 bp, human
gtaatgcaggatctgacgaa

SEQ ID NO: 100719 - DNA, 20 bp, human
ggtgagacctctgaggaaca

SEQ ID NO: 100720 - DNA, 20 bp, human
gtgcatgaactctcagtgga

SEQ ID NO: 100721 - DNA, 20 bp, human
gttgctgcatgaactctcag

SEQ ID NO: 100722 - DNA, 20 bp, human
gtgccaacaaggaagatacc

SEQ ID NO: 100723 - DNA, 20 bp, human
gtggttgtgatcttcctgaa

SEQ ID NO: 100724 - DNA, 20 bp, human
gacaatgggaggattcatgt

SEQ ID NO: 100725 - DNA, 20 bp, human
gaaaggcaactgtgccaaca

SEQ ID NO: 100726 - DNA, 20 bp, human
gtgccctatggggaacgtga

SEQ ID NO: 100727 - DNA, 20 bp, human
gggaccccaagtgaggactg

SEQ ID NO: 100728 - DNA, 20 bp, human
gtctcagccttgggacaacg

SEQ ID NO: 100729 - DNA, 20 bp, human
ggaccctcacgttccccata

SEQ ID NO: 100730 - DNA, 20 bp, human
ggccttgggacaacgaggac

SEQ ID NO: 100731 - DNA, 20 bp, human
gggccctatatgccaatgta

SEQ ID NO: 100732 - DNA, 20 bp, human
gaggactgaggatcccagaa

SEQ ID NO: 100733 - DNA, 20 bp, human
gtagacctgacataaagagg

SEQ ID NO: 100734 - DNA, 20 bp, human
gacctgtcctcgttgtccca

SEQ ID NO: 100735 - DNA, 20 bp, human
gtactcagcagtcagcaccg

SEQ ID NO: 100736 - DNA, 20 bp, human
gacccccaggctaacgtcaa

SEQ ID NO: 100737 - DNA, 20 bp, human
gaaaagtgctgtcacgtcag

SEQ ID NO: 100738 - DNA, 20 bp, human
gctgtcacgtcagcggaagg

SEQ ID NO: 100739 - DNA, 20 bp, human
gctcctcagggaccaggtcg

SEQ ID NO: 100740 - DNA, 20 bp, human
gggcaggtctctagagactg

SEQ ID NO: 100741 - DNA, 20 bp, human
ggtgctgtcacgtcagcgga

SEQ ID NO: 100742 - DNA, 20 bp, human
gtgtggacccaggtcagtag

SEQ ID NO: 100743 - DNA, 20 bp, human
gtacctctctgactctcaca

SEQ ID NO: 100744 - DNA, 20 bp, human
gtatcctgacctagaacggg

SEQ ID NO: 100745 - DNA, 20 bp, human
gaggtgggcgtggccggaag

SEQ ID NO: 100746 - DNA, 20 bp, human
ggccaggtctgccctgtttc

SEQ ID NO: 100747 - DNA, 20 bp, human
gtgtcctcacggcagaagaa

SEQ ID NO: 100748 - DNA, 20 bp, human
gtgctgggtgaggggtgtag

SEQ ID NO: 100749 - DNA, 20 bp, human
ggaggatcgtctcaggtcag

SEQ ID NO: 100750 - DNA, 20 bp, human
ggatcgtctcaggtcagcgg

SEQ ID NO: 100751 - DNA, 20 bp, human
gcacctggggagctctatgg

SEQ ID NO: 100752 - DNA, 20 bp, human
gctcaccttgaagactggat

SEQ ID NO: 100753 - DNA, 20 bp, human
ggctgagggacgtgtcctca

SEQ ID NO: 100754 - DNA, 20 bp, human
gccatgggacccccagaaca

SEQ ID NO: 100755 - DNA, 20 bp, human
gcctgctgggaacaagagtg

SEQ ID NO: 100756 - DNA, 20 bp, human
gtgggaatctgacggatcga

SEQ ID NO: 100757 - DNA, 20 bp, human
gtcctgggtgagtggcgtag

SEQ ID NO: 100758 - DNA, 20 bp, human
gacggggagctgcctctggt

SEQ ID NO: 100759 - DNA, 20 bp, human
gcggatcgaaggcatttgtg

SEQ ID NO: 100760 - DNA, 20 bp, human
gcgcgaatcaagttagcggg

SEQ ID NO: 100761 - DNA, 20 bp, human
gtggcagccatcttattcct

SEQ ID NO: 100762 - DNA, 20 bp, human
gatcgaaggcatttgtgagg

SEQ ID NO: 100763 - DNA, 20 bp, human
ggaggcgcgaatcaagttag

SEQ ID NO: 100764 - DNA, 20 bp, human
gcactcacccaggaataaga

SEQ ID NO: 100765 - DNA, 20 bp, human
gccagtcagctcaggcgggg

SEQ ID NO: 100766 - DNA, 20 bp, human
gtaggactgaggcacaaatg

SEQ ID NO: 100767 - DNA, 20 bp, human
gcagcatctggtgcagaggt

SEQ ID NO: 100768 - DNA, 20 bp, human
gtggatgccaccttcagtga

SEQ ID NO: 100769 - DNA, 20 bp, human
gtgatggcagtctaggccag

SEQ ID NO: 100770 - DNA, 20 bp, human
gcacaggctactgcaaccaa

SEQ ID NO: 100771 - DNA, 20 bp, human
gactacagcatctggtgcag

SEQ ID NO: 100772 - DNA, 20 bp, human
gctgaggtgggagcaccact

SEQ ID NO: 100773 - DNA, 20 bp, human
gctgccctgccactgggtgt

SEQ ID NO: 100774 - DNA, 20 bp, human
gacagtatgtagttcatcgg

SEQ ID NO: 100775 - DNA, 20 bp, human
gtggtgcagaggtgggacga

SEQ ID NO: 100776 - DNA, 20 bp, human
gggatggcaggtgacccgtg

SEQ ID NO: 100777 - DNA, 20 bp, human
gcgggtcacctgccatccta

SEQ ID NO: 100778 - DNA, 20 bp, human
gcagctgagaaactcaccca

SEQ ID NO: 100779 - DNA, 20 bp, human
gcaagttctctatcacagtt

SEQ ID NO: 100780 - DNA, 20 bp, human
gtggcatccaacaggcctga

SEQ ID NO: 100781 - DNA, 20 bp, human
gcgtcttccttaggagcagg

SEQ ID NO: 100782 - DNA, 20 bp, human
gggggacaaaccccctagga

SEQ ID NO: 100783 - DNA, 20 bp, human
gcatttacctcctgctccta

SEQ ID NO: 100784 - DNA, 20 bp, human
gtaacgtcttccttaggagc

SEQ ID NO: 100785 - DNA, 20 bp, human
ggagagagggacactgcaag

SEQ ID NO: 100786 - DNA, 20 bp, human
gggaggtgggcattaaggag

SEQ ID NO: 100787 - DNA, 20 bp, human
ggctggccaacaagcaagaa

SEQ ID NO: 100788 - DNA, 20 bp, human
gtagggaggtgggcacaaag

SEQ ID NO: 100789 - DNA, 20 bp, human
gcaggggtgacagcaaggag

SEQ ID NO: 100790 - DNA, 20 bp, human
ggtgggagtggtgggaatat

SEQ ID NO: 100791 - DNA, 20 bp, human
gtagctatctcccaacacgg

SEQ ID NO: 100792 - DNA, 20 bp, human
ggaggtgggtaggaaaaggt

SEQ ID NO: 100793 - DNA, 20 bp, human
gcaacacggagggaaggccc

SEQ ID NO: 100794 - DNA, 20 bp, human
gcaggttggtaggcccgaag

SEQ ID NO: 100795 - DNA, 20 bp, human
gtgcttgttggccagccccg

SEQ ID NO: 100796 - DNA, 20 bp, human
gtctgagtcgtgaagaaggg

SEQ ID NO: 100797 - DNA, 20 bp, human
gaatcaggaaggatcgggag

SEQ ID NO: 100798 - DNA, 20 bp, human
gtgaatgggcgtccagatgg

SEQ ID NO: 100799 - DNA, 20 bp, human
gcgatgggagggatcggaca

SEQ ID NO: 100800 - DNA, 20 bp, human
gtcagaggatcgggattgct

SEQ ID NO: 100801 - DNA, 20 bp, human
gcttcacgactcagaggatc

SEQ ID NO: 100802 - DNA, 20 bp, human
gtcctctgagtcgtgaagaa

SEQ ID NO: 100803 - DNA, 20 bp, human
ggaatccagggtgaagggat

SEQ ID NO: 100804 - DNA, 20 bp, human
gatcgaggtcaaggaatctg

SEQ ID NO: 100805 - DNA, 20 bp, human
gacagggcgaagcttcaaat

SEQ ID NO: 100806 - DNA, 20 bp, human
gcgcaggttaacaggatggg

SEQ ID NO: 100807 - DNA, 20 bp, human
ggttgctgccttcttcgtca

SEQ ID NO: 100808 - DNA, 20 bp, human
gagcagggggagtaaaacag

SEQ ID NO: 100809 - DNA, 20 bp, human
gcaaggtgagtgtaaagaag

SEQ ID NO: 100810 - DNA, 20 bp, human
gacactcaccttgacgaaga

SEQ ID NO: 100811 - DNA, 20 bp, human
gggggagtaaaacagagggt

SEQ ID NO: 100812 - DNA, 20 bp, human
ggcgaggcgatcagaaccac

SEQ ID NO: 100813 - DNA, 20 bp, human
gagtcgcaggttaacaggat

SEQ ID NO: 100814 - DNA, 20 bp, human
ggaaagaccaaaggccagca

SEQ ID NO: 100815 - DNA, 20 bp, human
gggggaacaggaaagaccaa

SEQ ID NO: 100816 - DNA, 20 bp, human
gttcgagagggacttagaga

SEQ ID NO: 100817 - DNA, 20 bp, human
gggaggctgagacttcgaga

SEQ ID NO: 100818 - DNA, 20 bp, human
gtctgcagctctagtccagg

SEQ ID NO: 100819 - DNA, 20 bp, human
gccgaactcgctggaggaca

SEQ ID NO: 100820 - DNA, 20 bp, human
gcgctggaggacaaggtgag

SEQ ID NO: 100821 - DNA, 20 bp, human
ggtgtgcaaacgtaacacgg

SEQ ID NO: 100822 - DNA, 20 bp, human
gcgcatcccgaactcgctgg

SEQ ID NO: 100823 - DNA, 20 bp, human
gtgcaaacgtaacacggagg

SEQ ID NO: 100824 - DNA, 20 bp, human
gagggtgtgcaaacgtaaca

SEQ ID NO: 100825 - DNA, 20 bp, human
ggtagtaggctgtacagact

SEQ ID NO: 100826 - DNA, 20 bp, human
ggacacccaggcaggaaagt

SEQ ID NO: 100827 - DNA, 20 bp, human
gatcttcctggagaagggga

SEQ ID NO: 100828 - DNA, 20 bp, human
gcgcaggtaggagtcagtac

SEQ ID NO: 100829 - DNA, 20 bp, human
gacccaggcaggaaagtagg

SEQ ID NO: 100830 - DNA, 20 bp, human
ggtcagagcacaccgcaggt

SEQ ID NO: 100831 - DNA, 20 bp, human
gcagcctccaggcacaacag

SEQ ID NO: 100832 - DNA, 20 bp, human
ggacttgggggcagcaacaa

SEQ ID NO: 100833 - DNA, 20 bp, human
gtcctctgagcaagaactga

SEQ ID NO: 100834 - DNA, 20 bp, human
gaggaaagggaggccttgtt

SEQ ID NO: 100835 - DNA, 20 bp, human
gcgactccgttctcagatac

SEQ ID NO: 100836 - DNA, 20 bp, human
gtgctggcagcagtaggcga

SEQ ID NO: 100837 - DNA, 20 bp, human
gaccttctcgggaactccaa

SEQ ID NO: 100838 - DNA, 20 bp, human
ggctcagactcgagcactag

SEQ ID NO: 100839 - DNA, 20 bp, human
gcactagaggcggatggagt

SEQ ID NO: 100840 - DNA, 20 bp, human
gtccgattggagcctcacct

SEQ ID NO: 100841 - DNA, 20 bp, human
gcccagacaggaccgggaga

SEQ ID NO: 100842 - DNA, 20 bp, human
gttcagtagggctcagatcg

SEQ ID NO: 100843 - DNA, 20 bp, human
ggctggatccttaccttctc

SEQ ID NO: 100844 - DNA, 20 bp, human
ggatctcaaacgcgaggact

SEQ ID NO: 100845 - DNA, 20 bp, human
gacctaggtgaggctccaat

SEQ ID NO: 100846 - DNA, 20 bp, human
gtgctggcagcagtaggcga

SEQ ID NO: 100847 - DNA, 20 bp, human
gaccttctcgggaactccaa

SEQ ID NO: 100848 - DNA, 20 bp, human
gcactagaggcggatggagt

SEQ ID NO: 100849 - DNA, 20 bp, human
gtccgattggagcctcacct

SEQ ID NO: 100850 - DNA, 20 bp, human
gttcagtagggctcagatcg

SEQ ID NO: 100851 - DNA, 20 bp, human
gcccagacaggaccgggaga

SEQ ID NO: 100852 - DNA, 20 bp, human
gacctaggtgaggctccaat

SEQ ID NO: 100853 - DNA, 20 bp, human
ggatctcaaacgcgaggact

SEQ ID NO: 100854 - DNA, 20 bp, human
ggctggatccttaccttctc

SEQ ID NO: 100855 - DNA, 20 bp, human
ggactgggcactccaggaag

SEQ ID NO: 100856 - DNA, 20 bp, human
gcaggtccctcagagatggt

SEQ ID NO: 100857 - DNA, 20 bp, human
gaggcctcagagatggtggg

SEQ ID NO: 100858 - DNA, 20 bp, human
gttgggccctcagcggaggt

SEQ ID NO: 100859 - DNA, 20 bp, human
gacatcagcggggagaccgg

SEQ ID NO: 100860 - DNA, 20 bp, human
ggcggaggtgggcagaacgg

SEQ ID NO: 100861 - DNA, 20 bp, human
gtagaggtggtgaaaaaggc

SEQ ID NO: 100862 - DNA, 20 bp, human
gcctacacgccaacgccggt

SEQ ID NO: 100863 - DNA, 20 bp, human
ggggagaccgggggcattag

SEQ ID NO: 100864 - DNA, 20 bp, human
gatctggcagagaggacggg

SEQ ID NO: 100865 - DNA, 20 bp, human
ggtgcttaggccctcactgg

SEQ ID NO: 100866 - DNA, 20 bp, human
gaaggatcaaaagtgaaatc

SEQ ID NO: 100867 - DNA, 20 bp, human
gcaggacccgaatgacctgg

SEQ ID NO: 100868 - DNA, 20 bp, human
gaagcccgagaccctggagc

SEQ ID NO: 100869 - DNA, 20 bp, human
ggcggcaaaataacgctctg

SEQ ID NO: 100870 - DNA, 20 bp, human
gctggatagacccctccgtc

SEQ ID NO: 100871 - DNA, 20 bp, human
ggttcaggacccgaatgacc

SEQ ID NO: 100872 - DNA, 20 bp, human
ggcatcaacgactagcatgg

SEQ ID NO: 100873 - DNA, 20 bp, human
gcagattacggcgacggcag

SEQ ID NO: 100874 - DNA, 20 bp, human
gccatgaccctctagaagac

SEQ ID NO: 100875 - DNA, 20 bp, human
gtcactgcagattacggcga

SEQ ID NO: 100876 - DNA, 20 bp, human
gtaccgccggctgaatcgga

SEQ ID NO: 100877 - DNA, 20 bp, human
gcaccgtccgattcagccgg

SEQ ID NO: 100878 - DNA, 20 bp, human
ggcgggagtacaaggagcaa

SEQ ID NO: 100879 - DNA, 20 bp, human
gcgcacgggagtcaaacctg

SEQ ID NO: 100880 - DNA, 20 bp, human
gcgccagcagccggaacctg

SEQ ID NO: 100881 - DNA, 20 bp, human
gtaggccctgcgccttgcca

SEQ ID NO: 100882 - DNA, 20 bp, human
gaaggcgcagggcctaccgc

SEQ ID NO: 100883 - DNA, 20 bp, human
gctgctgggccgcaccgcac

SEQ ID NO: 100884 - DNA, 20 bp, human
gcagtgacggcgggagtaca

SEQ ID NO: 100885 - DNA, 20 bp, human
gaagggccgcagagcatctg

SEQ ID NO: 100886 - DNA, 20 bp, human
ggaagacccgagcactccag

SEQ ID NO: 100887 - DNA, 20 bp, human
ggacccgagcactccagagg

SEQ ID NO: 100888 - DNA, 20 bp, human
gcgcgcaagtcagctggcgt

SEQ ID NO: 100889 - DNA, 20 bp, human
gagccgttctcagctacaaa

SEQ ID NO: 100890 - DNA, 20 bp, human
gagtgctcgggtcttcctcg

SEQ ID NO: 100891 - DNA, 20 bp, human
ggaggcatgtctcctgctag

SEQ ID NO: 100892 - DNA, 20 bp, human
gctcgaggcttcttcagggg

SEQ ID NO: 100893 - DNA, 20 bp, human
gcttacagcagtcctaggga

SEQ ID NO: 100894 - DNA, 20 bp, human
ggcctcggggacgaaagagt

SEQ ID NO: 100895 - DNA, 20 bp, human
gccgctcaggtcgtcttcgg

SEQ ID NO: 100896 - DNA, 20 bp, human
gagcctctgaacagccacgt

SEQ ID NO: 100897 - DNA, 20 bp, human
gtcaggaccccgggagtcgg

SEQ ID NO: 100898 - DNA, 20 bp, human
gagagaagagaatgcctacg

SEQ ID NO: 100899 - DNA, 20 bp, human
gccatcgggccccccagcgg

SEQ ID NO: 100900 - DNA, 20 bp, human
gggcccgcatcagaaccgta

SEQ ID NO: 100901 - DNA, 20 bp, human
gccatcaggaccccgggagt

SEQ ID NO: 100902 - DNA, 20 bp, human
ggtcggaggctgggccatcg

SEQ ID NO: 100903 - DNA, 20 bp, human
ggagtcggaggcttacccat

SEQ ID NO: 100904 - DNA, 20 bp, human
gggatgcaccatcaggaccc

SEQ ID NO: 100905 - DNA, 20 bp, human
ggggactatcgggcccccta

SEQ ID NO: 100906 - DNA, 20 bp, human
gcgccggaacgtggacccag

SEQ ID NO: 100907 - DNA, 20 bp, human
gcccctttaagcagatacaa

SEQ ID NO: 100908 - DNA, 20 bp, human
gggcgggaggtaagtgctcg

SEQ ID NO: 100909 - DNA, 20 bp, human
gtccgcgccgcggagcgcag

SEQ ID NO: 100910 - DNA, 20 bp, human
ggggagccctgaagacgcgg

SEQ ID NO: 100911 - DNA, 20 bp, human
ggccgggagccctgaagacg

SEQ ID NO: 100912 - DNA, 20 bp, human
gcgcagagtggactctggtc

SEQ ID NO: 100913 - DNA, 20 bp, human
ggctggcaggctgttactga

SEQ ID NO: 100914 - DNA, 20 bp, human
gagcggcgcagagtggactc

SEQ ID NO: 100915 - DNA, 20 bp, human
ggagtgcgcgagcgtgtgca

SEQ ID NO: 100916 - DNA, 20 bp, human
ggctcggctactgctcgctc

SEQ ID NO: 100917 - DNA, 20 bp, human
ggaagcagtggtggtggcgt

SEQ ID NO: 100918 - DNA, 20 bp, human
ggcaaggtggcctatgagag

SEQ ID NO: 100919 - DNA, 20 bp, human
gcagtagccgagctggtgag

SEQ ID NO: 100920 - DNA, 20 bp, human
gggacagttcccctacctgg

SEQ ID NO: 100921 - DNA, 20 bp, human
gtcattggcaggaacccgga

SEQ ID NO: 100922 - DNA, 20 bp, human
gggaacccggagggccagct

SEQ ID NO: 100923 - DNA, 20 bp, human
ggaaagcaccgaatagaggg

SEQ ID NO: 100924 - DNA, 20 bp, human
gccacacccgctcaccagct

SEQ ID NO: 100925 - DNA, 20 bp, human
ggcttcacctcccccaggta

SEQ ID NO: 100926 - DNA, 20 bp, human
gcccgtcgcgggatcgatcg

SEQ ID NO: 100927 - DNA, 20 bp, human
gcggcccgcgcagcccggta

SEQ ID NO: 100928 - DNA, 20 bp, human
gccgcgcagcccggtaaggg

SEQ ID NO: 100929 - DNA, 20 bp, human
gccgcgctacagctccgcag

SEQ ID NO: 100930 - DNA, 20 bp, human
gggatcgatcgtggccgctg

SEQ ID NO: 100931 - DNA, 20 bp, human
ggaaccccgctgcaccatgg

SEQ ID NO: 100932 - DNA, 20 bp, human
gtggcagcttgggcaggcgt

SEQ ID NO: 100933 - DNA, 20 bp, human
gcggcgaggccccccttacc

SEQ ID NO: 100934 - DNA, 20 bp, human
gccccaggaggttccagaag

SEQ ID NO: 100935 - DNA, 20 bp, human
ggcgcgcgtagacccgtcgc

SEQ ID NO: 100936 - DNA, 20 bp, human
ggagggttcggagaggagtt

SEQ ID NO: 100937 - DNA, 20 bp, human
ggagaggagttgggttcagt

SEQ ID NO: 100938 - DNA, 20 bp, human
gagggttagaggctaattag

SEQ ID NO: 100939 - DNA, 20 bp, human
gggccggtgatccacaatag

SEQ ID NO: 100940 - DNA, 20 bp, human
ggctgggggagggttcggag

SEQ ID NO: 100941 - DNA, 20 bp, human
gggcgtgctatggaaggttc

SEQ ID NO: 100942 - DNA, 20 bp, human
gttagagggcgtgctatgga

SEQ ID NO: 100943 - DNA, 20 bp, human
gaggaccgccgccagaacgg

SEQ ID NO: 100944 - DNA, 20 bp, human
gcggaaggagggtgagtgac

SEQ ID NO: 100945 - DNA, 20 bp, human
gggcgcagggcctccgctgg

SEQ ID NO: 100946 - DNA, 20 bp, human
gtcccgtcgtcgctgcgtgg

SEQ ID NO: 100947 - DNA, 20 bp, human
gcagtgtcgggcgcagacgg

SEQ ID NO: 100948 - DNA, 20 bp, human
gcgccgcaaacgtcagtgtc

SEQ ID NO: 100949 - DNA, 20 bp, human
gccccgtggagcagacacag

SEQ ID NO: 100950 - DNA, 20 bp, human
gcgagggtcggaaatctgtg

SEQ ID NO: 100951 - DNA, 20 bp, human
gcgtcagtgtcgggcgcaga

SEQ ID NO: 100952 - DNA, 20 bp, human
gcggcagtgcggcttgctct

SEQ ID NO: 100953 - DNA, 20 bp, human
ggaaatctgtggggaactag

SEQ ID NO: 100954 - DNA, 20 bp, human
ggattccagatagcagtgag

SEQ ID NO: 100955 - DNA, 20 bp, human
gctgccgtattcccaaagag

SEQ ID NO: 100956 - DNA, 20 bp, human
gggcttcccgggtacaaaaa

SEQ ID NO: 100957 - DNA, 20 bp, human
gccgggtacaaaaatggctg

SEQ ID NO: 100958 - DNA, 20 bp, human
gaaggcgccgggggacacgt

SEQ ID NO: 100959 - DNA, 20 bp, human
gccaccagcgggtggtccag

SEQ ID NO: 100960 - DNA, 20 bp, human
ggtggtgtggagggtacagg

SEQ ID NO: 100961 - DNA, 20 bp, human
gcatccactggaccacccgc

SEQ ID NO: 100962 - DNA, 20 bp, human
gaggagcttaagaatagagg

SEQ ID NO: 100963 - DNA, 20 bp, human
gttgaaaacacccccaccag

SEQ ID NO: 100964 - DNA, 20 bp, human
ggtgtggagggtacaggcgg

SEQ ID NO: 100965 - DNA, 20 bp, human
gaccgagaggccgggtggtg

SEQ ID NO: 100966 - DNA, 20 bp, human
ggcgtaattgaagccaccaa

SEQ ID NO: 100967 - DNA, 20 bp, human
gagcgaacatggcagcgcgt

SEQ ID NO: 100968 - DNA, 20 bp, human
gatgagcagcgccaccacca

SEQ ID NO: 100969 - DNA, 20 bp, human
gccccaccctcagacctagc

SEQ ID NO: 100970 - DNA, 20 bp, human
ggtctctgtgaccatggtgg

SEQ ID NO: 100971 - DNA, 20 bp, human
ggaacatggcagcgcgttgg

SEQ ID NO: 100972 - DNA, 20 bp, human
gttgctccggctaggtctga

SEQ ID NO: 100973 - DNA, 20 bp, human
ggcatagaagcggcagggaa

SEQ ID NO: 100974 - DNA, 20 bp, human
gtgggccccgtcaggtgttg

SEQ ID NO: 100975 - DNA, 20 bp, human
gtctcagatatcctactcct

SEQ ID NO: 100976 - DNA, 20 bp, human
gagacgccggagcttcacaa

SEQ ID NO: 100977 - DNA, 20 bp, human
gcagaggtgggagatcccgg

SEQ ID NO: 100978 - DNA, 20 bp, human
ggagcagaggtgggagatcc

SEQ ID NO: 100979 - DNA, 20 bp, human
ggcggacaggtaatccccag

SEQ ID NO: 100980 - DNA, 20 bp, human
gcttcacaagggagcgaacg

SEQ ID NO: 100981 - DNA, 20 bp, human
gagcgaacgaggtaagcagc

SEQ ID NO: 100982 - DNA, 20 bp, human
gggctgggtcggacagaggg

SEQ ID NO: 100983 - DNA, 20 bp, human
gcggtccctgacgccggtag

SEQ ID NO: 100984 - DNA, 20 bp, human
gatcccggaggagagtttag

SEQ ID NO: 100985 - DNA, 20 bp, human
ggcgggagtggtcagcccga

SEQ ID NO: 100986 - DNA, 20 bp, human
gtgggacccagtgcgatccg

SEQ ID NO: 100987 - DNA, 20 bp, human
gcgggtgtaagaacaaccgg

SEQ ID NO: 100988 - DNA, 20 bp, human
gggatgatgtgagtctcctc

SEQ ID NO: 100989 - DNA, 20 bp, human
gccccgggtgtaagaacaac

SEQ ID NO: 100990 - DNA, 20 bp, human
gtccgactgcatggtgtccg

SEQ ID NO: 100991 - DNA, 20 bp, human
gcgggacacatcgaccccat

SEQ ID NO: 100992 - DNA, 20 bp, human
gtgtgctcacaacccggccg

SEQ ID NO: 100993 - DNA, 20 bp, human
gaattccctgcgcaaacccc

SEQ ID NO: 100994 - DNA, 20 bp, human
ggccgcggacaccatgcagt

SEQ ID NO: 100995 - DNA, 20 bp, human
gaacgcgcacatggatgaga

SEQ ID NO: 100996 - DNA, 20 bp, human
gggtctgcgcggagtctgag

SEQ ID NO: 100997 - DNA, 20 bp, human
gggactatggaggaaaaact

SEQ ID NO: 100998 - DNA, 20 bp, human
ggctccgcggagccagcgag

SEQ ID NO: 100999 - DNA, 20 bp, human
gctggcgtcggccttgggac

SEQ ID NO: 101000 - DNA, 20 bp, human
gtctagaccaacagaatgag

SEQ ID NO: 101001 - DNA, 20 bp, human
gggaacagtctacaggacta

SEQ ID NO: 101002 - DNA, 20 bp, human
gctccgcgcagacctctcgc

SEQ ID NO: 101003 - DNA, 20 bp, human
ggcgcgcgggttaagagcag

SEQ ID NO: 101004 - DNA, 20 bp, human
ggaagggcacaaaggaccgg

SEQ ID NO: 101005 - DNA, 20 bp, human
gcggcgctcgtcccgtccca

SEQ ID NO: 101006 - DNA, 20 bp, human
gcggagcccgcggagctgag

SEQ ID NO: 101007 - DNA, 20 bp, human
gcaccgagaggaccccggga

SEQ ID NO: 101008 - DNA, 20 bp, human
ggcgcgcggagacgcagcag

SEQ ID NO: 101009 - DNA, 20 bp, human
gcgcgtaacaggtgctagga

SEQ ID NO: 101010 - DNA, 20 bp, human
gaggcgcctttagaaaccca

SEQ ID NO: 101011 - DNA, 20 bp, human
gggcctccttcccttcgacg

SEQ ID NO: 101012 - DNA, 20 bp, human
gacatcctgcggacctactc

SEQ ID NO: 101013 - DNA, 20 bp, human
ggagcaggtgcccgcgtaac

SEQ ID NO: 101014 - DNA, 20 bp, human
ggtaggtccgcaggatgtcg

SEQ ID NO: 101015 - DNA, 20 bp, human
gacaatctccaggcagacga

SEQ ID NO: 101016 - DNA, 20 bp, human
gccggaccgagaagagagag

SEQ ID NO: 101017 - DNA, 20 bp, human
gcccttggcggcataagacg

SEQ ID NO: 101018 - DNA, 20 bp, human
gggaacagcgcgacccccga

SEQ ID NO: 101019 - DNA, 20 bp, human
gcataagacggggcaccgag

SEQ ID NO: 101020 - DNA, 20 bp, human
ggagggaggaacccccttgg

SEQ ID NO: 101021 - DNA, 20 bp, human
gccgtccgacgtgccctcgg

SEQ ID NO: 101022 - DNA, 20 bp, human
gcgagctgccgcggagcacc

SEQ ID NO: 101023 - DNA, 20 bp, human
gtcggacggggcgtagctgg

SEQ ID NO: 101024 - DNA, 20 bp, human
gtcccaccgggcgcacagcg

SEQ ID NO: 101025 - DNA, 20 bp, human
ggaaggcgaaagggatggtg

SEQ ID NO: 101026 - DNA, 20 bp, human
gctgctgctatggggccggg

SEQ ID NO: 101027 - DNA, 20 bp, human
gcgacgcaaggctgctgcta

SEQ ID NO: 101028 - DNA, 20 bp, human
gcactgtgaaacgggaaggt

SEQ ID NO: 101029 - DNA, 20 bp, human
ggctgctcgccccactaatg

SEQ ID NO: 101030 - DNA, 20 bp, human
gggacgcccagaatcggacg

SEQ ID NO: 101031 - DNA, 20 bp, human
gctgcacatccagagctgga

SEQ ID NO: 101032 - DNA, 20 bp, human
gcggaggggacggtcaacga

SEQ ID NO: 101033 - DNA, 20 bp, human
gcgccctgcgccacattagt

SEQ ID NO: 101034 - DNA, 20 bp, human
gcgggcgtggagaagaacga

SEQ ID NO: 101035 - DNA, 20 bp, human
gaatcggacgcggcaggtac

SEQ ID NO: 101036 - DNA, 20 bp, human
gagcgcggcacggccctcag

SEQ ID NO: 101037 - DNA, 20 bp, human
ggcggcacggccctcagagg

SEQ ID NO: 101038 - DNA, 20 bp, human
gctccgagccgcggaggcag

SEQ ID NO: 101039 - DNA, 20 bp, human
ggcggccctgagctcacctg

SEQ ID NO: 101040 - DNA, 20 bp, human
gcggcaaacctgtctaattg

SEQ ID NO: 101041 - DNA, 20 bp, human
gtccgcctcaggtgagctca

SEQ ID NO: 101042 - DNA, 20 bp, human
ggcgtgagtgagcggaggtg

SEQ ID NO: 101043 - DNA, 20 bp, human
gcgggagccccggcagtccg

SEQ ID NO: 101044 - DNA, 20 bp, human
gaggacttcggtcattgagg

SEQ ID NO: 101045 - DNA, 20 bp, human
gccgggcgcgcgggtcgagc

SEQ ID NO: 101046 - DNA, 20 bp, human
gcggtgagccggacccccgg

SEQ ID NO: 101047 - DNA, 20 bp, human
gctggtcctgggcgacgatg

SEQ ID NO: 101048 - DNA, 20 bp, human
gctcctctcccagccagtcg

SEQ ID NO: 101049 - DNA, 20 bp, human
gggaccccgggacaaccccg

SEQ ID NO: 101050 - DNA, 20 bp, human
ggctgggctgggccatccga

SEQ ID NO: 101051 - DNA, 20 bp, human
gtcctagtgaaagggatcgt

SEQ ID NO: 101052 - DNA, 20 bp, human
gtgggccgcggtctgacctg

SEQ ID NO: 101053 - DNA, 20 bp, human
gttgaaaggccagccacgac

SEQ ID NO: 101054 - DNA, 20 bp, human
ggcagcctcaggtcagaccg

SEQ ID NO: 101055 - DNA, 20 bp, human
gctcctggcgttgcaaggta

SEQ ID NO: 101056 - DNA, 20 bp, human
gggagcagtgcggccacaca

SEQ ID NO: 101057 - DNA, 20 bp, human
ggctggacagaggcatggtt

SEQ ID NO: 101058 - DNA, 20 bp, human
gtaaccgcacggaacttccc

SEQ ID NO: 101059 - DNA, 20 bp, human
ggagggcgacccccaatggg

SEQ ID NO: 101060 - DNA, 20 bp, human
ggcgcaggctgataaccgca

SEQ ID NO: 101061 - DNA, 20 bp, human
gcccaatgggaggcatcgac

SEQ ID NO: 101062 - DNA, 20 bp, human
ggtgcctgggaagttccgtg

SEQ ID NO: 101063 - DNA, 20 bp, human
ggtccaagggtggcagatga

SEQ ID NO: 101064 - DNA, 20 bp, human
gacttcccaggcaccctgtg

SEQ ID NO: 101065 - DNA, 20 bp, human
ggcaggcccgaggaccccat

SEQ ID NO: 101066 - DNA, 20 bp, human
gggtagcgcggaaaacaatg

SEQ ID NO: 101067 - DNA, 20 bp, human
gtccaggcgctcgggcgaca

SEQ ID NO: 101068 - DNA, 20 bp, human
gggccccgccttcttccgag

SEQ ID NO: 101069 - DNA, 20 bp, human
gcgggcctctcggaagaagg

SEQ ID NO: 101070 - DNA, 20 bp, human
ggcgggcctcgcaggtgctg

SEQ ID NO: 101071 - DNA, 20 bp, human
gacctgcgaggcccgctacg

SEQ ID NO: 101072 - DNA, 20 bp, human
gggcgacacggcctcgtagc

SEQ ID NO: 101073 - DNA, 20 bp, human
gtggatgcagcgctggtgca

SEQ ID NO: 101074 - DNA, 20 bp, human
gggccgcgccatgcccccga

SEQ ID NO: 101075 - DNA, 20 bp, human
gtgctgcctacctcaagcct

SEQ ID NO: 101076 - DNA, 20 bp, human
gcattgtgctccgataggag

SEQ ID NO: 101077 - DNA, 20 bp, human
ggccagcaagctgcagatgg

SEQ ID NO: 101078 - DNA, 20 bp, human
gcggagtcacggcgatacac

SEQ ID NO: 101079 - DNA, 20 bp, human
gtgtattagaatagagccgg

SEQ ID NO: 101080 - DNA, 20 bp, human
gtggctcgcgcccggagtca

SEQ ID NO: 101081 - DNA, 20 bp, human
gccccggccagtggatctga

SEQ ID NO: 101082 - DNA, 20 bp, human
ggccagtggatctgagggtc

SEQ ID NO: 101083 - DNA, 20 bp, human
gtataaagcggagcaaatac

SEQ ID NO: 101084 - DNA, 20 bp, human
ggctttcattgtgctccgat

SEQ ID NO: 101085 - DNA, 20 bp, human
gctcgttcgaggctccctgg

SEQ ID NO: 101086 - DNA, 20 bp, human
gggcagcccagccgagcgtt

SEQ ID NO: 101087 - DNA, 20 bp, human
ggagcagttgatcattgtga

SEQ ID NO: 101088 - DNA, 20 bp, human
gcactccgctggcatggagg

SEQ ID NO: 101089 - DNA, 20 bp, human
gtatcactccgctggcatgg

SEQ ID NO: 101090 - DNA, 20 bp, human
gtcgcgcgtgtccgcactgg

SEQ ID NO: 101091 - DNA, 20 bp, human
gtcagtaaacacggcagcgg

SEQ ID NO: 101092 - DNA, 20 bp, human
gagctcagtaaacacggcag

SEQ ID NO: 101093 - DNA, 20 bp, human
ggtgtcgcgcgtgtccgcac

SEQ ID NO: 101094 - DNA, 20 bp, human
gtccacaccgcatcggaaaa

SEQ ID NO: 101095 - DNA, 20 bp, human
gcaagcatatgcctccagtg

SEQ ID NO: 101096 - DNA, 20 bp, human
ggaatggagcgagcagattg

SEQ ID NO: 101097 - DNA, 20 bp, human
gccgggctggttcgagaagg

SEQ ID NO: 101098 - DNA, 20 bp, human
gctcgcggccaagttcatgc

SEQ ID NO: 101099 - DNA, 20 bp, human
gccgtgctgcagagctccgg

SEQ ID NO: 101100 - DNA, 20 bp, human
gcagccgggctggttcgaga

SEQ ID NO: 101101 - DNA, 20 bp, human
ggcggccaagttcatgctgg

SEQ ID NO: 101102 - DNA, 20 bp, human
gctcgaaacgccggagacca

SEQ ID NO: 101103 - DNA, 20 bp, human
gggctggttcgagaaggggg

SEQ ID NO: 101104 - DNA, 20 bp, human
gagcgccgccagcatgaact

SEQ ID NO: 101105 - DNA, 20 bp, human
gccgtcgggcgtctgaaatc

SEQ ID NO: 101106 - DNA, 20 bp, human
gtcaggagcagagtaagtat

SEQ ID NO: 101107 - DNA, 20 bp, human
gcgaagctggaggactgtgg

SEQ ID NO: 101108 - DNA, 20 bp, human
gccagcttcggatccacaga

SEQ ID NO: 101109 - DNA, 20 bp, human
ggtaagtatgggccccaaaa

SEQ ID NO: 101110 - DNA, 20 bp, human
gatatcccagtggggagtgg

SEQ ID NO: 101111 - DNA, 20 bp, human
gagctgcaggaaccaatgag

SEQ ID NO: 101112 - DNA, 20 bp, human
gcggatccacagacggaatc

SEQ ID NO: 101113 - DNA, 20 bp, human
gattccaggatatcccagtg

SEQ ID NO: 101114 - DNA, 20 bp, human
gctgctcctgattccgtctg

SEQ ID NO: 101115 - DNA, 20 bp, human
gggccccaaaagggagggga

SEQ ID NO: 101116 - DNA, 20 bp, human
gcacctggtgagaagcccct

SEQ ID NO: 101117 - DNA, 20 bp, human
ggccccccccgtccacccca

SEQ ID NO: 101118 - DNA, 20 bp, human
gggacaccttgctccgagga

SEQ ID NO: 101119 - DNA, 20 bp, human
gcaccttgctccgaggaagg

SEQ ID NO: 101120 - DNA, 20 bp, human
gcagcttcgccgagcccacc

SEQ ID NO: 101121 - DNA, 20 bp, human
ggtctcaaccctgggatcct

SEQ ID NO: 101122 - DNA, 20 bp, human
gacccggacaccttgctccg

SEQ ID NO: 101123 - DNA, 20 bp, human
ggatgagaatccaagatcct

SEQ ID NO: 101124 - DNA, 20 bp, human
gggctgagggtctcaaccct

SEQ ID NO: 101125 - DNA, 20 bp, human
ggctcggcgaagctgtgctc

SEQ ID NO: 101126 - DNA, 20 bp, human
ggccccggcgcggctcaggt

SEQ ID NO: 101127 - DNA, 20 bp, human
gctggaggctcgccaggagt

SEQ ID NO: 101128 - DNA, 20 bp, human
ggcgcacctctgggcaggag

SEQ ID NO: 101129 - DNA, 20 bp, human
gggcagcgagtagagcagca

SEQ ID NO: 101130 - DNA, 20 bp, human
gaggctcgccaggagtcgga

SEQ ID NO: 101131 - DNA, 20 bp, human
gggaggggcagcgcacctct

SEQ ID NO: 101132 - DNA, 20 bp, human
gctcgccaggagtcggaggg

SEQ ID NO: 101133 - DNA, 20 bp, human
ggcagagtcctgtccagtcc

SEQ ID NO: 101134 - DNA, 20 bp, human
ggggcgagcgcgccgacctg

SEQ ID NO: 101135 - DNA, 20 bp, human
ggcagcgcgcgagcacctcg

SEQ ID NO: 101136 - DNA, 20 bp, human
gacccgtgcggtagcaacag

SEQ ID NO: 101137 - DNA, 20 bp, human
gcccgctgctgcccactcga

SEQ ID NO: 101138 - DNA, 20 bp, human
ggctccctgacagacccgtg

SEQ ID NO: 101139 - DNA, 20 bp, human
gcgtgcggtagcaacagcgg

SEQ ID NO: 101140 - DNA, 20 bp, human
gactcgacggctggcgcgaa

SEQ ID NO: 101141 - DNA, 20 bp, human
gctaccgcacgggtctgtca

SEQ ID NO: 101142 - DNA, 20 bp, human
gcggacgtctgcaaacaggg

SEQ ID NO: 101143 - DNA, 20 bp, human
gtgcagaaaagctgcaaggt

SEQ ID NO: 101144 - DNA, 20 bp, human
gcgtccgaaacacctgagtc

SEQ ID NO: 101145 - DNA, 20 bp, human
gacccctaggaatgaagagg

SEQ ID NO: 101146 - DNA, 20 bp, human
gtcgcctgcagcggtctcag

SEQ ID NO: 101147 - DNA, 20 bp, human
ggcaggagaagcggagctct

SEQ ID NO: 101148 - DNA, 20 bp, human
gtcggagccgcagtctggga

SEQ ID NO: 101149 - DNA, 20 bp, human
gtcctggttggggcagccgt

SEQ ID NO: 101150 - DNA, 20 bp, human
gctcttggagcggaaaccgg

SEQ ID NO: 101151 - DNA, 20 bp, human
gcgcgtatccgtgtgatggg

SEQ ID NO: 101152 - DNA, 20 bp, human
ggctctcggttcctctcagt

SEQ ID NO: 101153 - DNA, 20 bp, human
gagatgaagtcccgatgagg

SEQ ID NO: 101154 - DNA, 20 bp, human
gtgacaacagcaagagttgg

SEQ ID NO: 101155 - DNA, 20 bp, human
gacttcctgacgccgccagt

SEQ ID NO: 101156 - DNA, 20 bp, human
ggcttgaggcgagaggagtg

SEQ ID NO: 101157 - DNA, 20 bp, human
gagcgagtcctcccgcgagg

SEQ ID NO: 101158 - DNA, 20 bp, human
gacacgtgcctggactccga

SEQ ID NO: 101159 - DNA, 20 bp, human
gtggagcgagtcctcccgcg

SEQ ID NO: 101160 - DNA, 20 bp, human
gcgaagcggcgaaactctca

SEQ ID NO: 101161 - DNA, 20 bp, human
gccccgaagttcagggagtt

SEQ ID NO: 101162 - DNA, 20 bp, human
gtcgcgggccggggcatggc

SEQ ID NO: 101163 - DNA, 20 bp, human
gcgtcccggcctccccgtgg

SEQ ID NO: 101164 - DNA, 20 bp, human
gggaggcggctcctgctcgc

SEQ ID NO: 101165 - DNA, 20 bp, human
gccgggcgagcggagcggca

SEQ ID NO: 101166 - DNA, 20 bp, human
gcgcagctaggtcagagaag

SEQ ID NO: 101167 - DNA, 20 bp, human
ggcgtgtcctcctcacccag

SEQ ID NO: 101168 - DNA, 20 bp, human
gctaggtcagagaagcggag

SEQ ID NO: 101169 - DNA, 20 bp, human
gcccgggagaagggagcctc

SEQ ID NO: 101170 - DNA, 20 bp, human
gcgggcgcctattgacccag

SEQ ID NO: 101171 - DNA, 20 bp, human
ggtcccgcccagaagttgta

SEQ ID NO: 101172 - DNA, 20 bp, human
gcccacaaacgcggagatgg

SEQ ID NO: 101173 - DNA, 20 bp, human
gaccgcccgccacgagcagg

SEQ ID NO: 101174 - DNA, 20 bp, human
gcagcagccgctgggtcaat

SEQ ID NO: 101175 - DNA, 20 bp, human
gtctaggaagcagccgccgg

SEQ ID NO: 101176 - DNA, 20 bp, human
gcgacgaagtcggagcgggt

SEQ ID NO: 101177 - DNA, 20 bp, human
gagagacaggcgccaggtac

SEQ ID NO: 101178 - DNA, 20 bp, human
ggagagagttggatcacaga

SEQ ID NO: 101179 - DNA, 20 bp, human
gccgagcccggcctctgtcg

SEQ ID NO: 101180 - DNA, 20 bp, human
ggcctagacccagtctctaa

SEQ ID NO: 101181 - DNA, 20 bp, human
gcggcagcttcagaggctgg

SEQ ID NO: 101182 - DNA, 20 bp, human
gtccccggggccgacgaagt

SEQ ID NO: 101183 - DNA, 20 bp, human
ggagttggatcacagagggc

SEQ ID NO: 101184 - DNA, 20 bp, human
gcctgtctctgcggtccccg

SEQ ID NO: 101185 - DNA, 20 bp, human
ggctgcctgaggcccgtacc

SEQ ID NO: 101186 - DNA, 20 bp, human
gaagcatcccggagacacgg

SEQ ID NO: 101187 - DNA, 20 bp, human
ggcccgcgcgtaggcgccca

SEQ ID NO: 101188 - DNA, 20 bp, human
ggccatgggcgcctacgcgc

SEQ ID NO: 101189 - DNA, 20 bp, human
gggcaagcatcccggagaca

SEQ ID NO: 101190 - DNA, 20 bp, human
gccgagctgaaacgtacagg

SEQ ID NO: 101191 - DNA, 20 bp, human
gacccccgaagcccgcgcgt

SEQ ID NO: 101192 - DNA, 20 bp, human
gcctccgagctgaaacgtac

SEQ ID NO: 101193 - DNA, 20 bp, human
ggaatacagtctagaggtgt

SEQ ID NO: 101194 - DNA, 20 bp, human
ggggttccccggccctggaa

SEQ ID NO: 101195 - DNA, 20 bp, human
ggctgtgcgcatctgagtat

SEQ ID NO: 101196 - DNA, 20 bp, human
gtgcgagggtcctccaccag

SEQ ID NO: 101197 - DNA, 20 bp, human
gaccagggttacctgggcag

SEQ ID NO: 101198 - DNA, 20 bp, human
gtcgaaggttctggacacca

SEQ ID NO: 101199 - DNA, 20 bp, human
gagccccgagtacaacgcca

SEQ ID NO: 101200 - DNA, 20 bp, human
gaagtaatcgaccagctcct

SEQ ID NO: 101201 - DNA, 20 bp, human
gtctggacaccagggttacc

SEQ ID NO: 101202 - DNA, 20 bp, human
gctccttggcgttgtactcg

SEQ ID NO: 101203 - DNA, 20 bp, human
ggtcgatcagccgctggtgg

SEQ ID NO: 101204 - DNA, 20 bp, human
gtgtgtcgatcagccgctgg

SEQ ID NO: 101205 - DNA, 20 bp, human
ggtcgattacttcctaaatg

SEQ ID NO: 101206 - DNA, 20 bp, human
gccggcctgccgcagggatg

SEQ ID NO: 101207 - DNA, 20 bp, human
gcggcggactggacccctgg

SEQ ID NO: 101208 - DNA, 20 bp, human
gccctcgcggacccggaagt

SEQ ID NO: 101209 - DNA, 20 bp, human
gtagcgacgcaaccagtcaa

SEQ ID NO: 101210 - DNA, 20 bp, human
gaccttcccggcctgccgca

SEQ ID NO: 101211 - DNA, 20 bp, human
gccctggcggtcgcagcaac

SEQ ID NO: 101212 - DNA, 20 bp, human
ggagggtggtgcagattgga

SEQ ID NO: 101213 - DNA, 20 bp, human
gacccctgcattcccggctg

SEQ ID NO: 101214 - DNA, 20 bp, human
ggcaccacgaaggcccggat

SEQ ID NO: 101215 - DNA, 20 bp, human
gccgatgccggcgcagaagg

SEQ ID NO: 101216 - DNA, 20 bp, human
gagcgagagcccggcgatgg

SEQ ID NO: 101217 - DNA, 20 bp, human
gtacagtcggtaaagtagag

SEQ ID NO: 101218 - DNA, 20 bp, human
gctgcgtgggacgggccggt

SEQ ID NO: 101219 - DNA, 20 bp, human
gctaccaggaggcagtccag

SEQ ID NO: 101220 - DNA, 20 bp, human
gtgcgccagtgcttcaaggc

SEQ ID NO: 101221 - DNA, 20 bp, human
gtgcgccggccttgaagcac

SEQ ID NO: 101222 - DNA, 20 bp, human
gtggcgcaccacgctggagc

SEQ ID NO: 101223 - DNA, 20 bp, human
ggtcccgctggactgcctcc

SEQ ID NO: 101224 - DNA, 20 bp, human
gaagcactggcgcaccacgc

SEQ ID NO: 101225 - DNA, 20 bp, human
gcggcgcagccgccatcgcc

SEQ ID NO: 101226 - DNA, 20 bp, human
ggagatgtggagagatcgaa

SEQ ID NO: 101227 - DNA, 20 bp, human
gaggcagcgctgcaagggac

SEQ ID NO: 101228 - DNA, 20 bp, human
gcgatctctccacatctcgg

SEQ ID NO: 101229 - DNA, 20 bp, human
gctgatgtcccaacatgggt

SEQ ID NO: 101230 - DNA, 20 bp, human
gatcaggccctgctggaaca

SEQ ID NO: 101231 - DNA, 20 bp, human
gtcgaaaggcagcgctgcaa

SEQ ID NO: 101232 - DNA, 20 bp, human
ggggaaatgcccaagctatg

SEQ ID NO: 101233 - DNA, 20 bp, human
ggttactgatgtcccaacat

SEQ ID NO: 101234 - DNA, 20 bp, human
gcgcagccagggaccgcccc

SEQ ID NO: 101235 - DNA, 20 bp, human
ggcctcggctacttccgagg

SEQ ID NO: 101236 - DNA, 20 bp, human
gcaggccaccgcaccgagga

SEQ ID NO: 101237 - DNA, 20 bp, human
gtcttaccgtgggcaagtca

SEQ ID NO: 101238 - DNA, 20 bp, human
gcgtatggctctcttaccgt

SEQ ID NO: 101239 - DNA, 20 bp, human
ggagagagccgtcctcggtg

SEQ ID NO: 101240 - DNA, 20 bp, human
gcgcagggaactacttccgg

SEQ ID NO: 101241 - DNA, 20 bp, human
gaggccctccgcctcccggg

SEQ ID NO: 101242 - DNA, 20 bp, human
gccggccggcctgtctccag

SEQ ID NO: 101243 - DNA, 20 bp, human
gtggactgtgcacctactaa

SEQ ID NO: 101244 - DNA, 20 bp, human
gtgtactgcggggtaaaccg

SEQ ID NO: 101245 - DNA, 20 bp, human
gcgcagctttgcggtggggt

SEQ ID NO: 101246 - DNA, 20 bp, human
ggggagacaaggaaaatccg

SEQ ID NO: 101247 - DNA, 20 bp, human
gcgcgggtctaagaggacta

SEQ ID NO: 101248 - DNA, 20 bp, human
ggcgttccgggcgctttcag

SEQ ID NO: 101249 - DNA, 20 bp, human
gtgtgcgcgcgccttcgggg

SEQ ID NO: 101250 - DNA, 20 bp, human
ggaaaatccgaggcgacagg

SEQ ID NO: 101251 - DNA, 20 bp, human
gcggtcggctcaaggcccag

SEQ ID NO: 101252 - DNA, 20 bp, human
ggcagctactcaccagggtc

SEQ ID NO: 101253 - DNA, 20 bp, human
gctcctgcagctactcacca

SEQ ID NO: 101254 - DNA, 20 bp, human
gagcggcgcggaagaaagag

SEQ ID NO: 101255 - DNA, 20 bp, human
gcttgcaaggactcggccag

SEQ ID NO: 101256 - DNA, 20 bp, human
gcgagcccgcccgcactgcg

SEQ ID NO: 101257 - DNA, 20 bp, human
gacgcaggccttccggagcg

SEQ ID NO: 101258 - DNA, 20 bp, human
gacgctgggaggtagcgcgg

SEQ ID NO: 101259 - DNA, 20 bp, human
gcatggcgcggcacgctggg

SEQ ID NO: 101260 - DNA, 20 bp, human
gccgggcgcacagtctgcct

SEQ ID NO: 101261 - DNA, 20 bp, human
gccgtaccacgagtagtaga

SEQ ID NO: 101262 - DNA, 20 bp, human
gagacgcgcaggctctgcac

SEQ ID NO: 101263 - DNA, 20 bp, human
gccagtgcggcaccatgacg

SEQ ID NO: 101264 - DNA, 20 bp, human
gcccgcaccgcggaccctgg

SEQ ID NO: 101265 - DNA, 20 bp, human
ggtggtcccagtgaatgtag

SEQ ID NO: 101266 - DNA, 20 bp, human
gacttggaggcggtgcggcg

SEQ ID NO: 101267 - DNA, 20 bp, human
gcgggtgcggttcagtcggt

SEQ ID NO: 101268 - DNA, 20 bp, human
ggagctcccgacgccgaacg

SEQ ID NO: 101269 - DNA, 20 bp, human
gttcggcgtcgggagctcca

SEQ ID NO: 101270 - DNA, 20 bp, human
gcggttcagtcggtcggcgg

SEQ ID NO: 101271 - DNA, 20 bp, human
gtgtccccaccaccatctag

SEQ ID NO: 101272 - DNA, 20 bp, human
ggcggcgggtgcggttcagt

SEQ ID NO: 101273 - DNA, 20 bp, human
ggtggtggggacaataactc

SEQ ID NO: 101274 - DNA, 20 bp, human
gtaacctctagatggtggtg

SEQ ID NO: 101275 - DNA, 20 bp, human
gagacagggcgcagcaccca

SEQ ID NO: 101276 - DNA, 20 bp, human
ggtctcggcgaggaccgcag

SEQ ID NO: 101277 - DNA, 20 bp, human
gctcggcccctggaaaggag

SEQ ID NO: 101278 - DNA, 20 bp, human
gcaggccggtgcgggagctg

SEQ ID NO: 101279 - DNA, 20 bp, human
ggaccagctggggccaataa

SEQ ID NO: 101280 - DNA, 20 bp, human
gtgctccgcagctcccgcac

SEQ ID NO: 101281 - DNA, 20 bp, human
gcgctacctgcggagagagt

SEQ ID NO: 101282 - DNA, 20 bp, human
gagctgcggagcatccgctg

SEQ ID NO: 101283 - DNA, 20 bp, human
gggacctctaggcgggctca

SEQ ID NO: 101284 - DNA, 20 bp, human
gaaacccgccaggccggtgc

SEQ ID NO: 101285 - DNA, 20 bp, human
ggtgccttgagcccgcctag

SEQ ID NO: 101286 - DNA, 20 bp, human
gtagaagacctgggaagcga

SEQ ID NO: 101287 - DNA, 20 bp, human
gacagtctctggaacgtcag

SEQ ID NO: 101288 - DNA, 20 bp, human
gggtcttctaatcaatctgg

SEQ ID NO: 101289 - DNA, 20 bp, human
gagtctctgtaaaaaattgt

SEQ ID NO: 101290 - DNA, 20 bp, human
ggatattgctcctaagcatg

SEQ ID NO: 101291 - DNA, 20 bp, human
gcttaagatgctaagggaca

SEQ ID NO: 101292 - DNA, 20 bp, human
gccagacagaagctgaacac

SEQ ID NO: 101293 - DNA, 20 bp, human
gccaggtcttctaatcaatc

SEQ ID NO: 101294 - DNA, 20 bp, human
gttttgctaagtaaatataa

SEQ ID NO: 101295 - DNA, 20 bp, human
ggcacgtcttaagatgctaa

SEQ ID NO: 101296 - DNA, 20 bp, human
gtgacacgctcctgggtcgt

SEQ ID NO: 101297 - DNA, 20 bp, human
gtgggtcgtaggcacaggag

SEQ ID NO: 101298 - DNA, 20 bp, human
ggagcgtgtcagccaaagca

SEQ ID NO: 101299 - DNA, 20 bp, human
ggctcctgggtcgtaggcac

SEQ ID NO: 101300 - DNA, 20 bp, human
gacgtagtcgtgatcggagg

SEQ ID NO: 101301 - DNA, 20 bp, human
gagtggggacggcaaagggt

SEQ ID NO: 101302 - DNA, 20 bp, human
gctttggctgacacgctcct

SEQ ID NO: 101303 - DNA, 20 bp, human
gtcgacgtagtcgtgatcgg

SEQ ID NO: 101304 - DNA, 20 bp, human
gcaagagaaggcgagtatcg

SEQ ID NO: 101305 - DNA, 20 bp, human
gacaccacaagagctactgt

SEQ ID NO: 101306 - DNA, 20 bp, human
gacagcctgaccgtggagaa

SEQ ID NO: 101307 - DNA, 20 bp, human
gcggaggccactcttggagt

SEQ ID NO: 101308 - DNA, 20 bp, human
gaaaccccggaggccactct

SEQ ID NO: 101309 - DNA, 20 bp, human
ggcagcccttctccacggtc

SEQ ID NO: 101310 - DNA, 20 bp, human
gtaagaccggtagtgctgat

SEQ ID NO: 101311 - DNA, 20 bp, human
gaccgagaacagcctgaccg

SEQ ID NO: 101312 - DNA, 20 bp, human
ggacggaccgccactcagaa

SEQ ID NO: 101313 - DNA, 20 bp, human
gtccgctagccagttcccag

SEQ ID NO: 101314 - DNA, 20 bp, human
gctgactccgactccaagag

SEQ ID NO: 101315 - DNA, 20 bp, human
gtcagtactctcgctaagac

SEQ ID NO: 101316 - DNA, 20 bp, human
gcccggggctggtaatatag

SEQ ID NO: 101317 - DNA, 20 bp, human
gaggcctagcagccttctgg

SEQ ID NO: 101318 - DNA, 20 bp, human
gctgcgcgtccgggctcccg

SEQ ID NO: 101319 - DNA, 20 bp, human
gtccgagcgcgtgaagagga

SEQ ID NO: 101320 - DNA, 20 bp, human
gggtgcgttcccggacgcag

SEQ ID NO: 101321 - DNA, 20 bp, human
ggcacgggcagggctctagt

SEQ ID NO: 101322 - DNA, 20 bp, human
gccccagactgtccacgcac

SEQ ID NO: 101323 - DNA, 20 bp, human
ggcacgcaggactgggatcg

SEQ ID NO: 101324 - DNA, 20 bp, human
ggcagcgcgcagcaggccgg

SEQ ID NO: 101325 - DNA, 20 bp, human
gtcgccgaggcgctggtgca

SEQ ID NO: 101326 - DNA, 20 bp, human
gcgcagcgcacagggtcgtg

SEQ ID NO: 101327 - DNA, 20 bp, human
gctggagctgctggtggact

SEQ ID NO: 101328 - DNA, 20 bp, human
gtttcctggggcaacagcaa

SEQ ID NO: 101329 - DNA, 20 bp, human
gagcaggctgcaggcggaag

SEQ ID NO: 101330 - DNA, 20 bp, human
gaaacgtccccggtgacggt

SEQ ID NO: 101331 - DNA, 20 bp, human
gtccgagcggctcttctcgc

SEQ ID NO: 101332 - DNA, 20 bp, human
gaagagccgctcggacagcg

SEQ ID NO: 101333 - DNA, 20 bp, human
gtccagcgagaagagccgct

SEQ ID NO: 101334 - DNA, 20 bp, human
gcggtgggagcatccggagg

SEQ ID NO: 101335 - DNA, 20 bp, human
ggagggtaaaccaacagcgt

SEQ ID NO: 101336 - DNA, 20 bp, human
gaggaggaagcctctcatgg

SEQ ID NO: 101337 - DNA, 20 bp, human
gaggaagcctctcatggagg

SEQ ID NO: 101338 - DNA, 20 bp, human
ggcctcagccggcagcttca

SEQ ID NO: 101339 - DNA, 20 bp, human
gagtctgcagcacttagggt

SEQ ID NO: 101340 - DNA, 20 bp, human
ggggctatgtttctggtcag

SEQ ID NO: 101341 - DNA, 20 bp, human
gggcttcctcctacacccca

SEQ ID NO: 101342 - DNA, 20 bp, human
gctcatggaggcggcagctc

SEQ ID NO: 101343 - DNA, 20 bp, human
gtggttcggttcttaccctg

SEQ ID NO: 101344 - DNA, 20 bp, human
gtcttaccctggggtgtagg

SEQ ID NO: 101345 - DNA, 20 bp, human
ggaagagtctgcagcactta

SEQ ID NO: 101346 - DNA, 20 bp, human
gccaacggctggaagagcgg

SEQ ID NO: 101347 - DNA, 20 bp, human
gcggccgctcctctccactg

SEQ ID NO: 101348 - DNA, 20 bp, human
gggagcgagacacttcgccg

SEQ ID NO: 101349 - DNA, 20 bp, human
gggcaggatggcgaccgtgg

SEQ ID NO: 101350 - DNA, 20 bp, human
gtatgagaggtgacgaggag

SEQ ID NO: 101351 - DNA, 20 bp, human
ggcggtggccaactcagcac

SEQ ID NO: 101352 - DNA, 20 bp, human
gggtctggaccaagtatgag

SEQ ID NO: 101353 - DNA, 20 bp, human
ggccggcaggatggcgaccg

SEQ ID NO: 101354 - DNA, 20 bp, human
gtattagatatgagacccag

SEQ ID NO: 101355 - DNA, 20 bp, human
gttctcctgccgcagtggag

SEQ ID NO: 101356 - DNA, 20 bp, human
gctcgcgctcaagggctccg

SEQ ID NO: 101357 - DNA, 20 bp, human
gctccgcgcctcgcgctcaa

SEQ ID NO: 101358 - DNA, 20 bp, human
gaggcgagctgcgagctctg

SEQ ID NO: 101359 - DNA, 20 bp, human
gcgccccgcctgtcccggag

SEQ ID NO: 101360 - DNA, 20 bp, human
gggacagcggccagaccgtg

SEQ ID NO: 101361 - DNA, 20 bp, human
gtgcggtttgggggctccgg

SEQ ID NO: 101362 - DNA, 20 bp, human
gccagaccgtgaggccgggt

SEQ ID NO: 101363 - DNA, 20 bp, human
gacggggctgacgtcacctg

SEQ ID NO: 101364 - DNA, 20 bp, human
ggcagccgaccgctgtaagg

SEQ ID NO: 101365 - DNA, 20 bp, human
ggacctgggccggcccgacc

SEQ ID NO: 101366 - DNA, 20 bp, human
gtgcgggctgaggagataca

SEQ ID NO: 101367 - DNA, 20 bp, human
ggcggcggcgaatccgactc

SEQ ID NO: 101368 - DNA, 20 bp, human
gaagtggctatcgccagagt

SEQ ID NO: 101369 - DNA, 20 bp, human
ggacctctcggaggcctggg

SEQ ID NO: 101370 - DNA, 20 bp, human
gggaggaggcagccggcgga

SEQ ID NO: 101371 - DNA, 20 bp, human
gtcgcggcgacactcaccga

SEQ ID NO: 101372 - DNA, 20 bp, human
ggggcctgggacgccgtgag

SEQ ID NO: 101373 - DNA, 20 bp, human
ggggtccgagctgtggaggg

SEQ ID NO: 101374 - DNA, 20 bp, human
gggcggcggtggccggggta

SEQ ID NO: 101375 - DNA, 20 bp, human
gccggggtccgagctgtgga

SEQ ID NO: 101376 - DNA, 20 bp, human
ggcggcagcgaatccgactg

SEQ ID NO: 101377 - DNA, 20 bp, human
gagccttacacggccacagt

SEQ ID NO: 101378 - DNA, 20 bp, human
gatccgactgtggccgtgta

SEQ ID NO: 101379 - DNA, 20 bp, human
ggtggggatctgggccgcgg

SEQ ID NO: 101380 - DNA, 20 bp, human
gtcttctactctttgttcga

SEQ ID NO: 101381 - DNA, 20 bp, human
gtctattatcaccgggattt

SEQ ID NO: 101382 - DNA, 20 bp, human
ggtgcctcccaggagacgtt

SEQ ID NO: 101383 - DNA, 20 bp, human
gtgataatagaacgatacaa

SEQ ID NO: 101384 - DNA, 20 bp, human
gttcatcccgaacgtctcct

SEQ ID NO: 101385 - DNA, 20 bp, human
ggagctcactcatgttgaca

SEQ ID NO: 101386 - DNA, 20 bp, human
gacagacagagggaagctgt

SEQ ID NO: 101387 - DNA, 20 bp, human
gaggaacttggaacagacag

SEQ ID NO: 101388 - DNA, 20 bp, human
gtgaaggaggcccttatgta

SEQ ID NO: 101389 - DNA, 20 bp, human
ggtagtggagcgctacccca

SEQ ID NO: 101390 - DNA, 20 bp, human
gcactcttgacaggtggtag

SEQ ID NO: 101391 - DNA, 20 bp, human
gccccccagcggaagtccag

SEQ ID NO: 101392 - DNA, 20 bp, human
gtgagttaggttcccggttg

SEQ ID NO: 101393 - DNA, 20 bp, human
ggactgacactcttgacagg

SEQ ID NO: 101394 - DNA, 20 bp, human
ggaggaatgagttaggttcc

SEQ ID NO: 101395 - DNA, 20 bp, human
gagcgtgagtgttaggaact

SEQ ID NO: 101396 - DNA, 20 bp, human
gcaactccgggtgaagatag

SEQ ID NO: 101397 - DNA, 20 bp, human
ggcggcggtggctggatctg

SEQ ID NO: 101398 - DNA, 20 bp, human
gagcagtgagctcggagccg

SEQ ID NO: 101399 - DNA, 20 bp, human
gcggggcggcccgaagatgg

SEQ ID NO: 101400 - DNA, 20 bp, human
ggacgtaggtgaggagcccc

SEQ ID NO: 101401 - DNA, 20 bp, human
gagctcactgctcctcgtgg

SEQ ID NO: 101402 - DNA, 20 bp, human
gagccgtggtccaactgcaa

SEQ ID NO: 101403 - DNA, 20 bp, human
ggcgggcgccgagaacgccg

SEQ ID NO: 101404 - DNA, 20 bp, human
ggacccttgcagttggacca

SEQ ID NO: 101405 - DNA, 20 bp, human
gctccgggtgaagatagggg

SEQ ID NO: 101406 - DNA, 20 bp, human
gagaagcggaagggaagtaa

SEQ ID NO: 101407 - DNA, 20 bp, human
gtccgcagtgacacctggag

SEQ ID NO: 101408 - DNA, 20 bp, human
gctacatagagccagaggtg

SEQ ID NO: 101409 - DNA, 20 bp, human
ggcccgccccagactgagag

SEQ ID NO: 101410 - DNA, 20 bp, human
ggcgccctacatagagccag

SEQ ID NO: 101411 - DNA, 20 bp, human
gctcaggtaccagtagcgtc

SEQ ID NO: 101412 - DNA, 20 bp, human
gagtgacacctggagaggac

SEQ ID NO: 101413 - DNA, 20 bp, human
gttctacgaagccagggctc

SEQ ID NO: 101414 - DNA, 20 bp, human
gtagcgccctccggagaaaa

SEQ ID NO: 101415 - DNA, 20 bp, human
gaagagcgagtgagcttgtt

SEQ ID NO: 101416 - DNA, 20 bp, human
gacacacagacacgagctgg

SEQ ID NO: 101417 - DNA, 20 bp, human
gccgggagcattatccccac

SEQ ID NO: 101418 - DNA, 20 bp, human
gtttgcagcttccctttccc

SEQ ID NO: 101419 - DNA, 20 bp, human
ggccagagagccagcctgtg

SEQ ID NO: 101420 - DNA, 20 bp, human
ggagcattatccccacaggc

SEQ ID NO: 101421 - DNA, 20 bp, human
gcttgcagactgcgtctgtc

SEQ ID NO: 101422 - DNA, 20 bp, human
gaaccgaggaagcattgatt

SEQ ID NO: 101423 - DNA, 20 bp, human
gctgctgcagaatccttctc

SEQ ID NO: 101424 - DNA, 20 bp, human
ggtctgtgtgtgccggggaa

SEQ ID NO: 101425 - DNA, 20 bp, human
gttcagcttgtctctaaccg

SEQ ID NO: 101426 - DNA, 20 bp, human
gagagcggctaggagcacgg

SEQ ID NO: 101427 - DNA, 20 bp, human
ggcggctaggagcacggcgg

SEQ ID NO: 101428 - DNA, 20 bp, human
gccagggccgcttcgcagag

SEQ ID NO: 101429 - DNA, 20 bp, human
gcgcagagcggctaggagca

SEQ ID NO: 101430 - DNA, 20 bp, human
ggctctgcggagtaagtatg

SEQ ID NO: 101431 - DNA, 20 bp, human
gtcctagccgctctgcgaag

SEQ ID NO: 101432 - DNA, 20 bp, human
gttaactgcagagccgtcgg

SEQ ID NO: 101433 - DNA, 20 bp, human
gcgcgaagccgagtcccggg

SEQ ID NO: 101434 - DNA, 20 bp, human
ggcgcgcgaagccgagtccc

SEQ ID NO: 101435 - DNA, 20 bp, human
gctgcggagtaagtatgggg

SEQ ID NO: 101436 - DNA, 20 bp, human
gcgctgccgaggcccgaaga

SEQ ID NO: 101437 - DNA, 20 bp, human
gcgggcctcggcagcggtag

SEQ ID NO: 101438 - DNA, 20 bp, human
ggagccctcggggaaggacg

SEQ ID NO: 101439 - DNA, 20 bp, human
gaggagtgcacgaggcaggg

SEQ ID NO: 101440 - DNA, 20 bp, human
gggttcgcgaggagtgcacg

SEQ ID NO: 101441 - DNA, 20 bp, human
gtctagccggggcccatagg

SEQ ID NO: 101442 - DNA, 20 bp, human
gctgcggcgtcagccttctt

SEQ ID NO: 101443 - DNA, 20 bp, human
ggtcagccttcttcgggcct

SEQ ID NO: 101444 - DNA, 20 bp, human
gacggggtgagtggtgcacg

SEQ ID NO: 101445 - DNA, 20 bp, human
gctcccggcccgccccctat

SEQ ID NO: 101446 - DNA, 20 bp, human
ggcaagtgggtcctggacgg

SEQ ID NO: 101447 - DNA, 20 bp, human
ggcggtggagactaatctag

SEQ ID NO: 101448 - DNA, 20 bp, human
ggcggcgccggagacagact

SEQ ID NO: 101449 - DNA, 20 bp, human
gactgcggcgaggactgcgg

SEQ ID NO: 101450 - DNA, 20 bp, human
ggcgctgcccagtctgtctc

SEQ ID NO: 101451 - DNA, 20 bp, human
ggtcccaaggcctaacgtgg

SEQ ID NO: 101452 - DNA, 20 bp, human
gaggacgagtccgcgacggg

SEQ ID NO: 101453 - DNA, 20 bp, human
ggcaaggacgagtccgcgac

SEQ ID NO: 101454 - DNA, 20 bp, human
gcatgccccagtccaaaggt

SEQ ID NO: 101455 - DNA, 20 bp, human
gtggtcccgggaccccgaac

SEQ ID NO: 101456 - DNA, 20 bp, human
ggcctgctgagagcccggta

SEQ ID NO: 101457 - DNA, 20 bp, human
gtggcggctccgagcccgag

SEQ ID NO: 101458 - DNA, 20 bp, human
ggaagagccgagcggcgccg

SEQ ID NO: 101459 - DNA, 20 bp, human
ggggcggtcccggaccaggt

SEQ ID NO: 101460 - DNA, 20 bp, human
gcgggcgggcgccaggtaag

SEQ ID NO: 101461 - DNA, 20 bp, human
gggtccgggggcgtccgctg

SEQ ID NO: 101462 - DNA, 20 bp, human
gtcgtcgcggcctgccccag

SEQ ID NO: 101463 - DNA, 20 bp, human
gggcgcgttcccggaaacgg

SEQ ID NO: 101464 - DNA, 20 bp, human
gctggcgccggggaccctac

SEQ ID NO: 101465 - DNA, 20 bp, human
ggtcagcagcatgcagggta

SEQ ID NO: 101466 - DNA, 20 bp, human
gccgaggccgcgcggactgg

SEQ ID NO: 101467 - DNA, 20 bp, human
gggacagagggtgaaaacaa

SEQ ID NO: 101468 - DNA, 20 bp, human
gaggtgacaaggggagtgac

SEQ ID NO: 101469 - DNA, 20 bp, human
gcacccgaggccgcgcggac

SEQ ID NO: 101470 - DNA, 20 bp, human
ggggtctgaggtgtctcccg

SEQ ID NO: 101471 - DNA, 20 bp, human
gtgatcaggaacgcacccgc

SEQ ID NO: 101472 - DNA, 20 bp, human
ggtccccgcgggaggttcaa

SEQ ID NO: 101473 - DNA, 20 bp, human
ggggctccaagaggtgacaa

SEQ ID NO: 101474 - DNA, 20 bp, human
gctcagacccccgacagcct

SEQ ID NO: 101475 - DNA, 20 bp, human
gggagccccctcctaaccag

SEQ ID NO: 101476 - DNA, 20 bp, human
gccagttgcaacgttaggga

SEQ ID NO: 101477 - DNA, 20 bp, human
ggcagctacatgatgggcca

SEQ ID NO: 101478 - DNA, 20 bp, human
gtgtgctgcagctacatgat

SEQ ID NO: 101479 - DNA, 20 bp, human
gtcccccagttgcaacgtta

SEQ ID NO: 101480 - DNA, 20 bp, human
gtgcagcagatggactttca

SEQ ID NO: 101481 - DNA, 20 bp, human
gagatactcagttccaagtt

SEQ ID NO: 101482 - DNA, 20 bp, human
gtgctcccctcccccatcaa

SEQ ID NO: 101483 - DNA, 20 bp, human
gaggaaatgcaactgagctg

SEQ ID NO: 101484 - DNA, 20 bp, human
gcacaccttgcaaaacagac

SEQ ID NO: 101485 - DNA, 20 bp, human
gcagctaaaagctccaaact

SEQ ID NO: 101486 - DNA, 20 bp, human
ggtggcggcggggaagatgg

SEQ ID NO: 101487 - DNA, 20 bp, human
ggacagcttctgttccaggg

SEQ ID NO: 101488 - DNA, 20 bp, human
gagcccgacccagaggatca

SEQ ID NO: 101489 - DNA, 20 bp, human
gccaggcccagtaagcacgg

SEQ ID NO: 101490 - DNA, 20 bp, human
gtcgcctgggtccgggaact

SEQ ID NO: 101491 - DNA, 20 bp, human
gaagatggcggcgtcctccc

SEQ ID NO: 101492 - DNA, 20 bp, human
gcctgagggtgcgaaccccc

SEQ ID NO: 101493 - DNA, 20 bp, human
ggtttgtctgccggactgac

SEQ ID NO: 101494 - DNA, 20 bp, human
gagggtcacggtgacccggg

SEQ ID NO: 101495 - DNA, 20 bp, human
gtcgccgtgatcctctgggt

SEQ ID NO: 101496 - DNA, 20 bp, human
gggcgcctcgagtcccgcag

SEQ ID NO: 101497 - DNA, 20 bp, human
gtcggccgctgcgggactcg

SEQ ID NO: 101498 - DNA, 20 bp, human
gcccgggaatcccgacgacg

SEQ ID NO: 101499 - DNA, 20 bp, human
gtgtagcccgcgagagaaaa

SEQ ID NO: 101500 - DNA, 20 bp, human
gcaccttaccgagtcggtgg

SEQ ID NO: 101501 - DNA, 20 bp, human
ggactcgaggcgccgctgtc

SEQ ID NO: 101502 - DNA, 20 bp, human
gggcgcccaccttaccgagt

SEQ ID NO: 101503 - DNA, 20 bp, human
ggcccaccttaccgagtcgg

SEQ ID NO: 101504 - DNA, 20 bp, human
ggctgcaggagacggctcgg

SEQ ID NO: 101505 - DNA, 20 bp, human
gcgcggctcgcggctccgtg

SEQ ID NO: 101506 - DNA, 20 bp, human
gccgtacagccaaatcggaa

SEQ ID NO: 101507 - DNA, 20 bp, human
gcggggcccgagtgacgtgt

SEQ ID NO: 101508 - DNA, 20 bp, human
gggaggccggtgccaaggat

SEQ ID NO: 101509 - DNA, 20 bp, human
ggtcactcgggccccgccgg

SEQ ID NO: 101510 - DNA, 20 bp, human
gttggcaccggcctcccggt

SEQ ID NO: 101511 - DNA, 20 bp, human
gacgagcctgccctttgaaa

SEQ ID NO: 101512 - DNA, 20 bp, human
gcggcccccatccttggcac

SEQ ID NO: 101513 - DNA, 20 bp, human
gtgcttccccgggccaccgg

SEQ ID NO: 101514 - DNA, 20 bp, human
gtcaccccgcgcagctccac

SEQ ID NO: 101515 - DNA, 20 bp, human
gcccgcccgtacagccaaat

SEQ ID NO: 101516 - DNA, 20 bp, human
gcagcgggggtggggaccac

SEQ ID NO: 101517 - DNA, 20 bp, human
ggagccggcgctgggatgtg

SEQ ID NO: 101518 - DNA, 20 bp, human
gggggccaaagtacaaaggg

SEQ ID NO: 101519 - DNA, 20 bp, human
gcccggggccaaagtacaaa

SEQ ID NO: 101520 - DNA, 20 bp, human
gccgtcggggccaaaggaga

SEQ ID NO: 101521 - DNA, 20 bp, human
gtgaggaagaggctcttcaa

SEQ ID NO: 101522 - DNA, 20 bp, human
gtggctccccagagaggcgt

SEQ ID NO: 101523 - DNA, 20 bp, human
gggcagtctcggcccaactg

SEQ ID NO: 101524 - DNA, 20 bp, human
ggccaaagtacaaagggagg

SEQ ID NO: 101525 - DNA, 20 bp, human
ggaccacgggcacccagaga

SEQ ID NO: 101526 - DNA, 20 bp, human
gctaggtctgagctctgacc

SEQ ID NO: 101527 - DNA, 20 bp, human
gaggcaggaatagtcgaaat

SEQ ID NO: 101528 - DNA, 20 bp, human
gtattcctgcctgttacgga

SEQ ID NO: 101529 - DNA, 20 bp, human
gcccagcggcgtctacttcc

SEQ ID NO: 101530 - DNA, 20 bp, human
gcgactattcctgcctgtta

SEQ ID NO: 101531 - DNA, 20 bp, human
gaggttgttctctacaccct

SEQ ID NO: 101532 - DNA, 20 bp, human
ggagaacaaccttccgtaac

SEQ ID NO: 101533 - DNA, 20 bp, human
gccatccaactagctctacg

SEQ ID NO: 101534 - DNA, 20 bp, human
gacaaccttccgtaacaggc

SEQ ID NO: 101535 - DNA, 20 bp, human
gcgaccgatttcgctcccag

SEQ ID NO: 101536 - DNA, 20 bp, human
gggccaggctctcacctcgg

SEQ ID NO: 101537 - DNA, 20 bp, human
ggcggccgcagcacaaaagg

SEQ ID NO: 101538 - DNA, 20 bp, human
ggcgggagcagcatccggag

SEQ ID NO: 101539 - DNA, 20 bp, human
gtccgcggccgcagcacaaa

SEQ ID NO: 101540 - DNA, 20 bp, human
gctcggccaggctctcacct

SEQ ID NO: 101541 - DNA, 20 bp, human
gtctcacctcgggggctccg

SEQ ID NO: 101542 - DNA, 20 bp, human
ggcctggccgagttgtgggg

SEQ ID NO: 101543 - DNA, 20 bp, human
gggcccagcttggagacgaa

SEQ ID NO: 101544 - DNA, 20 bp, human
gagagcctggccgagttgtg

SEQ ID NO: 101545 - DNA, 20 bp, human
gagagttttggccccctcta

SEQ ID NO: 101546 - DNA, 20 bp, human
gggagggtgacgccatgggt

SEQ ID NO: 101547 - DNA, 20 bp, human
ggttacctgtcggggatcct

SEQ ID NO: 101548 - DNA, 20 bp, human
gctattagcagaacaggtcg

SEQ ID NO: 101549 - DNA, 20 bp, human
gggagcctaggatccccgac

SEQ ID NO: 101550 - DNA, 20 bp, human
gtccccgacaggtaacctgc

SEQ ID NO: 101551 - DNA, 20 bp, human
gttgtggagggtgacgccat

SEQ ID NO: 101552 - DNA, 20 bp, human
gtagcagaacaggtcggggt

SEQ ID NO: 101553 - DNA, 20 bp, human
gtgggtggggcggagcgtct

SEQ ID NO: 101554 - DNA, 20 bp, human
gacctgcgggcggatctgaa

SEQ ID NO: 101555 - DNA, 20 bp, human
ggcccgcaggttacctgtcg

SEQ ID NO: 101556 - DNA, 20 bp, human
gcaccacagcgaagtctgtg

SEQ ID NO: 101557 - DNA, 20 bp, human
ggacgtcacagattcatgaa

SEQ ID NO: 101558 - DNA, 20 bp, human
ggaggctcctagctgtaacg

SEQ ID NO: 101559 - DNA, 20 bp, human
gaaagccaagcaggcatccg

SEQ ID NO: 101560 - DNA, 20 bp, human
gctttgggctcctttgcggt

SEQ ID NO: 101561 - DNA, 20 bp, human
gttccgcacagacttcgctg

SEQ ID NO: 101562 - DNA, 20 bp, human
gcttgtctgcctgctagacg

SEQ ID NO: 101563 - DNA, 20 bp, human
gaaaatggaacagcatgtgt

SEQ ID NO: 101564 - DNA, 20 bp, human
gacggttctgcacgttacct

SEQ ID NO: 101565 - DNA, 20 bp, human
gaagcctttgggctcctttg

SEQ ID NO: 101566 - DNA, 20 bp, human
ggccggcggcgggagatcgc

SEQ ID NO: 101567 - DNA, 20 bp, human
gaccggggcggggcgaccac

SEQ ID NO: 101568 - DNA, 20 bp, human
gcggcaggcgagctccatcc

SEQ ID NO: 101569 - DNA, 20 bp, human
gaggagacacgtccgccccg

SEQ ID NO: 101570 - DNA, 20 bp, human
ggtgcgaggcgaccagggag

SEQ ID NO: 101571 - DNA, 20 bp, human
gccgggagggtttcacgcca

SEQ ID NO: 101572 - DNA, 20 bp, human
ggcttggccggtaggtgacg

SEQ ID NO: 101573 - DNA, 20 bp, human
ggcggagcgcaacactcgct

SEQ ID NO: 101574 - DNA, 20 bp, human
gggcgcggggcactagtgaa

SEQ ID NO: 101575 - DNA, 20 bp, human
ggcgcaacactcgcttggtt

SEQ ID NO: 101576 - DNA, 20 bp, human
ggcgtcaggctgcagcctag

SEQ ID NO: 101577 - DNA, 20 bp, human
gccccgcggcgggccgaaga

SEQ ID NO: 101578 - DNA, 20 bp, human
gcagcggcgagggcgagagt

SEQ ID NO: 101579 - DNA, 20 bp, human
ggcggctgcgatccgctagg

SEQ ID NO: 101580 - DNA, 20 bp, human
gccgctggccactcgcccag

SEQ ID NO: 101581 - DNA, 20 bp, human
ggggacgctacgggaatcga

SEQ ID NO: 101582 - DNA, 20 bp, human
gaggctgcagcctgacgctc

SEQ ID NO: 101583 - DNA, 20 bp, human
ggcctgcgcgcccttcccct

SEQ ID NO: 101584 - DNA, 20 bp, human
ggtgcgcagtgagagctccc

SEQ ID NO: 101585 - DNA, 20 bp, human
ggggccggcggagcccgacg

SEQ ID NO: 101586 - DNA, 20 bp, human
ggaggtgcctgcataagtat

SEQ ID NO: 101587 - DNA, 20 bp, human
ggcaggcacctctagaccat

SEQ ID NO: 101588 - DNA, 20 bp, human
gtaccaggcattcctcctct

SEQ ID NO: 101589 - DNA, 20 bp, human
gtctatttgcagctaactaa

SEQ ID NO: 101590 - DNA, 20 bp, human
ggtgcctgcataagtattgg

SEQ ID NO: 101591 - DNA, 20 bp, human
gcaatgaattaggatgatgt

SEQ ID NO: 101592 - DNA, 20 bp, human
ggcacagtggatggttgcct

SEQ ID NO: 101593 - DNA, 20 bp, human
gaatttagcctatggtctag

SEQ ID NO: 101594 - DNA, 20 bp, human
ggagatgaaaagcagagatt

SEQ ID NO: 101595 - DNA, 20 bp, human
gtctcaaataataatatcct

SEQ ID NO: 101596 - DNA, 20 bp, human
gcagcggcggcgcctgacga

SEQ ID NO: 101597 - DNA, 20 bp, human
gcggccgcggcaccctcgtc

SEQ ID NO: 101598 - DNA, 20 bp, human
gggctgcctgccctcagcgg

SEQ ID NO: 101599 - DNA, 20 bp, human
gaggcgccgccgctgagggc

SEQ ID NO: 101600 - DNA, 20 bp, human
ggtcacgggtccgtgtgtag

SEQ ID NO: 101601 - DNA, 20 bp, human
ggcgctacgcccgacgtcac

SEQ ID NO: 101602 - DNA, 20 bp, human
ggcccggcagccactacaca

SEQ ID NO: 101603 - DNA, 20 bp, human
ggagagccgcaggcccaagg

SEQ ID NO: 101604 - DNA, 20 bp, human
gcgtagcgcggcgcacgtca

SEQ ID NO: 101605 - DNA, 20 bp, human
gccagcgcggcctgtcaccg

SEQ ID NO: 101606 - DNA, 20 bp, human
gttcctgaggtggagaacgg

SEQ ID NO: 101607 - DNA, 20 bp, human
gtggccggacggagagactg

SEQ ID NO: 101608 - DNA, 20 bp, human
ggggcgagctgcgcgaccag

SEQ ID NO: 101609 - DNA, 20 bp, human
ggactgcgggtctgagggac

SEQ ID NO: 101610 - DNA, 20 bp, human
gcggcgtgagtgacagacag

SEQ ID NO: 101611 - DNA, 20 bp, human
ggacccgcagtctctccgtc

SEQ ID NO: 101612 - DNA, 20 bp, human
gcggagagactgcgggtctg

SEQ ID NO: 101613 - DNA, 20 bp, human
gcctgtcaggcggtggccca

SEQ ID NO: 101614 - DNA, 20 bp, human
gggccaccgttctccacctc

SEQ ID NO: 101615 - DNA, 20 bp, human
ggtggagaacggtggccgga

SEQ ID NO: 101616 - DNA, 20 bp, human
gggcggctcctccatggcgg

SEQ ID NO: 101617 - DNA, 20 bp, human
gggcttctctcatccgtgca

SEQ ID NO: 101618 - DNA, 20 bp, human
ggcggcgcgcacggctcctg

SEQ ID NO: 101619 - DNA, 20 bp, human
gtcctgcggcggggtagagg

SEQ ID NO: 101620 - DNA, 20 bp, human
ggccgcggccatcttggaaa

SEQ ID NO: 101621 - DNA, 20 bp, human
gtgcggcggggtagaggcgg

SEQ ID NO: 101622 - DNA, 20 bp, human
gctctgcttcccgccaggtg

SEQ ID NO: 101623 - DNA, 20 bp, human
gcgagcgccggggctacggt

SEQ ID NO: 101624 - DNA, 20 bp, human
gcgccggacagactcagacg

SEQ ID NO: 101625 - DNA, 20 bp, human
gggcggtcgtcggtctggga

SEQ ID NO: 101626 - DNA, 20 bp, human
gagctcaagggcgccgcgct

SEQ ID NO: 101627 - DNA, 20 bp, human
gagggcacgccgctgcccgg

SEQ ID NO: 101628 - DNA, 20 bp, human
ggcggcggctcgctcctcct

SEQ ID NO: 101629 - DNA, 20 bp, human
ggccggacaaccgatgccag

SEQ ID NO: 101630 - DNA, 20 bp, human
ggcgagcggcgcggccacgg

SEQ ID NO: 101631 - DNA, 20 bp, human
gggcagccgacggaccacgg

SEQ ID NO: 101632 - DNA, 20 bp, human
gtgagcacggaggcggacga

SEQ ID NO: 101633 - DNA, 20 bp, human
gcgttccagaagctgcccgg

SEQ ID NO: 101634 - DNA, 20 bp, human
gaaactctgcagagggcgag

SEQ ID NO: 101635 - DNA, 20 bp, human
gtctccgggccgggcagcaa

SEQ ID NO: 101636 - DNA, 20 bp, human
gtagcctacaagtgaaggca

SEQ ID NO: 101637 - DNA, 20 bp, human
ggcgctcccttgagaagtcc

SEQ ID NO: 101638 - DNA, 20 bp, human
ggaatctcccacgggatcta

SEQ ID NO: 101639 - DNA, 20 bp, human
gctagctccagcgtcccgaa

SEQ ID NO: 101640 - DNA, 20 bp, human
ggcagctcagagccacttgg

SEQ ID NO: 101641 - DNA, 20 bp, human
gccttgagaagtccaggtgg

SEQ ID NO: 101642 - DNA, 20 bp, human
ggagccacttgggggatcct

SEQ ID NO: 101643 - DNA, 20 bp, human
gatcctgggaatcggctcgg

SEQ ID NO: 101644 - DNA, 20 bp, human
gggtcggccgggaaagggct

SEQ ID NO: 101645 - DNA, 20 bp, human
gcctcgcgcaggcagcgcag

SEQ ID NO: 101646 - DNA, 20 bp, human
gccgtcggcggaaaacgcag

SEQ ID NO: 101647 - DNA, 20 bp, human
ggcggagccagagccggaca

SEQ ID NO: 101648 - DNA, 20 bp, human
ggaattagaggggccccggg

SEQ ID NO: 101649 - DNA, 20 bp, human
gcgatccgtggcgggggtag

SEQ ID NO: 101650 - DNA, 20 bp, human
gcctactacccggcgatccg

SEQ ID NO: 101651 - DNA, 20 bp, human
gcggcaccaggcagaggcgg

SEQ ID NO: 101652 - DNA, 20 bp, human
gactacccggcgatccgtgg

SEQ ID NO: 101653 - DNA, 20 bp, human
gccggaaccggaagtgtagt

SEQ ID NO: 101654 - DNA, 20 bp, human
gcgggaggcaccttcagagc

SEQ ID NO: 101655 - DNA, 20 bp, human
ggccgcgcagtcctactacc

SEQ ID NO: 101656 - DNA, 20 bp, human
gctaccagccagaagtttca

SEQ ID NO: 101657 - DNA, 20 bp, human
gggatgccagctaaaccaga

SEQ ID NO: 101658 - DNA, 20 bp, human
gcatggcgtgactataaata

SEQ ID NO: 101659 - DNA, 20 bp, human
gaggagtgtgacttcacagg

SEQ ID NO: 101660 - DNA, 20 bp, human
gcacaccacacatcaacttg

SEQ ID NO: 101661 - DNA, 20 bp, human
gaggacgtcgatttccacaa

SEQ ID NO: 101662 - DNA, 20 bp, human
gcccaagcaggaaatagcag

SEQ ID NO: 101663 - DNA, 20 bp, human
gggtatcaacagacttaatg

SEQ ID NO: 101664 - DNA, 20 bp, human
ggacttaatgaggcccgttg

SEQ ID NO: 101665 - DNA, 20 bp, human
gggaaggagtgtgacttcac

SEQ ID NO: 101666 - DNA, 20 bp, human
gaggagagaggggttgtgaa

SEQ ID NO: 101667 - DNA, 20 bp, human
gaacatcctggctgttagag

SEQ ID NO: 101668 - DNA, 20 bp, human
ggttgtgaagggaagcggaa

SEQ ID NO: 101669 - DNA, 20 bp, human
gaagggaagggaggtcccgt

SEQ ID NO: 101670 - DNA, 20 bp, human
gggagcggagacagctgtca

SEQ ID NO: 101671 - DNA, 20 bp, human
gcaacgactggccaaggcag

SEQ ID NO: 101672 - DNA, 20 bp, human
gcctggctgttagagaggca

SEQ ID NO: 101673 - DNA, 20 bp, human
gggatggtggcaagactgag

SEQ ID NO: 101674 - DNA, 20 bp, human
gtctgcctatgaaaggatgg

SEQ ID NO: 101675 - DNA, 20 bp, human
ggaggtcccgtgggacgctg

SEQ ID NO: 101676 - DNA, 20 bp, human
gtggcgctgcggatacggga

SEQ ID NO: 101677 - DNA, 20 bp, human
gcgtggcgcgcagtccagag

SEQ ID NO: 101678 - DNA, 20 bp, human
gtgcggatacgggaaggagg

SEQ ID NO: 101679 - DNA, 20 bp, human
gccttgcgcaagggtctcac

SEQ ID NO: 101680 - DNA, 20 bp, human
gcgcgcagtccagagcggag

SEQ ID NO: 101681 - DNA, 20 bp, human
ggccctggcgctgcggatac

SEQ ID NO: 101682 - DNA, 20 bp, human
gcaaggccgcaggtaatcca

SEQ ID NO: 101683 - DNA, 20 bp, human
gctcagacgccgtgagtcag

SEQ ID NO: 101684 - DNA, 20 bp, human
gccgggccactgggatccgg

SEQ ID NO: 101685 - DNA, 20 bp, human
ggactgcgcgccacgctctg

SEQ ID NO: 101686 - DNA, 20 bp, human
gcggctgcgcgagcaggtac

SEQ ID NO: 101687 - DNA, 20 bp, human
gggcacggcacggcgcggag

SEQ ID NO: 101688 - DNA, 20 bp, human
ggaggacccccccccaacga

SEQ ID NO: 101689 - DNA, 20 bp, human
gagccgagaagcgctctgga

SEQ ID NO: 101690 - DNA, 20 bp, human
gggccccgcaccctatggat

SEQ ID NO: 101691 - DNA, 20 bp, human
gaggcagccgagaagcgctc

SEQ ID NO: 101692 - DNA, 20 bp, human
gccatcctcccccggcgggg

SEQ ID NO: 101693 - DNA, 20 bp, human
gaccggcggcagaggtgacg

SEQ ID NO: 101694 - DNA, 20 bp, human
gcggggggcggggcacggca

SEQ ID NO: 101695 - DNA, 20 bp, human
ggcgccgctgccctactgga

SEQ ID NO: 101696 - DNA, 20 bp, human
gtgaggaggtaggagacgtc

SEQ ID NO: 101697 - DNA, 20 bp, human
gtgagccgcggagcgagggt

SEQ ID NO: 101698 - DNA, 20 bp, human
gggaggtaggagacgtcggg

SEQ ID NO: 101699 - DNA, 20 bp, human
gacctcctcacggctcttcc

SEQ ID NO: 101700 - DNA, 20 bp, human
gggaggtgtaggagaactca

SEQ ID NO: 101701 - DNA, 20 bp, human
ggccagcgagctagccggag

SEQ ID NO: 101702 - DNA, 20 bp, human
gatgccttgggctctggatg

SEQ ID NO: 101703 - DNA, 20 bp, human
ggagggtcggccgcagtctg

SEQ ID NO: 101704 - DNA, 20 bp, human
gcccagctccgtctcggcgg

SEQ ID NO: 101705 - DNA, 20 bp, human
ggctcttcccggcgctctcc

SEQ ID NO: 101706 - DNA, 20 bp, human
gggcctcagggctcaacttc

SEQ ID NO: 101707 - DNA, 20 bp, human
gcagggcttctggggacgga

SEQ ID NO: 101708 - DNA, 20 bp, human
gccacgacgtccatccctgg

SEQ ID NO: 101709 - DNA, 20 bp, human
ggtgaagatggagcctggtg

SEQ ID NO: 101710 - DNA, 20 bp, human
ggagctgggcctgcgcccag

SEQ ID NO: 101711 - DNA, 20 bp, human
gcagcccgcggaggcaaggc

SEQ ID NO: 101712 - DNA, 20 bp, human
ggtgatcccagtgtcccagg

SEQ ID NO: 101713 - DNA, 20 bp, human
gtgaggccctgctggcccct

SEQ ID NO: 101714 - DNA, 20 bp, human
ggctcgagacaaggtgtcag

SEQ ID NO: 101715 - DNA, 20 bp, human
ggcatggggagagagctaca

SEQ ID NO: 101716 - DNA, 20 bp, human
gcccggggcacgcctctcag

SEQ ID NO: 101717 - DNA, 20 bp, human
gcaggtgacagcacctcccg

SEQ ID NO: 101718 - DNA, 20 bp, human
ggagggtgaagcgggatggg

SEQ ID NO: 101719 - DNA, 20 bp, human
gggcctctgcgccagaggaa

SEQ ID NO: 101720 - DNA, 20 bp, human
ggcctggggccaggaggata

SEQ ID NO: 101721 - DNA, 20 bp, human
gcacaaagcaggtcacatgg

SEQ ID NO: 101722 - DNA, 20 bp, human
gttggcagctacctcaggtg

SEQ ID NO: 101723 - DNA, 20 bp, human
gtgtgtcgctgcaggacccg

SEQ ID NO: 101724 - DNA, 20 bp, human
gctgaggtagctgccaatgt

SEQ ID NO: 101725 - DNA, 20 bp, human
gagatagtcaagctagaccc

SEQ ID NO: 101726 - DNA, 20 bp, human
gggcgacgtctacaaggtaa

SEQ ID NO: 101727 - DNA, 20 bp, human
ggaacctggtcacacccaca

SEQ ID NO: 101728 - DNA, 20 bp, human
gtggtcacacccacaaggag

SEQ ID NO: 101729 - DNA, 20 bp, human
gtcccgaggacaggcggcaa

SEQ ID NO: 101730 - DNA, 20 bp, human
ggtctacaaggtaaaggcag

SEQ ID NO: 101731 - DNA, 20 bp, human
gcgggatcccacggcctcgg

SEQ ID NO: 101732 - DNA, 20 bp, human
gtgattcagcgcatcggcag

SEQ ID NO: 101733 - DNA, 20 bp, human
gtggcgccagggagcagtcg

SEQ ID NO: 101734 - DNA, 20 bp, human
gcccgagcgaggggctgcga

SEQ ID NO: 101735 - DNA, 20 bp, human
gtcggggtgaaactccaaca

SEQ ID NO: 101736 - DNA, 20 bp, human
gaggacgggcccggagcgtg

SEQ ID NO: 101737 - DNA, 20 bp, human
ggcgccgcgcgcctcgagga

SEQ ID NO: 101738 - DNA, 20 bp, human
ggactcccctgcaaaaagtc

SEQ ID NO: 101739 - DNA, 20 bp, human
ggccggcagagagccccgag

SEQ ID NO: 101740 - DNA, 20 bp, human
gggccccgcgaggagagtac

SEQ ID NO: 101741 - DNA, 20 bp, human
gcgcgctcactcgctcaact

SEQ ID NO: 101742 - DNA, 20 bp, human
gcgcgcctcgaggacgggcc

SEQ ID NO: 101743 - DNA, 20 bp, human
gctcctccctgcgggtgagt

SEQ ID NO: 101744 - DNA, 20 bp, human
ggagacaaagataacccggg

SEQ ID NO: 101745 - DNA, 20 bp, human
gtcccctgcaaaaagtctgg

SEQ ID NO: 101746 - DNA, 20 bp, human
gcggtctaggaagtaggtcc

SEQ ID NO: 101747 - DNA, 20 bp, human
gcgggtgcggtctaggaagt

SEQ ID NO: 101748 - DNA, 20 bp, human
gccgtgcagcggctgagtgg

SEQ ID NO: 101749 - DNA, 20 bp, human
gtgcacggcgcgtcctctcg

SEQ ID NO: 101750 - DNA, 20 bp, human
gctgcacgagggacgagcaa

SEQ ID NO: 101751 - DNA, 20 bp, human
ggtgcagacggagctgcggg

SEQ ID NO: 101752 - DNA, 20 bp, human
gcgcagctccgtctgcacga

SEQ ID NO: 101753 - DNA, 20 bp, human
ggcggcggcgacggcaaacc

SEQ ID NO: 101754 - DNA, 20 bp, human
gcgggcggaggctccatgtt

SEQ ID NO: 101755 - DNA, 20 bp, human
gcgcaggctacgacccccag

SEQ ID NO: 101756 - DNA, 20 bp, human
gtcctgctcccgggcctcag

SEQ ID NO: 101757 - DNA, 20 bp, human
gacccggggagagctgtcct

SEQ ID NO: 101758 - DNA, 20 bp, human
gcagcagactgcgctcccaa

SEQ ID NO: 101759 - DNA, 20 bp, human
gcagccagcccagggcgagt

SEQ ID NO: 101760 - DNA, 20 bp, human
gggccagcgcctgggcctac

SEQ ID NO: 101761 - DNA, 20 bp, human
gtcggcgcggcgcacaatcc

SEQ ID NO: 101762 - DNA, 20 bp, human
gtagagacgcagccagccca

SEQ ID NO: 101763 - DNA, 20 bp, human
ggtctgctgcgagcgccgaa

SEQ ID NO: 101764 - DNA, 20 bp, human
gaggccgcagagatctgcac

SEQ ID NO: 101765 - DNA, 20 bp, human
gcgccgaagggtgagacgca

SEQ ID NO: 101766 - DNA, 20 bp, human
gagcacaggcggctgataca

SEQ ID NO: 101767 - DNA, 20 bp, human
gcagctggaccgctccgacg

SEQ ID NO: 101768 - DNA, 20 bp, human
ggaccacgtcgtacaggtat

SEQ ID NO: 101769 - DNA, 20 bp, human
ggcaacgagtccccaccctg

SEQ ID NO: 101770 - DNA, 20 bp, human
gcccgctggtactgagtgag

SEQ ID NO: 101771 - DNA, 20 bp, human
gggcagctccgaggtcgcgt

SEQ ID NO: 101772 - DNA, 20 bp, human
gggcagcacgtagaccccgc

SEQ ID NO: 101773 - DNA, 20 bp, human
gctggaccgctccgacgtgg

SEQ ID NO: 101774 - DNA, 20 bp, human
ggcgtcctcccaccacaggg

SEQ ID NO: 101775 - DNA, 20 bp, human
gcggcaccgccacgtcggag

SEQ ID NO: 101776 - DNA, 20 bp, human
ggctcccggagatatggagc

SEQ ID NO: 101777 - DNA, 20 bp, human
ggctggtcggccgcggcgac

SEQ ID NO: 101778 - DNA, 20 bp, human
ggcgcgtcatcggagcacca

SEQ ID NO: 101779 - DNA, 20 bp, human
gtggcggagctaggagctgg

SEQ ID NO: 101780 - DNA, 20 bp, human
gccagtggccagagagtcgt

SEQ ID NO: 101781 - DNA, 20 bp, human
gggctctccgggcgcgtcat

SEQ ID NO: 101782 - DNA, 20 bp, human
gagctaggagctggcggcga

SEQ ID NO: 101783 - DNA, 20 bp, human
gatcccccagaccaaaccag

SEQ ID NO: 101784 - DNA, 20 bp, human
gcgggagccaagccgaggaa

SEQ ID NO: 101785 - DNA, 20 bp, human
gcacctggccgacgactctc

SEQ ID NO: 101786 - DNA, 20 bp, human
gcatctccccagctgagaag

SEQ ID NO: 101787 - DNA, 20 bp, human
gtgcctgtcggggagtcagt

SEQ ID NO: 101788 - DNA, 20 bp, human
gctaggtgaggggaactgca

SEQ ID NO: 101789 - DNA, 20 bp, human
gggatatgttagggttgtca

SEQ ID NO: 101790 - DNA, 20 bp, human
gctgtcggggagtcagtggg

SEQ ID NO: 101791 - DNA, 20 bp, human
gcagggcctcagttgccaag

SEQ ID NO: 101792 - DNA, 20 bp, human
gtctgggaactcaccagcag

SEQ ID NO: 101793 - DNA, 20 bp, human
gcaggttgtgcagtggtggg

SEQ ID NO: 101794 - DNA, 20 bp, human
ggattgaacaggttgtgcag

SEQ ID NO: 101795 - DNA, 20 bp, human
ggggaagctgctgctaggtg

SEQ ID NO: 101796 - DNA, 20 bp, human
gcagcccgggcggtacaata

SEQ ID NO: 101797 - DNA, 20 bp, human
gggcgctccggggaaggtcg

SEQ ID NO: 101798 - DNA, 20 bp, human
gaccgcagccgagagacccc

SEQ ID NO: 101799 - DNA, 20 bp, human
gtatgccgggagccacgcgg

SEQ ID NO: 101800 - DNA, 20 bp, human
gggtggcccgcgagtctcgg

SEQ ID NO: 101801 - DNA, 20 bp, human
gccacgcggaggcgagatgg

SEQ ID NO: 101802 - DNA, 20 bp, human
gcgggcggtacaatagggtt

SEQ ID NO: 101803 - DNA, 20 bp, human
ggagatgggggtagatggag

SEQ ID NO: 101804 - DNA, 20 bp, human
gccggcaagtagcgactcgg

SEQ ID NO: 101805 - DNA, 20 bp, human
gtgcagggcggccgaggatg

SEQ ID NO: 101806 - DNA, 20 bp, human
ggtgagtgggtacacatggg

SEQ ID NO: 101807 - DNA, 20 bp, human
ggcatcccgatggagcgcgg

SEQ ID NO: 101808 - DNA, 20 bp, human
gtgggtgagtgggtacacat

SEQ ID NO: 101809 - DNA, 20 bp, human
gtcaggccgggatcccgtcc

SEQ ID NO: 101810 - DNA, 20 bp, human
gtgcggccggcgcatcccga

SEQ ID NO: 101811 - DNA, 20 bp, human
gcgtccggacgtgcatccaa

SEQ ID NO: 101812 - DNA, 20 bp, human
gccatgccggctgctcctcg

SEQ ID NO: 101813 - DNA, 20 bp, human
ggagcagcgttcccaagaca

SEQ ID NO: 101814 - DNA, 20 bp, human
ggacagggagcgcatccggg

SEQ ID NO: 101815 - DNA, 20 bp, human
gcctcgagcgtggggggaag

SEQ ID NO: 101816 - DNA, 20 bp, human
ggcggcgcgaggcaactcac

SEQ ID NO: 101817 - DNA, 20 bp, human
gcggcgccgtccgccatcat

SEQ ID NO: 101818 - DNA, 20 bp, human
gtcatcggagtcgggaccgg

SEQ ID NO: 101819 - DNA, 20 bp, human
gcgccccccaagggcagatg

SEQ ID NO: 101820 - DNA, 20 bp, human
gtcggagtcgggaccggagg

SEQ ID NO: 101821 - DNA, 20 bp, human
gccgcagctctctcaaggat

SEQ ID NO: 101822 - DNA, 20 bp, human
ggtcccgactccgatgatgg

SEQ ID NO: 101823 - DNA, 20 bp, human
gtccgcggggctcagaccgt

SEQ ID NO: 101824 - DNA, 20 bp, human
gggcggccaccgccccccaa

SEQ ID NO: 101825 - DNA, 20 bp, human
gcgtgcccgcagctctctca

SEQ ID NO: 101826 - DNA, 20 bp, human
gcaagagccaagcatcgggt

SEQ ID NO: 101827 - DNA, 20 bp, human
gggtcctggaccgagcgagg

SEQ ID NO: 101828 - DNA, 20 bp, human
gcatacggcgcggtgaggag

SEQ ID NO: 101829 - DNA, 20 bp, human
ggaggaggggctaataacag

SEQ ID NO: 101830 - DNA, 20 bp, human
ggaatcaagagccaagcatc

SEQ ID NO: 101831 - DNA, 20 bp, human
ggcgcccgcagagccggtcc

SEQ ID NO: 101832 - DNA, 20 bp, human
ggacgtcacctggcctggta

SEQ ID NO: 101833 - DNA, 20 bp, human
gctggaccgagcgaggagga

SEQ ID NO: 101834 - DNA, 20 bp, human
gctggtagggaacggaaccc

SEQ ID NO: 101835 - DNA, 20 bp, human
ggaggggctaataacagagg

SEQ ID NO: 101836 - DNA, 20 bp, human
gaatcggtccgagtggctgt

SEQ ID NO: 101837 - DNA, 20 bp, human
gggcaggcaatcggtccgag

SEQ ID NO: 101838 - DNA, 20 bp, human
ggaggaaggaagacgccgag

SEQ ID NO: 101839 - DNA, 20 bp, human
ggccgccgacgctgaccggg

SEQ ID NO: 101840 - DNA, 20 bp, human
gtccgggttcgaggtcgccg

SEQ ID NO: 101841 - DNA, 20 bp, human
gcgcggaccgcggtgaagtc

SEQ ID NO: 101842 - DNA, 20 bp, human
ggccgcggcgacctcgaacc

SEQ ID NO: 101843 - DNA, 20 bp, human
gctgcccgcggaccatctcc

SEQ ID NO: 101844 - DNA, 20 bp, human
ggggcgcctacggcatggtg

SEQ ID NO: 101845 - DNA, 20 bp, human
ggccctcgccgatgtacgag

SEQ ID NO: 101846 - DNA, 20 bp, human
gccattgtggaacctaccag

SEQ ID NO: 101847 - DNA, 20 bp, human
gttctcaggcacggaatggt

SEQ ID NO: 101848 - DNA, 20 bp, human
ggtaggttccacaatggtac

SEQ ID NO: 101849 - DNA, 20 bp, human
ggtagttctcaggcacggaa

SEQ ID NO: 101850 - DNA, 20 bp, human
gagtatggaagagacgagag

SEQ ID NO: 101851 - DNA, 20 bp, human
gcaagcccctaggaattgag

SEQ ID NO: 101852 - DNA, 20 bp, human
gtctgtccgtctcctctggt

SEQ ID NO: 101853 - DNA, 20 bp, human
ggcagcatcacgctgcacaa

SEQ ID NO: 101854 - DNA, 20 bp, human
ggtttccaggcagtgaaaga

SEQ ID NO: 101855 - DNA, 20 bp, human
gtcaggcacggaatggtagg

SEQ ID NO: 101856 - DNA, 20 bp, human
ggagccgagcccgagccgag

SEQ ID NO: 101857 - DNA, 20 bp, human
ggcagacgccgttaccggga

SEQ ID NO: 101858 - DNA, 20 bp, human
ggagcagtccgaatcgggag

SEQ ID NO: 101859 - DNA, 20 bp, human
gcccccctccctcccggtaa

SEQ ID NO: 101860 - DNA, 20 bp, human
gcgggcgccaagcggatctg

SEQ ID NO: 101861 - DNA, 20 bp, human
ggtggggagcagtccgaatc

SEQ ID NO: 101862 - DNA, 20 bp, human
gacgccgttaccgggaggga

SEQ ID NO: 101863 - DNA, 20 bp, human
gtcacagctggcgtgagggt

SEQ ID NO: 101864 - DNA, 20 bp, human
gcgcgagggcccgacatgtc

SEQ ID NO: 101865 - DNA, 20 bp, human
gctacggctccgtctggtag

SEQ ID NO: 101866 - DNA, 20 bp, human
gcttggcgaacagctcggac

SEQ ID NO: 101867 - DNA, 20 bp, human
gagcaggcgcagctcgcggt

SEQ ID NO: 101868 - DNA, 20 bp, human
gcccgcagctcggccgtgga

SEQ ID NO: 101869 - DNA, 20 bp, human
ggacggccgcaccggcgcta

SEQ ID NO: 101870 - DNA, 20 bp, human
ggctcccggcccttccctca

SEQ ID NO: 101871 - DNA, 20 bp, human
gcgaacagctcggactggaa

SEQ ID NO: 101872 - DNA, 20 bp, human
ggcgccggtgcggccgtcca

SEQ ID NO: 101873 - DNA, 20 bp, human
gtcgggccgtgggtccccag

SEQ ID NO: 101874 - DNA, 20 bp, human
gcatccctgagggaagggcc

SEQ ID NO: 101875 - DNA, 20 bp, human
gggccatcaagaagctgtat

SEQ ID NO: 101876 - DNA, 20 bp, human
gcatcccgggcacccgatct

SEQ ID NO: 101877 - DNA, 20 bp, human
gatctgcccgatgaactctg

SEQ ID NO: 101878 - DNA, 20 bp, human
gcccgggcacccgatctcgg

SEQ ID NO: 101879 - DNA, 20 bp, human
gcgctggggccgccgagatc

SEQ ID NO: 101880 - DNA, 20 bp, human
gttccggatgaggctcatcc

SEQ ID NO: 101881 - DNA, 20 bp, human
gcaagaccccagagttcatc

SEQ ID NO: 101882 - DNA, 20 bp, human
gagtacaccgaggccccaag

SEQ ID NO: 101883 - DNA, 20 bp, human
ggagccacctccccctcttg

SEQ ID NO: 101884 - DNA, 20 bp, human
ggttacagacgagtacaccg

SEQ ID NO: 101885 - DNA, 20 bp, human
gacgtgcgtcggggacacgt

SEQ ID NO: 101886 - DNA, 20 bp, human
gtgggcgatgagcatgtcct

SEQ ID NO: 101887 - DNA, 20 bp, human
gcaggaaggtggggatacca

SEQ ID NO: 101888 - DNA, 20 bp, human
gacatgctcatcgcccaagt

SEQ ID NO: 101889 - DNA, 20 bp, human
gggactgagggagacatggt

SEQ ID NO: 101890 - DNA, 20 bp, human
gggtctcagggccagagtag

SEQ ID NO: 101891 - DNA, 20 bp, human
gcagaagatcgcacccactt

SEQ ID NO: 101892 - DNA, 20 bp, human
gcgtcttaaacacctgagtg

SEQ ID NO: 101893 - DNA, 20 bp, human
gtccggagctacagccagag

SEQ ID NO: 101894 - DNA, 20 bp, human
gagagcacgagtggccactc

SEQ ID NO: 101895 - DNA, 20 bp, human
ggaaaatatcagatacccca

SEQ ID NO: 101896 - DNA, 20 bp, human
gctcttggaaccgcgaccac

SEQ ID NO: 101897 - DNA, 20 bp, human
ggggcttgccccagtcgcag

SEQ ID NO: 101898 - DNA, 20 bp, human
ggcgcccgctaaggctccag

SEQ ID NO: 101899 - DNA, 20 bp, human
gcccctacaaggccgactcc

SEQ ID NO: 101900 - DNA, 20 bp, human
gacaggttctggtaacgctc

SEQ ID NO: 101901 - DNA, 20 bp, human
gcgggcgcagcagctggaac

SEQ ID NO: 101902 - DNA, 20 bp, human
gcgaccactggagccttagc

SEQ ID NO: 101903 - DNA, 20 bp, human
gcgaaggtgcagggagatcg

SEQ ID NO: 101904 - DNA, 20 bp, human
ggagctgaacaagacaatct

SEQ ID NO: 101905 - DNA, 20 bp, human
gggagaggcccacgttctac

SEQ ID NO: 101906 - DNA, 20 bp, human
gacaatgcgagggtccacta

SEQ ID NO: 101907 - DNA, 20 bp, human
gccgcgcccgggtcactgag

SEQ ID NO: 101908 - DNA, 20 bp, human
gtccactacggtgcacatgg

SEQ ID NO: 101909 - DNA, 20 bp, human
ggccgccatgtgcaccgtag

SEQ ID NO: 101910 - DNA, 20 bp, human
gtgtccggagatacctactc

SEQ ID NO: 101911 - DNA, 20 bp, human
gcccgagctgccgcctgagt

SEQ ID NO: 101912 - DNA, 20 bp, human
gccggagatacctactcagg

SEQ ID NO: 101913 - DNA, 20 bp, human
ggtatctccggacaatgcga

SEQ ID NO: 101914 - DNA, 20 bp, human
gtgcacacgacgctctgggg

SEQ ID NO: 101915 - DNA, 20 bp, human
gggcaaccgactcaacagta

SEQ ID NO: 101916 - DNA, 20 bp, human
gcccagggagaaggtgtcgg

SEQ ID NO: 101917 - DNA, 20 bp, human
gcaggcgcccagaaacccgt

SEQ ID NO: 101918 - DNA, 20 bp, human
gcgcagccagacctgacgtc

SEQ ID NO: 101919 - DNA, 20 bp, human
gccgtcgggcgcgacgtcag

SEQ ID NO: 101920 - DNA, 20 bp, human
gtcgcgcccgacgggtttct

SEQ ID NO: 101921 - DNA, 20 bp, human
ggggcgcctgacgtcaggtc

SEQ ID NO: 101922 - DNA, 20 bp, human
gagcgaaccggcctcctagc

SEQ ID NO: 101923 - DNA, 20 bp, human
gcaggcagcccgcagcgtgg

SEQ ID NO: 101924 - DNA, 20 bp, human
gaggctgcttcggtactagt

SEQ ID NO: 101925 - DNA, 20 bp, human
gaatatccgagaccgcagta

SEQ ID NO: 101926 - DNA, 20 bp, human
ggcgctgcctacgtcctcag

SEQ ID NO: 101927 - DNA, 20 bp, human
gcctgctcccctgaggacgt

SEQ ID NO: 101928 - DNA, 20 bp, human
gggagccccgtagaaccgag

SEQ ID NO: 101929 - DNA, 20 bp, human
gcgaccccctcggttctacg

SEQ ID NO: 101930 - DNA, 20 bp, human
gcaggagactcgggatgatc

SEQ ID NO: 101931 - DNA, 20 bp, human
ggcgaagccccctcccctga

SEQ ID NO: 101932 - DNA, 20 bp, human
gtcgggagcgtcccagggag

SEQ ID NO: 101933 - DNA, 20 bp, human
gtcccccagaaagcactcag

SEQ ID NO: 101934 - DNA, 20 bp, human
ggcctcgccccgtgtcacta

SEQ ID NO: 101935 - DNA, 20 bp, human
gcggggaccctagtgacacg

SEQ ID NO: 101936 - DNA, 20 bp, human
gcacaacgcgaggagcccag

SEQ ID NO: 101937 - DNA, 20 bp, human
gcaggcgaggagctcaccca

SEQ ID NO: 101938 - DNA, 20 bp, human
gcgtgcgccgtggctgggac

SEQ ID NO: 101939 - DNA, 20 bp, human
ggggctgtcggggcgaccgc

SEQ ID NO: 101940 - DNA, 20 bp, human
ggagcccgccgaactccgag

SEQ ID NO: 101941 - DNA, 20 bp, human
gcgccgcggccgcagacaaa

SEQ ID NO: 101942 - DNA, 20 bp, human
gtaaggtggggaggcagtgc

SEQ ID NO: 101943 - DNA, 20 bp, human
gcgctccggactgtccccgg

SEQ ID NO: 101944 - DNA, 20 bp, human
ggaggagaaagccagcggag

SEQ ID NO: 101945 - DNA, 20 bp, human
gggaggggagccacttaccg

SEQ ID NO: 101946 - DNA, 20 bp, human
ggcgggtcggggttacatgg

SEQ ID NO: 101947 - DNA, 20 bp, human
gtgaggccgagtcaccgggt

SEQ ID NO: 101948 - DNA, 20 bp, human
gggttacatggcggcgactg

SEQ ID NO: 101949 - DNA, 20 bp, human
gctcgcgggtcggggttaca

SEQ ID NO: 101950 - DNA, 20 bp, human
ggacgcgggagcatttcgaa

SEQ ID NO: 101951 - DNA, 20 bp, human
gcgcggcctggcagggcgac

SEQ ID NO: 101952 - DNA, 20 bp, human
ggcccggccggagtcagctg

SEQ ID NO: 101953 - DNA, 20 bp, human
gcacccggcacgcccctcgc

SEQ ID NO: 101954 - DNA, 20 bp, human
gggcggctgccgctcaacaa

SEQ ID NO: 101955 - DNA, 20 bp, human
gtggcagggcgaccggcgag

SEQ ID NO: 101956 - DNA, 20 bp, human
gccgcagaggagcagaggtt

SEQ ID NO: 101957 - DNA, 20 bp, human
gccacccgcgggctccgcag

SEQ ID NO: 101958 - DNA, 20 bp, human
ggctgcagcggagttaaccg

SEQ ID NO: 101959 - DNA, 20 bp, human
gcgcgggacagacaaacgag

SEQ ID NO: 101960 - DNA, 20 bp, human
gggagaggaccacctaccgt

SEQ ID NO: 101961 - DNA, 20 bp, human
gctgtgtggagactcgggtg

SEQ ID NO: 101962 - DNA, 20 bp, human
gcggaggaccgggatctctg

SEQ ID NO: 101963 - DNA, 20 bp, human
gtgacgggcaccctctaccg

SEQ ID NO: 101964 - DNA, 20 bp, human
gtggagactcgggtgaggag

SEQ ID NO: 101965 - DNA, 20 bp, human
gcccaaagcacgggaatcgc

SEQ ID NO: 101966 - DNA, 20 bp, human
gcgcgagcagcgctgggtaa

SEQ ID NO: 101967 - DNA, 20 bp, human
ggaggacgcgagaggacagg

SEQ ID NO: 101968 - DNA, 20 bp, human
ggacgacgcggcttggattg

SEQ ID NO: 101969 - DNA, 20 bp, human
gggcggcgcgggaacaatag

SEQ ID NO: 101970 - DNA, 20 bp, human
gcacgcgaagaggacgcgag

SEQ ID NO: 101971 - DNA, 20 bp, human
gaggcaggacccacgcgaag

SEQ ID NO: 101972 - DNA, 20 bp, human
ggaagaggacgcgagaggac

SEQ ID NO: 101973 - DNA, 20 bp, human
gcggctgagtaacagagacg

SEQ ID NO: 101974 - DNA, 20 bp, human
gcagcgctgggtaacggccg

SEQ ID NO: 101975 - DNA, 20 bp, human
gagcgcagcgaacggcgaca

SEQ ID NO: 101976 - DNA, 20 bp, human
gccccaggcactggacccgt

SEQ ID NO: 101977 - DNA, 20 bp, human
gggctgcacagcgcacggag

SEQ ID NO: 101978 - DNA, 20 bp, human
gcgcgccgggctgctctctg

SEQ ID NO: 101979 - DNA, 20 bp, human
gccgccgcggagatgtgagg

SEQ ID NO: 101980 - DNA, 20 bp, human
gagcgggaaggggcacccac

SEQ ID NO: 101981 - DNA, 20 bp, human
ggctcctcggatcccaacac

SEQ ID NO: 101982 - DNA, 20 bp, human
gggtgccgcggtctcaggtg

SEQ ID NO: 101983 - DNA, 20 bp, human
gccgggctgctctctgcggg

SEQ ID NO: 101984 - DNA, 20 bp, human
ggggccgccgcggagatgtg

SEQ ID NO: 101985 - DNA, 20 bp, human
gggtgaggcgccaacgtggg

SEQ ID NO: 101986 - DNA, 20 bp, human
gaggcgggcgcacctgtgtc

SEQ ID NO: 101987 - DNA, 20 bp, human
gcgggaacccgggaacgaaa

SEQ ID NO: 101988 - DNA, 20 bp, human
ggccagcctcaagtccggac

SEQ ID NO: 101989 - DNA, 20 bp, human
gcccagcctaggaccaggaa

SEQ ID NO: 101990 - DNA, 20 bp, human
gccgcctagcccgaactccg

SEQ ID NO: 101991 - DNA, 20 bp, human
gagcctaggaccaggaatgg

SEQ ID NO: 101992 - DNA, 20 bp, human
gaccagtccggacttgaggc

SEQ ID NO: 101993 - DNA, 20 bp, human
ggccccgccagcctcaagtc

SEQ ID NO: 101994 - DNA, 20 bp, human
gccgccgcggagttcgggct

SEQ ID NO: 101995 - DNA, 20 bp, human
gcagtcccgcgggccgtgcg

SEQ ID NO: 101996 - DNA, 20 bp, human
gggcgacagcgagtggaagg

SEQ ID NO: 101997 - DNA, 20 bp, human
gcctctcccggagaagatgg

SEQ ID NO: 101998 - DNA, 20 bp, human
ggggcctctcccggagaaga

SEQ ID NO: 101999 - DNA, 20 bp, human
gtggacggctgacctgtcaa

SEQ ID NO: 102000 - DNA, 20 bp, human
gctgggccgaccctctgcgg

SEQ ID NO: 102001 - DNA, 20 bp, human
gggatgcgggcacaccctcc

SEQ ID NO: 102002 - DNA, 20 bp, human
ggacgcgcggtgaagatgga

SEQ ID NO: 102003 - DNA, 20 bp, human
ggtctggcgtccactgaaag

SEQ ID NO: 102004 - DNA, 20 bp, human
gtggccttggcctctttcag

SEQ ID NO: 102005 - DNA, 20 bp, human
ggcgatccgccatcttctcc

SEQ ID NO: 102006 - DNA, 20 bp, human
gctgcggcctgcggaacctg

SEQ ID NO: 102007 - DNA, 20 bp, human
gcctgaggcgacagcagctg

SEQ ID NO: 102008 - DNA, 20 bp, human
gacgggcgcagcctcggcag

SEQ ID NO: 102009 - DNA, 20 bp, human
gagatccagatggacgaggg

SEQ ID NO: 102010 - DNA, 20 bp, human
gaccaggacgactactgctc

SEQ ID NO: 102011 - DNA, 20 bp, human
ggccggagcagtagtcgtcc

SEQ ID NO: 102012 - DNA, 20 bp, human
ggcaggcggaggaggtgcgt

SEQ ID NO: 102013 - DNA, 20 bp, human
gccagcacgttcaccaccag

SEQ ID NO: 102014 - DNA, 20 bp, human
gctcgtcgtagcagtggatg

SEQ ID NO: 102015 - DNA, 20 bp, human
gtccagatggacgagggcgg

SEQ ID NO: 102016 - DNA, 20 bp, human
ggcgcccctcacacccactg

SEQ ID NO: 102017 - DNA, 20 bp, human
ggccgccgcagtgggtgtga

SEQ ID NO: 102018 - DNA, 20 bp, human
gcggcggcagcggcggagaa

SEQ ID NO: 102019 - DNA, 20 bp, human
gcggaagggtcgcagcgccc

SEQ ID NO: 102020 - DNA, 20 bp, human
gatggcgcccgcagacccca

SEQ ID NO: 102021 - DNA, 20 bp, human
gcccctcacacccactgcgg

SEQ ID NO: 102022 - DNA, 20 bp, human
gtgtctgccccacctccggg

SEQ ID NO: 102023 - DNA, 20 bp, human
gcgcgagggtctgtcagacc

SEQ ID NO: 102024 - DNA, 20 bp, human
gtcctgcgccgggtgcccag

SEQ ID NO: 102025 - DNA, 20 bp, human
gtgctgacagccgggcggaa

SEQ ID NO: 102026 - DNA, 20 bp, human
gtgtgcggctcggggtaata

SEQ ID NO: 102027 - DNA, 20 bp, human
ggccgacccggcccgtagtg

SEQ ID NO: 102028 - DNA, 20 bp, human
ggcgagcagcaggggcatga

SEQ ID NO: 102029 - DNA, 20 bp, human
ggcccgggccacctgaacaa

SEQ ID NO: 102030 - DNA, 20 bp, human
gtgtggttccgggtcgtgtg

SEQ ID NO: 102031 - DNA, 20 bp, human
gcagctgacctggtagtgtg

SEQ ID NO: 102032 - DNA, 20 bp, human
gacgacccggaaccacaccc

SEQ ID NO: 102033 - DNA, 20 bp, human
gggcagcgctgaaactggag

SEQ ID NO: 102034 - DNA, 20 bp, human
gccccgagccgcacacgacc

SEQ ID NO: 102035 - DNA, 20 bp, human
gggggcatgagggctaaccc

SEQ ID NO: 102036 - DNA, 20 bp, human
gcctagggtgaagtagatcg

SEQ ID NO: 102037 - DNA, 20 bp, human
gttgtgtgactggagcccta

SEQ ID NO: 102038 - DNA, 20 bp, human
ggtgcttcctaactcaggga

SEQ ID NO: 102039 - DNA, 20 bp, human
gcagagaacagggttagaag

SEQ ID NO: 102040 - DNA, 20 bp, human
gggggaagaccgggtatgat

SEQ ID NO: 102041 - DNA, 20 bp, human
ggaccgggtatgattggtag

SEQ ID NO: 102042 - DNA, 20 bp, human
gtgaagctctgggggaagac

SEQ ID NO: 102043 - DNA, 20 bp, human
gagtagtaggcaaaagtggt

SEQ ID NO: 102044 - DNA, 20 bp, human
gcccttctcagggatatact

SEQ ID NO: 102045 - DNA, 20 bp, human
gtggtgaaaagtgaagctct

SEQ ID NO: 102046 - DNA, 20 bp, human
gtcctggggctgggcatcaa

SEQ ID NO: 102047 - DNA, 20 bp, human
gcgcagacgaggctgtgacg

SEQ ID NO: 102048 - DNA, 20 bp, human
gggtcaccagccaggtcctg

SEQ ID NO: 102049 - DNA, 20 bp, human
gctgcaggccggacttgacg

SEQ ID NO: 102050 - DNA, 20 bp, human
gcggcgcgcggtgggaccca

SEQ ID NO: 102051 - DNA, 20 bp, human
gctggcgctctggggaccgc

SEQ ID NO: 102052 - DNA, 20 bp, human
gaacttcgcagcccgtcggg

SEQ ID NO: 102053 - DNA, 20 bp, human
gcggacttgacgtggaactg

SEQ ID NO: 102054 - DNA, 20 bp, human
gggctgggtacattgtcgcg

SEQ ID NO: 102055 - DNA, 20 bp, human
gccatgctgtccaactccca

SEQ ID NO: 102056 - DNA, 20 bp, human
gccagcgagggcgtacctgg

SEQ ID NO: 102057 - DNA, 20 bp, human
gacgcaccttgctgaggtac

SEQ ID NO: 102058 - DNA, 20 bp, human
gttgctgaggtaccggcgag

SEQ ID NO: 102059 - DNA, 20 bp, human
gtggcggccgcagaaatccc

SEQ ID NO: 102060 - DNA, 20 bp, human
ggcggcaacgcaccttgctg

SEQ ID NO: 102061 - DNA, 20 bp, human
gcccagcctggcgcttctag

SEQ ID NO: 102062 - DNA, 20 bp, human
gctcggccctgggatttctg

SEQ ID NO: 102063 - DNA, 20 bp, human
ggtccgccgggtgcaactgg

SEQ ID NO: 102064 - DNA, 20 bp, human
ggtacaagcgagcaccgccc

SEQ ID NO: 102065 - DNA, 20 bp, human
gggcccagcgagggcgtacc

SEQ ID NO: 102066 - DNA, 20 bp, human
ggcgcggccgagggagcaaa

SEQ ID NO: 102067 - DNA, 20 bp, human
gccgtcgccacgaggcccag

SEQ ID NO: 102068 - DNA, 20 bp, human
ggcgatgtgtggcgctgagg

SEQ ID NO: 102069 - DNA, 20 bp, human
gcgggtgtcccggcgatgtg

SEQ ID NO: 102070 - DNA, 20 bp, human
gatgtgtggcgctgaggcgg

SEQ ID NO: 102071 - DNA, 20 bp, human
gggcggctcggaaaccccag

SEQ ID NO: 102072 - DNA, 20 bp, human
gagcagccgcccctcgggac

SEQ ID NO: 102073 - DNA, 20 bp, human
ggcggcgccgagctctgctt

SEQ ID NO: 102074 - DNA, 20 bp, human
gccgaagccgaagcagagct

SEQ ID NO: 102075 - DNA, 20 bp, human
gccggcgatgtgtggcgctg

SEQ ID NO: 102076 - DNA, 20 bp, human
gtctggaggatagggagtgg

SEQ ID NO: 102077 - DNA, 20 bp, human
gtggcaactgtagtgtccaa

SEQ ID NO: 102078 - DNA, 20 bp, human
ggctgctgcctctaccgctg

SEQ ID NO: 102079 - DNA, 20 bp, human
gggagctatggtggcacgat

SEQ ID NO: 102080 - DNA, 20 bp, human
gccccgctcacagcgccctc

SEQ ID NO: 102081 - DNA, 20 bp, human
gcgctctccgccctccacag

SEQ ID NO: 102082 - DNA, 20 bp, human
ggaggccgccgagaccacca

SEQ ID NO: 102083 - DNA, 20 bp, human
gctggcgagatggatgggat

SEQ ID NO: 102084 - DNA, 20 bp, human
gtgccgaacgcgatgcccga

SEQ ID NO: 102085 - DNA, 20 bp, human
gtcgtccacgagaccaactg

SEQ ID NO: 102086 - DNA, 20 bp, human
gtgagggccgagagatcggg

SEQ ID NO: 102087 - DNA, 20 bp, human
gaacgagacgaagacggaac

SEQ ID NO: 102088 - DNA, 20 bp, human
gggcccgctagccggctcac

SEQ ID NO: 102089 - DNA, 20 bp, human
ggcgactggaggtcccaggg

SEQ ID NO: 102090 - DNA, 20 bp, human
ggcagcgactggaggtccca

SEQ ID NO: 102091 - DNA, 20 bp, human
ggcctgagggccgagagatc

SEQ ID NO: 102092 - DNA, 20 bp, human
gcactgcccgcaaccggctc

SEQ ID NO: 102093 - DNA, 20 bp, human
gacgtcggcgcgtaacgagg

SEQ ID NO: 102094 - DNA, 20 bp, human
gcccagggcccaaccaccct

SEQ ID NO: 102095 - DNA, 20 bp, human
gctctggggacgcacattgt

SEQ ID NO: 102096 - DNA, 20 bp, human
ggcggcaggcacggtccgtg

SEQ ID NO: 102097 - DNA, 20 bp, human
gatggagggagacccctcga

SEQ ID NO: 102098 - DNA, 20 bp, human
gtgcggagcaggcgagcgag

SEQ ID NO: 102099 - DNA, 20 bp, human
gcagtgagcgagcaggcggc

SEQ ID NO: 102100 - DNA, 20 bp, human
gagcgttcctacaggtaatg

SEQ ID NO: 102101 - DNA, 20 bp, human
gtgccagccccattacctgt

SEQ ID NO: 102102 - DNA, 20 bp, human
ggaggctccgcgactgcaga

SEQ ID NO: 102103 - DNA, 20 bp, human
gttggcgcactcccgagaag

SEQ ID NO: 102104 - DNA, 20 bp, human
ggcactgtgtgcttccggaa

SEQ ID NO: 102105 - DNA, 20 bp, human
ggaaggggaacaaaccgctg

SEQ ID NO: 102106 - DNA, 20 bp, human
gcccagctgtcagcagagga

SEQ ID NO: 102107 - DNA, 20 bp, human
gagcccccagctgtcagcag

SEQ ID NO: 102108 - DNA, 20 bp, human
ggctgtccagggtaggaaca

SEQ ID NO: 102109 - DNA, 20 bp, human
gcggcgttggtgaaggaggg

SEQ ID NO: 102110 - DNA, 20 bp, human
gacacggcgttggtgaagga

SEQ ID NO: 102111 - DNA, 20 bp, human
gggctggggctgtccagggt

SEQ ID NO: 102112 - DNA, 20 bp, human
gcagggtaggaacacggcgt

SEQ ID NO: 102113 - DNA, 20 bp, human
gaccctccaggctctagctg

SEQ ID NO: 102114 - DNA, 20 bp, human
ggaggcgacagcgccggagc

SEQ ID NO: 102115 - DNA, 20 bp, human
gaggaaggaggcgacagcgc

SEQ ID NO: 102116 - DNA, 20 bp, human
ggtggacccggagagacgga

SEQ ID NO: 102117 - DNA, 20 bp, human
ggcgttgaagccggagaccg

SEQ ID NO: 102118 - DNA, 20 bp, human
ggcggtggccacgtctagtg

SEQ ID NO: 102119 - DNA, 20 bp, human
gtggagaaaatatcagccca

SEQ ID NO: 102120 - DNA, 20 bp, human
gcagaggctgcggctccggc

SEQ ID NO: 102121 - DNA, 20 bp, human
gtggggaaggagcctcaagg

SEQ ID NO: 102122 - DNA, 20 bp, human
gcagcgaggaccctccgccc

SEQ ID NO: 102123 - DNA, 20 bp, human
gcagagactgcgggggacga

SEQ ID NO: 102124 - DNA, 20 bp, human
gcccggagagacggagggaa

SEQ ID NO: 102125 - DNA, 20 bp, human
gaggagcctcaaggtggacc

SEQ ID NO: 102126 - DNA, 20 bp, human
gggctgcagtcgagagtgaa

SEQ ID NO: 102127 - DNA, 20 bp, human
ggaggctgtgccggcagggt

SEQ ID NO: 102128 - DNA, 20 bp, human
gtgttggtgccggagctggt

SEQ ID NO: 102129 - DNA, 20 bp, human
ggattcgcgcagaccccagg

SEQ ID NO: 102130 - DNA, 20 bp, human
ggaagccccagtctgcggag

SEQ ID NO: 102131 - DNA, 20 bp, human
ggcgcggcggcggtgacttg

SEQ ID NO: 102132 - DNA, 20 bp, human
gcctccctctccgcagactg

SEQ ID NO: 102133 - DNA, 20 bp, human
gtggaaagggacctgagcaa

SEQ ID NO: 102134 - DNA, 20 bp, human
ggtggcagcggcgctgctgt

SEQ ID NO: 102135 - DNA, 20 bp, human
ggggcgcgcgccggcgaaga

SEQ ID NO: 102136 - DNA, 20 bp, human
gtcgcggagaagccagccat

SEQ ID NO: 102137 - DNA, 20 bp, human
gtgagaagggaggagcgcag

SEQ ID NO: 102138 - DNA, 20 bp, human
gtggcttctccgcgaggtgg

SEQ ID NO: 102139 - DNA, 20 bp, human
gcggggcaagggggtgagaa

SEQ ID NO: 102140 - DNA, 20 bp, human
ggatccggctcggggcaagg

SEQ ID NO: 102141 - DNA, 20 bp, human
gggctggcttctccgcgagg

SEQ ID NO: 102142 - DNA, 20 bp, human
gaggcgacggaaggttgcag

SEQ ID NO: 102143 - DNA, 20 bp, human
gcttctccgcgaggtggcgg

SEQ ID NO: 102144 - DNA, 20 bp, human
ggcagcgctgatccggctcg

SEQ ID NO: 102145 - DNA, 20 bp, human
gctgcagcgcaggcgacgga

SEQ ID NO: 102146 - DNA, 20 bp, human
ggagcgggaatgccttaatg

SEQ ID NO: 102147 - DNA, 20 bp, human
gcaagcctgcgcggtaatgg

SEQ ID NO: 102148 - DNA, 20 bp, human
gaggcttggtcaccgcatta

SEQ ID NO: 102149 - DNA, 20 bp, human
ggaccaagcctgcgcggtaa

SEQ ID NO: 102150 - DNA, 20 bp, human
gccggtgaaatcctgcaaag

SEQ ID NO: 102151 - DNA, 20 bp, human
gtagatccagagcttcgcca

SEQ ID NO: 102152 - DNA, 20 bp, human
ggaagacaggcagacagcgg

SEQ ID NO: 102153 - DNA, 20 bp, human
ggaggagctggaagcgccca

SEQ ID NO: 102154 - DNA, 20 bp, human
ggagcagttccgcggagagc

SEQ ID NO: 102155 - DNA, 20 bp, human
ggacaggcagacagcggcgg

SEQ ID NO: 102156 - DNA, 20 bp, human
gttgaaaagggataagagga

SEQ ID NO: 102157 - DNA, 20 bp, human
gatgctaaagaaatgtggag

SEQ ID NO: 102158 - DNA, 20 bp, human
ggttgtttggaattctgtga

SEQ ID NO: 102159 - DNA, 20 bp, human
gcgaacacccgagatctcag

SEQ ID NO: 102160 - DNA, 20 bp, human
gtggaattctgtgagggtta

SEQ ID NO: 102161 - DNA, 20 bp, human
gccaaatcccctgagatctc

SEQ ID NO: 102162 - DNA, 20 bp, human
gacgataacatttacttata

SEQ ID NO: 102163 - DNA, 20 bp, human
gcgggtgttcgcgtgttgtt

SEQ ID NO: 102164 - DNA, 20 bp, human
gaaacctccacattggtgag

SEQ ID NO: 102165 - DNA, 20 bp, human
gtaatatattcatatagatt

SEQ ID NO: 102166 - DNA, 20 bp, human
gcagtggacccaccaggcaa

SEQ ID NO: 102167 - DNA, 20 bp, human
ggcacagcatcagccctgga

SEQ ID NO: 102168 - DNA, 20 bp, human
gtccggctggtagtcctggg

SEQ ID NO: 102169 - DNA, 20 bp, human
gcaagccccgctcgggatca

SEQ ID NO: 102170 - DNA, 20 bp, human
gttccactggatgacatcat

SEQ ID NO: 102171 - DNA, 20 bp, human
gccccagccacgctccccag

SEQ ID NO: 102172 - DNA, 20 bp, human
ggctgagtacggaagacaca

SEQ ID NO: 102173 - DNA, 20 bp, human
gctctccggctggtagtcct

SEQ ID NO: 102174 - DNA, 20 bp, human
gcaccagagaggcgcctact

SEQ ID NO: 102175 - DNA, 20 bp, human
ggactaccagccggagagaa

SEQ ID NO: 102176 - DNA, 20 bp, human
gcggaaagcagcctcgggga

SEQ ID NO: 102177 - DNA, 20 bp, human
gcgtctgcaggaaagaatgt

SEQ ID NO: 102178 - DNA, 20 bp, human
gggaggaagggcagacccac

SEQ ID NO: 102179 - DNA, 20 bp, human
gcgccggccggccttgcctg

SEQ ID NO: 102180 - DNA, 20 bp, human
gcggttgctagggaaaccgg

SEQ ID NO: 102181 - DNA, 20 bp, human
gacccctgtagccccggcag

SEQ ID NO: 102182 - DNA, 20 bp, human
gtgggagaactggagcggag

SEQ ID NO: 102183 - DNA, 20 bp, human
gcggggctacaggggtcgag

SEQ ID NO: 102184 - DNA, 20 bp, human
gagggcagacccacaggtaa

SEQ ID NO: 102185 - DNA, 20 bp, human
gtcccctgccggggctacag

SEQ ID NO: 102186 - DNA, 20 bp, human
ggctttgagggcggccacgg

SEQ ID NO: 102187 - DNA, 20 bp, human
ggccgccggctcggctctga

SEQ ID NO: 102188 - DNA, 20 bp, human
ggggccaagcgagccgctag

SEQ ID NO: 102189 - DNA, 20 bp, human
gcctggccggcgggctgcag

SEQ ID NO: 102190 - DNA, 20 bp, human
gaggtggccccgcggtgcag

SEQ ID NO: 102191 - DNA, 20 bp, human
ggaaggttctgcagctgcgg

SEQ ID NO: 102192 - DNA, 20 bp, human
gtccatcagagccgagccgg

SEQ ID NO: 102193 - DNA, 20 bp, human
gccaagcgagccgctagggg

SEQ ID NO: 102194 - DNA, 20 bp, human
ggccggcctcagactccccg

SEQ ID NO: 102195 - DNA, 20 bp, human
gagcgagccgctaggggagg

SEQ ID NO: 102196 - DNA, 20 bp, human
gccggccggcacctgcgtcc

SEQ ID NO: 102197 - DNA, 20 bp, human
gccggccggagcggagctag

SEQ ID NO: 102198 - DNA, 20 bp, human
gggcgccactagctccgctc

SEQ ID NO: 102199 - DNA, 20 bp, human
gcccagaagccccatcaggt

SEQ ID NO: 102200 - DNA, 20 bp, human
ggcccggccgcggatcaggt

SEQ ID NO: 102201 - DNA, 20 bp, human
gcgctctgagaaggaggttg

SEQ ID NO: 102202 - DNA, 20 bp, human
gggtgcccggacgcaggtgc

SEQ ID NO: 102203 - DNA, 20 bp, human
ggaccccggagacctcccac

SEQ ID NO: 102204 - DNA, 20 bp, human
gggggccgaggcgaaccgag

SEQ ID NO: 102205 - DNA, 20 bp, human
gcggagctagtggcgccgac

SEQ ID NO: 102206 - DNA, 20 bp, human
gctccaaagtggggaggtga

SEQ ID NO: 102207 - DNA, 20 bp, human
gactaactcttgcgctagga

SEQ ID NO: 102208 - DNA, 20 bp, human
gaacaacttcccctggccca

SEQ ID NO: 102209 - DNA, 20 bp, human
gaaatctgagctccaaagtg

SEQ ID NO: 102210 - DNA, 20 bp, human
gcaatcaaaatccgagccct

SEQ ID NO: 102211 - DNA, 20 bp, human
gttccttcacctccccactt

SEQ ID NO: 102212 - DNA, 20 bp, human
gcgctaggacggttcactgc

SEQ ID NO: 102213 - DNA, 20 bp, human
gaggagtttgagacgagcta

SEQ ID NO: 102214 - DNA, 20 bp, human
gaggtatgaacaacttcccc

SEQ ID NO: 102215 - DNA, 20 bp, human
gaattactaactcttgcgct

SEQ ID NO: 102216 - DNA, 20 bp, human
gcggacctgctcaacgagtg

SEQ ID NO: 102217 - DNA, 20 bp, human
gcgcgctgtgggcgactgtg

SEQ ID NO: 102218 - DNA, 20 bp, human
gacctgctcaacgagtgagg

SEQ ID NO: 102219 - DNA, 20 bp, human
gactggaaccgcgtcccggg

SEQ ID NO: 102220 - DNA, 20 bp, human
gttccggcgggcacctcagg

SEQ ID NO: 102221 - DNA, 20 bp, human
gtggcgtaattgacatgggt

SEQ ID NO: 102222 - DNA, 20 bp, human
gccatgtcgttgccgcagag

SEQ ID NO: 102223 - DNA, 20 bp, human
ggggagtgcggcaagcctgg

SEQ ID NO: 102224 - DNA, 20 bp, human
gctcacggcccagtggacca

SEQ ID NO: 102225 - DNA, 20 bp, human
gagttcgggagtggggatat

SEQ ID NO: 102226 - DNA, 20 bp, human
gccagccagaggcggtggag

SEQ ID NO: 102227 - DNA, 20 bp, human
gcggaagacgagacaacacc

SEQ ID NO: 102228 - DNA, 20 bp, human
gagcgctgccatgcaaccag

SEQ ID NO: 102229 - DNA, 20 bp, human
gaggaagcaaatcagattcc

SEQ ID NO: 102230 - DNA, 20 bp, human
gttgggaatcgagccagtgg

SEQ ID NO: 102231 - DNA, 20 bp, human
gtgcggtgccagctgaaggt

SEQ ID NO: 102232 - DNA, 20 bp, human
gtcgcagatgcaacgaggta

SEQ ID NO: 102233 - DNA, 20 bp, human
gtcgttgcatctgcgaggag

SEQ ID NO: 102234 - DNA, 20 bp, human
gcagaggcgaggccggcgtg

SEQ ID NO: 102235 - DNA, 20 bp, human
gaatctgatttgcttcctct

SEQ ID NO: 102236 - DNA, 20 bp, human
gggagtaggccgcagtccgg

SEQ ID NO: 102237 - DNA, 20 bp, human
gcaatagcactgagaggcgg

SEQ ID NO: 102238 - DNA, 20 bp, human
gcagggacaatagcactgag

SEQ ID NO: 102239 - DNA, 20 bp, human
gggcgactcttacctcacaa

SEQ ID NO: 102240 - DNA, 20 bp, human
gtcaccaagagcctcgaggg

SEQ ID NO: 102241 - DNA, 20 bp, human
gggacaatagcactgagagg

SEQ ID NO: 102242 - DNA, 20 bp, human
gctggccgtggaactcctcc

SEQ ID NO: 102243 - DNA, 20 bp, human
ggtccatggaccggaacctc

SEQ ID NO: 102244 - DNA, 20 bp, human
gtgctcaccaagagcctcga

SEQ ID NO: 102245 - DNA, 20 bp, human
ggaacctcgggccgacggac

SEQ ID NO: 102246 - DNA, 20 bp, human
gccagacaagatggacaccg

SEQ ID NO: 102247 - DNA, 20 bp, human
gggtccgcggcgctcgaggt

SEQ ID NO: 102248 - DNA, 20 bp, human
ggtacgctcaggtgcgagag

SEQ ID NO: 102249 - DNA, 20 bp, human
ggggtccccgcccccctcgg

SEQ ID NO: 102250 - DNA, 20 bp, human
ggaggggcgggaacacctag

SEQ ID NO: 102251 - DNA, 20 bp, human
ggacaagatggacaccgcgg

SEQ ID NO: 102252 - DNA, 20 bp, human
ggtagggcctggcgagcaat

SEQ ID NO: 102253 - DNA, 20 bp, human
gaacccgggcgccgacgcaa

SEQ ID NO: 102254 - DNA, 20 bp, human
ggacagaaagcgagcgacac

SEQ ID NO: 102255 - DNA, 20 bp, human
gcgggcaggtgcgtacgctc

SEQ ID NO: 102256 - DNA, 20 bp, human
ggccgccccgcgccaaagga

SEQ ID NO: 102257 - DNA, 20 bp, human
gagtcggcagcgaagcacaa

SEQ ID NO: 102258 - DNA, 20 bp, human
gtgcgccggatccgggagag

SEQ ID NO: 102259 - DNA, 20 bp, human
gcgccccacggcccaagagg

SEQ ID NO: 102260 - DNA, 20 bp, human
ggtgactgaggaaatgcagt

SEQ ID NO: 102261 - DNA, 20 bp, human
gagttctaggcccgtgactg

SEQ ID NO: 102262 - DNA, 20 bp, human
gagcagggaggggcacttaa

SEQ ID NO: 102263 - DNA, 20 bp, human
gagggaggggcacttaacgg

SEQ ID NO: 102264 - DNA, 20 bp, human
ggaccaaaggcccctggcaa

SEQ ID NO: 102265 - DNA, 20 bp, human
gctggttctgcgccggatcc

SEQ ID NO: 102266 - DNA, 20 bp, human
gcagcgcgtcggctacaggt

SEQ ID NO: 102267 - DNA, 20 bp, human
gcttgctgcgtccacgtctc

SEQ ID NO: 102268 - DNA, 20 bp, human
gaggccgcaggagttacctc

SEQ ID NO: 102269 - DNA, 20 bp, human
gctcacagccggtcagggaa

SEQ ID NO: 102270 - DNA, 20 bp, human
gtgctcgaggcgggccaggg

SEQ ID NO: 102271 - DNA, 20 bp, human
gtccgcgggaggacaccgag

SEQ ID NO: 102272 - DNA, 20 bp, human
gcgccgctggccgccaataa

SEQ ID NO: 102273 - DNA, 20 bp, human
gctcgagcatgcccgagacg

SEQ ID NO: 102274 - DNA, 20 bp, human
gggaattcacctggcacccg

SEQ ID NO: 102275 - DNA, 20 bp, human
gaacgtctcacagccggtca

SEQ ID NO: 102276 - DNA, 20 bp, human
ggctcggcggtggcaaatgg

SEQ ID NO: 102277 - DNA, 20 bp, human
ggccgagccaagcctgatcc

SEQ ID NO: 102278 - DNA, 20 bp, human
gctcggtcccagtccccctc

SEQ ID NO: 102279 - DNA, 20 bp, human
ggctcggcccgtgcgctcgg

SEQ ID NO: 102280 - DNA, 20 bp, human
gaaatggcggctccttccgg

SEQ ID NO: 102281 - DNA, 20 bp, human
gttgccaccgccgagcgcac

SEQ ID NO: 102282 - DNA, 20 bp, human
gccgagagaacggcgatggg

SEQ ID NO: 102283 - DNA, 20 bp, human
gccggctccgggatcaggct

SEQ ID NO: 102284 - DNA, 20 bp, human
gtgcaaggggggctcgctag

SEQ ID NO: 102285 - DNA, 20 bp, human
gccggacgatgctcaagtct

SEQ ID NO: 102286 - DNA, 20 bp, human
gacagtgcggctacaaatct

SEQ ID NO: 102287 - DNA, 20 bp, human
ggcggcagcggcacacacac

SEQ ID NO: 102288 - DNA, 20 bp, human
ggcagcggcacacacaccgg

SEQ ID NO: 102289 - DNA, 20 bp, human
gtagccgcactgtagacaag

SEQ ID NO: 102290 - DNA, 20 bp, human
ggaaacaaagagcctcgggt

SEQ ID NO: 102291 - DNA, 20 bp, human
gtcgggttggtgtaacgacg

SEQ ID NO: 102292 - DNA, 20 bp, human
ggagaactgggcacccatgc

SEQ ID NO: 102293 - DNA, 20 bp, human
gtttcctcttgtctacagtg

SEQ ID NO: 102294 - DNA, 20 bp, human
ggcggcttctcccttcgctg

SEQ ID NO: 102295 - DNA, 20 bp, human
gtctccaagaccgcagcgaa

SEQ ID NO: 102296 - DNA, 20 bp, human
gattctggcgcggagcggag

SEQ ID NO: 102297 - DNA, 20 bp, human
gcggccccgggccctagaag

SEQ ID NO: 102298 - DNA, 20 bp, human
gagagctccaaggctccccg

SEQ ID NO: 102299 - DNA, 20 bp, human
gctgcggcgccgagaacaaa

SEQ ID NO: 102300 - DNA, 20 bp, human
gcggcggcgggcgcagctag

SEQ ID NO: 102301 - DNA, 20 bp, human
gcccaggggcaggtagagtc

SEQ ID NO: 102302 - DNA, 20 bp, human
gcccccgcgggcgaagcgag

SEQ ID NO: 102303 - DNA, 20 bp, human
gcgcgccgcaggggatagta

SEQ ID NO: 102304 - DNA, 20 bp, human
ggctccgggcgcttatatat

SEQ ID NO: 102305 - DNA, 20 bp, human
gccgcgggcgaagcgagggg

SEQ ID NO: 102306 - DNA, 20 bp, human
gcaatgaaaacgcaaaacag

SEQ ID NO: 102307 - DNA, 20 bp, human
ggcaaaacaggggcactgaa

SEQ ID NO: 102308 - DNA, 20 bp, human
ggaaaggctccattgcaatt

SEQ ID NO: 102309 - DNA, 20 bp, human
gttattctgacacacaggtt

SEQ ID NO: 102310 - DNA, 20 bp, human
gacaagtcaatagaaagtct

SEQ ID NO: 102311 - DNA, 20 bp, human
gccagctgcagtggttcgat

SEQ ID NO: 102312 - DNA, 20 bp, human
gccaagtggttcctcttgag

SEQ ID NO: 102313 - DNA, 20 bp, human
gggggacatttaataagcat

SEQ ID NO: 102314 - DNA, 20 bp, human
gcagaaatgctcccctcaag

SEQ ID NO: 102315 - DNA, 20 bp, human
gtgtctggagtgcttcaatt

SEQ ID NO: 102316 - DNA, 20 bp, human
gggtatgcggacagtaacga

SEQ ID NO: 102317 - DNA, 20 bp, human
gtgcggacagtaacgaggga

SEQ ID NO: 102318 - DNA, 20 bp, human
gtactgtccgcataccccgg

SEQ ID NO: 102319 - DNA, 20 bp, human
ggctaggctctccggaccat

SEQ ID NO: 102320 - DNA, 20 bp, human
gcccccactgctcccgaggg

SEQ ID NO: 102321 - DNA, 20 bp, human
ggggccgctcctcctgactg

SEQ ID NO: 102322 - DNA, 20 bp, human
gaggctggcaggatgaggcg

SEQ ID NO: 102323 - DNA, 20 bp, human
gccgccgccgcgcctcagtc

SEQ ID NO: 102324 - DNA, 20 bp, human
gggcaggatgaggcgtggaa

SEQ ID NO: 102325 - DNA, 20 bp, human
gacacctgaggcggagaacg

SEQ ID NO: 102326 - DNA, 20 bp, human
gatgttgggagcagcaggtc

SEQ ID NO: 102327 - DNA, 20 bp, human
gtgctccgcgcccggcacac

SEQ ID NO: 102328 - DNA, 20 bp, human
gcggtggtggcggccatgtt

SEQ ID NO: 102329 - DNA, 20 bp, human
gacgctgaacgagagggaca

SEQ ID NO: 102330 - DNA, 20 bp, human
gagcaggtaaggagccccga

SEQ ID NO: 102331 - DNA, 20 bp, human
ggcagtgccgctgagggcag

SEQ ID NO: 102332 - DNA, 20 bp, human
gcatggcgccggtatctcgg

SEQ ID NO: 102333 - DNA, 20 bp, human
gggcccagccagagaattcg

SEQ ID NO: 102334 - DNA, 20 bp, human
gctacccacgctgaacgaga

SEQ ID NO: 102335 - DNA, 20 bp, human
ggagggctccccgaattctc

SEQ ID NO: 102336 - DNA, 20 bp, human
gagcacaccagaagcaaggt

SEQ ID NO: 102337 - DNA, 20 bp, human
gggacagcacaccagaagca

SEQ ID NO: 102338 - DNA, 20 bp, human
gagccccgctggcttctcaa

SEQ ID NO: 102339 - DNA, 20 bp, human
ggcctgctctggctgagtaa

SEQ ID NO: 102340 - DNA, 20 bp, human
ggcccacagcagaacctgtc

SEQ ID NO: 102341 - DNA, 20 bp, human
gtgctctggctgagtaaggg

SEQ ID NO: 102342 - DNA, 20 bp, human
gacatacccgactggagaaa

SEQ ID NO: 102343 - DNA, 20 bp, human
gtgggaagggtgtccagatg

SEQ ID NO: 102344 - DNA, 20 bp, human
gggcaatcctagagtaaaaa

SEQ ID NO: 102345 - DNA, 20 bp, human
gcaccactagcagagagact

SEQ ID NO: 102346 - DNA, 20 bp, human
gggcagcagaggaagccgag

SEQ ID NO: 102347 - DNA, 20 bp, human
gcggccatcttggctccgtg

SEQ ID NO: 102348 - DNA, 20 bp, human
gctgaggtgccggggtgcgg

SEQ ID NO: 102349 - DNA, 20 bp, human
ggcggcgcctgaaaacgagg

SEQ ID NO: 102350 - DNA, 20 bp, human
ggtgaggctctgaggtgccg

SEQ ID NO: 102351 - DNA, 20 bp, human
gggcgaggagaccgggaggg

SEQ ID NO: 102352 - DNA, 20 bp, human
gggatctagacggccgtagg

SEQ ID NO: 102353 - DNA, 20 bp, human
ggccaggcccgggatctaga

SEQ ID NO: 102354 - DNA, 20 bp, human
gccgaggcgaggagaccggg

SEQ ID NO: 102355 - DNA, 20 bp, human
gagccgaggggcggccatct

SEQ ID NO: 102356 - DNA, 20 bp, human
gtgaggttgttcatctgcac

SEQ ID NO: 102357 - DNA, 20 bp, human
gtctacaccgagctcctgag

SEQ ID NO: 102358 - DNA, 20 bp, human
ggtctgtagtttccgatgtg

SEQ ID NO: 102359 - DNA, 20 bp, human
gcctgagcggctggtacgag

SEQ ID NO: 102360 - DNA, 20 bp, human
gacagactgttgaaaacaat

SEQ ID NO: 102361 - DNA, 20 bp, human
gtaccagccgctcaggagct

SEQ ID NO: 102362 - DNA, 20 bp, human
gtggcaagacatatccttac

SEQ ID NO: 102363 - DNA, 20 bp, human
gctatatattacaggcgcta

SEQ ID NO: 102364 - DNA, 20 bp, human
gtgttgaaaacaatcggcaa

SEQ ID NO: 102365 - DNA, 20 bp, human
gcaccgagctcctgagcggc

SEQ ID NO: 102366 - DNA, 20 bp, human
gcgcggggcgaggggtacaa

SEQ ID NO: 102367 - DNA, 20 bp, human
gtggcggctggacccagcca

SEQ ID NO: 102368 - DNA, 20 bp, human
ggcccaggaaacgagggtag

SEQ ID NO: 102369 - DNA, 20 bp, human
gaagtccgggaggggtcgag

SEQ ID NO: 102370 - DNA, 20 bp, human
gggcgcggagccggcccaag

SEQ ID NO: 102371 - DNA, 20 bp, human
gaacgatcggaactcggaca

SEQ ID NO: 102372 - DNA, 20 bp, human
gagaggtgacgagccgggtc

SEQ ID NO: 102373 - DNA, 20 bp, human
ggagaggggtcccgagagag

SEQ ID NO: 102374 - DNA, 20 bp, human
ggtctgcacggggacaagag

SEQ ID NO: 102375 - DNA, 20 bp, human
gtaggggctcgcggggcgag

SEQ ID NO: 102376 - DNA, 20 bp, human
gcagcaccggcaagcaaccc

SEQ ID NO: 102377 - DNA, 20 bp, human
gggccgctgaactcagaagc

SEQ ID NO: 102378 - DNA, 20 bp, human
gtcgtgagtgatggcgtccc

SEQ ID NO: 102379 - DNA, 20 bp, human
gccgccgccgggagagcccg

SEQ ID NO: 102380 - DNA, 20 bp, human
ggaccgggaagacggaagag

SEQ ID NO: 102381 - DNA, 20 bp, human
gtactagcatgacagccccc

SEQ ID NO: 102382 - DNA, 20 bp, human
gggggatgcctgataggtgt

SEQ ID NO: 102383 - DNA, 20 bp, human
gagggaagagcagtttactg

SEQ ID NO: 102384 - DNA, 20 bp, human
ggttccggttgcatcagcga

SEQ ID NO: 102385 - DNA, 20 bp, human
gtgagactgttcgtgagtga

SEQ ID NO: 102386 - DNA, 20 bp, human
ggcagaccggccgcaagcgg

SEQ ID NO: 102387 - DNA, 20 bp, human
gaggacggacgttcgcagca

SEQ ID NO: 102388 - DNA, 20 bp, human
gccccgtgcgtcctagcagg

SEQ ID NO: 102389 - DNA, 20 bp, human
gcgtgcgtcctagcaggcgg

SEQ ID NO: 102390 - DNA, 20 bp, human
gcgtcctagcaggcggagga

SEQ ID NO: 102391 - DNA, 20 bp, human
gcccgcggtctgctctacaa

SEQ ID NO: 102392 - DNA, 20 bp, human
ggcgtgggccgaagtcctcc

SEQ ID NO: 102393 - DNA, 20 bp, human
ggctgtgcagcacttctggg

SEQ ID NO: 102394 - DNA, 20 bp, human
gctgtactcggcactactgg

SEQ ID NO: 102395 - DNA, 20 bp, human
ggcccgaactgtagtagcgt

SEQ ID NO: 102396 - DNA, 20 bp, human
ggccccgagcagcggaatgg

SEQ ID NO: 102397 - DNA, 20 bp, human
gggcgccccgagcagcggaa

SEQ ID NO: 102398 - DNA, 20 bp, human
ggaggaagagaggactaaga

SEQ ID NO: 102399 - DNA, 20 bp, human
ggaaggcgtggtaggcgcag

SEQ ID NO: 102400 - DNA, 20 bp, human
gtggtcgctcatgatgccgg

SEQ ID NO: 102401 - DNA, 20 bp, human
gtgctggcggccgcgctcta

SEQ ID NO: 102402 - DNA, 20 bp, human
gcgctggctcatggtcaacg

SEQ ID NO: 102403 - DNA, 20 bp, human
ggcgggcgcagcgggcacct

SEQ ID NO: 102404 - DNA, 20 bp, human
ggtggcgatagtgatccaga

SEQ ID NO: 102405 - DNA, 20 bp, human
gccagcgggctgcgcaggaa

SEQ ID NO: 102406 - DNA, 20 bp, human
gctgcccaggactctgaaac

SEQ ID NO: 102407 - DNA, 20 bp, human
gggccggagccagggatccg

SEQ ID NO: 102408 - DNA, 20 bp, human
gggcggctgcgcaggtaagt

SEQ ID NO: 102409 - DNA, 20 bp, human
gcccgcgcccggaaggacgg

SEQ ID NO: 102410 - DNA, 20 bp, human
gtgcgcaggtaagtgggacc

SEQ ID NO: 102411 - DNA, 20 bp, human
gcgtccgtcgcagcacacct

SEQ ID NO: 102412 - DNA, 20 bp, human
gtgtgggaccgggcgcccag

SEQ ID NO: 102413 - DNA, 20 bp, human
gccacgtgaccgggagagga

SEQ ID NO: 102414 - DNA, 20 bp, human
gtccgcagagcgaaacctgg

SEQ ID NO: 102415 - DNA, 20 bp, human
gaggtaagtgggaccggggt

SEQ ID NO: 102416 - DNA, 20 bp, human
ggccatggaagatccgtcgg

SEQ ID NO: 102417 - DNA, 20 bp, human
ggcagaggaagggagacccc

SEQ ID NO: 102418 - DNA, 20 bp, human
gcgggacccggagagagacc

SEQ ID NO: 102419 - DNA, 20 bp, human
gtcgctcccgggcggggaca

SEQ ID NO: 102420 - DNA, 20 bp, human
gccggccatggaagatccgt

SEQ ID NO: 102421 - DNA, 20 bp, human
ggggacacggaacccggcca

SEQ ID NO: 102422 - DNA, 20 bp, human
ggcccccgacggatcttcca

SEQ ID NO: 102423 - DNA, 20 bp, human
gcctcaggtcgctcccgggc

SEQ ID NO: 102424 - DNA, 20 bp, human
gcaggaagcgaagcagcgac

SEQ ID NO: 102425 - DNA, 20 bp, human
gccgggcccggccgagagag

SEQ ID NO: 102426 - DNA, 20 bp, human
gtgccagttgagatgttcgt

SEQ ID NO: 102427 - DNA, 20 bp, human
gcatcgccccaagtaccagt

SEQ ID NO: 102428 - DNA, 20 bp, human
ggatggggtaaaggactgac

SEQ ID NO: 102429 - DNA, 20 bp, human
gatgtctgcgatagacaggt

SEQ ID NO: 102430 - DNA, 20 bp, human
gatggcatcggtaccagatg

SEQ ID NO: 102431 - DNA, 20 bp, human
gctcagtcgggaatgcacat

SEQ ID NO: 102432 - DNA, 20 bp, human
gccggaagcacaggaaccag

SEQ ID NO: 102433 - DNA, 20 bp, human
gctgaggcctcctcatggat

SEQ ID NO: 102434 - DNA, 20 bp, human
gctgctgacggccattagtg

SEQ ID NO: 102435 - DNA, 20 bp, human
gaatggccgtcagcagatag

SEQ ID NO: 102436 - DNA, 20 bp, human
gggagcagtggtccatctag

SEQ ID NO: 102437 - DNA, 20 bp, human
gacatcacagtcaggagcag

SEQ ID NO: 102438 - DNA, 20 bp, human
ggtcagcagcgaccaggtgg

SEQ ID NO: 102439 - DNA, 20 bp, human
ggggccacaacatcacagtc

SEQ ID NO: 102440 - DNA, 20 bp, human
ggccagaggacaccactaga

SEQ ID NO: 102441 - DNA, 20 bp, human
ggtcccagcaccccatggtc

SEQ ID NO: 102442 - DNA, 20 bp, human
ggatcacgtcagcagcgacc

SEQ ID NO: 102443 - DNA, 20 bp, human
gtgggggcaatgatattcaa

SEQ ID NO: 102444 - DNA, 20 bp, human
gcacgtcagcagcgaccagg

SEQ ID NO: 102445 - DNA, 20 bp, human
ggtgatgttgtggcccactc

SEQ ID NO: 102446 - DNA, 20 bp, human
ggcatcacggacaccacacc

SEQ ID NO: 102447 - DNA, 20 bp, human
gacaccgggcacgagctcac

SEQ ID NO: 102448 - DNA, 20 bp, human
gggacctcagaacaaagata

SEQ ID NO: 102449 - DNA, 20 bp, human
gacaggcaagtcaagctggg

SEQ ID NO: 102450 - DNA, 20 bp, human
gctcacaggcaagtcaagct

SEQ ID NO: 102451 - DNA, 20 bp, human
gtcctgcatgtggtagtgag

SEQ ID NO: 102452 - DNA, 20 bp, human
gggtgagtctgtcagtgaca

SEQ ID NO: 102453 - DNA, 20 bp, human
gatcagccttgtgggtgaac

SEQ ID NO: 102454 - DNA, 20 bp, human
gatgaggtacgtgccagggg

SEQ ID NO: 102455 - DNA, 20 bp, human
gaaagcaatgctctttccag

SEQ ID NO: 102456 - DNA, 20 bp, human
gggcacaccatgaggtaggt

SEQ ID NO: 102457 - DNA, 20 bp, human
gtgggcgcccacctacctca

SEQ ID NO: 102458 - DNA, 20 bp, human
ggctggacgggcacaccatg

SEQ ID NO: 102459 - DNA, 20 bp, human
ggacgggcacaccatgaggt

SEQ ID NO: 102460 - DNA, 20 bp, human
gcaaaggtgagaccagcgta

SEQ ID NO: 102461 - DNA, 20 bp, human
gggtccccaaggagtagcca

SEQ ID NO: 102462 - DNA, 20 bp, human
ggtatgccaatgaccaggag

SEQ ID NO: 102463 - DNA, 20 bp, human
gaggagggtcagcagcctat

SEQ ID NO: 102464 - DNA, 20 bp, human
gggagagctccaggtcgaag

SEQ ID NO: 102465 - DNA, 20 bp, human
gcagcgccgctcctggtcat

SEQ ID NO: 102466 - DNA, 20 bp, human
gccgcagcgccagcagacaa

SEQ ID NO: 102467 - DNA, 20 bp, human
gaggcgccacaaacccccag

SEQ ID NO: 102468 - DNA, 20 bp, human
ggtggcaggtgcggcagcag

SEQ ID NO: 102469 - DNA, 20 bp, human
gcctgcagcagtacccggag

SEQ ID NO: 102470 - DNA, 20 bp, human
gagagtcagacatgacccgg

SEQ ID NO: 102471 - DNA, 20 bp, human
gtactgccgccggggaagga

SEQ ID NO: 102472 - DNA, 20 bp, human
ggagagagtcagacatgacc

SEQ ID NO: 102473 - DNA, 20 bp, human
ggtcagacatgacccggcgg

SEQ ID NO: 102474 - DNA, 20 bp, human
ggcttgcacgctggagagga

SEQ ID NO: 102475 - DNA, 20 bp, human
gacaatgtctaggggatcgg

SEQ ID NO: 102476 - DNA, 20 bp, human
gaggcccgaatcgtccatgg

SEQ ID NO: 102477 - DNA, 20 bp, human
ggaatcgtccatggcggcag

SEQ ID NO: 102478 - DNA, 20 bp, human
gcggcgccgatggccccgag

SEQ ID NO: 102479 - DNA, 20 bp, human
gatgaggcccgaatcgtcca

SEQ ID NO: 102480 - DNA, 20 bp, human
gccgaggggcatgagcccta

SEQ ID NO: 102481 - DNA, 20 bp, human
ggccgcgtacctgcagcctc

SEQ ID NO: 102482 - DNA, 20 bp, human
ggccggaggctgcaggtacg

SEQ ID NO: 102483 - DNA, 20 bp, human
gcagcctccggcggcggatg

SEQ ID NO: 102484 - DNA, 20 bp, human
gcggcgacttcggcccgggg

SEQ ID NO: 102485 - DNA, 20 bp, human
ggagcaaagttattgcccta

SEQ ID NO: 102486 - DNA, 20 bp, human
gccgaaggctggctgtaggc

SEQ ID NO: 102487 - DNA, 20 bp, human
gctgcccaacgtgtgctggg

SEQ ID NO: 102488 - DNA, 20 bp, human
gctcccacccagcacacgtt

SEQ ID NO: 102489 - DNA, 20 bp, human
gggcctgcccaacgtgtgct

SEQ ID NO: 102490 - DNA, 20 bp, human
gggcgggttgggatccggga

SEQ ID NO: 102491 - DNA, 20 bp, human
gccgggagggtgaacctgaa

SEQ ID NO: 102492 - DNA, 20 bp, human
gcccggtgcgcgcgcgtgag

SEQ ID NO: 102493 - DNA, 20 bp, human
ggaacctgaatggaagccgt

SEQ ID NO: 102494 - DNA, 20 bp, human
gatcttcggcgggaggaccc

SEQ ID NO: 102495 - DNA, 20 bp, human
gggagcaggtagggcgggtt

SEQ ID NO: 102496 - DNA, 20 bp, human
gggacgagtcgagcctcctg

SEQ ID NO: 102497 - DNA, 20 bp, human
ggtgcagcgacgacccaagg

SEQ ID NO: 102498 - DNA, 20 bp, human
gccaggtgaggcccctgcgc

SEQ ID NO: 102499 - DNA, 20 bp, human
ggtgaggcccctgcgcgggc

SEQ ID NO: 102500 - DNA, 20 bp, human
gcttccgcccgcccgcgcag

SEQ ID NO: 102501 - DNA, 20 bp, human
gcctggcggcgcggactccc

SEQ ID NO: 102502 - DNA, 20 bp, human
ggtgcccccttggacatcta

SEQ ID NO: 102503 - DNA, 20 bp, human
gacctccccaggtcgtcgta

SEQ ID NO: 102504 - DNA, 20 bp, human
ggcctgaaaggtgccgggag

SEQ ID NO: 102505 - DNA, 20 bp, human
ggaacatatggtgagctctc

SEQ ID NO: 102506 - DNA, 20 bp, human
ggtgcagcgcgggagcacag

SEQ ID NO: 102507 - DNA, 20 bp, human
gggagaagccgcagtacccg

SEQ ID NO: 102508 - DNA, 20 bp, human
gacccgagccgcgggtactg

SEQ ID NO: 102509 - DNA, 20 bp, human
gcgcccagggtgcctcccaa

SEQ ID NO: 102510 - DNA, 20 bp, human
ggccgaggaagcacccggag

SEQ ID NO: 102511 - DNA, 20 bp, human
ggacgcggcgaccagcgcag

SEQ ID NO: 102512 - DNA, 20 bp, human
gccagggtgcctcccaacgg

SEQ ID NO: 102513 - DNA, 20 bp, human
gtctgagcccgaggaggact

SEQ ID NO: 102514 - DNA, 20 bp, human
gactcggccgaggaagcacc

SEQ ID NO: 102515 - DNA, 20 bp, human
gcacagtggagcgcagatcg

SEQ ID NO: 102516 - DNA, 20 bp, human
gggagtggctgctcgcggag

SEQ ID NO: 102517 - DNA, 20 bp, human
ggaggcgcggcgactgagga

SEQ ID NO: 102518 - DNA, 20 bp, human
gatcgctggacagcatacag

SEQ ID NO: 102519 - DNA, 20 bp, human
gtggcgggagtggctgctcg

SEQ ID NO: 102520 - DNA, 20 bp, human
gtgaacccagttggcgggag

SEQ ID NO: 102521 - DNA, 20 bp, human
ggccaactgggttcaaagtg

SEQ ID NO: 102522 - DNA, 20 bp, human
gtgggcatctgagatatgga

SEQ ID NO: 102523 - DNA, 20 bp, human
gtcactgggcatctgagata

SEQ ID NO: 102524 - DNA, 20 bp, human
gcttcgggaaagtgtatctg

SEQ ID NO: 102525 - DNA, 20 bp, human
ggcagccactcccgccaact

SEQ ID NO: 102526 - DNA, 20 bp, human
gaggcgaggactgctgagaa

SEQ ID NO: 102527 - DNA, 20 bp, human
gcacgtgctcacaggcagtt

SEQ ID NO: 102528 - DNA, 20 bp, human
ggagggagtggatggaacac

SEQ ID NO: 102529 - DNA, 20 bp, human
ggtcgctcaggagcaagctg

SEQ ID NO: 102530 - DNA, 20 bp, human
gcctgtgagcacgtgagaac

SEQ ID NO: 102531 - DNA, 20 bp, human
ggagcacgtgagaacaggcg

SEQ ID NO: 102532 - DNA, 20 bp, human
gtaagtgactccctcagtat

SEQ ID NO: 102533 - DNA, 20 bp, human
ggcaagctgtggcaagctgg

SEQ ID NO: 102534 - DNA, 20 bp, human
gctgtgggagagggacaccc

SEQ ID NO: 102535 - DNA, 20 bp, human
ggtgaccactctctaagtga

SEQ ID NO: 102536 - DNA, 20 bp, human
gcgcggagcgaacgaagcag

SEQ ID NO: 102537 - DNA, 20 bp, human
gtggccttacgaaggagcag

SEQ ID NO: 102538 - DNA, 20 bp, human
ggagcgaacgaagcagcggg

SEQ ID NO: 102539 - DNA, 20 bp, human
gggcgcgcgaccgaatgaaa

SEQ ID NO: 102540 - DNA, 20 bp, human
gtctactcgtagcaggcggg

SEQ ID NO: 102541 - DNA, 20 bp, human
gcggcctgaagcgaagcgtg

SEQ ID NO: 102542 - DNA, 20 bp, human
gcgaccgaatgaaaagggag

SEQ ID NO: 102543 - DNA, 20 bp, human
gttacgaaggagcagcggcg

SEQ ID NO: 102544 - DNA, 20 bp, human
gctgcgaaatgcgcaagctg

SEQ ID NO: 102545 - DNA, 20 bp, human
ggcgcgcctaggcatgcgga

SEQ ID NO: 102546 - DNA, 20 bp, human
ggtcgttctgggcctagggg

SEQ ID NO: 102547 - DNA, 20 bp, human
gtttgcaggcgtattccgcc

SEQ ID NO: 102548 - DNA, 20 bp, human
gtgaggcccgcgtcgatcct

SEQ ID NO: 102549 - DNA, 20 bp, human
gactgcggcaggaagcaagt

SEQ ID NO: 102550 - DNA, 20 bp, human
gctccaacccaggatcgacg

SEQ ID NO: 102551 - DNA, 20 bp, human
ggcccgcgtcgatcctgggt

SEQ ID NO: 102552 - DNA, 20 bp, human
gtctgctcctgaggacgaag

SEQ ID NO: 102553 - DNA, 20 bp, human
ggcggcaggaagcaagtagg

SEQ ID NO: 102554 - DNA, 20 bp, human
gcggccggaggctctgaccc

SEQ ID NO: 102555 - DNA, 20 bp, human
ggctgcggcgtgaagacggc

SEQ ID NO: 102556 - DNA, 20 bp, human
gatttcaggagagcagatac

SEQ ID NO: 102557 - DNA, 20 bp, human
gaggagagcagatacgggat

SEQ ID NO: 102558 - DNA, 20 bp, human
gcggagaaccaggttatgaa

SEQ ID NO: 102559 - DNA, 20 bp, human
ggcgtgcctgcgctctctgc

SEQ ID NO: 102560 - DNA, 20 bp, human
gccgggtcagtaactaaagt

SEQ ID NO: 102561 - DNA, 20 bp, human
ggcaggcacgccaaaacgtg

SEQ ID NO: 102562 - DNA, 20 bp, human
gatgactccagaattatttc

SEQ ID NO: 102563 - DNA, 20 bp, human
gttctgcctgcagagagcgc

SEQ ID NO: 102564 - DNA, 20 bp, human
gcttattcttccatgtcccg

SEQ ID NO: 102565 - DNA, 20 bp, human
ggttactgacccggagaacc

SEQ ID NO: 102566 - DNA, 20 bp, human
ggcacgcagggcgctacgca

SEQ ID NO: 102567 - DNA, 20 bp, human
ggcacaccccgaggcggtcc

SEQ ID NO: 102568 - DNA, 20 bp, human
gacccgcgcgtccacgtgga

SEQ ID NO: 102569 - DNA, 20 bp, human
ggctcgcggaggccctcctg

SEQ ID NO: 102570 - DNA, 20 bp, human
gcctgagcaggtgagcacgt

SEQ ID NO: 102571 - DNA, 20 bp, human
gccccgagggctctaggcgg

SEQ ID NO: 102572 - DNA, 20 bp, human
ggtgtgcagccggctcgcgg

SEQ ID NO: 102573 - DNA, 20 bp, human
gacgcgcacagccctccacg

SEQ ID NO: 102574 - DNA, 20 bp, human
gcccgggacgtgcgcaggaa

SEQ ID NO: 102575 - DNA, 20 bp, human
gaaaccccgagggctctagg

SEQ ID NO: 102576 - DNA, 20 bp, human
gctcatagttctggcagcac

SEQ ID NO: 102577 - DNA, 20 bp, human
ggatatggcagggagcacac

SEQ ID NO: 102578 - DNA, 20 bp, human
ggcacacgggatccaggatg

SEQ ID NO: 102579 - DNA, 20 bp, human
gcagagagctggctgacgtc

SEQ ID NO: 102580 - DNA, 20 bp, human
gcatgaggctagtgccagag

SEQ ID NO: 102581 - DNA, 20 bp, human
ggagaggaccctcatagttc

SEQ ID NO: 102582 - DNA, 20 bp, human
gccctcacctctggactggg

SEQ ID NO: 102583 - DNA, 20 bp, human
gggcacggttgtgggaccag

SEQ ID NO: 102584 - DNA, 20 bp, human
ggctgtcatcaaagagccat

SEQ ID NO: 102585 - DNA, 20 bp, human
ggcctcgccccccagtccag

SEQ ID NO: 102586 - DNA, 20 bp, human
gagctgttcgccatcggagt

SEQ ID NO: 102587 - DNA, 20 bp, human
gcgccaaattggggtctcta

SEQ ID NO: 102588 - DNA, 20 bp, human
gtcagccgcctcagtctgag

SEQ ID NO: 102589 - DNA, 20 bp, human
gcgggactgtccaggagagg

SEQ ID NO: 102590 - DNA, 20 bp, human
ggcagctctgagatgcccgg

SEQ ID NO: 102591 - DNA, 20 bp, human
gcgtggacaaggccacgctg

SEQ ID NO: 102592 - DNA, 20 bp, human
gcatctgcttcgcctccctc

SEQ ID NO: 102593 - DNA, 20 bp, human
gccttcccctcagactgagg

SEQ ID NO: 102594 - DNA, 20 bp, human
gtggggcatcacatccctcc

SEQ ID NO: 102595 - DNA, 20 bp, human
ggaccttagagaccccaatt

SEQ ID NO: 102596 - DNA, 20 bp, human
gtgggacttggagcaagcgg

SEQ ID NO: 102597 - DNA, 20 bp, human
ggaagggagcgctctgggat

SEQ ID NO: 102598 - DNA, 20 bp, human
gcgacccctccgaggacagg

SEQ ID NO: 102599 - DNA, 20 bp, human
gagcgctctgggatgggact

SEQ ID NO: 102600 - DNA, 20 bp, human
gtctccccctgtcctcggag

SEQ ID NO: 102601 - DNA, 20 bp, human
ggacttggagcaagcggcgg

SEQ ID NO: 102602 - DNA, 20 bp, human
gaggccgacgaggaagaccc

SEQ ID NO: 102603 - DNA, 20 bp, human
ggtgccacagcgcccccacg

SEQ ID NO: 102604 - DNA, 20 bp, human
gcccacggggcactccgggg

SEQ ID NO: 102605 - DNA, 20 bp, human
ggcccccacggggcactccg

SEQ ID NO: 102606 - DNA, 20 bp, human
gttttcaaggcgagcaagag

SEQ ID NO: 102607 - DNA, 20 bp, human
ggaggaggacgatctgtccg

SEQ ID NO: 102608 - DNA, 20 bp, human
ggtgggaggtccatctctag

SEQ ID NO: 102609 - DNA, 20 bp, human
gccaacaaggacccagggaa

SEQ ID NO: 102610 - DNA, 20 bp, human
gcccccaaaagtgggcaggt

SEQ ID NO: 102611 - DNA, 20 bp, human
ggttggacctatctgagcaa

SEQ ID NO: 102612 - DNA, 20 bp, human
gagaagggccgtctgcgggt

SEQ ID NO: 102613 - DNA, 20 bp, human
gggccagggagcggtcacgt

SEQ ID NO: 102614 - DNA, 20 bp, human
ggaaatcttgccctgaatat

SEQ ID NO: 102615 - DNA, 20 bp, human
gcacccagaagggccgtctg

SEQ ID NO: 102616 - DNA, 20 bp, human
gcagcaggaggagtcccggg

SEQ ID NO: 102617 - DNA, 20 bp, human
gtggacacatgagtgatatt

SEQ ID NO: 102618 - DNA, 20 bp, human
ggcggcatggtgggctccgt

SEQ ID NO: 102619 - DNA, 20 bp, human
ggggccgggcgcggcatggt

SEQ ID NO: 102620 - DNA, 20 bp, human
gtggagacccgaggtcccgg

SEQ ID NO: 102621 - DNA, 20 bp, human
gtcccggatgaatcctgtgg

SEQ ID NO: 102622 - DNA, 20 bp, human
gccctcccggatgaatcctg

SEQ ID NO: 102623 - DNA, 20 bp, human
ggcctggtggtgtccgtcgg

SEQ ID NO: 102624 - DNA, 20 bp, human
gtcgaacgaggagaagccca

SEQ ID NO: 102625 - DNA, 20 bp, human
ggcgcccgcggtgcaggtac

SEQ ID NO: 102626 - DNA, 20 bp, human
ggggcacttggaccaggtaa

SEQ ID NO: 102627 - DNA, 20 bp, human
gtggcagcgtgccctaggtg

SEQ ID NO: 102628 - DNA, 20 bp, human
gcacttggaccaggtaacgg

SEQ ID NO: 102629 - DNA, 20 bp, human
ggggcactgcaaatcagata

SEQ ID NO: 102630 - DNA, 20 bp, human
gtcagagatgccctgaggtg

SEQ ID NO: 102631 - DNA, 20 bp, human
gggcactgaggggtctgcag

SEQ ID NO: 102632 - DNA, 20 bp, human
gggaccaggtaacggcggcg

SEQ ID NO: 102633 - DNA, 20 bp, human
ggtaggcatcaagccaggtc

SEQ ID NO: 102634 - DNA, 20 bp, human
gcagctacagcgggagactg

SEQ ID NO: 102635 - DNA, 20 bp, human
gcctcccgggcacttggacc

SEQ ID NO: 102636 - DNA, 20 bp, human
ggtcccgctcgctgggagag

SEQ ID NO: 102637 - DNA, 20 bp, human
gtcacgcctaccttagggaa

SEQ ID NO: 102638 - DNA, 20 bp, human
gatgtgagccgcctgatcgg

SEQ ID NO: 102639 - DNA, 20 bp, human
gcgccatgttaggagcgcag

SEQ ID NO: 102640 - DNA, 20 bp, human
gcatgttaggagcgcagtgg

SEQ ID NO: 102641 - DNA, 20 bp, human
gccgcttcacgcctacctta

SEQ ID NO: 102642 - DNA, 20 bp, human
ggtgggccgggagtcttagg

SEQ ID NO: 102643 - DNA, 20 bp, human
gcggcgcaaccagccttcta

SEQ ID NO: 102644 - DNA, 20 bp, human
gggagggaggagctcgctcg

SEQ ID NO: 102645 - DNA, 20 bp, human
gagggacagactgtacactg

SEQ ID NO: 102646 - DNA, 20 bp, human
gtggcggcggcttgttgttg

SEQ ID NO: 102647 - DNA, 20 bp, human
ggaagcaggcgcgcgagacg

SEQ ID NO: 102648 - DNA, 20 bp, human
gagcgccaggtaccacgagt

SEQ ID NO: 102649 - DNA, 20 bp, human
ggttgtggaggccaaaatgg

SEQ ID NO: 102650 - DNA, 20 bp, human
gaaaatggcggctcaggcgg

SEQ ID NO: 102651 - DNA, 20 bp, human
gacaagccgccgccacaggg

SEQ ID NO: 102652 - DNA, 20 bp, human
ggccaaaatggcggctcagg

SEQ ID NO: 102653 - DNA, 20 bp, human
gtgcttccgcctccctgtgg

SEQ ID NO: 102654 - DNA, 20 bp, human
ggttgttgtggaggccaaaa

SEQ ID NO: 102655 - DNA, 20 bp, human
ggaggccaaaatggcggctc

SEQ ID NO: 102656 - DNA, 20 bp, human
gcgggaagcgatcttacctc

SEQ ID NO: 102657 - DNA, 20 bp, human
gtacccccggccctgagacc

SEQ ID NO: 102658 - DNA, 20 bp, human
gccagggtgacgctaaggtg

SEQ ID NO: 102659 - DNA, 20 bp, human
ggtccagacccagcggaggg

SEQ ID NO: 102660 - DNA, 20 bp, human
gctctaggcgcacccggtcg

SEQ ID NO: 102661 - DNA, 20 bp, human
gcgggcccagggtgacgcta

SEQ ID NO: 102662 - DNA, 20 bp, human
gatcttacctcgggtacccc

SEQ ID NO: 102663 - DNA, 20 bp, human
gccgaaaggacccaacgccc

SEQ ID NO: 102664 - DNA, 20 bp, human
ggcggcagcactcgacctct

SEQ ID NO: 102665 - DNA, 20 bp, human
gaactgtccagacccagcgg

SEQ ID NO: 102666 - DNA, 20 bp, human
gtgggtgaggaactaggatg

SEQ ID NO: 102667 - DNA, 20 bp, human
gttgcggcagatatacttat

SEQ ID NO: 102668 - DNA, 20 bp, human
gaggtcttgtcttcagcaaa

SEQ ID NO: 102669 - DNA, 20 bp, human
ggccagcccaggcttgggtg

SEQ ID NO: 102670 - DNA, 20 bp, human
gcaggcttgggtgaggaact

SEQ ID NO: 102671 - DNA, 20 bp, human
ggaaggagccagcccaggct

SEQ ID NO: 102672 - DNA, 20 bp, human
gggaagtgacagcccgacac

SEQ ID NO: 102673 - DNA, 20 bp, human
gcagtccatccacccttcat

SEQ ID NO: 102674 - DNA, 20 bp, human
gggtctcttgctgtgaggca

SEQ ID NO: 102675 - DNA, 20 bp, human
gcacctggtctcttgctgtg

SEQ ID NO: 102676 - DNA, 20 bp, human
gcagggagcggccactgcag

SEQ ID NO: 102677 - DNA, 20 bp, human
gccccgcctgacaacccgca

SEQ ID NO: 102678 - DNA, 20 bp, human
gatcctgagccggggaaggt

SEQ ID NO: 102679 - DNA, 20 bp, human
gcactgcagcaccggatcaa

SEQ ID NO: 102680 - DNA, 20 bp, human
gcagcaccctcccgcaaggg

SEQ ID NO: 102681 - DNA, 20 bp, human
ggagagcgacgtgagtcctg

SEQ ID NO: 102682 - DNA, 20 bp, human
gccgcagcaccctcccgcaa

SEQ ID NO: 102683 - DNA, 20 bp, human
gcccaacctccagtcccagg

SEQ ID NO: 102684 - DNA, 20 bp, human
gtgcagcaccggatcaacgg

SEQ ID NO: 102685 - DNA, 20 bp, human
gaggcactcctggccccgag

SEQ ID NO: 102686 - DNA, 20 bp, human
gcggagacaaggcgccgagt

SEQ ID NO: 102687 - DNA, 20 bp, human
gctgggcctggactcccggg

SEQ ID NO: 102688 - DNA, 20 bp, human
gagtccattccaggtgagta

SEQ ID NO: 102689 - DNA, 20 bp, human
gcccgcacccgcggcccact

SEQ ID NO: 102690 - DNA, 20 bp, human
gggttctgggcgtgaccctg

SEQ ID NO: 102691 - DNA, 20 bp, human
ggcggccgagcccctccagg

SEQ ID NO: 102692 - DNA, 20 bp, human
gggacgcccgcccgcacccg

SEQ ID NO: 102693 - DNA, 20 bp, human
gctcacctggaatggactct

SEQ ID NO: 102694 - DNA, 20 bp, human
gccggcggccgagcccctcc

SEQ ID NO: 102695 - DNA, 20 bp, human
gtggcgggaaggagttcatg

SEQ ID NO: 102696 - DNA, 20 bp, human
ggtcctggccccaacagctg

SEQ ID NO: 102697 - DNA, 20 bp, human
gaggatgctcagagtccacc

SEQ ID NO: 102698 - DNA, 20 bp, human
gatgggctcactgggtgtcc

SEQ ID NO: 102699 - DNA, 20 bp, human
gcttgatcttagggtgtggg

SEQ ID NO: 102700 - DNA, 20 bp, human
gtggctgtacaaaatctctc

SEQ ID NO: 102701 - DNA, 20 bp, human
ggtacagccacctctcttac

SEQ ID NO: 102702 - DNA, 20 bp, human
gtaaaaacgcccttgggacc

SEQ ID NO: 102703 - DNA, 20 bp, human
ggcacgtggggtaggtcagt

SEQ ID NO: 102704 - DNA, 20 bp, human
gtagacagtcagagttaaca

SEQ ID NO: 102705 - DNA, 20 bp, human
gggctgacatcccaggccat

SEQ ID NO: 102706 - DNA, 20 bp, human
ggcagcgcgcgcccctctgg

SEQ ID NO: 102707 - DNA, 20 bp, human
ggaaaccaagcactactggc

SEQ ID NO: 102708 - DNA, 20 bp, human
gttaggcagggcggcctcgg

SEQ ID NO: 102709 - DNA, 20 bp, human
gcgggagccggctctttcca

SEQ ID NO: 102710 - DNA, 20 bp, human
gttcaggaaaaggccgcaag

SEQ ID NO: 102711 - DNA, 20 bp, human
ggacgccaccagcgcccctg

SEQ ID NO: 102712 - DNA, 20 bp, human
gcgccaggaagtcgggatcc

SEQ ID NO: 102713 - DNA, 20 bp, human
ggggcagccggagactcggt

SEQ ID NO: 102714 - DNA, 20 bp, human
ggactcggtgggatccatcg

SEQ ID NO: 102715 - DNA, 20 bp, human
gtggcggcaagaaccagccc

SEQ ID NO: 102716 - DNA, 20 bp, human
ggcgccgagtagcagctccg

SEQ ID NO: 102717 - DNA, 20 bp, human
gccaacaaggcagcctccct

SEQ ID NO: 102718 - DNA, 20 bp, human
gaagtatagtaaggagggga

SEQ ID NO: 102719 - DNA, 20 bp, human
gcccggcgtaaagtatagta

SEQ ID NO: 102720 - DNA, 20 bp, human
gcaggcagctcggctttcgg

SEQ ID NO: 102721 - DNA, 20 bp, human
gcgtaaagtatagtaaggag

SEQ ID NO: 102722 - DNA, 20 bp, human
ggcggctcccaccgccaaca

SEQ ID NO: 102723 - DNA, 20 bp, human
gggcttgttgttacagccca

SEQ ID NO: 102724 - DNA, 20 bp, human
gtcgggaaggcaacccagaa

SEQ ID NO: 102725 - DNA, 20 bp, human
gtctctggcagcggcaacgg

SEQ ID NO: 102726 - DNA, 20 bp, human
gacgctaaagggagacatcg

SEQ ID NO: 102727 - DNA, 20 bp, human
ggagcaacgaacagccgcgg

SEQ ID NO: 102728 - DNA, 20 bp, human
gcgggagcaacgaacagccg

SEQ ID NO: 102729 - DNA, 20 bp, human
ggccagaggcggagcccgag

SEQ ID NO: 102730 - DNA, 20 bp, human
gctgatgacaggagaaatag

SEQ ID NO: 102731 - DNA, 20 bp, human
ggctcaggcggaggatggga

SEQ ID NO: 102732 - DNA, 20 bp, human
gactgacgaggagaaatggg

SEQ ID NO: 102733 - DNA, 20 bp, human
gctggacgtggagagcgctc

SEQ ID NO: 102734 - DNA, 20 bp, human
ggcgggagcctccctattaa

SEQ ID NO: 102735 - DNA, 20 bp, human
ggcggtagctgtcgcctccg

SEQ ID NO: 102736 - DNA, 20 bp, human
gcgggtctccgggattccaa

SEQ ID NO: 102737 - DNA, 20 bp, human
ggccgcggccgtcccccgag

SEQ ID NO: 102738 - DNA, 20 bp, human
gactccgccatagagcaggg

SEQ ID NO: 102739 - DNA, 20 bp, human
ggattccaagggctcggtta

SEQ ID NO: 102740 - DNA, 20 bp, human
gtggcccccctgctctatgg

SEQ ID NO: 102741 - DNA, 20 bp, human
ggtcccccgagtggcggcag

SEQ ID NO: 102742 - DNA, 20 bp, human
gacttcaggtacctccctgg

SEQ ID NO: 102743 - DNA, 20 bp, human
gtggcggcggcgccccccgg

SEQ ID NO: 102744 - DNA, 20 bp, human
gagaagcgcagcgccggctg

SEQ ID NO: 102745 - DNA, 20 bp, human
gaggccgctgccgccactcg

SEQ ID NO: 102746 - DNA, 20 bp, human
gccgacagccccgaccttct

SEQ ID NO: 102747 - DNA, 20 bp, human
gcggccgcgcagggcctcaa

SEQ ID NO: 102748 - DNA, 20 bp, human
ggaacagccgcggcaagtgg

SEQ ID NO: 102749 - DNA, 20 bp, human
gccggcagccagtccctgaa

SEQ ID NO: 102750 - DNA, 20 bp, human
ggcggccagatgctaccggg

SEQ ID NO: 102751 - DNA, 20 bp, human
ggcccagcgcgcacgaacaa

SEQ ID NO: 102752 - DNA, 20 bp, human
gagccatgcggcccaacaag

SEQ ID NO: 102753 - DNA, 20 bp, human
gcggccggccgaaagccatg

SEQ ID NO: 102754 - DNA, 20 bp, human
gggagccgggcgcaatggag

SEQ ID NO: 102755 - DNA, 20 bp, human
gggctgccggacggcgactg

SEQ ID NO: 102756 - DNA, 20 bp, human
ggatggccaagagttcacag

SEQ ID NO: 102757 - DNA, 20 bp, human
gtgctggaggatcttgccag

SEQ ID NO: 102758 - DNA, 20 bp, human
ggtcagataccatcaatggg

SEQ ID NO: 102759 - DNA, 20 bp, human
gtgacctcattgccaggatg

SEQ ID NO: 102760 - DNA, 20 bp, human
gagcctgccttctcaggaca

SEQ ID NO: 102761 - DNA, 20 bp, human
gcgcatctgaagagcaggca

SEQ ID NO: 102762 - DNA, 20 bp, human
gtacacaggtggatctctgc

SEQ ID NO: 102763 - DNA, 20 bp, human
ggaggatcttgccagtggtc

SEQ ID NO: 102764 - DNA, 20 bp, human
gagatccacctgtgtaacta

SEQ ID NO: 102765 - DNA, 20 bp, human
gttgtccctagttacacagg

SEQ ID NO: 102766 - DNA, 20 bp, human
gtcgccctccaggcctggta

SEQ ID NO: 102767 - DNA, 20 bp, human
gctggagggcgaggctgatt

SEQ ID NO: 102768 - DNA, 20 bp, human
ggagcagagaccagttacag

SEQ ID NO: 102769 - DNA, 20 bp, human
ggcttaggcgacaggcgcgg

SEQ ID NO: 102770 - DNA, 20 bp, human
gtgggcggagatcagttccg

SEQ ID NO: 102771 - DNA, 20 bp, human
gactagaacacctctgccca

SEQ ID NO: 102772 - DNA, 20 bp, human
gggcgcttaggcgacaggcg

SEQ ID NO: 102773 - DNA, 20 bp, human
gtgagccgcacgaggcctgg

SEQ ID NO: 102774 - DNA, 20 bp, human
gagccccgccccggaaatgg

SEQ ID NO: 102775 - DNA, 20 bp, human
ggcagagtcgagcgtgttgg

SEQ ID NO: 102776 - DNA, 20 bp, human
ggctgtctgtgcctcaggag

SEQ ID NO: 102777 - DNA, 20 bp, human
gggaggaactctacagctat

SEQ ID NO: 102778 - DNA, 20 bp, human
gcctgctgaccccactcctg

SEQ ID NO: 102779 - DNA, 20 bp, human
gacaggcaggcttggaaaag

SEQ ID NO: 102780 - DNA, 20 bp, human
gcatactcaccagaacaggc

SEQ ID NO: 102781 - DNA, 20 bp, human
gcaacaaatattaacaccta

SEQ ID NO: 102782 - DNA, 20 bp, human
gctgaggcacagacagccct

SEQ ID NO: 102783 - DNA, 20 bp, human
gcatcactaagaaggaaaag

SEQ ID NO: 102784 - DNA, 20 bp, human
gtcaccagaacaggcaggct

SEQ ID NO: 102785 - DNA, 20 bp, human
gtcgtggaaacttataccct

SEQ ID NO: 102786 - DNA, 20 bp, human
gtggaaagttatacctcagg

SEQ ID NO: 102787 - DNA, 20 bp, human
gcgtactcaccagaacaggt

SEQ ID NO: 102788 - DNA, 20 bp, human
ggtcagcaagagaaactcta

SEQ ID NO: 102789 - DNA, 20 bp, human
gacaggtgggctcggaaaag

SEQ ID NO: 102790 - DNA, 20 bp, human
gtgtctgcatctcaagagtg

SEQ ID NO: 102791 - DNA, 20 bp, human
gagagaaactctacggctat

SEQ ID NO: 102792 - DNA, 20 bp, human
gtcaccagaacaggtgggct

SEQ ID NO: 102793 - DNA, 20 bp, human
gcaacagatattaccacctg

SEQ ID NO: 102794 - DNA, 20 bp, human
gatccaacatcactaggaaa

SEQ ID NO: 102795 - DNA, 20 bp, human
gttcaggagctttccagaga

SEQ ID NO: 102796 - DNA, 20 bp, human
gttgtggaaagtgatacctc

SEQ ID NO: 102797 - DNA, 20 bp, human
gtggaaagtgatacctcagg

SEQ ID NO: 102798 - DNA, 20 bp, human
gcgtactcaccagaacaggt

SEQ ID NO: 102799 - DNA, 20 bp, human
ggtcagcaagagaaactcta

SEQ ID NO: 102800 - DNA, 20 bp, human
gacaggtgggctcggaaaag

SEQ ID NO: 102801 - DNA, 20 bp, human
gtgtctgcatctcaagagtg

SEQ ID NO: 102802 - DNA, 20 bp, human
gagagaaactctacggctat

SEQ ID NO: 102803 - DNA, 20 bp, human
gcaacagatattaccacctg

SEQ ID NO: 102804 - DNA, 20 bp, human
gtcaccagaacaggtgggct

SEQ ID NO: 102805 - DNA, 20 bp, human
gatccaacatcactaggaaa

SEQ ID NO: 102806 - DNA, 20 bp, human
gttgtggaacgttatacctc

SEQ ID NO: 102807 - DNA, 20 bp, human
gcgtactcaccagaacaggt

SEQ ID NO: 102808 - DNA, 20 bp, human
ggtcagcaagagaaactcta

SEQ ID NO: 102809 - DNA, 20 bp, human
gacaggtgggctcggaaaag

SEQ ID NO: 102810 - DNA, 20 bp, human
gagagaaactctacggctat

SEQ ID NO: 102811 - DNA, 20 bp, human
gtgtctgcatctcaagagtg

SEQ ID NO: 102812 - DNA, 20 bp, human
gtcaccagaacaggtgggct

SEQ ID NO: 102813 - DNA, 20 bp, human
gatccaacatcactaggaaa

SEQ ID NO: 102814 - DNA, 20 bp, human
gcaacagatattaacacctg

SEQ ID NO: 102815 - DNA, 20 bp, human
gttcaggagctttccagaga

SEQ ID NO: 102816 - DNA, 20 bp, human
gccggtgccgtgagctgaag

SEQ ID NO: 102817 - DNA, 20 bp, human
ggccgcaacgcccagggtgt

SEQ ID NO: 102818 - DNA, 20 bp, human
gggaagtcgagcgcacccca

SEQ ID NO: 102819 - DNA, 20 bp, human
gtcgcacaggaagagcacct

SEQ ID NO: 102820 - DNA, 20 bp, human
gcccagcgccgcaacgccca

SEQ ID NO: 102821 - DNA, 20 bp, human
ggtgaaacctcttcagctca

SEQ ID NO: 102822 - DNA, 20 bp, human
gaagatgactagggagactg

SEQ ID NO: 102823 - DNA, 20 bp, human
gtaggatcctccaaccccaa

SEQ ID NO: 102824 - DNA, 20 bp, human
gaccccagggctgatcgcac

SEQ ID NO: 102825 - DNA, 20 bp, human
gcggcaccgggctgcaaccg

SEQ ID NO: 102826 - DNA, 20 bp, human
gttcgggtagaagagacggg

SEQ ID NO: 102827 - DNA, 20 bp, human
ggggttcgggtagaagagac

SEQ ID NO: 102828 - DNA, 20 bp, human
gagccctgagccctgagagg

SEQ ID NO: 102829 - DNA, 20 bp, human
gcctctcacggccaaagagg

SEQ ID NO: 102830 - DNA, 20 bp, human
ggagacatctcactacaccc

SEQ ID NO: 102831 - DNA, 20 bp, human
gtggagggagggaggcgagt

SEQ ID NO: 102832 - DNA, 20 bp, human
gcatgtccctctctgacggg

SEQ ID NO: 102833 - DNA, 20 bp, human
gagtgagatgtctccagcca

SEQ ID NO: 102834 - DNA, 20 bp, human
gctcacggccaaagaggagg

SEQ ID NO: 102835 - DNA, 20 bp, human
ggggtaggagtcgtggatgg

SEQ ID NO: 102836 - DNA, 20 bp, human
gccctcagcttgaggaggag

SEQ ID NO: 102837 - DNA, 20 bp, human
gggagcccgagcctccggta

SEQ ID NO: 102838 - DNA, 20 bp, human
ggggtgggcgaagcactgag

SEQ ID NO: 102839 - DNA, 20 bp, human
ggaggccgctcggtgatccg

SEQ ID NO: 102840 - DNA, 20 bp, human
ggccgccgcggatcaccgag

SEQ ID NO: 102841 - DNA, 20 bp, human
gaagctgagggaagcagtct

SEQ ID NO: 102842 - DNA, 20 bp, human
gcgcggcccagagggtgagt

SEQ ID NO: 102843 - DNA, 20 bp, human
gaggggaaggcgcacgaagt

SEQ ID NO: 102844 - DNA, 20 bp, human
ggccgctcggtgatccgcgg

SEQ ID NO: 102845 - DNA, 20 bp, human
gggaccggccggggccgtac

SEQ ID NO: 102846 - DNA, 20 bp, human
gtgtgagcaaatcttggtgg

SEQ ID NO: 102847 - DNA, 20 bp, human
gagcttaatcgcccgagcag

SEQ ID NO: 102848 - DNA, 20 bp, human
gctcgggcgattaagctccg

SEQ ID NO: 102849 - DNA, 20 bp, human
gcggggttgtgagcaaatct

SEQ ID NO: 102850 - DNA, 20 bp, human
gagctgtcctccccaagagt

SEQ ID NO: 102851 - DNA, 20 bp, human
gccccaagagtgggtgaggt

SEQ ID NO: 102852 - DNA, 20 bp, human
gactaaagctggaagggagg

SEQ ID NO: 102853 - DNA, 20 bp, human
ggcagccatgatatcttctc

SEQ ID NO: 102854 - DNA, 20 bp, human
gggttgtgagcaaatcttgg

SEQ ID NO: 102855 - DNA, 20 bp, human
ggtcggagtgaggaggacgg

SEQ ID NO: 102856 - DNA, 20 bp, human
gctccttctcctgagtatgg

SEQ ID NO: 102857 - DNA, 20 bp, human
ggctacaggcaatcactgca

SEQ ID NO: 102858 - DNA, 20 bp, human
gacaggtcaggccatcccgt

SEQ ID NO: 102859 - DNA, 20 bp, human
gagacgctgccaccatactc

SEQ ID NO: 102860 - DNA, 20 bp, human
gcctctccttctcctgagta

SEQ ID NO: 102861 - DNA, 20 bp, human
ggtagctctccaggcatcaa

SEQ ID NO: 102862 - DNA, 20 bp, human
gacctgtgggccactttcct

SEQ ID NO: 102863 - DNA, 20 bp, human
gtcagtctcctcatatcccc

SEQ ID NO: 102864 - DNA, 20 bp, human
gatgggcgtgatggcaccaa

SEQ ID NO: 102865 - DNA, 20 bp, human
gagggacatggtcctcacct

SEQ ID NO: 102866 - DNA, 20 bp, human
ggggtacacgggaaccgcag

SEQ ID NO: 102867 - DNA, 20 bp, human
gccgccatatctgggtacac

SEQ ID NO: 102868 - DNA, 20 bp, human
gcgcttcggccgccatatct

SEQ ID NO: 102869 - DNA, 20 bp, human
ggaggggatgccccgcacag

SEQ ID NO: 102870 - DNA, 20 bp, human
gggatcgcggagggacagga

SEQ ID NO: 102871 - DNA, 20 bp, human
gcccggcgacccctactctg

SEQ ID NO: 102872 - DNA, 20 bp, human
ggttcccgtgtacccagata

SEQ ID NO: 102873 - DNA, 20 bp, human
gggtcgccgggcaccagcag

SEQ ID NO: 102874 - DNA, 20 bp, human
gccaagtgtgaagggagtct

SEQ ID NO: 102875 - DNA, 20 bp, human
ggcgcagaaatcgaaaacgc

SEQ ID NO: 102876 - DNA, 20 bp, human
gagaggcccgcagtgagggt

SEQ ID NO: 102877 - DNA, 20 bp, human
gccctgcagagccagtgggt

SEQ ID NO: 102878 - DNA, 20 bp, human
gagccaggcggggtgagtgt

SEQ ID NO: 102879 - DNA, 20 bp, human
ggctagaaccgcccacccac

SEQ ID NO: 102880 - DNA, 20 bp, human
ggtccacacacagggcactg

SEQ ID NO: 102881 - DNA, 20 bp, human
gcgcgccctgcagagccagt

SEQ ID NO: 102882 - DNA, 20 bp, human
gcagcagaggcccgcagtga

SEQ ID NO: 102883 - DNA, 20 bp, human
gcccgggcgtgtgacagcag

SEQ ID NO: 102884 - DNA, 20 bp, human
gcagctggcgcagaaagtgt

SEQ ID NO: 102885 - DNA, 20 bp, human
gccgcgcaccagccagatgt

SEQ ID NO: 102886 - DNA, 20 bp, human
gccttgcaccgggctttgca

SEQ ID NO: 102887 - DNA, 20 bp, human
gcgccggccgcggttctccc

SEQ ID NO: 102888 - DNA, 20 bp, human
gggacccagggagaaacagg

SEQ ID NO: 102889 - DNA, 20 bp, human
gggcagcccagcgggaccca

SEQ ID NO: 102890 - DNA, 20 bp, human
gtgaaggaggaagtgcgagg

SEQ ID NO: 102891 - DNA, 20 bp, human
gcggagtccgaacaatgaag

SEQ ID NO: 102892 - DNA, 20 bp, human
ggcacggcttggcagcccag

SEQ ID NO: 102893 - DNA, 20 bp, human
gccacaatgctcccatgaca

SEQ ID NO: 102894 - DNA, 20 bp, human
ggccagacctcggcgataag

SEQ ID NO: 102895 - DNA, 20 bp, human
gcccctgcccgggagaaccg

SEQ ID NO: 102896 - DNA, 20 bp, human
gggacaggcagagctaaaca

SEQ ID NO: 102897 - DNA, 20 bp, human
gttgcctcaccccaaacagg

SEQ ID NO: 102898 - DNA, 20 bp, human
ggaaagccgtctgccgtatc

SEQ ID NO: 102899 - DNA, 20 bp, human
gtactgtaaatgggaaggac

SEQ ID NO: 102900 - DNA, 20 bp, human
gaggtaaaattttccagata

SEQ ID NO: 102901 - DNA, 20 bp, human
gtttcagagtacaataaaca

SEQ ID NO: 102902 - DNA, 20 bp, human
gaggcagagctaaacaaggt

SEQ ID NO: 102903 - DNA, 20 bp, human
gctcccgtaagcagcacaca

SEQ ID NO: 102904 - DNA, 20 bp, human
ggtgctgcttacgggagcca

SEQ ID NO: 102905 - DNA, 20 bp, human
ggttctgccagatgttcctg

SEQ ID NO: 102906 - DNA, 20 bp, human
gtgtcctaaagagggtacat

SEQ ID NO: 102907 - DNA, 20 bp, human
gtattactgtggactattaa

SEQ ID NO: 102908 - DNA, 20 bp, human
gcacttggtatcacgaatca

SEQ ID NO: 102909 - DNA, 20 bp, human
ggtggaatgagctttagact

SEQ ID NO: 102910 - DNA, 20 bp, human
gcatgtggaaaatggtcgtg

SEQ ID NO: 102911 - DNA, 20 bp, human
gctttaggacaatattactg

SEQ ID NO: 102912 - DNA, 20 bp, human
ggtggaaaatggtcgtgtgg

SEQ ID NO: 102913 - DNA, 20 bp, human
gaatccaatgtaccctcttt

SEQ ID NO: 102914 - DNA, 20 bp, human
gaattttgctttcaatatga

SEQ ID NO: 102915 - DNA, 20 bp, human
gacctttagagaatcaaaac

SEQ ID NO: 102916 - DNA, 20 bp, human
gctcgaggcgcaaactctcg

SEQ ID NO: 102917 - DNA, 20 bp, human
ggaaccggcgcaaactctcg

SEQ ID NO: 102918 - DNA, 20 bp, human
gcttgggcccggccctccta

SEQ ID NO: 102919 - DNA, 20 bp, human
gcaatgggcgcggagaggaa

SEQ ID NO: 102920 - DNA, 20 bp, human
ggaggccggggaatgcgaac

SEQ ID NO: 102921 - DNA, 20 bp, human
gcgaggcgcaaacttggctt

SEQ ID NO: 102922 - DNA, 20 bp, human
gagccacgggcgccgtagga

SEQ ID NO: 102923 - DNA, 20 bp, human
gaactctcgaggcgcaaact

SEQ ID NO: 102924 - DNA, 20 bp, human
ggtaggtggagcccgtggtg

SEQ ID NO: 102925 - DNA, 20 bp, human
ggtgttgcgggctgggacag

SEQ ID NO: 102926 - DNA, 20 bp, human
ggctgtgccgggcgacgacg

SEQ ID NO: 102927 - DNA, 20 bp, human
gccggggagggtggtcgtat

SEQ ID NO: 102928 - DNA, 20 bp, human
ggccgggcgacgacgaggat

SEQ ID NO: 102929 - DNA, 20 bp, human
gtggccaccaccagcaccac

SEQ ID NO: 102930 - DNA, 20 bp, human
gtacccgccgctccctggaa

SEQ ID NO: 102931 - DNA, 20 bp, human
gtgctccgggacccgaccac

SEQ ID NO: 102932 - DNA, 20 bp, human
gcacagcgcgagcgggcgag

SEQ ID NO: 102933 - DNA, 20 bp, human
gcgctcggcccggggatggc

SEQ ID NO: 102934 - DNA, 20 bp, human
gccatcgaccaggtaccccg

SEQ ID NO: 102935 - DNA, 20 bp, human
gccgcgcagagctccgaccg

SEQ ID NO: 102936 - DNA, 20 bp, human
gtggaggaaggcatcagtta

SEQ ID NO: 102937 - DNA, 20 bp, human
gccccctggtaaaacgatat

SEQ ID NO: 102938 - DNA, 20 bp, human
ggttctggttcctaatggag

SEQ ID NO: 102939 - DNA, 20 bp, human
gctggtaaaacgatatagga

SEQ ID NO: 102940 - DNA, 20 bp, human
gcagccaaagccactccatt

SEQ ID NO: 102941 - DNA, 20 bp, human
gtggttgagattactcttgg

SEQ ID NO: 102942 - DNA, 20 bp, human
gtcgtgccaggtaggctgga

SEQ ID NO: 102943 - DNA, 20 bp, human
gatactatagtgactgggtg

SEQ ID NO: 102944 - DNA, 20 bp, human
gaaagggaaatgcagccccc

SEQ ID NO: 102945 - DNA, 20 bp, human
gaatagccatccagcctacc

SEQ ID NO: 102946 - DNA, 20 bp, human
ggagctccgagtacgtgaag

SEQ ID NO: 102947 - DNA, 20 bp, human
ggcgaggcgaggttacacgg

SEQ ID NO: 102948 - DNA, 20 bp, human
gcttcgggctcggaacaagg

SEQ ID NO: 102949 - DNA, 20 bp, human
gtcgagtccaggtccacact

SEQ ID NO: 102950 - DNA, 20 bp, human
gcccggcgagcagctcaggt

SEQ ID NO: 102951 - DNA, 20 bp, human
gggaggcgcgttggaactcg

SEQ ID NO: 102952 - DNA, 20 bp, human
gcgagagcgcgagtcggcaa

SEQ ID NO: 102953 - DNA, 20 bp, human
ggcgcaccccagcgcatccc

SEQ ID NO: 102954 - DNA, 20 bp, human
gagaagccgagagcgcgagt

SEQ ID NO: 102955 - DNA, 20 bp, human
gcgggttctcagtaggagag

SEQ ID NO: 102956 - DNA, 20 bp, human
gcccttgtgaggaaaagagg

SEQ ID NO: 102957 - DNA, 20 bp, human
gacagaagagaccctcccag

SEQ ID NO: 102958 - DNA, 20 bp, human
gtggatccgtgcctctggga

SEQ ID NO: 102959 - DNA, 20 bp, human
gggagctcgtcggactcaga

SEQ ID NO: 102960 - DNA, 20 bp, human
gggtgagctctgaggagtag

SEQ ID NO: 102961 - DNA, 20 bp, human
gcactcaggcccacactctt

SEQ ID NO: 102962 - DNA, 20 bp, human
gtctggcaaggtgagctctg

SEQ ID NO: 102963 - DNA, 20 bp, human
gcatatgagcccaagagtgt

SEQ ID NO: 102964 - DNA, 20 bp, human
gtggatggtctggagctcgt

SEQ ID NO: 102965 - DNA, 20 bp, human
gtacttggatccgtgcctct

SEQ ID NO: 102966 - DNA, 20 bp, human
gggggccacccgagttaaag

SEQ ID NO: 102967 - DNA, 20 bp, human
gccggctgggcccagaccgg

SEQ ID NO: 102968 - DNA, 20 bp, human
gtagggaagtgggccaatcg

SEQ ID NO: 102969 - DNA, 20 bp, human
gtaatgttgttgatatcctg

SEQ ID NO: 102970 - DNA, 20 bp, human
gaacgagtccaaggctgacg

SEQ ID NO: 102971 - DNA, 20 bp, human
ggagaaccccaacgagtcca

SEQ ID NO: 102972 - DNA, 20 bp, human
gttaaaggggggaaatccgg

SEQ ID NO: 102973 - DNA, 20 bp, human
gcccccggctgggcccagac

SEQ ID NO: 102974 - DNA, 20 bp, human
ggatttcccccctttaactc

SEQ ID NO: 102975 - DNA, 20 bp, human
gcagccgttaaacgattcag

SEQ ID NO: 102976 - DNA, 20 bp, human
gctccgcggcgaacacgcct

SEQ ID NO: 102977 - DNA, 20 bp, human
ggccggcgggcccgggataa

SEQ ID NO: 102978 - DNA, 20 bp, human
gcgcctgggcactccattcg

SEQ ID NO: 102979 - DNA, 20 bp, human
ggcccagtctcgcgagagtt

SEQ ID NO: 102980 - DNA, 20 bp, human
gctgcgccgccgggagctca

SEQ ID NO: 102981 - DNA, 20 bp, human
gatatgcacagaccgagata

SEQ ID NO: 102982 - DNA, 20 bp, human
gtgcccaggcgtgttcgccg

SEQ ID NO: 102983 - DNA, 20 bp, human
ggcggaggcgccgttatccc

SEQ ID NO: 102984 - DNA, 20 bp, human
gaattctaggtgcgcttccg

SEQ ID NO: 102985 - DNA, 20 bp, human
gctcgcgagactgggcgacc

SEQ ID NO: 102986 - DNA, 20 bp, human
gggcgcgcgcggtcagctgt

SEQ ID NO: 102987 - DNA, 20 bp, human
gtggggctgtaaggcgcgcg

SEQ ID NO: 102988 - DNA, 20 bp, human
gagcggatgctggggctgta

SEQ ID NO: 102989 - DNA, 20 bp, human
gcctcccgggcaggacccga

SEQ ID NO: 102990 - DNA, 20 bp, human
gaccgcaaggaaggagccgg

SEQ ID NO: 102991 - DNA, 20 bp, human
ggccagtggtgggatcggga

SEQ ID NO: 102992 - DNA, 20 bp, human
ggccctcccgatcccaccac

SEQ ID NO: 102993 - DNA, 20 bp, human
ggcaggacccgaaggctgaa

SEQ ID NO: 102994 - DNA, 20 bp, human
gggttcctgagcggatgctg

SEQ ID NO: 102995 - DNA, 20 bp, human
ggaggagggaaggcgagccc

SEQ ID NO: 102996 - DNA, 20 bp, human
gtcttcctgggttcactcca

SEQ ID NO: 102997 - DNA, 20 bp, human
gccactgcaggcatcttcct

SEQ ID NO: 102998 - DNA, 20 bp, human
gggaagtgctgggaacgccc

SEQ ID NO: 102999 - DNA, 20 bp, human
ggcaccaacagccacatcaa

SEQ ID NO: 103000 - DNA, 20 bp, human
gctgcgtctgtgctgaaggg

SEQ ID NO: 103001 - DNA, 20 bp, human
gggcgaggctgggcccttgg

SEQ ID NO: 103002 - DNA, 20 bp, human
ggtccctgaagacctcacta

SEQ ID NO: 103003 - DNA, 20 bp, human
ggtagagcctgaggccactc

SEQ ID NO: 103004 - DNA, 20 bp, human
gggatgagcgacgagatgac

SEQ ID NO: 103005 - DNA, 20 bp, human
gccgctgcggaaggcaccac

SEQ ID NO: 103006 - DNA, 20 bp, human
gtctaggtgtaagagtgcgg

SEQ ID NO: 103007 - DNA, 20 bp, human
gtttagcgccacaaagacgt

SEQ ID NO: 103008 - DNA, 20 bp, human
gcggcagcttcctgaacctc

SEQ ID NO: 103009 - DNA, 20 bp, human
ggacaagctgatcaggtgaa

SEQ ID NO: 103010 - DNA, 20 bp, human
gaaaagcacttagcaagctg

SEQ ID NO: 103011 - DNA, 20 bp, human
gccacaaagacgtgggcatg

SEQ ID NO: 103012 - DNA, 20 bp, human
gacacctagacaagctgatc

SEQ ID NO: 103013 - DNA, 20 bp, human
ggggctttcatccttcctaa

SEQ ID NO: 103014 - DNA, 20 bp, human
gcttcctgaacctcaggcat

SEQ ID NO: 103015 - DNA, 20 bp, human
gttcctagctgctctattca

SEQ ID NO: 103016 - DNA, 20 bp, human
ggaagggctgatccgagctg

SEQ ID NO: 103017 - DNA, 20 bp, human
ggggctccagcagggtccgt

SEQ ID NO: 103018 - DNA, 20 bp, human
ggcgatcatgatggtctcca

SEQ ID NO: 103019 - DNA, 20 bp, human
gtccaaaagacgtatctgga

SEQ ID NO: 103020 - DNA, 20 bp, human
ggaaggtcaggtagtcgctg

SEQ ID NO: 103021 - DNA, 20 bp, human
gccagagacaggaaaacctc

SEQ ID NO: 103022 - DNA, 20 bp, human
gagcatccaaaagacgtatc

SEQ ID NO: 103023 - DNA, 20 bp, human
gtggataaactggtcctcga

SEQ ID NO: 103024 - DNA, 20 bp, human
gaggtagtcgctgtggacga

SEQ ID NO: 103025 - DNA, 20 bp, human
gaaactggtcctcgaaggtc

SEQ ID NO: 103026 - DNA, 20 bp, human
ggaagtgtgcatcccacggt

SEQ ID NO: 103027 - DNA, 20 bp, human
gggaaacagaagcttccgag

SEQ ID NO: 103028 - DNA, 20 bp, human
gcagagaagtgtgcatccca

SEQ ID NO: 103029 - DNA, 20 bp, human
gtgggtggagttcaccatgc

SEQ ID NO: 103030 - DNA, 20 bp, human
gggtgaactccacccaccgt

SEQ ID NO: 103031 - DNA, 20 bp, human
ggcacagattcgtctcccaa

SEQ ID NO: 103032 - DNA, 20 bp, human
ggacgactccctgacccagg

SEQ ID NO: 103033 - DNA, 20 bp, human
gaacactcaaagcaacgctc

SEQ ID NO: 103034 - DNA, 20 bp, human
ggtaactgctgcggttccag

SEQ ID NO: 103035 - DNA, 20 bp, human
gggaggttaaatcaattcag

SEQ ID NO: 103036 - DNA, 20 bp, human
gcacagtgcatcagaggact

SEQ ID NO: 103037 - DNA, 20 bp, human
ggaatgacacagtgcatcag

SEQ ID NO: 103038 - DNA, 20 bp, human
gcctgaaaggttgccctctg

SEQ ID NO: 103039 - DNA, 20 bp, human
gttcgtgtgcagcctggcag

SEQ ID NO: 103040 - DNA, 20 bp, human
ggagaacatcttggtcatag

SEQ ID NO: 103041 - DNA, 20 bp, human
gccaacacagcctaagaaag

SEQ ID NO: 103042 - DNA, 20 bp, human
gcagcatgtccgccactgcc

SEQ ID NO: 103043 - DNA, 20 bp, human
gctgggtgtcatcagcctct

SEQ ID NO: 103044 - DNA, 20 bp, human
gctcaacctgaatgccacag

SEQ ID NO: 103045 - DNA, 20 bp, human
gtttgacattgggtcctgaa

SEQ ID NO: 103046 - DNA, 20 bp, human
gcagcaggcggcgagcaaga

SEQ ID NO: 103047 - DNA, 20 bp, human
gcctccggccgggaagcatg

SEQ ID NO: 103048 - DNA, 20 bp, human
ggagccaagtgagcagctcg

SEQ ID NO: 103049 - DNA, 20 bp, human
gtggctctcgccctccggcc

SEQ ID NO: 103050 - DNA, 20 bp, human
ggcccgcctgttgctggaaa

SEQ ID NO: 103051 - DNA, 20 bp, human
gtccctgaggtgctcactct

SEQ ID NO: 103052 - DNA, 20 bp, human
gggggcccgcaattgaagcc

SEQ ID NO: 103053 - DNA, 20 bp, human
gtcacttggctctcgccctc

SEQ ID NO: 103054 - DNA, 20 bp, human
gcaccccccagcaccccgaa

SEQ ID NO: 103055 - DNA, 20 bp, human
gtgcttctgggaacgagaag

SEQ ID NO: 103056 - DNA, 20 bp, human
gcgggtcgcacgggtagcgt

SEQ ID NO: 103057 - DNA, 20 bp, human
ggaagctcgaggcgccgcgg

SEQ ID NO: 103058 - DNA, 20 bp, human
gcgacccggacgctcatggt

SEQ ID NO: 103059 - DNA, 20 bp, human
gatgagcgtccgggtcgcac

SEQ ID NO: 103060 - DNA, 20 bp, human
gggaggcaccgggaagctcg

SEQ ID NO: 103061 - DNA, 20 bp, human
ggggcctcgggcctcaccga

SEQ ID NO: 103062 - DNA, 20 bp, human
ggaggccccgtgacaggagg

SEQ ID NO: 103063 - DNA, 20 bp, human
gtgggcgccagctaccgccg

SEQ ID NO: 103064 - DNA, 20 bp, human
gtcacctgcagccctcggtg

SEQ ID NO: 103065 - DNA, 20 bp, human
ggcacgggtagcgtgggtca

SEQ ID NO: 103066 - DNA, 20 bp, human
ggtgaagtgcagctccgctc

SEQ ID NO: 103067 - DNA, 20 bp, human
gcgattcgaaggggaaactt

SEQ ID NO: 103068 - DNA, 20 bp, human
gggctgtctagactaaaatg

SEQ ID NO: 103069 - DNA, 20 bp, human
ggtccgtgaaacgcgagcca

SEQ ID NO: 103070 - DNA, 20 bp, human
gaagcgcaaacggaggatgc

SEQ ID NO: 103071 - DNA, 20 bp, human
gagctcgccggtgccctcta

SEQ ID NO: 103072 - DNA, 20 bp, human
gagttgcgaagcgcaaacgg

SEQ ID NO: 103073 - DNA, 20 bp, human
gcccccattaccaggatgga

SEQ ID NO: 103074 - DNA, 20 bp, human
gtccggggcagtgccaccct

SEQ ID NO: 103075 - DNA, 20 bp, human
gcacgagccgacaccctaga

SEQ ID NO: 103076 - DNA, 20 bp, human
gccgtgactccccagtacag

SEQ ID NO: 103077 - DNA, 20 bp, human
ggggtcacgaggcttcgtag

SEQ ID NO: 103078 - DNA, 20 bp, human
gtcacgaggcttcgtagtgg

SEQ ID NO: 103079 - DNA, 20 bp, human
gggcttcgtagtggaggaac

SEQ ID NO: 103080 - DNA, 20 bp, human
gcgcagctgcctctgtactg

SEQ ID NO: 103081 - DNA, 20 bp, human
ggtactggggagtcacggag

SEQ ID NO: 103082 - DNA, 20 bp, human
ggcgctgaagcgtggatgtg

SEQ ID NO: 103083 - DNA, 20 bp, human
ggtgcggcggaacccagggt

SEQ ID NO: 103084 - DNA, 20 bp, human
gtaggctcaggctccgacgg

SEQ ID NO: 103085 - DNA, 20 bp, human
gggaggtgcggcggaaccca

SEQ ID NO: 103086 - DNA, 20 bp, human
gacccacaaggtccagagta

SEQ ID NO: 103087 - DNA, 20 bp, human
gcccagccagggaagcggca

SEQ ID NO: 103088 - DNA, 20 bp, human
ggctctgccctctaccaggt

SEQ ID NO: 103089 - DNA, 20 bp, human
gcgcagggctaacctcagga

SEQ ID NO: 103090 - DNA, 20 bp, human
ggcgagagagcggcccacgc

SEQ ID NO: 103091 - DNA, 20 bp, human
gattcagctagctccccagg

SEQ ID NO: 103092 - DNA, 20 bp, human
gcaggtggcaattctaaacc

SEQ ID NO: 103093 - DNA, 20 bp, human
gcggccgcagggctaacctc

SEQ ID NO: 103094 - DNA, 20 bp, human
gaacctcaggacggcccaca

SEQ ID NO: 103095 - DNA, 20 bp, human
gcgggccgcgcgcctatcac

SEQ ID NO: 103096 - DNA, 20 bp, human
gccagggtaagtggcaccac

SEQ ID NO: 103097 - DNA, 20 bp, human
gcatggcgggtgacctggca

SEQ ID NO: 103098 - DNA, 20 bp, human
gcaccacaggtaggaacaga

SEQ ID NO: 103099 - DNA, 20 bp, human
gcctggagcgaaccagttcc

SEQ ID NO: 103100 - DNA, 20 bp, human
gggagggcagaaggaggcga

SEQ ID NO: 103101 - DNA, 20 bp, human
gggagcgaaccagttcctgg

SEQ ID NO: 103102 - DNA, 20 bp, human
ggtgccacttaccctgggag

SEQ ID NO: 103103 - DNA, 20 bp, human
gggaagggaaccctgaggtc

SEQ ID NO: 103104 - DNA, 20 bp, human
gaagatgacgtcccctccca

SEQ ID NO: 103105 - DNA, 20 bp, human
ggagctgtccaacggccacc

SEQ ID NO: 103106 - DNA, 20 bp, human
ggttgagagacgcgcggcag

SEQ ID NO: 103107 - DNA, 20 bp, human
gatctaatgtcctcccccgg

SEQ ID NO: 103108 - DNA, 20 bp, human
gggcaatccccgctactaag

SEQ ID NO: 103109 - DNA, 20 bp, human
gtccgtggctagtcttgacg

SEQ ID NO: 103110 - DNA, 20 bp, human
ggcgcgtctctcaacctccg

SEQ ID NO: 103111 - DNA, 20 bp, human
ggcgcaccaataaagagact

SEQ ID NO: 103112 - DNA, 20 bp, human
gaatgccgtaggtgaatacc

SEQ ID NO: 103113 - DNA, 20 bp, human
gtattcacctacggcattcg

SEQ ID NO: 103114 - DNA, 20 bp, human
ggccacgtcaagactagcca

SEQ ID NO: 103115 - DNA, 20 bp, human
gctgcagccgcgaatgccgt

SEQ ID NO: 103116 - DNA, 20 bp, human
ggtgctaatggaagcagcca

SEQ ID NO: 103117 - DNA, 20 bp, human
gtccccggagaggcaagatg

SEQ ID NO: 103118 - DNA, 20 bp, human
gcttgggtagtatttaaaaa

SEQ ID NO: 103119 - DNA, 20 bp, human
gctatcaaacaaagctgccg

SEQ ID NO: 103120 - DNA, 20 bp, human
ggctgactaatcagggatag

SEQ ID NO: 103121 - DNA, 20 bp, human
gagtggcagcaatgctgggg

SEQ ID NO: 103122 - DNA, 20 bp, human
gggcatgtcctaagagtgga

SEQ ID NO: 103123 - DNA, 20 bp, human
gtggactgctcaagaagatc

SEQ ID NO: 103124 - DNA, 20 bp, human
ggaaatacgagctgcttctt

SEQ ID NO: 103125 - DNA, 20 bp, human
gatcaggcatgtcctaagag

SEQ ID NO: 103126 - DNA, 20 bp, human
ggtggcgcggaaccaatcct

SEQ ID NO: 103127 - DNA, 20 bp, human
ggaaccaatcctgggcaggg

SEQ ID NO: 103128 - DNA, 20 bp, human
gccgcctccctgcccaggat

SEQ ID NO: 103129 - DNA, 20 bp, human
gtgacatggggggcactggt

SEQ ID NO: 103130 - DNA, 20 bp, human
gctagaaaggaacacgaggg

SEQ ID NO: 103131 - DNA, 20 bp, human
gggtgacactggctctctca

SEQ ID NO: 103132 - DNA, 20 bp, human
gtggctgaggactgaagaga

SEQ ID NO: 103133 - DNA, 20 bp, human
gcgtggtagctgtgacatgg

SEQ ID NO: 103134 - DNA, 20 bp, human
gggtttccaagcacacgggt

SEQ ID NO: 103135 - DNA, 20 bp, human
gttccgcgccaccgggaggg

SEQ ID NO: 103136 - DNA, 20 bp, human
gcacggttccgagtaaggac

SEQ ID NO: 103137 - DNA, 20 bp, human
ggtcgcagctggaccgagag

SEQ ID NO: 103138 - DNA, 20 bp, human
gcgccccacggttccgagta

SEQ ID NO: 103139 - DNA, 20 bp, human
gggaccggagctccactccg

SEQ ID NO: 103140 - DNA, 20 bp, human
gggagcccgcgctccacccc

SEQ ID NO: 103141 - DNA, 20 bp, human
gtccagggactgtagagtga

SEQ ID NO: 103142 - DNA, 20 bp, human
gtggagctccggtccttact

SEQ ID NO: 103143 - DNA, 20 bp, human
gagccccgggcgccacccgt

SEQ ID NO: 103144 - DNA, 20 bp, human
gtccggccgggcgagctccg

SEQ ID NO: 103145 - DNA, 20 bp, human
gcggcggcgcagagaagcca

SEQ ID NO: 103146 - DNA, 20 bp, human
gcagggagcgcgcgtgcgca

SEQ ID NO: 103147 - DNA, 20 bp, human
gtctgcttcggagaccgtaa

SEQ ID NO: 103148 - DNA, 20 bp, human
gtggtgaggctcacgttgga

SEQ ID NO: 103149 - DNA, 20 bp, human
gctgtggtctccccgagaga

SEQ ID NO: 103150 - DNA, 20 bp, human
gggctccagagcccccggtg

SEQ ID NO: 103151 - DNA, 20 bp, human
ggagcacggcctgtctcccg

SEQ ID NO: 103152 - DNA, 20 bp, human
gggcttgggctcaagatgag

SEQ ID NO: 103153 - DNA, 20 bp, human
gtggcccggcccaaaagcag

SEQ ID NO: 103154 - DNA, 20 bp, human
gccgggcccgacaggacctg

SEQ ID NO: 103155 - DNA, 20 bp, human
ggggtgcccaagccagaatt

SEQ ID NO: 103156 - DNA, 20 bp, human
gtccggacaccggtgagtaa

SEQ ID NO: 103157 - DNA, 20 bp, human
gggagctgctacagcagagg

SEQ ID NO: 103158 - DNA, 20 bp, human
gaaaggtgaacgctgcgctc

SEQ ID NO: 103159 - DNA, 20 bp, human
ggcccggcggcggaggtaac

SEQ ID NO: 103160 - DNA, 20 bp, human
gcaccggtgagtaagggaag

SEQ ID NO: 103161 - DNA, 20 bp, human
gtcgcgggcgctgtcatgga

SEQ ID NO: 103162 - DNA, 20 bp, human
ggagcggcccgtacgcgtac

SEQ ID NO: 103163 - DNA, 20 bp, human
gggaaggtgcggccaagaag

SEQ ID NO: 103164 - DNA, 20 bp, human
gcggccgggtctccacttct

SEQ ID NO: 103165 - DNA, 20 bp, human
gtcccttactcaccggtgtc

SEQ ID NO: 103166 - DNA, 20 bp, human
gggcagcggctgccaggcta

SEQ ID NO: 103167 - DNA, 20 bp, human
gagcggctgccaggctacgg

SEQ ID NO: 103168 - DNA, 20 bp, human
ggagcgcaagccccgcagtt

SEQ ID NO: 103169 - DNA, 20 bp, human
gcaagccccgcagttgggaa

SEQ ID NO: 103170 - DNA, 20 bp, human
gcttgcgctccgggacaagg

SEQ ID NO: 103171 - DNA, 20 bp, human
gatggtccgcaggggcagac

SEQ ID NO: 103172 - DNA, 20 bp, human
ggccagccgtgagacagcag

SEQ ID NO: 103173 - DNA, 20 bp, human
gtgctggcgttgggaccagt

SEQ ID NO: 103174 - DNA, 20 bp, human
gaggttatcggggccatcag

SEQ ID NO: 103175 - DNA, 20 bp, human
gagggggcaatggtccgcag

SEQ ID NO: 103176 - DNA, 20 bp, human
gacgcacccgatgctcggat

SEQ ID NO: 103177 - DNA, 20 bp, human
gatgctcggattggatgaag

SEQ ID NO: 103178 - DNA, 20 bp, human
ggccaaacgcccgaaccagc

SEQ ID NO: 103179 - DNA, 20 bp, human
gtaccggcgagccagccccg

SEQ ID NO: 103180 - DNA, 20 bp, human
gaaagcgggggtccaggcac

SEQ ID NO: 103181 - DNA, 20 bp, human
gcccagcaatcagacactac

SEQ ID NO: 103182 - DNA, 20 bp, human
ggtggcaaaggtaaccccgc

SEQ ID NO: 103183 - DNA, 20 bp, human
gaggcacctacgagacggag

SEQ ID NO: 103184 - DNA, 20 bp, human
gccgccccgctccgtctcgt

SEQ ID NO: 103185 - DNA, 20 bp, human
gtgtggaggcacctacgaga

SEQ ID NO: 103186 - DNA, 20 bp, human
gggcaggcgcgtgaccgaga

SEQ ID NO: 103187 - DNA, 20 bp, human
gccgaggaggtgctgagaga

SEQ ID NO: 103188 - DNA, 20 bp, human
gacgcgcctgccccaacctc

SEQ ID NO: 103189 - DNA, 20 bp, human
ggctcccgcctgtgcatccg

SEQ ID NO: 103190 - DNA, 20 bp, human
gcacctcctcggcagcccct

SEQ ID NO: 103191 - DNA, 20 bp, human
gcggccagttcgctcctccg

SEQ ID NO: 103192 - DNA, 20 bp, human
gacaggcgggagcccggtgt

SEQ ID NO: 103193 - DNA, 20 bp, human
gaggtgctgagagatggcgg

SEQ ID NO: 103194 - DNA, 20 bp, human
ggtgaccgagaaggagccga

SEQ ID NO: 103195 - DNA, 20 bp, human
ggctcacctggcagcgctgt

SEQ ID NO: 103196 - DNA, 20 bp, human
ggaagaccccgactccttac

SEQ ID NO: 103197 - DNA, 20 bp, human
gcttccttccagtaaggagt

SEQ ID NO: 103198 - DNA, 20 bp, human
gcggcccggcgagagatagg

SEQ ID NO: 103199 - DNA, 20 bp, human
gggcggcgactggcaatgtt

SEQ ID NO: 103200 - DNA, 20 bp, human
gccgcctggctgagaaaact

SEQ ID NO: 103201 - DNA, 20 bp, human
gctgagtgccggttacgtaa

SEQ ID NO: 103202 - DNA, 20 bp, human
gggacctcggcgccaatggg

SEQ ID NO: 103203 - DNA, 20 bp, human
ggcccgaagaggagctggac

SEQ ID NO: 103204 - DNA, 20 bp, human
ggtacgagccggagcctctc

SEQ ID NO: 103205 - DNA, 20 bp, human
gcagccggccgcttcccgag

SEQ ID NO: 103206 - DNA, 20 bp, human
ggggcgtgcgtgtgaccctc

SEQ ID NO: 103207 - DNA, 20 bp, human
ggggcgcgatctggatttgg

SEQ ID NO: 103208 - DNA, 20 bp, human
ggtgaacgaagaaggcgtcc

SEQ ID NO: 103209 - DNA, 20 bp, human
gggcgtcccggcatcgggtg

SEQ ID NO: 103210 - DNA, 20 bp, human
gcgtgcgtgtgaccctcggg

SEQ ID NO: 103211 - DNA, 20 bp, human
ggaagaaggcgtcccggcat

SEQ ID NO: 103212 - DNA, 20 bp, human
ggttcagctgtgaacgaaga

SEQ ID NO: 103213 - DNA, 20 bp, human
gcggccatgccagctccgag

SEQ ID NO: 103214 - DNA, 20 bp, human
ggacagtggacgactcaggg

SEQ ID NO: 103215 - DNA, 20 bp, human
ggcgctcctcacccgatgcc

SEQ ID NO: 103216 - DNA, 20 bp, human
ggatcgtggtactgctatgg

SEQ ID NO: 103217 - DNA, 20 bp, human
gtgttgctgtagtggcggag

SEQ ID NO: 103218 - DNA, 20 bp, human
ggtagtggcggagaggatcg

SEQ ID NO: 103219 - DNA, 20 bp, human
ggaggatcgtggtactgcta

SEQ ID NO: 103220 - DNA, 20 bp, human
gtgggccggggccagagtac

SEQ ID NO: 103221 - DNA, 20 bp, human
ggaagagccaccaaaacaag

SEQ ID NO: 103222 - DNA, 20 bp, human
gaacctggttgttgctgtag

SEQ ID NO: 103223 - DNA, 20 bp, human
ggcctccgcacccatgtccc

SEQ ID NO: 103224 - DNA, 20 bp, human
gacaagacaaagggacaaga

SEQ ID NO: 103225 - DNA, 20 bp, human
ggctatggcggtgagcgcgc

SEQ ID NO: 103226 - DNA, 20 bp, human
gggcacacggtctggaggtc

SEQ ID NO: 103227 - DNA, 20 bp, human
gaacctccacgcgactttgg

SEQ ID NO: 103228 - DNA, 20 bp, human
ggccggggtggagtcatcct

SEQ ID NO: 103229 - DNA, 20 bp, human
gtccgctgcggcacacggtc

SEQ ID NO: 103230 - DNA, 20 bp, human
gaaatgcaaaaggccgaggt

SEQ ID NO: 103231 - DNA, 20 bp, human
ggctggtcactatagcccta

SEQ ID NO: 103232 - DNA, 20 bp, human
gctccacgcgactttggtgg

SEQ ID NO: 103233 - DNA, 20 bp, human
gtaagtacaagcgatggtcc

SEQ ID NO: 103234 - DNA, 20 bp, human
gggccgggccgcgtccgcag

SEQ ID NO: 103235 - DNA, 20 bp, human
gtcttcctcgaggtaacctt

SEQ ID NO: 103236 - DNA, 20 bp, human
gtgcgcagcgctgagtgtcg

SEQ ID NO: 103237 - DNA, 20 bp, human
gagacttgaggcgcaagcac

SEQ ID NO: 103238 - DNA, 20 bp, human
gggcccctcggaaagacttg

SEQ ID NO: 103239 - DNA, 20 bp, human
gcgctcgagggtggccgcca

SEQ ID NO: 103240 - DNA, 20 bp, human
gccgcgggcagaaaacgccg

SEQ ID NO: 103241 - DNA, 20 bp, human
gcgaggcccgcgctgcccac

SEQ ID NO: 103242 - DNA, 20 bp, human
ggctccgagggaagccaggt

SEQ ID NO: 103243 - DNA, 20 bp, human
gcttccagcccgctcgaggg

SEQ ID NO: 103244 - DNA, 20 bp, human
ggagcgggctggaaggacga

SEQ ID NO: 103245 - DNA, 20 bp, human
gactcagcgctgcgcaccgc

SEQ ID NO: 103246 - DNA, 20 bp, human
ggcgcgcggttaccgtggaa

SEQ ID NO: 103247 - DNA, 20 bp, human
ggcaagcggccgcctttcca

SEQ ID NO: 103248 - DNA, 20 bp, human
gcggagtccgcgagcgtcgt

SEQ ID NO: 103249 - DNA, 20 bp, human
gcgcggactccgagtccacc

SEQ ID NO: 103250 - DNA, 20 bp, human
ggctactcgccaggtggact

SEQ ID NO: 103251 - DNA, 20 bp, human
gtgccgccggcgggaactct

SEQ ID NO: 103252 - DNA, 20 bp, human
gactgaaccaaaccaaacag

SEQ ID NO: 103253 - DNA, 20 bp, human
gcgcggttaccgtggaaagg

SEQ ID NO: 103254 - DNA, 20 bp, human
gccaggccacagcctgctgt

SEQ ID NO: 103255 - DNA, 20 bp, human
gcgcttgccgacgacgctcg

SEQ ID NO: 103256 - DNA, 20 bp, human
gtcctgcggcagtaccgagt

SEQ ID NO: 103257 - DNA, 20 bp, human
ggtgaagtgcggaaaaccag

SEQ ID NO: 103258 - DNA, 20 bp, human
gtccgcacttcacaaaccag

SEQ ID NO: 103259 - DNA, 20 bp, human
ggcgcttcaaggagttcctg

SEQ ID NO: 103260 - DNA, 20 bp, human
ggagtgggcaccgaccgcac

SEQ ID NO: 103261 - DNA, 20 bp, human
gcgacgcccaggccgacgag

SEQ ID NO: 103262 - DNA, 20 bp, human
ggtgcggaaaaccagaggtg

SEQ ID NO: 103263 - DNA, 20 bp, human
gctcccactagcctcacctc

SEQ ID NO: 103264 - DNA, 20 bp, human
gtcgcgggaaaaacaagagg

SEQ ID NO: 103265 - DNA, 20 bp, human
gtctacagcgacagcttcgg

SEQ ID NO: 103266 - DNA, 20 bp, human
ggacttgtggcggtcgagcg

SEQ ID NO: 103267 - DNA, 20 bp, human
gcgtggcgcaggcgaatcct

SEQ ID NO: 103268 - DNA, 20 bp, human
ggcaaatatggacctcgcgg

SEQ ID NO: 103269 - DNA, 20 bp, human
gcgagggctgtgcaaatacc

SEQ ID NO: 103270 - DNA, 20 bp, human
gcagacgccgcaggctccgg

SEQ ID NO: 103271 - DNA, 20 bp, human
ggcgtcttagggctcgagat

SEQ ID NO: 103272 - DNA, 20 bp, human
gggaaaaaagcgacttgtgg

SEQ ID NO: 103273 - DNA, 20 bp, human
gtaagcaaatatggacctcg

SEQ ID NO: 103274 - DNA, 20 bp, human
gggaacacccgccgcccaca

SEQ ID NO: 103275 - DNA, 20 bp, human
ggggtgcggccaggtcgagt

SEQ ID NO: 103276 - DNA, 20 bp, human
ggacctcaggagagtcttaa

SEQ ID NO: 103277 - DNA, 20 bp, human
gaagtcgcgcccaggacctc

SEQ ID NO: 103278 - DNA, 20 bp, human
gccgcgcttggcgggctcag

SEQ ID NO: 103279 - DNA, 20 bp, human
ggaggtcccggtgaaatcag

SEQ ID NO: 103280 - DNA, 20 bp, human
gatcgctgccgagggccgtg

SEQ ID NO: 103281 - DNA, 20 bp, human
gggagattctcagcttcccc

SEQ ID NO: 103282 - DNA, 20 bp, human
gatctccgcgcggtggactg

SEQ ID NO: 103283 - DNA, 20 bp, human
gctggggtgcgcgaggccag

SEQ ID NO: 103284 - DNA, 20 bp, human
gggcgcgctaacccggctgg

SEQ ID NO: 103285 - DNA, 20 bp, human
gctaccaggatgatgaactc

SEQ ID NO: 103286 - DNA, 20 bp, human
ggcctgaggagctaagatcc

SEQ ID NO: 103287 - DNA, 20 bp, human
ggtggtgcttctctacggga

SEQ ID NO: 103288 - DNA, 20 bp, human
gtgcttctctacgggaggga

SEQ ID NO: 103289 - DNA, 20 bp, human
ggccccgtggtgcttctcta

SEQ ID NO: 103290 - DNA, 20 bp, human
gagaagcggcaagacgagag

SEQ ID NO: 103291 - DNA, 20 bp, human
gcacggggctaagagtctcc

SEQ ID NO: 103292 - DNA, 20 bp, human
gtgaaggagcgcctcagctt

SEQ ID NO: 103293 - DNA, 20 bp, human
gacttggcaggagtcgcctg

SEQ ID NO: 103294 - DNA, 20 bp, human
gaaacgttaagaagtaggac

SEQ ID NO: 103295 - DNA, 20 bp, human
ggtcttgccgcttctttgag

SEQ ID NO: 103296 - DNA, 20 bp, human
gccatccggaagagccgccg

SEQ ID NO: 103297 - DNA, 20 bp, human
gcgccggggcagggaagttg

SEQ ID NO: 103298 - DNA, 20 bp, human
gcaggcagcgggttcgtctc

SEQ ID NO: 103299 - DNA, 20 bp, human
ggctcttccggatggagacg

SEQ ID NO: 103300 - DNA, 20 bp, human
gcttctggggctcttctccc

SEQ ID NO: 103301 - DNA, 20 bp, human
gttcaactccgggaccggac

SEQ ID NO: 103302 - DNA, 20 bp, human
gtccgggaccggacaggcac

SEQ ID NO: 103303 - DNA, 20 bp, human
ggaagtctcagagactgcca

SEQ ID NO: 103304 - DNA, 20 bp, human
gtaaccgcgaaaggaggagg

SEQ ID NO: 103305 - DNA, 20 bp, human
gcgttgctcccgaggccgaa

SEQ ID NO: 103306 - DNA, 20 bp, human
gcaggcagcgcggtcggcgg

SEQ ID NO: 103307 - DNA, 20 bp, human
gcggctcgctgtgcgtggga

SEQ ID NO: 103308 - DNA, 20 bp, human
gtcgcaggcagcgcggtcgg

SEQ ID NO: 103309 - DNA, 20 bp, human
ggccacgcgagccctcgaga

SEQ ID NO: 103310 - DNA, 20 bp, human
gccacgcggtaccatctcga

SEQ ID NO: 103311 - DNA, 20 bp, human
gggagctgctggcgacagtc

SEQ ID NO: 103312 - DNA, 20 bp, human
gttgtgcgaagtgaaggcta

SEQ ID NO: 103313 - DNA, 20 bp, human
ggcgcccagctcctcttcag

SEQ ID NO: 103314 - DNA, 20 bp, human
gtctgcgcggcgaggaggag

SEQ ID NO: 103315 - DNA, 20 bp, human
gccctgcctgctgcgaccgg

SEQ ID NO: 103316 - DNA, 20 bp, human
gatcagggcctggagttcgg

SEQ ID NO: 103317 - DNA, 20 bp, human
gagcaaccgccaagcttggt

SEQ ID NO: 103318 - DNA, 20 bp, human
gggacccctcccactgacag

SEQ ID NO: 103319 - DNA, 20 bp, human
gggagagcaaccgccaagct

SEQ ID NO: 103320 - DNA, 20 bp, human
gtgctctccgcctgcagcgt

SEQ ID NO: 103321 - DNA, 20 bp, human
ggcctgcagcgtaggcggag

SEQ ID NO: 103322 - DNA, 20 bp, human
gaggagggggccataaatca

SEQ ID NO: 103323 - DNA, 20 bp, human
ggcggtgacctcgagttagt

SEQ ID NO: 103324 - DNA, 20 bp, human
gtgggtgtcactgcgtaaag

SEQ ID NO: 103325 - DNA, 20 bp, human
ggttagactaagggaagaca

SEQ ID NO: 103326 - DNA, 20 bp, human
gagcgaggtcgcagtgacag

SEQ ID NO: 103327 - DNA, 20 bp, human
gggcgcggcttcaaaccctc

SEQ ID NO: 103328 - DNA, 20 bp, human
gctgcgacctcgctccctcg

SEQ ID NO: 103329 - DNA, 20 bp, human
ggacgcaggcgggtacggcg

SEQ ID NO: 103330 - DNA, 20 bp, human
gcgcgggacgcaggcgggta

SEQ ID NO: 103331 - DNA, 20 bp, human
gcagatcagctgatgccgga

SEQ ID NO: 103332 - DNA, 20 bp, human
gtcggaacctaggctcccag

SEQ ID NO: 103333 - DNA, 20 bp, human
gaggaacctcgccgccccag

SEQ ID NO: 103334 - DNA, 20 bp, human
gggcacagatcagctgatgc

SEQ ID NO: 103335 - DNA, 20 bp, human
ggccgcgccgcgagggagcg

SEQ ID NO: 103336 - DNA, 20 bp, human
gagtgcggcgggcagttctc

SEQ ID NO: 103337 - DNA, 20 bp, human
gagagcaggcgccgcagtcg

SEQ ID NO: 103338 - DNA, 20 bp, human
gccgccgcactccacgactg

SEQ ID NO: 103339 - DNA, 20 bp, human
gcagttctcgggcggctgaa

SEQ ID NO: 103340 - DNA, 20 bp, human
gttctcgggcggctgaaagg

SEQ ID NO: 103341 - DNA, 20 bp, human
gcagaccccggcccgagagc

SEQ ID NO: 103342 - DNA, 20 bp, human
ggcggcgggcagttctcggg

SEQ ID NO: 103343 - DNA, 20 bp, human
gacaggcctttccctcaggt

SEQ ID NO: 103344 - DNA, 20 bp, human
gaccacgcggccggcagaaa

SEQ ID NO: 103345 - DNA, 20 bp, human
gcggcgagggcgaaatgagt

SEQ ID NO: 103346 - DNA, 20 bp, human
gccgcccagagtcagacggg

SEQ ID NO: 103347 - DNA, 20 bp, human
ggccgcagctccggtgtccg

SEQ ID NO: 103348 - DNA, 20 bp, human
gcaagccgcccgcaggtcag

SEQ ID NO: 103349 - DNA, 20 bp, human
ggggcagtcggcgccatgga

SEQ ID NO: 103350 - DNA, 20 bp, human
gggacagtccgccttgaaag

SEQ ID NO: 103351 - DNA, 20 bp, human
gtgtccgcggcgagggcgca

SEQ ID NO: 103352 - DNA, 20 bp, human
ggctccagatggccttgacg

SEQ ID NO: 103353 - DNA, 20 bp, human
ggccgcccgcaggtcagtgg

SEQ ID NO: 103354 - DNA, 20 bp, human
gcgggaggcagcgagctgtc

SEQ ID NO: 103355 - DNA, 20 bp, human
ggcggcctggagggggaccg

SEQ ID NO: 103356 - DNA, 20 bp, human
ggcgcactcgggggatcccg

SEQ ID NO: 103357 - DNA, 20 bp, human
gggccgccatgacagacggc

SEQ ID NO: 103358 - DNA, 20 bp, human
gtggcggcccccatcctgaa

SEQ ID NO: 103359 - DNA, 20 bp, human
gcatgacagacggcgggatc

SEQ ID NO: 103360 - DNA, 20 bp, human
ggcccccatcctgaaaggtg

SEQ ID NO: 103361 - DNA, 20 bp, human
gtgggggccgccatgacaga

SEQ ID NO: 103362 - DNA, 20 bp, human
gaggctcgcaagcaccgcgt

SEQ ID NO: 103363 - DNA, 20 bp, human
gcaggcagcgggggattgag

SEQ ID NO: 103364 - DNA, 20 bp, human
gacctcacctttcaggatgg

SEQ ID NO: 103365 - DNA, 20 bp, human
ggccccagatccagggacta

SEQ ID NO: 103366 - DNA, 20 bp, human
gcggaagtagacgtacctca

SEQ ID NO: 103367 - DNA, 20 bp, human
ggccaaagccggcttccgtg

SEQ ID NO: 103368 - DNA, 20 bp, human
gggagggtccggtaaggaag

SEQ ID NO: 103369 - DNA, 20 bp, human
gggtctgtctcaagaactcg

SEQ ID NO: 103370 - DNA, 20 bp, human
ggtcgccgcggagaaattgt

SEQ ID NO: 103371 - DNA, 20 bp, human
gcgagcttgccggcaaactg

SEQ ID NO: 103372 - DNA, 20 bp, human
gggcgacggtagcagccgca

SEQ ID NO: 103373 - DNA, 20 bp, human
ggcaaaggcatggagaccgt

SEQ ID NO: 103374 - DNA, 20 bp, human
ggccggaccgggttagaatc

SEQ ID NO: 103375 - DNA, 20 bp, human
gaccttgggtgtgcactctt

SEQ ID NO: 103376 - DNA, 20 bp, human
ggcagcaagtgctccgtgca

SEQ ID NO: 103377 - DNA, 20 bp, human
gcagggctgttgctatcact

SEQ ID NO: 103378 - DNA, 20 bp, human
gggctgttgctatcacttgg

SEQ ID NO: 103379 - DNA, 20 bp, human
ggctctgcacagcagcgact

SEQ ID NO: 103380 - DNA, 20 bp, human
gctgagaaatggaaacattg

SEQ ID NO: 103381 - DNA, 20 bp, human
gcactgaataccggcaaaag

SEQ ID NO: 103382 - DNA, 20 bp, human
gcattgtggtagctttatat

SEQ ID NO: 103383 - DNA, 20 bp, human
gcactatgtatctcacaagt

SEQ ID NO: 103384 - DNA, 20 bp, human
gtggtagccttaaattaatg

SEQ ID NO: 103385 - DNA, 20 bp, human
gaaatatagtgcctgagaaa

SEQ ID NO: 103386 - DNA, 20 bp, human
gggagacgggtgtccagcaa

SEQ ID NO: 103387 - DNA, 20 bp, human
ggatgcaccagaagagccag

SEQ ID NO: 103388 - DNA, 20 bp, human
gagagccagaggtgagaata

SEQ ID NO: 103389 - DNA, 20 bp, human
gtctggtgcatcccctccaa

SEQ ID NO: 103390 - DNA, 20 bp, human
gccgaggtgtaggaagactg

SEQ ID NO: 103391 - DNA, 20 bp, human
ggccttgcccgtagatctgg

SEQ ID NO: 103392 - DNA, 20 bp, human
gttggggctcattaaaacag

SEQ ID NO: 103393 - DNA, 20 bp, human
gccagccctattctcacctc

SEQ ID NO: 103394 - DNA, 20 bp, human
gatcaacttgagcaagaaga

SEQ ID NO: 103395 - DNA, 20 bp, human
gtgctcaagttgatcaacaa

SEQ ID NO: 103396 - DNA, 20 bp, human
gagatcccctcacacgagga

SEQ ID NO: 103397 - DNA, 20 bp, human
ggagagccagccgcgcttta

SEQ ID NO: 103398 - DNA, 20 bp, human
ggaaggccggcactgacagt

SEQ ID NO: 103399 - DNA, 20 bp, human
gatagggaagggcccggaat

SEQ ID NO: 103400 - DNA, 20 bp, human
gcccctcacacgaggaaggc

SEQ ID NO: 103401 - DNA, 20 bp, human
gcggcagatcccctcacacg

SEQ ID NO: 103402 - DNA, 20 bp, human
gattggtagaaccctaggaa

SEQ ID NO: 103403 - DNA, 20 bp, human
gcacagtgcacggatgtgat

SEQ ID NO: 103404 - DNA, 20 bp, human
gcggagctgtagtcgttatc

SEQ ID NO: 103405 - DNA, 20 bp, human
ggcgcctacgtggagtccag

SEQ ID NO: 103406 - DNA, 20 bp, human
ggccgccgccccgagaggag

SEQ ID NO: 103407 - DNA, 20 bp, human
gagcaggagcgatctacctg

SEQ ID NO: 103408 - DNA, 20 bp, human
gtccgctgcgctgcctgggt

SEQ ID NO: 103409 - DNA, 20 bp, human
gaggagcgatctacctgcgg

SEQ ID NO: 103410 - DNA, 20 bp, human
ggccgtttccagttgagaga

SEQ ID NO: 103411 - DNA, 20 bp, human
gaccagggcggggaaggcac

SEQ ID NO: 103412 - DNA, 20 bp, human
gctgcggcggcgaccaggaa

SEQ ID NO: 103413 - DNA, 20 bp, human
gctggaaacggcgccgaccc

SEQ ID NO: 103414 - DNA, 20 bp, human
gtgctgctcctctcctctcg

SEQ ID NO: 103415 - DNA, 20 bp, human
gaggcgcctgaagggcacgg

SEQ ID NO: 103416 - DNA, 20 bp, human
gcgcagcgcccccagaccgt

SEQ ID NO: 103417 - DNA, 20 bp, human
gccagtgaactgctcgggga

SEQ ID NO: 103418 - DNA, 20 bp, human
gaccgtcggagagcgcagag

SEQ ID NO: 103419 - DNA, 20 bp, human
gtggtgcccgcccactccta

SEQ ID NO: 103420 - DNA, 20 bp, human
ggcagaccctaggagtgggc

SEQ ID NO: 103421 - DNA, 20 bp, human
ggaatcccgggcgctaaagt

SEQ ID NO: 103422 - DNA, 20 bp, human
gaaaagcagaccctaggagt

SEQ ID NO: 103423 - DNA, 20 bp, human
ggcctcagcggaagaccggg

SEQ ID NO: 103424 - DNA, 20 bp, human
gcccgcgcgcccggcaggaa

SEQ ID NO: 103425 - DNA, 20 bp, human
ggcgcccaaaagcagaccct

SEQ ID NO: 103426 - DNA, 20 bp, human
ggggttgcgcgttgcagtcg

SEQ ID NO: 103427 - DNA, 20 bp, human
ggctgccggcaacggataga

SEQ ID NO: 103428 - DNA, 20 bp, human
ggcgcgcggggacttaaagt

SEQ ID NO: 103429 - DNA, 20 bp, human
gccgcgcgcgccaccagtaa

SEQ ID NO: 103430 - DNA, 20 bp, human
gacacgcagtcgctccacct

SEQ ID NO: 103431 - DNA, 20 bp, human
ggttgacaggtagggaaagt

SEQ ID NO: 103432 - DNA, 20 bp, human
gtaaagtaggtgagttctag

SEQ ID NO: 103433 - DNA, 20 bp, human
gctagagggaaactgttgac

SEQ ID NO: 103434 - DNA, 20 bp, human
gccagtaacggtcgcgaccc

SEQ ID NO: 103435 - DNA, 20 bp, human
ggggagacgtcgggccacaa

SEQ ID NO: 103436 - DNA, 20 bp, human
gaggggcgaacggcgtgagc

SEQ ID NO: 103437 - DNA, 20 bp, human
ggccgtaagtagcgactatg

SEQ ID NO: 103438 - DNA, 20 bp, human
ggcactaggacagacccccg

SEQ ID NO: 103439 - DNA, 20 bp, human
gaggcggccctagacaagta

SEQ ID NO: 103440 - DNA, 20 bp, human
gcgagggccagtgagcacac

SEQ ID NO: 103441 - DNA, 20 bp, human
ggcggccacgtcccagcgat

SEQ ID NO: 103442 - DNA, 20 bp, human
gcccagacgcggctcctagg

SEQ ID NO: 103443 - DNA, 20 bp, human
gcgagacgctgtcaccccag

SEQ ID NO: 103444 - DNA, 20 bp, human
ggcagtccaagagggttcag

SEQ ID NO: 103445 - DNA, 20 bp, human
gtctcggccgtacttgtcta

SEQ ID NO: 103446 - DNA, 20 bp, human
gggcagggcgcacggaggaa

SEQ ID NO: 103447 - DNA, 20 bp, human
gcccggtggcctgacgacgg

SEQ ID NO: 103448 - DNA, 20 bp, human
gcgccccggtggcctgacga

SEQ ID NO: 103449 - DNA, 20 bp, human
ggggagggaacgtcccgcag

SEQ ID NO: 103450 - DNA, 20 bp, human
gtgccgggcggcgagctagg

SEQ ID NO: 103451 - DNA, 20 bp, human
gggtggcctgacgacggcgg

SEQ ID NO: 103452 - DNA, 20 bp, human
gagggaacgtcccgcagggg

SEQ ID NO: 103453 - DNA, 20 bp, human
ggccgcagttgccgccactg

SEQ ID NO: 103454 - DNA, 20 bp, human
gcccacgggcccgggagcga

SEQ ID NO: 103455 - DNA, 20 bp, human
gcaagtgcacagataggggt

SEQ ID NO: 103456 - DNA, 20 bp, human
ggagccgccgataaacccgg

SEQ ID NO: 103457 - DNA, 20 bp, human
ggcccggccctcctgatccg

SEQ ID NO: 103458 - DNA, 20 bp, human
ggctgctccccggatcagga

SEQ ID NO: 103459 - DNA, 20 bp, human
gcttcccccgggtttatcgg

SEQ ID NO: 103460 - DNA, 20 bp, human
gtacggccgcggccagacgg

SEQ ID NO: 103461 - DNA, 20 bp, human
ggccgagccgccgataaacc

SEQ ID NO: 103462 - DNA, 20 bp, human
gcgcggccagacggcgggag

SEQ ID NO: 103463 - DNA, 20 bp, human
gggcggctcggctaacttca

SEQ ID NO: 103464 - DNA, 20 bp, human
ggagcagcgcgggctgggtt

SEQ ID NO: 103465 - DNA, 20 bp, human
gggctaacttcacggacccg

SEQ ID NO: 103466 - DNA, 20 bp, human
gatcgccgaacggggagagg

SEQ ID NO: 103467 - DNA, 20 bp, human
gctgtatcgtgtaacaggat

SEQ ID NO: 103468 - DNA, 20 bp, human
gaacaggattggcgttgcaa

SEQ ID NO: 103469 - DNA, 20 bp, human
ggcgttgcaatggcaactga

SEQ ID NO: 103470 - DNA, 20 bp, human
gagcctggcttggacagccg

SEQ ID NO: 103471 - DNA, 20 bp, human
gagactcgcatcgccgaacg

SEQ ID NO: 103472 - DNA, 20 bp, human
gcgcacgccgcactcacacc

SEQ ID NO: 103473 - DNA, 20 bp, human
gaaaatcgcagacgccgggg

SEQ ID NO: 103474 - DNA, 20 bp, human
gtgacccaggacaccgagca

SEQ ID NO: 103475 - DNA, 20 bp, human
gcggcgtctgcgattttccc

SEQ ID NO: 103476 - DNA, 20 bp, human
gctctaccgcggaactgact

SEQ ID NO: 103477 - DNA, 20 bp, human
gcgcggaactgactcggaga

SEQ ID NO: 103478 - DNA, 20 bp, human
gagtcaggtcacctctaccg

SEQ ID NO: 103479 - DNA, 20 bp, human
gggtttgcgatgggagggaa

SEQ ID NO: 103480 - DNA, 20 bp, human
ggccgcagtgacccagtaat

SEQ ID NO: 103481 - DNA, 20 bp, human
ggtgtttgataaggacgata

SEQ ID NO: 103482 - DNA, 20 bp, human
ggagcggtgttagcgagaaa

SEQ ID NO: 103483 - DNA, 20 bp, human
gtcaagggcgcgagggccag

SEQ ID NO: 103484 - DNA, 20 bp, human
gtgcaagaaaccccactcaa

SEQ ID NO: 103485 - DNA, 20 bp, human
gctgactcggagagggcgag

SEQ ID NO: 103486 - DNA, 20 bp, human
gctggcgcccagcagaggtt

SEQ ID NO: 103487 - DNA, 20 bp, human
gcaatctgcgggcggacgcg

SEQ ID NO: 103488 - DNA, 20 bp, human
gatggtcgagagagactcag

SEQ ID NO: 103489 - DNA, 20 bp, human
ggagactgaaagctcctcta

SEQ ID NO: 103490 - DNA, 20 bp, human
gagaggtggacacaaggaac

SEQ ID NO: 103491 - DNA, 20 bp, human
gcgagagagactcagaggca

SEQ ID NO: 103492 - DNA, 20 bp, human
gcaagccgagcggccatggg

SEQ ID NO: 103493 - DNA, 20 bp, human
gccaggaaaccgcgaagccg

SEQ ID NO: 103494 - DNA, 20 bp, human
gctggcaaccacgcagccaa

SEQ ID NO: 103495 - DNA, 20 bp, human
gtggctggggaaggtattac

SEQ ID NO: 103496 - DNA, 20 bp, human
ggagcgggaggggcaccgac

SEQ ID NO: 103497 - DNA, 20 bp, human
gcccaggtaggccagacgag

SEQ ID NO: 103498 - DNA, 20 bp, human
gtgggcagtgtggaggtcgt

SEQ ID NO: 103499 - DNA, 20 bp, human
gggcacaggagctggtgacg

SEQ ID NO: 103500 - DNA, 20 bp, human
ggagaaagccggggaaaagg

SEQ ID NO: 103501 - DNA, 20 bp, human
gcttcaaggttgggaaacca

SEQ ID NO: 103502 - DNA, 20 bp, human
gggtctcccagatttcccag

SEQ ID NO: 103503 - DNA, 20 bp, human
ggcgaggtagtcccgctcca

SEQ ID NO: 103504 - DNA, 20 bp, human
gagccaagagcaggtcctct

SEQ ID NO: 103505 - DNA, 20 bp, human
gagctcctgtgcctgccagt

SEQ ID NO: 103506 - DNA, 20 bp, human
gcggcggcccctggtccgcc

SEQ ID NO: 103507 - DNA, 20 bp, human
gccatgtgaccggctcagac

SEQ ID NO: 103508 - DNA, 20 bp, human
gagcgccagcagggcgagga

SEQ ID NO: 103509 - DNA, 20 bp, human
gggagggagcgaagcagcgc

SEQ ID NO: 103510 - DNA, 20 bp, human
ggcggcggccggagcgggac

SEQ ID NO: 103511 - DNA, 20 bp, human
gcgccgggcccgtcccgctc

SEQ ID NO: 103512 - DNA, 20 bp, human
gccgcggccgggcggaccag

SEQ ID NO: 103513 - DNA, 20 bp, human
gccgcggtcgccaaaaagaa

SEQ ID NO: 103514 - DNA, 20 bp, human
gagtcgggctgctaaggtgg

SEQ ID NO: 103515 - DNA, 20 bp, human
gagactcgggctctcccctc

SEQ ID NO: 103516 - DNA, 20 bp, human
gcagttaactgtcggagtag

SEQ ID NO: 103517 - DNA, 20 bp, human
gccgggccgaggctttgcta

SEQ ID NO: 103518 - DNA, 20 bp, human
gttaactgtcggagtagcgg

SEQ ID NO: 103519 - DNA, 20 bp, human
gaggcggcgggcagattctg

SEQ ID NO: 103520 - DNA, 20 bp, human
gactggagaaaaagctccga

SEQ ID NO: 103521 - DNA, 20 bp, human
gagcgcaccggcatgtcgcc

SEQ ID NO: 103522 - DNA, 20 bp, human
ggcggaagctgccagcccca

SEQ ID NO: 103523 - DNA, 20 bp, human
gcctttgcgaagagaactaa

SEQ ID NO: 103524 - DNA, 20 bp, human
gccggcgccgggcgacatgc

SEQ ID NO: 103525 - DNA, 20 bp, human
ggagagggaactaggttaag

SEQ ID NO: 103526 - DNA, 20 bp, human
gccgcacaaaggctgcgaac

SEQ ID NO: 103527 - DNA, 20 bp, human
gccagccacgaaccgcacaa

SEQ ID NO: 103528 - DNA, 20 bp, human
ggaagcagccaagctcgccg

SEQ ID NO: 103529 - DNA, 20 bp, human
ggcaagaagccgagcccgag

SEQ ID NO: 103530 - DNA, 20 bp, human
ggccctgtgtgtcggaaaga

SEQ ID NO: 103531 - DNA, 20 bp, human
gggctgggaaccagcgatag

SEQ ID NO: 103532 - DNA, 20 bp, human
ggcgagcttggctgcttctg

SEQ ID NO: 103533 - DNA, 20 bp, human
ggctcgtacgcactaatccg

SEQ ID NO: 103534 - DNA, 20 bp, human
ggattggagggtagacctgt

SEQ ID NO: 103535 - DNA, 20 bp, human
ggcgccccgtgaaggaaact

SEQ ID NO: 103536 - DNA, 20 bp, human
ggtcacagatcctagggcct

SEQ ID NO: 103537 - DNA, 20 bp, human
gtcccccgccgagcccgggt

SEQ ID NO: 103538 - DNA, 20 bp, human
gggccaagagccacacctta

SEQ ID NO: 103539 - DNA, 20 bp, human
gccctcgtgtgaggccgtgt

SEQ ID NO: 103540 - DNA, 20 bp, human
gcctcggcagcattttgaaa

SEQ ID NO: 103541 - DNA, 20 bp, human
gtgtgggaggccggaagttg

SEQ ID NO: 103542 - DNA, 20 bp, human
ggccgcgccaggcggaagaa

SEQ ID NO: 103543 - DNA, 20 bp, human
gaaaatgctgccgaggccct

SEQ ID NO: 103544 - DNA, 20 bp, human
gggagcttgagaggtgggtc

SEQ ID NO: 103545 - DNA, 20 bp, human
gtcgcggaagataaaagtgg

SEQ ID NO: 103546 - DNA, 20 bp, human
ggcgtagttgctggctgctc

SEQ ID NO: 103547 - DNA, 20 bp, human
gagcgcctacaccgggagag

SEQ ID NO: 103548 - DNA, 20 bp, human
gtgcgccagcccacaggagg

SEQ ID NO: 103549 - DNA, 20 bp, human
gcagctccagcgcctacacc

SEQ ID NO: 103550 - DNA, 20 bp, human
gcaagcaggtaagacgtgaa

SEQ ID NO: 103551 - DNA, 20 bp, human
ggcaactacgcccgcaggaa

SEQ ID NO: 103552 - DNA, 20 bp, human
gagggggccagcttgacctg

SEQ ID NO: 103553 - DNA, 20 bp, human
gacgtgtggtgcccctctcc

SEQ ID NO: 103554 - DNA, 20 bp, human
gccgtgtgctcacccacgtg

SEQ ID NO: 103555 - DNA, 20 bp, human
gtgtgggctggcgcaggtcg

SEQ ID NO: 103556 - DNA, 20 bp, human
ggctgcgcgcagcagaggtg

SEQ ID NO: 103557 - DNA, 20 bp, human
ggacgtccgactgtacccag

SEQ ID NO: 103558 - DNA, 20 bp, human
gttagagagtgcggaacctc

SEQ ID NO: 103559 - DNA, 20 bp, human
gtaggacctcaggcacctct

SEQ ID NO: 103560 - DNA, 20 bp, human
ggcggaacctccggcagcta

SEQ ID NO: 103561 - DNA, 20 bp, human
gtggctgccttagctgccgg

SEQ ID NO: 103562 - DNA, 20 bp, human
gtgatggaactgtacgagat

SEQ ID NO: 103563 - DNA, 20 bp, human
gccgcactctctaaggcccc

SEQ ID NO: 103564 - DNA, 20 bp, human
gagccttggggtgcccggtg

SEQ ID NO: 103565 - DNA, 20 bp, human
ggcctggggcgggagatgca

SEQ ID NO: 103566 - DNA, 20 bp, human
gatgggatgccgaggtgcag

SEQ ID NO: 103567 - DNA, 20 bp, human
ggggatagaggtaaaggtaa

SEQ ID NO: 103568 - DNA, 20 bp, human
gacctcggcatcccatgtta

SEQ ID NO: 103569 - DNA, 20 bp, human
gctgatagagaggggccgat

SEQ ID NO: 103570 - DNA, 20 bp, human
gatccactagagtgatggca

SEQ ID NO: 103571 - DNA, 20 bp, human
gctgactgcagctgtggcgg

SEQ ID NO: 103572 - DNA, 20 bp, human
ggaagccggtgtccccagca

SEQ ID NO: 103573 - DNA, 20 bp, human
gtccgagccggcgtgtgagg

SEQ ID NO: 103574 - DNA, 20 bp, human
gtccgtatccactagagtga

SEQ ID NO: 103575 - DNA, 20 bp, human
gatagagaggggccgatggg

SEQ ID NO: 103576 - DNA, 20 bp, human
gccgaagagcggccgagaga

SEQ ID NO: 103577 - DNA, 20 bp, human
gtgtgagcctgagctgacgg

SEQ ID NO: 103578 - DNA, 20 bp, human
gcgggcggccccacacgcag

SEQ ID NO: 103579 - DNA, 20 bp, human
ggcagaggcggcccgaagag

SEQ ID NO: 103580 - DNA, 20 bp, human
gcgagggaccggctacatcg

SEQ ID NO: 103581 - DNA, 20 bp, human
gccggagccgccgtcagctc

SEQ ID NO: 103582 - DNA, 20 bp, human
ggccgcggccgctggaacct

SEQ ID NO: 103583 - DNA, 20 bp, human
gcgcgcgccgggtagagccg

SEQ ID NO: 103584 - DNA, 20 bp, human
gccgcgccgggccttaccag

SEQ ID NO: 103585 - DNA, 20 bp, human
gcggcgcgagacctctggta

SEQ ID NO: 103586 - DNA, 20 bp, human
gctccccgagcagcgcaggt

SEQ ID NO: 103587 - DNA, 20 bp, human
gggtggcagccgaggagtgg

SEQ ID NO: 103588 - DNA, 20 bp, human
gccatggtccttggcagacc

SEQ ID NO: 103589 - DNA, 20 bp, human
gggtctacgcggtcccgctg

SEQ ID NO: 103590 - DNA, 20 bp, human
ggcgcggcacccatggtcct

SEQ ID NO: 103591 - DNA, 20 bp, human
gcgggagagaaagcaaggtc

SEQ ID NO: 103592 - DNA, 20 bp, human
ggggcaccgggcctgatccg

SEQ ID NO: 103593 - DNA, 20 bp, human
gtccagcccccgccactcct

SEQ ID NO: 103594 - DNA, 20 bp, human
gcgtatccgcgcttcttcag

SEQ ID NO: 103595 - DNA, 20 bp, human
ggtgggtgtccagcgcggga

SEQ ID NO: 103596 - DNA, 20 bp, human
ggtgaggcgcgcgggaacac

SEQ ID NO: 103597 - DNA, 20 bp, human
gggaggccgcgggctctgag

SEQ ID NO: 103598 - DNA, 20 bp, human
gcgcgggctctgagcgggtg

SEQ ID NO: 103599 - DNA, 20 bp, human
gccggcgccgggattcggat

SEQ ID NO: 103600 - DNA, 20 bp, human
gcgtcctgccccgccggaag

SEQ ID NO: 103601 - DNA, 20 bp, human
gcccgcccccatccgaatcc

SEQ ID NO: 103602 - DNA, 20 bp, human
ggaacaccggcgccgggatt

SEQ ID NO: 103603 - DNA, 20 bp, human
gttgcacgcaggagactaca

SEQ ID NO: 103604 - DNA, 20 bp, human
gagcccgcggcctccacttc

SEQ ID NO: 103605 - DNA, 20 bp, human
gtaagaaccccgacttagga

SEQ ID NO: 103606 - DNA, 20 bp, human
ggccgggtgtccgggatctg

SEQ ID NO: 103607 - DNA, 20 bp, human
ggggtgtccgggatctgcgg

SEQ ID NO: 103608 - DNA, 20 bp, human
gaacatggcgatgcacaaca

SEQ ID NO: 103609 - DNA, 20 bp, human
gatggcgatgcacaacaagg

SEQ ID NO: 103610 - DNA, 20 bp, human
gcagctcccgccgggtgtcc

SEQ ID NO: 103611 - DNA, 20 bp, human
gggggagagggcgctaggaa

SEQ ID NO: 103612 - DNA, 20 bp, human
ggagcgtcagtgagccgcgg

SEQ ID NO: 103613 - DNA, 20 bp, human
ggcggcgccgccgcagatcc

SEQ ID NO: 103614 - DNA, 20 bp, human
gccctccacgccccctcctg

SEQ ID NO: 103615 - DNA, 20 bp, human
ggtcagtgagccgcgggggt

SEQ ID NO: 103616 - DNA, 20 bp, human
gcagatatgcaagatggcag

SEQ ID NO: 103617 - DNA, 20 bp, human
gggcacagcatgagatccaa

SEQ ID NO: 103618 - DNA, 20 bp, human
gggcgaccgggagcagagac

SEQ ID NO: 103619 - DNA, 20 bp, human
gcgggagcagagactggaac

SEQ ID NO: 103620 - DNA, 20 bp, human
gcggcgctgagatgttggag

SEQ ID NO: 103621 - DNA, 20 bp, human
gtgtctctagcgctccggga

SEQ ID NO: 103622 - DNA, 20 bp, human
gcgagtgtggattgagagaa

SEQ ID NO: 103623 - DNA, 20 bp, human
ggtctagcgcgcatgtgcga

SEQ ID NO: 103624 - DNA, 20 bp, human
gtggaaccggcaggttgctg

SEQ ID NO: 103625 - DNA, 20 bp, human
gagcatgagatccaaaggca

SEQ ID NO: 103626 - DNA, 20 bp, human
gcggcccaaagccccgagaa

SEQ ID NO: 103627 - DNA, 20 bp, human
ggagagcgcgatccagggag

SEQ ID NO: 103628 - DNA, 20 bp, human
gctccctcctctcggagaga

SEQ ID NO: 103629 - DNA, 20 bp, human
ggagcgcgcgcagccccgac

SEQ ID NO: 103630 - DNA, 20 bp, human
gccacagccctctctccgag

SEQ ID NO: 103631 - DNA, 20 bp, human
gagggggagagcgcgatcca

SEQ ID NO: 103632 - DNA, 20 bp, human
gagccccgacaggcgaaccc

SEQ ID NO: 103633 - DNA, 20 bp, human
gcccgcggggtcggacgaca

SEQ ID NO: 103634 - DNA, 20 bp, human
gcgcgcgcgctccctcctct

SEQ ID NO: 103635 - DNA, 20 bp, human
ggcggcggccattttccgga

SEQ ID NO: 103636 - DNA, 20 bp, human
ggtgggtctgcagtaccctg

SEQ ID NO: 103637 - DNA, 20 bp, human
gggtctgcagtaccctgtgg

SEQ ID NO: 103638 - DNA, 20 bp, human
gaggtagctgaagacccgag

SEQ ID NO: 103639 - DNA, 20 bp, human
gacccgagaggcaattatca

SEQ ID NO: 103640 - DNA, 20 bp, human
gttggttggagcgagcatgt

SEQ ID NO: 103641 - DNA, 20 bp, human
gggggttcgcacccgccaca

SEQ ID NO: 103642 - DNA, 20 bp, human
gtccgtgacagccagaagct

SEQ ID NO: 103643 - DNA, 20 bp, human
gcgtcaggctctgtgttggt

SEQ ID NO: 103644 - DNA, 20 bp, human
ggcgggtgcgaacccccgcc

SEQ ID NO: 103645 - DNA, 20 bp, human
gaacccccgcccggcagtgg

SEQ ID NO: 103646 - DNA, 20 bp, human
gatcaatctgaagtccccgg

SEQ ID NO: 103647 - DNA, 20 bp, human
ggagggggcgggacacaact

SEQ ID NO: 103648 - DNA, 20 bp, human
gccccggcggcaagaagaga

SEQ ID NO: 103649 - DNA, 20 bp, human
gatccttcccgggaagagta

SEQ ID NO: 103650 - DNA, 20 bp, human
gaagaagagaagggtgctcg

SEQ ID NO: 103651 - DNA, 20 bp, human
gcgagggtaagtgactgtag

SEQ ID NO: 103652 - DNA, 20 bp, human
gcctaaagtggtgggagacg

SEQ ID NO: 103653 - DNA, 20 bp, human
ggaagttccgttggggaaga

SEQ ID NO: 103654 - DNA, 20 bp, human
ggggcatagagtccaggaga

SEQ ID NO: 103655 - DNA, 20 bp, human
ggctctataatcaccaagga

SEQ ID NO: 103656 - DNA, 20 bp, human
ggagaagtttgaccacctag

SEQ ID NO: 103657 - DNA, 20 bp, human
gggccgggaagcgtgtgcta

SEQ ID NO: 103658 - DNA, 20 bp, human
ggagcgtagggccacgcctg

SEQ ID NO: 103659 - DNA, 20 bp, human
gctccaggtgctcctctagg

SEQ ID NO: 103660 - DNA, 20 bp, human
ggccatgacgacgtctccaa

SEQ ID NO: 103661 - DNA, 20 bp, human
gctaggggagcggggatcta

SEQ ID NO: 103662 - DNA, 20 bp, human
gagcaggaagcgggagcgta

SEQ ID NO: 103663 - DNA, 20 bp, human
gaaaggggcctcaaagaggt

SEQ ID NO: 103664 - DNA, 20 bp, human
ggctggcggggcacgagtag

SEQ ID NO: 103665 - DNA, 20 bp, human
ggagcacctggagaagttcg

SEQ ID NO: 103666 - DNA, 20 bp, human
gaacaagcgtcgcgtttctg

SEQ ID NO: 103667 - DNA, 20 bp, human
gtaacgagcggctcctagac

SEQ ID NO: 103668 - DNA, 20 bp, human
ggcttcagtgcaacacgtgg

SEQ ID NO: 103669 - DNA, 20 bp, human
gaccgacctgggtgaggtag

SEQ ID NO: 103670 - DNA, 20 bp, human
gaggtagccattatcactct

SEQ ID NO: 103671 - DNA, 20 bp, human
gctctcgttcgccaggctgt

SEQ ID NO: 103672 - DNA, 20 bp, human
gccaggtcggtgtgtctggg

SEQ ID NO: 103673 - DNA, 20 bp, human
ggcctagggagaggctacac

SEQ ID NO: 103674 - DNA, 20 bp, human
gaagcgtgaccgggctgcac

SEQ ID NO: 103675 - DNA, 20 bp, human
gcggctcctagaccggcagg

SEQ ID NO: 103676 - DNA, 20 bp, human
ggctggtgcctccggcgcta

SEQ ID NO: 103677 - DNA, 20 bp, human
gctgactgggggaacgggaa

SEQ ID NO: 103678 - DNA, 20 bp, human
gcggccgagagacaacaagg

SEQ ID NO: 103679 - DNA, 20 bp, human
gcggcggccgagagacaaca

SEQ ID NO: 103680 - DNA, 20 bp, human
ggcagggccaggctgactgg

SEQ ID NO: 103681 - DNA, 20 bp, human
gggagagggagccgaaaagg

SEQ ID NO: 103682 - DNA, 20 bp, human
ggcggtggttgagaggacgg

SEQ ID NO: 103683 - DNA, 20 bp, human
ggagcaaaagtcccgaaagg

SEQ ID NO: 103684 - DNA, 20 bp, human
gacgcggtcagcctaggagg

SEQ ID NO: 103685 - DNA, 20 bp, human
gaaagtgggctggcgtggga

SEQ ID NO: 103686 - DNA, 20 bp, human
gtcgcgctcccgggccgtgg

SEQ ID NO: 103687 - DNA, 20 bp, human
ggctcgccgcccccagacag

SEQ ID NO: 103688 - DNA, 20 bp, human
ggcccctggagggactgtaa

SEQ ID NO: 103689 - DNA, 20 bp, human
ggcagctacggtcccctcgg

SEQ ID NO: 103690 - DNA, 20 bp, human
ggccgtgggggcgagaacgc

SEQ ID NO: 103691 - DNA, 20 bp, human
gccctttacagtccctccag

SEQ ID NO: 103692 - DNA, 20 bp, human
ggagggggccgtgctcacgg

SEQ ID NO: 103693 - DNA, 20 bp, human
gggagcgcgagcttccgagt

SEQ ID NO: 103694 - DNA, 20 bp, human
ggaagtttgccactgtctgg

SEQ ID NO: 103695 - DNA, 20 bp, human
gtccgcagctacggtcccct

SEQ ID NO: 103696 - DNA, 20 bp, human
gggatggtgggttgtggcgc

SEQ ID NO: 103697 - DNA, 20 bp, human
gtcggaggcggcggtaatgg

SEQ ID NO: 103698 - DNA, 20 bp, human
gggcggtaatggcggatggt

SEQ ID NO: 103699 - DNA, 20 bp, human
gtggtcggaggcggcggtaa

SEQ ID NO: 103700 - DNA, 20 bp, human
ggccccgttcggcacgaagg

SEQ ID NO: 103701 - DNA, 20 bp, human
gttctctctctggtcggagg

SEQ ID NO: 103702 - DNA, 20 bp, human
gtggtgggttgtggcgccgg

SEQ ID NO: 103703 - DNA, 20 bp, human
gggacgagactacggtgaga

SEQ ID NO: 103704 - DNA, 20 bp, human
gaaacagagcccgggaccgt

SEQ ID NO: 103705 - DNA, 20 bp, human
gcagggatacagggccaata

SEQ ID NO: 103706 - DNA, 20 bp, human
gggagaagcgaggctgactg

SEQ ID NO: 103707 - DNA, 20 bp, human
gtcgcggaggatcatgactg

SEQ ID NO: 103708 - DNA, 20 bp, human
ggtcagagcaagcgagcccg

SEQ ID NO: 103709 - DNA, 20 bp, human
gcggtggctggagataaaca

SEQ ID NO: 103710 - DNA, 20 bp, human
gtggctggagataaacaagg

SEQ ID NO: 103711 - DNA, 20 bp, human
gtcgcttgctctgacagcaa

SEQ ID NO: 103712 - DNA, 20 bp, human
gcgaagccagcgggcgaccc

SEQ ID NO: 103713 - DNA, 20 bp, human
gactgcggcagcgaactggg

SEQ ID NO: 103714 - DNA, 20 bp, human
gctcaccagcgaaaagaggt

SEQ ID NO: 103715 - DNA, 20 bp, human
ggtgaccaagcgccagccaa

SEQ ID NO: 103716 - DNA, 20 bp, human
gcgcacggcttcctgttctg

SEQ ID NO: 103717 - DNA, 20 bp, human
gcaccgcgccgaaacgggag

SEQ ID NO: 103718 - DNA, 20 bp, human
ggccatggcggcgcaggacc

SEQ ID NO: 103719 - DNA, 20 bp, human
gcggtgaccgagcgcccggg

SEQ ID NO: 103720 - DNA, 20 bp, human
ggcggcccggcggtaggcgg

SEQ ID NO: 103721 - DNA, 20 bp, human
gggcgcaacggcacacgatg

SEQ ID NO: 103722 - DNA, 20 bp, human
gccccagggacaggagcgag

SEQ ID NO: 103723 - DNA, 20 bp, human
gcgccgggccgcctcagaac

SEQ ID NO: 103724 - DNA, 20 bp, human
gcgcgcgccgccggaaacca

SEQ ID NO: 103725 - DNA, 20 bp, human
ggaggcggcccggcggtagg

SEQ ID NO: 103726 - DNA, 20 bp, human
gcggccaagcgggatacggg

SEQ ID NO: 103727 - DNA, 20 bp, human
gtggcggccaagcgggatac

SEQ ID NO: 103728 - DNA, 20 bp, human
gggctctgtgactgaggcgg

SEQ ID NO: 103729 - DNA, 20 bp, human
gtacggcgccgggagacaga

SEQ ID NO: 103730 - DNA, 20 bp, human
gggcctcgcccgccacgcta

SEQ ID NO: 103731 - DNA, 20 bp, human
gtgggacccacgcaagtccc

SEQ ID NO: 103732 - DNA, 20 bp, human
gtcggccgaggcactgcgga

SEQ ID NO: 103733 - DNA, 20 bp, human
gctcgcccgccacgctaagg

SEQ ID NO: 103734 - DNA, 20 bp, human
gttcataagccagggctcgt

SEQ ID NO: 103735 - DNA, 20 bp, human
ggtccatgtcgggaacggag

SEQ ID NO: 103736 - DNA, 20 bp, human
gaggacagcagcgatcgcca

SEQ ID NO: 103737 - DNA, 20 bp, human
gcctggggcggggagacagg

SEQ ID NO: 103738 - DNA, 20 bp, human
gaacgagagttaaggaggga

SEQ ID NO: 103739 - DNA, 20 bp, human
gcaggtgccgcgctagtgcg

SEQ ID NO: 103740 - DNA, 20 bp, human
ggtgagtccccgcactagcg

SEQ ID NO: 103741 - DNA, 20 bp, human
ggagagaacgagagttaagg

SEQ ID NO: 103742 - DNA, 20 bp, human
gaggagagggaggatatgag

SEQ ID NO: 103743 - DNA, 20 bp, human
ggcggggactcactgagcct

SEQ ID NO: 103744 - DNA, 20 bp, human
ggctccactccggcgctctg

SEQ ID NO: 103745 - DNA, 20 bp, human
ggaggagagaacgagagtta

SEQ ID NO: 103746 - DNA, 20 bp, human
gttgttaccgaggaagatgg

SEQ ID NO: 103747 - DNA, 20 bp, human
gcgccagacccgaggcgcta

SEQ ID NO: 103748 - DNA, 20 bp, human
ggcgcttggtgggacttcgg

SEQ ID NO: 103749 - DNA, 20 bp, human
ggatggcggcgccagacccg

SEQ ID NO: 103750 - DNA, 20 bp, human
gctggcgccgccatcttcct

SEQ ID NO: 103751 - DNA, 20 bp, human
ggctagggaagatcgcaccg

SEQ ID NO: 103752 - DNA, 20 bp, human
gtggttgttaccgaggaaga

SEQ ID NO: 103753 - DNA, 20 bp, human
gaggcgactggttgttaccg

SEQ ID NO: 103754 - DNA, 20 bp, human
ggaggctgaaggcgcttggt

SEQ ID NO: 103755 - DNA, 20 bp, human
gcgatcttccctagcgcctc

SEQ ID NO: 103756 - DNA, 20 bp, human
ggtttcccgagggtcttctg

SEQ ID NO: 103757 - DNA, 20 bp, human
gggtgcctcagaagaccctc

SEQ ID NO: 103758 - DNA, 20 bp, human
ggcgttctgggaaagttgct

SEQ ID NO: 103759 - DNA, 20 bp, human
gaggaggcggcggggaccga

SEQ ID NO: 103760 - DNA, 20 bp, human
gtccgaaagacttaccgagg

SEQ ID NO: 103761 - DNA, 20 bp, human
gcgagggcgacgcgcaggag

SEQ ID NO: 103762 - DNA, 20 bp, human
gtgctccgaaagacttaccg

SEQ ID NO: 103763 - DNA, 20 bp, human
gctcctcggagcccgaaccc

SEQ ID NO: 103764 - DNA, 20 bp, human
gcaggacgacgaggaaggta

SEQ ID NO: 103765 - DNA, 20 bp, human
gtctgcgacatggacagcgg

SEQ ID NO: 103766 - DNA, 20 bp, human
gttggctggttgcaccgatc

SEQ ID NO: 103767 - DNA, 20 bp, human
gcttcccgggctcgggtaac

SEQ ID NO: 103768 - DNA, 20 bp, human
gtccgaccggaagtgagaag

SEQ ID NO: 103769 - DNA, 20 bp, human
ggcccgggaagcccccagat

SEQ ID NO: 103770 - DNA, 20 bp, human
gcaggcgggagaccacactg

SEQ ID NO: 103771 - DNA, 20 bp, human
gaggccggcggatcaactgg

SEQ ID NO: 103772 - DNA, 20 bp, human
ggaccggaagtgagaagagg

SEQ ID NO: 103773 - DNA, 20 bp, human
ggctcgggtaaccggagtgc

SEQ ID NO: 103774 - DNA, 20 bp, human
gagacactacagcctcaagg

SEQ ID NO: 103775 - DNA, 20 bp, human
gcgcgggtggatataattcc

SEQ ID NO: 103776 - DNA, 20 bp, human
ggccggggcggagggtacga

SEQ ID NO: 103777 - DNA, 20 bp, human
gggtacgatggagaatttca

SEQ ID NO: 103778 - DNA, 20 bp, human
gcacggagacagcgccgggg

SEQ ID NO: 103779 - DNA, 20 bp, human
gagacacggagacagcgccg

SEQ ID NO: 103780 - DNA, 20 bp, human
gggactgtggagccctaagt

SEQ ID NO: 103781 - DNA, 20 bp, human
ggcaaggccgagtactcacc

SEQ ID NO: 103782 - DNA, 20 bp, human
gcggaggtgcgaggtaacct

SEQ ID NO: 103783 - DNA, 20 bp, human
gaaattaccaacggcagaca

SEQ ID NO: 103784 - DNA, 20 bp, human
gcctggtccgaagccgagtg

SEQ ID NO: 103785 - DNA, 20 bp, human
gctaagtcggaagcgctgtt

SEQ ID NO: 103786 - DNA, 20 bp, human
gagctgagggagatgtcctc

SEQ ID NO: 103787 - DNA, 20 bp, human
gaatcacacagtagaaacgc

SEQ ID NO: 103788 - DNA, 20 bp, human
ggagtttctgtgggcggaca

SEQ ID NO: 103789 - DNA, 20 bp, human
gctgagacagaaggttgtgt

SEQ ID NO: 103790 - DNA, 20 bp, human
gccatggcgtcgggccagga

SEQ ID NO: 103791 - DNA, 20 bp, human
gctcgggttgtgtagatgag

SEQ ID NO: 103792 - DNA, 20 bp, human
gcgacgccatgggagtgact

SEQ ID NO: 103793 - DNA, 20 bp, human
gggggaacccgcagcccgga

SEQ ID NO: 103794 - DNA, 20 bp, human
gagatgagaggatgccgtcc

SEQ ID NO: 103795 - DNA, 20 bp, human
gctctgaggaaacaagcccg

SEQ ID NO: 103796 - DNA, 20 bp, human
gcggtaggaacatggcggat

SEQ ID NO: 103797 - DNA, 20 bp, human
gtgctgcggtaggaacatgg

SEQ ID NO: 103798 - DNA, 20 bp, human
gggacgctgtgaattcggtg

SEQ ID NO: 103799 - DNA, 20 bp, human
gggcgccaccgcgaactcgg

SEQ ID NO: 103800 - DNA, 20 bp, human
gcataaagcgctctctcggg

SEQ ID NO: 103801 - DNA, 20 bp, human
gcttcaggacgctgtgaatt

SEQ ID NO: 103802 - DNA, 20 bp, human
gagcatgagatctcccttgg

SEQ ID NO: 103803 - DNA, 20 bp, human
gcagagcatgagatctccct

SEQ ID NO: 103804 - DNA, 20 bp, human
gtggtggattaaaattgatg

SEQ ID NO: 103805 - DNA, 20 bp, human
gcggcataaagcgctctctc

SEQ ID NO: 103806 - DNA, 20 bp, human
ggaggctgcggcggctgact

SEQ ID NO: 103807 - DNA, 20 bp, human
ggtctggtgtgcgggcgctg

SEQ ID NO: 103808 - DNA, 20 bp, human
ggccagactccgaacctagg

SEQ ID NO: 103809 - DNA, 20 bp, human
ggcgccgaggccgtccagtg

SEQ ID NO: 103810 - DNA, 20 bp, human
gagtctggcgcacgaccgag

SEQ ID NO: 103811 - DNA, 20 bp, human
gcggggaagagagactgcgg

SEQ ID NO: 103812 - DNA, 20 bp, human
ggcgcaccggggaaccatga

SEQ ID NO: 103813 - DNA, 20 bp, human
gaagagagactgcggcggga

SEQ ID NO: 103814 - DNA, 20 bp, human
ggcacgaccgagcggactcc

SEQ ID NO: 103815 - DNA, 20 bp, human
gcccacaccccgccaaaaat

SEQ ID NO: 103816 - DNA, 20 bp, human
gaagcgacgccgaggagcta

SEQ ID NO: 103817 - DNA, 20 bp, human
gactcgagctctgggaatat

SEQ ID NO: 103818 - DNA, 20 bp, human
ggcagaggggcggagacctc

SEQ ID NO: 103819 - DNA, 20 bp, human
gggaggaaaccgtagctcct

SEQ ID NO: 103820 - DNA, 20 bp, human
gctgttggctgggctcggga

SEQ ID NO: 103821 - DNA, 20 bp, human
gtgccggccatccaggacta

SEQ ID NO: 103822 - DNA, 20 bp, human
ggagctacggtttcctccag

SEQ ID NO: 103823 - DNA, 20 bp, human
ggctccaggtaaagcgctgg

SEQ ID NO: 103824 - DNA, 20 bp, human
gccaggtaaagcgctggggg

SEQ ID NO: 103825 - DNA, 20 bp, human
gtgtaatacttggctaaggg

SEQ ID NO: 103826 - DNA, 20 bp, human
ggatgcctaccacctagaac

SEQ ID NO: 103827 - DNA, 20 bp, human
gcacctagaactggattgtg

SEQ ID NO: 103828 - DNA, 20 bp, human
gcaatccagttctaggtggt

SEQ ID NO: 103829 - DNA, 20 bp, human
gtaccgcacaatccagttct

SEQ ID NO: 103830 - DNA, 20 bp, human
gacagggcatcaaggagtta

SEQ ID NO: 103831 - DNA, 20 bp, human
gcaaggagttaaggcagtcc

SEQ ID NO: 103832 - DNA, 20 bp, human
gtgtgcggtaggcttaaatt

SEQ ID NO: 103833 - DNA, 20 bp, human
gtagagctaagggcgtaatt

SEQ ID NO: 103834 - DNA, 20 bp, human
ggggactaatagattaaaca

SEQ ID NO: 103835 - DNA, 20 bp, human
gtagattaaacagggcatca

SEQ ID NO: 103836 - DNA, 20 bp, human
ggcgggtaccgcacggggta

SEQ ID NO: 103837 - DNA, 20 bp, human
gccggggaccataccccgtg

SEQ ID NO: 103838 - DNA, 20 bp, human
gcattccgcggcgtcggctg

SEQ ID NO: 103839 - DNA, 20 bp, human
ggtatggtccccgggtccga

SEQ ID NO: 103840 - DNA, 20 bp, human
ggtggtggcgggtaccgcac

SEQ ID NO: 103841 - DNA, 20 bp, human
ggaagtgaaaggtcggagtc

SEQ ID NO: 103842 - DNA, 20 bp, human
gctgctgagacggacttcgg

SEQ ID NO: 103843 - DNA, 20 bp, human
gtgcggagcccctcgaagta

SEQ ID NO: 103844 - DNA, 20 bp, human
ggtctggactccttgttctg

SEQ ID NO: 103845 - DNA, 20 bp, human
gcgcatttctgctcattccg

SEQ ID NO: 103846 - DNA, 20 bp, human
gccgccgccgccaccaaagg

SEQ ID NO: 103847 - DNA, 20 bp, human
gcccgggcccgagaagcgag

SEQ ID NO: 103848 - DNA, 20 bp, human
ggatggcagcggccctcgag

SEQ ID NO: 103849 - DNA, 20 bp, human
ggggccgccgccgccaccaa

SEQ ID NO: 103850 - DNA, 20 bp, human
gtggagtttggttctcgagg

SEQ ID NO: 103851 - DNA, 20 bp, human
ggcccgagaagcgagaggca

SEQ ID NO: 103852 - DNA, 20 bp, human
gctcgcccaggcaatgacag

SEQ ID NO: 103853 - DNA, 20 bp, human
gggcgcccacctcccctcga

SEQ ID NO: 103854 - DNA, 20 bp, human
gagtttggttctcgaggcgg

SEQ ID NO: 103855 - DNA, 20 bp, human
gcactggagtttggttctcg

SEQ ID NO: 103856 - DNA, 20 bp, human
gcacagcagctctccaaagc

SEQ ID NO: 103857 - DNA, 20 bp, human
ggaagactcgagcgacgtag

SEQ ID NO: 103858 - DNA, 20 bp, human
gcgggacctcaagtaggtac

SEQ ID NO: 103859 - DNA, 20 bp, human
gggttccattcctaacaagg

SEQ ID NO: 103860 - DNA, 20 bp, human
gaatggaaccgccacagaag

SEQ ID NO: 103861 - DNA, 20 bp, human
gccatcctcgacctcttctg

SEQ ID NO: 103862 - DNA, 20 bp, human
ggaagcaagacgagaaagcg

SEQ ID NO: 103863 - DNA, 20 bp, human
gtaagatgtccctgagggac

SEQ ID NO: 103864 - DNA, 20 bp, human
gcgaccccggccccttcagc

SEQ ID NO: 103865 - DNA, 20 bp, human
gttgcttgcgaagccggctt

SEQ ID NO: 103866 - DNA, 20 bp, human
gcagccacccggtccccctc

SEQ ID NO: 103867 - DNA, 20 bp, human
ggggcctgagggggaccggg

SEQ ID NO: 103868 - DNA, 20 bp, human
gaacatggcggctccactag

SEQ ID NO: 103869 - DNA, 20 bp, human
gcggggatgagactaaggac

SEQ ID NO: 103870 - DNA, 20 bp, human
gtgcgccattccaaacatgg

SEQ ID NO: 103871 - DNA, 20 bp, human
ggaccggctgggaatctgga

SEQ ID NO: 103872 - DNA, 20 bp, human
gtaaggaccggctgggaatc

SEQ ID NO: 103873 - DNA, 20 bp, human
gatgagactaaggaccggct

SEQ ID NO: 103874 - DNA, 20 bp, human
gggagccgccatgtttggaa

SEQ ID NO: 103875 - DNA, 20 bp, human
ggtgctcggggatgagacta

SEQ ID NO: 103876 - DNA, 20 bp, human
gagtcgtaacgcacttccgg

SEQ ID NO: 103877 - DNA, 20 bp, human
gcagctgaaggagagtctac

SEQ ID NO: 103878 - DNA, 20 bp, human
gtcttcctcgcgtagaccgc

SEQ ID NO: 103879 - DNA, 20 bp, human
gtcctcagctgctggtgtat

SEQ ID NO: 103880 - DNA, 20 bp, human
ggggatgctgaaaagcaacg

SEQ ID NO: 103881 - DNA, 20 bp, human
gacttccggcggtctacgcg

SEQ ID NO: 103882 - DNA, 20 bp, human
gccgggccgccagccgaact

SEQ ID NO: 103883 - DNA, 20 bp, human
gtgctgcaggaggccgctct

SEQ ID NO: 103884 - DNA, 20 bp, human
gcgcagtcgtaacgcacttc

SEQ ID NO: 103885 - DNA, 20 bp, human
gggtgtatcgggtcctagtt

SEQ ID NO: 103886 - DNA, 20 bp, human
ggacgccgtgttgacttccc

SEQ ID NO: 103887 - DNA, 20 bp, human
gctgcagcttcaggccggaa

SEQ ID NO: 103888 - DNA, 20 bp, human
gggctgtggggcctcagcgt

SEQ ID NO: 103889 - DNA, 20 bp, human
ggggtctgcccggaattggg

SEQ ID NO: 103890 - DNA, 20 bp, human
gcactgtctcctgcccgatg

SEQ ID NO: 103891 - DNA, 20 bp, human
gtcacagtgggcggaagtcg

SEQ ID NO: 103892 - DNA, 20 bp, human
gcagcttgagagaccccccg

SEQ ID NO: 103893 - DNA, 20 bp, human
ggccgcccgggaagtcaaca

SEQ ID NO: 103894 - DNA, 20 bp, human
ggcagccccgatgacatcca

SEQ ID NO: 103895 - DNA, 20 bp, human
gcccgacgcggccaacggag

SEQ ID NO: 103896 - DNA, 20 bp, human
ggaacttcgcccgcgtctct

SEQ ID NO: 103897 - DNA, 20 bp, human
ggtctccatagcgacagcag

SEQ ID NO: 103898 - DNA, 20 bp, human
ggagcaaaagcccagagacg

SEQ ID NO: 103899 - DNA, 20 bp, human
ggcagaatgatacacaagtc

SEQ ID NO: 103900 - DNA, 20 bp, human
ggtagcgtctagaaagacta

SEQ ID NO: 103901 - DNA, 20 bp, human
gcctggcgtgggtgagacta

SEQ ID NO: 103902 - DNA, 20 bp, human
gagcagaaaaccaatcaagg

SEQ ID NO: 103903 - DNA, 20 bp, human
ggcgacgatatttcaaactt

SEQ ID NO: 103904 - DNA, 20 bp, human
gatggccgctgctgtcgcta

SEQ ID NO: 103905 - DNA, 20 bp, human
gccctgccaagagtaaggcc

SEQ ID NO: 103906 - DNA, 20 bp, human
gtggtaacagcacacgagag

SEQ ID NO: 103907 - DNA, 20 bp, human
gtcgttctcggggttcggcg

SEQ ID NO: 103908 - DNA, 20 bp, human
gtggctggccgcggacgaag

SEQ ID NO: 103909 - DNA, 20 bp, human
gaaatggctgcgtcttcgag

SEQ ID NO: 103910 - DNA, 20 bp, human
gttggggagacggtagtgaa

SEQ ID NO: 103911 - DNA, 20 bp, human
ggcgtcttcgagtggtgaga

SEQ ID NO: 103912 - DNA, 20 bp, human
gacggtagtgaagggtagac

SEQ ID NO: 103913 - DNA, 20 bp, human
gtttatggaacgctccttgg

SEQ ID NO: 103914 - DNA, 20 bp, human
gttccccagagtcccgccac

SEQ ID NO: 103915 - DNA, 20 bp, human
gaggtcctgtctaggtaatg

SEQ ID NO: 103916 - DNA, 20 bp, human
gcgtttacaggttctctttc

SEQ ID NO: 103917 - DNA, 20 bp, human
gctcggaattatggcggcgg

SEQ ID NO: 103918 - DNA, 20 bp, human
gtggcggcggtggatatccg

SEQ ID NO: 103919 - DNA, 20 bp, human
gtggcgcggtctaaagaatt

SEQ ID NO: 103920 - DNA, 20 bp, human
gtcatgctcagggacccgtg

SEQ ID NO: 103921 - DNA, 20 bp, human
gaacgctctcggaattatgg

SEQ ID NO: 103922 - DNA, 20 bp, human
gatggcgtttaggcagagaa

SEQ ID NO: 103923 - DNA, 20 bp, human
gtggaagcgtcggagagaag

SEQ ID NO: 103924 - DNA, 20 bp, human
gatagcaatacagtatacct

SEQ ID NO: 103925 - DNA, 20 bp, human
ggctctcggaattatggcgg

SEQ ID NO: 103926 - DNA, 20 bp, human
ggctcggcgtcccaacacgg

SEQ ID NO: 103927 - DNA, 20 bp, human
gtgaggtaagtgggcggcaa

SEQ ID NO: 103928 - DNA, 20 bp, human
gcgcactctcggagagactc

SEQ ID NO: 103929 - DNA, 20 bp, human
gtcgtcaggtccatctggag

SEQ ID NO: 103930 - DNA, 20 bp, human
gggctgagttcggcctccaa

SEQ ID NO: 103931 - DNA, 20 bp, human
gctgctcccagaagaaggaa

SEQ ID NO: 103932 - DNA, 20 bp, human
gtgagttcggcctccaaagg

SEQ ID NO: 103933 - DNA, 20 bp, human
gggtctctccgagagcgcgg

SEQ ID NO: 103934 - DNA, 20 bp, human
ggactaagtcagtaaaagag

SEQ ID NO: 103935 - DNA, 20 bp, human
ggaagacgacagacattcca

SEQ ID NO: 103936 - DNA, 20 bp, human
ggctggcaagcttcgggtac

SEQ ID NO: 103937 - DNA, 20 bp, human
gcgttgggcgtactagcggc

SEQ ID NO: 103938 - DNA, 20 bp, human
ggagcggcggcgattagagg

SEQ ID NO: 103939 - DNA, 20 bp, human
gcggcggcgattagaggtgg

SEQ ID NO: 103940 - DNA, 20 bp, human
ggcctcggccgccgcaatgc

SEQ ID NO: 103941 - DNA, 20 bp, human
ggttgcgttgggcgtactag

SEQ ID NO: 103942 - DNA, 20 bp, human
gcgggagcggcggcgattag

SEQ ID NO: 103943 - DNA, 20 bp, human
gcaagcagtgagggaattgt

SEQ ID NO: 103944 - DNA, 20 bp, human
gtgcctgacaggagacagtc

SEQ ID NO: 103945 - DNA, 20 bp, human
gaggctaattggagcgggag

SEQ ID NO: 103946 - DNA, 20 bp, human
gcttttggcgacccgacctc

SEQ ID NO: 103947 - DNA, 20 bp, human
ggcagcggctggtcggacgt

SEQ ID NO: 103948 - DNA, 20 bp, human
gggtaggttagccagaggtc

SEQ ID NO: 103949 - DNA, 20 bp, human
gcctctggctaacctacccc

SEQ ID NO: 103950 - DNA, 20 bp, human
gtaacctacccccggagcca

SEQ ID NO: 103951 - DNA, 20 bp, human
ggtgtcaggcagcggctggt

SEQ ID NO: 103952 - DNA, 20 bp, human
ggcagccgggcgacaggcgg

SEQ ID NO: 103953 - DNA, 20 bp, human
ggcggctggtcggacgttgg

SEQ ID NO: 103954 - DNA, 20 bp, human
gtcacctgcccgcgcgaggg

SEQ ID NO: 103955 - DNA, 20 bp, human
gagaagctggagggagtatg

SEQ ID NO: 103956 - DNA, 20 bp, human
gggtgccagtctgaccgccc

SEQ ID NO: 103957 - DNA, 20 bp, human
ggccagtctgaccgcccggg

SEQ ID NO: 103958 - DNA, 20 bp, human
gtcccagcgagtggcagctt

SEQ ID NO: 103959 - DNA, 20 bp, human
gcggcctcgtgcgcctcgac

SEQ ID NO: 103960 - DNA, 20 bp, human
ggccgcccgggcggtcagac

SEQ ID NO: 103961 - DNA, 20 bp, human
gagcggcgaccagctcgtgg

SEQ ID NO: 103962 - DNA, 20 bp, human
gaggcaccgcgcggagaaag

SEQ ID NO: 103963 - DNA, 20 bp, human
gtcccaagctgccactcgct

SEQ ID NO: 103964 - DNA, 20 bp, human
gtctccgcgcggtgcctgca

SEQ ID NO: 103965 - DNA, 20 bp, human
ggcggtagagctgcccgtcg

SEQ ID NO: 103966 - DNA, 20 bp, human
gcggcgcgaagcgctggtgg

SEQ ID NO: 103967 - DNA, 20 bp, human
gtgaaagaggcggctccggg

SEQ ID NO: 103968 - DNA, 20 bp, human
gccccaccggcccgccctca

SEQ ID NO: 103969 - DNA, 20 bp, human
ggccagctgctccggagata

SEQ ID NO: 103970 - DNA, 20 bp, human
ggatccgtgcgcggatgtcc

SEQ ID NO: 103971 - DNA, 20 bp, human
gcggatgtcccggcgagtcc

SEQ ID NO: 103972 - DNA, 20 bp, human
ggagccccatccagccccac

SEQ ID NO: 103973 - DNA, 20 bp, human
gctaggcgcccggggaggtg

SEQ ID NO: 103974 - DNA, 20 bp, human
gctgaggagctaggcgcccg

SEQ ID NO: 103975 - DNA, 20 bp, human
gcgcgcacggatccccacac

SEQ ID NO: 103976 - DNA, 20 bp, human
gggctcctccatagcgaccg

SEQ ID NO: 103977 - DNA, 20 bp, human
gcctgcgggcgggacagagg

SEQ ID NO: 103978 - DNA, 20 bp, human
gcgctcggccgcggtcgcta

SEQ ID NO: 103979 - DNA, 20 bp, human
ggaccgcggccgagcgaacc

SEQ ID NO: 103980 - DNA, 20 bp, human
ggcgaaccgggaaacggcac

SEQ ID NO: 103981 - DNA, 20 bp, human
gttcccggttcgctcggccg

SEQ ID NO: 103982 - DNA, 20 bp, human
gaggcgggcgtcccaacctc

SEQ ID NO: 103983 - DNA, 20 bp, human
gccggtaattaaagcagaca

SEQ ID NO: 103984 - DNA, 20 bp, human
gagacacggagcctttctac

SEQ ID NO: 103985 - DNA, 20 bp, human
ggggccggtaacttgtggag

SEQ ID NO: 103986 - DNA, 20 bp, human
ggggcgtctggaacttaaag

SEQ ID NO: 103987 - DNA, 20 bp, human
gggctcctccatagcgaccg

SEQ ID NO: 103988 - DNA, 20 bp, human
gcctgcgggcgggacagagg

SEQ ID NO: 103989 - DNA, 20 bp, human
gtctcaagaagaagaagtag

SEQ ID NO: 103990 - DNA, 20 bp, human
gccggcttcgggtagatggg

SEQ ID NO: 103991 - DNA, 20 bp, human
ggctccggcttcgggtagat

SEQ ID NO: 103992 - DNA, 20 bp, human
ggcgaaccgggaaacggcac

SEQ ID NO: 103993 - DNA, 20 bp, human
ggaccgcggccgagcgaacc

SEQ ID NO: 103994 - DNA, 20 bp, human
gcgctcggccgcggtcgcta

SEQ ID NO: 103995 - DNA, 20 bp, human
ggaagtaggggaagtacgcg

SEQ ID NO: 103996 - DNA, 20 bp, human
gggctcctccatagcgaccg

SEQ ID NO: 103997 - DNA, 20 bp, human
gcctgcgggcgggacagagg

SEQ ID NO: 103998 - DNA, 20 bp, human
gcgctcggccgcggtcgcta

SEQ ID NO: 103999 - DNA, 20 bp, human
ggaccgcggccgagcgaacc

SEQ ID NO: 104000 - DNA, 20 bp, human
ggcgaaccgggaaacggcac

SEQ ID NO: 104001 - DNA, 20 bp, human
gttcccggttcgctcggccg

SEQ ID NO: 104002 - DNA, 20 bp, human
gaggcgggcgtcccaacctc

SEQ ID NO: 104003 - DNA, 20 bp, human
gccggtaattaaagcagaca

SEQ ID NO: 104004 - DNA, 20 bp, human
gagacacggagcctttctac

SEQ ID NO: 104005 - DNA, 20 bp, human
ggggccggtaacttgtggag

SEQ ID NO: 104006 - DNA, 20 bp, human
gggttctgtgtgggtcgccg

SEQ ID NO: 104007 - DNA, 20 bp, human
gcgccgaggccgctcggaag

SEQ ID NO: 104008 - DNA, 20 bp, human
gtagcagcccgaagatgtct

SEQ ID NO: 104009 - DNA, 20 bp, human
ggcgtacacccagacatctt

SEQ ID NO: 104010 - DNA, 20 bp, human
gggtgtgacaggaacgagtc

SEQ ID NO: 104011 - DNA, 20 bp, human
gcccaaggactaatctgatc

SEQ ID NO: 104012 - DNA, 20 bp, human
gatcaggggtacttacatga

SEQ ID NO: 104013 - DNA, 20 bp, human
gaagaaaggaaaatatccca

SEQ ID NO: 104014 - DNA, 20 bp, human
ggactttgaaggttctgtgt

SEQ ID NO: 104015 - DNA, 20 bp, human
ggagtgatttcaatagctga

SEQ ID NO: 104016 - DNA, 20 bp, human
gcgggagtcgaggccgacgt

SEQ ID NO: 104017 - DNA, 20 bp, human
ggggctggaggagttacctt

SEQ ID NO: 104018 - DNA, 20 bp, human
gtcctcctttcgggctccaa

SEQ ID NO: 104019 - DNA, 20 bp, human
gacctttggagcccgaaagg

SEQ ID NO: 104020 - DNA, 20 bp, human
gcaacccctggaccgggtgg

SEQ ID NO: 104021 - DNA, 20 bp, human
gctccagcccccgggagtcg

SEQ ID NO: 104022 - DNA, 20 bp, human
gtgaagatcccccggaccag

SEQ ID NO: 104023 - DNA, 20 bp, human
gaggcctgggcccccgtcgt

SEQ ID NO: 104024 - DNA, 20 bp, human
ggttacctttggagcccgaa

SEQ ID NO: 104025 - DNA, 20 bp, human
gatatcaacaacagccgagg

SEQ ID NO: 104026 - DNA, 20 bp, human
gggacagcagatggtcacta

SEQ ID NO: 104027 - DNA, 20 bp, human
gagcagctcactctgacctg

SEQ ID NO: 104028 - DNA, 20 bp, human
gctggccgaggagctccaca

SEQ ID NO: 104029 - DNA, 20 bp, human
gtcactaggggtcttagcca

SEQ ID NO: 104030 - DNA, 20 bp, human
gtcttgctcaccaaggacag

SEQ ID NO: 104031 - DNA, 20 bp, human
gcactcagcactggatgagg

SEQ ID NO: 104032 - DNA, 20 bp, human
gctaccagaagccagacagc

SEQ ID NO: 104033 - DNA, 20 bp, human
gcctggggattgggagtctc

SEQ ID NO: 104034 - DNA, 20 bp, human
ggcgtactcttccccatagt

SEQ ID NO: 104035 - DNA, 20 bp, human
gatggcccgcaggacctgca

SEQ ID NO: 104036 - DNA, 20 bp, human
ggtttgcccaactcttaccc

SEQ ID NO: 104037 - DNA, 20 bp, human
gtgcgcaaaactgggcgact

SEQ ID NO: 104038 - DNA, 20 bp, human
gaggtggagaagcgggaaag

SEQ ID NO: 104039 - DNA, 20 bp, human
gggattgtgtaggaaaatcc

SEQ ID NO: 104040 - DNA, 20 bp, human
gtttcccggtgcgcaaaact

SEQ ID NO: 104041 - DNA, 20 bp, human
gttgttacatgggattgtgt

SEQ ID NO: 104042 - DNA, 20 bp, human
ggcgtgaggtggggcgagat

SEQ ID NO: 104043 - DNA, 20 bp, human
gcggggtgcggcgtgaggtg

SEQ ID NO: 104044 - DNA, 20 bp, human
gtgggcaaactcaactccgg

SEQ ID NO: 104045 - DNA, 20 bp, human
gcggcgtccggccaaggtcc

SEQ ID NO: 104046 - DNA, 20 bp, human
gatgtagggcgcctcaatgt

SEQ ID NO: 104047 - DNA, 20 bp, human
gggtcttcccccgcacgtgg

SEQ ID NO: 104048 - DNA, 20 bp, human
gcccgcacgtggaggcgccg

SEQ ID NO: 104049 - DNA, 20 bp, human
ggctgcggctgcccacattg

SEQ ID NO: 104050 - DNA, 20 bp, human
gagtcgggatgcagcgtccg

SEQ ID NO: 104051 - DNA, 20 bp, human
ggcgccgcgccactgctctc

SEQ ID NO: 104052 - DNA, 20 bp, human
gcatcccgactgcggccgga

SEQ ID NO: 104053 - DNA, 20 bp, human
ggccggccgcgggagcaggt

SEQ ID NO: 104054 - DNA, 20 bp, human
gagacccgagagcagtggcg

SEQ ID NO: 104055 - DNA, 20 bp, human
gtacatcctgccggaccccc

SEQ ID NO: 104056 - DNA, 20 bp, human
gcccggcgatcaggtctccg

SEQ ID NO: 104057 - DNA, 20 bp, human
gtcggagctcggtccaccac

SEQ ID NO: 104058 - DNA, 20 bp, human
ggtccaccacgggcctccag

SEQ ID NO: 104059 - DNA, 20 bp, human
gccgcctgtgagccggagag

SEQ ID NO: 104060 - DNA, 20 bp, human
gcgcgcccaaagtggcaccg

SEQ ID NO: 104061 - DNA, 20 bp, human
gaccgcggagacctgatcgc

SEQ ID NO: 104062 - DNA, 20 bp, human
ggccggggcgagttcctgca

SEQ ID NO: 104063 - DNA, 20 bp, human
gagccccagggacaaagcct

SEQ ID NO: 104064 - DNA, 20 bp, human
gtttccaggctctgagtccg

SEQ ID NO: 104065 - DNA, 20 bp, human
ggggctcggccggtcgtcca

SEQ ID NO: 104066 - DNA, 20 bp, human
gggggacccacccgtctata

SEQ ID NO: 104067 - DNA, 20 bp, human
gccggcaggagcctccatag

SEQ ID NO: 104068 - DNA, 20 bp, human
ggccagatcagagagacgag

SEQ ID NO: 104069 - DNA, 20 bp, human
gcggcccgcagcctctatgg

SEQ ID NO: 104070 - DNA, 20 bp, human
ggcagtcccggcgaagggta

SEQ ID NO: 104071 - DNA, 20 bp, human
ggccgaaccctagggaccgt

SEQ ID NO: 104072 - DNA, 20 bp, human
gcctccctccgaagccggat

SEQ ID NO: 104073 - DNA, 20 bp, human
ggacaggctctggaagccga

SEQ ID NO: 104074 - DNA, 20 bp, human
gtggcccatccggcttcgga

SEQ ID NO: 104075 - DNA, 20 bp, human
gggccttccatcgctctata

SEQ ID NO: 104076 - DNA, 20 bp, human
ggcggcggcgcagcacaaca

SEQ ID NO: 104077 - DNA, 20 bp, human
gccgagcggcgcctgaaagg

SEQ ID NO: 104078 - DNA, 20 bp, human
gctggagaagtcgcagccag

SEQ ID NO: 104079 - DNA, 20 bp, human
gtgtcagagggaggtggcga

SEQ ID NO: 104080 - DNA, 20 bp, human
gagcggcgcctgaaaggtgg

SEQ ID NO: 104081 - DNA, 20 bp, human
gcgtgggagccgtcgcccta

SEQ ID NO: 104082 - DNA, 20 bp, human
ggagccgtcgccctagggaa

SEQ ID NO: 104083 - DNA, 20 bp, human
gctggtcggcgcctgagagg

SEQ ID NO: 104084 - DNA, 20 bp, human
gccagcagtcgcccaaagag

SEQ ID NO: 104085 - DNA, 20 bp, human
ggccaggggtcggtggacgg

SEQ ID NO: 104086 - DNA, 20 bp, human
ggccagtggaccgggctcca

SEQ ID NO: 104087 - DNA, 20 bp, human
gagactgggtgaggtcccgg

SEQ ID NO: 104088 - DNA, 20 bp, human
gggcgacggcgggcactccc

SEQ ID NO: 104089 - DNA, 20 bp, human
gagagtgccgcctcagctga

SEQ ID NO: 104090 - DNA, 20 bp, human
gaaggtgtgtccctgagact

SEQ ID NO: 104091 - DNA, 20 bp, human
gccgaatccccgggaaatgg

SEQ ID NO: 104092 - DNA, 20 bp, human
gcctcagctgagggcaagcg

SEQ ID NO: 104093 - DNA, 20 bp, human
gtccgtggagcccggtccac

SEQ ID NO: 104094 - DNA, 20 bp, human
gctttcaggcgcagagccag

SEQ ID NO: 104095 - DNA, 20 bp, human
gcagaaggcggaaggcggga

SEQ ID NO: 104096 - DNA, 20 bp, human
gtgggtggatgcgtcgctgg

SEQ ID NO: 104097 - DNA, 20 bp, human
gggatgcgtcgctggaggcg

SEQ ID NO: 104098 - DNA, 20 bp, human
ggagacgcgagggtcgcgaa

SEQ ID NO: 104099 - DNA, 20 bp, human
gtcgcgaagggcacaacact

SEQ ID NO: 104100 - DNA, 20 bp, human
gccagtagagccggacccag

SEQ ID NO: 104101 - DNA, 20 bp, human
ggcgttactaagagacgcga

SEQ ID NO: 104102 - DNA, 20 bp, human
gctctcgctggccctgctcg

SEQ ID NO: 104103 - DNA, 20 bp, human
gttaggggccgcgtctccga

SEQ ID NO: 104104 - DNA, 20 bp, human
gaagccaatggggtccgggg

SEQ ID NO: 104105 - DNA, 20 bp, human
gatcggagccctcggagacg

SEQ ID NO: 104106 - DNA, 20 bp, human
ggcttctccacaggacgctc

SEQ ID NO: 104107 - DNA, 20 bp, human
gcgcttcgcggcttctccac

SEQ ID NO: 104108 - DNA, 20 bp, human
gctgtggcccgagcgtcctg

SEQ ID NO: 104109 - DNA, 20 bp, human
gcggccgtcgcacctgcacg

SEQ ID NO: 104110 - DNA, 20 bp, human
gtcgcacctgcacgaggctg

SEQ ID NO: 104111 - DNA, 20 bp, human
ggcgagcctcgggtaagcag

SEQ ID NO: 104112 - DNA, 20 bp, human
gccgggtcgcccgcgcttcg

SEQ ID NO: 104113 - DNA, 20 bp, human
ggggcggagtcgctgaggac

SEQ ID NO: 104114 - DNA, 20 bp, human
gcaggtccgcgaggccgcgg

SEQ ID NO: 104115 - DNA, 20 bp, human
gtggggcggcgtccgaggaa

SEQ ID NO: 104116 - DNA, 20 bp, human
gacgcacggggactgcaagc

SEQ ID NO: 104117 - DNA, 20 bp, human
ggtttccaagacagcagcgg

SEQ ID NO: 104118 - DNA, 20 bp, human
gactggaaggagattagaga

SEQ ID NO: 104119 - DNA, 20 bp, human
gtcaagggaagcgagcgcta

SEQ ID NO: 104120 - DNA, 20 bp, human
gtttggtagttgggtctgag

SEQ ID NO: 104121 - DNA, 20 bp, human
ggtgtgttgcacaggcggag

SEQ ID NO: 104122 - DNA, 20 bp, human
gcgggttctagcattctggt

SEQ ID NO: 104123 - DNA, 20 bp, human
gtgctagaacccggaagtag

SEQ ID NO: 104124 - DNA, 20 bp, human
gaaagtgtgtgttgcacagg

SEQ ID NO: 104125 - DNA, 20 bp, human
gacacactttacacacgcac

SEQ ID NO: 104126 - DNA, 20 bp, human
ggagagacaaaatacctacc

SEQ ID NO: 104127 - DNA, 20 bp, human
gttattgaagagcctcagtt

SEQ ID NO: 104128 - DNA, 20 bp, human
gtacggcggagacacatccc

SEQ ID NO: 104129 - DNA, 20 bp, human
gcggcgggagaacgaaatga

SEQ ID NO: 104130 - DNA, 20 bp, human
ggtggccatagcccgtcgta

SEQ ID NO: 104131 - DNA, 20 bp, human
ggacccgcgccgccaaactg

SEQ ID NO: 104132 - DNA, 20 bp, human
ggccatagcccgtcgtacgg

SEQ ID NO: 104133 - DNA, 20 bp, human
gggagacacatcccgggagt

SEQ ID NO: 104134 - DNA, 20 bp, human
gcgcactcgttgcatatcag

SEQ ID NO: 104135 - DNA, 20 bp, human
ggcatatcagaggctcggcg

SEQ ID NO: 104136 - DNA, 20 bp, human
gcccggggcgacggagggtc

SEQ ID NO: 104137 - DNA, 20 bp, human
ggacacaccggggaccgcag

SEQ ID NO: 104138 - DNA, 20 bp, human
gcaacaccgcgggccgtcag

SEQ ID NO: 104139 - DNA, 20 bp, human
ggcccggagggtaggtctcg

SEQ ID NO: 104140 - DNA, 20 bp, human
gcctcagcccatggcccgga

SEQ ID NO: 104141 - DNA, 20 bp, human
ggccccgagacctaccctcc

SEQ ID NO: 104142 - DNA, 20 bp, human
gtcccgagacggacacaccg

SEQ ID NO: 104143 - DNA, 20 bp, human
ggaggccggcggcagctcct

SEQ ID NO: 104144 - DNA, 20 bp, human
ggacctaccctccgggccat

SEQ ID NO: 104145 - DNA, 20 bp, human
gctccagagcctggccgcgg

SEQ ID NO: 104146 - DNA, 20 bp, human
ggagaggtgtgagggtctaa

SEQ ID NO: 104147 - DNA, 20 bp, human
ggacctcaggactccaagag

SEQ ID NO: 104148 - DNA, 20 bp, human
gccaggctgacccactactc

SEQ ID NO: 104149 - DNA, 20 bp, human
ggaagcctgggtagggaggt

SEQ ID NO: 104150 - DNA, 20 bp, human
gtgggcacttccagagtagt

SEQ ID NO: 104151 - DNA, 20 bp, human
gttggagtcctgaggtctaa

SEQ ID NO: 104152 - DNA, 20 bp, human
gctgatgcaggagaggtgtg

SEQ ID NO: 104153 - DNA, 20 bp, human
gtcagagaacccacagtaca

SEQ ID NO: 104154 - DNA, 20 bp, human
ggtgtgagggtctaagggct

SEQ ID NO: 104155 - DNA, 20 bp, human
ggatggataaagatatggat

SEQ ID NO: 104156 - DNA, 20 bp, human
ggcgcccgacagaaggacag

SEQ ID NO: 104157 - DNA, 20 bp, human
ggcgggagaactgacctgag

SEQ ID NO: 104158 - DNA, 20 bp, human
gcctgctgtcctgagagacg

SEQ ID NO: 104159 - DNA, 20 bp, human
gctgagagacgcggctggta

SEQ ID NO: 104160 - DNA, 20 bp, human
gggcgatcgaaaagattctt

SEQ ID NO: 104161 - DNA, 20 bp, human
gggagaactgacctgagggg

SEQ ID NO: 104162 - DNA, 20 bp, human
gtctatcgcagcctcctagg

SEQ ID NO: 104163 - DNA, 20 bp, human
gcgagagccaggagcaaact

SEQ ID NO: 104164 - DNA, 20 bp, human
gctgtcctgagagacgcggc

SEQ ID NO: 104165 - DNA, 20 bp, human
gaggcccctgtccttctgtc

SEQ ID NO: 104166 - DNA, 20 bp, human
gcagctccggccgtaagtga

SEQ ID NO: 104167 - DNA, 20 bp, human
gcagggctcttaagaacgaa

SEQ ID NO: 104168 - DNA, 20 bp, human
ggagctggtggcgcggtgca

SEQ ID NO: 104169 - DNA, 20 bp, human
ggtgcgacagccgtcactta

SEQ ID NO: 104170 - DNA, 20 bp, human
ggacagccgtcacttacggc

SEQ ID NO: 104171 - DNA, 20 bp, human
gtcaggaggccgtggattca

SEQ ID NO: 104172 - DNA, 20 bp, human
ggcagggaggcagcgagaaa

SEQ ID NO: 104173 - DNA, 20 bp, human
gagtgggacagtccacgact

SEQ ID NO: 104174 - DNA, 20 bp, human
ggcgcctgcgcagaacctcc

SEQ ID NO: 104175 - DNA, 20 bp, human
gtcttaagaacgaacggctt

SEQ ID NO: 104176 - DNA, 20 bp, human
ggtggcgagtaaggaagcgt

SEQ ID NO: 104177 - DNA, 20 bp, human
gcccgttagagtggcgagta

SEQ ID NO: 104178 - DNA, 20 bp, human
gtgggcaggacccgttagag

SEQ ID NO: 104179 - DNA, 20 bp, human
gacgcgcacacaaaagccca

SEQ ID NO: 104180 - DNA, 20 bp, human
ggaagcgttggctcttctcc

SEQ ID NO: 104181 - DNA, 20 bp, human
ggtcgggcagccccgcgagg

SEQ ID NO: 104182 - DNA, 20 bp, human
gcgcgcggcgaggttaacgg

SEQ ID NO: 104183 - DNA, 20 bp, human
gtccttactcgccactctaa

SEQ ID NO: 104184 - DNA, 20 bp, human
gggccgcgcggcgaggttaa

SEQ ID NO: 104185 - DNA, 20 bp, human
ggcgggtaggcagcggtgct

SEQ ID NO: 104186 - DNA, 20 bp, human
gtgcgccgcggtgcctagtg

SEQ ID NO: 104187 - DNA, 20 bp, human
ggggatgtaagcgcggaggt

SEQ ID NO: 104188 - DNA, 20 bp, human
ggtgtgggatgtaagcgcgg

SEQ ID NO: 104189 - DNA, 20 bp, human
ggtcaagcccccaaacccca

SEQ ID NO: 104190 - DNA, 20 bp, human
gcatcccacactaggcaccg

SEQ ID NO: 104191 - DNA, 20 bp, human
gctgcaaggcaagccggggg

SEQ ID NO: 104192 - DNA, 20 bp, human
gctagtgtgggatgtaagcg

SEQ ID NO: 104193 - DNA, 20 bp, human
ggcggccttcagccccatgg

SEQ ID NO: 104194 - DNA, 20 bp, human
gggacgcccggtacccgatg

SEQ ID NO: 104195 - DNA, 20 bp, human
gcaaaccccaaggagagtcc

SEQ ID NO: 104196 - DNA, 20 bp, human
gggacagcagatggatcccg

SEQ ID NO: 104197 - DNA, 20 bp, human
ggctgacgaggagttcgtcc

SEQ ID NO: 104198 - DNA, 20 bp, human
gcccattgccttccgagtgg

SEQ ID NO: 104199 - DNA, 20 bp, human
gaaaggaccgaggcgtgcag

SEQ ID NO: 104200 - DNA, 20 bp, human
gctcgtcagctggtgcgtct

SEQ ID NO: 104201 - DNA, 20 bp, human
ggcaggagcaagcccgacat

SEQ ID NO: 104202 - DNA, 20 bp, human
gagcccccagcccctgtctg

SEQ ID NO: 104203 - DNA, 20 bp, human
ggtaggctggtgcattggag

SEQ ID NO: 104204 - DNA, 20 bp, human
gtcagctggtgcgtctgggt

SEQ ID NO: 104205 - DNA, 20 bp, human
gttccgagtgggggtttcga

SEQ ID NO: 104206 - DNA, 20 bp, human
ggctactcagatgtcaagag

SEQ ID NO: 104207 - DNA, 20 bp, human
gtgccagccagcatcacagg

SEQ ID NO: 104208 - DNA, 20 bp, human
gcgggataccccaacgaaga

SEQ ID NO: 104209 - DNA, 20 bp, human
gggaagaagtagagagctcg

SEQ ID NO: 104210 - DNA, 20 bp, human
ggagctcggggtaagacata

SEQ ID NO: 104211 - DNA, 20 bp, human
gacatatgaacagtcggacc

SEQ ID NO: 104212 - DNA, 20 bp, human
gcccgcgattatgcaagatg

SEQ ID NO: 104213 - DNA, 20 bp, human
gtgcgcaggcagccaaagag

SEQ ID NO: 104214 - DNA, 20 bp, human
gggttgaagccaaaagaagg

SEQ ID NO: 104215 - DNA, 20 bp, human
gttccaggcagaagacttca

SEQ ID NO: 104216 - DNA, 20 bp, human
gaccggtacagctgctatgt

SEQ ID NO: 104217 - DNA, 20 bp, human
ggcccacatagcagctgtac

SEQ ID NO: 104218 - DNA, 20 bp, human
gttacttgaaacccagtggt

SEQ ID NO: 104219 - DNA, 20 bp, human
gaaagcaggactcgacttac

SEQ ID NO: 104220 - DNA, 20 bp, human
gatcagctcacttgcagcaa

SEQ ID NO: 104221 - DNA, 20 bp, human
gagaatcacaatacagtatt

SEQ ID NO: 104222 - DNA, 20 bp, human
ggtaaaaaagagaatgcaag

SEQ ID NO: 104223 - DNA, 20 bp, human
gctcacttgcagcaatggct

SEQ ID NO: 104224 - DNA, 20 bp, human
gtactgtattgtgattctct

SEQ ID NO: 104225 - DNA, 20 bp, human
gttattattagtcttgccga

SEQ ID NO: 104226 - DNA, 20 bp, human
gcttcttggagattaggggt

SEQ ID NO: 104227 - DNA, 20 bp, human
gtaggggtgggcagtgtgta

SEQ ID NO: 104228 - DNA, 20 bp, human
gggatttatggaatctgtct

SEQ ID NO: 104229 - DNA, 20 bp, human
gcaatgtctctactctggtg

SEQ ID NO: 104230 - DNA, 20 bp, human
gtatatcaatgtctctactc

SEQ ID NO: 104231 - DNA, 20 bp, human
gatagttagctactttcaac

SEQ ID NO: 104232 - DNA, 20 bp, human
gtgtttcttcttggagatta

SEQ ID NO: 104233 - DNA, 20 bp, human
gcttctcgtgatttctggct

SEQ ID NO: 104234 - DNA, 20 bp, human
gcttacaaagttttataacg

SEQ ID NO: 104235 - DNA, 20 bp, human
gtcaaatgagtgtttcttct

SEQ ID NO: 104236 - DNA, 20 bp, human
ggcgtcagcgcgatccggag

SEQ ID NO: 104237 - DNA, 20 bp, human
ggaactgacgggccagtgag

SEQ ID NO: 104238 - DNA, 20 bp, human
ggagaggcccgcgaactgac

SEQ ID NO: 104239 - DNA, 20 bp, human
ggaacaagggtcgggtgtca

SEQ ID NO: 104240 - DNA, 20 bp, human
ggtgagcgggcgtcgggagt

SEQ ID NO: 104241 - DNA, 20 bp, human
ggcgcgatcccacccaccgt

SEQ ID NO: 104242 - DNA, 20 bp, human
ggcgcgcactcgggaaaggg

SEQ ID NO: 104243 - DNA, 20 bp, human
gatagctgcgcagggaagta

SEQ ID NO: 104244 - DNA, 20 bp, human
gcgtgggtgttgaggcggag

SEQ ID NO: 104245 - DNA, 20 bp, human
gggcctctcaacacccaccg

SEQ ID NO: 104246 - DNA, 20 bp, human
gacatgaaagccaaattacc

SEQ ID NO: 104247 - DNA, 20 bp, human
gaatcctgcaacaagaagcc

SEQ ID NO: 104248 - DNA, 20 bp, human
gtgaaagataccaggtaatt

SEQ ID NO: 104249 - DNA, 20 bp, human
gctttcaccttcagaatacc

SEQ ID NO: 104250 - DNA, 20 bp, human
ggatgcttgccacccaagta

SEQ ID NO: 104251 - DNA, 20 bp, human
gttgcaggattagaagtctc

SEQ ID NO: 104252 - DNA, 20 bp, human
ggatctataaaatgcttgga

SEQ ID NO: 104253 - DNA, 20 bp, human
gcacttaacaaactgcaatc

SEQ ID NO: 104254 - DNA, 20 bp, human
gagcaaaactgtgtaatatt

SEQ ID NO: 104255 - DNA, 20 bp, human
gaaagtaataaaaccatact

SEQ ID NO: 104256 - DNA, 20 bp, human
gccgggcagtgagtgccgag

SEQ ID NO: 104257 - DNA, 20 bp, human
gggcagtgagtgccgagtgg

SEQ ID NO: 104258 - DNA, 20 bp, human
gtgcccgggccgcccggaca

SEQ ID NO: 104259 - DNA, 20 bp, human
gcctcctctgcggtgaagag

SEQ ID NO: 104260 - DNA, 20 bp, human
gggagggagcgcgtccacag

SEQ ID NO: 104261 - DNA, 20 bp, human
ggcttggccggcgacaggac

SEQ ID NO: 104262 - DNA, 20 bp, human
gaggcgccgcggtcagtgga

SEQ ID NO: 104263 - DNA, 20 bp, human
gccagcgaagctccctgtcc

SEQ ID NO: 104264 - DNA, 20 bp, human
gcctctggcaccgcagtggg

SEQ ID NO: 104265 - DNA, 20 bp, human
gggcgcctcaagcgtcccga

SEQ ID NO: 104266 - DNA, 20 bp, human
gctgctgcgggccccagacg

SEQ ID NO: 104267 - DNA, 20 bp, human
ggccgcgccgagtcagagtc

SEQ ID NO: 104268 - DNA, 20 bp, human
gggccccagacgaggcgaca

SEQ ID NO: 104269 - DNA, 20 bp, human
gagggaggttacggccgagg

SEQ ID NO: 104270 - DNA, 20 bp, human
gccgggggcgaggcgcggac

SEQ ID NO: 104271 - DNA, 20 bp, human
gcgggccgcgctctgtgaac

SEQ ID NO: 104272 - DNA, 20 bp, human
ggcgccgagtcagagtcggg

SEQ ID NO: 104273 - DNA, 20 bp, human
gtccagggaggttacggccg

SEQ ID NO: 104274 - DNA, 20 bp, human
gatttctataggctccaggg

SEQ ID NO: 104275 - DNA, 20 bp, human
gggcgtgccgagcaccacgg

SEQ ID NO: 104276 - DNA, 20 bp, human
gcgcggcgcagcgaaaatgg

SEQ ID NO: 104277 - DNA, 20 bp, human
gagcagcagcagcaggtcag

SEQ ID NO: 104278 - DNA, 20 bp, human
gggtcgggtaagcgcgtcta

SEQ ID NO: 104279 - DNA, 20 bp, human
gaggaatggagggtcaacag

SEQ ID NO: 104280 - DNA, 20 bp, human
gaaaatggcggcttccaggt

SEQ ID NO: 104281 - DNA, 20 bp, human
ggaggcacaaagcaggacca

SEQ ID NO: 104282 - DNA, 20 bp, human
ggctggagcgagggtcagca

SEQ ID NO: 104283 - DNA, 20 bp, human
gagcagggcgcgcgggtcag

SEQ ID NO: 104284 - DNA, 20 bp, human
gagaaatggcaggaggaaca

SEQ ID NO: 104285 - DNA, 20 bp, human
gagggcgcgcgggtcagagg

SEQ ID NO: 104286 - DNA, 20 bp, human
gcgacaggtggccgatatag

SEQ ID NO: 104287 - DNA, 20 bp, human
gctggagactctcctcgctg

SEQ ID NO: 104288 - DNA, 20 bp, human
ggccgtgctaggcctcagcg

SEQ ID NO: 104289 - DNA, 20 bp, human
gcccaccgcccgccaaggtg

SEQ ID NO: 104290 - DNA, 20 bp, human
ggcccgccaaggtgaggacc

SEQ ID NO: 104291 - DNA, 20 bp, human
gtggagccctgggcatacta

SEQ ID NO: 104292 - DNA, 20 bp, human
ggcgggggcacggacgaagg

SEQ ID NO: 104293 - DNA, 20 bp, human
ggcagggaaaggccacgcag

SEQ ID NO: 104294 - DNA, 20 bp, human
ggcctagcacggccgacagg

SEQ ID NO: 104295 - DNA, 20 bp, human
gcgaggcggcgtgccctgaa

SEQ ID NO: 104296 - DNA, 20 bp, human
gggccggccggcgccaagga

SEQ ID NO: 104297 - DNA, 20 bp, human
gtcccttgggacgaatacgg

SEQ ID NO: 104298 - DNA, 20 bp, human
gcgataggtggccgatgtag

SEQ ID NO: 104299 - DNA, 20 bp, human
gggcgcagacgcaggcggag

SEQ ID NO: 104300 - DNA, 20 bp, human
ggggaggggggtccacgaca

SEQ ID NO: 104301 - DNA, 20 bp, human
gaggtggccgatgtagcgga

SEQ ID NO: 104302 - DNA, 20 bp, human
ggtccacgacacggatccct

SEQ ID NO: 104303 - DNA, 20 bp, human
gctctggccggccggcgcca

SEQ ID NO: 104304 - DNA, 20 bp, human
gacccagcacggccgatagg

SEQ ID NO: 104305 - DNA, 20 bp, human
ggtatcttggggcagtaagg

SEQ ID NO: 104306 - DNA, 20 bp, human
gcaccccggcacctcctctg

SEQ ID NO: 104307 - DNA, 20 bp, human
gcgggcagctacagccactc

SEQ ID NO: 104308 - DNA, 20 bp, human
gtgccgcagaggaggtgccg

SEQ ID NO: 104309 - DNA, 20 bp, human
gcctcctcaagtaggcagag

SEQ ID NO: 104310 - DNA, 20 bp, human
ggcgggtgggctctaaaagt

SEQ ID NO: 104311 - DNA, 20 bp, human
gcgaaaactctaccgacagg

SEQ ID NO: 104312 - DNA, 20 bp, human
gctagaccccgggatcgtcg

SEQ ID NO: 104313 - DNA, 20 bp, human
ggtgtcactcctgcccgcaa

SEQ ID NO: 104314 - DNA, 20 bp, human
ggcagccccagctcggacac

SEQ ID NO: 104315 - DNA, 20 bp, human
gcgggcggcatgggataacg

SEQ ID NO: 104316 - DNA, 20 bp, human
gacctgaatcaggtaagagg

SEQ ID NO: 104317 - DNA, 20 bp, human
ggcggcggcgcacctcgtat

SEQ ID NO: 104318 - DNA, 20 bp, human
gcgagtccccacgcccagga

SEQ ID NO: 104319 - DNA, 20 bp, human
gggctgtcccacaagtagga

SEQ ID NO: 104320 - DNA, 20 bp, human
gtggctccacccgccctcct

SEQ ID NO: 104321 - DNA, 20 bp, human
gcaggtaagaccttgcctac

SEQ ID NO: 104322 - DNA, 20 bp, human
gtaagtgcgcgtggcccagg

SEQ ID NO: 104323 - DNA, 20 bp, human
ggtccccacgcccaggaggg

SEQ ID NO: 104324 - DNA, 20 bp, human
gcaaccggttctccgaaaca

SEQ ID NO: 104325 - DNA, 20 bp, human
gcgggctgcgagggtgcacg

SEQ ID NO: 104326 - DNA, 20 bp, human
gcgaggacgaaactagaatg

SEQ ID NO: 104327 - DNA, 20 bp, human
gccgccaggcgaccagactg

SEQ ID NO: 104328 - DNA, 20 bp, human
gccggccgcaggtgacccgg

SEQ ID NO: 104329 - DNA, 20 bp, human
gcagatgcggagccgagtgg

SEQ ID NO: 104330 - DNA, 20 bp, human
ggagcagatgcggagccgag

SEQ ID NO: 104331 - DNA, 20 bp, human
gccacctgtatgacttagga

SEQ ID NO: 104332 - DNA, 20 bp, human
gagaggggcgctgggacagt

SEQ ID NO: 104333 - DNA, 20 bp, human
gcagcagtcaggtctcttag

SEQ ID NO: 104334 - DNA, 20 bp, human
gtgtatgacttaggagggag

SEQ ID NO: 104335 - DNA, 20 bp, human
gacggtgggacgaggatgac

SEQ ID NO: 104336 - DNA, 20 bp, human
gctggaagagcgcctcaccg

SEQ ID NO: 104337 - DNA, 20 bp, human
gatggcggccgtggagacgc

SEQ ID NO: 104338 - DNA, 20 bp, human
gcgcgggtgtgcgagacaga

SEQ ID NO: 104339 - DNA, 20 bp, human
gaaccggccccagaacgcgg

SEQ ID NO: 104340 - DNA, 20 bp, human
ggtagcggcgccgggaagga

SEQ ID NO: 104341 - DNA, 20 bp, human
gggctgccggaggcaggtag

SEQ ID NO: 104342 - DNA, 20 bp, human
ggggaaccggccccagaacg

SEQ ID NO: 104343 - DNA, 20 bp, human
gtcgcacacccgcgtctcca

SEQ ID NO: 104344 - DNA, 20 bp, human
gcggcagcccgcacacctgg

SEQ ID NO: 104345 - DNA, 20 bp, human
gcggcgccgctacctgcctc

SEQ ID NO: 104346 - DNA, 20 bp, human
gctccacgcgcttacctctg

SEQ ID NO: 104347 - DNA, 20 bp, human
ggtgaccgacgccaacatgg

SEQ ID NO: 104348 - DNA, 20 bp, human
ggtggaggagagccccgtga

SEQ ID NO: 104349 - DNA, 20 bp, human
gtgccgagcaaggaaaccta

SEQ ID NO: 104350 - DNA, 20 bp, human
gcgagcaggtggacgccact

SEQ ID NO: 104351 - DNA, 20 bp, human
gtccacctgctcgtccgcag

SEQ ID NO: 104352 - DNA, 20 bp, human
gagctctagggaagggaacc

SEQ ID NO: 104353 - DNA, 20 bp, human
gcacgtgaccgacgccaaca

SEQ ID NO: 104354 - DNA, 20 bp, human
gacctctgcggacgagcagg

SEQ ID NO: 104355 - DNA, 20 bp, human
gaaccgtgcgaaccctcacg

SEQ ID NO: 104356 - DNA, 20 bp, human
gcctccgggagccacctgaa

SEQ ID NO: 104357 - DNA, 20 bp, human
ggctctctcgggcaacatgg

SEQ ID NO: 104358 - DNA, 20 bp, human
gtcgggcccagcgaccccag

SEQ ID NO: 104359 - DNA, 20 bp, human
ggacctggatccagacgaca

SEQ ID NO: 104360 - DNA, 20 bp, human
gcgcgctctctcgggcaaca

SEQ ID NO: 104361 - DNA, 20 bp, human
gtcgggcaacatggcgggtg

SEQ ID NO: 104362 - DNA, 20 bp, human
gatccaggtcgccattcagg

SEQ ID NO: 104363 - DNA, 20 bp, human
gtcagctcccacgcacatcg

SEQ ID NO: 104364 - DNA, 20 bp, human
gctcctcctgtgggactaga

SEQ ID NO: 104365 - DNA, 20 bp, human
gagaaaagagtgcctgaggt

SEQ ID NO: 104366 - DNA, 20 bp, human
ggctggggacaggacgggac

SEQ ID NO: 104367 - DNA, 20 bp, human
ggccgcggccgggaacccca

SEQ ID NO: 104368 - DNA, 20 bp, human
gcccacgctgccgggctcct

SEQ ID NO: 104369 - DNA, 20 bp, human
gcccttcccgacccgctcca

SEQ ID NO: 104370 - DNA, 20 bp, human
ggggcttgggggcttcgccg

SEQ ID NO: 104371 - DNA, 20 bp, human
gttcccgacccgctccaagg

SEQ ID NO: 104372 - DNA, 20 bp, human
gccatccgcgaggcggcctc

SEQ ID NO: 104373 - DNA, 20 bp, human
ggcgctctgcgcgctccgag

SEQ ID NO: 104374 - DNA, 20 bp, human
gtgcggagggcgcggttgag

SEQ ID NO: 104375 - DNA, 20 bp, human
ggcctcgcggatggggaaac

SEQ ID NO: 104376 - DNA, 20 bp, human
gaacttcagaggctcggcgg

SEQ ID NO: 104377 - DNA, 20 bp, human
ggccaacttcagaggctcgg

SEQ ID NO: 104378 - DNA, 20 bp, human
gtcggactcgccaacttcag

SEQ ID NO: 104379 - DNA, 20 bp, human
gtcggccggcccgggacggg

SEQ ID NO: 104380 - DNA, 20 bp, human
gccagcgggccgggatgggc

SEQ ID NO: 104381 - DNA, 20 bp, human
gggacagcgggcaccggact

SEQ ID NO: 104382 - DNA, 20 bp, human
gtcccgcgaccccatcccgg

SEQ ID NO: 104383 - DNA, 20 bp, human
gcgcgcagtactccagcgac

SEQ ID NO: 104384 - DNA, 20 bp, human
gcgcggccgcccgcccatcc

SEQ ID NO: 104385 - DNA, 20 bp, human
gcgacccccggagcagaccc

SEQ ID NO: 104386 - DNA, 20 bp, human
gccggccacgttccgagtct

SEQ ID NO: 104387 - DNA, 20 bp, human
ggcagccgagactcggaacg

SEQ ID NO: 104388 - DNA, 20 bp, human
gtctgcggggagggaaggta

SEQ ID NO: 104389 - DNA, 20 bp, human
gcggaacgtggccggagcag

SEQ ID NO: 104390 - DNA, 20 bp, human
gctgccatgatcccagtccg

SEQ ID NO: 104391 - DNA, 20 bp, human
gggtagagaaaccccggact

SEQ ID NO: 104392 - DNA, 20 bp, human
gtagcgcttctggggcggtg

SEQ ID NO: 104393 - DNA, 20 bp, human
gactgagactgaagtgatag

SEQ ID NO: 104394 - DNA, 20 bp, human
gctctaccaaatccacgtgg

SEQ ID NO: 104395 - DNA, 20 bp, human
gcgggcctaagtctgggtag

SEQ ID NO: 104396 - DNA, 20 bp, human
gcgtggagcgaaatgagctc

SEQ ID NO: 104397 - DNA, 20 bp, human
gtgagctcgggcgctgacgg

SEQ ID NO: 104398 - DNA, 20 bp, human
gtggggccgccatagagacg

SEQ ID NO: 104399 - DNA, 20 bp, human
gccaacggccgtccaggacg

SEQ ID NO: 104400 - DNA, 20 bp, human
gtggcggcgcggtcggacaa

SEQ ID NO: 104401 - DNA, 20 bp, human
gaaatgagctcgggcgctga

SEQ ID NO: 104402 - DNA, 20 bp, human
gtcggacaagggcagtcccg

SEQ ID NO: 104403 - DNA, 20 bp, human
gggcgagagtgagagaccga

SEQ ID NO: 104404 - DNA, 20 bp, human
gctgtgccccgtctctatgg

SEQ ID NO: 104405 - DNA, 20 bp, human
ggggacagggagaccctcgg

SEQ ID NO: 104406 - DNA, 20 bp, human
gtatcaggacaggctgtcat

SEQ ID NO: 104407 - DNA, 20 bp, human
gcagcctgtcctgatataga

SEQ ID NO: 104408 - DNA, 20 bp, human
gtgtcctgatatagatggag

SEQ ID NO: 104409 - DNA, 20 bp, human
ggacaggctgtcatgggtgt

SEQ ID NO: 104410 - DNA, 20 bp, human
gctctgactcacttacccag

SEQ ID NO: 104411 - DNA, 20 bp, human
gcggtgggccatgacaaagg

SEQ ID NO: 104412 - DNA, 20 bp, human
gccccggtgggccatgacaa

SEQ ID NO: 104413 - DNA, 20 bp, human
gtcccctctccatctatatc

SEQ ID NO: 104414 - DNA, 20 bp, human
gaagtgcctaaaatagagtc

SEQ ID NO: 104415 - DNA, 20 bp, human
gttctgccagcgggatctaa

SEQ ID NO: 104416 - DNA, 20 bp, human
gcactcccggccgcccaatc

SEQ ID NO: 104417 - DNA, 20 bp, human
gccgcccagagccttccacc

SEQ ID NO: 104418 - DNA, 20 bp, human
gctgtagtagccagattggg

SEQ ID NO: 104419 - DNA, 20 bp, human
gcgcggacacagactatggt

SEQ ID NO: 104420 - DNA, 20 bp, human
gtagctgtagtagccagatt

SEQ ID NO: 104421 - DNA, 20 bp, human
gagaacgcggacacagacta

SEQ ID NO: 104422 - DNA, 20 bp, human
gggtggtgagctagtaagtg

SEQ ID NO: 104423 - DNA, 20 bp, human
ggtgcgggaggcctttcgga

SEQ ID NO: 104424 - DNA, 20 bp, human
gtccgggactgcagagttcg

SEQ ID NO: 104425 - DNA, 20 bp, human
gagtcccggaaaaaagaacg

SEQ ID NO: 104426 - DNA, 20 bp, human
gggcgggagcgtactggtag

SEQ ID NO: 104427 - DNA, 20 bp, human
gatcgtgcgccgcacaaggg

SEQ ID NO: 104428 - DNA, 20 bp, human
gagttcgggaaaagtgtgag

SEQ ID NO: 104429 - DNA, 20 bp, human
ggcggcaggcgggagcgtac

SEQ ID NO: 104430 - DNA, 20 bp, human
gccgatcgtgcgccgcacaa

SEQ ID NO: 104431 - DNA, 20 bp, human
ggggagcgtactggtagagg

SEQ ID NO: 104432 - DNA, 20 bp, human
gcggctccaagacaaagcgg

SEQ ID NO: 104433 - DNA, 20 bp, human
gtgtgaggggctcttcacgt

SEQ ID NO: 104434 - DNA, 20 bp, human
gcgcacccggatatggttat

SEQ ID NO: 104435 - DNA, 20 bp, human
ggccgcacaagggcggagcg

SEQ ID NO: 104436 - DNA, 20 bp, human
ggcgccggaagtctctactg

SEQ ID NO: 104437 - DNA, 20 bp, human
gcttgcaggagatccgggag

SEQ ID NO: 104438 - DNA, 20 bp, human
ggaacatgccagacactcgg

SEQ ID NO: 104439 - DNA, 20 bp, human
gcctggtgtcccctgtggga

SEQ ID NO: 104440 - DNA, 20 bp, human
gacagactcggaagaaaggt

SEQ ID NO: 104441 - DNA, 20 bp, human
gttccacagactcggaagaa

SEQ ID NO: 104442 - DNA, 20 bp, human
gtaacagcggcaggtagaga

SEQ ID NO: 104443 - DNA, 20 bp, human
gccgggagcggcagaagtta

SEQ ID NO: 104444 - DNA, 20 bp, human
gaaagcttaaaggctaatcc

SEQ ID NO: 104445 - DNA, 20 bp, human
gggaactcccaccgagtgtc

SEQ ID NO: 104446 - DNA, 20 bp, human
gatgaaggatactccctcaa

SEQ ID NO: 104447 - DNA, 20 bp, human
gggacaaaaacgcgacgtgg

SEQ ID NO: 104448 - DNA, 20 bp, human
gccttacaagtttcccccag

SEQ ID NO: 104449 - DNA, 20 bp, human
ggcgtctaggtcctgcccct

SEQ ID NO: 104450 - DNA, 20 bp, human
gtaaggacaaaaacgcgacg

SEQ ID NO: 104451 - DNA, 20 bp, human
gttgaaggcgtgttgaagag

SEQ ID NO: 104452 - DNA, 20 bp, human
gctagacgcgcggcgcattc

SEQ ID NO: 104453 - DNA, 20 bp, human
gccctgtggagtacccccaa

SEQ ID NO: 104454 - DNA, 20 bp, human
gttcaacacgccttcaacct

SEQ ID NO: 104455 - DNA, 20 bp, human
gacgaatccagcgacccctg

SEQ ID NO: 104456 - DNA, 20 bp, human
ggtgaagagaccccacattt

SEQ ID NO: 104457 - DNA, 20 bp, human
gggcccggtcccagagttaa

SEQ ID NO: 104458 - DNA, 20 bp, human
gcctgcacccgccggtctac

SEQ ID NO: 104459 - DNA, 20 bp, human
gcaggcctcctgtagaccgg

SEQ ID NO: 104460 - DNA, 20 bp, human
ggcacccgccggtctacagg

SEQ ID NO: 104461 - DNA, 20 bp, human
gcaccaggcctcctgtagac

SEQ ID NO: 104462 - DNA, 20 bp, human
ggaggcctggtgatctcaag

SEQ ID NO: 104463 - DNA, 20 bp, human
ggaccgggccctgcacccgc

SEQ ID NO: 104464 - DNA, 20 bp, human
gtcactcacacccttaactc

SEQ ID NO: 104465 - DNA, 20 bp, human
gggtgtgagtgagactgctg

SEQ ID NO: 104466 - DNA, 20 bp, human
gcggctgctttaagattcta

SEQ ID NO: 104467 - DNA, 20 bp, human
gccgacttcggggtctagga

SEQ ID NO: 104468 - DNA, 20 bp, human
gttctaggagcttcgctatg

SEQ ID NO: 104469 - DNA, 20 bp, human
gagatggcttcacaagatgg

SEQ ID NO: 104470 - DNA, 20 bp, human
ggcgtatcatctgcgtttct

SEQ ID NO: 104471 - DNA, 20 bp, human
ggctagatggcttcacaaga

SEQ ID NO: 104472 - DNA, 20 bp, human
ggagagatccaaaactgagg

SEQ ID NO: 104473 - DNA, 20 bp, human
ggcaggaacctcggcctcag

SEQ ID NO: 104474 - DNA, 20 bp, human
gacggcagtggcaggactag

SEQ ID NO: 104475 - DNA, 20 bp, human
gcagacgtcgtgtctggcgt

SEQ ID NO: 104476 - DNA, 20 bp, human
ggggagccactccaaggccg

SEQ ID NO: 104477 - DNA, 20 bp, human
gcgttgggactgagggtcac

SEQ ID NO: 104478 - DNA, 20 bp, human
ggcctccggagccatggcgg

SEQ ID NO: 104479 - DNA, 20 bp, human
gttcgcctccggagccatgg

SEQ ID NO: 104480 - DNA, 20 bp, human
gcttcaagtcggcccaaaca

SEQ ID NO: 104481 - DNA, 20 bp, human
gtgggtcactccgggtacta

SEQ ID NO: 104482 - DNA, 20 bp, human
gcattaggaagatggtgccc

SEQ ID NO: 104483 - DNA, 20 bp, human
gatgggccaaagacgaaaag

SEQ ID NO: 104484 - DNA, 20 bp, human
gtgggcccagcgctccctat

SEQ ID NO: 104485 - DNA, 20 bp, human
gcgggaaagcgagaagaaac

SEQ ID NO: 104486 - DNA, 20 bp, human
ggcagagcaaacgcaaacta

SEQ ID NO: 104487 - DNA, 20 bp, human
gagtgagtcgagtcctccag

SEQ ID NO: 104488 - DNA, 20 bp, human
ggtgcgcgatttaggtccgg

SEQ ID NO: 104489 - DNA, 20 bp, human
gttagtaaagactaattcgg

SEQ ID NO: 104490 - DNA, 20 bp, human
gctggtgcgcgatttaggtc

SEQ ID NO: 104491 - DNA, 20 bp, human
gcgcgatttaggtccggagg

SEQ ID NO: 104492 - DNA, 20 bp, human
gcgcgatcccaggacacgtc

SEQ ID NO: 104493 - DNA, 20 bp, human
gcggctccaaaaccatagag

SEQ ID NO: 104494 - DNA, 20 bp, human
gctagggcactgcagtagtt

SEQ ID NO: 104495 - DNA, 20 bp, human
gccttgcagcgtgatgggag

SEQ ID NO: 104496 - DNA, 20 bp, human
gcagtgtcctgggatcgtag

SEQ ID NO: 104497 - DNA, 20 bp, human
ggcggcgctctgctagagcg

SEQ ID NO: 104498 - DNA, 20 bp, human
gttccacaacgggtagacgg

SEQ ID NO: 104499 - DNA, 20 bp, human
gtgagcgggaacagtcgcca

SEQ ID NO: 104500 - DNA, 20 bp, human
gatcccaggacactgatgtg

SEQ ID NO: 104501 - DNA, 20 bp, human
gagagcgccgcggcccggca

SEQ ID NO: 104502 - DNA, 20 bp, human
gggatcgtaggggtctctca

SEQ ID NO: 104503 - DNA, 20 bp, human
gctagagcgtggctcagttt

SEQ ID NO: 104504 - DNA, 20 bp, human
gacgttccacaacgggtaga

SEQ ID NO: 104505 - DNA, 20 bp, human
gggtggagtcgatcttaaag

SEQ ID NO: 104506 - DNA, 20 bp, human
gcctcccgggccgtaagtac

SEQ ID NO: 104507 - DNA, 20 bp, human
gaggatccccaggccatacg

SEQ ID NO: 104508 - DNA, 20 bp, human
gccgctaacacccagtctaa

SEQ ID NO: 104509 - DNA, 20 bp, human
gagctgcggcaaccctccag

SEQ ID NO: 104510 - DNA, 20 bp, human
gctatcgaagcagccgatgg

SEQ ID NO: 104511 - DNA, 20 bp, human
ggagcacccagggctcgccc

SEQ ID NO: 104512 - DNA, 20 bp, human
ggccgtaagtaccggcgtgg

SEQ ID NO: 104513 - DNA, 20 bp, human
ggagccctgggtgctccgcc

SEQ ID NO: 104514 - DNA, 20 bp, human
gtcactatcgaagcagccga

SEQ ID NO: 104515 - DNA, 20 bp, human
ggcgcttccaacccagaccc

SEQ ID NO: 104516 - DNA, 20 bp, human
gttccacagggacaccacga

SEQ ID NO: 104517 - DNA, 20 bp, human
gggcgctcagatcccggatc

SEQ ID NO: 104518 - DNA, 20 bp, human
gcagttggaggctaacggtg

SEQ ID NO: 104519 - DNA, 20 bp, human
ggcccgccaagggagtgcct

SEQ ID NO: 104520 - DNA, 20 bp, human
gagccgtcgtggtgtccctg

SEQ ID NO: 104521 - DNA, 20 bp, human
gaaggagggcaaactcaggg

SEQ ID NO: 104522 - DNA, 20 bp, human
gcgtgaggatggctccatat

SEQ ID NO: 104523 - DNA, 20 bp, human
gaggcggggctcgttccaca

SEQ ID NO: 104524 - DNA, 20 bp, human
gcgttagcctccaactggga

SEQ ID NO: 104525 - DNA, 20 bp, human
gagatcccggatccggagcg

SEQ ID NO: 104526 - DNA, 20 bp, human
gaaatgacttaagggcctca

SEQ ID NO: 104527 - DNA, 20 bp, human
gtaatagaacaatgtaggga

SEQ ID NO: 104528 - DNA, 20 bp, human
gtgaagatccacagtgaata

SEQ ID NO: 104529 - DNA, 20 bp, human
ggtcaagttctaccacagca

SEQ ID NO: 104530 - DNA, 20 bp, human
gcatttaatagaacaatgta

SEQ ID NO: 104531 - DNA, 20 bp, human
gtgagttacggcaatttaaa

SEQ ID NO: 104532 - DNA, 20 bp, human
gcgattatttcaagttgaca

SEQ ID NO: 104533 - DNA, 20 bp, human
gacacaggtttcagttgcct

SEQ ID NO: 104534 - DNA, 20 bp, human
gaaagctgagaatatccatc

SEQ ID NO: 104535 - DNA, 20 bp, human
gtccacagtgaatagggaag

SEQ ID NO: 104536 - DNA, 20 bp, human
gcgtctctgtgggacttagg

SEQ ID NO: 104537 - DNA, 20 bp, human
gtgcgtagagtggtagtgag

SEQ ID NO: 104538 - DNA, 20 bp, human
gtcccacagagacgggagtc

SEQ ID NO: 104539 - DNA, 20 bp, human
gacccgactcccgtctctgt

SEQ ID NO: 104540 - DNA, 20 bp, human
gaggcggccgccataacagg

SEQ ID NO: 104541 - DNA, 20 bp, human
ggaggcggcgggatagggta

SEQ ID NO: 104542 - DNA, 20 bp, human
gccgcggcgggtaagtgcct

SEQ ID NO: 104543 - DNA, 20 bp, human
gcgcagaccgcctgttatgg

SEQ ID NO: 104544 - DNA, 20 bp, human
gctggccacggtgcgtagag

SEQ ID NO: 104545 - DNA, 20 bp, human
gcacaagggtggcgtcagga

SEQ ID NO: 104546 - DNA, 20 bp, human
gtggcgcgaccggaagtgat

SEQ ID NO: 104547 - DNA, 20 bp, human
ggcgcagaactggcaacggg

SEQ ID NO: 104548 - DNA, 20 bp, human
gtgaggtcaggagcggatgt

SEQ ID NO: 104549 - DNA, 20 bp, human
ggcgaagaaagcccggagca

SEQ ID NO: 104550 - DNA, 20 bp, human
ggctgcgagcgaagaaagcc

SEQ ID NO: 104551 - DNA, 20 bp, human
gagcacctgacggcaagaag

SEQ ID NO: 104552 - DNA, 20 bp, human
gacgtggccgtagcacctga

SEQ ID NO: 104553 - DNA, 20 bp, human
gcagggttatcaccagatct

SEQ ID NO: 104554 - DNA, 20 bp, human
gcacgcgcagaactggcaac

SEQ ID NO: 104555 - DNA, 20 bp, human
gtccgcacccccggtccctc

SEQ ID NO: 104556 - DNA, 20 bp, human
ggggccatggcgctacactc

SEQ ID NO: 104557 - DNA, 20 bp, human
ggccgcctaagagagcacag

SEQ ID NO: 104558 - DNA, 20 bp, human
gtccgtagcgcggtcgggag

SEQ ID NO: 104559 - DNA, 20 bp, human
ggccgcctcgatgggacctc

SEQ ID NO: 104560 - DNA, 20 bp, human
gagcagggatgtagccccac

SEQ ID NO: 104561 - DNA, 20 bp, human
ggccgcacttcagtctatct

SEQ ID NO: 104562 - DNA, 20 bp, human
gcacagccccgagtagacac

SEQ ID NO: 104563 - DNA, 20 bp, human
gtagcgccatggcccgggag

SEQ ID NO: 104564 - DNA, 20 bp, human
gtccggaggtcccatcgagg

SEQ ID NO: 104565 - DNA, 20 bp, human
gcacggcgacccccaagtac

SEQ ID NO: 104566 - DNA, 20 bp, human
gcctcggagggtgagcgtca

SEQ ID NO: 104567 - DNA, 20 bp, human
gccgctgggaaaccgaggag

SEQ ID NO: 104568 - DNA, 20 bp, human
gcgccacctacagcctcgga

SEQ ID NO: 104569 - DNA, 20 bp, human
gcaccctccgaggctgtagg

SEQ ID NO: 104570 - DNA, 20 bp, human
ggcggcccgctgggaaaccg

SEQ ID NO: 104571 - DNA, 20 bp, human
gggtggaagccagcagaacc

SEQ ID NO: 104572 - DNA, 20 bp, human
gcagccagcactgtctccgg

SEQ ID NO: 104573 - DNA, 20 bp, human
ggcagacgaagcgagccccc

SEQ ID NO: 104574 - DNA, 20 bp, human
gacgcagcgtgggcaggtcc

SEQ ID NO: 104575 - DNA, 20 bp, human
ggtccggggtcaccgggaga

SEQ ID NO: 104576 - DNA, 20 bp, human
ggggcctcacgtcctggctg

SEQ ID NO: 104577 - DNA, 20 bp, human
ggggacagagggtcagcgac

SEQ ID NO: 104578 - DNA, 20 bp, human
gatcactctgccccttcgcc

SEQ ID NO: 104579 - DNA, 20 bp, human
ggacgcgcgccggatctctc

SEQ ID NO: 104580 - DNA, 20 bp, human
gagccggttcctgagagatc

SEQ ID NO: 104581 - DNA, 20 bp, human
gcaggaataaaggatctggg

SEQ ID NO: 104582 - DNA, 20 bp, human
gtcttatcggcgaggactgc

SEQ ID NO: 104583 - DNA, 20 bp, human
gggccaggaataaaggatct

SEQ ID NO: 104584 - DNA, 20 bp, human
gtgcccgcagccaggacgtg

SEQ ID NO: 104585 - DNA, 20 bp, human
gcagcgacaggccgggcgaa

SEQ ID NO: 104586 - DNA, 20 bp, human
ggcgtgctcgcggctataag

SEQ ID NO: 104587 - DNA, 20 bp, human
gtgctcgcggctataagggg

SEQ ID NO: 104588 - DNA, 20 bp, human
ggcgtgcgcgtaccctcctg

SEQ ID NO: 104589 - DNA, 20 bp, human
gttcccgccacaaaactcac

SEQ ID NO: 104590 - DNA, 20 bp, human
gcgatcagagaggatcccgg

SEQ ID NO: 104591 - DNA, 20 bp, human
ggcgagcactctagcgatgg

SEQ ID NO: 104592 - DNA, 20 bp, human
gtcgcggctataaggggcgg

SEQ ID NO: 104593 - DNA, 20 bp, human
gcacgcaacacgctaagtgt

SEQ ID NO: 104594 - DNA, 20 bp, human
ggagatcgtgaaggtgctct

SEQ ID NO: 104595 - DNA, 20 bp, human
gcgcccacaggtgctgagtt

SEQ ID NO: 104596 - DNA, 20 bp, human
ggggacagacggccagcgac

SEQ ID NO: 104597 - DNA, 20 bp, human
gccctcgcccggcctgtcgc

SEQ ID NO: 104598 - DNA, 20 bp, human
ggacgcgcgccggatcgctc

SEQ ID NO: 104599 - DNA, 20 bp, human
gagccggttcctgagcgatc

SEQ ID NO: 104600 - DNA, 20 bp, human
gcaggaataaaggatgtggg

SEQ ID NO: 104601 - DNA, 20 bp, human
gggccaggaataaaggatgt

SEQ ID NO: 104602 - DNA, 20 bp, human
gcgcttaaatgggctctcgt

SEQ ID NO: 104603 - DNA, 20 bp, human
gtcttatcggcgaggattgc

SEQ ID NO: 104604 - DNA, 20 bp, human
gagggggcagggtgattacc

SEQ ID NO: 104605 - DNA, 20 bp, human
gcacgtcctggctgcgagca

SEQ ID NO: 104606 - DNA, 20 bp, human
gtggggccgaggctcaaccg

SEQ ID NO: 104607 - DNA, 20 bp, human
ggtgagaattggctatatcc

SEQ ID NO: 104608 - DNA, 20 bp, human
gtctcacgcggacaccccga

SEQ ID NO: 104609 - DNA, 20 bp, human
gacgtcctcgcagtctgaag

SEQ ID NO: 104610 - DNA, 20 bp, human
gctgctgctgaaggtggaga

SEQ ID NO: 104611 - DNA, 20 bp, human
gggcaaggcggacgagggtg

SEQ ID NO: 104612 - DNA, 20 bp, human
gaccgaggcccagcgtgagg

SEQ ID NO: 104613 - DNA, 20 bp, human
ggaggcggaagcaggactcg

SEQ ID NO: 104614 - DNA, 20 bp, human
gcctctcgaataaggcgcgg

SEQ ID NO: 104615 - DNA, 20 bp, human
ggagtgggcaaggcggacga

SEQ ID NO: 104616 - DNA, 20 bp, human
gagggcgagttgagcgttca

SEQ ID NO: 104617 - DNA, 20 bp, human
ggttaggtcggaagacctgt

SEQ ID NO: 104618 - DNA, 20 bp, human
gtgcgtcaccccaggaactg

SEQ ID NO: 104619 - DNA, 20 bp, human
gtggccgtctctacgaagac

SEQ ID NO: 104620 - DNA, 20 bp, human
ggccgtaccaacgcaatcct

SEQ ID NO: 104621 - DNA, 20 bp, human
gtcccaggattgcgttggta

SEQ ID NO: 104622 - DNA, 20 bp, human
gttcgtagagacggccacac

SEQ ID NO: 104623 - DNA, 20 bp, human
gtgggctcccaggattgcgt

SEQ ID NO: 104624 - DNA, 20 bp, human
gcgcccagctgcgtcacccc

SEQ ID NO: 104625 - DNA, 20 bp, human
gccagaggaccgtgagcctc

SEQ ID NO: 104626 - DNA, 20 bp, human
ggacccgaagacgcgcccta

SEQ ID NO: 104627 - DNA, 20 bp, human
gctccagaggtgcgtggtcg

SEQ ID NO: 104628 - DNA, 20 bp, human
gcgtggcgcgagggatcctg

SEQ ID NO: 104629 - DNA, 20 bp, human
gaggtgcgggtcgcctccag

SEQ ID NO: 104630 - DNA, 20 bp, human
gccgcacattgcaggtaggg

SEQ ID NO: 104631 - DNA, 20 bp, human
gccgccccaggagacggcgg

SEQ ID NO: 104632 - DNA, 20 bp, human
gggccagcggtgctgaaaaa

SEQ ID NO: 104633 - DNA, 20 bp, human
gtagccgggaggtgggtcag

SEQ ID NO: 104634 - DNA, 20 bp, human
ggcgccgccgccgtctcctg

SEQ ID NO: 104635 - DNA, 20 bp, human
gaggcgacccgcacctcggc

SEQ ID NO: 104636 - DNA, 20 bp, human
gggcctcggaggcagaatac

SEQ ID NO: 104637 - DNA, 20 bp, human
gaggctgtcataggaaccag

SEQ ID NO: 104638 - DNA, 20 bp, human
gccacgaattcggattatcc

SEQ ID NO: 104639 - DNA, 20 bp, human
gcagccccactgggcctcgg

SEQ ID NO: 104640 - DNA, 20 bp, human
gtcaggaaatgagcccaccc

SEQ ID NO: 104641 - DNA, 20 bp, human
ggccatggcaaaagaactcc

SEQ ID NO: 104642 - DNA, 20 bp, human
gcatgggcccctagaccctg

SEQ ID NO: 104643 - DNA, 20 bp, human
gattctgaggaccacgaatt

SEQ ID NO: 104644 - DNA, 20 bp, human
ggggcccctagaccctgagg

SEQ ID NO: 104645 - DNA, 20 bp, human
gctgcctccgaggcccagtg

SEQ ID NO: 104646 - DNA, 20 bp, human
gggtcaccctgcacccaggt

SEQ ID NO: 104647 - DNA, 20 bp, human
ggccagtctcaggataaaga

SEQ ID NO: 104648 - DNA, 20 bp, human
ggaaagttcagcaggtacaa

SEQ ID NO: 104649 - DNA, 20 bp, human
ggtcactggagagcccggtg

SEQ ID NO: 104650 - DNA, 20 bp, human
gtgctggaaagtcaaatcat

SEQ ID NO: 104651 - DNA, 20 bp, human
ggtctccaaacccagagaag

SEQ ID NO: 104652 - DNA, 20 bp, human
gcagggagagtttcccggag

SEQ ID NO: 104653 - DNA, 20 bp, human
ggccggggagaacatgcacc

SEQ ID NO: 104654 - DNA, 20 bp, human
gaactctccctgctggaagt

SEQ ID NO: 104655 - DNA, 20 bp, human
gcagtgtacttacaccccac

SEQ ID NO: 104656 - DNA, 20 bp, human
ggcagagccatgaggtgcag

SEQ ID NO: 104657 - DNA, 20 bp, human
gcagctgcaggagtgggacc

SEQ ID NO: 104658 - DNA, 20 bp, human
gtggtctgccatggacatcc

SEQ ID NO: 104659 - DNA, 20 bp, human
gcaggcacctccaatatgag

SEQ ID NO: 104660 - DNA, 20 bp, human
gagtagggccactttcccgg

SEQ ID NO: 104661 - DNA, 20 bp, human
gggtgaccctgcagcccggt

SEQ ID NO: 104662 - DNA, 20 bp, human
gaaagagcatggctgagaac

SEQ ID NO: 104663 - DNA, 20 bp, human
gtcagcacggccatcaggta

SEQ ID NO: 104664 - DNA, 20 bp, human
gccgcagcccagctccagta

SEQ ID NO: 104665 - DNA, 20 bp, human
gggagaggacatgagacagc

SEQ ID NO: 104666 - DNA, 20 bp, human
gcctcccagggcgaaggtcg

SEQ ID NO: 104667 - DNA, 20 bp, human
ggagaagcttgtgagtaccg

SEQ ID NO: 104668 - DNA, 20 bp, human
ggtgagtaccggggcagtga

SEQ ID NO: 104669 - DNA, 20 bp, human
gggccccgccgggaaagtct

SEQ ID NO: 104670 - DNA, 20 bp, human
ggcgggcagggagcacccga

SEQ ID NO: 104671 - DNA, 20 bp, human
gcccagggaaagctgacacg

SEQ ID NO: 104672 - DNA, 20 bp, human
gcggcggcccagcctaccca

SEQ ID NO: 104673 - DNA, 20 bp, human
gctgcccagcacgggagtgt

SEQ ID NO: 104674 - DNA, 20 bp, human
gtctgggcctcgaaattcga

SEQ ID NO: 104675 - DNA, 20 bp, human
gagtgcagggcgcacacacg

SEQ ID NO: 104676 - DNA, 20 bp, human
ggcgatggctcgagctcggg

SEQ ID NO: 104677 - DNA, 20 bp, human
ggcccatccagcccccttca

SEQ ID NO: 104678 - DNA, 20 bp, human
gccgccagcagtctcatcgg

SEQ ID NO: 104679 - DNA, 20 bp, human
ggccgcgatggctcgagctc

SEQ ID NO: 104680 - DNA, 20 bp, human
ggctgggcccggctattgtg

SEQ ID NO: 104681 - DNA, 20 bp, human
gactttccaaggggccgagg

SEQ ID NO: 104682 - DNA, 20 bp, human
gcgcggggaaaactttccaa

SEQ ID NO: 104683 - DNA, 20 bp, human
ggcccggctattgtgcggga

SEQ ID NO: 104684 - DNA, 20 bp, human
gcatgactagcggcccgggt

SEQ ID NO: 104685 - DNA, 20 bp, human
ggcctgcgctgcggaacaaa

SEQ ID NO: 104686 - DNA, 20 bp, human
ggtccgggagcggcgctcag

SEQ ID NO: 104687 - DNA, 20 bp, human
gcggtgcgggagcctaacgg

SEQ ID NO: 104688 - DNA, 20 bp, human
gagagtttgagcgctggaag

SEQ ID NO: 104689 - DNA, 20 bp, human
gaggggctgggctctattgg

SEQ ID NO: 104690 - DNA, 20 bp, human
gcgtcacccccggagaggag

SEQ ID NO: 104691 - DNA, 20 bp, human
gctgtccaggcgcccccgtt

SEQ ID NO: 104692 - DNA, 20 bp, human
gatggcgaaacaaaagctgg

SEQ ID NO: 104693 - DNA, 20 bp, human
gccccccgtcacccccggag

SEQ ID NO: 104694 - DNA, 20 bp, human
gaggggggaacaaagaactg

SEQ ID NO: 104695 - DNA, 20 bp, human
gggccactgagcgccgctcc

SEQ ID NO: 104696 - DNA, 20 bp, human
gagccagccgggcactcggg

SEQ ID NO: 104697 - DNA, 20 bp, human
gggctcgctgtcgtacagag

SEQ ID NO: 104698 - DNA, 20 bp, human
gcgagaagctgcggccacaa

SEQ ID NO: 104699 - DNA, 20 bp, human
gtcgcagacctggagcgcaa

SEQ ID NO: 104700 - DNA, 20 bp, human
gcgaccagctctccctgctg

SEQ ID NO: 104701 - DNA, 20 bp, human
gagggctctttggtcatcca

SEQ ID NO: 104702 - DNA, 20 bp, human
gtggtcgagcgcgagctgca

SEQ ID NO: 104703 - DNA, 20 bp, human
gtgccgagcgaaaagcgagc

SEQ ID NO: 104704 - DNA, 20 bp, human
gctggggctggacagtgacg

SEQ ID NO: 104705 - DNA, 20 bp, human
gggcactcggggggcacgcg

SEQ ID NO: 104706 - DNA, 20 bp, human
gcccccggggaagaccacgg

SEQ ID NO: 104707 - DNA, 20 bp, human
gcccagttcgagcggtcccc

SEQ ID NO: 104708 - DNA, 20 bp, human
ggaagcacacggagcagtcg

SEQ ID NO: 104709 - DNA, 20 bp, human
gtatctgggcccagttcgag

SEQ ID NO: 104710 - DNA, 20 bp, human
gtggccacagggcaccagcg

SEQ ID NO: 104711 - DNA, 20 bp, human
gtaagtggtgccccaggtgg

SEQ ID NO: 104712 - DNA, 20 bp, human
ggctgcaggtccgcctcccg

SEQ ID NO: 104713 - DNA, 20 bp, human
gagttcgagcggtccccggg

SEQ ID NO: 104714 - DNA, 20 bp, human
gcgaactgggcccagataag

SEQ ID NO: 104715 - DNA, 20 bp, human
gtcgagcggtccccgggagg

SEQ ID NO: 104716 - DNA, 20 bp, human
gggtaggtaactaggtgggt

SEQ ID NO: 104717 - DNA, 20 bp, human
gcagaggtaggtaactaggt

SEQ ID NO: 104718 - DNA, 20 bp, human
ggccgcccggagaccggaga

SEQ ID NO: 104719 - DNA, 20 bp, human
gcgagctccgggccgcccga

SEQ ID NO: 104720 - DNA, 20 bp, human
gcccgggccgaggagcgcca

SEQ ID NO: 104721 - DNA, 20 bp, human
ggcgcttcgggccccggcag

SEQ ID NO: 104722 - DNA, 20 bp, human
gcaggcggcgagccccatgg

SEQ ID NO: 104723 - DNA, 20 bp, human
ggagctgccgctgggcatcg

SEQ ID NO: 104724 - DNA, 20 bp, human
gggcggcgcgctgtcaatgg

SEQ ID NO: 104725 - DNA, 20 bp, human
ggccgagctggagctggaag

SEQ ID NO: 104726 - DNA, 20 bp, human
ggactctggctgcggctcgg

SEQ ID NO: 104727 - DNA, 20 bp, human
gccggcggcccagctcgcag

SEQ ID NO: 104728 - DNA, 20 bp, human
gggctcctcggcggccgagg

SEQ ID NO: 104729 - DNA, 20 bp, human
gccgcgtcgtcgggttcggg

SEQ ID NO: 104730 - DNA, 20 bp, human
ggccggccgcctgcatccag

SEQ ID NO: 104731 - DNA, 20 bp, human
gcagctggtccagcgccagg

SEQ ID NO: 104732 - DNA, 20 bp, human
gcccagctcgcagaggcgga

SEQ ID NO: 104733 - DNA, 20 bp, human
gcgacagctggtccagcgcc

SEQ ID NO: 104734 - DNA, 20 bp, human
gagctcgcagaggcggaggg

SEQ ID NO: 104735 - DNA, 20 bp, human
gtccagcgccaggcggagcg

SEQ ID NO: 104736 - DNA, 20 bp, human
gctgatagagaaactactta

SEQ ID NO: 104737 - DNA, 20 bp, human
gcgtttgggcgcccacagct

SEQ ID NO: 104738 - DNA, 20 bp, human
gctgtgttcgcggactcagg

SEQ ID NO: 104739 - DNA, 20 bp, human
ggttcgcggactcaggtgga

SEQ ID NO: 104740 - DNA, 20 bp, human
gcagctgtgttcgcggactc

SEQ ID NO: 104741 - DNA, 20 bp, human
gccccagccgtagactgaat

SEQ ID NO: 104742 - DNA, 20 bp, human
gcagccgtagactgaatggg

SEQ ID NO: 104743 - DNA, 20 bp, human
gcaggccacaggaacaagat

SEQ ID NO: 104744 - DNA, 20 bp, human
ggttcgcaatgagaaaggta

SEQ ID NO: 104745 - DNA, 20 bp, human
gatcggatgcaagtgggtgg

SEQ ID NO: 104746 - DNA, 20 bp, human
gcggagtgacccggacaggt

SEQ ID NO: 104747 - DNA, 20 bp, human
gttcagagcggaggccaagg

SEQ ID NO: 104748 - DNA, 20 bp, human
ggagggtgcgggcctgagag

SEQ ID NO: 104749 - DNA, 20 bp, human
gagcgggcggcggagtgacc

SEQ ID NO: 104750 - DNA, 20 bp, human
gccggcgggcggactcggag

SEQ ID NO: 104751 - DNA, 20 bp, human
ggctgggtcagggctgaaag

SEQ ID NO: 104752 - DNA, 20 bp, human
ggcggcggagtgacccggac

SEQ ID NO: 104753 - DNA, 20 bp, human
gatcagagacgggagcgcga

SEQ ID NO: 104754 - DNA, 20 bp, human
gggacatttgtgggacacat

SEQ ID NO: 104755 - DNA, 20 bp, human
gttgcaacttggtctcacag

SEQ ID NO: 104756 - DNA, 20 bp, human
ggccggaaggagctagacgg

SEQ ID NO: 104757 - DNA, 20 bp, human
gagctagacggcggtcgggt

SEQ ID NO: 104758 - DNA, 20 bp, human
gtcgctgcgaggggactact

SEQ ID NO: 104759 - DNA, 20 bp, human
gaaggagctagacggcggtc

SEQ ID NO: 104760 - DNA, 20 bp, human
gtagctccttccggcctcag

SEQ ID NO: 104761 - DNA, 20 bp, human
ggaggccggaaggagctaga

SEQ ID NO: 104762 - DNA, 20 bp, human
gtaatgtgatggaacgaagt

SEQ ID NO: 104763 - DNA, 20 bp, human
gctccttccggcctcagcgg

SEQ ID NO: 104764 - DNA, 20 bp, human
gcgtgcaaaggccatatagt

SEQ ID NO: 104765 - DNA, 20 bp, human
gggtaggtgacggcttggtt

SEQ ID NO: 104766 - DNA, 20 bp, human
gcaacgctgtgaggcgccgg

SEQ ID NO: 104767 - DNA, 20 bp, human
gcgcccggtagcgcctactg

SEQ ID NO: 104768 - DNA, 20 bp, human
gcgacacctaggaggctcgc

SEQ ID NO: 104769 - DNA, 20 bp, human
ggaggcggctcgcccgcagt

SEQ ID NO: 104770 - DNA, 20 bp, human
ggggcgtccggcgcagagtg

SEQ ID NO: 104771 - DNA, 20 bp, human
gtcgaaccgtaaccttccga

SEQ ID NO: 104772 - DNA, 20 bp, human
ggcccgcagtaggcgctacc

SEQ ID NO: 104773 - DNA, 20 bp, human
gcgcgctcctcgccctcgga

SEQ ID NO: 104774 - DNA, 20 bp, human
gagccagccccgcaccgggt

SEQ ID NO: 104775 - DNA, 20 bp, human
gagcctcctaggtgtcgtgg

SEQ ID NO: 104776 - DNA, 20 bp, human
gagacctggggggcacacgg

SEQ ID NO: 104777 - DNA, 20 bp, human
gcccaggtctccgggatccg

SEQ ID NO: 104778 - DNA, 20 bp, human
gagcagaactgacagcatga

SEQ ID NO: 104779 - DNA, 20 bp, human
gaggccgcgtctgtgagtgt

SEQ ID NO: 104780 - DNA, 20 bp, human
gccacaggttgtgcaagaag

SEQ ID NO: 104781 - DNA, 20 bp, human
gactgacagcatgaaggtac

SEQ ID NO: 104782 - DNA, 20 bp, human
gagatgtcgtcacagtccag

SEQ ID NO: 104783 - DNA, 20 bp, human
gggccaggggcctctggagt

SEQ ID NO: 104784 - DNA, 20 bp, human
ggccacagagggcactatga

SEQ ID NO: 104785 - DNA, 20 bp, human
gggaactgagcccactccag

SEQ ID NO: 104786 - DNA, 20 bp, human
ggtgaaagaggccaaagggt

SEQ ID NO: 104787 - DNA, 20 bp, human
gcagcagccaaaggactcgg

SEQ ID NO: 104788 - DNA, 20 bp, human
gcaaagggtagggccaagta

SEQ ID NO: 104789 - DNA, 20 bp, human
gaaggaagattccacatcag

SEQ ID NO: 104790 - DNA, 20 bp, human
gccgctgaaacaatgagatg

SEQ ID NO: 104791 - DNA, 20 bp, human
ggcctctttcacccctgatg

SEQ ID NO: 104792 - DNA, 20 bp, human
gcctcagaggcatctttccc

SEQ ID NO: 104793 - DNA, 20 bp, human
gtccacatcaggggtgaaag

SEQ ID NO: 104794 - DNA, 20 bp, human
ggaataatggtaagtgacca

SEQ ID NO: 104795 - DNA, 20 bp, human
gattcagcagccaaaggact

SEQ ID NO: 104796 - DNA, 20 bp, human
ggagtccccgaggagagcga

SEQ ID NO: 104797 - DNA, 20 bp, human
gggagacgccgaaccacaca

SEQ ID NO: 104798 - DNA, 20 bp, human
gccgctacggctcccagaag

SEQ ID NO: 104799 - DNA, 20 bp, human
ggccagggcagaagcgcgaa

SEQ ID NO: 104800 - DNA, 20 bp, human
ggcctggcagccagctcggg

SEQ ID NO: 104801 - DNA, 20 bp, human
gtcagggagacactaccggg

SEQ ID NO: 104802 - DNA, 20 bp, human
ggctcccggggcgctcgagt

SEQ ID NO: 104803 - DNA, 20 bp, human
gcagctcgggcggcaggtcg

SEQ ID NO: 104804 - DNA, 20 bp, human
gccgggaccttgagtccccg

SEQ ID NO: 104805 - DNA, 20 bp, human
ggttggccggagggtctcgg

SEQ ID NO: 104806 - DNA, 20 bp, human
ggcgctggaatgggcacgct

SEQ ID NO: 104807 - DNA, 20 bp, human
gtaagccgcatccctggggg

SEQ ID NO: 104808 - DNA, 20 bp, human
ggggacgcgggcgctggaat

SEQ ID NO: 104809 - DNA, 20 bp, human
gagaaggcgccagaaccccg

SEQ ID NO: 104810 - DNA, 20 bp, human
gctgtaagccgcatccctgg

SEQ ID NO: 104811 - DNA, 20 bp, human
gattccggtcccagaggaga

SEQ ID NO: 104812 - DNA, 20 bp, human
gggcttacagataatgacaa

SEQ ID NO: 104813 - DNA, 20 bp, human
gctggtgaaaaatgaggcca

SEQ ID NO: 104814 - DNA, 20 bp, human
gctcacccagggcgacgagg

SEQ ID NO: 104815 - DNA, 20 bp, human
gcgccgggcaaacttccgag

SEQ ID NO: 104816 - DNA, 20 bp, human
gcgggtcctagcgcagccag

SEQ ID NO: 104817 - DNA, 20 bp, human
ggcccggggaaacggagaca

SEQ ID NO: 104818 - DNA, 20 bp, human
gctcccccaggagctcgagg

SEQ ID NO: 104819 - DNA, 20 bp, human
gccggccgccgagcgcggga

SEQ ID NO: 104820 - DNA, 20 bp, human
gccgagcgctggcggctagg

SEQ ID NO: 104821 - DNA, 20 bp, human
gagcgctggcggctaggggg

SEQ ID NO: 104822 - DNA, 20 bp, human
ggccggagccgggccccccg

SEQ ID NO: 104823 - DNA, 20 bp, human
ggcgacgcgagcggctccgg

SEQ ID NO: 104824 - DNA, 20 bp, human
gccgggccgacagcctcacg

SEQ ID NO: 104825 - DNA, 20 bp, human
ggcgctgggagggcgcgatt

SEQ ID NO: 104826 - DNA, 20 bp, human
ggccagcgcgagggggagca

SEQ ID NO: 104827 - DNA, 20 bp, human
gggccgcacttaaggagctc

SEQ ID NO: 104828 - DNA, 20 bp, human
ggagctcgggccagcgcgag

SEQ ID NO: 104829 - DNA, 20 bp, human
gaggcggcctcgaacacccg

SEQ ID NO: 104830 - DNA, 20 bp, human
ggattccgcccgggaactcg

SEQ ID NO: 104831 - DNA, 20 bp, human
gggcccgagctccttaagtg

SEQ ID NO: 104832 - DNA, 20 bp, human
ggtggagaggagctcccgga

SEQ ID NO: 104833 - DNA, 20 bp, human
ggaggaggtccgcagcagcc

SEQ ID NO: 104834 - DNA, 20 bp, human
ggaactcgcggccgcactta

SEQ ID NO: 104835 - DNA, 20 bp, human
gacgctccaaggagaagcgc

SEQ ID NO: 104836 - DNA, 20 bp, human
gctggggctggactacgtgg

SEQ ID NO: 104837 - DNA, 20 bp, human
ggtctgaatagcaccagggg

SEQ ID NO: 104838 - DNA, 20 bp, human
gtggctggggctggactacg

SEQ ID NO: 104839 - DNA, 20 bp, human
gggggtctgaatagcaccag

SEQ ID NO: 104840 - DNA, 20 bp, human
gctacgtggcggcgctggaa

SEQ ID NO: 104841 - DNA, 20 bp, human
gggaaagagcgcatctggaa

SEQ ID NO: 104842 - DNA, 20 bp, human
gccgctccctcagggttctg

SEQ ID NO: 104843 - DNA, 20 bp, human
gagggaggctgcggcgagtt

SEQ ID NO: 104844 - DNA, 20 bp, human
gtcaggcgcccgctctgggg

SEQ ID NO: 104845 - DNA, 20 bp, human
gccgctggggacgaacgcgg

SEQ ID NO: 104846 - DNA, 20 bp, human
gtgccgggtgatagttggag

SEQ ID NO: 104847 - DNA, 20 bp, human
gctccgctccaactatcacc

SEQ ID NO: 104848 - DNA, 20 bp, human
gcgagaagttaaaggcggag

SEQ ID NO: 104849 - DNA, 20 bp, human
gtcacccggcaacagcaact

SEQ ID NO: 104850 - DNA, 20 bp, human
ggaagttaaaggcggagagg

SEQ ID NO: 104851 - DNA, 20 bp, human
gtcgggaagatgaggcagtt

SEQ ID NO: 104852 - DNA, 20 bp, human
gcatcttcccgagaagttaa

SEQ ID NO: 104853 - DNA, 20 bp, human
gcttcccgagaagttaaagg

SEQ ID NO: 104854 - DNA, 20 bp, human
gaggtgggaggccttttcta

SEQ ID NO: 104855 - DNA, 20 bp, human
gacaccgggcgcaggagtca

SEQ ID NO: 104856 - DNA, 20 bp, human
gcgcgaggccgggaaggtga

SEQ ID NO: 104857 - DNA, 20 bp, human
gtaaacagggctgaacgaga

SEQ ID NO: 104858 - DNA, 20 bp, human
gggtgacgtagtgagtgtga

SEQ ID NO: 104859 - DNA, 20 bp, human
gcacgggacctgggactggt

SEQ ID NO: 104860 - DNA, 20 bp, human
gtccccggccctgagaggag

SEQ ID NO: 104861 - DNA, 20 bp, human
ggcagtaactgcccaaagtg

SEQ ID NO: 104862 - DNA, 20 bp, human
ggccctgccatccccacttt

SEQ ID NO: 104863 - DNA, 20 bp, human
gtgatggccgccgcgaggcc

SEQ ID NO: 104864 - DNA, 20 bp, human
ggaagtcatataagtaaaca

SEQ ID NO: 104865 - DNA, 20 bp, human
gggtagaacatggccgtgaa

SEQ ID NO: 104866 - DNA, 20 bp, human
gcctgtgctgggccgagatg

SEQ ID NO: 104867 - DNA, 20 bp, human
gtcctgtctcaggttgaggt

SEQ ID NO: 104868 - DNA, 20 bp, human
gtctaataagtcaggactgg

SEQ ID NO: 104869 - DNA, 20 bp, human
gaagaaaagggagatggatc

SEQ ID NO: 104870 - DNA, 20 bp, human
ggccaacctcaacctgagac

SEQ ID NO: 104871 - DNA, 20 bp, human
ggacagagactaactcttca

SEQ ID NO: 104872 - DNA, 20 bp, human
ggctgtggctctatacaaag

SEQ ID NO: 104873 - DNA, 20 bp, human
gatttgagctgagtggacag

SEQ ID NO: 104874 - DNA, 20 bp, human
gcaaggagccaacctgtgct

SEQ ID NO: 104875 - DNA, 20 bp, human
gtcaagagacttgccaccag

SEQ ID NO: 104876 - DNA, 20 bp, human
ggacagaggcggctgaaagg

SEQ ID NO: 104877 - DNA, 20 bp, human
ggctgcggcaggccggacag

SEQ ID NO: 104878 - DNA, 20 bp, human
gcagctccaggcgcaagcgg

SEQ ID NO: 104879 - DNA, 20 bp, human
gaaagtctggcaggcatcag

SEQ ID NO: 104880 - DNA, 20 bp, human
gcaggcggtcccggaggctg

SEQ ID NO: 104881 - DNA, 20 bp, human
gcgcaagcggtggaaagccc

SEQ ID NO: 104882 - DNA, 20 bp, human
gaaggaggcaccagcagaaa

SEQ ID NO: 104883 - DNA, 20 bp, human
ggagctgctgcttgacacgt

SEQ ID NO: 104884 - DNA, 20 bp, human
gtccagcagaggcaaaagtc

SEQ ID NO: 104885 - DNA, 20 bp, human
gaggggcggggccagacgaa

SEQ ID NO: 104886 - DNA, 20 bp, human
gggcagcctctactacccga

SEQ ID NO: 104887 - DNA, 20 bp, human
gccaggctagaccagttctt

SEQ ID NO: 104888 - DNA, 20 bp, human
gcgcaggtcggcgtcctcga

SEQ ID NO: 104889 - DNA, 20 bp, human
gctctactacccgagggaaa

SEQ ID NO: 104890 - DNA, 20 bp, human
gaggacgccgacctgcgggt

SEQ ID NO: 104891 - DNA, 20 bp, human
gtggcatggtaaccatccca

SEQ ID NO: 104892 - DNA, 20 bp, human
gcatcccagggggtgacctg

SEQ ID NO: 104893 - DNA, 20 bp, human
gggagctgggacgctgtagc

SEQ ID NO: 104894 - DNA, 20 bp, human
ggaggaatacccaacagaag

SEQ ID NO: 104895 - DNA, 20 bp, human
gtagaggctgcccctctgac

SEQ ID NO: 104896 - DNA, 20 bp, human
gccattgcgcccgcaggaga

SEQ ID NO: 104897 - DNA, 20 bp, human
gtccggaacgtggaggtcga

SEQ ID NO: 104898 - DNA, 20 bp, human
gctccgcgtccggaacgtgg

SEQ ID NO: 104899 - DNA, 20 bp, human
ggccctgacgaggccgacag

SEQ ID NO: 104900 - DNA, 20 bp, human
gcctgcgggcgcaatggagg

SEQ ID NO: 104901 - DNA, 20 bp, human
gacctctgtcggcctcgtca

SEQ ID NO: 104902 - DNA, 20 bp, human
ggctcttcagtaagtcccag

SEQ ID NO: 104903 - DNA, 20 bp, human
gctagaggcgatagatatga

SEQ ID NO: 104904 - DNA, 20 bp, human
gggccggctcaccaaagcca

SEQ ID NO: 104905 - DNA, 20 bp, human
gctggcaggcggccctgacg

SEQ ID NO: 104906 - DNA, 20 bp, human
gacggacggtcgcacagacg

SEQ ID NO: 104907 - DNA, 20 bp, human
ggtcgcacagacgcggaaca

SEQ ID NO: 104908 - DNA, 20 bp, human
ggcagggcaaggactcacgt

SEQ ID NO: 104909 - DNA, 20 bp, human
ggctgcgcgctcgggacgga

SEQ ID NO: 104910 - DNA, 20 bp, human
gcaacggtcctgagagacca

SEQ ID NO: 104911 - DNA, 20 bp, human
gtcccctaggaccccctcta

SEQ ID NO: 104912 - DNA, 20 bp, human
gcgccagggagaccgagtcc

SEQ ID NO: 104913 - DNA, 20 bp, human
ggcacgcgggatggcggagt

SEQ ID NO: 104914 - DNA, 20 bp, human
gggggccatggggtgcacac

SEQ ID NO: 104915 - DNA, 20 bp, human
ggcaccaggcacgccgccag

SEQ ID NO: 104916 - DNA, 20 bp, human
gaggttgaggggcccacgaa

SEQ ID NO: 104917 - DNA, 20 bp, human
ggcccacgaaggggattaaa

SEQ ID NO: 104918 - DNA, 20 bp, human
ggggcgtgaacttggagtat

SEQ ID NO: 104919 - DNA, 20 bp, human
gtgatgggcacttcaaagga

SEQ ID NO: 104920 - DNA, 20 bp, human
gcactcttcagacggagacg

SEQ ID NO: 104921 - DNA, 20 bp, human
gtgggcacttcaaaggaggg

SEQ ID NO: 104922 - DNA, 20 bp, human
gtacggaagagcacaacccc

SEQ ID NO: 104923 - DNA, 20 bp, human
gattatgatgggcacttcaa

SEQ ID NO: 104924 - DNA, 20 bp, human
gggccgcagtgagtcaggct

SEQ ID NO: 104925 - DNA, 20 bp, human
gttctggactgcattatgat

SEQ ID NO: 104926 - DNA, 20 bp, human
gcggcctcgtagcccacgag

SEQ ID NO: 104927 - DNA, 20 bp, human
gacgcggcggacgtgggtga

SEQ ID NO: 104928 - DNA, 20 bp, human
gtagcgggcgcagcagctgg

SEQ ID NO: 104929 - DNA, 20 bp, human
gggctgcagagtcgagcgtg

SEQ ID NO: 104930 - DNA, 20 bp, human
gtgcagagtcgagcgtgggg

SEQ ID NO: 104931 - DNA, 20 bp, human
ggggcggacgcggcggacgt

SEQ ID NO: 104932 - DNA, 20 bp, human
gggcgcggccgtaagagagc

SEQ ID NO: 104933 - DNA, 20 bp, human
gggctgtgcacaccgctcgt

SEQ ID NO: 104934 - DNA, 20 bp, human
gccgcggccgctgtccctgg

SEQ ID NO: 104935 - DNA, 20 bp, human
gggccttgcgcgggccgtag

SEQ ID NO: 104936 - DNA, 20 bp, human
gagtgcgggtgagcaaaggg

SEQ ID NO: 104937 - DNA, 20 bp, human
gcgagccagagaggacctgg

SEQ ID NO: 104938 - DNA, 20 bp, human
ggaacgcccggcccaggtga

SEQ ID NO: 104939 - DNA, 20 bp, human
gccggcccaggtgaaggtga

SEQ ID NO: 104940 - DNA, 20 bp, human
ggtggagtgcgggtgagcaa

SEQ ID NO: 104941 - DNA, 20 bp, human
gggtgacggagaaaagctgt

SEQ ID NO: 104942 - DNA, 20 bp, human
gtccgtcaccccctgtccca

SEQ ID NO: 104943 - DNA, 20 bp, human
gcactccacgctctgcggag

SEQ ID NO: 104944 - DNA, 20 bp, human
gctacgagccagagaggacc

SEQ ID NO: 104945 - DNA, 20 bp, human
gggaagcctacgagccagag

SEQ ID NO: 104946 - DNA, 20 bp, human
gaccccgggaggacctgcgg

SEQ ID NO: 104947 - DNA, 20 bp, human
gccaagggcgataaccccga

SEQ ID NO: 104948 - DNA, 20 bp, human
gtccggctgcggggacccct

SEQ ID NO: 104949 - DNA, 20 bp, human
gcagccgtgtaaccccgcga

SEQ ID NO: 104950 - DNA, 20 bp, human
gcgagggcaacggccgcggg

SEQ ID NO: 104951 - DNA, 20 bp, human
gcccctgcaccagccgccaa

SEQ ID NO: 104952 - DNA, 20 bp, human
ggccggaaagagactaggac

SEQ ID NO: 104953 - DNA, 20 bp, human
gggaagcctagccctagcca

SEQ ID NO: 104954 - DNA, 20 bp, human
ggcgagggcagcccctgagc

SEQ ID NO: 104955 - DNA, 20 bp, human
gccggcgccggaaagagact

SEQ ID NO: 104956 - DNA, 20 bp, human
gcgaagtcgggtccaaacgg

SEQ ID NO: 104957 - DNA, 20 bp, human
ggggcgagcggtccggacac

SEQ ID NO: 104958 - DNA, 20 bp, human
gcgagcggtccggacaccgg

SEQ ID NO: 104959 - DNA, 20 bp, human
gccccagaagaaccgaagtc

SEQ ID NO: 104960 - DNA, 20 bp, human
gcacggagcgtacagaacct

SEQ ID NO: 104961 - DNA, 20 bp, human
gagccctgcgcgtccaccag

SEQ ID NO: 104962 - DNA, 20 bp, human
gggaggtcgggttccaggtg

SEQ ID NO: 104963 - DNA, 20 bp, human
gtccggacaccggcggccgg

SEQ ID NO: 104964 - DNA, 20 bp, human
gccaggtagaggccggccag

SEQ ID NO: 104965 - DNA, 20 bp, human
gggccggactggagcccgta

SEQ ID NO: 104966 - DNA, 20 bp, human
ggcccatggcgcaggctgac

SEQ ID NO: 104967 - DNA, 20 bp, human
gcgctccagtaggtgagcgt

SEQ ID NO: 104968 - DNA, 20 bp, human
gctgcgacggccgcgtgtcg

SEQ ID NO: 104969 - DNA, 20 bp, human
ggcccgtcagcctgcgccat

SEQ ID NO: 104970 - DNA, 20 bp, human
gcctcccgcgggcggcactc

SEQ ID NO: 104971 - DNA, 20 bp, human
ggcggagcagccccgacacg

SEQ ID NO: 104972 - DNA, 20 bp, human
gcgtgggctgcaggttgcgg

SEQ ID NO: 104973 - DNA, 20 bp, human
gcctctcccccggccccgtg

SEQ ID NO: 104974 - DNA, 20 bp, human
gtttccagggagagctgcgg

SEQ ID NO: 104975 - DNA, 20 bp, human
gggcagctcttcggccaaga

SEQ ID NO: 104976 - DNA, 20 bp, human
gcctcttcacaggcaaggat

SEQ ID NO: 104977 - DNA, 20 bp, human
gtgtctcctaggacactgtg

SEQ ID NO: 104978 - DNA, 20 bp, human
gcgggagcgggattattgaa

SEQ ID NO: 104979 - DNA, 20 bp, human
ggggacgccccggacacgtc

SEQ ID NO: 104980 - DNA, 20 bp, human
gagtgtacgggagctgctgt

SEQ ID NO: 104981 - DNA, 20 bp, human
gcagggaggggtaagaagac

SEQ ID NO: 104982 - DNA, 20 bp, human
gctggagccggacgtgtccg

SEQ ID NO: 104983 - DNA, 20 bp, human
ggtaatagaaggaagtgtac

SEQ ID NO: 104984 - DNA, 20 bp, human
gcagaggcctgcccggctcc

SEQ ID NO: 104985 - DNA, 20 bp, human
ggtgtcctaggagacagctt

SEQ ID NO: 104986 - DNA, 20 bp, human
ggggcagcgcgcaccatccc

SEQ ID NO: 104987 - DNA, 20 bp, human
ggcgcgcgagcagcccggga

SEQ ID NO: 104988 - DNA, 20 bp, human
gctgctcgcgcgctcctccg

SEQ ID NO: 104989 - DNA, 20 bp, human
gcacccgacacggaagccgg

SEQ ID NO: 104990 - DNA, 20 bp, human
ggcccagccggagggcgggt

SEQ ID NO: 104991 - DNA, 20 bp, human
gtccagccggtagtgaccgg

SEQ ID NO: 104992 - DNA, 20 bp, human
gcacccgcggcagcagctgt

SEQ ID NO: 104993 - DNA, 20 bp, human
gcggaagtgctgccagcacg

SEQ ID NO: 104994 - DNA, 20 bp, human
ggggtccagccggtagtgac

SEQ ID NO: 104995 - DNA, 20 bp, human
gcgccgccgccggtcactac

SEQ ID NO: 104996 - DNA, 20 bp, human
gtggccaggaaggcacagac

SEQ ID NO: 104997 - DNA, 20 bp, human
gcggcgccgccccagaccgg

SEQ ID NO: 104998 - DNA, 20 bp, human
gagcccagaaggcagcgatt

SEQ ID NO: 104999 - DNA, 20 bp, human
ggcttggccgcgccctgggt

SEQ ID NO: 105000 - DNA, 20 bp, human
gccgcaccccgcacaccagg

SEQ ID NO: 105001 - DNA, 20 bp, human
gcctgctgatgtcccaccgg

SEQ ID NO: 105002 - DNA, 20 bp, human
gctgatggtcctggtcccac

SEQ ID NO: 105003 - DNA, 20 bp, human
gatgagtgccaacccccggt

SEQ ID NO: 105004 - DNA, 20 bp, human
gcctgggtgggcaccctaat

SEQ ID NO: 105005 - DNA, 20 bp, human
gctgcgcccccggtctgggg

SEQ ID NO: 105006 - DNA, 20 bp, human
gcatcgtcggcggcctccac

SEQ ID NO: 105007 - DNA, 20 bp, human
gccgtcggccccgccatcgt

SEQ ID NO: 105008 - DNA, 20 bp, human
gcccaggctggagccactga

SEQ ID NO: 105009 - DNA, 20 bp, human
gcgggaccggcggagacccg

SEQ ID NO: 105010 - DNA, 20 bp, human
ggtgactggcagatcccccg

SEQ ID NO: 105011 - DNA, 20 bp, human
ggaccggcggagacccgtgg

SEQ ID NO: 105012 - DNA, 20 bp, human
gagggctgggactccgtgac

SEQ ID NO: 105013 - DNA, 20 bp, human
ggaaggtccttaagcccggg

SEQ ID NO: 105014 - DNA, 20 bp, human
gtcggccccgccatcgtcgg

SEQ ID NO: 105015 - DNA, 20 bp, human
gagcccttcccagccttcag

SEQ ID NO: 105016 - DNA, 20 bp, human
ggcgccgtgtacgcgcctgg

SEQ ID NO: 105017 - DNA, 20 bp, human
ggcgggagactcgcgggtca

SEQ ID NO: 105018 - DNA, 20 bp, human
gcaggtgtgtcgcctaagag

SEQ ID NO: 105019 - DNA, 20 bp, human
gcttgtagggagtgtaacta

SEQ ID NO: 105020 - DNA, 20 bp, human
ggggcgcaagacgccttgta

SEQ ID NO: 105021 - DNA, 20 bp, human
gagcaggtgtcgcgagagtt

SEQ ID NO: 105022 - DNA, 20 bp, human
gtagggagtgtaactatggc

SEQ ID NO: 105023 - DNA, 20 bp, human
gctgcggaacgaaagtgaac

SEQ ID NO: 105024 - DNA, 20 bp, human
gcaccgcgctggaacccctc

SEQ ID NO: 105025 - DNA, 20 bp, human
ggtgaacaggagccgctctt

SEQ ID NO: 105026 - DNA, 20 bp, human
gcagactgaagtgggtgata

SEQ ID NO: 105027 - DNA, 20 bp, human
ggccagatgcagactgaagt

SEQ ID NO: 105028 - DNA, 20 bp, human
ggcagccgcggacctacccc

SEQ ID NO: 105029 - DNA, 20 bp, human
ggtgcaagagaaagcgcgag

SEQ ID NO: 105030 - DNA, 20 bp, human
ggagagcttgataggtagtg

SEQ ID NO: 105031 - DNA, 20 bp, human
gggcaagaggagagcttgat

SEQ ID NO: 105032 - DNA, 20 bp, human
gtaacacctggtcacacctg

SEQ ID NO: 105033 - DNA, 20 bp, human
ggagcagaagacaggaaccg

SEQ ID NO: 105034 - DNA, 20 bp, human
ggcgcgggtatggagcttgg

SEQ ID NO: 105035 - DNA, 20 bp, human
gggctcccggggtaggtccg

SEQ ID NO: 105036 - DNA, 20 bp, human
ggaccacaggggcgcgccaa

SEQ ID NO: 105037 - DNA, 20 bp, human
gagtccttcacatcccgctg

SEQ ID NO: 105038 - DNA, 20 bp, human
gcggcaccccacacacgcga

SEQ ID NO: 105039 - DNA, 20 bp, human
gcggaccgtaccacgcggag

SEQ ID NO: 105040 - DNA, 20 bp, human
gagcggccacgaggcgggag

SEQ ID NO: 105041 - DNA, 20 bp, human
gttcagctggagcggacaca

SEQ ID NO: 105042 - DNA, 20 bp, human
ggcgtgcgaagctctctcag

SEQ ID NO: 105043 - DNA, 20 bp, human
gcgcccccagcgggatgtga

SEQ ID NO: 105044 - DNA, 20 bp, human
gtcacgcggaccgtaccacg

SEQ ID NO: 105045 - DNA, 20 bp, human
ggcgggatgtgaaggactcc

SEQ ID NO: 105046 - DNA, 20 bp, human
ggcggctgcaagaggtaatg

SEQ ID NO: 105047 - DNA, 20 bp, human
gtccctctctgtctgaagga

SEQ ID NO: 105048 - DNA, 20 bp, human
ggagagggagcggctgcaag

SEQ ID NO: 105049 - DNA, 20 bp, human
ggtaaccgtaaaagaataca

SEQ ID NO: 105050 - DNA, 20 bp, human
ggagtatcgctctacgaccc

SEQ ID NO: 105051 - DNA, 20 bp, human
gccgctccctctctgtctga

SEQ ID NO: 105052 - DNA, 20 bp, human
ggtgtttaacaaattaacaa

SEQ ID NO: 105053 - DNA, 20 bp, human
gatcgctctacgacccaggc

SEQ ID NO: 105054 - DNA, 20 bp, human
gaccaaagcaaccaaagatc

SEQ ID NO: 105055 - DNA, 20 bp, human
gtaaatagttaccagatctt

SEQ ID NO: 105056 - DNA, 20 bp, human
gagtcttggagaccgccctg

SEQ ID NO: 105057 - DNA, 20 bp, human
gaggtctctagagctgaccg

SEQ ID NO: 105058 - DNA, 20 bp, human
gtaccgaggctgctgcgcgg

SEQ ID NO: 105059 - DNA, 20 bp, human
gggaagggcagcctgcgcct

SEQ ID NO: 105060 - DNA, 20 bp, human
gagcggcagcgccagagtct

SEQ ID NO: 105061 - DNA, 20 bp, human
ggtcagctctagagacctca

SEQ ID NO: 105062 - DNA, 20 bp, human
gggttggggggcgccctcag

SEQ ID NO: 105063 - DNA, 20 bp, human
ggcgatgtatctccgcaggg

SEQ ID NO: 105064 - DNA, 20 bp, human
gggcgcgatgtatctccgca

SEQ ID NO: 105065 - DNA, 20 bp, human
gagcctcggtacccaggcgc

SEQ ID NO: 105066 - DNA, 20 bp, human
gggcgcgccgcagaaagggc

SEQ ID NO: 105067 - DNA, 20 bp, human
gaaagggctggcgagtcgaa

SEQ ID NO: 105068 - DNA, 20 bp, human
gggcgagtcgaaaggcgagg

SEQ ID NO: 105069 - DNA, 20 bp, human
gccctctcgctagcactcat

SEQ ID NO: 105070 - DNA, 20 bp, human
gccgcacgcacggacgcccg

SEQ ID NO: 105071 - DNA, 20 bp, human
ggctggcgagtcgaaaggcg

SEQ ID NO: 105072 - DNA, 20 bp, human
ggccccggcgcgccgcagaa

SEQ ID NO: 105073 - DNA, 20 bp, human
ggcgccgagagggagcccaa

SEQ ID NO: 105074 - DNA, 20 bp, human
gtgctggagtgaggttaggg

SEQ ID NO: 105075 - DNA, 20 bp, human
gagggagcccaagggacgtc

SEQ ID NO: 105076 - DNA, 20 bp, human
ggaccccaggcggtgagggt

SEQ ID NO: 105077 - DNA, 20 bp, human
gatgggaccccaggcggtga

SEQ ID NO: 105078 - DNA, 20 bp, human
gcccagcagcctgtagtcct

SEQ ID NO: 105079 - DNA, 20 bp, human
gcacccagctgtctcaccat

SEQ ID NO: 105080 - DNA, 20 bp, human
ggccctaggcgggaaggact

SEQ ID NO: 105081 - DNA, 20 bp, human
gccgggcgcagacccgttct

SEQ ID NO: 105082 - DNA, 20 bp, human
gtacccaccctcaccgcctg

SEQ ID NO: 105083 - DNA, 20 bp, human
gggcgtgggtcctgatcaca

SEQ ID NO: 105084 - DNA, 20 bp, human
gccaccagccctaggcggga

SEQ ID NO: 105085 - DNA, 20 bp, human
gcggtgagggtgggtagccg

SEQ ID NO: 105086 - DNA, 20 bp, human
gacgcggcctcgcctcactc

SEQ ID NO: 105087 - DNA, 20 bp, human
gcagttgcgggttgtcataa

SEQ ID NO: 105088 - DNA, 20 bp, human
gcggccagaactgagcgacg

SEQ ID NO: 105089 - DNA, 20 bp, human
gaacggtccccgccggagtg

SEQ ID NO: 105090 - DNA, 20 bp, human
gcacccgtcagcagcctcga

SEQ ID NO: 105091 - DNA, 20 bp, human
ggcccgggatgagttagcga

SEQ ID NO: 105092 - DNA, 20 bp, human
gagccctcgaggctgctgac

SEQ ID NO: 105093 - DNA, 20 bp, human
gacaacccgcaactgccccg

SEQ ID NO: 105094 - DNA, 20 bp, human
ggccgtctagggcccctgta

SEQ ID NO: 105095 - DNA, 20 bp, human
gtccttacaggggccctaga

SEQ ID NO: 105096 - DNA, 20 bp, human
ggcccgctgggtctcagcaa

SEQ ID NO: 105097 - DNA, 20 bp, human
gcgctgggtctcagcaacgg

SEQ ID NO: 105098 - DNA, 20 bp, human
ggcacgcacggtcacaggag

SEQ ID NO: 105099 - DNA, 20 bp, human
gcgcctcgcaccgcagactc

SEQ ID NO: 105100 - DNA, 20 bp, human
ggctcggctgcaccccgggg

SEQ ID NO: 105101 - DNA, 20 bp, human
ggagctccccggtccccgga

SEQ ID NO: 105102 - DNA, 20 bp, human
gatggggcgagaggctgcgg

SEQ ID NO: 105103 - DNA, 20 bp, human
gtcgatccagcacgcgcggg

SEQ ID NO: 105104 - DNA, 20 bp, human
gccccgagcgtgaccttagg

SEQ ID NO: 105105 - DNA, 20 bp, human
gcactcgatccagcacgcgc

SEQ ID NO: 105106 - DNA, 20 bp, human
ggcggctacagcagctccgc

SEQ ID NO: 105107 - DNA, 20 bp, human
gtggcgtcgccgtgctcccg

SEQ ID NO: 105108 - DNA, 20 bp, human
gcgcagcccccgggtcccac

SEQ ID NO: 105109 - DNA, 20 bp, human
gagcacggcgacgccagcgg

SEQ ID NO: 105110 - DNA, 20 bp, human
gggagcgccaggaacgcacc

SEQ ID NO: 105111 - DNA, 20 bp, human
gagcaaagtgctgatccggg

SEQ ID NO: 105112 - DNA, 20 bp, human
gccgcaccgcgcacccctcg

SEQ ID NO: 105113 - DNA, 20 bp, human
gcggccggagctctgtgcgg

SEQ ID NO: 105114 - DNA, 20 bp, human
ggagatccacctgctggtaa

SEQ ID NO: 105115 - DNA, 20 bp, human
gcgacgccagcggcgggtga

SEQ ID NO: 105116 - DNA, 20 bp, human
gggctcactgcagatatcag

SEQ ID NO: 105117 - DNA, 20 bp, human
gcctggtacgcggcactcag

SEQ ID NO: 105118 - DNA, 20 bp, human
gtggcgcacctgggcgtcgg

SEQ ID NO: 105119 - DNA, 20 bp, human
gaagcttgcgccctgagggg

SEQ ID NO: 105120 - DNA, 20 bp, human
gtatcaggggcgcgggacac

SEQ ID NO: 105121 - DNA, 20 bp, human
gacaaagcttgcgccctgag

SEQ ID NO: 105122 - DNA, 20 bp, human
gcaggggcgcgggacactgg

SEQ ID NO: 105123 - DNA, 20 bp, human
gcgcgtaccaggacagcgag

SEQ ID NO: 105124 - DNA, 20 bp, human
gggggaaggggcgcctgcgt

SEQ ID NO: 105125 - DNA, 20 bp, human
gggcggccggaagccgacgc

SEQ ID NO: 105126 - DNA, 20 bp, human
gaatgaaaggcaggtaaatc

SEQ ID NO: 105127 - DNA, 20 bp, human
gatgtaaacatccatcataa

SEQ ID NO: 105128 - DNA, 20 bp, human
gaggctgcacagagcactgt

SEQ ID NO: 105129 - DNA, 20 bp, human
gtggaagcatgagtgatcct

SEQ ID NO: 105130 - DNA, 20 bp, human
gcagcacagtgccattatga

SEQ ID NO: 105131 - DNA, 20 bp, human
gcacacaaaagcgagataat

SEQ ID NO: 105132 - DNA, 20 bp, human
gtattagtattaaagaatag

SEQ ID NO: 105133 - DNA, 20 bp, human
gagtctacagcaacactact

SEQ ID NO: 105134 - DNA, 20 bp, human
gcgcttttgtgtgaggccca

SEQ ID NO: 105135 - DNA, 20 bp, human
gccggcttcgctttagaaaa

SEQ ID NO: 105136 - DNA, 20 bp, human
gagagccgcgagcccagaag

SEQ ID NO: 105137 - DNA, 20 bp, human
ggtgggagctcagtcgacca

SEQ ID NO: 105138 - DNA, 20 bp, human
gctgggctcgcggctctaga

SEQ ID NO: 105139 - DNA, 20 bp, human
gcgacgcgatcacccggatc

SEQ ID NO: 105140 - DNA, 20 bp, human
gctgctgctgcccaacaagg

SEQ ID NO: 105141 - DNA, 20 bp, human
gggaaggttgccagaaattg

SEQ ID NO: 105142 - DNA, 20 bp, human
gcagccccgagacgcagcag

SEQ ID NO: 105143 - DNA, 20 bp, human
ggagctcagtcgaccagggc

SEQ ID NO: 105144 - DNA, 20 bp, human
gcgcagcagaggcgctcctg

SEQ ID NO: 105145 - DNA, 20 bp, human
ggcggcagaggagcgacgga

SEQ ID NO: 105146 - DNA, 20 bp, human
gcctcctccgaggaacaatg

SEQ ID NO: 105147 - DNA, 20 bp, human
gcgcgcgacgctacgcccgg

SEQ ID NO: 105148 - DNA, 20 bp, human
gggcctgggcgtgcagcgga

SEQ ID NO: 105149 - DNA, 20 bp, human
gcgcccatggctctcgacga

SEQ ID NO: 105150 - DNA, 20 bp, human
gacgccggacaccagagcgc

SEQ ID NO: 105151 - DNA, 20 bp, human
ggcgccgcattgttcctcgg

SEQ ID NO: 105152 - DNA, 20 bp, human
gccgcccgcgctctggtgtc

SEQ ID NO: 105153 - DNA, 20 bp, human
gggaacaatgcggcgcctcc

SEQ ID NO: 105154 - DNA, 20 bp, human
gcggcgggcgccctcatccc

SEQ ID NO: 105155 - DNA, 20 bp, human
gagggttcgtggcccggacg

SEQ ID NO: 105156 - DNA, 20 bp, human
gataaacaggaagcgggcgg

SEQ ID NO: 105157 - DNA, 20 bp, human
ggcgccccagcttaaagccg

SEQ ID NO: 105158 - DNA, 20 bp, human
ggcagcagagggagagctcg

SEQ ID NO: 105159 - DNA, 20 bp, human
gcaacggacagaggtcgagg

SEQ ID NO: 105160 - DNA, 20 bp, human
gtccagcgatgcccccgcag

SEQ ID NO: 105161 - DNA, 20 bp, human
gggcaggaggatggtgcaga

SEQ ID NO: 105162 - DNA, 20 bp, human
gagacctaagattatcggga

SEQ ID NO: 105163 - DNA, 20 bp, human
gagcgatgcccccgcagagg

SEQ ID NO: 105164 - DNA, 20 bp, human
gccgaatgcccggatgagaa

SEQ ID NO: 105165 - DNA, 20 bp, human
gagtgcggataaacaggaag

SEQ ID NO: 105166 - DNA, 20 bp, human
ggccgctgggaaaaccgggt

SEQ ID NO: 105167 - DNA, 20 bp, human
ggcttcgcggcgacagggtg

SEQ ID NO: 105168 - DNA, 20 bp, human
ggcccacccggttttcccag

SEQ ID NO: 105169 - DNA, 20 bp, human
gggtcgcgcgcagctcgtcc

SEQ ID NO: 105170 - DNA, 20 bp, human
ggtagccccgaagctgtcat

SEQ ID NO: 105171 - DNA, 20 bp, human
gtcccggacacgcccggcgt

SEQ ID NO: 105172 - DNA, 20 bp, human
gcccaccggcaggctctccg

SEQ ID NO: 105173 - DNA, 20 bp, human
gcaaggcaaagtcgccccca

SEQ ID NO: 105174 - DNA, 20 bp, human
gcgctcggggaacgcgacag

SEQ ID NO: 105175 - DNA, 20 bp, human
gtgctccccacccctgacgg

SEQ ID NO: 105176 - DNA, 20 bp, human
gcccagcctacggcaagtgt

SEQ ID NO: 105177 - DNA, 20 bp, human
gtaaataaaagcccagccta

SEQ ID NO: 105178 - DNA, 20 bp, human
ggcgggacggatgaaagtac

SEQ ID NO: 105179 - DNA, 20 bp, human
gaggtaccgacacttgccgt

SEQ ID NO: 105180 - DNA, 20 bp, human
gatgtgacgcccaggaaggg

SEQ ID NO: 105181 - DNA, 20 bp, human
gttgagagttaagcgaagtg

SEQ ID NO: 105182 - DNA, 20 bp, human
ggggaggcgtgtgcgagaca

SEQ ID NO: 105183 - DNA, 20 bp, human
ggatggagcccgtcccatgg

SEQ ID NO: 105184 - DNA, 20 bp, human
gtgtgtggccgccatgggac

SEQ ID NO: 105185 - DNA, 20 bp, human
gaggactgtgtggccgccat

SEQ ID NO: 105186 - DNA, 20 bp, human
gcgacgcccgcaggtcctcg

SEQ ID NO: 105187 - DNA, 20 bp, human
gcaagccaaggcccgcgcag

SEQ ID NO: 105188 - DNA, 20 bp, human
gtgcgcaccgcgaggacctg

SEQ ID NO: 105189 - DNA, 20 bp, human
ggaaaggctgggcaacacct

SEQ ID NO: 105190 - DNA, 20 bp, human
gaggctgggcaacacctggg

SEQ ID NO: 105191 - DNA, 20 bp, human
gtgcgacttggtgagtgtct

SEQ ID NO: 105192 - DNA, 20 bp, human
ggcacctagaggtaaggcag

SEQ ID NO: 105193 - DNA, 20 bp, human
gcgggacgcaaagcgttcta

SEQ ID NO: 105194 - DNA, 20 bp, human
gcctcgctcccggaagagtg

SEQ ID NO: 105195 - DNA, 20 bp, human
gggctgtcccagcatatccg

SEQ ID NO: 105196 - DNA, 20 bp, human
ggtcttgtgtagcagcagta

SEQ ID NO: 105197 - DNA, 20 bp, human
gtagggagagaggctcctac

SEQ ID NO: 105198 - DNA, 20 bp, human
gccttccactaacatcccgt

SEQ ID NO: 105199 - DNA, 20 bp, human
gggcggccaggatggcaaga

SEQ ID NO: 105200 - DNA, 20 bp, human
gaacaggcaaacccgttcag

SEQ ID NO: 105201 - DNA, 20 bp, human
gagaaggatcaggctcttca

SEQ ID NO: 105202 - DNA, 20 bp, human
gggctcctacgggatgttag

SEQ ID NO: 105203 - DNA, 20 bp, human
gatttagactttggtatcaa

SEQ ID NO: 105204 - DNA, 20 bp, human
gacagagacttaccactgaa

SEQ ID NO: 105205 - DNA, 20 bp, human
gcacaaagttactaccgcta

SEQ ID NO: 105206 - DNA, 20 bp, human
ggccagggccggaacgggag

SEQ ID NO: 105207 - DNA, 20 bp, human
gggaacgggagcggcgacag

SEQ ID NO: 105208 - DNA, 20 bp, human
ggcagcgccaggtacggctc

SEQ ID NO: 105209 - DNA, 20 bp, human
gccgcacggacgctcgtcca

SEQ ID NO: 105210 - DNA, 20 bp, human
gtagcaacgaggcccggagg

SEQ ID NO: 105211 - DNA, 20 bp, human
ggctcgggcaggttcctccg

SEQ ID NO: 105212 - DNA, 20 bp, human
gagaggggccagggccggaa

SEQ ID NO: 105213 - DNA, 20 bp, human
ggcgctcaccggacttcgga

SEQ ID NO: 105214 - DNA, 20 bp, human
gggacgctcgtccacggccg

SEQ ID NO: 105215 - DNA, 20 bp, human
gccccacggccccgatccct

SEQ ID NO: 105216 - DNA, 20 bp, human
gacgcacggtgaggccgagg

SEQ ID NO: 105217 - DNA, 20 bp, human
gcctcccagtacgcacggtg

SEQ ID NO: 105218 - DNA, 20 bp, human
gtgcattgcgcgcgacccgg

SEQ ID NO: 105219 - DNA, 20 bp, human
gagtacgcacggtgaggccg

SEQ ID NO: 105220 - DNA, 20 bp, human
gggggaccgcatgcaaaggg

SEQ ID NO: 105221 - DNA, 20 bp, human
gtctcccctcccagtacgca

SEQ ID NO: 105222 - DNA, 20 bp, human
ggcgatgtctcaggtttcat

SEQ ID NO: 105223 - DNA, 20 bp, human
ggaaggggaccgcatgcaaa

SEQ ID NO: 105224 - DNA, 20 bp, human
ggcgcgcaatgcagggactg

SEQ ID NO: 105225 - DNA, 20 bp, human
gatgcaaagggtggcaggca

SEQ ID NO: 105226 - DNA, 20 bp, human
gtctggaacagaagtcagga

SEQ ID NO: 105227 - DNA, 20 bp, human
gggcctgtcagcaaagtaag

SEQ ID NO: 105228 - DNA, 20 bp, human
gggcggcatgggtgaccctg

SEQ ID NO: 105229 - DNA, 20 bp, human
ggctacctgcaagggcaagt

SEQ ID NO: 105230 - DNA, 20 bp, human
gggctgaatgacctttgctc

SEQ ID NO: 105231 - DNA, 20 bp, human
gctgaggcgactgtgctctg

SEQ ID NO: 105232 - DNA, 20 bp, human
ggccccacagcgttccagtt

SEQ ID NO: 105233 - DNA, 20 bp, human
ggagcgcacgggaagataaa

SEQ ID NO: 105234 - DNA, 20 bp, human
gtgcccttgcaggtagctct

SEQ ID NO: 105235 - DNA, 20 bp, human
gagttgggagaactaatctc

SEQ ID NO: 105236 - DNA, 20 bp, human
gcccagcagagccaccgtag

SEQ ID NO: 105237 - DNA, 20 bp, human
gaggtcgggtggtctccgga

SEQ ID NO: 105238 - DNA, 20 bp, human
gtggtctccggaaggcagaa

SEQ ID NO: 105239 - DNA, 20 bp, human
gtctgcgccggaacagcaga

SEQ ID NO: 105240 - DNA, 20 bp, human
gcccgggctctgcagtctgg

SEQ ID NO: 105241 - DNA, 20 bp, human
gagctgttcgaaggtgatcc

SEQ ID NO: 105242 - DNA, 20 bp, human
gaaactgcgcagcgcggtgt

SEQ ID NO: 105243 - DNA, 20 bp, human
gagcagagggcaaggtcggg

SEQ ID NO: 105244 - DNA, 20 bp, human
gctagccccgccccaggcga

SEQ ID NO: 105245 - DNA, 20 bp, human
ggcgcctaaaaccgctacgg

SEQ ID NO: 105246 - DNA, 20 bp, human
gggctgtagccggagtggag

SEQ ID NO: 105247 - DNA, 20 bp, human
gcagccccgccccttcactc

SEQ ID NO: 105248 - DNA, 20 bp, human
gccgggcccggggagtagga

SEQ ID NO: 105249 - DNA, 20 bp, human
ggcggggctgactgcatgaa

SEQ ID NO: 105250 - DNA, 20 bp, human
ggggccttaatggatctggg

SEQ ID NO: 105251 - DNA, 20 bp, human
gatggaagctcgggaccctg

SEQ ID NO: 105252 - DNA, 20 bp, human
gggctagagggaacactgaa

SEQ ID NO: 105253 - DNA, 20 bp, human
ggtggagcggctgccagccg

SEQ ID NO: 105254 - DNA, 20 bp, human
gaaggagccggggctgtagc

SEQ ID NO: 105255 - DNA, 20 bp, human
gtgagggagctggtcctgag

SEQ ID NO: 105256 - DNA, 20 bp, human
ggccgtgggcggctcttctg

SEQ ID NO: 105257 - DNA, 20 bp, human
gccttgtactacgggagaga

SEQ ID NO: 105258 - DNA, 20 bp, human
gcaagctgaagggccgtggg

SEQ ID NO: 105259 - DNA, 20 bp, human
gctccaagctgaagggccgt

SEQ ID NO: 105260 - DNA, 20 bp, human
gagggaagggtacagagctg

SEQ ID NO: 105261 - DNA, 20 bp, human
ggagtgcagccgtaagaatg

SEQ ID NO: 105262 - DNA, 20 bp, human
ggggaggcagcgtgagtctt

SEQ ID NO: 105263 - DNA, 20 bp, human
gtgcagccgtaagaatgggg

SEQ ID NO: 105264 - DNA, 20 bp, human
gatgacaccaaggcacacca

SEQ ID NO: 105265 - DNA, 20 bp, human
gctgacaccaggtccggaga

SEQ ID NO: 105266 - DNA, 20 bp, human
gccaacaagccgatagaaaa

SEQ ID NO: 105267 - DNA, 20 bp, human
gtggattatgaagtacagct

SEQ ID NO: 105268 - DNA, 20 bp, human
gctggagagtacaaaactgc

SEQ ID NO: 105269 - DNA, 20 bp, human
gcactaactataagagaaaa

SEQ ID NO: 105270 - DNA, 20 bp, human
gtgcagagcctcaatttagg

SEQ ID NO: 105271 - DNA, 20 bp, human
gcagagaaatagccagaaga

SEQ ID NO: 105272 - DNA, 20 bp, human
ggataccattgagaaatatt

SEQ ID NO: 105273 - DNA, 20 bp, human
ggataactacctttttctat

SEQ ID NO: 105274 - DNA, 20 bp, human
gtaatccaaatatttctcaa

SEQ ID NO: 105275 - DNA, 20 bp, human
gtggcagaccttaaaaaatg

SEQ ID NO: 105276 - DNA, 20 bp, human
gccccgaggtgaccacaaca

SEQ ID NO: 105277 - DNA, 20 bp, human
ggctggcccggcacccgcca

SEQ ID NO: 105278 - DNA, 20 bp, human
ggcagccagacgagcagccc

SEQ ID NO: 105279 - DNA, 20 bp, human
gccgcgtcaccggctccccg

SEQ ID NO: 105280 - DNA, 20 bp, human
ggccgccgcggagacccccg

SEQ ID NO: 105281 - DNA, 20 bp, human
gcaacatggctgcggcgcct

SEQ ID NO: 105282 - DNA, 20 bp, human
gggcgcctgggctgctcgtc

SEQ ID NO: 105283 - DNA, 20 bp, human
gggtgaccacaacatggctg

SEQ ID NO: 105284 - DNA, 20 bp, human
gtaaaacgctggcaacaagt

SEQ ID NO: 105285 - DNA, 20 bp, human
gccccatggtcaggcccgag

SEQ ID NO: 105286 - DNA, 20 bp, human
gggaaaggccccaattcagg

SEQ ID NO: 105287 - DNA, 20 bp, human
gcggcataaagcgaaagtgc

SEQ ID NO: 105288 - DNA, 20 bp, human
ggagtccgccccctgaattg

SEQ ID NO: 105289 - DNA, 20 bp, human
gtgaattggggcctttccgg

SEQ ID NO: 105290 - DNA, 20 bp, human
gatggagtgtgtcagatccg

SEQ ID NO: 105291 - DNA, 20 bp, human
gagagcttcctcctccggaa

SEQ ID NO: 105292 - DNA, 20 bp, human
ggcggcgatagaaggcacag

SEQ ID NO: 105293 - DNA, 20 bp, human
gaaggccccaattcaggggg

SEQ ID NO: 105294 - DNA, 20 bp, human
gcgggggacccggaacttgt

SEQ ID NO: 105295 - DNA, 20 bp, human
gattggggcctttccggagg

SEQ ID NO: 105296 - DNA, 20 bp, human
gcggcaataatagagtggga

SEQ ID NO: 105297 - DNA, 20 bp, human
gtgtctaggagggggatcct

SEQ ID NO: 105298 - DNA, 20 bp, human
gcgcgcgatcgcgggaagaa

SEQ ID NO: 105299 - DNA, 20 bp, human
gtcctcggcaataatagagt

SEQ ID NO: 105300 - DNA, 20 bp, human
ggcgatcgcgggaagaaagg

SEQ ID NO: 105301 - DNA, 20 bp, human
ggccgtacccaaggccggag

SEQ ID NO: 105302 - DNA, 20 bp, human
gcccggccaggctacagcga

SEQ ID NO: 105303 - DNA, 20 bp, human
ggaccctggagagacgctta

SEQ ID NO: 105304 - DNA, 20 bp, human
gaggaaaccacgctctcccc

SEQ ID NO: 105305 - DNA, 20 bp, human
ggtaccaccgctgcccacgg

SEQ ID NO: 105306 - DNA, 20 bp, human
ggccgcggccgccagacccc

SEQ ID NO: 105307 - DNA, 20 bp, human
ggccgcggctcgcagacgtc

SEQ ID NO: 105308 - DNA, 20 bp, human
ggcggctcgcagacgtcagg

SEQ ID NO: 105309 - DNA, 20 bp, human
gggcgttcgaggccacccac

SEQ ID NO: 105310 - DNA, 20 bp, human
ggaggctccgggacgcgcac

SEQ ID NO: 105311 - DNA, 20 bp, human
gcccgggcgcacgcaattac

SEQ ID NO: 105312 - DNA, 20 bp, human
gcgcgcgggactccagctcc

SEQ ID NO: 105313 - DNA, 20 bp, human
gggtcgtcgtccgggccggg

SEQ ID NO: 105314 - DNA, 20 bp, human
gccacgggcacgaatgacag

SEQ ID NO: 105315 - DNA, 20 bp, human
gcctgcgcgctcagacccca

SEQ ID NO: 105316 - DNA, 20 bp, human
ggacgtcgccaccctctcag

SEQ ID NO: 105317 - DNA, 20 bp, human
gaggcagcccgggaacccat

SEQ ID NO: 105318 - DNA, 20 bp, human
gctctcagcggctcaagcag

SEQ ID NO: 105319 - DNA, 20 bp, human
ggcttgagccgctgagaggg

SEQ ID NO: 105320 - DNA, 20 bp, human
ggctccctgcgccaccgaca

SEQ ID NO: 105321 - DNA, 20 bp, human
gttccgcggcgccttctccc

SEQ ID NO: 105322 - DNA, 20 bp, human
gcagtccttctgaggcccat

SEQ ID NO: 105323 - DNA, 20 bp, human
gcaagcagtggccggggaga

SEQ ID NO: 105324 - DNA, 20 bp, human
gggctcctgtgccctgtcgg

SEQ ID NO: 105325 - DNA, 20 bp, human
gagctcccggaggtgcaaaa

SEQ ID NO: 105326 - DNA, 20 bp, human
gctgcgggtggcccggacga

SEQ ID NO: 105327 - DNA, 20 bp, human
gggcagacggaatctcatga

SEQ ID NO: 105328 - DNA, 20 bp, human
gccgctggacgacttaccgg

SEQ ID NO: 105329 - DNA, 20 bp, human
ggctccgctggacgacttac

SEQ ID NO: 105330 - DNA, 20 bp, human
gacggaatctcatgacggaa

SEQ ID NO: 105331 - DNA, 20 bp, human
gctggagtcgcgcggagtgt

SEQ ID NO: 105332 - DNA, 20 bp, human
gcagcccgccgcgccgagac

SEQ ID NO: 105333 - DNA, 20 bp, human
gaacaggaagcggcccctcc

SEQ ID NO: 105334 - DNA, 20 bp, human
gccgggccacccgcagcggg

SEQ ID NO: 105335 - DNA, 20 bp, human
gcaaccaggtctgagcgggt

SEQ ID NO: 105336 - DNA, 20 bp, human
ggcgggccactgacagagct

SEQ ID NO: 105337 - DNA, 20 bp, human
gggtagttcggcgtgccggt

SEQ ID NO: 105338 - DNA, 20 bp, human
gggccgcgggcgcagcgatc

SEQ ID NO: 105339 - DNA, 20 bp, human
gtgttgcggagcggagtaag

SEQ ID NO: 105340 - DNA, 20 bp, human
gtccaacgcccgggagggtc

SEQ ID NO: 105341 - DNA, 20 bp, human
ggcaagcgccaaaacggggt

SEQ ID NO: 105342 - DNA, 20 bp, human
gagttcggcgtgccggtggg

SEQ ID NO: 105343 - DNA, 20 bp, human
gagcggagtaagaggtagtt

SEQ ID NO: 105344 - DNA, 20 bp, human
gccgtgtccaacgcccggga

SEQ ID NO: 105345 - DNA, 20 bp, human
gcccagcccggtccaccgcg

SEQ ID NO: 105346 - DNA, 20 bp, human
gctcgggctgcggaacaggg

SEQ ID NO: 105347 - DNA, 20 bp, human
gcctaccgcgccggacgctc

SEQ ID NO: 105348 - DNA, 20 bp, human
gacgctcgggctgcggaaca

SEQ ID NO: 105349 - DNA, 20 bp, human
gcggctggtcctgagttccg

SEQ ID NO: 105350 - DNA, 20 bp, human
gcgagggacaccgcagtatg

SEQ ID NO: 105351 - DNA, 20 bp, human
ggcagcccgagcgtccggcg

SEQ ID NO: 105352 - DNA, 20 bp, human
gcacctggccacgcatcctc

SEQ ID NO: 105353 - DNA, 20 bp, human
gctcggcgccggcgtcgctg

SEQ ID NO: 105354 - DNA, 20 bp, human
gctggccacgcatcctccgg

SEQ ID NO: 105355 - DNA, 20 bp, human
gcggctgctacctaccgcgc

SEQ ID NO: 105356 - DNA, 20 bp, human
gccgcgtaggcaggcacccg

SEQ ID NO: 105357 - DNA, 20 bp, human
gtgcagccccggcggagtcc

SEQ ID NO: 105358 - DNA, 20 bp, human
ggccgcgcggcgaggacgga

SEQ ID NO: 105359 - DNA, 20 bp, human
gcggcggggagcgcccgcgt

SEQ ID NO: 105360 - DNA, 20 bp, human
ggcgcggcctgagaacccct

SEQ ID NO: 105361 - DNA, 20 bp, human
gtgggcgcctgcctcggcag

SEQ ID NO: 105362 - DNA, 20 bp, human
gtaccctccagtccccctgt

SEQ ID NO: 105363 - DNA, 20 bp, human
gacgtggcatccgcactggt

SEQ ID NO: 105364 - DNA, 20 bp, human
gctccccgccgggactccgc

SEQ ID NO: 105365 - DNA, 20 bp, human
gggagggtactcaccgacta

SEQ ID NO: 105366 - DNA, 20 bp, human
gggctccctctagtcagcag

SEQ ID NO: 105367 - DNA, 20 bp, human
ggggacagcagtatggtgtg

SEQ ID NO: 105368 - DNA, 20 bp, human
gtagagggagccttttccaa

SEQ ID NO: 105369 - DNA, 20 bp, human
ggccagagagataccatgta

SEQ ID NO: 105370 - DNA, 20 bp, human
gatcttgagtcccttggaaa

SEQ ID NO: 105371 - DNA, 20 bp, human
gtatttccactgctgactag

SEQ ID NO: 105372 - DNA, 20 bp, human
gcttgcctctgacaaccagg

SEQ ID NO: 105373 - DNA, 20 bp, human
gaagcaaataccagaactgg

SEQ ID NO: 105374 - DNA, 20 bp, human
gcccaagcaaataccagaac

SEQ ID NO: 105375 - DNA, 20 bp, human
ggtttggtagagtgtgttgt

SEQ ID NO: 105376 - DNA, 20 bp, human
gggagagttcgggatcccac

SEQ ID NO: 105377 - DNA, 20 bp, human
gtccctgagaccccggccca

SEQ ID NO: 105378 - DNA, 20 bp, human
ggatcccgaactctcccccg

SEQ ID NO: 105379 - DNA, 20 bp, human
gccacgaccggcccacaatg

SEQ ID NO: 105380 - DNA, 20 bp, human
gtcggcgtctccgtgtccgg

SEQ ID NO: 105381 - DNA, 20 bp, human
ggcagaaggccaggccgtcc

SEQ ID NO: 105382 - DNA, 20 bp, human
ggagttcgggatcccacggg

SEQ ID NO: 105383 - DNA, 20 bp, human
gcgcagccgcagccggaaac

SEQ ID NO: 105384 - DNA, 20 bp, human
gcgccgtcccggccaagccg

SEQ ID NO: 105385 - DNA, 20 bp, human
gccgccctgaccccgcccgt

SEQ ID NO: 105386 - DNA, 20 bp, human
gacagacgctgggaccgcta

SEQ ID NO: 105387 - DNA, 20 bp, human
gtacggaaccgccagaccca

SEQ ID NO: 105388 - DNA, 20 bp, human
ggcactcgtcgccctcagtc

SEQ ID NO: 105389 - DNA, 20 bp, human
gcggccggcgggacagacgc

SEQ ID NO: 105390 - DNA, 20 bp, human
gccagctgcattcggtgtcc

SEQ ID NO: 105391 - DNA, 20 bp, human
gccactgaggacagcctcgg

SEQ ID NO: 105392 - DNA, 20 bp, human
gcacagccgcgggaaggtgt

SEQ ID NO: 105393 - DNA, 20 bp, human
gcatcagggcgctgcaacag

SEQ ID NO: 105394 - DNA, 20 bp, human
ggccctccgacaccttcccg

SEQ ID NO: 105395 - DNA, 20 bp, human
gggatggggagccgaggcgt

SEQ ID NO: 105396 - DNA, 20 bp, human
gtgagaaggtggcgacgtag

SEQ ID NO: 105397 - DNA, 20 bp, human
gcaggaaccccactcaccag

SEQ ID NO: 105398 - DNA, 20 bp, human
gggctgccgggggtgcaaaa

SEQ ID NO: 105399 - DNA, 20 bp, human
gggcgacggccagaaacagc

SEQ ID NO: 105400 - DNA, 20 bp, human
gtttcgacggggtcttctca

SEQ ID NO: 105401 - DNA, 20 bp, human
gctcacgggtttcattcagt

SEQ ID NO: 105402 - DNA, 20 bp, human
ggcgctcgcggcaacccacc

SEQ ID NO: 105403 - DNA, 20 bp, human
gggcagccgccgctggtgag

SEQ ID NO: 105404 - DNA, 20 bp, human
gggtgtgctgtctggagtgc

SEQ ID NO: 105405 - DNA, 20 bp, human
ggagcggcggggcgtttccg

SEQ ID NO: 105406 - DNA, 20 bp, human
gagcacttgccttagatccc

SEQ ID NO: 105407 - DNA, 20 bp, human
gagcatagtttgagacagag

SEQ ID NO: 105408 - DNA, 20 bp, human
ggcctcccctagcccagggg

SEQ ID NO: 105409 - DNA, 20 bp, human
gcctctgtgctcgtgagtcc

SEQ ID NO: 105410 - DNA, 20 bp, human
ggtgtgccagctccagcaaa

SEQ ID NO: 105411 - DNA, 20 bp, human
gcatgaagccagtcctcccc

SEQ ID NO: 105412 - DNA, 20 bp, human
ggagttgcttctcagcgccg

SEQ ID NO: 105413 - DNA, 20 bp, human
ggcatttagaagcggtttca

SEQ ID NO: 105414 - DNA, 20 bp, human
gtcgtgagtccagggatcta

SEQ ID NO: 105415 - DNA, 20 bp, human
gccctagcccaggggaggac

SEQ ID NO: 105416 - DNA, 20 bp, human
gtcatctctatggctgtcag

SEQ ID NO: 105417 - DNA, 20 bp, human
gattccaggagagccagtca

SEQ ID NO: 105418 - DNA, 20 bp, human
gcgggaggcaagcaagacta

SEQ ID NO: 105419 - DNA, 20 bp, human
ggtgggcggctttgaccgag

SEQ ID NO: 105420 - DNA, 20 bp, human
gcagtcgcctgtgaggaggg

SEQ ID NO: 105421 - DNA, 20 bp, human
gagagtcacgtgagagtggg

SEQ ID NO: 105422 - DNA, 20 bp, human
gaggagagtcacgtgagagt

SEQ ID NO: 105423 - DNA, 20 bp, human
ggagcgcatcagggagagac

SEQ ID NO: 105424 - DNA, 20 bp, human
gacactctggtagccttgac

SEQ ID NO: 105425 - DNA, 20 bp, human
gagtgtcccagtcgcctgtg

SEQ ID NO: 105426 - DNA, 20 bp, human
gtgcgcttccgcaaagatgg

SEQ ID NO: 105427 - DNA, 20 bp, human
ggtccgcggggttctcccaa

SEQ ID NO: 105428 - DNA, 20 bp, human
gggagggaggagcttgactg

SEQ ID NO: 105429 - DNA, 20 bp, human
gccccggcctgagtccccga

SEQ ID NO: 105430 - DNA, 20 bp, human
gcgcggggttctcccaaggg

SEQ ID NO: 105431 - DNA, 20 bp, human
gccgcggacgctgaacacca

SEQ ID NO: 105432 - DNA, 20 bp, human
gagggcgctccgatccgcag

SEQ ID NO: 105433 - DNA, 20 bp, human
gggagcgccctgcgactggt

SEQ ID NO: 105434 - DNA, 20 bp, human
ggcctaagggcgtcagggga

SEQ ID NO: 105435 - DNA, 20 bp, human
gccagcctcgaaggccctcg

SEQ ID NO: 105436 - DNA, 20 bp, human
gagagtggaggagacacccg

SEQ ID NO: 105437 - DNA, 20 bp, human
ggtggaggagacacccgggg

SEQ ID NO: 105438 - DNA, 20 bp, human
ggcccccacggcccaaggag

SEQ ID NO: 105439 - DNA, 20 bp, human
ggtgtgggcggcctccgcta

SEQ ID NO: 105440 - DNA, 20 bp, human
gcgcagcgcagccatagcgg

SEQ ID NO: 105441 - DNA, 20 bp, human
gcttcgcagcgcagccatag

SEQ ID NO: 105442 - DNA, 20 bp, human
ggggatgctgcccatcccag

SEQ ID NO: 105443 - DNA, 20 bp, human
gggccgcccacaccagagct

SEQ ID NO: 105444 - DNA, 20 bp, human
gtggcagccgccactgggat

SEQ ID NO: 105445 - DNA, 20 bp, human
gtgcgctgcgaaggctcttg

SEQ ID NO: 105446 - DNA, 20 bp, human
gtcataggctgggggagaaa

SEQ ID NO: 105447 - DNA, 20 bp, human
gtgcgtttggcggaaagacg

SEQ ID NO: 105448 - DNA, 20 bp, human
ggcaacccggcgaaatctac

SEQ ID NO: 105449 - DNA, 20 bp, human
gccgccaaacgcatcgacta

SEQ ID NO: 105450 - DNA, 20 bp, human
gcgcgtcgcagtcttcagag

SEQ ID NO: 105451 - DNA, 20 bp, human
gcccccagcctatgaaaagt

SEQ ID NO: 105452 - DNA, 20 bp, human
gcctgcgaccgacttttcat

SEQ ID NO: 105453 - DNA, 20 bp, human
gcaattagaggcaaaagtgg

SEQ ID NO: 105454 - DNA, 20 bp, human
gagtcggtcgcagggaagcg

SEQ ID NO: 105455 - DNA, 20 bp, human
gtgtcttgcgggctcctgtc

SEQ ID NO: 105456 - DNA, 20 bp, human
ggcaagcggctgctacgcaa

SEQ ID NO: 105457 - DNA, 20 bp, human
gagggcgctgctgcggtcag

SEQ ID NO: 105458 - DNA, 20 bp, human
gctgccagcgagacgagagt

SEQ ID NO: 105459 - DNA, 20 bp, human
gtgagcacctgggatgggta

SEQ ID NO: 105460 - DNA, 20 bp, human
gggactgtgactgcggacgg

SEQ ID NO: 105461 - DNA, 20 bp, human
gatggctgagggtgctctgt

SEQ ID NO: 105462 - DNA, 20 bp, human
gggcgcccggaaactcgcga

SEQ ID NO: 105463 - DNA, 20 bp, human
gctacgcaagggcgctgctg

SEQ ID NO: 105464 - DNA, 20 bp, human
gcgtaggtgggcgaggaggt

SEQ ID NO: 105465 - DNA, 20 bp, human
gtaaattgagcacctgggat

SEQ ID NO: 105466 - DNA, 20 bp, human
ggcggcgtcggcgacggtag

SEQ ID NO: 105467 - DNA, 20 bp, human
gcccccagcccttcctctgg

SEQ ID NO: 105468 - DNA, 20 bp, human
gcggcggcctacagtggtag

SEQ ID NO: 105469 - DNA, 20 bp, human
ggggcagcaccatgacacca

SEQ ID NO: 105470 - DNA, 20 bp, human
gctccggtcactcctgccag

SEQ ID NO: 105471 - DNA, 20 bp, human
gggcgggcggcggcctacag

SEQ ID NO: 105472 - DNA, 20 bp, human
gcatgtaaacgtgcctccag

SEQ ID NO: 105473 - DNA, 20 bp, human
gctcccctggcaggagtgac

SEQ ID NO: 105474 - DNA, 20 bp, human
gcggcctacagtggtagcgg

SEQ ID NO: 105475 - DNA, 20 bp, human
gccgccgcagaggaaaaaaa

SEQ ID NO: 105476 - DNA, 20 bp, human
gcgaggaagcgcgacccggg

SEQ ID NO: 105477 - DNA, 20 bp, human
gcgccgctcggaggatctgg

SEQ ID NO: 105478 - DNA, 20 bp, human
gacggctgttgctaagggag

SEQ ID NO: 105479 - DNA, 20 bp, human
gcacccccagatcctccgag

SEQ ID NO: 105480 - DNA, 20 bp, human
gatcctccgagcggcggcga

SEQ ID NO: 105481 - DNA, 20 bp, human
gcggcgacggctgttgctaa

SEQ ID NO: 105482 - DNA, 20 bp, human
gcgccgcgcctccgggacag

SEQ ID NO: 105483 - DNA, 20 bp, human
ggcgcgaggaagcgcgaccc

SEQ ID NO: 105484 - DNA, 20 bp, human
gaggtcgctccggctcctgg

SEQ ID NO: 105485 - DNA, 20 bp, human
gtgggtgccgtctgccgccc

SEQ ID NO: 105486 - DNA, 20 bp, human
ggcaggggaggaagacgact

SEQ ID NO: 105487 - DNA, 20 bp, human
gcgcattcggccccggacga

SEQ ID NO: 105488 - DNA, 20 bp, human
gggacctgcgggccgaggaa

SEQ ID NO: 105489 - DNA, 20 bp, human
gccctccccgggactccggg

SEQ ID NO: 105490 - DNA, 20 bp, human
gccgcgcgcttggcccagac

SEQ ID NO: 105491 - DNA, 20 bp, human
gtcgggagactgggaccgtg

SEQ ID NO: 105492 - DNA, 20 bp, human
gtcccaggcgggcccggcag

SEQ ID NO: 105493 - DNA, 20 bp, human
gctgcgagtaccttcgtccg

SEQ ID NO: 105494 - DNA, 20 bp, human
gcgaaggtactcgcagcact

SEQ ID NO: 105495 - DNA, 20 bp, human
gatcctgagccatctagagt

SEQ ID NO: 105496 - DNA, 20 bp, human
ggataccagcatgcagccgg

SEQ ID NO: 105497 - DNA, 20 bp, human
gtggccgggtacctctcccc

SEQ ID NO: 105498 - DNA, 20 bp, human
gggcgagggctgtaactaca

SEQ ID NO: 105499 - DNA, 20 bp, human
ggtcgtgtcccggaagtgaa

SEQ ID NO: 105500 - DNA, 20 bp, human
gtgacccggggagaggtacc

SEQ ID NO: 105501 - DNA, 20 bp, human
gcatgttgatgggtgacccg

SEQ ID NO: 105502 - DNA, 20 bp, human
gtgatgggtgacccggggag

SEQ ID NO: 105503 - DNA, 20 bp, human
gctgtaaaaggcgactgtca

SEQ ID NO: 105504 - DNA, 20 bp, human
gaggtcgctgggcgactggg

SEQ ID NO: 105505 - DNA, 20 bp, human
gtgcgcacggagctgcgaag

SEQ ID NO: 105506 - DNA, 20 bp, human
gccaacgactagggccccgg

SEQ ID NO: 105507 - DNA, 20 bp, human
ggcctgggaatggaacgtga

SEQ ID NO: 105508 - DNA, 20 bp, human
gccgcgcagcagccctaggt

SEQ ID NO: 105509 - DNA, 20 bp, human
gccctggaacccaacgacta

SEQ ID NO: 105510 - DNA, 20 bp, human
gaagcaggaaagggcacggg

SEQ ID NO: 105511 - DNA, 20 bp, human
gggcgtcacccgcccaccta

SEQ ID NO: 105512 - DNA, 20 bp, human
gggcccagggcaggcaggtt

SEQ ID NO: 105513 - DNA, 20 bp, human
gtccgcacgacgaccggagg

SEQ ID NO: 105514 - DNA, 20 bp, human
gccagggcaggcaggtttgg

SEQ ID NO: 105515 - DNA, 20 bp, human
ggcgacggaacgcagatcgg

SEQ ID NO: 105516 - DNA, 20 bp, human
gccggaagcaggggcccgag

SEQ ID NO: 105517 - DNA, 20 bp, human
ggcgctacggacgtctgccc

SEQ ID NO: 105518 - DNA, 20 bp, human
gtgcccggctcgacctcctc

SEQ ID NO: 105519 - DNA, 20 bp, human
gcccggctccccgctcatcg

SEQ ID NO: 105520 - DNA, 20 bp, human
gggctcgacctcctcgggag

SEQ ID NO: 105521 - DNA, 20 bp, human
gtatggaagggaactcatgt

SEQ ID NO: 105522 - DNA, 20 bp, human
ggcgtcacacccggaagcag

SEQ ID NO: 105523 - DNA, 20 bp, human
gcaccccctgacctatggaa

SEQ ID NO: 105524 - DNA, 20 bp, human
ggtagcgccccctcccgagg

SEQ ID NO: 105525 - DNA, 20 bp, human
gcggagccggccgcgatgag

SEQ ID NO: 105526 - DNA, 20 bp, human
gggctgcaggcggatggatg

SEQ ID NO: 105527 - DNA, 20 bp, human
ggggcttcttcaggcggtgg

SEQ ID NO: 105528 - DNA, 20 bp, human
gaggcgaactcactccgcag

SEQ ID NO: 105529 - DNA, 20 bp, human
gcggtccctgatcccagtcg

SEQ ID NO: 105530 - DNA, 20 bp, human
gccgcgctgggaatccgctg

SEQ ID NO: 105531 - DNA, 20 bp, human
gtcagggaccgaagcgaacg

SEQ ID NO: 105532 - DNA, 20 bp, human
gtggatggggcttcttcagg

SEQ ID NO: 105533 - DNA, 20 bp, human
gatggggcttcttcaggcgg

SEQ ID NO: 105534 - DNA, 20 bp, human
ggcagtcgatggccagaggg

SEQ ID NO: 105535 - DNA, 20 bp, human
ggcaagccaggcgcgttctg

SEQ ID NO: 105536 - DNA, 20 bp, human
gggagcggcagagacggcag

SEQ ID NO: 105537 - DNA, 20 bp, human
ggttcccgccgaggcagtgg

SEQ ID NO: 105538 - DNA, 20 bp, human
gcggatgtgagactcagcaa

SEQ ID NO: 105539 - DNA, 20 bp, human
gctgggtcacggccagaacc

SEQ ID NO: 105540 - DNA, 20 bp, human
gagactcagcaacgggactc

SEQ ID NO: 105541 - DNA, 20 bp, human
gaggcgtacttggacttcgg

SEQ ID NO: 105542 - DNA, 20 bp, human
ggtagtagtgcggtgcgagg

SEQ ID NO: 105543 - DNA, 20 bp, human
gctctcctggcccctagcac

SEQ ID NO: 105544 - DNA, 20 bp, human
gctgccgggtcacatctccg

SEQ ID NO: 105545 - DNA, 20 bp, human
gcctgttccggacaacaggt

SEQ ID NO: 105546 - DNA, 20 bp, human
ggcacacacggccatggcgg

SEQ ID NO: 105547 - DNA, 20 bp, human
gcgcgcacacacggccatgg

SEQ ID NO: 105548 - DNA, 20 bp, human
ggtgcgcggcccctcatccg

SEQ ID NO: 105549 - DNA, 20 bp, human
gccacgacgaggccgagcca

SEQ ID NO: 105550 - DNA, 20 bp, human
ggtccaccgggatcccgatg

SEQ ID NO: 105551 - DNA, 20 bp, human
gcgacgaggccgagccacgg

SEQ ID NO: 105552 - DNA, 20 bp, human
gcgctcactcacctccgcca

SEQ ID NO: 105553 - DNA, 20 bp, human
gccccagcactcggcaaagt

SEQ ID NO: 105554 - DNA, 20 bp, human
ggtccctggggcccacgacg

SEQ ID NO: 105555 - DNA, 20 bp, human
ggtggccgcgccgggatccc

SEQ ID NO: 105556 - DNA, 20 bp, human
gcgccctaaaggtaccaata

SEQ ID NO: 105557 - DNA, 20 bp, human
gccgggtgggtggaaaccgg

SEQ ID NO: 105558 - DNA, 20 bp, human
ggcggccggatcgcaaagag

SEQ ID NO: 105559 - DNA, 20 bp, human
gggcggcacggccccttata

SEQ ID NO: 105560 - DNA, 20 bp, human
gcgatccggccgcggagggg

SEQ ID NO: 105561 - DNA, 20 bp, human
ggtgagcagggaaaccgggc

SEQ ID NO: 105562 - DNA, 20 bp, human
gaaaggtaccaatatggcgg

SEQ ID NO: 105563 - DNA, 20 bp, human
ggcctccactggctggacgt

SEQ ID NO: 105564 - DNA, 20 bp, human
ggccgcggcctagtcccgga

SEQ ID NO: 105565 - DNA, 20 bp, human
gcggatcgcaaagaggggag

SEQ ID NO: 105566 - DNA, 20 bp, human
gagtcaggcacgtagctcag

SEQ ID NO: 105567 - DNA, 20 bp, human
gcagtggtgtccgagaagtc

SEQ ID NO: 105568 - DNA, 20 bp, human
gacagcatcggcaagatcgg

SEQ ID NO: 105569 - DNA, 20 bp, human
gaccagctcatggccttcgg

SEQ ID NO: 105570 - DNA, 20 bp, human
gacgatgaacatcggcatga

SEQ ID NO: 105571 - DNA, 20 bp, human
gacaaaaggcgggaccacag

SEQ ID NO: 105572 - DNA, 20 bp, human
gtgcctctgcgcgggtctcc

SEQ ID NO: 105573 - DNA, 20 bp, human
gctgctgggtgagctcggag

SEQ ID NO: 105574 - DNA, 20 bp, human
ggcggaacccctcgtccggt

SEQ ID NO: 105575 - DNA, 20 bp, human
gtggtgtttacgatgaacat

SEQ ID NO: 105576 - DNA, 20 bp, human
gcgcaggccggccccatccg

SEQ ID NO: 105577 - DNA, 20 bp, human
ggccgctgcatcccccggat

SEQ ID NO: 105578 - DNA, 20 bp, human
ggagccttcctcttactggg

SEQ ID NO: 105579 - DNA, 20 bp, human
gcccggaacgcccctcccgg

SEQ ID NO: 105580 - DNA, 20 bp, human
gcgagggctggagaccctaa

SEQ ID NO: 105581 - DNA, 20 bp, human
ggtgttgagaccgaaggact

SEQ ID NO: 105582 - DNA, 20 bp, human
gccggcaggggcggcggaca

SEQ ID NO: 105583 - DNA, 20 bp, human
gcggcgggtgttgagaccga

SEQ ID NO: 105584 - DNA, 20 bp, human
gcacccgccgctgcatcccc

SEQ ID NO: 105585 - DNA, 20 bp, human
gggagccgggacccacctgc

SEQ ID NO: 105586 - DNA, 20 bp, human
gccggccgaggcccctggaa

SEQ ID NO: 105587 - DNA, 20 bp, human
gggcgaccctctgactatag

SEQ ID NO: 105588 - DNA, 20 bp, human
ggagccacttggccagttag

SEQ ID NO: 105589 - DNA, 20 bp, human
ggccgcctgagccgttccag

SEQ ID NO: 105590 - DNA, 20 bp, human
gctacggcggcgcatgctag

SEQ ID NO: 105591 - DNA, 20 bp, human
gcgaggcgggacccccgcag

SEQ ID NO: 105592 - DNA, 20 bp, human
ggcacggagatgcagtccag

SEQ ID NO: 105593 - DNA, 20 bp, human
ggaggcccctggaacggctc

SEQ ID NO: 105594 - DNA, 20 bp, human
gattaccccgcagggccggg

SEQ ID NO: 105595 - DNA, 20 bp, human
gatccgcaggacaaagatcc

SEQ ID NO: 105596 - DNA, 20 bp, human
gataatgtgcccagggaccg

SEQ ID NO: 105597 - DNA, 20 bp, human
gacccctagaaagtgggact

SEQ ID NO: 105598 - DNA, 20 bp, human
ggcatagattccaacttcca

SEQ ID NO: 105599 - DNA, 20 bp, human
gcacggtcacctctcaaagc

SEQ ID NO: 105600 - DNA, 20 bp, human
gttccatggctgtgtctcca

SEQ ID NO: 105601 - DNA, 20 bp, human
ggttattacccctagaaagt

SEQ ID NO: 105602 - DNA, 20 bp, human
ggcccagtcccactttctag

SEQ ID NO: 105603 - DNA, 20 bp, human
gaagactgtgaaacacagtg

SEQ ID NO: 105604 - DNA, 20 bp, human
ggctgtgtctccacggtccc

SEQ ID NO: 105605 - DNA, 20 bp, human
gagtgattgtagcatattgt

SEQ ID NO: 105606 - DNA, 20 bp, human
ggtggaagccgtgctcgcac

SEQ ID NO: 105607 - DNA, 20 bp, human
gcagttctgccaccaccggg

SEQ ID NO: 105608 - DNA, 20 bp, human
gcgagagcgccccactcacc

SEQ ID NO: 105609 - DNA, 20 bp, human
gcaggccgtgccgggtgagt

SEQ ID NO: 105610 - DNA, 20 bp, human
ggcgagcacggcttccacgt

SEQ ID NO: 105611 - DNA, 20 bp, human
gccgctgcgccgcaacgcag

SEQ ID NO: 105612 - DNA, 20 bp, human
gctgctaatggtcgcgacac

SEQ ID NO: 105613 - DNA, 20 bp, human
ggagcgcacggaaagtttgg

SEQ ID NO: 105614 - DNA, 20 bp, human
gggcccgacatgacgcccgg

SEQ ID NO: 105615 - DNA, 20 bp, human
gcggcacggcctgttgctcg

SEQ ID NO: 105616 - DNA, 20 bp, human
ggtcgcccatggcctccgtg

SEQ ID NO: 105617 - DNA, 20 bp, human
gcaggagaggtggtaggctc

SEQ ID NO: 105618 - DNA, 20 bp, human
gcggcgggagtccgggaaag

SEQ ID NO: 105619 - DNA, 20 bp, human
ggatagcgcctgtcagtcgg

SEQ ID NO: 105620 - DNA, 20 bp, human
gccccatcggagaaccccgg

SEQ ID NO: 105621 - DNA, 20 bp, human
ggaccgacccaccgactgac

SEQ ID NO: 105622 - DNA, 20 bp, human
gccccagagtaaaggtaggg

SEQ ID NO: 105623 - DNA, 20 bp, human
gctgacaggcgctatctccc

SEQ ID NO: 105624 - DNA, 20 bp, human
ggagaggtggtaggctcggg

SEQ ID NO: 105625 - DNA, 20 bp, human
gcacagggtggggaccgaac

SEQ ID NO: 105626 - DNA, 20 bp, human
gcggtcgtgaagataggtaa

SEQ ID NO: 105627 - DNA, 20 bp, human
gagaggcctgacctcccgtg

SEQ ID NO: 105628 - DNA, 20 bp, human
gacccgggaggagaaccccg

SEQ ID NO: 105629 - DNA, 20 bp, human
gcggcgggaggtcactcggg

SEQ ID NO: 105630 - DNA, 20 bp, human
ggaccgcatccgccagacac

SEQ ID NO: 105631 - DNA, 20 bp, human
ggagtcgcagagctcttgag

SEQ ID NO: 105632 - DNA, 20 bp, human
gccccggcgggaggtcactc

SEQ ID NO: 105633 - DNA, 20 bp, human
gcttgagtggaagacagtgt

SEQ ID NO: 105634 - DNA, 20 bp, human
gacatgtctgagtcggagct

SEQ ID NO: 105635 - DNA, 20 bp, human
gaggaagtgggaccggtgtc

SEQ ID NO: 105636 - DNA, 20 bp, human
gccccggcgggaggtcactc

SEQ ID NO: 105637 - DNA, 20 bp, human
gacatgtctgagtcggagct

SEQ ID NO: 105638 - DNA, 20 bp, human
gacccgggaggagaaccccg

SEQ ID NO: 105639 - DNA, 20 bp, human
ggaccgcatccgccagacac

SEQ ID NO: 105640 - DNA, 20 bp, human
ggagtcgcagagctcttgag

SEQ ID NO: 105641 - DNA, 20 bp, human
gagaggcctgacctcccgtg

SEQ ID NO: 105642 - DNA, 20 bp, human
ggcggtcgtgaagataggta

SEQ ID NO: 105643 - DNA, 20 bp, human
gcttgagtggaagacagtgt

SEQ ID NO: 105644 - DNA, 20 bp, human
gcggcgggaggtcactcggg

SEQ ID NO: 105645 - DNA, 20 bp, human
gaggaagtgggaccggtgtc

SEQ ID NO: 105646 - DNA, 20 bp, human
gcgctacggaggtccggagg

SEQ ID NO: 105647 - DNA, 20 bp, human
gttccggctccggagggcag

SEQ ID NO: 105648 - DNA, 20 bp, human
gaggcgctacggaggtccgg

SEQ ID NO: 105649 - DNA, 20 bp, human
gggcaggcgctacggaggtc

SEQ ID NO: 105650 - DNA, 20 bp, human
gcagcgctgcacccaggtcg

SEQ ID NO: 105651 - DNA, 20 bp, human
ggggcgcgcgtagcatcgtc

SEQ ID NO: 105652 - DNA, 20 bp, human
ggtacgcggactggatggac

SEQ ID NO: 105653 - DNA, 20 bp, human
gagggccgcggcaggcgcta

SEQ ID NO: 105654 - DNA, 20 bp, human
ggccgcggcaggcgctacgg

SEQ ID NO: 105655 - DNA, 20 bp, human
ggcgcgtagcatcgtcggga

SEQ ID NO: 105656 - DNA, 20 bp, human
gcgcgctcactgacctgagg

SEQ ID NO: 105657 - DNA, 20 bp, human
gacgcccgggcctttcaact

SEQ ID NO: 105658 - DNA, 20 bp, human
gacctgcggagacctcctcg

SEQ ID NO: 105659 - DNA, 20 bp, human
gcctcagcgggagccaccgg

SEQ ID NO: 105660 - DNA, 20 bp, human
ggcccgtgacctggaccact

SEQ ID NO: 105661 - DNA, 20 bp, human
gacgcctggaggacgcgcag

SEQ ID NO: 105662 - DNA, 20 bp, human
gagcccagtggtccaggtca

SEQ ID NO: 105663 - DNA, 20 bp, human
gtatctccggcccctcgctg

SEQ ID NO: 105664 - DNA, 20 bp, human
ggtgcctggagcgggagagt

SEQ ID NO: 105665 - DNA, 20 bp, human
gtgttccctgcgccccgagg

SEQ ID NO: 105666 - DNA, 20 bp, human
gcctctgctcgagggctggt

SEQ ID NO: 105667 - DNA, 20 bp, human
gcctctcaggatgaaggtga

SEQ ID NO: 105668 - DNA, 20 bp, human
ggccagtgccagctagaaga

SEQ ID NO: 105669 - DNA, 20 bp, human
gagcacagacattcccaggg

SEQ ID NO: 105670 - DNA, 20 bp, human
gggaagcacagacattccca

SEQ ID NO: 105671 - DNA, 20 bp, human
gcgctcaggtggcaaagcac

SEQ ID NO: 105672 - DNA, 20 bp, human
gccgctccctctcaggatga

SEQ ID NO: 105673 - DNA, 20 bp, human
gagccacttccacccctcaa

SEQ ID NO: 105674 - DNA, 20 bp, human
gagtgccagctagaagaggg

SEQ ID NO: 105675 - DNA, 20 bp, human
gcacgcctgagcggcaccca

SEQ ID NO: 105676 - DNA, 20 bp, human
gtgcaccagtcagggagtca

SEQ ID NO: 105677 - DNA, 20 bp, human
gaatatggccctccaaaagg

SEQ ID NO: 105678 - DNA, 20 bp, human
ggtcagggcaatagagagac

SEQ ID NO: 105679 - DNA, 20 bp, human
gcactcaacacggtaatggt

SEQ ID NO: 105680 - DNA, 20 bp, human
ggctgatcgcagttcccaca

SEQ ID NO: 105681 - DNA, 20 bp, human
gaccatcccccctgccatgt

SEQ ID NO: 105682 - DNA, 20 bp, human
gggaaacctagcactcaaca

SEQ ID NO: 105683 - DNA, 20 bp, human
ggtgactgcaggattgacgt

SEQ ID NO: 105684 - DNA, 20 bp, human
ggattcacctgcaccagtca

SEQ ID NO: 105685 - DNA, 20 bp, human
ggcgaatatggccctccaaa

SEQ ID NO: 105686 - DNA, 20 bp, human
gagggatctgcgttggagga

SEQ ID NO: 105687 - DNA, 20 bp, human
ggtgctagaatgctgtgcgt

SEQ ID NO: 105688 - DNA, 20 bp, human
ggcgcggccagcaacaatca

SEQ ID NO: 105689 - DNA, 20 bp, human
ggctcccagcgaaagcagca

SEQ ID NO: 105690 - DNA, 20 bp, human
gagacgccactgtaaaaggt

SEQ ID NO: 105691 - DNA, 20 bp, human
ggcagggcagggatctgcgt

SEQ ID NO: 105692 - DNA, 20 bp, human
ggcaccagctggtctcccgt

SEQ ID NO: 105693 - DNA, 20 bp, human
gttgtgtgcgctctcgatga

SEQ ID NO: 105694 - DNA, 20 bp, human
ggcgaacccaccttttacag

SEQ ID NO: 105695 - DNA, 20 bp, human
gtgtgcgtcggaaggctggg

SEQ ID NO: 105696 - DNA, 20 bp, human
gtgggcacagagtcgatcag

SEQ ID NO: 105697 - DNA, 20 bp, human
gatgcgcctggcatagaccg

SEQ ID NO: 105698 - DNA, 20 bp, human
ggcatctcaggtaaacggtt

SEQ ID NO: 105699 - DNA, 20 bp, human
ggacggagaatgatagtggt

SEQ ID NO: 105700 - DNA, 20 bp, human
gagtgtgggcgaagaatgag

SEQ ID NO: 105701 - DNA, 20 bp, human
gtctgcggccgaaaactcca

SEQ ID NO: 105702 - DNA, 20 bp, human
ggcactcggcctgagaaact

SEQ ID NO: 105703 - DNA, 20 bp, human
gtataaaacgactctctcat

SEQ ID NO: 105704 - DNA, 20 bp, human
ggtgtcgtggggtcctcagg

SEQ ID NO: 105705 - DNA, 20 bp, human
ggcgcgcagtgtcgactccc

SEQ ID NO: 105706 - DNA, 20 bp, human
gaagtcaagggtgagcaaga

SEQ ID NO: 105707 - DNA, 20 bp, human
gactggtttttccaagtcaa

SEQ ID NO: 105708 - DNA, 20 bp, human
ggactcagcccatttcaagg

SEQ ID NO: 105709 - DNA, 20 bp, human
gtcagcccatttcaaggagg

SEQ ID NO: 105710 - DNA, 20 bp, human
gagggactcagcccatttca

SEQ ID NO: 105711 - DNA, 20 bp, human
gagtaccacctccttgaaat

SEQ ID NO: 105712 - DNA, 20 bp, human
gaaagagagagtttggagta

SEQ ID NO: 105713 - DNA, 20 bp, human
gcagaggaaagtggaattga

SEQ ID NO: 105714 - DNA, 20 bp, human
ggagagggagtaaaggtagc

SEQ ID NO: 105715 - DNA, 20 bp, human
gattgaaggagagggagtaa

SEQ ID NO: 105716 - DNA, 20 bp, human
gctggggaccctaaagagag

SEQ ID NO: 105717 - DNA, 20 bp, human
gcatggagctgacaaccatg

SEQ ID NO: 105718 - DNA, 20 bp, human
gggtggctgccgaggcctca

SEQ ID NO: 105719 - DNA, 20 bp, human
gccgatggtataaaacatag

SEQ ID NO: 105720 - DNA, 20 bp, human
ggagtgaagttcaggaggca

SEQ ID NO: 105721 - DNA, 20 bp, human
ggccgggagttggcatccga

SEQ ID NO: 105722 - DNA, 20 bp, human
gagattaaggttcccatctg

SEQ ID NO: 105723 - DNA, 20 bp, human
gcttcagagggacgggtgat

SEQ ID NO: 105724 - DNA, 20 bp, human
gggcttagaaggccgggagt

SEQ ID NO: 105725 - DNA, 20 bp, human
gcgtgcttcttcagagggac

SEQ ID NO: 105726 - DNA, 20 bp, human
gcagggacagacggcgcggt

SEQ ID NO: 105727 - DNA, 20 bp, human
gttgccagggacagacggcg

SEQ ID NO: 105728 - DNA, 20 bp, human
gtctgtccctggcaagccag

SEQ ID NO: 105729 - DNA, 20 bp, human
gtctagcagagaagatgagg

SEQ ID NO: 105730 - DNA, 20 bp, human
ggccagcggcggtttaaagg

SEQ ID NO: 105731 - DNA, 20 bp, human
ggtccctggcaagccagcgg

SEQ ID NO: 105732 - DNA, 20 bp, human
gcgccgaggcgcgtatcagt

SEQ ID NO: 105733 - DNA, 20 bp, human
gagcggcggtttaaaggagg

SEQ ID NO: 105734 - DNA, 20 bp, human
gcaactcgccgagatgacct

SEQ ID NO: 105735 - DNA, 20 bp, human
gaaccgccgctggcttgcca

SEQ ID NO: 105736 - DNA, 20 bp, human
ggacgcgtcggtggccgaca

SEQ ID NO: 105737 - DNA, 20 bp, human
ggtcggtggccgacatggag

SEQ ID NO: 105738 - DNA, 20 bp, human
gggcaggcgttcggtcactg

SEQ ID NO: 105739 - DNA, 20 bp, human
ggcgggcgatttgtaggtaa

SEQ ID NO: 105740 - DNA, 20 bp, human
gggtcactgaggtgtagcag

SEQ ID NO: 105741 - DNA, 20 bp, human
gtggggtcgccttcttccag

SEQ ID NO: 105742 - DNA, 20 bp, human
ggctgtgagtgcggcgacaa

SEQ ID NO: 105743 - DNA, 20 bp, human
gagtctgagagtgtgagctg

SEQ ID NO: 105744 - DNA, 20 bp, human
gtggggcgcgggcgatttgt

SEQ ID NO: 105745 - DNA, 20 bp, human
gccgcgccccagagcgccat

SEQ ID NO: 105746 - DNA, 20 bp, human
ggtgttagagaacgtcgcgg

SEQ ID NO: 105747 - DNA, 20 bp, human
gccgcgggcaggatacaccg

SEQ ID NO: 105748 - DNA, 20 bp, human
gcttggcgcctggccgccgc

SEQ ID NO: 105749 - DNA, 20 bp, human
gtcggctccgcgcggagaga

SEQ ID NO: 105750 - DNA, 20 bp, human
gcggagccgagccggaactg

SEQ ID NO: 105751 - DNA, 20 bp, human
ggcgggtccccgcagatggt

SEQ ID NO: 105752 - DNA, 20 bp, human
gtgtgtgttagagaacgtcg

SEQ ID NO: 105753 - DNA, 20 bp, human
gggctcgcgcctcaggccca

SEQ ID NO: 105754 - DNA, 20 bp, human
gaggatacaccgtgggcctg

SEQ ID NO: 105755 - DNA, 20 bp, human
gggaggaggtaagcgtcgct

SEQ ID NO: 105756 - DNA, 20 bp, human
gcatcgaggagtcagagtgg

SEQ ID NO: 105757 - DNA, 20 bp, human
ggcccatcgaggagtcagag

SEQ ID NO: 105758 - DNA, 20 bp, human
gcccagagcctcccagtcag

SEQ ID NO: 105759 - DNA, 20 bp, human
ggccccagagtacctagcgg

SEQ ID NO: 105760 - DNA, 20 bp, human
gggcagtaaacacccccgtg

SEQ ID NO: 105761 - DNA, 20 bp, human
ggaggccccagagtacctag

SEQ ID NO: 105762 - DNA, 20 bp, human
gaggtactctggggcctcaa

SEQ ID NO: 105763 - DNA, 20 bp, human
ggtcccaccaggcccctgac

SEQ ID NO: 105764 - DNA, 20 bp, human
gggaggctccgagggtgacg

SEQ ID NO: 105765 - DNA, 20 bp, human
gtgcctcagggaggctccga

SEQ ID NO: 105766 - DNA, 20 bp, human
gacttcatcctgggttgagg

SEQ ID NO: 105767 - DNA, 20 bp, human
gtcatcctgggttgaggcgg

SEQ ID NO: 105768 - DNA, 20 bp, human
gttctcctccgcctcaaccc

SEQ ID NO: 105769 - DNA, 20 bp, human
gacccgctcaacttcatcct

SEQ ID NO: 105770 - DNA, 20 bp, human
gccggacttcgccataattc

SEQ ID NO: 105771 - DNA, 20 bp, human
gaacccaggatgaagttgag

SEQ ID NO: 105772 - DNA, 20 bp, human
gccaaggcggggaggacctg

SEQ ID NO: 105773 - DNA, 20 bp, human
gtgagcaatgagccaaggcg

SEQ ID NO: 105774 - DNA, 20 bp, human
ggattgatgttacctagaaa

SEQ ID NO: 105775 - DNA, 20 bp, human
gtgatgttacctagaaaagg

SEQ ID NO: 105776 - DNA, 20 bp, human
gtcccccgagccgtgcgccc

SEQ ID NO: 105777 - DNA, 20 bp, human
gagagctcggcactgcgccg

SEQ ID NO: 105778 - DNA, 20 bp, human
gaagtgagaacagagcccgg

SEQ ID NO: 105779 - DNA, 20 bp, human
ggatggagcgcacttcgcgg

SEQ ID NO: 105780 - DNA, 20 bp, human
gccactcacctgctcttcag

SEQ ID NO: 105781 - DNA, 20 bp, human
gcgcggcccccaactgcgag

SEQ ID NO: 105782 - DNA, 20 bp, human
gctccatccgagcttcctaa

SEQ ID NO: 105783 - DNA, 20 bp, human
gcgctctcctcgccccagag

SEQ ID NO: 105784 - DNA, 20 bp, human
ggtgtaaactccccgcgctg

SEQ ID NO: 105785 - DNA, 20 bp, human
gagctgctgagactgattgg

SEQ ID NO: 105786 - DNA, 20 bp, human
gaggtatcccgagacaccac

SEQ ID NO: 105787 - DNA, 20 bp, human
gagagaaggtactataaaca

SEQ ID NO: 105788 - DNA, 20 bp, human
gttggaattatagaaagtag

SEQ ID NO: 105789 - DNA, 20 bp, human
gtctgtgataaagtttccgg

SEQ ID NO: 105790 - DNA, 20 bp, human
gaagtttccggtggtgtctc

SEQ ID NO: 105791 - DNA, 20 bp, human
gaatcttatgagcaatgaac

SEQ ID NO: 105792 - DNA, 20 bp, human
gtgccagtccatcttcaaat

SEQ ID NO: 105793 - DNA, 20 bp, human
ggcttctgtgataaagtttc

SEQ ID NO: 105794 - DNA, 20 bp, human
gtacattgaattacttctta

SEQ ID NO: 105795 - DNA, 20 bp, human
gatagtctaccgtctctcac

SEQ ID NO: 105796 - DNA, 20 bp, human
ggagtccaggatccaggtga

SEQ ID NO: 105797 - DNA, 20 bp, human
ggctcgcctgcgccccccaa

SEQ ID NO: 105798 - DNA, 20 bp, human
gtcggcaaactggagcgcac

SEQ ID NO: 105799 - DNA, 20 bp, human
ggcccggtacgctggaaacg

SEQ ID NO: 105800 - DNA, 20 bp, human
gagcgcacgggactcggctg

SEQ ID NO: 105801 - DNA, 20 bp, human
gtcgcaagtgcgcgctggag

SEQ ID NO: 105802 - DNA, 20 bp, human
gctcgcgcaagtggatgtcg

SEQ ID NO: 105803 - DNA, 20 bp, human
gtcgcacccggaggagacac

SEQ ID NO: 105804 - DNA, 20 bp, human
gcaagtgcgcgctggagcgg

SEQ ID NO: 105805 - DNA, 20 bp, human
gctccccgagtccaggatcc

SEQ ID NO: 105806 - DNA, 20 bp, human
gttgcgggccggatcgtccc

SEQ ID NO: 105807 - DNA, 20 bp, human
ggcgggcgcagcttaccggg

SEQ ID NO: 105808 - DNA, 20 bp, human
gcgggcgggaggactcgact

SEQ ID NO: 105809 - DNA, 20 bp, human
gcgggaggactcgactcggt

SEQ ID NO: 105810 - DNA, 20 bp, human
ggccaccgggtccccgtcag

SEQ ID NO: 105811 - DNA, 20 bp, human
gtctggcgagggcgtctcgg

SEQ ID NO: 105812 - DNA, 20 bp, human
gctcggtggaagctcccagg

SEQ ID NO: 105813 - DNA, 20 bp, human
gcccccggcgccccaaagtc

SEQ ID NO: 105814 - DNA, 20 bp, human
gggtgggagccgctagagcc

SEQ ID NO: 105815 - DNA, 20 bp, human
gcagctcacctgggacgatc

SEQ ID NO: 105816 - DNA, 20 bp, human
gagcgccgcgtggttagcgt

SEQ ID NO: 105817 - DNA, 20 bp, human
gacgaaggcaaggggcgccc

SEQ ID NO: 105818 - DNA, 20 bp, human
gctaacccggagataacctg

SEQ ID NO: 105819 - DNA, 20 bp, human
gaggccctggagccttcatg

SEQ ID NO: 105820 - DNA, 20 bp, human
gcgggtctagagggtatctg

SEQ ID NO: 105821 - DNA, 20 bp, human
ggccgcgtggttagcgtcgg

SEQ ID NO: 105822 - DNA, 20 bp, human
gagaaccagctggagggaat

SEQ ID NO: 105823 - DNA, 20 bp, human
ggggtaacggggaagtattg

SEQ ID NO: 105824 - DNA, 20 bp, human
ggagaccctggaggtaatga

SEQ ID NO: 105825 - DNA, 20 bp, human
gcttcatgtggagggtaacg

SEQ ID NO: 105826 - DNA, 20 bp, human
ggcaccctccagacagtcag

SEQ ID NO: 105827 - DNA, 20 bp, human
gcgaaggttgtcgggatccg

SEQ ID NO: 105828 - DNA, 20 bp, human
gacaggttcggcgtagaagg

SEQ ID NO: 105829 - DNA, 20 bp, human
ggaggaggctggctctctgt

SEQ ID NO: 105830 - DNA, 20 bp, human
gggacggggagtcacaggtt

SEQ ID NO: 105831 - DNA, 20 bp, human
gcgcaggtgggagcgtggtg

SEQ ID NO: 105832 - DNA, 20 bp, human
gccatcggcagctatttcag

SEQ ID NO: 105833 - DNA, 20 bp, human
gagaaggcggcagcgcaggt

SEQ ID NO: 105834 - DNA, 20 bp, human
gggaggggacggggagtcac

SEQ ID NO: 105835 - DNA, 20 bp, human
gtatccttcagtgaggacac

SEQ ID NO: 105836 - DNA, 20 bp, human
gtggccagcggcaaccaaga

SEQ ID NO: 105837 - DNA, 20 bp, human
gcagcggcaaccaagagggt

SEQ ID NO: 105838 - DNA, 20 bp, human
gaggcggtgagtgagagtcc

SEQ ID NO: 105839 - DNA, 20 bp, human
gcagaaggccggcaagaaga

SEQ ID NO: 105840 - DNA, 20 bp, human
gggccggagtcgcagagcgg

SEQ ID NO: 105841 - DNA, 20 bp, human
ggcggagggcgtgtggccag

SEQ ID NO: 105842 - DNA, 20 bp, human
gcggggccggagtcgcagag

SEQ ID NO: 105843 - DNA, 20 bp, human
gcgcagcttccgtggctgag

SEQ ID NO: 105844 - DNA, 20 bp, human
ggccctgccaggcagtgcac

SEQ ID NO: 105845 - DNA, 20 bp, human
gagaagtcgccgccagcgga

SEQ ID NO: 105846 - DNA, 20 bp, human
gatagaacctagagttctta

SEQ ID NO: 105847 - DNA, 20 bp, human
ggaaagcaggctgtaagagg

SEQ ID NO: 105848 - DNA, 20 bp, human
gcaagaaagcaggctgtaag

SEQ ID NO: 105849 - DNA, 20 bp, human
gtaattaaatattcttaccg

SEQ ID NO: 105850 - DNA, 20 bp, human
gttttccaggttcacaataa

SEQ ID NO: 105851 - DNA, 20 bp, human
ggtagaaacccatagctgtt

SEQ ID NO: 105852 - DNA, 20 bp, human
gcttgaacagtccacattcc

SEQ ID NO: 105853 - DNA, 20 bp, human
gaagaaagagaatgtaagac

SEQ ID NO: 105854 - DNA, 20 bp, human
ggctttcttgaggtctaaca

SEQ ID NO: 105855 - DNA, 20 bp, human
gataaccaccaaacagctat

SEQ ID NO: 105856 - DNA, 20 bp, human
gcacgcagggacggagtcgg

SEQ ID NO: 105857 - DNA, 20 bp, human
ggtgcacgcagggacggagt

SEQ ID NO: 105858 - DNA, 20 bp, human
gcgcgaggaccggttgaagg

SEQ ID NO: 105859 - DNA, 20 bp, human
ggcgagcagcgagagaggcc

SEQ ID NO: 105860 - DNA, 20 bp, human
gtgagagcggccgagaccga

SEQ ID NO: 105861 - DNA, 20 bp, human
ggcggaccccaggctagaag

SEQ ID NO: 105862 - DNA, 20 bp, human
ggaccggttgaaggaggcac

SEQ ID NO: 105863 - DNA, 20 bp, human
gcgggggcgagcagcgagag

SEQ ID NO: 105864 - DNA, 20 bp, human
gttgacccttgaggcggggt

SEQ ID NO: 105865 - DNA, 20 bp, human
gacgccggggctgcacagag

SEQ ID NO: 105866 - DNA, 20 bp, human
gtggcagcgaacgggaggag

SEQ ID NO: 105867 - DNA, 20 bp, human
gagcggccgccaccgaccgc

SEQ ID NO: 105868 - DNA, 20 bp, human
gtacggtgctgacaagatgg

SEQ ID NO: 105869 - DNA, 20 bp, human
gtagcgcgtaggggagaagc

SEQ ID NO: 105870 - DNA, 20 bp, human
ggctggcggagctgtcgctg

SEQ ID NO: 105871 - DNA, 20 bp, human
ggtgctgacgcggaagggtg

SEQ ID NO: 105872 - DNA, 20 bp, human
gaggagaaccggaagcccag

SEQ ID NO: 105873 - DNA, 20 bp, human
ggagcgagcccagggagaag

SEQ ID NO: 105874 - DNA, 20 bp, human
gccacttgtgtagcgcgtag

SEQ ID NO: 105875 - DNA, 20 bp, human
gggacgacctcagacattcg

SEQ ID NO: 105876 - DNA, 20 bp, human
gggaggagcgatctgcaggt

SEQ ID NO: 105877 - DNA, 20 bp, human
ggcgcgcgaccgctccccgg

SEQ ID NO: 105878 - DNA, 20 bp, human
gtgcggagggacagcctaag

SEQ ID NO: 105879 - DNA, 20 bp, human
gcagaggtcgcagacagctc

SEQ ID NO: 105880 - DNA, 20 bp, human
gtctcggaggagcgatctgc

SEQ ID NO: 105881 - DNA, 20 bp, human
ggatcgctcctccgagaacg

SEQ ID NO: 105882 - DNA, 20 bp, human
ggcctcttccgcgttctcgg

SEQ ID NO: 105883 - DNA, 20 bp, human
gtcctccgagaacgcggaag

SEQ ID NO: 105884 - DNA, 20 bp, human
ggctcggaggaatacctcgc

SEQ ID NO: 105885 - DNA, 20 bp, human
gaggcggtgctagatccagg

SEQ ID NO: 105886 - DNA, 20 bp, human
gggaaggtcgtaggacccag

SEQ ID NO: 105887 - DNA, 20 bp, human
gggctgacaggagagagaac

SEQ ID NO: 105888 - DNA, 20 bp, human
gggcgtcgcccggggcagga

SEQ ID NO: 105889 - DNA, 20 bp, human
ggcggagctggcgtcgcccg

SEQ ID NO: 105890 - DNA, 20 bp, human
ggtcctggcgtggcacagtc

SEQ ID NO: 105891 - DNA, 20 bp, human
gttcggggagcggaaatgtc

SEQ ID NO: 105892 - DNA, 20 bp, human
gtgaggttgcagggaagccg

SEQ ID NO: 105893 - DNA, 20 bp, human
gctacgaccttcctggccct

SEQ ID NO: 105894 - DNA, 20 bp, human
gttcgggcgggactctcctc

SEQ ID NO: 105895 - DNA, 20 bp, human
gcaggagaaaggcgatcctg

SEQ ID NO: 105896 - DNA, 20 bp, human
ggtccgggctgcgcgacgtg

SEQ ID NO: 105897 - DNA, 20 bp, human
gggggcccgtttcccgctac

SEQ ID NO: 105898 - DNA, 20 bp, human
ggcccggctcctctcagcgg

SEQ ID NO: 105899 - DNA, 20 bp, human
gcgcgcccggctcctctcag

SEQ ID NO: 105900 - DNA, 20 bp, human
gggcggtggcccaggtagag

SEQ ID NO: 105901 - DNA, 20 bp, human
gggccccgaggacaccgacc

SEQ ID NO: 105902 - DNA, 20 bp, human
gcaccgccgctgagaggagc

SEQ ID NO: 105903 - DNA, 20 bp, human
gctgggccaccgccgctgag

SEQ ID NO: 105904 - DNA, 20 bp, human
gtgcgggcgggagcagacaa

SEQ ID NO: 105905 - DNA, 20 bp, human
gcggtggaaaccctgaagtt

SEQ ID NO: 105906 - DNA, 20 bp, human
ggcggagtacatggccccgg

SEQ ID NO: 105907 - DNA, 20 bp, human
gtggatggcatcagggagta

SEQ ID NO: 105908 - DNA, 20 bp, human
ggtacagagtaggtccccgg

SEQ ID NO: 105909 - DNA, 20 bp, human
gaaggcctccactacctccg

SEQ ID NO: 105910 - DNA, 20 bp, human
ggtggaggccttcagcgagg

SEQ ID NO: 105911 - DNA, 20 bp, human
ggggaaactggcagacaggg

SEQ ID NO: 105912 - DNA, 20 bp, human
gtgcggctcggcggagtaca

SEQ ID NO: 105913 - DNA, 20 bp, human
gtcggcggagtacatggccc

SEQ ID NO: 105914 - DNA, 20 bp, human
gttcgggaaactggcagaca

SEQ ID NO: 105915 - DNA, 20 bp, human
gatcagggagtagggcacac

SEQ ID NO: 105916 - DNA, 20 bp, human
gtagcaggcggggaccgaac

SEQ ID NO: 105917 - DNA, 20 bp, human
gtgcggctagaggcgcggga

SEQ ID NO: 105918 - DNA, 20 bp, human
ggggccgcgggccaagcctg

SEQ ID NO: 105919 - DNA, 20 bp, human
gtctgggcccgcagttgaag

SEQ ID NO: 105920 - DNA, 20 bp, human
gagtgactgggggaacgcgg

SEQ ID NO: 105921 - DNA, 20 bp, human
gccaagcctgcggcgcggga

SEQ ID NO: 105922 - DNA, 20 bp, human
gggacactgaggcacccgtt

SEQ ID NO: 105923 - DNA, 20 bp, human
gctcagggaagtgtaagcgg

SEQ ID NO: 105924 - DNA, 20 bp, human
ggcgctcagggaagtgtaag

SEQ ID NO: 105925 - DNA, 20 bp, human
gtacgcgacgcgtagcaggc

SEQ ID NO: 105926 - DNA, 20 bp, human
gagaggcggcggcacgacga

SEQ ID NO: 105927 - DNA, 20 bp, human
ggagaggacggttacaaatg

SEQ ID NO: 105928 - DNA, 20 bp, human
gcccggatccccggctgtgg

SEQ ID NO: 105929 - DNA, 20 bp, human
gtaaagggacgccgagagga

SEQ ID NO: 105930 - DNA, 20 bp, human
ggctgtggtccgggaacctg

SEQ ID NO: 105931 - DNA, 20 bp, human
gcacgcatcccccggatccc

SEQ ID NO: 105932 - DNA, 20 bp, human
ggacctgcaagtgatctgct

SEQ ID NO: 105933 - DNA, 20 bp, human
gaggatgccggggcgctgtc

SEQ ID NO: 105934 - DNA, 20 bp, human
gtcccccggatccccggctg

SEQ ID NO: 105935 - DNA, 20 bp, human
gaggaaggacgtcctagcca

SEQ ID NO: 105936 - DNA, 20 bp, human
gctgcaggtattatatacat

SEQ ID NO: 105937 - DNA, 20 bp, human
gggcttgaggcccggaatgg

SEQ ID NO: 105938 - DNA, 20 bp, human
gcatgggcagtgcaaggagg

SEQ ID NO: 105939 - DNA, 20 bp, human
ggaatggcggccgcgctcgg

SEQ ID NO: 105940 - DNA, 20 bp, human
ggtcggaagatggccactga

SEQ ID NO: 105941 - DNA, 20 bp, human
gcatgtggcagggctgaatc

SEQ ID NO: 105942 - DNA, 20 bp, human
gtaaagaaaaaataccggag

SEQ ID NO: 105943 - DNA, 20 bp, human
gggcgaaacgccaccctcag

SEQ ID NO: 105944 - DNA, 20 bp, human
gcgctcggaggcttctctgg

SEQ ID NO: 105945 - DNA, 20 bp, human
gggcagggactggagctaca

SEQ ID NO: 105946 - DNA, 20 bp, human
gtggagcactgacaccgggg

SEQ ID NO: 105947 - DNA, 20 bp, human
gctgggtgcagacaacggag

SEQ ID NO: 105948 - DNA, 20 bp, human
gcgcgtcgcagctgtcatgg

SEQ ID NO: 105949 - DNA, 20 bp, human
ggtctggagcactgacaccg

SEQ ID NO: 105950 - DNA, 20 bp, human
ggtgtgctgggtgcagacaa

SEQ ID NO: 105951 - DNA, 20 bp, human
gcggcgcgtcgcagctgtca

SEQ ID NO: 105952 - DNA, 20 bp, human
ggagcgatacactgcctccc

SEQ ID NO: 105953 - DNA, 20 bp, human
gcagacaacggagaggaggt

SEQ ID NO: 105954 - DNA, 20 bp, human
gtgtcatggcggagaccgtc

SEQ ID NO: 105955 - DNA, 20 bp, human
gggtgcagacaacggagagg

SEQ ID NO: 105956 - DNA, 20 bp, human
gcacagtctggagtgaatcg

SEQ ID NO: 105957 - DNA, 20 bp, human
gcgcgcgcgggagtcctggg

SEQ ID NO: 105958 - DNA, 20 bp, human
gagtgcgcctagtctcgagg

SEQ ID NO: 105959 - DNA, 20 bp, human
ggctctcccgcctcgagact

SEQ ID NO: 105960 - DNA, 20 bp, human
gcctgtcgcaaggggtccgg

SEQ ID NO: 105961 - DNA, 20 bp, human
ggggagtgcgcctagtctcg

SEQ ID NO: 105962 - DNA, 20 bp, human
gaataaagccgagacgacgg

SEQ ID NO: 105963 - DNA, 20 bp, human
ggagaacatgcggcggggat

SEQ ID NO: 105964 - DNA, 20 bp, human
gtggccgcgcgcgggagtcc

SEQ ID NO: 105965 - DNA, 20 bp, human
ggcgcctctccaccagacct

SEQ ID NO: 105966 - DNA, 20 bp, human
ggaatgcgcgagccctggag

SEQ ID NO: 105967 - DNA, 20 bp, human
ggccgccgggagctccgcag

SEQ ID NO: 105968 - DNA, 20 bp, human
gctcggcttctaggagagga

SEQ ID NO: 105969 - DNA, 20 bp, human
gggggctcggcttctaggag

SEQ ID NO: 105970 - DNA, 20 bp, human
gtagaagccgagccccgctg

SEQ ID NO: 105971 - DNA, 20 bp, human
ggggcagacctgcactccca

SEQ ID NO: 105972 - DNA, 20 bp, human
gaaagggcccggagttccct

SEQ ID NO: 105973 - DNA, 20 bp, human
ggagctgtgacggggtcccg

SEQ ID NO: 105974 - DNA, 20 bp, human
ggtcgggaatgcccacctcg

SEQ ID NO: 105975 - DNA, 20 bp, human
ggcaacgcgggcgggtggac

SEQ ID NO: 105976 - DNA, 20 bp, human
gtcagcggggcaatgagggt

SEQ ID NO: 105977 - DNA, 20 bp, human
gggagaacacatctacctca

SEQ ID NO: 105978 - DNA, 20 bp, human
ggagaagaggactatgatta

SEQ ID NO: 105979 - DNA, 20 bp, human
ggggcaatgagggtaggcag

SEQ ID NO: 105980 - DNA, 20 bp, human
ggaagcagtcttcatacacg

SEQ ID NO: 105981 - DNA, 20 bp, human
ggaacacatctacctcaggg

SEQ ID NO: 105982 - DNA, 20 bp, human
ggagtcctctgtctgctggc

SEQ ID NO: 105983 - DNA, 20 bp, human
ggactatgattatggcgaga

SEQ ID NO: 105984 - DNA, 20 bp, human
gaggctctgagtttgaggta

SEQ ID NO: 105985 - DNA, 20 bp, human
gtcctggtctgagtagtaag

SEQ ID NO: 105986 - DNA, 20 bp, human
ggaggttcatgcctgagcag

SEQ ID NO: 105987 - DNA, 20 bp, human
ggatacagagccttgatggt

SEQ ID NO: 105988 - DNA, 20 bp, human
gggaactttaccaaccatca

SEQ ID NO: 105989 - DNA, 20 bp, human
ggatgagcagtaagactccc

SEQ ID NO: 105990 - DNA, 20 bp, human
gtcttgaaacaggaaatcct

SEQ ID NO: 105991 - DNA, 20 bp, human
gggtattgtagaagacgaaa

SEQ ID NO: 105992 - DNA, 20 bp, human
gggcatcctgacagtgatcc

SEQ ID NO: 105993 - DNA, 20 bp, human
gtcaggcatgaacctcaacc

SEQ ID NO: 105994 - DNA, 20 bp, human
gaatggatacagagccttga

SEQ ID NO: 105995 - DNA, 20 bp, human
gtgactctccagagattcag

SEQ ID NO: 105996 - DNA, 20 bp, human
gcagagaccagtgctcccaa

SEQ ID NO: 105997 - DNA, 20 bp, human
ggctcccaacggcagagcag

SEQ ID NO: 105998 - DNA, 20 bp, human
ggggcccagatggatcaatg

SEQ ID NO: 105999 - DNA, 20 bp, human
gagcactggtctctgggtga

SEQ ID NO: 106000 - DNA, 20 bp, human
gacattaagccgttgagtag

SEQ ID NO: 106001 - DNA, 20 bp, human
gatcggctttggccactctg

SEQ ID NO: 106002 - DNA, 20 bp, human
gaaaacatgcctctactcaa

SEQ ID NO: 106003 - DNA, 20 bp, human
ggtgtcaccagttctttatc

SEQ ID NO: 106004 - DNA, 20 bp, human
gctgaatggctcctgggtca

SEQ ID NO: 106005 - DNA, 20 bp, human
gaacacctgacaacatccat

SEQ ID NO: 106006 - DNA, 20 bp, human
gcccgtggctgagaagaagg

SEQ ID NO: 106007 - DNA, 20 bp, human
ggagagcgacatgtccccgg

SEQ ID NO: 106008 - DNA, 20 bp, human
gcctgagagcgacatgtccc

SEQ ID NO: 106009 - DNA, 20 bp, human
gaggtgggaggcggtacccg

SEQ ID NO: 106010 - DNA, 20 bp, human
gcagcaggccctggatcccg

SEQ ID NO: 106011 - DNA, 20 bp, human
gtgccgagccgcgggatcca

SEQ ID NO: 106012 - DNA, 20 bp, human
gatgtccccggcggctcagg

SEQ ID NO: 106013 - DNA, 20 bp, human
gggtaggttgttcctgaggt

SEQ ID NO: 106014 - DNA, 20 bp, human
ggcggccccagggtcgaaag

SEQ ID NO: 106015 - DNA, 20 bp, human
gctcagaaaaacagcgccac

SEQ ID NO: 106016 - DNA, 20 bp, human
ggaaaggactctgaactcag

SEQ ID NO: 106017 - DNA, 20 bp, human
gctccgaaggccaccaggat

SEQ ID NO: 106018 - DNA, 20 bp, human
ggctgttgtccgaggcatag

SEQ ID NO: 106019 - DNA, 20 bp, human
ggtcgtctcaggtaataaga

SEQ ID NO: 106020 - DNA, 20 bp, human
ggaagactccgaaggccacc

SEQ ID NO: 106021 - DNA, 20 bp, human
gatgaggctgctgttgtccg

SEQ ID NO: 106022 - DNA, 20 bp, human
gcgaggactgaagcacgtct

SEQ ID NO: 106023 - DNA, 20 bp, human
gttgttctcacaaccggcag

SEQ ID NO: 106024 - DNA, 20 bp, human
ggttggaatgaagactccga

SEQ ID NO: 106025 - DNA, 20 bp, human
gtgaggatccttgagcagga

SEQ ID NO: 106026 - DNA, 20 bp, human
gcaagagctagcctccagta

SEQ ID NO: 106027 - DNA, 20 bp, human
gagtgaggcgtcgtccgtac

SEQ ID NO: 106028 - DNA, 20 bp, human
ggaggcgtcgtccgtactgg

SEQ ID NO: 106029 - DNA, 20 bp, human
gtggaggctagctcttgtcg

SEQ ID NO: 106030 - DNA, 20 bp, human
ggcctgcgccgcggcgagtg

SEQ ID NO: 106031 - DNA, 20 bp, human
ggcggcagccgcggacagat

SEQ ID NO: 106032 - DNA, 20 bp, human
ggacgacgcctcactcgccg

SEQ ID NO: 106033 - DNA, 20 bp, human
gctagctcttgtcgcggccg

SEQ ID NO: 106034 - DNA, 20 bp, human
gggacgcgtgaggtaggcgg

SEQ ID NO: 106035 - DNA, 20 bp, human
ggcgggaattaaggtatcga

SEQ ID NO: 106036 - DNA, 20 bp, human
ggcttccagtcgctcgagag

SEQ ID NO: 106037 - DNA, 20 bp, human
ggcggcctcacaggtctgag

SEQ ID NO: 106038 - DNA, 20 bp, human
ggccccgcgctcccgagggt

SEQ ID NO: 106039 - DNA, 20 bp, human
gactcgggcgacctccacag

SEQ ID NO: 106040 - DNA, 20 bp, human
gcttacccctcagacctgtg

SEQ ID NO: 106041 - DNA, 20 bp, human
gccggattggctgttcggag

SEQ ID NO: 106042 - DNA, 20 bp, human
ggagcggcaccatggccccg

SEQ ID NO: 106043 - DNA, 20 bp, human
ggcgcgtgctcggcccggat

SEQ ID NO: 106044 - DNA, 20 bp, human
gtccggccccgcgctcccga

SEQ ID NO: 106045 - DNA, 20 bp, human
gccgacaggcccgtgcaggt

SEQ ID NO: 106046 - DNA, 20 bp, human
gcgagggggccgtacggagg

SEQ ID NO: 106047 - DNA, 20 bp, human
gcacagctgccacctccgta

SEQ ID NO: 106048 - DNA, 20 bp, human
gaggcctgagtgtaaggagg

SEQ ID NO: 106049 - DNA, 20 bp, human
gggccgagggggccgtacgg

SEQ ID NO: 106050 - DNA, 20 bp, human
ggttggccgagggggccgta

SEQ ID NO: 106051 - DNA, 20 bp, human
gtctagaacggtgtcgtcgg

SEQ ID NO: 106052 - DNA, 20 bp, human
gcccgccaggcgagcaggag

SEQ ID NO: 106053 - DNA, 20 bp, human
ggccgaggttcgggctccgt

SEQ ID NO: 106054 - DNA, 20 bp, human
ggccaacggagcccgaacct

SEQ ID NO: 106055 - DNA, 20 bp, human
gcgggctccgttggccgagg

SEQ ID NO: 106056 - DNA, 20 bp, human
gcggcggctggacgagacag

SEQ ID NO: 106057 - DNA, 20 bp, human
gcgtggcaggggttattcgg

SEQ ID NO: 106058 - DNA, 20 bp, human
gtttggcgccagaagagcca

SEQ ID NO: 106059 - DNA, 20 bp, human
gggcgccaaaatgtcgttcg

SEQ ID NO: 106060 - DNA, 20 bp, human
gggcacgtcagggaacccgg

SEQ ID NO: 106061 - DNA, 20 bp, human
ggaaacgtctagatgctcaa

SEQ ID NO: 106062 - DNA, 20 bp, human
gaacgggccgcgtcactcaa

SEQ ID NO: 106063 - DNA, 20 bp, human
gaggcctgactggcacgtca

SEQ ID NO: 106064 - DNA, 20 bp, human
gcagcgcatgcccacaacgg

SEQ ID NO: 106065 - DNA, 20 bp, human
gagagcggtaaagaaacaca

SEQ ID NO: 106066 - DNA, 20 bp, human
ggcacgagcctcaagatcca

SEQ ID NO: 106067 - DNA, 20 bp, human
ggcagccggcagcaactgac

SEQ ID NO: 106068 - DNA, 20 bp, human
ggtgcgcgcgtcggcgtccg

SEQ ID NO: 106069 - DNA, 20 bp, human
gagatccaaggtgcgcgcgt

SEQ ID NO: 106070 - DNA, 20 bp, human
gctccgaagcgcatgctcgt

SEQ ID NO: 106071 - DNA, 20 bp, human
gtctccgacaccaaccgcct

SEQ ID NO: 106072 - DNA, 20 bp, human
gccaaactcgggacaaatca

SEQ ID NO: 106073 - DNA, 20 bp, human
gggcgtcatcaggaaatcat

SEQ ID NO: 106074 - DNA, 20 bp, human
gcgtccgaggcggttggtgt

SEQ ID NO: 106075 - DNA, 20 bp, human
ggtcagtcccaggcgctggg

SEQ ID NO: 106076 - DNA, 20 bp, human
gcagcaaaacatggaaacag

SEQ ID NO: 106077 - DNA, 20 bp, human
gattgtgattgcctcagcac

SEQ ID NO: 106078 - DNA, 20 bp, human
gaaacaatcttccagtgctg

SEQ ID NO: 106079 - DNA, 20 bp, human
gggctctctgatagtgtcct

SEQ ID NO: 106080 - DNA, 20 bp, human
gaatttagaggagaaactga

SEQ ID NO: 106081 - DNA, 20 bp, human
ggtcctaggctctcacaact

SEQ ID NO: 106082 - DNA, 20 bp, human
gctggaaaagttgtgctagc

SEQ ID NO: 106083 - DNA, 20 bp, human
gttattaaacaagaatttag

SEQ ID NO: 106084 - DNA, 20 bp, human
gaatgccattacacaaatga

SEQ ID NO: 106085 - DNA, 20 bp, human
gatttataatgaaattgaca

SEQ ID NO: 106086 - DNA, 20 bp, human
gcagggcaccgtgagcctgg

SEQ ID NO: 106087 - DNA, 20 bp, human
ggacacttccccctccgacg

SEQ ID NO: 106088 - DNA, 20 bp, human
gctccgagctgcctagaaag

SEQ ID NO: 106089 - DNA, 20 bp, human
ggcggtcgtgggaaagaagg

SEQ ID NO: 106090 - DNA, 20 bp, human
ggctggagccacgtcggagg

SEQ ID NO: 106091 - DNA, 20 bp, human
ggcagctggagccacgtcgg

SEQ ID NO: 106092 - DNA, 20 bp, human
ggtgcgggcaccaggaaagg

SEQ ID NO: 106093 - DNA, 20 bp, human
gttggcagctggagccacgt

SEQ ID NO: 106094 - DNA, 20 bp, human
ggaggcgcgaaggtgagcat

SEQ ID NO: 106095 - DNA, 20 bp, human
gtgcctagaaagcggctcca

SEQ ID NO: 106096 - DNA, 20 bp, human
gacagacaatgagggcggcg

SEQ ID NO: 106097 - DNA, 20 bp, human
gcggcgcttgacagacaatg

SEQ ID NO: 106098 - DNA, 20 bp, human
gcaggctggggggtcaccag

SEQ ID NO: 106099 - DNA, 20 bp, human
gagcgggcggccgggatcgg

SEQ ID NO: 106100 - DNA, 20 bp, human
gtcaccaggggcgtcccaag

SEQ ID NO: 106101 - DNA, 20 bp, human
gagacccccgggagacccct

SEQ ID NO: 106102 - DNA, 20 bp, human
gccatccgcgaccccggcca

SEQ ID NO: 106103 - DNA, 20 bp, human
gatcggtgcgcgacccgggc

SEQ ID NO: 106104 - DNA, 20 bp, human
gcgggtcgcgcaccgatcac

SEQ ID NO: 106105 - DNA, 20 bp, human
ggttccgaggggtctcccgg

SEQ ID NO: 106106 - DNA, 20 bp, human
gctaacgcgggcgcccggag

SEQ ID NO: 106107 - DNA, 20 bp, human
gtccgcacaggcgcactggg

SEQ ID NO: 106108 - DNA, 20 bp, human
ggccaagtgacgctccgagg

SEQ ID NO: 106109 - DNA, 20 bp, human
ggaccggcccgtgtcactgg

SEQ ID NO: 106110 - DNA, 20 bp, human
gatcaagagggcctccgcac

SEQ ID NO: 106111 - DNA, 20 bp, human
gcccgtgtcactggaggacg

SEQ ID NO: 106112 - DNA, 20 bp, human
ggctgggccaggggcagcga

SEQ ID NO: 106113 - DNA, 20 bp, human
gaccatctaagagggagttg

SEQ ID NO: 106114 - DNA, 20 bp, human
gtcgctagagaccatctaag

SEQ ID NO: 106115 - DNA, 20 bp, human
gatagtatgaaggagatgat

SEQ ID NO: 106116 - DNA, 20 bp, human
gggagtgcctcgggagctcc

SEQ ID NO: 106117 - DNA, 20 bp, human
ggagctccggggtctgcgcc

SEQ ID NO: 106118 - DNA, 20 bp, human
gggcgtgttccaaagatgga

SEQ ID NO: 106119 - DNA, 20 bp, human
ggacagctgaagaggagaga

SEQ ID NO: 106120 - DNA, 20 bp, human
ggctgtcccccacctcatgt

SEQ ID NO: 106121 - DNA, 20 bp, human
gtactggcgtgttccaaaga

SEQ ID NO: 106122 - DNA, 20 bp, human
gcagctggtaaaacaaatta

SEQ ID NO: 106123 - DNA, 20 bp, human
gatgcagcccctcctaagaa

SEQ ID NO: 106124 - DNA, 20 bp, human
gaggatacttgaaatgaggt

SEQ ID NO: 106125 - DNA, 20 bp, human
gaagggggcgctatgaacaa

SEQ ID NO: 106126 - DNA, 20 bp, human
gatgagagcgcgcccaggag

SEQ ID NO: 106127 - DNA, 20 bp, human
gcgcggttccaattagagaa

SEQ ID NO: 106128 - DNA, 20 bp, human
gcctgtgaggctcggagccc

SEQ ID NO: 106129 - DNA, 20 bp, human
ggactgcaaagaggcgagga

SEQ ID NO: 106130 - DNA, 20 bp, human
gagcaaacctccgggccccc

SEQ ID NO: 106131 - DNA, 20 bp, human
ggttccaattagagaaaggt

SEQ ID NO: 106132 - DNA, 20 bp, human
ggccgtggcgcctgacaccc

SEQ ID NO: 106133 - DNA, 20 bp, human
gaattagagaaaggttggta

SEQ ID NO: 106134 - DNA, 20 bp, human
gtgtctgtgtgcgcgccggg

SEQ ID NO: 106135 - DNA, 20 bp, human
gagcgagcgcggggggaaaa

SEQ ID NO: 106136 - DNA, 20 bp, human
gcgcgccgcgtcctccgact

SEQ ID NO: 106137 - DNA, 20 bp, human
ggaggccaagtcggaggacg

SEQ ID NO: 106138 - DNA, 20 bp, human
gcggactgagccccaggcgg

SEQ ID NO: 106139 - DNA, 20 bp, human
ggagatcagccagccgaccg

SEQ ID NO: 106140 - DNA, 20 bp, human
gcagccggttggcgttccag

SEQ ID NO: 106141 - DNA, 20 bp, human
gcggccccgcgcggctgagg

SEQ ID NO: 106142 - DNA, 20 bp, human
ggcggccaggaccatgtcgg

SEQ ID NO: 106143 - DNA, 20 bp, human
gggccgacatcatccaccac

SEQ ID NO: 106144 - DNA, 20 bp, human
gcttccgccgctcctcgtca

SEQ ID NO: 106145 - DNA, 20 bp, human
gccgggcgcacaccggccgg

SEQ ID NO: 106146 - DNA, 20 bp, human
gggagtatgaaggagatggt

SEQ ID NO: 106147 - DNA, 20 bp, human
gcgtagcccgagcccggcgg

SEQ ID NO: 106148 - DNA, 20 bp, human
ggcccatcgcagtagaccag

SEQ ID NO: 106149 - DNA, 20 bp, human
ggcgtatgttcggacgagag

SEQ ID NO: 106150 - DNA, 20 bp, human
ggccctccggagacctcctg

SEQ ID NO: 106151 - DNA, 20 bp, human
ggccccaggaggtctccgga

SEQ ID NO: 106152 - DNA, 20 bp, human
ggtatgaaggagatggtagg

SEQ ID NO: 106153 - DNA, 20 bp, human
ggtcgtccaccaaggtacgg

SEQ ID NO: 106154 - DNA, 20 bp, human
gcccgctggtctactgcgat

SEQ ID NO: 106155 - DNA, 20 bp, human
gctcgggctacgcggcggcg

SEQ ID NO: 106156 - DNA, 20 bp, human
ggcgtgcacgtggtctgagt

SEQ ID NO: 106157 - DNA, 20 bp, human
gagtagcccttggagaaagt

SEQ ID NO: 106158 - DNA, 20 bp, human
ggtgcccgcgctgattccca

SEQ ID NO: 106159 - DNA, 20 bp, human
gcacgtggtctgagtgggtc

SEQ ID NO: 106160 - DNA, 20 bp, human
gagcccttggagaaagtggg

SEQ ID NO: 106161 - DNA, 20 bp, human
gccccacccactttctccaa

SEQ ID NO: 106162 - DNA, 20 bp, human
gccaagccagagctcatcat

SEQ ID NO: 106163 - DNA, 20 bp, human
gtggtggctttgctctggaa

SEQ ID NO: 106164 - DNA, 20 bp, human
ggcacgccgtaagtagccct

SEQ ID NO: 106165 - DNA, 20 bp, human
gccggctgggcactggaagg

SEQ ID NO: 106166 - DNA, 20 bp, human
gggcgcggcaggtcagacgg

SEQ ID NO: 106167 - DNA, 20 bp, human
gcagcccgagcaggatgagt

SEQ ID NO: 106168 - DNA, 20 bp, human
ggcagcggcccgaacaccca

SEQ ID NO: 106169 - DNA, 20 bp, human
gagaggcggtacaggtcgaa

SEQ ID NO: 106170 - DNA, 20 bp, human
ggcgggcgcggcaggtcaga

SEQ ID NO: 106171 - DNA, 20 bp, human
gccgagcaggatgagtaggt

SEQ ID NO: 106172 - DNA, 20 bp, human
gggccgcgcggagcacccat

SEQ ID NO: 106173 - DNA, 20 bp, human
gcgagcgccagaggcggtac

SEQ ID NO: 106174 - DNA, 20 bp, human
gccggcaccagcgcccccag

SEQ ID NO: 106175 - DNA, 20 bp, human
gatgctgcccaggtacaagt

SEQ ID NO: 106176 - DNA, 20 bp, human
ggggcaaggctggataatgg

SEQ ID NO: 106177 - DNA, 20 bp, human
gaggccagggcgtcaggtca

SEQ ID NO: 106178 - DNA, 20 bp, human
gtctgggtgcaggcacgggt

SEQ ID NO: 106179 - DNA, 20 bp, human
gccgggcggactggagacgg

SEQ ID NO: 106180 - DNA, 20 bp, human
gcaagatccgcgggcaaatg

SEQ ID NO: 106181 - DNA, 20 bp, human
gatgcctggcagaatcgaag

SEQ ID NO: 106182 - DNA, 20 bp, human
ggctcttctcctggactcta

SEQ ID NO: 106183 - DNA, 20 bp, human
ggtgtcgcgtgcagacccac

SEQ ID NO: 106184 - DNA, 20 bp, human
ggaagcagggcgtcaggcca

SEQ ID NO: 106185 - DNA, 20 bp, human
gccggggcaaggctggataa

SEQ ID NO: 106186 - DNA, 20 bp, human
gcggagccgcccgtaaggta

SEQ ID NO: 106187 - DNA, 20 bp, human
gggcctccgtaccttacggg

SEQ ID NO: 106188 - DNA, 20 bp, human
gcactccgccgtgtccagga

SEQ ID NO: 106189 - DNA, 20 bp, human
gtacggaggccgcgagccag

SEQ ID NO: 106190 - DNA, 20 bp, human
ggagtgcggagccgcccgta

SEQ ID NO: 106191 - DNA, 20 bp, human
gagccgcccgtaaggtacgg

SEQ ID NO: 106192 - DNA, 20 bp, human
gcgcggcctccgtaccttac

SEQ ID NO: 106193 - DNA, 20 bp, human
gcccctcgccgtcctggaca

SEQ ID NO: 106194 - DNA, 20 bp, human
gacctggctccggggctcca

SEQ ID NO: 106195 - DNA, 20 bp, human
gccgccccgggtggaggata

SEQ ID NO: 106196 - DNA, 20 bp, human
gcaagcgcgcagggtgacag

SEQ ID NO: 106197 - DNA, 20 bp, human
gtccggtgggtacaagatga

SEQ ID NO: 106198 - DNA, 20 bp, human
gccttgacccaagggtcctc

SEQ ID NO: 106199 - DNA, 20 bp, human
gggcccgtttccggtccggt

SEQ ID NO: 106200 - DNA, 20 bp, human
ggagccgggcgcctctcccg

SEQ ID NO: 106201 - DNA, 20 bp, human
gaggcgccttcccggaatgg

SEQ ID NO: 106202 - DNA, 20 bp, human
gtgcgtgcctgcagtggaag

SEQ ID NO: 106203 - DNA, 20 bp, human
gtcagacctccgcccctagg

SEQ ID NO: 106204 - DNA, 20 bp, human
gcgcgccccccattccggga

SEQ ID NO: 106205 - DNA, 20 bp, human
ggcctctcccgaggaccctt

SEQ ID NO: 106206 - DNA, 20 bp, human
gcgacaagcgcgcgaggcag

SEQ ID NO: 106207 - DNA, 20 bp, human
ggagagcacccgcccaagaa

SEQ ID NO: 106208 - DNA, 20 bp, human
gcttgccgaagctgtaggtc

SEQ ID NO: 106209 - DNA, 20 bp, human
gcgaggcgtcgatggacagg

SEQ ID NO: 106210 - DNA, 20 bp, human
gacgtcggcggccatgagaa

SEQ ID NO: 106211 - DNA, 20 bp, human
ggccagcagatcatccacag

SEQ ID NO: 106212 - DNA, 20 bp, human
gcgtgccagacctacagctt

SEQ ID NO: 106213 - DNA, 20 bp, human
ggcgttgccccgggctccgg

SEQ ID NO: 106214 - DNA, 20 bp, human
ggagcacatgaagacgtcgg

SEQ ID NO: 106215 - DNA, 20 bp, human
ggagcgaggcgtcgatggac

SEQ ID NO: 106216 - DNA, 20 bp, human
gccgctgtaggaggacctcg

SEQ ID NO: 106217 - DNA, 20 bp, human
gagggaccaggcggttgcgg

SEQ ID NO: 106218 - DNA, 20 bp, human
gctccgggagccgcaggacc

SEQ ID NO: 106219 - DNA, 20 bp, human
ggcaggaccgggctcgggtg

SEQ ID NO: 106220 - DNA, 20 bp, human
ggctcgcaggtcatccacag

SEQ ID NO: 106221 - DNA, 20 bp, human
ggccggcgcgctggcaggtc

SEQ ID NO: 106222 - DNA, 20 bp, human
gccggcggcgcgaccaggag

SEQ ID NO: 106223 - DNA, 20 bp, human
gatactgcgcggcccgaagt

SEQ ID NO: 106224 - DNA, 20 bp, human
ggcgaccaggaggggtccgt

SEQ ID NO: 106225 - DNA, 20 bp, human
ggagccgcaggaccgggctc

SEQ ID NO: 106226 - DNA, 20 bp, human
ggagctgcgcgagaagacac

SEQ ID NO: 106227 - DNA, 20 bp, human
gcccacaacagctgccgagg

SEQ ID NO: 106228 - DNA, 20 bp, human
gcgcagcgggaggagacgcc

SEQ ID NO: 106229 - DNA, 20 bp, human
gacatcagcaagctggacgg

SEQ ID NO: 106230 - DNA, 20 bp, human
gtgttgtggggcaccatgcg

SEQ ID NO: 106231 - DNA, 20 bp, human
ggtggaccacggccaggtgg

SEQ ID NO: 106232 - DNA, 20 bp, human
gcctggcccgaagcctcgca

SEQ ID NO: 106233 - DNA, 20 bp, human
ggccgcgggggcaaccgcag

SEQ ID NO: 106234 - DNA, 20 bp, human
ggtccagcttgctgatgtgg

SEQ ID NO: 106235 - DNA, 20 bp, human
gggcttcgggccaggcttga

SEQ ID NO: 106236 - DNA, 20 bp, human
ggcttcgggcgggtgagtat

SEQ ID NO: 106237 - DNA, 20 bp, human
gccgggtttggcagcgacaa

SEQ ID NO: 106238 - DNA, 20 bp, human
gcctgcgtgggaggatccgg

SEQ ID NO: 106239 - DNA, 20 bp, human
gcgcgcggcgtccaggagtc

SEQ ID NO: 106240 - DNA, 20 bp, human
ggcgcctgcgtgggaggatc

SEQ ID NO: 106241 - DNA, 20 bp, human
gtctttggtaggagtcatag

SEQ ID NO: 106242 - DNA, 20 bp, human
ggcgggagggcggccgtagg

SEQ ID NO: 106243 - DNA, 20 bp, human
ggcacttccgtggcttcggg

SEQ ID NO: 106244 - DNA, 20 bp, human
gccggtaaatggttaacctg

SEQ ID NO: 106245 - DNA, 20 bp, human
ggggtcaggtggcacttccg

SEQ ID NO: 106246 - DNA, 20 bp, human
ggcacccgcgcaggccaaga

SEQ ID NO: 106247 - DNA, 20 bp, human
gtgccgcggtgacctcacgg

SEQ ID NO: 106248 - DNA, 20 bp, human
gcctggctcatggctgtgtg

SEQ ID NO: 106249 - DNA, 20 bp, human
gcacgtgggcgccagagacc

SEQ ID NO: 106250 - DNA, 20 bp, human
gggcagggcatatcccatgt

SEQ ID NO: 106251 - DNA, 20 bp, human
ggtcaccccgcggactggac

SEQ ID NO: 106252 - DNA, 20 bp, human
gcgcggactggacgggaacc

SEQ ID NO: 106253 - DNA, 20 bp, human
ggctatcatcgggcagggca

SEQ ID NO: 106254 - DNA, 20 bp, human
gctggtgtatctgggacctg

SEQ ID NO: 106255 - DNA, 20 bp, human
ggcgacgacaccacgattca

SEQ ID NO: 106256 - DNA, 20 bp, human
gcagcgtgtaacgtgcgcta

SEQ ID NO: 106257 - DNA, 20 bp, human
gggtaaacctcgaagccaaa

SEQ ID NO: 106258 - DNA, 20 bp, human
gggataaactaacctggaag

SEQ ID NO: 106259 - DNA, 20 bp, human
ggcttgggttaaaaaggtag

SEQ ID NO: 106260 - DNA, 20 bp, human
gcagtgtccatgtgacaaca

SEQ ID NO: 106261 - DNA, 20 bp, human
ggcttcagctctgcgacttt

SEQ ID NO: 106262 - DNA, 20 bp, human
ggtgggggcttgggttaaaa

SEQ ID NO: 106263 - DNA, 20 bp, human
gggaggatcagaggctcccg

SEQ ID NO: 106264 - DNA, 20 bp, human
gaagctgactcaaaacgtaa

SEQ ID NO: 106265 - DNA, 20 bp, human
gtgaagtctcaaggacaatt

SEQ ID NO: 106266 - DNA, 20 bp, human
gaaaatacgggcaataccga

SEQ ID NO: 106267 - DNA, 20 bp, human
gatggctggggacaacgaca

SEQ ID NO: 106268 - DNA, 20 bp, human
gccgcggctgtaaaccggaa

SEQ ID NO: 106269 - DNA, 20 bp, human
gcaggctgatcggaaagatg

SEQ ID NO: 106270 - DNA, 20 bp, human
ggcctgctcaccgccagcgt

SEQ ID NO: 106271 - DNA, 20 bp, human
ggctggcggtgagcaggcaa

SEQ ID NO: 106272 - DNA, 20 bp, human
gacagtggtggtgactggta

SEQ ID NO: 106273 - DNA, 20 bp, human
ggcggtggtagcacctacgc

SEQ ID NO: 106274 - DNA, 20 bp, human
ggtggtagcacctacgctgg

SEQ ID NO: 106275 - DNA, 20 bp, human
gtttgatggcaggaagagtc

SEQ ID NO: 106276 - DNA, 20 bp, human
gggtgttggggccgttgaag

SEQ ID NO: 106277 - DNA, 20 bp, human
gaggccgcctgcgtgtccag

SEQ ID NO: 106278 - DNA, 20 bp, human
gggaacccttcggccgggta

SEQ ID NO: 106279 - DNA, 20 bp, human
gggccgggtagggtcggagt

SEQ ID NO: 106280 - DNA, 20 bp, human
gagatcgcgaggggagaccc

SEQ ID NO: 106281 - DNA, 20 bp, human
gcaggagcaaagggatcccc

SEQ ID NO: 106282 - DNA, 20 bp, human
gtccgtctcgtcagcaccgg

SEQ ID NO: 106283 - DNA, 20 bp, human
ggcgaggggagacccgggtg

SEQ ID NO: 106284 - DNA, 20 bp, human
gcaaggtgcgggatccaccc

SEQ ID NO: 106285 - DNA, 20 bp, human
gcccaggatgaatccaggtg

SEQ ID NO: 106286 - DNA, 20 bp, human
gcccgagaaaaccaggaccc

SEQ ID NO: 106287 - DNA, 20 bp, human
gagccggggggcgaacatcg

SEQ ID NO: 106288 - DNA, 20 bp, human
ggagcgctagaggggatcgg

SEQ ID NO: 106289 - DNA, 20 bp, human
ggcccaggccagctacgctc

SEQ ID NO: 106290 - DNA, 20 bp, human
gccatcccagcgagaagacg

SEQ ID NO: 106291 - DNA, 20 bp, human
gaaatacgcgaggtgagcgg

SEQ ID NO: 106292 - DNA, 20 bp, human
gtggaaatccagcagccggg

SEQ ID NO: 106293 - DNA, 20 bp, human
gcggcggggcccgagaacca

SEQ ID NO: 106294 - DNA, 20 bp, human
gccggagcgctagaggggat

SEQ ID NO: 106295 - DNA, 20 bp, human
gctcacggcgacccaggaca

SEQ ID NO: 106296 - DNA, 20 bp, human
gggcggatgcacggactgag

SEQ ID NO: 106297 - DNA, 20 bp, human
gatgagcgcacggggccggg

SEQ ID NO: 106298 - DNA, 20 bp, human
ggggctctggaagtcacgtc

SEQ ID NO: 106299 - DNA, 20 bp, human
gactgggacctgaagagtga

SEQ ID NO: 106300 - DNA, 20 bp, human
ggagggcagagccagccgag

SEQ ID NO: 106301 - DNA, 20 bp, human
gtctggaagtcacgtcaggt

SEQ ID NO: 106302 - DNA, 20 bp, human
gcgctgggagcccgtgggac

SEQ ID NO: 106303 - DNA, 20 bp, human
gtggcgcgggatctgctgag

SEQ ID NO: 106304 - DNA, 20 bp, human
gacataactccccaaggcag

SEQ ID NO: 106305 - DNA, 20 bp, human
ggggattcgggagaagttgg

SEQ ID NO: 106306 - DNA, 20 bp, human
gtccaggttactacagatgg

SEQ ID NO: 106307 - DNA, 20 bp, human
ggcccatgcctgcatcacaa

SEQ ID NO: 106308 - DNA, 20 bp, human
gtctccaggggcctgactgt

SEQ ID NO: 106309 - DNA, 20 bp, human
gggctccctggggacactcg

SEQ ID NO: 106310 - DNA, 20 bp, human
gataaaccgtatgccagagg

SEQ ID NO: 106311 - DNA, 20 bp, human
gcagtcaggaggttccactg

SEQ ID NO: 106312 - DNA, 20 bp, human
gactcctgctcacagtcagg

SEQ ID NO: 106313 - DNA, 20 bp, human
gtgcagtctcgcctgtgcca

SEQ ID NO: 106314 - DNA, 20 bp, human
ggtgactcctgctcacagtc

SEQ ID NO: 106315 - DNA, 20 bp, human
ggacggctccatgtgcccca

SEQ ID NO: 106316 - DNA, 20 bp, human
gctgcgtagagaacgtgtgg

SEQ ID NO: 106317 - DNA, 20 bp, human
ggaagggcgccggcaaatgg

SEQ ID NO: 106318 - DNA, 20 bp, human
ggcttcggtgtggaacccta

SEQ ID NO: 106319 - DNA, 20 bp, human
gtaggagggccggagcccaa

SEQ ID NO: 106320 - DNA, 20 bp, human
gtacggggaagcgaagagga

SEQ ID NO: 106321 - DNA, 20 bp, human
gcgctgcgcagcggaaaagg

SEQ ID NO: 106322 - DNA, 20 bp, human
ggaggcgaaagcgggagcta

SEQ ID NO: 106323 - DNA, 20 bp, human
gcggtgtggaaccctagggg

SEQ ID NO: 106324 - DNA, 20 bp, human
gaacggagtcataaacgaag

SEQ ID NO: 106325 - DNA, 20 bp, human
gaaccctaggggcggtgtgt

SEQ ID NO: 106326 - DNA, 20 bp, human
gggaggaaagctgtgcatac

SEQ ID NO: 106327 - DNA, 20 bp, human
gagcttcctagctgggatat

SEQ ID NO: 106328 - DNA, 20 bp, human
gtattggagcagcaagaggc

SEQ ID NO: 106329 - DNA, 20 bp, human
gggaggtgagagtgaactaa

SEQ ID NO: 106330 - DNA, 20 bp, human
gctgctccaatatcccagct

SEQ ID NO: 106331 - DNA, 20 bp, human
gcagagggagcttcctagct

SEQ ID NO: 106332 - DNA, 20 bp, human
gcttcacaataactaatagt

SEQ ID NO: 106333 - DNA, 20 bp, human
ggaaacacaagagcaagatg

SEQ ID NO: 106334 - DNA, 20 bp, human
ggttcactctcacctccaac

SEQ ID NO: 106335 - DNA, 20 bp, human
gcaagatgtggacttagtcc

SEQ ID NO: 106336 - DNA, 20 bp, human
ggctgccccactcagaggat

SEQ ID NO: 106337 - DNA, 20 bp, human
ggaggataggcagagcagac

SEQ ID NO: 106338 - DNA, 20 bp, human
gtaaaagaaaggccactagg

SEQ ID NO: 106339 - DNA, 20 bp, human
gagaatatatgaaactcctc

SEQ ID NO: 106340 - DNA, 20 bp, human
gttgcccaggtaattaacgg

SEQ ID NO: 106341 - DNA, 20 bp, human
gttctagctctaccccctag

SEQ ID NO: 106342 - DNA, 20 bp, human
ggctctgcctatcctctgag

SEQ ID NO: 106343 - DNA, 20 bp, human
gacctgggcaagatccttgt

SEQ ID NO: 106344 - DNA, 20 bp, human
gtagttaaaattattgggga

SEQ ID NO: 106345 - DNA, 20 bp, human
gatcttgcccaggtaattaa

SEQ ID NO: 106346 - DNA, 20 bp, human
ggtggggcggaagctataag

SEQ ID NO: 106347 - DNA, 20 bp, human
ggggcggaagctataagggg

SEQ ID NO: 106348 - DNA, 20 bp, human
ggccggagccatccgccccg

SEQ ID NO: 106349 - DNA, 20 bp, human
gagcagagggagtggtaaca

SEQ ID NO: 106350 - DNA, 20 bp, human
gacaaagccgagcagatccc

SEQ ID NO: 106351 - DNA, 20 bp, human
gttgtccctgcgatgaatag

SEQ ID NO: 106352 - DNA, 20 bp, human
ggcgagtggcgggcactcac

SEQ ID NO: 106353 - DNA, 20 bp, human
gggcggatccggaccgaagg

SEQ ID NO: 106354 - DNA, 20 bp, human
ggtgggacgggactccacgc

SEQ ID NO: 106355 - DNA, 20 bp, human
ggcctctcgcgctccagccg

SEQ ID NO: 106356 - DNA, 20 bp, human
gggcttgtagagctgttcag

SEQ ID NO: 106357 - DNA, 20 bp, human
gaggaacagttcaggaactt

SEQ ID NO: 106358 - DNA, 20 bp, human
gtcaggaacttaggctagaa

SEQ ID NO: 106359 - DNA, 20 bp, human
gagctgaaaattggtctagg

SEQ ID NO: 106360 - DNA, 20 bp, human
gttcttcttctaaaaacctt

SEQ ID NO: 106361 - DNA, 20 bp, human
gtgaaggactgttatgaaat

SEQ ID NO: 106362 - DNA, 20 bp, human
gatcagctgaaaattggtct

SEQ ID NO: 106363 - DNA, 20 bp, human
gcttctaatactgctcctgc

SEQ ID NO: 106364 - DNA, 20 bp, human
gctatttggtgaagtaagta

SEQ ID NO: 106365 - DNA, 20 bp, human
gaaagaggtattggttttga

SEQ ID NO: 106366 - DNA, 20 bp, human
ggtccagctcaagaagagga

SEQ ID NO: 106367 - DNA, 20 bp, human
gtaacctacaggtaaatcat

SEQ ID NO: 106368 - DNA, 20 bp, human
gcggaaagacaacagtcccc

SEQ ID NO: 106369 - DNA, 20 bp, human
gatgagtccagctcaagaag

SEQ ID NO: 106370 - DNA, 20 bp, human
gaggatggtagtatgatctc

SEQ ID NO: 106371 - DNA, 20 bp, human
gcatcaccaccactgggaag

SEQ ID NO: 106372 - DNA, 20 bp, human
gcccctggatgcatcttgaa

SEQ ID NO: 106373 - DNA, 20 bp, human
gaccattcaagatgcatcca

SEQ ID NO: 106374 - DNA, 20 bp, human
gagatgcggggttcctgatg

SEQ ID NO: 106375 - DNA, 20 bp, human
gtctcggagcctctcagtca

SEQ ID NO: 106376 - DNA, 20 bp, human
gggacagcctctattcggag

SEQ ID NO: 106377 - DNA, 20 bp, human
gagccctcctctccgaatag

SEQ ID NO: 106378 - DNA, 20 bp, human
gtgtcggcttggagttaaag

SEQ ID NO: 106379 - DNA, 20 bp, human
ggcgggcgcgactccgggaa

SEQ ID NO: 106380 - DNA, 20 bp, human
gagacatggtccgagaccac

SEQ ID NO: 106381 - DNA, 20 bp, human
gcggtgccgagcgtgagcag

SEQ ID NO: 106382 - DNA, 20 bp, human
gcgaatagaggctgtcccct

SEQ ID NO: 106383 - DNA, 20 bp, human
gagatcaaaaaccggaaaag

SEQ ID NO: 106384 - DNA, 20 bp, human
gtcccggcgggcgcgactcc

SEQ ID NO: 106385 - DNA, 20 bp, human
gctgcttagtcggcgaactg

SEQ ID NO: 106386 - DNA, 20 bp, human
gagagcaagcgagccagcca

SEQ ID NO: 106387 - DNA, 20 bp, human
ggtccccaagcagtcccggg

SEQ ID NO: 106388 - DNA, 20 bp, human
gagcgggcgcccgacgtccc

SEQ ID NO: 106389 - DNA, 20 bp, human
gggagccgcctaggtcgcct

SEQ ID NO: 106390 - DNA, 20 bp, human
gctgaactcgccggggacgt

SEQ ID NO: 106391 - DNA, 20 bp, human
gctcgctcgctctctcgggt

SEQ ID NO: 106392 - DNA, 20 bp, human
gagccgcgctgaactcgccg

SEQ ID NO: 106393 - DNA, 20 bp, human
gacgtcgggcgcccgctcct

SEQ ID NO: 106394 - DNA, 20 bp, human
gcaggcgcgccgcggacctc

SEQ ID NO: 106395 - DNA, 20 bp, human
ggaatttgccgaggcgacct

SEQ ID NO: 106396 - DNA, 20 bp, human
gggagagagggagaaaacga

SEQ ID NO: 106397 - DNA, 20 bp, human
gtcccggtgactgaccccgg

SEQ ID NO: 106398 - DNA, 20 bp, human
gacgtggcgcctaagttcac

SEQ ID NO: 106399 - DNA, 20 bp, human
gcggaaccgccggtgaactt

SEQ ID NO: 106400 - DNA, 20 bp, human
gtggcgcctaagttcaccgg

SEQ ID NO: 106401 - DNA, 20 bp, human
gaggctccttacccacccgg

SEQ ID NO: 106402 - DNA, 20 bp, human
gtcctccggggtcagtcacc

SEQ ID NO: 106403 - DNA, 20 bp, human
gtgtggaggtaagagtgcga

SEQ ID NO: 106404 - DNA, 20 bp, human
ggaggagtaggcagtgcagg

SEQ ID NO: 106405 - DNA, 20 bp, human
ggggtcagtcaccgggaacg

SEQ ID NO: 106406 - DNA, 20 bp, human
gctgcggaacgcgaagcgga

SEQ ID NO: 106407 - DNA, 20 bp, human
ggcgcacgcgagtcctgggg

SEQ ID NO: 106408 - DNA, 20 bp, human
gccagcgcacggagccggga

SEQ ID NO: 106409 - DNA, 20 bp, human
gcgagcgcacgcgagtcctg

SEQ ID NO: 106410 - DNA, 20 bp, human
ggaggacctcagcctgggag

SEQ ID NO: 106411 - DNA, 20 bp, human
gaaatgggtccagggcgcca

SEQ ID NO: 106412 - DNA, 20 bp, human
ggaacgcgaagcggagggcg

SEQ ID NO: 106413 - DNA, 20 bp, human
gcacccaggaaatgggtcca

SEQ ID NO: 106414 - DNA, 20 bp, human
gccgcgcgctcaccactccc

SEQ ID NO: 106415 - DNA, 20 bp, human
gtggcgctggggacccgcgg

SEQ ID NO: 106416 - DNA, 20 bp, human
gcaccagacgagagctccag

SEQ ID NO: 106417 - DNA, 20 bp, human
gcaaggctcccagaaatctc

SEQ ID NO: 106418 - DNA, 20 bp, human
gggagaggagggacctgata

SEQ ID NO: 106419 - DNA, 20 bp, human
gctgttataaagaggactag

SEQ ID NO: 106420 - DNA, 20 bp, human
gagtcctatgatgggagtgg

SEQ ID NO: 106421 - DNA, 20 bp, human
ggatgggcagggtagaccat

SEQ ID NO: 106422 - DNA, 20 bp, human
gacagatccatcaggagagg

SEQ ID NO: 106423 - DNA, 20 bp, human
gctaacagatccatcaggag

SEQ ID NO: 106424 - DNA, 20 bp, human
ggtgacctaacagatccatc

SEQ ID NO: 106425 - DNA, 20 bp, human
gagagacctgggccagcgga

SEQ ID NO: 106426 - DNA, 20 bp, human
ggctggaggctgcgcatctg

SEQ ID NO: 106427 - DNA, 20 bp, human
gcccaaaacggacaaagagt

SEQ ID NO: 106428 - DNA, 20 bp, human
gatgcagcggaaacaaggga

SEQ ID NO: 106429 - DNA, 20 bp, human
gtccagacttcctcaggcgg

SEQ ID NO: 106430 - DNA, 20 bp, human
gctggatgcagcggaaacaa

SEQ ID NO: 106431 - DNA, 20 bp, human
gcccagccggctacatctgg

SEQ ID NO: 106432 - DNA, 20 bp, human
gacggacaaagagttggcag

SEQ ID NO: 106433 - DNA, 20 bp, human
ggcatccagacttcctcagg

SEQ ID NO: 106434 - DNA, 20 bp, human
gggagacagagcgccctcag

SEQ ID NO: 106435 - DNA, 20 bp, human
ggctgcatccagacttcctc

SEQ ID NO: 106436 - DNA, 20 bp, human
ggaggctgcaactagggagg

SEQ ID NO: 106437 - DNA, 20 bp, human
gtacttcccgggaatgatgt

SEQ ID NO: 106438 - DNA, 20 bp, human
gctgggggaggctgcaacta

SEQ ID NO: 106439 - DNA, 20 bp, human
gaaacttcaaagccatgatg

SEQ ID NO: 106440 - DNA, 20 bp, human
gagctactgtgaggggatga

SEQ ID NO: 106441 - DNA, 20 bp, human
ggagcaaacaagtacttccc

SEQ ID NO: 106442 - DNA, 20 bp, human
gggggaggctgcaactaggg

SEQ ID NO: 106443 - DNA, 20 bp, human
gatgcaccagacaccaatct

SEQ ID NO: 106444 - DNA, 20 bp, human
gagcagaaaaataaaaaccg

SEQ ID NO: 106445 - DNA, 20 bp, human
gcaccagacaccaatctagg

SEQ ID NO: 106446 - DNA, 20 bp, human
gggctgtggaagagactctc

SEQ ID NO: 106447 - DNA, 20 bp, human
gagagactctcgggctgggt

SEQ ID NO: 106448 - DNA, 20 bp, human
gtggccaaggcactgtccga

SEQ ID NO: 106449 - DNA, 20 bp, human
ggtccgagcggtcccggctg

SEQ ID NO: 106450 - DNA, 20 bp, human
gcaggatgccggctgtgcag

SEQ ID NO: 106451 - DNA, 20 bp, human
ggcagagcagcagtgtcgga

SEQ ID NO: 106452 - DNA, 20 bp, human
gtctcgggctgggtgggcca

SEQ ID NO: 106453 - DNA, 20 bp, human
gacctccacgctgctcaggt

SEQ ID NO: 106454 - DNA, 20 bp, human
gcacatgcttgcctttggaa

SEQ ID NO: 106455 - DNA, 20 bp, human
gatgccaagtgcctttccaa

SEQ ID NO: 106456 - DNA, 20 bp, human
gtgcccccggggcctccgag

SEQ ID NO: 106457 - DNA, 20 bp, human
gccatggcagacttgctgtg

SEQ ID NO: 106458 - DNA, 20 bp, human
gcgtgaggacccccccaacc

SEQ ID NO: 106459 - DNA, 20 bp, human
gcggggcctccgaggggaca

SEQ ID NO: 106460 - DNA, 20 bp, human
gaggcacagggcgaccagcg

SEQ ID NO: 106461 - DNA, 20 bp, human
gcgcggggcccgtgtcccct

SEQ ID NO: 106462 - DNA, 20 bp, human
ggcgctcgacgcctgccccc

SEQ ID NO: 106463 - DNA, 20 bp, human
gatcctccccggaggctctg

SEQ ID NO: 106464 - DNA, 20 bp, human
ggcaagtctgccatgggccg

SEQ ID NO: 106465 - DNA, 20 bp, human
gctccggggaggatccggag

SEQ ID NO: 106466 - DNA, 20 bp, human
gccgctggcgggtccctggg

SEQ ID NO: 106467 - DNA, 20 bp, human
gcccgccagcggctccagcg

SEQ ID NO: 106468 - DNA, 20 bp, human
gcggctcctcggcatcccgg

SEQ ID NO: 106469 - DNA, 20 bp, human
gccgcgccagcccggaccca

SEQ ID NO: 106470 - DNA, 20 bp, human
gcctactgccgaggtcgcgg

SEQ ID NO: 106471 - DNA, 20 bp, human
ggcacctactgccgaggtcg

SEQ ID NO: 106472 - DNA, 20 bp, human
gcgggccgcacctactgccg

SEQ ID NO: 106473 - DNA, 20 bp, human
gccagcccggacccaaggcg

SEQ ID NO: 106474 - DNA, 20 bp, human
gactgccgaggtcgcggagg

SEQ ID NO: 106475 - DNA, 20 bp, human
gtccgggctggcgcggccca

SEQ ID NO: 106476 - DNA, 20 bp, human
ggctcgcgcccggagaggag

SEQ ID NO: 106477 - DNA, 20 bp, human
gcctccgctcgcgcccggag

SEQ ID NO: 106478 - DNA, 20 bp, human
ggggcacccggcaccgagta

SEQ ID NO: 106479 - DNA, 20 bp, human
gtggggtctgcagagagatt

SEQ ID NO: 106480 - DNA, 20 bp, human
gcggaggtctggatgtgccg

SEQ ID NO: 106481 - DNA, 20 bp, human
ggcgcgcgccccgaagccct

SEQ ID NO: 106482 - DNA, 20 bp, human
gaagtgcgcggtggagtcag

SEQ ID NO: 106483 - DNA, 20 bp, human
gtcgcgccgctgggtcgggt

SEQ ID NO: 106484 - DNA, 20 bp, human
gtgtgccgcggcggcctctc

SEQ ID NO: 106485 - DNA, 20 bp, human
gaatcccaggatggttgaga

SEQ ID NO: 106486 - DNA, 20 bp, human
gctggaacggcgaaacacca

SEQ ID NO: 106487 - DNA, 20 bp, human
gtactggagtgagagatcaa

SEQ ID NO: 106488 - DNA, 20 bp, human
gcaagcagtgggacaaatga

SEQ ID NO: 106489 - DNA, 20 bp, human
gaggtctctgatctatatac

SEQ ID NO: 106490 - DNA, 20 bp, human
gagatcagagacctatatac

SEQ ID NO: 106491 - DNA, 20 bp, human
gagtgggacaaatgagggtt

SEQ ID NO: 106492 - DNA, 20 bp, human
gcccctgctgcagaccataa

SEQ ID NO: 106493 - DNA, 20 bp, human
gactttcttagtcttctata

SEQ ID NO: 106494 - DNA, 20 bp, human
gtgagcaatggggctgaatt

SEQ ID NO: 106495 - DNA, 20 bp, human
gagtgaacactccagtatat

SEQ ID NO: 106496 - DNA, 20 bp, human
gatcagcacacagtgactgt

SEQ ID NO: 106497 - DNA, 20 bp, human
gactcagaagtcaacataaa

SEQ ID NO: 106498 - DNA, 20 bp, human
gagtatccaaaagtgcatgc

SEQ ID NO: 106499 - DNA, 20 bp, human
gatgaaataatggacttatt

SEQ ID NO: 106500 - DNA, 20 bp, human
ggattttgtaagaaactctg

SEQ ID NO: 106501 - DNA, 20 bp, human
gtattactgtgcactcacga

SEQ ID NO: 106502 - DNA, 20 bp, human
gattttatgtttgacctcgt

SEQ ID NO: 106503 - DNA, 20 bp, human
gactgagggcagcagtgtgc

SEQ ID NO: 106504 - DNA, 20 bp, human
gccaaaagtgcatgctggat

SEQ ID NO: 106505 - DNA, 20 bp, human
gtagttagatatgcaaaaat

SEQ ID NO: 106506 - DNA, 20 bp, human
ggcttcagctgaagaaagag

SEQ ID NO: 106507 - DNA, 20 bp, human
ggagagagccctgcaaggta

SEQ ID NO: 106508 - DNA, 20 bp, human
ggaggacccaatctacaatt

SEQ ID NO: 106509 - DNA, 20 bp, human
gttcatacatatagggatta

SEQ ID NO: 106510 - DNA, 20 bp, human
gaattctgtgctaacagaac

SEQ ID NO: 106511 - DNA, 20 bp, human
gagggctccaaattgtagat

SEQ ID NO: 106512 - DNA, 20 bp, human
ggtgatctccataccttgca

SEQ ID NO: 106513 - DNA, 20 bp, human
gagaaaataatagtgagacg

SEQ ID NO: 106514 - DNA, 20 bp, human
gtttccgtcatccggactaa

SEQ ID NO: 106515 - DNA, 20 bp, human
gtgaagggatgtttagtgcg

SEQ ID NO: 106516 - DNA, 20 bp, human
gcgaagggggcggaggacag

SEQ ID NO: 106517 - DNA, 20 bp, human
gtcccggcgaagggcagcgg

SEQ ID NO: 106518 - DNA, 20 bp, human
gggctcccggcgaagggcag

SEQ ID NO: 106519 - DNA, 20 bp, human
gcgccggccccggggaccga

SEQ ID NO: 106520 - DNA, 20 bp, human
ggcccgggctggacgacgtc

SEQ ID NO: 106521 - DNA, 20 bp, human
gggcccagagcgcgcagcta

SEQ ID NO: 106522 - DNA, 20 bp, human
ggctctccgccaggtacaca

SEQ ID NO: 106523 - DNA, 20 bp, human
ggcagattgtctgctcacag

SEQ ID NO: 106524 - DNA, 20 bp, human
ggtacgccgtgtgtacctgg

SEQ ID NO: 106525 - DNA, 20 bp, human
gccgagccgggctgcaccgg

SEQ ID NO: 106526 - DNA, 20 bp, human
gcgaggttggacctacaagg

SEQ ID NO: 106527 - DNA, 20 bp, human
gtcccgaggttggacctaca

SEQ ID NO: 106528 - DNA, 20 bp, human
gtgccacgcacagcaacagt

SEQ ID NO: 106529 - DNA, 20 bp, human
gaaggcacatgagtaacaag

SEQ ID NO: 106530 - DNA, 20 bp, human
gcccagtgctgctactgcta

SEQ ID NO: 106531 - DNA, 20 bp, human
gatgagtaacaagtggagag

SEQ ID NO: 106532 - DNA, 20 bp, human
ggaagactcttcatttccac

SEQ ID NO: 106533 - DNA, 20 bp, human
ggtcttgcctgcctccttgt

SEQ ID NO: 106534 - DNA, 20 bp, human
gaaagctgcgctcccgaggt

SEQ ID NO: 106535 - DNA, 20 bp, human
ggatgaaccatatcttgctt

SEQ ID NO: 106536 - DNA, 20 bp, human
gctcccgcctcctgaggcag

SEQ ID NO: 106537 - DNA, 20 bp, human
gtacatagtgagtggagggt

SEQ ID NO: 106538 - DNA, 20 bp, human
gtccactgcaatgctaacat

SEQ ID NO: 106539 - DNA, 20 bp, human
gaatggtatcaaccaaatga

SEQ ID NO: 106540 - DNA, 20 bp, human
gtcatgcctcccgcctcctg

SEQ ID NO: 106541 - DNA, 20 bp, human
gacaattgttcttggaccta

SEQ ID NO: 106542 - DNA, 20 bp, human
gctatctacatagtgagtgg

SEQ ID NO: 106543 - DNA, 20 bp, human
gtcactatgtagatagactc

SEQ ID NO: 106544 - DNA, 20 bp, human
gcttggacctatggttgatt

SEQ ID NO: 106545 - DNA, 20 bp, human
gaatggaaccctaagtaagt

SEQ ID NO: 106546 - DNA, 20 bp, human
gcagggtgctcgccagggaa

SEQ ID NO: 106547 - DNA, 20 bp, human
gaacgtcagggtgctcgcca

SEQ ID NO: 106548 - DNA, 20 bp, human
gtctgggtagggcccttccc

SEQ ID NO: 106549 - DNA, 20 bp, human
ggctttctttctgtccctct

SEQ ID NO: 106550 - DNA, 20 bp, human
gtgtagagttacccctagtt

SEQ ID NO: 106551 - DNA, 20 bp, human
gggagggttccaagctggta

SEQ ID NO: 106552 - DNA, 20 bp, human
gcttcaaactctacccctcc

SEQ ID NO: 106553 - DNA, 20 bp, human
gaacttgattgcagatatcc

SEQ ID NO: 106554 - DNA, 20 bp, human
gttccaagctggtaaggact

SEQ ID NO: 106555 - DNA, 20 bp, human
gatgtctggtgcttccatac

SEQ ID NO: 106556 - DNA, 20 bp, human
gataggctgggagtgaacag

SEQ ID NO: 106557 - DNA, 20 bp, human
gtgccagaggctcatggtga

SEQ ID NO: 106558 - DNA, 20 bp, human
ggtggactggcgctgtctgg

SEQ ID NO: 106559 - DNA, 20 bp, human
gagggttctggggtaagcat

SEQ ID NO: 106560 - DNA, 20 bp, human
gtctccagggaagagcacaa

SEQ ID NO: 106561 - DNA, 20 bp, human
gccagggaagagcacaaggg

SEQ ID NO: 106562 - DNA, 20 bp, human
ggaagagcacaagggtggac

SEQ ID NO: 106563 - DNA, 20 bp, human
gaatgggctagaggcatcca

SEQ ID NO: 106564 - DNA, 20 bp, human
gaacagaggtgtccagggtt

SEQ ID NO: 106565 - DNA, 20 bp, human
gagcagtgatggccagaaat

SEQ ID NO: 106566 - DNA, 20 bp, human
ggagatagctacaactccag

SEQ ID NO: 106567 - DNA, 20 bp, human
gagtcttagcagattcagtg

SEQ ID NO: 106568 - DNA, 20 bp, human
gatgctagcgttggttggga

SEQ ID NO: 106569 - DNA, 20 bp, human
ggtggaagcagctatcaaaa

SEQ ID NO: 106570 - DNA, 20 bp, human
gccgacatgacccgagtggt

SEQ ID NO: 106571 - DNA, 20 bp, human
gaatcctggagcagaatcag

SEQ ID NO: 106572 - DNA, 20 bp, human
ggccagtttgagatgtgtag

SEQ ID NO: 106573 - DNA, 20 bp, human
gaggtagctcatgtgaaatt

SEQ ID NO: 106574 - DNA, 20 bp, human
gagctatcaaaaaggccata

SEQ ID NO: 106575 - DNA, 20 bp, human
gcaaactactgagatgaagg

SEQ ID NO: 106576 - DNA, 20 bp, human
gacaccggcaaggaccccgt

SEQ ID NO: 106577 - DNA, 20 bp, human
gccctgccatggctccgaca

SEQ ID NO: 106578 - DNA, 20 bp, human
gcaggatcatcttggtggtg

SEQ ID NO: 106579 - DNA, 20 bp, human
gaagctcaggatcatcttgg

SEQ ID NO: 106580 - DNA, 20 bp, human
gtatctctgggccatctgtg

SEQ ID NO: 106581 - DNA, 20 bp, human
gggagctctgcagatcagag

SEQ ID NO: 106582 - DNA, 20 bp, human
gggaactccctgcaattctt

SEQ ID NO: 106583 - DNA, 20 bp, human
gatgctgggtgattgatggt

SEQ ID NO: 106584 - DNA, 20 bp, human
ggcctctctagacctcactg

SEQ ID NO: 106585 - DNA, 20 bp, human
gcggcaaggaccccgtagga

SEQ ID NO: 106586 - DNA, 20 bp, human
gtcgtgcacgaggccccata

SEQ ID NO: 106587 - DNA, 20 bp, human
gaacgcgaactagagaccgt

SEQ ID NO: 106588 - DNA, 20 bp, human
ggagccggcggaagggagag

SEQ ID NO: 106589 - DNA, 20 bp, human
ggagggagcggcctcagtac

SEQ ID NO: 106590 - DNA, 20 bp, human
ggaactagagaccgtgggag

SEQ ID NO: 106591 - DNA, 20 bp, human
gccgacagcaccgcccccta

SEQ ID NO: 106592 - DNA, 20 bp, human
gtcggtcacatgcgcacctg

SEQ ID NO: 106593 - DNA, 20 bp, human
gccgcccggcgcctgtactg

SEQ ID NO: 106594 - DNA, 20 bp, human
gtggaggcggcggcgcctat

SEQ ID NO: 106595 - DNA, 20 bp, human
gcgcctatgggtgccctatg

SEQ ID NO: 106596 - DNA, 20 bp, human
ggaacgctccctccccggct

SEQ ID NO: 106597 - DNA, 20 bp, human
gaaatgtgagcgggtacgac

SEQ ID NO: 106598 - DNA, 20 bp, human
gagccgggtacgcgggatac

SEQ ID NO: 106599 - DNA, 20 bp, human
ggcgcgcccgcgctccggaa

SEQ ID NO: 106600 - DNA, 20 bp, human
gcctgctgctgggaaacggg

SEQ ID NO: 106601 - DNA, 20 bp, human
gcggctgcagcaaggacccg

SEQ ID NO: 106602 - DNA, 20 bp, human
ggaccaccaacaggaatctt

SEQ ID NO: 106603 - DNA, 20 bp, human
gggaggaggcgagacccacc

SEQ ID NO: 106604 - DNA, 20 bp, human
ggctgcagagcccgacttag

SEQ ID NO: 106605 - DNA, 20 bp, human
ggaaatccggccactaagtc

SEQ ID NO: 106606 - DNA, 20 bp, human
gggcgaactcagacacccaa

SEQ ID NO: 106607 - DNA, 20 bp, human
ggaactcagacacccaacgg

SEQ ID NO: 106608 - DNA, 20 bp, human
ggggagggcagcgagacgag

SEQ ID NO: 106609 - DNA, 20 bp, human
ggcgtacgcccccctccctc

SEQ ID NO: 106610 - DNA, 20 bp, human
gcaccgttgcaggcgcggga

SEQ ID NO: 106611 - DNA, 20 bp, human
ggagtccctctcggacctga

SEQ ID NO: 106612 - DNA, 20 bp, human
gccgctcgcacaatccccgt

SEQ ID NO: 106613 - DNA, 20 bp, human
gtctgcgtggggcgttccga

SEQ ID NO: 106614 - DNA, 20 bp, human
gaaggcgcggctcctctgct

SEQ ID NO: 106615 - DNA, 20 bp, human
gcctctcccgactagcgggg

SEQ ID NO: 106616 - DNA, 20 bp, human
gtcccttcgcgaaagagcac

SEQ ID NO: 106617 - DNA, 20 bp, human
gggcgcctgcgagagtctgt

SEQ ID NO: 106618 - DNA, 20 bp, human
ggaactgcgggttctcagtg

SEQ ID NO: 106619 - DNA, 20 bp, human
gctgccaagcgcctgttggt

SEQ ID NO: 106620 - DNA, 20 bp, human
gatacagtcgggatactcat

SEQ ID NO: 106621 - DNA, 20 bp, human
gaggtggctctggctgaaac

SEQ ID NO: 106622 - DNA, 20 bp, human
gtgcttggtcgcgtctgagg

SEQ ID NO: 106623 - DNA, 20 bp, human
gcgcgtctgagggggcttgt

SEQ ID NO: 106624 - DNA, 20 bp, human
ggtctgagggggcttgtagg

SEQ ID NO: 106625 - DNA, 20 bp, human
ggtctctgccaagcgcctgt

SEQ ID NO: 106626 - DNA, 20 bp, human
gcggcgaagcccacacacta

SEQ ID NO: 106627 - DNA, 20 bp, human
gctgcgcccgcgccatggta

SEQ ID NO: 106628 - DNA, 20 bp, human
gcgcgccatggtaaggactg

SEQ ID NO: 106629 - DNA, 20 bp, human
ggtagcctcagtccttacca

SEQ ID NO: 106630 - DNA, 20 bp, human
gcgaagcccacacactaggg

SEQ ID NO: 106631 - DNA, 20 bp, human
gtcgggactccggacaggag

SEQ ID NO: 106632 - DNA, 20 bp, human
gggccgaagctggaggcgta

SEQ ID NO: 106633 - DNA, 20 bp, human
gacggggcccttgagaacct

SEQ ID NO: 106634 - DNA, 20 bp, human
gggcccgcgcttggggagag

SEQ ID NO: 106635 - DNA, 20 bp, human
ggccgggctgggcccctaca

SEQ ID NO: 106636 - DNA, 20 bp, human
gttggttcataccccaattg

SEQ ID NO: 106637 - DNA, 20 bp, human
gtaactgtctaggtagcaaa

SEQ ID NO: 106638 - DNA, 20 bp, human
gggaggatgacttggtgact

SEQ ID NO: 106639 - DNA, 20 bp, human
ggtggaagaagcatccatta

SEQ ID NO: 106640 - DNA, 20 bp, human
gtcttggctggaggatgact

SEQ ID NO: 106641 - DNA, 20 bp, human
ggatatttagaggagatact

SEQ ID NO: 106642 - DNA, 20 bp, human
gattctctactgagatggtg

SEQ ID NO: 106643 - DNA, 20 bp, human
gttctttctagttaggaatt

SEQ ID NO: 106644 - DNA, 20 bp, human
gaaagatctaggtatctagt

SEQ ID NO: 106645 - DNA, 20 bp, human
gggcataaattgatatttag

SEQ ID NO: 106646 - DNA, 20 bp, human
gcagccaggtgcgctccttg

SEQ ID NO: 106647 - DNA, 20 bp, human
gttacgcggcgtcttggcaa

SEQ ID NO: 106648 - DNA, 20 bp, human
gtggccgcggtcccacgaga

SEQ ID NO: 106649 - DNA, 20 bp, human
gcgcggcgtcttggcaacgg

SEQ ID NO: 106650 - DNA, 20 bp, human
ggcagaacgtggcctcccat

SEQ ID NO: 106651 - DNA, 20 bp, human
gaaagcgaattgataaatag

SEQ ID NO: 106652 - DNA, 20 bp, human
gccaccacgactaccaccac

SEQ ID NO: 106653 - DNA, 20 bp, human
gaccccctctcgtgggaccg

SEQ ID NO: 106654 - DNA, 20 bp, human
ggcactttatggccctgtgg

SEQ ID NO: 106655 - DNA, 20 bp, human
ggggaggagaaattccctgg

SEQ ID NO: 106656 - DNA, 20 bp, human
gtggccccggtgtagtagcg

SEQ ID NO: 106657 - DNA, 20 bp, human
gcgcccccgctactacaccg

SEQ ID NO: 106658 - DNA, 20 bp, human
ggagtcccgccgacaagaaa

SEQ ID NO: 106659 - DNA, 20 bp, human
ggcgggaggcatcggaaggg

SEQ ID NO: 106660 - DNA, 20 bp, human
gggggcgggaggcatcggaa

SEQ ID NO: 106661 - DNA, 20 bp, human
gttgtcggcgggactcccgg

SEQ ID NO: 106662 - DNA, 20 bp, human
gagcatagagacgctactgg

SEQ ID NO: 106663 - DNA, 20 bp, human
gcatcggaagggaggtagag

SEQ ID NO: 106664 - DNA, 20 bp, human
gggcggcccgcttcctggaa

SEQ ID NO: 106665 - DNA, 20 bp, human
gttgcaacaagatggcgagg

SEQ ID NO: 106666 - DNA, 20 bp, human
ggcgcgggtccccaccacgg

SEQ ID NO: 106667 - DNA, 20 bp, human
ggggcgagcggcgggactag

SEQ ID NO: 106668 - DNA, 20 bp, human
gggctgcagcgcaaagaacc

SEQ ID NO: 106669 - DNA, 20 bp, human
gccacctccggtgccagatg

SEQ ID NO: 106670 - DNA, 20 bp, human
gccctcaggcgaccgcgcgg

SEQ ID NO: 106671 - DNA, 20 bp, human
gccgccgcatctggcaccgg

SEQ ID NO: 106672 - DNA, 20 bp, human
ggagcttcaagtgcgcggag

SEQ ID NO: 106673 - DNA, 20 bp, human
ggtccccaccacggcggcag

SEQ ID NO: 106674 - DNA, 20 bp, human
gcgcaaagaaccgggctccc

SEQ ID NO: 106675 - DNA, 20 bp, human
ggcgacgtgaccaaggccag

SEQ ID NO: 106676 - DNA, 20 bp, human
ggcggcacgtccctccaggt

SEQ ID NO: 106677 - DNA, 20 bp, human
gcgagcgagaccaaaacagg

SEQ ID NO: 106678 - DNA, 20 bp, human
ggcccccagcggcgacgcca

SEQ ID NO: 106679 - DNA, 20 bp, human
gaccaaaacaggtggaatcc

SEQ ID NO: 106680 - DNA, 20 bp, human
ggggcacgagcactagatca

SEQ ID NO: 106681 - DNA, 20 bp, human
gccccgagcgagaccaaaac

SEQ ID NO: 106682 - DNA, 20 bp, human
gccacaggcacctggagtac

SEQ ID NO: 106683 - DNA, 20 bp, human
gcgccagggcagccgcactg

SEQ ID NO: 106684 - DNA, 20 bp, human
ggctggagccggagctccgg

SEQ ID NO: 106685 - DNA, 20 bp, human
gggctctgacggacactcgg

SEQ ID NO: 106686 - DNA, 20 bp, human
ggagaggccgacagagatga

SEQ ID NO: 106687 - DNA, 20 bp, human
gcccccgcggacccgaacag

SEQ ID NO: 106688 - DNA, 20 bp, human
gctcgcagcggccagaaacc

SEQ ID NO: 106689 - DNA, 20 bp, human
gaaacggagcgtgaaggctg

SEQ ID NO: 106690 - DNA, 20 bp, human
gtcgagacaagagaaactgg

SEQ ID NO: 106691 - DNA, 20 bp, human
gtaaaggaaacggagcgtga

SEQ ID NO: 106692 - DNA, 20 bp, human
gcgggcgccgaggtttgcaa

SEQ ID NO: 106693 - DNA, 20 bp, human
ggcgctcgggcggaaaagtt

SEQ ID NO: 106694 - DNA, 20 bp, human
ggcccgaccccactcacaag

SEQ ID NO: 106695 - DNA, 20 bp, human
gaaggtcgaagtaaaggaaa

SEQ ID NO: 106696 - DNA, 20 bp, human
gtcggtggccgcaactagtt

SEQ ID NO: 106697 - DNA, 20 bp, human
gtagggcttcgagtactcgt

SEQ ID NO: 106698 - DNA, 20 bp, human
gaatggaacaggagacaggg

SEQ ID NO: 106699 - DNA, 20 bp, human
gtactcgaagccctatgggg

SEQ ID NO: 106700 - DNA, 20 bp, human
ggagtactcgaagccctatg

SEQ ID NO: 106701 - DNA, 20 bp, human
ggcgtgggccaggaaagaag

SEQ ID NO: 106702 - DNA, 20 bp, human
gggggggaagaacctcctca

SEQ ID NO: 106703 - DNA, 20 bp, human
gtaaccgccgcctccccata

SEQ ID NO: 106704 - DNA, 20 bp, human
gtagttccaatggcaggggg

SEQ ID NO: 106705 - DNA, 20 bp, human
gcagctagttccaatggcag

SEQ ID NO: 106706 - DNA, 20 bp, human
ggccgccggccacactggga

SEQ ID NO: 106707 - DNA, 20 bp, human
ggccacacgcaagctgtcca

SEQ ID NO: 106708 - DNA, 20 bp, human
ggccaaggctggtgaaacga

SEQ ID NO: 106709 - DNA, 20 bp, human
gccctggccaatgggacgcc

SEQ ID NO: 106710 - DNA, 20 bp, human
ggtggtctcccagcatgagt

SEQ ID NO: 106711 - DNA, 20 bp, human
gtctctgccaggcgtcccat

SEQ ID NO: 106712 - DNA, 20 bp, human
gccggccagtccctgcaaag

SEQ ID NO: 106713 - DNA, 20 bp, human
ggccctcccagtgtggccgg

SEQ ID NO: 106714 - DNA, 20 bp, human
ggccctggacagcttgcgtg

SEQ ID NO: 106715 - DNA, 20 bp, human
gtgccccctttccagaggca

SEQ ID NO: 106716 - DNA, 20 bp, human
gggccagttgggtaccggga

SEQ ID NO: 106717 - DNA, 20 bp, human
gccgcggccgtgtccctccg

SEQ ID NO: 106718 - DNA, 20 bp, human
ggcggcagaggcgatcaggt

SEQ ID NO: 106719 - DNA, 20 bp, human
ggaagctggatccctcagac

SEQ ID NO: 106720 - DNA, 20 bp, human
ggaggcggccagttgggtac

SEQ ID NO: 106721 - DNA, 20 bp, human
ggcggccgaggcggccagtt

SEQ ID NO: 106722 - DNA, 20 bp, human
gcaggaagggcgaaccctgg

SEQ ID NO: 106723 - DNA, 20 bp, human
ggcgggcggcagaggcgatc

SEQ ID NO: 106724 - DNA, 20 bp, human
gcggctgcgaggcggtgcgg

SEQ ID NO: 106725 - DNA, 20 bp, human
ggaggccgagccttcaggaa

SEQ ID NO: 106726 - DNA, 20 bp, human
gtcgtccgtgggaagaccgg

SEQ ID NO: 106727 - DNA, 20 bp, human
gggctcccccggtcttccca

SEQ ID NO: 106728 - DNA, 20 bp, human
gcggcctcaggggacaacga

SEQ ID NO: 106729 - DNA, 20 bp, human
ggtctcgtccgtgggaagac

SEQ ID NO: 106730 - DNA, 20 bp, human
gttccacaccaaggccttct

SEQ ID NO: 106731 - DNA, 20 bp, human
gggtgattggccacagaaag

SEQ ID NO: 106732 - DNA, 20 bp, human
gtcacttgtgtctcgtccgt

SEQ ID NO: 106733 - DNA, 20 bp, human
gaagaccgggggagcccaga

SEQ ID NO: 106734 - DNA, 20 bp, human
gacaacgagggcgggagtca

SEQ ID NO: 106735 - DNA, 20 bp, human
gggcgggagtcagggtcccg

SEQ ID NO: 106736 - DNA, 20 bp, human
ggcgcgctgggtgcatgagg

SEQ ID NO: 106737 - DNA, 20 bp, human
gggctgctccggagcgacgg

SEQ ID NO: 106738 - DNA, 20 bp, human
ggtcccggcgagccaaccgg

SEQ ID NO: 106739 - DNA, 20 bp, human
gggcgagccaaccggcggac

SEQ ID NO: 106740 - DNA, 20 bp, human
gaggagccggccagaaaccc

SEQ ID NO: 106741 - DNA, 20 bp, human
gtggccggcgggcagaagac

SEQ ID NO: 106742 - DNA, 20 bp, human
gcggccagaaacccaggcgc

SEQ ID NO: 106743 - DNA, 20 bp, human
gccgggacctcgcgcaccgg

SEQ ID NO: 106744 - DNA, 20 bp, human
gggctggaggtaaaacccca

SEQ ID NO: 106745 - DNA, 20 bp, human
gcgccggcaggggtctgaag

SEQ ID NO: 106746 - DNA, 20 bp, human
gtggccagctggtgcaacgt

SEQ ID NO: 106747 - DNA, 20 bp, human
ggtcacgagagaggtcgcag

SEQ ID NO: 106748 - DNA, 20 bp, human
ggcttggacgagatgacctc

SEQ ID NO: 106749 - DNA, 20 bp, human
gtccctggcagggtatcctc

SEQ ID NO: 106750 - DNA, 20 bp, human
gcaagatgggaggactgtgg

SEQ ID NO: 106751 - DNA, 20 bp, human
ggcaggcccaccagcagaca

SEQ ID NO: 106752 - DNA, 20 bp, human
gggcggggcactggacctag

SEQ ID NO: 106753 - DNA, 20 bp, human
gcaagcccctgtctgctggt

SEQ ID NO: 106754 - DNA, 20 bp, human
ggaccaacagcaagtctgag

SEQ ID NO: 106755 - DNA, 20 bp, human
gcacagggccatggccagct

SEQ ID NO: 106756 - DNA, 20 bp, human
gcgcctagacgctggcacta

SEQ ID NO: 106757 - DNA, 20 bp, human
gcggtacccggatgtaggga

SEQ ID NO: 106758 - DNA, 20 bp, human
ggaagccacctaaggaatca

SEQ ID NO: 106759 - DNA, 20 bp, human
gcagctgactagcattggag

SEQ ID NO: 106760 - DNA, 20 bp, human
gagcctggtggagacccccg

SEQ ID NO: 106761 - DNA, 20 bp, human
gactccagccgcctagacgc

SEQ ID NO: 106762 - DNA, 20 bp, human
gctgtcccagaagccaccta

SEQ ID NO: 106763 - DNA, 20 bp, human
ggagtcggtacccggatgta

SEQ ID NO: 106764 - DNA, 20 bp, human
gtgctgaggcggaacaggcc

SEQ ID NO: 106765 - DNA, 20 bp, human
ggcgagcctgtcagcagcaa

SEQ ID NO: 106766 - DNA, 20 bp, human
ggaagtaggctcaaaccctc

SEQ ID NO: 106767 - DNA, 20 bp, human
ggtctataccaggtccctga

SEQ ID NO: 106768 - DNA, 20 bp, human
ggaaggtaagaggattccat

SEQ ID NO: 106769 - DNA, 20 bp, human
gaagattgagaggacataca

SEQ ID NO: 106770 - DNA, 20 bp, human
gcagattctgcgtctatacc

SEQ ID NO: 106771 - DNA, 20 bp, human
gattctgcatgcattgaagt

SEQ ID NO: 106772 - DNA, 20 bp, human
gttagcaggaacattccagg

SEQ ID NO: 106773 - DNA, 20 bp, human
gcacaacaactgctatttga

SEQ ID NO: 106774 - DNA, 20 bp, human
gactgctatttgaaggtaag

SEQ ID NO: 106775 - DNA, 20 bp, human
gaccatgtttattctgatgt

SEQ ID NO: 106776 - DNA, 20 bp, human
gaggggtctcccgcaagaga

SEQ ID NO: 106777 - DNA, 20 bp, human
gcctaagccccgctcgcgga

SEQ ID NO: 106778 - DNA, 20 bp, human
gcgcggtgcgctcgggtccc

SEQ ID NO: 106779 - DNA, 20 bp, human
gcactgtaaagggcctgctg

SEQ ID NO: 106780 - DNA, 20 bp, human
gactcttccgactttccggt

SEQ ID NO: 106781 - DNA, 20 bp, human
ggcaggccctttacagtgag

SEQ ID NO: 106782 - DNA, 20 bp, human
gaggtagcgccgctctcact

SEQ ID NO: 106783 - DNA, 20 bp, human
ggggcgggaaaaggggaaga

SEQ ID NO: 106784 - DNA, 20 bp, human
ggagcggcgctacctcattc

SEQ ID NO: 106785 - DNA, 20 bp, human
gggcctggatggactagccg

SEQ ID NO: 106786 - DNA, 20 bp, human
gcttgctgggatgaccccgg

SEQ ID NO: 106787 - DNA, 20 bp, human
gccatgaagcctgatacgag

SEQ ID NO: 106788 - DNA, 20 bp, human
gcccagcgggagaggttcct

SEQ ID NO: 106789 - DNA, 20 bp, human
gataggccgggagctactgg

SEQ ID NO: 106790 - DNA, 20 bp, human
ggcggaaccgcagcccgctt

SEQ ID NO: 106791 - DNA, 20 bp, human
gctgcgtccacagcttcccg

SEQ ID NO: 106792 - DNA, 20 bp, human
ggtctcacccgctagcccag

SEQ ID NO: 106793 - DNA, 20 bp, human
gagctcagggctagaagggg

SEQ ID NO: 106794 - DNA, 20 bp, human
gacccgttggcactcctcag

SEQ ID NO: 106795 - DNA, 20 bp, human
gctgcggttccgctcgtatc

SEQ ID NO: 106796 - DNA, 20 bp, human
ggtgccgctgtgccaggtaa

SEQ ID NO: 106797 - DNA, 20 bp, human
gccgctgtgccaggtaaggg

SEQ ID NO: 106798 - DNA, 20 bp, human
gggacagcgggaccgaatca

SEQ ID NO: 106799 - DNA, 20 bp, human
gcaggtttgcaaatgatcaa

SEQ ID NO: 106800 - DNA, 20 bp, human
gcacacccgccacccttacc

SEQ ID NO: 106801 - DNA, 20 bp, human
ggaggacccgacttctgctg

SEQ ID NO: 106802 - DNA, 20 bp, human
gtcggtcccgctgtcctagg

SEQ ID NO: 106803 - DNA, 20 bp, human
gcagcggcaccatcccgcct

SEQ ID NO: 106804 - DNA, 20 bp, human
gctgtgccaggtaagggtgg

SEQ ID NO: 106805 - DNA, 20 bp, human
gtaaagcccggagacaggaa

SEQ ID NO: 106806 - DNA, 20 bp, human
gaaggcgagtacctcctccc

SEQ ID NO: 106807 - DNA, 20 bp, human
ggcgtaagggcctgagtgta

SEQ ID NO: 106808 - DNA, 20 bp, human
gccgcgtgcgtgctaatcgt

SEQ ID NO: 106809 - DNA, 20 bp, human
gggccttgtggactatgacg

SEQ ID NO: 106810 - DNA, 20 bp, human
gcttccggaagaggtcgcca

SEQ ID NO: 106811 - DNA, 20 bp, human
gttccactgccgaattgagg

SEQ ID NO: 106812 - DNA, 20 bp, human
ggaagttgcccaacgtgagg

SEQ ID NO: 106813 - DNA, 20 bp, human
gtagtcctcgcaggtctcgg

SEQ ID NO: 106814 - DNA, 20 bp, human
ggtcgccatggcttcccggg

SEQ ID NO: 106815 - DNA, 20 bp, human
gtgcatggcgaggcactggc

SEQ ID NO: 106816 - DNA, 20 bp, human
ggcaaggtcaggccaagtgg

SEQ ID NO: 106817 - DNA, 20 bp, human
gaaggggacatgcaccccaa

SEQ ID NO: 106818 - DNA, 20 bp, human
ggagcccccgcagcaaggtc

SEQ ID NO: 106819 - DNA, 20 bp, human
gcaccccaagggcctccact

SEQ ID NO: 106820 - DNA, 20 bp, human
gaaagcccaagggaagatct

SEQ ID NO: 106821 - DNA, 20 bp, human
gttactgctgaaaagcccaa

SEQ ID NO: 106822 - DNA, 20 bp, human
gaggctgtaagaaccaccca

SEQ ID NO: 106823 - DNA, 20 bp, human
gggagaccctgaaaacagaa

SEQ ID NO: 106824 - DNA, 20 bp, human
gccctccaagatcttccctt

SEQ ID NO: 106825 - DNA, 20 bp, human
gaggccaagtggaggccctt

SEQ ID NO: 106826 - DNA, 20 bp, human
gtggctgggcggagaggaaa

SEQ ID NO: 106827 - DNA, 20 bp, human
ggaagtgcccggccggatcc

SEQ ID NO: 106828 - DNA, 20 bp, human
gccagcgcggggcccggatc

SEQ ID NO: 106829 - DNA, 20 bp, human
gaccgtcccgagggaggata

SEQ ID NO: 106830 - DNA, 20 bp, human
ggctgctctgcggcgcctgt

SEQ ID NO: 106831 - DNA, 20 bp, human
gcgggccccgcgctgggcac

SEQ ID NO: 106832 - DNA, 20 bp, human
gacccaactgcgccctgggt

SEQ ID NO: 106833 - DNA, 20 bp, human
ggcggggcccggatccggcc

SEQ ID NO: 106834 - DNA, 20 bp, human
ggcaccttgcctacaataaa

SEQ ID NO: 106835 - DNA, 20 bp, human
ggcgccagctggatgttgag

SEQ ID NO: 106836 - DNA, 20 bp, human
ggctcccacggcataaacaa

SEQ ID NO: 106837 - DNA, 20 bp, human
ggcagagctcacagaacctg

SEQ ID NO: 106838 - DNA, 20 bp, human
gggagggaacaaaaacctgt

SEQ ID NO: 106839 - DNA, 20 bp, human
gagaccaccgcactcaggtg

SEQ ID NO: 106840 - DNA, 20 bp, human
gggttctgtgagctctgctg

SEQ ID NO: 106841 - DNA, 20 bp, human
gccatgctggcgggtcagcc

SEQ ID NO: 106842 - DNA, 20 bp, human
gaggcccaggagttctctct

SEQ ID NO: 106843 - DNA, 20 bp, human
gggcgcgaactctaccatgc

SEQ ID NO: 106844 - DNA, 20 bp, human
gctgcccagagagaactcct

SEQ ID NO: 106845 - DNA, 20 bp, human
ggcgaactctaccatgctgg

SEQ ID NO: 106846 - DNA, 20 bp, human
gcagagtagcgtgtgtccgt

SEQ ID NO: 106847 - DNA, 20 bp, human
gggacacacgctactctggg

SEQ ID NO: 106848 - DNA, 20 bp, human
gccaaagctgggctcctgta

SEQ ID NO: 106849 - DNA, 20 bp, human
gagagctggttgttctgaag

SEQ ID NO: 106850 - DNA, 20 bp, human
gatgcctgaggacagtgacc

SEQ ID NO: 106851 - DNA, 20 bp, human
ggctggttgttctgaagggg

SEQ ID NO: 106852 - DNA, 20 bp, human
ggcaggatcccagaacccgg

SEQ ID NO: 106853 - DNA, 20 bp, human
gagcagcatctagaagcagt

SEQ ID NO: 106854 - DNA, 20 bp, human
gctctcccagaccagtcacc

SEQ ID NO: 106855 - DNA, 20 bp, human
gcccggaggacaaacgatga

SEQ ID NO: 106856 - DNA, 20 bp, human
gaaccggacggtggtcgcca

SEQ ID NO: 106857 - DNA, 20 bp, human
ggcaggtgtcgctaaccgga

SEQ ID NO: 106858 - DNA, 20 bp, human
gggtgtcgctaaccggacgg

SEQ ID NO: 106859 - DNA, 20 bp, human
gaggagtcggcaggcaacac

SEQ ID NO: 106860 - DNA, 20 bp, human
gtggccccggacctcttctg

SEQ ID NO: 106861 - DNA, 20 bp, human
gacggcggggctggaggagt

SEQ ID NO: 106862 - DNA, 20 bp, human
gcggtggtcgccagggcgag

SEQ ID NO: 106863 - DNA, 20 bp, human
gcccggttaccggtgaggag

SEQ ID NO: 106864 - DNA, 20 bp, human
gcatgccgaagtagacgtga

SEQ ID NO: 106865 - DNA, 20 bp, human
ggcgtcacaagagctcggag

SEQ ID NO: 106866 - DNA, 20 bp, human
gtgacagggacacaacatgg

SEQ ID NO: 106867 - DNA, 20 bp, human
ggggtgacagggacacaaca

SEQ ID NO: 106868 - DNA, 20 bp, human
gctccgtggtggtccctcga

SEQ ID NO: 106869 - DNA, 20 bp, human
gtcccgcactaggatctccg

SEQ ID NO: 106870 - DNA, 20 bp, human
gctccttcgagggaccacca

SEQ ID NO: 106871 - DNA, 20 bp, human
ggacggttgctagggtgaca

SEQ ID NO: 106872 - DNA, 20 bp, human
gcctgagcgggaactcgagt

SEQ ID NO: 106873 - DNA, 20 bp, human
gcagggcctgacggttgcta

SEQ ID NO: 106874 - DNA, 20 bp, human
gcccctgggggaagcttgag

SEQ ID NO: 106875 - DNA, 20 bp, human
gcaccacggagatcctagtg

SEQ ID NO: 106876 - DNA, 20 bp, human
gtggctgggagggcgagatc

SEQ ID NO: 106877 - DNA, 20 bp, human
ggccctcccagccaaaggat

SEQ ID NO: 106878 - DNA, 20 bp, human
ggagggcgagatccggtagg

SEQ ID NO: 106879 - DNA, 20 bp, human
gaccggcggccgggtgaggg

SEQ ID NO: 106880 - DNA, 20 bp, human
gtgggagggcgagatccggt

SEQ ID NO: 106881 - DNA, 20 bp, human
ggccggctagtccccagctg

SEQ ID NO: 106882 - DNA, 20 bp, human
gccgggtgagggcggtggga

SEQ ID NO: 106883 - DNA, 20 bp, human
gcccagctggggaatacaaa

SEQ ID NO: 106884 - DNA, 20 bp, human
gcctggaggcacctagagac

SEQ ID NO: 106885 - DNA, 20 bp, human
ggagtggggagagtcctacc

SEQ ID NO: 106886 - DNA, 20 bp, human
gcgccgctacggggaagtaa

SEQ ID NO: 106887 - DNA, 20 bp, human
gtgagtgggaggggaatcga

SEQ ID NO: 106888 - DNA, 20 bp, human
gcgccggatcccgaagacga

SEQ ID NO: 106889 - DNA, 20 bp, human
gtatccggccaattgagatt

SEQ ID NO: 106890 - DNA, 20 bp, human
gagggggcctgactctataa

SEQ ID NO: 106891 - DNA, 20 bp, human
ggcagtaggagtgtgtccaa

SEQ ID NO: 106892 - DNA, 20 bp, human
gtaccattacttccccgtag

SEQ ID NO: 106893 - DNA, 20 bp, human
gggcccacttcgcttaccag

SEQ ID NO: 106894 - DNA, 20 bp, human
gcccgaagacgagggcctgg

SEQ ID NO: 106895 - DNA, 20 bp, human
ggaaaagaggagactctact

SEQ ID NO: 106896 - DNA, 20 bp, human
ggggacggtgcgactgcggg

SEQ ID NO: 106897 - DNA, 20 bp, human
gagcttccccgcaacacctc

SEQ ID NO: 106898 - DNA, 20 bp, human
gtggcgtcggcgagtcttag

SEQ ID NO: 106899 - DNA, 20 bp, human
ggcgactcggctaatggcgt

SEQ ID NO: 106900 - DNA, 20 bp, human
ggaccttggaggatcatgtc

SEQ ID NO: 106901 - DNA, 20 bp, human
gcgggtgtcaccagccaacc

SEQ ID NO: 106902 - DNA, 20 bp, human
gcggcagcgctcggaattgt

SEQ ID NO: 106903 - DNA, 20 bp, human
gtggctggtgacacccggtg

SEQ ID NO: 106904 - DNA, 20 bp, human
gtgccggacatgatcctcca

SEQ ID NO: 106905 - DNA, 20 bp, human
ggtcccagccaatttccgag

SEQ ID NO: 106906 - DNA, 20 bp, human
gcacgacccgcgcaactcaa

SEQ ID NO: 106907 - DNA, 20 bp, human
gggggacaaggacacctgac

SEQ ID NO: 106908 - DNA, 20 bp, human
gtgttaggcagactaaggtt

SEQ ID NO: 106909 - DNA, 20 bp, human
gttgcgcgggtcgtgttcga

SEQ ID NO: 106910 - DNA, 20 bp, human
ggttcgagggcatggacgac

SEQ ID NO: 106911 - DNA, 20 bp, human
gaggcgaacggctgccggtc

SEQ ID NO: 106912 - DNA, 20 bp, human
ggactaaggttaggcaggat

SEQ ID NO: 106913 - DNA, 20 bp, human
gcgcgcaactcaaggggaca

SEQ ID NO: 106914 - DNA, 20 bp, human
gcacctcggcactcacgagt

SEQ ID NO: 106915 - DNA, 20 bp, human
gcaggtaccctgcgcttcag

SEQ ID NO: 106916 - DNA, 20 bp, human
gcttccaaggaccggatcga

SEQ ID NO: 106917 - DNA, 20 bp, human
gcacgaagaggagctactcc

SEQ ID NO: 106918 - DNA, 20 bp, human
gtggccgcctccccacgaag

SEQ ID NO: 106919 - DNA, 20 bp, human
gattccgcggggagggacaa

SEQ ID NO: 106920 - DNA, 20 bp, human
gcacctgaccgggcactacc

SEQ ID NO: 106921 - DNA, 20 bp, human
gagaatcctggcatcacgtg

SEQ ID NO: 106922 - DNA, 20 bp, human
gccggagaccaagatgtcga

SEQ ID NO: 106923 - DNA, 20 bp, human
gatccgggtagtgcccggtc

SEQ ID NO: 106924 - DNA, 20 bp, human
gggcctgcccgaggtgctgt

SEQ ID NO: 106925 - DNA, 20 bp, human
gtcttaaacaggcccaagac

SEQ ID NO: 106926 - DNA, 20 bp, human
gtgtagctcgctcaagatgg

SEQ ID NO: 106927 - DNA, 20 bp, human
gccgccgcaacccgactggg

SEQ ID NO: 106928 - DNA, 20 bp, human
gtgaggcgtatcccgcgggg

SEQ ID NO: 106929 - DNA, 20 bp, human
gccgcaacccgactgggagg

SEQ ID NO: 106930 - DNA, 20 bp, human
ggaagtgggcggtacccata

SEQ ID NO: 106931 - DNA, 20 bp, human
gtggcggcgcagccaccccg

SEQ ID NO: 106932 - DNA, 20 bp, human
gcagctgctgggagactagg

SEQ ID NO: 106933 - DNA, 20 bp, human
ggcgctgaggcgtatcccgc

SEQ ID NO: 106934 - DNA, 20 bp, human
gctcccaccacgacgcccag

SEQ ID NO: 106935 - DNA, 20 bp, human
ggcctccgccgcaacccgac

SEQ ID NO: 106936 - DNA, 20 bp, human
ggcagtcgccgggtcggtag

SEQ ID NO: 106937 - DNA, 20 bp, human
gggtagaggtgctgacaggg

SEQ ID NO: 106938 - DNA, 20 bp, human
ggtcggtagaggtgctgaca

SEQ ID NO: 106939 - DNA, 20 bp, human
gcacctgtcccgggcgggag

SEQ ID NO: 106940 - DNA, 20 bp, human
gggtagcgggggctcatctg

SEQ ID NO: 106941 - DNA, 20 bp, human
gcagcagacgggtaccgtgg

SEQ ID NO: 106942 - DNA, 20 bp, human
gggagttgctctggaggtag

SEQ ID NO: 106943 - DNA, 20 bp, human
ggcccgggcagtcgccgggt

SEQ ID NO: 106944 - DNA, 20 bp, human
gcgctccagccacctgtccc

SEQ ID NO: 106945 - DNA, 20 bp, human
gtccagccacctgtcccggg

SEQ ID NO: 106946 - DNA, 20 bp, human
gctgcgggcgctggcaaatc

SEQ ID NO: 106947 - DNA, 20 bp, human
ggagagagcagcctattgta

SEQ ID NO: 106948 - DNA, 20 bp, human
gctaacggcgcaggagatag

SEQ ID NO: 106949 - DNA, 20 bp, human
gccggcccaggatgtagagc

SEQ ID NO: 106950 - DNA, 20 bp, human
ggctgcgcaggcgttagagt

SEQ ID NO: 106951 - DNA, 20 bp, human
gttgggaaaaaggcacctaa

SEQ ID NO: 106952 - DNA, 20 bp, human
ggcgctggcaaatccggccc

SEQ ID NO: 106953 - DNA, 20 bp, human
gcccgtcgcctccctacaat

SEQ ID NO: 106954 - DNA, 20 bp, human
ggtgcgcggcgggctgtcgt

SEQ ID NO: 106955 - DNA, 20 bp, human
gagagcagcctattgtaggg

SEQ ID NO: 106956 - DNA, 20 bp, human
gactatggcggttggaggaa

SEQ ID NO: 106957 - DNA, 20 bp, human
gaacggcagtgatcacacgt

SEQ ID NO: 106958 - DNA, 20 bp, human
ggagaaacctggctttacta

SEQ ID NO: 106959 - DNA, 20 bp, human
gatcagttgccagagaaacc

SEQ ID NO: 106960 - DNA, 20 bp, human
gtctggcaactgatatccat

SEQ ID NO: 106961 - DNA, 20 bp, human
gattctaggaaagaagttga

SEQ ID NO: 106962 - DNA, 20 bp, human
gaaacctggctttactatgg

SEQ ID NO: 106963 - DNA, 20 bp, human
ggctttactatggcggttgg

SEQ ID NO: 106964 - DNA, 20 bp, human
gtgatcacacgtcggctgct

SEQ ID NO: 106965 - DNA, 20 bp, human
gctggctttactatggcggt

SEQ ID NO: 106966 - DNA, 20 bp, human
gcttggagatcaggacgcaa

SEQ ID NO: 106967 - DNA, 20 bp, human
gcattagcaactccaaaggg

SEQ ID NO: 106968 - DNA, 20 bp, human
gatctagtggcagactcgag

SEQ ID NO: 106969 - DNA, 20 bp, human
gttggcacggaggaaaacgt

SEQ ID NO: 106970 - DNA, 20 bp, human
ggtgcgtatttgcctgaaga

SEQ ID NO: 106971 - DNA, 20 bp, human
ggcgacaataacagataaag

SEQ ID NO: 106972 - DNA, 20 bp, human
gtagggactccggatttctg

SEQ ID NO: 106973 - DNA, 20 bp, human
gcacgcaaccttgaagggag

SEQ ID NO: 106974 - DNA, 20 bp, human
gaagcacactgaccttcttc

SEQ ID NO: 106975 - DNA, 20 bp, human
ggccgcattagcaactccaa

SEQ ID NO: 106976 - DNA, 20 bp, human
gagctcccgcgggccgcgtc

SEQ ID NO: 106977 - DNA, 20 bp, human
gcgttggcgggcgggcctcc

SEQ ID NO: 106978 - DNA, 20 bp, human
gtcgctaagagaaccctcgg

SEQ ID NO: 106979 - DNA, 20 bp, human
gtcacagccagcgggacctg

SEQ ID NO: 106980 - DNA, 20 bp, human
gtcccgaagcccaggacttg

SEQ ID NO: 106981 - DNA, 20 bp, human
gagatggcagcggcgggcga

SEQ ID NO: 106982 - DNA, 20 bp, human
gggcggcaagatggcagcgg

SEQ ID NO: 106983 - DNA, 20 bp, human
gctaggcggccgccccggaa

SEQ ID NO: 106984 - DNA, 20 bp, human
gggcgcacggcgagtcctgt

SEQ ID NO: 106985 - DNA, 20 bp, human
gagaaccctcggcggcaaga

SEQ ID NO: 106986 - DNA, 20 bp, human
gccgcagagctggccgccca

SEQ ID NO: 106987 - DNA, 20 bp, human
gcgggagagaactaggcgct

SEQ ID NO: 106988 - DNA, 20 bp, human
gctgcggccgggagagaact

SEQ ID NO: 106989 - DNA, 20 bp, human
gtaggcgctaggacagctcc

SEQ ID NO: 106990 - DNA, 20 bp, human
ggacagctccaggtgcgact

SEQ ID NO: 106991 - DNA, 20 bp, human
gaaactctgcgactccccct

SEQ ID NO: 106992 - DNA, 20 bp, human
ggcccctcggctagacggtc

SEQ ID NO: 106993 - DNA, 20 bp, human
gctctgcgactccccctggg

SEQ ID NO: 106994 - DNA, 20 bp, human
ggctcccggtaactcctgtg

SEQ ID NO: 106995 - DNA, 20 bp, human
gagaccacccggcaccatag

SEQ ID NO: 106996 - DNA, 20 bp, human
ggcgcagctgacggacattg

SEQ ID NO: 106997 - DNA, 20 bp, human
gctggatgctgcgatcccgc

SEQ ID NO: 106998 - DNA, 20 bp, human
gagctgacggacattgaggc

SEQ ID NO: 106999 - DNA, 20 bp, human
ggaccggcctggcggcatgg

SEQ ID NO: 107000 - DNA, 20 bp, human
gggggtcagtcaggagtcct

SEQ ID NO: 107001 - DNA, 20 bp, human
ggtaacaaagaccggcctgg

SEQ ID NO: 107002 - DNA, 20 bp, human
gtgagtaacaaagaccggcc

SEQ ID NO: 107003 - DNA, 20 bp, human
gttaggactacagcctcctc

SEQ ID NO: 107004 - DNA, 20 bp, human
gcgcgttgccatagcgaccc

SEQ ID NO: 107005 - DNA, 20 bp, human
gatcacatgagtccgagagt

SEQ ID NO: 107006 - DNA, 20 bp, human
ggggcaatcgctggtggagg

SEQ ID NO: 107007 - DNA, 20 bp, human
gaggatggcggcgtcaagtg

SEQ ID NO: 107008 - DNA, 20 bp, human
gcgtcaagtggggcaatcgc

SEQ ID NO: 107009 - DNA, 20 bp, human
gcagggtctaacgctcacac

SEQ ID NO: 107010 - DNA, 20 bp, human
gtcaggtgggcactgaggaa

SEQ ID NO: 107011 - DNA, 20 bp, human
gccatcagaggaaaagtccg

SEQ ID NO: 107012 - DNA, 20 bp, human
gccccgcggtggagactaaa

SEQ ID NO: 107013 - DNA, 20 bp, human
ggcgggcccggatagcagga

SEQ ID NO: 107014 - DNA, 20 bp, human
gcaagtggggcaatcgctgg

SEQ ID NO: 107015 - DNA, 20 bp, human
ggggtggagggttgcatcag

SEQ ID NO: 107016 - DNA, 20 bp, human
gcaggcgccatggagtacac

SEQ ID NO: 107017 - DNA, 20 bp, human
ggactccggatcctaacagc

SEQ ID NO: 107018 - DNA, 20 bp, human
gtccggagtctcagtggata

SEQ ID NO: 107019 - DNA, 20 bp, human
gttaggatccggagtctcag

SEQ ID NO: 107020 - DNA, 20 bp, human
ggcttccagctgttaggatc

SEQ ID NO: 107021 - DNA, 20 bp, human
ggccgtatccactgagactc

SEQ ID NO: 107022 - DNA, 20 bp, human
gacagctggaagctaaaaac

SEQ ID NO: 107023 - DNA, 20 bp, human
gtcactatgacaacctggag

SEQ ID NO: 107024 - DNA, 20 bp, human
gaagctaaaaacaggcgcca

SEQ ID NO: 107025 - DNA, 20 bp, human
gacacagggagcaaatatat

SEQ ID NO: 107026 - DNA, 20 bp, human
ggctgccgctcccccgaata

SEQ ID NO: 107027 - DNA, 20 bp, human
gagcctagggaccatcatca

SEQ ID NO: 107028 - DNA, 20 bp, human
gggcggcgccatagatgact

SEQ ID NO: 107029 - DNA, 20 bp, human
gcaccctgagggggacgcag

SEQ ID NO: 107030 - DNA, 20 bp, human
gcgcagggtccaatagccta

SEQ ID NO: 107031 - DNA, 20 bp, human
gcagcacatactgtacgcgg

SEQ ID NO: 107032 - DNA, 20 bp, human
gctcccctgcgtccccctca

SEQ ID NO: 107033 - DNA, 20 bp, human
ggcgccccggagctcctgaa

SEQ ID NO: 107034 - DNA, 20 bp, human
ggcgccgccggccaccctga

SEQ ID NO: 107035 - DNA, 20 bp, human
gcggcagcacatactgtacg

SEQ ID NO: 107036 - DNA, 20 bp, human
gtcgcgggacaactcttcgg

SEQ ID NO: 107037 - DNA, 20 bp, human
ggacgctgacaaaggagcgg

SEQ ID NO: 107038 - DNA, 20 bp, human
gccgtcgggcaggcaccgag

SEQ ID NO: 107039 - DNA, 20 bp, human
gagcctagagacgctgacaa

SEQ ID NO: 107040 - DNA, 20 bp, human
gcccgcgagccgcatccccg

SEQ ID NO: 107041 - DNA, 20 bp, human
gggctcgcgggacaactctt

SEQ ID NO: 107042 - DNA, 20 bp, human
gaccggctaggctggaggaa

SEQ ID NO: 107043 - DNA, 20 bp, human
ggacggtgtcaccccaaacg

SEQ ID NO: 107044 - DNA, 20 bp, human
ggcggcgccgggatgcgggt

SEQ ID NO: 107045 - DNA, 20 bp, human
gcccgggcaaaggcaggctc

SEQ ID NO: 107046 - DNA, 20 bp, human
gcggtcggcgacggtagaac

SEQ ID NO: 107047 - DNA, 20 bp, human
gtgccgggtgatgagatact

SEQ ID NO: 107048 - DNA, 20 bp, human
ggggtgatgagatactcggt

SEQ ID NO: 107049 - DNA, 20 bp, human
gtgagatactcggtcggcga

SEQ ID NO: 107050 - DNA, 20 bp, human
gacccggcagtcccgcccag

SEQ ID NO: 107051 - DNA, 20 bp, human
ggaggtagacagagaagggt

SEQ ID NO: 107052 - DNA, 20 bp, human
gccctcacaggaatgatgct

SEQ ID NO: 107053 - DNA, 20 bp, human
gacctctgggcgggactgcc

SEQ ID NO: 107054 - DNA, 20 bp, human
gattcctgtgagggtcgaaa

SEQ ID NO: 107055 - DNA, 20 bp, human
gcagtgcacacggcttgtca

SEQ ID NO: 107056 - DNA, 20 bp, human
ggcgggtccgaaggaacctg

SEQ ID NO: 107057 - DNA, 20 bp, human
gtgggcggtcggacatccga

SEQ ID NO: 107058 - DNA, 20 bp, human
gagtattcagggcggaccag

SEQ ID NO: 107059 - DNA, 20 bp, human
gcttggaaccccgctagatg

SEQ ID NO: 107060 - DNA, 20 bp, human
gagggatcggcgcctcgtgg

SEQ ID NO: 107061 - DNA, 20 bp, human
gggacaacgggtcccaaggg

SEQ ID NO: 107062 - DNA, 20 bp, human
gtagagggtcagcagctgtc

SEQ ID NO: 107063 - DNA, 20 bp, human
ggccaatgacagaggccgta

SEQ ID NO: 107064 - DNA, 20 bp, human
gagtatagaaaaggactctc

SEQ ID NO: 107065 - DNA, 20 bp, human
gagcgaagcgcagttcctgt

SEQ ID NO: 107066 - DNA, 20 bp, human
gataggacgaagaaaccgaa

SEQ ID NO: 107067 - DNA, 20 bp, human
ggctcaggccagtcccgggg

SEQ ID NO: 107068 - DNA, 20 bp, human
ggccggcagctgaacttact

SEQ ID NO: 107069 - DNA, 20 bp, human
ggcggctcaggccagtcccg

SEQ ID NO: 107070 - DNA, 20 bp, human
gctgcgccccggggcgggaa

SEQ ID NO: 107071 - DNA, 20 bp, human
gaagggagcccgcaggatca

SEQ ID NO: 107072 - DNA, 20 bp, human
gatcaggggtcagagttagg

SEQ ID NO: 107073 - DNA, 20 bp, human
ggacctccgagcctcagcca

SEQ ID NO: 107074 - DNA, 20 bp, human
gaaaggtggccctcgcgcgg

SEQ ID NO: 107075 - DNA, 20 bp, human
gcactcccggccccgaatcg

SEQ ID NO: 107076 - DNA, 20 bp, human
gagcagctggaagtaggaga

SEQ ID NO: 107077 - DNA, 20 bp, human
gagagagagcagctggaagt

SEQ ID NO: 107078 - DNA, 20 bp, human
gctgctctccgacatctgag

SEQ ID NO: 107079 - DNA, 20 bp, human
gtcactgcgtgaggtcgggt

SEQ ID NO: 107080 - DNA, 20 bp, human
gaaagaccagatgtgccccg

SEQ ID NO: 107081 - DNA, 20 bp, human
ggcagtttggtgaacaacag

SEQ ID NO: 107082 - DNA, 20 bp, human
gtgctgacgacgttagggag

SEQ ID NO: 107083 - DNA, 20 bp, human
ggctgtgactaccaagtgct

SEQ ID NO: 107084 - DNA, 20 bp, human
gaaacacggggcaaagcctc

SEQ ID NO: 107085 - DNA, 20 bp, human
gaacgtcgtcagcaagagaa

SEQ ID NO: 107086 - DNA, 20 bp, human
gcggccagcagcacatcctc

SEQ ID NO: 107087 - DNA, 20 bp, human
gtaccggcctccagccgctg

SEQ ID NO: 107088 - DNA, 20 bp, human
ggcagaacgaggagcggcag

SEQ ID NO: 107089 - DNA, 20 bp, human
gctccagccgctggggagtg

SEQ ID NO: 107090 - DNA, 20 bp, human
gtgcgcactgcaggctacgt

SEQ ID NO: 107091 - DNA, 20 bp, human
gggctggaggccggtaccgg

SEQ ID NO: 107092 - DNA, 20 bp, human
gaggagacgcgcttacctgg

SEQ ID NO: 107093 - DNA, 20 bp, human
gggaccctcctggactcgga

SEQ ID NO: 107094 - DNA, 20 bp, human
gggactcggagggcaagtac

SEQ ID NO: 107095 - DNA, 20 bp, human
gcacgggcggccctacctcc

SEQ ID NO: 107096 - DNA, 20 bp, human
ggcagaggcagggaccactc

SEQ ID NO: 107097 - DNA, 20 bp, human
ggccgacaccagaccccgag

SEQ ID NO: 107098 - DNA, 20 bp, human
gaccactcggggtctggtgt

SEQ ID NO: 107099 - DNA, 20 bp, human
ggtagagagccggtgacagt

SEQ ID NO: 107100 - DNA, 20 bp, human
ggacaccccggccaaccccc

SEQ ID NO: 107101 - DNA, 20 bp, human
ggggttggccggggtgtcat

SEQ ID NO: 107102 - DNA, 20 bp, human
ggtgtcggcacagccatggc

SEQ ID NO: 107103 - DNA, 20 bp, human
gtctggtgtcggcacagcca

SEQ ID NO: 107104 - DNA, 20 bp, human
gggaccgccacaccccgaag

SEQ ID NO: 107105 - DNA, 20 bp, human
gccctcgtcgcggactgcac

SEQ ID NO: 107106 - DNA, 20 bp, human
gttcaacacccgagccgcac

SEQ ID NO: 107107 - DNA, 20 bp, human
ggcgcagcgttagatggcgg

SEQ ID NO: 107108 - DNA, 20 bp, human
gcctgcgggccacctaccac

SEQ ID NO: 107109 - DNA, 20 bp, human
gcgccccgcgaaggttgagg

SEQ ID NO: 107110 - DNA, 20 bp, human
ggggctgtggatgcctctag

SEQ ID NO: 107111 - DNA, 20 bp, human
ggcctggagtacccttcccg

SEQ ID NO: 107112 - DNA, 20 bp, human
gctctgacaactgcctctag

SEQ ID NO: 107113 - DNA, 20 bp, human
gcggcttcacttgaagggaa

SEQ ID NO: 107114 - DNA, 20 bp, human
ggcagggaaagccgcgggaa

SEQ ID NO: 107115 - DNA, 20 bp, human
gaggcggacgcgagtcgtcg

SEQ ID NO: 107116 - DNA, 20 bp, human
gtgaaggcccgattcatcag

SEQ ID NO: 107117 - DNA, 20 bp, human
gggcggacggaccgcttaaa

SEQ ID NO: 107118 - DNA, 20 bp, human
gctagcgatctaataaaggt

SEQ ID NO: 107119 - DNA, 20 bp, human
ggtgccagtggggaagtcac

SEQ ID NO: 107120 - DNA, 20 bp, human
gagaagggcggaagtgtctc

SEQ ID NO: 107121 - DNA, 20 bp, human
gcacccggtgacttccccac

SEQ ID NO: 107122 - DNA, 20 bp, human
gcctgctagcgatctaataa

SEQ ID NO: 107123 - DNA, 20 bp, human
ggttggtcgtagcatttctc

SEQ ID NO: 107124 - DNA, 20 bp, human
gttgatcggcgactaagtga

SEQ ID NO: 107125 - DNA, 20 bp, human
gtctcgggctccttagaggg

SEQ ID NO: 107126 - DNA, 20 bp, human
gggcgaggcgaggcatccag

SEQ ID NO: 107127 - DNA, 20 bp, human
gcctccgcggcagccccggt

SEQ ID NO: 107128 - DNA, 20 bp, human
ggccgcacttgcgccgaccg

SEQ ID NO: 107129 - DNA, 20 bp, human
ggccccggtcggcgcaagtg

SEQ ID NO: 107130 - DNA, 20 bp, human
gaagagaagacagtgagcgt

SEQ ID NO: 107131 - DNA, 20 bp, human
gccgccggtcgcaggcgtca

SEQ ID NO: 107132 - DNA, 20 bp, human
gcccccaagcgccgagccca

SEQ ID NO: 107133 - DNA, 20 bp, human
gtatccaccgcggggctggg

SEQ ID NO: 107134 - DNA, 20 bp, human
ggcgaggcatccagaggccc

SEQ ID NO: 107135 - DNA, 20 bp, human
gggagacttgcgagtagcaa

SEQ ID NO: 107136 - DNA, 20 bp, human
gactcaccagccctacacag

SEQ ID NO: 107137 - DNA, 20 bp, human
ggcttgctggccgctgtgta

SEQ ID NO: 107138 - DNA, 20 bp, human
gtctgtgttgatggagtagg

SEQ ID NO: 107139 - DNA, 20 bp, human
gctgtcctggaagtcctacc

SEQ ID NO: 107140 - DNA, 20 bp, human
gtgctgccgctgcccagaag

SEQ ID NO: 107141 - DNA, 20 bp, human
gcggcagcatgggctaaatc

SEQ ID NO: 107142 - DNA, 20 bp, human
gagggccaccatcctcttct

SEQ ID NO: 107143 - DNA, 20 bp, human
ggtggccctgaagttgttca

SEQ ID NO: 107144 - DNA, 20 bp, human
ggctggccgctgtgtagggc

SEQ ID NO: 107145 - DNA, 20 bp, human
gagttctgtgttgatggagt

SEQ ID NO: 107146 - DNA, 20 bp, human
gtgggactcggaccccggcg

SEQ ID NO: 107147 - DNA, 20 bp, human
gcgaccacggaagcacccct

SEQ ID NO: 107148 - DNA, 20 bp, human
gcggcctggcagcacccgga

SEQ ID NO: 107149 - DNA, 20 bp, human
gcgctccgccccggtcctag

SEQ ID NO: 107150 - DNA, 20 bp, human
gcttcgtgggactcggaccc

SEQ ID NO: 107151 - DNA, 20 bp, human
ggctcgggccggggcttcgt

SEQ ID NO: 107152 - DNA, 20 bp, human
gtcccatgccaggaggactt

SEQ ID NO: 107153 - DNA, 20 bp, human
gacctaagtcctcctggcat

SEQ ID NO: 107154 - DNA, 20 bp, human
gactgccagtcggcctggaa

SEQ ID NO: 107155 - DNA, 20 bp, human
ggctctgccccgaaccctcg

SEQ ID NO: 107156 - DNA, 20 bp, human
gtctgtgtgtagagggatgg

SEQ ID NO: 107157 - DNA, 20 bp, human
ggccgcaggtctggcgtcga

SEQ ID NO: 107158 - DNA, 20 bp, human
gccctctacacacagactgt

SEQ ID NO: 107159 - DNA, 20 bp, human
gacacctagaagcttccctt

SEQ ID NO: 107160 - DNA, 20 bp, human
gagtcggcaaagccacgggt

SEQ ID NO: 107161 - DNA, 20 bp, human
gaagcactcgggccgacccg

SEQ ID NO: 107162 - DNA, 20 bp, human
gttgagagcacataggagga

SEQ ID NO: 107163 - DNA, 20 bp, human
gagcggtgtctgacggaagt

SEQ ID NO: 107164 - DNA, 20 bp, human
gagccatggcgccgcaggtc

SEQ ID NO: 107165 - DNA, 20 bp, human
ggaagaagcttagtcatggg

SEQ ID NO: 107166 - DNA, 20 bp, human
ggaggctcgcggccggagtg

SEQ ID NO: 107167 - DNA, 20 bp, human
gggcggccgagcgaaagaca

SEQ ID NO: 107168 - DNA, 20 bp, human
gcgctgggcggaagctacca

SEQ ID NO: 107169 - DNA, 20 bp, human
gacgcggctccgcgcatgtg

SEQ ID NO: 107170 - DNA, 20 bp, human
ggcatgtgcggtgaggctcg

SEQ ID NO: 107171 - DNA, 20 bp, human
ggtgcccctaccgcccggag

SEQ ID NO: 107172 - DNA, 20 bp, human
gtccgcccagcgccgcactc

SEQ ID NO: 107173 - DNA, 20 bp, human
ggcgccactccgggcggtag

SEQ ID NO: 107174 - DNA, 20 bp, human
ggtgcggtgaggctcgcggc

SEQ ID NO: 107175 - DNA, 20 bp, human
gacgctgagagcgccactcc

SEQ ID NO: 107176 - DNA, 20 bp, human
gggccgagcgcggaacgcga

SEQ ID NO: 107177 - DNA, 20 bp, human
gggcagacccaaaacaggag

SEQ ID NO: 107178 - DNA, 20 bp, human
gcgcgagctggaaacagcac

SEQ ID NO: 107179 - DNA, 20 bp, human
gagacccaaaacaggagcgg

SEQ ID NO: 107180 - DNA, 20 bp, human
ggcacgggcagacccaaaac

SEQ ID NO: 107181 - DNA, 20 bp, human
gctggacatgaagaccgagg

SEQ ID NO: 107182 - DNA, 20 bp, human
gtgcaagcacgcgaaatcgt

SEQ ID NO: 107183 - DNA, 20 bp, human
gaccgagggggtatgtggag

SEQ ID NO: 107184 - DNA, 20 bp, human
gtgaagaccgagggggtatg

SEQ ID NO: 107185 - DNA, 20 bp, human
gatcctggacatgaagaccg

SEQ ID NO: 107186 - DNA, 20 bp, human
gcactgtcatcctctggaaa

SEQ ID NO: 107187 - DNA, 20 bp, human
gaatgattctccctttccag

SEQ ID NO: 107188 - DNA, 20 bp, human
gtccagaggatgacagtgaa

SEQ ID NO: 107189 - DNA, 20 bp, human
ggaagccaaagaagaactaa

SEQ ID NO: 107190 - DNA, 20 bp, human
gaagtgcaagagagagagca

SEQ ID NO: 107191 - DNA, 20 bp, human
ggcccttcactgtcatcctc

SEQ ID NO: 107192 - DNA, 20 bp, human
gccagacctggagagctcct

SEQ ID NO: 107193 - DNA, 20 bp, human
ggacaagtccaaaccagacc

SEQ ID NO: 107194 - DNA, 20 bp, human
gcttgattcagattccacct

SEQ ID NO: 107195 - DNA, 20 bp, human
ggactcctttagttcttctt

SEQ ID NO: 107196 - DNA, 20 bp, human
ggcttgcatgaccctgacat

SEQ ID NO: 107197 - DNA, 20 bp, human
gctgacatcggcagcgggag

SEQ ID NO: 107198 - DNA, 20 bp, human
gtaagctacggaaagcaggg

SEQ ID NO: 107199 - DNA, 20 bp, human
ggcggctatcgggtcaaagt

SEQ ID NO: 107200 - DNA, 20 bp, human
gctcgggtaacggtcgcgag

SEQ ID NO: 107201 - DNA, 20 bp, human
gatgaccctgacatcggcag

SEQ ID NO: 107202 - DNA, 20 bp, human
gccgcgcgagtgtcactcaa

SEQ ID NO: 107203 - DNA, 20 bp, human
gacgccgaagggctccgagg

SEQ ID NO: 107204 - DNA, 20 bp, human
ggctcacagtcagcccgcaa

SEQ ID NO: 107205 - DNA, 20 bp, human
gcgcgcgctccctcgggtaa

SEQ ID NO: 107206 - DNA, 20 bp, human
gcagccaatggctcacctcg

SEQ ID NO: 107207 - DNA, 20 bp, human
gtcgccgacaccccagccaa

SEQ ID NO: 107208 - DNA, 20 bp, human
ggcagaaggtacctatccca

SEQ ID NO: 107209 - DNA, 20 bp, human
gcctagtgtcccgggaaacc

SEQ ID NO: 107210 - DNA, 20 bp, human
ggctccgcgaggtgagccat

SEQ ID NO: 107211 - DNA, 20 bp, human
gttcccgggacactagggtg

SEQ ID NO: 107212 - DNA, 20 bp, human
gaggcatacgtgcttaatcc

SEQ ID NO: 107213 - DNA, 20 bp, human
gctggggacagagtcaaata

SEQ ID NO: 107214 - DNA, 20 bp, human
gcacggcacgacgtctagaa

SEQ ID NO: 107215 - DNA, 20 bp, human
gaatactaggggcacagaca

SEQ ID NO: 107216 - DNA, 20 bp, human
ggttttgaggggccaggagg

SEQ ID NO: 107217 - DNA, 20 bp, human
gtccagcacctaccgcgggt

SEQ ID NO: 107218 - DNA, 20 bp, human
ggtgcagggacagatacatg

SEQ ID NO: 107219 - DNA, 20 bp, human
gtaaggcaggcacacagtgg

SEQ ID NO: 107220 - DNA, 20 bp, human
gagcttcctgaagggaggat

SEQ ID NO: 107221 - DNA, 20 bp, human
gggcccagcttcctgaaggg

SEQ ID NO: 107222 - DNA, 20 bp, human
ggctgctgtatgcctacccg

SEQ ID NO: 107223 - DNA, 20 bp, human
ggcggagaagatgccctcct

SEQ ID NO: 107224 - DNA, 20 bp, human
gctgaagggaggatgggcta

SEQ ID NO: 107225 - DNA, 20 bp, human
gttcagagtggtcctcggac

SEQ ID NO: 107226 - DNA, 20 bp, human
gcagttccggtgggagaacg

SEQ ID NO: 107227 - DNA, 20 bp, human
gagtctgtcggtcagaccaa

SEQ ID NO: 107228 - DNA, 20 bp, human
ggcaattcggctactcccca

SEQ ID NO: 107229 - DNA, 20 bp, human
gctccacccggaccagggta

SEQ ID NO: 107230 - DNA, 20 bp, human
gcggttgatacagttccggt

SEQ ID NO: 107231 - DNA, 20 bp, human
ggaccagggtaaggaggagt

SEQ ID NO: 107232 - DNA, 20 bp, human
gtcccgtacggcctagaccg

SEQ ID NO: 107233 - DNA, 20 bp, human
gtagaccggggcccgtacgg

SEQ ID NO: 107234 - DNA, 20 bp, human
gcacccggaccagggtaagg

SEQ ID NO: 107235 - DNA, 20 bp, human
ggcctagaccggggcccgta

SEQ ID NO: 107236 - DNA, 20 bp, human
gagccgcgatgggacgaggg

SEQ ID NO: 107237 - DNA, 20 bp, human
gtacggcgggcccagcgggg

SEQ ID NO: 107238 - DNA, 20 bp, human
gcgcccggagctctagactc

SEQ ID NO: 107239 - DNA, 20 bp, human
gagccggagtctagagctcc

SEQ ID NO: 107240 - DNA, 20 bp, human
ggcggccatggcaggtacgg

SEQ ID NO: 107241 - DNA, 20 bp, human
ggtgctgtccatctactacc

SEQ ID NO: 107242 - DNA, 20 bp, human
ggtgctcaccaggtagtaga

SEQ ID NO: 107243 - DNA, 20 bp, human
gtagtagatggacagcaccc

SEQ ID NO: 107244 - DNA, 20 bp, human
gtcgcggctcgggcaggaag

SEQ ID NO: 107245 - DNA, 20 bp, human
gccgagccgcgatgggacga

SEQ ID NO: 107246 - DNA, 20 bp, human
gaggcctgctctgagaaaag

SEQ ID NO: 107247 - DNA, 20 bp, human
gagctctggggcctgatagg

SEQ ID NO: 107248 - DNA, 20 bp, human
gatggccaggagccctgcta

SEQ ID NO: 107249 - DNA, 20 bp, human
gaatatcaggtgagctgtgg

SEQ ID NO: 107250 - DNA, 20 bp, human
ggtgagcccctccctcaagg

SEQ ID NO: 107251 - DNA, 20 bp, human
gtgggccccaaccccctatc

SEQ ID NO: 107252 - DNA, 20 bp, human
gcctggagcagcaccttcag

SEQ ID NO: 107253 - DNA, 20 bp, human
gctacaaggagcggcgggaa

SEQ ID NO: 107254 - DNA, 20 bp, human
ggccagacctccttgaggga

SEQ ID NO: 107255 - DNA, 20 bp, human
gaagaggagctgacaatatc

SEQ ID NO: 107256 - DNA, 20 bp, human
gggcagcgctgggaatgaca

SEQ ID NO: 107257 - DNA, 20 bp, human
gtggacagtgcgcttattaa

SEQ ID NO: 107258 - DNA, 20 bp, human
gcaactggaaggactgctgg

SEQ ID NO: 107259 - DNA, 20 bp, human
ggcggagaaggcgggagacg

SEQ ID NO: 107260 - DNA, 20 bp, human
gcagcagcccggtacgaacc

SEQ ID NO: 107261 - DNA, 20 bp, human
gcgcaagacagggcagcgct

SEQ ID NO: 107262 - DNA, 20 bp, human
ggcgcggccgggttcgtacc

SEQ ID NO: 107263 - DNA, 20 bp, human
gcgggccccgctagtcccaa

SEQ ID NO: 107264 - DNA, 20 bp, human
gtgcggggctgcggagaagg

SEQ ID NO: 107265 - DNA, 20 bp, human
gtgaccctcaaggcgagcga

SEQ ID NO: 107266 - DNA, 20 bp, human
gggcgcaggtaggcgtcccc

SEQ ID NO: 107267 - DNA, 20 bp, human
gggaagcccctagctccggg

SEQ ID NO: 107268 - DNA, 20 bp, human
gccgggaagcccctagctcc

SEQ ID NO: 107269 - DNA, 20 bp, human
gctggagccgcccggagcta

SEQ ID NO: 107270 - DNA, 20 bp, human
ggggttggggagcgagacag

SEQ ID NO: 107271 - DNA, 20 bp, human
ggtgctgttagcgcttccgg

SEQ ID NO: 107272 - DNA, 20 bp, human
gggcttcccggggcgcaggt

SEQ ID NO: 107273 - DNA, 20 bp, human
gccactgggaagggttaggg

SEQ ID NO: 107274 - DNA, 20 bp, human
gggaggccgcgcagataccg

SEQ ID NO: 107275 - DNA, 20 bp, human
gggaggccggcacaactcgg

SEQ ID NO: 107276 - DNA, 20 bp, human
ggttcgcggagcacacatcc

SEQ ID NO: 107277 - DNA, 20 bp, human
gcatcccggcgcgacgaggt

SEQ ID NO: 107278 - DNA, 20 bp, human
gagcagcccgagggtgagtc

SEQ ID NO: 107279 - DNA, 20 bp, human
gccacgccggactcaccctc

SEQ ID NO: 107280 - DNA, 20 bp, human
gcaggctctgggcactcgcg

SEQ ID NO: 107281 - DNA, 20 bp, human
gcacacatcccggcgcgacg

SEQ ID NO: 107282 - DNA, 20 bp, human
gcccggcgcgacgaggtagg

SEQ ID NO: 107283 - DNA, 20 bp, human
gtccgggaaggcggagccag

SEQ ID NO: 107284 - DNA, 20 bp, human
gctcgcgcggctcccgttcg

SEQ ID NO: 107285 - DNA, 20 bp, human
gcgctctccgaaggaacctg

SEQ ID NO: 107286 - DNA, 20 bp, human
gcaagcatagtaagggtagg

SEQ ID NO: 107287 - DNA, 20 bp, human
gtcttgcaggtaagagacct

SEQ ID NO: 107288 - DNA, 20 bp, human
gtgaaaaacaagcatagtaa

SEQ ID NO: 107289 - DNA, 20 bp, human
gccggactgagtacacagaa

SEQ ID NO: 107290 - DNA, 20 bp, human
gaaacaagcatagtaagggt

SEQ ID NO: 107291 - DNA, 20 bp, human
gcaacagcatttggacccag

SEQ ID NO: 107292 - DNA, 20 bp, human
gaaggctgatacctccctca

SEQ ID NO: 107293 - DNA, 20 bp, human
gtccagacaaaagctttagt

SEQ ID NO: 107294 - DNA, 20 bp, human
gtggtacagaagtcatggaa

SEQ ID NO: 107295 - DNA, 20 bp, human
gagctttagtaggatactag

SEQ ID NO: 107296 - DNA, 20 bp, human
gctcggagagagggcgcagg

SEQ ID NO: 107297 - DNA, 20 bp, human
gtgcagaagcgacagccctc

SEQ ID NO: 107298 - DNA, 20 bp, human
gagaagcgacagccctccgg

SEQ ID NO: 107299 - DNA, 20 bp, human
gcgtcgcgacctcggagaga

SEQ ID NO: 107300 - DNA, 20 bp, human
gcagtgcgtaggagcggccg

SEQ ID NO: 107301 - DNA, 20 bp, human
ggcgttgctccgagggacaa

SEQ ID NO: 107302 - DNA, 20 bp, human
ggcgacgcgcgggactctcc

SEQ ID NO: 107303 - DNA, 20 bp, human
ggaggtaagaggcggatcgg

SEQ ID NO: 107304 - DNA, 20 bp, human
ggccgaggcgtggaggtaag

SEQ ID NO: 107305 - DNA, 20 bp, human
ggcggggactaaggattctg

SEQ ID NO: 107306 - DNA, 20 bp, human
ggggggtccagttaactcac

SEQ ID NO: 107307 - DNA, 20 bp, human
gggcgcgaccgttacccgag

SEQ ID NO: 107308 - DNA, 20 bp, human
gcagccgcccgcagccagag

SEQ ID NO: 107309 - DNA, 20 bp, human
gtgcagatggggctgctcgg

SEQ ID NO: 107310 - DNA, 20 bp, human
ggagcggcggcaagcagcat

SEQ ID NO: 107311 - DNA, 20 bp, human
gcccggcgcggccccgactg

SEQ ID NO: 107312 - DNA, 20 bp, human
ggaagcccaggtgccgaggg

SEQ ID NO: 107313 - DNA, 20 bp, human
gagccccatctgcaaactcg

SEQ ID NO: 107314 - DNA, 20 bp, human
gctgcctctctggctgcggg

SEQ ID NO: 107315 - DNA, 20 bp, human
ggcggccctagccccagtcg

SEQ ID NO: 107316 - DNA, 20 bp, human
gtccgacaggcgctccccag

SEQ ID NO: 107317 - DNA, 20 bp, human
gcagagcggggagaaccgac

SEQ ID NO: 107318 - DNA, 20 bp, human
ggagtcccgcgcgtcaacag

SEQ ID NO: 107319 - DNA, 20 bp, human
ggcagaacgcacgagcccag

SEQ ID NO: 107320 - DNA, 20 bp, human
ggcgggaccctgaggacccc

SEQ ID NO: 107321 - DNA, 20 bp, human
gagcggggagaaccgacagg

SEQ ID NO: 107322 - DNA, 20 bp, human
gacaggtggaggaaaaactg

SEQ ID NO: 107323 - DNA, 20 bp, human
gggctcccgattgtcctctg

SEQ ID NO: 107324 - DNA, 20 bp, human
gagcgggctcggcaccgccg

SEQ ID NO: 107325 - DNA, 20 bp, human
gcgggggccgggctcccact

SEQ ID NO: 107326 - DNA, 20 bp, human
gtaccgcggaaacaggaagt

SEQ ID NO: 107327 - DNA, 20 bp, human
ggggtggcttcggtggccga

SEQ ID NO: 107328 - DNA, 20 bp, human
gcggctccggctgcagttcc

SEQ ID NO: 107329 - DNA, 20 bp, human
gcccctgcaaagtaatacat

SEQ ID NO: 107330 - DNA, 20 bp, human
gcggaaacaggaagttggct

SEQ ID NO: 107331 - DNA, 20 bp, human
gtaggattgcaagttaacct

SEQ ID NO: 107332 - DNA, 20 bp, human
gcgcgcgctaccgcggaaac

SEQ ID NO: 107333 - DNA, 20 bp, human
gacaggcccgcgcgctaccg

SEQ ID NO: 107334 - DNA, 20 bp, human
gcttgcaatcctaacacgga

SEQ ID NO: 107335 - DNA, 20 bp, human
gagtttaaatgttgtcacac

SEQ ID NO: 107336 - DNA, 20 bp, human
gcagcagcgcgcaccgaggg

SEQ ID NO: 107337 - DNA, 20 bp, human
ggccccgggctcctcttcgg

SEQ ID NO: 107338 - DNA, 20 bp, human
ggtaggctctctacaagcgg

SEQ ID NO: 107339 - DNA, 20 bp, human
ggagcagcagcgcgcaccga

SEQ ID NO: 107340 - DNA, 20 bp, human
ggaggagcccggggccaggt

SEQ ID NO: 107341 - DNA, 20 bp, human
ggcccgcctccggtcctacc

SEQ ID NO: 107342 - DNA, 20 bp, human
gggccaggtaggaccggagg

SEQ ID NO: 107343 - DNA, 20 bp, human
gcgcgtccgaggctgcaagt

SEQ ID NO: 107344 - DNA, 20 bp, human
gctgctggcggagtagctgg

SEQ ID NO: 107345 - DNA, 20 bp, human
gagcagcgactggcgagcaa

SEQ ID NO: 107346 - DNA, 20 bp, human
gctcgcacgcgcctctgaca

SEQ ID NO: 107347 - DNA, 20 bp, human
gagcgagcggtgcagtgaca

SEQ ID NO: 107348 - DNA, 20 bp, human
ggtgccgagcactagaggaa

SEQ ID NO: 107349 - DNA, 20 bp, human
ggcccggtgccgagcactag

SEQ ID NO: 107350 - DNA, 20 bp, human
ggagggcgcggcgagccgga

SEQ ID NO: 107351 - DNA, 20 bp, human
ggcaccgctcgctctccctc

SEQ ID NO: 107352 - DNA, 20 bp, human
gccgctcgtgcggatgtcag

SEQ ID NO: 107353 - DNA, 20 bp, human
gtaatccgccccgggaaggg

SEQ ID NO: 107354 - DNA, 20 bp, human
gaggagagggagcgagggcg

SEQ ID NO: 107355 - DNA, 20 bp, human
gacccgagcagcctcgatct

SEQ ID NO: 107356 - DNA, 20 bp, human
gagcgcctcacgcactacgg

SEQ ID NO: 107357 - DNA, 20 bp, human
gcggccgctgcaaatgggac

SEQ ID NO: 107358 - DNA, 20 bp, human
gccccgcggccgctgcaaat

SEQ ID NO: 107359 - DNA, 20 bp, human
gcggagcgcctcacgcacta

SEQ ID NO: 107360 - DNA, 20 bp, human
gcccgcccccgtagtgcgtg

SEQ ID NO: 107361 - DNA, 20 bp, human
ggcctcacgcactacggggg

SEQ ID NO: 107362 - DNA, 20 bp, human
gagcgaaccgcccgccggga

SEQ ID NO: 107363 - DNA, 20 bp, human
gcgccgcgggcccatggacg

SEQ ID NO: 107364 - DNA, 20 bp, human
gggccgcgtccatgggcccg

SEQ ID NO: 107365 - DNA, 20 bp, human
ggctccggtcccatttgcag

SEQ ID NO: 107366 - DNA, 20 bp, human
gcgagaccccgctgacccag

SEQ ID NO: 107367 - DNA, 20 bp, human
gcaacctgcagcggaccaaa

SEQ ID NO: 107368 - DNA, 20 bp, human
gcacgccgcggcagttaccc

SEQ ID NO: 107369 - DNA, 20 bp, human
ggacctggtggcaccagaga

SEQ ID NO: 107370 - DNA, 20 bp, human
gctggtggcaccagagaggg

SEQ ID NO: 107371 - DNA, 20 bp, human
ggtggcaccagagagggcgg

SEQ ID NO: 107372 - DNA, 20 bp, human
gaaggcaagccgccacgccg

SEQ ID NO: 107373 - DNA, 20 bp, human
gctcccgcgcgggacctggg

SEQ ID NO: 107374 - DNA, 20 bp, human
ggtccgctgcaggttggtgg

SEQ ID NO: 107375 - DNA, 20 bp, human
gcggcttcctggctccgcca

SEQ ID NO: 107376 - DNA, 20 bp, human
gcccgtcactgcccggatat

SEQ ID NO: 107377 - DNA, 20 bp, human
gctccagattcagacttggt

SEQ ID NO: 107378 - DNA, 20 bp, human
ggtgagtggcgggtgatctg

SEQ ID NO: 107379 - DNA, 20 bp, human
gctaggccagcctgtcacgt

SEQ ID NO: 107380 - DNA, 20 bp, human
ggccagcctgtcacgtggga

SEQ ID NO: 107381 - DNA, 20 bp, human
ggagtcgccttagacaattg

SEQ ID NO: 107382 - DNA, 20 bp, human
gtaggacttgagtgggacca

SEQ ID NO: 107383 - DNA, 20 bp, human
gggagggaggctcggcgctc

SEQ ID NO: 107384 - DNA, 20 bp, human
ggaaggggcgggacttgtgg

SEQ ID NO: 107385 - DNA, 20 bp, human
ggtgggcacaagggaatgtc

SEQ ID NO: 107386 - DNA, 20 bp, human
gcggggacgcgctgcaacag

SEQ ID NO: 107387 - DNA, 20 bp, human
gggcccctcaccgacataga

SEQ ID NO: 107388 - DNA, 20 bp, human
gcggtctcggccttctatgt

SEQ ID NO: 107389 - DNA, 20 bp, human
gtcgctccggagcttctgga

SEQ ID NO: 107390 - DNA, 20 bp, human
ggagccgtaaagcagcacgt

SEQ ID NO: 107391 - DNA, 20 bp, human
gtcctgacctggtggacctc

SEQ ID NO: 107392 - DNA, 20 bp, human
ggccagaggtccaccaggtc

SEQ ID NO: 107393 - DNA, 20 bp, human
gcctccagtcccccaatact

SEQ ID NO: 107394 - DNA, 20 bp, human
gacttggccagcagggcgtg

SEQ ID NO: 107395 - DNA, 20 bp, human
ggtgggtcgctcaatcgctc

SEQ ID NO: 107396 - DNA, 20 bp, human
gctgccccgcggataacagg

SEQ ID NO: 107397 - DNA, 20 bp, human
gcggcgcggcgaaagcagag

SEQ ID NO: 107398 - DNA, 20 bp, human
gccaggaggcgcggctccag

SEQ ID NO: 107399 - DNA, 20 bp, human
gtccagaggctcctgggtag

SEQ ID NO: 107400 - DNA, 20 bp, human
gaagctgccccgcggataac

SEQ ID NO: 107401 - DNA, 20 bp, human
gttgtagtggaagaatgcac

SEQ ID NO: 107402 - DNA, 20 bp, human
gctcctggtggggcttgtag

SEQ ID NO: 107403 - DNA, 20 bp, human
gaggtctctgcccactaccc

SEQ ID NO: 107404 - DNA, 20 bp, human
gggagccgcgcctcctggtg

SEQ ID NO: 107405 - DNA, 20 bp, human
gacagtgactcgcgactggt

SEQ ID NO: 107406 - DNA, 20 bp, human
ggccccaggagccatagctg

SEQ ID NO: 107407 - DNA, 20 bp, human
gaggggcccggagcatctgt

SEQ ID NO: 107408 - DNA, 20 bp, human
gggaccaggaactgaacggg

SEQ ID NO: 107409 - DNA, 20 bp, human
gctgtggggttgagaaagtg

SEQ ID NO: 107410 - DNA, 20 bp, human
gcaagactcccagagtagag

SEQ ID NO: 107411 - DNA, 20 bp, human
gtgccccagctatggctcct

SEQ ID NO: 107412 - DNA, 20 bp, human
ggttgagaaagtgggggacc

SEQ ID NO: 107413 - DNA, 20 bp, human
ggaaccccccgttcagttcc

SEQ ID NO: 107414 - DNA, 20 bp, human
gctcaaccccacagatgctc

SEQ ID NO: 107415 - DNA, 20 bp, human
gtctgggagtcttgggactc

SEQ ID NO: 107416 - DNA, 20 bp, human
ggagtccgccaaaggcccaa

SEQ ID NO: 107417 - DNA, 20 bp, human
gatcgagatggagctacgaa

SEQ ID NO: 107418 - DNA, 20 bp, human
ggaagaggaagctgtgtccg

SEQ ID NO: 107419 - DNA, 20 bp, human
gtaggggtggagtccgccaa

SEQ ID NO: 107420 - DNA, 20 bp, human
gagctgtgtccgcggtgcaa

SEQ ID NO: 107421 - DNA, 20 bp, human
gaaggtgatggtcatcgaga

SEQ ID NO: 107422 - DNA, 20 bp, human
ggccgccgggcagcagtgag

SEQ ID NO: 107423 - DNA, 20 bp, human
gtcgcaaggataagaaatag

SEQ ID NO: 107424 - DNA, 20 bp, human
gctctcttcttgcagtgcta

SEQ ID NO: 107425 - DNA, 20 bp, human
gtgacagcaggccggagctc

SEQ ID NO: 107426 - DNA, 20 bp, human
gcgcggctgggaccggagtg

SEQ ID NO: 107427 - DNA, 20 bp, human
gggaggcccgcgttccccat

SEQ ID NO: 107428 - DNA, 20 bp, human
gggagagccgcggctgggac

SEQ ID NO: 107429 - DNA, 20 bp, human
ggcgcactgagagccgaggt

SEQ ID NO: 107430 - DNA, 20 bp, human
gggacagcgagggccggagt

SEQ ID NO: 107431 - DNA, 20 bp, human
ggcgcggcctgcgctctctg

SEQ ID NO: 107432 - DNA, 20 bp, human
gagtggggagcgcggcgtgg

SEQ ID NO: 107433 - DNA, 20 bp, human
ggagctggagagccgcggct

SEQ ID NO: 107434 - DNA, 20 bp, human
gccttcccggccagtcgcgg

SEQ ID NO: 107435 - DNA, 20 bp, human
ggtgcgggcaggccaatgag

SEQ ID NO: 107436 - DNA, 20 bp, human
gctgccaaggccactccggg

SEQ ID NO: 107437 - DNA, 20 bp, human
gcaccctgccaaggccactc

SEQ ID NO: 107438 - DNA, 20 bp, human
gagtgattcaggcacagaga

SEQ ID NO: 107439 - DNA, 20 bp, human
gaagtcctgccagcagtggg

SEQ ID NO: 107440 - DNA, 20 bp, human
gtcctctctctgggaaaacg

SEQ ID NO: 107441 - DNA, 20 bp, human
gaccgcgttttcccagagag

SEQ ID NO: 107442 - DNA, 20 bp, human
gtggccccagagaccggacg

SEQ ID NO: 107443 - DNA, 20 bp, human
gaccggacggggcagaccga

SEQ ID NO: 107444 - DNA, 20 bp, human
ggtgcttgctcctcccggag

SEQ ID NO: 107445 - DNA, 20 bp, human
gtccttggcatacagctcac

SEQ ID NO: 107446 - DNA, 20 bp, human
ggaacaggacgcccagcaga

SEQ ID NO: 107447 - DNA, 20 bp, human
gcagctcccggtaacgacac

SEQ ID NO: 107448 - DNA, 20 bp, human
gttaccgggagctgtaaaca

SEQ ID NO: 107449 - DNA, 20 bp, human
gtacagcgcccaaacgacag

SEQ ID NO: 107450 - DNA, 20 bp, human
gccttcccagagctatgcgg

SEQ ID NO: 107451 - DNA, 20 bp, human
gttctggagacccccctacc

SEQ ID NO: 107452 - DNA, 20 bp, human
gatggaaccacaaagagctc

SEQ ID NO: 107453 - DNA, 20 bp, human
ggtaacgacacaggtaacac

SEQ ID NO: 107454 - DNA, 20 bp, human
gagctcccaaagctcaggaa

SEQ ID NO: 107455 - DNA, 20 bp, human
gcaaagagctctggctttgg

SEQ ID NO: 107456 - DNA, 20 bp, human
gggaaagagaaggactatgg

SEQ ID NO: 107457 - DNA, 20 bp, human
gcccggaaagagaaggacta

SEQ ID NO: 107458 - DNA, 20 bp, human
ggatgtagtcagagtttcag

SEQ ID NO: 107459 - DNA, 20 bp, human
gaggactatgggggaactga

SEQ ID NO: 107460 - DNA, 20 bp, human
gactctggaagttagaaaag

SEQ ID NO: 107461 - DNA, 20 bp, human
ggggtgctagagtagcaggg

SEQ ID NO: 107462 - DNA, 20 bp, human
gtgaaaaatatagaagccag

SEQ ID NO: 107463 - DNA, 20 bp, human
gttaggagagaagaggacgt

SEQ ID NO: 107464 - DNA, 20 bp, human
gagaggacgtgggatactca

SEQ ID NO: 107465 - DNA, 20 bp, human
gcacaatgatgagaggtaac

SEQ ID NO: 107466 - DNA, 20 bp, human
gaagccggtcagacagaggc

SEQ ID NO: 107467 - DNA, 20 bp, human
gagggaagccggtcagacag

SEQ ID NO: 107468 - DNA, 20 bp, human
gaatgaggtccagatagtcc

SEQ ID NO: 107469 - DNA, 20 bp, human
gtagctgtagtatggggcag

SEQ ID NO: 107470 - DNA, 20 bp, human
gtaactccggtagacatcat

SEQ ID NO: 107471 - DNA, 20 bp, human
gacttgacccagggcagtcg

SEQ ID NO: 107472 - DNA, 20 bp, human
ggcagaggcgttggtcccgt

SEQ ID NO: 107473 - DNA, 20 bp, human
gtagtatggggcagaggcgt

SEQ ID NO: 107474 - DNA, 20 bp, human
gctgcccagtgccacagaca

SEQ ID NO: 107475 - DNA, 20 bp, human
gggccggggcccaaatgact

SEQ ID NO: 107476 - DNA, 20 bp, human
gcgagtagctcctagatccg

SEQ ID NO: 107477 - DNA, 20 bp, human
gagctcctagatccgaggtg

SEQ ID NO: 107478 - DNA, 20 bp, human
gcgccgcctcccaccgccca

SEQ ID NO: 107479 - DNA, 20 bp, human
ggcgtccacacgcacatcag

SEQ ID NO: 107480 - DNA, 20 bp, human
gtcctagatccgaggtgcgg

SEQ ID NO: 107481 - DNA, 20 bp, human
gcgtccgaaaagcctggaag

SEQ ID NO: 107482 - DNA, 20 bp, human
gtccgccgcacctcggatct

SEQ ID NO: 107483 - DNA, 20 bp, human
ggagctactcgcccggccct

SEQ ID NO: 107484 - DNA, 20 bp, human
ggcgcgtgcagctttggtca

SEQ ID NO: 107485 - DNA, 20 bp, human
ggagccaggagccggaacca

SEQ ID NO: 107486 - DNA, 20 bp, human
gtggcggcgcggtcgcttta

SEQ ID NO: 107487 - DNA, 20 bp, human
gaacccggtggatagatggg

SEQ ID NO: 107488 - DNA, 20 bp, human
ggagaacccggtggatagat

SEQ ID NO: 107489 - DNA, 20 bp, human
gcccgcggccgccggactga

SEQ ID NO: 107490 - DNA, 20 bp, human
ggccacgaccaagaccccag

SEQ ID NO: 107491 - DNA, 20 bp, human
gaccggcgcaggctaggagg

SEQ ID NO: 107492 - DNA, 20 bp, human
gcggcgcggtcgctttaagg

SEQ ID NO: 107493 - DNA, 20 bp, human
gcgcgacgctgcctcctcac

SEQ ID NO: 107494 - DNA, 20 bp, human
ggagcgcgcggtgagtggtc

SEQ ID NO: 107495 - DNA, 20 bp, human
ggggcggggacggaccggag

SEQ ID NO: 107496 - DNA, 20 bp, human
gcttctcctgatggacagga

SEQ ID NO: 107497 - DNA, 20 bp, human
gaggacactgaaggtctgta

SEQ ID NO: 107498 - DNA, 20 bp, human
ggaacttggattaggtggag

SEQ ID NO: 107499 - DNA, 20 bp, human
ggaagtcaggaggacactga

SEQ ID NO: 107500 - DNA, 20 bp, human
gagcgatgagagaagtcagg

SEQ ID NO: 107501 - DNA, 20 bp, human
gaggcaaaaaccaggagcag

SEQ ID NO: 107502 - DNA, 20 bp, human
gtaggtggagaggcagttgg

SEQ ID NO: 107503 - DNA, 20 bp, human
gacgagcgatgagagaagtc

SEQ ID NO: 107504 - DNA, 20 bp, human
gtctgggaacttggattagg

SEQ ID NO: 107505 - DNA, 20 bp, human
ggtctgtagggttcccggca

SEQ ID NO: 107506 - DNA, 20 bp, human
gacgcgctgtggcagccccg

SEQ ID NO: 107507 - DNA, 20 bp, human
gggagcgcgcctagaggtgg

SEQ ID NO: 107508 - DNA, 20 bp, human
gggaggagcgcgcctagagg

SEQ ID NO: 107509 - DNA, 20 bp, human
gtcgcgtcctcctccgggtc

SEQ ID NO: 107510 - DNA, 20 bp, human
gtcacttcgtcccgacccgg

SEQ ID NO: 107511 - DNA, 20 bp, human
gcttcgtcccgacccggagg

SEQ ID NO: 107512 - DNA, 20 bp, human
ggaggacgcgagccccttgc

SEQ ID NO: 107513 - DNA, 20 bp, human
gctgtgatgaccgcccgcaa

SEQ ID NO: 107514 - DNA, 20 bp, human
gggcagcgccttacccggga

SEQ ID NO: 107515 - DNA, 20 bp, human
ggacgaagtgatgcctcccg

SEQ ID NO: 107516 - DNA, 20 bp, human
gtgaattccgcgggagagaa

SEQ ID NO: 107517 - DNA, 20 bp, human
gcgggaagagcgggccgagt

SEQ ID NO: 107518 - DNA, 20 bp, human
gacaaacacgtggtctgcgg

SEQ ID NO: 107519 - DNA, 20 bp, human
ggccgtaaacctgaattccg

SEQ ID NO: 107520 - DNA, 20 bp, human
gccgtgaaaagaaaacaaca

SEQ ID NO: 107521 - DNA, 20 bp, human
gcggacgccgttctctcccg

SEQ ID NO: 107522 - DNA, 20 bp, human
gcgaggttccagttaactct

SEQ ID NO: 107523 - DNA, 20 bp, human
ggcggaagcccagagttaac

SEQ ID NO: 107524 - DNA, 20 bp, human
gtgaagtgtcgcgagagaaa

SEQ ID NO: 107525 - DNA, 20 bp, human
gctgattccgaggttccctg

SEQ ID NO: 107526 - DNA, 20 bp, human
gttgctggaagggcacgcgg

SEQ ID NO: 107527 - DNA, 20 bp, human
gcatcccataaggaaccaag

SEQ ID NO: 107528 - DNA, 20 bp, human
gggagagcgagggcccccac

SEQ ID NO: 107529 - DNA, 20 bp, human
gggcgcacccacctgacgag

SEQ ID NO: 107530 - DNA, 20 bp, human
gccaaacaaaacgcaaggag

SEQ ID NO: 107531 - DNA, 20 bp, human
gtagccgggcgccgagagtg

SEQ ID NO: 107532 - DNA, 20 bp, human
ggtccgcgcgcatcacgccg

SEQ ID NO: 107533 - DNA, 20 bp, human
gggcttgctggaagggcacg

SEQ ID NO: 107534 - DNA, 20 bp, human
gaacaaaacgcaaggagagg

SEQ ID NO: 107535 - DNA, 20 bp, human
gtcagccccatggagagcga

SEQ ID NO: 107536 - DNA, 20 bp, human
gatcgtcgagctggcggaac

SEQ ID NO: 107537 - DNA, 20 bp, human
ggccgcaacgcgcagagcgc

SEQ ID NO: 107538 - DNA, 20 bp, human
gcgacttacgcgcagagtaa

SEQ ID NO: 107539 - DNA, 20 bp, human
gcgcgtcgcccgggttctgg

SEQ ID NO: 107540 - DNA, 20 bp, human
gcgcgtaagtcgcttgtccg

SEQ ID NO: 107541 - DNA, 20 bp, human
gcggcgtgggataatcagag

SEQ ID NO: 107542 - DNA, 20 bp, human
ggcgcggtcggcggtaagtc

SEQ ID NO: 107543 - DNA, 20 bp, human
gcgagggccgggcggccaag

SEQ ID NO: 107544 - DNA, 20 bp, human
gcgagatgcaccggaatcgg

SEQ ID NO: 107545 - DNA, 20 bp, human
ggcggccaagaggtgcgaga

SEQ ID NO: 107546 - DNA, 20 bp, human
ggtggatgcacacaaataag

SEQ ID NO: 107547 - DNA, 20 bp, human
gtctgcgggaagaatcgccg

SEQ ID NO: 107548 - DNA, 20 bp, human
gcgcagagttgtgaagcgaa

SEQ ID NO: 107549 - DNA, 20 bp, human
gtactgcggtactgaggaag

SEQ ID NO: 107550 - DNA, 20 bp, human
gcggcccctggacatagacg

SEQ ID NO: 107551 - DNA, 20 bp, human
ggaagccgacgagagagtgt

SEQ ID NO: 107552 - DNA, 20 bp, human
gaaataagcggcctacaaaa

SEQ ID NO: 107553 - DNA, 20 bp, human
gcccctggacatagacgagg

SEQ ID NO: 107554 - DNA, 20 bp, human
ggaagcgcctgaggaagtgg

SEQ ID NO: 107555 - DNA, 20 bp, human
gatcacgtgcagcacccgag

SEQ ID NO: 107556 - DNA, 20 bp, human
gcttgtggcccagcatggcg

SEQ ID NO: 107557 - DNA, 20 bp, human
gagcctgggcgctcaccgac

SEQ ID NO: 107558 - DNA, 20 bp, human
gcgagcaaggagcccccggc

SEQ ID NO: 107559 - DNA, 20 bp, human
gcgggccgcggccatgggag

SEQ ID NO: 107560 - DNA, 20 bp, human
gagcccggcggaggagacag

SEQ ID NO: 107561 - DNA, 20 bp, human
gggacctcgcggtctcacgg

SEQ ID NO: 107562 - DNA, 20 bp, human
gtcacgggggtaggggtcgt

SEQ ID NO: 107563 - DNA, 20 bp, human
ggggtggctgcggagagatg

SEQ ID NO: 107564 - DNA, 20 bp, human
gcgcggtctcacgggggtag

SEQ ID NO: 107565 - DNA, 20 bp, human
gtgctgggccacaagcccgt

SEQ ID NO: 107566 - DNA, 20 bp, human
gcagccctaaactattccag

SEQ ID NO: 107567 - DNA, 20 bp, human
gtgtcagtggtattgaccag

SEQ ID NO: 107568 - DNA, 20 bp, human
gaggctcaggcccactgtgt

SEQ ID NO: 107569 - DNA, 20 bp, human
gtagtttagggctgactcca

SEQ ID NO: 107570 - DNA, 20 bp, human
ggtgacacttgaaccagata

SEQ ID NO: 107571 - DNA, 20 bp, human
gctccctctggaatagttta

SEQ ID NO: 107572 - DNA, 20 bp, human
gcccaggctgacaggtgcct

SEQ ID NO: 107573 - DNA, 20 bp, human
gagctcgtggaccttgtcag

SEQ ID NO: 107574 - DNA, 20 bp, human
gccgcacaggcaggtgaaca

SEQ ID NO: 107575 - DNA, 20 bp, human
gacagtgcacacggcctacc

SEQ ID NO: 107576 - DNA, 20 bp, human
gggtgcggcccgtcagaggg

SEQ ID NO: 107577 - DNA, 20 bp, human
gggtggtgcggcccgtcaga

SEQ ID NO: 107578 - DNA, 20 bp, human
gtatcaacagggagctctcc

SEQ ID NO: 107579 - DNA, 20 bp, human
gtctcttgctgtccacacct

SEQ ID NO: 107580 - DNA, 20 bp, human
gcgcggccaggatagatcca

SEQ ID NO: 107581 - DNA, 20 bp, human
gcaggtggctggatcagggt

SEQ ID NO: 107582 - DNA, 20 bp, human
gtcaggaaggtgtctctctg

SEQ ID NO: 107583 - DNA, 20 bp, human
ggccagtcctctgccccaaa

SEQ ID NO: 107584 - DNA, 20 bp, human
gtggatgccatgtgactcgg

SEQ ID NO: 107585 - DNA, 20 bp, human
gaggaaaccacgagatctct

SEQ ID NO: 107586 - DNA, 20 bp, human
ggtcaggtcctgccacggga

SEQ ID NO: 107587 - DNA, 20 bp, human
ggagcaggagctggacggtg

SEQ ID NO: 107588 - DNA, 20 bp, human
gcagagaggctgtcactcac

SEQ ID NO: 107589 - DNA, 20 bp, human
gaatgacgcgggcactgtag

SEQ ID NO: 107590 - DNA, 20 bp, human
gggccggaggcgggagtcac

SEQ ID NO: 107591 - DNA, 20 bp, human
gccatctcttccagcaggag

SEQ ID NO: 107592 - DNA, 20 bp, human
gccggccggcggacccgccg

SEQ ID NO: 107593 - DNA, 20 bp, human
gctgctggaagagatggctt

SEQ ID NO: 107594 - DNA, 20 bp, human
gggggtgaggccagctgaga

SEQ ID NO: 107595 - DNA, 20 bp, human
ggagggtgttccaacaaccg

SEQ ID NO: 107596 - DNA, 20 bp, human
ggtagcgcgggcagaccagg

SEQ ID NO: 107597 - DNA, 20 bp, human
gagggtcggggtccacacca

SEQ ID NO: 107598 - DNA, 20 bp, human
ggcaccagcccgttacctac

SEQ ID NO: 107599 - DNA, 20 bp, human
gactgtcgaaggttctccag

SEQ ID NO: 107600 - DNA, 20 bp, human
gtgggcctcgggggaccggt

SEQ ID NO: 107601 - DNA, 20 bp, human
gcccaccgcgaaccacagga

SEQ ID NO: 107602 - DNA, 20 bp, human
gcacaccagggcgcagagga

SEQ ID NO: 107603 - DNA, 20 bp, human
gcgcaggcgttggcgggcag

SEQ ID NO: 107604 - DNA, 20 bp, human
gcgcagcaggccgcaggcgt

SEQ ID NO: 107605 - DNA, 20 bp, human
ggaggcccacgatcagcgtc

SEQ ID NO: 107606 - DNA, 20 bp, human
gcattcatttaaggagctag

SEQ ID NO: 107607 - DNA, 20 bp, human
gcgtcttcaccactggacaa

SEQ ID NO: 107608 - DNA, 20 bp, human
gtcagtgattggaataaggg

SEQ ID NO: 107609 - DNA, 20 bp, human
ggttgaaactcacacagtct

SEQ ID NO: 107610 - DNA, 20 bp, human
gatcgtttctgtttccacct

SEQ ID NO: 107611 - DNA, 20 bp, human
gtatggacagataaatcaaa

SEQ ID NO: 107612 - DNA, 20 bp, human
gcctgcctgtagcacctagg

SEQ ID NO: 107613 - DNA, 20 bp, human
gctccttaaatgaatgtgag

SEQ ID NO: 107614 - DNA, 20 bp, human
gcaggagctggagtcaaagc

SEQ ID NO: 107615 - DNA, 20 bp, human
gtcccctgcctgtagcacct

SEQ ID NO: 107616 - DNA, 20 bp, human
gtgggactggcaaacagctg

SEQ ID NO: 107617 - DNA, 20 bp, human
gagttgagaagtgctttcct

SEQ ID NO: 107618 - DNA, 20 bp, human
gactggcaaacagctgagga

SEQ ID NO: 107619 - DNA, 20 bp, human
gtggtagatagaagagaagt

SEQ ID NO: 107620 - DNA, 20 bp, human
ggatgctgggagatccgaat

SEQ ID NO: 107621 - DNA, 20 bp, human
gcccttctttctactggagt

SEQ ID NO: 107622 - DNA, 20 bp, human
gcacatcacacactctaaag

SEQ ID NO: 107623 - DNA, 20 bp, human
ggtttcactccagatcctgc

SEQ ID NO: 107624 - DNA, 20 bp, human
ggggacaatgacagatatga

SEQ ID NO: 107625 - DNA, 20 bp, human
gtgctggcagcttagatgct

SEQ ID NO: 107626 - DNA, 20 bp, human
ggacaaagaaggaacgataa

SEQ ID NO: 107627 - DNA, 20 bp, human
gggtctaaggaagatataga

SEQ ID NO: 107628 - DNA, 20 bp, human
ggcaccaaggtggaagcata

SEQ ID NO: 107629 - DNA, 20 bp, human
gatagatggcccaataatta

SEQ ID NO: 107630 - DNA, 20 bp, human
gtggggagataaattagaag

SEQ ID NO: 107631 - DNA, 20 bp, human
gtgaatgattggaatgaagg

SEQ ID NO: 107632 - DNA, 20 bp, human
gacagcactcagtttctgaa

SEQ ID NO: 107633 - DNA, 20 bp, human
gtgtccttatgcttccacct

SEQ ID NO: 107634 - DNA, 20 bp, human
gacattcatttaacgagcaa

SEQ ID NO: 107635 - DNA, 20 bp, human
gggcagcagtctctccatga

SEQ ID NO: 107636 - DNA, 20 bp, human
gtaccgaagactgggacggt

SEQ ID NO: 107637 - DNA, 20 bp, human
ggccctggccggatgagtgg

SEQ ID NO: 107638 - DNA, 20 bp, human
gagtcacttaccaaaggtgg

SEQ ID NO: 107639 - DNA, 20 bp, human
ggaggacagtaaatcccata

SEQ ID NO: 107640 - DNA, 20 bp, human
gaaagccctggccggatgag

SEQ ID NO: 107641 - DNA, 20 bp, human
gtaaatcccatacggcaggg

SEQ ID NO: 107642 - DNA, 20 bp, human
gacccccactcatccggcca

SEQ ID NO: 107643 - DNA, 20 bp, human
gcagttttgtaccgaagact

SEQ ID NO: 107644 - DNA, 20 bp, human
gcagtaaatcccatacggca

SEQ ID NO: 107645 - DNA, 20 bp, human
gccccaccaccctgccgtat

SEQ ID NO: 107646 - DNA, 20 bp, human
gcaagcccagcgcaactcag

SEQ ID NO: 107647 - DNA, 20 bp, human
gcgcaactcagagggagcta

SEQ ID NO: 107648 - DNA, 20 bp, human
ggcgcccgcctgcagctcca

SEQ ID NO: 107649 - DNA, 20 bp, human
gcagggagccccgcgagtag

SEQ ID NO: 107650 - DNA, 20 bp, human
ggcgcgggccatgttgacag

SEQ ID NO: 107651 - DNA, 20 bp, human
gaggctgagacagcccacca

SEQ ID NO: 107652 - DNA, 20 bp, human
ggtccgcgcgcacttgggag

SEQ ID NO: 107653 - DNA, 20 bp, human
ggagtagcggatcgcctcca

SEQ ID NO: 107654 - DNA, 20 bp, human
gcgcctgcagctccacggcg

SEQ ID NO: 107655 - DNA, 20 bp, human
gacatcagccaggtcgcggg

SEQ ID NO: 107656 - DNA, 20 bp, human
gcaggagccgggccacagag

SEQ ID NO: 107657 - DNA, 20 bp, human
gggaagcgagggacccacgt

SEQ ID NO: 107658 - DNA, 20 bp, human
ggtccagttgtgggtaatcg

SEQ ID NO: 107659 - DNA, 20 bp, human
ggaagctccagccgagaggt

SEQ ID NO: 107660 - DNA, 20 bp, human
gtgcagagccaggagacacg

SEQ ID NO: 107661 - DNA, 20 bp, human
gcgctcccaggctcccacgt

SEQ ID NO: 107662 - DNA, 20 bp, human
gcctgtccgagagagctcgg

SEQ ID NO: 107663 - DNA, 20 bp, human
gagccgggccacagagcggc

SEQ ID NO: 107664 - DNA, 20 bp, human
gagctcggtagtccagttgt

SEQ ID NO: 107665 - DNA, 20 bp, human
gggagcctgggagcgaactg

SEQ ID NO: 107666 - DNA, 20 bp, human
ggccctcccgagtcaggaac

SEQ ID NO: 107667 - DNA, 20 bp, human
gcaacagtgtcccttacctg

SEQ ID NO: 107668 - DNA, 20 bp, human
gcgggctccggttcatcacg

SEQ ID NO: 107669 - DNA, 20 bp, human
gtgggagctcgacctctagg

SEQ ID NO: 107670 - DNA, 20 bp, human
gtaagggacactgttggccg

SEQ ID NO: 107671 - DNA, 20 bp, human
ggcccgttcctgactcggga

SEQ ID NO: 107672 - DNA, 20 bp, human
gcggagcccgttcctgactc

SEQ ID NO: 107673 - DNA, 20 bp, human
gtgtcctgtgagctgaacga

SEQ ID NO: 107674 - DNA, 20 bp, human
gagaggtcgagctcccatac

SEQ ID NO: 107675 - DNA, 20 bp, human
gaggcgtcctggctgcactt

SEQ ID NO: 107676 - DNA, 20 bp, human
gtggcggctgacaagaaaac

SEQ ID NO: 107677 - DNA, 20 bp, human
gcttgtcagccgccagctga

SEQ ID NO: 107678 - DNA, 20 bp, human
gtgggcactcagcaagttac

SEQ ID NO: 107679 - DNA, 20 bp, human
ggttctttgcatctgtagga

SEQ ID NO: 107680 - DNA, 20 bp, human
gagacctgcagcgggttccc

SEQ ID NO: 107681 - DNA, 20 bp, human
gattcagtagatgagattaa

SEQ ID NO: 107682 - DNA, 20 bp, human
gcggccgccttggtatcggc

SEQ ID NO: 107683 - DNA, 20 bp, human
gacaaggaatgcaggtggcc

SEQ ID NO: 107684 - DNA, 20 bp, human
gtgtaagggttcatacacac

SEQ ID NO: 107685 - DNA, 20 bp, human
gggactcaccccacaactgc

SEQ ID NO: 107686 - DNA, 20 bp, human
gtgtagaagagagggcgaga

SEQ ID NO: 107687 - DNA, 20 bp, human
gaggaatgggtctcctggaa

SEQ ID NO: 107688 - DNA, 20 bp, human
gttggcccaatacacatcaa

SEQ ID NO: 107689 - DNA, 20 bp, human
gatagtaaagggccatggga

SEQ ID NO: 107690 - DNA, 20 bp, human
gtcaaggaacttgggacagg

SEQ ID NO: 107691 - DNA, 20 bp, human
gtgtcgagatggtggaagaa

SEQ ID NO: 107692 - DNA, 20 bp, human
gttatcaaagtgagacagct

SEQ ID NO: 107693 - DNA, 20 bp, human
gaatgggtctcctggaaggg

SEQ ID NO: 107694 - DNA, 20 bp, human
gagaagaagaccctaaggaa

SEQ ID NO: 107695 - DNA, 20 bp, human
ggccatgggatggatctttg

SEQ ID NO: 107696 - DNA, 20 bp, human
gttagtacagaggaatccat

SEQ ID NO: 107697 - DNA, 20 bp, human
gactgtcctgatgttgggaa

SEQ ID NO: 107698 - DNA, 20 bp, human
ggctttactgtcctgatgtt

SEQ ID NO: 107699 - DNA, 20 bp, human
ggacatgacacttagtacag

SEQ ID NO: 107700 - DNA, 20 bp, human
gctaagtattagaaatagta

SEQ ID NO: 107701 - DNA, 20 bp, human
gtcatgtcttggctgtttca

SEQ ID NO: 107702 - DNA, 20 bp, human
gtctgggagcttccagagat

SEQ ID NO: 107703 - DNA, 20 bp, human
gaaaaatcaaagaggcaggt

SEQ ID NO: 107704 - DNA, 20 bp, human
gcaaatactctggtcaccaa

SEQ ID NO: 107705 - DNA, 20 bp, human
ggaggcactttcatttagag

SEQ ID NO: 107706 - DNA, 20 bp, human
gggcgtgaggccagagttag

SEQ ID NO: 107707 - DNA, 20 bp, human
ggttagtggtgagctcctgt

SEQ ID NO: 107708 - DNA, 20 bp, human
gtgtgggccggccctgtcta

SEQ ID NO: 107709 - DNA, 20 bp, human
gctgcaccccaaccatggac

SEQ ID NO: 107710 - DNA, 20 bp, human
gaggagctcaccactaactc

SEQ ID NO: 107711 - DNA, 20 bp, human
gagggccagtgccgtagaca

SEQ ID NO: 107712 - DNA, 20 bp, human
gacacaggtgcaggctatgt

SEQ ID NO: 107713 - DNA, 20 bp, human
gactctggcctcacgcctgt

SEQ ID NO: 107714 - DNA, 20 bp, human
ggtgagggccagagggacca

SEQ ID NO: 107715 - DNA, 20 bp, human
ggaggaggctgagtaccggt

SEQ ID NO: 107716 - DNA, 20 bp, human
gaacttcgcaggaggagcag

SEQ ID NO: 107717 - DNA, 20 bp, human
gcggcttctaggtcagtcct

SEQ ID NO: 107718 - DNA, 20 bp, human
gctgcaggcaagggccgcca

SEQ ID NO: 107719 - DNA, 20 bp, human
gtcagggttagagcccccac

SEQ ID NO: 107720 - DNA, 20 bp, human
gcaagggccgccatggctgg

SEQ ID NO: 107721 - DNA, 20 bp, human
gtcctgggaggtcaaacctg

SEQ ID NO: 107722 - DNA, 20 bp, human
gtgggggtcctgtggatggt

SEQ ID NO: 107723 - DNA, 20 bp, human
gaggtcagcgtgaaacaggc

SEQ ID NO: 107724 - DNA, 20 bp, human
gctgggcacaacttcgcagg

SEQ ID NO: 107725 - DNA, 20 bp, human
gtcgctgccagcttcaggga

SEQ ID NO: 107726 - DNA, 20 bp, human
gcccatcccaaggacctcag

SEQ ID NO: 107727 - DNA, 20 bp, human
gcctggagctggacctggtt

SEQ ID NO: 107728 - DNA, 20 bp, human
ggctgactcggtgtgatctg

SEQ ID NO: 107729 - DNA, 20 bp, human
gctctccaggcttcccaacc

SEQ ID NO: 107730 - DNA, 20 bp, human
gtggacctggttgggaagcc

SEQ ID NO: 107731 - DNA, 20 bp, human
gcgaggaagcggcgggtcta

SEQ ID NO: 107732 - DNA, 20 bp, human
gaattgtcggaggggaggca

SEQ ID NO: 107733 - DNA, 20 bp, human
gagagtcccaaggagcccga

SEQ ID NO: 107734 - DNA, 20 bp, human
gcggtgggagtggtgagtgt

SEQ ID NO: 107735 - DNA, 20 bp, human
gtcggtgtgatctggggaca

SEQ ID NO: 107736 - DNA, 20 bp, human
gagctctgggaaagtcctag

SEQ ID NO: 107737 - DNA, 20 bp, human
ggaagcctaggtaagctgag

SEQ ID NO: 107738 - DNA, 20 bp, human
ggtggtaactcccttgtggg

SEQ ID NO: 107739 - DNA, 20 bp, human
ggggaaagtcctaggggtgg

SEQ ID NO: 107740 - DNA, 20 bp, human
gtgtacccagaagtgcggga

SEQ ID NO: 107741 - DNA, 20 bp, human
gtagaggcttagagtcatga

SEQ ID NO: 107742 - DNA, 20 bp, human
ggaaggtggtaactcccttg

SEQ ID NO: 107743 - DNA, 20 bp, human
ggacttgtacccagaagtgc

SEQ ID NO: 107744 - DNA, 20 bp, human
gaccaccttcccgcacttct

SEQ ID NO: 107745 - DNA, 20 bp, human
ggtaagctgaggggcagctc

SEQ ID NO: 107746 - DNA, 20 bp, human
gggatcgagggtccgaagga

SEQ ID NO: 107747 - DNA, 20 bp, human
gcccttcccctgcgggacag

SEQ ID NO: 107748 - DNA, 20 bp, human
gtggggcgctctcggatcga

SEQ ID NO: 107749 - DNA, 20 bp, human
gaggagggctgcgagctggt

SEQ ID NO: 107750 - DNA, 20 bp, human
gccctgcgggacaggggcat

SEQ ID NO: 107751 - DNA, 20 bp, human
gaggagcgttgcgagacggt

SEQ ID NO: 107752 - DNA, 20 bp, human
gtctcggatcgagggtccga

SEQ ID NO: 107753 - DNA, 20 bp, human
gcagggccttgcagttcccg

SEQ ID NO: 107754 - DNA, 20 bp, human
ggtcggttccaagtgggcct

SEQ ID NO: 107755 - DNA, 20 bp, human
gccctgtgagcgggaggact

SEQ ID NO: 107756 - DNA, 20 bp, human
gttacgttatggcccaggta

SEQ ID NO: 107757 - DNA, 20 bp, human
gcgttatggcccaggtatgg

SEQ ID NO: 107758 - DNA, 20 bp, human
ggaaatgttgacactcgtca

SEQ ID NO: 107759 - DNA, 20 bp, human
gacctagagtattttacctt

SEQ ID NO: 107760 - DNA, 20 bp, human
gacattagaaaattacgtta

SEQ ID NO: 107761 - DNA, 20 bp, human
gacatttcaaagaatttgct

SEQ ID NO: 107762 - DNA, 20 bp, human
gtaattttctaatgtattca

SEQ ID NO: 107763 - DNA, 20 bp, human
ggccaaaggtaaaatactct

SEQ ID NO: 107764 - DNA, 20 bp, human
gtgtaacttctctgtaatca

SEQ ID NO: 107765 - DNA, 20 bp, human
gtattttacctttggctaag

SEQ ID NO: 107766 - DNA, 20 bp, human
gcctgctcccgggtcatgta

SEQ ID NO: 107767 - DNA, 20 bp, human
gcggccgccagcagacgccg

SEQ ID NO: 107768 - DNA, 20 bp, human
gcgccgcctggagatcgagg

SEQ ID NO: 107769 - DNA, 20 bp, human
ggacgggtgcgcttacgcca

SEQ ID NO: 107770 - DNA, 20 bp, human
gatccgccgcctggagatcg

SEQ ID NO: 107771 - DNA, 20 bp, human
gcgaggcggagaaccattac

SEQ ID NO: 107772 - DNA, 20 bp, human
ggtgcgaattcggttctcta

SEQ ID NO: 107773 - DNA, 20 bp, human
gtaaggccagcaggcgaaga

SEQ ID NO: 107774 - DNA, 20 bp, human
gacgccacggcgtctgctgg

SEQ ID NO: 107775 - DNA, 20 bp, human
ggcctgcggaagagagggac

SEQ ID NO: 107776 - DNA, 20 bp, human
gtccggagtgcccaacatgg

SEQ ID NO: 107777 - DNA, 20 bp, human
gcggcggccgtaaggtgcat

SEQ ID NO: 107778 - DNA, 20 bp, human
gccgtaaggtgcatgggtag

SEQ ID NO: 107779 - DNA, 20 bp, human
gagacgtccaccctgaggga

SEQ ID NO: 107780 - DNA, 20 bp, human
gtagtggagtgtgataagtg

SEQ ID NO: 107781 - DNA, 20 bp, human
gggagtgcccaacatggcgg

SEQ ID NO: 107782 - DNA, 20 bp, human
gatgggtagaggtaaggcga

SEQ ID NO: 107783 - DNA, 20 bp, human
gctggagacgtccaccctga

SEQ ID NO: 107784 - DNA, 20 bp, human
gagggtggacgtctccagaa

SEQ ID NO: 107785 - DNA, 20 bp, human
gcccactccctccctcaggg

SEQ ID NO: 107786 - DNA, 20 bp, human
ggacggaagccgagtggaga

SEQ ID NO: 107787 - DNA, 20 bp, human
gctcctgccccaggcgggta

SEQ ID NO: 107788 - DNA, 20 bp, human
gcctcgcagcatccccgcca

SEQ ID NO: 107789 - DNA, 20 bp, human
gtctccaccggaagaatgga

SEQ ID NO: 107790 - DNA, 20 bp, human
gcctctattaaactccgcaa

SEQ ID NO: 107791 - DNA, 20 bp, human
ggccactccttacccgcctg

SEQ ID NO: 107792 - DNA, 20 bp, human
gagacacgccgtgaggacct

SEQ ID NO: 107793 - DNA, 20 bp, human
ggacggggctaaggagtcaa

SEQ ID NO: 107794 - DNA, 20 bp, human
ggccccaggcgggtaaggag

SEQ ID NO: 107795 - DNA, 20 bp, human
ggtggagacggaaagagcta

SEQ ID NO: 107796 - DNA, 20 bp, human
gtggcttcagttcacctcag

SEQ ID NO: 107797 - DNA, 20 bp, human
gcgtggcgggaacccgacgt

SEQ ID NO: 107798 - DNA, 20 bp, human
ggatcttctggctcacggag

SEQ ID NO: 107799 - DNA, 20 bp, human
ggctgtaatgaggataacgt

SEQ ID NO: 107800 - DNA, 20 bp, human
gagacgaaggagggaacgga

SEQ ID NO: 107801 - DNA, 20 bp, human
gggtcaagggtcctcacgtt

SEQ ID NO: 107802 - DNA, 20 bp, human
ggggtcctcacgttaggcta

SEQ ID NO: 107803 - DNA, 20 bp, human
gcgagctttgacatgatgcg

SEQ ID NO: 107804 - DNA, 20 bp, human
gaagctaggacgcggatgga

SEQ ID NO: 107805 - DNA, 20 bp, human
ggtgaagacgaaggagggaa

SEQ ID NO: 107806 - DNA, 20 bp, human
ggccgccgggcattcgagct

SEQ ID NO: 107807 - DNA, 20 bp, human
gaaggtcacacgcggttccc

SEQ ID NO: 107808 - DNA, 20 bp, human
ggcagcaaaggcccatccgt

SEQ ID NO: 107809 - DNA, 20 bp, human
ggaatgcccggcggccgagg

SEQ ID NO: 107810 - DNA, 20 bp, human
gtcacacgcggttccccggg

SEQ ID NO: 107811 - DNA, 20 bp, human
gcgggctggaaggtcacacg

SEQ ID NO: 107812 - DNA, 20 bp, human
gaaacgccgcacccacggat

SEQ ID NO: 107813 - DNA, 20 bp, human
gcgcggaccgatgctgccgg

SEQ ID NO: 107814 - DNA, 20 bp, human
ggagcggccgccggcagcat

SEQ ID NO: 107815 - DNA, 20 bp, human
gggccgctcgccccctgtgg

SEQ ID NO: 107816 - DNA, 20 bp, human
gctactaggagaaggacgta

SEQ ID NO: 107817 - DNA, 20 bp, human
ggtgacccggcgtggctact

SEQ ID NO: 107818 - DNA, 20 bp, human
gcggcgtggctactaggaga

SEQ ID NO: 107819 - DNA, 20 bp, human
gcgtacggtcctgctagtag

SEQ ID NO: 107820 - DNA, 20 bp, human
gtaagagtccgagctcacct

SEQ ID NO: 107821 - DNA, 20 bp, human
ggtttcccgccgggccagta

SEQ ID NO: 107822 - DNA, 20 bp, human
gtaataaggtggatcacata

SEQ ID NO: 107823 - DNA, 20 bp, human
gctcggccaagaggtgactt

SEQ ID NO: 107824 - DNA, 20 bp, human
gcacaagagggtcgtcagtc

SEQ ID NO: 107825 - DNA, 20 bp, human
gaaggctgagtgacccggcg

SEQ ID NO: 107826 - DNA, 20 bp, human
ggctaggaagaggccgcgtg

SEQ ID NO: 107827 - DNA, 20 bp, human
ggtggggcgaaggcggcgct

SEQ ID NO: 107828 - DNA, 20 bp, human
ggaagccggaggagacgctc

SEQ ID NO: 107829 - DNA, 20 bp, human
ggcgcgcaggcgctaggaag

SEQ ID NO: 107830 - DNA, 20 bp, human
gaggccgcgtggggcgaagg

SEQ ID NO: 107831 - DNA, 20 bp, human
ggctccggagtgaccagcga

SEQ ID NO: 107832 - DNA, 20 bp, human
gcactccggagcgtctcctc

SEQ ID NO: 107833 - DNA, 20 bp, human
ggcgagagcggtatggtggg

SEQ ID NO: 107834 - DNA, 20 bp, human
gcggaaagcggagaagccgg

SEQ ID NO: 107835 - DNA, 20 bp, human
gacctaagttgggaaagggg

SEQ ID NO: 107836 - DNA, 20 bp, human
gcggtcccttgcagggcggt

SEQ ID NO: 107837 - DNA, 20 bp, human
ggttatggccggtcccttgc

SEQ ID NO: 107838 - DNA, 20 bp, human
ggtggcctccgagcagctca

SEQ ID NO: 107839 - DNA, 20 bp, human
gaggccccggagtaggtcca

SEQ ID NO: 107840 - DNA, 20 bp, human
gtggccggtcccttgcaggg

SEQ ID NO: 107841 - DNA, 20 bp, human
gctgggcagtaagggagaac

SEQ ID NO: 107842 - DNA, 20 bp, human
ggggccctggacctactccg

SEQ ID NO: 107843 - DNA, 20 bp, human
gacgcggcaggccccggagt

SEQ ID NO: 107844 - DNA, 20 bp, human
gggcgccctgagctgctcgg

SEQ ID NO: 107845 - DNA, 20 bp, human
gggaggccacgtggtctcgg

SEQ ID NO: 107846 - DNA, 20 bp, human
gtcctgagccgattacagct

SEQ ID NO: 107847 - DNA, 20 bp, human
gagacagccggagtcgctgg

SEQ ID NO: 107848 - DNA, 20 bp, human
gcctgcacccaggtaagcag

SEQ ID NO: 107849 - DNA, 20 bp, human
gggagctcccccagcgactc

SEQ ID NO: 107850 - DNA, 20 bp, human
gggagcgccgctgcttacct

SEQ ID NO: 107851 - DNA, 20 bp, human
gaacttccggccccactgag

SEQ ID NO: 107852 - DNA, 20 bp, human
gttccactaaatggactcaa

SEQ ID NO: 107853 - DNA, 20 bp, human
gctcaggacaccgctcagtg

SEQ ID NO: 107854 - DNA, 20 bp, human
gcacctcaagactcctccgg

SEQ ID NO: 107855 - DNA, 20 bp, human
gagggagaaaaagcactgga

SEQ ID NO: 107856 - DNA, 20 bp, human
gtcgctgcagcgatctccca

SEQ ID NO: 107857 - DNA, 20 bp, human
gctcgggaccgaggcccata

SEQ ID NO: 107858 - DNA, 20 bp, human
gcgcgtgtggacgaaatgag

SEQ ID NO: 107859 - DNA, 20 bp, human
gtccagttccggcctccaag

SEQ ID NO: 107860 - DNA, 20 bp, human
ggcccatacggcgaaatacg

SEQ ID NO: 107861 - DNA, 20 bp, human
gccaaggggcgggcagaagt

SEQ ID NO: 107862 - DNA, 20 bp, human
gacccgcagagtggacaaga

SEQ ID NO: 107863 - DNA, 20 bp, human
ggttagggctgcggagttag

SEQ ID NO: 107864 - DNA, 20 bp, human
gagggctgcggagttagggg

SEQ ID NO: 107865 - DNA, 20 bp, human
gagttccggcctccaagggg

SEQ ID NO: 107866 - DNA, 20 bp, human
ggtctggcgtggagagtttg

SEQ ID NO: 107867 - DNA, 20 bp, human
ggagcagccatataaagtca

SEQ ID NO: 107868 - DNA, 20 bp, human
gggggatctacagcagccaa

SEQ ID NO: 107869 - DNA, 20 bp, human
ggtcgtccgtgaggaaaaag

SEQ ID NO: 107870 - DNA, 20 bp, human
gagctggggtgtaactggag

SEQ ID NO: 107871 - DNA, 20 bp, human
gtgggcaccgcgtaggaata

SEQ ID NO: 107872 - DNA, 20 bp, human
gcctcgggcctaaagattgg

SEQ ID NO: 107873 - DNA, 20 bp, human
gtaagggcgcgaacctgggt

SEQ ID NO: 107874 - DNA, 20 bp, human
gcaacgggaaaaaccgcaca

SEQ ID NO: 107875 - DNA, 20 bp, human
gaaagtcagggacaagcctt

SEQ ID NO: 107876 - DNA, 20 bp, human
ggtccggctccacttactgc

SEQ ID NO: 107877 - DNA, 20 bp, human
gaggcgatagaggccggcgg

SEQ ID NO: 107878 - DNA, 20 bp, human
gagttgccggcctagcgcca

SEQ ID NO: 107879 - DNA, 20 bp, human
gcctgcgttccggttccacg

SEQ ID NO: 107880 - DNA, 20 bp, human
gggtcccggctctaaggtgg

SEQ ID NO: 107881 - DNA, 20 bp, human
gcctggcggcttggaaactc

SEQ ID NO: 107882 - DNA, 20 bp, human
gggcggcctgcattgcagcg

SEQ ID NO: 107883 - DNA, 20 bp, human
gcgtgagctagctggcatgg

SEQ ID NO: 107884 - DNA, 20 bp, human
gctaggccggcaactggggt

SEQ ID NO: 107885 - DNA, 20 bp, human
gcgaggtcccggctctaagg

SEQ ID NO: 107886 - DNA, 20 bp, human
ggcagcttggctaaaagtaa

SEQ ID NO: 107887 - DNA, 20 bp, human
gcctatacctggcttatcat

SEQ ID NO: 107888 - DNA, 20 bp, human
ggcggcggggaacagactcg

SEQ ID NO: 107889 - DNA, 20 bp, human
ggcgcgggtcagtgcgcaca

SEQ ID NO: 107890 - DNA, 20 bp, human
gctaggagcaccgagcagct

SEQ ID NO: 107891 - DNA, 20 bp, human
gcggacagtcaacgtcatct

SEQ ID NO: 107892 - DNA, 20 bp, human
ggctctgcgctctctgaacc

SEQ ID NO: 107893 - DNA, 20 bp, human
gggtctgcgggcatgcgagg

SEQ ID NO: 107894 - DNA, 20 bp, human
ggcaggggcggcgacggtcg

SEQ ID NO: 107895 - DNA, 20 bp, human
gccatctccggcagcccgaa

SEQ ID NO: 107896 - DNA, 20 bp, human
gggcgcccggggtatcccgc

SEQ ID NO: 107897 - DNA, 20 bp, human
gtatcccgcgggccaagggg

SEQ ID NO: 107898 - DNA, 20 bp, human
gtgcgcggtgaggaagacca

SEQ ID NO: 107899 - DNA, 20 bp, human
gtcgcggcgcagaaacgcag

SEQ ID NO: 107900 - DNA, 20 bp, human
ggacccgggcaagatggcag

SEQ ID NO: 107901 - DNA, 20 bp, human
gctgcacactagctgggtcg

SEQ ID NO: 107902 - DNA, 20 bp, human
gctcctggatccgaaagtag

SEQ ID NO: 107903 - DNA, 20 bp, human
gtggatccgaaagtagcggt

SEQ ID NO: 107904 - DNA, 20 bp, human
ggaggtgctgaagcacgcca

SEQ ID NO: 107905 - DNA, 20 bp, human
gcgccccgcaggcaaactgt

SEQ ID NO: 107906 - DNA, 20 bp, human
gacggtcaccttagggcggc

SEQ ID NO: 107907 - DNA, 20 bp, human
gtatgtgcctgggtccgacc

SEQ ID NO: 107908 - DNA, 20 bp, human
gcgccctaaggtgaccgtca

SEQ ID NO: 107909 - DNA, 20 bp, human
gagaccagctcgcagcctgg

SEQ ID NO: 107910 - DNA, 20 bp, human
ggcggacgccagccgcccta

SEQ ID NO: 107911 - DNA, 20 bp, human
gtccgggccccgaaggtctc

SEQ ID NO: 107912 - DNA, 20 bp, human
gttccctgacggtcacctta

SEQ ID NO: 107913 - DNA, 20 bp, human
gggggcagtggttcaagcac

SEQ ID NO: 107914 - DNA, 20 bp, human
gagtggaagaagagtacttc

SEQ ID NO: 107915 - DNA, 20 bp, human
gcagcatcctgagaccttcg

SEQ ID NO: 107916 - DNA, 20 bp, human
gcggcagtactgggacagtt

SEQ ID NO: 107917 - DNA, 20 bp, human
gtccagaaggcgcttgaact

SEQ ID NO: 107918 - DNA, 20 bp, human
ggcgggagggcgaaagatgg

SEQ ID NO: 107919 - DNA, 20 bp, human
gagatggcggcggcagtact

SEQ ID NO: 107920 - DNA, 20 bp, human
ggtagcgggagggcgaaaga

SEQ ID NO: 107921 - DNA, 20 bp, human
ggtactgggacagttgggta

SEQ ID NO: 107922 - DNA, 20 bp, human
ggaggcgctcagttaccaac

SEQ ID NO: 107923 - DNA, 20 bp, human
gaactcggcggcttccgtag

SEQ ID NO: 107924 - DNA, 20 bp, human
gggcggcttccgtagcggga

SEQ ID NO: 107925 - DNA, 20 bp, human
gaggattacccataacccaa

SEQ ID NO: 107926 - DNA, 20 bp, human
ggcggaatgtggtgtgagta

SEQ ID NO: 107927 - DNA, 20 bp, human
gcagggccgagggagctgtt

SEQ ID NO: 107928 - DNA, 20 bp, human
ggaagcgcgcgtggccgcca

SEQ ID NO: 107929 - DNA, 20 bp, human
ggtctgcttgtgacactaag

SEQ ID NO: 107930 - DNA, 20 bp, human
ggtgtctcaaggcatgacag

SEQ ID NO: 107931 - DNA, 20 bp, human
ggccgccatggcgcggaatg

SEQ ID NO: 107932 - DNA, 20 bp, human
gggtcgtcacccccccgtcg

SEQ ID NO: 107933 - DNA, 20 bp, human
gaggtttagggcaaccccag

SEQ ID NO: 107934 - DNA, 20 bp, human
gctggacccaacagccgacg

SEQ ID NO: 107935 - DNA, 20 bp, human
gtaaggggcgccccgcgacg

SEQ ID NO: 107936 - DNA, 20 bp, human
gctctcggacgggcacctct

SEQ ID NO: 107937 - DNA, 20 bp, human
gcttggcgatgtctgggatg

SEQ ID NO: 107938 - DNA, 20 bp, human
ggaagtgccgcggaaagtgg

SEQ ID NO: 107939 - DNA, 20 bp, human
gccgcacctgcctctcggac

SEQ ID NO: 107940 - DNA, 20 bp, human
gggacgggcacctctagggc

SEQ ID NO: 107941 - DNA, 20 bp, human
gttggagccgtgacctgaga

SEQ ID NO: 107942 - DNA, 20 bp, human
gaagaagggaaggatctcgg

SEQ ID NO: 107943 - DNA, 20 bp, human
gggtctgccctctcaggtca

SEQ ID NO: 107944 - DNA, 20 bp, human
gtggattgactgaggtgaag

SEQ ID NO: 107945 - DNA, 20 bp, human
gtgagggccgcccgccctag

SEQ ID NO: 107946 - DNA, 20 bp, human
gcgacaccgtccctcaaacc

SEQ ID NO: 107947 - DNA, 20 bp, human
ggtgatcgaaagcatggcgt

SEQ ID NO: 107948 - DNA, 20 bp, human
ggtcccattaccggctgtcc

SEQ ID NO: 107949 - DNA, 20 bp, human
gtgggacgcagtagtcagag

SEQ ID NO: 107950 - DNA, 20 bp, human
gggacccggacagccggtaa

SEQ ID NO: 107951 - DNA, 20 bp, human
ggaacccgtccgtgctgctg

SEQ ID NO: 107952 - DNA, 20 bp, human
gaccagagagaaccgttcgg

SEQ ID NO: 107953 - DNA, 20 bp, human
gagcatggcgtcggtggtgt

SEQ ID NO: 107954 - DNA, 20 bp, human
gatcgaaagcatggcgtcgg

SEQ ID NO: 107955 - DNA, 20 bp, human
ggactactgcgtcccattac

SEQ ID NO: 107956 - DNA, 20 bp, human
gttcagggttcagagcccac

SEQ ID NO: 107957 - DNA, 20 bp, human
gcactacctgcgctccctgg

SEQ ID NO: 107958 - DNA, 20 bp, human
gcctggaggcgacacatctc

SEQ ID NO: 107959 - DNA, 20 bp, human
gtcccgtgtggctctggaag

SEQ ID NO: 107960 - DNA, 20 bp, human
gcgtgcactataggcctcat

SEQ ID NO: 107961 - DNA, 20 bp, human
gtacctggagagacctgggt

SEQ ID NO: 107962 - DNA, 20 bp, human
gcgccggggcagaaggggag

SEQ ID NO: 107963 - DNA, 20 bp, human
ggttcagagcccaccggaac

SEQ ID NO: 107964 - DNA, 20 bp, human
gaaccctgaaaggtgggcgc

SEQ ID NO: 107965 - DNA, 20 bp, human
ggggagcgcaggtagtggcc

SEQ ID NO: 107966 - DNA, 20 bp, human
gcatcggccggcgaccgttc

SEQ ID NO: 107967 - DNA, 20 bp, human
gtgctgggtcgactcgggga

SEQ ID NO: 107968 - DNA, 20 bp, human
gcgtggacgcagtagccgtg

SEQ ID NO: 107969 - DNA, 20 bp, human
gggctactgcgtccacgtgg

SEQ ID NO: 107970 - DNA, 20 bp, human
gctgggcccggggaacaggt

SEQ ID NO: 107971 - DNA, 20 bp, human
gcgtcgcagagagcatcggc

SEQ ID NO: 107972 - DNA, 20 bp, human
gcggccggcgaccgttccgg

SEQ ID NO: 107973 - DNA, 20 bp, human
gcgttctaaggggattgaag

SEQ ID NO: 107974 - DNA, 20 bp, human
gaataagggccgttaaccta

SEQ ID NO: 107975 - DNA, 20 bp, human
ggtgggacacagaagaataa

SEQ ID NO: 107976 - DNA, 20 bp, human
ggaggtcgcgctcactgcga

SEQ ID NO: 107977 - DNA, 20 bp, human
gctgaaggtttagcgggtgc

SEQ ID NO: 107978 - DNA, 20 bp, human
ggccaatgtgacgggatcag

SEQ ID NO: 107979 - DNA, 20 bp, human
gccggtgagtggggaatgag

SEQ ID NO: 107980 - DNA, 20 bp, human
gctgctctgcttcccttcgg

SEQ ID NO: 107981 - DNA, 20 bp, human
ggaatgagtggcggagagtg

SEQ ID NO: 107982 - DNA, 20 bp, human
gaagcaaccttaatacccag

SEQ ID NO: 107983 - DNA, 20 bp, human
gcccttcggaggaaaatttc

SEQ ID NO: 107984 - DNA, 20 bp, human
gctgcaaattgggaaacggg

SEQ ID NO: 107985 - DNA, 20 bp, human
gttcaggctgaaggtttagc

SEQ ID NO: 107986 - DNA, 20 bp, human
gcgtacccacggcctcgtga

SEQ ID NO: 107987 - DNA, 20 bp, human
gacgaggccgtgggtacgac

SEQ ID NO: 107988 - DNA, 20 bp, human
gacgaccggaagccgcaggt

SEQ ID NO: 107989 - DNA, 20 bp, human
gcgagccctcacgaggccgt

SEQ ID NO: 107990 - DNA, 20 bp, human
gtccagctcgagccctcacg

SEQ ID NO: 107991 - DNA, 20 bp, human
gcggcttccggtcgtaccca

SEQ ID NO: 107992 - DNA, 20 bp, human
ggctacggcccgcaacatcc

SEQ ID NO: 107993 - DNA, 20 bp, human
ggcctcgtgagggctcgagc

SEQ ID NO: 107994 - DNA, 20 bp, human
ggcgcgcgcccaagacccca

SEQ ID NO: 107995 - DNA, 20 bp, human
ggagaggggacaaaataata

SEQ ID NO: 107996 - DNA, 20 bp, human
gggtcttggtggtttcgccg

SEQ ID NO: 107997 - DNA, 20 bp, human
gctccccgggccgcagacca

SEQ ID NO: 107998 - DNA, 20 bp, human
gaggccgcggatcagaaccg

SEQ ID NO: 107999 - DNA, 20 bp, human
ggtgcgcatgctgaaagcag

SEQ ID NO: 108000 - DNA, 20 bp, human
ggtacgaatggaacaagcag

SEQ ID NO: 108001 - DNA, 20 bp, human
gccctgctggaagaccgccc

SEQ ID NO: 108002 - DNA, 20 bp, human
gctactgggagcgactgcta

SEQ ID NO: 108003 - DNA, 20 bp, human
gccgtggggtaggtaaagaa

SEQ ID NO: 108004 - DNA, 20 bp, human
gaagggctccgtgggagagg

SEQ ID NO: 108005 - DNA, 20 bp, human
gaggtaaagaagggctccgt

SEQ ID NO: 108006 - DNA, 20 bp, human
gccccacttacagaagaccg

SEQ ID NO: 108007 - DNA, 20 bp, human
gccggtgacggagactgccc

SEQ ID NO: 108008 - DNA, 20 bp, human
ggaacatggtgaccacacct

SEQ ID NO: 108009 - DNA, 20 bp, human
gaggaaaccgctcccgagag

SEQ ID NO: 108010 - DNA, 20 bp, human
gcttacagaagaccgcggag

SEQ ID NO: 108011 - DNA, 20 bp, human
gcctgtgggtgcctgagaag

SEQ ID NO: 108012 - DNA, 20 bp, human
ggcctccctgcgcggacctg

SEQ ID NO: 108013 - DNA, 20 bp, human
ggacggagactgcccaggtg

SEQ ID NO: 108014 - DNA, 20 bp, human
gccggacgctgtggtcctga

SEQ ID NO: 108015 - DNA, 20 bp, human
gtcattgcccctctcgggag

SEQ ID NO: 108016 - DNA, 20 bp, human
gtaccggctgcgggcgattc

SEQ ID NO: 108017 - DNA, 20 bp, human
gtcttggctggatccctgtt

SEQ ID NO: 108018 - DNA, 20 bp, human
gctactcgtggggcccaaca

SEQ ID NO: 108019 - DNA, 20 bp, human
ggaacaagcacggctgggtc

SEQ ID NO: 108020 - DNA, 20 bp, human
gtcgcccgcagccggtactg

SEQ ID NO: 108021 - DNA, 20 bp, human
gttgggccccacgagtaggt

SEQ ID NO: 108022 - DNA, 20 bp, human
gacgctgccgacctactcgt

SEQ ID NO: 108023 - DNA, 20 bp, human
ggtcccgcagtaccggctgc

SEQ ID NO: 108024 - DNA, 20 bp, human
gtcacgcgggcagtgaagag

SEQ ID NO: 108025 - DNA, 20 bp, human
ggcgggacccactgcggata

SEQ ID NO: 108026 - DNA, 20 bp, human
gccatcttcaccttcgccta

SEQ ID NO: 108027 - DNA, 20 bp, human
gcaaggttaaaggtcgtgaa

SEQ ID NO: 108028 - DNA, 20 bp, human
gaacccaaagcggccgccgt

SEQ ID NO: 108029 - DNA, 20 bp, human
ggcctctaaatcagaaagtt

SEQ ID NO: 108030 - DNA, 20 bp, human
gggcccgcgtgagtccgagt

SEQ ID NO: 108031 - DNA, 20 bp, human
ggagtcgggggacttggtac

SEQ ID NO: 108032 - DNA, 20 bp, human
gtcttcaccttcgcctacgg

SEQ ID NO: 108033 - DNA, 20 bp, human
gcagagaaactggaacggag

SEQ ID NO: 108034 - DNA, 20 bp, human
gcggcaaatgcgtgacacac

SEQ ID NO: 108035 - DNA, 20 bp, human
ggttaaaggtcgtgaatggc

SEQ ID NO: 108036 - DNA, 20 bp, human
gagaagacggctcccttacc

SEQ ID NO: 108037 - DNA, 20 bp, human
ggagagcgtgcggccgggta

SEQ ID NO: 108038 - DNA, 20 bp, human
gtgccagtgcgcagacgcag

SEQ ID NO: 108039 - DNA, 20 bp, human
ggacccctgacctgagaaga

SEQ ID NO: 108040 - DNA, 20 bp, human
ggacccctgcgtctgcgcac

SEQ ID NO: 108041 - DNA, 20 bp, human
gccggccgcacgctctcacc

SEQ ID NO: 108042 - DNA, 20 bp, human
gggcgccgggtgagagcgtg

SEQ ID NO: 108043 - DNA, 20 bp, human
gcccggcccttagggttcag

SEQ ID NO: 108044 - DNA, 20 bp, human
gcggggccgctgaaccctaa

SEQ ID NO: 108045 - DNA, 20 bp, human
gaagcaggggcgggcgaccg

SEQ ID NO: 108046 - DNA, 20 bp, human
gggtccaggtggaggtcttg

SEQ ID NO: 108047 - DNA, 20 bp, human
gaagtgcatcttccccgcaa

SEQ ID NO: 108048 - DNA, 20 bp, human
gtgaggctatcagatcggta

SEQ ID NO: 108049 - DNA, 20 bp, human
gggccctgcgcgcggcaaca

SEQ ID NO: 108050 - DNA, 20 bp, human
gcctgcgcgcggcaacatgg

SEQ ID NO: 108051 - DNA, 20 bp, human
gctcgagaaggcggcaacgg

SEQ ID NO: 108052 - DNA, 20 bp, human
gtagcctcaagacctccacc

SEQ ID NO: 108053 - DNA, 20 bp, human
gatctcgtacaccctatcca

SEQ ID NO: 108054 - DNA, 20 bp, human
gtggggcctcaccctcgaga

SEQ ID NO: 108055 - DNA, 20 bp, human
gagccacagagggtcggggt

SEQ ID NO: 108056 - DNA, 20 bp, human
gacagcgcggctcgccacca

SEQ ID NO: 108057 - DNA, 20 bp, human
ggcgtccccagcatccacaa

SEQ ID NO: 108058 - DNA, 20 bp, human
gtcgcaggccggagggaaga

SEQ ID NO: 108059 - DNA, 20 bp, human
gggcgccgccatcttccctc

SEQ ID NO: 108060 - DNA, 20 bp, human
gtgcggggcgactggagcag

SEQ ID NO: 108061 - DNA, 20 bp, human
gcagcgcccggggaaaacgc

SEQ ID NO: 108062 - DNA, 20 bp, human
gacctgtgcccgggtcctag

SEQ ID NO: 108063 - DNA, 20 bp, human
ggctgtgcgagtgtcggaga

SEQ ID NO: 108064 - DNA, 20 bp, human
gcctccggcctgcgacactg

SEQ ID NO: 108065 - DNA, 20 bp, human
gcgacttgagcaacctggag

SEQ ID NO: 108066 - DNA, 20 bp, human
gacggttctcaccgctgcta

SEQ ID NO: 108067 - DNA, 20 bp, human
gtctggctggtcgcacccgg

SEQ ID NO: 108068 - DNA, 20 bp, human
gtatcccaaaggccaaatca

SEQ ID NO: 108069 - DNA, 20 bp, human
gcaaatcagggaacctgcca

SEQ ID NO: 108070 - DNA, 20 bp, human
ggttctcaccgctgctatgg

SEQ ID NO: 108071 - DNA, 20 bp, human
gctatggaggcgctggccat

SEQ ID NO: 108072 - DNA, 20 bp, human
gaacgtgcgctgcttcccag

SEQ ID NO: 108073 - DNA, 20 bp, human
gggtcgctcttgcacagctt

SEQ ID NO: 108074 - DNA, 20 bp, human
ggggagcgaggcctagatag

SEQ ID NO: 108075 - DNA, 20 bp, human
gaccgctgctatggaggcgc

SEQ ID NO: 108076 - DNA, 20 bp, human
gccttgacctcccgcggcgt

SEQ ID NO: 108077 - DNA, 20 bp, human
gcggaggcgggacccaaagt

SEQ ID NO: 108078 - DNA, 20 bp, human
ggcctaccggcagccaggtg

SEQ ID NO: 108079 - DNA, 20 bp, human
gagcgagggtaaggcaaccg

SEQ ID NO: 108080 - DNA, 20 bp, human
ggcctcacctggctgccggt

SEQ ID NO: 108081 - DNA, 20 bp, human
ggctgtaatggtgaactgag

SEQ ID NO: 108082 - DNA, 20 bp, human
gcaggtggcgagcgagggta

SEQ ID NO: 108083 - DNA, 20 bp, human
ggcgatgctgcagttcgtcc

SEQ ID NO: 108084 - DNA, 20 bp, human
ggcactgggcgtcgatgagt

SEQ ID NO: 108085 - DNA, 20 bp, human
gcgcggtggcgaaaacatcg

SEQ ID NO: 108086 - DNA, 20 bp, human
gcgcagcacggaggccgtca

SEQ ID NO: 108087 - DNA, 20 bp, human
gtagccctgcgcccgactag

SEQ ID NO: 108088 - DNA, 20 bp, human
ggagatacttcgcagcacgg

SEQ ID NO: 108089 - DNA, 20 bp, human
gccgcactcacccgctagtc

SEQ ID NO: 108090 - DNA, 20 bp, human
ggcaggaccgctgctcgcca

SEQ ID NO: 108091 - DNA, 20 bp, human
ggcggcgagggtagccatga

SEQ ID NO: 108092 - DNA, 20 bp, human
gggcaccgcgggccggactg

SEQ ID NO: 108093 - DNA, 20 bp, human
gcacccgctagtcgggcgca

SEQ ID NO: 108094 - DNA, 20 bp, human
gccctgggcactccgctatc

SEQ ID NO: 108095 - DNA, 20 bp, human
gtatgacagcaaggtcaacg

SEQ ID NO: 108096 - DNA, 20 bp, human
ggggcgaggtagctcacgta

SEQ ID NO: 108097 - DNA, 20 bp, human
gagagctgcgcggccgtcag

SEQ ID NO: 108098 - DNA, 20 bp, human
gggcgtctcctcgctctcag

SEQ ID NO: 108099 - DNA, 20 bp, human
gggccgcttggagctcgtgt

SEQ ID NO: 108100 - DNA, 20 bp, human
gagcaaggtcgaggccgggt

SEQ ID NO: 108101 - DNA, 20 bp, human
gtcgtcgtcccggatctgac

SEQ ID NO: 108102 - DNA, 20 bp, human
ggcgacgcagcggtcggaag

SEQ ID NO: 108103 - DNA, 20 bp, human
gcgagggtgaccgggcagga

SEQ ID NO: 108104 - DNA, 20 bp, human
gccacctggcggacgaacac

SEQ ID NO: 108105 - DNA, 20 bp, human
ggcgggccctggactcgaga

SEQ ID NO: 108106 - DNA, 20 bp, human
gtcctcgacaggaggagtag

SEQ ID NO: 108107 - DNA, 20 bp, human
gcgtccgccagggaacaaag

SEQ ID NO: 108108 - DNA, 20 bp, human
gtcgtggtgagaagccgtca

SEQ ID NO: 108109 - DNA, 20 bp, human
gagggaagcggttaccttga

SEQ ID NO: 108110 - DNA, 20 bp, human
gcgaggaagtcctcgacagg

SEQ ID NO: 108111 - DNA, 20 bp, human
gctctgggcttcggacagag

SEQ ID NO: 108112 - DNA, 20 bp, human
gtccccacgggcgtccgcca

SEQ ID NO: 108113 - DNA, 20 bp, human
gcgaggacttcctcgaaact

SEQ ID NO: 108114 - DNA, 20 bp, human
gtcttctgcaggaaggacaa

SEQ ID NO: 108115 - DNA, 20 bp, human
ggaaacgcgcagccacatgc

SEQ ID NO: 108116 - DNA, 20 bp, human
gccgcggagcctaagcagcg

SEQ ID NO: 108117 - DNA, 20 bp, human
ggggactccgagccgcttct

SEQ ID NO: 108118 - DNA, 20 bp, human
ggaggtggcaacgactcccc

SEQ ID NO: 108119 - DNA, 20 bp, human
ggtaggtcgcccccagtcag

SEQ ID NO: 108120 - DNA, 20 bp, human
gtggcaacgactccccgggt

SEQ ID NO: 108121 - DNA, 20 bp, human
ggtgcgaccaagcgagaagg

SEQ ID NO: 108122 - DNA, 20 bp, human
gttcgcccgacggaatccag

SEQ ID NO: 108123 - DNA, 20 bp, human
gctccaagctgtagctatga

SEQ ID NO: 108124 - DNA, 20 bp, human
gagctacagcttggaggccg

SEQ ID NO: 108125 - DNA, 20 bp, human
gccgttaactggcagaagag

SEQ ID NO: 108126 - DNA, 20 bp, human
gggtggcggtcgcagacact

SEQ ID NO: 108127 - DNA, 20 bp, human
gggtggctcctaccggcgca

SEQ ID NO: 108128 - DNA, 20 bp, human
gcgccggtaggagccacctc

SEQ ID NO: 108129 - DNA, 20 bp, human
gccgcgggcggtagagcttc

SEQ ID NO: 108130 - DNA, 20 bp, human
ggctcctaccggcgcacggg

SEQ ID NO: 108131 - DNA, 20 bp, human
gaccctgagacctcttcccg

SEQ ID NO: 108132 - DNA, 20 bp, human
gcagtagccaaaatcctaaa

SEQ ID NO: 108133 - DNA, 20 bp, human
gacctcgggaagaggtctca

SEQ ID NO: 108134 - DNA, 20 bp, human
ggggggcgactggagccagg

SEQ ID NO: 108135 - DNA, 20 bp, human
gattgcacgagagaaaacga

SEQ ID NO: 108136 - DNA, 20 bp, human
gcaagagaacccttgaggta

SEQ ID NO: 108137 - DNA, 20 bp, human
gacaggagaggacagagtcg

SEQ ID NO: 108138 - DNA, 20 bp, human
ggagggtttattggtcagtt

SEQ ID NO: 108139 - DNA, 20 bp, human
ggtcctctcctgtagcccct

SEQ ID NO: 108140 - DNA, 20 bp, human
ggtttttgggctggtggttt

SEQ ID NO: 108141 - DNA, 20 bp, human
ggagaacccttgaggtatgg

SEQ ID NO: 108142 - DNA, 20 bp, human
gcttgtttatcgaggttttt

SEQ ID NO: 108143 - DNA, 20 bp, human
gttgggctggtggtttcggc

SEQ ID NO: 108144 - DNA, 20 bp, human
gaataaaccctcgaaagatc

SEQ ID NO: 108145 - DNA, 20 bp, human
gagatctcctgatctttcga

SEQ ID NO: 108146 - DNA, 20 bp, human
gcgtaaggcggacgctgtta

SEQ ID NO: 108147 - DNA, 20 bp, human
gcggcggttcgagaggctct

SEQ ID NO: 108148 - DNA, 20 bp, human
gaggcggacgctgttagggg

SEQ ID NO: 108149 - DNA, 20 bp, human
ggatggcggcgcccgtaagg

SEQ ID NO: 108150 - DNA, 20 bp, human
gaacagagtaggcttatcat

SEQ ID NO: 108151 - DNA, 20 bp, human
gcttcctgcaatggggtcaa

SEQ ID NO: 108152 - DNA, 20 bp, human
gaaagatggcggcgcccgta

SEQ ID NO: 108153 - DNA, 20 bp, human
gacggcttggagactacagg

SEQ ID NO: 108154 - DNA, 20 bp, human
gatctccaaagagttgtcta

SEQ ID NO: 108155 - DNA, 20 bp, human
ggggttggcggcggttcgag

SEQ ID NO: 108156 - DNA, 20 bp, human
gtccggctctgccatccagg

SEQ ID NO: 108157 - DNA, 20 bp, human
ggcagagccggagcccactt

SEQ ID NO: 108158 - DNA, 20 bp, human
gagtacagaagcatcctctt

SEQ ID NO: 108159 - DNA, 20 bp, human
gccggaagtgacgctatcgt

SEQ ID NO: 108160 - DNA, 20 bp, human
gtgaggagttattaacgatc

SEQ ID NO: 108161 - DNA, 20 bp, human
ggaggtgagcgacttctcca

SEQ ID NO: 108162 - DNA, 20 bp, human
gaacatggctgcggccggtt

SEQ ID NO: 108163 - DNA, 20 bp, human
ggaacaactcaagaatggaa

SEQ ID NO: 108164 - DNA, 20 bp, human
gttatgcgaaaacatggctg

SEQ ID NO: 108165 - DNA, 20 bp, human
ggcgaaaacatggctgcggc

SEQ ID NO: 108166 - DNA, 20 bp, human
gccctgcagccgcgttccca

SEQ ID NO: 108167 - DNA, 20 bp, human
gttcagacgccctgggaacg

SEQ ID NO: 108168 - DNA, 20 bp, human
ggggcgtctgaaaacactga

SEQ ID NO: 108169 - DNA, 20 bp, human
gagaggccgcgcagcagcaa

SEQ ID NO: 108170 - DNA, 20 bp, human
ggaatcacgacaccaggata

SEQ ID NO: 108171 - DNA, 20 bp, human
gggcggcgcgcggacatccg

SEQ ID NO: 108172 - DNA, 20 bp, human
gtggcggacggtgcagagag

SEQ ID NO: 108173 - DNA, 20 bp, human
gttgctgctgcacctggtca

SEQ ID NO: 108174 - DNA, 20 bp, human
gatccggggatgagacactg

SEQ ID NO: 108175 - DNA, 20 bp, human
ggtgtgggcgtggcacgggt

SEQ ID NO: 108176 - DNA, 20 bp, human
gcgcagcgtagcccggaaca

SEQ ID NO: 108177 - DNA, 20 bp, human
gccgcagccccgctggacac

SEQ ID NO: 108178 - DNA, 20 bp, human
gaggcagctcgcgcaggacg

SEQ ID NO: 108179 - DNA, 20 bp, human
gagttgcgcgcacagaaggc

SEQ ID NO: 108180 - DNA, 20 bp, human
ggagggaaaatggtagactg

SEQ ID NO: 108181 - DNA, 20 bp, human
gggagaaccggtgtccagcg

SEQ ID NO: 108182 - DNA, 20 bp, human
gcaaaactaaggccccaagt

SEQ ID NO: 108183 - DNA, 20 bp, human
gagacagttgcgcgcacaga

SEQ ID NO: 108184 - DNA, 20 bp, human
gggagctgagggcatcgcgt

SEQ ID NO: 108185 - DNA, 20 bp, human
gatcgaaaacggcaaaacta

SEQ ID NO: 108186 - DNA, 20 bp, human
ggcgcgtcactgctggctga

SEQ ID NO: 108187 - DNA, 20 bp, human
gcccgcgcctgatcagagca

SEQ ID NO: 108188 - DNA, 20 bp, human
gatcaggcgcgggaccacga

SEQ ID NO: 108189 - DNA, 20 bp, human
gatggcggcgcgatctgtgt

SEQ ID NO: 108190 - DNA, 20 bp, human
gggacaaggaggtccggtta

SEQ ID NO: 108191 - DNA, 20 bp, human
ggatcagagcaaggacaagg

SEQ ID NO: 108192 - DNA, 20 bp, human
gctcaactcgggaccctaac

SEQ ID NO: 108193 - DNA, 20 bp, human
gggtctgggcgcgtcactgc

SEQ ID NO: 108194 - DNA, 20 bp, human
gtgtttgcagacaacacact

SEQ ID NO: 108195 - DNA, 20 bp, human
ggaagcactcattgagtggt

SEQ ID NO: 108196 - DNA, 20 bp, human
gcggaccggaagcactgagg

SEQ ID NO: 108197 - DNA, 20 bp, human
gtgaaggacgccaaagaaag

SEQ ID NO: 108198 - DNA, 20 bp, human
gaggcgaagacagccatctt

SEQ ID NO: 108199 - DNA, 20 bp, human
ggccatcttgggccttaccc

SEQ ID NO: 108200 - DNA, 20 bp, human
ggcccacagctgcctgggta

SEQ ID NO: 108201 - DNA, 20 bp, human
gcagtcacccccaggaaagg

SEQ ID NO: 108202 - DNA, 20 bp, human
ggcctgggtaaggcccaaga

SEQ ID NO: 108203 - DNA, 20 bp, human
gtaagacttgaccttcgacg

SEQ ID NO: 108204 - DNA, 20 bp, human
gcaacttcacacgagtacta

SEQ ID NO: 108205 - DNA, 20 bp, human
gtctctggccagcagaaata

SEQ ID NO: 108206 - DNA, 20 bp, human
gcactgcagcgtagccgctt

SEQ ID NO: 108207 - DNA, 20 bp, human
gggccacgcgcgacgctatc

SEQ ID NO: 108208 - DNA, 20 bp, human
gcagtgagtgggtatagata

SEQ ID NO: 108209 - DNA, 20 bp, human
gatgcgggtaagcgctgatc

SEQ ID NO: 108210 - DNA, 20 bp, human
gcaaagggcccccgagtcca

SEQ ID NO: 108211 - DNA, 20 bp, human
gtagagggaacgcccctgga

SEQ ID NO: 108212 - DNA, 20 bp, human
gcggggagctgggggtatca

SEQ ID NO: 108213 - DNA, 20 bp, human
gcctgggatgagggcacctg

SEQ ID NO: 108214 - DNA, 20 bp, human
gctggcagttaactccactg

SEQ ID NO: 108215 - DNA, 20 bp, human
ggagctgggggtatcaaggt

SEQ ID NO: 108216 - DNA, 20 bp, human
gtccggggcggaggtcacca

SEQ ID NO: 108217 - DNA, 20 bp, human
gcgtctgcaggaaggtccta

SEQ ID NO: 108218 - DNA, 20 bp, human
ggcctgcacgagttcttccg

SEQ ID NO: 108219 - DNA, 20 bp, human
gtcctacggtggaaaaacag

SEQ ID NO: 108220 - DNA, 20 bp, human
gtccctggcccggatgtggg

SEQ ID NO: 108221 - DNA, 20 bp, human
ggaacaagactagatcagag

SEQ ID NO: 108222 - DNA, 20 bp, human
gctgcaggaaggtcctacgg

SEQ ID NO: 108223 - DNA, 20 bp, human
gcggtgggcttggtggagac

SEQ ID NO: 108224 - DNA, 20 bp, human
gcttggctcggcttggtctg

SEQ ID NO: 108225 - DNA, 20 bp, human
gcaggcgatgcccgtctcct

SEQ ID NO: 108226 - DNA, 20 bp, human
gcccccagccggcccacgtc

SEQ ID NO: 108227 - DNA, 20 bp, human
gagctgcccgcaatacgtca

SEQ ID NO: 108228 - DNA, 20 bp, human
gcgtccgggtagccccgaaa

SEQ ID NO: 108229 - DNA, 20 bp, human
ggcgcaggcgcgggttggaa

SEQ ID NO: 108230 - DNA, 20 bp, human
gctggggaggtcatgaactt

SEQ ID NO: 108231 - DNA, 20 bp, human
gggtcgccatgacgtattgc

SEQ ID NO: 108232 - DNA, 20 bp, human
ggccaggagtcttccggaag

SEQ ID NO: 108233 - DNA, 20 bp, human
gactgtagcgattggaccca

SEQ ID NO: 108234 - DNA, 20 bp, human
ggcctgcgcagtgaaacgcg

SEQ ID NO: 108235 - DNA, 20 bp, human
ggtagccccgaaaaggcgtt

SEQ ID NO: 108236 - DNA, 20 bp, human
ggggaggcgctgtaccctcc

SEQ ID NO: 108237 - DNA, 20 bp, human
gtccctggtcttagttccac

SEQ ID NO: 108238 - DNA, 20 bp, human
gcccggtggaactaagacca

SEQ ID NO: 108239 - DNA, 20 bp, human
ggaggccacgcaggagatca

SEQ ID NO: 108240 - DNA, 20 bp, human
gcctgactcccgctgcccgg

SEQ ID NO: 108241 - DNA, 20 bp, human
gtcgtgtgggccgggaacag

SEQ ID NO: 108242 - DNA, 20 bp, human
gcgcctgccagtgacgtcgt

SEQ ID NO: 108243 - DNA, 20 bp, human
gtcctgcgtggcctcgtccc

SEQ ID NO: 108244 - DNA, 20 bp, human
gggaactaagaccagggacg

SEQ ID NO: 108245 - DNA, 20 bp, human
gtgcggaggggtctgaggac

SEQ ID NO: 108246 - DNA, 20 bp, human
gaggcgtccaggagctactg

SEQ ID NO: 108247 - DNA, 20 bp, human
gcgggcgccgccatgttcac

SEQ ID NO: 108248 - DNA, 20 bp, human
gctgcccggggccgtgacaa

SEQ ID NO: 108249 - DNA, 20 bp, human
gcgcccgttgtcacggcccc

SEQ ID NO: 108250 - DNA, 20 bp, human
gggcacagaatgagacctga

SEQ ID NO: 108251 - DNA, 20 bp, human
gcgcgtctataagctggtgg

SEQ ID NO: 108252 - DNA, 20 bp, human
gcgccagggcacggtcatcg

SEQ ID NO: 108253 - DNA, 20 bp, human
gctggcggccaggaaagcga

SEQ ID NO: 108254 - DNA, 20 bp, human
gacagaatgagacctgaggg

SEQ ID NO: 108255 - DNA, 20 bp, human
gacgcagtcggtggagagta

SEQ ID NO: 108256 - DNA, 20 bp, human
gcctctggcaggtactggat

SEQ ID NO: 108257 - DNA, 20 bp, human
ggtcgggaccggcaagatgg

SEQ ID NO: 108258 - DNA, 20 bp, human
gcggcgcctctggcaggtac

SEQ ID NO: 108259 - DNA, 20 bp, human
ggcaggtactggattggcta

SEQ ID NO: 108260 - DNA, 20 bp, human
gccccggaagcaatcctgag

SEQ ID NO: 108261 - DNA, 20 bp, human
ggaggtcgggaccggcaaga

SEQ ID NO: 108262 - DNA, 20 bp, human
gtggattggctagggagact

SEQ ID NO: 108263 - DNA, 20 bp, human
gaatcctgagaggtcgggac

SEQ ID NO: 108264 - DNA, 20 bp, human
gagtgagtccaggcaaagat

SEQ ID NO: 108265 - DNA, 20 bp, human
gagcgttcggtgctgtgtgc

SEQ ID NO: 108266 - DNA, 20 bp, human
gctgcagacggaaactgact

SEQ ID NO: 108267 - DNA, 20 bp, human
ggggtcaattcaagtcatgc

SEQ ID NO: 108268 - DNA, 20 bp, human
gatgcaggctgtgagaaacg

SEQ ID NO: 108269 - DNA, 20 bp, human
gggtggcggtgggctcgagg

SEQ ID NO: 108270 - DNA, 20 bp, human
gtctgactctggagggtgtc

SEQ ID NO: 108271 - DNA, 20 bp, human
gcggccgggaccatctgcac

SEQ ID NO: 108272 - DNA, 20 bp, human
gcgcggggtcgcggttcctg

SEQ ID NO: 108273 - DNA, 20 bp, human
gtggctcaagggacacgagt

SEQ ID NO: 108274 - DNA, 20 bp, human
ggacatagctgaaaattcac

SEQ ID NO: 108275 - DNA, 20 bp, human
gcactggttctgactctgga

SEQ ID NO: 108276 - DNA, 20 bp, human
gtgtccgcgacctcaccttt

SEQ ID NO: 108277 - DNA, 20 bp, human
gcctgtggttagacctatag

SEQ ID NO: 108278 - DNA, 20 bp, human
gccgacctcacaggacctaa

SEQ ID NO: 108279 - DNA, 20 bp, human
gctcacaggacctaaaggtg

SEQ ID NO: 108280 - DNA, 20 bp, human
ggtgaggtcggtggaatcct

SEQ ID NO: 108281 - DNA, 20 bp, human
gggacctaaaggtgaggtcg

SEQ ID NO: 108282 - DNA, 20 bp, human
gcacggatagcgcccggaag

SEQ ID NO: 108283 - DNA, 20 bp, human
gcggagccccgagggaaacg

SEQ ID NO: 108284 - DNA, 20 bp, human
gcctaacttgtggtaagtgg

SEQ ID NO: 108285 - DNA, 20 bp, human
gggtagatttggaggacccc

SEQ ID NO: 108286 - DNA, 20 bp, human
gtttgtagcggacaacatgg

SEQ ID NO: 108287 - DNA, 20 bp, human
gcagagccgtgggggacccg

SEQ ID NO: 108288 - DNA, 20 bp, human
ggcccaagcgcggaagaggg

SEQ ID NO: 108289 - DNA, 20 bp, human
ggctagggagatggaaaact

SEQ ID NO: 108290 - DNA, 20 bp, human
gagcagcgagcccagcatga

SEQ ID NO: 108291 - DNA, 20 bp, human
gacatggcggccttcatgct

SEQ ID NO: 108292 - DNA, 20 bp, human
ggatggaaaactaggagagt

SEQ ID NO: 108293 - DNA, 20 bp, human
gtgggatggccgggaagcaa

SEQ ID NO: 108294 - DNA, 20 bp, human
gtagtttgtagcggacaaca

SEQ ID NO: 108295 - DNA, 20 bp, human
ggcggacgttcaagcaggtc

SEQ ID NO: 108296 - DNA, 20 bp, human
gttacccaggtcctagtacc

SEQ ID NO: 108297 - DNA, 20 bp, human
ggtccgtgccgcaaagcgaa

SEQ ID NO: 108298 - DNA, 20 bp, human
gggcacggaccgggttacat

SEQ ID NO: 108299 - DNA, 20 bp, human
gcgtgccgcaaagcgaacgg

SEQ ID NO: 108300 - DNA, 20 bp, human
gagaagcgcatagaccgtgg

SEQ ID NO: 108301 - DNA, 20 bp, human
gcggcgggcgtagggaaaca

SEQ ID NO: 108302 - DNA, 20 bp, human
ggcccaggatcgaccaatcg

SEQ ID NO: 108303 - DNA, 20 bp, human
gggcggacgggcaatgcgag

SEQ ID NO: 108304 - DNA, 20 bp, human
ggagtaggggagatatacag

SEQ ID NO: 108305 - DNA, 20 bp, human
gtaaggaagcacaggagtag

SEQ ID NO: 108306 - DNA, 20 bp, human
gttttcgggcttgtaccgct

SEQ ID NO: 108307 - DNA, 20 bp, human
ggacgttccgggcggtcacg

SEQ ID NO: 108308 - DNA, 20 bp, human
ggaacctgcaagccgacacc

SEQ ID NO: 108309 - DNA, 20 bp, human
ggtggcccgatgactcactg

SEQ ID NO: 108310 - DNA, 20 bp, human
gcagctctacggccttggca

SEQ ID NO: 108311 - DNA, 20 bp, human
gaccaggccgcaccgccaag

SEQ ID NO: 108312 - DNA, 20 bp, human
gcccgcacgcaccagctcta

SEQ ID NO: 108313 - DNA, 20 bp, human
gtggctggactggccaagag

SEQ ID NO: 108314 - DNA, 20 bp, human
gagcagctaaggctccgaca

SEQ ID NO: 108315 - DNA, 20 bp, human
gacccaaacccaccccgcat

SEQ ID NO: 108316 - DNA, 20 bp, human
gggcgtcacgccgtacgcat

SEQ ID NO: 108317 - DNA, 20 bp, human
ggcaggtggctgcatagtct

SEQ ID NO: 108318 - DNA, 20 bp, human
ggcggaggtgagtctcgtgg

SEQ ID NO: 108319 - DNA, 20 bp, human
gggctgcatagtcttggcgg

SEQ ID NO: 108320 - DNA, 20 bp, human
ggaggtgagtctcgtggtgg

SEQ ID NO: 108321 - DNA, 20 bp, human
gagcgccggtcgcagcggga

SEQ ID NO: 108322 - DNA, 20 bp, human
gttggcggaggtgagtctcg

SEQ ID NO: 108323 - DNA, 20 bp, human
gggtggctgcatagtcttgg

SEQ ID NO: 108324 - DNA, 20 bp, human
gtcccccggcagcaataccc

SEQ ID NO: 108325 - DNA, 20 bp, human
gcacagaacgctcaatacca

SEQ ID NO: 108326 - DNA, 20 bp, human
gctgtgggcggcttctccgt

SEQ ID NO: 108327 - DNA, 20 bp, human
gggtaggaaggagcgcaccg

SEQ ID NO: 108328 - DNA, 20 bp, human
gcgggcccgctagtagccca

SEQ ID NO: 108329 - DNA, 20 bp, human
gtctggtgtccggctgtggg

SEQ ID NO: 108330 - DNA, 20 bp, human
gagacactaaacctgtccta

SEQ ID NO: 108331 - DNA, 20 bp, human
gggaaatggacgagaggtca

SEQ ID NO: 108332 - DNA, 20 bp, human
gatggcggccctcaaggctc

SEQ ID NO: 108333 - DNA, 20 bp, human
gcttctccgtgggctactag

SEQ ID NO: 108334 - DNA, 20 bp, human
ggcgattcggagaacatgga

SEQ ID NO: 108335 - DNA, 20 bp, human
gaatcggacgaaggaaaggt

SEQ ID NO: 108336 - DNA, 20 bp, human
gataggaagccgcctcagca

SEQ ID NO: 108337 - DNA, 20 bp, human
gtcctgggcgtacgtcaaga

SEQ ID NO: 108338 - DNA, 20 bp, human
gtgggcgtacgtcaagatgg

SEQ ID NO: 108339 - DNA, 20 bp, human
gctcggaagagagatagcat

SEQ ID NO: 108340 - DNA, 20 bp, human
gtcacgcgcacgcgacaggg

SEQ ID NO: 108341 - DNA, 20 bp, human
gagacagctaagacacacgt

SEQ ID NO: 108342 - DNA, 20 bp, human
gtggtcacgcgcacgcgaca

SEQ ID NO: 108343 - DNA, 20 bp, human
gctgaactctgtgagaacct

SEQ ID NO: 108344 - DNA, 20 bp, human
gcatgactgagggtggacag

SEQ ID NO: 108345 - DNA, 20 bp, human
gcgcccaggacaggaattga

SEQ ID NO: 108346 - DNA, 20 bp, human
gacggggtactcgagcccac

SEQ ID NO: 108347 - DNA, 20 bp, human
gagcagcggaaggggccttt

SEQ ID NO: 108348 - DNA, 20 bp, human
gggacccgcgagagtaggtg

SEQ ID NO: 108349 - DNA, 20 bp, human
gacagcaaccacagcggcca

SEQ ID NO: 108350 - DNA, 20 bp, human
gcacatcccgggactcacac

SEQ ID NO: 108351 - DNA, 20 bp, human
gtctctggataatcttagtg

SEQ ID NO: 108352 - DNA, 20 bp, human
ggatttggaacgaaaggaag

SEQ ID NO: 108353 - DNA, 20 bp, human
gagcaaattccagatgtcta

SEQ ID NO: 108354 - DNA, 20 bp, human
gggggcctttcggaacgatt

SEQ ID NO: 108355 - DNA, 20 bp, human
gcaggggaagagcagcggaa

SEQ ID NO: 108356 - DNA, 20 bp, human
ggcggccgaggatgtcgcca

SEQ ID NO: 108357 - DNA, 20 bp, human
gctgccgggcgactccccaa

SEQ ID NO: 108358 - DNA, 20 bp, human
ggcgagtcggaggacagcac

SEQ ID NO: 108359 - DNA, 20 bp, human
gggacagcaccggtaacact

SEQ ID NO: 108360 - DNA, 20 bp, human
gtccgactcgcggatcataa

SEQ ID NO: 108361 - DNA, 20 bp, human
gcacccgcgccgagtattcg

SEQ ID NO: 108362 - DNA, 20 bp, human
gctgctgggaccgtcgtgtg

SEQ ID NO: 108363 - DNA, 20 bp, human
gccagccatggcgacatcct

SEQ ID NO: 108364 - DNA, 20 bp, human
gctgccccgcgtcccagcca

SEQ ID NO: 108365 - DNA, 20 bp, human
gccgggcgaaagaaacccca

SEQ ID NO: 108366 - DNA, 20 bp, human
ggctaggtactgagcgcgcg

SEQ ID NO: 108367 - DNA, 20 bp, human
ggcgaggtgaggagttgtgc

SEQ ID NO: 108368 - DNA, 20 bp, human
gtagtgagaacccttccggt

SEQ ID NO: 108369 - DNA, 20 bp, human
ggtactgagcgcgcgaggtg

SEQ ID NO: 108370 - DNA, 20 bp, human
gcagtacctagcccaccgga

SEQ ID NO: 108371 - DNA, 20 bp, human
gcgctcagtacctagcccac

SEQ ID NO: 108372 - DNA, 20 bp, human
gcgcgtcgccgggcatgaga

SEQ ID NO: 108373 - DNA, 20 bp, human
ggaaggctggcttggcgaga

SEQ ID NO: 108374 - DNA, 20 bp, human
gtgaggagttgtgcagggtt

SEQ ID NO: 108375 - DNA, 20 bp, human
gccggtagtgagaacccttc

SEQ ID NO: 108376 - DNA, 20 bp, human
gagcctcttgaggagttctc

SEQ ID NO: 108377 - DNA, 20 bp, human
ggaacgccccagcgaaagtc

SEQ ID NO: 108378 - DNA, 20 bp, human
gtaggggacgcacacaggag

SEQ ID NO: 108379 - DNA, 20 bp, human
ggcaatacagttgttccgag

SEQ ID NO: 108380 - DNA, 20 bp, human
gtctgcacggagcggaactc

SEQ ID NO: 108381 - DNA, 20 bp, human
gcacagtgctctgcacggag

SEQ ID NO: 108382 - DNA, 20 bp, human
gattgctgtggagcctcttg

SEQ ID NO: 108383 - DNA, 20 bp, human
gcggaacaactgtattgctg

SEQ ID NO: 108384 - DNA, 20 bp, human
gtgataatcatggcgcccct

SEQ ID NO: 108385 - DNA, 20 bp, human
gggcctcggagctgaaccgg

SEQ ID NO: 108386 - DNA, 20 bp, human
ggcagccggctggaaaccgt

SEQ ID NO: 108387 - DNA, 20 bp, human
gaccaggcgcagatcatggc

SEQ ID NO: 108388 - DNA, 20 bp, human
gcggtaccaggcgcagatca

SEQ ID NO: 108389 - DNA, 20 bp, human
gcgagagaagatgctcccta

SEQ ID NO: 108390 - DNA, 20 bp, human
gctgctaccggaaccggaag

SEQ ID NO: 108391 - DNA, 20 bp, human
gggtagcagctagtcacgct

SEQ ID NO: 108392 - DNA, 20 bp, human
gtccgtgaccgaacgtgggt

SEQ ID NO: 108393 - DNA, 20 bp, human
ggctagtcacgctcggtacc

SEQ ID NO: 108394 - DNA, 20 bp, human
gggtcttgcatgacctgata

SEQ ID NO: 108395 - DNA, 20 bp, human
ggtgtgctcccagccgtggt

SEQ ID NO: 108396 - DNA, 20 bp, human
gtccctgcgagtcggaggtg

SEQ ID NO: 108397 - DNA, 20 bp, human
ggagtcgccccactcacccg

SEQ ID NO: 108398 - DNA, 20 bp, human
gtccgcttggcccaagatgg

SEQ ID NO: 108399 - DNA, 20 bp, human
gtggcggcctccgtgtgcag

SEQ ID NO: 108400 - DNA, 20 bp, human
gcgtgtgcagcgggttgctg

SEQ ID NO: 108401 - DNA, 20 bp, human
gaagccggtgacctacgagg

SEQ ID NO: 108402 - DNA, 20 bp, human
ggcaggtccctgcgagtcgg

SEQ ID NO: 108403 - DNA, 20 bp, human
gggcgcgtgtgcctcctcgt

SEQ ID NO: 108404 - DNA, 20 bp, human
gaccgcgggagagcgaacag

SEQ ID NO: 108405 - DNA, 20 bp, human
ggctggggccacgggtgagt

SEQ ID NO: 108406 - DNA, 20 bp, human
gggactagctagcacccgcg

SEQ ID NO: 108407 - DNA, 20 bp, human
gagccgagcagcgacgagaa

SEQ ID NO: 108408 - DNA, 20 bp, human
gcgccggaggaaggagatcc

SEQ ID NO: 108409 - DNA, 20 bp, human
gcacccgcgcggatctcacg

SEQ ID NO: 108410 - DNA, 20 bp, human
gatgggcatggcggcaacgg

SEQ ID NO: 108411 - DNA, 20 bp, human
gagtcgtgacgaggtttggg

SEQ ID NO: 108412 - DNA, 20 bp, human
gtgctcggctcgcggcccgt

SEQ ID NO: 108413 - DNA, 20 bp, human
gggcgaggctgacccgaggg

SEQ ID NO: 108414 - DNA, 20 bp, human
gaggtccagactgaggcgga

SEQ ID NO: 108415 - DNA, 20 bp, human
gagccgcgtgagatccgcgc

SEQ ID NO: 108416 - DNA, 20 bp, human
ggaaccaggcggagaaccgg

SEQ ID NO: 108417 - DNA, 20 bp, human
gtggccgagtctcctcactg

SEQ ID NO: 108418 - DNA, 20 bp, human
gctggaaccaggcggagaac

SEQ ID NO: 108419 - DNA, 20 bp, human
ggcgcgctggcagcaccaga

SEQ ID NO: 108420 - DNA, 20 bp, human
gatcagctcgcggtgctcgg

SEQ ID NO: 108421 - DNA, 20 bp, human
ggcagcaccagaggggcccg

SEQ ID NO: 108422 - DNA, 20 bp, human
gtgctcggcggcgtccttca

SEQ ID NO: 108423 - DNA, 20 bp, human
ggcggagcgcaaggccctga

SEQ ID NO: 108424 - DNA, 20 bp, human
gcctgagggcgcgcacggtc

SEQ ID NO: 108425 - DNA, 20 bp, human
ggttccaggccatcagctcg

SEQ ID NO: 108426 - DNA, 20 bp, human
gggggcctaatgaagctgtc

SEQ ID NO: 108427 - DNA, 20 bp, human
gagctgtccggccaacctgc

SEQ ID NO: 108428 - DNA, 20 bp, human
gatcccgcgccgcactatgg

SEQ ID NO: 108429 - DNA, 20 bp, human
ggatggctgcctccatagtg

SEQ ID NO: 108430 - DNA, 20 bp, human
gagcatcccgcgccgcacta

SEQ ID NO: 108431 - DNA, 20 bp, human
ggtgcggcgcgggatgctcc

SEQ ID NO: 108432 - DNA, 20 bp, human
gcatcttggagcgtaccaaa

SEQ ID NO: 108433 - DNA, 20 bp, human
gatgctcctggcgcggcaag

SEQ ID NO: 108434 - DNA, 20 bp, human
gcgggttacggacagaggaa

SEQ ID NO: 108435 - DNA, 20 bp, human
gctgcctccatagtgcggcg

SEQ ID NO: 108436 - DNA, 20 bp, human
ggactccctctcacccgccc

SEQ ID NO: 108437 - DNA, 20 bp, human
gtttcgcgagcgcgttggag

SEQ ID NO: 108438 - DNA, 20 bp, human
gctgctggggaggcgatcta

SEQ ID NO: 108439 - DNA, 20 bp, human
gagaggtaaagaagtcatgg

SEQ ID NO: 108440 - DNA, 20 bp, human
ggaatgggactcacacggag

SEQ ID NO: 108441 - DNA, 20 bp, human
gctgtgtcggacccgtgctg

SEQ ID NO: 108442 - DNA, 20 bp, human
gcacacaaaaggacaacgaa

SEQ ID NO: 108443 - DNA, 20 bp, human
gcaccaagcacagattctag

SEQ ID NO: 108444 - DNA, 20 bp, human
gcttgcggaggggaggtcaa

SEQ ID NO: 108445 - DNA, 20 bp, human
gtgggcggggtcgggaatag

SEQ ID NO: 108446 - DNA, 20 bp, human
ggcctcggaccgcgtagcaa

SEQ ID NO: 108447 - DNA, 20 bp, human
ggtcgtttctgtagccgtgg

SEQ ID NO: 108448 - DNA, 20 bp, human
ggaatcgcgggcaaagatgg

SEQ ID NO: 108449 - DNA, 20 bp, human
ggatggcggcggccaggtgt

SEQ ID NO: 108450 - DNA, 20 bp, human
gccggaatcgcgggcaaaga

SEQ ID NO: 108451 - DNA, 20 bp, human
gtcgcgggcaaagatggcgg

SEQ ID NO: 108452 - DNA, 20 bp, human
ggaacctgcgctggacctcg

SEQ ID NO: 108453 - DNA, 20 bp, human
gcggtgtgcaatgaaagcct

SEQ ID NO: 108454 - DNA, 20 bp, human
gagcaaaggcctccaacacc

SEQ ID NO: 108455 - DNA, 20 bp, human
gggcagacccgacaggaaca

SEQ ID NO: 108456 - DNA, 20 bp, human
ggttggcccggtaggtcctc

SEQ ID NO: 108457 - DNA, 20 bp, human
gtcggaggatgtacaggacg

SEQ ID NO: 108458 - DNA, 20 bp, human
gaggaagtcggaggatgtac

SEQ ID NO: 108459 - DNA, 20 bp, human
gtgacaagaggaatgaggcg

SEQ ID NO: 108460 - DNA, 20 bp, human
ggagagggcggggacgtgtt

SEQ ID NO: 108461 - DNA, 20 bp, human
gcaggccggaagcggaagag

SEQ ID NO: 108462 - DNA, 20 bp, human
gggaactacacgctccgtga

SEQ ID NO: 108463 - DNA, 20 bp, human
ggtagtagagcacagcgacc

SEQ ID NO: 108464 - DNA, 20 bp, human
ggaaggcgccaggccggaag

SEQ ID NO: 108465 - DNA, 20 bp, human
gggttgcctgaggacctacc

SEQ ID NO: 108466 - DNA, 20 bp, human
gcgagcttggagccgggtag

SEQ ID NO: 108467 - DNA, 20 bp, human
gggaaggtcaggtctaggta

SEQ ID NO: 108468 - DNA, 20 bp, human
gggtgaggaaggtcaggtct

SEQ ID NO: 108469 - DNA, 20 bp, human
gggacgagggcgcgtgggtg

SEQ ID NO: 108470 - DNA, 20 bp, human
gttccgggacgagggcgcgt

SEQ ID NO: 108471 - DNA, 20 bp, human
gcatgatcgagtcaggtgga

SEQ ID NO: 108472 - DNA, 20 bp, human
ggcgctcccgagtcaaacat

SEQ ID NO: 108473 - DNA, 20 bp, human
gaggctgtcggtgactttgg

SEQ ID NO: 108474 - DNA, 20 bp, human
gggaaggcccgccctctacc

SEQ ID NO: 108475 - DNA, 20 bp, human
gtcggcactgtagctttggg

SEQ ID NO: 108476 - DNA, 20 bp, human
ggtgcgtccgcggctgatcg

SEQ ID NO: 108477 - DNA, 20 bp, human
gtcccacctcctgacctcgg

SEQ ID NO: 108478 - DNA, 20 bp, human
ggcggaagaaggtgcgtccg

SEQ ID NO: 108479 - DNA, 20 bp, human
gctcggcccccgaggtcagg

SEQ ID NO: 108480 - DNA, 20 bp, human
gcggtccggccggaagtcac

SEQ ID NO: 108481 - DNA, 20 bp, human
gccagctccgcgatcagccg

SEQ ID NO: 108482 - DNA, 20 bp, human
gcacgcgcaagtcctggctg

SEQ ID NO: 108483 - DNA, 20 bp, human
gcgggtgcggcccgactaca

SEQ ID NO: 108484 - DNA, 20 bp, human
gggcggcccaggccgaagag

SEQ ID NO: 108485 - DNA, 20 bp, human
gctggtgcccaagcacgagg

SEQ ID NO: 108486 - DNA, 20 bp, human
gctcatgaagggtgccgcgg

SEQ ID NO: 108487 - DNA, 20 bp, human
gacaagcggcgttcagtgtc

SEQ ID NO: 108488 - DNA, 20 bp, human
gctgcagagacagccatgct

SEQ ID NO: 108489 - DNA, 20 bp, human
gtggctgtctctgcagtcga

SEQ ID NO: 108490 - DNA, 20 bp, human
gggaataccggcctcatgaa

SEQ ID NO: 108491 - DNA, 20 bp, human
ggacagccatgctgggagcg

SEQ ID NO: 108492 - DNA, 20 bp, human
gcgaggacggcaagccggag

SEQ ID NO: 108493 - DNA, 20 bp, human
gaccggagtggccgagtaga

SEQ ID NO: 108494 - DNA, 20 bp, human
gaacacaggagcaggtcacg

SEQ ID NO: 108495 - DNA, 20 bp, human
gtaccagacgggcctggcag

SEQ ID NO: 108496 - DNA, 20 bp, human
gcgtcactggccctccgcag

SEQ ID NO: 108497 - DNA, 20 bp, human
gggccagtgacggcgcccgc

SEQ ID NO: 108498 - DNA, 20 bp, human
gcggcgatcactggagtccc

SEQ ID NO: 108499 - DNA, 20 bp, human
gcgagaaggggcagtttccg

SEQ ID NO: 108500 - DNA, 20 bp, human
gagcgagccgcggcgatcac

SEQ ID NO: 108501 - DNA, 20 bp, human
gcatcatgacccccgagaag

SEQ ID NO: 108502 - DNA, 20 bp, human
gggacagtgggtcagatcca

SEQ ID NO: 108503 - DNA, 20 bp, human
gggatcccggcagtaggtac

SEQ ID NO: 108504 - DNA, 20 bp, human
gcgacggcgtcggggagtaa

SEQ ID NO: 108505 - DNA, 20 bp, human
gcctaagactaacaaggtcc

SEQ ID NO: 108506 - DNA, 20 bp, human
gcgcaccgcggtcgccatgc

SEQ ID NO: 108507 - DNA, 20 bp, human
gcggctccggcggaaggtgg

SEQ ID NO: 108508 - DNA, 20 bp, human
ggactccagcatggcgaccg

SEQ ID NO: 108509 - DNA, 20 bp, human
gcccgtgctgtgtagcggga

SEQ ID NO: 108510 - DNA, 20 bp, human
gcaacatcaaatgaacccgg

SEQ ID NO: 108511 - DNA, 20 bp, human
ggcctccccgtgctgtgtag

SEQ ID NO: 108512 - DNA, 20 bp, human
gggtcacacagcggctccgg

SEQ ID NO: 108513 - DNA, 20 bp, human
gcagcccacagcgcgcaccg

SEQ ID NO: 108514 - DNA, 20 bp, human
gagagctccgcgacccagag

SEQ ID NO: 108515 - DNA, 20 bp, human
ggccgtcccgctacacagca

SEQ ID NO: 108516 - DNA, 20 bp, human
gagcccgggcttaaaggcgc

SEQ ID NO: 108517 - DNA, 20 bp, human
gtcgccgcctgggagccgtc

SEQ ID NO: 108518 - DNA, 20 bp, human
ggcgtgtgcgcggtccggga

SEQ ID NO: 108519 - DNA, 20 bp, human
gtagaaactgctgcgccgga

SEQ ID NO: 108520 - DNA, 20 bp, human
ggctgcgccggacggctccc

SEQ ID NO: 108521 - DNA, 20 bp, human
ggcgggaagaccggctctga

SEQ ID NO: 108522 - DNA, 20 bp, human
gtgctacctagctctcgaac

SEQ ID NO: 108523 - DNA, 20 bp, human
ggagagctaggtagcaggca

SEQ ID NO: 108524 - DNA, 20 bp, human
gctcccaggcggcgaaagca

SEQ ID NO: 108525 - DNA, 20 bp, human
gggtccgagagcgcgagccc

SEQ ID NO: 108526 - DNA, 20 bp, human
gaggttgcccgaggatggtc

SEQ ID NO: 108527 - DNA, 20 bp, human
gagtgaaggttgcccgagga

SEQ ID NO: 108528 - DNA, 20 bp, human
ggccaggcccgaccatcctc

SEQ ID NO: 108529 - DNA, 20 bp, human
gcgggcaaccttcactgcgg

SEQ ID NO: 108530 - DNA, 20 bp, human
gtggtcaagtgctaacggta

SEQ ID NO: 108531 - DNA, 20 bp, human
gactgcgacggatacaggga

SEQ ID NO: 108532 - DNA, 20 bp, human
gccgttagcacttgaccagg

SEQ ID NO: 108533 - DNA, 20 bp, human
gtcctcgtggccagccaaga

SEQ ID NO: 108534 - DNA, 20 bp, human
gaagtgctaacggtaaggat

SEQ ID NO: 108535 - DNA, 20 bp, human
gccagactgcgacggataca

SEQ ID NO: 108536 - DNA, 20 bp, human
gtacgaaactgctccgccgt

SEQ ID NO: 108537 - DNA, 20 bp, human
gctccgccgtaggacacaca

SEQ ID NO: 108538 - DNA, 20 bp, human
ggctcccacagctaacatgg

SEQ ID NO: 108539 - DNA, 20 bp, human
gcgccctgtgtgtcctacgg

SEQ ID NO: 108540 - DNA, 20 bp, human
gggcgccgccatgttagctg

SEQ ID NO: 108541 - DNA, 20 bp, human
gctggacccaacacagacct

SEQ ID NO: 108542 - DNA, 20 bp, human
gtgggagctccaggaccgga

SEQ ID NO: 108543 - DNA, 20 bp, human
ggcgaggggaacttacctga

SEQ ID NO: 108544 - DNA, 20 bp, human
gccaggaccggaggggtgag

SEQ ID NO: 108545 - DNA, 20 bp, human
gaaggcacgcgagacgctgg

SEQ ID NO: 108546 - DNA, 20 bp, human
gtcacgcggtcagaaagtga

SEQ ID NO: 108547 - DNA, 20 bp, human
ggcccctcgaggccctgtca

SEQ ID NO: 108548 - DNA, 20 bp, human
gtccttgacagggcctcgag

SEQ ID NO: 108549 - DNA, 20 bp, human
gggaaagactcgtgcgacgg

SEQ ID NO: 108550 - DNA, 20 bp, human
ggcgcttaaattcagaccta

SEQ ID NO: 108551 - DNA, 20 bp, human
gtagtaacctgggcgatagc

SEQ ID NO: 108552 - DNA, 20 bp, human
gaccactctgtgccacccag

SEQ ID NO: 108553 - DNA, 20 bp, human
gctggtgagtgtccttgaca

SEQ ID NO: 108554 - DNA, 20 bp, human
gcactcaccagctatcgccc

SEQ ID NO: 108555 - DNA, 20 bp, human
gtaaggaaagactcgtgcga

SEQ ID NO: 108556 - DNA, 20 bp, human
ggggcacacagcgtccgccg

SEQ ID NO: 108557 - DNA, 20 bp, human
ggaggcagggtaaactgcgc

SEQ ID NO: 108558 - DNA, 20 bp, human
gcaggtcgggcggtagcgac

SEQ ID NO: 108559 - DNA, 20 bp, human
ggcgtccggcatgaaggtct

SEQ ID NO: 108560 - DNA, 20 bp, human
ggtgcacagagtctgcaggt

SEQ ID NO: 108561 - DNA, 20 bp, human
ggcaacgggaggacccacag

SEQ ID NO: 108562 - DNA, 20 bp, human
gcagccagcgtccggcatga

SEQ ID NO: 108563 - DNA, 20 bp, human
gggccgcaggcagcaacggg

SEQ ID NO: 108564 - DNA, 20 bp, human
gctgattggaaggagccgag

SEQ ID NO: 108565 - DNA, 20 bp, human
gggtcgcattctgagcgagt

SEQ ID NO: 108566 - DNA, 20 bp, human
gccaagcgcgacaagaaagg

SEQ ID NO: 108567 - DNA, 20 bp, human
gcaagaaaggtgggcgaagg

SEQ ID NO: 108568 - DNA, 20 bp, human
gaatccaagcgcgacaagaa

SEQ ID NO: 108569 - DNA, 20 bp, human
ggcccacggagctcccccca

SEQ ID NO: 108570 - DNA, 20 bp, human
gatcgcgctgaatccacgtg

SEQ ID NO: 108571 - DNA, 20 bp, human
gtgggaaaagtgggccgaaa

SEQ ID NO: 108572 - DNA, 20 bp, human
ggctgtaaaaccgccagagg

SEQ ID NO: 108573 - DNA, 20 bp, human
gcaaggccaactgggtcggg

SEQ ID NO: 108574 - DNA, 20 bp, human
gaccctggggggagctccgt

SEQ ID NO: 108575 - DNA, 20 bp, human
gcggcagcaggcatagccgg

SEQ ID NO: 108576 - DNA, 20 bp, human
gagctgtgcacactttccaa

SEQ ID NO: 108577 - DNA, 20 bp, human
gtcttcggctgggaagcgga

SEQ ID NO: 108578 - DNA, 20 bp, human
ggcccaggttcaaggcagag

SEQ ID NO: 108579 - DNA, 20 bp, human
gtcaaggcagaggggcgtag

SEQ ID NO: 108580 - DNA, 20 bp, human
gagacaggtcatgccagccc

SEQ ID NO: 108581 - DNA, 20 bp, human
gtgcctcttcggctgggaag

SEQ ID NO: 108582 - DNA, 20 bp, human
gcgaagaggcaggttattct

SEQ ID NO: 108583 - DNA, 20 bp, human
gcaggttattctaggatata

SEQ ID NO: 108584 - DNA, 20 bp, human
gttattctaggatatagggg

SEQ ID NO: 108585 - DNA, 20 bp, human
ggggcccacaggaaagctag

SEQ ID NO: 108586 - DNA, 20 bp, human
gtgctagctgcggagttcag

SEQ ID NO: 108587 - DNA, 20 bp, human
gccaaggcctcaaatctcaa

SEQ ID NO: 108588 - DNA, 20 bp, human
gggccttggagactcaggta

SEQ ID NO: 108589 - DNA, 20 bp, human
gcaaatctcaagggctgatt

SEQ ID NO: 108590 - DNA, 20 bp, human
gagttctatgacttaaggag

SEQ ID NO: 108591 - DNA, 20 bp, human
gagctccagtttgaacccaa

SEQ ID NO: 108592 - DNA, 20 bp, human
gaggaggggtgacgatatca

SEQ ID NO: 108593 - DNA, 20 bp, human
gctattaggaagtctgacta

SEQ ID NO: 108594 - DNA, 20 bp, human
gtgatggataaggtatagaa

SEQ ID NO: 108595 - DNA, 20 bp, human
gcccattacattaggaaaat

SEQ ID NO: 108596 - DNA, 20 bp, human
ggagctccggcagcgcaaga

SEQ ID NO: 108597 - DNA, 20 bp, human
gccccatggcaggaacagag

SEQ ID NO: 108598 - DNA, 20 bp, human
gggggctcctccagcaataa

SEQ ID NO: 108599 - DNA, 20 bp, human
gagcaataagggtcagtaac

SEQ ID NO: 108600 - DNA, 20 bp, human
gaccactcaccccaggacct

SEQ ID NO: 108601 - DNA, 20 bp, human
gcaagagggcaaagcacagc

SEQ ID NO: 108602 - DNA, 20 bp, human
ggactgcaagaaaagtgtct

SEQ ID NO: 108603 - DNA, 20 bp, human
gacttgtcgagggccacgag

SEQ ID NO: 108604 - DNA, 20 bp, human
ggttacttaaactcccagaa

SEQ ID NO: 108605 - DNA, 20 bp, human
gtactgacccttattgctgg

SEQ ID NO: 108606 - DNA, 20 bp, human
gataggcaagaacgtatcaa

SEQ ID NO: 108607 - DNA, 20 bp, human
gccaggtaaatatctgatac

SEQ ID NO: 108608 - DNA, 20 bp, human
gatatctgatactggcacac

SEQ ID NO: 108609 - DNA, 20 bp, human
gaatcaatgggcacaaactg

SEQ ID NO: 108610 - DNA, 20 bp, human
gtagagaacagaacccacac

SEQ ID NO: 108611 - DNA, 20 bp, human
ggaggccagttgaaaaatga

SEQ ID NO: 108612 - DNA, 20 bp, human
ggtggctggtctacctgtgt

SEQ ID NO: 108613 - DNA, 20 bp, human
gtatctctcctccaaatcaa

SEQ ID NO: 108614 - DNA, 20 bp, human
gttctgttctctagattgga

SEQ ID NO: 108615 - DNA, 20 bp, human
gtgggttctgttctctagat

SEQ ID NO: 108616 - DNA, 20 bp, human
gcagcacccggccggctctc

SEQ ID NO: 108617 - DNA, 20 bp, human
gctcctggctatccctgtga

SEQ ID NO: 108618 - DNA, 20 bp, human
gagggagtgacggtctgcaa

SEQ ID NO: 108619 - DNA, 20 bp, human
gttctaggccttaatattag

SEQ ID NO: 108620 - DNA, 20 bp, human
gaagccataaagggacacgg

SEQ ID NO: 108621 - DNA, 20 bp, human
gcgcccaggcctagatgaag

SEQ ID NO: 108622 - DNA, 20 bp, human
gtgacggtctgcaatggcaa

SEQ ID NO: 108623 - DNA, 20 bp, human
gtgaagaggaagatcccggc

SEQ ID NO: 108624 - DNA, 20 bp, human
ggggacacggaggctgatta

SEQ ID NO: 108625 - DNA, 20 bp, human
ggttgatgcctctaatatta

SEQ ID NO: 108626 - DNA, 20 bp, human
gagaattagagtaggaccat

SEQ ID NO: 108627 - DNA, 20 bp, human
ggttcctgccagaacgatct

SEQ ID NO: 108628 - DNA, 20 bp, human
gcagagcaccaagatcgttc

SEQ ID NO: 108629 - DNA, 20 bp, human
gactgctctaagaaagggac

SEQ ID NO: 108630 - DNA, 20 bp, human
gctggggatcagctcacctc

SEQ ID NO: 108631 - DNA, 20 bp, human
ggcaccaagatcgttctggc

SEQ ID NO: 108632 - DNA, 20 bp, human
gacgctccaactcacacagg

SEQ ID NO: 108633 - DNA, 20 bp, human
gatcttgcattagaacccca

SEQ ID NO: 108634 - DNA, 20 bp, human
gggtggtcagaatcagagac

SEQ ID NO: 108635 - DNA, 20 bp, human
gctgacgctccaactcacac

SEQ ID NO: 108636 - DNA, 20 bp, human
gcacgctgccaaagcctagg

SEQ ID NO: 108637 - DNA, 20 bp, human
ggcctcatccacctaggctt

SEQ ID NO: 108638 - DNA, 20 bp, human
gtaggtggatgaggccgatg

SEQ ID NO: 108639 - DNA, 20 bp, human
gcagcacgctgccaaagcct

SEQ ID NO: 108640 - DNA, 20 bp, human
gtggttcgccgcggccacgt

SEQ ID NO: 108641 - DNA, 20 bp, human
ggatgaagaagatgcccacg

SEQ ID NO: 108642 - DNA, 20 bp, human
gctgccaaaaaggacgggaa

SEQ ID NO: 108643 - DNA, 20 bp, human
gggcacagcctctcctaggt

SEQ ID NO: 108644 - DNA, 20 bp, human
ggaagatgcccacgtggccg

SEQ ID NO: 108645 - DNA, 20 bp, human
gtgaggatctgcaccgtctg

SEQ ID NO: 108646 - DNA, 20 bp, human
ggcccagggttagcattcag

SEQ ID NO: 108647 - DNA, 20 bp, human
gtgaggaggtcagaacatta

SEQ ID NO: 108648 - DNA, 20 bp, human
gccatgaccgaacaggtgat

SEQ ID NO: 108649 - DNA, 20 bp, human
gggctgcagatgatttccag

SEQ ID NO: 108650 - DNA, 20 bp, human
gcagaggccacagggttgct

SEQ ID NO: 108651 - DNA, 20 bp, human
gggtaagtggtcacctctga

SEQ ID NO: 108652 - DNA, 20 bp, human
gatccagcccagcaaccctg

SEQ ID NO: 108653 - DNA, 20 bp, human
gtatcagcgacagtatccag

SEQ ID NO: 108654 - DNA, 20 bp, human
gtatctggggcaataatgcc

SEQ ID NO: 108655 - DNA, 20 bp, human
ggtgtacagagtcaacccat

SEQ ID NO: 108656 - DNA, 20 bp, human
gcagcctctagggaactatt

SEQ ID NO: 108657 - DNA, 20 bp, human
gaggccatccagatcctcat

SEQ ID NO: 108658 - DNA, 20 bp, human
gaaagagaacccagagaggg

SEQ ID NO: 108659 - DNA, 20 bp, human
gctgacaaccaggtcacaaa

SEQ ID NO: 108660 - DNA, 20 bp, human
gagcgggtaccctgacaacc

SEQ ID NO: 108661 - DNA, 20 bp, human
gcgtcaggccgatgaggatc

SEQ ID NO: 108662 - DNA, 20 bp, human
gcggataatcctccccagag

SEQ ID NO: 108663 - DNA, 20 bp, human
gaggatctggatggcctgca

SEQ ID NO: 108664 - DNA, 20 bp, human
gacccaggaaggagaccata

SEQ ID NO: 108665 - DNA, 20 bp, human
gaaggatagtaatacagcac

SEQ ID NO: 108666 - DNA, 20 bp, human
gcttactgcatgctctgaat

SEQ ID NO: 108667 - DNA, 20 bp, human
gctacctggaaggctcctgt

SEQ ID NO: 108668 - DNA, 20 bp, human
ggcaggggaagtcatagtca

SEQ ID NO: 108669 - DNA, 20 bp, human
gtactgtgtatgtagatctc

SEQ ID NO: 108670 - DNA, 20 bp, human
gctgggtctgacatgtgctg

SEQ ID NO: 108671 - DNA, 20 bp, human
gccagggagagagaaccaca

SEQ ID NO: 108672 - DNA, 20 bp, human
gcccaattcagccatttcta

SEQ ID NO: 108673 - DNA, 20 bp, human
gctcagtcacttagtggcag

SEQ ID NO: 108674 - DNA, 20 bp, human
gagccttccaggtaggtaca

SEQ ID NO: 108675 - DNA, 20 bp, human
gtctaccctcagtcacttag

SEQ ID NO: 108676 - DNA, 20 bp, human
gcttgcgacaaggtggactt

SEQ ID NO: 108677 - DNA, 20 bp, human
ggcgacaaggtggacttggg

SEQ ID NO: 108678 - DNA, 20 bp, human
gggagagggaatctatacct

SEQ ID NO: 108679 - DNA, 20 bp, human
ggagggaatctataccttgg

SEQ ID NO: 108680 - DNA, 20 bp, human
gccttggaggcttcaggctt

SEQ ID NO: 108681 - DNA, 20 bp, human
ggtgtctcctacttgcgaca

SEQ ID NO: 108682 - DNA, 20 bp, human
gtgccagctctgatgatgag

SEQ ID NO: 108683 - DNA, 20 bp, human
gtctcctacttgcgacaagg

SEQ ID NO: 108684 - DNA, 20 bp, human
gagagctggcagacaaactc

SEQ ID NO: 108685 - DNA, 20 bp, human
gaaagaaaggggaatgtcta

SEQ ID NO: 108686 - DNA, 20 bp, human
ggccatcagcccgaaagcct

SEQ ID NO: 108687 - DNA, 20 bp, human
gagatgaggtaactagtcaa

SEQ ID NO: 108688 - DNA, 20 bp, human
gtgtaggtctgatgcatgca

SEQ ID NO: 108689 - DNA, 20 bp, human
gggagtgggggaagttgatt

SEQ ID NO: 108690 - DNA, 20 bp, human
gtctgatgcatgcagggctc

SEQ ID NO: 108691 - DNA, 20 bp, human
gtccaaacatctgctagaag

SEQ ID NO: 108692 - DNA, 20 bp, human
gtaaatgtgcattcggtggg

SEQ ID NO: 108693 - DNA, 20 bp, human
gtcctaggctttcgggctga

SEQ ID NO: 108694 - DNA, 20 bp, human
gcaagttcctcaaagttctt

SEQ ID NO: 108695 - DNA, 20 bp, human
gtttattctctgtgtctgac

SEQ ID NO: 108696 - DNA, 20 bp, human
gactatcagtccgagagcct

SEQ ID NO: 108697 - DNA, 20 bp, human
gagtcttcgctacagttgat

SEQ ID NO: 108698 - DNA, 20 bp, human
gtccaaacatctactagaaa

SEQ ID NO: 108699 - DNA, 20 bp, human
gtgagggttgtgggtggttg

SEQ ID NO: 108700 - DNA, 20 bp, human
gtgcaggtctgatgagtgca

SEQ ID NO: 108701 - DNA, 20 bp, human
gtcccagaaatcctaaaccc

SEQ ID NO: 108702 - DNA, 20 bp, human
gtcctgggtttaggatttct

SEQ ID NO: 108703 - DNA, 20 bp, human
gatctagcacgtgcagaatt

SEQ ID NO: 108704 - DNA, 20 bp, human
gttttgttccgtaagttctc

SEQ ID NO: 108705 - DNA, 20 bp, human
ggatagtttgtttcatttcc

SEQ ID NO: 108706 - DNA, 20 bp, human
ggtgtcggtgataatttgaa

SEQ ID NO: 108707 - DNA, 20 bp, human
gtgagaagaacgaatcatgt

SEQ ID NO: 108708 - DNA, 20 bp, human
ggcggtgcttgaatccatga

SEQ ID NO: 108709 - DNA, 20 bp, human
gtgaaaggagatgatttagt

SEQ ID NO: 108710 - DNA, 20 bp, human
gcttgaatccatgatggtgt

SEQ ID NO: 108711 - DNA, 20 bp, human
gagaaacaccggactgtgtg

SEQ ID NO: 108712 - DNA, 20 bp, human
gggctagggaaattatctgt

SEQ ID NO: 108713 - DNA, 20 bp, human
ggagattactcagactgaga

SEQ ID NO: 108714 - DNA, 20 bp, human
gttggtgggccatttgagag

SEQ ID NO: 108715 - DNA, 20 bp, human
ggcctcagtaaaatatacat

SEQ ID NO: 108716 - DNA, 20 bp, human
gggtttctcagtcccatcaa

SEQ ID NO: 108717 - DNA, 20 bp, human
gtaaacactggaataaggaa

SEQ ID NO: 108718 - DNA, 20 bp, human
ggtcctcagaagctccaaag

SEQ ID NO: 108719 - DNA, 20 bp, human
ggatgactttcagaagatga

SEQ ID NO: 108720 - DNA, 20 bp, human
ggtaagtagaaaccgttgat

SEQ ID NO: 108721 - DNA, 20 bp, human
gcctgtatagctgtaaacac

SEQ ID NO: 108722 - DNA, 20 bp, human
gaggactcagctggaaccaa

SEQ ID NO: 108723 - DNA, 20 bp, human
gtcttggactcataacacat

SEQ ID NO: 108724 - DNA, 20 bp, human
gcttgccgtgacctcattag

SEQ ID NO: 108725 - DNA, 20 bp, human
gggaaccaacgggcacaggt

SEQ ID NO: 108726 - DNA, 20 bp, human
gagcctgaagaaacgtctac

SEQ ID NO: 108727 - DNA, 20 bp, human
gaggcaaaagtcaaagttat

SEQ ID NO: 108728 - DNA, 20 bp, human
gacatgttggagaggggtta

SEQ ID NO: 108729 - DNA, 20 bp, human
gaagggtctccacactcaca

SEQ ID NO: 108730 - DNA, 20 bp, human
gtttctgtaatttgcagtaa

SEQ ID NO: 108731 - DNA, 20 bp, human
ggtccctccagcaaaactta

SEQ ID NO: 108732 - DNA, 20 bp, human
gtttctaagacaatctcctg

SEQ ID NO: 108733 - DNA, 20 bp, human
gctggtcatccttgtgagtg

SEQ ID NO: 108734 - DNA, 20 bp, human
gggagacccttaagttttgc

SEQ ID NO: 108735 - DNA, 20 bp, human
ggaagagatgatgtatgttt

SEQ ID NO: 108736 - DNA, 20 bp, human
gagaattagagtaggaccat

SEQ ID NO: 108737 - DNA, 20 bp, human
ggttcctgccagaacgatct

SEQ ID NO: 108738 - DNA, 20 bp, human
gcagagcaccaagatcgttc

SEQ ID NO: 108739 - DNA, 20 bp, human
gactgctctaagaaagggac

SEQ ID NO: 108740 - DNA, 20 bp, human
gctggggatcagctcacctc

SEQ ID NO: 108741 - DNA, 20 bp, human
ggcaccaagatcgttctggc

SEQ ID NO: 108742 - DNA, 20 bp, human
gacgctccaactcacacagg

SEQ ID NO: 108743 - DNA, 20 bp, human
gatcttgcattagaacccca

SEQ ID NO: 108744 - DNA, 20 bp, human
gggtggtcagaatcagagac

SEQ ID NO: 108745 - DNA, 20 bp, human
gctgacgctccaactcacac

SEQ ID NO: 108746 - DNA, 20 bp, human
gaagggaagccccattgcca

SEQ ID NO: 108747 - DNA, 20 bp, human
gggcgaaccagtgtggatga

SEQ ID NO: 108748 - DNA, 20 bp, human
ggacttacggcgaaccagtg

SEQ ID NO: 108749 - DNA, 20 bp, human
ggcagtgtctgttcattggg

SEQ ID NO: 108750 - DNA, 20 bp, human
gagacactgccttggcaatg

SEQ ID NO: 108751 - DNA, 20 bp, human
gcaaggcagtgtctgttcat

SEQ ID NO: 108752 - DNA, 20 bp, human
gagtggacaagaatcctcca

SEQ ID NO: 108753 - DNA, 20 bp, human
gagcctagaaaattgagcag

SEQ ID NO: 108754 - DNA, 20 bp, human
gaataggatcaagagatacg

SEQ ID NO: 108755 - DNA, 20 bp, human
gggtccccacagcaaagaaa

SEQ ID NO: 108756 - DNA, 20 bp, human
ggcccggccccacgcaccat

SEQ ID NO: 108757 - DNA, 20 bp, human
ggccgctcacgctcgctcga

SEQ ID NO: 108758 - DNA, 20 bp, human
ggtgtgggccccaccaggac

SEQ ID NO: 108759 - DNA, 20 bp, human
gcggccccacgcaccatggg

SEQ ID NO: 108760 - DNA, 20 bp, human
ggctccaagaaagtcaggag

SEQ ID NO: 108761 - DNA, 20 bp, human
ggccttcgagcgagcgtgag

SEQ ID NO: 108762 - DNA, 20 bp, human
gctgagtcgggacgatgtgt

SEQ ID NO: 108763 - DNA, 20 bp, human
gaatggggcctacatctgac

SEQ ID NO: 108764 - DNA, 20 bp, human
gcggcgggcccgcaactgga

SEQ ID NO: 108765 - DNA, 20 bp, human
gcccacgcaccatgggcggg

SEQ ID NO: 108766 - DNA, 20 bp, human
gcgggcagctccgagccaca

SEQ ID NO: 108767 - DNA, 20 bp, human
gcgggacacgcgctcgtaca

SEQ ID NO: 108768 - DNA, 20 bp, human
gggcagtgcggcgggctcgg

SEQ ID NO: 108769 - DNA, 20 bp, human
gagccccgagctgaagagaa

SEQ ID NO: 108770 - DNA, 20 bp, human
gccaggggagaaggagaccg

SEQ ID NO: 108771 - DNA, 20 bp, human
gggaagatggctgcgccctg

SEQ ID NO: 108772 - DNA, 20 bp, human
ggcggcggccgcttggaaga

SEQ ID NO: 108773 - DNA, 20 bp, human
gagggagccggcacggtgtt

SEQ ID NO: 108774 - DNA, 20 bp, human
ggggaaagcacctccatctt

SEQ ID NO: 108775 - DNA, 20 bp, human
gacgcgctcatcgcagtgtg

SEQ ID NO: 108776 - DNA, 20 bp, human
gcggcggcgtccgggctttg

SEQ ID NO: 108777 - DNA, 20 bp, human
gcgtccgggctttgtggccg

SEQ ID NO: 108778 - DNA, 20 bp, human
ggcgccactgagtaccccag

SEQ ID NO: 108779 - DNA, 20 bp, human
gtactcaccgagtcccatcg

SEQ ID NO: 108780 - DNA, 20 bp, human
gccgcgccccggggctttgt

SEQ ID NO: 108781 - DNA, 20 bp, human
gctcggcggcgccgacggac

SEQ ID NO: 108782 - DNA, 20 bp, human
gcggcagccgcggcgaccgg

SEQ ID NO: 108783 - DNA, 20 bp, human
gtgcgcgccgcgatgggact

SEQ ID NO: 108784 - DNA, 20 bp, human
gtgctgcctacaaagccccg

SEQ ID NO: 108785 - DNA, 20 bp, human
gcgccgggatgggaagaccg

SEQ ID NO: 108786 - DNA, 20 bp, human
ggcggccaggagaaatacag

SEQ ID NO: 108787 - DNA, 20 bp, human
gttcctgcagagccccccgg

SEQ ID NO: 108788 - DNA, 20 bp, human
gccagtgagagcgtgcacac

SEQ ID NO: 108789 - DNA, 20 bp, human
gcatcaggaacggatacctt

SEQ ID NO: 108790 - DNA, 20 bp, human
gaccccgacgcctcagccca

SEQ ID NO: 108791 - DNA, 20 bp, human
gcctgagtacccacgtccta

SEQ ID NO: 108792 - DNA, 20 bp, human
gaccttgggctgaggcgtcg

SEQ ID NO: 108793 - DNA, 20 bp, human
gtgccaggtacgctgcttaa

SEQ ID NO: 108794 - DNA, 20 bp, human
gaatcccgcagggacacgct

SEQ ID NO: 108795 - DNA, 20 bp, human
ggagcgtgcacactggcatc

SEQ ID NO: 108796 - DNA, 20 bp, human
gccccggcggcacctcccca

SEQ ID NO: 108797 - DNA, 20 bp, human
gcgctcacctgcgaccccgg

SEQ ID NO: 108798 - DNA, 20 bp, human
gccactgcgagggcacccac

SEQ ID NO: 108799 - DNA, 20 bp, human
gccccacggtcgccccaagg

SEQ ID NO: 108800 - DNA, 20 bp, human
gggttctatgctggaggagg

SEQ ID NO: 108801 - DNA, 20 bp, human
gatgctggaggaggcggcca

SEQ ID NO: 108802 - DNA, 20 bp, human
gcgagggcacccactggtca

SEQ ID NO: 108803 - DNA, 20 bp, human
ggttagactgggctcccgga

SEQ ID NO: 108804 - DNA, 20 bp, human
gagcggttctatgctggagg

SEQ ID NO: 108805 - DNA, 20 bp, human
gggaagaatcgagttagact

SEQ ID NO: 108806 - DNA, 20 bp, human
gagagtgcaagcagtcgcag

SEQ ID NO: 108807 - DNA, 20 bp, human
gcacccagtgaacctggtag

SEQ ID NO: 108808 - DNA, 20 bp, human
gcaccccgggcaaagaagag

SEQ ID NO: 108809 - DNA, 20 bp, human
gtaaagggggccaagaggtg

SEQ ID NO: 108810 - DNA, 20 bp, human
ggggagcgtggactacgagt

SEQ ID NO: 108811 - DNA, 20 bp, human
gtagtcaatggctgtcactg

SEQ ID NO: 108812 - DNA, 20 bp, human
gcgatgcaaacagacacgga

SEQ ID NO: 108813 - DNA, 20 bp, human
gctccgcctccgccagggag

SEQ ID NO: 108814 - DNA, 20 bp, human
gcggggtgagaaagcgaggt

SEQ ID NO: 108815 - DNA, 20 bp, human
gtcgcccagtgacaactcgt

SEQ ID NO: 108816 - DNA, 20 bp, human
gctttccccggctccatcgc

SEQ ID NO: 108817 - DNA, 20 bp, human
ggattccagcgatggagccg

SEQ ID NO: 108818 - DNA, 20 bp, human
gagtcaggatgtctgtccag

SEQ ID NO: 108819 - DNA, 20 bp, human
gccagaagggcaccaaagtc

SEQ ID NO: 108820 - DNA, 20 bp, human
gggagcccaagccatcctcg

SEQ ID NO: 108821 - DNA, 20 bp, human
ggaggcggaaagccagcgag

SEQ ID NO: 108822 - DNA, 20 bp, human
ggagggagaagctcaggatg

SEQ ID NO: 108823 - DNA, 20 bp, human
ggatgtctgtccagcggagg

SEQ ID NO: 108824 - DNA, 20 bp, human
gtggccccgccgtgctcaca

SEQ ID NO: 108825 - DNA, 20 bp, human
gccttctgcagctgtctcgc

SEQ ID NO: 108826 - DNA, 20 bp, human
ggccaagcagaacctgggga

SEQ ID NO: 108827 - DNA, 20 bp, human
gaggtgaggaggtttcgaca

SEQ ID NO: 108828 - DNA, 20 bp, human
gtggagagcgcggccgaggt

SEQ ID NO: 108829 - DNA, 20 bp, human
gagatccggggcggctggag

SEQ ID NO: 108830 - DNA, 20 bp, human
gtttcttcaaccaggaggtg

SEQ ID NO: 108831 - DNA, 20 bp, human
gggaggtgttcaagacccag

SEQ ID NO: 108832 - DNA, 20 bp, human
gtccggagccaagcagaacc

SEQ ID NO: 108833 - DNA, 20 bp, human
gctccagtgcggaggcacgg

SEQ ID NO: 108834 - DNA, 20 bp, human
gtgaggaggtttcgacatgg

SEQ ID NO: 108835 - DNA, 20 bp, human
gagcagcctctccagtgcgg

SEQ ID NO: 108836 - DNA, 20 bp, human
gcgcagacgcctgggaactg

SEQ ID NO: 108837 - DNA, 20 bp, human
ggcaggcttccggcgagaca

SEQ ID NO: 108838 - DNA, 20 bp, human
ggaccctccgcccgatgata

SEQ ID NO: 108839 - DNA, 20 bp, human
gcttccggcgagacatggca

SEQ ID NO: 108840 - DNA, 20 bp, human
gggatggcagcccggcggca

SEQ ID NO: 108841 - DNA, 20 bp, human
gctccagccctatcatcggg

SEQ ID NO: 108842 - DNA, 20 bp, human
gccagccggggctacaaatt

SEQ ID NO: 108843 - DNA, 20 bp, human
gggtgggaagagcccagccg

SEQ ID NO: 108844 - DNA, 20 bp, human
gggcgaggagcgcgagcccg

SEQ ID NO: 108845 - DNA, 20 bp, human
gtgcagcgccagggtccacc

SEQ ID NO: 108846 - DNA, 20 bp, human
gtgtagttgggctactggag

SEQ ID NO: 108847 - DNA, 20 bp, human
gccctgacccgagaagtatg

SEQ ID NO: 108848 - DNA, 20 bp, human
ggaagctgcgccgctgaaac

SEQ ID NO: 108849 - DNA, 20 bp, human
gagaggccggcagttcatgg

SEQ ID NO: 108850 - DNA, 20 bp, human
ggcagttcatggaggctcgg

SEQ ID NO: 108851 - DNA, 20 bp, human
ggaccacctggaccgaaggg

SEQ ID NO: 108852 - DNA, 20 bp, human
gtggaggctcgggggcacgt

SEQ ID NO: 108853 - DNA, 20 bp, human
gcggcgcagcttctgtagtt

SEQ ID NO: 108854 - DNA, 20 bp, human
gagagaccacctggaccgaa

SEQ ID NO: 108855 - DNA, 20 bp, human
ggttctcccgcccgtttcag

SEQ ID NO: 108856 - DNA, 20 bp, human
gcacagaggaggccggggta

SEQ ID NO: 108857 - DNA, 20 bp, human
gaacctgagtcgctacaggt

SEQ ID NO: 108858 - DNA, 20 bp, human
gctgcggatgcaaaaagtga

SEQ ID NO: 108859 - DNA, 20 bp, human
gagaggaggccggggtaggg

SEQ ID NO: 108860 - DNA, 20 bp, human
gcggatgcaaaaagtgaggg

SEQ ID NO: 108861 - DNA, 20 bp, human
gccgcagggaccgagacctg

SEQ ID NO: 108862 - DNA, 20 bp, human
ggctggccgaggtctctgag

SEQ ID NO: 108863 - DNA, 20 bp, human
gcagtaacctgagtcgctac

SEQ ID NO: 108864 - DNA, 20 bp, human
gtccttttgcaggctcgtgg

SEQ ID NO: 108865 - DNA, 20 bp, human
gtctgcgcgccaccctaccc

SEQ ID NO: 108866 - DNA, 20 bp, human
gggagctccgtccgacagaa

SEQ ID NO: 108867 - DNA, 20 bp, human
gaggagccgcgcggtagatg

SEQ ID NO: 108868 - DNA, 20 bp, human
gtccgtccgacagaacggtt

SEQ ID NO: 108869 - DNA, 20 bp, human
gctggccctgggctcggagg

SEQ ID NO: 108870 - DNA, 20 bp, human
gctgctggcgggaaatctgg

SEQ ID NO: 108871 - DNA, 20 bp, human
ggcccaaccgttctgtcgga

SEQ ID NO: 108872 - DNA, 20 bp, human
ggacataccgacagccggca

SEQ ID NO: 108873 - DNA, 20 bp, human
gcaaggcccaaccgttctgt

SEQ ID NO: 108874 - DNA, 20 bp, human
gccaccccgctacctggtgg

SEQ ID NO: 108875 - DNA, 20 bp, human
ggtcgcgacataccgacagc

SEQ ID NO: 108876 - DNA, 20 bp, human
ggggcgcgtcagtctccatc

SEQ ID NO: 108877 - DNA, 20 bp, human
ggctcggcgcggggcagatg

SEQ ID NO: 108878 - DNA, 20 bp, human
gagcgcccgccggtccggca

SEQ ID NO: 108879 - DNA, 20 bp, human
gagggcgcccggggtcagca

SEQ ID NO: 108880 - DNA, 20 bp, human
ggcagcaagatgttcatcgg

SEQ ID NO: 108881 - DNA, 20 bp, human
gccccccggcgccccggacc

SEQ ID NO: 108882 - DNA, 20 bp, human
gggcgcgaaagagggcgcga

SEQ ID NO: 108883 - DNA, 20 bp, human
gccgggcggggcgcgaaaga

SEQ ID NO: 108884 - DNA, 20 bp, human
ggcagcatggcctgtccgtc

SEQ ID NO: 108885 - DNA, 20 bp, human
gacgcagggtgagcgagccc

SEQ ID NO: 108886 - DNA, 20 bp, human
gagatctcggggctcggagc

SEQ ID NO: 108887 - DNA, 20 bp, human
gttcggaggagcccgggcgg

SEQ ID NO: 108888 - DNA, 20 bp, human
gggcgagagccgtcacacgt

SEQ ID NO: 108889 - DNA, 20 bp, human
gatgggagccaaggcacctc

SEQ ID NO: 108890 - DNA, 20 bp, human
gcgctcgcagagagattcgg

SEQ ID NO: 108891 - DNA, 20 bp, human
ggagcgagagccgggaggtg

SEQ ID NO: 108892 - DNA, 20 bp, human
gcgccgctcgcagagagatt

SEQ ID NO: 108893 - DNA, 20 bp, human
gacggctctcgccgctgccc

SEQ ID NO: 108894 - DNA, 20 bp, human
gggagggagcggagatctcg

SEQ ID NO: 108895 - DNA, 20 bp, human
gcgtggaagttacacacctt

SEQ ID NO: 108896 - DNA, 20 bp, human
ggcggatctcatggtcatag

SEQ ID NO: 108897 - DNA, 20 bp, human
gtcaggattgccgccggcag

SEQ ID NO: 108898 - DNA, 20 bp, human
gcctgcctctgaggcgaagg

SEQ ID NO: 108899 - DNA, 20 bp, human
ggctccggggatgagctcgg

SEQ ID NO: 108900 - DNA, 20 bp, human
gcagcgactggactacgagc

SEQ ID NO: 108901 - DNA, 20 bp, human
gcgcagccgccgccaaccgg

SEQ ID NO: 108902 - DNA, 20 bp, human
ggcggcggcgaggcccccat

SEQ ID NO: 108903 - DNA, 20 bp, human
gcgcgcatgcgtcctccggt

SEQ ID NO: 108904 - DNA, 20 bp, human
gccgcccccgagctcatccc

SEQ ID NO: 108905 - DNA, 20 bp, human
ggctcctgcctctgaggcga

SEQ ID NO: 108906 - DNA, 20 bp, human
gcgagcgctagcgacgacgg

SEQ ID NO: 108907 - DNA, 20 bp, human
gggagtctcggggatgacag

SEQ ID NO: 108908 - DNA, 20 bp, human
ggtgcgagcgctagcgacga

SEQ ID NO: 108909 - DNA, 20 bp, human
gaaatggccgggcagtgagg

SEQ ID NO: 108910 - DNA, 20 bp, human
gaccccggagtgtgcgactg

SEQ ID NO: 108911 - DNA, 20 bp, human
ggcctcagtcgcacactccg

SEQ ID NO: 108912 - DNA, 20 bp, human
gacgacgaccgttaccccaa

SEQ ID NO: 108913 - DNA, 20 bp, human
gcgggcgggagtcctcaacc

SEQ ID NO: 108914 - DNA, 20 bp, human
ggggagtcctcaacccggag

SEQ ID NO: 108915 - DNA, 20 bp, human
gtgtgcgactgaggcgcgag

SEQ ID NO: 108916 - DNA, 20 bp, human
gcggccaccgttgcagtcgg

SEQ ID NO: 108917 - DNA, 20 bp, human
gggagggcgaggctccgggg

SEQ ID NO: 108918 - DNA, 20 bp, human
gagcaaatgagcgcgagcga

SEQ ID NO: 108919 - DNA, 20 bp, human
gctgcaacggtggccgctga

SEQ ID NO: 108920 - DNA, 20 bp, human
gcggtaacgcgacaaagcat

SEQ ID NO: 108921 - DNA, 20 bp, human
gggaggaggcttctcgaata

SEQ ID NO: 108922 - DNA, 20 bp, human
ggcgcccccgactgcaacgg

SEQ ID NO: 108923 - DNA, 20 bp, human
gccggcctgacggaaggaag

SEQ ID NO: 108924 - DNA, 20 bp, human
gcgcgctcatttgctcatcg

SEQ ID NO: 108925 - DNA, 20 bp, human
gcggcctgcgaggagcggtg

SEQ ID NO: 108926 - DNA, 20 bp, human
gagagctaccggtggaccca

SEQ ID NO: 108927 - DNA, 20 bp, human
gcacaacaggaagagctcaa

SEQ ID NO: 108928 - DNA, 20 bp, human
ggcggacagagagctaccgg

SEQ ID NO: 108929 - DNA, 20 bp, human
gcgtggccatcggatcacag

SEQ ID NO: 108930 - DNA, 20 bp, human
gatcggatcacaggggacct

SEQ ID NO: 108931 - DNA, 20 bp, human
gcgcgcggacagagagctac

SEQ ID NO: 108932 - DNA, 20 bp, human
gttacttacagatcccaggg

SEQ ID NO: 108933 - DNA, 20 bp, human
gccacacgtgggcctctaaa

SEQ ID NO: 108934 - DNA, 20 bp, human
gagctgggctggggccgtgg

SEQ ID NO: 108935 - DNA, 20 bp, human
gcgtcaaagggaacaaatga

SEQ ID NO: 108936 - DNA, 20 bp, human
ggcttgcggtgagaccccag

SEQ ID NO: 108937 - DNA, 20 bp, human
gtgagctgagataggaaccc

SEQ ID NO: 108938 - DNA, 20 bp, human
gtcctgcttatcacaatggt

SEQ ID NO: 108939 - DNA, 20 bp, human
gagcaggactccttatagac

SEQ ID NO: 108940 - DNA, 20 bp, human
gctggatgtacctgtctata

SEQ ID NO: 108941 - DNA, 20 bp, human
gcctgtgaatgagctgagat

SEQ ID NO: 108942 - DNA, 20 bp, human
gtatcacaatggtaggtaac

SEQ ID NO: 108943 - DNA, 20 bp, human
ggcagggagagaggaatgcc

SEQ ID NO: 108944 - DNA, 20 bp, human
gagcacacgcatattaaaat

SEQ ID NO: 108945 - DNA, 20 bp, human
gaattgaaccccagaattac

SEQ ID NO: 108946 - DNA, 20 bp, human
gttgcataaagtcacgaagg

SEQ ID NO: 108947 - DNA, 20 bp, human
ggcattgcataaagtcacga

SEQ ID NO: 108948 - DNA, 20 bp, human
gtgtaatgtgaagaaaggtc

SEQ ID NO: 108949 - DNA, 20 bp, human
gtacctaatgagggagttcc

SEQ ID NO: 108950 - DNA, 20 bp, human
gttcaaccaggagtaagtct

SEQ ID NO: 108951 - DNA, 20 bp, human
gtactcctggttgaatctcc

SEQ ID NO: 108952 - DNA, 20 bp, human
gaaagatcacaacgctgccc

SEQ ID NO: 108953 - DNA, 20 bp, human
ggttattgcagcctggtaga

SEQ ID NO: 108954 - DNA, 20 bp, human
gcattacagaatgttctcct

SEQ ID NO: 108955 - DNA, 20 bp, human
gctcctggaactccctcatt

SEQ ID NO: 108956 - DNA, 20 bp, human
gccaggcgaggcaggttccg

SEQ ID NO: 108957 - DNA, 20 bp, human
gcctggcgagtcctcggtgt

SEQ ID NO: 108958 - DNA, 20 bp, human
gctgccggccaccgacaccg

SEQ ID NO: 108959 - DNA, 20 bp, human
gacggccgcgagatgactgc

SEQ ID NO: 108960 - DNA, 20 bp, human
ggcgaggcaggttccgaggt

SEQ ID NO: 108961 - DNA, 20 bp, human
gcgcggccgttcaggtgagg

SEQ ID NO: 108962 - DNA, 20 bp, human
gggaacacctggcgagtcct

SEQ ID NO: 108963 - DNA, 20 bp, human
gggcagtggtacccgagacg

SEQ ID NO: 108964 - DNA, 20 bp, human
gggcgagtcctcggtgtcgg

SEQ ID NO: 108965 - DNA, 20 bp, human
gtgaaggtgggcctaggcta

SEQ ID NO: 108966 - DNA, 20 bp, human
ggtgtaggagtgctgatgag

SEQ ID NO: 108967 - DNA, 20 bp, human
gcagggagatagtgtgagac

SEQ ID NO: 108968 - DNA, 20 bp, human
ggcacttgctgtagactcct

SEQ ID NO: 108969 - DNA, 20 bp, human
gaagaacgggaaatgttagt

SEQ ID NO: 108970 - DNA, 20 bp, human
gtgagaggcagaggctcttc

SEQ ID NO: 108971 - DNA, 20 bp, human
gggccaagaagggtctgaga

SEQ ID NO: 108972 - DNA, 20 bp, human
ggcagaggctcttctggtct

SEQ ID NO: 108973 - DNA, 20 bp, human
ggaaagacaaactaaatacg

SEQ ID NO: 108974 - DNA, 20 bp, human
gccaagctcaaggtaaagtg

SEQ ID NO: 108975 - DNA, 20 bp, human
ggggaaatgttagtaggtgt

SEQ ID NO: 108976 - DNA, 20 bp, human
gggagcgggcggcgcgacag

SEQ ID NO: 108977 - DNA, 20 bp, human
gggtcgacagcgcccacctc

SEQ ID NO: 108978 - DNA, 20 bp, human
gtggtctggtgcgccctcag

SEQ ID NO: 108979 - DNA, 20 bp, human
gccatcagcaaagggctatg

SEQ ID NO: 108980 - DNA, 20 bp, human
gtccgccatagccaagggta

SEQ ID NO: 108981 - DNA, 20 bp, human
ggcgggcggcgcgacagggg

SEQ ID NO: 108982 - DNA, 20 bp, human
gtgggcgctgtcgaccccaa

SEQ ID NO: 108983 - DNA, 20 bp, human
gctgttgcatctcagacaca

SEQ ID NO: 108984 - DNA, 20 bp, human
gccatagccaagggtaggga

SEQ ID NO: 108985 - DNA, 20 bp, human
ggcgccctcaggggttgagg

SEQ ID NO: 108986 - DNA, 20 bp, human
gatcaagggaagataataaa

SEQ ID NO: 108987 - DNA, 20 bp, human
gctgctttctttaggacgaa

SEQ ID NO: 108988 - DNA, 20 bp, human
gatatttgctatataatcaa

SEQ ID NO: 108989 - DNA, 20 bp, human
ggtagtttgaaccagcaatg

SEQ ID NO: 108990 - DNA, 20 bp, human
ggcatctggtacatgaagaa

SEQ ID NO: 108991 - DNA, 20 bp, human
gctcctttcataacttttca

SEQ ID NO: 108992 - DNA, 20 bp, human
gactatgagataaagatttt

SEQ ID NO: 108993 - DNA, 20 bp, human
gtattgtatcagcaataatt

SEQ ID NO: 108994 - DNA, 20 bp, human
gcaatcaatagaaacaattc

SEQ ID NO: 108995 - DNA, 20 bp, human
gtttcgataatcaaaaaata

SEQ ID NO: 108996 - DNA, 20 bp, human
gccgtaccggctgtcaccgg

SEQ ID NO: 108997 - DNA, 20 bp, human
gtggaggccgcccgtaatcg

SEQ ID NO: 108998 - DNA, 20 bp, human
gctgcccggaaggaagccgt

SEQ ID NO: 108999 - DNA, 20 bp, human
gtaagcactggccacacgga

SEQ ID NO: 109000 - DNA, 20 bp, human
gcagggaaggaacacgcccc

SEQ ID NO: 109001 - DNA, 20 bp, human
gtcgaggttgcccaaacccg

SEQ ID NO: 109002 - DNA, 20 bp, human
ggggccacaccccctgtcca

SEQ ID NO: 109003 - DNA, 20 bp, human
gcccaaacccggggccgtac

SEQ ID NO: 109004 - DNA, 20 bp, human
gtccgggtggccgagagcat

SEQ ID NO: 109005 - DNA, 20 bp, human
ggccacacggaaggcgcggg

SEQ ID NO: 109006 - DNA, 20 bp, human
ggtaccggcggtcgtcgggt

SEQ ID NO: 109007 - DNA, 20 bp, human
gaagcgcgctgcggttccgg

SEQ ID NO: 109008 - DNA, 20 bp, human
gaagggatcgggatacgtgg

SEQ ID NO: 109009 - DNA, 20 bp, human
gtagggtcggggcttcggag

SEQ ID NO: 109010 - DNA, 20 bp, human
gaggtggacgcgggtaccgg

SEQ ID NO: 109011 - DNA, 20 bp, human
gcagaacgacatggcgccac

SEQ ID NO: 109012 - DNA, 20 bp, human
gcatcactttggagtgtagg

SEQ ID NO: 109013 - DNA, 20 bp, human
gggcagcggcaagcgcgctg

SEQ ID NO: 109014 - DNA, 20 bp, human
ggccggggagaagcgaacag

SEQ ID NO: 109015 - DNA, 20 bp, human
ggggctcaccgtcctggagg

SEQ ID NO: 109016 - DNA, 20 bp, human
gcgcctggagtccccgatag

SEQ ID NO: 109017 - DNA, 20 bp, human
gcgccgaggcgcagttccga

SEQ ID NO: 109018 - DNA, 20 bp, human
gcgaggagggcttagtagga

SEQ ID NO: 109019 - DNA, 20 bp, human
gttcttggctcggggagtgg

SEQ ID NO: 109020 - DNA, 20 bp, human
ggcgccgaggagggcttagt

SEQ ID NO: 109021 - DNA, 20 bp, human
gcggagcgggcgtcatggcg

SEQ ID NO: 109022 - DNA, 20 bp, human
ggggagtgggggcataagtg

SEQ ID NO: 109023 - DNA, 20 bp, human
gggcgccggagcgggcgtca

SEQ ID NO: 109024 - DNA, 20 bp, human
gagtccccgataggggtcag

SEQ ID NO: 109025 - DNA, 20 bp, human
ggggcataagtggggctcgg

SEQ ID NO: 109026 - DNA, 20 bp, human
gtcgctcccgggacaggata

SEQ ID NO: 109027 - DNA, 20 bp, human
gagcgaggttcggacaccgg

SEQ ID NO: 109028 - DNA, 20 bp, human
gccgccgcgggctcatggaa

SEQ ID NO: 109029 - DNA, 20 bp, human
gggcagcccgcgggaggcag

SEQ ID NO: 109030 - DNA, 20 bp, human
gccagcggtgaggggccgaa

SEQ ID NO: 109031 - DNA, 20 bp, human
ggggagcgaggttcggacac

SEQ ID NO: 109032 - DNA, 20 bp, human
gcccgccgaagggaggcgtc

SEQ ID NO: 109033 - DNA, 20 bp, human
gaacgtggcagggtcggggt

SEQ ID NO: 109034 - DNA, 20 bp, human
ggctgccagacgcctccctt

SEQ ID NO: 109035 - DNA, 20 bp, human
gtccccgcaggtggccgagg

SEQ ID NO: 109036 - DNA, 20 bp, human
gggaagctgaggacttagca

SEQ ID NO: 109037 - DNA, 20 bp, human
ggaacaccaacaccaagaac

SEQ ID NO: 109038 - DNA, 20 bp, human
gaagcaagcagacaggttga

SEQ ID NO: 109039 - DNA, 20 bp, human
gaaacgtctttggagaggta

SEQ ID NO: 109040 - DNA, 20 bp, human
gtcattggagatccttataa

SEQ ID NO: 109041 - DNA, 20 bp, human
gtggtggtaaagaagaagat

SEQ ID NO: 109042 - DNA, 20 bp, human
gatgcaaaacgtctttggag

SEQ ID NO: 109043 - DNA, 20 bp, human
gggagaaggaagactgaaac

SEQ ID NO: 109044 - DNA, 20 bp, human
gaggtgaaacttgggactct

SEQ ID NO: 109045 - DNA, 20 bp, human
gaagggggtaggaaaagaga

SEQ ID NO: 109046 - DNA, 20 bp, human
ggggttgggggcacttacca

SEQ ID NO: 109047 - DNA, 20 bp, human
gagggcctagtacagcttag

SEQ ID NO: 109048 - DNA, 20 bp, human
gctagtacagcttagtggac

SEQ ID NO: 109049 - DNA, 20 bp, human
gggtctgggctccagcccct

SEQ ID NO: 109050 - DNA, 20 bp, human
gagcttagtggacaggtgtt

SEQ ID NO: 109051 - DNA, 20 bp, human
gaaagtttaatgtcacccag

SEQ ID NO: 109052 - DNA, 20 bp, human
gggcccttgcaactgaccta

SEQ ID NO: 109053 - DNA, 20 bp, human
gtgagagctgccagaggtct

SEQ ID NO: 109054 - DNA, 20 bp, human
gtgcagcctagtcagcccaa

SEQ ID NO: 109055 - DNA, 20 bp, human
gtgaaggcagatggggatca

SEQ ID NO: 109056 - DNA, 20 bp, human
gaagcgccagtgtacagcgg

SEQ ID NO: 109057 - DNA, 20 bp, human
gaggccatggtgacctacga

SEQ ID NO: 109058 - DNA, 20 bp, human
gcccagccgccgctgtacac

SEQ ID NO: 109059 - DNA, 20 bp, human
gggccggtagggatcctcta

SEQ ID NO: 109060 - DNA, 20 bp, human
ggtccaggcccaggccggta

SEQ ID NO: 109061 - DNA, 20 bp, human
gggcgggaggagctccatcg

SEQ ID NO: 109062 - DNA, 20 bp, human
gggcctccggcggagaagct

SEQ ID NO: 109063 - DNA, 20 bp, human
gtcgccctcgtaggtcacca

SEQ ID NO: 109064 - DNA, 20 bp, human
ggtcaggtgctcagacccga

SEQ ID NO: 109065 - DNA, 20 bp, human
ggaccctagaggatccctac

SEQ ID NO: 109066 - DNA, 20 bp, human
gcgccgagcgctgtgagtgg

SEQ ID NO: 109067 - DNA, 20 bp, human
gggctcccaagcagtcacgt

SEQ ID NO: 109068 - DNA, 20 bp, human
ggcgctcggcgttcaggaag

SEQ ID NO: 109069 - DNA, 20 bp, human
gtgctgggcaccggcgacaa

SEQ ID NO: 109070 - DNA, 20 bp, human
gagggccgccgaactacccc

SEQ ID NO: 109071 - DNA, 20 bp, human
ggtcacctggccatagtgac

SEQ ID NO: 109072 - DNA, 20 bp, human
ggggcaccggcgacaaggga

SEQ ID NO: 109073 - DNA, 20 bp, human
gagggcagggccggtcacta

SEQ ID NO: 109074 - DNA, 20 bp, human
gtggcgccttgggttcggac

SEQ ID NO: 109075 - DNA, 20 bp, human
gcgccggtgcccagcaccga

SEQ ID NO: 109076 - DNA, 20 bp, human
ggatcaatcagttcccggag

SEQ ID NO: 109077 - DNA, 20 bp, human
gtgatcagtatgatgtccag

SEQ ID NO: 109078 - DNA, 20 bp, human
gtacagtataaaagattcac

SEQ ID NO: 109079 - DNA, 20 bp, human
gcaatcagttcccggagtgg

SEQ ID NO: 109080 - DNA, 20 bp, human
gacccaaagctcctccactc

SEQ ID NO: 109081 - DNA, 20 bp, human
gtcccggagtggaggagctt

SEQ ID NO: 109082 - DNA, 20 bp, human
gatcgctgctgtcatccctc

SEQ ID NO: 109083 - DNA, 20 bp, human
gctgattgttgctggtccag

SEQ ID NO: 109084 - DNA, 20 bp, human
ggacagcagcgatggctctt

SEQ ID NO: 109085 - DNA, 20 bp, human
ggctgtgtaatgcatgtact

SEQ ID NO: 109086 - DNA, 20 bp, human
gcagagccagtaacagacag

SEQ ID NO: 109087 - DNA, 20 bp, human
gtaacagacagcggctgact

SEQ ID NO: 109088 - DNA, 20 bp, human
gtgaggccaagtgcccatct

SEQ ID NO: 109089 - DNA, 20 bp, human
ggttactggctctgttcttg

SEQ ID NO: 109090 - DNA, 20 bp, human
ggagacccaggggacgaatc

SEQ ID NO: 109091 - DNA, 20 bp, human
gaaggtatgaagctttgtaa

SEQ ID NO: 109092 - DNA, 20 bp, human
gatgaagctttgtaaggggt

SEQ ID NO: 109093 - DNA, 20 bp, human
gatacccctgattcgtcccc

SEQ ID NO: 109094 - DNA, 20 bp, human
gtaggacagtgtgatctgag

SEQ ID NO: 109095 - DNA, 20 bp, human
gggatggcactgcagtggaa

SEQ ID NO: 109096 - DNA, 20 bp, human
ggggaactctgcctgcgcgg

SEQ ID NO: 109097 - DNA, 20 bp, human
ggcgcggcggcagcgaccgg

SEQ ID NO: 109098 - DNA, 20 bp, human
gagttcccgggagcactcgc

SEQ ID NO: 109099 - DNA, 20 bp, human
gccgcctgcacgccctcgga

SEQ ID NO: 109100 - DNA, 20 bp, human
ggctgaagggcaggagcgaa

SEQ ID NO: 109101 - DNA, 20 bp, human
gggcgctcatggccgaccac

SEQ ID NO: 109102 - DNA, 20 bp, human
gagtgctgcggcagaagggg

SEQ ID NO: 109103 - DNA, 20 bp, human
gtctctggggagccgcggta

SEQ ID NO: 109104 - DNA, 20 bp, human
gggagccggcgagtgctccc

SEQ ID NO: 109105 - DNA, 20 bp, human
ggaggccaggcccagcacgc

SEQ ID NO: 109106 - DNA, 20 bp, human
gtccgctggcaacccggcag

SEQ ID NO: 109107 - DNA, 20 bp, human
gcgcgactccgctggcaacc

SEQ ID NO: 109108 - DNA, 20 bp, human
gtctcgaagggcttcaccag

SEQ ID NO: 109109 - DNA, 20 bp, human
gggtagcgcggggtactgga

SEQ ID NO: 109110 - DNA, 20 bp, human
ggcggcggcgaatatcggcc

SEQ ID NO: 109111 - DNA, 20 bp, human
gtttgctgcggagacgggag

SEQ ID NO: 109112 - DNA, 20 bp, human
ggccaagtgagtgcgcgccg

SEQ ID NO: 109113 - DNA, 20 bp, human
gacttggcggcggcgaatat

SEQ ID NO: 109114 - DNA, 20 bp, human
gctgctgggccctcctcgtc

SEQ ID NO: 109115 - DNA, 20 bp, human
ggccccggcgcgcactcact

SEQ ID NO: 109116 - DNA, 20 bp, human
gctctcgcctctgaaatggg

SEQ ID NO: 109117 - DNA, 20 bp, human
gctcggctgggcggactcag

SEQ ID NO: 109118 - DNA, 20 bp, human
gggaactgcgcagagtactg

SEQ ID NO: 109119 - DNA, 20 bp, human
ggaaagagggccggacgcaa

SEQ ID NO: 109120 - DNA, 20 bp, human
gcctagggacatctatcctg

SEQ ID NO: 109121 - DNA, 20 bp, human
gtagatgtccctaggagtag

SEQ ID NO: 109122 - DNA, 20 bp, human
gttcagaggcgagaggactc

SEQ ID NO: 109123 - DNA, 20 bp, human
gatagctcctgtccaactca

SEQ ID NO: 109124 - DNA, 20 bp, human
ggcacgtggaaggcttggta

SEQ ID NO: 109125 - DNA, 20 bp, human
gcggggaaataggtatccta

SEQ ID NO: 109126 - DNA, 20 bp, human
gtatcttgcctaggaactcc

SEQ ID NO: 109127 - DNA, 20 bp, human
gaggaactccaggcttgtct

SEQ ID NO: 109128 - DNA, 20 bp, human
gggagcagttgggatccatt

SEQ ID NO: 109129 - DNA, 20 bp, human
ggccaggcgtcccttacctg

SEQ ID NO: 109130 - DNA, 20 bp, human
gaactctgagcagccgggaa

SEQ ID NO: 109131 - DNA, 20 bp, human
ggagatgctcacaggagctt

SEQ ID NO: 109132 - DNA, 20 bp, human
gccagggacactgtgtacag

SEQ ID NO: 109133 - DNA, 20 bp, human
gcacacagtccaggaagact

SEQ ID NO: 109134 - DNA, 20 bp, human
gagctgggaccttcctgatg

SEQ ID NO: 109135 - DNA, 20 bp, human
ggacttacaagcacagagga

SEQ ID NO: 109136 - DNA, 20 bp, human
gcactcagcggatcccggga

SEQ ID NO: 109137 - DNA, 20 bp, human
ggtgcggagcggggaacgtg

SEQ ID NO: 109138 - DNA, 20 bp, human
ggactgcttgttcgtctcac

SEQ ID NO: 109139 - DNA, 20 bp, human
gaaaccgcggagctaggggt

SEQ ID NO: 109140 - DNA, 20 bp, human
gtgggctgcacacggactct

SEQ ID NO: 109141 - DNA, 20 bp, human
ggaacaccgcgtacctgcgg

SEQ ID NO: 109142 - DNA, 20 bp, human
gactctgacgtagaggccca

SEQ ID NO: 109143 - DNA, 20 bp, human
gtccgcactcagcggatccc

SEQ ID NO: 109144 - DNA, 20 bp, human
gccagagaccctctgtaata

SEQ ID NO: 109145 - DNA, 20 bp, human
gcaagtcgagctgaaaaccg

SEQ ID NO: 109146 - DNA, 20 bp, human
ggagagaagcgaagaagcag

SEQ ID NO: 109147 - DNA, 20 bp, human
gacccggcgttccttaccag

SEQ ID NO: 109148 - DNA, 20 bp, human
gggaaagtccagtctctcct

SEQ ID NO: 109149 - DNA, 20 bp, human
gcccctgactatcaaagcag

SEQ ID NO: 109150 - DNA, 20 bp, human
gaccctcaacgctgacacag

SEQ ID NO: 109151 - DNA, 20 bp, human
gaaagcactggactaagtca

SEQ ID NO: 109152 - DNA, 20 bp, human
gttgagcagcaggattagat

SEQ ID NO: 109153 - DNA, 20 bp, human
gcgtggtggaccccaacagc

SEQ ID NO: 109154 - DNA, 20 bp, human
gagaggaaggaaatgctctc

SEQ ID NO: 109155 - DNA, 20 bp, human
gctgggaatcgagcatcccc

SEQ ID NO: 109156 - DNA, 20 bp, human
gcccgggcgtcccttaccag

SEQ ID NO: 109157 - DNA, 20 bp, human
ggtgcacgtggaaggcggag

SEQ ID NO: 109158 - DNA, 20 bp, human
gctgacatagaggaacaggg

SEQ ID NO: 109159 - DNA, 20 bp, human
gggaactctagtctcgcctc

SEQ ID NO: 109160 - DNA, 20 bp, human
gaggagacattggataggag

SEQ ID NO: 109161 - DNA, 20 bp, human
gaagaggcagtgggtgcacg

SEQ ID NO: 109162 - DNA, 20 bp, human
gctagagttcccaagcgaga

SEQ ID NO: 109163 - DNA, 20 bp, human
ggtctcgcctcgggttgcaa

SEQ ID NO: 109164 - DNA, 20 bp, human
gcggattggataggagacat

SEQ ID NO: 109165 - DNA, 20 bp, human
gggaggaggaaaatgccctc

SEQ ID NO: 109166 - DNA, 20 bp, human
gagcagccggattggatggg

SEQ ID NO: 109167 - DNA, 20 bp, human
gcgtggtggagcgcaacagt

SEQ ID NO: 109168 - DNA, 20 bp, human
ggccaagaggaaagcagcgg

SEQ ID NO: 109169 - DNA, 20 bp, human
gtgggaggcattggataggt

SEQ ID NO: 109170 - DNA, 20 bp, human
gtggggacattgcctcttca

SEQ ID NO: 109171 - DNA, 20 bp, human
gcggattggatgggaggcat

SEQ ID NO: 109172 - DNA, 20 bp, human
gaggctctgagcagccggat

SEQ ID NO: 109173 - DNA, 20 bp, human
gaggctggtaaggaacgccc

SEQ ID NO: 109174 - DNA, 20 bp, human
gtccctcccctgactagaaa

SEQ ID NO: 109175 - DNA, 20 bp, human
gtctgagcagccggattgga

SEQ ID NO: 109176 - DNA, 20 bp, human
gcaggagccggcgcaggcgt

SEQ ID NO: 109177 - DNA, 20 bp, human
gactgctcctgcgccgctgg

SEQ ID NO: 109178 - DNA, 20 bp, human
gtcttctcgcttgggaacgc

SEQ ID NO: 109179 - DNA, 20 bp, human
gagaatgacacgtaaagtcc

SEQ ID NO: 109180 - DNA, 20 bp, human
ggaggctcctacgcctgcgc

SEQ ID NO: 109181 - DNA, 20 bp, human
gctgttttcatccgagagca

SEQ ID NO: 109182 - DNA, 20 bp, human
gtgcatccgcaaaggggctt

SEQ ID NO: 109183 - DNA, 20 bp, human
gattgattcaaactttaaac

SEQ ID NO: 109184 - DNA, 20 bp, human
gggtagaagcaacccacagt

SEQ ID NO: 109185 - DNA, 20 bp, human
ggcagggcagtcccgacatc

SEQ ID NO: 109186 - DNA, 20 bp, human
gagccaagaaatgacgggag

SEQ ID NO: 109187 - DNA, 20 bp, human
gaagtactggacgaagtaaa

SEQ ID NO: 109188 - DNA, 20 bp, human
gaggctctaagcaagcaggg

SEQ ID NO: 109189 - DNA, 20 bp, human
gacgcagggacactgtactg

SEQ ID NO: 109190 - DNA, 20 bp, human
gcctggtggggtgaaatagg

SEQ ID NO: 109191 - DNA, 20 bp, human
gtattccaagaagaaagtac

SEQ ID NO: 109192 - DNA, 20 bp, human
ggccactggtaagggaaccc

SEQ ID NO: 109193 - DNA, 20 bp, human
gtggaaggcacgttggagcc

SEQ ID NO: 109194 - DNA, 20 bp, human
gctttgagattcaggacagg

SEQ ID NO: 109195 - DNA, 20 bp, human
gtctaggctctaagcaagca

SEQ ID NO: 109196 - DNA, 20 bp, human
gtccaccacgccgtccgggt

SEQ ID NO: 109197 - DNA, 20 bp, human
gccaggggcacacccaaccc

SEQ ID NO: 109198 - DNA, 20 bp, human
ggagcaatcagggtggactg

SEQ ID NO: 109199 - DNA, 20 bp, human
gccctgggaccttcctggta

SEQ ID NO: 109200 - DNA, 20 bp, human
ggcccacccggacggcgtgg

SEQ ID NO: 109201 - DNA, 20 bp, human
gctgggaaatgggattccta

SEQ ID NO: 109202 - DNA, 20 bp, human
ggattcctagggcgcagggt

SEQ ID NO: 109203 - DNA, 20 bp, human
gtggcaatctcagtattcct

SEQ ID NO: 109204 - DNA, 20 bp, human
gtaggcccacccggacggcg

SEQ ID NO: 109205 - DNA, 20 bp, human
gggcgctccaccacgccgtc

SEQ ID NO: 109206 - DNA, 20 bp, human
gggacagatgaaaagcgtgg

SEQ ID NO: 109207 - DNA, 20 bp, human
gtcaagaggaaaacacgcag

SEQ ID NO: 109208 - DNA, 20 bp, human
gagcccaggaaggctaagac

SEQ ID NO: 109209 - DNA, 20 bp, human
gggcacagggaggcgagaag

SEQ ID NO: 109210 - DNA, 20 bp, human
ggagctaggtgtcccttacc

SEQ ID NO: 109211 - DNA, 20 bp, human
gctaacttagaggcacaggg

SEQ ID NO: 109212 - DNA, 20 bp, human
gctgggaaacgggcatccca

SEQ ID NO: 109213 - DNA, 20 bp, human
gcacagtacagactcttcct

SEQ ID NO: 109214 - DNA, 20 bp, human
gaagagagccgccggcttct

SEQ ID NO: 109215 - DNA, 20 bp, human
ggtggtctcagggacgtgat

SEQ ID NO: 109216 - DNA, 20 bp, human
gggctccgaataacctagaa

SEQ ID NO: 109217 - DNA, 20 bp, human
gggcatccccagcctcttac

SEQ ID NO: 109218 - DNA, 20 bp, human
ggtcgggacaggttgcacgc

SEQ ID NO: 109219 - DNA, 20 bp, human
gcgccgccggtaagaggctg

SEQ ID NO: 109220 - DNA, 20 bp, human
gctcctgcgccgccggtaag

SEQ ID NO: 109221 - DNA, 20 bp, human
gtcctgcaagaaaagtaagt

SEQ ID NO: 109222 - DNA, 20 bp, human
gggttgcacgcgggttcgct

SEQ ID NO: 109223 - DNA, 20 bp, human
gcagaggtgagaaccgtccc

SEQ ID NO: 109224 - DNA, 20 bp, human
gctccttaacggtaaaaagg

SEQ ID NO: 109225 - DNA, 20 bp, human
gtcccttgttcaggtatcca

SEQ ID NO: 109226 - DNA, 20 bp, human
gggtctcagggtccatgtcg

SEQ ID NO: 109227 - DNA, 20 bp, human
ggggcgggggctcaccagaa

SEQ ID NO: 109228 - DNA, 20 bp, human
gctccgcagagcagaggggg

SEQ ID NO: 109229 - DNA, 20 bp, human
gtgcaggagccacctagaga

SEQ ID NO: 109230 - DNA, 20 bp, human
gccgactccgcagagcagag

SEQ ID NO: 109231 - DNA, 20 bp, human
gtgcatagggagtaagaggt

SEQ ID NO: 109232 - DNA, 20 bp, human
gggacgcgcggcttggctag

SEQ ID NO: 109233 - DNA, 20 bp, human
gagcagctggaggcggtgaa

SEQ ID NO: 109234 - DNA, 20 bp, human
gagggcaggggcaggtctca

SEQ ID NO: 109235 - DNA, 20 bp, human
gtggcgtcgccctctctagg

SEQ ID NO: 109236 - DNA, 20 bp, human
gcatggtccaggtgtccgaa

SEQ ID NO: 109237 - DNA, 20 bp, human
gtgctgtcacggctggggaa

SEQ ID NO: 109238 - DNA, 20 bp, human
gcccctaagggcagtcacca

SEQ ID NO: 109239 - DNA, 20 bp, human
gaagggcagtcaccagggtg

SEQ ID NO: 109240 - DNA, 20 bp, human
gctcccaggacgaaccccat

SEQ ID NO: 109241 - DNA, 20 bp, human
gtccagtgctgtcacggctg

SEQ ID NO: 109242 - DNA, 20 bp, human
gggcagctcccactctctgt

SEQ ID NO: 109243 - DNA, 20 bp, human
gccaaggttcccagacccca

SEQ ID NO: 109244 - DNA, 20 bp, human
gccaggacgaaccccattgg

SEQ ID NO: 109245 - DNA, 20 bp, human
gcgtcctgggagccgacagg

SEQ ID NO: 109246 - DNA, 20 bp, human
ggccgggcataaaggcggtg

SEQ ID NO: 109247 - DNA, 20 bp, human
gaaggagccgggggccgcga

SEQ ID NO: 109248 - DNA, 20 bp, human
gcccctcggccccaacaggt

SEQ ID NO: 109249 - DNA, 20 bp, human
gtcggggccgggcataaagg

SEQ ID NO: 109250 - DNA, 20 bp, human
ggttggggtgagcacggcgg

SEQ ID NO: 109251 - DNA, 20 bp, human
ggccccgcccgcccccgatg

SEQ ID NO: 109252 - DNA, 20 bp, human
gccgcgggtcggccccatcg

SEQ ID NO: 109253 - DNA, 20 bp, human
gccgccaacatgtacagggt

SEQ ID NO: 109254 - DNA, 20 bp, human
gatgtacagggtcggaggta

SEQ ID NO: 109255 - DNA, 20 bp, human
gatggccgccaacatgtaca

SEQ ID NO: 109256 - DNA, 20 bp, human
gggatgaaccgcgacggctg

SEQ ID NO: 109257 - DNA, 20 bp, human
ggggccgggatgaaccgcga

SEQ ID NO: 109258 - DNA, 20 bp, human
gcggaaggaggcgaaccctg

SEQ ID NO: 109259 - DNA, 20 bp, human
gaaggaggcgaaccctgagg

SEQ ID NO: 109260 - DNA, 20 bp, human
gccgggtgggaggtgagtac

SEQ ID NO: 109261 - DNA, 20 bp, human
gtaccgggcgcagggatacg

SEQ ID NO: 109262 - DNA, 20 bp, human
gcggccgaaggtgttccgga

SEQ ID NO: 109263 - DNA, 20 bp, human
ggactagtgggactccgcgg

SEQ ID NO: 109264 - DNA, 20 bp, human
ggcagagcccaacgactagt

SEQ ID NO: 109265 - DNA, 20 bp, human
gggatcggccgaaggtgttc

SEQ ID NO: 109266 - DNA, 20 bp, human
gctgctgcctcgccacgggg

SEQ ID NO: 109267 - DNA, 20 bp, human
gacgggccctaccccgatga

SEQ ID NO: 109268 - DNA, 20 bp, human
ggggccaggcctctacttgg

SEQ ID NO: 109269 - DNA, 20 bp, human
gctccacgaaaccctcatcg

SEQ ID NO: 109270 - DNA, 20 bp, human
gaggcgctggagaggatgag

SEQ ID NO: 109271 - DNA, 20 bp, human
ggaggcctggccctaaacac

SEQ ID NO: 109272 - DNA, 20 bp, human
gcatgtaccgggtcggaggt

SEQ ID NO: 109273 - DNA, 20 bp, human
gccccaggctcccactgagt

SEQ ID NO: 109274 - DNA, 20 bp, human
ggccaactgccgggagccaa

SEQ ID NO: 109275 - DNA, 20 bp, human
gcctggccctaaacactggg

SEQ ID NO: 109276 - DNA, 20 bp, human
gaaccaagcgagccacagag

SEQ ID NO: 109277 - DNA, 20 bp, human
gcaagcgagccacagagcgg

SEQ ID NO: 109278 - DNA, 20 bp, human
gcactcccgcgcagtgaggt

SEQ ID NO: 109279 - DNA, 20 bp, human
ggcggcggcaagggacgcac

SEQ ID NO: 109280 - DNA, 20 bp, human
ggagaggtcgtggatgggag

SEQ ID NO: 109281 - DNA, 20 bp, human
gcccgcaccctgtagggcgt

SEQ ID NO: 109282 - DNA, 20 bp, human
gacgggaaaggaatctgcag

SEQ ID NO: 109283 - DNA, 20 bp, human
gagagagagaggtcgtggat

SEQ ID NO: 109284 - DNA, 20 bp, human
ggtgcagataagccaaaagg

SEQ ID NO: 109285 - DNA, 20 bp, human
gtgcgcgggagtgagcagtg

SEQ ID NO: 109286 - DNA, 20 bp, human
gaatcagccgggtaagcgct

SEQ ID NO: 109287 - DNA, 20 bp, human
ggccgagacctaaagttggg

SEQ ID NO: 109288 - DNA, 20 bp, human
ggcaggaaattccattacta

SEQ ID NO: 109289 - DNA, 20 bp, human
gccgtcggcggccagtaggg

SEQ ID NO: 109290 - DNA, 20 bp, human
gagttggggggtgatctctg

SEQ ID NO: 109291 - DNA, 20 bp, human
gcagtagggaggcagaacat

SEQ ID NO: 109292 - DNA, 20 bp, human
gcgaagctgggactctatct

SEQ ID NO: 109293 - DNA, 20 bp, human
gtccagcccttagaagttct

SEQ ID NO: 109294 - DNA, 20 bp, human
gaccccccaactttaggtct

SEQ ID NO: 109295 - DNA, 20 bp, human
ggggaacggcttgtggagag

SEQ ID NO: 109296 - DNA, 20 bp, human
gcggcaccgccgcgagccca

SEQ ID NO: 109297 - DNA, 20 bp, human
gagcccagggcgccacttcc

SEQ ID NO: 109298 - DNA, 20 bp, human
ggacccggaagtggcgccct

SEQ ID NO: 109299 - DNA, 20 bp, human
ggagggagttgggaacgcag

SEQ ID NO: 109300 - DNA, 20 bp, human
ggccatgggagcttcggacc

SEQ ID NO: 109301 - DNA, 20 bp, human
ggacaacgccccgaccactg

SEQ ID NO: 109302 - DNA, 20 bp, human
gctggagccggagctcgcgg

SEQ ID NO: 109303 - DNA, 20 bp, human
gtccgggtccgaagctccca

SEQ ID NO: 109304 - DNA, 20 bp, human
ggattggggcgggcagtcaa

SEQ ID NO: 109305 - DNA, 20 bp, human
gccgggcgccatgggagctt

SEQ ID NO: 109306 - DNA, 20 bp, human
gaccggctcaccgggtcgct

SEQ ID NO: 109307 - DNA, 20 bp, human
gacggagccaccaagcgacc

SEQ ID NO: 109308 - DNA, 20 bp, human
gctggcacgtgacctaggac

SEQ ID NO: 109309 - DNA, 20 bp, human
gggcgggccagtgaaaccgg

SEQ ID NO: 109310 - DNA, 20 bp, human
gcccgcgggtgccatcatgg

SEQ ID NO: 109311 - DNA, 20 bp, human
gtgacctaggaccggctcac

SEQ ID NO: 109312 - DNA, 20 bp, human
gagagggcctcaacgctggg

SEQ ID NO: 109313 - DNA, 20 bp, human
gcggttggctaagggaggag

SEQ ID NO: 109314 - DNA, 20 bp, human
gggctcaccgggtcgcttgg

SEQ ID NO: 109315 - DNA, 20 bp, human
gggtggcggttggctaaggg

SEQ ID NO: 109316 - DNA, 20 bp, human
ggcaggcgcctcccgagtac

SEQ ID NO: 109317 - DNA, 20 bp, human
gcgcgcacgggtctccttag

SEQ ID NO: 109318 - DNA, 20 bp, human
gatgggcgccggtactcggg

SEQ ID NO: 109319 - DNA, 20 bp, human
gggcaaccggaagtggtcca

SEQ ID NO: 109320 - DNA, 20 bp, human
gagagttgtacgagattcgg

SEQ ID NO: 109321 - DNA, 20 bp, human
gggcggacgtactctgtgag

SEQ ID NO: 109322 - DNA, 20 bp, human
gaagcgtgtaggccgcgcac

SEQ ID NO: 109323 - DNA, 20 bp, human
gaaaatgggcgccggtactc

SEQ ID NO: 109324 - DNA, 20 bp, human
gactcgggaggcgcctgccc

SEQ ID NO: 109325 - DNA, 20 bp, human
gcacgggtctccttagcggg

SEQ ID NO: 109326 - DNA, 20 bp, human
gggacgaccgtgggtcacgt

SEQ ID NO: 109327 - DNA, 20 bp, human
gggcggagtgaggctgacag

SEQ ID NO: 109328 - DNA, 20 bp, human
gccggctgggtgatcctggt

SEQ ID NO: 109329 - DNA, 20 bp, human
gcgagctgggcctcgacctg

SEQ ID NO: 109330 - DNA, 20 bp, human
gtgcgggaaatgctctcggt

SEQ ID NO: 109331 - DNA, 20 bp, human
gtccctcggcggaacaatgg

SEQ ID NO: 109332 - DNA, 20 bp, human
gctcggtgcgcagaaagcct

SEQ ID NO: 109333 - DNA, 20 bp, human
gcgggagggagtgtctccag

SEQ ID NO: 109334 - DNA, 20 bp, human
gcctctgacgggagggaaga

SEQ ID NO: 109335 - DNA, 20 bp, human
ggcgagtccctctgacggga

SEQ ID NO: 109336 - DNA, 20 bp, human
gccggagcggctaggaggag

SEQ ID NO: 109337 - DNA, 20 bp, human
ggagttaagaaagacccacc

SEQ ID NO: 109338 - DNA, 20 bp, human
gtagccgctccggaccccag

SEQ ID NO: 109339 - DNA, 20 bp, human
gccgctccggaccccagagg

SEQ ID NO: 109340 - DNA, 20 bp, human
gaagtaaaagcgaactacag

SEQ ID NO: 109341 - DNA, 20 bp, human
gaaagcgaactacagtggat

SEQ ID NO: 109342 - DNA, 20 bp, human
gatggaaagagccttcggtg

SEQ ID NO: 109343 - DNA, 20 bp, human
gcagggtgagattgggaagg

SEQ ID NO: 109344 - DNA, 20 bp, human
ggtacatgcctacatatgat

SEQ ID NO: 109345 - DNA, 20 bp, human
ggcctacatatgatgggaaa

SEQ ID NO: 109346 - DNA, 20 bp, human
ggacgtgcggcccagcgagt

SEQ ID NO: 109347 - DNA, 20 bp, human
gagcgcggctgcgctgtgta

SEQ ID NO: 109348 - DNA, 20 bp, human
gagagaaagggaggttatgg

SEQ ID NO: 109349 - DNA, 20 bp, human
gcgcggcgggacgggacgtg

SEQ ID NO: 109350 - DNA, 20 bp, human
gcgggaccgaccaactcgct

SEQ ID NO: 109351 - DNA, 20 bp, human
gtcccgtagcgggtgacccc

SEQ ID NO: 109352 - DNA, 20 bp, human
gcgaggcctgcttcccgtag

SEQ ID NO: 109353 - DNA, 20 bp, human
gggggcagcttcctaataaa

SEQ ID NO: 109354 - DNA, 20 bp, human
gctagtgcttcgctagaaaa

SEQ ID NO: 109355 - DNA, 20 bp, human
gcgcgctcccgggcccacgt

SEQ ID NO: 109356 - DNA, 20 bp, human
gccagctcgagcttacctga

SEQ ID NO: 109357 - DNA, 20 bp, human
gcgtgcacggacctccggga

SEQ ID NO: 109358 - DNA, 20 bp, human
gcagcgacgcagaggaaccg

SEQ ID NO: 109359 - DNA, 20 bp, human
gggccggaagtgaaggacgg

SEQ ID NO: 109360 - DNA, 20 bp, human
gctggccgtgaaacactcgg

SEQ ID NO: 109361 - DNA, 20 bp, human
gtgccatcttctccgcgcta

SEQ ID NO: 109362 - DNA, 20 bp, human
gctgggcgcgcgggcttctc

SEQ ID NO: 109363 - DNA, 20 bp, human
gccgggagggctccacgacc

SEQ ID NO: 109364 - DNA, 20 bp, human
gtccgcgctatggctgcgtt

SEQ ID NO: 109365 - DNA, 20 bp, human
gatggctgcgttcggccgtc

SEQ ID NO: 109366 - DNA, 20 bp, human
gagaccgaggaccgaaatcc

SEQ ID NO: 109367 - DNA, 20 bp, human
gggcgctgctgagaactgtc

SEQ ID NO: 109368 - DNA, 20 bp, human
gcgggagcttcttgagaccg

SEQ ID NO: 109369 - DNA, 20 bp, human
gtcggggactgcggactgtg

SEQ ID NO: 109370 - DNA, 20 bp, human
gtgggcgtgttcctcaccag

SEQ ID NO: 109371 - DNA, 20 bp, human
gggaggctggccggagagag

SEQ ID NO: 109372 - DNA, 20 bp, human
gtacacagttatggttagta

SEQ ID NO: 109373 - DNA, 20 bp, human
gaaggcacagggagtcccgg

SEQ ID NO: 109374 - DNA, 20 bp, human
gccatgggcgaagggactga

SEQ ID NO: 109375 - DNA, 20 bp, human
gagcggcgccgcagcggtca

SEQ ID NO: 109376 - DNA, 20 bp, human
gcctccgcggctcccggcaa

SEQ ID NO: 109377 - DNA, 20 bp, human
ggagcaccgagggccccagt

SEQ ID NO: 109378 - DNA, 20 bp, human
gcgggagccgcggaggtaaa

SEQ ID NO: 109379 - DNA, 20 bp, human
ggctgccccggcaccctcgg

SEQ ID NO: 109380 - DNA, 20 bp, human
gatcatggtgccgctgggga

SEQ ID NO: 109381 - DNA, 20 bp, human
ggttgccgccgagggtgccg

SEQ ID NO: 109382 - DNA, 20 bp, human
gagagagagaagagcaccga

SEQ ID NO: 109383 - DNA, 20 bp, human
ggtgccggggcagcccactg

SEQ ID NO: 109384 - DNA, 20 bp, human
gcgaaacaaacaagaccagg

SEQ ID NO: 109385 - DNA, 20 bp, human
gtgggctgccccggcaccct

SEQ ID NO: 109386 - DNA, 20 bp, human
ggaatgcaccggcagtccgc

SEQ ID NO: 109387 - DNA, 20 bp, human
gagcgcccacggggacggat

SEQ ID NO: 109388 - DNA, 20 bp, human
gcgaggggctgtattgaagt

SEQ ID NO: 109389 - DNA, 20 bp, human
gagtccgcgggaaaccaaaa

SEQ ID NO: 109390 - DNA, 20 bp, human
gggtccttggagacaagggt

SEQ ID NO: 109391 - DNA, 20 bp, human
gccgcgctcccagaatgcac

SEQ ID NO: 109392 - DNA, 20 bp, human
ggggaaaccaaaatggcgag

SEQ ID NO: 109393 - DNA, 20 bp, human
gtgcaaaggcacccacatac

SEQ ID NO: 109394 - DNA, 20 bp, human
gactcttccggaggagatgg

SEQ ID NO: 109395 - DNA, 20 bp, human
gagaatgagcgttcttacac

SEQ ID NO: 109396 - DNA, 20 bp, human
gtgttggtgcggcgctgttg

SEQ ID NO: 109397 - DNA, 20 bp, human
ggcggcctggaggccttcag

SEQ ID NO: 109398 - DNA, 20 bp, human
ggcgcctggagaacccacag

SEQ ID NO: 109399 - DNA, 20 bp, human
gtggcgccatgagccagcgg

SEQ ID NO: 109400 - DNA, 20 bp, human
gtacccgggccagggatccg

SEQ ID NO: 109401 - DNA, 20 bp, human
gggctcatggcgccaggcgt

SEQ ID NO: 109402 - DNA, 20 bp, human
gtgggaggccgagtccccag

SEQ ID NO: 109403 - DNA, 20 bp, human
ggccgaggcgatgagggtgt

SEQ ID NO: 109404 - DNA, 20 bp, human
gccggcggccgaggcgatga

SEQ ID NO: 109405 - DNA, 20 bp, human
gcagctcggcacagcgtggg

SEQ ID NO: 109406 - DNA, 20 bp, human
gcggccactacagccggtac

SEQ ID NO: 109407 - DNA, 20 bp, human
gactgcagtggagccagtac

SEQ ID NO: 109408 - DNA, 20 bp, human
gcagacccaagtgccggcgg

SEQ ID NO: 109409 - DNA, 20 bp, human
gccagggcggaagctcccat

SEQ ID NO: 109410 - DNA, 20 bp, human
ggggcagacccaagtgccgg

SEQ ID NO: 109411 - DNA, 20 bp, human
gttcggcgcgggactttcgg

SEQ ID NO: 109412 - DNA, 20 bp, human
ggagccagtaccggctgtag

SEQ ID NO: 109413 - DNA, 20 bp, human
gccagagcgcatgccagagc

SEQ ID NO: 109414 - DNA, 20 bp, human
gtgcgtgtcaggaccgaaat

SEQ ID NO: 109415 - DNA, 20 bp, human
ggtcaggaccgaaatgggag

SEQ ID NO: 109416 - DNA, 20 bp, human
gcggttgagtgtttgccccg

SEQ ID NO: 109417 - DNA, 20 bp, human
gttctagcttggctgtcccg

SEQ ID NO: 109418 - DNA, 20 bp, human
ggaagcctgaggagccggag

SEQ ID NO: 109419 - DNA, 20 bp, human
gcgcgcggccgaggtgagta

SEQ ID NO: 109420 - DNA, 20 bp, human
gttaagggcgcagcacccaa

SEQ ID NO: 109421 - DNA, 20 bp, human
gcggctcctgagcccgttaa

SEQ ID NO: 109422 - DNA, 20 bp, human
ggttcccaccctactcacct

SEQ ID NO: 109423 - DNA, 20 bp, human
gtgattggcagcaacgccac

SEQ ID NO: 109424 - DNA, 20 bp, human
gagggagccgccgcgaaggg

SEQ ID NO: 109425 - DNA, 20 bp, human
gcgcgaagggcggtctcccc

SEQ ID NO: 109426 - DNA, 20 bp, human
ggccgtgaggtgagagagtc

SEQ ID NO: 109427 - DNA, 20 bp, human
gccgggtcctgtgggtccaa

SEQ ID NO: 109428 - DNA, 20 bp, human
gacccgacctgggccaaggt

SEQ ID NO: 109429 - DNA, 20 bp, human
gcccggactctctcacctca

SEQ ID NO: 109430 - DNA, 20 bp, human
gtgaggtgagaaaggttcta

SEQ ID NO: 109431 - DNA, 20 bp, human
ggaggctgggcggcccaagg

SEQ ID NO: 109432 - DNA, 20 bp, human
gggcggcccaaggtggaagg

SEQ ID NO: 109433 - DNA, 20 bp, human
gcccgagcttgaggtgagaa

SEQ ID NO: 109434 - DNA, 20 bp, human
ggacgacccgacctgggcca

SEQ ID NO: 109435 - DNA, 20 bp, human
gcagaggtgacaagacccac

SEQ ID NO: 109436 - DNA, 20 bp, human
gtagggactagcaggtgggt

SEQ ID NO: 109437 - DNA, 20 bp, human
ggtcctagggactagcaggt

SEQ ID NO: 109438 - DNA, 20 bp, human
gaagtagcagtccggtccta

SEQ ID NO: 109439 - DNA, 20 bp, human
ggttgggcgcaggaggacgg

SEQ ID NO: 109440 - DNA, 20 bp, human
gtccggtcctagggactagc

SEQ ID NO: 109441 - DNA, 20 bp, human
gtcacggcctgttactagat

SEQ ID NO: 109442 - DNA, 20 bp, human
gttggttgggcgcaggagga

SEQ ID NO: 109443 - DNA, 20 bp, human
gtcatgcggaagtagcagtc

SEQ ID NO: 109444 - DNA, 20 bp, human
gaggcgcgcgggtggaaact

SEQ ID NO: 109445 - DNA, 20 bp, human
ggagcgatctgcacaaggag

SEQ ID NO: 109446 - DNA, 20 bp, human
ggcgcgcggggtcaatctca

SEQ ID NO: 109447 - DNA, 20 bp, human
gccgctgcgacccgcctctg

SEQ ID NO: 109448 - DNA, 20 bp, human
gcgcagcgccggaacctcag

SEQ ID NO: 109449 - DNA, 20 bp, human
gcgcggggtcaatctcatgg

SEQ ID NO: 109450 - DNA, 20 bp, human
gaggcttcgggggattaaaa

SEQ ID NO: 109451 - DNA, 20 bp, human
ggggccagcccagaacgacc

SEQ ID NO: 109452 - DNA, 20 bp, human
gcacgtcgcgaccgcacagg

SEQ ID NO: 109453 - DNA, 20 bp, human
gcggcgcagcctcggaccca

SEQ ID NO: 109454 - DNA, 20 bp, human
gcaagaacatgtggaaacgg

SEQ ID NO: 109455 - DNA, 20 bp, human
gctcatggcggcaccgtccc

SEQ ID NO: 109456 - DNA, 20 bp, human
gtccccgctcccgcactcac

SEQ ID NO: 109457 - DNA, 20 bp, human
gccgagcgctcgctactcca

SEQ ID NO: 109458 - DNA, 20 bp, human
gcgggccgcgaccacccccc

SEQ ID NO: 109459 - DNA, 20 bp, human
ggcggcccgggcgcaaggag

SEQ ID NO: 109460 - DNA, 20 bp, human
gcgggaaagcacgtcacttc

SEQ ID NO: 109461 - DNA, 20 bp, human
gtacttagagcgctggatca

SEQ ID NO: 109462 - DNA, 20 bp, human
gaaaaggccccggaagtggt

SEQ ID NO: 109463 - DNA, 20 bp, human
gtttcccgagccggtgagtg

SEQ ID NO: 109464 - DNA, 20 bp, human
gagcgagcgctcgggcggtg

SEQ ID NO: 109465 - DNA, 20 bp, human
gtcggccgcttgcgacgctc

SEQ ID NO: 109466 - DNA, 20 bp, human
gggccagtccctaagcacgt

SEQ ID NO: 109467 - DNA, 20 bp, human
gttgtcctgcttggctgcgg

SEQ ID NO: 109468 - DNA, 20 bp, human
ggcgggagggacacttgtag

SEQ ID NO: 109469 - DNA, 20 bp, human
ggggagtggaacctcgatat

SEQ ID NO: 109470 - DNA, 20 bp, human
ggcgcgtttgggagcatagt

SEQ ID NO: 109471 - DNA, 20 bp, human
gagtccctaagcacgtgggt

SEQ ID NO: 109472 - DNA, 20 bp, human
gagtggaacctcgatattgg

SEQ ID NO: 109473 - DNA, 20 bp, human
gttctgagttctgactaggg

SEQ ID NO: 109474 - DNA, 20 bp, human
gccgggagagtgggtagttg

SEQ ID NO: 109475 - DNA, 20 bp, human
gctgtggacgagggctctga

SEQ ID NO: 109476 - DNA, 20 bp, human
gccgggtgcagtgcccccta

SEQ ID NO: 109477 - DNA, 20 bp, human
gagcggcagacgcgtgccca

SEQ ID NO: 109478 - DNA, 20 bp, human
gagcgcgacagggcacacgg

SEQ ID NO: 109479 - DNA, 20 bp, human
gccacagccgctggagacct

SEQ ID NO: 109480 - DNA, 20 bp, human
ggagcgctggcggagaacgg

SEQ ID NO: 109481 - DNA, 20 bp, human
gcccggcccccctaatgagt

SEQ ID NO: 109482 - DNA, 20 bp, human
gggaagggcgcacaacacca

SEQ ID NO: 109483 - DNA, 20 bp, human
ggcccttcgggacaacttgg

SEQ ID NO: 109484 - DNA, 20 bp, human
gcggctggggcggaaaccag

SEQ ID NO: 109485 - DNA, 20 bp, human
gcgcgtgccaggggagcagg

SEQ ID NO: 109486 - DNA, 20 bp, human
gcagtcaccggcgcggtcta

SEQ ID NO: 109487 - DNA, 20 bp, human
gaggccgcagtataaccgcg

SEQ ID NO: 109488 - DNA, 20 bp, human
gggtggcgtgcggaacgcga

SEQ ID NO: 109489 - DNA, 20 bp, human
gcccggcgcagtcaccggcg

SEQ ID NO: 109490 - DNA, 20 bp, human
gggcccccgagggacaccga

SEQ ID NO: 109491 - DNA, 20 bp, human
ggagagcggctccctccgaa

SEQ ID NO: 109492 - DNA, 20 bp, human
gtcagcggccaccaccgccg

SEQ ID NO: 109493 - DNA, 20 bp, human
gggggcccgtggccagtcgg

SEQ ID NO: 109494 - DNA, 20 bp, human
ggccgctctcctgcgactcg

SEQ ID NO: 109495 - DNA, 20 bp, human
ggccagtcggcgggcgggac

SEQ ID NO: 109496 - DNA, 20 bp, human
gctgtggacaagaggtgggt

SEQ ID NO: 109497 - DNA, 20 bp, human
gagaccacaggcccacagat

SEQ ID NO: 109498 - DNA, 20 bp, human
ggtctctgtggacaagaggt

SEQ ID NO: 109499 - DNA, 20 bp, human
gagttcaggtctggatgatg

SEQ ID NO: 109500 - DNA, 20 bp, human
ggtttgtgttctaggtctca

SEQ ID NO: 109501 - DNA, 20 bp, human
gctgtgtctctgtggacaag

SEQ ID NO: 109502 - DNA, 20 bp, human
gatggcttgccattatctag

SEQ ID NO: 109503 - DNA, 20 bp, human
gaggtggcctttccttcgaa

SEQ ID NO: 109504 - DNA, 20 bp, human
gacagattactgtgtctctg

SEQ ID NO: 109505 - DNA, 20 bp, human
gggctgtgaaaccactcgcg

SEQ ID NO: 109506 - DNA, 20 bp, human
ggcagcgagaagccgcggac

SEQ ID NO: 109507 - DNA, 20 bp, human
gccatgacggtgccggtccg

SEQ ID NO: 109508 - DNA, 20 bp, human
gcaacgccggcgctcggcca

SEQ ID NO: 109509 - DNA, 20 bp, human
gagcacagcaccctccgtaa

SEQ ID NO: 109510 - DNA, 20 bp, human
ggcggagcagcgagaagccg

SEQ ID NO: 109511 - DNA, 20 bp, human
gctcccggtgcccttacgga

SEQ ID NO: 109512 - DNA, 20 bp, human
gcgctcggccaaggcggccg

SEQ ID NO: 109513 - DNA, 20 bp, human
gcgccggcgctcggccaagg

SEQ ID NO: 109514 - DNA, 20 bp, human
gcatttgaggcactaagaaa

SEQ ID NO: 109515 - DNA, 20 bp, human
gtccggaagccggggatccg

SEQ ID NO: 109516 - DNA, 20 bp, human
gggcccatattcctagcgag

SEQ ID NO: 109517 - DNA, 20 bp, human
gggagcctggcagcagcgga

SEQ ID NO: 109518 - DNA, 20 bp, human
gccatggtgaacgaagccag

SEQ ID NO: 109519 - DNA, 20 bp, human
gatggaccatcgaaaagcca

SEQ ID NO: 109520 - DNA, 20 bp, human
gtgcccctcgctaggaatat

SEQ ID NO: 109521 - DNA, 20 bp, human
gacacatcaagacacctgag

SEQ ID NO: 109522 - DNA, 20 bp, human
ggaggaccctggcttttcga

SEQ ID NO: 109523 - DNA, 20 bp, human
ggtgacagctacctgatgga

SEQ ID NO: 109524 - DNA, 20 bp, human
ggcccggacagccatagctg

SEQ ID NO: 109525 - DNA, 20 bp, human
gggggcagtagtgcccagct

SEQ ID NO: 109526 - DNA, 20 bp, human
gctggagaggcgggcctaca

SEQ ID NO: 109527 - DNA, 20 bp, human
gcctacagggcggaaaccac

SEQ ID NO: 109528 - DNA, 20 bp, human
ggggcggggaacgcagtgaa

SEQ ID NO: 109529 - DNA, 20 bp, human
ggggcctgggccggtcagag

SEQ ID NO: 109530 - DNA, 20 bp, human
gaggtgtcaggttgctggag

SEQ ID NO: 109531 - DNA, 20 bp, human
ggtcactgagtcaccgatgg

SEQ ID NO: 109532 - DNA, 20 bp, human
ggccgccggccgcaccactg

SEQ ID NO: 109533 - DNA, 20 bp, human
gccggcaaacaacctcccgg

SEQ ID NO: 109534 - DNA, 20 bp, human
ggctccctgcctggacggag

SEQ ID NO: 109535 - DNA, 20 bp, human
gtcccgcgaagggtgcgcaa

SEQ ID NO: 109536 - DNA, 20 bp, human
gccgaacccgagggcgccca

SEQ ID NO: 109537 - DNA, 20 bp, human
gcttgggcgtgagatggcgg

SEQ ID NO: 109538 - DNA, 20 bp, human
gaagagcgagaggacggcag

SEQ ID NO: 109539 - DNA, 20 bp, human
gactcggcttgggcgtgaga

SEQ ID NO: 109540 - DNA, 20 bp, human
ggggctaaagagcgagagga

SEQ ID NO: 109541 - DNA, 20 bp, human
gcagcgccaagcggagcctg

SEQ ID NO: 109542 - DNA, 20 bp, human
gctgcttcagctctccccgc

SEQ ID NO: 109543 - DNA, 20 bp, human
gcacagcaccgtcatcccca

SEQ ID NO: 109544 - DNA, 20 bp, human
gggcgatgagtgccgaggag

SEQ ID NO: 109545 - DNA, 20 bp, human
ggtgctcgaaaaccctccgt

SEQ ID NO: 109546 - DNA, 20 bp, human
ggcaggtccgggattcgggg

SEQ ID NO: 109547 - DNA, 20 bp, human
ggaatcccggacctgcgctg

SEQ ID NO: 109548 - DNA, 20 bp, human
gcccgcgccgtaggagggag

SEQ ID NO: 109549 - DNA, 20 bp, human
gtacagggccgaccctcggt

SEQ ID NO: 109550 - DNA, 20 bp, human
gtcccggacctgcgctgagg

SEQ ID NO: 109551 - DNA, 20 bp, human
gtgaggaggcggttcatctg

SEQ ID NO: 109552 - DNA, 20 bp, human
ggcgctgcctccccgaatcc

SEQ ID NO: 109553 - DNA, 20 bp, human
gggctgcagagaccggatat

SEQ ID NO: 109554 - DNA, 20 bp, human
ggaagcagcacgaacagccg

SEQ ID NO: 109555 - DNA, 20 bp, human
gtgggtctcagcgcaaagtc

SEQ ID NO: 109556 - DNA, 20 bp, human
gtgcatcaccatggagccga

SEQ ID NO: 109557 - DNA, 20 bp, human
gccacctgccctcggctcca

SEQ ID NO: 109558 - DNA, 20 bp, human
gtgttaagcggtttcagcat

SEQ ID NO: 109559 - DNA, 20 bp, human
gtgaggctcaggaacaggat

SEQ ID NO: 109560 - DNA, 20 bp, human
gtgggttcgggtcgaaccag

SEQ ID NO: 109561 - DNA, 20 bp, human
ggccccgcctcgaccctcac

SEQ ID NO: 109562 - DNA, 20 bp, human
gccccgcgtgtaggtcaaac

SEQ ID NO: 109563 - DNA, 20 bp, human
gacacctgccgtgcacgtgg

SEQ ID NO: 109564 - DNA, 20 bp, human
ggaggatggggcagaatcac

SEQ ID NO: 109565 - DNA, 20 bp, human
ggaatcccgagaaagatgtc

SEQ ID NO: 109566 - DNA, 20 bp, human
gcctaacgtgggctcacgca

SEQ ID NO: 109567 - DNA, 20 bp, human
ggggtaggatcccttaacca

SEQ ID NO: 109568 - DNA, 20 bp, human
ggctgtaggtaggagttaag

SEQ ID NO: 109569 - DNA, 20 bp, human
ggcccctggattctgagcac

SEQ ID NO: 109570 - DNA, 20 bp, human
gctggacccggaagaatggt

SEQ ID NO: 109571 - DNA, 20 bp, human
gcttcgtgaatgcctaacgt

SEQ ID NO: 109572 - DNA, 20 bp, human
gggagatcaccttctggacc

SEQ ID NO: 109573 - DNA, 20 bp, human
gcctggattctgagcacggg

SEQ ID NO: 109574 - DNA, 20 bp, human
gaggtaggagttaagtgggt

SEQ ID NO: 109575 - DNA, 20 bp, human
gacccggaagaatggtcggt

SEQ ID NO: 109576 - DNA, 20 bp, human
gcgcaagtacagcggatctg

SEQ ID NO: 109577 - DNA, 20 bp, human
ggtagcggacgcaagtacag

SEQ ID NO: 109578 - DNA, 20 bp, human
ggagcgccagggctagagac

SEQ ID NO: 109579 - DNA, 20 bp, human
gacctgcagaacgggaccgg

SEQ ID NO: 109580 - DNA, 20 bp, human
gccggttgttggtaagtcgg

SEQ ID NO: 109581 - DNA, 20 bp, human
gggaggcacccggaaggtca

SEQ ID NO: 109582 - DNA, 20 bp, human
gcccacctgcagaacgggac

SEQ ID NO: 109583 - DNA, 20 bp, human
ggcgacgcccacctgcagaa

SEQ ID NO: 109584 - DNA, 20 bp, human
gcttccgggagcccccgacc

SEQ ID NO: 109585 - DNA, 20 bp, human
gcccactacggagagcgaag

SEQ ID NO: 109586 - DNA, 20 bp, human
gtcccgctcgctccacgctg

SEQ ID NO: 109587 - DNA, 20 bp, human
gcctccgaggaggaatgacg

SEQ ID NO: 109588 - DNA, 20 bp, human
gcaggtgcgtccctccgagg

SEQ ID NO: 109589 - DNA, 20 bp, human
gtgccgcagcgtggagcgag

SEQ ID NO: 109590 - DNA, 20 bp, human
gtcaggtgagcggcgaccag

SEQ ID NO: 109591 - DNA, 20 bp, human
gccccaggtgcgtccctccg

SEQ ID NO: 109592 - DNA, 20 bp, human
gcgttggcggttggagaagg

SEQ ID NO: 109593 - DNA, 20 bp, human
ggggaggggcgaccaggtaa

SEQ ID NO: 109594 - DNA, 20 bp, human
gggggcgaccaggtaagggg

SEQ ID NO: 109595 - DNA, 20 bp, human
ggtcacgggaggggcgacca

SEQ ID NO: 109596 - DNA, 20 bp, human
ggtgagcgcgcacccacctc

SEQ ID NO: 109597 - DNA, 20 bp, human
gagcagcctggcaacggcgg

SEQ ID NO: 109598 - DNA, 20 bp, human
ggagcgtcgccggggaggca

SEQ ID NO: 109599 - DNA, 20 bp, human
gggacggggaagcaaagtcc

SEQ ID NO: 109600 - DNA, 20 bp, human
gccgcggagcgtcgccgggg

SEQ ID NO: 109601 - DNA, 20 bp, human
gcactcaccgccccgggacg

SEQ ID NO: 109602 - DNA, 20 bp, human
gccaaggcgaggaccagccg

SEQ ID NO: 109603 - DNA, 20 bp, human
gcaccttgggcggggagaac

SEQ ID NO: 109604 - DNA, 20 bp, human
gcctggggagcagctccgaa

SEQ ID NO: 109605 - DNA, 20 bp, human
ggacggacgcccgctccgtg

SEQ ID NO: 109606 - DNA, 20 bp, human
ggccaggtgacagctaatgg

SEQ ID NO: 109607 - DNA, 20 bp, human
ggccgccaggtgacagctaa

SEQ ID NO: 109608 - DNA, 20 bp, human
ggcgggcggtatagagcggg

SEQ ID NO: 109609 - DNA, 20 bp, human
gcggcccgcagcaggtccga

SEQ ID NO: 109610 - DNA, 20 bp, human
gaccgcccgcccgcctcagg

SEQ ID NO: 109611 - DNA, 20 bp, human
gagggcagcagtccccggat

SEQ ID NO: 109612 - DNA, 20 bp, human
gcgggcgggcggtatagagc

SEQ ID NO: 109613 - DNA, 20 bp, human
gtataccgcccgcccgcctc

SEQ ID NO: 109614 - DNA, 20 bp, human
gtaatggcggcggccgcctg

SEQ ID NO: 109615 - DNA, 20 bp, human
ggccgtcgggacgggagcgg

SEQ ID NO: 109616 - DNA, 20 bp, human
gcagaacttcgggcagagaa

SEQ ID NO: 109617 - DNA, 20 bp, human
ggggcgtaaagctctcagtg

SEQ ID NO: 109618 - DNA, 20 bp, human
gccgtagaaggaccctccag

SEQ ID NO: 109619 - DNA, 20 bp, human
gctacggacgacagaacttc

SEQ ID NO: 109620 - DNA, 20 bp, human
gccgagccgggcggactgac

SEQ ID NO: 109621 - DNA, 20 bp, human
gtgctagtgccggaacgcag

SEQ ID NO: 109622 - DNA, 20 bp, human
ggctcggctggccgcagaaa

SEQ ID NO: 109623 - DNA, 20 bp, human
gggaggtaggacctgaaggt

SEQ ID NO: 109624 - DNA, 20 bp, human
gcgttcccgtcgcgggccag

SEQ ID NO: 109625 - DNA, 20 bp, human
gaggctccacggaagcgcag

SEQ ID NO: 109626 - DNA, 20 bp, human
gtctgaattgagggtagcag

SEQ ID NO: 109627 - DNA, 20 bp, human
gctagtacagcgagagtggg

SEQ ID NO: 109628 - DNA, 20 bp, human
gtcagaagggccccgaggtt

SEQ ID NO: 109629 - DNA, 20 bp, human
gcagctggacgagtgaagag

SEQ ID NO: 109630 - DNA, 20 bp, human
gagggtagcaggggcttgta

SEQ ID NO: 109631 - DNA, 20 bp, human
ggaggtgaatccggtcagaa

SEQ ID NO: 109632 - DNA, 20 bp, human
gaacagtgttcgggcttcgg

SEQ ID NO: 109633 - DNA, 20 bp, human
gtcactagtacagcgagagt

SEQ ID NO: 109634 - DNA, 20 bp, human
gagggccccgaggttaggct

SEQ ID NO: 109635 - DNA, 20 bp, human
gcgcgctctgggtgataaag

SEQ ID NO: 109636 - DNA, 20 bp, human
gcggcggccaccagcactag

SEQ ID NO: 109637 - DNA, 20 bp, human
gccaccagcactagcggctg

SEQ ID NO: 109638 - DNA, 20 bp, human
gcgacgcgcggacgcagagg

SEQ ID NO: 109639 - DNA, 20 bp, human
gtcgcggccttggggatggg

SEQ ID NO: 109640 - DNA, 20 bp, human
gcagcgacgcgcggacgcag

SEQ ID NO: 109641 - DNA, 20 bp, human
ggagccccagccgctagtgc

SEQ ID NO: 109642 - DNA, 20 bp, human
gggattctggagaggacctg

SEQ ID NO: 109643 - DNA, 20 bp, human
ggctccccgctgcaaggaag

SEQ ID NO: 109644 - DNA, 20 bp, human
gttgtgggcactgctgggag

SEQ ID NO: 109645 - DNA, 20 bp, human
gggcggctcgggctccagct

SEQ ID NO: 109646 - DNA, 20 bp, human
gaagtggaagtagaaggcgg

SEQ ID NO: 109647 - DNA, 20 bp, human
gccgcttgaggcacactgag

SEQ ID NO: 109648 - DNA, 20 bp, human
ggttccggaggttctagtgt

SEQ ID NO: 109649 - DNA, 20 bp, human
gctcagtaccgggccaagga

SEQ ID NO: 109650 - DNA, 20 bp, human
gactccgacactagaacctc

SEQ ID NO: 109651 - DNA, 20 bp, human
ggcggtggctgaggcggttc

SEQ ID NO: 109652 - DNA, 20 bp, human
ggtatccggagtataagagt

SEQ ID NO: 109653 - DNA, 20 bp, human
ggggtgcaggcaggtgccat

SEQ ID NO: 109654 - DNA, 20 bp, human
gaggatggcagcgggaccgg

SEQ ID NO: 109655 - DNA, 20 bp, human
gatactccggatacagaccc

SEQ ID NO: 109656 - DNA, 20 bp, human
gacagggcgggagaagcgga

SEQ ID NO: 109657 - DNA, 20 bp, human
gagtcttcgcggctacaggg

SEQ ID NO: 109658 - DNA, 20 bp, human
gagggcggagtgctacggac

SEQ ID NO: 109659 - DNA, 20 bp, human
gagcggagggcggagtgcta

SEQ ID NO: 109660 - DNA, 20 bp, human
gagcagtcttcgcggctaca

SEQ ID NO: 109661 - DNA, 20 bp, human
gatcggaatatgaaaggtag

SEQ ID NO: 109662 - DNA, 20 bp, human
gaacgagatcggaatatgaa

SEQ ID NO: 109663 - DNA, 20 bp, human
gagcctccacgccccaggga

SEQ ID NO: 109664 - DNA, 20 bp, human
gcaggcgcggtgcactctgg

SEQ ID NO: 109665 - DNA, 20 bp, human
gactgggaccacctccatcg

SEQ ID NO: 109666 - DNA, 20 bp, human
ggccggacgagacgtcccag

SEQ ID NO: 109667 - DNA, 20 bp, human
ggccgctgggacgtctcgtc

SEQ ID NO: 109668 - DNA, 20 bp, human
ggacatggcgaggccctcca

SEQ ID NO: 109669 - DNA, 20 bp, human
ggcccggaccctagatgcgg

SEQ ID NO: 109670 - DNA, 20 bp, human
gtcggcccggaccctagatg

SEQ ID NO: 109671 - DNA, 20 bp, human
gagtgggaatgggagctcgg

SEQ ID NO: 109672 - DNA, 20 bp, human
gtcacccgccgaggagacgg

SEQ ID NO: 109673 - DNA, 20 bp, human
gccgtcctccgtctcctcgg

SEQ ID NO: 109674 - DNA, 20 bp, human
gcgagacgtcccagcggctc

SEQ ID NO: 109675 - DNA, 20 bp, human
gcgggctgccttcccagacc

SEQ ID NO: 109676 - DNA, 20 bp, human
ggggcaagacgcggtcgttg

SEQ ID NO: 109677 - DNA, 20 bp, human
ggtcttgcccggctccgccc

SEQ ID NO: 109678 - DNA, 20 bp, human
ggcacggtgactcacccagg

SEQ ID NO: 109679 - DNA, 20 bp, human
gatactgtgaacagggaggt

SEQ ID NO: 109680 - DNA, 20 bp, human
ggcggcctcagagggtcggg

SEQ ID NO: 109681 - DNA, 20 bp, human
gccaggtgcccaggttctag

SEQ ID NO: 109682 - DNA, 20 bp, human
gtgggcagtaccacagatgg

SEQ ID NO: 109683 - DNA, 20 bp, human
gcatgagggagaatggccta

SEQ ID NO: 109684 - DNA, 20 bp, human
ggcggagcctaaagactggg

SEQ ID NO: 109685 - DNA, 20 bp, human
gggataaaagcctccatctg

SEQ ID NO: 109686 - DNA, 20 bp, human
gctcccgcacgagtgcagaa

SEQ ID NO: 109687 - DNA, 20 bp, human
gcgcacgagtgcagaaggga

SEQ ID NO: 109688 - DNA, 20 bp, human
gcctggccttcgaccatctc

SEQ ID NO: 109689 - DNA, 20 bp, human
gccggccccgaacgtttggg

SEQ ID NO: 109690 - DNA, 20 bp, human
gtctcccctcctctccacaa

SEQ ID NO: 109691 - DNA, 20 bp, human
gagctgggcccgctccattg

SEQ ID NO: 109692 - DNA, 20 bp, human
gcgcggcggccaagaggcta

SEQ ID NO: 109693 - DNA, 20 bp, human
gctgcctttgggggcctagg

SEQ ID NO: 109694 - DNA, 20 bp, human
gggggatgggctgaaatcga

SEQ ID NO: 109695 - DNA, 20 bp, human
gatggagcaggagacgcggg

SEQ ID NO: 109696 - DNA, 20 bp, human
gagcgtgtgtggaccgagag

SEQ ID NO: 109697 - DNA, 20 bp, human
gcggcctcccgggggactcg

SEQ ID NO: 109698 - DNA, 20 bp, human
gtctaggagacggcgctcac

SEQ ID NO: 109699 - DNA, 20 bp, human
gcctgtacctacaggagcag

SEQ ID NO: 109700 - DNA, 20 bp, human
gctgccccgagtcccccggg

SEQ ID NO: 109701 - DNA, 20 bp, human
ggtctcacaggcgtaccata

SEQ ID NO: 109702 - DNA, 20 bp, human
gccatacggctacagaaaca

SEQ ID NO: 109703 - DNA, 20 bp, human
gccggccccggtggcgtcaa

SEQ ID NO: 109704 - DNA, 20 bp, human
ggggccggcagacagacccg

SEQ ID NO: 109705 - DNA, 20 bp, human
gagaggcctcctgtacctac

SEQ ID NO: 109706 - DNA, 20 bp, human
gcccgggaccctgcagacgt

SEQ ID NO: 109707 - DNA, 20 bp, human
gcgctggtgtcaccaacctt

SEQ ID NO: 109708 - DNA, 20 bp, human
gtgcagacgtgggccagcca

SEQ ID NO: 109709 - DNA, 20 bp, human
gacatccgtacgcccaaggt

SEQ ID NO: 109710 - DNA, 20 bp, human
gggcgtacggatgtgctcca

SEQ ID NO: 109711 - DNA, 20 bp, human
ggagcacatccgtacgccca

SEQ ID NO: 109712 - DNA, 20 bp, human
gagctaaggctaggcctggg

SEQ ID NO: 109713 - DNA, 20 bp, human
gagcagctaaggctaggcct

SEQ ID NO: 109714 - DNA, 20 bp, human
gctcgtgccaggagaaagaa

SEQ ID NO: 109715 - DNA, 20 bp, human
ggcattgcctgagcatcccg

SEQ ID NO: 109716 - DNA, 20 bp, human
ggaggcggctagaccggtgg

SEQ ID NO: 109717 - DNA, 20 bp, human
gtagcactgagatcttccgg

SEQ ID NO: 109718 - DNA, 20 bp, human
ggtataaaaagctgagataa

SEQ ID NO: 109719 - DNA, 20 bp, human
ggcaggaggcagagcaatgt

SEQ ID NO: 109720 - DNA, 20 bp, human
gaggcgtgcaccaggagcgg

SEQ ID NO: 109721 - DNA, 20 bp, human
gagggcgggggtagaaaccc

SEQ ID NO: 109722 - DNA, 20 bp, human
gtgagtgtgaggtcaaggct

SEQ ID NO: 109723 - DNA, 20 bp, human
gaaggaagtaactccgcagg

SEQ ID NO: 109724 - DNA, 20 bp, human
gagaacccgggaccccccac

SEQ ID NO: 109725 - DNA, 20 bp, human
gtgagccaggaccgggaggg

SEQ ID NO: 109726 - DNA, 20 bp, human
ggtcccgcgttggcaagcgg

SEQ ID NO: 109727 - DNA, 20 bp, human
ggcgagtagccacttccgct

SEQ ID NO: 109728 - DNA, 20 bp, human
gccagggaaccgagcccggt

SEQ ID NO: 109729 - DNA, 20 bp, human
gcgcgggacccggagcccaa

SEQ ID NO: 109730 - DNA, 20 bp, human
gccccgccgcagggaagtag

SEQ ID NO: 109731 - DNA, 20 bp, human
ggagcccggtaggtgcgagg

SEQ ID NO: 109732 - DNA, 20 bp, human
gccgggtcctccatctggac

SEQ ID NO: 109733 - DNA, 20 bp, human
gctgaaacccgtccagatgg

SEQ ID NO: 109734 - DNA, 20 bp, human
gggccgctagggactcctag

SEQ ID NO: 109735 - DNA, 20 bp, human
gtcctcccggcaggacaata

SEQ ID NO: 109736 - DNA, 20 bp, human
gcagggaccatgcagggcaa

SEQ ID NO: 109737 - DNA, 20 bp, human
gggacgcagcgcctctccgc

SEQ ID NO: 109738 - DNA, 20 bp, human
gcgcgcacagggaccatgca

SEQ ID NO: 109739 - DNA, 20 bp, human
ggcacgggctgggaggcgtt

SEQ ID NO: 109740 - DNA, 20 bp, human
gggagtgtcccacctcttag

SEQ ID NO: 109741 - DNA, 20 bp, human
gaagctcaggaacgcaggta

SEQ ID NO: 109742 - DNA, 20 bp, human
ggtcacagcccctaagaggt

SEQ ID NO: 109743 - DNA, 20 bp, human
gctcccctgggccagcgctc

SEQ ID NO: 109744 - DNA, 20 bp, human
ggtccggagcgctggcccag

SEQ ID NO: 109745 - DNA, 20 bp, human
gggagccttaacaagtggtc

SEQ ID NO: 109746 - DNA, 20 bp, human
ggacgcactcccttctacaa

SEQ ID NO: 109747 - DNA, 20 bp, human
gcacggagaggatcaccagg

SEQ ID NO: 109748 - DNA, 20 bp, human
gttgcccacgacgtccacgg

SEQ ID NO: 109749 - DNA, 20 bp, human
gaggttgcccacgacgtcca

SEQ ID NO: 109750 - DNA, 20 bp, human
ggcggttcctgagcacggag

SEQ ID NO: 109751 - DNA, 20 bp, human
gcccgggctgaggagggaaa

SEQ ID NO: 109752 - DNA, 20 bp, human
gaggggatggagaaaaatat

SEQ ID NO: 109753 - DNA, 20 bp, human
ggggtgcagccgttgtagaa

SEQ ID NO: 109754 - DNA, 20 bp, human
gacccctcgacctccctggg

SEQ ID NO: 109755 - DNA, 20 bp, human
ggagataactaattaagcgt

SEQ ID NO: 109756 - DNA, 20 bp, human
gggctaaaaccacagaaggt

SEQ ID NO: 109757 - DNA, 20 bp, human
ggcggtggctgcctcagtcc

SEQ ID NO: 109758 - DNA, 20 bp, human
gttgaagctgacacgagtga

SEQ ID NO: 109759 - DNA, 20 bp, human
ggtcccccgcttcagaccgg

SEQ ID NO: 109760 - DNA, 20 bp, human
gcgtcgaagtgcggagtccg

SEQ ID NO: 109761 - DNA, 20 bp, human
gcgagagccgcaccgagcgg

SEQ ID NO: 109762 - DNA, 20 bp, human
gcgcctcccccggtctgaag

SEQ ID NO: 109763 - DNA, 20 bp, human
ggtccgagagccgcaccgag

SEQ ID NO: 109764 - DNA, 20 bp, human
gccttgcgagacactgatcg

SEQ ID NO: 109765 - DNA, 20 bp, human
ggtgagaatcctaccttctg

SEQ ID NO: 109766 - DNA, 20 bp, human
gtcccggcttagaggacagc

SEQ ID NO: 109767 - DNA, 20 bp, human
gggacagcggggaaggcggg

SEQ ID NO: 109768 - DNA, 20 bp, human
ggcctggcacgacccctcta

SEQ ID NO: 109769 - DNA, 20 bp, human
gcggacgctagtgttccctg

SEQ ID NO: 109770 - DNA, 20 bp, human
ggggcctgaagcggcggtac

SEQ ID NO: 109771 - DNA, 20 bp, human
gatacgtggctcaaaagaaa

SEQ ID NO: 109772 - DNA, 20 bp, human
gtagaggacagcggggaagg

SEQ ID NO: 109773 - DNA, 20 bp, human
gggcagggggcctgaagcgg

SEQ ID NO: 109774 - DNA, 20 bp, human
gtcctctaagccgggagcga

SEQ ID NO: 109775 - DNA, 20 bp, human
gcctcgaggggtgggagtca

SEQ ID NO: 109776 - DNA, 20 bp, human
gacggaactacagggcaaac

SEQ ID NO: 109777 - DNA, 20 bp, human
gcttcagggagcgtggagac

SEQ ID NO: 109778 - DNA, 20 bp, human
ggctgtgggacggaactaca

SEQ ID NO: 109779 - DNA, 20 bp, human
gtggactcgagttcttctcc

SEQ ID NO: 109780 - DNA, 20 bp, human
gcacagcgggcgaggagtct

SEQ ID NO: 109781 - DNA, 20 bp, human
gagtccagcggcctatcgtc

SEQ ID NO: 109782 - DNA, 20 bp, human
gcgggcacacaggttcaaac

SEQ ID NO: 109783 - DNA, 20 bp, human
gcgaggagtctgggatcacg

SEQ ID NO: 109784 - DNA, 20 bp, human
ggcactagcgcgaagctgaa

SEQ ID NO: 109785 - DNA, 20 bp, human
ggttcccctacagagatcag

SEQ ID NO: 109786 - DNA, 20 bp, human
gacctctctgctgggcccgg

SEQ ID NO: 109787 - DNA, 20 bp, human
gggagagacttcctgggtgg

SEQ ID NO: 109788 - DNA, 20 bp, human
ggagtgaaccggaagtgtaa

SEQ ID NO: 109789 - DNA, 20 bp, human
gttggccgcggcgaccgttc

SEQ ID NO: 109790 - DNA, 20 bp, human
gtgaggctgaggaagctgat

SEQ ID NO: 109791 - DNA, 20 bp, human
ggccgcggcgaccgttcggg

SEQ ID NO: 109792 - DNA, 20 bp, human
gagagtaggcgagaacacgg

SEQ ID NO: 109793 - DNA, 20 bp, human
gctgggtggaggcggcacca

SEQ ID NO: 109794 - DNA, 20 bp, human
gcaggcggaacctctctgct

SEQ ID NO: 109795 - DNA, 20 bp, human
gaaggagagaggggcgtcta

SEQ ID NO: 109796 - DNA, 20 bp, human
gccgcgcgtgtctggctgct

SEQ ID NO: 109797 - DNA, 20 bp, human
gagcgccctagggcctctct

SEQ ID NO: 109798 - DNA, 20 bp, human
ggaactaaccgcgctctgaa

SEQ ID NO: 109799 - DNA, 20 bp, human
gcgcgacgcgagccaacggg

SEQ ID NO: 109800 - DNA, 20 bp, human
gaggaggacgacgtgacatc

SEQ ID NO: 109801 - DNA, 20 bp, human
gaaggttctaaatgtctgcg

SEQ ID NO: 109802 - DNA, 20 bp, human
gagccccgagagaggcccta

SEQ ID NO: 109803 - DNA, 20 bp, human
ggagaagacgtgctctccac

SEQ ID NO: 109804 - DNA, 20 bp, human
ggaaagcccgcagcgcccta

SEQ ID NO: 109805 - DNA, 20 bp, human
gaagagaaaaccggcagagg

SEQ ID NO: 109806 - DNA, 20 bp, human
gtcagaagcgacagcccgcg

SEQ ID NO: 109807 - DNA, 20 bp, human
gggtttgtcgggctgaaatg

SEQ ID NO: 109808 - DNA, 20 bp, human
gaaatgtggcgggtctcgga

SEQ ID NO: 109809 - DNA, 20 bp, human
gttgtcgggctgaaatgtgg

SEQ ID NO: 109810 - DNA, 20 bp, human
gaggaagtgaacgtgatctc

SEQ ID NO: 109811 - DNA, 20 bp, human
gtagctctctttactgaggt

SEQ ID NO: 109812 - DNA, 20 bp, human
gacgtgatctcgggtttgtc

SEQ ID NO: 109813 - DNA, 20 bp, human
ggctgaaatgtggcgggtct

SEQ ID NO: 109814 - DNA, 20 bp, human
gacgttagctctctttactg

SEQ ID NO: 109815 - DNA, 20 bp, human
gaacccggaagaagtgaacc

SEQ ID NO: 109816 - DNA, 20 bp, human
gcgatctcggactaaggatg

SEQ ID NO: 109817 - DNA, 20 bp, human
gggcagcgccccacagaacc

SEQ ID NO: 109818 - DNA, 20 bp, human
gggagcacaagagagcccac

SEQ ID NO: 109819 - DNA, 20 bp, human
gagagcccacaggagaggat

SEQ ID NO: 109820 - DNA, 20 bp, human
gtgcggtcccgggttctgtg

SEQ ID NO: 109821 - DNA, 20 bp, human
gcgagatcgcggaccctgac

SEQ ID NO: 109822 - DNA, 20 bp, human
gcgcggaccctgaccggaac

SEQ ID NO: 109823 - DNA, 20 bp, human
gggtccgcgatctcggacta

SEQ ID NO: 109824 - DNA, 20 bp, human
gggactaaggatgcggtccc

SEQ ID NO: 109825 - DNA, 20 bp, human
gctaataagcatgtaaaagg

SEQ ID NO: 109826 - DNA, 20 bp, human
gattggtccaatgtgatgtg

SEQ ID NO: 109827 - DNA, 20 bp, human
ggcttcttctaggccaactt

SEQ ID NO: 109828 - DNA, 20 bp, human
gcttctatgaaatgatagat

SEQ ID NO: 109829 - DNA, 20 bp, human
gaagaagcgatcaattaaga

SEQ ID NO: 109830 - DNA, 20 bp, human
gttaattgatcgcttcttct

SEQ ID NO: 109831 - DNA, 20 bp, human
gaaaatataacttccaaagt

SEQ ID NO: 109832 - DNA, 20 bp, human
gttttttcatctttccatcg

SEQ ID NO: 109833 - DNA, 20 bp, human
gaggagttcagttatgtgtt

SEQ ID NO: 109834 - DNA, 20 bp, human
gaaccaagcataaagtagca

SEQ ID NO: 109835 - DNA, 20 bp, human
ggtgtttggaattttttggg

SEQ ID NO: 109836 - DNA, 20 bp, human
gtattaggctaactgtcagt

SEQ ID NO: 109837 - DNA, 20 bp, human
gttgtatgaatgaccacacg

SEQ ID NO: 109838 - DNA, 20 bp, human
gctgtctcctacttttaatc

SEQ ID NO: 109839 - DNA, 20 bp, human
gcagtatcctgactgtgcaa

SEQ ID NO: 109840 - DNA, 20 bp, human
gatgctacctttgcacagtc

SEQ ID NO: 109841 - DNA, 20 bp, human
gcttaattggtgattgcttt

SEQ ID NO: 109842 - DNA, 20 bp, human
gcccagtgacatacgttcaa

SEQ ID NO: 109843 - DNA, 20 bp, human
gacaggcggggtaaaatttg

SEQ ID NO: 109844 - DNA, 20 bp, human
ggccattgaacgtatgtcac

SEQ ID NO: 109845 - DNA, 20 bp, human
gaatttccctgattaaaagt

SEQ ID NO: 109846 - DNA, 20 bp, human
gtggtttggttaaggttgtt

SEQ ID NO: 109847 - DNA, 20 bp, human
gttaaggttgtttggtagta

SEQ ID NO: 109848 - DNA, 20 bp, human
gaggttgtttggtagtaagg

SEQ ID NO: 109849 - DNA, 20 bp, human
gaaccaagcataatatagca

SEQ ID NO: 109850 - DNA, 20 bp, human
gtttggtagtaaggtggaat

SEQ ID NO: 109851 - DNA, 20 bp, human
gctgcttttaggcctactat

SEQ ID NO: 109852 - DNA, 20 bp, human
ggggatttggagggttctgt

SEQ ID NO: 109853 - DNA, 20 bp, human
gtttatttgagtaaatggtt

SEQ ID NO: 109854 - DNA, 20 bp, human
gatttacagggggatttgga

SEQ ID NO: 109855 - DNA, 20 bp, human
gtagtaaggtggaatgggtt

SEQ ID NO: 109856 - DNA, 20 bp, human
gtgttaggagttcagtagac

SEQ ID NO: 109857 - DNA, 20 bp, human
gtggtatcctgaccgtgcga

SEQ ID NO: 109858 - DNA, 20 bp, human
gtaaatgctttcttaattag

SEQ ID NO: 109859 - DNA, 20 bp, human
gtgattatgctaccttcgca

SEQ ID NO: 109860 - DNA, 20 bp, human
gatgctaccttcgcacggtc

SEQ ID NO: 109861 - DNA, 20 bp, human
gtgggatgttaactgtcagt

SEQ ID NO: 109862 - DNA, 20 bp, human
gttatatcatttattaatat

SEQ ID NO: 109863 - DNA, 20 bp, human
gtgaatgaatggccacacga

SEQ ID NO: 109864 - DNA, 20 bp, human
gagacagctgaaccttcgtg

SEQ ID NO: 109865 - DNA, 20 bp, human
ggttaacagtgcaaataata

SEQ ID NO: 109866 - DNA, 20 bp, human
gagcagtgacaagcctacgg

SEQ ID NO: 109867 - DNA, 20 bp, human
gagctatcaccagcctccgt

SEQ ID NO: 109868 - DNA, 20 bp, human
gtaatattaggagtttaaca

SEQ ID NO: 109869 - DNA, 20 bp, human
gtaagtttaactgttaaagg

SEQ ID NO: 109870 - DNA, 20 bp, human
gtcttttactctctatagga

SEQ ID NO: 109871 - DNA, 20 bp, human
ggaagctcctctgattttgg

SEQ ID NO: 109872 - DNA, 20 bp, human
ggtgacaagcctacggaggc

SEQ ID NO: 109873 - DNA, 20 bp, human
gaaaatcttttactctctat

SEQ ID NO: 109874 - DNA, 20 bp, human
gaagagtacactcatttatg

SEQ ID NO: 109875 - DNA, 20 bp, human
gggagaagctcctctgattt

SEQ ID NO: 109876 - DNA, 20 bp, human
gctgctttcgggccaactat

SEQ ID NO: 109877 - DNA, 20 bp, human
gaggctgttaatttgtcagt

SEQ ID NO: 109878 - DNA, 20 bp, human
gttaattgatggctgctttc

SEQ ID NO: 109879 - DNA, 20 bp, human
gacaggcatgctctaaggaa

SEQ ID NO: 109880 - DNA, 20 bp, human
gggggattaagtggctctgt

SEQ ID NO: 109881 - DNA, 20 bp, human
gagctatcactaggctcagt

SEQ ID NO: 109882 - DNA, 20 bp, human
gctgatgtaggcttaagcag

SEQ ID NO: 109883 - DNA, 20 bp, human
gtgtgttggattaacagtat

SEQ ID NO: 109884 - DNA, 20 bp, human
gaatttacagggggattaag

SEQ ID NO: 109885 - DNA, 20 bp, human
ggtaatagattagtccaatg

SEQ ID NO: 109886 - DNA, 20 bp, human
gagtagaagtgacaaggcta

SEQ ID NO: 109887 - DNA, 20 bp, human
gataagcttaaagttgaact

SEQ ID NO: 109888 - DNA, 20 bp, human
gttgaactaggagtctatct

SEQ ID NO: 109889 - DNA, 20 bp, human
gtaaacatgttcttaattgg

SEQ ID NO: 109890 - DNA, 20 bp, human
gaggtgtgtttttggtaaac

SEQ ID NO: 109891 - DNA, 20 bp, human
gacttaaacatgttcttaat

SEQ ID NO: 109892 - DNA, 20 bp, human
gaacagttaaacttacaggg

SEQ ID NO: 109893 - DNA, 20 bp, human
gggttaacagtgtaaataat

SEQ ID NO: 109894 - DNA, 20 bp, human
gaactgtcagtggattattc

SEQ ID NO: 109895 - DNA, 20 bp, human
gaatattttttattttctgt

SEQ ID NO: 109896 - DNA, 20 bp, human
gaagctgttcggtagtaagg

SEQ ID NO: 109897 - DNA, 20 bp, human
gtgatttggttaaagctgtt

SEQ ID NO: 109898 - DNA, 20 bp, human
gttaaagctgttcggtagta

SEQ ID NO: 109899 - DNA, 20 bp, human
gaaatagtgggaagattcgt

SEQ ID NO: 109900 - DNA, 20 bp, human
gggcgatagaaattgtaaat

SEQ ID NO: 109901 - DNA, 20 bp, human
gttcggtagtaaggtggaat

SEQ ID NO: 109902 - DNA, 20 bp, human
ggggatttggagggttctgt

SEQ ID NO: 109903 - DNA, 20 bp, human
gtttatttgggtaaatgatt

SEQ ID NO: 109904 - DNA, 20 bp, human
gatttacagggggatttgga

SEQ ID NO: 109905 - DNA, 20 bp, human
gtagtaaggtggaatgggtt

SEQ ID NO: 109906 - DNA, 20 bp, human
ggtaagctgcctgtcggcta

SEQ ID NO: 109907 - DNA, 20 bp, human
gtgcccggctggcgcggcgt

SEQ ID NO: 109908 - DNA, 20 bp, human
ggcgtgggtaagctgcctgt

SEQ ID NO: 109909 - DNA, 20 bp, human
gtccgggaaccgtagccgac

SEQ ID NO: 109910 - DNA, 20 bp, human
gcggccgcgggcagaactca

SEQ ID NO: 109911 - DNA, 20 bp, human
ggggcgagcggccggaatcc

SEQ ID NO: 109912 - DNA, 20 bp, human
ggtgggcgctcggaacgtcc

SEQ ID NO: 109913 - DNA, 20 bp, human
gggaaagcgcctagaaccaa

SEQ ID NO: 109914 - DNA, 20 bp, human
gtcggggacgcggggaactg

SEQ ID NO: 109915 - DNA, 20 bp, human
gctcccaggagattagtgca

SEQ ID NO: 109916 - DNA, 20 bp, human
gcgggcgcgcaggagtgaaa

SEQ ID NO: 109917 - DNA, 20 bp, human
gcagctgcgagcaacagatc

SEQ ID NO: 109918 - DNA, 20 bp, human
ggaggctgcgagtccgaggt

SEQ ID NO: 109919 - DNA, 20 bp, human
ggctgacccgctctgctgtt

SEQ ID NO: 109920 - DNA, 20 bp, human
ggagtccgaggtgggtctct

SEQ ID NO: 109921 - DNA, 20 bp, human
gaggcgaataccctacagag

SEQ ID NO: 109922 - DNA, 20 bp, human
gagggcgagggcacacacgc

SEQ ID NO: 109923 - DNA, 20 bp, human
gagaagaggctgcgagtccg

SEQ ID NO: 109924 - DNA, 20 bp, human
gccgaggtgggtctctcgga

SEQ ID NO: 109925 - DNA, 20 bp, human
gccgtagtgggcaccagtgg

SEQ ID NO: 109926 - DNA, 20 bp, human
gggcaggacgcgctcagaca

SEQ ID NO: 109927 - DNA, 20 bp, human
ggacgggcacccggagacac

SEQ ID NO: 109928 - DNA, 20 bp, human
ggcctcggcgcggggactga

SEQ ID NO: 109929 - DNA, 20 bp, human
gcgcggcgcgcggccacacg

SEQ ID NO: 109930 - DNA, 20 bp, human
gacgggcgcccagcagacgc

SEQ ID NO: 109931 - DNA, 20 bp, human
gcgtgacgcccgatcctcgg

SEQ ID NO: 109932 - DNA, 20 bp, human
gggcgcgggccatgtcgcag

SEQ ID NO: 109933 - DNA, 20 bp, human
gaccccccggggacgcgtgg

SEQ ID NO: 109934 - DNA, 20 bp, human
gacgggtgcgggaccccccg

SEQ ID NO: 109935 - DNA, 20 bp, human
gcgggtggccgagcctcgtg

SEQ ID NO: 109936 - DNA, 20 bp, human
gaacagcaggtaacaatagt

SEQ ID NO: 109937 - DNA, 20 bp, human
ggagaagtggactctttcaa

SEQ ID NO: 109938 - DNA, 20 bp, human
gaagagggtcactccctcac

SEQ ID NO: 109939 - DNA, 20 bp, human
gtgggcactggatgcagttg

SEQ ID NO: 109940 - DNA, 20 bp, human
ggcaagaacacactggtctg

SEQ ID NO: 109941 - DNA, 20 bp, human
gttctcagtgactcctagct

SEQ ID NO: 109942 - DNA, 20 bp, human
gaattgaagcaagaacacac

SEQ ID NO: 109943 - DNA, 20 bp, human
gcaatgtgaccaacaacagc

SEQ ID NO: 109944 - DNA, 20 bp, human
gggatgcagttgaggattgc

SEQ ID NO: 109945 - DNA, 20 bp, human
gtattgttacctgctgttgt

SEQ ID NO: 109946 - DNA, 20 bp, human
gacagtgtgatgtggttcag

SEQ ID NO: 109947 - DNA, 20 bp, human
gaggcagcttctagacctgc

SEQ ID NO: 109948 - DNA, 20 bp, human
gtatgcgagacagacctgtg

SEQ ID NO: 109949 - DNA, 20 bp, human
gaaaccctgaaggaagtcga

SEQ ID NO: 109950 - DNA, 20 bp, human
ggacagtatgtgacagtcca

SEQ ID NO: 109951 - DNA, 20 bp, human
gaaaccttcgacttccttca

SEQ ID NO: 109952 - DNA, 20 bp, human
gttcatccgagatggtaaag

SEQ ID NO: 109953 - DNA, 20 bp, human
gtctgtttagtgttgcacgg

SEQ ID NO: 109954 - DNA, 20 bp, human
gaaacacttggccagccctg

SEQ ID NO: 109955 - DNA, 20 bp, human
ggtcagtcgtatgtgaatgg

SEQ ID NO: 109956 - DNA, 20 bp, human
gcagcagcaatggcccatcc

SEQ ID NO: 109957 - DNA, 20 bp, human
gccagccagcctgccgggat

SEQ ID NO: 109958 - DNA, 20 bp, human
gggcactgaaggcagttata

SEQ ID NO: 109959 - DNA, 20 bp, human
ggcccttgcaaaggaggagg

SEQ ID NO: 109960 - DNA, 20 bp, human
gggcgggcgggagccaggaa

SEQ ID NO: 109961 - DNA, 20 bp, human
ggcacattggaacgagtaaa

SEQ ID NO: 109962 - DNA, 20 bp, human
gagggggacaggcaccgagg

SEQ ID NO: 109963 - DNA, 20 bp, human
ggtaccggcacacacgaaag

SEQ ID NO: 109964 - DNA, 20 bp, human
gcgtcttgtccaggcactga

SEQ ID NO: 109965 - DNA, 20 bp, human
gaactcctaagccgaggtac

SEQ ID NO: 109966 - DNA, 20 bp, human
ggggctgccgtcagtggacc

SEQ ID NO: 109967 - DNA, 20 bp, human
gcagagggtgggcaagatgg

SEQ ID NO: 109968 - DNA, 20 bp, human
gggctgtccaggtccactga

SEQ ID NO: 109969 - DNA, 20 bp, human
gactaggctggactgtctca

SEQ ID NO: 109970 - DNA, 20 bp, human
gtgccagggctactcagcac

SEQ ID NO: 109971 - DNA, 20 bp, human
gcggccgccggcccatccag

SEQ ID NO: 109972 - DNA, 20 bp, human
ggagcctgccgcgccttcag

SEQ ID NO: 109973 - DNA, 20 bp, human
gtagggcactgaggccatat

SEQ ID NO: 109974 - DNA, 20 bp, human
gtggaaaacatgctgctcgg

SEQ ID NO: 109975 - DNA, 20 bp, human
gagcctagtaaacctccgaa

SEQ ID NO: 109976 - DNA, 20 bp, human
gggctggccgcagacccaga

SEQ ID NO: 109977 - DNA, 20 bp, human
gcccactccaacagcagcgg

SEQ ID NO: 109978 - DNA, 20 bp, human
gaagcccactccaacagcag

SEQ ID NO: 109979 - DNA, 20 bp, human
ggctttgcgagtctgaacgt

SEQ ID NO: 109980 - DNA, 20 bp, human
gtggccgcagacccagaagg

SEQ ID NO: 109981 - DNA, 20 bp, human
ggccgcgctacctgcaatct

SEQ ID NO: 109982 - DNA, 20 bp, human
gcaggcctggcggtaacctt

SEQ ID NO: 109983 - DNA, 20 bp, human
gaccgcccaagggaaggaga

SEQ ID NO: 109984 - DNA, 20 bp, human
gcaaagtaccgcccaaggga

SEQ ID NO: 109985 - DNA, 20 bp, human
ggaccgcgccgccaccttct

SEQ ID NO: 109986 - DNA, 20 bp, human
gggactcgctgtgaaccgat

SEQ ID NO: 109987 - DNA, 20 bp, human
ggtcggcccgcgcaagatgg

SEQ ID NO: 109988 - DNA, 20 bp, human
gcttccgggatagtaaaggt

SEQ ID NO: 109989 - DNA, 20 bp, human
gccccagcaactgagttcca

SEQ ID NO: 109990 - DNA, 20 bp, human
gctccccgtgatctcaagta

SEQ ID NO: 109991 - DNA, 20 bp, human
ggcagcgcagcgggaaactg

SEQ ID NO: 109992 - DNA, 20 bp, human
gtgctccccaaaaggtcctg

SEQ ID NO: 109993 - DNA, 20 bp, human
gtgcgctgcggggtccagga

SEQ ID NO: 109994 - DNA, 20 bp, human
ggacgcgggcgccagccacc

SEQ ID NO: 109995 - DNA, 20 bp, human
gcagaaggcgactgatactg

SEQ ID NO: 109996 - DNA, 20 bp, human
gtgggtgcccggtgtcatgg

SEQ ID NO: 109997 - DNA, 20 bp, human
gccctgagagtgggtaccag

SEQ ID NO: 109998 - DNA, 20 bp, human
ggcgctggctgcttgagagg

SEQ ID NO: 109999 - DNA, 20 bp, human
ggaaggaggcggccaaccca

SEQ ID NO: 110000 - DNA, 20 bp, human
ggagagggaaggcttaagag

SEQ ID NO: 110001 - DNA, 20 bp, human
gatggtggtggtgaaatggg

SEQ ID NO: 110002 - DNA, 20 bp, human
ggtgcccggtgtcatggtgg

SEQ ID NO: 110003 - DNA, 20 bp, human
gcaggcgctggctgcttgag

SEQ ID NO: 110004 - DNA, 20 bp, human
ggactgggtgcccggtgtca

SEQ ID NO: 110005 - DNA, 20 bp, human
ggccaacccaggggttactg

SEQ ID NO: 110006 - DNA, 20 bp, human
gcctcctgacgagggaagac

SEQ ID NO: 110007 - DNA, 20 bp, human
ggataaagcccccaggatga

SEQ ID NO: 110008 - DNA, 20 bp, human
ggccccttcatcctcccggg

SEQ ID NO: 110009 - DNA, 20 bp, human
gctccccccgggaggatgaa

SEQ ID NO: 110010 - DNA, 20 bp, human
gtctccaggctccccccggg

SEQ ID NO: 110011 - DNA, 20 bp, human
gttatagctgatcccttcct

SEQ ID NO: 110012 - DNA, 20 bp, human
gtcttggtccctcctgacga

SEQ ID NO: 110013 - DNA, 20 bp, human
gaagcccccaggatgagggc

SEQ ID NO: 110014 - DNA, 20 bp, human
gggtgctgaagaggtcactg

SEQ ID NO: 110015 - DNA, 20 bp, human
gagccaggggcccgttccct

SEQ ID NO: 110016 - DNA, 20 bp, human
gagaagagtaagatgaatga

SEQ ID NO: 110017 - DNA, 20 bp, human
gaacgaaaggtagccaggaa

SEQ ID NO: 110018 - DNA, 20 bp, human
ggttcttgcttggtaatctg

SEQ ID NO: 110019 - DNA, 20 bp, human
gcttgcttggtaatctgagg

SEQ ID NO: 110020 - DNA, 20 bp, human
gcttacctgtgtttacagaa

SEQ ID NO: 110021 - DNA, 20 bp, human
gctctcctttctgtaaacac

SEQ ID NO: 110022 - DNA, 20 bp, human
gaatagcaaaagtggtctgt

SEQ ID NO: 110023 - DNA, 20 bp, human
ggttaaaacgaaaggtagcc

SEQ ID NO: 110024 - DNA, 20 bp, human
ggatagagcaatagcaaaag

SEQ ID NO: 110025 - DNA, 20 bp, human
gtgggagaattggtagctat

SEQ ID NO: 110026 - DNA, 20 bp, human
gagcaggtgaagtagctgtt

SEQ ID NO: 110027 - DNA, 20 bp, human
gaggtgggtatgttctggtg

SEQ ID NO: 110028 - DNA, 20 bp, human
gtcagggaaattagtttcag

SEQ ID NO: 110029 - DNA, 20 bp, human
gtctggtggggtaggaaaat

SEQ ID NO: 110030 - DNA, 20 bp, human
gaggatggagagtacaattg

SEQ ID NO: 110031 - DNA, 20 bp, human
gtggagagtacaattgtgga

SEQ ID NO: 110032 - DNA, 20 bp, human
gttccctcaaagactcccca

SEQ ID NO: 110033 - DNA, 20 bp, human
ggtgctggtctccaataaag

SEQ ID NO: 110034 - DNA, 20 bp, human
gtgtggtgctagcagtttca

SEQ ID NO: 110035 - DNA, 20 bp, human
ggagggaggtgggtatgttc

SEQ ID NO: 110036 - DNA, 20 bp, human
ggtgccagggaaacaaaatt

SEQ ID NO: 110037 - DNA, 20 bp, human
ggcaggtcagtcaggttcct

SEQ ID NO: 110038 - DNA, 20 bp, human
gagggaaacaaaattaggtg

SEQ ID NO: 110039 - DNA, 20 bp, human
gaatgtcgcactgagcagga

SEQ ID NO: 110040 - DNA, 20 bp, human
gaggagtgcaaatactcatt

SEQ ID NO: 110041 - DNA, 20 bp, human
gagtgtgcgttgggtcactt

SEQ ID NO: 110042 - DNA, 20 bp, human
gcttgtgtaacagagcgccc

SEQ ID NO: 110043 - DNA, 20 bp, human
gttctgtaatctagcaaatt

SEQ ID NO: 110044 - DNA, 20 bp, human
gttaagtcagatcttagtaa

SEQ ID NO: 110045 - DNA, 20 bp, human
gcctgaaggtaagtgtgcgt

SEQ ID NO: 110046 - DNA, 20 bp, human
gagagctgccgtatgtatgg

SEQ ID NO: 110047 - DNA, 20 bp, human
gcggcagctcttctagacac

SEQ ID NO: 110048 - DNA, 20 bp, human
ggacatcacccccaaagact

SEQ ID NO: 110049 - DNA, 20 bp, human
gtcctctagaggttgactca

SEQ ID NO: 110050 - DNA, 20 bp, human
gctgtcatcaaggagcgggt

SEQ ID NO: 110051 - DNA, 20 bp, human
gtccctgagtcaacctctag

SEQ ID NO: 110052 - DNA, 20 bp, human
gagaagagctgccgtatgta

SEQ ID NO: 110053 - DNA, 20 bp, human
ggagtgtgtcattcctctag

SEQ ID NO: 110054 - DNA, 20 bp, human
gcagggtgggagatatggct

SEQ ID NO: 110055 - DNA, 20 bp, human
gttggccagtcctacatctt

SEQ ID NO: 110056 - DNA, 20 bp, human
gcagggatcatgcctcgggg

SEQ ID NO: 110057 - DNA, 20 bp, human
ggcctccaggacaccaatag

SEQ ID NO: 110058 - DNA, 20 bp, human
gggctcggaaggggaaacta

SEQ ID NO: 110059 - DNA, 20 bp, human
gacttgcctgtcacccccag

SEQ ID NO: 110060 - DNA, 20 bp, human
gagctccgatgccaaggcca

SEQ ID NO: 110061 - DNA, 20 bp, human
gtggtccctggccttggcat

SEQ ID NO: 110062 - DNA, 20 bp, human
ggctcagagctccgatgcca

SEQ ID NO: 110063 - DNA, 20 bp, human
ggcagagggcacacccctat

SEQ ID NO: 110064 - DNA, 20 bp, human
gctgtcacccccagaggagc

SEQ ID NO: 110065 - DNA, 20 bp, human
gtggaggcagctctccctcg

SEQ ID NO: 110066 - DNA, 20 bp, human
gtggagagacaagtctacaa

SEQ ID NO: 110067 - DNA, 20 bp, human
gatttgggacctagaaatgg

SEQ ID NO: 110068 - DNA, 20 bp, human
gaaatggaggatagtcattc

SEQ ID NO: 110069 - DNA, 20 bp, human
ggtgatttgggacctagaaa

SEQ ID NO: 110070 - DNA, 20 bp, human
gtaccataagatcaacttca

SEQ ID NO: 110071 - DNA, 20 bp, human
gcaacttcatggttgtgatt

SEQ ID NO: 110072 - DNA, 20 bp, human
gtatacttagtctacagtat

SEQ ID NO: 110073 - DNA, 20 bp, human
gcataccttggagatatctc

SEQ ID NO: 110074 - DNA, 20 bp, human
ggacacgattgttaaagctg

SEQ ID NO: 110075 - DNA, 20 bp, human
gcaaacccgagatatctcca

SEQ ID NO: 110076 - DNA, 20 bp, human
ggggcttccagggaccaacc

SEQ ID NO: 110077 - DNA, 20 bp, human
gctgccactagcccgcctgg

SEQ ID NO: 110078 - DNA, 20 bp, human
gagaaggccccattctcagg

SEQ ID NO: 110079 - DNA, 20 bp, human
gactgggtcattgtccatag

SEQ ID NO: 110080 - DNA, 20 bp, human
gcaggcacacagccgccagg

SEQ ID NO: 110081 - DNA, 20 bp, human
gtgctgccccaactcttcaa

SEQ ID NO: 110082 - DNA, 20 bp, human
gggggctcggagctccagac

SEQ ID NO: 110083 - DNA, 20 bp, human
gttgtccataggggaggaag

SEQ ID NO: 110084 - DNA, 20 bp, human
ggagaatggggccttctggt

SEQ ID NO: 110085 - DNA, 20 bp, human
gcgagccccctgccaaagac

SEQ ID NO: 110086 - DNA, 20 bp, human
gacgctgccatcgtaaggga

SEQ ID NO: 110087 - DNA, 20 bp, human
gctaggatgggctgtctctg

SEQ ID NO: 110088 - DNA, 20 bp, human
gatcacctggtcacacacct

SEQ ID NO: 110089 - DNA, 20 bp, human
gtctcagccatcccttacga

SEQ ID NO: 110090 - DNA, 20 bp, human
gctgcttcctcaaaccaggg

SEQ ID NO: 110091 - DNA, 20 bp, human
gtgcccttgcccatgaaggg

SEQ ID NO: 110092 - DNA, 20 bp, human
gacactcacacacatcgtca

SEQ ID NO: 110093 - DNA, 20 bp, human
gtcacaaatgtgcaggctga

SEQ ID NO: 110094 - DNA, 20 bp, human
gatgggctgtctctggggtc

SEQ ID NO: 110095 - DNA, 20 bp, human
gttcctgcttcctcaaacca

SEQ ID NO: 110096 - DNA, 20 bp, human
ggaggaagcctaaggaaccc

SEQ ID NO: 110097 - DNA, 20 bp, human
ggaatcttggactcaggcgt

SEQ ID NO: 110098 - DNA, 20 bp, human
gaggcaactacattgcctgg

SEQ ID NO: 110099 - DNA, 20 bp, human
gaagaggcaactacattgcc

SEQ ID NO: 110100 - DNA, 20 bp, human
ggtgttcctgggaagaatct

SEQ ID NO: 110101 - DNA, 20 bp, human
gttcccaggaacacaaacgt

SEQ ID NO: 110102 - DNA, 20 bp, human
gctggtgcttccaggagcgt

SEQ ID NO: 110103 - DNA, 20 bp, human
gcttgaaggtgaagagataa

SEQ ID NO: 110104 - DNA, 20 bp, human
gctgcatgacataccttgtt

SEQ ID NO: 110105 - DNA, 20 bp, human
ggatgtaccaagactttaga

SEQ ID NO: 110106 - DNA, 20 bp, human
ggtgccagggtaagccttgt

SEQ ID NO: 110107 - DNA, 20 bp, human
ggtggaattgggatcagtac

SEQ ID NO: 110108 - DNA, 20 bp, human
gcaaaggccagccagtgcca

SEQ ID NO: 110109 - DNA, 20 bp, human
ggtaggcagatggcatggtt

SEQ ID NO: 110110 - DNA, 20 bp, human
gaaactgtggagcaatttgg

SEQ ID NO: 110111 - DNA, 20 bp, human
gtggaagaagagtcatgcct

SEQ ID NO: 110112 - DNA, 20 bp, human
gaaggaaggataggtcaaag

SEQ ID NO: 110113 - DNA, 20 bp, human
gataagccctgaaggagatg

SEQ ID NO: 110114 - DNA, 20 bp, human
gaatcatggtcagtggaatt

SEQ ID NO: 110115 - DNA, 20 bp, human
gttagatgcctgggttccaa

SEQ ID NO: 110116 - DNA, 20 bp, human
gtctgcagctggagggtaga

SEQ ID NO: 110117 - DNA, 20 bp, human
gcggcagggacgtggccctg

SEQ ID NO: 110118 - DNA, 20 bp, human
gacagctgcatgggcccagc

SEQ ID NO: 110119 - DNA, 20 bp, human
gcagctgcagatacagattg

SEQ ID NO: 110120 - DNA, 20 bp, human
gctggggaggggggataaga

SEQ ID NO: 110121 - DNA, 20 bp, human
gtcattacgtgcacgcccca

SEQ ID NO: 110122 - DNA, 20 bp, human
gcgaggcacggcctgactgg

SEQ ID NO: 110123 - DNA, 20 bp, human
gggagccccaacagctgcat

SEQ ID NO: 110124 - DNA, 20 bp, human
gtcaggaccaagacagcggc

SEQ ID NO: 110125 - DNA, 20 bp, human
gggagggaaaagtggctgta

SEQ ID NO: 110126 - DNA, 20 bp, human
ggccagccgcctgaggggac

SEQ ID NO: 110127 - DNA, 20 bp, human
ggacgtgagcccgtcccctc

SEQ ID NO: 110128 - DNA, 20 bp, human
ggagatgaatgggacaacat

SEQ ID NO: 110129 - DNA, 20 bp, human
gttcgggccagccgcctgag

SEQ ID NO: 110130 - DNA, 20 bp, human
ggctgcggcaaaagtccccc

SEQ ID NO: 110131 - DNA, 20 bp, human
gggcagctcagggacaccca

SEQ ID NO: 110132 - DNA, 20 bp, human
gtgtcagagaaagaggtccg

SEQ ID NO: 110133 - DNA, 20 bp, human
gggagaaacgcacttggttc

SEQ ID NO: 110134 - DNA, 20 bp, human
gctccagcgtgcccccttca

SEQ ID NO: 110135 - DNA, 20 bp, human
gcaagtgcgtttctccgaag

SEQ ID NO: 110136 - DNA, 20 bp, human
ggagcagctggagatactgt

SEQ ID NO: 110137 - DNA, 20 bp, human
gccgtccacacaatgagtgt

SEQ ID NO: 110138 - DNA, 20 bp, human
ggcagcctgcccggaaccca

SEQ ID NO: 110139 - DNA, 20 bp, human
gcaggtgctgtcggcttctg

SEQ ID NO: 110140 - DNA, 20 bp, human
gccggccaacactcattgtg

SEQ ID NO: 110141 - DNA, 20 bp, human
gactcattgtgtggacggcg

SEQ ID NO: 110142 - DNA, 20 bp, human
gaggaagctggccctgctct

SEQ ID NO: 110143 - DNA, 20 bp, human
ggaagtaggagctcagatct

SEQ ID NO: 110144 - DNA, 20 bp, human
gtgggcttcgcggacctctg

SEQ ID NO: 110145 - DNA, 20 bp, human
gtgcacccggcacacaggta

SEQ ID NO: 110146 - DNA, 20 bp, human
gccctgggagaccaccgaaa

SEQ ID NO: 110147 - DNA, 20 bp, human
gcagagccaacaccagcgtc

SEQ ID NO: 110148 - DNA, 20 bp, human
ggtcccatccaggacactca

SEQ ID NO: 110149 - DNA, 20 bp, human
gacactcagggagtcgtagg

SEQ ID NO: 110150 - DNA, 20 bp, human
gtcacagctgggggtctctc

SEQ ID NO: 110151 - DNA, 20 bp, human
gacataagctggggccccca

SEQ ID NO: 110152 - DNA, 20 bp, human
gctggagccccatgaggccc

SEQ ID NO: 110153 - DNA, 20 bp, human
gaccgcagggcaaggcccct

SEQ ID NO: 110154 - DNA, 20 bp, human
ggtgggacaggagtgggcaa

SEQ ID NO: 110155 - DNA, 20 bp, human
gcagcgtccggcacgcgctc

SEQ ID NO: 110156 - DNA, 20 bp, human
gggactcaggaccccactcg

SEQ ID NO: 110157 - DNA, 20 bp, human
gaccatggtgcacagtggag

SEQ ID NO: 110158 - DNA, 20 bp, human
ggcactcccgcgggaacagt

SEQ ID NO: 110159 - DNA, 20 bp, human
ggccgttggagccgcatgga

SEQ ID NO: 110160 - DNA, 20 bp, human
gagcagccaccgctggacca

SEQ ID NO: 110161 - DNA, 20 bp, human
ggcgctctccctccccgagt

SEQ ID NO: 110162 - DNA, 20 bp, human
gtatataaggcacccaggac

SEQ ID NO: 110163 - DNA, 20 bp, human
gccacatggacgctgatgga

SEQ ID NO: 110164 - DNA, 20 bp, human
gctcaggaccccactcgggg

SEQ ID NO: 110165 - DNA, 20 bp, human
gcgaggggcgccagacactg

SEQ ID NO: 110166 - DNA, 20 bp, human
gtagagggggcagaaggact

SEQ ID NO: 110167 - DNA, 20 bp, human
gtggttgcagaactcaagtg

SEQ ID NO: 110168 - DNA, 20 bp, human
ggttgcagtcataggacctg

SEQ ID NO: 110169 - DNA, 20 bp, human
gcaagacgaggaggatatga

SEQ ID NO: 110170 - DNA, 20 bp, human
ggtgtggtgataggtgatga

SEQ ID NO: 110171 - DNA, 20 bp, human
gtgaggcagccaagacgagg

SEQ ID NO: 110172 - DNA, 20 bp, human
gctcaagtgggggagttgtg

SEQ ID NO: 110173 - DNA, 20 bp, human
gttctgaggcagccaagacg

SEQ ID NO: 110174 - DNA, 20 bp, human
gtggtgataggtgatgacgg

SEQ ID NO: 110175 - DNA, 20 bp, human
gaaacagtagagggggcaga

SEQ ID NO: 110176 - DNA, 20 bp, human
gttctagttaccatcctcaa

SEQ ID NO: 110177 - DNA, 20 bp, human
ggttaccatcctcaaaggat

SEQ ID NO: 110178 - DNA, 20 bp, human
gtatgaactgccaaacagtg

SEQ ID NO: 110179 - DNA, 20 bp, human
gtcacactgcaccaggtatg

SEQ ID NO: 110180 - DNA, 20 bp, human
gacatcataagaatgtcctg

SEQ ID NO: 110181 - DNA, 20 bp, human
gtaccactgagactttatta

SEQ ID NO: 110182 - DNA, 20 bp, human
gagaacacaatatgattggt

SEQ ID NO: 110183 - DNA, 20 bp, human
gttagccaatcctttgagga

SEQ ID NO: 110184 - DNA, 20 bp, human
gattattccagtcaatcctc

SEQ ID NO: 110185 - DNA, 20 bp, human
ggtgtgaatctttcttctta

SEQ ID NO: 110186 - DNA, 20 bp, human
gggttgtagccactaaggta

SEQ ID NO: 110187 - DNA, 20 bp, human
gatatggtggtggcattctg

SEQ ID NO: 110188 - DNA, 20 bp, human
gctgatgggaaagtcacaga

SEQ ID NO: 110189 - DNA, 20 bp, human
gatttgggttgtagccacta

SEQ ID NO: 110190 - DNA, 20 bp, human
ggtggtcaaccctaccttag

SEQ ID NO: 110191 - DNA, 20 bp, human
ggaggcggatgatgggtcta

SEQ ID NO: 110192 - DNA, 20 bp, human
gaattttggtggaagctgat

SEQ ID NO: 110193 - DNA, 20 bp, human
gtttggaagggtagtaattt

SEQ ID NO: 110194 - DNA, 20 bp, human
gggaagggtagtaattttgg

SEQ ID NO: 110195 - DNA, 20 bp, human
gtctcttgaagatatggtgg

SEQ ID NO: 110196 - DNA, 20 bp, human
ggtccagcagaggccggtca

SEQ ID NO: 110197 - DNA, 20 bp, human
gagtcgctgcgggatcactt

SEQ ID NO: 110198 - DNA, 20 bp, human
gtgatcccgcagcgactctg

SEQ ID NO: 110199 - DNA, 20 bp, human
gtcccgcagcgactctgagg

SEQ ID NO: 110200 - DNA, 20 bp, human
ggtcctcctcagagtcgctg

SEQ ID NO: 110201 - DNA, 20 bp, human
gcaagaatgcccgaccctca

SEQ ID NO: 110202 - DNA, 20 bp, human
ggaggaggaccctgagggtc

SEQ ID NO: 110203 - DNA, 20 bp, human
ggccccgcaaatcctaacgt

SEQ ID NO: 110204 - DNA, 20 bp, human
gaggccacagccctgaggac

SEQ ID NO: 110205 - DNA, 20 bp, human
gctctgctggacgcccaccg

SEQ ID NO: 110206 - DNA, 20 bp, human
gactgctaagaacttcatgg

SEQ ID NO: 110207 - DNA, 20 bp, human
gcagcgccttgccttctctt

SEQ ID NO: 110208 - DNA, 20 bp, human
gtggtggtgacctgaagatc

SEQ ID NO: 110209 - DNA, 20 bp, human
gtgttcaagaaggtaatcag

SEQ ID NO: 110210 - DNA, 20 bp, human
gcaaagcctaagagaaggca

SEQ ID NO: 110211 - DNA, 20 bp, human
gaggactgctaagaacttca

SEQ ID NO: 110212 - DNA, 20 bp, human
gtgatagaacaagttaggag

SEQ ID NO: 110213 - DNA, 20 bp, human
gtagcagtcctggtactctt

SEQ ID NO: 110214 - DNA, 20 bp, human
gctggtacaccaaggactga

SEQ ID NO: 110215 - DNA, 20 bp, human
gaatggtgatagaacaagtt

SEQ ID NO: 110216 - DNA, 20 bp, human
gcgactgtggcgccaaggat

SEQ ID NO: 110217 - DNA, 20 bp, human
gggtcctggtcggaaggagg

SEQ ID NO: 110218 - DNA, 20 bp, human
ggagccccggtggccgactg

SEQ ID NO: 110219 - DNA, 20 bp, human
ggggtcaccaggcctatcct

SEQ ID NO: 110220 - DNA, 20 bp, human
gggaaggaggtggagagtcg

SEQ ID NO: 110221 - DNA, 20 bp, human
ggctggatgacacccttcag

SEQ ID NO: 110222 - DNA, 20 bp, human
gcggtacacggagtacaggg

SEQ ID NO: 110223 - DNA, 20 bp, human
gtgcggtcctggtcggaagg

SEQ ID NO: 110224 - DNA, 20 bp, human
gggattcgggctcgggataa

SEQ ID NO: 110225 - DNA, 20 bp, human
ggcgccacagtcggccaccg

SEQ ID NO: 110226 - DNA, 20 bp, human
ggatccagggaaggagatag

SEQ ID NO: 110227 - DNA, 20 bp, human
gaatccagggaagcagatgg

SEQ ID NO: 110228 - DNA, 20 bp, human
ggcaagagatggggtccggg

SEQ ID NO: 110229 - DNA, 20 bp, human
ggccgcagcggccgcaacag

SEQ ID NO: 110230 - DNA, 20 bp, human
gcccggcctagagactcctc

SEQ ID NO: 110231 - DNA, 20 bp, human
gggttcacggcagacgtgag

SEQ ID NO: 110232 - DNA, 20 bp, human
gcagagtgggggacccacgg

SEQ ID NO: 110233 - DNA, 20 bp, human
gcgctcccggaggagtctct

SEQ ID NO: 110234 - DNA, 20 bp, human
ggacccacggcggtagggac

SEQ ID NO: 110235 - DNA, 20 bp, human
gagatggggtccgggcggca

SEQ ID NO: 110236 - DNA, 20 bp, human
ggaggagctgcattacacac

SEQ ID NO: 110237 - DNA, 20 bp, human
ggcccagccagtcttcgggg

SEQ ID NO: 110238 - DNA, 20 bp, human
gcaggcttcggaggcttccg

SEQ ID NO: 110239 - DNA, 20 bp, human
gcattacacacaggcttcgg

SEQ ID NO: 110240 - DNA, 20 bp, human
gtcctccccgaagactggct

SEQ ID NO: 110241 - DNA, 20 bp, human
gctgcattacacacaggctt

SEQ ID NO: 110242 - DNA, 20 bp, human
gtgcgcccagccagtcttcg

SEQ ID NO: 110243 - DNA, 20 bp, human
gaggcttccgtggagaagct

SEQ ID NO: 110244 - DNA, 20 bp, human
gtaaaagtccacagtcgggg

SEQ ID NO: 110245 - DNA, 20 bp, human
gattaccacctccccgactg

SEQ ID NO: 110246 - DNA, 20 bp, human
gtacctggaatattaccacg

SEQ ID NO: 110247 - DNA, 20 bp, human
gcaagtgccagaattgattg

SEQ ID NO: 110248 - DNA, 20 bp, human
gacagtcgcatagcaataca

SEQ ID NO: 110249 - DNA, 20 bp, human
gtgcacactgtccacgatgg

SEQ ID NO: 110250 - DNA, 20 bp, human
gaaagatgtgaaagcccggg

SEQ ID NO: 110251 - DNA, 20 bp, human
gactcgacaggcgattctgg

SEQ ID NO: 110252 - DNA, 20 bp, human
ggccagaattgattgtggtt

SEQ ID NO: 110253 - DNA, 20 bp, human
ggacaaagtagcctccatcg

SEQ ID NO: 110254 - DNA, 20 bp, human
gacacaagtgcaagcttacc

SEQ ID NO: 110255 - DNA, 20 bp, human
gtcctaaccacaatcaattc

SEQ ID NO: 110256 - DNA, 20 bp, human
gcagcgaacgaagagcgggt

SEQ ID NO: 110257 - DNA, 20 bp, human
gcgttcgctggctgaccgag

SEQ ID NO: 110258 - DNA, 20 bp, human
gcacagggggcactaacgag

SEQ ID NO: 110259 - DNA, 20 bp, human
ggggaaagggcgcgtctcaa

SEQ ID NO: 110260 - DNA, 20 bp, human
gcacggggccccaaacacag

SEQ ID NO: 110261 - DNA, 20 bp, human
ggagccggtccaggctccgg

SEQ ID NO: 110262 - DNA, 20 bp, human
gggggtagggtacctggtca

SEQ ID NO: 110263 - DNA, 20 bp, human
gcagccagcgaacgaagagc

SEQ ID NO: 110264 - DNA, 20 bp, human
ggaacacctggcccagggcg

SEQ ID NO: 110265 - DNA, 20 bp, human
ggaccccgctctcgaatctg

SEQ ID NO: 110266 - DNA, 20 bp, human
gtgcagagctctgacttcta

SEQ ID NO: 110267 - DNA, 20 bp, human
ggagctctgcatgcactatg

SEQ ID NO: 110268 - DNA, 20 bp, human
ggaacttcggagtaaaatat

SEQ ID NO: 110269 - DNA, 20 bp, human
gctggacaacgcaaggaaaa

SEQ ID NO: 110270 - DNA, 20 bp, human
gagggtgaaatgtatgatga

SEQ ID NO: 110271 - DNA, 20 bp, human
gcgcaggacgaagttccttc

SEQ ID NO: 110272 - DNA, 20 bp, human
gtgctttaaaatgtaaactg

SEQ ID NO: 110273 - DNA, 20 bp, human
ggttccttctggacaacgca

SEQ ID NO: 110274 - DNA, 20 bp, human
gttactctggttgccttcag

SEQ ID NO: 110275 - DNA, 20 bp, human
gtcttcttgttgtcttgtca

SEQ ID NO: 110276 - DNA, 20 bp, human
ggtctctgaaggcgcctctc

SEQ ID NO: 110277 - DNA, 20 bp, human
ggtaagcgctgggtctctga

SEQ ID NO: 110278 - DNA, 20 bp, human
gctgctggaaaagatctgag

SEQ ID NO: 110279 - DNA, 20 bp, human
gtacccaccatgtcccaggt

SEQ ID NO: 110280 - DNA, 20 bp, human
gcctcctacctgggacatgg

SEQ ID NO: 110281 - DNA, 20 bp, human
gtcatcagggagcctgtcag

SEQ ID NO: 110282 - DNA, 20 bp, human
ggcccccaggcagcagtact

SEQ ID NO: 110283 - DNA, 20 bp, human
gctgcggacctgaatcatca

SEQ ID NO: 110284 - DNA, 20 bp, human
gttgctgggtcctcctacct

SEQ ID NO: 110285 - DNA, 20 bp, human
gccaaagccacatagaagag

SEQ ID NO: 110286 - DNA, 20 bp, human
ggcggtggcgcggtttgtgt

SEQ ID NO: 110287 - DNA, 20 bp, human
ggtcagccggacgactctgg

SEQ ID NO: 110288 - DNA, 20 bp, human
gtgccaacgggaacagttca

SEQ ID NO: 110289 - DNA, 20 bp, human
gcaccctgaactgttcccgt

SEQ ID NO: 110290 - DNA, 20 bp, human
gaacccacaacctagaaggg

SEQ ID NO: 110291 - DNA, 20 bp, human
ggaagtccctggcaattcgg

SEQ ID NO: 110292 - DNA, 20 bp, human
ggtcgtccggctgacgctgg

SEQ ID NO: 110293 - DNA, 20 bp, human
ggccaaagaagataccgaca

SEQ ID NO: 110294 - DNA, 20 bp, human
gctacgcccccagagtcgtc

SEQ ID NO: 110295 - DNA, 20 bp, human
gggacttcgcccaaaactag

SEQ ID NO: 110296 - DNA, 20 bp, human
gtgaagacagcagaacacgg

SEQ ID NO: 110297 - DNA, 20 bp, human
gctcgggctcatagttctag

SEQ ID NO: 110298 - DNA, 20 bp, human
ggaggctcctcaagcttcag

SEQ ID NO: 110299 - DNA, 20 bp, human
gtgatgaagacagcagaaca

SEQ ID NO: 110300 - DNA, 20 bp, human
gacggtgagcggcttcccag

SEQ ID NO: 110301 - DNA, 20 bp, human
gccggagccgcggtgtacaa

SEQ ID NO: 110302 - DNA, 20 bp, human
ggcgcgctagagctcgcggg

SEQ ID NO: 110303 - DNA, 20 bp, human
gtcctcgtggctagttcagg

SEQ ID NO: 110304 - DNA, 20 bp, human
ggactcaggcgggagacgag

SEQ ID NO: 110305 - DNA, 20 bp, human
ggctttccggcgcactccag

SEQ ID NO: 110306 - DNA, 20 bp, human
gacctcggagcgcctcccga

SEQ ID NO: 110307 - DNA, 20 bp, human
gtaggctgcccagagaacta

SEQ ID NO: 110308 - DNA, 20 bp, human
gccctggtggttccgaaggt

SEQ ID NO: 110309 - DNA, 20 bp, human
gggaggcgctccgaggttcg

SEQ ID NO: 110310 - DNA, 20 bp, human
gggcatagggcaccgtgaat

SEQ ID NO: 110311 - DNA, 20 bp, human
gagacgggggagaagcccag

SEQ ID NO: 110312 - DNA, 20 bp, human
ggtgcaggagatctaccggg

SEQ ID NO: 110313 - DNA, 20 bp, human
gggtcgcgagcgctgccgtc

SEQ ID NO: 110314 - DNA, 20 bp, human
ggggcaccgtgaatgggcag

SEQ ID NO: 110315 - DNA, 20 bp, human
ggccgagtctgtcccgggta

SEQ ID NO: 110316 - DNA, 20 bp, human
ggcgcgagcctcaccgagag

SEQ ID NO: 110317 - DNA, 20 bp, human
gcgagcctcaccgagagcgg

SEQ ID NO: 110318 - DNA, 20 bp, human
ggaggctcgcgctcgagctg

SEQ ID NO: 110319 - DNA, 20 bp, human
gcctctcacgcgggcagagg

SEQ ID NO: 110320 - DNA, 20 bp, human
gtcgccgccaggccgagccc

SEQ ID NO: 110321 - DNA, 20 bp, human
gtcacctgcccgggccttgg

SEQ ID NO: 110322 - DNA, 20 bp, human
gctccctctcacgcgggcag

SEQ ID NO: 110323 - DNA, 20 bp, human
gcagcttctcatcgcccggg

SEQ ID NO: 110324 - DNA, 20 bp, human
gaagcagcttctcatcgccc

SEQ ID NO: 110325 - DNA, 20 bp, human
ggtgcccgggctcggcctgg

SEQ ID NO: 110326 - DNA, 20 bp, human
gtgggatcgcgggccgtaag

SEQ ID NO: 110327 - DNA, 20 bp, human
gtacaagtgactgccgccag

SEQ ID NO: 110328 - DNA, 20 bp, human
gtggagctggggtcactgcg

SEQ ID NO: 110329 - DNA, 20 bp, human
gacagcgccggtcaacatcg

SEQ ID NO: 110330 - DNA, 20 bp, human
ggccgccagcggcttctccg

SEQ ID NO: 110331 - DNA, 20 bp, human
gatggcctcggagaagccgc

SEQ ID NO: 110332 - DNA, 20 bp, human
gagcgaggccgggtacgcgg

SEQ ID NO: 110333 - DNA, 20 bp, human
gcccagggcctcgacagacg

SEQ ID NO: 110334 - DNA, 20 bp, human
gtgatgaccgcgatgttgac

SEQ ID NO: 110335 - DNA, 20 bp, human
gtcgtaagaatccgccgtgg

SEQ ID NO: 110336 - DNA, 20 bp, human
ggcgacgacaccacgattca

SEQ ID NO: 110337 - DNA, 20 bp, human
gcggcttcggcgcggagggg

SEQ ID NO: 110338 - DNA, 20 bp, human
gtccagagccgcggccctca

SEQ ID NO: 110339 - DNA, 20 bp, human
gcggcggtgtgacgtaccca

SEQ ID NO: 110340 - DNA, 20 bp, human
ggaacacctgccgtgaatcg

SEQ ID NO: 110341 - DNA, 20 bp, human
gctccggcttcggcgcggag

SEQ ID NO: 110342 - DNA, 20 bp, human
gtgaggtcgccgatccctcg

SEQ ID NO: 110343 - DNA, 20 bp, human
gctctgggttgtgggagttg

SEQ ID NO: 110344 - DNA, 20 bp, human
gcagagcgcccgtgcctcaa

SEQ ID NO: 110345 - DNA, 20 bp, human
ggcacccgcgcaggccaaga

SEQ ID NO: 110346 - DNA, 20 bp, human
gtgccgggaagtgatcccca

SEQ ID NO: 110347 - DNA, 20 bp, human
gggaagtgatccccaaggca

SEQ ID NO: 110348 - DNA, 20 bp, human
gtagagcaagcaccgatcta

SEQ ID NO: 110349 - DNA, 20 bp, human
gccgatctagggctaagatg

SEQ ID NO: 110350 - DNA, 20 bp, human
gtgcaacaaacgcctcagat

SEQ ID NO: 110351 - DNA, 20 bp, human
gggactaaagagagcctcaa

SEQ ID NO: 110352 - DNA, 20 bp, human
gagagttaaggggcctgaat

SEQ ID NO: 110353 - DNA, 20 bp, human
gtactcacatctagaagtgc

SEQ ID NO: 110354 - DNA, 20 bp, human
gatcacttcccggcagggca

SEQ ID NO: 110355 - DNA, 20 bp, human
gactcacctgcactgtcctg

SEQ ID NO: 110356 - DNA, 20 bp, human
gcggtgagtgtcgcttctgg

SEQ ID NO: 110357 - DNA, 20 bp, human
gagaagtcgacggaaagcag

SEQ ID NO: 110358 - DNA, 20 bp, human
gcccaggaaatagaagtcga

SEQ ID NO: 110359 - DNA, 20 bp, human
gcagtggtcggcgttcgggt

SEQ ID NO: 110360 - DNA, 20 bp, human
ggcgctaggagcgcggagaa

SEQ ID NO: 110361 - DNA, 20 bp, human
gagaggcgaagcgagagcgg

SEQ ID NO: 110362 - DNA, 20 bp, human
gtagcaagggcgctgatggg

SEQ ID NO: 110363 - DNA, 20 bp, human
ggacctccgcagtctgactt

SEQ ID NO: 110364 - DNA, 20 bp, human
gcgggaaagtttcagatcca

SEQ ID NO: 110365 - DNA, 20 bp, human
gcctggtgggaaccagaatc

SEQ ID NO: 110366 - DNA, 20 bp, human
gacgtgcagcggtaagagcg

SEQ ID NO: 110367 - DNA, 20 bp, human
gctgtgcacaaggctactgt

SEQ ID NO: 110368 - DNA, 20 bp, human
gagcggggccggtgcaggga

SEQ ID NO: 110369 - DNA, 20 bp, human
gtaagagcggggccggtgca

SEQ ID NO: 110370 - DNA, 20 bp, human
gagcgtcctacaaagtctgg

SEQ ID NO: 110371 - DNA, 20 bp, human
ggcccgaaaagtcgtctcgg

SEQ ID NO: 110372 - DNA, 20 bp, human
gaaagcagccctccctgcac

SEQ ID NO: 110373 - DNA, 20 bp, human
gtgtgcccgaaaagtcgtct

SEQ ID NO: 110374 - DNA, 20 bp, human
gctccatcctgaacgtgcag

SEQ ID NO: 110375 - DNA, 20 bp, human
gtaccgctgcacgttcagga

SEQ ID NO: 110376 - DNA, 20 bp, human
ggtcgtccgtcccaccatgg

SEQ ID NO: 110377 - DNA, 20 bp, human
gtttgggccacgcaagtcgt

SEQ ID NO: 110378 - DNA, 20 bp, human
gacggcgatgaccacttccg

SEQ ID NO: 110379 - DNA, 20 bp, human
gccgtcccaccatggcgggt

SEQ ID NO: 110380 - DNA, 20 bp, human
gatggtcgtccgtcccacca

SEQ ID NO: 110381 - DNA, 20 bp, human
gagtcgtgggcggagctctg

SEQ ID NO: 110382 - DNA, 20 bp, human
gtttacccacccgccatggt

SEQ ID NO: 110383 - DNA, 20 bp, human
gttgctgaaacagagctcat

SEQ ID NO: 110384 - DNA, 20 bp, human
ggacttgcgtggcccaaagc

SEQ ID NO: 110385 - DNA, 20 bp, human
gtgtgacgagcagaggaaat

SEQ ID NO: 110386 - DNA, 20 bp, human
gggcccccggtgcagaatgg

SEQ ID NO: 110387 - DNA, 20 bp, human
gccgggttctgtcactgtgt

SEQ ID NO: 110388 - DNA, 20 bp, human
gcgctcgacaagagagggag

SEQ ID NO: 110389 - DNA, 20 bp, human
gcctccaaccacccccggag

SEQ ID NO: 110390 - DNA, 20 bp, human
gtccccacgcgcggtccgaa

SEQ ID NO: 110391 - DNA, 20 bp, human
gggcggccgactatctggag

SEQ ID NO: 110392 - DNA, 20 bp, human
gcgcgcgtggggagagccag

SEQ ID NO: 110393 - DNA, 20 bp, human
gaaccacgctcgacaagaga

SEQ ID NO: 110394 - DNA, 20 bp, human
gtcggcggtgcccagctcac

SEQ ID NO: 110395 - DNA, 20 bp, human
gtggggagagccagaggggt

SEQ ID NO: 110396 - DNA, 20 bp, human
gcgcgggcggggactctctc

SEQ ID NO: 110397 - DNA, 20 bp, human
ggggtgccggccggagcaag

SEQ ID NO: 110398 - DNA, 20 bp, human
ggggctggacctggtcccag

SEQ ID NO: 110399 - DNA, 20 bp, human
gccatgtcggcgacagctgg

SEQ ID NO: 110400 - DNA, 20 bp, human
gctggccaagggttccatgt

SEQ ID NO: 110401 - DNA, 20 bp, human
gtgcagccgcttgctccggc

SEQ ID NO: 110402 - DNA, 20 bp, human
gcacggtgcaacaaacacag

SEQ ID NO: 110403 - DNA, 20 bp, human
ggtccagccccagcctgacg

SEQ ID NO: 110404 - DNA, 20 bp, human
gccccgcccgcgtcaggctg

SEQ ID NO: 110405 - DNA, 20 bp, human
ggtgctgcagccgcttgctc

SEQ ID NO: 110406 - DNA, 20 bp, human
gggccgagcgccggagtccg

SEQ ID NO: 110407 - DNA, 20 bp, human
gtccgcggagtctggaagtg

SEQ ID NO: 110408 - DNA, 20 bp, human
ggccgcacttccagactccg

SEQ ID NO: 110409 - DNA, 20 bp, human
gggcccggagagcacgctcc

SEQ ID NO: 110410 - DNA, 20 bp, human
gtggcgaagtcgccgtcgaa

SEQ ID NO: 110411 - DNA, 20 bp, human
gcggagagcacgctccgggc

SEQ ID NO: 110412 - DNA, 20 bp, human
ggcgcaaggccccgaacaac

SEQ ID NO: 110413 - DNA, 20 bp, human
ggtctggaagtgcggcggcc

SEQ ID NO: 110414 - DNA, 20 bp, human
gggacacacggcgcggtcag

SEQ ID NO: 110415 - DNA, 20 bp, human
gcgggggcgggggttcggac

SEQ ID NO: 110416 - DNA, 20 bp, human
gcagcgaggctcgggaagtc

SEQ ID NO: 110417 - DNA, 20 bp, human
ggaggctcgggaagtcaggc

SEQ ID NO: 110418 - DNA, 20 bp, human
gcgggcgccgaggaagagca

SEQ ID NO: 110419 - DNA, 20 bp, human
gcaacaggggtcgcccaagt

SEQ ID NO: 110420 - DNA, 20 bp, human
gctcgaggccgccagctacc

SEQ ID NO: 110421 - DNA, 20 bp, human
gaggcgccggggcgaaaagc

SEQ ID NO: 110422 - DNA, 20 bp, human
gaactgcaggcagcgaggct

SEQ ID NO: 110423 - DNA, 20 bp, human
gctgcccgaggaccccgctg

SEQ ID NO: 110424 - DNA, 20 bp, human
ggcaaggaggcgcgctgcga

SEQ ID NO: 110425 - DNA, 20 bp, human
gcggacccccgctcctccat

SEQ ID NO: 110426 - DNA, 20 bp, human
gtgtgcgcgcgtgagggtag

SEQ ID NO: 110427 - DNA, 20 bp, human
ggaggtgcgcgcatgaggtg

SEQ ID NO: 110428 - DNA, 20 bp, human
gacccgcggtgcccatggag

SEQ ID NO: 110429 - DNA, 20 bp, human
gaggtaaacaaaccacgcgc

SEQ ID NO: 110430 - DNA, 20 bp, human
gccgagaagggagtgcggag

SEQ ID NO: 110431 - DNA, 20 bp, human
gcctctccccgcgagcacgg

SEQ ID NO: 110432 - DNA, 20 bp, human
gtcggcccgagaagggagtg

SEQ ID NO: 110433 - DNA, 20 bp, human
gagtgcggtgcggccggtaa

SEQ ID NO: 110434 - DNA, 20 bp, human
gtgaggtgtgcgcgcatgtg

SEQ ID NO: 110435 - DNA, 20 bp, human
gtagaggagcgcgcgtgtgt

SEQ ID NO: 110436 - DNA, 20 bp, human
gcacggccgggagtttgccg

SEQ ID NO: 110437 - DNA, 20 bp, human
ggggagcatccaccgagccg

SEQ ID NO: 110438 - DNA, 20 bp, human
gagtagctaaggatcagata

SEQ ID NO: 110439 - DNA, 20 bp, human
gcatggccccggcaaactcc

SEQ ID NO: 110440 - DNA, 20 bp, human
ggcagctcggcttcccagcg

SEQ ID NO: 110441 - DNA, 20 bp, human
gaagccgccgcacacgggag

SEQ ID NO: 110442 - DNA, 20 bp, human
gccagcgcggcacagcaagc

SEQ ID NO: 110443 - DNA, 20 bp, human
gcacccaagggaaacactgg

SEQ ID NO: 110444 - DNA, 20 bp, human
gggggcgcgcgagtcacggc

SEQ ID NO: 110445 - DNA, 20 bp, human
gagctaaggatcagataggg

SEQ ID NO: 110446 - DNA, 20 bp, human
ggtcccagctggcccgcact

SEQ ID NO: 110447 - DNA, 20 bp, human
gaggcgaggcaggtacgcac

SEQ ID NO: 110448 - DNA, 20 bp, human
gtccctggctcggcggggaa

SEQ ID NO: 110449 - DNA, 20 bp, human
gcccgctccctggctcggcg

SEQ ID NO: 110450 - DNA, 20 bp, human
gcgccgagtgcgggccagct

SEQ ID NO: 110451 - DNA, 20 bp, human
ggccgttccccgccgagcca

SEQ ID NO: 110452 - DNA, 20 bp, human
ggccgcgccccgcctcgggg

SEQ ID NO: 110453 - DNA, 20 bp, human
gcgcggcccgcaggaaatgc

SEQ ID NO: 110454 - DNA, 20 bp, human
gcgcttcctgggggcagcct

SEQ ID NO: 110455 - DNA, 20 bp, human
gcgcgggttctgcgcttcct

SEQ ID NO: 110456 - DNA, 20 bp, human
gtccaaagcaggattcggga

SEQ ID NO: 110457 - DNA, 20 bp, human
gccgagtgggacaaagcctg

SEQ ID NO: 110458 - DNA, 20 bp, human
ggagagacttagagccgagt

SEQ ID NO: 110459 - DNA, 20 bp, human
gaagcccagagggccaagaa

SEQ ID NO: 110460 - DNA, 20 bp, human
ggagtgggtcagtgattgaa

SEQ ID NO: 110461 - DNA, 20 bp, human
gggcttcaactccctaggag

SEQ ID NO: 110462 - DNA, 20 bp, human
gcacggcggcgtctccctcg

SEQ ID NO: 110463 - DNA, 20 bp, human
gttcaactccctaggagggg

SEQ ID NO: 110464 - DNA, 20 bp, human
ggccatcccgaatcctgctt

SEQ ID NO: 110465 - DNA, 20 bp, human
gtgaccgggcacattcctct

SEQ ID NO: 110466 - DNA, 20 bp, human
ggctgaagcaaagacgacag

SEQ ID NO: 110467 - DNA, 20 bp, human
gtagagagatggggactcgt

SEQ ID NO: 110468 - DNA, 20 bp, human
gagtcgccactggctgcctg

SEQ ID NO: 110469 - DNA, 20 bp, human
gtctgcgggagtagagagat

SEQ ID NO: 110470 - DNA, 20 bp, human
gagattccagcctccaacta

SEQ ID NO: 110471 - DNA, 20 bp, human
gtcatacgtctggaagagtg

SEQ ID NO: 110472 - DNA, 20 bp, human
gtgcctgaggtgaggttgtg

SEQ ID NO: 110473 - DNA, 20 bp, human
gctgaggacctggactgtgg

SEQ ID NO: 110474 - DNA, 20 bp, human
gctgttgcttatgccctctg

SEQ ID NO: 110475 - DNA, 20 bp, human
ggacgacagcggcagctgga

SEQ ID NO: 110476 - DNA, 20 bp, human
gcccgctgcctactcaccag

SEQ ID NO: 110477 - DNA, 20 bp, human
ggctgtaagagcacctgagg

SEQ ID NO: 110478 - DNA, 20 bp, human
ggcgttcgatccctagaggg

SEQ ID NO: 110479 - DNA, 20 bp, human
ggctaagaccgctggtgagt

SEQ ID NO: 110480 - DNA, 20 bp, human
gtccacggagaaagatctgg

SEQ ID NO: 110481 - DNA, 20 bp, human
gtcaccagcggtcttagcag

SEQ ID NO: 110482 - DNA, 20 bp, human
gcagggcgttcgatccctag

SEQ ID NO: 110483 - DNA, 20 bp, human
gccctgcggagacaggaacg

SEQ ID NO: 110484 - DNA, 20 bp, human
gaccgctggtgagtaggcag

SEQ ID NO: 110485 - DNA, 20 bp, human
gaacggcctacctccccctc

SEQ ID NO: 110486 - DNA, 20 bp, human
gaccacgcggccatccagaa

SEQ ID NO: 110487 - DNA, 20 bp, human
gaggatcctgaagcccatgc

SEQ ID NO: 110488 - DNA, 20 bp, human
gatgcaggctctgaaccacg

SEQ ID NO: 110489 - DNA, 20 bp, human
ggcagaaccctgtgaacccc

SEQ ID NO: 110490 - DNA, 20 bp, human
gtattccggggctctgatca

SEQ ID NO: 110491 - DNA, 20 bp, human
gcacgcaagctgctattccg

SEQ ID NO: 110492 - DNA, 20 bp, human
gctctgctgtctatgtgagg

SEQ ID NO: 110493 - DNA, 20 bp, human
ggagcatgagggtccccacg

SEQ ID NO: 110494 - DNA, 20 bp, human
gggttcacagggttctgctg

SEQ ID NO: 110495 - DNA, 20 bp, human
gtcattgcctggggttcaca

SEQ ID NO: 110496 - DNA, 20 bp, human
gcgccatggcccgaagaccc

SEQ ID NO: 110497 - DNA, 20 bp, human
ggagccgcggggaccgcacc

SEQ ID NO: 110498 - DNA, 20 bp, human
gtccctccccggctgcgcag

SEQ ID NO: 110499 - DNA, 20 bp, human
gcgttgggaagcacgccctg

SEQ ID NO: 110500 - DNA, 20 bp, human
ggaaagcacgttccagccga

SEQ ID NO: 110501 - DNA, 20 bp, human
ggcggcgctccgcaccgctg

SEQ ID NO: 110502 - DNA, 20 bp, human
gaaacttcgccccagcggtg

SEQ ID NO: 110503 - DNA, 20 bp, human
gcgttccgggatcatctgag

SEQ ID NO: 110504 - DNA, 20 bp, human
ggatccctcgccgacacccg

SEQ ID NO: 110505 - DNA, 20 bp, human
gctgagaaacttcgccccag

SEQ ID NO: 110506 - DNA, 20 bp, human
gcctgacctggaagcggctg

SEQ ID NO: 110507 - DNA, 20 bp, human
ggtttgtgtcggctcggagg

SEQ ID NO: 110508 - DNA, 20 bp, human
gcccagggagttgagactgg

SEQ ID NO: 110509 - DNA, 20 bp, human
gtggcaggccgaaggtggag

SEQ ID NO: 110510 - DNA, 20 bp, human
gcatcggctgggcgggatcc

SEQ ID NO: 110511 - DNA, 20 bp, human
gggtgtgcttggttccgcag

SEQ ID NO: 110512 - DNA, 20 bp, human
gtggatgccagggtgcgcgg

SEQ ID NO: 110513 - DNA, 20 bp, human
gtcggtgagtgtggcggaga

SEQ ID NO: 110514 - DNA, 20 bp, human
gccctgaagcgtctaatcac

SEQ ID NO: 110515 - DNA, 20 bp, human
gtatcccggcaaggaagcgg

SEQ ID NO: 110516 - DNA, 20 bp, human
gggctgggcgcgagattcgg

SEQ ID NO: 110517 - DNA, 20 bp, human
ggggctcgcagtctcctgca

SEQ ID NO: 110518 - DNA, 20 bp, human
ggcagaactgctagctgcgg

SEQ ID NO: 110519 - DNA, 20 bp, human
gcgacaggcctgggcgaaag

SEQ ID NO: 110520 - DNA, 20 bp, human
gggaggctgggcgcgagatt

SEQ ID NO: 110521 - DNA, 20 bp, human
gggaacgcacgtcctcgaca

SEQ ID NO: 110522 - DNA, 20 bp, human
gaaacggcggctcttgaggg

SEQ ID NO: 110523 - DNA, 20 bp, human
ggcggctcttgagggaggct

SEQ ID NO: 110524 - DNA, 20 bp, human
gcccagcccggctccgccac

SEQ ID NO: 110525 - DNA, 20 bp, human
gccgcctccagagggagcga

SEQ ID NO: 110526 - DNA, 20 bp, human
gctggtgagacgagccggga

SEQ ID NO: 110527 - DNA, 20 bp, human
gactgcagttcctgcgagcg

SEQ ID NO: 110528 - DNA, 20 bp, human
gtcctgcgagcgaggagcgc

SEQ ID NO: 110529 - DNA, 20 bp, human
gtgggcctcggagctgggac

SEQ ID NO: 110530 - DNA, 20 bp, human
gctgcgtcctgggccctctg

SEQ ID NO: 110531 - DNA, 20 bp, human
gggccccgggccgcgctcga

SEQ ID NO: 110532 - DNA, 20 bp, human
ggcctcggagctgggacggg

SEQ ID NO: 110533 - DNA, 20 bp, human
ggtcaggacccgggctgctc

SEQ ID NO: 110534 - DNA, 20 bp, human
ggggcgcgcgtaaagctggg

SEQ ID NO: 110535 - DNA, 20 bp, human
gggctcttgggcgtccctcg

SEQ ID NO: 110536 - DNA, 20 bp, human
gggcgagagatggtgcaggt

SEQ ID NO: 110537 - DNA, 20 bp, human
gtcaactagtcgtggaggga

SEQ ID NO: 110538 - DNA, 20 bp, human
gtctgtcaactagtcgtgga

SEQ ID NO: 110539 - DNA, 20 bp, human
gcatctctcgcctgcctgtg

SEQ ID NO: 110540 - DNA, 20 bp, human
gggtttctgtcaactagtcg

SEQ ID NO: 110541 - DNA, 20 bp, human
gtcggtgtgacaagcagttg

SEQ ID NO: 110542 - DNA, 20 bp, human
gtttagattaaacagaccag

SEQ ID NO: 110543 - DNA, 20 bp, human
gtctgcaaattgcaaataca

SEQ ID NO: 110544 - DNA, 20 bp, human
gtaaggatgttaattgctga

SEQ ID NO: 110545 - DNA, 20 bp, human
gtcttaccctctttcttagt

SEQ ID NO: 110546 - DNA, 20 bp, human
gcgcgtcccgctaggcccta

SEQ ID NO: 110547 - DNA, 20 bp, human
gggcccacctgtcctcccta

SEQ ID NO: 110548 - DNA, 20 bp, human
gggacaggtgggcccctaag

SEQ ID NO: 110549 - DNA, 20 bp, human
ggctaggccctagggaggac

SEQ ID NO: 110550 - DNA, 20 bp, human
ggtcccgctaggccctaggg

SEQ ID NO: 110551 - DNA, 20 bp, human
gtggtggagatgggattctc

SEQ ID NO: 110552 - DNA, 20 bp, human
gacatgcctgaggcaaaacc

SEQ ID NO: 110553 - DNA, 20 bp, human
ggtgattgggggggcatctc

SEQ ID NO: 110554 - DNA, 20 bp, human
gattgggggggcatctctgg

SEQ ID NO: 110555 - DNA, 20 bp, human
gaacatgcgggcggaatgtg

SEQ ID NO: 110556 - DNA, 20 bp, human
gggagactgagacccatagt

SEQ ID NO: 110557 - DNA, 20 bp, human
gggcacaggtcacccaaaga

SEQ ID NO: 110558 - DNA, 20 bp, human
gccaggcacgaagcaggcac

SEQ ID NO: 110559 - DNA, 20 bp, human
gtcagctccatactaaacgt

SEQ ID NO: 110560 - DNA, 20 bp, human
gacccatagtgggtagagac

SEQ ID NO: 110561 - DNA, 20 bp, human
ggtcacaccaggcacgaagc

SEQ ID NO: 110562 - DNA, 20 bp, human
gtccgcggggaaccttgctg

SEQ ID NO: 110563 - DNA, 20 bp, human
gtctcaggatgcctgagccg

SEQ ID NO: 110564 - DNA, 20 bp, human
gcacctctcatcagagggat

SEQ ID NO: 110565 - DNA, 20 bp, human
gagaggtgaaggtaaaccca

SEQ ID NO: 110566 - DNA, 20 bp, human
gtagggtgcctgggacacct

SEQ ID NO: 110567 - DNA, 20 bp, human
ggcaggggtcagccgttggg

SEQ ID NO: 110568 - DNA, 20 bp, human
ggaggctgtaggggcctgtg

SEQ ID NO: 110569 - DNA, 20 bp, human
gcattgctggactggctggg

SEQ ID NO: 110570 - DNA, 20 bp, human
gcccaagtgaaggtgactga

SEQ ID NO: 110571 - DNA, 20 bp, human
ggcagagcctcccggagaag

SEQ ID NO: 110572 - DNA, 20 bp, human
gggcctccagggctatgtgc

SEQ ID NO: 110573 - DNA, 20 bp, human
ggaggcaggcatgtcagggg

SEQ ID NO: 110574 - DNA, 20 bp, human
gtgtgcaggggtcagccgtt

SEQ ID NO: 110575 - DNA, 20 bp, human
ggcaggcttagtggctgtgg

SEQ ID NO: 110576 - DNA, 20 bp, human
ggcagccacagctccggagg

SEQ ID NO: 110577 - DNA, 20 bp, human
gtggatcctgcggccacctc

SEQ ID NO: 110578 - DNA, 20 bp, human
gcagtcaggaagggactgag

SEQ ID NO: 110579 - DNA, 20 bp, human
ggagaagtcagtgatggtgt

SEQ ID NO: 110580 - DNA, 20 bp, human
gaccttcagcttggatcctg

SEQ ID NO: 110581 - DNA, 20 bp, human
gtagactccatcaaggacag

SEQ ID NO: 110582 - DNA, 20 bp, human
gccctatagaaggtgaccca

SEQ ID NO: 110583 - DNA, 20 bp, human
gctgtggctgcctccatgct

SEQ ID NO: 110584 - DNA, 20 bp, human
ggcagagctaaagactctat

SEQ ID NO: 110585 - DNA, 20 bp, human
gcctgaggcgccgttcagga

SEQ ID NO: 110586 - DNA, 20 bp, human
ggggcgcgcgttcagagcgt

SEQ ID NO: 110587 - DNA, 20 bp, human
gagggcgcctcgctaaggct

SEQ ID NO: 110588 - DNA, 20 bp, human
gtaattccagcgagaggcag

SEQ ID NO: 110589 - DNA, 20 bp, human
gtgagtcgaatgcctaaata

SEQ ID NO: 110590 - DNA, 20 bp, human
gcgtcctgggaagggagatc

SEQ ID NO: 110591 - DNA, 20 bp, human
gctgtagtaattccagcgag

SEQ ID NO: 110592 - DNA, 20 bp, human
gagcgggcggccggctaggg

SEQ ID NO: 110593 - DNA, 20 bp, human
ggagatccggagcgaatagg

SEQ ID NO: 110594 - DNA, 20 bp, human
gtataatgcgagggtctgga

SEQ ID NO: 110595 - DNA, 20 bp, human
ggctgcgctgcgggcgtcct

SEQ ID NO: 110596 - DNA, 20 bp, human
ggcgccggggagcacgacga

SEQ ID NO: 110597 - DNA, 20 bp, human
gcggcctgaagagacaccgg

SEQ ID NO: 110598 - DNA, 20 bp, human
gtacggcccgctggggaacg

SEQ ID NO: 110599 - DNA, 20 bp, human
gcccacgctacggcccgctg

SEQ ID NO: 110600 - DNA, 20 bp, human
ggcgctgccccgttccccag

SEQ ID NO: 110601 - DNA, 20 bp, human
gggagggccccgaggtagtg

SEQ ID NO: 110602 - DNA, 20 bp, human
ggagctaggctaccccaccc

SEQ ID NO: 110603 - DNA, 20 bp, human
gccggtgcggagaagggtag

SEQ ID NO: 110604 - DNA, 20 bp, human
gcggcggcctgaagagacac

SEQ ID NO: 110605 - DNA, 20 bp, human
gacctcgctggaccccggac

SEQ ID NO: 110606 - DNA, 20 bp, human
gcagcagccacggagccgtc

SEQ ID NO: 110607 - DNA, 20 bp, human
gccattgcgggtagccccgg

SEQ ID NO: 110608 - DNA, 20 bp, human
gagatgagcggccccagtag

SEQ ID NO: 110609 - DNA, 20 bp, human
gtagtgaccccgggagtccg

SEQ ID NO: 110610 - DNA, 20 bp, human
gccaccccgggaatgtgagg

SEQ ID NO: 110611 - DNA, 20 bp, human
gtccccgccgagccccgagg

SEQ ID NO: 110612 - DNA, 20 bp, human
gccccgggaatgtgaggagg

SEQ ID NO: 110613 - DNA, 20 bp, human
gccaacgacgacggctccgg

SEQ ID NO: 110614 - DNA, 20 bp, human
gccacggagccgtcgggaac

SEQ ID NO: 110615 - DNA, 20 bp, human
gagcagctggtagtgacccc

SEQ ID NO: 110616 - DNA, 20 bp, human
gcgcggcccgatgaagaagg

SEQ ID NO: 110617 - DNA, 20 bp, human
ggtgcgcggcccgatgaaga

SEQ ID NO: 110618 - DNA, 20 bp, human
gcgccggcccagagacaccg

SEQ ID NO: 110619 - DNA, 20 bp, human
gtcgctcttgaagccgccgg

SEQ ID NO: 110620 - DNA, 20 bp, human
ggaaagatcacggggaagtg

SEQ ID NO: 110621 - DNA, 20 bp, human
gatccaccgatcaacttggg

SEQ ID NO: 110622 - DNA, 20 bp, human
gggcccgcagggctttctag

SEQ ID NO: 110623 - DNA, 20 bp, human
gcgcatccaccgatcaactt

SEQ ID NO: 110624 - DNA, 20 bp, human
gtctggtcggagttattctg

SEQ ID NO: 110625 - DNA, 20 bp, human
gctccgcccaagttgatcgg

SEQ ID NO: 110626 - DNA, 20 bp, human
gagcgcgcggacccgactgt

SEQ ID NO: 110627 - DNA, 20 bp, human
ggactgtgccgagggacccg

SEQ ID NO: 110628 - DNA, 20 bp, human
ggccccgggtcagagtggta

SEQ ID NO: 110629 - DNA, 20 bp, human
gcccgccacctggagcggac

SEQ ID NO: 110630 - DNA, 20 bp, human
ggggcggctggagcgaggtg

SEQ ID NO: 110631 - DNA, 20 bp, human
ggccggtccgctccaggtgg

SEQ ID NO: 110632 - DNA, 20 bp, human
ggcgcaggctgcaagctggt

SEQ ID NO: 110633 - DNA, 20 bp, human
gatgtccgctccctgcggga

SEQ ID NO: 110634 - DNA, 20 bp, human
gcgctccctgcgggagggaa

SEQ ID NO: 110635 - DNA, 20 bp, human
gctgccgggctgccccgagc

SEQ ID NO: 110636 - DNA, 20 bp, human
gctgcagtcggcgggaggta

SEQ ID NO: 110637 - DNA, 20 bp, human
gcccttaccggggggagtaa

SEQ ID NO: 110638 - DNA, 20 bp, human
gcgcgctgggtggatgcggg

SEQ ID NO: 110639 - DNA, 20 bp, human
gtggacgcgctgggtggatg

SEQ ID NO: 110640 - DNA, 20 bp, human
gcggctccaacacagttccc

SEQ ID NO: 110641 - DNA, 20 bp, human
ggccattactccccccggta

SEQ ID NO: 110642 - DNA, 20 bp, human
gagggaagcgacgagcgccg

SEQ ID NO: 110643 - DNA, 20 bp, human
ggtggatgcggggggctcct

SEQ ID NO: 110644 - DNA, 20 bp, human
gtctgtctggacgcgctggg

SEQ ID NO: 110645 - DNA, 20 bp, human
ggctgtgacagtcatctgtc

SEQ ID NO: 110646 - DNA, 20 bp, human
gccactgctcccgaaggtgg

SEQ ID NO: 110647 - DNA, 20 bp, human
gcccgactcgacccccccgg

SEQ ID NO: 110648 - DNA, 20 bp, human
gctctgcccactgctcccga

SEQ ID NO: 110649 - DNA, 20 bp, human
gtctccgtgacccagctcgg

SEQ ID NO: 110650 - DNA, 20 bp, human
gatgggcgccccctctaacc

SEQ ID NO: 110651 - DNA, 20 bp, human
gccccccgggggaggacatc

SEQ ID NO: 110652 - DNA, 20 bp, human
gcggagagggtgggcaaacg

SEQ ID NO: 110653 - DNA, 20 bp, human
ggctccgcgaagccacggct

SEQ ID NO: 110654 - DNA, 20 bp, human
gtgggcgacagcgggggcgt

SEQ ID NO: 110655 - DNA, 20 bp, human
gggggcttggagggaagatt

SEQ ID NO: 110656 - DNA, 20 bp, human
ggggtattaagtacagattt

SEQ ID NO: 110657 - DNA, 20 bp, human
gctgctttttttcgacatac

SEQ ID NO: 110658 - DNA, 20 bp, human
gggtgttacaaaatataatt

SEQ ID NO: 110659 - DNA, 20 bp, human
gctatttcttgtggatatta

SEQ ID NO: 110660 - DNA, 20 bp, human
gctaataacacaacaagttt

SEQ ID NO: 110661 - DNA, 20 bp, human
gccatggccagaaaactttt

SEQ ID NO: 110662 - DNA, 20 bp, human
ggtaattcctgcttagaata

SEQ ID NO: 110663 - DNA, 20 bp, human
gagatattcaagaagaatct

SEQ ID NO: 110664 - DNA, 20 bp, human
ggataaaaataaaaaacata

SEQ ID NO: 110665 - DNA, 20 bp, human
gaataaaaaacataaggtgg

SEQ ID NO: 110666 - DNA, 20 bp, human
gagacacaagcggaccccac

SEQ ID NO: 110667 - DNA, 20 bp, human
ggcccccgaggcaggaaatg

SEQ ID NO: 110668 - DNA, 20 bp, human
ggctccaggaccgcccgcca

SEQ ID NO: 110669 - DNA, 20 bp, human
gtcctggcctcgtacctggg

SEQ ID NO: 110670 - DNA, 20 bp, human
gcatgggagacaggatgctg

SEQ ID NO: 110671 - DNA, 20 bp, human
gccgggacctcctgcagcca

SEQ ID NO: 110672 - DNA, 20 bp, human
gatgcgacccgaccgcgctg

SEQ ID NO: 110673 - DNA, 20 bp, human
gctggagcctcagcgcggtc

SEQ ID NO: 110674 - DNA, 20 bp, human
gtcgagcagtcggcctacag

SEQ ID NO: 110675 - DNA, 20 bp, human
gggaaatggggtctctccat

SEQ ID NO: 110676 - DNA, 20 bp, human
gctggggcaatagcagatga

SEQ ID NO: 110677 - DNA, 20 bp, human
ggcggcacctaggggagagt

SEQ ID NO: 110678 - DNA, 20 bp, human
gaccatccggcggcacctag

SEQ ID NO: 110679 - DNA, 20 bp, human
gggtgccaggcaggacatcg

SEQ ID NO: 110680 - DNA, 20 bp, human
gcacaaactggatgtcgctg

SEQ ID NO: 110681 - DNA, 20 bp, human
ggtttgtgcaggagatgatc

SEQ ID NO: 110682 - DNA, 20 bp, human
gggtaagctcaaccctgctc

SEQ ID NO: 110683 - DNA, 20 bp, human
ggggaaggctgacaatccag

SEQ ID NO: 110684 - DNA, 20 bp, human
ggacaaccaccaccatccgg

SEQ ID NO: 110685 - DNA, 20 bp, human
gtgaaggcatcgaaacgctc

SEQ ID NO: 110686 - DNA, 20 bp, human
ggctccgagcgcgacaatgg

SEQ ID NO: 110687 - DNA, 20 bp, human
ggccccggctcccagaccac

SEQ ID NO: 110688 - DNA, 20 bp, human
gggggctccgagcgcgacaa

SEQ ID NO: 110689 - DNA, 20 bp, human
gccggctcccagaccacagg

SEQ ID NO: 110690 - DNA, 20 bp, human
gggatccgttaccgcttccc

SEQ ID NO: 110691 - DNA, 20 bp, human
gcggagcccctcagctcagg

SEQ ID NO: 110692 - DNA, 20 bp, human
gcgagagccgcaccccgcgg

SEQ ID NO: 110693 - DNA, 20 bp, human
ggctgccggggaagcggtaa

SEQ ID NO: 110694 - DNA, 20 bp, human
gcctcggccgcctgagctga

SEQ ID NO: 110695 - DNA, 20 bp, human
ggggcggggagtctaccggg

SEQ ID NO: 110696 - DNA, 20 bp, human
ggacagtaacaggagaatca

SEQ ID NO: 110697 - DNA, 20 bp, human
gaaagcaggaaagtatgctt

SEQ ID NO: 110698 - DNA, 20 bp, human
gtctgagcaggtaagaagca

SEQ ID NO: 110699 - DNA, 20 bp, human
gtcctgctttgtagggatgt

SEQ ID NO: 110700 - DNA, 20 bp, human
ggaggtggccggttcttggt

SEQ ID NO: 110701 - DNA, 20 bp, human
gttgggctcagtgaagagtc

SEQ ID NO: 110702 - DNA, 20 bp, human
gtgtagggatgtgggttcgc

SEQ ID NO: 110703 - DNA, 20 bp, human
ggggtgagtgggagctaata

SEQ ID NO: 110704 - DNA, 20 bp, human
ggggttcgcgggacagtaac

SEQ ID NO: 110705 - DNA, 20 bp, human
gccgaggcttccacgacggg

SEQ ID NO: 110706 - DNA, 20 bp, human
gaaccgggatttgctctccg

SEQ ID NO: 110707 - DNA, 20 bp, human
gggacctggacgaggtggca

SEQ ID NO: 110708 - DNA, 20 bp, human
gggccccgagatgaagccgg

SEQ ID NO: 110709 - DNA, 20 bp, human
gtggacgagatgttccccga

SEQ ID NO: 110710 - DNA, 20 bp, human
gcccgagatgaagccggcgg

SEQ ID NO: 110711 - DNA, 20 bp, human
gacgcaccgcgggcccccat

SEQ ID NO: 110712 - DNA, 20 bp, human
gcgcggccccgagatgaagc

SEQ ID NO: 110713 - DNA, 20 bp, human
gccaggtgctcggagaaacc

SEQ ID NO: 110714 - DNA, 20 bp, human
gtcccaggctccctgccccg

SEQ ID NO: 110715 - DNA, 20 bp, human
gggaacatctcgtccaccgc

SEQ ID NO: 110716 - DNA, 20 bp, human
gtcgctccggtaattaacaa

SEQ ID NO: 110717 - DNA, 20 bp, human
gccgccgatgggcaaatccc

SEQ ID NO: 110718 - DNA, 20 bp, human
gttaccggagcgacagacta

SEQ ID NO: 110719 - DNA, 20 bp, human
gccgatgggcaaatcccggg

SEQ ID NO: 110720 - DNA, 20 bp, human
gagactagggagctccgccc

SEQ ID NO: 110721 - DNA, 20 bp, human
gctccgaaggcagccactcg

SEQ ID NO: 110722 - DNA, 20 bp, human
ggtctgcccttgttaattac

SEQ ID NO: 110723 - DNA, 20 bp, human
gcacgaccaaccccaaccag

SEQ ID NO: 110724 - DNA, 20 bp, human
gggcaggcggtgcacctgga

SEQ ID NO: 110725 - DNA, 20 bp, human
ggtcgtggtacacctcttga

SEQ ID NO: 110726 - DNA, 20 bp, human
gcaccctgcgcgaaaggagg

SEQ ID NO: 110727 - DNA, 20 bp, human
ggatggactcaaaaacccag

SEQ ID NO: 110728 - DNA, 20 bp, human
gggccttcgaggcactgaag

SEQ ID NO: 110729 - DNA, 20 bp, human
ggcactgaagcggcgaactg

SEQ ID NO: 110730 - DNA, 20 bp, human
gcagatcgagtcagaggcca

SEQ ID NO: 110731 - DNA, 20 bp, human
gaagcggggagcgacagcag

SEQ ID NO: 110732 - DNA, 20 bp, human
gcgccaccctgcgcgaaagg

SEQ ID NO: 110733 - DNA, 20 bp, human
gcccggccagtgtctgatct

SEQ ID NO: 110734 - DNA, 20 bp, human
gccagttcagatcgagtcag

SEQ ID NO: 110735 - DNA, 20 bp, human
gtaattaaatgccatctggg

SEQ ID NO: 110736 - DNA, 20 bp, human
gctctgtctggaggacggta

SEQ ID NO: 110737 - DNA, 20 bp, human
ggaggacggtaagggatgtc

SEQ ID NO: 110738 - DNA, 20 bp, human
gggatgtgtggcatgcacgc

SEQ ID NO: 110739 - DNA, 20 bp, human
gttgcgagggatatgagtta

SEQ ID NO: 110740 - DNA, 20 bp, human
gtagagatgcgaccttaaag

SEQ ID NO: 110741 - DNA, 20 bp, human
gcaagtcatactcattccaa

SEQ ID NO: 110742 - DNA, 20 bp, human
gtctgcagtggtttggacag

SEQ ID NO: 110743 - DNA, 20 bp, human
gagcgtgatcaaccatgaaa

SEQ ID NO: 110744 - DNA, 20 bp, human
gtgcaaggaatcttctgcag

SEQ ID NO: 110745 - DNA, 20 bp, human
gctgagaaccaggaaatgac

SEQ ID NO: 110746 - DNA, 20 bp, human
gggcgctggatctgtggtcg

SEQ ID NO: 110747 - DNA, 20 bp, human
gcagtgctaaaggagcccgg

SEQ ID NO: 110748 - DNA, 20 bp, human
gcaccttcagccgaagatgg

SEQ ID NO: 110749 - DNA, 20 bp, human
gcaggagggcgacccctggg

SEQ ID NO: 110750 - DNA, 20 bp, human
ggctgggggatggagatctg

SEQ ID NO: 110751 - DNA, 20 bp, human
ggactgaggcgctggatctg

SEQ ID NO: 110752 - DNA, 20 bp, human
gtgaggaccaggttctcggt

SEQ ID NO: 110753 - DNA, 20 bp, human
ggcgcccgcgccaccatctt

SEQ ID NO: 110754 - DNA, 20 bp, human
ggtgcaggagggcgacccct

SEQ ID NO: 110755 - DNA, 20 bp, human
ggagatggagagactcccgg

SEQ ID NO: 110756 - DNA, 20 bp, human
gctccaactggggggactag

SEQ ID NO: 110757 - DNA, 20 bp, human
gggtccggtgcagacaatca

SEQ ID NO: 110758 - DNA, 20 bp, human
ggaggacgcgcagggagatt

SEQ ID NO: 110759 - DNA, 20 bp, human
gtctgacgcacctcccaggc

SEQ ID NO: 110760 - DNA, 20 bp, human
gctcgtaagggccatggtgg

SEQ ID NO: 110761 - DNA, 20 bp, human
gactggggggactagtggag

SEQ ID NO: 110762 - DNA, 20 bp, human
ggctcccttggaaatctcag

SEQ ID NO: 110763 - DNA, 20 bp, human
gaggataatctaagacgata

SEQ ID NO: 110764 - DNA, 20 bp, human
gttacagatctccaactggg

SEQ ID NO: 110765 - DNA, 20 bp, human
gctataaagagaggcgtccg

SEQ ID NO: 110766 - DNA, 20 bp, human
gaggtgcaactatagctacg

SEQ ID NO: 110767 - DNA, 20 bp, human
gctgtgaccgcagcatctct

SEQ ID NO: 110768 - DNA, 20 bp, human
gtgatcaggttaccagtcaa

SEQ ID NO: 110769 - DNA, 20 bp, human
gtcaggttaccagtcaaggg

SEQ ID NO: 110770 - DNA, 20 bp, human
gcttagtaggccctccgtaa

SEQ ID NO: 110771 - DNA, 20 bp, human
gcattgacctaaataatcag

SEQ ID NO: 110772 - DNA, 20 bp, human
gtgacctaaataatcagagg

SEQ ID NO: 110773 - DNA, 20 bp, human
gtaagatgggtaagatgctt

SEQ ID NO: 110774 - DNA, 20 bp, human
ggctatagttgcacctgatc

SEQ ID NO: 110775 - DNA, 20 bp, human
gctgcggtcacagcaatttc

SEQ ID NO: 110776 - DNA, 20 bp, human
ggggcactcaccggcttcca

SEQ ID NO: 110777 - DNA, 20 bp, human
gggcttccagggccgtcccg

SEQ ID NO: 110778 - DNA, 20 bp, human
gtctcacgtgtcagaatcgg

SEQ ID NO: 110779 - DNA, 20 bp, human
ggaccgggcctcgcacacgg

SEQ ID NO: 110780 - DNA, 20 bp, human
gcagagagaggggtcgtgac

SEQ ID NO: 110781 - DNA, 20 bp, human
gggactggaggcgatgactc

SEQ ID NO: 110782 - DNA, 20 bp, human
ggaggggtcgtgactggaag

SEQ ID NO: 110783 - DNA, 20 bp, human
ggccggcagccctccggggg

SEQ ID NO: 110784 - DNA, 20 bp, human
gtggaagaggcggaggggta

SEQ ID NO: 110785 - DNA, 20 bp, human
gaagcgtccaagtacatcat

SEQ ID NO: 110786 - DNA, 20 bp, human
gaaaggccctaaacgtgagt

SEQ ID NO: 110787 - DNA, 20 bp, human
gcttcttctgaggaaggctg

SEQ ID NO: 110788 - DNA, 20 bp, human
ggaaggctgcggcttctcca

SEQ ID NO: 110789 - DNA, 20 bp, human
gtgggaggcagtctaggccc

SEQ ID NO: 110790 - DNA, 20 bp, human
ggagggcctctgagtatcca

SEQ ID NO: 110791 - DNA, 20 bp, human
gtggatggtgagacatgtgg

SEQ ID NO: 110792 - DNA, 20 bp, human
gatggaagtacccacagaag

SEQ ID NO: 110793 - DNA, 20 bp, human
gagatggatctgtcagacct

SEQ ID NO: 110794 - DNA, 20 bp, human
ggcattcactgataactaag

SEQ ID NO: 110795 - DNA, 20 bp, human
gtaccctaagcaaataagtt

SEQ ID NO: 110796 - DNA, 20 bp, human
gagctgctgctgacactggg

SEQ ID NO: 110797 - DNA, 20 bp, human
gtacggctcaagcattggtg

SEQ ID NO: 110798 - DNA, 20 bp, human
ggaccagtgtccctcttgaa

SEQ ID NO: 110799 - DNA, 20 bp, human
gcaggacgggcctttcaaga

SEQ ID NO: 110800 - DNA, 20 bp, human
gaaggtaagtgggagcagga

SEQ ID NO: 110801 - DNA, 20 bp, human
gcaactgtgcttcaggaaag

SEQ ID NO: 110802 - DNA, 20 bp, human
gtaaaacgtgcagttccaga

SEQ ID NO: 110803 - DNA, 20 bp, human
gtcctggaggagaatgcaag

SEQ ID NO: 110804 - DNA, 20 bp, human
gatgtgtgcattgtcctgaa

SEQ ID NO: 110805 - DNA, 20 bp, human
gtcatttacggctcaagcat

SEQ ID NO: 110806 - DNA, 20 bp, human
ggtgggcggaggtaagtcac

SEQ ID NO: 110807 - DNA, 20 bp, human
gagcagctgagacctagaag

SEQ ID NO: 110808 - DNA, 20 bp, human
gtctgtggctcgcttgtggg

SEQ ID NO: 110809 - DNA, 20 bp, human
ggtggatgtgctcaccgggt

SEQ ID NO: 110810 - DNA, 20 bp, human
gcatggcagctgggctcacg

SEQ ID NO: 110811 - DNA, 20 bp, human
gcagccagtgtggtcttgag

SEQ ID NO: 110812 - DNA, 20 bp, human
ggcagatgtacagcccaggt

SEQ ID NO: 110813 - DNA, 20 bp, human
gccctctgtggctcgcttgt

SEQ ID NO: 110814 - DNA, 20 bp, human
ggggccagggaaccacgcac

SEQ ID NO: 110815 - DNA, 20 bp, human
gtgcttggagcacacccacc

SEQ ID NO: 110816 - DNA, 20 bp, human
gtcagcttggaggtcatcca

SEQ ID NO: 110817 - DNA, 20 bp, human
ggctccgagtagacctggaa

SEQ ID NO: 110818 - DNA, 20 bp, human
ggtggaagatgagcagacac

SEQ ID NO: 110819 - DNA, 20 bp, human
ggaggcgcaccagcaggcct

SEQ ID NO: 110820 - DNA, 20 bp, human
gagtcccagaactccagggt

SEQ ID NO: 110821 - DNA, 20 bp, human
gcaagcaacagctggacgaa

SEQ ID NO: 110822 - DNA, 20 bp, human
gtgctggtgcgcctcttgga

SEQ ID NO: 110823 - DNA, 20 bp, human
gcttgcaaaatggaagccag

SEQ ID NO: 110824 - DNA, 20 bp, human
gtcgggagtcccagaactcc

SEQ ID NO: 110825 - DNA, 20 bp, human
ggggttggaagagccctcaa

SEQ ID NO: 110826 - DNA, 20 bp, human
gtattgggaataggatatcg

SEQ ID NO: 110827 - DNA, 20 bp, human
gtcttgaaggtatgtatatg

SEQ ID NO: 110828 - DNA, 20 bp, human
gatgtcgtccttaagaatgt

SEQ ID NO: 110829 - DNA, 20 bp, human
gtaagttttgtttgattaag

SEQ ID NO: 110830 - DNA, 20 bp, human
gctattcccaatactaaact

SEQ ID NO: 110831 - DNA, 20 bp, human
gcaagaattttgaggaagga

SEQ ID NO: 110832 - DNA, 20 bp, human
gttatttcctagtttagtat

SEQ ID NO: 110833 - DNA, 20 bp, human
gcataccttcaagaattttg

SEQ ID NO: 110834 - DNA, 20 bp, human
gattctttccaacattctta

SEQ ID NO: 110835 - DNA, 20 bp, human
gcataaaattttgacttttc

SEQ ID NO: 110836 - DNA, 20 bp, human
gctgcggcccaggtaagagg

SEQ ID NO: 110837 - DNA, 20 bp, human
gtgccaagaaggaaggacaa

SEQ ID NO: 110838 - DNA, 20 bp, human
gaggaggtccctcacggtgg

SEQ ID NO: 110839 - DNA, 20 bp, human
gacagatagagagactcctg

SEQ ID NO: 110840 - DNA, 20 bp, human
gtgaaggaggtccctcacgg

SEQ ID NO: 110841 - DNA, 20 bp, human
ggcccaggtaagaggaggtt

SEQ ID NO: 110842 - DNA, 20 bp, human
gcccaaacctcctcttacct

SEQ ID NO: 110843 - DNA, 20 bp, human
gccacagagcccccaccgtg

SEQ ID NO: 110844 - DNA, 20 bp, human
gaaagatggagacaacatgt

SEQ ID NO: 110845 - DNA, 20 bp, human
gaatatgagtgcgagggacg

SEQ ID NO: 110846 - DNA, 20 bp, human
gggatacaagtgcaagaagg

SEQ ID NO: 110847 - DNA, 20 bp, human
gccctcccgggacaaaatct

SEQ ID NO: 110848 - DNA, 20 bp, human
gggggtcttgtagataaaga

SEQ ID NO: 110849 - DNA, 20 bp, human
gccctcttaggcgaacactg

SEQ ID NO: 110850 - DNA, 20 bp, human
gtcagagaaggagcgtctag

SEQ ID NO: 110851 - DNA, 20 bp, human
gtcctcaaaggagcatgtcc

SEQ ID NO: 110852 - DNA, 20 bp, human
gtgagaaagtggactcatgg

SEQ ID NO: 110853 - DNA, 20 bp, human
gcactcagtgcgaatgtcaa

SEQ ID NO: 110854 - DNA, 20 bp, human
gcttgcagggggagctgaga

SEQ ID NO: 110855 - DNA, 20 bp, human
ggtgcgaatgtcaaagggcc

SEQ ID NO: 110856 - DNA, 20 bp, human
ggcctcacagaatcacatga

SEQ ID NO: 110857 - DNA, 20 bp, human
gcagcccctgagaccaggtc

SEQ ID NO: 110858 - DNA, 20 bp, human
gtgctgctctcaggtaggag

SEQ ID NO: 110859 - DNA, 20 bp, human
ggtgccacaggagttcctag

SEQ ID NO: 110860 - DNA, 20 bp, human
gatcacgtctgtgaacgagg

SEQ ID NO: 110861 - DNA, 20 bp, human
gttccctgctgctctcaggt

SEQ ID NO: 110862 - DNA, 20 bp, human
gggagctggaggctttactc

SEQ ID NO: 110863 - DNA, 20 bp, human
gcatgtgcaggtctaaacat

SEQ ID NO: 110864 - DNA, 20 bp, human
gacgaggaggttcctttgca

SEQ ID NO: 110865 - DNA, 20 bp, human
gggggctccaggcttaggaa

SEQ ID NO: 110866 - DNA, 20 bp, human
ggtatccaggcccagtcccg

SEQ ID NO: 110867 - DNA, 20 bp, human
gattctggcgagcacacctc

SEQ ID NO: 110868 - DNA, 20 bp, human
ggaggcgctagagaagtccg

SEQ ID NO: 110869 - DNA, 20 bp, human
gggaggaaatgagggacgag

SEQ ID NO: 110870 - DNA, 20 bp, human
ggcgagcacacctcgggact

SEQ ID NO: 110871 - DNA, 20 bp, human
gcaaaaagctgctggaacgt

SEQ ID NO: 110872 - DNA, 20 bp, human
gcagcagggagtctctgcag

SEQ ID NO: 110873 - DNA, 20 bp, human
ggagttcacacgcctcaaag

SEQ ID NO: 110874 - DNA, 20 bp, human
gcacacctcgggactgggcc

SEQ ID NO: 110875 - DNA, 20 bp, human
ggtaggtgagagatctcaag

SEQ ID NO: 110876 - DNA, 20 bp, human
ggctgagtcgaggccaggaa

SEQ ID NO: 110877 - DNA, 20 bp, human
ggactcagcgccaaaggtat

SEQ ID NO: 110878 - DNA, 20 bp, human
gccagcagggaaagcattag

SEQ ID NO: 110879 - DNA, 20 bp, human
gtaggcttaaagagcaggcg

SEQ ID NO: 110880 - DNA, 20 bp, human
gggcctcgactcagcgccaa

SEQ ID NO: 110881 - DNA, 20 bp, human
gcgggacagtcactacctca

SEQ ID NO: 110882 - DNA, 20 bp, human
ggaaggggcggtcgatgaga

SEQ ID NO: 110883 - DNA, 20 bp, human
ggcgcttgcgctgaccgccc

SEQ ID NO: 110884 - DNA, 20 bp, human
gccggctaggcttaaagagc

SEQ ID NO: 110885 - DNA, 20 bp, human
ggggcagagacccatacctt

SEQ ID NO: 110886 - DNA, 20 bp, human
gacccagaggtaagtgatga

SEQ ID NO: 110887 - DNA, 20 bp, human
gatttccaccaagaacccag

SEQ ID NO: 110888 - DNA, 20 bp, human
gactcgaaaaaccccaggtg

SEQ ID NO: 110889 - DNA, 20 bp, human
gttggaactcgaaaaacccc

SEQ ID NO: 110890 - DNA, 20 bp, human
ggaatcttggaacccaaatg

SEQ ID NO: 110891 - DNA, 20 bp, human
gatgctcacagataactacg

SEQ ID NO: 110892 - DNA, 20 bp, human
gggtggaaataaggcacaag

SEQ ID NO: 110893 - DNA, 20 bp, human
ggccttcatcacttacctct

SEQ ID NO: 110894 - DNA, 20 bp, human
ggaactccagaggtaagact

SEQ ID NO: 110895 - DNA, 20 bp, human
gcttacctctgggttcttgg

SEQ ID NO: 110896 - DNA, 20 bp, human
ggcgaggcctaggggtgcag

SEQ ID NO: 110897 - DNA, 20 bp, human
gttcctgggcagggcacgga

SEQ ID NO: 110898 - DNA, 20 bp, human
gcggcagcagcgaggcctag

SEQ ID NO: 110899 - DNA, 20 bp, human
ggtggggcgagcgcacgagg

SEQ ID NO: 110900 - DNA, 20 bp, human
ggcagatcaccgcggttcct

SEQ ID NO: 110901 - DNA, 20 bp, human
ggaaccaccagtcggcctgg

SEQ ID NO: 110902 - DNA, 20 bp, human
gcctcgcccaggcccgactc

SEQ ID NO: 110903 - DNA, 20 bp, human
gaggccgcccctgcacccct

SEQ ID NO: 110904 - DNA, 20 bp, human
gctgccgccaggccgactgg

SEQ ID NO: 110905 - DNA, 20 bp, human
gagtcctgagaccgcgccgg

SEQ ID NO: 110906 - DNA, 20 bp, human
gccagggatgaccccactca

SEQ ID NO: 110907 - DNA, 20 bp, human
gccagccgctccatcatggt

SEQ ID NO: 110908 - DNA, 20 bp, human
gcagcccagccgctccatca

SEQ ID NO: 110909 - DNA, 20 bp, human
ggctgctccggtccctgagt

SEQ ID NO: 110910 - DNA, 20 bp, human
gctcataggacccaccatga

SEQ ID NO: 110911 - DNA, 20 bp, human
gtaaatagaagacagactta

SEQ ID NO: 110912 - DNA, 20 bp, human
gagtgagttgagggctgctc

SEQ ID NO: 110913 - DNA, 20 bp, human
gtatgtgatacagcaagagt

SEQ ID NO: 110914 - DNA, 20 bp, human
gttttagctatcagcatcac

SEQ ID NO: 110915 - DNA, 20 bp, human
gtgacaaattattgtctcat

SEQ ID NO: 110916 - DNA, 20 bp, human
ggtctgcatggtccgcctag

SEQ ID NO: 110917 - DNA, 20 bp, human
gtgccctatgaacgggataa

SEQ ID NO: 110918 - DNA, 20 bp, human
gaggggatcagctgtacccg

SEQ ID NO: 110919 - DNA, 20 bp, human
gccaaggcagataagaagtg

SEQ ID NO: 110920 - DNA, 20 bp, human
gccatcgcatgccctatgaa

SEQ ID NO: 110921 - DNA, 20 bp, human
gatgatattcccttccccaa

SEQ ID NO: 110922 - DNA, 20 bp, human
gttcccttatcccgttcata

SEQ ID NO: 110923 - DNA, 20 bp, human
gggacacgtgttttaagaca

SEQ ID NO: 110924 - DNA, 20 bp, human
gatatacaacacagaaggtc

SEQ ID NO: 110925 - DNA, 20 bp, human
gcagctgatcccctgccttt

SEQ ID NO: 110926 - DNA, 20 bp, human
gctccgcgggggcagctgga

SEQ ID NO: 110927 - DNA, 20 bp, human
gggagacgggtccccgggat

SEQ ID NO: 110928 - DNA, 20 bp, human
gtagcagggtggtgtgatag

SEQ ID NO: 110929 - DNA, 20 bp, human
ggtgtgatagcggcagcgag

SEQ ID NO: 110930 - DNA, 20 bp, human
gggcagcgaggggctcggag

SEQ ID NO: 110931 - DNA, 20 bp, human
ggctgcagcagggggacaac

SEQ ID NO: 110932 - DNA, 20 bp, human
gtccccggttctgggatccg

SEQ ID NO: 110933 - DNA, 20 bp, human
gtggcgccggtagcgcacct

SEQ ID NO: 110934 - DNA, 20 bp, human
ggcgcaaaccctcttgaatc

SEQ ID NO: 110935 - DNA, 20 bp, human
gcggaagcggtggtttttag

SEQ ID NO: 110936 - DNA, 20 bp, human
ggcaactctgaaggatggta

SEQ ID NO: 110937 - DNA, 20 bp, human
gtccctgcaactctgaagga

SEQ ID NO: 110938 - DNA, 20 bp, human
gttcagagttgcagggaaga

SEQ ID NO: 110939 - DNA, 20 bp, human
gaatttaggtaagagagcaa

SEQ ID NO: 110940 - DNA, 20 bp, human
gctacttttgcctagtggtg

SEQ ID NO: 110941 - DNA, 20 bp, human
gtgactgtaatgcaagaaac

SEQ ID NO: 110942 - DNA, 20 bp, human
gattttaccgggataaattt

SEQ ID NO: 110943 - DNA, 20 bp, human
ggtaatgcaagaaactggtt

SEQ ID NO: 110944 - DNA, 20 bp, human
gttattgtaccctcaccact

SEQ ID NO: 110945 - DNA, 20 bp, human
gtacagtcacactaaatcac

SEQ ID NO: 110946 - DNA, 20 bp, human
gagcgaagagcgttaggctg

SEQ ID NO: 110947 - DNA, 20 bp, human
gtgtcggcgccgccactgtc

SEQ ID NO: 110948 - DNA, 20 bp, human
gtgggtgacctcagacacct

SEQ ID NO: 110949 - DNA, 20 bp, human
gccccagggcggccaggcgg

SEQ ID NO: 110950 - DNA, 20 bp, human
gacgccaaacaccagaaccg

SEQ ID NO: 110951 - DNA, 20 bp, human
gcgggcagccgggccgtcca

SEQ ID NO: 110952 - DNA, 20 bp, human
gccaccgccaggacccgccg

SEQ ID NO: 110953 - DNA, 20 bp, human
ggcgccgcggcgggtcctgg

SEQ ID NO: 110954 - DNA, 20 bp, human
gaacgacagcgaagagcgtt

SEQ ID NO: 110955 - DNA, 20 bp, human
ggcagggcgtctccccatac

SEQ ID NO: 110956 - DNA, 20 bp, human
gtccaccatggtgagtacaa

SEQ ID NO: 110957 - DNA, 20 bp, human
gggagcccttgtactcacca

SEQ ID NO: 110958 - DNA, 20 bp, human
gggtgtccccctcctgaagt

SEQ ID NO: 110959 - DNA, 20 bp, human
ggtgtggaattcttctcggg

SEQ ID NO: 110960 - DNA, 20 bp, human
gggaggtgatgatgccgggt

SEQ ID NO: 110961 - DNA, 20 bp, human
gtacaagcgagggaccacgg

SEQ ID NO: 110962 - DNA, 20 bp, human
ggggactgcccacttcagga

SEQ ID NO: 110963 - DNA, 20 bp, human
gcactacaagcgagggacca

SEQ ID NO: 110964 - DNA, 20 bp, human
gtccaggaggtgatgatgcc

SEQ ID NO: 110965 - DNA, 20 bp, human
gtgttatttgtggcctatcg

SEQ ID NO: 110966 - DNA, 20 bp, human
gaaatgcaggtgtaatcagt

SEQ ID NO: 110967 - DNA, 20 bp, human
gtcgaacatggagaacacgt

SEQ ID NO: 110968 - DNA, 20 bp, human
gaagcaaagaagagagccgg

SEQ ID NO: 110969 - DNA, 20 bp, human
gtccaggaatttaaggaggt

SEQ ID NO: 110970 - DNA, 20 bp, human
gaaagaaggttctccctcgt

SEQ ID NO: 110971 - DNA, 20 bp, human
ggaaggttctccctcgtggg

SEQ ID NO: 110972 - DNA, 20 bp, human
ggtgggtgggatttccatcc

SEQ ID NO: 110973 - DNA, 20 bp, human
gatggaaatcccacccacga

SEQ ID NO: 110974 - DNA, 20 bp, human
gatttgggtctgttcgaaca

SEQ ID NO: 110975 - DNA, 20 bp, human
gatggagaacacgttggagt

SEQ ID NO: 110976 - DNA, 20 bp, human
gtaaggtggagtctagactg

SEQ ID NO: 110977 - DNA, 20 bp, human
gctggtgctgctgagaacta

SEQ ID NO: 110978 - DNA, 20 bp, human
ggggggctgtaagtacagag

SEQ ID NO: 110979 - DNA, 20 bp, human
gctgtacttacagcccccaa

SEQ ID NO: 110980 - DNA, 20 bp, human
gagaatgcagaaagcagggt

SEQ ID NO: 110981 - DNA, 20 bp, human
gccagagtggacctagcaag

SEQ ID NO: 110982 - DNA, 20 bp, human
gccttggcatcatccttctt

SEQ ID NO: 110983 - DNA, 20 bp, human
gccccaaggatgagaagtcc

SEQ ID NO: 110984 - DNA, 20 bp, human
gcaagaggcaggtcaggctc

SEQ ID NO: 110985 - DNA, 20 bp, human
ggctttttgggggccattgg

SEQ ID NO: 110986 - DNA, 20 bp, human
gccgacgcgggagtgtggag

SEQ ID NO: 110987 - DNA, 20 bp, human
ggcgggggccggatgatcaa

SEQ ID NO: 110988 - DNA, 20 bp, human
gcctctagcgcaatgtcccg

SEQ ID NO: 110989 - DNA, 20 bp, human
gagccgccgacgcgggagtg

SEQ ID NO: 110990 - DNA, 20 bp, human
gctagcgcaatgtcccgggg

SEQ ID NO: 110991 - DNA, 20 bp, human
ggccgaggcccggagtctta

SEQ ID NO: 110992 - DNA, 20 bp, human
gaggggacgaggcgagggtg

SEQ ID NO: 110993 - DNA, 20 bp, human
ggaggcccggagtcttacgg

SEQ ID NO: 110994 - DNA, 20 bp, human
gcccgccgccgtaagactcc

SEQ ID NO: 110995 - DNA, 20 bp, human
gcgagggtggggctggacgt

SEQ ID NO: 110996 - DNA, 20 bp, human
gaagcctgagcctaagaagg

SEQ ID NO: 110997 - DNA, 20 bp, human
gcagctaagttgggaatggg

SEQ ID NO: 110998 - DNA, 20 bp, human
gcccatgggactgcgatctg

SEQ ID NO: 110999 - DNA, 20 bp, human
gtcttaggctcaggcttctt

SEQ ID NO: 111000 - DNA, 20 bp, human
gaagaagaaaccgagagacg

SEQ ID NO: 111001 - DNA, 20 bp, human
gggagatgagataggagcct

SEQ ID NO: 111002 - DNA, 20 bp, human
gaccgagagacgtggcgtct

SEQ ID NO: 111003 - DNA, 20 bp, human
gtggactgggatgaggacta

SEQ ID NO: 111004 - DNA, 20 bp, human
gtggaaacccagaaggacca

SEQ ID NO: 111005 - DNA, 20 bp, human
gagatcccaacaagacaaca

SEQ ID NO: 111006 - DNA, 20 bp, human
ggctccagctccgggatgaa

SEQ ID NO: 111007 - DNA, 20 bp, human
ggaagtgatggggcatcctg

SEQ ID NO: 111008 - DNA, 20 bp, human
gcacacggccaggacgcgga

SEQ ID NO: 111009 - DNA, 20 bp, human
gcttcgggacagaagtgatg

SEQ ID NO: 111010 - DNA, 20 bp, human
gcctggagtcgggggaccca

SEQ ID NO: 111011 - DNA, 20 bp, human
gggtgaggaagctccagctc

SEQ ID NO: 111012 - DNA, 20 bp, human
gggcaggtccttctcctaca

SEQ ID NO: 111013 - DNA, 20 bp, human
ggaccgcgcccacccgaggg

SEQ ID NO: 111014 - DNA, 20 bp, human
gtcacttctgtcccgaagag

SEQ ID NO: 111015 - DNA, 20 bp, human
gcagggagcagcctctgttg

SEQ ID NO: 111016 - DNA, 20 bp, human
gcctaagggtgacctcggta

SEQ ID NO: 111017 - DNA, 20 bp, human
gacgagaggcaggaagagac

SEQ ID NO: 111018 - DNA, 20 bp, human
gagggtgtccctctccctaa

SEQ ID NO: 111019 - DNA, 20 bp, human
ggggcaggattggggacgag

SEQ ID NO: 111020 - DNA, 20 bp, human
ggatgacagattaagattag

SEQ ID NO: 111021 - DNA, 20 bp, human
gatggtggggcccaggtctt

SEQ ID NO: 111022 - DNA, 20 bp, human
gttagaggataggtgctggg

SEQ ID NO: 111023 - DNA, 20 bp, human
gccagggggtaatctcatgg

SEQ ID NO: 111024 - DNA, 20 bp, human
gctgcccgtctcccaagacc

SEQ ID NO: 111025 - DNA, 20 bp, human
gggctgggatagaaactcgg

SEQ ID NO: 111026 - DNA, 20 bp, human
gccgcagggtgagtttttgg

SEQ ID NO: 111027 - DNA, 20 bp, human
gccccagacacggaccccgc

SEQ ID NO: 111028 - DNA, 20 bp, human
ggaggatgtgggcgctccta

SEQ ID NO: 111029 - DNA, 20 bp, human
gtgaatactcatggagccat

SEQ ID NO: 111030 - DNA, 20 bp, human
ggttgtggggtgaatactca

SEQ ID NO: 111031 - DNA, 20 bp, human
gagacccagcatcaaccccg

SEQ ID NO: 111032 - DNA, 20 bp, human
gggagagagtccaagttggg

SEQ ID NO: 111033 - DNA, 20 bp, human
gagtattcaccccacaacca

SEQ ID NO: 111034 - DNA, 20 bp, human
gggatttaggtagcattctg

SEQ ID NO: 111035 - DNA, 20 bp, human
ggctgggagagagtccaagt

SEQ ID NO: 111036 - DNA, 20 bp, human
gggtgtgagaggcaaggtca

SEQ ID NO: 111037 - DNA, 20 bp, human
gatctgaggctactgggagt

SEQ ID NO: 111038 - DNA, 20 bp, human
ggcaaggtcagggtagaagg

SEQ ID NO: 111039 - DNA, 20 bp, human
ggtcccccgcaggaggaact

SEQ ID NO: 111040 - DNA, 20 bp, human
gagtccaggtgggtccaggt

SEQ ID NO: 111041 - DNA, 20 bp, human
gaagcaaggcgtgacaaggg

SEQ ID NO: 111042 - DNA, 20 bp, human
gggccaggaagagtccaggt

SEQ ID NO: 111043 - DNA, 20 bp, human
ggatgggatctgaggctact

SEQ ID NO: 111044 - DNA, 20 bp, human
gagggcagtgtgaggagacg

SEQ ID NO: 111045 - DNA, 20 bp, human
gacctgggatgctggagaca

SEQ ID NO: 111046 - DNA, 20 bp, human
ggttccccctggcccagtaa

SEQ ID NO: 111047 - DNA, 20 bp, human
gccgcaccaggtgggatccg

SEQ ID NO: 111048 - DNA, 20 bp, human
gcggggccccggatcccacc

SEQ ID NO: 111049 - DNA, 20 bp, human
gcgccttctccgcaccaggt

SEQ ID NO: 111050 - DNA, 20 bp, human
gccctggccagagtccctgt

SEQ ID NO: 111051 - DNA, 20 bp, human
ggcctgtcctcaagaccccc

SEQ ID NO: 111052 - DNA, 20 bp, human
ggcctggagtccagacccga

SEQ ID NO: 111053 - DNA, 20 bp, human
gtcgctgggtgcgtggaact

SEQ ID NO: 111054 - DNA, 20 bp, human
ggtcttgaggacaggcctaa

SEQ ID NO: 111055 - DNA, 20 bp, human
gctggggagcccgggtacaa

SEQ ID NO: 111056 - DNA, 20 bp, human
gcagctgcccctgtcctccg

SEQ ID NO: 111057 - DNA, 20 bp, human
gggcgccaccgcggaggaca

SEQ ID NO: 111058 - DNA, 20 bp, human
gcctcccggcccctagtagg

SEQ ID NO: 111059 - DNA, 20 bp, human
gctgcccctgtcctccgcgg

SEQ ID NO: 111060 - DNA, 20 bp, human
gctggcgcgccccctactag

SEQ ID NO: 111061 - DNA, 20 bp, human
ggtgcctcccggcccctagt

SEQ ID NO: 111062 - DNA, 20 bp, human
gctggagtgcggcgccaccg

SEQ ID NO: 111063 - DNA, 20 bp, human
gtgtcgcagcgcaggcagtt

SEQ ID NO: 111064 - DNA, 20 bp, human
ggactgcctcaaccaggtga

SEQ ID NO: 111065 - DNA, 20 bp, human
gccagccccggactcggaga

SEQ ID NO: 111066 - DNA, 20 bp, human
ggtgcagcctggcgtcactg

SEQ ID NO: 111067 - DNA, 20 bp, human
gggggtgcggcgaggagtca

SEQ ID NO: 111068 - DNA, 20 bp, human
ggcgaggagtcaggggcgta

SEQ ID NO: 111069 - DNA, 20 bp, human
gcgggaggcacagacggtgg

SEQ ID NO: 111070 - DNA, 20 bp, human
gctggaagtcaaggctccga

SEQ ID NO: 111071 - DNA, 20 bp, human
gctccattaggggagtcggg

SEQ ID NO: 111072 - DNA, 20 bp, human
gggctggaaggaccttcacg

SEQ ID NO: 111073 - DNA, 20 bp, human
gatgtgattccgggaaggta

SEQ ID NO: 111074 - DNA, 20 bp, human
gcgccctgctgccgaccggg

SEQ ID NO: 111075 - DNA, 20 bp, human
gagtcgggaggcacagacgg

SEQ ID NO: 111076 - DNA, 20 bp, human
ggccggctggatctaataga

SEQ ID NO: 111077 - DNA, 20 bp, human
ggtggacactgacctaactg

SEQ ID NO: 111078 - DNA, 20 bp, human
gatccagccggcccaggaaa

SEQ ID NO: 111079 - DNA, 20 bp, human
ggctcctctgtgaagatgag

SEQ ID NO: 111080 - DNA, 20 bp, human
gtcaggtgtgtccagtctgg

SEQ ID NO: 111081 - DNA, 20 bp, human
gtgatgcagaggttccgagg

SEQ ID NO: 111082 - DNA, 20 bp, human
gcccaggaaaaggcttgaca

SEQ ID NO: 111083 - DNA, 20 bp, human
ggactccatgcccctgacag

SEQ ID NO: 111084 - DNA, 20 bp, human
gtcttgagggatccacactg

SEQ ID NO: 111085 - DNA, 20 bp, human
ggtggagcagatccccagtt

SEQ ID NO: 111086 - DNA, 20 bp, human
gccgaggcctgctaactgag

SEQ ID NO: 111087 - DNA, 20 bp, human
gggatgcacctaaacagtca

SEQ ID NO: 111088 - DNA, 20 bp, human
ggctgctcaggagcagtcct

SEQ ID NO: 111089 - DNA, 20 bp, human
gggagcaaagaggggcaacc

SEQ ID NO: 111090 - DNA, 20 bp, human
ggactgggcaggttcctcag

SEQ ID NO: 111091 - DNA, 20 bp, human
gcagtcctgggcagttgtaa

SEQ ID NO: 111092 - DNA, 20 bp, human
gcacacgcctccctacctca

SEQ ID NO: 111093 - DNA, 20 bp, human
gatcaacaggtgccaagctg

SEQ ID NO: 111094 - DNA, 20 bp, human
ggcagtgagacaggaagccg

SEQ ID NO: 111095 - DNA, 20 bp, human
gacctcatggcgacagaaaa

SEQ ID NO: 111096 - DNA, 20 bp, human
gtccgtagctgacagactcc

SEQ ID NO: 111097 - DNA, 20 bp, human
ggccaggagtctgtcagcta

SEQ ID NO: 111098 - DNA, 20 bp, human
gcacacagcccaggccatcg

SEQ ID NO: 111099 - DNA, 20 bp, human
gagggccatgcagcaggatg

SEQ ID NO: 111100 - DNA, 20 bp, human
gctgaagagggcctccagcc

SEQ ID NO: 111101 - DNA, 20 bp, human
gctggttctcactcaggcgg

SEQ ID NO: 111102 - DNA, 20 bp, human
gccaacctccacgatggcct

SEQ ID NO: 111103 - DNA, 20 bp, human
gagcaggatgcggcccagca

SEQ ID NO: 111104 - DNA, 20 bp, human
gcgtggaggttggtgctgcc

SEQ ID NO: 111105 - DNA, 20 bp, human
gaacctccaaggagagtctg

SEQ ID NO: 111106 - DNA, 20 bp, human
gaaacctggaggcagttaag

SEQ ID NO: 111107 - DNA, 20 bp, human
gatctgtgcaagctgccctc

SEQ ID NO: 111108 - DNA, 20 bp, human
gcagacaaacttaaacctgg

SEQ ID NO: 111109 - DNA, 20 bp, human
ggccctctgagcgttctcgt

SEQ ID NO: 111110 - DNA, 20 bp, human
ggccaacgagaacgctcaga

SEQ ID NO: 111111 - DNA, 20 bp, human
gtcgctgtgatgagtcatac

SEQ ID NO: 111112 - DNA, 20 bp, human
gacacagacaaacttaaacc

SEQ ID NO: 111113 - DNA, 20 bp, human
ggactcatcacagcgacagg

SEQ ID NO: 111114 - DNA, 20 bp, human
gatcccttgggacccatgga

SEQ ID NO: 111115 - DNA, 20 bp, human
gtctcccttcctctgctggt

SEQ ID NO: 111116 - DNA, 20 bp, human
ggacaagtgtccactacgag

SEQ ID NO: 111117 - DNA, 20 bp, human
gaaggtaacttagaaaaaag

SEQ ID NO: 111118 - DNA, 20 bp, human
gtttaaacaggggctgaaag

SEQ ID NO: 111119 - DNA, 20 bp, human
gaagatacttcctctcgtag

SEQ ID NO: 111120 - DNA, 20 bp, human
gttgcagatgaaactcaagt

SEQ ID NO: 111121 - DNA, 20 bp, human
ggtaacttagaaaaaagggg

SEQ ID NO: 111122 - DNA, 20 bp, human
ggtatgctctagacttggag

SEQ ID NO: 111123 - DNA, 20 bp, human
gatgaaactcaagttggatc

SEQ ID NO: 111124 - DNA, 20 bp, human
gaactacgactaaaatacta

SEQ ID NO: 111125 - DNA, 20 bp, human
gttcgatgtgatcctatcaa

SEQ ID NO: 111126 - DNA, 20 bp, human
gcctgaggtctaagggatct

SEQ ID NO: 111127 - DNA, 20 bp, human
gcccccggagactgaagaca

SEQ ID NO: 111128 - DNA, 20 bp, human
gaggctgccctgaggtctaa

SEQ ID NO: 111129 - DNA, 20 bp, human
ggtctaagggatctgggcag

SEQ ID NO: 111130 - DNA, 20 bp, human
gagaagcaaggagtcagcat

SEQ ID NO: 111131 - DNA, 20 bp, human
gaccatgtcttcagtctccg

SEQ ID NO: 111132 - DNA, 20 bp, human
gcttcagtctccggggggca

SEQ ID NO: 111133 - DNA, 20 bp, human
gtgtgagttgaatgtctggg

SEQ ID NO: 111134 - DNA, 20 bp, human
ggatggagtacaggaatgaa

SEQ ID NO: 111135 - DNA, 20 bp, human
gccttaggaagatggagtac

SEQ ID NO: 111136 - DNA, 20 bp, human
gagagaaggacagtagaggg

SEQ ID NO: 111137 - DNA, 20 bp, human
ggccaagagaaggacagtag

SEQ ID NO: 111138 - DNA, 20 bp, human
gctgacagggctggaaccca

SEQ ID NO: 111139 - DNA, 20 bp, human
ggaactcctggatctgagtc

SEQ ID NO: 111140 - DNA, 20 bp, human
gccccaggtgggaatattca

SEQ ID NO: 111141 - DNA, 20 bp, human
gatctgagtctggtcgaaca

SEQ ID NO: 111142 - DNA, 20 bp, human
gatccaggagttcaaagagg

SEQ ID NO: 111143 - DNA, 20 bp, human
gttttcagctgggtagactg

SEQ ID NO: 111144 - DNA, 20 bp, human
gtcctggggtagggatgctg

SEQ ID NO: 111145 - DNA, 20 bp, human
gggctcacccatggctgcga

SEQ ID NO: 111146 - DNA, 20 bp, human
gaccgatagcaacccaaggg

SEQ ID NO: 111147 - DNA, 20 bp, human
gctcaccgatagcaacccaa

SEQ ID NO: 111148 - DNA, 20 bp, human
ggacttctgtcaccaggtaa

SEQ ID NO: 111149 - DNA, 20 bp, human
gcaccgtggaaggaagggag

SEQ ID NO: 111150 - DNA, 20 bp, human
gcggtgacgtcctcccaaga

SEQ ID NO: 111151 - DNA, 20 bp, human
gggctctagagagaccggga

SEQ ID NO: 111152 - DNA, 20 bp, human
ggccgcctcgcgtagagagt

SEQ ID NO: 111153 - DNA, 20 bp, human
gctcgcgtagagagtgggaa

SEQ ID NO: 111154 - DNA, 20 bp, human
gcccaggctctagagagacc

SEQ ID NO: 111155 - DNA, 20 bp, human
gtagagcctgggccatcaga

SEQ ID NO: 111156 - DNA, 20 bp, human
gtgacttccgcgagtcggag

SEQ ID NO: 111157 - DNA, 20 bp, human
gggtgagcagtcccgcgccg

SEQ ID NO: 111158 - DNA, 20 bp, human
gtccccgcgcgagcgcttgg

SEQ ID NO: 111159 - DNA, 20 bp, human
ggaccgggcgatggcagcag

SEQ ID NO: 111160 - DNA, 20 bp, human
gtagtcccgcgggcgagagc

SEQ ID NO: 111161 - DNA, 20 bp, human
gcgctgggctgtagtcccgc

SEQ ID NO: 111162 - DNA, 20 bp, human
gagcgctcgcgcggggatcg

SEQ ID NO: 111163 - DNA, 20 bp, human
gagcgggccgcaaagtgagc

SEQ ID NO: 111164 - DNA, 20 bp, human
gccggaggccaggtcggact

SEQ ID NO: 111165 - DNA, 20 bp, human
gtgggctccggaggccaggt

SEQ ID NO: 111166 - DNA, 20 bp, human
gcagccagaggacccccatg

SEQ ID NO: 111167 - DNA, 20 bp, human
gttgagttcacagggtgtca

SEQ ID NO: 111168 - DNA, 20 bp, human
gggaaggccttgagttcaca

SEQ ID NO: 111169 - DNA, 20 bp, human
gcctgcatgccgcctcatgg

SEQ ID NO: 111170 - DNA, 20 bp, human
ggccatgaggccctaagtga

SEQ ID NO: 111171 - DNA, 20 bp, human
ggacagaccccaaggactct

SEQ ID NO: 111172 - DNA, 20 bp, human
gcaggtctggatctaatcca

SEQ ID NO: 111173 - DNA, 20 bp, human
gccccaaggactctaggcta

SEQ ID NO: 111174 - DNA, 20 bp, human
gaggccacagaacgcaggta

SEQ ID NO: 111175 - DNA, 20 bp, human
gtggccagtgacagacccca

SEQ ID NO: 111176 - DNA, 20 bp, human
ggcagaggagagatttccaa

SEQ ID NO: 111177 - DNA, 20 bp, human
gagactttcagtgaaagcag

SEQ ID NO: 111178 - DNA, 20 bp, human
gatgagaggctccaaccaga

SEQ ID NO: 111179 - DNA, 20 bp, human
gttaccacaatgtggatgag

SEQ ID NO: 111180 - DNA, 20 bp, human
gtgacccacttaccacaatg

SEQ ID NO: 111181 - DNA, 20 bp, human
ggagcctctcatccacattg

SEQ ID NO: 111182 - DNA, 20 bp, human
gcgtggaccagaactgcgct

SEQ ID NO: 111183 - DNA, 20 bp, human
gaagtctccgagcgcagttc

SEQ ID NO: 111184 - DNA, 20 bp, human
gaaagtcttcgtgagtgaag

SEQ ID NO: 111185 - DNA, 20 bp, human
gcatccacattgtggtaagt

SEQ ID NO: 111186 - DNA, 20 bp, human
gaagggactctagcaagcac

SEQ ID NO: 111187 - DNA, 20 bp, human
gagacgctgccgttggccaa

SEQ ID NO: 111188 - DNA, 20 bp, human
ggccttctcgcgctcatagt

SEQ ID NO: 111189 - DNA, 20 bp, human
gtggtcgatttccatctcat

SEQ ID NO: 111190 - DNA, 20 bp, human
gtacatagctgaaagcaacc

SEQ ID NO: 111191 - DNA, 20 bp, human
ggcaggaagggttcctgaaa

SEQ ID NO: 111192 - DNA, 20 bp, human
gatttttttatcttactagg

SEQ ID NO: 111193 - DNA, 20 bp, human
ggtcctgtagcatgtccgtg

SEQ ID NO: 111194 - DNA, 20 bp, human
ggcctactatgagcgcgaga

SEQ ID NO: 111195 - DNA, 20 bp, human
gaacctcacggacatgctac

SEQ ID NO: 111196 - DNA, 20 bp, human
ggcggggaagggggaaccac

SEQ ID NO: 111197 - DNA, 20 bp, human
ggtggccggtgagtgccggt

SEQ ID NO: 111198 - DNA, 20 bp, human
gggcagcagaagcggagacg

SEQ ID NO: 111199 - DNA, 20 bp, human
gccgcagctccgggccacct

SEQ ID NO: 111200 - DNA, 20 bp, human
gcatcgtggggcctggacgg

SEQ ID NO: 111201 - DNA, 20 bp, human
gacgcggcatccagcagcct

SEQ ID NO: 111202 - DNA, 20 bp, human
ggctctgctccatccctgac

SEQ ID NO: 111203 - DNA, 20 bp, human
ggatggagcagagcgcagcg

SEQ ID NO: 111204 - DNA, 20 bp, human
ggccgccgaccggcactcac

SEQ ID NO: 111205 - DNA, 20 bp, human
gccccgggcgtcgagctcca

SEQ ID NO: 111206 - DNA, 20 bp, human
gtctaagacgtctccccggg

SEQ ID NO: 111207 - DNA, 20 bp, human
ggtcccttcgcggccacccg

SEQ ID NO: 111208 - DNA, 20 bp, human
gcccaccgagccgggaaagc

SEQ ID NO: 111209 - DNA, 20 bp, human
gctgtctaagacgtctcccc

SEQ ID NO: 111210 - DNA, 20 bp, human
gctccccgggtggccgcgaa

SEQ ID NO: 111211 - DNA, 20 bp, human
ggaagctctcaacaccagaa

SEQ ID NO: 111212 - DNA, 20 bp, human
gaaggggaagggatgtgtgt

SEQ ID NO: 111213 - DNA, 20 bp, human
ggagacgtcttagacagtcg

SEQ ID NO: 111214 - DNA, 20 bp, human
gcagcacgggcaacaggcaa

SEQ ID NO: 111215 - DNA, 20 bp, human
gcgaagggaccccaccgagc

SEQ ID NO: 111216 - DNA, 20 bp, human
gcaggcggcgggaagaacac

SEQ ID NO: 111217 - DNA, 20 bp, human
gccgcccggccagactggaa

SEQ ID NO: 111218 - DNA, 20 bp, human
ggcacgagcgccatgatggg

SEQ ID NO: 111219 - DNA, 20 bp, human
ggcagcggtgaggaagaagt

SEQ ID NO: 111220 - DNA, 20 bp, human
ggctcgtgccagtgtcccgt

SEQ ID NO: 111221 - DNA, 20 bp, human
gctggcacgagcgccatgat

SEQ ID NO: 111222 - DNA, 20 bp, human
gacaggagtgggtagcccac

SEQ ID NO: 111223 - DNA, 20 bp, human
gccggccagactggaaaggc

SEQ ID NO: 111224 - DNA, 20 bp, human
gtgggtagcccacgggacac

SEQ ID NO: 111225 - DNA, 20 bp, human
gtcacggcgaggccctatca

SEQ ID NO: 111226 - DNA, 20 bp, human
gtaactaacttggcagggaa

SEQ ID NO: 111227 - DNA, 20 bp, human
gggcaggactcacccaacac

SEQ ID NO: 111228 - DNA, 20 bp, human
gagtggacactggcaagagg

SEQ ID NO: 111229 - DNA, 20 bp, human
ggctggaagaggcagcaaaa

SEQ ID NO: 111230 - DNA, 20 bp, human
gaggcaagaggccccagatg

SEQ ID NO: 111231 - DNA, 20 bp, human
gtcacccaacactggaacta

SEQ ID NO: 111232 - DNA, 20 bp, human
gcactgtccttggagaatgg

SEQ ID NO: 111233 - DNA, 20 bp, human
ggagaagcagaaggtgggtt

SEQ ID NO: 111234 - DNA, 20 bp, human
gaagagtggacactggcaag

SEQ ID NO: 111235 - DNA, 20 bp, human
gtgcaaggaagctgggaaaa

SEQ ID NO: 111236 - DNA, 20 bp, human
ggtgcaaggtccaaactcta

SEQ ID NO: 111237 - DNA, 20 bp, human
gagcagccatagctgagagt

SEQ ID NO: 111238 - DNA, 20 bp, human
gattctccaactctcagcta

SEQ ID NO: 111239 - DNA, 20 bp, human
gtgcactagcatggaactgt

SEQ ID NO: 111240 - DNA, 20 bp, human
gactgaatagcaccaccccg

SEQ ID NO: 111241 - DNA, 20 bp, human
gggacatctatacacatgtg

SEQ ID NO: 111242 - DNA, 20 bp, human
gtgtattgccttcctcgggg

SEQ ID NO: 111243 - DNA, 20 bp, human
gatctgtattgccttcctcg

SEQ ID NO: 111244 - DNA, 20 bp, human
gggtacttcttatctatcag

SEQ ID NO: 111245 - DNA, 20 bp, human
ggggggagttcaatgaaact

SEQ ID NO: 111246 - DNA, 20 bp, human
gcgcacgggagcctcaaccg

SEQ ID NO: 111247 - DNA, 20 bp, human
ggccgcgtctcccaagagag

SEQ ID NO: 111248 - DNA, 20 bp, human
gcctcaaccgcggcgcgtgg

SEQ ID NO: 111249 - DNA, 20 bp, human
gccagctgcggagtgctcag

SEQ ID NO: 111250 - DNA, 20 bp, human
gtccgcagctgggtgcgcac

SEQ ID NO: 111251 - DNA, 20 bp, human
gctctgcccacaggtacgag

SEQ ID NO: 111252 - DNA, 20 bp, human
ggactccgcagtggcttcgg

SEQ ID NO: 111253 - DNA, 20 bp, human
gggtggtcgtgactccgcag

SEQ ID NO: 111254 - DNA, 20 bp, human
gtcccgtgcgcacccagctg

SEQ ID NO: 111255 - DNA, 20 bp, human
gttctgccaaggctgtcccg

SEQ ID NO: 111256 - DNA, 20 bp, human
ggtgaggacaagcctgggag

SEQ ID NO: 111257 - DNA, 20 bp, human
gccgggcaggatgcgctacc

SEQ ID NO: 111258 - DNA, 20 bp, human
gggcccccggccagaaatct

SEQ ID NO: 111259 - DNA, 20 bp, human
gcgtggtcagaggacaccgg

SEQ ID NO: 111260 - DNA, 20 bp, human
gtggacacccagagtatcca

SEQ ID NO: 111261 - DNA, 20 bp, human
gccccaggctcaccgacgcc

SEQ ID NO: 111262 - DNA, 20 bp, human
gggtgtcctctgaccacgaa

SEQ ID NO: 111263 - DNA, 20 bp, human
ggcgcgggattggagcgggg

SEQ ID NO: 111264 - DNA, 20 bp, human
gtcagagaagaacaaggtgg

SEQ ID NO: 111265 - DNA, 20 bp, human
gaggatgcgctaccgggcgt

SEQ ID NO: 111266 - DNA, 20 bp, human
gccgcgccccgagtacccac

SEQ ID NO: 111267 - DNA, 20 bp, human
gccaggggcggagaacggga

SEQ ID NO: 111268 - DNA, 20 bp, human
gcggcttctccggaacccag

SEQ ID NO: 111269 - DNA, 20 bp, human
gcttctccggaacccagagg

SEQ ID NO: 111270 - DNA, 20 bp, human
gtggcgggcttggggatccg

SEQ ID NO: 111271 - DNA, 20 bp, human
ggcgccccgagtgtgacggg

SEQ ID NO: 111272 - DNA, 20 bp, human
gagcgcgccccgagtgtgac

SEQ ID NO: 111273 - DNA, 20 bp, human
gggccccaggggcggagaac

SEQ ID NO: 111274 - DNA, 20 bp, human
gccccgagtacccaccggcg

SEQ ID NO: 111275 - DNA, 20 bp, human
gcgcgccggaagagccacgc

SEQ ID NO: 111276 - DNA, 20 bp, human
gcgggacaccgagacggaga

SEQ ID NO: 111277 - DNA, 20 bp, human
gaggggccgggacaccgaga

SEQ ID NO: 111278 - DNA, 20 bp, human
gaccgagacggagacggcag

SEQ ID NO: 111279 - DNA, 20 bp, human
gcggctgccgggcgctgtag

SEQ ID NO: 111280 - DNA, 20 bp, human
ggccgctgccgtctccgtct

SEQ ID NO: 111281 - DNA, 20 bp, human
ggggaggagcggaaactgtc

SEQ ID NO: 111282 - DNA, 20 bp, human
gtgaggttggccatgaactc

SEQ ID NO: 111283 - DNA, 20 bp, human
ggctgcgctttcccgagagg

SEQ ID NO: 111284 - DNA, 20 bp, human
gtcatcgcgggcccacggag

SEQ ID NO: 111285 - DNA, 20 bp, human
gcgggagcgcccaagctcca

SEQ ID NO: 111286 - DNA, 20 bp, human
gccggcagcgcgcccaaggt

SEQ ID NO: 111287 - DNA, 20 bp, human
gagactcagccagaggagta

SEQ ID NO: 111288 - DNA, 20 bp, human
gcagaggagtacggattaag

SEQ ID NO: 111289 - DNA, 20 bp, human
gggtccggcgtcctaggacg

SEQ ID NO: 111290 - DNA, 20 bp, human
gggcgtggtgcacccacctt

SEQ ID NO: 111291 - DNA, 20 bp, human
gattaagtggccgaagaaag

SEQ ID NO: 111292 - DNA, 20 bp, human
gggagccaatgggaacccag

SEQ ID NO: 111293 - DNA, 20 bp, human
ggtgctaggtgagggcgaga

SEQ ID NO: 111294 - DNA, 20 bp, human
gcggcgcggccaactcacca

SEQ ID NO: 111295 - DNA, 20 bp, human
gaccgcggcgcgagtcacca

SEQ ID NO: 111296 - DNA, 20 bp, human
gagccgggagtccggtgaac

SEQ ID NO: 111297 - DNA, 20 bp, human
gcacagggagacgagagact

SEQ ID NO: 111298 - DNA, 20 bp, human
gatccctggatccaaggata

SEQ ID NO: 111299 - DNA, 20 bp, human
gtgcccgttcaccggactcc

SEQ ID NO: 111300 - DNA, 20 bp, human
gatggaggtgcaggttcagg

SEQ ID NO: 111301 - DNA, 20 bp, human
ggctcctgaatgggtcgtga

SEQ ID NO: 111302 - DNA, 20 bp, human
gggtggtatccctggatcca

SEQ ID NO: 111303 - DNA, 20 bp, human
gggcatggtggacttctgtg

SEQ ID NO: 111304 - DNA, 20 bp, human
gctcctggaggctcctgaat

SEQ ID NO: 111305 - DNA, 20 bp, human
gcaggttcagggggatcttg

SEQ ID NO: 111306 - DNA, 20 bp, human
ggtcatgccctggccccgtc

SEQ ID NO: 111307 - DNA, 20 bp, human
gacgaggaaggccctgagta

SEQ ID NO: 111308 - DNA, 20 bp, human
ggaagatgcctggactgtgt

SEQ ID NO: 111309 - DNA, 20 bp, human
ggaggcaactgtccctgtca

SEQ ID NO: 111310 - DNA, 20 bp, human
gtttccagccggcaggatgg

SEQ ID NO: 111311 - DNA, 20 bp, human
ggccagggcatgacacttct

SEQ ID NO: 111312 - DNA, 20 bp, human
gtcttggacagatacatacc

SEQ ID NO: 111313 - DNA, 20 bp, human
gcgtcctcgcagagacctga

SEQ ID NO: 111314 - DNA, 20 bp, human
gagggctggcaagtcagcac

SEQ ID NO: 111315 - DNA, 20 bp, human
ggacgcaaggtgggagaccc

SEQ ID NO: 111316 - DNA, 20 bp, human
gactgcccgggacaaggtcg

SEQ ID NO: 111317 - DNA, 20 bp, human
gggtcccgggactagatcta

SEQ ID NO: 111318 - DNA, 20 bp, human
gttgcggaggttgtcgacaa

SEQ ID NO: 111319 - DNA, 20 bp, human
ggatggctgccctcagatcc

SEQ ID NO: 111320 - DNA, 20 bp, human
gtagggtttcagacaatgtc

SEQ ID NO: 111321 - DNA, 20 bp, human
gcaagtgcatggcagcaaga

SEQ ID NO: 111322 - DNA, 20 bp, human
gctcgctgaaacgcttgcgg

SEQ ID NO: 111323 - DNA, 20 bp, human
gacattaaagggagatactg

SEQ ID NO: 111324 - DNA, 20 bp, human
ggaaggggcgctgactgccc

SEQ ID NO: 111325 - DNA, 20 bp, human
gggacctacagtaacagaca

SEQ ID NO: 111326 - DNA, 20 bp, human
gctacgggcgctccctcgag

SEQ ID NO: 111327 - DNA, 20 bp, human
gcgggaagggtgaacctgag

SEQ ID NO: 111328 - DNA, 20 bp, human
gctggatgggagagctcgag

SEQ ID NO: 111329 - DNA, 20 bp, human
ggcgcccccgtaaagaaata

SEQ ID NO: 111330 - DNA, 20 bp, human
ggaactgggccgcctgtaga

SEQ ID NO: 111331 - DNA, 20 bp, human
gggcgggggtgaactcgagg

SEQ ID NO: 111332 - DNA, 20 bp, human
gcccccgtaaagaaataagg

SEQ ID NO: 111333 - DNA, 20 bp, human
gccttcggcccgccctctac

SEQ ID NO: 111334 - DNA, 20 bp, human
ggtgagagaggggactcgag

SEQ ID NO: 111335 - DNA, 20 bp, human
gacgtgtcgggacagcgcag

SEQ ID NO: 111336 - DNA, 20 bp, human
gaaggcaaatgctaactgag

SEQ ID NO: 111337 - DNA, 20 bp, human
gatgctaactgagaggaccc

SEQ ID NO: 111338 - DNA, 20 bp, human
gagggggatgacagccactc

SEQ ID NO: 111339 - DNA, 20 bp, human
gatctgaggctaacacctct

SEQ ID NO: 111340 - DNA, 20 bp, human
gaatccggcttatgagagat

SEQ ID NO: 111341 - DNA, 20 bp, human
gaaaaccagcagaacacttc

SEQ ID NO: 111342 - DNA, 20 bp, human
gacctagatcgaaagtcctt

SEQ ID NO: 111343 - DNA, 20 bp, human
gaccaaaggactttcgatct

SEQ ID NO: 111344 - DNA, 20 bp, human
gtaaaaagcaatactcaaga

SEQ ID NO: 111345 - DNA, 20 bp, human
gagggcagatgcagctgccc

SEQ ID NO: 111346 - DNA, 20 bp, human
gcgccctgctaaatccacat

SEQ ID NO: 111347 - DNA, 20 bp, human
gggtagggccgagggttctg

SEQ ID NO: 111348 - DNA, 20 bp, human
gacgccccccgcctgtgcgg

SEQ ID NO: 111349 - DNA, 20 bp, human
gggagctctacacaaaggta

SEQ ID NO: 111350 - DNA, 20 bp, human
ggcggccgcccgagcggact

SEQ ID NO: 111351 - DNA, 20 bp, human
ggcctgggcggccgcccgag

SEQ ID NO: 111352 - DNA, 20 bp, human
gaggccgcacctcgcctggg

SEQ ID NO: 111353 - DNA, 20 bp, human
gtcgggcgagatggtgaagg

SEQ ID NO: 111354 - DNA, 20 bp, human
ggccgcgctgctcgagctgg

SEQ ID NO: 111355 - DNA, 20 bp, human
gagcgggcttcggagtggaa

SEQ ID NO: 111356 - DNA, 20 bp, human
ggccgccgcggcgggagtaa

SEQ ID NO: 111357 - DNA, 20 bp, human
gggcgctcgcaactcctgtc

SEQ ID NO: 111358 - DNA, 20 bp, human
gagtgacgaggaggacaccg

SEQ ID NO: 111359 - DNA, 20 bp, human
gaccgaagttagggactccg

SEQ ID NO: 111360 - DNA, 20 bp, human
ggtggcgctgcggaacctct

SEQ ID NO: 111361 - DNA, 20 bp, human
gcggcccgggccatgtcggt

SEQ ID NO: 111362 - DNA, 20 bp, human
gggaacctctaggagccggg

SEQ ID NO: 111363 - DNA, 20 bp, human
gtccgaggacagtgacgagg

SEQ ID NO: 111364 - DNA, 20 bp, human
ggccgcggccggctcgctcc

SEQ ID NO: 111365 - DNA, 20 bp, human
gggcgcagctacggccggac

SEQ ID NO: 111366 - DNA, 20 bp, human
gcggcggtctctcctgcgcc

SEQ ID NO: 111367 - DNA, 20 bp, human
gaacgggaacaggaggccgt

SEQ ID NO: 111368 - DNA, 20 bp, human
gacagggcacccaggcgcag

SEQ ID NO: 111369 - DNA, 20 bp, human
gccgcgggtaagccccctcc

SEQ ID NO: 111370 - DNA, 20 bp, human
gagcgagcgtcgcccctcca

SEQ ID NO: 111371 - DNA, 20 bp, human
ggcttacccgcgggcaggga

SEQ ID NO: 111372 - DNA, 20 bp, human
gccgaacgtgcgaggctcgg

SEQ ID NO: 111373 - DNA, 20 bp, human
ggctcctgggagcgctgtgg

SEQ ID NO: 111374 - DNA, 20 bp, human
gaggcgcagcggagccagga

SEQ ID NO: 111375 - DNA, 20 bp, human
gctaggccccgaggccggag

SEQ ID NO: 111376 - DNA, 20 bp, human
ggcggacgggcaccaggaca

SEQ ID NO: 111377 - DNA, 20 bp, human
ggcgcggtgagaagtgatga

SEQ ID NO: 111378 - DNA, 20 bp, human
gagccagggaagaaacacaa

SEQ ID NO: 111379 - DNA, 20 bp, human
gggtgatgagaacccatgaa

SEQ ID NO: 111380 - DNA, 20 bp, human
ggagtgtccaagtccgagtt

SEQ ID NO: 111381 - DNA, 20 bp, human
ggtgatgagggccagtgaag

SEQ ID NO: 111382 - DNA, 20 bp, human
ggccagggaacgcgagaccc

SEQ ID NO: 111383 - DNA, 20 bp, human
ggctcggacagatcccgagt

SEQ ID NO: 111384 - DNA, 20 bp, human
ggcgtcgtcgccctcttcac

SEQ ID NO: 111385 - DNA, 20 bp, human
gaagagggcgacgacgcgga

SEQ ID NO: 111386 - DNA, 20 bp, human
gctggcaggtcactgagagt

SEQ ID NO: 111387 - DNA, 20 bp, human
gacagagagacggcgaggaa

SEQ ID NO: 111388 - DNA, 20 bp, human
gctgggccccaggtaaggat

SEQ ID NO: 111389 - DNA, 20 bp, human
gcacacacagagagacggcg

SEQ ID NO: 111390 - DNA, 20 bp, human
gccaggagcaagtggctgtg

SEQ ID NO: 111391 - DNA, 20 bp, human
gtggcaggaagcccagtccc

SEQ ID NO: 111392 - DNA, 20 bp, human
gggcagcccatccttacctg

SEQ ID NO: 111393 - DNA, 20 bp, human
gtcgggacagtttcattcag

SEQ ID NO: 111394 - DNA, 20 bp, human
gtcgttctaggcgtccctct

SEQ ID NO: 111395 - DNA, 20 bp, human
gggacgcctagaacgagact

SEQ ID NO: 111396 - DNA, 20 bp, human
gcgggtgtgtcagggagtaa

SEQ ID NO: 111397 - DNA, 20 bp, human
gtgggactccgggtgtgtca

SEQ ID NO: 111398 - DNA, 20 bp, human
gaggccctctagctgtgagg

SEQ ID NO: 111399 - DNA, 20 bp, human
gcagctagagggcctcactg

SEQ ID NO: 111400 - DNA, 20 bp, human
gcaggaaaggaggcaatgtt

SEQ ID NO: 111401 - DNA, 20 bp, human
gtagctgtgaggaggcttca

SEQ ID NO: 111402 - DNA, 20 bp, human
gtctggcaggggctcatcat

SEQ ID NO: 111403 - DNA, 20 bp, human
ggaggcaatgttgggactcc

SEQ ID NO: 111404 - DNA, 20 bp, human
gggcctcactgtggaatcat

SEQ ID NO: 111405 - DNA, 20 bp, human
gtgggcaccctgaaagagcc

SEQ ID NO: 111406 - DNA, 20 bp, human
ggcgcgaccgaagcggataa

SEQ ID NO: 111407 - DNA, 20 bp, human
gccgaagcggataagggacg

SEQ ID NO: 111408 - DNA, 20 bp, human
gcttgggcgggtcttacctc

SEQ ID NO: 111409 - DNA, 20 bp, human
gcagcccggactgcgagagg

SEQ ID NO: 111410 - DNA, 20 bp, human
gcatctccggtcctaccctg

SEQ ID NO: 111411 - DNA, 20 bp, human
ggggcggagtctctctgaca

SEQ ID NO: 111412 - DNA, 20 bp, human
gaatagcgaggctgagacgt

SEQ ID NO: 111413 - DNA, 20 bp, human
gcgaccggagccaaatagcg

SEQ ID NO: 111414 - DNA, 20 bp, human
gggacagcccggactgcgag

SEQ ID NO: 111415 - DNA, 20 bp, human
gaagcggataagggacgcgg

SEQ ID NO: 111416 - DNA, 20 bp, human
ggctcgaagcctgcctttgg

SEQ ID NO: 111417 - DNA, 20 bp, human
gggtggaagcgagacggtga

SEQ ID NO: 111418 - DNA, 20 bp, human
gggcggagcggctcgagcag

SEQ ID NO: 111419 - DNA, 20 bp, human
gcggggacccggcccgggac

SEQ ID NO: 111420 - DNA, 20 bp, human
ggggctggcaggcggtcgtc

SEQ ID NO: 111421 - DNA, 20 bp, human
gtggcaggcggtcgtccggc

SEQ ID NO: 111422 - DNA, 20 bp, human
ggagcggctcgagcagcggc

SEQ ID NO: 111423 - DNA, 20 bp, human
gcgcaggaaacggcgttgtg

SEQ ID NO: 111424 - DNA, 20 bp, human
gggcttaagtggtaattggg

SEQ ID NO: 111425 - DNA, 20 bp, human
gaggaaacggcgttgtgggg

SEQ ID NO: 111426 - DNA, 20 bp, human
gggcttggtgaggcttcctc

SEQ ID NO: 111427 - DNA, 20 bp, human
gtaggcagtctccaactctc

SEQ ID NO: 111428 - DNA, 20 bp, human
ggaacctcattgcagaggct

SEQ ID NO: 111429 - DNA, 20 bp, human
gggaaggccaatgaccagag

SEQ ID NO: 111430 - DNA, 20 bp, human
gtcaccaagcctctgcaatg

SEQ ID NO: 111431 - DNA, 20 bp, human
gggccacactgaaggtatac

SEQ ID NO: 111432 - DNA, 20 bp, human
gcaaggtcaattggtggagg

SEQ ID NO: 111433 - DNA, 20 bp, human
gataaacctctctggagctc

SEQ ID NO: 111434 - DNA, 20 bp, human
ggtccaaggtcaattggtgg

SEQ ID NO: 111435 - DNA, 20 bp, human
ggctcgggcatgagccagca

SEQ ID NO: 111436 - DNA, 20 bp, human
gcccctgggtaggagtacag

SEQ ID NO: 111437 - DNA, 20 bp, human
gtgctcctggccaacctccg

SEQ ID NO: 111438 - DNA, 20 bp, human
gaggagcagcgcggcatccc

SEQ ID NO: 111439 - DNA, 20 bp, human
gacatcagacaggaacgcct

SEQ ID NO: 111440 - DNA, 20 bp, human
gaacaaagttgaggtagacc

SEQ ID NO: 111441 - DNA, 20 bp, human
gtggccaacctccgaggagg

SEQ ID NO: 111442 - DNA, 20 bp, human
ggcagcctatgacatcagac

SEQ ID NO: 111443 - DNA, 20 bp, human
gtccgtgagctcccctgggt

SEQ ID NO: 111444 - DNA, 20 bp, human
ggagcaagttcagatcaggt

SEQ ID NO: 111445 - DNA, 20 bp, human
gccacccaaagcacttacaa

SEQ ID NO: 111446 - DNA, 20 bp, human
gcgccttgcaggcccacagt

SEQ ID NO: 111447 - DNA, 20 bp, human
ggcgcctggcgagaagctag

SEQ ID NO: 111448 - DNA, 20 bp, human
gttgtggttaaggaaagcgg

SEQ ID NO: 111449 - DNA, 20 bp, human
gtacagccggggctcccgag

SEQ ID NO: 111450 - DNA, 20 bp, human
gcaggccggacaggagaggg

SEQ ID NO: 111451 - DNA, 20 bp, human
ggagcagagagagccgtcgg

SEQ ID NO: 111452 - DNA, 20 bp, human
gcaacccaagcggcagagag

SEQ ID NO: 111453 - DNA, 20 bp, human
gaaatcaggccggacaggag

SEQ ID NO: 111454 - DNA, 20 bp, human
gccgcgccaccgccaggata

SEQ ID NO: 111455 - DNA, 20 bp, human
gacccgcgcctgatgcacgt

SEQ ID NO: 111456 - DNA, 20 bp, human
ggcaaacgaagtggagacta

SEQ ID NO: 111457 - DNA, 20 bp, human
gactagggcgctggagctcc

SEQ ID NO: 111458 - DNA, 20 bp, human
ggagaacttctctcccaggg

SEQ ID NO: 111459 - DNA, 20 bp, human
gctccagggcttgagactca

SEQ ID NO: 111460 - DNA, 20 bp, human
ggaagttctctcccagtgaa

SEQ ID NO: 111461 - DNA, 20 bp, human
gctccgggtcgcaccgccct

SEQ ID NO: 111462 - DNA, 20 bp, human
ggagaaatcctcccttcact

SEQ ID NO: 111463 - DNA, 20 bp, human
ggaagggaggatttctccca

SEQ ID NO: 111464 - DNA, 20 bp, human
ggaagtggagactagggcgc

SEQ ID NO: 111465 - DNA, 20 bp, human
ggaggatttctcccagggca

SEQ ID NO: 111466 - DNA, 20 bp, human
gaggcgctcgatgtactgga

SEQ ID NO: 111467 - DNA, 20 bp, human
gggttcctggtagaagtagg

SEQ ID NO: 111468 - DNA, 20 bp, human
gcctgctcaaccccaaccag

SEQ ID NO: 111469 - DNA, 20 bp, human
gcggggttcctggtagaagt

SEQ ID NO: 111470 - DNA, 20 bp, human
gagctccatggggtcggaaa

SEQ ID NO: 111471 - DNA, 20 bp, human
gtgtctcatacagctccatg

SEQ ID NO: 111472 - DNA, 20 bp, human
gctggaggcgctcgatgtac

SEQ ID NO: 111473 - DNA, 20 bp, human
gggacccccgagcactgtcc

SEQ ID NO: 111474 - DNA, 20 bp, human
gagggccccttgaggacaag

SEQ ID NO: 111475 - DNA, 20 bp, human
gtggcctggacagtgctcgg

SEQ ID NO: 111476 - DNA, 20 bp, human
ggtttccaaaggagtaatgg

SEQ ID NO: 111477 - DNA, 20 bp, human
gactggtaagtgtgacactg

SEQ ID NO: 111478 - DNA, 20 bp, human
gccagtttccaaaggagtaa

SEQ ID NO: 111479 - DNA, 20 bp, human
gtccaaaggagtaatggtgg

SEQ ID NO: 111480 - DNA, 20 bp, human
gtggtggaaatgttccgatg

SEQ ID NO: 111481 - DNA, 20 bp, human
gagagctgtgccagcccgac

SEQ ID NO: 111482 - DNA, 20 bp, human
ggaacagccgggtgccagtc

SEQ ID NO: 111483 - DNA, 20 bp, human
gagcattgtatggcacatgc

SEQ ID NO: 111484 - DNA, 20 bp, human
ggagggaaaccagaacagcc

SEQ ID NO: 111485 - DNA, 20 bp, human
gcacacttaccagtttccaa

SEQ ID NO: 111486 - DNA, 20 bp, human
gcccacactccagccgagga

SEQ ID NO: 111487 - DNA, 20 bp, human
gcagggggccccccagtcag

SEQ ID NO: 111488 - DNA, 20 bp, human
gtggggccacgatgagacca

SEQ ID NO: 111489 - DNA, 20 bp, human
gcagaccttaaacgggaggg

SEQ ID NO: 111490 - DNA, 20 bp, human
gcggcacttagcaaagacca

SEQ ID NO: 111491 - DNA, 20 bp, human
gcctcagaccttaaacggga

SEQ ID NO: 111492 - DNA, 20 bp, human
ggaaacgaaagcctcccccg

SEQ ID NO: 111493 - DNA, 20 bp, human
gcacgccgcagggtgctaaa

SEQ ID NO: 111494 - DNA, 20 bp, human
ggacatcagtccactgactg

SEQ ID NO: 111495 - DNA, 20 bp, human
ggtctcatcgtggccccagg

SEQ ID NO: 111496 - DNA, 20 bp, human
gaagagaacaaggaccctct

SEQ ID NO: 111497 - DNA, 20 bp, human
gtccccagagactcctaagt

SEQ ID NO: 111498 - DNA, 20 bp, human
gtgcccacttaggagtctct

SEQ ID NO: 111499 - DNA, 20 bp, human
gcacacagaacagtgggatg

SEQ ID NO: 111500 - DNA, 20 bp, human
gcgggagaagaatgcgatcc

SEQ ID NO: 111501 - DNA, 20 bp, human
gcacagatatcactccccag

SEQ ID NO: 111502 - DNA, 20 bp, human
gcttatcgctgctccatcac

SEQ ID NO: 111503 - DNA, 20 bp, human
gttaagacggtgcagtctcc

SEQ ID NO: 111504 - DNA, 20 bp, human
gcagctccgctctaagttcg

SEQ ID NO: 111505 - DNA, 20 bp, human
gcccccaccctgatttctgg

SEQ ID NO: 111506 - DNA, 20 bp, human
ggaggaggccgtcagagcca

SEQ ID NO: 111507 - DNA, 20 bp, human
ggcccagcctagccctctgg

SEQ ID NO: 111508 - DNA, 20 bp, human
gactcaccaagacagctcgg

SEQ ID NO: 111509 - DNA, 20 bp, human
gatcaggttggagcctccag

SEQ ID NO: 111510 - DNA, 20 bp, human
gagcgccgcggactacgccc

SEQ ID NO: 111511 - DNA, 20 bp, human
gactgggggccctgggaaca

SEQ ID NO: 111512 - DNA, 20 bp, human
ggctgccagggcgtagtccg

SEQ ID NO: 111513 - DNA, 20 bp, human
gaagcacattcagggtcggg

SEQ ID NO: 111514 - DNA, 20 bp, human
ggcagcagccctggctctga

SEQ ID NO: 111515 - DNA, 20 bp, human
ggtccctccccccatcaggt

SEQ ID NO: 111516 - DNA, 20 bp, human
ggacttacccgtagttccag

SEQ ID NO: 111517 - DNA, 20 bp, human
gggtttaacccactattgaa

SEQ ID NO: 111518 - DNA, 20 bp, human
gccctcacagactaatctag

SEQ ID NO: 111519 - DNA, 20 bp, human
gaaacccagctggcaccctc

SEQ ID NO: 111520 - DNA, 20 bp, human
gtaacccactattgaaggga

SEQ ID NO: 111521 - DNA, 20 bp, human
ggttccagagggtgccagct

SEQ ID NO: 111522 - DNA, 20 bp, human
gctggcaccctctggaacta

SEQ ID NO: 111523 - DNA, 20 bp, human
ggccactagattagtctgtg

SEQ ID NO: 111524 - DNA, 20 bp, human
gttgcacagaagactgatag

SEQ ID NO: 111525 - DNA, 20 bp, human
gtcttccttcccttcaatag

SEQ ID NO: 111526 - DNA, 20 bp, human
ggatagagctggagacttac

SEQ ID NO: 111527 - DNA, 20 bp, human
gggagacttaccggctgctc

SEQ ID NO: 111528 - DNA, 20 bp, human
gagcagtggggaattgaggt

SEQ ID NO: 111529 - DNA, 20 bp, human
gttaccggctgctcgggcag

SEQ ID NO: 111530 - DNA, 20 bp, human
gtccaaagctgctggacccc

SEQ ID NO: 111531 - DNA, 20 bp, human
gtgaccggagaacacgagct

SEQ ID NO: 111532 - DNA, 20 bp, human
gtagtaataggatctggcaa

SEQ ID NO: 111533 - DNA, 20 bp, human
gacacagaagtcaacacagt

SEQ ID NO: 111534 - DNA, 20 bp, human
gataggatctggcaatggaa

SEQ ID NO: 111535 - DNA, 20 bp, human
gggggcagaaacatagtaat

SEQ ID NO: 111536 - DNA, 20 bp, human
gtctggagatggactatgga

SEQ ID NO: 111537 - DNA, 20 bp, human
gccccagtttgagtcagagt

SEQ ID NO: 111538 - DNA, 20 bp, human
gccatgctgtcccaggttca

SEQ ID NO: 111539 - DNA, 20 bp, human
gaatactgtggagaaaagag

SEQ ID NO: 111540 - DNA, 20 bp, human
gccctactctgactcaaact

SEQ ID NO: 111541 - DNA, 20 bp, human
gggatggcacttgggcctga

SEQ ID NO: 111542 - DNA, 20 bp, human
ggatgaatcccagtttgtgg

SEQ ID NO: 111543 - DNA, 20 bp, human
gggtttttatccttgaacct

SEQ ID NO: 111544 - DNA, 20 bp, human
gagactaaaccagaattctt

SEQ ID NO: 111545 - DNA, 20 bp, human
gagagttgtgactcataaat

SEQ ID NO: 111546 - DNA, 20 bp, human
gcgtccctgtaggcagtcag

SEQ ID NO: 111547 - DNA, 20 bp, human
gtcagcggtcagcagtcagt

SEQ ID NO: 111548 - DNA, 20 bp, human
gagttgcgtggcgtccctgt

SEQ ID NO: 111549 - DNA, 20 bp, human
gcgggaagctgagagttgcg

SEQ ID NO: 111550 - DNA, 20 bp, human
ggagaggatgggaccacaat

SEQ ID NO: 111551 - DNA, 20 bp, human
gactctcagcttcccgacag

SEQ ID NO: 111552 - DNA, 20 bp, human
ggggagcttggggaactcag

SEQ ID NO: 111553 - DNA, 20 bp, human
gcaagattaacacctctgtc

SEQ ID NO: 111554 - DNA, 20 bp, human
ggggccctgcagtggatcta

SEQ ID NO: 111555 - DNA, 20 bp, human
gggatgggaccacaataggc

SEQ ID NO: 111556 - DNA, 20 bp, human
gagttttctcctgtccaatc

SEQ ID NO: 111557 - DNA, 20 bp, human
gagcaaagggattccatagc

SEQ ID NO: 111558 - DNA, 20 bp, human
gtgtgagctgacaaatgctc

SEQ ID NO: 111559 - DNA, 20 bp, human
gtagccgtccatagagagtg

SEQ ID NO: 111560 - DNA, 20 bp, human
gacaaatgctctggctccgg

SEQ ID NO: 111561 - DNA, 20 bp, human
ggccatcttcactgaaacta

SEQ ID NO: 111562 - DNA, 20 bp, human
gagatgaggatgtccaatcc

SEQ ID NO: 111563 - DNA, 20 bp, human
ggacatgttgcatatctcat

SEQ ID NO: 111564 - DNA, 20 bp, human
ggaagatggctgtaagaagc

SEQ ID NO: 111565 - DNA, 20 bp, human
gaccttagtttcagtgaaga

SEQ ID NO: 111566 - DNA, 20 bp, human
ggatcctggttgattgatat

SEQ ID NO: 111567 - DNA, 20 bp, human
gcaagttaggcagtgagatt

SEQ ID NO: 111568 - DNA, 20 bp, human
gatttgtggttacctgtctc

SEQ ID NO: 111569 - DNA, 20 bp, human
gtttcaaaaatacggcatag

SEQ ID NO: 111570 - DNA, 20 bp, human
gatccaaaacaatagatggg

SEQ ID NO: 111571 - DNA, 20 bp, human
gactatccaaaacaatagat

SEQ ID NO: 111572 - DNA, 20 bp, human
gtctctgtttttcaaaaata

SEQ ID NO: 111573 - DNA, 20 bp, human
gcaaaacaatagatgggtgg

SEQ ID NO: 111574 - DNA, 20 bp, human
gattcctatatcaatcaacc

SEQ ID NO: 111575 - DNA, 20 bp, human
gataaaagatcttatataaa

SEQ ID NO: 111576 - DNA, 20 bp, human
gcgggccacgggtcactcac

SEQ ID NO: 111577 - DNA, 20 bp, human
gccgagccctgacccaccgg

SEQ ID NO: 111578 - DNA, 20 bp, human
gcgcagccgccggtgggtca

SEQ ID NO: 111579 - DNA, 20 bp, human
gggagccggtgagtgacccg

SEQ ID NO: 111580 - DNA, 20 bp, human
gtgcaggagttagagaatgg

SEQ ID NO: 111581 - DNA, 20 bp, human
gtgcatctaagacccccccg

SEQ ID NO: 111582 - DNA, 20 bp, human
gagcgaaggtcgcggagggt

SEQ ID NO: 111583 - DNA, 20 bp, human
gggagagcgaaggtcgcgga

SEQ ID NO: 111584 - DNA, 20 bp, human
ggcagggagagcgaaggtcg

SEQ ID NO: 111585 - DNA, 20 bp, human
gggagggtggggaccgagtc

SEQ ID NO: 111586 - DNA, 20 bp, human
ggcggcccgcgcgacagtcc

SEQ ID NO: 111587 - DNA, 20 bp, human
gggagggtcccagccagagg

SEQ ID NO: 111588 - DNA, 20 bp, human
gcgggtcctggaaggctcaa

SEQ ID NO: 111589 - DNA, 20 bp, human
gccgtagccggagcccagcc

SEQ ID NO: 111590 - DNA, 20 bp, human
ggacagtcccggctgggctc

SEQ ID NO: 111591 - DNA, 20 bp, human
ggaaagttccgggtcctgga

SEQ ID NO: 111592 - DNA, 20 bp, human
gctgatctccccgggaactg

SEQ ID NO: 111593 - DNA, 20 bp, human
gccagccgggactgtcgcgc

SEQ ID NO: 111594 - DNA, 20 bp, human
gaaggagtccggacctggaa

SEQ ID NO: 111595 - DNA, 20 bp, human
ggctcaaaggagtccggacc

SEQ ID NO: 111596 - DNA, 20 bp, human
gaccgggccatggtataagg

SEQ ID NO: 111597 - DNA, 20 bp, human
gcccaccgggcaggatgcac

SEQ ID NO: 111598 - DNA, 20 bp, human
gcaaggcagcccagatcggc

SEQ ID NO: 111599 - DNA, 20 bp, human
gtgtcccccagaaagcaggt

SEQ ID NO: 111600 - DNA, 20 bp, human
ggccctgtgcccgccgatct

SEQ ID NO: 111601 - DNA, 20 bp, human
ggaagccagtgcatcctgcc

SEQ ID NO: 111602 - DNA, 20 bp, human
gctgctggccctagattcta

SEQ ID NO: 111603 - DNA, 20 bp, human
gccagcaggtaaccgggcca

SEQ ID NO: 111604 - DNA, 20 bp, human
gtgaatggccgagcctggaa

SEQ ID NO: 111605 - DNA, 20 bp, human
gacacccacctgctttctgg

SEQ ID NO: 111606 - DNA, 20 bp, human
gaaagctggcccggctaaag

SEQ ID NO: 111607 - DNA, 20 bp, human
ggctaaagcggctcagtagt

SEQ ID NO: 111608 - DNA, 20 bp, human
gcttcattatcagaaagtag

SEQ ID NO: 111609 - DNA, 20 bp, human
gaaactaactaacaaccttg

SEQ ID NO: 111610 - DNA, 20 bp, human
gctgattgtgcttgcttcac

SEQ ID NO: 111611 - DNA, 20 bp, human
gctcttctattctttcctca

SEQ ID NO: 111612 - DNA, 20 bp, human
gggattgccatagaaatttg

SEQ ID NO: 111613 - DNA, 20 bp, human
gagaataagatcaatctaaa

SEQ ID NO: 111614 - DNA, 20 bp, human
gaatagaagagttagaaata

SEQ ID NO: 111615 - DNA, 20 bp, human
gatggaacagaaagctggcc

SEQ ID NO: 111616 - DNA, 20 bp, human
ggaacccgggaaccgacagg

SEQ ID NO: 111617 - DNA, 20 bp, human
gcgggaacccgggaaccgac

SEQ ID NO: 111618 - DNA, 20 bp, human
gcccgggaaccgacaggagg

SEQ ID NO: 111619 - DNA, 20 bp, human
ggcccctcgcccctccgcag

SEQ ID NO: 111620 - DNA, 20 bp, human
gctgcgctcccgcctcctgt

SEQ ID NO: 111621 - DNA, 20 bp, human
gccagtcagcctctgcggag

SEQ ID NO: 111622 - DNA, 20 bp, human
gggctgactggccgcgccta

SEQ ID NO: 111623 - DNA, 20 bp, human
gtccggacgcgcacagggtg

SEQ ID NO: 111624 - DNA, 20 bp, human
gggcggacggtactcacggg

SEQ ID NO: 111625 - DNA, 20 bp, human
gccgcgaccggggtcatcga

SEQ ID NO: 111626 - DNA, 20 bp, human
gggcggatgtggatatcgaa

SEQ ID NO: 111627 - DNA, 20 bp, human
gcagggtgaggcttagagac

SEQ ID NO: 111628 - DNA, 20 bp, human
gatcatggcggctgaagagg

SEQ ID NO: 111629 - DNA, 20 bp, human
gacggggtcaggtcccatca

SEQ ID NO: 111630 - DNA, 20 bp, human
gcccatcatggcggctgaag

SEQ ID NO: 111631 - DNA, 20 bp, human
ggcggctgaagaggcggatg

SEQ ID NO: 111632 - DNA, 20 bp, human
gcggctacggacgagacctg

SEQ ID NO: 111633 - DNA, 20 bp, human
gatcgaaggggacgtggtag

SEQ ID NO: 111634 - DNA, 20 bp, human
gatctctcgggaggacggac

SEQ ID NO: 111635 - DNA, 20 bp, human
gtcgtctcgcgggatctctc

SEQ ID NO: 111636 - DNA, 20 bp, human
ggaactcctaagccagctaa

SEQ ID NO: 111637 - DNA, 20 bp, human
gtagcagcggtggcacgggc

SEQ ID NO: 111638 - DNA, 20 bp, human
gaaactgctctggaggacgg

SEQ ID NO: 111639 - DNA, 20 bp, human
gtcattagcagcggtggcac

SEQ ID NO: 111640 - DNA, 20 bp, human
gtgactgctctcattagcag

SEQ ID NO: 111641 - DNA, 20 bp, human
gctgctctcattagcagcgg

SEQ ID NO: 111642 - DNA, 20 bp, human
gtaggagttcgcacactaag

SEQ ID NO: 111643 - DNA, 20 bp, human
gcgtacagcggtcacatgtg

SEQ ID NO: 111644 - DNA, 20 bp, human
gcatgtgaccgctgtacggg

SEQ ID NO: 111645 - DNA, 20 bp, human
gatgggtagcgtatttacaa

SEQ ID NO: 111646 - DNA, 20 bp, human
ggtgcttcaacaagactgca

SEQ ID NO: 111647 - DNA, 20 bp, human
gacaatgagcaaaaaacccg

SEQ ID NO: 111648 - DNA, 20 bp, human
gtgaaatgttcctggactgg

SEQ ID NO: 111649 - DNA, 20 bp, human
gtttaaaaaggagcagacaa

SEQ ID NO: 111650 - DNA, 20 bp, human
gagtcttgttgaagcacccc

SEQ ID NO: 111651 - DNA, 20 bp, human
gggctcaaaatacacagaca

SEQ ID NO: 111652 - DNA, 20 bp, human
ggataggctcgcaggcctca

SEQ ID NO: 111653 - DNA, 20 bp, human
ggaagtcaaacagatccctg

SEQ ID NO: 111654 - DNA, 20 bp, human
ggtgttttaccgtagctcaa

SEQ ID NO: 111655 - DNA, 20 bp, human
gattacaaagcctccagtcc

SEQ ID NO: 111656 - DNA, 20 bp, human
gcccaccagctggtaggaga

SEQ ID NO: 111657 - DNA, 20 bp, human
gggaaggagaggaaatctct

SEQ ID NO: 111658 - DNA, 20 bp, human
gctgcaccgcgaaggcccgg

SEQ ID NO: 111659 - DNA, 20 bp, human
gccctagtcccctctagagg

SEQ ID NO: 111660 - DNA, 20 bp, human
gccgggcagaataagcgtgc

SEQ ID NO: 111661 - DNA, 20 bp, human
gctcccgcttgaggtttcag

SEQ ID NO: 111662 - DNA, 20 bp, human
gggagcgcagcatcccgcag

SEQ ID NO: 111663 - DNA, 20 bp, human
ggggcgacgcgggacggcgc

SEQ ID NO: 111664 - DNA, 20 bp, human
gggagggtcactgccagagc

SEQ ID NO: 111665 - DNA, 20 bp, human
gggccccctgaaacctcaag

SEQ ID NO: 111666 - DNA, 20 bp, human
ggcctaacagcagacaatct

SEQ ID NO: 111667 - DNA, 20 bp, human
gcgcaggtgagcgggcatgt

SEQ ID NO: 111668 - DNA, 20 bp, human
ggacaagtgagtgattccct

SEQ ID NO: 111669 - DNA, 20 bp, human
gggagtccggactcaaggat

SEQ ID NO: 111670 - DNA, 20 bp, human
gcttgctgaactggctcctg

SEQ ID NO: 111671 - DNA, 20 bp, human
gtgcagagctgtggcttacc

SEQ ID NO: 111672 - DNA, 20 bp, human
gctggggtctcaaaatactg

SEQ ID NO: 111673 - DNA, 20 bp, human
ggtgacagcctcatggcccc

SEQ ID NO: 111674 - DNA, 20 bp, human
gaggccggtggtggaatgtg

SEQ ID NO: 111675 - DNA, 20 bp, human
gcggtggtggaatgtgaggt

SEQ ID NO: 111676 - DNA, 20 bp, human
gacgacgcctaggcaaccgg

SEQ ID NO: 111677 - DNA, 20 bp, human
gcgcccagggctagagcgag

SEQ ID NO: 111678 - DNA, 20 bp, human
gccgcctcgaatccgtgcgt

SEQ ID NO: 111679 - DNA, 20 bp, human
ggtccttgcgggagcgccca

SEQ ID NO: 111680 - DNA, 20 bp, human
gaagcgcggggaacgaatcc

SEQ ID NO: 111681 - DNA, 20 bp, human
ggattcgaggcggggagcat

SEQ ID NO: 111682 - DNA, 20 bp, human
ggcatgcgcgatctggtagg

SEQ ID NO: 111683 - DNA, 20 bp, human
gcctgggagacgtagtccag

SEQ ID NO: 111684 - DNA, 20 bp, human
ggcctctcaggtacaacaga

SEQ ID NO: 111685 - DNA, 20 bp, human
gcgctccagggtgccaaggt

SEQ ID NO: 111686 - DNA, 20 bp, human
ggattgcctcggagagagga

SEQ ID NO: 111687 - DNA, 20 bp, human
ggaagggcctgacccggaac

SEQ ID NO: 111688 - DNA, 20 bp, human
gccatggctaaggccgaggg

SEQ ID NO: 111689 - DNA, 20 bp, human
gtagccatggcgagtagcag

SEQ ID NO: 111690 - DNA, 20 bp, human
gctgggatgcgggatagagg

SEQ ID NO: 111691 - DNA, 20 bp, human
gctacccgcccgatctcctg

SEQ ID NO: 111692 - DNA, 20 bp, human
gagggaacgggtgtactggg

SEQ ID NO: 111693 - DNA, 20 bp, human
ggcaccgctgctactcgcca

SEQ ID NO: 111694 - DNA, 20 bp, human
gtcaccgcaggagatcgggc

SEQ ID NO: 111695 - DNA, 20 bp, human
gtcgccatggctaaggccga

SEQ ID NO: 111696 - DNA, 20 bp, human
gcggcgggcctcgcggatgg

SEQ ID NO: 111697 - DNA, 20 bp, human
gatccgcgaggcccgccgaa

SEQ ID NO: 111698 - DNA, 20 bp, human
gagcagaggtcgggggtgtc

SEQ ID NO: 111699 - DNA, 20 bp, human
gttggagcccaacagttagt

SEQ ID NO: 111700 - DNA, 20 bp, human
ggcggtgggcgcatccgcta

SEQ ID NO: 111701 - DNA, 20 bp, human
gggctccaatgacgccgagg

SEQ ID NO: 111702 - DNA, 20 bp, human
gtgagcggcgcgctaggcgt

SEQ ID NO: 111703 - DNA, 20 bp, human
ggaccaatgcaagtctatca

SEQ ID NO: 111704 - DNA, 20 bp, human
ggccgcctcctcggcgtcat

SEQ ID NO: 111705 - DNA, 20 bp, human
gcggggcggggcgcaccttt

SEQ ID NO: 111706 - DNA, 20 bp, human
gccggaaagcagaggtcggg

SEQ ID NO: 111707 - DNA, 20 bp, human
ggcgctctaggagccgggag

SEQ ID NO: 111708 - DNA, 20 bp, human
ggcacgcggattccttgctg

SEQ ID NO: 111709 - DNA, 20 bp, human
gctggggagaaagtaccttg

SEQ ID NO: 111710 - DNA, 20 bp, human
gggcggagcgcacctttccg

SEQ ID NO: 111711 - DNA, 20 bp, human
gatccccgcggcccgcggaa

SEQ ID NO: 111712 - DNA, 20 bp, human
ggcggggaagagaaatggcg

SEQ ID NO: 111713 - DNA, 20 bp, human
gaggcgcgtgcgcaaagcga

SEQ ID NO: 111714 - DNA, 20 bp, human
ggcgtgcgcaaagcgaaggc

SEQ ID NO: 111715 - DNA, 20 bp, human
gaagtaccttggggcgccgg

SEQ ID NO: 111716 - DNA, 20 bp, human
gcggagacccggaccgatcg

SEQ ID NO: 111717 - DNA, 20 bp, human
gcacagcgccaaggtgagtc

SEQ ID NO: 111718 - DNA, 20 bp, human
gcaagctgctgcggtcgtgg

SEQ ID NO: 111719 - DNA, 20 bp, human
ggcagcagcttggcaattgc

SEQ ID NO: 111720 - DNA, 20 bp, human
gctgactggcttgggagcag

SEQ ID NO: 111721 - DNA, 20 bp, human
gtatagccgggcctgagggc

SEQ ID NO: 111722 - DNA, 20 bp, human
ggaggcggtgcacagcgcca

SEQ ID NO: 111723 - DNA, 20 bp, human
gtagcgcgccgagcacggct

SEQ ID NO: 111724 - DNA, 20 bp, human
ggccaaacaggccctcgata

SEQ ID NO: 111725 - DNA, 20 bp, human
ggcgcgcccgcggcctcgat

SEQ ID NO: 111726 - DNA, 20 bp, human
gggcccgcgggtcagatcgg

SEQ ID NO: 111727 - DNA, 20 bp, human
gtcccggcgggaacagatct

SEQ ID NO: 111728 - DNA, 20 bp, human
gaggcccgccaggcactcgg

SEQ ID NO: 111729 - DNA, 20 bp, human
ggcgccgggccccacattca

SEQ ID NO: 111730 - DNA, 20 bp, human
gccgggcccgcgggtcagat

SEQ ID NO: 111731 - DNA, 20 bp, human
ggctcgccgtgtctcccccg

SEQ ID NO: 111732 - DNA, 20 bp, human
gcgaggccgggcgaaggcgg

SEQ ID NO: 111733 - DNA, 20 bp, human
gcggcgggaacagatctggg

SEQ ID NO: 111734 - DNA, 20 bp, human
gccgcgggtcagatcggagg

SEQ ID NO: 111735 - DNA, 20 bp, human
gatctgggaggaaacctcgg

SEQ ID NO: 111736 - DNA, 20 bp, human
ggaaggaaactgtcctccat

SEQ ID NO: 111737 - DNA, 20 bp, human
gacttcagtaaagggaaccc

SEQ ID NO: 111738 - DNA, 20 bp, human
gctgtcctccatgggcagga

SEQ ID NO: 111739 - DNA, 20 bp, human
gggctccgggaaaactacac

SEQ ID NO: 111740 - DNA, 20 bp, human
gggctggctgcgagagcccc

SEQ ID NO: 111741 - DNA, 20 bp, human
gctgaggccgttgccacccc

SEQ ID NO: 111742 - DNA, 20 bp, human
gcaggcgccaggggtggcaa

SEQ ID NO: 111743 - DNA, 20 bp, human
gagcgcggcgggaaacaaac

SEQ ID NO: 111744 - DNA, 20 bp, human
gacctcctgcgaggcctccc

SEQ ID NO: 111745 - DNA, 20 bp, human
gtggccccgggcccgtgcac

SEQ ID NO: 111746 - DNA, 20 bp, human
gactaaagccgaggtctgga

SEQ ID NO: 111747 - DNA, 20 bp, human
gtaccgcgattctgagaggt

SEQ ID NO: 111748 - DNA, 20 bp, human
gttgttaccgcgattctgag

SEQ ID NO: 111749 - DNA, 20 bp, human
ggctcactctggaagtctgg

SEQ ID NO: 111750 - DNA, 20 bp, human
gagcccacctctcagaatcg

SEQ ID NO: 111751 - DNA, 20 bp, human
gcatcttgcgtacggaggtg

SEQ ID NO: 111752 - DNA, 20 bp, human
gagctggaggaagacaactg

SEQ ID NO: 111753 - DNA, 20 bp, human
gaccgccatcttgcgtacgg

SEQ ID NO: 111754 - DNA, 20 bp, human
ggtgaccgccatcttgcgta

SEQ ID NO: 111755 - DNA, 20 bp, human
ggtcccgaagaaaagcaacc

SEQ ID NO: 111756 - DNA, 20 bp, human
ggcaggcgccgggaaaacgc

SEQ ID NO: 111757 - DNA, 20 bp, human
gccgggagcaggggacacct

SEQ ID NO: 111758 - DNA, 20 bp, human
gactgcgtgccgggtcggag

SEQ ID NO: 111759 - DNA, 20 bp, human
gaggctcccgtctgagagat

SEQ ID NO: 111760 - DNA, 20 bp, human
gcccctgctcccggtcaccg

SEQ ID NO: 111761 - DNA, 20 bp, human
ggccggagccggattggcga

SEQ ID NO: 111762 - DNA, 20 bp, human
gcccctccagcggagcatcg

SEQ ID NO: 111763 - DNA, 20 bp, human
gcaaaggcggagggaaaacc

SEQ ID NO: 111764 - DNA, 20 bp, human
ggtcgccaccatggtaagtg

SEQ ID NO: 111765 - DNA, 20 bp, human
gtccagcggagcatcggggt

SEQ ID NO: 111766 - DNA, 20 bp, human
gggcccacgtgcccgtggaa

SEQ ID NO: 111767 - DNA, 20 bp, human
gggaacgcagcgaaggacta

SEQ ID NO: 111768 - DNA, 20 bp, human
gcagcgaaggactatggcag

SEQ ID NO: 111769 - DNA, 20 bp, human
gcttcgctacgccgttccac

SEQ ID NO: 111770 - DNA, 20 bp, human
gcgcgcatggaacgcagcga

SEQ ID NO: 111771 - DNA, 20 bp, human
gcgcctgctccggctcaggg

SEQ ID NO: 111772 - DNA, 20 bp, human
gctgactgcttaccatgcaa

SEQ ID NO: 111773 - DNA, 20 bp, human
gcgccgttccacgggcacgt

SEQ ID NO: 111774 - DNA, 20 bp, human
gactggcagggtgcgaggag

SEQ ID NO: 111775 - DNA, 20 bp, human
gggctcgtacacgtcgctga

SEQ ID NO: 111776 - DNA, 20 bp, human
gtcgggcgcagctgtagggt

SEQ ID NO: 111777 - DNA, 20 bp, human
gcgcacgcgcggctggtgag

SEQ ID NO: 111778 - DNA, 20 bp, human
gcactgcacacggcgagtct

SEQ ID NO: 111779 - DNA, 20 bp, human
ggggttcgggcgcagctgta

SEQ ID NO: 111780 - DNA, 20 bp, human
gccagtccaaaacgcctcgg

SEQ ID NO: 111781 - DNA, 20 bp, human
gctgactgtccgctcctgga

SEQ ID NO: 111782 - DNA, 20 bp, human
gacgtgcgcggcacaggacg

SEQ ID NO: 111783 - DNA, 20 bp, human
ggctggtgagtggcgggttc

SEQ ID NO: 111784 - DNA, 20 bp, human
gccggcctgagagtggatcc

SEQ ID NO: 111785 - DNA, 20 bp, human
gaacccagtccaaaacgcct

SEQ ID NO: 111786 - DNA, 20 bp, human
ggcgtcgcttcggagcgcgg

SEQ ID NO: 111787 - DNA, 20 bp, human
ggctcggccccgctccctcg

SEQ ID NO: 111788 - DNA, 20 bp, human
gctccgaagcgacgccggga

SEQ ID NO: 111789 - DNA, 20 bp, human
ggaacgcgctcagtctaagg

SEQ ID NO: 111790 - DNA, 20 bp, human
ggccagccccataggtccag

SEQ ID NO: 111791 - DNA, 20 bp, human
ggggtcccagcggatcgtga

SEQ ID NO: 111792 - DNA, 20 bp, human
ggtggaacgcgctcagtcta

SEQ ID NO: 111793 - DNA, 20 bp, human
gtgagaagcctgctccccgt

SEQ ID NO: 111794 - DNA, 20 bp, human
gtgggctcgctgggcgacgg

SEQ ID NO: 111795 - DNA, 20 bp, human
gggggccgagcagaccgacg

SEQ ID NO: 111796 - DNA, 20 bp, human
gaccaccgggctgaatcgtg

SEQ ID NO: 111797 - DNA, 20 bp, human
gggccgtgaagcgttcacac

SEQ ID NO: 111798 - DNA, 20 bp, human
gcagcttctgggccaggccg

SEQ ID NO: 111799 - DNA, 20 bp, human
gcctcaggaatcgagtccag

SEQ ID NO: 111800 - DNA, 20 bp, human
gccgggctgaatcgtgtgga

SEQ ID NO: 111801 - DNA, 20 bp, human
gggctgaatcgtgtggaggg

SEQ ID NO: 111802 - DNA, 20 bp, human
gcgtgtggagggcggatggc

SEQ ID NO: 111803 - DNA, 20 bp, human
gagggcggatggcgggaagg

SEQ ID NO: 111804 - DNA, 20 bp, human
gaaaagatggtgccaaactg

SEQ ID NO: 111805 - DNA, 20 bp, human
gggctgtcgccgaccttaag

SEQ ID NO: 111806 - DNA, 20 bp, human
gagctacggaacggcagcgg

SEQ ID NO: 111807 - DNA, 20 bp, human
gggctgaagcagctacggaa

SEQ ID NO: 111808 - DNA, 20 bp, human
gccccactacgggtctccgt

SEQ ID NO: 111809 - DNA, 20 bp, human
gcgccgacggagacccgtag

SEQ ID NO: 111810 - DNA, 20 bp, human
gggcctgacgagagctatga

SEQ ID NO: 111811 - DNA, 20 bp, human
gcccgccgggccgaggttag

SEQ ID NO: 111812 - DNA, 20 bp, human
gctggcgcgcgggccatagt

SEQ ID NO: 111813 - DNA, 20 bp, human
gagcagctacggaacggcag

SEQ ID NO: 111814 - DNA, 20 bp, human
gctgacgagagctatgaagg

SEQ ID NO: 111815 - DNA, 20 bp, human
ggcgggcaagtgggcgacac

SEQ ID NO: 111816 - DNA, 20 bp, human
gagcaggacacgcttcccct

SEQ ID NO: 111817 - DNA, 20 bp, human
ggccaaaaagcggagcccag

SEQ ID NO: 111818 - DNA, 20 bp, human
ggccgccgctggccaaaaag

SEQ ID NO: 111819 - DNA, 20 bp, human
ggaggtaaacaaagagcggt

SEQ ID NO: 111820 - DNA, 20 bp, human
gctccgaggtaaacaaagag

SEQ ID NO: 111821 - DNA, 20 bp, human
gcggccggagcgggaaagtg

SEQ ID NO: 111822 - DNA, 20 bp, human
gggcgagccgcagaagaccg

SEQ ID NO: 111823 - DNA, 20 bp, human
ggttcccgcgcactgcaaga

SEQ ID NO: 111824 - DNA, 20 bp, human
ggcagcccgactctcagcag

SEQ ID NO: 111825 - DNA, 20 bp, human
ggccttaagggcaagcggtc

SEQ ID NO: 111826 - DNA, 20 bp, human
gggtcttggcgaacggtctt

SEQ ID NO: 111827 - DNA, 20 bp, human
gggcgcggggtcttggcgaa

SEQ ID NO: 111828 - DNA, 20 bp, human
gcacgaaccagcaagcagta

SEQ ID NO: 111829 - DNA, 20 bp, human
gtgcgagctggcaggttctg

SEQ ID NO: 111830 - DNA, 20 bp, human
ggaacggtcttcggaagcgg

SEQ ID NO: 111831 - DNA, 20 bp, human
gccacgctccgggagacttc

SEQ ID NO: 111832 - DNA, 20 bp, human
gcgccctgccggaagtctcc

SEQ ID NO: 111833 - DNA, 20 bp, human
gtcctgacagcgaccacgag

SEQ ID NO: 111834 - DNA, 20 bp, human
gctccgggagacttccggca

SEQ ID NO: 111835 - DNA, 20 bp, human
gggcgaacggtcttcggaag

SEQ ID NO: 111836 - DNA, 20 bp, human
ggcgacgcggggccatgtgc

SEQ ID NO: 111837 - DNA, 20 bp, human
ggccggaggcgcctgtcgtt

SEQ ID NO: 111838 - DNA, 20 bp, human
gtgtgcaggaccctaacgac

SEQ ID NO: 111839 - DNA, 20 bp, human
gagaccggagatctccccga

SEQ ID NO: 111840 - DNA, 20 bp, human
gcgaaggtggaagccggctc

SEQ ID NO: 111841 - DNA, 20 bp, human
gctcaccgtaaatgggccgg

SEQ ID NO: 111842 - DNA, 20 bp, human
gccaccttcggggagatctc

SEQ ID NO: 111843 - DNA, 20 bp, human
ggcagccgcgggcctcgcgt

SEQ ID NO: 111844 - DNA, 20 bp, human
gacactcaccgtaaatgggc

SEQ ID NO: 111845 - DNA, 20 bp, human
gcccaaggctgaggaaggtt

SEQ ID NO: 111846 - DNA, 20 bp, human
gggctgagtgagaaccttgg

SEQ ID NO: 111847 - DNA, 20 bp, human
gcgaggagcgcggagaacag

SEQ ID NO: 111848 - DNA, 20 bp, human
gtgctgcagcgaggacgagg

SEQ ID NO: 111849 - DNA, 20 bp, human
gtcctcgctgcagcaggcga

SEQ ID NO: 111850 - DNA, 20 bp, human
ggaggctgccgcggctgcga

SEQ ID NO: 111851 - DNA, 20 bp, human
ggtgagaaccttggcggctg

SEQ ID NO: 111852 - DNA, 20 bp, human
gccgccgggaagggacagcg

SEQ ID NO: 111853 - DNA, 20 bp, human
gaggcgctttacggcgacgg

SEQ ID NO: 111854 - DNA, 20 bp, human
gacgaagagcacgaaggcgg

SEQ ID NO: 111855 - DNA, 20 bp, human
gaggacgacgaagagcacga

SEQ ID NO: 111856 - DNA, 20 bp, human
ggtggcggcgcgggtgacca

SEQ ID NO: 111857 - DNA, 20 bp, human
ggatctgccacacgcgcggg

SEQ ID NO: 111858 - DNA, 20 bp, human
ggggtgaccacgggagaagt

SEQ ID NO: 111859 - DNA, 20 bp, human
gacgagcgagagggtttcaa

SEQ ID NO: 111860 - DNA, 20 bp, human
gtagggccgaggcacacctg

SEQ ID NO: 111861 - DNA, 20 bp, human
gcgcgcgtgtggcagatcct

SEQ ID NO: 111862 - DNA, 20 bp, human
gaacctcgccgggagcaatg

SEQ ID NO: 111863 - DNA, 20 bp, human
gcagctaccgaagtcaatca

SEQ ID NO: 111864 - DNA, 20 bp, human
gaccacgggagaagtaggta

SEQ ID NO: 111865 - DNA, 20 bp, human
gggtttcaatggctacgcag

SEQ ID NO: 111866 - DNA, 20 bp, human
ggaaagggcgcgccagaacc

SEQ ID NO: 111867 - DNA, 20 bp, human
gagatgaacagtcgtcctgg

SEQ ID NO: 111868 - DNA, 20 bp, human
ggtcatgctgttcggcccgg

SEQ ID NO: 111869 - DNA, 20 bp, human
gtggcctcggcgggatcctg

SEQ ID NO: 111870 - DNA, 20 bp, human
gtcggcaccgctgcgttacc

SEQ ID NO: 111871 - DNA, 20 bp, human
gtgttcggcccggcggttcc

SEQ ID NO: 111872 - DNA, 20 bp, human
ggacgtcatgctgttcggcc

SEQ ID NO: 111873 - DNA, 20 bp, human
gacgacccagagttcgccgg

SEQ ID NO: 111874 - DNA, 20 bp, human
ggcagcagcgggaaggctcg

SEQ ID NO: 111875 - DNA, 20 bp, human
gggggcgggcgaggagatga

SEQ ID NO: 111876 - DNA, 20 bp, human
ggcctagcccgggaatcctc

SEQ ID NO: 111877 - DNA, 20 bp, human
gacccttagaatgggggagt

SEQ ID NO: 111878 - DNA, 20 bp, human
ggagcgggaagctaacccca

SEQ ID NO: 111879 - DNA, 20 bp, human
gacggcggtggctgcaacag

SEQ ID NO: 111880 - DNA, 20 bp, human
gaggtgatgagtgaccctgg

SEQ ID NO: 111881 - DNA, 20 bp, human
gacacttgccggcagggagg

SEQ ID NO: 111882 - DNA, 20 bp, human
gcacacacttgccggcaggg

SEQ ID NO: 111883 - DNA, 20 bp, human
ggcctcactcacccccatag

SEQ ID NO: 111884 - DNA, 20 bp, human
ggtagggacccttagaatgg

SEQ ID NO: 111885 - DNA, 20 bp, human
gtggccgagggtctccgacc

SEQ ID NO: 111886 - DNA, 20 bp, human
gtaagggtgcggagacctaa

SEQ ID NO: 111887 - DNA, 20 bp, human
gcacagcgcggcagcgggtc

SEQ ID NO: 111888 - DNA, 20 bp, human
gcacgtgcactcgggtctct

SEQ ID NO: 111889 - DNA, 20 bp, human
ggattcagggcgaagacggg

SEQ ID NO: 111890 - DNA, 20 bp, human
gagcggaggcaagacccggg

SEQ ID NO: 111891 - DNA, 20 bp, human
gagagattcagggcgaagac

SEQ ID NO: 111892 - DNA, 20 bp, human
ggtccgggcccatgtagagg

SEQ ID NO: 111893 - DNA, 20 bp, human
gttccctcggctcccggagg

SEQ ID NO: 111894 - DNA, 20 bp, human
ggtggcccgagctaagggtg

SEQ ID NO: 111895 - DNA, 20 bp, human
gctaagggcggcgactacga

SEQ ID NO: 111896 - DNA, 20 bp, human
gccggctcccccacgaggtg

SEQ ID NO: 111897 - DNA, 20 bp, human
gggacactgacgcaaccccc

SEQ ID NO: 111898 - DNA, 20 bp, human
gccagggacgagggttgagg

SEQ ID NO: 111899 - DNA, 20 bp, human
gactagagggtggtcctcat

SEQ ID NO: 111900 - DNA, 20 bp, human
gcagcgcgctcgtacccggt

SEQ ID NO: 111901 - DNA, 20 bp, human
gcgagttatgtaaccggcag

SEQ ID NO: 111902 - DNA, 20 bp, human
gggccgctgggggtgttgta

SEQ ID NO: 111903 - DNA, 20 bp, human
gcctcgcgcgacaccccaca

SEQ ID NO: 111904 - DNA, 20 bp, human
gtccgcgcggtcccacttcc

SEQ ID NO: 111905 - DNA, 20 bp, human
gcccggcgcacggtcctccc

SEQ ID NO: 111906 - DNA, 20 bp, human
gacccggacgctgctcaggg

SEQ ID NO: 111907 - DNA, 20 bp, human
gcttacccgggctccgacag

SEQ ID NO: 111908 - DNA, 20 bp, human
ggcgccacgctgacccggaa

SEQ ID NO: 111909 - DNA, 20 bp, human
ggctgcaggtctccaagttg

SEQ ID NO: 111910 - DNA, 20 bp, human
gcttagggcgtgaggtctca

SEQ ID NO: 111911 - DNA, 20 bp, human
gccaacccggacgctgctca

SEQ ID NO: 111912 - DNA, 20 bp, human
gggctccagcggccgcaact

SEQ ID NO: 111913 - DNA, 20 bp, human
gcagcagggacggaagcccc

SEQ ID NO: 111914 - DNA, 20 bp, human
gctgggcggtccactgactg

SEQ ID NO: 111915 - DNA, 20 bp, human
ggaatccagcgcggcaggtt

SEQ ID NO: 111916 - DNA, 20 bp, human
gagagaaacagagagcgcgc

SEQ ID NO: 111917 - DNA, 20 bp, human
ggcagtaacccggacatagt

SEQ ID NO: 111918 - DNA, 20 bp, human
gaagccatggcggaatccag

SEQ ID NO: 111919 - DNA, 20 bp, human
gatcacgagccccggagtcg

SEQ ID NO: 111920 - DNA, 20 bp, human
ggccttgcgaaggtcagcgg

SEQ ID NO: 111921 - DNA, 20 bp, human
ggctacattcgcgagcttcg

SEQ ID NO: 111922 - DNA, 20 bp, human
gcacaggtccccagcgggta

SEQ ID NO: 111923 - DNA, 20 bp, human
gagcagccaagcacatccaa

SEQ ID NO: 111924 - DNA, 20 bp, human
gggtcctcaagaagccatgg

SEQ ID NO: 111925 - DNA, 20 bp, human
gacactctaccccgactccg

SEQ ID NO: 111926 - DNA, 20 bp, human
gtaaggactggaccacgggt

SEQ ID NO: 111927 - DNA, 20 bp, human
gtaccgaggcagggacggag

SEQ ID NO: 111928 - DNA, 20 bp, human
gctcgtaaggactggaccac

SEQ ID NO: 111929 - DNA, 20 bp, human
gcgcatgcagcaaggtaccg

SEQ ID NO: 111930 - DNA, 20 bp, human
gggacggggccgctacgggt

SEQ ID NO: 111931 - DNA, 20 bp, human
gggctggggcaagcctcgta

SEQ ID NO: 111932 - DNA, 20 bp, human
gccggtctcctgcccacccg

SEQ ID NO: 111933 - DNA, 20 bp, human
gctcacccggtcataggtat

SEQ ID NO: 111934 - DNA, 20 bp, human
gtaagcccagggacagaagg

SEQ ID NO: 111935 - DNA, 20 bp, human
gcgcctgctcacccggtcat

SEQ ID NO: 111936 - DNA, 20 bp, human
gaatttgggggacccgtgga

SEQ ID NO: 111937 - DNA, 20 bp, human
ggggggacccgtggagggta

SEQ ID NO: 111938 - DNA, 20 bp, human
ggaaggtcacaaagcttgca

SEQ ID NO: 111939 - DNA, 20 bp, human
gcacaaatttgggggacccg

SEQ ID NO: 111940 - DNA, 20 bp, human
gcagttgtttacaaagactc

SEQ ID NO: 111941 - DNA, 20 bp, human
gaagctttccataccctcca

SEQ ID NO: 111942 - DNA, 20 bp, human
ggcacctgaacatgcatgca

SEQ ID NO: 111943 - DNA, 20 bp, human
gtttctgcgagcgagaaaag

SEQ ID NO: 111944 - DNA, 20 bp, human
gtaccttgcaaagacgtgtt

SEQ ID NO: 111945 - DNA, 20 bp, human
gcatgcatgttcaggtgccc

SEQ ID NO: 111946 - DNA, 20 bp, human
gggccgccgccggaaggaga

SEQ ID NO: 111947 - DNA, 20 bp, human
gggccgccctctccttccgg

SEQ ID NO: 111948 - DNA, 20 bp, human
gccgctggctgagtacgtac

SEQ ID NO: 111949 - DNA, 20 bp, human
ggagcgccgtcggggcgggt

SEQ ID NO: 111950 - DNA, 20 bp, human
gggccacgcgggcactttgg

SEQ ID NO: 111951 - DNA, 20 bp, human
gggcggccccgggctcgtgt

SEQ ID NO: 111952 - DNA, 20 bp, human
gggctgagtacgtaccggag

SEQ ID NO: 111953 - DNA, 20 bp, human
gggccgagtgacgcagatcc

SEQ ID NO: 111954 - DNA, 20 bp, human
ggcggcgaatgtagcaagag

SEQ ID NO: 111955 - DNA, 20 bp, human
ggccacgggcgaacttgggg

SEQ ID NO: 111956 - DNA, 20 bp, human
gggctcggagagagaagacg

SEQ ID NO: 111957 - DNA, 20 bp, human
ggcctggacagcggtggaca

SEQ ID NO: 111958 - DNA, 20 bp, human
ggacagagcctggacagcgg

SEQ ID NO: 111959 - DNA, 20 bp, human
gtcggagagagaagacgtgg

SEQ ID NO: 111960 - DNA, 20 bp, human
ggcatcgtgcgcggggaaga

SEQ ID NO: 111961 - DNA, 20 bp, human
gggacggccggagatcaccc

SEQ ID NO: 111962 - DNA, 20 bp, human
gggagcccacagagtaaacc

SEQ ID NO: 111963 - DNA, 20 bp, human
gccagagggcggaggtcgag

SEQ ID NO: 111964 - DNA, 20 bp, human
gaaaccaggaatggagattt

SEQ ID NO: 111965 - DNA, 20 bp, human
gcagccgagcagccgccggg

SEQ ID NO: 111966 - DNA, 20 bp, human
ggcacagcgggcggtggagt

SEQ ID NO: 111967 - DNA, 20 bp, human
gcaaagcttcccaccctccc

SEQ ID NO: 111968 - DNA, 20 bp, human
gtgtgacagcgaaacgggag

SEQ ID NO: 111969 - DNA, 20 bp, human
gcggctgcggagacgcgagt

SEQ ID NO: 111970 - DNA, 20 bp, human
gacaggcgcggctacggctg

SEQ ID NO: 111971 - DNA, 20 bp, human
gcgagatcggatcctacctg

SEQ ID NO: 111972 - DNA, 20 bp, human
ggacaggggcgaaggcagag

SEQ ID NO: 111973 - DNA, 20 bp, human
gcttcgcccctgtcccggga

SEQ ID NO: 111974 - DNA, 20 bp, human
gcagggctcccgcctcaggt

SEQ ID NO: 111975 - DNA, 20 bp, human
gtgtgagtgagcgggactca

SEQ ID NO: 111976 - DNA, 20 bp, human
gcctgccggctggcttgggt

SEQ ID NO: 111977 - DNA, 20 bp, human
gagccgacgtagacaggggt

SEQ ID NO: 111978 - DNA, 20 bp, human
gtccacggggcagcatccgg

SEQ ID NO: 111979 - DNA, 20 bp, human
ggcggagccgacgtagacag

SEQ ID NO: 111980 - DNA, 20 bp, human
gccccctgcgggctgctcag

SEQ ID NO: 111981 - DNA, 20 bp, human
gcccactggatggggaatag

SEQ ID NO: 111982 - DNA, 20 bp, human
gcttgggaagtggagcatgg

SEQ ID NO: 111983 - DNA, 20 bp, human
gtccctacccctgtctacgt

SEQ ID NO: 111984 - DNA, 20 bp, human
gcgtgcacagtcctgccggc

SEQ ID NO: 111985 - DNA, 20 bp, human
ggaggggatggaccgagtcc

SEQ ID NO: 111986 - DNA, 20 bp, human
gcaggagctgcctacgagga

SEQ ID NO: 111987 - DNA, 20 bp, human
gagccttcgtccctcctcgt

SEQ ID NO: 111988 - DNA, 20 bp, human
gtgcctacgaggagggacga

SEQ ID NO: 111989 - DNA, 20 bp, human
gatacggcaggagagcgcct

SEQ ID NO: 111990 - DNA, 20 bp, human
gctcctggctgctggtgtag

SEQ ID NO: 111991 - DNA, 20 bp, human
ggacttcctgtctagagtgg

SEQ ID NO: 111992 - DNA, 20 bp, human
gccaggcctccactctagac

SEQ ID NO: 111993 - DNA, 20 bp, human
gcggggagccatcgtggata

SEQ ID NO: 111994 - DNA, 20 bp, human
gaccgcaaagcttagatctg

SEQ ID NO: 111995 - DNA, 20 bp, human
gctagacttcctgtctagag

SEQ ID NO: 111996 - DNA, 20 bp, human
gggctgcggatagacagtag

SEQ ID NO: 111997 - DNA, 20 bp, human
gacttactgtgcagggaacg

SEQ ID NO: 111998 - DNA, 20 bp, human
gccctgtgacaagcaagtgt

SEQ ID NO: 111999 - DNA, 20 bp, human
ggactttggggtaccaggag

SEQ ID NO: 112000 - DNA, 20 bp, human
gtggtgtcctggcaaaagca

SEQ ID NO: 112001 - DNA, 20 bp, human
gccagtgtgagtattaggag

SEQ ID NO: 112002 - DNA, 20 bp, human
gtgggcctccggacaaaatg

SEQ ID NO: 112003 - DNA, 20 bp, human
gaaagaaaggcggatggctg

SEQ ID NO: 112004 - DNA, 20 bp, human
gtaactctcagtccccgggg

SEQ ID NO: 112005 - DNA, 20 bp, human
gttgcttgtcacagggagaa

SEQ ID NO: 112006 - DNA, 20 bp, human
gtatgtaggcatccgaagca

SEQ ID NO: 112007 - DNA, 20 bp, human
gacacaaaaagcctggctgg

SEQ ID NO: 112008 - DNA, 20 bp, human
gcgttccctgcacaaaatgc

SEQ ID NO: 112009 - DNA, 20 bp, human
gtgcttgctgagataaatct

SEQ ID NO: 112010 - DNA, 20 bp, human
gctggaacagcatctgatag

SEQ ID NO: 112011 - DNA, 20 bp, human
ggagttcaaggtgaagctgt

SEQ ID NO: 112012 - DNA, 20 bp, human
gtagtggtgaatcagtacca

SEQ ID NO: 112013 - DNA, 20 bp, human
gaccacacaaaaagcctggc

SEQ ID NO: 112014 - DNA, 20 bp, human
gttttgtgtggtggtctggg

SEQ ID NO: 112015 - DNA, 20 bp, human
ggctttttgtgtggtggtct

SEQ ID NO: 112016 - DNA, 20 bp, human
gtccctgggtcggaagccaa

SEQ ID NO: 112017 - DNA, 20 bp, human
ggctgggccgctctggacag

SEQ ID NO: 112018 - DNA, 20 bp, human
ggcacggactgacggagggt

SEQ ID NO: 112019 - DNA, 20 bp, human
gcagaactgcggggaaggtg

SEQ ID NO: 112020 - DNA, 20 bp, human
gggcagctcggtgcaaacaa

SEQ ID NO: 112021 - DNA, 20 bp, human
gaccgacccgggccccgcac

SEQ ID NO: 112022 - DNA, 20 bp, human
gcgcgagccagaaagaacgt

SEQ ID NO: 112023 - DNA, 20 bp, human
gggagggtcggaaggactga

SEQ ID NO: 112024 - DNA, 20 bp, human
gcaactgaggaccctcccgg

SEQ ID NO: 112025 - DNA, 20 bp, human
gcgatcaggtgaccaccggg

SEQ ID NO: 112026 - DNA, 20 bp, human
gggagcccgccgggaccccc

SEQ ID NO: 112027 - DNA, 20 bp, human
gaccccccggagcgcggcca

SEQ ID NO: 112028 - DNA, 20 bp, human
gcgcggcggccattcattgt

SEQ ID NO: 112029 - DNA, 20 bp, human
gcggcctggcccacaatgaa

SEQ ID NO: 112030 - DNA, 20 bp, human
gctccctcgctgggagacgg

SEQ ID NO: 112031 - DNA, 20 bp, human
gggtccgaggcggaaaagtg

SEQ ID NO: 112032 - DNA, 20 bp, human
ggaagttggagggtccgagg

SEQ ID NO: 112033 - DNA, 20 bp, human
gggcaggtaccggggatccg

SEQ ID NO: 112034 - DNA, 20 bp, human
ggcgtccagcccgagcttca

SEQ ID NO: 112035 - DNA, 20 bp, human
ggtcccggcgggctccgcag

SEQ ID NO: 112036 - DNA, 20 bp, human
ggaggtcggagaaagtccat

SEQ ID NO: 112037 - DNA, 20 bp, human
gtcggccagtcgggtccctg

SEQ ID NO: 112038 - DNA, 20 bp, human
gccccgcgcggccggcactg

SEQ ID NO: 112039 - DNA, 20 bp, human
gcgccggtgctgggcgaggt

SEQ ID NO: 112040 - DNA, 20 bp, human
gaagcacttcctgccgcggg

SEQ ID NO: 112041 - DNA, 20 bp, human
ggcctccccagggacccgac

SEQ ID NO: 112042 - DNA, 20 bp, human
ggggctcgcgccaagttggg

SEQ ID NO: 112043 - DNA, 20 bp, human
ggcccggcggcgtaacccgg

SEQ ID NO: 112044 - DNA, 20 bp, human
gcaggaagtgcttggcgtcc

SEQ ID NO: 112045 - DNA, 20 bp, human
gctccgacctcgcccagcac

SEQ ID NO: 112046 - DNA, 20 bp, human
ggccaagggccaggtagcga

SEQ ID NO: 112047 - DNA, 20 bp, human
ggcggcgcattgctgctcgg

SEQ ID NO: 112048 - DNA, 20 bp, human
ggacctggccgcccaagcag

SEQ ID NO: 112049 - DNA, 20 bp, human
gcaggcggccagggcgccaa

SEQ ID NO: 112050 - DNA, 20 bp, human
gcggggtccgggcggccatg

SEQ ID NO: 112051 - DNA, 20 bp, human
gctggccgcctgttgcccca

SEQ ID NO: 112052 - DNA, 20 bp, human
gtctcccgggcggggaaggt

SEQ ID NO: 112053 - DNA, 20 bp, human
gtctgagggaggccgctgtc

SEQ ID NO: 112054 - DNA, 20 bp, human
gtacctggcccttggcgccc

SEQ ID NO: 112055 - DNA, 20 bp, human
gggccagggcgccaagggcc

SEQ ID NO: 112056 - DNA, 20 bp, human
ggtgaagtacagggcaccaa

SEQ ID NO: 112057 - DNA, 20 bp, human
gggtgccctgtacttcactg

SEQ ID NO: 112058 - DNA, 20 bp, human
gcaccaagggtgactggaaa

SEQ ID NO: 112059 - DNA, 20 bp, human
gtgaatgaagtagtcgagtg

SEQ ID NO: 112060 - DNA, 20 bp, human
ggtgactggaaagggaagca

SEQ ID NO: 112061 - DNA, 20 bp, human
gaatccagagacacggaaca

SEQ ID NO: 112062 - DNA, 20 bp, human
gctctctggtcaggactcct

SEQ ID NO: 112063 - DNA, 20 bp, human
gtcaggtccacaccgaccct

SEQ ID NO: 112064 - DNA, 20 bp, human
gagagacacggaacacggcc

SEQ ID NO: 112065 - DNA, 20 bp, human
gtgagccgtgagcccgccac

SEQ ID NO: 112066 - DNA, 20 bp, human
gcgttacgcggagctctcgg

SEQ ID NO: 112067 - DNA, 20 bp, human
ggcgaagttagaggcccggg

SEQ ID NO: 112068 - DNA, 20 bp, human
gctctaacttcgcgccggac

SEQ ID NO: 112069 - DNA, 20 bp, human
gccgagaggtccccccgagg

SEQ ID NO: 112070 - DNA, 20 bp, human
ggtacgagttcgagcagcag

SEQ ID NO: 112071 - DNA, 20 bp, human
gcgagcccgggagcgaagcg

SEQ ID NO: 112072 - DNA, 20 bp, human
gctcgggacgactcttccca

SEQ ID NO: 112073 - DNA, 20 bp, human
ggttcatgcagggacttagg

SEQ ID NO: 112074 - DNA, 20 bp, human
gtacgcggagctctcggagg

SEQ ID NO: 112075 - DNA, 20 bp, human
gggcgcgaagttagaggccc

SEQ ID NO: 112076 - DNA, 20 bp, human
gaccagggtcccagcgaggt

SEQ ID NO: 112077 - DNA, 20 bp, human
gatcctggccgcagtcgctt

SEQ ID NO: 112078 - DNA, 20 bp, human
gcggggacgagcgatataca

SEQ ID NO: 112079 - DNA, 20 bp, human
gttgggcaggaggccagcgg

SEQ ID NO: 112080 - DNA, 20 bp, human
gcagggccgagagtttccca

SEQ ID NO: 112081 - DNA, 20 bp, human
gagggtcccagcgaggtagg

SEQ ID NO: 112082 - DNA, 20 bp, human
gagcgggggacagcaagacc

SEQ ID NO: 112083 - DNA, 20 bp, human
gggcagctcagtcccaacca

SEQ ID NO: 112084 - DNA, 20 bp, human
gggcacggttaagaaaagtc

SEQ ID NO: 112085 - DNA, 20 bp, human
gcccagcgaggtaggcggct

SEQ ID NO: 112086 - DNA, 20 bp, human
gtggtggcggcgctccgcag

SEQ ID NO: 112087 - DNA, 20 bp, human
ggccagccgggtagctaagg

SEQ ID NO: 112088 - DNA, 20 bp, human
gcaaggagcagaagtacgac

SEQ ID NO: 112089 - DNA, 20 bp, human
ggagggcggcacagagggtt

SEQ ID NO: 112090 - DNA, 20 bp, human
gagcgccagccgggtagcta

SEQ ID NO: 112091 - DNA, 20 bp, human
gtgcgcgcttgtggagctgg

SEQ ID NO: 112092 - DNA, 20 bp, human
ggccgcgagggcggcacaga

SEQ ID NO: 112093 - DNA, 20 bp, human
gcgccctcgcggccgggatg

SEQ ID NO: 112094 - DNA, 20 bp, human
gcggcagctgaggtgagccg

SEQ ID NO: 112095 - DNA, 20 bp, human
ggaagtacgaccggcagctg

SEQ ID NO: 112096 - DNA, 20 bp, human
gccgcgacggcgttcagaac

SEQ ID NO: 112097 - DNA, 20 bp, human
gggctctgcggctcctgggg

SEQ ID NO: 112098 - DNA, 20 bp, human
gctcaggtaactacacgcgg

SEQ ID NO: 112099 - DNA, 20 bp, human
gcgcggtgcgatggaggtag

SEQ ID NO: 112100 - DNA, 20 bp, human
ggacgctgggcagaccgtgg

SEQ ID NO: 112101 - DNA, 20 bp, human
gtaagggacccggagctgtg

SEQ ID NO: 112102 - DNA, 20 bp, human
gcgttcagaacgggctgcag

SEQ ID NO: 112103 - DNA, 20 bp, human
gccggacgctgggcagaccg

SEQ ID NO: 112104 - DNA, 20 bp, human
gtccgagtccgaggtctcca

SEQ ID NO: 112105 - DNA, 20 bp, human
ggagccgtgagcttgtccag

SEQ ID NO: 112106 - DNA, 20 bp, human
gggattcgagtcagaagcgg

SEQ ID NO: 112107 - DNA, 20 bp, human
gaccggattcgagtcagaag

SEQ ID NO: 112108 - DNA, 20 bp, human
ggcggcaggtctgaacgctt

SEQ ID NO: 112109 - DNA, 20 bp, human
gcccgcccgggctcagaaaa

SEQ ID NO: 112110 - DNA, 20 bp, human
gcgcttcggtaggataagtg

SEQ ID NO: 112111 - DNA, 20 bp, human
gtcggtaggataagtgcggt

SEQ ID NO: 112112 - DNA, 20 bp, human
gcaggtctgaacgcttcggt

SEQ ID NO: 112113 - DNA, 20 bp, human
ggcagtgctgggagtcccga

SEQ ID NO: 112114 - DNA, 20 bp, human
gtcaccaagaaagagcggag

SEQ ID NO: 112115 - DNA, 20 bp, human
gggaacgcttcggacttatc

SEQ ID NO: 112116 - DNA, 20 bp, human
gcacaggcagagtccccgta

SEQ ID NO: 112117 - DNA, 20 bp, human
ggcatggccgcgatctatgg

SEQ ID NO: 112118 - DNA, 20 bp, human
gacggcgggaccagcagcga

SEQ ID NO: 112119 - DNA, 20 bp, human
ggatctatgggggtgtagag

SEQ ID NO: 112120 - DNA, 20 bp, human
gagaagcgggacaaagatct

SEQ ID NO: 112121 - DNA, 20 bp, human
gcggggagagacgcaaacgg

SEQ ID NO: 112122 - DNA, 20 bp, human
ggcagcatggccgcgatcta

SEQ ID NO: 112123 - DNA, 20 bp, human
ggttccgccaagaaacacaa

SEQ ID NO: 112124 - DNA, 20 bp, human
gcagctgaagacagcggagt

SEQ ID NO: 112125 - DNA, 20 bp, human
gaggcggggagagacgcaaa

SEQ ID NO: 112126 - DNA, 20 bp, human
gacgcggggaagcttcgggg

SEQ ID NO: 112127 - DNA, 20 bp, human
gcgctgccacccaaatcggg

SEQ ID NO: 112128 - DNA, 20 bp, human
gagaaggacccccaccgccg

SEQ ID NO: 112129 - DNA, 20 bp, human
gcccggccccggccaggaga

SEQ ID NO: 112130 - DNA, 20 bp, human
ggctggaacacaggcctgta

SEQ ID NO: 112131 - DNA, 20 bp, human
gacagaagtcgcgcaggtag

SEQ ID NO: 112132 - DNA, 20 bp, human
gggccagccgaggctctgaa

SEQ ID NO: 112133 - DNA, 20 bp, human
gcggacgcggggaagcttcg

SEQ ID NO: 112134 - DNA, 20 bp, human
gtggacacctacagcctggg

SEQ ID NO: 112135 - DNA, 20 bp, human
ggcttcggggcggtacctgt

SEQ ID NO: 112136 - DNA, 20 bp, human
gcgggcggccgtgagctcag

SEQ ID NO: 112137 - DNA, 20 bp, human
ggaagccgaatagtgcaagc

SEQ ID NO: 112138 - DNA, 20 bp, human
gaggagaagccagcgacccg

SEQ ID NO: 112139 - DNA, 20 bp, human
ggccgccggacgcttcccag

SEQ ID NO: 112140 - DNA, 20 bp, human
gagaagccagcgacccgtgg

SEQ ID NO: 112141 - DNA, 20 bp, human
gccaatatggcgacctccac

SEQ ID NO: 112142 - DNA, 20 bp, human
ggccgaatagtgcaagccgg

SEQ ID NO: 112143 - DNA, 20 bp, human
gccgaggccccggtccaata

SEQ ID NO: 112144 - DNA, 20 bp, human
ggcccgcgccgtctcctcca

SEQ ID NO: 112145 - DNA, 20 bp, human
gaaggtgcgcaggggctcaa

SEQ ID NO: 112146 - DNA, 20 bp, human
gacagactgccactcttggg

SEQ ID NO: 112147 - DNA, 20 bp, human
gccagtggcgcgcctcccca

SEQ ID NO: 112148 - DNA, 20 bp, human
gaactcttgccccccaagag

SEQ ID NO: 112149 - DNA, 20 bp, human
gtggagcgtctggcactggg

SEQ ID NO: 112150 - DNA, 20 bp, human
gctggaactgcgtgagccag

SEQ ID NO: 112151 - DNA, 20 bp, human
ggctccgctcacctcgatga

SEQ ID NO: 112152 - DNA, 20 bp, human
ggggcttgtccgcggagtga

SEQ ID NO: 112153 - DNA, 20 bp, human
gcgcggagtgatggcaggtc

SEQ ID NO: 112154 - DNA, 20 bp, human
ggcagtctgtctggagcgtc

SEQ ID NO: 112155 - DNA, 20 bp, human
gcagacagactgccactctt

SEQ ID NO: 112156 - DNA, 20 bp, human
gtgcagtggtgcctggagtc

SEQ ID NO: 112157 - DNA, 20 bp, human
gggagacagacctgctgcag

SEQ ID NO: 112158 - DNA, 20 bp, human
gcacgtctggcccacagcta

SEQ ID NO: 112159 - DNA, 20 bp, human
gcgcggccgtctccccgatg

SEQ ID NO: 112160 - DNA, 20 bp, human
ggtctggcccacagctacgg

SEQ ID NO: 112161 - DNA, 20 bp, human
gtacggcggcatcgtctcgg

SEQ ID NO: 112162 - DNA, 20 bp, human
ggcgcagatctgggcaccca

SEQ ID NO: 112163 - DNA, 20 bp, human
gccagggagggcgcagatct

SEQ ID NO: 112164 - DNA, 20 bp, human
gggcggaagtaaggataaag

SEQ ID NO: 112165 - DNA, 20 bp, human
gcggagtccttagccaggga

SEQ ID NO: 112166 - DNA, 20 bp, human
gtagcgaggggggttaccaa

SEQ ID NO: 112167 - DNA, 20 bp, human
gcggcggaagaggcagattc

SEQ ID NO: 112168 - DNA, 20 bp, human
ggcagcggccgggccggtcg

SEQ ID NO: 112169 - DNA, 20 bp, human
gctgccagccagcagcgtaa

SEQ ID NO: 112170 - DNA, 20 bp, human
ggcctcaccaccctccacgg

SEQ ID NO: 112171 - DNA, 20 bp, human
gaagccattacgctgctggc

SEQ ID NO: 112172 - DNA, 20 bp, human
gcccctggccgccaagagtg

SEQ ID NO: 112173 - DNA, 20 bp, human
ggcactttgcgtagcgaggg

SEQ ID NO: 112174 - DNA, 20 bp, human
gctcgctacgcaaagtgcgt

SEQ ID NO: 112175 - DNA, 20 bp, human
gcctcacccaccccctacag

SEQ ID NO: 112176 - DNA, 20 bp, human
gccagtggaaggaaagtatg

SEQ ID NO: 112177 - DNA, 20 bp, human
gcatggcacagttgcctcaa

SEQ ID NO: 112178 - DNA, 20 bp, human
gttctggtgtgagactctgt

SEQ ID NO: 112179 - DNA, 20 bp, human
gagaggagaatgctggccag

SEQ ID NO: 112180 - DNA, 20 bp, human
gactggagtcacacagactt

SEQ ID NO: 112181 - DNA, 20 bp, human
gggaggagaagtaatttcca

SEQ ID NO: 112182 - DNA, 20 bp, human
gagaactgtggataaacctc

SEQ ID NO: 112183 - DNA, 20 bp, human
ggatttaatcaggacccaaa

SEQ ID NO: 112184 - DNA, 20 bp, human
gctttggaggcaggatggta

SEQ ID NO: 112185 - DNA, 20 bp, human
ggagtcaacaggatttaatc

SEQ ID NO: 112186 - DNA, 20 bp, human
ggcagtcgaagaggtacaca

SEQ ID NO: 112187 - DNA, 20 bp, human
gcacagggcaacgtccagaa

SEQ ID NO: 112188 - DNA, 20 bp, human
ggatgaacaggcagtcgaag

SEQ ID NO: 112189 - DNA, 20 bp, human
gcaacgtccagaagggtccc

SEQ ID NO: 112190 - DNA, 20 bp, human
gccaagagcctcgaaatcaa

SEQ ID NO: 112191 - DNA, 20 bp, human
gaagggtcccaggtgagcac

SEQ ID NO: 112192 - DNA, 20 bp, human
gaaaggtcctgtgctcacct

SEQ ID NO: 112193 - DNA, 20 bp, human
gcagaagggggcccagtatt

SEQ ID NO: 112194 - DNA, 20 bp, human
gcaaggtgcattcattgcaa

SEQ ID NO: 112195 - DNA, 20 bp, human
gagagtgggtttaggagcgg

SEQ ID NO: 112196 - DNA, 20 bp, human
ggacgcgggcccctcaccta

SEQ ID NO: 112197 - DNA, 20 bp, human
gccacgcgcaggaataggga

SEQ ID NO: 112198 - DNA, 20 bp, human
ggcgggcccctcacctacgg

SEQ ID NO: 112199 - DNA, 20 bp, human
gcggcgctcagtgagtgaca

SEQ ID NO: 112200 - DNA, 20 bp, human
gacacccacgcgcaggaata

SEQ ID NO: 112201 - DNA, 20 bp, human
gccaccgccccgctctcggg

SEQ ID NO: 112202 - DNA, 20 bp, human
ggcatctagcaggtgttggg

SEQ ID NO: 112203 - DNA, 20 bp, human
ggcgctgtagtgatgcccag

SEQ ID NO: 112204 - DNA, 20 bp, human
gggctgaggacgaggccact

SEQ ID NO: 112205 - DNA, 20 bp, human
ggcgcctccacccgagagcg

SEQ ID NO: 112206 - DNA, 20 bp, human
ggtcactgctcggtcggcgg

SEQ ID NO: 112207 - DNA, 20 bp, human
gtgacttaagcaacggagcg

SEQ ID NO: 112208 - DNA, 20 bp, human
gcggcccgagatgaatcctg

SEQ ID NO: 112209 - DNA, 20 bp, human
gctgccgcaggattcatctc

SEQ ID NO: 112210 - DNA, 20 bp, human
gagccgcgccagggagctcg

SEQ ID NO: 112211 - DNA, 20 bp, human
ggccaggaggatgttgaact

SEQ ID NO: 112212 - DNA, 20 bp, human
gcctggcgcggctgcgagga

SEQ ID NO: 112213 - DNA, 20 bp, human
ggggctgaggcgggccccag

SEQ ID NO: 112214 - DNA, 20 bp, human
gtcatctcgggccggaggac

SEQ ID NO: 112215 - DNA, 20 bp, human
gcgagcagtgacttaagcaa

SEQ ID NO: 112216 - DNA, 20 bp, human
gtggaaaaaggggtttccag

SEQ ID NO: 112217 - DNA, 20 bp, human
gggtccatcattgctcaaga

SEQ ID NO: 112218 - DNA, 20 bp, human
gtaaggaacttggcctttca

SEQ ID NO: 112219 - DNA, 20 bp, human
gtaacacttctttatagtaa

SEQ ID NO: 112220 - DNA, 20 bp, human
gttattatcaactaatcctc

SEQ ID NO: 112221 - DNA, 20 bp, human
gtttttccattataacttgg

SEQ ID NO: 112222 - DNA, 20 bp, human
gtttccctcttgagcaatga

SEQ ID NO: 112223 - DNA, 20 bp, human
gccttctctcttttccctta

SEQ ID NO: 112224 - DNA, 20 bp, human
gaaagaaatttatccttgaa

SEQ ID NO: 112225 - DNA, 20 bp, human
gccctttttccattataact

SEQ ID NO: 112226 - DNA, 20 bp, human
ggaccaattagtccttggta

SEQ ID NO: 112227 - DNA, 20 bp, human
gctccctaccaaggactaat

SEQ ID NO: 112228 - DNA, 20 bp, human
gagagatgaccgaccagata

SEQ ID NO: 112229 - DNA, 20 bp, human
gctctgtaacctccctacca

SEQ ID NO: 112230 - DNA, 20 bp, human
gttgagttgagctatgagaa

SEQ ID NO: 112231 - DNA, 20 bp, human
gggatgacatctaccttatc

SEQ ID NO: 112232 - DNA, 20 bp, human
gttaaagaccaattagtcct

SEQ ID NO: 112233 - DNA, 20 bp, human
gaaaagaagtggcagttgtc

SEQ ID NO: 112234 - DNA, 20 bp, human
ggctttttgactcaaaccac

SEQ ID NO: 112235 - DNA, 20 bp, human
gtaaaactcctcaatgcacc

SEQ ID NO: 112236 - DNA, 20 bp, human
gcagcgcgctccccaggtag

SEQ ID NO: 112237 - DNA, 20 bp, human
gcccaggggaaagcctccat

SEQ ID NO: 112238 - DNA, 20 bp, human
ggggccgcccgactacgacg

SEQ ID NO: 112239 - DNA, 20 bp, human
ggtcccggggccgctacctg

SEQ ID NO: 112240 - DNA, 20 bp, human
gagtcgttccaggagctgaa

SEQ ID NO: 112241 - DNA, 20 bp, human
gctcctggaacgactacctg

SEQ ID NO: 112242 - DNA, 20 bp, human
ggcgcccgcggtgggaacgg

SEQ ID NO: 112243 - DNA, 20 bp, human
gtcggcgtgtcccttccgtc

SEQ ID NO: 112244 - DNA, 20 bp, human
gccaggcccggcccccgtgt

SEQ ID NO: 112245 - DNA, 20 bp, human
gtgctgctccccccacacgg

SEQ ID NO: 112246 - DNA, 20 bp, human
gccttccacatgtcgaaggg

SEQ ID NO: 112247 - DNA, 20 bp, human
gcatggcaccaaagcagggg

SEQ ID NO: 112248 - DNA, 20 bp, human
gcgagttgcgcccgctgcgg

SEQ ID NO: 112249 - DNA, 20 bp, human
ggggcgccaggggccaacgg

SEQ ID NO: 112250 - DNA, 20 bp, human
gagtactgcccgcttaacgg

SEQ ID NO: 112251 - DNA, 20 bp, human
gctgctggccaccgttaagc

SEQ ID NO: 112252 - DNA, 20 bp, human
ggtatgggcctggtcaccgg

SEQ ID NO: 112253 - DNA, 20 bp, human
ggggcagtacttgagcgtat

SEQ ID NO: 112254 - DNA, 20 bp, human
ggcggcggtagagggactgc

SEQ ID NO: 112255 - DNA, 20 bp, human
gagcaggggtggtgggccac

SEQ ID NO: 112256 - DNA, 20 bp, human
gtcccacgtgctgaaggacg

SEQ ID NO: 112257 - DNA, 20 bp, human
ggtagccctggccagtaagt

SEQ ID NO: 112258 - DNA, 20 bp, human
ggtggtgtggctgtagacgg

SEQ ID NO: 112259 - DNA, 20 bp, human
gacgtgctgaaggacgaggc

SEQ ID NO: 112260 - DNA, 20 bp, human
ggcagagaggggtcagaagg

SEQ ID NO: 112261 - DNA, 20 bp, human
gcctggttagggctctgagt

SEQ ID NO: 112262 - DNA, 20 bp, human
gtcggccagcacagactccc

SEQ ID NO: 112263 - DNA, 20 bp, human
ggtaagtgggcagaagcgtc

SEQ ID NO: 112264 - DNA, 20 bp, human
gctgggcagcatgtgccagg

SEQ ID NO: 112265 - DNA, 20 bp, human
gacacaggccaccgccgagg

SEQ ID NO: 112266 - DNA, 20 bp, human
ggccagcggccggcgctatg

SEQ ID NO: 112267 - DNA, 20 bp, human
gacgcggaagggctccgtga

SEQ ID NO: 112268 - DNA, 20 bp, human
gacaccgacagtctgaccgg

SEQ ID NO: 112269 - DNA, 20 bp, human
gtggcgctcgggacgcggaa

SEQ ID NO: 112270 - DNA, 20 bp, human
gtacaggcaggctaggaccg

SEQ ID NO: 112271 - DNA, 20 bp, human
gggactgcccagagagacgt

SEQ ID NO: 112272 - DNA, 20 bp, human
gaggctacggttcgcgccag

SEQ ID NO: 112273 - DNA, 20 bp, human
ggccaccgtggcagccgtca

SEQ ID NO: 112274 - DNA, 20 bp, human
gctaggaccgcgggcgctca

SEQ ID NO: 112275 - DNA, 20 bp, human
gccgcccccggtcagactgt

SEQ ID NO: 112276 - DNA, 20 bp, human
gtcacagaacagagtagagg

SEQ ID NO: 112277 - DNA, 20 bp, human
ggcggcggccggacccagac

SEQ ID NO: 112278 - DNA, 20 bp, human
gcagaacagagtagaggcgg

SEQ ID NO: 112279 - DNA, 20 bp, human
gaacagagtagaggcggcgg

SEQ ID NO: 112280 - DNA, 20 bp, human
gtaatgcagaaaggtcacga

SEQ ID NO: 112281 - DNA, 20 bp, human
gggaaacaggtcgggttagg

SEQ ID NO: 112282 - DNA, 20 bp, human
gcggacccagactggtagtg

SEQ ID NO: 112283 - DNA, 20 bp, human
gggaggaaacaggtcgggtt

SEQ ID NO: 112284 - DNA, 20 bp, human
gttattctggcaccagaacg

SEQ ID NO: 112285 - DNA, 20 bp, human
gtgcagaaaggtcacgaggg

SEQ ID NO: 112286 - DNA, 20 bp, human
ggcgagaggcgggtccaggc

SEQ ID NO: 112287 - DNA, 20 bp, human
ggaggaggttagacaccggc

SEQ ID NO: 112288 - DNA, 20 bp, human
ggcggcgcagccgagtctca

SEQ ID NO: 112289 - DNA, 20 bp, human
ggtccacgcggaaaagacgg

SEQ ID NO: 112290 - DNA, 20 bp, human
gctgcgccgcgaggaccggg

SEQ ID NO: 112291 - DNA, 20 bp, human
gcctcacaggacgaccccgg

SEQ ID NO: 112292 - DNA, 20 bp, human
ggacggctgaggcgacgtag

SEQ ID NO: 112293 - DNA, 20 bp, human
gcgaccccggaggccacggg

SEQ ID NO: 112294 - DNA, 20 bp, human
ggttaccggcgactagtatg

SEQ ID NO: 112295 - DNA, 20 bp, human
gccggtccacgcggaaaaga

SEQ ID NO: 112296 - DNA, 20 bp, human
gcagcagtagctgcttgcgg

SEQ ID NO: 112297 - DNA, 20 bp, human
gtagctgcgtaatcatactg

SEQ ID NO: 112298 - DNA, 20 bp, human
ggactgcagagagctgcagt

SEQ ID NO: 112299 - DNA, 20 bp, human
gtgctgggcttggagacgat

SEQ ID NO: 112300 - DNA, 20 bp, human
gggtggctaccacagagatc

SEQ ID NO: 112301 - DNA, 20 bp, human
ggaggctggtaatcagataa

SEQ ID NO: 112302 - DNA, 20 bp, human
ggccgagtcagagaaccgca

SEQ ID NO: 112303 - DNA, 20 bp, human
gactgaagcagtggcgacct

SEQ ID NO: 112304 - DNA, 20 bp, human
gttggagacgatgggaagtg

SEQ ID NO: 112305 - DNA, 20 bp, human
gtctctgtggtagccacctt

SEQ ID NO: 112306 - DNA, 20 bp, human
ggtggaggcttgggcgacag

SEQ ID NO: 112307 - DNA, 20 bp, human
gagaccgcgcgaccagagat

SEQ ID NO: 112308 - DNA, 20 bp, human
ggagatgtaccgcagccgaa

SEQ ID NO: 112309 - DNA, 20 bp, human
ggtggcggcaaggcctctcc

SEQ ID NO: 112310 - DNA, 20 bp, human
gacgggaggtctgactgcaa

SEQ ID NO: 112311 - DNA, 20 bp, human
gtcctcttcggcaaccccat

SEQ ID NO: 112312 - DNA, 20 bp, human
ggcagcggcagtggaggctt

SEQ ID NO: 112313 - DNA, 20 bp, human
ggaggtctgactgcaagggg

SEQ ID NO: 112314 - DNA, 20 bp, human
gatgggcagaaaatgactca

SEQ ID NO: 112315 - DNA, 20 bp, human
gggtctcatactgcgccatt

SEQ ID NO: 112316 - DNA, 20 bp, human
gcccaaagcgagcgaagcta

SEQ ID NO: 112317 - DNA, 20 bp, human
gacgcctcctgcggcagtgg

SEQ ID NO: 112318 - DNA, 20 bp, human
gccgcacctcacgcctcctg

SEQ ID NO: 112319 - DNA, 20 bp, human
gaggcgaagacggcgagagg

SEQ ID NO: 112320 - DNA, 20 bp, human
gtcgccgccactgccgcagg

SEQ ID NO: 112321 - DNA, 20 bp, human
gttctggtcggggcaggcag

SEQ ID NO: 112322 - DNA, 20 bp, human
gggcgtgaggtgcggagaca

SEQ ID NO: 112323 - DNA, 20 bp, human
gctgggcggcggccccttgg

SEQ ID NO: 112324 - DNA, 20 bp, human
ggcctgccccgaccagaacg

SEQ ID NO: 112325 - DNA, 20 bp, human
ggccgagggcatgtctgacg

SEQ ID NO: 112326 - DNA, 20 bp, human
ggaagccgcagaggtctagg

SEQ ID NO: 112327 - DNA, 20 bp, human
ggagccctcctagacctctg

SEQ ID NO: 112328 - DNA, 20 bp, human
gggagaagccgcagaggtct

SEQ ID NO: 112329 - DNA, 20 bp, human
gtcgggtgcagggcctctgc

SEQ ID NO: 112330 - DNA, 20 bp, human
gagctcaccggcgagatgga

SEQ ID NO: 112331 - DNA, 20 bp, human
ggatctctctggaccagctc

SEQ ID NO: 112332 - DNA, 20 bp, human
gcgcatccgcaagatctctc

SEQ ID NO: 112333 - DNA, 20 bp, human
gcttggatcttggcgagtag

SEQ ID NO: 112334 - DNA, 20 bp, human
gtccgagtcggccatgttag

SEQ ID NO: 112335 - DNA, 20 bp, human
gagaggccctgcacccgagc

SEQ ID NO: 112336 - DNA, 20 bp, human
gcgggccgcggaacacagat

SEQ ID NO: 112337 - DNA, 20 bp, human
ggagagacggtctgacatgg

SEQ ID NO: 112338 - DNA, 20 bp, human
ggaggagagacggtctgaca

SEQ ID NO: 112339 - DNA, 20 bp, human
gccgcggctgagtcttccca

SEQ ID NO: 112340 - DNA, 20 bp, human
gccgaggcgacactatcttg

SEQ ID NO: 112341 - DNA, 20 bp, human
gacctaggctgagaggacga

SEQ ID NO: 112342 - DNA, 20 bp, human
gggctgcgttgacgtcgcac

SEQ ID NO: 112343 - DNA, 20 bp, human
gacggtctgacatggcggaa

SEQ ID NO: 112344 - DNA, 20 bp, human
gcggagaggaacctgcaata

SEQ ID NO: 112345 - DNA, 20 bp, human
ggttagggcacgcagagctc

SEQ ID NO: 112346 - DNA, 20 bp, human
gggatccggagagcgtgtgg

SEQ ID NO: 112347 - DNA, 20 bp, human
gtgggggctgaggaaccctg

SEQ ID NO: 112348 - DNA, 20 bp, human
ggcacagcgagccggctgag

SEQ ID NO: 112349 - DNA, 20 bp, human
gcctgcggccgccagaggga

SEQ ID NO: 112350 - DNA, 20 bp, human
gggcgccttaaccctccctc

SEQ ID NO: 112351 - DNA, 20 bp, human
gaaaccccgcatcctcccag

SEQ ID NO: 112352 - DNA, 20 bp, human
ggccgccagagggagggtta

SEQ ID NO: 112353 - DNA, 20 bp, human
ggaggccgagaagcgagtca

SEQ ID NO: 112354 - DNA, 20 bp, human
gggagttctgccggccctag

SEQ ID NO: 112355 - DNA, 20 bp, human
ggggtccctgtgagactctg

SEQ ID NO: 112356 - DNA, 20 bp, human
ggcatctccgagatgaggga

SEQ ID NO: 112357 - DNA, 20 bp, human
gagtggagcgggctgagagt

SEQ ID NO: 112358 - DNA, 20 bp, human
gtaaaaggggagaaacctgt

SEQ ID NO: 112359 - DNA, 20 bp, human
ggccctgtcgctcacaagtg

SEQ ID NO: 112360 - DNA, 20 bp, human
ggccggaagccgcggaactg

SEQ ID NO: 112361 - DNA, 20 bp, human
gggaagccgcggaactgagg

SEQ ID NO: 112362 - DNA, 20 bp, human
gttgctccgcccagagaccg

SEQ ID NO: 112363 - DNA, 20 bp, human
gtgcctcctccacggtctct

SEQ ID NO: 112364 - DNA, 20 bp, human
gattcttcggcgaagtggag

SEQ ID NO: 112365 - DNA, 20 bp, human
ggtgcggcatctccgagatg

SEQ ID NO: 112366 - DNA, 20 bp, human
ggcggccttagcacccgggg

SEQ ID NO: 112367 - DNA, 20 bp, human
gggctcagaagataaacgag

SEQ ID NO: 112368 - DNA, 20 bp, human
gcacagtcaggtctctgacg

SEQ ID NO: 112369 - DNA, 20 bp, human
gttcttggcgccggaggaag

SEQ ID NO: 112370 - DNA, 20 bp, human
gggtctctgacgtggagaga

SEQ ID NO: 112371 - DNA, 20 bp, human
gccccgggagtgtgacccag

SEQ ID NO: 112372 - DNA, 20 bp, human
gcgctccccagagccggtgt

SEQ ID NO: 112373 - DNA, 20 bp, human
gctgctcctgaagattgtgg

SEQ ID NO: 112374 - DNA, 20 bp, human
gagccgccatctccacagtc

SEQ ID NO: 112375 - DNA, 20 bp, human
ggtgagtgagaaccttccgg

SEQ ID NO: 112376 - DNA, 20 bp, human
gggaaggcgagggagccctc

SEQ ID NO: 112377 - DNA, 20 bp, human
gtcggtgctgcccccagaca

SEQ ID NO: 112378 - DNA, 20 bp, human
gacgcaggatccgtgtctgg

SEQ ID NO: 112379 - DNA, 20 bp, human
gccggacgtcgggagcagga

SEQ ID NO: 112380 - DNA, 20 bp, human
gcagagacacgagcgactgg

SEQ ID NO: 112381 - DNA, 20 bp, human
gggagcagtcgagggcccga

SEQ ID NO: 112382 - DNA, 20 bp, human
ggcccggtcttggtcaccag

SEQ ID NO: 112383 - DNA, 20 bp, human
gtgccaggcggcggaaaggg

SEQ ID NO: 112384 - DNA, 20 bp, human
gaccggtcgtgggacatggg

SEQ ID NO: 112385 - DNA, 20 bp, human
gcggggcggagtccggacgt

SEQ ID NO: 112386 - DNA, 20 bp, human
gggatcagtgtggccccgga

SEQ ID NO: 112387 - DNA, 20 bp, human
gaccaggctgtcacccctaa

SEQ ID NO: 112388 - DNA, 20 bp, human
gggtggtggagacatcgctg

SEQ ID NO: 112389 - DNA, 20 bp, human
ggagacatcgctggggacct

SEQ ID NO: 112390 - DNA, 20 bp, human
gctgaatgtggagccttccg

SEQ ID NO: 112391 - DNA, 20 bp, human
ggtgtgaacccaggtgtcct

SEQ ID NO: 112392 - DNA, 20 bp, human
gtgggagtcctagacttaaa

SEQ ID NO: 112393 - DNA, 20 bp, human
gaggcagaaaatccctccta

SEQ ID NO: 112394 - DNA, 20 bp, human
gaaggttggggtggtagatg

SEQ ID NO: 112395 - DNA, 20 bp, human
gtgtcagagtggagccctta

SEQ ID NO: 112396 - DNA, 20 bp, human
gtcagcctcagggaagcacc

SEQ ID NO: 112397 - DNA, 20 bp, human
gagggaagcaccgggagact

SEQ ID NO: 112398 - DNA, 20 bp, human
gcagtggtgtcccagtctcc

SEQ ID NO: 112399 - DNA, 20 bp, human
gccacagtccgagtaaacag

SEQ ID NO: 112400 - DNA, 20 bp, human
ggacaacaaagggccgcggg

SEQ ID NO: 112401 - DNA, 20 bp, human
gtccgagtaaacagcggtcg

SEQ ID NO: 112402 - DNA, 20 bp, human
gctgctcggtgaccctcaga

SEQ ID NO: 112403 - DNA, 20 bp, human
gcaccgagcagccggtgcag

SEQ ID NO: 112404 - DNA, 20 bp, human
gcgtcgggggaggacaacaa

SEQ ID NO: 112405 - DNA, 20 bp, human
ggagtaaacagcggtcgtgg

SEQ ID NO: 112406 - DNA, 20 bp, human
ggctgcagcgccccgctgaa

SEQ ID NO: 112407 - DNA, 20 bp, human
gtcatggcgtcgcccttcag

SEQ ID NO: 112408 - DNA, 20 bp, human
ggcgctgcagctgacggacc

SEQ ID NO: 112409 - DNA, 20 bp, human
gcggcccgatgaagtcatcc

SEQ ID NO: 112410 - DNA, 20 bp, human
gccctccagctgcgacccag

SEQ ID NO: 112411 - DNA, 20 bp, human
gcagctgcgacccaggggtc

SEQ ID NO: 112412 - DNA, 20 bp, human
ggttagggttagggatgtgt

SEQ ID NO: 112413 - DNA, 20 bp, human
gtcatcgggccgtctcaggt

SEQ ID NO: 112414 - DNA, 20 bp, human
gtaaccctaacccgacccct

SEQ ID NO: 112415 - DNA, 20 bp, human
gtagcgacacctgcgcgcgg

SEQ ID NO: 112416 - DNA, 20 bp, human
ggggcgcgcgcgacaatgtg

SEQ ID NO: 112417 - DNA, 20 bp, human
gcactgggtcgaagtgtgag

SEQ ID NO: 112418 - DNA, 20 bp, human
ggacaccgaacgggcccgac

SEQ ID NO: 112419 - DNA, 20 bp, human
gccgccgcggaccatgaggt

SEQ ID NO: 112420 - DNA, 20 bp, human
gccgcccacctcatggtccg

SEQ ID NO: 112421 - DNA, 20 bp, human
gagcgggcgtgctcatgcag

SEQ ID NO: 112422 - DNA, 20 bp, human
gtgtgagaggtagattaagt

SEQ ID NO: 112423 - DNA, 20 bp, human
gcggccacatcctttaaata

SEQ ID NO: 112424 - DNA, 20 bp, human
gagagccgccgcggaccatg

SEQ ID NO: 112425 - DNA, 20 bp, human
ggcgcagagccaggagcaaa

SEQ ID NO: 112426 - DNA, 20 bp, human
gcgccacacggggtcagtgt

SEQ ID NO: 112427 - DNA, 20 bp, human
ggggccgctctgtaatggta

SEQ ID NO: 112428 - DNA, 20 bp, human
gcccccgggccgctctgtaa

SEQ ID NO: 112429 - DNA, 20 bp, human
gtacccggctgcgccttcat

SEQ ID NO: 112430 - DNA, 20 bp, human
gggagcggccccgccacacg

SEQ ID NO: 112431 - DNA, 20 bp, human
ggaggccctgtagccggact

SEQ ID NO: 112432 - DNA, 20 bp, human
ggccgggtatagaggtgcag

SEQ ID NO: 112433 - DNA, 20 bp, human
gggagacccgacgtcatctc

SEQ ID NO: 112434 - DNA, 20 bp, human
gaaggcgcagccgggtatag

SEQ ID NO: 112435 - DNA, 20 bp, human
gtgcccacactgaccccgtg

SEQ ID NO: 112436 - DNA, 20 bp, human
gtgaagaactgcaggagtag

SEQ ID NO: 112437 - DNA, 20 bp, human
gtgcaggcatggtgctaggt

SEQ ID NO: 112438 - DNA, 20 bp, human
gtggagtcataagacggcgt

SEQ ID NO: 112439 - DNA, 20 bp, human
ggagtctcagcgcaatcggg

SEQ ID NO: 112440 - DNA, 20 bp, human
ggtggccctggtcacctcca

SEQ ID NO: 112441 - DNA, 20 bp, human
ggcacgttggagtcataaga

SEQ ID NO: 112442 - DNA, 20 bp, human
gggaaaccgccggtgcacgt

SEQ ID NO: 112443 - DNA, 20 bp, human
ggtgggtgagactcagtgta

SEQ ID NO: 112444 - DNA, 20 bp, human
ggagactcaggcgctgggac

SEQ ID NO: 112445 - DNA, 20 bp, human
ggcggggcgcccactctggt

SEQ ID NO: 112446 - DNA, 20 bp, human
gtaaacctacgaacagaacc

SEQ ID NO: 112447 - DNA, 20 bp, human
gcggcccgggttctgttcgt

SEQ ID NO: 112448 - DNA, 20 bp, human
ggcggaatggacaggacact

SEQ ID NO: 112449 - DNA, 20 bp, human
ggagaaagcgcgcagccgag

SEQ ID NO: 112450 - DNA, 20 bp, human
ggcgtcccgcacgctcagtt

SEQ ID NO: 112451 - DNA, 20 bp, human
gaagcggcgttggcgtggtg

SEQ ID NO: 112452 - DNA, 20 bp, human
gagcgtgcgggacgctctcg

SEQ ID NO: 112453 - DNA, 20 bp, human
gcacgtgcagttggcagctg

SEQ ID NO: 112454 - DNA, 20 bp, human
gcgtagcgtgatgacgtaag

SEQ ID NO: 112455 - DNA, 20 bp, human
ggaagcggagaggttctgtg

SEQ ID NO: 112456 - DNA, 20 bp, human
ggctgcccccggcaagatgg

SEQ ID NO: 112457 - DNA, 20 bp, human
gggagaaggggcagaccggt

SEQ ID NO: 112458 - DNA, 20 bp, human
ggaggtggcgaaccagcgaa

SEQ ID NO: 112459 - DNA, 20 bp, human
ggcggccgccatcttgccgg

SEQ ID NO: 112460 - DNA, 20 bp, human
gatcttgccgggggcagcgg

SEQ ID NO: 112461 - DNA, 20 bp, human
gtaaggcactggccagtccg

SEQ ID NO: 112462 - DNA, 20 bp, human
gcgcgcagcagcggtaacgg

SEQ ID NO: 112463 - DNA, 20 bp, human
gcgcggggagggctaatgga

SEQ ID NO: 112464 - DNA, 20 bp, human
gcgctggttcgccacctcag

SEQ ID NO: 112465 - DNA, 20 bp, human
gatggcggccgcgaaaagcg

SEQ ID NO: 112466 - DNA, 20 bp, human
gaacccaacagtttgaatca

SEQ ID NO: 112467 - DNA, 20 bp, human
ggttatttcagccggcaacc

SEQ ID NO: 112468 - DNA, 20 bp, human
ggctgaaataacctggtaag

SEQ ID NO: 112469 - DNA, 20 bp, human
gggtaagtggaactctgtaa

SEQ ID NO: 112470 - DNA, 20 bp, human
gcccacatccaaggtctatg

SEQ ID NO: 112471 - DNA, 20 bp, human
gtgcaatcctcccacatcca

SEQ ID NO: 112472 - DNA, 20 bp, human
gtcctcatagaccttggatg

SEQ ID NO: 112473 - DNA, 20 bp, human
gtcactactccacagcttag

SEQ ID NO: 112474 - DNA, 20 bp, human
gtttgggacacacaccactg

SEQ ID NO: 112475 - DNA, 20 bp, human
ggcttagtggtgacagttac

SEQ ID NO: 112476 - DNA, 20 bp, human
gtgtctaccagttcctgaga

SEQ ID NO: 112477 - DNA, 20 bp, human
ggacaccaggcatacgctag

SEQ ID NO: 112478 - DNA, 20 bp, human
gggagtcggggtgaatgggt

SEQ ID NO: 112479 - DNA, 20 bp, human
gccaggcttactacgtgacc

SEQ ID NO: 112480 - DNA, 20 bp, human
gctgagagggacgcgtgccg

SEQ ID NO: 112481 - DNA, 20 bp, human
gacgcgtccctctcaggaac

SEQ ID NO: 112482 - DNA, 20 bp, human
gggaacaactccgaaagaga

SEQ ID NO: 112483 - DNA, 20 bp, human
gctggggagtcggggtgaat

SEQ ID NO: 112484 - DNA, 20 bp, human
gtacaggcactacttagagg

SEQ ID NO: 112485 - DNA, 20 bp, human
ggcactgcgggcaagctcca

SEQ ID NO: 112486 - DNA, 20 bp, human
ggaccagcaagcacctgcac

SEQ ID NO: 112487 - DNA, 20 bp, human
gaaccttgtcgaaggaccaa

SEQ ID NO: 112488 - DNA, 20 bp, human
gaagtaggtcagcgtcaggg

SEQ ID NO: 112489 - DNA, 20 bp, human
ggctgctccctacccctcgg

SEQ ID NO: 112490 - DNA, 20 bp, human
gacgccagctcccttctggg

SEQ ID NO: 112491 - DNA, 20 bp, human
gacctggtgagaacataagt

SEQ ID NO: 112492 - DNA, 20 bp, human
gcgcctttggtccttcgaca

SEQ ID NO: 112493 - DNA, 20 bp, human
ggttgctgctccctacccct

SEQ ID NO: 112494 - DNA, 20 bp, human
gtccccaaagctcccccgag

SEQ ID NO: 112495 - DNA, 20 bp, human
gcaggccccggccccccaga

SEQ ID NO: 112496 - DNA, 20 bp, human
ggtaaggactgggagtccca

SEQ ID NO: 112497 - DNA, 20 bp, human
ggtcccagggcaaggctcat

SEQ ID NO: 112498 - DNA, 20 bp, human
gccgactccagcgcgatctg

SEQ ID NO: 112499 - DNA, 20 bp, human
gcccagtgaaccgacagccc

SEQ ID NO: 112500 - DNA, 20 bp, human
gcagcgcgatctgcggaccg

SEQ ID NO: 112501 - DNA, 20 bp, human
ggtcaagagacagcacccgg

SEQ ID NO: 112502 - DNA, 20 bp, human
gcaagcaggtgagaaggaca

SEQ ID NO: 112503 - DNA, 20 bp, human
gtcccctgggtcaaagggtc

SEQ ID NO: 112504 - DNA, 20 bp, human
gcaaagggtctggtaaggac

SEQ ID NO: 112505 - DNA, 20 bp, human
gaccagaccctttgacccag

SEQ ID NO: 112506 - DNA, 20 bp, human
gcggagcccgactctaacgt

SEQ ID NO: 112507 - DNA, 20 bp, human
gctaacgtcggtcagcgctg

SEQ ID NO: 112508 - DNA, 20 bp, human
gcccgaacccctgaaccgat

SEQ ID NO: 112509 - DNA, 20 bp, human
gcgcgtcgccaacggagctg

SEQ ID NO: 112510 - DNA, 20 bp, human
gggggcgcccatcggttcag

SEQ ID NO: 112511 - DNA, 20 bp, human
ggctgaccgacgttagagtc

SEQ ID NO: 112512 - DNA, 20 bp, human
gcggctccggcgaggtaggg

SEQ ID NO: 112513 - DNA, 20 bp, human
gccctgggcgccggaccctg

SEQ ID NO: 112514 - DNA, 20 bp, human
ggggagcgacatggcaacag

SEQ ID NO: 112515 - DNA, 20 bp, human
ggaaggccaccgcccctcag

SEQ ID NO: 112516 - DNA, 20 bp, human
gtggccagcaaccaggaact

SEQ ID NO: 112517 - DNA, 20 bp, human
gtacagaccttggaagcaag

SEQ ID NO: 112518 - DNA, 20 bp, human
gcttactttggccagcaacc

SEQ ID NO: 112519 - DNA, 20 bp, human
gcaggccataatggaaaggg

SEQ ID NO: 112520 - DNA, 20 bp, human
gtgacaatagcagaccctga

SEQ ID NO: 112521 - DNA, 20 bp, human
gtctttgacacatattgaaa

SEQ ID NO: 112522 - DNA, 20 bp, human
gtggggtcgcctaggacaag

SEQ ID NO: 112523 - DNA, 20 bp, human
gagcactttattacagacct

SEQ ID NO: 112524 - DNA, 20 bp, human
ggcagtgtactttgaaagtg

SEQ ID NO: 112525 - DNA, 20 bp, human
gatggatcccctcttgtcct

SEQ ID NO: 112526 - DNA, 20 bp, human
gcgacaacgttggcccccag

SEQ ID NO: 112527 - DNA, 20 bp, human
gggcgtgccgcaggacgcga

SEQ ID NO: 112528 - DNA, 20 bp, human
gctgcagccgtcgcgtcctg

SEQ ID NO: 112529 - DNA, 20 bp, human
gagccccgcccacagtgggt

SEQ ID NO: 112530 - DNA, 20 bp, human
ggggtggggtcggcactgaa

SEQ ID NO: 112531 - DNA, 20 bp, human
ggccccaggatccgccccta

SEQ ID NO: 112532 - DNA, 20 bp, human
gtgtcggaccgaggagtccg

SEQ ID NO: 112533 - DNA, 20 bp, human
gacgcgcggggtggacctac

SEQ ID NO: 112534 - DNA, 20 bp, human
ggcgacgcgcgggtgctggg

SEQ ID NO: 112535 - DNA, 20 bp, human
gaaccgaggcccgggagaga

SEQ ID NO: 112536 - DNA, 20 bp, human
gcaggcagtctactttccag

SEQ ID NO: 112537 - DNA, 20 bp, human
gtccctggagaaggacaaaa

SEQ ID NO: 112538 - DNA, 20 bp, human
gacagaaaaaggaagagcgg

SEQ ID NO: 112539 - DNA, 20 bp, human
ggcttctccgtgcattgagg

SEQ ID NO: 112540 - DNA, 20 bp, human
gattcaggagccaagcaata

SEQ ID NO: 112541 - DNA, 20 bp, human
gaggagccaagcaataaggc

SEQ ID NO: 112542 - DNA, 20 bp, human
gttgagggggcacctacctc

SEQ ID NO: 112543 - DNA, 20 bp, human
ggacaaaagggttgcacgtg

SEQ ID NO: 112544 - DNA, 20 bp, human
gagtttttaggttgctgaag

SEQ ID NO: 112545 - DNA, 20 bp, human
gtctgtccaacacaagtttc

SEQ ID NO: 112546 - DNA, 20 bp, human
gcaatgagcaccgtggtcag

SEQ ID NO: 112547 - DNA, 20 bp, human
gcaggagagcgaccgcaagt

SEQ ID NO: 112548 - DNA, 20 bp, human
ggcgaccgcaagtaggtcgt

SEQ ID NO: 112549 - DNA, 20 bp, human
ggagaccaggagtagggcaa

SEQ ID NO: 112550 - DNA, 20 bp, human
gaacacgagggccagaatcc

SEQ ID NO: 112551 - DNA, 20 bp, human
gcaagcccacgacctacttg

SEQ ID NO: 112552 - DNA, 20 bp, human
gaggcagcttcagtaatcgc

SEQ ID NO: 112553 - DNA, 20 bp, human
gaatcctacctgagtgagtg

SEQ ID NO: 112554 - DNA, 20 bp, human
gttcagtaatcgccggaagg

SEQ ID NO: 112555 - DNA, 20 bp, human
gactcctggtctctggctcc

SEQ ID NO: 112556 - DNA, 20 bp, human
ggatgccgtcgtagaagatg

SEQ ID NO: 112557 - DNA, 20 bp, human
gacacgccgcgcccccccgg

SEQ ID NO: 112558 - DNA, 20 bp, human
ggtctgcgagacgaagatcg

SEQ ID NO: 112559 - DNA, 20 bp, human
gtgcatccgcgagttccgtg

SEQ ID NO: 112560 - DNA, 20 bp, human
gagcgcctcatggtcctcgg

SEQ ID NO: 112561 - DNA, 20 bp, human
gcgcgccgcatcttctacga

SEQ ID NO: 112562 - DNA, 20 bp, human
gatggagcgcatccctaaca

SEQ ID NO: 112563 - DNA, 20 bp, human
gtctcgcagaccatgtcggg

SEQ ID NO: 112564 - DNA, 20 bp, human
gtcgtctcgcagaccatgtc

SEQ ID NO: 112565 - DNA, 20 bp, human
gcggcgcgccgcctcctgct

SEQ ID NO: 112566 - DNA, 20 bp, human
ggggagtggacggaaggaac

SEQ ID NO: 112567 - DNA, 20 bp, human
gggagtggctagagccccgt

SEQ ID NO: 112568 - DNA, 20 bp, human
gctgcgggggacgatttcgt

SEQ ID NO: 112569 - DNA, 20 bp, human
gcctcttggagtgggagtca

SEQ ID NO: 112570 - DNA, 20 bp, human
gccggccgggcctgggaacg

SEQ ID NO: 112571 - DNA, 20 bp, human
ggaaatcgtcccccgcagaa

SEQ ID NO: 112572 - DNA, 20 bp, human
ggttctggggagtggacgga

SEQ ID NO: 112573 - DNA, 20 bp, human
gggtcgccggggtaagaggt

SEQ ID NO: 112574 - DNA, 20 bp, human
gcttgccctgaagtggtcgg

SEQ ID NO: 112575 - DNA, 20 bp, human
gtctcacgcgcatgcggaag

SEQ ID NO: 112576 - DNA, 20 bp, human
gtgcagctccgagcagagga

SEQ ID NO: 112577 - DNA, 20 bp, human
gagccagccagcccgagtcg

SEQ ID NO: 112578 - DNA, 20 bp, human
gagggagagaggcaagccga

SEQ ID NO: 112579 - DNA, 20 bp, human
ggggaagccggggagcgata

SEQ ID NO: 112580 - DNA, 20 bp, human
ggcgcgtctgcaggcacggg

SEQ ID NO: 112581 - DNA, 20 bp, human
gctgcaggcacggggggagg

SEQ ID NO: 112582 - DNA, 20 bp, human
gtcctcgcgggcagaatgct

SEQ ID NO: 112583 - DNA, 20 bp, human
gcggaagaaaccgaggaaga

SEQ ID NO: 112584 - DNA, 20 bp, human
gctgcagcctcgactcgggc

SEQ ID NO: 112585 - DNA, 20 bp, human
gcggggcgccggcaggaagg

SEQ ID NO: 112586 - DNA, 20 bp, human
gggctggcgggaactctgtc

SEQ ID NO: 112587 - DNA, 20 bp, human
gggtgtcttgacttactggt

SEQ ID NO: 112588 - DNA, 20 bp, human
ggatgcttccaaatccacag

SEQ ID NO: 112589 - DNA, 20 bp, human
gggactggaagatcaaaaga

SEQ ID NO: 112590 - DNA, 20 bp, human
gccggaaggaggtagcatgg

SEQ ID NO: 112591 - DNA, 20 bp, human
gaagccagttatccacggac

SEQ ID NO: 112592 - DNA, 20 bp, human
ggaggtggtgctgatttcct

SEQ ID NO: 112593 - DNA, 20 bp, human
gagagaaagccagttatcca

SEQ ID NO: 112594 - DNA, 20 bp, human
gagtgtgattcagagagcat

SEQ ID NO: 112595 - DNA, 20 bp, human
ggagtggattttaagaagac

SEQ ID NO: 112596 - DNA, 20 bp, human
gtggggttgcctcaaaactg

SEQ ID NO: 112597 - DNA, 20 bp, human
ggttggagtctaccagactg

SEQ ID NO: 112598 - DNA, 20 bp, human
gtcggaagagcagtatgcac

SEQ ID NO: 112599 - DNA, 20 bp, human
gactgaggcagccagctgtt

SEQ ID NO: 112600 - DNA, 20 bp, human
gacccagtagtgccaagatt

SEQ ID NO: 112601 - DNA, 20 bp, human
ggagagaagaaacccctcca

SEQ ID NO: 112602 - DNA, 20 bp, human
gttgaggcaaccccaagaac

SEQ ID NO: 112603 - DNA, 20 bp, human
gtagtgccaagatttggtat

SEQ ID NO: 112604 - DNA, 20 bp, human
gaccaaatcttggcactact

SEQ ID NO: 112605 - DNA, 20 bp, human
gctgtttcagtaagttccaa

SEQ ID NO: 112606 - DNA, 20 bp, human
ggagtcctcggcgaacatgg

SEQ ID NO: 112607 - DNA, 20 bp, human
gcagcggaggagtgtctcta

SEQ ID NO: 112608 - DNA, 20 bp, human
gcatggcggcccccgagtca

SEQ ID NO: 112609 - DNA, 20 bp, human
gcgtagcaggagccacgtag

SEQ ID NO: 112610 - DNA, 20 bp, human
gctcaaagccggccctgact

SEQ ID NO: 112611 - DNA, 20 bp, human
gcttggcgcgggcgcttcgt

SEQ ID NO: 112612 - DNA, 20 bp, human
gcacgtaggggagtggagac

SEQ ID NO: 112613 - DNA, 20 bp, human
gaaagccggccctgactcgg

SEQ ID NO: 112614 - DNA, 20 bp, human
gtaggggagtggagacgggt

SEQ ID NO: 112615 - DNA, 20 bp, human
gtgagtccaggcactgcaga

SEQ ID NO: 112616 - DNA, 20 bp, human
gggcaacatggcggagtgag

SEQ ID NO: 112617 - DNA, 20 bp, human
gaacatggcggagtgagcgg

SEQ ID NO: 112618 - DNA, 20 bp, human
gcggggcttcacaacaacag

SEQ ID NO: 112619 - DNA, 20 bp, human
ggcagggggcggcaacatgg

SEQ ID NO: 112620 - DNA, 20 bp, human
gggcttcacaacaacagtgg

SEQ ID NO: 112621 - DNA, 20 bp, human
gggagtgagcggcggcgtcg

SEQ ID NO: 112622 - DNA, 20 bp, human
gcaggcagggggcggcaaca

SEQ ID NO: 112623 - DNA, 20 bp, human
gtggctgctaccgcaggcag

SEQ ID NO: 112624 - DNA, 20 bp, human
ggcgcagtggctgctaccgc

SEQ ID NO: 112625 - DNA, 20 bp, human
ggcagcagcgtcaatagcat

SEQ ID NO: 112626 - DNA, 20 bp, human
ggtgaggggcggctttgagt

SEQ ID NO: 112627 - DNA, 20 bp, human
gccgctcgtctgcctggctg

SEQ ID NO: 112628 - DNA, 20 bp, human
ggaagtgggcacgcacacac

SEQ ID NO: 112629 - DNA, 20 bp, human
gcgccttgggaaggggtcga

SEQ ID NO: 112630 - DNA, 20 bp, human
gcctggctgcggggtgacac

SEQ ID NO: 112631 - DNA, 20 bp, human
ggtcgagggaagcagttaga

SEQ ID NO: 112632 - DNA, 20 bp, human
gttccctcgaccccttccca

SEQ ID NO: 112633 - DNA, 20 bp, human
gtgagtgggctaggctgtca

SEQ ID NO: 112634 - DNA, 20 bp, human
gcccaagacaacccaaacag

SEQ ID NO: 112635 - DNA, 20 bp, human
ggacgagcgggcgggacatg

SEQ ID NO: 112636 - DNA, 20 bp, human
gggccatggccgcctcggag

SEQ ID NO: 112637 - DNA, 20 bp, human
gcaggccgcgcccaagggag

SEQ ID NO: 112638 - DNA, 20 bp, human
gtgccctcggccaggcccat

SEQ ID NO: 112639 - DNA, 20 bp, human
gctggccgagggcaaccggc

SEQ ID NO: 112640 - DNA, 20 bp, human
gcgacaggtggcgcgcagca

SEQ ID NO: 112641 - DNA, 20 bp, human
gcctctagcaagaaagactc

SEQ ID NO: 112642 - DNA, 20 bp, human
gcccaaggcataagtgccag

SEQ ID NO: 112643 - DNA, 20 bp, human
gaactcgtacagccgctccg

SEQ ID NO: 112644 - DNA, 20 bp, human
gaggagagtggcctgggccg

SEQ ID NO: 112645 - DNA, 20 bp, human
ggccgagggcaaccggcggg

SEQ ID NO: 112646 - DNA, 20 bp, human
gcctggcagcgcctagacct

SEQ ID NO: 112647 - DNA, 20 bp, human
ggccccagagctggttccat

SEQ ID NO: 112648 - DNA, 20 bp, human
gggcgctgccaggaaaactt

SEQ ID NO: 112649 - DNA, 20 bp, human
gaggactgcaggcattaggg

SEQ ID NO: 112650 - DNA, 20 bp, human
gccaggtaaccagcaagggt

SEQ ID NO: 112651 - DNA, 20 bp, human
gcctaggactgcaggcatta

SEQ ID NO: 112652 - DNA, 20 bp, human
gaggtcagcatcagagagtt

SEQ ID NO: 112653 - DNA, 20 bp, human
gactgcaggcattagggagg

SEQ ID NO: 112654 - DNA, 20 bp, human
ggggtccaggtaaccagcaa

SEQ ID NO: 112655 - DNA, 20 bp, human
gtaaagaaggctactgaagg

SEQ ID NO: 112656 - DNA, 20 bp, human
gcgcctcgccgagcctcctg

SEQ ID NO: 112657 - DNA, 20 bp, human
gatccagaaacggaaccctg

SEQ ID NO: 112658 - DNA, 20 bp, human
gcgggcccgggcgccccagg

SEQ ID NO: 112659 - DNA, 20 bp, human
gtccgcggccgggggagaga

SEQ ID NO: 112660 - DNA, 20 bp, human
ggcagcccagccgagcgtcg

SEQ ID NO: 112661 - DNA, 20 bp, human
gctcggcgaggcggccggca

SEQ ID NO: 112662 - DNA, 20 bp, human
ggaaccctggggcgagtctg

SEQ ID NO: 112663 - DNA, 20 bp, human
gcgtccccagactcgcccca

SEQ ID NO: 112664 - DNA, 20 bp, human
gacgccggcgctggggacgt

SEQ ID NO: 112665 - DNA, 20 bp, human
ggcgggcgcccggcttccag

SEQ ID NO: 112666 - DNA, 20 bp, human
gacatcggtccggctcctca

SEQ ID NO: 112667 - DNA, 20 bp, human
gtgctagacgagcgcggata

SEQ ID NO: 112668 - DNA, 20 bp, human
gcccggcaggaagttagcat

SEQ ID NO: 112669 - DNA, 20 bp, human
gacgtgcaaccgcgtaaccg

SEQ ID NO: 112670 - DNA, 20 bp, human
gtggatggcctgcgggtaag

SEQ ID NO: 112671 - DNA, 20 bp, human
gtctagcagccccggttacg

SEQ ID NO: 112672 - DNA, 20 bp, human
ggcatgggcggaccacacgg

SEQ ID NO: 112673 - DNA, 20 bp, human
gcgcggaggactgccaccag

SEQ ID NO: 112674 - DNA, 20 bp, human
gcggcgcctgcggtcggcat

SEQ ID NO: 112675 - DNA, 20 bp, human
gccgcgccgttgcagcgcta

SEQ ID NO: 112676 - DNA, 20 bp, human
gacgagagttgggctgcggg

SEQ ID NO: 112677 - DNA, 20 bp, human
gcacgcccatcgggatcctg

SEQ ID NO: 112678 - DNA, 20 bp, human
gaatccagcgcggggaactc

SEQ ID NO: 112679 - DNA, 20 bp, human
gggcgtgtcaggataaccca

SEQ ID NO: 112680 - DNA, 20 bp, human
gggctcctcaggatcccgat

SEQ ID NO: 112681 - DNA, 20 bp, human
ggttatcctgacacgcccat

SEQ ID NO: 112682 - DNA, 20 bp, human
gccgagcttctgagcgagcg

SEQ ID NO: 112683 - DNA, 20 bp, human
gcgcgtaacttcccattcac

SEQ ID NO: 112684 - DNA, 20 bp, human
gaacggatttctggcctgga

SEQ ID NO: 112685 - DNA, 20 bp, human
gggatcccgatgggcgtgtc

SEQ ID NO: 112686 - DNA, 20 bp, human
ggcctgcagtcctaaacgct

SEQ ID NO: 112687 - DNA, 20 bp, human
gccggagctacccagcgttt

SEQ ID NO: 112688 - DNA, 20 bp, human
ggtcagactatggggcggtg

SEQ ID NO: 112689 - DNA, 20 bp, human
gcggaagtcagactatgggg

SEQ ID NO: 112690 - DNA, 20 bp, human
ggcccggaagtcagactatg

SEQ ID NO: 112691 - DNA, 20 bp, human
gtagctccgggcttccgagg

SEQ ID NO: 112692 - DNA, 20 bp, human
ggcggcggtggagatagcgg

SEQ ID NO: 112693 - DNA, 20 bp, human
gccgcaagcaagttgctggg

SEQ ID NO: 112694 - DNA, 20 bp, human
gatagcggcggtgctgggag

SEQ ID NO: 112695 - DNA, 20 bp, human
gaatggaggacagagcgcag

SEQ ID NO: 112696 - DNA, 20 bp, human
gcaggagcggggccgaggta

SEQ ID NO: 112697 - DNA, 20 bp, human
gcccagcgttccggaggtga

SEQ ID NO: 112698 - DNA, 20 bp, human
gaatggaggacagagcgcag

SEQ ID NO: 112699 - DNA, 20 bp, human
gagtccacccagcgttccgg

SEQ ID NO: 112700 - DNA, 20 bp, human
gccgggcgggaggtgagtct

SEQ ID NO: 112701 - DNA, 20 bp, human
ggaggtgagtctgggacctg

SEQ ID NO: 112702 - DNA, 20 bp, human
gccgcaagcaagttgctggg

SEQ ID NO: 112703 - DNA, 20 bp, human
ggcggcggtggagatagcgg

SEQ ID NO: 112704 - DNA, 20 bp, human
gtcagcgaattgcagggtca

SEQ ID NO: 112705 - DNA, 20 bp, human
gatagcggcggtgctgggag

SEQ ID NO: 112706 - DNA, 20 bp, human
gtcgctccaggcttccgagg

SEQ ID NO: 112707 - DNA, 20 bp, human
ggggtcgctccaggcttccg

SEQ ID NO: 112708 - DNA, 20 bp, human
gctggagcgaccccgcgttt

SEQ ID NO: 112709 - DNA, 20 bp, human
ggacttccgggctccgcccg

SEQ ID NO: 112710 - DNA, 20 bp, human
ggtcagactatggggcggtg

SEQ ID NO: 112711 - DNA, 20 bp, human
gccgcaagcaagttgctggg

SEQ ID NO: 112712 - DNA, 20 bp, human
gcggaagtcagactatgggg

SEQ ID NO: 112713 - DNA, 20 bp, human
ggtctcccgcctctttaacc

SEQ ID NO: 112714 - DNA, 20 bp, human
ggcccggaagtcagactatg

SEQ ID NO: 112715 - DNA, 20 bp, human
gaagcctgcagtcctaaacg

SEQ ID NO: 112716 - DNA, 20 bp, human
gatttatcaaacagaggagg

SEQ ID NO: 112717 - DNA, 20 bp, human
gaatatttatcaaacagagg

SEQ ID NO: 112718 - DNA, 20 bp, human
gacaaatatttatcaaacag

SEQ ID NO: 112719 - DNA, 20 bp, human
ggaagtacagcagctcggtg

SEQ ID NO: 112720 - DNA, 20 bp, human
ggaggatagtaaaaatgtat

SEQ ID NO: 112721 - DNA, 20 bp, human
ggtgtgtagcgagcctgcca

SEQ ID NO: 112722 - DNA, 20 bp, human
gtctctgaagtacagcagct

SEQ ID NO: 112723 - DNA, 20 bp, human
gaatgagcgacagttcaagg

SEQ ID NO: 112724 - DNA, 20 bp, human
gaggtgaggggaccccatgg

SEQ ID NO: 112725 - DNA, 20 bp, human
ggagcagctcaagcaagctg

SEQ ID NO: 112726 - DNA, 20 bp, human
gcttccccagcgcccaagga

SEQ ID NO: 112727 - DNA, 20 bp, human
ggctctcctgacgcgccggg

SEQ ID NO: 112728 - DNA, 20 bp, human
ggggtcccgcccggcgcgtc

SEQ ID NO: 112729 - DNA, 20 bp, human
gttgggctctcctgacgcgc

SEQ ID NO: 112730 - DNA, 20 bp, human
gcgcagccctccttgggcgc

SEQ ID NO: 112731 - DNA, 20 bp, human
gacagcggcggtatcgggag

SEQ ID NO: 112732 - DNA, 20 bp, human
ggcccaaggagggctgcggg

SEQ ID NO: 112733 - DNA, 20 bp, human
gacgcatggaacttaagccc

SEQ ID NO: 112734 - DNA, 20 bp, human
gcatggaacttaagccccgg

SEQ ID NO: 112735 - DNA, 20 bp, human
gttgagacagcggcggtatc

SEQ ID NO: 112736 - DNA, 20 bp, human
gcggcggtactgggatgggt

SEQ ID NO: 112737 - DNA, 20 bp, human
gacagcggcggtactgggat

SEQ ID NO: 112738 - DNA, 20 bp, human
gcaggcacaggcgaggggtt

SEQ ID NO: 112739 - DNA, 20 bp, human
ggcagaagctcactcagtct

SEQ ID NO: 112740 - DNA, 20 bp, human
ggccctcagcccagctctcg

SEQ ID NO: 112741 - DNA, 20 bp, human
gacgcgggactggcaacctg

SEQ ID NO: 112742 - DNA, 20 bp, human
gtgcgggccgccgtctggat

SEQ ID NO: 112743 - DNA, 20 bp, human
gcccacgagagctgggctga

SEQ ID NO: 112744 - DNA, 20 bp, human
ggggggtcgtgcaccgccgg

SEQ ID NO: 112745 - DNA, 20 bp, human
ggacggccgcgcctcgaccc

SEQ ID NO: 112746 - DNA, 20 bp, human
gtggctggttggagtcataa

SEQ ID NO: 112747 - DNA, 20 bp, human
gatactgaatcgaagctagt

SEQ ID NO: 112748 - DNA, 20 bp, human
ggttggagtcataagggcca

SEQ ID NO: 112749 - DNA, 20 bp, human
gtatcaagttactcaacccc

SEQ ID NO: 112750 - DNA, 20 bp, human
gtgactccaaccagccacat

SEQ ID NO: 112751 - DNA, 20 bp, human
gtcctcccattcaacatgag

SEQ ID NO: 112752 - DNA, 20 bp, human
gtcctctcatgttgaatggg

SEQ ID NO: 112753 - DNA, 20 bp, human
ggttttcctatgtggctggt

SEQ ID NO: 112754 - DNA, 20 bp, human
gggtttctaaacagatatca

SEQ ID NO: 112755 - DNA, 20 bp, human
gtgattttggttttcctatg

SEQ ID NO: 112756 - DNA, 20 bp, human
ggaaaaccaacagcaatatc

SEQ ID NO: 112757 - DNA, 20 bp, human
gaaccaacagcaatatcagg

SEQ ID NO: 112758 - DNA, 20 bp, human
gctcctcctgatattgctgt

SEQ ID NO: 112759 - DNA, 20 bp, human
gattgaaaagtaccaagaag

SEQ ID NO: 112760 - DNA, 20 bp, human
gaggtaactttgagcaatta

SEQ ID NO: 112761 - DNA, 20 bp, human
gccaagacccatcatgcccc

SEQ ID NO: 112762 - DNA, 20 bp, human
gttggtcttcttccacttct

SEQ ID NO: 112763 - DNA, 20 bp, human
gcctggagatgccaggtcca

SEQ ID NO: 112764 - DNA, 20 bp, human
ggttgacacctggagatgcc

SEQ ID NO: 112765 - DNA, 20 bp, human
gctcttgttttccctggacc

SEQ ID NO: 112766 - DNA, 20 bp, human
gaattgctgaaagtcacctg

SEQ ID NO: 112767 - DNA, 20 bp, human
gattctgtgttaacacctgg

SEQ ID NO: 112768 - DNA, 20 bp, human
gcctggaggcaacagattca

SEQ ID NO: 112769 - DNA, 20 bp, human
gctgaaagtcacctggggca

SEQ ID NO: 112770 - DNA, 20 bp, human
gtcaaaacccaccatgcccc

SEQ ID NO: 112771 - DNA, 20 bp, human
gcatgacatcaaacacactc

SEQ ID NO: 112772 - DNA, 20 bp, human
gaagtcacctggggcatggt

SEQ ID NO: 112773 - DNA, 20 bp, human
gaaccaacagcaatgacagt

SEQ ID NO: 112774 - DNA, 20 bp, human
gctcctactgtcattgctgt

SEQ ID NO: 112775 - DNA, 20 bp, human
ggatgtcatgttttcaacga

SEQ ID NO: 112776 - DNA, 20 bp, human
gacgtcctgtcttctctctg

SEQ ID NO: 112777 - DNA, 20 bp, human
ggtagccagtacctgctctg

SEQ ID NO: 112778 - DNA, 20 bp, human
gtgctctgaggggcttcaag

SEQ ID NO: 112779 - DNA, 20 bp, human
gtctgttctagtgactctga

SEQ ID NO: 112780 - DNA, 20 bp, human
gttgtctgcaggatcttata

SEQ ID NO: 112781 - DNA, 20 bp, human
ggtttctgttgaggcccaac

SEQ ID NO: 112782 - DNA, 20 bp, human
ggaacagagctttgcctgtt

SEQ ID NO: 112783 - DNA, 20 bp, human
gaggatcttatatggtagag

SEQ ID NO: 112784 - DNA, 20 bp, human
gtcagttcaagtttctgttg

SEQ ID NO: 112785 - DNA, 20 bp, human
gctagatgttatttgtctgc

SEQ ID NO: 112786 - DNA, 20 bp, human
gattcaccccacagggatag

SEQ ID NO: 112787 - DNA, 20 bp, human
ggctctgccgctatccctgt

SEQ ID NO: 112788 - DNA, 20 bp, human
gatagcggcagagccggtag

SEQ ID NO: 112789 - DNA, 20 bp, human
gcggcagagccggtagcgga

SEQ ID NO: 112790 - DNA, 20 bp, human
gcctgccggaggccaatgca

SEQ ID NO: 112791 - DNA, 20 bp, human
gaggtcagaatcgccacctg

SEQ ID NO: 112792 - DNA, 20 bp, human
gtgcaaggaccgtccgctac

SEQ ID NO: 112793 - DNA, 20 bp, human
ggaaggccacgactccccag

SEQ ID NO: 112794 - DNA, 20 bp, human
gactaggagtgcgcagatgt

SEQ ID NO: 112795 - DNA, 20 bp, human
gagacagtgtcactaccccg

SEQ ID NO: 112796 - DNA, 20 bp, human
ggcgcgcggttctgggaacc

SEQ ID NO: 112797 - DNA, 20 bp, human
gttgcaggggggccaagatg

SEQ ID NO: 112798 - DNA, 20 bp, human
ggttccagcagctccctcct

SEQ ID NO: 112799 - DNA, 20 bp, human
gaatgacagaggaattgaca

SEQ ID NO: 112800 - DNA, 20 bp, human
ggccccgcaggcagcctctc

SEQ ID NO: 112801 - DNA, 20 bp, human
gtggcccccctgcaaccccg

SEQ ID NO: 112802 - DNA, 20 bp, human
gctggctcccgagaagcgga

SEQ ID NO: 112803 - DNA, 20 bp, human
gcttcaccgcggggttgcag

SEQ ID NO: 112804 - DNA, 20 bp, human
ggacagggtgaactgcaccc

SEQ ID NO: 112805 - DNA, 20 bp, human
gcccgcggtgaagcccacgc

SEQ ID NO: 112806 - DNA, 20 bp, human
gcttctcaggtggtgtcctc

SEQ ID NO: 112807 - DNA, 20 bp, human
ggcggtgagctaggactatg

SEQ ID NO: 112808 - DNA, 20 bp, human
gacccgaggaggcaagcaga

SEQ ID NO: 112809 - DNA, 20 bp, human
ggtgggcatgaagagtccag

SEQ ID NO: 112810 - DNA, 20 bp, human
gacgcccggaggctgcacca

SEQ ID NO: 112811 - DNA, 20 bp, human
gtggcgacggtgctgtccag

SEQ ID NO: 112812 - DNA, 20 bp, human
ggacggtgctgtccaggggg

SEQ ID NO: 112813 - DNA, 20 bp, human
ggctcccttgaacttcactg

SEQ ID NO: 112814 - DNA, 20 bp, human
ggcaagcagatggcacccct

SEQ ID NO: 112815 - DNA, 20 bp, human
gttgcaggggggccaagatg

SEQ ID NO: 112816 - DNA, 20 bp, human
ggaaggtgcacagtatagca

SEQ ID NO: 112817 - DNA, 20 bp, human
gacagtatagcacggtgcag

SEQ ID NO: 112818 - DNA, 20 bp, human
gctgcgcccggaggtcatgc

SEQ ID NO: 112819 - DNA, 20 bp, human
gaattcttgccgccaggatg

SEQ ID NO: 112820 - DNA, 20 bp, human
gaacagcaagctgcgcccgg

SEQ ID NO: 112821 - DNA, 20 bp, human
gatctcaagtaagaattgga

SEQ ID NO: 112822 - DNA, 20 bp, human
gcttgagtgtaacttcgagg

SEQ ID NO: 112823 - DNA, 20 bp, human
gcccagtggacatttgtcaa

SEQ ID NO: 112824 - DNA, 20 bp, human
gtcttgagagactgccccag

SEQ ID NO: 112825 - DNA, 20 bp, human
ggaagcctttataccattcc

SEQ ID NO: 112826 - DNA, 20 bp, human
gctgcagcgagtgtggacgg

SEQ ID NO: 112827 - DNA, 20 bp, human
gcgccgcgggcgcacaaagt

SEQ ID NO: 112828 - DNA, 20 bp, human
ggcgcacaaagtgggaaggg

SEQ ID NO: 112829 - DNA, 20 bp, human
gaacgcagctcggctgccgc

SEQ ID NO: 112830 - DNA, 20 bp, human
ggcgcggccgctgagtcccc

SEQ ID NO: 112831 - DNA, 20 bp, human
gcccctgcagcgagtgtgga

SEQ ID NO: 112832 - DNA, 20 bp, human
gtagcgttcctcctaggagt

SEQ ID NO: 112833 - DNA, 20 bp, human
ggcgggcgcacaaagtggga

SEQ ID NO: 112834 - DNA, 20 bp, human
gctaggggcagacaattgcc

SEQ ID NO: 112835 - DNA, 20 bp, human
gcagcggccgcgctggtgat

SEQ ID NO: 112836 - DNA, 20 bp, human
gtcggtgagcaggatatcca

SEQ ID NO: 112837 - DNA, 20 bp, human
ggctctagcagaggcggccg

SEQ ID NO: 112838 - DNA, 20 bp, human
gccgctgcctggatatagtg

SEQ ID NO: 112839 - DNA, 20 bp, human
ggagaaagccataatcccag

SEQ ID NO: 112840 - DNA, 20 bp, human
ggcggcggctctagcagagg

SEQ ID NO: 112841 - DNA, 20 bp, human
gggatatagtgcggcaagag

SEQ ID NO: 112842 - DNA, 20 bp, human
ggcgaaaggttctctctcca

SEQ ID NO: 112843 - DNA, 20 bp, human
gtatatccaggcagcggcgg

SEQ ID NO: 112844 - DNA, 20 bp, human
gctcttggccgggtggaagg

SEQ ID NO: 112845 - DNA, 20 bp, human
gttgcagtcactttgcgagg

SEQ ID NO: 112846 - DNA, 20 bp, human
gctagctcggacgcatcccg

SEQ ID NO: 112847 - DNA, 20 bp, human
gcgagctaggagccaggtgg

SEQ ID NO: 112848 - DNA, 20 bp, human
gacacccagatgccgaatgg

SEQ ID NO: 112849 - DNA, 20 bp, human
gggcgcggagctggctgagt

SEQ ID NO: 112850 - DNA, 20 bp, human
ggcgctccctcctcaaccta

SEQ ID NO: 112851 - DNA, 20 bp, human
gtgaggagggagcgcgaact

SEQ ID NO: 112852 - DNA, 20 bp, human
ggaatccggagactaccccc

SEQ ID NO: 112853 - DNA, 20 bp, human
gtgtctcggctgagatacgg

SEQ ID NO: 112854 - DNA, 20 bp, human
ggggtgtctcggctgagata

SEQ ID NO: 112855 - DNA, 20 bp, human
ggctcggacgcatcccgggg

SEQ ID NO: 112856 - DNA, 20 bp, human
gtacctggggatctcacccg

SEQ ID NO: 112857 - DNA, 20 bp, human
gaggcggaccggaagcactg

SEQ ID NO: 112858 - DNA, 20 bp, human
gagccgcgggtgagatcccc

SEQ ID NO: 112859 - DNA, 20 bp, human
ggcaaacagcctaacagact

SEQ ID NO: 112860 - DNA, 20 bp, human
gcagtcacccccaggaaagg

SEQ ID NO: 112861 - DNA, 20 bp, human
gtccggcgctccaaaacttc

SEQ ID NO: 112862 - DNA, 20 bp, human
gagcccactagcccatgctg

SEQ ID NO: 112863 - DNA, 20 bp, human
ggagatccccaggtaagatg

SEQ ID NO: 112864 - DNA, 20 bp, human
gaaacttccggcaggcggac

SEQ ID NO: 112865 - DNA, 20 bp, human
gtgaaggacgccaaagaaag

SEQ ID NO: 112866 - DNA, 20 bp, human
gtaagatccagcggacacca

SEQ ID NO: 112867 - DNA, 20 bp, human
gcggccggcgctccagcggt

SEQ ID NO: 112868 - DNA, 20 bp, human
gcaacgccaccatgatccca

SEQ ID NO: 112869 - DNA, 20 bp, human
gcgttgcggggccttggtag

SEQ ID NO: 112870 - DNA, 20 bp, human
ggggctgcaggccgctacca

SEQ ID NO: 112871 - DNA, 20 bp, human
ggttcgagtgctgacgggaa

SEQ ID NO: 112872 - DNA, 20 bp, human
gcaccgagtctaagatccag

SEQ ID NO: 112873 - DNA, 20 bp, human
gcgcatgcgcagggagagcg

SEQ ID NO: 112874 - DNA, 20 bp, human
gtgtcgcctgacgagggcaa

SEQ ID NO: 112875 - DNA, 20 bp, human
ggagctttgaaagttgagca

SEQ ID NO: 112876 - DNA, 20 bp, human
gtcgagcggtaaatactccc

SEQ ID NO: 112877 - DNA, 20 bp, human
gaaccaggcgaagctggtgg

SEQ ID NO: 112878 - DNA, 20 bp, human
gtgccagcccgccaacccag

SEQ ID NO: 112879 - DNA, 20 bp, human
gctcggagagcgctgcctct

SEQ ID NO: 112880 - DNA, 20 bp, human
ggcgcgggcaggactcgtcc

SEQ ID NO: 112881 - DNA, 20 bp, human
ggctgtcatagaagactact

SEQ ID NO: 112882 - DNA, 20 bp, human
gtgtcggctcagaaaagcca

SEQ ID NO: 112883 - DNA, 20 bp, human
gaacgacgcccaggcttcgg

SEQ ID NO: 112884 - DNA, 20 bp, human
ggcctgggcgtcgttcacac

SEQ ID NO: 112885 - DNA, 20 bp, human
ggaagtcagggacttacccg

SEQ ID NO: 112886 - DNA, 20 bp, human
ggtccgagcgcgggaaacgg

SEQ ID NO: 112887 - DNA, 20 bp, human
gacccgccggcgccccagac

SEQ ID NO: 112888 - DNA, 20 bp, human
gcgcctgatgacgaccggga

SEQ ID NO: 112889 - DNA, 20 bp, human
gctggtccgagcgcgggaaa

SEQ ID NO: 112890 - DNA, 20 bp, human
gggagggcggggcccgtctg

SEQ ID NO: 112891 - DNA, 20 bp, human
ggcggcgcctgatgacgacc

SEQ ID NO: 112892 - DNA, 20 bp, human
gcggcaccgcagctcttacc

SEQ ID NO: 112893 - DNA, 20 bp, human
gcggcgggtgcgtttgaatc

SEQ ID NO: 112894 - DNA, 20 bp, human
ggggattgggttcagagcag

SEQ ID NO: 112895 - DNA, 20 bp, human
gcgacacggacaagaaggac

SEQ ID NO: 112896 - DNA, 20 bp, human
gaccagctcaggagacgcca

SEQ ID NO: 112897 - DNA, 20 bp, human
gagacgcctgagcgccgtaa

SEQ ID NO: 112898 - DNA, 20 bp, human
gaggagacgccaaggaaaga

SEQ ID NO: 112899 - DNA, 20 bp, human
ggccctgcggctgacagcag

SEQ ID NO: 112900 - DNA, 20 bp, human
gcgacgtcacgcggccgtta

SEQ ID NO: 112901 - DNA, 20 bp, human
ggggaggtcccatctttcct

SEQ ID NO: 112902 - DNA, 20 bp, human
gtccttggcgtctcctgagc

SEQ ID NO: 112903 - DNA, 20 bp, human
gctgacagcagaggccggtg

SEQ ID NO: 112904 - DNA, 20 bp, human
gcagggctttggaagcgatg

SEQ ID NO: 112905 - DNA, 20 bp, human
gcgcgatttaaaaccagctc

SEQ ID NO: 112906 - DNA, 20 bp, human
gggacgccgtacccctcgga

SEQ ID NO: 112907 - DNA, 20 bp, human
gcgcagggctgccttccgag

SEQ ID NO: 112908 - DNA, 20 bp, human
gatgtccgggagggaacggg

SEQ ID NO: 112909 - DNA, 20 bp, human
gaaaatggcgccagaactag

SEQ ID NO: 112910 - DNA, 20 bp, human
gctgaggacgccgtacccct

SEQ ID NO: 112911 - DNA, 20 bp, human
gatggcgccagaactagtgg

SEQ ID NO: 112912 - DNA, 20 bp, human
gctgggcgggaacagcaaaa

SEQ ID NO: 112913 - DNA, 20 bp, human
gcagctgggcgagtatctgg

SEQ ID NO: 112914 - DNA, 20 bp, human
gcataggcgtggagacggtg

SEQ ID NO: 112915 - DNA, 20 bp, human
ggggcggcaaagggaccgca

SEQ ID NO: 112916 - DNA, 20 bp, human
gctggccgctggccgacgca

SEQ ID NO: 112917 - DNA, 20 bp, human
ggcaggagaggccgccgggt

SEQ ID NO: 112918 - DNA, 20 bp, human
gccagtgggtccctaagagg

SEQ ID NO: 112919 - DNA, 20 bp, human
gggtgcgccgcggaaccgag

SEQ ID NO: 112920 - DNA, 20 bp, human
ggcggaaccgagaggccagg

SEQ ID NO: 112921 - DNA, 20 bp, human
gggttccgcggcgcaccgga

SEQ ID NO: 112922 - DNA, 20 bp, human
gaagcgctgcaggaactgtc

SEQ ID NO: 112923 - DNA, 20 bp, human
gaccggagggcagcatgtcg

SEQ ID NO: 112924 - DNA, 20 bp, human
gggcacagcgacgagaacga

SEQ ID NO: 112925 - DNA, 20 bp, human
gaacgagacactaggaccag

SEQ ID NO: 112926 - DNA, 20 bp, human
gagagaagcggaccacaatg

SEQ ID NO: 112927 - DNA, 20 bp, human
gctgcgcagcgactcctacg

SEQ ID NO: 112928 - DNA, 20 bp, human
gaggcgcctctgcctactct

SEQ ID NO: 112929 - DNA, 20 bp, human
gatgtcgggtggcctcctga

SEQ ID NO: 112930 - DNA, 20 bp, human
ggctgcgcagcgccttcagg

SEQ ID NO: 112931 - DNA, 20 bp, human
gaccacaatgcggcgactcc

SEQ ID NO: 112932 - DNA, 20 bp, human
ggctacgtagtcgtctgcgg

SEQ ID NO: 112933 - DNA, 20 bp, human
ggtctgcggaggcacaaccg

SEQ ID NO: 112934 - DNA, 20 bp, human
gagacgactacgtagcaagg

SEQ ID NO: 112935 - DNA, 20 bp, human
gcagtgccgagaggtttgag

SEQ ID NO: 112936 - DNA, 20 bp, human
ggcgcagcctcgagggatgg

SEQ ID NO: 112937 - DNA, 20 bp, human
ggacagtcgcgcagcctcga

SEQ ID NO: 112938 - DNA, 20 bp, human
gggatggaggaggtgcgtga

SEQ ID NO: 112939 - DNA, 20 bp, human
gagggacacgcgctcggtgg

SEQ ID NO: 112940 - DNA, 20 bp, human
gtggaggctcgcgggcccat

SEQ ID NO: 112941 - DNA, 20 bp, human
gcaaccccgaaggtgcgcaa

SEQ ID NO: 112942 - DNA, 20 bp, human
gcgactgtcccggtttcaca

SEQ ID NO: 112943 - DNA, 20 bp, human
ggtgagggacacgcgctcgg

SEQ ID NO: 112944 - DNA, 20 bp, human
ggcttccaggtgaggcgctg

SEQ ID NO: 112945 - DNA, 20 bp, human
ggccgtccgaggctcacgcc

SEQ ID NO: 112946 - DNA, 20 bp, human
ggagccaggagtgggcaacg

SEQ ID NO: 112947 - DNA, 20 bp, human
gtgatgaagtcacgacaggg

SEQ ID NO: 112948 - DNA, 20 bp, human
ggcgatgctccgggagcctc

SEQ ID NO: 112949 - DNA, 20 bp, human
gctggctgcggcgggacagg

SEQ ID NO: 112950 - DNA, 20 bp, human
ggcaggggagggcccgaagg

SEQ ID NO: 112951 - DNA, 20 bp, human
gccggcattgcccttcccgg

SEQ ID NO: 112952 - DNA, 20 bp, human
gggctcccggagcatcgcgc

SEQ ID NO: 112953 - DNA, 20 bp, human
ggagtctcgacagggcacga

SEQ ID NO: 112954 - DNA, 20 bp, human
gatgccggccgcgagaccaa

SEQ ID NO: 112955 - DNA, 20 bp, human
gacaaaatggagtctcgaca

SEQ ID NO: 112956 - DNA, 20 bp, human
ggataccacccggagacctc

SEQ ID NO: 112957 - DNA, 20 bp, human
ggttgccggaggtctccggg

SEQ ID NO: 112958 - DNA, 20 bp, human
ggcgggcagaaagttgccgg

SEQ ID NO: 112959 - DNA, 20 bp, human
ggggtgcacagcaagtggtg

SEQ ID NO: 112960 - DNA, 20 bp, human
gtgctgtgcaccccggaaag

SEQ ID NO: 112961 - DNA, 20 bp, human
ggccgcgggcagaaagttgc

SEQ ID NO: 112962 - DNA, 20 bp, human
gcgtgaatgagcagctgccg

SEQ ID NO: 112963 - DNA, 20 bp, human
ggccaatcagaggctgcgtc

SEQ ID NO: 112964 - DNA, 20 bp, human
gtcgcctccttgctagcagc

SEQ ID NO: 112965 - DNA, 20 bp, human
gtgcaaggacaccgtagagg

SEQ ID NO: 112966 - DNA, 20 bp, human
gctggaggccacccagtcat

SEQ ID NO: 112967 - DNA, 20 bp, human
gaagtgccagggagcactgg

SEQ ID NO: 112968 - DNA, 20 bp, human
ggcgcagcctggaagtgcca

SEQ ID NO: 112969 - DNA, 20 bp, human
ggaaggtgtcccccatgact

SEQ ID NO: 112970 - DNA, 20 bp, human
gggcagcccagcgctctctc

SEQ ID NO: 112971 - DNA, 20 bp, human
gggctgcgccttaaatgcac

SEQ ID NO: 112972 - DNA, 20 bp, human
gggctgcctggccatggcag

SEQ ID NO: 112973 - DNA, 20 bp, human
gctgatagctgggctagtca

SEQ ID NO: 112974 - DNA, 20 bp, human
gggagcagaaagaggactcc

SEQ ID NO: 112975 - DNA, 20 bp, human
gggtgtcccccatgactggg

SEQ ID NO: 112976 - DNA, 20 bp, human
gactaaggcagccctgctag

SEQ ID NO: 112977 - DNA, 20 bp, human
ggttaaatcaggctgtctag

SEQ ID NO: 112978 - DNA, 20 bp, human
gtggagcgtctcccctagca

SEQ ID NO: 112979 - DNA, 20 bp, human
gacggcactgaaggcatcca

SEQ ID NO: 112980 - DNA, 20 bp, human
gcagaaagtgaacaccttgg

SEQ ID NO: 112981 - DNA, 20 bp, human
gctgtctaggggtggagctt

SEQ ID NO: 112982 - DNA, 20 bp, human
gttcggaaacctaacctctg

SEQ ID NO: 112983 - DNA, 20 bp, human
ggggccagatgagtagaatg

SEQ ID NO: 112984 - DNA, 20 bp, human
ggcccagaaagtgaacacct

SEQ ID NO: 112985 - DNA, 20 bp, human
gccaggtggagagcaggtga

SEQ ID NO: 112986 - DNA, 20 bp, human
gtggggactcccaggaccac

SEQ ID NO: 112987 - DNA, 20 bp, human
gggcctgcttctctccagtc

SEQ ID NO: 112988 - DNA, 20 bp, human
ggagcagtgagaaggcccgg

SEQ ID NO: 112989 - DNA, 20 bp, human
gtcactcgttgtgtgaccgt

SEQ ID NO: 112990 - DNA, 20 bp, human
gcaggctgagacgagacgca

SEQ ID NO: 112991 - DNA, 20 bp, human
gcccgggggcggccacaccc

SEQ ID NO: 112992 - DNA, 20 bp, human
ggtccccaggagctgccttt

SEQ ID NO: 112993 - DNA, 20 bp, human
gcgagacgcagggtggctgg

SEQ ID NO: 112994 - DNA, 20 bp, human
gcctccccaaaggcagctcc

SEQ ID NO: 112995 - DNA, 20 bp, human
gcttctctccagtctggcag

SEQ ID NO: 112996 - DNA, 20 bp, human
ggccgccgtgatggccgtaa

SEQ ID NO: 112997 - DNA, 20 bp, human
gtctcccaagagctacgcgg

SEQ ID NO: 112998 - DNA, 20 bp, human
ggctccagctcacctgagga

SEQ ID NO: 112999 - DNA, 20 bp, human
gctctctcccaagagctacg

SEQ ID NO: 113000 - DNA, 20 bp, human
gcgtgccgttacggccatca

SEQ ID NO: 113001 - DNA, 20 bp, human
ggcccgacacagcgctccag

SEQ ID NO: 113002 - DNA, 20 bp, human
ggccgttacggccatcacgg

SEQ ID NO: 113003 - DNA, 20 bp, human
gcgacctcccaggctcgcac

SEQ ID NO: 113004 - DNA, 20 bp, human
gccgcccgtgcgagcctggg

SEQ ID NO: 113005 - DNA, 20 bp, human
gatccgaggccgggaaggta

SEQ ID NO: 113006 - DNA, 20 bp, human
gtccggcctgacgatccccg

SEQ ID NO: 113007 - DNA, 20 bp, human
gagggccgagagcaccggag

SEQ ID NO: 113008 - DNA, 20 bp, human
gggaggtgcccggcagtccg

SEQ ID NO: 113009 - DNA, 20 bp, human
gcgctgccgcggggatcgtc

SEQ ID NO: 113010 - DNA, 20 bp, human
gccctaacccccaccatcgg

SEQ ID NO: 113011 - DNA, 20 bp, human
gggccggcccccgatggtgg

SEQ ID NO: 113012 - DNA, 20 bp, human
ggagcggcgcagacaaagag

SEQ ID NO: 113013 - DNA, 20 bp, human
ggcctgggcgcccccgaccg

SEQ ID NO: 113014 - DNA, 20 bp, human
gtcgtcaggccggagccgcg

SEQ ID NO: 113015 - DNA, 20 bp, human
ggccgcggggatcgtcaggc

SEQ ID NO: 113016 - DNA, 20 bp, human
gcgggcccgggagggatgaa

SEQ ID NO: 113017 - DNA, 20 bp, human
gccggctgctccactaggtg

SEQ ID NO: 113018 - DNA, 20 bp, human
ggctgctccactaggtgtgg

SEQ ID NO: 113019 - DNA, 20 bp, human
gccatgggcgcgctctccta

SEQ ID NO: 113020 - DNA, 20 bp, human
gcttccccggctgctccact

SEQ ID NO: 113021 - DNA, 20 bp, human
gacgccccggtcgttgagga

SEQ ID NO: 113022 - DNA, 20 bp, human
gcagcccagtcagcagaagc

SEQ ID NO: 113023 - DNA, 20 bp, human
ggctccactaggtgtggcgg

SEQ ID NO: 113024 - DNA, 20 bp, human
gagcactgagcgcgacatgg

SEQ ID NO: 113025 - DNA, 20 bp, human
gtgggcgcgctctcctaagg

SEQ ID NO: 113026 - DNA, 20 bp, human
gggggatggggaaacaacag

SEQ ID NO: 113027 - DNA, 20 bp, human
ggcagatgtcaaagacatga

SEQ ID NO: 113028 - DNA, 20 bp, human
gcaggccagccagttcagga

SEQ ID NO: 113029 - DNA, 20 bp, human
ggagatcagacattgctgtc

SEQ ID NO: 113030 - DNA, 20 bp, human
gatgattcttgccccaacga

SEQ ID NO: 113031 - DNA, 20 bp, human
ggattattccaacaataata

SEQ ID NO: 113032 - DNA, 20 bp, human
gttccaagtgacttggataa

SEQ ID NO: 113033 - DNA, 20 bp, human
gggaaaagcagtggaaaaaa

SEQ ID NO: 113034 - DNA, 20 bp, human
ggtctggggtccaaccttct

SEQ ID NO: 113035 - DNA, 20 bp, human
gagtgacttggataaaggtc

SEQ ID NO: 113036 - DNA, 20 bp, human
gggaagtcctgccgtgaatg

SEQ ID NO: 113037 - DNA, 20 bp, human
gtaactatagggccctaaag

SEQ ID NO: 113038 - DNA, 20 bp, human
gtacaagctcgaagcaacta

SEQ ID NO: 113039 - DNA, 20 bp, human
gtaaagtggactggaattag

SEQ ID NO: 113040 - DNA, 20 bp, human
gatagggccctaaagtggac

SEQ ID NO: 113041 - DNA, 20 bp, human
gcaaacttgctccgcattca

SEQ ID NO: 113042 - DNA, 20 bp, human
gtaactacaagtaagactgt

SEQ ID NO: 113043 - DNA, 20 bp, human
gtttgcggagacttgctccc

SEQ ID NO: 113044 - DNA, 20 bp, human
gaagtcccaaatgacatcac

SEQ ID NO: 113045 - DNA, 20 bp, human
gctgaacatccacagcggct

SEQ ID NO: 113046 - DNA, 20 bp, human
gtaagcggcacccggacggt

SEQ ID NO: 113047 - DNA, 20 bp, human
gcaagccgcggccatggacc

SEQ ID NO: 113048 - DNA, 20 bp, human
ggccggatccgccaggtcca

SEQ ID NO: 113049 - DNA, 20 bp, human
gaagccttgacatcaggagg

SEQ ID NO: 113050 - DNA, 20 bp, human
gataacccggcaccgctaag

SEQ ID NO: 113051 - DNA, 20 bp, human
ggagccgcctcctgatgtca

SEQ ID NO: 113052 - DNA, 20 bp, human
gacactccgtggccccggaa

SEQ ID NO: 113053 - DNA, 20 bp, human
gggacggtgggatgcgggtt

SEQ ID NO: 113054 - DNA, 20 bp, human
ggcagccggacccccgagga

SEQ ID NO: 113055 - DNA, 20 bp, human
gtggcagtacagagtcggag

SEQ ID NO: 113056 - DNA, 20 bp, human
gctgagacccccggacccac

SEQ ID NO: 113057 - DNA, 20 bp, human
gggcggcgcaggtaggctgg

SEQ ID NO: 113058 - DNA, 20 bp, human
gtcagtccccgtgggtccgg

SEQ ID NO: 113059 - DNA, 20 bp, human
ggcgcgcggtacatgaggcc

SEQ ID NO: 113060 - DNA, 20 bp, human
gtcacggggcgggacaaccg

SEQ ID NO: 113061 - DNA, 20 bp, human
gtggcctcgggtcccggaga

SEQ ID NO: 113062 - DNA, 20 bp, human
gtcgggagttggtctgtcaa

SEQ ID NO: 113063 - DNA, 20 bp, human
ggccccgcggaaccgaccca

SEQ ID NO: 113064 - DNA, 20 bp, human
ggcctgcgtagtgtgtcacg

SEQ ID NO: 113065 - DNA, 20 bp, human
ggtacagcgcgcggtacatg

SEQ ID NO: 113066 - DNA, 20 bp, human
ggccgtcgtcgcctttccac

SEQ ID NO: 113067 - DNA, 20 bp, human
gccgcgggtgctgaagatcc

SEQ ID NO: 113068 - DNA, 20 bp, human
gcagcgagagctcgagactg

SEQ ID NO: 113069 - DNA, 20 bp, human
gccggagcacgtacacccga

SEQ ID NO: 113070 - DNA, 20 bp, human
gagccaagcgacggcgatgg

SEQ ID NO: 113071 - DNA, 20 bp, human
gcagtcccgggcgcgttcta

SEQ ID NO: 113072 - DNA, 20 bp, human
gtccagaagaagccaagcga

SEQ ID NO: 113073 - DNA, 20 bp, human
gagaagccaagcgacggcga

SEQ ID NO: 113074 - DNA, 20 bp, human
gggagtgtgaagcggacaag

SEQ ID NO: 113075 - DNA, 20 bp, human
ggtcactgagcgcggggagg

SEQ ID NO: 113076 - DNA, 20 bp, human
ggtgctgccatcccagccaa

SEQ ID NO: 113077 - DNA, 20 bp, human
ggacgatgaggaagatggta

SEQ ID NO: 113078 - DNA, 20 bp, human
gagttgtcttggtagttact

SEQ ID NO: 113079 - DNA, 20 bp, human
gtactgggcttctgattaca

SEQ ID NO: 113080 - DNA, 20 bp, human
gagatggtaaggagttgtct

SEQ ID NO: 113081 - DNA, 20 bp, human
gtctcatctccaggttgtcg

SEQ ID NO: 113082 - DNA, 20 bp, human
gggaattctctgggttgttg

SEQ ID NO: 113083 - DNA, 20 bp, human
gctattgaaattttctcaag

SEQ ID NO: 113084 - DNA, 20 bp, human
gatccttgtgggaattctct

SEQ ID NO: 113085 - DNA, 20 bp, human
gtattccttccacgacaacc

SEQ ID NO: 113086 - DNA, 20 bp, human
gcgcggactcacctcggcat

SEQ ID NO: 113087 - DNA, 20 bp, human
gggcgcccgcaggaccccgg

SEQ ID NO: 113088 - DNA, 20 bp, human
gtcgcctggggcctgagcat

SEQ ID NO: 113089 - DNA, 20 bp, human
gagctgggacgggacggcgg

SEQ ID NO: 113090 - DNA, 20 bp, human
gccggcggctacccatgccg

SEQ ID NO: 113091 - DNA, 20 bp, human
gcagggcgcccgggggtcca

SEQ ID NO: 113092 - DNA, 20 bp, human
ggcagcccaggccggagcta

SEQ ID NO: 113093 - DNA, 20 bp, human
gggctgcccgacccatgctc

SEQ ID NO: 113094 - DNA, 20 bp, human
ggccggggacacgcaccgta

SEQ ID NO: 113095 - DNA, 20 bp, human
gagacctaggcaggggccgg

SEQ ID NO: 113096 - DNA, 20 bp, human
gtgacccggcctggagataa

SEQ ID NO: 113097 - DNA, 20 bp, human
ggctcgacagagcaggtagg

SEQ ID NO: 113098 - DNA, 20 bp, human
gggcggataaggccccaagt

SEQ ID NO: 113099 - DNA, 20 bp, human
ggcatagggcagacccatca

SEQ ID NO: 113100 - DNA, 20 bp, human
gggggctcgacagagcaggt

SEQ ID NO: 113101 - DNA, 20 bp, human
gcgcccggcgctgccaccct

SEQ ID NO: 113102 - DNA, 20 bp, human
gatgggtctgccctatgcag

SEQ ID NO: 113103 - DNA, 20 bp, human
ggagcggggctcgacagagc

SEQ ID NO: 113104 - DNA, 20 bp, human
gtgaatcgcagatcttccgg

SEQ ID NO: 113105 - DNA, 20 bp, human
gcgaggctcgctggaagaaa

SEQ ID NO: 113106 - DNA, 20 bp, human
ggccctctccgcgctaacta

SEQ ID NO: 113107 - DNA, 20 bp, human
gagccgaaagggccgaggaa

SEQ ID NO: 113108 - DNA, 20 bp, human
gacgaggcgattgggaggtg

SEQ ID NO: 113109 - DNA, 20 bp, human
gcggagagggcgagcatccg

SEQ ID NO: 113110 - DNA, 20 bp, human
gagagggcgagcatccgcgg

SEQ ID NO: 113111 - DNA, 20 bp, human
gtgttgacgaggcgattggg

SEQ ID NO: 113112 - DNA, 20 bp, human
gagggcaactggaaaagagg

SEQ ID NO: 113113 - DNA, 20 bp, human
ggggcgagcatccgcggagg

SEQ ID NO: 113114 - DNA, 20 bp, human
gcggaggtcgcagctgtcac

SEQ ID NO: 113115 - DNA, 20 bp, human
gccgcggcgtccctctccgt

SEQ ID NO: 113116 - DNA, 20 bp, human
ggcctcggctacagcttcgg

SEQ ID NO: 113117 - DNA, 20 bp, human
ggaagctgtagccgaggctg

SEQ ID NO: 113118 - DNA, 20 bp, human
ggccgccgaagctgtagccg

SEQ ID NO: 113119 - DNA, 20 bp, human
gaggcagcagttattaacac

SEQ ID NO: 113120 - DNA, 20 bp, human
ggagctcaggagacgagtcc

SEQ ID NO: 113121 - DNA, 20 bp, human
gcgagtcccggagcgcgagg

SEQ ID NO: 113122 - DNA, 20 bp, human
gtcggagctcggcgcaggaa

SEQ ID NO: 113123 - DNA, 20 bp, human
gagagccgtgcgcctccgag

SEQ ID NO: 113124 - DNA, 20 bp, human
gcagcgccttgcgagagctc

SEQ ID NO: 113125 - DNA, 20 bp, human
gcggcgaaggtcagcgccga

SEQ ID NO: 113126 - DNA, 20 bp, human
gcgctccacagcgacggcag

SEQ ID NO: 113127 - DNA, 20 bp, human
ggcggctgcggcttagtcgg

SEQ ID NO: 113128 - DNA, 20 bp, human
ggcagcggctgcggcttagt

SEQ ID NO: 113129 - DNA, 20 bp, human
gtgagctgcgaggaaaatgg

SEQ ID NO: 113130 - DNA, 20 bp, human
ggctgcggcttagtcggtgg

SEQ ID NO: 113131 - DNA, 20 bp, human
gcccaggctgcgagagccag

SEQ ID NO: 113132 - DNA, 20 bp, human
gcttagtcggtggcggccgg

SEQ ID NO: 113133 - DNA, 20 bp, human
ggtccccccgcaaactcctc

SEQ ID NO: 113134 - DNA, 20 bp, human
gcgcgcggaggggtcacccg

SEQ ID NO: 113135 - DNA, 20 bp, human
gagaagctgctaaggagccg

SEQ ID NO: 113136 - DNA, 20 bp, human
gggcgatccgaggagacctt

SEQ ID NO: 113137 - DNA, 20 bp, human
gctcctcggatcgcctggag

SEQ ID NO: 113138 - DNA, 20 bp, human
gtgcctctccaggcgatccg

SEQ ID NO: 113139 - DNA, 20 bp, human
gacactaacctacggcccaa

SEQ ID NO: 113140 - DNA, 20 bp, human
gcaggtccgagtgcctctcc

SEQ ID NO: 113141 - DNA, 20 bp, human
ggtccgagccgggtgtgagg

SEQ ID NO: 113142 - DNA, 20 bp, human
gccacggccgggcacgagga

SEQ ID NO: 113143 - DNA, 20 bp, human
ggccgggtgtgaggagggtc

SEQ ID NO: 113144 - DNA, 20 bp, human
gcctaaagagaggggaaggc

SEQ ID NO: 113145 - DNA, 20 bp, human
gaaaggacaggcccacggcc

SEQ ID NO: 113146 - DNA, 20 bp, human
gcctgcccgccgtaggacaa

SEQ ID NO: 113147 - DNA, 20 bp, human
gaaaggcgccaccaaccgac

SEQ ID NO: 113148 - DNA, 20 bp, human
gggcaggtgggccgacgcgg

SEQ ID NO: 113149 - DNA, 20 bp, human
ggcgggcaggtgggccgacg

SEQ ID NO: 113150 - DNA, 20 bp, human
gcgtgcccgcgccggtcggt

SEQ ID NO: 113151 - DNA, 20 bp, human
gtggtggcgcctttgtccta

SEQ ID NO: 113152 - DNA, 20 bp, human
gcgcgggcacgaggcaatgg

SEQ ID NO: 113153 - DNA, 20 bp, human
gcggcgcgggcacgaggcaa

SEQ ID NO: 113154 - DNA, 20 bp, human
ggcaccgcgcgcacccggag

SEQ ID NO: 113155 - DNA, 20 bp, human
ggccaccaaccgaccggcgc

SEQ ID NO: 113156 - DNA, 20 bp, human
ggcgcgggcccgtaaggggt

SEQ ID NO: 113157 - DNA, 20 bp, human
ggcacgcgaggactgacgga

SEQ ID NO: 113158 - DNA, 20 bp, human
gggccgcccgcagcccgacc

SEQ ID NO: 113159 - DNA, 20 bp, human
gccgacccggcagggcctca

SEQ ID NO: 113160 - DNA, 20 bp, human
ggcgcgggcggcgggacaga

SEQ ID NO: 113161 - DNA, 20 bp, human
ggggcgcacgcgaggactga

SEQ ID NO: 113162 - DNA, 20 bp, human
gccgcgaagccagcccgaca

SEQ ID NO: 113163 - DNA, 20 bp, human
gcggcggcgcgggcccgtaa

SEQ ID NO: 113164 - DNA, 20 bp, human
ggccagcccgacaaggaccg

SEQ ID NO: 113165 - DNA, 20 bp, human
gatggcgccgggcgaccgag

SEQ ID NO: 113166 - DNA, 20 bp, human
ggccgagaggatgcgctccc

SEQ ID NO: 113167 - DNA, 20 bp, human
gctctcggcggcagcatcag

SEQ ID NO: 113168 - DNA, 20 bp, human
ggcgcgccagtacgagagtg

SEQ ID NO: 113169 - DNA, 20 bp, human
gtgagctgctgaaaatccaa

SEQ ID NO: 113170 - DNA, 20 bp, human
ggccggggagcgcatcctct

SEQ ID NO: 113171 - DNA, 20 bp, human
gtcaccacctacctacaggg

SEQ ID NO: 113172 - DNA, 20 bp, human
gtatttggggagaagaccgt

SEQ ID NO: 113173 - DNA, 20 bp, human
gcgccagtacgagagtgggg

SEQ ID NO: 113174 - DNA, 20 bp, human
gctctcggcgggtggaagga

SEQ ID NO: 113175 - DNA, 20 bp, human
gtcgcatgcatttctgggag

SEQ ID NO: 113176 - DNA, 20 bp, human
gtcccggggcagcagccgct

SEQ ID NO: 113177 - DNA, 20 bp, human
gctccgcacaggacacctcg

SEQ ID NO: 113178 - DNA, 20 bp, human
gacgcagctccggccagagg

SEQ ID NO: 113179 - DNA, 20 bp, human
ggaccctgcaaacccctccg

SEQ ID NO: 113180 - DNA, 20 bp, human
gggcgccagggcctactcac

SEQ ID NO: 113181 - DNA, 20 bp, human
ggtcaagatggcggccaagg

SEQ ID NO: 113182 - DNA, 20 bp, human
gcctacaccgggacctcgtt

SEQ ID NO: 113183 - DNA, 20 bp, human
gtcgggcgcgcggaacagac

SEQ ID NO: 113184 - DNA, 20 bp, human
gccgcgcccggctctctcct

SEQ ID NO: 113185 - DNA, 20 bp, human
gcggactagcaggagcccgg

SEQ ID NO: 113186 - DNA, 20 bp, human
gcagggcagggagcaactta

SEQ ID NO: 113187 - DNA, 20 bp, human
gaggcaggatgaacctcctg

SEQ ID NO: 113188 - DNA, 20 bp, human
gaacacctgggcccatcgac

SEQ ID NO: 113189 - DNA, 20 bp, human
gcagggtggggcctgtcgat

SEQ ID NO: 113190 - DNA, 20 bp, human
ggctggaggcagtttctggt

SEQ ID NO: 113191 - DNA, 20 bp, human
gaggaaacggcccatcactg

SEQ ID NO: 113192 - DNA, 20 bp, human
gacccaacacccgaacacct

SEQ ID NO: 113193 - DNA, 20 bp, human
gtgcggggtcccccagtgat

SEQ ID NO: 113194 - DNA, 20 bp, human
gacttcccgtgagaaagtcc

SEQ ID NO: 113195 - DNA, 20 bp, human
gcccgtgagaaagtccaggc

SEQ ID NO: 113196 - DNA, 20 bp, human
gggctctgccctctctggac

SEQ ID NO: 113197 - DNA, 20 bp, human
gcccactaccagtccagaga

SEQ ID NO: 113198 - DNA, 20 bp, human
gaatggaagaagggtctcaa

SEQ ID NO: 113199 - DNA, 20 bp, human
gggctgtgtggatcccgaca

SEQ ID NO: 113200 - DNA, 20 bp, human
gccggacgcacacggtaagg

SEQ ID NO: 113201 - DNA, 20 bp, human
gtgtgtggatcccgacatgg

SEQ ID NO: 113202 - DNA, 20 bp, human
gcgctgccgcagtattgggt

SEQ ID NO: 113203 - DNA, 20 bp, human
ggtgagctgatgacgaggac

SEQ ID NO: 113204 - DNA, 20 bp, human
gtctggactggtagtgggat

SEQ ID NO: 113205 - DNA, 20 bp, human
ggggtgaagactcagtggaa

SEQ ID NO: 113206 - DNA, 20 bp, human
ggtctctggaagggaatcag

SEQ ID NO: 113207 - DNA, 20 bp, human
gaactcaccgacgcagagca

SEQ ID NO: 113208 - DNA, 20 bp, human
gggggctcggcccagatgaa

SEQ ID NO: 113209 - DNA, 20 bp, human
gtagatacacaggaagtggt

SEQ ID NO: 113210 - DNA, 20 bp, human
gctgttgccagggaaattat

SEQ ID NO: 113211 - DNA, 20 bp, human
gggtggagcctaaggttggg

SEQ ID NO: 113212 - DNA, 20 bp, human
ggtccttccttcaaagccca

SEQ ID NO: 113213 - DNA, 20 bp, human
gtttgggagagtctctggaa

SEQ ID NO: 113214 - DNA, 20 bp, human
gagggctgtgtctgagtcag

SEQ ID NO: 113215 - DNA, 20 bp, human
gagcccagggtcactcttcc

SEQ ID NO: 113216 - DNA, 20 bp, human
gggctctcaggcacaatcca

SEQ ID NO: 113217 - DNA, 20 bp, human
ggaatgatgaagtaacgcat

SEQ ID NO: 113218 - DNA, 20 bp, human
ggggacacctggagaagact

SEQ ID NO: 113219 - DNA, 20 bp, human
gagcagtagcagtgggtgta

SEQ ID NO: 113220 - DNA, 20 bp, human
ggctcaggtacttcaaagtg

SEQ ID NO: 113221 - DNA, 20 bp, human
gggagatgggagactgcaaa

SEQ ID NO: 113222 - DNA, 20 bp, human
gcaggcacaatccaaggctc

SEQ ID NO: 113223 - DNA, 20 bp, human
gagtctgggtctggtgggct

SEQ ID NO: 113224 - DNA, 20 bp, human
gacccagactcacctacagc

SEQ ID NO: 113225 - DNA, 20 bp, human
gtcctgtgcgctcatgggag

SEQ ID NO: 113226 - DNA, 20 bp, human
ggctgctggaggagatgtca

SEQ ID NO: 113227 - DNA, 20 bp, human
gaggagtgggactgctccaa

SEQ ID NO: 113228 - DNA, 20 bp, human
gctccaaaggtgacactcag

SEQ ID NO: 113229 - DNA, 20 bp, human
gaaacacacggctctgaggg

SEQ ID NO: 113230 - DNA, 20 bp, human
gagatgtcagggtctctagg

SEQ ID NO: 113231 - DNA, 20 bp, human
gtagggaacgggcttggtgg

SEQ ID NO: 113232 - DNA, 20 bp, human
gagggtctctaggaggccaa

SEQ ID NO: 113233 - DNA, 20 bp, human
gggctggactagatgctata

SEQ ID NO: 113234 - DNA, 20 bp, human
gtagatggctgctaacccaa

SEQ ID NO: 113235 - DNA, 20 bp, human
gtggtgggggctgaaacaca

SEQ ID NO: 113236 - DNA, 20 bp, human
ggtggggctggtcacgcgcc

SEQ ID NO: 113237 - DNA, 20 bp, human
gtttcccaggttcgcactgc

SEQ ID NO: 113238 - DNA, 20 bp, human
gtgtgggcgctgacgaccga

SEQ ID NO: 113239 - DNA, 20 bp, human
ggcgctgacgaccgaaggta

SEQ ID NO: 113240 - DNA, 20 bp, human
ggcggcccggtagaaaccaa

SEQ ID NO: 113241 - DNA, 20 bp, human
ggacgaccgaaggtaggggg

SEQ ID NO: 113242 - DNA, 20 bp, human
gcccagccgccccctacctt

SEQ ID NO: 113243 - DNA, 20 bp, human
gaggagcgccgcgcacgtgg

SEQ ID NO: 113244 - DNA, 20 bp, human
gcagcgcccacagcagaatc

SEQ ID NO: 113245 - DNA, 20 bp, human
gagcgccgcgcacgtggagg

SEQ ID NO: 113246 - DNA, 20 bp, human
gtggatttccccatcctcgg

SEQ ID NO: 113247 - DNA, 20 bp, human
gccgggcggggaggacggag

SEQ ID NO: 113248 - DNA, 20 bp, human
ggtgtggccgcggtcgtccc

SEQ ID NO: 113249 - DNA, 20 bp, human
gcagcagcgagcatgtgccg

SEQ ID NO: 113250 - DNA, 20 bp, human
gccctggttactgggctccg

SEQ ID NO: 113251 - DNA, 20 bp, human
ggcggcccgggaacctccga

SEQ ID NO: 113252 - DNA, 20 bp, human
ggccgcggagcccagtaacc

SEQ ID NO: 113253 - DNA, 20 bp, human
gggctgggagcactcacagt

SEQ ID NO: 113254 - DNA, 20 bp, human
ggcggtcgtccctggttact

SEQ ID NO: 113255 - DNA, 20 bp, human
gacctccgaggggtccacat

SEQ ID NO: 113256 - DNA, 20 bp, human
gcagagaggcaagatggcta

SEQ ID NO: 113257 - DNA, 20 bp, human
gagatggctacggcaggggg

SEQ ID NO: 113258 - DNA, 20 bp, human
ggggctgacccgggaagtcg

SEQ ID NO: 113259 - DNA, 20 bp, human
gggcaagatggctacggcag

SEQ ID NO: 113260 - DNA, 20 bp, human
gacagacaggagccgaacgg

SEQ ID NO: 113261 - DNA, 20 bp, human
gaaggagaccccgacttccc

SEQ ID NO: 113262 - DNA, 20 bp, human
gggaggcctcacctgctagt

SEQ ID NO: 113263 - DNA, 20 bp, human
gcgagacatctggacaaagt

SEQ ID NO: 113264 - DNA, 20 bp, human
gcaggaagaggcctagagaa

SEQ ID NO: 113265 - DNA, 20 bp, human
gggggcagcaggaaccagaa

SEQ ID NO: 113266 - DNA, 20 bp, human
gcaggtcgcgggacatactg

SEQ ID NO: 113267 - DNA, 20 bp, human
gtcctgtacgccctagacta

SEQ ID NO: 113268 - DNA, 20 bp, human
gcaagggtaccgtatccagt

SEQ ID NO: 113269 - DNA, 20 bp, human
gctaggggccgccatctcca

SEQ ID NO: 113270 - DNA, 20 bp, human
gcagcgtggagagaacgcgt

SEQ ID NO: 113271 - DNA, 20 bp, human
gagatggcggcccctagtct

SEQ ID NO: 113272 - DNA, 20 bp, human
gcccctagtctagggcgtac

SEQ ID NO: 113273 - DNA, 20 bp, human
gggttagggtccagtaagca

SEQ ID NO: 113274 - DNA, 20 bp, human
gaactccaggaaccgccctc

SEQ ID NO: 113275 - DNA, 20 bp, human
gagaaatgtggcattagtag

SEQ ID NO: 113276 - DNA, 20 bp, human
gcagcggtcatcaaaacacc

SEQ ID NO: 113277 - DNA, 20 bp, human
ggtgcaagtatctgctagac

SEQ ID NO: 113278 - DNA, 20 bp, human
gaggctcgggagaggaaacg

SEQ ID NO: 113279 - DNA, 20 bp, human
gggacactgatgaggagtgg

SEQ ID NO: 113280 - DNA, 20 bp, human
gggacaagagaggactcgtt

SEQ ID NO: 113281 - DNA, 20 bp, human
gtgcgtaatgacgtcagcgc

SEQ ID NO: 113282 - DNA, 20 bp, human
gaacggggaagaattgaagg

SEQ ID NO: 113283 - DNA, 20 bp, human
gtagcttcttatggccgtgt

SEQ ID NO: 113284 - DNA, 20 bp, human
gggagaatttcaaattcgaa

SEQ ID NO: 113285 - DNA, 20 bp, human
gaagagaggactcgttgggt

SEQ ID NO: 113286 - DNA, 20 bp, human
ggcccctgctcgggtaagtg

SEQ ID NO: 113287 - DNA, 20 bp, human
ggcctcacttacccgagcag

SEQ ID NO: 113288 - DNA, 20 bp, human
gcatctaggagaggagtatg

SEQ ID NO: 113289 - DNA, 20 bp, human
gggcgaggccaacgcggcgg

SEQ ID NO: 113290 - DNA, 20 bp, human
gcagaggcggctgcgaaggg

SEQ ID NO: 113291 - DNA, 20 bp, human
gaggggcggcgaggccaacg

SEQ ID NO: 113292 - DNA, 20 bp, human
ggccagcgcgaggaacgcac

SEQ ID NO: 113293 - DNA, 20 bp, human
gaaagaaacgagggtcatct

SEQ ID NO: 113294 - DNA, 20 bp, human
gccacccaggaagtcccgga

SEQ ID NO: 113295 - DNA, 20 bp, human
gtttaggacgggaggctcca

SEQ ID NO: 113296 - DNA, 20 bp, human
gagctcgtgacgtggacccg

SEQ ID NO: 113297 - DNA, 20 bp, human
ggtcgaaaggaaccttgaag

SEQ ID NO: 113298 - DNA, 20 bp, human
gggagaatgagctcgtgacg

SEQ ID NO: 113299 - DNA, 20 bp, human
gtaaatctagtgcaacctag

SEQ ID NO: 113300 - DNA, 20 bp, human
gaattctattaaatcctggt

SEQ ID NO: 113301 - DNA, 20 bp, human
ggcgtttccagtgacaggtt

SEQ ID NO: 113302 - DNA, 20 bp, human
gttcacgttgtggagtcgaa

SEQ ID NO: 113303 - DNA, 20 bp, human
ggaactccgggggacctcgt

SEQ ID NO: 113304 - DNA, 20 bp, human
gtgctcgcccaacctgtcac

SEQ ID NO: 113305 - DNA, 20 bp, human
gacgtgacgagacccgagag

SEQ ID NO: 113306 - DNA, 20 bp, human
gccgatgtgtggccccccag

SEQ ID NO: 113307 - DNA, 20 bp, human
gggagctcggggctgcgtag

SEQ ID NO: 113308 - DNA, 20 bp, human
ggtacgctgagtggagctcg

SEQ ID NO: 113309 - DNA, 20 bp, human
gggagtggcccagtcggagg

SEQ ID NO: 113310 - DNA, 20 bp, human
gcaaggagtggcccagtcgg

SEQ ID NO: 113311 - DNA, 20 bp, human
gcctcaccctacccggaacg

SEQ ID NO: 113312 - DNA, 20 bp, human
ggccgctgccacctccgact

SEQ ID NO: 113313 - DNA, 20 bp, human
gggcgcggaggtacgctgag

SEQ ID NO: 113314 - DNA, 20 bp, human
ggcccagtcggaggtggcag

SEQ ID NO: 113315 - DNA, 20 bp, human
gagcccacggtgccacgtcc

SEQ ID NO: 113316 - DNA, 20 bp, human
gagagcgtctcgcccgggag

SEQ ID NO: 113317 - DNA, 20 bp, human
gcgggcgagacgctcttctc

SEQ ID NO: 113318 - DNA, 20 bp, human
gaccgccggagtcccacctg

SEQ ID NO: 113319 - DNA, 20 bp, human
gaccccaggtgggactccgg

SEQ ID NO: 113320 - DNA, 20 bp, human
gcacaggcggcatcgatctg

SEQ ID NO: 113321 - DNA, 20 bp, human
ggcgtctcgcccgggagcgg

SEQ ID NO: 113322 - DNA, 20 bp, human
gcccacctggggtcgcagac

SEQ ID NO: 113323 - DNA, 20 bp, human
gcgccgccgaggctccgacg

SEQ ID NO: 113324 - DNA, 20 bp, human
gcgccttgggtgggtctcga

SEQ ID NO: 113325 - DNA, 20 bp, human
gagggggacgcgccttgggt

SEQ ID NO: 113326 - DNA, 20 bp, human
gggaagctcttcacttcctg

SEQ ID NO: 113327 - DNA, 20 bp, human
gggttccgcggagaagctcc

SEQ ID NO: 113328 - DNA, 20 bp, human
gaccaacgcggaggtctcgg

SEQ ID NO: 113329 - DNA, 20 bp, human
gtgcagccgcggtctcccgg

SEQ ID NO: 113330 - DNA, 20 bp, human
gaccgcggctgcaggaacgg

SEQ ID NO: 113331 - DNA, 20 bp, human
gcggccgctgcgggagccac

SEQ ID NO: 113332 - DNA, 20 bp, human
gaggcaggagtgcgcaggtg

SEQ ID NO: 113333 - DNA, 20 bp, human
ggcgccccggagcttctccg

SEQ ID NO: 113334 - DNA, 20 bp, human
ggccgccgagacctccgcgt

SEQ ID NO: 113335 - DNA, 20 bp, human
gggaaccgcgaccaacgcgg

SEQ ID NO: 113336 - DNA, 20 bp, human
gtgtctgcgccgtctggcaa

SEQ ID NO: 113337 - DNA, 20 bp, human
gcttcctctccaggaatccg

SEQ ID NO: 113338 - DNA, 20 bp, human
gcctctccaggaatccgcgg

SEQ ID NO: 113339 - DNA, 20 bp, human
ggaaggcgcacgagctcatg

SEQ ID NO: 113340 - DNA, 20 bp, human
gggccgtcgggcctagagga

SEQ ID NO: 113341 - DNA, 20 bp, human
gcccaggccccgaacgacga

SEQ ID NO: 113342 - DNA, 20 bp, human
ggacatgtcagaacaaagta

SEQ ID NO: 113343 - DNA, 20 bp, human
gcatcggcagctacaagaag

SEQ ID NO: 113344 - DNA, 20 bp, human
gcgctccctccgcggattcc

SEQ ID NO: 113345 - DNA, 20 bp, human
ggtggtgcaggagcatcctc

SEQ ID NO: 113346 - DNA, 20 bp, human
gtctctcgcggctggaagtg

SEQ ID NO: 113347 - DNA, 20 bp, human
gcaaagttgggacacttcag

SEQ ID NO: 113348 - DNA, 20 bp, human
ggcggggctggggaatcccg

SEQ ID NO: 113349 - DNA, 20 bp, human
gcaggaacgagaagcctgga

SEQ ID NO: 113350 - DNA, 20 bp, human
gccggggcagcgccgagaag

SEQ ID NO: 113351 - DNA, 20 bp, human
gggcttcagcagtgacactc

SEQ ID NO: 113352 - DNA, 20 bp, human
gtgggagagccgggcgcacg

SEQ ID NO: 113353 - DNA, 20 bp, human
gagttagctccactctctcg

SEQ ID NO: 113354 - DNA, 20 bp, human
gcaggcgcctgtgcgactag

SEQ ID NO: 113355 - DNA, 20 bp, human
ggttgctgcgaagtggagta

SEQ ID NO: 113356 - DNA, 20 bp, human
ggtcggcgacccgctaacgc

SEQ ID NO: 113357 - DNA, 20 bp, human
gtgccggcgcacactccggt

SEQ ID NO: 113358 - DNA, 20 bp, human
gcaggtgccggcgcacactc

SEQ ID NO: 113359 - DNA, 20 bp, human
gtccggtaggcaagcagccg

SEQ ID NO: 113360 - DNA, 20 bp, human
gcgacactgcgcgcgcctcc

SEQ ID NO: 113361 - DNA, 20 bp, human
gcgacccgcaatccccgccg

SEQ ID NO: 113362 - DNA, 20 bp, human
gtgcgcgcgcctccaggcac

SEQ ID NO: 113363 - DNA, 20 bp, human
ggccgcggctgcttgcctac

SEQ ID NO: 113364 - DNA, 20 bp, human
gcgctaacgccggtgcctgg

SEQ ID NO: 113365 - DNA, 20 bp, human
gcagccgcggcggggattgc

SEQ ID NO: 113366 - DNA, 20 bp, human
gggtcgatgaccccgcgagg

SEQ ID NO: 113367 - DNA, 20 bp, human
gcggagcggtccctgcaacc

SEQ ID NO: 113368 - DNA, 20 bp, human
gtagtctcagaccagaccac

SEQ ID NO: 113369 - DNA, 20 bp, human
ggccctggactcctacccgg

SEQ ID NO: 113370 - DNA, 20 bp, human
gactagaaggcagttcccgc

SEQ ID NO: 113371 - DNA, 20 bp, human
gcggggtgcgcccggtggtc

SEQ ID NO: 113372 - DNA, 20 bp, human
gcggtggtgagggctcgcta

SEQ ID NO: 113373 - DNA, 20 bp, human
gagcctgagtaaaggagaag

SEQ ID NO: 113374 - DNA, 20 bp, human
gagctgcgggctcggcatcg

SEQ ID NO: 113375 - DNA, 20 bp, human
gagttcagtttagcacctgg

SEQ ID NO: 113376 - DNA, 20 bp, human
gaggcaagccatgtgacaga

SEQ ID NO: 113377 - DNA, 20 bp, human
gctcatcccacttacaatgg

SEQ ID NO: 113378 - DNA, 20 bp, human
ggggctccatgaatccatgt

SEQ ID NO: 113379 - DNA, 20 bp, human
gtagttgaccccgtgaaagg

SEQ ID NO: 113380 - DNA, 20 bp, human
gcttaccttaggggaacgca

SEQ ID NO: 113381 - DNA, 20 bp, human
gggagccctgcgttccccta

SEQ ID NO: 113382 - DNA, 20 bp, human
gttttctgagagctagaaag

SEQ ID NO: 113383 - DNA, 20 bp, human
gcttcgcagccccctttcac

SEQ ID NO: 113384 - DNA, 20 bp, human
gacttgccaacatggattca

SEQ ID NO: 113385 - DNA, 20 bp, human
gtagtgcccccattgtaagt

SEQ ID NO: 113386 - DNA, 20 bp, human
gtttgtttacgtccgggcgg

SEQ ID NO: 113387 - DNA, 20 bp, human
gctgcgtgctgggactgcga

SEQ ID NO: 113388 - DNA, 20 bp, human
ggccccgcggaagccgaggg

SEQ ID NO: 113389 - DNA, 20 bp, human
gagcgccccgcggaagccga

SEQ ID NO: 113390 - DNA, 20 bp, human
ggacggtccgaaaaaatacc

SEQ ID NO: 113391 - DNA, 20 bp, human
ggagtacgcggggctacaaa

SEQ ID NO: 113392 - DNA, 20 bp, human
gaggggtgcgcgctggacgt

SEQ ID NO: 113393 - DNA, 20 bp, human
gacgccaggaaacgctatcc

SEQ ID NO: 113394 - DNA, 20 bp, human
ggaaccccaatccccagcta

SEQ ID NO: 113395 - DNA, 20 bp, human
gcgtcgcgcctgggagaaga

SEQ ID NO: 113396 - DNA, 20 bp, human
ggtcgggacgcagcaaagag

SEQ ID NO: 113397 - DNA, 20 bp, human
gagccgagggatccctctca

SEQ ID NO: 113398 - DNA, 20 bp, human
gctacacggagactgagtag

SEQ ID NO: 113399 - DNA, 20 bp, human
gcggctgctccgggagaagt

SEQ ID NO: 113400 - DNA, 20 bp, human
gcgggagaagttggacaaca

SEQ ID NO: 113401 - DNA, 20 bp, human
gcgtcccgacgcctgctctc

SEQ ID NO: 113402 - DNA, 20 bp, human
ggagtagaggagagaagcga

SEQ ID NO: 113403 - DNA, 20 bp, human
gaaggtggaagcggccgcgg

SEQ ID NO: 113404 - DNA, 20 bp, human
ggggcaggcgaggggccgta

SEQ ID NO: 113405 - DNA, 20 bp, human
gcccggagcagccggagagc

SEQ ID NO: 113406 - DNA, 20 bp, human
gcgcgcggcgccgcattcgg

SEQ ID NO: 113407 - DNA, 20 bp, human
gctgacctgggtccggcggg

SEQ ID NO: 113408 - DNA, 20 bp, human
gggaggcgctcactcacctg

SEQ ID NO: 113409 - DNA, 20 bp, human
ggctgctgctgcactgacgg

SEQ ID NO: 113410 - DNA, 20 bp, human
gagatggatgagcaacccca

SEQ ID NO: 113411 - DNA, 20 bp, human
ggccgctgctgctgcactga

SEQ ID NO: 113412 - DNA, 20 bp, human
gcaagcagcacgggccacca

SEQ ID NO: 113413 - DNA, 20 bp, human
gggagcgacgcccccgaatg

SEQ ID NO: 113414 - DNA, 20 bp, human
ggctcactcacctgaggcgc

SEQ ID NO: 113415 - DNA, 20 bp, human
ggcccctcttccaagcatct

SEQ ID NO: 113416 - DNA, 20 bp, human
gctgagtcactcgggtccag

SEQ ID NO: 113417 - DNA, 20 bp, human
gctagcgcccgggtccacac

SEQ ID NO: 113418 - DNA, 20 bp, human
ggggcgggggcagctcgagt

SEQ ID NO: 113419 - DNA, 20 bp, human
ggatggtcggctctgtgatg

SEQ ID NO: 113420 - DNA, 20 bp, human
gcacggtcagagggacatgc

SEQ ID NO: 113421 - DNA, 20 bp, human
ggagggaacccgcctctacc

SEQ ID NO: 113422 - DNA, 20 bp, human
ggaacccgcctctaccagga

SEQ ID NO: 113423 - DNA, 20 bp, human
gccagagggcacacggtcag

SEQ ID NO: 113424 - DNA, 20 bp, human
gtagtcagagcccatagcag

SEQ ID NO: 113425 - DNA, 20 bp, human
ggggcagctcgagtgggaga

SEQ ID NO: 113426 - DNA, 20 bp, human
ggatcgaaccccgctcccag

SEQ ID NO: 113427 - DNA, 20 bp, human
gtctctggccggcacccacg

SEQ ID NO: 113428 - DNA, 20 bp, human
gcggctggggcgccactcgg

SEQ ID NO: 113429 - DNA, 20 bp, human
gcggcacccacgcggcatca

SEQ ID NO: 113430 - DNA, 20 bp, human
gcagcggccgcgattcgggg

SEQ ID NO: 113431 - DNA, 20 bp, human
gggccagagaagagctccgg

SEQ ID NO: 113432 - DNA, 20 bp, human
gcgatcccgtgatgccgcgt

SEQ ID NO: 113433 - DNA, 20 bp, human
gcgctgggccgaggaggtaa

SEQ ID NO: 113434 - DNA, 20 bp, human
ggctcggagataggggtcaa

SEQ ID NO: 113435 - DNA, 20 bp, human
gctccccgctgcgggacgag

SEQ ID NO: 113436 - DNA, 20 bp, human
gccccgccgagaggagacgg

SEQ ID NO: 113437 - DNA, 20 bp, human
gagcgttcgctcggagatgg

SEQ ID NO: 113438 - DNA, 20 bp, human
gcgaagagcgcaccggatgt

SEQ ID NO: 113439 - DNA, 20 bp, human
ggtggatgcgaagagcgcac

SEQ ID NO: 113440 - DNA, 20 bp, human
gcagagcgttcgctcggaga

SEQ ID NO: 113441 - DNA, 20 bp, human
ggagcccgcccggtccggag

SEQ ID NO: 113442 - DNA, 20 bp, human
gtgatggtggcaacatccaa

SEQ ID NO: 113443 - DNA, 20 bp, human
gtccgagcgggtgccaccag

SEQ ID NO: 113444 - DNA, 20 bp, human
ggcccgtggccccgaaagca

SEQ ID NO: 113445 - DNA, 20 bp, human
gaccggatgtgggacaccaa

SEQ ID NO: 113446 - DNA, 20 bp, human
gctcctgcgctggagaacca

SEQ ID NO: 113447 - DNA, 20 bp, human
gggatctgcgcggacacagc

SEQ ID NO: 113448 - DNA, 20 bp, human
gacacagctggtggcgactt

SEQ ID NO: 113449 - DNA, 20 bp, human
gaggccgaagacccgaggga

SEQ ID NO: 113450 - DNA, 20 bp, human
gcagcctcttgagtgactgt

SEQ ID NO: 113451 - DNA, 20 bp, human
gcgcggccgggcgggtccca

SEQ ID NO: 113452 - DNA, 20 bp, human
gagaccggccccgtcctcca

SEQ ID NO: 113453 - DNA, 20 bp, human
ggtggcgacttcggccgctc

SEQ ID NO: 113454 - DNA, 20 bp, human
gcaagcgccacccggacgag

SEQ ID NO: 113455 - DNA, 20 bp, human
ggcagatcccgggcgcggag

SEQ ID NO: 113456 - DNA, 20 bp, human
gccgactacagctaaacaag

SEQ ID NO: 113457 - DNA, 20 bp, human
ggcaggagcagctggtattc

SEQ ID NO: 113458 - DNA, 20 bp, human
gggacacgagaattacacca

SEQ ID NO: 113459 - DNA, 20 bp, human
gagagttcagacactaagac

SEQ ID NO: 113460 - DNA, 20 bp, human
gcacatctccagaactataa

SEQ ID NO: 113461 - DNA, 20 bp, human
gttctggagatgtgagagag

SEQ ID NO: 113462 - DNA, 20 bp, human
gttaacggtgtgctgaacag

SEQ ID NO: 113463 - DNA, 20 bp, human
ggttgccggaacatttgcat

SEQ ID NO: 113464 - DNA, 20 bp, human
gtggctccaggttaattaga

SEQ ID NO: 113465 - DNA, 20 bp, human
gatgagaactatttaatcac

SEQ ID NO: 113466 - DNA, 20 bp, human
gtactgctgccgctttctcc

SEQ ID NO: 113467 - DNA, 20 bp, human
gacccagagcccggagaaag

SEQ ID NO: 113468 - DNA, 20 bp, human
gtttcaaggacccagaagta

SEQ ID NO: 113469 - DNA, 20 bp, human
gtgtatcagagtgggcctta

SEQ ID NO: 113470 - DNA, 20 bp, human
gggttttggcctaggtaacg

SEQ ID NO: 113471 - DNA, 20 bp, human
gggcaaccggaagcaagtag

SEQ ID NO: 113472 - DNA, 20 bp, human
ggggcagagtagcgacgcgg

SEQ ID NO: 113473 - DNA, 20 bp, human
gcgcccatgacggagagtcc

SEQ ID NO: 113474 - DNA, 20 bp, human
ggcgtcgctactctgcccta

SEQ ID NO: 113475 - DNA, 20 bp, human
ggcaagtagagggccgacct

SEQ ID NO: 113476 - DNA, 20 bp, human
gtcaaggacccaaggggacg

SEQ ID NO: 113477 - DNA, 20 bp, human
gggacgtcgctgccagcttc

SEQ ID NO: 113478 - DNA, 20 bp, human
gcggcctgccacctgcacac

SEQ ID NO: 113479 - DNA, 20 bp, human
gttcaggagccgcaaggcca

SEQ ID NO: 113480 - DNA, 20 bp, human
gctcaggatcaaggacccaa

SEQ ID NO: 113481 - DNA, 20 bp, human
ggccttgcggctcctgaagc

SEQ ID NO: 113482 - DNA, 20 bp, human
gcccggtcagctcaggatca

SEQ ID NO: 113483 - DNA, 20 bp, human
gatggctacccggtcagctc

SEQ ID NO: 113484 - DNA, 20 bp, human
gcccgccgccacgacccggg

SEQ ID NO: 113485 - DNA, 20 bp, human
ggcgtccgcccgggtcgtgg

SEQ ID NO: 113486 - DNA, 20 bp, human
gtagtccctggggtcatctg

SEQ ID NO: 113487 - DNA, 20 bp, human
gaccgcctcagatgacccca

SEQ ID NO: 113488 - DNA, 20 bp, human
gtccctggggtcatctgagg

SEQ ID NO: 113489 - DNA, 20 bp, human
ggtctcgcgatagccagccg

SEQ ID NO: 113490 - DNA, 20 bp, human
gccacggaccccgccagctc

SEQ ID NO: 113491 - DNA, 20 bp, human
gggaagcgcaagggcagccg

SEQ ID NO: 113492 - DNA, 20 bp, human
ggaaattgtggagtgagaca

SEQ ID NO: 113493 - DNA, 20 bp, human
gaggccgcagggaggtcgtg

SEQ ID NO: 113494 - DNA, 20 bp, human
ggaggtcgtggggttactgg

SEQ ID NO: 113495 - DNA, 20 bp, human
gtgcgacaagctagtccctg

SEQ ID NO: 113496 - DNA, 20 bp, human
gagcagatcaccggccacgg

SEQ ID NO: 113497 - DNA, 20 bp, human
gtgggcttcctgcggctgag

SEQ ID NO: 113498 - DNA, 20 bp, human
gtagtgcaggtcctgaaacg

SEQ ID NO: 113499 - DNA, 20 bp, human
gttacagacaaggaactgta

SEQ ID NO: 113500 - DNA, 20 bp, human
gtgcagcagatcaccggcca

SEQ ID NO: 113501 - DNA, 20 bp, human
gcggtctccgaggctatcta

SEQ ID NO: 113502 - DNA, 20 bp, human
gatagcctcggagaccgccg

SEQ ID NO: 113503 - DNA, 20 bp, human
gcacgccctggagagtaatg

SEQ ID NO: 113504 - DNA, 20 bp, human
gggcaagatggagttagtgc

SEQ ID NO: 113505 - DNA, 20 bp, human
gcggggccagcgaggcaaga

SEQ ID NO: 113506 - DNA, 20 bp, human
ggcccatagccccccggcgg

SEQ ID NO: 113507 - DNA, 20 bp, human
ggacccgacagtcctcgacg

SEQ ID NO: 113508 - DNA, 20 bp, human
gggcctgcgcaacaccccag

SEQ ID NO: 113509 - DNA, 20 bp, human
gtgggcccatagccccccgg

SEQ ID NO: 113510 - DNA, 20 bp, human
gcgatgggcccatagccccc

SEQ ID NO: 113511 - DNA, 20 bp, human
gcagggctccacgtagtcac

SEQ ID NO: 113512 - DNA, 20 bp, human
gagaaggccgcggctcccca

SEQ ID NO: 113513 - DNA, 20 bp, human
ggatgagaggccactagcaa

SEQ ID NO: 113514 - DNA, 20 bp, human
gtgggatactgcgagtatgg

SEQ ID NO: 113515 - DNA, 20 bp, human
gctcaccccaatccctggaa

SEQ ID NO: 113516 - DNA, 20 bp, human
gatattaacaaggatggcgg

SEQ ID NO: 113517 - DNA, 20 bp, human
ggggcgagcgctgacataag

SEQ ID NO: 113518 - DNA, 20 bp, human
ggcagcaagtcgaggagtcg

SEQ ID NO: 113519 - DNA, 20 bp, human
gagcacttggcctgaagacc

SEQ ID NO: 113520 - DNA, 20 bp, human
gtggcctgaagacctggaat

SEQ ID NO: 113521 - DNA, 20 bp, human
gcggcggccgcagcaagtcg

SEQ ID NO: 113522 - DNA, 20 bp, human
gccaagctctgggcccgcta

SEQ ID NO: 113523 - DNA, 20 bp, human
gggtgagtgcgggacgccag

SEQ ID NO: 113524 - DNA, 20 bp, human
ggggtctggggctccggtag

SEQ ID NO: 113525 - DNA, 20 bp, human
gtcgatattaacaaggatgg

SEQ ID NO: 113526 - DNA, 20 bp, human
ggagggttagaggtcaccgg

SEQ ID NO: 113527 - DNA, 20 bp, human
gcctgccgcacctcagtccc

SEQ ID NO: 113528 - DNA, 20 bp, human
ggccgccgcggagacaaaga

SEQ ID NO: 113529 - DNA, 20 bp, human
gggacccgagggcggcgata

SEQ ID NO: 113530 - DNA, 20 bp, human
gactagaggggacccgaggg

SEQ ID NO: 113531 - DNA, 20 bp, human
gcagtcccaggaccgcccag

SEQ ID NO: 113532 - DNA, 20 bp, human
gtgcgagtaagtgcaggttc

SEQ ID NO: 113533 - DNA, 20 bp, human
gacacactagaggggacccg

SEQ ID NO: 113534 - DNA, 20 bp, human
gggcggcgatagggctttag

SEQ ID NO: 113535 - DNA, 20 bp, human
gtagtgtgtctgcaccccca

SEQ ID NO: 113536 - DNA, 20 bp, human
gtatctgcaatgagacacta

SEQ ID NO: 113537 - DNA, 20 bp, human
gcagggtctggtctgacgga

SEQ ID NO: 113538 - DNA, 20 bp, human
gtgcggcagaggtctccgac

SEQ ID NO: 113539 - DNA, 20 bp, human
gcccgacgcaagaaggacaa

SEQ ID NO: 113540 - DNA, 20 bp, human
gcaggttgtgcggtccagga

SEQ ID NO: 113541 - DNA, 20 bp, human
gcagagatggtataacacat

SEQ ID NO: 113542 - DNA, 20 bp, human
gtccttcaggtaggaggtcc

SEQ ID NO: 113543 - DNA, 20 bp, human
ggtgggtcagagactagcat

SEQ ID NO: 113544 - DNA, 20 bp, human
gggatagatgtgcgctgtgt

SEQ ID NO: 113545 - DNA, 20 bp, human
gagatgacaaacactaggcg

SEQ ID NO: 113546 - DNA, 20 bp, human
gtagaagcgggccccaagac

SEQ ID NO: 113547 - DNA, 20 bp, human
ggactgggaaaacaacgata

SEQ ID NO: 113548 - DNA, 20 bp, human
gtatggcaggagccagtctt

SEQ ID NO: 113549 - DNA, 20 bp, human
gggttctgaggactcacccc

SEQ ID NO: 113550 - DNA, 20 bp, human
gggcagattaagccgatcat

SEQ ID NO: 113551 - DNA, 20 bp, human
gcagatcaaaagacatccgg

SEQ ID NO: 113552 - DNA, 20 bp, human
gggatgatctgcggggaaga

SEQ ID NO: 113553 - DNA, 20 bp, human
gcgatcatcgggatgatctg

SEQ ID NO: 113554 - DNA, 20 bp, human
gtaggagcgctgagggacct

SEQ ID NO: 113555 - DNA, 20 bp, human
ggcttaatctgcctgggcat

SEQ ID NO: 113556 - DNA, 20 bp, human
gcatgacagcgccaacgact

SEQ ID NO: 113557 - DNA, 20 bp, human
gtaacctgccctacccggta

SEQ ID NO: 113558 - DNA, 20 bp, human
gaagaaggtgagacgaatgg

SEQ ID NO: 113559 - DNA, 20 bp, human
gctgcatgccttaccgggta

SEQ ID NO: 113560 - DNA, 20 bp, human
gctgaagaaggtgagacgaa

SEQ ID NO: 113561 - DNA, 20 bp, human
ggtctgagaattgttcccaa

SEQ ID NO: 113562 - DNA, 20 bp, human
gttgtgcgtcaccgagtcgt

SEQ ID NO: 113563 - DNA, 20 bp, human
ggtgtgcaatactcctcacg

SEQ ID NO: 113564 - DNA, 20 bp, human
gcaaaggtacatacctcgtg

SEQ ID NO: 113565 - DNA, 20 bp, human
gtcaacacccgcgggaagta

SEQ ID NO: 113566 - DNA, 20 bp, human
gggatgctttggcaagatgg

SEQ ID NO: 113567 - DNA, 20 bp, human
gggcttcacgaaggtgctgg

SEQ ID NO: 113568 - DNA, 20 bp, human
gcagctgaggtcaccaactt

SEQ ID NO: 113569 - DNA, 20 bp, human
gtcatgtcccgactgaaaat

SEQ ID NO: 113570 - DNA, 20 bp, human
gatgggcttcacgaaggtgc

SEQ ID NO: 113571 - DNA, 20 bp, human
gctgaaaatgggcttcacga

SEQ ID NO: 113572 - DNA, 20 bp, human
ggcgctgcttgcaaaggggt

SEQ ID NO: 113573 - DNA, 20 bp, human
gggccggctacgaccttgag

SEQ ID NO: 113574 - DNA, 20 bp, human
gggttgtggagtggatgctt

SEQ ID NO: 113575 - DNA, 20 bp, human
ggctggcggtagaagtagct

SEQ ID NO: 113576 - DNA, 20 bp, human
gagccgctggatgagacggg

SEQ ID NO: 113577 - DNA, 20 bp, human
gcgccacccgtctcatccag

SEQ ID NO: 113578 - DNA, 20 bp, human
gccgcagccgctggatgaga

SEQ ID NO: 113579 - DNA, 20 bp, human
ggcaccccaggagagaggaa

SEQ ID NO: 113580 - DNA, 20 bp, human
gccagcggtggagacgtcac

SEQ ID NO: 113581 - DNA, 20 bp, human
ggacagggctgcaccatggg

SEQ ID NO: 113582 - DNA, 20 bp, human
gcagtatcgcggacggaaga

SEQ ID NO: 113583 - DNA, 20 bp, human
ggctgcgcccttcagtatcg

SEQ ID NO: 113584 - DNA, 20 bp, human
gagagggtcccgggctgaag

SEQ ID NO: 113585 - DNA, 20 bp, human
ggcaaggcaccccaggagag

SEQ ID NO: 113586 - DNA, 20 bp, human
gggctgagggcttctcgtcg

SEQ ID NO: 113587 - DNA, 20 bp, human
gaaggggagttcaaggagac

SEQ ID NO: 113588 - DNA, 20 bp, human
gcggtcgaaaggggagttca

SEQ ID NO: 113589 - DNA, 20 bp, human
gtggcactcggcggtcgaaa

SEQ ID NO: 113590 - DNA, 20 bp, human
gggcgccgtgtggcactcgg

SEQ ID NO: 113591 - DNA, 20 bp, human
ggatccgcggagcccaaggg

SEQ ID NO: 113592 - DNA, 20 bp, human
gcgcatgcgcaggcgccgtg

SEQ ID NO: 113593 - DNA, 20 bp, human
gcctgggcctagcccccctt

SEQ ID NO: 113594 - DNA, 20 bp, human
gcaaggagacgggggcgacg

SEQ ID NO: 113595 - DNA, 20 bp, human
gcgctgtggagggcgaaagg

SEQ ID NO: 113596 - DNA, 20 bp, human
ggtttggagctgcctcagtc

SEQ ID NO: 113597 - DNA, 20 bp, human
gacgtaagtgttaccgggaa

SEQ ID NO: 113598 - DNA, 20 bp, human
ggacaggacccggacaaccc

SEQ ID NO: 113599 - DNA, 20 bp, human
ggtctcggaatcccgaccag

SEQ ID NO: 113600 - DNA, 20 bp, human
ggaccaggggccgccgttcc

SEQ ID NO: 113601 - DNA, 20 bp, human
gtaagtgttaccgggaacgg

SEQ ID NO: 113602 - DNA, 20 bp, human
gcagcactcccggctgacta

SEQ ID NO: 113603 - DNA, 20 bp, human
gcagccgggagtgctgtcgt

SEQ ID NO: 113604 - DNA, 20 bp, human
gacacttacgtgacattgac

SEQ ID NO: 113605 - DNA, 20 bp, human
ggggagaaatgtgtaaggga

SEQ ID NO: 113606 - DNA, 20 bp, human
ggcgggcaggcggctgacat

SEQ ID NO: 113607 - DNA, 20 bp, human
gggcgcagtgcatcctgggt

SEQ ID NO: 113608 - DNA, 20 bp, human
ggcggctgacataggctgaa

SEQ ID NO: 113609 - DNA, 20 bp, human
gcggccagcatccggacccg

SEQ ID NO: 113610 - DNA, 20 bp, human
gacccggggcagcggcgcaa

SEQ ID NO: 113611 - DNA, 20 bp, human
ggtccccgcggagcagagag

SEQ ID NO: 113612 - DNA, 20 bp, human
ggccatggctacgccaaccc

SEQ ID NO: 113613 - DNA, 20 bp, human
gcaggcaggggtgacccggg

SEQ ID NO: 113614 - DNA, 20 bp, human
gccggaaaggaaccctggtc

SEQ ID NO: 113615 - DNA, 20 bp, human
gtcctgggttggcgtagcca

SEQ ID NO: 113616 - DNA, 20 bp, human
gccggcggttggtgtgtccc

SEQ ID NO: 113617 - DNA, 20 bp, human
gaaggtacactataggctcg

SEQ ID NO: 113618 - DNA, 20 bp, human
gtgggcggaaggtacactat

SEQ ID NO: 113619 - DNA, 20 bp, human
ggtacactataggctcgggg

SEQ ID NO: 113620 - DNA, 20 bp, human
ggtgcgggaggtatacgcca

SEQ ID NO: 113621 - DNA, 20 bp, human
gcccaccgtcaacctcaggg

SEQ ID NO: 113622 - DNA, 20 bp, human
gaccgccctgaggttgacgg

SEQ ID NO: 113623 - DNA, 20 bp, human
gactggacaataccgccctg

SEQ ID NO: 113624 - DNA, 20 bp, human
ggggtaaagtggcttctggg

SEQ ID NO: 113625 - DNA, 20 bp, human
gtggcacttgagggttgagg

SEQ ID NO: 113626 - DNA, 20 bp, human
gcggtgatatatccggccaa

SEQ ID NO: 113627 - DNA, 20 bp, human
gtactagaagggctccagga

SEQ ID NO: 113628 - DNA, 20 bp, human
gggcagcgctggaaactggg

SEQ ID NO: 113629 - DNA, 20 bp, human
gcagtccagggctaaaactg

SEQ ID NO: 113630 - DNA, 20 bp, human
gtaacagcgcaagcagcccg

SEQ ID NO: 113631 - DNA, 20 bp, human
ggggaaggcgctgggtagta

SEQ ID NO: 113632 - DNA, 20 bp, human
gagccctggactggcgacgg

SEQ ID NO: 113633 - DNA, 20 bp, human
gccgacccagcccaccgagg

SEQ ID NO: 113634 - DNA, 20 bp, human
gcgctgggtagtagggaccg

SEQ ID NO: 113635 - DNA, 20 bp, human
ggtgattgcgaggtcagtaa

SEQ ID NO: 113636 - DNA, 20 bp, human
gcgcgcggcgaagtcgtcac

SEQ ID NO: 113637 - DNA, 20 bp, human
gctcccaacccggggactaa

SEQ ID NO: 113638 - DNA, 20 bp, human
gacggtgcccgaagccccaa

SEQ ID NO: 113639 - DNA, 20 bp, human
gagcgcgagagcggtggcca

SEQ ID NO: 113640 - DNA, 20 bp, human
ggccatggctgaccaacgcg

SEQ ID NO: 113641 - DNA, 20 bp, human
ggctctgctcccgcactcgg

SEQ ID NO: 113642 - DNA, 20 bp, human
ggccgcgcgttggtcagcca

SEQ ID NO: 113643 - DNA, 20 bp, human
gaagctacgtagcgcgagag

SEQ ID NO: 113644 - DNA, 20 bp, human
gggtgagggcctgtgactct

SEQ ID NO: 113645 - DNA, 20 bp, human
gcagccggctcaagtttctc

SEQ ID NO: 113646 - DNA, 20 bp, human
gggcctccggacccacgcta

SEQ ID NO: 113647 - DNA, 20 bp, human
gtgggagcactagtgattcg

SEQ ID NO: 113648 - DNA, 20 bp, human
ggcctacttccgagacccag

SEQ ID NO: 113649 - DNA, 20 bp, human
ggcctggttagcgggagcac

SEQ ID NO: 113650 - DNA, 20 bp, human
gtcaggttcaggccgcacgt

SEQ ID NO: 113651 - DNA, 20 bp, human
ggcgcccgcggtgaggtcgg

SEQ ID NO: 113652 - DNA, 20 bp, human
ggcctctgggtctcggaagt

SEQ ID NO: 113653 - DNA, 20 bp, human
gccgctaaccaggccctcgc

SEQ ID NO: 113654 - DNA, 20 bp, human
gtccgcgcccgcggtgaggt

SEQ ID NO: 113655 - DNA, 20 bp, human
gcaccggcgcaggacaactc

SEQ ID NO: 113656 - DNA, 20 bp, human
ggcgtgacgctccgccgtaa

SEQ ID NO: 113657 - DNA, 20 bp, human
gcctagttcgcttgccatta

SEQ ID NO: 113658 - DNA, 20 bp, human
gttatgtcggcgaccttggg

SEQ ID NO: 113659 - DNA, 20 bp, human
gccgcggggagagacaccag

SEQ ID NO: 113660 - DNA, 20 bp, human
gagggctctggcgcttatgt

SEQ ID NO: 113661 - DNA, 20 bp, human
gggagatgctgcggccggca

SEQ ID NO: 113662 - DNA, 20 bp, human
gttacagtagaggccgaaag

SEQ ID NO: 113663 - DNA, 20 bp, human
gcgcttatgtcggcgacctt

SEQ ID NO: 113664 - DNA, 20 bp, human
gctgggaccctcgccgccca

SEQ ID NO: 113665 - DNA, 20 bp, human
ggtagaggccgaaagaggca

SEQ ID NO: 113666 - DNA, 20 bp, human
ggcggaggccgccatgacgc

SEQ ID NO: 113667 - DNA, 20 bp, human
gtgcgcgcgtacagacccag

SEQ ID NO: 113668 - DNA, 20 bp, human
gcgcgcacggctctgtctgg

SEQ ID NO: 113669 - DNA, 20 bp, human
gctccgcgcacggctctgtc

SEQ ID NO: 113670 - DNA, 20 bp, human
gcagataaggcgacaagcgt

SEQ ID NO: 113671 - DNA, 20 bp, human
gaggcggccggcggcagcac

SEQ ID NO: 113672 - DNA, 20 bp, human
gcccacaggaacattcacat

SEQ ID NO: 113673 - DNA, 20 bp, human
ggacaagcgtgggcagtcga

SEQ ID NO: 113674 - DNA, 20 bp, human
gcggggatgccaagccgcaa

SEQ ID NO: 113675 - DNA, 20 bp, human
gctagaacgcacacccagag

SEQ ID NO: 113676 - DNA, 20 bp, human
gtcttcagttgagggtaccg

SEQ ID NO: 113677 - DNA, 20 bp, human
gcgcgcgccacggcacacaa

SEQ ID NO: 113678 - DNA, 20 bp, human
gtagcccgcggtctgcggtg

SEQ ID NO: 113679 - DNA, 20 bp, human
gtccaccttgaaggtaccct

SEQ ID NO: 113680 - DNA, 20 bp, human
gcagcatgagtgtactgctg

SEQ ID NO: 113681 - DNA, 20 bp, human
gccagcccagggtaccttca

SEQ ID NO: 113682 - DNA, 20 bp, human
ggagggtaccgggggatcaa

SEQ ID NO: 113683 - DNA, 20 bp, human
gaatagggctgcgtagtcgt

SEQ ID NO: 113684 - DNA, 20 bp, human
gggcggcttgcgctcgtgaa

SEQ ID NO: 113685 - DNA, 20 bp, human
gctcgctccgccaggagctg

SEQ ID NO: 113686 - DNA, 20 bp, human
ggtcgcagcttccactggcg

SEQ ID NO: 113687 - DNA, 20 bp, human
gtaagctgctcgcggagggg

SEQ ID NO: 113688 - DNA, 20 bp, human
gaggttagcgagaagacaga

SEQ ID NO: 113689 - DNA, 20 bp, human
gggggtcgctgtaggcgctg

SEQ ID NO: 113690 - DNA, 20 bp, human
gatgtaagctgctcgcggag

SEQ ID NO: 113691 - DNA, 20 bp, human
gaccggactggagagaagac

SEQ ID NO: 113692 - DNA, 20 bp, human
ggcgcccgcacggagcagag

SEQ ID NO: 113693 - DNA, 20 bp, human
gcggcgaatggcaggtcccg

SEQ ID NO: 113694 - DNA, 20 bp, human
ggtcgccgtgatcctcgtcg

SEQ ID NO: 113695 - DNA, 20 bp, human
ggcttccgaacgaaggtgac

SEQ ID NO: 113696 - DNA, 20 bp, human
gccctcggcgtcctctgtag

SEQ ID NO: 113697 - DNA, 20 bp, human
gcctaggtcgcccgctacag

SEQ ID NO: 113698 - DNA, 20 bp, human
gcggacggaggtagaggcca

SEQ ID NO: 113699 - DNA, 20 bp, human
gggccgcgggacccggacgg

SEQ ID NO: 113700 - DNA, 20 bp, human
ggggacccggacggaggtag

SEQ ID NO: 113701 - DNA, 20 bp, human
ggagagtaagggatcctggg

SEQ ID NO: 113702 - DNA, 20 bp, human
gctaggccgcgggacccgga

SEQ ID NO: 113703 - DNA, 20 bp, human
gggagctcggaggtctccgg

SEQ ID NO: 113704 - DNA, 20 bp, human
gagggcagcgcgtccgggag

SEQ ID NO: 113705 - DNA, 20 bp, human
ggaagaagcggggcatcccg

SEQ ID NO: 113706 - DNA, 20 bp, human
ggaccaccatccacctacta

SEQ ID NO: 113707 - DNA, 20 bp, human
gggcagtgagtttccctggg

SEQ ID NO: 113708 - DNA, 20 bp, human
gatggtgctgcagggtctca

SEQ ID NO: 113709 - DNA, 20 bp, human
gagcgcgcttccttagtagg

SEQ ID NO: 113710 - DNA, 20 bp, human
ggccagcgcttgccaatcag

SEQ ID NO: 113711 - DNA, 20 bp, human
ggcagcaccatctgtcatgg

SEQ ID NO: 113712 - DNA, 20 bp, human
gcgccgctgccgccaaaaga

SEQ ID NO: 113713 - DNA, 20 bp, human
ggcccagccgccatgacaga

SEQ ID NO: 113714 - DNA, 20 bp, human
gcctgcagcaccatctgtca

SEQ ID NO: 113715 - DNA, 20 bp, human
ggcgaaagcctagaagactt

SEQ ID NO: 113716 - DNA, 20 bp, human
gagcgccggggaagcgaagt

SEQ ID NO: 113717 - DNA, 20 bp, human
ggagtatgtccgctctgact

SEQ ID NO: 113718 - DNA, 20 bp, human
gggggaagcgaagtaggcag

SEQ ID NO: 113719 - DNA, 20 bp, human
ggacgccagccgagtcagag

SEQ ID NO: 113720 - DNA, 20 bp, human
gagggccgtcatggtagtag

SEQ ID NO: 113721 - DNA, 20 bp, human
gtcacgcgtgcgtctcccga

SEQ ID NO: 113722 - DNA, 20 bp, human
gaagccggaagccaacgctg

SEQ ID NO: 113723 - DNA, 20 bp, human
gggagacgcacgcgtgaatg

SEQ ID NO: 113724 - DNA, 20 bp, human
gtcttcaggcgccccagtca

SEQ ID NO: 113725 - DNA, 20 bp, human
gccggcgcgggcggtccagg

SEQ ID NO: 113726 - DNA, 20 bp, human
gggtaaattagggagttggt

SEQ ID NO: 113727 - DNA, 20 bp, human
gcggagccaaccggaaacgg

SEQ ID NO: 113728 - DNA, 20 bp, human
gtcaggtagagactacatga

SEQ ID NO: 113729 - DNA, 20 bp, human
ggtcaggtaaattagggagt

SEQ ID NO: 113730 - DNA, 20 bp, human
ggtttgcctttggatcgcaa

SEQ ID NO: 113731 - DNA, 20 bp, human
ggagaggtcagattgctgtc

SEQ ID NO: 113732 - DNA, 20 bp, human
gaaccggagccaaccggaaa

SEQ ID NO: 113733 - DNA, 20 bp, human
ggattgctgtcaggtaaatt

SEQ ID NO: 113734 - DNA, 20 bp, human
gtcctgccgtgagaaactcg

SEQ ID NO: 113735 - DNA, 20 bp, human
gagctcttaatcctaatcaa

SEQ ID NO: 113736 - DNA, 20 bp, human
gggcctcccaggcgggaata

SEQ ID NO: 113737 - DNA, 20 bp, human
ggcagagtgcgcaggctcga

SEQ ID NO: 113738 - DNA, 20 bp, human
gacgacatcttggcgaacca

SEQ ID NO: 113739 - DNA, 20 bp, human
ggcttggccctcgagaggac

SEQ ID NO: 113740 - DNA, 20 bp, human
gccagagccggtcctctcga

SEQ ID NO: 113741 - DNA, 20 bp, human
gggtctcaggcagagtgcgc

SEQ ID NO: 113742 - DNA, 20 bp, human
gccagagcttggccctcgag

SEQ ID NO: 113743 - DNA, 20 bp, human
gactcacgatgagccctcgg

SEQ ID NO: 113744 - DNA, 20 bp, human
gaacgttcttaaggtcacgc

SEQ ID NO: 113745 - DNA, 20 bp, human
gtgaaggtcagcatagacaa

SEQ ID NO: 113746 - DNA, 20 bp, human
gtggccgccatggctactac

SEQ ID NO: 113747 - DNA, 20 bp, human
ggctgagatctgtatctcta

SEQ ID NO: 113748 - DNA, 20 bp, human
gctgcccgtagtagccatgg

SEQ ID NO: 113749 - DNA, 20 bp, human
gcgggtttcggttactgcgg

SEQ ID NO: 113750 - DNA, 20 bp, human
gacccgccgcaacaaactca

SEQ ID NO: 113751 - DNA, 20 bp, human
ggggagccgggacaagttgt

SEQ ID NO: 113752 - DNA, 20 bp, human
gcggcgggtttcggttactg

SEQ ID NO: 113753 - DNA, 20 bp, human
gggcggccatgagtttgttg

SEQ ID NO: 113754 - DNA, 20 bp, human
gctcctgcccgtagtagcca

SEQ ID NO: 113755 - DNA, 20 bp, human
gatccgaggcgagtgccaag

SEQ ID NO: 113756 - DNA, 20 bp, human
ggtaccagcggcgacatgac

SEQ ID NO: 113757 - DNA, 20 bp, human
ggacatgacggggtacactc

SEQ ID NO: 113758 - DNA, 20 bp, human
ggtcctcctggagtctcggg

SEQ ID NO: 113759 - DNA, 20 bp, human
gacggcgcaccctcgaacta

SEQ ID NO: 113760 - DNA, 20 bp, human
ggtaccaacgcaaaaggaca

SEQ ID NO: 113761 - DNA, 20 bp, human
gaggagtccaggaatatgta

SEQ ID NO: 113762 - DNA, 20 bp, human
gtaactagtccgtagttcga

SEQ ID NO: 113763 - DNA, 20 bp, human
ggggcagcaccggctcccga

SEQ ID NO: 113764 - DNA, 20 bp, human
gtaggccccatcttctgtgg

SEQ ID NO: 113765 - DNA, 20 bp, human
gccttttgcgttggtaccag

SEQ ID NO: 113766 - DNA, 20 bp, human
ggcgcgggtgcctgaacacc

SEQ ID NO: 113767 - DNA, 20 bp, human
gaggtagcgccggaccaggt

SEQ ID NO: 113768 - DNA, 20 bp, human
gagatccctgcagcagccga

SEQ ID NO: 113769 - DNA, 20 bp, human
gtggaggcgttccagcccaa

SEQ ID NO: 113770 - DNA, 20 bp, human
gccccagggctggcacccca

SEQ ID NO: 113771 - DNA, 20 bp, human
gcgtagtctggcgggaaggt

SEQ ID NO: 113772 - DNA, 20 bp, human
gaaagtgaggcgacaagtgg

SEQ ID NO: 113773 - DNA, 20 bp, human
gctggaacgcctccacactg

SEQ ID NO: 113774 - DNA, 20 bp, human
ggggtcacctagctcctacc

SEQ ID NO: 113775 - DNA, 20 bp, human
gctccaccgaggcatcgccc

SEQ ID NO: 113776 - DNA, 20 bp, human
gactgatcctgcgaagtccc

SEQ ID NO: 113777 - DNA, 20 bp, human
ggacctgtccgtgcgcccag

SEQ ID NO: 113778 - DNA, 20 bp, human
gcttctggggtcctaggata

SEQ ID NO: 113779 - DNA, 20 bp, human
ggttcccggggccctatcct

SEQ ID NO: 113780 - DNA, 20 bp, human
gcccagcggcatcacgttcc

SEQ ID NO: 113781 - DNA, 20 bp, human
gcggcggcagcctccgggta

SEQ ID NO: 113782 - DNA, 20 bp, human
gcatgcgcaaaggcctgtca

SEQ ID NO: 113783 - DNA, 20 bp, human
gacgggcgagacctcagtgt

SEQ ID NO: 113784 - DNA, 20 bp, human
ggcatggggtgagacagaga

SEQ ID NO: 113785 - DNA, 20 bp, human
gcgacttgaagccttcggag

SEQ ID NO: 113786 - DNA, 20 bp, human
ggaaactgcacgcctgctgc

SEQ ID NO: 113787 - DNA, 20 bp, human
ggctacgccacctcgagtcg

SEQ ID NO: 113788 - DNA, 20 bp, human
gtgaacctccaggtacccag

SEQ ID NO: 113789 - DNA, 20 bp, human
ggacgccaagaacgccatta

SEQ ID NO: 113790 - DNA, 20 bp, human
gttacggcgctgaccttccc

SEQ ID NO: 113791 - DNA, 20 bp, human
gtttgctgatgggtcaggta

SEQ ID NO: 113792 - DNA, 20 bp, human
ggacgcacgaccagcgcaga

SEQ ID NO: 113793 - DNA, 20 bp, human
ggacgcaccacgactcgagg

SEQ ID NO: 113794 - DNA, 20 bp, human
ggaccctcggggccccatgg

SEQ ID NO: 113795 - DNA, 20 bp, human
gcttcgggaacggaattgga

SEQ ID NO: 113796 - DNA, 20 bp, human
gagcagagagccctgcgtag

SEQ ID NO: 113797 - DNA, 20 bp, human
gcaactcggagagactgagc

SEQ ID NO: 113798 - DNA, 20 bp, human
gtgcacgaggaggatactca

SEQ ID NO: 113799 - DNA, 20 bp, human
gcccccgccaggctcccgag

SEQ ID NO: 113800 - DNA, 20 bp, human
ggaaaggggacgcagcaagg

SEQ ID NO: 113801 - DNA, 20 bp, human
gctcgggagtggtcatgtaa

SEQ ID NO: 113802 - DNA, 20 bp, human
gccctcagacgactcgggag

SEQ ID NO: 113803 - DNA, 20 bp, human
ggtccgcaagcccttaaacg

SEQ ID NO: 113804 - DNA, 20 bp, human
gaggatactcacggccgctc

SEQ ID NO: 113805 - DNA, 20 bp, human
gggggccagcagccgggaaa

SEQ ID NO: 113806 - DNA, 20 bp, human
gccagaaacgagaacaacgg

SEQ ID NO: 113807 - DNA, 20 bp, human
gtatgcaactgactacaagg

SEQ ID NO: 113808 - DNA, 20 bp, human
gactccagaaacgagaacaa

SEQ ID NO: 113809 - DNA, 20 bp, human
gacgagaacaacggaggcag

SEQ ID NO: 113810 - DNA, 20 bp, human
gcggcagtctagaagccggg

SEQ ID NO: 113811 - DNA, 20 bp, human
ggacaggtgaatcccaagag

SEQ ID NO: 113812 - DNA, 20 bp, human
ggatcggggagaatgagaac

SEQ ID NO: 113813 - DNA, 20 bp, human
gctggcgcgcgggccatagt

SEQ ID NO: 113814 - DNA, 20 bp, human
ggaaccggcagtctagaagc

SEQ ID NO: 113815 - DNA, 20 bp, human
gaaccagggcctcaagcgtg

SEQ ID NO: 113816 - DNA, 20 bp, human
gctctgcgcgccggactcac

SEQ ID NO: 113817 - DNA, 20 bp, human
gccggccgtaggcccccctg

SEQ ID NO: 113818 - DNA, 20 bp, human
gaccactaccccggcctaag

SEQ ID NO: 113819 - DNA, 20 bp, human
gtggggccagctaggcaaaa

SEQ ID NO: 113820 - DNA, 20 bp, human
ggcccaagctgaccgacccg

SEQ ID NO: 113821 - DNA, 20 bp, human
gaagctgaccgcttaggccg

SEQ ID NO: 113822 - DNA, 20 bp, human
gaccacgacgaccactaccc

SEQ ID NO: 113823 - DNA, 20 bp, human
gacccgcggctcctctacat

SEQ ID NO: 113824 - DNA, 20 bp, human
ggggaggagaaggggtcgta

SEQ ID NO: 113825 - DNA, 20 bp, human
ggccggggtagtggtcgtcg

SEQ ID NO: 113826 - DNA, 20 bp, human
gaggagaaagctgaccgctt

SEQ ID NO: 113827 - DNA, 20 bp, human
ggccgcgggtcggtcagctt

SEQ ID NO: 113828 - DNA, 20 bp, human
gctctgcgcgccggactcac

SEQ ID NO: 113829 - DNA, 20 bp, human
gaccactaccccggcctaag

SEQ ID NO: 113830 - DNA, 20 bp, human
gtggggccagctaggcaaaa

SEQ ID NO: 113831 - DNA, 20 bp, human
gccggccgtaggcccccctg

SEQ ID NO: 113832 - DNA, 20 bp, human
ggcccaagctgaccgacccg

SEQ ID NO: 113833 - DNA, 20 bp, human
gacccgcggctcctctacat

SEQ ID NO: 113834 - DNA, 20 bp, human
gaagctgaccgcttaggccg

SEQ ID NO: 113835 - DNA, 20 bp, human
gaccacgacgaccactaccc

SEQ ID NO: 113836 - DNA, 20 bp, human
ggctttccgttctccaggcc

SEQ ID NO: 113837 - DNA, 20 bp, human
gggtcgcttattcaatatgg

SEQ ID NO: 113838 - DNA, 20 bp, human
gaccacgacgaccccctagg

SEQ ID NO: 113839 - DNA, 20 bp, human
gtaagcgacccggcctccta

SEQ ID NO: 113840 - DNA, 20 bp, human
gtggaccacgacgaccccct

SEQ ID NO: 113841 - DNA, 20 bp, human
gggacactggtcctctcccg

SEQ ID NO: 113842 - DNA, 20 bp, human
ggacgaccccctaggaggcc

SEQ ID NO: 113843 - DNA, 20 bp, human
gctgagagccggcagatggg

SEQ ID NO: 113844 - DNA, 20 bp, human
gccgggtcgcttattcaata

SEQ ID NO: 113845 - DNA, 20 bp, human
gcggctgacagagttagccg

SEQ ID NO: 113846 - DNA, 20 bp, human
gcttttctaggagcgagcaa

SEQ ID NO: 113847 - DNA, 20 bp, human
gtatctgccccacgcaggaa

SEQ ID NO: 113848 - DNA, 20 bp, human
gtgcagccggagtaagatgg

SEQ ID NO: 113849 - DNA, 20 bp, human
ggtctgcagccggagtaaga

SEQ ID NO: 113850 - DNA, 20 bp, human
ggactgcgggaaggagaacc

SEQ ID NO: 113851 - DNA, 20 bp, human
gcagcgccgccatcttactc

SEQ ID NO: 113852 - DNA, 20 bp, human
gtactccggctgcagactgc

SEQ ID NO: 113853 - DNA, 20 bp, human
gcgtcgcggcccaggtgctg

SEQ ID NO: 113854 - DNA, 20 bp, human
ggcccagcaggtgagatcga

SEQ ID NO: 113855 - DNA, 20 bp, human
gcttgggctacgggatgcag

SEQ ID NO: 113856 - DNA, 20 bp, human
ggggcctcggcgctgaccag

SEQ ID NO: 113857 - DNA, 20 bp, human
gcgtagggaagggcatccta

SEQ ID NO: 113858 - DNA, 20 bp, human
gcatctgagtaacatggcgg

SEQ ID NO: 113859 - DNA, 20 bp, human
gctgagtaacatggcggcgg

SEQ ID NO: 113860 - DNA, 20 bp, human
gctcaccggcagcaacagaa

SEQ ID NO: 113861 - DNA, 20 bp, human
gtggtggcgcgggatcttgg

SEQ ID NO: 113862 - DNA, 20 bp, human
ggccaggaggacgtagggaa

SEQ ID NO: 113863 - DNA, 20 bp, human
gagggccataacaggcctaa

SEQ ID NO: 113864 - DNA, 20 bp, human
gagtctgcatctgagtaaca

SEQ ID NO: 113865 - DNA, 20 bp, human
gccggcagcaacagaacgga

SEQ ID NO: 113866 - DNA, 20 bp, human
ggtgatccgtcctttcatcc

SEQ ID NO: 113867 - DNA, 20 bp, human
gaaaggacggatcaccgcaa

SEQ ID NO: 113868 - DNA, 20 bp, human
gcagacgttgtggcggagaa

SEQ ID NO: 113869 - DNA, 20 bp, human
gtttgcctgcagcaagatgg

SEQ ID NO: 113870 - DNA, 20 bp, human
gccgagaaaagggtcaacag

SEQ ID NO: 113871 - DNA, 20 bp, human
gatggaagggatgcagaaag

SEQ ID NO: 113872 - DNA, 20 bp, human
gggaaccctggaaacggaaa

SEQ ID NO: 113873 - DNA, 20 bp, human
ggactcctccccttctctga

SEQ ID NO: 113874 - DNA, 20 bp, human
gaggcaaacgccaggatgaa

SEQ ID NO: 113875 - DNA, 20 bp, human
gccttctgtaaggactggag

SEQ ID NO: 113876 - DNA, 20 bp, human
gctagctagtcgttctgaag

SEQ ID NO: 113877 - DNA, 20 bp, human
ggcttcggtgccattagctg

SEQ ID NO: 113878 - DNA, 20 bp, human
gggcggccagagaagagtca

SEQ ID NO: 113879 - DNA, 20 bp, human
gacgagcatcgggtaggtag

SEQ ID NO: 113880 - DNA, 20 bp, human
gaagggcacgagcatcgggt

SEQ ID NO: 113881 - DNA, 20 bp, human
ggctagtcgttctgaagcgg

SEQ ID NO: 113882 - DNA, 20 bp, human
ggaggtgaagcggcctggga

SEQ ID NO: 113883 - DNA, 20 bp, human
gtggagcgcagcgtgcatga

SEQ ID NO: 113884 - DNA, 20 bp, human
gagtcaagggcacgagcatc

SEQ ID NO: 113885 - DNA, 20 bp, human
ggaacgactagctagcgacg

SEQ ID NO: 113886 - DNA, 20 bp, human
gcatggaatcggttatactc

SEQ ID NO: 113887 - DNA, 20 bp, human
gcagaggctacagtgagacg

SEQ ID NO: 113888 - DNA, 20 bp, human
gttagtgggtcattgagcag

SEQ ID NO: 113889 - DNA, 20 bp, human
gcacttaagagtaatcccag

SEQ ID NO: 113890 - DNA, 20 bp, human
ggcttcggcagaaaacggta

SEQ ID NO: 113891 - DNA, 20 bp, human
gttaagagtaatcccagagg

SEQ ID NO: 113892 - DNA, 20 bp, human
gtgtttgcttcggcagaaaa

SEQ ID NO: 113893 - DNA, 20 bp, human
gtggcttgccaaatgtgaat

SEQ ID NO: 113894 - DNA, 20 bp, human
gagctttgccaattcacatt

SEQ ID NO: 113895 - DNA, 20 bp, human
gactcttaagtgtttttagt

SEQ ID NO: 113896 - DNA, 20 bp, human
gccaccagtcgcccgaggtg

SEQ ID NO: 113897 - DNA, 20 bp, human
gctgaaccggtgtggcgagg

SEQ ID NO: 113898 - DNA, 20 bp, human
gtagagctagggccctgatg

SEQ ID NO: 113899 - DNA, 20 bp, human
gggccagcggcgcaaaatgg

SEQ ID NO: 113900 - DNA, 20 bp, human
gcgaaacacctggcgcccag

SEQ ID NO: 113901 - DNA, 20 bp, human
ggcgccgggtcaaaggccag

SEQ ID NO: 113902 - DNA, 20 bp, human
ggccggctgctgaaccggtg

SEQ ID NO: 113903 - DNA, 20 bp, human
gcagccgcaggctagagcta

SEQ ID NO: 113904 - DNA, 20 bp, human
ggccctgatgaggcaggcaa

SEQ ID NO: 113905 - DNA, 20 bp, human
ggctgccacaaatcgcctat

SEQ ID NO: 113906 - DNA, 20 bp, human
gtaaggagaacggacctcag

SEQ ID NO: 113907 - DNA, 20 bp, human
gcaggtgagcgcggcaccgg

SEQ ID NO: 113908 - DNA, 20 bp, human
ggacctcgaagaccctcaat

SEQ ID NO: 113909 - DNA, 20 bp, human
ggagggtcttcgaggtcaca

SEQ ID NO: 113910 - DNA, 20 bp, human
ggacgccaccacgacacccg

SEQ ID NO: 113911 - DNA, 20 bp, human
gccaagatggcggtgctgtc

SEQ ID NO: 113912 - DNA, 20 bp, human
gccgcccggcttgcgatgaa

SEQ ID NO: 113913 - DNA, 20 bp, human
ggacctcagaggttgtctga

SEQ ID NO: 113914 - DNA, 20 bp, human
gacgacacccgaggctccca

SEQ ID NO: 113915 - DNA, 20 bp, human
gagggtggcgtggatgtcct

SEQ ID NO: 113916 - DNA, 20 bp, human
gagcggcggcgcttcaaggt

SEQ ID NO: 113917 - DNA, 20 bp, human
gtgcttggcaaggcaagtag

SEQ ID NO: 113918 - DNA, 20 bp, human
gagcaggccagtcaatcggg

SEQ ID NO: 113919 - DNA, 20 bp, human
ggggagcccgtacatgccaa

SEQ ID NO: 113920 - DNA, 20 bp, human
gccaagcaggccagtcaatc

SEQ ID NO: 113921 - DNA, 20 bp, human
gttggcaaggcaagtagcgg

SEQ ID NO: 113922 - DNA, 20 bp, human
ggaggcggaggctacactgt

SEQ ID NO: 113923 - DNA, 20 bp, human
gctgcacctgaaggacacgg

SEQ ID NO: 113924 - DNA, 20 bp, human
gggttggtcttgggaattag

SEQ ID NO: 113925 - DNA, 20 bp, human
gccgctgcacctgaaggaca

SEQ ID NO: 113926 - DNA, 20 bp, human
gcgccgtgttgccagcatcg

SEQ ID NO: 113927 - DNA, 20 bp, human
ggcatcgcggcgggccagat

SEQ ID NO: 113928 - DNA, 20 bp, human
gcagcgtgaggtgacccatc

SEQ ID NO: 113929 - DNA, 20 bp, human
gtgtcaccttcatagcactg

SEQ ID NO: 113930 - DNA, 20 bp, human
gctatgaaggtgacagcgtg

SEQ ID NO: 113931 - DNA, 20 bp, human
ggccctacaaggctgtgaca

SEQ ID NO: 113932 - DNA, 20 bp, human
ggccgaggactgtaaaacaa

SEQ ID NO: 113933 - DNA, 20 bp, human
gctggcgcgatagagacgct

SEQ ID NO: 113934 - DNA, 20 bp, human
ggcgcgatagagacgctagg

SEQ ID NO: 113935 - DNA, 20 bp, human
gaggagagaatgaaagacta

SEQ ID NO: 113936 - DNA, 20 bp, human
ggggctggggcctacatctg

SEQ ID NO: 113937 - DNA, 20 bp, human
gctggggccagatagagagt

SEQ ID NO: 113938 - DNA, 20 bp, human
gagtccattgagggcaagca

SEQ ID NO: 113939 - DNA, 20 bp, human
gtaggctggcaacaacacac

SEQ ID NO: 113940 - DNA, 20 bp, human
gggggcctacatctgtggag

SEQ ID NO: 113941 - DNA, 20 bp, human
ggccatgggtgcaggaccct

SEQ ID NO: 113942 - DNA, 20 bp, human
gttgccctgcttgccctcaa

SEQ ID NO: 113943 - DNA, 20 bp, human
ggtctcctctccacagatgt

SEQ ID NO: 113944 - DNA, 20 bp, human
ggagaactggtggctgctag

SEQ ID NO: 113945 - DNA, 20 bp, human
gcgctcatcgagtccattga

SEQ ID NO: 113946 - DNA, 20 bp, human
gaccccaggcctaggcgacc

SEQ ID NO: 113947 - DNA, 20 bp, human
gagcgccgcggagaagaaca

SEQ ID NO: 113948 - DNA, 20 bp, human
gtcactaggcttgaaacgag

SEQ ID NO: 113949 - DNA, 20 bp, human
gaagaccgtcgctccgaagg

SEQ ID NO: 113950 - DNA, 20 bp, human
ggtatggcaaccctccctcg

SEQ ID NO: 113951 - DNA, 20 bp, human
gcaggcctaggcgacccgga

SEQ ID NO: 113952 - DNA, 20 bp, human
gaaacgagaggtgcctcctt

SEQ ID NO: 113953 - DNA, 20 bp, human
gacggtcttcgaaactgatc

SEQ ID NO: 113954 - DNA, 20 bp, human
gttgctgtagcgcagaatct

SEQ ID NO: 113955 - DNA, 20 bp, human
gcgtgagaagccccgaggga

SEQ ID NO: 113956 - DNA, 20 bp, human
gaaacacggggcagccatgg

SEQ ID NO: 113957 - DNA, 20 bp, human
ggcgcccgctgtcaccgcca

SEQ ID NO: 113958 - DNA, 20 bp, human
gccttgccgcagcaaacacg

SEQ ID NO: 113959 - DNA, 20 bp, human
gcagccatggcggtgacagc

SEQ ID NO: 113960 - DNA, 20 bp, human
gccgtgcgggagccgcacag

SEQ ID NO: 113961 - DNA, 20 bp, human
ggccggggcgctgaaggtaa

SEQ ID NO: 113962 - DNA, 20 bp, human
gggctgccccgtgtttgctg

SEQ ID NO: 113963 - DNA, 20 bp, human
ggtcagcggcccaactagga

SEQ ID NO: 113964 - DNA, 20 bp, human
gcggccccgagcctacgtag

SEQ ID NO: 113965 - DNA, 20 bp, human
gcctgggcggcagactcggg

SEQ ID NO: 113966 - DNA, 20 bp, human
gtgcctggggttctcaggag

SEQ ID NO: 113967 - DNA, 20 bp, human
gagcgaaactgccactcctc

SEQ ID NO: 113968 - DNA, 20 bp, human
gccataactgaggaaattag

SEQ ID NO: 113969 - DNA, 20 bp, human
gtacatagcagatattagta

SEQ ID NO: 113970 - DNA, 20 bp, human
gcggagcccaggcatcacgc

SEQ ID NO: 113971 - DNA, 20 bp, human
ggcttttgcctggggttctc

SEQ ID NO: 113972 - DNA, 20 bp, human
ggggccttagtagggcaatg

SEQ ID NO: 113973 - DNA, 20 bp, human
ggctgctgaggaaatttatt

SEQ ID NO: 113974 - DNA, 20 bp, human
gatttggtagattgaaggta

SEQ ID NO: 113975 - DNA, 20 bp, human
gtgggctccgaattatcatg

SEQ ID NO: 113976 - DNA, 20 bp, human
ggcgagcgacgcagagccag

SEQ ID NO: 113977 - DNA, 20 bp, human
gtcgctcgcactccaggtac

SEQ ID NO: 113978 - DNA, 20 bp, human
gtcgccgggggatgtcacag

SEQ ID NO: 113979 - DNA, 20 bp, human
gtggaaagcaatgagtgggt

SEQ ID NO: 113980 - DNA, 20 bp, human
ggagccgctgtgacatcccc

SEQ ID NO: 113981 - DNA, 20 bp, human
gggatgtcacagcggctcct

SEQ ID NO: 113982 - DNA, 20 bp, human
ggcgcgaacgaagacgccag

SEQ ID NO: 113983 - DNA, 20 bp, human
ggcgccctccccccgtgcca

SEQ ID NO: 113984 - DNA, 20 bp, human
ggggccacgggtgagtgcac

SEQ ID NO: 113985 - DNA, 20 bp, human
gtggggccggccgcgctctc

SEQ ID NO: 113986 - DNA, 20 bp, human
ggacgcaccggctctggcaa

SEQ ID NO: 113987 - DNA, 20 bp, human
gtcccggatccagagcccgg

SEQ ID NO: 113988 - DNA, 20 bp, human
gcggatccagagcccggcgg

SEQ ID NO: 113989 - DNA, 20 bp, human
gcggggctaggcggacgcac

SEQ ID NO: 113990 - DNA, 20 bp, human
ggctccgcctgaggccgtca

SEQ ID NO: 113991 - DNA, 20 bp, human
ggcgggagcgaacaccctcc

SEQ ID NO: 113992 - DNA, 20 bp, human
gcaggcggagcggggctagg

SEQ ID NO: 113993 - DNA, 20 bp, human
ggccgcgcccttgccagagc

SEQ ID NO: 113994 - DNA, 20 bp, human
gccgtcagggctcccgagga

SEQ ID NO: 113995 - DNA, 20 bp, human
gtcctccaacaactcctcgg

SEQ ID NO: 113996 - DNA, 20 bp, human
gccagcgcccggccctgctg

SEQ ID NO: 113997 - DNA, 20 bp, human
gccgagaagcgccggtggag

SEQ ID NO: 113998 - DNA, 20 bp, human
ggctgggtgggcgccaggat

SEQ ID NO: 113999 - DNA, 20 bp, human
gggactccgagaagcgccgg

SEQ ID NO: 114000 - DNA, 20 bp, human
gagaagcgccggtggagggg

SEQ ID NO: 114001 - DNA, 20 bp, human
gctggagaccggcctggacg

SEQ ID NO: 114002 - DNA, 20 bp, human
gtcccgcggggtaaagggtg

SEQ ID NO: 114003 - DNA, 20 bp, human
gtacccgggcaggagacccc

SEQ ID NO: 114004 - DNA, 20 bp, human
gcagggactccgagaagcgc

SEQ ID NO: 114005 - DNA, 20 bp, human
gggcgcgatgtgcgagcggg

SEQ ID NO: 114006 - DNA, 20 bp, human
gccgccgcggcgtccagggt

SEQ ID NO: 114007 - DNA, 20 bp, human
gcagcggtcaccccactctg

SEQ ID NO: 114008 - DNA, 20 bp, human
ggacagaacaggtcacacaa

SEQ ID NO: 114009 - DNA, 20 bp, human
gatggcgccgccacccgctc

SEQ ID NO: 114010 - DNA, 20 bp, human
ggtgagactaacagagactc

SEQ ID NO: 114011 - DNA, 20 bp, human
gactaacagagactcgggta

SEQ ID NO: 114012 - DNA, 20 bp, human
ggagtccgccgcggcgtcca

SEQ ID NO: 114013 - DNA, 20 bp, human
gaaccgcagccgagcccgag

SEQ ID NO: 114014 - DNA, 20 bp, human
gctggcgacaatcacagcag

SEQ ID NO: 114015 - DNA, 20 bp, human
ggggcccgaacaaccccgga

SEQ ID NO: 114016 - DNA, 20 bp, human
ggctgggctgggctccccgg

SEQ ID NO: 114017 - DNA, 20 bp, human
ggcagcagtaccggcatcct

SEQ ID NO: 114018 - DNA, 20 bp, human
ggagcgcgagccgaggatgc

SEQ ID NO: 114019 - DNA, 20 bp, human
ggctgcggcggcaagaggcg

SEQ ID NO: 114020 - DNA, 20 bp, human
ggtcagcctgggatggatga

SEQ ID NO: 114021 - DNA, 20 bp, human
gcggggcgccacgcagggaa

SEQ ID NO: 114022 - DNA, 20 bp, human
gaggcgcggcggccggaaga

SEQ ID NO: 114023 - DNA, 20 bp, human
ggcacccagattgcgcggag

SEQ ID NO: 114024 - DNA, 20 bp, human
ggattgcgcggagcgggcga

SEQ ID NO: 114025 - DNA, 20 bp, human
gggcgccacgcagggaaggg

SEQ ID NO: 114026 - DNA, 20 bp, human
gcccaagatggcgaccgagt

SEQ ID NO: 114027 - DNA, 20 bp, human
gtccggtagacgctgacgtc

SEQ ID NO: 114028 - DNA, 20 bp, human
gggagatgacaacccaggta

SEQ ID NO: 114029 - DNA, 20 bp, human
ggccgacagcggacccaaga

SEQ ID NO: 114030 - DNA, 20 bp, human
gcccccggcagcgccgacag

SEQ ID NO: 114031 - DNA, 20 bp, human
gtagcaaggtgacaatacag

SEQ ID NO: 114032 - DNA, 20 bp, human
gtgataagctgaaggacgca

SEQ ID NO: 114033 - DNA, 20 bp, human
ggacaatacagaggtagtag

SEQ ID NO: 114034 - DNA, 20 bp, human
ggatgacaacccaggtaggg

SEQ ID NO: 114035 - DNA, 20 bp, human
gggaggcccggggcggaatc

SEQ ID NO: 114036 - DNA, 20 bp, human
ggaggagagcgggtacgagt

SEQ ID NO: 114037 - DNA, 20 bp, human
ggcgtcgcgatggaggagag

SEQ ID NO: 114038 - DNA, 20 bp, human
gcgtccgtcggacagaggaa

SEQ ID NO: 114039 - DNA, 20 bp, human
gaagtcgccggaagttcggt

SEQ ID NO: 114040 - DNA, 20 bp, human
ggctccaggcgtcgcgatgg

SEQ ID NO: 114041 - DNA, 20 bp, human
gagcgcttagggaccccggt

SEQ ID NO: 114042 - DNA, 20 bp, human
gccgtcggacagaggaacgg

SEQ ID NO: 114043 - DNA, 20 bp, human
ggtggaagtcgccggaagtt

SEQ ID NO: 114044 - DNA, 20 bp, human
gggtccctaagcgctagata

SEQ ID NO: 114045 - DNA, 20 bp, human
gctgccgggtaccctaaact

SEQ ID NO: 114046 - DNA, 20 bp, human
gcccgctccgtccccctcag

SEQ ID NO: 114047 - DNA, 20 bp, human
gccccgcccagcaaccgctc

SEQ ID NO: 114048 - DNA, 20 bp, human
gctgttgtgttgctgcggag

SEQ ID NO: 114049 - DNA, 20 bp, human
ggtgttgctgcggagaggtg

SEQ ID NO: 114050 - DNA, 20 bp, human
gcaggacaacagctcaagtg

SEQ ID NO: 114051 - DNA, 20 bp, human
gcggagaggtgaggttccgg

SEQ ID NO: 114052 - DNA, 20 bp, human
gcgggggcccgctgacctca

SEQ ID NO: 114053 - DNA, 20 bp, human
gggctgggaagtgtccgggg

SEQ ID NO: 114054 - DNA, 20 bp, human
gtaacagtccaggcgggagc

SEQ ID NO: 114055 - DNA, 20 bp, human
ggaagtttaacagtccaggc

SEQ ID NO: 114056 - DNA, 20 bp, human
gagctccgcacacccggcgg

SEQ ID NO: 114057 - DNA, 20 bp, human
gcggcggcggccacgaccgg

SEQ ID NO: 114058 - DNA, 20 bp, human
gtagcggcggcggccacgac

SEQ ID NO: 114059 - DNA, 20 bp, human
gggctgctgaataacccgaa

SEQ ID NO: 114060 - DNA, 20 bp, human
gtcagcagccggacccgggg

SEQ ID NO: 114061 - DNA, 20 bp, human
gtattcagcagccggacccg

SEQ ID NO: 114062 - DNA, 20 bp, human
gctccacagttgcctgccct

SEQ ID NO: 114063 - DNA, 20 bp, human
gccgggtgtgcggagctccc

SEQ ID NO: 114064 - DNA, 20 bp, human
gagttgcctgccctgggcgg

SEQ ID NO: 114065 - DNA, 20 bp, human
gaaactgacaagtaaggcgg

SEQ ID NO: 114066 - DNA, 20 bp, human
gtaggagaatacaatattaa

SEQ ID NO: 114067 - DNA, 20 bp, human
ggaagagtatgcggaagtcg

SEQ ID NO: 114068 - DNA, 20 bp, human
ggcaagttctgaagagtatg

SEQ ID NO: 114069 - DNA, 20 bp, human
gtaaaggtttagtgcattaa

SEQ ID NO: 114070 - DNA, 20 bp, human
gcatttgagcaggtaacact

SEQ ID NO: 114071 - DNA, 20 bp, human
gaatgacactctgctgtgga

SEQ ID NO: 114072 - DNA, 20 bp, human
gaatgcgagacgtctcattt

SEQ ID NO: 114073 - DNA, 20 bp, human
gtgttcctaaataaaccctg

SEQ ID NO: 114074 - DNA, 20 bp, human
gacacaatcatgactatggg

SEQ ID NO: 114075 - DNA, 20 bp, human
gcaaagctgtatctccactt

SEQ ID NO: 114076 - DNA, 20 bp, human
ggggtctgaggcgctcccag

SEQ ID NO: 114077 - DNA, 20 bp, human
ggagcgcgccgagcaccggg

SEQ ID NO: 114078 - DNA, 20 bp, human
ggcagggcgtgcgcagggta

SEQ ID NO: 114079 - DNA, 20 bp, human
gccggacggcgctagcgagg

SEQ ID NO: 114080 - DNA, 20 bp, human
ggacggcgctagcgaggagg

SEQ ID NO: 114081 - DNA, 20 bp, human
gctctgcctccaggtccccc

SEQ ID NO: 114082 - DNA, 20 bp, human
ggcgcgggataggaactccc

SEQ ID NO: 114083 - DNA, 20 bp, human
gcggaaggctgcgggaccag

SEQ ID NO: 114084 - DNA, 20 bp, human
ggcgtccagggcgcgctctc

SEQ ID NO: 114085 - DNA, 20 bp, human
gcgcagaggaggctcggagg

SEQ ID NO: 114086 - DNA, 20 bp, human
gcagcggcgaccggagcggt

SEQ ID NO: 114087 - DNA, 20 bp, human
ggtgccttacgggagacgtg

SEQ ID NO: 114088 - DNA, 20 bp, human
gtgcaggcaagagtgctgga

SEQ ID NO: 114089 - DNA, 20 bp, human
gcatagagaaggcctagcag

SEQ ID NO: 114090 - DNA, 20 bp, human
gcgtcctccaggctagggaa

SEQ ID NO: 114091 - DNA, 20 bp, human
gccaagaatctgagagacgg

SEQ ID NO: 114092 - DNA, 20 bp, human
ggtggagccagacagtgacc

SEQ ID NO: 114093 - DNA, 20 bp, human
ggaggacgctgactgcctca

SEQ ID NO: 114094 - DNA, 20 bp, human
gaggggtggtgggaaatagg

SEQ ID NO: 114095 - DNA, 20 bp, human
ggtcagcgtcctccaggcta

SEQ ID NO: 114096 - DNA, 20 bp, human
gcccagaagggctttgagag

SEQ ID NO: 114097 - DNA, 20 bp, human
ggcctcagggctccgcgcga

SEQ ID NO: 114098 - DNA, 20 bp, human
gtgcaggcaagagtgctgga

SEQ ID NO: 114099 - DNA, 20 bp, human
gcagcggcgaccggagcggt

SEQ ID NO: 114100 - DNA, 20 bp, human
gcatagagaaggcctagcag

SEQ ID NO: 114101 - DNA, 20 bp, human
gcgtcctccaggctagggaa

SEQ ID NO: 114102 - DNA, 20 bp, human
gccaagaatctgagagacgg

SEQ ID NO: 114103 - DNA, 20 bp, human
ggtggagccagacagtgacc

SEQ ID NO: 114104 - DNA, 20 bp, human
ggaggacgctgactgcctca

SEQ ID NO: 114105 - DNA, 20 bp, human
gaggggtggtgggaaatagg

SEQ ID NO: 114106 - DNA, 20 bp, human
gatgaaagcgagaaggtccc

SEQ ID NO: 114107 - DNA, 20 bp, human
gaggcgctgcgactgacaag

SEQ ID NO: 114108 - DNA, 20 bp, human
ggagctcagagacttgaggg

SEQ ID NO: 114109 - DNA, 20 bp, human
gagcagccactggagatcag

SEQ ID NO: 114110 - DNA, 20 bp, human
gagcgctgcactcaatggag

SEQ ID NO: 114111 - DNA, 20 bp, human
ggcgctagatgaaagcgaga

SEQ ID NO: 114112 - DNA, 20 bp, human
gaactctccgggacacacaa

SEQ ID NO: 114113 - DNA, 20 bp, human
gagtgagctcagagacttga

SEQ ID NO: 114114 - DNA, 20 bp, human
gcatctagcgctgcactcaa

SEQ ID NO: 114115 - DNA, 20 bp, human
ggggtgtctgacttgaatcg

SEQ ID NO: 114116 - DNA, 20 bp, human
gccctctctgggcaggcggg

SEQ ID NO: 114117 - DNA, 20 bp, human
gcgagcggacttgcttctag

SEQ ID NO: 114118 - DNA, 20 bp, human
gctgacgacagtaggaagag

SEQ ID NO: 114119 - DNA, 20 bp, human
gcacacacgtcggatgtgag

SEQ ID NO: 114120 - DNA, 20 bp, human
gcgtgtgtggttgctcagta

SEQ ID NO: 114121 - DNA, 20 bp, human
gcgacgctctggccctctct

SEQ ID NO: 114122 - DNA, 20 bp, human
gggtctccaagttgacctgg

SEQ ID NO: 114123 - DNA, 20 bp, human
gcagcacctccaggtcaact

SEQ ID NO: 114124 - DNA, 20 bp, human
gacgacagtaggaagagggg

SEQ ID NO: 114125 - DNA, 20 bp, human
gagatgtctggcaccaactc

SEQ ID NO: 114126 - DNA, 20 bp, human
ggcgccgccgaagctcatca

SEQ ID NO: 114127 - DNA, 20 bp, human
gcgggtacatcgacaaggtg

SEQ ID NO: 114128 - DNA, 20 bp, human
gggctgccgccgccatgcag

SEQ ID NO: 114129 - DNA, 20 bp, human
gaggccatgatgagcttcgg

SEQ ID NO: 114130 - DNA, 20 bp, human
gcagctcgcccatagcggag

SEQ ID NO: 114131 - DNA, 20 bp, human
gtcgtacagctcgcccatag

SEQ ID NO: 114132 - DNA, 20 bp, human
gccatgcagcggcgcgaacg

SEQ ID NO: 114133 - DNA, 20 bp, human
gaggcgggccgctccgctat

SEQ ID NO: 114134 - DNA, 20 bp, human
gttcgccgggtacatcgaca

SEQ ID NO: 114135 - DNA, 20 bp, human
gggacgtccgtgtccacgag

SEQ ID NO: 114136 - DNA, 20 bp, human
gtagctgaaggaactcatgg

SEQ ID NO: 114137 - DNA, 20 bp, human
gtgtaggaggtcgagtagta

SEQ ID NO: 114138 - DNA, 20 bp, human
gtcgtagctgaaggaactca

SEQ ID NO: 114139 - DNA, 20 bp, human
ggaggatggatggctgtgtg

SEQ ID NO: 114140 - DNA, 20 bp, human
gggtcgaggttctccagact

SEQ ID NO: 114141 - DNA, 20 bp, human
gcgctggagatgtgcacccg

SEQ ID NO: 114142 - DNA, 20 bp, human
gatcgagcgcgtgcacgagc

SEQ ID NO: 114143 - DNA, 20 bp, human
gtactccagctactcggcgc

SEQ ID NO: 114144 - DNA, 20 bp, human
gcgctacgtggagacgcccc

SEQ ID NO: 114145 - DNA, 20 bp, human
gggatggctcggagtgcttc

SEQ ID NO: 114146 - DNA, 20 bp, human
gtacctggagcagcagaata

SEQ ID NO: 114147 - DNA, 20 bp, human
gggcggagatccaggcgctg

SEQ ID NO: 114148 - DNA, 20 bp, human
gtccaagatgagctacacgt

SEQ ID NO: 114149 - DNA, 20 bp, human
gtacccgccggtaggcggac

SEQ ID NO: 114150 - DNA, 20 bp, human
ggtgacagccacacgcccca

SEQ ID NO: 114151 - DNA, 20 bp, human
gcagcagaataaggagattg

SEQ ID NO: 114152 - DNA, 20 bp, human
ggtctcggttacccgccggt

SEQ ID NO: 114153 - DNA, 20 bp, human
gaagtcaaggctgctctcgg

SEQ ID NO: 114154 - DNA, 20 bp, human
ggggcaacccgtccgcctac

SEQ ID NO: 114155 - DNA, 20 bp, human
gtccaacgtgtagctcatct

SEQ ID NO: 114156 - DNA, 20 bp, human
ggcttgggagcttccacctt

SEQ ID NO: 114157 - DNA, 20 bp, human
gtactggatattgtgattgg

SEQ ID NO: 114158 - DNA, 20 bp, human
gagtcagaccaagccgaaga

SEQ ID NO: 114159 - DNA, 20 bp, human
ggccctgacagccattacag

SEQ ID NO: 114160 - DNA, 20 bp, human
ggtggaagctcccaagctta

SEQ ID NO: 114161 - DNA, 20 bp, human
gtgtgttggaccttaagctt

SEQ ID NO: 114162 - DNA, 20 bp, human
ggcacctgaagttaaagaag

SEQ ID NO: 114163 - DNA, 20 bp, human
gatagaggaaaccaaagtgg

SEQ ID NO: 114164 - DNA, 20 bp, human
gggatcctccctcttcggct

SEQ ID NO: 114165 - DNA, 20 bp, human
gtcactagagccttccttct

SEQ ID NO: 114166 - DNA, 20 bp, human
ggagcaccgccgccagccac

SEQ ID NO: 114167 - DNA, 20 bp, human
gcggaacgccaagtagcctg

SEQ ID NO: 114168 - DNA, 20 bp, human
gagagtgagcagccctagca

SEQ ID NO: 114169 - DNA, 20 bp, human
gatcatgtccatccctgcta

SEQ ID NO: 114170 - DNA, 20 bp, human
gtgcttgttgctcgaaccag

SEQ ID NO: 114171 - DNA, 20 bp, human
gcgagcgcgccggcgagtga

SEQ ID NO: 114172 - DNA, 20 bp, human
gtggggatgagtgaactgtc

SEQ ID NO: 114173 - DNA, 20 bp, human
ggaagactcgccagcaccag

SEQ ID NO: 114174 - DNA, 20 bp, human
ggacacggcggtgcttaggt

SEQ ID NO: 114175 - DNA, 20 bp, human
gcacactctgtccagccggg

SEQ ID NO: 114176 - DNA, 20 bp, human
gagctagcgtgggacagggt

SEQ ID NO: 114177 - DNA, 20 bp, human
gtggcgccggcgagatgcgg

SEQ ID NO: 114178 - DNA, 20 bp, human
ggtgagcggccagatccagg

SEQ ID NO: 114179 - DNA, 20 bp, human
gccaggcgggtcctaagtgt

SEQ ID NO: 114180 - DNA, 20 bp, human
gtgggaggtgtagtccctca

SEQ ID NO: 114181 - DNA, 20 bp, human
ggagcggctccagcgcatgg

SEQ ID NO: 114182 - DNA, 20 bp, human
gtctggccgctcaccaccga

SEQ ID NO: 114183 - DNA, 20 bp, human
gtctcgccggcgccaggcag

SEQ ID NO: 114184 - DNA, 20 bp, human
gtggggtccccgagcttggg

SEQ ID NO: 114185 - DNA, 20 bp, human
ggcggtacgcacaggcccta

SEQ ID NO: 114186 - DNA, 20 bp, human
ggcacagccgctccagctgg

SEQ ID NO: 114187 - DNA, 20 bp, human
gaggccgcagatctaccgga

SEQ ID NO: 114188 - DNA, 20 bp, human
gggcgggcggctgcactcac

SEQ ID NO: 114189 - DNA, 20 bp, human
gtgcactcaccggctccggg

SEQ ID NO: 114190 - DNA, 20 bp, human
gtgcgtagcggtgctgggtc

SEQ ID NO: 114191 - DNA, 20 bp, human
gagatctaccggagggcggg

SEQ ID NO: 114192 - DNA, 20 bp, human
gggccgacgtgccacccacc

SEQ ID NO: 114193 - DNA, 20 bp, human
ggagctcctcggtagccccc

SEQ ID NO: 114194 - DNA, 20 bp, human
gcgcagatctaccggagggc

SEQ ID NO: 114195 - DNA, 20 bp, human
gcgccaggccgcagatctac

SEQ ID NO: 114196 - DNA, 20 bp, human
gccttcactggattccccta

SEQ ID NO: 114197 - DNA, 20 bp, human
gaccaggccctgcaatcggt

SEQ ID NO: 114198 - DNA, 20 bp, human
gccggagcaagatgccctag

SEQ ID NO: 114199 - DNA, 20 bp, human
gcagagatggtggaaggacc

SEQ ID NO: 114200 - DNA, 20 bp, human
gtctcaccaggccctgcaat

SEQ ID NO: 114201 - DNA, 20 bp, human
ggtgggaccccaggaaacct

SEQ ID NO: 114202 - DNA, 20 bp, human
gtacaggagtagctcacctg

SEQ ID NO: 114203 - DNA, 20 bp, human
gatctctgtggccggcactg

SEQ ID NO: 114204 - DNA, 20 bp, human
gaatcggtgggccacagtgc

SEQ ID NO: 114205 - DNA, 20 bp, human
gtgcggggagaccacaaccg

SEQ ID NO: 114206 - DNA, 20 bp, human
gtgctcgagaggccagggta

SEQ ID NO: 114207 - DNA, 20 bp, human
gtggagcgaatgcggactaa

SEQ ID NO: 114208 - DNA, 20 bp, human
ggtaaggactccgcaaccta

SEQ ID NO: 114209 - DNA, 20 bp, human
gacctagggtcccaaaaccc

SEQ ID NO: 114210 - DNA, 20 bp, human
gggcgtcgcccgagacagga

SEQ ID NO: 114211 - DNA, 20 bp, human
ggttggagaggcggtaacgg

SEQ ID NO: 114212 - DNA, 20 bp, human
ggctcacagtccagactgaa

SEQ ID NO: 114213 - DNA, 20 bp, human
gcaaaaccctggagcgaatg

SEQ ID NO: 114214 - DNA, 20 bp, human
gcgcctctccaacttcacag

SEQ ID NO: 114215 - DNA, 20 bp, human
gcggagtccttaccctaccc

SEQ ID NO: 114216 - DNA, 20 bp, human
gcggtgtccctgaggttgag

SEQ ID NO: 114217 - DNA, 20 bp, human
gggaccgggaataggctggg

SEQ ID NO: 114218 - DNA, 20 bp, human
gcccggtcccctcaacctca

SEQ ID NO: 114219 - DNA, 20 bp, human
ggctggccgcggtgtccctg

SEQ ID NO: 114220 - DNA, 20 bp, human
gccgcggccagctgcaccgt

SEQ ID NO: 114221 - DNA, 20 bp, human
gcggcgagcagcttgagtca

SEQ ID NO: 114222 - DNA, 20 bp, human
gggacgggctgagactggac

SEQ ID NO: 114223 - DNA, 20 bp, human
gacctgctgctgcagaccgg

SEQ ID NO: 114224 - DNA, 20 bp, human
gtgagactggacgggacccc

SEQ ID NO: 114225 - DNA, 20 bp, human
ggatttgattggaaaaccaa

SEQ ID NO: 114226 - DNA, 20 bp, human
gcgggcaggcctcaaactag

SEQ ID NO: 114227 - DNA, 20 bp, human
gcaccgagcgccagacaccg

SEQ ID NO: 114228 - DNA, 20 bp, human
gccaagtcttgcgggtaatc

SEQ ID NO: 114229 - DNA, 20 bp, human
ggtctggcgctcggtgggtg

SEQ ID NO: 114230 - DNA, 20 bp, human
ggagattcggaacccagccc

SEQ ID NO: 114231 - DNA, 20 bp, human
gtatcttcccaggtaataag

SEQ ID NO: 114232 - DNA, 20 bp, human
gtccaaacagccgtggcccg

SEQ ID NO: 114233 - DNA, 20 bp, human
gtacctgggaagataactac

SEQ ID NO: 114234 - DNA, 20 bp, human
ggtcttgcgggtaatcgggc

SEQ ID NO: 114235 - DNA, 20 bp, human
gttcccaggtaataagagga

SEQ ID NO: 114236 - DNA, 20 bp, human
gccagggaccaggaactcca

SEQ ID NO: 114237 - DNA, 20 bp, human
gggcgacgaaacctaagcag

SEQ ID NO: 114238 - DNA, 20 bp, human
gggcccgcgacggttaaacg

SEQ ID NO: 114239 - DNA, 20 bp, human
gtctgacagcctgtcctggg

SEQ ID NO: 114240 - DNA, 20 bp, human
gccaccgaagggaaccgaca

SEQ ID NO: 114241 - DNA, 20 bp, human
ggacggttaaacggggccca

SEQ ID NO: 114242 - DNA, 20 bp, human
ggcgagatcagggcccgcga

SEQ ID NO: 114243 - DNA, 20 bp, human
gggctgtcagatgcagaccc

SEQ ID NO: 114244 - DNA, 20 bp, human
ggtgatggcaaggtgagcgt

SEQ ID NO: 114245 - DNA, 20 bp, human
gttaaacggggcccaaggca

SEQ ID NO: 114246 - DNA, 20 bp, human
gcggttgccaggccaaggag

SEQ ID NO: 114247 - DNA, 20 bp, human
gcaggccaaggagtggacta

SEQ ID NO: 114248 - DNA, 20 bp, human
gttctagaggcagcccgcca

SEQ ID NO: 114249 - DNA, 20 bp, human
ggagtggactagggtcgccg

SEQ ID NO: 114250 - DNA, 20 bp, human
ggcgaccctagtccactcct

SEQ ID NO: 114251 - DNA, 20 bp, human
gtagaggcagcccgccaggg

SEQ ID NO: 114252 - DNA, 20 bp, human
ggctgcctctagaacgagga

SEQ ID NO: 114253 - DNA, 20 bp, human
gtccgccctgctgaccccca

SEQ ID NO: 114254 - DNA, 20 bp, human
gaccgcggggcggaagtgag

SEQ ID NO: 114255 - DNA, 20 bp, human
gctagggtcgccggggaagc

SEQ ID NO: 114256 - DNA, 20 bp, human
gctcccggcccggatcgcta

SEQ ID NO: 114257 - DNA, 20 bp, human
ggcccggatcgctatggcag

SEQ ID NO: 114258 - DNA, 20 bp, human
gtcgtgggcaaggggagcta

SEQ ID NO: 114259 - DNA, 20 bp, human
ggccgctgccatagcgatcc

SEQ ID NO: 114260 - DNA, 20 bp, human
gctgggcgcatattacaggg

SEQ ID NO: 114261 - DNA, 20 bp, human
gacccgcaggtagcagtagg

SEQ ID NO: 114262 - DNA, 20 bp, human
gtcggttcatgcccgagagg

SEQ ID NO: 114263 - DNA, 20 bp, human
gtgttgaggcagccgggccc

SEQ ID NO: 114264 - DNA, 20 bp, human
gatggtcccagaccaagacg

SEQ ID NO: 114265 - DNA, 20 bp, human
gggtagcagtaggcggccag

SEQ ID NO: 114266 - DNA, 20 bp, human
gggctccgggcaagaactaa

SEQ ID NO: 114267 - DNA, 20 bp, human
gggagcaggtacgcttgcag

SEQ ID NO: 114268 - DNA, 20 bp, human
ggagaggctgcagacaccgg

SEQ ID NO: 114269 - DNA, 20 bp, human
gcagggcgcgtcggtctcta

SEQ ID NO: 114270 - DNA, 20 bp, human
gctgcagacaccggaggatc

SEQ ID NO: 114271 - DNA, 20 bp, human
gcgggaacccggatccttcc

SEQ ID NO: 114272 - DNA, 20 bp, human
ggccaacgaagcgtcccgga

SEQ ID NO: 114273 - DNA, 20 bp, human
gcgctccacacgcggaggtc

SEQ ID NO: 114274 - DNA, 20 bp, human
gtgtgtgggtgtagcgtcca

SEQ ID NO: 114275 - DNA, 20 bp, human
gcggggccaacgaagcgtcc

SEQ ID NO: 114276 - DNA, 20 bp, human
gcagcgcaccggtcccccag

SEQ ID NO: 114277 - DNA, 20 bp, human
gctgcgccgcaaactcgtgt

SEQ ID NO: 114278 - DNA, 20 bp, human
gtgcaccccggagcgtctgg

SEQ ID NO: 114279 - DNA, 20 bp, human
gtcgtccccactcgggaagt

SEQ ID NO: 114280 - DNA, 20 bp, human
ggcggcggaaccgagctgac

SEQ ID NO: 114281 - DNA, 20 bp, human
gtgagtgcgtgcggggacgc

SEQ ID NO: 114282 - DNA, 20 bp, human
gccgcccgtcgtccccactc

SEQ ID NO: 114283 - DNA, 20 bp, human
gcacatgcgtgagcctagaa

SEQ ID NO: 114284 - DNA, 20 bp, human
gggagtacgtgcgggtctca

SEQ ID NO: 114285 - DNA, 20 bp, human
gactcgggaagtgggtagcg

SEQ ID NO: 114286 - DNA, 20 bp, human
ggtccggagtgcgagcctag

SEQ ID NO: 114287 - DNA, 20 bp, human
gtcgggagtcgcgggaggat

SEQ ID NO: 114288 - DNA, 20 bp, human
gcggagtgcgagcctagcgg

SEQ ID NO: 114289 - DNA, 20 bp, human
gccgagcgagggtatcccgg

SEQ ID NO: 114290 - DNA, 20 bp, human
ggcctcgcagtgcgcagggt

SEQ ID NO: 114291 - DNA, 20 bp, human
gggataccctcgctcggggt

SEQ ID NO: 114292 - DNA, 20 bp, human
gagaggcccgaggccgccaa

SEQ ID NO: 114293 - DNA, 20 bp, human
ggaggatcgggagtcgcggg

SEQ ID NO: 114294 - DNA, 20 bp, human
ggtccgggcgcctgaaccct

SEQ ID NO: 114295 - DNA, 20 bp, human
gtacctggccccggctctag

SEQ ID NO: 114296 - DNA, 20 bp, human
gagagccctggctcacccga

SEQ ID NO: 114297 - DNA, 20 bp, human
gtacgagcggatccgagtgg

SEQ ID NO: 114298 - DNA, 20 bp, human
gaagtacgagcggatccgag

SEQ ID NO: 114299 - DNA, 20 bp, human
gggcacctctccccaccact

SEQ ID NO: 114300 - DNA, 20 bp, human
gtgagatggagaagtacgag

SEQ ID NO: 114301 - DNA, 20 bp, human
gagaggcggagtctccccgg

SEQ ID NO: 114302 - DNA, 20 bp, human
gggagactccgcctctacgg

SEQ ID NO: 114303 - DNA, 20 bp, human
gcttggaacttactgactgt

SEQ ID NO: 114304 - DNA, 20 bp, human
gggtgccttcgggtgagcca

SEQ ID NO: 114305 - DNA, 20 bp, human
gggcgtggcctccgtagagg

SEQ ID NO: 114306 - DNA, 20 bp, human
ggccgagaaggagggactcg

SEQ ID NO: 114307 - DNA, 20 bp, human
ggacccgacagcgccagaca

SEQ ID NO: 114308 - DNA, 20 bp, human
gggccggcatctgaagcgag

SEQ ID NO: 114309 - DNA, 20 bp, human
gggggcctagcgccagtcag

SEQ ID NO: 114310 - DNA, 20 bp, human
gaccccgcgaagctcgatgg

SEQ ID NO: 114311 - DNA, 20 bp, human
gagggctcccacgggaacaa

SEQ ID NO: 114312 - DNA, 20 bp, human
gccgacagcgccagacaggg

SEQ ID NO: 114313 - DNA, 20 bp, human
gtgctgggctgacggatccg

SEQ ID NO: 114314 - DNA, 20 bp, human
ggagggccgctacctcggtg

SEQ ID NO: 114315 - DNA, 20 bp, human
gtagccaagagggtaagcaa

SEQ ID NO: 114316 - DNA, 20 bp, human
gccatgcgggagagcgacac

SEQ ID NO: 114317 - DNA, 20 bp, human
gccgcacggtggacgaggta

SEQ ID NO: 114318 - DNA, 20 bp, human
ggtcctgaagacccacggtg

SEQ ID NO: 114319 - DNA, 20 bp, human
gactggagggaggtattcgg

SEQ ID NO: 114320 - DNA, 20 bp, human
gacggtggggatgagaaccg

SEQ ID NO: 114321 - DNA, 20 bp, human
gggagagcgacacgggcctg

SEQ ID NO: 114322 - DNA, 20 bp, human
gaggtgggagatgaggatcg

SEQ ID NO: 114323 - DNA, 20 bp, human
gtggctgcacaacaagctgg

SEQ ID NO: 114324 - DNA, 20 bp, human
gcccaagatggcgtccatgc

SEQ ID NO: 114325 - DNA, 20 bp, human
gtggggatgagaaccgaggt

SEQ ID NO: 114326 - DNA, 20 bp, human
ggcccggcggagcgggcttc

SEQ ID NO: 114327 - DNA, 20 bp, human
gggcggtgcggggcggaagt

SEQ ID NO: 114328 - DNA, 20 bp, human
ggttggcgggcggacctggg

SEQ ID NO: 114329 - DNA, 20 bp, human
gtggctgagtcctgttctgg

SEQ ID NO: 114330 - DNA, 20 bp, human
gcacccagccgtccagcaaa

SEQ ID NO: 114331 - DNA, 20 bp, human
gacggctgggtggctttcgg

SEQ ID NO: 114332 - DNA, 20 bp, human
gagcacggctgggaacacct

SEQ ID NO: 114333 - DNA, 20 bp, human
gcgggagtcgggcctggcgg

SEQ ID NO: 114334 - DNA, 20 bp, human
ggcggcccggccctccaact

SEQ ID NO: 114335 - DNA, 20 bp, human
ggccgagctggagggcgccg

SEQ ID NO: 114336 - DNA, 20 bp, human
gtcatggacgaggactacta

SEQ ID NO: 114337 - DNA, 20 bp, human
ggggcgggacaccaacgcta

SEQ ID NO: 114338 - DNA, 20 bp, human
ggccgtgccgggcgccatca

SEQ ID NO: 114339 - DNA, 20 bp, human
ggctcgctcgcgggagggca

SEQ ID NO: 114340 - DNA, 20 bp, human
ggccgcgctcgctcgcggga

SEQ ID NO: 114341 - DNA, 20 bp, human
gccgggcgccatcatggacg

SEQ ID NO: 114342 - DNA, 20 bp, human
gcgctcgcgggagggcatgg

SEQ ID NO: 114343 - DNA, 20 bp, human
gcggagcgagggggtactgg

SEQ ID NO: 114344 - DNA, 20 bp, human
gcgggacaccaacgctaagg

SEQ ID NO: 114345 - DNA, 20 bp, human
gtaaggtggagggttgggtc

SEQ ID NO: 114346 - DNA, 20 bp, human
ggggcgcggccggagaccgt

SEQ ID NO: 114347 - DNA, 20 bp, human
gaagcagagggccttacccg

SEQ ID NO: 114348 - DNA, 20 bp, human
gcagagggccttacccgagg

SEQ ID NO: 114349 - DNA, 20 bp, human
ggttgtgagcccgctatcag

SEQ ID NO: 114350 - DNA, 20 bp, human
gccgcgctggccgctgatag

SEQ ID NO: 114351 - DNA, 20 bp, human
ggacccccctaccctcgcta

SEQ ID NO: 114352 - DNA, 20 bp, human
ggaaccccgggtggtaacag

SEQ ID NO: 114353 - DNA, 20 bp, human
gagacagaaggtccacacca

SEQ ID NO: 114354 - DNA, 20 bp, human
gcactccgtcggaaagacga

SEQ ID NO: 114355 - DNA, 20 bp, human
gtaggcagacctgaaggggt

SEQ ID NO: 114356 - DNA, 20 bp, human
gtcaggggcgcaggagtgag

SEQ ID NO: 114357 - DNA, 20 bp, human
gagggtccccgcctagcagg

SEQ ID NO: 114358 - DNA, 20 bp, human
gggtgaaaatagggactcac

SEQ ID NO: 114359 - DNA, 20 bp, human
gtgccctgctcggagtgaca

SEQ ID NO: 114360 - DNA, 20 bp, human
gtcaggggacccggcctcag

SEQ ID NO: 114361 - DNA, 20 bp, human
gcgccgcccgctagcaagtt

SEQ ID NO: 114362 - DNA, 20 bp, human
ggttgagtgccccttctcag

SEQ ID NO: 114363 - DNA, 20 bp, human
ggggtgcccacagaccacgg

SEQ ID NO: 114364 - DNA, 20 bp, human
gcgcccgctagcaagtttgg

SEQ ID NO: 114365 - DNA, 20 bp, human
gagcagggcaaagagatccc

SEQ ID NO: 114366 - DNA, 20 bp, human
gcgcacacccggtagaaggg

SEQ ID NO: 114367 - DNA, 20 bp, human
gcccacacgcagggccgagg

SEQ ID NO: 114368 - DNA, 20 bp, human
gggcggccccaagaaagccc

SEQ ID NO: 114369 - DNA, 20 bp, human
gcctttacaacaggttcggg

SEQ ID NO: 114370 - DNA, 20 bp, human
gctactgatcagtaaatccg

SEQ ID NO: 114371 - DNA, 20 bp, human
gtgggaagcttggagtaagg

SEQ ID NO: 114372 - DNA, 20 bp, human
ggaaagctccgggagacgcg

SEQ ID NO: 114373 - DNA, 20 bp, human
gttcgggcggcggggaagac

SEQ ID NO: 114374 - DNA, 20 bp, human
gagtaagacccgagactcca

SEQ ID NO: 114375 - DNA, 20 bp, human
gcccggacccaaagtaggtc

SEQ ID NO: 114376 - DNA, 20 bp, human
ggagtccggccgggcagtag

SEQ ID NO: 114377 - DNA, 20 bp, human
gcgggcagtagaggaacttg

SEQ ID NO: 114378 - DNA, 20 bp, human
gcgcctgcgcggaggagaag

SEQ ID NO: 114379 - DNA, 20 bp, human
ggacctgcctaggcctgagt

SEQ ID NO: 114380 - DNA, 20 bp, human
gagtacggcgcggaggtcaa

SEQ ID NO: 114381 - DNA, 20 bp, human
gagtggcgtcgagtccggcc

SEQ ID NO: 114382 - DNA, 20 bp, human
gtcttcatggcgaggcccga

SEQ ID NO: 114383 - DNA, 20 bp, human
gacttgcggtagtgaccctc

SEQ ID NO: 114384 - DNA, 20 bp, human
gtaaccagactggtccgtaa

SEQ ID NO: 114385 - DNA, 20 bp, human
gctgaagcaaacgaccactc

SEQ ID NO: 114386 - DNA, 20 bp, human
gcgggccgagggacccgggg

SEQ ID NO: 114387 - DNA, 20 bp, human
gcgcggcgcggggcccacca

SEQ ID NO: 114388 - DNA, 20 bp, human
ggctgcgcgctcaccatggt

SEQ ID NO: 114389 - DNA, 20 bp, human
gttgcgctgcgcgctcacca

SEQ ID NO: 114390 - DNA, 20 bp, human
ggctatggcggggaggaggt

SEQ ID NO: 114391 - DNA, 20 bp, human
ggagcgcgcagcgcaaggca

SEQ ID NO: 114392 - DNA, 20 bp, human
gtcgcgggccgagggacccg

SEQ ID NO: 114393 - DNA, 20 bp, human
gccgagggagaagttcaggg

SEQ ID NO: 114394 - DNA, 20 bp, human
gcgcagcgcaaggcaaggcc

SEQ ID NO: 114395 - DNA, 20 bp, human
ggaaatctcccggggaccga

SEQ ID NO: 114396 - DNA, 20 bp, human
gcgctggaggggagactcca

SEQ ID NO: 114397 - DNA, 20 bp, human
ggtctcccctccagcgagag

SEQ ID NO: 114398 - DNA, 20 bp, human
gccggttgccgaagagaaag

SEQ ID NO: 114399 - DNA, 20 bp, human
ggcagcccctctcgctggag

SEQ ID NO: 114400 - DNA, 20 bp, human
ggatccaggaggaaacgtgc

SEQ ID NO: 114401 - DNA, 20 bp, human
gcgagcttgcagcgagggac

SEQ ID NO: 114402 - DNA, 20 bp, human
gtggtgtgtggagccggagt

SEQ ID NO: 114403 - DNA, 20 bp, human
gtgtgtggagccggagtcgg

SEQ ID NO: 114404 - DNA, 20 bp, human
gtgcagcgagggaccggctg

SEQ ID NO: 114405 - DNA, 20 bp, human
gtccccgcccccttgcagga

SEQ ID NO: 114406 - DNA, 20 bp, human
gaccgacggggacaatgacg

SEQ ID NO: 114407 - DNA, 20 bp, human
gggaagagaaaagagaccga

SEQ ID NO: 114408 - DNA, 20 bp, human
ggccccgtcattgtccccgt

SEQ ID NO: 114409 - DNA, 20 bp, human
gctggcccgggagcggacga

SEQ ID NO: 114410 - DNA, 20 bp, human
ggctgaagagctggagggcg

SEQ ID NO: 114411 - DNA, 20 bp, human
ggctcgcagagcttttagga

SEQ ID NO: 114412 - DNA, 20 bp, human
gagcctgagcgactgagagt

SEQ ID NO: 114413 - DNA, 20 bp, human
ggcgactgagagtcgggagt

SEQ ID NO: 114414 - DNA, 20 bp, human
gcgcaaccggcgcgccgtcg

SEQ ID NO: 114415 - DNA, 20 bp, human
gagggccgccagctcgtcgt

SEQ ID NO: 114416 - DNA, 20 bp, human
gatggaaccacccctggaag

SEQ ID NO: 114417 - DNA, 20 bp, human
ggagtcaggaggctagctgg

SEQ ID NO: 114418 - DNA, 20 bp, human
ggagggttcagggcttggaa

SEQ ID NO: 114419 - DNA, 20 bp, human
ggaggtgatggaaccacccc

SEQ ID NO: 114420 - DNA, 20 bp, human
ggagcctcccagggagggta

SEQ ID NO: 114421 - DNA, 20 bp, human
gaactctcctcttccagggg

SEQ ID NO: 114422 - DNA, 20 bp, human
gctccctgggaggctcccaa

SEQ ID NO: 114423 - DNA, 20 bp, human
ggcctcagcctcaggctgaa

SEQ ID NO: 114424 - DNA, 20 bp, human
gtcgctctctactttcccca

SEQ ID NO: 114425 - DNA, 20 bp, human
gagggagtcaggaggctagc

SEQ ID NO: 114426 - DNA, 20 bp, human
gccaccgcggcgagaggcat

SEQ ID NO: 114427 - DNA, 20 bp, human
gcccagagctcggccaccct

SEQ ID NO: 114428 - DNA, 20 bp, human
gacgctatgcagaggcacac

SEQ ID NO: 114429 - DNA, 20 bp, human
gctgtagcgacgctatgcag

SEQ ID NO: 114430 - DNA, 20 bp, human
gatgggcacgtggctgccga

SEQ ID NO: 114431 - DNA, 20 bp, human
gtctgctccaccgcggcgag

SEQ ID NO: 114432 - DNA, 20 bp, human
ggtgcccatgcctctcgccg

SEQ ID NO: 114433 - DNA, 20 bp, human
gtggcacatgatgagactgg

SEQ ID NO: 114434 - DNA, 20 bp, human
ggagtacttgggaagcatgg

SEQ ID NO: 114435 - DNA, 20 bp, human
gggactggttattgacatct

SEQ ID NO: 114436 - DNA, 20 bp, human
gggaagaaggggtccgtcat

SEQ ID NO: 114437 - DNA, 20 bp, human
gcagcccggcgagccgatga

SEQ ID NO: 114438 - DNA, 20 bp, human
gccgtcaggaccctcctccc

SEQ ID NO: 114439 - DNA, 20 bp, human
gttccgcaagatagcagagg

SEQ ID NO: 114440 - DNA, 20 bp, human
gtctttccgcaagatagcag

SEQ ID NO: 114441 - DNA, 20 bp, human
gtatcttgcggaaagaggag

SEQ ID NO: 114442 - DNA, 20 bp, human
gccttggggatcttccgctg

SEQ ID NO: 114443 - DNA, 20 bp, human
gccgctgaggcattgaaggc

SEQ ID NO: 114444 - DNA, 20 bp, human
gtgatgcgagcgtcacggtg

SEQ ID NO: 114445 - DNA, 20 bp, human
ggcggcggcgcggatggtgg

SEQ ID NO: 114446 - DNA, 20 bp, human
ggcgcgggtaagggacgcag

SEQ ID NO: 114447 - DNA, 20 bp, human
gggcgcgggatccactgaag

SEQ ID NO: 114448 - DNA, 20 bp, human
gggctctgctcggtcctcaa

SEQ ID NO: 114449 - DNA, 20 bp, human
ggccagcctcggcccgcagg

SEQ ID NO: 114450 - DNA, 20 bp, human
gccacggacggcgccccctg

SEQ ID NO: 114451 - DNA, 20 bp, human
gtcctcaaaggtaaggaccg

SEQ ID NO: 114452 - DNA, 20 bp, human
ggccagacaaagaggcgcgt

SEQ ID NO: 114453 - DNA, 20 bp, human
gaagaggcgcgtcgggtccc

SEQ ID NO: 114454 - DNA, 20 bp, human
gtccgcactcctcggccctc

SEQ ID NO: 114455 - DNA, 20 bp, human
gctgcctccccgctcccctg

SEQ ID NO: 114456 - DNA, 20 bp, human
gagtctagctgccagggtcg

SEQ ID NO: 114457 - DNA, 20 bp, human
gctgcggggagagatgactg

SEQ ID NO: 114458 - DNA, 20 bp, human
gcagctgactcccgactctg

SEQ ID NO: 114459 - DNA, 20 bp, human
gctgtggagtctagctgcca

SEQ ID NO: 114460 - DNA, 20 bp, human
ggagaaggcgccttcaggga

SEQ ID NO: 114461 - DNA, 20 bp, human
gagaggaaggggctcgaatg

SEQ ID NO: 114462 - DNA, 20 bp, human
gcagctagactccacagagt

SEQ ID NO: 114463 - DNA, 20 bp, human
ggcaggggagggtctacgaa

SEQ ID NO: 114464 - DNA, 20 bp, human
gaaaggagaaggcgccttca

SEQ ID NO: 114465 - DNA, 20 bp, human
gtcgaatgaggagaaggacg

SEQ ID NO: 114466 - DNA, 20 bp, human
gagcagggcagggattctgt

SEQ ID NO: 114467 - DNA, 20 bp, human
ggcagggattctgtaggcat

SEQ ID NO: 114468 - DNA, 20 bp, human
gatcacagcagcaaagggtg

SEQ ID NO: 114469 - DNA, 20 bp, human
ggtaggcatgggctcccgac

SEQ ID NO: 114470 - DNA, 20 bp, human
gaggtccagggaaccattag

SEQ ID NO: 114471 - DNA, 20 bp, human
gaaggagagcgtgttccagt

SEQ ID NO: 114472 - DNA, 20 bp, human
gtaattcacagtgaacccag

SEQ ID NO: 114473 - DNA, 20 bp, human
gatccgtgatgacctcacgg

SEQ ID NO: 114474 - DNA, 20 bp, human
gtgaggtcatcacggatgct

SEQ ID NO: 114475 - DNA, 20 bp, human
gggacaggaagggacgccat

SEQ ID NO: 114476 - DNA, 20 bp, human
ggactgccggaaacaggtaa

SEQ ID NO: 114477 - DNA, 20 bp, human
gggctcctccgtctctgtcg

SEQ ID NO: 114478 - DNA, 20 bp, human
gggagaaacaactgagacgg

SEQ ID NO: 114479 - DNA, 20 bp, human
gacaactgagacggaggaca

SEQ ID NO: 114480 - DNA, 20 bp, human
gctgtggcactgaagagagg

SEQ ID NO: 114481 - DNA, 20 bp, human
ggctcacctgcactggaccc

SEQ ID NO: 114482 - DNA, 20 bp, human
gtgagacagagccacctagt

SEQ ID NO: 114483 - DNA, 20 bp, human
gctctggagtgataattctg

SEQ ID NO: 114484 - DNA, 20 bp, human
gagtcggctaggatctgacc

SEQ ID NO: 114485 - DNA, 20 bp, human
ggagacaggagagctccccg

SEQ ID NO: 114486 - DNA, 20 bp, human
gacagggctgaccccaaggt

SEQ ID NO: 114487 - DNA, 20 bp, human
gaatagaggccacagcaccg

SEQ ID NO: 114488 - DNA, 20 bp, human
gggctcccacaggtccctgt

SEQ ID NO: 114489 - DNA, 20 bp, human
gccacagcagagacacaaag

SEQ ID NO: 114490 - DNA, 20 bp, human
gccagaccgggagcgagtgt

SEQ ID NO: 114491 - DNA, 20 bp, human
gccaaggtgggtacaggaag

SEQ ID NO: 114492 - DNA, 20 bp, human
gggtgagggagtcagaaaca

SEQ ID NO: 114493 - DNA, 20 bp, human
gcacaaagaggtgagcccac

SEQ ID NO: 114494 - DNA, 20 bp, human
gtgctgtggcctctattctg

SEQ ID NO: 114495 - DNA, 20 bp, human
gaggggctgctccagatctg

SEQ ID NO: 114496 - DNA, 20 bp, human
gcagttcccgccaacctcaa

SEQ ID NO: 114497 - DNA, 20 bp, human
gtgagcagccgtgggccatg

SEQ ID NO: 114498 - DNA, 20 bp, human
gatataccctgggtagacgg

SEQ ID NO: 114499 - DNA, 20 bp, human
gcagggtatatgacagccac

SEQ ID NO: 114500 - DNA, 20 bp, human
gagaaatgaagttacaggag

SEQ ID NO: 114501 - DNA, 20 bp, human
gtgggctgtgcattgagaag

SEQ ID NO: 114502 - DNA, 20 bp, human
gggtagacggtggcttgtcc

SEQ ID NO: 114503 - DNA, 20 bp, human
gcggggacagagccccagat

SEQ ID NO: 114504 - DNA, 20 bp, human
ggaggtccctgggcccatct

SEQ ID NO: 114505 - DNA, 20 bp, human
gtggggtgaaagccacccgg

SEQ ID NO: 114506 - DNA, 20 bp, human
ggaccgcgaagtccagagaa

SEQ ID NO: 114507 - DNA, 20 bp, human
gtgcgccaggacacccgtgg

SEQ ID NO: 114508 - DNA, 20 bp, human
gcttgctccccgggacgcta

SEQ ID NO: 114509 - DNA, 20 bp, human
gcagcagggccctcccccgg

SEQ ID NO: 114510 - DNA, 20 bp, human
gtcccgccacggggcatggg

SEQ ID NO: 114511 - DNA, 20 bp, human
gccccggggccatagagtca

SEQ ID NO: 114512 - DNA, 20 bp, human
gcgggggacaccagctgcgt

SEQ ID NO: 114513 - DNA, 20 bp, human
gcgcgggtgcgcgccaccgg

SEQ ID NO: 114514 - DNA, 20 bp, human
gccgcccgccacgggtgtcc

SEQ ID NO: 114515 - DNA, 20 bp, human
gtggcgggcggaacccgcca

SEQ ID NO: 114516 - DNA, 20 bp, human
gccccaaggtaaccaggacg

SEQ ID NO: 114517 - DNA, 20 bp, human
ggcgcgcggcatcgccccag

SEQ ID NO: 114518 - DNA, 20 bp, human
gtgcgagccgagggctccaa

SEQ ID NO: 114519 - DNA, 20 bp, human
gcgcgcggaggctaattacg

SEQ ID NO: 114520 - DNA, 20 bp, human
gcgccgagctgaggtccggg

SEQ ID NO: 114521 - DNA, 20 bp, human
gactctggagagctacccca

SEQ ID NO: 114522 - DNA, 20 bp, human
gtgcgcaaaaagggccgctg

SEQ ID NO: 114523 - DNA, 20 bp, human
ggaccggggtcgacgctccg

SEQ ID NO: 114524 - DNA, 20 bp, human
ggcgctgatgagcaaactca

SEQ ID NO: 114525 - DNA, 20 bp, human
gcggggcatcgcagctgcac

SEQ ID NO: 114526 - DNA, 20 bp, human
gaggcccgcggaccttgacc

SEQ ID NO: 114527 - DNA, 20 bp, human
gtccgtagggaccaaagaag

SEQ ID NO: 114528 - DNA, 20 bp, human
gtggtccctacggacctggg

SEQ ID NO: 114529 - DNA, 20 bp, human
gaccgccccccaggtccgta

SEQ ID NO: 114530 - DNA, 20 bp, human
gaccgcaaggcgaccttgta

SEQ ID NO: 114531 - DNA, 20 bp, human
gcggctgaagcacacgccgt

SEQ ID NO: 114532 - DNA, 20 bp, human
gtgtggcccgcgtcccagag

SEQ ID NO: 114533 - DNA, 20 bp, human
gggcggtcaatgccgggtca

SEQ ID NO: 114534 - DNA, 20 bp, human
ggcccgggctacgatctgcg

SEQ ID NO: 114535 - DNA, 20 bp, human
ggggcggtggcggtcaatgc

SEQ ID NO: 114536 - DNA, 20 bp, human
gagacggggtaggacagcca

SEQ ID NO: 114537 - DNA, 20 bp, human
gacattgccgggcaccgaga

SEQ ID NO: 114538 - DNA, 20 bp, human
gcgcgctgccccggtgtcag

SEQ ID NO: 114539 - DNA, 20 bp, human
ggccccggtgtcagcggaga

SEQ ID NO: 114540 - DNA, 20 bp, human
ggtggtgggaggcgtctaga

SEQ ID NO: 114541 - DNA, 20 bp, human
ggaggcgtctagagggagac

SEQ ID NO: 114542 - DNA, 20 bp, human
ggggccaggagtttaaccac

SEQ ID NO: 114543 - DNA, 20 bp, human
ggaaagaccatagagcacca

SEQ ID NO: 114544 - DNA, 20 bp, human
gaccgccccctggtgctcta

SEQ ID NO: 114545 - DNA, 20 bp, human
gtccgagggatacgaccggg

SEQ ID NO: 114546 - DNA, 20 bp, human
ggcggcgtccggaggcccca

SEQ ID NO: 114547 - DNA, 20 bp, human
gcccgcgcggccacgacacg

SEQ ID NO: 114548 - DNA, 20 bp, human
gcaggaggcgcggcgtccgg

SEQ ID NO: 114549 - DNA, 20 bp, human
gcaggacctactaacaacaa

SEQ ID NO: 114550 - DNA, 20 bp, human
gttcgcccacgcaggaggcg

SEQ ID NO: 114551 - DNA, 20 bp, human
gaggaattcgcccacgcagg

SEQ ID NO: 114552 - DNA, 20 bp, human
gcttatgggcaattatggag

SEQ ID NO: 114553 - DNA, 20 bp, human
gggacgccgcgcctcctgcg

SEQ ID NO: 114554 - DNA, 20 bp, human
gagtgatagtctcataaccc

SEQ ID NO: 114555 - DNA, 20 bp, human
gacgaggaattcgcccacgc

SEQ ID NO: 114556 - DNA, 20 bp, human
gcctgggctgcagcccctaa

SEQ ID NO: 114557 - DNA, 20 bp, human
gctaagggagagagaacctg

SEQ ID NO: 114558 - DNA, 20 bp, human
gtatgggcttggcacgtcac

SEQ ID NO: 114559 - DNA, 20 bp, human
gtacctcggagaggagtcaa

SEQ ID NO: 114560 - DNA, 20 bp, human
gcccccaccgagcccatcgc

SEQ ID NO: 114561 - DNA, 20 bp, human
ggatgcccacccaatgaggg

SEQ ID NO: 114562 - DNA, 20 bp, human
ggcgaaccgcggagcgagtg

SEQ ID NO: 114563 - DNA, 20 bp, human
gtatggcctggcatagaggc

SEQ ID NO: 114564 - DNA, 20 bp, human
ggggcagcggctcctcaagg

SEQ ID NO: 114565 - DNA, 20 bp, human
ggatgcccccctcattgggt

SEQ ID NO: 114566 - DNA, 20 bp, human
gctctccggggagctaacca

SEQ ID NO: 114567 - DNA, 20 bp, human
gggagctaaccagggagagg

SEQ ID NO: 114568 - DNA, 20 bp, human
gcggggagctaaccagggag

SEQ ID NO: 114569 - DNA, 20 bp, human
gcaaaactgcagcaagtcag

SEQ ID NO: 114570 - DNA, 20 bp, human
ggaagttcccactcacctag

SEQ ID NO: 114571 - DNA, 20 bp, human
gtcctgaaagctcctctccg

SEQ ID NO: 114572 - DNA, 20 bp, human
gtcacctagaggagcagttg

SEQ ID NO: 114573 - DNA, 20 bp, human
gctggatggtcagggagact

SEQ ID NO: 114574 - DNA, 20 bp, human
gactgctcctctaggtgagt

SEQ ID NO: 114575 - DNA, 20 bp, human
gctcttctgggtaaggcagg

SEQ ID NO: 114576 - DNA, 20 bp, human
gacacagatctagagactcc

SEQ ID NO: 114577 - DNA, 20 bp, human
gtgagtgtcgcatcgtctcc

SEQ ID NO: 114578 - DNA, 20 bp, human
gatggcatgggtaccagctc

SEQ ID NO: 114579 - DNA, 20 bp, human
ggggtaccagctctggcagt

SEQ ID NO: 114580 - DNA, 20 bp, human
gcactcagcctgaaaagatt

SEQ ID NO: 114581 - DNA, 20 bp, human
gctaaagtcttcaaacaaat

SEQ ID NO: 114582 - DNA, 20 bp, human
gctgtgacgtcactagcaga

SEQ ID NO: 114583 - DNA, 20 bp, human
gacgtcactagcagatggca

SEQ ID NO: 114584 - DNA, 20 bp, human
ggttcagaatcccaaatgaa

SEQ ID NO: 114585 - DNA, 20 bp, human
gcaattgcagtcagaatcct

SEQ ID NO: 114586 - DNA, 20 bp, human
gggcgcgcccaatatctccc

SEQ ID NO: 114587 - DNA, 20 bp, human
gctcgtgtgagcaccgagtg

SEQ ID NO: 114588 - DNA, 20 bp, human
gacaggacgacgagcaggag

SEQ ID NO: 114589 - DNA, 20 bp, human
gccgggtgaatggagcgagg

SEQ ID NO: 114590 - DNA, 20 bp, human
ggcgctgcagcccggactga

SEQ ID NO: 114591 - DNA, 20 bp, human
ggcagcggcagtgacctatc

SEQ ID NO: 114592 - DNA, 20 bp, human
gggcgcgggcggccccgaag

SEQ ID NO: 114593 - DNA, 20 bp, human
ggaggctgcctgttggagtc

SEQ ID NO: 114594 - DNA, 20 bp, human
ggactgtgccagactccaac

SEQ ID NO: 114595 - DNA, 20 bp, human
ggggtacttaaggggtcctg

SEQ ID NO: 114596 - DNA, 20 bp, human
gcaccaatcacaatggacag

SEQ ID NO: 114597 - DNA, 20 bp, human
gcaatcacaatggacagcgg

SEQ ID NO: 114598 - DNA, 20 bp, human
ggaagctgcttgtggttcag

SEQ ID NO: 114599 - DNA, 20 bp, human
gtcacgccgggcgaaggacc

SEQ ID NO: 114600 - DNA, 20 bp, human
gcgcgagccaccaatcacaa

SEQ ID NO: 114601 - DNA, 20 bp, human
gggagctggcgaagccgcag

SEQ ID NO: 114602 - DNA, 20 bp, human
ggaggccgcagtcccttctc

SEQ ID NO: 114603 - DNA, 20 bp, human
gacgcaggaccgcccgcgga

SEQ ID NO: 114604 - DNA, 20 bp, human
gcggtcgcagaggtcccccg

SEQ ID NO: 114605 - DNA, 20 bp, human
gtcgcgtgccaggagccgca

SEQ ID NO: 114606 - DNA, 20 bp, human
gggacagtgggcgcacccga

SEQ ID NO: 114607 - DNA, 20 bp, human
gtcgagagagagcgtgacag

SEQ ID NO: 114608 - DNA, 20 bp, human
gggatgacgcctcaaccctc

SEQ ID NO: 114609 - DNA, 20 bp, human
gagtgacccgtgagacggag

SEQ ID NO: 114610 - DNA, 20 bp, human
ggggttgaggcgtcatccta

SEQ ID NO: 114611 - DNA, 20 bp, human
gggagttgccccagccccaa

SEQ ID NO: 114612 - DNA, 20 bp, human
ggctctctctcgaggcgcgg

SEQ ID NO: 114613 - DNA, 20 bp, human
ggtccaagtgacccgtgaga

SEQ ID NO: 114614 - DNA, 20 bp, human
gcacgggtcacttggacagt

SEQ ID NO: 114615 - DNA, 20 bp, human
ggaagagagaatggggtccg

SEQ ID NO: 114616 - DNA, 20 bp, human
ggcagccagaggactcccag

SEQ ID NO: 114617 - DNA, 20 bp, human
gccccagggtctgaaagtgt

SEQ ID NO: 114618 - DNA, 20 bp, human
gtcggcggggtgcctaccag

SEQ ID NO: 114619 - DNA, 20 bp, human
ggctggagcagaagtgttag

SEQ ID NO: 114620 - DNA, 20 bp, human
ggggctccctccctacagta

SEQ ID NO: 114621 - DNA, 20 bp, human
ggcgcgtcccgcctggctgt

SEQ ID NO: 114622 - DNA, 20 bp, human
gccagaggactcccagcggc

SEQ ID NO: 114623 - DNA, 20 bp, human
ggtgtcgggtcccctggtgg

SEQ ID NO: 114624 - DNA, 20 bp, human
gaacttgctgctggagacgg

SEQ ID NO: 114625 - DNA, 20 bp, human
ggggtgcgttccctactgta

SEQ ID NO: 114626 - DNA, 20 bp, human
gggatcctttccacggcccg

SEQ ID NO: 114627 - DNA, 20 bp, human
ggcggcgtctcggactgtga

SEQ ID NO: 114628 - DNA, 20 bp, human
gtggggacagagtaggtgag

SEQ ID NO: 114629 - DNA, 20 bp, human
ggtggggagacggcgctagt

SEQ ID NO: 114630 - DNA, 20 bp, human
ggcaggtaaccggcccgtgg

SEQ ID NO: 114631 - DNA, 20 bp, human
gcacttccggtggggtgtca

SEQ ID NO: 114632 - DNA, 20 bp, human
gttccggtggggtgtcatgg

SEQ ID NO: 114633 - DNA, 20 bp, human
gggttacctgctcgtcgaag

SEQ ID NO: 114634 - DNA, 20 bp, human
gctctccccgggccgtggaa

SEQ ID NO: 114635 - DNA, 20 bp, human
gctcggactgtgatggctgt

SEQ ID NO: 114636 - DNA, 20 bp, human
ggactccgcgcgcctctcag

SEQ ID NO: 114637 - DNA, 20 bp, human
gtcgggacgggacccctaga

SEQ ID NO: 114638 - DNA, 20 bp, human
ggcggccccgtgaccctagt

SEQ ID NO: 114639 - DNA, 20 bp, human
gaccctagtcggccgctgag

SEQ ID NO: 114640 - DNA, 20 bp, human
ggcctctcagcggccgacta

SEQ ID NO: 114641 - DNA, 20 bp, human
gcagcggccgactagggtca

SEQ ID NO: 114642 - DNA, 20 bp, human
ggcctgtgcagcaactccag

SEQ ID NO: 114643 - DNA, 20 bp, human
gtccatggtgacgatcctca

SEQ ID NO: 114644 - DNA, 20 bp, human
gtctgggccgctgccgtcta

SEQ ID NO: 114645 - DNA, 20 bp, human
gcgggcgcgcggagtgagga

SEQ ID NO: 114646 - DNA, 20 bp, human
ggcagggcccgccacctcac

SEQ ID NO: 114647 - DNA, 20 bp, human
gaggctggttctccatctgg

SEQ ID NO: 114648 - DNA, 20 bp, human
gggcccgccacctcacaggc

SEQ ID NO: 114649 - DNA, 20 bp, human
ggcccttaaacaaggagggt

SEQ ID NO: 114650 - DNA, 20 bp, human
gagggacagctccccatccg

SEQ ID NO: 114651 - DNA, 20 bp, human
gcacaggctggttctccatc

SEQ ID NO: 114652 - DNA, 20 bp, human
gcctggcccttaaacaagga

SEQ ID NO: 114653 - DNA, 20 bp, human
gcacgtgaggttcctcggat

SEQ ID NO: 114654 - DNA, 20 bp, human
gaacgctgcagacttcacag

SEQ ID NO: 114655 - DNA, 20 bp, human
gccggcgcagctaattccca

SEQ ID NO: 114656 - DNA, 20 bp, human
gggggacgcgggggaagtgg

SEQ ID NO: 114657 - DNA, 20 bp, human
ggccgccagccgccgcatta

SEQ ID NO: 114658 - DNA, 20 bp, human
gcaggcagggctcacggatg

SEQ ID NO: 114659 - DNA, 20 bp, human
gggtctctgccctaatgcgg

SEQ ID NO: 114660 - DNA, 20 bp, human
ggaggtaaacagaagtacaa

SEQ ID NO: 114661 - DNA, 20 bp, human
gcgcgctcgcctacctccaa

SEQ ID NO: 114662 - DNA, 20 bp, human
ggcagggctcacggatgagg

SEQ ID NO: 114663 - DNA, 20 bp, human
ggccgcccggggacgcgcac

SEQ ID NO: 114664 - DNA, 20 bp, human
gaggggatggagacagacga

SEQ ID NO: 114665 - DNA, 20 bp, human
ggcgaacaccggagagatgg

SEQ ID NO: 114666 - DNA, 20 bp, human
ggtccccgtcccgccggggg

SEQ ID NO: 114667 - DNA, 20 bp, human
ggggctcagattcctgtcag

SEQ ID NO: 114668 - DNA, 20 bp, human
gctcgcgagtagagggactt

SEQ ID NO: 114669 - DNA, 20 bp, human
ggaagtcactaccctcgagg

SEQ ID NO: 114670 - DNA, 20 bp, human
gaggagaggggttcaggacg

SEQ ID NO: 114671 - DNA, 20 bp, human
gtctactcgcgaggtgagtc

SEQ ID NO: 114672 - DNA, 20 bp, human
ggctgaggagaaacacgaaa

SEQ ID NO: 114673 - DNA, 20 bp, human
gggggaagggggagagccaa

SEQ ID NO: 114674 - DNA, 20 bp, human
ggtcactaccctcgaggagg

SEQ ID NO: 114675 - DNA, 20 bp, human
ggcaatgagatgaagtccga

SEQ ID NO: 114676 - DNA, 20 bp, human
ggaggctccgaactcgccgg

SEQ ID NO: 114677 - DNA, 20 bp, human
gctgctgctgggatctggcg

SEQ ID NO: 114678 - DNA, 20 bp, human
gtcagaggctccgaactcgc

SEQ ID NO: 114679 - DNA, 20 bp, human
gggcaccatgaagtcagcgg

SEQ ID NO: 114680 - DNA, 20 bp, human
ggcgccctgctgctgggatc

SEQ ID NO: 114681 - DNA, 20 bp, human
gcttcccggagacccgaccc

SEQ ID NO: 114682 - DNA, 20 bp, human
ggcgactccgccggcgagtt

SEQ ID NO: 114683 - DNA, 20 bp, human
gagccaccgcgcaggtccta

SEQ ID NO: 114684 - DNA, 20 bp, human
gccatgaagtcagcggagga

SEQ ID NO: 114685 - DNA, 20 bp, human
gccggaggaaagtcatcgag

SEQ ID NO: 114686 - DNA, 20 bp, human
ggccgggagaaccgaacccc

SEQ ID NO: 114687 - DNA, 20 bp, human
ggggagaaccgaacccctgg

SEQ ID NO: 114688 - DNA, 20 bp, human
gggcccgacccgccatgacg

SEQ ID NO: 114689 - DNA, 20 bp, human
ggcgccaccagccctctgtc

SEQ ID NO: 114690 - DNA, 20 bp, human
gaagagcgcagcccggacac

SEQ ID NO: 114691 - DNA, 20 bp, human
gcgttacgcggaggacgcgc

SEQ ID NO: 114692 - DNA, 20 bp, human
gtggtcctccagccccgtca

SEQ ID NO: 114693 - DNA, 20 bp, human
gcgaagtggtcccggacaga

SEQ ID NO: 114694 - DNA, 20 bp, human
ggacacgggcgtggacgaag

SEQ ID NO: 114695 - DNA, 20 bp, human
ggtggtcccggacagagggc

SEQ ID NO: 114696 - DNA, 20 bp, human
gcgcgcccggggaagctgag

SEQ ID NO: 114697 - DNA, 20 bp, human
gctgggcacaggagtcctct

SEQ ID NO: 114698 - DNA, 20 bp, human
gctccctggcacctgggtag

SEQ ID NO: 114699 - DNA, 20 bp, human
ggccgaccgccccctaaggg

SEQ ID NO: 114700 - DNA, 20 bp, human
gtccgaacgaaggtcggtgg

SEQ ID NO: 114701 - DNA, 20 bp, human
gcgcgagcttcctgctccgg

SEQ ID NO: 114702 - DNA, 20 bp, human
gagcggcagccccaacccga

SEQ ID NO: 114703 - DNA, 20 bp, human
gctggcccctgagcccgcca

SEQ ID NO: 114704 - DNA, 20 bp, human
gcgccatgaacgcccccgag

SEQ ID NO: 114705 - DNA, 20 bp, human
ggagcccctggcgggctcag

SEQ ID NO: 114706 - DNA, 20 bp, human
ggcgatccggcttactccag

SEQ ID NO: 114707 - DNA, 20 bp, human
gggccagggaagggacactt

SEQ ID NO: 114708 - DNA, 20 bp, human
gagaggctgcgttcagactg

SEQ ID NO: 114709 - DNA, 20 bp, human
gaggagcctcggagcgaccc

SEQ ID NO: 114710 - DNA, 20 bp, human
gtcggcgcggctccgcgatc

SEQ ID NO: 114711 - DNA, 20 bp, human
ggtccacagaccccatgatg

SEQ ID NO: 114712 - DNA, 20 bp, human
gctcccggcagaggtcggtg

SEQ ID NO: 114713 - DNA, 20 bp, human
gccgctcgccctcggcgcac

SEQ ID NO: 114714 - DNA, 20 bp, human
gtttggacaactttacgcgg

SEQ ID NO: 114715 - DNA, 20 bp, human
gaaggaagtcgcgttgcctc

SEQ ID NO: 114716 - DNA, 20 bp, human
gccgagtacaccggaaccag

SEQ ID NO: 114717 - DNA, 20 bp, human
gaccgctacctccggaccag

SEQ ID NO: 114718 - DNA, 20 bp, human
gggaccggcggaagggccaa

SEQ ID NO: 114719 - DNA, 20 bp, human
ggaaggtgcgcccggtcccg

SEQ ID NO: 114720 - DNA, 20 bp, human
gcggccggcaccgctacctc

SEQ ID NO: 114721 - DNA, 20 bp, human
gggaggaaagtgtgccatgg

SEQ ID NO: 114722 - DNA, 20 bp, human
gcggctggtgctggatccgg

SEQ ID NO: 114723 - DNA, 20 bp, human
gagcggggccgctggtccgg

SEQ ID NO: 114724 - DNA, 20 bp, human
gcggggagggtagggctata

SEQ ID NO: 114725 - DNA, 20 bp, human
ggcaccttccccgagtacac

SEQ ID NO: 114726 - DNA, 20 bp, human
gtcggtctccggtcatccaa

SEQ ID NO: 114727 - DNA, 20 bp, human
gaagccgacagtggaggctt

SEQ ID NO: 114728 - DNA, 20 bp, human
ggtggaggcttaggcaccgg

SEQ ID NO: 114729 - DNA, 20 bp, human
ggtgcctaagcctccactgt

SEQ ID NO: 114730 - DNA, 20 bp, human
gaaccgcagccgcccgccac

SEQ ID NO: 114731 - DNA, 20 bp, human
gccggtcatccaagggaaca

SEQ ID NO: 114732 - DNA, 20 bp, human
ggaggcttaggcaccggtgg

SEQ ID NO: 114733 - DNA, 20 bp, human
gcttaggcaccggtggcggg

SEQ ID NO: 114734 - DNA, 20 bp, human
ggcgcggccagctttcggaa

SEQ ID NO: 114735 - DNA, 20 bp, human
gccgcgcgccgagcagcacc

SEQ ID NO: 114736 - DNA, 20 bp, human
gtaacgagggggcttctgga

SEQ ID NO: 114737 - DNA, 20 bp, human
gcagaggtcgaagggagtcg

SEQ ID NO: 114738 - DNA, 20 bp, human
gtcgttggcctgcggaagtg

SEQ ID NO: 114739 - DNA, 20 bp, human
ggggcttctcagagaaaggg

SEQ ID NO: 114740 - DNA, 20 bp, human
gaaggcagcgagcctagggt

SEQ ID NO: 114741 - DNA, 20 bp, human
ggacaggcggcccagccggg

SEQ ID NO: 114742 - DNA, 20 bp, human
ggctcctgccggatccatgg

SEQ ID NO: 114743 - DNA, 20 bp, human
gagtttctataataacgagg

SEQ ID NO: 114744 - DNA, 20 bp, human
ggcggccagctgcgaggatg

SEQ ID NO: 114745 - DNA, 20 bp, human
ggggagtcggggggactcgt

SEQ ID NO: 114746 - DNA, 20 bp, human
ggactgagaactcaggccga

SEQ ID NO: 114747 - DNA, 20 bp, human
gggtcctcgcagattctcaa

SEQ ID NO: 114748 - DNA, 20 bp, human
gtccaccacaggtgcctgaa

SEQ ID NO: 114749 - DNA, 20 bp, human
gctctaggagaagacctaag

SEQ ID NO: 114750 - DNA, 20 bp, human
ggaggcaaggcaccgctgag

SEQ ID NO: 114751 - DNA, 20 bp, human
ggattccagtgagatccgag

SEQ ID NO: 114752 - DNA, 20 bp, human
gcactgctggacgaggatcc

SEQ ID NO: 114753 - DNA, 20 bp, human
gcctgctgtgactccaccac

SEQ ID NO: 114754 - DNA, 20 bp, human
gcctgcccctcggatctcac

SEQ ID NO: 114755 - DNA, 20 bp, human
gacgctggtgcgcctgcttg

SEQ ID NO: 114756 - DNA, 20 bp, human
gaagctccggcgccgagagt

SEQ ID NO: 114757 - DNA, 20 bp, human
gccctggaggctagaagctc

SEQ ID NO: 114758 - DNA, 20 bp, human
gctgcccggatacccgagtc

SEQ ID NO: 114759 - DNA, 20 bp, human
gccgagtgcggtagcaggag

SEQ ID NO: 114760 - DNA, 20 bp, human
gaaattgcgtgagaacggga

SEQ ID NO: 114761 - DNA, 20 bp, human
ggttcgctggccgcccctgg

SEQ ID NO: 114762 - DNA, 20 bp, human
gaggccctaagcccgagtcc

SEQ ID NO: 114763 - DNA, 20 bp, human
gcgccggccggcctagagct

SEQ ID NO: 114764 - DNA, 20 bp, human
gtagcgtaagcaggaattct

SEQ ID NO: 114765 - DNA, 20 bp, human
ggaggctccgagctctaggc

SEQ ID NO: 114766 - DNA, 20 bp, human
gagcccgagggcgaacgggt

SEQ ID NO: 114767 - DNA, 20 bp, human
gcacgagcccgagggcgaac

SEQ ID NO: 114768 - DNA, 20 bp, human
gaggcgcggcgcggacaggg

SEQ ID NO: 114769 - DNA, 20 bp, human
gtcggtaatcggctacacgc

SEQ ID NO: 114770 - DNA, 20 bp, human
gcgaccgaccacgagcccga

SEQ ID NO: 114771 - DNA, 20 bp, human
ggaagttgcgggaaggtctg

SEQ ID NO: 114772 - DNA, 20 bp, human
gcgcagggcccagagggccg

SEQ ID NO: 114773 - DNA, 20 bp, human
gctccccggcactcggtaat

SEQ ID NO: 114774 - DNA, 20 bp, human
gagccgattaccgagtgccg

SEQ ID NO: 114775 - DNA, 20 bp, human
gggactgagcccgctcgcgt

SEQ ID NO: 114776 - DNA, 20 bp, human
gacatatataaagtactcag

SEQ ID NO: 114777 - DNA, 20 bp, human
gattctcttctgtgctgtca

SEQ ID NO: 114778 - DNA, 20 bp, human
gagacaaacaactttaaagg

SEQ ID NO: 114779 - DNA, 20 bp, human
gcaaagacaaagccgctctg

SEQ ID NO: 114780 - DNA, 20 bp, human
gggaacatgttaagaaattg

SEQ ID NO: 114781 - DNA, 20 bp, human
gattgtaaagttttaagtta

SEQ ID NO: 114782 - DNA, 20 bp, human
gattccaaaatgtgtaagac

SEQ ID NO: 114783 - DNA, 20 bp, human
gaaactttacaatagatctt

SEQ ID NO: 114784 - DNA, 20 bp, human
gggaaaaaaattggaattca

SEQ ID NO: 114785 - DNA, 20 bp, human
gctgttaaatgtaaagtttt

SEQ ID NO: 114786 - DNA, 20 bp, human
ggctggtgcgagggacgaag

SEQ ID NO: 114787 - DNA, 20 bp, human
gtccgcacgtgtcaccccgg

SEQ ID NO: 114788 - DNA, 20 bp, human
gagcagctcgtcctgcagca

SEQ ID NO: 114789 - DNA, 20 bp, human
ggggtccgcacgtgtcaccc

SEQ ID NO: 114790 - DNA, 20 bp, human
ggccgccggggtgacacgtg

SEQ ID NO: 114791 - DNA, 20 bp, human
ggtaaagatctaggtctacg

SEQ ID NO: 114792 - DNA, 20 bp, human
gtcgcaccagcgtggatgca

SEQ ID NO: 114793 - DNA, 20 bp, human
gaccagccatgcatccacgc

SEQ ID NO: 114794 - DNA, 20 bp, human
gcggagcttggccaccgcgc

SEQ ID NO: 114795 - DNA, 20 bp, human
gttcatcgccgccgcgcgcc

SEQ ID NO: 114796 - DNA, 20 bp, human
gggtggagggagacgatgaa

SEQ ID NO: 114797 - DNA, 20 bp, human
ggcaagtacctggcacacgt

SEQ ID NO: 114798 - DNA, 20 bp, human
gcgaagaccggagcccctcc

SEQ ID NO: 114799 - DNA, 20 bp, human
gagaccatcctggatggtgg

SEQ ID NO: 114800 - DNA, 20 bp, human
ggtccacgggggacgaagac

SEQ ID NO: 114801 - DNA, 20 bp, human
gctcgggaaaacagggaaaa

SEQ ID NO: 114802 - DNA, 20 bp, human
gctccggtcttcgtcccccg

SEQ ID NO: 114803 - DNA, 20 bp, human
ggcctgctttctggggcgga

SEQ ID NO: 114804 - DNA, 20 bp, human
ggcacacgtcggagccttct

SEQ ID NO: 114805 - DNA, 20 bp, human
gaaatccatacagcctctct

SEQ ID NO: 114806 - DNA, 20 bp, human
gtggagtgtagggaaactct

SEQ ID NO: 114807 - DNA, 20 bp, human
gtccacgccgcggcttacct

SEQ ID NO: 114808 - DNA, 20 bp, human
ggtctcacccaggtaagccg

SEQ ID NO: 114809 - DNA, 20 bp, human
gcgcgcgtgtgcccgcgggt

SEQ ID NO: 114810 - DNA, 20 bp, human
gagtgtagggaaactctagg

SEQ ID NO: 114811 - DNA, 20 bp, human
ggagcggcaatagcgctggc

SEQ ID NO: 114812 - DNA, 20 bp, human
ggcgagcaaggagcgagcca

SEQ ID NO: 114813 - DNA, 20 bp, human
gcatggagcggcaatagcgc

SEQ ID NO: 114814 - DNA, 20 bp, human
gggcaatagcgctggctggc

SEQ ID NO: 114815 - DNA, 20 bp, human
gagcgagccacggagagagc

SEQ ID NO: 114816 - DNA, 20 bp, human
gtcgagcggggtccagaggg

SEQ ID NO: 114817 - DNA, 20 bp, human
gagctcgagcggggtccaga

SEQ ID NO: 114818 - DNA, 20 bp, human
gctgcggcaggatcccggag

SEQ ID NO: 114819 - DNA, 20 bp, human
ggttacagccccaagcactg

SEQ ID NO: 114820 - DNA, 20 bp, human
gctgacccggccgagcgtgg

SEQ ID NO: 114821 - DNA, 20 bp, human
ggaccatgtgtgtgcgcgag

SEQ ID NO: 114822 - DNA, 20 bp, human
gcgagcgctgatctctgggg

SEQ ID NO: 114823 - DNA, 20 bp, human
gggcgaaaagcagccaacac

SEQ ID NO: 114824 - DNA, 20 bp, human
ggtgcgcgaaggttcggtgt

SEQ ID NO: 114825 - DNA, 20 bp, human
gggggtccagagggtggaac

SEQ ID NO: 114826 - DNA, 20 bp, human
ggacgaatacatcccgggcg

SEQ ID NO: 114827 - DNA, 20 bp, human
gcgaggaccgtacctgggtg

SEQ ID NO: 114828 - DNA, 20 bp, human
gccgggcgaggaccgtacct

SEQ ID NO: 114829 - DNA, 20 bp, human
ggcggggacgaatacatccc

SEQ ID NO: 114830 - DNA, 20 bp, human
gcccgacactcggaaaggtc

SEQ ID NO: 114831 - DNA, 20 bp, human
gcccgccccgacactcggaa

SEQ ID NO: 114832 - DNA, 20 bp, human
ggctctgcctcacccaggta

SEQ ID NO: 114833 - DNA, 20 bp, human
gccccctagattcctctcag

SEQ ID NO: 114834 - DNA, 20 bp, human
ggcctctgagaggaatctag

SEQ ID NO: 114835 - DNA, 20 bp, human
ggggggtccgcggtaggtaa

SEQ ID NO: 114836 - DNA, 20 bp, human
gcccgggcgaaaacgaaagt

SEQ ID NO: 114837 - DNA, 20 bp, human
gtgctgcgaggaggcgaggc

SEQ ID NO: 114838 - DNA, 20 bp, human
gccgagcgcgcagtccgtgg

SEQ ID NO: 114839 - DNA, 20 bp, human
gggaccgagcgcgctcgctc

SEQ ID NO: 114840 - DNA, 20 bp, human
gtgggtgcggcgacgtacca

SEQ ID NO: 114841 - DNA, 20 bp, human
ggcgaaaacgaaagtgggtg

SEQ ID NO: 114842 - DNA, 20 bp, human
ggggtgcggggggggatcgt

SEQ ID NO: 114843 - DNA, 20 bp, human
gatcgtgggtaggggtcccg

SEQ ID NO: 114844 - DNA, 20 bp, human
ggtaccatggcgctgctgcg

SEQ ID NO: 114845 - DNA, 20 bp, human
ggccgcgggagaccccaagt

SEQ ID NO: 114846 - DNA, 20 bp, human
gggcgagtcccatcctgaca

SEQ ID NO: 114847 - DNA, 20 bp, human
gaccagccaggactacgtgc

SEQ ID NO: 114848 - DNA, 20 bp, human
gtcgcgccggcacgtagtcc

SEQ ID NO: 114849 - DNA, 20 bp, human
ggatgggactcgccacctta

SEQ ID NO: 114850 - DNA, 20 bp, human
gattatgcaacagcagcggg

SEQ ID NO: 114851 - DNA, 20 bp, human
ggggactcgccaccttaagg

SEQ ID NO: 114852 - DNA, 20 bp, human
gcggagagatgtgtgttagt

SEQ ID NO: 114853 - DNA, 20 bp, human
gggcccggcgaccgctccca

SEQ ID NO: 114854 - DNA, 20 bp, human
ggccacggcgcccgcggacc

SEQ ID NO: 114855 - DNA, 20 bp, human
gcggcccgagagcaggaaca

SEQ ID NO: 114856 - DNA, 20 bp, human
gacctgggtgaggcagtacg

SEQ ID NO: 114857 - DNA, 20 bp, human
gttggaagcggcgcactccg

SEQ ID NO: 114858 - DNA, 20 bp, human
ggcatggagtagacgcgcgg

SEQ ID NO: 114859 - DNA, 20 bp, human
gcggcacagcctgcacccct

SEQ ID NO: 114860 - DNA, 20 bp, human
gggggcggcggccggtacct

SEQ ID NO: 114861 - DNA, 20 bp, human
gtactgcctcacccaggtac

SEQ ID NO: 114862 - DNA, 20 bp, human
gcacagcctgcacccctcgg

SEQ ID NO: 114863 - DNA, 20 bp, human
gagtacatagctgggcgccc

SEQ ID NO: 114864 - DNA, 20 bp, human
gagggtgaccggccgagcgg

SEQ ID NO: 114865 - DNA, 20 bp, human
ggtacggggagtacatagct

SEQ ID NO: 114866 - DNA, 20 bp, human
gaccattgatctgaagcacc

SEQ ID NO: 114867 - DNA, 20 bp, human
ggagtccagaatctcagaat

SEQ ID NO: 114868 - DNA, 20 bp, human
gaatctcagaatcgggcgtt

SEQ ID NO: 114869 - DNA, 20 bp, human
gtcgggcgttgggctttgcc

SEQ ID NO: 114870 - DNA, 20 bp, human
gtggatgttccaactggatc

SEQ ID NO: 114871 - DNA, 20 bp, human
ggcttgtctcggccacatta

SEQ ID NO: 114872 - DNA, 20 bp, human
gatccacgagcaagcgagtg

SEQ ID NO: 114873 - DNA, 20 bp, human
gcactcagtcaggtgacaga

SEQ ID NO: 114874 - DNA, 20 bp, human
gttggggtggatgttccaac

SEQ ID NO: 114875 - DNA, 20 bp, human
ggtctgattaaaaaatgttg

SEQ ID NO: 114876 - DNA, 20 bp, human
gacccgggtaagccaaactc

SEQ ID NO: 114877 - DNA, 20 bp, human
ggcggcccgaccgacgggaa

SEQ ID NO: 114878 - DNA, 20 bp, human
ggaagtgcaccagcgagccg

SEQ ID NO: 114879 - DNA, 20 bp, human
gaggcccgcgccgcttagga

SEQ ID NO: 114880 - DNA, 20 bp, human
gcgcgccaggaggccgaacg

SEQ ID NO: 114881 - DNA, 20 bp, human
gggaatgaggaagtccgagt

SEQ ID NO: 114882 - DNA, 20 bp, human
ggccaaactcgggcgagtgg

SEQ ID NO: 114883 - DNA, 20 bp, human
gtaaccgctgggctagaccg

SEQ ID NO: 114884 - DNA, 20 bp, human
gcgcagccgcccggccagta

SEQ ID NO: 114885 - DNA, 20 bp, human
ggtgggctctccctcctaag

SEQ ID NO: 114886 - DNA, 20 bp, human
gtgtggcgggtgagatccgg

SEQ ID NO: 114887 - DNA, 20 bp, human
gcccgccacacccggacagg

SEQ ID NO: 114888 - DNA, 20 bp, human
gccagccgcctgtccgggtg

SEQ ID NO: 114889 - DNA, 20 bp, human
ggagagcgagatccggagtt

SEQ ID NO: 114890 - DNA, 20 bp, human
gtcacccgccacacccggac

SEQ ID NO: 114891 - DNA, 20 bp, human
gtccggatctcgctctccac

SEQ ID NO: 114892 - DNA, 20 bp, human
gtaggcccggctctgtctag

SEQ ID NO: 114893 - DNA, 20 bp, human
gctgcgagcatacaggtgta

SEQ ID NO: 114894 - DNA, 20 bp, human
gggatctcacccgccacacc

SEQ ID NO: 114895 - DNA, 20 bp, human
ggcaggcggcatgactcact

SEQ ID NO: 114896 - DNA, 20 bp, human
gctggactccatgaaagacg

SEQ ID NO: 114897 - DNA, 20 bp, human
gcgacgggctgaagaaggag

SEQ ID NO: 114898 - DNA, 20 bp, human
gagccgcgcggcacctcctg

SEQ ID NO: 114899 - DNA, 20 bp, human
ggaccagcgatgcagccggg

SEQ ID NO: 114900 - DNA, 20 bp, human
gagccctgcagcgttcgggg

SEQ ID NO: 114901 - DNA, 20 bp, human
gatcgctggtcccccggctc

SEQ ID NO: 114902 - DNA, 20 bp, human
gggcctggagcccgagccgg

SEQ ID NO: 114903 - DNA, 20 bp, human
gtggacgaccgccacgacag

SEQ ID NO: 114904 - DNA, 20 bp, human
gcgctcggccgcctggaaca

SEQ ID NO: 114905 - DNA, 20 bp, human
ggaggacggggactcgtaag

SEQ ID NO: 114906 - DNA, 20 bp, human
ggccaggcagccctgctcac

SEQ ID NO: 114907 - DNA, 20 bp, human
gagggctgcctggccagcgt

SEQ ID NO: 114908 - DNA, 20 bp, human
gggtggtgcaggactgagtc

SEQ ID NO: 114909 - DNA, 20 bp, human
gggctaagtgtagacacgtg

SEQ ID NO: 114910 - DNA, 20 bp, human
gagccttcaggatggagtgg

SEQ ID NO: 114911 - DNA, 20 bp, human
gcacgatgcccaggtagcca

SEQ ID NO: 114912 - DNA, 20 bp, human
ggctcacaggcaaggtgtag

SEQ ID NO: 114913 - DNA, 20 bp, human
gggtagccttcaggatggag

SEQ ID NO: 114914 - DNA, 20 bp, human
gcctctatccatggctacct

SEQ ID NO: 114915 - DNA, 20 bp, human
gcctgccccaccccctcgga

SEQ ID NO: 114916 - DNA, 20 bp, human
gcccggcaaagcccagctac

SEQ ID NO: 114917 - DNA, 20 bp, human
ggcaaagcccagctacaggc

SEQ ID NO: 114918 - DNA, 20 bp, human
gagctacaggcgggcgactg

SEQ ID NO: 114919 - DNA, 20 bp, human
gtacaggcgggcgactgcgg

SEQ ID NO: 114920 - DNA, 20 bp, human
gatggcccccgccgcctcag

SEQ ID NO: 114921 - DNA, 20 bp, human
gaatgtgacgccgggtccta

SEQ ID NO: 114922 - DNA, 20 bp, human
gtgacgtagccgaagacgag

SEQ ID NO: 114923 - DNA, 20 bp, human
gcggctacgtcactgaggat

SEQ ID NO: 114924 - DNA, 20 bp, human
ggttaaaagttaggactcgg

SEQ ID NO: 114925 - DNA, 20 bp, human
gcgggtcctagggctccgtt

SEQ ID NO: 114926 - DNA, 20 bp, human
gcccaagatcggggacccgg

SEQ ID NO: 114927 - DNA, 20 bp, human
ggcctagtccctgcttctag

SEQ ID NO: 114928 - DNA, 20 bp, human
gggtaccggacccaagatcg

SEQ ID NO: 114929 - DNA, 20 bp, human
gacccctagaagcagggact

SEQ ID NO: 114930 - DNA, 20 bp, human
gctccgcgggggaaacagcg

SEQ ID NO: 114931 - DNA, 20 bp, human
gcgtggattgcgggccccca

SEQ ID NO: 114932 - DNA, 20 bp, human
ggggcccgcaatccacgcca

SEQ ID NO: 114933 - DNA, 20 bp, human
gcattacctcggggattccg

SEQ ID NO: 114934 - DNA, 20 bp, human
gatcggcgtgggtctcggtg

SEQ ID NO: 114935 - DNA, 20 bp, human
gcagggccccgagggtgcaa

SEQ ID NO: 114936 - DNA, 20 bp, human
gagatccgagacagacccgg

SEQ ID NO: 114937 - DNA, 20 bp, human
gccctcccgcgcggaaaaac

SEQ ID NO: 114938 - DNA, 20 bp, human
ggaagcttctggaagagcag

SEQ ID NO: 114939 - DNA, 20 bp, human
gtatagatccgagacagacc

SEQ ID NO: 114940 - DNA, 20 bp, human
gccctcggggctgatgagag

SEQ ID NO: 114941 - DNA, 20 bp, human
gctgtcccgtagggactcag

SEQ ID NO: 114942 - DNA, 20 bp, human
ggaacccaggtgactttatc

SEQ ID NO: 114943 - DNA, 20 bp, human
gctgccagataaagtcacct

SEQ ID NO: 114944 - DNA, 20 bp, human
gtcactgtgcgggagaggag

SEQ ID NO: 114945 - DNA, 20 bp, human
gtctcccgcacagtgagcag

SEQ ID NO: 114946 - DNA, 20 bp, human
gtccacccagcggttactgt

SEQ ID NO: 114947 - DNA, 20 bp, human
gagcgaggaggagccatagg

SEQ ID NO: 114948 - DNA, 20 bp, human
gagcgggctgattccaccta

SEQ ID NO: 114949 - DNA, 20 bp, human
gcgggctgtggggctccgag

SEQ ID NO: 114950 - DNA, 20 bp, human
ggcctccttcccgggctgtg

SEQ ID NO: 114951 - DNA, 20 bp, human
gagggtgtaggtgagcgagg

SEQ ID NO: 114952 - DNA, 20 bp, human
ggacagggtgtaggtgagcg

SEQ ID NO: 114953 - DNA, 20 bp, human
gccacaggagaaggaagacg

SEQ ID NO: 114954 - DNA, 20 bp, human
gcatcctccgggacccgtca

SEQ ID NO: 114955 - DNA, 20 bp, human
ggccccacagcccgggaagg

SEQ ID NO: 114956 - DNA, 20 bp, human
gtaagaagctcggagacggg

SEQ ID NO: 114957 - DNA, 20 bp, human
gaggggggtgataggatcag

SEQ ID NO: 114958 - DNA, 20 bp, human
gcaagtacccccagagccgt

SEQ ID NO: 114959 - DNA, 20 bp, human
gggaagggcggagacactcc

SEQ ID NO: 114960 - DNA, 20 bp, human
gccccagagccgtaggccca

SEQ ID NO: 114961 - DNA, 20 bp, human
ggctctgggggtacttgggg

SEQ ID NO: 114962 - DNA, 20 bp, human
ggagggagaaggaccagcca

SEQ ID NO: 114963 - DNA, 20 bp, human
gctccgagcttcttaaacac

SEQ ID NO: 114964 - DNA, 20 bp, human
gaccaaagggagaaacaaca

SEQ ID NO: 114965 - DNA, 20 bp, human
gaaaggatcagggttaggtt

SEQ ID NO: 114966 - DNA, 20 bp, human
gggacggcgcgggccagtac

SEQ ID NO: 114967 - DNA, 20 bp, human
ggcgcgccccgagtacgcag

SEQ ID NO: 114968 - DNA, 20 bp, human
gctgcgcgcggctgcctccc

SEQ ID NO: 114969 - DNA, 20 bp, human
gcgcgcacgcctaggaggtt

SEQ ID NO: 114970 - DNA, 20 bp, human
ggcgggactccccagatgga

SEQ ID NO: 114971 - DNA, 20 bp, human
gggctcagggagctgtcggc

SEQ ID NO: 114972 - DNA, 20 bp, human
gccgcaggaggacaccgacg

SEQ ID NO: 114973 - DNA, 20 bp, human
gtggagtcccggtcgagagg

SEQ ID NO: 114974 - DNA, 20 bp, human
ggagccggtggcgcaggtgt

SEQ ID NO: 114975 - DNA, 20 bp, human
gccgcaccgctgcgtactcg

SEQ ID NO: 114976 - DNA, 20 bp, human
gggcgagttcttagagaaaa

SEQ ID NO: 114977 - DNA, 20 bp, human
gtaaagggcgccagtgagag

SEQ ID NO: 114978 - DNA, 20 bp, human
gctgacctcgtggcaagagg

SEQ ID NO: 114979 - DNA, 20 bp, human
gaggactgagatactaatgg

SEQ ID NO: 114980 - DNA, 20 bp, human
gtggaggagatcgatagaat

SEQ ID NO: 114981 - DNA, 20 bp, human
gaactcgccgtctgacctcg

SEQ ID NO: 114982 - DNA, 20 bp, human
gagtatggctactcaaacat

SEQ ID NO: 114983 - DNA, 20 bp, human
gcttgactcttcaaacacaa

SEQ ID NO: 114984 - DNA, 20 bp, human
gttgctttaaaggcccagga

SEQ ID NO: 114985 - DNA, 20 bp, human
gcgtctgacctcgtggcaag

SEQ ID NO: 114986 - DNA, 20 bp, human
gttgctctggaaggacccga

SEQ ID NO: 114987 - DNA, 20 bp, human
ggagtgcgtctgggagcccg

SEQ ID NO: 114988 - DNA, 20 bp, human
gtgcgggagcgagtgcgtct

SEQ ID NO: 114989 - DNA, 20 bp, human
ggcgcccgcggttcaggtga

SEQ ID NO: 114990 - DNA, 20 bp, human
gcagcggggaaagttagacc

SEQ ID NO: 114991 - DNA, 20 bp, human
gagaagggctgcgggttagg

SEQ ID NO: 114992 - DNA, 20 bp, human
gtcgctcccgcaaggagtct

SEQ ID NO: 114993 - DNA, 20 bp, human
ggtgcgacgcgtgaggctgg

SEQ ID NO: 114994 - DNA, 20 bp, human
gacgcagaagctaaaccctc

SEQ ID NO: 114995 - DNA, 20 bp, human
gccagtgatgagaggccgag

SEQ ID NO: 114996 - DNA, 20 bp, human
gtcgggtcccgctctccggg

SEQ ID NO: 114997 - DNA, 20 bp, human
ggcaggcgcagcccccgagt

SEQ ID NO: 114998 - DNA, 20 bp, human
gtgcagcggcttcggaaggt

SEQ ID NO: 114999 - DNA, 20 bp, human
gcggagcagcatggtcccgc

SEQ ID NO: 115000 - DNA, 20 bp, human
gactgccgcccgcctccaag

SEQ ID NO: 115001 - DNA, 20 bp, human
gccgaagccgctgcagtcct

SEQ ID NO: 115002 - DNA, 20 bp, human
gcaagcggctcggagcagca

SEQ ID NO: 115003 - DNA, 20 bp, human
gtaggaaggaaggctctaaa

SEQ ID NO: 115004 - DNA, 20 bp, human
ggaagggactgcacctactc

SEQ ID NO: 115005 - DNA, 20 bp, human
gcccttctgaccgaaggtaa

SEQ ID NO: 115006 - DNA, 20 bp, human
ggcactccggactaagatgg

SEQ ID NO: 115007 - DNA, 20 bp, human
gatctttcgtggttctgtca

SEQ ID NO: 115008 - DNA, 20 bp, human
gtaccgcctgcgcagcccgg

SEQ ID NO: 115009 - DNA, 20 bp, human
gtaggcactccggactaaga

SEQ ID NO: 115010 - DNA, 20 bp, human
gcacccggtagagggcctgg

SEQ ID NO: 115011 - DNA, 20 bp, human
gcagggctcacccccaacta

SEQ ID NO: 115012 - DNA, 20 bp, human
gggctgtagagccagaacgg

SEQ ID NO: 115013 - DNA, 20 bp, human
gcgtcgccgccatcttagtc

SEQ ID NO: 115014 - DNA, 20 bp, human
gcgcccccaggccctctacc

SEQ ID NO: 115015 - DNA, 20 bp, human
ggggagacccttaggcactc

SEQ ID NO: 115016 - DNA, 20 bp, human
gtaggttctgcggcacggga

SEQ ID NO: 115017 - DNA, 20 bp, human
gcagctcgatctaggttctg

SEQ ID NO: 115018 - DNA, 20 bp, human
gtggctgtacagctcgatct

SEQ ID NO: 115019 - DNA, 20 bp, human
ggttctgcggcacgggatgg

SEQ ID NO: 115020 - DNA, 20 bp, human
gtcgcggcgccggaagtccg

SEQ ID NO: 115021 - DNA, 20 bp, human
gcccacgccaccactccagg

SEQ ID NO: 115022 - DNA, 20 bp, human
gcggaggcgcctcctgtctc

SEQ ID NO: 115023 - DNA, 20 bp, human
gctcataccgcctggagtgg

SEQ ID NO: 115024 - DNA, 20 bp, human
gggcgggctcttgacgtgta

SEQ ID NO: 115025 - DNA, 20 bp, human
gtcacagccagtgacggtgg

SEQ ID NO: 115026 - DNA, 20 bp, human
gctctgcgggagcgtggtag

SEQ ID NO: 115027 - DNA, 20 bp, human
gcgccgggaaccaactgcag

SEQ ID NO: 115028 - DNA, 20 bp, human
ggttcccggcgggagacgca

SEQ ID NO: 115029 - DNA, 20 bp, human
gactgcagtggtacacccca

SEQ ID NO: 115030 - DNA, 20 bp, human
gggaggagtcgcgaccacgg

SEQ ID NO: 115031 - DNA, 20 bp, human
gtctccgcggcgccggagga

SEQ ID NO: 115032 - DNA, 20 bp, human
gagtggcccgtccccgggat

SEQ ID NO: 115033 - DNA, 20 bp, human
gaggcgaaggagggtcagtg

SEQ ID NO: 115034 - DNA, 20 bp, human
gcggtggccgaggccgatcc

SEQ ID NO: 115035 - DNA, 20 bp, human
ggggactcgccctccggtaa

SEQ ID NO: 115036 - DNA, 20 bp, human
ggactccgaaacccaatcag

SEQ ID NO: 115037 - DNA, 20 bp, human
gagaacctgggcctgagtcg

SEQ ID NO: 115038 - DNA, 20 bp, human
gcacgaatggccctacacta

SEQ ID NO: 115039 - DNA, 20 bp, human
gtcgccattttgctaggcag

SEQ ID NO: 115040 - DNA, 20 bp, human
gcggagagtggagagtgcaa

SEQ ID NO: 115041 - DNA, 20 bp, human
ggcggctggagcctctgatt

SEQ ID NO: 115042 - DNA, 20 bp, human
ggcatgtgtcccctagtgta

SEQ ID NO: 115043 - DNA, 20 bp, human
gtcggggagcaggcacctcg

SEQ ID NO: 115044 - DNA, 20 bp, human
gtgcgagggtcggagccccg

SEQ ID NO: 115045 - DNA, 20 bp, human
gcctccctcccgacctagag

SEQ ID NO: 115046 - DNA, 20 bp, human
gtggagacgggagccaacca

SEQ ID NO: 115047 - DNA, 20 bp, human
gcgggcccggagctcaacgg

SEQ ID NO: 115048 - DNA, 20 bp, human
gccccgggcccggagctcaa

SEQ ID NO: 115049 - DNA, 20 bp, human
gcctggccccgtagccccgg

SEQ ID NO: 115050 - DNA, 20 bp, human
ggtccaaccaaacagccgat

SEQ ID NO: 115051 - DNA, 20 bp, human
ggtcggggccccgctctcga

SEQ ID NO: 115052 - DNA, 20 bp, human
gtcggtttaggagcgatcat

SEQ ID NO: 115053 - DNA, 20 bp, human
gcccgggacgccgtcgagag

SEQ ID NO: 115054 - DNA, 20 bp, human
ggccggctccccgcacaaaa

SEQ ID NO: 115055 - DNA, 20 bp, human
ggcgcggcccccgggatgtg

SEQ ID NO: 115056 - DNA, 20 bp, human
gcgcgaggaagtgaggtctc

SEQ ID NO: 115057 - DNA, 20 bp, human
gaagtgtgcgtcacggagaa

SEQ ID NO: 115058 - DNA, 20 bp, human
gaggcccaggcgcggcggag

SEQ ID NO: 115059 - DNA, 20 bp, human
gcggagcgcgcgcgaagcgg

SEQ ID NO: 115060 - DNA, 20 bp, human
ggagggggaagtgtgcgtca

SEQ ID NO: 115061 - DNA, 20 bp, human
gacggagtcgggcaatgcag

SEQ ID NO: 115062 - DNA, 20 bp, human
gggagctggcgcgtccaata

SEQ ID NO: 115063 - DNA, 20 bp, human
ggcgccagctccggtctagg

SEQ ID NO: 115064 - DNA, 20 bp, human
ggccaggcaagagcacaaca

SEQ ID NO: 115065 - DNA, 20 bp, human
ggaacggagcgcgcgcgaag

SEQ ID NO: 115066 - DNA, 20 bp, human
ggtccccggaagcacagctg

SEQ ID NO: 115067 - DNA, 20 bp, human
gaaggcgcgcggccagtcgt

SEQ ID NO: 115068 - DNA, 20 bp, human
ggcgcgcggccagtcgtagg

SEQ ID NO: 115069 - DNA, 20 bp, human
gcagatgtgcgccagaggag

SEQ ID NO: 115070 - DNA, 20 bp, human
gagggcgcagcggccaagcg

SEQ ID NO: 115071 - DNA, 20 bp, human
ggcaggaccggccccgaagg

SEQ ID NO: 115072 - DNA, 20 bp, human
gagcggccaagcggggtccc

SEQ ID NO: 115073 - DNA, 20 bp, human
ggcggcaggaccggccccga

SEQ ID NO: 115074 - DNA, 20 bp, human
gcccggagcccgagctgatc

SEQ ID NO: 115075 - DNA, 20 bp, human
ggagcgcccggggatgcggg

SEQ ID NO: 115076 - DNA, 20 bp, human
gactcggggccttcacactc

SEQ ID NO: 115077 - DNA, 20 bp, human
gtcctgtccggtaacccaag

SEQ ID NO: 115078 - DNA, 20 bp, human
gggaagtacgacaccggaag

SEQ ID NO: 115079 - DNA, 20 bp, human
gcgctcaggaagtacgacac

SEQ ID NO: 115080 - DNA, 20 bp, human
gtaggaaagtggaacgtcta

SEQ ID NO: 115081 - DNA, 20 bp, human
ggtgtgaaggccccgagtct

SEQ ID NO: 115082 - DNA, 20 bp, human
gaagtgagtagtgtcgcctc

SEQ ID NO: 115083 - DNA, 20 bp, human
gcgtgactaatttattccag

SEQ ID NO: 115084 - DNA, 20 bp, human
ggcggctggaggcaaactgt

SEQ ID NO: 115085 - DNA, 20 bp, human
ggacaggaacggtaactcta

SEQ ID NO: 115086 - DNA, 20 bp, human
gccgcgggagtgctcggcag

SEQ ID NO: 115087 - DNA, 20 bp, human
gcgtcgggcccgcaccccat

SEQ ID NO: 115088 - DNA, 20 bp, human
ggctcaacacccacccgatg

SEQ ID NO: 115089 - DNA, 20 bp, human
gaccagggcgcccaggacga

SEQ ID NO: 115090 - DNA, 20 bp, human
ggcagcgcgcgcggctcgac

SEQ ID NO: 115091 - DNA, 20 bp, human
ggcccgcccgcgggagtgct

SEQ ID NO: 115092 - DNA, 20 bp, human
gcgactagcgggctgcggag

SEQ ID NO: 115093 - DNA, 20 bp, human
gctgcccggcaggtgaggac

SEQ ID NO: 115094 - DNA, 20 bp, human
gggcccgcaccccatcgggt

SEQ ID NO: 115095 - DNA, 20 bp, human
gctgggtcgggggcgactag

SEQ ID NO: 115096 - DNA, 20 bp, human
ggagccggaggggagcgcag

SEQ ID NO: 115097 - DNA, 20 bp, human
gcccgagccgatcccgagag

SEQ ID NO: 115098 - DNA, 20 bp, human
ggctgcgcccctctcgggat

SEQ ID NO: 115099 - DNA, 20 bp, human
gagagagcgctgggagccgg

SEQ ID NO: 115100 - DNA, 20 bp, human
gcaagtgagggagagcgaat

SEQ ID NO: 115101 - DNA, 20 bp, human
gggaggacgagtcggaccga

SEQ ID NO: 115102 - DNA, 20 bp, human
gtagccctcgagctagaccc

SEQ ID NO: 115103 - DNA, 20 bp, human
gcggcacagcagagagcgct

SEQ ID NO: 115104 - DNA, 20 bp, human
gtgagagcagctcggcgctc

SEQ ID NO: 115105 - DNA, 20 bp, human
gctgaggtgagcgccgagta

SEQ ID NO: 115106 - DNA, 20 bp, human
ggcgcagaggcgactctcca

SEQ ID NO: 115107 - DNA, 20 bp, human
ggtggagatgagggcaagac

SEQ ID NO: 115108 - DNA, 20 bp, human
gcagaggcgactctccaggg

SEQ ID NO: 115109 - DNA, 20 bp, human
gtagggttcccggagcgcag

SEQ ID NO: 115110 - DNA, 20 bp, human
ggaccacgaaggagggtcta

SEQ ID NO: 115111 - DNA, 20 bp, human
gcctcaggtaccgcaggggg

SEQ ID NO: 115112 - DNA, 20 bp, human
gatgccgggaccacgaagga

SEQ ID NO: 115113 - DNA, 20 bp, human
gtccgctttgcggactgatg

SEQ ID NO: 115114 - DNA, 20 bp, human
gcgcgggaggcgggcgatgg

SEQ ID NO: 115115 - DNA, 20 bp, human
gtctgatgccgggaccacga

SEQ ID NO: 115116 - DNA, 20 bp, human
ggagcacggaaagggccggg

SEQ ID NO: 115117 - DNA, 20 bp, human
gcattcggcccggggaaaag

SEQ ID NO: 115118 - DNA, 20 bp, human
gcgggctcggagcacggaaa

SEQ ID NO: 115119 - DNA, 20 bp, human
ggccccggccatgccagcag

SEQ ID NO: 115120 - DNA, 20 bp, human
gtgcagtcgagccggggtgg

SEQ ID NO: 115121 - DNA, 20 bp, human
gctcggagcacggaaagggc

SEQ ID NO: 115122 - DNA, 20 bp, human
gacctgcagtcgagccgggg

SEQ ID NO: 115123 - DNA, 20 bp, human
gcagacctgcagtcgagccg

SEQ ID NO: 115124 - DNA, 20 bp, human
ggcggggcgctggcagcgag

SEQ ID NO: 115125 - DNA, 20 bp, human
gggagcccgggctcggagca

SEQ ID NO: 115126 - DNA, 20 bp, human
gtgaggcgcctgctcagtgt

SEQ ID NO: 115127 - DNA, 20 bp, human
gcgctggcgctcaagcatgg

SEQ ID NO: 115128 - DNA, 20 bp, human
gtggcgctcaagcatggcgg

SEQ ID NO: 115129 - DNA, 20 bp, human
gcgttaaacgacgagaagag

SEQ ID NO: 115130 - DNA, 20 bp, human
gcggcattgggcagctcctc

SEQ ID NO: 115131 - DNA, 20 bp, human
ggcatggcggcggcggcatt

SEQ ID NO: 115132 - DNA, 20 bp, human
gtgcgggtgaactggagtcc

SEQ ID NO: 115133 - DNA, 20 bp, human
ggagctctgccagaacaccc

SEQ ID NO: 115134 - DNA, 20 bp, human
ggtccggcctgagcttcaga

SEQ ID NO: 115135 - DNA, 20 bp, human
gctcagatatcgggacacaa

SEQ ID NO: 115136 - DNA, 20 bp, human
ggcgaacccacagcgagtga

SEQ ID NO: 115137 - DNA, 20 bp, human
gaacccacagcgagtgacgg

SEQ ID NO: 115138 - DNA, 20 bp, human
ggtcggctacgaaacagcag

SEQ ID NO: 115139 - DNA, 20 bp, human
gagggccgctgcgcaagcag

SEQ ID NO: 115140 - DNA, 20 bp, human
gggaagtagccgggtaagac

SEQ ID NO: 115141 - DNA, 20 bp, human
gaggacacccggcgccaagg

SEQ ID NO: 115142 - DNA, 20 bp, human
gcaagcagcggcaggacacc

SEQ ID NO: 115143 - DNA, 20 bp, human
gcgactgggagccggaggaa

SEQ ID NO: 115144 - DNA, 20 bp, human
ggacgctgcgcccctaacaa

SEQ ID NO: 115145 - DNA, 20 bp, human
ggcgccgccgtcactcgctg

SEQ ID NO: 115146 - DNA, 20 bp, human
gtgcgtgcggctaagagagt

SEQ ID NO: 115147 - DNA, 20 bp, human
gccgaaaggcctagagtaag

SEQ ID NO: 115148 - DNA, 20 bp, human
gcccgctcgcgcaaaccgaa

SEQ ID NO: 115149 - DNA, 20 bp, human
gcaacaaagccggccaccag

SEQ ID NO: 115150 - DNA, 20 bp, human
ggaaagcggcctcttactct

SEQ ID NO: 115151 - DNA, 20 bp, human
gcagtgctgtagaaatggga

SEQ ID NO: 115152 - DNA, 20 bp, human
gatggttgtggtgggaccta

SEQ ID NO: 115153 - DNA, 20 bp, human
gctgcccggcgtggatggta

SEQ ID NO: 115154 - DNA, 20 bp, human
gctgggacagcgcgaaccct

SEQ ID NO: 115155 - DNA, 20 bp, human
ggggcaggaaagcgtgcgtg

SEQ ID NO: 115156 - DNA, 20 bp, human
ggctccagggcagataagag

SEQ ID NO: 115157 - DNA, 20 bp, human
gtccagggtccaaggatcag

SEQ ID NO: 115158 - DNA, 20 bp, human
gagagggacacgcggagaca

SEQ ID NO: 115159 - DNA, 20 bp, human
gaacccaactgaggatagat

SEQ ID NO: 115160 - DNA, 20 bp, human
gtaggcacaaagagtcgaag

SEQ ID NO: 115161 - DNA, 20 bp, human
gcctagaaggaccctgtcag

SEQ ID NO: 115162 - DNA, 20 bp, human
gagtggagaagagggacacg

SEQ ID NO: 115163 - DNA, 20 bp, human
gtccaagccggcaggacaag

SEQ ID NO: 115164 - DNA, 20 bp, human
ggccagccctaacccaactg

SEQ ID NO: 115165 - DNA, 20 bp, human
gtgagcacccagaggagact

SEQ ID NO: 115166 - DNA, 20 bp, human
ggccgtattaaggaaaagaa

SEQ ID NO: 115167 - DNA, 20 bp, human
gagaggcagagatgcgtgtg

SEQ ID NO: 115168 - DNA, 20 bp, human
gtcctggagtaacagtgaca

SEQ ID NO: 115169 - DNA, 20 bp, human
gagcagagaaagacgggaag

SEQ ID NO: 115170 - DNA, 20 bp, human
ggaaaggcatacgataggag

SEQ ID NO: 115171 - DNA, 20 bp, human
gatactgtaactaggagcta

SEQ ID NO: 115172 - DNA, 20 bp, human
gatctccaggctgaatcaat

SEQ ID NO: 115173 - DNA, 20 bp, human
gggctgaatcaattggtacc

SEQ ID NO: 115174 - DNA, 20 bp, human
ggtgaaaagtgaacgtctcc

SEQ ID NO: 115175 - DNA, 20 bp, human
gacaacatacaagtaagtga

SEQ ID NO: 115176 - DNA, 20 bp, human
gccagccgccgaaggtgtgg

SEQ ID NO: 115177 - DNA, 20 bp, human
gctgcagaatgggcactcga

SEQ ID NO: 115178 - DNA, 20 bp, human
gggaccctggtcaaccccac

SEQ ID NO: 115179 - DNA, 20 bp, human
gaaggtgtggtggcaggtga

SEQ ID NO: 115180 - DNA, 20 bp, human
ggacaaagcgccagtccggt

SEQ ID NO: 115181 - DNA, 20 bp, human
gcctgccaccacaccttcgg

SEQ ID NO: 115182 - DNA, 20 bp, human
gtgagcccaggagctctatg

SEQ ID NO: 115183 - DNA, 20 bp, human
gggcgtcagtgacaaccaca

SEQ ID NO: 115184 - DNA, 20 bp, human
gcccccagccgccgaaggtg

SEQ ID NO: 115185 - DNA, 20 bp, human
ggtgaccgagagcgtcgctg

SEQ ID NO: 115186 - DNA, 20 bp, human
gccaaatcggcgcagttccc

SEQ ID NO: 115187 - DNA, 20 bp, human
gttccgccgggctcccgatg

SEQ ID NO: 115188 - DNA, 20 bp, human
gcggcgtggggaccgaaaag

SEQ ID NO: 115189 - DNA, 20 bp, human
gcgggagcccggcggaaaca

SEQ ID NO: 115190 - DNA, 20 bp, human
gggcgccgtccccgaggaag

SEQ ID NO: 115191 - DNA, 20 bp, human
ggtgccagggaaacccccgt

SEQ ID NO: 115192 - DNA, 20 bp, human
gcagtacccgagtttccgga

SEQ ID NO: 115193 - DNA, 20 bp, human
gcaatgtccaggctcggctg

SEQ ID NO: 115194 - DNA, 20 bp, human
gccactccccggggcgccag

SEQ ID NO: 115195 - DNA, 20 bp, human
gggcgaagggccactccccg

SEQ ID NO: 115196 - DNA, 20 bp, human
ggtggcgacgcctcccaaca

SEQ ID NO: 115197 - DNA, 20 bp, human
gcccgaagcacctgacatga

SEQ ID NO: 115198 - DNA, 20 bp, human
gggaggcgtcgccacggtcg

SEQ ID NO: 115199 - DNA, 20 bp, human
ggaagcacctgacatgaggg

SEQ ID NO: 115200 - DNA, 20 bp, human
gggtggccactgaaagtcag

SEQ ID NO: 115201 - DNA, 20 bp, human
ggggtccccgccctcatgtc

SEQ ID NO: 115202 - DNA, 20 bp, human
gtgcgggtagccctgttggg

SEQ ID NO: 115203 - DNA, 20 bp, human
gagctcgtgcatccagggag

SEQ ID NO: 115204 - DNA, 20 bp, human
gagggtccgcaggtgtctgg

SEQ ID NO: 115205 - DNA, 20 bp, human
gggcgggaaagggtggtcac

SEQ ID NO: 115206 - DNA, 20 bp, human
gagcagggcccagcgagaca

SEQ ID NO: 115207 - DNA, 20 bp, human
gcccaccgagagaggccggg

SEQ ID NO: 115208 - DNA, 20 bp, human
gctcgctgggccctgcttcg

SEQ ID NO: 115209 - DNA, 20 bp, human
gcccaggcacctagacacta

SEQ ID NO: 115210 - DNA, 20 bp, human
ggccacccagccccgaagca

SEQ ID NO: 115211 - DNA, 20 bp, human
gacctgggccctgtctcgct

SEQ ID NO: 115212 - DNA, 20 bp, human
gttctagtttccaacaacag

SEQ ID NO: 115213 - DNA, 20 bp, human
gccgtagaaaggggttccac

SEQ ID NO: 115214 - DNA, 20 bp, human
ggtagaccctcaggaccagg

SEQ ID NO: 115215 - DNA, 20 bp, human
gcggcctcataggaagaaac

SEQ ID NO: 115216 - DNA, 20 bp, human
gaactacggagagcggagag

SEQ ID NO: 115217 - DNA, 20 bp, human
gccagggaggcgagcccacg

SEQ ID NO: 115218 - DNA, 20 bp, human
ggaagtgatgcctaaagctg

SEQ ID NO: 115219 - DNA, 20 bp, human
gccacgcggtccacagcttt

SEQ ID NO: 115220 - DNA, 20 bp, human
gtctcgcgcagctgatgacc

SEQ ID NO: 115221 - DNA, 20 bp, human
ggctgcaacgacagaagagt

SEQ ID NO: 115222 - DNA, 20 bp, human
gcctgattggccgtgttgta

SEQ ID NO: 115223 - DNA, 20 bp, human
ggagaagccgccgtacaaca

SEQ ID NO: 115224 - DNA, 20 bp, human
ggattggccgtgttgtacgg

SEQ ID NO: 115225 - DNA, 20 bp, human
gtagtaggcgcgcagtaaaa

SEQ ID NO: 115226 - DNA, 20 bp, human
gccggcgcacgcactcacca

SEQ ID NO: 115227 - DNA, 20 bp, human
gccgggaagcgggagactca

SEQ ID NO: 115228 - DNA, 20 bp, human
ggaaagagaccaacccacgt

SEQ ID NO: 115229 - DNA, 20 bp, human
gaccatggctgcggttccgc

SEQ ID NO: 115230 - DNA, 20 bp, human
gcacagctgcggggatccta

SEQ ID NO: 115231 - DNA, 20 bp, human
ggtgggagagggcaaaaagt

SEQ ID NO: 115232 - DNA, 20 bp, human
gacgtcagctgcgctcccct

SEQ ID NO: 115233 - DNA, 20 bp, human
gtcctgaaccccagcaacgg

SEQ ID NO: 115234 - DNA, 20 bp, human
ggcccgcggaaccgcagcca

SEQ ID NO: 115235 - DNA, 20 bp, human
ggaggttgatccgaatccca

SEQ ID NO: 115236 - DNA, 20 bp, human
ggcgcaatcgctccccggag

SEQ ID NO: 115237 - DNA, 20 bp, human
gcagccagggagagagatcc

SEQ ID NO: 115238 - DNA, 20 bp, human
ggccccctccctgctcaggt

SEQ ID NO: 115239 - DNA, 20 bp, human
gtggcagtccggatacgcag

SEQ ID NO: 115240 - DNA, 20 bp, human
gggcatcccgcgcagccagg

SEQ ID NO: 115241 - DNA, 20 bp, human
gtgagccagtcgaccctggt

SEQ ID NO: 115242 - DNA, 20 bp, human
ggtccggcaaaagcgcgatc

SEQ ID NO: 115243 - DNA, 20 bp, human
gcccgggcgcaatcgctccc

SEQ ID NO: 115244 - DNA, 20 bp, human
gcagggaacggtgcacccaa

SEQ ID NO: 115245 - DNA, 20 bp, human
gcctcagtttgaaagtaccc

SEQ ID NO: 115246 - DNA, 20 bp, human
gtctaaggatatgagaccgg

SEQ ID NO: 115247 - DNA, 20 bp, human
gcagcctgggcagatgtcta

SEQ ID NO: 115248 - DNA, 20 bp, human
ggcccaggctgatgtaactg

SEQ ID NO: 115249 - DNA, 20 bp, human
gctagagttacaaaagtctg

SEQ ID NO: 115250 - DNA, 20 bp, human
gacctcagttacatcagcct

SEQ ID NO: 115251 - DNA, 20 bp, human
gatgtctaaggatatgagac

SEQ ID NO: 115252 - DNA, 20 bp, human
ggagtgtgaaacagcgtaat

SEQ ID NO: 115253 - DNA, 20 bp, human
gagcttgccacctgcctact

SEQ ID NO: 115254 - DNA, 20 bp, human
gtatccttagacatctgccc

SEQ ID NO: 115255 - DNA, 20 bp, human
gctgaggtatttaaacaacc

SEQ ID NO: 115256 - DNA, 20 bp, human
gcagtgagcgctgaggaggt

SEQ ID NO: 115257 - DNA, 20 bp, human
gtctctggcagtgagcgctg

SEQ ID NO: 115258 - DNA, 20 bp, human
gctgcagcagttccatggag

SEQ ID NO: 115259 - DNA, 20 bp, human
gggctggccgccccgctctc

SEQ ID NO: 115260 - DNA, 20 bp, human
gacattctgcagcagttcca

SEQ ID NO: 115261 - DNA, 20 bp, human
gtgttcatgtaagggttaga

SEQ ID NO: 115262 - DNA, 20 bp, human
ggcgctcactgccagagagc

SEQ ID NO: 115263 - DNA, 20 bp, human
ggtagagaaattttcatgta

SEQ ID NO: 115264 - DNA, 20 bp, human
ggacttcgtgtccatttggg

SEQ ID NO: 115265 - DNA, 20 bp, human
gtgggtggcaaagttctact

SEQ ID NO: 115266 - DNA, 20 bp, human
gtagagcgccggctcccccg

SEQ ID NO: 115267 - DNA, 20 bp, human
gtctgctcgaggacctcgag

SEQ ID NO: 115268 - DNA, 20 bp, human
gtgcgggcgccaaagacgac

SEQ ID NO: 115269 - DNA, 20 bp, human
gccaaagacgacgggcgggt

SEQ ID NO: 115270 - DNA, 20 bp, human
ggacctctgtggccactcgt

SEQ ID NO: 115271 - DNA, 20 bp, human
gcccggcgaagcagagtcag

SEQ ID NO: 115272 - DNA, 20 bp, human
gcggcgagtgtgcagccccg

SEQ ID NO: 115273 - DNA, 20 bp, human
gccggtacaggctgtctgtg

SEQ ID NO: 115274 - DNA, 20 bp, human
gggcagctcgccgacctctg

SEQ ID NO: 115275 - DNA, 20 bp, human
gggcgggtaggcgggctgac

SEQ ID NO: 115276 - DNA, 20 bp, human
ggcatgcaggtggcgagagt

SEQ ID NO: 115277 - DNA, 20 bp, human
gccagcgctgtcctggatgt

SEQ ID NO: 115278 - DNA, 20 bp, human
gcggctgaggatgccgggaa

SEQ ID NO: 115279 - DNA, 20 bp, human
gcggcggttgcacttagttg

SEQ ID NO: 115280 - DNA, 20 bp, human
gcaggcttgctcacctcgaa

SEQ ID NO: 115281 - DNA, 20 bp, human
gcgcgaccgaggctcccggg

SEQ ID NO: 115282 - DNA, 20 bp, human
gctcgaagggagcgacgctg

SEQ ID NO: 115283 - DNA, 20 bp, human
gaggctcggctgaggatgcc

SEQ ID NO: 115284 - DNA, 20 bp, human
gaacgaccgagattccaggt

SEQ ID NO: 115285 - DNA, 20 bp, human
gagcctggtgggcgcgaccg

SEQ ID NO: 115286 - DNA, 20 bp, human
gccgcagttcgggaacatgt

SEQ ID NO: 115287 - DNA, 20 bp, human
gcggatagcagggaccgggt

SEQ ID NO: 115288 - DNA, 20 bp, human
ggcctcgagcagccggatcc

SEQ ID NO: 115289 - DNA, 20 bp, human
gacgtgagtgagccccggga

SEQ ID NO: 115290 - DNA, 20 bp, human
ggcctctgcagggtccgcga

SEQ ID NO: 115291 - DNA, 20 bp, human
ggaagctccgcggggtccat

SEQ ID NO: 115292 - DNA, 20 bp, human
ggtccctgctatccgaagag

SEQ ID NO: 115293 - DNA, 20 bp, human
gccggcacccatggaccccg

SEQ ID NO: 115294 - DNA, 20 bp, human
gcgggtcgggaagaccttcg

SEQ ID NO: 115295 - DNA, 20 bp, human
ggaccccgcgacccgctctt

SEQ ID NO: 115296 - DNA, 20 bp, human
gctggcgcggcgcggagagt

SEQ ID NO: 115297 - DNA, 20 bp, human
gcggccgagcgagcatggag

SEQ ID NO: 115298 - DNA, 20 bp, human
gcgggaaaagtgccaggagg

SEQ ID NO: 115299 - DNA, 20 bp, human
gcggcccgcaacattagcaa

SEQ ID NO: 115300 - DNA, 20 bp, human
gggattcgccagcttcacca

SEQ ID NO: 115301 - DNA, 20 bp, human
gtggccgggtaccaccgcaa

SEQ ID NO: 115302 - DNA, 20 bp, human
gcaggcgcccgcggagatcc

SEQ ID NO: 115303 - DNA, 20 bp, human
gggcgggacgcgttgtgcag

SEQ ID NO: 115304 - DNA, 20 bp, human
gcggaaaccctgcctccaga

SEQ ID NO: 115305 - DNA, 20 bp, human
gtctgtttcctcccctctgg

SEQ ID NO: 115306 - DNA, 20 bp, human
gtccgggactggtgagtagt

SEQ ID NO: 115307 - DNA, 20 bp, human
gaggtcacaactacactcgc

SEQ ID NO: 115308 - DNA, 20 bp, human
gcaaccggcacctaccgcga

SEQ ID NO: 115309 - DNA, 20 bp, human
gtagttgtgaccttcgcggt

SEQ ID NO: 115310 - DNA, 20 bp, human
gaatcacagccggccccaac

SEQ ID NO: 115311 - DNA, 20 bp, human
gtcctggaaaaggcctgaag

SEQ ID NO: 115312 - DNA, 20 bp, human
gctgaagtggcactgaaatg

SEQ ID NO: 115313 - DNA, 20 bp, human
gtgaccttcgcggtaggtgc

SEQ ID NO: 115314 - DNA, 20 bp, human
gacagtgcttactctaggac

SEQ ID NO: 115315 - DNA, 20 bp, human
gcagcgcactagtgggacag

SEQ ID NO: 115316 - DNA, 20 bp, human
gaggctcccggagctgtcag

SEQ ID NO: 115317 - DNA, 20 bp, human
gggagcctcaagcgcgacag

SEQ ID NO: 115318 - DNA, 20 bp, human
gtgggcgccgcacatgacac

SEQ ID NO: 115319 - DNA, 20 bp, human
gcacgcgcgcacatagacat

SEQ ID NO: 115320 - DNA, 20 bp, human
gcaggggcggccgacctgac

SEQ ID NO: 115321 - DNA, 20 bp, human
gctcccggagctgtcagggg

SEQ ID NO: 115322 - DNA, 20 bp, human
gtcggtgtgtggatgtcccg

SEQ ID NO: 115323 - DNA, 20 bp, human
gcctctggagcaggagcggt

SEQ ID NO: 115324 - DNA, 20 bp, human
ggacagcggcgccctcacct

SEQ ID NO: 115325 - DNA, 20 bp, human
gccacttcgcagacaccccg

SEQ ID NO: 115326 - DNA, 20 bp, human
gcggcgtccagagctccggg

SEQ ID NO: 115327 - DNA, 20 bp, human
gacaaaagcgcggctctcgg

SEQ ID NO: 115328 - DNA, 20 bp, human
gggagagaccgacagaaggt

SEQ ID NO: 115329 - DNA, 20 bp, human
gtctggacgccggggaggaa

SEQ ID NO: 115330 - DNA, 20 bp, human
gtccccggcgtccagagctc

SEQ ID NO: 115331 - DNA, 20 bp, human
gtgagagcccggagcgaact

SEQ ID NO: 115332 - DNA, 20 bp, human
gctcagacagcccattgtgt

SEQ ID NO: 115333 - DNA, 20 bp, human
ggacagaaggtaggcgaggg

SEQ ID NO: 115334 - DNA, 20 bp, human
gtgggcaccggatcactcgg

SEQ ID NO: 115335 - DNA, 20 bp, human
ggcgctgcctgcccacacaa

SEQ ID NO: 115336 - DNA, 20 bp, human
ggctcaggcccggatcctgg

SEQ ID NO: 115337 - DNA, 20 bp, human
gggttcccgagtccatggtg

SEQ ID NO: 115338 - DNA, 20 bp, human
ggcggccgcaccatggactc

SEQ ID NO: 115339 - DNA, 20 bp, human
gccgaggagtacgagctcaa

SEQ ID NO: 115340 - DNA, 20 bp, human
gaggagtacgagctcaacgg

SEQ ID NO: 115341 - DNA, 20 bp, human
ggcccaggccgccaggatcc

SEQ ID NO: 115342 - DNA, 20 bp, human
gggcgaggctgaagttagag

SEQ ID NO: 115343 - DNA, 20 bp, human
gcgcgctcaggcccggatcc

SEQ ID NO: 115344 - DNA, 20 bp, human
gagaggcccgcgcgagagtg

SEQ ID NO: 115345 - DNA, 20 bp, human
ggcgcgggcgctgcttagtg

SEQ ID NO: 115346 - DNA, 20 bp, human
ggcgttgtacggccaccgag

SEQ ID NO: 115347 - DNA, 20 bp, human
ggcgctgtgggccagaagaa

SEQ ID NO: 115348 - DNA, 20 bp, human
gcgacgcggctcacaaacta

SEQ ID NO: 115349 - DNA, 20 bp, human
gctgctggaggcttgggcag

SEQ ID NO: 115350 - DNA, 20 bp, human
gggagagatgaagcgttgta

SEQ ID NO: 115351 - DNA, 20 bp, human
gttgcaaagcagccgctcgg

SEQ ID NO: 115352 - DNA, 20 bp, human
gcggctcacaaactagggag

SEQ ID NO: 115353 - DNA, 20 bp, human
gctcctgtcctgccctccgg

SEQ ID NO: 115354 - DNA, 20 bp, human
ggtgctcctggagccctcgg

SEQ ID NO: 115355 - DNA, 20 bp, human
gagacagccgcgccgccgga

SEQ ID NO: 115356 - DNA, 20 bp, human
gcggcacccggtgcgtgtga

SEQ ID NO: 115357 - DNA, 20 bp, human
gagaagtctctactgtcctg

SEQ ID NO: 115358 - DNA, 20 bp, human
gctcagacggcggagcctgg

SEQ ID NO: 115359 - DNA, 20 bp, human
gagactgcgtgggctcctcc

SEQ ID NO: 115360 - DNA, 20 bp, human
gagagagcagaggggagacc

SEQ ID NO: 115361 - DNA, 20 bp, human
gcaagtcccttcacacgcac

SEQ ID NO: 115362 - DNA, 20 bp, human
gccagagagaacttacttga

SEQ ID NO: 115363 - DNA, 20 bp, human
gagcccacgcagtctgttcc

SEQ ID NO: 115364 - DNA, 20 bp, human
gacttctcttagagctgccg

SEQ ID NO: 115365 - DNA, 20 bp, human
ggagtaagaagagaacgggg

SEQ ID NO: 115366 - DNA, 20 bp, human
gggcctccagacacaaagag

SEQ ID NO: 115367 - DNA, 20 bp, human
gagagcggccggcggtacgg

SEQ ID NO: 115368 - DNA, 20 bp, human
gagacacaaagagcggccgg

SEQ ID NO: 115369 - DNA, 20 bp, human
gcaaagagcggccggcggta

SEQ ID NO: 115370 - DNA, 20 bp, human
gcccaaggctcggcctgagg

SEQ ID NO: 115371 - DNA, 20 bp, human
gggcaccacccccgtaccgc

SEQ ID NO: 115372 - DNA, 20 bp, human
gcggcctcgggtgctcctcg

SEQ ID NO: 115373 - DNA, 20 bp, human
gcgtagctcattaccacggg

SEQ ID NO: 115374 - DNA, 20 bp, human
ggcaccgcgaggagcacccg

SEQ ID NO: 115375 - DNA, 20 bp, human
ggagccgggtctggtgacta

SEQ ID NO: 115376 - DNA, 20 bp, human
gaccgcggcgactatcccat

SEQ ID NO: 115377 - DNA, 20 bp, human
gtgtggccgtggctaccgat

SEQ ID NO: 115378 - DNA, 20 bp, human
gggatccggtgttccaaccc

SEQ ID NO: 115379 - DNA, 20 bp, human
gtccggtgttccaacccagg

SEQ ID NO: 115380 - DNA, 20 bp, human
gttaccaaggcacgaggatc

SEQ ID NO: 115381 - DNA, 20 bp, human
gctcactaaaagggtaaagg

SEQ ID NO: 115382 - DNA, 20 bp, human
ggcaaggttgcggatgaagg

SEQ ID NO: 115383 - DNA, 20 bp, human
gggtaactggaaacggaagt

SEQ ID NO: 115384 - DNA, 20 bp, human
ggcggatgaaggaggctcgt

SEQ ID NO: 115385 - DNA, 20 bp, human
gcaatgctgagggcaaaaag

SEQ ID NO: 115386 - DNA, 20 bp, human
gggagcggcccaggaatcac

SEQ ID NO: 115387 - DNA, 20 bp, human
gcccgagcgccaggacgcgg

SEQ ID NO: 115388 - DNA, 20 bp, human
gcccaggccgagcgacacgg

SEQ ID NO: 115389 - DNA, 20 bp, human
gcgtgccaagcggcgaggta

SEQ ID NO: 115390 - DNA, 20 bp, human
gacgcccaggccgagcgaca

SEQ ID NO: 115391 - DNA, 20 bp, human
gggcgaagcgccggacgctc

SEQ ID NO: 115392 - DNA, 20 bp, human
gcaggacgcggcggcagcct

SEQ ID NO: 115393 - DNA, 20 bp, human
gcgagggaaaaagtcagccg

SEQ ID NO: 115394 - DNA, 20 bp, human
gtgagaacggagaaaagccg

SEQ ID NO: 115395 - DNA, 20 bp, human
gcgttcgtgctacagaagaa

SEQ ID NO: 115396 - DNA, 20 bp, human
gacctgccaaggacaacctc

SEQ ID NO: 115397 - DNA, 20 bp, human
gaggcttccgtgggactgaa

SEQ ID NO: 115398 - DNA, 20 bp, human
gcaacgagccaggcttccgt

SEQ ID NO: 115399 - DNA, 20 bp, human
gcggtgccggaggttgtcct

SEQ ID NO: 115400 - DNA, 20 bp, human
gggccggcgccggaaaacct

SEQ ID NO: 115401 - DNA, 20 bp, human
gccggcagcggtggtgacgg

SEQ ID NO: 115402 - DNA, 20 bp, human
gcggcaatccgattcacggt

SEQ ID NO: 115403 - DNA, 20 bp, human
ggccgtgcgagcgcaggact

SEQ ID NO: 115404 - DNA, 20 bp, human
ggtcccggcagcggtggtga

SEQ ID NO: 115405 - DNA, 20 bp, human
gcggccggccgactagggtg

SEQ ID NO: 115406 - DNA, 20 bp, human
gtcggccgcagactctggaa

SEQ ID NO: 115407 - DNA, 20 bp, human
gtgacgtcggccgcagactc

SEQ ID NO: 115408 - DNA, 20 bp, human
ggcggccgacgtcacccggt

SEQ ID NO: 115409 - DNA, 20 bp, human
ggagcgggcttccggaacgc

SEQ ID NO: 115410 - DNA, 20 bp, human
ggccgcgggtgcgtgtggag

SEQ ID NO: 115411 - DNA, 20 bp, human
ggcccccatggccccgggag

SEQ ID NO: 115412 - DNA, 20 bp, human
gctgtgctggaaaacctgag

SEQ ID NO: 115413 - DNA, 20 bp, human
ggtgtgggacggggaaactc

SEQ ID NO: 115414 - DNA, 20 bp, human
gttgcggagactggaaaggg

SEQ ID NO: 115415 - DNA, 20 bp, human
ggggaaactcaggatgctat

SEQ ID NO: 115416 - DNA, 20 bp, human
gccgggcaccgagcaggaag

SEQ ID NO: 115417 - DNA, 20 bp, human
ggcctcctcgcggtgcaaca

SEQ ID NO: 115418 - DNA, 20 bp, human
gcggaggtcccaggaacggg

SEQ ID NO: 115419 - DNA, 20 bp, human
gtaccgcaggaaccaggtaa

SEQ ID NO: 115420 - DNA, 20 bp, human
gtcctcgcggtgcaacaggg

SEQ ID NO: 115421 - DNA, 20 bp, human
gcgccgggagcgagacctca

SEQ ID NO: 115422 - DNA, 20 bp, human
gaggcgggatcgggacccgg

SEQ ID NO: 115423 - DNA, 20 bp, human
gacccggaggtcccaggaac

SEQ ID NO: 115424 - DNA, 20 bp, human
gacacccggcctctccgagt

SEQ ID NO: 115425 - DNA, 20 bp, human
gaggtcaaggccgaagacct

SEQ ID NO: 115426 - DNA, 20 bp, human
ggactcttcgtgcaacccgg

SEQ ID NO: 115427 - DNA, 20 bp, human
gagcggctcgggcttcctgg

SEQ ID NO: 115428 - DNA, 20 bp, human
gcgagccgctcggcacgaag

SEQ ID NO: 115429 - DNA, 20 bp, human
gaccggcggcgtctcctcta

SEQ ID NO: 115430 - DNA, 20 bp, human
gtggcagctctgaattggga

SEQ ID NO: 115431 - DNA, 20 bp, human
gaagcccgcttctggaacag

SEQ ID NO: 115432 - DNA, 20 bp, human
gtcgaggccaagaggagcgg

SEQ ID NO: 115433 - DNA, 20 bp, human
gaaggcaacgggacccaggt

SEQ ID NO: 115434 - DNA, 20 bp, human
gaggaagggtatgtacacta

SEQ ID NO: 115435 - DNA, 20 bp, human
gtcggactcttcgtgcaacc

SEQ ID NO: 115436 - DNA, 20 bp, human
gtcgcgcgcgagccacgcgg

SEQ ID NO: 115437 - DNA, 20 bp, human
gtccccagctccggagcagg

SEQ ID NO: 115438 - DNA, 20 bp, human
gccacgcgggggacaagtcg

SEQ ID NO: 115439 - DNA, 20 bp, human
gccctgggtccggaccccgg

SEQ ID NO: 115440 - DNA, 20 bp, human
gctgggaggagaggatgcga

SEQ ID NO: 115441 - DNA, 20 bp, human
gaagtcgcggccacctgctc

SEQ ID NO: 115442 - DNA, 20 bp, human
gcacccctgggtccggaccc

SEQ ID NO: 115443 - DNA, 20 bp, human
gggcacacgaaccgacgcgc

SEQ ID NO: 115444 - DNA, 20 bp, human
gaccccccatctcaacccag

SEQ ID NO: 115445 - DNA, 20 bp, human
gggctccccagctccggagc

SEQ ID NO: 115446 - DNA, 20 bp, human
gcgcctgtggaagagacctg

SEQ ID NO: 115447 - DNA, 20 bp, human
gggccccaggtctcttccac

SEQ ID NO: 115448 - DNA, 20 bp, human
gacaccaccaagccgcaggg

SEQ ID NO: 115449 - DNA, 20 bp, human
ggtgagtcggtaccgacgga

SEQ ID NO: 115450 - DNA, 20 bp, human
gagagttcgctcctctctgg

SEQ ID NO: 115451 - DNA, 20 bp, human
gcgggaaccaattctcctgt

SEQ ID NO: 115452 - DNA, 20 bp, human
gggccgctaaggaaacggcg

SEQ ID NO: 115453 - DNA, 20 bp, human
gaagagacctggggccgcta

SEQ ID NO: 115454 - DNA, 20 bp, human
gcctggggccgctaaggaaa

SEQ ID NO: 115455 - DNA, 20 bp, human
gtcggtaccgacggagggag

SEQ ID NO: 115456 - DNA, 20 bp, human
gcacagccgcggagccatgt

SEQ ID NO: 115457 - DNA, 20 bp, human
gagccatgttggagccgcaa

SEQ ID NO: 115458 - DNA, 20 bp, human
gcggctccaacatggctccg

SEQ ID NO: 115459 - DNA, 20 bp, human
gggaggagtggcccattccc

SEQ ID NO: 115460 - DNA, 20 bp, human
gcagagatgctgcacagccg

SEQ ID NO: 115461 - DNA, 20 bp, human
ggccagggactgggtcgtgg

SEQ ID NO: 115462 - DNA, 20 bp, human
gctccgccaccagggcttgg

SEQ ID NO: 115463 - DNA, 20 bp, human
gcatctctgtgacggcgcgg

SEQ ID NO: 115464 - DNA, 20 bp, human
gcacaagctacgcctgggaa

SEQ ID NO: 115465 - DNA, 20 bp, human
gtaaatcacaagctacgcct

SEQ ID NO: 115466 - DNA, 20 bp, human
gccactcgggaaaccttcag

SEQ ID NO: 115467 - DNA, 20 bp, human
ggccatgggagtgtcccggt

SEQ ID NO: 115468 - DNA, 20 bp, human
ggtctcagaaaggacacggc

SEQ ID NO: 115469 - DNA, 20 bp, human
gccgcagccgcgacatagct

SEQ ID NO: 115470 - DNA, 20 bp, human
gacccaccgggacactccca

SEQ ID NO: 115471 - DNA, 20 bp, human
gcggcgccatgggagtgtcc

SEQ ID NO: 115472 - DNA, 20 bp, human
ggaggccagcgcccgagtca

SEQ ID NO: 115473 - DNA, 20 bp, human
gggagcggctcctggatcat

SEQ ID NO: 115474 - DNA, 20 bp, human
gccgagtcagggcgcttctg

SEQ ID NO: 115475 - DNA, 20 bp, human
gccccggaaccccaagacag

SEQ ID NO: 115476 - DNA, 20 bp, human
gtagaacttcggcggcggcg

SEQ ID NO: 115477 - DNA, 20 bp, human
gaagcgtgcgagccacgctc

SEQ ID NO: 115478 - DNA, 20 bp, human
gagaagtctcacaaaggact

SEQ ID NO: 115479 - DNA, 20 bp, human
ggtctcacaaaggactcggc

SEQ ID NO: 115480 - DNA, 20 bp, human
ggaccgcgttagaacttcgg

SEQ ID NO: 115481 - DNA, 20 bp, human
gcgtctggcgcgcaaggagg

SEQ ID NO: 115482 - DNA, 20 bp, human
gcttcagagaagtctcacaa

SEQ ID NO: 115483 - DNA, 20 bp, human
gctcagaagcggcctgacca

SEQ ID NO: 115484 - DNA, 20 bp, human
gcttcccgagtggaaaaaag

SEQ ID NO: 115485 - DNA, 20 bp, human
gagagaccgcgttagaactt

SEQ ID NO: 115486 - DNA, 20 bp, human
gggcggcggagacccgaaca

SEQ ID NO: 115487 - DNA, 20 bp, human
gagtcctagaggatctagag

SEQ ID NO: 115488 - DNA, 20 bp, human
gtcctcctggacccctgtaa

SEQ ID NO: 115489 - DNA, 20 bp, human
gggaggggggtgtctagatg

SEQ ID NO: 115490 - DNA, 20 bp, human
gcagaaagggaggctcgggt

SEQ ID NO: 115491 - DNA, 20 bp, human
gccccgaggagcgggtagaa

SEQ ID NO: 115492 - DNA, 20 bp, human
ggtccaggaggaaggcgatg

SEQ ID NO: 115493 - DNA, 20 bp, human
ggcgcaccttcgggcccgag

SEQ ID NO: 115494 - DNA, 20 bp, human
gaagggtacgcgatcagaaa

SEQ ID NO: 115495 - DNA, 20 bp, human
gggcctggaagaccgttaca

SEQ ID NO: 115496 - DNA, 20 bp, human
gtcgcagggtccgatccgga

SEQ ID NO: 115497 - DNA, 20 bp, human
gtccgatccggagggcggtc

SEQ ID NO: 115498 - DNA, 20 bp, human
gccattcgcagggtccgatc

SEQ ID NO: 115499 - DNA, 20 bp, human
gggccgacgggatagggagt

SEQ ID NO: 115500 - DNA, 20 bp, human
gtccagaccgccctccggat

SEQ ID NO: 115501 - DNA, 20 bp, human
gttcggagaggtagacgggt

SEQ ID NO: 115502 - DNA, 20 bp, human
ggggaaagccctgacatgta

SEQ ID NO: 115503 - DNA, 20 bp, human
gcagaagcgccgcagcgagt

SEQ ID NO: 115504 - DNA, 20 bp, human
gctggctccagaccgccctc

SEQ ID NO: 115505 - DNA, 20 bp, human
gccccttgcccaccagggag

SEQ ID NO: 115506 - DNA, 20 bp, human
ggggagacgaagaaccgcct

SEQ ID NO: 115507 - DNA, 20 bp, human
gccgcggcgtcgctacggtg

SEQ ID NO: 115508 - DNA, 20 bp, human
gtggagctggaaagtgagtg

SEQ ID NO: 115509 - DNA, 20 bp, human
ggctcagtccgcgccgcagg

SEQ ID NO: 115510 - DNA, 20 bp, human
ggcgcggccgcgccacttac

SEQ ID NO: 115511 - DNA, 20 bp, human
gaccaccgcggcccacaccg

SEQ ID NO: 115512 - DNA, 20 bp, human
gcagagtcatgacctgtaag

SEQ ID NO: 115513 - DNA, 20 bp, human
gacaagcaccacctgcggcg

SEQ ID NO: 115514 - DNA, 20 bp, human
gggtaggatccaactccctt

SEQ ID NO: 115515 - DNA, 20 bp, human
gccgtgcgcggccttccctg

SEQ ID NO: 115516 - DNA, 20 bp, human
gggagagcgagccccgagcg

SEQ ID NO: 115517 - DNA, 20 bp, human
gccgcggccgacgagagccc

SEQ ID NO: 115518 - DNA, 20 bp, human
gcagtcgcccgggctctcgt

SEQ ID NO: 115519 - DNA, 20 bp, human
gcaccctgccccgactgcct

SEQ ID NO: 115520 - DNA, 20 bp, human
gcgggagtgtccggtcccca

SEQ ID NO: 115521 - DNA, 20 bp, human
ggtcgcgtgcccaggcagtc

SEQ ID NO: 115522 - DNA, 20 bp, human
gggcggccgcggagcaagaa

SEQ ID NO: 115523 - DNA, 20 bp, human
gacggcccgctagacaaagg

SEQ ID NO: 115524 - DNA, 20 bp, human
gccgggcgactgccccagct

SEQ ID NO: 115525 - DNA, 20 bp, human
ggtcccagggcgtgcgggtg

SEQ ID NO: 115526 - DNA, 20 bp, human
gcaggggtctcggaaaccat

SEQ ID NO: 115527 - DNA, 20 bp, human
gcgtacaggttgttaaacag

SEQ ID NO: 115528 - DNA, 20 bp, human
gccgcgccgcgtcccagcag

SEQ ID NO: 115529 - DNA, 20 bp, human
gaggcgagcggcgcggagag

SEQ ID NO: 115530 - DNA, 20 bp, human
ggcactctggggtacaggag

SEQ ID NO: 115531 - DNA, 20 bp, human
gtggccgacgtgggacagtc

SEQ ID NO: 115532 - DNA, 20 bp, human
gttcagggagacgcactctg

SEQ ID NO: 115533 - DNA, 20 bp, human
ggacagtctggctgtggcag

SEQ ID NO: 115534 - DNA, 20 bp, human
ggctgctgcgcgcaatgatg

SEQ ID NO: 115535 - DNA, 20 bp, human
gctgccactgcaataaccca

SEQ ID NO: 115536 - DNA, 20 bp, human
gcccgccgggaaactaacaa

SEQ ID NO: 115537 - DNA, 20 bp, human
gccccagcgcatgggaccgg

SEQ ID NO: 115538 - DNA, 20 bp, human
gggactactccggagtcagg

SEQ ID NO: 115539 - DNA, 20 bp, human
gaccgcagagggagtcgcag

SEQ ID NO: 115540 - DNA, 20 bp, human
gggacccccgccagacgctc

SEQ ID NO: 115541 - DNA, 20 bp, human
gcggacgccgccggcaccat

SEQ ID NO: 115542 - DNA, 20 bp, human
gggagcagggacctgtcctg

SEQ ID NO: 115543 - DNA, 20 bp, human
gcgagccctggagccgcgag

SEQ ID NO: 115544 - DNA, 20 bp, human
ggcctctgcgactccctctg

SEQ ID NO: 115545 - DNA, 20 bp, human
ggagggcgcggtctcacccc

SEQ ID NO: 115546 - DNA, 20 bp, human
gctgtataggcgggcaccat

SEQ ID NO: 115547 - DNA, 20 bp, human
ggaggacgacgagcgcgcag

SEQ ID NO: 115548 - DNA, 20 bp, human
gcaccagctgaaaagcgcag

SEQ ID NO: 115549 - DNA, 20 bp, human
ggagacaggcgcgcacccgg

SEQ ID NO: 115550 - DNA, 20 bp, human
gctccaggaggctcgcggag

SEQ ID NO: 115551 - DNA, 20 bp, human
ggccgtgggtcgggcaccgg

SEQ ID NO: 115552 - DNA, 20 bp, human
gccgagcgcggggcacccgg

SEQ ID NO: 115553 - DNA, 20 bp, human
gccgcaggcgacgccacctt

SEQ ID NO: 115554 - DNA, 20 bp, human
gtgcggggcgtggggagtcg

SEQ ID NO: 115555 - DNA, 20 bp, human
gcagcgaacgggccccgggg

SEQ ID NO: 115556 - DNA, 20 bp, human
gggaccgcagctggtcgtag

SEQ ID NO: 115557 - DNA, 20 bp, human
gcagcgggcgacaggcaggg

SEQ ID NO: 115558 - DNA, 20 bp, human
ggactcgggtaggaggactg

SEQ ID NO: 115559 - DNA, 20 bp, human
gcggccactacgaccagctg

SEQ ID NO: 115560 - DNA, 20 bp, human
ggcagtccaactcccacccc

SEQ ID NO: 115561 - DNA, 20 bp, human
ggtgggcagcaggggaccgg

SEQ ID NO: 115562 - DNA, 20 bp, human
ggaccccagggcgggagcat

SEQ ID NO: 115563 - DNA, 20 bp, human
ggcgacaggcagggaggcga

SEQ ID NO: 115564 - DNA, 20 bp, human
gcagggcccaaaggctcggg

SEQ ID NO: 115565 - DNA, 20 bp, human
ggcacccgcccggtcgccat

SEQ ID NO: 115566 - DNA, 20 bp, human
gggtgacgaccgcctagatc

SEQ ID NO: 115567 - DNA, 20 bp, human
gcggcaggtcccgggaacca

SEQ ID NO: 115568 - DNA, 20 bp, human
ggcccgaggcctccctatcc

SEQ ID NO: 115569 - DNA, 20 bp, human
gaaaccttggacacagttct

SEQ ID NO: 115570 - DNA, 20 bp, human
gccgtaatagactgacgagg

SEQ ID NO: 115571 - DNA, 20 bp, human
gcgaggaggcagaagcgaag

SEQ ID NO: 115572 - DNA, 20 bp, human
gcagcagccgtgggacaagg

SEQ ID NO: 115573 - DNA, 20 bp, human
gtgtcgaggaggctaggcca

SEQ ID NO: 115574 - DNA, 20 bp, human
gctgccgtaatagactgacg

SEQ ID NO: 115575 - DNA, 20 bp, human
ggcggaacagcccaaatctg

SEQ ID NO: 115576 - DNA, 20 bp, human
ggcggttgctacagacccag

SEQ ID NO: 115577 - DNA, 20 bp, human
gagctggaccgggatactgg

SEQ ID NO: 115578 - DNA, 20 bp, human
gagagagccatcggcagagg

SEQ ID NO: 115579 - DNA, 20 bp, human
gtcagcggaagactacgaga

SEQ ID NO: 115580 - DNA, 20 bp, human
ggctattccgaggacatcgt

SEQ ID NO: 115581 - DNA, 20 bp, human
gcgagaaggaagagagccat

SEQ ID NO: 115582 - DNA, 20 bp, human
gttgctacagacccagaggc

SEQ ID NO: 115583 - DNA, 20 bp, human
ggcagaagaacggcagtcag

SEQ ID NO: 115584 - DNA, 20 bp, human
gtagcaaccgcccagcgttg

SEQ ID NO: 115585 - DNA, 20 bp, human
gtgagccgcgcctcaacgct

SEQ ID NO: 115586 - DNA, 20 bp, human
ggggagagcccggaaggtag

SEQ ID NO: 115587 - DNA, 20 bp, human
gtcgggaggaggagagccaa

SEQ ID NO: 115588 - DNA, 20 bp, human
gaagcagcccccgagccgag

SEQ ID NO: 115589 - DNA, 20 bp, human
gtggccctggtcataagacc

SEQ ID NO: 115590 - DNA, 20 bp, human
gatggacgcgggggacaccg

SEQ ID NO: 115591 - DNA, 20 bp, human
gcggcggcaggagcgcgtcc

SEQ ID NO: 115592 - DNA, 20 bp, human
ggtcagtcgggccgcggcga

SEQ ID NO: 115593 - DNA, 20 bp, human
gccgccaggtcttatgacca

SEQ ID NO: 115594 - DNA, 20 bp, human
gacctcggggatggacgcgg

SEQ ID NO: 115595 - DNA, 20 bp, human
ggcgcggggcgcagacctcg

SEQ ID NO: 115596 - DNA, 20 bp, human
ggagagcccggaaggtgagc

SEQ ID NO: 115597 - DNA, 20 bp, human
gagccagggggcgccaggta

SEQ ID NO: 115598 - DNA, 20 bp, human
gggtgagccgcgggccggta

SEQ ID NO: 115599 - DNA, 20 bp, human
ggcgggcgcacgcgctcaga

SEQ ID NO: 115600 - DNA, 20 bp, human
gggccccgcgctcaggtgca

SEQ ID NO: 115601 - DNA, 20 bp, human
gggtgagcgggcgagccgac

SEQ ID NO: 115602 - DNA, 20 bp, human
ggcgcgggctcctagctctg

SEQ ID NO: 115603 - DNA, 20 bp, human
gtgcggcacggcgggacgcg

SEQ ID NO: 115604 - DNA, 20 bp, human
ggctcgcccgctcaccttcc

SEQ ID NO: 115605 - DNA, 20 bp, human
gagcaagctagggtgccggt

SEQ ID NO: 115606 - DNA, 20 bp, human
ggacaggaccaggaagctca

SEQ ID NO: 115607 - DNA, 20 bp, human
ggcctggggggaacagtgag

SEQ ID NO: 115608 - DNA, 20 bp, human
gcaagcagttggggcagtga

SEQ ID NO: 115609 - DNA, 20 bp, human
gccgctggcaacccctctgt

SEQ ID NO: 115610 - DNA, 20 bp, human
gacgtggatgtagcctgatc

SEQ ID NO: 115611 - DNA, 20 bp, human
gatcggtgctcaaagcaatc

SEQ ID NO: 115612 - DNA, 20 bp, human
gcagtggtcttctcccgatc

SEQ ID NO: 115613 - DNA, 20 bp, human
gcccgagtgagctgagtggg

SEQ ID NO: 115614 - DNA, 20 bp, human
gacgcagaccttcagcatta

SEQ ID NO: 115615 - DNA, 20 bp, human
gggcatggggacatcatatc

SEQ ID NO: 115616 - DNA, 20 bp, human
ggcggcctgggcgtctcgag

SEQ ID NO: 115617 - DNA, 20 bp, human
ggtccaggctccaaagccgg

SEQ ID NO: 115618 - DNA, 20 bp, human
gtctcgagaggtgagagagt

SEQ ID NO: 115619 - DNA, 20 bp, human
gagacgcagagactccgcag

SEQ ID NO: 115620 - DNA, 20 bp, human
gcagcaggccccagcgccca

SEQ ID NO: 115621 - DNA, 20 bp, human
gcgcaagattcgagcctgag

SEQ ID NO: 115622 - DNA, 20 bp, human
gattcgagcctgagcggcct

SEQ ID NO: 115623 - DNA, 20 bp, human
gcgtcgtgcggtggccagag

SEQ ID NO: 115624 - DNA, 20 bp, human
gctcacctctcgagacgccc

SEQ ID NO: 115625 - DNA, 20 bp, human
gagagttggcggcgaggtct

SEQ ID NO: 115626 - DNA, 20 bp, human
gacgatcgtccttataggag

SEQ ID NO: 115627 - DNA, 20 bp, human
ggcatcgcctcaacagctgg

SEQ ID NO: 115628 - DNA, 20 bp, human
gccgagctcgcggggaccag

SEQ ID NO: 115629 - DNA, 20 bp, human
gctcgcggggaccaggggag

SEQ ID NO: 115630 - DNA, 20 bp, human
gagcccccagagggaatgag

SEQ ID NO: 115631 - DNA, 20 bp, human
ggagcctacaccgactctgg

SEQ ID NO: 115632 - DNA, 20 bp, human
ggaggagcctacaccgactc

SEQ ID NO: 115633 - DNA, 20 bp, human
gaggggcagcgccgccgcaa

SEQ ID NO: 115634 - DNA, 20 bp, human
gaagactggagcctttgcgg

SEQ ID NO: 115635 - DNA, 20 bp, human
gcttcctccagagtcggtgt

SEQ ID NO: 115636 - DNA, 20 bp, human
gtgggccacggcagcccgag

SEQ ID NO: 115637 - DNA, 20 bp, human
gggtgcacctcggtgatgat

SEQ ID NO: 115638 - DNA, 20 bp, human
ggaagggcagtgcgccatag

SEQ ID NO: 115639 - DNA, 20 bp, human
gggactgctgccagagcgag

SEQ ID NO: 115640 - DNA, 20 bp, human
ggcaccgagtacacgctgaa

SEQ ID NO: 115641 - DNA, 20 bp, human
gcagcagccccaggcacacg

SEQ ID NO: 115642 - DNA, 20 bp, human
gggcggccgcgtgccgtgag

SEQ ID NO: 115643 - DNA, 20 bp, human
gttagcgcctggcagtacgc

SEQ ID NO: 115644 - DNA, 20 bp, human
gccgagcggcagcctgctca

SEQ ID NO: 115645 - DNA, 20 bp, human
ggccgcgcagcgcgagagcg

SEQ ID NO: 115646 - DNA, 20 bp, human
gctatagccacgaaagtgac

SEQ ID NO: 115647 - DNA, 20 bp, human
gtaggagggtgcagagatcg

SEQ ID NO: 115648 - DNA, 20 bp, human
gcacctgcacagctatcccg

SEQ ID NO: 115649 - DNA, 20 bp, human
gagcgcgaggagctggtcga

SEQ ID NO: 115650 - DNA, 20 bp, human
gccacgaaagtgactggcag

SEQ ID NO: 115651 - DNA, 20 bp, human
gctagaagaggattattgag

SEQ ID NO: 115652 - DNA, 20 bp, human
gacctgcgtagggccttcca

SEQ ID NO: 115653 - DNA, 20 bp, human
gagccccgggatagctgtgc

SEQ ID NO: 115654 - DNA, 20 bp, human
ggcgctggagggatcgatga

SEQ ID NO: 115655 - DNA, 20 bp, human
gcatgacataacagctagga

SEQ ID NO: 115656 - DNA, 20 bp, human
gggtggtcaaccgaaggtgg

SEQ ID NO: 115657 - DNA, 20 bp, human
gggagacggcgttccgttag

SEQ ID NO: 115658 - DNA, 20 bp, human
gcccatcgcgaccgaggtgg

SEQ ID NO: 115659 - DNA, 20 bp, human
gcgttggggtttggctgcag

SEQ ID NO: 115660 - DNA, 20 bp, human
ggccgggtgagctggaaact

SEQ ID NO: 115661 - DNA, 20 bp, human
ggaacgccgtctcctccccc

SEQ ID NO: 115662 - DNA, 20 bp, human
gccgctcccaaaaaggccgg

SEQ ID NO: 115663 - DNA, 20 bp, human
gtgctcacggggacccgctc

SEQ ID NO: 115664 - DNA, 20 bp, human
ggcctggcgccaagaaaagg

SEQ ID NO: 115665 - DNA, 20 bp, human
gaaactggggagcgctgctg

SEQ ID NO: 115666 - DNA, 20 bp, human
gtgcccaggaagctatggac

SEQ ID NO: 115667 - DNA, 20 bp, human
gcagtgtcgctggccgcgag

SEQ ID NO: 115668 - DNA, 20 bp, human
gctccagcgcggggaaaggc

SEQ ID NO: 115669 - DNA, 20 bp, human
gaactcgccacggtgtccca

SEQ ID NO: 115670 - DNA, 20 bp, human
gttacgaccctgggacaccg

SEQ ID NO: 115671 - DNA, 20 bp, human
gggccagacccaactcgcca

SEQ ID NO: 115672 - DNA, 20 bp, human
ggccgcaggcacagtgtcgc

SEQ ID NO: 115673 - DNA, 20 bp, human
gcgcagggacgggggaccgg

SEQ ID NO: 115674 - DNA, 20 bp, human
gttccacggagcctcggcgt

SEQ ID NO: 115675 - DNA, 20 bp, human
gttgggtctggcccacgccg

SEQ ID NO: 115676 - DNA, 20 bp, human
gccgcctcggacttggatag

SEQ ID NO: 115677 - DNA, 20 bp, human
gaccgccaagccacagccga

SEQ ID NO: 115678 - DNA, 20 bp, human
gggaggctccccgcattaca

SEQ ID NO: 115679 - DNA, 20 bp, human
gctgcctctatccaagtccg

SEQ ID NO: 115680 - DNA, 20 bp, human
gagagaaggcgcacgggacc

SEQ ID NO: 115681 - DNA, 20 bp, human
gcgggaagccaggaaaagtt

SEQ ID NO: 115682 - DNA, 20 bp, human
gcgccgctcgggcttgcctt

SEQ ID NO: 115683 - DNA, 20 bp, human
gcctcagagagaaggcgcac

SEQ ID NO: 115684 - DNA, 20 bp, human
gaacagccgggcccggtgag

SEQ ID NO: 115685 - DNA, 20 bp, human
gggcctcagccccaacaatg

SEQ ID NO: 115686 - DNA, 20 bp, human
gcgcccggcaacagacagac

SEQ ID NO: 115687 - DNA, 20 bp, human
gtctgacggcggcagaagag

SEQ ID NO: 115688 - DNA, 20 bp, human
gccagacacgcggggatctg

SEQ ID NO: 115689 - DNA, 20 bp, human
ggaccaacagtgcggcccca

SEQ ID NO: 115690 - DNA, 20 bp, human
ggacacgtagaccaacagtg

SEQ ID NO: 115691 - DNA, 20 bp, human
gaactgagcctgaaccccgg

SEQ ID NO: 115692 - DNA, 20 bp, human
gggatgggaaggggtctcac

SEQ ID NO: 115693 - DNA, 20 bp, human
gaaatgagcgagcgagtctg

SEQ ID NO: 115694 - DNA, 20 bp, human
gggtaccccacaaaaaatgg

SEQ ID NO: 115695 - DNA, 20 bp, human
gcggaactgagcctgaaccc

SEQ ID NO: 115696 - DNA, 20 bp, human
ggccaaggcggcgtcagctc

SEQ ID NO: 115697 - DNA, 20 bp, human
gaactccaggaggggtgcca

SEQ ID NO: 115698 - DNA, 20 bp, human
gctggtggcgaggaaaaaat

SEQ ID NO: 115699 - DNA, 20 bp, human
ggcccgagctgacgccgcct

SEQ ID NO: 115700 - DNA, 20 bp, human
ggctgaccaacacaaagacg

SEQ ID NO: 115701 - DNA, 20 bp, human
gctgccggacaccaacgatg

SEQ ID NO: 115702 - DNA, 20 bp, human
gctcctggagttagaaacta

SEQ ID NO: 115703 - DNA, 20 bp, human
ggtccggaggaagagaacga

SEQ ID NO: 115704 - DNA, 20 bp, human
gtctgtggccgaaggtccgg

SEQ ID NO: 115705 - DNA, 20 bp, human
gacagagccctcctcatcgt

SEQ ID NO: 115706 - DNA, 20 bp, human
gcccaggtcccggccaatgg

SEQ ID NO: 115707 - DNA, 20 bp, human
gacccccaggtcccggccaa

SEQ ID NO: 115708 - DNA, 20 bp, human
ggtctgtcaaaagcccgact

SEQ ID NO: 115709 - DNA, 20 bp, human
gtccccgtggccgtctgctg

SEQ ID NO: 115710 - DNA, 20 bp, human
gcaatggaggcgatttagac

SEQ ID NO: 115711 - DNA, 20 bp, human
gccgtgtggacatagccctg

SEQ ID NO: 115712 - DNA, 20 bp, human
gaggcgatttagactggagt

SEQ ID NO: 115713 - DNA, 20 bp, human
gtaacaaaacccagaccccc

SEQ ID NO: 115714 - DNA, 20 bp, human
gcgagtctcgcaggaccgtg

SEQ ID NO: 115715 - DNA, 20 bp, human
gtagccgcagcagacggcca

SEQ ID NO: 115716 - DNA, 20 bp, human
ggcctgtgacgaggagtcgg

SEQ ID NO: 115717 - DNA, 20 bp, human
gtgagcctgtgacgaggagt

SEQ ID NO: 115718 - DNA, 20 bp, human
ggccgccgactcctcgtcac

SEQ ID NO: 115719 - DNA, 20 bp, human
gaggcggccgcggcccccag

SEQ ID NO: 115720 - DNA, 20 bp, human
gccatgggcagctactgcaa

SEQ ID NO: 115721 - DNA, 20 bp, human
ggcgcgccggcaggacgcgg

SEQ ID NO: 115722 - DNA, 20 bp, human
gggaactgcgagacgccggg

SEQ ID NO: 115723 - DNA, 20 bp, human
gagctgcccgcctacacgga

SEQ ID NO: 115724 - DNA, 20 bp, human
gacgccgggcggcatgtggt

SEQ ID NO: 115725 - DNA, 20 bp, human
gagacctacaagaagttcag

SEQ ID NO: 115726 - DNA, 20 bp, human
ggcacgtggatagaaggcgg

SEQ ID NO: 115727 - DNA, 20 bp, human
gcgggcagagagctctccgg

SEQ ID NO: 115728 - DNA, 20 bp, human
gccaggtgggcggcagaaag

SEQ ID NO: 115729 - DNA, 20 bp, human
gcagtctcacagcgccaggt

SEQ ID NO: 115730 - DNA, 20 bp, human
ggacgaaagcgacccaggag

SEQ ID NO: 115731 - DNA, 20 bp, human
ggccagctctggatgtgtcc

SEQ ID NO: 115732 - DNA, 20 bp, human
gtctcacagcgccaggtggg

SEQ ID NO: 115733 - DNA, 20 bp, human
gcgggcggcggcaccatgca

SEQ ID NO: 115734 - DNA, 20 bp, human
gctgtaggcacgtggataga

SEQ ID NO: 115735 - DNA, 20 bp, human
gagggtccttggctgggtcg

SEQ ID NO: 115736 - DNA, 20 bp, human
ggcacactgggtgtcaggag

SEQ ID NO: 115737 - DNA, 20 bp, human
gctcgaacccaggagatagg

SEQ ID NO: 115738 - DNA, 20 bp, human
gcgcggcttcgccacatccg

SEQ ID NO: 115739 - DNA, 20 bp, human
gatgtccttgaccgagaagg

SEQ ID NO: 115740 - DNA, 20 bp, human
gagtaaggccctgaatctca

SEQ ID NO: 115741 - DNA, 20 bp, human
ggatgggaatgggattcgag

SEQ ID NO: 115742 - DNA, 20 bp, human
gaggggtgtgtgaagcacac

SEQ ID NO: 115743 - DNA, 20 bp, human
gcggctctgcgtccattctc

SEQ ID NO: 115744 - DNA, 20 bp, human
gtcctacggggggaatgtgg

SEQ ID NO: 115745 - DNA, 20 bp, human
ggtcaggagaggatgggaat

SEQ ID NO: 115746 - DNA, 20 bp, human
ggtgggaggtaggaggcgtg

SEQ ID NO: 115747 - DNA, 20 bp, human
gaccctggagacccggacct

SEQ ID NO: 115748 - DNA, 20 bp, human
gcggctttccggcccctcgt

SEQ ID NO: 115749 - DNA, 20 bp, human
ggtgaagctcaggcgtccag

SEQ ID NO: 115750 - DNA, 20 bp, human
gcaagggcccagcccacgag

SEQ ID NO: 115751 - DNA, 20 bp, human
gctgctcgggtaaatctaga

SEQ ID NO: 115752 - DNA, 20 bp, human
gctttcaaagcggcctgggt

SEQ ID NO: 115753 - DNA, 20 bp, human
ggagcactggaccagagccg

SEQ ID NO: 115754 - DNA, 20 bp, human
ggcgtggggcagcagaatca

SEQ ID NO: 115755 - DNA, 20 bp, human
gggacgccgctcctacggat

SEQ ID NO: 115756 - DNA, 20 bp, human
gtccggaaccctgagcatcc

SEQ ID NO: 115757 - DNA, 20 bp, human
gggcgggtgcattcaggcca

SEQ ID NO: 115758 - DNA, 20 bp, human
gggctcagggttcattccgg

SEQ ID NO: 115759 - DNA, 20 bp, human
gctataagcgagccgggagg

SEQ ID NO: 115760 - DNA, 20 bp, human
ggggaggcggaaagtgaaag

SEQ ID NO: 115761 - DNA, 20 bp, human
gggggccgccgggatgctca

SEQ ID NO: 115762 - DNA, 20 bp, human
gcctgcaccccgagctctgg

SEQ ID NO: 115763 - DNA, 20 bp, human
ggggtgcattcaggccaagg

SEQ ID NO: 115764 - DNA, 20 bp, human
gcggcccggggaggcgaaag

SEQ ID NO: 115765 - DNA, 20 bp, human
gaccctgagccccagcgtca

SEQ ID NO: 115766 - DNA, 20 bp, human
ggtggtacagtggaacgcaa

SEQ ID NO: 115767 - DNA, 20 bp, human
gtacagtggaacgcaaggga

SEQ ID NO: 115768 - DNA, 20 bp, human
ggggtgggcctctaaggtgg

SEQ ID NO: 115769 - DNA, 20 bp, human
ggcggccgctggattccgag

SEQ ID NO: 115770 - DNA, 20 bp, human
gcgcgcctctcggaatccag

SEQ ID NO: 115771 - DNA, 20 bp, human
gtgggccgcgcagcagtggg

SEQ ID NO: 115772 - DNA, 20 bp, human
ggagggtcggcgctgatcct

SEQ ID NO: 115773 - DNA, 20 bp, human
ggtcggcgctgatcctggga

SEQ ID NO: 115774 - DNA, 20 bp, human
gcgggcggggtgggcctcta

SEQ ID NO: 115775 - DNA, 20 bp, human
ggctgatcctgggacggagt

SEQ ID NO: 115776 - DNA, 20 bp, human
gagccccgccggggatgagg

SEQ ID NO: 115777 - DNA, 20 bp, human
ggcagccgccgcctcatccc

SEQ ID NO: 115778 - DNA, 20 bp, human
gcggcgctgtcaaactactg

SEQ ID NO: 115779 - DNA, 20 bp, human
gcgccctcgctgcaaggcta

SEQ ID NO: 115780 - DNA, 20 bp, human
ggcagaggcggacgaggaag

SEQ ID NO: 115781 - DNA, 20 bp, human
gccaggcgtgcgtccctcca

SEQ ID NO: 115782 - DNA, 20 bp, human
ggggtggtagtactcacgag

SEQ ID NO: 115783 - DNA, 20 bp, human
ggcaggcagcgggggatacg

SEQ ID NO: 115784 - DNA, 20 bp, human
gggggccgcgacccgggagt

SEQ ID NO: 115785 - DNA, 20 bp, human
ggcgggctctgcatcactcc

SEQ ID NO: 115786 - DNA, 20 bp, human
gacatcctgggccggcccgt

SEQ ID NO: 115787 - DNA, 20 bp, human
ggcgggcccgaagtaaacgc

SEQ ID NO: 115788 - DNA, 20 bp, human
gacgcgagcccgttgagccg

SEQ ID NO: 115789 - DNA, 20 bp, human
gccgggcggttagtgtccat

SEQ ID NO: 115790 - DNA, 20 bp, human
gcgccgggccagaagatggg

SEQ ID NO: 115791 - DNA, 20 bp, human
gcggaccctgcagcgcgtag

SEQ ID NO: 115792 - DNA, 20 bp, human
gtgccgtgcggggtcccgag

SEQ ID NO: 115793 - DNA, 20 bp, human
gcagcacgaacgcgcccggg

SEQ ID NO: 115794 - DNA, 20 bp, human
gctggccgcgctgcacaaca

SEQ ID NO: 115795 - DNA, 20 bp, human
gacccgggccagccagacgc

SEQ ID NO: 115796 - DNA, 20 bp, human
gggagggtcccccgactcag

SEQ ID NO: 115797 - DNA, 20 bp, human
gccgactcagaggcagaaag

SEQ ID NO: 115798 - DNA, 20 bp, human
gggagttctgcacagagtac

SEQ ID NO: 115799 - DNA, 20 bp, human
gacagagtactggcacaccg

SEQ ID NO: 115800 - DNA, 20 bp, human
gcctggcccatgccttaggt

SEQ ID NO: 115801 - DNA, 20 bp, human
gttgccctggccggacaggg

SEQ ID NO: 115802 - DNA, 20 bp, human
gaggatgtccgtgatcccgt

SEQ ID NO: 115803 - DNA, 20 bp, human
gtggccgccggaacccccca

SEQ ID NO: 115804 - DNA, 20 bp, human
ggggccaccctgtccggcca

SEQ ID NO: 115805 - DNA, 20 bp, human
gctcccagtcaggacaggga

SEQ ID NO: 115806 - DNA, 20 bp, human
gcagctgcccgccctcatcc

SEQ ID NO: 115807 - DNA, 20 bp, human
ggtctggtcgcccgcccaga

SEQ ID NO: 115808 - DNA, 20 bp, human
gacgtggggacgcaggatgg

SEQ ID NO: 115809 - DNA, 20 bp, human
gtggcggcagcagtgccggt

SEQ ID NO: 115810 - DNA, 20 bp, human
ggtgggagctcacgccaggt

SEQ ID NO: 115811 - DNA, 20 bp, human
gaggatggcggcagcagtgc

SEQ ID NO: 115812 - DNA, 20 bp, human
gtgtccggggtgatgtccac

SEQ ID NO: 115813 - DNA, 20 bp, human
gtgcagttccaggatgaggg

SEQ ID NO: 115814 - DNA, 20 bp, human
gcctgcgcgagcaagtgggg

SEQ ID NO: 115815 - DNA, 20 bp, human
gttgctcgcgcaggacgagg

SEQ ID NO: 115816 - DNA, 20 bp, human
gcaatggggcacccaatccc

SEQ ID NO: 115817 - DNA, 20 bp, human
gtggcatgcttggtacaccg

SEQ ID NO: 115818 - DNA, 20 bp, human
gtatatgtcccgactgagga

SEQ ID NO: 115819 - DNA, 20 bp, human
ggacaactaatgtgggacca

SEQ ID NO: 115820 - DNA, 20 bp, human
gaatttggccacgtgcatct

SEQ ID NO: 115821 - DNA, 20 bp, human
gcaacatacagagagtcaat

SEQ ID NO: 115822 - DNA, 20 bp, human
gcacgtggccaaattatgtt

SEQ ID NO: 115823 - DNA, 20 bp, human
gcacacaggagcaaattgag

SEQ ID NO: 115824 - DNA, 20 bp, human
gatataggcagtcttcgctc

SEQ ID NO: 115825 - DNA, 20 bp, human
ggatgatgtggacccactgg

SEQ ID NO: 115826 - DNA, 20 bp, human
ggggcaagggaaattggatg

SEQ ID NO: 115827 - DNA, 20 bp, human
gggagccacatgctgatcgg

SEQ ID NO: 115828 - DNA, 20 bp, human
ggggcagacagaaaggaatg

SEQ ID NO: 115829 - DNA, 20 bp, human
gccgtgccccctccatggag

SEQ ID NO: 115830 - DNA, 20 bp, human
gtggcgggggctcaacgcgg

SEQ ID NO: 115831 - DNA, 20 bp, human
gccctgggacccccccccct

SEQ ID NO: 115832 - DNA, 20 bp, human
gtcctggcgctgtgtctggt

SEQ ID NO: 115833 - DNA, 20 bp, human
ggggtcccccgatcagcatg

SEQ ID NO: 115834 - DNA, 20 bp, human
ggcgctgtgtctggtggggc

SEQ ID NO: 115835 - DNA, 20 bp, human
gccaggagccacatgctgat

SEQ ID NO: 115836 - DNA, 20 bp, human
gctgccggagagctgatctc

SEQ ID NO: 115837 - DNA, 20 bp, human
gcatatcgcctccaggccaa

SEQ ID NO: 115838 - DNA, 20 bp, human
gggctgggggccctcaatag

SEQ ID NO: 115839 - DNA, 20 bp, human
gatccccgagatcagctctc

SEQ ID NO: 115840 - DNA, 20 bp, human
ggtggaaatagagggaccat

SEQ ID NO: 115841 - DNA, 20 bp, human
ggctagaggatgagagaccg

SEQ ID NO: 115842 - DNA, 20 bp, human
ggggtaccgatggagaacat

SEQ ID NO: 115843 - DNA, 20 bp, human
gggcctggaggcgatatggg

SEQ ID NO: 115844 - DNA, 20 bp, human
gctgtgcccgcgcaccgagg

SEQ ID NO: 115845 - DNA, 20 bp, human
gggggggctgcagatagtgg

SEQ ID NO: 115846 - DNA, 20 bp, human
ggcaggaagggccaagctag

SEQ ID NO: 115847 - DNA, 20 bp, human
gagctcaagtatctgcagtg

SEQ ID NO: 115848 - DNA, 20 bp, human
gccgccaatagtctgtggac

SEQ ID NO: 115849 - DNA, 20 bp, human
gctgcccgtccacagactat

SEQ ID NO: 115850 - DNA, 20 bp, human
gcgggttccctagaaaaatc

SEQ ID NO: 115851 - DNA, 20 bp, human
gttctagggaacccgaaacg

SEQ ID NO: 115852 - DNA, 20 bp, human
gtgcagctcttccaaagcta

SEQ ID NO: 115853 - DNA, 20 bp, human
gccgaaacgaggtatgattc

SEQ ID NO: 115854 - DNA, 20 bp, human
gcctccaaactaggcggtgt

SEQ ID NO: 115855 - DNA, 20 bp, human
gtggatgaggaaatctagtt

SEQ ID NO: 115856 - DNA, 20 bp, human
gcggcggaggagacagtgcg

SEQ ID NO: 115857 - DNA, 20 bp, human
gcactgggcccggataccgg

SEQ ID NO: 115858 - DNA, 20 bp, human
gagcctaccggttctcggag

SEQ ID NO: 115859 - DNA, 20 bp, human
gccaagcgcgcagccggcgg

SEQ ID NO: 115860 - DNA, 20 bp, human
gggtcaggttgagggacagg

SEQ ID NO: 115861 - DNA, 20 bp, human
gagccccttcccactccagt

SEQ ID NO: 115862 - DNA, 20 bp, human
gtcggctgcagatgatgcgt

SEQ ID NO: 115863 - DNA, 20 bp, human
gcccaggagaaccccgccga

SEQ ID NO: 115864 - DNA, 20 bp, human
ggagcactgggcccggatac

SEQ ID NO: 115865 - DNA, 20 bp, human
gaggccggtcgctaccccgg

SEQ ID NO: 115866 - DNA, 20 bp, human
gcagccaagagcacagtcgg

SEQ ID NO: 115867 - DNA, 20 bp, human
ggaggcggcagagacggtgg

SEQ ID NO: 115868 - DNA, 20 bp, human
gagagccaggtcaggctggg

SEQ ID NO: 115869 - DNA, 20 bp, human
gcacggggcctagataccgg

SEQ ID NO: 115870 - DNA, 20 bp, human
gacggtggcgggtgagctag

SEQ ID NO: 115871 - DNA, 20 bp, human
gcggcacggggcctagatac

SEQ ID NO: 115872 - DNA, 20 bp, human
gtgggctgcagatgacgagt

SEQ ID NO: 115873 - DNA, 20 bp, human
gaggaggccgatctacccca

SEQ ID NO: 115874 - DNA, 20 bp, human
gaacctaccggttctccgag

SEQ ID NO: 115875 - DNA, 20 bp, human
ggctcactagacccccgccg

SEQ ID NO: 115876 - DNA, 20 bp, human
ggcaggaaaggccgagctag

SEQ ID NO: 115877 - DNA, 20 bp, human
ggtggctctccagcaaagga

SEQ ID NO: 115878 - DNA, 20 bp, human
gctgtcaatagtgtgtcccc

SEQ ID NO: 115879 - DNA, 20 bp, human
gcccgaaggggaaggcgcct

SEQ ID NO: 115880 - DNA, 20 bp, human
gagctcaaatatcgccagtg

SEQ ID NO: 115881 - DNA, 20 bp, human
gactagattcgctcatccag

SEQ ID NO: 115882 - DNA, 20 bp, human
ggcccaggcgccttcccctt

SEQ ID NO: 115883 - DNA, 20 bp, human
gcctccaaacccggcaatgt

SEQ ID NO: 115884 - DNA, 20 bp, human
gcaggttccttagaaaaatt

SEQ ID NO: 115885 - DNA, 20 bp, human
gggatgagcgaatctagttg

SEQ ID NO: 115886 - DNA, 20 bp, human
gagggaggaatgaaagatgt

SEQ ID NO: 115887 - DNA, 20 bp, human
ggagaggagaaagagagccg

SEQ ID NO: 115888 - DNA, 20 bp, human
gctagcaaagccggatagag

SEQ ID NO: 115889 - DNA, 20 bp, human
ggagccggggcaaaagtgaa

SEQ ID NO: 115890 - DNA, 20 bp, human
gacgctggctccgctctatc

SEQ ID NO: 115891 - DNA, 20 bp, human
gtcctgggcagaataagcca

SEQ ID NO: 115892 - DNA, 20 bp, human
gtgctgtacagggtgtacag

SEQ ID NO: 115893 - DNA, 20 bp, human
gccggccgcggcggaaccgg

SEQ ID NO: 115894 - DNA, 20 bp, human
ggctcggacgcccagacgga

SEQ ID NO: 115895 - DNA, 20 bp, human
gtatccggctttgctagggg

SEQ ID NO: 115896 - DNA, 20 bp, human
gtaggccggctcgagactcc

SEQ ID NO: 115897 - DNA, 20 bp, human
gccaaggttaacccgcgcgc

SEQ ID NO: 115898 - DNA, 20 bp, human
gggagctgccgcacgtggga

SEQ ID NO: 115899 - DNA, 20 bp, human
ggcgcccgggagtctcgagc

SEQ ID NO: 115900 - DNA, 20 bp, human
gcgagccggcctagccgcag

SEQ ID NO: 115901 - DNA, 20 bp, human
ggcgtggagctgccgcacgt

SEQ ID NO: 115902 - DNA, 20 bp, human
gtgaccagcctcgctgactg

SEQ ID NO: 115903 - DNA, 20 bp, human
gcgtcctcccgagggagcgg

SEQ ID NO: 115904 - DNA, 20 bp, human
ggaggcagtcccaaacaaag

SEQ ID NO: 115905 - DNA, 20 bp, human
gcactgtggcctctgcggct

SEQ ID NO: 115906 - DNA, 20 bp, human
ggtgaggacccggagccaca

SEQ ID NO: 115907 - DNA, 20 bp, human
gtggtaagtgccctgatccc

SEQ ID NO: 115908 - DNA, 20 bp, human
gacagccggtgggctcggtg

SEQ ID NO: 115909 - DNA, 20 bp, human
gtaaggcctgagctactctg

SEQ ID NO: 115910 - DNA, 20 bp, human
gagccacagggacagccggt

SEQ ID NO: 115911 - DNA, 20 bp, human
ggcagccccaccgagcccac

SEQ ID NO: 115912 - DNA, 20 bp, human
gttctcaggaccagggatca

SEQ ID NO: 115913 - DNA, 20 bp, human
gtccaagaagctgtctcctg

SEQ ID NO: 115914 - DNA, 20 bp, human
gtgacctcagtgcagggcag

SEQ ID NO: 115915 - DNA, 20 bp, human
ggccaaccaaccaaccgtgt

SEQ ID NO: 115916 - DNA, 20 bp, human
gtctggtctacaagaactcg

SEQ ID NO: 115917 - DNA, 20 bp, human
ggaggacagtgtacagagag

SEQ ID NO: 115918 - DNA, 20 bp, human
gttagctactgggaggactg

SEQ ID NO: 115919 - DNA, 20 bp, human
gtctgggattcaaggtacag

SEQ ID NO: 115920 - DNA, 20 bp, human
gcacagaacaagaaggtatc

SEQ ID NO: 115921 - DNA, 20 bp, human
gtgcacaggcacactcacat

SEQ ID NO: 115922 - DNA, 20 bp, human
ggacgcacggggacaccctc

SEQ ID NO: 115923 - DNA, 20 bp, human
gggactactgtgagatggaa

SEQ ID NO: 115924 - DNA, 20 bp, human
gtgtccccgtgcgtcatcgg

SEQ ID NO: 115925 - DNA, 20 bp, human
gtccggagtataaacagcca

SEQ ID NO: 115926 - DNA, 20 bp, human
ggagagtgggtggatccggt

SEQ ID NO: 115927 - DNA, 20 bp, human
gcagagagagtgggtggatc

SEQ ID NO: 115928 - DNA, 20 bp, human
ggcggagcagctctaggcgg

SEQ ID NO: 115929 - DNA, 20 bp, human
ggcactggcggagcagctct

SEQ ID NO: 115930 - DNA, 20 bp, human
gatagctgggtaagcggaca

SEQ ID NO: 115931 - DNA, 20 bp, human
gagcggaagggagaggatcg

SEQ ID NO: 115932 - DNA, 20 bp, human
gcactcaccctcagcgctcg

SEQ ID NO: 115933 - DNA, 20 bp, human
gcgccagtgcatggaactgg

SEQ ID NO: 115934 - DNA, 20 bp, human
gtgagggtcgcctggatggg

SEQ ID NO: 115935 - DNA, 20 bp, human
gcgcagctcctgtcacctac

SEQ ID NO: 115936 - DNA, 20 bp, human
gtaagagacggtaagagcca

SEQ ID NO: 115937 - DNA, 20 bp, human
ggcagcccggggctccactc

SEQ ID NO: 115938 - DNA, 20 bp, human
gcccaggtggtgagggtatc

SEQ ID NO: 115939 - DNA, 20 bp, human
gtctatcggcgtctatctgt

SEQ ID NO: 115940 - DNA, 20 bp, human
ggagctgcaaggctgagaag

SEQ ID NO: 115941 - DNA, 20 bp, human
gagaggggcctgcaagacac

SEQ ID NO: 115942 - DNA, 20 bp, human
gagatagacgccgatagagg

SEQ ID NO: 115943 - DNA, 20 bp, human
gccgaatgctgaataagaga

SEQ ID NO: 115944 - DNA, 20 bp, human
ggacgccgatagagggggag

SEQ ID NO: 115945 - DNA, 20 bp, human
gccgatagagggggagtggt

SEQ ID NO: 115946 - DNA, 20 bp, human
ggtatcaagctgtagctggt

SEQ ID NO: 115947 - DNA, 20 bp, human
ggagctgtcggaccaggaaa

SEQ ID NO: 115948 - DNA, 20 bp, human
gcctggtccgacagctctac

SEQ ID NO: 115949 - DNA, 20 bp, human
ggctccccaagtctgaactg

SEQ ID NO: 115950 - DNA, 20 bp, human
gggaacatgttaggatacag

SEQ ID NO: 115951 - DNA, 20 bp, human
gggctaagagagcccaaact

SEQ ID NO: 115952 - DNA, 20 bp, human
gagaagtgaactagtgagta

SEQ ID NO: 115953 - DNA, 20 bp, human
gatataggcctggaacagaa

SEQ ID NO: 115954 - DNA, 20 bp, human
gagctctacaggtccaagtt

SEQ ID NO: 115955 - DNA, 20 bp, human
ggttaggatacaggggactt

SEQ ID NO: 115956 - DNA, 20 bp, human
gtcgaccagccaaggagacc

SEQ ID NO: 115957 - DNA, 20 bp, human
gaagcaaacaagctaggcag

SEQ ID NO: 115958 - DNA, 20 bp, human
gacaaacaaatcggccagaa

SEQ ID NO: 115959 - DNA, 20 bp, human
gggtcgaaagcaaacaagct

SEQ ID NO: 115960 - DNA, 20 bp, human
ggtttgctttcgaccagcca

SEQ ID NO: 115961 - DNA, 20 bp, human
ggccaccaggtctccttggc

SEQ ID NO: 115962 - DNA, 20 bp, human
gaaatgactaaagttcctaa

SEQ ID NO: 115963 - DNA, 20 bp, human
gtagaagaatagcatccata

SEQ ID NO: 115964 - DNA, 20 bp, human
gggttggtgagttacctttc

SEQ ID NO: 115965 - DNA, 20 bp, human
gtgaagtgtatgtgcactgt

SEQ ID NO: 115966 - DNA, 20 bp, human
gagtgggcatgtagatcagt

SEQ ID NO: 115967 - DNA, 20 bp, human
gagacctaggtgatactgat

SEQ ID NO: 115968 - DNA, 20 bp, human
gtgaagcggcagatggacaa

SEQ ID NO: 115969 - DNA, 20 bp, human
gatcggtagctggtatccaa

SEQ ID NO: 115970 - DNA, 20 bp, human
ggatggtagacagcttcaag

SEQ ID NO: 115971 - DNA, 20 bp, human
gctgaggggatcagatagtt

SEQ ID NO: 115972 - DNA, 20 bp, human
gatgcgttgacatcagaggc

SEQ ID NO: 115973 - DNA, 20 bp, human
ggcttcaagtggtactcggt

SEQ ID NO: 115974 - DNA, 20 bp, human
gagatgtgttgggtttactg

SEQ ID NO: 115975 - DNA, 20 bp, human
gagattcttgagacatcctt

SEQ ID NO: 115976 - DNA, 20 bp, human
gctcctatgcacgggacaca

SEQ ID NO: 115977 - DNA, 20 bp, human
gataaacaggaaggacctgt

SEQ ID NO: 115978 - DNA, 20 bp, human
gcccaaaggagaggacctgg

SEQ ID NO: 115979 - DNA, 20 bp, human
gcttccattgcatcattcac

SEQ ID NO: 115980 - DNA, 20 bp, human
ggcctcctctggcccgaagt

SEQ ID NO: 115981 - DNA, 20 bp, human
ggtaggtggacaggcgacag

SEQ ID NO: 115982 - DNA, 20 bp, human
ggtgctgagagccaacctcc

SEQ ID NO: 115983 - DNA, 20 bp, human
gagccccaaaggagaggacc

SEQ ID NO: 115984 - DNA, 20 bp, human
gacctacttggaagaactcg

SEQ ID NO: 115985 - DNA, 20 bp, human
gttgcatcattcacaggcag

SEQ ID NO: 115986 - DNA, 20 bp, human
gcaacggtggtaccaaccaa

SEQ ID NO: 115987 - DNA, 20 bp, human
ggatccagggccatcaggta

SEQ ID NO: 115988 - DNA, 20 bp, human
gtaaggcagaagcccttggt

SEQ ID NO: 115989 - DNA, 20 bp, human
gtaatcacctgccccaacgg

SEQ ID NO: 115990 - DNA, 20 bp, human
gtccagctgatactgatcca

SEQ ID NO: 115991 - DNA, 20 bp, human
gctgtaatcacctgccccaa

SEQ ID NO: 115992 - DNA, 20 bp, human
gtgaccccacaaaaacccag

SEQ ID NO: 115993 - DNA, 20 bp, human
gatactgatccagggccatc

SEQ ID NO: 115994 - DNA, 20 bp, human
gcttctggtcggccccccag

SEQ ID NO: 115995 - DNA, 20 bp, human
gtgagagtcctcaagaagga

SEQ ID NO: 115996 - DNA, 20 bp, human
ggaggacgcaccagcattaa

SEQ ID NO: 115997 - DNA, 20 bp, human
ggtcccaggacactgaggag

SEQ ID NO: 115998 - DNA, 20 bp, human
gtgcgggcgctcgggggata

SEQ ID NO: 115999 - DNA, 20 bp, human
gcccagggccctaaaagctt

SEQ ID NO: 116000 - DNA, 20 bp, human
ggcgctcgggggataaggcg

SEQ ID NO: 116001 - DNA, 20 bp, human
ggcgatgctagctagtgcca

SEQ ID NO: 116002 - DNA, 20 bp, human
ggcccgcgcaggaatgccag

SEQ ID NO: 116003 - DNA, 20 bp, human
ggcaccagcattaatggaat

SEQ ID NO: 116004 - DNA, 20 bp, human
gtgaggtgcccattccgcca

SEQ ID NO: 116005 - DNA, 20 bp, human
ggctagtgccagggctagtg

SEQ ID NO: 116006 - DNA, 20 bp, human
gggctggtctcagtccgcct

SEQ ID NO: 116007 - DNA, 20 bp, human
gtctaataaggcttctctct

SEQ ID NO: 116008 - DNA, 20 bp, human
gggttgagaaagctctaata

SEQ ID NO: 116009 - DNA, 20 bp, human
gtactcgccggcggagatga

SEQ ID NO: 116010 - DNA, 20 bp, human
gaacacctggccctactcgc

SEQ ID NO: 116011 - DNA, 20 bp, human
gtgggaggtgagtagctctc

SEQ ID NO: 116012 - DNA, 20 bp, human
ggccccgagggccaatcaca

SEQ ID NO: 116013 - DNA, 20 bp, human
gctgcagccctcatctccgc

SEQ ID NO: 116014 - DNA, 20 bp, human
gacctggccctactcgccgg

SEQ ID NO: 116015 - DNA, 20 bp, human
gtccgccggcgagtagggcc

SEQ ID NO: 116016 - DNA, 20 bp, human
gagagcagtcacctcaggat

SEQ ID NO: 116017 - DNA, 20 bp, human
gtgtcgcccacactgccccg

SEQ ID NO: 116018 - DNA, 20 bp, human
gctcccctgggagggatact

SEQ ID NO: 116019 - DNA, 20 bp, human
ggcctcaggaacagctagag

SEQ ID NO: 116020 - DNA, 20 bp, human
gccagctccgcggggcagtg

SEQ ID NO: 116021 - DNA, 20 bp, human
ggcaaatctgctgaagtcgt

SEQ ID NO: 116022 - DNA, 20 bp, human
gaagtcgtgggtgtaaacta

SEQ ID NO: 116023 - DNA, 20 bp, human
gctgggtaagtccagctccg

SEQ ID NO: 116024 - DNA, 20 bp, human
ggttcctgaggctggcatct

SEQ ID NO: 116025 - DNA, 20 bp, human
ggtgctggtgttagggtgga

SEQ ID NO: 116026 - DNA, 20 bp, human
gaactcactacaccattcac

SEQ ID NO: 116027 - DNA, 20 bp, human
ggtgtatcctgagtcagtga

SEQ ID NO: 116028 - DNA, 20 bp, human
gtcacgggtatattgtctac

SEQ ID NO: 116029 - DNA, 20 bp, human
gctctgctattcaatcagga

SEQ ID NO: 116030 - DNA, 20 bp, human
gagacttgctggaccataag

SEQ ID NO: 116031 - DNA, 20 bp, human
gtcagctctgctattcaatc

SEQ ID NO: 116032 - DNA, 20 bp, human
gggccatcatcagcttcatc

SEQ ID NO: 116033 - DNA, 20 bp, human
gtgatcattcaaggaccaca

SEQ ID NO: 116034 - DNA, 20 bp, human
gctcttgccctcactgactc

SEQ ID NO: 116035 - DNA, 20 bp, human
ggtggcccccaggccaaacc

SEQ ID NO: 116036 - DNA, 20 bp, human
gcctcataggtaactctaag

SEQ ID NO: 116037 - DNA, 20 bp, human
gacctccctggagaagtaat

SEQ ID NO: 116038 - DNA, 20 bp, human
gtgcagcagaacactccccg

SEQ ID NO: 116039 - DNA, 20 bp, human
gttgcaggaggacttgaact

SEQ ID NO: 116040 - DNA, 20 bp, human
ggtccctggacaactgtcat

SEQ ID NO: 116041 - DNA, 20 bp, human
gcagacagcagcgagggcag

SEQ ID NO: 116042 - DNA, 20 bp, human
gtgtcatggtaccaaggctg

SEQ ID NO: 116043 - DNA, 20 bp, human
gaagaggctgtcgacgcacg

SEQ ID NO: 116044 - DNA, 20 bp, human
gtccgtgtgtcatggtacca

SEQ ID NO: 116045 - DNA, 20 bp, human
gttgcagcagacagcagcga

SEQ ID NO: 116046 - DNA, 20 bp, human
gcccccagcgagagacccac

SEQ ID NO: 116047 - DNA, 20 bp, human
gtgcgcgacgtgggcccgga

SEQ ID NO: 116048 - DNA, 20 bp, human
gctccgggaagcgggaagga

SEQ ID NO: 116049 - DNA, 20 bp, human
ggacggacgcagcatcccgt

SEQ ID NO: 116050 - DNA, 20 bp, human
gcacgtcgcgcagcttgtgg

SEQ ID NO: 116051 - DNA, 20 bp, human
gggctccgggccgtagaact

SEQ ID NO: 116052 - DNA, 20 bp, human
ggcgagagacccaccggaca

SEQ ID NO: 116053 - DNA, 20 bp, human
gagctgctccgcgaggtcca

SEQ ID NO: 116054 - DNA, 20 bp, human
gacgcagcatcccgtggggg

SEQ ID NO: 116055 - DNA, 20 bp, human
gggcggcgcagctccaggag

SEQ ID NO: 116056 - DNA, 20 bp, human
gtctttgtcttctcgtttaa

SEQ ID NO: 116057 - DNA, 20 bp, human
gggaaacggataaaaagggg

SEQ ID NO: 116058 - DNA, 20 bp, human
gcaaaggaaacggataaaaa

SEQ ID NO: 116059 - DNA, 20 bp, human
ggtgtttcctgcaaaggaaa

SEQ ID NO: 116060 - DNA, 20 bp, human
ggcaccaaccattaaggctt

SEQ ID NO: 116061 - DNA, 20 bp, human
gcttcccaagccttaatggt

SEQ ID NO: 116062 - DNA, 20 bp, human
gtggcccttggtacgctagg

SEQ ID NO: 116063 - DNA, 20 bp, human
gcgcctggcctaatgtctta

SEQ ID NO: 116064 - DNA, 20 bp, human
ggtccttaagacattaggcc

SEQ ID NO: 116065 - DNA, 20 bp, human
gttggtgcgaggatgctgga

SEQ ID NO: 116066 - DNA, 20 bp, human
gtaacctaaggtctcatact

SEQ ID NO: 116067 - DNA, 20 bp, human
gctgcagagtccactctagc

SEQ ID NO: 116068 - DNA, 20 bp, human
gaagaccccatggtctgagg

SEQ ID NO: 116069 - DNA, 20 bp, human
gcagaagaccccatggtctg

SEQ ID NO: 116070 - DNA, 20 bp, human
ggaggctgatggcaagaaac

SEQ ID NO: 116071 - DNA, 20 bp, human
gtcttccacctcagaccatg

SEQ ID NO: 116072 - DNA, 20 bp, human
gcgtgctacagaagacccca

SEQ ID NO: 116073 - DNA, 20 bp, human
ggatgggtaagtagaacctg

SEQ ID NO: 116074 - DNA, 20 bp, human
gaggggaaaagcccataaaa

SEQ ID NO: 116075 - DNA, 20 bp, human
gtctgtagcacgtcttcgag

SEQ ID NO: 116076 - DNA, 20 bp, human
ggatctggtggataaagtgg

SEQ ID NO: 116077 - DNA, 20 bp, human
gtagtccgcagagagataaa

SEQ ID NO: 116078 - DNA, 20 bp, human
gcacgataaagacaaccgat

SEQ ID NO: 116079 - DNA, 20 bp, human
gtactgactgagctcagtac

SEQ ID NO: 116080 - DNA, 20 bp, human
gggtagcaagagaatgtcca

SEQ ID NO: 116081 - DNA, 20 bp, human
ggaaccgttgtagctcctca

SEQ ID NO: 116082 - DNA, 20 bp, human
gatatgagaactgtgagtgg

SEQ ID NO: 116083 - DNA, 20 bp, human
ggtctttatcgtggacactg

SEQ ID NO: 116084 - DNA, 20 bp, human
gtaaatggtgagtgttgatc

SEQ ID NO: 116085 - DNA, 20 bp, human
gccagctggctgtctcgacc

SEQ ID NO: 116086 - DNA, 20 bp, human
gtcacaatcctggggcgata

SEQ ID NO: 116087 - DNA, 20 bp, human
gtaggaagagttgcaggcca

SEQ ID NO: 116088 - DNA, 20 bp, human
ggccccaggattgtgaactg

SEQ ID NO: 116089 - DNA, 20 bp, human
ggccagggctgttcatatgt

SEQ ID NO: 116090 - DNA, 20 bp, human
gtgaactgaggtgtctccag

SEQ ID NO: 116091 - DNA, 20 bp, human
gtgagaatgtgtgtgggtca

SEQ ID NO: 116092 - DNA, 20 bp, human
ggcccacatatgaacagccc

SEQ ID NO: 116093 - DNA, 20 bp, human
ggattctgccatatcgcccc

SEQ ID NO: 116094 - DNA, 20 bp, human
gtgtgggccagcgatgaact

SEQ ID NO: 116095 - DNA, 20 bp, human
ggggtcaaggtgagagttga

SEQ ID NO: 116096 - DNA, 20 bp, human
gctgcagagggcagtactag

SEQ ID NO: 116097 - DNA, 20 bp, human
gatcccggccgagaacgaga

SEQ ID NO: 116098 - DNA, 20 bp, human
ggggacgatggcgggacggg

SEQ ID NO: 116099 - DNA, 20 bp, human
ggcccgcggggatggaggca

SEQ ID NO: 116100 - DNA, 20 bp, human
gggtggcctcgggaacgcag

SEQ ID NO: 116101 - DNA, 20 bp, human
gcccgaggccacccgaaagt

SEQ ID NO: 116102 - DNA, 20 bp, human
gggagctgggcgctgaatgg

SEQ ID NO: 116103 - DNA, 20 bp, human
gggggggacgatggcgggac

SEQ ID NO: 116104 - DNA, 20 bp, human
gctcggccgggatctccccg

SEQ ID NO: 116105 - DNA, 20 bp, human
ggacggagctgggcgctgaa

SEQ ID NO: 116106 - DNA, 20 bp, human
gcaccggccaaacaggggcc

SEQ ID NO: 116107 - DNA, 20 bp, human
gtaaggtaaggggcaccggc

SEQ ID NO: 116108 - DNA, 20 bp, human
gaagtctcgcctaaggtaag

SEQ ID NO: 116109 - DNA, 20 bp, human
ggcgcgcccgaacgaagccg

SEQ ID NO: 116110 - DNA, 20 bp, human
ggcgcagccagtttaagaca

SEQ ID NO: 116111 - DNA, 20 bp, human
gccgggccgcggcttcgttc

SEQ ID NO: 116112 - DNA, 20 bp, human
gccccccgcccgccgggcca

SEQ ID NO: 116113 - DNA, 20 bp, human
gcatggctgtgcccgggccg

SEQ ID NO: 116114 - DNA, 20 bp, human
gttcggttaagtctcgccta

SEQ ID NO: 116115 - DNA, 20 bp, human
gtgcagcaaaaacacaccag

SEQ ID NO: 116116 - DNA, 20 bp, human
ggagggacgggatcacacag

SEQ ID NO: 116117 - DNA, 20 bp, human
gccggtggtcaccgagaggt

SEQ ID NO: 116118 - DNA, 20 bp, human
gcgtgggcgttcagtcctca

SEQ ID NO: 116119 - DNA, 20 bp, human
gccaccggcgcgaatgagag

SEQ ID NO: 116120 - DNA, 20 bp, human
gcctaagagttcaggacctg

SEQ ID NO: 116121 - DNA, 20 bp, human
gtcatcctggcgctgtccag

SEQ ID NO: 116122 - DNA, 20 bp, human
ggggccgcagctgaaatccc

SEQ ID NO: 116123 - DNA, 20 bp, human
ggagcggttccgttcccgag

SEQ ID NO: 116124 - DNA, 20 bp, human
gagcggagcgcccgagtgtg

SEQ ID NO: 116125 - DNA, 20 bp, human
ggcctcggacgggaccacca

SEQ ID NO: 116126 - DNA, 20 bp, human
gtccaaccctggacgaccaa

SEQ ID NO: 116127 - DNA, 20 bp, human
gccaagggcgaggtcagctc

SEQ ID NO: 116128 - DNA, 20 bp, human
gcaggtgagatggaggtcag

SEQ ID NO: 116129 - DNA, 20 bp, human
ggctcgcgagatcttctctg

SEQ ID NO: 116130 - DNA, 20 bp, human
gtacagaacgatggagtata

SEQ ID NO: 116131 - DNA, 20 bp, human
gtggtctggaggcgcgaagt

SEQ ID NO: 116132 - DNA, 20 bp, human
gcctcgcccttggtcgtcca

SEQ ID NO: 116133 - DNA, 20 bp, human
gggttggagcccaggtgaga

SEQ ID NO: 116134 - DNA, 20 bp, human
ggtcccgtcagctgccaacc

SEQ ID NO: 116135 - DNA, 20 bp, human
gagccaggttggcagctgac

SEQ ID NO: 116136 - DNA, 20 bp, human
gcaagtgctgcgaaccacgt

SEQ ID NO: 116137 - DNA, 20 bp, human
gaacgcgcccgggacccacg

SEQ ID NO: 116138 - DNA, 20 bp, human
gtgcgaaccacgtgggtccc

SEQ ID NO: 116139 - DNA, 20 bp, human
ggaaaggcggccaccgacaa

SEQ ID NO: 116140 - DNA, 20 bp, human
gtgtgtcaccgggaccgatg

SEQ ID NO: 116141 - DNA, 20 bp, human
gcaaacctaagcagctggaa

SEQ ID NO: 116142 - DNA, 20 bp, human
ggcggcgaggaggatcggat

SEQ ID NO: 116143 - DNA, 20 bp, human
gggcgcgtttcgggtgctgg

SEQ ID NO: 116144 - DNA, 20 bp, human
ggcagtgccgggcacggagt

SEQ ID NO: 116145 - DNA, 20 bp, human
gtggacaagtgcagaccggt

SEQ ID NO: 116146 - DNA, 20 bp, human
gatgaaggtacgctcacagt

SEQ ID NO: 116147 - DNA, 20 bp, human
ggaccccgctggaccccatc

SEQ ID NO: 116148 - DNA, 20 bp, human
ggtacgctcacagttggcca

SEQ ID NO: 116149 - DNA, 20 bp, human
gtctggtttgatcgcaatga

SEQ ID NO: 116150 - DNA, 20 bp, human
gaaacaacctgtctcaaagg

SEQ ID NO: 116151 - DNA, 20 bp, human
gaagatgtagccaaacgcta

SEQ ID NO: 116152 - DNA, 20 bp, human
gcacagttggccatggttct

SEQ ID NO: 116153 - DNA, 20 bp, human
gctctcccacaagaccccgc

SEQ ID NO: 116154 - DNA, 20 bp, human
gattgcgatcaaaccagatg

SEQ ID NO: 116155 - DNA, 20 bp, human
ggaatttcagaccaacaagg

SEQ ID NO: 116156 - DNA, 20 bp, human
ggaacgggaggagtcgccag

SEQ ID NO: 116157 - DNA, 20 bp, human
gtggtgcgaccaccacaccc

SEQ ID NO: 116158 - DNA, 20 bp, human
gcgccttaccgggaagctgg

SEQ ID NO: 116159 - DNA, 20 bp, human
gggacctgcgggaaatcggg

SEQ ID NO: 116160 - DNA, 20 bp, human
gtcctgcggggcgagaggtg

SEQ ID NO: 116161 - DNA, 20 bp, human
gtcatcgccatcaagccgga

SEQ ID NO: 116162 - DNA, 20 bp, human
gcgcggggcgcaagctgcaa

SEQ ID NO: 116163 - DNA, 20 bp, human
gggttggccatggtcctgcg

SEQ ID NO: 116164 - DNA, 20 bp, human
gaagcggaagagggaacggg

SEQ ID NO: 116165 - DNA, 20 bp, human
gcccctccagcttcccggta

SEQ ID NO: 116166 - DNA, 20 bp, human
ggaacgggaggagtcgccag

SEQ ID NO: 116167 - DNA, 20 bp, human
gtggtgcgaccaccacaccc

SEQ ID NO: 116168 - DNA, 20 bp, human
gcgccttaccgggaagctgg

SEQ ID NO: 116169 - DNA, 20 bp, human
gggacctgcgggaaatcggg

SEQ ID NO: 116170 - DNA, 20 bp, human
gtcctgcggggcgagaggtg

SEQ ID NO: 116171 - DNA, 20 bp, human
gtcatcgccatcaagccgga

SEQ ID NO: 116172 - DNA, 20 bp, human
gcgcggggcgcaagctgcaa

SEQ ID NO: 116173 - DNA, 20 bp, human
gggttggccatggtcctgcg

SEQ ID NO: 116174 - DNA, 20 bp, human
gaagcggaagagggaacggg

SEQ ID NO: 116175 - DNA, 20 bp, human
gcccctccagcttcccggta

SEQ ID NO: 116176 - DNA, 20 bp, human
gggaggccatatacttgaca

SEQ ID NO: 116177 - DNA, 20 bp, human
gtgcggcgcttcgagaggaa

SEQ ID NO: 116178 - DNA, 20 bp, human
gtgacaaggcggccgtagaa

SEQ ID NO: 116179 - DNA, 20 bp, human
gagcgaagatggtcagcacc

SEQ ID NO: 116180 - DNA, 20 bp, human
gcgtcaggccggcccagcac

SEQ ID NO: 116181 - DNA, 20 bp, human
gtcctcggaggcctgcggaa

SEQ ID NO: 116182 - DNA, 20 bp, human
gcgccgcgcggctcacccgc

SEQ ID NO: 116183 - DNA, 20 bp, human
ggctggtgggcgagattgtg

SEQ ID NO: 116184 - DNA, 20 bp, human
ggagaggaagggcttcaagt

SEQ ID NO: 116185 - DNA, 20 bp, human
gacccttccgcaggcctccg

SEQ ID NO: 116186 - DNA, 20 bp, human
gcagcgcggagcgccagaag

SEQ ID NO: 116187 - DNA, 20 bp, human
gcccgcgggccgggcgtcat

SEQ ID NO: 116188 - DNA, 20 bp, human
ggcgggccgggcgtcatggg

SEQ ID NO: 116189 - DNA, 20 bp, human
ggggcccgggagcgcaagga

SEQ ID NO: 116190 - DNA, 20 bp, human
gggccggctgcagcactggg

SEQ ID NO: 116191 - DNA, 20 bp, human
gcgcgccccgaggcctctgg

SEQ ID NO: 116192 - DNA, 20 bp, human
gagccggacgggcactggag

SEQ ID NO: 116193 - DNA, 20 bp, human
gaggagccgcagagccggac

SEQ ID NO: 116194 - DNA, 20 bp, human
gcgtcatgggcggcctcttc

SEQ ID NO: 116195 - DNA, 20 bp, human
gccgctcctcgcgctcacag

SEQ ID NO: 116196 - DNA, 20 bp, human
gggacagggtcgcttcacag

SEQ ID NO: 116197 - DNA, 20 bp, human
gcatatgaggacggccgctg

SEQ ID NO: 116198 - DNA, 20 bp, human
gctctaagtactcacctcag

SEQ ID NO: 116199 - DNA, 20 bp, human
gccaaggcaggaaggactat

SEQ ID NO: 116200 - DNA, 20 bp, human
gcaacaagttgtaccatatg

SEQ ID NO: 116201 - DNA, 20 bp, human
gagccaccgtccccacgctg

SEQ ID NO: 116202 - DNA, 20 bp, human
ggacctgaagccccagcgtg

SEQ ID NO: 116203 - DNA, 20 bp, human
gtatgggctcacataaccag

SEQ ID NO: 116204 - DNA, 20 bp, human
gggctcgatttggacatagt

SEQ ID NO: 116205 - DNA, 20 bp, human
gaagttgtaccatatgagga

SEQ ID NO: 116206 - DNA, 20 bp, human
gtgcagcagaagtccggctg

SEQ ID NO: 116207 - DNA, 20 bp, human
gccggacttctgctgcactg

SEQ ID NO: 116208 - DNA, 20 bp, human
ggccgcgcgtgggtggacca

SEQ ID NO: 116209 - DNA, 20 bp, human
gtatccagcgtggcgcctgg

SEQ ID NO: 116210 - DNA, 20 bp, human
gctggagggcgtggccacgg

SEQ ID NO: 116211 - DNA, 20 bp, human
gtccgaatgacccagaatct

SEQ ID NO: 116212 - DNA, 20 bp, human
gtgcaggcctagagaagtag

SEQ ID NO: 116213 - DNA, 20 bp, human
gcttaggccccgggtacgag

SEQ ID NO: 116214 - DNA, 20 bp, human
ggcaggtcccggccgcgcgt

SEQ ID NO: 116215 - DNA, 20 bp, human
gttgccgcggacgggacgag

SEQ ID NO: 116216 - DNA, 20 bp, human
gagtaaccgtatgatggtgg

SEQ ID NO: 116217 - DNA, 20 bp, human
ggatctcagcactagaaaat

SEQ ID NO: 116218 - DNA, 20 bp, human
gctgagtaaccgtatgatgg

SEQ ID NO: 116219 - DNA, 20 bp, human
ggactgcaggaacagcccgt

SEQ ID NO: 116220 - DNA, 20 bp, human
gtgcctgagtaaccgtatga

SEQ ID NO: 116221 - DNA, 20 bp, human
gccacgcctcgtgcgacagt

SEQ ID NO: 116222 - DNA, 20 bp, human
gaaataggtatcgttgagac

SEQ ID NO: 116223 - DNA, 20 bp, human
gggaacagcccgtgggaagg

SEQ ID NO: 116224 - DNA, 20 bp, human
gtggcactcaccattgtctc

SEQ ID NO: 116225 - DNA, 20 bp, human
gcgcctcgtgcgacagtggg

SEQ ID NO: 116226 - DNA, 20 bp, human
ggctcaaacggccacaacga

SEQ ID NO: 116227 - DNA, 20 bp, human
gtcccagtctagcttagagg

SEQ ID NO: 116228 - DNA, 20 bp, human
gcaggggcggtgtagaacag

SEQ ID NO: 116229 - DNA, 20 bp, human
gttgggaggataagatagtg

SEQ ID NO: 116230 - DNA, 20 bp, human
gtcctcctctaagctagact

SEQ ID NO: 116231 - DNA, 20 bp, human
gccctattcagtggtatcag

SEQ ID NO: 116232 - DNA, 20 bp, human
gaggcccagaggatctaaat

SEQ ID NO: 116233 - DNA, 20 bp, human
gggacgtttaaagaaaagga

SEQ ID NO: 116234 - DNA, 20 bp, human
gaccttgcttcaggactgtt

SEQ ID NO: 116235 - DNA, 20 bp, human
gactgggacgtttaaagaaa

SEQ ID NO: 116236 - DNA, 20 bp, human
gaggtcgcggcagactcggt

SEQ ID NO: 116237 - DNA, 20 bp, human
ggacgaccgcggctaggtcg

SEQ ID NO: 116238 - DNA, 20 bp, human
gggcttgctgatccacgcag

SEQ ID NO: 116239 - DNA, 20 bp, human
ggtgagccactgcgaacgac

SEQ ID NO: 116240 - DNA, 20 bp, human
gggctaggtcgcggcagact

SEQ ID NO: 116241 - DNA, 20 bp, human
ggcccacggccgcggtaaca

SEQ ID NO: 116242 - DNA, 20 bp, human
gcaggttgccatgacgaccg

SEQ ID NO: 116243 - DNA, 20 bp, human
gttgtacctgtcgttcgcag

SEQ ID NO: 116244 - DNA, 20 bp, human
gcagactcggttggtgactc

SEQ ID NO: 116245 - DNA, 20 bp, human
ggtcttctttgcagagccat

SEQ ID NO: 116246 - DNA, 20 bp, human
gggccacgccgccttcgagg

SEQ ID NO: 116247 - DNA, 20 bp, human
gaggtgcgccccctcgaagg

SEQ ID NO: 116248 - DNA, 20 bp, human
gagcaggtgcgccccctcga

SEQ ID NO: 116249 - DNA, 20 bp, human
gtgcagtctctgggccgtca

SEQ ID NO: 116250 - DNA, 20 bp, human
gcgggcggacgcgggtgagt

SEQ ID NO: 116251 - DNA, 20 bp, human
gcgctgctgttttccgggaa

SEQ ID NO: 116252 - DNA, 20 bp, human
ggctgcccgcagccgagtcg

SEQ ID NO: 116253 - DNA, 20 bp, human
ggaaacgccggaaccccggg

SEQ ID NO: 116254 - DNA, 20 bp, human
gggcccgctgtgcagtctct

SEQ ID NO: 116255 - DNA, 20 bp, human
gcctgaaacgccggaacccc

SEQ ID NO: 116256 - DNA, 20 bp, human
gccgggccgctggtgatctc

SEQ ID NO: 116257 - DNA, 20 bp, human
gccgccggcccgagtgctac

SEQ ID NO: 116258 - DNA, 20 bp, human
gtgctaccggagatcaccag

SEQ ID NO: 116259 - DNA, 20 bp, human
gtcgggccggcggacagtga

SEQ ID NO: 116260 - DNA, 20 bp, human
ggtgatctccggtagcactc

SEQ ID NO: 116261 - DNA, 20 bp, human
gtctccggtagcactcgggc

SEQ ID NO: 116262 - DNA, 20 bp, human
ggccagcgagtggaacatct

SEQ ID NO: 116263 - DNA, 20 bp, human
gccggcggacagtgagggcg

SEQ ID NO: 116264 - DNA, 20 bp, human
ggcgcggtaagctccccgca

SEQ ID NO: 116265 - DNA, 20 bp, human
ggacggctgggcgtcagagg

SEQ ID NO: 116266 - DNA, 20 bp, human
gagataccagaactggagtg

SEQ ID NO: 116267 - DNA, 20 bp, human
gcaacgagacacaaaaagag

SEQ ID NO: 116268 - DNA, 20 bp, human
gctcgcagggggccaaaggt

SEQ ID NO: 116269 - DNA, 20 bp, human
gcaggcgagcaagataacgt

SEQ ID NO: 116270 - DNA, 20 bp, human
ggtccttcgcggtggtctag

SEQ ID NO: 116271 - DNA, 20 bp, human
gctggcgaagaccgggatgg

SEQ ID NO: 116272 - DNA, 20 bp, human
gggtgcagatgggtccttcg

SEQ ID NO: 116273 - DNA, 20 bp, human
ggcagatgggtccttcgcgg

SEQ ID NO: 116274 - DNA, 20 bp, human
gccggcccacccctccgaag

SEQ ID NO: 116275 - DNA, 20 bp, human
gtaccaggctggcgaagacc

SEQ ID NO: 116276 - DNA, 20 bp, human
gcggagtgcggagccatccg

SEQ ID NO: 116277 - DNA, 20 bp, human
gccgctggggcgacaggtgg

SEQ ID NO: 116278 - DNA, 20 bp, human
gagggcccgccccagcgaag

SEQ ID NO: 116279 - DNA, 20 bp, human
gatctgcccggggccgctaa

SEQ ID NO: 116280 - DNA, 20 bp, human
gcggttcgcgccaccccgga

SEQ ID NO: 116281 - DNA, 20 bp, human
gagtgcggagccatccgggg

SEQ ID NO: 116282 - DNA, 20 bp, human
gcccctagtacctgagctgg

SEQ ID NO: 116283 - DNA, 20 bp, human
gactcccaggactcagttag

SEQ ID NO: 116284 - DNA, 20 bp, human
gcggggtggcgcgaaccggg

SEQ ID NO: 116285 - DNA, 20 bp, human
gtccccgctggggcgacagg

SEQ ID NO: 116286 - DNA, 20 bp, human
gagcggcgctctgccaggtg

SEQ ID NO: 116287 - DNA, 20 bp, human
gctcgatgcatagacaatgg

SEQ ID NO: 116288 - DNA, 20 bp, human
ggacgctgggcttccgtgag

SEQ ID NO: 116289 - DNA, 20 bp, human
ggccgacacgtcgggattgg

SEQ ID NO: 116290 - DNA, 20 bp, human
gaggcgccctggctctgcaa

SEQ ID NO: 116291 - DNA, 20 bp, human
gcacggaagcccagcgtcgg

SEQ ID NO: 116292 - DNA, 20 bp, human
gggcccaagggacacgaggt

SEQ ID NO: 116293 - DNA, 20 bp, human
gttcccgccaggagcgacaa

SEQ ID NO: 116294 - DNA, 20 bp, human
ggcggccgagtccactgcag

SEQ ID NO: 116295 - DNA, 20 bp, human
gatcgggcccaagggacacg

SEQ ID NO: 116296 - DNA, 20 bp, human
gttagagggatgccaggtag

SEQ ID NO: 116297 - DNA, 20 bp, human
gtctggtgaccgcccctacc

SEQ ID NO: 116298 - DNA, 20 bp, human
gcagcctggagaagtcgcca

SEQ ID NO: 116299 - DNA, 20 bp, human
gctaacccaggaggagcgtg

SEQ ID NO: 116300 - DNA, 20 bp, human
gggcgccgagagtagagaaa

SEQ ID NO: 116301 - DNA, 20 bp, human
gggaggacgtgtactcatgg

SEQ ID NO: 116302 - DNA, 20 bp, human
gcctgggttagagggatgcc

SEQ ID NO: 116303 - DNA, 20 bp, human
gccccgccccgccccaacgg

SEQ ID NO: 116304 - DNA, 20 bp, human
gccggaataatcctgaaaat

SEQ ID NO: 116305 - DNA, 20 bp, human
ggtcatcaccccaacgctag

SEQ ID NO: 116306 - DNA, 20 bp, human
gccggcatgaagctcatcgt

SEQ ID NO: 116307 - DNA, 20 bp, human
gttccaaggcagcccgggta

SEQ ID NO: 116308 - DNA, 20 bp, human
ggcggcggggacgacttcca

SEQ ID NO: 116309 - DNA, 20 bp, human
ggcttcatgccggtgcggag

SEQ ID NO: 116310 - DNA, 20 bp, human
ggcgtggtcgcaccctaccc

SEQ ID NO: 116311 - DNA, 20 bp, human
ggtgtccccagtgggaaggg

SEQ ID NO: 116312 - DNA, 20 bp, human
ggcggcgtgtaggtgacctc

SEQ ID NO: 116313 - DNA, 20 bp, human
gtgcgctccggagtgcgtcc

SEQ ID NO: 116314 - DNA, 20 bp, human
gatgaagccgggacgcactc

SEQ ID NO: 116315 - DNA, 20 bp, human
gcctgcactctgacctcggg

SEQ ID NO: 116316 - DNA, 20 bp, human
gcatgttcaggacatcccta

SEQ ID NO: 116317 - DNA, 20 bp, human
gctccttgctggccacagac

SEQ ID NO: 116318 - DNA, 20 bp, human
gagacaggtgctgctaggac

SEQ ID NO: 116319 - DNA, 20 bp, human
ggacagaccttgatccccca

SEQ ID NO: 116320 - DNA, 20 bp, human
gctgatcagatgcaggacag

SEQ ID NO: 116321 - DNA, 20 bp, human
ggcatttccccaaggtccac

SEQ ID NO: 116322 - DNA, 20 bp, human
ggccacagacaggtgctgct

SEQ ID NO: 116323 - DNA, 20 bp, human
gtgaagggaaaggcacttcc

SEQ ID NO: 116324 - DNA, 20 bp, human
gccaagatgagagggaactg

SEQ ID NO: 116325 - DNA, 20 bp, human
gttcaggacatccctagggc

SEQ ID NO: 116326 - DNA, 20 bp, human
gctctcgcaactcaagatgg

SEQ ID NO: 116327 - DNA, 20 bp, human
ggagacagcagtgaagccgc

SEQ ID NO: 116328 - DNA, 20 bp, human
ggctgccgcagatgatggaa

SEQ ID NO: 116329 - DNA, 20 bp, human
gcgttcccttccatcatctg

SEQ ID NO: 116330 - DNA, 20 bp, human
gctgctctcgcaactcaaga

SEQ ID NO: 116331 - DNA, 20 bp, human
gtcctgggaaaagagcatgt

SEQ ID NO: 116332 - DNA, 20 bp, human
gtggggtgcggggaagtcac

SEQ ID NO: 116333 - DNA, 20 bp, human
gatggcctgaagcacacgag

SEQ ID NO: 116334 - DNA, 20 bp, human
gccgcgccccactacatggg

SEQ ID NO: 116335 - DNA, 20 bp, human
gcctccgctgccgcagatga

SEQ ID NO: 116336 - DNA, 20 bp, human
gtacggcgggaggcactaga

SEQ ID NO: 116337 - DNA, 20 bp, human
ggctccgactccaagcagta

SEQ ID NO: 116338 - DNA, 20 bp, human
gctccaagcagtacggcggg

SEQ ID NO: 116339 - DNA, 20 bp, human
ggcgccccggacctcaccat

SEQ ID NO: 116340 - DNA, 20 bp, human
gctgtcctccgccatcgcgg

SEQ ID NO: 116341 - DNA, 20 bp, human
ggcggccgccacaaagggaa

SEQ ID NO: 116342 - DNA, 20 bp, human
gacccccgaacgggagaccg

SEQ ID NO: 116343 - DNA, 20 bp, human
gccgactccaagcagtacgg

SEQ ID NO: 116344 - DNA, 20 bp, human
ggcccgcgggtggctccggt

SEQ ID NO: 116345 - DNA, 20 bp, human
gcggagcacgccaaagggta

SEQ ID NO: 116346 - DNA, 20 bp, human
gggcacaggtcgcctcccca

SEQ ID NO: 116347 - DNA, 20 bp, human
gtgggaggcgggaaaccccg

SEQ ID NO: 116348 - DNA, 20 bp, human
gccagggcaactagcgacgt

SEQ ID NO: 116349 - DNA, 20 bp, human
ggcgtagctggtgctccacc

SEQ ID NO: 116350 - DNA, 20 bp, human
gactagcgacgtaggagcaa

SEQ ID NO: 116351 - DNA, 20 bp, human
gcgatagatggagactggta

SEQ ID NO: 116352 - DNA, 20 bp, human
gcgctgggcatcaacgagca

SEQ ID NO: 116353 - DNA, 20 bp, human
ggtcgctagttgccctgggg

SEQ ID NO: 116354 - DNA, 20 bp, human
gggccagggccgaaataccc

SEQ ID NO: 116355 - DNA, 20 bp, human
gtgcgggaggctcggtgcta

SEQ ID NO: 116356 - DNA, 20 bp, human
gagggtgtggggctcaatag

SEQ ID NO: 116357 - DNA, 20 bp, human
ggacgcggcgcgggagccag

SEQ ID NO: 116358 - DNA, 20 bp, human
gcgagcgacggacacagacg

SEQ ID NO: 116359 - DNA, 20 bp, human
gccgctgtcagtcagtccac

SEQ ID NO: 116360 - DNA, 20 bp, human
gcccgcggcccgcgagaccc

SEQ ID NO: 116361 - DNA, 20 bp, human
gtctgtgtccgtcgctcgga

SEQ ID NO: 116362 - DNA, 20 bp, human
ggctcggagggtggaagccg

SEQ ID NO: 116363 - DNA, 20 bp, human
gcttggcactgccagttctg

SEQ ID NO: 116364 - DNA, 20 bp, human
gcgcctgcgcacctaccatg

SEQ ID NO: 116365 - DNA, 20 bp, human
ggtggggctcaatagaggag

SEQ ID NO: 116366 - DNA, 20 bp, human
gaagcagtcacgaaagtcac

SEQ ID NO: 116367 - DNA, 20 bp, human
gacatctcatagacctccag

SEQ ID NO: 116368 - DNA, 20 bp, human
ggacctccaggggcattcca

SEQ ID NO: 116369 - DNA, 20 bp, human
gcggtccaggcagcctaacc

SEQ ID NO: 116370 - DNA, 20 bp, human
ggaaagtcacaggcttcgta

SEQ ID NO: 116371 - DNA, 20 bp, human
ggctgcgccgaggtccgcag

SEQ ID NO: 116372 - DNA, 20 bp, human
ggtcacaggcttcgtaagga

SEQ ID NO: 116373 - DNA, 20 bp, human
gaggcttcgtaaggaaggct

SEQ ID NO: 116374 - DNA, 20 bp, human
gcgccgaggtccgcagagga

SEQ ID NO: 116375 - DNA, 20 bp, human
gcagagcctcgtaccagggg

SEQ ID NO: 116376 - DNA, 20 bp, human
gcagcggactccgagaccag

SEQ ID NO: 116377 - DNA, 20 bp, human
ggcggcagtgcgcccaacag

SEQ ID NO: 116378 - DNA, 20 bp, human
gccgctgcggacgatcaccc

SEQ ID NO: 116379 - DNA, 20 bp, human
gggtgggtggtcgagaaaga

SEQ ID NO: 116380 - DNA, 20 bp, human
gggcgcgggcgcactaggga

SEQ ID NO: 116381 - DNA, 20 bp, human
ggcagtcttgcgggttctag

SEQ ID NO: 116382 - DNA, 20 bp, human
gggcaggcgcgggcgcacta

SEQ ID NO: 116383 - DNA, 20 bp, human
ggccagggaacaaagactcg

SEQ ID NO: 116384 - DNA, 20 bp, human
gggaggacggcgcagggaat

SEQ ID NO: 116385 - DNA, 20 bp, human
gccatggttccaagaatggt

SEQ ID NO: 116386 - DNA, 20 bp, human
ggaagggctgaactgatgga

SEQ ID NO: 116387 - DNA, 20 bp, human
gggagtctcagggcacgact

SEQ ID NO: 116388 - DNA, 20 bp, human
ggcagacaacagacttacct

SEQ ID NO: 116389 - DNA, 20 bp, human
gtaaatgggtgatgccaaaa

SEQ ID NO: 116390 - DNA, 20 bp, human
gcttctgcagggtcactccc

SEQ ID NO: 116391 - DNA, 20 bp, human
gttcttttagaacagatggt

SEQ ID NO: 116392 - DNA, 20 bp, human
gtcaagcaaaaggaaaccag

SEQ ID NO: 116393 - DNA, 20 bp, human
gggacagcactccggtcctc

SEQ ID NO: 116394 - DNA, 20 bp, human
ggtacagaagtgagacataa

SEQ ID NO: 116395 - DNA, 20 bp, human
ggtcatatagatggagtctc

SEQ ID NO: 116396 - DNA, 20 bp, human
gacgtcgcgctggcagaccc

SEQ ID NO: 116397 - DNA, 20 bp, human
gcgtcctctcgcggccctca

SEQ ID NO: 116398 - DNA, 20 bp, human
gggaactgggtccccgaaga

SEQ ID NO: 116399 - DNA, 20 bp, human
ggaaaggcaggtacccggag

SEQ ID NO: 116400 - DNA, 20 bp, human
gcggcgctgcgcctccaacc

SEQ ID NO: 116401 - DNA, 20 bp, human
gcaggccgcaggcttaggtg

SEQ ID NO: 116402 - DNA, 20 bp, human
ggtgccctgagggccgcgag

SEQ ID NO: 116403 - DNA, 20 bp, human
gcccagcaggagacgagaaa

SEQ ID NO: 116404 - DNA, 20 bp, human
gccgcgagaggacgtcgcgc

SEQ ID NO: 116405 - DNA, 20 bp, human
gggacagcgagagtcgtacg

SEQ ID NO: 116406 - DNA, 20 bp, human
gagcggatccacgaaggaaa

SEQ ID NO: 116407 - DNA, 20 bp, human
ggcctgaacggtaggcgagc

SEQ ID NO: 116408 - DNA, 20 bp, human
gcttcgtggatccgctccca

SEQ ID NO: 116409 - DNA, 20 bp, human
ggtgaactgctcgggctgtg

SEQ ID NO: 116410 - DNA, 20 bp, human
gtgaggaagtagctccaaag

SEQ ID NO: 116411 - DNA, 20 bp, human
gtggcgcgctgccgtgggag

SEQ ID NO: 116412 - DNA, 20 bp, human
gacccggcattgccgcccag

SEQ ID NO: 116413 - DNA, 20 bp, human
gccagcggcgtgaactgctc

SEQ ID NO: 116414 - DNA, 20 bp, human
ggtgcggaggaacttctctc

SEQ ID NO: 116415 - DNA, 20 bp, human
gccgggagcacccggtcgtg

SEQ ID NO: 116416 - DNA, 20 bp, human
gcgttctgtccgcaggacat

SEQ ID NO: 116417 - DNA, 20 bp, human
gatgcggctctgcaggtacg

SEQ ID NO: 116418 - DNA, 20 bp, human
ggcgcagatggcacccagtt

SEQ ID NO: 116419 - DNA, 20 bp, human
gtccgggacgagagagatct

SEQ ID NO: 116420 - DNA, 20 bp, human
gcatgttggctgcgtgagag

SEQ ID NO: 116421 - DNA, 20 bp, human
gtaaatctactgctctgata

SEQ ID NO: 116422 - DNA, 20 bp, human
gggtacggggagctccctcc

SEQ ID NO: 116423 - DNA, 20 bp, human
gcagcttcccgtcaacgcta

SEQ ID NO: 116424 - DNA, 20 bp, human
gactggaggactccagaccc

SEQ ID NO: 116425 - DNA, 20 bp, human
gcccagttgggtgcgagttg

SEQ ID NO: 116426 - DNA, 20 bp, human
gggtctccacactcacccag

SEQ ID NO: 116427 - DNA, 20 bp, human
ggagaccccgtcgtgcgagg

SEQ ID NO: 116428 - DNA, 20 bp, human
gatccctgccagggaccgct

SEQ ID NO: 116429 - DNA, 20 bp, human
gcacccagcggtccctggca

SEQ ID NO: 116430 - DNA, 20 bp, human
gacactcacccagcggtccc

SEQ ID NO: 116431 - DNA, 20 bp, human
gacgctgacctggtgatcac

SEQ ID NO: 116432 - DNA, 20 bp, human
gtaagactagaagggtcctg

SEQ ID NO: 116433 - DNA, 20 bp, human
ggcggcgggagtccaggcca

SEQ ID NO: 116434 - DNA, 20 bp, human
gtagcgcacatcactcccat

SEQ ID NO: 116435 - DNA, 20 bp, human
gctgaccccctcgcacgacg

SEQ ID NO: 116436 - DNA, 20 bp, human
ggaacctgctggccatgaca

SEQ ID NO: 116437 - DNA, 20 bp, human
gtaacatcaccagacctgga

SEQ ID NO: 116438 - DNA, 20 bp, human
gacctgggacaccagagaca

SEQ ID NO: 116439 - DNA, 20 bp, human
gtacagacccaagataccaa

SEQ ID NO: 116440 - DNA, 20 bp, human
gatggcttcaaagcccagga

SEQ ID NO: 116441 - DNA, 20 bp, human
gcaaaaggagagccatgtca

SEQ ID NO: 116442 - DNA, 20 bp, human
gggagggtgagctcatgtcc

SEQ ID NO: 116443 - DNA, 20 bp, human
ggaaggggtccgggattcta

SEQ ID NO: 116444 - DNA, 20 bp, human
gaaacccatgagaagccatg

SEQ ID NO: 116445 - DNA, 20 bp, human
ggcagggcagctttagtgag

SEQ ID NO: 116446 - DNA, 20 bp, human
gtggtgtcatggcagctgcg

SEQ ID NO: 116447 - DNA, 20 bp, human
gacgcttcgggttggtgtca

SEQ ID NO: 116448 - DNA, 20 bp, human
ggccttggccctgagacccc

SEQ ID NO: 116449 - DNA, 20 bp, human
gtggggtgcacgcttcgggt

SEQ ID NO: 116450 - DNA, 20 bp, human
ggaggtcagcaacccaaccg

SEQ ID NO: 116451 - DNA, 20 bp, human
gaaatcggccctcggacccg

SEQ ID NO: 116452 - DNA, 20 bp, human
gacccgcggcttacctcttg

SEQ ID NO: 116453 - DNA, 20 bp, human
gagccgcaagaggtaagccg

SEQ ID NO: 116454 - DNA, 20 bp, human
gaggtaagccgcgggtccga

SEQ ID NO: 116455 - DNA, 20 bp, human
ggtcctgtcccaccccggtt

SEQ ID NO: 116456 - DNA, 20 bp, human
gatgagctcggtgtaaggaa

SEQ ID NO: 116457 - DNA, 20 bp, human
gccgcggcctagggcccctt

SEQ ID NO: 116458 - DNA, 20 bp, human
gggttactacagaaatcccg

SEQ ID NO: 116459 - DNA, 20 bp, human
gtctggtagtgtagggactt

SEQ ID NO: 116460 - DNA, 20 bp, human
ggagtcacggtacccatgaa

SEQ ID NO: 116461 - DNA, 20 bp, human
gttccggctctggtagtgta

SEQ ID NO: 116462 - DNA, 20 bp, human
gaccaccgccccctagacac

SEQ ID NO: 116463 - DNA, 20 bp, human
gcggcacgtgtgtcattccc

SEQ ID NO: 116464 - DNA, 20 bp, human
gttataaactcgctgagggt

SEQ ID NO: 116465 - DNA, 20 bp, human
ggggcggtggtttagactgg

SEQ ID NO: 116466 - DNA, 20 bp, human
gatccgcgttgttccgtgtt

SEQ ID NO: 116467 - DNA, 20 bp, human
gcggagtcgcggcacgggag

SEQ ID NO: 116468 - DNA, 20 bp, human
gagagcccggcgaactcccg

SEQ ID NO: 116469 - DNA, 20 bp, human
gcccccaacacggaacaacg

SEQ ID NO: 116470 - DNA, 20 bp, human
gctccatgccgcccccaaca

SEQ ID NO: 116471 - DNA, 20 bp, human
gacgggagcgggacttgaat

SEQ ID NO: 116472 - DNA, 20 bp, human
gcagcaaggccccgaaaaga

SEQ ID NO: 116473 - DNA, 20 bp, human
gggagcgggacttgaatggg

SEQ ID NO: 116474 - DNA, 20 bp, human
gctgaggagatggtcatgac

SEQ ID NO: 116475 - DNA, 20 bp, human
gtccccaggaggttccgaga

SEQ ID NO: 116476 - DNA, 20 bp, human
gagggtgcagcctggatatc

SEQ ID NO: 116477 - DNA, 20 bp, human
gcggagagcgccatggtccg

SEQ ID NO: 116478 - DNA, 20 bp, human
gccactgtggtcgaacgcag

SEQ ID NO: 116479 - DNA, 20 bp, human
ggctcttctctagctctcag

SEQ ID NO: 116480 - DNA, 20 bp, human
gccatggtccggggacgccg

SEQ ID NO: 116481 - DNA, 20 bp, human
gaagagcccggagagcgcca

SEQ ID NO: 116482 - DNA, 20 bp, human
gtgctcccgcagtagcgcga

SEQ ID NO: 116483 - DNA, 20 bp, human
gcccgcagtagcgcgaggga

SEQ ID NO: 116484 - DNA, 20 bp, human
gtcgaacgctggctgcacac

SEQ ID NO: 116485 - DNA, 20 bp, human
gatctcacggagtcagaccc

SEQ ID NO: 116486 - DNA, 20 bp, human
ggggagtcgtggcccggagt

SEQ ID NO: 116487 - DNA, 20 bp, human
gcgactccaaggcccactcc

SEQ ID NO: 116488 - DNA, 20 bp, human
gggcaggagattcccataag

SEQ ID NO: 116489 - DNA, 20 bp, human
gcgcctgcgcgccgactcca

SEQ ID NO: 116490 - DNA, 20 bp, human
gtagatctcacacccaacaa

SEQ ID NO: 116491 - DNA, 20 bp, human
gactcccccaggagaaaccg

SEQ ID NO: 116492 - DNA, 20 bp, human
gtgggctgtctgggaaggga

SEQ ID NO: 116493 - DNA, 20 bp, human
gggagtcccagaatgtagat

SEQ ID NO: 116494 - DNA, 20 bp, human
ggggaagtgagacggaaagg

SEQ ID NO: 116495 - DNA, 20 bp, human
gtggtgtgggctgtctggga

SEQ ID NO: 116496 - DNA, 20 bp, human
gaccaggcgtgcagaaggaa

SEQ ID NO: 116497 - DNA, 20 bp, human
ggcagcacccgcctggagta

SEQ ID NO: 116498 - DNA, 20 bp, human
ggcctggtgggccctactcc

SEQ ID NO: 116499 - DNA, 20 bp, human
ggcctggagtagggcccacc

SEQ ID NO: 116500 - DNA, 20 bp, human
ggcgtatccacggccgagtc

SEQ ID NO: 116501 - DNA, 20 bp, human
gggcagtgggcgtgcatggt

SEQ ID NO: 116502 - DNA, 20 bp, human
gtccacggccgagtcgggaa

SEQ ID NO: 116503 - DNA, 20 bp, human
ggagacaatggtccccgtcg

SEQ ID NO: 116504 - DNA, 20 bp, human
gccagaggggatggcgacga

SEQ ID NO: 116505 - DNA, 20 bp, human
gggcccaccaggcgtgcaga

SEQ ID NO: 116506 - DNA, 20 bp, human
gtccggaggcggctcacccg

SEQ ID NO: 116507 - DNA, 20 bp, human
ggctgcgcgaagggctctcc

SEQ ID NO: 116508 - DNA, 20 bp, human
gccggacgaagagcagcgag

SEQ ID NO: 116509 - DNA, 20 bp, human
gagccgcctccggagagacg

SEQ ID NO: 116510 - DNA, 20 bp, human
ggccgccgctggagtccgcc

SEQ ID NO: 116511 - DNA, 20 bp, human
gcagcggcgcttgcacagag

SEQ ID NO: 116512 - DNA, 20 bp, human
gtcccaccggggcggaagaa

SEQ ID NO: 116513 - DNA, 20 bp, human
gggcgtagagggtgacccct

SEQ ID NO: 116514 - DNA, 20 bp, human
gggcatccgaaattactcca

SEQ ID NO: 116515 - DNA, 20 bp, human
gagccccaggaccaccacca

SEQ ID NO: 116516 - DNA, 20 bp, human
ggctcgagcaccgtaatccc

SEQ ID NO: 116517 - DNA, 20 bp, human
gagcaggggctcggaggtcc

SEQ ID NO: 116518 - DNA, 20 bp, human
gcaggaagtgcgtcatcagt

SEQ ID NO: 116519 - DNA, 20 bp, human
gcaagagctcgagagtgagg

SEQ ID NO: 116520 - DNA, 20 bp, human
gacgctggtgggaaaggacc

SEQ ID NO: 116521 - DNA, 20 bp, human
ggcgccagaaactggaccaa

SEQ ID NO: 116522 - DNA, 20 bp, human
gcgccagcggccgcacgccg

SEQ ID NO: 116523 - DNA, 20 bp, human
gggtgctcgagcacgctggt

SEQ ID NO: 116524 - DNA, 20 bp, human
gtcgagcacgctggtgggaa

SEQ ID NO: 116525 - DNA, 20 bp, human
gcagcgtccagctaaaacag

SEQ ID NO: 116526 - DNA, 20 bp, human
gggcctgccgggagtgagcg

SEQ ID NO: 116527 - DNA, 20 bp, human
gagtgagcgcggccgtactt

SEQ ID NO: 116528 - DNA, 20 bp, human
ggtacggccgcgctcactcc

SEQ ID NO: 116529 - DNA, 20 bp, human
gagagcgtctgagtgcacgt

SEQ ID NO: 116530 - DNA, 20 bp, human
gcgcccgcgggaggatggaa

SEQ ID NO: 116531 - DNA, 20 bp, human
ggagctccgcgctcagaaag

SEQ ID NO: 116532 - DNA, 20 bp, human
gagaatgaacgggcctgagg

SEQ ID NO: 116533 - DNA, 20 bp, human
ggataataaagaccctagga

SEQ ID NO: 116534 - DNA, 20 bp, human
ggtcgctctgctccacgcct

SEQ ID NO: 116535 - DNA, 20 bp, human
gcgctcagaaaggggcgaga

SEQ ID NO: 116536 - DNA, 20 bp, human
ggtagcgtactcatcctccc

SEQ ID NO: 116537 - DNA, 20 bp, human
ggcgagatggtgacgaccgg

SEQ ID NO: 116538 - DNA, 20 bp, human
ggaagcgagatggtgacgac

SEQ ID NO: 116539 - DNA, 20 bp, human
gtgtgccggaccgatggact

SEQ ID NO: 116540 - DNA, 20 bp, human
gccagcccagtccatcggtc

SEQ ID NO: 116541 - DNA, 20 bp, human
gccggcggcctcactgctat

SEQ ID NO: 116542 - DNA, 20 bp, human
gacacccggaagtgtcttca

SEQ ID NO: 116543 - DNA, 20 bp, human
ggaggtggggaggtcaagaa

SEQ ID NO: 116544 - DNA, 20 bp, human
gaggatgagtacgctacacc

SEQ ID NO: 116545 - DNA, 20 bp, human
gcttcgacgaggagaagagg

SEQ ID NO: 116546 - DNA, 20 bp, human
gcgaggcttgacccgtgagt

SEQ ID NO: 116547 - DNA, 20 bp, human
gtttgggcgtccccactcac

SEQ ID NO: 116548 - DNA, 20 bp, human
ggagctgtgtgagcctcaaa

SEQ ID NO: 116549 - DNA, 20 bp, human
gtacccccagacaggataaa

SEQ ID NO: 116550 - DNA, 20 bp, human
ggagtggggacgcccaaaac

SEQ ID NO: 116551 - DNA, 20 bp, human
gccagagcttgagagtcctg

SEQ ID NO: 116552 - DNA, 20 bp, human
gttagcggccagtccttcga

SEQ ID NO: 116553 - DNA, 20 bp, human
gtcacgggtcaagcctcggc

SEQ ID NO: 116554 - DNA, 20 bp, human
gcctcccacagccgggagtg

SEQ ID NO: 116555 - DNA, 20 bp, human
gtagagactccagctggtct

SEQ ID NO: 116556 - DNA, 20 bp, human
gcaggacagagcgtctggag

SEQ ID NO: 116557 - DNA, 20 bp, human
gccgcaagcacaggacctgg

SEQ ID NO: 116558 - DNA, 20 bp, human
gggcacagcgtagcagctcc

SEQ ID NO: 116559 - DNA, 20 bp, human
gctcaccgggccagagtacg

SEQ ID NO: 116560 - DNA, 20 bp, human
gacagagcgtctggagaggc

SEQ ID NO: 116561 - DNA, 20 bp, human
gtgcttgcggagccgtccgg

SEQ ID NO: 116562 - DNA, 20 bp, human
ggaggccaacacggggaact

SEQ ID NO: 116563 - DNA, 20 bp, human
gctcgatcccagccgccgga

SEQ ID NO: 116564 - DNA, 20 bp, human
gcgcggtcgatagtctctga

SEQ ID NO: 116565 - DNA, 20 bp, human
ggacaccgagttccccgtgt

SEQ ID NO: 116566 - DNA, 20 bp, human
ggctgggagcatccggccag

SEQ ID NO: 116567 - DNA, 20 bp, human
gtacgtgcctgtcaagacca

SEQ ID NO: 116568 - DNA, 20 bp, human
gtccggcagacaaataacag

SEQ ID NO: 116569 - DNA, 20 bp, human
gcactcaccgtggtcttgac

SEQ ID NO: 116570 - DNA, 20 bp, human
ggaaggcgagtcactcaccg

SEQ ID NO: 116571 - DNA, 20 bp, human
gaggcgcccagagaaggaca

SEQ ID NO: 116572 - DNA, 20 bp, human
ggcagacaaataacagagga

SEQ ID NO: 116573 - DNA, 20 bp, human
gagccggacgaggtccgcgg

SEQ ID NO: 116574 - DNA, 20 bp, human
ggacgccgccgcccgacccg

SEQ ID NO: 116575 - DNA, 20 bp, human
ggaccacaaagactgtacag

SEQ ID NO: 116576 - DNA, 20 bp, human
gaagctatgaggtatagacc

SEQ ID NO: 116577 - DNA, 20 bp, human
ggtgggttgagccatcgggg

SEQ ID NO: 116578 - DNA, 20 bp, human
ggcgccggccccatcactca

SEQ ID NO: 116579 - DNA, 20 bp, human
gccggctagaatctgaagtg

SEQ ID NO: 116580 - DNA, 20 bp, human
gtaaggctctctgggatgag

SEQ ID NO: 116581 - DNA, 20 bp, human
gtgctggaccctgagtgatg

SEQ ID NO: 116582 - DNA, 20 bp, human
gtactggagcgctccaggag

SEQ ID NO: 116583 - DNA, 20 bp, human
gctgaagtgcgggagagtgc

SEQ ID NO: 116584 - DNA, 20 bp, human
ggttgaagagacccacactt

SEQ ID NO: 116585 - DNA, 20 bp, human
gtaggcatttccgcccacgt

SEQ ID NO: 116586 - DNA, 20 bp, human
ggcgtctcgcgccccggcgt

SEQ ID NO: 116587 - DNA, 20 bp, human
gagaaggttagaggctaggg

SEQ ID NO: 116588 - DNA, 20 bp, human
gaacagaaggttagaggcta

SEQ ID NO: 116589 - DNA, 20 bp, human
ggcgtcggcggaggcgatgg

SEQ ID NO: 116590 - DNA, 20 bp, human
gggctcagggagaattccta

SEQ ID NO: 116591 - DNA, 20 bp, human
gggcgcgagacgctcgcggt

SEQ ID NO: 116592 - DNA, 20 bp, human
gccggggcgcgagacgctcg

SEQ ID NO: 116593 - DNA, 20 bp, human
ggagctgttcatcgaacaga

SEQ ID NO: 116594 - DNA, 20 bp, human
ggagaagaggaagcgacgcg

SEQ ID NO: 116595 - DNA, 20 bp, human
gcggaggcgatggtggacga

SEQ ID NO: 116596 - DNA, 20 bp, human
gtggctttaggtgaacgacg

SEQ ID NO: 116597 - DNA, 20 bp, human
gacacgtgaccagaagttag

SEQ ID NO: 116598 - DNA, 20 bp, human
gttaggtgaacgacgtggtg

SEQ ID NO: 116599 - DNA, 20 bp, human
gtcggcgtaagagaggaagt

SEQ ID NO: 116600 - DNA, 20 bp, human
ggaaggttgctgtatcacag

SEQ ID NO: 116601 - DNA, 20 bp, human
ggagactatcgggaagaggt

SEQ ID NO: 116602 - DNA, 20 bp, human
ggaagagaggatgctccgtt

SEQ ID NO: 116603 - DNA, 20 bp, human
ggactaggtcggcgtaagag

SEQ ID NO: 116604 - DNA, 20 bp, human
ggccgacctagtccaggaat

SEQ ID NO: 116605 - DNA, 20 bp, human
gcagaatacacgccatgtgg

SEQ ID NO: 116606 - DNA, 20 bp, human
ggacccgcagccaagtggaa

SEQ ID NO: 116607 - DNA, 20 bp, human
gtggcggttactgcaagccc

SEQ ID NO: 116608 - DNA, 20 bp, human
gcggtcgagcaggtaggtgg

SEQ ID NO: 116609 - DNA, 20 bp, human
gcgccggtagtagtccccga

SEQ ID NO: 116610 - DNA, 20 bp, human
gccgccatgctgggtcctca

SEQ ID NO: 116611 - DNA, 20 bp, human
gtctcgcgcggtaggccctg

SEQ ID NO: 116612 - DNA, 20 bp, human
ggacccagcatggcggactc

SEQ ID NO: 116613 - DNA, 20 bp, human
gcgcagccaagtggaacggc

SEQ ID NO: 116614 - DNA, 20 bp, human
gtgctgccggtcgagcaggt

SEQ ID NO: 116615 - DNA, 20 bp, human
gtgccctcggggactactac

SEQ ID NO: 116616 - DNA, 20 bp, human
gacgcgtattgcctggagga

SEQ ID NO: 116617 - DNA, 20 bp, human
gggaaccacgcggcgaatgc

SEQ ID NO: 116618 - DNA, 20 bp, human
gcaggtcgctgggaaccacg

SEQ ID NO: 116619 - DNA, 20 bp, human
gagtcgtgctgcgtcgacaa

SEQ ID NO: 116620 - DNA, 20 bp, human
gcgtattgcctggaggatgg

SEQ ID NO: 116621 - DNA, 20 bp, human
gcgactcaggaacccaacag

SEQ ID NO: 116622 - DNA, 20 bp, human
ggcaggaagccgagcacgag

SEQ ID NO: 116623 - DNA, 20 bp, human
ggaagaaccaacgtcctcag

SEQ ID NO: 116624 - DNA, 20 bp, human
gagtgacgcgtattgcctgg

SEQ ID NO: 116625 - DNA, 20 bp, human
gcggcagcgtgggagcctcg

SEQ ID NO: 116626 - DNA, 20 bp, human
gaggcgaggggtcccgacta

SEQ ID NO: 116627 - DNA, 20 bp, human
ggcggagccgaagaagccag

SEQ ID NO: 116628 - DNA, 20 bp, human
gcccgggcgaaagctcaccg

SEQ ID NO: 116629 - DNA, 20 bp, human
gtggtccgcatgaagcgcag

SEQ ID NO: 116630 - DNA, 20 bp, human
gcgaagaagccagcggtcac

SEQ ID NO: 116631 - DNA, 20 bp, human
gcacgcgtttcgaaagatgg

SEQ ID NO: 116632 - DNA, 20 bp, human
gccggcccgggcggctccca

SEQ ID NO: 116633 - DNA, 20 bp, human
ggcccgcccagcccctagtc

SEQ ID NO: 116634 - DNA, 20 bp, human
gggacggcgggccccgaaca

SEQ ID NO: 116635 - DNA, 20 bp, human
gccgtcccgggtcaaggcca

SEQ ID NO: 116636 - DNA, 20 bp, human
gtgtcagccggcctaggagg

SEQ ID NO: 116637 - DNA, 20 bp, human
gggctgtcagccggcctagg

SEQ ID NO: 116638 - DNA, 20 bp, human
gctgcggcgtgcagtgtgag

SEQ ID NO: 116639 - DNA, 20 bp, human
ggacagcatagcctcggaag

SEQ ID NO: 116640 - DNA, 20 bp, human
gaggccagcgcggcccagag

SEQ ID NO: 116641 - DNA, 20 bp, human
gctccccagtcgcgctggag

SEQ ID NO: 116642 - DNA, 20 bp, human
ggctcggaggacatcgtggt

SEQ ID NO: 116643 - DNA, 20 bp, human
gatagcctcggaagaggtaa

SEQ ID NO: 116644 - DNA, 20 bp, human
gcggcgtgcagtgtgagggg

SEQ ID NO: 116645 - DNA, 20 bp, human
gggagcccttacctcttccg

SEQ ID NO: 116646 - DNA, 20 bp, human
gtgtcagccggcctaggagg

SEQ ID NO: 116647 - DNA, 20 bp, human
gaggccagcgcggcccagag

SEQ ID NO: 116648 - DNA, 20 bp, human
ggacagcatagcctcggaag

SEQ ID NO: 116649 - DNA, 20 bp, human
gatagcctcggaagaggtaa

SEQ ID NO: 116650 - DNA, 20 bp, human
ggccccagaagagagaacta

SEQ ID NO: 116651 - DNA, 20 bp, human
gccgcccggtgtcagagacg

SEQ ID NO: 116652 - DNA, 20 bp, human
gtggcctcgtctctgacacc

SEQ ID NO: 116653 - DNA, 20 bp, human
ggccttagttctctcttctg

SEQ ID NO: 116654 - DNA, 20 bp, human
gggagcccttacctcttccg

SEQ ID NO: 116655 - DNA, 20 bp, human
ggctcggaggacatcgtggt

SEQ ID NO: 116656 - DNA, 20 bp, human
gcacgcgcgcttcgacccca

SEQ ID NO: 116657 - DNA, 20 bp, human
gtcttctggggctgtgaccg

SEQ ID NO: 116658 - DNA, 20 bp, human
gtgtcagccggcctaggagg

SEQ ID NO: 116659 - DNA, 20 bp, human
gaggccagcgcggcccagag

SEQ ID NO: 116660 - DNA, 20 bp, human
ggacagcatagcctcggaag

SEQ ID NO: 116661 - DNA, 20 bp, human
gatagcctcggaagaggtaa

SEQ ID NO: 116662 - DNA, 20 bp, human
gggctgtcagccggcctagg

SEQ ID NO: 116663 - DNA, 20 bp, human
ggctcggaggacatcgtggt

SEQ ID NO: 116664 - DNA, 20 bp, human
gctccccagtcgcgctggag

SEQ ID NO: 116665 - DNA, 20 bp, human
gggagcccttacctcttccg

SEQ ID NO: 116666 - DNA, 20 bp, human
gggcagagacaaggcctcaa

SEQ ID NO: 116667 - DNA, 20 bp, human
ggctagggcgaagctaggtt

SEQ ID NO: 116668 - DNA, 20 bp, human
gaccgccggaaacgagacga

SEQ ID NO: 116669 - DNA, 20 bp, human
gggagataccagtcggtaga

SEQ ID NO: 116670 - DNA, 20 bp, human
gcccagggcggctcagaggc

SEQ ID NO: 116671 - DNA, 20 bp, human
gagtcgtggttggttagagg

SEQ ID NO: 116672 - DNA, 20 bp, human
gcacaccgtcgggcccaggg

SEQ ID NO: 116673 - DNA, 20 bp, human
gagatcgctgaagtcgtggt

SEQ ID NO: 116674 - DNA, 20 bp, human
gggtcgcgcgctcttttctc

SEQ ID NO: 116675 - DNA, 20 bp, human
gtgagccgccctgggcccga

SEQ ID NO: 116676 - DNA, 20 bp, human
gaccactgcagactgagcgg

SEQ ID NO: 116677 - DNA, 20 bp, human
gactgagcggtggaccgaat

SEQ ID NO: 116678 - DNA, 20 bp, human
gcggaccactgcagactgag

SEQ ID NO: 116679 - DNA, 20 bp, human
gtaagccagcggtcccaatt

SEQ ID NO: 116680 - DNA, 20 bp, human
gctgctcgttgaggtaatac

SEQ ID NO: 116681 - DNA, 20 bp, human
gatgatcgcttataagccag

SEQ ID NO: 116682 - DNA, 20 bp, human
ggagtgggtgaggtcatacg

SEQ ID NO: 116683 - DNA, 20 bp, human
gacgaacacgtgacgcggtc

SEQ ID NO: 116684 - DNA, 20 bp, human
gaaagtccagaaccgaggtg

SEQ ID NO: 116685 - DNA, 20 bp, human
gtggaccgaattgggaccgc

SEQ ID NO: 116686 - DNA, 20 bp, human
gctcgggcccttgggcgcag

SEQ ID NO: 116687 - DNA, 20 bp, human
ggcgaaggcgaagaaggtcg

SEQ ID NO: 116688 - DNA, 20 bp, human
gccgagacccgaagagagac

SEQ ID NO: 116689 - DNA, 20 bp, human
gacaggccgtgacaggcaca

SEQ ID NO: 116690 - DNA, 20 bp, human
gcccgggcagtcccacgtcg

SEQ ID NO: 116691 - DNA, 20 bp, human
gtctctgagctggagtgacc

SEQ ID NO: 116692 - DNA, 20 bp, human
ggagcggcacaggccgtgac

SEQ ID NO: 116693 - DNA, 20 bp, human
ggccatggcgaaggcgaaga

SEQ ID NO: 116694 - DNA, 20 bp, human
gcggcccggcacgtgtctta

SEQ ID NO: 116695 - DNA, 20 bp, human
gcccgtgcgcgagacacccc

SEQ ID NO: 116696 - DNA, 20 bp, human
gcacgaggtctgagagacag

SEQ ID NO: 116697 - DNA, 20 bp, human
gggccaagggcaaaacccgg

SEQ ID NO: 116698 - DNA, 20 bp, human
gggaccacgctaaatcggta

SEQ ID NO: 116699 - DNA, 20 bp, human
ggtaggaactgcacaaggag

SEQ ID NO: 116700 - DNA, 20 bp, human
gagaggacagtgatgtcgga

SEQ ID NO: 116701 - DNA, 20 bp, human
gtctgacacctaggtcagta

SEQ ID NO: 116702 - DNA, 20 bp, human
gtaagagaaaggtactgaca

SEQ ID NO: 116703 - DNA, 20 bp, human
ggacagtgatgtcggaggga

SEQ ID NO: 116704 - DNA, 20 bp, human
ggtgcccctccgtaagagaa

SEQ ID NO: 116705 - DNA, 20 bp, human
ggtggtacccataggtaagt

SEQ ID NO: 116706 - DNA, 20 bp, human
gcggccctccacgtgcaatc

SEQ ID NO: 116707 - DNA, 20 bp, human
gcgagtgccggccgaaagct

SEQ ID NO: 116708 - DNA, 20 bp, human
gacgtggagggccgcccgaa

SEQ ID NO: 116709 - DNA, 20 bp, human
ggccggccgaaagctaggtc

SEQ ID NO: 116710 - DNA, 20 bp, human
gccctacgaaggagaagcgg

SEQ ID NO: 116711 - DNA, 20 bp, human
gcgggcctccagggggatag

SEQ ID NO: 116712 - DNA, 20 bp, human
gtccgagagtgcccttcggg

SEQ ID NO: 116713 - DNA, 20 bp, human
gcgttcggtcgggcctccag

SEQ ID NO: 116714 - DNA, 20 bp, human
gaatctgacgagttctgtct

SEQ ID NO: 116715 - DNA, 20 bp, human
gggtccggattgcacgtgga

SEQ ID NO: 116716 - DNA, 20 bp, human
gcgcattgcgagccgaaccc

SEQ ID NO: 116717 - DNA, 20 bp, human
gtggcgccagctcccgggtt

SEQ ID NO: 116718 - DNA, 20 bp, human
gcaccatggcgccagctccc

SEQ ID NO: 116719 - DNA, 20 bp, human
gtggaaagctctagatccgg

SEQ ID NO: 116720 - DNA, 20 bp, human
ggcgcggaaccaggctccag

SEQ ID NO: 116721 - DNA, 20 bp, human
gctgctggcgctgaaggaag

SEQ ID NO: 116722 - DNA, 20 bp, human
gctagagcgattctacccat

SEQ ID NO: 116723 - DNA, 20 bp, human
ggcctggaaagctctagatc

SEQ ID NO: 116724 - DNA, 20 bp, human
gtcccacgtggccggccgag

SEQ ID NO: 116725 - DNA, 20 bp, human
ggcgggcgacgcgacggtgg

SEQ ID NO: 116726 - DNA, 20 bp, human
ggagagcgagccgttaaagg

SEQ ID NO: 116727 - DNA, 20 bp, human
gtcctagttccagtacagcg

SEQ ID NO: 116728 - DNA, 20 bp, human
gagttccagtacagcgtgga

SEQ ID NO: 116729 - DNA, 20 bp, human
gagtacagcgtggagggttt

SEQ ID NO: 116730 - DNA, 20 bp, human
gttcctcccgttgaaggggt

SEQ ID NO: 116731 - DNA, 20 bp, human
gttatagcccgggctctggg

SEQ ID NO: 116732 - DNA, 20 bp, human
gcagaacgggtctccccaaa

SEQ ID NO: 116733 - DNA, 20 bp, human
gtgcccaccccttcaacggg

SEQ ID NO: 116734 - DNA, 20 bp, human
ggaactactcagagtagcgt

SEQ ID NO: 116735 - DNA, 20 bp, human
gtgctggacagacgaggaga

SEQ ID NO: 116736 - DNA, 20 bp, human
ggaaggtccgtccgcagtta

SEQ ID NO: 116737 - DNA, 20 bp, human
ggcacgcttggcgacgtcga

SEQ ID NO: 116738 - DNA, 20 bp, human
gaggtcgcgaagcacacatg

SEQ ID NO: 116739 - DNA, 20 bp, human
ggtgtgcttcgcgacctgtc

SEQ ID NO: 116740 - DNA, 20 bp, human
ggcaaaagcttccttaactg

SEQ ID NO: 116741 - DNA, 20 bp, human
gccgagactggggaagaacg

SEQ ID NO: 116742 - DNA, 20 bp, human
ggctccgagcgcccatccgg

SEQ ID NO: 116743 - DNA, 20 bp, human
ggcgctctccacacaaggtg

SEQ ID NO: 116744 - DNA, 20 bp, human
gcccagctggtggcaaacgg

SEQ ID NO: 116745 - DNA, 20 bp, human
gaccaagagcatcaaatcca

SEQ ID NO: 116746 - DNA, 20 bp, human
ggcgccgcggctcctccgag

SEQ ID NO: 116747 - DNA, 20 bp, human
gctcctaccaggaggcgagt

SEQ ID NO: 116748 - DNA, 20 bp, human
gttggaggcacaaagcggag

SEQ ID NO: 116749 - DNA, 20 bp, human
ggcgcgcggctcctaccagg

SEQ ID NO: 116750 - DNA, 20 bp, human
gcacccactcgcctcctggt

SEQ ID NO: 116751 - DNA, 20 bp, human
ggctgagggaggggacgcaa

SEQ ID NO: 116752 - DNA, 20 bp, human
ggcgggtgcgcagcgcgaag

SEQ ID NO: 116753 - DNA, 20 bp, human
ggcacaaagcggaggggaag

SEQ ID NO: 116754 - DNA, 20 bp, human
ggaggagctacttagcgccg

SEQ ID NO: 116755 - DNA, 20 bp, human
gagccctggggacggagaag

SEQ ID NO: 116756 - DNA, 20 bp, human
gggacccgctccttcggagg

SEQ ID NO: 116757 - DNA, 20 bp, human
ggaagaaaaggcgacggtgg

SEQ ID NO: 116758 - DNA, 20 bp, human
gttcctgccggctaggaggg

SEQ ID NO: 116759 - DNA, 20 bp, human
gtggatcagccgccagcgag

SEQ ID NO: 116760 - DNA, 20 bp, human
ggcagtggaacgcaccgccc

SEQ ID NO: 116761 - DNA, 20 bp, human
gtggcggtggcggcggagca

SEQ ID NO: 116762 - DNA, 20 bp, human
gtgctaggcatggttacccg

SEQ ID NO: 116763 - DNA, 20 bp, human
gggcggacccgctccttcgg

SEQ ID NO: 116764 - DNA, 20 bp, human
gctggcgagaccccggggag

SEQ ID NO: 116765 - DNA, 20 bp, human
ggtacaaccttgtggacgat

SEQ ID NO: 116766 - DNA, 20 bp, human
gccagtcccctcatcaaagg

SEQ ID NO: 116767 - DNA, 20 bp, human
gtgtagcgagtcgaaaactg

SEQ ID NO: 116768 - DNA, 20 bp, human
gtgcccagtcccctcatcaa

SEQ ID NO: 116769 - DNA, 20 bp, human
gaatgaggctgagttctctg

SEQ ID NO: 116770 - DNA, 20 bp, human
gtacaaagttatgaacacac

SEQ ID NO: 116771 - DNA, 20 bp, human
gaggctgagttctctgcggc

SEQ ID NO: 116772 - DNA, 20 bp, human
ggccgcttccccagaaatga

SEQ ID NO: 116773 - DNA, 20 bp, human
ggacagtcccgaagttctca

SEQ ID NO: 116774 - DNA, 20 bp, human
gtggctgcactgcctccccg

SEQ ID NO: 116775 - DNA, 20 bp, human
gctcggccacctttgatgag

SEQ ID NO: 116776 - DNA, 20 bp, human
gagtggacgcacagtaacat

SEQ ID NO: 116777 - DNA, 20 bp, human
gcaggcagctaggagcaggt

SEQ ID NO: 116778 - DNA, 20 bp, human
gaggagcaggtgggcaacaa

SEQ ID NO: 116779 - DNA, 20 bp, human
gaaagtcaaacagctcctgg

SEQ ID NO: 116780 - DNA, 20 bp, human
gaggtgaaagctgggagtaa

SEQ ID NO: 116781 - DNA, 20 bp, human
gtagaacaggacagtctggg

SEQ ID NO: 116782 - DNA, 20 bp, human
gagcaggtgggcaacaaggg

SEQ ID NO: 116783 - DNA, 20 bp, human
ggggtgccagctatagaatc

SEQ ID NO: 116784 - DNA, 20 bp, human
gcttcctaaggaaaaggcca

SEQ ID NO: 116785 - DNA, 20 bp, human
gcagcgccagaacacaggta

SEQ ID NO: 116786 - DNA, 20 bp, human
gtagtgaggtgagttcgagg

SEQ ID NO: 116787 - DNA, 20 bp, human
gggactgggagtcgttagtg

SEQ ID NO: 116788 - DNA, 20 bp, human
gaagaagcgaccgagggact

SEQ ID NO: 116789 - DNA, 20 bp, human
gcagttgaagaagcgaccga

SEQ ID NO: 116790 - DNA, 20 bp, human
gcgttagtgaggtgagttcg

SEQ ID NO: 116791 - DNA, 20 bp, human
gaggtggccaaccgtccatc

SEQ ID NO: 116792 - DNA, 20 bp, human
ggagagaactgcccgatgga

SEQ ID NO: 116793 - DNA, 20 bp, human
gttgctgggggtctaaggag

SEQ ID NO: 116794 - DNA, 20 bp, human
gctgtgccccgacaccggaa

SEQ ID NO: 116795 - DNA, 20 bp, human
ggtgcaggaagagtgttgct

SEQ ID NO: 116796 - DNA, 20 bp, human
gtggctctgagaataaagtg

SEQ ID NO: 116797 - DNA, 20 bp, human
gcaccggacaatctgtcagt

SEQ ID NO: 116798 - DNA, 20 bp, human
ggacccactgacagattgtc

SEQ ID NO: 116799 - DNA, 20 bp, human
gtccggtgagtagctcagtg

SEQ ID NO: 116800 - DNA, 20 bp, human
gccaaaaaatgagggtgaaa

SEQ ID NO: 116801 - DNA, 20 bp, human
gtattctcagagccaaaaat

SEQ ID NO: 116802 - DNA, 20 bp, human
gatggtgccaacatcatgtg

SEQ ID NO: 116803 - DNA, 20 bp, human
gtccttgactccaaaaaatg

SEQ ID NO: 116804 - DNA, 20 bp, human
gtgcctgcgtgtgaggaggg

SEQ ID NO: 116805 - DNA, 20 bp, human
gatgctggagcgtaggtgaa

SEQ ID NO: 116806 - DNA, 20 bp, human
gcgcggccgaggcactagtg

SEQ ID NO: 116807 - DNA, 20 bp, human
gtagtgcctcggccgcggga

SEQ ID NO: 116808 - DNA, 20 bp, human
gcggcggcatgcctccccac

SEQ ID NO: 116809 - DNA, 20 bp, human
gctagtgaggctcagagtcg

SEQ ID NO: 116810 - DNA, 20 bp, human
gagagcaggggcgccaggag

SEQ ID NO: 116811 - DNA, 20 bp, human
gcaaagggcgcggaaagtgg

SEQ ID NO: 116812 - DNA, 20 bp, human
gcagccagccggggaagaga

SEQ ID NO: 116813 - DNA, 20 bp, human
ggtcggtcctccctgatccc

SEQ ID NO: 116814 - DNA, 20 bp, human
ggcgcagcgaaggaacgagc

SEQ ID NO: 116815 - DNA, 20 bp, human
ggcgccgccaaagtttccaa

SEQ ID NO: 116816 - DNA, 20 bp, human
ggcctctgcggtccaccacg

SEQ ID NO: 116817 - DNA, 20 bp, human
ggccacgtggtggaccgcag

SEQ ID NO: 116818 - DNA, 20 bp, human
gtccaccacgtggcatgtcc

SEQ ID NO: 116819 - DNA, 20 bp, human
gaggggcggcctggacacag

SEQ ID NO: 116820 - DNA, 20 bp, human
gaacgccgggacatgccacg

SEQ ID NO: 116821 - DNA, 20 bp, human
gtgtcccggcgttcttgcag

SEQ ID NO: 116822 - DNA, 20 bp, human
gacgaggcgattccaggtct

SEQ ID NO: 116823 - DNA, 20 bp, human
ggagcaagcagctgaaaacg

SEQ ID NO: 116824 - DNA, 20 bp, human
gacaggtgagggccagtgca

SEQ ID NO: 116825 - DNA, 20 bp, human
gagcggggacagcaagagtt

SEQ ID NO: 116826 - DNA, 20 bp, human
gctgccgaggaggcgtgtaa

SEQ ID NO: 116827 - DNA, 20 bp, human
gcgctcgaccccaagaaacg

SEQ ID NO: 116828 - DNA, 20 bp, human
ggcgctacgctccgaagccc

SEQ ID NO: 116829 - DNA, 20 bp, human
gagtcgaggcatttgcgcct

SEQ ID NO: 116830 - DNA, 20 bp, human
gtcaggttccgcgtttcttg

SEQ ID NO: 116831 - DNA, 20 bp, human
gggcatttgcgcctgggctt

SEQ ID NO: 116832 - DNA, 20 bp, human
gattctggcgtggagagcgg

SEQ ID NO: 116833 - DNA, 20 bp, human
gccgacggcgggcctcggag

SEQ ID NO: 116834 - DNA, 20 bp, human
gtgccagggtgcagggaggt

SEQ ID NO: 116835 - DNA, 20 bp, human
gtcctcggcaggagggaggc

SEQ ID NO: 116836 - DNA, 20 bp, human
gaggcatttgcgctgggctt

SEQ ID NO: 116837 - DNA, 20 bp, human
gcggcgatgtccaaactctc

SEQ ID NO: 116838 - DNA, 20 bp, human
gcgctgggttcccgagagtt

SEQ ID NO: 116839 - DNA, 20 bp, human
ggagtcgaggcatttgcgct

SEQ ID NO: 116840 - DNA, 20 bp, human
ggtttcagccaaacttcggg

SEQ ID NO: 116841 - DNA, 20 bp, human
gcacacagagaaggaccgag

SEQ ID NO: 116842 - DNA, 20 bp, human
gtgaggcggaaggacacacg

SEQ ID NO: 116843 - DNA, 20 bp, human
gtcagccgccgcccgaagtt

SEQ ID NO: 116844 - DNA, 20 bp, human
gcgcctgggcagatccacat

SEQ ID NO: 116845 - DNA, 20 bp, human
gctcggggcgcggggagtcg

SEQ ID NO: 116846 - DNA, 20 bp, human
ggacccaggagtccgagact

SEQ ID NO: 116847 - DNA, 20 bp, human
gctcacttcggcgaagttgg

SEQ ID NO: 116848 - DNA, 20 bp, human
gctggcggatgggacgaggg

SEQ ID NO: 116849 - DNA, 20 bp, human
ggacctggcggatgggacga

SEQ ID NO: 116850 - DNA, 20 bp, human
ggattagagctgaagatgaa

SEQ ID NO: 116851 - DNA, 20 bp, human
ggtccgagactgggagctcg

SEQ ID NO: 116852 - DNA, 20 bp, human
gacgcgggcagaacccggag

SEQ ID NO: 116853 - DNA, 20 bp, human
gctcccagtctcggactcct

SEQ ID NO: 116854 - DNA, 20 bp, human
gtcagggactcgaggtgggg

SEQ ID NO: 116855 - DNA, 20 bp, human
gcgcctcacttcggcgaagt

SEQ ID NO: 116856 - DNA, 20 bp, human
gggaccctcagagctctcac

SEQ ID NO: 116857 - DNA, 20 bp, human
gtctcagtggtcagacccag

SEQ ID NO: 116858 - DNA, 20 bp, human
gggcttgcagcaggccgagg

SEQ ID NO: 116859 - DNA, 20 bp, human
gcgaggttcttcctggaggt

SEQ ID NO: 116860 - DNA, 20 bp, human
ggtggtcagacccagaggtg

SEQ ID NO: 116861 - DNA, 20 bp, human
gaggaaacagctcagacgtg

SEQ ID NO: 116862 - DNA, 20 bp, human
gggaagaacctcgtcagcac

SEQ ID NO: 116863 - DNA, 20 bp, human
ggccccagtgagagctctga

SEQ ID NO: 116864 - DNA, 20 bp, human
gtcgtcagcactggcactgg

SEQ ID NO: 116865 - DNA, 20 bp, human
gctgacgaggttcttcctgg

SEQ ID NO: 116866 - DNA, 20 bp, human
gtccggcctggagaagcgag

SEQ ID NO: 116867 - DNA, 20 bp, human
gcagcgtcagcagatcccag

SEQ ID NO: 116868 - DNA, 20 bp, human
ggcggctcgggcgttgttca

SEQ ID NO: 116869 - DNA, 20 bp, human
ggcctggagaagcgagcggg

SEQ ID NO: 116870 - DNA, 20 bp, human
gagagccagggccgatatca

SEQ ID NO: 116871 - DNA, 20 bp, human
gcccgcgccgccaggaatag

SEQ ID NO: 116872 - DNA, 20 bp, human
gccagggccgatatcaggga

SEQ ID NO: 116873 - DNA, 20 bp, human
gcagatcccagtggttacgt

SEQ ID NO: 116874 - DNA, 20 bp, human
gccagtggtcgcgcaagtga

SEQ ID NO: 116875 - DNA, 20 bp, human
gaggccacgcccacaggact

SEQ ID NO: 116876 - DNA, 20 bp, human
gagcccagcaggccgcagac

SEQ ID NO: 116877 - DNA, 20 bp, human
gcgcgcgtggctcccgtctg

SEQ ID NO: 116878 - DNA, 20 bp, human
gcgagcaagaccggttgtct

SEQ ID NO: 116879 - DNA, 20 bp, human
gcgttgcccggacggacgca

SEQ ID NO: 116880 - DNA, 20 bp, human
gcggttgtctgggaacctcc

SEQ ID NO: 116881 - DNA, 20 bp, human
gggcgggcagccacgatgtc

SEQ ID NO: 116882 - DNA, 20 bp, human
gacgatgtcgggcaagccca

SEQ ID NO: 116883 - DNA, 20 bp, human
gtgcccgcctacctgagcgt

SEQ ID NO: 116884 - DNA, 20 bp, human
gagggtaaaaacctacgctc

SEQ ID NO: 116885 - DNA, 20 bp, human
gtaaaaacctacgctcaggt

SEQ ID NO: 116886 - DNA, 20 bp, human
gtccagcgggaagctctcca

SEQ ID NO: 116887 - DNA, 20 bp, human
gaccctgcgctgccctcgga

SEQ ID NO: 116888 - DNA, 20 bp, human
gtgcggcccgcgccaatgag

SEQ ID NO: 116889 - DNA, 20 bp, human
ggccgtccgagggcagcgca

SEQ ID NO: 116890 - DNA, 20 bp, human
gctcggcccccgccgctcat

SEQ ID NO: 116891 - DNA, 20 bp, human
gcacggccgtgaagtccagc

SEQ ID NO: 116892 - DNA, 20 bp, human
gaggaggcggctgctgaccc

SEQ ID NO: 116893 - DNA, 20 bp, human
gagcttcccgctggacttca

SEQ ID NO: 116894 - DNA, 20 bp, human
gggagcgggcggccttgagg

SEQ ID NO: 116895 - DNA, 20 bp, human
ggcgcagggtctgggtgcgc

SEQ ID NO: 116896 - DNA, 20 bp, human
gcggcaagcaccggaccagg

SEQ ID NO: 116897 - DNA, 20 bp, human
gggcgagagctgctcagatc

SEQ ID NO: 116898 - DNA, 20 bp, human
ggagcccggtgaccaaatgg

SEQ ID NO: 116899 - DNA, 20 bp, human
gagcaccgcgcgcaccccgg

SEQ ID NO: 116900 - DNA, 20 bp, human
gagccatgcgacgagagcag

SEQ ID NO: 116901 - DNA, 20 bp, human
gggcgggcaaagtaacttgg

SEQ ID NO: 116902 - DNA, 20 bp, human
gcgcgctgcgatcacagtag

SEQ ID NO: 116903 - DNA, 20 bp, human
ggggtgcgcgcggtgctgga

SEQ ID NO: 116904 - DNA, 20 bp, human
gaacctgtgctgggcgtgat

SEQ ID NO: 116905 - DNA, 20 bp, human
ggtcgcagcgacctgaaggc

SEQ ID NO: 116906 - DNA, 20 bp, human
gcgccgagcagcccaggcaa

SEQ ID NO: 116907 - DNA, 20 bp, human
gggcaacggcagaaccgctc

SEQ ID NO: 116908 - DNA, 20 bp, human
gatgccgagagaggagcgag

SEQ ID NO: 116909 - DNA, 20 bp, human
ggagccgggaaggagcgcgg

SEQ ID NO: 116910 - DNA, 20 bp, human
gaggaggtggatgccgagag

SEQ ID NO: 116911 - DNA, 20 bp, human
gagaggggcgagtgaatgag

SEQ ID NO: 116912 - DNA, 20 bp, human
gtttgttctcactggggagg

SEQ ID NO: 116913 - DNA, 20 bp, human
gagcgagcgcaacgctagcg

SEQ ID NO: 116914 - DNA, 20 bp, human
ggagggggtgtgagagacgg

SEQ ID NO: 116915 - DNA, 20 bp, human
gttgcgtttggggtttctta

SEQ ID NO: 116916 - DNA, 20 bp, human
gtggtgcagaccacctcggg

SEQ ID NO: 116917 - DNA, 20 bp, human
gggccgcggaggccgtgaag

SEQ ID NO: 116918 - DNA, 20 bp, human
ggagacacccctccccgagg

SEQ ID NO: 116919 - DNA, 20 bp, human
gccggcggccatcatcctca

SEQ ID NO: 116920 - DNA, 20 bp, human
ggcggtgcacggcctcttca

SEQ ID NO: 116921 - DNA, 20 bp, human
gggcctcttgcgggaatccg

SEQ ID NO: 116922 - DNA, 20 bp, human
ggggcctcagcgagaggagg

SEQ ID NO: 116923 - DNA, 20 bp, human
gccaagcgcagcaacacggg

SEQ ID NO: 116924 - DNA, 20 bp, human
gccgccccaggcccccccca

SEQ ID NO: 116925 - DNA, 20 bp, human
gcggccatcatcctcatggt

SEQ ID NO: 116926 - DNA, 20 bp, human
gcaactgtgggtcagatgag

SEQ ID NO: 116927 - DNA, 20 bp, human
gtcccaggaactcttggggt

SEQ ID NO: 116928 - DNA, 20 bp, human
gttcattcccaggaactctt

SEQ ID NO: 116929 - DNA, 20 bp, human
ggtagtagttagaagtgaga

SEQ ID NO: 116930 - DNA, 20 bp, human
gagagagaaatcagcactca

SEQ ID NO: 116931 - DNA, 20 bp, human
gggagcccttctaggcaaca

SEQ ID NO: 116932 - DNA, 20 bp, human
ggaaggacctctccagaatc

SEQ ID NO: 116933 - DNA, 20 bp, human
gcttgtggttctcatagata

SEQ ID NO: 116934 - DNA, 20 bp, human
gagcaatccggattctggag

SEQ ID NO: 116935 - DNA, 20 bp, human
gttgtcaaatcacaagtatt

SEQ ID NO: 116936 - DNA, 20 bp, human
ggagcaacaagtatcatgat

SEQ ID NO: 116937 - DNA, 20 bp, human
gaacatccagacacaggtga

SEQ ID NO: 116938 - DNA, 20 bp, human
gatacttactactaatatgg

SEQ ID NO: 116939 - DNA, 20 bp, human
gcgacccaacatccagacac

SEQ ID NO: 116940 - DNA, 20 bp, human
ggatgttgggtcgttagtaa

SEQ ID NO: 116941 - DNA, 20 bp, human
gatgatacttactactaata

SEQ ID NO: 116942 - DNA, 20 bp, human
gcaagcaacgttgattaaga

SEQ ID NO: 116943 - DNA, 20 bp, human
gcatgatacttgttgctctt

SEQ ID NO: 116944 - DNA, 20 bp, human
gttgttgctcttcggctgtc

SEQ ID NO: 116945 - DNA, 20 bp, human
gctttgcatgattctataag

SEQ ID NO: 116946 - DNA, 20 bp, human
gccgccggaccgagaaggag

SEQ ID NO: 116947 - DNA, 20 bp, human
gaccctcggtcctcgctcag

SEQ ID NO: 116948 - DNA, 20 bp, human
gtctctgagcgtgcacgggt

SEQ ID NO: 116949 - DNA, 20 bp, human
gtgtgcccgccggaccgaga

SEQ ID NO: 116950 - DNA, 20 bp, human
ggagctggctcgccaacgaa

SEQ ID NO: 116951 - DNA, 20 bp, human
gctcagagcgctgggcgtct

SEQ ID NO: 116952 - DNA, 20 bp, human
gcgcccgctccttctcggtc

SEQ ID NO: 116953 - DNA, 20 bp, human
gagactgagtggaagcccga

SEQ ID NO: 116954 - DNA, 20 bp, human
gcctagcccgccatcctacc

SEQ ID NO: 116955 - DNA, 20 bp, human
gtacagttgtgcggcctgcc

SEQ ID NO: 116956 - DNA, 20 bp, human
gccgaaagggaaggtgtcag

SEQ ID NO: 116957 - DNA, 20 bp, human
gcaccaggctgggaacctca

SEQ ID NO: 116958 - DNA, 20 bp, human
gggcgcggcccagatgagac

SEQ ID NO: 116959 - DNA, 20 bp, human
ggccctgggacacccagcaa

SEQ ID NO: 116960 - DNA, 20 bp, human
gggctggggaaggatcgggt

SEQ ID NO: 116961 - DNA, 20 bp, human
gcaatggctggggaaggatc

SEQ ID NO: 116962 - DNA, 20 bp, human
gaccgttgctgggtgtccca

SEQ ID NO: 116963 - DNA, 20 bp, human
ggggaacctcaaggccgaaa

SEQ ID NO: 116964 - DNA, 20 bp, human
gagggaggcatgtaggacca

SEQ ID NO: 116965 - DNA, 20 bp, human
gtcagggaacgcagcaactg

SEQ ID NO: 116966 - DNA, 20 bp, human
gggcgctgggccctccccag

SEQ ID NO: 116967 - DNA, 20 bp, human
gaggaggggccaggatcccg

SEQ ID NO: 116968 - DNA, 20 bp, human
gcccgacccagcgaacgccc

SEQ ID NO: 116969 - DNA, 20 bp, human
gagcgaacgccccggcaggt

SEQ ID NO: 116970 - DNA, 20 bp, human
gcggcagggcgaccccgtga

SEQ ID NO: 116971 - DNA, 20 bp, human
gtaagcgaggccgcgctggg

SEQ ID NO: 116972 - DNA, 20 bp, human
ggctgcggggtctccgaggc

SEQ ID NO: 116973 - DNA, 20 bp, human
ggcgcaggctgtggatcgtg

SEQ ID NO: 116974 - DNA, 20 bp, human
gcctccccaggggctcgagg

SEQ ID NO: 116975 - DNA, 20 bp, human
gggcgaccccgtgacggtcg

SEQ ID NO: 116976 - DNA, 20 bp, human
gccccaagcccacgatctgg

SEQ ID NO: 116977 - DNA, 20 bp, human
gggcgtgcaagactgaagaa

SEQ ID NO: 116978 - DNA, 20 bp, human
ggctcctgcccccagatcgt

SEQ ID NO: 116979 - DNA, 20 bp, human
gcttagtggccccaagggat

SEQ ID NO: 116980 - DNA, 20 bp, human
gagccctctcaagcacgggg

SEQ ID NO: 116981 - DNA, 20 bp, human
gcagagaaggcaaacgtctg

SEQ ID NO: 116982 - DNA, 20 bp, human
ggccgtggaggtgctggtcc

SEQ ID NO: 116983 - DNA, 20 bp, human
gagaggctccaagtaagacc

SEQ ID NO: 116984 - DNA, 20 bp, human
gtcagtcttgcacgcctcca

SEQ ID NO: 116985 - DNA, 20 bp, human
ggtgcttgagagggctctgg

SEQ ID NO: 116986 - DNA, 20 bp, human
gtcatgggcagccagtgatt

SEQ ID NO: 116987 - DNA, 20 bp, human
gtccaaaacgcaggagggaa

SEQ ID NO: 116988 - DNA, 20 bp, human
gactggctgcccatgaatcc

SEQ ID NO: 116989 - DNA, 20 bp, human
gtttgaggattcctaatcac

SEQ ID NO: 116990 - DNA, 20 bp, human
gtagagtgtgaattcaagag

SEQ ID NO: 116991 - DNA, 20 bp, human
gtcctcagtacttctgatcc

SEQ ID NO: 116992 - DNA, 20 bp, human
gaatggaagggaaaacgtcc

SEQ ID NO: 116993 - DNA, 20 bp, human
gagagccaatcttctctgtt

SEQ ID NO: 116994 - DNA, 20 bp, human
gtatcattgtcccctgtcta

SEQ ID NO: 116995 - DNA, 20 bp, human
ggagaacagagtttagtgaa

SEQ ID NO: 116996 - DNA, 20 bp, human
gcgtaaaacagggtcagcag

SEQ ID NO: 116997 - DNA, 20 bp, human
ggcttggtcgccagaggagg

SEQ ID NO: 116998 - DNA, 20 bp, human
gtgtgcttggtcgccagagg

SEQ ID NO: 116999 - DNA, 20 bp, human
gggagagtgaacatgcggct

SEQ ID NO: 117000 - DNA, 20 bp, human
gggcacggctagctctaaat

SEQ ID NO: 117001 - DNA, 20 bp, human
ggagtgaacatgcggctggg

SEQ ID NO: 117002 - DNA, 20 bp, human
gtgcctcctaccgtaaaaca

SEQ ID NO: 117003 - DNA, 20 bp, human
gggttccgagcaggcagcat

SEQ ID NO: 117004 - DNA, 20 bp, human
ggtttgtgcttggtcgccag

SEQ ID NO: 117005 - DNA, 20 bp, human
gagggatccttacggaactg

SEQ ID NO: 117006 - DNA, 20 bp, human
gggcagctccatagaccccg

SEQ ID NO: 117007 - DNA, 20 bp, human
ggaggtgggcgccgagagct

SEQ ID NO: 117008 - DNA, 20 bp, human
gcagcgggacgcgcgggctg

SEQ ID NO: 117009 - DNA, 20 bp, human
gcctggttcctggggttagg

SEQ ID NO: 117010 - DNA, 20 bp, human
gctccaagtctgcgaggccg

SEQ ID NO: 117011 - DNA, 20 bp, human
gttgggagacctggacacgg

SEQ ID NO: 117012 - DNA, 20 bp, human
ggcgcgtctccaagtctgcg

SEQ ID NO: 117013 - DNA, 20 bp, human
gtgttctgaacgcctggtcc

SEQ ID NO: 117014 - DNA, 20 bp, human
gacacctgggccccgagtgt

SEQ ID NO: 117015 - DNA, 20 bp, human
ggagtgtcgggtcaatcctg

SEQ ID NO: 117016 - DNA, 20 bp, human
gcaggacgcgaagcccccag

SEQ ID NO: 117017 - DNA, 20 bp, human
gcgcagccgcgcgggtccct

SEQ ID NO: 117018 - DNA, 20 bp, human
gggcctctcgcaggagccga

SEQ ID NO: 117019 - DNA, 20 bp, human
gcccagcggcctgactgtgg

SEQ ID NO: 117020 - DNA, 20 bp, human
gtccccgccggctctgcgtg

SEQ ID NO: 117021 - DNA, 20 bp, human
gtagcaatcgctgggccggt

SEQ ID NO: 117022 - DNA, 20 bp, human
ggagaggccggctgctcgcg

SEQ ID NO: 117023 - DNA, 20 bp, human
gcacctgctcgccagcgtgg

SEQ ID NO: 117024 - DNA, 20 bp, human
gccggggaccccggacgcgg

SEQ ID NO: 117025 - DNA, 20 bp, human
ggcaccggggaccccggacg

SEQ ID NO: 117026 - DNA, 20 bp, human
gtcctcatctgtagaacgag

SEQ ID NO: 117027 - DNA, 20 bp, human
ggtggccgcggctcactaat

SEQ ID NO: 117028 - DNA, 20 bp, human
ggggcaggcaaagtgagccc

SEQ ID NO: 117029 - DNA, 20 bp, human
ggcaccccgcagaacgtcca

SEQ ID NO: 117030 - DNA, 20 bp, human
gcactaatgggattgcaggc

SEQ ID NO: 117031 - DNA, 20 bp, human
gccgccgcgcacagtggccg

SEQ ID NO: 117032 - DNA, 20 bp, human
gtcctctccgccgcgcacag

SEQ ID NO: 117033 - DNA, 20 bp, human
gacacacatgcacattgcca

SEQ ID NO: 117034 - DNA, 20 bp, human
gactactcaccgctgctggt

SEQ ID NO: 117035 - DNA, 20 bp, human
ggtgttgtaagacacaaaac

SEQ ID NO: 117036 - DNA, 20 bp, human
ggagagacggggaagcacgg

SEQ ID NO: 117037 - DNA, 20 bp, human
ggagctgagggaacccgctg

SEQ ID NO: 117038 - DNA, 20 bp, human
gcgagcctgagcgagagacg

SEQ ID NO: 117039 - DNA, 20 bp, human
gtggggctgtcgcatgtcta

SEQ ID NO: 117040 - DNA, 20 bp, human
ggcctggcaggagctatata

SEQ ID NO: 117041 - DNA, 20 bp, human
ggctcgctctctgctctcct

SEQ ID NO: 117042 - DNA, 20 bp, human
gtcccgtcccgacgcaccgg

SEQ ID NO: 117043 - DNA, 20 bp, human
ggcctggcagctcggatctg

SEQ ID NO: 117044 - DNA, 20 bp, human
gagcgagagacggggaagca

SEQ ID NO: 117045 - DNA, 20 bp, human
gtggcaggagctatataagg

SEQ ID NO: 117046 - DNA, 20 bp, human
ggaaccaggagatgcggcgc

SEQ ID NO: 117047 - DNA, 20 bp, human
gcacagcaggaaccacaata

SEQ ID NO: 117048 - DNA, 20 bp, human
gcatctcctggttccagtgg

SEQ ID NO: 117049 - DNA, 20 bp, human
gcaggggtcctaattaagtg

SEQ ID NO: 117050 - DNA, 20 bp, human
gaagcccgaggggaagctcg

SEQ ID NO: 117051 - DNA, 20 bp, human
ggcgagttcagtgccgccac

SEQ ID NO: 117052 - DNA, 20 bp, human
gtgccgtgaagcgaaagagg

SEQ ID NO: 117053 - DNA, 20 bp, human
ggctcggggtggaacacctg

SEQ ID NO: 117054 - DNA, 20 bp, human
gcagtgccgccactggaacc

SEQ ID NO: 117055 - DNA, 20 bp, human
gtctcaactcgtaagctggg

SEQ ID NO: 117056 - DNA, 20 bp, human
gcgccctcgccgcagatata

SEQ ID NO: 117057 - DNA, 20 bp, human
ggggacgccggctgactggt

SEQ ID NO: 117058 - DNA, 20 bp, human
gcctcgccgcagatataagg

SEQ ID NO: 117059 - DNA, 20 bp, human
gctcggagcagccaccgcct

SEQ ID NO: 117060 - DNA, 20 bp, human
gacgccggctgactggtggg

SEQ ID NO: 117061 - DNA, 20 bp, human
gctgggccgccttatatctg

SEQ ID NO: 117062 - DNA, 20 bp, human
gctcgcgtggtacaagccag

SEQ ID NO: 117063 - DNA, 20 bp, human
gccgcgcgtacggggacctg

SEQ ID NO: 117064 - DNA, 20 bp, human
gtgtcgcggaccgggccatg

SEQ ID NO: 117065 - DNA, 20 bp, human
gagcaggcacagcgccaggg

SEQ ID NO: 117066 - DNA, 20 bp, human
ggccgggcgaagactgcgaa

SEQ ID NO: 117067 - DNA, 20 bp, human
gggcgtccaggaaggcgtag

SEQ ID NO: 117068 - DNA, 20 bp, human
gatgtcgccgcggactcacg

SEQ ID NO: 117069 - DNA, 20 bp, human
gaggagatagcgatgaccag

SEQ ID NO: 117070 - DNA, 20 bp, human
gcggaagctggcgtccagga

SEQ ID NO: 117071 - DNA, 20 bp, human
ggcggcaagttatcagctgg

SEQ ID NO: 117072 - DNA, 20 bp, human
gcgcgcggcaagttatcagc

SEQ ID NO: 117073 - DNA, 20 bp, human
gctcaggctggtgatgaagt

SEQ ID NO: 117074 - DNA, 20 bp, human
ggagttgcccgccagaccca

SEQ ID NO: 117075 - DNA, 20 bp, human
gagcaggtccgtgcagaacc

SEQ ID NO: 117076 - DNA, 20 bp, human
gctgaagtctcaccaggaag

SEQ ID NO: 117077 - DNA, 20 bp, human
gactgacagacctccagctg

SEQ ID NO: 117078 - DNA, 20 bp, human
ggtgcatctgcgggttgctg

SEQ ID NO: 117079 - DNA, 20 bp, human
ggaaggaccttcagattcaa

SEQ ID NO: 117080 - DNA, 20 bp, human
gtctgcagcatctctcggga

SEQ ID NO: 117081 - DNA, 20 bp, human
gcgggctgcgtagaatcaag

SEQ ID NO: 117082 - DNA, 20 bp, human
gagcagctgctctctgcggg

SEQ ID NO: 117083 - DNA, 20 bp, human
ggtttcaagacctgccctgc

SEQ ID NO: 117084 - DNA, 20 bp, human
ggctgctctctgcgggagga

SEQ ID NO: 117085 - DNA, 20 bp, human
ggtgcttcgagtccagaagt

SEQ ID NO: 117086 - DNA, 20 bp, human
ggcaccccgcgcaggaggag

SEQ ID NO: 117087 - DNA, 20 bp, human
ggaggcggctctacttcccc

SEQ ID NO: 117088 - DNA, 20 bp, human
gggaagtagagccgcctccg

SEQ ID NO: 117089 - DNA, 20 bp, human
gctgaaaggaatctggaccc

SEQ ID NO: 117090 - DNA, 20 bp, human
ggatggaacaagctcagaac

SEQ ID NO: 117091 - DNA, 20 bp, human
ggcactcgcggatcgtcaca

SEQ ID NO: 117092 - DNA, 20 bp, human
gtttctagcagagcccgggg

SEQ ID NO: 117093 - DNA, 20 bp, human
gcggcccgggagagtatctg

SEQ ID NO: 117094 - DNA, 20 bp, human
gcatcacggccagaaaccgt

SEQ ID NO: 117095 - DNA, 20 bp, human
ggacagaaacaggacaagtg

SEQ ID NO: 117096 - DNA, 20 bp, human
gggaggactgagcactctgg

SEQ ID NO: 117097 - DNA, 20 bp, human
gacctggtgagcatcaccta

SEQ ID NO: 117098 - DNA, 20 bp, human
gtagggaggactgagcactc

SEQ ID NO: 117099 - DNA, 20 bp, human
gaggcctggaccccacagta

SEQ ID NO: 117100 - DNA, 20 bp, human
gccaggcctgcagttgaggg

SEQ ID NO: 117101 - DNA, 20 bp, human
gctgcgcttggtgagtccca

SEQ ID NO: 117102 - DNA, 20 bp, human
ggctgaccccttcccagacc

SEQ ID NO: 117103 - DNA, 20 bp, human
gccacagtagggccagtgac

SEQ ID NO: 117104 - DNA, 20 bp, human
gggtccaggcctgcagttga

SEQ ID NO: 117105 - DNA, 20 bp, human
gcgttactgggtgacagcaa

SEQ ID NO: 117106 - DNA, 20 bp, human
gtttgtcttgtgaccgcggg

SEQ ID NO: 117107 - DNA, 20 bp, human
gttatccgcgatgcgtttcc

SEQ ID NO: 117108 - DNA, 20 bp, human
gtgtagggcggacaacagaa

SEQ ID NO: 117109 - DNA, 20 bp, human
gataacgaagttccaagctc

SEQ ID NO: 117110 - DNA, 20 bp, human
ggctgccaggaaacgcatcg

SEQ ID NO: 117111 - DNA, 20 bp, human
gtccagttaggtagggtcca

SEQ ID NO: 117112 - DNA, 20 bp, human
gaccggttcggcctgggcag

SEQ ID NO: 117113 - DNA, 20 bp, human
gtccagctctggtggagggg

SEQ ID NO: 117114 - DNA, 20 bp, human
gtgggctgggcggatccctc

SEQ ID NO: 117115 - DNA, 20 bp, human
gagcccattccagttaggta

SEQ ID NO: 117116 - DNA, 20 bp, human
gtccacctgagggggcggga

SEQ ID NO: 117117 - DNA, 20 bp, human
gctgcagcaaggatccggga

SEQ ID NO: 117118 - DNA, 20 bp, human
ggacgctgcagcaaggatcc

SEQ ID NO: 117119 - DNA, 20 bp, human
gggcttctgccggttcccag

SEQ ID NO: 117120 - DNA, 20 bp, human
gctgcgcgctccacctgagg

SEQ ID NO: 117121 - DNA, 20 bp, human
gtgcaggcctggtccgctgg

SEQ ID NO: 117122 - DNA, 20 bp, human
gcatggcaccgcgaggccag

SEQ ID NO: 117123 - DNA, 20 bp, human
ggcagcgcggagcctccaaa

SEQ ID NO: 117124 - DNA, 20 bp, human
gggcctgtttattccatcgt

SEQ ID NO: 117125 - DNA, 20 bp, human
gggaagaagccatgaatgta

SEQ ID NO: 117126 - DNA, 20 bp, human
gcaggaagatggcgaacgtg

SEQ ID NO: 117127 - DNA, 20 bp, human
gcgcgaggccgcgacacctg

SEQ ID NO: 117128 - DNA, 20 bp, human
gaggccgcgacacctgcgga

SEQ ID NO: 117129 - DNA, 20 bp, human
ggccgggccgcctccctgaa

SEQ ID NO: 117130 - DNA, 20 bp, human
gggactcggacccacagagc

SEQ ID NO: 117131 - DNA, 20 bp, human
gcagccccaggccccgtcgc

SEQ ID NO: 117132 - DNA, 20 bp, human
ggaggaccaccgcgccgcac

SEQ ID NO: 117133 - DNA, 20 bp, human
ggaagccagggcctgtcgcc

SEQ ID NO: 117134 - DNA, 20 bp, human
gtctcgcgagcagcccggag

SEQ ID NO: 117135 - DNA, 20 bp, human
gttcctgccggcccacgccc

SEQ ID NO: 117136 - DNA, 20 bp, human
gggagggcccgcaaggaggg

SEQ ID NO: 117137 - DNA, 20 bp, human
gaaggggaggagggcccgca

SEQ ID NO: 117138 - DNA, 20 bp, human
ggggaggagggcccgcaagg

SEQ ID NO: 117139 - DNA, 20 bp, human
ggtgcgggcggactggcggg

SEQ ID NO: 117140 - DNA, 20 bp, human
gaggcaaaggctgtagttga

SEQ ID NO: 117141 - DNA, 20 bp, human
gcagccggagcgctaggggc

SEQ ID NO: 117142 - DNA, 20 bp, human
gggcgggcgggcctcgggtc

SEQ ID NO: 117143 - DNA, 20 bp, human
ggggctgcctacggggaagg

SEQ ID NO: 117144 - DNA, 20 bp, human
gcccgagggtcgctgtacct

SEQ ID NO: 117145 - DNA, 20 bp, human
gggagcgctaggggctggga

SEQ ID NO: 117146 - DNA, 20 bp, human
gtaactccaggcttaggggc

SEQ ID NO: 117147 - DNA, 20 bp, human
gctgagagcatgaagtcctg

SEQ ID NO: 117148 - DNA, 20 bp, human
gaggtggcagcatggattct

SEQ ID NO: 117149 - DNA, 20 bp, human
gcactacctgctccaggcaa

SEQ ID NO: 117150 - DNA, 20 bp, human
gtgctgctgttaatagacgg

SEQ ID NO: 117151 - DNA, 20 bp, human
gcccagaggtgagtctgaaa

SEQ ID NO: 117152 - DNA, 20 bp, human
gtgctgctgctgttaataga

SEQ ID NO: 117153 - DNA, 20 bp, human
gcaggaagaccagctctccg

SEQ ID NO: 117154 - DNA, 20 bp, human
gcacaggatgcccagacctc

SEQ ID NO: 117155 - DNA, 20 bp, human
gggttggggtggctgtagga

SEQ ID NO: 117156 - DNA, 20 bp, human
gcgggagccagtcagcccga

SEQ ID NO: 117157 - DNA, 20 bp, human
gagccagtcagcccgagggg

SEQ ID NO: 117158 - DNA, 20 bp, human
gcgccggagcccgcaactgg

SEQ ID NO: 117159 - DNA, 20 bp, human
gccgcaggtccggtcggtcc

SEQ ID NO: 117160 - DNA, 20 bp, human
gcccctggtcgggaggcgag

SEQ ID NO: 117161 - DNA, 20 bp, human
gtggccggtttccctcccct

SEQ ID NO: 117162 - DNA, 20 bp, human
gtctggctctggacagccat

SEQ ID NO: 117163 - DNA, 20 bp, human
ggggctccggcggtctccga

SEQ ID NO: 117164 - DNA, 20 bp, human
gtctgcccgctggcccgaag

SEQ ID NO: 117165 - DNA, 20 bp, human
gcgcagcgctgctgcccgca

SEQ ID NO: 117166 - DNA, 20 bp, human
gtctgtggtgcagacatcca

SEQ ID NO: 117167 - DNA, 20 bp, human
ggacctggtcaagggatgtg

SEQ ID NO: 117168 - DNA, 20 bp, human
gtcactggcccaacactggg

SEQ ID NO: 117169 - DNA, 20 bp, human
gccagcctggagcggaagcc

SEQ ID NO: 117170 - DNA, 20 bp, human
ggagtggagcaggcagtccg

SEQ ID NO: 117171 - DNA, 20 bp, human
gccgggagaggtaacagcat

SEQ ID NO: 117172 - DNA, 20 bp, human
gccggacaaggaggcgggga

SEQ ID NO: 117173 - DNA, 20 bp, human
gagcgttgggcattagagag

SEQ ID NO: 117174 - DNA, 20 bp, human
gcactccaggcttccgctcc

SEQ ID NO: 117175 - DNA, 20 bp, human
gtccctgctctgcaagcctg

SEQ ID NO: 117176 - DNA, 20 bp, human
gtgccagggaaaccaaccgg

SEQ ID NO: 117177 - DNA, 20 bp, human
gcgtctcgccagcatctccc

SEQ ID NO: 117178 - DNA, 20 bp, human
gggtaggaggttgagacgtt

SEQ ID NO: 117179 - DNA, 20 bp, human
ggttagtgagttgttagggt

SEQ ID NO: 117180 - DNA, 20 bp, human
gggaggttgagacgttaggt

SEQ ID NO: 117181 - DNA, 20 bp, human
gggagtgagggtcggaggag

SEQ ID NO: 117182 - DNA, 20 bp, human
gacaacctgggaaggtaagt

SEQ ID NO: 117183 - DNA, 20 bp, human
gcgacagcgagatcctctcc

SEQ ID NO: 117184 - DNA, 20 bp, human
gagtgagttgttagggtagg

SEQ ID NO: 117185 - DNA, 20 bp, human
ggccctgcggcgccgcaatc

SEQ ID NO: 117186 - DNA, 20 bp, human
gcgctcgtgagccccgcggg

SEQ ID NO: 117187 - DNA, 20 bp, human
gagtgatcgaggacacgtac

SEQ ID NO: 117188 - DNA, 20 bp, human
gagcgacgaggcggtcccca

SEQ ID NO: 117189 - DNA, 20 bp, human
gggtactcactaggtagtag

SEQ ID NO: 117190 - DNA, 20 bp, human
gactgggcagcggaacggaa

SEQ ID NO: 117191 - DNA, 20 bp, human
ggctggacacggagaacaag

SEQ ID NO: 117192 - DNA, 20 bp, human
ggggctcacgagcgacgagg

SEQ ID NO: 117193 - DNA, 20 bp, human
gggacggccgtgcttcccaa

SEQ ID NO: 117194 - DNA, 20 bp, human
gcactaggtagtagcggcaa

SEQ ID NO: 117195 - DNA, 20 bp, human
gagtcctgctggtactcact

SEQ ID NO: 117196 - DNA, 20 bp, human
gcgcggtgcgccgccttccg

SEQ ID NO: 117197 - DNA, 20 bp, human
gcgggaggagcctcggaagg

SEQ ID NO: 117198 - DNA, 20 bp, human
gccccgtccgctgccacccg

SEQ ID NO: 117199 - DNA, 20 bp, human
ggtagccaaacggcacccag

SEQ ID NO: 117200 - DNA, 20 bp, human
gccaagtgtcccgacgaggg

SEQ ID NO: 117201 - DNA, 20 bp, human
gggaccgaggactggccgag

SEQ ID NO: 117202 - DNA, 20 bp, human
gctcctcccgcgggtggcag

SEQ ID NO: 117203 - DNA, 20 bp, human
ggccacaagcctgaggaccg

SEQ ID NO: 117204 - DNA, 20 bp, human
gaagcctgaggaccgaggac

SEQ ID NO: 117205 - DNA, 20 bp, human
gcgcaggcgtcccccctcgt

SEQ ID NO: 117206 - DNA, 20 bp, human
gggagcctaggagagcgatg

SEQ ID NO: 117207 - DNA, 20 bp, human
gtcagcctcatcgctctcct

SEQ ID NO: 117208 - DNA, 20 bp, human
ggacagagagagatactcac

SEQ ID NO: 117209 - DNA, 20 bp, human
gggctgtgagtagtgagaca

SEQ ID NO: 117210 - DNA, 20 bp, human
ggtgagaatgagctcaagct

SEQ ID NO: 117211 - DNA, 20 bp, human
gcaagctgggtcagagagca

SEQ ID NO: 117212 - DNA, 20 bp, human
gagatactcacagggaagag

SEQ ID NO: 117213 - DNA, 20 bp, human
gagagagaacggcttagaca

SEQ ID NO: 117214 - DNA, 20 bp, human
gagaggaaaacgagaaaggg

SEQ ID NO: 117215 - DNA, 20 bp, human
ggctgcaggtccttcttgaa

SEQ ID NO: 117216 - DNA, 20 bp, human
gtgcagaaggacgctcctgg

SEQ ID NO: 117217 - DNA, 20 bp, human
gcacgcgctggccatgatcg

SEQ ID NO: 117218 - DNA, 20 bp, human
gaggcgatagaaggagctca

SEQ ID NO: 117219 - DNA, 20 bp, human
gtcgcggagctcggcgctgt

SEQ ID NO: 117220 - DNA, 20 bp, human
gagtacgttgaggcgataga

SEQ ID NO: 117221 - DNA, 20 bp, human
ggcacatacacagtacgttg

SEQ ID NO: 117222 - DNA, 20 bp, human
ggcgggatgacacttgcaga

SEQ ID NO: 117223 - DNA, 20 bp, human
ggagtagtttagggtcaaga

SEQ ID NO: 117224 - DNA, 20 bp, human
ggaaggagctcacggtttcg

SEQ ID NO: 117225 - DNA, 20 bp, human
gaagtgtcatcccgcgatca

SEQ ID NO: 117226 - DNA, 20 bp, human
gagcagcgcgggagcgctag

SEQ ID NO: 117227 - DNA, 20 bp, human
gcaggttcccaggaacggaa

SEQ ID NO: 117228 - DNA, 20 bp, human
ggagcggcccgaggaaggta

SEQ ID NO: 117229 - DNA, 20 bp, human
gaactaaggggcgtcagata

SEQ ID NO: 117230 - DNA, 20 bp, human
ggacccgcagcgactccaca

SEQ ID NO: 117231 - DNA, 20 bp, human
gtaaggggcgtcagataagg

SEQ ID NO: 117232 - DNA, 20 bp, human
ggcgggagcgctaggggcac

SEQ ID NO: 117233 - DNA, 20 bp, human
gcgcccggcagctctgagga

SEQ ID NO: 117234 - DNA, 20 bp, human
gtggccatggaggggcatac

SEQ ID NO: 117235 - DNA, 20 bp, human
gtggcttcagtgggtctcgt

SEQ ID NO: 117236 - DNA, 20 bp, human
gcaccatgctgggtacatgg

SEQ ID NO: 117237 - DNA, 20 bp, human
gtggagtccgaacccctgat

SEQ ID NO: 117238 - DNA, 20 bp, human
gacccctgatgggaaactgc

SEQ ID NO: 117239 - DNA, 20 bp, human
ggcccgcagtttcccatcag

SEQ ID NO: 117240 - DNA, 20 bp, human
gcccgcagtgccaccatgct

SEQ ID NO: 117241 - DNA, 20 bp, human
gctcgcctggctaaagcaag

SEQ ID NO: 117242 - DNA, 20 bp, human
gacagggctgttccatcttg

SEQ ID NO: 117243 - DNA, 20 bp, human
ggtcccccatgtacccagca

SEQ ID NO: 117244 - DNA, 20 bp, human
gatttcgtgaaatgagacgg

SEQ ID NO: 117245 - DNA, 20 bp, human
gttcatttcgtgaaatgaga

SEQ ID NO: 117246 - DNA, 20 bp, human
ggccactgggaggtttctaa

SEQ ID NO: 117247 - DNA, 20 bp, human
gtcccttagaaacctcccag

SEQ ID NO: 117248 - DNA, 20 bp, human
gacatctatagcaagtgaag

SEQ ID NO: 117249 - DNA, 20 bp, human
gcacacccggcccggccact

SEQ ID NO: 117250 - DNA, 20 bp, human
gctcagaagaagcaagcacg

SEQ ID NO: 117251 - DNA, 20 bp, human
gggtttctaagggactaact

SEQ ID NO: 117252 - DNA, 20 bp, human
gaacctcccagtggccgggc

SEQ ID NO: 117253 - DNA, 20 bp, human
ggctgctgtgcagttgtccg

SEQ ID NO: 117254 - DNA, 20 bp, human
gttgcttcttctgagttatc

SEQ ID NO: 117255 - DNA, 20 bp, human
gatgtactgagattttcttc

SEQ ID NO: 117256 - DNA, 20 bp, human
gactatcatttggggccttg

SEQ ID NO: 117257 - DNA, 20 bp, human
gacagttctacagaggtgca

SEQ ID NO: 117258 - DNA, 20 bp, human
ggagggcagaatgtacctct

SEQ ID NO: 117259 - DNA, 20 bp, human
ggctgcacggacaagagcgg

SEQ ID NO: 117260 - DNA, 20 bp, human
gggacaggtactcggagaag

SEQ ID NO: 117261 - DNA, 20 bp, human
gctgtctgcaaacaatccgg

SEQ ID NO: 117262 - DNA, 20 bp, human
ggcgcggcccgcgacggcac

SEQ ID NO: 117263 - DNA, 20 bp, human
gtcgcgggccgcgctcaccc

SEQ ID NO: 117264 - DNA, 20 bp, human
gacgctgggaaacggatctg

SEQ ID NO: 117265 - DNA, 20 bp, human
gcggacaagagcggaggcct

SEQ ID NO: 117266 - DNA, 20 bp, human
gcgaggcaccgggacgtcgg

SEQ ID NO: 117267 - DNA, 20 bp, human
ggagcgaggcaccgggacgt

SEQ ID NO: 117268 - DNA, 20 bp, human
gcgggcgggcgaagctggag

SEQ ID NO: 117269 - DNA, 20 bp, human
ggaccccggttccccgccct

SEQ ID NO: 117270 - DNA, 20 bp, human
gtgcccagggcggggaaccg

SEQ ID NO: 117271 - DNA, 20 bp, human
gccgccagccgccgacgtcc

SEQ ID NO: 117272 - DNA, 20 bp, human
gcggcggcgtagggaggccg

SEQ ID NO: 117273 - DNA, 20 bp, human
gctcggcctttccctgccca

SEQ ID NO: 117274 - DNA, 20 bp, human
gcgtccgtgtccctccccag

SEQ ID NO: 117275 - DNA, 20 bp, human
gtcccggcctcgcgcccgag

SEQ ID NO: 117276 - DNA, 20 bp, human
gacgagtgcgcgtgctcggt

SEQ ID NO: 117277 - DNA, 20 bp, human
gagggtctatatataagcgc

SEQ ID NO: 117278 - DNA, 20 bp, human
ggagctccgccacgtatccc

SEQ ID NO: 117279 - DNA, 20 bp, human
gcggcaaaggccgaacttcc

SEQ ID NO: 117280 - DNA, 20 bp, human
gcggctgcaaccgggtctgg

SEQ ID NO: 117281 - DNA, 20 bp, human
gtggagaccgccagaccgac

SEQ ID NO: 117282 - DNA, 20 bp, human
gagaccgccagaccgacggg

SEQ ID NO: 117283 - DNA, 20 bp, human
ggagcggcctgaagcgtctg

SEQ ID NO: 117284 - DNA, 20 bp, human
gacccgctcaggcctcccgt

SEQ ID NO: 117285 - DNA, 20 bp, human
gcgccacgtatccccggcaa

SEQ ID NO: 117286 - DNA, 20 bp, human
gccacccagaccgacgccaa

SEQ ID NO: 117287 - DNA, 20 bp, human
gtgcccgctgcggctctccg

SEQ ID NO: 117288 - DNA, 20 bp, human
ggcgcagaggaggaaagaat

SEQ ID NO: 117289 - DNA, 20 bp, human
gcacctggagggctgttaag

SEQ ID NO: 117290 - DNA, 20 bp, human
gctcccgcggagagccgcag

SEQ ID NO: 117291 - DNA, 20 bp, human
gtctgcgcggcagaatcacc

SEQ ID NO: 117292 - DNA, 20 bp, human
gcagggctcgctcgctctca

SEQ ID NO: 117293 - DNA, 20 bp, human
ggcgggagatctcaccgttc

SEQ ID NO: 117294 - DNA, 20 bp, human
ggctgaggcttcctctccat

SEQ ID NO: 117295 - DNA, 20 bp, human
gctgcccttggcgtcggtct

SEQ ID NO: 117296 - DNA, 20 bp, human
gtcctgactcaaaaacgcta

SEQ ID NO: 117297 - DNA, 20 bp, human
ggctaaggcagctgcagtac

SEQ ID NO: 117298 - DNA, 20 bp, human
ggccccgcccaacacatctg

SEQ ID NO: 117299 - DNA, 20 bp, human
gcgcccaaggttacacgtga

SEQ ID NO: 117300 - DNA, 20 bp, human
gactggggcggtaagaggta

SEQ ID NO: 117301 - DNA, 20 bp, human
gggtaagaggtagggatgtg

SEQ ID NO: 117302 - DNA, 20 bp, human
gtcgcacgcacagccaaagg

SEQ ID NO: 117303 - DNA, 20 bp, human
gagtcaggagagccgaacgc

SEQ ID NO: 117304 - DNA, 20 bp, human
ggtcccggccccggtcacta

SEQ ID NO: 117305 - DNA, 20 bp, human
gcgccgtcacgtgtaacctt

SEQ ID NO: 117306 - DNA, 20 bp, human
gtgccgctcccggaggacag

SEQ ID NO: 117307 - DNA, 20 bp, human
gcgcgaggagagcggtccag

SEQ ID NO: 117308 - DNA, 20 bp, human
gtggggtcccagactcgcaa

SEQ ID NO: 117309 - DNA, 20 bp, human
ggcgcctcgccgctgtcctc

SEQ ID NO: 117310 - DNA, 20 bp, human
ggagtctgggaccccatccg

SEQ ID NO: 117311 - DNA, 20 bp, human
gcacctcccgtcgaactcgg

SEQ ID NO: 117312 - DNA, 20 bp, human
gctcccggaggacagcggcg

SEQ ID NO: 117313 - DNA, 20 bp, human
gggttcctcgagactctcag

SEQ ID NO: 117314 - DNA, 20 bp, human
gggtggtgggcgccgatggg

SEQ ID NO: 117315 - DNA, 20 bp, human
gtgcccgcccgaggcggaga

SEQ ID NO: 117316 - DNA, 20 bp, human
gcagacgtaggccaagagag

SEQ ID NO: 117317 - DNA, 20 bp, human
gggtccagggaggcacctca

SEQ ID NO: 117318 - DNA, 20 bp, human
gtgacttccccggtccaggg

SEQ ID NO: 117319 - DNA, 20 bp, human
gccagggaggcacctcaggg

SEQ ID NO: 117320 - DNA, 20 bp, human
ggctcactgagcacttgtgg

SEQ ID NO: 117321 - DNA, 20 bp, human
ggagccgaatgaagaagcgg

SEQ ID NO: 117322 - DNA, 20 bp, human
ggcacgacctcatcttctaa

SEQ ID NO: 117323 - DNA, 20 bp, human
gtgggctgggctgacttccc

SEQ ID NO: 117324 - DNA, 20 bp, human
gtataaaaagaggcggcact

SEQ ID NO: 117325 - DNA, 20 bp, human
gaaaaggaggaagctcacgg

SEQ ID NO: 117326 - DNA, 20 bp, human
ggcctcagggacccacccct

SEQ ID NO: 117327 - DNA, 20 bp, human
ggccaggaggagcaccccgc

SEQ ID NO: 117328 - DNA, 20 bp, human
gggcaggtgggaagcaaacc

SEQ ID NO: 117329 - DNA, 20 bp, human
gcaaggcagtcggttcactt

SEQ ID NO: 117330 - DNA, 20 bp, human
gctgctcctgcaatgaatgg

SEQ ID NO: 117331 - DNA, 20 bp, human
gttcacttgggtgccatgaa

SEQ ID NO: 117332 - DNA, 20 bp, human
gcaagtccgaggctgaaccg

SEQ ID NO: 117333 - DNA, 20 bp, human
gggctggtgagcccaggggt

SEQ ID NO: 117334 - DNA, 20 bp, human
gctgctgctgcgatgcgtcc

SEQ ID NO: 117335 - DNA, 20 bp, human
gaggagcaccccgcaggctg

SEQ ID NO: 117336 - DNA, 20 bp, human
gcgccgggcaggccacactg

SEQ ID NO: 117337 - DNA, 20 bp, human
gatgggccgatgttctccgg

SEQ ID NO: 117338 - DNA, 20 bp, human
gaaggcgcgagcagagtcac

SEQ ID NO: 117339 - DNA, 20 bp, human
gggcaggccacactggggta

SEQ ID NO: 117340 - DNA, 20 bp, human
gtccagcctccggagaacat

SEQ ID NO: 117341 - DNA, 20 bp, human
gggctcagagcgcacccagc

SEQ ID NO: 117342 - DNA, 20 bp, human
ggccggcgccgcgcagcact

SEQ ID NO: 117343 - DNA, 20 bp, human
gcgcatgggccgatgttctc

SEQ ID NO: 117344 - DNA, 20 bp, human
ggcagccccctaccccagtg

SEQ ID NO: 117345 - DNA, 20 bp, human
gcctgcccggcgagcagcaa

SEQ ID NO: 117346 - DNA, 20 bp, human
gccagggagtgtgccagaag

SEQ ID NO: 117347 - DNA, 20 bp, human
gggaccgaggaggccatggt

SEQ ID NO: 117348 - DNA, 20 bp, human
gtgcgtgagcgcctgcccca

SEQ ID NO: 117349 - DNA, 20 bp, human
gtccggccggcccaagtctc

SEQ ID NO: 117350 - DNA, 20 bp, human
gtgggtgccaggagaacgtc

SEQ ID NO: 117351 - DNA, 20 bp, human
gggctatccggagggaaccg

SEQ ID NO: 117352 - DNA, 20 bp, human
ggcttggctcgggtcctcca

SEQ ID NO: 117353 - DNA, 20 bp, human
ggcatcaggcgcgtccctat

SEQ ID NO: 117354 - DNA, 20 bp, human
gcgcgcctgatgcctgggac

SEQ ID NO: 117355 - DNA, 20 bp, human
ggatagccggagacttgggc

SEQ ID NO: 117356 - DNA, 20 bp, human
gctgaggactgagaacgggg

SEQ ID NO: 117357 - DNA, 20 bp, human
gggagtgggctaccagccta

SEQ ID NO: 117358 - DNA, 20 bp, human
gggccgccgtagctccggat

SEQ ID NO: 117359 - DNA, 20 bp, human
gctggtcccatccggagcta

SEQ ID NO: 117360 - DNA, 20 bp, human
gggactgaggactgagaacg

SEQ ID NO: 117361 - DNA, 20 bp, human
ggtcccatccggagctacgg

SEQ ID NO: 117362 - DNA, 20 bp, human
gcccgggcgctggtcccatc

SEQ ID NO: 117363 - DNA, 20 bp, human
ggcggaaggactgggatcat

SEQ ID NO: 117364 - DNA, 20 bp, human
gacagctgaaagggccggga

SEQ ID NO: 117365 - DNA, 20 bp, human
ggcagagaggagcggggaca

SEQ ID NO: 117366 - DNA, 20 bp, human
gaaaatagtatatgtataaa

SEQ ID NO: 117367 - DNA, 20 bp, human
ggtccctcggcgcaaggtca

SEQ ID NO: 117368 - DNA, 20 bp, human
gccgcgtcggtgcttcagga

SEQ ID NO: 117369 - DNA, 20 bp, human
gtggggggcagagggcgagt

SEQ ID NO: 117370 - DNA, 20 bp, human
gagtgcagatggctccatcg

SEQ ID NO: 117371 - DNA, 20 bp, human
gccgagggaccaggaaggtc

SEQ ID NO: 117372 - DNA, 20 bp, human
gcttggagagaagagtgggg

SEQ ID NO: 117373 - DNA, 20 bp, human
gggagaggcggtgatcgcac

SEQ ID NO: 117374 - DNA, 20 bp, human
gccagccgagtagtacgcac

SEQ ID NO: 117375 - DNA, 20 bp, human
ggggcacaccaggtccgcga

SEQ ID NO: 117376 - DNA, 20 bp, human
gaggcccccggctcccaatg

SEQ ID NO: 117377 - DNA, 20 bp, human
gcccagcgacacaggcctcg

SEQ ID NO: 117378 - DNA, 20 bp, human
gcgccattgggcagagggat

SEQ ID NO: 117379 - DNA, 20 bp, human
ggggaagacatacgtcacat

SEQ ID NO: 117380 - DNA, 20 bp, human
gcctgcgcagcgcgactcag

SEQ ID NO: 117381 - DNA, 20 bp, human
ggcgcaccgccgctccgtca

SEQ ID NO: 117382 - DNA, 20 bp, human
gtcagttcagggatactcat

SEQ ID NO: 117383 - DNA, 20 bp, human
gtgtaggatatcgggctgta

SEQ ID NO: 117384 - DNA, 20 bp, human
gagcccgggtggcacctgat

SEQ ID NO: 117385 - DNA, 20 bp, human
gagctcaactggctgcctga

SEQ ID NO: 117386 - DNA, 20 bp, human
ggcacgtgggttggtaactg

SEQ ID NO: 117387 - DNA, 20 bp, human
gagcccggagcgtggcacgt

SEQ ID NO: 117388 - DNA, 20 bp, human
gcggagcgtggcacgtgggt

SEQ ID NO: 117389 - DNA, 20 bp, human
gacaggggtggtggtggacg

SEQ ID NO: 117390 - DNA, 20 bp, human
ggctcctggcttctctggaa

SEQ ID NO: 117391 - DNA, 20 bp, human
gagacttcggcgacaccgtc

SEQ ID NO: 117392 - DNA, 20 bp, human
gtgtcccgcatcccgccgtg

SEQ ID NO: 117393 - DNA, 20 bp, human
gtcaccagaatcacgctgat

SEQ ID NO: 117394 - DNA, 20 bp, human
gcttcggcgacaccgtccgg

SEQ ID NO: 117395 - DNA, 20 bp, human
gccttagcacctcctccgga

SEQ ID NO: 117396 - DNA, 20 bp, human
gtgggaagtccaaaatgatt

SEQ ID NO: 117397 - DNA, 20 bp, human
gtcccaaaatctgtaaagat

SEQ ID NO: 117398 - DNA, 20 bp, human
gtgtggacagcgacagaact

SEQ ID NO: 117399 - DNA, 20 bp, human
gtccaaaatgattaggtaaa

SEQ ID NO: 117400 - DNA, 20 bp, human
gttagtgtgacaagtaacac

SEQ ID NO: 117401 - DNA, 20 bp, human
gttactctcagaccctcatt

SEQ ID NO: 117402 - DNA, 20 bp, human
gtatccagttccatcttcta

SEQ ID NO: 117403 - DNA, 20 bp, human
gctctcagaccctcattggg

SEQ ID NO: 117404 - DNA, 20 bp, human
gttagggttggctcctgcaa

SEQ ID NO: 117405 - DNA, 20 bp, human
gagttccatcttctaaggta

SEQ ID NO: 117406 - DNA, 20 bp, human
gctgcagctctgctgaacgg

SEQ ID NO: 117407 - DNA, 20 bp, human
gagagctctgcctgatgaca

SEQ ID NO: 117408 - DNA, 20 bp, human
gtacctggtggtaattgcca

SEQ ID NO: 117409 - DNA, 20 bp, human
ggtagatcctccctgtcatc

SEQ ID NO: 117410 - DNA, 20 bp, human
gagggcagcttcgattccag

SEQ ID NO: 117411 - DNA, 20 bp, human
ggcagagctcttcagtgagg

SEQ ID NO: 117412 - DNA, 20 bp, human
gtgctatgctggctacctgg

SEQ ID NO: 117413 - DNA, 20 bp, human
gacgctggattcttccccag

SEQ ID NO: 117414 - DNA, 20 bp, human
gatgccagccaacttcacag

SEQ ID NO: 117415 - DNA, 20 bp, human
gctccttggcaattaccacc

SEQ ID NO: 117416 - DNA, 20 bp, human
gcgggtccgagaggaggtac

SEQ ID NO: 117417 - DNA, 20 bp, human
gggccgagtgggcgtctgag

SEQ ID NO: 117418 - DNA, 20 bp, human
gcgacgtggagcctccgagt

SEQ ID NO: 117419 - DNA, 20 bp, human
ggcgcgggtgtgaggaccgg

SEQ ID NO: 117420 - DNA, 20 bp, human
gccggaggctcctatccgag

SEQ ID NO: 117421 - DNA, 20 bp, human
gagcaacagcgagagggcca

SEQ ID NO: 117422 - DNA, 20 bp, human
gtccgagtgggcaacacctc

SEQ ID NO: 117423 - DNA, 20 bp, human
gaccggctgcgggtttgagg

SEQ ID NO: 117424 - DNA, 20 bp, human
gacgcccccgccgctcggat

SEQ ID NO: 117425 - DNA, 20 bp, human
gacacggaggaagccgacgt

SEQ ID NO: 117426 - DNA, 20 bp, human
gaccgcgcggccgaagagcg

SEQ ID NO: 117427 - DNA, 20 bp, human
gcgtgctctggctctcgcag

SEQ ID NO: 117428 - DNA, 20 bp, human
gtgggggcctgatagcgcgg

SEQ ID NO: 117429 - DNA, 20 bp, human
gacggacgcggcgcacatgt

SEQ ID NO: 117430 - DNA, 20 bp, human
gcgcacatgtcggcgtccac

SEQ ID NO: 117431 - DNA, 20 bp, human
gcggcggcgccgaggagctc

SEQ ID NO: 117432 - DNA, 20 bp, human
ggtgctgcagctccgcgaga

SEQ ID NO: 117433 - DNA, 20 bp, human
ggcctgatagcgcggcggtg

SEQ ID NO: 117434 - DNA, 20 bp, human
gctctgggcgccgcgctctt

SEQ ID NO: 117435 - DNA, 20 bp, human
gcagcttggcggtcagctcg

SEQ ID NO: 117436 - DNA, 20 bp, human
gaggccatccgcgagctcac

SEQ ID NO: 117437 - DNA, 20 bp, human
gggtgggtgcggctgtgaga

SEQ ID NO: 117438 - DNA, 20 bp, human
ggagggtcgcgtgcaccgcg

SEQ ID NO: 117439 - DNA, 20 bp, human
gccacgggcaaggacactat

SEQ ID NO: 117440 - DNA, 20 bp, human
gtgcagcagaaggagacgct

SEQ ID NO: 117441 - DNA, 20 bp, human
gcggcgtgcaccgcctctgg

SEQ ID NO: 117442 - DNA, 20 bp, human
gtgcacggcactgcccccag

SEQ ID NO: 117443 - DNA, 20 bp, human
gggtgcggctgtgagacggc

SEQ ID NO: 117444 - DNA, 20 bp, human
gagccgcgctgtcgtctcga

SEQ ID NO: 117445 - DNA, 20 bp, human
ggagaccgtcgtgcagcaga

SEQ ID NO: 117446 - DNA, 20 bp, human
gcccctgctgggcccccgac

SEQ ID NO: 117447 - DNA, 20 bp, human
gggctgaacaggggcccggg

SEQ ID NO: 117448 - DNA, 20 bp, human
gcacaggaagcggctgaaca

SEQ ID NO: 117449 - DNA, 20 bp, human
gtgctgggcccccgacgggc

SEQ ID NO: 117450 - DNA, 20 bp, human
gagcagccagcggcgtgcac

SEQ ID NO: 117451 - DNA, 20 bp, human
gaggaacgccagcatgcccg

SEQ ID NO: 117452 - DNA, 20 bp, human
ggaggcgaccgaagcattgt

SEQ ID NO: 117453 - DNA, 20 bp, human
gatcgccagcgtgcccctgg

SEQ ID NO: 117454 - DNA, 20 bp, human
gggagcctgagcgcgctgca

SEQ ID NO: 117455 - DNA, 20 bp, human
gggccaggaacttcagcgtg

SEQ ID NO: 117456 - DNA, 20 bp, human
ggatgttaacaagcttgaag

SEQ ID NO: 117457 - DNA, 20 bp, human
gacaattgtactggtgagta

SEQ ID NO: 117458 - DNA, 20 bp, human
gtctgtcatgacaattgtac

SEQ ID NO: 117459 - DNA, 20 bp, human
gtttatacattgtcagagga

SEQ ID NO: 117460 - DNA, 20 bp, human
gttacaaaatcattagactt

SEQ ID NO: 117461 - DNA, 20 bp, human
ggcagcccaatgtttatgag

SEQ ID NO: 117462 - DNA, 20 bp, human
gcatatttgtaataaatggt

SEQ ID NO: 117463 - DNA, 20 bp, human
gttctcctctcataaacatt

SEQ ID NO: 117464 - DNA, 20 bp, human
gtgagaggagaaaaaaattg

SEQ ID NO: 117465 - DNA, 20 bp, human
gagcacgacagcaatcaggc

SEQ ID NO: 117466 - DNA, 20 bp, human
gctcctgcgctccggtacct

SEQ ID NO: 117467 - DNA, 20 bp, human
gagttgggacgcccaggtac

SEQ ID NO: 117468 - DNA, 20 bp, human
gacagctcctgaacccacga

SEQ ID NO: 117469 - DNA, 20 bp, human
gcagtggagttgggacgccc

SEQ ID NO: 117470 - DNA, 20 bp, human
gttgggcgcgcagtggagtt

SEQ ID NO: 117471 - DNA, 20 bp, human
gggcggggcgggccacgaac

SEQ ID NO: 117472 - DNA, 20 bp, human
gagcggcgcggcccaccgtg

SEQ ID NO: 117473 - DNA, 20 bp, human
ggcgcgcggcgccacagata

SEQ ID NO: 117474 - DNA, 20 bp, human
gcctctcctgctgccctcgt

SEQ ID NO: 117475 - DNA, 20 bp, human
ggaggctggaggcgagccgt

SEQ ID NO: 117476 - DNA, 20 bp, human
gtcgggcgagcgtctccgag

SEQ ID NO: 117477 - DNA, 20 bp, human
gtccgaggggtgagagccag

SEQ ID NO: 117478 - DNA, 20 bp, human
gacccgggaccgctatccca

SEQ ID NO: 117479 - DNA, 20 bp, human
gcgggtcgtagcactcacgg

SEQ ID NO: 117480 - DNA, 20 bp, human
gcgcggtaggaaggtttccc

SEQ ID NO: 117481 - DNA, 20 bp, human
gagacgggtcgtagcactca

SEQ ID NO: 117482 - DNA, 20 bp, human
gcagagagcgggtcgcgaca

SEQ ID NO: 117483 - DNA, 20 bp, human
gctcaaggcggcgacccgca

SEQ ID NO: 117484 - DNA, 20 bp, human
gccggcagcgccatcgagtg

SEQ ID NO: 117485 - DNA, 20 bp, human
ggagccggcatagtccgctg

SEQ ID NO: 117486 - DNA, 20 bp, human
gaggcacacgagcagggaca

SEQ ID NO: 117487 - DNA, 20 bp, human
ggacagggcgagggtcagtc

SEQ ID NO: 117488 - DNA, 20 bp, human
ggctaggtaacaagcgactg

SEQ ID NO: 117489 - DNA, 20 bp, human
gcgggttgtccggcttggag

SEQ ID NO: 117490 - DNA, 20 bp, human
gcacagaaggctcaacggac

SEQ ID NO: 117491 - DNA, 20 bp, human
ggcacccaggcacacgagca

SEQ ID NO: 117492 - DNA, 20 bp, human
gacgagcagggacagggcga

SEQ ID NO: 117493 - DNA, 20 bp, human
ggcaggcacagaaggctcaa

SEQ ID NO: 117494 - DNA, 20 bp, human
gcctggggaacctgaatctg

SEQ ID NO: 117495 - DNA, 20 bp, human
gctgcacaccaggagatcct

SEQ ID NO: 117496 - DNA, 20 bp, human
gaaaggccgaggcactggga

SEQ ID NO: 117497 - DNA, 20 bp, human
ggtgtgggataggcgaactc

SEQ ID NO: 117498 - DNA, 20 bp, human
gggccttttaaagagaaccg

SEQ ID NO: 117499 - DNA, 20 bp, human
gcgacgcgggtgaaaggaga

SEQ ID NO: 117500 - DNA, 20 bp, human
gcagagtggggaagatccgc

SEQ ID NO: 117501 - DNA, 20 bp, human
ggcgtcgtccccataccctt

SEQ ID NO: 117502 - DNA, 20 bp, human
gaaatgagcgggtgtgggat

SEQ ID NO: 117503 - DNA, 20 bp, human
gaaggaaaatgagcgggtgt

SEQ ID NO: 117504 - DNA, 20 bp, human
ggaaattccccgggagcagg

SEQ ID NO: 117505 - DNA, 20 bp, human
gagccagctcaagacacgta

SEQ ID NO: 117506 - DNA, 20 bp, human
gggaggcggctgagagaccc

SEQ ID NO: 117507 - DNA, 20 bp, human
gggaaccgagcgctcctcta

SEQ ID NO: 117508 - DNA, 20 bp, human
ggagaggtcggcagcagacc

SEQ ID NO: 117509 - DNA, 20 bp, human
gagcagtcagagcggctggg

SEQ ID NO: 117510 - DNA, 20 bp, human
gcggagcagtcagagcggct

SEQ ID NO: 117511 - DNA, 20 bp, human
gaggtcggctggctaatcat

SEQ ID NO: 117512 - DNA, 20 bp, human
gccggttccgtcccctccta

SEQ ID NO: 117513 - DNA, 20 bp, human
ggggagcaggaacagtgtcc

SEQ ID NO: 117514 - DNA, 20 bp, human
ggccacctcccgcctaaagg

SEQ ID NO: 117515 - DNA, 20 bp, human
gtctcaggccaagcgcgcct

SEQ ID NO: 117516 - DNA, 20 bp, human
gccgcacgcaggcagcatcg

SEQ ID NO: 117517 - DNA, 20 bp, human
gttcctctgattgactggga

SEQ ID NO: 117518 - DNA, 20 bp, human
gtcccagtggggttagaata

SEQ ID NO: 117519 - DNA, 20 bp, human
gccccctgggcacaggagtg

SEQ ID NO: 117520 - DNA, 20 bp, human
gccagctgcaagccccaaca

SEQ ID NO: 117521 - DNA, 20 bp, human
gagactgaggtccacagtgg

SEQ ID NO: 117522 - DNA, 20 bp, human
gatgctgcctgcgtgcggag

SEQ ID NO: 117523 - DNA, 20 bp, human
ggccgcccatgtctcaggtg

SEQ ID NO: 117524 - DNA, 20 bp, human
gtgccttcccagtcaatcag

SEQ ID NO: 117525 - DNA, 20 bp, human
gtcctcacctgagacatggg

SEQ ID NO: 117526 - DNA, 20 bp, human
gccagagcgcgtccagccgg

SEQ ID NO: 117527 - DNA, 20 bp, human
gcagcgggagcaggacctgg

SEQ ID NO: 117528 - DNA, 20 bp, human
gacccgggaggagagtgtcg

SEQ ID NO: 117529 - DNA, 20 bp, human
gtccgcgaaggagcctcctg

SEQ ID NO: 117530 - DNA, 20 bp, human
gcgtgccgagcaggtccctc

SEQ ID NO: 117531 - DNA, 20 bp, human
ggcaggcgcgggccgaaccc

SEQ ID NO: 117532 - DNA, 20 bp, human
ggtcaggagtgaagagacag

SEQ ID NO: 117533 - DNA, 20 bp, human
gcgggtgagttgggaaccgg

SEQ ID NO: 117534 - DNA, 20 bp, human
ggagtgtcggggatccgcga

SEQ ID NO: 117535 - DNA, 20 bp, human
gggcgcgggccgaacccggg

SEQ ID NO: 117536 - DNA, 20 bp, human
gcaccacagtaatccgcatc

SEQ ID NO: 117537 - DNA, 20 bp, human
gctgggggaggggattgtag

SEQ ID NO: 117538 - DNA, 20 bp, human
ggctccggctgcaaccttgt

SEQ ID NO: 117539 - DNA, 20 bp, human
gcctgtggaggaggttgtag

SEQ ID NO: 117540 - DNA, 20 bp, human
gtacacacgcgactcccaca

SEQ ID NO: 117541 - DNA, 20 bp, human
gggcgaccctggccggaact

SEQ ID NO: 117542 - DNA, 20 bp, human
ggagagcctagttccggcca

SEQ ID NO: 117543 - DNA, 20 bp, human
gtcggtgagctgggcggctc

SEQ ID NO: 117544 - DNA, 20 bp, human
gggccgtcagaggccaaatc

SEQ ID NO: 117545 - DNA, 20 bp, human
gccaccccacgaactctagt

SEQ ID NO: 117546 - DNA, 20 bp, human
gcgtactggctcactcagag

SEQ ID NO: 117547 - DNA, 20 bp, human
gcagcggctttgaagaagaa

SEQ ID NO: 117548 - DNA, 20 bp, human
gagaagagcactgatcgtac

SEQ ID NO: 117549 - DNA, 20 bp, human
ggacatcggaaggggtgtca

SEQ ID NO: 117550 - DNA, 20 bp, human
gtatggggggacatcggaag

SEQ ID NO: 117551 - DNA, 20 bp, human
ggcagagaatgcagtaaagt

SEQ ID NO: 117552 - DNA, 20 bp, human
gtccaggtatggggggacat

SEQ ID NO: 117553 - DNA, 20 bp, human
gtccttcatggcatagttga

SEQ ID NO: 117554 - DNA, 20 bp, human
gccatacctggaatatcaca

SEQ ID NO: 117555 - DNA, 20 bp, human
ggctaattaggtacatgtct

SEQ ID NO: 117556 - DNA, 20 bp, human
ggcccccggggaccacggac

SEQ ID NO: 117557 - DNA, 20 bp, human
gggttccgggctgcttaggt

SEQ ID NO: 117558 - DNA, 20 bp, human
gacaccgggaccctgcgtgt

SEQ ID NO: 117559 - DNA, 20 bp, human
gaccggtccgtggtccccgg

SEQ ID NO: 117560 - DNA, 20 bp, human
ggtaggcgcgctgcgtaaag

SEQ ID NO: 117561 - DNA, 20 bp, human
gtaccagcacccgctccata

SEQ ID NO: 117562 - DNA, 20 bp, human
ggggctgcttaggttggcac

SEQ ID NO: 117563 - DNA, 20 bp, human
gcagggaccattctgtacat

SEQ ID NO: 117564 - DNA, 20 bp, human
gactgcgcccccggggacca

SEQ ID NO: 117565 - DNA, 20 bp, human
gcagtcctgcggctcctact

SEQ ID NO: 117566 - DNA, 20 bp, human
gggcgggcgagaaccaccag

SEQ ID NO: 117567 - DNA, 20 bp, human
ggcgagaaccaccagtggca

SEQ ID NO: 117568 - DNA, 20 bp, human
gttgcggtaaagaccaccca

SEQ ID NO: 117569 - DNA, 20 bp, human
gtcgggcagtgcctatctag

SEQ ID NO: 117570 - DNA, 20 bp, human
ggctagtgagcaagctgtag

SEQ ID NO: 117571 - DNA, 20 bp, human
gaccggccgcagcgcaccag

SEQ ID NO: 117572 - DNA, 20 bp, human
gaggagtacgcctacctcaa

SEQ ID NO: 117573 - DNA, 20 bp, human
gggccgcagcgcaccagagg

SEQ ID NO: 117574 - DNA, 20 bp, human
ggtggcgctcaagagtccac

SEQ ID NO: 117575 - DNA, 20 bp, human
ggctcgtcagcatgctgtag

SEQ ID NO: 117576 - DNA, 20 bp, human
ggcatgggcaggcccctggt

SEQ ID NO: 117577 - DNA, 20 bp, human
gatgagcaccagccaaccag

SEQ ID NO: 117578 - DNA, 20 bp, human
ggcttgcagctccctggcat

SEQ ID NO: 117579 - DNA, 20 bp, human
gaagtgcgtagagaatggcg

SEQ ID NO: 117580 - DNA, 20 bp, human
ggggccggtgctgcctacat

SEQ ID NO: 117581 - DNA, 20 bp, human
gtgcgtagagaatggcgggg

SEQ ID NO: 117582 - DNA, 20 bp, human
gggggcctcagccacctcaa

SEQ ID NO: 117583 - DNA, 20 bp, human
ggtgctgcctacataggcag

SEQ ID NO: 117584 - DNA, 20 bp, human
gtggctggtgctcatggtta

SEQ ID NO: 117585 - DNA, 20 bp, human
ggtcttggccagaacatcca

SEQ ID NO: 117586 - DNA, 20 bp, human
gctgccgagggaacgtagca

SEQ ID NO: 117587 - DNA, 20 bp, human
ggaaaggctcgggcaaaagg

SEQ ID NO: 117588 - DNA, 20 bp, human
gggaccttgactcaaactag

SEQ ID NO: 117589 - DNA, 20 bp, human
gagtgcccagggggcaacag

SEQ ID NO: 117590 - DNA, 20 bp, human
gctgtcccagggaaaggctc

SEQ ID NO: 117591 - DNA, 20 bp, human
gcccttagccagtgcccagg

SEQ ID NO: 117592 - DNA, 20 bp, human
gttgcaaccaggaagtaagt

SEQ ID NO: 117593 - DNA, 20 bp, human
ggtgccctgctacgttccct

SEQ ID NO: 117594 - DNA, 20 bp, human
gcccggtgcaaaagtcccag

SEQ ID NO: 117595 - DNA, 20 bp, human
gggggcaccgagtcgcaaag

SEQ ID NO: 117596 - DNA, 20 bp, human
gtccctgacaacaaaagcgg

SEQ ID NO: 117597 - DNA, 20 bp, human
ggggtccctgacaacaaaag

SEQ ID NO: 117598 - DNA, 20 bp, human
gagcaggctgcagcgagaga

SEQ ID NO: 117599 - DNA, 20 bp, human
gcgagccagaggcggacacg

SEQ ID NO: 117600 - DNA, 20 bp, human
gatgggaaccgagccagagg

SEQ ID NO: 117601 - DNA, 20 bp, human
gtgcagccagcgcaccgcgg

SEQ ID NO: 117602 - DNA, 20 bp, human
gggtgtccccatggccggtg

SEQ ID NO: 117603 - DNA, 20 bp, human
ggcgatgggaaccgagccag

SEQ ID NO: 117604 - DNA, 20 bp, human
gcgagggcggctgacgggga

SEQ ID NO: 117605 - DNA, 20 bp, human
ggctttgcagggagacaaga

SEQ ID NO: 117606 - DNA, 20 bp, human
gagtagcggcggtgtgtcag

SEQ ID NO: 117607 - DNA, 20 bp, human
gggaggcgcgaattaccgag

SEQ ID NO: 117608 - DNA, 20 bp, human
gtcttccggacgtgacgcaa

SEQ ID NO: 117609 - DNA, 20 bp, human
ggcggggttgccggaagaag

SEQ ID NO: 117610 - DNA, 20 bp, human
gagagcaagggaacccaggt

SEQ ID NO: 117611 - DNA, 20 bp, human
ggtcacgtccggaagagggg

SEQ ID NO: 117612 - DNA, 20 bp, human
ggacctggagagaggtgcga

SEQ ID NO: 117613 - DNA, 20 bp, human
gcggacgtgacgcaagggcg

SEQ ID NO: 117614 - DNA, 20 bp, human
ggacctgcagcgcggtgcgg

SEQ ID NO: 117615 - DNA, 20 bp, human
ggagggtatttgagtagcgg

SEQ ID NO: 117616 - DNA, 20 bp, human
gtcctgtccagaagtctcgg

SEQ ID NO: 117617 - DNA, 20 bp, human
gcggtggccagccagtgagc

SEQ ID NO: 117618 - DNA, 20 bp, human
gggctggccaccgagacttc

SEQ ID NO: 117619 - DNA, 20 bp, human
ggccaccagacttcctgggt

SEQ ID NO: 117620 - DNA, 20 bp, human
ggtttcctgtccagaagtct

SEQ ID NO: 117621 - DNA, 20 bp, human
ggagccccaggccactgcta

SEQ ID NO: 117622 - DNA, 20 bp, human
gccaggccaccagacttcct

SEQ ID NO: 117623 - DNA, 20 bp, human
gagcagcgtgtttcactggg

SEQ ID NO: 117624 - DNA, 20 bp, human
gctggaaagtggcacgagcg

SEQ ID NO: 117625 - DNA, 20 bp, human
ggtttctggggagaagtgag

SEQ ID NO: 117626 - DNA, 20 bp, human
gggaacggtaggccagactg

SEQ ID NO: 117627 - DNA, 20 bp, human
ggaaaaggcgcagtctcggt

SEQ ID NO: 117628 - DNA, 20 bp, human
ggggcaacctcaaggacaca

SEQ ID NO: 117629 - DNA, 20 bp, human
gtgtgcagggcaggaacggt

SEQ ID NO: 117630 - DNA, 20 bp, human
gcttacttagggacctgctg

SEQ ID NO: 117631 - DNA, 20 bp, human
gccagactggggcaacctca

SEQ ID NO: 117632 - DNA, 20 bp, human
gctgctggggtgcggggaaa

SEQ ID NO: 117633 - DNA, 20 bp, human
gcggggaaaaggcgcagtct

SEQ ID NO: 117634 - DNA, 20 bp, human
ggttcgccgccatcttactt

SEQ ID NO: 117635 - DNA, 20 bp, human
ggtgcaggagggtcgtggtc

SEQ ID NO: 117636 - DNA, 20 bp, human
gataagtcggggagacaatg

SEQ ID NO: 117637 - DNA, 20 bp, human
ggtgtactgtgcatgatcac

SEQ ID NO: 117638 - DNA, 20 bp, human
gttcgcattaggataagtcg

SEQ ID NO: 117639 - DNA, 20 bp, human
gggtcacctgagtaaatcac

SEQ ID NO: 117640 - DNA, 20 bp, human
gtactgtgcatgatcacagg

SEQ ID NO: 117641 - DNA, 20 bp, human
gatgctgctgctagcccaga

SEQ ID NO: 117642 - DNA, 20 bp, human
gaaatcgctgggatctggag

SEQ ID NO: 117643 - DNA, 20 bp, human
gatacacaacccactcccaa

SEQ ID NO: 117644 - DNA, 20 bp, human
gacccactcccaaaggaatt

SEQ ID NO: 117645 - DNA, 20 bp, human
gtagcaaaatcgctgggatc

SEQ ID NO: 117646 - DNA, 20 bp, human
ggagattcccactgaagtaa

SEQ ID NO: 117647 - DNA, 20 bp, human
gccagagagcatcagtaatg

SEQ ID NO: 117648 - DNA, 20 bp, human
gcataacctatgactaggac

SEQ ID NO: 117649 - DNA, 20 bp, human
gccgctgccttgttcaggac

SEQ ID NO: 117650 - DNA, 20 bp, human
gtgttcaaagtggaccccag

SEQ ID NO: 117651 - DNA, 20 bp, human
ggcactgcctttacttcagt

SEQ ID NO: 117652 - DNA, 20 bp, human
gctatgactaggacgggaag

SEQ ID NO: 117653 - DNA, 20 bp, human
gcggtgcaaaggatcgatca

SEQ ID NO: 117654 - DNA, 20 bp, human
gctgtggtgatttttctagg

SEQ ID NO: 117655 - DNA, 20 bp, human
gaatactcctgtcctgaaca

SEQ ID NO: 117656 - DNA, 20 bp, human
gctcaggagttgccagtgat

SEQ ID NO: 117657 - DNA, 20 bp, human
gtggcaactcctgagatcag

SEQ ID NO: 117658 - DNA, 20 bp, human
gggcacagaccctggactca

SEQ ID NO: 117659 - DNA, 20 bp, human
gaatccctaactccaatcac

SEQ ID NO: 117660 - DNA, 20 bp, human
gcacagtcactgagagcaac

SEQ ID NO: 117661 - DNA, 20 bp, human
ggattatgacccgtagtatc

SEQ ID NO: 117662 - DNA, 20 bp, human
ggttgccagtgattggagtt

SEQ ID NO: 117663 - DNA, 20 bp, human
gctcagtgactgtggggtta

SEQ ID NO: 117664 - DNA, 20 bp, human
gggaaaaccagcaacagcgt

SEQ ID NO: 117665 - DNA, 20 bp, human
gtcttgttttccagatacta

SEQ ID NO: 117666 - DNA, 20 bp, human
gcattagcaacggggagaag

SEQ ID NO: 117667 - DNA, 20 bp, human
gtcgtgacgttcccagggtg

SEQ ID NO: 117668 - DNA, 20 bp, human
ggtgggatcgagattcacgg

SEQ ID NO: 117669 - DNA, 20 bp, human
ggatgtgggatcgagattca

SEQ ID NO: 117670 - DNA, 20 bp, human
ggtaagcgcagctggaaagg

SEQ ID NO: 117671 - DNA, 20 bp, human
gaagaaagccgacgggatgt

SEQ ID NO: 117672 - DNA, 20 bp, human
ggaggttgaagaaagccgac

SEQ ID NO: 117673 - DNA, 20 bp, human
ggcggtaagcgcagctggaa

SEQ ID NO: 117674 - DNA, 20 bp, human
ggcgccccccaatccacgag

SEQ ID NO: 117675 - DNA, 20 bp, human
gtctcgatcccacatcccgt

SEQ ID NO: 117676 - DNA, 20 bp, human
gccgcgcgctggtaggagga

SEQ ID NO: 117677 - DNA, 20 bp, human
gccgcccgcgcgctggtagg

SEQ ID NO: 117678 - DNA, 20 bp, human
gtggcaaaggtaaaagggtc

SEQ ID NO: 117679 - DNA, 20 bp, human
gccgccgcccgcgcgctggt

SEQ ID NO: 117680 - DNA, 20 bp, human
gggccgcccgccgcagacac

SEQ ID NO: 117681 - DNA, 20 bp, human
gaccccgtggcaaaggtaaa

SEQ ID NO: 117682 - DNA, 20 bp, human
gaggtcagagttcgtgaccc

SEQ ID NO: 117683 - DNA, 20 bp, human
gagagacgagacgccgaggt

SEQ ID NO: 117684 - DNA, 20 bp, human
ggcccggcgctttgcatagt

SEQ ID NO: 117685 - DNA, 20 bp, human
gcgccgccaccccgtggcaa

SEQ ID NO: 117686 - DNA, 20 bp, human
gtgagcaggtaagagtctgt

SEQ ID NO: 117687 - DNA, 20 bp, human
gccctcagtggacagatctg

SEQ ID NO: 117688 - DNA, 20 bp, human
ggatttcccgcgggtttcgg

SEQ ID NO: 117689 - DNA, 20 bp, human
ggcctcctcaagctacaggg

SEQ ID NO: 117690 - DNA, 20 bp, human
gggttccgggtcccaagatt

SEQ ID NO: 117691 - DNA, 20 bp, human
gccactgagggctcgacccc

SEQ ID NO: 117692 - DNA, 20 bp, human
gtggcgaggccctaagcctg

SEQ ID NO: 117693 - DNA, 20 bp, human
gcctcgcagggcttaggatt

SEQ ID NO: 117694 - DNA, 20 bp, human
gagcactgaactcaccctgg

SEQ ID NO: 117695 - DNA, 20 bp, human
gaggatcaaggcgaagagag

SEQ ID NO: 117696 - DNA, 20 bp, human
gcgacaggcacaaagtcacg

SEQ ID NO: 117697 - DNA, 20 bp, human
gagagccgggaagaaactta

SEQ ID NO: 117698 - DNA, 20 bp, human
gggaagaggcggccaggtcc

SEQ ID NO: 117699 - DNA, 20 bp, human
gaatcttccgagggaagagg

SEQ ID NO: 117700 - DNA, 20 bp, human
gtccttgggagaccagcggt

SEQ ID NO: 117701 - DNA, 20 bp, human
gacataggcatgcagagtgt

SEQ ID NO: 117702 - DNA, 20 bp, human
ggcttctggagatattacag

SEQ ID NO: 117703 - DNA, 20 bp, human
gttgctgggaaatcttccga

SEQ ID NO: 117704 - DNA, 20 bp, human
gagccgcggggaggggaata

SEQ ID NO: 117705 - DNA, 20 bp, human
gcacgaaaatggccttccta

SEQ ID NO: 117706 - DNA, 20 bp, human
ggactgggaaagggacccga

SEQ ID NO: 117707 - DNA, 20 bp, human
ggaggggcttcgggaccttg

SEQ ID NO: 117708 - DNA, 20 bp, human
ggctctgatgagctccacag

SEQ ID NO: 117709 - DNA, 20 bp, human
ggaatcctagaaacacggtg

SEQ ID NO: 117710 - DNA, 20 bp, human
gacccagccccgccggctgt

SEQ ID NO: 117711 - DNA, 20 bp, human
gcaggacagcctagccgatg

SEQ ID NO: 117712 - DNA, 20 bp, human
gggattctgggtttacccac

SEQ ID NO: 117713 - DNA, 20 bp, human
gccccgccggctgtgggcaa

SEQ ID NO: 117714 - DNA, 20 bp, human
ggcctgggggaggatcccac

SEQ ID NO: 117715 - DNA, 20 bp, human
gctgaactctgtctgaactc

SEQ ID NO: 117716 - DNA, 20 bp, human
ggaatggagtaaaagagaca

SEQ ID NO: 117717 - DNA, 20 bp, human
ggagctagttaaaaaaaccc

SEQ ID NO: 117718 - DNA, 20 bp, human
gcatttttgggcgatctcca

SEQ ID NO: 117719 - DNA, 20 bp, human
gttgaatgcgtttaaacggg

SEQ ID NO: 117720 - DNA, 20 bp, human
ggagcaatgtttccgaaagg

SEQ ID NO: 117721 - DNA, 20 bp, human
ggcagagcaatgtttccgaa

SEQ ID NO: 117722 - DNA, 20 bp, human
gtaaataagtgctcttcagc

SEQ ID NO: 117723 - DNA, 20 bp, human
gaacgataagaagaatacga

SEQ ID NO: 117724 - DNA, 20 bp, human
gttcgcgcagatcccccttt

SEQ ID NO: 117725 - DNA, 20 bp, human
gtttaaacgcattcaatttt

SEQ ID NO: 117726 - DNA, 20 bp, human
gcagtacggcacccggagaa

SEQ ID NO: 117727 - DNA, 20 bp, human
ggagctcagtgagctgatcg

SEQ ID NO: 117728 - DNA, 20 bp, human
ggcggcagcagcgacttcag

SEQ ID NO: 117729 - DNA, 20 bp, human
ggcggcggcgctagacgcag

SEQ ID NO: 117730 - DNA, 20 bp, human
ggcagcagcgacttcagcgg

SEQ ID NO: 117731 - DNA, 20 bp, human
gagcggctccgggcccgacc

SEQ ID NO: 117732 - DNA, 20 bp, human
gggagaaaggaggcaactcg

SEQ ID NO: 117733 - DNA, 20 bp, human
gggctccgggcccgacccgg

SEQ ID NO: 117734 - DNA, 20 bp, human
gatccttcgtgcgcagaggg

SEQ ID NO: 117735 - DNA, 20 bp, human
gtaaaaaggggggcgcggga

SEQ ID NO: 117736 - DNA, 20 bp, human
gctatggccatggtgaccgg

SEQ ID NO: 117737 - DNA, 20 bp, human
ggccgggaggggcacgctag

SEQ ID NO: 117738 - DNA, 20 bp, human
gcaccatggccatagcccca

SEQ ID NO: 117739 - DNA, 20 bp, human
ggccccggcggcgacacgaa

SEQ ID NO: 117740 - DNA, 20 bp, human
gcgcgcacgcgtgggaaagt

SEQ ID NO: 117741 - DNA, 20 bp, human
ggtgcccggagggaagagcg

SEQ ID NO: 117742 - DNA, 20 bp, human
gggcggcgagagcgaggctt

SEQ ID NO: 117743 - DNA, 20 bp, human
ggcgcggatggggggctcac

SEQ ID NO: 117744 - DNA, 20 bp, human
ggcgcgccggcctcgcgctg

SEQ ID NO: 117745 - DNA, 20 bp, human
gggcgggacgcgagtcctct

SEQ ID NO: 117746 - DNA, 20 bp, human
ggctccgcgggtcgaggttc

SEQ ID NO: 117747 - DNA, 20 bp, human
ggcgagcgagcgggaccgag

SEQ ID NO: 117748 - DNA, 20 bp, human
gtcggctgcggcgggaactg

SEQ ID NO: 117749 - DNA, 20 bp, human
gcaccaccgcatcatctggg

SEQ ID NO: 117750 - DNA, 20 bp, human
ggagttgtctccggtcccag

SEQ ID NO: 117751 - DNA, 20 bp, human
gtacgtactttgggcccggg

SEQ ID NO: 117752 - DNA, 20 bp, human
gcggcctgacacgccctctg

SEQ ID NO: 117753 - DNA, 20 bp, human
ggcagagcgagctcccgagt

SEQ ID NO: 117754 - DNA, 20 bp, human
gcgagcggctcctctgccag

SEQ ID NO: 117755 - DNA, 20 bp, human
gagagcgcggacacgcgaaa

SEQ ID NO: 117756 - DNA, 20 bp, human
gggagacgggagccaacttc

SEQ ID NO: 117757 - DNA, 20 bp, human
gggccgaggcaggtgtgtag

SEQ ID NO: 117758 - DNA, 20 bp, human
gcccgtgcagtcagtcacct

SEQ ID NO: 117759 - DNA, 20 bp, human
ggtagacctcccactgccaa

SEQ ID NO: 117760 - DNA, 20 bp, human
gcagcaacgctcttgcaccc

SEQ ID NO: 117761 - DNA, 20 bp, human
gaagtggctgcgtaatccgg

SEQ ID NO: 117762 - DNA, 20 bp, human
ggtcctctggcggccaaagg

SEQ ID NO: 117763 - DNA, 20 bp, human
ggagagacggaccccggccg

SEQ ID NO: 117764 - DNA, 20 bp, human
gtccggaggcacagtcagta

SEQ ID NO: 117765 - DNA, 20 bp, human
gccgggcccaatgacacccc

SEQ ID NO: 117766 - DNA, 20 bp, human
gcggaggctacgaaacttgg

SEQ ID NO: 117767 - DNA, 20 bp, human
gggagtgcacagaagaactt

SEQ ID NO: 117768 - DNA, 20 bp, human
gaccctaggagactgaacta

SEQ ID NO: 117769 - DNA, 20 bp, human
ggagcaccgtgcgcccagtt

SEQ ID NO: 117770 - DNA, 20 bp, human
ggccttagttcagtctccta

SEQ ID NO: 117771 - DNA, 20 bp, human
gtctcctagggtgcccaact

SEQ ID NO: 117772 - DNA, 20 bp, human
gcgcacggtgctctgaactt

SEQ ID NO: 117773 - DNA, 20 bp, human
gggccggcatgcaagagggt

SEQ ID NO: 117774 - DNA, 20 bp, human
gcggtgctctgaacttgggt

SEQ ID NO: 117775 - DNA, 20 bp, human
gtggcggaggctacgaaact

SEQ ID NO: 117776 - DNA, 20 bp, human
ggcgcaagccacataaacaa

SEQ ID NO: 117777 - DNA, 20 bp, human
gcgtgcgcgcagttaccggg

SEQ ID NO: 117778 - DNA, 20 bp, human
gcggccagggccagtccgcc

SEQ ID NO: 117779 - DNA, 20 bp, human
gctagtgagagtgggaccga

SEQ ID NO: 117780 - DNA, 20 bp, human
gagagtgggaccgaaggatg

SEQ ID NO: 117781 - DNA, 20 bp, human
gggagactttaggtgcatgt

SEQ ID NO: 117782 - DNA, 20 bp, human
gggacaggcaaaagggaccg

SEQ ID NO: 117783 - DNA, 20 bp, human
gtttaggtgcatgttggcag

SEQ ID NO: 117784 - DNA, 20 bp, human
gccgtgcgcgagccgccggg

SEQ ID NO: 117785 - DNA, 20 bp, human
ggccggctggacaggcaaaa

SEQ ID NO: 117786 - DNA, 20 bp, human
gggcgggaggagcggaacag

SEQ ID NO: 117787 - DNA, 20 bp, human
ggtatcctggacctagagtc

SEQ ID NO: 117788 - DNA, 20 bp, human
gacgcgggaagtgaaagcgg

SEQ ID NO: 117789 - DNA, 20 bp, human
ggccggacgccggcgacaat

SEQ ID NO: 117790 - DNA, 20 bp, human
ggagtcccggaagggccgtc

SEQ ID NO: 117791 - DNA, 20 bp, human
ggtcccccgactctaggtcc

SEQ ID NO: 117792 - DNA, 20 bp, human
gggtcgcggccgaccaagaa

SEQ ID NO: 117793 - DNA, 20 bp, human
gccgggcaggtaacgtatcc

SEQ ID NO: 117794 - DNA, 20 bp, human
gcgctgggcgcgcctggtac

SEQ ID NO: 117795 - DNA, 20 bp, human
gccccaacatgtccagagag

SEQ ID NO: 117796 - DNA, 20 bp, human
gcgccgcgctgcaccggcaa

SEQ ID NO: 117797 - DNA, 20 bp, human
gggacgcccgcggaacctct

SEQ ID NO: 117798 - DNA, 20 bp, human
gctgcaccggcaagggctca

SEQ ID NO: 117799 - DNA, 20 bp, human
ggattcgcccagttaataag

SEQ ID NO: 117800 - DNA, 20 bp, human
gctgcggtgtacaagcccag

SEQ ID NO: 117801 - DNA, 20 bp, human
gacgtacttgagtgctgtgg

SEQ ID NO: 117802 - DNA, 20 bp, human
ggtgtgtgcgagtgagggag

SEQ ID NO: 117803 - DNA, 20 bp, human
gtggcttgggctgtgaccag

SEQ ID NO: 117804 - DNA, 20 bp, human
gtgctgcgatcccgactcat

SEQ ID NO: 117805 - DNA, 20 bp, human
ggcccaagccaggacgcccg

SEQ ID NO: 117806 - DNA, 20 bp, human
gagagacagcgggacaccag

SEQ ID NO: 117807 - DNA, 20 bp, human
ggtgggacggtggcgactgt

SEQ ID NO: 117808 - DNA, 20 bp, human
gggaggaggacggacggaca

SEQ ID NO: 117809 - DNA, 20 bp, human
gacaccagcggacctccatg

SEQ ID NO: 117810 - DNA, 20 bp, human
gggcatccaccaggctgtgt

SEQ ID NO: 117811 - DNA, 20 bp, human
gggcagcccaggtgggacgg

SEQ ID NO: 117812 - DNA, 20 bp, human
gcccctcacaccacggcggg

SEQ ID NO: 117813 - DNA, 20 bp, human
gggtgagtctgggagacccc

SEQ ID NO: 117814 - DNA, 20 bp, human
gtccggtggcccccccacca

SEQ ID NO: 117815 - DNA, 20 bp, human
gaaaccccctcacaccacgg

SEQ ID NO: 117816 - DNA, 20 bp, human
gtacagcaggtcactaatgt

SEQ ID NO: 117817 - DNA, 20 bp, human
gacattcttagtgaaattat

SEQ ID NO: 117818 - DNA, 20 bp, human
ggaaactcctacttaccaat

SEQ ID NO: 117819 - DNA, 20 bp, human
gagcacggacttacacctat

SEQ ID NO: 117820 - DNA, 20 bp, human
ggaaattataggcagttctt

SEQ ID NO: 117821 - DNA, 20 bp, human
gcttacacctattggtaagt

SEQ ID NO: 117822 - DNA, 20 bp, human
ggattttgcattttaagtca

SEQ ID NO: 117823 - DNA, 20 bp, human
gtggatacatggtttacagc

SEQ ID NO: 117824 - DNA, 20 bp, human
gttttcttaactttcactaa

SEQ ID NO: 117825 - DNA, 20 bp, human
gcttgtaactttatgaattc

SEQ ID NO: 117826 - DNA, 20 bp, human
gggcagcacagattcaactc

SEQ ID NO: 117827 - DNA, 20 bp, human
gctgggcttccggaccgaca

SEQ ID NO: 117828 - DNA, 20 bp, human
gtccggcgaaaagaaggaag

SEQ ID NO: 117829 - DNA, 20 bp, human
gagagaggcttccagctcta

SEQ ID NO: 117830 - DNA, 20 bp, human
gagcatgacaaggcgaccgc

SEQ ID NO: 117831 - DNA, 20 bp, human
gctctatggcaacccaagca

SEQ ID NO: 117832 - DNA, 20 bp, human
gggggatgggggatccgtgt

SEQ ID NO: 117833 - DNA, 20 bp, human
gcttctaattaaggaaagag

SEQ ID NO: 117834 - DNA, 20 bp, human
ggttgggttagcaggcatcc

SEQ ID NO: 117835 - DNA, 20 bp, human
gtgcgatcgagccagtccca

SEQ ID NO: 117836 - DNA, 20 bp, human
gcccggccgcggctctctct

SEQ ID NO: 117837 - DNA, 20 bp, human
gagcgagaccggggaggaga

SEQ ID NO: 117838 - DNA, 20 bp, human
ggcagcggcgtgtgacgtca

SEQ ID NO: 117839 - DNA, 20 bp, human
gggcgtgtgacgtcagggga

SEQ ID NO: 117840 - DNA, 20 bp, human
gtcgccctgggaagccgcag

SEQ ID NO: 117841 - DNA, 20 bp, human
gaccctgagcgagaccgggg

SEQ ID NO: 117842 - DNA, 20 bp, human
ggggccgctgcggcttccca

SEQ ID NO: 117843 - DNA, 20 bp, human
ggtccgcgcagaagggaaca

SEQ ID NO: 117844 - DNA, 20 bp, human
gaagggaacagggacgaagg

SEQ ID NO: 117845 - DNA, 20 bp, human
gctctgggccccgagccgcc

SEQ ID NO: 117846 - DNA, 20 bp, human
ggaaagatcgaggtgcccac

SEQ ID NO: 117847 - DNA, 20 bp, human
ggaagacttgaactagactg

SEQ ID NO: 117848 - DNA, 20 bp, human
gcaaactagaaggtcagcaa

SEQ ID NO: 117849 - DNA, 20 bp, human
ggaagagagaggacaaagat

SEQ ID NO: 117850 - DNA, 20 bp, human
ggttggattctgaaagatcg

SEQ ID NO: 117851 - DNA, 20 bp, human
gaatgtgtagaactaaataa

SEQ ID NO: 117852 - DNA, 20 bp, human
ggacgaccataaaattcctg

SEQ ID NO: 117853 - DNA, 20 bp, human
gacagctataacaacactca

SEQ ID NO: 117854 - DNA, 20 bp, human
gcatacccacacctagaaca

SEQ ID NO: 117855 - DNA, 20 bp, human
gctgctgacttcaaactaga

SEQ ID NO: 117856 - DNA, 20 bp, human
ggtccagccattggagctga

SEQ ID NO: 117857 - DNA, 20 bp, human
gagctgagggcatcttgaca

SEQ ID NO: 117858 - DNA, 20 bp, human
gaagatgccctcagctccaa

SEQ ID NO: 117859 - DNA, 20 bp, human
gcagtcgctaggactaagat

SEQ ID NO: 117860 - DNA, 20 bp, human
ggaatggctggtccagccat

SEQ ID NO: 117861 - DNA, 20 bp, human
gacatggaaaagagcaggtc

SEQ ID NO: 117862 - DNA, 20 bp, human
gcacttaggaaaacagattg

SEQ ID NO: 117863 - DNA, 20 bp, human
gtgccctcagctccaatggc

SEQ ID NO: 117864 - DNA, 20 bp, human
gatcacatacctggccatat

SEQ ID NO: 117865 - DNA, 20 bp, human
gtgtgcagaccaatatggcc

SEQ ID NO: 117866 - DNA, 20 bp, human
gaggcgccttgggaccgcgt

SEQ ID NO: 117867 - DNA, 20 bp, human
ggccgcagccgaaccgagta

SEQ ID NO: 117868 - DNA, 20 bp, human
gcggctcccacgcggtccca

SEQ ID NO: 117869 - DNA, 20 bp, human
gtccaggaggctgtgcgcaa

SEQ ID NO: 117870 - DNA, 20 bp, human
gggcgggcgagctagtgctg

SEQ ID NO: 117871 - DNA, 20 bp, human
ggctagtgctgcggcgcgtg

SEQ ID NO: 117872 - DNA, 20 bp, human
gacgcagcgcatcttccagg

SEQ ID NO: 117873 - DNA, 20 bp, human
gagtgctgcggcgcgtgggg

SEQ ID NO: 117874 - DNA, 20 bp, human
gagccgaaccgagtagggac

SEQ ID NO: 117875 - DNA, 20 bp, human
gtcccggtccctactcggtt

SEQ ID NO: 117876 - DNA, 20 bp, human
gccacagccgggaaaaatgt

SEQ ID NO: 117877 - DNA, 20 bp, human
gaagtgccgctccttggtgg

SEQ ID NO: 117878 - DNA, 20 bp, human
gacaggacacagtaaccagg

SEQ ID NO: 117879 - DNA, 20 bp, human
ggcctacgtggggagatctt

SEQ ID NO: 117880 - DNA, 20 bp, human
gcaaatggaaggtcacacta

SEQ ID NO: 117881 - DNA, 20 bp, human
ggcgccgactgattacgtag

SEQ ID NO: 117882 - DNA, 20 bp, human
ggctgttcatggcggttccg

SEQ ID NO: 117883 - DNA, 20 bp, human
gcggaagtgccgctccttgg

SEQ ID NO: 117884 - DNA, 20 bp, human
gtggccagggaccctgtata

SEQ ID NO: 117885 - DNA, 20 bp, human
gctgtccaaagcagaggcag

SEQ ID NO: 117886 - DNA, 20 bp, human
gtgggacactcaccaggttg

SEQ ID NO: 117887 - DNA, 20 bp, human
gagccagcgataggcgctga

SEQ ID NO: 117888 - DNA, 20 bp, human
ggcaggccctggcccaactg

SEQ ID NO: 117889 - DNA, 20 bp, human
gcgccccaagagccagcgat

SEQ ID NO: 117890 - DNA, 20 bp, human
gaggagggcaaagtctgaag

SEQ ID NO: 117891 - DNA, 20 bp, human
gggacttcccccagccagag

SEQ ID NO: 117892 - DNA, 20 bp, human
gcccggggccccgcgacagg

SEQ ID NO: 117893 - DNA, 20 bp, human
gcgcctatcgctggctcttg

SEQ ID NO: 117894 - DNA, 20 bp, human
gagtgcctctccaggctgta

SEQ ID NO: 117895 - DNA, 20 bp, human
gtggtcgcagaggctgtgag

SEQ ID NO: 117896 - DNA, 20 bp, human
gagggagtcgctgtgatccg

SEQ ID NO: 117897 - DNA, 20 bp, human
gctgcggagcgcagctgtga

SEQ ID NO: 117898 - DNA, 20 bp, human
gccgcagttcggttgcgctg

SEQ ID NO: 117899 - DNA, 20 bp, human
ggcggcctgcggaagctcgg

SEQ ID NO: 117900 - DNA, 20 bp, human
gtgcggggcgcggagtcggg

SEQ ID NO: 117901 - DNA, 20 bp, human
gcggcgcccggaccaacgat

SEQ ID NO: 117902 - DNA, 20 bp, human
gcagtagcccaggcccgatc

SEQ ID NO: 117903 - DNA, 20 bp, human
gcgccaagccagagacgcca

SEQ ID NO: 117904 - DNA, 20 bp, human
gtggcgttcgcttggaactc

SEQ ID NO: 117905 - DNA, 20 bp, human
gctccgaggcccgggacggt

SEQ ID NO: 117906 - DNA, 20 bp, human
gccaggccaaaggggtccag

SEQ ID NO: 117907 - DNA, 20 bp, human
ggcccagcctagagccgccg

SEQ ID NO: 117908 - DNA, 20 bp, human
ggcggctggaaacctctccg

SEQ ID NO: 117909 - DNA, 20 bp, human
gtcctggaggaaagcccgtg

SEQ ID NO: 117910 - DNA, 20 bp, human
ggccgcggcggctctaggct

SEQ ID NO: 117911 - DNA, 20 bp, human
gccgccggcgcagcctctcc

SEQ ID NO: 117912 - DNA, 20 bp, human
ggacgagagcgacatcctgg

SEQ ID NO: 117913 - DNA, 20 bp, human
ggaggacgagagcgacatcc

SEQ ID NO: 117914 - DNA, 20 bp, human
ggggcgagcgccaggccaaa

SEQ ID NO: 117915 - DNA, 20 bp, human
gctcgccctgggactccctg

SEQ ID NO: 117916 - DNA, 20 bp, human
ggcgggcgcggagcagaagt

SEQ ID NO: 117917 - DNA, 20 bp, human
gcgagaacggaggacaccgg

SEQ ID NO: 117918 - DNA, 20 bp, human
ggtccgagcctcagacgcgc

SEQ ID NO: 117919 - DNA, 20 bp, human
gctcagacgcgcgggcgcgg

SEQ ID NO: 117920 - DNA, 20 bp, human
gagcgctcggctgaaccccg

SEQ ID NO: 117921 - DNA, 20 bp, human
ggcccacgagcaagagctct

SEQ ID NO: 117922 - DNA, 20 bp, human
gaggcccccgacactcccgc

SEQ ID NO: 117923 - DNA, 20 bp, human
ggcgtctgaggctcggactg

SEQ ID NO: 117924 - DNA, 20 bp, human
gggccagcctcgcttcgcca

SEQ ID NO: 117925 - DNA, 20 bp, human
gcgggcgccgagagggagca

SEQ ID NO: 117926 - DNA, 20 bp, human
gtctagaacgcggaggaggt

SEQ ID NO: 117927 - DNA, 20 bp, human
gcaccgcctctagaacgcgg

SEQ ID NO: 117928 - DNA, 20 bp, human
gcgccaccgcctctagaacg

SEQ ID NO: 117929 - DNA, 20 bp, human
gctcctccgcgttctagagg

SEQ ID NO: 117930 - DNA, 20 bp, human
gggttcaggcctgttccccg

SEQ ID NO: 117931 - DNA, 20 bp, human
ggccagaataggaaagggtc

SEQ ID NO: 117932 - DNA, 20 bp, human
gcaagcaataccggtgaggg

SEQ ID NO: 117933 - DNA, 20 bp, human
gggcatggccagaataggaa

SEQ ID NO: 117934 - DNA, 20 bp, human
gccccaagcaataccggtga

SEQ ID NO: 117935 - DNA, 20 bp, human
gctaggagcggatgaatctg

SEQ ID NO: 117936 - DNA, 20 bp, human
gggaacagcgccatgaccac

SEQ ID NO: 117937 - DNA, 20 bp, human
gacctccgttcttctctata

SEQ ID NO: 117938 - DNA, 20 bp, human
ggcctcactaagccccgcaa

SEQ ID NO: 117939 - DNA, 20 bp, human
gccatccctatagagaagaa

SEQ ID NO: 117940 - DNA, 20 bp, human
gtccctatagagaagaacgg

SEQ ID NO: 117941 - DNA, 20 bp, human
gggcttagtgaggctcccga

SEQ ID NO: 117942 - DNA, 20 bp, human
gcagcgccgcggagaactct

SEQ ID NO: 117943 - DNA, 20 bp, human
gtacagaagtcccagctcca

SEQ ID NO: 117944 - DNA, 20 bp, human
gactaagccccgcaaaggct

SEQ ID NO: 117945 - DNA, 20 bp, human
ggagtgcaccgcgacggcag

SEQ ID NO: 117946 - DNA, 20 bp, human
gtcccagccggggataggaa

SEQ ID NO: 117947 - DNA, 20 bp, human
ggagtaatcaagtgtaaggg

SEQ ID NO: 117948 - DNA, 20 bp, human
gtgcttccgagggtcttctt

SEQ ID NO: 117949 - DNA, 20 bp, human
gcagccttggaaaaaggagg

SEQ ID NO: 117950 - DNA, 20 bp, human
gaaagagtaatcaagtgtaa

SEQ ID NO: 117951 - DNA, 20 bp, human
gtaatcaagtgtaagggcgg

SEQ ID NO: 117952 - DNA, 20 bp, human
gtcaggctggaatttaactt

SEQ ID NO: 117953 - DNA, 20 bp, human
gtatccccggctgggagcgc

SEQ ID NO: 117954 - DNA, 20 bp, human
gtatatgccattcctatccc

SEQ ID NO: 117955 - DNA, 20 bp, human
gctcttggagagagagcgcg

SEQ ID NO: 117956 - DNA, 20 bp, human
gcgctcgccattgccgctgg

SEQ ID NO: 117957 - DNA, 20 bp, human
gctcctgccaccagcggcaa

SEQ ID NO: 117958 - DNA, 20 bp, human
gggaggaggccggaaccctg

SEQ ID NO: 117959 - DNA, 20 bp, human
gggcgcggtcgcagtctcca

SEQ ID NO: 117960 - DNA, 20 bp, human
gagagcggctgcgctaccgt

SEQ ID NO: 117961 - DNA, 20 bp, human
gggccgggccccgggttcca

SEQ ID NO: 117962 - DNA, 20 bp, human
gtctccacggcgcaggccca

SEQ ID NO: 117963 - DNA, 20 bp, human
gagctggagattgcgcggta

SEQ ID NO: 117964 - DNA, 20 bp, human
gaaccctggggctctcggga

SEQ ID NO: 117965 - DNA, 20 bp, human
gccgccgcctggggctctcg

SEQ ID NO: 117966 - DNA, 20 bp, human
gtgctcacgctcccatcgtc

SEQ ID NO: 117967 - DNA, 20 bp, human
ggcggcggctgccggacgat

SEQ ID NO: 117968 - DNA, 20 bp, human
gagatgtccgagcgcaaaga

SEQ ID NO: 117969 - DNA, 20 bp, human
gggagacggagcgctctacg

SEQ ID NO: 117970 - DNA, 20 bp, human
ggcgccctcgcaacccgatc

SEQ ID NO: 117971 - DNA, 20 bp, human
gggagttccccgaaacttgt

SEQ ID NO: 117972 - DNA, 20 bp, human
gcgaaacttgttggaactcc

SEQ ID NO: 117973 - DNA, 20 bp, human
ggcgctcgccctggctctcg

SEQ ID NO: 117974 - DNA, 20 bp, human
gtggtccaagggctcggatc

SEQ ID NO: 117975 - DNA, 20 bp, human
gcggtccggccacctggaac

SEQ ID NO: 117976 - DNA, 20 bp, human
gcggggaggtggcccagcta

SEQ ID NO: 117977 - DNA, 20 bp, human
gaggtcctggcgcacagggt

SEQ ID NO: 117978 - DNA, 20 bp, human
ggctgcggctcgcgaacggg

SEQ ID NO: 117979 - DNA, 20 bp, human
ggcgcctcttagccctccac

SEQ ID NO: 117980 - DNA, 20 bp, human
gaggtggcccagctagggca

SEQ ID NO: 117981 - DNA, 20 bp, human
gcaaatggcctggccagatg

SEQ ID NO: 117982 - DNA, 20 bp, human
gcgggccgcgatgcgcagcg

SEQ ID NO: 117983 - DNA, 20 bp, human
ggccgccactggagaagggt

SEQ ID NO: 117984 - DNA, 20 bp, human
gaccgacccttctccagtgg

SEQ ID NO: 117985 - DNA, 20 bp, human
ggcgcgagagagcaagtggg

SEQ ID NO: 117986 - DNA, 20 bp, human
gtggagtccactaggtcggt

SEQ ID NO: 117987 - DNA, 20 bp, human
gcgatgaagccgatgaacag

SEQ ID NO: 117988 - DNA, 20 bp, human
gcgggctcgggcgcaggcag

SEQ ID NO: 117989 - DNA, 20 bp, human
gatcgtggtgggctccgtca

SEQ ID NO: 117990 - DNA, 20 bp, human
gagggccgcggcagaggcat

SEQ ID NO: 117991 - DNA, 20 bp, human
gcgacctagtggactccaag

SEQ ID NO: 117992 - DNA, 20 bp, human
gtacagcgtaactcccgggg

SEQ ID NO: 117993 - DNA, 20 bp, human
ggtgctgctactgaagaacg

SEQ ID NO: 117994 - DNA, 20 bp, human
gaccacagcacggaacactg

SEQ ID NO: 117995 - DNA, 20 bp, human
ggtggacgggaccgtcgcag

SEQ ID NO: 117996 - DNA, 20 bp, human
gcgagcgagaacaggcagga

SEQ ID NO: 117997 - DNA, 20 bp, human
gcacacgagcgagaacaggc

SEQ ID NO: 117998 - DNA, 20 bp, human
gtggctttgagagaagacct

SEQ ID NO: 117999 - DNA, 20 bp, human
gttctttatagaacagaact

SEQ ID NO: 118000 - DNA, 20 bp, human
gaacacacacgagcgagaac

SEQ ID NO: 118001 - DNA, 20 bp, human
gcttttgtttctgttatagc

SEQ ID NO: 118002 - DNA, 20 bp, human
gagggtaagtcctgtttgtt

SEQ ID NO: 118003 - DNA, 20 bp, human
gtgttagagtctttctgttt

SEQ ID NO: 118004 - DNA, 20 bp, human
gtcacagctgctgttgtctg

SEQ ID NO: 118005 - DNA, 20 bp, human
ggtcaaaaatctgatttata

SEQ ID NO: 118006 - DNA, 20 bp, human
gaccgtaagttagagggccc

SEQ ID NO: 118007 - DNA, 20 bp, human
gaagttagagggcccggggg

SEQ ID NO: 118008 - DNA, 20 bp, human
gagacagcctaggctggact

SEQ ID NO: 118009 - DNA, 20 bp, human
gtccagcctaggctgtctaa

SEQ ID NO: 118010 - DNA, 20 bp, human
gcctaggctgtctaacggat

SEQ ID NO: 118011 - DNA, 20 bp, human
ggcagctctgctctcgggtc

SEQ ID NO: 118012 - DNA, 20 bp, human
gcgcctgagaaagccctgga

SEQ ID NO: 118013 - DNA, 20 bp, human
gcggcagggctctgcaagag

SEQ ID NO: 118014 - DNA, 20 bp, human
gctgctgtttcggcgcgggt

SEQ ID NO: 118015 - DNA, 20 bp, human
gcaagaggggaactgcgggt

SEQ ID NO: 118016 - DNA, 20 bp, human
ggcagagccccgaactcggg

SEQ ID NO: 118017 - DNA, 20 bp, human
ggcagcagagccccgaactc

SEQ ID NO: 118018 - DNA, 20 bp, human
ggaacccggagactcgaacc

SEQ ID NO: 118019 - DNA, 20 bp, human
ggagccccgaactcgggagg

SEQ ID NO: 118020 - DNA, 20 bp, human
gccggccccccgcgagaacc

SEQ ID NO: 118021 - DNA, 20 bp, human
ggcccagaactggcacggac

SEQ ID NO: 118022 - DNA, 20 bp, human
gccgagcctgacggagccgg

SEQ ID NO: 118023 - DNA, 20 bp, human
gcggagggaagagctcgccg

SEQ ID NO: 118024 - DNA, 20 bp, human
gcgcggccgtcactcacccc

SEQ ID NO: 118025 - DNA, 20 bp, human
ggtgccagttctgggcaagg

SEQ ID NO: 118026 - DNA, 20 bp, human
gcaggagggtctccacggga

SEQ ID NO: 118027 - DNA, 20 bp, human
gccaacaggagggtctccac

SEQ ID NO: 118028 - DNA, 20 bp, human
ggtctccacgggagggaaag

SEQ ID NO: 118029 - DNA, 20 bp, human
gtgcagcacgggacagagac

SEQ ID NO: 118030 - DNA, 20 bp, human
ggagcgggacctgaaagctg

SEQ ID NO: 118031 - DNA, 20 bp, human
gcccgctggacagcctcaag

SEQ ID NO: 118032 - DNA, 20 bp, human
gctccctctacagcaatctc

SEQ ID NO: 118033 - DNA, 20 bp, human
ggcctcttgaggctgtccag

SEQ ID NO: 118034 - DNA, 20 bp, human
gctcggcacctccaaggact

SEQ ID NO: 118035 - DNA, 20 bp, human
gctgcctcctgctcaggatc

SEQ ID NO: 118036 - DNA, 20 bp, human
ggagcagccagtgcgcgcgc

SEQ ID NO: 118037 - DNA, 20 bp, human
gctccccgcgacgtcacgct

SEQ ID NO: 118038 - DNA, 20 bp, human
gtcgaggctgaggctgccgg

SEQ ID NO: 118039 - DNA, 20 bp, human
ggcttcttgaggccgtccag

SEQ ID NO: 118040 - DNA, 20 bp, human
gctggaggagctcgaggctg

SEQ ID NO: 118041 - DNA, 20 bp, human
gcttgcggccgccctcagtg

SEQ ID NO: 118042 - DNA, 20 bp, human
gcgcagcaggggtactggaa

SEQ ID NO: 118043 - DNA, 20 bp, human
gtactcagggctcctcactg

SEQ ID NO: 118044 - DNA, 20 bp, human
gcctgagtaaaacatcgctg

SEQ ID NO: 118045 - DNA, 20 bp, human
gaacatcgctgaggcgccgg

SEQ ID NO: 118046 - DNA, 20 bp, human
gacgggcgtcctctactcac

SEQ ID NO: 118047 - DNA, 20 bp, human
gggagacgaagaagctagaa

SEQ ID NO: 118048 - DNA, 20 bp, human
gggagcctgagcgtcagtcc

SEQ ID NO: 118049 - DNA, 20 bp, human
gggttctgcgtaccagaggg

SEQ ID NO: 118050 - DNA, 20 bp, human
gaaagaggcgcaccctgacg

SEQ ID NO: 118051 - DNA, 20 bp, human
ggagcggacgccctcaaaac

SEQ ID NO: 118052 - DNA, 20 bp, human
ggtctccaggactgacgctc

SEQ ID NO: 118053 - DNA, 20 bp, human
gagttgggctaaggcgagag

SEQ ID NO: 118054 - DNA, 20 bp, human
ggcgggttctgcgtaccaga

SEQ ID NO: 118055 - DNA, 20 bp, human
gagacacagcgctctcgaca

SEQ ID NO: 118056 - DNA, 20 bp, human
gcaggagactgaaggctcca

SEQ ID NO: 118057 - DNA, 20 bp, human
gggagtggagtagggtacca

SEQ ID NO: 118058 - DNA, 20 bp, human
ggtcacccttgagaggacag

SEQ ID NO: 118059 - DNA, 20 bp, human
gggtgacaggttccatagag

SEQ ID NO: 118060 - DNA, 20 bp, human
gggacacaggccagtcaggg

SEQ ID NO: 118061 - DNA, 20 bp, human
gctgtgggcacagagcccaa

SEQ ID NO: 118062 - DNA, 20 bp, human
gagggttgctgccctctcta

SEQ ID NO: 118063 - DNA, 20 bp, human
gtgagggacacaggccagtc

SEQ ID NO: 118064 - DNA, 20 bp, human
gatgtacagaaggagtagtg

SEQ ID NO: 118065 - DNA, 20 bp, human
gcacttcagaaatggccgag

SEQ ID NO: 118066 - DNA, 20 bp, human
ggagcggttggccaacgcag

SEQ ID NO: 118067 - DNA, 20 bp, human
gggttaccgccggcttcagt

SEQ ID NO: 118068 - DNA, 20 bp, human
gctggtgggtggtctcgcgt

SEQ ID NO: 118069 - DNA, 20 bp, human
gcacctcccactgaagccgg

SEQ ID NO: 118070 - DNA, 20 bp, human
gactaggcgtaacggctgag

SEQ ID NO: 118071 - DNA, 20 bp, human
ggcggcagtcggtgtaaaca

SEQ ID NO: 118072 - DNA, 20 bp, human
ggcgagaccacccaccagcc

SEQ ID NO: 118073 - DNA, 20 bp, human
gtaccgccggcttcagtggg

SEQ ID NO: 118074 - DNA, 20 bp, human
gacagccgaactaggcgtaa

SEQ ID NO: 118075 - DNA, 20 bp, human
ggcgtaacggctgagaggcg

SEQ ID NO: 118076 - DNA, 20 bp, human
ggccatggcgagaaatggag

SEQ ID NO: 118077 - DNA, 20 bp, human
ggccaggatgaaagaggcga

SEQ ID NO: 118078 - DNA, 20 bp, human
gggcgagggcagcagggatc

SEQ ID NO: 118079 - DNA, 20 bp, human
gccaaaggccaggatgaaag

SEQ ID NO: 118080 - DNA, 20 bp, human
gggatcgaggatgaactggg

SEQ ID NO: 118081 - DNA, 20 bp, human
ggccgtaggagagggattga

SEQ ID NO: 118082 - DNA, 20 bp, human
gaagcgcacgaactccactc

SEQ ID NO: 118083 - DNA, 20 bp, human
gtggagaaccgaagtaagag

SEQ ID NO: 118084 - DNA, 20 bp, human
gagcggccgagaagctacag

SEQ ID NO: 118085 - DNA, 20 bp, human
gcaggggccatggcgagaaa

SEQ ID NO: 118086 - DNA, 20 bp, human
gtatgcactgggaaggcaga

SEQ ID NO: 118087 - DNA, 20 bp, human
ggagactttatgcactggga

SEQ ID NO: 118088 - DNA, 20 bp, human
ggaagccggcaatcccccga

SEQ ID NO: 118089 - DNA, 20 bp, human
gggcaatcccccgagggtgg

SEQ ID NO: 118090 - DNA, 20 bp, human
gggactagcgcgtcccagat

SEQ ID NO: 118091 - DNA, 20 bp, human
gggatgggacttaagttgaa

SEQ ID NO: 118092 - DNA, 20 bp, human
gtgtgtgctcaggaaaaagg

SEQ ID NO: 118093 - DNA, 20 bp, human
gcgggggaaagccaaaaaat

SEQ ID NO: 118094 - DNA, 20 bp, human
gcgcggtgcaaataggtaag

SEQ ID NO: 118095 - DNA, 20 bp, human
gtgatcctcgcggtgcaaat

SEQ ID NO: 118096 - DNA, 20 bp, human
gggccagacgccgaagagga

SEQ ID NO: 118097 - DNA, 20 bp, human
gacgctctcggaagctgcta

SEQ ID NO: 118098 - DNA, 20 bp, human
gtctggacggccaaaccccg

SEQ ID NO: 118099 - DNA, 20 bp, human
ggccgggccagacgccgaag

SEQ ID NO: 118100 - DNA, 20 bp, human
ggttcggtcaccttcctctt

SEQ ID NO: 118101 - DNA, 20 bp, human
gcccgaggcgcgggactgga

SEQ ID NO: 118102 - DNA, 20 bp, human
gtcggaagctgctacgggtt

SEQ ID NO: 118103 - DNA, 20 bp, human
gttgcaaacgggtacgctct

SEQ ID NO: 118104 - DNA, 20 bp, human
gggaaacacaggccgcacga

SEQ ID NO: 118105 - DNA, 20 bp, human
gcactggcgcccacgaccct

SEQ ID NO: 118106 - DNA, 20 bp, human
gggcagcagcgcatcatccc

SEQ ID NO: 118107 - DNA, 20 bp, human
gacggcctcagggcatgggg

SEQ ID NO: 118108 - DNA, 20 bp, human
ggatgcccgcactcaccgag

SEQ ID NO: 118109 - DNA, 20 bp, human
gtgcactaggctctcagcca

SEQ ID NO: 118110 - DNA, 20 bp, human
gagcaacggcctcagggcat

SEQ ID NO: 118111 - DNA, 20 bp, human
ggggtggagaagagttgtaa

SEQ ID NO: 118112 - DNA, 20 bp, human
gagcagctagctcctgcact

SEQ ID NO: 118113 - DNA, 20 bp, human
gggacttatagaccagtcgt

SEQ ID NO: 118114 - DNA, 20 bp, human
ggaggccccggaccaggagc

SEQ ID NO: 118115 - DNA, 20 bp, human
gtctttagagagagttcgga

SEQ ID NO: 118116 - DNA, 20 bp, human
gagacacccggacctcccct

SEQ ID NO: 118117 - DNA, 20 bp, human
gtggcgcccaggggaggtcc

SEQ ID NO: 118118 - DNA, 20 bp, human
ggccagctccgcggctccaa

SEQ ID NO: 118119 - DNA, 20 bp, human
gcgcgggagaacgaggacgt

SEQ ID NO: 118120 - DNA, 20 bp, human
gccgggtccgcaggcagacg

SEQ ID NO: 118121 - DNA, 20 bp, human
ggcagaggcgcgggtgacag

SEQ ID NO: 118122 - DNA, 20 bp, human
gcgggtgtctgcgggaagga

SEQ ID NO: 118123 - DNA, 20 bp, human
ggggagaacgaggacgtggg

SEQ ID NO: 118124 - DNA, 20 bp, human
gaaagatgagcgggagacag

SEQ ID NO: 118125 - DNA, 20 bp, human
gctgcctgcggacccggaga

SEQ ID NO: 118126 - DNA, 20 bp, human
gcggcgggagcctcccccaa

SEQ ID NO: 118127 - DNA, 20 bp, human
gcatgctgctcggcctgaaa

SEQ ID NO: 118128 - DNA, 20 bp, human
ggcacccttgacggacacac

SEQ ID NO: 118129 - DNA, 20 bp, human
ggcgatctctgcctcccctc

SEQ ID NO: 118130 - DNA, 20 bp, human
ggccgcacagacactcggcg

SEQ ID NO: 118131 - DNA, 20 bp, human
ggaggcagagatcgcgagcg

SEQ ID NO: 118132 - DNA, 20 bp, human
gcagacactcggcgaggtgg

SEQ ID NO: 118133 - DNA, 20 bp, human
gcctcagccgcacagacact

SEQ ID NO: 118134 - DNA, 20 bp, human
ggcctctcgaggggagtctg

SEQ ID NO: 118135 - DNA, 20 bp, human
gcgcttggccagcctctcga

SEQ ID NO: 118136 - DNA, 20 bp, human
gcgttcggctgctctcgagg

SEQ ID NO: 118137 - DNA, 20 bp, human
gcggggcgcatcgtctccgg

SEQ ID NO: 118138 - DNA, 20 bp, human
gcccacgcgggaaatactca

SEQ ID NO: 118139 - DNA, 20 bp, human
gccgcgttcggctgctctcg

SEQ ID NO: 118140 - DNA, 20 bp, human
gggtagcccagccccgcgtt

SEQ ID NO: 118141 - DNA, 20 bp, human
gccgcagctcagggctcacg

SEQ ID NO: 118142 - DNA, 20 bp, human
ggacgtagtggaaaccacga

SEQ ID NO: 118143 - DNA, 20 bp, human
gtatccagtcgcccagccca

SEQ ID NO: 118144 - DNA, 20 bp, human
ggcatgtgagcagacagtta

SEQ ID NO: 118145 - DNA, 20 bp, human
ggagcacttagagctgagaa

SEQ ID NO: 118146 - DNA, 20 bp, human
gcagcgagagatctgcagct

SEQ ID NO: 118147 - DNA, 20 bp, human
gccagctgtcaatcaggcgc

SEQ ID NO: 118148 - DNA, 20 bp, human
ggagagatctgcagctaggc

SEQ ID NO: 118149 - DNA, 20 bp, human
gacgggtcaggggatcggag

SEQ ID NO: 118150 - DNA, 20 bp, human
ggccacgcagagtccagggg

SEQ ID NO: 118151 - DNA, 20 bp, human
gcacttgctccacgggtcag

SEQ ID NO: 118152 - DNA, 20 bp, human
gcatttatgcatgaagaagg

SEQ ID NO: 118153 - DNA, 20 bp, human
gtgttatgtaagaatttggg

SEQ ID NO: 118154 - DNA, 20 bp, human
gtaataaacgtgaatgaagg

SEQ ID NO: 118155 - DNA, 20 bp, human
gcggtgaaaacatacaaatt

SEQ ID NO: 118156 - DNA, 20 bp, human
ggacctggaaaagggactga

SEQ ID NO: 118157 - DNA, 20 bp, human
gctacccatcccccccggga

SEQ ID NO: 118158 - DNA, 20 bp, human
gggctgggtagaggcttcaa

SEQ ID NO: 118159 - DNA, 20 bp, human
gtgctgtctccgccgagcaa

SEQ ID NO: 118160 - DNA, 20 bp, human
gcgccgagcaaaggcgggtc

SEQ ID NO: 118161 - DNA, 20 bp, human
gacccagcctatcaaccctg

SEQ ID NO: 118162 - DNA, 20 bp, human
ggaggcgtcgaggggcgatg

SEQ ID NO: 118163 - DNA, 20 bp, human
ggaaggggcgccctcccggg

SEQ ID NO: 118164 - DNA, 20 bp, human
gcttcggtgaggagtctgag

SEQ ID NO: 118165 - DNA, 20 bp, human
gtggggaactgcgggagtga

SEQ ID NO: 118166 - DNA, 20 bp, human
ggaccagcgcaggtccgagg

SEQ ID NO: 118167 - DNA, 20 bp, human
gggatacgccacactcagtc

SEQ ID NO: 118168 - DNA, 20 bp, human
gatgcagcgctggaaggcgg

SEQ ID NO: 118169 - DNA, 20 bp, human
ggctgctggagggacagacg

SEQ ID NO: 118170 - DNA, 20 bp, human
ggaatggtcgataatcacat

SEQ ID NO: 118171 - DNA, 20 bp, human
gccatctggatgtgtcgaga

SEQ ID NO: 118172 - DNA, 20 bp, human
gtccagacttgaataaacgt

SEQ ID NO: 118173 - DNA, 20 bp, human
gacatgggaatggtccctca

SEQ ID NO: 118174 - DNA, 20 bp, human
gtcgaggcaggcggtgcagg

SEQ ID NO: 118175 - DNA, 20 bp, human
ggagaatggcatcacaggca

SEQ ID NO: 118176 - DNA, 20 bp, human
gactgctgctgccttttcag

SEQ ID NO: 118177 - DNA, 20 bp, human
gttcctgaggtctatggata

SEQ ID NO: 118178 - DNA, 20 bp, human
gtatctccaggagtgcggga

SEQ ID NO: 118179 - DNA, 20 bp, human
gagtgtggggctgatgaggt

SEQ ID NO: 118180 - DNA, 20 bp, human
gggcttgagcgtctatctcc

SEQ ID NO: 118181 - DNA, 20 bp, human
gggtcaaagcgaatttcctg

SEQ ID NO: 118182 - DNA, 20 bp, human
gaggggagaacaggcaacgg

SEQ ID NO: 118183 - DNA, 20 bp, human
ggcgtctatctccaggagtg

SEQ ID NO: 118184 - DNA, 20 bp, human
gcgagctgaggggaataacc

SEQ ID NO: 118185 - DNA, 20 bp, human
gtactgcacaaattaacgat

SEQ ID NO: 118186 - DNA, 20 bp, human
ggcgccagaagctggagggt

SEQ ID NO: 118187 - DNA, 20 bp, human
ggatgctccgcgagtcaggg

SEQ ID NO: 118188 - DNA, 20 bp, human
gctgagagctgaggagaatg

SEQ ID NO: 118189 - DNA, 20 bp, human
ggaggatgctccgcgagtca

SEQ ID NO: 118190 - DNA, 20 bp, human
gtggcccggtgacagcgagg

SEQ ID NO: 118191 - DNA, 20 bp, human
ggagcagccgccctgactcg

SEQ ID NO: 118192 - DNA, 20 bp, human
gcggagcatcctcctcggag

SEQ ID NO: 118193 - DNA, 20 bp, human
gccgcggtgcctctccgagg

SEQ ID NO: 118194 - DNA, 20 bp, human
ggcaggacggatgaattggg

SEQ ID NO: 118195 - DNA, 20 bp, human
gtccctgcaacaccgactga

SEQ ID NO: 118196 - DNA, 20 bp, human
gtgctctacctggacgacgg

SEQ ID NO: 118197 - DNA, 20 bp, human
gtgctgctctacctggacga

SEQ ID NO: 118198 - DNA, 20 bp, human
ggatgccggcttccctcagg

SEQ ID NO: 118199 - DNA, 20 bp, human
gtggcactgtgagcctgcaa

SEQ ID NO: 118200 - DNA, 20 bp, human
gcttctgtcggagcccgcgg

SEQ ID NO: 118201 - DNA, 20 bp, human
gcatggcgtccgggagccgg

SEQ ID NO: 118202 - DNA, 20 bp, human
gccggacgccatgcctacgg

SEQ ID NO: 118203 - DNA, 20 bp, human
ggctggtggacggccgcctg

SEQ ID NO: 118204 - DNA, 20 bp, human
gcggacggcctggagttcgg

SEQ ID NO: 118205 - DNA, 20 bp, human
ggctcttctgtcggagcccg

SEQ ID NO: 118206 - DNA, 20 bp, human
gcgggcctaacaccatccca

SEQ ID NO: 118207 - DNA, 20 bp, human
gcatcccacggcagaaaact

SEQ ID NO: 118208 - DNA, 20 bp, human
gccggtggaagtgggtagag

SEQ ID NO: 118209 - DNA, 20 bp, human
gaccttcgtcaagatcccgg

SEQ ID NO: 118210 - DNA, 20 bp, human
gtcaagatcccggtggaagt

SEQ ID NO: 118211 - DNA, 20 bp, human
gtctgccgtgggatggtgtt

SEQ ID NO: 118212 - DNA, 20 bp, human
gtccaccgggatcttgacga

SEQ ID NO: 118213 - DNA, 20 bp, human
gcagttaaaactaagatcca

SEQ ID NO: 118214 - DNA, 20 bp, human
gcctaccttcgtcaagatcc

SEQ ID NO: 118215 - DNA, 20 bp, human
gatctaaccatggaaatacg

SEQ ID NO: 118216 - DNA, 20 bp, human
gtgagaaagcacaacctcag

SEQ ID NO: 118217 - DNA, 20 bp, human
ggagggcttgaggaatgtgg

SEQ ID NO: 118218 - DNA, 20 bp, human
gaccgagggcggtgttagga

SEQ ID NO: 118219 - DNA, 20 bp, human
gaaatcacgaacaccgaggg

SEQ ID NO: 118220 - DNA, 20 bp, human
gtccgggagagacacaggac

SEQ ID NO: 118221 - DNA, 20 bp, human
gcagggccacagagttcatt

SEQ ID NO: 118222 - DNA, 20 bp, human
ggcaaaatcacgaacaccga

SEQ ID NO: 118223 - DNA, 20 bp, human
gtgctgcactaagatttgaa

SEQ ID NO: 118224 - DNA, 20 bp, human
ggatatgtgagctgcggtgg

SEQ ID NO: 118225 - DNA, 20 bp, human
gattgctccgggagagacac

SEQ ID NO: 118226 - DNA, 20 bp, human
gccagagcctaatgggaata

SEQ ID NO: 118227 - DNA, 20 bp, human
ggacatctaagactgtacaa

SEQ ID NO: 118228 - DNA, 20 bp, human
gatcagccccagagcctaat

SEQ ID NO: 118229 - DNA, 20 bp, human
gtgcggccgtcaccatggta

SEQ ID NO: 118230 - DNA, 20 bp, human
gaaaggatggtagacccgtg

SEQ ID NO: 118231 - DNA, 20 bp, human
gggacaaccatattcccatt

SEQ ID NO: 118232 - DNA, 20 bp, human
gcgaggcatcctccttacca

SEQ ID NO: 118233 - DNA, 20 bp, human
ggaatttttaggactcttag

SEQ ID NO: 118234 - DNA, 20 bp, human
gggctctgcggccgtcacca

SEQ ID NO: 118235 - DNA, 20 bp, human
gtgtgtgtcgcgagcgtccg

SEQ ID NO: 118236 - DNA, 20 bp, human
gcgcgccgggaggaagttcg

SEQ ID NO: 118237 - DNA, 20 bp, human
gtgttcgcaggcggccggcg

SEQ ID NO: 118238 - DNA, 20 bp, human
ggcggcggcggaataggccg

SEQ ID NO: 118239 - DNA, 20 bp, human
gcccccgcgtctctcttcag

SEQ ID NO: 118240 - DNA, 20 bp, human
gcagcctgctacctgagggg

SEQ ID NO: 118241 - DNA, 20 bp, human
ggctgccgcgaacttcctcc

SEQ ID NO: 118242 - DNA, 20 bp, human
gcggccgcctgcgaacacct

SEQ ID NO: 118243 - DNA, 20 bp, human
ggagagcgccgcccaatcag

SEQ ID NO: 118244 - DNA, 20 bp, human
gcgtctctcttcaggggaga

SEQ ID NO: 118245 - DNA, 20 bp, human
gtgagcccggctggtagtga

SEQ ID NO: 118246 - DNA, 20 bp, human
gtccgggcctggagttcagt

SEQ ID NO: 118247 - DNA, 20 bp, human
ggagtaaagggtggcggtcc

SEQ ID NO: 118248 - DNA, 20 bp, human
ggacacagggtgacctccaa

SEQ ID NO: 118249 - DNA, 20 bp, human
gccgtaggcgcccccctgtc

SEQ ID NO: 118250 - DNA, 20 bp, human
gtacatctgggtcagtctag

SEQ ID NO: 118251 - DNA, 20 bp, human
gtcacgcgggaggggagtaa

SEQ ID NO: 118252 - DNA, 20 bp, human
gcaggggggcgcctacggac

SEQ ID NO: 118253 - DNA, 20 bp, human
ggtctggggcctatacatct

SEQ ID NO: 118254 - DNA, 20 bp, human
gggccccagttcaccgtcct

SEQ ID NO: 118255 - DNA, 20 bp, human
gagcccaggacggtgaactg

SEQ ID NO: 118256 - DNA, 20 bp, human
ggacccccagagcccgtcag

SEQ ID NO: 118257 - DNA, 20 bp, human
gcttgcgagggcttattagg

SEQ ID NO: 118258 - DNA, 20 bp, human
ggacgcgcgcgtcctcacgg

SEQ ID NO: 118259 - DNA, 20 bp, human
gaggccagagcgggacttga

SEQ ID NO: 118260 - DNA, 20 bp, human
gcggttgcacgcctgcgcga

SEQ ID NO: 118261 - DNA, 20 bp, human
gcgaccctgcggctgtgtgg

SEQ ID NO: 118262 - DNA, 20 bp, human
ggcggctgtgtggaggacga

SEQ ID NO: 118263 - DNA, 20 bp, human
gcgccgaagccccctctgac

SEQ ID NO: 118264 - DNA, 20 bp, human
gagggacgcgcgcgtcctca

SEQ ID NO: 118265 - DNA, 20 bp, human
gcgggacttgagggtagcag

SEQ ID NO: 118266 - DNA, 20 bp, human
ggcgcacggggcgaagatgg

SEQ ID NO: 118267 - DNA, 20 bp, human
gccggcctccagcagatact

SEQ ID NO: 118268 - DNA, 20 bp, human
gggccacctagtcccgagtg

SEQ ID NO: 118269 - DNA, 20 bp, human
gctccagcagatactcggcg

SEQ ID NO: 118270 - DNA, 20 bp, human
gatggcggcggagcgacagg

SEQ ID NO: 118271 - DNA, 20 bp, human
gaagcgggcccggtcctcct

SEQ ID NO: 118272 - DNA, 20 bp, human
ggagcgacaggaggcgctga

SEQ ID NO: 118273 - DNA, 20 bp, human
gacgggcgccgaggaggacc

SEQ ID NO: 118274 - DNA, 20 bp, human
gggccgactcgagaaagaag

SEQ ID NO: 118275 - DNA, 20 bp, human
gaagatggcggcggagcgac

SEQ ID NO: 118276 - DNA, 20 bp, human
ggcgcggcccgtaaaggagg

SEQ ID NO: 118277 - DNA, 20 bp, human
ggcgcgtccgcgtataaagg

SEQ ID NO: 118278 - DNA, 20 bp, human
gccggacgcggagagaaggg

SEQ ID NO: 118279 - DNA, 20 bp, human
gctctgggaagccgcgacag

SEQ ID NO: 118280 - DNA, 20 bp, human
gggtggcggagaccagagca

SEQ ID NO: 118281 - DNA, 20 bp, human
gcctccccaacccagcacta

SEQ ID NO: 118282 - DNA, 20 bp, human
gagggacagagcgaccccca

SEQ ID NO: 118283 - DNA, 20 bp, human
ggcggagtagcgctctccca

SEQ ID NO: 118284 - DNA, 20 bp, human
ggggagggggcgaccaaaag

SEQ ID NO: 118285 - DNA, 20 bp, human
ggccgccgcccgagcatcct

SEQ ID NO: 118286 - DNA, 20 bp, human
gctcggggacgctctgccgg

SEQ ID NO: 118287 - DNA, 20 bp, human
gcgctctgccggaggagatt

SEQ ID NO: 118288 - DNA, 20 bp, human
gggtcaaggaccaccaactc

SEQ ID NO: 118289 - DNA, 20 bp, human
gcttgtcccatggagggtca

SEQ ID NO: 118290 - DNA, 20 bp, human
ggtggtccttgaccctccat

SEQ ID NO: 118291 - DNA, 20 bp, human
gccgcgagctccttgtccca

SEQ ID NO: 118292 - DNA, 20 bp, human
gatggcggggtctcctgagt

SEQ ID NO: 118293 - DNA, 20 bp, human
gcagttccgacgaaaaatgg

SEQ ID NO: 118294 - DNA, 20 bp, human
gactgtgggcggggcactct

SEQ ID NO: 118295 - DNA, 20 bp, human
gctggttctacagtagcctg

SEQ ID NO: 118296 - DNA, 20 bp, human
gcggagatctgagggacggg

SEQ ID NO: 118297 - DNA, 20 bp, human
ggataaacgccatggagggt

SEQ ID NO: 118298 - DNA, 20 bp, human
gcctcgcgtggggactccgg

SEQ ID NO: 118299 - DNA, 20 bp, human
gggcctctcaccccgacctc

SEQ ID NO: 118300 - DNA, 20 bp, human
gtggcggaaacctgaggtcg

SEQ ID NO: 118301 - DNA, 20 bp, human
gcagctgcagctctactcca

SEQ ID NO: 118302 - DNA, 20 bp, human
ggcctgccgaggaggtccgg

SEQ ID NO: 118303 - DNA, 20 bp, human
gccggcagtgcaggtcccgg

SEQ ID NO: 118304 - DNA, 20 bp, human
ggccaggccagattccaccg

SEQ ID NO: 118305 - DNA, 20 bp, human
gggcggccgagagcccgacg

SEQ ID NO: 118306 - DNA, 20 bp, human
ggctccctggtgggtaacgt

SEQ ID NO: 118307 - DNA, 20 bp, human
ggggtaacgtggggagctag

SEQ ID NO: 118308 - DNA, 20 bp, human
gcaggccgcgctagcggata

SEQ ID NO: 118309 - DNA, 20 bp, human
ggagggcggcgggacaaaga

SEQ ID NO: 118310 - DNA, 20 bp, human
gctccccacgttacccacca

SEQ ID NO: 118311 - DNA, 20 bp, human
ggcatcccaggccgcgctag

SEQ ID NO: 118312 - DNA, 20 bp, human
gcgcggcctgggatgcgctt

SEQ ID NO: 118313 - DNA, 20 bp, human
ggggagcccaagcgcatccc

SEQ ID NO: 118314 - DNA, 20 bp, human
gcaaagagggtggtcggcaa

SEQ ID NO: 118315 - DNA, 20 bp, human
gcgcgttcgccccgcctcaa

SEQ ID NO: 118316 - DNA, 20 bp, human
ggcccgctctcacttttcag

SEQ ID NO: 118317 - DNA, 20 bp, human
gtttcagcggcaggcgaagg

SEQ ID NO: 118318 - DNA, 20 bp, human
gccaagctgtctccgtctgg

SEQ ID NO: 118319 - DNA, 20 bp, human
ggtctaggcaggggaaattg

SEQ ID NO: 118320 - DNA, 20 bp, human
gtaaaagtaaggccacggga

SEQ ID NO: 118321 - DNA, 20 bp, human
gacgccacggtagtgagtct

SEQ ID NO: 118322 - DNA, 20 bp, human
gtgccgctgaaaagtgagag

SEQ ID NO: 118323 - DNA, 20 bp, human
gtgtcccagactcactaccg

SEQ ID NO: 118324 - DNA, 20 bp, human
gaaattggggtgccaccaga

SEQ ID NO: 118325 - DNA, 20 bp, human
gaccctcagggacactccac

SEQ ID NO: 118326 - DNA, 20 bp, human
ggcctgctcccggcggaacg

SEQ ID NO: 118327 - DNA, 20 bp, human
ggggtccatcatctcgtccc

SEQ ID NO: 118328 - DNA, 20 bp, human
gtcaccgtgcaacttcggaa

SEQ ID NO: 118329 - DNA, 20 bp, human
gctggaggacacagagccgt

SEQ ID NO: 118330 - DNA, 20 bp, human
gacggctccagccacaaagt

SEQ ID NO: 118331 - DNA, 20 bp, human
gaccggaggcaggtgccggg

SEQ ID NO: 118332 - DNA, 20 bp, human
gccgtgcaacttcggaacgg

SEQ ID NO: 118333 - DNA, 20 bp, human
gtctcgtccccggaatccga

SEQ ID NO: 118334 - DNA, 20 bp, human
ggtgaattggcgctatgtct

SEQ ID NO: 118335 - DNA, 20 bp, human
ggtaaggcggcgcctccggg

SEQ ID NO: 118336 - DNA, 20 bp, human
gcgcggggagggcgcctcag

SEQ ID NO: 118337 - DNA, 20 bp, human
ggtccccgcatggccgcacc

SEQ ID NO: 118338 - DNA, 20 bp, human
ggttcgggcagcgctctccc

SEQ ID NO: 118339 - DNA, 20 bp, human
gaggccactcccgacctggg

SEQ ID NO: 118340 - DNA, 20 bp, human
ggcggcgcccatggtcgagg

SEQ ID NO: 118341 - DNA, 20 bp, human
gcgggccctgacgtcacgat

SEQ ID NO: 118342 - DNA, 20 bp, human
gcacgcgctcgcgaggggag

SEQ ID NO: 118343 - DNA, 20 bp, human
gcggggccggccctcggttc

SEQ ID NO: 118344 - DNA, 20 bp, human
ggcgccgccgcctcgaccat

SEQ ID NO: 118345 - DNA, 20 bp, human
ggcggcacgcgcggagcgcc

SEQ ID NO: 118346 - DNA, 20 bp, human
ggtgagtgatccgggagtta

SEQ ID NO: 118347 - DNA, 20 bp, human
ggtcagcgtcacggaggcgt

SEQ ID NO: 118348 - DNA, 20 bp, human
gcccgcttggatgctctcag

SEQ ID NO: 118349 - DNA, 20 bp, human
gggagcaagatggcgattcc

SEQ ID NO: 118350 - DNA, 20 bp, human
gaggagaacaaggccctcta

SEQ ID NO: 118351 - DNA, 20 bp, human
gggcaggcagtgagtgatcc

SEQ ID NO: 118352 - DNA, 20 bp, human
gaggcgtcggccacgttcag

SEQ ID NO: 118353 - DNA, 20 bp, human
gccagcctgaccctaactcc

SEQ ID NO: 118354 - DNA, 20 bp, human
gggccacgttcagcggacac

SEQ ID NO: 118355 - DNA, 20 bp, human
ggctgggggatgagaaacta

SEQ ID NO: 118356 - DNA, 20 bp, human
gggaagtcccgggaggtgta

SEQ ID NO: 118357 - DNA, 20 bp, human
gtccggccggaagtcccggg

SEQ ID NO: 118358 - DNA, 20 bp, human
gtcgtgcccgagggcgagtg

SEQ ID NO: 118359 - DNA, 20 bp, human
gcgcagaaaccggcccgcca

SEQ ID NO: 118360 - DNA, 20 bp, human
ggaccaggcccggacacgtg

SEQ ID NO: 118361 - DNA, 20 bp, human
gggctaccccgagatcgtca

SEQ ID NO: 118362 - DNA, 20 bp, human
gttcttaaagtggccgggag

SEQ ID NO: 118363 - DNA, 20 bp, human
ggcacgcagcacgcagaaac

SEQ ID NO: 118364 - DNA, 20 bp, human
ggagcccgcgtgggaaacct

SEQ ID NO: 118365 - DNA, 20 bp, human
gcgcggccgcgtgggctatg

SEQ ID NO: 118366 - DNA, 20 bp, human
gcagtatcaaaaagcctcca

SEQ ID NO: 118367 - DNA, 20 bp, human
ggtctgcgagctggacggaa

SEQ ID NO: 118368 - DNA, 20 bp, human
gctcgcgaggggacgaacaa

SEQ ID NO: 118369 - DNA, 20 bp, human
gtctgacttccgggattcgc

SEQ ID NO: 118370 - DNA, 20 bp, human
gagtggatgcccgcgaatcc

SEQ ID NO: 118371 - DNA, 20 bp, human
ggaaacgctgatctcgcgag

SEQ ID NO: 118372 - DNA, 20 bp, human
gtgtgtcacagcggtatccc

SEQ ID NO: 118373 - DNA, 20 bp, human
gcagccctccaagagctgga

SEQ ID NO: 118374 - DNA, 20 bp, human
ggacgcggccgaggtggcga

SEQ ID NO: 118375 - DNA, 20 bp, human
gtagaagtctgcgagctgga

SEQ ID NO: 118376 - DNA, 20 bp, human
gtaagtttcgggacctggcc

SEQ ID NO: 118377 - DNA, 20 bp, human
gtggctgcgctgacactgag

SEQ ID NO: 118378 - DNA, 20 bp, human
gcccgtggagcacgccgata

SEQ ID NO: 118379 - DNA, 20 bp, human
ggagggagggaagtaaaagg

SEQ ID NO: 118380 - DNA, 20 bp, human
gtccggtcggaattaccccg

SEQ ID NO: 118381 - DNA, 20 bp, human
gcatagagtgcggacagagg

SEQ ID NO: 118382 - DNA, 20 bp, human
gagtgtcagcgcagccatat

SEQ ID NO: 118383 - DNA, 20 bp, human
gcgagagagggaggtgccta

SEQ ID NO: 118384 - DNA, 20 bp, human
ggccatatcggcgtgctcca

SEQ ID NO: 118385 - DNA, 20 bp, human
gcgggagctgctgaagcgtg

SEQ ID NO: 118386 - DNA, 20 bp, human
ggctgcagctgcaggcgtgt

SEQ ID NO: 118387 - DNA, 20 bp, human
gacctggccaaggtgagggg

SEQ ID NO: 118388 - DNA, 20 bp, human
gccgtgcggagaagaagctg

SEQ ID NO: 118389 - DNA, 20 bp, human
gagcgccggcctcctccgtg

SEQ ID NO: 118390 - DNA, 20 bp, human
gcagctgcaggcgtgttggc

SEQ ID NO: 118391 - DNA, 20 bp, human
ggacctgggcgcgagtagta

SEQ ID NO: 118392 - DNA, 20 bp, human
gggcgcgagtagtaggggtg

SEQ ID NO: 118393 - DNA, 20 bp, human
gggtcggacgggcccgggtg

SEQ ID NO: 118394 - DNA, 20 bp, human
gctctgtggcaaaacgcacc

SEQ ID NO: 118395 - DNA, 20 bp, human
gtggcaaaacgcacccggct

SEQ ID NO: 118396 - DNA, 20 bp, human
gctttccgccgagaaatagg

SEQ ID NO: 118397 - DNA, 20 bp, human
gggacgcagatcagtaagcc

SEQ ID NO: 118398 - DNA, 20 bp, human
gcccggcagccccttctaat

SEQ ID NO: 118399 - DNA, 20 bp, human
gcgcgccccctatttctcgg

SEQ ID NO: 118400 - DNA, 20 bp, human
ggaaggctttatgaataagg

SEQ ID NO: 118401 - DNA, 20 bp, human
ggaggttgaaaactatctta

SEQ ID NO: 118402 - DNA, 20 bp, human
gcttccaccacacctcatcg

SEQ ID NO: 118403 - DNA, 20 bp, human
gacattgcctcgatgaggtg

SEQ ID NO: 118404 - DNA, 20 bp, human
gaagcctagccgattagaag

SEQ ID NO: 118405 - DNA, 20 bp, human
gcagccccttctaatcggct

SEQ ID NO: 118406 - DNA, 20 bp, human
gcgactgccggagactcggg

SEQ ID NO: 118407 - DNA, 20 bp, human
gttccctcaagccagtctgg

SEQ ID NO: 118408 - DNA, 20 bp, human
gagtcgactgccggagactc

SEQ ID NO: 118409 - DNA, 20 bp, human
ggcaaccgcgagcggaggtg

SEQ ID NO: 118410 - DNA, 20 bp, human
gcgagggcggatggttcccg

SEQ ID NO: 118411 - DNA, 20 bp, human
gcgaagggggccacccacag

SEQ ID NO: 118412 - DNA, 20 bp, human
gctcccaccggcaggattcg

SEQ ID NO: 118413 - DNA, 20 bp, human
gcggacgtggcggcgaagag

SEQ ID NO: 118414 - DNA, 20 bp, human
gctcggggtaagggaggagt

SEQ ID NO: 118415 - DNA, 20 bp, human
gagccggtgactgggctgtg

SEQ ID NO: 118416 - DNA, 20 bp, human
gagagctcgcagctccggcc

SEQ ID NO: 118417 - DNA, 20 bp, human
gacccgcagggaggctcctg

SEQ ID NO: 118418 - DNA, 20 bp, human
ggttcccgcgaggacccgca

SEQ ID NO: 118419 - DNA, 20 bp, human
ggctccgggcccgagctcag

SEQ ID NO: 118420 - DNA, 20 bp, human
gaggtccaggaaaaagcccg

SEQ ID NO: 118421 - DNA, 20 bp, human
gcggcacgtgcggctcctca

SEQ ID NO: 118422 - DNA, 20 bp, human
gcccggggcttcgtacacac

SEQ ID NO: 118423 - DNA, 20 bp, human
ggccctgcggcccgacctgg

SEQ ID NO: 118424 - DNA, 20 bp, human
ggggctcggccggaagcgga

SEQ ID NO: 118425 - DNA, 20 bp, human
gcggagggggcgtcggtcag

SEQ ID NO: 118426 - DNA, 20 bp, human
gtggcgtggaacccgagtcc

SEQ ID NO: 118427 - DNA, 20 bp, human
ggagccggagcatggaacct

SEQ ID NO: 118428 - DNA, 20 bp, human
ggcaggcggcggcgtagacg

SEQ ID NO: 118429 - DNA, 20 bp, human
ggctccccggcggcccgagt

SEQ ID NO: 118430 - DNA, 20 bp, human
gctgcccaggttccatgctc

SEQ ID NO: 118431 - DNA, 20 bp, human
gagcagcggcagcgacacac

SEQ ID NO: 118432 - DNA, 20 bp, human
ggacacacgggcgaccgaga

SEQ ID NO: 118433 - DNA, 20 bp, human
ggcaatgcacgggtatgcgg

SEQ ID NO: 118434 - DNA, 20 bp, human
gcgtagacgcggaggtggct

SEQ ID NO: 118435 - DNA, 20 bp, human
ggcgagtcccggcgagggaa

SEQ ID NO: 118436 - DNA, 20 bp, human
gtagtaaaaggtaaaaacag

SEQ ID NO: 118437 - DNA, 20 bp, human
gtgcaaagctagactgagca

SEQ ID NO: 118438 - DNA, 20 bp, human
gctcatatgttagtagtaaa

SEQ ID NO: 118439 - DNA, 20 bp, human
gcattgcagagcctttgcag

SEQ ID NO: 118440 - DNA, 20 bp, human
ggtctattgtctttcctact

SEQ ID NO: 118441 - DNA, 20 bp, human
gccatcatttgcctctgcaa

SEQ ID NO: 118442 - DNA, 20 bp, human
ggctgtctttgaagaatgca

SEQ ID NO: 118443 - DNA, 20 bp, human
gtgtcttagaatcttgccat

SEQ ID NO: 118444 - DNA, 20 bp, human
gaatttcagataatggcttc

SEQ ID NO: 118445 - DNA, 20 bp, human
gcaagggaagtgacaggaaa

SEQ ID NO: 118446 - DNA, 20 bp, human
gtagtaaaaggtaaaaacag

SEQ ID NO: 118447 - DNA, 20 bp, human
gtgcaaagctagactgagca

SEQ ID NO: 118448 - DNA, 20 bp, human
gctcatatgttagtagtaaa

SEQ ID NO: 118449 - DNA, 20 bp, human
gcattgcagagcctttgcag

SEQ ID NO: 118450 - DNA, 20 bp, human
ggtctattgtctttcctact

SEQ ID NO: 118451 - DNA, 20 bp, human
gccatcatttgcctctgcaa

SEQ ID NO: 118452 - DNA, 20 bp, human
ggctgtctttgaagaatgca

SEQ ID NO: 118453 - DNA, 20 bp, human
gtgtcttagaatcttgccat

SEQ ID NO: 118454 - DNA, 20 bp, human
gaatttcagataatggcttc

SEQ ID NO: 118455 - DNA, 20 bp, human
gcaagggaagtgacaggaaa

SEQ ID NO: 118456 - DNA, 20 bp, human
gcggggcccgccgcactcac

SEQ ID NO: 118457 - DNA, 20 bp, human
gttgcgcgctgggattgttg

SEQ ID NO: 118458 - DNA, 20 bp, human
ggcgcgcgttgaggcggctg

SEQ ID NO: 118459 - DNA, 20 bp, human
gggcgaacggccgcgctggg

SEQ ID NO: 118460 - DNA, 20 bp, human
gtgttgcggtgcgctggagc

SEQ ID NO: 118461 - DNA, 20 bp, human
gggccgaacacgcgacccca

SEQ ID NO: 118462 - DNA, 20 bp, human
gcggtgcggcccccgcccca

SEQ ID NO: 118463 - DNA, 20 bp, human
gcggggtcccagcgagccgg

SEQ ID NO: 118464 - DNA, 20 bp, human
gacgtgggccggaggcgtcg

SEQ ID NO: 118465 - DNA, 20 bp, human
gccccaaggcccctctcctt

SEQ ID NO: 118466 - DNA, 20 bp, human
ggaaacctaacaaagaccac

SEQ ID NO: 118467 - DNA, 20 bp, human
gcccgcgtgcggccactccg

SEQ ID NO: 118468 - DNA, 20 bp, human
gccgaacagcggcccagcac

SEQ ID NO: 118469 - DNA, 20 bp, human
gccccgtcgcgaccgaacag

SEQ ID NO: 118470 - DNA, 20 bp, human
gaaagaccacgggcagccaa

SEQ ID NO: 118471 - DNA, 20 bp, human
ggcgcgcccagagcacgcga

SEQ ID NO: 118472 - DNA, 20 bp, human
ggctgcccgtggtctttgtt

SEQ ID NO: 118473 - DNA, 20 bp, human
gcccagagcacgcgaggggc

SEQ ID NO: 118474 - DNA, 20 bp, human
gccagcctgacaggcgacgc

SEQ ID NO: 118475 - DNA, 20 bp, human
ggtttccgtttgaaggaaca

SEQ ID NO: 118476 - DNA, 20 bp, human
ggctcgtccggttaccttca

SEQ ID NO: 118477 - DNA, 20 bp, human
ggattaggaacagttattat

SEQ ID NO: 118478 - DNA, 20 bp, human
ggctttgtgttactaggatt

SEQ ID NO: 118479 - DNA, 20 bp, human
gtttgctggtgtagctcgtc

SEQ ID NO: 118480 - DNA, 20 bp, human
gcctggaaagagacttctga

SEQ ID NO: 118481 - DNA, 20 bp, human
gcctagtaacacaaagcttg

SEQ ID NO: 118482 - DNA, 20 bp, human
gatattagtacttctcagac

SEQ ID NO: 118483 - DNA, 20 bp, human
gagtctctttccaggttgag

SEQ ID NO: 118484 - DNA, 20 bp, human
gagagtgtttcccctcaacc

SEQ ID NO: 118485 - DNA, 20 bp, human
gaacactctaagattcaatt

SEQ ID NO: 118486 - DNA, 20 bp, human
ggaccaggcctcgaacggga

SEQ ID NO: 118487 - DNA, 20 bp, human
gcgccgaccaggcctcgaac

SEQ ID NO: 118488 - DNA, 20 bp, human
ggcctcgaacgggatggcag

SEQ ID NO: 118489 - DNA, 20 bp, human
gggcgggtgcaggagatcgt

SEQ ID NO: 118490 - DNA, 20 bp, human
gcaaagcgggaaggcccaat

SEQ ID NO: 118491 - DNA, 20 bp, human
gtgaggagggaggaagcgtc

SEQ ID NO: 118492 - DNA, 20 bp, human
gccggttacaggtacctctg

SEQ ID NO: 118493 - DNA, 20 bp, human
gggtccgcggcagagcaaag

SEQ ID NO: 118494 - DNA, 20 bp, human
ggtcccgcgagccgccgacc

SEQ ID NO: 118495 - DNA, 20 bp, human
gagggaggaagcgtccggag

SEQ ID NO: 118496 - DNA, 20 bp, human
gggagcgcctcggccgcgaa

SEQ ID NO: 118497 - DNA, 20 bp, human
gcgcgaagggtgcaaggagc

SEQ ID NO: 118498 - DNA, 20 bp, human
ggacgctgcgggacaggacc

SEQ ID NO: 118499 - DNA, 20 bp, human
ggagggatagggaagaacga

SEQ ID NO: 118500 - DNA, 20 bp, human
gctgcgcgcaacctccatgg

SEQ ID NO: 118501 - DNA, 20 bp, human
gcgcagagcgcggcctccag

SEQ ID NO: 118502 - DNA, 20 bp, human
gggctgcgcggggagcacca

SEQ ID NO: 118503 - DNA, 20 bp, human
ggctaatgttgagagggata

SEQ ID NO: 118504 - DNA, 20 bp, human
gcgccgttgcccaaacctgg

SEQ ID NO: 118505 - DNA, 20 bp, human
ggggcaaactgcgcaagacc

SEQ ID NO: 118506 - DNA, 20 bp, human
gtggcgggcgcgcagtcgga

SEQ ID NO: 118507 - DNA, 20 bp, human
ggagcacgaggccaccgtgg

SEQ ID NO: 118508 - DNA, 20 bp, human
gccgcccaggcacccaccag

SEQ ID NO: 118509 - DNA, 20 bp, human
gccggaggagcggcaccctg

SEQ ID NO: 118510 - DNA, 20 bp, human
gcgggcgcgcagtcggaggg

SEQ ID NO: 118511 - DNA, 20 bp, human
ggaggagcacgaggccaccg

SEQ ID NO: 118512 - DNA, 20 bp, human
ggtccacgcggaagacaccc

SEQ ID NO: 118513 - DNA, 20 bp, human
ggactgcgcgcccgccacgg

SEQ ID NO: 118514 - DNA, 20 bp, human
gggccctggcgagccccact

SEQ ID NO: 118515 - DNA, 20 bp, human
gccggagcgcaagggccggg

SEQ ID NO: 118516 - DNA, 20 bp, human
gctcccggtagcgctcccac

SEQ ID NO: 118517 - DNA, 20 bp, human
gggcagcagcagtcgcagag

SEQ ID NO: 118518 - DNA, 20 bp, human
gcagagcgcgggtagatctt

SEQ ID NO: 118519 - DNA, 20 bp, human
ggcccagctgcggacctcca

SEQ ID NO: 118520 - DNA, 20 bp, human
gtcgcgactggaggccctgg

SEQ ID NO: 118521 - DNA, 20 bp, human
ggacatgaagcgctacctgt

SEQ ID NO: 118522 - DNA, 20 bp, human
gtcccgggtgcagtgcacaa

SEQ ID NO: 118523 - DNA, 20 bp, human
gcctgcgtcggaacacgtgg

SEQ ID NO: 118524 - DNA, 20 bp, human
gtgggctggtccgggtccta

SEQ ID NO: 118525 - DNA, 20 bp, human
ggcagtgcacaagggccggg

SEQ ID NO: 118526 - DNA, 20 bp, human
gcaagtcctccgctgggcca

SEQ ID NO: 118527 - DNA, 20 bp, human
gagactgtcctggcactcgg

SEQ ID NO: 118528 - DNA, 20 bp, human
gcccagcccggcacccccac

SEQ ID NO: 118529 - DNA, 20 bp, human
gggtgtgcaagtcctccgct

SEQ ID NO: 118530 - DNA, 20 bp, human
gtctccttagaccccagcag

SEQ ID NO: 118531 - DNA, 20 bp, human
gggtgtgtgcatgcgtgcga

SEQ ID NO: 118532 - DNA, 20 bp, human
ggtgttatgcacacagctca

SEQ ID NO: 118533 - DNA, 20 bp, human
gaccgtgcgggcatccagtg

SEQ ID NO: 118534 - DNA, 20 bp, human
gcgctctgaaaagccaccag

SEQ ID NO: 118535 - DNA, 20 bp, human
gtgagactctgcccagactg

SEQ ID NO: 118536 - DNA, 20 bp, human
gggcgagtgccggcgagtag

SEQ ID NO: 118537 - DNA, 20 bp, human
gtagctgtggcgcgtgaact

SEQ ID NO: 118538 - DNA, 20 bp, human
ggctcggggacacatagctg

SEQ ID NO: 118539 - DNA, 20 bp, human
ggctgctcgcccctactcgc

SEQ ID NO: 118540 - DNA, 20 bp, human
gacgccggcgaccagtacca

SEQ ID NO: 118541 - DNA, 20 bp, human
gagccgggctggaaaagcag

SEQ ID NO: 118542 - DNA, 20 bp, human
ggtgaactgggtgcgaaagc

SEQ ID NO: 118543 - DNA, 20 bp, human
gcagggcgcggagagatgtg

SEQ ID NO: 118544 - DNA, 20 bp, human
ggcgcccgggatagtagtcc

SEQ ID NO: 118545 - DNA, 20 bp, human
gagtccgggactactatccc

SEQ ID NO: 118546 - DNA, 20 bp, human
gggagaagcccccaacgctg

SEQ ID NO: 118547 - DNA, 20 bp, human
gcggcgcgcgcggtccctaa

SEQ ID NO: 118548 - DNA, 20 bp, human
gggtcctccagcgcgatgaa

SEQ ID NO: 118549 - DNA, 20 bp, human
gtctgggtgtcggagcagta

SEQ ID NO: 118550 - DNA, 20 bp, human
gggtgcgggcgcgcaagtac

SEQ ID NO: 118551 - DNA, 20 bp, human
ggcgtgctggctgacttcga

SEQ ID NO: 118552 - DNA, 20 bp, human
gaagtaccggccccagagcg

SEQ ID NO: 118553 - DNA, 20 bp, human
gggagcagtacggccgcctg

SEQ ID NO: 118554 - DNA, 20 bp, human
gagcgcgctgggccatgatc

SEQ ID NO: 118555 - DNA, 20 bp, human
gcagcgcgctggcccgtcgt

SEQ ID NO: 118556 - DNA, 20 bp, human
ggccgcccctcgacgagcag

SEQ ID NO: 118557 - DNA, 20 bp, human
gggcggctgcagcccccata

SEQ ID NO: 118558 - DNA, 20 bp, human
gggacccccattccccgacg

SEQ ID NO: 118559 - DNA, 20 bp, human
gccgccccgtcggggaatgg

SEQ ID NO: 118560 - DNA, 20 bp, human
gtgtcagagagtggcctccg

SEQ ID NO: 118561 - DNA, 20 bp, human
gcccggggctgcaaagcggg

SEQ ID NO: 118562 - DNA, 20 bp, human
ggatgccgctgctcgtcgag

SEQ ID NO: 118563 - DNA, 20 bp, human
gagcagcggcatcgcggagg

SEQ ID NO: 118564 - DNA, 20 bp, human
gcgcagtgctgtgcgacctt

SEQ ID NO: 118565 - DNA, 20 bp, human
ggccgctgctcgtcgagggg

SEQ ID NO: 118566 - DNA, 20 bp, human
gggagctgttcggaagggag

SEQ ID NO: 118567 - DNA, 20 bp, human
gtgcgcggagctgttcggaa

SEQ ID NO: 118568 - DNA, 20 bp, human
gggcggtgcgcggagctgtt

SEQ ID NO: 118569 - DNA, 20 bp, human
gccgccgcctccccttaccg

SEQ ID NO: 118570 - DNA, 20 bp, human
gccgcgcagattctgttcac

SEQ ID NO: 118571 - DNA, 20 bp, human
gcgcagccactacccagcag

SEQ ID NO: 118572 - DNA, 20 bp, human
ggacgtcgacatgaagagaa

SEQ ID NO: 118573 - DNA, 20 bp, human
gcttttgccacggtaagggg

SEQ ID NO: 118574 - DNA, 20 bp, human
gagtgagcgcggcgcgatgg

SEQ ID NO: 118575 - DNA, 20 bp, human
gttgccacggtaaggggagg

SEQ ID NO: 118576 - DNA, 20 bp, human
gggagggggcaaccacctag

SEQ ID NO: 118577 - DNA, 20 bp, human
gcctgagatgtcaggaagga

SEQ ID NO: 118578 - DNA, 20 bp, human
gcttcggggggcccctgtgg

SEQ ID NO: 118579 - DNA, 20 bp, human
gtgggagtccccaggcttcg

SEQ ID NO: 118580 - DNA, 20 bp, human
gaggggccccccgaagcctg

SEQ ID NO: 118581 - DNA, 20 bp, human
gccccagagctccgaggcgg

SEQ ID NO: 118582 - DNA, 20 bp, human
gggggaagaaaagaatagac

SEQ ID NO: 118583 - DNA, 20 bp, human
ggttctgggaaagggtggcg

SEQ ID NO: 118584 - DNA, 20 bp, human
gggcagttttgaggtgaact

SEQ ID NO: 118585 - DNA, 20 bp, human
ggtcacaacctggaatccta

SEQ ID NO: 118586 - DNA, 20 bp, human
ggtgcctcctgtccactccc

SEQ ID NO: 118587 - DNA, 20 bp, human
gggagagaaggtcccactca

SEQ ID NO: 118588 - DNA, 20 bp, human
gtgcaaggctgataacgctg

SEQ ID NO: 118589 - DNA, 20 bp, human
gctagacaggactactcggg

SEQ ID NO: 118590 - DNA, 20 bp, human
gccactcaggggccagaaaa

SEQ ID NO: 118591 - DNA, 20 bp, human
gctgtgtgcgatgcagtcag

SEQ ID NO: 118592 - DNA, 20 bp, human
gctgataacgctgaggaagg

SEQ ID NO: 118593 - DNA, 20 bp, human
ggtgggggttgggactcaat

SEQ ID NO: 118594 - DNA, 20 bp, human
ggcgggtttcaaagaagtac

SEQ ID NO: 118595 - DNA, 20 bp, human
gcgcccacgcaagtccacag

SEQ ID NO: 118596 - DNA, 20 bp, human
ggggcctctccggagaagag

SEQ ID NO: 118597 - DNA, 20 bp, human
ggcccccagcaggtcctcaa

SEQ ID NO: 118598 - DNA, 20 bp, human
gagcctggagtggagagtcc

SEQ ID NO: 118599 - DNA, 20 bp, human
gagagtcccggacagagtgg

SEQ ID NO: 118600 - DNA, 20 bp, human
gagcatcctcgcgctcaagg

SEQ ID NO: 118601 - DNA, 20 bp, human
gcggtcatgccggactcctg

SEQ ID NO: 118602 - DNA, 20 bp, human
ggctcctccctacacccccg

SEQ ID NO: 118603 - DNA, 20 bp, human
ggctgggccgcgggggtgta

SEQ ID NO: 118604 - DNA, 20 bp, human
gtcttgcttggggcgaaagg

SEQ ID NO: 118605 - DNA, 20 bp, human
gggaacgcagggccgcacgt

SEQ ID NO: 118606 - DNA, 20 bp, human
gcccagcggcagttcagaca

SEQ ID NO: 118607 - DNA, 20 bp, human
gccgaggaagttgaccgagg

SEQ ID NO: 118608 - DNA, 20 bp, human
gcacggaggacggccaaagg

SEQ ID NO: 118609 - DNA, 20 bp, human
ggcggctgccgcaggatccc

SEQ ID NO: 118610 - DNA, 20 bp, human
gtcctcggccaccttcccgg

SEQ ID NO: 118611 - DNA, 20 bp, human
gtaccagaaggggacggggt

SEQ ID NO: 118612 - DNA, 20 bp, human
gcagacacggcactttggag

SEQ ID NO: 118613 - DNA, 20 bp, human
gccggcggaagcagcgagga

SEQ ID NO: 118614 - DNA, 20 bp, human
gccgaggctggcaaaagccg

SEQ ID NO: 118615 - DNA, 20 bp, human
gtcatccagctacccagagg

SEQ ID NO: 118616 - DNA, 20 bp, human
gagggcgccgaaacagttag

SEQ ID NO: 118617 - DNA, 20 bp, human
gtcgtggtctggcggagctg

SEQ ID NO: 118618 - DNA, 20 bp, human
gggactacggagcagtccat

SEQ ID NO: 118619 - DNA, 20 bp, human
gcggacctgggcagggacta

SEQ ID NO: 118620 - DNA, 20 bp, human
ggcgtctggtcgtggtctgg

SEQ ID NO: 118621 - DNA, 20 bp, human
ggagctgtcgcgtctggtcg

SEQ ID NO: 118622 - DNA, 20 bp, human
gccgagcgccagcccgacac

SEQ ID NO: 118623 - DNA, 20 bp, human
gtgctgcggtctggggaccg

SEQ ID NO: 118624 - DNA, 20 bp, human
gtcccatccatcctccaagt

SEQ ID NO: 118625 - DNA, 20 bp, human
gtacggagcagtccatgggt

SEQ ID NO: 118626 - DNA, 20 bp, human
gggcatctgagagggacccc

SEQ ID NO: 118627 - DNA, 20 bp, human
gcccgggctgcgagacgaag

SEQ ID NO: 118628 - DNA, 20 bp, human
ggcggcggcggagccttcgg

SEQ ID NO: 118629 - DNA, 20 bp, human
gcactcgcgctgggagtgag

SEQ ID NO: 118630 - DNA, 20 bp, human
gcggcggggacgcgatcggg

SEQ ID NO: 118631 - DNA, 20 bp, human
gcagcgagcgagaggctctc

SEQ ID NO: 118632 - DNA, 20 bp, human
ggtcactcgggcgagagagg

SEQ ID NO: 118633 - DNA, 20 bp, human
gcgcgggccgtgcagagtcg

SEQ ID NO: 118634 - DNA, 20 bp, human
gggcggccgcgtagtcactc

SEQ ID NO: 118635 - DNA, 20 bp, human
gctcccagcgcgagtggcgg

SEQ ID NO: 118636 - DNA, 20 bp, human
ggccggcggcccaggactca

SEQ ID NO: 118637 - DNA, 20 bp, human
ggccactggctgacccgcag

SEQ ID NO: 118638 - DNA, 20 bp, human
ggccgctgcgggtcagccag

SEQ ID NO: 118639 - DNA, 20 bp, human
gtcgctctaggcccagcggg

SEQ ID NO: 118640 - DNA, 20 bp, human
gctcctcccggctgcagcga

SEQ ID NO: 118641 - DNA, 20 bp, human
gctgggcctagagcgatgac

SEQ ID NO: 118642 - DNA, 20 bp, human
gagcacagcagcggggatgt

SEQ ID NO: 118643 - DNA, 20 bp, human
ggggcgcacccccctcatcg

SEQ ID NO: 118644 - DNA, 20 bp, human
gtcggcattgcgggcctggt

SEQ ID NO: 118645 - DNA, 20 bp, human
gggcggggcctgcggtgcac

SEQ ID NO: 118646 - DNA, 20 bp, human
gggagggagccgagacctct

SEQ ID NO: 118647 - DNA, 20 bp, human
gcggggcagccagaagaggt

SEQ ID NO: 118648 - DNA, 20 bp, human
ggaagaggtgggaaaagcgg

SEQ ID NO: 118649 - DNA, 20 bp, human
gaactgcccgtggagaagga

SEQ ID NO: 118650 - DNA, 20 bp, human
ggcggcggccgggaagtgaa

SEQ ID NO: 118651 - DNA, 20 bp, human
gtcccgcagcccagaggtct

SEQ ID NO: 118652 - DNA, 20 bp, human
gccgtcccgtccttctccac

SEQ ID NO: 118653 - DNA, 20 bp, human
gagcgccgccgtcctcggga

SEQ ID NO: 118654 - DNA, 20 bp, human
ggcagctccccatggccggg

SEQ ID NO: 118655 - DNA, 20 bp, human
gaaagcggaggaggacgccc

SEQ ID NO: 118656 - DNA, 20 bp, human
ggcgcggtgggctctcagga

SEQ ID NO: 118657 - DNA, 20 bp, human
gctcccctggcccagatgac

SEQ ID NO: 118658 - DNA, 20 bp, human
gggcgccaggctccttggga

SEQ ID NO: 118659 - DNA, 20 bp, human
gggatcccccaggaacacta

SEQ ID NO: 118660 - DNA, 20 bp, human
gccaccgcgccacagcttgg

SEQ ID NO: 118661 - DNA, 20 bp, human
gcattttgcacccactcagg

SEQ ID NO: 118662 - DNA, 20 bp, human
gagccctgaggccccgacat

SEQ ID NO: 118663 - DNA, 20 bp, human
gtgtggcgcggtgggctctc

SEQ ID NO: 118664 - DNA, 20 bp, human
gggcctgtcatctgggccag

SEQ ID NO: 118665 - DNA, 20 bp, human
gaaatggcgccaggctcctt

SEQ ID NO: 118666 - DNA, 20 bp, human
ggcgccccgaggtcgtggag

SEQ ID NO: 118667 - DNA, 20 bp, human
gacagcaacagcgagcggga

SEQ ID NO: 118668 - DNA, 20 bp, human
gcgagagccggaaagaggag

SEQ ID NO: 118669 - DNA, 20 bp, human
gcaggtctcgaggtagtata

SEQ ID NO: 118670 - DNA, 20 bp, human
ggagacctgtgcgctccgag

SEQ ID NO: 118671 - DNA, 20 bp, human
ggagctcctggcaaacttag

SEQ ID NO: 118672 - DNA, 20 bp, human
ggagcgcgagagccggaaag

SEQ ID NO: 118673 - DNA, 20 bp, human
gagcaacagcaacagcgagc

SEQ ID NO: 118674 - DNA, 20 bp, human
gcagcgagcgggacggagtt

SEQ ID NO: 118675 - DNA, 20 bp, human
ggaatgcgcgaaggaaaccc

SEQ ID NO: 118676 - DNA, 20 bp, human
ggccctacgcgcacacacag

SEQ ID NO: 118677 - DNA, 20 bp, human
ggggcgcgatcggaatcccc

SEQ ID NO: 118678 - DNA, 20 bp, human
gccggcgggagaggaccccg

SEQ ID NO: 118679 - DNA, 20 bp, human
gtccgcgcgctgcctcctcg

SEQ ID NO: 118680 - DNA, 20 bp, human
gctgcgatgcacaggcggga

SEQ ID NO: 118681 - DNA, 20 bp, human
ggctcgggtcgcagtaggag

SEQ ID NO: 118682 - DNA, 20 bp, human
gcagcctggtccgcctcggg

SEQ ID NO: 118683 - DNA, 20 bp, human
gtttgtaaagcgccccgagg

SEQ ID NO: 118684 - DNA, 20 bp, human
gctgtgcatcgcagcgggtg

SEQ ID NO: 118685 - DNA, 20 bp, human
gggaggcgaaggtaattaag

SEQ ID NO: 118686 - DNA, 20 bp, human
gcgatggtgatcgtgagtga

SEQ ID NO: 118687 - DNA, 20 bp, human
ggcgctgcgcctcccccctc

SEQ ID NO: 118688 - DNA, 20 bp, human
gcgcggcgcgggccagatgg

SEQ ID NO: 118689 - DNA, 20 bp, human
gaacttggagcggagtgcag

SEQ ID NO: 118690 - DNA, 20 bp, human
gcctcggcattaacttggag

SEQ ID NO: 118691 - DNA, 20 bp, human
ggccgaggaccgccaccctc

SEQ ID NO: 118692 - DNA, 20 bp, human
gccggcgcggagacctggga

SEQ ID NO: 118693 - DNA, 20 bp, human
gcctggccccgatctgacgg

SEQ ID NO: 118694 - DNA, 20 bp, human
ggccttaccccggctcggag

SEQ ID NO: 118695 - DNA, 20 bp, human
gtcctccccgggccgcccag

SEQ ID NO: 118696 - DNA, 20 bp, human
gcaggggagcagtccaggtt

SEQ ID NO: 118697 - DNA, 20 bp, human
gcgtgccgggccatactggt

SEQ ID NO: 118698 - DNA, 20 bp, human
gctgagtcgcgaccctggtc

SEQ ID NO: 118699 - DNA, 20 bp, human
gttcaggtcaggtccggacc

SEQ ID NO: 118700 - DNA, 20 bp, human
gcggcaaccgcgatgtgaag

SEQ ID NO: 118701 - DNA, 20 bp, human
gccgctgccgctggcccctg

SEQ ID NO: 118702 - DNA, 20 bp, human
gggggcctgcgacacgcggt

SEQ ID NO: 118703 - DNA, 20 bp, human
ggggtaggggttgcggtcag

SEQ ID NO: 118704 - DNA, 20 bp, human
ggggcggggcctgcgacacg

SEQ ID NO: 118705 - DNA, 20 bp, human
gaacacgtgccgggccatac

SEQ ID NO: 118706 - DNA, 20 bp, human
gcggctgcggaggaacgccc

SEQ ID NO: 118707 - DNA, 20 bp, human
gcgcccgcctcgctcaggcg

SEQ ID NO: 118708 - DNA, 20 bp, human
gccagctgccctgaacacta

SEQ ID NO: 118709 - DNA, 20 bp, human
gcagtcccgaggagccgtgg

SEQ ID NO: 118710 - DNA, 20 bp, human
gctgccccgcctgagcgagg

SEQ ID NO: 118711 - DNA, 20 bp, human
gcgtccgcctcgcagcatcg

SEQ ID NO: 118712 - DNA, 20 bp, human
gcgcccagcgcacatgtcgg

SEQ ID NO: 118713 - DNA, 20 bp, human
gcggctgccccgcctgagcg

SEQ ID NO: 118714 - DNA, 20 bp, human
gctatccagggccccatccc

SEQ ID NO: 118715 - DNA, 20 bp, human
gccgccgcgatgctgcgagg

SEQ ID NO: 118716 - DNA, 20 bp, human
ggagagagtgggcacactgg

SEQ ID NO: 118717 - DNA, 20 bp, human
ggctctacgcgctcagtccc

SEQ ID NO: 118718 - DNA, 20 bp, human
gcaggctcctgctaccgccg

SEQ ID NO: 118719 - DNA, 20 bp, human
gctcaggctcgaagagagag

SEQ ID NO: 118720 - DNA, 20 bp, human
gccgcgccaccggcacccag

SEQ ID NO: 118721 - DNA, 20 bp, human
gtgagggccgaggcgaccga

SEQ ID NO: 118722 - DNA, 20 bp, human
ggaccccagcccggagactg

SEQ ID NO: 118723 - DNA, 20 bp, human
ggcggctcccggaattgggt

SEQ ID NO: 118724 - DNA, 20 bp, human
ggtagcaggagcctggaccc

SEQ ID NO: 118725 - DNA, 20 bp, human
ggcgcggcacgtcccacctg

SEQ ID NO: 118726 - DNA, 20 bp, human
gccgcgcggcgagccattcg

SEQ ID NO: 118727 - DNA, 20 bp, human
gcgcggcgagccattcgcgg

SEQ ID NO: 118728 - DNA, 20 bp, human
gagggttgcaacagacggtg

SEQ ID NO: 118729 - DNA, 20 bp, human
ggctgactcgccgggtccgg

SEQ ID NO: 118730 - DNA, 20 bp, human
gtgatcgctcggcgtttcaa

SEQ ID NO: 118731 - DNA, 20 bp, human
gaaggaaacaaagacggcga

SEQ ID NO: 118732 - DNA, 20 bp, human
gagccgcgaggagcgcctag

SEQ ID NO: 118733 - DNA, 20 bp, human
gaaacaaagacggcgaggga

SEQ ID NO: 118734 - DNA, 20 bp, human
gtcagcgtctgaaaccatcg

SEQ ID NO: 118735 - DNA, 20 bp, human
gtcaccaagtcccacctact

SEQ ID NO: 118736 - DNA, 20 bp, human
gcactttcaaagccagctga

SEQ ID NO: 118737 - DNA, 20 bp, human
gagtcagaagcacactgaag

SEQ ID NO: 118738 - DNA, 20 bp, human
gagttgttgaattccaaagg

SEQ ID NO: 118739 - DNA, 20 bp, human
gaaagtgagtgaactatgag

SEQ ID NO: 118740 - DNA, 20 bp, human
gtctagttgttgaattccaa

SEQ ID NO: 118741 - DNA, 20 bp, human
gcatctctcagtaatcataa

SEQ ID NO: 118742 - DNA, 20 bp, human
gacggacttggcttgttaga

SEQ ID NO: 118743 - DNA, 20 bp, human
gaacactgcacgacctcctt

SEQ ID NO: 118744 - DNA, 20 bp, human
gaaatctgcaaagcaataaa

SEQ ID NO: 118745 - DNA, 20 bp, human
gtgaactatgagaggtgctc

SEQ ID NO: 118746 - DNA, 20 bp, human
gggctgggcgctgtcctcgg

SEQ ID NO: 118747 - DNA, 20 bp, human
gggccgccgaccccttccag

SEQ ID NO: 118748 - DNA, 20 bp, human
gcgcgcggtttggagatcgg

SEQ ID NO: 118749 - DNA, 20 bp, human
gggcgcgtggcgaagaccag

SEQ ID NO: 118750 - DNA, 20 bp, human
gccgatgaacgggagcccag

SEQ ID NO: 118751 - DNA, 20 bp, human
ggcagtgcgtgcgctcctcc

SEQ ID NO: 118752 - DNA, 20 bp, human
ggcgcaggccggactggagg

SEQ ID NO: 118753 - DNA, 20 bp, human
gagctgttgaggcgcatggt

SEQ ID NO: 118754 - DNA, 20 bp, human
gcagcgggcgcaggccggac

SEQ ID NO: 118755 - DNA, 20 bp, human
gtggtgggcgctggagtccg

SEQ ID NO: 118756 - DNA, 20 bp, human
gcagactccgggcagtgaga

SEQ ID NO: 118757 - DNA, 20 bp, human
gctccgggcagtgagaggga

SEQ ID NO: 118758 - DNA, 20 bp, human
gggcagctcgcccagactcc

SEQ ID NO: 118759 - DNA, 20 bp, human
ggagctgtgcgcctacgcca

SEQ ID NO: 118760 - DNA, 20 bp, human
ggaggaggtgctcactaacc

SEQ ID NO: 118761 - DNA, 20 bp, human
gccaggtcgccgaagaccca

SEQ ID NO: 118762 - DNA, 20 bp, human
ggcgctctacgcactcatct

SEQ ID NO: 118763 - DNA, 20 bp, human
ggtgtggttccactacccct

SEQ ID NO: 118764 - DNA, 20 bp, human
gcacgtggtgctgaaggcgc

SEQ ID NO: 118765 - DNA, 20 bp, human
gggagctctacagcttcgtg

SEQ ID NO: 118766 - DNA, 20 bp, human
gggtctcctgcagctcgtag

SEQ ID NO: 118767 - DNA, 20 bp, human
gcggcgagctgtggagcgtc

SEQ ID NO: 118768 - DNA, 20 bp, human
gtgtggagcgtcgggcgagg

SEQ ID NO: 118769 - DNA, 20 bp, human
gggcgaccttgagcgtacag

SEQ ID NO: 118770 - DNA, 20 bp, human
ggggcgagccgggctacaga

SEQ ID NO: 118771 - DNA, 20 bp, human
gggagcccaggaagccgcac

SEQ ID NO: 118772 - DNA, 20 bp, human
ggcgccgggctctccccgag

SEQ ID NO: 118773 - DNA, 20 bp, human
gggcacagcgctgggatgtc

SEQ ID NO: 118774 - DNA, 20 bp, human
gagctgtggagcgtcgggcg

SEQ ID NO: 118775 - DNA, 20 bp, human
gatgtcggggtccccaccga

SEQ ID NO: 118776 - DNA, 20 bp, human
gcaggtcccgcaccaggacg

SEQ ID NO: 118777 - DNA, 20 bp, human
ggggcggcaggggaatcagt

SEQ ID NO: 118778 - DNA, 20 bp, human
gaggtgagcaagggcggcag

SEQ ID NO: 118779 - DNA, 20 bp, human
gtgagtgcggctccctctcg

SEQ ID NO: 118780 - DNA, 20 bp, human
gggccgccggcagggagcgg

SEQ ID NO: 118781 - DNA, 20 bp, human
ggtggctccccgtcctggtg

SEQ ID NO: 118782 - DNA, 20 bp, human
gggtctccaggaactcgtag

SEQ ID NO: 118783 - DNA, 20 bp, human
gccaccacaagcacaacctg

SEQ ID NO: 118784 - DNA, 20 bp, human
gggaatcagtaggctgtgcg

SEQ ID NO: 118785 - DNA, 20 bp, human
gtcagtaggctgtgcgggga

SEQ ID NO: 118786 - DNA, 20 bp, human
gccagcagagtgcccggatg

SEQ ID NO: 118787 - DNA, 20 bp, human
ggagtgcccggatgcggcag

SEQ ID NO: 118788 - DNA, 20 bp, human
ggagtggcgtggcgcaggtg

SEQ ID NO: 118789 - DNA, 20 bp, human
gccagtcggaccgggaaccg

SEQ ID NO: 118790 - DNA, 20 bp, human
gggcgcgaaggcgacagcgg

SEQ ID NO: 118791 - DNA, 20 bp, human
gccggaatgaaaacaaacgg

SEQ ID NO: 118792 - DNA, 20 bp, human
gtgatagaatcaggtcgtca

SEQ ID NO: 118793 - DNA, 20 bp, human
gtaactcagggcaaaccaaa

SEQ ID NO: 118794 - DNA, 20 bp, human
ggcactctgctggtcgcggc

SEQ ID NO: 118795 - DNA, 20 bp, human
gcaaaccaaagggccccgaa

SEQ ID NO: 118796 - DNA, 20 bp, human
gcgggttccggtgaccacga

SEQ ID NO: 118797 - DNA, 20 bp, human
gcctccgcgagcttaccgtg

SEQ ID NO: 118798 - DNA, 20 bp, human
gggcaaaggcgacggaatgg

SEQ ID NO: 118799 - DNA, 20 bp, human
ggtgcctcacggtaagctcg

SEQ ID NO: 118800 - DNA, 20 bp, human
gaaaggcgacggaatggagg

SEQ ID NO: 118801 - DNA, 20 bp, human
gccggacacgggtgagaaaa

SEQ ID NO: 118802 - DNA, 20 bp, human
gggggcggggcgtggaaagt

SEQ ID NO: 118803 - DNA, 20 bp, human
gacgaaggcggcaaaggcga

SEQ ID NO: 118804 - DNA, 20 bp, human
gatggagggtggagactgac

SEQ ID NO: 118805 - DNA, 20 bp, human
gcaggaacgaggcctttaga

SEQ ID NO: 118806 - DNA, 20 bp, human
gcgccgcctccaggagctcg

SEQ ID NO: 118807 - DNA, 20 bp, human
ggtgggccccgctatcctgg

SEQ ID NO: 118808 - DNA, 20 bp, human
gtgagtggcgggccagggtg

SEQ ID NO: 118809 - DNA, 20 bp, human
ggacggcccgcgggcgtaag

SEQ ID NO: 118810 - DNA, 20 bp, human
gcccgctatcctggaggtcg

SEQ ID NO: 118811 - DNA, 20 bp, human
ggcctcccagctagagcgaa

SEQ ID NO: 118812 - DNA, 20 bp, human
ggcacgcactgcccattggt

SEQ ID NO: 118813 - DNA, 20 bp, human
gaccgcgacctccaggatag

SEQ ID NO: 118814 - DNA, 20 bp, human
gaccggatcgagagctcctc

SEQ ID NO: 118815 - DNA, 20 bp, human
gaccgcgcccgcctacaacg

SEQ ID NO: 118816 - DNA, 20 bp, human
ggttccgcgtcatggggatt

SEQ ID NO: 118817 - DNA, 20 bp, human
gtgcagggccgcagatgccc

SEQ ID NO: 118818 - DNA, 20 bp, human
gctgggcctgcctgaaaagt

SEQ ID NO: 118819 - DNA, 20 bp, human
gctgccaaatccccatgacg

SEQ ID NO: 118820 - DNA, 20 bp, human
gctgcctctttacggagata

SEQ ID NO: 118821 - DNA, 20 bp, human
gcagcagcgttccgcgtcat

SEQ ID NO: 118822 - DNA, 20 bp, human
gaagcgggctgacagatgct

SEQ ID NO: 118823 - DNA, 20 bp, human
gaagccttatctccgtaaag

SEQ ID NO: 118824 - DNA, 20 bp, human
gtgtcgctccgggctggtgg

SEQ ID NO: 118825 - DNA, 20 bp, human
ggtggggtgtcgctccgggc

SEQ ID NO: 118826 - DNA, 20 bp, human
ggccctctgcggtgaaggag

SEQ ID NO: 118827 - DNA, 20 bp, human
gccctaggacccaagagtat

SEQ ID NO: 118828 - DNA, 20 bp, human
gccctggaaaacgccctctg

SEQ ID NO: 118829 - DNA, 20 bp, human
ggaactcctggttccagggg

SEQ ID NO: 118830 - DNA, 20 bp, human
gccagggttcccatactctt

SEQ ID NO: 118831 - DNA, 20 bp, human
gaagtgggcgtggtctaggg

SEQ ID NO: 118832 - DNA, 20 bp, human
gaaaacgccctctgcggtga

SEQ ID NO: 118833 - DNA, 20 bp, human
gacagaaggagggttcctcg

SEQ ID NO: 118834 - DNA, 20 bp, human
gggggcctctgtggataagt

SEQ ID NO: 118835 - DNA, 20 bp, human
gcatggcagtgtggtctgtg

SEQ ID NO: 118836 - DNA, 20 bp, human
gggtgtccctcctcactagt

SEQ ID NO: 118837 - DNA, 20 bp, human
gtgcgctggacgcaagcacc

SEQ ID NO: 118838 - DNA, 20 bp, human
ggccgagacccggccaggta

SEQ ID NO: 118839 - DNA, 20 bp, human
gagcctcgctcgccgagacc

SEQ ID NO: 118840 - DNA, 20 bp, human
gcagcgcggcgggagattag

SEQ ID NO: 118841 - DNA, 20 bp, human
gcgggcctagctttgctgag

SEQ ID NO: 118842 - DNA, 20 bp, human
gacccgaagggaccccgcca

SEQ ID NO: 118843 - DNA, 20 bp, human
gcgggtttgggcaggtcgat

SEQ ID NO: 118844 - DNA, 20 bp, human
gcgcggccaccggccttacc

SEQ ID NO: 118845 - DNA, 20 bp, human
ggagcatcgcctggaattgg

SEQ ID NO: 118846 - DNA, 20 bp, human
ggtgcgcgcgggccccgaaa

SEQ ID NO: 118847 - DNA, 20 bp, human
gcagggccccccacgctcaa

SEQ ID NO: 118848 - DNA, 20 bp, human
ggactccgcactgacctgac

SEQ ID NO: 118849 - DNA, 20 bp, human
gccccaccttcagcgaggag

SEQ ID NO: 118850 - DNA, 20 bp, human
ggccctgaaccaaagagcag

SEQ ID NO: 118851 - DNA, 20 bp, human
ggcgcacccttgagcgtggg

SEQ ID NO: 118852 - DNA, 20 bp, human
gtcggcagcagcggtcccat

SEQ ID NO: 118853 - DNA, 20 bp, human
ggcggcctgtcaggtcagtg

SEQ ID NO: 118854 - DNA, 20 bp, human
gcgcgcgggccccgaaaggg

SEQ ID NO: 118855 - DNA, 20 bp, human
gcgagtggtgaaaagagtgg

SEQ ID NO: 118856 - DNA, 20 bp, human
gccggctccgatccacgtcc

SEQ ID NO: 118857 - DNA, 20 bp, human
ggcggacgactagagtcgtt

SEQ ID NO: 118858 - DNA, 20 bp, human
gggcggcgtgcaggaggtaa

SEQ ID NO: 118859 - DNA, 20 bp, human
ggggcgcagtgagaatgtag

SEQ ID NO: 118860 - DNA, 20 bp, human
ggcaggagcgtagagagcgc

SEQ ID NO: 118861 - DNA, 20 bp, human
gagagctccgggacgtggat

SEQ ID NO: 118862 - DNA, 20 bp, human
gagtcgtccgccttccgcag

SEQ ID NO: 118863 - DNA, 20 bp, human
gagtgcagagctccgggacg

SEQ ID NO: 118864 - DNA, 20 bp, human
gccggctccgctgcggaagg

SEQ ID NO: 118865 - DNA, 20 bp, human
ggcgagccgtcgaatgtgtg

SEQ ID NO: 118866 - DNA, 20 bp, human
gagcgcggacctttcaacaa

SEQ ID NO: 118867 - DNA, 20 bp, human
gtcgcacagagactgggaag

SEQ ID NO: 118868 - DNA, 20 bp, human
gcacgcctcgcacagagact

SEQ ID NO: 118869 - DNA, 20 bp, human
gccagctggtaacaaggcag

SEQ ID NO: 118870 - DNA, 20 bp, human
gccctggaaagcgatggagg

SEQ ID NO: 118871 - DNA, 20 bp, human
ggcgcgaaggcggctcccac

SEQ ID NO: 118872 - DNA, 20 bp, human
gctgcggccctggaaagcga

SEQ ID NO: 118873 - DNA, 20 bp, human
gacctcagacctcagaggct

SEQ ID NO: 118874 - DNA, 20 bp, human
gggcttgcgtggactcacgg

SEQ ID NO: 118875 - DNA, 20 bp, human
gcaagctccagctggtaaca

SEQ ID NO: 118876 - DNA, 20 bp, human
gccgaggcgtagcctaagcg

SEQ ID NO: 118877 - DNA, 20 bp, human
ggacccgagcggagaggccg

SEQ ID NO: 118878 - DNA, 20 bp, human
gcgcgagatcctcaaggtag

SEQ ID NO: 118879 - DNA, 20 bp, human
gcggccgcggccgcaccagg

SEQ ID NO: 118880 - DNA, 20 bp, human
ggcatgcgcagtgacccgag

SEQ ID NO: 118881 - DNA, 20 bp, human
gcagagcccccgcctcttca

SEQ ID NO: 118882 - DNA, 20 bp, human
gtaccgtgcgggaccccgtg

SEQ ID NO: 118883 - DNA, 20 bp, human
gggcatgtggcgctgtcggt

SEQ ID NO: 118884 - DNA, 20 bp, human
gggccagtggtaccagacct

SEQ ID NO: 118885 - DNA, 20 bp, human
gcgcagtgacccgagcggag

SEQ ID NO: 118886 - DNA, 20 bp, human
ggtgtgtgtgaagcgtacct

SEQ ID NO: 118887 - DNA, 20 bp, human
gtccggagcgaacacctcag

SEQ ID NO: 118888 - DNA, 20 bp, human
gcctagggcgggaggcgaca

SEQ ID NO: 118889 - DNA, 20 bp, human
gtgtgaagcgtacctagggc

SEQ ID NO: 118890 - DNA, 20 bp, human
gccagtcggcaggtctgagg

SEQ ID NO: 118891 - DNA, 20 bp, human
gagacaaaagagcccgacaa

SEQ ID NO: 118892 - DNA, 20 bp, human
gcgggaggcgacatggagac

SEQ ID NO: 118893 - DNA, 20 bp, human
gcgctggcgggtgctgagta

SEQ ID NO: 118894 - DNA, 20 bp, human
gtggccagtcggcaggtctg

SEQ ID NO: 118895 - DNA, 20 bp, human
gagggcctggtcatacagct

SEQ ID NO: 118896 - DNA, 20 bp, human
ggaggccacgcccccggaag

SEQ ID NO: 118897 - DNA, 20 bp, human
ggcgggcggcaggagactag

SEQ ID NO: 118898 - DNA, 20 bp, human
gcactgagactgggtcctgg

SEQ ID NO: 118899 - DNA, 20 bp, human
gccaggagtcgtggtgacca

SEQ ID NO: 118900 - DNA, 20 bp, human
ggccacgcccccggaagcgg

SEQ ID NO: 118901 - DNA, 20 bp, human
ggagtcgtggtgaccaggga

SEQ ID NO: 118902 - DNA, 20 bp, human
gtggcctctgaccggaagtg

SEQ ID NO: 118903 - DNA, 20 bp, human
gaagcgcgcgcggggattcc

SEQ ID NO: 118904 - DNA, 20 bp, human
gcaggtcagacagggtaaat

SEQ ID NO: 118905 - DNA, 20 bp, human
gtctgaccggaagtgaggcc

SEQ ID NO: 118906 - DNA, 20 bp, human
ggggggcagacggcagacgg

SEQ ID NO: 118907 - DNA, 20 bp, human
gctcggctgctgcccggcag

SEQ ID NO: 118908 - DNA, 20 bp, human
gcagcacctcggctgctgcc

SEQ ID NO: 118909 - DNA, 20 bp, human
gctcgggggcagacggcaga

SEQ ID NO: 118910 - DNA, 20 bp, human
gcacgtacgttctgtgcttg

SEQ ID NO: 118911 - DNA, 20 bp, human
gagagaaagggccgaggaga

SEQ ID NO: 118912 - DNA, 20 bp, human
gcgagaggtgtacgaagagg

SEQ ID NO: 118913 - DNA, 20 bp, human
ggcggcagcagctgcgtcgg

SEQ ID NO: 118914 - DNA, 20 bp, human
gctcgtcctcgcgctcgctc

SEQ ID NO: 118915 - DNA, 20 bp, human
gggggtcgtaggtccgtgtc

SEQ ID NO: 118916 - DNA, 20 bp, human
gcagcacctcggctgttccc

SEQ ID NO: 118917 - DNA, 20 bp, human
gcacctcggctgttccccgg

SEQ ID NO: 118918 - DNA, 20 bp, human
gctcggctgttccccggcgg

SEQ ID NO: 118919 - DNA, 20 bp, human
gcgttctgtgcttgcgatcc

SEQ ID NO: 118920 - DNA, 20 bp, human
gctccgtctgcccgcgagcc

SEQ ID NO: 118921 - DNA, 20 bp, human
gccagatattcggcgtgcac

SEQ ID NO: 118922 - DNA, 20 bp, human
gttcggcgtgcacgggcttg

SEQ ID NO: 118923 - DNA, 20 bp, human
gcctcgaggcagcctcctcg

SEQ ID NO: 118924 - DNA, 20 bp, human
gagagaaagggccgaggcga

SEQ ID NO: 118925 - DNA, 20 bp, human
gaaagggccgaggcgagggg

SEQ ID NO: 118926 - DNA, 20 bp, human
gggctccaggaaaagcgagt

SEQ ID NO: 118927 - DNA, 20 bp, human
gagaaggaatctcacagtag

SEQ ID NO: 118928 - DNA, 20 bp, human
gcaggatgcagtccaaagat

SEQ ID NO: 118929 - DNA, 20 bp, human
gcggatctccaccggaagtc

SEQ ID NO: 118930 - DNA, 20 bp, human
gttcagagaccgtgcacggg

SEQ ID NO: 118931 - DNA, 20 bp, human
gaagtcgggaagactgcatc

SEQ ID NO: 118932 - DNA, 20 bp, human
ggaccacagtagaggcaacc

SEQ ID NO: 118933 - DNA, 20 bp, human
ggtgtggcggagcctcgtag

SEQ ID NO: 118934 - DNA, 20 bp, human
gcccacccccggatctccac

SEQ ID NO: 118935 - DNA, 20 bp, human
gatcctggttgcctctactg

SEQ ID NO: 118936 - DNA, 20 bp, human
gcacgactgtggacctccat

SEQ ID NO: 118937 - DNA, 20 bp, human
gtcaggaatcagcacaaaag

SEQ ID NO: 118938 - DNA, 20 bp, human
gagaaacggactctaaacac

SEQ ID NO: 118939 - DNA, 20 bp, human
gagcagcaatggtccctcca

SEQ ID NO: 118940 - DNA, 20 bp, human
gtgtggacctccatgggaca

SEQ ID NO: 118941 - DNA, 20 bp, human
gaaggcacaatgtgagaggt

SEQ ID NO: 118942 - DNA, 20 bp, human
gcagttatgaggcaaaacta

SEQ ID NO: 118943 - DNA, 20 bp, human
gtcactctgaattcttttcg

SEQ ID NO: 118944 - DNA, 20 bp, human
gcttcaaagctgtattcccg

SEQ ID NO: 118945 - DNA, 20 bp, human
ggccgttgaacgtgaacatt

SEQ ID NO: 118946 - DNA, 20 bp, human
gccgcccgaaggctcctgtc

SEQ ID NO: 118947 - DNA, 20 bp, human
gcggcagcgcggaagatggt

SEQ ID NO: 118948 - DNA, 20 bp, human
gctctgcgggggccgacacg

SEQ ID NO: 118949 - DNA, 20 bp, human
gccctcgatgcgctccatgg

SEQ ID NO: 118950 - DNA, 20 bp, human
ggcggcgcccggacaggcgg

SEQ ID NO: 118951 - DNA, 20 bp, human
ggaaggctcctgtcgggaca

SEQ ID NO: 118952 - DNA, 20 bp, human
gtccatggcggcgcccggac

SEQ ID NO: 118953 - DNA, 20 bp, human
gacagggcgccgccccgtgt

SEQ ID NO: 118954 - DNA, 20 bp, human
gtgcgggggccgacacgggg

SEQ ID NO: 118955 - DNA, 20 bp, human
ggccgcgggagggacatctg

SEQ ID NO: 118956 - DNA, 20 bp, human
gggcggccaggagtcggagt

SEQ ID NO: 118957 - DNA, 20 bp, human
gcgcggacgcgaggaaaccg

SEQ ID NO: 118958 - DNA, 20 bp, human
gtaggatcgcgcccaggagg

SEQ ID NO: 118959 - DNA, 20 bp, human
ggaactccagatgacctcca

SEQ ID NO: 118960 - DNA, 20 bp, human
ggtcctcccgcgcgctatga

SEQ ID NO: 118961 - DNA, 20 bp, human
gggccagcgcacagccgcgc

SEQ ID NO: 118962 - DNA, 20 bp, human
gcggcacacggaagcaagca

SEQ ID NO: 118963 - DNA, 20 bp, human
ggcgcggacgttctcacgca

SEQ ID NO: 118964 - DNA, 20 bp, human
gtccccaggaggacgcaacg

SEQ ID NO: 118965 - DNA, 20 bp, human
ggctggccgtcatagcgcgc

SEQ ID NO: 118966 - DNA, 20 bp, human
gtgggccttcgggacagcag

SEQ ID NO: 118967 - DNA, 20 bp, human
gcgtggccctgacccgacgt

SEQ ID NO: 118968 - DNA, 20 bp, human
gcagcccgaccccagcgcca

SEQ ID NO: 118969 - DNA, 20 bp, human
gtgacccgacgtgggagctg

SEQ ID NO: 118970 - DNA, 20 bp, human
gcggcgcgtagaggagagcg

SEQ ID NO: 118971 - DNA, 20 bp, human
ggctgtcccgaaggcccaat

SEQ ID NO: 118972 - DNA, 20 bp, human
ggtgcgctccacgcggaaag

SEQ ID NO: 118973 - DNA, 20 bp, human
gggacagaagcctagaggac

SEQ ID NO: 118974 - DNA, 20 bp, human
gcgaagagcatcccagggtc

SEQ ID NO: 118975 - DNA, 20 bp, human
gtgcgggctccggccatggc

SEQ ID NO: 118976 - DNA, 20 bp, human
ggtcagtgccaagatgtcga

SEQ ID NO: 118977 - DNA, 20 bp, human
gagtgccaagatgtcgacgg

SEQ ID NO: 118978 - DNA, 20 bp, human
ggtacaggtgcgccacgacg

SEQ ID NO: 118979 - DNA, 20 bp, human
ggcggtgtgggccctcggtc

SEQ ID NO: 118980 - DNA, 20 bp, human
ggctcgcgcatgctcttaag

SEQ ID NO: 118981 - DNA, 20 bp, human
gaagcagatcagccgggtgg

SEQ ID NO: 118982 - DNA, 20 bp, human
gcaggtagtcggcctcggtg

SEQ ID NO: 118983 - DNA, 20 bp, human
gtaggcgcatcgcctccacc

SEQ ID NO: 118984 - DNA, 20 bp, human
gtgagctcgcacctgaccga

SEQ ID NO: 118985 - DNA, 20 bp, human
ggagctgaagcagatcagcc

SEQ ID NO: 118986 - DNA, 20 bp, human
gctcctccagggccgcaaaa

SEQ ID NO: 118987 - DNA, 20 bp, human
ggccgcaaaagggcagaaag

SEQ ID NO: 118988 - DNA, 20 bp, human
ggtgcgaagctcaccgactc

SEQ ID NO: 118989 - DNA, 20 bp, human
gggtccacacctcgatctgt

SEQ ID NO: 118990 - DNA, 20 bp, human
gcagaagggcggcactgggt

SEQ ID NO: 118991 - DNA, 20 bp, human
gtaaagtgggccccaaaatg

SEQ ID NO: 118992 - DNA, 20 bp, human
gggttaaggcttcagaaggg

SEQ ID NO: 118993 - DNA, 20 bp, human
gctgtcccggcgtccggagt

SEQ ID NO: 118994 - DNA, 20 bp, human
gtcgctggactgcagaatga

SEQ ID NO: 118995 - DNA, 20 bp, human
gagggcagaaagggggtcgc

SEQ ID NO: 118996 - DNA, 20 bp, human
gagcccgctcccagtccctg

SEQ ID NO: 118997 - DNA, 20 bp, human
gcgcagcgcactctagcccg

SEQ ID NO: 118998 - DNA, 20 bp, human
gcacagatgcgagtgggagt

SEQ ID NO: 118999 - DNA, 20 bp, human
ggaccgactgagccgagccg

SEQ ID NO: 119000 - DNA, 20 bp, human
gggcccgctgccgcagggac

SEQ ID NO: 119001 - DNA, 20 bp, human
ggcaggacacagatgcgagt

SEQ ID NO: 119002 - DNA, 20 bp, human
gccgggagctcacgagaacg

SEQ ID NO: 119003 - DNA, 20 bp, human
ggcccgcggctcggctcagt

SEQ ID NO: 119004 - DNA, 20 bp, human
gcgcactctagcccgcggct

SEQ ID NO: 119005 - DNA, 20 bp, human
gctgggaagcgccacgcacg

SEQ ID NO: 119006 - DNA, 20 bp, human
gcaggttcacccaacgccag

SEQ ID NO: 119007 - DNA, 20 bp, human
gcagcgacgggaaagcggtg

SEQ ID NO: 119008 - DNA, 20 bp, human
gagcgcggcggcccgtggtg

SEQ ID NO: 119009 - DNA, 20 bp, human
ggcccagccagtccgccgag

SEQ ID NO: 119010 - DNA, 20 bp, human
gggaattgaggacgagcctc

SEQ ID NO: 119011 - DNA, 20 bp, human
gcgggcgcgcacgtcttctc

SEQ ID NO: 119012 - DNA, 20 bp, human
gtgcggaaggctacgtcctc

SEQ ID NO: 119013 - DNA, 20 bp, human
ggcggccagcatcgtcctgg

SEQ ID NO: 119014 - DNA, 20 bp, human
ggggggcctcgcgggaattg

SEQ ID NO: 119015 - DNA, 20 bp, human
gggaaagcggtgcggctgaa

SEQ ID NO: 119016 - DNA, 20 bp, human
gactcacccgaagcagaagg

SEQ ID NO: 119017 - DNA, 20 bp, human
gcgaagcagaaggaggtagg

SEQ ID NO: 119018 - DNA, 20 bp, human
gttcgggtgagtacccttaa

SEQ ID NO: 119019 - DNA, 20 bp, human
gggtactcacccgaagcaga

SEQ ID NO: 119020 - DNA, 20 bp, human
gggaggtaggaggcggacct

SEQ ID NO: 119021 - DNA, 20 bp, human
gctgagaactaaaatcaagt

SEQ ID NO: 119022 - DNA, 20 bp, human
ggtaggaggcggaccttgga

SEQ ID NO: 119023 - DNA, 20 bp, human
gcctgtctgcaccgggagaa

SEQ ID NO: 119024 - DNA, 20 bp, human
gcgggccctgcagcgaccag

SEQ ID NO: 119025 - DNA, 20 bp, human
gtattgaatggataatatcg

SEQ ID NO: 119026 - DNA, 20 bp, human
ggctactgcccgccattaac

SEQ ID NO: 119027 - DNA, 20 bp, human
ggcgggcagtagccgctgag

SEQ ID NO: 119028 - DNA, 20 bp, human
gttatctgcaatcccctcag

SEQ ID NO: 119029 - DNA, 20 bp, human
gaacaggacagcgcaagagg

SEQ ID NO: 119030 - DNA, 20 bp, human
gaaaaggactctaaccctgg

SEQ ID NO: 119031 - DNA, 20 bp, human
ggcgctgtcctgttaatggc

SEQ ID NO: 119032 - DNA, 20 bp, human
gcagaaaaggactctaaccc

SEQ ID NO: 119033 - DNA, 20 bp, human
ggtgaacccggagcctctgg

SEQ ID NO: 119034 - DNA, 20 bp, human
gatgaccgaatacataggat

SEQ ID NO: 119035 - DNA, 20 bp, human
gtcttgcgctgtcctgttaa

SEQ ID NO: 119036 - DNA, 20 bp, human
ggtccccgcgcgccccgggt

SEQ ID NO: 119037 - DNA, 20 bp, human
ggcgcggggacccctttcca

SEQ ID NO: 119038 - DNA, 20 bp, human
ggagcttccgggccctggaa

SEQ ID NO: 119039 - DNA, 20 bp, human
gtagctgcgcagcccaggag

SEQ ID NO: 119040 - DNA, 20 bp, human
gcggcctgtatctgctcctg

SEQ ID NO: 119041 - DNA, 20 bp, human
gagtgggcgacggtcatggg

SEQ ID NO: 119042 - DNA, 20 bp, human
gggcagtgggcgacggtcat

SEQ ID NO: 119043 - DNA, 20 bp, human
gctggggcaggcccccgcca

SEQ ID NO: 119044 - DNA, 20 bp, human
gacccccctgaccactcctt

SEQ ID NO: 119045 - DNA, 20 bp, human
gcaggggtctgcctccgacc

SEQ ID NO: 119046 - DNA, 20 bp, human
gcgcatcgcgcccaagatgg

SEQ ID NO: 119047 - DNA, 20 bp, human
ggccgccgctgccaccgtca

SEQ ID NO: 119048 - DNA, 20 bp, human
ggcgggtcgcaggagtcgag

SEQ ID NO: 119049 - DNA, 20 bp, human
ggctctcgctgcggaaacac

SEQ ID NO: 119050 - DNA, 20 bp, human
ggcgcggtcgtcgtcggggg

SEQ ID NO: 119051 - DNA, 20 bp, human
gcttgggcgcgatgcgtcag

SEQ ID NO: 119052 - DNA, 20 bp, human
ggagacggcagccgtgacgg

SEQ ID NO: 119053 - DNA, 20 bp, human
ggcggagacggcagccgtga

SEQ ID NO: 119054 - DNA, 20 bp, human
gttccgcagcgagagcgagg

SEQ ID NO: 119055 - DNA, 20 bp, human
gggctcggccaagggaagca

SEQ ID NO: 119056 - DNA, 20 bp, human
gcgagcaggaggacgaggta

SEQ ID NO: 119057 - DNA, 20 bp, human
gtagaccccggcgccccgga

SEQ ID NO: 119058 - DNA, 20 bp, human
gtccatctgggcactcgaga

SEQ ID NO: 119059 - DNA, 20 bp, human
gggcggccgggcccccacgg

SEQ ID NO: 119060 - DNA, 20 bp, human
ggagacgatggactagagat

SEQ ID NO: 119061 - DNA, 20 bp, human
gtaagatggtgactcccgct

SEQ ID NO: 119062 - DNA, 20 bp, human
gccgctaggcgagacttacg

SEQ ID NO: 119063 - DNA, 20 bp, human
gagccccgcagcctgcgcag

SEQ ID NO: 119064 - DNA, 20 bp, human
ggcacccgggccctagaccc

SEQ ID NO: 119065 - DNA, 20 bp, human
ggggctgatagatgagacaa

SEQ ID NO: 119066 - DNA, 20 bp, human
ggtcaaaggcgggggttcta

SEQ ID NO: 119067 - DNA, 20 bp, human
gcttcaggagattactttcc

SEQ ID NO: 119068 - DNA, 20 bp, human
gggacgaaataactagctgg

SEQ ID NO: 119069 - DNA, 20 bp, human
ggtgccacggctcgaaacac

SEQ ID NO: 119070 - DNA, 20 bp, human
gtaggggtgaagaacggaag

SEQ ID NO: 119071 - DNA, 20 bp, human
ggaaccctccaggatcgtac

SEQ ID NO: 119072 - DNA, 20 bp, human
gagaggacgaaataactagc

SEQ ID NO: 119073 - DNA, 20 bp, human
gccgcctgtacgatcctgga

SEQ ID NO: 119074 - DNA, 20 bp, human
gcgagccgtggcaccggcat

SEQ ID NO: 119075 - DNA, 20 bp, human
gtcagccgatgccggtgcca

SEQ ID NO: 119076 - DNA, 20 bp, human
gattaagcggcgtggagatg

SEQ ID NO: 119077 - DNA, 20 bp, human
ggggcaacggacgaattaag

SEQ ID NO: 119078 - DNA, 20 bp, human
gcaagtgcgcctgggacgaa

SEQ ID NO: 119079 - DNA, 20 bp, human
gggcatctgtgaaagaagat

SEQ ID NO: 119080 - DNA, 20 bp, human
gggcaagcatcgcgcgccag

SEQ ID NO: 119081 - DNA, 20 bp, human
gctgggacgaagggctcccg

SEQ ID NO: 119082 - DNA, 20 bp, human
gctgtcgagcccagagggaa

SEQ ID NO: 119083 - DNA, 20 bp, human
gggcccggggccgtaggttc

SEQ ID NO: 119084 - DNA, 20 bp, human
gtacggccccgggccttcgg

SEQ ID NO: 119085 - DNA, 20 bp, human
gcgatgcttgcccgaaccta

SEQ ID NO: 119086 - DNA, 20 bp, human
gaccccaggacccccgacag

SEQ ID NO: 119087 - DNA, 20 bp, human
ggaccgaccgagcagctccg

SEQ ID NO: 119088 - DNA, 20 bp, human
gcggaaacaaacattcccca

SEQ ID NO: 119089 - DNA, 20 bp, human
gccagggcaatgtcacgact

SEQ ID NO: 119090 - DNA, 20 bp, human
gaactgaaagtagccaccgg

SEQ ID NO: 119091 - DNA, 20 bp, human
gcctggccagagcagtgcaa

SEQ ID NO: 119092 - DNA, 20 bp, human
gtacgaaactgacagaccca

SEQ ID NO: 119093 - DNA, 20 bp, human
gccggattcaagtcccccgg

SEQ ID NO: 119094 - DNA, 20 bp, human
gaggcgagtgctcccccatc

SEQ ID NO: 119095 - DNA, 20 bp, human
gcacaactgaaagtagccac

SEQ ID NO: 119096 - DNA, 20 bp, human
gcctcggccgacaggcagtc

SEQ ID NO: 119097 - DNA, 20 bp, human
ggcctgaccgggaggcacaa

SEQ ID NO: 119098 - DNA, 20 bp, human
gtgcgcggccgggacactga

SEQ ID NO: 119099 - DNA, 20 bp, human
gggagagtccctccgcccaa

SEQ ID NO: 119100 - DNA, 20 bp, human
gagggcgacgtcaggtacag

SEQ ID NO: 119101 - DNA, 20 bp, human
gcagctcgccctcggccgac

SEQ ID NO: 119102 - DNA, 20 bp, human
gcgcgtacgaggggcccacg

SEQ ID NO: 119103 - DNA, 20 bp, human
gtaagcgggaaacagctcaa

SEQ ID NO: 119104 - DNA, 20 bp, human
gatgctgcccgactgcctgt

SEQ ID NO: 119105 - DNA, 20 bp, human
ggcgcaaggacgcgtacgag

SEQ ID NO: 119106 - DNA, 20 bp, human
gcctgaacgcctggatgccg

SEQ ID NO: 119107 - DNA, 20 bp, human
gccggccgcgggtatctgat

SEQ ID NO: 119108 - DNA, 20 bp, human
ggaggacctgatagtcacag

SEQ ID NO: 119109 - DNA, 20 bp, human
gctcccgttcgggaacccaa

SEQ ID NO: 119110 - DNA, 20 bp, human
gggagccggtagtaggaggg

SEQ ID NO: 119111 - DNA, 20 bp, human
gtcgtggccgcggtttcccc

SEQ ID NO: 119112 - DNA, 20 bp, human
gaaaggagccggtagtagga

SEQ ID NO: 119113 - DNA, 20 bp, human
gaggtctagggcaaaggagc

SEQ ID NO: 119114 - DNA, 20 bp, human
ggccgggactcggagctgtg

SEQ ID NO: 119115 - DNA, 20 bp, human
gtcatggcgggacgcctcct

SEQ ID NO: 119116 - DNA, 20 bp, human
gcactgtaggtgagcgcgag

SEQ ID NO: 119117 - DNA, 20 bp, human
gacctgcccgcgccttggga

SEQ ID NO: 119118 - DNA, 20 bp, human
ggaactcgccgtcttcctgt

SEQ ID NO: 119119 - DNA, 20 bp, human
gtacagtgccggccgccgac

SEQ ID NO: 119120 - DNA, 20 bp, human
gcgggacttccagtaggagg

SEQ ID NO: 119121 - DNA, 20 bp, human
ggaagaaaccagagcctggg

SEQ ID NO: 119122 - DNA, 20 bp, human
gggtgagcgcgagaggacgg

SEQ ID NO: 119123 - DNA, 20 bp, human
ggtgttttcgtcgtgctcag

SEQ ID NO: 119124 - DNA, 20 bp, human
ggggcgggacttccagtagg

SEQ ID NO: 119125 - DNA, 20 bp, human
gatggggcgggacttccagt

SEQ ID NO: 119126 - DNA, 20 bp, human
gtagactccggacccgccag

SEQ ID NO: 119127 - DNA, 20 bp, human
gtccggacccgccagtggta

SEQ ID NO: 119128 - DNA, 20 bp, human
gggagtctagcacgcgactg

SEQ ID NO: 119129 - DNA, 20 bp, human
gcgactgtggagcaagcatt

SEQ ID NO: 119130 - DNA, 20 bp, human
gtgagaatcaaggggagact

SEQ ID NO: 119131 - DNA, 20 bp, human
ggaacgggggaaaaaggtaa

SEQ ID NO: 119132 - DNA, 20 bp, human
ggaagaatctgggcgtcgaa

SEQ ID NO: 119133 - DNA, 20 bp, human
gaaggggagaggaaagaacg

SEQ ID NO: 119134 - DNA, 20 bp, human
ggccttgtagttcacggtaa

SEQ ID NO: 119135 - DNA, 20 bp, human
ggtaaaggggtcgactcacg

SEQ ID NO: 119136 - DNA, 20 bp, human
gtgcgggctgctgcaccgtc

SEQ ID NO: 119137 - DNA, 20 bp, human
gtcccagccgctttcaatgg

SEQ ID NO: 119138 - DNA, 20 bp, human
ggagtcccagccgctttcaa

SEQ ID NO: 119139 - DNA, 20 bp, human
gccgagctctagaatgaaag

SEQ ID NO: 119140 - DNA, 20 bp, human
gacctgcagcatggagccga

SEQ ID NO: 119141 - DNA, 20 bp, human
gtctgggagggaggacgggt

SEQ ID NO: 119142 - DNA, 20 bp, human
ggggcatccccagagccgga

SEQ ID NO: 119143 - DNA, 20 bp, human
ggatccgaaaagcgcggacg

SEQ ID NO: 119144 - DNA, 20 bp, human
ggggctggatccgaaaagcg

SEQ ID NO: 119145 - DNA, 20 bp, human
gtcctccattgaaagcggct

SEQ ID NO: 119146 - DNA, 20 bp, human
gaggtatttggaaccagctg

SEQ ID NO: 119147 - DNA, 20 bp, human
ggttccaaatacctgaacca

SEQ ID NO: 119148 - DNA, 20 bp, human
gggcagcttctccttggttc

SEQ ID NO: 119149 - DNA, 20 bp, human
gtctactgtggcatcctatc

SEQ ID NO: 119150 - DNA, 20 bp, human
gtagctccctgatggcaagt

SEQ ID NO: 119151 - DNA, 20 bp, human
gaagggctacgtaccccagc

SEQ ID NO: 119152 - DNA, 20 bp, human
gtaacgtctgctttctactg

SEQ ID NO: 119153 - DNA, 20 bp, human
gtttgtgattgtggcccaaa

SEQ ID NO: 119154 - DNA, 20 bp, human
gaaacaacgctacagctaag

SEQ ID NO: 119155 - DNA, 20 bp, human
gtctccttggttcaggtatt

SEQ ID NO: 119156 - DNA, 20 bp, human
gctggcgcgagcccacgaag

SEQ ID NO: 119157 - DNA, 20 bp, human
ggaaagggcagaatctatgg

SEQ ID NO: 119158 - DNA, 20 bp, human
gacaggccggggtccggaag

SEQ ID NO: 119159 - DNA, 20 bp, human
gtccataaccgagtccgaaa

SEQ ID NO: 119160 - DNA, 20 bp, human
gtaggcctgagcacccgcag

SEQ ID NO: 119161 - DNA, 20 bp, human
gtccgaaagggcagaatcta

SEQ ID NO: 119162 - DNA, 20 bp, human
ggagcgcgcagccaggtaac

SEQ ID NO: 119163 - DNA, 20 bp, human
ggaccccggcctgtacttga

SEQ ID NO: 119164 - DNA, 20 bp, human
ggggtaaggtttgtgaggag

SEQ ID NO: 119165 - DNA, 20 bp, human
ggtgaggagaggcgcctgag

SEQ ID NO: 119166 - DNA, 20 bp, human
ggttcgcgctgactgggcta

SEQ ID NO: 119167 - DNA, 20 bp, human
gcggcgagttcgcgctgact

SEQ ID NO: 119168 - DNA, 20 bp, human
gccactggcggccgaggtag

SEQ ID NO: 119169 - DNA, 20 bp, human
ggcggccgaggtagaggcag

SEQ ID NO: 119170 - DNA, 20 bp, human
gtggcgcttgagttggtcgg

SEQ ID NO: 119171 - DNA, 20 bp, human
gaggtgagtgccggtaacgc

SEQ ID NO: 119172 - DNA, 20 bp, human
gggtctagcgcgctgaccgg

SEQ ID NO: 119173 - DNA, 20 bp, human
gcagtggcgcttgagttggt

SEQ ID NO: 119174 - DNA, 20 bp, human
gtggtggccactggcggccg

SEQ ID NO: 119175 - DNA, 20 bp, human
ggaatccgggaagcccgcag

SEQ ID NO: 119176 - DNA, 20 bp, human
gctcaacgaagaggcccatg

SEQ ID NO: 119177 - DNA, 20 bp, human
gccatgaggcagggcaccga

SEQ ID NO: 119178 - DNA, 20 bp, human
gtactaagttcgaggttcta

SEQ ID NO: 119179 - DNA, 20 bp, human
gtttctgtgggtcaactctc

SEQ ID NO: 119180 - DNA, 20 bp, human
gtgtgagatgctcaacgaag

SEQ ID NO: 119181 - DNA, 20 bp, human
gaacagctcctggggaacca

SEQ ID NO: 119182 - DNA, 20 bp, human
gcatgaggttccaagtgatt

SEQ ID NO: 119183 - DNA, 20 bp, human
gttggaacatactaagttcg

SEQ ID NO: 119184 - DNA, 20 bp, human
gtagtatgttccaaaagctt

SEQ ID NO: 119185 - DNA, 20 bp, human
gtggcaggactcacttccta

SEQ ID NO: 119186 - DNA, 20 bp, human
gcccggaacggaatcctccc

SEQ ID NO: 119187 - DNA, 20 bp, human
gtgcatcccgcaccatcccc

SEQ ID NO: 119188 - DNA, 20 bp, human
ggccaaagcccaggagaccg

SEQ ID NO: 119189 - DNA, 20 bp, human
gggaatcctcccgggagccg

SEQ ID NO: 119190 - DNA, 20 bp, human
ggcacgcgcgcgagcctcct

SEQ ID NO: 119191 - DNA, 20 bp, human
ggcggcggccagcgtgagaa

SEQ ID NO: 119192 - DNA, 20 bp, human
gctcggtctgacgccggcca

SEQ ID NO: 119193 - DNA, 20 bp, human
gtgctgatgtggcggagggt

SEQ ID NO: 119194 - DNA, 20 bp, human
gccccacaaaaccaaggaca

SEQ ID NO: 119195 - DNA, 20 bp, human
gtctgacgccggccagggcc

SEQ ID NO: 119196 - DNA, 20 bp, human
ggagcgggaaggctaaaacg

SEQ ID NO: 119197 - DNA, 20 bp, human
gttgcttccggagagcggga

SEQ ID NO: 119198 - DNA, 20 bp, human
gttccacacacaaccaaagt

SEQ ID NO: 119199 - DNA, 20 bp, human
gggaagcaagcccttcgacc

SEQ ID NO: 119200 - DNA, 20 bp, human
ggccagtcagtgaagatact

SEQ ID NO: 119201 - DNA, 20 bp, human
ggctaaactgcagccaactt

SEQ ID NO: 119202 - DNA, 20 bp, human
gagactgcttccgggtcgaa

SEQ ID NO: 119203 - DNA, 20 bp, human
ggacaggtcagtactgatgg

SEQ ID NO: 119204 - DNA, 20 bp, human
ggtcccgggtgcttccccta

SEQ ID NO: 119205 - DNA, 20 bp, human
ggaacgtagtgggaaagtaa

SEQ ID NO: 119206 - DNA, 20 bp, human
gcgaccggcgagaagagcac

SEQ ID NO: 119207 - DNA, 20 bp, human
gttgcagcctggcctgcgcg

SEQ ID NO: 119208 - DNA, 20 bp, human
gtccgccgccccggttccaa

SEQ ID NO: 119209 - DNA, 20 bp, human
gggctgggaacatgactcca

SEQ ID NO: 119210 - DNA, 20 bp, human
gactccaaggagcagcgact

SEQ ID NO: 119211 - DNA, 20 bp, human
ggcggaacttaaacacctaa

SEQ ID NO: 119212 - DNA, 20 bp, human
gactaggacagcgagggatc

SEQ ID NO: 119213 - DNA, 20 bp, human
ggcgcgccatctcttccctt

SEQ ID NO: 119214 - DNA, 20 bp, human
gacctaggcgcagtcaagaa

SEQ ID NO: 119215 - DNA, 20 bp, human
gcccggacggctagcaggaa

SEQ ID NO: 119216 - DNA, 20 bp, human
gctgaggaaaggcccgagtg

SEQ ID NO: 119217 - DNA, 20 bp, human
gcccgcgctgtccacacagt

SEQ ID NO: 119218 - DNA, 20 bp, human
ggcgggcgctgtgcgcacag

SEQ ID NO: 119219 - DNA, 20 bp, human
ggcaggggtaataggcgcaa

SEQ ID NO: 119220 - DNA, 20 bp, human
gtcgccagcggcttcaactg

SEQ ID NO: 119221 - DNA, 20 bp, human
ggcgagcaggagcggagaga

SEQ ID NO: 119222 - DNA, 20 bp, human
gcgctccggggcgggtaagg

SEQ ID NO: 119223 - DNA, 20 bp, human
ggtaataggcgcaacggcgg

SEQ ID NO: 119224 - DNA, 20 bp, human
gcagtgggcacaagcacccc

SEQ ID NO: 119225 - DNA, 20 bp, human
ggcggcagccgccttagcag

SEQ ID NO: 119226 - DNA, 20 bp, human
gcggatctaagctaacttct

SEQ ID NO: 119227 - DNA, 20 bp, human
ggcgcgcgcgccctaggcgg

SEQ ID NO: 119228 - DNA, 20 bp, human
gttggcgcgcgcgccctagg

SEQ ID NO: 119229 - DNA, 20 bp, human
gagcttagatccgccgccta

SEQ ID NO: 119230 - DNA, 20 bp, human
ggcggaagtgcgtcatgtcg

SEQ ID NO: 119231 - DNA, 20 bp, human
gtaagcagctcggaaaggtc

SEQ ID NO: 119232 - DNA, 20 bp, human
ggcgcgccaaacgagcgcct

SEQ ID NO: 119233 - DNA, 20 bp, human
gtcccagttgaagcagaaag

SEQ ID NO: 119234 - DNA, 20 bp, human
gcgtttggcgcgcgcgccct

SEQ ID NO: 119235 - DNA, 20 bp, human
gctcgccgggaccaacgctg

SEQ ID NO: 119236 - DNA, 20 bp, human
gggcggcgggagccctggaa

SEQ ID NO: 119237 - DNA, 20 bp, human
ggccctggaacggagcttcg

SEQ ID NO: 119238 - DNA, 20 bp, human
ggcgacgcccaacggaacaa

SEQ ID NO: 119239 - DNA, 20 bp, human
gtccacgaagctccgttcca

SEQ ID NO: 119240 - DNA, 20 bp, human
gcggctggaacgcctccgga

SEQ ID NO: 119241 - DNA, 20 bp, human
ggactcaggaggatgaaaca

SEQ ID NO: 119242 - DNA, 20 bp, human
gggagcttcgtggagctaag

SEQ ID NO: 119243 - DNA, 20 bp, human
ggctagaggcatgtggactc

SEQ ID NO: 119244 - DNA, 20 bp, human
gatctgcgggaaccttccag

SEQ ID NO: 119245 - DNA, 20 bp, human
gagaggcatgtggactcagg

SEQ ID NO: 119246 - DNA, 20 bp, human
ggcgggccgtgtgtgaggtg

SEQ ID NO: 119247 - DNA, 20 bp, human
gccgtgtgtgaggtgcggag

SEQ ID NO: 119248 - DNA, 20 bp, human
ggagaccgcaaagctccccg

SEQ ID NO: 119249 - DNA, 20 bp, human
gcgccggcgggccgtgtgtg

SEQ ID NO: 119250 - DNA, 20 bp, human
gcagggcgcactcgacgccg

SEQ ID NO: 119251 - DNA, 20 bp, human
gcgacgccggggcaggacac

SEQ ID NO: 119252 - DNA, 20 bp, human
gcctgcagcagggacgtggg

SEQ ID NO: 119253 - DNA, 20 bp, human
ggacgcgtcggaggtgagag

SEQ ID NO: 119254 - DNA, 20 bp, human
ggagcgggtcgaatggaccg

SEQ ID NO: 119255 - DNA, 20 bp, human
gcgggtcgaatggaccgggg

SEQ ID NO: 119256 - DNA, 20 bp, human
ggcatggaggccccgggaaa

SEQ ID NO: 119257 - DNA, 20 bp, human
gtcagcctcaccctttcccg

SEQ ID NO: 119258 - DNA, 20 bp, human
gatgagcagaggctgaaagt

SEQ ID NO: 119259 - DNA, 20 bp, human
gaaaggcgtcgccatcttag

SEQ ID NO: 119260 - DNA, 20 bp, human
gagaggctgaaagtaggcgt

SEQ ID NO: 119261 - DNA, 20 bp, human
gcggtaaattcgggtaagtg

SEQ ID NO: 119262 - DNA, 20 bp, human
gacgcgcgccattcaaactg

SEQ ID NO: 119263 - DNA, 20 bp, human
gggcgtcggagttccttata

SEQ ID NO: 119264 - DNA, 20 bp, human
gtcttccacagtgaagccag

SEQ ID NO: 119265 - DNA, 20 bp, human
ggggcctccatgcggcagaa

SEQ ID NO: 119266 - DNA, 20 bp, human
gcggccgcgcgcctcaccag

SEQ ID NO: 119267 - DNA, 20 bp, human
gtgacgcgcggcgaggatgg

SEQ ID NO: 119268 - DNA, 20 bp, human
ggccatgacatgagcagtgg

SEQ ID NO: 119269 - DNA, 20 bp, human
gggcgccatgacatgagcag

SEQ ID NO: 119270 - DNA, 20 bp, human
gcgctctgctcgcgcctcag

SEQ ID NO: 119271 - DNA, 20 bp, human
ggcgggagcggagggcaacg

SEQ ID NO: 119272 - DNA, 20 bp, human
gcagcggtagcagccctccg

SEQ ID NO: 119273 - DNA, 20 bp, human
gagggctgctaccgctggtg

SEQ ID NO: 119274 - DNA, 20 bp, human
gcagcaggtgatgagcgcgg

SEQ ID NO: 119275 - DNA, 20 bp, human
gacgctgtcggtgctgttgg

SEQ ID NO: 119276 - DNA, 20 bp, human
gtgagcgggaacccgagacc

SEQ ID NO: 119277 - DNA, 20 bp, human
gtaggacacgccacacccaa

SEQ ID NO: 119278 - DNA, 20 bp, human
ggacgccggacagccagtca

SEQ ID NO: 119279 - DNA, 20 bp, human
gacctggcagtcgccatgac

SEQ ID NO: 119280 - DNA, 20 bp, human
ggtcgccatgactggctgtc

SEQ ID NO: 119281 - DNA, 20 bp, human
gagacgtgtgaggaattctc

SEQ ID NO: 119282 - DNA, 20 bp, human
gcggcgtcatcaagacgccg

SEQ ID NO: 119283 - DNA, 20 bp, human
gagtgtggtgtcagtgaagg

SEQ ID NO: 119284 - DNA, 20 bp, human
ggaaaaagagcccgaagcct

SEQ ID NO: 119285 - DNA, 20 bp, human
gcgaagggtagcaacacctg

SEQ ID NO: 119286 - DNA, 20 bp, human
gcgagcggcctgggttccgt

SEQ ID NO: 119287 - DNA, 20 bp, human
gcctggggcggtcacaatag

SEQ ID NO: 119288 - DNA, 20 bp, human
gccgccccaggaagtagcta

SEQ ID NO: 119289 - DNA, 20 bp, human
ggttccgtgggcaaggccgt

SEQ ID NO: 119290 - DNA, 20 bp, human
gggctgcttcgacacactga

SEQ ID NO: 119291 - DNA, 20 bp, human
ggaggaagtttgctgtcgag

SEQ ID NO: 119292 - DNA, 20 bp, human
gggcactgtggtagtcatcg

SEQ ID NO: 119293 - DNA, 20 bp, human
gggccttgcccacggaaccc

SEQ ID NO: 119294 - DNA, 20 bp, human
gcaacgccaggactaaagaa

SEQ ID NO: 119295 - DNA, 20 bp, human
ggaagtagtcgttaacgtag

SEQ ID NO: 119296 - DNA, 20 bp, human
ggtagcacgccgttacccgt

SEQ ID NO: 119297 - DNA, 20 bp, human
gaaacgctccccacgggtaa

SEQ ID NO: 119298 - DNA, 20 bp, human
ggcggtgccctgaagtgtgt

SEQ ID NO: 119299 - DNA, 20 bp, human
gaactgaccgcggtacacgt

SEQ ID NO: 119300 - DNA, 20 bp, human
gccgcggtcagttcctccca

SEQ ID NO: 119301 - DNA, 20 bp, human
gggtccccagaagcatccct

SEQ ID NO: 119302 - DNA, 20 bp, human
gccctgaggttccactgcaa

SEQ ID NO: 119303 - DNA, 20 bp, human
gagtgtagttgccgacgcaa

SEQ ID NO: 119304 - DNA, 20 bp, human
gcacctaacgcgggcccctg

SEQ ID NO: 119305 - DNA, 20 bp, human
gggaccgactatgaacttgg

SEQ ID NO: 119306 - DNA, 20 bp, human
gtctgcggtgcgtatcgagc

SEQ ID NO: 119307 - DNA, 20 bp, human
gcctgcctctggtcggttcc

SEQ ID NO: 119308 - DNA, 20 bp, human
gagcgccaggaaccgaccag

SEQ ID NO: 119309 - DNA, 20 bp, human
gagaccagcctgcctctggt

SEQ ID NO: 119310 - DNA, 20 bp, human
gtatggacacggagacagag

SEQ ID NO: 119311 - DNA, 20 bp, human
gctacaacggcagagaagaa

SEQ ID NO: 119312 - DNA, 20 bp, human
gatcgagctgggagcccgag

SEQ ID NO: 119313 - DNA, 20 bp, human
ggcagagccacagcgcgtcg

SEQ ID NO: 119314 - DNA, 20 bp, human
gctggcccggggagaggtgt

SEQ ID NO: 119315 - DNA, 20 bp, human
gaaaagcatcccggcctctc

SEQ ID NO: 119316 - DNA, 20 bp, human
gcggtctgtaaacttcccgg

SEQ ID NO: 119317 - DNA, 20 bp, human
ggctgcggccgctttcggca

SEQ ID NO: 119318 - DNA, 20 bp, human
ggcgagaagaaccagaaggt

SEQ ID NO: 119319 - DNA, 20 bp, human
gggctcaggcatgccatcac

SEQ ID NO: 119320 - DNA, 20 bp, human
gagctcaaccggagagaggg

SEQ ID NO: 119321 - DNA, 20 bp, human
gggtcagctcaaccggagag

SEQ ID NO: 119322 - DNA, 20 bp, human
gtacctgctgcggccgcttt

SEQ ID NO: 119323 - DNA, 20 bp, human
gaggggctcgtccctatcag

SEQ ID NO: 119324 - DNA, 20 bp, human
gagggttccgcgggaagagg

SEQ ID NO: 119325 - DNA, 20 bp, human
gcgtagctcagagccggtga

SEQ ID NO: 119326 - DNA, 20 bp, human
gttgcgcagtagctgaacgc

SEQ ID NO: 119327 - DNA, 20 bp, human
gccgaggaggtgaggagcgg

SEQ ID NO: 119328 - DNA, 20 bp, human
gagcgtgaggagccccccca

SEQ ID NO: 119329 - DNA, 20 bp, human
gggagtgcgagtgcagggct

SEQ ID NO: 119330 - DNA, 20 bp, human
gggaggggagtgcgagtgca

SEQ ID NO: 119331 - DNA, 20 bp, human
gaggagcccccccagggata

SEQ ID NO: 119332 - DNA, 20 bp, human
ggtgctactgccggaagcgc

SEQ ID NO: 119333 - DNA, 20 bp, human
gactcagaggacttagtgct

SEQ ID NO: 119334 - DNA, 20 bp, human
ggcaagcgcgccggcgcttc

SEQ ID NO: 119335 - DNA, 20 bp, human
ggactcaaacaccatatccc

SEQ ID NO: 119336 - DNA, 20 bp, human
ggtcgcaggagtaacctact

SEQ ID NO: 119337 - DNA, 20 bp, human
gtccgagactctccgacctg

SEQ ID NO: 119338 - DNA, 20 bp, human
gcggtaccggaggtgcccga

SEQ ID NO: 119339 - DNA, 20 bp, human
ggtggctgcagcggtaccgg

SEQ ID NO: 119340 - DNA, 20 bp, human
ggccgacgcggagactttag

SEQ ID NO: 119341 - DNA, 20 bp, human
gtcccggccggactgagaag

SEQ ID NO: 119342 - DNA, 20 bp, human
ggcgttcccgcccatccagg

SEQ ID NO: 119343 - DNA, 20 bp, human
ggccctatcctcgccgagtc

SEQ ID NO: 119344 - DNA, 20 bp, human
ggagggagccccaaaattga

SEQ ID NO: 119345 - DNA, 20 bp, human
ggagggaggttctcgggcaa

SEQ ID NO: 119346 - DNA, 20 bp, human
gggcgcagaagtagtacggt

SEQ ID NO: 119347 - DNA, 20 bp, human
gagggccacgagctgcgaaa

SEQ ID NO: 119348 - DNA, 20 bp, human
gagctgcgaaagggcgggaa

SEQ ID NO: 119349 - DNA, 20 bp, human
gccccagggctccctaaaga

SEQ ID NO: 119350 - DNA, 20 bp, human
gtcgcgcggccccaaccggg

SEQ ID NO: 119351 - DNA, 20 bp, human
gccacgagctgcgaaagggc

SEQ ID NO: 119352 - DNA, 20 bp, human
gccctgatccccaggaggag

SEQ ID NO: 119353 - DNA, 20 bp, human
gggatccccagctgagaggg

SEQ ID NO: 119354 - DNA, 20 bp, human
gccatggctgcagcaaggag

SEQ ID NO: 119355 - DNA, 20 bp, human
gggaggaggaaaccagaccc

SEQ ID NO: 119356 - DNA, 20 bp, human
gagcgggaacctgcccacta

SEQ ID NO: 119357 - DNA, 20 bp, human
gaagaatcggcctccttagt

SEQ ID NO: 119358 - DNA, 20 bp, human
gtgctcgagccggaaagaat

SEQ ID NO: 119359 - DNA, 20 bp, human
ggggaacctgcccactaagg

SEQ ID NO: 119360 - DNA, 20 bp, human
gccggaagccttgcctacag

SEQ ID NO: 119361 - DNA, 20 bp, human
ggtgaagctaaccgagactg

SEQ ID NO: 119362 - DNA, 20 bp, human
gagactgctagacgccagag

SEQ ID NO: 119363 - DNA, 20 bp, human
ggtccggccctgaactatac

SEQ ID NO: 119364 - DNA, 20 bp, human
gtcggttagcttcacttcag

SEQ ID NO: 119365 - DNA, 20 bp, human
gctgctagacgccagagggg

SEQ ID NO: 119366 - DNA, 20 bp, human
ggagcgcctcgcgaccacta

SEQ ID NO: 119367 - DNA, 20 bp, human
gctggggttcggcgctatgg

SEQ ID NO: 119368 - DNA, 20 bp, human
gcgcgatgcagagcttaata

SEQ ID NO: 119369 - DNA, 20 bp, human
gaggcctgagcgggaagcat

SEQ ID NO: 119370 - DNA, 20 bp, human
gagcgacttctaggagcctg

SEQ ID NO: 119371 - DNA, 20 bp, human
gtcctcttgggcattagagt

SEQ ID NO: 119372 - DNA, 20 bp, human
ggcgctatggaggagctcga

SEQ ID NO: 119373 - DNA, 20 bp, human
ggagccaacagtcactgtaa

SEQ ID NO: 119374 - DNA, 20 bp, human
gtggcgtccgagcgacttct

SEQ ID NO: 119375 - DNA, 20 bp, human
gtaacgaggtgcccgcccta

SEQ ID NO: 119376 - DNA, 20 bp, human
gcggccgccgagggaccggt

SEQ ID NO: 119377 - DNA, 20 bp, human
ggagccgcaagaacacgacg

SEQ ID NO: 119378 - DNA, 20 bp, human
gtcgcccaccggtccctcgg

SEQ ID NO: 119379 - DNA, 20 bp, human
gggtgggcgacggcgagctg

SEQ ID NO: 119380 - DNA, 20 bp, human
gccgtcgcccaccggtccct

SEQ ID NO: 119381 - DNA, 20 bp, human
gcgaccgcgtatggcagcgt

SEQ ID NO: 119382 - DNA, 20 bp, human
ggagtccccgcgaccgcgta

SEQ ID NO: 119383 - DNA, 20 bp, human
ggcaagaacacgacgtggtt

SEQ ID NO: 119384 - DNA, 20 bp, human
gactccgacgctgccatacg

SEQ ID NO: 119385 - DNA, 20 bp, human
gcgaaggcgaacgactaaga

SEQ ID NO: 119386 - DNA, 20 bp, human
gcggctgtagcacaaggtaa

SEQ ID NO: 119387 - DNA, 20 bp, human
gggagcgccgtccccacgct

SEQ ID NO: 119388 - DNA, 20 bp, human
gcctcaagccggcacctgag

SEQ ID NO: 119389 - DNA, 20 bp, human
gcaagccggcacctgagcgg

SEQ ID NO: 119390 - DNA, 20 bp, human
gagagcggcgcgagaagcgg

SEQ ID NO: 119391 - DNA, 20 bp, human
ggcgcaggcttaggcagggt

SEQ ID NO: 119392 - DNA, 20 bp, human
gaagcaggcagggcacggtc

SEQ ID NO: 119393 - DNA, 20 bp, human
gggcggccgcgtcctcaagc

SEQ ID NO: 119394 - DNA, 20 bp, human
ggcgcgagggcaccacagtg

SEQ ID NO: 119395 - DNA, 20 bp, human
gggcacctgagcggcggaga

SEQ ID NO: 119396 - DNA, 20 bp, human
gggtgtaaggaccccacggt

SEQ ID NO: 119397 - DNA, 20 bp, human
ggacagacacccactcgcgt

SEQ ID NO: 119398 - DNA, 20 bp, human
gaagcggcggtcggtggcag

SEQ ID NO: 119399 - DNA, 20 bp, human
ggcggcgctagacttcgaag

SEQ ID NO: 119400 - DNA, 20 bp, human
gcgcgctgcgcccgaagcgg

SEQ ID NO: 119401 - DNA, 20 bp, human
ggagctgcagcggccgagac

SEQ ID NO: 119402 - DNA, 20 bp, human
gggccagaaggtgcgcgcag

SEQ ID NO: 119403 - DNA, 20 bp, human
gggcggcgacggtttcgtgg

SEQ ID NO: 119404 - DNA, 20 bp, human
ggctagacttcgaagcggag

SEQ ID NO: 119405 - DNA, 20 bp, human
gtaacagggtcgacccagag

SEQ ID NO: 119406 - DNA, 20 bp, human
ggaacttccagccccaacgg

SEQ ID NO: 119407 - DNA, 20 bp, human
ggacccgaaggagaaccctg

SEQ ID NO: 119408 - DNA, 20 bp, human
gcgggaacttccagccccaa

SEQ ID NO: 119409 - DNA, 20 bp, human
gtcgcccggcacggacctgg

SEQ ID NO: 119410 - DNA, 20 bp, human
gctctcgcccggcacggacc

SEQ ID NO: 119411 - DNA, 20 bp, human
ggcgctgggcccgggtaccg

SEQ ID NO: 119412 - DNA, 20 bp, human
gctcaaagccgaggcgggcc

SEQ ID NO: 119413 - DNA, 20 bp, human
gccaggaaggcgagaaagtg

SEQ ID NO: 119414 - DNA, 20 bp, human
ggggcagcatctctctcgcc

SEQ ID NO: 119415 - DNA, 20 bp, human
ggacaggatggggacaccaa

SEQ ID NO: 119416 - DNA, 20 bp, human
gcgacggcgtcgctgacgga

SEQ ID NO: 119417 - DNA, 20 bp, human
gcccagtaacaggcatcgaa

SEQ ID NO: 119418 - DNA, 20 bp, human
ggttaccgcggaggattcag

SEQ ID NO: 119419 - DNA, 20 bp, human
gcgttgtgcagggcccagta

SEQ ID NO: 119420 - DNA, 20 bp, human
gtgacaaatggccattgcga

SEQ ID NO: 119421 - DNA, 20 bp, human
gtcagaggagagtcacctga

SEQ ID NO: 119422 - DNA, 20 bp, human
gattgcgacggcgtcgctga

SEQ ID NO: 119423 - DNA, 20 bp, human
gccagcagcgggaaacacgc

SEQ ID NO: 119424 - DNA, 20 bp, human
gcctacaaggtagtttcgat

SEQ ID NO: 119425 - DNA, 20 bp, human
gagcatccaggcccaaaccc

SEQ ID NO: 119426 - DNA, 20 bp, human
gcagagacagacaaagcgtt

SEQ ID NO: 119427 - DNA, 20 bp, human
ggccttataagctgagggag

SEQ ID NO: 119428 - DNA, 20 bp, human
gcccatctcaccactgcagg

SEQ ID NO: 119429 - DNA, 20 bp, human
gggaaggtggccatcgtgcc

SEQ ID NO: 119430 - DNA, 20 bp, human
gaccgtggagatggctgagt

SEQ ID NO: 119431 - DNA, 20 bp, human
ggcgctggttgctggtggga

SEQ ID NO: 119432 - DNA, 20 bp, human
ggccagactgtggtctgagg

SEQ ID NO: 119433 - DNA, 20 bp, human
ggggggcgctggttgctggt

SEQ ID NO: 119434 - DNA, 20 bp, human
ggccttaccgaggtaggaat

SEQ ID NO: 119435 - DNA, 20 bp, human
gtgagaggaaacaagagggg

SEQ ID NO: 119436 - DNA, 20 bp, human
ggacgctcctagggtccccg

SEQ ID NO: 119437 - DNA, 20 bp, human
gtccaggagcgcccagacgc

SEQ ID NO: 119438 - DNA, 20 bp, human
ggggctccgcgtgaaggtgg

SEQ ID NO: 119439 - DNA, 20 bp, human
gaccttcacgcggagcccat

SEQ ID NO: 119440 - DNA, 20 bp, human
gcggccacctgcccgcgtct

SEQ ID NO: 119441 - DNA, 20 bp, human
ggcgcaggtagtagtagtcc

SEQ ID NO: 119442 - DNA, 20 bp, human
ggggtccccggggcactggt

SEQ ID NO: 119443 - DNA, 20 bp, human
gtgctcgccctgggcagagt

SEQ ID NO: 119444 - DNA, 20 bp, human
ggcgcagcaagggccggact

SEQ ID NO: 119445 - DNA, 20 bp, human
gtgaggcgagtgcgcatctt

SEQ ID NO: 119446 - DNA, 20 bp, human
gactgtccatgtactactgg

SEQ ID NO: 119447 - DNA, 20 bp, human
gccccgcccccagtagtaca

SEQ ID NO: 119448 - DNA, 20 bp, human
gccagcgtggaattctgacg

SEQ ID NO: 119449 - DNA, 20 bp, human
ggtccatgtactactggggg

SEQ ID NO: 119450 - DNA, 20 bp, human
ggtacatggacagttccgat

SEQ ID NO: 119451 - DNA, 20 bp, human
gggaactgtccatgtactac

SEQ ID NO: 119452 - DNA, 20 bp, human
ggaattccacgctggccaat

SEQ ID NO: 119453 - DNA, 20 bp, human
ggaattctgacgcggcttct

SEQ ID NO: 119454 - DNA, 20 bp, human
gtccgcccctgcggccggcg

SEQ ID NO: 119455 - DNA, 20 bp, human
gttttatccgcccctgcggc

SEQ ID NO: 119456 - DNA, 20 bp, human
ggcctagtcaaagttaagag

SEQ ID NO: 119457 - DNA, 20 bp, human
gtcagcgcggttcaaatccc

SEQ ID NO: 119458 - DNA, 20 bp, human
ggccactcttaactttgact

SEQ ID NO: 119459 - DNA, 20 bp, human
ggaaccgcgctgacgaagtt

SEQ ID NO: 119460 - DNA, 20 bp, human
gaaagttaagagtggcgcca

SEQ ID NO: 119461 - DNA, 20 bp, human
gtcgaaatcccggcgatact

SEQ ID NO: 119462 - DNA, 20 bp, human
gtcgtaatcgacgccctgag

SEQ ID NO: 119463 - DNA, 20 bp, human
gcccggcgatactcggaaga

SEQ ID NO: 119464 - DNA, 20 bp, human
gcggtgcgaagggaccgaga

SEQ ID NO: 119465 - DNA, 20 bp, human
gggtctccgggccaacctga

SEQ ID NO: 119466 - DNA, 20 bp, human
gccatccccggatccttcgt

SEQ ID NO: 119467 - DNA, 20 bp, human
gcagcccctcgggtgagtgt

SEQ ID NO: 119468 - DNA, 20 bp, human
gggccgggccaggctagacg

SEQ ID NO: 119469 - DNA, 20 bp, human
gggccgccgcctcacaggac

SEQ ID NO: 119470 - DNA, 20 bp, human
gtaggtgggtagcaggacgt

SEQ ID NO: 119471 - DNA, 20 bp, human
ggccgcccggggactctcag

SEQ ID NO: 119472 - DNA, 20 bp, human
ggcctcccgccggtcctgtg

SEQ ID NO: 119473 - DNA, 20 bp, human
gcgccgcctcacaggaccgg

SEQ ID NO: 119474 - DNA, 20 bp, human
gcagcggggcgggcgaagga

SEQ ID NO: 119475 - DNA, 20 bp, human
gggccccgacactcacccga

SEQ ID NO: 119476 - DNA, 20 bp, human
gcggaccactgcagactgag

SEQ ID NO: 119477 - DNA, 20 bp, human
gaccactgcagactgagcgg

SEQ ID NO: 119478 - DNA, 20 bp, human
gactgagcggtggaccgaat

SEQ ID NO: 119479 - DNA, 20 bp, human
gctgctcgttgaggtaatac

SEQ ID NO: 119480 - DNA, 20 bp, human
gtaagccagcggtcccaatt

SEQ ID NO: 119481 - DNA, 20 bp, human
gtcagagcccctttacccta

SEQ ID NO: 119482 - DNA, 20 bp, human
gatgatcgcttataagccag

SEQ ID NO: 119483 - DNA, 20 bp, human
gtggaccgaattgggaccgc

SEQ ID NO: 119484 - DNA, 20 bp, human
gggtacacggcgttagaggg

SEQ ID NO: 119485 - DNA, 20 bp, human
gctggatgtaaaagagggga

SEQ ID NO: 119486 - DNA, 20 bp, human
gtagggctgatgttgaggga

SEQ ID NO: 119487 - DNA, 20 bp, human
gcccaggtgtgatgtccctg

SEQ ID NO: 119488 - DNA, 20 bp, human
gatgttgagggagggagcac

SEQ ID NO: 119489 - DNA, 20 bp, human
gccctctaaacactatggaa

SEQ ID NO: 119490 - DNA, 20 bp, human
gaaatggaggtgagcctgta

SEQ ID NO: 119491 - DNA, 20 bp, human
ggataatgccccatccctac

SEQ ID NO: 119492 - DNA, 20 bp, human
gggaagctgccagacagtgg

SEQ ID NO: 119493 - DNA, 20 bp, human
ggtggcccagggagaatgac

SEQ ID NO: 119494 - DNA, 20 bp, human
gttccaggtgcctgaagaca

SEQ ID NO: 119495 - DNA, 20 bp, human
ggccctataagctgtcccca

SEQ ID NO: 119496 - DNA, 20 bp, human
gagaaaggggacgggaagta

SEQ ID NO: 119497 - DNA, 20 bp, human
gggaatctgtccacaccagt

SEQ ID NO: 119498 - DNA, 20 bp, human
gactgagtcttcctaagaaa

SEQ ID NO: 119499 - DNA, 20 bp, human
ggtcttcctaagaaagggga

SEQ ID NO: 119500 - DNA, 20 bp, human
gtcttaggaagactcagtcc

SEQ ID NO: 119501 - DNA, 20 bp, human
gggaagtaaggctggcctac

SEQ ID NO: 119502 - DNA, 20 bp, human
gaggggacgggaagtaaggc

SEQ ID NO: 119503 - DNA, 20 bp, human
gtaatagcctggatcagctg

SEQ ID NO: 119504 - DNA, 20 bp, human
ggaatggcctcagctgatcc

SEQ ID NO: 119505 - DNA, 20 bp, human
gaagcagtccttgtgccccc

SEQ ID NO: 119506 - DNA, 20 bp, human
ggctgatgttgagggagcac

SEQ ID NO: 119507 - DNA, 20 bp, human
gccctctaaacactatggaa

SEQ ID NO: 119508 - DNA, 20 bp, human
gaaatggaggtgagcctgta

SEQ ID NO: 119509 - DNA, 20 bp, human
ggataatgccccatccctac

SEQ ID NO: 119510 - DNA, 20 bp, human
ggtggcccagggagaatgac

SEQ ID NO: 119511 - DNA, 20 bp, human
gggaagctgccagacagtgg

SEQ ID NO: 119512 - DNA, 20 bp, human
gttccaggtgcctgaagaca

SEQ ID NO: 119513 - DNA, 20 bp, human
ggacctgtccccctctagaa

SEQ ID NO: 119514 - DNA, 20 bp, human
gctagttcttagagaggagt

SEQ ID NO: 119515 - DNA, 20 bp, human
ggccctataagctgtcccca

SEQ ID NO: 119516 - DNA, 20 bp, human
ggagctggcggtccgagctg

SEQ ID NO: 119517 - DNA, 20 bp, human
gcccccggttgactaggagc

SEQ ID NO: 119518 - DNA, 20 bp, human
ggccccggcagcaccaacta

SEQ ID NO: 119519 - DNA, 20 bp, human
ggatgaagcccagacctgca

SEQ ID NO: 119520 - DNA, 20 bp, human
gagaggtccttgagaagggg

SEQ ID NO: 119521 - DNA, 20 bp, human
gcacgcccagacccagactg

SEQ ID NO: 119522 - DNA, 20 bp, human
gggtctgggcttcatcgcgt

SEQ ID NO: 119523 - DNA, 20 bp, human
ggaagacgaccagacaactt

SEQ ID NO: 119524 - DNA, 20 bp, human
gtgagactccgcaccaacgt

SEQ ID NO: 119525 - DNA, 20 bp, human
gacgaggcccccggttgact

SEQ ID NO: 119526 - DNA, 20 bp, human
gaccagcaaaggctaaagag

SEQ ID NO: 119527 - DNA, 20 bp, human
ggtcgttcaactaccagcaa

SEQ ID NO: 119528 - DNA, 20 bp, human
ggcttccccagtaaggacag

SEQ ID NO: 119529 - DNA, 20 bp, human
gtggtcagagacagcctctc

SEQ ID NO: 119530 - DNA, 20 bp, human
ggcatagagcactaaagtac

SEQ ID NO: 119531 - DNA, 20 bp, human
gggactgggcttccccagta

SEQ ID NO: 119532 - DNA, 20 bp, human
ggggtcactacgcaatggga

SEQ ID NO: 119533 - DNA, 20 bp, human
ggcattgggagtgacttaag

SEQ ID NO: 119534 - DNA, 20 bp, human
gtcagcgttctggctgtcct

SEQ ID NO: 119535 - DNA, 20 bp, human
ggctaaatgcattagactag

SEQ ID NO: 119536 - DNA, 20 bp, human
gtcctgagcgcttgggagtt

SEQ ID NO: 119537 - DNA, 20 bp, human
gatgccacagcgaagatcaa

SEQ ID NO: 119538 - DNA, 20 bp, human
gcacagcgaagatcaagggc

SEQ ID NO: 119539 - DNA, 20 bp, human
gctggacgcagtaaaaaata

SEQ ID NO: 119540 - DNA, 20 bp, human
ggagtgagtgccctgctcgt

SEQ ID NO: 119541 - DNA, 20 bp, human
ggcccggcgtagggacactt

SEQ ID NO: 119542 - DNA, 20 bp, human
gaggttgtttgccggcgtag

SEQ ID NO: 119543 - DNA, 20 bp, human
gtcagggcagcccacgagca

SEQ ID NO: 119544 - DNA, 20 bp, human
ggccgccaaacctaactgac

SEQ ID NO: 119545 - DNA, 20 bp, human
ggcggacgccgggcccctag

SEQ ID NO: 119546 - DNA, 20 bp, human
gggagcagtactccaagccc

SEQ ID NO: 119547 - DNA, 20 bp, human
gtgcctgaccctgagtgtca

SEQ ID NO: 119548 - DNA, 20 bp, human
ggaaagaaagggctgtgtca

SEQ ID NO: 119549 - DNA, 20 bp, human
gctccttgacactcagggtc

SEQ ID NO: 119550 - DNA, 20 bp, human
gccactccccacctgacccg

SEQ ID NO: 119551 - DNA, 20 bp, human
ggggatggcacaggatgttg

SEQ ID NO: 119552 - DNA, 20 bp, human
gatggggcagctgaaagaaa

SEQ ID NO: 119553 - DNA, 20 bp, human
gtgggtgccccgggtcaggt

SEQ ID NO: 119554 - DNA, 20 bp, human
gggtcctgggcttaaagcct

SEQ ID NO: 119555 - DNA, 20 bp, human
gttcaaggcagtccatgtct

SEQ ID NO: 119556 - DNA, 20 bp, human
ggcttcgctagcagacgcag

SEQ ID NO: 119557 - DNA, 20 bp, human
gaggccgccagtcgaggacg

SEQ ID NO: 119558 - DNA, 20 bp, human
gccgccagtcgaggacgagg

SEQ ID NO: 119559 - DNA, 20 bp, human
gtgagggaccagggtcgcga

SEQ ID NO: 119560 - DNA, 20 bp, human
gagggtcgcgagggctgtgg

SEQ ID NO: 119561 - DNA, 20 bp, human
ggaggcgaggccgccagtcg

SEQ ID NO: 119562 - DNA, 20 bp, human
ggttctcaaaggaacaacta

SEQ ID NO: 119563 - DNA, 20 bp, human
gctgctgcctgagtccaggc

SEQ ID NO: 119564 - DNA, 20 bp, human
gagggctcaaaggttctcaa

SEQ ID NO: 119565 - DNA, 20 bp, human
ggctagcagacgcagaggcg

SEQ ID NO: 119566 - DNA, 20 bp, human
gccttgaccctaggtaatgt

SEQ ID NO: 119567 - DNA, 20 bp, human
gaggtaatgtaggccaaaaa

SEQ ID NO: 119568 - DNA, 20 bp, human
gtttgtggcaagattctgag

SEQ ID NO: 119569 - DNA, 20 bp, human
gtcaaggtttagggattcat

SEQ ID NO: 119570 - DNA, 20 bp, human
ggaggggaagtgtagctccc

SEQ ID NO: 119571 - DNA, 20 bp, human
gacctaattggaagaagact

SEQ ID NO: 119572 - DNA, 20 bp, human
gagaagacttggaaccaacc

SEQ ID NO: 119573 - DNA, 20 bp, human
gatccctaaaccttgaccct

SEQ ID NO: 119574 - DNA, 20 bp, human
ggcctcactcccaagtacct

SEQ ID NO: 119575 - DNA, 20 bp, human
ggtttagggattcataggaa

SEQ ID NO: 119576 - DNA, 20 bp, human
ggaaaacgtagaattcccag

SEQ ID NO: 119577 - DNA, 20 bp, human
gcgtagaattcccagaggta

SEQ ID NO: 119578 - DNA, 20 bp, human
gaagaggagggtttgaatgg

SEQ ID NO: 119579 - DNA, 20 bp, human
gaacacacatccctacctct

SEQ ID NO: 119580 - DNA, 20 bp, human
gcactgaataccatagaaca

SEQ ID NO: 119581 - DNA, 20 bp, human
gcagaagaggagggtttgaa

SEQ ID NO: 119582 - DNA, 20 bp, human
gtacgttttcaagatcccag

SEQ ID NO: 119583 - DNA, 20 bp, human
gtgggcattgccttgttcta

SEQ ID NO: 119584 - DNA, 20 bp, human
gtgttagagagggaaatgtg

SEQ ID NO: 119585 - DNA, 20 bp, human
gttcatcacaaaccacacaa

SEQ ID NO: 119586 - DNA, 20 bp, human
gaggtaatgtaggccaaaaa

SEQ ID NO: 119587 - DNA, 20 bp, human
gtttgtggcaagattctgag

SEQ ID NO: 119588 - DNA, 20 bp, human
gccttgaccctaggtaatgt

SEQ ID NO: 119589 - DNA, 20 bp, human
ggaggggaagtgtagctccc

SEQ ID NO: 119590 - DNA, 20 bp, human
gagaagacttggaaccaacc

SEQ ID NO: 119591 - DNA, 20 bp, human
gtcaaggtttagggattcat

SEQ ID NO: 119592 - DNA, 20 bp, human
gacctaattggaagaagact

SEQ ID NO: 119593 - DNA, 20 bp, human
gatccctaaaccttgaccct

SEQ ID NO: 119594 - DNA, 20 bp, human
ggcctcactcccaagtacct

SEQ ID NO: 119595 - DNA, 20 bp, human
gttgttgtaatttacctaat

SEQ ID NO: 119596 - DNA, 20 bp, human
ggaaaacgtagaattcccag

SEQ ID NO: 119597 - DNA, 20 bp, human
gcgtagaattcccagaggta

SEQ ID NO: 119598 - DNA, 20 bp, human
gcactgaataccatagaaca

SEQ ID NO: 119599 - DNA, 20 bp, human
gaagaggagggtttgaatgg

SEQ ID NO: 119600 - DNA, 20 bp, human
gaacacacatccctacctct

SEQ ID NO: 119601 - DNA, 20 bp, human
gcagaagaggagggtttgaa

SEQ ID NO: 119602 - DNA, 20 bp, human
gtgttagagagggaaatgtg

SEQ ID NO: 119603 - DNA, 20 bp, human
gtgggcattgccttgttcta

SEQ ID NO: 119604 - DNA, 20 bp, human
gtacgttttcaagatcccag

SEQ ID NO: 119605 - DNA, 20 bp, human
gttcatcacaaaccacacaa

SEQ ID NO: 119606 - DNA, 20 bp, human
gccgccagtcgaggacgagg

SEQ ID NO: 119607 - DNA, 20 bp, human
ggcttcgctagcagacgcag

SEQ ID NO: 119608 - DNA, 20 bp, human
gaggccgccagtcgaggacg

SEQ ID NO: 119609 - DNA, 20 bp, human
gtgagggaccagggtcgcga

SEQ ID NO: 119610 - DNA, 20 bp, human
gagggtcgcgagggctgtgg

SEQ ID NO: 119611 - DNA, 20 bp, human
ggaggcgaggccgccagtcg

SEQ ID NO: 119612 - DNA, 20 bp, human
gagggctcaaaggttctcaa

SEQ ID NO: 119613 - DNA, 20 bp, human
ggttctcaaaggaacaacta

SEQ ID NO: 119614 - DNA, 20 bp, human
gctgctgcctgagtccaggc

SEQ ID NO: 119615 - DNA, 20 bp, human
gattaagtaccagggctcaa

SEQ ID NO: 119616 - DNA, 20 bp, human
gtgaggagggctgctgacga

SEQ ID NO: 119617 - DNA, 20 bp, human
gctcttgaggagaatctgtg

SEQ ID NO: 119618 - DNA, 20 bp, human
gatctgtgtggcctggggac

SEQ ID NO: 119619 - DNA, 20 bp, human
gtgtacactagaggtggtag

SEQ ID NO: 119620 - DNA, 20 bp, human
gttccttggatgtacactag

SEQ ID NO: 119621 - DNA, 20 bp, human
gcttggatgtacactagagg

SEQ ID NO: 119622 - DNA, 20 bp, human
gtggcctggggacgggagtt

SEQ ID NO: 119623 - DNA, 20 bp, human
gtgtgggttagggtaaggtg

SEQ ID NO: 119624 - DNA, 20 bp, human
gtggagtctcaggtctcaca

SEQ ID NO: 119625 - DNA, 20 bp, human
gtgttatgtgggttagggta

SEQ ID NO: 119626 - DNA, 20 bp, human
gcattctcctggcagcgtga

SEQ ID NO: 119627 - DNA, 20 bp, human
gggtcacttactgtcttagt

SEQ ID NO: 119628 - DNA, 20 bp, human
gtgacaccaaggcttcaatt

SEQ ID NO: 119629 - DNA, 20 bp, human
gaatgctggaagtggaataa

SEQ ID NO: 119630 - DNA, 20 bp, human
ggaagccttggtgtcagtga

SEQ ID NO: 119631 - DNA, 20 bp, human
gactcccctcactgacacca

SEQ ID NO: 119632 - DNA, 20 bp, human
gcacttactgtcttagttgg

SEQ ID NO: 119633 - DNA, 20 bp, human
gaacatgaggaaatggttca

SEQ ID NO: 119634 - DNA, 20 bp, human
gtctcgttgaggtctgcatt

SEQ ID NO: 119635 - DNA, 20 bp, human
gcacagtgagtatctcgttg

SEQ ID NO: 119636 - DNA, 20 bp, human
ggtaagacacacaaaactga

SEQ ID NO: 119637 - DNA, 20 bp, human
gtagtacctcaactactcat

SEQ ID NO: 119638 - DNA, 20 bp, human
ggttagtcacaaaacactgt

SEQ ID NO: 119639 - DNA, 20 bp, human
ggaaatatgcttataagtta

SEQ ID NO: 119640 - DNA, 20 bp, human
gacacaaaactgagggtaaa

SEQ ID NO: 119641 - DNA, 20 bp, human
gagcatttccaggtttgttc

SEQ ID NO: 119642 - DNA, 20 bp, human
ggaagatacttagtttgaac

SEQ ID NO: 119643 - DNA, 20 bp, human
ggtagtttccccaacttata

SEQ ID NO: 119644 - DNA, 20 bp, human
gtttttccaatgagtagttg

SEQ ID NO: 119645 - DNA, 20 bp, human
gactcaatttccatataagt

SEQ ID NO: 119646 - DNA, 20 bp, human
gtgtagggcagcgccagcca

SEQ ID NO: 119647 - DNA, 20 bp, human
gcggctgcgaccccgctcca

SEQ ID NO: 119648 - DNA, 20 bp, human
ggtcctcggaccaggaccag

SEQ ID NO: 119649 - DNA, 20 bp, human
gcgccgcgcggaccgtggag

SEQ ID NO: 119650 - DNA, 20 bp, human
gtgcggtgggccaggatgtc

SEQ ID NO: 119651 - DNA, 20 bp, human
gcgcaggcgcccgtagaagg

SEQ ID NO: 119652 - DNA, 20 bp, human
gccccgctccacggtccgcg

SEQ ID NO: 119653 - DNA, 20 bp, human
gcttcgtgcgggacatgccg

SEQ ID NO: 119654 - DNA, 20 bp, human
gagcagagcccggcccagta

SEQ ID NO: 119655 - DNA, 20 bp, human
gcctcccgccgcgcggaccg

SEQ ID NO: 119656 - DNA, 20 bp, human
gggagccagtcagcagaccg

SEQ ID NO: 119657 - DNA, 20 bp, human
gaggccatggtaacctgggt

SEQ ID NO: 119658 - DNA, 20 bp, human
gccatatactgggaactagg

SEQ ID NO: 119659 - DNA, 20 bp, human
gcaggatgcggccagagaac

SEQ ID NO: 119660 - DNA, 20 bp, human
gattgttgcggatcaggatg

SEQ ID NO: 119661 - DNA, 20 bp, human
gcaggacgagctggatacgg

SEQ ID NO: 119662 - DNA, 20 bp, human
gaactagggggtacagacag

SEQ ID NO: 119663 - DNA, 20 bp, human
gcacccaacccaggttacca

SEQ ID NO: 119664 - DNA, 20 bp, human
gtggtccccggtctgctgac

SEQ ID NO: 119665 - DNA, 20 bp, human
gcagggaggccatggtaacc

SEQ ID NO: 119666 - DNA, 20 bp, human
gtggctggccccgctcccag

SEQ ID NO: 119667 - DNA, 20 bp, human
gtatagaagtcgcagagcag

SEQ ID NO: 119668 - DNA, 20 bp, human
ggcgctgcagaacaaggtgg

SEQ ID NO: 119669 - DNA, 20 bp, human
ggcggcgctgcagaacaagg

SEQ ID NO: 119670 - DNA, 20 bp, human
ggagcagcggcgtgaagtcg

SEQ ID NO: 119671 - DNA, 20 bp, human
gcggcccgcgcccttcgaag

SEQ ID NO: 119672 - DNA, 20 bp, human
gatctcctgggagctgccgt

SEQ ID NO: 119673 - DNA, 20 bp, human
gacacgaagaccacttcgaa

SEQ ID NO: 119674 - DNA, 20 bp, human
gtggccccgctcccagaggc

SEQ ID NO: 119675 - DNA, 20 bp, human
gccagagaccccagatacct

SEQ ID NO: 119676 - DNA, 20 bp, human
ggagccagttaagaactcac

SEQ ID NO: 119677 - DNA, 20 bp, human
gatgatctctcctatctggg

SEQ ID NO: 119678 - DNA, 20 bp, human
gaggtgagtaagcaaaacta

SEQ ID NO: 119679 - DNA, 20 bp, human
gactcaacctaacatctagt

SEQ ID NO: 119680 - DNA, 20 bp, human
gctctctccaactagatgtt

SEQ ID NO: 119681 - DNA, 20 bp, human
gtaggagagatcattaaaac

SEQ ID NO: 119682 - DNA, 20 bp, human
gttaatgatctctcctatct

SEQ ID NO: 119683 - DNA, 20 bp, human
ggtacctgtgagttcttaac

SEQ ID NO: 119684 - DNA, 20 bp, human
gctctcttactgacaaggat

SEQ ID NO: 119685 - DNA, 20 bp, human
gtaatcttgccagtggtcag

SEQ ID NO: 119686 - DNA, 20 bp, human
gtgagaacacgagaagatgg

SEQ ID NO: 119687 - DNA, 20 bp, human
gctgtgagaacacgagaaga

SEQ ID NO: 119688 - DNA, 20 bp, human
gttggaaagtaccacaccta

SEQ ID NO: 119689 - DNA, 20 bp, human
gggagaaaatactcatccat

SEQ ID NO: 119690 - DNA, 20 bp, human
ggtggcaaagagctaaatta

SEQ ID NO: 119691 - DNA, 20 bp, human
gagctaacgtcagggaaggg

SEQ ID NO: 119692 - DNA, 20 bp, human
gtactgccaagctaacgtca

SEQ ID NO: 119693 - DNA, 20 bp, human
gggtcctggtcaaaaatgtt

SEQ ID NO: 119694 - DNA, 20 bp, human
ggcacgctgtggccacaaat

SEQ ID NO: 119695 - DNA, 20 bp, human
ggtgtgatgcaaccctttag

SEQ ID NO: 119696 - DNA, 20 bp, human
gttttcccctacagaaaaaa

SEQ ID NO: 119697 - DNA, 20 bp, human
ggggaggggcttcgcagtct

SEQ ID NO: 119698 - DNA, 20 bp, human
gccggagcccaggctagtac

SEQ ID NO: 119699 - DNA, 20 bp, human
ggcgctgcggcgaccgaccg

SEQ ID NO: 119700 - DNA, 20 bp, human
ggagcccaggctagtaccgg

SEQ ID NO: 119701 - DNA, 20 bp, human
gaggcccgggtcgaaggcat

SEQ ID NO: 119702 - DNA, 20 bp, human
gggaggtgaggagacgtcgc

SEQ ID NO: 119703 - DNA, 20 bp, human
gtccgacccccggctacgat

SEQ ID NO: 119704 - DNA, 20 bp, human
gctccaccaatcgtagccgg

SEQ ID NO: 119705 - DNA, 20 bp, human
ggccccgccggtactagcct

SEQ ID NO: 119706 - DNA, 20 bp, human
gtatgccagtagcacactgg

SEQ ID NO: 119707 - DNA, 20 bp, human
ggggtgaaaggtgcttctag

SEQ ID NO: 119708 - DNA, 20 bp, human
ggaagccaccagtgtgctac

SEQ ID NO: 119709 - DNA, 20 bp, human
gcgccagagagtctatgtat

SEQ ID NO: 119710 - DNA, 20 bp, human
gggttgtgaatccatgctaa

SEQ ID NO: 119711 - DNA, 20 bp, human
gagatccctagtttatacat

SEQ ID NO: 119712 - DNA, 20 bp, human
gtgtaaaattgggaaggtga

SEQ ID NO: 119713 - DNA, 20 bp, human
gactagggatctggggtgaa

SEQ ID NO: 119714 - DNA, 20 bp, human
gttattttggtatagacaag

SEQ ID NO: 119715 - DNA, 20 bp, human
gaatgcccatgtataaacta

SEQ ID NO: 119716 - DNA, 20 bp, human
gggtgaccctcacagctcgg

SEQ ID NO: 119717 - DNA, 20 bp, human
ggccgggcgcctccgacctg

SEQ ID NO: 119718 - DNA, 20 bp, human
gcggccacccggggacgctc

SEQ ID NO: 119719 - DNA, 20 bp, human
ggtgtaccctccgggaacag

SEQ ID NO: 119720 - DNA, 20 bp, human
ggagcgctttgggtttccgg

SEQ ID NO: 119721 - DNA, 20 bp, human
ggctccagagcgtccccggg

SEQ ID NO: 119722 - DNA, 20 bp, human
gagcgcccgggactccactg

SEQ ID NO: 119723 - DNA, 20 bp, human
gaggtaggcgtgccaagccg

SEQ ID NO: 119724 - DNA, 20 bp, human
gggagactgagcaagtcctc

SEQ ID NO: 119725 - DNA, 20 bp, human
gttgtccgtgtcaggaaggt

SEQ ID NO: 119726 - DNA, 20 bp, human
gggatctacaggcgactcag

SEQ ID NO: 119727 - DNA, 20 bp, human
gggcaggactgaggacgcca

SEQ ID NO: 119728 - DNA, 20 bp, human
gcagcgctcggattccggga

SEQ ID NO: 119729 - DNA, 20 bp, human
gcgcgcagctctggccgggt

SEQ ID NO: 119730 - DNA, 20 bp, human
gggcgcagcgctcggattcc

SEQ ID NO: 119731 - DNA, 20 bp, human
gagccagggaccaccacgag

SEQ ID NO: 119732 - DNA, 20 bp, human
gcagcgcggcgcttccctcc

SEQ ID NO: 119733 - DNA, 20 bp, human
gcggccagagctgcgcggca

SEQ ID NO: 119734 - DNA, 20 bp, human
gcggaatagacgggatctac

SEQ ID NO: 119735 - DNA, 20 bp, human
ggttgccttagaggtcgaaa

SEQ ID NO: 119736 - DNA, 20 bp, human
gcgctctcgcccagatgtgc

SEQ ID NO: 119737 - DNA, 20 bp, human
gagcggcgccgctggagccg

SEQ ID NO: 119738 - DNA, 20 bp, human
gcggaccactcaccagatag

SEQ ID NO: 119739 - DNA, 20 bp, human
ggcgccgctggagccgaggg

SEQ ID NO: 119740 - DNA, 20 bp, human
ggcgcccccctcggctccag

SEQ ID NO: 119741 - DNA, 20 bp, human
gatctggtgagtggtccgag

SEQ ID NO: 119742 - DNA, 20 bp, human
ggtgcagggtagcctctatc

SEQ ID NO: 119743 - DNA, 20 bp, human
gtgcacagctggaccgaagg

SEQ ID NO: 119744 - DNA, 20 bp, human
gagcgaggggacgagagcgg

SEQ ID NO: 119745 - DNA, 20 bp, human
ggccatccccgggatgtcgg

SEQ ID NO: 119746 - DNA, 20 bp, human
gagactgcccgattcaggac

SEQ ID NO: 119747 - DNA, 20 bp, human
gctccttaggaaggtaagag

SEQ ID NO: 119748 - DNA, 20 bp, human
ggcgcctcgcgcccagtccg

SEQ ID NO: 119749 - DNA, 20 bp, human
gagagtgcccgtcctgaatc

SEQ ID NO: 119750 - DNA, 20 bp, human
ggcactctcctagcgcaagt

SEQ ID NO: 119751 - DNA, 20 bp, human
gtcctagcgcaagttggctg

SEQ ID NO: 119752 - DNA, 20 bp, human
gcccccgccgcgcctgaagt

SEQ ID NO: 119753 - DNA, 20 bp, human
gtaggaaggtaagagtggca

SEQ ID NO: 119754 - DNA, 20 bp, human
gcctgaagtcggctgcaagg

SEQ ID NO: 119755 - DNA, 20 bp, human
gggcccgtggctccttagga

SEQ ID NO: 119756 - DNA, 20 bp, human
gcacctgcgacgggtcgtac

SEQ ID NO: 119757 - DNA, 20 bp, human
gcgggtcgtacaggcacggt

SEQ ID NO: 119758 - DNA, 20 bp, human
gcgggaccctcagctagcgt

SEQ ID NO: 119759 - DNA, 20 bp, human
gcggagtgcccgcaaggctg

SEQ ID NO: 119760 - DNA, 20 bp, human
gcccccagagtggaaggagt

SEQ ID NO: 119761 - DNA, 20 bp, human
gaggggcgctatccgaagta

SEQ ID NO: 119762 - DNA, 20 bp, human
ggcgacgggtcgtacaggca

SEQ ID NO: 119763 - DNA, 20 bp, human
ggcactccgcataaggaaaa

SEQ ID NO: 119764 - DNA, 20 bp, human
gtgtcttctcatactccacg

SEQ ID NO: 119765 - DNA, 20 bp, human
ggaagtaggggtgctcactc

SEQ ID NO: 119766 - DNA, 20 bp, human
gctcgcgtctgcgtggagac

SEQ ID NO: 119767 - DNA, 20 bp, human
gactgcgccggaaagtcccc

SEQ ID NO: 119768 - DNA, 20 bp, human
gggcgagagcctcaccgcgg

SEQ ID NO: 119769 - DNA, 20 bp, human
gacaggcgagagcctcaccg

SEQ ID NO: 119770 - DNA, 20 bp, human
gacgggaaaagctaccacag

SEQ ID NO: 119771 - DNA, 20 bp, human
gccaccgaagcctctggtag

SEQ ID NO: 119772 - DNA, 20 bp, human
gcggcggcaactctaccacg

SEQ ID NO: 119773 - DNA, 20 bp, human
gaactctaccacgtggacaa

SEQ ID NO: 119774 - DNA, 20 bp, human
ggagtaagcctccaagaagg

SEQ ID NO: 119775 - DNA, 20 bp, human
gactttccggcgcagttccg

SEQ ID NO: 119776 - DNA, 20 bp, human
gtgagctgggaaatagcgag

SEQ ID NO: 119777 - DNA, 20 bp, human
gcttccgggagagaatggga

SEQ ID NO: 119778 - DNA, 20 bp, human
gagcgagaggcggggatgtt

SEQ ID NO: 119779 - DNA, 20 bp, human
ggctgggcgccggactccag

SEQ ID NO: 119780 - DNA, 20 bp, human
ggctacttccgggagagaat

SEQ ID NO: 119781 - DNA, 20 bp, human
gccggaaaggaccctgagct

SEQ ID NO: 119782 - DNA, 20 bp, human
ggctgggaaatagcgagagg

SEQ ID NO: 119783 - DNA, 20 bp, human
gcgttcgtgccggagaatta

SEQ ID NO: 119784 - DNA, 20 bp, human
ggacggaccgagctacttcc

SEQ ID NO: 119785 - DNA, 20 bp, human
ggccccgtacatgaatgaga

SEQ ID NO: 119786 - DNA, 20 bp, human
gagactggagccccccgggt

SEQ ID NO: 119787 - DNA, 20 bp, human
ggagagacagagacagaccg

SEQ ID NO: 119788 - DNA, 20 bp, human
ggcgcctgggaggagaagtg

SEQ ID NO: 119789 - DNA, 20 bp, human
gcccctcaatcccacccggg

SEQ ID NO: 119790 - DNA, 20 bp, human
ggggcggagcccggcatggg

SEQ ID NO: 119791 - DNA, 20 bp, human
gtccgggcggagcccggcat

SEQ ID NO: 119792 - DNA, 20 bp, human
gcagcccagaaggtagcagt

SEQ ID NO: 119793 - DNA, 20 bp, human
gtacggtgatggagaacctg

SEQ ID NO: 119794 - DNA, 20 bp, human
gcccagggtagcaggacaag

SEQ ID NO: 119795 - DNA, 20 bp, human
gggggcctcccaaatcctgg

SEQ ID NO: 119796 - DNA, 20 bp, human
ggagggcatagctaatgggt

SEQ ID NO: 119797 - DNA, 20 bp, human
gtctctcacggttgatctca

SEQ ID NO: 119798 - DNA, 20 bp, human
gctgtcagagccctctctca

SEQ ID NO: 119799 - DNA, 20 bp, human
gatctagtgatgaagaatct

SEQ ID NO: 119800 - DNA, 20 bp, human
ggagcatctttttggctgaa

SEQ ID NO: 119801 - DNA, 20 bp, human
gtgctaggaagatgcagtgg

SEQ ID NO: 119802 - DNA, 20 bp, human
gagatgcagtggcggaagac

SEQ ID NO: 119803 - DNA, 20 bp, human
ggaaaagagggcatagctaa

SEQ ID NO: 119804 - DNA, 20 bp, human
gtttggagcagcccagcttg

SEQ ID NO: 119805 - DNA, 20 bp, human
gaagtgcattgtgtctggat

SEQ ID NO: 119806 - DNA, 20 bp, human
ggggcaggaagagctcgtcg

SEQ ID NO: 119807 - DNA, 20 bp, human
ggcggtagcagcggtcgaag

SEQ ID NO: 119808 - DNA, 20 bp, human
ggagctcgtcgcggtagcag

SEQ ID NO: 119809 - DNA, 20 bp, human
gggaccaagctccagagggc

SEQ ID NO: 119810 - DNA, 20 bp, human
gagctgtagccagaagtagg

SEQ ID NO: 119811 - DNA, 20 bp, human
gcacccctagctacaacccc

SEQ ID NO: 119812 - DNA, 20 bp, human
ggacccaccccgcacggctc

SEQ ID NO: 119813 - DNA, 20 bp, human
gatcgaagcctcgggtgcag

SEQ ID NO: 119814 - DNA, 20 bp, human
gacggcctccttcctccagg

SEQ ID NO: 119815 - DNA, 20 bp, human
gtgcccggggttgtagctag

SEQ ID NO: 119816 - DNA, 20 bp, human
gtgagagagaagtaaaggtg

SEQ ID NO: 119817 - DNA, 20 bp, human
gggaagaagtgtggaggcat

SEQ ID NO: 119818 - DNA, 20 bp, human
gggcatgggagggttctcat

SEQ ID NO: 119819 - DNA, 20 bp, human
gaacccagcaaggaaatgga

SEQ ID NO: 119820 - DNA, 20 bp, human
gccagggtcattaagaagga

SEQ ID NO: 119821 - DNA, 20 bp, human
gaccagggagactcccagga

SEQ ID NO: 119822 - DNA, 20 bp, human
gcagggctgtagcctgacaa

SEQ ID NO: 119823 - DNA, 20 bp, human
gcctgacttgggagatggat

SEQ ID NO: 119824 - DNA, 20 bp, human
gttcccttagcccaacacca

SEQ ID NO: 119825 - DNA, 20 bp, human
gcaggaccagggagactccc

SEQ ID NO: 119826 - DNA, 20 bp, human
ggcacctcgcggcccttaaa

SEQ ID NO: 119827 - DNA, 20 bp, human
gtcggcggtgaaggagacga

SEQ ID NO: 119828 - DNA, 20 bp, human
gggcggccccgaggcggaga

SEQ ID NO: 119829 - DNA, 20 bp, human
gtcgagctgcgcaagcccga

SEQ ID NO: 119830 - DNA, 20 bp, human
gctgcaggcggacagcgacg

SEQ ID NO: 119831 - DNA, 20 bp, human
gaggagacgagggtgccgtc

SEQ ID NO: 119832 - DNA, 20 bp, human
ggtgccaccccggcgagtga

SEQ ID NO: 119833 - DNA, 20 bp, human
ggccccggcgcgccgcgtgg

SEQ ID NO: 119834 - DNA, 20 bp, human
gcgggaaggcgcatccccgg

SEQ ID NO: 119835 - DNA, 20 bp, human
gcgagctgcgggtccgcgtg

SEQ ID NO: 119836 - DNA, 20 bp, human
gggaggcgtgtcttagggat

SEQ ID NO: 119837 - DNA, 20 bp, human
gtccaggtgaagggtgactt

SEQ ID NO: 119838 - DNA, 20 bp, human
gccttcacctggaaaggagt

SEQ ID NO: 119839 - DNA, 20 bp, human
ggggtgacttgggtacgttg

SEQ ID NO: 119840 - DNA, 20 bp, human
ggagcgccccgctccgtcag

SEQ ID NO: 119841 - DNA, 20 bp, human
ggaggaagaacgcttaggtt

SEQ ID NO: 119842 - DNA, 20 bp, human
gaaggaggaggcgtgtctta

SEQ ID NO: 119843 - DNA, 20 bp, human
gcctccccgcaccctcccat

SEQ ID NO: 119844 - DNA, 20 bp, human
ggaagaacgcttaggttcgg

SEQ ID NO: 119845 - DNA, 20 bp, human
gaatcggccttgctccggag

SEQ ID NO: 119846 - DNA, 20 bp, human
gacttcagcgggaagtaggg

SEQ ID NO: 119847 - DNA, 20 bp, human
ggataaaagcaaacaggtct

SEQ ID NO: 119848 - DNA, 20 bp, human
gttggacacacacacagggt

SEQ ID NO: 119849 - DNA, 20 bp, human
gcacagggtaggagctacct

SEQ ID NO: 119850 - DNA, 20 bp, human
gtgtgtgtccaaggtggtaa

SEQ ID NO: 119851 - DNA, 20 bp, human
gcctgtgtgtgtgtccaagg

SEQ ID NO: 119852 - DNA, 20 bp, human
gtaaacttcagcgggaagta

SEQ ID NO: 119853 - DNA, 20 bp, human
gtctgagatccatcattgac

SEQ ID NO: 119854 - DNA, 20 bp, human
ggggtcacttgttaataata

SEQ ID NO: 119855 - DNA, 20 bp, human
gtgaaggaaaggtgcttccg

SEQ ID NO: 119856 - DNA, 20 bp, human
gcagtgaatggtaggatggg

SEQ ID NO: 119857 - DNA, 20 bp, human
gctgccggcaagacagtgaa

SEQ ID NO: 119858 - DNA, 20 bp, human
ggcaggcaccgaggacagct

SEQ ID NO: 119859 - DNA, 20 bp, human
ggaggcaggagattccacgg

SEQ ID NO: 119860 - DNA, 20 bp, human
gcggtgcctgctcagaagct

SEQ ID NO: 119861 - DNA, 20 bp, human
gagtggccatagtgagtcca

SEQ ID NO: 119862 - DNA, 20 bp, human
ggcagccagctgagagcaat

SEQ ID NO: 119863 - DNA, 20 bp, human
ggcctgctcagaagctgggt

SEQ ID NO: 119864 - DNA, 20 bp, human
ggctgagagcaatgggaaat

SEQ ID NO: 119865 - DNA, 20 bp, human
gtgtgggcctcgcacataat

SEQ ID NO: 119866 - DNA, 20 bp, human
gccgaacatacgagccaggt

SEQ ID NO: 119867 - DNA, 20 bp, human
gccgcccggcgcaggtgcaa

SEQ ID NO: 119868 - DNA, 20 bp, human
gggggtgctgtacaagtcca

SEQ ID NO: 119869 - DNA, 20 bp, human
gacgaacctgtccagcgcag

SEQ ID NO: 119870 - DNA, 20 bp, human
gggacgcttaagcctcacat

SEQ ID NO: 119871 - DNA, 20 bp, human
ggggcttaagagtacctacc

SEQ ID NO: 119872 - DNA, 20 bp, human
gccgcgcgtggcgtgaaacg

SEQ ID NO: 119873 - DNA, 20 bp, human
gcgggtgctgaaaactgtca

SEQ ID NO: 119874 - DNA, 20 bp, human
gcaaggtgaggtcccacctc

SEQ ID NO: 119875 - DNA, 20 bp, human
ggtgtccaaaggggagtcct

SEQ ID NO: 119876 - DNA, 20 bp, human
gggtactctcgggacagaga

SEQ ID NO: 119877 - DNA, 20 bp, human
ggcccagcagcggtactctc

SEQ ID NO: 119878 - DNA, 20 bp, human
gggacgtggactctgatact

SEQ ID NO: 119879 - DNA, 20 bp, human
gaggtagtcaaggtaagact

SEQ ID NO: 119880 - DNA, 20 bp, human
ggaccgtggaggagtttctg

SEQ ID NO: 119881 - DNA, 20 bp, human
gggactccttcgtggctcag

SEQ ID NO: 119882 - DNA, 20 bp, human
gtccaggctggactccttcg

SEQ ID NO: 119883 - DNA, 20 bp, human
gctagggataaggaggacag

SEQ ID NO: 119884 - DNA, 20 bp, human
gcttccttccactcccggtg

SEQ ID NO: 119885 - DNA, 20 bp, human
gtgcagccactgagccacga

SEQ ID NO: 119886 - DNA, 20 bp, human
gacagcgcctgaggacaacc

SEQ ID NO: 119887 - DNA, 20 bp, human
ggcgctgtcaggtaccgtct

SEQ ID NO: 119888 - DNA, 20 bp, human
gcgccaaccccaggaaccaa

SEQ ID NO: 119889 - DNA, 20 bp, human
gcaggacagcggcgcccaga

SEQ ID NO: 119890 - DNA, 20 bp, human
gcctcctacccggaaccccg

SEQ ID NO: 119891 - DNA, 20 bp, human
gctgcgctcgcggcctgtgg

SEQ ID NO: 119892 - DNA, 20 bp, human
ggaggacaaccgggtacacg

SEQ ID NO: 119893 - DNA, 20 bp, human
gccccgcctgccagaccggg

SEQ ID NO: 119894 - DNA, 20 bp, human
ggcggcggctccgcccggtc

SEQ ID NO: 119895 - DNA, 20 bp, human
ggcgccggccggagactcca

SEQ ID NO: 119896 - DNA, 20 bp, human
ggccttagcagtgctctcgg

SEQ ID NO: 119897 - DNA, 20 bp, human
ggtgcggagttggatttggg

SEQ ID NO: 119898 - DNA, 20 bp, human
gatcgcgccggggacgaggt

SEQ ID NO: 119899 - DNA, 20 bp, human
gtcctggtttcggaccccag

SEQ ID NO: 119900 - DNA, 20 bp, human
ggagcactgctaaggccggg

SEQ ID NO: 119901 - DNA, 20 bp, human
ggccgctggggtccgaaacc

SEQ ID NO: 119902 - DNA, 20 bp, human
gttttgcgaacggcgagcag

SEQ ID NO: 119903 - DNA, 20 bp, human
ggcttctggaagcttcggac

SEQ ID NO: 119904 - DNA, 20 bp, human
ggcaaatcaggcgccccgga

SEQ ID NO: 119905 - DNA, 20 bp, human
gcgcgcgccggggacctatc

SEQ ID NO: 119906 - DNA, 20 bp, human
gcgctcgctgaggcaaaagg

SEQ ID NO: 119907 - DNA, 20 bp, human
gtggaggcaggcgctcgctg

SEQ ID NO: 119908 - DNA, 20 bp, human
gctcggcccgcggcctgaca

SEQ ID NO: 119909 - DNA, 20 bp, human
gaggcgctcgctgaggcaaa

SEQ ID NO: 119910 - DNA, 20 bp, human
gtgcgggctaagtccctgtc

SEQ ID NO: 119911 - DNA, 20 bp, human
ggcggccggggagggtcagt

SEQ ID NO: 119912 - DNA, 20 bp, human
gcgcgcggggtcgatctctg

SEQ ID NO: 119913 - DNA, 20 bp, human
gaggagaaggcccggatgag

SEQ ID NO: 119914 - DNA, 20 bp, human
gagggctgaggaccggacta

SEQ ID NO: 119915 - DNA, 20 bp, human
gatgggcccggctgaagagg

SEQ ID NO: 119916 - DNA, 20 bp, human
gtgggaagatacacagtacc

SEQ ID NO: 119917 - DNA, 20 bp, human
ggatacacagtaccaggctc

SEQ ID NO: 119918 - DNA, 20 bp, human
gttatcttggaatctgaggt

SEQ ID NO: 119919 - DNA, 20 bp, human
gcccctcttgatataagaaa

SEQ ID NO: 119920 - DNA, 20 bp, human
gggcgtatggtgaccagatc

SEQ ID NO: 119921 - DNA, 20 bp, human
gtggtgaccagatcgggtag

SEQ ID NO: 119922 - DNA, 20 bp, human
gcaaagtgaagttcacaggt

SEQ ID NO: 119923 - DNA, 20 bp, human
gggcccaggaacatagaaac

SEQ ID NO: 119924 - DNA, 20 bp, human
gtagtttatcttggaatctg

SEQ ID NO: 119925 - DNA, 20 bp, human
gtgaaaaactgccttgtaag

SEQ ID NO: 119926 - DNA, 20 bp, human
gcgccagggcacggtcatcg

SEQ ID NO: 119927 - DNA, 20 bp, human
gcgctggtggaaggtaccgc

SEQ ID NO: 119928 - DNA, 20 bp, human
gctggcggccaggaaagcga

SEQ ID NO: 119929 - DNA, 20 bp, human
gcgggcgccgccatgttcac

SEQ ID NO: 119930 - DNA, 20 bp, human
gggcgcgccgcaggcagcac

SEQ ID NO: 119931 - DNA, 20 bp, human
gtgagggaggaccccggcgt

SEQ ID NO: 119932 - DNA, 20 bp, human
gggcacagaatgagacctga

SEQ ID NO: 119933 - DNA, 20 bp, human
gcggccgtggtggagggaga

SEQ ID NO: 119934 - DNA, 20 bp, human
gtgcctgcggcgcgccggta

SEQ ID NO: 119935 - DNA, 20 bp, human
gacagaatgagacctgaggg

SEQ ID NO: 119936 - DNA, 20 bp, human
gacctggcccttccggcgct

SEQ ID NO: 119937 - DNA, 20 bp, human
gcagaaaccgcttggggtcc

SEQ ID NO: 119938 - DNA, 20 bp, human
gccggaagggccaggtctca

SEQ ID NO: 119939 - DNA, 20 bp, human
ggggtgaacgcagggatcca

SEQ ID NO: 119940 - DNA, 20 bp, human
gggcgggaggggctacaagt

SEQ ID NO: 119941 - DNA, 20 bp, human
ggcggctccgagcgccggaa

SEQ ID NO: 119942 - DNA, 20 bp, human
ggagtcctggacgcccacct

SEQ ID NO: 119943 - DNA, 20 bp, human
gacgcaggcgtcctgacgtg

SEQ ID NO: 119944 - DNA, 20 bp, human
gggatccaggctgcatcaag

SEQ ID NO: 119945 - DNA, 20 bp, human
ggaacagcgggagagccgta

SEQ ID NO: 119946 - DNA, 20 bp, human
gcccagggccggagcaggct

SEQ ID NO: 119947 - DNA, 20 bp, human
gcggagcaggctcggctcag

SEQ ID NO: 119948 - DNA, 20 bp, human
gtcctccagggtgaaggaca

SEQ ID NO: 119949 - DNA, 20 bp, human
gcccagtgacctgccgaggt

SEQ ID NO: 119950 - DNA, 20 bp, human
gagcgtgacacccaggaaca

SEQ ID NO: 119951 - DNA, 20 bp, human
gggtcggcagcacagagctc

SEQ ID NO: 119952 - DNA, 20 bp, human
gagatgaagaccctgttcct

SEQ ID NO: 119953 - DNA, 20 bp, human
gcaggccgagcgtgacaccc

SEQ ID NO: 119954 - DNA, 20 bp, human
ggctcccagcccccagtgga

SEQ ID NO: 119955 - DNA, 20 bp, human
gggtgagccctccctccaca

SEQ ID NO: 119956 - DNA, 20 bp, human
gcggagcaggctcgtctcag

SEQ ID NO: 119957 - DNA, 20 bp, human
gccctgcccaggagtccgcc

SEQ ID NO: 119958 - DNA, 20 bp, human
gtcctccagggtgaaggaca

SEQ ID NO: 119959 - DNA, 20 bp, human
gcccagtgacctgccgaggt

SEQ ID NO: 119960 - DNA, 20 bp, human
gggtcggcagcacagagctc

SEQ ID NO: 119961 - DNA, 20 bp, human
gagcgtgacacccaggaaca

SEQ ID NO: 119962 - DNA, 20 bp, human
gagatgaagaccctgttcct

SEQ ID NO: 119963 - DNA, 20 bp, human
ggctcccagcccccagtgga

SEQ ID NO: 119964 - DNA, 20 bp, human
gcaggccgagcgtgacaccc

SEQ ID NO: 119965 - DNA, 20 bp, human
ggtcactgggcgtctgaaca

SEQ ID NO: 119966 - DNA, 20 bp, human
gtgaggagcggccggagtgt

SEQ ID NO: 119967 - DNA, 20 bp, human
gtgagcaagggtcaactccg

SEQ ID NO: 119968 - DNA, 20 bp, human
gcaggccgctctctgagcaa

SEQ ID NO: 119969 - DNA, 20 bp, human
gccccgtccagtttgaggag

SEQ ID NO: 119970 - DNA, 20 bp, human
gccggggtagaggggacggt

SEQ ID NO: 119971 - DNA, 20 bp, human
gttagtggagccaccctcca

SEQ ID NO: 119972 - DNA, 20 bp, human
gggtcaactccggggtagag

SEQ ID NO: 119973 - DNA, 20 bp, human
gctccggccgctcctcaaac

SEQ ID NO: 119974 - DNA, 20 bp, human
gcgggtctcacctccctccg

SEQ ID NO: 119975 - DNA, 20 bp, human
gaactccggggtagagggga

SEQ ID NO: 119976 - DNA, 20 bp, human
ggggaagcgcaggaagcacg

SEQ ID NO: 119977 - DNA, 20 bp, human
ggccccgagctgcagctctg

SEQ ID NO: 119978 - DNA, 20 bp, human
gcccgaagcctggcgctcag

SEQ ID NO: 119979 - DNA, 20 bp, human
ggaacgcctgagcttcccgg

SEQ ID NO: 119980 - DNA, 20 bp, human
gctcggggccgagggtaagg

SEQ ID NO: 119981 - DNA, 20 bp, human
gcagctcggggccgagggta

SEQ ID NO: 119982 - DNA, 20 bp, human
gggacccgcggagctctccc

SEQ ID NO: 119983 - DNA, 20 bp, human
gcgtagacccccgcgtcggt

SEQ ID NO: 119984 - DNA, 20 bp, human
ggccgcagagctgcagctcg

SEQ ID NO: 119985 - DNA, 20 bp, human
gggcgagctcgggggatcag

SEQ ID NO: 119986 - DNA, 20 bp, human
gtcatccagctgcactccag

SEQ ID NO: 119987 - DNA, 20 bp, human
gcctaccgtgaaggctccac

SEQ ID NO: 119988 - DNA, 20 bp, human
gatatcctggagcaacatcc

SEQ ID NO: 119989 - DNA, 20 bp, human
gtaacagatgcctaccgtga

SEQ ID NO: 119990 - DNA, 20 bp, human
gatggaggataaggtggtag

SEQ ID NO: 119991 - DNA, 20 bp, human
gagctggatgaatgatgcta

SEQ ID NO: 119992 - DNA, 20 bp, human
gggtggtaggggatgctctc

SEQ ID NO: 119993 - DNA, 20 bp, human
gaagaggcagaaagggtagg

SEQ ID NO: 119994 - DNA, 20 bp, human
gaggcatctgttattcctga

SEQ ID NO: 119995 - DNA, 20 bp, human
ggaagacagcaagtaaagga

SEQ ID NO: 119996 - DNA, 20 bp, human
gctccgctcaccatccagag

SEQ ID NO: 119997 - DNA, 20 bp, human
gcgctcaccatccagagcgg

SEQ ID NO: 119998 - DNA, 20 bp, human
gaccatccagagcggaggtg

SEQ ID NO: 119999 - DNA, 20 bp, human
gctaaggaaacgcctgacca

SEQ ID NO: 120000 - DNA, 20 bp, human
gaaggtccgcacctccgctc

SEQ ID NO: 120001 - DNA, 20 bp, human
ggacctcatggcccaccagg

SEQ ID NO: 120002 - DNA, 20 bp, human
gctagccatgagccgtggtc

SEQ ID NO: 120003 - DNA, 20 bp, human
ggcctcctagccatgagccg

SEQ ID NO: 120004 - DNA, 20 bp, human
gcggaccttaaactcactcc

SEQ ID NO: 120005 - DNA, 20 bp, human
gtccttagaatggaatgcac

SEQ ID NO: 120006 - DNA, 20 bp, human
gcggcctgtgggtggacacg

SEQ ID NO: 120007 - DNA, 20 bp, human
gtgtgggtggacacgcggag

SEQ ID NO: 120008 - DNA, 20 bp, human
gtgacgacgcgcacggagaa

SEQ ID NO: 120009 - DNA, 20 bp, human
gtcggagaggcacttccgtc

SEQ ID NO: 120010 - DNA, 20 bp, human
gaaagactcgcggctcccgg

SEQ ID NO: 120011 - DNA, 20 bp, human
gcgctgggacaggtgacccg

SEQ ID NO: 120012 - DNA, 20 bp, human
ggctcccgcggggtgagagt

SEQ ID NO: 120013 - DNA, 20 bp, human
gagtaaatgcacaacccgga

SEQ ID NO: 120014 - DNA, 20 bp, human
ggggcagctcggccgaagag

SEQ ID NO: 120015 - DNA, 20 bp, human
gtcgccgcgcagcctgggac

SEQ ID NO: 120016 - DNA, 20 bp, human
ggtaagtatacagtgcctcc

SEQ ID NO: 120017 - DNA, 20 bp, human
ggcgatctgtccaccctcac

SEQ ID NO: 120018 - DNA, 20 bp, human
gcaagaagtcatccagacag

SEQ ID NO: 120019 - DNA, 20 bp, human
gggagggtggactcgagagg

SEQ ID NO: 120020 - DNA, 20 bp, human
ggatggagtgcggtaatcag

SEQ ID NO: 120021 - DNA, 20 bp, human
gcccggagggtggactcgag

SEQ ID NO: 120022 - DNA, 20 bp, human
gagggagggagaaaagtgca

SEQ ID NO: 120023 - DNA, 20 bp, human
gtacgcggagggcaacaacg

SEQ ID NO: 120024 - DNA, 20 bp, human
gaaaagtgcaaggtaccgcg

SEQ ID NO: 120025 - DNA, 20 bp, human
gagtgcaaggtaccgcgggg

SEQ ID NO: 120026 - DNA, 20 bp, human
ggccggcggtgcagtcacgg

SEQ ID NO: 120027 - DNA, 20 bp, human
gggagacaggtggggtactc

SEQ ID NO: 120028 - DNA, 20 bp, human
ggtgctgaccgacgaatgtg

SEQ ID NO: 120029 - DNA, 20 bp, human
gggagggcgcgccccagcat

SEQ ID NO: 120030 - DNA, 20 bp, human
gtcgggaagctggagcgggc

SEQ ID NO: 120031 - DNA, 20 bp, human
ggggcgcgccccagcatggg

SEQ ID NO: 120032 - DNA, 20 bp, human
gctgctgggcttggcaacga

SEQ ID NO: 120033 - DNA, 20 bp, human
gtggtggggaagggacccgt

SEQ ID NO: 120034 - DNA, 20 bp, human
gcgggccggcggtgcagtca

SEQ ID NO: 120035 - DNA, 20 bp, human
gaagggacccgtgggttcgt

SEQ ID NO: 120036 - DNA, 20 bp, human
gtatactaatgtgtctgcta

SEQ ID NO: 120037 - DNA, 20 bp, human
gctcaggcaaatgactttat

SEQ ID NO: 120038 - DNA, 20 bp, human
gtggtattatatggctatcc

SEQ ID NO: 120039 - DNA, 20 bp, human
ggctcttcacacaggtccca

SEQ ID NO: 120040 - DNA, 20 bp, human
gggtaaatctttaacaataa

SEQ ID NO: 120041 - DNA, 20 bp, human
ggcaggtttcaggatttgca

SEQ ID NO: 120042 - DNA, 20 bp, human
gacagtacaactgctgttag

SEQ ID NO: 120043 - DNA, 20 bp, human
gttcaggatttgcagggtat

SEQ ID NO: 120044 - DNA, 20 bp, human
gcagtctatgctcttcacac

SEQ ID NO: 120045 - DNA, 20 bp, human
gaagagcatagactgtagtt

SEQ ID NO: 120046 - DNA, 20 bp, human
gtgagcgctggcggtcggtg

SEQ ID NO: 120047 - DNA, 20 bp, human
gggactcgtgggaaccagag

SEQ ID NO: 120048 - DNA, 20 bp, human
ggggagcgcgctcacctggc

SEQ ID NO: 120049 - DNA, 20 bp, human
gactgggcccgaccctccgg

SEQ ID NO: 120050 - DNA, 20 bp, human
gtccccgagctgggactcgt

SEQ ID NO: 120051 - DNA, 20 bp, human
ggcgcggagcgtcctccccc

SEQ ID NO: 120052 - DNA, 20 bp, human
gccgggggccaacggtgcca

SEQ ID NO: 120053 - DNA, 20 bp, human
gccgaccctccgggggccaa

SEQ ID NO: 120054 - DNA, 20 bp, human
ggcgcgctccctggcaccgt

SEQ ID NO: 120055 - DNA, 20 bp, human
gcgatcctgcatccgctctg

SEQ ID NO: 120056 - DNA, 20 bp, human
gctcacacagaataaatgag

SEQ ID NO: 120057 - DNA, 20 bp, human
gcagcgctccaggaatgccg

SEQ ID NO: 120058 - DNA, 20 bp, human
gtagaggggacgtgaggcgg

SEQ ID NO: 120059 - DNA, 20 bp, human
gtccaggaatgccgaggtag

SEQ ID NO: 120060 - DNA, 20 bp, human
gtgattttgtgttgactcgc

SEQ ID NO: 120061 - DNA, 20 bp, human
gcaggaatgtgcacatccag

SEQ ID NO: 120062 - DNA, 20 bp, human
ggaggcgataagccacaaac

SEQ ID NO: 120063 - DNA, 20 bp, human
ggccaggcggccagacgcag

SEQ ID NO: 120064 - DNA, 20 bp, human
gaggtagaaaatgagcatca

SEQ ID NO: 120065 - DNA, 20 bp, human
gccgaggtagaggggacgtg

SEQ ID NO: 120066 - DNA, 20 bp, human
gggcatgcacctgtcctgaa

SEQ ID NO: 120067 - DNA, 20 bp, human
gggtggctctgacacctgga

SEQ ID NO: 120068 - DNA, 20 bp, human
gttccggtggctctgacacc

SEQ ID NO: 120069 - DNA, 20 bp, human
ggtcagagccaccggaaaac

SEQ ID NO: 120070 - DNA, 20 bp, human
gcctggggggaaaccgaaaa

SEQ ID NO: 120071 - DNA, 20 bp, human
ggcagacattctgtggaaga

SEQ ID NO: 120072 - DNA, 20 bp, human
gcagtgaagaaaagagtctg

SEQ ID NO: 120073 - DNA, 20 bp, human
gcagagattaaaatccttcc

SEQ ID NO: 120074 - DNA, 20 bp, human
gtttcctgattcttcctggg

SEQ ID NO: 120075 - DNA, 20 bp, human
gttagactcctgttttccgg

SEQ ID NO: 120076 - DNA, 20 bp, human
gttgtgttgcctcgctggag

SEQ ID NO: 120077 - DNA, 20 bp, human
gtgccaaggtagaggggacg

SEQ ID NO: 120078 - DNA, 20 bp, human
gagagtctacaaaaaaggcc

SEQ ID NO: 120079 - DNA, 20 bp, human
gtagacagagtctacaaaaa

SEQ ID NO: 120080 - DNA, 20 bp, human
gaaaaaaaaaaatgtagacc

SEQ ID NO: 120081 - DNA, 20 bp, human
gctcacacagaataaacgag

SEQ ID NO: 120082 - DNA, 20 bp, human
gtccaggaatgccaaggtag

SEQ ID NO: 120083 - DNA, 20 bp, human
gtagaggggacgtggggcgg

SEQ ID NO: 120084 - DNA, 20 bp, human
gtgattttgtgttgcctcgc

SEQ ID NO: 120085 - DNA, 20 bp, human
gcaggaacgtgcacatccag

SEQ ID NO: 120086 - DNA, 20 bp, human
ggtatgcgggcgctagtcaa

SEQ ID NO: 120087 - DNA, 20 bp, human
gcgaggcgccgctctctctt

SEQ ID NO: 120088 - DNA, 20 bp, human
gggccctgcggaacacggtg

SEQ ID NO: 120089 - DNA, 20 bp, human
gctccttcggaagcgcggtg

SEQ ID NO: 120090 - DNA, 20 bp, human
gacacgcagccgaggtgggt

SEQ ID NO: 120091 - DNA, 20 bp, human
gccgtatccgccggagagaa

SEQ ID NO: 120092 - DNA, 20 bp, human
gggaggagtggtgcactgcg

SEQ ID NO: 120093 - DNA, 20 bp, human
gcggcgcgggagacgaagca

SEQ ID NO: 120094 - DNA, 20 bp, human
gtcgagggtatggagatgaa

SEQ ID NO: 120095 - DNA, 20 bp, human
ggtgcactgcggggcgaagg

SEQ ID NO: 120096 - DNA, 20 bp, human
gaggtcacatagccaaggaa

SEQ ID NO: 120097 - DNA, 20 bp, human
ggcctggcatgctgtccaaa

SEQ ID NO: 120098 - DNA, 20 bp, human
gggtcgctggcagctgtggc

SEQ ID NO: 120099 - DNA, 20 bp, human
gcatgctgtccaaatggcag

SEQ ID NO: 120100 - DNA, 20 bp, human
gctgcacggggtattgaaaa

SEQ ID NO: 120101 - DNA, 20 bp, human
gaggaagtgggggaatcgct

SEQ ID NO: 120102 - DNA, 20 bp, human
gggatgacaattcctgcacg

SEQ ID NO: 120103 - DNA, 20 bp, human
gtggaaaagcagaagtggca

SEQ ID NO: 120104 - DNA, 20 bp, human
gggcagtggtttcaggcggg

SEQ ID NO: 120105 - DNA, 20 bp, human
gaatggcagtggtttcaggc

SEQ ID NO: 120106 - DNA, 20 bp, human
gctctaggaaaagcagctca

SEQ ID NO: 120107 - DNA, 20 bp, human
gggccccagtcacgtaagtc

SEQ ID NO: 120108 - DNA, 20 bp, human
gggcctgacttacgtgactg

SEQ ID NO: 120109 - DNA, 20 bp, human
gtggggcctggttgtgtctg

SEQ ID NO: 120110 - DNA, 20 bp, human
ggcggtgtttgaagctgtaa

SEQ ID NO: 120111 - DNA, 20 bp, human
gttttgaaggagaatacata

SEQ ID NO: 120112 - DNA, 20 bp, human
gatgcctcaagagcaaggac

SEQ ID NO: 120113 - DNA, 20 bp, human
gaagctgtaagggatcaact

SEQ ID NO: 120114 - DNA, 20 bp, human
gtcagctttgaaataggcag

SEQ ID NO: 120115 - DNA, 20 bp, human
gggatcaacttggcctgcct

SEQ ID NO: 120116 - DNA, 20 bp, human
gcccgccggtgctataagta

SEQ ID NO: 120117 - DNA, 20 bp, human
gccccgagctgtgaagacgg

SEQ ID NO: 120118 - DNA, 20 bp, human
gggcggcggcggctacagga

SEQ ID NO: 120119 - DNA, 20 bp, human
gcggtgctataagtagggag

SEQ ID NO: 120120 - DNA, 20 bp, human
gtagggagcggcgtgccgtg

SEQ ID NO: 120121 - DNA, 20 bp, human
gtgaagacgggggcagaacg

SEQ ID NO: 120122 - DNA, 20 bp, human
gcggctggataagggtgatc

SEQ ID NO: 120123 - DNA, 20 bp, human
gccagccgcgggagaacccc

SEQ ID NO: 120124 - DNA, 20 bp, human
gccggcccggggttctcccg

SEQ ID NO: 120125 - DNA, 20 bp, human
ggacccacccggagaccctg

SEQ ID NO: 120126 - DNA, 20 bp, human
ggaaggtggacagagaacta

SEQ ID NO: 120127 - DNA, 20 bp, human
ggcacaagcagtacggatat

SEQ ID NO: 120128 - DNA, 20 bp, human
gcaagtcacagcagcaatag

SEQ ID NO: 120129 - DNA, 20 bp, human
ggtgcatatacaagtcgcac

SEQ ID NO: 120130 - DNA, 20 bp, human
gataatcacacaggcaacat

SEQ ID NO: 120131 - DNA, 20 bp, human
gctttgggaaatggcactcc

SEQ ID NO: 120132 - DNA, 20 bp, human
gacatgggtagagatcacac

SEQ ID NO: 120133 - DNA, 20 bp, human
gtctcgcttctcatcttcta

SEQ ID NO: 120134 - DNA, 20 bp, human
ggtatattagccttataagt

SEQ ID NO: 120135 - DNA, 20 bp, human
gcgaccatctctcagaagtt

SEQ ID NO: 120136 - DNA, 20 bp, human
ggccccgtggtagccaagag

SEQ ID NO: 120137 - DNA, 20 bp, human
gagccagactgcatccgccg

SEQ ID NO: 120138 - DNA, 20 bp, human
ggcccgaggagaggacgagg

SEQ ID NO: 120139 - DNA, 20 bp, human
gatgaagtcgttgaagtcgg

SEQ ID NO: 120140 - DNA, 20 bp, human
gggacagcgctgcctacgga

SEQ ID NO: 120141 - DNA, 20 bp, human
gcctctgtcggcggagagaa

SEQ ID NO: 120142 - DNA, 20 bp, human
gccgacgggcagcagagcga

SEQ ID NO: 120143 - DNA, 20 bp, human
gtcgtgccatggagacgccg

SEQ ID NO: 120144 - DNA, 20 bp, human
gtgtcggcggagagaaggga

SEQ ID NO: 120145 - DNA, 20 bp, human
gcctctcaccaggagcgaca

SEQ ID NO: 120146 - DNA, 20 bp, human
gttgagcgggcactcttctg

SEQ ID NO: 120147 - DNA, 20 bp, human
gggccaggtagtcagcctga

SEQ ID NO: 120148 - DNA, 20 bp, human
gtgtggtccccgggacatca

SEQ ID NO: 120149 - DNA, 20 bp, human
gcgacgacgtgcggacgcag

SEQ ID NO: 120150 - DNA, 20 bp, human
gggcggcgagactcactctt

SEQ ID NO: 120151 - DNA, 20 bp, human
gttaccgcgggagcccttag

SEQ ID NO: 120152 - DNA, 20 bp, human
gcgagactcactcttaggaa

SEQ ID NO: 120153 - DNA, 20 bp, human
gaaggcaagggacgcgaggt

SEQ ID NO: 120154 - DNA, 20 bp, human
gttctgcggcaagcaggtct

SEQ ID NO: 120155 - DNA, 20 bp, human
gctccctcaggctgactacc

SEQ ID NO: 120156 - DNA, 20 bp, human
ggcagggtcggggacatcag

SEQ ID NO: 120157 - DNA, 20 bp, human
gcactgaagggtaagacctg

SEQ ID NO: 120158 - DNA, 20 bp, human
gtgtaagcccatgaggagag

SEQ ID NO: 120159 - DNA, 20 bp, human
gggccttcctctctcctcat

SEQ ID NO: 120160 - DNA, 20 bp, human
ggaacctgctgcagcatcag

SEQ ID NO: 120161 - DNA, 20 bp, human
ggtgtcagcaagagcagggt

SEQ ID NO: 120162 - DNA, 20 bp, human
gcccttagagccgagaacag

SEQ ID NO: 120163 - DNA, 20 bp, human
gggtcggggacatcaggggc

SEQ ID NO: 120164 - DNA, 20 bp, human
gcttggagtggtcaaagatg

SEQ ID NO: 120165 - DNA, 20 bp, human
ggccagggagttcccgcaaa

SEQ ID NO: 120166 - DNA, 20 bp, human
gagcacctgcggacagaagg

SEQ ID NO: 120167 - DNA, 20 bp, human
gacctgcggacagaaggcgg

SEQ ID NO: 120168 - DNA, 20 bp, human
gccgccccgcgctgatccca

SEQ ID NO: 120169 - DNA, 20 bp, human
gcgcccaacaccggtagaag

SEQ ID NO: 120170 - DNA, 20 bp, human
gggccgcgacgggtcatgca

SEQ ID NO: 120171 - DNA, 20 bp, human
gaagcgcgcgccgaaggtga

SEQ ID NO: 120172 - DNA, 20 bp, human
ggcccggccagacgctaact

SEQ ID NO: 120173 - DNA, 20 bp, human
ggcgctgatcccagggtagt

SEQ ID NO: 120174 - DNA, 20 bp, human
gggcaggccccgggattgag

SEQ ID NO: 120175 - DNA, 20 bp, human
gcgcagcacctgcggacaga

SEQ ID NO: 120176 - DNA, 20 bp, human
ggagcagctaaggctgtctg

SEQ ID NO: 120177 - DNA, 20 bp, human
gtcccccaccccagacacgg

SEQ ID NO: 120178 - DNA, 20 bp, human
gcctccaagctgaccctcac

SEQ ID NO: 120179 - DNA, 20 bp, human
ggacacggaggaagctggga

SEQ ID NO: 120180 - DNA, 20 bp, human
gcccagacacggaggaagct

SEQ ID NO: 120181 - DNA, 20 bp, human
gggagctggagatgacgtca

SEQ ID NO: 120182 - DNA, 20 bp, human
gtctccagcttgagcagcta

SEQ ID NO: 120183 - DNA, 20 bp, human
ggaggctcaggtcttctgta

SEQ ID NO: 120184 - DNA, 20 bp, human
gtcatcatggccaagatcaa

SEQ ID NO: 120185 - DNA, 20 bp, human
ggggtctaaacagcagtcaa

SEQ ID NO: 120186 - DNA, 20 bp, human
gcccgcagcagggagtcgtg

SEQ ID NO: 120187 - DNA, 20 bp, human
gaggctggtcggccggacac

SEQ ID NO: 120188 - DNA, 20 bp, human
ggatggtccaggaaagagtc

SEQ ID NO: 120189 - DNA, 20 bp, human
gcctggccgacactcgatcc

SEQ ID NO: 120190 - DNA, 20 bp, human
ggccatcgcctgcccaccat

SEQ ID NO: 120191 - DNA, 20 bp, human
gggacggccaccctggagaa

SEQ ID NO: 120192 - DNA, 20 bp, human
gtggcacgcaccgttctcca

SEQ ID NO: 120193 - DNA, 20 bp, human
ggtcactcgccggccaaggg

SEQ ID NO: 120194 - DNA, 20 bp, human
ggccccacgactccctgctg

SEQ ID NO: 120195 - DNA, 20 bp, human
gggacaagaggccgtctgtg

SEQ ID NO: 120196 - DNA, 20 bp, human
gcaacacctgggccatccag

SEQ ID NO: 120197 - DNA, 20 bp, human
gcctggcctgctgaatgggt

SEQ ID NO: 120198 - DNA, 20 bp, human
ggtgccccaggaaaattccg

SEQ ID NO: 120199 - DNA, 20 bp, human
gtagtaggataaaggcaacc

SEQ ID NO: 120200 - DNA, 20 bp, human
gagactcttgatccaagaga

SEQ ID NO: 120201 - DNA, 20 bp, human
gaggtgagctgggacaagat

SEQ ID NO: 120202 - DNA, 20 bp, human
ggggacctggcctgctgaat

SEQ ID NO: 120203 - DNA, 20 bp, human
ggagctcagaggccaacacc

SEQ ID NO: 120204 - DNA, 20 bp, human
gctgccacggaattttcctg

SEQ ID NO: 120205 - DNA, 20 bp, human
gcaaggacctgttactactg

SEQ ID NO: 120206 - DNA, 20 bp, human
gagccaggggaagcactggt

SEQ ID NO: 120207 - DNA, 20 bp, human
gaccagtctcatcaccatga

SEQ ID NO: 120208 - DNA, 20 bp, human
gctctaccttgaacagccag

SEQ ID NO: 120209 - DNA, 20 bp, human
gccaggaatgaggctgtctt

SEQ ID NO: 120210 - DNA, 20 bp, human
gatatctagctgtctcagag

SEQ ID NO: 120211 - DNA, 20 bp, human
gtgcttcccctggctgttca

SEQ ID NO: 120212 - DNA, 20 bp, human
gttcagaaactggactgacc

SEQ ID NO: 120213 - DNA, 20 bp, human
gacctggttaccttcactgt

SEQ ID NO: 120214 - DNA, 20 bp, human
ggaaagcctcattacaaact

SEQ ID NO: 120215 - DNA, 20 bp, human
gttaccttaaggagaaagtc

SEQ ID NO: 120216 - DNA, 20 bp, human
gggacccaggcacgactcaa

SEQ ID NO: 120217 - DNA, 20 bp, human
gggcggggacccagacacta

SEQ ID NO: 120218 - DNA, 20 bp, human
ggaagccataagaggcctag

SEQ ID NO: 120219 - DNA, 20 bp, human
ggaggcaagggcgaggaccc

SEQ ID NO: 120220 - DNA, 20 bp, human
ggacagaggcagggttctga

SEQ ID NO: 120221 - DNA, 20 bp, human
gctagggactgaaggcagcg

SEQ ID NO: 120222 - DNA, 20 bp, human
gcctccggggaagccataag

SEQ ID NO: 120223 - DNA, 20 bp, human
ggccttcagtccctagtgtc

SEQ ID NO: 120224 - DNA, 20 bp, human
gatcaggcgtcagctccctc

SEQ ID NO: 120225 - DNA, 20 bp, human
gggtatactggatacactca

SEQ ID NO: 120226 - DNA, 20 bp, human
gaggcgccgacaccccactc

SEQ ID NO: 120227 - DNA, 20 bp, human
gtgtcggcgcctcattcggg

SEQ ID NO: 120228 - DNA, 20 bp, human
gcgacacccggcactgggac

SEQ ID NO: 120229 - DNA, 20 bp, human
gtggttaggccgctctccga

SEQ ID NO: 120230 - DNA, 20 bp, human
gaggagagtgcgtcccggtc

SEQ ID NO: 120231 - DNA, 20 bp, human
gcgccaagcgccgcgacacc

SEQ ID NO: 120232 - DNA, 20 bp, human
gcgggaaggagagtgcgtcc

SEQ ID NO: 120233 - DNA, 20 bp, human
gacgcccgcggcgaccttgg

SEQ ID NO: 120234 - DNA, 20 bp, human
ggcggtcctcacaggcggga

SEQ ID NO: 120235 - DNA, 20 bp, human
gtccgcaggggtgaccccca

SEQ ID NO: 120236 - DNA, 20 bp, human
ggcgctgcagcgaggtccgg

SEQ ID NO: 120237 - DNA, 20 bp, human
gtccgcgctgcagcgaggtc

SEQ ID NO: 120238 - DNA, 20 bp, human
gtgcacctggcgggacccat

SEQ ID NO: 120239 - DNA, 20 bp, human
gggagggcccggagctgcga

SEQ ID NO: 120240 - DNA, 20 bp, human
gaggcagcttcggactacca

SEQ ID NO: 120241 - DNA, 20 bp, human
ggtcagggggctgcgcggaa

SEQ ID NO: 120242 - DNA, 20 bp, human
gggccgccgcgctcaccggg

SEQ ID NO: 120243 - DNA, 20 bp, human
gccgggtccgcgctgcagcg

SEQ ID NO: 120244 - DNA, 20 bp, human
gcagcggcgcagggaccggg

SEQ ID NO: 120245 - DNA, 20 bp, human
ggaagcagcggcgcagggac

SEQ ID NO: 120246 - DNA, 20 bp, human
gtcaagacgctaccttcctg

SEQ ID NO: 120247 - DNA, 20 bp, human
gggccgggaaacacgataaa

SEQ ID NO: 120248 - DNA, 20 bp, human
gagttgcagtaccctcagga

SEQ ID NO: 120249 - DNA, 20 bp, human
gcgggagttgcagtaccctc

SEQ ID NO: 120250 - DNA, 20 bp, human
gcctggcgacgcccaatcag

SEQ ID NO: 120251 - DNA, 20 bp, human
ggccgccacgcagaggtcta

SEQ ID NO: 120252 - DNA, 20 bp, human
gcggtaaccgggtgctctca

SEQ ID NO: 120253 - DNA, 20 bp, human
gtaaccgggtgctctcaggg

SEQ ID NO: 120254 - DNA, 20 bp, human
gggtagcgtcttgatctgcg

SEQ ID NO: 120255 - DNA, 20 bp, human
ggcaggacgccgttcagtca

SEQ ID NO: 120256 - DNA, 20 bp, human
gggtgcagaagcaggcgcag

SEQ ID NO: 120257 - DNA, 20 bp, human
gctctctacggaagctggta

SEQ ID NO: 120258 - DNA, 20 bp, human
gcgcagcggcagaagtgccg

SEQ ID NO: 120259 - DNA, 20 bp, human
gcgtgcccgaagtctctcta

SEQ ID NO: 120260 - DNA, 20 bp, human
gcggaagctggtagggctgt

SEQ ID NO: 120261 - DNA, 20 bp, human
ggtaatccaacagactgtgg

SEQ ID NO: 120262 - DNA, 20 bp, human
ggcttccgtagagagacttc

SEQ ID NO: 120263 - DNA, 20 bp, human
gttggtggagacactcactg

SEQ ID NO: 120264 - DNA, 20 bp, human
gagaggagccccgacctcaa

SEQ ID NO: 120265 - DNA, 20 bp, human
gtcaggacagggctccgggc

SEQ ID NO: 120266 - DNA, 20 bp, human
gggggacgaacgccgtaaca

SEQ ID NO: 120267 - DNA, 20 bp, human
gccggaaccggagcaggtag

SEQ ID NO: 120268 - DNA, 20 bp, human
gctgcccctctgggataggt

SEQ ID NO: 120269 - DNA, 20 bp, human
gtggtccgatggctcctcag

SEQ ID NO: 120270 - DNA, 20 bp, human
gtgcctcgcgctccctgtta

SEQ ID NO: 120271 - DNA, 20 bp, human
gcgggacagcgacagccaaa

SEQ ID NO: 120272 - DNA, 20 bp, human
gcgccgtaacagggagcgcg

SEQ ID NO: 120273 - DNA, 20 bp, human
gaccggagcaggtagcggtg

SEQ ID NO: 120274 - DNA, 20 bp, human
ggcgcccgagggcaacggag

SEQ ID NO: 120275 - DNA, 20 bp, human
ggcggacagggccatggagt

SEQ ID NO: 120276 - DNA, 20 bp, human
gggccgcgcgtgggtgacag

SEQ ID NO: 120277 - DNA, 20 bp, human
gccaggtggagtcgcagtcg

SEQ ID NO: 120278 - DNA, 20 bp, human
gggtcgtccatgctcggcgg

SEQ ID NO: 120279 - DNA, 20 bp, human
gcggggtcgtccatgctcgg

SEQ ID NO: 120280 - DNA, 20 bp, human
gacggcgcccacacacgatg

SEQ ID NO: 120281 - DNA, 20 bp, human
gacacacgatggggcccggg

SEQ ID NO: 120282 - DNA, 20 bp, human
gacgcgcccgaggcaccccc

SEQ ID NO: 120283 - DNA, 20 bp, human
ggcgggaggggttccatcag

SEQ ID NO: 120284 - DNA, 20 bp, human
ggaagcgaaaccgaaagcag

SEQ ID NO: 120285 - DNA, 20 bp, human
ggacgaggacgaggagtcgg

SEQ ID NO: 120286 - DNA, 20 bp, human
gagctgcggcaggcgctcta

SEQ ID NO: 120287 - DNA, 20 bp, human
ggcccgagcccgaagaacca

SEQ ID NO: 120288 - DNA, 20 bp, human
gcctcgcgctcggaggccag

SEQ ID NO: 120289 - DNA, 20 bp, human
ggagcaggtacgcggcccag

SEQ ID NO: 120290 - DNA, 20 bp, human
gcggaggggtcgggtcgcag

SEQ ID NO: 120291 - DNA, 20 bp, human
gccagcggtggcctcgggtc

SEQ ID NO: 120292 - DNA, 20 bp, human
ggggcgccccgacaccccag

SEQ ID NO: 120293 - DNA, 20 bp, human
ggcgctctagggcccgggca

SEQ ID NO: 120294 - DNA, 20 bp, human
ggtggagtcgcagtcctcca

SEQ ID NO: 120295 - DNA, 20 bp, human
gccgaagaaccagggccggg

SEQ ID NO: 120296 - DNA, 20 bp, human
gtcagagcgagggcacggga

SEQ ID NO: 120297 - DNA, 20 bp, human
gggatgatggaagaaacccg

SEQ ID NO: 120298 - DNA, 20 bp, human
gtacgatgccccatgcgcct

SEQ ID NO: 120299 - DNA, 20 bp, human
gcaggcgcagctcagagcga

SEQ ID NO: 120300 - DNA, 20 bp, human
gggtaggcggggctactacg

SEQ ID NO: 120301 - DNA, 20 bp, human
gcacagcaccaccggaagta

SEQ ID NO: 120302 - DNA, 20 bp, human
gcagctcagagcgagggcac

SEQ ID NO: 120303 - DNA, 20 bp, human
gcccaggtaggaatgcagag

SEQ ID NO: 120304 - DNA, 20 bp, human
ggcacgggatggaggcccac

SEQ ID NO: 120305 - DNA, 20 bp, human
gacgaggcctggttctgggt

SEQ ID NO: 120306 - DNA, 20 bp, human
gctgtgcattagccccaagt

SEQ ID NO: 120307 - DNA, 20 bp, human
gatccacgcaggcaagaata

SEQ ID NO: 120308 - DNA, 20 bp, human
gtcaaaacagctacaacggt

SEQ ID NO: 120309 - DNA, 20 bp, human
ggcattagccccaagtggga

SEQ ID NO: 120310 - DNA, 20 bp, human
gattcctttaggctcatcaa

SEQ ID NO: 120311 - DNA, 20 bp, human
gtttgaggaatgtaatagaa

SEQ ID NO: 120312 - DNA, 20 bp, human
gctcattcaccctcccactt

SEQ ID NO: 120313 - DNA, 20 bp, human
gaatccattgatgagcctaa

SEQ ID NO: 120314 - DNA, 20 bp, human
ggaatagtattgcaggctag

SEQ ID NO: 120315 - DNA, 20 bp, human
gcagacatgaacatctattg

SEQ ID NO: 120316 - DNA, 20 bp, human
gctagtggcctgctgactgt

SEQ ID NO: 120317 - DNA, 20 bp, human
gtagcaaaaatcaaggtgac

SEQ ID NO: 120318 - DNA, 20 bp, human
gatgtgtctgataaggtaag

SEQ ID NO: 120319 - DNA, 20 bp, human
gcagaggcacaagcagtaac

SEQ ID NO: 120320 - DNA, 20 bp, human
gactctaaaaatacaatctt

SEQ ID NO: 120321 - DNA, 20 bp, human
gggttactatagatactgtt

SEQ ID NO: 120322 - DNA, 20 bp, human
gatgaggataaatacctgga

SEQ ID NO: 120323 - DNA, 20 bp, human
gttcattttagcaaaaatca

SEQ ID NO: 120324 - DNA, 20 bp, human
gttcctgaatgtgtctgata

SEQ ID NO: 120325 - DNA, 20 bp, human
ggttttgtcccacagtcagc

SEQ ID NO: 120326 - DNA, 20 bp, human
gggtcttgaaatggcggcga

SEQ ID NO: 120327 - DNA, 20 bp, human
gctctggagggcttgagcgg

SEQ ID NO: 120328 - DNA, 20 bp, human
ggttacaggcttcaaaccct

SEQ ID NO: 120329 - DNA, 20 bp, human
gacggcgcgagaccccaagg

SEQ ID NO: 120330 - DNA, 20 bp, human
ggccgtagcaatgctctgga

SEQ ID NO: 120331 - DNA, 20 bp, human
gtagtacggtcttgaaatgg

SEQ ID NO: 120332 - DNA, 20 bp, human
gtcctcggccgaaacaacat

SEQ ID NO: 120333 - DNA, 20 bp, human
ggccatctggagcttctcga

SEQ ID NO: 120334 - DNA, 20 bp, human
gttcgggaagcggacaacag

SEQ ID NO: 120335 - DNA, 20 bp, human
gcaagaccgtactaggtaga

SEQ ID NO: 120336 - DNA, 20 bp, human
gaagcgttcgggaaaggcag

SEQ ID NO: 120337 - DNA, 20 bp, human
gcacaaaagtccccccgggg

SEQ ID NO: 120338 - DNA, 20 bp, human
gcaggcgaggtgcaccgagt

SEQ ID NO: 120339 - DNA, 20 bp, human
gcgggtggcggagaaccacc

SEQ ID NO: 120340 - DNA, 20 bp, human
gaacgtgagcgatgccgcag

SEQ ID NO: 120341 - DNA, 20 bp, human
ggcagtgaagcgttcgggaa

SEQ ID NO: 120342 - DNA, 20 bp, human
gggcctggcgtgtattcgaa

SEQ ID NO: 120343 - DNA, 20 bp, human
gggcagaggctagcccgaga

SEQ ID NO: 120344 - DNA, 20 bp, human
gtcccgctttctccaccggg

SEQ ID NO: 120345 - DNA, 20 bp, human
ggccacccggtggagaaagc

SEQ ID NO: 120346 - DNA, 20 bp, human
ggcacctccgtgtcacccgt

SEQ ID NO: 120347 - DNA, 20 bp, human
ggaccaactgccagaaacac

SEQ ID NO: 120348 - DNA, 20 bp, human
gtgacatgagactcacccac

SEQ ID NO: 120349 - DNA, 20 bp, human
ggactcacccacgggtgaca

SEQ ID NO: 120350 - DNA, 20 bp, human
gtcacccacgggtgacacgg

SEQ ID NO: 120351 - DNA, 20 bp, human
gaaggaacaccagtattaag

SEQ ID NO: 120352 - DNA, 20 bp, human
gttctggcagttggtccaga

SEQ ID NO: 120353 - DNA, 20 bp, human
gtggaaaatcctcttaatac

SEQ ID NO: 120354 - DNA, 20 bp, human
gaggaatggaggcatccttc

SEQ ID NO: 120355 - DNA, 20 bp, human
gtagtgaaagctgtgggata

SEQ ID NO: 120356 - DNA, 20 bp, human
gggtcctctggcctacagag

SEQ ID NO: 120357 - DNA, 20 bp, human
gctgccggccacctctctgt

SEQ ID NO: 120358 - DNA, 20 bp, human
ggcctccaaagaacagatac

SEQ ID NO: 120359 - DNA, 20 bp, human
ggcctcaccgtgctcggcct

SEQ ID NO: 120360 - DNA, 20 bp, human
ggcccaggccgagcacggtg

SEQ ID NO: 120361 - DNA, 20 bp, human
gcctctggcctacagagagg

SEQ ID NO: 120362 - DNA, 20 bp, human
gggtgtcaggacgctgagaa

SEQ ID NO: 120363 - DNA, 20 bp, human
gctgggagttggccaggaac

SEQ ID NO: 120364 - DNA, 20 bp, human
gccggcagcccacccaaagt

SEQ ID NO: 120365 - DNA, 20 bp, human
gccggtggcccagtccggag

SEQ ID NO: 120366 - DNA, 20 bp, human
gatataatcactggtatctg

SEQ ID NO: 120367 - DNA, 20 bp, human
gatatgagacatatctgaga

SEQ ID NO: 120368 - DNA, 20 bp, human
gtaaaagataatccaactat

SEQ ID NO: 120369 - DNA, 20 bp, human
gcatatgcacagcctatagt

SEQ ID NO: 120370 - DNA, 20 bp, human
gtctgaaagatgactttctt

SEQ ID NO: 120371 - DNA, 20 bp, human
ggggctagcctgagaaatta

SEQ ID NO: 120372 - DNA, 20 bp, human
ggttccttacattatctgtg

SEQ ID NO: 120373 - DNA, 20 bp, human
gcagagttcatctcaaagcc

SEQ ID NO: 120374 - DNA, 20 bp, human
gcaaaaagagaactgagaaa

SEQ ID NO: 120375 - DNA, 20 bp, human
gtggattgccaaagaaagag

SEQ ID NO: 120376 - DNA, 20 bp, human
ggccggacggcgcttcccgg

SEQ ID NO: 120377 - DNA, 20 bp, human
gcgcagcgctcagagccgga

SEQ ID NO: 120378 - DNA, 20 bp, human
ggacgcagccgggcaaggca

SEQ ID NO: 120379 - DNA, 20 bp, human
gtgcccggctgcgtccctcc

SEQ ID NO: 120380 - DNA, 20 bp, human
gggacggcgcttcccggtgg

SEQ ID NO: 120381 - DNA, 20 bp, human
gtgttgaggcccaccagcga

SEQ ID NO: 120382 - DNA, 20 bp, human
gggacgctggaccgcagcac

SEQ ID NO: 120383 - DNA, 20 bp, human
gaacaccaccaagctctcgg

SEQ ID NO: 120384 - DNA, 20 bp, human
gaggaggaggagccgcgcca

SEQ ID NO: 120385 - DNA, 20 bp, human
gcgcccaggcggccttcagg

SEQ ID NO: 120386 - DNA, 20 bp, human
gcgctccgggtgctgaatcc

SEQ ID NO: 120387 - DNA, 20 bp, human
gcgctaggctggacctgggt

SEQ ID NO: 120388 - DNA, 20 bp, human
gccggctccgctggctccgg

SEQ ID NO: 120389 - DNA, 20 bp, human
ggggtgctgaatccaggcgt

SEQ ID NO: 120390 - DNA, 20 bp, human
gggtgcaggctgaccggaga

SEQ ID NO: 120391 - DNA, 20 bp, human
ggctggaggagcgccgtctc

SEQ ID NO: 120392 - DNA, 20 bp, human
ggcgccgccgccggagccag

SEQ ID NO: 120393 - DNA, 20 bp, human
gctgggcgcccgaagtgccg

SEQ ID NO: 120394 - DNA, 20 bp, human
gtcctcttcctcatcctgat

SEQ ID NO: 120395 - DNA, 20 bp, human
gaggcgtggggacacgagcc

SEQ ID NO: 120396 - DNA, 20 bp, human
gtggcttgggagaggacgag

SEQ ID NO: 120397 - DNA, 20 bp, human
gggccgggacgtgcactctc

SEQ ID NO: 120398 - DNA, 20 bp, human
gttgggagggaaacttcagg

SEQ ID NO: 120399 - DNA, 20 bp, human
ggagggttcccggagaaacg

SEQ ID NO: 120400 - DNA, 20 bp, human
gcgacccccgcccgccctag

SEQ ID NO: 120401 - DNA, 20 bp, human
gatctcgctggagctgaatg

SEQ ID NO: 120402 - DNA, 20 bp, human
gggacaggtaggggcccggc

SEQ ID NO: 120403 - DNA, 20 bp, human
gcccaaaccagcccagcttg

SEQ ID NO: 120404 - DNA, 20 bp, human
gggcctggccggacaggtag

SEQ ID NO: 120405 - DNA, 20 bp, human
gccggagaaacggggttggg

SEQ ID NO: 120406 - DNA, 20 bp, human
gcccgctgccagcccggcac

SEQ ID NO: 120407 - DNA, 20 bp, human
gtagtgactgattaagatcc

SEQ ID NO: 120408 - DNA, 20 bp, human
gtaagatcccggtgccgggc

SEQ ID NO: 120409 - DNA, 20 bp, human
gccaccgcagtaacttacta

SEQ ID NO: 120410 - DNA, 20 bp, human
ggttcagtcccaccaaggat

SEQ ID NO: 120411 - DNA, 20 bp, human
gaccacgaggctgtcgactc

SEQ ID NO: 120412 - DNA, 20 bp, human
gagtggaggactcattgctg

SEQ ID NO: 120413 - DNA, 20 bp, human
gtccggagtcgacagcctcg

SEQ ID NO: 120414 - DNA, 20 bp, human
gcaccaaggatgggagagtt

SEQ ID NO: 120415 - DNA, 20 bp, human
ggtggtgttcagtcccacca

SEQ ID NO: 120416 - DNA, 20 bp, human
ggccagcggctccagctaag

SEQ ID NO: 120417 - DNA, 20 bp, human
gttggccaaggaagaacaga

SEQ ID NO: 120418 - DNA, 20 bp, human
gcaagctgcaggggatttgg

SEQ ID NO: 120419 - DNA, 20 bp, human
gccagccgcagcttaggcag

SEQ ID NO: 120420 - DNA, 20 bp, human
gtcctcttagctggagccgc

SEQ ID NO: 120421 - DNA, 20 bp, human
gaggttctgtgtcccaggtg

SEQ ID NO: 120422 - DNA, 20 bp, human
gtgggaaagagctgaagccg

SEQ ID NO: 120423 - DNA, 20 bp, human
gttcatggatggctagacct

SEQ ID NO: 120424 - DNA, 20 bp, human
gtggctctgcagagagccca

SEQ ID NO: 120425 - DNA, 20 bp, human
gccatggggaaatcaccact

SEQ ID NO: 120426 - DNA, 20 bp, human
ggagggtccgcatgtgtcaa

SEQ ID NO: 120427 - DNA, 20 bp, human
ggtggttgcaagctgcttcc

SEQ ID NO: 120428 - DNA, 20 bp, human
gggtcctgggtacactgcgg

SEQ ID NO: 120429 - DNA, 20 bp, human
gcctgggtacactgcggcgg

SEQ ID NO: 120430 - DNA, 20 bp, human
gactgagctcacgtatcggg

SEQ ID NO: 120431 - DNA, 20 bp, human
ggatgtctcaagggctccgg

SEQ ID NO: 120432 - DNA, 20 bp, human
gagctgggggaagggaacgg

SEQ ID NO: 120433 - DNA, 20 bp, human
gtatcgggtggaataacaag

SEQ ID NO: 120434 - DNA, 20 bp, human
gatgcacacacaattaagcc

SEQ ID NO: 120435 - DNA, 20 bp, human
gcagcgctttcgagtcttgg

SEQ ID NO: 120436 - DNA, 20 bp, human
gtagggatgctagggacccg

SEQ ID NO: 120437 - DNA, 20 bp, human
gaacaagcgctggagatgta

SEQ ID NO: 120438 - DNA, 20 bp, human
ggccctagctccgcccctgg

SEQ ID NO: 120439 - DNA, 20 bp, human
ggagctgagagaccgaacct

SEQ ID NO: 120440 - DNA, 20 bp, human
gcggcgctggaagacccgcg

SEQ ID NO: 120441 - DNA, 20 bp, human
gccgagagaggggcgcgtgg

SEQ ID NO: 120442 - DNA, 20 bp, human
gtggagatgtagggatgcta

SEQ ID NO: 120443 - DNA, 20 bp, human
gcccacgcgcgccgacagta

SEQ ID NO: 120444 - DNA, 20 bp, human
ggggcaggcagagcgggcga

SEQ ID NO: 120445 - DNA, 20 bp, human
gttcagtgctgagaagtccc

SEQ ID NO: 120446 - DNA, 20 bp, human
gacgcacggggaccggacac

SEQ ID NO: 120447 - DNA, 20 bp, human
gagccggacgcaaggaagag

SEQ ID NO: 120448 - DNA, 20 bp, human
gacggggaccggacacgggg

SEQ ID NO: 120449 - DNA, 20 bp, human
gactggggctgcacagtcga

SEQ ID NO: 120450 - DNA, 20 bp, human
gagtagagaactagcagccg

SEQ ID NO: 120451 - DNA, 20 bp, human
gctgctgggctagggagccg

SEQ ID NO: 120452 - DNA, 20 bp, human
ggccccagccattctctgaa

SEQ ID NO: 120453 - DNA, 20 bp, human
gagctcgcgcggaaggaggg

SEQ ID NO: 120454 - DNA, 20 bp, human
gcttccgcgcgagctctccg

SEQ ID NO: 120455 - DNA, 20 bp, human
gcccccagatgcgcagacag

SEQ ID NO: 120456 - DNA, 20 bp, human
ggcctccaaagctaaccctc

SEQ ID NO: 120457 - DNA, 20 bp, human
ggctaaccctcgggcttgag

SEQ ID NO: 120458 - DNA, 20 bp, human
gtactctggcaccactctcc

SEQ ID NO: 120459 - DNA, 20 bp, human
gcctcgggcttgaggggaag

SEQ ID NO: 120460 - DNA, 20 bp, human
gctgggattagatagaataa

SEQ ID NO: 120461 - DNA, 20 bp, human
gggcggggctagaagagaaa

SEQ ID NO: 120462 - DNA, 20 bp, human
ggggtcccgaccatgacaaa

SEQ ID NO: 120463 - DNA, 20 bp, human
gaggaagttatagattcccc

SEQ ID NO: 120464 - DNA, 20 bp, human
gttgaagttggaggttcccg

SEQ ID NO: 120465 - DNA, 20 bp, human
gaaacgagagccaaaattgt

SEQ ID NO: 120466 - DNA, 20 bp, human
gtgccgaccggcccacccca

SEQ ID NO: 120467 - DNA, 20 bp, human
gggcagtgcgccgctgagta

SEQ ID NO: 120468 - DNA, 20 bp, human
gggtcaggcgcgcacccggg

SEQ ID NO: 120469 - DNA, 20 bp, human
ggtcatcctgccctactcag

SEQ ID NO: 120470 - DNA, 20 bp, human
gcctccctctacgagctggt

SEQ ID NO: 120471 - DNA, 20 bp, human
gcgccctggggtgggccggt

SEQ ID NO: 120472 - DNA, 20 bp, human
ggtagcccaccagctcgtag

SEQ ID NO: 120473 - DNA, 20 bp, human
ggcccttcaggaacgccctg

SEQ ID NO: 120474 - DNA, 20 bp, human
ggcccggccggacgccaagg

SEQ ID NO: 120475 - DNA, 20 bp, human
gacctcgcgcagggcgtcca

SEQ ID NO: 120476 - DNA, 20 bp, human
gaaagcctcaggggagaacc

SEQ ID NO: 120477 - DNA, 20 bp, human
gggtgccaggttctcccctg

SEQ ID NO: 120478 - DNA, 20 bp, human
gtcgctccgaaaagcctcag

SEQ ID NO: 120479 - DNA, 20 bp, human
gaaaccggccgagcccctaa

SEQ ID NO: 120480 - DNA, 20 bp, human
gcgtggtgtcgatggagata

SEQ ID NO: 120481 - DNA, 20 bp, human
ggagatgcagcggtgagtgt

SEQ ID NO: 120482 - DNA, 20 bp, human
gtcgacgcgacaccagcgcc

SEQ ID NO: 120483 - DNA, 20 bp, human
ggtccctgggatctaggctg

SEQ ID NO: 120484 - DNA, 20 bp, human
gggggcggggacacttactc

SEQ ID NO: 120485 - DNA, 20 bp, human
gagaaatggcccgcagagta

SEQ ID NO: 120486 - DNA, 20 bp, human
ggcagcctaaccagagagag

SEQ ID NO: 120487 - DNA, 20 bp, human
gtaaccagagagaggggcgt

SEQ ID NO: 120488 - DNA, 20 bp, human
gcccgcgagaggctttcccc

SEQ ID NO: 120489 - DNA, 20 bp, human
gctaaagcctccccacggta

SEQ ID NO: 120490 - DNA, 20 bp, human
gccaggaacccacttctccg

SEQ ID NO: 120491 - DNA, 20 bp, human
gatgcggccctaccgtgggg

SEQ ID NO: 120492 - DNA, 20 bp, human
gcttggcgccagcccgcgag

SEQ ID NO: 120493 - DNA, 20 bp, human
gcctgaacctagccatggac

SEQ ID NO: 120494 - DNA, 20 bp, human
gggggatgcggccctaccgt

SEQ ID NO: 120495 - DNA, 20 bp, human
gtacttgctgctctctcccg

SEQ ID NO: 120496 - DNA, 20 bp, human
ggtttcacggagctaataag

SEQ ID NO: 120497 - DNA, 20 bp, human
gaggctggtccttcacagtc

SEQ ID NO: 120498 - DNA, 20 bp, human
gcttttacagagagctaact

SEQ ID NO: 120499 - DNA, 20 bp, human
gcttcacagtctggatcttt

SEQ ID NO: 120500 - DNA, 20 bp, human
gaagctaaacacccaagtat

SEQ ID NO: 120501 - DNA, 20 bp, human
gctcattcttagcttgaatt

SEQ ID NO: 120502 - DNA, 20 bp, human
gagagagctaactgggcatc

SEQ ID NO: 120503 - DNA, 20 bp, human
gaaaaaagctaaaggtacta

SEQ ID NO: 120504 - DNA, 20 bp, human
gagctaaaggtactagggat

SEQ ID NO: 120505 - DNA, 20 bp, human
gggatgggaaaatgtgtaca

SEQ ID NO: 120506 - DNA, 20 bp, human
gcacttcctgcccgccatac

SEQ ID NO: 120507 - DNA, 20 bp, human
ggcgccccggccggtatggc

SEQ ID NO: 120508 - DNA, 20 bp, human
gtgaggagcccgaagccccg

SEQ ID NO: 120509 - DNA, 20 bp, human
gtgcgcgcctgcgcataggt

SEQ ID NO: 120510 - DNA, 20 bp, human
gcgagtaggatcgtgcccag

SEQ ID NO: 120511 - DNA, 20 bp, human
ggccgggaggcggtcccctc

SEQ ID NO: 120512 - DNA, 20 bp, human
gctgcttgagtcagtcctca

SEQ ID NO: 120513 - DNA, 20 bp, human
ggtaggatcgtgcccagggg

SEQ ID NO: 120514 - DNA, 20 bp, human
gactcaagcagaagcgaaag

SEQ ID NO: 120515 - DNA, 20 bp, human
gtacgggaggaggcgtgggt

SEQ ID NO: 120516 - DNA, 20 bp, human
ggtaactctgtgtccagaca

SEQ ID NO: 120517 - DNA, 20 bp, human
gttcaagagacagccctgtc

SEQ ID NO: 120518 - DNA, 20 bp, human
gggaaagattctcaggttaa

SEQ ID NO: 120519 - DNA, 20 bp, human
gatcttcttggaaaacactc

SEQ ID NO: 120520 - DNA, 20 bp, human
gcaatgctagtgattccggt

SEQ ID NO: 120521 - DNA, 20 bp, human
gatgcctcaaaggcattagc

SEQ ID NO: 120522 - DNA, 20 bp, human
ggaatttctgattcatttaa

SEQ ID NO: 120523 - DNA, 20 bp, human
gtgagcaatgctagtgattc

SEQ ID NO: 120524 - DNA, 20 bp, human
gaaactaaagcaaattgaac

SEQ ID NO: 120525 - DNA, 20 bp, human
gtaagcaaatacaatcttct

SEQ ID NO: 120526 - DNA, 20 bp, human
gtataggtactgtgttggtc

SEQ ID NO: 120527 - DNA, 20 bp, human
gaggtttataggtactgtgt

SEQ ID NO: 120528 - DNA, 20 bp, human
gtcgtcttgttctgtagagt

SEQ ID NO: 120529 - DNA, 20 bp, human
ggatgttgaagacgacacca

SEQ ID NO: 120530 - DNA, 20 bp, human
gttttctctgggaaacttaa

SEQ ID NO: 120531 - DNA, 20 bp, human
gtataaaatgtgaggtttat

SEQ ID NO: 120532 - DNA, 20 bp, human
gcacctgatcagtaccacat

SEQ ID NO: 120533 - DNA, 20 bp, human
gttgctgcagtgtcagttga

SEQ ID NO: 120534 - DNA, 20 bp, human
gctgatcagtaccacatagg

SEQ ID NO: 120535 - DNA, 20 bp, human
gttaagaaaaagtcaacgtt

SEQ ID NO: 120536 - DNA, 20 bp, human
gccagcggcatgtccagctg

SEQ ID NO: 120537 - DNA, 20 bp, human
gcgggcaaggtcaccatcac

SEQ ID NO: 120538 - DNA, 20 bp, human
gggctccacaccctcgccaa

SEQ ID NO: 120539 - DNA, 20 bp, human
gaggcgctccccaaactcca

SEQ ID NO: 120540 - DNA, 20 bp, human
gtagccgcatctgcctggtc

SEQ ID NO: 120541 - DNA, 20 bp, human
gcagagctggttaaaaacca

SEQ ID NO: 120542 - DNA, 20 bp, human
gaccctcgccaaaggtgacg

SEQ ID NO: 120543 - DNA, 20 bp, human
gagctggttaaaaaccacgg

SEQ ID NO: 120544 - DNA, 20 bp, human
ggtggagcccgccaacctca

SEQ ID NO: 120545 - DNA, 20 bp, human
gcatctgcctggtcaggccc

SEQ ID NO: 120546 - DNA, 20 bp, human
gggcggacacaacatcgatg

SEQ ID NO: 120547 - DNA, 20 bp, human
gcgctggccagcttgagcca

SEQ ID NO: 120548 - DNA, 20 bp, human
gtgtaacagtaacagagcca

SEQ ID NO: 120549 - DNA, 20 bp, human
gcggagtccggtcttcacat

SEQ ID NO: 120550 - DNA, 20 bp, human
gggcggcggctaccgaaccg

SEQ ID NO: 120551 - DNA, 20 bp, human
ggatccgggcgagcaggcgg

SEQ ID NO: 120552 - DNA, 20 bp, human
ggacagagccccacagtgag

SEQ ID NO: 120553 - DNA, 20 bp, human
gacagagccatggctcaagc

SEQ ID NO: 120554 - DNA, 20 bp, human
gcgtgatccgggcgagcagg

SEQ ID NO: 120555 - DNA, 20 bp, human
gcagcagccgatgtgaagac

SEQ ID NO: 120556 - DNA, 20 bp, human
gtcacccaaacagaagacgt

SEQ ID NO: 120557 - DNA, 20 bp, human
ggccatgtccgagcccgctc

SEQ ID NO: 120558 - DNA, 20 bp, human
ggccggagcgggctcggaca

SEQ ID NO: 120559 - DNA, 20 bp, human
gagctgacaatggaaagtct

SEQ ID NO: 120560 - DNA, 20 bp, human
gatgaacccggagctgacaa

SEQ ID NO: 120561 - DNA, 20 bp, human
ggcctcaccaaagacctaga

SEQ ID NO: 120562 - DNA, 20 bp, human
ggaaggctgcgccatgaacc

SEQ ID NO: 120563 - DNA, 20 bp, human
gaggcatcgataggcggtgt

SEQ ID NO: 120564 - DNA, 20 bp, human
ggcgccgacgtcttctgttt

SEQ ID NO: 120565 - DNA, 20 bp, human
ggccttctaggtctttggtg

SEQ ID NO: 120566 - DNA, 20 bp, human
gactcccgcccgctccccgg

SEQ ID NO: 120567 - DNA, 20 bp, human
ggcgggcgggagtcatgcag

SEQ ID NO: 120568 - DNA, 20 bp, human
gaggggcgtgagcgtcgtgt

SEQ ID NO: 120569 - DNA, 20 bp, human
ggcccgctgcacccggcaat

SEQ ID NO: 120570 - DNA, 20 bp, human
ggacttccgcggggaactgg

SEQ ID NO: 120571 - DNA, 20 bp, human
ggcagcggccttgagcacta

SEQ ID NO: 120572 - DNA, 20 bp, human
gcgccggcccctagtgctca

SEQ ID NO: 120573 - DNA, 20 bp, human
ggcagccaccggggagcggg

SEQ ID NO: 120574 - DNA, 20 bp, human
gctgcacccggcaatgggca

SEQ ID NO: 120575 - DNA, 20 bp, human
gcctgcgaggcgccgggcct

SEQ ID NO: 120576 - DNA, 20 bp, human
ggattaccgcgccaacaaag

SEQ ID NO: 120577 - DNA, 20 bp, human
gtgggcgggatagagagcgt

SEQ ID NO: 120578 - DNA, 20 bp, human
gggcagttcctcgtgaccag

SEQ ID NO: 120579 - DNA, 20 bp, human
gcagcggccacggcctccgg

SEQ ID NO: 120580 - DNA, 20 bp, human
gggccttgggagctcctccg

SEQ ID NO: 120581 - DNA, 20 bp, human
ggctcccaaggcctctacgt

SEQ ID NO: 120582 - DNA, 20 bp, human
ggtcctgagggatatagtgt

SEQ ID NO: 120583 - DNA, 20 bp, human
gcacaacgctcactggccaa

SEQ ID NO: 120584 - DNA, 20 bp, human
gatagagagcgtgggcgggg

SEQ ID NO: 120585 - DNA, 20 bp, human
gtaatcggtgagaatgggag

SEQ ID NO: 120586 - DNA, 20 bp, human
gcctgcgctggggactggtc

SEQ ID NO: 120587 - DNA, 20 bp, human
gagaccattctggggttcaa

SEQ ID NO: 120588 - DNA, 20 bp, human
gtgaagtataaggtaaagaa

SEQ ID NO: 120589 - DNA, 20 bp, human
gcataccggcactgagacta

SEQ ID NO: 120590 - DNA, 20 bp, human
ggtgggtggtggtaggaact

SEQ ID NO: 120591 - DNA, 20 bp, human
gagccctttgaaccccagaa

SEQ ID NO: 120592 - DNA, 20 bp, human
gatagccaaggacacatgga

SEQ ID NO: 120593 - DNA, 20 bp, human
gttatctgcattccttgata

SEQ ID NO: 120594 - DNA, 20 bp, human
ggggcaaatgaagaccattc

SEQ ID NO: 120595 - DNA, 20 bp, human
gtaaagagagctgaaagatg

SEQ ID NO: 120596 - DNA, 20 bp, human
gcgactacgtcgggccgctg

SEQ ID NO: 120597 - DNA, 20 bp, human
gggctcccgcgtggccgtct

SEQ ID NO: 120598 - DNA, 20 bp, human
gaagtggccctcagcagcaa

SEQ ID NO: 120599 - DNA, 20 bp, human
gcagcaagggcacagagccg

SEQ ID NO: 120600 - DNA, 20 bp, human
ggagacgggccaagattgag

SEQ ID NO: 120601 - DNA, 20 bp, human
gcccggtccaggaatgaccc

SEQ ID NO: 120602 - DNA, 20 bp, human
gtgggtagggccagagaaaa

SEQ ID NO: 120603 - DNA, 20 bp, human
ggaagacacaagggtgtaaa

SEQ ID NO: 120604 - DNA, 20 bp, human
gagtccatgcgccattggga

SEQ ID NO: 120605 - DNA, 20 bp, human
gacttccgcaagagcctgac

SEQ ID NO: 120606 - DNA, 20 bp, human
gtgtgagaccgccaagatgg

SEQ ID NO: 120607 - DNA, 20 bp, human
gtggcgaagctgctatactt

SEQ ID NO: 120608 - DNA, 20 bp, human
ggtggtgggcgcgttcccta

SEQ ID NO: 120609 - DNA, 20 bp, human
gaggaaatgccagccgataa

SEQ ID NO: 120610 - DNA, 20 bp, human
gccctgtgagaccgccaaga

SEQ ID NO: 120611 - DNA, 20 bp, human
gtccaggatagaggagctag

SEQ ID NO: 120612 - DNA, 20 bp, human
ggtatagcagcttcgccata

SEQ ID NO: 120613 - DNA, 20 bp, human
gacgggtggcccagtagtga

SEQ ID NO: 120614 - DNA, 20 bp, human
gtccagtggccaatagtggg

SEQ ID NO: 120615 - DNA, 20 bp, human
gaaggagccaccacgcgagt

SEQ ID NO: 120616 - DNA, 20 bp, human
gaggtccccggtcttgacaa

SEQ ID NO: 120617 - DNA, 20 bp, human
gaccggggacctggacgcag

SEQ ID NO: 120618 - DNA, 20 bp, human
ggaggtcccacaacagacgg

SEQ ID NO: 120619 - DNA, 20 bp, human
gtgcgcgcggcgactggacg

SEQ ID NO: 120620 - DNA, 20 bp, human
gcccccgcggggcagaacag

SEQ ID NO: 120621 - DNA, 20 bp, human
gcgcgccgttgtcaagaccg

SEQ ID NO: 120622 - DNA, 20 bp, human
ggagtcagagacatccgcag

SEQ ID NO: 120623 - DNA, 20 bp, human
ggcgcggcgactggacgggg

SEQ ID NO: 120624 - DNA, 20 bp, human
ggaaggaaagacacgtccag

SEQ ID NO: 120625 - DNA, 20 bp, human
gcccacaacagacgggggtg

SEQ ID NO: 120626 - DNA, 20 bp, human
ggtgtacgaagaaggttcct

SEQ ID NO: 120627 - DNA, 20 bp, human
gtcaactagaaagggaacat

SEQ ID NO: 120628 - DNA, 20 bp, human
gcaaaggcagtgtacgaaga

SEQ ID NO: 120629 - DNA, 20 bp, human
ggcttgtgtctttcatttgt

SEQ ID NO: 120630 - DNA, 20 bp, human
gccatttctgacagtctccc

SEQ ID NO: 120631 - DNA, 20 bp, human
gttaactgacaaagctgcag

SEQ ID NO: 120632 - DNA, 20 bp, human
gtaaatgtacaatgaagtaa

SEQ ID NO: 120633 - DNA, 20 bp, human
gactctgtactcttgtatgt

SEQ ID NO: 120634 - DNA, 20 bp, human
gctgtcttacttgtttaatc

SEQ ID NO: 120635 - DNA, 20 bp, human
gccctttctagttgaagcaa

SEQ ID NO: 120636 - DNA, 20 bp, human
gagtagcgtctcgaagagag

SEQ ID NO: 120637 - DNA, 20 bp, human
gcgtgccgcgtccccggagg

SEQ ID NO: 120638 - DNA, 20 bp, human
gctgctaggctggaaagctg

SEQ ID NO: 120639 - DNA, 20 bp, human
ggttccagatgcgagacctg

SEQ ID NO: 120640 - DNA, 20 bp, human
gtctcgcatctggaacccca

SEQ ID NO: 120641 - DNA, 20 bp, human
gcgcatctggaaccccaagg

SEQ ID NO: 120642 - DNA, 20 bp, human
ggcgactcgcggccagccgg

SEQ ID NO: 120643 - DNA, 20 bp, human
gcggggagctgggcggacgg

SEQ ID NO: 120644 - DNA, 20 bp, human
gtggccgcgagtcgccgacc

SEQ ID NO: 120645 - DNA, 20 bp, human
ggcagccagggtcgtccggt

SEQ ID NO: 120646 - DNA, 20 bp, human
gctgggaacagcctctctac

SEQ ID NO: 120647 - DNA, 20 bp, human
gcaaagaccgagagcatcaa

SEQ ID NO: 120648 - DNA, 20 bp, human
gttgggcccgcccaaggtgt

SEQ ID NO: 120649 - DNA, 20 bp, human
gagcatcaatggcacagtag

SEQ ID NO: 120650 - DNA, 20 bp, human
gggcacagtagaggaagtag

SEQ ID NO: 120651 - DNA, 20 bp, human
gagcgagcggaagacttcct

SEQ ID NO: 120652 - DNA, 20 bp, human
ggtgtaggcgaggttagagc

SEQ ID NO: 120653 - DNA, 20 bp, human
gccctggtcaggaaactcta

SEQ ID NO: 120654 - DNA, 20 bp, human
gctctacaggctcctcgctc

SEQ ID NO: 120655 - DNA, 20 bp, human
gtcgcagtcggatcccggca

SEQ ID NO: 120656 - DNA, 20 bp, human
gacggagcctgagcaccgac

SEQ ID NO: 120657 - DNA, 20 bp, human
gcccacctggcgctcggctc

SEQ ID NO: 120658 - DNA, 20 bp, human
ggccgcaggcccagctccga

SEQ ID NO: 120659 - DNA, 20 bp, human
gtgggccgaaacccaggcag

SEQ ID NO: 120660 - DNA, 20 bp, human
gcccggagaagcgcgatgct

SEQ ID NO: 120661 - DNA, 20 bp, human
ggcatcaggccgctgaccgc

SEQ ID NO: 120662 - DNA, 20 bp, human
gcggctcggtcgctcgcggt

SEQ ID NO: 120663 - DNA, 20 bp, human
gcttctccgggccctggact

SEQ ID NO: 120664 - DNA, 20 bp, human
ggctccggctcggtcgctcg

SEQ ID NO: 120665 - DNA, 20 bp, human
gcccgaggcgaggctggtgc

SEQ ID NO: 120666 - DNA, 20 bp, human
ggccctggcgcatcacctga

SEQ ID NO: 120667 - DNA, 20 bp, human
gaccctcaggtgatgcgcca

SEQ ID NO: 120668 - DNA, 20 bp, human
ggcgctttatactggcctgt

SEQ ID NO: 120669 - DNA, 20 bp, human
gccagcagtggagcctccaa

SEQ ID NO: 120670 - DNA, 20 bp, human
gtggaaagccctgtccccga

SEQ ID NO: 120671 - DNA, 20 bp, human
gagggactccgtggaatgag

SEQ ID NO: 120672 - DNA, 20 bp, human
gaggaagctgagggactccg

SEQ ID NO: 120673 - DNA, 20 bp, human
gcagtgaacacactcatcta

SEQ ID NO: 120674 - DNA, 20 bp, human
gcggcctcggattctcaaag

SEQ ID NO: 120675 - DNA, 20 bp, human
gtgagccagcaggcccgtgg

SEQ ID NO: 120676 - DNA, 20 bp, human
gaccctcaggtgacgcacca

SEQ ID NO: 120677 - DNA, 20 bp, human
ggccctggtgcgtcacctga

SEQ ID NO: 120678 - DNA, 20 bp, human
gggtgctttataccggccag

SEQ ID NO: 120679 - DNA, 20 bp, human
gtggaaagccctgtccccga

SEQ ID NO: 120680 - DNA, 20 bp, human
gccagcagtggagcctccaa

SEQ ID NO: 120681 - DNA, 20 bp, human
gagggactccgtggaatgag

SEQ ID NO: 120682 - DNA, 20 bp, human
ggtgcgtcacctgagggtca

SEQ ID NO: 120683 - DNA, 20 bp, human
gcggcctcggattctcaaag

SEQ ID NO: 120684 - DNA, 20 bp, human
gcagtgaacacactcatcta

SEQ ID NO: 120685 - DNA, 20 bp, human
gaggctccactgctgggcca

SEQ ID NO: 120686 - DNA, 20 bp, human
gaccctcaggtgacgcacca

SEQ ID NO: 120687 - DNA, 20 bp, human
ggccctggtgcgtcacctga

SEQ ID NO: 120688 - DNA, 20 bp, human
gggtgctttataccggccag

SEQ ID NO: 120689 - DNA, 20 bp, human
gtggaaagccctgtccccga

SEQ ID NO: 120690 - DNA, 20 bp, human
gccagcagtggagcctccaa

SEQ ID NO: 120691 - DNA, 20 bp, human
gagggactccgtggaatgag

SEQ ID NO: 120692 - DNA, 20 bp, human
ggtgcgtcacctgagggtca

SEQ ID NO: 120693 - DNA, 20 bp, human
gcggcctcggattctcaaag

SEQ ID NO: 120694 - DNA, 20 bp, human
gcagtgaacacactcatcta

SEQ ID NO: 120695 - DNA, 20 bp, human
gaggctccactgctgggcca

SEQ ID NO: 120696 - DNA, 20 bp, human
gaggtagaaggcccagacag

SEQ ID NO: 120697 - DNA, 20 bp, human
gggtactgaggcccatccca

SEQ ID NO: 120698 - DNA, 20 bp, human
gctttaggaaccccctccag

SEQ ID NO: 120699 - DNA, 20 bp, human
gtccatgagaaaaatgtcgg

SEQ ID NO: 120700 - DNA, 20 bp, human
gacagctggcgacgaagaca

SEQ ID NO: 120701 - DNA, 20 bp, human
gcacctataagaggactcag

SEQ ID NO: 120702 - DNA, 20 bp, human
gttcctaaagaggagtctgg

SEQ ID NO: 120703 - DNA, 20 bp, human
gaggttgctactccactgga

SEQ ID NO: 120704 - DNA, 20 bp, human
ggtctgggccttctacctcc

SEQ ID NO: 120705 - DNA, 20 bp, human
gcagaggaggaagcctccga

SEQ ID NO: 120706 - DNA, 20 bp, human
gggcgcgctccgcactgggt

SEQ ID NO: 120707 - DNA, 20 bp, human
ggctgggtgtgggacaccgt

SEQ ID NO: 120708 - DNA, 20 bp, human
gctcgcggcgcgctccgcac

SEQ ID NO: 120709 - DNA, 20 bp, human
gcgggcccctcagtgcacaa

SEQ ID NO: 120710 - DNA, 20 bp, human
gtcctgcctgaggaacggct

SEQ ID NO: 120711 - DNA, 20 bp, human
ggacaccgtgggctgcgtgt

SEQ ID NO: 120712 - DNA, 20 bp, human
ggcacaatggctagagcagg

SEQ ID NO: 120713 - DNA, 20 bp, human
gaggcaggacacgaaggtaa

SEQ ID NO: 120714 - DNA, 20 bp, human
ggcgtgtgggacgggtttag

SEQ ID NO: 120715 - DNA, 20 bp, human
gccagtccaactcaccgaag

SEQ ID NO: 120716 - DNA, 20 bp, human
gccctcctggccacacacag

SEQ ID NO: 120717 - DNA, 20 bp, human
gacacacaggggctttgaca

SEQ ID NO: 120718 - DNA, 20 bp, human
gaagatggggatgaactctg

SEQ ID NO: 120719 - DNA, 20 bp, human
gatcaggggcgggctcagag

SEQ ID NO: 120720 - DNA, 20 bp, human
gcagcctggagctgctcttg

SEQ ID NO: 120721 - DNA, 20 bp, human
ggtccggcgcagatccagcc

SEQ ID NO: 120722 - DNA, 20 bp, human
gctggcggttgctctgtgtc

SEQ ID NO: 120723 - DNA, 20 bp, human
ggcaaggaccatcccaactc

SEQ ID NO: 120724 - DNA, 20 bp, human
ggtgcccttgacttctctgt

SEQ ID NO: 120725 - DNA, 20 bp, human
gctggatctgcgccggacac

SEQ ID NO: 120726 - DNA, 20 bp, human
gacagttgaaggcagttgag

SEQ ID NO: 120727 - DNA, 20 bp, human
gagtgacatatcacaagcat

SEQ ID NO: 120728 - DNA, 20 bp, human
ggacagttgaagacagttga

SEQ ID NO: 120729 - DNA, 20 bp, human
ggttttaggtcattagagta

SEQ ID NO: 120730 - DNA, 20 bp, human
ggtcgttgagagtgttacct

SEQ ID NO: 120731 - DNA, 20 bp, human
gattacatatatcatcagca

SEQ ID NO: 120732 - DNA, 20 bp, human
gctacaggtatgttaatgtg

SEQ ID NO: 120733 - DNA, 20 bp, human
gcacaagcataggaagcttc

SEQ ID NO: 120734 - DNA, 20 bp, human
gacaagtttctaatggtaag

SEQ ID NO: 120735 - DNA, 20 bp, human
gaacttcagagttgcttaga

SEQ ID NO: 120736 - DNA, 20 bp, human
gcggcccgcagcggactcac

SEQ ID NO: 120737 - DNA, 20 bp, human
ggcgctccgggcgaggagag

SEQ ID NO: 120738 - DNA, 20 bp, human
gaggcgttggcgaagagcgg

SEQ ID NO: 120739 - DNA, 20 bp, human
gtcctggctcacagcgctcc

SEQ ID NO: 120740 - DNA, 20 bp, human
gacgaggcgcagagacagcg

SEQ ID NO: 120741 - DNA, 20 bp, human
gcgcacggtggagagggacg

SEQ ID NO: 120742 - DNA, 20 bp, human
gacgttgcccagcagcccca

SEQ ID NO: 120743 - DNA, 20 bp, human
gacggtggagagggacgcgg

SEQ ID NO: 120744 - DNA, 20 bp, human
gcccagggcgcacggtggag

SEQ ID NO: 120745 - DNA, 20 bp, human
gcacacggccgagtagagcg

SEQ ID NO: 120746 - DNA, 20 bp, human
gtgcctagaattggtgaggg

SEQ ID NO: 120747 - DNA, 20 bp, human
gagcctgcggactcccaccc

SEQ ID NO: 120748 - DNA, 20 bp, human
gcggaacagcagccctcggg

SEQ ID NO: 120749 - DNA, 20 bp, human
gccgggccgcaagtcgccgg

SEQ ID NO: 120750 - DNA, 20 bp, human
ggacgtgcgctgagaggcgg

SEQ ID NO: 120751 - DNA, 20 bp, human
gggccccgctctccgcccga

SEQ ID NO: 120752 - DNA, 20 bp, human
gggagacgtgcgctgagagg

SEQ ID NO: 120753 - DNA, 20 bp, human
ggcgcgcctgctggccggaa

SEQ ID NO: 120754 - DNA, 20 bp, human
gcagagccgccgccagtagt

SEQ ID NO: 120755 - DNA, 20 bp, human
ggaaccggctggacgcggag

SEQ ID NO: 120756 - DNA, 20 bp, human
gcgagcacaggtgcagagca

SEQ ID NO: 120757 - DNA, 20 bp, human
gtcacacacagggtgcctgg

SEQ ID NO: 120758 - DNA, 20 bp, human
gacgcagcagccgagtgagc

SEQ ID NO: 120759 - DNA, 20 bp, human
gtcggctgctgcgtctggtc

SEQ ID NO: 120760 - DNA, 20 bp, human
gccggctggcagtcgagcac

SEQ ID NO: 120761 - DNA, 20 bp, human
ggacacacccagaaacgcct

SEQ ID NO: 120762 - DNA, 20 bp, human
gggacacgtgtccacccaca

SEQ ID NO: 120763 - DNA, 20 bp, human
ggtttagagactcacacaca

SEQ ID NO: 120764 - DNA, 20 bp, human
gttcgggctgccggctcact

SEQ ID NO: 120765 - DNA, 20 bp, human
ggagccgctggaggtcgggt

SEQ ID NO: 120766 - DNA, 20 bp, human
gtccgtccgcccgggagcca

SEQ ID NO: 120767 - DNA, 20 bp, human
gagagtcgaggtgctcatag

SEQ ID NO: 120768 - DNA, 20 bp, human
gcacccccaggcgactgtgg

SEQ ID NO: 120769 - DNA, 20 bp, human
ggccgcacggtagtagatgg

SEQ ID NO: 120770 - DNA, 20 bp, human
gcggcccccacagtcgcctg

SEQ ID NO: 120771 - DNA, 20 bp, human
gatgagcacctcgactctcc

SEQ ID NO: 120772 - DNA, 20 bp, human
gtgggacacacgggtcagca

SEQ ID NO: 120773 - DNA, 20 bp, human
gttacagacgcggctcacgg

SEQ ID NO: 120774 - DNA, 20 bp, human
ggctcacggaggcgaggggt

SEQ ID NO: 120775 - DNA, 20 bp, human
gtgtgggacttccacgacag

SEQ ID NO: 120776 - DNA, 20 bp, human
ggagcctctgtgaactacta

SEQ ID NO: 120777 - DNA, 20 bp, human
gctctgtgaactactaaggt

SEQ ID NO: 120778 - DNA, 20 bp, human
ggagcaacttgagtacgcca

SEQ ID NO: 120779 - DNA, 20 bp, human
gcaagttgacccaggaaccg

SEQ ID NO: 120780 - DNA, 20 bp, human
gcaattgctggcgttcgtgg

SEQ ID NO: 120781 - DNA, 20 bp, human
gggacaggttgccatctaag

SEQ ID NO: 120782 - DNA, 20 bp, human
ggtccgaaccgcaccgacct

SEQ ID NO: 120783 - DNA, 20 bp, human
gagaggagcgtcaggcggag

SEQ ID NO: 120784 - DNA, 20 bp, human
gcggaccgcatgggtcggac

SEQ ID NO: 120785 - DNA, 20 bp, human
gtgggccatgcgggattcgg

SEQ ID NO: 120786 - DNA, 20 bp, human
ggtggaggctgtctgaactg

SEQ ID NO: 120787 - DNA, 20 bp, human
gctgcagcttccagaaaggt

SEQ ID NO: 120788 - DNA, 20 bp, human
gaagggtggggaggttaact

SEQ ID NO: 120789 - DNA, 20 bp, human
gcagaagcattgaaggggta

SEQ ID NO: 120790 - DNA, 20 bp, human
gcttcaatgcttctggatcc

SEQ ID NO: 120791 - DNA, 20 bp, human
gggcctctggccaaagaagt

SEQ ID NO: 120792 - DNA, 20 bp, human
gttggacaagacttttgggt

SEQ ID NO: 120793 - DNA, 20 bp, human
ggttagacagtggtgcccgg

SEQ ID NO: 120794 - DNA, 20 bp, human
ggccatcggtgcgcaaatga

SEQ ID NO: 120795 - DNA, 20 bp, human
gattgaaggggtaaggctca

SEQ ID NO: 120796 - DNA, 20 bp, human
gggaaagccaggagcctcat

SEQ ID NO: 120797 - DNA, 20 bp, human
gcaccaaggccagcagactc

SEQ ID NO: 120798 - DNA, 20 bp, human
gaagtgacaagtccctatgg

SEQ ID NO: 120799 - DNA, 20 bp, human
ggccaggaccagccgctgaa

SEQ ID NO: 120800 - DNA, 20 bp, human
ggcggctggtcctggcaagt

SEQ ID NO: 120801 - DNA, 20 bp, human
gtctaagtgacaagtcccta

SEQ ID NO: 120802 - DNA, 20 bp, human
gtcaggacatcattccgcag

SEQ ID NO: 120803 - DNA, 20 bp, human
gtgactccccatgaggctcc

SEQ ID NO: 120804 - DNA, 20 bp, human
gacatagctttggcaggggg

SEQ ID NO: 120805 - DNA, 20 bp, human
gagcctcatggggagtcaga

SEQ ID NO: 120806 - DNA, 20 bp, human
gtggaggctggagccgcagg

SEQ ID NO: 120807 - DNA, 20 bp, human
gagagaactcccgaccggga

SEQ ID NO: 120808 - DNA, 20 bp, human
gaccaggtcaggacccgccg

SEQ ID NO: 120809 - DNA, 20 bp, human
gtgaccagggaacctgccgg

SEQ ID NO: 120810 - DNA, 20 bp, human
ggcctcggcgggtcctgacc

SEQ ID NO: 120811 - DNA, 20 bp, human
gtgagcgaagccaagccggg

SEQ ID NO: 120812 - DNA, 20 bp, human
gtgggaggatccccaagcct

SEQ ID NO: 120813 - DNA, 20 bp, human
ggtcgggagttctctccagg

SEQ ID NO: 120814 - DNA, 20 bp, human
gccggccctggacccttctt

SEQ ID NO: 120815 - DNA, 20 bp, human
gacacgcctgtgggagacat

SEQ ID NO: 120816 - DNA, 20 bp, human
gttcctgtagctataagtgt

SEQ ID NO: 120817 - DNA, 20 bp, human
ggggcagaagtccccaactg

SEQ ID NO: 120818 - DNA, 20 bp, human
gcaaaggactcgtgccaaac

SEQ ID NO: 120819 - DNA, 20 bp, human
gtgcccacacttatagctac

SEQ ID NO: 120820 - DNA, 20 bp, human
gatcagggtgaccaggtaga

SEQ ID NO: 120821 - DNA, 20 bp, human
gaagtccccaactgtggtca

SEQ ID NO: 120822 - DNA, 20 bp, human
gttctccatgaccacagttg

SEQ ID NO: 120823 - DNA, 20 bp, human
ggtttcccatcagggtgacc

SEQ ID NO: 120824 - DNA, 20 bp, human
ggatgaggcagtttcccatc

SEQ ID NO: 120825 - DNA, 20 bp, human
gagtagctacaggaaagcct

SEQ ID NO: 120826 - DNA, 20 bp, human
ggtcataagccatcgctccc

SEQ ID NO: 120827 - DNA, 20 bp, human
gccagtgattatgaacagag

SEQ ID NO: 120828 - DNA, 20 bp, human
gcaccacagataggttcagg

SEQ ID NO: 120829 - DNA, 20 bp, human
gactcacctccaccacagat

SEQ ID NO: 120830 - DNA, 20 bp, human
ggacttgaactcacagctat

SEQ ID NO: 120831 - DNA, 20 bp, human
gttcctcctgaacctatctg

SEQ ID NO: 120832 - DNA, 20 bp, human
gtatattgtttttatggacc

SEQ ID NO: 120833 - DNA, 20 bp, human
gacttcatactcgatatacc

SEQ ID NO: 120834 - DNA, 20 bp, human
ggttttcctagttatttatg

SEQ ID NO: 120835 - DNA, 20 bp, human
gagctccaggtgcagctctt

SEQ ID NO: 120836 - DNA, 20 bp, human
ggcctgaagctcagtggaca

SEQ ID NO: 120837 - DNA, 20 bp, human
gtatgtggcccatgatgact

SEQ ID NO: 120838 - DNA, 20 bp, human
gttctgcccaggacttcact

SEQ ID NO: 120839 - DNA, 20 bp, human
gctgggcagaagaatgatgt

SEQ ID NO: 120840 - DNA, 20 bp, human
gtgcactacccagtcatcat

SEQ ID NO: 120841 - DNA, 20 bp, human
gcactgggcattcaaaatct

SEQ ID NO: 120842 - DNA, 20 bp, human
gcacatatcctgtgcccagc

SEQ ID NO: 120843 - DNA, 20 bp, human
gagctgcctcttggttctca

SEQ ID NO: 120844 - DNA, 20 bp, human
ggttgtgtcttgaatgatca

SEQ ID NO: 120845 - DNA, 20 bp, human
gtgaatgcccagtgaagtcc

SEQ ID NO: 120846 - DNA, 20 bp, human
gcaaaggacacgggccaaac

SEQ ID NO: 120847 - DNA, 20 bp, human
gcatcatgaaccaaaggaca

SEQ ID NO: 120848 - DNA, 20 bp, human
gggatttatgcccatactta

SEQ ID NO: 120849 - DNA, 20 bp, human
gaaatccccagctgtggtcc

SEQ ID NO: 120850 - DNA, 20 bp, human
gctggagagagattcttgat

SEQ ID NO: 120851 - DNA, 20 bp, human
ggggcataaatccccagctg

SEQ ID NO: 120852 - DNA, 20 bp, human
gtttcctatagccataagta

SEQ ID NO: 120853 - DNA, 20 bp, human
gtctatttggttactctgaa

SEQ ID NO: 120854 - DNA, 20 bp, human
gatagatagttagaaatgtc

SEQ ID NO: 120855 - DNA, 20 bp, human
ggactgtatttcagtaggta

SEQ ID NO: 120856 - DNA, 20 bp, human
gggtactgttcaaacatcat

SEQ ID NO: 120857 - DNA, 20 bp, human
ggtacctaacataaaaccta

SEQ ID NO: 120858 - DNA, 20 bp, human
gggtcaccagataaataacc

SEQ ID NO: 120859 - DNA, 20 bp, human
ggagacgatgactataataa

SEQ ID NO: 120860 - DNA, 20 bp, human
gaccaaatgattatgaataa

SEQ ID NO: 120861 - DNA, 20 bp, human
gtaatcatttggtagttgag

SEQ ID NO: 120862 - DNA, 20 bp, human
ggggccttaggttttatgtt

SEQ ID NO: 120863 - DNA, 20 bp, human
gcatttggtagttgagagga

SEQ ID NO: 120864 - DNA, 20 bp, human
gtttctcctgaacttatctg

SEQ ID NO: 120865 - DNA, 20 bp, human
ggtccaccacagataagttc

SEQ ID NO: 120866 - DNA, 20 bp, human
ggagggaaacttgcatctcg

SEQ ID NO: 120867 - DNA, 20 bp, human
gtatgcttgtggatggccat

SEQ ID NO: 120868 - DNA, 20 bp, human
gccggacatccaagagccta

SEQ ID NO: 120869 - DNA, 20 bp, human
gttatgactgaataatggag

SEQ ID NO: 120870 - DNA, 20 bp, human
gaggtccctatgcttgtgga

SEQ ID NO: 120871 - DNA, 20 bp, human
ggttcattatgactgaataa

SEQ ID NO: 120872 - DNA, 20 bp, human
gtgaagtgcgagatccacac

SEQ ID NO: 120873 - DNA, 20 bp, human
gaagaagaagaagtacatct

SEQ ID NO: 120874 - DNA, 20 bp, human
ggaacaggtccctatgcttg

SEQ ID NO: 120875 - DNA, 20 bp, human
ggtctatgctacagacagct

SEQ ID NO: 120876 - DNA, 20 bp, human
ggatgatgggaaaagcacaa

SEQ ID NO: 120877 - DNA, 20 bp, human
gatagctgtggggtaataga

SEQ ID NO: 120878 - DNA, 20 bp, human
ggcacaagggtatagctgtg

SEQ ID NO: 120879 - DNA, 20 bp, human
gttgggcttctgggaccaag

SEQ ID NO: 120880 - DNA, 20 bp, human
ggtaatagaaggtacccact

SEQ ID NO: 120881 - DNA, 20 bp, human
ggccatggtgaggctgtaga

SEQ ID NO: 120882 - DNA, 20 bp, human
ggcctcaccatggccatgaa

SEQ ID NO: 120883 - DNA, 20 bp, human
gaaagccaagaggatgcact

SEQ ID NO: 120884 - DNA, 20 bp, human
gagcatctggggcctgtttg

SEQ ID NO: 120885 - DNA, 20 bp, human
ggtggccgagtgcatcctct

SEQ ID NO: 120886 - DNA, 20 bp, human
gctttgtggttcatcactag

SEQ ID NO: 120887 - DNA, 20 bp, human
gacaggaattgtgatggtcc

SEQ ID NO: 120888 - DNA, 20 bp, human
gtcaaatgtgactacaataa

SEQ ID NO: 120889 - DNA, 20 bp, human
gattactacaggaattgtga

SEQ ID NO: 120890 - DNA, 20 bp, human
gcatgggagtctggagagcg

SEQ ID NO: 120891 - DNA, 20 bp, human
gtgatgatcctgatgtgcaa

SEQ ID NO: 120892 - DNA, 20 bp, human
gtgatattcccaatctccac

SEQ ID NO: 120893 - DNA, 20 bp, human
gaaaagcatccagtggagat

SEQ ID NO: 120894 - DNA, 20 bp, human
gtcagctgataatagcttcc

SEQ ID NO: 120895 - DNA, 20 bp, human
gtgtctccttctgacagtga

SEQ ID NO: 120896 - DNA, 20 bp, human
ggggcaagaggtgataagag

SEQ ID NO: 120897 - DNA, 20 bp, human
gacagttcaactatttagag

SEQ ID NO: 120898 - DNA, 20 bp, human
gtagaatgataggcactatc

SEQ ID NO: 120899 - DNA, 20 bp, human
gatcaggaagagatgaagtc

SEQ ID NO: 120900 - DNA, 20 bp, human
gaggtcacctcttatcagac

SEQ ID NO: 120901 - DNA, 20 bp, human
gtgtctttccagttttacct

SEQ ID NO: 120902 - DNA, 20 bp, human
gacatgttctttagaatgat

SEQ ID NO: 120903 - DNA, 20 bp, human
gtataggagcttaaaaagag

SEQ ID NO: 120904 - DNA, 20 bp, human
gcagacaggagacaagttga

SEQ ID NO: 120905 - DNA, 20 bp, human
gttgtctcctgtctgataag

SEQ ID NO: 120906 - DNA, 20 bp, human
gagccgaggaacggtgactg

SEQ ID NO: 120907 - DNA, 20 bp, human
ggaggcttcttagatttggg

SEQ ID NO: 120908 - DNA, 20 bp, human
gacgggatagccttgatgga

SEQ ID NO: 120909 - DNA, 20 bp, human
gtccaaaataagccgaggaa

SEQ ID NO: 120910 - DNA, 20 bp, human
gagaatgaaatctgtcacca

SEQ ID NO: 120911 - DNA, 20 bp, human
gaacacatcgctggatgccg

SEQ ID NO: 120912 - DNA, 20 bp, human
gtgtcggatgattgatgcct

SEQ ID NO: 120913 - DNA, 20 bp, human
ggattttactccttccatca

SEQ ID NO: 120914 - DNA, 20 bp, human
gctcctcagtcaccgttcct

SEQ ID NO: 120915 - DNA, 20 bp, human
ggaggaggcttcttagattt

SEQ ID NO: 120916 - DNA, 20 bp, human
gtccttagcctgagtggata

SEQ ID NO: 120917 - DNA, 20 bp, human
gtccgtatccactcaggcta

SEQ ID NO: 120918 - DNA, 20 bp, human
gagagtgtccttagcctgag

SEQ ID NO: 120919 - DNA, 20 bp, human
gaggcgagggacaatgatgg

SEQ ID NO: 120920 - DNA, 20 bp, human
gatggcaggatccatccatg

SEQ ID NO: 120921 - DNA, 20 bp, human
gatgaggcgagggacaatga

SEQ ID NO: 120922 - DNA, 20 bp, human
gataggccattagggtgtag

SEQ ID NO: 120923 - DNA, 20 bp, human
gtgactgcgtttatcctgac

SEQ ID NO: 120924 - DNA, 20 bp, human
gtgagcgccttgcttgtggc

SEQ ID NO: 120925 - DNA, 20 bp, human
gagcaacacagccaccaaat

SEQ ID NO: 120926 - DNA, 20 bp, human
ggctgtcacgaggctggcgt

SEQ ID NO: 120927 - DNA, 20 bp, human
gggctggacgccctcctctt

SEQ ID NO: 120928 - DNA, 20 bp, human
ggaggatgaatgctgtcacg

SEQ ID NO: 120929 - DNA, 20 bp, human
gggcaaatggaaagtcaata

SEQ ID NO: 120930 - DNA, 20 bp, human
gcagcatgatgagtgggagc

SEQ ID NO: 120931 - DNA, 20 bp, human
gatgaatgctgtcacgaggc

SEQ ID NO: 120932 - DNA, 20 bp, human
gttggtgtccccaagcggca

SEQ ID NO: 120933 - DNA, 20 bp, human
gaggagggcgtccagccctg

SEQ ID NO: 120934 - DNA, 20 bp, human
gcaagtgccggtggccagga

SEQ ID NO: 120935 - DNA, 20 bp, human
gcaccaggaagattccaaag

SEQ ID NO: 120936 - DNA, 20 bp, human
gaggatgaacgctgtcagta

SEQ ID NO: 120937 - DNA, 20 bp, human
ggacatttcttctcatatat

SEQ ID NO: 120938 - DNA, 20 bp, human
ggagcgcccagtcatcatgt

SEQ ID NO: 120939 - DNA, 20 bp, human
gatgaacgctgtcagtaggg

SEQ ID NO: 120940 - DNA, 20 bp, human
ggctgtcagtagggtggcgt

SEQ ID NO: 120941 - DNA, 20 bp, human
ggggcgctcgtgtgccctcc

SEQ ID NO: 120942 - DNA, 20 bp, human
gcgtgtgccctcctggccac

SEQ ID NO: 120943 - DNA, 20 bp, human
gcaagtgccggtggccagga

SEQ ID NO: 120944 - DNA, 20 bp, human
ggtacaccaacatgatgact

SEQ ID NO: 120945 - DNA, 20 bp, human
gctgccgcttggggacacca

SEQ ID NO: 120946 - DNA, 20 bp, human
gacaggacatgaccctgtag

SEQ ID NO: 120947 - DNA, 20 bp, human
gatttctttcacttcctagg

SEQ ID NO: 120948 - DNA, 20 bp, human
ggggcgctcgtgtactcttc

SEQ ID NO: 120949 - DNA, 20 bp, human
ggaaacactcggtgccccct

SEQ ID NO: 120950 - DNA, 20 bp, human
gcaccgagtgtttcctctac

SEQ ID NO: 120951 - DNA, 20 bp, human
gtgactttggtgttcccaag

SEQ ID NO: 120952 - DNA, 20 bp, human
gttggtgttcccaagtggca

SEQ ID NO: 120953 - DNA, 20 bp, human
gcccaaattgctgatgactt

SEQ ID NO: 120954 - DNA, 20 bp, human
gaccaaagtcatcagcaatt

SEQ ID NO: 120955 - DNA, 20 bp, human
gggcatggggaaggcccatg

SEQ ID NO: 120956 - DNA, 20 bp, human
ggctgtcacgaggctggtct

SEQ ID NO: 120957 - DNA, 20 bp, human
gggcaaatggaaagtcaata

SEQ ID NO: 120958 - DNA, 20 bp, human
gatgaacgctgtcacgaggc

SEQ ID NO: 120959 - DNA, 20 bp, human
gttggtgtccccaagcggca

SEQ ID NO: 120960 - DNA, 20 bp, human
gctgctcccactcatcatgc

SEQ ID NO: 120961 - DNA, 20 bp, human
gagtggggcgtccagccctg

SEQ ID NO: 120962 - DNA, 20 bp, human
ggaggatgaacgctgtcacg

SEQ ID NO: 120963 - DNA, 20 bp, human
gaggaagattccaaagagtg

SEQ ID NO: 120964 - DNA, 20 bp, human
gggctggacgccccactctt

SEQ ID NO: 120965 - DNA, 20 bp, human
gatggaaagtcaatatggtc

SEQ ID NO: 120966 - DNA, 20 bp, human
gcctggggtgagatgtgaca

SEQ ID NO: 120967 - DNA, 20 bp, human
gcagtcccttgggcaaatcc

SEQ ID NO: 120968 - DNA, 20 bp, human
gggagacggagagggcgcac

SEQ ID NO: 120969 - DNA, 20 bp, human
ggcaaatccaggtatgggga

SEQ ID NO: 120970 - DNA, 20 bp, human
gccttgggcaaatccaggta

SEQ ID NO: 120971 - DNA, 20 bp, human
gttatcaagagcagtccctt

SEQ ID NO: 120972 - DNA, 20 bp, human
gaggatgaattgggtcactg

SEQ ID NO: 120973 - DNA, 20 bp, human
gtgggtcactgtggagtgat

SEQ ID NO: 120974 - DNA, 20 bp, human
ggaagccgacgaggatgaat

SEQ ID NO: 120975 - DNA, 20 bp, human
gtgattggctctctgcatgg

SEQ ID NO: 120976 - DNA, 20 bp, human
gggagactgagaggacgcac

SEQ ID NO: 120977 - DNA, 20 bp, human
gtcctctcttccccaactag

SEQ ID NO: 120978 - DNA, 20 bp, human
gaacgtgctcatgagcccac

SEQ ID NO: 120979 - DNA, 20 bp, human
gatgacggccacccctagtt

SEQ ID NO: 120980 - DNA, 20 bp, human
gtgcctggtgggctgctcct

SEQ ID NO: 120981 - DNA, 20 bp, human
gagcccaggagcagcccacc

SEQ ID NO: 120982 - DNA, 20 bp, human
gaggggtggccgtcatgctg

SEQ ID NO: 120983 - DNA, 20 bp, human
gacccctagttggggaagag

SEQ ID NO: 120984 - DNA, 20 bp, human
gtggtttagccccagcatga

SEQ ID NO: 120985 - DNA, 20 bp, human
gggggctgcgcctgcctggt

SEQ ID NO: 120986 - DNA, 20 bp, human
ggagaggataaattcagata

SEQ ID NO: 120987 - DNA, 20 bp, human
gacatgctaatgagtccccg

SEQ ID NO: 120988 - DNA, 20 bp, human
gtagcatgttgtaatgcagt

SEQ ID NO: 120989 - DNA, 20 bp, human
gctgcgttcaatccaaactg

SEQ ID NO: 120990 - DNA, 20 bp, human
gaactgtggccatgataaga

SEQ ID NO: 120991 - DNA, 20 bp, human
gcttggcaaccttcttatca

SEQ ID NO: 120992 - DNA, 20 bp, human
gcatgttgtaatgcagtggg

SEQ ID NO: 120993 - DNA, 20 bp, human
gtggttctgtagttctgacc

SEQ ID NO: 120994 - DNA, 20 bp, human
ggggatgatggtgacaatga

SEQ ID NO: 120995 - DNA, 20 bp, human
gctgtgcccatcttgtggcc

SEQ ID NO: 120996 - DNA, 20 bp, human
gcagcaggaacaagatgggc

SEQ ID NO: 120997 - DNA, 20 bp, human
gcacattgtaacgcagtggg

SEQ ID NO: 120998 - DNA, 20 bp, human
ggagcacattgtaacgcagt

SEQ ID NO: 120999 - DNA, 20 bp, human
gaaggtgatggaatgatggg

SEQ ID NO: 121000 - DNA, 20 bp, human
gtatctgaatttaacctctt

SEQ ID NO: 121001 - DNA, 20 bp, human
gctatagttctgactaggca

SEQ ID NO: 121002 - DNA, 20 bp, human
gctgtgttcaatccagattg

SEQ ID NO: 121003 - DNA, 20 bp, human
gaagatgggcacagtcacgg

SEQ ID NO: 121004 - DNA, 20 bp, human
gtgatgctatagttctgact

SEQ ID NO: 121005 - DNA, 20 bp, human
gaagatgggcaggaggtgct

SEQ ID NO: 121006 - DNA, 20 bp, human
gggcggccacccctagttgg

SEQ ID NO: 121007 - DNA, 20 bp, human
gtgtctagtgactcccacct

SEQ ID NO: 121008 - DNA, 20 bp, human
gtcctctctccaccaactag

SEQ ID NO: 121009 - DNA, 20 bp, human
gaggatctcggtgatggaga

SEQ ID NO: 121010 - DNA, 20 bp, human
ggtgtggtttagcccctgca

SEQ ID NO: 121011 - DNA, 20 bp, human
gtaggggtggccgccatgca

SEQ ID NO: 121012 - DNA, 20 bp, human
gccagtggttaggagcacag

SEQ ID NO: 121013 - DNA, 20 bp, human
gacccctagttggtggagag

SEQ ID NO: 121014 - DNA, 20 bp, human
gtggtttagcccctgcatgg

SEQ ID NO: 121015 - DNA, 20 bp, human
gctgcgctcgctccagacag

SEQ ID NO: 121016 - DNA, 20 bp, human
gaagcagttagtgatgccaa

SEQ ID NO: 121017 - DNA, 20 bp, human
ggggctggctcatacctacg

SEQ ID NO: 121018 - DNA, 20 bp, human
ggtgcttctactgctttact

SEQ ID NO: 121019 - DNA, 20 bp, human
gtgaagtggacagcatgctc

SEQ ID NO: 121020 - DNA, 20 bp, human
ggaggctggagagcattctt

SEQ ID NO: 121021 - DNA, 20 bp, human
gatggaagctagagaaacct

SEQ ID NO: 121022 - DNA, 20 bp, human
ggcacaccctgccaatgata

SEQ ID NO: 121023 - DNA, 20 bp, human
ggttctctcttttcatggat

SEQ ID NO: 121024 - DNA, 20 bp, human
gacaaaaaagaacatctgtg

SEQ ID NO: 121025 - DNA, 20 bp, human
ggcaaggaacacgccaaaaa

SEQ ID NO: 121026 - DNA, 20 bp, human
gaggaactcagtcacaaaag

SEQ ID NO: 121027 - DNA, 20 bp, human
gactggcctctggatcactg

SEQ ID NO: 121028 - DNA, 20 bp, human
gagtcagcaggtacaaagtt

SEQ ID NO: 121029 - DNA, 20 bp, human
gccaatccccagtgatccag

SEQ ID NO: 121030 - DNA, 20 bp, human
gttgtgctgccgcctgaagc

SEQ ID NO: 121031 - DNA, 20 bp, human
gaagagggcctgtatccaac

SEQ ID NO: 121032 - DNA, 20 bp, human
gagagatggatagcatgcac

SEQ ID NO: 121033 - DNA, 20 bp, human
ggggtggcaatgggctgatg

SEQ ID NO: 121034 - DNA, 20 bp, human
ggaatttagctttggcatca

SEQ ID NO: 121035 - DNA, 20 bp, human
gtcagtcatcatgggtaaga

SEQ ID NO: 121036 - DNA, 20 bp, human
ggcaacaaatggagtcaaca

SEQ ID NO: 121037 - DNA, 20 bp, human
gatgctggctagttcagaga

SEQ ID NO: 121038 - DNA, 20 bp, human
gatgtgcccagctggtgtgt

SEQ ID NO: 121039 - DNA, 20 bp, human
gtgaggctcaaaagcattcg

SEQ ID NO: 121040 - DNA, 20 bp, human
gagtgtctgaaagcaacaaa

SEQ ID NO: 121041 - DNA, 20 bp, human
gtgaactagccagcatgctt

SEQ ID NO: 121042 - DNA, 20 bp, human
gtgtgtgggtcctttggcat

SEQ ID NO: 121043 - DNA, 20 bp, human
gtgcttcctgcttactgcaa

SEQ ID NO: 121044 - DNA, 20 bp, human
gataccccattgcagtaagc

SEQ ID NO: 121045 - DNA, 20 bp, human
gcatcagataaccctctttg

SEQ ID NO: 121046 - DNA, 20 bp, human
gcttctataaaggagagtca

SEQ ID NO: 121047 - DNA, 20 bp, human
gagggacagaggtagaaacc

SEQ ID NO: 121048 - DNA, 20 bp, human
gatggagagcacttctataa

SEQ ID NO: 121049 - DNA, 20 bp, human
gccttcctgctggcagccat

SEQ ID NO: 121050 - DNA, 20 bp, human
gagggctctgtccagcacaa

SEQ ID NO: 121051 - DNA, 20 bp, human
gaagtacatgggagtatgaa

SEQ ID NO: 121052 - DNA, 20 bp, human
gcaggatccagaaaggagag

SEQ ID NO: 121053 - DNA, 20 bp, human
ggtcttattgacttgctcca

SEQ ID NO: 121054 - DNA, 20 bp, human
gtgagagagttcgtcgtcct

SEQ ID NO: 121055 - DNA, 20 bp, human
gaatttcacacaaagtttgc

SEQ ID NO: 121056 - DNA, 20 bp, human
ggagcgggtcaatgagactg

SEQ ID NO: 121057 - DNA, 20 bp, human
gggggtgtgtatgggactag

SEQ ID NO: 121058 - DNA, 20 bp, human
gtgatgtatgctccatggag

SEQ ID NO: 121059 - DNA, 20 bp, human
gccatggagcatacatcatc

SEQ ID NO: 121060 - DNA, 20 bp, human
gcccatgactgccagcagaa

SEQ ID NO: 121061 - DNA, 20 bp, human
ggtctcattgacccgctcca

SEQ ID NO: 121062 - DNA, 20 bp, human
ggcacagatcatcacatcct

SEQ ID NO: 121063 - DNA, 20 bp, human
ggatatgaagggccctgtcc

SEQ ID NO: 121064 - DNA, 20 bp, human
gacagtgaagccacaggcac

SEQ ID NO: 121065 - DNA, 20 bp, human
gtgtgcaacagtgaagccac

SEQ ID NO: 121066 - DNA, 20 bp, human
ggcccgtgggctcaagaggg

SEQ ID NO: 121067 - DNA, 20 bp, human
gagagggtggaatagcgtag

SEQ ID NO: 121068 - DNA, 20 bp, human
gcaggcccgtgggctcaaga

SEQ ID NO: 121069 - DNA, 20 bp, human
gagcttctggcctggagtga

SEQ ID NO: 121070 - DNA, 20 bp, human
gcatggccatgcaggcccgt

SEQ ID NO: 121071 - DNA, 20 bp, human
gatcccagaaggaggaattc

SEQ ID NO: 121072 - DNA, 20 bp, human
ggtcctgggcacgatgtcag

SEQ ID NO: 121073 - DNA, 20 bp, human
ggagctccaccactgagagt

SEQ ID NO: 121074 - DNA, 20 bp, human
gagccaggaggtacccacca

SEQ ID NO: 121075 - DNA, 20 bp, human
gggccatggtgggtacctcc

SEQ ID NO: 121076 - DNA, 20 bp, human
gagctcgcgggtcatgatga

SEQ ID NO: 121077 - DNA, 20 bp, human
ggagggtgtagtgcagcggg

SEQ ID NO: 121078 - DNA, 20 bp, human
gtgaagacaagtttccccac

SEQ ID NO: 121079 - DNA, 20 bp, human
gagttccaggaaagacaggt

SEQ ID NO: 121080 - DNA, 20 bp, human
ggacaggaagaaatacatcg

SEQ ID NO: 121081 - DNA, 20 bp, human
gagctgtgcacgcagatgct

SEQ ID NO: 121082 - DNA, 20 bp, human
gagcatcaagggtactacca

SEQ ID NO: 121083 - DNA, 20 bp, human
gatcaagggtactaccacgg

SEQ ID NO: 121084 - DNA, 20 bp, human
gaaacagtccgtgctgccga

SEQ ID NO: 121085 - DNA, 20 bp, human
ggaactctgctacaccaccg

SEQ ID NO: 121086 - DNA, 20 bp, human
gtaagagtggggtaatgcag

SEQ ID NO: 121087 - DNA, 20 bp, human
gctgccagctcataagagtg

SEQ ID NO: 121088 - DNA, 20 bp, human
gctgccaagatctgcaaagg

SEQ ID NO: 121089 - DNA, 20 bp, human
ggaattcggtgaccatggtg

SEQ ID NO: 121090 - DNA, 20 bp, human
gaacaggaattcggtgacca

SEQ ID NO: 121091 - DNA, 20 bp, human
gttggcagaaaacctcacca

SEQ ID NO: 121092 - DNA, 20 bp, human
gaatagcaggcagttggtaa

SEQ ID NO: 121093 - DNA, 20 bp, human
gcagttgaaggagattgtcc

SEQ ID NO: 121094 - DNA, 20 bp, human
gtttccccctttgcagatct

SEQ ID NO: 121095 - DNA, 20 bp, human
ggtagattgatgagcatctt

SEQ ID NO: 121096 - DNA, 20 bp, human
gcagggtacatagagtagga

SEQ ID NO: 121097 - DNA, 20 bp, human
gacatagagtaggagggcag

SEQ ID NO: 121098 - DNA, 20 bp, human
gatggcagggtacatagagt

SEQ ID NO: 121099 - DNA, 20 bp, human
ggagaaccccaaccagactg

SEQ ID NO: 121100 - DNA, 20 bp, human
gccatgctgtagatgtagaa

SEQ ID NO: 121101 - DNA, 20 bp, human
gctacatctacagcatggca

SEQ ID NO: 121102 - DNA, 20 bp, human
gggtgtacctcaaaccctcc

SEQ ID NO: 121103 - DNA, 20 bp, human
gggcagaggcatcacaattc

SEQ ID NO: 121104 - DNA, 20 bp, human
ggctgtagatgtagaaaggc

SEQ ID NO: 121105 - DNA, 20 bp, human
gttactgggtaagaccaagg

SEQ ID NO: 121106 - DNA, 20 bp, human
gcatcataaacaaaaggctg

SEQ ID NO: 121107 - DNA, 20 bp, human
ggtggttacacagttcatcc

SEQ ID NO: 121108 - DNA, 20 bp, human
gagctggagctcccccaggc

SEQ ID NO: 121109 - DNA, 20 bp, human
ggatgagtgtgtacctcaga

SEQ ID NO: 121110 - DNA, 20 bp, human
gaaagcaataaagaaacctg

SEQ ID NO: 121111 - DNA, 20 bp, human
gggtttcaacaaaaccactg

SEQ ID NO: 121112 - DNA, 20 bp, human
gcaccaggattgtcaagtat

SEQ ID NO: 121113 - DNA, 20 bp, human
ggtgggtttctccagcctgg

SEQ ID NO: 121114 - DNA, 20 bp, human
gtttctctctcaggagccac

SEQ ID NO: 121115 - DNA, 20 bp, human
ggtccagctgaagcgaataa

SEQ ID NO: 121116 - DNA, 20 bp, human
ggcatctggacctcagggtc

SEQ ID NO: 121117 - DNA, 20 bp, human
gccaatactctactcatgga

SEQ ID NO: 121118 - DNA, 20 bp, human
gtgtgtgtggagctgctggt

SEQ ID NO: 121119 - DNA, 20 bp, human
gtgatgagcctgtatcgcag

SEQ ID NO: 121120 - DNA, 20 bp, human
gaggtccaatactctactca

SEQ ID NO: 121121 - DNA, 20 bp, human
gctaagaggaaagatgacat

SEQ ID NO: 121122 - DNA, 20 bp, human
gaaatcagcatctggacctc

SEQ ID NO: 121123 - DNA, 20 bp, human
ggtagagtattggacctaag

SEQ ID NO: 121124 - DNA, 20 bp, human
gaacaggaaccccagcacca

SEQ ID NO: 121125 - DNA, 20 bp, human
ggagctgctggtaggctcct

SEQ ID NO: 121126 - DNA, 20 bp, human
gggacagaatatgcagttct

SEQ ID NO: 121127 - DNA, 20 bp, human
gaagtgtcaaggaattcttg

SEQ ID NO: 121128 - DNA, 20 bp, human
ggagctattttcagaaagag

SEQ ID NO: 121129 - DNA, 20 bp, human
gataaaccaggctgacccca

SEQ ID NO: 121130 - DNA, 20 bp, human
gactggagttagaaactgga

SEQ ID NO: 121131 - DNA, 20 bp, human
gttggggctagaaatcatta

SEQ ID NO: 121132 - DNA, 20 bp, human
gctagaaatcattaaggtaa

SEQ ID NO: 121133 - DNA, 20 bp, human
gggagagctacaagtacaga

SEQ ID NO: 121134 - DNA, 20 bp, human
ggatgatcaaaccataaacc

SEQ ID NO: 121135 - DNA, 20 bp, human
gcatagtttggcccaactct

SEQ ID NO: 121136 - DNA, 20 bp, human
gaagcagtggatatcttaga

SEQ ID NO: 121137 - DNA, 20 bp, human
gcaatgttggtcataagcag

SEQ ID NO: 121138 - DNA, 20 bp, human
ggaattccttcaggattgtc

SEQ ID NO: 121139 - DNA, 20 bp, human
gcaggtaatctgatcatcat

SEQ ID NO: 121140 - DNA, 20 bp, human
gcactaaggaagagatacat

SEQ ID NO: 121141 - DNA, 20 bp, human
gtagagggttacagatggcc

SEQ ID NO: 121142 - DNA, 20 bp, human
gattacctgcaagggtgaga

SEQ ID NO: 121143 - DNA, 20 bp, human
gagttgtccacatacaatgt

SEQ ID NO: 121144 - DNA, 20 bp, human
gagatacataggggtgtgga

SEQ ID NO: 121145 - DNA, 20 bp, human
gatcatcatgggtctaactt

SEQ ID NO: 121146 - DNA, 20 bp, human
ggcagaccaacgtaacctcc

SEQ ID NO: 121147 - DNA, 20 bp, human
ggaccaacgtaacctcctgg

SEQ ID NO: 121148 - DNA, 20 bp, human
gggatatacctctcagaatg

SEQ ID NO: 121149 - DNA, 20 bp, human
gacagagggtaggattcatg

SEQ ID NO: 121150 - DNA, 20 bp, human
gtccctccaggaggttacgt

SEQ ID NO: 121151 - DNA, 20 bp, human
gtccaaagaggtatccagtc

SEQ ID NO: 121152 - DNA, 20 bp, human
gtggtctgccccattctgag

SEQ ID NO: 121153 - DNA, 20 bp, human
gatgaccagctgggcacaga

SEQ ID NO: 121154 - DNA, 20 bp, human
gcagttagtacaggcccatg

SEQ ID NO: 121155 - DNA, 20 bp, human
gaagacaaaatccctccagg

SEQ ID NO: 121156 - DNA, 20 bp, human
gcacatatggggagaaacta

SEQ ID NO: 121157 - DNA, 20 bp, human
gaagccatcctagcagtgaa

SEQ ID NO: 121158 - DNA, 20 bp, human
ggtgaatggaaacacacata

SEQ ID NO: 121159 - DNA, 20 bp, human
ggtaatagagaaacagtgtg

SEQ ID NO: 121160 - DNA, 20 bp, human
ggaagcagctaaatagtagc

SEQ ID NO: 121161 - DNA, 20 bp, human
gcatgttgcacgtttttagt

SEQ ID NO: 121162 - DNA, 20 bp, human
gtagctggtgattctagctt

SEQ ID NO: 121163 - DNA, 20 bp, human
gcatgtgatagacattctag

SEQ ID NO: 121164 - DNA, 20 bp, human
gtttccattcactgctagga

SEQ ID NO: 121165 - DNA, 20 bp, human
gacctatttgtggaatttca

SEQ ID NO: 121166 - DNA, 20 bp, human
ggacggtgcaaacatagatg

SEQ ID NO: 121167 - DNA, 20 bp, human
gaccagcaattactgaatga

SEQ ID NO: 121168 - DNA, 20 bp, human
gtggtgcttttacaattcac

SEQ ID NO: 121169 - DNA, 20 bp, human
gccagagaacgagatgatct

SEQ ID NO: 121170 - DNA, 20 bp, human
gtcgataccttgccatctgt

SEQ ID NO: 121171 - DNA, 20 bp, human
gaccgtcattcagtaattgc

SEQ ID NO: 121172 - DNA, 20 bp, human
gatcaaatgccataactgcc

SEQ ID NO: 121173 - DNA, 20 bp, human
gaggaagttggccagcatgc

SEQ ID NO: 121174 - DNA, 20 bp, human
gtccacagtccccagcatgc

SEQ ID NO: 121175 - DNA, 20 bp, human
ggaagaaaaagtagaactgg

SEQ ID NO: 121176 - DNA, 20 bp, human
gtgatggcagggtactgcag

SEQ ID NO: 121177 - DNA, 20 bp, human
ggtgttgctgacctgttcat

SEQ ID NO: 121178 - DNA, 20 bp, human
ggattacactccaagagact

SEQ ID NO: 121179 - DNA, 20 bp, human
gggacacataccagatctca

SEQ ID NO: 121180 - DNA, 20 bp, human
ggagtgtaatccaagtctct

SEQ ID NO: 121181 - DNA, 20 bp, human
gactagcatgttaggaatag

SEQ ID NO: 121182 - DNA, 20 bp, human
gccagcaaccagggaatccc

SEQ ID NO: 121183 - DNA, 20 bp, human
gtgtctctttctggcagtaa

SEQ ID NO: 121184 - DNA, 20 bp, human
gagacttaagacccatgaac

SEQ ID NO: 121185 - DNA, 20 bp, human
gagcatgttaggaatagtgg

SEQ ID NO: 121186 - DNA, 20 bp, human
gcgcagctcaaagagtcatt

SEQ ID NO: 121187 - DNA, 20 bp, human
gtgtcaggagatagagaacc

SEQ ID NO: 121188 - DNA, 20 bp, human
gatcagttatggcttatgat

SEQ ID NO: 121189 - DNA, 20 bp, human
gctgtgcagtgaaattggac

SEQ ID NO: 121190 - DNA, 20 bp, human
gcctttgaccatggaaaccc

SEQ ID NO: 121191 - DNA, 20 bp, human
gagattttgctaactcatgc

SEQ ID NO: 121192 - DNA, 20 bp, human
ggatattgactagcatgttt

SEQ ID NO: 121193 - DNA, 20 bp, human
gaaaggcaaagtttcccaga

SEQ ID NO: 121194 - DNA, 20 bp, human
gtgcttcttctcattcatcc

SEQ ID NO: 121195 - DNA, 20 bp, human
gtttcccagaaggatgtaca

SEQ ID NO: 121196 - DNA, 20 bp, human
ggccaggagaaagcactcgg

SEQ ID NO: 121197 - DNA, 20 bp, human
ggcccacgatgcatgaggaa

SEQ ID NO: 121198 - DNA, 20 bp, human
gatgcatgaggaaggggtag

SEQ ID NO: 121199 - DNA, 20 bp, human
ggcaggttggctaggagaag

SEQ ID NO: 121200 - DNA, 20 bp, human
gggggctccattgcctgtgg

SEQ ID NO: 121201 - DNA, 20 bp, human
gagctgaaagttagtcacag

SEQ ID NO: 121202 - DNA, 20 bp, human
gtcatcaccgtggtgagcca

SEQ ID NO: 121203 - DNA, 20 bp, human
gcagggcctgccattcaaga

SEQ ID NO: 121204 - DNA, 20 bp, human
gtggaggaacatgtacatag

SEQ ID NO: 121205 - DNA, 20 bp, human
gcgtgggctctgtgccaggt

SEQ ID NO: 121206 - DNA, 20 bp, human
ggagtaacagatatccaggt

SEQ ID NO: 121207 - DNA, 20 bp, human
gactcccaagaggagaaatt

SEQ ID NO: 121208 - DNA, 20 bp, human
ggagaaaattctgagccgga

SEQ ID NO: 121209 - DNA, 20 bp, human
gatggactccgtgctgccca

SEQ ID NO: 121210 - DNA, 20 bp, human
gcgtagagtaacagatatcc

SEQ ID NO: 121211 - DNA, 20 bp, human
gacagatatccaggtaggac

SEQ ID NO: 121212 - DNA, 20 bp, human
gctgggaaacctgtcctacc

SEQ ID NO: 121213 - DNA, 20 bp, human
gttcatttcttccactccct

SEQ ID NO: 121214 - DNA, 20 bp, human
gcccaggaagaaatacataa

SEQ ID NO: 121215 - DNA, 20 bp, human
gatggcatttgacctctctg

SEQ ID NO: 121216 - DNA, 20 bp, human
gcagctcctgaacaccagtc

SEQ ID NO: 121217 - DNA, 20 bp, human
gcgaggtttacgagcagctt

SEQ ID NO: 121218 - DNA, 20 bp, human
ggccaacagaatacacacct

SEQ ID NO: 121219 - DNA, 20 bp, human
gactgtcatcatgaaccccc

SEQ ID NO: 121220 - DNA, 20 bp, human
gttcttctacttggcctgac

SEQ ID NO: 121221 - DNA, 20 bp, human
gagccctgcgactgcacacg

SEQ ID NO: 121222 - DNA, 20 bp, human
gcttggcctgactggtgttc

SEQ ID NO: 121223 - DNA, 20 bp, human
gtgacattctccattgctct

SEQ ID NO: 121224 - DNA, 20 bp, human
gtctgttggcagctgcggcc

SEQ ID NO: 121225 - DNA, 20 bp, human
gtgaatgagtttcttctact

SEQ ID NO: 121226 - DNA, 20 bp, human
ggatggctggagaaatctgg

SEQ ID NO: 121227 - DNA, 20 bp, human
gggtggctagaattctaggg

SEQ ID NO: 121228 - DNA, 20 bp, human
gccacccaatcacaataagt

SEQ ID NO: 121229 - DNA, 20 bp, human
gataagtgggtaattacctg

SEQ ID NO: 121230 - DNA, 20 bp, human
gaagtgcagaaacctcacac

SEQ ID NO: 121231 - DNA, 20 bp, human
gtaaagaggagtcactcact

SEQ ID NO: 121232 - DNA, 20 bp, human
gcctcacactgggacattga

SEQ ID NO: 121233 - DNA, 20 bp, human
gtctgtccctggagttaaag

SEQ ID NO: 121234 - DNA, 20 bp, human
ggctgcagctgtgctgactc

SEQ ID NO: 121235 - DNA, 20 bp, human
gtgactcctctttaactcca

SEQ ID NO: 121236 - DNA, 20 bp, human
gcagaagcttgagtgcccaa

SEQ ID NO: 121237 - DNA, 20 bp, human
gggcactcaagcttctgaag

SEQ ID NO: 121238 - DNA, 20 bp, human
gcaacaggatattcgaacag

SEQ ID NO: 121239 - DNA, 20 bp, human
gccacatttatcaaaccctt

SEQ ID NO: 121240 - DNA, 20 bp, human
gatctcaccagcaggccaac

SEQ ID NO: 121241 - DNA, 20 bp, human
gccacccaatcacaataagt

SEQ ID NO: 121242 - DNA, 20 bp, human
gaatgccctatgaaactcaa

SEQ ID NO: 121243 - DNA, 20 bp, human
gataagtgggtaattacctg

SEQ ID NO: 121244 - DNA, 20 bp, human
gtgctcccttgagtttcata

SEQ ID NO: 121245 - DNA, 20 bp, human
gattacaagagtattactaa

SEQ ID NO: 121246 - DNA, 20 bp, human
gcaggtaaacttacactcaa

SEQ ID NO: 121247 - DNA, 20 bp, human
ggcaagaatgatagaacatg

SEQ ID NO: 121248 - DNA, 20 bp, human
gatatttgtgatgatcaggt

SEQ ID NO: 121249 - DNA, 20 bp, human
ggaatgatagaacatgtggc

SEQ ID NO: 121250 - DNA, 20 bp, human
gccatatatgaaaaatccac

SEQ ID NO: 121251 - DNA, 20 bp, human
gaaggaaaataacataataa

SEQ ID NO: 121252 - DNA, 20 bp, human
gctcattctgtcattctggc

SEQ ID NO: 121253 - DNA, 20 bp, human
gtctatcattcttgcattcc

SEQ ID NO: 121254 - DNA, 20 bp, human
gtgagtgttttcgtgataaa

SEQ ID NO: 121255 - DNA, 20 bp, human
gaacatgtggcagggtgtgc

SEQ ID NO: 121256 - DNA, 20 bp, human
gttaacatgctctctcttac

SEQ ID NO: 121257 - DNA, 20 bp, human
gtccaggacccagctgccat

SEQ ID NO: 121258 - DNA, 20 bp, human
gggttaaatagagagtaaaa

SEQ ID NO: 121259 - DNA, 20 bp, human
gtatcccatcatcatgagta

SEQ ID NO: 121260 - DNA, 20 bp, human
gcctatgtacccatggcagc

SEQ ID NO: 121261 - DNA, 20 bp, human
gtgtccccatggccaagccg

SEQ ID NO: 121262 - DNA, 20 bp, human
ggtgcagatgttcctcggct

SEQ ID NO: 121263 - DNA, 20 bp, human
gcagctgggtcctggatcat

SEQ ID NO: 121264 - DNA, 20 bp, human
gaaggatgcctatgtaccca

SEQ ID NO: 121265 - DNA, 20 bp, human
gatagagagtaaaatggaat

SEQ ID NO: 121266 - DNA, 20 bp, human
gaaatgagaatcaaagatgc

SEQ ID NO: 121267 - DNA, 20 bp, human
gaaattctgacacaagtgtc

SEQ ID NO: 121268 - DNA, 20 bp, human
gaccaatgttgagggaacag

SEQ ID NO: 121269 - DNA, 20 bp, human
gaatgttgagggaacagagg

SEQ ID NO: 121270 - DNA, 20 bp, human
gtcttttgacacatattaga

SEQ ID NO: 121271 - DNA, 20 bp, human
gatttgtactgtttgtttct

SEQ ID NO: 121272 - DNA, 20 bp, human
gttcctgaaagcagatgaca

SEQ ID NO: 121273 - DNA, 20 bp, human
gagtaaacaatctcaatctt

SEQ ID NO: 121274 - DNA, 20 bp, human
gttcttcttctgggtctttc

SEQ ID NO: 121275 - DNA, 20 bp, human
gtgtctgcttcttggcatga

SEQ ID NO: 121276 - DNA, 20 bp, human
gaccagtgttgagggaatgg

SEQ ID NO: 121277 - DNA, 20 bp, human
gtcattcttctgggactctc

SEQ ID NO: 121278 - DNA, 20 bp, human
gcccatcatcatgaacaagg

SEQ ID NO: 121279 - DNA, 20 bp, human
gctgtatcatggctttctgg

SEQ ID NO: 121280 - DNA, 20 bp, human
gctcaccagtgttgagggaa

SEQ ID NO: 121281 - DNA, 20 bp, human
gccagctttcaggatgccaa

SEQ ID NO: 121282 - DNA, 20 bp, human
gtcctccattccctcaacac

SEQ ID NO: 121283 - DNA, 20 bp, human
gactgctgacttctgtatca

SEQ ID NO: 121284 - DNA, 20 bp, human
gaagaaaatgatctcaagtt

SEQ ID NO: 121285 - DNA, 20 bp, human
gatcaaatgccatcatgcca

SEQ ID NO: 121286 - DNA, 20 bp, human
gtctgtcttacaagctaaag

SEQ ID NO: 121287 - DNA, 20 bp, human
gatatgtgccataattccca

SEQ ID NO: 121288 - DNA, 20 bp, human
gagctaaagagggagtaaaa

SEQ ID NO: 121289 - DNA, 20 bp, human
gtctttttccttgggaatta

SEQ ID NO: 121290 - DNA, 20 bp, human
gtgtccccatggccaagctg

SEQ ID NO: 121291 - DNA, 20 bp, human
gtgtgtgcttctgggcgtga

SEQ ID NO: 121292 - DNA, 20 bp, human
gtgttcctcagcttggccat

SEQ ID NO: 121293 - DNA, 20 bp, human
gagagggagtaaaatggaat

SEQ ID NO: 121294 - DNA, 20 bp, human
ggtgcagatgttcctcagct

SEQ ID NO: 121295 - DNA, 20 bp, human
gactagcgtggagggaatag

SEQ ID NO: 121296 - DNA, 20 bp, human
gactgtctggagctttgggt

SEQ ID NO: 121297 - DNA, 20 bp, human
gaaagctggcaagaattagt

SEQ ID NO: 121298 - DNA, 20 bp, human
gtagaacgaagaaaactgtc

SEQ ID NO: 121299 - DNA, 20 bp, human
ggaggaaggaaagattacag

SEQ ID NO: 121300 - DNA, 20 bp, human
gtctgtcgacgtggaatcgt

SEQ ID NO: 121301 - DNA, 20 bp, human
gccacggagtgcatgatctt

SEQ ID NO: 121302 - DNA, 20 bp, human
ggcaagaattagtgggacag

SEQ ID NO: 121303 - DNA, 20 bp, human
gatgagcaagggtgcctatg

SEQ ID NO: 121304 - DNA, 20 bp, human
gcagtatatgtaatatggaa

SEQ ID NO: 121305 - DNA, 20 bp, human
gacttgtgtagcaaacgtcg

SEQ ID NO: 121306 - DNA, 20 bp, human
ggggacattctgttcaccca

SEQ ID NO: 121307 - DNA, 20 bp, human
gctatgtacccatggctgtt

SEQ ID NO: 121308 - DNA, 20 bp, human
gagagacatttaaatggaat

SEQ ID NO: 121309 - DNA, 20 bp, human
gtgttgggtcctggtttgca

SEQ ID NO: 121310 - DNA, 20 bp, human
gttgacaatccctgcaaacc

SEQ ID NO: 121311 - DNA, 20 bp, human
gaaccaggacccaacagcca

SEQ ID NO: 121312 - DNA, 20 bp, human
gtaaaagagagacatttaaa

SEQ ID NO: 121313 - DNA, 20 bp, human
gaaagagtaactcaagcctt

SEQ ID NO: 121314 - DNA, 20 bp, human
gggaagctcactagtgtgga

SEQ ID NO: 121315 - DNA, 20 bp, human
ggaaaggaagctcactagtg

SEQ ID NO: 121316 - DNA, 20 bp, human
gctgctgggtagtatagaaa

SEQ ID NO: 121317 - DNA, 20 bp, human
ggcaggtgacctagaacaca

SEQ ID NO: 121318 - DNA, 20 bp, human
gatagaaaaggacatgattc

SEQ ID NO: 121319 - DNA, 20 bp, human
gtctatactacccagcaggc

SEQ ID NO: 121320 - DNA, 20 bp, human
gttctaggtcacctgcctgc

SEQ ID NO: 121321 - DNA, 20 bp, human
gtcttgtctccatgtgttct

SEQ ID NO: 121322 - DNA, 20 bp, human
gtcagtggagcccaagccaa

SEQ ID NO: 121323 - DNA, 20 bp, human
gtgcagagcacagccaatga

SEQ ID NO: 121324 - DNA, 20 bp, human
gtaagaatcaaacacaatat

SEQ ID NO: 121325 - DNA, 20 bp, human
gaccagaaagaattcagtca

SEQ ID NO: 121326 - DNA, 20 bp, human
gaccggtcatatgccatcat

SEQ ID NO: 121327 - DNA, 20 bp, human
gagggagaggtacatctgag

SEQ ID NO: 121328 - DNA, 20 bp, human
gcagaaaggagagattgctg

SEQ ID NO: 121329 - DNA, 20 bp, human
gaaacatgccagatatgtga

SEQ ID NO: 121330 - DNA, 20 bp, human
ggcccatgatggcatatgac

SEQ ID NO: 121331 - DNA, 20 bp, human
gatgccagatatgtgaagga

SEQ ID NO: 121332 - DNA, 20 bp, human
gaccccctccttcacatatc

SEQ ID NO: 121333 - DNA, 20 bp, human
gacctgtacgtatgcataga

SEQ ID NO: 121334 - DNA, 20 bp, human
gtccttctatgcatacgtac

SEQ ID NO: 121335 - DNA, 20 bp, human
gggggtagtgaaaaaatccc

SEQ ID NO: 121336 - DNA, 20 bp, human
ggagcaaggctacacacata

SEQ ID NO: 121337 - DNA, 20 bp, human
ggctgtgtgcacccaggaat

SEQ ID NO: 121338 - DNA, 20 bp, human
gtcctgcttgggtgattgaa

SEQ ID NO: 121339 - DNA, 20 bp, human
gcaaggctacacacatatgg

SEQ ID NO: 121340 - DNA, 20 bp, human
gccaaaaagcctgaactcca

SEQ ID NO: 121341 - DNA, 20 bp, human
ggctgtgattcatcctgctt

SEQ ID NO: 121342 - DNA, 20 bp, human
gtaactgagttcattattct

SEQ ID NO: 121343 - DNA, 20 bp, human
gagataattccctggagttc

SEQ ID NO: 121344 - DNA, 20 bp, human
ggccattcaatcacccaagc

SEQ ID NO: 121345 - DNA, 20 bp, human
gtattgcagtcaccaattcc

SEQ ID NO: 121346 - DNA, 20 bp, human
ggaatgggaataaagatgga

SEQ ID NO: 121347 - DNA, 20 bp, human
gacagcagagtgcctcctac

SEQ ID NO: 121348 - DNA, 20 bp, human
ggccatggcctatgaccgtg

SEQ ID NO: 121349 - DNA, 20 bp, human
gtagtgttacctgaaagaat

SEQ ID NO: 121350 - DNA, 20 bp, human
gatagcaaccacacggtcat

SEQ ID NO: 121351 - DNA, 20 bp, human
gatcggggataagagaggta

SEQ ID NO: 121352 - DNA, 20 bp, human
gcaaacatcggggataagag

SEQ ID NO: 121353 - DNA, 20 bp, human
ggtaacactaagtagccaat

SEQ ID NO: 121354 - DNA, 20 bp, human
ggcatccatttaatgaatag

SEQ ID NO: 121355 - DNA, 20 bp, human
gggaagctgttccataacaa

SEQ ID NO: 121356 - DNA, 20 bp, human
ggagccgctcaacagaacag

SEQ ID NO: 121357 - DNA, 20 bp, human
gtgagcacgtggtacctgag

SEQ ID NO: 121358 - DNA, 20 bp, human
gggaggtggaccagcatcag

SEQ ID NO: 121359 - DNA, 20 bp, human
gagatggtccacagctggga

SEQ ID NO: 121360 - DNA, 20 bp, human
gggtccacagctgggatgga

SEQ ID NO: 121361 - DNA, 20 bp, human
gggcgtgtagcagatgtcca

SEQ ID NO: 121362 - DNA, 20 bp, human
gccggtggctcatgagcacg

SEQ ID NO: 121363 - DNA, 20 bp, human
gtggatggcacagacagcaa

SEQ ID NO: 121364 - DNA, 20 bp, human
gggccgtgatggccagtagc

SEQ ID NO: 121365 - DNA, 20 bp, human
gaggcactccgtggagcccg

SEQ ID NO: 121366 - DNA, 20 bp, human
ggggagccgtgactgaaata

SEQ ID NO: 121367 - DNA, 20 bp, human
gcactgtgtcttggctgtat

SEQ ID NO: 121368 - DNA, 20 bp, human
ggtcaaaggacatcaccgtg

SEQ ID NO: 121369 - DNA, 20 bp, human
gacagtggctctttggacac

SEQ ID NO: 121370 - DNA, 20 bp, human
ggtgacatatagcagtatag

SEQ ID NO: 121371 - DNA, 20 bp, human
gtgatgacatcatagtgcag

SEQ ID NO: 121372 - DNA, 20 bp, human
gctatgatgtcatcatggac

SEQ ID NO: 121373 - DNA, 20 bp, human
gccaagacacagtggctctt

SEQ ID NO: 121374 - DNA, 20 bp, human
gacacagccaaggaatgaaa

SEQ ID NO: 121375 - DNA, 20 bp, human
gaaaggacatcaccgtgagg

SEQ ID NO: 121376 - DNA, 20 bp, human
gcactggcctccctactcag

SEQ ID NO: 121377 - DNA, 20 bp, human
gtctatgcaggcatgcacac

SEQ ID NO: 121378 - DNA, 20 bp, human
gacaagaccactgagtaggg

SEQ ID NO: 121379 - DNA, 20 bp, human
gtagggaggccagtgtcatc

SEQ ID NO: 121380 - DNA, 20 bp, human
gtagacaagaccactgagta

SEQ ID NO: 121381 - DNA, 20 bp, human
gcacagggtagtgaagtggc

SEQ ID NO: 121382 - DNA, 20 bp, human
gaggagaaattccatcacgg

SEQ ID NO: 121383 - DNA, 20 bp, human
gtagcggtcatgagccataa

SEQ ID NO: 121384 - DNA, 20 bp, human
gtggttgaattgggcatcgg

SEQ ID NO: 121385 - DNA, 20 bp, human
ggacagcaccaccatttcta

SEQ ID NO: 121386 - DNA, 20 bp, human
gtcaggagggtgctatcaga

SEQ ID NO: 121387 - DNA, 20 bp, human
ggagccgtgatgacatcagg

SEQ ID NO: 121388 - DNA, 20 bp, human
gcacggctctgtattggagg

SEQ ID NO: 121389 - DNA, 20 bp, human
gacagagccgtgatgacatc

SEQ ID NO: 121390 - DNA, 20 bp, human
gcaccctcctgatgtcatca

SEQ ID NO: 121391 - DNA, 20 bp, human
gtgtcatcacggctctgtat

SEQ ID NO: 121392 - DNA, 20 bp, human
gtctgcgagtcagggagtta

SEQ ID NO: 121393 - DNA, 20 bp, human
ggcacagatccaaaacggag

SEQ ID NO: 121394 - DNA, 20 bp, human
gcgagtcagggagttacgga

SEQ ID NO: 121395 - DNA, 20 bp, human
gtcagatggcagtcaccacc

SEQ ID NO: 121396 - DNA, 20 bp, human
gttaggaagccaaagacagt

SEQ ID NO: 121397 - DNA, 20 bp, human
ggctatcactgcatgcctac

SEQ ID NO: 121398 - DNA, 20 bp, human
gggtatcttcagagagacta

SEQ ID NO: 121399 - DNA, 20 bp, human
ggctctggcctcatcagaag

SEQ ID NO: 121400 - DNA, 20 bp, human
gactgcatgcctacaggcac

SEQ ID NO: 121401 - DNA, 20 bp, human
gagaatggccacttctgatg

SEQ ID NO: 121402 - DNA, 20 bp, human
gcacagtgatgtcttatgac

SEQ ID NO: 121403 - DNA, 20 bp, human
gtaatagtctcataatgaag

SEQ ID NO: 121404 - DNA, 20 bp, human
gtatggatccccgtgcctgt

SEQ ID NO: 121405 - DNA, 20 bp, human
gcgacggtccacggtaatga

SEQ ID NO: 121406 - DNA, 20 bp, human
gctgaccagtaactcccagg

SEQ ID NO: 121407 - DNA, 20 bp, human
gaggatgaattccagtgtag

SEQ ID NO: 121408 - DNA, 20 bp, human
gcactggaattcatcctcct

SEQ ID NO: 121409 - DNA, 20 bp, human
gtgttgtgtagtgaagtggg

SEQ ID NO: 121410 - DNA, 20 bp, human
gaataaccagtcctctacac

SEQ ID NO: 121411 - DNA, 20 bp, human
gggatttgctgcccaagaga

SEQ ID NO: 121412 - DNA, 20 bp, human
ggttgacatcttcttctcat

SEQ ID NO: 121413 - DNA, 20 bp, human
gggcttctttaacatgaaag

SEQ ID NO: 121414 - DNA, 20 bp, human
gcatgttaaagaagccatga

SEQ ID NO: 121415 - DNA, 20 bp, human
gaggcgaacatcagagcaaa

SEQ ID NO: 121416 - DNA, 20 bp, human
gtcatccgtaaccatcccta

SEQ ID NO: 121417 - DNA, 20 bp, human
gggcttcttcagcatgaaag

SEQ ID NO: 121418 - DNA, 20 bp, human
gaaggcagacagctatacct

SEQ ID NO: 121419 - DNA, 20 bp, human
ggctggccaaccatctcttg

SEQ ID NO: 121420 - DNA, 20 bp, human
gagaataaaatccaggttaa

SEQ ID NO: 121421 - DNA, 20 bp, human
gagctataccttggctgcaa

SEQ ID NO: 121422 - DNA, 20 bp, human
ggatttccagtcagtgtgat

SEQ ID NO: 121423 - DNA, 20 bp, human
gggagcaagttcatctcctt

SEQ ID NO: 121424 - DNA, 20 bp, human
gtcgtatgccattgcagcca

SEQ ID NO: 121425 - DNA, 20 bp, human
gttgtatcctgcttattgct

SEQ ID NO: 121426 - DNA, 20 bp, human
gggagagtgtgaagcattag

SEQ ID NO: 121427 - DNA, 20 bp, human
ggttagctctcgagaaccca

SEQ ID NO: 121428 - DNA, 20 bp, human
gacccaaggagcaaaaaaac

SEQ ID NO: 121429 - DNA, 20 bp, human
ggcctctctgtgatagacat

SEQ ID NO: 121430 - DNA, 20 bp, human
gcagctcaaggctagtaagc

SEQ ID NO: 121431 - DNA, 20 bp, human
ggcgggcagcaggaatggtt

SEQ ID NO: 121432 - DNA, 20 bp, human
gtttggtaatgaatcaccaa

SEQ ID NO: 121433 - DNA, 20 bp, human
gaactggggcagtgtaactg

SEQ ID NO: 121434 - DNA, 20 bp, human
ggaccccctgcactatgctt

SEQ ID NO: 121435 - DNA, 20 bp, human
ggggtaatgagagaccaaat

SEQ ID NO: 121436 - DNA, 20 bp, human
ggaagtacataggggaatgg

SEQ ID NO: 121437 - DNA, 20 bp, human
gaacaaaggccaagttacta

SEQ ID NO: 121438 - DNA, 20 bp, human
gagcatgttccccaaggtgg

SEQ ID NO: 121439 - DNA, 20 bp, human
gcatgaacacaagatgtcat

SEQ ID NO: 121440 - DNA, 20 bp, human
gtcagggaattcgtccttct

SEQ ID NO: 121441 - DNA, 20 bp, human
gtgctcatcattgcgacgat

SEQ ID NO: 121442 - DNA, 20 bp, human
gagaaatctaacagttgtca

SEQ ID NO: 121443 - DNA, 20 bp, human
ggcattcaagcaagcaagtt

SEQ ID NO: 121444 - DNA, 20 bp, human
gatgtatttagccaccacct

SEQ ID NO: 121445 - DNA, 20 bp, human
gtctagatttgttgggaata

SEQ ID NO: 121446 - DNA, 20 bp, human
gtaggacccaacacaaggaa

SEQ ID NO: 121447 - DNA, 20 bp, human
gtgtatgaggccatagagga

SEQ ID NO: 121448 - DNA, 20 bp, human
gacggataggacccaacaca

SEQ ID NO: 121449 - DNA, 20 bp, human
ggaggccatagaggacggat

SEQ ID NO: 121450 - DNA, 20 bp, human
gggctgtggtgtagtggagg

SEQ ID NO: 121451 - DNA, 20 bp, human
ggctcatggctgtggtgtag

SEQ ID NO: 121452 - DNA, 20 bp, human
gggagtaagatacagagctt

SEQ ID NO: 121453 - DNA, 20 bp, human
ggggtcctatccgtcctcta

SEQ ID NO: 121454 - DNA, 20 bp, human
gcatgaggagggtgtgtatg

SEQ ID NO: 121455 - DNA, 20 bp, human
gatacagagcttagggctca

SEQ ID NO: 121456 - DNA, 20 bp, human
gggctgtgacatagtggagg

SEQ ID NO: 121457 - DNA, 20 bp, human
gacagacagcccccaacaca

SEQ ID NO: 121458 - DNA, 20 bp, human
gtaatgttacagaaagttgg

SEQ ID NO: 121459 - DNA, 20 bp, human
gctcaccttcctcctgacca

SEQ ID NO: 121460 - DNA, 20 bp, human
gagaaagttgggggaatgga

SEQ ID NO: 121461 - DNA, 20 bp, human
gttacagaaagttgggggaa

SEQ ID NO: 121462 - DNA, 20 bp, human
gacatagtggagggggcagc

SEQ ID NO: 121463 - DNA, 20 bp, human
ggggggctgtctgttctcta

SEQ ID NO: 121464 - DNA, 20 bp, human
gtgctcctctccttgtgttg

SEQ ID NO: 121465 - DNA, 20 bp, human
gcagcccccaacacaaggag

SEQ ID NO: 121466 - DNA, 20 bp, human
gatgctctgtctcgccctgg

SEQ ID NO: 121467 - DNA, 20 bp, human
gcccatgctctgtctcgccc

SEQ ID NO: 121468 - DNA, 20 bp, human
gttctgtaacaacttgggaa

SEQ ID NO: 121469 - DNA, 20 bp, human
gctccaggtctccaaataac

SEQ ID NO: 121470 - DNA, 20 bp, human
gttacagaacatgcagaacc

SEQ ID NO: 121471 - DNA, 20 bp, human
gttcctgttatttggagacc

SEQ ID NO: 121472 - DNA, 20 bp, human
gtgtacttcttcctgttatt

SEQ ID NO: 121473 - DNA, 20 bp, human
gggtcacggaagagaagcag

SEQ ID NO: 121474 - DNA, 20 bp, human
ggtgtgtaacatggcatgga

SEQ ID NO: 121475 - DNA, 20 bp, human
gtgtaacatggcatggaagg

SEQ ID NO: 121476 - DNA, 20 bp, human
gatgctctgtctctccgtgg

SEQ ID NO: 121477 - DNA, 20 bp, human
gcccatgctctgtctctccg

SEQ ID NO: 121478 - DNA, 20 bp, human
gagatggcggtgtagtgcat

SEQ ID NO: 121479 - DNA, 20 bp, human
gggtcaggcagtctgcatag

SEQ ID NO: 121480 - DNA, 20 bp, human
gtgctgagaaacaaatacac

SEQ ID NO: 121481 - DNA, 20 bp, human
gataggggatggatgggtct

SEQ ID NO: 121482 - DNA, 20 bp, human
gtgcaggaggaagcagatgg

SEQ ID NO: 121483 - DNA, 20 bp, human
gtttgctgctctggttggat

SEQ ID NO: 121484 - DNA, 20 bp, human
gcaagaacagggcatagcac

SEQ ID NO: 121485 - DNA, 20 bp, human
gtgtgactgaggaaaagcag

SEQ ID NO: 121486 - DNA, 20 bp, human
gcctgggatcctggacacag

SEQ ID NO: 121487 - DNA, 20 bp, human
ggaactcggagacactcgac

SEQ ID NO: 121488 - DNA, 20 bp, human
gctggttgctggattatggg

SEQ ID NO: 121489 - DNA, 20 bp, human
gctgctggttgctggattat

SEQ ID NO: 121490 - DNA, 20 bp, human
gggtgtgcagaaggacattc

SEQ ID NO: 121491 - DNA, 20 bp, human
gctcagaccatctccttctg

SEQ ID NO: 121492 - DNA, 20 bp, human
gggagtctatgcttacggac

SEQ ID NO: 121493 - DNA, 20 bp, human
gactggtttgtcccgctcat

SEQ ID NO: 121494 - DNA, 20 bp, human
gttgtcccgctcatgggcct

SEQ ID NO: 121495 - DNA, 20 bp, human
gtatttcgttttcatgttcg

SEQ ID NO: 121496 - DNA, 20 bp, human
gcagctgctcagagaacccc

SEQ ID NO: 121497 - DNA, 20 bp, human
gctgctcagagaaccccagg

SEQ ID NO: 121498 - DNA, 20 bp, human
ggatccaggatgcagacacg

SEQ ID NO: 121499 - DNA, 20 bp, human
gactgtggtggacacaaagc

SEQ ID NO: 121500 - DNA, 20 bp, human
gtgtagtagacaccctgagt

SEQ ID NO: 121501 - DNA, 20 bp, human
gcttcctacagacaaatgga

SEQ ID NO: 121502 - DNA, 20 bp, human
gacaaagcaggcatctgcaa

SEQ ID NO: 121503 - DNA, 20 bp, human
ggaagaaagttgggttaatt

SEQ ID NO: 121504 - DNA, 20 bp, human
ggatcagaatgtaatgaagt

SEQ ID NO: 121505 - DNA, 20 bp, human
gtggagggcattcatgatcc

SEQ ID NO: 121506 - DNA, 20 bp, human
gtgtatggtctgtgactagt

SEQ ID NO: 121507 - DNA, 20 bp, human
ggtgactagtgggaacaaaa

SEQ ID NO: 121508 - DNA, 20 bp, human
gatggtcccgaacaggtgga

SEQ ID NO: 121509 - DNA, 20 bp, human
ggccaggagaaagctgtcca

SEQ ID NO: 121510 - DNA, 20 bp, human
ggaaggcatacatctgggtg

SEQ ID NO: 121511 - DNA, 20 bp, human
gacggtggtggaggataata

SEQ ID NO: 121512 - DNA, 20 bp, human
gtgagaaccaagtaacgctg

SEQ ID NO: 121513 - DNA, 20 bp, human
gaggtggaaggcatacatct

SEQ ID NO: 121514 - DNA, 20 bp, human
gaccatggacagctttctcc

SEQ ID NO: 121515 - DNA, 20 bp, human
gtagggtgtcaacgagtgag

SEQ ID NO: 121516 - DNA, 20 bp, human
gtatcagctggagggcacta

SEQ ID NO: 121517 - DNA, 20 bp, human
gtggctctgagtcatgatgg

SEQ ID NO: 121518 - DNA, 20 bp, human
gcactggctctgagtcatga

SEQ ID NO: 121519 - DNA, 20 bp, human
gaggaacagggcgaagaaca

SEQ ID NO: 121520 - DNA, 20 bp, human
gagccaccagcatgacacac

SEQ ID NO: 121521 - DNA, 20 bp, human
gcacgcacaagcgatgaccc

SEQ ID NO: 121522 - DNA, 20 bp, human
gcacttcaatggcatatgac

SEQ ID NO: 121523 - DNA, 20 bp, human
ggggcactagggaaatttga

SEQ ID NO: 121524 - DNA, 20 bp, human
gcagagccagtgtgtcatgc

SEQ ID NO: 121525 - DNA, 20 bp, human
gtgaaaaggagatgtcagtg

SEQ ID NO: 121526 - DNA, 20 bp, human
gcaggagaagggtgtgagag

SEQ ID NO: 121527 - DNA, 20 bp, human
gcactacactgtcatcatga

SEQ ID NO: 121528 - DNA, 20 bp, human
gtacaaatcgatcctctatg

SEQ ID NO: 121529 - DNA, 20 bp, human
gtaagatgctgatggacatg

SEQ ID NO: 121530 - DNA, 20 bp, human
gatatgccattgatgtaata

SEQ ID NO: 121531 - DNA, 20 bp, human
ggagctctgtgtcttcttag

SEQ ID NO: 121532 - DNA, 20 bp, human
gcttcttagtggctgtatct

SEQ ID NO: 121533 - DNA, 20 bp, human
gtcacacccttctcctgacc

SEQ ID NO: 121534 - DNA, 20 bp, human
gagaaatgcattcctcatag

SEQ ID NO: 121535 - DNA, 20 bp, human
gagcttccttattacatcaa

SEQ ID NO: 121536 - DNA, 20 bp, human
gaggaggagagtgtgagaca

SEQ ID NO: 121537 - DNA, 20 bp, human
gcagggcattggtacaggag

SEQ ID NO: 121538 - DNA, 20 bp, human
ggaagactgtcagcatgaag

SEQ ID NO: 121539 - DNA, 20 bp, human
gtgagacagggcattggtac

SEQ ID NO: 121540 - DNA, 20 bp, human
ggatagtggtgtagcggagg

SEQ ID NO: 121541 - DNA, 20 bp, human
gacacaccctgcataaagaa

SEQ ID NO: 121542 - DNA, 20 bp, human
gtacaccactatcatgaaag

SEQ ID NO: 121543 - DNA, 20 bp, human
gcacttcaatggcatacgat

SEQ ID NO: 121544 - DNA, 20 bp, human
gcttactagtcactgtgtcc

SEQ ID NO: 121545 - DNA, 20 bp, human
gagtccctctttcatgatag

SEQ ID NO: 121546 - DNA, 20 bp, human
gtattcgcctggaacctgaa

SEQ ID NO: 121547 - DNA, 20 bp, human
ggactcattggcagcctcca

SEQ ID NO: 121548 - DNA, 20 bp, human
gccatgtgcgcagccctggt

SEQ ID NO: 121549 - DNA, 20 bp, human
gggacatcctcgtggcatag

SEQ ID NO: 121550 - DNA, 20 bp, human
gatggcccgggacatcctcg

SEQ ID NO: 121551 - DNA, 20 bp, human
gctgccaatgagtcttcaga

SEQ ID NO: 121552 - DNA, 20 bp, human
ggcgaataaccagcctgcca

SEQ ID NO: 121553 - DNA, 20 bp, human
gtgggactgacaacaagtcc

SEQ ID NO: 121554 - DNA, 20 bp, human
gtgactgctacgtggccatc

SEQ ID NO: 121555 - DNA, 20 bp, human
gatcttgggcacagtgacgg

SEQ ID NO: 121556 - DNA, 20 bp, human
gtcgagaggagagtccaagg

SEQ ID NO: 121557 - DNA, 20 bp, human
gccaaggaggatgaattcag

SEQ ID NO: 121558 - DNA, 20 bp, human
gtaggtgaacccacaactat

SEQ ID NO: 121559 - DNA, 20 bp, human
gttctgatcctcaggtcgag

SEQ ID NO: 121560 - DNA, 20 bp, human
gcactgtgataaggtagatg

SEQ ID NO: 121561 - DNA, 20 bp, human
gggactctcctctcgacctg

SEQ ID NO: 121562 - DNA, 20 bp, human
gtaatggtgatgtagtggaa

SEQ ID NO: 121563 - DNA, 20 bp, human
gactcataatggtgatgtag

SEQ ID NO: 121564 - DNA, 20 bp, human
gcagcatctgtgactcataa

SEQ ID NO: 121565 - DNA, 20 bp, human
ggaattcagagggtcttgtt

SEQ ID NO: 121566 - DNA, 20 bp, human
gtaggtgagtacaagtccat

SEQ ID NO: 121567 - DNA, 20 bp, human
gttgaagtcgaggatcagag

SEQ ID NO: 121568 - DNA, 20 bp, human
gctctcggtctgaagaccag

SEQ ID NO: 121569 - DNA, 20 bp, human
gactcagtgtaagaacaacg

SEQ ID NO: 121570 - DNA, 20 bp, human
ggtcaggttggacattccca

SEQ ID NO: 121571 - DNA, 20 bp, human
gtaatggaatgggttacaaa

SEQ ID NO: 121572 - DNA, 20 bp, human
gaacagtgacataatggaat

SEQ ID NO: 121573 - DNA, 20 bp, human
ggacagtgttgcttatcttt

SEQ ID NO: 121574 - DNA, 20 bp, human
ggcttaggaaaaaatacata

SEQ ID NO: 121575 - DNA, 20 bp, human
gaaattcagagagtcttgtc

SEQ ID NO: 121576 - DNA, 20 bp, human
ggcatgagtaggcaatgcca

SEQ ID NO: 121577 - DNA, 20 bp, human
gattccccaccgcagtgagt

SEQ ID NO: 121578 - DNA, 20 bp, human
gatcatgtacctactcactg

SEQ ID NO: 121579 - DNA, 20 bp, human
gtgtacctactcactgcggt

SEQ ID NO: 121580 - DNA, 20 bp, human
gcaaagattatctcttatgt

SEQ ID NO: 121581 - DNA, 20 bp, human
gatccagatgtacttcttca

SEQ ID NO: 121582 - DNA, 20 bp, human
gggtttctgcagcttagggt

SEQ ID NO: 121583 - DNA, 20 bp, human
gagagaggtttctgcagctt

SEQ ID NO: 121584 - DNA, 20 bp, human
gcacgcggaacagggaatgt

SEQ ID NO: 121585 - DNA, 20 bp, human
ggttggaagagaggcccagg

SEQ ID NO: 121586 - DNA, 20 bp, human
ggcatgagcaggcaatgccg

SEQ ID NO: 121587 - DNA, 20 bp, human
gcaaaggttatctcctatgt

SEQ ID NO: 121588 - DNA, 20 bp, human
gatcatgtacctgctcgctg

SEQ ID NO: 121589 - DNA, 20 bp, human
gtgtacctgctcgctgcggt

SEQ ID NO: 121590 - DNA, 20 bp, human
gattccccaccgcagcgagc

SEQ ID NO: 121591 - DNA, 20 bp, human
gtgggccaggcagcccacat

SEQ ID NO: 121592 - DNA, 20 bp, human
ggcccagatgtacttcttta

SEQ ID NO: 121593 - DNA, 20 bp, human
gatctcctatgtgggctgcc

SEQ ID NO: 121594 - DNA, 20 bp, human
gaattttctatcagagacaa

SEQ ID NO: 121595 - DNA, 20 bp, human
gggtttctgcagctgagggt

SEQ ID NO: 121596 - DNA, 20 bp, human
gcataggggtctgaagatgg

SEQ ID NO: 121597 - DNA, 20 bp, human
ggctcatggtggtgacatag

SEQ ID NO: 121598 - DNA, 20 bp, human
gaaaggccatgactgccaga

SEQ ID NO: 121599 - DNA, 20 bp, human
gggtgaccaggtacacgatg

SEQ ID NO: 121600 - DNA, 20 bp, human
gtggtggtgacatagtggaa

SEQ ID NO: 121601 - DNA, 20 bp, human
gcttgctaggttctcatgat

SEQ ID NO: 121602 - DNA, 20 bp, human
gcagctgtcactgttgccca

SEQ ID NO: 121603 - DNA, 20 bp, human
gccgggaggagagtcccagg

SEQ ID NO: 121604 - DNA, 20 bp, human
ggtacctggtcaccataaca

SEQ ID NO: 121605 - DNA, 20 bp, human
gaacagtgacagctgccttc

SEQ ID NO: 121606 - DNA, 20 bp, human
gcttggcgtagtgcaatggg

SEQ ID NO: 121607 - DNA, 20 bp, human
gtgatcttggcgtagtgcaa

SEQ ID NO: 121608 - DNA, 20 bp, human
ggtccacgatgccaaagaaa

SEQ ID NO: 121609 - DNA, 20 bp, human
gagagaagcgtctcctgctc

SEQ ID NO: 121610 - DNA, 20 bp, human
ggctggtgagccttcaaacc

SEQ ID NO: 121611 - DNA, 20 bp, human
gctctcagaaaagccagagc

SEQ ID NO: 121612 - DNA, 20 bp, human
ggttccccacgaccatgacc

SEQ ID NO: 121613 - DNA, 20 bp, human
gagcgtcataatcgccatga

SEQ ID NO: 121614 - DNA, 20 bp, human
gtgtacctggtcatggtcgt

SEQ ID NO: 121615 - DNA, 20 bp, human
gtacatctggatcaggcagc

SEQ ID NO: 121616 - DNA, 20 bp, human
gatgaggaacgtgtgagtca

SEQ ID NO: 121617 - DNA, 20 bp, human
gtggaggcgctgatattcct

SEQ ID NO: 121618 - DNA, 20 bp, human
gtgagtcagggcaacgatat

SEQ ID NO: 121619 - DNA, 20 bp, human
gaggcgctgatattcctcgg

SEQ ID NO: 121620 - DNA, 20 bp, human
gtgcgtgaggcaacccgtat

SEQ ID NO: 121621 - DNA, 20 bp, human
gatgagcaggttcccagtca

SEQ ID NO: 121622 - DNA, 20 bp, human
ggaaggacaaccgagccatg

SEQ ID NO: 121623 - DNA, 20 bp, human
ggggactgctgttgctctgg

SEQ ID NO: 121624 - DNA, 20 bp, human
gacttggggcctcatgactg

SEQ ID NO: 121625 - DNA, 20 bp, human
gcagggcaacgatattggtg

SEQ ID NO: 121626 - DNA, 20 bp, human
ggtcaaggccaccaaacata

SEQ ID NO: 121627 - DNA, 20 bp, human
gctcagagagtcctagaagg

SEQ ID NO: 121628 - DNA, 20 bp, human
gtacaagggatgggaaaacc

SEQ ID NO: 121629 - DNA, 20 bp, human
ggcagatcacacgaactaca

SEQ ID NO: 121630 - DNA, 20 bp, human
gggcatgtacctggtcacca

SEQ ID NO: 121631 - DNA, 20 bp, human
gtacgagatgatctgactct

SEQ ID NO: 121632 - DNA, 20 bp, human
gaaggccaccaaacataagg

SEQ ID NO: 121633 - DNA, 20 bp, human
gtgactctgggtatgaatgt

SEQ ID NO: 121634 - DNA, 20 bp, human
gaggaggaagtctgaaacag

SEQ ID NO: 121635 - DNA, 20 bp, human
gccactcagagagtcctaga

SEQ ID NO: 121636 - DNA, 20 bp, human
gcatagtgtagtggaaaggg

SEQ ID NO: 121637 - DNA, 20 bp, human
gagtcaggatcatagtgtag

SEQ ID NO: 121638 - DNA, 20 bp, human
gggatcatagtgtagtggaa

SEQ ID NO: 121639 - DNA, 20 bp, human
ggtcatggaaaacttcatcc

SEQ ID NO: 121640 - DNA, 20 bp, human
gatggcaatgtacctgtcat

SEQ ID NO: 121641 - DNA, 20 bp, human
gagaacaaaatgggacacac

SEQ ID NO: 121642 - DNA, 20 bp, human
gtgggctaaacagcctgtgt

SEQ ID NO: 121643 - DNA, 20 bp, human
gcacacacagcattctagtc

SEQ ID NO: 121644 - DNA, 20 bp, human
gaatgcccaagagaacaaaa

SEQ ID NO: 121645 - DNA, 20 bp, human
gtaggaaattacctttgtag

SEQ ID NO: 121646 - DNA, 20 bp, human
gtcggcagaaatatgcatca

SEQ ID NO: 121647 - DNA, 20 bp, human
gtgagcaaaatgccgaacct

SEQ ID NO: 121648 - DNA, 20 bp, human
gtaagagatggattgactct

SEQ ID NO: 121649 - DNA, 20 bp, human
gatcctgcttgaaaaatccc

SEQ ID NO: 121650 - DNA, 20 bp, human
ggagaattgtataattcaga

SEQ ID NO: 121651 - DNA, 20 bp, human
ggaattatacaattctcatg

SEQ ID NO: 121652 - DNA, 20 bp, human
gtacaattctcatgcggccc

SEQ ID NO: 121653 - DNA, 20 bp, human
gtcattgacaatttgctctt

SEQ ID NO: 121654 - DNA, 20 bp, human
gttagttcctttcttcagat

SEQ ID NO: 121655 - DNA, 20 bp, human
gcctacaagaaaacctaaca

SEQ ID NO: 121656 - DNA, 20 bp, human
gctcctgggactctccaacc

SEQ ID NO: 121657 - DNA, 20 bp, human
gagcctggttggagagtccc

SEQ ID NO: 121658 - DNA, 20 bp, human
gctttcatgcgggccaggtt

SEQ ID NO: 121659 - DNA, 20 bp, human
gtgaaagttgtatagttcag

SEQ ID NO: 121660 - DNA, 20 bp, human
ggctctcataagagatggat

SEQ ID NO: 121661 - DNA, 20 bp, human
gatcgccacaaagtggtcga

SEQ ID NO: 121662 - DNA, 20 bp, human
gagtatgtatgtggtcactg

SEQ ID NO: 121663 - DNA, 20 bp, human
gatggccttcgaccactttg

SEQ ID NO: 121664 - DNA, 20 bp, human
ggtatgtggtcactgtggtt

SEQ ID NO: 121665 - DNA, 20 bp, human
ggaactatacaactttcatg

SEQ ID NO: 121666 - DNA, 20 bp, human
gcttaggatgagaaccacat

SEQ ID NO: 121667 - DNA, 20 bp, human
gtggagagtctgcatcaccc

SEQ ID NO: 121668 - DNA, 20 bp, human
gccgtcacttcctggacgtg

SEQ ID NO: 121669 - DNA, 20 bp, human
ggatgacggagtatcggaga

SEQ ID NO: 121670 - DNA, 20 bp, human
gactctccaggtcatgatga

SEQ ID NO: 121671 - DNA, 20 bp, human
gggtcatgatgacggagtat

SEQ ID NO: 121672 - DNA, 20 bp, human
gcgtccaggaagtgacggcc

SEQ ID NO: 121673 - DNA, 20 bp, human
gctttttcacagggaaatgg

SEQ ID NO: 121674 - DNA, 20 bp, human
gggcaccgtgttgcgggtgt

SEQ ID NO: 121675 - DNA, 20 bp, human
gatcgcctacacccgcaaca

SEQ ID NO: 121676 - DNA, 20 bp, human
gatcttagggacagtactcg

SEQ ID NO: 121677 - DNA, 20 bp, human
ggcataggacatgtccacaa

SEQ ID NO: 121678 - DNA, 20 bp, human
gaatgagggtgtattgcaag

SEQ ID NO: 121679 - DNA, 20 bp, human
ggtccacctggaatcccaac

SEQ ID NO: 121680 - DNA, 20 bp, human
gcacaatggccaggtgtgac

SEQ ID NO: 121681 - DNA, 20 bp, human
ggggacagtactcgaggcat

SEQ ID NO: 121682 - DNA, 20 bp, human
gactctccagttcataatga

SEQ ID NO: 121683 - DNA, 20 bp, human
gtgaagtatgcaaggagcaa

SEQ ID NO: 121684 - DNA, 20 bp, human
ggggaaatgggattatcctg

SEQ ID NO: 121685 - DNA, 20 bp, human
gatcacagaagtcatcctgt

SEQ ID NO: 121686 - DNA, 20 bp, human
gcatgctcttgtggacatct

SEQ ID NO: 121687 - DNA, 20 bp, human
gagcagggtgagtgtataga

SEQ ID NO: 121688 - DNA, 20 bp, human
gctggaccaacctggaatcg

SEQ ID NO: 121689 - DNA, 20 bp, human
gtcttgtggacatctaggac

SEQ ID NO: 121690 - DNA, 20 bp, human
ggcataggatatgtcaacaa

SEQ ID NO: 121691 - DNA, 20 bp, human
gccttgccgcgattccaggt

SEQ ID NO: 121692 - DNA, 20 bp, human
gccagtcaaagatgcacaga

SEQ ID NO: 121693 - DNA, 20 bp, human
gtaagattcgtcagcatctt

SEQ ID NO: 121694 - DNA, 20 bp, human
gatcaccttgccgcgattcc

SEQ ID NO: 121695 - DNA, 20 bp, human
gaaaggagatggtgctttcc

SEQ ID NO: 121696 - DNA, 20 bp, human
gaccctcatctaggacagga

SEQ ID NO: 121697 - DNA, 20 bp, human
gtctgccacaagagcatgga

SEQ ID NO: 121698 - DNA, 20 bp, human
gacaaaccctcatctaggac

SEQ ID NO: 121699 - DNA, 20 bp, human
gaccaacctggaatcccagc

SEQ ID NO: 121700 - DNA, 20 bp, human
gaccttcctgtcctagatga

SEQ ID NO: 121701 - DNA, 20 bp, human
ggaaagacaaaccctcatct

SEQ ID NO: 121702 - DNA, 20 bp, human
gtatttgctgagtgtttcag

SEQ ID NO: 121703 - DNA, 20 bp, human
gtttctctgccacaagagca

SEQ ID NO: 121704 - DNA, 20 bp, human
gcatggaaggcaaccagaca

SEQ ID NO: 121705 - DNA, 20 bp, human
gtgtgtgaagcttagagtcc

SEQ ID NO: 121706 - DNA, 20 bp, human
gtgatggtagaatatcggag

SEQ ID NO: 121707 - DNA, 20 bp, human
gggcaccgtgctgcaagcac

SEQ ID NO: 121708 - DNA, 20 bp, human
ggctccttgtttcttctaca

SEQ ID NO: 121709 - DNA, 20 bp, human
gtggggaacgggacaatcct

SEQ ID NO: 121710 - DNA, 20 bp, human
ggtttcttctacagggaaat

SEQ ID NO: 121711 - DNA, 20 bp, human
gatattctaccatcatgacc

SEQ ID NO: 121712 - DNA, 20 bp, human
gactcaaaaacagaaacatc

SEQ ID NO: 121713 - DNA, 20 bp, human
gcttcattctgttggggaac

SEQ ID NO: 121714 - DNA, 20 bp, human
gtctacatcttcattctgtt

SEQ ID NO: 121715 - DNA, 20 bp, human
gtcttctacagggaaatggg

SEQ ID NO: 121716 - DNA, 20 bp, human
gagtaggaggaactctctga

SEQ ID NO: 121717 - DNA, 20 bp, human
gggggaacgggaccatactg

SEQ ID NO: 121718 - DNA, 20 bp, human
ggatggccaaatatcggagg

SEQ ID NO: 121719 - DNA, 20 bp, human
gtgcatcatgcggcccgcaa

SEQ ID NO: 121720 - DNA, 20 bp, human
gtaacttgttcggcactctt

SEQ ID NO: 121721 - DNA, 20 bp, human
gggccaaatatcggaggggg

SEQ ID NO: 121722 - DNA, 20 bp, human
gggcaccgtgttgcaggcgt

SEQ ID NO: 121723 - DNA, 20 bp, human
gtcctctgtcatagggatat

SEQ ID NO: 121724 - DNA, 20 bp, human
gcatgatggccaaatatcgg

SEQ ID NO: 121725 - DNA, 20 bp, human
gtcccatatccctatgacag

SEQ ID NO: 121726 - DNA, 20 bp, human
gcttaggatgagaaccacat

SEQ ID NO: 121727 - DNA, 20 bp, human
gccgtcacttcctggacgtg

SEQ ID NO: 121728 - DNA, 20 bp, human
gtggagagtctgcatcaccc

SEQ ID NO: 121729 - DNA, 20 bp, human
ggatgacggagtatcggaga

SEQ ID NO: 121730 - DNA, 20 bp, human
gactctccaggtcatgatga

SEQ ID NO: 121731 - DNA, 20 bp, human
gggtcatgatgacggagtat

SEQ ID NO: 121732 - DNA, 20 bp, human
gcgtccaggaagtgacggcc

SEQ ID NO: 121733 - DNA, 20 bp, human
gctttttcacagggaaatgg

SEQ ID NO: 121734 - DNA, 20 bp, human
gatcgcctacacccgcaaca

SEQ ID NO: 121735 - DNA, 20 bp, human
gggcaccgtgttgcgggtgt

SEQ ID NO: 121736 - DNA, 20 bp, human
gaacgcaggtactgtcacaa

SEQ ID NO: 121737 - DNA, 20 bp, human
gtaggctgagtggaaatccc

SEQ ID NO: 121738 - DNA, 20 bp, human
gcagggagaaaagcccagag

SEQ ID NO: 121739 - DNA, 20 bp, human
ggtcctggctgtcacttctt

SEQ ID NO: 121740 - DNA, 20 bp, human
gcctgcgttggactctgctg

SEQ ID NO: 121741 - DNA, 20 bp, human
gtgatgacagaatattgcag

SEQ ID NO: 121742 - DNA, 20 bp, human
gattctgtcatcatgagatg

SEQ ID NO: 121743 - DNA, 20 bp, human
gcatgacaaaaaatcagaca

SEQ ID NO: 121744 - DNA, 20 bp, human
gtctgaatccttaggctgag

SEQ ID NO: 121745 - DNA, 20 bp, human
gtgcattgtgcatgggacaa

SEQ ID NO: 121746 - DNA, 20 bp, human
gcctctgtcatagggatatg

SEQ ID NO: 121747 - DNA, 20 bp, human
gggggaacgggaccatactg

SEQ ID NO: 121748 - DNA, 20 bp, human
ggatggccaaatatcggagg

SEQ ID NO: 121749 - DNA, 20 bp, human
gtaacttgttcggcactctt

SEQ ID NO: 121750 - DNA, 20 bp, human
gtgcatcatgcggcccgcaa

SEQ ID NO: 121751 - DNA, 20 bp, human
gggccaaatatcggaggggg

SEQ ID NO: 121752 - DNA, 20 bp, human
gggcaccgtgttgcaggcgt

SEQ ID NO: 121753 - DNA, 20 bp, human
ggcaaaagtggaaaacagaa

SEQ ID NO: 121754 - DNA, 20 bp, human
gcatgatggccaaatatcgg

SEQ ID NO: 121755 - DNA, 20 bp, human
ggaaatcaagttaatgctca

SEQ ID NO: 121756 - DNA, 20 bp, human
gggcagacttcatccttgag

SEQ ID NO: 121757 - DNA, 20 bp, human
gaggatgaagtctgccagag

SEQ ID NO: 121758 - DNA, 20 bp, human
ggtgctcatgaacaagaagg

SEQ ID NO: 121759 - DNA, 20 bp, human
gaagaaggtgggactgatga

SEQ ID NO: 121760 - DNA, 20 bp, human
ggcaataaggaagaccacca

SEQ ID NO: 121761 - DNA, 20 bp, human
gtggctaccaactacctatc

SEQ ID NO: 121762 - DNA, 20 bp, human
ggctgtcatgtcatggttgg

SEQ ID NO: 121763 - DNA, 20 bp, human
gtccactctctgtttcctca

SEQ ID NO: 121764 - DNA, 20 bp, human
gtttcctcagggattgagaa

SEQ ID NO: 121765 - DNA, 20 bp, human
gatggctgtcatgtcatggt

SEQ ID NO: 121766 - DNA, 20 bp, human
gtgagggtcatgtatgtcag

SEQ ID NO: 121767 - DNA, 20 bp, human
ggatgccaggatccaggacg

SEQ ID NO: 121768 - DNA, 20 bp, human
gagagcctgctggctcatgg

SEQ ID NO: 121769 - DNA, 20 bp, human
gtagggcacttagggatgcc

SEQ ID NO: 121770 - DNA, 20 bp, human
gaagtggcttcattttggtg

SEQ ID NO: 121771 - DNA, 20 bp, human
gcatgagctcaagagcctgc

SEQ ID NO: 121772 - DNA, 20 bp, human
gtcaagagcctgctggctca

SEQ ID NO: 121773 - DNA, 20 bp, human
gagtaggccattgctgatca

SEQ ID NO: 121774 - DNA, 20 bp, human
gcagtgccaggaacatctga

SEQ ID NO: 121775 - DNA, 20 bp, human
gtgttggccctgatcagcaa

SEQ ID NO: 121776 - DNA, 20 bp, human
ggaaccaaatatattatcag

SEQ ID NO: 121777 - DNA, 20 bp, human
gggtcagtgccaacatgtat

SEQ ID NO: 121778 - DNA, 20 bp, human
gctgacaatgggtagcgctg

SEQ ID NO: 121779 - DNA, 20 bp, human
ggagctccggaactccacct

SEQ ID NO: 121780 - DNA, 20 bp, human
gaagcggcttcatcttggtg

SEQ ID NO: 121781 - DNA, 20 bp, human
gaaggtgttcactctagctt

SEQ ID NO: 121782 - DNA, 20 bp, human
gaggagcagcagaccattgc

SEQ ID NO: 121783 - DNA, 20 bp, human
gatgaagccgcttcccaagg

SEQ ID NO: 121784 - DNA, 20 bp, human
gtctagctttggattgttct

SEQ ID NO: 121785 - DNA, 20 bp, human
gtcactgtgcattggccaat

SEQ ID NO: 121786 - DNA, 20 bp, human
gagggcttcagttccaccaa

SEQ ID NO: 121787 - DNA, 20 bp, human
gagagcaactgtaaagaggg

SEQ ID NO: 121788 - DNA, 20 bp, human
gatgtgttcttggcccttgg

SEQ ID NO: 121789 - DNA, 20 bp, human
gtcacagcccaaaaatctaa

SEQ ID NO: 121790 - DNA, 20 bp, human
ggctgaaaccaaaatatcaa

SEQ ID NO: 121791 - DNA, 20 bp, human
gactgccatcttgggcactg

SEQ ID NO: 121792 - DNA, 20 bp, human
gcgtatgtgttcttggccct

SEQ ID NO: 121793 - DNA, 20 bp, human
gtgtcagagcaactgtaaag

SEQ ID NO: 121794 - DNA, 20 bp, human
gggtgttcagtcgaatgagg

SEQ ID NO: 121795 - DNA, 20 bp, human
gaaatattcacttacatgtt

SEQ ID NO: 121796 - DNA, 20 bp, human
gaagtcctgctgactcatca

SEQ ID NO: 121797 - DNA, 20 bp, human
ggactcatcagggtgattgt

SEQ ID NO: 121798 - DNA, 20 bp, human
gtgatgctaatcaggaccct

SEQ ID NO: 121799 - DNA, 20 bp, human
ggtccagcaaggtgaggatg

SEQ ID NO: 121800 - DNA, 20 bp, human
gaaaggtgaaaactgccacc

SEQ ID NO: 121801 - DNA, 20 bp, human
gtttctgctcttggctgggt

SEQ ID NO: 121802 - DNA, 20 bp, human
gcctgattagcatcacaaca

SEQ ID NO: 121803 - DNA, 20 bp, human
gtcttggctgggtgggctaa

SEQ ID NO: 121804 - DNA, 20 bp, human
gccaagagcagaaaatcagc

SEQ ID NO: 121805 - DNA, 20 bp, human
ggaaatacatgggagtctga

SEQ ID NO: 121806 - DNA, 20 bp, human
gtgcccaatagatagaagac

SEQ ID NO: 121807 - DNA, 20 bp, human
gacagcctgtaatgaatcag

SEQ ID NO: 121808 - DNA, 20 bp, human
gcagggaggaagaaggtctc

SEQ ID NO: 121809 - DNA, 20 bp, human
ggtggtgaaaaggatgtcca

SEQ ID NO: 121810 - DNA, 20 bp, human
gaccacggccaccaggatca

SEQ ID NO: 121811 - DNA, 20 bp, human
gcctgtaatgaatcagtgga

SEQ ID NO: 121812 - DNA, 20 bp, human
ggtgaaaaggatgtccaagg

SEQ ID NO: 121813 - DNA, 20 bp, human
gcggtccccaagcaagaata

SEQ ID NO: 121814 - DNA, 20 bp, human
gattggtctgtgggttcatg

SEQ ID NO: 121815 - DNA, 20 bp, human
gctggctgccaaggtagcat

SEQ ID NO: 121816 - DNA, 20 bp, human
gagagcacggtgcatgagaa

SEQ ID NO: 121817 - DNA, 20 bp, human
gtgagaacggcatagtgcag

SEQ ID NO: 121818 - DNA, 20 bp, human
gctcagatgctggtcaacat

SEQ ID NO: 121819 - DNA, 20 bp, human
gagaaggatgaaggctttag

SEQ ID NO: 121820 - DNA, 20 bp, human
gtgtcgtggtggtgtagcag

SEQ ID NO: 121821 - DNA, 20 bp, human
gatctgagggactgtcgtgg

SEQ ID NO: 121822 - DNA, 20 bp, human
gagcatctgagggactgtcg

SEQ ID NO: 121823 - DNA, 20 bp, human
ggctctctgtcagcagctcg

SEQ ID NO: 121824 - DNA, 20 bp, human
gtgacaaccatagcttctta

SEQ ID NO: 121825 - DNA, 20 bp, human
gtgcacggagtgcatcgtcc

SEQ ID NO: 121826 - DNA, 20 bp, human
gagacattctgtggaaccca

SEQ ID NO: 121827 - DNA, 20 bp, human
gtaacagaatgaactcctgt

SEQ ID NO: 121828 - DNA, 20 bp, human
gctctgaaatataagaagtc

SEQ ID NO: 121829 - DNA, 20 bp, human
ggattatagctgacaaaatc

SEQ ID NO: 121830 - DNA, 20 bp, human
gagggtggaatctctagcca

SEQ ID NO: 121831 - DNA, 20 bp, human
ggtaaataagagtgtcccac

SEQ ID NO: 121832 - DNA, 20 bp, human
gtgtacttgtggtatagcaa

SEQ ID NO: 121833 - DNA, 20 bp, human
gctcaattatcatgcaccag

SEQ ID NO: 121834 - DNA, 20 bp, human
gacagaaacatcacaaaggg

SEQ ID NO: 121835 - DNA, 20 bp, human
gttacccaattcatgttaaa

SEQ ID NO: 121836 - DNA, 20 bp, human
gagacactctgtagcaccta

SEQ ID NO: 121837 - DNA, 20 bp, human
gtagggccaggaagatgatg

SEQ ID NO: 121838 - DNA, 20 bp, human
gtattggttctgcctaagga

SEQ ID NO: 121839 - DNA, 20 bp, human
ggctacagagtgtctccttc

SEQ ID NO: 121840 - DNA, 20 bp, human
gttaacaggaccacaaaaag

SEQ ID NO: 121841 - DNA, 20 bp, human
gggcaatgtgtccatcatga

SEQ ID NO: 121842 - DNA, 20 bp, human
gatggacacattgccaaata

SEQ ID NO: 121843 - DNA, 20 bp, human
ggaattattggttctgccta

SEQ ID NO: 121844 - DNA, 20 bp, human
gacatgggagtatgaagttt

SEQ ID NO: 121845 - DNA, 20 bp, human
gctcatatgttggtaaatat

SEQ ID NO: 121846 - DNA, 20 bp, human
gggagtggaaactccagcca

SEQ ID NO: 121847 - DNA, 20 bp, human
gagatccaggagtgatagat

SEQ ID NO: 121848 - DNA, 20 bp, human
gagaaatcaagaagaccaca

SEQ ID NO: 121849 - DNA, 20 bp, human
ggggtttctcagatcgacct

SEQ ID NO: 121850 - DNA, 20 bp, human
gaggcgtgacactagaataa

SEQ ID NO: 121851 - DNA, 20 bp, human
gcagctgcatcctgggttac

SEQ ID NO: 121852 - DNA, 20 bp, human
gttactaaaaccagtaaccc

SEQ ID NO: 121853 - DNA, 20 bp, human
gatttgtgggactgtacatg

SEQ ID NO: 121854 - DNA, 20 bp, human
gttctcagatcgaccttggc

SEQ ID NO: 121855 - DNA, 20 bp, human
gagatattcagtagccccca

SEQ ID NO: 121856 - DNA, 20 bp, human
gccggcacactgccacgtag

SEQ ID NO: 121857 - DNA, 20 bp, human
gagacaaccagtgatggacg

SEQ ID NO: 121858 - DNA, 20 bp, human
ggactgaagacaaccagtga

SEQ ID NO: 121859 - DNA, 20 bp, human
gcattcaccccgtccatcac

SEQ ID NO: 121860 - DNA, 20 bp, human
ggcgaaagcaaggtccaagg

SEQ ID NO: 121861 - DNA, 20 bp, human
gaccgagtgcatcctgctgg

SEQ ID NO: 121862 - DNA, 20 bp, human
gcaggcaagaccatcagcta

SEQ ID NO: 121863 - DNA, 20 bp, human
gtgcagggctttgttctgat

SEQ ID NO: 121864 - DNA, 20 bp, human
ggtagcgaaagcaaggtcca

SEQ ID NO: 121865 - DNA, 20 bp, human
ggccaccgagtgcatcctgc

SEQ ID NO: 121866 - DNA, 20 bp, human
gatctacaatccagtaaggt

SEQ ID NO: 121867 - DNA, 20 bp, human
ggtatgcaataagacctctc

SEQ ID NO: 121868 - DNA, 20 bp, human
gcaataagacctctctggaa

SEQ ID NO: 121869 - DNA, 20 bp, human
ggatttctgtgaaatttcag

SEQ ID NO: 121870 - DNA, 20 bp, human
gtctcacgatgggtcttgct

SEQ ID NO: 121871 - DNA, 20 bp, human
gtatgatctacaatccagta

SEQ ID NO: 121872 - DNA, 20 bp, human
gtaatttctatggctaactg

SEQ ID NO: 121873 - DNA, 20 bp, human
gccaaaaagaatctcacgat

SEQ ID NO: 121874 - DNA, 20 bp, human
ggggcatgatctaatactga

SEQ ID NO: 121875 - DNA, 20 bp, human
ggcttaggttcaaagccata

SEQ ID NO: 121876 - DNA, 20 bp, human
gctatgtgctaaccatagac

SEQ ID NO: 121877 - DNA, 20 bp, human
gtgggagtcaacatgaacaa

SEQ ID NO: 121878 - DNA, 20 bp, human
gcactgcaagaagggcgcac

SEQ ID NO: 121879 - DNA, 20 bp, human
gagtgcctgaggaactatgt

SEQ ID NO: 121880 - DNA, 20 bp, human
gtaggacatcactgcaagaa

SEQ ID NO: 121881 - DNA, 20 bp, human
ggcaggtggactagtgcctg

SEQ ID NO: 121882 - DNA, 20 bp, human
gaaattttcagtagaaattg

SEQ ID NO: 121883 - DNA, 20 bp, human
gtctaccaacatagttcctc

SEQ ID NO: 121884 - DNA, 20 bp, human
ggtattattgggtgtctacc

SEQ ID NO: 121885 - DNA, 20 bp, human
gttatataattcagaagtgc

SEQ ID NO: 121886 - DNA, 20 bp, human
gtgatggtagagtagtacag

SEQ ID NO: 121887 - DNA, 20 bp, human
gttgtgccaaacaggtaaac

SEQ ID NO: 121888 - DNA, 20 bp, human
gaacaggcaaaaatatcaat

SEQ ID NO: 121889 - DNA, 20 bp, human
gagtgtgaaggcgagaatcc

SEQ ID NO: 121890 - DNA, 20 bp, human
gaaacttggacacaaaggtt

SEQ ID NO: 121891 - DNA, 20 bp, human
gttttgcctgtttacctgtt

SEQ ID NO: 121892 - DNA, 20 bp, human
gcacacccgttgtgtcatga

SEQ ID NO: 121893 - DNA, 20 bp, human
gcaagtcctgtgaaagaccc

SEQ ID NO: 121894 - DNA, 20 bp, human
gacatcaagtcttgtagaag

SEQ ID NO: 121895 - DNA, 20 bp, human
gaggataaatagcaggatct

SEQ ID NO: 121896 - DNA, 20 bp, human
gatgatggccgagtatcgca

SEQ ID NO: 121897 - DNA, 20 bp, human
gagtgtcccagtcactggac

SEQ ID NO: 121898 - DNA, 20 bp, human
gagctgagggactacacttg

SEQ ID NO: 121899 - DNA, 20 bp, human
gaggattattaatctgtgaa

SEQ ID NO: 121900 - DNA, 20 bp, human
gctcggcctgtccagtgact

SEQ ID NO: 121901 - DNA, 20 bp, human
ggaccaagaacaggacaaac

SEQ ID NO: 121902 - DNA, 20 bp, human
gtgtgatgccctgcgatact

SEQ ID NO: 121903 - DNA, 20 bp, human
gcacatacatgaccaagaac

SEQ ID NO: 121904 - DNA, 20 bp, human
gtgtatgtggtgaccgtgct

SEQ ID NO: 121905 - DNA, 20 bp, human
gggaacagataaccagactt

SEQ ID NO: 121906 - DNA, 20 bp, human
ggtcagacacagccacatgg

SEQ ID NO: 121907 - DNA, 20 bp, human
ggaaatagataaccagacgt

SEQ ID NO: 121908 - DNA, 20 bp, human
ggatggccgagtatcgcagg

SEQ ID NO: 121909 - DNA, 20 bp, human
gccagtcactggataagcca

SEQ ID NO: 121910 - DNA, 20 bp, human
gtctgaccgcctgcgatact

SEQ ID NO: 121911 - DNA, 20 bp, human
gaggtatgtgaccaagaaca

SEQ ID NO: 121912 - DNA, 20 bp, human
gaaattctctcacccacgtc

SEQ ID NO: 121913 - DNA, 20 bp, human
ggttccccagcactgtcatg

SEQ ID NO: 121914 - DNA, 20 bp, human
gatacctcatgacagtgctg

SEQ ID NO: 121915 - DNA, 20 bp, human
gagctgggggactacgcttg

SEQ ID NO: 121916 - DNA, 20 bp, human
ggtgagggtggactgtacca

SEQ ID NO: 121917 - DNA, 20 bp, human
gacgcactcagtggatccca

SEQ ID NO: 121918 - DNA, 20 bp, human
gtgcatggccttggcatcta

SEQ ID NO: 121919 - DNA, 20 bp, human
gcagctcctggtaaacctgt

SEQ ID NO: 121920 - DNA, 20 bp, human
gagggtggactgtaccaggg

SEQ ID NO: 121921 - DNA, 20 bp, human
gcatctatggcatggctcag

SEQ ID NO: 121922 - DNA, 20 bp, human
gcctgctaggttgctctcat

SEQ ID NO: 121923 - DNA, 20 bp, human
ggtgaagcagcggtacagga

SEQ ID NO: 121924 - DNA, 20 bp, human
ggtggactgtaccagggtgg

SEQ ID NO: 121925 - DNA, 20 bp, human
gtgaaccaaacagccaccat

SEQ ID NO: 121926 - DNA, 20 bp, human
ggagaacagcctccagacga

SEQ ID NO: 121927 - DNA, 20 bp, human
gtaggtgcggatccccctgg

SEQ ID NO: 121928 - DNA, 20 bp, human
gcggatccccctggagggat

SEQ ID NO: 121929 - DNA, 20 bp, human
gcctaaggcaggaatggaat

SEQ ID NO: 121930 - DNA, 20 bp, human
gagaaggatgaaatccatta

SEQ ID NO: 121931 - DNA, 20 bp, human
gccttaggtgcggatccccc

SEQ ID NO: 121932 - DNA, 20 bp, human
gtccattcctgccttaggtg

SEQ ID NO: 121933 - DNA, 20 bp, human
ggcagatgtccagtaaagag

SEQ ID NO: 121934 - DNA, 20 bp, human
gggcaatgagagttccctaa

SEQ ID NO: 121935 - DNA, 20 bp, human
ggccaagaggatacattcag

SEQ ID NO: 121936 - DNA, 20 bp, human
gcagagacgcacagaacctg

SEQ ID NO: 121937 - DNA, 20 bp, human
gcctgaagctgcaggaaaaa

SEQ ID NO: 121938 - DNA, 20 bp, human
gtaatggctatgtagcgcag

SEQ ID NO: 121939 - DNA, 20 bp, human
gcacacacgagaggttgctg

SEQ ID NO: 121940 - DNA, 20 bp, human
gcagaacctggggtgcataa

SEQ ID NO: 121941 - DNA, 20 bp, human
gggctatgtagcgcagtggc

SEQ ID NO: 121942 - DNA, 20 bp, human
gatggtaaccagcaactgtg

SEQ ID NO: 121943 - DNA, 20 bp, human
ggcagatgtccacacacgag

SEQ ID NO: 121944 - DNA, 20 bp, human
gagatcagcctcagctagag

SEQ ID NO: 121945 - DNA, 20 bp, human
ggtctctggccggtggagca

SEQ ID NO: 121946 - DNA, 20 bp, human
ggtggagttaatgggatgta

SEQ ID NO: 121947 - DNA, 20 bp, human
gtcctggcactgacactcat

SEQ ID NO: 121948 - DNA, 20 bp, human
gccacagcttccccatagaa

SEQ ID NO: 121949 - DNA, 20 bp, human
ggtagcagttagtacatgac

SEQ ID NO: 121950 - DNA, 20 bp, human
gttaagtcagactctcttca

SEQ ID NO: 121951 - DNA, 20 bp, human
gaaggaacttctggactggt

SEQ ID NO: 121952 - DNA, 20 bp, human
gagaacatgtggaaattgat

SEQ ID NO: 121953 - DNA, 20 bp, human
gagtagtgcttgcctattat

SEQ ID NO: 121954 - DNA, 20 bp, human
ggtccagaagttcctttcta

SEQ ID NO: 121955 - DNA, 20 bp, human
gccccatagaaaggaacttc

SEQ ID NO: 121956 - DNA, 20 bp, human
gagaaggaggaagcccggtg

SEQ ID NO: 121957 - DNA, 20 bp, human
ggttaaccaaagctccacac

SEQ ID NO: 121958 - DNA, 20 bp, human
ggggcttctctgaacaccca

SEQ ID NO: 121959 - DNA, 20 bp, human
ggaagcccggtgtggagctt

SEQ ID NO: 121960 - DNA, 20 bp, human
gtgtgttgcccactagggtt

SEQ ID NO: 121961 - DNA, 20 bp, human
ggttgcccactagggttagg

SEQ ID NO: 121962 - DNA, 20 bp, human
ggagagtcctttccagccct

SEQ ID NO: 121963 - DNA, 20 bp, human
gcctacctcctaaccctagt

SEQ ID NO: 121964 - DNA, 20 bp, human
ggatctggacagagcagtcc

SEQ ID NO: 121965 - DNA, 20 bp, human
ggcctgggtcattgggctag

SEQ ID NO: 121966 - DNA, 20 bp, human
gagttgctggtgaatctccg

SEQ ID NO: 121967 - DNA, 20 bp, human
gggtgcacactctctggaag

SEQ ID NO: 121968 - DNA, 20 bp, human
gtctacctgatgacactgac

SEQ ID NO: 121969 - DNA, 20 bp, human
gctggtgaatctccggggcc

SEQ ID NO: 121970 - DNA, 20 bp, human
ggacagactttgagtttatg

SEQ ID NO: 121971 - DNA, 20 bp, human
gatgcaaccagcatacgaga

SEQ ID NO: 121972 - DNA, 20 bp, human
ggtttcctgtcagtgtcatc

SEQ ID NO: 121973 - DNA, 20 bp, human
gtttactttgttcttgcact

SEQ ID NO: 121974 - DNA, 20 bp, human
gagagaactacttccagctg

SEQ ID NO: 121975 - DNA, 20 bp, human
gatcatcatcctgtcatacg

SEQ ID NO: 121976 - DNA, 20 bp, human
gcagcaggtggcagaaacga

SEQ ID NO: 121977 - DNA, 20 bp, human
ggaggaatgaagtgctgagt

SEQ ID NO: 121978 - DNA, 20 bp, human
gccaagaagccacagccagc

SEQ ID NO: 121979 - DNA, 20 bp, human
gtcagttgctggtcaatctc

SEQ ID NO: 121980 - DNA, 20 bp, human
gctggaagtagttatctttg

SEQ ID NO: 121981 - DNA, 20 bp, human
gagtcaatgctagctctgag

SEQ ID NO: 121982 - DNA, 20 bp, human
gagaagccacagccagcagg

SEQ ID NO: 121983 - DNA, 20 bp, human
ggcagaaacgagggtgcatg

SEQ ID NO: 121984 - DNA, 20 bp, human
gtgaggacagtgtaatgcaa

SEQ ID NO: 121985 - DNA, 20 bp, human
gctgtggcttcttgggtaag

SEQ ID NO: 121986 - DNA, 20 bp, human
ggagaaccacttctaaccct

SEQ ID NO: 121987 - DNA, 20 bp, human
gcggatggctacggtctcct

SEQ ID NO: 121988 - DNA, 20 bp, human
ggtcaggcaacccgtcaccc

SEQ ID NO: 121989 - DNA, 20 bp, human
ggggattttcccagtaccca

SEQ ID NO: 121990 - DNA, 20 bp, human
ggtctgtgcacggatggcta

SEQ ID NO: 121991 - DNA, 20 bp, human
gggtttccagcagagcggtc

SEQ ID NO: 121992 - DNA, 20 bp, human
gaaactggtttccagcagag

SEQ ID NO: 121993 - DNA, 20 bp, human
gaggagaaaacttcaccatt

SEQ ID NO: 121994 - DNA, 20 bp, human
gcgttgtcagatacattaca

SEQ ID NO: 121995 - DNA, 20 bp, human
gcacttctaaccctgggtac

SEQ ID NO: 121996 - DNA, 20 bp, human
gcggcgtctttggcagtagt

SEQ ID NO: 121997 - DNA, 20 bp, human
ggctgctgcgagaccagccg

SEQ ID NO: 121998 - DNA, 20 bp, human
gtgacagtcgggagcaagaa

SEQ ID NO: 121999 - DNA, 20 bp, human
gtcagacgagaggccccctg

SEQ ID NO: 122000 - DNA, 20 bp, human
ggaccgaggtatcagacgag

SEQ ID NO: 122001 - DNA, 20 bp, human
ggtaaccgccccgtccccag

SEQ ID NO: 122002 - DNA, 20 bp, human
ggggaggagggctgacagtc

SEQ ID NO: 122003 - DNA, 20 bp, human
gactggtgtctcctgcggaa

SEQ ID NO: 122004 - DNA, 20 bp, human
ggggcacgccttccagaccg

SEQ ID NO: 122005 - DNA, 20 bp, human
gctcctgcggaagggcagct

SEQ ID NO: 122006 - DNA, 20 bp, human
gatcctgaagggagacaaaa

SEQ ID NO: 122007 - DNA, 20 bp, human
gaatgagggtgaatacgaaa

SEQ ID NO: 122008 - DNA, 20 bp, human
gtgactttagcagttgcaga

SEQ ID NO: 122009 - DNA, 20 bp, human
gtgcattacaagactcccag

SEQ ID NO: 122010 - DNA, 20 bp, human
gtcttgtaatgcagccactg

SEQ ID NO: 122011 - DNA, 20 bp, human
gaggaaaatgagaaaaatga

SEQ ID NO: 122012 - DNA, 20 bp, human
gtcctacaatccatcctgaa

SEQ ID NO: 122013 - DNA, 20 bp, human
gtatctccttcactggatgt

SEQ ID NO: 122014 - DNA, 20 bp, human
gggattgtaggaattcccca

SEQ ID NO: 122015 - DNA, 20 bp, human
gaattcacttttatccacag

SEQ ID NO: 122016 - DNA, 20 bp, human
gagagcacacgaatgcccca

SEQ ID NO: 122017 - DNA, 20 bp, human
gtggcatctgattttctgtc

SEQ ID NO: 122018 - DNA, 20 bp, human
gttcttttgctcatgcggat

SEQ ID NO: 122019 - DNA, 20 bp, human
ggtttcttcttctcggcatt

SEQ ID NO: 122020 - DNA, 20 bp, human
ggtgtgtgctgatgataaca

SEQ ID NO: 122021 - DNA, 20 bp, human
gtaggaaaatgaaaacaatg

SEQ ID NO: 122022 - DNA, 20 bp, human
gtcttcttctcggcattagg

SEQ ID NO: 122023 - DNA, 20 bp, human
gggtgcagaagcactacttt

SEQ ID NO: 122024 - DNA, 20 bp, human
gtgcggatgggatagtgaag

SEQ ID NO: 122025 - DNA, 20 bp, human
gtaacagggtcttggatcat

SEQ ID NO: 122026 - DNA, 20 bp, human
gatacattcttttgctcata

SEQ ID NO: 122027 - DNA, 20 bp, human
gtcttcttcatgacttttgc

SEQ ID NO: 122028 - DNA, 20 bp, human
gggatcgtatgaatgcccca

SEQ ID NO: 122029 - DNA, 20 bp, human
gttcttttgctcatacggat

SEQ ID NO: 122030 - DNA, 20 bp, human
gtgttcccaccatcaaaaat

SEQ ID NO: 122031 - DNA, 20 bp, human
ggagggagagctgactaagc

SEQ ID NO: 122032 - DNA, 20 bp, human
ggtgtgagcacaagagttga

SEQ ID NO: 122033 - DNA, 20 bp, human
ggagaacaaagagaatgaag

SEQ ID NO: 122034 - DNA, 20 bp, human
gtggcttctgattttctgta

SEQ ID NO: 122035 - DNA, 20 bp, human
ggctcatacggatgggatag

SEQ ID NO: 122036 - DNA, 20 bp, human
gagcattcctacaatccatt

SEQ ID NO: 122037 - DNA, 20 bp, human
gagaaaaggtcaattcttga

SEQ ID NO: 122038 - DNA, 20 bp, human
gggattgtaggaatgctcca

SEQ ID NO: 122039 - DNA, 20 bp, human
ggagggagagctgactcagt

SEQ ID NO: 122040 - DNA, 20 bp, human
ggatgagaagaatcatggac

SEQ ID NO: 122041 - DNA, 20 bp, human
ggtttccaattagagccatc

SEQ ID NO: 122042 - DNA, 20 bp, human
ggctcatgcggatgagatag

SEQ ID NO: 122043 - DNA, 20 bp, human
ggtgtgtgctgatgataaca

SEQ ID NO: 122044 - DNA, 20 bp, human
gtcttcttcttggcattagg

SEQ ID NO: 122045 - DNA, 20 bp, human
gggtgcagaagcactacttt

SEQ ID NO: 122046 - DNA, 20 bp, human
ggaagaggaacgtgtgtggt

SEQ ID NO: 122047 - DNA, 20 bp, human
ggaaagaagaggaacgtgtg

SEQ ID NO: 122048 - DNA, 20 bp, human
gggccactaaaaagatgccc

SEQ ID NO: 122049 - DNA, 20 bp, human
ggtaaaaagcacattcatca

SEQ ID NO: 122050 - DNA, 20 bp, human
ggtcctgggcatctttttag

SEQ ID NO: 122051 - DNA, 20 bp, human
gcctaaaatttgtggactta

SEQ ID NO: 122052 - DNA, 20 bp, human
gattttaggattcatgagat

SEQ ID NO: 122053 - DNA, 20 bp, human
gtcttctatatatcactgtc

SEQ ID NO: 122054 - DNA, 20 bp, human
gacttatggctaccttctcc

SEQ ID NO: 122055 - DNA, 20 bp, human
gggctctgaatgttttcttt

SEQ ID NO: 122056 - DNA, 20 bp, human
gatgctcagaagaaaacctt

SEQ ID NO: 122057 - DNA, 20 bp, human
ggtatctaataaataatgga

SEQ ID NO: 122058 - DNA, 20 bp, human
gaattatagagcttgtccta

SEQ ID NO: 122059 - DNA, 20 bp, human
gctaatttttcaatggagaa

SEQ ID NO: 122060 - DNA, 20 bp, human
gcaaaaccagcgtattaatt

SEQ ID NO: 122061 - DNA, 20 bp, human
gaagcatacacatcatggca

SEQ ID NO: 122062 - DNA, 20 bp, human
gttttaccaaattaatacgc

SEQ ID NO: 122063 - DNA, 20 bp, human
gtatagtatctaataaataa

SEQ ID NO: 122064 - DNA, 20 bp, human
ggtaaaaagcatacacatca

SEQ ID NO: 122065 - DNA, 20 bp, human
gtataattctaatttttcaa

SEQ ID NO: 122066 - DNA, 20 bp, human
ggcccaggaccagagaaaaa

SEQ ID NO: 122067 - DNA, 20 bp, human
gattcccagcaggatgaaga

SEQ ID NO: 122068 - DNA, 20 bp, human
gtgaggatggtgtactgaag

SEQ ID NO: 122069 - DNA, 20 bp, human
ggaccttggggtctcttgat

SEQ ID NO: 122070 - DNA, 20 bp, human
gtaaggcaaattatccagga

SEQ ID NO: 122071 - DNA, 20 bp, human
gtgttgcttcctggaccttg

SEQ ID NO: 122072 - DNA, 20 bp, human
gtgccagtgagaagatgccc

SEQ ID NO: 122073 - DNA, 20 bp, human
gaaattatccaggatggtgt

SEQ ID NO: 122074 - DNA, 20 bp, human
gatgtagatgaggagaacca

SEQ ID NO: 122075 - DNA, 20 bp, human
gacagagtttcggattcatg

SEQ ID NO: 122076 - DNA, 20 bp, human
ggattgcatccatagagccc

SEQ ID NO: 122077 - DNA, 20 bp, human
gctcagtcaactgttcctca

SEQ ID NO: 122078 - DNA, 20 bp, human
ggtaaaaaacatattcatca

SEQ ID NO: 122079 - DNA, 20 bp, human
gtcttctatgtatcactgct

SEQ ID NO: 122080 - DNA, 20 bp, human
ggtcctggccatcttttcag

SEQ ID NO: 122081 - DNA, 20 bp, human
gatgaaggccactgaaaaga

SEQ ID NO: 122082 - DNA, 20 bp, human
gggccactgaaaagatggcc

SEQ ID NO: 122083 - DNA, 20 bp, human
gggctccgaatgctttctgt

SEQ ID NO: 122084 - DNA, 20 bp, human
gttcatgggaaactctgtca

SEQ ID NO: 122085 - DNA, 20 bp, human
gtcatgagacccaaaatttg

SEQ ID NO: 122086 - DNA, 20 bp, human
ggtaacaggcatattcatca

SEQ ID NO: 122087 - DNA, 20 bp, human
gttttgcggtgctaggtaac

SEQ ID NO: 122088 - DNA, 20 bp, human
ggaactgtttttgcggtgct

SEQ ID NO: 122089 - DNA, 20 bp, human
gaaggccatcttgggtacag

SEQ ID NO: 122090 - DNA, 20 bp, human
gttcatgggaaactccatca

SEQ ID NO: 122091 - DNA, 20 bp, human
ggtggcaaatggcagtgtag

SEQ ID NO: 122092 - DNA, 20 bp, human
gtcttctatatatcattgct

SEQ ID NO: 122093 - DNA, 20 bp, human
gaattaatgaactgtttttg

SEQ ID NO: 122094 - DNA, 20 bp, human
gggctccgaatgctttctgt

SEQ ID NO: 122095 - DNA, 20 bp, human
ggaggtccatgagggacagt

SEQ ID NO: 122096 - DNA, 20 bp, human
ggatcacggagtacctaagg

SEQ ID NO: 122097 - DNA, 20 bp, human
gatcacaggggaggtctcat

SEQ ID NO: 122098 - DNA, 20 bp, human
ggcagccttgctcatgatca

SEQ ID NO: 122099 - DNA, 20 bp, human
gtggcagaggggatatcaca

SEQ ID NO: 122100 - DNA, 20 bp, human
gggtagtgaagcagatgtcc

SEQ ID NO: 122101 - DNA, 20 bp, human
gtccaggaccagtgggactg

SEQ ID NO: 122102 - DNA, 20 bp, human
ggtcttttccagctctgggt

SEQ ID NO: 122103 - DNA, 20 bp, human
gcatgatcacggagtaccta

SEQ ID NO: 122104 - DNA, 20 bp, human
gtactttgctgatggcagag

SEQ ID NO: 122105 - DNA, 20 bp, human
ggctttttgggaagagtcct

SEQ ID NO: 122106 - DNA, 20 bp, human
gtcccacaagggtaaggtag

SEQ ID NO: 122107 - DNA, 20 bp, human
gttcagctcccacaagggta

SEQ ID NO: 122108 - DNA, 20 bp, human
gtaagatgatagcattccca

SEQ ID NO: 122109 - DNA, 20 bp, human
gtgagctgtgcaccccacaa

SEQ ID NO: 122110 - DNA, 20 bp, human
gggtaattaaccagcatctt

SEQ ID NO: 122111 - DNA, 20 bp, human
gagcatcttaggcacaatag

SEQ ID NO: 122112 - DNA, 20 bp, human
gtaattacctgctggatcaa

SEQ ID NO: 122113 - DNA, 20 bp, human
gatggcaaaaataagacctg

SEQ ID NO: 122114 - DNA, 20 bp, human
gggcacaactgtaggatcaa

SEQ ID NO: 122115 - DNA, 20 bp, human
gctagatatcagtctcaatg

SEQ ID NO: 122116 - DNA, 20 bp, human
ggcggccagggtgtgagatc

SEQ ID NO: 122117 - DNA, 20 bp, human
ggctcatgagcacagagtaa

SEQ ID NO: 122118 - DNA, 20 bp, human
gggctggccaaccagaccct

SEQ ID NO: 122119 - DNA, 20 bp, human
gcagccgcatgctgtatgat

SEQ ID NO: 122120 - DNA, 20 bp, human
gtctgtgctcatgagccata

SEQ ID NO: 122121 - DNA, 20 bp, human
gcagccgatcatacagcatg

SEQ ID NO: 122122 - DNA, 20 bp, human
ggctgtatgatcggctgaag

SEQ ID NO: 122123 - DNA, 20 bp, human
gtgcaggtagaagtacatct

SEQ ID NO: 122124 - DNA, 20 bp, human
gctggctgaagattcccaac

SEQ ID NO: 122125 - DNA, 20 bp, human
gatgcagagaggagtcaatg

SEQ ID NO: 122126 - DNA, 20 bp, human
gatggcccacgagcgtccca

SEQ ID NO: 122127 - DNA, 20 bp, human
ggaagacacaaggaccagga

SEQ ID NO: 122128 - DNA, 20 bp, human
gacgggaagacacaaggacc

SEQ ID NO: 122129 - DNA, 20 bp, human
gtcaggactgggtatctcag

SEQ ID NO: 122130 - DNA, 20 bp, human
gagggcaacgggaagacaca

SEQ ID NO: 122131 - DNA, 20 bp, human
ggttgccctgggacgctcgt

SEQ ID NO: 122132 - DNA, 20 bp, human
gctcagaaccaatcatggtc

SEQ ID NO: 122133 - DNA, 20 bp, human
gaagagaacacggtcaagat

SEQ ID NO: 122134 - DNA, 20 bp, human
gacagtggtacagatgaaaa

SEQ ID NO: 122135 - DNA, 20 bp, human
gactgttcaccagaagcccc

SEQ ID NO: 122136 - DNA, 20 bp, human
gaacagggaggtcaaaacgg

SEQ ID NO: 122137 - DNA, 20 bp, human
gggccagaagcatcatgaag

SEQ ID NO: 122138 - DNA, 20 bp, human
gatgagggcattgctaaaca

SEQ ID NO: 122139 - DNA, 20 bp, human
ggtcctcttcatgatgcttc

SEQ ID NO: 122140 - DNA, 20 bp, human
ggaggaagtacatgggcctg

SEQ ID NO: 122141 - DNA, 20 bp, human
gcccaggagccaggacgaca

SEQ ID NO: 122142 - DNA, 20 bp, human
gcctaggagaataaaatctg

SEQ ID NO: 122143 - DNA, 20 bp, human
gctaaacagggaggtcaaaa

SEQ ID NO: 122144 - DNA, 20 bp, human
gtcagctgcacccaggagcc

SEQ ID NO: 122145 - DNA, 20 bp, human
gaccatgtcgtcctggctcc

SEQ ID NO: 122146 - DNA, 20 bp, human
gggagcttgtcatggaccat

SEQ ID NO: 122147 - DNA, 20 bp, human
gcctgtgaggacgaagttag

SEQ ID NO: 122148 - DNA, 20 bp, human
ggaaggcaggatgggtgatg

SEQ ID NO: 122149 - DNA, 20 bp, human
gtgaggagagggtaccgtag

SEQ ID NO: 122150 - DNA, 20 bp, human
gggctgtgtgcaaccctcta

SEQ ID NO: 122151 - DNA, 20 bp, human
gcaagctccttgggctgtaa

SEQ ID NO: 122152 - DNA, 20 bp, human
gggctgtaaaggcagaaatc

SEQ ID NO: 122153 - DNA, 20 bp, human
gcctgcggttcatgaggaga

SEQ ID NO: 122154 - DNA, 20 bp, human
gtccaaggaaccaccaaccc

SEQ ID NO: 122155 - DNA, 20 bp, human
gcatgaataagcaaaccctg

SEQ ID NO: 122156 - DNA, 20 bp, human
gtgagggcaaagagaagcca

SEQ ID NO: 122157 - DNA, 20 bp, human
gtcttgcggctcatgaggac

SEQ ID NO: 122158 - DNA, 20 bp, human
gggctgggagggtctatcga

SEQ ID NO: 122159 - DNA, 20 bp, human
gccctgctaaggtcaagtag

SEQ ID NO: 122160 - DNA, 20 bp, human
gatctgctggttgattgtgg

SEQ ID NO: 122161 - DNA, 20 bp, human
gtctgctccatagctctgta

SEQ ID NO: 122162 - DNA, 20 bp, human
gaaaaagaccaggagaatga

SEQ ID NO: 122163 - DNA, 20 bp, human
ggtcaagtagaggaagtgtt

SEQ ID NO: 122164 - DNA, 20 bp, human
gaggataaagtcggcataca

SEQ ID NO: 122165 - DNA, 20 bp, human
gtgtgtaccctacagagcta

SEQ ID NO: 122166 - DNA, 20 bp, human
gcctgtcctcatgaaccata

SEQ ID NO: 122167 - DNA, 20 bp, human
gggttggatttcatcctcat

SEQ ID NO: 122168 - DNA, 20 bp, human
gtgctggttcctgggctcag

SEQ ID NO: 122169 - DNA, 20 bp, human
ggttcatgaggacagggtaa

SEQ ID NO: 122170 - DNA, 20 bp, human
gacagaccctatggttcatg

SEQ ID NO: 122171 - DNA, 20 bp, human
ggaagccatccactgagccc

SEQ ID NO: 122172 - DNA, 20 bp, human
gcatcgggctgctggttcct

SEQ ID NO: 122173 - DNA, 20 bp, human
gacctgctagtgtcagatag

SEQ ID NO: 122174 - DNA, 20 bp, human
ggaaccagcagcccgatgcc

SEQ ID NO: 122175 - DNA, 20 bp, human
gcaggtcatgggtgtgaata

SEQ ID NO: 122176 - DNA, 20 bp, human
gctggctcagtttccccctg

SEQ ID NO: 122177 - DNA, 20 bp, human
gcaggagctggcacaccctc

SEQ ID NO: 122178 - DNA, 20 bp, human
gtcagcagtgggtaatggag

SEQ ID NO: 122179 - DNA, 20 bp, human
ggattccctgagcacatgac

SEQ ID NO: 122180 - DNA, 20 bp, human
ggcaggctgacaccaggagc

SEQ ID NO: 122181 - DNA, 20 bp, human
gccactgctgatgaaccaga

SEQ ID NO: 122182 - DNA, 20 bp, human
gaacccagcaggctgacacc

SEQ ID NO: 122183 - DNA, 20 bp, human
gcttgggcacagtcacgcat

SEQ ID NO: 122184 - DNA, 20 bp, human
gcctggcccacaagcatctt

SEQ ID NO: 122185 - DNA, 20 bp, human
gtcagcaaagagtcccgtga

SEQ ID NO: 122186 - DNA, 20 bp, human
gcccaggagccaacacgaca

SEQ ID NO: 122187 - DNA, 20 bp, human
ggaggatgaccatgtcgtgt

SEQ ID NO: 122188 - DNA, 20 bp, human
gcctaggagaataaaatctg

SEQ ID NO: 122189 - DNA, 20 bp, human
gaccatgtcgtgttggctcc

SEQ ID NO: 122190 - DNA, 20 bp, human
ggctcctgggtgcagctgac

SEQ ID NO: 122191 - DNA, 20 bp, human
gcatgtccatgagggaaagt

SEQ ID NO: 122192 - DNA, 20 bp, human
gatcacaccaggggaaatta

SEQ ID NO: 122193 - DNA, 20 bp, human
gactcagaaccatcatgaag

SEQ ID NO: 122194 - DNA, 20 bp, human
gatgagggaattgccaaaca

SEQ ID NO: 122195 - DNA, 20 bp, human
gatttgcaccatcacaccag

SEQ ID NO: 122196 - DNA, 20 bp, human
gggctcacagtttccccctg

SEQ ID NO: 122197 - DNA, 20 bp, human
gcaggagctggcacaccctc

SEQ ID NO: 122198 - DNA, 20 bp, human
gtcagcagtgggtaatggag

SEQ ID NO: 122199 - DNA, 20 bp, human
ggcaggctgacaccaggagc

SEQ ID NO: 122200 - DNA, 20 bp, human
gccactgctgatgaaccaga

SEQ ID NO: 122201 - DNA, 20 bp, human
gaacccagcaggctgacacc

SEQ ID NO: 122202 - DNA, 20 bp, human
ggattccctgagcacatgac

SEQ ID NO: 122203 - DNA, 20 bp, human
gcctggcccacaagcatctt

SEQ ID NO: 122204 - DNA, 20 bp, human
gcttgggcacagtcacgcat

SEQ ID NO: 122205 - DNA, 20 bp, human
gtcagcaaagagtcccgtga

SEQ ID NO: 122206 - DNA, 20 bp, human
ggtcagcatgaacccatcca

SEQ ID NO: 122207 - DNA, 20 bp, human
gcctgtgaggacgaagttag

SEQ ID NO: 122208 - DNA, 20 bp, human
gggagcttgtcatggaccat

SEQ ID NO: 122209 - DNA, 20 bp, human
ggaaggcaggatgggtgatg

SEQ ID NO: 122210 - DNA, 20 bp, human
gtactgcaaagagaagcccg

SEQ ID NO: 122211 - DNA, 20 bp, human
gtgaggagagggtaccgtag

SEQ ID NO: 122212 - DNA, 20 bp, human
gggctgtgtgcaaccctcta

SEQ ID NO: 122213 - DNA, 20 bp, human
gtggtggtcggctcctgggt

SEQ ID NO: 122214 - DNA, 20 bp, human
gtccaaggaaccaccaaccc

SEQ ID NO: 122215 - DNA, 20 bp, human
ggcaaagagaagcccgggga

SEQ ID NO: 122216 - DNA, 20 bp, human
gttggccatccaggtgatat

SEQ ID NO: 122217 - DNA, 20 bp, human
gtcttctacgtgacactagc

SEQ ID NO: 122218 - DNA, 20 bp, human
gtccaatggccaatatcacc

SEQ ID NO: 122219 - DNA, 20 bp, human
gcatccagcactactttgtg

SEQ ID NO: 122220 - DNA, 20 bp, human
gtgaccacacaaagtagtgc

SEQ ID NO: 122221 - DNA, 20 bp, human
gccaggtgatgttgtccatg

SEQ ID NO: 122222 - DNA, 20 bp, human
gagacaatccaaacatccaa

SEQ ID NO: 122223 - DNA, 20 bp, human
gtccaggtgatattggccat

SEQ ID NO: 122224 - DNA, 20 bp, human
gctttgtgtggtcatttttg

SEQ ID NO: 122225 - DNA, 20 bp, human
gttgtctgaagagtcccatc

SEQ ID NO: 122226 - DNA, 20 bp, human
ggccaaccacactggaaagt

SEQ ID NO: 122227 - DNA, 20 bp, human
gtcgtctgaagagtcccatg

SEQ ID NO: 122228 - DNA, 20 bp, human
gcctgtcctcatgaaccata

SEQ ID NO: 122229 - DNA, 20 bp, human
gtgctggttcctgggctcag

SEQ ID NO: 122230 - DNA, 20 bp, human
ggttcatgaggacagggtaa

SEQ ID NO: 122231 - DNA, 20 bp, human
ggaagccatccactgagccc

SEQ ID NO: 122232 - DNA, 20 bp, human
gacagaccctatggttcatg

SEQ ID NO: 122233 - DNA, 20 bp, human
gagttggatttcatcctcat

SEQ ID NO: 122234 - DNA, 20 bp, human
gcatcgggctgctggttcct

SEQ ID NO: 122235 - DNA, 20 bp, human
gacctgctagtgtcagatag

SEQ ID NO: 122236 - DNA, 20 bp, human
gcccatgagggtaaagcctc

SEQ ID NO: 122237 - DNA, 20 bp, human
ggtgagtgaagagccccatg

SEQ ID NO: 122238 - DNA, 20 bp, human
ggccagctcttggttcggtg

SEQ ID NO: 122239 - DNA, 20 bp, human
gagggtaaagcctctggtca

SEQ ID NO: 122240 - DNA, 20 bp, human
gacaatgaaaccttgaccag

SEQ ID NO: 122241 - DNA, 20 bp, human
ggcagacccgccagctgatg

SEQ ID NO: 122242 - DNA, 20 bp, human
ggccccaccgaaccaagagc

SEQ ID NO: 122243 - DNA, 20 bp, human
gtgctggtagattatctcat

SEQ ID NO: 122244 - DNA, 20 bp, human
ggaggacaggatagcgcagt

SEQ ID NO: 122245 - DNA, 20 bp, human
ggatgatcctggccagctct

SEQ ID NO: 122246 - DNA, 20 bp, human
gcctaggagaatgaaataag

SEQ ID NO: 122247 - DNA, 20 bp, human
ggaggatgaacctgtcgtgt

SEQ ID NO: 122248 - DNA, 20 bp, human
gtcactcttatttgaaatca

SEQ ID NO: 122249 - DNA, 20 bp, human
gatttgaaatcatggaaaat

SEQ ID NO: 122250 - DNA, 20 bp, human
gacccaggagccaacacgac

SEQ ID NO: 122251 - DNA, 20 bp, human
gacctgtcgtgttggctcct

SEQ ID NO: 122252 - DNA, 20 bp, human
ggctcctgggtgcagctgac

SEQ ID NO: 122253 - DNA, 20 bp, human
gatgagggaattgccaaaca

SEQ ID NO: 122254 - DNA, 20 bp, human
gactcagaaccatcatgaag

SEQ ID NO: 122255 - DNA, 20 bp, human
gcagggtagcaacagcctgc

SEQ ID NO: 122256 - DNA, 20 bp, human
ggtgggaaaagatgcccaag

SEQ ID NO: 122257 - DNA, 20 bp, human
gaactaagccatgggaagat

SEQ ID NO: 122258 - DNA, 20 bp, human
gttcagatggtggcagccat

SEQ ID NO: 122259 - DNA, 20 bp, human
gcagtgaacaactaagccat

SEQ ID NO: 122260 - DNA, 20 bp, human
gtggttcacccatcttccca

SEQ ID NO: 122261 - DNA, 20 bp, human
gctcttctctgcagttatgg

SEQ ID NO: 122262 - DNA, 20 bp, human
gggtgtgaagtccagcgtcc

SEQ ID NO: 122263 - DNA, 20 bp, human
ggaagaggacaaggtcagtc

SEQ ID NO: 122264 - DNA, 20 bp, human
ggatggagtgattcagatgg

SEQ ID NO: 122265 - DNA, 20 bp, human
gatagatggagtgattcaga

SEQ ID NO: 122266 - DNA, 20 bp, human
gacaaggtcagcagtactgt

SEQ ID NO: 122267 - DNA, 20 bp, human
gaaccgagccatggagacgt

SEQ ID NO: 122268 - DNA, 20 bp, human
ggtgaagaccgccataacca

SEQ ID NO: 122269 - DNA, 20 bp, human
gcgccataaccacggagaag

SEQ ID NO: 122270 - DNA, 20 bp, human
gtggttcacccacgtctcca

SEQ ID NO: 122271 - DNA, 20 bp, human
gaggagcaacaaccgagcca

SEQ ID NO: 122272 - DNA, 20 bp, human
ggaccttgtcctcttctccg

SEQ ID NO: 122273 - DNA, 20 bp, human
gcacccacgtctccatggct

SEQ ID NO: 122274 - DNA, 20 bp, human
gaagccatcgattatcccaa

SEQ ID NO: 122275 - DNA, 20 bp, human
gatcgatggcttgatccaga

SEQ ID NO: 122276 - DNA, 20 bp, human
gggaggtagatgatgataca

SEQ ID NO: 122277 - DNA, 20 bp, human
gagatgatgatacaaggata

SEQ ID NO: 122278 - DNA, 20 bp, human
gtgtatgaagctgggaatcc

SEQ ID NO: 122279 - DNA, 20 bp, human
gcatctttagacatagatgt

SEQ ID NO: 122280 - DNA, 20 bp, human
gatagctgtaaaacgatcat

SEQ ID NO: 122281 - DNA, 20 bp, human
gtcagttgagtgccttctcc

SEQ ID NO: 122282 - DNA, 20 bp, human
gggttgtgaaacatagatct

SEQ ID NO: 122283 - DNA, 20 bp, human
gcagatgctggtcaacttgt

SEQ ID NO: 122284 - DNA, 20 bp, human
gctcctccttttctcactct

SEQ ID NO: 122285 - DNA, 20 bp, human
ggatggcgacaactcctgac

SEQ ID NO: 122286 - DNA, 20 bp, human
gtagagatggatggaaccaa

SEQ ID NO: 122287 - DNA, 20 bp, human
gggtcactgacaccaagccc

SEQ ID NO: 122288 - DNA, 20 bp, human
gtgaccgaccccatctggag

SEQ ID NO: 122289 - DNA, 20 bp, human
gtcggtcagagaatcccagt

SEQ ID NO: 122290 - DNA, 20 bp, human
ggatcaggatgaccacaaag

SEQ ID NO: 122291 - DNA, 20 bp, human
gaagaggatcctctccagat

SEQ ID NO: 122292 - DNA, 20 bp, human
gaaggttgtagagcagctgg

SEQ ID NO: 122293 - DNA, 20 bp, human
ggaatcccagtaggatgaaa

SEQ ID NO: 122294 - DNA, 20 bp, human
gcttgcagatagccacacac

SEQ ID NO: 122295 - DNA, 20 bp, human
ggttgcctacgagggtcagg

SEQ ID NO: 122296 - DNA, 20 bp, human
gtgctgggagccatagaaaa

SEQ ID NO: 122297 - DNA, 20 bp, human
ggaagcagagaacatcccca

SEQ ID NO: 122298 - DNA, 20 bp, human
ggctcccagcaccaagaggg

SEQ ID NO: 122299 - DNA, 20 bp, human
gcagaagtaaggctgtcaca

SEQ ID NO: 122300 - DNA, 20 bp, human
gggtagagctctgtcagtat

SEQ ID NO: 122301 - DNA, 20 bp, human
gagggttattgaagagatgg

SEQ ID NO: 122302 - DNA, 20 bp, human
gagctcttaaggaagttcca

SEQ ID NO: 122303 - DNA, 20 bp, human
gatgctgtcttcagttccat

SEQ ID NO: 122304 - DNA, 20 bp, human
gatggctcccagcaccaaga

SEQ ID NO: 122305 - DNA, 20 bp, human
gagtaaggctgtcacaaggc

SEQ ID NO: 122306 - DNA, 20 bp, human
gggaggcgatagccagggtc

SEQ ID NO: 122307 - DNA, 20 bp, human
gagcttgtgctcagtatagg

SEQ ID NO: 122308 - DNA, 20 bp, human
ggtgcatgatggccatgtag

SEQ ID NO: 122309 - DNA, 20 bp, human
gcagacaggcaaaaggccat

SEQ ID NO: 122310 - DNA, 20 bp, human
gccccaggaggcgatagcca

SEQ ID NO: 122311 - DNA, 20 bp, human
ggccagggtctggcagagat

SEQ ID NO: 122312 - DNA, 20 bp, human
gctggtgttgaaacttccca

SEQ ID NO: 122313 - DNA, 20 bp, human
gtgtagcttgtgctcagtat

SEQ ID NO: 122314 - DNA, 20 bp, human
gtgcctgtctgaacagcaga

SEQ ID NO: 122315 - DNA, 20 bp, human
gaaaggttgatcaggagctg

SEQ ID NO: 122316 - DNA, 20 bp, human
gtaagtacaggatactgcag

SEQ ID NO: 122317 - DNA, 20 bp, human
gaggaagaacagctgaacta

SEQ ID NO: 122318 - DNA, 20 bp, human
gtatggcaagaagcctgcat

SEQ ID NO: 122319 - DNA, 20 bp, human
ggcaagaagcctgcatgggg

SEQ ID NO: 122320 - DNA, 20 bp, human
gcctggcgtctcataagtac

SEQ ID NO: 122321 - DNA, 20 bp, human
gtcttggggatggtgaccat

SEQ ID NO: 122322 - DNA, 20 bp, human
ggctgcaccacctccatagg

SEQ ID NO: 122323 - DNA, 20 bp, human
gcccaccagaatgaagtctg

SEQ ID NO: 122324 - DNA, 20 bp, human
ggcaccacctccataggagg

SEQ ID NO: 122325 - DNA, 20 bp, human
gaaggtgccacctcctatgg

SEQ ID NO: 122326 - DNA, 20 bp, human
gcccctgaccgtgaccaggt

SEQ ID NO: 122327 - DNA, 20 bp, human
gagccagaatctggggccaa

SEQ ID NO: 122328 - DNA, 20 bp, human
gttccattggccccagattc

SEQ ID NO: 122329 - DNA, 20 bp, human
gactcatgcagccagaatct

SEQ ID NO: 122330 - DNA, 20 bp, human
gccggcagatggccaggaat

SEQ ID NO: 122331 - DNA, 20 bp, human
gggagacgactcaacattga

SEQ ID NO: 122332 - DNA, 20 bp, human
ggttgcccctgaccgtgacc

SEQ ID NO: 122333 - DNA, 20 bp, human
ggcaagcgtgcagttccctg

SEQ ID NO: 122334 - DNA, 20 bp, human
gcctatcagtgctggatgtt

SEQ ID NO: 122335 - DNA, 20 bp, human
gctctttgcctacctggtca

SEQ ID NO: 122336 - DNA, 20 bp, human
gtaaggacatgtcccagcag

SEQ ID NO: 122337 - DNA, 20 bp, human
ggtccatcccagccagaagg

SEQ ID NO: 122338 - DNA, 20 bp, human
gctggcagatggccaggagt

SEQ ID NO: 122339 - DNA, 20 bp, human
ggccagaagctgggaccaat

SEQ ID NO: 122340 - DNA, 20 bp, human
gtcagcaacagcggtcctat

SEQ ID NO: 122341 - DNA, 20 bp, human
gggctccatgagtttctgta

SEQ ID NO: 122342 - DNA, 20 bp, human
gatgtccttacagaaactca

SEQ ID NO: 122343 - DNA, 20 bp, human
ggcagtccatcccagccaga

SEQ ID NO: 122344 - DNA, 20 bp, human
gtgggagaggcaggcgtcat

SEQ ID NO: 122345 - DNA, 20 bp, human
gcctatctggtcacaactgg

SEQ ID NO: 122346 - DNA, 20 bp, human
gtaaggacatgtcccagcag

SEQ ID NO: 122347 - DNA, 20 bp, human
gtcagcaacagcggtcctat

SEQ ID NO: 122348 - DNA, 20 bp, human
ggccagaagctgggaccaat

SEQ ID NO: 122349 - DNA, 20 bp, human
gacagtccagaggatgttgg

SEQ ID NO: 122350 - DNA, 20 bp, human
ggtccatcccagccagaagg

SEQ ID NO: 122351 - DNA, 20 bp, human
gatgtccttacagaaactca

SEQ ID NO: 122352 - DNA, 20 bp, human
gcgcagccaccaacatcctc

SEQ ID NO: 122353 - DNA, 20 bp, human
gctggcagatggccaggagt

SEQ ID NO: 122354 - DNA, 20 bp, human
gcctatctggtcacaactgg

SEQ ID NO: 122355 - DNA, 20 bp, human
gtgggagaggcaggcgtcat

SEQ ID NO: 122356 - DNA, 20 bp, human
gtcggagcctacaaacaaaa

SEQ ID NO: 122357 - DNA, 20 bp, human
gatggccatgtatcgatcat

SEQ ID NO: 122358 - DNA, 20 bp, human
gtggtgatcaattcatgaag

SEQ ID NO: 122359 - DNA, 20 bp, human
gttctgaaggtgttggactc

SEQ ID NO: 122360 - DNA, 20 bp, human
gatggcctatgatcgataca

SEQ ID NO: 122361 - DNA, 20 bp, human
gcactgacccttttgtttgt

SEQ ID NO: 122362 - DNA, 20 bp, human
gcagaaccctgaggggcaaa

SEQ ID NO: 122363 - DNA, 20 bp, human
ggatggtcactatgataagc

SEQ ID NO: 122364 - DNA, 20 bp, human
gacattcttactaatctaca

SEQ ID NO: 122365 - DNA, 20 bp, human
ggactgaatttatcctctta

SEQ ID NO: 122366 - DNA, 20 bp, human
gcattagggagcccaaggag

SEQ ID NO: 122367 - DNA, 20 bp, human
ggacatggcagtggaatata

SEQ ID NO: 122368 - DNA, 20 bp, human
ggcatccataagtgacaagt

SEQ ID NO: 122369 - DNA, 20 bp, human
gcataagtgacaagtaggca

SEQ ID NO: 122370 - DNA, 20 bp, human
gagtagtcacccaaatgagg

SEQ ID NO: 122371 - DNA, 20 bp, human
gtcatttgggtgactactat

SEQ ID NO: 122372 - DNA, 20 bp, human
gtcatagaacacttacttgg

SEQ ID NO: 122373 - DNA, 20 bp, human
ggcagaggtcttccttttgg

SEQ ID NO: 122374 - DNA, 20 bp, human
ggtgggaaacctcctcattt

SEQ ID NO: 122375 - DNA, 20 bp, human
gtgacccatgcaagctgaca

SEQ ID NO: 122376 - DNA, 20 bp, human
gtatcgagcacattttcggt

SEQ ID NO: 122377 - DNA, 20 bp, human
gtttcccccagattgatttc

SEQ ID NO: 122378 - DNA, 20 bp, human
gagcagctgtaaagaataca

SEQ ID NO: 122379 - DNA, 20 bp, human
gcacattttcggtgggtcag

SEQ ID NO: 122380 - DNA, 20 bp, human
gtctttatcgagcacatttt

SEQ ID NO: 122381 - DNA, 20 bp, human
gtgataaccaaataatgcaa

SEQ ID NO: 122382 - DNA, 20 bp, human
gtttacctataaaacaaggg

SEQ ID NO: 122383 - DNA, 20 bp, human
gtaaagaatacatggagcca

SEQ ID NO: 122384 - DNA, 20 bp, human
gaagcctgaaatcaatctgg

SEQ ID NO: 122385 - DNA, 20 bp, human
gattctgtgtgaagcccaag

SEQ ID NO: 122386 - DNA, 20 bp, human
gctgtaacgaaatagtgatc

SEQ ID NO: 122387 - DNA, 20 bp, human
gtttctcccaagttaattgt

SEQ ID NO: 122388 - DNA, 20 bp, human
ggtgagagctcagggaaaca

SEQ ID NO: 122389 - DNA, 20 bp, human
gtatcagaggtgagagctca

SEQ ID NO: 122390 - DNA, 20 bp, human
gaaatacattggggaaccca

SEQ ID NO: 122391 - DNA, 20 bp, human
gtggcccatgcaaccttgga

SEQ ID NO: 122392 - DNA, 20 bp, human
gaaaagactatttccttcca

SEQ ID NO: 122393 - DNA, 20 bp, human
ggggaacctgctcattgtgg

SEQ ID NO: 122394 - DNA, 20 bp, human
gataagcctacaattaactt

SEQ ID NO: 122395 - DNA, 20 bp, human
gatttccttccaaggttgca

SEQ ID NO: 122396 - DNA, 20 bp, human
gcaccaaggacaggcagcta

SEQ ID NO: 122397 - DNA, 20 bp, human
gccaccgtggcaaggtacac

SEQ ID NO: 122398 - DNA, 20 bp, human
gactgatctccaccaaggac

SEQ ID NO: 122399 - DNA, 20 bp, human
ggagatctgtcttctctgag

SEQ ID NO: 122400 - DNA, 20 bp, human
gaggccattgcccaccaccg

SEQ ID NO: 122401 - DNA, 20 bp, human
ggaataactgatctccacca

SEQ ID NO: 122402 - DNA, 20 bp, human
gtgacaaaagccccccagcc

SEQ ID NO: 122403 - DNA, 20 bp, human
gatgaatttaggggcgatag

SEQ ID NO: 122404 - DNA, 20 bp, human
gtgactgagttgattttcac

SEQ ID NO: 122405 - DNA, 20 bp, human
gaagtctatgatgaatttag

SEQ ID NO: 122406 - DNA, 20 bp, human
gtgatggttgggtaacgcaa

SEQ ID NO: 122407 - DNA, 20 bp, human
gattaacacaggatcccttg

SEQ ID NO: 122408 - DNA, 20 bp, human
gctgctggctcatgatggtt

SEQ ID NO: 122409 - DNA, 20 bp, human
gtatccaggcaagaacaatc

SEQ ID NO: 122410 - DNA, 20 bp, human
ggcatccacaattaatctag

SEQ ID NO: 122411 - DNA, 20 bp, human
gatactgttaggattaacac

SEQ ID NO: 122412 - DNA, 20 bp, human
gtgcctgaattcatactgtt

SEQ ID NO: 122413 - DNA, 20 bp, human
gtgtattaaagaccctatcc

SEQ ID NO: 122414 - DNA, 20 bp, human
gattaactagttctaatctg

SEQ ID NO: 122415 - DNA, 20 bp, human
gatcctaacagtatgaattc

SEQ ID NO: 122416 - DNA, 20 bp, human
gtgcattctcctggtggcag

SEQ ID NO: 122417 - DNA, 20 bp, human
gatcacccacactacataga

SEQ ID NO: 122418 - DNA, 20 bp, human
gcttacacagaaccccataa

SEQ ID NO: 122419 - DNA, 20 bp, human
gacgtgactttctccattat

SEQ ID NO: 122420 - DNA, 20 bp, human
gtaatggttgtgtagttcag

SEQ ID NO: 122421 - DNA, 20 bp, human
gagcctgtgcattctcctgg

SEQ ID NO: 122422 - DNA, 20 bp, human
gctcctggtggcagtggcct

SEQ ID NO: 122423 - DNA, 20 bp, human
gatggccacatagcagtcac

SEQ ID NO: 122424 - DNA, 20 bp, human
ggtcacgtttgtagtatttt

SEQ ID NO: 122425 - DNA, 20 bp, human
gcacccaggccactgccacc

SEQ ID NO: 122426 - DNA, 20 bp, human
gcatgggggatctcagtgat

SEQ ID NO: 122427 - DNA, 20 bp, human
gtctacatcaacgccatgat

SEQ ID NO: 122428 - DNA, 20 bp, human
gacatgctgcttcatgacgg

SEQ ID NO: 122429 - DNA, 20 bp, human
gcgccatgtatttcaaatga

SEQ ID NO: 122430 - DNA, 20 bp, human
gtgacggtggtatagtgcaa

SEQ ID NO: 122431 - DNA, 20 bp, human
gtgggagtgtcatgggtagg

SEQ ID NO: 122432 - DNA, 20 bp, human
gctgctagtgggagtgtcat

SEQ ID NO: 122433 - DNA, 20 bp, human
gtagtgggagtgtcatgggt

SEQ ID NO: 122434 - DNA, 20 bp, human
gagcttaggggtattgacag

SEQ ID NO: 122435 - DNA, 20 bp, human
ggaatctgtgatcagcttag

SEQ ID NO: 122436 - DNA, 20 bp, human
gatcatagtcattaacaagt

SEQ ID NO: 122437 - DNA, 20 bp, human
ggcacgcatccaggaaggac

SEQ ID NO: 122438 - DNA, 20 bp, human
gtagtctgcaattaggacaa

SEQ ID NO: 122439 - DNA, 20 bp, human
ggatggtttttgtcacatag

SEQ ID NO: 122440 - DNA, 20 bp, human
gagatgagaagcacgcatcc

SEQ ID NO: 122441 - DNA, 20 bp, human
ggactatacatgatccctgt

SEQ ID NO: 122442 - DNA, 20 bp, human
gtcatgtatagtctgcaatt

SEQ ID NO: 122443 - DNA, 20 bp, human
ggagtctacaatcatctttg

SEQ ID NO: 122444 - DNA, 20 bp, human
gtctacattgcaactgttgg

SEQ ID NO: 122445 - DNA, 20 bp, human
gcacttctttgctggggtgg

SEQ ID NO: 122446 - DNA, 20 bp, human
gattctgcttggattgacac

SEQ ID NO: 122447 - DNA, 20 bp, human
gaggggttatggaagtagag

SEQ ID NO: 122448 - DNA, 20 bp, human
ggagaggcaagtatcagata

SEQ ID NO: 122449 - DNA, 20 bp, human
gggcatccacaatcattcta

SEQ ID NO: 122450 - DNA, 20 bp, human
ggtcaacagccgtgaggatg

SEQ ID NO: 122451 - DNA, 20 bp, human
gcatgaccatcataagccag

SEQ ID NO: 122452 - DNA, 20 bp, human
ggatgaggatgaagatctcc

SEQ ID NO: 122453 - DNA, 20 bp, human
gcagacccactggcttatga

SEQ ID NO: 122454 - DNA, 20 bp, human
ggacatgggatgaaaagact

SEQ ID NO: 122455 - DNA, 20 bp, human
gtctacttgggaacactgtt

SEQ ID NO: 122456 - DNA, 20 bp, human
ggggctctcacagaactcag

SEQ ID NO: 122457 - DNA, 20 bp, human
gagtattgcctataaagaca

SEQ ID NO: 122458 - DNA, 20 bp, human
gacacaggggaagccagcgt

SEQ ID NO: 122459 - DNA, 20 bp, human
gaatagaactaattgcatgg

SEQ ID NO: 122460 - DNA, 20 bp, human
gggtatgtccatagattcca

SEQ ID NO: 122461 - DNA, 20 bp, human
gtggccaggaaaaaatacac

SEQ ID NO: 122462 - DNA, 20 bp, human
gtcagtgaccttggaatcta

SEQ ID NO: 122463 - DNA, 20 bp, human
ggaataaaaggtgtcaataa

SEQ ID NO: 122464 - DNA, 20 bp, human
gttgctgactcattgtatga

SEQ ID NO: 122465 - DNA, 20 bp, human
gtgtggcaacatgctcattg

SEQ ID NO: 122466 - DNA, 20 bp, human
gcctgccaatgtgatcaagt

SEQ ID NO: 122467 - DNA, 20 bp, human
gcagttctggattgtgagtg

SEQ ID NO: 122468 - DNA, 20 bp, human
ggacggaaaagagtacatgg

SEQ ID NO: 122469 - DNA, 20 bp, human
gatgcagccattgaaggata

SEQ ID NO: 122470 - DNA, 20 bp, human
gatcacctacttgatcacat

SEQ ID NO: 122471 - DNA, 20 bp, human
gtaatagaattcatactgct

SEQ ID NO: 122472 - DNA, 20 bp, human
gacaagaatttctgcagttc

SEQ ID NO: 122473 - DNA, 20 bp, human
gaagtcaaagttcattttag

SEQ ID NO: 122474 - DNA, 20 bp, human
ggatgatgactgagatgaac

SEQ ID NO: 122475 - DNA, 20 bp, human
gtaggacggaaaagagtaca

SEQ ID NO: 122476 - DNA, 20 bp, human
ggaatgtgtgatcaggttag

SEQ ID NO: 122477 - DNA, 20 bp, human
gataaaggagagataggcca

SEQ ID NO: 122478 - DNA, 20 bp, human
gcattcactctatggaaaga

SEQ ID NO: 122479 - DNA, 20 bp, human
gatgacagagtttgttttgc

SEQ ID NO: 122480 - DNA, 20 bp, human
gaatcatcatgagaaataca

SEQ ID NO: 122481 - DNA, 20 bp, human
gatagagtgaatgtgtgatc

SEQ ID NO: 122482 - DNA, 20 bp, human
ggtgggatatgtgctcattg

SEQ ID NO: 122483 - DNA, 20 bp, human
gtcccccatgtacctttccc

SEQ ID NO: 122484 - DNA, 20 bp, human
gtagcagggcacacacacac

SEQ ID NO: 122485 - DNA, 20 bp, human
gtgggagtggtgtggatggg

SEQ ID NO: 122486 - DNA, 20 bp, human
ggagtctgaccaaagtccag

SEQ ID NO: 122487 - DNA, 20 bp, human
ggcagcagggggctcaacaa

SEQ ID NO: 122488 - DNA, 20 bp, human
gcaagaaagagaggatctgt

SEQ ID NO: 122489 - DNA, 20 bp, human
gagaaggagtgcaagctata

SEQ ID NO: 122490 - DNA, 20 bp, human
gcccccgcaggaaaacctaa

SEQ ID NO: 122491 - DNA, 20 bp, human
gactttggtcagactcctgt

SEQ ID NO: 122492 - DNA, 20 bp, human
ggaccagaaaatatgcatct

SEQ ID NO: 122493 - DNA, 20 bp, human
gtaaggcattacttccaaaa

SEQ ID NO: 122494 - DNA, 20 bp, human
gaagactggtaagtaaaggg

SEQ ID NO: 122495 - DNA, 20 bp, human
gcagtaagtgagtaacaaac

SEQ ID NO: 122496 - DNA, 20 bp, human
ggaaccacagaacaccacac

SEQ ID NO: 122497 - DNA, 20 bp, human
gtgatggtgacataccggag

SEQ ID NO: 122498 - DNA, 20 bp, human
gggtctgtgaaaaccctaag

SEQ ID NO: 122499 - DNA, 20 bp, human
gaacgtgggggaagatccta

SEQ ID NO: 122500 - DNA, 20 bp, human
gtttctctgtaggaacgtgg

SEQ ID NO: 122501 - DNA, 20 bp, human
gcacccaggcggctactacc

SEQ ID NO: 122502 - DNA, 20 bp, human
gggcctggtagtagccgcct

SEQ ID NO: 122503 - DNA, 20 bp, human
gatacctgtgtggtgttctg

SEQ ID NO: 122504 - DNA, 20 bp, human
ggacagtcccacctcccaaa

SEQ ID NO: 122505 - DNA, 20 bp, human
gccctggtaggagatcgtct

SEQ ID NO: 122506 - DNA, 20 bp, human
ggagatggaaaactgcacca

SEQ ID NO: 122507 - DNA, 20 bp, human
gccagtgctttcacatgaca

SEQ ID NO: 122508 - DNA, 20 bp, human
gcttggcctgacccagaatc

SEQ ID NO: 122509 - DNA, 20 bp, human
ggaggatgattgaatggaga

SEQ ID NO: 122510 - DNA, 20 bp, human
gtgagtgaagcaatgattga

SEQ ID NO: 122511 - DNA, 20 bp, human
gaagctcacttcccgattct

SEQ ID NO: 122512 - DNA, 20 bp, human
ggtattttctctttcggtga

SEQ ID NO: 122513 - DNA, 20 bp, human
gtgtatgtgacaactttgct

SEQ ID NO: 122514 - DNA, 20 bp, human
gcacttcccgattctgggtc

SEQ ID NO: 122515 - DNA, 20 bp, human
gatggcattggatcgatatg

SEQ ID NO: 122516 - DNA, 20 bp, human
gtctctgcctcttggatggg

SEQ ID NO: 122517 - DNA, 20 bp, human
ggtctgccccaccaaggagg

SEQ ID NO: 122518 - DNA, 20 bp, human
gtgtgaccatcatgagtaga

SEQ ID NO: 122519 - DNA, 20 bp, human
gtcatctctgcctcttggat

SEQ ID NO: 122520 - DNA, 20 bp, human
gactttaggagcagttgtgg

SEQ ID NO: 122521 - DNA, 20 bp, human
gcaagaccaaactctggtct

SEQ ID NO: 122522 - DNA, 20 bp, human
gatgcagcttgtataggata

SEQ ID NO: 122523 - DNA, 20 bp, human
gaagagaaaacatgattcaa

SEQ ID NO: 122524 - DNA, 20 bp, human
gaagactttaggagcagttg

SEQ ID NO: 122525 - DNA, 20 bp, human
gaacatgattcaatggagtt

SEQ ID NO: 122526 - DNA, 20 bp, human
ggaaacagggaacctcacgt

SEQ ID NO: 122527 - DNA, 20 bp, human
gagccagctggacaatagag

SEQ ID NO: 122528 - DNA, 20 bp, human
gtgacggtgacatagcggag

SEQ ID NO: 122529 - DNA, 20 bp, human
gccgagtctgcgagagcccc

SEQ ID NO: 122530 - DNA, 20 bp, human
ggaacactcagctctgggtg

SEQ ID NO: 122531 - DNA, 20 bp, human
ggggctggtggtagccacct

SEQ ID NO: 122532 - DNA, 20 bp, human
gaaagtctgatacccacgtg

SEQ ID NO: 122533 - DNA, 20 bp, human
gatcagactttgtcttcctg

SEQ ID NO: 122534 - DNA, 20 bp, human
ggttcatgacggtgacatag

SEQ ID NO: 122535 - DNA, 20 bp, human
gcattagaaacaggaaacgc

SEQ ID NO: 122536 - DNA, 20 bp, human
gtccaccaaaggaaatggta

SEQ ID NO: 122537 - DNA, 20 bp, human
gcttgatgcctccaatgaag

SEQ ID NO: 122538 - DNA, 20 bp, human
gtttgctggattcatctggt

SEQ ID NO: 122539 - DNA, 20 bp, human
gggaagagtagcaaaagtcc

SEQ ID NO: 122540 - DNA, 20 bp, human
gagcgtgtagtgcaggggct

SEQ ID NO: 122541 - DNA, 20 bp, human
gtgctggttgacttgctctc

SEQ ID NO: 122542 - DNA, 20 bp, human
gggcaggatttgttctactg

SEQ ID NO: 122543 - DNA, 20 bp, human
gagcatcctaggtgctgtga

SEQ ID NO: 122544 - DNA, 20 bp, human
gatacgccatgacagtcagc

SEQ ID NO: 122545 - DNA, 20 bp, human
ggttctactggggctctctc

SEQ ID NO: 122546 - DNA, 20 bp, human
ggcactatgtgaccatgatg

SEQ ID NO: 122547 - DNA, 20 bp, human
gtcgggaacgtgtaagttcc

SEQ ID NO: 122548 - DNA, 20 bp, human
ggtgaccatgatgaggaaag

SEQ ID NO: 122549 - DNA, 20 bp, human
gacccaagaagccaccacca

SEQ ID NO: 122550 - DNA, 20 bp, human
gcttcatcaaaggtaggacc

SEQ ID NO: 122551 - DNA, 20 bp, human
gcacattagtgtggttgatc

SEQ ID NO: 122552 - DNA, 20 bp, human
gaagagagtcatccccatca

SEQ ID NO: 122553 - DNA, 20 bp, human
gggttgatctggtccatgat

SEQ ID NO: 122554 - DNA, 20 bp, human
gaaagaggtgtgggtggcct

SEQ ID NO: 122555 - DNA, 20 bp, human
gctgcggaacaaatcagtcc

SEQ ID NO: 122556 - DNA, 20 bp, human
gtcgggactgagtaattccc

SEQ ID NO: 122557 - DNA, 20 bp, human
gcgatgcacaggcctcatcg

SEQ ID NO: 122558 - DNA, 20 bp, human
gtgagtgacacagccactga

SEQ ID NO: 122559 - DNA, 20 bp, human
ggaagatctatcaggacctt

SEQ ID NO: 122560 - DNA, 20 bp, human
gagaaatctgcgctatggag

SEQ ID NO: 122561 - DNA, 20 bp, human
gtatgaccatcatgagtagg

SEQ ID NO: 122562 - DNA, 20 bp, human
gtaagacctggctcagttct

SEQ ID NO: 122563 - DNA, 20 bp, human
ggcagatgtcaagaatagac

SEQ ID NO: 122564 - DNA, 20 bp, human
gtgagtagggggcgatgcac

SEQ ID NO: 122565 - DNA, 20 bp, human
gtgtcatgtacaccaaaaac

SEQ ID NO: 122566 - DNA, 20 bp, human
gcttgggactcactgataac

SEQ ID NO: 122567 - DNA, 20 bp, human
gcccccctaagctcattgaa

SEQ ID NO: 122568 - DNA, 20 bp, human
gctgtgcctaagatgttgga

SEQ ID NO: 122569 - DNA, 20 bp, human
gagcagaaagatctcggcac

SEQ ID NO: 122570 - DNA, 20 bp, human
ggtccattcaatgagcttag

SEQ ID NO: 122571 - DNA, 20 bp, human
gctcactgataaccgggtgc

SEQ ID NO: 122572 - DNA, 20 bp, human
gttgtctttgctctctggtt

SEQ ID NO: 122573 - DNA, 20 bp, human
gaaattcagtcactcttgtt

SEQ ID NO: 122574 - DNA, 20 bp, human
gaataaaggacagattgctc

SEQ ID NO: 122575 - DNA, 20 bp, human
gctctcatgttcatcacatt

SEQ ID NO: 122576 - DNA, 20 bp, human
gtggataaggccaatgatag

SEQ ID NO: 122577 - DNA, 20 bp, human
gtggagtctgaggcaatgaa

SEQ ID NO: 122578 - DNA, 20 bp, human
gatgggactcaccaactcac

SEQ ID NO: 122579 - DNA, 20 bp, human
gtagccacttcctctatcat

SEQ ID NO: 122580 - DNA, 20 bp, human
gagccaggaggaaatacatg

SEQ ID NO: 122581 - DNA, 20 bp, human
gaacctctcaatcattgata

SEQ ID NO: 122582 - DNA, 20 bp, human
gtacagtgaatacaatgaca

SEQ ID NO: 122583 - DNA, 20 bp, human
gatatcacaaatcatcttag

SEQ ID NO: 122584 - DNA, 20 bp, human
ggattgagaggttagccagg

SEQ ID NO: 122585 - DNA, 20 bp, human
gtgagtaatacatccccgaa

SEQ ID NO: 122586 - DNA, 20 bp, human
gtgggtctctctgattctca

SEQ ID NO: 122587 - DNA, 20 bp, human
gcctcattgggaccacagaa

SEQ ID NO: 122588 - DNA, 20 bp, human
gccacagaagggtaagtgca

SEQ ID NO: 122589 - DNA, 20 bp, human
ggtgcacggcaaaggccaac

SEQ ID NO: 122590 - DNA, 20 bp, human
gaagggtaagtgcacggcaa

SEQ ID NO: 122591 - DNA, 20 bp, human
gagtgaaacgaataactcta

SEQ ID NO: 122592 - DNA, 20 bp, human
gggccaactggctcaccgaa

SEQ ID NO: 122593 - DNA, 20 bp, human
gcaacataaataggaaggtc

SEQ ID NO: 122594 - DNA, 20 bp, human
gtgtgtggcaacgcatgtgt

SEQ ID NO: 122595 - DNA, 20 bp, human
gaaggagaaatatctgaaca

SEQ ID NO: 122596 - DNA, 20 bp, human
gtagtaagtctcactgagat

SEQ ID NO: 122597 - DNA, 20 bp, human
ggaggtgggtaagaaaacac

SEQ ID NO: 122598 - DNA, 20 bp, human
gccggacctggggaaagatg

SEQ ID NO: 122599 - DNA, 20 bp, human
ggtattataaaaaggaggga

SEQ ID NO: 122600 - DNA, 20 bp, human
gtaagaaaacaccggacctg

SEQ ID NO: 122601 - DNA, 20 bp, human
ggacttactataaggacata

SEQ ID NO: 122602 - DNA, 20 bp, human
ggctccaaaccaagtttcac

SEQ ID NO: 122603 - DNA, 20 bp, human
gcactggtattataaaaagg

SEQ ID NO: 122604 - DNA, 20 bp, human
gataccagtgaaacttggtt

SEQ ID NO: 122605 - DNA, 20 bp, human
gctcagtgagacttactata

SEQ ID NO: 122606 - DNA, 20 bp, human
gagtgaaacgaataactcta

SEQ ID NO: 122607 - DNA, 20 bp, human
gtgtgtggcaacgcatgtgt

SEQ ID NO: 122608 - DNA, 20 bp, human
gggccaactggctcaccgaa

SEQ ID NO: 122609 - DNA, 20 bp, human
gcaacataaataggaaggtc

SEQ ID NO: 122610 - DNA, 20 bp, human
gaactgcagaggctatttcc

SEQ ID NO: 122611 - DNA, 20 bp, human
gactacactacaattatgtg

SEQ ID NO: 122612 - DNA, 20 bp, human
gaaggagaaatatctgaaca

SEQ ID NO: 122613 - DNA, 20 bp, human
gtggctgtcgcatggggaat

SEQ ID NO: 122614 - DNA, 20 bp, human
gagatcaatgagtgagaggt

SEQ ID NO: 122615 - DNA, 20 bp, human
gtggtgatcctcatagccat

SEQ ID NO: 122616 - DNA, 20 bp, human
gggcattatggctgtcacat

SEQ ID NO: 122617 - DNA, 20 bp, human
ggtgcacggcaaacgccaac

SEQ ID NO: 122618 - DNA, 20 bp, human
gccgtgcacttactcttctg

SEQ ID NO: 122619 - DNA, 20 bp, human
gctcttctgtggtcccaatg

SEQ ID NO: 122620 - DNA, 20 bp, human
gagtgaaacgaataactcta

SEQ ID NO: 122621 - DNA, 20 bp, human
gcaacataaataggaaggtc

SEQ ID NO: 122622 - DNA, 20 bp, human
gcgccaactggctcaccgaa

SEQ ID NO: 122623 - DNA, 20 bp, human
gtgtgtggcaacgcatgtgt

SEQ ID NO: 122624 - DNA, 20 bp, human
gctgggtctctctgattctc

SEQ ID NO: 122625 - DNA, 20 bp, human
gtacaaaaaacaacataaat

SEQ ID NO: 122626 - DNA, 20 bp, human
ggagttgtcacagccgacag

SEQ ID NO: 122627 - DNA, 20 bp, human
gtcacagccgacagaggcaa

SEQ ID NO: 122628 - DNA, 20 bp, human
ggatgaagccaatcactctg

SEQ ID NO: 122629 - DNA, 20 bp, human
gccgcgagtcagagagtccc

SEQ ID NO: 122630 - DNA, 20 bp, human
ggaccatcatgaacccacaa

SEQ ID NO: 122631 - DNA, 20 bp, human
ggactgtaaacgagggtcag

SEQ ID NO: 122632 - DNA, 20 bp, human
gtcagagaccacagagtgat

SEQ ID NO: 122633 - DNA, 20 bp, human
gcatgggggactgtaaacga

SEQ ID NO: 122634 - DNA, 20 bp, human
gcttcatccattgcctctgt

SEQ ID NO: 122635 - DNA, 20 bp, human
gctctcatgctaactgaaag

SEQ ID NO: 122636 - DNA, 20 bp, human
gtaattgtactgtagtgcag

SEQ ID NO: 122637 - DNA, 20 bp, human
gtaactgaatattggataca

SEQ ID NO: 122638 - DNA, 20 bp, human
gcagtacaattatgaaccgg

SEQ ID NO: 122639 - DNA, 20 bp, human
ggtacataggagagttcaaa

SEQ ID NO: 122640 - DNA, 20 bp, human
gaagtctacaagcatcttgg

SEQ ID NO: 122641 - DNA, 20 bp, human
gctacagtacaattatgaac

SEQ ID NO: 122642 - DNA, 20 bp, human
gtttttaggtaactgaatat

SEQ ID NO: 122643 - DNA, 20 bp, human
gctgtgaagaacgaatatct

SEQ ID NO: 122644 - DNA, 20 bp, human
gaaaaattacacagagcctc

SEQ ID NO: 122645 - DNA, 20 bp, human
gaagaaaagttgaagtcccc

SEQ ID NO: 122646 - DNA, 20 bp, human
gtagcccagtgagcacccgt

SEQ ID NO: 122647 - DNA, 20 bp, human
gtgatggtcatgtaatggag

SEQ ID NO: 122648 - DNA, 20 bp, human
gagcacccgtgggctcatga

SEQ ID NO: 122649 - DNA, 20 bp, human
gtgggataaagttgacgata

SEQ ID NO: 122650 - DNA, 20 bp, human
ggcaaaccattcagtggtat

SEQ ID NO: 122651 - DNA, 20 bp, human
gaaattccgataccactgaa

SEQ ID NO: 122652 - DNA, 20 bp, human
gcgtaagaccatctcatggt

SEQ ID NO: 122653 - DNA, 20 bp, human
ggctcatgatggtcatgtaa

SEQ ID NO: 122654 - DNA, 20 bp, human
ggtgtgaaggagcgaatcaa

SEQ ID NO: 122655 - DNA, 20 bp, human
gtgcacaaatccaactgcat

SEQ ID NO: 122656 - DNA, 20 bp, human
gacaccaaggaatagttctg

SEQ ID NO: 122657 - DNA, 20 bp, human
ggccactcccaagatgatca

SEQ ID NO: 122658 - DNA, 20 bp, human
ggtgcactccatcagtcaag

SEQ ID NO: 122659 - DNA, 20 bp, human
gtggcagacttgcatcaggc

SEQ ID NO: 122660 - DNA, 20 bp, human
ggagttggcagacttgcatc

SEQ ID NO: 122661 - DNA, 20 bp, human
gtctgtgggtccattgcctc

SEQ ID NO: 122662 - DNA, 20 bp, human
gtgctggcttcatgggtcgt

SEQ ID NO: 122663 - DNA, 20 bp, human
ggtacataggggaggagtgc

SEQ ID NO: 122664 - DNA, 20 bp, human
gagaaggttacccagcataa

SEQ ID NO: 122665 - DNA, 20 bp, human
gtccctgatcatcttgggag

SEQ ID NO: 122666 - DNA, 20 bp, human
gtcattcatcgattttggaa

SEQ ID NO: 122667 - DNA, 20 bp, human
gcagacacatacatagcaat

SEQ ID NO: 122668 - DNA, 20 bp, human
gaatgagacaaatcattctc

SEQ ID NO: 122669 - DNA, 20 bp, human
gatttcttttgatgcctgcc

SEQ ID NO: 122670 - DNA, 20 bp, human
gttgtctcattcatcgattt

SEQ ID NO: 122671 - DNA, 20 bp, human
gcagttaatgaagtgagcat

SEQ ID NO: 122672 - DNA, 20 bp, human
ggtgtgaaggcgggaatctg

SEQ ID NO: 122673 - DNA, 20 bp, human
gagatgaacaaagaaaatct

SEQ ID NO: 122674 - DNA, 20 bp, human
gctgggactgtctagttcaa

SEQ ID NO: 122675 - DNA, 20 bp, human
gtctttgttcatctcttcac

SEQ ID NO: 122676 - DNA, 20 bp, human
gccaagagcgagctgtagga

SEQ ID NO: 122677 - DNA, 20 bp, human
gagagcgagctgtaggatgg

SEQ ID NO: 122678 - DNA, 20 bp, human
gtcatccaagagcgagctgt

SEQ ID NO: 122679 - DNA, 20 bp, human
gttactgggtggggttgaaa

SEQ ID NO: 122680 - DNA, 20 bp, human
gatggtactgttggtctcca

SEQ ID NO: 122681 - DNA, 20 bp, human
gttctccttcacttactggg

SEQ ID NO: 122682 - DNA, 20 bp, human
gttcagaatcaccttagggg

SEQ ID NO: 122683 - DNA, 20 bp, human
ggaaaagatcactcatacca

SEQ ID NO: 122684 - DNA, 20 bp, human
gctcttctcggttatctatg

SEQ ID NO: 122685 - DNA, 20 bp, human
gatttttcactcatactcca

SEQ ID NO: 122686 - DNA, 20 bp, human
ggaatcaagacaatggatgt

SEQ ID NO: 122687 - DNA, 20 bp, human
gtgcctatgaatcaagacaa

SEQ ID NO: 122688 - DNA, 20 bp, human
ggaaatacataggagagtgt

SEQ ID NO: 122689 - DNA, 20 bp, human
ggtgtgtgttgctctcgtgg

SEQ ID NO: 122690 - DNA, 20 bp, human
gtggtggcttcctggattat

SEQ ID NO: 122691 - DNA, 20 bp, human
gcaggtgtgtgttgctctcg

SEQ ID NO: 122692 - DNA, 20 bp, human
gacataggagagtgtaggtg

SEQ ID NO: 122693 - DNA, 20 bp, human
ggcttctgtcattagtcccc

SEQ ID NO: 122694 - DNA, 20 bp, human
gctcagttccagtgaaaagg

SEQ ID NO: 122695 - DNA, 20 bp, human
gattgcaatatacctatcaa

SEQ ID NO: 122696 - DNA, 20 bp, human
ggataagtccaattcttcag

SEQ ID NO: 122697 - DNA, 20 bp, human
gtgatgaccacatagtataa

SEQ ID NO: 122698 - DNA, 20 bp, human
ggaagaattggacttatcca

SEQ ID NO: 122699 - DNA, 20 bp, human
gcgaaggacatgcactgtct

SEQ ID NO: 122700 - DNA, 20 bp, human
gagtttgcagcttggaacca

SEQ ID NO: 122701 - DNA, 20 bp, human
gtgtggtcatcatgagccga

SEQ ID NO: 122702 - DNA, 20 bp, human
gatgcagccactgaaagata

SEQ ID NO: 122703 - DNA, 20 bp, human
gtgtttcgatggcctatgac

SEQ ID NO: 122704 - DNA, 20 bp, human
gtctgaaacaactctaaagg

SEQ ID NO: 122705 - DNA, 20 bp, human
gtcagacaccactgaagaat

SEQ ID NO: 122706 - DNA, 20 bp, human
gtgagccacaagctgctaaa

SEQ ID NO: 122707 - DNA, 20 bp, human
gacagtagcaccgtagatca

SEQ ID NO: 122708 - DNA, 20 bp, human
gctaggattttttggacgat

SEQ ID NO: 122709 - DNA, 20 bp, human
ggttcattgttaaaactatc

SEQ ID NO: 122710 - DNA, 20 bp, human
gacaagaccatctctgtgtg

SEQ ID NO: 122711 - DNA, 20 bp, human
gatcttgggtgttgtggcag

SEQ ID NO: 122712 - DNA, 20 bp, human
gcgatactttcatggataat

SEQ ID NO: 122713 - DNA, 20 bp, human
gaaacccctttagcagcttg

SEQ ID NO: 122714 - DNA, 20 bp, human
gatgatcatcttgggtgttg

SEQ ID NO: 122715 - DNA, 20 bp, human
gcctttctgagttgagtaaa

SEQ ID NO: 122716 - DNA, 20 bp, human
gggcctatcccagactcggg

SEQ ID NO: 122717 - DNA, 20 bp, human
gactctagataaatgctatg

SEQ ID NO: 122718 - DNA, 20 bp, human
gagttggacctcccgagtct

SEQ ID NO: 122719 - DNA, 20 bp, human
gtgtgcaatgcatccaccaa

SEQ ID NO: 122720 - DNA, 20 bp, human
gccttatcatttgcaccatc

SEQ ID NO: 122721 - DNA, 20 bp, human
gattcatgatggtagcatag

SEQ ID NO: 122722 - DNA, 20 bp, human
gcactggcctatcccagact

SEQ ID NO: 122723 - DNA, 20 bp, human
gagaggaagataatttcctt

SEQ ID NO: 122724 - DNA, 20 bp, human
gtcggcagatagcagcatag

SEQ ID NO: 122725 - DNA, 20 bp, human
ggacctcccgagtctgggat

SEQ ID NO: 122726 - DNA, 20 bp, human
gtcggcagatagcagtgtag

SEQ ID NO: 122727 - DNA, 20 bp, human
gggcctatcccagactccag

SEQ ID NO: 122728 - DNA, 20 bp, human
gaaagcagtgatataactct

SEQ ID NO: 122729 - DNA, 20 bp, human
gatagcagtgtagaggtcaa

SEQ ID NO: 122730 - DNA, 20 bp, human
gagttggacctctggagtct

SEQ ID NO: 122731 - DNA, 20 bp, human
gggaagataatttcttttga

SEQ ID NO: 122732 - DNA, 20 bp, human
ggacctctggagtctgggat

SEQ ID NO: 122733 - DNA, 20 bp, human
gaagtctatgagcatttcag

SEQ ID NO: 122734 - DNA, 20 bp, human
gcttcttcttacactttgct

SEQ ID NO: 122735 - DNA, 20 bp, human
gcataggagaggtcagatga

SEQ ID NO: 122736 - DNA, 20 bp, human
gcattgcatagcaggttcta

SEQ ID NO: 122737 - DNA, 20 bp, human
ggagctgaatatcttgagac

SEQ ID NO: 122738 - DNA, 20 bp, human
gttctagggttcatgacagt

SEQ ID NO: 122739 - DNA, 20 bp, human
gtgacagtaggatagtgcag

SEQ ID NO: 122740 - DNA, 20 bp, human
gagtaggatagtgcagaggc

SEQ ID NO: 122741 - DNA, 20 bp, human
gtaaaactagcacaaagacc

SEQ ID NO: 122742 - DNA, 20 bp, human
ggtactgcaggccagggaaa

SEQ ID NO: 122743 - DNA, 20 bp, human
ggattatcttcttcgcagag

SEQ ID NO: 122744 - DNA, 20 bp, human
gttctcgctttccatttccc

SEQ ID NO: 122745 - DNA, 20 bp, human
gagactgggtcagaccaagg

SEQ ID NO: 122746 - DNA, 20 bp, human
gtgacagttgaacagtgcag

SEQ ID NO: 122747 - DNA, 20 bp, human
gagttgaacagtgcagaggc

SEQ ID NO: 122748 - DNA, 20 bp, human
gtcttttattgatattctac

SEQ ID NO: 122749 - DNA, 20 bp, human
gaataaaagagtttattttc

SEQ ID NO: 122750 - DNA, 20 bp, human
gatttccagggaggatgata

SEQ ID NO: 122751 - DNA, 20 bp, human
gagactgagtcagaccaagg

SEQ ID NO: 122752 - DNA, 20 bp, human
gttgagactgagtcagacca

SEQ ID NO: 122753 - DNA, 20 bp, human
gagatagaataatataaatg

SEQ ID NO: 122754 - DNA, 20 bp, human
gagttcttgaactaaacaca

SEQ ID NO: 122755 - DNA, 20 bp, human
gggattactccttgttgtga

SEQ ID NO: 122756 - DNA, 20 bp, human
gagttgagcatcttgagact

SEQ ID NO: 122757 - DNA, 20 bp, human
ggaattctgtcaccactgtg

SEQ ID NO: 122758 - DNA, 20 bp, human
gggctacttgtacaatggaa

SEQ ID NO: 122759 - DNA, 20 bp, human
gataagggctacttgtacaa

SEQ ID NO: 122760 - DNA, 20 bp, human
ggcctgctatgcattatcgt

SEQ ID NO: 122761 - DNA, 20 bp, human
gtgatggttgaatagtgtaa

SEQ ID NO: 122762 - DNA, 20 bp, human
gtgagtgatgcagcttctat

SEQ ID NO: 122763 - DNA, 20 bp, human
gtgcattatcgttggttctg

SEQ ID NO: 122764 - DNA, 20 bp, human
gaaaggccatcacaacgagg

SEQ ID NO: 122765 - DNA, 20 bp, human
gggttgaatagtgtaaaggc

SEQ ID NO: 122766 - DNA, 20 bp, human
ggcactttgtttattctctt

SEQ ID NO: 122767 - DNA, 20 bp, human
ggtggatgtgtagcaaaggt

SEQ ID NO: 122768 - DNA, 20 bp, human
gcactgtggatgtgtagcaa

SEQ ID NO: 122769 - DNA, 20 bp, human
ggcaaaggtcggagagtgag

SEQ ID NO: 122770 - DNA, 20 bp, human
gggagagtgagaggtaattg

SEQ ID NO: 122771 - DNA, 20 bp, human
gaaattaatggttgacttac

SEQ ID NO: 122772 - DNA, 20 bp, human
gctacaccattattatgagc

SEQ ID NO: 122773 - DNA, 20 bp, human
gcatgggttggtgaatgagc

SEQ ID NO: 122774 - DNA, 20 bp, human
gtagagatcttcattctcac

SEQ ID NO: 122775 - DNA, 20 bp, human
gttttgcctgctcataataa

SEQ ID NO: 122776 - DNA, 20 bp, human
gtggcacagtaacacagctc

SEQ ID NO: 122777 - DNA, 20 bp, human
gtgactgtaaggtagcgcaa

SEQ ID NO: 122778 - DNA, 20 bp, human
gatacataggagattggagc

SEQ ID NO: 122779 - DNA, 20 bp, human
gctgggggttcatgactgta

SEQ ID NO: 122780 - DNA, 20 bp, human
gagtaacacagctcaggcat

SEQ ID NO: 122781 - DNA, 20 bp, human
gatgtttttgctgacagtca

SEQ ID NO: 122782 - DNA, 20 bp, human
ggcaggcaagaaccaaccaa

SEQ ID NO: 122783 - DNA, 20 bp, human
gcagctcccaagaagatgat

SEQ ID NO: 122784 - DNA, 20 bp, human
gctgggcctatcatcttctt

SEQ ID NO: 122785 - DNA, 20 bp, human
gcaaccaaaggcatagctgg

SEQ ID NO: 122786 - DNA, 20 bp, human
gatcagggcagataatccat

SEQ ID NO: 122787 - DNA, 20 bp, human
gtcagtgccaccaaagaagt

SEQ ID NO: 122788 - DNA, 20 bp, human
gggcagctgaaccgtgagga

SEQ ID NO: 122789 - DNA, 20 bp, human
gatcctgcagaccctcctca

SEQ ID NO: 122790 - DNA, 20 bp, human
ggacagtgagcacatgaaag

SEQ ID NO: 122791 - DNA, 20 bp, human
gcgctagcaggccacacttc

SEQ ID NO: 122792 - DNA, 20 bp, human
gaaaaggcagctgaaccgtg

SEQ ID NO: 122793 - DNA, 20 bp, human
gcacttccggcaatccatga

SEQ ID NO: 122794 - DNA, 20 bp, human
gctgcactacacagccatca

SEQ ID NO: 122795 - DNA, 20 bp, human
gtcttgggtatggtagtgga

SEQ ID NO: 122796 - DNA, 20 bp, human
gtgttattagggacgtgggt

SEQ ID NO: 122797 - DNA, 20 bp, human
gtgcaacatgcaccccacat

SEQ ID NO: 122798 - DNA, 20 bp, human
gaaaatgttattagggacgt

SEQ ID NO: 122799 - DNA, 20 bp, human
gtattagggacgtgggtagg

SEQ ID NO: 122800 - DNA, 20 bp, human
gtggaatgggtcaagttctt

SEQ ID NO: 122801 - DNA, 20 bp, human
gtatatgaccatcatgaacc

SEQ ID NO: 122802 - DNA, 20 bp, human
gacaaactttctcaatctct

SEQ ID NO: 122803 - DNA, 20 bp, human
gatcataggccattacagta

SEQ ID NO: 122804 - DNA, 20 bp, human
gaacaggtcaacaatcatct

SEQ ID NO: 122805 - DNA, 20 bp, human
gcatgtctcccggttcatga

SEQ ID NO: 122806 - DNA, 20 bp, human
gtgatggccatgtagtgcaa

SEQ ID NO: 122807 - DNA, 20 bp, human
gctcctcgtgaggatagcat

SEQ ID NO: 122808 - DNA, 20 bp, human
ggggcctgctgcattctgtt

SEQ ID NO: 122809 - DNA, 20 bp, human
ggggagctggaaaatcagga

SEQ ID NO: 122810 - DNA, 20 bp, human
gtcatgaaccagcgaatgtg

SEQ ID NO: 122811 - DNA, 20 bp, human
ggccccatgctatcctcacg

SEQ ID NO: 122812 - DNA, 20 bp, human
gtgaggatagcatggggcgg

SEQ ID NO: 122813 - DNA, 20 bp, human
gaatgtgtggtctcctcgtg

SEQ ID NO: 122814 - DNA, 20 bp, human
ggaggagaccacacattcgc

SEQ ID NO: 122815 - DNA, 20 bp, human
gcaggatggtcaccacaatg

SEQ ID NO: 122816 - DNA, 20 bp, human
gttgtaggaatagcatgggt

SEQ ID NO: 122817 - DNA, 20 bp, human
gtgatggtggtgtagctgag

SEQ ID NO: 122818 - DNA, 20 bp, human
gacctgccagttcatgatgg

SEQ ID NO: 122819 - DNA, 20 bp, human
ggagtagcagatctccatga

SEQ ID NO: 122820 - DNA, 20 bp, human
ggtactttctcccaaccagg

SEQ ID NO: 122821 - DNA, 20 bp, human
ggcaaaccctctgcacctcc

SEQ ID NO: 122822 - DNA, 20 bp, human
gagatctgagatgagtttgg

SEQ ID NO: 122823 - DNA, 20 bp, human
gcatcaagaggcagcaattt

SEQ ID NO: 122824 - DNA, 20 bp, human
gcatgacagtgagcacaatg

SEQ ID NO: 122825 - DNA, 20 bp, human
ggttgtgtatgttagccaag

SEQ ID NO: 122826 - DNA, 20 bp, human
ggcactagaagaagtttcag

SEQ ID NO: 122827 - DNA, 20 bp, human
gttcttaaagtgaaagggaa

SEQ ID NO: 122828 - DNA, 20 bp, human
gagacagagccctccttgca

SEQ ID NO: 122829 - DNA, 20 bp, human
gggtgtatctcagaggattg

SEQ ID NO: 122830 - DNA, 20 bp, human
gagtttcaggggcattgaac

SEQ ID NO: 122831 - DNA, 20 bp, human
gggcatcccaaccaagaaga

SEQ ID NO: 122832 - DNA, 20 bp, human
gatcccaaccaagaagaagg

SEQ ID NO: 122833 - DNA, 20 bp, human
ggaaagggaagggaagaacc

SEQ ID NO: 122834 - DNA, 20 bp, human
gtgtcagagttgcccaaata

SEQ ID NO: 122835 - DNA, 20 bp, human
gaccaggagcatgctcttaa

SEQ ID NO: 122836 - DNA, 20 bp, human
gaaaatacagatgcttgtgt

SEQ ID NO: 122837 - DNA, 20 bp, human
gaggcattggatgaaatttc

SEQ ID NO: 122838 - DNA, 20 bp, human
ggattgaggtgtatctcaga

SEQ ID NO: 122839 - DNA, 20 bp, human
gtcctgggcaaagcaggcat

SEQ ID NO: 122840 - DNA, 20 bp, human
gggcatcccaaccaagaaga

SEQ ID NO: 122841 - DNA, 20 bp, human
gatcccaaccaagaagaagg

SEQ ID NO: 122842 - DNA, 20 bp, human
gtgtcagagttgcccaaata

SEQ ID NO: 122843 - DNA, 20 bp, human
gtgtgtgcatattctagccc

SEQ ID NO: 122844 - DNA, 20 bp, human
gtggacatgattcattcata

SEQ ID NO: 122845 - DNA, 20 bp, human
gcagagggttgtggatggct

SEQ ID NO: 122846 - DNA, 20 bp, human
ggggatggagaaccaaatgt

SEQ ID NO: 122847 - DNA, 20 bp, human
gctcaacatggtaggaaggg

SEQ ID NO: 122848 - DNA, 20 bp, human
gtctatcctcactagcaaca

SEQ ID NO: 122849 - DNA, 20 bp, human
gcaggtacatgaggcaaatg

SEQ ID NO: 122850 - DNA, 20 bp, human
ggtgggcatgttccagtcct

SEQ ID NO: 122851 - DNA, 20 bp, human
gactaagagaatgctcctaa

SEQ ID NO: 122852 - DNA, 20 bp, human
gagaaggaaaagcttgactt

SEQ ID NO: 122853 - DNA, 20 bp, human
ggcattaggtgaaattccca

SEQ ID NO: 122854 - DNA, 20 bp, human
gtatcttaagggattgtgaa

SEQ ID NO: 122855 - DNA, 20 bp, human
gtacatgaggcaaatgggga

SEQ ID NO: 122856 - DNA, 20 bp, human
gggccacatagtgtatccac

SEQ ID NO: 122857 - DNA, 20 bp, human
gtaccggtggatacactatg

SEQ ID NO: 122858 - DNA, 20 bp, human
ggagtcatagcgttaggagt

SEQ ID NO: 122859 - DNA, 20 bp, human
ggaatggaagcatatctcaa

SEQ ID NO: 122860 - DNA, 20 bp, human
gaaggggctgcagtaatatt

SEQ ID NO: 122861 - DNA, 20 bp, human
gctggcaggcacagacctca

SEQ ID NO: 122862 - DNA, 20 bp, human
gaacgctatgactctagtat

SEQ ID NO: 122863 - DNA, 20 bp, human
gtcaggttccctcctggcaa

SEQ ID NO: 122864 - DNA, 20 bp, human
gtatctcaaaggattgcgga

SEQ ID NO: 122865 - DNA, 20 bp, human
ggaaatctgatctttaccgg

SEQ ID NO: 122866 - DNA, 20 bp, human
ggaagccagtcagcaagaag

SEQ ID NO: 122867 - DNA, 20 bp, human
gtgccatccgcacaccactg

SEQ ID NO: 122868 - DNA, 20 bp, human
ggcactgttgttataccaca

SEQ ID NO: 122869 - DNA, 20 bp, human
gtgttgttataccacatggt

SEQ ID NO: 122870 - DNA, 20 bp, human
ggactgggggtactgatgag

SEQ ID NO: 122871 - DNA, 20 bp, human
ggttgtacctcagtggtgtg

SEQ ID NO: 122872 - DNA, 20 bp, human
gcgagtgatgaacataggac

SEQ ID NO: 122873 - DNA, 20 bp, human
gtacctcagtggtgtgcgga

SEQ ID NO: 122874 - DNA, 20 bp, human
gattcccgagtgatgaacat

SEQ ID NO: 122875 - DNA, 20 bp, human
ggtctagcagcaggacaccc

SEQ ID NO: 122876 - DNA, 20 bp, human
gaacccaggatgtcgtccag

SEQ ID NO: 122877 - DNA, 20 bp, human
gtgccgctggacgacatcct

SEQ ID NO: 122878 - DNA, 20 bp, human
gcgagtattagtaagtacag

SEQ ID NO: 122879 - DNA, 20 bp, human
gagaggactcccagcaccgt

SEQ ID NO: 122880 - DNA, 20 bp, human
gtacagaggtatatctaaga

SEQ ID NO: 122881 - DNA, 20 bp, human
gaccagtcaataggaaggga

SEQ ID NO: 122882 - DNA, 20 bp, human
ggcctggaaaaccagtcaat

SEQ ID NO: 122883 - DNA, 20 bp, human
gagaatgccagactcgagaa

SEQ ID NO: 122884 - DNA, 20 bp, human
gcttggaggaagctcatcac

SEQ ID NO: 122885 - DNA, 20 bp, human
gtactcgagtagtgaagatt

SEQ ID NO: 122886 - DNA, 20 bp, human
gggtgtgcgggtattgacaa

SEQ ID NO: 122887 - DNA, 20 bp, human
gtgggtgttggtcaggatag

SEQ ID NO: 122888 - DNA, 20 bp, human
gcatggagaaggcacatcac

SEQ ID NO: 122889 - DNA, 20 bp, human
gccaagaagtatggagatgt

SEQ ID NO: 122890 - DNA, 20 bp, human
gagtgtaggcgaacaactat

SEQ ID NO: 122891 - DNA, 20 bp, human
ggtgccattgccaagaagta

SEQ ID NO: 122892 - DNA, 20 bp, human
gtgcgggtattgacaagggc

SEQ ID NO: 122893 - DNA, 20 bp, human
gacacccaggtaatgaagat

SEQ ID NO: 122894 - DNA, 20 bp, human
ggatagaggtatatcttaag

SEQ ID NO: 122895 - DNA, 20 bp, human
gtgttggcagctacagacct

SEQ ID NO: 122896 - DNA, 20 bp, human
gtgatagggaccaagagctg

SEQ ID NO: 122897 - DNA, 20 bp, human
gcttctgcatacaaaatcca

SEQ ID NO: 122898 - DNA, 20 bp, human
ggggtctaggaaagtagaaa

SEQ ID NO: 122899 - DNA, 20 bp, human
ggagaggactaggtcaatag

SEQ ID NO: 122900 - DNA, 20 bp, human
gacaatggtcaggttaccca

SEQ ID NO: 122901 - DNA, 20 bp, human
gctccacggctgacagagca

SEQ ID NO: 122902 - DNA, 20 bp, human
gacacgaatgatgaggacaa

SEQ ID NO: 122903 - DNA, 20 bp, human
gtcatttagttgtggctcag

SEQ ID NO: 122904 - DNA, 20 bp, human
gggaaaagactggccatctt

SEQ ID NO: 122905 - DNA, 20 bp, human
gtgtatgccttggccaccct

SEQ ID NO: 122906 - DNA, 20 bp, human
ggaggaagactggacaaagg

SEQ ID NO: 122907 - DNA, 20 bp, human
gctggaggaagactggacaa

SEQ ID NO: 122908 - DNA, 20 bp, human
gcctgccagacctcttctgg

SEQ ID NO: 122909 - DNA, 20 bp, human
gctgatgtgaatgaggacag

SEQ ID NO: 122910 - DNA, 20 bp, human
gtaggaagcccctgactcaa

SEQ ID NO: 122911 - DNA, 20 bp, human
gccagaagtgggagatgtgt

SEQ ID NO: 122912 - DNA, 20 bp, human
gcctgaccagggaggtccaa

SEQ ID NO: 122913 - DNA, 20 bp, human
gcccctgccagcctccagat

SEQ ID NO: 122914 - DNA, 20 bp, human
ggctgtgaagaaccagaagt

SEQ ID NO: 122915 - DNA, 20 bp, human
gtgcactcacctcaaccgta

SEQ ID NO: 122916 - DNA, 20 bp, human
ggagctgaaaggccaattcc

SEQ ID NO: 122917 - DNA, 20 bp, human
gctgaaaggccaattcctgg

SEQ ID NO: 122918 - DNA, 20 bp, human
ggtgagttagcaccaccacc

SEQ ID NO: 122919 - DNA, 20 bp, human
gtagcaccaccaccaggaat

SEQ ID NO: 122920 - DNA, 20 bp, human
gggccgagcttgcaaatatg

SEQ ID NO: 122921 - DNA, 20 bp, human
gtcactgtgtcttcagggtg

SEQ ID NO: 122922 - DNA, 20 bp, human
gcaggaaatacgtagagaat

SEQ ID NO: 122923 - DNA, 20 bp, human
ggtgaggaaattactccctg

SEQ ID NO: 122924 - DNA, 20 bp, human
gagacttattccagcctgac

SEQ ID NO: 122925 - DNA, 20 bp, human
ggattagatgttggtatggt

SEQ ID NO: 122926 - DNA, 20 bp, human
gggaatgccggtcaacaaga

SEQ ID NO: 122927 - DNA, 20 bp, human
gtgccggtcaacaagaaggt

SEQ ID NO: 122928 - DNA, 20 bp, human
gccagacatgggcagactct

SEQ ID NO: 122929 - DNA, 20 bp, human
gctgcaaaaccaggacacca

SEQ ID NO: 122930 - DNA, 20 bp, human
gggctatcagccactgatct

SEQ ID NO: 122931 - DNA, 20 bp, human
gcatgggcagactctaggcc

SEQ ID NO: 122932 - DNA, 20 bp, human
gggacaaatgctgcaaaacc

SEQ ID NO: 122933 - DNA, 20 bp, human
gttcacgtgcctcaaaccag

SEQ ID NO: 122934 - DNA, 20 bp, human
gaatggtagtgtacctcaga

SEQ ID NO: 122935 - DNA, 20 bp, human
gttccaaccttcttgttgac

SEQ ID NO: 122936 - DNA, 20 bp, human
gattattgaggaccgacata

SEQ ID NO: 122937 - DNA, 20 bp, human
gagagacggcaacaacatat

SEQ ID NO: 122938 - DNA, 20 bp, human
gatcacttgtaacatctctc

SEQ ID NO: 122939 - DNA, 20 bp, human
gatggaggctccgttcacag

SEQ ID NO: 122940 - DNA, 20 bp, human
gccgtgtagaaagaacatct

SEQ ID NO: 122941 - DNA, 20 bp, human
gtcaaaccagaagacaccaa

SEQ ID NO: 122942 - DNA, 20 bp, human
ggggatggagatccagtact

SEQ ID NO: 122943 - DNA, 20 bp, human
gatagtacataggcttatgg

SEQ ID NO: 122944 - DNA, 20 bp, human
gatggagatccagtactggg

SEQ ID NO: 122945 - DNA, 20 bp, human
ggcatttaggttgatttctc

SEQ ID NO: 122946 - DNA, 20 bp, human
gggacggtggagtcatgcag

SEQ ID NO: 122947 - DNA, 20 bp, human
gtacatgggtccatggagag

SEQ ID NO: 122948 - DNA, 20 bp, human
gaagcccgtcaggaagaaag

SEQ ID NO: 122949 - DNA, 20 bp, human
gatacatgcaggtgtcagga

SEQ ID NO: 122950 - DNA, 20 bp, human
gctccattgaagacaaggtg

SEQ ID NO: 122951 - DNA, 20 bp, human
gacgtagcggtcaatggaca

SEQ ID NO: 122952 - DNA, 20 bp, human
ggggcagtgtggaaaggcaa

SEQ ID NO: 122953 - DNA, 20 bp, human
ggcagggatgccaatctctc

SEQ ID NO: 122954 - DNA, 20 bp, human
gtcaggtagatgaagcagaa

SEQ ID NO: 122955 - DNA, 20 bp, human
ggaatatagaatgagattcc

SEQ ID NO: 122956 - DNA, 20 bp, human
ggggatgccactcagcagga

SEQ ID NO: 122957 - DNA, 20 bp, human
gcagtagcacagaggactcg

SEQ ID NO: 122958 - DNA, 20 bp, human
gtcattgtgtgaggagacaa

SEQ ID NO: 122959 - DNA, 20 bp, human
gaaagatgcccaggactgta

SEQ ID NO: 122960 - DNA, 20 bp, human
gggaaacatagtgcaagggg

SEQ ID NO: 122961 - DNA, 20 bp, human
ggactgtagggagagtgcaa

SEQ ID NO: 122962 - DNA, 20 bp, human
gatcctgccaatgactgtgt

SEQ ID NO: 122963 - DNA, 20 bp, human
ggtgcatgcgctccagccca

SEQ ID NO: 122964 - DNA, 20 bp, human
gatcccagggtcattgtgtg

SEQ ID NO: 122965 - DNA, 20 bp, human
gaatggaaacatagtgcaag

SEQ ID NO: 122966 - DNA, 20 bp, human
gatacaaacaggcctcacct

SEQ ID NO: 122967 - DNA, 20 bp, human
gaatcagggcaacccaggtg

SEQ ID NO: 122968 - DNA, 20 bp, human
ggcacagtgacatagcgtaa

SEQ ID NO: 122969 - DNA, 20 bp, human
gcagcaacactccagctgac

SEQ ID NO: 122970 - DNA, 20 bp, human
gtccagctgacaggcattcc

SEQ ID NO: 122971 - DNA, 20 bp, human
ggtatattggctatgggtct

SEQ ID NO: 122972 - DNA, 20 bp, human
gcccaggaatgcctgtcagc

SEQ ID NO: 122973 - DNA, 20 bp, human
gccattgagacccagcatgg

SEQ ID NO: 122974 - DNA, 20 bp, human
gagtatgcctgactccatga

SEQ ID NO: 122975 - DNA, 20 bp, human
ggcattcctgggatacaaac

SEQ ID NO: 122976 - DNA, 20 bp, human
gtgctggaggacaagaaatc

SEQ ID NO: 122977 - DNA, 20 bp, human
gccatagcaaaacaaactta

SEQ ID NO: 122978 - DNA, 20 bp, human
gaccagggataccagtcagg

SEQ ID NO: 122979 - DNA, 20 bp, human
gagtcaggaggaagaatgca

SEQ ID NO: 122980 - DNA, 20 bp, human
gcagaaggttcggagtacag

SEQ ID NO: 122981 - DNA, 20 bp, human
gggcagtgtggccatggata

SEQ ID NO: 122982 - DNA, 20 bp, human
gactgaaggacaacatggac

SEQ ID NO: 122983 - DNA, 20 bp, human
gagtgatgttgcgggcattg

SEQ ID NO: 122984 - DNA, 20 bp, human
gcacagttgcatagcgcaag

SEQ ID NO: 122985 - DNA, 20 bp, human
gagaatacctgattccatca

SEQ ID NO: 122986 - DNA, 20 bp, human
ggtctcagtagcaaaggtgt

SEQ ID NO: 122987 - DNA, 20 bp, human
gcagtccaggaaaacccctc

SEQ ID NO: 122988 - DNA, 20 bp, human
gaacccctcaggataaatat

SEQ ID NO: 122989 - DNA, 20 bp, human
gactgttggtgaggatggtg

SEQ ID NO: 122990 - DNA, 20 bp, human
gggtggggtagtgcagtgga

SEQ ID NO: 122991 - DNA, 20 bp, human
gatggtgggaagtgtagaca

SEQ ID NO: 122992 - DNA, 20 bp, human
gcataacacagcaagcatgg

SEQ ID NO: 122993 - DNA, 20 bp, human
gaattactcaaagtcactat

SEQ ID NO: 122994 - DNA, 20 bp, human
gcaaagtcactatgggagac

SEQ ID NO: 122995 - DNA, 20 bp, human
gaatgaacatactccagtcc

SEQ ID NO: 122996 - DNA, 20 bp, human
ggaccgaatacctcagaggg

SEQ ID NO: 122997 - DNA, 20 bp, human
gtaatgaccgaatacctcag

SEQ ID NO: 122998 - DNA, 20 bp, human
gcatgggtgtgtgcagacga

SEQ ID NO: 122999 - DNA, 20 bp, human
ggacatcatgaggagcactg

SEQ ID NO: 123000 - DNA, 20 bp, human
ggggctaaactgagtaatgt

SEQ ID NO: 123001 - DNA, 20 bp, human
gagctggtgagatagaatat

SEQ ID NO: 123002 - DNA, 20 bp, human
gttgaggactgagcgaatat

SEQ ID NO: 123003 - DNA, 20 bp, human
ggcggtcaaaggacatcatg

SEQ ID NO: 123004 - DNA, 20 bp, human
gcacagccccaggtcagtga

SEQ ID NO: 123005 - DNA, 20 bp, human
gattggactgacattcctcg

SEQ ID NO: 123006 - DNA, 20 bp, human
ggattcaggatcttcactca

SEQ ID NO: 123007 - DNA, 20 bp, human
gcataaaggagaatccatga

SEQ ID NO: 123008 - DNA, 20 bp, human
ggtcaacggacatagccagg

SEQ ID NO: 123009 - DNA, 20 bp, human
ggtgagacccaggtccgtca

SEQ ID NO: 123010 - DNA, 20 bp, human
gactgtgggtagggtggtga

SEQ ID NO: 123011 - DNA, 20 bp, human
gtgactaacaccacacaaga

SEQ ID NO: 123012 - DNA, 20 bp, human
gtgcatgactgtgggtaggg

SEQ ID NO: 123013 - DNA, 20 bp, human
gctctgtgcgaatgacagtg

SEQ ID NO: 123014 - DNA, 20 bp, human
gggtgtagagacagcagacg

SEQ ID NO: 123015 - DNA, 20 bp, human
gtcatcctcacggacatccc

SEQ ID NO: 123016 - DNA, 20 bp, human
ggacatggcgagcaagacag

SEQ ID NO: 123017 - DNA, 20 bp, human
gaggattccacgttgaactc

SEQ ID NO: 123018 - DNA, 20 bp, human
gctgcagggcaatgatccag

SEQ ID NO: 123019 - DNA, 20 bp, human
gcaggttccagagttcaacg

SEQ ID NO: 123020 - DNA, 20 bp, human
gatctgtagaaggcaggctg

SEQ ID NO: 123021 - DNA, 20 bp, human
gatggccagtgcccgatcaa

SEQ ID NO: 123022 - DNA, 20 bp, human
gagtgcccgatcaatggaca

SEQ ID NO: 123023 - DNA, 20 bp, human
ggaaggtagacagcaatgag

SEQ ID NO: 123024 - DNA, 20 bp, human
gtgcccaccagcaagaaggt

SEQ ID NO: 123025 - DNA, 20 bp, human
ggaggaagaagtgcattggg

SEQ ID NO: 123026 - DNA, 20 bp, human
gcccagggaatgcagtgagg

SEQ ID NO: 123027 - DNA, 20 bp, human
gggatagtagcatagttcag

SEQ ID NO: 123028 - DNA, 20 bp, human
gacagtgggaagggtcgtaa

SEQ ID NO: 123029 - DNA, 20 bp, human
gcaggatggtcctggtgata

SEQ ID NO: 123030 - DNA, 20 bp, human
gtattgaatattgccatggt

SEQ ID NO: 123031 - DNA, 20 bp, human
gtcctcggtgctggtagcca

SEQ ID NO: 123032 - DNA, 20 bp, human
gatggtcctggtgatagggc

SEQ ID NO: 123033 - DNA, 20 bp, human
ggctttaaagctgatctccc

SEQ ID NO: 123034 - DNA, 20 bp, human
gttgctggagtcctcggtgc

SEQ ID NO: 123035 - DNA, 20 bp, human
gctgtttcccaagagggcaa

SEQ ID NO: 123036 - DNA, 20 bp, human
gggatggaggaataacgtag

SEQ ID NO: 123037 - DNA, 20 bp, human
gccggtcaaaggccatagtg

SEQ ID NO: 123038 - DNA, 20 bp, human
gcccatgcacaggtcagtga

SEQ ID NO: 123039 - DNA, 20 bp, human
gcccagcactgtgtacacag

SEQ ID NO: 123040 - DNA, 20 bp, human
gtgggctcactataataggt

SEQ ID NO: 123041 - DNA, 20 bp, human
gctggaattagtcaggatgg

SEQ ID NO: 123042 - DNA, 20 bp, human
gaaattgggctcactataat

SEQ ID NO: 123043 - DNA, 20 bp, human
gcatggagcagcaatacccc

SEQ ID NO: 123044 - DNA, 20 bp, human
gagtggacagccccatgcac

SEQ ID NO: 123045 - DNA, 20 bp, human
gccatggatgaaataggact

SEQ ID NO: 123046 - DNA, 20 bp, human
ggcattatgccaaagatgct

SEQ ID NO: 123047 - DNA, 20 bp, human
gctactagtgtcaacacaga

SEQ ID NO: 123048 - DNA, 20 bp, human
gctgcacagattctaggcct

SEQ ID NO: 123049 - DNA, 20 bp, human
gtgagataaatggcacagaa

SEQ ID NO: 123050 - DNA, 20 bp, human
gcattgcagggtatagagtc

SEQ ID NO: 123051 - DNA, 20 bp, human
gggaactatggtcgtactca

SEQ ID NO: 123052 - DNA, 20 bp, human
gtatctgaatgacaagctgg

SEQ ID NO: 123053 - DNA, 20 bp, human
gctagcaagtgcaatgtctg

SEQ ID NO: 123054 - DNA, 20 bp, human
gccagcactgcacagattct

SEQ ID NO: 123055 - DNA, 20 bp, human
gtcctatctgaatgacaagc

SEQ ID NO: 123056 - DNA, 20 bp, human
gagatatttagcaggttgag

SEQ ID NO: 123057 - DNA, 20 bp, human
gtattctagtagttaaaaca

SEQ ID NO: 123058 - DNA, 20 bp, human
ggccaagtctagtattccat

SEQ ID NO: 123059 - DNA, 20 bp, human
gacccatggaatactagact

SEQ ID NO: 123060 - DNA, 20 bp, human
gaaataaatgcaaagagatt

SEQ ID NO: 123061 - DNA, 20 bp, human
gcaacctgctaaatatcttc

SEQ ID NO: 123062 - DNA, 20 bp, human
gaaagcatgtcttgggccca

SEQ ID NO: 123063 - DNA, 20 bp, human
gtactagacttggctttagc

SEQ ID NO: 123064 - DNA, 20 bp, human
gtgttagatgattaagttat

SEQ ID NO: 123065 - DNA, 20 bp, human
gttcttttaaagcatgtctt

SEQ ID NO: 123066 - DNA, 20 bp, human
gggacttggggtgacactca

SEQ ID NO: 123067 - DNA, 20 bp, human
gagactgagccattgaatgt

SEQ ID NO: 123068 - DNA, 20 bp, human
gagatggtggcatgtctcaa

SEQ ID NO: 123069 - DNA, 20 bp, human
ggtcagtgcagtgttggatt

SEQ ID NO: 123070 - DNA, 20 bp, human
gaaggaaggtattataagaa

SEQ ID NO: 123071 - DNA, 20 bp, human
gatttgatgagccctaagga

SEQ ID NO: 123072 - DNA, 20 bp, human
gtctggagtcagtgcagtgt

SEQ ID NO: 123073 - DNA, 20 bp, human
gccaattagtataaacgcag

SEQ ID NO: 123074 - DNA, 20 bp, human
gctaattgggattcctggtc

SEQ ID NO: 123075 - DNA, 20 bp, human
gaggcatcaaaagaaatctc

SEQ ID NO: 123076 - DNA, 20 bp, human
gaagaagccttgggtgacac

SEQ ID NO: 123077 - DNA, 20 bp, human
gcatgacggccagcattgag

SEQ ID NO: 123078 - DNA, 20 bp, human
gttgatgcctgtgtcaccca

SEQ ID NO: 123079 - DNA, 20 bp, human
ggacagcaggatgtccatga

SEQ ID NO: 123080 - DNA, 20 bp, human
ggcactgttgtatatctcag

SEQ ID NO: 123081 - DNA, 20 bp, human
gggaaacagcatcctgatag

SEQ ID NO: 123082 - DNA, 20 bp, human
ggtgataagcctccaaccca

SEQ ID NO: 123083 - DNA, 20 bp, human
gatcaaaggccatggctaac

SEQ ID NO: 123084 - DNA, 20 bp, human
ggtccatatgatgtttgtgg

SEQ ID NO: 123085 - DNA, 20 bp, human
gcaggaaggacaaaaactgc

SEQ ID NO: 123086 - DNA, 20 bp, human
gagcaggctgttcccaagaa

SEQ ID NO: 123087 - DNA, 20 bp, human
gtacctcagtgggtagcata

SEQ ID NO: 123088 - DNA, 20 bp, human
gttctacctctgtgagtagg

SEQ ID NO: 123089 - DNA, 20 bp, human
gcggaaccagaagatagcta

SEQ ID NO: 123090 - DNA, 20 bp, human
gccaagaagggcggtgacat

SEQ ID NO: 123091 - DNA, 20 bp, human
gttcttctacctctgtgagt

SEQ ID NO: 123092 - DNA, 20 bp, human
gatccctgactcagagatga

SEQ ID NO: 123093 - DNA, 20 bp, human
gtttacagtaggcatagctg

SEQ ID NO: 123094 - DNA, 20 bp, human
gtgagtgatgcaacgatcca

SEQ ID NO: 123095 - DNA, 20 bp, human
gcgatgtcaccaggagctta

SEQ ID NO: 123096 - DNA, 20 bp, human
gagggcgctgcataaaatca

SEQ ID NO: 123097 - DNA, 20 bp, human
gggattgtgacatatcgcag

SEQ ID NO: 123098 - DNA, 20 bp, human
gtgagtgaggcagccatcaa

SEQ ID NO: 123099 - DNA, 20 bp, human
gtcctcacaagcaaggtcat

SEQ ID NO: 123100 - DNA, 20 bp, human
ggccagggccttaggcatgg

SEQ ID NO: 123101 - DNA, 20 bp, human
gagggccttaggcatggtgg

SEQ ID NO: 123102 - DNA, 20 bp, human
gcgccctcacctgtgccata

SEQ ID NO: 123103 - DNA, 20 bp, human
gggctcatgcaggattgcct

SEQ ID NO: 123104 - DNA, 20 bp, human
gtatcgcaggggggagcaga

SEQ ID NO: 123105 - DNA, 20 bp, human
ggcagccatcaaaggaaatg

SEQ ID NO: 123106 - DNA, 20 bp, human
ggggatggcaatccagaagt

SEQ ID NO: 123107 - DNA, 20 bp, human
ggggatccctgttaagaaga

SEQ ID NO: 123108 - DNA, 20 bp, human
ggaagaaggtgtctggaaga

SEQ ID NO: 123109 - DNA, 20 bp, human
gctgttaagaagaaggtgtc

SEQ ID NO: 123110 - DNA, 20 bp, human
gttctcaaccatgctgtcat

SEQ ID NO: 123111 - DNA, 20 bp, human
gaccagtgctacaagataca

SEQ ID NO: 123112 - DNA, 20 bp, human
gatggcaatgaccaggatga

SEQ ID NO: 123113 - DNA, 20 bp, human
gatgctgtcataggcagaat

SEQ ID NO: 123114 - DNA, 20 bp, human
gacttgccatggcctttgat

SEQ ID NO: 123115 - DNA, 20 bp, human
gccagcatggagccacaaaa

SEQ ID NO: 123116 - DNA, 20 bp, human
ggttgagagacccacatcag

SEQ ID NO: 123117 - DNA, 20 bp, human
gggatggcgctatattggag

SEQ ID NO: 123118 - DNA, 20 bp, human
gggtgaggatggcgctatat

SEQ ID NO: 123119 - DNA, 20 bp, human
gatcacagaaacaaccttgt

SEQ ID NO: 123120 - DNA, 20 bp, human
gtcttctggatcaacctcag

SEQ ID NO: 123121 - DNA, 20 bp, human
ggataaaaaacatctgggtg

SEQ ID NO: 123122 - DNA, 20 bp, human
gagaaacaaccttgttggtg

SEQ ID NO: 123123 - DNA, 20 bp, human
gttcaaagatgatccctctg

SEQ ID NO: 123124 - DNA, 20 bp, human
gttgtggataaaaaacatct

SEQ ID NO: 123125 - DNA, 20 bp, human
gatcatgtacacagcacaga

SEQ ID NO: 123126 - DNA, 20 bp, human
gggtgaggatcatggtgtac

SEQ ID NO: 123127 - DNA, 20 bp, human
gtcctggtattcctagcagg

SEQ ID NO: 123128 - DNA, 20 bp, human
gacagaagctaggatactga

SEQ ID NO: 123129 - DNA, 20 bp, human
gtatgtaaagtgtccagtcc

SEQ ID NO: 123130 - DNA, 20 bp, human
gtcctcctgctaggaatacc

SEQ ID NO: 123131 - DNA, 20 bp, human
gcccaaagctgatctcttgg

SEQ ID NO: 123132 - DNA, 20 bp, human
gaggatactgatggttttat

SEQ ID NO: 123133 - DNA, 20 bp, human
gggaattcagtgacacttgc

SEQ ID NO: 123134 - DNA, 20 bp, human
gagatcaatcatagacaaca

SEQ ID NO: 123135 - DNA, 20 bp, human
gcaaaatgctaggaatcttc

SEQ ID NO: 123136 - DNA, 20 bp, human
gactgggtgtcgttagctat

SEQ ID NO: 123137 - DNA, 20 bp, human
gttaagaggagaaacaccag

SEQ ID NO: 123138 - DNA, 20 bp, human
ggtcctgaggagcttgtaca

SEQ ID NO: 123139 - DNA, 20 bp, human
ggtcatggagagcatcgtat

SEQ ID NO: 123140 - DNA, 20 bp, human
gttgtacatggtcattccac

SEQ ID NO: 123141 - DNA, 20 bp, human
ggaccatgtacaagctcctc

SEQ ID NO: 123142 - DNA, 20 bp, human
gattgacctgagcttgtcta

SEQ ID NO: 123143 - DNA, 20 bp, human
gggtggccgtagacaagctc

SEQ ID NO: 123144 - DNA, 20 bp, human
gatggagagcatcgtattgg

SEQ ID NO: 123145 - DNA, 20 bp, human
gatcttctggttcaatatca

SEQ ID NO: 123146 - DNA, 20 bp, human
gtgtgcccagcagctttata

SEQ ID NO: 123147 - DNA, 20 bp, human
gggtggctgtagacaagccc

SEQ ID NO: 123148 - DNA, 20 bp, human
gccaccatccccaaaatgtt

SEQ ID NO: 123149 - DNA, 20 bp, human
gatggagagcattgtgttgg

SEQ ID NO: 123150 - DNA, 20 bp, human
gggaatattataatcgtcgc

SEQ ID NO: 123151 - DNA, 20 bp, human
gcctccaaaagatatttctt

SEQ ID NO: 123152 - DNA, 20 bp, human
gccagcagtaggaatgaaga

SEQ ID NO: 123153 - DNA, 20 bp, human
ggctatggagagcattgtgt

SEQ ID NO: 123154 - DNA, 20 bp, human
gcccagcagctttatatggc

SEQ ID NO: 123155 - DNA, 20 bp, human
gtcctgccatataaagctgc

SEQ ID NO: 123156 - DNA, 20 bp, human
gggatccctaccagaatgaa

SEQ ID NO: 123157 - DNA, 20 bp, human
gctcaggttgaaaatgatca

SEQ ID NO: 123158 - DNA, 20 bp, human
gtctcagcccctaaagacag

SEQ ID NO: 123159 - DNA, 20 bp, human
gagatggtggtatatctcaa

SEQ ID NO: 123160 - DNA, 20 bp, human
gttgaaaatgatcatggcag

SEQ ID NO: 123161 - DNA, 20 bp, human
gtaaagacagagggtgatta

SEQ ID NO: 123162 - DNA, 20 bp, human
gtcctggattgtaactgctc

SEQ ID NO: 123163 - DNA, 20 bp, human
gccatcatcaagagtgctat

SEQ ID NO: 123164 - DNA, 20 bp, human
gacctgagcagttacaatcc

SEQ ID NO: 123165 - DNA, 20 bp, human
gaggacccttcattctggta

SEQ ID NO: 123166 - DNA, 20 bp, human
gatgaatgtgacagctctga

SEQ ID NO: 123167 - DNA, 20 bp, human
ggtgatgctgggaatgagta

SEQ ID NO: 123168 - DNA, 20 bp, human
ggtgacagctctgatggtga

SEQ ID NO: 123169 - DNA, 20 bp, human
ggaattctcttgtagtgtag

SEQ ID NO: 123170 - DNA, 20 bp, human
gtcattcccagcatcacttg

SEQ ID NO: 123171 - DNA, 20 bp, human
gtcacgcctcaagtgatgct

SEQ ID NO: 123172 - DNA, 20 bp, human
gaccatcttgggtaccacgg

SEQ ID NO: 123173 - DNA, 20 bp, human
gatcttgggtaccacggagg

SEQ ID NO: 123174 - DNA, 20 bp, human
gccattgtgtggttgtaagc

SEQ ID NO: 123175 - DNA, 20 bp, human
gattgttatggcctcctccg

SEQ ID NO: 123176 - DNA, 20 bp, human
gtaagatttgttgacacatg

SEQ ID NO: 123177 - DNA, 20 bp, human
gttgttgacacatgtggtgc

SEQ ID NO: 123178 - DNA, 20 bp, human
gacatcatttgtgcattaac

SEQ ID NO: 123179 - DNA, 20 bp, human
gccaagctgagaatatcctt

SEQ ID NO: 123180 - DNA, 20 bp, human
gatcttgggtaccaccgagg

SEQ ID NO: 123181 - DNA, 20 bp, human
gattgttatggcctcctcgg

SEQ ID NO: 123182 - DNA, 20 bp, human
gccattgtgtggttataagc

SEQ ID NO: 123183 - DNA, 20 bp, human
ggtggtgctgggaaaaccta

SEQ ID NO: 123184 - DNA, 20 bp, human
gatacccacaaggaggaagg

SEQ ID NO: 123185 - DNA, 20 bp, human
gtcctgggatacccacaagg

SEQ ID NO: 123186 - DNA, 20 bp, human
gggtagataagatagaccat

SEQ ID NO: 123187 - DNA, 20 bp, human
gaggcccggagatccacatg

SEQ ID NO: 123188 - DNA, 20 bp, human
gcagacctgggattccaatg

SEQ ID NO: 123189 - DNA, 20 bp, human
gagcacagacggccacataa

SEQ ID NO: 123190 - DNA, 20 bp, human
gcaatgaggaaaaatgtgac

SEQ ID NO: 123191 - DNA, 20 bp, human
gagatggttgcgtaatgtag

SEQ ID NO: 123192 - DNA, 20 bp, human
gctaatgcccaccaacactt

SEQ ID NO: 123193 - DNA, 20 bp, human
gatcttgacatcccaagtgt

SEQ ID NO: 123194 - DNA, 20 bp, human
gtgggaagtgtaagtaaaac

SEQ ID NO: 123195 - DNA, 20 bp, human
gcaaggtagaacagactctc

SEQ ID NO: 123196 - DNA, 20 bp, human
gggaccgtcgtgtagtgcaa

SEQ ID NO: 123197 - DNA, 20 bp, human
gtgtgttgaggtgatattag

SEQ ID NO: 123198 - DNA, 20 bp, human
gaagccattgcactacacga

SEQ ID NO: 123199 - DNA, 20 bp, human
ggatggagatccaggcatgc

SEQ ID NO: 123200 - DNA, 20 bp, human
gcatgcaggtgttccaaacc

SEQ ID NO: 123201 - DNA, 20 bp, human
gaattgacaaggagatttcc

SEQ ID NO: 123202 - DNA, 20 bp, human
gaagacagctggatgtgttg

SEQ ID NO: 123203 - DNA, 20 bp, human
gagccctgtaaaaattgaca

SEQ ID NO: 123204 - DNA, 20 bp, human
gagtataagcaaagcagaag

SEQ ID NO: 123205 - DNA, 20 bp, human
gttggtaggaattcctggtt

SEQ ID NO: 123206 - DNA, 20 bp, human
gggccctgtggaagcagata

SEQ ID NO: 123207 - DNA, 20 bp, human
gcctgtggaagcagataagg

SEQ ID NO: 123208 - DNA, 20 bp, human
gggatgtgttaaggtgatat

SEQ ID NO: 123209 - DNA, 20 bp, human
gggaggctgacatggctcct

SEQ ID NO: 123210 - DNA, 20 bp, human
gccaccaacaagaaggcagt

SEQ ID NO: 123211 - DNA, 20 bp, human
gaaggcagttggatgtgtta

SEQ ID NO: 123212 - DNA, 20 bp, human
gtattgaatattctctggaa

SEQ ID NO: 123213 - DNA, 20 bp, human
gtgtgttaaggtgatattgg

SEQ ID NO: 123214 - DNA, 20 bp, human
ggtgatattggaggctgaca

SEQ ID NO: 123215 - DNA, 20 bp, human
gaagaacatctgggccagac

SEQ ID NO: 123216 - DNA, 20 bp, human
gcattatcaatggcttggag

SEQ ID NO: 123217 - DNA, 20 bp, human
gacgatgtacccaatctcgt

SEQ ID NO: 123218 - DNA, 20 bp, human
gtccctaccaggagaaaaga

SEQ ID NO: 123219 - DNA, 20 bp, human
gggttcatgcccacgagatt

SEQ ID NO: 123220 - DNA, 20 bp, human
gaggagcattatcaatggct

SEQ ID NO: 123221 - DNA, 20 bp, human
gcctccagcttgaattgcta

SEQ ID NO: 123222 - DNA, 20 bp, human
ggacaatgtgataatgtagc

SEQ ID NO: 123223 - DNA, 20 bp, human
gttctcctggtagggattcc

SEQ ID NO: 123224 - DNA, 20 bp, human
gggatgatggttgccccatt

SEQ ID NO: 123225 - DNA, 20 bp, human
ggccttcttttctcctggta

SEQ ID NO: 123226 - DNA, 20 bp, human
gatggagagccagacgtgta

SEQ ID NO: 123227 - DNA, 20 bp, human
gaatgtagagaacaccccgg

SEQ ID NO: 123228 - DNA, 20 bp, human
gggcggatcatcagaggcag

SEQ ID NO: 123229 - DNA, 20 bp, human
gatggtgctcacttatacag

SEQ ID NO: 123230 - DNA, 20 bp, human
gtccaatgtagagaacaccc

SEQ ID NO: 123231 - DNA, 20 bp, human
ggtagacagaaccaggtcaa

SEQ ID NO: 123232 - DNA, 20 bp, human
ggtgtagggactccagccct

SEQ ID NO: 123233 - DNA, 20 bp, human
ggcaccatgctatgacgtag

SEQ ID NO: 123234 - DNA, 20 bp, human
ggtgctcacttatacagtgg

SEQ ID NO: 123235 - DNA, 20 bp, human
ggctggagtccctacacgtc

SEQ ID NO: 123236 - DNA, 20 bp, human
gactgaattagtgaggatgg

SEQ ID NO: 123237 - DNA, 20 bp, human
gcacacccctaagaaaagtg

SEQ ID NO: 123238 - DNA, 20 bp, human
gtacatggtacacagtggga

SEQ ID NO: 123239 - DNA, 20 bp, human
ggcttggtgaggaaagtgga

SEQ ID NO: 123240 - DNA, 20 bp, human
ggctgtacatggtacacagt

SEQ ID NO: 123241 - DNA, 20 bp, human
gtcatcctaaatggcatccc

SEQ ID NO: 123242 - DNA, 20 bp, human
ggtgtgcacaaagaacatct

SEQ ID NO: 123243 - DNA, 20 bp, human
gatgcacatcttccaaacca

SEQ ID NO: 123244 - DNA, 20 bp, human
ggatggtggcataacgcaga

SEQ ID NO: 123245 - DNA, 20 bp, human
gatggccacacagtggtcca

SEQ ID NO: 123246 - DNA, 20 bp, human
gagacatgatggctgacagg

SEQ ID NO: 123247 - DNA, 20 bp, human
ggccttggcgatgacagggt

SEQ ID NO: 123248 - DNA, 20 bp, human
ggatggtggcatagcgtaag

SEQ ID NO: 123249 - DNA, 20 bp, human
gcccagacatgatggctgac

SEQ ID NO: 123250 - DNA, 20 bp, human
ggataaagaatcctggggtc

SEQ ID NO: 123251 - DNA, 20 bp, human
gggcgatgacagggttggta

SEQ ID NO: 123252 - DNA, 20 bp, human
gctgttgtccccagacatga

SEQ ID NO: 123253 - DNA, 20 bp, human
ggaccagccttggcgatgac

SEQ ID NO: 123254 - DNA, 20 bp, human
gtatcttgaatggcgttcct

SEQ ID NO: 123255 - DNA, 20 bp, human
gcacaaggtgacatcagtga

SEQ ID NO: 123256 - DNA, 20 bp, human
gttagcatgataagtctggt

SEQ ID NO: 123257 - DNA, 20 bp, human
gggatagttgaatagcgtaa

SEQ ID NO: 123258 - DNA, 20 bp, human
gagtgttagcatgataagtc

SEQ ID NO: 123259 - DNA, 20 bp, human
gggtgaagaacatctggaca

SEQ ID NO: 123260 - DNA, 20 bp, human
gtgcaattacaggattggtg

SEQ ID NO: 123261 - DNA, 20 bp, human
gctcatagtgaatgaggtag

SEQ ID NO: 123262 - DNA, 20 bp, human
gaataaatgaagctggtatt

SEQ ID NO: 123263 - DNA, 20 bp, human
gaatagctcaaaatttgtct

SEQ ID NO: 123264 - DNA, 20 bp, human
gacctttgcaattacaggat

SEQ ID NO: 123265 - DNA, 20 bp, human
gactggaagacacacaactc

SEQ ID NO: 123266 - DNA, 20 bp, human
ggtgtggtagcataacgcaa

SEQ ID NO: 123267 - DNA, 20 bp, human
ggcaggtaaggaggtcaatg

SEQ ID NO: 123268 - DNA, 20 bp, human
gttcacaggtgtggagtctg

SEQ ID NO: 123269 - DNA, 20 bp, human
ggaggagtcacatgaattgt

SEQ ID NO: 123270 - DNA, 20 bp, human
gtacattgtgcagagtggga

SEQ ID NO: 123271 - DNA, 20 bp, human
gtaacgcaaagggtagcaaa

SEQ ID NO: 123272 - DNA, 20 bp, human
gatgatagggttggtgagtg

SEQ ID NO: 123273 - DNA, 20 bp, human
gggactcctcataataaatg

SEQ ID NO: 123274 - DNA, 20 bp, human
gaaatacatcggatgatgta

SEQ ID NO: 123275 - DNA, 20 bp, human
gaccaaccctatcattgcca

SEQ ID NO: 123276 - DNA, 20 bp, human
gtacgtggcacagaacggaa

SEQ ID NO: 123277 - DNA, 20 bp, human
gcaagcaggatgaaggacac

SEQ ID NO: 123278 - DNA, 20 bp, human
ggatgctagagtgtcggagt

SEQ ID NO: 123279 - DNA, 20 bp, human
gggaccatcgtgatgctgag

SEQ ID NO: 123280 - DNA, 20 bp, human
ggggattccaagcaggatga

SEQ ID NO: 123281 - DNA, 20 bp, human
ggaccatattaaccagtcca

SEQ ID NO: 123282 - DNA, 20 bp, human
gccacaactggaaactctcc

SEQ ID NO: 123283 - DNA, 20 bp, human
gatcggtcgtgatcaaactg

SEQ ID NO: 123284 - DNA, 20 bp, human
gacaacagccacagcatacg

SEQ ID NO: 123285 - DNA, 20 bp, human
gagccctctcagcatcacga

SEQ ID NO: 123286 - DNA, 20 bp, human
gctcctgacagggaagataa

SEQ ID NO: 123287 - DNA, 20 bp, human
gacaacttgagggctcatgg

SEQ ID NO: 123288 - DNA, 20 bp, human
gtgtggtgggcacaacttga

SEQ ID NO: 123289 - DNA, 20 bp, human
gtgatcgtgctgcggcaata

SEQ ID NO: 123290 - DNA, 20 bp, human
gtggccaacagtagaaacat

SEQ ID NO: 123291 - DNA, 20 bp, human
gaccagtgtcagccaagtct

SEQ ID NO: 123292 - DNA, 20 bp, human
gggaccaggcacacagcata

SEQ ID NO: 123293 - DNA, 20 bp, human
gagttgtgcccaccacagaa

SEQ ID NO: 123294 - DNA, 20 bp, human
ggcagcacgatcacaggcca

SEQ ID NO: 123295 - DNA, 20 bp, human
gcagcatatggcacagatcg

SEQ ID NO: 123296 - DNA, 20 bp, human
gtgttgctgggtgacgccat

SEQ ID NO: 123297 - DNA, 20 bp, human
gggatgggtaccgcagtggg

SEQ ID NO: 123298 - DNA, 20 bp, human
gcagctcatgattcagccta

SEQ ID NO: 123299 - DNA, 20 bp, human
ggatggatgggtaccgcagt

SEQ ID NO: 123300 - DNA, 20 bp, human
ggagccagtgctgccaactc

SEQ ID NO: 123301 - DNA, 20 bp, human
gttctgatgactatgtttat

SEQ ID NO: 123302 - DNA, 20 bp, human
gatggagtcctgcacgttta

SEQ ID NO: 123303 - DNA, 20 bp, human
ggctgaatcatgagctgagt

SEQ ID NO: 123304 - DNA, 20 bp, human
ggtttatgggcagatacaag

SEQ ID NO: 123305 - DNA, 20 bp, human
ggccatgaccataaacgtgc

SEQ ID NO: 123306 - DNA, 20 bp, human
ggtctgaagcttcagtggag

SEQ ID NO: 123307 - DNA, 20 bp, human
gtgatggatatctcagtggg

SEQ ID NO: 123308 - DNA, 20 bp, human
gtgattgatggatatctcag

SEQ ID NO: 123309 - DNA, 20 bp, human
gagcaggcagggaagctgat

SEQ ID NO: 123310 - DNA, 20 bp, human
gtctgacaaaacaattcaag

SEQ ID NO: 123311 - DNA, 20 bp, human
gcagatggtcatcaggaggg

SEQ ID NO: 123312 - DNA, 20 bp, human
gtttctggtcaaaataaaca

SEQ ID NO: 123313 - DNA, 20 bp, human
gagtggagagggtgtcattt

SEQ ID NO: 123314 - DNA, 20 bp, human
gtgtgcaagactccatggct

SEQ ID NO: 123315 - DNA, 20 bp, human
gagtgatcagtgatgattga

SEQ ID NO: 123316 - DNA, 20 bp, human
gtgggaagctgatcgacctg

SEQ ID NO: 123317 - DNA, 20 bp, human
ggacagatacagggcctcag

SEQ ID NO: 123318 - DNA, 20 bp, human
gacatacttggttaaatata

SEQ ID NO: 123319 - DNA, 20 bp, human
gacttggttaaatataaggg

SEQ ID NO: 123320 - DNA, 20 bp, human
gctggcatatgatacatact

SEQ ID NO: 123321 - DNA, 20 bp, human
gtctagacgtagtagagtgt

SEQ ID NO: 123322 - DNA, 20 bp, human
gctgggtctccagattgatc

SEQ ID NO: 123323 - DNA, 20 bp, human
gactttattgggacagatac

SEQ ID NO: 123324 - DNA, 20 bp, human
gggggcagtggagtcattgc

SEQ ID NO: 123325 - DNA, 20 bp, human
gctacgttttaaggtacact

SEQ ID NO: 123326 - DNA, 20 bp, human
gtgatggatgagtactgtag

SEQ ID NO: 123327 - DNA, 20 bp, human
gtagatggtgatcagaaggg

SEQ ID NO: 123328 - DNA, 20 bp, human
gatagtaagaaggccattcc

SEQ ID NO: 123329 - DNA, 20 bp, human
gggggataggcatagtaaga

SEQ ID NO: 123330 - DNA, 20 bp, human
ggtgatcagaagggtggcat

SEQ ID NO: 123331 - DNA, 20 bp, human
gagggtggcattggccccca

SEQ ID NO: 123332 - DNA, 20 bp, human
gactgatcaatttgtcgcta

SEQ ID NO: 123333 - DNA, 20 bp, human
gggcattggcccccatggcc

SEQ ID NO: 123334 - DNA, 20 bp, human
gtttccccagtttccagagc

SEQ ID NO: 123335 - DNA, 20 bp, human
gcagatagatggtgatcaga

SEQ ID NO: 123336 - DNA, 20 bp, human
gccgagtaccagatctgagt

SEQ ID NO: 123337 - DNA, 20 bp, human
gcagatgtccagtactactg

SEQ ID NO: 123338 - DNA, 20 bp, human
gtactggggtaagatgatat

SEQ ID NO: 123339 - DNA, 20 bp, human
gtaaaggtaaggggattcag

SEQ ID NO: 123340 - DNA, 20 bp, human
gggatgctgcaagttcttaa

SEQ ID NO: 123341 - DNA, 20 bp, human
ggatgtggtcctgtcttagg

SEQ ID NO: 123342 - DNA, 20 bp, human
gctgtctcttctccagagta

SEQ ID NO: 123343 - DNA, 20 bp, human
gggttaggatataggagagg

SEQ ID NO: 123344 - DNA, 20 bp, human
gtgtcttagggggaatgacc

SEQ ID NO: 123345 - DNA, 20 bp, human
gggctcaatagggaagcggg

SEQ ID NO: 123346 - DNA, 20 bp, human
gctctatgcagaagaagcag

SEQ ID NO: 123347 - DNA, 20 bp, human
ggcttcttctgcatagagtc

SEQ ID NO: 123348 - DNA, 20 bp, human
ggtggaggtatccatggaat

SEQ ID NO: 123349 - DNA, 20 bp, human
gctggagtcataggtaacac

SEQ ID NO: 123350 - DNA, 20 bp, human
ggatctgagcaaaacacatg

SEQ ID NO: 123351 - DNA, 20 bp, human
ggatgaactgggaaatctgg

SEQ ID NO: 123352 - DNA, 20 bp, human
ggagtcataggtaacactgg

SEQ ID NO: 123353 - DNA, 20 bp, human
gcaggatgaactgggaaatc

SEQ ID NO: 123354 - DNA, 20 bp, human
gtcataggtaacactggtgg

SEQ ID NO: 123355 - DNA, 20 bp, human
ggtttaaaagttcagctaag

SEQ ID NO: 123356 - DNA, 20 bp, human
gggccctgggtcatgatagt

SEQ ID NO: 123357 - DNA, 20 bp, human
gaatcccaggaggatgaaca

SEQ ID NO: 123358 - DNA, 20 bp, human
gtgccatagcagtcaggagg

SEQ ID NO: 123359 - DNA, 20 bp, human
gggcctctgtacacgcatgg

SEQ ID NO: 123360 - DNA, 20 bp, human
ggtcactgatgagctgttcc

SEQ ID NO: 123361 - DNA, 20 bp, human
gtggtggttggggcatatgt

SEQ ID NO: 123362 - DNA, 20 bp, human
gaccccactatcatgaccca

SEQ ID NO: 123363 - DNA, 20 bp, human
gatgcgtgtacagaggccct

SEQ ID NO: 123364 - DNA, 20 bp, human
ggcacagcccacaaatgata

SEQ ID NO: 123365 - DNA, 20 bp, human
gaaggacaagatgcagacct

SEQ ID NO: 123366 - DNA, 20 bp, human
gtatgcaggaagcaggccta

SEQ ID NO: 123367 - DNA, 20 bp, human
gtgagtggcacagccaacaa

SEQ ID NO: 123368 - DNA, 20 bp, human
ggaggactgtgtaaagcaag

SEQ ID NO: 123369 - DNA, 20 bp, human
gtggtggttggcgcctatgt

SEQ ID NO: 123370 - DNA, 20 bp, human
gacaaagtgtatgggatatg

SEQ ID NO: 123371 - DNA, 20 bp, human
gtgttccttcctacagccat

SEQ ID NO: 123372 - DNA, 20 bp, human
gacactttgtttaaagatgg

SEQ ID NO: 123373 - DNA, 20 bp, human
gcagaagacaaagtactgag

SEQ ID NO: 123374 - DNA, 20 bp, human
gtcagacagcatcttagggg

SEQ ID NO: 123375 - DNA, 20 bp, human
gtggttggcgcctatgtggg

SEQ ID NO: 123376 - DNA, 20 bp, human
gagcatcctaggggttatag

SEQ ID NO: 123377 - DNA, 20 bp, human
ggtaaactcacatgaaccag

SEQ ID NO: 123378 - DNA, 20 bp, human
gacgagtatggatatatcag

SEQ ID NO: 123379 - DNA, 20 bp, human
gaggacttacagatcgacca

SEQ ID NO: 123380 - DNA, 20 bp, human
gagaagaggacgtgcagcca

SEQ ID NO: 123381 - DNA, 20 bp, human
ggtttgttggacatcatcac

SEQ ID NO: 123382 - DNA, 20 bp, human
gaaattgaccagcatcctag

SEQ ID NO: 123383 - DNA, 20 bp, human
gtgggtgatgcactcagcta

SEQ ID NO: 123384 - DNA, 20 bp, human
gcttattacagtgacgagta

SEQ ID NO: 123385 - DNA, 20 bp, human
gtgaaaaggctaaaccacca

SEQ ID NO: 123386 - DNA, 20 bp, human
ggtgctgtttcctagtgtca

SEQ ID NO: 123387 - DNA, 20 bp, human
gaaacggatgcagactgttc

SEQ ID NO: 123388 - DNA, 20 bp, human
ggatacaccaaaactcatgc

SEQ ID NO: 123389 - DNA, 20 bp, human
gttttactagccatgacact

SEQ ID NO: 123390 - DNA, 20 bp, human
gtggtgcccagcatgagttt

SEQ ID NO: 123391 - DNA, 20 bp, human
ggtcactgaattctatcttc

SEQ ID NO: 123392 - DNA, 20 bp, human
gagaatttgatgttatttca

SEQ ID NO: 123393 - DNA, 20 bp, human
gctcctggctatgatggcag

SEQ ID NO: 123394 - DNA, 20 bp, human
ggcttacagatggcaacata

SEQ ID NO: 123395 - DNA, 20 bp, human
gatgattacagtatagtgaa

SEQ ID NO: 123396 - DNA, 20 bp, human
ggcactgagccaatgactgg

SEQ ID NO: 123397 - DNA, 20 bp, human
gggagcactgagccaatgac

SEQ ID NO: 123398 - DNA, 20 bp, human
gtatttcctcccccagtcat

SEQ ID NO: 123399 - DNA, 20 bp, human
gagtgctcctaatatcagaa

SEQ ID NO: 123400 - DNA, 20 bp, human
gtgctgttcctgtaagaggt

SEQ ID NO: 123401 - DNA, 20 bp, human
gatatagcagacatctatga

SEQ ID NO: 123402 - DNA, 20 bp, human
gagtaccatccaaacacaga

SEQ ID NO: 123403 - DNA, 20 bp, human
gatgatggatgaatagagca

SEQ ID NO: 123404 - DNA, 20 bp, human
gtcttgtctcatgacagcca

SEQ ID NO: 123405 - DNA, 20 bp, human
ggtcacccaccctctgtgtt

SEQ ID NO: 123406 - DNA, 20 bp, human
gcgagaactgggtagagcag

SEQ ID NO: 123407 - DNA, 20 bp, human
ggacttatgaaagaggttcg

SEQ ID NO: 123408 - DNA, 20 bp, human
gtctcccagacacgagaact

SEQ ID NO: 123409 - DNA, 20 bp, human
gagaggcatctacaaaagag

SEQ ID NO: 123410 - DNA, 20 bp, human
gccttgtagatctggattgt

SEQ ID NO: 123411 - DNA, 20 bp, human
gagaggactccttgtagatc

SEQ ID NO: 123412 - DNA, 20 bp, human
gtctatatggcaaacatggt

SEQ ID NO: 123413 - DNA, 20 bp, human
gtagctacctccttcttagc

SEQ ID NO: 123414 - DNA, 20 bp, human
gcctccttcttagcaggttg

SEQ ID NO: 123415 - DNA, 20 bp, human
gtctacccagttctcgtgtc

SEQ ID NO: 123416 - DNA, 20 bp, human
gtgaaggtgctatagtggag

SEQ ID NO: 123417 - DNA, 20 bp, human
gctcatgctgggctcttacc

SEQ ID NO: 123418 - DNA, 20 bp, human
ggataaagaaaacagctcaa

SEQ ID NO: 123419 - DNA, 20 bp, human
gggacatgaaggtgctatag

SEQ ID NO: 123420 - DNA, 20 bp, human
ggcccaggtcaacaaaggag

SEQ ID NO: 123421 - DNA, 20 bp, human
gcagacctgcttggacatga

SEQ ID NO: 123422 - DNA, 20 bp, human
ggatgctgagtgctatgtcc

SEQ ID NO: 123423 - DNA, 20 bp, human
gtgactgagtttatcttcat

SEQ ID NO: 123424 - DNA, 20 bp, human
gtctgcttggctctcatgct

SEQ ID NO: 123425 - DNA, 20 bp, human
gatcacccaggaccctcaga

SEQ ID NO: 123426 - DNA, 20 bp, human
gcaacaaataggaactcagt

SEQ ID NO: 123427 - DNA, 20 bp, human
gagccattgctgccaggata

SEQ ID NO: 123428 - DNA, 20 bp, human
gcctgaatgtgaggcacaca

SEQ ID NO: 123429 - DNA, 20 bp, human
gagtggaagtacaacatcac

SEQ ID NO: 123430 - DNA, 20 bp, human
gtcagtgtagtatagagcag

SEQ ID NO: 123431 - DNA, 20 bp, human
gctatactacactgatgtct

SEQ ID NO: 123432 - DNA, 20 bp, human
gctggtatatacattaacta

SEQ ID NO: 123433 - DNA, 20 bp, human
gaacaagaaaactaagatgt

SEQ ID NO: 123434 - DNA, 20 bp, human
ggatgctgagtgccttatcc

SEQ ID NO: 123435 - DNA, 20 bp, human
gctcagagtcacactgttct

SEQ ID NO: 123436 - DNA, 20 bp, human
gagaagttcaccagggtctg

SEQ ID NO: 123437 - DNA, 20 bp, human
gagggtctggggcacaaccg

SEQ ID NO: 123438 - DNA, 20 bp, human
gttggccaagaagttcacca

SEQ ID NO: 123439 - DNA, 20 bp, human
gtgaagatgagtcttattga

SEQ ID NO: 123440 - DNA, 20 bp, human
ggagctcaaactccatccct

SEQ ID NO: 123441 - DNA, 20 bp, human
ggatttctgctactcctcca

SEQ ID NO: 123442 - DNA, 20 bp, human
ggaaggagaggctcttcagg

SEQ ID NO: 123443 - DNA, 20 bp, human
gggtggcactcacatggatc

SEQ ID NO: 123444 - DNA, 20 bp, human
gaggggcaaacctgagccaa

SEQ ID NO: 123445 - DNA, 20 bp, human
gaaatgaggttgaacacctg

SEQ ID NO: 123446 - DNA, 20 bp, human
gccaatggagaacaacacag

SEQ ID NO: 123447 - DNA, 20 bp, human
ggcagctacataattcccaa

SEQ ID NO: 123448 - DNA, 20 bp, human
ggatgtaggagcctatggcc

SEQ ID NO: 123449 - DNA, 20 bp, human
ggaataaccaaagtccacca

SEQ ID NO: 123450 - DNA, 20 bp, human
ggagtgggatctgcagttct

SEQ ID NO: 123451 - DNA, 20 bp, human
ggaaaccccaccatcacctt

SEQ ID NO: 123452 - DNA, 20 bp, human
ggactgaattcatccttgtg

SEQ ID NO: 123453 - DNA, 20 bp, human
gagtgatgaggtagatgaaa

SEQ ID NO: 123454 - DNA, 20 bp, human
gtgatggtggggtttctcac

SEQ ID NO: 123455 - DNA, 20 bp, human
ggtcataggccattgatgcc

SEQ ID NO: 123456 - DNA, 20 bp, human
gtccatggagaataatacag

SEQ ID NO: 123457 - DNA, 20 bp, human
ggggtaaacatgataaagag

SEQ ID NO: 123458 - DNA, 20 bp, human
ggttcccagtcagagtgatg

SEQ ID NO: 123459 - DNA, 20 bp, human
ggcacaggcactgtaggaga

SEQ ID NO: 123460 - DNA, 20 bp, human
gggcattggttagaccaagc

SEQ ID NO: 123461 - DNA, 20 bp, human
gggtggtggtataatgtagg

SEQ ID NO: 123462 - DNA, 20 bp, human
gtgtgtgcttgtctggctat

SEQ ID NO: 123463 - DNA, 20 bp, human
ggttacacactgctgcgtag

SEQ ID NO: 123464 - DNA, 20 bp, human
gctataggctgttatgtcat

SEQ ID NO: 123465 - DNA, 20 bp, human
gaccaatgcctgcaagagac

SEQ ID NO: 123466 - DNA, 20 bp, human
ggccagacaggcacctacac

SEQ ID NO: 123467 - DNA, 20 bp, human
gacactggccgtcatggtgg

SEQ ID NO: 123468 - DNA, 20 bp, human
ggcacctacactggccgtca

SEQ ID NO: 123469 - DNA, 20 bp, human
gcctacactggccgtcatgg

SEQ ID NO: 123470 - DNA, 20 bp, human
gatactgatggagaattgta

SEQ ID NO: 123471 - DNA, 20 bp, human
gccctaggctcatatgtctg

SEQ ID NO: 123472 - DNA, 20 bp, human
ggttcccacacagagtgagg

SEQ ID NO: 123473 - DNA, 20 bp, human
ggccagtgtaggtgcctgtc

SEQ ID NO: 123474 - DNA, 20 bp, human
ggatgaccttgtctcctcta

SEQ ID NO: 123475 - DNA, 20 bp, human
gatctgtagttctgggacac

SEQ ID NO: 123476 - DNA, 20 bp, human
gtaggaaccagtagcaagga

SEQ ID NO: 123477 - DNA, 20 bp, human
ggtgcctgctgcatggatag

SEQ ID NO: 123478 - DNA, 20 bp, human
ggctgtagcccccaaaacgg

SEQ ID NO: 123479 - DNA, 20 bp, human
ggagtaacccaagtctacaa

SEQ ID NO: 123480 - DNA, 20 bp, human
gtcgccatgcagcggtatgt

SEQ ID NO: 123481 - DNA, 20 bp, human
ggcctatgatcgccatgcag

SEQ ID NO: 123482 - DNA, 20 bp, human
ggacataggaaccagtagca

SEQ ID NO: 123483 - DNA, 20 bp, human
gtaattcaagctggccacaa

SEQ ID NO: 123484 - DNA, 20 bp, human
gggaggggtatctgaagatt

SEQ ID NO: 123485 - DNA, 20 bp, human
gtgcatggatagaggcattg

SEQ ID NO: 123486 - DNA, 20 bp, human
gggaatccagccatgacgat

SEQ ID NO: 123487 - DNA, 20 bp, human
gacctgcagttctgagtcat

SEQ ID NO: 123488 - DNA, 20 bp, human
gtgtgtgctcgtctggccat

SEQ ID NO: 123489 - DNA, 20 bp, human
ggctgtcactcccatcgtca

SEQ ID NO: 123490 - DNA, 20 bp, human
gactgctctgggggactcac

SEQ ID NO: 123491 - DNA, 20 bp, human
ggatgaccttgtcttctata

SEQ ID NO: 123492 - DNA, 20 bp, human
gaaggggaacgttataaaga

SEQ ID NO: 123493 - DNA, 20 bp, human
gacaactgtgtgtgctcgtc

SEQ ID NO: 123494 - DNA, 20 bp, human
gtatcaatacaataattccc

SEQ ID NO: 123495 - DNA, 20 bp, human
gattttccatcactgctctg

SEQ ID NO: 123496 - DNA, 20 bp, human
gaggaggacgaattcagcag

SEQ ID NO: 123497 - DNA, 20 bp, human
gtgctgggagcatcaggcct

SEQ ID NO: 123498 - DNA, 20 bp, human
gaactcagagaacctcaccc

SEQ ID NO: 123499 - DNA, 20 bp, human
gcaggaagagggccacacgc

SEQ ID NO: 123500 - DNA, 20 bp, human
ggcaggctcaccaggtagac

SEQ ID NO: 123501 - DNA, 20 bp, human
gaattcagcaggggcaaccg

SEQ ID NO: 123502 - DNA, 20 bp, human
ggcacaggctgtgtaaggga

SEQ ID NO: 123503 - DNA, 20 bp, human
gagctgttgtatagagaagt

SEQ ID NO: 123504 - DNA, 20 bp, human
gagcatcttggggccgatgg

SEQ ID NO: 123505 - DNA, 20 bp, human
gtgtaagggatggtggctcg

SEQ ID NO: 123506 - DNA, 20 bp, human
gggctgggtcctatacatgg

SEQ ID NO: 123507 - DNA, 20 bp, human
gaacccaagagaataaaagt

SEQ ID NO: 123508 - DNA, 20 bp, human
gagcttctgagacataatag

SEQ ID NO: 123509 - DNA, 20 bp, human
gtaatagtggtatacagcaa

SEQ ID NO: 123510 - DNA, 20 bp, human
gggtggctgggtcctataca

SEQ ID NO: 123511 - DNA, 20 bp, human
gcacactatcccccatgtat

SEQ ID NO: 123512 - DNA, 20 bp, human
gagtttaggtgtaactacag

SEQ ID NO: 123513 - DNA, 20 bp, human
gcacccacttttattctctt

SEQ ID NO: 123514 - DNA, 20 bp, human
gagaaaatatgtgagtatca

SEQ ID NO: 123515 - DNA, 20 bp, human
gaaccagaaagagtggaacc

SEQ ID NO: 123516 - DNA, 20 bp, human
gtggctgggtcatatctctg

SEQ ID NO: 123517 - DNA, 20 bp, human
gtacagtggccatgtcacag

SEQ ID NO: 123518 - DNA, 20 bp, human
gtggccactgtataaagcag

SEQ ID NO: 123519 - DNA, 20 bp, human
gcataacaaaggagtaccaa

SEQ ID NO: 123520 - DNA, 20 bp, human
ggcacagagcctctgtgaca

SEQ ID NO: 123521 - DNA, 20 bp, human
gctgcttgagaacttggtaa

SEQ ID NO: 123522 - DNA, 20 bp, human
ggtaatctgtgaaacctaaa

SEQ ID NO: 123523 - DNA, 20 bp, human
gcacagtggtaggaaacctt

SEQ ID NO: 123524 - DNA, 20 bp, human
gcaccacagcagtgcaggac

SEQ ID NO: 123525 - DNA, 20 bp, human
ggagaggaatctgaagcttt

SEQ ID NO: 123526 - DNA, 20 bp, human
gaggccacattcactctctt

SEQ ID NO: 123527 - DNA, 20 bp, human
ggcagagcacgcgagtgtca

SEQ ID NO: 123528 - DNA, 20 bp, human
gccaggttcaccagcatcat

SEQ ID NO: 123529 - DNA, 20 bp, human
ggagagaaatacgacatctg

SEQ ID NO: 123530 - DNA, 20 bp, human
gaagcccaagagagtgaatg

SEQ ID NO: 123531 - DNA, 20 bp, human
ggcagtctacggcttcagtg

SEQ ID NO: 123532 - DNA, 20 bp, human
ggtggttgtattgtatgcat

SEQ ID NO: 123533 - DNA, 20 bp, human
gtacaatacaaccaccagca

SEQ ID NO: 123534 - DNA, 20 bp, human
gttgtatttctggcagtcta

SEQ ID NO: 123535 - DNA, 20 bp, human
ggccagaaatacaaagaaga

SEQ ID NO: 123536 - DNA, 20 bp, human
gggaccacgttcaccctctt

SEQ ID NO: 123537 - DNA, 20 bp, human
gaagcccaagagggtgaacg

SEQ ID NO: 123538 - DNA, 20 bp, human
gaaggaacatgagactcccc

SEQ ID NO: 123539 - DNA, 20 bp, human
ggactgatagaaatacaagt

SEQ ID NO: 123540 - DNA, 20 bp, human
ggtagatggccagaaaaacc

SEQ ID NO: 123541 - DNA, 20 bp, human
ggttaactgtgtagagcaga

SEQ ID NO: 123542 - DNA, 20 bp, human
gagcagcacgcagagtttct

SEQ ID NO: 123543 - DNA, 20 bp, human
gtctgcgtgctgctggttgt

SEQ ID NO: 123544 - DNA, 20 bp, human
gcactgtgctagggaatatt

SEQ ID NO: 123545 - DNA, 20 bp, human
gagcacagtgacattgtaga

SEQ ID NO: 123546 - DNA, 20 bp, human
gtacagtactgggaaatctc

SEQ ID NO: 123547 - DNA, 20 bp, human
gatttttaggtagacggtcc

SEQ ID NO: 123548 - DNA, 20 bp, human
ggctgccatttttaggtaga

SEQ ID NO: 123549 - DNA, 20 bp, human
gtttatacacttacagtact

SEQ ID NO: 123550 - DNA, 20 bp, human
ggcagggttgctgaacttca

SEQ ID NO: 123551 - DNA, 20 bp, human
gctgactgagttcgtcctat

SEQ ID NO: 123552 - DNA, 20 bp, human
ggagttacaaacgtccacaa

SEQ ID NO: 123553 - DNA, 20 bp, human
gcacaaaggacaggttagcc

SEQ ID NO: 123554 - DNA, 20 bp, human
gaggacgaactcagtcagtg

SEQ ID NO: 123555 - DNA, 20 bp, human
gtgatcaaggagtaaagcag

SEQ ID NO: 123556 - DNA, 20 bp, human
ggggatgtcgaatgaggaca

SEQ ID NO: 123557 - DNA, 20 bp, human
ggtgaattgttcataatcac

SEQ ID NO: 123558 - DNA, 20 bp, human
gtcgaatgaggacatggaac

SEQ ID NO: 123559 - DNA, 20 bp, human
gatttcagggatgtcgaatg

SEQ ID NO: 123560 - DNA, 20 bp, human
ggaacaattcactatgcata

SEQ ID NO: 123561 - DNA, 20 bp, human
gacaggggcattttccactc

SEQ ID NO: 123562 - DNA, 20 bp, human
gaacattttgggagttactg

SEQ ID NO: 123563 - DNA, 20 bp, human
gcatggggatgtgaagttgt

SEQ ID NO: 123564 - DNA, 20 bp, human
ggtagttccaccaaatgcaa

SEQ ID NO: 123565 - DNA, 20 bp, human
gtggtctgattgctcttatc

SEQ ID NO: 123566 - DNA, 20 bp, human
ggtggttacagtggttacaa

SEQ ID NO: 123567 - DNA, 20 bp, human
gaaacattctgtggttacag

SEQ ID NO: 123568 - DNA, 20 bp, human
gcctttgcttcatttttcag

SEQ ID NO: 123569 - DNA, 20 bp, human
gagagcggtattttacagtc

SEQ ID NO: 123570 - DNA, 20 bp, human
gtgtaaaataccgctcttcc

SEQ ID NO: 123571 - DNA, 20 bp, human
gaaaaatgaagcaaaggtaa

SEQ ID NO: 123572 - DNA, 20 bp, human
gggtaaaggaacatttgcaa

SEQ ID NO: 123573 - DNA, 20 bp, human
gtggaattgtgagttgaaat

SEQ ID NO: 123574 - DNA, 20 bp, human
gtaaagtaaagctttgcaaa

SEQ ID NO: 123575 - DNA, 20 bp, human
gtggtctaattgttctcatc

SEQ ID NO: 123576 - DNA, 20 bp, human
gacagatagaaactacacgt

SEQ ID NO: 123577 - DNA, 20 bp, human
gtctgcagttcagggcgagt

SEQ ID NO: 123578 - DNA, 20 bp, human
gcaggacaatctgcagttca

SEQ ID NO: 123579 - DNA, 20 bp, human
gacacagttgtgatgtctag

SEQ ID NO: 123580 - DNA, 20 bp, human
ggcaaaggatgtgtgaacca

SEQ ID NO: 123581 - DNA, 20 bp, human
gtgcagggcacacccataat

SEQ ID NO: 123582 - DNA, 20 bp, human
gggaggcaacatgagttccc

SEQ ID NO: 123583 - DNA, 20 bp, human
gttgtcttgtcataccttgg

SEQ ID NO: 123584 - DNA, 20 bp, human
gcacaactgtgtacaataaa

SEQ ID NO: 123585 - DNA, 20 bp, human
ggcaaaggtctacaaatgat

SEQ ID NO: 123586 - DNA, 20 bp, human
gagtgtgtggagcttgtcac

SEQ ID NO: 123587 - DNA, 20 bp, human
gtcacaggatcatggatagg

SEQ ID NO: 123588 - DNA, 20 bp, human
gtggctacagtgtaaagcaa

SEQ ID NO: 123589 - DNA, 20 bp, human
gttgtcacaggatcatggat

SEQ ID NO: 123590 - DNA, 20 bp, human
gagattcctcaacaaggtaa

SEQ ID NO: 123591 - DNA, 20 bp, human
gtaaagcaagggactcacaa

SEQ ID NO: 123592 - DNA, 20 bp, human
gggagcttgtcacaggatca

SEQ ID NO: 123593 - DNA, 20 bp, human
ggtgaacctcctggttgtga

SEQ ID NO: 123594 - DNA, 20 bp, human
gatgtctgatagaaagtgtg

SEQ ID NO: 123595 - DNA, 20 bp, human
gggtaatggcgtaaatcacc

SEQ ID NO: 123596 - DNA, 20 bp, human
gacagttatttaggtctctt

SEQ ID NO: 123597 - DNA, 20 bp, human
gttaggtctctttggcttaa

SEQ ID NO: 123598 - DNA, 20 bp, human
gttttcagacaagtcaggaa

SEQ ID NO: 123599 - DNA, 20 bp, human
gcttgtctgaaaaaaaattg

SEQ ID NO: 123600 - DNA, 20 bp, human
gtaatatgccacagttattt

SEQ ID NO: 123601 - DNA, 20 bp, human
gattttttttcagacaagtc

SEQ ID NO: 123602 - DNA, 20 bp, human
ggtctctttggcttaaagga

SEQ ID NO: 123603 - DNA, 20 bp, human
gcattggtgtgtgaagccga

SEQ ID NO: 123604 - DNA, 20 bp, human
ggtggtggggaatattagtt

SEQ ID NO: 123605 - DNA, 20 bp, human
gtgtactgcacattcataga

SEQ ID NO: 123606 - DNA, 20 bp, human
gtctctgaaaaaaattgtag

SEQ ID NO: 123607 - DNA, 20 bp, human
gaaagagacgtcaataattg

SEQ ID NO: 123608 - DNA, 20 bp, human
gaaaaaattgtagaggaata

SEQ ID NO: 123609 - DNA, 20 bp, human
gtttcttggacatcatgatg

SEQ ID NO: 123610 - DNA, 20 bp, human
gtgctttcttctggcagcag

SEQ ID NO: 123611 - DNA, 20 bp, human
gtagagaacttcttttctga

SEQ ID NO: 123612 - DNA, 20 bp, human
gttttcagagaggtcaggaa

SEQ ID NO: 123613 - DNA, 20 bp, human
ggtggtggggaatattagtt

SEQ ID NO: 123614 - DNA, 20 bp, human
gaatttttttcagagaggtc

SEQ ID NO: 123615 - DNA, 20 bp, human
gcagcagagtcttcagctca

SEQ ID NO: 123616 - DNA, 20 bp, human
gtgcaggttgccagctaggt

SEQ ID NO: 123617 - DNA, 20 bp, human
ggacaaggtggagatgaata

SEQ ID NO: 123618 - DNA, 20 bp, human
gtagctgagttcatcctcac

SEQ ID NO: 123619 - DNA, 20 bp, human
gctgcaggagcctacctagc

SEQ ID NO: 123620 - DNA, 20 bp, human
gaggatgaactcagctatca

SEQ ID NO: 123621 - DNA, 20 bp, human
ggaaactctacttcaatcat

SEQ ID NO: 123622 - DNA, 20 bp, human
ggcaggaatccatcagaact

SEQ ID NO: 123623 - DNA, 20 bp, human
gatggtggggaacattggtt

SEQ ID NO: 123624 - DNA, 20 bp, human
gtctgcattcagatgactgc

SEQ ID NO: 123625 - DNA, 20 bp, human
gatctgaatgcagagtgtct

SEQ ID NO: 123626 - DNA, 20 bp, human
gaggatgaattcagctgcta

SEQ ID NO: 123627 - DNA, 20 bp, human
ggagaagccaggaatggcta

SEQ ID NO: 123628 - DNA, 20 bp, human
gcagctgaattcatcctcat

SEQ ID NO: 123629 - DNA, 20 bp, human
gagaccaagattccccacca

SEQ ID NO: 123630 - DNA, 20 bp, human
gccacaggggccttcaaagc

SEQ ID NO: 123631 - DNA, 20 bp, human
gctgggcaacctggctctga

SEQ ID NO: 123632 - DNA, 20 bp, human
ggtccaagacgctctgcatt

SEQ ID NO: 123633 - DNA, 20 bp, human
gatccgaatgcagagcgtct

SEQ ID NO: 123634 - DNA, 20 bp, human
gtcatgtagggcttttatta

SEQ ID NO: 123635 - DNA, 20 bp, human
ggtgttctctgccatctatc

SEQ ID NO: 123636 - DNA, 20 bp, human
gccaatttatatgagattgg

SEQ ID NO: 123637 - DNA, 20 bp, human
gtgcacttgtgtggtcactg

SEQ ID NO: 123638 - DNA, 20 bp, human
gctcatataaattggagaca

SEQ ID NO: 123639 - DNA, 20 bp, human
gagtgcaatcatgcccaggt

SEQ ID NO: 123640 - DNA, 20 bp, human
gtctccaatttatatgagat

SEQ ID NO: 123641 - DNA, 20 bp, human
gaatcagtgcaatcatgccc

SEQ ID NO: 123642 - DNA, 20 bp, human
gtggtgactgtgtatagcaa

SEQ ID NO: 123643 - DNA, 20 bp, human
gaaaagacaccagaaaaagt

SEQ ID NO: 123644 - DNA, 20 bp, human
gttttctggtgtctttttac

SEQ ID NO: 123645 - DNA, 20 bp, human
gtacttgttttgcacttgtg

SEQ ID NO: 123646 - DNA, 20 bp, human
gctgcataaattggagacat

SEQ ID NO: 123647 - DNA, 20 bp, human
gtggtcaccatgtacagcag

SEQ ID NO: 123648 - DNA, 20 bp, human
gatgtctcagaagctgcgtg

SEQ ID NO: 123649 - DNA, 20 bp, human
gtgcacatgtggagtcactg

SEQ ID NO: 123650 - DNA, 20 bp, human
gagtgcagtcatgcccagat

SEQ ID NO: 123651 - DNA, 20 bp, human
gccacagaagtagcagcaag

SEQ ID NO: 123652 - DNA, 20 bp, human
gtgctgctacttctgtggga

SEQ ID NO: 123653 - DNA, 20 bp, human
gtctacttgttttgcacatg

SEQ ID NO: 123654 - DNA, 20 bp, human
gctgaggaaaaagtacacgg

SEQ ID NO: 123655 - DNA, 20 bp, human
gtcacgttgttagccaatct

SEQ ID NO: 123656 - DNA, 20 bp, human
gaagaaacccatacatgtaa

SEQ ID NO: 123657 - DNA, 20 bp, human
gcatgtatgggtttcttagt

SEQ ID NO: 123658 - DNA, 20 bp, human
gcactatcccttacatgtat

SEQ ID NO: 123659 - DNA, 20 bp, human
gaatgtctacaaaggagagg

SEQ ID NO: 123660 - DNA, 20 bp, human
gagacagacacagatgttct

SEQ ID NO: 123661 - DNA, 20 bp, human
ggaaatacatgggtgtttgc

SEQ ID NO: 123662 - DNA, 20 bp, human
gtacaaaggagaggtggcca

SEQ ID NO: 123663 - DNA, 20 bp, human
gcgcaaggaataccccaaac

SEQ ID NO: 123664 - DNA, 20 bp, human
gtcctggaactgtaatgcaa

SEQ ID NO: 123665 - DNA, 20 bp, human
gtaaaactcagtgatcacca

SEQ ID NO: 123666 - DNA, 20 bp, human
gatgaaacaaatgccaaatc

SEQ ID NO: 123667 - DNA, 20 bp, human
gattctctctgatccagatt

SEQ ID NO: 123668 - DNA, 20 bp, human
gagagagatgcaaatgttct

SEQ ID NO: 123669 - DNA, 20 bp, human
gatcctgtttggggtgttcc

SEQ ID NO: 123670 - DNA, 20 bp, human
gtcctggaactgtaatgtaa

SEQ ID NO: 123671 - DNA, 20 bp, human
gtacatgggtgtttgcagtt

SEQ ID NO: 123672 - DNA, 20 bp, human
gcgccaggaacaccccaaac

SEQ ID NO: 123673 - DNA, 20 bp, human
ggtaaaactcagtgatcact

SEQ ID NO: 123674 - DNA, 20 bp, human
gtgtgattaggtagatcgcc

SEQ ID NO: 123675 - DNA, 20 bp, human
gtacaaaggagaggtgacca

SEQ ID NO: 123676 - DNA, 20 bp, human
gtagcgcagagggtcatata

SEQ ID NO: 123677 - DNA, 20 bp, human
ggcttgaagagcaaactgtc

SEQ ID NO: 123678 - DNA, 20 bp, human
gcacaaaggctaagttagtg

SEQ ID NO: 123679 - DNA, 20 bp, human
gtaaaactcagtgagtagaa

SEQ ID NO: 123680 - DNA, 20 bp, human
gtctgagaagccatagacat

SEQ ID NO: 123681 - DNA, 20 bp, human
gcacagaattcattttactt

SEQ ID NO: 123682 - DNA, 20 bp, human
ggttgcctagcagggtgacg

SEQ ID NO: 123683 - DNA, 20 bp, human
ggatattagtcgacatctgc

SEQ ID NO: 123684 - DNA, 20 bp, human
gttctcagatggactcttcc

SEQ ID NO: 123685 - DNA, 20 bp, human
gcagtttgctcttcaagcta

SEQ ID NO: 123686 - DNA, 20 bp, human
gtgatagatacatggcaatt

SEQ ID NO: 123687 - DNA, 20 bp, human
ggtggtctacatcatcacca

SEQ ID NO: 123688 - DNA, 20 bp, human
ggtgggcaatatcggcatga

SEQ ID NO: 123689 - DNA, 20 bp, human
gtgtttttttatctgataac

SEQ ID NO: 123690 - DNA, 20 bp, human
gttcttcatcatctttcttg

SEQ ID NO: 123691 - DNA, 20 bp, human
ggctaacgagccgtcgagaa

SEQ ID NO: 123692 - DNA, 20 bp, human
ggagaacttgccattctcga

SEQ ID NO: 123693 - DNA, 20 bp, human
gttgggaatcctctgcttta

SEQ ID NO: 123694 - DNA, 20 bp, human
gtatggcagtaaaatgtcaa

SEQ ID NO: 123695 - DNA, 20 bp, human
gcagaaaaccataaatgtaa

SEQ ID NO: 123696 - DNA, 20 bp, human
gatgagaagaaactgcacgt

SEQ ID NO: 123697 - DNA, 20 bp, human
gccggcgactggtcagtccc

SEQ ID NO: 123698 - DNA, 20 bp, human
gggcatgtggagccaggcgt

SEQ ID NO: 123699 - DNA, 20 bp, human
ggtggagccaggcgttggcc

SEQ ID NO: 123700 - DNA, 20 bp, human
gatttgtaattcccggcgac

SEQ ID NO: 123701 - DNA, 20 bp, human
gaggaaggagcacacactct

SEQ ID NO: 123702 - DNA, 20 bp, human
gatttccttcggtggaagaa

SEQ ID NO: 123703 - DNA, 20 bp, human
gagttcctttcttccaccga

SEQ ID NO: 123704 - DNA, 20 bp, human
gaggaactttacatatatat

SEQ ID NO: 123705 - DNA, 20 bp, human
gtagatctcaacatggacca

SEQ ID NO: 123706 - DNA, 20 bp, human
gacctgtcgtcaggagctac

SEQ ID NO: 123707 - DNA, 20 bp, human
gctgacgacaggtcagcccc

SEQ ID NO: 123708 - DNA, 20 bp, human
gtagacctccacgtggacaa

SEQ ID NO: 123709 - DNA, 20 bp, human
gctgtcacatccgtgaaatt

SEQ ID NO: 123710 - DNA, 20 bp, human
gcacgtggaggtctatatcc

SEQ ID NO: 123711 - DNA, 20 bp, human
gcagcctaatatgcacacta

SEQ ID NO: 123712 - DNA, 20 bp, human
gtctctgtgccttatgtcta

SEQ ID NO: 123713 - DNA, 20 bp, human
gttaggcattgccttagtat

SEQ ID NO: 123714 - DNA, 20 bp, human
gtatgcacactatggactta

SEQ ID NO: 123715 - DNA, 20 bp, human
ggtctaggactgtgtgtgtt

SEQ ID NO: 123716 - DNA, 20 bp, human
ggaatcacaccgctctgacg

SEQ ID NO: 123717 - DNA, 20 bp, human
gaggatgaaccccgtcagag

SEQ ID NO: 123718 - DNA, 20 bp, human
gtggatggcacatccaaggt

SEQ ID NO: 123719 - DNA, 20 bp, human
gagctggacactgacttgtg

SEQ ID NO: 123720 - DNA, 20 bp, human
gaagctggatggcacatcca

SEQ ID NO: 123721 - DNA, 20 bp, human
ggccgctgaaccaagctgga

SEQ ID NO: 123722 - DNA, 20 bp, human
gcgtctcatgaattccctga

SEQ ID NO: 123723 - DNA, 20 bp, human
gcatgaagaggatgactcga

SEQ ID NO: 123724 - DNA, 20 bp, human
gggtgtgacagaagatgaat

SEQ ID NO: 123725 - DNA, 20 bp, human
gagaggatgactcgaaggat

SEQ ID NO: 123726 - DNA, 20 bp, human
gtgcaggtagagtagagcag

SEQ ID NO: 123727 - DNA, 20 bp, human
ggagtctgcatcatcttagt

SEQ ID NO: 123728 - DNA, 20 bp, human
gtagtgggcatgtcctacct

SEQ ID NO: 123729 - DNA, 20 bp, human
gtgggcatgtcctacctggg

SEQ ID NO: 123730 - DNA, 20 bp, human
gggccacacaaccagcaaca

SEQ ID NO: 123731 - DNA, 20 bp, human
gagagtaaactctaccacag

SEQ ID NO: 123732 - DNA, 20 bp, human
gggaagctcatgagcatgac

SEQ ID NO: 123733 - DNA, 20 bp, human
gaccattcccaatatagatg

SEQ ID NO: 123734 - DNA, 20 bp, human
gcaaccagcaacagggagag

SEQ ID NO: 123735 - DNA, 20 bp, human
gaagatgatgcagactccag

SEQ ID NO: 123736 - DNA, 20 bp, human
gagagtctgcattcaactgg

SEQ ID NO: 123737 - DNA, 20 bp, human
gacggaaagtgataacggtg

SEQ ID NO: 123738 - DNA, 20 bp, human
gtctgaaaggaattaccaac

SEQ ID NO: 123739 - DNA, 20 bp, human
gcacagtgctgggcaatctt

SEQ ID NO: 123740 - DNA, 20 bp, human
gccaggaagctgtatatata

SEQ ID NO: 123741 - DNA, 20 bp, human
ggcctgaagctctggccggt

SEQ ID NO: 123742 - DNA, 20 bp, human
ggtgataacggtgtggaaga

SEQ ID NO: 123743 - DNA, 20 bp, human
gagcacggggcctgaagctc

SEQ ID NO: 123744 - DNA, 20 bp, human
gcaaaacctgttaggataaa

SEQ ID NO: 123745 - DNA, 20 bp, human
gtcagtgttgaataatgcag

SEQ ID NO: 123746 - DNA, 20 bp, human
gacgaacatgaggatataat

SEQ ID NO: 123747 - DNA, 20 bp, human
gtgtatagatccatatctga

SEQ ID NO: 123748 - DNA, 20 bp, human
gcactctaataggcaattta

SEQ ID NO: 123749 - DNA, 20 bp, human
gaacaatagctaaaatgtca

SEQ ID NO: 123750 - DNA, 20 bp, human
gtcagggttgccttcagata

SEQ ID NO: 123751 - DNA, 20 bp, human
gtttccaagaaacgaacatg

SEQ ID NO: 123752 - DNA, 20 bp, human
gggctggttgtaccgatcat

SEQ ID NO: 123753 - DNA, 20 bp, human
gtctatctattcactctaat

SEQ ID NO: 123754 - DNA, 20 bp, human
gaccaagaaaatagtacatt

SEQ ID NO: 123755 - DNA, 20 bp, human
gaccgatcattggggatttc

SEQ ID NO: 123756 - DNA, 20 bp, human
gagtgagtggcatgaacaca

SEQ ID NO: 123757 - DNA, 20 bp, human
gcacctgtgctacacatcca

SEQ ID NO: 123758 - DNA, 20 bp, human
ggaggtagattgctagaaac

SEQ ID NO: 123759 - DNA, 20 bp, human
gttccttggatgtgtagcac

SEQ ID NO: 123760 - DNA, 20 bp, human
ggaacaacaccatgactcaa

SEQ ID NO: 123761 - DNA, 20 bp, human
gttaccttatttgtactgaa

SEQ ID NO: 123762 - DNA, 20 bp, human
gatttcccatgagagtgaag

SEQ ID NO: 123763 - DNA, 20 bp, human
gtctacctcttcactctcat

SEQ ID NO: 123764 - DNA, 20 bp, human
gctgattttagtggtcatta

SEQ ID NO: 123765 - DNA, 20 bp, human
gttaacatccccttgagtca

SEQ ID NO: 123766 - DNA, 20 bp, human
ggaatggactccactttcac

SEQ ID NO: 123767 - DNA, 20 bp, human
gcttcagtcttgttcttcag

SEQ ID NO: 123768 - DNA, 20 bp, human
gaaacaaggatacaattgaa

SEQ ID NO: 123769 - DNA, 20 bp, human
gtaccttgataggcaattta

SEQ ID NO: 123770 - DNA, 20 bp, human
gaaatggacaagttgtcatc

SEQ ID NO: 123771 - DNA, 20 bp, human
ggttggtcattgaggattcc

SEQ ID NO: 123772 - DNA, 20 bp, human
ggcacatccgataaatgaaa

SEQ ID NO: 123773 - DNA, 20 bp, human
gaagcctgtcaatataaaca

SEQ ID NO: 123774 - DNA, 20 bp, human
gatcaggtttggatatatac

SEQ ID NO: 123775 - DNA, 20 bp, human
gaatttagggctggttgtgt

SEQ ID NO: 123776 - DNA, 20 bp, human
gtaaagacaggactgtgagg

SEQ ID NO: 123777 - DNA, 20 bp, human
gggttgagctcaagcaggga

SEQ ID NO: 123778 - DNA, 20 bp, human
ggaccctgttctctaaagac

SEQ ID NO: 123779 - DNA, 20 bp, human
ggctgaagacttcagaatgt

SEQ ID NO: 123780 - DNA, 20 bp, human
gatggagaaaagagcagcac

SEQ ID NO: 123781 - DNA, 20 bp, human
gcatgaaaacattagtatga

SEQ ID NO: 123782 - DNA, 20 bp, human
gagaacagggtcgatatttc

SEQ ID NO: 123783 - DNA, 20 bp, human
ggaaagttgctagtgattac

SEQ ID NO: 123784 - DNA, 20 bp, human
gtaacatatcaactgaagct

SEQ ID NO: 123785 - DNA, 20 bp, human
gtattctagagaaatactgc

SEQ ID NO: 123786 - DNA, 20 bp, human
gggaggtgcaccatcatctg

SEQ ID NO: 123787 - DNA, 20 bp, human
gaggaaaccaggcgacatca

SEQ ID NO: 123788 - DNA, 20 bp, human
ggaataactgaataccttaa

SEQ ID NO: 123789 - DNA, 20 bp, human
gagcatgacctgaaaaataa

SEQ ID NO: 123790 - DNA, 20 bp, human
gatatgccattgctgccagt

SEQ ID NO: 123791 - DNA, 20 bp, human
gtgtcgcctggtttcctttc

SEQ ID NO: 123792 - DNA, 20 bp, human
gagcaatgtcccccagatga

SEQ ID NO: 123793 - DNA, 20 bp, human
gatttcttatgtggggtgtg

SEQ ID NO: 123794 - DNA, 20 bp, human
gttctttccatgatgtcgcc

SEQ ID NO: 123795 - DNA, 20 bp, human
gataatacataggtgtatgc

SEQ ID NO: 123796 - DNA, 20 bp, human
ggccaagaatacagcaaata

SEQ ID NO: 123797 - DNA, 20 bp, human
gtgactggggtttatctggt

SEQ ID NO: 123798 - DNA, 20 bp, human
gtgcagagcacagccataga

SEQ ID NO: 123799 - DNA, 20 bp, human
gatggccttgtaccgatcaa

SEQ ID NO: 123800 - DNA, 20 bp, human
gagaacaaggaagaatggac

SEQ ID NO: 123801 - DNA, 20 bp, human
gtgctatctactcttgactg

SEQ ID NO: 123802 - DNA, 20 bp, human
ggttgactgtatagagcagg

SEQ ID NO: 123803 - DNA, 20 bp, human
gacaagtcaatacccttcta

SEQ ID NO: 123804 - DNA, 20 bp, human
gatagggtcactttcatctc

SEQ ID NO: 123805 - DNA, 20 bp, human
gtagagcagggggttgatga

SEQ ID NO: 123806 - DNA, 20 bp, human
gggagtggcggaaccatagt

SEQ ID NO: 123807 - DNA, 20 bp, human
gattggtcgaataccacgta

SEQ ID NO: 123808 - DNA, 20 bp, human
gttaatctggaaatgagcta

SEQ ID NO: 123809 - DNA, 20 bp, human
gtcagtcagcaccaacacat

SEQ ID NO: 123810 - DNA, 20 bp, human
gagctgtccatgatcctgtt

SEQ ID NO: 123811 - DNA, 20 bp, human
gagagtagagagtcttcagt

SEQ ID NO: 123812 - DNA, 20 bp, human
gagatgcttgctggctttgt

SEQ ID NO: 123813 - DNA, 20 bp, human
gcaaacaatagtacctgtag

SEQ ID NO: 123814 - DNA, 20 bp, human
gacccagcctttctcttaat

SEQ ID NO: 123815 - DNA, 20 bp, human
ggtaagagagaccaatgaca

SEQ ID NO: 123816 - DNA, 20 bp, human
gtatggttgggtagtggagt

SEQ ID NO: 123817 - DNA, 20 bp, human
gactccatattggagacaca

SEQ ID NO: 123818 - DNA, 20 bp, human
ggtctccaagaaggacaggt

SEQ ID NO: 123819 - DNA, 20 bp, human
gcccatggctcattatggtt

SEQ ID NO: 123820 - DNA, 20 bp, human
gaagccctgtgtctccaata

SEQ ID NO: 123821 - DNA, 20 bp, human
gccaggtctccaagaaggac

SEQ ID NO: 123822 - DNA, 20 bp, human
gatgtaccaggtctccaaga

SEQ ID NO: 123823 - DNA, 20 bp, human
ggaacttggtgactcgtgtc

SEQ ID NO: 123824 - DNA, 20 bp, human
ggtggcctatattctgacag

SEQ ID NO: 123825 - DNA, 20 bp, human
gcctgggagcttgagtatgc

SEQ ID NO: 123826 - DNA, 20 bp, human
gaggatgaaggtgctgacct

SEQ ID NO: 123827 - DNA, 20 bp, human
gggtgctgctccagacgatg

SEQ ID NO: 123828 - DNA, 20 bp, human
gatcctggtgggcctcccca

SEQ ID NO: 123829 - DNA, 20 bp, human
gagacacgtaccagatctcc

SEQ ID NO: 123830 - DNA, 20 bp, human
gggccatcatcctcatcgtc

SEQ ID NO: 123831 - DNA, 20 bp, human
gcatgtctttcctggagatc

SEQ ID NO: 123832 - DNA, 20 bp, human
gccccggggtcacaaggacg

SEQ ID NO: 123833 - DNA, 20 bp, human
ggacgtggtagcgcagcggg

SEQ ID NO: 123834 - DNA, 20 bp, human
gcaagcacagaggcatgagt

SEQ ID NO: 123835 - DNA, 20 bp, human
gcaaggacgtggtagcgcag

SEQ ID NO: 123836 - DNA, 20 bp, human
gaggatgaaggtgccgaccc

SEQ ID NO: 123837 - DNA, 20 bp, human
gggagaagcccaccagctgg

SEQ ID NO: 123838 - DNA, 20 bp, human
gatggtgaagccactcacaa

SEQ ID NO: 123839 - DNA, 20 bp, human
gtgggcttctcctttgtgag

SEQ ID NO: 123840 - DNA, 20 bp, human
gaaaggagaagcccaccagc

SEQ ID NO: 123841 - DNA, 20 bp, human
gataaaacagaccttgatca

SEQ ID NO: 123842 - DNA, 20 bp, human
gttcaccatctccatgatca

SEQ ID NO: 123843 - DNA, 20 bp, human
ggggagaatgtcaccagggt

SEQ ID NO: 123844 - DNA, 20 bp, human
gggtgctgctccagacggtg

SEQ ID NO: 123845 - DNA, 20 bp, human
gagacacgtaccagatctct

SEQ ID NO: 123846 - DNA, 20 bp, human
gtgatactcaagcaatgcag

SEQ ID NO: 123847 - DNA, 20 bp, human
gagaaacttgggtatactga

SEQ ID NO: 123848 - DNA, 20 bp, human
gtaatgttacccagaaactt

SEQ ID NO: 123849 - DNA, 20 bp, human
gaaactctgttatttctgta

SEQ ID NO: 123850 - DNA, 20 bp, human
gcagcagggtaattgtgata

SEQ ID NO: 123851 - DNA, 20 bp, human
ggagcatgtaggtgatgagc

SEQ ID NO: 123852 - DNA, 20 bp, human
gggtaattgtgataagggtc

SEQ ID NO: 123853 - DNA, 20 bp, human
ggtgaacgaaatttctaata

SEQ ID NO: 123854 - DNA, 20 bp, human
gttctgggtaacattatttc

SEQ ID NO: 123855 - DNA, 20 bp, human
gcttgtttttacttcttggc

SEQ ID NO: 123856 - DNA, 20 bp, human
gttatcctgctgggactgac

SEQ ID NO: 123857 - DNA, 20 bp, human
gaagcagaacttgcaggtgt

SEQ ID NO: 123858 - DNA, 20 bp, human
gttagttctctgctgttggg

SEQ ID NO: 123859 - DNA, 20 bp, human
gtgactggcacaagcattgt

SEQ ID NO: 123860 - DNA, 20 bp, human
ggtggtcatcatgaacaaca

SEQ ID NO: 123861 - DNA, 20 bp, human
gtggtggtccaccaatgtga

SEQ ID NO: 123862 - DNA, 20 bp, human
ggcacaagcattgtaggtaa

SEQ ID NO: 123863 - DNA, 20 bp, human
gtgtgagggtgataatagtc

SEQ ID NO: 123864 - DNA, 20 bp, human
gttattagttctctgctgtt

SEQ ID NO: 123865 - DNA, 20 bp, human
gatatattgtacaagaatct

SEQ ID NO: 123866 - DNA, 20 bp, human
gatcatcagaaaggcccagg

SEQ ID NO: 123867 - DNA, 20 bp, human
gcagctggaggagaagcata

SEQ ID NO: 123868 - DNA, 20 bp, human
gaggatcatcagaaaggccc

SEQ ID NO: 123869 - DNA, 20 bp, human
ggctgtgtgcctggctaagt

SEQ ID NO: 123870 - DNA, 20 bp, human
ggagaaaaatcacaatctga

SEQ ID NO: 123871 - DNA, 20 bp, human
ggaggagaagcataaggggt

SEQ ID NO: 123872 - DNA, 20 bp, human
ggtcagaaacccacttagcc

SEQ ID NO: 123873 - DNA, 20 bp, human
gtaagaaagagaagttccgg

SEQ ID NO: 123874 - DNA, 20 bp, human
gtgggagtccacaaaggtta

SEQ ID NO: 123875 - DNA, 20 bp, human
gaaactctgtgaccattgtg

SEQ ID NO: 123876 - DNA, 20 bp, human
gtgaccttcggaaaacctaa

SEQ ID NO: 123877 - DNA, 20 bp, human
gtaatagtcaggtaatgcaa

SEQ ID NO: 123878 - DNA, 20 bp, human
gtcatgctggtcagaaatct

SEQ ID NO: 123879 - DNA, 20 bp, human
gagaataaactcaccaaaca

SEQ ID NO: 123880 - DNA, 20 bp, human
gtaacgatcataagacatgg

SEQ ID NO: 123881 - DNA, 20 bp, human
gtagtgttctgctcctggtt

SEQ ID NO: 123882 - DNA, 20 bp, human
gtgggggtctagtaaggtga

SEQ ID NO: 123883 - DNA, 20 bp, human
gtgttctgctcctggttggg

SEQ ID NO: 123884 - DNA, 20 bp, human
gtctgctgctcataatagtc

SEQ ID NO: 123885 - DNA, 20 bp, human
ggatacttagcatgtaggtg

SEQ ID NO: 123886 - DNA, 20 bp, human
gccaagagctaagtacaagt

SEQ ID NO: 123887 - DNA, 20 bp, human
gtgggtcatctgtcaatcct

SEQ ID NO: 123888 - DNA, 20 bp, human
gctacaccttgagcctgatg

SEQ ID NO: 123889 - DNA, 20 bp, human
gaaatagagttcattctcct

SEQ ID NO: 123890 - DNA, 20 bp, human
gggtaaaactcagtaactcc

SEQ ID NO: 123891 - DNA, 20 bp, human
gcctcaccctgctggatccc

SEQ ID NO: 123892 - DNA, 20 bp, human
gttgagccggggatccagca

SEQ ID NO: 123893 - DNA, 20 bp, human
gtttgcagatggcaacgtag

SEQ ID NO: 123894 - DNA, 20 bp, human
gaagttccccatcaggctca

SEQ ID NO: 123895 - DNA, 20 bp, human
ggttttgtctctagtcacaa

SEQ ID NO: 123896 - DNA, 20 bp, human
gtgggccatggaagcattat

SEQ ID NO: 123897 - DNA, 20 bp, human
gctctaattgatgtcatatt

SEQ ID NO: 123898 - DNA, 20 bp, human
gatggaagcattataggaaa

SEQ ID NO: 123899 - DNA, 20 bp, human
gttctgatcaacattgctac

SEQ ID NO: 123900 - DNA, 20 bp, human
gattgatgtcatatttggca

SEQ ID NO: 123901 - DNA, 20 bp, human
gaaaaaaaatacttgggcca

SEQ ID NO: 123902 - DNA, 20 bp, human
gtatcacaacttgtaactct

SEQ ID NO: 123903 - DNA, 20 bp, human
gcttagttctgaattctgat

SEQ ID NO: 123904 - DNA, 20 bp, human
gtaagaaagagaaattcctg

SEQ ID NO: 123905 - DNA, 20 bp, human
gcatacttattgagtgtaag

SEQ ID NO: 123906 - DNA, 20 bp, human
gaaaacctaagctaagtggt

SEQ ID NO: 123907 - DNA, 20 bp, human
gacctaagctaagtggtggg

SEQ ID NO: 123908 - DNA, 20 bp, human
gatcttctgtcagtcccaga

SEQ ID NO: 123909 - DNA, 20 bp, human
gaacatggtgagggcgataa

SEQ ID NO: 123910 - DNA, 20 bp, human
gtataagaatcttggaacac

SEQ ID NO: 123911 - DNA, 20 bp, human
gtaacaacattcatccttct

SEQ ID NO: 123912 - DNA, 20 bp, human
gttcaggtggggatccaaca

SEQ ID NO: 123913 - DNA, 20 bp, human
gtggggatccaacatggtga

SEQ ID NO: 123914 - DNA, 20 bp, human
gtgattgccatataatgcaa

SEQ ID NO: 123915 - DNA, 20 bp, human
gagatactgtataagaatct

SEQ ID NO: 123916 - DNA, 20 bp, human
gagaaatgaagaatcataca

SEQ ID NO: 123917 - DNA, 20 bp, human
gagttaagacctaaaatcag

SEQ ID NO: 123918 - DNA, 20 bp, human
gtgatggacatataacgcaa

SEQ ID NO: 123919 - DNA, 20 bp, human
gcaatggtgattaggaatct

SEQ ID NO: 123920 - DNA, 20 bp, human
gtttattcttctgggactga

SEQ ID NO: 123921 - DNA, 20 bp, human
gataggacagagcagctaga

SEQ ID NO: 123922 - DNA, 20 bp, human
gttgtgtgttgagcatgata

SEQ ID NO: 123923 - DNA, 20 bp, human
gcctggtaacaatggtgatt

SEQ ID NO: 123924 - DNA, 20 bp, human
ggtcttttccctggtaacaa

SEQ ID NO: 123925 - DNA, 20 bp, human
gcagaaaagagaaattacgg

SEQ ID NO: 123926 - DNA, 20 bp, human
gggtagcaatgtctttatgg

SEQ ID NO: 123927 - DNA, 20 bp, human
gccagtgatgctcaacatgt

SEQ ID NO: 123928 - DNA, 20 bp, human
gggtggatttcaagaaaaat

SEQ ID NO: 123929 - DNA, 20 bp, human
gttgagatgcaaatccagta

SEQ ID NO: 123930 - DNA, 20 bp, human
gagaaaaattagaacagaag

SEQ ID NO: 123931 - DNA, 20 bp, human
gtttttcactattctcttgg

SEQ ID NO: 123932 - DNA, 20 bp, human
gaaagtttgctactgttgta

SEQ ID NO: 123933 - DNA, 20 bp, human
ggtgggtagcaatgtcttta

SEQ ID NO: 123934 - DNA, 20 bp, human
gatcatcactctcaccctac

SEQ ID NO: 123935 - DNA, 20 bp, human
ggcacaatcgttgtaagaaa

SEQ ID NO: 123936 - DNA, 20 bp, human
gcaggagctaaagacaagaa

SEQ ID NO: 123937 - DNA, 20 bp, human
gacaagaagggtacacactc

SEQ ID NO: 123938 - DNA, 20 bp, human
gactgcagcagaagcattac

SEQ ID NO: 123939 - DNA, 20 bp, human
gccagtcacacttaacatgt

SEQ ID NO: 123940 - DNA, 20 bp, human
gggtgagggtgataatgatc

SEQ ID NO: 123941 - DNA, 20 bp, human
gcaggaatgagaagttccga

SEQ ID NO: 123942 - DNA, 20 bp, human
gataaagtctgttactgctg

SEQ ID NO: 123943 - DNA, 20 bp, human
gtccttgtcactgttgtgac

SEQ ID NO: 123944 - DNA, 20 bp, human
gagacgtgaatgaaatttcc

SEQ ID NO: 123945 - DNA, 20 bp, human
gatttcttataatgggtgtg

SEQ ID NO: 123946 - DNA, 20 bp, human
ggctgtaagcccatggccag

SEQ ID NO: 123947 - DNA, 20 bp, human
gattatccgtcagacccaga

SEQ ID NO: 123948 - DNA, 20 bp, human
gcagatcctgtcactcatga

SEQ ID NO: 123949 - DNA, 20 bp, human
gaaatccagctgtaagccca

SEQ ID NO: 123950 - DNA, 20 bp, human
gacggataatccgcaactgc

SEQ ID NO: 123951 - DNA, 20 bp, human
gcagtacatacgtaagaaat

SEQ ID NO: 123952 - DNA, 20 bp, human
ggtgggaatccagcagggta

SEQ ID NO: 123953 - DNA, 20 bp, human
gttcatccttctgggtctga

SEQ ID NO: 123954 - DNA, 20 bp, human
gctgatcagcattctaacag

SEQ ID NO: 123955 - DNA, 20 bp, human
ggcacaagcattataagata

SEQ ID NO: 123956 - DNA, 20 bp, human
gtcagtaccacaatggacac

SEQ ID NO: 123957 - DNA, 20 bp, human
gatagcagatggcaagacag

SEQ ID NO: 123958 - DNA, 20 bp, human
ggagagcaggctactcatga

SEQ ID NO: 123959 - DNA, 20 bp, human
gtgatggctccgtagtgtaa

SEQ ID NO: 123960 - DNA, 20 bp, human
gtagtgtaaaggatagcaga

SEQ ID NO: 123961 - DNA, 20 bp, human
gggttaaagggctcagtgcg

SEQ ID NO: 123962 - DNA, 20 bp, human
gttgttgcctgtgtccattg

SEQ ID NO: 123963 - DNA, 20 bp, human
gggggtatgcaactgatggg

SEQ ID NO: 123964 - DNA, 20 bp, human
gatgggggtatgcaactgat

SEQ ID NO: 123965 - DNA, 20 bp, human
gggcaacaaaactctgcccc

SEQ ID NO: 123966 - DNA, 20 bp, human
gcctgaatggtggttcgatt

SEQ ID NO: 123967 - DNA, 20 bp, human
ggctgcatatggccaggtag

SEQ ID NO: 123968 - DNA, 20 bp, human
gtgcactcaagccttctagg

SEQ ID NO: 123969 - DNA, 20 bp, human
ggatagagggataatgaaga

SEQ ID NO: 123970 - DNA, 20 bp, human
gagcttgggggtcatgatag

SEQ ID NO: 123971 - DNA, 20 bp, human
gagacttaacccaggaataa

SEQ ID NO: 123972 - DNA, 20 bp, human
gcagcaacttaaagtcagtt

SEQ ID NO: 123973 - DNA, 20 bp, human
gtaatgaagagggctgcata

SEQ ID NO: 123974 - DNA, 20 bp, human
gaagataaactcctgaatgg

SEQ ID NO: 123975 - DNA, 20 bp, human
gaagagggctgcatatggcc

SEQ ID NO: 123976 - DNA, 20 bp, human
gggtagctctactagaaata

SEQ ID NO: 123977 - DNA, 20 bp, human
gcaggataaggaaaccgaag

SEQ ID NO: 123978 - DNA, 20 bp, human
ggattccctcagcttcagga

SEQ ID NO: 123979 - DNA, 20 bp, human
gactaccatcctgaagctga

SEQ ID NO: 123980 - DNA, 20 bp, human
gctactagaaatatggagag

SEQ ID NO: 123981 - DNA, 20 bp, human
gtggaaatcatcacaatctc

SEQ ID NO: 123982 - DNA, 20 bp, human
gataaggaaaccgaagaggc

SEQ ID NO: 123983 - DNA, 20 bp, human
gagaaggccatctcaatgac

SEQ ID NO: 123984 - DNA, 20 bp, human
gtctgtgctcaactctctgc

SEQ ID NO: 123985 - DNA, 20 bp, human
gtgactgaatttatcttcac

SEQ ID NO: 123986 - DNA, 20 bp, human
ggccagtgggaatcagacaa

SEQ ID NO: 123987 - DNA, 20 bp, human
gttaggcaggacagcatctt

SEQ ID NO: 123988 - DNA, 20 bp, human
gtcccgcatgcgcacagagg

SEQ ID NO: 123989 - DNA, 20 bp, human
gatccgtagatgagaagcaa

SEQ ID NO: 123990 - DNA, 20 bp, human
gtgttcccgcatgcgcacag

SEQ ID NO: 123991 - DNA, 20 bp, human
gtgttcattgtcatccaggt

SEQ ID NO: 123992 - DNA, 20 bp, human
ggacacagttgacggccagt

SEQ ID NO: 123993 - DNA, 20 bp, human
gttctgctcactgattaggc

SEQ ID NO: 123994 - DNA, 20 bp, human
gttcccttgcttctcatcta

SEQ ID NO: 123995 - DNA, 20 bp, human
gtcagatgattttggcatgg

SEQ ID NO: 123996 - DNA, 20 bp, human
gagagctgggaaggcaatta

SEQ ID NO: 123997 - DNA, 20 bp, human
gcatgacaactactatatgg

SEQ ID NO: 123998 - DNA, 20 bp, human
ggcatcccagaaccagcaga

SEQ ID NO: 123999 - DNA, 20 bp, human
gtcccatgacaactactata

SEQ ID NO: 124000 - DNA, 20 bp, human
gagtagttgtcatgggaaac

SEQ ID NO: 124001 - DNA, 20 bp, human
gggaggcaggccaacaactt

SEQ ID NO: 124002 - DNA, 20 bp, human
gaactactatatggtgggca

SEQ ID NO: 124003 - DNA, 20 bp, human
ggagagatattcgaatctcc

SEQ ID NO: 124004 - DNA, 20 bp, human
gtccctgaagaaacaagaaa

SEQ ID NO: 124005 - DNA, 20 bp, human
gttcgaatctccaggagagc

SEQ ID NO: 124006 - DNA, 20 bp, human
gatggtgagcaatggacaca

SEQ ID NO: 124007 - DNA, 20 bp, human
gtcacatctagggacatgaa

SEQ ID NO: 124008 - DNA, 20 bp, human
gagcaatggacacagggaac

SEQ ID NO: 124009 - DNA, 20 bp, human
gatctggacaccctggagat

SEQ ID NO: 124010 - DNA, 20 bp, human
ggacagctatggcctacgat

SEQ ID NO: 124011 - DNA, 20 bp, human
gcaaagtgttggggtcatga

SEQ ID NO: 124012 - DNA, 20 bp, human
ggatgatgaattctgctacc

SEQ ID NO: 124013 - DNA, 20 bp, human
gatgtgaagtgtggaaggat

SEQ ID NO: 124014 - DNA, 20 bp, human
gatggctaaatacctatcgt

SEQ ID NO: 124015 - DNA, 20 bp, human
ggagataaatctggacaccc

SEQ ID NO: 124016 - DNA, 20 bp, human
ggccagtgtgggctatgtca

SEQ ID NO: 124017 - DNA, 20 bp, human
ggcccacactggcaaagcca

SEQ ID NO: 124018 - DNA, 20 bp, human
ggccatcttggcacagagtg

SEQ ID NO: 124019 - DNA, 20 bp, human
gatcttggcacagagtgtgg

SEQ ID NO: 124020 - DNA, 20 bp, human
gggttgtattgatccatggg

SEQ ID NO: 124021 - DNA, 20 bp, human
ggaagaagtaggtctgaagg

SEQ ID NO: 124022 - DNA, 20 bp, human
gtgggaggctgaggtaaaga

SEQ ID NO: 124023 - DNA, 20 bp, human
gtccttggctttgccagtgt

SEQ ID NO: 124024 - DNA, 20 bp, human
gtgtggtggtcataattata

SEQ ID NO: 124025 - DNA, 20 bp, human
gttcagacgctcccaaggag

SEQ ID NO: 124026 - DNA, 20 bp, human
gaagaagccactgccccaag

SEQ ID NO: 124027 - DNA, 20 bp, human
gtaggagactctaccatcct

SEQ ID NO: 124028 - DNA, 20 bp, human
gaggcatgagactagggtaa

SEQ ID NO: 124029 - DNA, 20 bp, human
ggaggcagcagcaaggcgag

SEQ ID NO: 124030 - DNA, 20 bp, human
ggcaaggcgagtggccagac

SEQ ID NO: 124031 - DNA, 20 bp, human
gatgagactagggtaaagga

SEQ ID NO: 124032 - DNA, 20 bp, human
gtcgaggagtttgtcttggt

SEQ ID NO: 124033 - DNA, 20 bp, human
ggagccatgagaaatttgag

SEQ ID NO: 124034 - DNA, 20 bp, human
ggctgccaagagccgaggaa

SEQ ID NO: 124035 - DNA, 20 bp, human
gcaagacaaactcctcgaca

SEQ ID NO: 124036 - DNA, 20 bp, human
gggacacaaaagccccatag

SEQ ID NO: 124037 - DNA, 20 bp, human
gcaaaagccccatagtggag

SEQ ID NO: 124038 - DNA, 20 bp, human
gtataccaaaaactggaccc

SEQ ID NO: 124039 - DNA, 20 bp, human
gtgtatgcctctccactatg

SEQ ID NO: 124040 - DNA, 20 bp, human
gtggggcacctgcatccgtc

SEQ ID NO: 124041 - DNA, 20 bp, human
gaggaaacctaccagccaac

SEQ ID NO: 124042 - DNA, 20 bp, human
gtggtatatggttgcatatg

SEQ ID NO: 124043 - DNA, 20 bp, human
gtagtggagaggcatacaaa

SEQ ID NO: 124044 - DNA, 20 bp, human
gcagctgcctgttggctggt

SEQ ID NO: 124045 - DNA, 20 bp, human
gaccaaggtgaacaggtaca

SEQ ID NO: 124046 - DNA, 20 bp, human
gctgccaggacgaactctgt

SEQ ID NO: 124047 - DNA, 20 bp, human
ggatccaacagagttcgtcc

SEQ ID NO: 124048 - DNA, 20 bp, human
ggctaccccttgctcatgag

SEQ ID NO: 124049 - DNA, 20 bp, human
gcagccccactcatgagcaa

SEQ ID NO: 124050 - DNA, 20 bp, human
ggccaacagtaagaactcgg

SEQ ID NO: 124051 - DNA, 20 bp, human
gaaagacaatgagtcctgat

SEQ ID NO: 124052 - DNA, 20 bp, human
gagaagtgagcagtatctct

SEQ ID NO: 124053 - DNA, 20 bp, human
gaatctcaacagcgcaagag

SEQ ID NO: 124054 - DNA, 20 bp, human
ggcctccgagttcttactgt

SEQ ID NO: 124055 - DNA, 20 bp, human
gcgtgtggccttggcctgct

SEQ ID NO: 124056 - DNA, 20 bp, human
gcaggaggccagcactagtt

SEQ ID NO: 124057 - DNA, 20 bp, human
gtcagggtctcatagcggag

SEQ ID NO: 124058 - DNA, 20 bp, human
gggtctcatagcggagtggt

SEQ ID NO: 124059 - DNA, 20 bp, human
gggtgcctagaaagaagtag

SEQ ID NO: 124060 - DNA, 20 bp, human
gaaccctgaaaactggactc

SEQ ID NO: 124061 - DNA, 20 bp, human
ggaacaccaggaactgtatg

SEQ ID NO: 124062 - DNA, 20 bp, human
gcactagttgggaacagaca

SEQ ID NO: 124063 - DNA, 20 bp, human
ggctatgagaccctgatgaa

SEQ ID NO: 124064 - DNA, 20 bp, human
gcagacatggccattcatca

SEQ ID NO: 124065 - DNA, 20 bp, human
gcctagaaagaagtagaggt

SEQ ID NO: 124066 - DNA, 20 bp, human
gtgggtaccatggctaggaa

SEQ ID NO: 124067 - DNA, 20 bp, human
gccaagaggacaaattcgga

SEQ ID NO: 124068 - DNA, 20 bp, human
gagtgccatagcgcagtggg

SEQ ID NO: 124069 - DNA, 20 bp, human
gacaggtctgagagcatcct

SEQ ID NO: 124070 - DNA, 20 bp, human
ggacagtgggtaccatggct

SEQ ID NO: 124071 - DNA, 20 bp, human
gaggaaggggccatacagaa

SEQ ID NO: 124072 - DNA, 20 bp, human
gggccccatactgtggatca

SEQ ID NO: 124073 - DNA, 20 bp, human
gtctgccacccactgcgcta

SEQ ID NO: 124074 - DNA, 20 bp, human
ggaggacaaattcggagggc

SEQ ID NO: 124075 - DNA, 20 bp, human
gcagagtgccatagcgcagt

SEQ ID NO: 124076 - DNA, 20 bp, human
gtatcaagggacatgagaaa

SEQ ID NO: 124077 - DNA, 20 bp, human
gtgtctttctagggtatcaa

SEQ ID NO: 124078 - DNA, 20 bp, human
ggtgaggatcaagaactcgg

SEQ ID NO: 124079 - DNA, 20 bp, human
gctgctaggaacctttgtag

SEQ ID NO: 124080 - DNA, 20 bp, human
gtgatggtggggtggtgaag

SEQ ID NO: 124081 - DNA, 20 bp, human
gatagtgaggatcaagaact

SEQ ID NO: 124082 - DNA, 20 bp, human
ggataacaggaaagcctagc

SEQ ID NO: 124083 - DNA, 20 bp, human
gcctgcaagggttaatatgt

SEQ ID NO: 124084 - DNA, 20 bp, human
gccttcttccacttcttcgt

SEQ ID NO: 124085 - DNA, 20 bp, human
gtaagaaagacaagttacaa

SEQ ID NO: 124086 - DNA, 20 bp, human
gtctgtggcacactggctgg

SEQ ID NO: 124087 - DNA, 20 bp, human
gtcatgaccaaccagctctg

SEQ ID NO: 124088 - DNA, 20 bp, human
ggctggaaggctggtcgtgt

SEQ ID NO: 124089 - DNA, 20 bp, human
gatgtactcagtgcagacaa

SEQ ID NO: 124090 - DNA, 20 bp, human
ggctggttggtcatgatgac

SEQ ID NO: 124091 - DNA, 20 bp, human
gagctctgtggcacactggc

SEQ ID NO: 124092 - DNA, 20 bp, human
gcacactggctggaggatgc

SEQ ID NO: 124093 - DNA, 20 bp, human
gtagcgtagtggattacaaa

SEQ ID NO: 124094 - DNA, 20 bp, human
gggaagtcaacaagcatctt

SEQ ID NO: 124095 - DNA, 20 bp, human
gtggtggtcatgactggctg

SEQ ID NO: 124096 - DNA, 20 bp, human
gtcagaggaaccagaattgc

SEQ ID NO: 124097 - DNA, 20 bp, human
gaacttccttctgaccgtga

SEQ ID NO: 124098 - DNA, 20 bp, human
gattttagaatttcttctcc

SEQ ID NO: 124099 - DNA, 20 bp, human
gttcttactctttgtaggat

SEQ ID NO: 124100 - DNA, 20 bp, human
ggctttttcttactctttgt

SEQ ID NO: 124101 - DNA, 20 bp, human
gaatgaccatgtagtgcaga

SEQ ID NO: 124102 - DNA, 20 bp, human
gacaaaacagatgtctacga

SEQ ID NO: 124103 - DNA, 20 bp, human
gataggccatcacggtcaga

SEQ ID NO: 124104 - DNA, 20 bp, human
ggatgactttgttgtgtgtc

SEQ ID NO: 124105 - DNA, 20 bp, human
gtggttcctctgaaattccc

SEQ ID NO: 124106 - DNA, 20 bp, human
ggggttagacagcttactcc

SEQ ID NO: 124107 - DNA, 20 bp, human
gttatttattaacatagaca

SEQ ID NO: 124108 - DNA, 20 bp, human
gggaaccagagaatgacaca

SEQ ID NO: 124109 - DNA, 20 bp, human
ggttcttctgggactttctg

SEQ ID NO: 124110 - DNA, 20 bp, human
gaacgctggtctgaacctcc

SEQ ID NO: 124111 - DNA, 20 bp, human
gaaatccctgtgtcattctc

SEQ ID NO: 124112 - DNA, 20 bp, human
gatttcagaatttgttcttc

SEQ ID NO: 124113 - DNA, 20 bp, human
gagcatctttgggattgtag

SEQ ID NO: 124114 - DNA, 20 bp, human
gcttttttgtactttttgga

SEQ ID NO: 124115 - DNA, 20 bp, human
gggatgttaatgagcatctt

SEQ ID NO: 124116 - DNA, 20 bp, human
gctcactggatgattgatgg

SEQ ID NO: 124117 - DNA, 20 bp, human
gcccaattagaaggaatagg

SEQ ID NO: 124118 - DNA, 20 bp, human
gccaggaggggatctctccg

SEQ ID NO: 124119 - DNA, 20 bp, human
ggtaagtgcaaattcctcac

SEQ ID NO: 124120 - DNA, 20 bp, human
gctctccaactcaccaggag

SEQ ID NO: 124121 - DNA, 20 bp, human
ggagtagagaaatcgtgtat

SEQ ID NO: 124122 - DNA, 20 bp, human
gttcctcactggatgattga

SEQ ID NO: 124123 - DNA, 20 bp, human
gactgaactaggcaatgcaa

SEQ ID NO: 124124 - DNA, 20 bp, human
gtacacaaggaactcttcct

SEQ ID NO: 124125 - DNA, 20 bp, human
ggtgagttggagagcccagt

SEQ ID NO: 124126 - DNA, 20 bp, human
gtgagaagccaggctataga

SEQ ID NO: 124127 - DNA, 20 bp, human
ggaatccctggtcagaccta

SEQ ID NO: 124128 - DNA, 20 bp, human
gaacaaagagcatcctgtaa

SEQ ID NO: 124129 - DNA, 20 bp, human
gcccgatggtagcaaagaaa

SEQ ID NO: 124130 - DNA, 20 bp, human
ggaatccgtaggtctgacca

SEQ ID NO: 124131 - DNA, 20 bp, human
ggtctgcagctcgcctttac

SEQ ID NO: 124132 - DNA, 20 bp, human
gctacatttccagatcccga

SEQ ID NO: 124133 - DNA, 20 bp, human
gatgtagattctgaatccgt

SEQ ID NO: 124134 - DNA, 20 bp, human
gatagagggtacaagtatta

SEQ ID NO: 124135 - DNA, 20 bp, human
gtccttttctttgctaccat

SEQ ID NO: 124136 - DNA, 20 bp, human
ggtcctctgcgaatcccagg

SEQ ID NO: 124137 - DNA, 20 bp, human
gctcctcctgggattcgcag

SEQ ID NO: 124138 - DNA, 20 bp, human
gccagcggccccatggaaag

SEQ ID NO: 124139 - DNA, 20 bp, human
gagagtcctctgcgaatccc

SEQ ID NO: 124140 - DNA, 20 bp, human
ggccgctgggtttgccgaga

SEQ ID NO: 124141 - DNA, 20 bp, human
ggtgaaacagatgtcagcaa

SEQ ID NO: 124142 - DNA, 20 bp, human
gtgtacctggttaccatcat

SEQ ID NO: 124143 - DNA, 20 bp, human
gtgagaccttgaccattttg

SEQ ID NO: 124144 - DNA, 20 bp, human
ggtttccgatgatggtaacc

SEQ ID NO: 124145 - DNA, 20 bp, human
ggtttggtttcctctttcca

SEQ ID NO: 124146 - DNA, 20 bp, human
gtgtgtgaggcagtccatgt

SEQ ID NO: 124147 - DNA, 20 bp, human
gggaacagcccaaatatgaa

SEQ ID NO: 124148 - DNA, 20 bp, human
gatccttctcggactctctg

SEQ ID NO: 124149 - DNA, 20 bp, human
gatcctcagagagtccgaga

SEQ ID NO: 124150 - DNA, 20 bp, human
gctgaaacagatgtcaaccc

SEQ ID NO: 124151 - DNA, 20 bp, human
gccctgcagttgcaaattcc

SEQ ID NO: 124152 - DNA, 20 bp, human
gtgtagatacatcagctaca

SEQ ID NO: 124153 - DNA, 20 bp, human
gacatcagctacatggaagc

SEQ ID NO: 124154 - DNA, 20 bp, human
gactacagccgttcatattt

SEQ ID NO: 124155 - DNA, 20 bp, human
gggagaaatagacctgtgtg

SEQ ID NO: 124156 - DNA, 20 bp, human
gttatcaaaatttctcctcc

SEQ ID NO: 124157 - DNA, 20 bp, human
ggtagctgttgtgtctgctg

SEQ ID NO: 124158 - DNA, 20 bp, human
gaagatgctagtgagcatcc

SEQ ID NO: 124159 - DNA, 20 bp, human
gataggccatcacggccagt

SEQ ID NO: 124160 - DNA, 20 bp, human
gccaggaggccacagaggca

SEQ ID NO: 124161 - DNA, 20 bp, human
gtgagtgaggcaccccatgt

SEQ ID NO: 124162 - DNA, 20 bp, human
gccaagatgccagaaccagg

SEQ ID NO: 124163 - DNA, 20 bp, human
ggaaccaagatgccagaacc

SEQ ID NO: 124164 - DNA, 20 bp, human
gatgaaacagatgtcaacaa

SEQ ID NO: 124165 - DNA, 20 bp, human
ggctagtgagcatccaggca

SEQ ID NO: 124166 - DNA, 20 bp, human
gaagtaactctaaggaaatt

SEQ ID NO: 124167 - DNA, 20 bp, human
gagaaattaagttttcacat

SEQ ID NO: 124168 - DNA, 20 bp, human
gtctgtggctctgtgtagct

SEQ ID NO: 124169 - DNA, 20 bp, human
ggtagctcggacaccttttg

SEQ ID NO: 124170 - DNA, 20 bp, human
gctttttttttttcctcaaa

SEQ ID NO: 124171 - DNA, 20 bp, human
gtgagtcaggcagccttcat

SEQ ID NO: 124172 - DNA, 20 bp, human
gtagacacagtgctagatgc

SEQ ID NO: 124173 - DNA, 20 bp, human
gcaactgagaactattgctg

SEQ ID NO: 124174 - DNA, 20 bp, human
gtagcactgtgtctatattt

SEQ ID NO: 124175 - DNA, 20 bp, human
gaaaaagagaattggaaaat

SEQ ID NO: 124176 - DNA, 20 bp, human
gaccatcagactctgaacca

SEQ ID NO: 124177 - DNA, 20 bp, human
gcttctcatgaaagtgacag

SEQ ID NO: 124178 - DNA, 20 bp, human
ggactgtgtacctcagtggg

SEQ ID NO: 124179 - DNA, 20 bp, human
gaccaagacaagacagatct

SEQ ID NO: 124180 - DNA, 20 bp, human
gaagggattaacttcagttc

SEQ ID NO: 124181 - DNA, 20 bp, human
gccagaaatggacattcatg

SEQ ID NO: 124182 - DNA, 20 bp, human
gtccatgttcatgagcacta

SEQ ID NO: 124183 - DNA, 20 bp, human
ggttaaacagatgtcagtaa

SEQ ID NO: 124184 - DNA, 20 bp, human
gatgagcactatggatgccc

SEQ ID NO: 124185 - DNA, 20 bp, human
ggacagccaggagaatgagc

SEQ ID NO: 124186 - DNA, 20 bp, human
gctgtaagcagcagctgcat

SEQ ID NO: 124187 - DNA, 20 bp, human
ggatgactgtgtatctaagg

SEQ ID NO: 124188 - DNA, 20 bp, human
gggaacaggctgaaaaggac

SEQ ID NO: 124189 - DNA, 20 bp, human
gcttctcctgggactgatag

SEQ ID NO: 124190 - DNA, 20 bp, human
gctgggactgatagaggatc

SEQ ID NO: 124191 - DNA, 20 bp, human
gatcggagcatcacgtactc

SEQ ID NO: 124192 - DNA, 20 bp, human
gagattcatcatcaacagca

SEQ ID NO: 124193 - DNA, 20 bp, human
ggaattttgaaatagctgtt

SEQ ID NO: 124194 - DNA, 20 bp, human
gaccagcatctttgggatcg

SEQ ID NO: 124195 - DNA, 20 bp, human
ggtcataggccattgctgca

SEQ ID NO: 124196 - DNA, 20 bp, human
gggaacagcatgaagaggat

SEQ ID NO: 124197 - DNA, 20 bp, human
gtccaggacactaacgatga

SEQ ID NO: 124198 - DNA, 20 bp, human
gtcatgaaccccaaactctg

SEQ ID NO: 124199 - DNA, 20 bp, human
gctttctcttgggattgtca

SEQ ID NO: 124200 - DNA, 20 bp, human
gtgatgacattgtacctcag

SEQ ID NO: 124201 - DNA, 20 bp, human
gaggcagcctgtgtaattga

SEQ ID NO: 124202 - DNA, 20 bp, human
ggtgaaacagatgtcgacca

SEQ ID NO: 124203 - DNA, 20 bp, human
gacagatgtcgaccaaggac

SEQ ID NO: 124204 - DNA, 20 bp, human
gttgggattgtcaggggatc

SEQ ID NO: 124205 - DNA, 20 bp, human
ggctctgctgcacacgttga

SEQ ID NO: 124206 - DNA, 20 bp, human
ggatgtttcactagcaccaa

SEQ ID NO: 124207 - DNA, 20 bp, human
gggtgctagtgaaacatcct

SEQ ID NO: 124208 - DNA, 20 bp, human
gttaaaaggctaatcttgga

SEQ ID NO: 124209 - DNA, 20 bp, human
gggtgaccaagtagatcccg

SEQ ID NO: 124210 - DNA, 20 bp, human
gtgtgacatgcaccctgcgt

SEQ ID NO: 124211 - DNA, 20 bp, human
gacggctagtcttgagcctt

SEQ ID NO: 124212 - DNA, 20 bp, human
gctacttggtcaccatcgtg

SEQ ID NO: 124213 - DNA, 20 bp, human
gctcttcctcgggatctact

SEQ ID NO: 124214 - DNA, 20 bp, human
gcaagattagccttttaatg

SEQ ID NO: 124215 - DNA, 20 bp, human
ggtctcccatgcatccctgc

SEQ ID NO: 124216 - DNA, 20 bp, human
gccagcaaaccccatcccat

SEQ ID NO: 124217 - DNA, 20 bp, human
ggtcaggcaggagagtcgga

SEQ ID NO: 124218 - DNA, 20 bp, human
gaaacacacctggcaagaca

SEQ ID NO: 124219 - DNA, 20 bp, human
gctggtgggttaagccttcg

SEQ ID NO: 124220 - DNA, 20 bp, human
gtcggaggggacaagagaag

SEQ ID NO: 124221 - DNA, 20 bp, human
gaacccaccagccgggactg

SEQ ID NO: 124222 - DNA, 20 bp, human
gagagggggatccgcagtcc

SEQ ID NO: 124223 - DNA, 20 bp, human
gcgtgtagaaacccagaaac

SEQ ID NO: 124224 - DNA, 20 bp, human
gctacacggtcaccgtggtg

SEQ ID NO: 124225 - DNA, 20 bp, human
gtctgtcacagaagagtttt

SEQ ID NO: 124226 - DNA, 20 bp, human
ggaatattatctccaatgtt

SEQ ID NO: 124227 - DNA, 20 bp, human
ggaacagacctgatgggaca

SEQ ID NO: 124228 - DNA, 20 bp, human
gagcatagaacagacctgat

SEQ ID NO: 124229 - DNA, 20 bp, human
gagaggggttgccggaactc

SEQ ID NO: 124230 - DNA, 20 bp, human
gtggtgaccttatacagcaa

SEQ ID NO: 124231 - DNA, 20 bp, human
gattttgggagtgaaaacag

SEQ ID NO: 124232 - DNA, 20 bp, human
gaaggtcaccatgtcccatc

SEQ ID NO: 124233 - DNA, 20 bp, human
gcgagtcatgcacccaacat

SEQ ID NO: 124234 - DNA, 20 bp, human
ggctgcttacataatgggat

SEQ ID NO: 124235 - DNA, 20 bp, human
gactagaaacaggaaaaaga

SEQ ID NO: 124236 - DNA, 20 bp, human
gctctttttcctgtttctag

SEQ ID NO: 124237 - DNA, 20 bp, human
ggaatattatctcctatgtt

SEQ ID NO: 124238 - DNA, 20 bp, human
ggaacagacctgatgggaca

SEQ ID NO: 124239 - DNA, 20 bp, human
gagcatagaacagacctgat

SEQ ID NO: 124240 - DNA, 20 bp, human
gagaggggttgctggaactc

SEQ ID NO: 124241 - DNA, 20 bp, human
gtggagccacggcccacacc

SEQ ID NO: 124242 - DNA, 20 bp, human
gattttgggagtgaaaacag

SEQ ID NO: 124243 - DNA, 20 bp, human
gtggtgaccttatacagcaa

SEQ ID NO: 124244 - DNA, 20 bp, human
gtgagtcatgcacccaacat

SEQ ID NO: 124245 - DNA, 20 bp, human
gaaggtcaccatgtcccatc

SEQ ID NO: 124246 - DNA, 20 bp, human
gatggtcaccatgtccccaa

SEQ ID NO: 124247 - DNA, 20 bp, human
gggtgaccatgtagagcagg

SEQ ID NO: 124248 - DNA, 20 bp, human
gtctcttggcgagctgtctg

SEQ ID NO: 124249 - DNA, 20 bp, human
gccagcaaaccctaccacat

SEQ ID NO: 124250 - DNA, 20 bp, human
gctgttctgataatcccaca

SEQ ID NO: 124251 - DNA, 20 bp, human
gtcagcagaaagcagaccct

SEQ ID NO: 124252 - DNA, 20 bp, human
ggggatctatgtgttcactg

SEQ ID NO: 124253 - DNA, 20 bp, human
gtgctatgtgttggtatcaa

SEQ ID NO: 124254 - DNA, 20 bp, human
gaattctgagtgctatgtgt

SEQ ID NO: 124255 - DNA, 20 bp, human
gtgtttggttcctatgtggt

SEQ ID NO: 124256 - DNA, 20 bp, human
gaggcattctgtggggacaa

SEQ ID NO: 124257 - DNA, 20 bp, human
gtgagagttgagccttatca

SEQ ID NO: 124258 - DNA, 20 bp, human
ggtcatttaaggcattctgt

SEQ ID NO: 124259 - DNA, 20 bp, human
gaggataaactgtgtcacga

SEQ ID NO: 124260 - DNA, 20 bp, human
gagaatgccttaaatgacaa

SEQ ID NO: 124261 - DNA, 20 bp, human
gataaactgtgtcacgaagg

SEQ ID NO: 124262 - DNA, 20 bp, human
gcaggcttaactgaccaacc

SEQ ID NO: 124263 - DNA, 20 bp, human
gggcttctacgtggtcactg

SEQ ID NO: 124264 - DNA, 20 bp, human
gctacgtggtcactgtggtg

SEQ ID NO: 124265 - DNA, 20 bp, human
gggggatctggactcccggt

SEQ ID NO: 124266 - DNA, 20 bp, human
ggcagtgagggtccatgtta

SEQ ID NO: 124267 - DNA, 20 bp, human
gtaaagcagtgggctacaga

SEQ ID NO: 124268 - DNA, 20 bp, human
ggaccatgcactcagagtaa

SEQ ID NO: 124269 - DNA, 20 bp, human
ggatcgcattataaagcagt

SEQ ID NO: 124270 - DNA, 20 bp, human
ggcctaaagaagaatgacca

SEQ ID NO: 124271 - DNA, 20 bp, human
gagtatgaattaccttaaca

SEQ ID NO: 124272 - DNA, 20 bp, human
gaaaccaaattgcataaggg

SEQ ID NO: 124273 - DNA, 20 bp, human
gatcatatgccatggcagtc

SEQ ID NO: 124274 - DNA, 20 bp, human
gaaatgctggtgaacttcct

SEQ ID NO: 124275 - DNA, 20 bp, human
ggaatagcagaaatcgacga

SEQ ID NO: 124276 - DNA, 20 bp, human
gaatggaagcaaccaacatg

SEQ ID NO: 124277 - DNA, 20 bp, human
gacataacggtcatattcca

SEQ ID NO: 124278 - DNA, 20 bp, human
gacttcaaaccattcttcag

SEQ ID NO: 124279 - DNA, 20 bp, human
gagaatgacatgccccatgt

SEQ ID NO: 124280 - DNA, 20 bp, human
gtcaggggctgagtttatcc

SEQ ID NO: 124281 - DNA, 20 bp, human
ggacaatattgtaaagcagt

SEQ ID NO: 124282 - DNA, 20 bp, human
gcataataccttaaaagaca

SEQ ID NO: 124283 - DNA, 20 bp, human
gtgagtaatgcattccagaa

SEQ ID NO: 124284 - DNA, 20 bp, human
ggaagtagccatgtctttta

SEQ ID NO: 124285 - DNA, 20 bp, human
gctgttccttggaatatatg

SEQ ID NO: 124286 - DNA, 20 bp, human
gagcagagaacagaccctag

SEQ ID NO: 124287 - DNA, 20 bp, human
gagggtcatcatgtccccta

SEQ ID NO: 124288 - DNA, 20 bp, human
gacgtagcgatcgcaggcca

SEQ ID NO: 124289 - DNA, 20 bp, human
gctgcagcccactgctctac

SEQ ID NO: 124290 - DNA, 20 bp, human
gatggccacgtagcgatcgc

SEQ ID NO: 124291 - DNA, 20 bp, human
gatttctgaatgctacatgc

SEQ ID NO: 124292 - DNA, 20 bp, human
gtgaatcatgcatccagaat

SEQ ID NO: 124293 - DNA, 20 bp, human
gttacccctaaaatgctatc

SEQ ID NO: 124294 - DNA, 20 bp, human
gaaaccctgatagcatttta

SEQ ID NO: 124295 - DNA, 20 bp, human
gatagatccatctcctattc

SEQ ID NO: 124296 - DNA, 20 bp, human
gtttgtgcgtcagctcatat

SEQ ID NO: 124297 - DNA, 20 bp, human
gatgagctgacgcacaaatc

SEQ ID NO: 124298 - DNA, 20 bp, human
gtgccctgaagaaaacgcta

SEQ ID NO: 124299 - DNA, 20 bp, human
gtccgcattcgctacactga

SEQ ID NO: 124300 - DNA, 20 bp, human
gcgttttcttcagggcaacg

SEQ ID NO: 124301 - DNA, 20 bp, human
gttccctagcgttttcttca

SEQ ID NO: 124302 - DNA, 20 bp, human
gttaatgtaagtactagaac

SEQ ID NO: 124303 - DNA, 20 bp, human
gtactgattttaatctttag

SEQ ID NO: 124304 - DNA, 20 bp, human
gtgtcagctccatggaccag

SEQ ID NO: 124305 - DNA, 20 bp, human
gccatggagctgacagatga

SEQ ID NO: 124306 - DNA, 20 bp, human
gttggatctacaattcacac

SEQ ID NO: 124307 - DNA, 20 bp, human
gttcctttggtcagtttcta

SEQ ID NO: 124308 - DNA, 20 bp, human
gattttgggggtaatgatag

SEQ ID NO: 124309 - DNA, 20 bp, human
gtcctgctgacattttcctt

SEQ ID NO: 124310 - DNA, 20 bp, human
gaatgaaggacagaccactg

SEQ ID NO: 124311 - DNA, 20 bp, human
ggggggtaatgatagtggaa

SEQ ID NO: 124312 - DNA, 20 bp, human
gaccaaaggaaaatgtcagc

SEQ ID NO: 124313 - DNA, 20 bp, human
gtgtcacatgttggctgtaa

SEQ ID NO: 124314 - DNA, 20 bp, human
gcactgtgagccagaagcag

SEQ ID NO: 124315 - DNA, 20 bp, human
ggaactcagtcactgaggaa

SEQ ID NO: 124316 - DNA, 20 bp, human
gattgttattctccttttgt

SEQ ID NO: 124317 - DNA, 20 bp, human
gaaacttagtcacaaaagaa

SEQ ID NO: 124318 - DNA, 20 bp, human
gttctttgatgagtttctgc

SEQ ID NO: 124319 - DNA, 20 bp, human
ggactaagtttattctggtt

SEQ ID NO: 124320 - DNA, 20 bp, human
gtttgtgactaagtttattc

SEQ ID NO: 124321 - DNA, 20 bp, human
ggggatcactttcctacaaa

SEQ ID NO: 124322 - DNA, 20 bp, human
gaaatgatcatatataaaca

SEQ ID NO: 124323 - DNA, 20 bp, human
gtcccaggaagacgaggaag

SEQ ID NO: 124324 - DNA, 20 bp, human
ggagaaaaaacatggtattt

SEQ ID NO: 124325 - DNA, 20 bp, human
gccctcttcctcgtcttcct

SEQ ID NO: 124326 - DNA, 20 bp, human
gtaaagcaattgaacatcat

SEQ ID NO: 124327 - DNA, 20 bp, human
gtaataactgggtaacgtag

SEQ ID NO: 124328 - DNA, 20 bp, human
gtagtataaagagggccatc

SEQ ID NO: 124329 - DNA, 20 bp, human
gcaggagaaatagtataaag

SEQ ID NO: 124330 - DNA, 20 bp, human
gttgataaagctaatcacat

SEQ ID NO: 124331 - DNA, 20 bp, human
ggccttttggacataataac

SEQ ID NO: 124332 - DNA, 20 bp, human
ggtcccgtaaggatgaagtc

SEQ ID NO: 124333 - DNA, 20 bp, human
gagagcgcaacacagccttt

SEQ ID NO: 124334 - DNA, 20 bp, human
gtgttttcttctctcatcaa

SEQ ID NO: 124335 - DNA, 20 bp, human
gtgtgttgcgctcttgtcac

SEQ ID NO: 124336 - DNA, 20 bp, human
gagaaagtgtcagtcccata

SEQ ID NO: 124337 - DNA, 20 bp, human
gcattcagcagtacccaaga

SEQ ID NO: 124338 - DNA, 20 bp, human
gatgggccattgaggagaga

SEQ ID NO: 124339 - DNA, 20 bp, human
gatagactcctttgtcaacg

SEQ ID NO: 124340 - DNA, 20 bp, human
gctttctgaagagatccaga

SEQ ID NO: 124341 - DNA, 20 bp, human
gtggctgacttcatccttat

SEQ ID NO: 124342 - DNA, 20 bp, human
gtgggcaaagcagcccgtaa

SEQ ID NO: 124343 - DNA, 20 bp, human
gccaactatatttcctttac

SEQ ID NO: 124344 - DNA, 20 bp, human
gtagagcaggtgaacatgat

SEQ ID NO: 124345 - DNA, 20 bp, human
gaggcccagtgatgagagcg

SEQ ID NO: 124346 - DNA, 20 bp, human
ggagcgaggcagagcctttt

SEQ ID NO: 124347 - DNA, 20 bp, human
gcatagtaattaggtatatg

SEQ ID NO: 124348 - DNA, 20 bp, human
gcacagttattatgcccaaa

SEQ ID NO: 124349 - DNA, 20 bp, human
gccaactatatttccttcac

SEQ ID NO: 124350 - DNA, 20 bp, human
gtagagcaggtgaacatgat

SEQ ID NO: 124351 - DNA, 20 bp, human
gggactgtcagactctgaag

SEQ ID NO: 124352 - DNA, 20 bp, human
gagagtctgacagtcccgta

SEQ ID NO: 124353 - DNA, 20 bp, human
gaggcccagtgatgagagcg

SEQ ID NO: 124354 - DNA, 20 bp, human
ggactctgaagaggtccaga

SEQ ID NO: 124355 - DNA, 20 bp, human
gagaaggaatgacacaaatg

SEQ ID NO: 124356 - DNA, 20 bp, human
ggccttaggtgttacagtag

SEQ ID NO: 124357 - DNA, 20 bp, human
gtgactactgaatacagtaa

SEQ ID NO: 124358 - DNA, 20 bp, human
gtcctctactgtaacaccta

SEQ ID NO: 124359 - DNA, 20 bp, human
gctgagttgatgtaaatggc

SEQ ID NO: 124360 - DNA, 20 bp, human
gaggcctgagttgatgtaaa

SEQ ID NO: 124361 - DNA, 20 bp, human
gggcattactcccagccagt

SEQ ID NO: 124362 - DNA, 20 bp, human
ggagtaatgccatatgtgat

SEQ ID NO: 124363 - DNA, 20 bp, human
gttgtgaagcctatcacata

SEQ ID NO: 124364 - DNA, 20 bp, human
gactgtaacacctaaggcat

SEQ ID NO: 124365 - DNA, 20 bp, human
ggtcccaaaaagtgtccaac

SEQ ID NO: 124366 - DNA, 20 bp, human
gtggaaattcatctgtttgg

SEQ ID NO: 124367 - DNA, 20 bp, human
gtggtctttctggtgctcta

SEQ ID NO: 124368 - DNA, 20 bp, human
gtactttttcctgcaacatc

SEQ ID NO: 124369 - DNA, 20 bp, human
ggtaatcatgctggctttga

SEQ ID NO: 124370 - DNA, 20 bp, human
gaatgagagccagatgttgc

SEQ ID NO: 124371 - DNA, 20 bp, human
gtctgtttgggggaaaagag

SEQ ID NO: 124372 - DNA, 20 bp, human
ggtttggaaattcatctgtt

SEQ ID NO: 124373 - DNA, 20 bp, human
gatctggctctcattaatct

SEQ ID NO: 124374 - DNA, 20 bp, human
gccaccaccatgtacagcag

SEQ ID NO: 124375 - DNA, 20 bp, human
ggtatgtgagggagaccagc

SEQ ID NO: 124376 - DNA, 20 bp, human
gggctcctgaaaatttcacc

SEQ ID NO: 124377 - DNA, 20 bp, human
gatctagctatcatcaatct

SEQ ID NO: 124378 - DNA, 20 bp, human
ggtaatgatgctggctgtga

SEQ ID NO: 124379 - DNA, 20 bp, human
gggtcagcacatagagcact

SEQ ID NO: 124380 - DNA, 20 bp, human
gggcttttctacagctattg

SEQ ID NO: 124381 - DNA, 20 bp, human
ggatgatagctagatgtctc

SEQ ID NO: 124382 - DNA, 20 bp, human
gccaccaccatgtagagcag

SEQ ID NO: 124383 - DNA, 20 bp, human
ggtatcggaggtaatgatgc

SEQ ID NO: 124384 - DNA, 20 bp, human
gagctgtagaaaagccatag

SEQ ID NO: 124385 - DNA, 20 bp, human
gaaccctctgctctacatgg

SEQ ID NO: 124386 - DNA, 20 bp, human
gtcacagtgataggcaatct

SEQ ID NO: 124387 - DNA, 20 bp, human
gtgaggaagagtccaaacag

SEQ ID NO: 124388 - DNA, 20 bp, human
gtcaaagaatgctagctgag

SEQ ID NO: 124389 - DNA, 20 bp, human
gggctgcaggctccactgtt

SEQ ID NO: 124390 - DNA, 20 bp, human
gaatcacacggcagtgacca

SEQ ID NO: 124391 - DNA, 20 bp, human
gtttgatgtatgagcaatag

SEQ ID NO: 124392 - DNA, 20 bp, human
gtgtgaccagatatatgatg

SEQ ID NO: 124393 - DNA, 20 bp, human
ggtggtaaaacacaatcaca

SEQ ID NO: 124394 - DNA, 20 bp, human
ggttaccaagatgaatcatg

SEQ ID NO: 124395 - DNA, 20 bp, human
gggggattacagacaaccct

SEQ ID NO: 124396 - DNA, 20 bp, human
ggaatgtgcaatagaggtaa

SEQ ID NO: 124397 - DNA, 20 bp, human
gatgtcacgaagggtatgtc

SEQ ID NO: 124398 - DNA, 20 bp, human
gcgaagggtatgtcaggtgc

SEQ ID NO: 124399 - DNA, 20 bp, human
gttggttattcaacaactgt

SEQ ID NO: 124400 - DNA, 20 bp, human
gagaaatgaatgtgcaatag

SEQ ID NO: 124401 - DNA, 20 bp, human
gacagtaatcatgtcacgaa

SEQ ID NO: 124402 - DNA, 20 bp, human
ggttttctgatgaacctgga

SEQ ID NO: 124403 - DNA, 20 bp, human
ggattactgtgtatagcaga

SEQ ID NO: 124404 - DNA, 20 bp, human
gtgaatgaattcattcttac

SEQ ID NO: 124405 - DNA, 20 bp, human
gagattgtgttgttccatcc

SEQ ID NO: 124406 - DNA, 20 bp, human
gcagcgactgtgtcatgtac

SEQ ID NO: 124407 - DNA, 20 bp, human
gcgactgtgtcatgtactgg

SEQ ID NO: 124408 - DNA, 20 bp, human
ggtcatctacctaatcacag

SEQ ID NO: 124409 - DNA, 20 bp, human
gaaaggggaatctgcagctc

SEQ ID NO: 124410 - DNA, 20 bp, human
gtagcactgttagattgtgt

SEQ ID NO: 124411 - DNA, 20 bp, human
gtctacctaatcacagtggt

SEQ ID NO: 124412 - DNA, 20 bp, human
ggttgcccaccactgtgatt

SEQ ID NO: 124413 - DNA, 20 bp, human
gggtcaaaatgatcatagtt

SEQ ID NO: 124414 - DNA, 20 bp, human
gtacttttctatcagacatt

SEQ ID NO: 124415 - DNA, 20 bp, human
gatttggcttttgttgatct

SEQ ID NO: 124416 - DNA, 20 bp, human
ggttaaagagtacatagtgt

SEQ ID NO: 124417 - DNA, 20 bp, human
ggagtacatagtgttggtcc

SEQ ID NO: 124418 - DNA, 20 bp, human
ggaagaaccagagtaactat

SEQ ID NO: 124419 - DNA, 20 bp, human
gagaacaagggactatggat

SEQ ID NO: 124420 - DNA, 20 bp, human
gccatactagcattggctcc

SEQ ID NO: 124421 - DNA, 20 bp, human
ggactatggattggatgaat

SEQ ID NO: 124422 - DNA, 20 bp, human
gtgtggggcgacgaagattc

SEQ ID NO: 124423 - DNA, 20 bp, human
gatgctagagcgtgtggaag

SEQ ID NO: 124424 - DNA, 20 bp, human
gcgccccacattgggcacca

SEQ ID NO: 124425 - DNA, 20 bp, human
ggcgacgaagattctggcaa

SEQ ID NO: 124426 - DNA, 20 bp, human
gtagatggccagaaaagata

SEQ ID NO: 124427 - DNA, 20 bp, human
gcaactcctgatggtctgtg

SEQ ID NO: 124428 - DNA, 20 bp, human
gtatagctatagcttcctaa

SEQ ID NO: 124429 - DNA, 20 bp, human
gtccatctacctcttcacag

SEQ ID NO: 124430 - DNA, 20 bp, human
ggctcacatcaattgcaccc

SEQ ID NO: 124431 - DNA, 20 bp, human
gtgagtagcacatgcatcaa

SEQ ID NO: 124432 - DNA, 20 bp, human
gttacaaccatatacaatag

SEQ ID NO: 124433 - DNA, 20 bp, human
ggggcatcttcaactcctga

SEQ ID NO: 124434 - DNA, 20 bp, human
gatatggttgtaatgactcc

SEQ ID NO: 124435 - DNA, 20 bp, human
gtccttgctactggcttcca

SEQ ID NO: 124436 - DNA, 20 bp, human
gtagatggccagaaaagata

SEQ ID NO: 124437 - DNA, 20 bp, human
gcaactcctgatggtctgtg

SEQ ID NO: 124438 - DNA, 20 bp, human
gtatagctatagcttcctaa

SEQ ID NO: 124439 - DNA, 20 bp, human
gtccatctacctcttcacag

SEQ ID NO: 124440 - DNA, 20 bp, human
ggctcacatcaattgcaccc

SEQ ID NO: 124441 - DNA, 20 bp, human
gtgagtagcacatgcatcaa

SEQ ID NO: 124442 - DNA, 20 bp, human
gttacaaccatatacaatag

SEQ ID NO: 124443 - DNA, 20 bp, human
ggggcatcttcaactcctga

SEQ ID NO: 124444 - DNA, 20 bp, human
gatatggttgtaatgactcc

SEQ ID NO: 124445 - DNA, 20 bp, human
gtccttgctactggcttcca

SEQ ID NO: 124446 - DNA, 20 bp, human
gcctagaaggtggaattcag

SEQ ID NO: 124447 - DNA, 20 bp, human
gcccagggaagcctagaagg

SEQ ID NO: 124448 - DNA, 20 bp, human
gggacccagggaagcctaga

SEQ ID NO: 124449 - DNA, 20 bp, human
ggtgtagtccttgggaccca

SEQ ID NO: 124450 - DNA, 20 bp, human
ggtcctgctctcaagagaga

SEQ ID NO: 124451 - DNA, 20 bp, human
gtcttgagagcaggaccatg

SEQ ID NO: 124452 - DNA, 20 bp, human
gttcaaaacaagcagaatca

SEQ ID NO: 124453 - DNA, 20 bp, human
gactattaccacccaaatac

SEQ ID NO: 124454 - DNA, 20 bp, human
gagcagtacctgtatttggg

SEQ ID NO: 124455 - DNA, 20 bp, human
ggaacagcagtacctgtatt

SEQ ID NO: 124456 - DNA, 20 bp, human
gtagatttcacaaggaacaa

SEQ ID NO: 124457 - DNA, 20 bp, human
gggctgtctgtaaccctctg

SEQ ID NO: 124458 - DNA, 20 bp, human
gaagaagagctggacaacac

SEQ ID NO: 124459 - DNA, 20 bp, human
gctctgttgtccccacagca

SEQ ID NO: 124460 - DNA, 20 bp, human
gttgctctctagatttcaca

SEQ ID NO: 124461 - DNA, 20 bp, human
gagcatcacggggacgatta

SEQ ID NO: 124462 - DNA, 20 bp, human
gatgtagttcttcagagcca

SEQ ID NO: 124463 - DNA, 20 bp, human
gttcgcattacttggagcaa

SEQ ID NO: 124464 - DNA, 20 bp, human
gttacttggagcaatggctg

SEQ ID NO: 124465 - DNA, 20 bp, human
gatatattgtctgcatccca

SEQ ID NO: 124466 - DNA, 20 bp, human
ggcccaggaacaccacgaag

SEQ ID NO: 124467 - DNA, 20 bp, human
gattccttacagccatgcag

SEQ ID NO: 124468 - DNA, 20 bp, human
gtagcagtctcatattgtgg

SEQ ID NO: 124469 - DNA, 20 bp, human
gatgcagctgggcctcttcg

SEQ ID NO: 124470 - DNA, 20 bp, human
gagtgagagagtacacgccc

SEQ ID NO: 124471 - DNA, 20 bp, human
gctgtaaggaatctcaccta

SEQ ID NO: 124472 - DNA, 20 bp, human
ggctcctctgcatggctgta

SEQ ID NO: 124473 - DNA, 20 bp, human
gcagacccaggaatgcagct

SEQ ID NO: 124474 - DNA, 20 bp, human
gtgactgagtttatactgct

SEQ ID NO: 124475 - DNA, 20 bp, human
ggcacacagctttatggaca

SEQ ID NO: 124476 - DNA, 20 bp, human
ggtacagagggcggtggaca

SEQ ID NO: 124477 - DNA, 20 bp, human
gacaagcccagtacagaggg

SEQ ID NO: 124478 - DNA, 20 bp, human
gcctccgtggacatggaagt

SEQ ID NO: 124479 - DNA, 20 bp, human
gtggtacctgaataaagcaa

SEQ ID NO: 124480 - DNA, 20 bp, human
ggcaacaagcccagtacaga

SEQ ID NO: 124481 - DNA, 20 bp, human
gttgttgctggctcctacat

SEQ ID NO: 124482 - DNA, 20 bp, human
gagcccagtacagagggcgg

SEQ ID NO: 124483 - DNA, 20 bp, human
gtttctcagcagattcccag

SEQ ID NO: 124484 - DNA, 20 bp, human
gagtcaggctttcacctccg

SEQ ID NO: 124485 - DNA, 20 bp, human
gttgctggctcctacatagg

SEQ ID NO: 124486 - DNA, 20 bp, human
ggcccaggaacaccacgaag

SEQ ID NO: 124487 - DNA, 20 bp, human
gattccttacagccatgcag

SEQ ID NO: 124488 - DNA, 20 bp, human
gtagcagtctcatattgtgg

SEQ ID NO: 124489 - DNA, 20 bp, human
gatgcagctgggcctcttcg

SEQ ID NO: 124490 - DNA, 20 bp, human
gagtgagagagtacacgccc

SEQ ID NO: 124491 - DNA, 20 bp, human
gctgtaaggaatctcaccta

SEQ ID NO: 124492 - DNA, 20 bp, human
ggctcctctgcatggctgta

SEQ ID NO: 124493 - DNA, 20 bp, human
gcagacccaggaatgcagct

SEQ ID NO: 124494 - DNA, 20 bp, human
gtgactgagtttatactgct

SEQ ID NO: 124495 - DNA, 20 bp, human
ggcacacagctttatggaca

SEQ ID NO: 124496 - DNA, 20 bp, human
gtggccacggtatagagcag

SEQ ID NO: 124497 - DNA, 20 bp, human
gcctgacaccccacagacat

SEQ ID NO: 124498 - DNA, 20 bp, human
ggtaggagcctatgtctgtg

SEQ ID NO: 124499 - DNA, 20 bp, human
ggacataggctcctaccacc

SEQ ID NO: 124500 - DNA, 20 bp, human
gtctgctggagcctggtggt

SEQ ID NO: 124501 - DNA, 20 bp, human
ggtgcaagtggtacgcagga

SEQ ID NO: 124502 - DNA, 20 bp, human
gaatgtggctaggatctgag

SEQ ID NO: 124503 - DNA, 20 bp, human
gtaaccgaattcattctcat

SEQ ID NO: 124504 - DNA, 20 bp, human
gtagagcagtgggttgcgaa

SEQ ID NO: 124505 - DNA, 20 bp, human
gtaccgtggccatgaatccc

SEQ ID NO: 124506 - DNA, 20 bp, human
gccctcagtcacaatgagga

SEQ ID NO: 124507 - DNA, 20 bp, human
gaagtcacagtatacttatg

SEQ ID NO: 124508 - DNA, 20 bp, human
gatggtagaaacctgttgag

SEQ ID NO: 124509 - DNA, 20 bp, human
ggaggagaatgtggagctct

SEQ ID NO: 124510 - DNA, 20 bp, human
gcattacaaataatctctta

SEQ ID NO: 124511 - DNA, 20 bp, human
gcaaggctatgatcaacttc

SEQ ID NO: 124512 - DNA, 20 bp, human
gaaacctgttgagaggcaca

SEQ ID NO: 124513 - DNA, 20 bp, human
ggatccttctagggaatgtt

SEQ ID NO: 124514 - DNA, 20 bp, human
gacattggtgtgttcagccg

SEQ ID NO: 124515 - DNA, 20 bp, human
gtacaaatgaactcttggtt

SEQ ID NO: 124516 - DNA, 20 bp, human
gtgccacacagagatggtag

SEQ ID NO: 124517 - DNA, 20 bp, human
gggtctccgggcttcatcct

SEQ ID NO: 124518 - DNA, 20 bp, human
gggtgttatgagacagacag

SEQ ID NO: 124519 - DNA, 20 bp, human
gcgaggtgagcaggcgcagt

SEQ ID NO: 124520 - DNA, 20 bp, human
gagatggtagagggagcgaa

SEQ ID NO: 124521 - DNA, 20 bp, human
gggtgagcaggcgcagtggg

SEQ ID NO: 124522 - DNA, 20 bp, human
gcacagctacggcctgacgg

SEQ ID NO: 124523 - DNA, 20 bp, human
gaatcagagagcaggtctcc

SEQ ID NO: 124524 - DNA, 20 bp, human
gtgctgggctggactaaaga

SEQ ID NO: 124525 - DNA, 20 bp, human
gctacggcctgacggaggta

SEQ ID NO: 124526 - DNA, 20 bp, human
gtaaccgagaaggcccgctg

SEQ ID NO: 124527 - DNA, 20 bp, human
gtaagacaagagccagatga

SEQ ID NO: 124528 - DNA, 20 bp, human
gagaaggtagcagtcgatgg

SEQ ID NO: 124529 - DNA, 20 bp, human
gcgctggggcctagtcactg

SEQ ID NO: 124530 - DNA, 20 bp, human
gtccagtggttcacctgcaa

SEQ ID NO: 124531 - DNA, 20 bp, human
gaggtgaaccactggatgga

SEQ ID NO: 124532 - DNA, 20 bp, human
ggccgttgcaggtgaaccac

SEQ ID NO: 124533 - DNA, 20 bp, human
gctggcacacggccgtgtag

SEQ ID NO: 124534 - DNA, 20 bp, human
ggatgtccaccaaggaaagg

SEQ ID NO: 124535 - DNA, 20 bp, human
gaggaagaactccgtcacta

SEQ ID NO: 124536 - DNA, 20 bp, human
ggctggcaaaagcccccggg

SEQ ID NO: 124537 - DNA, 20 bp, human
ggccgctggcaaaagccccc

SEQ ID NO: 124538 - DNA, 20 bp, human
gccgagcccggactctgata

SEQ ID NO: 124539 - DNA, 20 bp, human
ggcagccgggacagtagagg

SEQ ID NO: 124540 - DNA, 20 bp, human
gatccagtccgggtaggtga

SEQ ID NO: 124541 - DNA, 20 bp, human
gtggccgatccagtccgggt

SEQ ID NO: 124542 - DNA, 20 bp, human
gtctggtcactgccgcccgg

SEQ ID NO: 124543 - DNA, 20 bp, human
gtccaggccccggggatccg

SEQ ID NO: 124544 - DNA, 20 bp, human
gatcggccagagttactccg

SEQ ID NO: 124545 - DNA, 20 bp, human
gactctggccgatccagtcc

SEQ ID NO: 124546 - DNA, 20 bp, human
ggcgcccagaggatcagggt

SEQ ID NO: 124547 - DNA, 20 bp, human
ggcatctggggcaccggcaa

SEQ ID NO: 124548 - DNA, 20 bp, human
gtccagcaggcgcactggga

SEQ ID NO: 124549 - DNA, 20 bp, human
gcactgggccacaggccacg

SEQ ID NO: 124550 - DNA, 20 bp, human
gtgcggcgcccagaggatca

SEQ ID NO: 124551 - DNA, 20 bp, human
ggaggtcaccaaccccggat

SEQ ID NO: 124552 - DNA, 20 bp, human
ggcggccacgcagtccgagc

SEQ ID NO: 124553 - DNA, 20 bp, human
ggatgcagcctagcgcccct

SEQ ID NO: 124554 - DNA, 20 bp, human
gctctctccagcaggcgcac

SEQ ID NO: 124555 - DNA, 20 bp, human
gcgcggtcactacccatccg

SEQ ID NO: 124556 - DNA, 20 bp, human
gcgagagcaaggcagacgtg

SEQ ID NO: 124557 - DNA, 20 bp, human
gggaggggtcacacccggtg

SEQ ID NO: 124558 - DNA, 20 bp, human
gggcccggctgaggtagagg

SEQ ID NO: 124559 - DNA, 20 bp, human
ggcaagaaaagcagcgtctg

SEQ ID NO: 124560 - DNA, 20 bp, human
ggacaggacgagcaggatgc

SEQ ID NO: 124561 - DNA, 20 bp, human
gacgagcaggatgcaggcgg

SEQ ID NO: 124562 - DNA, 20 bp, human
gaggccccgctgaaccctga

SEQ ID NO: 124563 - DNA, 20 bp, human
gcttggcccggctgaggtag

SEQ ID NO: 124564 - DNA, 20 bp, human
gggaggccaaaacaggaact

SEQ ID NO: 124565 - DNA, 20 bp, human
gccggtggggcagagcaagt

SEQ ID NO: 124566 - DNA, 20 bp, human
gggtctgctacggcaccgcg

SEQ ID NO: 124567 - DNA, 20 bp, human
ggaagctgccgggtctgcta

SEQ ID NO: 124568 - DNA, 20 bp, human
gaggcacaaatgctccgctt

SEQ ID NO: 124569 - DNA, 20 bp, human
ggctgggagacgaccagaca

SEQ ID NO: 124570 - DNA, 20 bp, human
gaggagacgagacccacttc

SEQ ID NO: 124571 - DNA, 20 bp, human
gggccgcctcgtcctctggg

SEQ ID NO: 124572 - DNA, 20 bp, human
gcacaaatgctccgcttggg

SEQ ID NO: 124573 - DNA, 20 bp, human
gggcagctcccagatggcaa

SEQ ID NO: 124574 - DNA, 20 bp, human
gctgacagggaaggcgggtc

SEQ ID NO: 124575 - DNA, 20 bp, human
gcgggtctggaagagcagct

SEQ ID NO: 124576 - DNA, 20 bp, human
gggctagccggaggaagctt

SEQ ID NO: 124577 - DNA, 20 bp, human
gcgggctgcgagggactcgg

SEQ ID NO: 124578 - DNA, 20 bp, human
ggggctccttctacaactac

SEQ ID NO: 124579 - DNA, 20 bp, human
gtctagtgagacacacgctt

SEQ ID NO: 124580 - DNA, 20 bp, human
gttcggcccgtagttgtaga

SEQ ID NO: 124581 - DNA, 20 bp, human
ggggaactgagtttgcaggg

SEQ ID NO: 124582 - DNA, 20 bp, human
gcaactacgggccgaaagcc

SEQ ID NO: 124583 - DNA, 20 bp, human
ggactcgggggagggcgcat

SEQ ID NO: 124584 - DNA, 20 bp, human
gcctctaacctgcaccagca

SEQ ID NO: 124585 - DNA, 20 bp, human
ggttgtagaaggagccctgc

SEQ ID NO: 124586 - DNA, 20 bp, human
ggtggtcgggcgcgaattac

SEQ ID NO: 124587 - DNA, 20 bp, human
ggccgcagggaaggtacctt

SEQ ID NO: 124588 - DNA, 20 bp, human
gcccgaccaccggggaggta

SEQ ID NO: 124589 - DNA, 20 bp, human
gtcgcgcccgaccaccgggg

SEQ ID NO: 124590 - DNA, 20 bp, human
ggtgctccttacctccccgg

SEQ ID NO: 124591 - DNA, 20 bp, human
gagcgcagccaactggccag

SEQ ID NO: 124592 - DNA, 20 bp, human
ggggaggtaaggagcaccgg

SEQ ID NO: 124593 - DNA, 20 bp, human
ggaggtgagaggctcactct

SEQ ID NO: 124594 - DNA, 20 bp, human
gcagccaactggccagaggc

SEQ ID NO: 124595 - DNA, 20 bp, human
gtggctgcgctccaccagta

SEQ ID NO: 124596 - DNA, 20 bp, human
ggctacgtcctcgatgtcta

SEQ ID NO: 124597 - DNA, 20 bp, human
ggtagagccacagtgcgcat

SEQ ID NO: 124598 - DNA, 20 bp, human
ggacatcgaggacgtagcca

SEQ ID NO: 124599 - DNA, 20 bp, human
gcgatgtctaaggtatgtgg

SEQ ID NO: 124600 - DNA, 20 bp, human
gaggcagacaacagaagagt

SEQ ID NO: 124601 - DNA, 20 bp, human
ggttaggtaccaagatgcag

SEQ ID NO: 124602 - DNA, 20 bp, human
gcctcgatgtctaaggtatg

SEQ ID NO: 124603 - DNA, 20 bp, human
gtggtggccgatgcgcactg

SEQ ID NO: 124604 - DNA, 20 bp, human
ggtgcgccaagcactccgtt

SEQ ID NO: 124605 - DNA, 20 bp, human
gggagcggcgtactgagctg

SEQ ID NO: 124606 - DNA, 20 bp, human
gggttgtgtacggtccgcag

SEQ ID NO: 124607 - DNA, 20 bp, human
gggcaggtgaagtctagcag

SEQ ID NO: 124608 - DNA, 20 bp, human
gtgaagtctagcagaggacg

SEQ ID NO: 124609 - DNA, 20 bp, human
ggacggaggacttctatcta

SEQ ID NO: 124610 - DNA, 20 bp, human
ggtccgagtgtaagagagaa

SEQ ID NO: 124611 - DNA, 20 bp, human
gtgccgggagtggttgtgta

SEQ ID NO: 124612 - DNA, 20 bp, human
gaggacgcggccaggcgatt

SEQ ID NO: 124613 - DNA, 20 bp, human
gtagtaggtgaggagcgtga

SEQ ID NO: 124614 - DNA, 20 bp, human
ggaccgtacacaaccactcc

SEQ ID NO: 124615 - DNA, 20 bp, human
gggcgggagtggccacaaga

SEQ ID NO: 124616 - DNA, 20 bp, human
ggagcctctcccgagtctgg

SEQ ID NO: 124617 - DNA, 20 bp, human
gacggagcctctcccgagtc

SEQ ID NO: 124618 - DNA, 20 bp, human
gagcgtgggccgccagactc

SEQ ID NO: 124619 - DNA, 20 bp, human
gtcttgtgcaagggtcctgt

SEQ ID NO: 124620 - DNA, 20 bp, human
gctggcaggcaccaccgcag

SEQ ID NO: 124621 - DNA, 20 bp, human
gagcgaccggcctgcactat

SEQ ID NO: 124622 - DNA, 20 bp, human
ggaggctccgtcttgtgcaa

SEQ ID NO: 124623 - DNA, 20 bp, human
gcggtttccggcgggagcgt

SEQ ID NO: 124624 - DNA, 20 bp, human
gaacttctaggagctaatgt

SEQ ID NO: 124625 - DNA, 20 bp, human
ggctgcactggcctctgcgg

SEQ ID NO: 124626 - DNA, 20 bp, human
gctcggcgaggcccaggcgc

SEQ ID NO: 124627 - DNA, 20 bp, human
gccgatcagctccgacccca

SEQ ID NO: 124628 - DNA, 20 bp, human
gaacagccagccctgtccgt

SEQ ID NO: 124629 - DNA, 20 bp, human
ggttgacccgcggcgttcac

SEQ ID NO: 124630 - DNA, 20 bp, human
gagtgccggcgccatggggt

SEQ ID NO: 124631 - DNA, 20 bp, human
gagcggggaacccgacaacg

SEQ ID NO: 124632 - DNA, 20 bp, human
gtaggcgttggcggaatgaa

SEQ ID NO: 124633 - DNA, 20 bp, human
ggccaacgcctactgcagtc

SEQ ID NO: 124634 - DNA, 20 bp, human
ggactgtgtagaccttaacc

SEQ ID NO: 124635 - DNA, 20 bp, human
ggccgcccgtcgcctgggaa

SEQ ID NO: 124636 - DNA, 20 bp, human
gaggcaggagggttcactgt

SEQ ID NO: 124637 - DNA, 20 bp, human
gtcccgctggacattcaggt

SEQ ID NO: 124638 - DNA, 20 bp, human
gatcgcccatcacagtcctg

SEQ ID NO: 124639 - DNA, 20 bp, human
gctgtctaaagccaaacaga

SEQ ID NO: 124640 - DNA, 20 bp, human
gcgctggacattcaggtagg

SEQ ID NO: 124641 - DNA, 20 bp, human
ggaatgtccagcgggaaaat

SEQ ID NO: 124642 - DNA, 20 bp, human
gggtggtgttatagatgcac

SEQ ID NO: 124643 - DNA, 20 bp, human
gagattaaagccagccctcc

SEQ ID NO: 124644 - DNA, 20 bp, human
gaagccaaacagaaggcgga

SEQ ID NO: 124645 - DNA, 20 bp, human
gtttccttccgccttctgtt

SEQ ID NO: 124646 - DNA, 20 bp, human
ggaccacagccagcaggtaa

SEQ ID NO: 124647 - DNA, 20 bp, human
gtgggcttccctttacctgc

SEQ ID NO: 124648 - DNA, 20 bp, human
gggatctgggcttccagcag

SEQ ID NO: 124649 - DNA, 20 bp, human
ggggagatgaggcccctggt

SEQ ID NO: 124650 - DNA, 20 bp, human
ggcgccatactgagaccagg

SEQ ID NO: 124651 - DNA, 20 bp, human
gggcttccagcagaggtagg

SEQ ID NO: 124652 - DNA, 20 bp, human
ggtgcctcctggtctcagta

SEQ ID NO: 124653 - DNA, 20 bp, human
gctcaggactgtaagaaccc

SEQ ID NO: 124654 - DNA, 20 bp, human
gacagcgccatactgagacc

SEQ ID NO: 124655 - DNA, 20 bp, human
gtaaagggaagcccagagaa

SEQ ID NO: 124656 - DNA, 20 bp, human
gtgcgggtcgccgtcttcgg

SEQ ID NO: 124657 - DNA, 20 bp, human
gtcgccggtgcctccgaaga

SEQ ID NO: 124658 - DNA, 20 bp, human
gagtggggcggcgggtaagt

SEQ ID NO: 124659 - DNA, 20 bp, human
gtaagtgggcacgaacgcgg

SEQ ID NO: 124660 - DNA, 20 bp, human
ggcctgagggcgtgtatccg

SEQ ID NO: 124661 - DNA, 20 bp, human
gaggaccagcccggctgcta

SEQ ID NO: 124662 - DNA, 20 bp, human
gcccatagaacaggcatcaa

SEQ ID NO: 124663 - DNA, 20 bp, human
gtggtcctgctgcgagccgg

SEQ ID NO: 124664 - DNA, 20 bp, human
ggggtaagtgggcacgaacg

SEQ ID NO: 124665 - DNA, 20 bp, human
gtctctggcccagagcgctc

SEQ ID NO: 124666 - DNA, 20 bp, human
gccgcgcccatagccggacg

SEQ ID NO: 124667 - DNA, 20 bp, human
gaacccagtccagaagccgt

SEQ ID NO: 124668 - DNA, 20 bp, human
ggccagctcagatccccgtc

SEQ ID NO: 124669 - DNA, 20 bp, human
ggccggacggggatctgagc

SEQ ID NO: 124670 - DNA, 20 bp, human
gttcctggagacttcaggtg

SEQ ID NO: 124671 - DNA, 20 bp, human
gcagatccccgtccggctat

SEQ ID NO: 124672 - DNA, 20 bp, human
gggcgggcttaaggaactgg

SEQ ID NO: 124673 - DNA, 20 bp, human
ggttgctgaggaaaaatggt

SEQ ID NO: 124674 - DNA, 20 bp, human
gaaggagaggcgttacttcc

SEQ ID NO: 124675 - DNA, 20 bp, human
gcacgcttgagagaagtaat

SEQ ID NO: 124676 - DNA, 20 bp, human
ggtgtggggccgaagatcaa

SEQ ID NO: 124677 - DNA, 20 bp, human
gcagcagctgtaacaacccg

SEQ ID NO: 124678 - DNA, 20 bp, human
gcggcccgggaacggttccc

SEQ ID NO: 124679 - DNA, 20 bp, human
ggccggagctgccagcgggg

SEQ ID NO: 124680 - DNA, 20 bp, human
gcgggaacggttcccgggag

SEQ ID NO: 124681 - DNA, 20 bp, human
gcgcgttcacccagccctgg

SEQ ID NO: 124682 - DNA, 20 bp, human
gaagatcaacggcccgggaa

SEQ ID NO: 124683 - DNA, 20 bp, human
ggttccgagtgcgaagaccc

SEQ ID NO: 124684 - DNA, 20 bp, human
gtggctgtggggtcccggac

SEQ ID NO: 124685 - DNA, 20 bp, human
gctcggaacccggtccggtc

SEQ ID NO: 124686 - DNA, 20 bp, human
gggaagcgggtaagagatag

SEQ ID NO: 124687 - DNA, 20 bp, human
gcaccgccggtcagacttgc

SEQ ID NO: 124688 - DNA, 20 bp, human
gtacccgcaagtctgaccgg

SEQ ID NO: 124689 - DNA, 20 bp, human
gcaggtgagaggcgtataag

SEQ ID NO: 124690 - DNA, 20 bp, human
gtccgccctaagccaggcag

SEQ ID NO: 124691 - DNA, 20 bp, human
gagcagcagtcctaacaaac

SEQ ID NO: 124692 - DNA, 20 bp, human
ggccgttgcctgtcatggga

SEQ ID NO: 124693 - DNA, 20 bp, human
ggagacctgaaggttgacag

SEQ ID NO: 124694 - DNA, 20 bp, human
ggtataaggggcgagggtct

SEQ ID NO: 124695 - DNA, 20 bp, human
gttcaggctcccgacaccgc

SEQ ID NO: 124696 - DNA, 20 bp, human
gtcacttgaggaagaccccg

SEQ ID NO: 124697 - DNA, 20 bp, human
gaggaagaccccgcggatat

SEQ ID NO: 124698 - DNA, 20 bp, human
gcggcgacggcggctctcgt

SEQ ID NO: 124699 - DNA, 20 bp, human
gccgcctggagatacaagac

SEQ ID NO: 124700 - DNA, 20 bp, human
gcgacggcggctctcgtagg

SEQ ID NO: 124701 - DNA, 20 bp, human
gccgcccggagcgccccaca

SEQ ID NO: 124702 - DNA, 20 bp, human
gtgcgcggcggtggctgatg

SEQ ID NO: 124703 - DNA, 20 bp, human
gttatatcaaaggctaccag

SEQ ID NO: 124704 - DNA, 20 bp, human
gtagccgtgtggggcgctcc

SEQ ID NO: 124705 - DNA, 20 bp, human
ggttcgggctcggctcgaga

SEQ ID NO: 124706 - DNA, 20 bp, human
gccgctgtcagaacaggtgt

SEQ ID NO: 124707 - DNA, 20 bp, human
gcggacctaggaaggaccca

SEQ ID NO: 124708 - DNA, 20 bp, human
ggtgtcggaggcagtttcgg

SEQ ID NO: 124709 - DNA, 20 bp, human
gtcggaggcagtgccaagat

SEQ ID NO: 124710 - DNA, 20 bp, human
gtgcctgtcgtgccacacgg

SEQ ID NO: 124711 - DNA, 20 bp, human
gccaccggccggacctagga

SEQ ID NO: 124712 - DNA, 20 bp, human
ggagtcaagctcaggtgtag

SEQ ID NO: 124713 - DNA, 20 bp, human
gcgggagagcggctccgatg

SEQ ID NO: 124714 - DNA, 20 bp, human
gaggacccagggtccaaaca

SEQ ID NO: 124715 - DNA, 20 bp, human
ggcggccgagcggccagtgg

SEQ ID NO: 124716 - DNA, 20 bp, human
gccccttcggatccaagaga

SEQ ID NO: 124717 - DNA, 20 bp, human
gcagtccagggcacagacgg

SEQ ID NO: 124718 - DNA, 20 bp, human
ggcgcccacggaccatggag

SEQ ID NO: 124719 - DNA, 20 bp, human
gggaggccgatctgcagggt

SEQ ID NO: 124720 - DNA, 20 bp, human
gacgcaggaagggcaccgtt

SEQ ID NO: 124721 - DNA, 20 bp, human
gaccgttgggaggcatcact

SEQ ID NO: 124722 - DNA, 20 bp, human
gcctccagggctggcagaac

SEQ ID NO: 124723 - DNA, 20 bp, human
gggagggagccggcgctcga

SEQ ID NO: 124724 - DNA, 20 bp, human
gcaggaagggcaccgttggg

SEQ ID NO: 124725 - DNA, 20 bp, human
gcaccaacctcctccagggc

SEQ ID NO: 124726 - DNA, 20 bp, human
ggatagcgcgagagactcac

SEQ ID NO: 124727 - DNA, 20 bp, human
ggacccaagcgcgaatgcca

SEQ ID NO: 124728 - DNA, 20 bp, human
gggccctggctgtatctcgg

SEQ ID NO: 124729 - DNA, 20 bp, human
gctggcccgggccctcgact

SEQ ID NO: 124730 - DNA, 20 bp, human
ggcagattctgtagccaaga

SEQ ID NO: 124731 - DNA, 20 bp, human
gagcccccgagatacagcca

SEQ ID NO: 124732 - DNA, 20 bp, human
gggacccgcggcctaacctc

SEQ ID NO: 124733 - DNA, 20 bp, human
ggtctcctccgcaggtcctc

SEQ ID NO: 124734 - DNA, 20 bp, human
gagccaagacggctgggaaa

SEQ ID NO: 124735 - DNA, 20 bp, human
ggttctctcccgctcaagaa

SEQ ID NO: 124736 - DNA, 20 bp, human
gatggtcgtggcacccgagt

SEQ ID NO: 124737 - DNA, 20 bp, human
gccggagacagacgttacgc

SEQ ID NO: 124738 - DNA, 20 bp, human
gaagtggtcgtcaccaactc

SEQ ID NO: 124739 - DNA, 20 bp, human
gtgcggcaccagcatggtcg

SEQ ID NO: 124740 - DNA, 20 bp, human
gggggagtgccagccagagt

SEQ ID NO: 124741 - DNA, 20 bp, human
ggcgggctcgagcgtcctcg

SEQ ID NO: 124742 - DNA, 20 bp, human
gggtcgtcaccaactctggc

SEQ ID NO: 124743 - DNA, 20 bp, human
ggtccgcccgccccacgtcg

SEQ ID NO: 124744 - DNA, 20 bp, human
gaacgtctgtctccgggacc

SEQ ID NO: 124745 - DNA, 20 bp, human
gaggcacgcagctgaagatc

SEQ ID NO: 124746 - DNA, 20 bp, human
gtgagctcggccggcaaccg

SEQ ID NO: 124747 - DNA, 20 bp, human
gcgggcgcgcctcccagtgg

SEQ ID NO: 124748 - DNA, 20 bp, human
gaaccgagggacccgcgtcc

SEQ ID NO: 124749 - DNA, 20 bp, human
gcacctggacgcgggtccct

SEQ ID NO: 124750 - DNA, 20 bp, human
gacctcaccgggaacaggga

SEQ ID NO: 124751 - DNA, 20 bp, human
gcccggcctcgacccccact

SEQ ID NO: 124752 - DNA, 20 bp, human
gcaccacctcaccgggaaca

SEQ ID NO: 124753 - DNA, 20 bp, human
gtagggcgatcctgtaggtg

SEQ ID NO: 124754 - DNA, 20 bp, human
ggtccccacttcctgctcag

SEQ ID NO: 124755 - DNA, 20 bp, human
gggcggggcggcagtgagct

SEQ ID NO: 124756 - DNA, 20 bp, human
ggcgcgcgccgagaagttct

SEQ ID NO: 124757 - DNA, 20 bp, human
gcggcggcgcgggctcggaa

SEQ ID NO: 124758 - DNA, 20 bp, human
gccggtccggcagagaaccg

SEQ ID NO: 124759 - DNA, 20 bp, human
gactcggacagaccccggtc

SEQ ID NO: 124760 - DNA, 20 bp, human
gagcccgaggagccgcgcaa

SEQ ID NO: 124761 - DNA, 20 bp, human
ggggcgactcggacagaccc

SEQ ID NO: 124762 - DNA, 20 bp, human
gtgggcaaagtactcagaac

SEQ ID NO: 124763 - DNA, 20 bp, human
gcggggaggctccggccctg

SEQ ID NO: 124764 - DNA, 20 bp, human
gaaccgggagaaggcaaccc

SEQ ID NO: 124765 - DNA, 20 bp, human
ggctcctcgggctaatcgcc

SEQ ID NO: 124766 - DNA, 20 bp, human
gaaaggagccgggaccgcca

SEQ ID NO: 124767 - DNA, 20 bp, human
ggagctcgcggcacggtagg

SEQ ID NO: 124768 - DNA, 20 bp, human
gtcgcggcacggtaggaggt

SEQ ID NO: 124769 - DNA, 20 bp, human
ggcccggagcaccgagctcg

SEQ ID NO: 124770 - DNA, 20 bp, human
gctcggctccccacttggtg

SEQ ID NO: 124771 - DNA, 20 bp, human
gaccgagctcgcggcacggt

SEQ ID NO: 124772 - DNA, 20 bp, human
ggagcaccgagctcgcggca

SEQ ID NO: 124773 - DNA, 20 bp, human
gctttaagccccaccaagtg

SEQ ID NO: 124774 - DNA, 20 bp, human
ggctactgccagggtccgcg

SEQ ID NO: 124775 - DNA, 20 bp, human
gccaccttccctggcggtcc

SEQ ID NO: 124776 - DNA, 20 bp, human
gcgatctccagcaccgacag

SEQ ID NO: 124777 - DNA, 20 bp, human
ggcgcgggctagtggaggag

SEQ ID NO: 124778 - DNA, 20 bp, human
gtctccagcaccgacagcgg

SEQ ID NO: 124779 - DNA, 20 bp, human
gcagcgcagcggaccactgg

SEQ ID NO: 124780 - DNA, 20 bp, human
gtggcaacgagggggaggga

SEQ ID NO: 124781 - DNA, 20 bp, human
gctggcgcgcgggctagtgg

SEQ ID NO: 124782 - DNA, 20 bp, human
gcccgggctacagggaagtg

SEQ ID NO: 124783 - DNA, 20 bp, human
ggaccgtgctgcgcctccag

SEQ ID NO: 124784 - DNA, 20 bp, human
ggaattccctggcaacgagg

SEQ ID NO: 124785 - DNA, 20 bp, human
gccatcccggccgcgagaat

SEQ ID NO: 124786 - DNA, 20 bp, human
gctcggagacggtgactcag

SEQ ID NO: 124787 - DNA, 20 bp, human
gggagccggtgactcggaga

SEQ ID NO: 124788 - DNA, 20 bp, human
ggtcaccgtctccgagtcac

SEQ ID NO: 124789 - DNA, 20 bp, human
gcccagaggggacagggatg

SEQ ID NO: 124790 - DNA, 20 bp, human
gcgcaagggccaaggagtac

SEQ ID NO: 124791 - DNA, 20 bp, human
gagggggaggctctatcggt

SEQ ID NO: 124792 - DNA, 20 bp, human
gcagaggcagagcggcgcaa

SEQ ID NO: 124793 - DNA, 20 bp, human
ggcaggaacgggtgcccagg

SEQ ID NO: 124794 - DNA, 20 bp, human
gcatggacgccagtactcct

SEQ ID NO: 124795 - DNA, 20 bp, human
gcccagagatacctgaacac

SEQ ID NO: 124796 - DNA, 20 bp, human
gctaccggcagcggctactg

SEQ ID NO: 124797 - DNA, 20 bp, human
gctccctgggagctccgcac

SEQ ID NO: 124798 - DNA, 20 bp, human
gtagcaagccgactgaggga

SEQ ID NO: 124799 - DNA, 20 bp, human
gcgacgcgctcctggccagg

SEQ ID NO: 124800 - DNA, 20 bp, human
ggctcagaacgtggcaataa

SEQ ID NO: 124801 - DNA, 20 bp, human
gggtgcgcagtcgccctgag

SEQ ID NO: 124802 - DNA, 20 bp, human
gcgcggcggatgacaacatt

SEQ ID NO: 124803 - DNA, 20 bp, human
gcagctgccgccgacgacag

SEQ ID NO: 124804 - DNA, 20 bp, human
gacagcccgagctcagaacg

SEQ ID NO: 124805 - DNA, 20 bp, human
gcacccgtgcggagctccca

SEQ ID NO: 124806 - DNA, 20 bp, human
gcccaagatggcgtccatca

SEQ ID NO: 124807 - DNA, 20 bp, human
gagatggcgtccatcatgga

SEQ ID NO: 124808 - DNA, 20 bp, human
gaatggactaacgtgatgaa

SEQ ID NO: 124809 - DNA, 20 bp, human
ggtagtccagcacgaaccaa

SEQ ID NO: 124810 - DNA, 20 bp, human
ggaagggctggcagtaccgt

SEQ ID NO: 124811 - DNA, 20 bp, human
gtcattggcggctcccaaga

SEQ ID NO: 124812 - DNA, 20 bp, human
gcttagggtccgctattaag

SEQ ID NO: 124813 - DNA, 20 bp, human
gggactgctctcctactaca

SEQ ID NO: 124814 - DNA, 20 bp, human
gagggaaccctcgcgtacgg

SEQ ID NO: 124815 - DNA, 20 bp, human
gacaagggaaccctcgcgta

SEQ ID NO: 124816 - DNA, 20 bp, human
gctcacgagttcaggaatct

SEQ ID NO: 124817 - DNA, 20 bp, human
gagcgggtatctgcccacca

SEQ ID NO: 124818 - DNA, 20 bp, human
gctggaaaggtggagttcaa

SEQ ID NO: 124819 - DNA, 20 bp, human
gctgattccctgggaaaagg

SEQ ID NO: 124820 - DNA, 20 bp, human
gagagggtgcgaccaagccc

SEQ ID NO: 124821 - DNA, 20 bp, human
gctcttgctttaggacccag

SEQ ID NO: 124822 - DNA, 20 bp, human
gcagctggaggatcagcacc

SEQ ID NO: 124823 - DNA, 20 bp, human
gcttgaggcaggaagaggtc

SEQ ID NO: 124824 - DNA, 20 bp, human
gcccagggaatcaggagtcc

SEQ ID NO: 124825 - DNA, 20 bp, human
ggattcccgaaagaggaagg

SEQ ID NO: 124826 - DNA, 20 bp, human
ggccgtggaggtaaaggaag

SEQ ID NO: 124827 - DNA, 20 bp, human
ggatggagccgtggaggtaa

SEQ ID NO: 124828 - DNA, 20 bp, human
gcacgcaggtccgcaaagtc

SEQ ID NO: 124829 - DNA, 20 bp, human
gaggtaaaggaagtggtgtc

SEQ ID NO: 124830 - DNA, 20 bp, human
gcagaacaaagatggagccg

SEQ ID NO: 124831 - DNA, 20 bp, human
gaacaaagatggagccgtgg

SEQ ID NO: 124832 - DNA, 20 bp, human
gcgaggtctcagctcaacat

SEQ ID NO: 124833 - DNA, 20 bp, human
gtcctgctgcgacccaccta

SEQ ID NO: 124834 - DNA, 20 bp, human
ggcaggaggactagtcactc

SEQ ID NO: 124835 - DNA, 20 bp, human
ggactaaggagattccacgc

SEQ ID NO: 124836 - DNA, 20 bp, human
gcactggctaccgaaccccg

SEQ ID NO: 124837 - DNA, 20 bp, human
gatactcccagtggacacta

SEQ ID NO: 124838 - DNA, 20 bp, human
gggtagcgtccgcaccgaca

SEQ ID NO: 124839 - DNA, 20 bp, human
gtgctggaaacgagctggac

SEQ ID NO: 124840 - DNA, 20 bp, human
gtggggaaattagggaggtc

SEQ ID NO: 124841 - DNA, 20 bp, human
gctggactggtgaagagccc

SEQ ID NO: 124842 - DNA, 20 bp, human
gcatggtgctggaaacgagc

SEQ ID NO: 124843 - DNA, 20 bp, human
gcgggagacaaggcccgcaa

SEQ ID NO: 124844 - DNA, 20 bp, human
gccccagcaaccggactatt

SEQ ID NO: 124845 - DNA, 20 bp, human
gggtgaagagccccggggtt

SEQ ID NO: 124846 - DNA, 20 bp, human
ggagcgtctctcccaaatct

SEQ ID NO: 124847 - DNA, 20 bp, human
gggccaaggagggcgaaaag

SEQ ID NO: 124848 - DNA, 20 bp, human
ggctccgaggcgagagagaa

SEQ ID NO: 124849 - DNA, 20 bp, human
ggaggtagccaaagagaatg

SEQ ID NO: 124850 - DNA, 20 bp, human
gcaaagagaatggggctccg

SEQ ID NO: 124851 - DNA, 20 bp, human
gtcagtcgggtgccgagatt

SEQ ID NO: 124852 - DNA, 20 bp, human
gggcaaagggcggccaagga

SEQ ID NO: 124853 - DNA, 20 bp, human
gcaggccgcggcagataagg

SEQ ID NO: 124854 - DNA, 20 bp, human
ggtttggatccgggtcagtc

SEQ ID NO: 124855 - DNA, 20 bp, human
ggagtcggagcgaggcacaa

SEQ ID NO: 124856 - DNA, 20 bp, human
gacaacgataaacagcccga

SEQ ID NO: 124857 - DNA, 20 bp, human
gcctgtcttcctaactgcca

SEQ ID NO: 124858 - DNA, 20 bp, human
ggcagctttccggagcgcag

SEQ ID NO: 124859 - DNA, 20 bp, human
gggcccagcgcggactagtg

SEQ ID NO: 124860 - DNA, 20 bp, human
ggccagcctgcagatagcac

SEQ ID NO: 124861 - DNA, 20 bp, human
gctggcaatgtcaggagctg

SEQ ID NO: 124862 - DNA, 20 bp, human
gagcactgggaaagacaccg

SEQ ID NO: 124863 - DNA, 20 bp, human
ggccagcttcctctgcgctc

SEQ ID NO: 124864 - DNA, 20 bp, human
gcccagtgctatctgcaggc

SEQ ID NO: 124865 - DNA, 20 bp, human
gcaaggtgctggcgaacccg

SEQ ID NO: 124866 - DNA, 20 bp, human
gcacccaccttccacttggg

SEQ ID NO: 124867 - DNA, 20 bp, human
gctactgccgcccaagtgga

SEQ ID NO: 124868 - DNA, 20 bp, human
gcagtcgacagtctttagta

SEQ ID NO: 124869 - DNA, 20 bp, human
gaaagggacacggcatccca

SEQ ID NO: 124870 - DNA, 20 bp, human
gctttctcctgcagcgataa

SEQ ID NO: 124871 - DNA, 20 bp, human
gtgccgcccaagtggaaggt

SEQ ID NO: 124872 - DNA, 20 bp, human
gagcgctacccaagtcacgt

SEQ ID NO: 124873 - DNA, 20 bp, human
gccaccacactaaagggaca

SEQ ID NO: 124874 - DNA, 20 bp, human
gggctgaacccacgtgactt

SEQ ID NO: 124875 - DNA, 20 bp, human
gccagacagacacaacctag

SEQ ID NO: 124876 - DNA, 20 bp, human
gcgctcctagcaggaaagag

SEQ ID NO: 124877 - DNA, 20 bp, human
gtgtgcactaggagggtcag

SEQ ID NO: 124878 - DNA, 20 bp, human
gtaccctgtggggatccaag

SEQ ID NO: 124879 - DNA, 20 bp, human
gggacacccattaccctgtg

SEQ ID NO: 124880 - DNA, 20 bp, human
gacagctgggcagtaagccc

SEQ ID NO: 124881 - DNA, 20 bp, human
gagcctcttggatccccaca

SEQ ID NO: 124882 - DNA, 20 bp, human
gtggatccccacagggtaat

SEQ ID NO: 124883 - DNA, 20 bp, human
gagcctggctgccgacccag

SEQ ID NO: 124884 - DNA, 20 bp, human
ggggtgtcccgatctcgcgg

SEQ ID NO: 124885 - DNA, 20 bp, human
gcagagtcccccgcgagatc

SEQ ID NO: 124886 - DNA, 20 bp, human
gagcggaagccgctatctgg

SEQ ID NO: 124887 - DNA, 20 bp, human
gagccagcgggcgccccgag

SEQ ID NO: 124888 - DNA, 20 bp, human
gggagtccgcctccagatag

SEQ ID NO: 124889 - DNA, 20 bp, human
gggaagccgctatctggagg

SEQ ID NO: 124890 - DNA, 20 bp, human
ggagcagcggcagcaccaca

SEQ ID NO: 124891 - DNA, 20 bp, human
gaggagcggaagccgctatc

SEQ ID NO: 124892 - DNA, 20 bp, human
gggaacagcgcagggctccc

SEQ ID NO: 124893 - DNA, 20 bp, human
gacggcgaggcgcgaggcag

SEQ ID NO: 124894 - DNA, 20 bp, human
ggcggtccagagcgagaaaa

SEQ ID NO: 124895 - DNA, 20 bp, human
gccggaggcgggtgatctcg

SEQ ID NO: 124896 - DNA, 20 bp, human
gcgagaggtgtcacccccag

SEQ ID NO: 124897 - DNA, 20 bp, human
ggagcacgggcacccagcat

SEQ ID NO: 124898 - DNA, 20 bp, human
gcgggcgcgggccggagcac

SEQ ID NO: 124899 - DNA, 20 bp, human
gtgcagggctcccagccgag

SEQ ID NO: 124900 - DNA, 20 bp, human
gtgagcagtacccccatgct

SEQ ID NO: 124901 - DNA, 20 bp, human
ggagtggtccactgagaacc

SEQ ID NO: 124902 - DNA, 20 bp, human
gttcatcccgggcaagctgg

SEQ ID NO: 124903 - DNA, 20 bp, human
gaggtgatgtcaagatgtag

SEQ ID NO: 124904 - DNA, 20 bp, human
gcagcaggcgggttctggcg

SEQ ID NO: 124905 - DNA, 20 bp, human
gaaccagggggtgagagaat

SEQ ID NO: 124906 - DNA, 20 bp, human
gagccgggccgagtcctcgg

SEQ ID NO: 124907 - DNA, 20 bp, human
gcccggcctgcctacctggt

SEQ ID NO: 124908 - DNA, 20 bp, human
gggtcgcgtccagccgggat

SEQ ID NO: 124909 - DNA, 20 bp, human
ggtctgagaaatgggcgact

SEQ ID NO: 124910 - DNA, 20 bp, human
gtgggcgactcggcactgtg

SEQ ID NO: 124911 - DNA, 20 bp, human
gacgagccgggccgagtcct

SEQ ID NO: 124912 - DNA, 20 bp, human
gcggcactgtgcggcctgta

SEQ ID NO: 124913 - DNA, 20 bp, human
gccacgcgccgccgaggact

SEQ ID NO: 124914 - DNA, 20 bp, human
gctccggggcggacgtgcag

SEQ ID NO: 124915 - DNA, 20 bp, human
gccgtcggaaaagccaccga

SEQ ID NO: 124916 - DNA, 20 bp, human
gtcggagctcggcctctccc

SEQ ID NO: 124917 - DNA, 20 bp, human
gcctggttcagacccagcga

SEQ ID NO: 124918 - DNA, 20 bp, human
gggagcagctgagaacgtgc

SEQ ID NO: 124919 - DNA, 20 bp, human
gggacggtgagcctcgctcg

SEQ ID NO: 124920 - DNA, 20 bp, human
gtgctaagggatgagtgagt

SEQ ID NO: 124921 - DNA, 20 bp, human
gccccggcgtgcaggatccg

SEQ ID NO: 124922 - DNA, 20 bp, human
gctgagaacgtgccggggag

SEQ ID NO: 124923 - DNA, 20 bp, human
gcgctcgcggctccctcgct

SEQ ID NO: 124924 - DNA, 20 bp, human
ggagcagtgacaaggaacct

SEQ ID NO: 124925 - DNA, 20 bp, human
gttgttccgcagaggtcctg

SEQ ID NO: 124926 - DNA, 20 bp, human
gcccgcagaaaggtcaacct

SEQ ID NO: 124927 - DNA, 20 bp, human
gtcgctgtcgactcccggtg

SEQ ID NO: 124928 - DNA, 20 bp, human
ggagtgttcgctctgggaag

SEQ ID NO: 124929 - DNA, 20 bp, human
gcggcgtgcttgctgctgga

SEQ ID NO: 124930 - DNA, 20 bp, human
gtgtcgactcccggtgaggt

SEQ ID NO: 124931 - DNA, 20 bp, human
ggctgtagctgccctttgga

SEQ ID NO: 124932 - DNA, 20 bp, human
gctgtgggctccgacctcac

SEQ ID NO: 124933 - DNA, 20 bp, human
ggcccaagactcccggcctg

SEQ ID NO: 124934 - DNA, 20 bp, human
gaggagtcgcggacatgatc

SEQ ID NO: 124935 - DNA, 20 bp, human
gggaggtgagtgttcgctct

SEQ ID NO: 124936 - DNA, 20 bp, human
gcttcgggcttgttcgctgg

SEQ ID NO: 124937 - DNA, 20 bp, human
ggcctctgacctgaccagtc

SEQ ID NO: 124938 - DNA, 20 bp, human
ggagccgagccggactggtc

SEQ ID NO: 124939 - DNA, 20 bp, human
gcgtcggagccgagccggac

SEQ ID NO: 124940 - DNA, 20 bp, human
gcgaagtcagagacctggac

SEQ ID NO: 124941 - DNA, 20 bp, human
gtgacctgaccagtccggct

SEQ ID NO: 124942 - DNA, 20 bp, human
gtccggggaggcggccacca

SEQ ID NO: 124943 - DNA, 20 bp, human
gcacgcaggggccgtcccac

SEQ ID NO: 124944 - DNA, 20 bp, human
gagcgacacgcccagcatgt

SEQ ID NO: 124945 - DNA, 20 bp, human
gatcatcctgcggagaagag

SEQ ID NO: 124946 - DNA, 20 bp, human
gggaacagacgcgcctcccg

SEQ ID NO: 124947 - DNA, 20 bp, human
gtgactcggatccctgggat

SEQ ID NO: 124948 - DNA, 20 bp, human
gctcggatccctgggatggg

SEQ ID NO: 124949 - DNA, 20 bp, human
gccgacggcatgtgcaacca

SEQ ID NO: 124950 - DNA, 20 bp, human
gttctagccctcccatccca

SEQ ID NO: 124951 - DNA, 20 bp, human
gacagacgcgcctcccgggg

SEQ ID NO: 124952 - DNA, 20 bp, human
gagaactgacccgccccggg

SEQ ID NO: 124953 - DNA, 20 bp, human
gtgtttccgggaggcgcgtg

SEQ ID NO: 124954 - DNA, 20 bp, human
gctcttaagacagggcgtga

SEQ ID NO: 124955 - DNA, 20 bp, human
ggcacgcgcacttgttaggg

SEQ ID NO: 124956 - DNA, 20 bp, human
gtaggaccggcgcccaccct

SEQ ID NO: 124957 - DNA, 20 bp, human
gcccttggctgcgggaagag

SEQ ID NO: 124958 - DNA, 20 bp, human
gggtgggcgccggtcctagg

SEQ ID NO: 124959 - DNA, 20 bp, human
gaccgtgcgcctcctaggac

SEQ ID NO: 124960 - DNA, 20 bp, human
ggacaacgtagcaaaagtga

SEQ ID NO: 124961 - DNA, 20 bp, human
gcggcgcccacccttggctg

SEQ ID NO: 124962 - DNA, 20 bp, human
ggccggtcctaggaggcgca

SEQ ID NO: 124963 - DNA, 20 bp, human
gcagtcaaaccaggtgaggg

SEQ ID NO: 124964 - DNA, 20 bp, human
gagatcggccccaccgggat

SEQ ID NO: 124965 - DNA, 20 bp, human
gggaggcgccggcaccgcgg

SEQ ID NO: 124966 - DNA, 20 bp, human
gacgcgccctcctcgtgacc

SEQ ID NO: 124967 - DNA, 20 bp, human
gggtcgtggaagaccctgtg

SEQ ID NO: 124968 - DNA, 20 bp, human
gaccgggctcacacacccca

SEQ ID NO: 124969 - DNA, 20 bp, human
gcgctcgcggaaaccggaag

SEQ ID NO: 124970 - DNA, 20 bp, human
gtcgggcccggctccatcac

SEQ ID NO: 124971 - DNA, 20 bp, human
gggggtagcaggtctgacag

SEQ ID NO: 124972 - DNA, 20 bp, human
gcagcagcgcagagctgaca

SEQ ID NO: 124973 - DNA, 20 bp, human
gaggtctgacagaggcgcac

SEQ ID NO: 124974 - DNA, 20 bp, human
gcggaagcggcggctgtccg

SEQ ID NO: 124975 - DNA, 20 bp, human
ggcagagctgacagggtgtc

SEQ ID NO: 124976 - DNA, 20 bp, human
gagagtggtctaaacaacct

SEQ ID NO: 124977 - DNA, 20 bp, human
gcaacctaggtaaaaaagaa

SEQ ID NO: 124978 - DNA, 20 bp, human
gacttacctcgtgaaagatc

SEQ ID NO: 124979 - DNA, 20 bp, human
gctccaaaactcagccctgg

SEQ ID NO: 124980 - DNA, 20 bp, human
gcaccaccagggctgagttt

SEQ ID NO: 124981 - DNA, 20 bp, human
gaatctcctgatctttcacg

SEQ ID NO: 124982 - DNA, 20 bp, human
gtttttgtaatgcaaactta

SEQ ID NO: 124983 - DNA, 20 bp, human
gtcattatttctatcaaaac

SEQ ID NO: 124984 - DNA, 20 bp, human
ggattttgttaaaattagag

SEQ ID NO: 124985 - DNA, 20 bp, human
ggagagaaaactcaccacca

SEQ ID NO: 124986 - DNA, 20 bp, human
gctgtaggggaagccaccca

SEQ ID NO: 124987 - DNA, 20 bp, human
gtccacagcaagttagccag

SEQ ID NO: 124988 - DNA, 20 bp, human
gaggggaagccacccatggc

SEQ ID NO: 124989 - DNA, 20 bp, human
gcttgctgtggagttttcaa

SEQ ID NO: 124990 - DNA, 20 bp, human
gctgttatacctgccatggg

SEQ ID NO: 124991 - DNA, 20 bp, human
gtaaccaggggactttgata

SEQ ID NO: 124992 - DNA, 20 bp, human
gagtctgttatacctgccat

SEQ ID NO: 124993 - DNA, 20 bp, human
gctgcagtatctctaaccag

SEQ ID NO: 124994 - DNA, 20 bp, human
gaagtggctgaaggaaatta

SEQ ID NO: 124995 - DNA, 20 bp, human
gaagtgatggtcagagactt

SEQ ID NO: 124996 - DNA, 20 bp, human
gtgtataactcgacactcca

SEQ ID NO: 124997 - DNA, 20 bp, human
gggaaaagggagtatgtcgt

SEQ ID NO: 124998 - DNA, 20 bp, human
gccaggcagggtaagtcctg

SEQ ID NO: 124999 - DNA, 20 bp, human
gaactacaggagaatgtctc

SEQ ID NO: 125000 - DNA, 20 bp, human
gaagttggcaattccagtag

SEQ ID NO: 125001 - DNA, 20 bp, human
ggtccactctgagaaaaccg

SEQ ID NO: 125002 - DNA, 20 bp, human
gtaatcagagtcccctctac

SEQ ID NO: 125003 - DNA, 20 bp, human
gcagtgccaaattccaggca

SEQ ID NO: 125004 - DNA, 20 bp, human
gaactgtgtggaaaccacaa

SEQ ID NO: 125005 - DNA, 20 bp, human
gttatacagtgccaaattcc

SEQ ID NO: 125006 - DNA, 20 bp, human
gatgctgcccacagagacca

SEQ ID NO: 125007 - DNA, 20 bp, human
gtggttgccttggtctctgt

SEQ ID NO: 125008 - DNA, 20 bp, human
gacacaggcatggaagaaca

SEQ ID NO: 125009 - DNA, 20 bp, human
gtctctgtgggcagcatcgg

SEQ ID NO: 125010 - DNA, 20 bp, human
gacaatggccagtcagtccc

SEQ ID NO: 125011 - DNA, 20 bp, human
gctgtgggcagcatcggagg

SEQ ID NO: 125012 - DNA, 20 bp, human
gcagagccctctgcctgggg

SEQ ID NO: 125013 - DNA, 20 bp, human
ggcgggaaggagctagccgg

SEQ ID NO: 125014 - DNA, 20 bp, human
gagacagtctcggagctgcg

SEQ ID NO: 125015 - DNA, 20 bp, human
gctgggctgacaacttggag

SEQ ID NO: 125016 - DNA, 20 bp, human
ggggaccccgaagccaacag

SEQ ID NO: 125017 - DNA, 20 bp, human
gagggacctcggctgcggag

SEQ ID NO: 125018 - DNA, 20 bp, human
gaccctgccttagcccgggg

SEQ ID NO: 125019 - DNA, 20 bp, human
ggaggtgcctccccgggcta

SEQ ID NO: 125020 - DNA, 20 bp, human
ggacctcggctgcggagtgg

SEQ ID NO: 125021 - DNA, 20 bp, human
ggcctccccgggctaaggca

SEQ ID NO: 125022 - DNA, 20 bp, human
gagggacacgaggggaccgg

SEQ ID NO: 125023 - DNA, 20 bp, human
gatgagaacaagagggacct

SEQ ID NO: 125024 - DNA, 20 bp, human
gggtggaagagacccgaggt

SEQ ID NO: 125025 - DNA, 20 bp, human
gacaagagggacctcggctg

SEQ ID NO: 125026 - DNA, 20 bp, human
ggaagcaagaatatactcca

SEQ ID NO: 125027 - DNA, 20 bp, human
gtgtatgtagttggaaagcc

SEQ ID NO: 125028 - DNA, 20 bp, human
gttcagatgctgtatgtagt

SEQ ID NO: 125029 - DNA, 20 bp, human
gtagaagtatgcatatttgt

SEQ ID NO: 125030 - DNA, 20 bp, human
ggacttcaaagtgctttata

SEQ ID NO: 125031 - DNA, 20 bp, human
gcaatttggttacatttcag

SEQ ID NO: 125032 - DNA, 20 bp, human
gtactgctgttttcattaca

SEQ ID NO: 125033 - DNA, 20 bp, human
gataataaagaccatcaatt

SEQ ID NO: 125034 - DNA, 20 bp, human
gactcaatttaatgatacct

SEQ ID NO: 125035 - DNA, 20 bp, human
gtaattcaaaaaggaattcc

SEQ ID NO: 125036 - DNA, 20 bp, human
gaacaacgtagaaactcctg

SEQ ID NO: 125037 - DNA, 20 bp, human
gtgcaaatagtaacaggtct

SEQ ID NO: 125038 - DNA, 20 bp, human
gagttgagaggtaggttgtc

SEQ ID NO: 125039 - DNA, 20 bp, human
gagggtctaaagccatccag

SEQ ID NO: 125040 - DNA, 20 bp, human
gagacagaatccaaggccga

SEQ ID NO: 125041 - DNA, 20 bp, human
gtcttccagcttcaaatatg

SEQ ID NO: 125042 - DNA, 20 bp, human
gctggctgtccagtctctcc

SEQ ID NO: 125043 - DNA, 20 bp, human
ggaatccaaggccgagggtt

SEQ ID NO: 125044 - DNA, 20 bp, human
gcacctgtacccgggcagaa

SEQ ID NO: 125045 - DNA, 20 bp, human
ggaaccaattaccaaaccct

SEQ ID NO: 125046 - DNA, 20 bp, human
ggtgtctcgaagatgctcga

SEQ ID NO: 125047 - DNA, 20 bp, human
gctcggtcgcagggtcgtcg

SEQ ID NO: 125048 - DNA, 20 bp, human
ggactcaccgcgcagccagc

SEQ ID NO: 125049 - DNA, 20 bp, human
gcgggcagctgcaagcgcct

SEQ ID NO: 125050 - DNA, 20 bp, human
gaggatgcagccagcgggcg

SEQ ID NO: 125051 - DNA, 20 bp, human
ggcgcggtgagtccaggcgc

SEQ ID NO: 125052 - DNA, 20 bp, human
gacctcggggccgaggacga

SEQ ID NO: 125053 - DNA, 20 bp, human
gaggcggagacccgctcgcc

SEQ ID NO: 125054 - DNA, 20 bp, human
gtgcaagcgcctcggtcgca

SEQ ID NO: 125055 - DNA, 20 bp, human
gaggacacgcacgcgggtgc

SEQ ID NO: 125056 - DNA, 20 bp, human
gtcgcctgcacgctcatcag

SEQ ID NO: 125057 - DNA, 20 bp, human
gccggcccggggcacccacc

SEQ ID NO: 125058 - DNA, 20 bp, human
ggctagagggatcactgtag

SEQ ID NO: 125059 - DNA, 20 bp, human
ggcgccgcgtgcgggcccca

SEQ ID NO: 125060 - DNA, 20 bp, human
gccgactgccctccggcccg

SEQ ID NO: 125061 - DNA, 20 bp, human
gcccagggaggtgtggaaga

SEQ ID NO: 125062 - DNA, 20 bp, human
gcgcctgtccatctcggcgt

SEQ ID NO: 125063 - DNA, 20 bp, human
ggccagctcctcggacatgg

SEQ ID NO: 125064 - DNA, 20 bp, human
gcggagggcagtcggacttg

SEQ ID NO: 125065 - DNA, 20 bp, human
gctcccacgccgagatggac

SEQ ID NO: 125066 - DNA, 20 bp, human
gccgggagaggcatcgccgt

SEQ ID NO: 125067 - DNA, 20 bp, human
gggtccacggaaaggagtag

SEQ ID NO: 125068 - DNA, 20 bp, human
gtgggctaaccaccgactgc

SEQ ID NO: 125069 - DNA, 20 bp, human
gggcgctccgggcttacctg

SEQ ID NO: 125070 - DNA, 20 bp, human
gggcatcggtctcacctgga

SEQ ID NO: 125071 - DNA, 20 bp, human
gggccccgcagtccctaaaa

SEQ ID NO: 125072 - DNA, 20 bp, human
gcgcgggcatcggtctcacc

SEQ ID NO: 125073 - DNA, 20 bp, human
gggctcggaaggaaatcccg

SEQ ID NO: 125074 - DNA, 20 bp, human
gcgggaaagcggggtgactg

SEQ ID NO: 125075 - DNA, 20 bp, human
gtgtctggacgcccggtctg

SEQ ID NO: 125076 - DNA, 20 bp, human
gtacagccacaagacccggg

SEQ ID NO: 125077 - DNA, 20 bp, human
gacatacagccacaagaccc

SEQ ID NO: 125078 - DNA, 20 bp, human
gaagcggggactgacttcag

SEQ ID NO: 125079 - DNA, 20 bp, human
gaagctgataacatacacat

SEQ ID NO: 125080 - DNA, 20 bp, human
gcttgaactctgactggaag

SEQ ID NO: 125081 - DNA, 20 bp, human
ggagcttcttggaagctaga

SEQ ID NO: 125082 - DNA, 20 bp, human
gttactacggagaattcact

SEQ ID NO: 125083 - DNA, 20 bp, human
gtgaattttataacagtaaa

SEQ ID NO: 125084 - DNA, 20 bp, human
gttcttctggtctgcatgtt

SEQ ID NO: 125085 - DNA, 20 bp, human
gttttaacttgaactctgac

SEQ ID NO: 125086 - DNA, 20 bp, human
gtgcaagaggccccagtagg

SEQ ID NO: 125087 - DNA, 20 bp, human
ggacaaggtaagctctggag

SEQ ID NO: 125088 - DNA, 20 bp, human
gagcaggatgaacccaggaa

SEQ ID NO: 125089 - DNA, 20 bp, human
gcaccagctgcagggctcta

SEQ ID NO: 125090 - DNA, 20 bp, human
ggaggggccgctctggaggg

SEQ ID NO: 125091 - DNA, 20 bp, human
ggggctgcccacactgggac

SEQ ID NO: 125092 - DNA, 20 bp, human
gacctgcaagaggccccagt

SEQ ID NO: 125093 - DNA, 20 bp, human
ggagaacaggagggctgtcg

SEQ ID NO: 125094 - DNA, 20 bp, human
gccccagggctgcccacact

SEQ ID NO: 125095 - DNA, 20 bp, human
ggagccctgcagctggtgtc

SEQ ID NO: 125096 - DNA, 20 bp, human
ggaatatgtagatccaagaa

SEQ ID NO: 125097 - DNA, 20 bp, human
gagatccaagaaaggagttg

SEQ ID NO: 125098 - DNA, 20 bp, human
ggagtgcgcgcctctcgccc

SEQ ID NO: 125099 - DNA, 20 bp, human
gcacctccccgtctctctaa

SEQ ID NO: 125100 - DNA, 20 bp, human
gtcggtttgtggttaaaaag

SEQ ID NO: 125101 - DNA, 20 bp, human
ggtcgcattaaggtaaaata

SEQ ID NO: 125102 - DNA, 20 bp, human
gagcatcgcgcaccgctcca

SEQ ID NO: 125103 - DNA, 20 bp, human
gctcctaacaaattatcacg

SEQ ID NO: 125104 - DNA, 20 bp, human
gacctagcctggcgtccagg

SEQ ID NO: 125105 - DNA, 20 bp, human
gtaccccgtgataatttgtt

SEQ ID NO: 125106 - DNA, 20 bp, human
gggcagagaggcctacgcca

SEQ ID NO: 125107 - DNA, 20 bp, human
gcttcggagtcgctgcccag

SEQ ID NO: 125108 - DNA, 20 bp, human
gcggcgctgtttaaagatgg

SEQ ID NO: 125109 - DNA, 20 bp, human
gtccccagggcccaactcat

SEQ ID NO: 125110 - DNA, 20 bp, human
gagcagaagcaggagccgct

SEQ ID NO: 125111 - DNA, 20 bp, human
gtccttgcagtcaggcagag

SEQ ID NO: 125112 - DNA, 20 bp, human
gccggaagcggtcggtagtg

SEQ ID NO: 125113 - DNA, 20 bp, human
ggcgaaactcgaggccctca

SEQ ID NO: 125114 - DNA, 20 bp, human
gaggcgggaaaagacagagt

SEQ ID NO: 125115 - DNA, 20 bp, human
ggtgcggcgctgtttaaaga

SEQ ID NO: 125116 - DNA, 20 bp, human
gcgaccgctccgcaaaccaa

SEQ ID NO: 125117 - DNA, 20 bp, human
gtcggtggcggggacctcga

SEQ ID NO: 125118 - DNA, 20 bp, human
ggtccccgccaccgaaccag

SEQ ID NO: 125119 - DNA, 20 bp, human
gacatccacggggtacaggg

SEQ ID NO: 125120 - DNA, 20 bp, human
gctcgacggaagcagggaca

SEQ ID NO: 125121 - DNA, 20 bp, human
gtaacctttggtttgcggag

SEQ ID NO: 125122 - DNA, 20 bp, human
gggctccgccgctggttcgg

SEQ ID NO: 125123 - DNA, 20 bp, human
ggccccagcgaggagcgatc

SEQ ID NO: 125124 - DNA, 20 bp, human
ggctgggtgggcgccctcga

SEQ ID NO: 125125 - DNA, 20 bp, human
gccacccagcgccgtcgagg

SEQ ID NO: 125126 - DNA, 20 bp, human
gggcgggacgcgctccaacg

SEQ ID NO: 125127 - DNA, 20 bp, human
gctgcagcgagaccttgaag

SEQ ID NO: 125128 - DNA, 20 bp, human
gttcctccgtgagtccccag

SEQ ID NO: 125129 - DNA, 20 bp, human
gcggtggacgtgtagtgcgg

SEQ ID NO: 125130 - DNA, 20 bp, human
gggctcgccgcgcctataag

SEQ ID NO: 125131 - DNA, 20 bp, human
ggcaccgcgctcctcctcgc

SEQ ID NO: 125132 - DNA, 20 bp, human
gggcctgaggtaaacaaccg

SEQ ID NO: 125133 - DNA, 20 bp, human
ggccgccgctacccccttca

SEQ ID NO: 125134 - DNA, 20 bp, human
gtgcacccactaccccgccg

SEQ ID NO: 125135 - DNA, 20 bp, human
gaggaagccgcccgccccgt

SEQ ID NO: 125136 - DNA, 20 bp, human
gcagcgtccgcctcaagcgt

SEQ ID NO: 125137 - DNA, 20 bp, human
gtgggaaggtaaaacagcgc

SEQ ID NO: 125138 - DNA, 20 bp, human
gaccttcccaacgcttgagg

SEQ ID NO: 125139 - DNA, 20 bp, human
gcccgggccgcccgaatgaa

SEQ ID NO: 125140 - DNA, 20 bp, human
gtccgcctcaagcgttggga

SEQ ID NO: 125141 - DNA, 20 bp, human
gggaatcggccggagtctgg

SEQ ID NO: 125142 - DNA, 20 bp, human
gacgctcgcggggatcccaa

SEQ ID NO: 125143 - DNA, 20 bp, human
ggatggacgcgagcgggcaa

SEQ ID NO: 125144 - DNA, 20 bp, human
ggcagtccccagcggcagga

SEQ ID NO: 125145 - DNA, 20 bp, human
ggatccccgcgagcgtctcg

SEQ ID NO: 125146 - DNA, 20 bp, human
gcgaggtgctgttctctccc

SEQ ID NO: 125147 - DNA, 20 bp, human
gccgacagcggagaggacgg

SEQ ID NO: 125148 - DNA, 20 bp, human
gttcgctttcggcccgacag

SEQ ID NO: 125149 - DNA, 20 bp, human
gcccagcagagcataataaa

SEQ ID NO: 125150 - DNA, 20 bp, human
gggcgctgtgacgacagcca

SEQ ID NO: 125151 - DNA, 20 bp, human
gccactccggcgttacaatg

SEQ ID NO: 125152 - DNA, 20 bp, human
gacggcgggagatgtagtct

SEQ ID NO: 125153 - DNA, 20 bp, human
gagcagagcataataaaggg

SEQ ID NO: 125154 - DNA, 20 bp, human
gcttggcagccgcaggaagt

SEQ ID NO: 125155 - DNA, 20 bp, human
ggcaaagcagcgtcccactc

SEQ ID NO: 125156 - DNA, 20 bp, human
gcagcagccgcccacgccta

SEQ ID NO: 125157 - DNA, 20 bp, human
gggtcggcgtcgggaggcgg

SEQ ID NO: 125158 - DNA, 20 bp, human
gccgcgccgggtttgttggg

SEQ ID NO: 125159 - DNA, 20 bp, human
ggacccgccactgcaccagg

SEQ ID NO: 125160 - DNA, 20 bp, human
gtgggtggtgccgtaggcgt

SEQ ID NO: 125161 - DNA, 20 bp, human
gctggtagcgggccttgagg

SEQ ID NO: 125162 - DNA, 20 bp, human
ggtggtgccgtaggcgtggg

SEQ ID NO: 125163 - DNA, 20 bp, human
gaccgccgccgggaccacct

SEQ ID NO: 125164 - DNA, 20 bp, human
ggagtaccccccaacaaacc

SEQ ID NO: 125165 - DNA, 20 bp, human
gggagagaacccggatgagg

SEQ ID NO: 125166 - DNA, 20 bp, human
gcgagatggctcagaagcac

SEQ ID NO: 125167 - DNA, 20 bp, human
gagagagcgaccgttaggac

SEQ ID NO: 125168 - DNA, 20 bp, human
gctccatgcgggccacgtct

SEQ ID NO: 125169 - DNA, 20 bp, human
gagatgtcggagcacctggc

SEQ ID NO: 125170 - DNA, 20 bp, human
gagagaaagaatggagtccg

SEQ ID NO: 125171 - DNA, 20 bp, human
gtgaggacttctggtctgtt

SEQ ID NO: 125172 - DNA, 20 bp, human
gagaagctcgccgccatcct

SEQ ID NO: 125173 - DNA, 20 bp, human
ggcgccgccaccaacgcgag

SEQ ID NO: 125174 - DNA, 20 bp, human
gcgaccgttaggacaggctg

SEQ ID NO: 125175 - DNA, 20 bp, human
gagcgggagttgaaatttgc

SEQ ID NO: 125176 - DNA, 20 bp, human
gtagaaaagggaggcatcgt

SEQ ID NO: 125177 - DNA, 20 bp, human
gggacaagtatcggtaactg

SEQ ID NO: 125178 - DNA, 20 bp, human
ggggcaggtatagaaaaggg

SEQ ID NO: 125179 - DNA, 20 bp, human
gtgggagcggaccaagacgg

SEQ ID NO: 125180 - DNA, 20 bp, human
ggtggaaggtgcctactagc

SEQ ID NO: 125181 - DNA, 20 bp, human
ggaaacctgcaccggctagt

SEQ ID NO: 125182 - DNA, 20 bp, human
gctggggcaggtatagaaaa

SEQ ID NO: 125183 - DNA, 20 bp, human
gtgctactaggggaagtcta

SEQ ID NO: 125184 - DNA, 20 bp, human
ggggtacctggtcgtcatgg

SEQ ID NO: 125185 - DNA, 20 bp, human
gtacctggtcgtcatggagg

SEQ ID NO: 125186 - DNA, 20 bp, human
gtggtacttgagcactaagt

SEQ ID NO: 125187 - DNA, 20 bp, human
gtttaagaaaatatgttcaa

SEQ ID NO: 125188 - DNA, 20 bp, human
gttccaatacctgatgacag

SEQ ID NO: 125189 - DNA, 20 bp, human
gctcaagtaccactgtcatc

SEQ ID NO: 125190 - DNA, 20 bp, human
gtattggaaatcttcttatt

SEQ ID NO: 125191 - DNA, 20 bp, human
gaagaaaatacttttgtggt

SEQ ID NO: 125192 - DNA, 20 bp, human
gtaaaattttgacttaatat

SEQ ID NO: 125193 - DNA, 20 bp, human
gtgagcgagagaaccctcga

SEQ ID NO: 125194 - DNA, 20 bp, human
ggcgagagaaccctcgaggg

SEQ ID NO: 125195 - DNA, 20 bp, human
ggaaatggctccaccctcga

SEQ ID NO: 125196 - DNA, 20 bp, human
gttaccctcgcgggctcccg

SEQ ID NO: 125197 - DNA, 20 bp, human
gtggcgaccgggtgcggagt

SEQ ID NO: 125198 - DNA, 20 bp, human
gcgggactggcctcccccag

SEQ ID NO: 125199 - DNA, 20 bp, human
gacgaagcaaggagcagtca

SEQ ID NO: 125200 - DNA, 20 bp, human
gccgcacccggtcgccactc

SEQ ID NO: 125201 - DNA, 20 bp, human
ggcgagaaaggagtgccgag

SEQ ID NO: 125202 - DNA, 20 bp, human
ggagccagaaaggactgatc

SEQ ID NO: 125203 - DNA, 20 bp, human
gaggggacagtggcgatctg

SEQ ID NO: 125204 - DNA, 20 bp, human
gcaggacgcaggtgaaaggg

SEQ ID NO: 125205 - DNA, 20 bp, human
gggagcagtcagggcgagaa

SEQ ID NO: 125206 - DNA, 20 bp, human
ggcgttcacatacccgggga

SEQ ID NO: 125207 - DNA, 20 bp, human
ggcgatttaccttgtcggag

SEQ ID NO: 125208 - DNA, 20 bp, human
gcactcccggtgcaacgtgg

SEQ ID NO: 125209 - DNA, 20 bp, human
gcccggggagggcagtagaa

SEQ ID NO: 125210 - DNA, 20 bp, human
gaagacaagccactccgaca

SEQ ID NO: 125211 - DNA, 20 bp, human
gagcactggaattaccctgg

SEQ ID NO: 125212 - DNA, 20 bp, human
gagcagcactggaattaccc

SEQ ID NO: 125213 - DNA, 20 bp, human
gggtagatggtgaacggccc

SEQ ID NO: 125214 - DNA, 20 bp, human
gtctctcacagagacccgcc

SEQ ID NO: 125215 - DNA, 20 bp, human
gttgcaggttggctgcccgg

SEQ ID NO: 125216 - DNA, 20 bp, human
gaagtagatgtggcgagtga

SEQ ID NO: 125217 - DNA, 20 bp, human
gatcacagtggaggctgtgt

SEQ ID NO: 125218 - DNA, 20 bp, human
gatctccctgagagcgggac

SEQ ID NO: 125219 - DNA, 20 bp, human
ggaggccggtcccgctctca

SEQ ID NO: 125220 - DNA, 20 bp, human
gtgcgaacgtggagttctgt

SEQ ID NO: 125221 - DNA, 20 bp, human
gtaccttacagcctcatggg

SEQ ID NO: 125222 - DNA, 20 bp, human
ggaacgtggagttctgtagg

SEQ ID NO: 125223 - DNA, 20 bp, human
ggaactccacgttcgcagag

SEQ ID NO: 125224 - DNA, 20 bp, human
gcacgttcgcagaggggcat

SEQ ID NO: 125225 - DNA, 20 bp, human
gttcgcagaggggcatcggt

SEQ ID NO: 125226 - DNA, 20 bp, human
gtggcctgaacaggagacag

SEQ ID NO: 125227 - DNA, 20 bp, human
gcagcggaggaagacggtga

SEQ ID NO: 125228 - DNA, 20 bp, human
gccggaagcccgccaggcac

SEQ ID NO: 125229 - DNA, 20 bp, human
gggcttccgtgagaagaccg

SEQ ID NO: 125230 - DNA, 20 bp, human
gggccgcgcagcgacccctg

SEQ ID NO: 125231 - DNA, 20 bp, human
gcagcgccccggtcttctca

SEQ ID NO: 125232 - DNA, 20 bp, human
ggatgggattagggcatggg

SEQ ID NO: 125233 - DNA, 20 bp, human
gagagagaaaaagggaatcg

SEQ ID NO: 125234 - DNA, 20 bp, human
gcaaggagcgacggaagcac

SEQ ID NO: 125235 - DNA, 20 bp, human
ggatgctgaagggtgtcgag

SEQ ID NO: 125236 - DNA, 20 bp, human
gtaggtgagcctagggacct

SEQ ID NO: 125237 - DNA, 20 bp, human
gtcggccaccccagaagcct

SEQ ID NO: 125238 - DNA, 20 bp, human
gaggctcacctaggcttctg

SEQ ID NO: 125239 - DNA, 20 bp, human
gctgggcaccaggactgcgg

SEQ ID NO: 125240 - DNA, 20 bp, human
gtgtccccaaaggaaggtct

SEQ ID NO: 125241 - DNA, 20 bp, human
gggcaccaggactgcggagg

SEQ ID NO: 125242 - DNA, 20 bp, human
gtgttgctgttgctggtcat

SEQ ID NO: 125243 - DNA, 20 bp, human
gtactaaggagcctcctcca

SEQ ID NO: 125244 - DNA, 20 bp, human
ggcccatagcctccacgcac

SEQ ID NO: 125245 - DNA, 20 bp, human
gtgggcctgctggccagtgc

SEQ ID NO: 125246 - DNA, 20 bp, human
ggcaatcggcataggacaca

SEQ ID NO: 125247 - DNA, 20 bp, human
gcaagatgggattatgtaat

SEQ ID NO: 125248 - DNA, 20 bp, human
ggaacaatctcagttcactt

SEQ ID NO: 125249 - DNA, 20 bp, human
gttgctctatgaaccaagat

SEQ ID NO: 125250 - DNA, 20 bp, human
gtgacgtccattgccagcaa

SEQ ID NO: 125251 - DNA, 20 bp, human
gccaaaggaacatggagtct

SEQ ID NO: 125252 - DNA, 20 bp, human
gctggaaatcagcatggatt

SEQ ID NO: 125253 - DNA, 20 bp, human
gcaactctttcgctccccaa

SEQ ID NO: 125254 - DNA, 20 bp, human
gtatctcctgcaatcggcat

SEQ ID NO: 125255 - DNA, 20 bp, human
gaaaactaagcgaagaaaac

SEQ ID NO: 125256 - DNA, 20 bp, human
gcacgaggagagattcccag

SEQ ID NO: 125257 - DNA, 20 bp, human
gagcagtgcctccttccgga

SEQ ID NO: 125258 - DNA, 20 bp, human
gatatactctgggtagaaag

SEQ ID NO: 125259 - DNA, 20 bp, human
gctctgggtagaaagaggac

SEQ ID NO: 125260 - DNA, 20 bp, human
gctgtttgccttccggaagg

SEQ ID NO: 125261 - DNA, 20 bp, human
gagaaagaggacaggcccct

SEQ ID NO: 125262 - DNA, 20 bp, human
ggtagacatacactatgcag

SEQ ID NO: 125263 - DNA, 20 bp, human
ggcaaacaggagctcctaag

SEQ ID NO: 125264 - DNA, 20 bp, human
gatgtctacagatatactct

SEQ ID NO: 125265 - DNA, 20 bp, human
gcaaacttgcactgacgtca

SEQ ID NO: 125266 - DNA, 20 bp, human
ggtttctaaagttggaccag

SEQ ID NO: 125267 - DNA, 20 bp, human
gctggactgagtgacactgc

SEQ ID NO: 125268 - DNA, 20 bp, human
ggagagcagcctgagactca

SEQ ID NO: 125269 - DNA, 20 bp, human
gtaacagaactggtccaagg

SEQ ID NO: 125270 - DNA, 20 bp, human
gcataaagcctggcacttcc

SEQ ID NO: 125271 - DNA, 20 bp, human
ggatgtggaagctgttgctg

SEQ ID NO: 125272 - DNA, 20 bp, human
gactcagggaagcctagatt

SEQ ID NO: 125273 - DNA, 20 bp, human
ggcctagattaggtagagat

SEQ ID NO: 125274 - DNA, 20 bp, human
gaacacttgtcattgtccct

SEQ ID NO: 125275 - DNA, 20 bp, human
gctaggcttccctgagtctc

SEQ ID NO: 125276 - DNA, 20 bp, human
gtgcggccaggtgcaccggg

SEQ ID NO: 125277 - DNA, 20 bp, human
gctgagaacgaggtcccttg

SEQ ID NO: 125278 - DNA, 20 bp, human
gaagcgtctcccggctcgac

SEQ ID NO: 125279 - DNA, 20 bp, human
gcggggacgccagtcgagcc

SEQ ID NO: 125280 - DNA, 20 bp, human
gcggccccgcaaaggtggga

SEQ ID NO: 125281 - DNA, 20 bp, human
gcccttgcggccaggtgcac

SEQ ID NO: 125282 - DNA, 20 bp, human
gtggagcgagctccccgacg

SEQ ID NO: 125283 - DNA, 20 bp, human
gggcccgtgtccagcgacga

SEQ ID NO: 125284 - DNA, 20 bp, human
gaacagggaaggagtcgcta

SEQ ID NO: 125285 - DNA, 20 bp, human
ggttcagcccggccccgcaa

SEQ ID NO: 125286 - DNA, 20 bp, human
gcgcgagtgagaccacgccg

SEQ ID NO: 125287 - DNA, 20 bp, human
gtaggtgtcgccgagccggg

SEQ ID NO: 125288 - DNA, 20 bp, human
gtcataaggtggaatagaaa

SEQ ID NO: 125289 - DNA, 20 bp, human
gcactcgcgatttaaggcat

SEQ ID NO: 125290 - DNA, 20 bp, human
gtccccgctaggggcaacgg

SEQ ID NO: 125291 - DNA, 20 bp, human
gctcatccccctcttccggg

SEQ ID NO: 125292 - DNA, 20 bp, human
gcccggctgctccccgctag

SEQ ID NO: 125293 - DNA, 20 bp, human
ggcgcgctcacctgggatgt

SEQ ID NO: 125294 - DNA, 20 bp, human
ggcaggcgaggcgggaaggt

SEQ ID NO: 125295 - DNA, 20 bp, human
ggactcccagcctcccggct

SEQ ID NO: 125296 - DNA, 20 bp, human
gccgctggaagagatccctg

SEQ ID NO: 125297 - DNA, 20 bp, human
ggtccacagccccccaactg

SEQ ID NO: 125298 - DNA, 20 bp, human
gcaggcagatggccccagtt

SEQ ID NO: 125299 - DNA, 20 bp, human
gtgggatataggcatctccc

SEQ ID NO: 125300 - DNA, 20 bp, human
gctcactactaggaaaggag

SEQ ID NO: 125301 - DNA, 20 bp, human
ggagagctcactactaggaa

SEQ ID NO: 125302 - DNA, 20 bp, human
gcgccttcctggtcaggagt

SEQ ID NO: 125303 - DNA, 20 bp, human
ggtgtggagagccttccgga

SEQ ID NO: 125304 - DNA, 20 bp, human
gtactgttaggtctcacccc

SEQ ID NO: 125305 - DNA, 20 bp, human
gtggacgccgactcctgacc

SEQ ID NO: 125306 - DNA, 20 bp, human
gtgctgggcccatagtgtcg

SEQ ID NO: 125307 - DNA, 20 bp, human
gggcagctcggccactacag

SEQ ID NO: 125308 - DNA, 20 bp, human
gtggcgatgggactaatgtg

SEQ ID NO: 125309 - DNA, 20 bp, human
gtagcaagcgcagaagctcc

SEQ ID NO: 125310 - DNA, 20 bp, human
gcgcaaggaagaggtagtgt

SEQ ID NO: 125311 - DNA, 20 bp, human
gagctcggccactacagggg

SEQ ID NO: 125312 - DNA, 20 bp, human
ggcgcagaccgctagcccga

SEQ ID NO: 125313 - DNA, 20 bp, human
gggagcagaagtcctcgcgt

SEQ ID NO: 125314 - DNA, 20 bp, human
gctagcccgaaggcatgcag

SEQ ID NO: 125315 - DNA, 20 bp, human
ggtcatgtgaggacgcgcta

SEQ ID NO: 125316 - DNA, 20 bp, human
gcctcaccgcccgaagatgg

SEQ ID NO: 125317 - DNA, 20 bp, human
ggagccgaagcccggaggag

SEQ ID NO: 125318 - DNA, 20 bp, human
ggagagccgccatcttcggg

SEQ ID NO: 125319 - DNA, 20 bp, human
ggcgcagagccgaagcccgg

SEQ ID NO: 125320 - DNA, 20 bp, human
gctgcctcaccgcccgaaga

SEQ ID NO: 125321 - DNA, 20 bp, human
ggcgactgcgaaggaaaccc

SEQ ID NO: 125322 - DNA, 20 bp, human
gcctcagagtccctatccaa

SEQ ID NO: 125323 - DNA, 20 bp, human
gaggctggagagagcgggta

SEQ ID NO: 125324 - DNA, 20 bp, human
gcgcgcggagaggctgagaa

SEQ ID NO: 125325 - DNA, 20 bp, human
gcagagtccctatccaaggg

SEQ ID NO: 125326 - DNA, 20 bp, human
ggggctcacaccacctgtcc

SEQ ID NO: 125327 - DNA, 20 bp, human
gagaacttggcacggagccg

SEQ ID NO: 125328 - DNA, 20 bp, human
gcgacccgggccgactatgg

SEQ ID NO: 125329 - DNA, 20 bp, human
ggccgcagcgccgccatagt

SEQ ID NO: 125330 - DNA, 20 bp, human
gctccgacccgggccgacta

SEQ ID NO: 125331 - DNA, 20 bp, human
gctgtcctggcctccgaccc

SEQ ID NO: 125332 - DNA, 20 bp, human
gctgtgcgagagccagtacc

SEQ ID NO: 125333 - DNA, 20 bp, human
gcagctctcctgccaggtac

SEQ ID NO: 125334 - DNA, 20 bp, human
gagctggagctcacgcccca

SEQ ID NO: 125335 - DNA, 20 bp, human
ggggcgaccgtcatgatcgg

SEQ ID NO: 125336 - DNA, 20 bp, human
ggttggtggacagcatgaag

SEQ ID NO: 125337 - DNA, 20 bp, human
gccatggcccaagcagccca

SEQ ID NO: 125338 - DNA, 20 bp, human
gtcaggttatgaagttccat

SEQ ID NO: 125339 - DNA, 20 bp, human
gctcaaccgctacctgaagg

SEQ ID NO: 125340 - DNA, 20 bp, human
gggtagtagtccacgcggag

SEQ ID NO: 125341 - DNA, 20 bp, human
ggcactcaaccgctacctga

SEQ ID NO: 125342 - DNA, 20 bp, human
ggggccatgggcctgagaga

SEQ ID NO: 125343 - DNA, 20 bp, human
ggctgtgaggaagacaacgc

SEQ ID NO: 125344 - DNA, 20 bp, human
ggcgccaggtctcatggagg

SEQ ID NO: 125345 - DNA, 20 bp, human
gacaccagcgaggaagaggt

SEQ ID NO: 125346 - DNA, 20 bp, human
gctgcggtccgggaccaact

SEQ ID NO: 125347 - DNA, 20 bp, human
gagcagggcggtgatcaatg

SEQ ID NO: 125348 - DNA, 20 bp, human
gcctcccagacccctcactt

SEQ ID NO: 125349 - DNA, 20 bp, human
gtaggctgcacaggcacgct

SEQ ID NO: 125350 - DNA, 20 bp, human
gccgggacaggtctgcggtc

SEQ ID NO: 125351 - DNA, 20 bp, human
gccgcagacctgtcccgggg

SEQ ID NO: 125352 - DNA, 20 bp, human
gcctcccgccacaggatctg

SEQ ID NO: 125353 - DNA, 20 bp, human
ggcgcatgtccgcctcgccg

SEQ ID NO: 125354 - DNA, 20 bp, human
gggtgagccgcgcgtgatcg

SEQ ID NO: 125355 - DNA, 20 bp, human
gcgtgcctgtgcagcctagt

SEQ ID NO: 125356 - DNA, 20 bp, human
gtgcggagggtggtcgaggg

SEQ ID NO: 125357 - DNA, 20 bp, human
ggcccgccgctcacggtcag

SEQ ID NO: 125358 - DNA, 20 bp, human
gggcaacccctgaccgtgag

SEQ ID NO: 125359 - DNA, 20 bp, human
gcctgtgtgcgagccctcct

SEQ ID NO: 125360 - DNA, 20 bp, human
gagcagcatcgcccgcggac

SEQ ID NO: 125361 - DNA, 20 bp, human
gtgctgcggagggtggtcga

SEQ ID NO: 125362 - DNA, 20 bp, human
gtccgcagcagcatcgcccg

SEQ ID NO: 125363 - DNA, 20 bp, human
gactcggtaagagccgatgg

SEQ ID NO: 125364 - DNA, 20 bp, human
ggccgagccacggaccgcgg

SEQ ID NO: 125365 - DNA, 20 bp, human
gagggtggtcgagggaggcc

SEQ ID NO: 125366 - DNA, 20 bp, human
gtctgcaagctaggtgccag

SEQ ID NO: 125367 - DNA, 20 bp, human
gaggcgcctgcaactaaacg

SEQ ID NO: 125368 - DNA, 20 bp, human
gggcacctagcttgcagacc

SEQ ID NO: 125369 - DNA, 20 bp, human
gaggcgcctggaatactccg

SEQ ID NO: 125370 - DNA, 20 bp, human
gtgggaccgcggagtattcc

SEQ ID NO: 125371 - DNA, 20 bp, human
ggcgctgctacgtcacgtct

SEQ ID NO: 125372 - DNA, 20 bp, human
ggtggccgggtctgcaagct

SEQ ID NO: 125373 - DNA, 20 bp, human
ggaaaggaccaagccctgga

SEQ ID NO: 125374 - DNA, 20 bp, human
gtcaccaggaagggaggtcg

SEQ ID NO: 125375 - DNA, 20 bp, human
ggcagggaaactttccccgc

SEQ ID NO: 125376 - DNA, 20 bp, human
gatcagcaacaagcaagcgg

SEQ ID NO: 125377 - DNA, 20 bp, human
gagcggaggctcttcactga

SEQ ID NO: 125378 - DNA, 20 bp, human
gttcactgacggtgactcac

SEQ ID NO: 125379 - DNA, 20 bp, human
gcgtgttgcaggagattcat

SEQ ID NO: 125380 - DNA, 20 bp, human
gatacgactgagggagccac

SEQ ID NO: 125381 - DNA, 20 bp, human
gtagattgtgtcagcagcta

SEQ ID NO: 125382 - DNA, 20 bp, human
gagatcctctgtgccaacaa

SEQ ID NO: 125383 - DNA, 20 bp, human
gacgggctcaaaacccaagt

SEQ ID NO: 125384 - DNA, 20 bp, human
gtcagagctgtcagttccat

SEQ ID NO: 125385 - DNA, 20 bp, human
gtcctgcaacacgtaactca

SEQ ID NO: 125386 - DNA, 20 bp, human
gcgggaggcgaaagaaaggt

SEQ ID NO: 125387 - DNA, 20 bp, human
ggcccatcagacctgaccca

SEQ ID NO: 125388 - DNA, 20 bp, human
gatcagacctgacccagggg

SEQ ID NO: 125389 - DNA, 20 bp, human
gcgcgcgggaggcgaaagaa

SEQ ID NO: 125390 - DNA, 20 bp, human
ggcgcttcgaagattacctg

SEQ ID NO: 125391 - DNA, 20 bp, human
gtcaggtctgatgggccggt

SEQ ID NO: 125392 - DNA, 20 bp, human
gaccgcctgttggggttcgg

SEQ ID NO: 125393 - DNA, 20 bp, human
ggcccccgaaccccaacagg

SEQ ID NO: 125394 - DNA, 20 bp, human
gaggaggtcgacggtttcgg

SEQ ID NO: 125395 - DNA, 20 bp, human
gcgtccagcccggagggacc

SEQ ID NO: 125396 - DNA, 20 bp, human
ggacacttctccacagtcgg

SEQ ID NO: 125397 - DNA, 20 bp, human
ggaaaaagaaatcaggcccc

SEQ ID NO: 125398 - DNA, 20 bp, human
gactgagcgtctggatacat

SEQ ID NO: 125399 - DNA, 20 bp, human
ggccagcgatacctgtaacg

SEQ ID NO: 125400 - DNA, 20 bp, human
ggcgtcatcgcccccgactg

SEQ ID NO: 125401 - DNA, 20 bp, human
gtatccagacgctcagtcta

SEQ ID NO: 125402 - DNA, 20 bp, human
ggtgcctgagaggcgataca

SEQ ID NO: 125403 - DNA, 20 bp, human
gagcgtctggatacatgggt

SEQ ID NO: 125404 - DNA, 20 bp, human
gagggtactacgaaggccag

SEQ ID NO: 125405 - DNA, 20 bp, human
gccggacacttctccacagt

SEQ ID NO: 125406 - DNA, 20 bp, human
gcctcctgctcctccgagtc

SEQ ID NO: 125407 - DNA, 20 bp, human
gtgctgcggaggccgaggac

SEQ ID NO: 125408 - DNA, 20 bp, human
gcccggcgccgtccgacccg

SEQ ID NO: 125409 - DNA, 20 bp, human
ggagtcctcggacatgacgg

SEQ ID NO: 125410 - DNA, 20 bp, human
gcgtccctgttgatggacca

SEQ ID NO: 125411 - DNA, 20 bp, human
ggaggccgaggacaggacgt

SEQ ID NO: 125412 - DNA, 20 bp, human
gctgccctggtccatcaaca

SEQ ID NO: 125413 - DNA, 20 bp, human
gcgggcagtgccggactcgg

SEQ ID NO: 125414 - DNA, 20 bp, human
gacgtcagcgcgctgcgtgt

SEQ ID NO: 125415 - DNA, 20 bp, human
gctcgagtcctcggacatga

SEQ ID NO: 125416 - DNA, 20 bp, human
ggagagaccgccaccagtca

SEQ ID NO: 125417 - DNA, 20 bp, human
gggccctcttgcctcccagg

SEQ ID NO: 125418 - DNA, 20 bp, human
ggccgagcagacagcaagcg

SEQ ID NO: 125419 - DNA, 20 bp, human
ggtccagggtccgtgactgg

SEQ ID NO: 125420 - DNA, 20 bp, human
gacccagcgcacccgcacca

SEQ ID NO: 125421 - DNA, 20 bp, human
ggcagacagcaagcgaggct

SEQ ID NO: 125422 - DNA, 20 bp, human
gggcggaggtcagcgccagg

SEQ ID NO: 125423 - DNA, 20 bp, human
ggaccctgcgaggccggccg

SEQ ID NO: 125424 - DNA, 20 bp, human
gtgcgggtgcgctgggtcca

SEQ ID NO: 125425 - DNA, 20 bp, human
gcagttctggatgtagcagg

SEQ ID NO: 125426 - DNA, 20 bp, human
ggccatcgggacccgagtgg

SEQ ID NO: 125427 - DNA, 20 bp, human
gcgcgcagacccctccggag

SEQ ID NO: 125428 - DNA, 20 bp, human
gccagccgcgcagacccctc

SEQ ID NO: 125429 - DNA, 20 bp, human
gatcgcacgggtccgctagg

SEQ ID NO: 125430 - DNA, 20 bp, human
gggcgaggggattccaaccg

SEQ ID NO: 125431 - DNA, 20 bp, human
gtaagcaggggtggacggga

SEQ ID NO: 125432 - DNA, 20 bp, human
ggtcgctggatgggtacagg

SEQ ID NO: 125433 - DNA, 20 bp, human
gaaccagctccgctccggag

SEQ ID NO: 125434 - DNA, 20 bp, human
gctctcactggagcctcggt

SEQ ID NO: 125435 - DNA, 20 bp, human
gacctccactcgggtcccga

SEQ ID NO: 125436 - DNA, 20 bp, human
ggcagctcttggcccctgga

SEQ ID NO: 125437 - DNA, 20 bp, human
ggctcgctggtgtcacgcaa

SEQ ID NO: 125438 - DNA, 20 bp, human
gaggtcagctggaggcactt

SEQ ID NO: 125439 - DNA, 20 bp, human
ggaggacaggcccggggtag

SEQ ID NO: 125440 - DNA, 20 bp, human
gcgcaagggatgtcagagtc

SEQ ID NO: 125441 - DNA, 20 bp, human
gggccttcccctggatggag

SEQ ID NO: 125442 - DNA, 20 bp, human
gtacgtcatcgggtgagtcc

SEQ ID NO: 125443 - DNA, 20 bp, human
gcggctcaccctgagagcag

SEQ ID NO: 125444 - DNA, 20 bp, human
gtgcagtctgttgccttcca

SEQ ID NO: 125445 - DNA, 20 bp, human
gtggtgcgtaataagaaggt

SEQ ID NO: 125446 - DNA, 20 bp, human
gcctccaggaaggcgctgca

SEQ ID NO: 125447 - DNA, 20 bp, human
ggctgcgcaccgagagcggg

SEQ ID NO: 125448 - DNA, 20 bp, human
gggcgcggtacaggaccccc

SEQ ID NO: 125449 - DNA, 20 bp, human
gccccgctgcgcaccgagag

SEQ ID NO: 125450 - DNA, 20 bp, human
ggagacgcccaaggtgatcg

SEQ ID NO: 125451 - DNA, 20 bp, human
gtcctcaccacgatcacctt

SEQ ID NO: 125452 - DNA, 20 bp, human
gcagcccaagtaccccgccg

SEQ ID NO: 125453 - DNA, 20 bp, human
gtcgccccggcggggtactt

SEQ ID NO: 125454 - DNA, 20 bp, human
gggcgtctcgtagtcccaga

SEQ ID NO: 125455 - DNA, 20 bp, human
gggtgatcgtggtgaggaac

SEQ ID NO: 125456 - DNA, 20 bp, human
gttgcatggcttaaagggac

SEQ ID NO: 125457 - DNA, 20 bp, human
gtggagggggcagcttagag

SEQ ID NO: 125458 - DNA, 20 bp, human
ggaatttaggccctaggtgg

SEQ ID NO: 125459 - DNA, 20 bp, human
gcctctgccacccccaccta

SEQ ID NO: 125460 - DNA, 20 bp, human
gtatgagaccaccaagtcgg

SEQ ID NO: 125461 - DNA, 20 bp, human
gtaggattgcatggcttaaa

SEQ ID NO: 125462 - DNA, 20 bp, human
gaagctggatggtagcaccg

SEQ ID NO: 125463 - DNA, 20 bp, human
gagggtgaagacgggatacc

SEQ ID NO: 125464 - DNA, 20 bp, human
gagggaggtcctacaggaca

SEQ ID NO: 125465 - DNA, 20 bp, human
gaagagcagagaatctcact

SEQ ID NO: 125466 - DNA, 20 bp, human
gctgggacccagaccgacta

SEQ ID NO: 125467 - DNA, 20 bp, human
gccagaccgactaggggact

SEQ ID NO: 125468 - DNA, 20 bp, human
ggactgggcggggctccgag

SEQ ID NO: 125469 - DNA, 20 bp, human
ggtgtcgtactcgaacagga

SEQ ID NO: 125470 - DNA, 20 bp, human
gcggcgtgtcgtactcgaac

SEQ ID NO: 125471 - DNA, 20 bp, human
ggcggcgcagcagcccgcca

SEQ ID NO: 125472 - DNA, 20 bp, human
gccagcaggccaggcggact

SEQ ID NO: 125473 - DNA, 20 bp, human
gccgcacggcgcggacgcga

SEQ ID NO: 125474 - DNA, 20 bp, human
gaacaggaaggccgccagcg

SEQ ID NO: 125475 - DNA, 20 bp, human
gacctgggcgagtccgggag

SEQ ID NO: 125476 - DNA, 20 bp, human
gaccctggagaaggacgcgg

SEQ ID NO: 125477 - DNA, 20 bp, human
ggacgcggttgagaaagcct

SEQ ID NO: 125478 - DNA, 20 bp, human
gtggcgctagaggtgatgag

SEQ ID NO: 125479 - DNA, 20 bp, human
gggagtagggtgtagagagg

SEQ ID NO: 125480 - DNA, 20 bp, human
gtcacctctagcgccagtgg

SEQ ID NO: 125481 - DNA, 20 bp, human
gaccaggtacgccaggatgg

SEQ ID NO: 125482 - DNA, 20 bp, human
gcggctgagagcgcgccatg

SEQ ID NO: 125483 - DNA, 20 bp, human
gagaggtagcggcaaggtcg

SEQ ID NO: 125484 - DNA, 20 bp, human
gcggcccacgtgcgctcatg

SEQ ID NO: 125485 - DNA, 20 bp, human
gccgccttcccaaaagtccg

SEQ ID NO: 125486 - DNA, 20 bp, human
gcaggccagttgctgttaaa

SEQ ID NO: 125487 - DNA, 20 bp, human
ggggcagattgggacggggt

SEQ ID NO: 125488 - DNA, 20 bp, human
gtgaccaggaactggcgggt

SEQ ID NO: 125489 - DNA, 20 bp, human
gaagggggcagattgggacg

SEQ ID NO: 125490 - DNA, 20 bp, human
ggctccccaggggctacgac

SEQ ID NO: 125491 - DNA, 20 bp, human
gcagcctgtcgtagcccctg

SEQ ID NO: 125492 - DNA, 20 bp, human
gcagctgggattaggggttg

SEQ ID NO: 125493 - DNA, 20 bp, human
gggcctgggaaggaggcaag

SEQ ID NO: 125494 - DNA, 20 bp, human
ggagtggaagggggcagatt

SEQ ID NO: 125495 - DNA, 20 bp, human
gaacagcaactggcctggcc

SEQ ID NO: 125496 - DNA, 20 bp, human
gggcctgaagtagagcagaa

SEQ ID NO: 125497 - DNA, 20 bp, human
ggatcctcgcctcctccctg

SEQ ID NO: 125498 - DNA, 20 bp, human
gcacagccagctgggcggga

SEQ ID NO: 125499 - DNA, 20 bp, human
gagggaggctgtcaccatgc

SEQ ID NO: 125500 - DNA, 20 bp, human
gaggaatcccgcttgtcctg

SEQ ID NO: 125501 - DNA, 20 bp, human
gtctggtccagctccgcgca

SEQ ID NO: 125502 - DNA, 20 bp, human
gaaagcgcagggcaacaccc

SEQ ID NO: 125503 - DNA, 20 bp, human
gggatccagagcatgaatta

SEQ ID NO: 125504 - DNA, 20 bp, human
ggcacgcctggtgatcatgc

SEQ ID NO: 125505 - DNA, 20 bp, human
ggtttggtaagtgggatctg

SEQ ID NO: 125506 - DNA, 20 bp, human
gagaggcgcagcgaggtcaa

SEQ ID NO: 125507 - DNA, 20 bp, human
gaaggggttcctgaactacg

SEQ ID NO: 125508 - DNA, 20 bp, human
gcggcactccggacagagct

SEQ ID NO: 125509 - DNA, 20 bp, human
ggcggagctccctagagggt

SEQ ID NO: 125510 - DNA, 20 bp, human
gcccgggccgccaccgaact

SEQ ID NO: 125511 - DNA, 20 bp, human
gccgctctcccgcctaaccc

SEQ ID NO: 125512 - DNA, 20 bp, human
gacgctgctaccggagtcgg

SEQ ID NO: 125513 - DNA, 20 bp, human
gggtagcagcgtgccggcag

SEQ ID NO: 125514 - DNA, 20 bp, human
ggcagtcggaaagttatccg

SEQ ID NO: 125515 - DNA, 20 bp, human
gaagcaggaggcgtcttctg

SEQ ID NO: 125516 - DNA, 20 bp, human
gtttctttgcagggagtaaa

SEQ ID NO: 125517 - DNA, 20 bp, human
gtgagggctctttagagagt

SEQ ID NO: 125518 - DNA, 20 bp, human
gtatattcagtgagactcat

SEQ ID NO: 125519 - DNA, 20 bp, human
gcagaacagaggtggatgtg

SEQ ID NO: 125520 - DNA, 20 bp, human
gtgggacaacttgacatatt

SEQ ID NO: 125521 - DNA, 20 bp, human
gtgctcctggcataatgaag

SEQ ID NO: 125522 - DNA, 20 bp, human
ggctaggcattaacttaccc

SEQ ID NO: 125523 - DNA, 20 bp, human
gcactttgtgccatcttctc

SEQ ID NO: 125524 - DNA, 20 bp, human
ggcagctcactctttgatga

SEQ ID NO: 125525 - DNA, 20 bp, human
gaagctttactctggcggca

SEQ ID NO: 125526 - DNA, 20 bp, human
ggcatggcagccaacgtctc

SEQ ID NO: 125527 - DNA, 20 bp, human
ggcagccaacgtctcgggta

SEQ ID NO: 125528 - DNA, 20 bp, human
gaacgtctcgggtaaggaga

SEQ ID NO: 125529 - DNA, 20 bp, human
gacaggctgaggatcggcac

SEQ ID NO: 125530 - DNA, 20 bp, human
ggaggatcggcacgggagca

SEQ ID NO: 125531 - DNA, 20 bp, human
ggggtaaggagaaggcatgt

SEQ ID NO: 125532 - DNA, 20 bp, human
gggcatgttggctgtctctg

SEQ ID NO: 125533 - DNA, 20 bp, human
gctgcagattgtcaggaggt

SEQ ID NO: 125534 - DNA, 20 bp, human
gtggtaaaacacctaggtct

SEQ ID NO: 125535 - DNA, 20 bp, human
gaacacctaggtctggggct

SEQ ID NO: 125536 - DNA, 20 bp, human
gtgtccagggtcagattaca

SEQ ID NO: 125537 - DNA, 20 bp, human
gtctgggtactaataaggtt

SEQ ID NO: 125538 - DNA, 20 bp, human
ggtgatcacaatcagaagac

SEQ ID NO: 125539 - DNA, 20 bp, human
gctgaaatgacaaaaatcca

SEQ ID NO: 125540 - DNA, 20 bp, human
gttaccttgtaatctgaccc

SEQ ID NO: 125541 - DNA, 20 bp, human
ggttatgtgcatgtaacttc

SEQ ID NO: 125542 - DNA, 20 bp, human
gctggttatatatttaacag

SEQ ID NO: 125543 - DNA, 20 bp, human
gctgattgtgatcactaccc

SEQ ID NO: 125544 - DNA, 20 bp, human
gaaaggagtctgttagtggt

SEQ ID NO: 125545 - DNA, 20 bp, human
ggtaatgcatcagatttatt

SEQ ID NO: 125546 - DNA, 20 bp, human
gcaggttctgcctcattcac

SEQ ID NO: 125547 - DNA, 20 bp, human
ggcttcacatgctcatttgt

SEQ ID NO: 125548 - DNA, 20 bp, human
gacagtagcacctgtgaatg

SEQ ID NO: 125549 - DNA, 20 bp, human
gattgaaattcacctttggg

SEQ ID NO: 125550 - DNA, 20 bp, human
ggaaagtgttggataaatgc

SEQ ID NO: 125551 - DNA, 20 bp, human
gacacatctattgaaagtgt

SEQ ID NO: 125552 - DNA, 20 bp, human
gtgaggcagaacctgttatt

SEQ ID NO: 125553 - DNA, 20 bp, human
gaaaaattgaaattcacctt

SEQ ID NO: 125554 - DNA, 20 bp, human
gcttgtgaaatccaaataac

SEQ ID NO: 125555 - DNA, 20 bp, human
gatataaaagaatatgctta

SEQ ID NO: 125556 - DNA, 20 bp, human
gccttggagcctacaatgag

SEQ ID NO: 125557 - DNA, 20 bp, human
gcagatgaaggcctagacgc

SEQ ID NO: 125558 - DNA, 20 bp, human
gctgggacgtggaaacaaag

SEQ ID NO: 125559 - DNA, 20 bp, human
ggcatgactctcacagatga

SEQ ID NO: 125560 - DNA, 20 bp, human
gctgggcagcaacaaagctg

SEQ ID NO: 125561 - DNA, 20 bp, human
gggatccccatattagcatg

SEQ ID NO: 125562 - DNA, 20 bp, human
gttgaaatacctctcattgt

SEQ ID NO: 125563 - DNA, 20 bp, human
ggacagaaaccacaagatag

SEQ ID NO: 125564 - DNA, 20 bp, human
gatcgattagcataatactt

SEQ ID NO: 125565 - DNA, 20 bp, human
gatgtatgtgaatggtgcat

SEQ ID NO: 125566 - DNA, 20 bp, human
ggcgcacagcctcactactg

SEQ ID NO: 125567 - DNA, 20 bp, human
ggttggggaacagcgcaggg

SEQ ID NO: 125568 - DNA, 20 bp, human
ggacgggcgccccagtagtg

SEQ ID NO: 125569 - DNA, 20 bp, human
ggcgcgtcagcgtactgggg

SEQ ID NO: 125570 - DNA, 20 bp, human
gcgcagagacccacgtgcct

SEQ ID NO: 125571 - DNA, 20 bp, human
gcgtgtagcgcataactgga

SEQ ID NO: 125572 - DNA, 20 bp, human
gtgagtgtgtgcgcccctcg

SEQ ID NO: 125573 - DNA, 20 bp, human
gcttggccagtcgccccgag

SEQ ID NO: 125574 - DNA, 20 bp, human
ggcggtagaaagggtcagtc

SEQ ID NO: 125575 - DNA, 20 bp, human
gagttcaaccacggacccac

SEQ ID NO: 125576 - DNA, 20 bp, human
gcacccttgcccaagaacgt

SEQ ID NO: 125577 - DNA, 20 bp, human
gagcttcaaggggaccaggt

SEQ ID NO: 125578 - DNA, 20 bp, human
gagctggaccaagggagctt

SEQ ID NO: 125579 - DNA, 20 bp, human
ggagatgtgccaacgttctt

SEQ ID NO: 125580 - DNA, 20 bp, human
ggagaggcgaaggcactgtg

SEQ ID NO: 125581 - DNA, 20 bp, human
gagctgacagaagcgcatct

SEQ ID NO: 125582 - DNA, 20 bp, human
gacttcccaagctggaccaa

SEQ ID NO: 125583 - DNA, 20 bp, human
ggaccaagggagcttgggta

SEQ ID NO: 125584 - DNA, 20 bp, human
gtgccaacgttcttgggcaa

SEQ ID NO: 125585 - DNA, 20 bp, human
ggagcctggctggctgaaga

SEQ ID NO: 125586 - DNA, 20 bp, human
gcaggggctgctccacgagt

SEQ ID NO: 125587 - DNA, 20 bp, human
ggagccacaaaggtcttggt

SEQ ID NO: 125588 - DNA, 20 bp, human
gttctggcagaagtctggag

SEQ ID NO: 125589 - DNA, 20 bp, human
gtttcaggcacagaactgac

SEQ ID NO: 125590 - DNA, 20 bp, human
gggctcatcacaggcaagag

SEQ ID NO: 125591 - DNA, 20 bp, human
gagccaccgaggctcatcac

SEQ ID NO: 125592 - DNA, 20 bp, human
gcatacgcagggagagacca

SEQ ID NO: 125593 - DNA, 20 bp, human
gacaggcaagagtggcagta

SEQ ID NO: 125594 - DNA, 20 bp, human
gtcaggattcggagccacaa

SEQ ID NO: 125595 - DNA, 20 bp, human
gtggagcaaattcccactcg

SEQ ID NO: 125596 - DNA, 20 bp, human
ggacagtcgtgccagccggt

SEQ ID NO: 125597 - DNA, 20 bp, human
gctgtccagcaaccttgcaa

SEQ ID NO: 125598 - DNA, 20 bp, human
gggtgggccacccagcgaag

SEQ ID NO: 125599 - DNA, 20 bp, human
gttgagaaggtgttcgtggg

SEQ ID NO: 125600 - DNA, 20 bp, human
gtgcttgagaaggtgttcgt

SEQ ID NO: 125601 - DNA, 20 bp, human
gcgctgggtggcccaccggc

SEQ ID NO: 125602 - DNA, 20 bp, human
gcagccgcttcgtcacttag

SEQ ID NO: 125603 - DNA, 20 bp, human
gtctcccctaagtgacgaag

SEQ ID NO: 125604 - DNA, 20 bp, human
gccaggagtgcaaatttcct

SEQ ID NO: 125605 - DNA, 20 bp, human
ggttgctggacagatggaac

SEQ ID NO: 125606 - DNA, 20 bp, human
gtccgagtggaggcgactgg

SEQ ID NO: 125607 - DNA, 20 bp, human
gcctggaaagtgggacgaga

SEQ ID NO: 125608 - DNA, 20 bp, human
gaagtagccgctccgagtgg

SEQ ID NO: 125609 - DNA, 20 bp, human
gaggaagtagccgctccgag

SEQ ID NO: 125610 - DNA, 20 bp, human
ggcccccagtcgcctccact

SEQ ID NO: 125611 - DNA, 20 bp, human
ggcccgctggcggcgcgact

SEQ ID NO: 125612 - DNA, 20 bp, human
gcgaggcgcactagggacag

SEQ ID NO: 125613 - DNA, 20 bp, human
gcctaccctcagcccgctgg

SEQ ID NO: 125614 - DNA, 20 bp, human
ggcgcactagggacagaggt

SEQ ID NO: 125615 - DNA, 20 bp, human
gaggctgctgtggtaacctg

SEQ ID NO: 125616 - DNA, 20 bp, human
gccgggagctgcgagtgtcc

SEQ ID NO: 125617 - DNA, 20 bp, human
gcccagcgctaaggttgatc

SEQ ID NO: 125618 - DNA, 20 bp, human
gccagacgggtgcagaaaca

SEQ ID NO: 125619 - DNA, 20 bp, human
gacttcccgggagcctgaca

SEQ ID NO: 125620 - DNA, 20 bp, human
gggagcctgacagggaagag

SEQ ID NO: 125621 - DNA, 20 bp, human
ggacgggtgcagaaacaggg

SEQ ID NO: 125622 - DNA, 20 bp, human
ggcggcacaagaacccagac

SEQ ID NO: 125623 - DNA, 20 bp, human
gaatatgaagaggcccctca

SEQ ID NO: 125624 - DNA, 20 bp, human
gtgccggctgttgggagcgg

SEQ ID NO: 125625 - DNA, 20 bp, human
gagcgctaaggttgatctgg

SEQ ID NO: 125626 - DNA, 20 bp, human
ggcgctggctatgggtcctg

SEQ ID NO: 125627 - DNA, 20 bp, human
gctcatgccacggagtgtca

SEQ ID NO: 125628 - DNA, 20 bp, human
ggtgggaccctgacactccg

SEQ ID NO: 125629 - DNA, 20 bp, human
ggcggctgcgggacctgact

SEQ ID NO: 125630 - DNA, 20 bp, human
ggggtgacaatgggtctagg

SEQ ID NO: 125631 - DNA, 20 bp, human
ggagtgtcagggtcccacac

SEQ ID NO: 125632 - DNA, 20 bp, human
ggtcccacacagggtgacaa

SEQ ID NO: 125633 - DNA, 20 bp, human
gaggtgagggcacgacgagt

SEQ ID NO: 125634 - DNA, 20 bp, human
gagttcgcgagcgctggcta

SEQ ID NO: 125635 - DNA, 20 bp, human
gactccgtggcatgaggtgt

SEQ ID NO: 125636 - DNA, 20 bp, human
gagcatgtcggacacggatc

SEQ ID NO: 125637 - DNA, 20 bp, human
gggcgccgccgggacagcgg

SEQ ID NO: 125638 - DNA, 20 bp, human
gcggcgcagcatgtcggaca

SEQ ID NO: 125639 - DNA, 20 bp, human
gagagcgcggcgcagcatgt

SEQ ID NO: 125640 - DNA, 20 bp, human
gtgtcggacacggatcaggc

SEQ ID NO: 125641 - DNA, 20 bp, human
gcggcgcgcccggaactgaa

SEQ ID NO: 125642 - DNA, 20 bp, human
gtcaggcggggcgcttcggt

SEQ ID NO: 125643 - DNA, 20 bp, human
gagcccggctctcaccccca

SEQ ID NO: 125644 - DNA, 20 bp, human
ggcgtcggcgcgcaccaggg

SEQ ID NO: 125645 - DNA, 20 bp, human
gataaaggcgaggccgggac

SEQ ID NO: 125646 - DNA, 20 bp, human
gcagcggcctgagaccgcgg

SEQ ID NO: 125647 - DNA, 20 bp, human
ggcgtagacgcggacaagag

SEQ ID NO: 125648 - DNA, 20 bp, human
gagcggcggtgacaggccag

SEQ ID NO: 125649 - DNA, 20 bp, human
gcgacagcaggcgagtgagt

SEQ ID NO: 125650 - DNA, 20 bp, human
gagccgggtgaggggaccta

SEQ ID NO: 125651 - DNA, 20 bp, human
gggaagagaagccccagcgt

SEQ ID NO: 125652 - DNA, 20 bp, human
ggtcccctcacccggctgga

SEQ ID NO: 125653 - DNA, 20 bp, human
gcagcacgttacccaggtac

SEQ ID NO: 125654 - DNA, 20 bp, human
gggtctggcggcgcccactg

SEQ ID NO: 125655 - DNA, 20 bp, human
gcattaaggcatacactagt

SEQ ID NO: 125656 - DNA, 20 bp, human
gctagagtctggcggccgag

SEQ ID NO: 125657 - DNA, 20 bp, human
gctgggacaactagtcctct

SEQ ID NO: 125658 - DNA, 20 bp, human
gcccaggctgaagtctatgg

SEQ ID NO: 125659 - DNA, 20 bp, human
gtgcggactgagctactgag

SEQ ID NO: 125660 - DNA, 20 bp, human
gcaggtcccaggcgcgacac

SEQ ID NO: 125661 - DNA, 20 bp, human
gtcgccgctgccagaatcag

SEQ ID NO: 125662 - DNA, 20 bp, human
gagtctatggaggtgcgggt

SEQ ID NO: 125663 - DNA, 20 bp, human
gctggtgtcagggacactag

SEQ ID NO: 125664 - DNA, 20 bp, human
gcccaccacgccgtgcccag

SEQ ID NO: 125665 - DNA, 20 bp, human
gcgtgcccagcggaccggtg

SEQ ID NO: 125666 - DNA, 20 bp, human
gagtcgctctgaatcctcaa

SEQ ID NO: 125667 - DNA, 20 bp, human
gaggcccagaacagagtcag

SEQ ID NO: 125668 - DNA, 20 bp, human
gtgggcctggattcacctga

SEQ ID NO: 125669 - DNA, 20 bp, human
gggggcctaggagaatacaa

SEQ ID NO: 125670 - DNA, 20 bp, human
gggtggaggcggggtcgaga

SEQ ID NO: 125671 - DNA, 20 bp, human
gaggcgttgcgggcacaacg

SEQ ID NO: 125672 - DNA, 20 bp, human
gcatcacatacacaaagtgg

SEQ ID NO: 125673 - DNA, 20 bp, human
gcgactgggcgcaagccctc

SEQ ID NO: 125674 - DNA, 20 bp, human
gtggtgagtacagagacttc

SEQ ID NO: 125675 - DNA, 20 bp, human
gaacgcacgctcctacgcgg

SEQ ID NO: 125676 - DNA, 20 bp, human
gactaaccgccggggagaag

SEQ ID NO: 125677 - DNA, 20 bp, human
gctctcagcactaaccgccg

SEQ ID NO: 125678 - DNA, 20 bp, human
gagaccgacccgcccgcccg

SEQ ID NO: 125679 - DNA, 20 bp, human
gagcggggagcaagcgcaga

SEQ ID NO: 125680 - DNA, 20 bp, human
ggagcgccgggctccgcggt

SEQ ID NO: 125681 - DNA, 20 bp, human
ggccggcggacggtgagcgc

SEQ ID NO: 125682 - DNA, 20 bp, human
gaaataaaagtctccggcgg

SEQ ID NO: 125683 - DNA, 20 bp, human
gaaatccgcgtctcccccgc

SEQ ID NO: 125684 - DNA, 20 bp, human
gccgggctccgcggtcggcc

SEQ ID NO: 125685 - DNA, 20 bp, human
ggttgagtagttttcaattc

SEQ ID NO: 125686 - DNA, 20 bp, human
gaaccgctggcgttcatggt

SEQ ID NO: 125687 - DNA, 20 bp, human
ggcgccgggtggctacatcg

SEQ ID NO: 125688 - DNA, 20 bp, human
gtgcccaccatgaacgccag

SEQ ID NO: 125689 - DNA, 20 bp, human
gctgaggctcaaagataaca

SEQ ID NO: 125690 - DNA, 20 bp, human
gctgcggggcaagcaggagc

SEQ ID NO: 125691 - DNA, 20 bp, human
gagccccgcgctcacccggg

SEQ ID NO: 125692 - DNA, 20 bp, human
gagaggcctggcccctgaga

SEQ ID NO: 125693 - DNA, 20 bp, human
gtagcccagcgagcgccggg

SEQ ID NO: 125694 - DNA, 20 bp, human
gtactgctattcctctacag

SEQ ID NO: 125695 - DNA, 20 bp, human
gctcaaagataacagggcgt

SEQ ID NO: 125696 - DNA, 20 bp, human
gggcaagaccatcgacaaca

SEQ ID NO: 125697 - DNA, 20 bp, human
gacgtcttcatcaagaacct

SEQ ID NO: 125698 - DNA, 20 bp, human
gggaggccatctgaaaatct

SEQ ID NO: 125699 - DNA, 20 bp, human
ggatgcgaaggtggcggccg

SEQ ID NO: 125700 - DNA, 20 bp, human
ggcggatgcggatgcgaagg

SEQ ID NO: 125701 - DNA, 20 bp, human
ggccgccgcggatgcagatg

SEQ ID NO: 125702 - DNA, 20 bp, human
gctgcaccctgaggtgaccg

SEQ ID NO: 125703 - DNA, 20 bp, human
ggaccctcggtgactgtgag

SEQ ID NO: 125704 - DNA, 20 bp, human
gtccgcatctgcatccgcgg

SEQ ID NO: 125705 - DNA, 20 bp, human
gagtggcctgtgacgaaaag

SEQ ID NO: 125706 - DNA, 20 bp, human
ggaccctcggtgactgtgag

SEQ ID NO: 125707 - DNA, 20 bp, human
gggaggccatctgaaaatct

SEQ ID NO: 125708 - DNA, 20 bp, human
ggccgccgcggatgcagatg

SEQ ID NO: 125709 - DNA, 20 bp, human
gttcccctcacagtcaccga

SEQ ID NO: 125710 - DNA, 20 bp, human
ggtgacgaaaaggggcccaa

SEQ ID NO: 125711 - DNA, 20 bp, human
gtccgcatctgcatccgcgg

SEQ ID NO: 125712 - DNA, 20 bp, human
gctgcaccctgaggtgaccg

SEQ ID NO: 125713 - DNA, 20 bp, human
gtcatccgcatctgcatccg

SEQ ID NO: 125714 - DNA, 20 bp, human
gggcaagaccatcgacaaca

SEQ ID NO: 125715 - DNA, 20 bp, human
gagtggcctgtgacgaaaag

SEQ ID NO: 125716 - DNA, 20 bp, human
gctctactcctgtaacggaa

SEQ ID NO: 125717 - DNA, 20 bp, human
gagcacccccagctacccaa

SEQ ID NO: 125718 - DNA, 20 bp, human
ggcagggacttgatcaccag

SEQ ID NO: 125719 - DNA, 20 bp, human
gcacgtagagcgaggccgtt

SEQ ID NO: 125720 - DNA, 20 bp, human
gcgaggccgttgggtagctg

SEQ ID NO: 125721 - DNA, 20 bp, human
gacgcgctctactcctgtaa

SEQ ID NO: 125722 - DNA, 20 bp, human
gtcgcggcttgtgtgcctgc

SEQ ID NO: 125723 - DNA, 20 bp, human
gctggggttcattctcggca

SEQ ID NO: 125724 - DNA, 20 bp, human
gaaggacgcggagcatgctc

SEQ ID NO: 125725 - DNA, 20 bp, human
gttccagcatacgaaggacg

SEQ ID NO: 125726 - DNA, 20 bp, human
gaggctgcgaagcccgaaag

SEQ ID NO: 125727 - DNA, 20 bp, human
gtataggcctcgggctccgg

SEQ ID NO: 125728 - DNA, 20 bp, human
gaggcggcagcgacccgggg

SEQ ID NO: 125729 - DNA, 20 bp, human
gagcccgaaagcggcggagg

SEQ ID NO: 125730 - DNA, 20 bp, human
gctgcgaagcccgaaagcgg

SEQ ID NO: 125731 - DNA, 20 bp, human
gcgggcgggtataaatggag

SEQ ID NO: 125732 - DNA, 20 bp, human
ggtgtccccgaggccgccgt

SEQ ID NO: 125733 - DNA, 20 bp, human
ggaccggacgctgcccacgg

SEQ ID NO: 125734 - DNA, 20 bp, human
ggcgggtataaatggagcgg

SEQ ID NO: 125735 - DNA, 20 bp, human
gaccgacggacggagaccga

SEQ ID NO: 125736 - DNA, 20 bp, human
gggcgtcctgaagacctagg

SEQ ID NO: 125737 - DNA, 20 bp, human
gggccccagccgtggagtat

SEQ ID NO: 125738 - DNA, 20 bp, human
gaaataggcctcgctcagag

SEQ ID NO: 125739 - DNA, 20 bp, human
ggctcaccggcggtcgtctg

SEQ ID NO: 125740 - DNA, 20 bp, human
gccacaagcggaggcgtcag

SEQ ID NO: 125741 - DNA, 20 bp, human
gccagcgaccagggcgtctg

SEQ ID NO: 125742 - DNA, 20 bp, human
gggaagaactccacaagcgg

SEQ ID NO: 125743 - DNA, 20 bp, human
gcggcggcgcctgcagaacc

SEQ ID NO: 125744 - DNA, 20 bp, human
gcctcgcagcccatactcca

SEQ ID NO: 125745 - DNA, 20 bp, human
gggtgggaaacgtgtaatag

SEQ ID NO: 125746 - DNA, 20 bp, human
gctgaggctcgaggcaggtc

SEQ ID NO: 125747 - DNA, 20 bp, human
gcaggtccggagagactgac

SEQ ID NO: 125748 - DNA, 20 bp, human
gactgggtacggaccgagtg

SEQ ID NO: 125749 - DNA, 20 bp, human
gcggtgatttcagcagcctg

SEQ ID NO: 125750 - DNA, 20 bp, human
gtggcaaacgcgcagtgagt

SEQ ID NO: 125751 - DNA, 20 bp, human
ggcagcctgaggctcgaggc

SEQ ID NO: 125752 - DNA, 20 bp, human
gccaagatgcccactgggta

SEQ ID NO: 125753 - DNA, 20 bp, human
ggtacggaccgagtgaggcg

SEQ ID NO: 125754 - DNA, 20 bp, human
gcaactagcattgcagacag

SEQ ID NO: 125755 - DNA, 20 bp, human
ggcactcagcgtctgcgaaa

SEQ ID NO: 125756 - DNA, 20 bp, human
ggccatcgccgctcagactg

SEQ ID NO: 125757 - DNA, 20 bp, human
gcagagctcgggcgagcggg

SEQ ID NO: 125758 - DNA, 20 bp, human
gtggccggccgggtcactgg

SEQ ID NO: 125759 - DNA, 20 bp, human
gtccctcaccgggtcctcaa

SEQ ID NO: 125760 - DNA, 20 bp, human
ggtgatcgctgacccatccc

SEQ ID NO: 125761 - DNA, 20 bp, human
gcagctctccaatcgccggg

SEQ ID NO: 125762 - DNA, 20 bp, human
ggacggcgccattgaggacc

SEQ ID NO: 125763 - DNA, 20 bp, human
gggtcagcgatcactacaag

SEQ ID NO: 125764 - DNA, 20 bp, human
gccctctctagaacaacact

SEQ ID NO: 125765 - DNA, 20 bp, human
gtcactacaaggggcccgac

SEQ ID NO: 125766 - DNA, 20 bp, human
gggagccaggcctgagtcgg

SEQ ID NO: 125767 - DNA, 20 bp, human
gtgggaagagagagcggctc

SEQ ID NO: 125768 - DNA, 20 bp, human
gacctcaagggcccttcccc

SEQ ID NO: 125769 - DNA, 20 bp, human
ggcccttccccaggcgagag

SEQ ID NO: 125770 - DNA, 20 bp, human
gcggctcgggaagggccaca

SEQ ID NO: 125771 - DNA, 20 bp, human
gacggtctcctcagaccctg

SEQ ID NO: 125772 - DNA, 20 bp, human
gccttgaggtgcggtttcgg

SEQ ID NO: 125773 - DNA, 20 bp, human
gaagagagagcggctcggga

SEQ ID NO: 125774 - DNA, 20 bp, human
gctccttgccaccttcgtcc

SEQ ID NO: 125775 - DNA, 20 bp, human
gtgcctggacgaaggtggca

SEQ ID NO: 125776 - DNA, 20 bp, human
gtcctgaaccgcaccacaac

SEQ ID NO: 125777 - DNA, 20 bp, human
gggcggcggggcgaaggtga

SEQ ID NO: 125778 - DNA, 20 bp, human
ggaagggagctggaccctag

SEQ ID NO: 125779 - DNA, 20 bp, human
gcaaccgggaggcttacctt

SEQ ID NO: 125780 - DNA, 20 bp, human
gtggctcagagtccatccta

SEQ ID NO: 125781 - DNA, 20 bp, human
gtcaacctgggcactacgag

SEQ ID NO: 125782 - DNA, 20 bp, human
gggagctggaccctaggggc

SEQ ID NO: 125783 - DNA, 20 bp, human
gggtccagctcccttcacct

SEQ ID NO: 125784 - DNA, 20 bp, human
gcctcagaaaccagagagtg

SEQ ID NO: 125785 - DNA, 20 bp, human
gccaggttgatccagatgtt

SEQ ID NO: 125786 - DNA, 20 bp, human
gctcggtcggccaacaaccg

SEQ ID NO: 125787 - DNA, 20 bp, human
gaaacgcaggcgctcggtgg

SEQ ID NO: 125788 - DNA, 20 bp, human
ggcggcgcgaccaggttcag

SEQ ID NO: 125789 - DNA, 20 bp, human
gcccaaacgcaggcgctcgg

SEQ ID NO: 125790 - DNA, 20 bp, human
gaccggggggggcttatgac

SEQ ID NO: 125791 - DNA, 20 bp, human
gccagctgccccccaccggg

SEQ ID NO: 125792 - DNA, 20 bp, human
gcttatgaccggcactcggt

SEQ ID NO: 125793 - DNA, 20 bp, human
ggcctgcgtttggggaaatg

SEQ ID NO: 125794 - DNA, 20 bp, human
ggaagtgagtgtaggagggg

SEQ ID NO: 125795 - DNA, 20 bp, human
ggccggtcataagccccccc

SEQ ID NO: 125796 - DNA, 20 bp, human
gcgcgagccgcaacaggcag

SEQ ID NO: 125797 - DNA, 20 bp, human
ggagccgcaacaggcagcgg

SEQ ID NO: 125798 - DNA, 20 bp, human
gatggaggtggaggtagacg

SEQ ID NO: 125799 - DNA, 20 bp, human
gctggccccgggccaccggg

SEQ ID NO: 125800 - DNA, 20 bp, human
gtcgtcctcgtccacctcgg

SEQ ID NO: 125801 - DNA, 20 bp, human
ggagcccgaggccaccgcca

SEQ ID NO: 125802 - DNA, 20 bp, human
gtggcctgggccagcttggg

SEQ ID NO: 125803 - DNA, 20 bp, human
gtcgctcccgcggagtagaa

SEQ ID NO: 125804 - DNA, 20 bp, human
ggcgaggcccgcgcgcccag

SEQ ID NO: 125805 - DNA, 20 bp, human
gtcccaggcttcccccgcgg

SEQ ID NO: 125806 - DNA, 20 bp, human
gcccaggtcccgagcaccgg

SEQ ID NO: 125807 - DNA, 20 bp, human
ggcttgccggagctgcgggg

SEQ ID NO: 125808 - DNA, 20 bp, human
gaggtggcgaacaggttcat

SEQ ID NO: 125809 - DNA, 20 bp, human
gcggtcacatggctgccggg

SEQ ID NO: 125810 - DNA, 20 bp, human
gcggcgggcggcgcgtacct

SEQ ID NO: 125811 - DNA, 20 bp, human
gccccaggccgccgagggag

SEQ ID NO: 125812 - DNA, 20 bp, human
ggcggctgcacgcgtcgaac

SEQ ID NO: 125813 - DNA, 20 bp, human
gctgcacgcgtcgaaccggc

SEQ ID NO: 125814 - DNA, 20 bp, human
ggggcggcggcgcggtcaca

SEQ ID NO: 125815 - DNA, 20 bp, human
gcgcagccccaggccgccga

SEQ ID NO: 125816 - DNA, 20 bp, human
gtcgctctgggatctcgccg

SEQ ID NO: 125817 - DNA, 20 bp, human
ggcgagatcccagagcgacg

SEQ ID NO: 125818 - DNA, 20 bp, human
gagatcccagagcgacgcgg

SEQ ID NO: 125819 - DNA, 20 bp, human
gggccagacctcctacctgg

SEQ ID NO: 125820 - DNA, 20 bp, human
gtcccagagcgacgcggtgg

SEQ ID NO: 125821 - DNA, 20 bp, human
gcccagggagatgtcagtcc

SEQ ID NO: 125822 - DNA, 20 bp, human
gtgccagctcgctcccccaa

SEQ ID NO: 125823 - DNA, 20 bp, human
ggagttcgcgggcatcaccc

SEQ ID NO: 125824 - DNA, 20 bp, human
gactgcgctgggtcccttgg

SEQ ID NO: 125825 - DNA, 20 bp, human
ggagctccggggaccatcgg

SEQ ID NO: 125826 - DNA, 20 bp, human
ggcggtggagggaaccctag

SEQ ID NO: 125827 - DNA, 20 bp, human
gtggcagtggtggagacaag

SEQ ID NO: 125828 - DNA, 20 bp, human
ggtggagacaagaggtacag

SEQ ID NO: 125829 - DNA, 20 bp, human
gtgcctacctgggcccgtgt

SEQ ID NO: 125830 - DNA, 20 bp, human
gctgggggctctgtcctcta

SEQ ID NO: 125831 - DNA, 20 bp, human
gtgccttcctgagtgagcgg

SEQ ID NO: 125832 - DNA, 20 bp, human
gcagaggaggaaaggcaaca

SEQ ID NO: 125833 - DNA, 20 bp, human
ggctacaaagtcaggacctg

SEQ ID NO: 125834 - DNA, 20 bp, human
gagggacagtccccctgatg

SEQ ID NO: 125835 - DNA, 20 bp, human
gtgcccacacgggcccaggt

SEQ ID NO: 125836 - DNA, 20 bp, human
gagtgctgccggagcaaaag

SEQ ID NO: 125837 - DNA, 20 bp, human
ggcccgacccgcttccctca

SEQ ID NO: 125838 - DNA, 20 bp, human
gggccgcaggggtctgggca

SEQ ID NO: 125839 - DNA, 20 bp, human
ggccggagcaaaagcggtag

SEQ ID NO: 125840 - DNA, 20 bp, human
gcactccgttcaggctgcca

SEQ ID NO: 125841 - DNA, 20 bp, human
gcggcgcggcggccctgacg

SEQ ID NO: 125842 - DNA, 20 bp, human
gtcgcggctggcggcagaag

SEQ ID NO: 125843 - DNA, 20 bp, human
gcccacagcgccgcccccat

SEQ ID NO: 125844 - DNA, 20 bp, human
gcgcctggagaagacatctt

SEQ ID NO: 125845 - DNA, 20 bp, human
gagcagctcttaacccccga

SEQ ID NO: 125846 - DNA, 20 bp, human
ggggttcggagtgcgtcatc

SEQ ID NO: 125847 - DNA, 20 bp, human
gcccgtggagccacgcggag

SEQ ID NO: 125848 - DNA, 20 bp, human
gcccaggagcggcaggactc

SEQ ID NO: 125849 - DNA, 20 bp, human
gtcctccctgggcccctcgg

SEQ ID NO: 125850 - DNA, 20 bp, human
ggcagcggacccaggaatcg

SEQ ID NO: 125851 - DNA, 20 bp, human
gtgggggtccggccacgctc

SEQ ID NO: 125852 - DNA, 20 bp, human
gatagggcgagggatcgcca

SEQ ID NO: 125853 - DNA, 20 bp, human
gcccgccccgaggccccaga

SEQ ID NO: 125854 - DNA, 20 bp, human
gcagggagcgaggaccctct

SEQ ID NO: 125855 - DNA, 20 bp, human
ggcaaggccggcccaggcag

SEQ ID NO: 125856 - DNA, 20 bp, human
ggctccccagctcccgtcct

SEQ ID NO: 125857 - DNA, 20 bp, human
ggagccagggctgatctagg

SEQ ID NO: 125858 - DNA, 20 bp, human
ggctcagagttagaaatcta

SEQ ID NO: 125859 - DNA, 20 bp, human
gaggctggactcttacccag

SEQ ID NO: 125860 - DNA, 20 bp, human
gggggagccagggctgatct

SEQ ID NO: 125861 - DNA, 20 bp, human
gtcctggcaaagaagtgccc

SEQ ID NO: 125862 - DNA, 20 bp, human
ggccctgcattctgacacct

SEQ ID NO: 125863 - DNA, 20 bp, human
gagagtgtaagtcaatgggg

SEQ ID NO: 125864 - DNA, 20 bp, human
ggcatgggtaggcatcttca

SEQ ID NO: 125865 - DNA, 20 bp, human
ggttagagtgtaagtcaatg

SEQ ID NO: 125866 - DNA, 20 bp, human
gtcgggatgagggacaactc

SEQ ID NO: 125867 - DNA, 20 bp, human
gactggagagggccagacgg

SEQ ID NO: 125868 - DNA, 20 bp, human
ggcccgcgctcgctggtccg

SEQ ID NO: 125869 - DNA, 20 bp, human
gccagcgagcgcgggcactg

SEQ ID NO: 125870 - DNA, 20 bp, human
gcggagggttacgggtgaaa

SEQ ID NO: 125871 - DNA, 20 bp, human
gagaactggagagggccaga

SEQ ID NO: 125872 - DNA, 20 bp, human
gtcggcccgggcatcacggt

SEQ ID NO: 125873 - DNA, 20 bp, human
gtagacatcggtccagaggt

SEQ ID NO: 125874 - DNA, 20 bp, human
ggggtgtgaggtcccccggg

SEQ ID NO: 125875 - DNA, 20 bp, human
gggaccgtgcggctgcagta

SEQ ID NO: 125876 - DNA, 20 bp, human
gtgcagggaggaaggtccaa

SEQ ID NO: 125877 - DNA, 20 bp, human
gtgactgagctccagaccgg

SEQ ID NO: 125878 - DNA, 20 bp, human
gctcatcctaaggggcctca

SEQ ID NO: 125879 - DNA, 20 bp, human
gggctggtgccgcgaagaga

SEQ ID NO: 125880 - DNA, 20 bp, human
gccacacacaccgcgctggt

SEQ ID NO: 125881 - DNA, 20 bp, human
gtcaggggcagtgttggggt

SEQ ID NO: 125882 - DNA, 20 bp, human
gactgcccctgaggcccctt

SEQ ID NO: 125883 - DNA, 20 bp, human
gtcggaacagcagccaatca

SEQ ID NO: 125884 - DNA, 20 bp, human
gctggtgttggacttagctg

SEQ ID NO: 125885 - DNA, 20 bp, human
gccaagggatgctgcaggtt

SEQ ID NO: 125886 - DNA, 20 bp, human
gtgtcccctgggccatcgtc

SEQ ID NO: 125887 - DNA, 20 bp, human
ggcatgggtgggctgctctg

SEQ ID NO: 125888 - DNA, 20 bp, human
gggacgagctagcccgacga

SEQ ID NO: 125889 - DNA, 20 bp, human
gcacgtgtgccctggaagta

SEQ ID NO: 125890 - DNA, 20 bp, human
gctagcccgacgatggccca

SEQ ID NO: 125891 - DNA, 20 bp, human
ggggctgctctggggtcaca

SEQ ID NO: 125892 - DNA, 20 bp, human
gtcgggctagctcgtccctc

SEQ ID NO: 125893 - DNA, 20 bp, human
gggggcttcctacagccaga

SEQ ID NO: 125894 - DNA, 20 bp, human
gcatctccctgtcttcatcg

SEQ ID NO: 125895 - DNA, 20 bp, human
gggggctaaccttacttcca

SEQ ID NO: 125896 - DNA, 20 bp, human
gctccacgctgaccatcctc

SEQ ID NO: 125897 - DNA, 20 bp, human
ggtccatggcagctgctaca

SEQ ID NO: 125898 - DNA, 20 bp, human
gcccatggtttcacagatag

SEQ ID NO: 125899 - DNA, 20 bp, human
gcacagataggggaacagag

SEQ ID NO: 125900 - DNA, 20 bp, human
gggcctgaggatggtcagcg

SEQ ID NO: 125901 - DNA, 20 bp, human
gcccaaggcttcccaagatg

SEQ ID NO: 125902 - DNA, 20 bp, human
gggacaggtggatgatactc

SEQ ID NO: 125903 - DNA, 20 bp, human
gctgccatggactcttagtg

SEQ ID NO: 125904 - DNA, 20 bp, human
gtggggacgctggcctcggg

SEQ ID NO: 125905 - DNA, 20 bp, human
gtgctcctcacagccccccg

SEQ ID NO: 125906 - DNA, 20 bp, human
ggccgggacaccacagacca

SEQ ID NO: 125907 - DNA, 20 bp, human
gcactgcctcagcatccctc

SEQ ID NO: 125908 - DNA, 20 bp, human
gctctgagctctggagccag

SEQ ID NO: 125909 - DNA, 20 bp, human
gggctgagtctaactgggat

SEQ ID NO: 125910 - DNA, 20 bp, human
ggacggggctgagtctaact

SEQ ID NO: 125911 - DNA, 20 bp, human
gaggaggcacagcatggctg

SEQ ID NO: 125912 - DNA, 20 bp, human
gacagcatggctgcggctgt

SEQ ID NO: 125913 - DNA, 20 bp, human
gccgggtgcaacgagagcca

SEQ ID NO: 125914 - DNA, 20 bp, human
gtgggcgtggccctggtctg

SEQ ID NO: 125915 - DNA, 20 bp, human
ggaggcagtgtgggctcagg

SEQ ID NO: 125916 - DNA, 20 bp, human
gcggcctgaggagacccgtt

SEQ ID NO: 125917 - DNA, 20 bp, human
ggaacgcgcaggcagcaccg

SEQ ID NO: 125918 - DNA, 20 bp, human
gtcccgctaggaccccgtcc

SEQ ID NO: 125919 - DNA, 20 bp, human
ggagcgcttcatgacgtcac

SEQ ID NO: 125920 - DNA, 20 bp, human
ggcgcaggcagcaccgggga

SEQ ID NO: 125921 - DNA, 20 bp, human
gggagcttcgagtccgtccc

SEQ ID NO: 125922 - DNA, 20 bp, human
gggtgggcgccatagcgacg

SEQ ID NO: 125923 - DNA, 20 bp, human
ggggcctgggtctggatggt

SEQ ID NO: 125924 - DNA, 20 bp, human
gtaatccctgaactgcacgg

SEQ ID NO: 125925 - DNA, 20 bp, human
gcctgaactgcacggcgggg

SEQ ID NO: 125926 - DNA, 20 bp, human
ggacggaagaggccctgcgg

SEQ ID NO: 125927 - DNA, 20 bp, human
ggcggtgcagcgctccggta

SEQ ID NO: 125928 - DNA, 20 bp, human
ggcagcgacacgggagtcta

SEQ ID NO: 125929 - DNA, 20 bp, human
gacccggcggcctgacgatg

SEQ ID NO: 125930 - DNA, 20 bp, human
gttggactcgagccccggaa

SEQ ID NO: 125931 - DNA, 20 bp, human
ggtgcagcgctccggtaagg

SEQ ID NO: 125932 - DNA, 20 bp, human
gcgccggtggatgggagtga

SEQ ID NO: 125933 - DNA, 20 bp, human
gagcggaggagcagcgacac

SEQ ID NO: 125934 - DNA, 20 bp, human
gccgcggccctccccaagaa

SEQ ID NO: 125935 - DNA, 20 bp, human
gctcctccaccgcgcccggg

SEQ ID NO: 125936 - DNA, 20 bp, human
gctcctgggaaaggccgtgg

SEQ ID NO: 125937 - DNA, 20 bp, human
gcgcgccggagcgggaccga

SEQ ID NO: 125938 - DNA, 20 bp, human
ggtcgctcgctcggtcccgt

SEQ ID NO: 125939 - DNA, 20 bp, human
gctccggcgcgtccctcctc

SEQ ID NO: 125940 - DNA, 20 bp, human
gcccgccgcgctaccctcct

SEQ ID NO: 125941 - DNA, 20 bp, human
gaccctcctgggaaaggccg

SEQ ID NO: 125942 - DNA, 20 bp, human
gaccgcgggtgggcccggca

SEQ ID NO: 125943 - DNA, 20 bp, human
gggtcccgtcggtcccgctc

SEQ ID NO: 125944 - DNA, 20 bp, human
ggccctgccgggcccacccg

SEQ ID NO: 125945 - DNA, 20 bp, human
gtcccaggagggtagcgcgg

SEQ ID NO: 125946 - DNA, 20 bp, human
gcactgtgcggccgtcgtgg

SEQ ID NO: 125947 - DNA, 20 bp, human
gtgccgcgaggggtaggagt

SEQ ID NO: 125948 - DNA, 20 bp, human
gcgccggtgcaggacgtaca

SEQ ID NO: 125949 - DNA, 20 bp, human
ggcgcgcgagagggagtcaa

SEQ ID NO: 125950 - DNA, 20 bp, human
ggaggacgaaggccgataca

SEQ ID NO: 125951 - DNA, 20 bp, human
gtacctgattgggaaactga

SEQ ID NO: 125952 - DNA, 20 bp, human
gactcctcaatatcccaggt

SEQ ID NO: 125953 - DNA, 20 bp, human
ggctgcggcgccaagatgag

SEQ ID NO: 125954 - DNA, 20 bp, human
gcccaatcaggtagtgagag

SEQ ID NO: 125955 - DNA, 20 bp, human
ggggatattgaggagtccgg

SEQ ID NO: 125956 - DNA, 20 bp, human
gctgaggaatcagcttgact

SEQ ID NO: 125957 - DNA, 20 bp, human
gccgtcgagttaaacgtctg

SEQ ID NO: 125958 - DNA, 20 bp, human
gaaaagtgcgaggcgaccgt

SEQ ID NO: 125959 - DNA, 20 bp, human
gaggtagggccgaggaatca

SEQ ID NO: 125960 - DNA, 20 bp, human
ggagtaaagtacacaaaggg

SEQ ID NO: 125961 - DNA, 20 bp, human
gaggagcataaagaagcccg

SEQ ID NO: 125962 - DNA, 20 bp, human
gcaaagggccacgggttcat

SEQ ID NO: 125963 - DNA, 20 bp, human
gcccggggttcagggatgtg

SEQ ID NO: 125964 - DNA, 20 bp, human
ggggccgaggaatcagggta

SEQ ID NO: 125965 - DNA, 20 bp, human
ggtgcgaggcgaccgtggga

SEQ ID NO: 125966 - DNA, 20 bp, human
ggacggacaagcgagcggga

SEQ ID NO: 125967 - DNA, 20 bp, human
gtgcgcgccggagtttgcag

SEQ ID NO: 125968 - DNA, 20 bp, human
gcagtcggctggtcacatcg

SEQ ID NO: 125969 - DNA, 20 bp, human
gccgcgccgcggagaatgac

SEQ ID NO: 125970 - DNA, 20 bp, human
ggcgcagacggacaagcgag

SEQ ID NO: 125971 - DNA, 20 bp, human
gcggcggcgagtgctggctg

SEQ ID NO: 125972 - DNA, 20 bp, human
gcctggcggacggcgctcgg

SEQ ID NO: 125973 - DNA, 20 bp, human
gcggcgcctgtcattctccg

SEQ ID NO: 125974 - DNA, 20 bp, human
gcaaggcgactggtgcagag

SEQ ID NO: 125975 - DNA, 20 bp, human
gggcgactggtgcagagcgg

SEQ ID NO: 125976 - DNA, 20 bp, human
gaggggtcaaagtcccgagg

SEQ ID NO: 125977 - DNA, 20 bp, human
gtggaggggtcaaagtcccg

SEQ ID NO: 125978 - DNA, 20 bp, human
ggtcaaagtcccgaggtggt

SEQ ID NO: 125979 - DNA, 20 bp, human
gagtcctgaatggggccccg

SEQ ID NO: 125980 - DNA, 20 bp, human
gtgctgcgggtgctgttgga

SEQ ID NO: 125981 - DNA, 20 bp, human
gggcgaaggggccgacggga

SEQ ID NO: 125982 - DNA, 20 bp, human
gccgcctcggggccccattc

SEQ ID NO: 125983 - DNA, 20 bp, human
gcgagtgctgcgggtgctgt

SEQ ID NO: 125984 - DNA, 20 bp, human
gtcactgggtgccttcccgt

SEQ ID NO: 125985 - DNA, 20 bp, human
gtggtaggaacccatgacac

SEQ ID NO: 125986 - DNA, 20 bp, human
gctctgtgcggacacaagac

SEQ ID NO: 125987 - DNA, 20 bp, human
ggacgcgggaagggaccgtg

SEQ ID NO: 125988 - DNA, 20 bp, human
gcgtgtggtcagtaacgaag

SEQ ID NO: 125989 - DNA, 20 bp, human
gcaggtcgcgacgccaccat

SEQ ID NO: 125990 - DNA, 20 bp, human
gtgggaactgggagcgcggt

SEQ ID NO: 125991 - DNA, 20 bp, human
gccagtcaggacaagtccca

SEQ ID NO: 125992 - DNA, 20 bp, human
gtctgcagaacggtgttact

SEQ ID NO: 125993 - DNA, 20 bp, human
gtcctgactgggctgggatg

SEQ ID NO: 125994 - DNA, 20 bp, human
gaactgggagcgcggtgggc

SEQ ID NO: 125995 - DNA, 20 bp, human
ggtcagtaacgaaggggctt

SEQ ID NO: 125996 - DNA, 20 bp, human
ggacgcgggaagagaccatg

SEQ ID NO: 125997 - DNA, 20 bp, human
gagagaccatgtggtcagta

SEQ ID NO: 125998 - DNA, 20 bp, human
gacgacgacaagtcccacgg

SEQ ID NO: 125999 - DNA, 20 bp, human
gcaggtcgggatgccaccgt

SEQ ID NO: 126000 - DNA, 20 bp, human
ggccacgacgacaagtccca

SEQ ID NO: 126001 - DNA, 20 bp, human
ggtttccagactcctcggta

SEQ ID NO: 126002 - DNA, 20 bp, human
gccatgtggtcagtaaggaa

SEQ ID NO: 126003 - DNA, 20 bp, human
ggctgtgtgtggacagaagg

SEQ ID NO: 126004 - DNA, 20 bp, human
gtggcatcccgacctgggag

SEQ ID NO: 126005 - DNA, 20 bp, human
gtcttcccgcgtccctaccg

SEQ ID NO: 126006 - DNA, 20 bp, human
ggagcctggcgaagaatgaa

SEQ ID NO: 126007 - DNA, 20 bp, human
gcaaggaggcagaagtaggt

SEQ ID NO: 126008 - DNA, 20 bp, human
gcggcaccctcacagctccg

SEQ ID NO: 126009 - DNA, 20 bp, human
ggaactgccgcggagctgtg

SEQ ID NO: 126010 - DNA, 20 bp, human
gtgctgaggtctaaacaagg

SEQ ID NO: 126011 - DNA, 20 bp, human
gcccacgaggtgaactgccg

SEQ ID NO: 126012 - DNA, 20 bp, human
gagaacaggtgtgagtgagt

SEQ ID NO: 126013 - DNA, 20 bp, human
gcctgagactgagactcagt

SEQ ID NO: 126014 - DNA, 20 bp, human
gtccgcggcagttcacctcg

SEQ ID NO: 126015 - DNA, 20 bp, human
gcactgctgaggtctaaaca

SEQ ID NO: 126016 - DNA, 20 bp, human
gggcagagctctgcaaggag

SEQ ID NO: 126017 - DNA, 20 bp, human
gaaacgcctggaactctctg

SEQ ID NO: 126018 - DNA, 20 bp, human
gtgagaaagaacgaagatgt

SEQ ID NO: 126019 - DNA, 20 bp, human
ggctctgcctagacagaagg

SEQ ID NO: 126020 - DNA, 20 bp, human
gttctgcccaccttctgtct

SEQ ID NO: 126021 - DNA, 20 bp, human
gagagctctgcctagacaga

SEQ ID NO: 126022 - DNA, 20 bp, human
ggggcttaggacaggtcccg

SEQ ID NO: 126023 - DNA, 20 bp, human
gcgccatgggccggtaatcg

SEQ ID NO: 126024 - DNA, 20 bp, human
gaggcgatctaccccctcca

SEQ ID NO: 126025 - DNA, 20 bp, human
gcgctgtgggctggtgacta

SEQ ID NO: 126026 - DNA, 20 bp, human
ggacactgcggccagtacgg

SEQ ID NO: 126027 - DNA, 20 bp, human
ggaagtgacctccggcctcc

SEQ ID NO: 126028 - DNA, 20 bp, human
gcaagggacataggccacta

SEQ ID NO: 126029 - DNA, 20 bp, human
gtgcagctccagagtaccgt

SEQ ID NO: 126030 - DNA, 20 bp, human
gccctctccacacccggaca

SEQ ID NO: 126031 - DNA, 20 bp, human
gcagtcctcggagtcctcct

SEQ ID NO: 126032 - DNA, 20 bp, human
ggacataggccactagggca

SEQ ID NO: 126033 - DNA, 20 bp, human
ggacagaggcgccgccgtac

SEQ ID NO: 126034 - DNA, 20 bp, human
gggcgcctctgtctgaagaa

SEQ ID NO: 126035 - DNA, 20 bp, human
gaccctgcgacgacagatac

SEQ ID NO: 126036 - DNA, 20 bp, human
gtagggcctcaggtacaggc

SEQ ID NO: 126037 - DNA, 20 bp, human
gggtttgcaaacagcacgtg

SEQ ID NO: 126038 - DNA, 20 bp, human
gtccccgggagtgaggtctc

SEQ ID NO: 126039 - DNA, 20 bp, human
gaggagaagagagttacaaa

SEQ ID NO: 126040 - DNA, 20 bp, human
gggagaacatctgtcctcgg

SEQ ID NO: 126041 - DNA, 20 bp, human
gggagccagcatgtccactg

SEQ ID NO: 126042 - DNA, 20 bp, human
gtttttagggcctcaggtac

SEQ ID NO: 126043 - DNA, 20 bp, human
gctgcggtcctggaaaaccc

SEQ ID NO: 126044 - DNA, 20 bp, human
ggccagagacctcactcccg

SEQ ID NO: 126045 - DNA, 20 bp, human
ggtaggagaacatctgtcct

SEQ ID NO: 126046 - DNA, 20 bp, human
gcagctgagggtgagtaaca

SEQ ID NO: 126047 - DNA, 20 bp, human
gtaacccggaggggtatggg

SEQ ID NO: 126048 - DNA, 20 bp, human
gaacgggcaaagcaagactc

SEQ ID NO: 126049 - DNA, 20 bp, human
gggataatggcgacagctga

SEQ ID NO: 126050 - DNA, 20 bp, human
ggaaaggtcattaacctaac

SEQ ID NO: 126051 - DNA, 20 bp, human
gcccgaggcagtaaagttcg

SEQ ID NO: 126052 - DNA, 20 bp, human
gagggagaccgtgaagggcc

SEQ ID NO: 126053 - DNA, 20 bp, human
gcgcccgcgcggctgcctag

SEQ ID NO: 126054 - DNA, 20 bp, human
gcatacccctccgggttagg

SEQ ID NO: 126055 - DNA, 20 bp, human
gtctgcctcgcttcccggcg

SEQ ID NO: 126056 - DNA, 20 bp, human
ggtgcttctggcggagcgga

SEQ ID NO: 126057 - DNA, 20 bp, human
gcctcactcgggcctcatgg

SEQ ID NO: 126058 - DNA, 20 bp, human
gtctggagcggcgggtgctc

SEQ ID NO: 126059 - DNA, 20 bp, human
gggaggaggagcatgtcgga

SEQ ID NO: 126060 - DNA, 20 bp, human
gcggggcgggcgctctggag

SEQ ID NO: 126061 - DNA, 20 bp, human
gagccgagggtagccgagcg

SEQ ID NO: 126062 - DNA, 20 bp, human
gcccggggcgctcccaggta

SEQ ID NO: 126063 - DNA, 20 bp, human
gagggccgcgtgaccgggta

SEQ ID NO: 126064 - DNA, 20 bp, human
gggctgctcggtgcttctgg

SEQ ID NO: 126065 - DNA, 20 bp, human
gcccccagccaggcgcacaa

SEQ ID NO: 126066 - DNA, 20 bp, human
ggagatccgcggaggccgac

SEQ ID NO: 126067 - DNA, 20 bp, human
gcgacggcagaggggcctaa

SEQ ID NO: 126068 - DNA, 20 bp, human
gggcctccgcggatctccac

SEQ ID NO: 126069 - DNA, 20 bp, human
gcgaagcgcacgtcgagcgg

SEQ ID NO: 126070 - DNA, 20 bp, human
gcaggggaaagggtacccgg

SEQ ID NO: 126071 - DNA, 20 bp, human
gctcggtggccaaccaccca

SEQ ID NO: 126072 - DNA, 20 bp, human
gcggcggagggataaaggac

SEQ ID NO: 126073 - DNA, 20 bp, human
ggaggccgcaatggactcgg

SEQ ID NO: 126074 - DNA, 20 bp, human
gtctctatccgggtcctcag

SEQ ID NO: 126075 - DNA, 20 bp, human
ggtacccggcggagggataa

SEQ ID NO: 126076 - DNA, 20 bp, human
ggccgtcgccacaacagtct

SEQ ID NO: 126077 - DNA, 20 bp, human
gccgacggcggcagaaaggg

SEQ ID NO: 126078 - DNA, 20 bp, human
ggcctgcccgagctcctgta

SEQ ID NO: 126079 - DNA, 20 bp, human
gcccttcacagccccgacgg

SEQ ID NO: 126080 - DNA, 20 bp, human
gagtggtagtggcgcttctc

SEQ ID NO: 126081 - DNA, 20 bp, human
gaacttgggtgggagtcggg

SEQ ID NO: 126082 - DNA, 20 bp, human
gtgcccctcgggagcaatag

SEQ ID NO: 126083 - DNA, 20 bp, human
ggtggcgacggcgacctcta

SEQ ID NO: 126084 - DNA, 20 bp, human
ggtgttaggaggacgctgag

SEQ ID NO: 126085 - DNA, 20 bp, human
ggggaaacagagcacctgtg

SEQ ID NO: 126086 - DNA, 20 bp, human
ggagaccaggttcctcgagg

SEQ ID NO: 126087 - DNA, 20 bp, human
gctgaggggcgaggtgcgaa

SEQ ID NO: 126088 - DNA, 20 bp, human
gggacgcgaggggtactggg

SEQ ID NO: 126089 - DNA, 20 bp, human
gggaggcgccaggtaaggtg

SEQ ID NO: 126090 - DNA, 20 bp, human
gctgcgagggaagggatgat

SEQ ID NO: 126091 - DNA, 20 bp, human
ggccgcctagccgggagtga

SEQ ID NO: 126092 - DNA, 20 bp, human
ggcggagaccaggttcctcg

SEQ ID NO: 126093 - DNA, 20 bp, human
gctgaggggagccccgccac

SEQ ID NO: 126094 - DNA, 20 bp, human
gcacagtagacgccccctca

SEQ ID NO: 126095 - DNA, 20 bp, human
gtgagccccctcgaggaacc

SEQ ID NO: 126096 - DNA, 20 bp, human
gaggcacgtgcgctgctgaa

SEQ ID NO: 126097 - DNA, 20 bp, human
gaaaggtccacgggacacaa

SEQ ID NO: 126098 - DNA, 20 bp, human
ggtgtacagcgaacccaaag

SEQ ID NO: 126099 - DNA, 20 bp, human
ggtgcgctgctgaatggagc

SEQ ID NO: 126100 - DNA, 20 bp, human
gtacgcccgtctgaagggag

SEQ ID NO: 126101 - DNA, 20 bp, human
ggggcaagcaggcatatctc

SEQ ID NO: 126102 - DNA, 20 bp, human
ggctacgagcaggtcctctt

SEQ ID NO: 126103 - DNA, 20 bp, human
gtggagcgcctgctgttcac

SEQ ID NO: 126104 - DNA, 20 bp, human
ggtcgctggttgctacgagc

SEQ ID NO: 126105 - DNA, 20 bp, human
gcgtggtcgccgcaagcctc

SEQ ID NO: 126106 - DNA, 20 bp, human
gctgctaccgctaggcccag

SEQ ID NO: 126107 - DNA, 20 bp, human
ggccaggccacggagaagga

SEQ ID NO: 126108 - DNA, 20 bp, human
ggtcctgcgcacgccaggga

SEQ ID NO: 126109 - DNA, 20 bp, human
gctaccgctaggcccagcgg

SEQ ID NO: 126110 - DNA, 20 bp, human
gcggagtcctgcgcacgcca

SEQ ID NO: 126111 - DNA, 20 bp, human
ggggagggaagaccgagagt

SEQ ID NO: 126112 - DNA, 20 bp, human
gccgccgggagctctgaccg

SEQ ID NO: 126113 - DNA, 20 bp, human
ggctcccagcacgcaggtgg

SEQ ID NO: 126114 - DNA, 20 bp, human
gcaatggcgacggcccgggc

SEQ ID NO: 126115 - DNA, 20 bp, human
gcgagagtcggcagagaccg

SEQ ID NO: 126116 - DNA, 20 bp, human
ggagccacgtaggagactcg

SEQ ID NO: 126117 - DNA, 20 bp, human
gcccagtgcgagatcccaga

SEQ ID NO: 126118 - DNA, 20 bp, human
gcgagcaggggctctaccgc

SEQ ID NO: 126119 - DNA, 20 bp, human
gcgtaggagactcgaggctg

SEQ ID NO: 126120 - DNA, 20 bp, human
ggtgacgtaatagcagagaa

SEQ ID NO: 126121 - DNA, 20 bp, human
gtaatagcagagaagggcta

SEQ ID NO: 126122 - DNA, 20 bp, human
ggctgtgccagctaaccgtc

SEQ ID NO: 126123 - DNA, 20 bp, human
gctggagcgctcggaggtag

SEQ ID NO: 126124 - DNA, 20 bp, human
gcaggggctctaccgcgggc

SEQ ID NO: 126125 - DNA, 20 bp, human
ggagatcccagacggttagc

SEQ ID NO: 126126 - DNA, 20 bp, human
gtgacctctgaccctcgtgg

SEQ ID NO: 126127 - DNA, 20 bp, human
gcgttggggattcaacatgg

SEQ ID NO: 126128 - DNA, 20 bp, human
gtctgggcgagtctcaaaaa

SEQ ID NO: 126129 - DNA, 20 bp, human
ggcggcgggagtgtccgcgg

SEQ ID NO: 126130 - DNA, 20 bp, human
ggttcgttggggattcaaca

SEQ ID NO: 126131 - DNA, 20 bp, human
gctgcccccacgagggtcag

SEQ ID NO: 126132 - DNA, 20 bp, human
ggcgggagtgtccgcggtgg

SEQ ID NO: 126133 - DNA, 20 bp, human
gaagccccggatgttcgttg

SEQ ID NO: 126134 - DNA, 20 bp, human
ggggaaggctgcccccacga

SEQ ID NO: 126135 - DNA, 20 bp, human
ggtcagaggtcacagcccca

SEQ ID NO: 126136 - DNA, 20 bp, human
gcagccggggaacccacctg

SEQ ID NO: 126137 - DNA, 20 bp, human
gctggctcaggtgcaagagg

SEQ ID NO: 126138 - DNA, 20 bp, human
gctctcgccgcgaacctccg

SEQ ID NO: 126139 - DNA, 20 bp, human
ggaacgctcgaagaggtcgt

SEQ ID NO: 126140 - DNA, 20 bp, human
gagcccaggaacgctcgaag

SEQ ID NO: 126141 - DNA, 20 bp, human
ggctccgcaggtgggttccc

SEQ ID NO: 126142 - DNA, 20 bp, human
gggcttcccgctccgcaggt

SEQ ID NO: 126143 - DNA, 20 bp, human
ggacctcttcgagcgttcct

SEQ ID NO: 126144 - DNA, 20 bp, human
gcggctgccccggaggttcg

SEQ ID NO: 126145 - DNA, 20 bp, human
gaggttcgcggcgagaggac

SEQ ID NO: 126146 - DNA, 20 bp, human
gcacactctggagacagcca

SEQ ID NO: 126147 - DNA, 20 bp, human
ggaaatcccaaagtgagccg

SEQ ID NO: 126148 - DNA, 20 bp, human
gacgagcaggtcgatgcctg

SEQ ID NO: 126149 - DNA, 20 bp, human
gcgcgcgccccggctcactt

SEQ ID NO: 126150 - DNA, 20 bp, human
gctggagacagccacggtcc

SEQ ID NO: 126151 - DNA, 20 bp, human
gctcggcgccccaaacgagc

SEQ ID NO: 126152 - DNA, 20 bp, human
gagacagccacggtccaggc

SEQ ID NO: 126153 - DNA, 20 bp, human
ggctcctggcacatcaggac

SEQ ID NO: 126154 - DNA, 20 bp, human
gcctgctgccacagcccccc

SEQ ID NO: 126155 - DNA, 20 bp, human
gtcgatgcctgaggatttaa

SEQ ID NO: 126156 - DNA, 20 bp, human
gtgacagccggccaccaggt

SEQ ID NO: 126157 - DNA, 20 bp, human
ggcgtgcgcccggggagacc

SEQ ID NO: 126158 - DNA, 20 bp, human
gctctcagggctggaatccg

SEQ ID NO: 126159 - DNA, 20 bp, human
gccatgttcccggtctcccc

SEQ ID NO: 126160 - DNA, 20 bp, human
gtctccccgggcgcacgctg

SEQ ID NO: 126161 - DNA, 20 bp, human
gactactactggctgggtag

SEQ ID NO: 126162 - DNA, 20 bp, human
gcacgctggggaactactac

SEQ ID NO: 126163 - DNA, 20 bp, human
gtcatggacagtcctccgag

SEQ ID NO: 126164 - DNA, 20 bp, human
gaccagcacgctctcagggc

SEQ ID NO: 126165 - DNA, 20 bp, human
gccggctgtcagcgaagcgg

SEQ ID NO: 126166 - DNA, 20 bp, human
gctctgaccccgctttccca

SEQ ID NO: 126167 - DNA, 20 bp, human
gatttaattggccggagttt

SEQ ID NO: 126168 - DNA, 20 bp, human
gaggcgccccaggaaggaat

SEQ ID NO: 126169 - DNA, 20 bp, human
gtagcgtggtgctcacgtgg

SEQ ID NO: 126170 - DNA, 20 bp, human
gcctcctcttagggctgagg

SEQ ID NO: 126171 - DNA, 20 bp, human
ggccaactgggtcccggtgt

SEQ ID NO: 126172 - DNA, 20 bp, human
ggtcagctgatcgcgcactg

SEQ ID NO: 126173 - DNA, 20 bp, human
ggcgtgcgcaggccgaatgg

SEQ ID NO: 126174 - DNA, 20 bp, human
gccaagcgcgccctaaactc

SEQ ID NO: 126175 - DNA, 20 bp, human
ggcgatcagctgacccacgc

SEQ ID NO: 126176 - DNA, 20 bp, human
ggcagaggtggctccggagg

SEQ ID NO: 126177 - DNA, 20 bp, human
gggcgcgcaggtcccgtcgc

SEQ ID NO: 126178 - DNA, 20 bp, human
gagagggagcccgtgctcac

SEQ ID NO: 126179 - DNA, 20 bp, human
gtcccgtcgccggtgagcac

SEQ ID NO: 126180 - DNA, 20 bp, human
gccggcgaggccacgcgaga

SEQ ID NO: 126181 - DNA, 20 bp, human
gcaggacctcacctctccaa

SEQ ID NO: 126182 - DNA, 20 bp, human
ggaggcaagagggactcaca

SEQ ID NO: 126183 - DNA, 20 bp, human
gcaccaaacccagggaactc

SEQ ID NO: 126184 - DNA, 20 bp, human
gacttcgccagcccatgcgg

SEQ ID NO: 126185 - DNA, 20 bp, human
gagcccgtgctcaccggcga

SEQ ID NO: 126186 - DNA, 20 bp, human
gcaggcagtctctaatgaat

SEQ ID NO: 126187 - DNA, 20 bp, human
gttagagactgcctggtccg

SEQ ID NO: 126188 - DNA, 20 bp, human
gtctgggagaatggaggttg

SEQ ID NO: 126189 - DNA, 20 bp, human
gagttgcctcaaagtgacca

SEQ ID NO: 126190 - DNA, 20 bp, human
gctggtccgtggtcactttg

SEQ ID NO: 126191 - DNA, 20 bp, human
gcttaatatactaactagta

SEQ ID NO: 126192 - DNA, 20 bp, human
gtggtgctatcaattccaaa

SEQ ID NO: 126193 - DNA, 20 bp, human
gctagcttaaatatgggtga

SEQ ID NO: 126194 - DNA, 20 bp, human
gacttatctagcttaaatat

SEQ ID NO: 126195 - DNA, 20 bp, human
gaagcttaagcatgctaaga

SEQ ID NO: 126196 - DNA, 20 bp, human
gcgcagccgggaagagactc

SEQ ID NO: 126197 - DNA, 20 bp, human
ggcggggagatggagtgagt

SEQ ID NO: 126198 - DNA, 20 bp, human
ggccggaccggtgcaatctg

SEQ ID NO: 126199 - DNA, 20 bp, human
gtccccacgcgccggtgggt

SEQ ID NO: 126200 - DNA, 20 bp, human
gcgggtccccacgcgccggt

SEQ ID NO: 126201 - DNA, 20 bp, human
gggcagcgacgcccccaatg

SEQ ID NO: 126202 - DNA, 20 bp, human
gtcggctctcggccacctgt

SEQ ID NO: 126203 - DNA, 20 bp, human
gacccacccggacctcggcg

SEQ ID NO: 126204 - DNA, 20 bp, human
gctcgggccagtccaggacg

SEQ ID NO: 126205 - DNA, 20 bp, human
gcaatggggcgcgagagagg

SEQ ID NO: 126206 - DNA, 20 bp, human
gccgcgccagccgaggacgt

SEQ ID NO: 126207 - DNA, 20 bp, human
gtatagatggagacccccaa

SEQ ID NO: 126208 - DNA, 20 bp, human
gtgccggcgtcccacgtcct

SEQ ID NO: 126209 - DNA, 20 bp, human
gaggggctaaaactctgtca

SEQ ID NO: 126210 - DNA, 20 bp, human
gccgggagaacgcccaggga

SEQ ID NO: 126211 - DNA, 20 bp, human
gccctggaacatatgacctg

SEQ ID NO: 126212 - DNA, 20 bp, human
gggctagcgcgccctcccgg

SEQ ID NO: 126213 - DNA, 20 bp, human
gtgacctgcggctactgtgc

SEQ ID NO: 126214 - DNA, 20 bp, human
gcctctgccatcctggagaa

SEQ ID NO: 126215 - DNA, 20 bp, human
ggtcacccaaggaaactgat

SEQ ID NO: 126216 - DNA, 20 bp, human
gccgcgccagccgaggacgt

SEQ ID NO: 126217 - DNA, 20 bp, human
gtatagatggagacccccaa

SEQ ID NO: 126218 - DNA, 20 bp, human
gtgccggcgtcccacgtcct

SEQ ID NO: 126219 - DNA, 20 bp, human
gaggggctaaaactctgtca

SEQ ID NO: 126220 - DNA, 20 bp, human
gccgggagaacgcccaggga

SEQ ID NO: 126221 - DNA, 20 bp, human
gccctggaacatatgacctg

SEQ ID NO: 126222 - DNA, 20 bp, human
gggctagcgcgccctcccgg

SEQ ID NO: 126223 - DNA, 20 bp, human
gtgacctgcggctactgtgc

SEQ ID NO: 126224 - DNA, 20 bp, human
gcctctgccatcctggagaa

SEQ ID NO: 126225 - DNA, 20 bp, human
ggtcacccaaggaaactgat

SEQ ID NO: 126226 - DNA, 20 bp, human
ggagctccctctaccggcag

SEQ ID NO: 126227 - DNA, 20 bp, human
gcagagagacgaggaagtca

SEQ ID NO: 126228 - DNA, 20 bp, human
gagacgagaagggagcatgg

SEQ ID NO: 126229 - DNA, 20 bp, human
gtgaccagacaggaactggg

SEQ ID NO: 126230 - DNA, 20 bp, human
gtctcccaacaggcccatgg

SEQ ID NO: 126231 - DNA, 20 bp, human
gttctagccgctgccggtag

SEQ ID NO: 126232 - DNA, 20 bp, human
gggaaggactgtcaggatgg

SEQ ID NO: 126233 - DNA, 20 bp, human
gtcagggatgaaagttccca

SEQ ID NO: 126234 - DNA, 20 bp, human
gctctggactcccccatctc

SEQ ID NO: 126235 - DNA, 20 bp, human
ggggggagtccagagagacg

SEQ ID NO: 126236 - DNA, 20 bp, human
ggagttacagagggtcatga

SEQ ID NO: 126237 - DNA, 20 bp, human
gcttagaggaaggcagaccg

SEQ ID NO: 126238 - DNA, 20 bp, human
ggagacgctcctgacaagtc

SEQ ID NO: 126239 - DNA, 20 bp, human
ggttgactgacaagtttgaa

SEQ ID NO: 126240 - DNA, 20 bp, human
gtgacaagtttgaacggcag

SEQ ID NO: 126241 - DNA, 20 bp, human
ggaagccccagagttacaga

SEQ ID NO: 126242 - DNA, 20 bp, human
gaacagagactcgtccatga

SEQ ID NO: 126243 - DNA, 20 bp, human
gccgagcagatgcacagatc

SEQ ID NO: 126244 - DNA, 20 bp, human
gcgacaggggcagccggcca

SEQ ID NO: 126245 - DNA, 20 bp, human
gatgtaatgagggtgtgctg

SEQ ID NO: 126246 - DNA, 20 bp, human
gtatgactccggaatgacag

SEQ ID NO: 126247 - DNA, 20 bp, human
ggaatgacaggggctgtgag

SEQ ID NO: 126248 - DNA, 20 bp, human
ggaggcgtctcggtcacgag

SEQ ID NO: 126249 - DNA, 20 bp, human
gtgcccgggccatgaagtag

SEQ ID NO: 126250 - DNA, 20 bp, human
gaaggagaactagcaggcta

SEQ ID NO: 126251 - DNA, 20 bp, human
gacagctgcttggaaaaaca

SEQ ID NO: 126252 - DNA, 20 bp, human
gcgcgggtgccttatgactc

SEQ ID NO: 126253 - DNA, 20 bp, human
gtctcccggcggggtcgtat

SEQ ID NO: 126254 - DNA, 20 bp, human
ggggcacggcgggcgtcctg

SEQ ID NO: 126255 - DNA, 20 bp, human
gtgaccgagacgcctcgccg

SEQ ID NO: 126256 - DNA, 20 bp, human
ggaggcgtctcggtcacgag

SEQ ID NO: 126257 - DNA, 20 bp, human
gacaggagtgggtccaaggg

SEQ ID NO: 126258 - DNA, 20 bp, human
gggctgtgagggataaaggg

SEQ ID NO: 126259 - DNA, 20 bp, human
gcagaacaccggctctacag

SEQ ID NO: 126260 - DNA, 20 bp, human
ggcacgcgagcggcgctgga

SEQ ID NO: 126261 - DNA, 20 bp, human
gaaaacaggagtgggtccaa

SEQ ID NO: 126262 - DNA, 20 bp, human
gtatgactccggaatgacag

SEQ ID NO: 126263 - DNA, 20 bp, human
ggataaaggggggaagaagt

SEQ ID NO: 126264 - DNA, 20 bp, human
gtgcccgggccatgaagtag

SEQ ID NO: 126265 - DNA, 20 bp, human
gtggccgcggcgaggcgtct

SEQ ID NO: 126266 - DNA, 20 bp, human
gcccgactcggggctcacca

SEQ ID NO: 126267 - DNA, 20 bp, human
ggtcggagtttgagccccgg

SEQ ID NO: 126268 - DNA, 20 bp, human
ggcagcgctgtaaggttcca

SEQ ID NO: 126269 - DNA, 20 bp, human
gtggcagccgctctgcctcc

SEQ ID NO: 126270 - DNA, 20 bp, human
gcagcggtggagcatgagtc

SEQ ID NO: 126271 - DNA, 20 bp, human
ggccggggatcaagcgtggt

SEQ ID NO: 126272 - DNA, 20 bp, human
ggccatggtgagccccgagt

SEQ ID NO: 126273 - DNA, 20 bp, human
gccccggtagcgcccgactc

SEQ ID NO: 126274 - DNA, 20 bp, human
gagcgtggtcggcgggtcag

SEQ ID NO: 126275 - DNA, 20 bp, human
gcgtgtgagcgagcagccgt

SEQ ID NO: 126276 - DNA, 20 bp, human
gccctccccagtagacgctc

SEQ ID NO: 126277 - DNA, 20 bp, human
gggtgcccgagcgtctactg

SEQ ID NO: 126278 - DNA, 20 bp, human
ggcaccagccgcggcaagga

SEQ ID NO: 126279 - DNA, 20 bp, human
gactgggagtctcaggaggt

SEQ ID NO: 126280 - DNA, 20 bp, human
gcaccctaggaggacaccct

SEQ ID NO: 126281 - DNA, 20 bp, human
ggcccgagcgtctactgggg

SEQ ID NO: 126282 - DNA, 20 bp, human
ggagcaggactgggagtctc

SEQ ID NO: 126283 - DNA, 20 bp, human
gcccagctccatccttgccg

SEQ ID NO: 126284 - DNA, 20 bp, human
gtggcaaggacgagatgaga

SEQ ID NO: 126285 - DNA, 20 bp, human
gctcctagggtgtcctccta

SEQ ID NO: 126286 - DNA, 20 bp, human
gttaggttgagccctaggcg

SEQ ID NO: 126287 - DNA, 20 bp, human
ggttatctagaattctccca

SEQ ID NO: 126288 - DNA, 20 bp, human
gtaggcgtgggggagaactg

SEQ ID NO: 126289 - DNA, 20 bp, human
gaagggagcgagaattgcgg

SEQ ID NO: 126290 - DNA, 20 bp, human
ggggctcaacctaaccacta

SEQ ID NO: 126291 - DNA, 20 bp, human
ggcctagcggaggagggata

SEQ ID NO: 126292 - DNA, 20 bp, human
ggagaatcctgggtagctat

SEQ ID NO: 126293 - DNA, 20 bp, human
ggcgtggaattagaacgagt

SEQ ID NO: 126294 - DNA, 20 bp, human
gggttgagccctaggcgtgg

SEQ ID NO: 126295 - DNA, 20 bp, human
gtcctgggtagctattggag

SEQ ID NO: 126296 - DNA, 20 bp, human
gaggccgccgccactgttca

SEQ ID NO: 126297 - DNA, 20 bp, human
gagcgcgagagagcgagtgg

SEQ ID NO: 126298 - DNA, 20 bp, human
gccgccaccaccatagacgg

SEQ ID NO: 126299 - DNA, 20 bp, human
ggcggcgttgccatgaacag

SEQ ID NO: 126300 - DNA, 20 bp, human
gcgggcggcggcggaagacg

SEQ ID NO: 126301 - DNA, 20 bp, human
gcgacggccgtctcaggaag

SEQ ID NO: 126302 - DNA, 20 bp, human
gcagcggcgacggccgtctc

SEQ ID NO: 126303 - DNA, 20 bp, human
gccaccaccatagacggggg

SEQ ID NO: 126304 - DNA, 20 bp, human
gaccatagacgggggaggaa

SEQ ID NO: 126305 - DNA, 20 bp, human
ggcgttgccatgaacagtgg

SEQ ID NO: 126306 - DNA, 20 bp, human
gcgcgcggcctggggatcag

SEQ ID NO: 126307 - DNA, 20 bp, human
gggccgcgcgacttcaaacg

SEQ ID NO: 126308 - DNA, 20 bp, human
gtggcggggaccagtctggg

SEQ ID NO: 126309 - DNA, 20 bp, human
ggaccccggctgcagacgtg

SEQ ID NO: 126310 - DNA, 20 bp, human
gcagtggcggggaccagtct

SEQ ID NO: 126311 - DNA, 20 bp, human
gtctgcagccggggtccagt

SEQ ID NO: 126312 - DNA, 20 bp, human
gagacgtgcggcggctggac

SEQ ID NO: 126313 - DNA, 20 bp, human
gtgaacgggctgctgcacaa

SEQ ID NO: 126314 - DNA, 20 bp, human
gaagccgcagggaggatccg

SEQ ID NO: 126315 - DNA, 20 bp, human
gcagcgccgccgctgtgaac

SEQ ID NO: 126316 - DNA, 20 bp, human
gaatgcacttcggctttctc

SEQ ID NO: 126317 - DNA, 20 bp, human
gctaaagcttgtatatataa

SEQ ID NO: 126318 - DNA, 20 bp, human
gttgtaattgtaatgtacac

SEQ ID NO: 126319 - DNA, 20 bp, human
gagccctttgacatgactgt

SEQ ID NO: 126320 - DNA, 20 bp, human
ggaagggggaggttgagttg

SEQ ID NO: 126321 - DNA, 20 bp, human
gcacccacagtcatgtcaaa

SEQ ID NO: 126322 - DNA, 20 bp, human
gccacagcgtcctgtgggga

SEQ ID NO: 126323 - DNA, 20 bp, human
gacatcccacagcgtcctgt

SEQ ID NO: 126324 - DNA, 20 bp, human
gggttatgctgttcgatata

SEQ ID NO: 126325 - DNA, 20 bp, human
gtttttttcaacgaaggggg

SEQ ID NO: 126326 - DNA, 20 bp, human
gccgcgcgcgggaaaaacgg

SEQ ID NO: 126327 - DNA, 20 bp, human
ggaaggaatccgacgctggg

SEQ ID NO: 126328 - DNA, 20 bp, human
gccgcacggtggtccctcgt

SEQ ID NO: 126329 - DNA, 20 bp, human
gtgtccgcgcgcgggaaaaa

SEQ ID NO: 126330 - DNA, 20 bp, human
gagcgactgctgctgcggat

SEQ ID NO: 126331 - DNA, 20 bp, human
ggcacgaggcgggatcgact

SEQ ID NO: 126332 - DNA, 20 bp, human
gggacactgtccccgcacgg

SEQ ID NO: 126333 - DNA, 20 bp, human
gcagccgaggccccgaccgc

SEQ ID NO: 126334 - DNA, 20 bp, human
gcgagaaggaatccgacgct

SEQ ID NO: 126335 - DNA, 20 bp, human
ggtcaggccacgcaccaacg

SEQ ID NO: 126336 - DNA, 20 bp, human
gatggacggcctccgatccg

SEQ ID NO: 126337 - DNA, 20 bp, human
gagagcagaggcggcgactc

SEQ ID NO: 126338 - DNA, 20 bp, human
gtgctctcagtgccccggat

SEQ ID NO: 126339 - DNA, 20 bp, human
ggaggcggcgactccggagg

SEQ ID NO: 126340 - DNA, 20 bp, human
gtctcagtgccccggatcgg

SEQ ID NO: 126341 - DNA, 20 bp, human
gcggcccgaggggcgatgga

SEQ ID NO: 126342 - DNA, 20 bp, human
gctgggagaggagactagtc

SEQ ID NO: 126343 - DNA, 20 bp, human
gcagatctcgaagagaaagt

SEQ ID NO: 126344 - DNA, 20 bp, human
gggcgcttcgtccggtatgg

SEQ ID NO: 126345 - DNA, 20 bp, human
gaggccgtccatcgcccctc

SEQ ID NO: 126346 - DNA, 20 bp, human
gtagttcgcgcggccgtcct

SEQ ID NO: 126347 - DNA, 20 bp, human
gccgcgcgaactaccaggcc

SEQ ID NO: 126348 - DNA, 20 bp, human
gttcgcgcggccgtcctggg

SEQ ID NO: 126349 - DNA, 20 bp, human
gtgcggaagatctcgtcggg

SEQ ID NO: 126350 - DNA, 20 bp, human
ggggcggcgggaaggacgaa

SEQ ID NO: 126351 - DNA, 20 bp, human
gtaaaggccacggaaggcac

SEQ ID NO: 126352 - DNA, 20 bp, human
ggacggccgcgcgaactacc

SEQ ID NO: 126353 - DNA, 20 bp, human
gtacccgccgcgaggtggga

SEQ ID NO: 126354 - DNA, 20 bp, human
gcgaccctcccacctcgcgg

SEQ ID NO: 126355 - DNA, 20 bp, human
ggggcgcccagatgccgatg

SEQ ID NO: 126356 - DNA, 20 bp, human
gctgaggcaccgagacacaa

SEQ ID NO: 126357 - DNA, 20 bp, human
gaggctcgaccaggaggtcc

SEQ ID NO: 126358 - DNA, 20 bp, human
gtgtgagcgcagggctatcc

SEQ ID NO: 126359 - DNA, 20 bp, human
gcggcgcgccaggctcgacc

SEQ ID NO: 126360 - DNA, 20 bp, human
ggagcgcagggctatcccgg

SEQ ID NO: 126361 - DNA, 20 bp, human
gagctcaccgggccagaccg

SEQ ID NO: 126362 - DNA, 20 bp, human
gggcgccttcacccagtcac

SEQ ID NO: 126363 - DNA, 20 bp, human
gagcgagcgcgagagcccag

SEQ ID NO: 126364 - DNA, 20 bp, human
gagcctcgcccaggacggag

SEQ ID NO: 126365 - DNA, 20 bp, human
gccggccggtgactgggtga

SEQ ID NO: 126366 - DNA, 20 bp, human
gggatcccggcccggagcgc

SEQ ID NO: 126367 - DNA, 20 bp, human
gccctggcgcgtgcctccgg

SEQ ID NO: 126368 - DNA, 20 bp, human
gcacctcctggagcagtcgg

SEQ ID NO: 126369 - DNA, 20 bp, human
ggtccgccgactgctccagg

SEQ ID NO: 126370 - DNA, 20 bp, human
gccgccctggcgcgtgcctc

SEQ ID NO: 126371 - DNA, 20 bp, human
gcaccacctcctggagcagt

SEQ ID NO: 126372 - DNA, 20 bp, human
ggcccgccccctgaccccgg

SEQ ID NO: 126373 - DNA, 20 bp, human
gggagccccccgctcggtcc

SEQ ID NO: 126374 - DNA, 20 bp, human
gaccgagcggggggctccgg

SEQ ID NO: 126375 - DNA, 20 bp, human
gggacgccgggaccgagcgg

SEQ ID NO: 126376 - DNA, 20 bp, human
gggatggtggaatgaggaga

SEQ ID NO: 126377 - DNA, 20 bp, human
ggcacagtgacgggattcca

SEQ ID NO: 126378 - DNA, 20 bp, human
gcagatggtgcatgagttca

SEQ ID NO: 126379 - DNA, 20 bp, human
gatgaggagacggcagcttc

SEQ ID NO: 126380 - DNA, 20 bp, human
gacttgactatccggtccag

SEQ ID NO: 126381 - DNA, 20 bp, human
gcccagcagagatatccata

SEQ ID NO: 126382 - DNA, 20 bp, human
gcttggaagcaacttaccag

SEQ ID NO: 126383 - DNA, 20 bp, human
gtgcagagagtgacatgagg

SEQ ID NO: 126384 - DNA, 20 bp, human
gagatggtgcgcacagtgac

SEQ ID NO: 126385 - DNA, 20 bp, human
gccagggacatcagcaacaa

SEQ ID NO: 126386 - DNA, 20 bp, human
gcgcggtccgggcagtccga

SEQ ID NO: 126387 - DNA, 20 bp, human
gggccagggaaggcgaccta

SEQ ID NO: 126388 - DNA, 20 bp, human
gaccgcgcgatggagtcgac

SEQ ID NO: 126389 - DNA, 20 bp, human
gccgagagctccagacctcc

SEQ ID NO: 126390 - DNA, 20 bp, human
ggggcttctgagtagccggg

SEQ ID NO: 126391 - DNA, 20 bp, human
gcgactccatcgcgcggtcc

SEQ ID NO: 126392 - DNA, 20 bp, human
gtctgagtagccgggaggtc

SEQ ID NO: 126393 - DNA, 20 bp, human
gggtctggagctctcggagg

SEQ ID NO: 126394 - DNA, 20 bp, human
gggcgacctacggctccaca

SEQ ID NO: 126395 - DNA, 20 bp, human
ggagtcgaccggcagcgtcg

SEQ ID NO: 126396 - DNA, 20 bp, human
gggacagctaggcccagctc

SEQ ID NO: 126397 - DNA, 20 bp, human
gcccgaaccaaaggaggtag

SEQ ID NO: 126398 - DNA, 20 bp, human
gcgtgaccccggatgagaat

SEQ ID NO: 126399 - DNA, 20 bp, human
gtaggcccaggtcggcggcg

SEQ ID NO: 126400 - DNA, 20 bp, human
gcccggatgagaataggcag

SEQ ID NO: 126401 - DNA, 20 bp, human
gaaagggtggtgaagaacta

SEQ ID NO: 126402 - DNA, 20 bp, human
ggaaccaaaggaggtagtgg

SEQ ID NO: 126403 - DNA, 20 bp, human
gaacgcagcagtgtaggccc

SEQ ID NO: 126404 - DNA, 20 bp, human
gggggctgcaaggatataga

SEQ ID NO: 126405 - DNA, 20 bp, human
gggaggtagtggtggcccgt

SEQ ID NO: 126406 - DNA, 20 bp, human
ggcgggcggcaacctccatg

SEQ ID NO: 126407 - DNA, 20 bp, human
gacggggaccccagtgacag

SEQ ID NO: 126408 - DNA, 20 bp, human
gcgtggacgaggccgcatgg

SEQ ID NO: 126409 - DNA, 20 bp, human
gggctccacagaagagcgag

SEQ ID NO: 126410 - DNA, 20 bp, human
gtccacagaagagcgagcgg

SEQ ID NO: 126411 - DNA, 20 bp, human
gcccgcagggagcgcgttgt

SEQ ID NO: 126412 - DNA, 20 bp, human
ggccgccgctcgctcttctg

SEQ ID NO: 126413 - DNA, 20 bp, human
gggggtccccgtgcaaatgg

SEQ ID NO: 126414 - DNA, 20 bp, human
gacgcacggcgaggcctccc

SEQ ID NO: 126415 - DNA, 20 bp, human
gcggaggagcgaggacgcta

SEQ ID NO: 126416 - DNA, 20 bp, human
ggtacagcccgggcatccag

SEQ ID NO: 126417 - DNA, 20 bp, human
gccgtcggcgaagttgaaga

SEQ ID NO: 126418 - DNA, 20 bp, human
gtgcccgttggctgtgccag

SEQ ID NO: 126419 - DNA, 20 bp, human
gcgcggcccggggtgcccgt

SEQ ID NO: 126420 - DNA, 20 bp, human
ggcgcccctggcacagccaa

SEQ ID NO: 126421 - DNA, 20 bp, human
gtggaactggtgctgcgacg

SEQ ID NO: 126422 - DNA, 20 bp, human
gtacgcgcggctcttccacg

SEQ ID NO: 126423 - DNA, 20 bp, human
ggccgcgcggccgctctcag

SEQ ID NO: 126424 - DNA, 20 bp, human
ggcacagccaacgggcaccc

SEQ ID NO: 126425 - DNA, 20 bp, human
gagagccgcgcgtacagccc

SEQ ID NO: 126426 - DNA, 20 bp, human
gcgcgaactcataaataccg

SEQ ID NO: 126427 - DNA, 20 bp, human
gagccgggtcgggaccatcc

SEQ ID NO: 126428 - DNA, 20 bp, human
gaaagcgctggagagaaggg

SEQ ID NO: 126429 - DNA, 20 bp, human
ggaactcataaataccgggg

SEQ ID NO: 126430 - DNA, 20 bp, human
ggggcagccggcgcccccga

SEQ ID NO: 126431 - DNA, 20 bp, human
gcgcccccgagggtgagccg

SEQ ID NO: 126432 - DNA, 20 bp, human
gcgagggtgagccggggtcc

SEQ ID NO: 126433 - DNA, 20 bp, human
ggaaggctaaggatggagta

SEQ ID NO: 126434 - DNA, 20 bp, human
gtgggctctaaaggatctgg

SEQ ID NO: 126435 - DNA, 20 bp, human
gtggaatctcgggagtaggt

SEQ ID NO: 126436 - DNA, 20 bp, human
ggcgccagcgaagacaggta

SEQ ID NO: 126437 - DNA, 20 bp, human
gctccaggcccgcggcccag

SEQ ID NO: 126438 - DNA, 20 bp, human
ggaggggcgcacggtctcca

SEQ ID NO: 126439 - DNA, 20 bp, human
gccgcgggcctggagcgtcc

SEQ ID NO: 126440 - DNA, 20 bp, human
gtcccggcgccagcgaagac

SEQ ID NO: 126441 - DNA, 20 bp, human
gccagtggcacctcccggga

SEQ ID NO: 126442 - DNA, 20 bp, human
gtgggcgggcaccgacggag

SEQ ID NO: 126443 - DNA, 20 bp, human
gcaggtgccggcagccgctg

SEQ ID NO: 126444 - DNA, 20 bp, human
ggggcctgggcgggcaccga

SEQ ID NO: 126445 - DNA, 20 bp, human
gggagaggcgcggttcccac

SEQ ID NO: 126446 - DNA, 20 bp, human
gggcgcgggcgagagtgtgt

SEQ ID NO: 126447 - DNA, 20 bp, human
gctatggcccacaggtgacc

SEQ ID NO: 126448 - DNA, 20 bp, human
ggacccgcaacaggacagcc

SEQ ID NO: 126449 - DNA, 20 bp, human
gagggcgcagtgtgtaggaa

SEQ ID NO: 126450 - DNA, 20 bp, human
ggctgcagggcgcagtgtgt

SEQ ID NO: 126451 - DNA, 20 bp, human
gtgaccaggagacccgcaac

SEQ ID NO: 126452 - DNA, 20 bp, human
ggggtctcctggtcacctgt

SEQ ID NO: 126453 - DNA, 20 bp, human
gtctcccgcaggctgagatg

SEQ ID NO: 126454 - DNA, 20 bp, human
gaggacagccgggtgcgcct

SEQ ID NO: 126455 - DNA, 20 bp, human
gggcaggaccgcactcaccg

SEQ ID NO: 126456 - DNA, 20 bp, human
gcagttctagaacgttgctg

SEQ ID NO: 126457 - DNA, 20 bp, human
gagcgctcgggcgccatgtt

SEQ ID NO: 126458 - DNA, 20 bp, human
gcagctgacccagccaggaa

SEQ ID NO: 126459 - DNA, 20 bp, human
gggaggagaagcgcttaaag

SEQ ID NO: 126460 - DNA, 20 bp, human
ggcgccatgttaggacgaag

SEQ ID NO: 126461 - DNA, 20 bp, human
ggggagaggggttggaccca

SEQ ID NO: 126462 - DNA, 20 bp, human
gggagaagcgcttaaagcgg

SEQ ID NO: 126463 - DNA, 20 bp, human
gcagcacacggggggaagtg

SEQ ID NO: 126464 - DNA, 20 bp, human
gcgggaacccagcacacggg

SEQ ID NO: 126465 - DNA, 20 bp, human
ggttaggacgaaggggaagg

SEQ ID NO: 126466 - DNA, 20 bp, human
gatggcgccagacccctcag

SEQ ID NO: 126467 - DNA, 20 bp, human
gggaggagaagctcctgaag

SEQ ID NO: 126468 - DNA, 20 bp, human
gcccttcggggtcttcgaag

SEQ ID NO: 126469 - DNA, 20 bp, human
ggcgcccgcgcgtgtacggt

SEQ ID NO: 126470 - DNA, 20 bp, human
gacgcagccgctgaggggtc

SEQ ID NO: 126471 - DNA, 20 bp, human
gggggtctggcgccatgttg

SEQ ID NO: 126472 - DNA, 20 bp, human
gtgggagtggggtcggacca

SEQ ID NO: 126473 - DNA, 20 bp, human
gtggggaccgctagactgat

SEQ ID NO: 126474 - DNA, 20 bp, human
gttcagcgcccgccccgcca

SEQ ID NO: 126475 - DNA, 20 bp, human
gccgctgaggcggaagggca

SEQ ID NO: 126476 - DNA, 20 bp, human
ggctcccggccggtccgcaa

SEQ ID NO: 126477 - DNA, 20 bp, human
ggcacctcccctaaacccgg

SEQ ID NO: 126478 - DNA, 20 bp, human
gagcgcggccgacgccaata

SEQ ID NO: 126479 - DNA, 20 bp, human
ggtgcagggcgcaagggaca

SEQ ID NO: 126480 - DNA, 20 bp, human
gctgggaagcggcgccatat

SEQ ID NO: 126481 - DNA, 20 bp, human
gccgaggacgccctcagaaa

SEQ ID NO: 126482 - DNA, 20 bp, human
gggtgagccgccgggtttag

SEQ ID NO: 126483 - DNA, 20 bp, human
gtgtctgcgtaagtggtggg

SEQ ID NO: 126484 - DNA, 20 bp, human
ggagccgccgggtttagggg

SEQ ID NO: 126485 - DNA, 20 bp, human
gagaggtgcctgtgtccgta

SEQ ID NO: 126486 - DNA, 20 bp, human
gtcagcggatcagtcttaag

SEQ ID NO: 126487 - DNA, 20 bp, human
ggagttgggtgctgcacctg

SEQ ID NO: 126488 - DNA, 20 bp, human
gagctgttaggggaaaaata

SEQ ID NO: 126489 - DNA, 20 bp, human
gaggggggctcgcccaagaa

SEQ ID NO: 126490 - DNA, 20 bp, human
gggacatgcggctctggagt

SEQ ID NO: 126491 - DNA, 20 bp, human
ggaagaagcgaagaaagtcg

SEQ ID NO: 126492 - DNA, 20 bp, human
gtcgcttcttcacccttctt

SEQ ID NO: 126493 - DNA, 20 bp, human
ggcgccgaggctcccaaagc

SEQ ID NO: 126494 - DNA, 20 bp, human
ggagtggagcacacaccttg

SEQ ID NO: 126495 - DNA, 20 bp, human
ggccacctgcgccacccggg

SEQ ID NO: 126496 - DNA, 20 bp, human
ggggagcctgacccttggat

SEQ ID NO: 126497 - DNA, 20 bp, human
gggaaaccctgaaccccact

SEQ ID NO: 126498 - DNA, 20 bp, human
gatgactctctctcttgagt

SEQ ID NO: 126499 - DNA, 20 bp, human
gtgggacgcagccctgtaag

SEQ ID NO: 126500 - DNA, 20 bp, human
ggagagagagtcatgcccag

SEQ ID NO: 126501 - DNA, 20 bp, human
gaagtacacacccgagaaaa

SEQ ID NO: 126502 - DNA, 20 bp, human
gccaagcccacgagtatcaa

SEQ ID NO: 126503 - DNA, 20 bp, human
gtgggaacaatgatgctaaa

SEQ ID NO: 126504 - DNA, 20 bp, human
gtcagtcagcagacatgcta

SEQ ID NO: 126505 - DNA, 20 bp, human
gttgttcccatccaagggtc

SEQ ID NO: 126506 - DNA, 20 bp, human
gctcccggcgcagagaaccc

SEQ ID NO: 126507 - DNA, 20 bp, human
gctccgggtgctgaaacctg

SEQ ID NO: 126508 - DNA, 20 bp, human
gccgggagggtagcaagagg

SEQ ID NO: 126509 - DNA, 20 bp, human
gccgcggtcatggagatccc

SEQ ID NO: 126510 - DNA, 20 bp, human
gggtccgagccaccgttcgt

SEQ ID NO: 126511 - DNA, 20 bp, human
ggcgccgggagggtagcaag

SEQ ID NO: 126512 - DNA, 20 bp, human
gtcagcaagcgccagttcac

SEQ ID NO: 126513 - DNA, 20 bp, human
gggcgcttgctgaaacctcc

SEQ ID NO: 126514 - DNA, 20 bp, human
gcctggaaggatggatgcgg

SEQ ID NO: 126515 - DNA, 20 bp, human
gaaacctgggccaaccgcac

SEQ ID NO: 126516 - DNA, 20 bp, human
gtcccgggagcagagaccga

SEQ ID NO: 126517 - DNA, 20 bp, human
gagaccgaaggacgcaggga

SEQ ID NO: 126518 - DNA, 20 bp, human
gccgaaggacgcagggacgg

SEQ ID NO: 126519 - DNA, 20 bp, human
ggcagagaccgaaggacgca

SEQ ID NO: 126520 - DNA, 20 bp, human
gcagcggctgccggactccc

SEQ ID NO: 126521 - DNA, 20 bp, human
gcccacttgagaagctcggg

SEQ ID NO: 126522 - DNA, 20 bp, human
gaagctcgggaggtctctcg

SEQ ID NO: 126523 - DNA, 20 bp, human
gcgggtctggaagagctctt

SEQ ID NO: 126524 - DNA, 20 bp, human
gctggtcctggatctagatc

SEQ ID NO: 126525 - DNA, 20 bp, human
gggctgccggactcccggga

SEQ ID NO: 126526 - DNA, 20 bp, human
gcgcggcgcgctgacgtcag

SEQ ID NO: 126527 - DNA, 20 bp, human
gggggcggcgaggaaatgat

SEQ ID NO: 126528 - DNA, 20 bp, human
gcccggctctgcgctcacac

SEQ ID NO: 126529 - DNA, 20 bp, human
gggtagccgtcggtgatgta

SEQ ID NO: 126530 - DNA, 20 bp, human
gaagggggaccagacaaaaa

SEQ ID NO: 126531 - DNA, 20 bp, human
gggctgtgtatcaaaaggta

SEQ ID NO: 126532 - DNA, 20 bp, human
gtgagagaagggggcactcc

SEQ ID NO: 126533 - DNA, 20 bp, human
ggagaagggggcactccagg

SEQ ID NO: 126534 - DNA, 20 bp, human
gggcgcgctgacgtcagagg

SEQ ID NO: 126535 - DNA, 20 bp, human
ggcgctgccgctgctgccca

SEQ ID NO: 126536 - DNA, 20 bp, human
gccgcagggacagctcgcgg

SEQ ID NO: 126537 - DNA, 20 bp, human
gtagtctctctgcagccagg

SEQ ID NO: 126538 - DNA, 20 bp, human
gggtaccggcccgccagcag

SEQ ID NO: 126539 - DNA, 20 bp, human
gcgagcgcagggcgatgggt

SEQ ID NO: 126540 - DNA, 20 bp, human
gcggcgggaactaggagcct

SEQ ID NO: 126541 - DNA, 20 bp, human
gcagggacagctcgcggcgg

SEQ ID NO: 126542 - DNA, 20 bp, human
gtattgaactgcaggtgcgg

SEQ ID NO: 126543 - DNA, 20 bp, human
gactgcggtcggctccgcca

SEQ ID NO: 126544 - DNA, 20 bp, human
ggggccgcgcctgctggact

SEQ ID NO: 126545 - DNA, 20 bp, human
gcaggtagaagaggctgcgc

SEQ ID NO: 126546 - DNA, 20 bp, human
gtgcagggcccgcgagtccg

SEQ ID NO: 126547 - DNA, 20 bp, human
ggcagcccgggaggagtgtc

SEQ ID NO: 126548 - DNA, 20 bp, human
ggcggtggaggaaggataag

SEQ ID NO: 126549 - DNA, 20 bp, human
gctcgggagtccagtggaca

SEQ ID NO: 126550 - DNA, 20 bp, human
gcaggctcaacgggctccac

SEQ ID NO: 126551 - DNA, 20 bp, human
gggctctctgctgcaatcga

SEQ ID NO: 126552 - DNA, 20 bp, human
ggtaggcgcggcgacccgca

SEQ ID NO: 126553 - DNA, 20 bp, human
gctgtgcagccccaatccaa

SEQ ID NO: 126554 - DNA, 20 bp, human
gcccagacccgccctcggag

SEQ ID NO: 126555 - DNA, 20 bp, human
gtgcggcgaccccggactcg

SEQ ID NO: 126556 - DNA, 20 bp, human
gcaacaggcccagggctcca

SEQ ID NO: 126557 - DNA, 20 bp, human
ggctccacgggcggagtcca

SEQ ID NO: 126558 - DNA, 20 bp, human
ggtgggtgctcctaagctgg

SEQ ID NO: 126559 - DNA, 20 bp, human
gtggtgggtcaacaggccca

SEQ ID NO: 126560 - DNA, 20 bp, human
gctaagggaaggcaccgtga

SEQ ID NO: 126561 - DNA, 20 bp, human
gagcgagcaagggataccct

SEQ ID NO: 126562 - DNA, 20 bp, human
gcctaagctggtgggtcaac

SEQ ID NO: 126563 - DNA, 20 bp, human
gcagccttggactccgcccg

SEQ ID NO: 126564 - DNA, 20 bp, human
gaggagtgaggaatacgctg

SEQ ID NO: 126565 - DNA, 20 bp, human
gtgctggggtgcagggacta

SEQ ID NO: 126566 - DNA, 20 bp, human
gggtagcccgcatagatgta

SEQ ID NO: 126567 - DNA, 20 bp, human
ggtgcgtaggccaggacgga

SEQ ID NO: 126568 - DNA, 20 bp, human
gagaagagctggatcatccg

SEQ ID NO: 126569 - DNA, 20 bp, human
gaaccagcgctcgggcatga

SEQ ID NO: 126570 - DNA, 20 bp, human
gcagcagaaagaagaccacc

SEQ ID NO: 126571 - DNA, 20 bp, human
ggtggccctgcccgaagaca

SEQ ID NO: 126572 - DNA, 20 bp, human
gtgccagggaaccagcgctc

SEQ ID NO: 126573 - DNA, 20 bp, human
gcaggaaagccaggcgagaa

SEQ ID NO: 126574 - DNA, 20 bp, human
gctctaccacaagtgccagg

SEQ ID NO: 126575 - DNA, 20 bp, human
gacggcttccagaagagcgg

SEQ ID NO: 126576 - DNA, 20 bp, human
gggagccctggagctctgaa

SEQ ID NO: 126577 - DNA, 20 bp, human
gccggccacgagcttcccgc

SEQ ID NO: 126578 - DNA, 20 bp, human
gcgcggtcacagccacccgc

SEQ ID NO: 126579 - DNA, 20 bp, human
ggccacccgcgggaagctcg

SEQ ID NO: 126580 - DNA, 20 bp, human
ggccacgagcttcccgcggg

SEQ ID NO: 126581 - DNA, 20 bp, human
gacagccgttcagagctcca

SEQ ID NO: 126582 - DNA, 20 bp, human
ggctctgaacggctgtagtg

SEQ ID NO: 126583 - DNA, 20 bp, human
gctcccgcggcgggactcac

SEQ ID NO: 126584 - DNA, 20 bp, human
gctgcgatgctggggagtca

SEQ ID NO: 126585 - DNA, 20 bp, human
gagattcaggaccaagacgt

SEQ ID NO: 126586 - DNA, 20 bp, human
gggccgcgcgccggtagcag

SEQ ID NO: 126587 - DNA, 20 bp, human
gaccgaggctaggcactcct

SEQ ID NO: 126588 - DNA, 20 bp, human
gggccgtgcacggcagacgc

SEQ ID NO: 126589 - DNA, 20 bp, human
gagcactccacgaagtcgtc

SEQ ID NO: 126590 - DNA, 20 bp, human
gctcgccaagcccctgctac

SEQ ID NO: 126591 - DNA, 20 bp, human
gcagacgccggtagcccgac

SEQ ID NO: 126592 - DNA, 20 bp, human
gggcactcctgggccgtgca

SEQ ID NO: 126593 - DNA, 20 bp, human
ggtgggcacaaaggctccga

SEQ ID NO: 126594 - DNA, 20 bp, human
gtcccgggaggcggcagagt

SEQ ID NO: 126595 - DNA, 20 bp, human
ggctgcgaccgccaggagcg

SEQ ID NO: 126596 - DNA, 20 bp, human
gtaccggaaggccatcgcca

SEQ ID NO: 126597 - DNA, 20 bp, human
ggacggcgccgggatcaata

SEQ ID NO: 126598 - DNA, 20 bp, human
gcagcctccggccacctgtt

SEQ ID NO: 126599 - DNA, 20 bp, human
gcgcgcgcccgagtccccag

SEQ ID NO: 126600 - DNA, 20 bp, human
gaggccatcgccaaggtgag

SEQ ID NO: 126601 - DNA, 20 bp, human
gacgccgaacaggtggccgg

SEQ ID NO: 126602 - DNA, 20 bp, human
gcgccgcgacgccgaacagg

SEQ ID NO: 126603 - DNA, 20 bp, human
ggtcgcggcgcgctcgccgg

SEQ ID NO: 126604 - DNA, 20 bp, human
ggcggtgacccgctaccgga

SEQ ID NO: 126605 - DNA, 20 bp, human
gggccacctgttcggcgtcg

SEQ ID NO: 126606 - DNA, 20 bp, human
gcggcgcacggggccagagt

SEQ ID NO: 126607 - DNA, 20 bp, human
ggggtgggcccagagacccg

SEQ ID NO: 126608 - DNA, 20 bp, human
gcgggcgccgcagaggagtt

SEQ ID NO: 126609 - DNA, 20 bp, human
gcagggccggccccaagccg

SEQ ID NO: 126610 - DNA, 20 bp, human
gcccgggcgtcctccgagag

SEQ ID NO: 126611 - DNA, 20 bp, human
gaacaggtgtctgaccccgc

SEQ ID NO: 126612 - DNA, 20 bp, human
gccggctcccaactcctctg

SEQ ID NO: 126613 - DNA, 20 bp, human
gggaacaccctgaggcccgg

SEQ ID NO: 126614 - DNA, 20 bp, human
gcgggcgcagcccccactct

SEQ ID NO: 126615 - DNA, 20 bp, human
ggcctgggccgggcaggagt

SEQ ID NO: 126616 - DNA, 20 bp, human
gggcaggaatgggaaagatg

SEQ ID NO: 126617 - DNA, 20 bp, human
gccagcctgcggtgagaaag

SEQ ID NO: 126618 - DNA, 20 bp, human
gtgccccaggcggcccgccg

SEQ ID NO: 126619 - DNA, 20 bp, human
gcttaaggctgccgcaaaag

SEQ ID NO: 126620 - DNA, 20 bp, human
gtgcgcgccggagtcctctg

SEQ ID NO: 126621 - DNA, 20 bp, human
gccggggacggtgccccagg

SEQ ID NO: 126622 - DNA, 20 bp, human
gctgtgcacctgcgcctcgg

SEQ ID NO: 126623 - DNA, 20 bp, human
ggggcgtgtgctaccgccag

SEQ ID NO: 126624 - DNA, 20 bp, human
ggcccggccgcagaggactc

SEQ ID NO: 126625 - DNA, 20 bp, human
gggcgtcaaactggaagtcg

SEQ ID NO: 126626 - DNA, 20 bp, human
ggctcacacggcgggaccga

SEQ ID NO: 126627 - DNA, 20 bp, human
gggcccgggcgcctcctcac

SEQ ID NO: 126628 - DNA, 20 bp, human
gacacggcgggaccgagggt

SEQ ID NO: 126629 - DNA, 20 bp, human
gccgcaccgtccagaccccg

SEQ ID NO: 126630 - DNA, 20 bp, human
gggaccgagggtcggactgg

SEQ ID NO: 126631 - DNA, 20 bp, human
ggcgggaccgagggtcggac

SEQ ID NO: 126632 - DNA, 20 bp, human
gcggtgcggtcgggagactg

SEQ ID NO: 126633 - DNA, 20 bp, human
ggcgccaccagtccgaccct

SEQ ID NO: 126634 - DNA, 20 bp, human
gggctgcctgggcactatgg

SEQ ID NO: 126635 - DNA, 20 bp, human
gagctgccccggggtctgga

SEQ ID NO: 126636 - DNA, 20 bp, human
gcgcgcctcagggactccag

SEQ ID NO: 126637 - DNA, 20 bp, human
gcagctcgggcccgcagcac

SEQ ID NO: 126638 - DNA, 20 bp, human
ggccgcagaaagactcccgg

SEQ ID NO: 126639 - DNA, 20 bp, human
ggagggccatcggacagtcc

SEQ ID NO: 126640 - DNA, 20 bp, human
gcccgcgcggacacaaagcc

SEQ ID NO: 126641 - DNA, 20 bp, human
gcgtcgccctcgctcctcag

SEQ ID NO: 126642 - DNA, 20 bp, human
gcggcccgcgctcgcttggc

SEQ ID NO: 126643 - DNA, 20 bp, human
gccgccggccaagcgagcgc

SEQ ID NO: 126644 - DNA, 20 bp, human
gctgcgggcccgagctgggc

SEQ ID NO: 126645 - DNA, 20 bp, human
gctccgcgggacgcgcactg

SEQ ID NO: 126646 - DNA, 20 bp, human
gagacacagggcccataaac

SEQ ID NO: 126647 - DNA, 20 bp, human
gcctagtagaatgtctctaa

SEQ ID NO: 126648 - DNA, 20 bp, human
gatgcaaaatgcttgcttcc

SEQ ID NO: 126649 - DNA, 20 bp, human
gaccatgcttgcctgtttat

SEQ ID NO: 126650 - DNA, 20 bp, human
gttgtacccagtggaagatg

SEQ ID NO: 126651 - DNA, 20 bp, human
gtgcttcctggcactaagga

SEQ ID NO: 126652 - DNA, 20 bp, human
gctttgaaagaggagacaca

SEQ ID NO: 126653 - DNA, 20 bp, human
gagtctgaatgagctcccac

SEQ ID NO: 126654 - DNA, 20 bp, human
gtgcttgcttcctggcacta

SEQ ID NO: 126655 - DNA, 20 bp, human
gttttggtcttaatagactc

SEQ ID NO: 126656 - DNA, 20 bp, human
gacccaggagagccgctggt

SEQ ID NO: 126657 - DNA, 20 bp, human
gaacaggcccatgcgcgcag

SEQ ID NO: 126658 - DNA, 20 bp, human
gtcccaccagcggctctcct

SEQ ID NO: 126659 - DNA, 20 bp, human
ggaccgcgaacgaggagcgg

SEQ ID NO: 126660 - DNA, 20 bp, human
gggcctggaggatttaaccc

SEQ ID NO: 126661 - DNA, 20 bp, human
gaaccggccagtgaggtgag

SEQ ID NO: 126662 - DNA, 20 bp, human
ggcaccacaaccggccagtg

SEQ ID NO: 126663 - DNA, 20 bp, human
gctggcgccgctgcgcgcat

SEQ ID NO: 126664 - DNA, 20 bp, human
gggcggcggggcgaaggtga

SEQ ID NO: 126665 - DNA, 20 bp, human
gggcgcagagaggctgtacc

SEQ ID NO: 126666 - DNA, 20 bp, human
gtccatgccggcgagaggtt

SEQ ID NO: 126667 - DNA, 20 bp, human
ggtaccactcaccccacacc

SEQ ID NO: 126668 - DNA, 20 bp, human
gccagcgacagggcccgact

SEQ ID NO: 126669 - DNA, 20 bp, human
gtggggtgagtggtacccaa

SEQ ID NO: 126670 - DNA, 20 bp, human
gcaacgacagcagctcaacg

SEQ ID NO: 126671 - DNA, 20 bp, human
gactgggaggccggaagcga

SEQ ID NO: 126672 - DNA, 20 bp, human
gtgactgaccgccagcgtgg

SEQ ID NO: 126673 - DNA, 20 bp, human
gcgcggcgccccggcccgtt

SEQ ID NO: 126674 - DNA, 20 bp, human
gcgtgagtctgcgcagtgtg

SEQ ID NO: 126675 - DNA, 20 bp, human
ggcgacagggcccgactggg

SEQ ID NO: 126676 - DNA, 20 bp, human
gtggtaaggtcgggccatgg

SEQ ID NO: 126677 - DNA, 20 bp, human
gagctggggttggtaaggtc

SEQ ID NO: 126678 - DNA, 20 bp, human
gtctggccgtgtatcctcgg

SEQ ID NO: 126679 - DNA, 20 bp, human
gctccgcccccgaggataca

SEQ ID NO: 126680 - DNA, 20 bp, human
gggaaggacgtgactggaag

SEQ ID NO: 126681 - DNA, 20 bp, human
gccattgggaaggacgtgac

SEQ ID NO: 126682 - DNA, 20 bp, human
gttgggaagatggcgtggcg

SEQ ID NO: 126683 - DNA, 20 bp, human
gcactcgcgattatgaagtg

SEQ ID NO: 126684 - DNA, 20 bp, human
gggaagtagttgcgcagctg

SEQ ID NO: 126685 - DNA, 20 bp, human
gtggaaggggaactaagctg

SEQ ID NO: 126686 - DNA, 20 bp, human
gaagagcgcggagcaccgga

SEQ ID NO: 126687 - DNA, 20 bp, human
gcgcgaacagctccagtgga

SEQ ID NO: 126688 - DNA, 20 bp, human
gggagggcgcgaggcaaacg

SEQ ID NO: 126689 - DNA, 20 bp, human
gccggagggcacgcagctga

SEQ ID NO: 126690 - DNA, 20 bp, human
ggcagaagagcgcggagcac

SEQ ID NO: 126691 - DNA, 20 bp, human
gtggcgccatcctcccggaa

SEQ ID NO: 126692 - DNA, 20 bp, human
gtacggttcgggaccgccaa

SEQ ID NO: 126693 - DNA, 20 bp, human
gcacctgcgcactcacccgg

SEQ ID NO: 126694 - DNA, 20 bp, human
gcccgaaccgtactgaggga

SEQ ID NO: 126695 - DNA, 20 bp, human
ggcggtcccgaaccgtactg

SEQ ID NO: 126696 - DNA, 20 bp, human
ggtcccggaggtgtgcaccg

SEQ ID NO: 126697 - DNA, 20 bp, human
gcccggcccggagaaggaca

SEQ ID NO: 126698 - DNA, 20 bp, human
gtcggcgagtagaaccgctg

SEQ ID NO: 126699 - DNA, 20 bp, human
ggcggccggcgtcaccgctg

SEQ ID NO: 126700 - DNA, 20 bp, human
gaggagggaaaagccctgag

SEQ ID NO: 126701 - DNA, 20 bp, human
gccgcagtcgccgcggaatt

SEQ ID NO: 126702 - DNA, 20 bp, human
ggccggaaggggaaaagtcc

SEQ ID NO: 126703 - DNA, 20 bp, human
gcgaggggtgcatgggtcag

SEQ ID NO: 126704 - DNA, 20 bp, human
gaagtcctcgaggggtgcat

SEQ ID NO: 126705 - DNA, 20 bp, human
gagctcccgaggctgagagc

SEQ ID NO: 126706 - DNA, 20 bp, human
gcgtgcgctcacccagccgc

SEQ ID NO: 126707 - DNA, 20 bp, human
ggcaatctatcagggaacgg

SEQ ID NO: 126708 - DNA, 20 bp, human
gccgggccgctcgggaggag

SEQ ID NO: 126709 - DNA, 20 bp, human
ggccggtgcggcgtgttcgg

SEQ ID NO: 126710 - DNA, 20 bp, human
gggtgcggcgtgttcggtgg

SEQ ID NO: 126711 - DNA, 20 bp, human
gtgggtgagcgcacgcgagg

SEQ ID NO: 126712 - DNA, 20 bp, human
gctggccgctcaggcgcctg

SEQ ID NO: 126713 - DNA, 20 bp, human
ggcagcgtgtttctaggtcg

SEQ ID NO: 126714 - DNA, 20 bp, human
gatctatcagggaacggcgg

SEQ ID NO: 126715 - DNA, 20 bp, human
ggtcggccgggccgctcggg

SEQ ID NO: 126716 - DNA, 20 bp, human
gcagggttaggcttgctgag

SEQ ID NO: 126717 - DNA, 20 bp, human
gaggggcggggcaggatgtc

SEQ ID NO: 126718 - DNA, 20 bp, human
ggtggccgctaggcagcctc

SEQ ID NO: 126719 - DNA, 20 bp, human
gagaccctctcggcgtctgt

SEQ ID NO: 126720 - DNA, 20 bp, human
gtacattccccgtggccgct

SEQ ID NO: 126721 - DNA, 20 bp, human
gcccagggttgcaatggcgg

SEQ ID NO: 126722 - DNA, 20 bp, human
gccccgtcccagggttgcaa

SEQ ID NO: 126723 - DNA, 20 bp, human
gcgtcccagggttgcaatgg

SEQ ID NO: 126724 - DNA, 20 bp, human
ggtctctgccagctcaacac

SEQ ID NO: 126725 - DNA, 20 bp, human
gctgcccacagacgccgaga

SEQ ID NO: 126726 - DNA, 20 bp, human
ggtccccgggagcgaaggga

SEQ ID NO: 126727 - DNA, 20 bp, human
ggatgaggctgaaacatcac

SEQ ID NO: 126728 - DNA, 20 bp, human
ggcgggtccccgggagcgaa

SEQ ID NO: 126729 - DNA, 20 bp, human
gaggaggaaggccttcgtaa

SEQ ID NO: 126730 - DNA, 20 bp, human
gcgctggcttgtgacaggga

SEQ ID NO: 126731 - DNA, 20 bp, human
gtaaacgctggcttgtgaca

SEQ ID NO: 126732 - DNA, 20 bp, human
ggtcccgcccggctactcac

SEQ ID NO: 126733 - DNA, 20 bp, human
gggattcgcttcccacataa

SEQ ID NO: 126734 - DNA, 20 bp, human
gaacaaatggtgaagggatg

SEQ ID NO: 126735 - DNA, 20 bp, human
gtaacggtgacaaaatcgag

SEQ ID NO: 126736 - DNA, 20 bp, human
gcgcagctcgggcaactcca

SEQ ID NO: 126737 - DNA, 20 bp, human
gagttcctgagagccgggta

SEQ ID NO: 126738 - DNA, 20 bp, human
ggaatgacggtgcgaggtca

SEQ ID NO: 126739 - DNA, 20 bp, human
gggcgccgcgccgggagcga

SEQ ID NO: 126740 - DNA, 20 bp, human
ggcgggctggaagtgcgtga

SEQ ID NO: 126741 - DNA, 20 bp, human
ggagggactcagggtcgagt

SEQ ID NO: 126742 - DNA, 20 bp, human
gtggcccaggccggcgtcgt

SEQ ID NO: 126743 - DNA, 20 bp, human
gtctgcaggttcatggtcta

SEQ ID NO: 126744 - DNA, 20 bp, human
gggtcctctagacgcctggg

SEQ ID NO: 126745 - DNA, 20 bp, human
ggcgccacccgcggtccgac

SEQ ID NO: 126746 - DNA, 20 bp, human
ggctctccgccggactgcag

SEQ ID NO: 126747 - DNA, 20 bp, human
gcgcggcccctgcagtccgg

SEQ ID NO: 126748 - DNA, 20 bp, human
gtaatggcgcggcccggagg

SEQ ID NO: 126749 - DNA, 20 bp, human
gccctcgaccagcagcggga

SEQ ID NO: 126750 - DNA, 20 bp, human
gaggagccctcgaccagcag

SEQ ID NO: 126751 - DNA, 20 bp, human
gaccagcagcgggaaggagc

SEQ ID NO: 126752 - DNA, 20 bp, human
gaaagttagcggcccggagt

SEQ ID NO: 126753 - DNA, 20 bp, human
gtccagagcccgaagaggtc

SEQ ID NO: 126754 - DNA, 20 bp, human
gtggattccgagcgcacccg

SEQ ID NO: 126755 - DNA, 20 bp, human
ggaacaccaggaagcgggat

SEQ ID NO: 126756 - DNA, 20 bp, human
gagtcccagcgagctgagga

SEQ ID NO: 126757 - DNA, 20 bp, human
gctgccggccgggaaccgtg

SEQ ID NO: 126758 - DNA, 20 bp, human
gagtatggtgaggagcgcgg

SEQ ID NO: 126759 - DNA, 20 bp, human
gttcgaggcacaagcctgtt

SEQ ID NO: 126760 - DNA, 20 bp, human
gctcctcaccatactccggg

SEQ ID NO: 126761 - DNA, 20 bp, human
gccgtgcataagttctctgg

SEQ ID NO: 126762 - DNA, 20 bp, human
gagagccggacgagatcggg

SEQ ID NO: 126763 - DNA, 20 bp, human
gttccctgttccggaagagg

SEQ ID NO: 126764 - DNA, 20 bp, human
gctcccggcgctcttcctcc

SEQ ID NO: 126765 - DNA, 20 bp, human
ggcgctcctcaccatactcc

SEQ ID NO: 126766 - DNA, 20 bp, human
gctcgcccgtcgcggagagt

SEQ ID NO: 126767 - DNA, 20 bp, human
ggcagcagcctcgcccgtcg

SEQ ID NO: 126768 - DNA, 20 bp, human
gtctgcccgccgtcccccgg

SEQ ID NO: 126769 - DNA, 20 bp, human
gcggcaacgcgcagtgacct

SEQ ID NO: 126770 - DNA, 20 bp, human
ggcagcccccgggggacggc

SEQ ID NO: 126771 - DNA, 20 bp, human
gcagagcccactctccgcga

SEQ ID NO: 126772 - DNA, 20 bp, human
ggcgagaggcgggacttcgg

SEQ ID NO: 126773 - DNA, 20 bp, human
ggggtagacgcgctggttag

SEQ ID NO: 126774 - DNA, 20 bp, human
gacgcgctggttaggggcaa

SEQ ID NO: 126775 - DNA, 20 bp, human
gcgaggcctggaccgcgggt

SEQ ID NO: 126776 - DNA, 20 bp, human
gcataggccagacccacgca

SEQ ID NO: 126777 - DNA, 20 bp, human
gctggacacattgggattaa

SEQ ID NO: 126778 - DNA, 20 bp, human
ggtaacgctggctggcgcag

SEQ ID NO: 126779 - DNA, 20 bp, human
ggtgaggccggaaaccaact

SEQ ID NO: 126780 - DNA, 20 bp, human
gactctcgtggtgaatctca

SEQ ID NO: 126781 - DNA, 20 bp, human
gctgctactgctccgtgcgt

SEQ ID NO: 126782 - DNA, 20 bp, human
ggttttctttgataccgagg

SEQ ID NO: 126783 - DNA, 20 bp, human
gggtgttttctttgataccg

SEQ ID NO: 126784 - DNA, 20 bp, human
gtgcccgctcctgctgcggc

SEQ ID NO: 126785 - DNA, 20 bp, human
gtgaatctcagggttcttaa

SEQ ID NO: 126786 - DNA, 20 bp, human
gggcgacggagcaccggcgg

SEQ ID NO: 126787 - DNA, 20 bp, human
gcagcgttcgaattccatgg

SEQ ID NO: 126788 - DNA, 20 bp, human
gcgcggcggcgacggagcac

SEQ ID NO: 126789 - DNA, 20 bp, human
gggcggcgacggagcaccgg

SEQ ID NO: 126790 - DNA, 20 bp, human
ggaattccatggcggcgcgg

SEQ ID NO: 126791 - DNA, 20 bp, human
gcgtcagcgttcgaattcca

SEQ ID NO: 126792 - DNA, 20 bp, human
gcggagcaccggcggcggca

SEQ ID NO: 126793 - DNA, 20 bp, human
gggagctcaatatcgcggga

SEQ ID NO: 126794 - DNA, 20 bp, human
gggcccgcgattccttggag

SEQ ID NO: 126795 - DNA, 20 bp, human
gggttcggagctcaatatcg

SEQ ID NO: 126796 - DNA, 20 bp, human
gggccacatgagcagcgcta

SEQ ID NO: 126797 - DNA, 20 bp, human
gctgccgtgggcaggaccat

SEQ ID NO: 126798 - DNA, 20 bp, human
ggtggccttgaactgataga

SEQ ID NO: 126799 - DNA, 20 bp, human
gagccagaactccggatcag

SEQ ID NO: 126800 - DNA, 20 bp, human
gagtcaggcgaccagtccca

SEQ ID NO: 126801 - DNA, 20 bp, human
gtctggcatatccaaggccg

SEQ ID NO: 126802 - DNA, 20 bp, human
gcctacccctcaggacacac

SEQ ID NO: 126803 - DNA, 20 bp, human
gaggcgaccagtcccacgga

SEQ ID NO: 126804 - DNA, 20 bp, human
gcggcccggcaaccatgcca

SEQ ID NO: 126805 - DNA, 20 bp, human
gggaggctgcgtctgtatcc

SEQ ID NO: 126806 - DNA, 20 bp, human
gggagctagctggatcctct

SEQ ID NO: 126807 - DNA, 20 bp, human
gagcaaggagcgcggaatcg

SEQ ID NO: 126808 - DNA, 20 bp, human
gcgcccacgcacctgcctag

SEQ ID NO: 126809 - DNA, 20 bp, human
ggcagggagagcctagatta

SEQ ID NO: 126810 - DNA, 20 bp, human
ggcgctgctaggctcgggag

SEQ ID NO: 126811 - DNA, 20 bp, human
gatcctctaggcaggtgcgt

SEQ ID NO: 126812 - DNA, 20 bp, human
gcgcggaatcggggagcgtc

SEQ ID NO: 126813 - DNA, 20 bp, human
gtacggaagtaccgcgagca

SEQ ID NO: 126814 - DNA, 20 bp, human
ggtaccgcgagcaaggagcg

SEQ ID NO: 126815 - DNA, 20 bp, human
ggggagcgtccggagctagc

SEQ ID NO: 126816 - DNA, 20 bp, human
gctgatctggatgatcacag

SEQ ID NO: 126817 - DNA, 20 bp, human
gcctcaccccagggcaaccc

SEQ ID NO: 126818 - DNA, 20 bp, human
ggatagagagtgctagtgtg

SEQ ID NO: 126819 - DNA, 20 bp, human
gatcagaatgtaacctctgg

SEQ ID NO: 126820 - DNA, 20 bp, human
ggtccagcctgggttgccct

SEQ ID NO: 126821 - DNA, 20 bp, human
gatgtaacctctggtggcag

SEQ ID NO: 126822 - DNA, 20 bp, human
gaggcactaaatgtccagcc

SEQ ID NO: 126823 - DNA, 20 bp, human
ggtaggatgacggcagcgtt

SEQ ID NO: 126824 - DNA, 20 bp, human
gtatgttagaacatggtaag

SEQ ID NO: 126825 - DNA, 20 bp, human
gaaacagtcaagtgctgatc

SEQ ID NO: 126826 - DNA, 20 bp, human
gcagctgggcggtcacatct

SEQ ID NO: 126827 - DNA, 20 bp, human
ggagcgcgggagccaaaagg

SEQ ID NO: 126828 - DNA, 20 bp, human
gattgctctctggctgtccc

SEQ ID NO: 126829 - DNA, 20 bp, human
gctggtggctgcctcagact

SEQ ID NO: 126830 - DNA, 20 bp, human
ggcccgcgtggccggagcgg

SEQ ID NO: 126831 - DNA, 20 bp, human
ggacgtcgcggtcagaaaac

SEQ ID NO: 126832 - DNA, 20 bp, human
gcgttggtccgggcgggtga

SEQ ID NO: 126833 - DNA, 20 bp, human
ggttgcacgtccccattctg

SEQ ID NO: 126834 - DNA, 20 bp, human
gctggctgtccccggcacct

SEQ ID NO: 126835 - DNA, 20 bp, human
gtgcctcagacttggcggtg

SEQ ID NO: 126836 - DNA, 20 bp, human
gggcaccggacctactcacc

SEQ ID NO: 126837 - DNA, 20 bp, human
gcccggcaggccgctctcct

SEQ ID NO: 126838 - DNA, 20 bp, human
gctgtctgcaccgaggagag

SEQ ID NO: 126839 - DNA, 20 bp, human
gcctgccgggtgagtaggtc

SEQ ID NO: 126840 - DNA, 20 bp, human
gtcctcggtgcagacagcac

SEQ ID NO: 126841 - DNA, 20 bp, human
ggagtaggtccggtgcctct

SEQ ID NO: 126842 - DNA, 20 bp, human
gggctctgccgggaacaggg

SEQ ID NO: 126843 - DNA, 20 bp, human
gccggtgcctctgggccctc

SEQ ID NO: 126844 - DNA, 20 bp, human
ggaggcggacctgtgaacca

SEQ ID NO: 126845 - DNA, 20 bp, human
gaccgaggagagcggcctgc

SEQ ID NO: 126846 - DNA, 20 bp, human
ggcgagacttacgtgattag

SEQ ID NO: 126847 - DNA, 20 bp, human
gcgcgggagggcatcccgtt

SEQ ID NO: 126848 - DNA, 20 bp, human
ggctgtaactaatcaggagt

SEQ ID NO: 126849 - DNA, 20 bp, human
gcaagtcccaaaggttcctt

SEQ ID NO: 126850 - DNA, 20 bp, human
gtgggaggctgtaactaatc

SEQ ID NO: 126851 - DNA, 20 bp, human
ggtcccaaaggttccttggg

SEQ ID NO: 126852 - DNA, 20 bp, human
gtggagtccgtgtacatagt

SEQ ID NO: 126853 - DNA, 20 bp, human
gaggtttgaactgtattcag

SEQ ID NO: 126854 - DNA, 20 bp, human
ggttcgagtgcaagtcccaa

SEQ ID NO: 126855 - DNA, 20 bp, human
gcagcctcccaaggaacctt

SEQ ID NO: 126856 - DNA, 20 bp, human
gacggcggtggtcttgcggg

SEQ ID NO: 126857 - DNA, 20 bp, human
ggattgcggtaggtgaacgt

SEQ ID NO: 126858 - DNA, 20 bp, human
ggtggtcttgcgggaggcgt

SEQ ID NO: 126859 - DNA, 20 bp, human
ggcgcccgtccctcaggtct

SEQ ID NO: 126860 - DNA, 20 bp, human
gaggtccggggcgaagtgag

SEQ ID NO: 126861 - DNA, 20 bp, human
gcgtgggctgggattgcggt

SEQ ID NO: 126862 - DNA, 20 bp, human
gagggtcaccgagcgagtga

SEQ ID NO: 126863 - DNA, 20 bp, human
gggcacggcggtggtcttgc

SEQ ID NO: 126864 - DNA, 20 bp, human
ggggtgactcccagacctga

SEQ ID NO: 126865 - DNA, 20 bp, human
gtggagaaaacggaggtccg

SEQ ID NO: 126866 - DNA, 20 bp, human
gcgagccccgggctcagtgt

SEQ ID NO: 126867 - DNA, 20 bp, human
gaggctgccgcgggccggtc

SEQ ID NO: 126868 - DNA, 20 bp, human
gtggcgctgggcggacgcag

SEQ ID NO: 126869 - DNA, 20 bp, human
gcgcgcttcccgggtacgtc

SEQ ID NO: 126870 - DNA, 20 bp, human
ggctcctgcccgacgtaccc

SEQ ID NO: 126871 - DNA, 20 bp, human
gcccggcccctcggccccta

SEQ ID NO: 126872 - DNA, 20 bp, human
gacttgggagtgggagactt

SEQ ID NO: 126873 - DNA, 20 bp, human
gtcgatggcccgcgagcccc

SEQ ID NO: 126874 - DNA, 20 bp, human
ggaaggcgacttctgcgggg

SEQ ID NO: 126875 - DNA, 20 bp, human
gggcgggcggtaggagccgg

SEQ ID NO: 126876 - DNA, 20 bp, human
gagcgcggcgcggaggacat

SEQ ID NO: 126877 - DNA, 20 bp, human
gcagggaagagctgaacacc

SEQ ID NO: 126878 - DNA, 20 bp, human
ggaagagctgaacacccggc

SEQ ID NO: 126879 - DNA, 20 bp, human
ggaggacatgggccgcgcgt

SEQ ID NO: 126880 - DNA, 20 bp, human
ggcctctccccggggcgacc

SEQ ID NO: 126881 - DNA, 20 bp, human
gtggctatgccgctggccca

SEQ ID NO: 126882 - DNA, 20 bp, human
gtcggccctagagccccacg

SEQ ID NO: 126883 - DNA, 20 bp, human
gacgcgcgtttggcagactc

SEQ ID NO: 126884 - DNA, 20 bp, human
gcatgggccgcgcgtggggc

SEQ ID NO: 126885 - DNA, 20 bp, human
gacccaggacccgtaaacaa

SEQ ID NO: 126886 - DNA, 20 bp, human
gtgcagccgagagtccaggt

SEQ ID NO: 126887 - DNA, 20 bp, human
ggttggctgaagttcagagg

SEQ ID NO: 126888 - DNA, 20 bp, human
gcacctggagacggaggggt

SEQ ID NO: 126889 - DNA, 20 bp, human
gagactcctacctggactct

SEQ ID NO: 126890 - DNA, 20 bp, human
gtcttcacctggagacggag

SEQ ID NO: 126891 - DNA, 20 bp, human
gctcgggccctgccgcagag

SEQ ID NO: 126892 - DNA, 20 bp, human
gcacgcaggagactcctacc

SEQ ID NO: 126893 - DNA, 20 bp, human
gtcctgcgtggtcccgggag

SEQ ID NO: 126894 - DNA, 20 bp, human
gcatgcatcaggaccagaga

SEQ ID NO: 126895 - DNA, 20 bp, human
gagtctgcagccgagagtcc

SEQ ID NO: 126896 - DNA, 20 bp, human
ggagagcccgggagcctggt

SEQ ID NO: 126897 - DNA, 20 bp, human
gctcaccggagaccacaggg

SEQ ID NO: 126898 - DNA, 20 bp, human
gcaggctcccgggctctcac

SEQ ID NO: 126899 - DNA, 20 bp, human
gatcgtaggtgcaccatagg

SEQ ID NO: 126900 - DNA, 20 bp, human
gcagccaccgagggacaaag

SEQ ID NO: 126901 - DNA, 20 bp, human
gaccatcgtaggtgcaccat

SEQ ID NO: 126902 - DNA, 20 bp, human
gggctctcaccggagaccac

SEQ ID NO: 126903 - DNA, 20 bp, human
gaatcaatgggtgcctccta

SEQ ID NO: 126904 - DNA, 20 bp, human
gggtgggcgcccggaaagtc

SEQ ID NO: 126905 - DNA, 20 bp, human
ggaggaggttcagaatgtgg

SEQ ID NO: 126906 - DNA, 20 bp, human
gccaagccggctacacacca

SEQ ID NO: 126907 - DNA, 20 bp, human
gtctcacctggatcaggcga

SEQ ID NO: 126908 - DNA, 20 bp, human
gccgggcaggctacactgaa

SEQ ID NO: 126909 - DNA, 20 bp, human
gcaggtatctcacctggatc

SEQ ID NO: 126910 - DNA, 20 bp, human
ggtgggataaaagcgcggaa

SEQ ID NO: 126911 - DNA, 20 bp, human
ggcggaagggctcctttccg

SEQ ID NO: 126912 - DNA, 20 bp, human
gaagagagcgcagggtcccg

SEQ ID NO: 126913 - DNA, 20 bp, human
gggacccacacgcccagtgc

SEQ ID NO: 126914 - DNA, 20 bp, human
gcgtgaccctcgcctgatcc

SEQ ID NO: 126915 - DNA, 20 bp, human
gggcgagggtcacgccaagc

SEQ ID NO: 126916 - DNA, 20 bp, human
ggtgagtaggaatagataag

SEQ ID NO: 126917 - DNA, 20 bp, human
ggtgagagcacccatgacag

SEQ ID NO: 126918 - DNA, 20 bp, human
ggatggggagttccagcaag

SEQ ID NO: 126919 - DNA, 20 bp, human
gtggggacatgacatacccc

SEQ ID NO: 126920 - DNA, 20 bp, human
gctttaggggtgagtcccta

SEQ ID NO: 126921 - DNA, 20 bp, human
ggtgatccagataatgctgt

SEQ ID NO: 126922 - DNA, 20 bp, human
gatgacagaggccttctcat

SEQ ID NO: 126923 - DNA, 20 bp, human
gtcctgctctgctgctttag

SEQ ID NO: 126924 - DNA, 20 bp, human
gatagataagtggtatgaga

SEQ ID NO: 126925 - DNA, 20 bp, human
gcttaccagctgtcaaccct

SEQ ID NO: 126926 - DNA, 20 bp, human
gccaggacttaccccaatat

SEQ ID NO: 126927 - DNA, 20 bp, human
ggcatcctggagcttctgtc

SEQ ID NO: 126928 - DNA, 20 bp, human
gtgcacctgacagaagctcc

SEQ ID NO: 126929 - DNA, 20 bp, human
gggcaggaggcgaaacccct

SEQ ID NO: 126930 - DNA, 20 bp, human
gaaatcatcaggctagataa

SEQ ID NO: 126931 - DNA, 20 bp, human
gtgtgagactgtaacatgga

SEQ ID NO: 126932 - DNA, 20 bp, human
gaacaacttgctccttccac

SEQ ID NO: 126933 - DNA, 20 bp, human
ggcctccttactctaagaaa

SEQ ID NO: 126934 - DNA, 20 bp, human
gttgtccatttcttagagta

SEQ ID NO: 126935 - DNA, 20 bp, human
gagagacggacagatgctgg

SEQ ID NO: 126936 - DNA, 20 bp, human
gccatcaacaaatgggatat

SEQ ID NO: 126937 - DNA, 20 bp, human
gcaggatctagggagctcca

SEQ ID NO: 126938 - DNA, 20 bp, human
gacttgagagacaggatcta

SEQ ID NO: 126939 - DNA, 20 bp, human
gtggggaatggtagggacag

SEQ ID NO: 126940 - DNA, 20 bp, human
ggggattatggggaatggta

SEQ ID NO: 126941 - DNA, 20 bp, human
gtcctgcacaagggatttcc

SEQ ID NO: 126942 - DNA, 20 bp, human
gcacaagggatttccgggtc

SEQ ID NO: 126943 - DNA, 20 bp, human
gtccccataatcccaagccc

SEQ ID NO: 126944 - DNA, 20 bp, human
gaaggatggaagagttgtca

SEQ ID NO: 126945 - DNA, 20 bp, human
ggaccagctccatcaacaaa

SEQ ID NO: 126946 - DNA, 20 bp, human
gtacactgagaagtagccag

SEQ ID NO: 126947 - DNA, 20 bp, human
gaggaaaactaggagagtgt

SEQ ID NO: 126948 - DNA, 20 bp, human
gcccaaacaagcatccaatg

SEQ ID NO: 126949 - DNA, 20 bp, human
ggtggagggaggcaacttag

SEQ ID NO: 126950 - DNA, 20 bp, human
gagtgagacttggagagtag

SEQ ID NO: 126951 - DNA, 20 bp, human
gggtgtgctgagtgaggtat

SEQ ID NO: 126952 - DNA, 20 bp, human
ggtccaaaatgagataagta

SEQ ID NO: 126953 - DNA, 20 bp, human
gtaaacactgggatacctta

SEQ ID NO: 126954 - DNA, 20 bp, human
ggctgagtgaggtattggaa

SEQ ID NO: 126955 - DNA, 20 bp, human
gctacctgatcattaaacac

SEQ ID NO: 126956 - DNA, 20 bp, human
gacgctccggcgtacggcgg

SEQ ID NO: 126957 - DNA, 20 bp, human
gccgcgcgcgggtcctccac

SEQ ID NO: 126958 - DNA, 20 bp, human
gcccctagaggagccacgga

SEQ ID NO: 126959 - DNA, 20 bp, human
gaccctccgtggctcctcta

SEQ ID NO: 126960 - DNA, 20 bp, human
gcccacccctagaggagcca

SEQ ID NO: 126961 - DNA, 20 bp, human
ggcgcgcggagagagagtga

SEQ ID NO: 126962 - DNA, 20 bp, human
gggtcgcgggtctaatccta

SEQ ID NO: 126963 - DNA, 20 bp, human
gtgcagtgctctaccctccg

SEQ ID NO: 126964 - DNA, 20 bp, human
gccccgcaggaacacaggac

SEQ ID NO: 126965 - DNA, 20 bp, human
gccacgcacgctccggcgta

SEQ ID NO: 126966 - DNA, 20 bp, human
gccctagagccgagctggga

SEQ ID NO: 126967 - DNA, 20 bp, human
gctagggagctgtcccacaa

SEQ ID NO: 126968 - DNA, 20 bp, human
gaaggacagcaacagtcagg

SEQ ID NO: 126969 - DNA, 20 bp, human
gcagcaacctctgcatgctg

SEQ ID NO: 126970 - DNA, 20 bp, human
gtgaggcacaggctagaagc

SEQ ID NO: 126971 - DNA, 20 bp, human
gggacggtgactggtgatgt

SEQ ID NO: 126972 - DNA, 20 bp, human
gaccagtcaccgtccgagtg

SEQ ID NO: 126973 - DNA, 20 bp, human
gcttgaaggtatcaacaagt

SEQ ID NO: 126974 - DNA, 20 bp, human
gagggacagaaatgaggcac

SEQ ID NO: 126975 - DNA, 20 bp, human
gccttcaaggcaattcatct

SEQ ID NO: 126976 - DNA, 20 bp, human
gatagaaagggcgttgggtg

SEQ ID NO: 126977 - DNA, 20 bp, human
gccttcaaggcaattcatct

SEQ ID NO: 126978 - DNA, 20 bp, human
ggttaaattgcagtgagtca

SEQ ID NO: 126979 - DNA, 20 bp, human
gccacttgttgataccttca

SEQ ID NO: 126980 - DNA, 20 bp, human
gggcaatgctgtttcactgg

SEQ ID NO: 126981 - DNA, 20 bp, human
gctggaggacacggctaaga

SEQ ID NO: 126982 - DNA, 20 bp, human
gctgtgctagaacttaatga

SEQ ID NO: 126983 - DNA, 20 bp, human
gcagcaacctctgcatgctg

SEQ ID NO: 126984 - DNA, 20 bp, human
gaggcaatagaaagggcgtt

SEQ ID NO: 126985 - DNA, 20 bp, human
gcaaggcaattcatcttggc

SEQ ID NO: 126986 - DNA, 20 bp, human
ggccggcgcgcagccaagaa

SEQ ID NO: 126987 - DNA, 20 bp, human
ggggctccgtgtgttcggag

SEQ ID NO: 126988 - DNA, 20 bp, human
gcttctcccggcctgaggaa

SEQ ID NO: 126989 - DNA, 20 bp, human
ggctcgcgcacccccccgga

SEQ ID NO: 126990 - DNA, 20 bp, human
ggcaggcgcgtttgcaggag

SEQ ID NO: 126991 - DNA, 20 bp, human
gcggaaggtagaccgggaag

SEQ ID NO: 126992 - DNA, 20 bp, human
gggggggtgcgcgagcgaag

SEQ ID NO: 126993 - DNA, 20 bp, human
gaaggtagaccgggaagggg

SEQ ID NO: 126994 - DNA, 20 bp, human
gtcccggtctaccttccggg

SEQ ID NO: 126995 - DNA, 20 bp, human
ggtggcgcgcagtccagcga

SEQ ID NO: 126996 - DNA, 20 bp, human
gctgtggagccagaactggg

SEQ ID NO: 126997 - DNA, 20 bp, human
ggcaggtgcacacttctgag

SEQ ID NO: 126998 - DNA, 20 bp, human
gtttctaggaccagaggcgg

SEQ ID NO: 126999 - DNA, 20 bp, human
gcagtgttttctaggaccag

SEQ ID NO: 127000 - DNA, 20 bp, human
gcacatatcccctcctggaa

SEQ ID NO: 127001 - DNA, 20 bp, human
ggcctcacaagtgtcaggta

SEQ ID NO: 127002 - DNA, 20 bp, human
gtgttttctaggaccagagg

SEQ ID NO: 127003 - DNA, 20 bp, human
gactgcagcctttccaggag

SEQ ID NO: 127004 - DNA, 20 bp, human
gcccctacctgacacttgtg

SEQ ID NO: 127005 - DNA, 20 bp, human
gacacgcagcggctggctca

SEQ ID NO: 127006 - DNA, 20 bp, human
ggcgcgctcgaggactccaa

SEQ ID NO: 127007 - DNA, 20 bp, human
gttgcagggtggggacccgg

SEQ ID NO: 127008 - DNA, 20 bp, human
gctggccggtagtgactggt

SEQ ID NO: 127009 - DNA, 20 bp, human
gggcggcggtcgagatacta

SEQ ID NO: 127010 - DNA, 20 bp, human
ggctgctggccggtagtgac

SEQ ID NO: 127011 - DNA, 20 bp, human
ggacccaagggtctgccccc

SEQ ID NO: 127012 - DNA, 20 bp, human
ggtccgtactgtaggtgcgt

SEQ ID NO: 127013 - DNA, 20 bp, human
gctccaggcaatcccaggac

SEQ ID NO: 127014 - DNA, 20 bp, human
gcacctcaggccgcccacca

SEQ ID NO: 127015 - DNA, 20 bp, human
gcgcgcccaccagtcactac

SEQ ID NO: 127016 - DNA, 20 bp, human
gcctgaaggctggggatcag

SEQ ID NO: 127017 - DNA, 20 bp, human
gatcggatgaagttcaccct

SEQ ID NO: 127018 - DNA, 20 bp, human
ggccgcgtgagaggcataga

SEQ ID NO: 127019 - DNA, 20 bp, human
gccctgggcgacccagtcct

SEQ ID NO: 127020 - DNA, 20 bp, human
ggcgggcgtggagagtgtcc

SEQ ID NO: 127021 - DNA, 20 bp, human
gagttgagcaagtctgggaa

SEQ ID NO: 127022 - DNA, 20 bp, human
gccagggaaagcggacgaga

SEQ ID NO: 127023 - DNA, 20 bp, human
gaactgccccctgaaggctg

SEQ ID NO: 127024 - DNA, 20 bp, human
gggggcagttgagcaagtct

SEQ ID NO: 127025 - DNA, 20 bp, human
gtgaagttcaccctgggcct

SEQ ID NO: 127026 - DNA, 20 bp, human
gcagccccgagccccgacag

SEQ ID NO: 127027 - DNA, 20 bp, human
gcgcagccgcaacccacctg

SEQ ID NO: 127028 - DNA, 20 bp, human
gttgcggctgcgagaagact

SEQ ID NO: 127029 - DNA, 20 bp, human
gcaacccggaggagccccag

SEQ ID NO: 127030 - DNA, 20 bp, human
gcaagctccggccaacccgg

SEQ ID NO: 127031 - DNA, 20 bp, human
gggtcagcagaatggccccg

SEQ ID NO: 127032 - DNA, 20 bp, human
gccgcaacttgccactgtcg

SEQ ID NO: 127033 - DNA, 20 bp, human
gcgcggccgaagggccggga

SEQ ID NO: 127034 - DNA, 20 bp, human
gtgcagccagggctgaagct

SEQ ID NO: 127035 - DNA, 20 bp, human
ggcagtgcatatccatgggg

SEQ ID NO: 127036 - DNA, 20 bp, human
gggcccggccgcatcatcct

SEQ ID NO: 127037 - DNA, 20 bp, human
gcactcggtgtcaccacagg

SEQ ID NO: 127038 - DNA, 20 bp, human
gggttcccgctggaaggtaa

SEQ ID NO: 127039 - DNA, 20 bp, human
gcggccagcgtggtcatcct

SEQ ID NO: 127040 - DNA, 20 bp, human
gcccgctggaaggtaaggga

SEQ ID NO: 127041 - DNA, 20 bp, human
gggcagaactacccgcgtag

SEQ ID NO: 127042 - DNA, 20 bp, human
gagagagccacggcgagccg

SEQ ID NO: 127043 - DNA, 20 bp, human
ggccctcccttaccttccag

SEQ ID NO: 127044 - DNA, 20 bp, human
gagagagagggagggacgcg

SEQ ID NO: 127045 - DNA, 20 bp, human
gaggtgaaggcgaaacggaa

SEQ ID NO: 127046 - DNA, 20 bp, human
gcaggagaggatgcactcgg

SEQ ID NO: 127047 - DNA, 20 bp, human
ggcttgcgttgacagcctgg

SEQ ID NO: 127048 - DNA, 20 bp, human
gcccaggctcttgccttcag

SEQ ID NO: 127049 - DNA, 20 bp, human
gtcctgggagatcctctcgg

SEQ ID NO: 127050 - DNA, 20 bp, human
gacctccgagaggatctccc

SEQ ID NO: 127051 - DNA, 20 bp, human
ggggctgttgcaggctctga

SEQ ID NO: 127052 - DNA, 20 bp, human
gtacccggcagcagattgtg

SEQ ID NO: 127053 - DNA, 20 bp, human
gcctctcggaggttgaaaag

SEQ ID NO: 127054 - DNA, 20 bp, human
gcagcatgaaccagcttggg

SEQ ID NO: 127055 - DNA, 20 bp, human
gacttcctgggagatcctct

SEQ ID NO: 127056 - DNA, 20 bp, human
gcccggagcgaggaaagggt

SEQ ID NO: 127057 - DNA, 20 bp, human
gccggcccggagcgaggaaa

SEQ ID NO: 127058 - DNA, 20 bp, human
gtcggaccagcaggacaggt

SEQ ID NO: 127059 - DNA, 20 bp, human
gacaggtaggaccgcgatac

SEQ ID NO: 127060 - DNA, 20 bp, human
gccggcttcccgctctactc

SEQ ID NO: 127061 - DNA, 20 bp, human
gggcccggccggagtagagc

SEQ ID NO: 127062 - DNA, 20 bp, human
ggggccgggtccgccacgtc

SEQ ID NO: 127063 - DNA, 20 bp, human
gtcctgctggtccgaggagt

SEQ ID NO: 127064 - DNA, 20 bp, human
gcacgctggcgtccttccgg

SEQ ID NO: 127065 - DNA, 20 bp, human
gtaacttgcagacccccgga

SEQ ID NO: 127066 - DNA, 20 bp, human
gagtgagagataaagagtgt

SEQ ID NO: 127067 - DNA, 20 bp, human
gctgctacgccgggagagtt

SEQ ID NO: 127068 - DNA, 20 bp, human
gtctcccggcgtagcagtgg

SEQ ID NO: 127069 - DNA, 20 bp, human
gcggcagtcgccctccgacg

SEQ ID NO: 127070 - DNA, 20 bp, human
gtacgccgggagagttgggc

SEQ ID NO: 127071 - DNA, 20 bp, human
gcatgttgcggagtgattag

SEQ ID NO: 127072 - DNA, 20 bp, human
gttctccggcccaactctcc

SEQ ID NO: 127073 - DNA, 20 bp, human
gtcctgcgtggaaacttctc

SEQ ID NO: 127074 - DNA, 20 bp, human
gcagaaaggatgcctcataa

SEQ ID NO: 127075 - DNA, 20 bp, human
ggagataaagagtgtgggtg

SEQ ID NO: 127076 - DNA, 20 bp, human
gggctggacggaggagacag

SEQ ID NO: 127077 - DNA, 20 bp, human
gccagccctgaaacccgagg

SEQ ID NO: 127078 - DNA, 20 bp, human
gccggggacgaatccaaagt

SEQ ID NO: 127079 - DNA, 20 bp, human
gcagccctgcgggtaaagac

SEQ ID NO: 127080 - DNA, 20 bp, human
gacccggagaccaggccccg

SEQ ID NO: 127081 - DNA, 20 bp, human
ggcctcggccagaagttgtg

SEQ ID NO: 127082 - DNA, 20 bp, human
ggagcccggagactgcggag

SEQ ID NO: 127083 - DNA, 20 bp, human
gaggggtgaagggagcggac

SEQ ID NO: 127084 - DNA, 20 bp, human
gagtgtggtccggagaaaga

SEQ ID NO: 127085 - DNA, 20 bp, human
gcgcggcgctcgccactctg

SEQ ID NO: 127086 - DNA, 20 bp, human
gcgcggcccggacctacggg

SEQ ID NO: 127087 - DNA, 20 bp, human
ggggcggacccaaccagtga

SEQ ID NO: 127088 - DNA, 20 bp, human
ggctgcaggccctcactggt

SEQ ID NO: 127089 - DNA, 20 bp, human
gcggccaggtatgtcaccca

SEQ ID NO: 127090 - DNA, 20 bp, human
gtcggtgatgccgggtggat

SEQ ID NO: 127091 - DNA, 20 bp, human
gcaggcgcggcccggaccta

SEQ ID NO: 127092 - DNA, 20 bp, human
ggatgggaacaaacttcaga

SEQ ID NO: 127093 - DNA, 20 bp, human
gcctgcacaaacccaggaga

SEQ ID NO: 127094 - DNA, 20 bp, human
gtggttgggtccgcccgcga

SEQ ID NO: 127095 - DNA, 20 bp, human
ggggaacaaacttcagaagg

SEQ ID NO: 127096 - DNA, 20 bp, human
gactcaagcctctttcatcg

SEQ ID NO: 127097 - DNA, 20 bp, human
ggtgaacgctggctactggg

SEQ ID NO: 127098 - DNA, 20 bp, human
gactctgtcagagccgggaa

SEQ ID NO: 127099 - DNA, 20 bp, human
gggaacacgctaagggtcag

SEQ ID NO: 127100 - DNA, 20 bp, human
gctgtcagagccgggaaggg

SEQ ID NO: 127101 - DNA, 20 bp, human
gtcaatctaagcagcaacgt

SEQ ID NO: 127102 - DNA, 20 bp, human
gagttgtaggaacacgctaa

SEQ ID NO: 127103 - DNA, 20 bp, human
ggtttgctactcgggctgag

SEQ ID NO: 127104 - DNA, 20 bp, human
ggtgtactgctcggagcaat

SEQ ID NO: 127105 - DNA, 20 bp, human
ggcgtgttcctacaacttgt

SEQ ID NO: 127106 - DNA, 20 bp, human
ggctctcgcaaggagaaagc

SEQ ID NO: 127107 - DNA, 20 bp, human
gcgagcgctcgcagcccgtg

SEQ ID NO: 127108 - DNA, 20 bp, human
gggtccgacagcgacacgac

SEQ ID NO: 127109 - DNA, 20 bp, human
ggacacgaccggagccctgc

SEQ ID NO: 127110 - DNA, 20 bp, human
gcccaccagaggacccctga

SEQ ID NO: 127111 - DNA, 20 bp, human
gaagccgcaagcgcacggag

SEQ ID NO: 127112 - DNA, 20 bp, human
ggctgatcccacctcccgca

SEQ ID NO: 127113 - DNA, 20 bp, human
gtctggtgggagaggaggac

SEQ ID NO: 127114 - DNA, 20 bp, human
ggagagactcttgaaccgtg

SEQ ID NO: 127115 - DNA, 20 bp, human
gtgcaggggccagcggtcca

SEQ ID NO: 127116 - DNA, 20 bp, human
ggcctttcggaacatccccg

SEQ ID NO: 127117 - DNA, 20 bp, human
ggatgttccgaaaggcccgg

SEQ ID NO: 127118 - DNA, 20 bp, human
gagcaacagaggactcgacc

SEQ ID NO: 127119 - DNA, 20 bp, human
ggggtgcgcggtagcaacag

SEQ ID NO: 127120 - DNA, 20 bp, human
gaggcctcgcgagaacaaag

SEQ ID NO: 127121 - DNA, 20 bp, human
ggggcgtccagagaatacgg

SEQ ID NO: 127122 - DNA, 20 bp, human
gccggcggcggcaacaacgg

SEQ ID NO: 127123 - DNA, 20 bp, human
gcggggatgcggccgtctaa

SEQ ID NO: 127124 - DNA, 20 bp, human
ggctgggcgtccagagaata

SEQ ID NO: 127125 - DNA, 20 bp, human
gctcgacccggctggagctc

SEQ ID NO: 127126 - DNA, 20 bp, human
gcgggccgccgcgatcatgt

SEQ ID NO: 127127 - DNA, 20 bp, human
gcaggcgcccaaagttcctg

SEQ ID NO: 127128 - DNA, 20 bp, human
gagcaaaggagcagagaacg

SEQ ID NO: 127129 - DNA, 20 bp, human
gaaaggagcagagaacgagg

SEQ ID NO: 127130 - DNA, 20 bp, human
ggcctggtccgacatgatcg

SEQ ID NO: 127131 - DNA, 20 bp, human
gggctcagggcgcgcactag

SEQ ID NO: 127132 - DNA, 20 bp, human
ggccgcgatcatgtcggacc

SEQ ID NO: 127133 - DNA, 20 bp, human
gctgactgcgctgagggcag

SEQ ID NO: 127134 - DNA, 20 bp, human
gagctccgagggcggacgag

SEQ ID NO: 127135 - DNA, 20 bp, human
gcctgaggagatgttcaggg

SEQ ID NO: 127136 - DNA, 20 bp, human
ggttgagaaggactctgatc

SEQ ID NO: 127137 - DNA, 20 bp, human
gctggagggagagcgcacgg

SEQ ID NO: 127138 - DNA, 20 bp, human
ggaaggagccacgctttcgg

SEQ ID NO: 127139 - DNA, 20 bp, human
ggtggagccgccagttgaga

SEQ ID NO: 127140 - DNA, 20 bp, human
gggcgcggtggctcccccca

SEQ ID NO: 127141 - DNA, 20 bp, human
gaccggctcatcagttccac

SEQ ID NO: 127142 - DNA, 20 bp, human
gccccggaaacctagaaagg

SEQ ID NO: 127143 - DNA, 20 bp, human
gccggtgagacgctgttctg

SEQ ID NO: 127144 - DNA, 20 bp, human
gcgcctgtgcggggagggta

SEQ ID NO: 127145 - DNA, 20 bp, human
gcactgcgactggccttggg

SEQ ID NO: 127146 - DNA, 20 bp, human
gaggagggttcgaattgcaa

SEQ ID NO: 127147 - DNA, 20 bp, human
gagctgccgggcgtatgtgt

SEQ ID NO: 127148 - DNA, 20 bp, human
ggcgtatgtgttggtgctag

SEQ ID NO: 127149 - DNA, 20 bp, human
gtagatgtagaaactccaag

SEQ ID NO: 127150 - DNA, 20 bp, human
gacaaagctacgacgcggac

SEQ ID NO: 127151 - DNA, 20 bp, human
gcaatccaggggctcacaag

SEQ ID NO: 127152 - DNA, 20 bp, human
gcagctgcagggtctcgctg

SEQ ID NO: 127153 - DNA, 20 bp, human
ggtcacgaaagcccccgcag

SEQ ID NO: 127154 - DNA, 20 bp, human
ggcggacgggcagcagaaaa

SEQ ID NO: 127155 - DNA, 20 bp, human
ggactttttgaaagccagga

SEQ ID NO: 127156 - DNA, 20 bp, human
gccgggcggcagaattacaa

SEQ ID NO: 127157 - DNA, 20 bp, human
gactcccaaatccaggacaa

SEQ ID NO: 127158 - DNA, 20 bp, human
gggcggcagaattacaaagg

SEQ ID NO: 127159 - DNA, 20 bp, human
gggaaagccaatggcgacga

SEQ ID NO: 127160 - DNA, 20 bp, human
ggacgccgaggcccgaagta

SEQ ID NO: 127161 - DNA, 20 bp, human
ggtgctcaactcccaaatcc

SEQ ID NO: 127162 - DNA, 20 bp, human
gtacagtggcgcggccacct

SEQ ID NO: 127163 - DNA, 20 bp, human
ggaaaggccgggcagttggg

SEQ ID NO: 127164 - DNA, 20 bp, human
gtagtgaagcgagcagggaa

SEQ ID NO: 127165 - DNA, 20 bp, human
gcgcgccactgtacccaaaa

SEQ ID NO: 127166 - DNA, 20 bp, human
gatgcatctgctatgaaaat

SEQ ID NO: 127167 - DNA, 20 bp, human
gttggacgtacccaaggcat

SEQ ID NO: 127168 - DNA, 20 bp, human
gcacagcaagagcatttcgt

SEQ ID NO: 127169 - DNA, 20 bp, human
ggaaaacctgatggctaaaa

SEQ ID NO: 127170 - DNA, 20 bp, human
gaccaaagaggtaaacaaac

SEQ ID NO: 127171 - DNA, 20 bp, human
gaggttaaagatactcagtt

SEQ ID NO: 127172 - DNA, 20 bp, human
gcaaagaacacaaaccaaag

SEQ ID NO: 127173 - DNA, 20 bp, human
gcaagaagaagacgtaaagc

SEQ ID NO: 127174 - DNA, 20 bp, human
gatttcattggacgtaccca

SEQ ID NO: 127175 - DNA, 20 bp, human
gctaggaggcaaacagcagc

SEQ ID NO: 127176 - DNA, 20 bp, human
gagacagcattccagaccta

SEQ ID NO: 127177 - DNA, 20 bp, human
gtaggaccttaaatatatcg

SEQ ID NO: 127178 - DNA, 20 bp, human
ggaccttaaatatatcgagg

SEQ ID NO: 127179 - DNA, 20 bp, human
gttaactcagaccctaggtc

SEQ ID NO: 127180 - DNA, 20 bp, human
gaaatatgagggccttctta

SEQ ID NO: 127181 - DNA, 20 bp, human
gtagaatgcctggtagcctt

SEQ ID NO: 127182 - DNA, 20 bp, human
gggaatcatggctgatggtt

SEQ ID NO: 127183 - DNA, 20 bp, human
ggcatggtgtgactgttcta

SEQ ID NO: 127184 - DNA, 20 bp, human
ggaaataccttgtagcagaa

SEQ ID NO: 127185 - DNA, 20 bp, human
gctcttaccattctgctaca

SEQ ID NO: 127186 - DNA, 20 bp, human
ggcggcaccgggaggggtaa

SEQ ID NO: 127187 - DNA, 20 bp, human
gacaaaggcgcactacgggt

SEQ ID NO: 127188 - DNA, 20 bp, human
gtttgcggcggcaccgggag

SEQ ID NO: 127189 - DNA, 20 bp, human
gcagggacaaaggcgcacta

SEQ ID NO: 127190 - DNA, 20 bp, human
gcctgccggcaggtgcgaca

SEQ ID NO: 127191 - DNA, 20 bp, human
ggcggcgggtgccgaagcga

SEQ ID NO: 127192 - DNA, 20 bp, human
gcgcgggactggttttgcgg

SEQ ID NO: 127193 - DNA, 20 bp, human
gggtgccgaagcgacggcag

SEQ ID NO: 127194 - DNA, 20 bp, human
gggctactgggcccatccgg

SEQ ID NO: 127195 - DNA, 20 bp, human
ggcccgcgcacgcagagagg

SEQ ID NO: 127196 - DNA, 20 bp, human
ggcggcggcaggcaaagcac

SEQ ID NO: 127197 - DNA, 20 bp, human
gagatctcccccagccgcgg

SEQ ID NO: 127198 - DNA, 20 bp, human
gggagtttgcagagacacgg

SEQ ID NO: 127199 - DNA, 20 bp, human
ggccagagtgatctcaaagg

SEQ ID NO: 127200 - DNA, 20 bp, human
gctcccggcgcttaaatctg

SEQ ID NO: 127201 - DNA, 20 bp, human
gtgcctctttagaggatggt

SEQ ID NO: 127202 - DNA, 20 bp, human
gcgggccagagtgatctcaa

SEQ ID NO: 127203 - DNA, 20 bp, human
gctcccaccatcctctaaag

SEQ ID NO: 127204 - DNA, 20 bp, human
gcctttgcctctttagagga

SEQ ID NO: 127205 - DNA, 20 bp, human
ggtggggataagggctggtg

SEQ ID NO: 127206 - DNA, 20 bp, human
ggagagaggaggcccaagcg

SEQ ID NO: 127207 - DNA, 20 bp, human
ggcagcggccccagcgagtt

SEQ ID NO: 127208 - DNA, 20 bp, human
gctcacacacacccccgctt

SEQ ID NO: 127209 - DNA, 20 bp, human
gcaagtgagtgcccccactc

SEQ ID NO: 127210 - DNA, 20 bp, human
gggggggagaagtaaccagg

SEQ ID NO: 127211 - DNA, 20 bp, human
gtgggggcactcacttggcc

SEQ ID NO: 127212 - DNA, 20 bp, human
gcccctccaggcgggggccg

SEQ ID NO: 127213 - DNA, 20 bp, human
gctggcgagcctcccggtgg

SEQ ID NO: 127214 - DNA, 20 bp, human
gcggggtctccgccaccggg

SEQ ID NO: 127215 - DNA, 20 bp, human
gcggccccagcgagtttggg

SEQ ID NO: 127216 - DNA, 20 bp, human
gcgggatggacgatcaatcc

SEQ ID NO: 127217 - DNA, 20 bp, human
gtggccagccaggttcaccc

SEQ ID NO: 127218 - DNA, 20 bp, human
ggcgcgggcaagtccccccg

SEQ ID NO: 127219 - DNA, 20 bp, human
ggactcccgcccgcttcggg

SEQ ID NO: 127220 - DNA, 20 bp, human
gtccaggatgctgcagactc

SEQ ID NO: 127221 - DNA, 20 bp, human
gtcggcaaagttgctctggg

SEQ ID NO: 127222 - DNA, 20 bp, human
ggctcgggacggactcggtg

SEQ ID NO: 127223 - DNA, 20 bp, human
gccgcgccccccgaagcggg

SEQ ID NO: 127224 - DNA, 20 bp, human
gactctggccggggtgaacc

SEQ ID NO: 127225 - DNA, 20 bp, human
gctggccactcggtgcaggg

SEQ ID NO: 127226 - DNA, 20 bp, human
gggtagtgctccaggctcga

SEQ ID NO: 127227 - DNA, 20 bp, human
gtggaggccagactgacgag

SEQ ID NO: 127228 - DNA, 20 bp, human
ggcgccagtggtagtgctcc

SEQ ID NO: 127229 - DNA, 20 bp, human
gccgaggacgaagggatgta

SEQ ID NO: 127230 - DNA, 20 bp, human
gagggtcgtggcagtgaggt

SEQ ID NO: 127231 - DNA, 20 bp, human
ggcgctcaggcagcggcggt

SEQ ID NO: 127232 - DNA, 20 bp, human
ggcgagaaggttgggtttag

SEQ ID NO: 127233 - DNA, 20 bp, human
gctgagaaatgggcacgtac

SEQ ID NO: 127234 - DNA, 20 bp, human
gagctcatcttggggcgaga

SEQ ID NO: 127235 - DNA, 20 bp, human
gtttaggggtttagggagta

SEQ ID NO: 127236 - DNA, 20 bp, human
gaaggcggaactaatctaga

SEQ ID NO: 127237 - DNA, 20 bp, human
gtccacagattcgctttgaa

SEQ ID NO: 127238 - DNA, 20 bp, human
gtgaagaccgaagcaagagc

SEQ ID NO: 127239 - DNA, 20 bp, human
gcgctaaagcaaaggatcta

SEQ ID NO: 127240 - DNA, 20 bp, human
gtgcctgaatgaaaagaagg

SEQ ID NO: 127241 - DNA, 20 bp, human
ggtggaccccttcccagcta

SEQ ID NO: 127242 - DNA, 20 bp, human
gctgttgggaccaggcataa

SEQ ID NO: 127243 - DNA, 20 bp, human
gaagtgaggctgggagagta

SEQ ID NO: 127244 - DNA, 20 bp, human
gttctcgggctgcaaacaaa

SEQ ID NO: 127245 - DNA, 20 bp, human
gttgggaccaggcataaagg

SEQ ID NO: 127246 - DNA, 20 bp, human
ggaggcagcagcggtagagg

SEQ ID NO: 127247 - DNA, 20 bp, human
gagctgttctctgtcagtgg

SEQ ID NO: 127248 - DNA, 20 bp, human
gccgcgggaagaggaccgtg

SEQ ID NO: 127249 - DNA, 20 bp, human
gcctcgcgcgaggtccctga

SEQ ID NO: 127250 - DNA, 20 bp, human
gaggactggcgacggcgagg

SEQ ID NO: 127251 - DNA, 20 bp, human
ggagccacatccagtacgat

SEQ ID NO: 127252 - DNA, 20 bp, human
ggacttgggttcgaaccctc

SEQ ID NO: 127253 - DNA, 20 bp, human
gtcccgatcctgacagactt

SEQ ID NO: 127254 - DNA, 20 bp, human
gggctggaggagacagcgac

SEQ ID NO: 127255 - DNA, 20 bp, human
gcaggaagccgcggcgtgta

SEQ ID NO: 127256 - DNA, 20 bp, human
gcgcgccatggtgagtccag

SEQ ID NO: 127257 - DNA, 20 bp, human
gagcaggtggccagcggaga

SEQ ID NO: 127258 - DNA, 20 bp, human
gagcagaatcgggccaccaa

SEQ ID NO: 127259 - DNA, 20 bp, human
ggggccggggaagacagtcg

SEQ ID NO: 127260 - DNA, 20 bp, human
gaccaaggggacgagatccg

SEQ ID NO: 127261 - DNA, 20 bp, human
gccggggaagacagtcgtgg

SEQ ID NO: 127262 - DNA, 20 bp, human
gtgttccgggacccttccgg

SEQ ID NO: 127263 - DNA, 20 bp, human
gcttcggagcaggcaagact

SEQ ID NO: 127264 - DNA, 20 bp, human
gatactggggtgggagcgag

SEQ ID NO: 127265 - DNA, 20 bp, human
gcggggcctacgaccttcct

SEQ ID NO: 127266 - DNA, 20 bp, human
gctcggcagacggccaatgg

SEQ ID NO: 127267 - DNA, 20 bp, human
gtcgtcctcagcacaacgag

SEQ ID NO: 127268 - DNA, 20 bp, human
gggcggaagtgtaaagtcaa

SEQ ID NO: 127269 - DNA, 20 bp, human
ggcgacgcggcgcttgttgg

SEQ ID NO: 127270 - DNA, 20 bp, human
gcgagcagggagccgccata

SEQ ID NO: 127271 - DNA, 20 bp, human
gcaccatggccgctagccct

SEQ ID NO: 127272 - DNA, 20 bp, human
gggccgctgtgcactcacca

SEQ ID NO: 127273 - DNA, 20 bp, human
ggtgcgccgctcagagaccg

SEQ ID NO: 127274 - DNA, 20 bp, human
gtaaagtcaagggcaagtgg

SEQ ID NO: 127275 - DNA, 20 bp, human
gtcagcacaacgagcggcag

SEQ ID NO: 127276 - DNA, 20 bp, human
ggggagttgggctcgttacg

SEQ ID NO: 127277 - DNA, 20 bp, human
gggcgcggcggtggcgactc

SEQ ID NO: 127278 - DNA, 20 bp, human
gggcgcgcggatcaacatct

SEQ ID NO: 127279 - DNA, 20 bp, human
gggccgcagcgtagtcgcag

SEQ ID NO: 127280 - DNA, 20 bp, human
ggcggatcaacatctcggag

SEQ ID NO: 127281 - DNA, 20 bp, human
gatctcggaggggaattgtc

SEQ ID NO: 127282 - DNA, 20 bp, human
ggcagcctcggcggtctggg

SEQ ID NO: 127283 - DNA, 20 bp, human
gagaccgccgaggctgccgc

SEQ ID NO: 127284 - DNA, 20 bp, human
gccgcgcgccactctcctcg

SEQ ID NO: 127285 - DNA, 20 bp, human
gcttaaagatggcattggtg

SEQ ID NO: 127286 - DNA, 20 bp, human
gaaaggggagcgggcgggaa

SEQ ID NO: 127287 - DNA, 20 bp, human
gcctggcacagtgaggtggt

SEQ ID NO: 127288 - DNA, 20 bp, human
gggctctggcgcggcctagt

SEQ ID NO: 127289 - DNA, 20 bp, human
gcgccaccgggaaaaggcgg

SEQ ID NO: 127290 - DNA, 20 bp, human
gctcgcgtgaatgaccggcc

SEQ ID NO: 127291 - DNA, 20 bp, human
gagggcctcgcgtgaatgac

SEQ ID NO: 127292 - DNA, 20 bp, human
gcctctgctggtctgggagg

SEQ ID NO: 127293 - DNA, 20 bp, human
ggcgggactacgcgagaccg

SEQ ID NO: 127294 - DNA, 20 bp, human
ggccttgcgcgaggcctact

SEQ ID NO: 127295 - DNA, 20 bp, human
ggccatagccgggggcgcaa

SEQ ID NO: 127296 - DNA, 20 bp, human
ggtggaagcgtctaactctt

SEQ ID NO: 127297 - DNA, 20 bp, human
gcctgtgttaggaaccaagt

SEQ ID NO: 127298 - DNA, 20 bp, human
gttgagggcgaagaaacaag

SEQ ID NO: 127299 - DNA, 20 bp, human
gcagggcccctccacccagg

SEQ ID NO: 127300 - DNA, 20 bp, human
ggagttagacgcttccacct

SEQ ID NO: 127301 - DNA, 20 bp, human
gcacaggaatctagttccca

SEQ ID NO: 127302 - DNA, 20 bp, human
gaggcgggtgccgaagcacg

SEQ ID NO: 127303 - DNA, 20 bp, human
ggcctcgaggcgaagtaaga

SEQ ID NO: 127304 - DNA, 20 bp, human
gtggtggggccgagactcgc

SEQ ID NO: 127305 - DNA, 20 bp, human
ggcgttctccttcgcagtct

SEQ ID NO: 127306 - DNA, 20 bp, human
gcgcctgctgatgcatggaa

SEQ ID NO: 127307 - DNA, 20 bp, human
gcatcagcaggcggatggtg

SEQ ID NO: 127308 - DNA, 20 bp, human
gtggagtccaaggtctcaga

SEQ ID NO: 127309 - DNA, 20 bp, human
gtttcctacagagacaatgg

SEQ ID NO: 127310 - DNA, 20 bp, human
gagtccaaggtctcagaagg

SEQ ID NO: 127311 - DNA, 20 bp, human
gccatgcatcagcaggcgga

SEQ ID NO: 127312 - DNA, 20 bp, human
ggagccgccattgtctctgt

SEQ ID NO: 127313 - DNA, 20 bp, human
gccacaatttggcagaagga

SEQ ID NO: 127314 - DNA, 20 bp, human
gtctctggttctgtctgccg

SEQ ID NO: 127315 - DNA, 20 bp, human
gtacctttccatgcatcagc

SEQ ID NO: 127316 - DNA, 20 bp, human
gagtgcagggcgggtacctg

SEQ ID NO: 127317 - DNA, 20 bp, human
ggcgtgctggcggtgacctg

SEQ ID NO: 127318 - DNA, 20 bp, human
ggagccagaaccgtagtccg

SEQ ID NO: 127319 - DNA, 20 bp, human
ggggtacctggggagctgcg

SEQ ID NO: 127320 - DNA, 20 bp, human
gacgggaagcaggcgcgtgc

SEQ ID NO: 127321 - DNA, 20 bp, human
gtggctcgctagctctggaa

SEQ ID NO: 127322 - DNA, 20 bp, human
gtgcgtggactcgcgcagac

SEQ ID NO: 127323 - DNA, 20 bp, human
gggaagcaggcgcgtgctgg

SEQ ID NO: 127324 - DNA, 20 bp, human
gctggaagggagcaccggga

SEQ ID NO: 127325 - DNA, 20 bp, human
gcacaggcgcgcttccacac

SEQ ID NO: 127326 - DNA, 20 bp, human
gacattgtccccgggagagg

SEQ ID NO: 127327 - DNA, 20 bp, human
gcccacattgtccccgggag

SEQ ID NO: 127328 - DNA, 20 bp, human
ggccaggagctacaggggag

SEQ ID NO: 127329 - DNA, 20 bp, human
gtgagcggccgcctctcccg

SEQ ID NO: 127330 - DNA, 20 bp, human
gtgtcactcgcagttgtgag

SEQ ID NO: 127331 - DNA, 20 bp, human
gcgctgaggcctgcacaggt

SEQ ID NO: 127332 - DNA, 20 bp, human
ggtgcaggcctcagcggtgt

SEQ ID NO: 127333 - DNA, 20 bp, human
gatcagctgcgaacaatgag

SEQ ID NO: 127334 - DNA, 20 bp, human
gtacaggggagtggcaagtg

SEQ ID NO: 127335 - DNA, 20 bp, human
ggtgcccagccaggagctac

SEQ ID NO: 127336 - DNA, 20 bp, human
ggccgtccggcagcgaccag

SEQ ID NO: 127337 - DNA, 20 bp, human
gctgtgtgagaggtcagcag

SEQ ID NO: 127338 - DNA, 20 bp, human
gtctgcggggacaacaatgg

SEQ ID NO: 127339 - DNA, 20 bp, human
ggcccgcacgccctccgagg

SEQ ID NO: 127340 - DNA, 20 bp, human
gtagccgtgccgcctctggg

SEQ ID NO: 127341 - DNA, 20 bp, human
gggcgccagccgcccagagg

SEQ ID NO: 127342 - DNA, 20 bp, human
gtgccacgcgaactccggga

SEQ ID NO: 127343 - DNA, 20 bp, human
gggccaccgcccacgccgtc

SEQ ID NO: 127344 - DNA, 20 bp, human
gacctctcacacagccggag

SEQ ID NO: 127345 - DNA, 20 bp, human
ggcctagggcagaggcagtt

SEQ ID NO: 127346 - DNA, 20 bp, human
ggccggcacagcaaaaatgg

SEQ ID NO: 127347 - DNA, 20 bp, human
gcgcgccggcacagcaaaaa

SEQ ID NO: 127348 - DNA, 20 bp, human
gatggcggcggcattacggg

SEQ ID NO: 127349 - DNA, 20 bp, human
gtactcaggtgcgccggtag

SEQ ID NO: 127350 - DNA, 20 bp, human
ggcggcggcattacgggtgg

SEQ ID NO: 127351 - DNA, 20 bp, human
gcaagcgagtgagtcctgag

SEQ ID NO: 127352 - DNA, 20 bp, human
gaaaatggcggcggcattac

SEQ ID NO: 127353 - DNA, 20 bp, human
ggcggcattacgggtggcgg

SEQ ID NO: 127354 - DNA, 20 bp, human
gttacgggtggcggcggtcg

SEQ ID NO: 127355 - DNA, 20 bp, human
ggtgccggcgcgtcccctac

SEQ ID NO: 127356 - DNA, 20 bp, human
gtagggaaagctaacagcca

SEQ ID NO: 127357 - DNA, 20 bp, human
gcttcatcaataggagtgaa

SEQ ID NO: 127358 - DNA, 20 bp, human
ggcaaaacaatcaagaccca

SEQ ID NO: 127359 - DNA, 20 bp, human
gcatagagaagtggtggccc

SEQ ID NO: 127360 - DNA, 20 bp, human
gtatctgaagtcctctgcag

SEQ ID NO: 127361 - DNA, 20 bp, human
gctctacaacagcaagcaca

SEQ ID NO: 127362 - DNA, 20 bp, human
gagatgtgcagattttggaa

SEQ ID NO: 127363 - DNA, 20 bp, human
gtgaatggcactgtcatctt

SEQ ID NO: 127364 - DNA, 20 bp, human
gtgtaagcatagagaagtgg

SEQ ID NO: 127365 - DNA, 20 bp, human
ggagaggatcagtctcttgc

SEQ ID NO: 127366 - DNA, 20 bp, human
ggctccccgagtgtgtgagg

SEQ ID NO: 127367 - DNA, 20 bp, human
ggccgccgcctcacacactc

SEQ ID NO: 127368 - DNA, 20 bp, human
gccggaggcgggtaaggatc

SEQ ID NO: 127369 - DNA, 20 bp, human
gcggcgagaagccgagggag

SEQ ID NO: 127370 - DNA, 20 bp, human
ggaggcgggtaaggatccgg

SEQ ID NO: 127371 - DNA, 20 bp, human
gttctcgccgcggacctggg

SEQ ID NO: 127372 - DNA, 20 bp, human
ggtccgcggcgagaagccga

SEQ ID NO: 127373 - DNA, 20 bp, human
gtctgggcgcagcagcccgg

SEQ ID NO: 127374 - DNA, 20 bp, human
gcccgctccccgagtgtgtg

SEQ ID NO: 127375 - DNA, 20 bp, human
gtgctgggagcccatagcag

SEQ ID NO: 127376 - DNA, 20 bp, human
gtgatgggaggagaacgagg

SEQ ID NO: 127377 - DNA, 20 bp, human
gtgctgatgggaggagaacg

SEQ ID NO: 127378 - DNA, 20 bp, human
gaactgccagcccagaccac

SEQ ID NO: 127379 - DNA, 20 bp, human
ggccagccgttgacattaag

SEQ ID NO: 127380 - DNA, 20 bp, human
gactggaaggaaaaagagac

SEQ ID NO: 127381 - DNA, 20 bp, human
gagacaggttagagggaaag

SEQ ID NO: 127382 - DNA, 20 bp, human
gttgtcttcttgctgatggg

SEQ ID NO: 127383 - DNA, 20 bp, human
ggcctctgagcctgtggtct

SEQ ID NO: 127384 - DNA, 20 bp, human
gtcagcaagaagacaaaccg

SEQ ID NO: 127385 - DNA, 20 bp, human
ggtgccggaaaagcacagaa

SEQ ID NO: 127386 - DNA, 20 bp, human
ggatcgaggtgcgcgaccat

SEQ ID NO: 127387 - DNA, 20 bp, human
gaccagctgaaccaccaggg

SEQ ID NO: 127388 - DNA, 20 bp, human
gtccaccagctgaaccacca

SEQ ID NO: 127389 - DNA, 20 bp, human
gagggtggcggtggaggaaa

SEQ ID NO: 127390 - DNA, 20 bp, human
gtgccgatagaggagtccgg

SEQ ID NO: 127391 - DNA, 20 bp, human
ggccgggttactgggtacat

SEQ ID NO: 127392 - DNA, 20 bp, human
gccggcccaggtgccgatag

SEQ ID NO: 127393 - DNA, 20 bp, human
gagcccccggactcctctat

SEQ ID NO: 127394 - DNA, 20 bp, human
gcagctcataaggccgctgg

SEQ ID NO: 127395 - DNA, 20 bp, human
gccttatgagctggtgatcg

SEQ ID NO: 127396 - DNA, 20 bp, human
ggagaaagagcaaaccccgg

SEQ ID NO: 127397 - DNA, 20 bp, human
gaaaccccggaggtgagcgc

SEQ ID NO: 127398 - DNA, 20 bp, human
gtgcagtcggcgaactgtcg

SEQ ID NO: 127399 - DNA, 20 bp, human
ggtcggcgaactgtcggggc

SEQ ID NO: 127400 - DNA, 20 bp, human
ggctctttctcttacctccc

SEQ ID NO: 127401 - DNA, 20 bp, human
ggcccgcgcggcaaagagga

SEQ ID NO: 127402 - DNA, 20 bp, human
ggtcatagttcagacctcag

SEQ ID NO: 127403 - DNA, 20 bp, human
gtacctcccgggaagagaag

SEQ ID NO: 127404 - DNA, 20 bp, human
gtgagtgcagctactgctca

SEQ ID NO: 127405 - DNA, 20 bp, human
ggcagtgccagcggcgacac

SEQ ID NO: 127406 - DNA, 20 bp, human
gtgcagtcggcgaactgtct

SEQ ID NO: 127407 - DNA, 20 bp, human
ggtcggcgaactgtctgggc

SEQ ID NO: 127408 - DNA, 20 bp, human
ggcccgcgcggcaaagagga

SEQ ID NO: 127409 - DNA, 20 bp, human
ggtcatagttcagacctcag

SEQ ID NO: 127410 - DNA, 20 bp, human
gtgagtgcagctactgctca

SEQ ID NO: 127411 - DNA, 20 bp, human
gctgaactatgacaacgggg

SEQ ID NO: 127412 - DNA, 20 bp, human
ggcagtgccagcggcgacac

SEQ ID NO: 127413 - DNA, 20 bp, human
gggtctgaactatgacaacg

SEQ ID NO: 127414 - DNA, 20 bp, human
gcgcagagtggcagtgccag

SEQ ID NO: 127415 - DNA, 20 bp, human
ggaagagaaagagcaaaccc

SEQ ID NO: 127416 - DNA, 20 bp, human
gggacaagagctggtctaag

SEQ ID NO: 127417 - DNA, 20 bp, human
gacccagttgagcaggatgt

SEQ ID NO: 127418 - DNA, 20 bp, human
gcaggggagaccccctactg

SEQ ID NO: 127419 - DNA, 20 bp, human
gcccctactggggaactagt

SEQ ID NO: 127420 - DNA, 20 bp, human
gccccagcctagcaactgtt

SEQ ID NO: 127421 - DNA, 20 bp, human
gggacctgacccagttgagc

SEQ ID NO: 127422 - DNA, 20 bp, human
gtcccacatcctgctcaact

SEQ ID NO: 127423 - DNA, 20 bp, human
gtggcacttcctctgacact

SEQ ID NO: 127424 - DNA, 20 bp, human
ggttgtgccggcagctctgg

SEQ ID NO: 127425 - DNA, 20 bp, human
gggtccacttcagcaaatga

SEQ ID NO: 127426 - DNA, 20 bp, human
gctcagaacgtggagaatga

SEQ ID NO: 127427 - DNA, 20 bp, human
gtagttgcttgtggtaacta

SEQ ID NO: 127428 - DNA, 20 bp, human
gtgcttgtggtaactaaggc

SEQ ID NO: 127429 - DNA, 20 bp, human
gacaataccagacagtaatc

SEQ ID NO: 127430 - DNA, 20 bp, human
ggcttagtgttagttgcttg

SEQ ID NO: 127431 - DNA, 20 bp, human
ggcctcacagaaacaagagg

SEQ ID NO: 127432 - DNA, 20 bp, human
gcgggggaagaacttacttg

SEQ ID NO: 127433 - DNA, 20 bp, human
gggaactagattatgagcac

SEQ ID NO: 127434 - DNA, 20 bp, human
gacatgtgaatgaatcgtct

SEQ ID NO: 127435 - DNA, 20 bp, human
gctaacactaagctgctagc

SEQ ID NO: 127436 - DNA, 20 bp, human
ggcgggagagacgaaacccc

SEQ ID NO: 127437 - DNA, 20 bp, human
gaatcttgcattgctggctg

SEQ ID NO: 127438 - DNA, 20 bp, human
ggcaaggcggtggcttcctg

SEQ ID NO: 127439 - DNA, 20 bp, human
gtaagaaggaaatctcgtct

SEQ ID NO: 127440 - DNA, 20 bp, human
gagcagggaggtgtgtctct

SEQ ID NO: 127441 - DNA, 20 bp, human
gggctcaaacttgagcgatg

SEQ ID NO: 127442 - DNA, 20 bp, human
ggatgaggcaggcgataaga

SEQ ID NO: 127443 - DNA, 20 bp, human
ggtttgagcctcccgaagtc

SEQ ID NO: 127444 - DNA, 20 bp, human
gttccgagcagccaaaggga

SEQ ID NO: 127445 - DNA, 20 bp, human
gggtggcttcctgcggctgg

SEQ ID NO: 127446 - DNA, 20 bp, human
ggactggagtcagcaatcac

SEQ ID NO: 127447 - DNA, 20 bp, human
gctgcagccgagcagctaaa

SEQ ID NO: 127448 - DNA, 20 bp, human
ggacacactgcagactccac

SEQ ID NO: 127449 - DNA, 20 bp, human
gaagggagaaagaatcgctc

SEQ ID NO: 127450 - DNA, 20 bp, human
gcacgacttccagatacctt

SEQ ID NO: 127451 - DNA, 20 bp, human
ggtatctggaagtcgtgaca

SEQ ID NO: 127452 - DNA, 20 bp, human
gggactggactccatgccga

SEQ ID NO: 127453 - DNA, 20 bp, human
gattcttgcccagtacatcg

SEQ ID NO: 127454 - DNA, 20 bp, human
gacgttgccaaaggaagttg

SEQ ID NO: 127455 - DNA, 20 bp, human
gatctattgcagggtgccgg

SEQ ID NO: 127456 - DNA, 20 bp, human
gtcctgcaagtaaacttcgg

SEQ ID NO: 127457 - DNA, 20 bp, human
gcgctcctgcaagtaaactt

SEQ ID NO: 127458 - DNA, 20 bp, human
gacggacgagcgggcacaga

SEQ ID NO: 127459 - DNA, 20 bp, human
gcagcgcggagacggacgag

SEQ ID NO: 127460 - DNA, 20 bp, human
gtggagtatgagcaagcagg

SEQ ID NO: 127461 - DNA, 20 bp, human
gagtagtttgcggcatccgg

SEQ ID NO: 127462 - DNA, 20 bp, human
ggcgacaaaatcgtcgactg

SEQ ID NO: 127463 - DNA, 20 bp, human
gtggcttgcccgggaggcac

SEQ ID NO: 127464 - DNA, 20 bp, human
gaagcacccggtacccacgg

SEQ ID NO: 127465 - DNA, 20 bp, human
gtgatttcatcttcccggag

SEQ ID NO: 127466 - DNA, 20 bp, human
gcggccgcgcattccctggg

SEQ ID NO: 127467 - DNA, 20 bp, human
gcctcggccgcgcattccct

SEQ ID NO: 127468 - DNA, 20 bp, human
gataaggtcgagggcatcgg

SEQ ID NO: 127469 - DNA, 20 bp, human
gcagcctcccagggaatgcg

SEQ ID NO: 127470 - DNA, 20 bp, human
gtgagctgcgcgcattccct

SEQ ID NO: 127471 - DNA, 20 bp, human
ggcacccgcgcctggatatg

SEQ ID NO: 127472 - DNA, 20 bp, human
gagcgctcttgaagggaggg

SEQ ID NO: 127473 - DNA, 20 bp, human
ggcgcgggtgccaggtcgcc

SEQ ID NO: 127474 - DNA, 20 bp, human
gcagagcgctcttgaaggga

SEQ ID NO: 127475 - DNA, 20 bp, human
gacaggccctgggagtgagc

SEQ ID NO: 127476 - DNA, 20 bp, human
gcgacatgcgggccgaatgc

SEQ ID NO: 127477 - DNA, 20 bp, human
gcggctgcgaacccaaactt

SEQ ID NO: 127478 - DNA, 20 bp, human
ggcagagtcggagttgagac

SEQ ID NO: 127479 - DNA, 20 bp, human
gcacggccgggcgtccccaa

SEQ ID NO: 127480 - DNA, 20 bp, human
gcccgctgcatgagcagagt

SEQ ID NO: 127481 - DNA, 20 bp, human
ggtgagaagggactgactct

SEQ ID NO: 127482 - DNA, 20 bp, human
gggcccgcatgtcggagcag

SEQ ID NO: 127483 - DNA, 20 bp, human
gcgctgtgcgcgattcaggg

SEQ ID NO: 127484 - DNA, 20 bp, human
ggcgtctctgaagatggctc

SEQ ID NO: 127485 - DNA, 20 bp, human
gaccgtgcggtgcccaagtt

SEQ ID NO: 127486 - DNA, 20 bp, human
gacggagaggcgcagagtga

SEQ ID NO: 127487 - DNA, 20 bp, human
gcctgtgcgggagaagtctg

SEQ ID NO: 127488 - DNA, 20 bp, human
gcgtcctcagagcccgctgg

SEQ ID NO: 127489 - DNA, 20 bp, human
gccgggtgcgcgaaggcgac

SEQ ID NO: 127490 - DNA, 20 bp, human
gagccgctcgcggtccaggc

SEQ ID NO: 127491 - DNA, 20 bp, human
gtggaccgcgagcggctgtg

SEQ ID NO: 127492 - DNA, 20 bp, human
gctggccacacagccgctcg

SEQ ID NO: 127493 - DNA, 20 bp, human
ggcctcaagtgcgatccgaa

SEQ ID NO: 127494 - DNA, 20 bp, human
ggaagagctgcaaggggaaa

SEQ ID NO: 127495 - DNA, 20 bp, human
ggctgttgaattgcttcatc

SEQ ID NO: 127496 - DNA, 20 bp, human
ggcgtgcttcagagactctg

SEQ ID NO: 127497 - DNA, 20 bp, human
ggagagcacgcgagacggaa

SEQ ID NO: 127498 - DNA, 20 bp, human
gagagggagagcacgcgaga

SEQ ID NO: 127499 - DNA, 20 bp, human
gagaaattcagttcagagag

SEQ ID NO: 127500 - DNA, 20 bp, human
gtctcaataagcccagaggg

SEQ ID NO: 127501 - DNA, 20 bp, human
gactggtgctaccagatgca

SEQ ID NO: 127502 - DNA, 20 bp, human
gcatctggtagcaccagttt

SEQ ID NO: 127503 - DNA, 20 bp, human
gacttaagcagtattggcat

SEQ ID NO: 127504 - DNA, 20 bp, human
gtgcatggctttctatgtgt

SEQ ID NO: 127505 - DNA, 20 bp, human
gacgcaagagataaccgatt

SEQ ID NO: 127506 - DNA, 20 bp, human
gtcgcgaggagctgtgccag

SEQ ID NO: 127507 - DNA, 20 bp, human
gtaagaggagagcataagaa

SEQ ID NO: 127508 - DNA, 20 bp, human
gtgagcaacgcggccaacga

SEQ ID NO: 127509 - DNA, 20 bp, human
gcggtaaagagataaatgat

SEQ ID NO: 127510 - DNA, 20 bp, human
gctctcaggcggtgacaaaa

SEQ ID NO: 127511 - DNA, 20 bp, human
ggtcggcgatcaactccagg

SEQ ID NO: 127512 - DNA, 20 bp, human
gtcccaggtcctgagcaacg

SEQ ID NO: 127513 - DNA, 20 bp, human
ggagctgtgccagtggagcg

SEQ ID NO: 127514 - DNA, 20 bp, human
gaaaacctgcagcggcctgt

SEQ ID NO: 127515 - DNA, 20 bp, human
ggtggcgtccaaaacacaca

SEQ ID NO: 127516 - DNA, 20 bp, human
gctgttacggagaacctggg

SEQ ID NO: 127517 - DNA, 20 bp, human
gggcatcagccagtttctca

SEQ ID NO: 127518 - DNA, 20 bp, human
ggttctgttacggagaacct

SEQ ID NO: 127519 - DNA, 20 bp, human
gttacaaatcgacgaatcag

SEQ ID NO: 127520 - DNA, 20 bp, human
gacccccaggcagctacatc

SEQ ID NO: 127521 - DNA, 20 bp, human
gtatctattttttatcgaaa

SEQ ID NO: 127522 - DNA, 20 bp, human
gtttccagatgtagctgcct

SEQ ID NO: 127523 - DNA, 20 bp, human
gaaaaatagatataagaaat

SEQ ID NO: 127524 - DNA, 20 bp, human
gaaacaagagaaggataaga

SEQ ID NO: 127525 - DNA, 20 bp, human
gaaatagctttttagaacaa

SEQ ID NO: 127526 - DNA, 20 bp, human
ggtgaggcactcccatacaa

SEQ ID NO: 127527 - DNA, 20 bp, human
gaaggttggtctgaacagtg

SEQ ID NO: 127528 - DNA, 20 bp, human
gacggtggcatccggtatga

SEQ ID NO: 127529 - DNA, 20 bp, human
gtcaaaggatccttaaacgg

SEQ ID NO: 127530 - DNA, 20 bp, human
gcaaaggaactccatcatac

SEQ ID NO: 127531 - DNA, 20 bp, human
gcacctcccagaattcgagg

SEQ ID NO: 127532 - DNA, 20 bp, human
gaagccagagctgtagtcgt

SEQ ID NO: 127533 - DNA, 20 bp, human
ggtggcgtccaaaacacatg

SEQ ID NO: 127534 - DNA, 20 bp, human
ggtttcaaaggatccttaaa

SEQ ID NO: 127535 - DNA, 20 bp, human
gctcctcctcgaattctggg

SEQ ID NO: 127536 - DNA, 20 bp, human
gccgtgaatgattggaatgt

SEQ ID NO: 127537 - DNA, 20 bp, human
gcagcagacgctgggatccc

SEQ ID NO: 127538 - DNA, 20 bp, human
gaaaatgagggcctctgagt

SEQ ID NO: 127539 - DNA, 20 bp, human
gttaagggatcgcttgcctg

SEQ ID NO: 127540 - DNA, 20 bp, human
gactgattgtcccaactcag

SEQ ID NO: 127541 - DNA, 20 bp, human
gtggtgattatcggaccaag

SEQ ID NO: 127542 - DNA, 20 bp, human
gttatcggaccaagaggccc

SEQ ID NO: 127543 - DNA, 20 bp, human
gatgtcgctctacactcaga

SEQ ID NO: 127544 - DNA, 20 bp, human
gactgctcataaaatacctc

SEQ ID NO: 127545 - DNA, 20 bp, human
gttccaatcattcacggaat

SEQ ID NO: 127546 - DNA, 20 bp, human
gtccccgaggaagcaaaaca

SEQ ID NO: 127547 - DNA, 20 bp, human
gctaggaagccataaaaatt

SEQ ID NO: 127548 - DNA, 20 bp, human
gtacctcaaactgtctctca

SEQ ID NO: 127549 - DNA, 20 bp, human
ggtgcggaaggattcgcaag

SEQ ID NO: 127550 - DNA, 20 bp, human
gggccttgagagacagtttg

SEQ ID NO: 127551 - DNA, 20 bp, human
gtatggcttcctagtgcgga

SEQ ID NO: 127552 - DNA, 20 bp, human
ggcaaggaggcccaagaccg

SEQ ID NO: 127553 - DNA, 20 bp, human
gtgcaggaagaaagaaacgg

SEQ ID NO: 127554 - DNA, 20 bp, human
ggccagagcagtagttgccg

SEQ ID NO: 127555 - DNA, 20 bp, human
gtatattgcagatagctctg

SEQ ID NO: 127556 - DNA, 20 bp, human
ggaatgtagcatccacgtgg

SEQ ID NO: 127557 - DNA, 20 bp, human
gtgttacttcagagaagcgg

SEQ ID NO: 127558 - DNA, 20 bp, human
ggcggaatgtagcatccacg

SEQ ID NO: 127559 - DNA, 20 bp, human
ggaggaataagagaagcagc

SEQ ID NO: 127560 - DNA, 20 bp, human
gtctatcagaaggggccgag

SEQ ID NO: 127561 - DNA, 20 bp, human
ggcttctctgaagtaacaaa

SEQ ID NO: 127562 - DNA, 20 bp, human
gtggcgtcttctatcagaag

SEQ ID NO: 127563 - DNA, 20 bp, human
gaaacattgaggattggtaa

SEQ ID NO: 127564 - DNA, 20 bp, human
gtaatttgatcaaaacattg

SEQ ID NO: 127565 - DNA, 20 bp, human
gtgaagtaacaaaggggctc

SEQ ID NO: 127566 - DNA, 20 bp, human
gagaccgcgaggaactgtgc

SEQ ID NO: 127567 - DNA, 20 bp, human
gtgcttggcctcctcagaga

SEQ ID NO: 127568 - DNA, 20 bp, human
gtctcctggcgagaagatcc

SEQ ID NO: 127569 - DNA, 20 bp, human
gtctctaaaatttaacaccg

SEQ ID NO: 127570 - DNA, 20 bp, human
gaaactttggatcaatgtaa

SEQ ID NO: 127571 - DNA, 20 bp, human
gagagaaagcagcaggcact

SEQ ID NO: 127572 - DNA, 20 bp, human
ggctccaggatcttctcgcc

SEQ ID NO: 127573 - DNA, 20 bp, human
gagtttaagaaatgaagata

SEQ ID NO: 127574 - DNA, 20 bp, human
gcttcatttcttaaactcct

SEQ ID NO: 127575 - DNA, 20 bp, human
ggagcagaagagaaagcagc

SEQ ID NO: 127576 - DNA, 20 bp, human
gaggaaccatatacactctt

SEQ ID NO: 127577 - DNA, 20 bp, human
gtatcgtttctcaaagtcaa

SEQ ID NO: 127578 - DNA, 20 bp, human
gagactccaaagagtgtata

SEQ ID NO: 127579 - DNA, 20 bp, human
gtacctccagaaggcctccg

SEQ ID NO: 127580 - DNA, 20 bp, human
gtcaagggaaatcttttaat

SEQ ID NO: 127581 - DNA, 20 bp, human
ggggaagcggccaggaatcc

SEQ ID NO: 127582 - DNA, 20 bp, human
gcagcagacgccgggattcc

SEQ ID NO: 127583 - DNA, 20 bp, human
gaaattccttctattcttac

SEQ ID NO: 127584 - DNA, 20 bp, human
gtaaagatggagttttcctg

SEQ ID NO: 127585 - DNA, 20 bp, human
gagtaagagcagcagacgcc

SEQ ID NO: 127586 - DNA, 20 bp, human
gtggcacagccaaaaatgga

SEQ ID NO: 127587 - DNA, 20 bp, human
gttcttggcacagccaaaaa

SEQ ID NO: 127588 - DNA, 20 bp, human
gcttctccttgcctactgga

SEQ ID NO: 127589 - DNA, 20 bp, human
gggaggagctgtgccggcgg

SEQ ID NO: 127590 - DNA, 20 bp, human
gtctcccttcccagcctcaa

SEQ ID NO: 127591 - DNA, 20 bp, human
gccctgccttccagtaggca

SEQ ID NO: 127592 - DNA, 20 bp, human
gagatggtatattcccggag

SEQ ID NO: 127593 - DNA, 20 bp, human
gtattcccggagaggaagtc

SEQ ID NO: 127594 - DNA, 20 bp, human
ggatcccagacttcctctcc

SEQ ID NO: 127595 - DNA, 20 bp, human
gggaagggagaaaaaccttc

SEQ ID NO: 127596 - DNA, 20 bp, human
gatggcggacgcagaagaaa

SEQ ID NO: 127597 - DNA, 20 bp, human
gcgccatcattcaacagtca

SEQ ID NO: 127598 - DNA, 20 bp, human
gtgcgaggagcagaagcggg

SEQ ID NO: 127599 - DNA, 20 bp, human
gttaccccggaggatagatt

SEQ ID NO: 127600 - DNA, 20 bp, human
gaggccatcctgaacaggcg

SEQ ID NO: 127601 - DNA, 20 bp, human
gtatgcggaagatcttctaa

SEQ ID NO: 127602 - DNA, 20 bp, human
ggtgccgcgcctgttcagga

SEQ ID NO: 127603 - DNA, 20 bp, human
gacaccatgtcaaatacctc

SEQ ID NO: 127604 - DNA, 20 bp, human
gatggcctccaaagaccgcg

SEQ ID NO: 127605 - DNA, 20 bp, human
ggacatggtgtttaccccgg

SEQ ID NO: 127606 - DNA, 20 bp, human
gctctttggatgcacaacaa

SEQ ID NO: 127607 - DNA, 20 bp, human
gacatcgagattgaaatgaa

SEQ ID NO: 127608 - DNA, 20 bp, human
gtacctccagaagatcccca

SEQ ID NO: 127609 - DNA, 20 bp, human
ggcggtgtgcaaattccgtg

SEQ ID NO: 127610 - DNA, 20 bp, human
gtctagcagcttgggaggca

SEQ ID NO: 127611 - DNA, 20 bp, human
gttccgtggggatcttctgg

SEQ ID NO: 127612 - DNA, 20 bp, human
gcccgaatggatacgaccca

SEQ ID NO: 127613 - DNA, 20 bp, human
ggcgtctttccagtgcgaaa

SEQ ID NO: 127614 - DNA, 20 bp, human
gctaaacatggcaacttcgt

SEQ ID NO: 127615 - DNA, 20 bp, human
gaaattccgtggggatcttc

SEQ ID NO: 127616 - DNA, 20 bp, human
ggtctctaaaggccgaacaa

SEQ ID NO: 127617 - DNA, 20 bp, human
gacgggagatgcagcggaat

SEQ ID NO: 127618 - DNA, 20 bp, human
gatcactggcgaggagagct

SEQ ID NO: 127619 - DNA, 20 bp, human
gcgctgcatctcccgttgtt

SEQ ID NO: 127620 - DNA, 20 bp, human
gaggaaacgactatttaaca

SEQ ID NO: 127621 - DNA, 20 bp, human
gacatggattatcactggcg

SEQ ID NO: 127622 - DNA, 20 bp, human
gagcaagagtagtagtcgcc

SEQ ID NO: 127623 - DNA, 20 bp, human
gtaagataatattttctgat

SEQ ID NO: 127624 - DNA, 20 bp, human
gatttaacatggattatcac

SEQ ID NO: 127625 - DNA, 20 bp, human
gtgacagcatctgtctctaa

SEQ ID NO: 127626 - DNA, 20 bp, human
gatggcgaacacagcagaat

SEQ ID NO: 127627 - DNA, 20 bp, human
gctctctctgtgctgaacga

SEQ ID NO: 127628 - DNA, 20 bp, human
gtcagaagcgagagcagtag

SEQ ID NO: 127629 - DNA, 20 bp, human
gtcaagtcgaggagatccag

SEQ ID NO: 127630 - DNA, 20 bp, human
gctgatcctcgcaatgtggg

SEQ ID NO: 127631 - DNA, 20 bp, human
gtcctcgcaatgtgggtggt

SEQ ID NO: 127632 - DNA, 20 bp, human
ggcagtagaggctgaccctc

SEQ ID NO: 127633 - DNA, 20 bp, human
gcccttttcccatgggaaag

SEQ ID NO: 127634 - DNA, 20 bp, human
ggcggcctttggaatccaac

SEQ ID NO: 127635 - DNA, 20 bp, human
gcttctgatcctcgcaatgt

SEQ ID NO: 127636 - DNA, 20 bp, human
gtcgggaggcgcaacgtcgg

SEQ ID NO: 127637 - DNA, 20 bp, human
gccgacgcgcggctcccaaa

SEQ ID NO: 127638 - DNA, 20 bp, human
gcgttcgggaggcgcaacgt

SEQ ID NO: 127639 - DNA, 20 bp, human
gagcccgcagcagtgacggc

SEQ ID NO: 127640 - DNA, 20 bp, human
gggcaatgccggcgttcggg

SEQ ID NO: 127641 - DNA, 20 bp, human
gcgcagattgctgataactg

SEQ ID NO: 127642 - DNA, 20 bp, human
ggatgtggaggttaagatct

SEQ ID NO: 127643 - DNA, 20 bp, human
gctgccggccgtcactgctg

SEQ ID NO: 127644 - DNA, 20 bp, human
gtcggggtggatctacccag

SEQ ID NO: 127645 - DNA, 20 bp, human
gggagcgcagcgccgcctag

SEQ ID NO: 127646 - DNA, 20 bp, human
gcctccccctggagctgtag

SEQ ID NO: 127647 - DNA, 20 bp, human
ggccgggttgagcgactcgg

SEQ ID NO: 127648 - DNA, 20 bp, human
gcgagccgggttgagcgact

SEQ ID NO: 127649 - DNA, 20 bp, human
ggcctccgagtcgctcaacc

SEQ ID NO: 127650 - DNA, 20 bp, human
gagcggaggagctggaatat

SEQ ID NO: 127651 - DNA, 20 bp, human
gggagtcagcgaggacggtg

SEQ ID NO: 127652 - DNA, 20 bp, human
gcgccgggtgcctgctcctc

SEQ ID NO: 127653 - DNA, 20 bp, human
gaggcacccggcgcgctcgt

SEQ ID NO: 127654 - DNA, 20 bp, human
gacagagtatcgcagctggg

SEQ ID NO: 127655 - DNA, 20 bp, human
ggctccggcggcccatgccc

SEQ ID NO: 127656 - DNA, 20 bp, human
gggacctaggactggaggta

SEQ ID NO: 127657 - DNA, 20 bp, human
gtccttccgggccgaggtca

SEQ ID NO: 127658 - DNA, 20 bp, human
ggcttgtgagaactgatggc

SEQ ID NO: 127659 - DNA, 20 bp, human
ggcgcgcttgtgagaactga

SEQ ID NO: 127660 - DNA, 20 bp, human
ggctaaggacctaggactgg

SEQ ID NO: 127661 - DNA, 20 bp, human
gttcaaagtgcagaacacaa

SEQ ID NO: 127662 - DNA, 20 bp, human
gaagtgcagaacacaagggt

SEQ ID NO: 127663 - DNA, 20 bp, human
gacaactatccgctattcag

SEQ ID NO: 127664 - DNA, 20 bp, human
ggtagctaaggacctaggac

SEQ ID NO: 127665 - DNA, 20 bp, human
ggggcgcggctggtttccga

SEQ ID NO: 127666 - DNA, 20 bp, human
gtcactaataaaggaagaca

SEQ ID NO: 127667 - DNA, 20 bp, human
ggctttagctgccaaagatt

SEQ ID NO: 127668 - DNA, 20 bp, human
gctatgcaagtcactaataa

SEQ ID NO: 127669 - DNA, 20 bp, human
gagctgccaaagattgggaa

SEQ ID NO: 127670 - DNA, 20 bp, human
ggctgtggctgtaaccaact

SEQ ID NO: 127671 - DNA, 20 bp, human
gcggtttgggaattgctctg

SEQ ID NO: 127672 - DNA, 20 bp, human
ggctacacggcgtaggtgca

SEQ ID NO: 127673 - DNA, 20 bp, human
gataacgtatgcagcagcta

SEQ ID NO: 127674 - DNA, 20 bp, human
gcaggctaaagagacggttt

SEQ ID NO: 127675 - DNA, 20 bp, human
ggcatacgttatttcctagt

SEQ ID NO: 127676 - DNA, 20 bp, human
gagagaactgtcctcacggg

SEQ ID NO: 127677 - DNA, 20 bp, human
gtgtagcacgcaaggctcga

SEQ ID NO: 127678 - DNA, 20 bp, human
ggacacgcactcagcagata

SEQ ID NO: 127679 - DNA, 20 bp, human
ggaaacaacaagccttcaag

SEQ ID NO: 127680 - DNA, 20 bp, human
gcaatctggcaaaggacctg

SEQ ID NO: 127681 - DNA, 20 bp, human
gttaagtgaaacactagaca

SEQ ID NO: 127682 - DNA, 20 bp, human
gaccacccgagccccccgtg

SEQ ID NO: 127683 - DNA, 20 bp, human
gaaggaactatggagaacca

SEQ ID NO: 127684 - DNA, 20 bp, human
ggacctggaaaccattcaac

SEQ ID NO: 127685 - DNA, 20 bp, human
gtaaaatccttagaccacag

SEQ ID NO: 127686 - DNA, 20 bp, human
gccagtacacgcggagaact

SEQ ID NO: 127687 - DNA, 20 bp, human
gctgagagaaatgctagaca

SEQ ID NO: 127688 - DNA, 20 bp, human
gagagaaatgctagacaggg

SEQ ID NO: 127689 - DNA, 20 bp, human
gggcaggcactctgcagata

SEQ ID NO: 127690 - DNA, 20 bp, human
gtacagcacacaaggctcat

SEQ ID NO: 127691 - DNA, 20 bp, human
ggatttggtagacagatcag

SEQ ID NO: 127692 - DNA, 20 bp, human
gcttctaggttctcccttaa

SEQ ID NO: 127693 - DNA, 20 bp, human
ggatctgtctaccaaatcct

SEQ ID NO: 127694 - DNA, 20 bp, human
gaccttgttgaatggcttct

SEQ ID NO: 127695 - DNA, 20 bp, human
gagtgagctgtcttcgcggg

SEQ ID NO: 127696 - DNA, 20 bp, human
ggtgaccgcacagatcctca

SEQ ID NO: 127697 - DNA, 20 bp, human
gtggaccgtgaggatctgtg

SEQ ID NO: 127698 - DNA, 20 bp, human
gtcatttagcaacaaatccg

SEQ ID NO: 127699 - DNA, 20 bp, human
gtggcctccattgttcttgc

SEQ ID NO: 127700 - DNA, 20 bp, human
ggagcttggatgccaaaggg

SEQ ID NO: 127701 - DNA, 20 bp, human
gctgtggtggaggaaactga

SEQ ID NO: 127702 - DNA, 20 bp, human
gtctggagaggactactcac

SEQ ID NO: 127703 - DNA, 20 bp, human
ggcagaacctggaagtccac

SEQ ID NO: 127704 - DNA, 20 bp, human
gacggctgggtcctctggag

SEQ ID NO: 127705 - DNA, 20 bp, human
gttggatgccaaagggagga

SEQ ID NO: 127706 - DNA, 20 bp, human
gtcgcctacagagctgctgg

SEQ ID NO: 127707 - DNA, 20 bp, human
gggagccacacagctcgtct

SEQ ID NO: 127708 - DNA, 20 bp, human
gctgaaaagacaggcattaa

SEQ ID NO: 127709 - DNA, 20 bp, human
gctggaggatacactctcca

SEQ ID NO: 127710 - DNA, 20 bp, human
ggaatctgcacactattctg

SEQ ID NO: 127711 - DNA, 20 bp, human
ggtttttaacaggaaccccc

SEQ ID NO: 127712 - DNA, 20 bp, human
gtagaccgagacgagctgtg

SEQ ID NO: 127713 - DNA, 20 bp, human
gaaggaaccatggagatcag

SEQ ID NO: 127714 - DNA, 20 bp, human
gattcccagtcagcaaatca

SEQ ID NO: 127715 - DNA, 20 bp, human
gtagcgagggacctagggct

SEQ ID NO: 127716 - DNA, 20 bp, human
gcaacctggccaatgaccta

SEQ ID NO: 127717 - DNA, 20 bp, human
gggagcgctttcccgaacaa

SEQ ID NO: 127718 - DNA, 20 bp, human
gtagcattctccggagacac

SEQ ID NO: 127719 - DNA, 20 bp, human
ggtaggagaatagcattctc

SEQ ID NO: 127720 - DNA, 20 bp, human
ggagcacggaccagtgtctc

SEQ ID NO: 127721 - DNA, 20 bp, human
gaaagcctgttagcagagca

SEQ ID NO: 127722 - DNA, 20 bp, human
gagacctctttcagcctaag

SEQ ID NO: 127723 - DNA, 20 bp, human
gcggagtcagagctacttca

SEQ ID NO: 127724 - DNA, 20 bp, human
gagctacttcagggagcgat

SEQ ID NO: 127725 - DNA, 20 bp, human
gataacctgttcggaaatgt

SEQ ID NO: 127726 - DNA, 20 bp, human
ggcccaacggtgtcttaaag

SEQ ID NO: 127727 - DNA, 20 bp, human
gggccaggatcatttcccag

SEQ ID NO: 127728 - DNA, 20 bp, human
gtagatcgagaggagctatg

SEQ ID NO: 127729 - DNA, 20 bp, human
ggatgcacaatcggagacaa

SEQ ID NO: 127730 - DNA, 20 bp, human
gcagctcaaggctcaaactg

SEQ ID NO: 127731 - DNA, 20 bp, human
gtgtagtatgcaaggctcag

SEQ ID NO: 127732 - DNA, 20 bp, human
gacggaataggaccccaact

SEQ ID NO: 127733 - DNA, 20 bp, human
gacctctttaagacaccgtt

SEQ ID NO: 127734 - DNA, 20 bp, human
gttcacactcacgttcgctc

SEQ ID NO: 127735 - DNA, 20 bp, human
gaatgagaagctagatcgag

SEQ ID NO: 127736 - DNA, 20 bp, human
gaggaagaggaggctttcta

SEQ ID NO: 127737 - DNA, 20 bp, human
gggatgagtggacaatccta

SEQ ID NO: 127738 - DNA, 20 bp, human
gcggtcgctccgggaaatcc

SEQ ID NO: 127739 - DNA, 20 bp, human
gtaggacacagggctctgtg

SEQ ID NO: 127740 - DNA, 20 bp, human
gtcgctgatactgggatgag

SEQ ID NO: 127741 - DNA, 20 bp, human
gcagcctaggcactattcag

SEQ ID NO: 127742 - DNA, 20 bp, human
gcagttcgataggcagaccg

SEQ ID NO: 127743 - DNA, 20 bp, human
gtcctagggcccggatttcc

SEQ ID NO: 127744 - DNA, 20 bp, human
gagtggacaatcctagggcc

SEQ ID NO: 127745 - DNA, 20 bp, human
ggtatctgggtaaggagcgt

SEQ ID NO: 127746 - DNA, 20 bp, human
gctggctcaaaaatctgcct

SEQ ID NO: 127747 - DNA, 20 bp, human
gtccagaggctcagacttgc

SEQ ID NO: 127748 - DNA, 20 bp, human
ggtgacgcacggatccagtg

SEQ ID NO: 127749 - DNA, 20 bp, human
ggagtcaagacgctattctg

SEQ ID NO: 127750 - DNA, 20 bp, human
gtgcctgggctctcaaccgc

SEQ ID NO: 127751 - DNA, 20 bp, human
gtagtatgcatggttctgtg

SEQ ID NO: 127752 - DNA, 20 bp, human
gttcactaggccgtctacaa

SEQ ID NO: 127753 - DNA, 20 bp, human
ggatctgggactaagggtag

SEQ ID NO: 127754 - DNA, 20 bp, human
gaggccgtctacaaaggttg

SEQ ID NO: 127755 - DNA, 20 bp, human
ggaggaactggccgcgaggg

SEQ ID NO: 127756 - DNA, 20 bp, human
gagcagtgcaggtttaccaa

SEQ ID NO: 127757 - DNA, 20 bp, human
gtatcgctgccccaagccgt

SEQ ID NO: 127758 - DNA, 20 bp, human
gtgcagctggatcgtcagac

SEQ ID NO: 127759 - DNA, 20 bp, human
gtctgagggagaaactagac

SEQ ID NO: 127760 - DNA, 20 bp, human
ggaagcgttacaagcagtgc

SEQ ID NO: 127761 - DNA, 20 bp, human
ggacagcacccgggctgacc

SEQ ID NO: 127762 - DNA, 20 bp, human
gtcatcgtcagacagcaccc

SEQ ID NO: 127763 - DNA, 20 bp, human
gcatccaaacaggcaagtgt

SEQ ID NO: 127764 - DNA, 20 bp, human
ggcaggtttaccaacggctt

SEQ ID NO: 127765 - DNA, 20 bp, human
gactggagatttgcttctga

SEQ ID NO: 127766 - DNA, 20 bp, human
ggcgcgcgaatgcattacaa

SEQ ID NO: 127767 - DNA, 20 bp, human
gctggaccgggtctgaacaa

SEQ ID NO: 127768 - DNA, 20 bp, human
ggcgctgcaggctaagagtg

SEQ ID NO: 127769 - DNA, 20 bp, human
ggtggctagatcttcagggt

SEQ ID NO: 127770 - DNA, 20 bp, human
ggtgtggatagtgggctctg

SEQ ID NO: 127771 - DNA, 20 bp, human
gcgccccgcacatcacctcc

SEQ ID NO: 127772 - DNA, 20 bp, human
gtctagtggctagatcttca

SEQ ID NO: 127773 - DNA, 20 bp, human
gtgcagcttgatataaagac

SEQ ID NO: 127774 - DNA, 20 bp, human
gtgggggaactggccactcg

SEQ ID NO: 127775 - DNA, 20 bp, human
ggaccgggaggtgatgtgcg

SEQ ID NO: 127776 - DNA, 20 bp, human
ggagatagatgtgtccggga

SEQ ID NO: 127777 - DNA, 20 bp, human
gagctgagatagatgtgtcc

SEQ ID NO: 127778 - DNA, 20 bp, human
ggaaagctctgcagactcgg

SEQ ID NO: 127779 - DNA, 20 bp, human
gtcagctttagctgtaaacg

SEQ ID NO: 127780 - DNA, 20 bp, human
gacaaaggacctgggactga

SEQ ID NO: 127781 - DNA, 20 bp, human
ggcagtaaatcatgggtctg

SEQ ID NO: 127782 - DNA, 20 bp, human
gctggcgacgactgccttcc

SEQ ID NO: 127783 - DNA, 20 bp, human
gagagggtcgacggtagatg

SEQ ID NO: 127784 - DNA, 20 bp, human
ggcgctcgggttgttttcaa

SEQ ID NO: 127785 - DNA, 20 bp, human
gctaaatgaaaaactggacc

SEQ ID NO: 127786 - DNA, 20 bp, human
gagcataggaaaggaaacag

SEQ ID NO: 127787 - DNA, 20 bp, human
gtaggggaactgagagcccg

SEQ ID NO: 127788 - DNA, 20 bp, human
gcaacttggcaaaagaccta

SEQ ID NO: 127789 - DNA, 20 bp, human
ggaagagaaaagcataggaa

SEQ ID NO: 127790 - DNA, 20 bp, human
gtggcggaggaaaccgagag

SEQ ID NO: 127791 - DNA, 20 bp, human
gctccagcggctctcacaaa

SEQ ID NO: 127792 - DNA, 20 bp, human
gactggaaaggcagcacaca

SEQ ID NO: 127793 - DNA, 20 bp, human
gctctcacaaatggcagcag

SEQ ID NO: 127794 - DNA, 20 bp, human
gaaacagtggtaataggaat

SEQ ID NO: 127795 - DNA, 20 bp, human
gtgcacagcacgctccactc

SEQ ID NO: 127796 - DNA, 20 bp, human
gttatcctgcagcgccacca

SEQ ID NO: 127797 - DNA, 20 bp, human
gatcctgtgaggacccgtgg

SEQ ID NO: 127798 - DNA, 20 bp, human
gctgtggtggaggaaactga

SEQ ID NO: 127799 - DNA, 20 bp, human
gggagcagagggaattctcc

SEQ ID NO: 127800 - DNA, 20 bp, human
ggacctgggtctggagcaga

SEQ ID NO: 127801 - DNA, 20 bp, human
gagcagaacctggaagtcca

SEQ ID NO: 127802 - DNA, 20 bp, human
ggagggaattctccaggcgg

SEQ ID NO: 127803 - DNA, 20 bp, human
ggaacctagaagctattctg

SEQ ID NO: 127804 - DNA, 20 bp, human
ggaagctcatttgcagacaa

SEQ ID NO: 127805 - DNA, 20 bp, human
gttggcatccaagctccccg

SEQ ID NO: 127806 - DNA, 20 bp, human
gtcactaataaaggaagaca

SEQ ID NO: 127807 - DNA, 20 bp, human
ggctttagctgccaaagatt

SEQ ID NO: 127808 - DNA, 20 bp, human
gctatgcaagtcactaataa

SEQ ID NO: 127809 - DNA, 20 bp, human
gagctgccaaagattgggaa

SEQ ID NO: 127810 - DNA, 20 bp, human
gcggtttgggaattgctctg

SEQ ID NO: 127811 - DNA, 20 bp, human
ggctgtggctgtaaccaact

SEQ ID NO: 127812 - DNA, 20 bp, human
gcaggctaaagagacggttt

SEQ ID NO: 127813 - DNA, 20 bp, human
gataacgtatgcagcagcta

SEQ ID NO: 127814 - DNA, 20 bp, human
ggctacacggcgtaggtgca

SEQ ID NO: 127815 - DNA, 20 bp, human
ggcatacgttatttcctagt

SEQ ID NO: 127816 - DNA, 20 bp, human
gtggagagtcatccagaagt

SEQ ID NO: 127817 - DNA, 20 bp, human
gcggttatggaggttctaag

SEQ ID NO: 127818 - DNA, 20 bp, human
gtcgctctgaatcctagaag

SEQ ID NO: 127819 - DNA, 20 bp, human
gtaggattcagagcgaaaag

SEQ ID NO: 127820 - DNA, 20 bp, human
gttcaatctggcggttatgg

SEQ ID NO: 127821 - DNA, 20 bp, human
gtcatccagaagtaggattt

SEQ ID NO: 127822 - DNA, 20 bp, human
gggacagtcagttttcaatc

SEQ ID NO: 127823 - DNA, 20 bp, human
gtgatcaagctgccacttct

SEQ ID NO: 127824 - DNA, 20 bp, human
ggacctagggctgcaacccc

SEQ ID NO: 127825 - DNA, 20 bp, human
gttttcaggagaattctgac

SEQ ID NO: 127826 - DNA, 20 bp, human
gagcctttctctaattcctc

SEQ ID NO: 127827 - DNA, 20 bp, human
gaaccggctgctgggctgca

SEQ ID NO: 127828 - DNA, 20 bp, human
gctacacaagccccacaaac

SEQ ID NO: 127829 - DNA, 20 bp, human
ggcccagcagccggtttgtg

SEQ ID NO: 127830 - DNA, 20 bp, human
ggcctgggcactttaaattc

SEQ ID NO: 127831 - DNA, 20 bp, human
gttcttcgggattccatggg

SEQ ID NO: 127832 - DNA, 20 bp, human
ggccccacaaaccggctgct

SEQ ID NO: 127833 - DNA, 20 bp, human
ggctcaaaggaatcgctcaa

SEQ ID NO: 127834 - DNA, 20 bp, human
gaatatccttgtggaagaca

SEQ ID NO: 127835 - DNA, 20 bp, human
gttcctgaggaattagagaa

SEQ ID NO: 127836 - DNA, 20 bp, human
gcacacaaagcggaatgaga

SEQ ID NO: 127837 - DNA, 20 bp, human
gtactcacagatcctgacac

SEQ ID NO: 127838 - DNA, 20 bp, human
gccgcctctaccacacaaag

SEQ ID NO: 127839 - DNA, 20 bp, human
gtcgctgtgaatccgcgaag

SEQ ID NO: 127840 - DNA, 20 bp, human
ggtgccagaagagaccgaaa

SEQ ID NO: 127841 - DNA, 20 bp, human
gacagcgcggggaccgcagt

SEQ ID NO: 127842 - DNA, 20 bp, human
gccgaaaagggctccttcgt

SEQ ID NO: 127843 - DNA, 20 bp, human
gcagcagcagcagccgactg

SEQ ID NO: 127844 - DNA, 20 bp, human
gtcgagaaaccgcggaatat

SEQ ID NO: 127845 - DNA, 20 bp, human
ggccaggcagatccgatatt

SEQ ID NO: 127846 - DNA, 20 bp, human
gaccgggaggagctctgtat

SEQ ID NO: 127847 - DNA, 20 bp, human
gtgggagtatgtggaaacaa

SEQ ID NO: 127848 - DNA, 20 bp, human
gcccatagaatgggacagtt

SEQ ID NO: 127849 - DNA, 20 bp, human
gctaggaatgaaccatccct

SEQ ID NO: 127850 - DNA, 20 bp, human
gctgccgctgcgcggattca

SEQ ID NO: 127851 - DNA, 20 bp, human
gactgcaccgggactacaaa

SEQ ID NO: 127852 - DNA, 20 bp, human
ggagtatgtggaaacaacgg

SEQ ID NO: 127853 - DNA, 20 bp, human
gaaccatccctgggagtatg

SEQ ID NO: 127854 - DNA, 20 bp, human
gttccacatactcccaggga

SEQ ID NO: 127855 - DNA, 20 bp, human
ggagctggagaaaggctcta

SEQ ID NO: 127856 - DNA, 20 bp, human
gcggctcccacagcacaagg

SEQ ID NO: 127857 - DNA, 20 bp, human
gccctatggagagaactggt

SEQ ID NO: 127858 - DNA, 20 bp, human
ggacatccaatccagcaata

SEQ ID NO: 127859 - DNA, 20 bp, human
gctcccacagcacaaggggg

SEQ ID NO: 127860 - DNA, 20 bp, human
gtgcgggaagagatcgacag

SEQ ID NO: 127861 - DNA, 20 bp, human
ggcccaccagttctctccat

SEQ ID NO: 127862 - DNA, 20 bp, human
gggtttggccctaaagcttc

SEQ ID NO: 127863 - DNA, 20 bp, human
gcgggttcagagcaaagagc

SEQ ID NO: 127864 - DNA, 20 bp, human
gctcccacagggtcgccaaa

SEQ ID NO: 127865 - DNA, 20 bp, human
ggcacaagggggtggaggtt

SEQ ID NO: 127866 - DNA, 20 bp, human
ggttgactaagaggtgaggt

SEQ ID NO: 127867 - DNA, 20 bp, human
gatcagactcagaagatccg

SEQ ID NO: 127868 - DNA, 20 bp, human
gagactcagaagatccgggg

SEQ ID NO: 127869 - DNA, 20 bp, human
ggctggttgactaagaggtg

SEQ ID NO: 127870 - DNA, 20 bp, human
gaccgcggagaggatagacc

SEQ ID NO: 127871 - DNA, 20 bp, human
gtcccggtctatcctctccg

SEQ ID NO: 127872 - DNA, 20 bp, human
ggtgaggttggcagccgccc

SEQ ID NO: 127873 - DNA, 20 bp, human
gaaacagctggttgactaag

SEQ ID NO: 127874 - DNA, 20 bp, human
gcagcttggtcaccgcggag

SEQ ID NO: 127875 - DNA, 20 bp, human
gtgtctgaggagctagataa

SEQ ID NO: 127876 - DNA, 20 bp, human
gttcacagccagagctctca

SEQ ID NO: 127877 - DNA, 20 bp, human
gcagcacaaagcactggctc

SEQ ID NO: 127878 - DNA, 20 bp, human
gccccaggagaaggcagatc

SEQ ID NO: 127879 - DNA, 20 bp, human
gtttctgcagcacaaagcac

SEQ ID NO: 127880 - DNA, 20 bp, human
gaggaagaaggctcagtggt

SEQ ID NO: 127881 - DNA, 20 bp, human
ggagcagccgggtgtggtct

SEQ ID NO: 127882 - DNA, 20 bp, human
gtgtggtctgggcgagcagg

SEQ ID NO: 127883 - DNA, 20 bp, human
gcgaagcacaggcgactccg

SEQ ID NO: 127884 - DNA, 20 bp, human
ggctcctcaggcctcgacag

SEQ ID NO: 127885 - DNA, 20 bp, human
gtgctcgcccagaccacacc

SEQ ID NO: 127886 - DNA, 20 bp, human
gcaatggcgagtccacctag

SEQ ID NO: 127887 - DNA, 20 bp, human
gtcagggaatatgtacccat

SEQ ID NO: 127888 - DNA, 20 bp, human
gtaaagttcaccacacacag

SEQ ID NO: 127889 - DNA, 20 bp, human
gcgctgtgcgagccaggatc

SEQ ID NO: 127890 - DNA, 20 bp, human
gcagagtcgggtcgcctctg

SEQ ID NO: 127891 - DNA, 20 bp, human
gcaacatagccaaggacctt

SEQ ID NO: 127892 - DNA, 20 bp, human
gtggagcgttggcttttcgt

SEQ ID NO: 127893 - DNA, 20 bp, human
gagcgtccccaggagcatga

SEQ ID NO: 127894 - DNA, 20 bp, human
gcatcggctttagataaata

SEQ ID NO: 127895 - DNA, 20 bp, human
ggaaaatgggcgtggagcgt

SEQ ID NO: 127896 - DNA, 20 bp, human
gagtaatggcgcctccgcag

SEQ ID NO: 127897 - DNA, 20 bp, human
gcgtgctccgccaactcctg

SEQ ID NO: 127898 - DNA, 20 bp, human
gacctgggcaagaaaatcaa

SEQ ID NO: 127899 - DNA, 20 bp, human
gtgcgctgcggatgcctctg

SEQ ID NO: 127900 - DNA, 20 bp, human
gggacctgctcgctgcgctg

SEQ ID NO: 127901 - DNA, 20 bp, human
gtctctctgaatccgcgaaa

SEQ ID NO: 127902 - DNA, 20 bp, human
ggttcctaataagccagtaa

SEQ ID NO: 127903 - DNA, 20 bp, human
ggcttattaggaacttctct

SEQ ID NO: 127904 - DNA, 20 bp, human
ggcaaattagacgggaaagc

SEQ ID NO: 127905 - DNA, 20 bp, human
gttctcagaaatagcggtga

SEQ ID NO: 127906 - DNA, 20 bp, human
gtcagaatccagcaggatag

SEQ ID NO: 127907 - DNA, 20 bp, human
gtttagtgcagcctggaaga

SEQ ID NO: 127908 - DNA, 20 bp, human
gttgcgataagccctcttcc

SEQ ID NO: 127909 - DNA, 20 bp, human
ggacccctctgtcttaggaa

SEQ ID NO: 127910 - DNA, 20 bp, human
gagaagcaggacgactatgg

SEQ ID NO: 127911 - DNA, 20 bp, human
gaagagaagcaggacgacta

SEQ ID NO: 127912 - DNA, 20 bp, human
gctgccgctgcgctggttca

SEQ ID NO: 127913 - DNA, 20 bp, human
gtctgtgctgtaaaactcgg

SEQ ID NO: 127914 - DNA, 20 bp, human
ggcttgagtttagtgcagcc

SEQ ID NO: 127915 - DNA, 20 bp, human
gtcagaatgcgggtgtatcc

SEQ ID NO: 127916 - DNA, 20 bp, human
gctggagtgcctccaaacag

SEQ ID NO: 127917 - DNA, 20 bp, human
ggtgcctccaaacaggggtc

SEQ ID NO: 127918 - DNA, 20 bp, human
ggcatctgcgggtcttcgtg

SEQ ID NO: 127919 - DNA, 20 bp, human
ggatgccacaaactaactgc

SEQ ID NO: 127920 - DNA, 20 bp, human
ggcgaaacccgacccctgtt

SEQ ID NO: 127921 - DNA, 20 bp, human
ggtgcttcgccagcttccgg

SEQ ID NO: 127922 - DNA, 20 bp, human
gcgcgtctggggcgactctg

SEQ ID NO: 127923 - DNA, 20 bp, human
gacgctgtgggaaatcggga

SEQ ID NO: 127924 - DNA, 20 bp, human
gtatggagatgacaatcctc

SEQ ID NO: 127925 - DNA, 20 bp, human
gtgacaatcctccggaaacc

SEQ ID NO: 127926 - DNA, 20 bp, human
gtctgcggctacacaaaacc

SEQ ID NO: 127927 - DNA, 20 bp, human
gataccacaaacctgctccc

SEQ ID NO: 127928 - DNA, 20 bp, human
gctcctggggatgctatggg

SEQ ID NO: 127929 - DNA, 20 bp, human
gtcttccaccctgcaaagta

SEQ ID NO: 127930 - DNA, 20 bp, human
gaagacagagtgaaactgta

SEQ ID NO: 127931 - DNA, 20 bp, human
ggggatgctatgggaggcca

SEQ ID NO: 127932 - DNA, 20 bp, human
gatccggatttccagttctg

SEQ ID NO: 127933 - DNA, 20 bp, human
gtcgctcctggggatgctat

SEQ ID NO: 127934 - DNA, 20 bp, human
gagccgcagaactggaaatc

SEQ ID NO: 127935 - DNA, 20 bp, human
gtagcaggactaatcttccg

SEQ ID NO: 127936 - DNA, 20 bp, human
gtaggcgctcgagggtgaac

SEQ ID NO: 127937 - DNA, 20 bp, human
ggcgtctgtgctcagtgcac

SEQ ID NO: 127938 - DNA, 20 bp, human
gttccagaggagctagccaa

SEQ ID NO: 127939 - DNA, 20 bp, human
gcttattagttaggcgctcg

SEQ ID NO: 127940 - DNA, 20 bp, human
gggtgccttcctgctttgtc

SEQ ID NO: 127941 - DNA, 20 bp, human
ggagctagccaacggctcac

SEQ ID NO: 127942 - DNA, 20 bp, human
gtcagtgcaccggacaaagc

SEQ ID NO: 127943 - DNA, 20 bp, human
gtctgcaggagcgtcaggca

SEQ ID NO: 127944 - DNA, 20 bp, human
ggcggggatttgttagtgaa

SEQ ID NO: 127945 - DNA, 20 bp, human
gggatttgttagtgaacggt

SEQ ID NO: 127946 - DNA, 20 bp, human
ggagaaggccagtatagatt

SEQ ID NO: 127947 - DNA, 20 bp, human
ggatggcagaatccgggcta

SEQ ID NO: 127948 - DNA, 20 bp, human
gttccggggatggcagaatc

SEQ ID NO: 127949 - DNA, 20 bp, human
gaggaggaataagccttccg

SEQ ID NO: 127950 - DNA, 20 bp, human
ggaaggcttattcctcctat

SEQ ID NO: 127951 - DNA, 20 bp, human
gggaataagccttccgggga

SEQ ID NO: 127952 - DNA, 20 bp, human
gttgctcctttgcccatagg

SEQ ID NO: 127953 - DNA, 20 bp, human
ggatgaaagcgagctcaggg

SEQ ID NO: 127954 - DNA, 20 bp, human
gagaccgagaacagatatgc

SEQ ID NO: 127955 - DNA, 20 bp, human
gtatactggccttctctgtg

SEQ ID NO: 127956 - DNA, 20 bp, human
gtgtgcttgggttctctaat

SEQ ID NO: 127957 - DNA, 20 bp, human
gagcgaccgtatagaccgag

SEQ ID NO: 127958 - DNA, 20 bp, human
gttcccgaggagctggacag

SEQ ID NO: 127959 - DNA, 20 bp, human
gtcctgctcggagaactctt

SEQ ID NO: 127960 - DNA, 20 bp, human
ggaaaagtgcactctctatc

SEQ ID NO: 127961 - DNA, 20 bp, human
gcctgctgggcccctccatc

SEQ ID NO: 127962 - DNA, 20 bp, human
gcgggaatagcgtagcggat

SEQ ID NO: 127963 - DNA, 20 bp, human
gtaccgtgagccccgaaaat

SEQ ID NO: 127964 - DNA, 20 bp, human
gatagcgtagcggatcggtt

SEQ ID NO: 127965 - DNA, 20 bp, human
gtaacccgcaggttcctagt

SEQ ID NO: 127966 - DNA, 20 bp, human
gactgcaactaaagtccgtt

SEQ ID NO: 127967 - DNA, 20 bp, human
ggaagaattttttcttgaac

SEQ ID NO: 127968 - DNA, 20 bp, human
ggcggtgtaaaggctggcgc

SEQ ID NO: 127969 - DNA, 20 bp, human
gaattcttctttttccgagg

SEQ ID NO: 127970 - DNA, 20 bp, human
gaaaaattcttctttttccg

SEQ ID NO: 127971 - DNA, 20 bp, human
gcgaggaggaagcggtgtaa

SEQ ID NO: 127972 - DNA, 20 bp, human
ggtgagcagcaggctagaca

SEQ ID NO: 127973 - DNA, 20 bp, human
gctgcgctcacggtgaagta

SEQ ID NO: 127974 - DNA, 20 bp, human
gagcagcaggctagacaggg

SEQ ID NO: 127975 - DNA, 20 bp, human
gtagacagggaggagatatg

SEQ ID NO: 127976 - DNA, 20 bp, human
ggatttttggatctccgaac

SEQ ID NO: 127977 - DNA, 20 bp, human
gactggaactaaagcccgtt

SEQ ID NO: 127978 - DNA, 20 bp, human
gaaagaatcgtttcctaaac

SEQ ID NO: 127979 - DNA, 20 bp, human
gttagttccagttccagttt

SEQ ID NO: 127980 - DNA, 20 bp, human
gggaaacgattctttttccg

SEQ ID NO: 127981 - DNA, 20 bp, human
gtcgtttcctaaactggaac

SEQ ID NO: 127982 - DNA, 20 bp, human
gaacgattctttttccgagg

SEQ ID NO: 127983 - DNA, 20 bp, human
ggtgagcagcaggctagaca

SEQ ID NO: 127984 - DNA, 20 bp, human
gctgcgctcacggtgaagta

SEQ ID NO: 127985 - DNA, 20 bp, human
gagcagcaggctagacaggg

SEQ ID NO: 127986 - DNA, 20 bp, human
gaaaggtctgcgcagccggg

SEQ ID NO: 127987 - DNA, 20 bp, human
gggatcggctcactcagggt

SEQ ID NO: 127988 - DNA, 20 bp, human
gtagcggatcggctcactca

SEQ ID NO: 127989 - DNA, 20 bp, human
gcagacctttcccagcacag

SEQ ID NO: 127990 - DNA, 20 bp, human
ggctggcaatccgctgtgct

SEQ ID NO: 127991 - DNA, 20 bp, human
gctgcacttcagcgtagacg

SEQ ID NO: 127992 - DNA, 20 bp, human
ggttttcttctttctgttgt

SEQ ID NO: 127993 - DNA, 20 bp, human
gtcagcgtagacgcggagag

SEQ ID NO: 127994 - DNA, 20 bp, human
ggcagggaatcccaggccag

SEQ ID NO: 127995 - DNA, 20 bp, human
gcagccgggaggctctgtgt

SEQ ID NO: 127996 - DNA, 20 bp, human
ggatcggctcacacagcgtg

SEQ ID NO: 127997 - DNA, 20 bp, human
gcaatctggtgtgctgggca

SEQ ID NO: 127998 - DNA, 20 bp, human
gagctggcaatctggtgtgc

SEQ ID NO: 127999 - DNA, 20 bp, human
gatccctcagcctctagcct

SEQ ID NO: 128000 - DNA, 20 bp, human
gggtctcggagctggcaatc

SEQ ID NO: 128001 - DNA, 20 bp, human
gaatcccaggctagaggctg

SEQ ID NO: 128002 - DNA, 20 bp, human
gtggttttcttttctgttgt

SEQ ID NO: 128003 - DNA, 20 bp, human
gaaaaccagctcccacacag

SEQ ID NO: 128004 - DNA, 20 bp, human
gtcagcgtagacgcgcagag

SEQ ID NO: 128005 - DNA, 20 bp, human
gagcggggacttacttgtga

SEQ ID NO: 128006 - DNA, 20 bp, human
gcagccggcgagcaaatcaa

SEQ ID NO: 128007 - DNA, 20 bp, human
gctgggcgccgagtccgaca

SEQ ID NO: 128008 - DNA, 20 bp, human
gcagaaagccatgtcggact

SEQ ID NO: 128009 - DNA, 20 bp, human
gaacgaccgtctggatcgag

SEQ ID NO: 128010 - DNA, 20 bp, human
gtaagcaccgggagggtagt

SEQ ID NO: 128011 - DNA, 20 bp, human
ggaggcagagactgaacagc

SEQ ID NO: 128012 - DNA, 20 bp, human
gggactggtaagcaccggga

SEQ ID NO: 128013 - DNA, 20 bp, human
gaccgtggaagccttgttca

SEQ ID NO: 128014 - DNA, 20 bp, human
gctttctgcgccccgggatg

SEQ ID NO: 128015 - DNA, 20 bp, human
gtcagcccgcaggttccggg

SEQ ID NO: 128016 - DNA, 20 bp, human
gcgaccgagaggcactgtgt

SEQ ID NO: 128017 - DNA, 20 bp, human
gcttcggtgacaaactccag

SEQ ID NO: 128018 - DNA, 20 bp, human
gggccgaaccgcgccagagc

SEQ ID NO: 128019 - DNA, 20 bp, human
gtgctgccgcggaaaacggg

SEQ ID NO: 128020 - DNA, 20 bp, human
gctcctctgggaccgggtag

SEQ ID NO: 128021 - DNA, 20 bp, human
gatccgctacccggtcccag

SEQ ID NO: 128022 - DNA, 20 bp, human
gaagaacccaatcgaccgag

SEQ ID NO: 128023 - DNA, 20 bp, human
gccagagctggcgcggggaa

SEQ ID NO: 128024 - DNA, 20 bp, human
gcagtgcctctcggtcgatt

SEQ ID NO: 128025 - DNA, 20 bp, human
gggttcggccggcgccgcaa

SEQ ID NO: 128026 - DNA, 20 bp, human
gtgtctccaaggtagaccca

SEQ ID NO: 128027 - DNA, 20 bp, human
ggctggtgctggctccacat

SEQ ID NO: 128028 - DNA, 20 bp, human
ggttcagtcaccacctgcac

SEQ ID NO: 128029 - DNA, 20 bp, human
gctggagctaatccgtgtag

SEQ ID NO: 128030 - DNA, 20 bp, human
gcctcttaaaaactgctcgg

SEQ ID NO: 128031 - DNA, 20 bp, human
ggggcagcttcgttactcag

SEQ ID NO: 128032 - DNA, 20 bp, human
ggtggtgactgaacaccccc

SEQ ID NO: 128033 - DNA, 20 bp, human
gcgtgtagaggtagagatcc

SEQ ID NO: 128034 - DNA, 20 bp, human
gggtggaggagtctgagccg

SEQ ID NO: 128035 - DNA, 20 bp, human
gcagtttttaagaggctgga

SEQ ID NO: 128036 - DNA, 20 bp, human
gggcccgggaaccacctcca

SEQ ID NO: 128037 - DNA, 20 bp, human
ggtcatggcgacgctccgag

SEQ ID NO: 128038 - DNA, 20 bp, human
gcccggagccaggcctaccg

SEQ ID NO: 128039 - DNA, 20 bp, human
gcgctggcgccggccgaatc

SEQ ID NO: 128040 - DNA, 20 bp, human
ggaaccacctccagggtgag

SEQ ID NO: 128041 - DNA, 20 bp, human
gagggtgcggcggtgagacc

SEQ ID NO: 128042 - DNA, 20 bp, human
ggggctgcaggctgatccta

SEQ ID NO: 128043 - DNA, 20 bp, human
ggtggttcccgggccggatt

SEQ ID NO: 128044 - DNA, 20 bp, human
ggagcgcgtccgcgtcgtca

SEQ ID NO: 128045 - DNA, 20 bp, human
gggtgggcgagccggcgtgt

SEQ ID NO: 128046 - DNA, 20 bp, human
ggggcgcgaagcccaggtac

SEQ ID NO: 128047 - DNA, 20 bp, human
gtcggggcggcagccaagtg

SEQ ID NO: 128048 - DNA, 20 bp, human
ggagaccccagcccgtacct

SEQ ID NO: 128049 - DNA, 20 bp, human
gcactgtgggcagcctcact

SEQ ID NO: 128050 - DNA, 20 bp, human
gcactttccggcaggagact

SEQ ID NO: 128051 - DNA, 20 bp, human
gccccctcggagcgcccctg

SEQ ID NO: 128052 - DNA, 20 bp, human
ggcggtgcgcaggcataccc

SEQ ID NO: 128053 - DNA, 20 bp, human
ggctcagatctcgctgaggg

SEQ ID NO: 128054 - DNA, 20 bp, human
ggggtcgcgggtgaacaccg

SEQ ID NO: 128055 - DNA, 20 bp, human
gctcgccacgtgacccggac

SEQ ID NO: 128056 - DNA, 20 bp, human
gagaggaagaaagctatcta

SEQ ID NO: 128057 - DNA, 20 bp, human
ggaactggagaagggacgtg

SEQ ID NO: 128058 - DNA, 20 bp, human
gtcacaatgatctacaggag

SEQ ID NO: 128059 - DNA, 20 bp, human
gctcagagcttgggctatag

SEQ ID NO: 128060 - DNA, 20 bp, human
gagctctgagatctcccgtc

SEQ ID NO: 128061 - DNA, 20 bp, human
gatgttgtggttgaccacaa

SEQ ID NO: 128062 - DNA, 20 bp, human
gtctggtcacaatgatctac

SEQ ID NO: 128063 - DNA, 20 bp, human
gcttgggctataggggaaat

SEQ ID NO: 128064 - DNA, 20 bp, human
ggtggttgaccacaaaggct

SEQ ID NO: 128065 - DNA, 20 bp, human
gttagttgtgaactggagaa

SEQ ID NO: 128066 - DNA, 20 bp, human
ggagtttcaagcagccgcgg

SEQ ID NO: 128067 - DNA, 20 bp, human
gagcttggctgctgcgtcca

SEQ ID NO: 128068 - DNA, 20 bp, human
ggcggcgcagccaatccgag

SEQ ID NO: 128069 - DNA, 20 bp, human
ggctcttcgctggctcccgg

SEQ ID NO: 128070 - DNA, 20 bp, human
ggcgcagccaatccgagagg

SEQ ID NO: 128071 - DNA, 20 bp, human
ggctggaggaggaaagcggg

SEQ ID NO: 128072 - DNA, 20 bp, human
ggaggagtttcaagcagccg

SEQ ID NO: 128073 - DNA, 20 bp, human
gcagcctcccgagtgcggag

SEQ ID NO: 128074 - DNA, 20 bp, human
gccgttctagaggtccgggt

SEQ ID NO: 128075 - DNA, 20 bp, human
ggcgggcggcaccctctagc

SEQ ID NO: 128076 - DNA, 20 bp, human
ggagatcacccgcgagacgg

SEQ ID NO: 128077 - DNA, 20 bp, human
gagtagatgttgcgaaagtc

SEQ ID NO: 128078 - DNA, 20 bp, human
gagaggaagaggagtcggaa

SEQ ID NO: 128079 - DNA, 20 bp, human
gggaggcggggtatccagag

SEQ ID NO: 128080 - DNA, 20 bp, human
gagacgatctccttggcgaa

SEQ ID NO: 128081 - DNA, 20 bp, human
gcggagccgcgagagagccg

SEQ ID NO: 128082 - DNA, 20 bp, human
gatgagagagacgatctcct

SEQ ID NO: 128083 - DNA, 20 bp, human
ggtcgtgcgaaatgaactag

SEQ ID NO: 128084 - DNA, 20 bp, human
ggagaacctgcccttcgcca

SEQ ID NO: 128085 - DNA, 20 bp, human
gttcgcacgacgcagcggtt

SEQ ID NO: 128086 - DNA, 20 bp, human
gtcgcaatctggcccccctg

SEQ ID NO: 128087 - DNA, 20 bp, human
gtaagatggcgtctcctcag

SEQ ID NO: 128088 - DNA, 20 bp, human
ggcccccaggagctaatccc

SEQ ID NO: 128089 - DNA, 20 bp, human
ggtcaggcgagtccacgtga

SEQ ID NO: 128090 - DNA, 20 bp, human
gaggaggcgacccccaaggt

SEQ ID NO: 128091 - DNA, 20 bp, human
gagggctccgcgcacagcgg

SEQ ID NO: 128092 - DNA, 20 bp, human
gcagagggctccgcgcacag

SEQ ID NO: 128093 - DNA, 20 bp, human
gccgtctagtgtgatgaagg

SEQ ID NO: 128094 - DNA, 20 bp, human
gagtctcccctgggaaagga

SEQ ID NO: 128095 - DNA, 20 bp, human
ggtcagcttggtgaagacta

SEQ ID NO: 128096 - DNA, 20 bp, human
ggcgggaggggagaaaccta

SEQ ID NO: 128097 - DNA, 20 bp, human
ggccgcccgggcgagcgaca

SEQ ID NO: 128098 - DNA, 20 bp, human
gcggaacagggtctgcccgg

SEQ ID NO: 128099 - DNA, 20 bp, human
ggcagccgtgtcgctcgccc

SEQ ID NO: 128100 - DNA, 20 bp, human
ggagaaacctacggtaagaa

SEQ ID NO: 128101 - DNA, 20 bp, human
gtagcgagggggaaggtccg

SEQ ID NO: 128102 - DNA, 20 bp, human
ggctgggctagggactgacg

SEQ ID NO: 128103 - DNA, 20 bp, human
ggagcctccccctcccatcg

SEQ ID NO: 128104 - DNA, 20 bp, human
gctgttccgaggtagcgagg

SEQ ID NO: 128105 - DNA, 20 bp, human
gcgcaagccccgatgggagg

SEQ ID NO: 128106 - DNA, 20 bp, human
gctcctggtcgccggccaga

SEQ ID NO: 128107 - DNA, 20 bp, human
gccagcgccaggtggagccg

SEQ ID NO: 128108 - DNA, 20 bp, human
gagtcgggcgagcgccaaga

SEQ ID NO: 128109 - DNA, 20 bp, human
gggctgggcccgactcccac

SEQ ID NO: 128110 - DNA, 20 bp, human
gtcgagctggggtcactcgg

SEQ ID NO: 128111 - DNA, 20 bp, human
gcgccctctggccggcgacc

SEQ ID NO: 128112 - DNA, 20 bp, human
gctggggctccggtccgcag

SEQ ID NO: 128113 - DNA, 20 bp, human
ggggcgaaagcattcacccg

SEQ ID NO: 128114 - DNA, 20 bp, human
gccagtgtgcgcaggtctcc

SEQ ID NO: 128115 - DNA, 20 bp, human
gttggaaacgccgggagtag

SEQ ID NO: 128116 - DNA, 20 bp, human
gctgggtcccccccaagagg

SEQ ID NO: 128117 - DNA, 20 bp, human
gcctctgggtcccccccaag

SEQ ID NO: 128118 - DNA, 20 bp, human
ggaggagaaaaaagcccgtc

SEQ ID NO: 128119 - DNA, 20 bp, human
gtttgttttaaactccggac

SEQ ID NO: 128120 - DNA, 20 bp, human
gagccttccgggccggacac

SEQ ID NO: 128121 - DNA, 20 bp, human
gtccgcgccggaggggggag

SEQ ID NO: 128122 - DNA, 20 bp, human
gccggaaggctccgaacccc

SEQ ID NO: 128123 - DNA, 20 bp, human
ggccaggccgacggggacga

SEQ ID NO: 128124 - DNA, 20 bp, human
ggcatgcgcggtgtgcgtct

SEQ ID NO: 128125 - DNA, 20 bp, human
gttcccgggccaggccgacg

SEQ ID NO: 128126 - DNA, 20 bp, human
gggtccggtgccgcctccaa

SEQ ID NO: 128127 - DNA, 20 bp, human
gccgcccggtacctacccag

SEQ ID NO: 128128 - DNA, 20 bp, human
gccgctctccccgccgaggt

SEQ ID NO: 128129 - DNA, 20 bp, human
ggtggagttgcccttggagg

SEQ ID NO: 128130 - DNA, 20 bp, human
gactcggctcaggcccgaca

SEQ ID NO: 128131 - DNA, 20 bp, human
gggtgccgccggttggaagt

SEQ ID NO: 128132 - DNA, 20 bp, human
gggagctgtgcctacctcgg

SEQ ID NO: 128133 - DNA, 20 bp, human
gtgcagggggctaccgaccc

SEQ ID NO: 128134 - DNA, 20 bp, human
gcgcgccggcctcagagtga

SEQ ID NO: 128135 - DNA, 20 bp, human
ggggtggtactaagatccta

SEQ ID NO: 128136 - DNA, 20 bp, human
gggtccggtgccgcctccaa

SEQ ID NO: 128137 - DNA, 20 bp, human
ggtggagttgcccttggagg

SEQ ID NO: 128138 - DNA, 20 bp, human
gggtgccgccggttggaagt

SEQ ID NO: 128139 - DNA, 20 bp, human
gactcggctcaggcccgaca

SEQ ID NO: 128140 - DNA, 20 bp, human
gagtgtgggtccagagatca

SEQ ID NO: 128141 - DNA, 20 bp, human
gtccacccacttccaaccgg

SEQ ID NO: 128142 - DNA, 20 bp, human
gcagataaggtgcaaatcaa

SEQ ID NO: 128143 - DNA, 20 bp, human
ggggcctcggggcccaggtc

SEQ ID NO: 128144 - DNA, 20 bp, human
gtgcagggggagagcagacg

SEQ ID NO: 128145 - DNA, 20 bp, human
gaccgaaggggtggacggtg

SEQ ID NO: 128146 - DNA, 20 bp, human
gcatggtcgggagagacacc

SEQ ID NO: 128147 - DNA, 20 bp, human
gtctctcccgaccatggagg

SEQ ID NO: 128148 - DNA, 20 bp, human
gtcgggagagacaccaggcg

SEQ ID NO: 128149 - DNA, 20 bp, human
gcgaccccgctgggcccaag

SEQ ID NO: 128150 - DNA, 20 bp, human
ggcggcggcgcactaggatc

SEQ ID NO: 128151 - DNA, 20 bp, human
gctgggcccaagcggcgtca

SEQ ID NO: 128152 - DNA, 20 bp, human
gtaggcgctgccaaaaccga

SEQ ID NO: 128153 - DNA, 20 bp, human
gcggcgcactaggatcgggc

SEQ ID NO: 128154 - DNA, 20 bp, human
gtgcgcagtggtggcgtccg

SEQ ID NO: 128155 - DNA, 20 bp, human
gacgccgcttgggcccagcg

SEQ ID NO: 128156 - DNA, 20 bp, human
gacccacctgctgcaggtac

SEQ ID NO: 128157 - DNA, 20 bp, human
gttaatggtaatgtgcgcca

SEQ ID NO: 128158 - DNA, 20 bp, human
gccatgggagcgccgccgaa

SEQ ID NO: 128159 - DNA, 20 bp, human
gggtggcgctctccgttcgg

SEQ ID NO: 128160 - DNA, 20 bp, human
gagccgcgcgagccgaacag

SEQ ID NO: 128161 - DNA, 20 bp, human
gcacacgtgccagcaagtga

SEQ ID NO: 128162 - DNA, 20 bp, human
gggcccgcttgaggcgtagg

SEQ ID NO: 128163 - DNA, 20 bp, human
ggacacagcaccgcccacag

SEQ ID NO: 128164 - DNA, 20 bp, human
gccgcttgaggcgtaggggg

SEQ ID NO: 128165 - DNA, 20 bp, human
ggccgagggcccgctgtggg

SEQ ID NO: 128166 - DNA, 20 bp, human
gcaggaatgatgacctctat

SEQ ID NO: 128167 - DNA, 20 bp, human
gacgggaaagagatgtcact

SEQ ID NO: 128168 - DNA, 20 bp, human
ggacaaaagcaaaccccaac

SEQ ID NO: 128169 - DNA, 20 bp, human
gataaaatcactcaaagtca

SEQ ID NO: 128170 - DNA, 20 bp, human
ggaggggacactcagaagac

SEQ ID NO: 128171 - DNA, 20 bp, human
gggtaatatcgtagctggtc

SEQ ID NO: 128172 - DNA, 20 bp, human
gtctgagtgtcccctcaggg

SEQ ID NO: 128173 - DNA, 20 bp, human
gccagcatttccaccctgag

SEQ ID NO: 128174 - DNA, 20 bp, human
gcccagtacagaaaacaagc

SEQ ID NO: 128175 - DNA, 20 bp, human
gttgtcacagtctccaatag

SEQ ID NO: 128176 - DNA, 20 bp, human
ggcggaggcggcaaaacggg

SEQ ID NO: 128177 - DNA, 20 bp, human
gcccggcccgggacacaaga

SEQ ID NO: 128178 - DNA, 20 bp, human
gccgcggcgaggtccctcag

SEQ ID NO: 128179 - DNA, 20 bp, human
gacccgcgggtctaagatgg

SEQ ID NO: 128180 - DNA, 20 bp, human
gcccctaccccagcgagggt

SEQ ID NO: 128181 - DNA, 20 bp, human
gcggcgaggtccctcagagg

SEQ ID NO: 128182 - DNA, 20 bp, human
ggagcccgacacaaaggcgg

SEQ ID NO: 128183 - DNA, 20 bp, human
ggagtcggagcccgacacaa

SEQ ID NO: 128184 - DNA, 20 bp, human
gcccgacacaaaggcggtgg

SEQ ID NO: 128185 - DNA, 20 bp, human
gtgcccggagcggactggag

SEQ ID NO: 128186 - DNA, 20 bp, human
gcaagcacggccttcccact

SEQ ID NO: 128187 - DNA, 20 bp, human
gggaagagggcatcctcagg

SEQ ID NO: 128188 - DNA, 20 bp, human
gatctcgaagggagatccac

SEQ ID NO: 128189 - DNA, 20 bp, human
gcacatctgtgacggctctg

SEQ ID NO: 128190 - DNA, 20 bp, human
gagcctggacagcctacccc

SEQ ID NO: 128191 - DNA, 20 bp, human
gtctgcagagtgctgctaag

SEQ ID NO: 128192 - DNA, 20 bp, human
gcttgctggcgggaagagcc

SEQ ID NO: 128193 - DNA, 20 bp, human
gctctttggatgatctcgaa

SEQ ID NO: 128194 - DNA, 20 bp, human
ggcaagtttgtgttcccagt

SEQ ID NO: 128195 - DNA, 20 bp, human
ggggaacacaaacttgctgg

SEQ ID NO: 128196 - DNA, 20 bp, human
ggagcggagccggggaggta

SEQ ID NO: 128197 - DNA, 20 bp, human
gaggtccgagggaggtatct

SEQ ID NO: 128198 - DNA, 20 bp, human
gcctaggatgggaaacctgg

SEQ ID NO: 128199 - DNA, 20 bp, human
gcactcaccgcaggccaggg

SEQ ID NO: 128200 - DNA, 20 bp, human
gggtcactcaccgcaggcca

SEQ ID NO: 128201 - DNA, 20 bp, human
gccgagggaggtatctggga

SEQ ID NO: 128202 - DNA, 20 bp, human
gcgccgcgcgtctcttggga

SEQ ID NO: 128203 - DNA, 20 bp, human
gaggccagggcggtacaatg

SEQ ID NO: 128204 - DNA, 20 bp, human
gaggatgggaaacctggcgg

SEQ ID NO: 128205 - DNA, 20 bp, human
gcctccctcggacctctaac

SEQ ID NO: 128206 - DNA, 20 bp, human
ggcgctgtccaacatggagg

SEQ ID NO: 128207 - DNA, 20 bp, human
gtccaacatggaggaggcac

SEQ ID NO: 128208 - DNA, 20 bp, human
gtgcctggcgctgtccaaca

SEQ ID NO: 128209 - DNA, 20 bp, human
gtccatgccggccgggatcg

SEQ ID NO: 128210 - DNA, 20 bp, human
gatcccggccggcatggagg

SEQ ID NO: 128211 - DNA, 20 bp, human
gcgccgaggcggcgtccggg

SEQ ID NO: 128212 - DNA, 20 bp, human
ggctcagatctgcttctccc

SEQ ID NO: 128213 - DNA, 20 bp, human
gtgcgcccttgacatgacag

SEQ ID NO: 128214 - DNA, 20 bp, human
gcatggctcagggagactcg

SEQ ID NO: 128215 - DNA, 20 bp, human
gcgggaggtgtcttctgcaa

SEQ ID NO: 128216 - DNA, 20 bp, human
gcccagaggcgggagagtaa

SEQ ID NO: 128217 - DNA, 20 bp, human
gtgcgtagctgaggtcgaaa

SEQ ID NO: 128218 - DNA, 20 bp, human
gcaatgagatcctaagatgg

SEQ ID NO: 128219 - DNA, 20 bp, human
gaggcagccaggaaacgtgt

SEQ ID NO: 128220 - DNA, 20 bp, human
ggtcgcgaggtgctcacccg

SEQ ID NO: 128221 - DNA, 20 bp, human
gtgagatcctaagatggcgg

SEQ ID NO: 128222 - DNA, 20 bp, human
gactgatcgccgggatcccc

SEQ ID NO: 128223 - DNA, 20 bp, human
gatcccggcgatcagtcctg

SEQ ID NO: 128224 - DNA, 20 bp, human
gcccgtggccagacccaaca

SEQ ID NO: 128225 - DNA, 20 bp, human
ggcccggggcaggaagaccc

SEQ ID NO: 128226 - DNA, 20 bp, human
gcgacgacgtggactggaag

SEQ ID NO: 128227 - DNA, 20 bp, human
ggagtgacaggtcccgaggg

SEQ ID NO: 128228 - DNA, 20 bp, human
ggtaacagcggcagctacag

SEQ ID NO: 128229 - DNA, 20 bp, human
gtgccgggagcgcgcagtgg

SEQ ID NO: 128230 - DNA, 20 bp, human
gagcggggcggtgacggtgt

SEQ ID NO: 128231 - DNA, 20 bp, human
gcgacgagtgacaggtcccg

SEQ ID NO: 128232 - DNA, 20 bp, human
gccagctgccctacaacggg

SEQ ID NO: 128233 - DNA, 20 bp, human
ggacgcgagcggggcggtga

SEQ ID NO: 128234 - DNA, 20 bp, human
gagcggggacgcgagcgggg

SEQ ID NO: 128235 - DNA, 20 bp, human
ggcttgcagtcgcctccctc

SEQ ID NO: 128236 - DNA, 20 bp, human
ggccccgcctctccactcgg

SEQ ID NO: 128237 - DNA, 20 bp, human
gacgccaccgccgagtggag

SEQ ID NO: 128238 - DNA, 20 bp, human
ggccaggcgctaggactcgg

SEQ ID NO: 128239 - DNA, 20 bp, human
gacggcagccgaagagtcgg

SEQ ID NO: 128240 - DNA, 20 bp, human
gccgaggacgagccgaggac

SEQ ID NO: 128241 - DNA, 20 bp, human
gcacggacgccaccgccgag

SEQ ID NO: 128242 - DNA, 20 bp, human
gccaccgccgagtggagagg

SEQ ID NO: 128243 - DNA, 20 bp, human
gcaagcccaggtcagagccg

SEQ ID NO: 128244 - DNA, 20 bp, human
gtcgtcctcggctctgacct

SEQ ID NO: 128245 - DNA, 20 bp, human
gtcgggagccggggtccctg

SEQ ID NO: 128246 - DNA, 20 bp, human
gctcggccgcggacacacga

SEQ ID NO: 128247 - DNA, 20 bp, human
gacggcggccgaggttggag

SEQ ID NO: 128248 - DNA, 20 bp, human
gcgacgggttcggaccgcct

SEQ ID NO: 128249 - DNA, 20 bp, human
gaggtgagggtgcccgaggt

SEQ ID NO: 128250 - DNA, 20 bp, human
gcggcggcggatgtttacgg

SEQ ID NO: 128251 - DNA, 20 bp, human
gcaaggcaagccaagagcta

SEQ ID NO: 128252 - DNA, 20 bp, human
gtgtttacggcggccgaggt

SEQ ID NO: 128253 - DNA, 20 bp, human
gagcagcgccgctccaacct

SEQ ID NO: 128254 - DNA, 20 bp, human
gcacacgagggacgcgcccg

SEQ ID NO: 128255 - DNA, 20 bp, human
gaggagagctccgggcgcag

SEQ ID NO: 128256 - DNA, 20 bp, human
ggggcgaacgtcgcgacgac

SEQ ID NO: 128257 - DNA, 20 bp, human
ggcgtggtgacgtcgcaacg

SEQ ID NO: 128258 - DNA, 20 bp, human
gcgctcccgccaagcaccgg

SEQ ID NO: 128259 - DNA, 20 bp, human
gaagcgctcccgccaagcac

SEQ ID NO: 128260 - DNA, 20 bp, human
gcccggcccgcctgcacctc

SEQ ID NO: 128261 - DNA, 20 bp, human
gcggacgcggcggcattaaa

SEQ ID NO: 128262 - DNA, 20 bp, human
gacgccagccaatgagggct

SEQ ID NO: 128263 - DNA, 20 bp, human
gcaggagcctcagagcgagc

SEQ ID NO: 128264 - DNA, 20 bp, human
gctgcacctccggtgcttgg

SEQ ID NO: 128265 - DNA, 20 bp, human
ggccatccgcgccttctcat

SEQ ID NO: 128266 - DNA, 20 bp, human
gggagccgctaccgccacac

SEQ ID NO: 128267 - DNA, 20 bp, human
gctcccctgcagccacgcca

SEQ ID NO: 128268 - DNA, 20 bp, human
ggggagaccgaactcggggt

SEQ ID NO: 128269 - DNA, 20 bp, human
ggtgatgtgcgtctccggtg

SEQ ID NO: 128270 - DNA, 20 bp, human
gtcccgcggcaactactcgg

SEQ ID NO: 128271 - DNA, 20 bp, human
ggaaagggagaccgaactcg

SEQ ID NO: 128272 - DNA, 20 bp, human
ggccaggaggtgacgaacag

SEQ ID NO: 128273 - DNA, 20 bp, human
gaaaatggcggacgggaagg

SEQ ID NO: 128274 - DNA, 20 bp, human
gccaggcaaggaggcgatgt

SEQ ID NO: 128275 - DNA, 20 bp, human
gggtcgtgacgtccttggcg

SEQ ID NO: 128276 - DNA, 20 bp, human
gcgcggccacagccaatcag

SEQ ID NO: 128277 - DNA, 20 bp, human
gagggcgagcccaagcgcgg

SEQ ID NO: 128278 - DNA, 20 bp, human
ggggagtgtaaatagagcga

SEQ ID NO: 128279 - DNA, 20 bp, human
gcgcagagcccatgactcgg

SEQ ID NO: 128280 - DNA, 20 bp, human
gctgcagggcggggctacag

SEQ ID NO: 128281 - DNA, 20 bp, human
gtggcgtgaagtcctaaggg

SEQ ID NO: 128282 - DNA, 20 bp, human
gcggaggacgcgggagccac

SEQ ID NO: 128283 - DNA, 20 bp, human
gcaagggcgcgggaagaaga

SEQ ID NO: 128284 - DNA, 20 bp, human
gcgagcccaagcgcggggga

SEQ ID NO: 128285 - DNA, 20 bp, human
ggcgtacgccaggcccggac

SEQ ID NO: 128286 - DNA, 20 bp, human
ggaggaggagacccgagagg

SEQ ID NO: 128287 - DNA, 20 bp, human
ggaggaggcagcaaacgagg

SEQ ID NO: 128288 - DNA, 20 bp, human
gctccggaggtggatagacg

SEQ ID NO: 128289 - DNA, 20 bp, human
gcgcggcccacaccccctgt

SEQ ID NO: 128290 - DNA, 20 bp, human
ggcccagcagaaagagccac

SEQ ID NO: 128291 - DNA, 20 bp, human
gggcccacaccccctgtcgg

SEQ ID NO: 128292 - DNA, 20 bp, human
gctgcagatcctccgacagg

SEQ ID NO: 128293 - DNA, 20 bp, human
ggaggcagcaaacgaggagg

SEQ ID NO: 128294 - DNA, 20 bp, human
gagaaagaggcccggcgcca

SEQ ID NO: 128295 - DNA, 20 bp, human
ggcggcgccgggtggggatg

SEQ ID NO: 128296 - DNA, 20 bp, human
gtgagcgccatgtccgaggg

SEQ ID NO: 128297 - DNA, 20 bp, human
gaggtgagcgccatgtccga

SEQ ID NO: 128298 - DNA, 20 bp, human
gcgcccggacccgcgaaccg

SEQ ID NO: 128299 - DNA, 20 bp, human
ggacatggcgctcacctgcc

SEQ ID NO: 128300 - DNA, 20 bp, human
ggacgtgccatcagcctcac

SEQ ID NO: 128301 - DNA, 20 bp, human
gatccttcctccctcggaca

SEQ ID NO: 128302 - DNA, 20 bp, human
gcgaaccgcggcgccggagc

SEQ ID NO: 128303 - DNA, 20 bp, human
gctcagaggcggctgctcag

SEQ ID NO: 128304 - DNA, 20 bp, human
gtccggtcccggggagctgt

SEQ ID NO: 128305 - DNA, 20 bp, human
gcgccatgtccgagggagga

SEQ ID NO: 128306 - DNA, 20 bp, human
ggccggcctaaggaggaggc

SEQ ID NO: 128307 - DNA, 20 bp, human
gtgctggtgccggcctaagg

SEQ ID NO: 128308 - DNA, 20 bp, human
gggccggccgggacagtcag

SEQ ID NO: 128309 - DNA, 20 bp, human
gacccgtcggcggcatccag

SEQ ID NO: 128310 - DNA, 20 bp, human
gggccctcaggcgccagacg

SEQ ID NO: 128311 - DNA, 20 bp, human
gtccggcctcctccttaggc

SEQ ID NO: 128312 - DNA, 20 bp, human
gccccggcccatgccccgtc

SEQ ID NO: 128313 - DNA, 20 bp, human
ggcacgggccgggtacccgt

SEQ ID NO: 128314 - DNA, 20 bp, human
gcgcatgcgccactgcaggc

SEQ ID NO: 128315 - DNA, 20 bp, human
gcgggccgggtacccgtcgg

SEQ ID NO: 128316 - DNA, 20 bp, human
ggcgcgttcggggacctcgt

SEQ ID NO: 128317 - DNA, 20 bp, human
ggcactaaccaacctcccgg

SEQ ID NO: 128318 - DNA, 20 bp, human
ggagggaagagaagacgcga

SEQ ID NO: 128319 - DNA, 20 bp, human
gcgggcactaaccaacctcc

SEQ ID NO: 128320 - DNA, 20 bp, human
gaagacgcgaaggcatccca

SEQ ID NO: 128321 - DNA, 20 bp, human
gcgtacctcaagtcacccga

SEQ ID NO: 128322 - DNA, 20 bp, human
gtcgggagcgagcacagacc

SEQ ID NO: 128323 - DNA, 20 bp, human
gggttagtgcccgaatgcgg

SEQ ID NO: 128324 - DNA, 20 bp, human
ggccgccacccggagctgaa

SEQ ID NO: 128325 - DNA, 20 bp, human
gctgcctggccggggacgac

SEQ ID NO: 128326 - DNA, 20 bp, human
ggctggggtcctcaagacag

SEQ ID NO: 128327 - DNA, 20 bp, human
ggggagacttaagagaccag

SEQ ID NO: 128328 - DNA, 20 bp, human
ggtcaaggatctgggtgggt

SEQ ID NO: 128329 - DNA, 20 bp, human
ggggggtcaaggatctgggt

SEQ ID NO: 128330 - DNA, 20 bp, human
ggcaggcagcatggccccgg

SEQ ID NO: 128331 - DNA, 20 bp, human
gtctctcttgggttctatgg

SEQ ID NO: 128332 - DNA, 20 bp, human
gagagaccagaggacgaagg

SEQ ID NO: 128333 - DNA, 20 bp, human
gttaagagaccagaggacga

SEQ ID NO: 128334 - DNA, 20 bp, human
ggggagtggtgtgtcagcaa

SEQ ID NO: 128335 - DNA, 20 bp, human
gccccgggggaaaggcgctg

SEQ ID NO: 128336 - DNA, 20 bp, human
ggcggcagcagtccccagag

SEQ ID NO: 128337 - DNA, 20 bp, human
ggtcgagcgctgggtcaccc

SEQ ID NO: 128338 - DNA, 20 bp, human
gctgctgccagtgtgagcgg

SEQ ID NO: 128339 - DNA, 20 bp, human
gttcccctgaggagctgctc

SEQ ID NO: 128340 - DNA, 20 bp, human
gggatgggtcccgaagtccc

SEQ ID NO: 128341 - DNA, 20 bp, human
gggtaacgcgacccctgccc

SEQ ID NO: 128342 - DNA, 20 bp, human
gctgccgccggagaacaaac

SEQ ID NO: 128343 - DNA, 20 bp, human
gtcacccaggcgcgccgaag

SEQ ID NO: 128344 - DNA, 20 bp, human
gcccatagacacgaggagag

SEQ ID NO: 128345 - DNA, 20 bp, human
ggcaggcgtccgccaccctc

SEQ ID NO: 128346 - DNA, 20 bp, human
gaatccacacccccacgtcc

SEQ ID NO: 128347 - DNA, 20 bp, human
gcttttaaacgtccaggacg

SEQ ID NO: 128348 - DNA, 20 bp, human
gggaccccctgacccagttg

SEQ ID NO: 128349 - DNA, 20 bp, human
gatgctggatctggcatggt

SEQ ID NO: 128350 - DNA, 20 bp, human
gcccacaacgatgctggatc

SEQ ID NO: 128351 - DNA, 20 bp, human
gcagttgtggctgtagaaag

SEQ ID NO: 128352 - DNA, 20 bp, human
gcacagcgaggtccaagctc

SEQ ID NO: 128353 - DNA, 20 bp, human
gcctctctggcactgggccg

SEQ ID NO: 128354 - DNA, 20 bp, human
gaggccagcagaaaagtgac

SEQ ID NO: 128355 - DNA, 20 bp, human
gttgtgggcaaacaattatc

SEQ ID NO: 128356 - DNA, 20 bp, human
ggttagagccaacatgagtg

SEQ ID NO: 128357 - DNA, 20 bp, human
ggtgaatgcaagccatggaa

SEQ ID NO: 128358 - DNA, 20 bp, human
gggtgagtgatgcttcgacc

SEQ ID NO: 128359 - DNA, 20 bp, human
gagagaaaagccagaaccgg

SEQ ID NO: 128360 - DNA, 20 bp, human
gtcactcacctcactcatgt

SEQ ID NO: 128361 - DNA, 20 bp, human
gcagtgttctctgtgctgag

SEQ ID NO: 128362 - DNA, 20 bp, human
gtgcccactcacattctgaa

SEQ ID NO: 128363 - DNA, 20 bp, human
gcttgtccccttcccttcca

SEQ ID NO: 128364 - DNA, 20 bp, human
ggaaagggctggccgttggg

SEQ ID NO: 128365 - DNA, 20 bp, human
gttaagagaaaagccagaac

SEQ ID NO: 128366 - DNA, 20 bp, human
ggctgggctccgagaatccc

SEQ ID NO: 128367 - DNA, 20 bp, human
ggccgcgaagaaccctccag

SEQ ID NO: 128368 - DNA, 20 bp, human
gtgagcggctctgacaggac

SEQ ID NO: 128369 - DNA, 20 bp, human
gtaggaaagctcccacctcg

SEQ ID NO: 128370 - DNA, 20 bp, human
gctgacaggacgggtcgcag

SEQ ID NO: 128371 - DNA, 20 bp, human
gaaaagcgccgtccacagta

SEQ ID NO: 128372 - DNA, 20 bp, human
gggcgctgcacgcacaggtg

SEQ ID NO: 128373 - DNA, 20 bp, human
gtgctggcacccgggattct

SEQ ID NO: 128374 - DNA, 20 bp, human
gcggggcgctgggaaacgat

SEQ ID NO: 128375 - DNA, 20 bp, human
gtgctctggtgctggcaccc

SEQ ID NO: 128376 - DNA, 20 bp, human
gtgctctgcgaagagctagg

SEQ ID NO: 128377 - DNA, 20 bp, human
gctctggagagtgcaacctg

SEQ ID NO: 128378 - DNA, 20 bp, human
gtggtctagagcccgagggt

SEQ ID NO: 128379 - DNA, 20 bp, human
ggcagtgcactgcagactcc

SEQ ID NO: 128380 - DNA, 20 bp, human
gggagtggtctagagcccga

SEQ ID NO: 128381 - DNA, 20 bp, human
gggagcgcggtcttccaagt

SEQ ID NO: 128382 - DNA, 20 bp, human
gggttgctctgcgaagagct

SEQ ID NO: 128383 - DNA, 20 bp, human
ggcttgaacaagagtgggaa

SEQ ID NO: 128384 - DNA, 20 bp, human
gcactcgcttgaacaagagt

SEQ ID NO: 128385 - DNA, 20 bp, human
gcaagcgagtgtgtgagcta

SEQ ID NO: 128386 - DNA, 20 bp, human
ggcaccgggcacggagaggt

SEQ ID NO: 128387 - DNA, 20 bp, human
gggcagggcacggttaccgg

SEQ ID NO: 128388 - DNA, 20 bp, human
ggtgccgtggacagcgtcac

SEQ ID NO: 128389 - DNA, 20 bp, human
gacaggcaccgggcacggag

SEQ ID NO: 128390 - DNA, 20 bp, human
gcggacaacgccacccgcac

SEQ ID NO: 128391 - DNA, 20 bp, human
ggtgcctgtgacgctgtcca

SEQ ID NO: 128392 - DNA, 20 bp, human
ggagtggtgggcgccagcaa

SEQ ID NO: 128393 - DNA, 20 bp, human
gccagcaagggcacttggag

SEQ ID NO: 128394 - DNA, 20 bp, human
gtggcaagtgcgcagtgccg

SEQ ID NO: 128395 - DNA, 20 bp, human
gcaaccccaaccctcgccgg

SEQ ID NO: 128396 - DNA, 20 bp, human
gggagagaaagagcgagtgt

SEQ ID NO: 128397 - DNA, 20 bp, human
gcgggcaggggtgcgaatgt

SEQ ID NO: 128398 - DNA, 20 bp, human
ggcggagcaggggactcgga

SEQ ID NO: 128399 - DNA, 20 bp, human
ggccgtgttctgctgcaact

SEQ ID NO: 128400 - DNA, 20 bp, human
gttgtggagttgcataaagg

SEQ ID NO: 128401 - DNA, 20 bp, human
gcacggctttggagtccgaa

SEQ ID NO: 128402 - DNA, 20 bp, human
ggccgggccgcctgactgca

SEQ ID NO: 128403 - DNA, 20 bp, human
ggagcaggggactcggaggg

SEQ ID NO: 128404 - DNA, 20 bp, human
ggaggggaagccgtgcagtc

SEQ ID NO: 128405 - DNA, 20 bp, human
gagtgaaaagtggtgctagg

SEQ ID NO: 128406 - DNA, 20 bp, human
gcagctgctgacatagatgg

SEQ ID NO: 128407 - DNA, 20 bp, human
gggcccaccccacagcccgg

SEQ ID NO: 128408 - DNA, 20 bp, human
ggagccgggtcccatcggtg

SEQ ID NO: 128409 - DNA, 20 bp, human
ggtgaaagtactgcccgtca

SEQ ID NO: 128410 - DNA, 20 bp, human
gcacagcccgggggcggaca

SEQ ID NO: 128411 - DNA, 20 bp, human
gggactgctggaccacgccc

SEQ ID NO: 128412 - DNA, 20 bp, human
gcaggggagccgggtcccat

SEQ ID NO: 128413 - DNA, 20 bp, human
gccctcgggggcttcagcag

SEQ ID NO: 128414 - DNA, 20 bp, human
gcgcagccacagcgcaatcg

SEQ ID NO: 128415 - DNA, 20 bp, human
gcgggatagacgggaagtgg

SEQ ID NO: 128416 - DNA, 20 bp, human
gtccccggctcggacgcagg

SEQ ID NO: 128417 - DNA, 20 bp, human
ggaccgggcgccccctctgc

SEQ ID NO: 128418 - DNA, 20 bp, human
gagcgaggcgccgggaccat

SEQ ID NO: 128419 - DNA, 20 bp, human
gagcgcgcgaggattctgag

SEQ ID NO: 128420 - DNA, 20 bp, human
ggccgggcgaaacccaactg

SEQ ID NO: 128421 - DNA, 20 bp, human
ggcgcggcggagatgaccag

SEQ ID NO: 128422 - DNA, 20 bp, human
gagcggtacaggcagcgacc

SEQ ID NO: 128423 - DNA, 20 bp, human
gggctggttccgcgcactaa

SEQ ID NO: 128424 - DNA, 20 bp, human
gcgaggattctgagtggcaa

SEQ ID NO: 128425 - DNA, 20 bp, human
ggcctcctgccgatcgcccg

SEQ ID NO: 128426 - DNA, 20 bp, human
gggcgcgcgcggaggcatag

SEQ ID NO: 128427 - DNA, 20 bp, human
gcgggcggacaggactgcgg

SEQ ID NO: 128428 - DNA, 20 bp, human
ggagctgcgagtgcgccggg

SEQ ID NO: 128429 - DNA, 20 bp, human
ggccgaggcggaccgcgtgg

SEQ ID NO: 128430 - DNA, 20 bp, human
gcgcgcgcgtgggaaggctc

SEQ ID NO: 128431 - DNA, 20 bp, human
gcagcacttgcaccgcccag

SEQ ID NO: 128432 - DNA, 20 bp, human
gcgcacgggtacctcaactt

SEQ ID NO: 128433 - DNA, 20 bp, human
ggccgcccgccgtccccaag

SEQ ID NO: 128434 - DNA, 20 bp, human
ggcggaggcatagcggcgac

SEQ ID NO: 128435 - DNA, 20 bp, human
gaaggcggcactccaccccc

SEQ ID NO: 128436 - DNA, 20 bp, human
gtgggtgctaatgaggagag

SEQ ID NO: 128437 - DNA, 20 bp, human
gaggtctcaacctctcccaa

SEQ ID NO: 128438 - DNA, 20 bp, human
ggcctccctgcggaaactcg

SEQ ID NO: 128439 - DNA, 20 bp, human
gtgagttgggaactaggtgt

SEQ ID NO: 128440 - DNA, 20 bp, human
gatacaagtggactctcccg

SEQ ID NO: 128441 - DNA, 20 bp, human
ggccgcgagtttccgcaggg

SEQ ID NO: 128442 - DNA, 20 bp, human
ggagtccacttgtatctcag

SEQ ID NO: 128443 - DNA, 20 bp, human
ggagccgactgcgagaagga

SEQ ID NO: 128444 - DNA, 20 bp, human
gggccggtgagttgggaact

SEQ ID NO: 128445 - DNA, 20 bp, human
ggccagctgtcgccgccaga

SEQ ID NO: 128446 - DNA, 20 bp, human
gcagaccctgaactgaacgg

SEQ ID NO: 128447 - DNA, 20 bp, human
gggcgccgccgttcagttca

SEQ ID NO: 128448 - DNA, 20 bp, human
gcctctcccctggccctcat

SEQ ID NO: 128449 - DNA, 20 bp, human
ggagctgacggtgcccatga

SEQ ID NO: 128450 - DNA, 20 bp, human
gtcggccaggccgtcctcct

SEQ ID NO: 128451 - DNA, 20 bp, human
gacccgcagccgggacggtg

SEQ ID NO: 128452 - DNA, 20 bp, human
gggtttccgcagcgacgtcg

SEQ ID NO: 128453 - DNA, 20 bp, human
ggacgaggacggcgactacg

SEQ ID NO: 128454 - DNA, 20 bp, human
gcaggcagtgagactggctc

SEQ ID NO: 128455 - DNA, 20 bp, human
gccgcaccttggcgcagcgg

SEQ ID NO: 128456 - DNA, 20 bp, human
ggccgccggaagcttctcgg

SEQ ID NO: 128457 - DNA, 20 bp, human
gtcctccgagaagcttccgg

SEQ ID NO: 128458 - DNA, 20 bp, human
gagctcctagtggagacctc

SEQ ID NO: 128459 - DNA, 20 bp, human
gctggccgccggaagcttct

SEQ ID NO: 128460 - DNA, 20 bp, human
gccccgtcgggcctgacctg

SEQ ID NO: 128461 - DNA, 20 bp, human
ggaggagcccggactgcgga

SEQ ID NO: 128462 - DNA, 20 bp, human
ggccgactggcagctcctag

SEQ ID NO: 128463 - DNA, 20 bp, human
gcgcccccaggcccacacta

SEQ ID NO: 128464 - DNA, 20 bp, human
gcggcctgccctccaggcgg

SEQ ID NO: 128465 - DNA, 20 bp, human
gtgctcctccgagaagcttc

SEQ ID NO: 128466 - DNA, 20 bp, human
gaggccagctgcagagcttg

SEQ ID NO: 128467 - DNA, 20 bp, human
gcagcggtgggaggactgcg

SEQ ID NO: 128468 - DNA, 20 bp, human
gcagagcttgtggaggccat

SEQ ID NO: 128469 - DNA, 20 bp, human
ggccccacacctaagagaca

SEQ ID NO: 128470 - DNA, 20 bp, human
gccaggtcaagccagaacac

SEQ ID NO: 128471 - DNA, 20 bp, human
gccacgcccattcctcaagt

SEQ ID NO: 128472 - DNA, 20 bp, human
ggccatggggcgcgtcgtcg

SEQ ID NO: 128473 - DNA, 20 bp, human
gatctgggcgcactgcgcag

SEQ ID NO: 128474 - DNA, 20 bp, human
gcgggaagatagagaaacct

SEQ ID NO: 128475 - DNA, 20 bp, human
gcgccctgaagtgtgaatgg

SEQ ID NO: 128476 - DNA, 20 bp, human
ggtggaggagaggcgccgaa

SEQ ID NO: 128477 - DNA, 20 bp, human
gctaggcgcccgggtgacag

SEQ ID NO: 128478 - DNA, 20 bp, human
gacccgctagcgcctgaatc

SEQ ID NO: 128479 - DNA, 20 bp, human
gcggtcaacgcggcgagcag

SEQ ID NO: 128480 - DNA, 20 bp, human
gtgggcgatggcattcacag

SEQ ID NO: 128481 - DNA, 20 bp, human
ggacctcccggtgagatccg

SEQ ID NO: 128482 - DNA, 20 bp, human
ggcatctccgccagcagcgg

SEQ ID NO: 128483 - DNA, 20 bp, human
gtcagcgaccctggacctcc

SEQ ID NO: 128484 - DNA, 20 bp, human
gagctaggtggggtatagga

SEQ ID NO: 128485 - DNA, 20 bp, human
gtaggtggggtataggaggg

SEQ ID NO: 128486 - DNA, 20 bp, human
gtcactgactagggaagttg

SEQ ID NO: 128487 - DNA, 20 bp, human
gtcgggggagcgtgagttgc

SEQ ID NO: 128488 - DNA, 20 bp, human
gcggcgccgcgtcactgact

SEQ ID NO: 128489 - DNA, 20 bp, human
gacctacgtggggaagtaag

SEQ ID NO: 128490 - DNA, 20 bp, human
gccagtccgctgaaaacctg

SEQ ID NO: 128491 - DNA, 20 bp, human
gcttggaccgaggaagtatg

SEQ ID NO: 128492 - DNA, 20 bp, human
gacttccctagtcagtgacg

SEQ ID NO: 128493 - DNA, 20 bp, human
gggtaggcgcggaggtgcag

SEQ ID NO: 128494 - DNA, 20 bp, human
gaagagggtgggtcagccac

SEQ ID NO: 128495 - DNA, 20 bp, human
gtaggtaaaagctaacgctg

SEQ ID NO: 128496 - DNA, 20 bp, human
ggactggtaagtaaagacaa

SEQ ID NO: 128497 - DNA, 20 bp, human
gacagctgagaaggattagg

SEQ ID NO: 128498 - DNA, 20 bp, human
gctgggaggagactctctga

SEQ ID NO: 128499 - DNA, 20 bp, human
gtaaacagctgagaaggatt

SEQ ID NO: 128500 - DNA, 20 bp, human
gcagcatcagtggtaactac

SEQ ID NO: 128501 - DNA, 20 bp, human
gttccctaggggaagtaaag

SEQ ID NO: 128502 - DNA, 20 bp, human
gagctagagggagcattcac

SEQ ID NO: 128503 - DNA, 20 bp, human
gctgagggtgtagagctaga

SEQ ID NO: 128504 - DNA, 20 bp, human
gacttaccagtcgaggctgt

SEQ ID NO: 128505 - DNA, 20 bp, human
gggaaatgtatgcgtggcta

SEQ ID NO: 128506 - DNA, 20 bp, human
gccggatcatggccccgcag

SEQ ID NO: 128507 - DNA, 20 bp, human
gggcgagcgtccctgtaggt

SEQ ID NO: 128508 - DNA, 20 bp, human
gccggtcacgccgacctctc

SEQ ID NO: 128509 - DNA, 20 bp, human
gcctccgccagaggtagacg

SEQ ID NO: 128510 - DNA, 20 bp, human
ggtggctccagatctcagcg

SEQ ID NO: 128511 - DNA, 20 bp, human
ggctccagatctcagcgcgg

SEQ ID NO: 128512 - DNA, 20 bp, human
gccgccaggcgcacgctcag

SEQ ID NO: 128513 - DNA, 20 bp, human
gacgctcgcccggaggccag

SEQ ID NO: 128514 - DNA, 20 bp, human
gcgaccccgtctacctctgg

SEQ ID NO: 128515 - DNA, 20 bp, human
gaggtagacggggtcgccca

SEQ ID NO: 128516 - DNA, 20 bp, human
gccaggtctggaaggctcat

SEQ ID NO: 128517 - DNA, 20 bp, human
gttaggcattgcggctccgg

SEQ ID NO: 128518 - DNA, 20 bp, human
gcggcgcctcgaactgacac

SEQ ID NO: 128519 - DNA, 20 bp, human
gtcccgaacggagagactag

SEQ ID NO: 128520 - DNA, 20 bp, human
gccactgacggagtgactct

SEQ ID NO: 128521 - DNA, 20 bp, human
gtgcctctcgcgtaaaacgt

SEQ ID NO: 128522 - DNA, 20 bp, human
ggcaatgcctaaaggaggtg

SEQ ID NO: 128523 - DNA, 20 bp, human
gcccgcccctcacctccttt

SEQ ID NO: 128524 - DNA, 20 bp, human
gagagggaggctgtccgcac

SEQ ID NO: 128525 - DNA, 20 bp, human
gtcctagccagccaaagagt

SEQ ID NO: 128526 - DNA, 20 bp, human
gcccactcaacaaggacacc

SEQ ID NO: 128527 - DNA, 20 bp, human
ggcctggtgtccttgttgag

SEQ ID NO: 128528 - DNA, 20 bp, human
gtacttgtggactcacagtt

SEQ ID NO: 128529 - DNA, 20 bp, human
gaagacgagttcagtagaca

SEQ ID NO: 128530 - DNA, 20 bp, human
gctggctcccaagttggaaa

SEQ ID NO: 128531 - DNA, 20 bp, human
ggaagatctggctcccaagt

SEQ ID NO: 128532 - DNA, 20 bp, human
gtagttctcccttcactcaa

SEQ ID NO: 128533 - DNA, 20 bp, human
gcgcactccttttccaactt

SEQ ID NO: 128534 - DNA, 20 bp, human
gactcgtcttgaacttcaat

SEQ ID NO: 128535 - DNA, 20 bp, human
gatcaccattctttccccta

SEQ ID NO: 128536 - DNA, 20 bp, human
gagaaggcggcactctggtg

SEQ ID NO: 128537 - DNA, 20 bp, human
gccaggcatgcagatcccac

SEQ ID NO: 128538 - DNA, 20 bp, human
gcccaaggaccggctgagag

SEQ ID NO: 128539 - DNA, 20 bp, human
ggcgccctggccagtcgtct

SEQ ID NO: 128540 - DNA, 20 bp, human
gctcacctccgcctgagcag

SEQ ID NO: 128541 - DNA, 20 bp, human
gttctccactgctcaggcgg

SEQ ID NO: 128542 - DNA, 20 bp, human
gtctgggcggtgctacaact

SEQ ID NO: 128543 - DNA, 20 bp, human
gcaggcggaggtgagcggaa

SEQ ID NO: 128544 - DNA, 20 bp, human
ggtagcaccgcccagacgac

SEQ ID NO: 128545 - DNA, 20 bp, human
gttgggcagctcgaactcct

SEQ ID NO: 128546 - DNA, 20 bp, human
gaccgagcagaagaggtcta

SEQ ID NO: 128547 - DNA, 20 bp, human
gttggttctggcaggcggag

SEQ ID NO: 128548 - DNA, 20 bp, human
gggcttcggaccgagaggtg

SEQ ID NO: 128549 - DNA, 20 bp, human
gttgatccgggagttgaaga

SEQ ID NO: 128550 - DNA, 20 bp, human
ggacgccggaaggacccaag

SEQ ID NO: 128551 - DNA, 20 bp, human
gggtgtggcttcggaccgag

SEQ ID NO: 128552 - DNA, 20 bp, human
gtacaccttaccagcaactg

SEQ ID NO: 128553 - DNA, 20 bp, human
gcgccggagtgaattgatcc

SEQ ID NO: 128554 - DNA, 20 bp, human
gggagttgaagagggctgca

SEQ ID NO: 128555 - DNA, 20 bp, human
ggttgaagagggctgcaagg

SEQ ID NO: 128556 - DNA, 20 bp, human
gccgtggcgctggtgagtaa

SEQ ID NO: 128557 - DNA, 20 bp, human
gtagctgggtgcagacgccg

SEQ ID NO: 128558 - DNA, 20 bp, human
ggccgcggtactcacacacg

SEQ ID NO: 128559 - DNA, 20 bp, human
gtccgcgtgtgtgagtaccg

SEQ ID NO: 128560 - DNA, 20 bp, human
gtggtaataagactctacaa

SEQ ID NO: 128561 - DNA, 20 bp, human
gtaccgcggcgcgaggttag

SEQ ID NO: 128562 - DNA, 20 bp, human
gaaagaagtgatgaccgggt

SEQ ID NO: 128563 - DNA, 20 bp, human
gccgggtggggccaaggata

SEQ ID NO: 128564 - DNA, 20 bp, human
gactcacacacgcggagacc

SEQ ID NO: 128565 - DNA, 20 bp, human
gtaccactaacctcgcgccg

SEQ ID NO: 128566 - DNA, 20 bp, human
gagctgggacatatgaggat

SEQ ID NO: 128567 - DNA, 20 bp, human
gcctcagaaattgtgctgag

SEQ ID NO: 128568 - DNA, 20 bp, human
gctcaaatggtgtggagaga

SEQ ID NO: 128569 - DNA, 20 bp, human
gtctcttgcctcaaatggtg

SEQ ID NO: 128570 - DNA, 20 bp, human
gtttctagctgggacatatg

SEQ ID NO: 128571 - DNA, 20 bp, human
gggaacaagtgagagaaatc

SEQ ID NO: 128572 - DNA, 20 bp, human
gcaacaagaacaatatgcat

SEQ ID NO: 128573 - DNA, 20 bp, human
gcctcatgtgagtaacgagt

SEQ ID NO: 128574 - DNA, 20 bp, human
gttgactcactctcatgtta

SEQ ID NO: 128575 - DNA, 20 bp, human
gcattttggtggctactata

SEQ ID NO: 128576 - DNA, 20 bp, human
gcgccttccgacccagctgt

SEQ ID NO: 128577 - DNA, 20 bp, human
gtaattccgggagcgaccag

SEQ ID NO: 128578 - DNA, 20 bp, human
gagcccacagctgggtcgga

SEQ ID NO: 128579 - DNA, 20 bp, human
ggccccggcggcagccatgc

SEQ ID NO: 128580 - DNA, 20 bp, human
gccgggagcgaccaggggga

SEQ ID NO: 128581 - DNA, 20 bp, human
gcccgggagaaggtgctcct

SEQ ID NO: 128582 - DNA, 20 bp, human
ggggtcggaaggcggaaatc

SEQ ID NO: 128583 - DNA, 20 bp, human
gctcctggggcagcgcggag

SEQ ID NO: 128584 - DNA, 20 bp, human
ggtgcttgccgccgtccccc

SEQ ID NO: 128585 - DNA, 20 bp, human
gaacgccgcgcacgcgtcgg

SEQ ID NO: 128586 - DNA, 20 bp, human
gctcgaaggcccagcagcac

SEQ ID NO: 128587 - DNA, 20 bp, human
gagcagcaccggcttcagaa

SEQ ID NO: 128588 - DNA, 20 bp, human
ggtgcaccggcgcatctcga

SEQ ID NO: 128589 - DNA, 20 bp, human
gcaggtgaaaacgcaaacta

SEQ ID NO: 128590 - DNA, 20 bp, human
ggagtgggcgaggtcctggg

SEQ ID NO: 128591 - DNA, 20 bp, human
ggccccggctgtagcaccgg

SEQ ID NO: 128592 - DNA, 20 bp, human
ggcctgggcgcagccacggt

SEQ ID NO: 128593 - DNA, 20 bp, human
ggtgaaaacgcaaactacgg

SEQ ID NO: 128594 - DNA, 20 bp, human
gaccgccggtgctacagccg

SEQ ID NO: 128595 - DNA, 20 bp, human
gcggtgcgcgcaggtaggcg

SEQ ID NO: 128596 - DNA, 20 bp, human
gggccagagactctccgagg

SEQ ID NO: 128597 - DNA, 20 bp, human
ggccggctgaccaggaacct

SEQ ID NO: 128598 - DNA, 20 bp, human
gggctgagggggaccttcaa

SEQ ID NO: 128599 - DNA, 20 bp, human
ggacctgcggggctacaaga

SEQ ID NO: 128600 - DNA, 20 bp, human
gattcaacctccgccagagg

SEQ ID NO: 128601 - DNA, 20 bp, human
gccgaggggtcagtaccagt

SEQ ID NO: 128602 - DNA, 20 bp, human
gagacagaagagcggggtcg

SEQ ID NO: 128603 - DNA, 20 bp, human
gtggcggaggttgaattcgg

SEQ ID NO: 128604 - DNA, 20 bp, human
gcaacctccgccagaggggg

SEQ ID NO: 128605 - DNA, 20 bp, human
gctcgcgcgcccctctcagt

SEQ ID NO: 128606 - DNA, 20 bp, human
gttccagggaacatactgat

SEQ ID NO: 128607 - DNA, 20 bp, human
ggaccaatcagtatgttccc

SEQ ID NO: 128608 - DNA, 20 bp, human
gaaaaattccccttaaatgt

SEQ ID NO: 128609 - DNA, 20 bp, human
gagctgctaaaaccccatgt

SEQ ID NO: 128610 - DNA, 20 bp, human
gaacagcagcagccaacatg

SEQ ID NO: 128611 - DNA, 20 bp, human
gagacttattcatctttcca

SEQ ID NO: 128612 - DNA, 20 bp, human
ggaatattccacttaagaag

SEQ ID NO: 128613 - DNA, 20 bp, human
gatttaaggggaatttttaa

SEQ ID NO: 128614 - DNA, 20 bp, human
gcagacatcaatgcaaaact

SEQ ID NO: 128615 - DNA, 20 bp, human
gaatgattagataataaaca

SEQ ID NO: 128616 - DNA, 20 bp, human
gggggctgcgagagtgaccg

SEQ ID NO: 128617 - DNA, 20 bp, human
gcgctgacgccgagccatgg

SEQ ID NO: 128618 - DNA, 20 bp, human
gcagcgctgacgccgagcca

SEQ ID NO: 128619 - DNA, 20 bp, human
gaggccgcgctcgcgccgag

SEQ ID NO: 128620 - DNA, 20 bp, human
gggaggcgcgccctacactc

SEQ ID NO: 128621 - DNA, 20 bp, human
ggagctgcaggccaaacacg

SEQ ID NO: 128622 - DNA, 20 bp, human
gtcaagctcctcgtccgcca

SEQ ID NO: 128623 - DNA, 20 bp, human
ggcggaccctcaatacctgt

SEQ ID NO: 128624 - DNA, 20 bp, human
gagcgcctgcgcagtggtca

SEQ ID NO: 128625 - DNA, 20 bp, human
gcgccctcgcccggagtgta

SEQ ID NO: 128626 - DNA, 20 bp, human
ggggccggggcggtaagagt

SEQ ID NO: 128627 - DNA, 20 bp, human
gcagcgacgagagacctctc

SEQ ID NO: 128628 - DNA, 20 bp, human
ggaagcggagtcggcctgag

SEQ ID NO: 128629 - DNA, 20 bp, human
ggaggaggccgcagtagaac

SEQ ID NO: 128630 - DNA, 20 bp, human
ggccgcgggggacccgacag

SEQ ID NO: 128631 - DNA, 20 bp, human
gggtaagagtaggcggccat

SEQ ID NO: 128632 - DNA, 20 bp, human
gggccgcagtagaaccggca

SEQ ID NO: 128633 - DNA, 20 bp, human
gacccgacaggggacggagg

SEQ ID NO: 128634 - DNA, 20 bp, human
gcagtagaaccggcagggaa

SEQ ID NO: 128635 - DNA, 20 bp, human
gagggaacggggttggtcgg

SEQ ID NO: 128636 - DNA, 20 bp, human
gacgagggccgaggagagag

SEQ ID NO: 128637 - DNA, 20 bp, human
gcggagccctcgccgaccaa

SEQ ID NO: 128638 - DNA, 20 bp, human
ggaccgcggacagcttacga

SEQ ID NO: 128639 - DNA, 20 bp, human
gctcgagacgctcctgaggt

SEQ ID NO: 128640 - DNA, 20 bp, human
ggcccaggttacaggattga

SEQ ID NO: 128641 - DNA, 20 bp, human
gggagagagaggtactgggc

SEQ ID NO: 128642 - DNA, 20 bp, human
ggttcgggccaaacagaccg

SEQ ID NO: 128643 - DNA, 20 bp, human
gggacagcttacgagggccg

SEQ ID NO: 128644 - DNA, 20 bp, human
gacgtgcaggcaggacaagc

SEQ ID NO: 128645 - DNA, 20 bp, human
gctgaccaggcgcgtaggtg

SEQ ID NO: 128646 - DNA, 20 bp, human
gcggtgggcctgggcgaccc

SEQ ID NO: 128647 - DNA, 20 bp, human
gggcagggccatgttcacga

SEQ ID NO: 128648 - DNA, 20 bp, human
ggccgccctggagcccgcgg

SEQ ID NO: 128649 - DNA, 20 bp, human
ggaagtgacaggaatctgag

SEQ ID NO: 128650 - DNA, 20 bp, human
gcgagcacgtcggccggcgg

SEQ ID NO: 128651 - DNA, 20 bp, human
ggccaccgcgggctccaggg

SEQ ID NO: 128652 - DNA, 20 bp, human
gacgcctgcgcgaccggcag

SEQ ID NO: 128653 - DNA, 20 bp, human
gccgggaagggccgacactg

SEQ ID NO: 128654 - DNA, 20 bp, human
ggccgcatccccgagcacgt

SEQ ID NO: 128655 - DNA, 20 bp, human
gctgcagccccgagcctccg

SEQ ID NO: 128656 - DNA, 20 bp, human
gggacacagcagcggcggag

SEQ ID NO: 128657 - DNA, 20 bp, human
gctccgggcgccggaaggaa

SEQ ID NO: 128658 - DNA, 20 bp, human
gagggatccggagcgagcta

SEQ ID NO: 128659 - DNA, 20 bp, human
gttcttaagaggaagagcag

SEQ ID NO: 128660 - DNA, 20 bp, human
gctggagacgcgagcagagg

SEQ ID NO: 128661 - DNA, 20 bp, human
ggaagacgcggagaacttgg

SEQ ID NO: 128662 - DNA, 20 bp, human
gccaggaatgggccaagcgg

SEQ ID NO: 128663 - DNA, 20 bp, human
gccgcgctgtcgggcttcgg

SEQ ID NO: 128664 - DNA, 20 bp, human
gccccggacgggaagcagag

SEQ ID NO: 128665 - DNA, 20 bp, human
ggcagctgcggactacggga

SEQ ID NO: 128666 - DNA, 20 bp, human
ggaaaccgccgggcctgaag

SEQ ID NO: 128667 - DNA, 20 bp, human
ggacgacgcgggctcttgag

SEQ ID NO: 128668 - DNA, 20 bp, human
ggagacccgcagccttctcc

SEQ ID NO: 128669 - DNA, 20 bp, human
gtcgagtgaccgccagaaga

SEQ ID NO: 128670 - DNA, 20 bp, human
ggagggcggacacaggaggt

SEQ ID NO: 128671 - DNA, 20 bp, human
gggctgcgggtctccatccg

SEQ ID NO: 128672 - DNA, 20 bp, human
ggcgcccgcttcaggcccgg

SEQ ID NO: 128673 - DNA, 20 bp, human
ggctggcgaggcgccacgga

SEQ ID NO: 128674 - DNA, 20 bp, human
gtcgcctctccctcttctgg

SEQ ID NO: 128675 - DNA, 20 bp, human
gcgccagctgcaggacgacg

SEQ ID NO: 128676 - DNA, 20 bp, human
gtgcacaaaagagagctgag

SEQ ID NO: 128677 - DNA, 20 bp, human
gccttaggggagttcaggag

SEQ ID NO: 128678 - DNA, 20 bp, human
gactcccctaaggcacacct

SEQ ID NO: 128679 - DNA, 20 bp, human
ggaccttcacaggcccgggt

SEQ ID NO: 128680 - DNA, 20 bp, human
gtcagtggagccaggaacac

SEQ ID NO: 128681 - DNA, 20 bp, human
gcccgggcctaacgagacaa

SEQ ID NO: 128682 - DNA, 20 bp, human
gcgagaagacatagtcccgg

SEQ ID NO: 128683 - DNA, 20 bp, human
gggcgccgcaggcacgaggg

SEQ ID NO: 128684 - DNA, 20 bp, human
ggatccggcaagaccttcac

SEQ ID NO: 128685 - DNA, 20 bp, human
gtacccacccgggcctgtga

SEQ ID NO: 128686 - DNA, 20 bp, human
gccgagccatggcgtccgag

SEQ ID NO: 128687 - DNA, 20 bp, human
gccgctggccacgagcagac

SEQ ID NO: 128688 - DNA, 20 bp, human
gccgggcccgacgtttctag

SEQ ID NO: 128689 - DNA, 20 bp, human
gccgggcagacgagactcgg

SEQ ID NO: 128690 - DNA, 20 bp, human
gcgccgggcctcaccttcgg

SEQ ID NO: 128691 - DNA, 20 bp, human
gtcgccgggcagacgagact

SEQ ID NO: 128692 - DNA, 20 bp, human
ggtccgagcggctccctaac

SEQ ID NO: 128693 - DNA, 20 bp, human
gtcctggggcaagggtacca

SEQ ID NO: 128694 - DNA, 20 bp, human
gaggtcaccgcaccacggag

SEQ ID NO: 128695 - DNA, 20 bp, human
ggggagccgctcggacgcca

SEQ ID NO: 128696 - DNA, 20 bp, human
ggaggggacccgggacgaga

SEQ ID NO: 128697 - DNA, 20 bp, human
ggcgagcgccaagggagcgc

SEQ ID NO: 128698 - DNA, 20 bp, human
ggacgagaaggcgagcgcca

SEQ ID NO: 128699 - DNA, 20 bp, human
ggcgccctctctgcgcgcgg

SEQ ID NO: 128700 - DNA, 20 bp, human
gaaactccgcggcgtcccca

SEQ ID NO: 128701 - DNA, 20 bp, human
ggcgctcgccttctcgtccc

SEQ ID NO: 128702 - DNA, 20 bp, human
gtgctggtggggacgctcaa

SEQ ID NO: 128703 - DNA, 20 bp, human
gccaccagcagtagtcaccg

SEQ ID NO: 128704 - DNA, 20 bp, human
gccagcagtagtcaccgcgg

SEQ ID NO: 128705 - DNA, 20 bp, human
gccggcgccctctctgcgcg

SEQ ID NO: 128706 - DNA, 20 bp, human
gcagcggcggcagccagaac

SEQ ID NO: 128707 - DNA, 20 bp, human
gacaggagcagcgatagctc

SEQ ID NO: 128708 - DNA, 20 bp, human
gggaacagctagaggcctcg

SEQ ID NO: 128709 - DNA, 20 bp, human
ggctatcgctgctcctgttc

SEQ ID NO: 128710 - DNA, 20 bp, human
ggcaggagatggttgaaaag

SEQ ID NO: 128711 - DNA, 20 bp, human
gctgaactgggaatactggt

SEQ ID NO: 128712 - DNA, 20 bp, human
ggcggcggcagctcagtgct

SEQ ID NO: 128713 - DNA, 20 bp, human
gtgagtggaccgctgtgaca

SEQ ID NO: 128714 - DNA, 20 bp, human
gtcacagcggtccactcatc

SEQ ID NO: 128715 - DNA, 20 bp, human
gagattacttgatgcggaag

SEQ ID NO: 128716 - DNA, 20 bp, human
ggcgcttcgggtgatccgga

SEQ ID NO: 128717 - DNA, 20 bp, human
gctactgtcaggtggagctg

SEQ ID NO: 128718 - DNA, 20 bp, human
gcgatcagcggcctactgtc

SEQ ID NO: 128719 - DNA, 20 bp, human
gtcgagcccgaaggcctcta

SEQ ID NO: 128720 - DNA, 20 bp, human
gtagcggtcgacaagacccg

SEQ ID NO: 128721 - DNA, 20 bp, human
gaagacccgcggccgatcag

SEQ ID NO: 128722 - DNA, 20 bp, human
gggtagtacagcttcaccac

SEQ ID NO: 128723 - DNA, 20 bp, human
ggccggccgaatgctagcgg

SEQ ID NO: 128724 - DNA, 20 bp, human
gggctgaggactcgacccag

SEQ ID NO: 128725 - DNA, 20 bp, human
gagcctccacatgaacctgg

SEQ ID NO: 128726 - DNA, 20 bp, human
ggtgctgatgtacaaagctg

SEQ ID NO: 128727 - DNA, 20 bp, human
gacaagttgttagctgaggt

SEQ ID NO: 128728 - DNA, 20 bp, human
gggaaactagcccacaaagg

SEQ ID NO: 128729 - DNA, 20 bp, human
ggtcttaggagcatcatcat

SEQ ID NO: 128730 - DNA, 20 bp, human
gaaatgtggcagcgcctgaa

SEQ ID NO: 128731 - DNA, 20 bp, human
gcctgtaagatacttaaaag

SEQ ID NO: 128732 - DNA, 20 bp, human
gtggtgctatccgcctttgt

SEQ ID NO: 128733 - DNA, 20 bp, human
gatttgctattgactttgac

SEQ ID NO: 128734 - DNA, 20 bp, human
gattaaagtaaggtaacttc

SEQ ID NO: 128735 - DNA, 20 bp, human
gtattaacgtgactaattgt

SEQ ID NO: 128736 - DNA, 20 bp, human
gaatagagctcgtaaactgt

SEQ ID NO: 128737 - DNA, 20 bp, human
ggtcttaggagcatcatcat

SEQ ID NO: 128738 - DNA, 20 bp, human
ggtgctgatgtacaaagctg

SEQ ID NO: 128739 - DNA, 20 bp, human
gtactgctgtctgcttaggg

SEQ ID NO: 128740 - DNA, 20 bp, human
gacaagttgttagctgaggt

SEQ ID NO: 128741 - DNA, 20 bp, human
gggaaactagcccacaaagg

SEQ ID NO: 128742 - DNA, 20 bp, human
gcctgtaagatacttaaaag

SEQ ID NO: 128743 - DNA, 20 bp, human
gaaatgtggcagcgcctgaa

SEQ ID NO: 128744 - DNA, 20 bp, human
ggagagcttgagtactcagt

SEQ ID NO: 128745 - DNA, 20 bp, human
gagtagcaggctcacatgta

SEQ ID NO: 128746 - DNA, 20 bp, human
gggtgcggagagcttggact

SEQ ID NO: 128747 - DNA, 20 bp, human
gtccccggcccgggaatggg

SEQ ID NO: 128748 - DNA, 20 bp, human
ggggagcccaaagctcggct

SEQ ID NO: 128749 - DNA, 20 bp, human
gggactgggagcccaaagct

SEQ ID NO: 128750 - DNA, 20 bp, human
gcggtctacggaacagaagg

SEQ ID NO: 128751 - DNA, 20 bp, human
gctctaggctcggcccaagc

SEQ ID NO: 128752 - DNA, 20 bp, human
gagcggcggtgcggagagct

SEQ ID NO: 128753 - DNA, 20 bp, human
gatggggggaagggacctta

SEQ ID NO: 128754 - DNA, 20 bp, human
gggtgagggtctctcggctg

SEQ ID NO: 128755 - DNA, 20 bp, human
gggcctggccacgcgtgtca

SEQ ID NO: 128756 - DNA, 20 bp, human
ggccccagggcccccaagag

SEQ ID NO: 128757 - DNA, 20 bp, human
gaggaaggcaggggccaaag

SEQ ID NO: 128758 - DNA, 20 bp, human
gaggatgttggcagtcagga

SEQ ID NO: 128759 - DNA, 20 bp, human
ggaaggaatgtgaggtccta

SEQ ID NO: 128760 - DNA, 20 bp, human
gggaagttgtcccctcttgg

SEQ ID NO: 128761 - DNA, 20 bp, human
ggcttcttcttgactatggt

SEQ ID NO: 128762 - DNA, 20 bp, human
gtgtgaggtcctaaggatgt

SEQ ID NO: 128763 - DNA, 20 bp, human
ggaggggacaacttcctctt

SEQ ID NO: 128764 - DNA, 20 bp, human
gcctccagggccccattctc

SEQ ID NO: 128765 - DNA, 20 bp, human
gccctccccaaagttctctc

SEQ ID NO: 128766 - DNA, 20 bp, human
ggctgcaggtaggtgaccac

SEQ ID NO: 128767 - DNA, 20 bp, human
ggcaggtaggtgaccactgg

SEQ ID NO: 128768 - DNA, 20 bp, human
gcgactccatagctgcaggt

SEQ ID NO: 128769 - DNA, 20 bp, human
ggctctaagtcggagtctgg

SEQ ID NO: 128770 - DNA, 20 bp, human
gggtttggaggtgaaaagga

SEQ ID NO: 128771 - DNA, 20 bp, human
gcagctcgcgatgcccagcc

SEQ ID NO: 128772 - DNA, 20 bp, human
ggctatggagtcgccaacca

SEQ ID NO: 128773 - DNA, 20 bp, human
gagcgcgcagctaaagggtt

SEQ ID NO: 128774 - DNA, 20 bp, human
gatcggagtccgctctaagt

SEQ ID NO: 128775 - DNA, 20 bp, human
gagggataagcacagggata

SEQ ID NO: 128776 - DNA, 20 bp, human
gagagccagccgagcagcag

SEQ ID NO: 128777 - DNA, 20 bp, human
gtgagtccaggctgagtagg

SEQ ID NO: 128778 - DNA, 20 bp, human
ggggcagcagagctggattg

SEQ ID NO: 128779 - DNA, 20 bp, human
gcggacgatgaggagtgatg

SEQ ID NO: 128780 - DNA, 20 bp, human
ggagccgtgagtatagtgag

SEQ ID NO: 128781 - DNA, 20 bp, human
gactcccaggaccctgtctg

SEQ ID NO: 128782 - DNA, 20 bp, human
gcgcctccccagccagacta

SEQ ID NO: 128783 - DNA, 20 bp, human
gcccagcctcatcacctact

SEQ ID NO: 128784 - DNA, 20 bp, human
gttacctctgagcagaatga

SEQ ID NO: 128785 - DNA, 20 bp, human
ggctgcagtctggcaacgcg

SEQ ID NO: 128786 - DNA, 20 bp, human
gccagcagcgcgacagccag

SEQ ID NO: 128787 - DNA, 20 bp, human
gcagcgcgacagccagaggc

SEQ ID NO: 128788 - DNA, 20 bp, human
gcatccagaagaaggcacac

SEQ ID NO: 128789 - DNA, 20 bp, human
gctgcagccggacatctcgg

SEQ ID NO: 128790 - DNA, 20 bp, human
ggacatctcggcggacacga

SEQ ID NO: 128791 - DNA, 20 bp, human
ggtcctgaccgcgctagtca

SEQ ID NO: 128792 - DNA, 20 bp, human
gctgctgcagccggacatct

SEQ ID NO: 128793 - DNA, 20 bp, human
gaacaccgggatatcttcct

SEQ ID NO: 128794 - DNA, 20 bp, human
ggccggggtgcgcctgcctc

SEQ ID NO: 128795 - DNA, 20 bp, human
ggactgaagagcagcgccga

SEQ ID NO: 128796 - DNA, 20 bp, human
gaggtgcccgagggaaaagg

SEQ ID NO: 128797 - DNA, 20 bp, human
gctgagtctccagtcccgag

SEQ ID NO: 128798 - DNA, 20 bp, human
gcaccgcgcggactgaggag

SEQ ID NO: 128799 - DNA, 20 bp, human
ggagaggtgcccgagggaaa

SEQ ID NO: 128800 - DNA, 20 bp, human
gagtcccgagaggtgcccga

SEQ ID NO: 128801 - DNA, 20 bp, human
gtaactgttgcagccagcgg

SEQ ID NO: 128802 - DNA, 20 bp, human
ggcggcagctaaactggtcc

SEQ ID NO: 128803 - DNA, 20 bp, human
gcgttcctcagactctcggg

SEQ ID NO: 128804 - DNA, 20 bp, human
gcaccccgctcgtaccgtag

SEQ ID NO: 128805 - DNA, 20 bp, human
gcagctccacgttgcagaag

SEQ ID NO: 128806 - DNA, 20 bp, human
gtgggctggtgggaccaggt

SEQ ID NO: 128807 - DNA, 20 bp, human
gctggggctgctgcacacag

SEQ ID NO: 128808 - DNA, 20 bp, human
gtgagctgggcccccggtgt

SEQ ID NO: 128809 - DNA, 20 bp, human
ggaccaggtaggagagtgca

SEQ ID NO: 128810 - DNA, 20 bp, human
gctggtgggctggtgggacc

SEQ ID NO: 128811 - DNA, 20 bp, human
gaggtaggagagtgcagggt

SEQ ID NO: 128812 - DNA, 20 bp, human
ggcaggctgcatgggatgtc

SEQ ID NO: 128813 - DNA, 20 bp, human
gctggcgggccatgtaacca

SEQ ID NO: 128814 - DNA, 20 bp, human
ggggggtccgtgcccatggg

SEQ ID NO: 128815 - DNA, 20 bp, human
ggtggggggtccgtgcccat

SEQ ID NO: 128816 - DNA, 20 bp, human
ggccctggagacctctgata

SEQ ID NO: 128817 - DNA, 20 bp, human
gagcctggcggcccaaatcc

SEQ ID NO: 128818 - DNA, 20 bp, human
gcagttgcagctccgggatg

SEQ ID NO: 128819 - DNA, 20 bp, human
gagggcaaccctggcggtca

SEQ ID NO: 128820 - DNA, 20 bp, human
gctactgcatgccctatcag

SEQ ID NO: 128821 - DNA, 20 bp, human
gcaactggtggccttcccgg

SEQ ID NO: 128822 - DNA, 20 bp, human
ggccgccaccgccaccggga

SEQ ID NO: 128823 - DNA, 20 bp, human
gggccaccagttgcagctcc

SEQ ID NO: 128824 - DNA, 20 bp, human
gtggcgcactccagggtcta

SEQ ID NO: 128825 - DNA, 20 bp, human
gagctccccagcgcccgccg

SEQ ID NO: 128826 - DNA, 20 bp, human
gacaaggaggctactgacat

SEQ ID NO: 128827 - DNA, 20 bp, human
gcacatgctggacggattct

SEQ ID NO: 128828 - DNA, 20 bp, human
gagcaagtcaggctgtcaca

SEQ ID NO: 128829 - DNA, 20 bp, human
gtgtcacaaggagctttatc

SEQ ID NO: 128830 - DNA, 20 bp, human
gactgacattggaagcactt

SEQ ID NO: 128831 - DNA, 20 bp, human
gcagacaaacctcatccaca

SEQ ID NO: 128832 - DNA, 20 bp, human
gcactttggcgcattttcag

SEQ ID NO: 128833 - DNA, 20 bp, human
gagtagcctccttgtggatg

SEQ ID NO: 128834 - DNA, 20 bp, human
gctctaagacgctcatacat

SEQ ID NO: 128835 - DNA, 20 bp, human
gaaacattacacatgctgga

SEQ ID NO: 128836 - DNA, 20 bp, human
gcctgccaccggctctgcac

SEQ ID NO: 128837 - DNA, 20 bp, human
ggtaggtgtgaggccatctg

SEQ ID NO: 128838 - DNA, 20 bp, human
gggccctcccggcgcaggaa

SEQ ID NO: 128839 - DNA, 20 bp, human
gtgagccctgaacctgctgg

SEQ ID NO: 128840 - DNA, 20 bp, human
gtccagaaagcggaagggtg

SEQ ID NO: 128841 - DNA, 20 bp, human
gacacgcaggtgcaaggagc

SEQ ID NO: 128842 - DNA, 20 bp, human
gccacacacctgtgcagagc

SEQ ID NO: 128843 - DNA, 20 bp, human
gcgccattcctgcgccggga

SEQ ID NO: 128844 - DNA, 20 bp, human
gcagggccatgggggttcca

SEQ ID NO: 128845 - DNA, 20 bp, human
gctggtccgccaaccctccg

SEQ ID NO: 128846 - DNA, 20 bp, human
gcatcgccaggactgcgtgg

SEQ ID NO: 128847 - DNA, 20 bp, human
gccgcgcggggatccccgag

SEQ ID NO: 128848 - DNA, 20 bp, human
gggacgcccggtgtggaggt

SEQ ID NO: 128849 - DNA, 20 bp, human
ggcgagacaaaagtagggta

SEQ ID NO: 128850 - DNA, 20 bp, human
gtacagagaaagcgagggag

SEQ ID NO: 128851 - DNA, 20 bp, human
gacgcagtcctggcgatgca

SEQ ID NO: 128852 - DNA, 20 bp, human
gcaactgcgagacaaaagta

SEQ ID NO: 128853 - DNA, 20 bp, human
gcgcctggatataggcccag

SEQ ID NO: 128854 - DNA, 20 bp, human
gccactctgggcctcacagc

SEQ ID NO: 128855 - DNA, 20 bp, human
ggtcccctgggcctatatcc

SEQ ID NO: 128856 - DNA, 20 bp, human
gtacagctggcaagaatcca

SEQ ID NO: 128857 - DNA, 20 bp, human
ggagagcaggactccctgaa

SEQ ID NO: 128858 - DNA, 20 bp, human
gcagcaacatccccaaacag

SEQ ID NO: 128859 - DNA, 20 bp, human
gacggtcccggaaatgtcca

SEQ ID NO: 128860 - DNA, 20 bp, human
gcggtggcacatacatggta

SEQ ID NO: 128861 - DNA, 20 bp, human
gaaacagcggcgtttcacgg

SEQ ID NO: 128862 - DNA, 20 bp, human
gaggcgagcgcactcctccg

SEQ ID NO: 128863 - DNA, 20 bp, human
gtttcacggtggcacataca

SEQ ID NO: 128864 - DNA, 20 bp, human
ggcagacctcgcagaaatgg

SEQ ID NO: 128865 - DNA, 20 bp, human
gaaggtcttcgttcagccac

SEQ ID NO: 128866 - DNA, 20 bp, human
gggcgcgcagcggtacctag

SEQ ID NO: 128867 - DNA, 20 bp, human
gcgcgtctgcggcctccaca

SEQ ID NO: 128868 - DNA, 20 bp, human
ggagccggaagcccgctgac

SEQ ID NO: 128869 - DNA, 20 bp, human
ggagcccagtctgctaaaag

SEQ ID NO: 128870 - DNA, 20 bp, human
ggcgcagacgcaaagcctcg

SEQ ID NO: 128871 - DNA, 20 bp, human
gtgctgaccggagaccaccg

SEQ ID NO: 128872 - DNA, 20 bp, human
gcgccccgcctgggttctaa

SEQ ID NO: 128873 - DNA, 20 bp, human
gagacgcaaagcctcgggga

SEQ ID NO: 128874 - DNA, 20 bp, human
gcctcaggcccttagaaccc

SEQ ID NO: 128875 - DNA, 20 bp, human
ggatttcaagatggcgccag

SEQ ID NO: 128876 - DNA, 20 bp, human
gggccggcccgctccatggt

SEQ ID NO: 128877 - DNA, 20 bp, human
gaggcgcgcggtgccaacca

SEQ ID NO: 128878 - DNA, 20 bp, human
gggaataccaagagggtcgg

SEQ ID NO: 128879 - DNA, 20 bp, human
gcagtaccagagagcctccg

SEQ ID NO: 128880 - DNA, 20 bp, human
gcgcggtgccaaccatggag

SEQ ID NO: 128881 - DNA, 20 bp, human
ggaagggcacaattcaacag

SEQ ID NO: 128882 - DNA, 20 bp, human
gttggcaccgcgcgcctcgg

SEQ ID NO: 128883 - DNA, 20 bp, human
gtgccaaccatggagcgggc

SEQ ID NO: 128884 - DNA, 20 bp, human
gcgactggagcaggacgaag

SEQ ID NO: 128885 - DNA, 20 bp, human
gtgagggacggaccccagct

SEQ ID NO: 128886 - DNA, 20 bp, human
ggctactctgtagaaggact

SEQ ID NO: 128887 - DNA, 20 bp, human
gtgtagaaggactgggacgg

SEQ ID NO: 128888 - DNA, 20 bp, human
gtcatgtaccggacccgcaa

SEQ ID NO: 128889 - DNA, 20 bp, human
ggacccagagaagtccagac

SEQ ID NO: 128890 - DNA, 20 bp, human
gtggtagttgctgaagtcca

SEQ ID NO: 128891 - DNA, 20 bp, human
ggcgggtccggtacatgaac

SEQ ID NO: 128892 - DNA, 20 bp, human
gccactggctactctgtaga

SEQ ID NO: 128893 - DNA, 20 bp, human
ggtctgcaacaagtccagtc

SEQ ID NO: 128894 - DNA, 20 bp, human
gcatcaccaggcagtcctcg

SEQ ID NO: 128895 - DNA, 20 bp, human
gggcgaggtgacagcagagg

SEQ ID NO: 128896 - DNA, 20 bp, human
ggccaccatgagcctcagtg

SEQ ID NO: 128897 - DNA, 20 bp, human
ggcgctggcggtacatgaag

SEQ ID NO: 128898 - DNA, 20 bp, human
gtccagtgggaagacgatct

SEQ ID NO: 128899 - DNA, 20 bp, human
ggtactggcgggcaaaatcg

SEQ ID NO: 128900 - DNA, 20 bp, human
gcacctggcagaggtcccgg

SEQ ID NO: 128901 - DNA, 20 bp, human
gagtcctccaggacgctgtc

SEQ ID NO: 128902 - DNA, 20 bp, human
ggtgcagccggacagcgtcc

SEQ ID NO: 128903 - DNA, 20 bp, human
gggccgcggccacattctca

SEQ ID NO: 128904 - DNA, 20 bp, human
gcaggcacgcatggactccc

SEQ ID NO: 128905 - DNA, 20 bp, human
gccacgaccccgatgtccag

SEQ ID NO: 128906 - DNA, 20 bp, human
gtccctcataggacttccaa

SEQ ID NO: 128907 - DNA, 20 bp, human
gtcctgtgccggtcccggaa

SEQ ID NO: 128908 - DNA, 20 bp, human
gaccgtaaatggtccctcat

SEQ ID NO: 128909 - DNA, 20 bp, human
ggcacaggaacatgctgcag

SEQ ID NO: 128910 - DNA, 20 bp, human
ggcaaagcaagccacaccat

SEQ ID NO: 128911 - DNA, 20 bp, human
ggtcacatcccaagagttac

SEQ ID NO: 128912 - DNA, 20 bp, human
gcccagagcagggggttcac

SEQ ID NO: 128913 - DNA, 20 bp, human
ggacctttggaagtcctatg

SEQ ID NO: 128914 - DNA, 20 bp, human
gtcccggaacggcatacctg

SEQ ID NO: 128915 - DNA, 20 bp, human
ggttgccgtggagaaatacc

SEQ ID NO: 128916 - DNA, 20 bp, human
ggcagcggccagaccaggac

SEQ ID NO: 128917 - DNA, 20 bp, human
gctcgggctagcagccgcag

SEQ ID NO: 128918 - DNA, 20 bp, human
gagagaggccggtcctggtc

SEQ ID NO: 128919 - DNA, 20 bp, human
gagggcactgcgaggctagg

SEQ ID NO: 128920 - DNA, 20 bp, human
gcagcgtgccgagcacccgg

SEQ ID NO: 128921 - DNA, 20 bp, human
gggtgggccccacagaagaa

SEQ ID NO: 128922 - DNA, 20 bp, human
gagcccgaggtctccaagcc

SEQ ID NO: 128923 - DNA, 20 bp, human
gggtgcccaggagccgagga

SEQ ID NO: 128924 - DNA, 20 bp, human
ggcgcgagaggcgccccaag

SEQ ID NO: 128925 - DNA, 20 bp, human
ggccccaaggggcgtcctga

SEQ ID NO: 128926 - DNA, 20 bp, human
gagtgcagggcgggtctcag

SEQ ID NO: 128927 - DNA, 20 bp, human
ggatggttggagctccatca

SEQ ID NO: 128928 - DNA, 20 bp, human
ggaagcactggttaccatgg

SEQ ID NO: 128929 - DNA, 20 bp, human
ggacccccactgactcactg

SEQ ID NO: 128930 - DNA, 20 bp, human
gcacaggctgggtcgggcca

SEQ ID NO: 128931 - DNA, 20 bp, human
gtgggaacctcaggccacgt

SEQ ID NO: 128932 - DNA, 20 bp, human
ggagtcccctctgaataaca

SEQ ID NO: 128933 - DNA, 20 bp, human
gagcagcgagataaaggccg

SEQ ID NO: 128934 - DNA, 20 bp, human
ggcagcggtttccacatgga

SEQ ID NO: 128935 - DNA, 20 bp, human
gctgtgctatctaggatatg

SEQ ID NO: 128936 - DNA, 20 bp, human
ggagcatgagaatgaccaca

SEQ ID NO: 128937 - DNA, 20 bp, human
gaaacagggaggtcactatt

SEQ ID NO: 128938 - DNA, 20 bp, human
gcatcctgggccaagtttgc

SEQ ID NO: 128939 - DNA, 20 bp, human
ggtcccatggcataacaaga

SEQ ID NO: 128940 - DNA, 20 bp, human
gcctcacactcacaccatcc

SEQ ID NO: 128941 - DNA, 20 bp, human
gtttgagcaggataattgaa

SEQ ID NO: 128942 - DNA, 20 bp, human
gtactatgaagctgcaaaca

SEQ ID NO: 128943 - DNA, 20 bp, human
gaacagttttctgaagaagg

SEQ ID NO: 128944 - DNA, 20 bp, human
gataattgaagggctttggg

SEQ ID NO: 128945 - DNA, 20 bp, human
ggaccttcttgttatgccat

SEQ ID NO: 128946 - DNA, 20 bp, human
gccggcggcggagtgaagtc

SEQ ID NO: 128947 - DNA, 20 bp, human
ggggaggagcaggactccgg

SEQ ID NO: 128948 - DNA, 20 bp, human
gggagtgaagtcaggctccg

SEQ ID NO: 128949 - DNA, 20 bp, human
gtctcggccgaggagcccca

SEQ ID NO: 128950 - DNA, 20 bp, human
gtacgccgggctcgcgccgg

SEQ ID NO: 128951 - DNA, 20 bp, human
gcgccggcgggaaggctccg

SEQ ID NO: 128952 - DNA, 20 bp, human
ggtgcaagcggggccagcac

SEQ ID NO: 128953 - DNA, 20 bp, human
gaattacgccgggctcgcgc

SEQ ID NO: 128954 - DNA, 20 bp, human
ggtggttggcgcaaggtccg

SEQ ID NO: 128955 - DNA, 20 bp, human
ggcacaggcaaagtcggaaa

SEQ ID NO: 128956 - DNA, 20 bp, human
ggcactttgagcccacactg

SEQ ID NO: 128957 - DNA, 20 bp, human
gctttgagcccacactgagg

SEQ ID NO: 128958 - DNA, 20 bp, human
gttaaagaccacctcagtgt

SEQ ID NO: 128959 - DNA, 20 bp, human
ggaatccagcaacttcatcc

SEQ ID NO: 128960 - DNA, 20 bp, human
gagaaagagagactctccct

SEQ ID NO: 128961 - DNA, 20 bp, human
gagcaacttcatccaggatt

SEQ ID NO: 128962 - DNA, 20 bp, human
ggagatttcacggcattcaa

SEQ ID NO: 128963 - DNA, 20 bp, human
gggagtctcattacactggt

SEQ ID NO: 128964 - DNA, 20 bp, human
gaagtggtgttactcaccca

SEQ ID NO: 128965 - DNA, 20 bp, human
gtgccggagtctcattacac

SEQ ID NO: 128966 - DNA, 20 bp, human
gtcggctcctgcctcaggaa

SEQ ID NO: 128967 - DNA, 20 bp, human
gagcccggcgatgtgagagg

SEQ ID NO: 128968 - DNA, 20 bp, human
gtccgaacatgcccttcctg

SEQ ID NO: 128969 - DNA, 20 bp, human
ggcgagcccggcgatgtgag

SEQ ID NO: 128970 - DNA, 20 bp, human
ggcggcccgccggacgacag

SEQ ID NO: 128971 - DNA, 20 bp, human
gcgatgtgagaggcggccgt

SEQ ID NO: 128972 - DNA, 20 bp, human
ggcgcttccggggaaatagg

SEQ ID NO: 128973 - DNA, 20 bp, human
ggcctcaggaagggcatgtt

SEQ ID NO: 128974 - DNA, 20 bp, human
gtggagtcggagcttcgcga

SEQ ID NO: 128975 - DNA, 20 bp, human
gggccgtcggctcctgcctc

SEQ ID NO: 128976 - DNA, 20 bp, human
gggccgcgctaggaaaggtg

SEQ ID NO: 128977 - DNA, 20 bp, human
ggtggacggtcggagaggac

SEQ ID NO: 128978 - DNA, 20 bp, human
ggccctggagcgaccctgag

SEQ ID NO: 128979 - DNA, 20 bp, human
gtccagggccgcgctaggaa

SEQ ID NO: 128980 - DNA, 20 bp, human
gccggcgcctgtgtaatccg

SEQ ID NO: 128981 - DNA, 20 bp, human
gcgggagcggctgcctctca

SEQ ID NO: 128982 - DNA, 20 bp, human
gcctgcgagggagcgcacgt

SEQ ID NO: 128983 - DNA, 20 bp, human
ggccacgcctcggattacac

SEQ ID NO: 128984 - DNA, 20 bp, human
ggcctctcagggtcgctcca

SEQ ID NO: 128985 - DNA, 20 bp, human
ggccgcaaagctacagcacc

SEQ ID NO: 128986 - DNA, 20 bp, human
gtgacgcgcgcggtccccgg

SEQ ID NO: 128987 - DNA, 20 bp, human
gtcccggagctctcccgaca

SEQ ID NO: 128988 - DNA, 20 bp, human
gggcccaaaagggaaagttg

SEQ ID NO: 128989 - DNA, 20 bp, human
gggcgtcggtctggacgaag

SEQ ID NO: 128990 - DNA, 20 bp, human
gcatcttcctccccgagcgg

SEQ ID NO: 128991 - DNA, 20 bp, human
gatgcgcgctcccccgctcg

SEQ ID NO: 128992 - DNA, 20 bp, human
ggggagcccggccgagggat

SEQ ID NO: 128993 - DNA, 20 bp, human
ggcagggcccgcaccgagct

SEQ ID NO: 128994 - DNA, 20 bp, human
gcgcggccagcccgacggag

SEQ ID NO: 128995 - DNA, 20 bp, human
gcggtctggacgaagaggcc

SEQ ID NO: 128996 - DNA, 20 bp, human
gcaccgggcccgggacgccc

SEQ ID NO: 128997 - DNA, 20 bp, human
gccgagcgcgagccgagcgg

SEQ ID NO: 128998 - DNA, 20 bp, human
gccgggcgcaggatgggatc

SEQ ID NO: 128999 - DNA, 20 bp, human
ggagctggcggagcgcacgg

SEQ ID NO: 129000 - DNA, 20 bp, human
gctccgccagctctggtcgg

SEQ ID NO: 129001 - DNA, 20 bp, human
gagcccgagcgcgagccgag

SEQ ID NO: 129002 - DNA, 20 bp, human
ggcgctccgccagctctggt

SEQ ID NO: 129003 - DNA, 20 bp, human
gcagccgccgggcgcaggat

SEQ ID NO: 129004 - DNA, 20 bp, human
ggccttgggccggtagctgg

SEQ ID NO: 129005 - DNA, 20 bp, human
ggcccccgcgcgacaggaag

SEQ ID NO: 129006 - DNA, 20 bp, human
gacggcacggccgcccacag

SEQ ID NO: 129007 - DNA, 20 bp, human
gccgccatggcccggctgtg

SEQ ID NO: 129008 - DNA, 20 bp, human
gctgcaagcccggacaccga

SEQ ID NO: 129009 - DNA, 20 bp, human
gcagcaccgggtccccgact

SEQ ID NO: 129010 - DNA, 20 bp, human
gctcgggaaaggtgaccagg

SEQ ID NO: 129011 - DNA, 20 bp, human
gggccgggtcactgttaagg

SEQ ID NO: 129012 - DNA, 20 bp, human
ggctgcagcggctgacgcaa

SEQ ID NO: 129013 - DNA, 20 bp, human
ggcgggccgggtcactgtta

SEQ ID NO: 129014 - DNA, 20 bp, human
gggcacacgtgcgagaacgg

SEQ ID NO: 129015 - DNA, 20 bp, human
gggttcacgaacacgcgcag

SEQ ID NO: 129016 - DNA, 20 bp, human
gttcttcctcggtgcgttcc

SEQ ID NO: 129017 - DNA, 20 bp, human
ggcgagcagtgagtgcggag

SEQ ID NO: 129018 - DNA, 20 bp, human
gagcagcgaggtggacgagt

SEQ ID NO: 129019 - DNA, 20 bp, human
gctgctccccggtccccccg

SEQ ID NO: 129020 - DNA, 20 bp, human
gggcgcagcgaggccccggg

SEQ ID NO: 129021 - DNA, 20 bp, human
gccaacctcggccagaacat

SEQ ID NO: 129022 - DNA, 20 bp, human
gaaactccccacacacactt

SEQ ID NO: 129023 - DNA, 20 bp, human
gcgctccagccggtctcctg

SEQ ID NO: 129024 - DNA, 20 bp, human
ggccatgcctaagtgtgtgt

SEQ ID NO: 129025 - DNA, 20 bp, human
gggccgcgctccctaaggga

SEQ ID NO: 129026 - DNA, 20 bp, human
gcggccggaggggagcccta

SEQ ID NO: 129027 - DNA, 20 bp, human
gctcccccgctgcctcccta

SEQ ID NO: 129028 - DNA, 20 bp, human
gcgagcacccgggcagggag

SEQ ID NO: 129029 - DNA, 20 bp, human
gaggctgcgggtgcgcaggg

SEQ ID NO: 129030 - DNA, 20 bp, human
gccgcagaggacgcccagag

SEQ ID NO: 129031 - DNA, 20 bp, human
gaacggcagctcgagcaccc

SEQ ID NO: 129032 - DNA, 20 bp, human
gccgcccgggccgggtaggg

SEQ ID NO: 129033 - DNA, 20 bp, human
ggagccctagggaggcagcg

SEQ ID NO: 129034 - DNA, 20 bp, human
gaaaggccggaacagctgaa

SEQ ID NO: 129035 - DNA, 20 bp, human
gtccaaagttggctttgcaa

SEQ ID NO: 129036 - DNA, 20 bp, human
gcaggtagcagcagagagac

SEQ ID NO: 129037 - DNA, 20 bp, human
gctcggcgctgaccagacgc

SEQ ID NO: 129038 - DNA, 20 bp, human
gccgaggctggcgccgaagt

SEQ ID NO: 129039 - DNA, 20 bp, human
gcaggacagagcctaagccg

SEQ ID NO: 129040 - DNA, 20 bp, human
ggcgcaagcttgcacctcct

SEQ ID NO: 129041 - DNA, 20 bp, human
ggaaccagccccagccgccg

SEQ ID NO: 129042 - DNA, 20 bp, human
gcacctcctgggcaagccga

SEQ ID NO: 129043 - DNA, 20 bp, human
ggcgccgaggtgagttgcca

SEQ ID NO: 129044 - DNA, 20 bp, human
gacagagcctaagccgaggc

SEQ ID NO: 129045 - DNA, 20 bp, human
gggctgggagcgaggtccgg

SEQ ID NO: 129046 - DNA, 20 bp, human
gagactggaagccaagtcgg

SEQ ID NO: 129047 - DNA, 20 bp, human
ggacagaggcgaaaactcaa

SEQ ID NO: 129048 - DNA, 20 bp, human
gcccggagagccgcatctat

SEQ ID NO: 129049 - DNA, 20 bp, human
ggggctccgcgctaacctcg

SEQ ID NO: 129050 - DNA, 20 bp, human
ggacgccgcgcgtagccccg

SEQ ID NO: 129051 - DNA, 20 bp, human
gacgcgcggcgtctccgcac

SEQ ID NO: 129052 - DNA, 20 bp, human
gcaccccccacccccgaagg

SEQ ID NO: 129053 - DNA, 20 bp, human
gaggcgagggaggaatgagg

SEQ ID NO: 129054 - DNA, 20 bp, human
gcttccccctcccccttcgg

SEQ ID NO: 129055 - DNA, 20 bp, human
gtctccgcacggggtgaaga

SEQ ID NO: 129056 - DNA, 20 bp, human
ggcgattagcacagcgaccc

SEQ ID NO: 129057 - DNA, 20 bp, human
gctctctcaggactggatac

SEQ ID NO: 129058 - DNA, 20 bp, human
gcggtcccgggagcagaacc

SEQ ID NO: 129059 - DNA, 20 bp, human
gccggaaatggagctctctc

SEQ ID NO: 129060 - DNA, 20 bp, human
gtttccggaatgggactgag

SEQ ID NO: 129061 - DNA, 20 bp, human
ggaactttccgagcgcgtgt

SEQ ID NO: 129062 - DNA, 20 bp, human
ggttcagcatgcaggaagtt

SEQ ID NO: 129063 - DNA, 20 bp, human
gtgtgggacgcgtgctgatg

SEQ ID NO: 129064 - DNA, 20 bp, human
gtgcagcaaggtgagccacc

SEQ ID NO: 129065 - DNA, 20 bp, human
gtgggtgccgcacttccttg

SEQ ID NO: 129066 - DNA, 20 bp, human
gacatcggaggagaaggtaa

SEQ ID NO: 129067 - DNA, 20 bp, human
gctgtagctccaacagtaat

SEQ ID NO: 129068 - DNA, 20 bp, human
gacttcacttggggacgggt

SEQ ID NO: 129069 - DNA, 20 bp, human
gccatagagttagaaagtct

SEQ ID NO: 129070 - DNA, 20 bp, human
gatttctttgggaggccata

SEQ ID NO: 129071 - DNA, 20 bp, human
gcattgcggaataacatcgg

SEQ ID NO: 129072 - DNA, 20 bp, human
gaatactgggccgaacacca

SEQ ID NO: 129073 - DNA, 20 bp, human
gcagtcccagagtctgatca

SEQ ID NO: 129074 - DNA, 20 bp, human
gggaataacatcggaggaga

SEQ ID NO: 129075 - DNA, 20 bp, human
gaagtccctgatcagactct

SEQ ID NO: 129076 - DNA, 20 bp, human
gcgatcctgggtcccagata

SEQ ID NO: 129077 - DNA, 20 bp, human
gtcctgggtcccagataggg

SEQ ID NO: 129078 - DNA, 20 bp, human
ggtgactgcccgccctatct

SEQ ID NO: 129079 - DNA, 20 bp, human
gtaactgggagagggcagta

SEQ ID NO: 129080 - DNA, 20 bp, human
gagactgctggtcccagagt

SEQ ID NO: 129081 - DNA, 20 bp, human
gttgctcacagagcgatcct

SEQ ID NO: 129082 - DNA, 20 bp, human
ggctcaggagaacagaggga

SEQ ID NO: 129083 - DNA, 20 bp, human
gctgggagagggcagtaagg

SEQ ID NO: 129084 - DNA, 20 bp, human
ggaaggctcaggagaacaga

SEQ ID NO: 129085 - DNA, 20 bp, human
gcagacagccagacccaggg

SEQ ID NO: 129086 - DNA, 20 bp, human
ggcagccagaccttcatctc

SEQ ID NO: 129087 - DNA, 20 bp, human
gcgggtcccggctaaagtca

SEQ ID NO: 129088 - DNA, 20 bp, human
ggatcgcttccacctcccag

SEQ ID NO: 129089 - DNA, 20 bp, human
gctccgggcaggcaaagagt

SEQ ID NO: 129090 - DNA, 20 bp, human
ggcccccagtgtcaacgtgt

SEQ ID NO: 129091 - DNA, 20 bp, human
ggtcaacgtgtcggtctggg

SEQ ID NO: 129092 - DNA, 20 bp, human
ggaccgacacgttgacactg

SEQ ID NO: 129093 - DNA, 20 bp, human
gacctcggagcgcaggagcg

SEQ ID NO: 129094 - DNA, 20 bp, human
gaccttcatctcgggaacct

SEQ ID NO: 129095 - DNA, 20 bp, human
gtctaacgttcggccctcgg

SEQ ID NO: 129096 - DNA, 20 bp, human
gcgtctgctggggcacctga

SEQ ID NO: 129097 - DNA, 20 bp, human
ggtgcccccaagtctccttc

SEQ ID NO: 129098 - DNA, 20 bp, human
ggcacctgaaggagacttgg

SEQ ID NO: 129099 - DNA, 20 bp, human
gcaacccaggaggcacgacg

SEQ ID NO: 129100 - DNA, 20 bp, human
gcccgcccgggaggtctcac

SEQ ID NO: 129101 - DNA, 20 bp, human
ggacagcacgcgggagacgg

SEQ ID NO: 129102 - DNA, 20 bp, human
ggctgtgcgccaggcgaagt

SEQ ID NO: 129103 - DNA, 20 bp, human
gcctcatgaagcacaggcag

SEQ ID NO: 129104 - DNA, 20 bp, human
gccgggatggggcgcgagtg

SEQ ID NO: 129105 - DNA, 20 bp, human
gccgtgtcctgtaacccaac

SEQ ID NO: 129106 - DNA, 20 bp, human
gctcaacacgcgggagatga

SEQ ID NO: 129107 - DNA, 20 bp, human
gcttcacggagtgctgtaga

SEQ ID NO: 129108 - DNA, 20 bp, human
gagctgacgggaagaagagg

SEQ ID NO: 129109 - DNA, 20 bp, human
gcagctctgcgagaatggat

SEQ ID NO: 129110 - DNA, 20 bp, human
gcagagctgacgggaagaag

SEQ ID NO: 129111 - DNA, 20 bp, human
gccgaggccaggccttccgg

SEQ ID NO: 129112 - DNA, 20 bp, human
gggcaactcgcctcaacacg

SEQ ID NO: 129113 - DNA, 20 bp, human
gcactccgtgaagaatatgc

SEQ ID NO: 129114 - DNA, 20 bp, human
gggccttccggcggtcgtta

SEQ ID NO: 129115 - DNA, 20 bp, human
gagtgctcactagggcggag

SEQ ID NO: 129116 - DNA, 20 bp, human
gggcggtgtctggcttggtg

SEQ ID NO: 129117 - DNA, 20 bp, human
gggtgctcgtcggacgaggg

SEQ ID NO: 129118 - DNA, 20 bp, human
ggaggacacgaccaagatgg

SEQ ID NO: 129119 - DNA, 20 bp, human
gcgcctggcaattagcacac

SEQ ID NO: 129120 - DNA, 20 bp, human
ggcctccttcccgagagaag

SEQ ID NO: 129121 - DNA, 20 bp, human
gaattgccaggcggcgacag

SEQ ID NO: 129122 - DNA, 20 bp, human
gtgacggcgggacgcagggt

SEQ ID NO: 129123 - DNA, 20 bp, human
gctgctgcctacctcccgaa

SEQ ID NO: 129124 - DNA, 20 bp, human
gggagaccccttcgggaggt

SEQ ID NO: 129125 - DNA, 20 bp, human
gaacaggcgcgggtgctcgt

SEQ ID NO: 129126 - DNA, 20 bp, human
ggaggctgggctgtgatccg

SEQ ID NO: 129127 - DNA, 20 bp, human
ggagaaggccgtcaagatgg

SEQ ID NO: 129128 - DNA, 20 bp, human
gcgccggctgagatatccag

SEQ ID NO: 129129 - DNA, 20 bp, human
gatcttgacggccttctcac

SEQ ID NO: 129130 - DNA, 20 bp, human
gatacaaaccagggggccta

SEQ ID NO: 129131 - DNA, 20 bp, human
gccccggccgccgaagcgta

SEQ ID NO: 129132 - DNA, 20 bp, human
gcaaagccatacaaaccagg

SEQ ID NO: 129133 - DNA, 20 bp, human
gggctgctgcgttatcttgt

SEQ ID NO: 129134 - DNA, 20 bp, human
gtgagccttgattggaaagg

SEQ ID NO: 129135 - DNA, 20 bp, human
gggaccccaaccggagaaag

SEQ ID NO: 129136 - DNA, 20 bp, human
ggagaagacgggagcgaagt

SEQ ID NO: 129137 - DNA, 20 bp, human
gccagccccacccaagacag

SEQ ID NO: 129138 - DNA, 20 bp, human
gctccaggcggcggtgtcca

SEQ ID NO: 129139 - DNA, 20 bp, human
ggagcccctctgtcttgggt

SEQ ID NO: 129140 - DNA, 20 bp, human
gtggtgatccccgagaagac

SEQ ID NO: 129141 - DNA, 20 bp, human
gcggctcctcggcggctccg

SEQ ID NO: 129142 - DNA, 20 bp, human
gcctggagcccctctgtctt

SEQ ID NO: 129143 - DNA, 20 bp, human
gggaccaggtgcggacgggt

SEQ ID NO: 129144 - DNA, 20 bp, human
ggaagggaccaggtgcggac

SEQ ID NO: 129145 - DNA, 20 bp, human
ggctcaccgcagtcgcgccg

SEQ ID NO: 129146 - DNA, 20 bp, human
ggacgcgcgagcgcaagcag

SEQ ID NO: 129147 - DNA, 20 bp, human
gagcgcaagcagcgggttag

SEQ ID NO: 129148 - DNA, 20 bp, human
gtccggctgcaggtccgcct

SEQ ID NO: 129149 - DNA, 20 bp, human
ggcagaatggactcaccagg

SEQ ID NO: 129150 - DNA, 20 bp, human
ggaggcgcctcgccgagagc

SEQ ID NO: 129151 - DNA, 20 bp, human
gctcctccagtctacagact

SEQ ID NO: 129152 - DNA, 20 bp, human
gtcggcagaatggactcacc

SEQ ID NO: 129153 - DNA, 20 bp, human
gtgagtccattctgccgagg

SEQ ID NO: 129154 - DNA, 20 bp, human
ggtccattctgccgaggcgg

SEQ ID NO: 129155 - DNA, 20 bp, human
gttcccccgcctcggcagaa

SEQ ID NO: 129156 - DNA, 20 bp, human
ggagcgcggcctcctagcgt

SEQ ID NO: 129157 - DNA, 20 bp, human
gtgagcgcaccgagaactcg

SEQ ID NO: 129158 - DNA, 20 bp, human
gcgcgtcgctaaggagcgac

SEQ ID NO: 129159 - DNA, 20 bp, human
gggaagacccctgtcacccg

SEQ ID NO: 129160 - DNA, 20 bp, human
gtggggttcccgggagagga

SEQ ID NO: 129161 - DNA, 20 bp, human
gagggccgcgcgcaggagta

SEQ ID NO: 129162 - DNA, 20 bp, human
gcgcggcctcctagcgtcgg

SEQ ID NO: 129163 - DNA, 20 bp, human
gtgtcacccgaggctgggag

SEQ ID NO: 129164 - DNA, 20 bp, human
gaaggtggccggggtctctt

SEQ ID NO: 129165 - DNA, 20 bp, human
gcggggcctcatggtagcgg

SEQ ID NO: 129166 - DNA, 20 bp, human
gggagaaaggagccagcggt

SEQ ID NO: 129167 - DNA, 20 bp, human
gcgggcgccggagtggagaa

SEQ ID NO: 129168 - DNA, 20 bp, human
gcaagcgctcccggacgcag

SEQ ID NO: 129169 - DNA, 20 bp, human
gcagggctcggagtctggag

SEQ ID NO: 129170 - DNA, 20 bp, human
ggtggagctagcaggcgggc

SEQ ID NO: 129171 - DNA, 20 bp, human
gcgtggcaccgggaactcgg

SEQ ID NO: 129172 - DNA, 20 bp, human
gccgcggtggagctagcagg

SEQ ID NO: 129173 - DNA, 20 bp, human
gggtcggggcacagccggtc

SEQ ID NO: 129174 - DNA, 20 bp, human
gcaatctgggtgagactgtg

SEQ ID NO: 129175 - DNA, 20 bp, human
gtggcagggtgcttacgcca

SEQ ID NO: 129176 - DNA, 20 bp, human
gtattcccggagagtcgcag

SEQ ID NO: 129177 - DNA, 20 bp, human
gcgctgcagggctgaagcgg

SEQ ID NO: 129178 - DNA, 20 bp, human
gcagccccggccggatcccg

SEQ ID NO: 129179 - DNA, 20 bp, human
gggaatacagaccccctccc

SEQ ID NO: 129180 - DNA, 20 bp, human
gaggagctgcataaagcagg

SEQ ID NO: 129181 - DNA, 20 bp, human
gcctccccgggatccggccg

SEQ ID NO: 129182 - DNA, 20 bp, human
ggagagccatgccgagcgcc

SEQ ID NO: 129183 - DNA, 20 bp, human
gcggcgtgcggcacgctgca

SEQ ID NO: 129184 - DNA, 20 bp, human
gctggcctggggcgggacgt

SEQ ID NO: 129185 - DNA, 20 bp, human
ggtaggtgcgggccagcgga

SEQ ID NO: 129186 - DNA, 20 bp, human
gtctgcaggccgccattatc

SEQ ID NO: 129187 - DNA, 20 bp, human
gggcgcgagctgcccgataa

SEQ ID NO: 129188 - DNA, 20 bp, human
gggctgctgactggaggcgg

SEQ ID NO: 129189 - DNA, 20 bp, human
ggcgagctgcccgataatgg

SEQ ID NO: 129190 - DNA, 20 bp, human
ggcctgcagagcccatgaga

SEQ ID NO: 129191 - DNA, 20 bp, human
ggccggctgctgactggagg

SEQ ID NO: 129192 - DNA, 20 bp, human
gccagaggtgttgcccgacg

SEQ ID NO: 129193 - DNA, 20 bp, human
gggtgcagttgcggagacgg

SEQ ID NO: 129194 - DNA, 20 bp, human
gctgggtgcgatcatctggg

SEQ ID NO: 129195 - DNA, 20 bp, human
ggaggtggccccggtatgag

SEQ ID NO: 129196 - DNA, 20 bp, human
ggcaggacccgcagacgact

SEQ ID NO: 129197 - DNA, 20 bp, human
gggcattctaaagaatccac

SEQ ID NO: 129198 - DNA, 20 bp, human
gggtagagaaaagcctccca

SEQ ID NO: 129199 - DNA, 20 bp, human
gtctggggttgggtgagtct

SEQ ID NO: 129200 - DNA, 20 bp, human
ggttcaaacccaaacccagt

SEQ ID NO: 129201 - DNA, 20 bp, human
gtggcttctccttgtgatca

SEQ ID NO: 129202 - DNA, 20 bp, human
gggtggggccacaaactctg

SEQ ID NO: 129203 - DNA, 20 bp, human
gctggggttctagaggacca

SEQ ID NO: 129204 - DNA, 20 bp, human
gaccttggccccaggaaccc

SEQ ID NO: 129205 - DNA, 20 bp, human
gctgtggcccttaagaagga

SEQ ID NO: 129206 - DNA, 20 bp, human
gccagcgccggcacttcgga

SEQ ID NO: 129207 - DNA, 20 bp, human
gtggctggcggcgtaaataa

SEQ ID NO: 129208 - DNA, 20 bp, human
ggggaggaaggaagcaccta

SEQ ID NO: 129209 - DNA, 20 bp, human
gtggcggcgtaaataacggt

SEQ ID NO: 129210 - DNA, 20 bp, human
gctcacgtaccactcggcag

SEQ ID NO: 129211 - DNA, 20 bp, human
ggaagcacctaaggcgctgg

SEQ ID NO: 129212 - DNA, 20 bp, human
gcggcacttcggagggagga

SEQ ID NO: 129213 - DNA, 20 bp, human
ggcgccggcacttcggaggg

SEQ ID NO: 129214 - DNA, 20 bp, human
ggagtggtacgtgagggacg

SEQ ID NO: 129215 - DNA, 20 bp, human
gccgctgccccaggccgggt

SEQ ID NO: 129216 - DNA, 20 bp, human
gaggcccacgaagaaacctc

SEQ ID NO: 129217 - DNA, 20 bp, human
gcgccagggcaagggtaggg

SEQ ID NO: 129218 - DNA, 20 bp, human
gtcttcgtgggcctcatgaa

SEQ ID NO: 129219 - DNA, 20 bp, human
gcacacccagcgcatggctg

SEQ ID NO: 129220 - DNA, 20 bp, human
gaccgcgtcgctgggccgaa

SEQ ID NO: 129221 - DNA, 20 bp, human
gaagggtcttgaagagtaag

SEQ ID NO: 129222 - DNA, 20 bp, human
ggggaccacaaccaaagtcg

SEQ ID NO: 129223 - DNA, 20 bp, human
gcggccggggcctctcgacg

SEQ ID NO: 129224 - DNA, 20 bp, human
gttggttgtggtccccgcgc

SEQ ID NO: 129225 - DNA, 20 bp, human
gacccagcgcatggctgcgg

SEQ ID NO: 129226 - DNA, 20 bp, human
gaagctgcggagatccgggg

SEQ ID NO: 129227 - DNA, 20 bp, human
gccgaagctgcggagatccg

SEQ ID NO: 129228 - DNA, 20 bp, human
gagcctagggaagccgcggg

SEQ ID NO: 129229 - DNA, 20 bp, human
gcagccaagccgcacggata

SEQ ID NO: 129230 - DNA, 20 bp, human
gcggagcctagggaagccgc

SEQ ID NO: 129231 - DNA, 20 bp, human
ggggctagggaatatccggg

SEQ ID NO: 129232 - DNA, 20 bp, human
gtatccggggggctctcctg

SEQ ID NO: 129233 - DNA, 20 bp, human
ggcgagactccccaaacctg

SEQ ID NO: 129234 - DNA, 20 bp, human
gggccgcccgcggcttccct

SEQ ID NO: 129235 - DNA, 20 bp, human
gggcggggctagggaatatc

SEQ ID NO: 129236 - DNA, 20 bp, human
ggccggcctggtgccccgag

SEQ ID NO: 129237 - DNA, 20 bp, human
gcgggtgggcgtcaagatga

SEQ ID NO: 129238 - DNA, 20 bp, human
gcccaaacaggaggagtcac

SEQ ID NO: 129239 - DNA, 20 bp, human
ggcagcgctggctcgctcaa

SEQ ID NO: 129240 - DNA, 20 bp, human
gcccccgagtcccaaacagg

SEQ ID NO: 129241 - DNA, 20 bp, human
ggcagagcctggttccgagg

SEQ ID NO: 129242 - DNA, 20 bp, human
ggccgcggagtgaagagtct

SEQ ID NO: 129243 - DNA, 20 bp, human
gcctagccctccctctacca

SEQ ID NO: 129244 - DNA, 20 bp, human
gagaaatgctccacctctcg

SEQ ID NO: 129245 - DNA, 20 bp, human
gggcagagtcggagatgcag

SEQ ID NO: 129246 - DNA, 20 bp, human
ggcttgcagggcacccccgg

SEQ ID NO: 129247 - DNA, 20 bp, human
ggcggctgtcggagaaagag

SEQ ID NO: 129248 - DNA, 20 bp, human
ggacagacgggcaggacgcg

SEQ ID NO: 129249 - DNA, 20 bp, human
gacgcgcggaacagcttgca

SEQ ID NO: 129250 - DNA, 20 bp, human
gtgtggcgggcgacgacccg

SEQ ID NO: 129251 - DNA, 20 bp, human
gtttctccgacagccgccgg

SEQ ID NO: 129252 - DNA, 20 bp, human
ggagcgcagcctccgcgaag

SEQ ID NO: 129253 - DNA, 20 bp, human
gcgctatgggaggtgatatg

SEQ ID NO: 129254 - DNA, 20 bp, human
gtgtccgccagaaaaaaaga

SEQ ID NO: 129255 - DNA, 20 bp, human
ggtccttgccgcccacgagg

SEQ ID NO: 129256 - DNA, 20 bp, human
gcctgggcctggaggaacga

SEQ ID NO: 129257 - DNA, 20 bp, human
gcagggcccggggtacggaa

SEQ ID NO: 129258 - DNA, 20 bp, human
gccgaggccggcctgttggg

SEQ ID NO: 129259 - DNA, 20 bp, human
gggccgcgctggcgactcgg

SEQ ID NO: 129260 - DNA, 20 bp, human
gtggtgctgccgccttcccc

SEQ ID NO: 129261 - DNA, 20 bp, human
ggggcaggagaagagcgtgg

SEQ ID NO: 129262 - DNA, 20 bp, human
gctcggccgcgctggcgact

SEQ ID NO: 129263 - DNA, 20 bp, human
gccccgggccctgactggat

SEQ ID NO: 129264 - DNA, 20 bp, human
gccagtcagggcccggggta

SEQ ID NO: 129265 - DNA, 20 bp, human
ggaaaggagctggactgtcg

SEQ ID NO: 129266 - DNA, 20 bp, human
gcagcgcggagtccactgac

SEQ ID NO: 129267 - DNA, 20 bp, human
gagagtcgggtagacggcag

SEQ ID NO: 129268 - DNA, 20 bp, human
gctccccagagtcgggtaga

SEQ ID NO: 129269 - DNA, 20 bp, human
gcaaaggtctgggaatctcg

SEQ ID NO: 129270 - DNA, 20 bp, human
gcctgggcgcccagccggac

SEQ ID NO: 129271 - DNA, 20 bp, human
gggcgggctctccccagagt

SEQ ID NO: 129272 - DNA, 20 bp, human
gaggctaggcctgggcccaa

SEQ ID NO: 129273 - DNA, 20 bp, human
ggggtagacggcagcgggag

SEQ ID NO: 129274 - DNA, 20 bp, human
gaggtctgggaatctcgggg

SEQ ID NO: 129275 - DNA, 20 bp, human
ggggagagcgcagctcgcgg

SEQ ID NO: 129276 - DNA, 20 bp, human
gccgggaggatcaccgtctg

SEQ ID NO: 129277 - DNA, 20 bp, human
ggggacacttagagcccggt

SEQ ID NO: 129278 - DNA, 20 bp, human
gcgctgcggacccagaggat

SEQ ID NO: 129279 - DNA, 20 bp, human
gaaagtcgctgcggacccag

SEQ ID NO: 129280 - DNA, 20 bp, human
gctaccctggtgatgaccaa

SEQ ID NO: 129281 - DNA, 20 bp, human
gccgtcaagtggctgcggag

SEQ ID NO: 129282 - DNA, 20 bp, human
gacacttagagcccggtggg

SEQ ID NO: 129283 - DNA, 20 bp, human
gtctcctcggaaagtcgctg

SEQ ID NO: 129284 - DNA, 20 bp, human
gggtccgcagcgactttccg

SEQ ID NO: 129285 - DNA, 20 bp, human
gttgttacggaagggcgatg

SEQ ID NO: 129286 - DNA, 20 bp, human
gggtctagacagctctacag

SEQ ID NO: 129287 - DNA, 20 bp, human
ggagcctgagccggactctg

SEQ ID NO: 129288 - DNA, 20 bp, human
gcgcgcagggtcacggaatg

SEQ ID NO: 129289 - DNA, 20 bp, human
ggtccttcccgggtccacag

SEQ ID NO: 129290 - DNA, 20 bp, human
gcctgagccggactctgagg

SEQ ID NO: 129291 - DNA, 20 bp, human
ggaaggcccgcgcagggtca

SEQ ID NO: 129292 - DNA, 20 bp, human
gtcacggaatggggcatcgc

SEQ ID NO: 129293 - DNA, 20 bp, human
ggtcccggccgcccaccagg

SEQ ID NO: 129294 - DNA, 20 bp, human
ggacccctggcccatctccg

SEQ ID NO: 129295 - DNA, 20 bp, human
gtcatctgggggagccactg

SEQ ID NO: 129296 - DNA, 20 bp, human
gctgcctccgcctcagacaa

SEQ ID NO: 129297 - DNA, 20 bp, human
gctcccaccggagatccgag

SEQ ID NO: 129298 - DNA, 20 bp, human
gccggacccgaggtgagtgg

SEQ ID NO: 129299 - DNA, 20 bp, human
ggcgccggacccgaggtgag

SEQ ID NO: 129300 - DNA, 20 bp, human
gcgccggcagccgggtgggt

SEQ ID NO: 129301 - DNA, 20 bp, human
gacttgtcagcccttgtctg

SEQ ID NO: 129302 - DNA, 20 bp, human
gagggctgacaagtgactcg

SEQ ID NO: 129303 - DNA, 20 bp, human
ggatgcgcctctcggatctc

SEQ ID NO: 129304 - DNA, 20 bp, human
gggtaggaagcgggactcaa

SEQ ID NO: 129305 - DNA, 20 bp, human
ggcgtcgcccggcaccaccg

SEQ ID NO: 129306 - DNA, 20 bp, human
gtgctctgcgtcgggctcca

SEQ ID NO: 129307 - DNA, 20 bp, human
gctggcggccgatcccaacg

SEQ ID NO: 129308 - DNA, 20 bp, human
ggcccctgtggagacagatg

SEQ ID NO: 129309 - DNA, 20 bp, human
ggggggcggggtcagaacac

SEQ ID NO: 129310 - DNA, 20 bp, human
gtacctgcttggcccggcca

SEQ ID NO: 129311 - DNA, 20 bp, human
gcccctgggtgctgaagaag

SEQ ID NO: 129312 - DNA, 20 bp, human
gcccccatctgtctccacag

SEQ ID NO: 129313 - DNA, 20 bp, human
gcagggagcctcgttgggat

SEQ ID NO: 129314 - DNA, 20 bp, human
gccttccccgagcccagtgg

SEQ ID NO: 129315 - DNA, 20 bp, human
gcccgccgcagccggcttag

SEQ ID NO: 129316 - DNA, 20 bp, human
gaggcagcaggcggacagac

SEQ ID NO: 129317 - DNA, 20 bp, human
gagggcagaaaccggagcta

SEQ ID NO: 129318 - DNA, 20 bp, human
gcagtcacccacggccactc

SEQ ID NO: 129319 - DNA, 20 bp, human
ggcatcgatggcgagaatgc

SEQ ID NO: 129320 - DNA, 20 bp, human
gagcccctggctcaactcca

SEQ ID NO: 129321 - DNA, 20 bp, human
gcgcaggccggagtggccgt

SEQ ID NO: 129322 - DNA, 20 bp, human
gcggagctaaggcgggtcta

SEQ ID NO: 129323 - DNA, 20 bp, human
gacagacaggcggacatgcg

SEQ ID NO: 129324 - DNA, 20 bp, human
gaggggctgctgcacggtcc

SEQ ID NO: 129325 - DNA, 20 bp, human
gcagaaaccggagctaaggc

SEQ ID NO: 129326 - DNA, 20 bp, human
gtggaaagagcgccgagcgg

SEQ ID NO: 129327 - DNA, 20 bp, human
ggccccctcacaactttgga

SEQ ID NO: 129328 - DNA, 20 bp, human
gggcagagtgagctccaggg

SEQ ID NO: 129329 - DNA, 20 bp, human
gggcggcagagtgagctcca

SEQ ID NO: 129330 - DNA, 20 bp, human
gcctgacccggggtgcgtca

SEQ ID NO: 129331 - DNA, 20 bp, human
gcaggggccggaagacgcta

SEQ ID NO: 129332 - DNA, 20 bp, human
gattcttcccgacgaggagg

SEQ ID NO: 129333 - DNA, 20 bp, human
gggagtagggaatacgaacc

SEQ ID NO: 129334 - DNA, 20 bp, human
gctccagctgtcagcacgaa

SEQ ID NO: 129335 - DNA, 20 bp, human
gcgacaacgacgccaccgct

SEQ ID NO: 129336 - DNA, 20 bp, human
gtcgggacacagagctccaa

SEQ ID NO: 129337 - DNA, 20 bp, human
ggcgcaggcgctgaactgac

SEQ ID NO: 129338 - DNA, 20 bp, human
ggcgcacagtgccacaactg

SEQ ID NO: 129339 - DNA, 20 bp, human
gtaggccagagcagctagtg

SEQ ID NO: 129340 - DNA, 20 bp, human
gtggagctgggtcctgacta

SEQ ID NO: 129341 - DNA, 20 bp, human
ggctagtggggtgccccggt

SEQ ID NO: 129342 - DNA, 20 bp, human
gcctgggtgaggtgaggacc

SEQ ID NO: 129343 - DNA, 20 bp, human
gactgaccggacggagcggg

SEQ ID NO: 129344 - DNA, 20 bp, human
ggacccttggctgcctaccg

SEQ ID NO: 129345 - DNA, 20 bp, human
gcgggcgagggtccgaggta

SEQ ID NO: 129346 - DNA, 20 bp, human
gatgagggcggccattgctg

SEQ ID NO: 129347 - DNA, 20 bp, human
gctggggctccgcttcgggg

SEQ ID NO: 129348 - DNA, 20 bp, human
gagcgtcctcctccccgaag

SEQ ID NO: 129349 - DNA, 20 bp, human
gctggccatgggccccgcgt

SEQ ID NO: 129350 - DNA, 20 bp, human
ggccgagccgcgcagcgctg

SEQ ID NO: 129351 - DNA, 20 bp, human
gccgcctcgccggacccggg

SEQ ID NO: 129352 - DNA, 20 bp, human
gcattgctggggctccgctt

SEQ ID NO: 129353 - DNA, 20 bp, human
gacccggcagggtaacaaac

SEQ ID NO: 129354 - DNA, 20 bp, human
gcccgggcggccgccggacc

SEQ ID NO: 129355 - DNA, 20 bp, human
gctccttacctgcagccggg

SEQ ID NO: 129356 - DNA, 20 bp, human
gccggccaaacagagcccga

SEQ ID NO: 129357 - DNA, 20 bp, human
gatctctcccgaggaggcgg

SEQ ID NO: 129358 - DNA, 20 bp, human
gcgctcgtccccatcagcga

SEQ ID NO: 129359 - DNA, 20 bp, human
gcaggagagcaacaactcaa

SEQ ID NO: 129360 - DNA, 20 bp, human
gagcgcgtcgctctgggtcc

SEQ ID NO: 129361 - DNA, 20 bp, human
gcgggtggaaggttcacagt

SEQ ID NO: 129362 - DNA, 20 bp, human
gcccgagcttcccagaccct

SEQ ID NO: 129363 - DNA, 20 bp, human
gccagcctggaggagcgcga

SEQ ID NO: 129364 - DNA, 20 bp, human
ggccaaacagagcccgaggg

SEQ ID NO: 129365 - DNA, 20 bp, human
gcagcaccagagagatcggg

SEQ ID NO: 129366 - DNA, 20 bp, human
ggtgtgcaagcccgagacgg

SEQ ID NO: 129367 - DNA, 20 bp, human
gaccttacggggacgagtac

SEQ ID NO: 129368 - DNA, 20 bp, human
gggggtgtgcaagcccgaga

SEQ ID NO: 129369 - DNA, 20 bp, human
gcagttgcctggggtcgccg

SEQ ID NO: 129370 - DNA, 20 bp, human
gccccgggcaagggtactgc

SEQ ID NO: 129371 - DNA, 20 bp, human
gggcagccacaacagttgcc

SEQ ID NO: 129372 - DNA, 20 bp, human
ggccggcagtacccttgccc

SEQ ID NO: 129373 - DNA, 20 bp, human
ggcgcgctcgtgcgctgctg

SEQ ID NO: 129374 - DNA, 20 bp, human
gggggacgagtactggcgcc

SEQ ID NO: 129375 - DNA, 20 bp, human
gcgaccccaggcaactgttg

SEQ ID NO: 129376 - DNA, 20 bp, human
gggcgctatgctatcacccg

SEQ ID NO: 129377 - DNA, 20 bp, human
ggccagccggctgcgagagg

SEQ ID NO: 129378 - DNA, 20 bp, human
ggccggaagcacctagagag

SEQ ID NO: 129379 - DNA, 20 bp, human
gtgcgcagcgggagtcgaag

SEQ ID NO: 129380 - DNA, 20 bp, human
ggccctgtaaaggccctcag

SEQ ID NO: 129381 - DNA, 20 bp, human
gagccgcaagcggagttggt

SEQ ID NO: 129382 - DNA, 20 bp, human
gagtcgaagcggagatcccg

SEQ ID NO: 129383 - DNA, 20 bp, human
gggccccatggttgatctag

SEQ ID NO: 129384 - DNA, 20 bp, human
gcgagagccgcaagcggagt

SEQ ID NO: 129385 - DNA, 20 bp, human
ggtgcccctagatcaaccat

SEQ ID NO: 129386 - DNA, 20 bp, human
gggggcgtccgggtccgagt

SEQ ID NO: 129387 - DNA, 20 bp, human
gacccggacgcccctcgcag

SEQ ID NO: 129388 - DNA, 20 bp, human
gtgtgcagcccgactagggg

SEQ ID NO: 129389 - DNA, 20 bp, human
gagtcgggctgcacacaaag

SEQ ID NO: 129390 - DNA, 20 bp, human
gcggggcctcgcgcacacac

SEQ ID NO: 129391 - DNA, 20 bp, human
gtgcgccgccgcccctagtc

SEQ ID NO: 129392 - DNA, 20 bp, human
gttgtgtgcagcccgactag

SEQ ID NO: 129393 - DNA, 20 bp, human
ggagcgcccgggcctctgtc

SEQ ID NO: 129394 - DNA, 20 bp, human
gcgcccgggcctctgtcagg

SEQ ID NO: 129395 - DNA, 20 bp, human
gccctccagcagcctagggc

SEQ ID NO: 129396 - DNA, 20 bp, human
ggagtagcgagtcggcaacc

SEQ ID NO: 129397 - DNA, 20 bp, human
gaggcgattggatgcggcgg

SEQ ID NO: 129398 - DNA, 20 bp, human
gtagcgagtcggcaacccgg

SEQ ID NO: 129399 - DNA, 20 bp, human
gagtgagcggagtagcgagt

SEQ ID NO: 129400 - DNA, 20 bp, human
ggccccggccgggatcagag

SEQ ID NO: 129401 - DNA, 20 bp, human
ggagaggaggaggaacggca

SEQ ID NO: 129402 - DNA, 20 bp, human
gacgcacacagcggcagtgg

SEQ ID NO: 129403 - DNA, 20 bp, human
gcgctactccgctcactccg

SEQ ID NO: 129404 - DNA, 20 bp, human
gagtggcggccgctgaaaaa

SEQ ID NO: 129405 - DNA, 20 bp, human
ggaggctgcggcagaacccg

SEQ ID NO: 129406 - DNA, 20 bp, human
ggcgcgttggactgaagtag

SEQ ID NO: 129407 - DNA, 20 bp, human
gagcagtgggcggaatgaat

SEQ ID NO: 129408 - DNA, 20 bp, human
gaccccgggagcgttttggg

SEQ ID NO: 129409 - DNA, 20 bp, human
gggtgggatccgtgtcctgg

SEQ ID NO: 129410 - DNA, 20 bp, human
gacggctccaatgacagcag

SEQ ID NO: 129411 - DNA, 20 bp, human
ggtgggactccggagctgag

SEQ ID NO: 129412 - DNA, 20 bp, human
gaagtaggggcgccctacac

SEQ ID NO: 129413 - DNA, 20 bp, human
gggcgcgcggggtagctccg

SEQ ID NO: 129414 - DNA, 20 bp, human
gtagctccggggtagctccg

SEQ ID NO: 129415 - DNA, 20 bp, human
gtggcccgcgatcctcctcc

SEQ ID NO: 129416 - DNA, 20 bp, human
ggcgtcctccacataggcag

SEQ ID NO: 129417 - DNA, 20 bp, human
ggccgcgggaaacaaaccag

SEQ ID NO: 129418 - DNA, 20 bp, human
gaatatggcgtcctccacat

SEQ ID NO: 129419 - DNA, 20 bp, human
gacagccactgcctatgtgg

SEQ ID NO: 129420 - DNA, 20 bp, human
gcggcctgccgtaaagacag

SEQ ID NO: 129421 - DNA, 20 bp, human
gcagaggcggagaagatcgt

SEQ ID NO: 129422 - DNA, 20 bp, human
ggtggctgtggtttctaccc

SEQ ID NO: 129423 - DNA, 20 bp, human
gtggaatcaggtagtgtcag

SEQ ID NO: 129424 - DNA, 20 bp, human
ggcattccatgcctccaata

SEQ ID NO: 129425 - DNA, 20 bp, human
gtccccggcccactggaatc

SEQ ID NO: 129426 - DNA, 20 bp, human
gctgtcaaagcgagcagggg

SEQ ID NO: 129427 - DNA, 20 bp, human
gtgtgtggcgttcccactcc

SEQ ID NO: 129428 - DNA, 20 bp, human
ggttccctctgagatcagtg

SEQ ID NO: 129429 - DNA, 20 bp, human
gccggggatttggcactgtg

SEQ ID NO: 129430 - DNA, 20 bp, human
gcatgtacaggcacgcaggg

SEQ ID NO: 129431 - DNA, 20 bp, human
gtagacttcatccatgggaa

SEQ ID NO: 129432 - DNA, 20 bp, human
gggctccagctcccgactcc

SEQ ID NO: 129433 - DNA, 20 bp, human
gggagctgtcaaagcgagca

SEQ ID NO: 129434 - DNA, 20 bp, human
gcccgggccgcagccatgaa

SEQ ID NO: 129435 - DNA, 20 bp, human
gaaggcagctggacgcggtt

SEQ ID NO: 129436 - DNA, 20 bp, human
gtgacaggccctgcctgagg

SEQ ID NO: 129437 - DNA, 20 bp, human
gggctccgcccagcgctacg

SEQ ID NO: 129438 - DNA, 20 bp, human
gggcggggccccgtagcgct

SEQ ID NO: 129439 - DNA, 20 bp, human
gggggccccgtagcgctggg

SEQ ID NO: 129440 - DNA, 20 bp, human
ggttcggtgggggccgcgac

SEQ ID NO: 129441 - DNA, 20 bp, human
gcatcaggttcggcagcccg

SEQ ID NO: 129442 - DNA, 20 bp, human
gggcgaggcctcctcaggca

SEQ ID NO: 129443 - DNA, 20 bp, human
gcccgcgcccgcggccggcg

SEQ ID NO: 129444 - DNA, 20 bp, human
ggcgctgggcggagccctct

SEQ ID NO: 129445 - DNA, 20 bp, human
gaggctgggcggggttcggt

SEQ ID NO: 129446 - DNA, 20 bp, human
ggccgcccgctgaggtcaga

SEQ ID NO: 129447 - DNA, 20 bp, human
gtccttctgacctcagcggg

SEQ ID NO: 129448 - DNA, 20 bp, human
gggacccgtcccacccgcag

SEQ ID NO: 129449 - DNA, 20 bp, human
ggagccctgtgcaccagcta

SEQ ID NO: 129450 - DNA, 20 bp, human
ggggaactgaggctcgtctc

SEQ ID NO: 129451 - DNA, 20 bp, human
gcctggcgcgggcgccctgg

SEQ ID NO: 129452 - DNA, 20 bp, human
gggttcggagccgcccgctg

SEQ ID NO: 129453 - DNA, 20 bp, human
ggagccagagtcgcagccga

SEQ ID NO: 129454 - DNA, 20 bp, human
gggaggcgtctgcgctgatc

SEQ ID NO: 129455 - DNA, 20 bp, human
gcacgtagccgcggatgacg

SEQ ID NO: 129456 - DNA, 20 bp, human
gctgcatggcgcgctgcgag

SEQ ID NO: 129457 - DNA, 20 bp, human
gcgaagcgcagggccagctc

SEQ ID NO: 129458 - DNA, 20 bp, human
ggcgccgtgttcgtgctggg

SEQ ID NO: 129459 - DNA, 20 bp, human
gcgcgctgcgagaggctgcg

SEQ ID NO: 129460 - DNA, 20 bp, human
gagcgcgccatgcagccggc

SEQ ID NO: 129461 - DNA, 20 bp, human
gtcgtcgtagcccacaagca

SEQ ID NO: 129462 - DNA, 20 bp, human
gggagagcgcgccgtgcccg

SEQ ID NO: 129463 - DNA, 20 bp, human
gcggcccagcacgtcgcgca

SEQ ID NO: 129464 - DNA, 20 bp, human
gtcgccgcccagcacgaaca

SEQ ID NO: 129465 - DNA, 20 bp, human
gccggcgcgtccggaggccc

SEQ ID NO: 129466 - DNA, 20 bp, human
gtggctggtccaaggctcag

SEQ ID NO: 129467 - DNA, 20 bp, human
gcctggatgggagaagtgag

SEQ ID NO: 129468 - DNA, 20 bp, human
gtccttgactccggcttggg

SEQ ID NO: 129469 - DNA, 20 bp, human
gagcaggtcggaggtggcag

SEQ ID NO: 129470 - DNA, 20 bp, human
gtcctcccaagccggagtca

SEQ ID NO: 129471 - DNA, 20 bp, human
ggccaaagggtggtcctctt

SEQ ID NO: 129472 - DNA, 20 bp, human
gtggccgagcaggtcggagg

SEQ ID NO: 129473 - DNA, 20 bp, human
gctctggacctagagatggt

SEQ ID NO: 129474 - DNA, 20 bp, human
gtgcaggtaacatccagagg

SEQ ID NO: 129475 - DNA, 20 bp, human
ggcctccttgactccggctt

SEQ ID NO: 129476 - DNA, 20 bp, human
gtgtggactgcccactggtg

SEQ ID NO: 129477 - DNA, 20 bp, human
ggggtcagctcgttgcaccc

SEQ ID NO: 129478 - DNA, 20 bp, human
ggccgcaccacctcaccagt

SEQ ID NO: 129479 - DNA, 20 bp, human
gtgtcagtgagcggagtctg

SEQ ID NO: 129480 - DNA, 20 bp, human
ggtcgctgtggactgcccac

SEQ ID NO: 129481 - DNA, 20 bp, human
gtcagtctgggaaccggaag

SEQ ID NO: 129482 - DNA, 20 bp, human
gagactgaattgtcagtgag

SEQ ID NO: 129483 - DNA, 20 bp, human
gaactatccgcagggactcg

SEQ ID NO: 129484 - DNA, 20 bp, human
ggcccactggtgaggtggtg

SEQ ID NO: 129485 - DNA, 20 bp, human
gggatgccaagcaacctgtc

SEQ ID NO: 129486 - DNA, 20 bp, human
gtgcgcagcgaggcgaggag

SEQ ID NO: 129487 - DNA, 20 bp, human
ggaatccccgcccatcctgg

SEQ ID NO: 129488 - DNA, 20 bp, human
gtccgccgagcctccaggat

SEQ ID NO: 129489 - DNA, 20 bp, human
gtgggcacacacggtctcgg

SEQ ID NO: 129490 - DNA, 20 bp, human
ggagtgaggacgccgaaccg

SEQ ID NO: 129491 - DNA, 20 bp, human
ggaggagcggaccccagcgc

SEQ ID NO: 129492 - DNA, 20 bp, human
ggagccgcaggccgaaccca

SEQ ID NO: 129493 - DNA, 20 bp, human
ggcccatcctggaggctcgg

SEQ ID NO: 129494 - DNA, 20 bp, human
ggggacgcgcggctccgggt

SEQ ID NO: 129495 - DNA, 20 bp, human
gcgaaccggggtcccacgtt

SEQ ID NO: 129496 - DNA, 20 bp, human
gatctactgggcaaagaagt

SEQ ID NO: 129497 - DNA, 20 bp, human
gtatggagaaagccgcaggt

SEQ ID NO: 129498 - DNA, 20 bp, human
gcaatggaagaggcacatct

SEQ ID NO: 129499 - DNA, 20 bp, human
gcaggagaaatcctctgcag

SEQ ID NO: 129500 - DNA, 20 bp, human
gtgggttgctgatccagcta

SEQ ID NO: 129501 - DNA, 20 bp, human
gtgaaccttgtccctacccc

SEQ ID NO: 129502 - DNA, 20 bp, human
gagggaaacccccaaactca

SEQ ID NO: 129503 - DNA, 20 bp, human
ggacaggcagggggccgact

SEQ ID NO: 129504 - DNA, 20 bp, human
gctgcaggggactttgggac

SEQ ID NO: 129505 - DNA, 20 bp, human
gggcacttacagagttaacg

SEQ ID NO: 129506 - DNA, 20 bp, human
gcacccggccaggagaaaaa

SEQ ID NO: 129507 - DNA, 20 bp, human
ggggagctggagacggccag

SEQ ID NO: 129508 - DNA, 20 bp, human
ggcggctgctggacgaagag

SEQ ID NO: 129509 - DNA, 20 bp, human
gagcgaagagttaacctgag

SEQ ID NO: 129510 - DNA, 20 bp, human
ggctcgaggaggacaaggta

SEQ ID NO: 129511 - DNA, 20 bp, human
gccagtggggaggcccggag

SEQ ID NO: 129512 - DNA, 20 bp, human
gagctcccgcccgggacgac

SEQ ID NO: 129513 - DNA, 20 bp, human
gccgcgcccgggtcagtgaa

SEQ ID NO: 129514 - DNA, 20 bp, human
gtgcgtggtccagaaaccgg

SEQ ID NO: 129515 - DNA, 20 bp, human
gcacgcgagcgcgcccacgg

SEQ ID NO: 129516 - DNA, 20 bp, human
gagtagctctcgcctgcggg

SEQ ID NO: 129517 - DNA, 20 bp, human
ggcctgcgggtggtttgaca

SEQ ID NO: 129518 - DNA, 20 bp, human
ggccttgtcaaaccacccgc

SEQ ID NO: 129519 - DNA, 20 bp, human
gccacaccagcgaccaggtg

SEQ ID NO: 129520 - DNA, 20 bp, human
gcggcgccacaccagcgacc

SEQ ID NO: 129521 - DNA, 20 bp, human
ggtgagacaaaagagaggtc

SEQ ID NO: 129522 - DNA, 20 bp, human
gcggcagtagctctcgcctg

SEQ ID NO: 129523 - DNA, 20 bp, human
ggcccgcatatgcatgagag

SEQ ID NO: 129524 - DNA, 20 bp, human
ggtgcctggtcggcctcacc

SEQ ID NO: 129525 - DNA, 20 bp, human
gtgcggctccgggtctaaag

SEQ ID NO: 129526 - DNA, 20 bp, human
gcgccgccacaccggccctt

SEQ ID NO: 129527 - DNA, 20 bp, human
gcctcctcagacgctcccga

SEQ ID NO: 129528 - DNA, 20 bp, human
gctccgtgggcctcgtccag

SEQ ID NO: 129529 - DNA, 20 bp, human
gggctcgggccggcgcgctg

SEQ ID NO: 129530 - DNA, 20 bp, human
gtcccgaagggccggtgtgg

SEQ ID NO: 129531 - DNA, 20 bp, human
gggcccttcgggagcgtctg

SEQ ID NO: 129532 - DNA, 20 bp, human
gcgctcccgaagggccggtg

SEQ ID NO: 129533 - DNA, 20 bp, human
ggtgccgggcctgctcctaa

SEQ ID NO: 129534 - DNA, 20 bp, human
ggcggcgcccgagcccgcag

SEQ ID NO: 129535 - DNA, 20 bp, human
gcctcaggggccgctccgga

SEQ ID NO: 129536 - DNA, 20 bp, human
ggaggtcaggcagcccggga

SEQ ID NO: 129537 - DNA, 20 bp, human
ggggcaaggttcgaaactgt

SEQ ID NO: 129538 - DNA, 20 bp, human
gccttctgcatggtcccggg

SEQ ID NO: 129539 - DNA, 20 bp, human
gtaacaacaacgatggagag

SEQ ID NO: 129540 - DNA, 20 bp, human
gggttcgaaactgttggcat

SEQ ID NO: 129541 - DNA, 20 bp, human
ggaggccttctgcatggtcc

SEQ ID NO: 129542 - DNA, 20 bp, human
gatgatgataacaacaacga

SEQ ID NO: 129543 - DNA, 20 bp, human
gaagcgggtgaagaagccct

SEQ ID NO: 129544 - DNA, 20 bp, human
gaacggtgcactcttggcct

SEQ ID NO: 129545 - DNA, 20 bp, human
gagtttcgaaccttgcccgc

SEQ ID NO: 129546 - DNA, 20 bp, human
ggtggccagcaccctcaagg

SEQ ID NO: 129547 - DNA, 20 bp, human
gtcttacctggagatggaag

SEQ ID NO: 129548 - DNA, 20 bp, human
gccaaggcccctgtatcagt

SEQ ID NO: 129549 - DNA, 20 bp, human
ggaccttcctactgatacag

SEQ ID NO: 129550 - DNA, 20 bp, human
ggacacgagcagttcttacc

SEQ ID NO: 129551 - DNA, 20 bp, human
gctagtgggcaagctaagtt

SEQ ID NO: 129552 - DNA, 20 bp, human
ggtatcagtaggaaggtccc

SEQ ID NO: 129553 - DNA, 20 bp, human
gcctagcctacaaaggtgag

SEQ ID NO: 129554 - DNA, 20 bp, human
gggcccctgtatcagtagga

SEQ ID NO: 129555 - DNA, 20 bp, human
ggagtcttctctgctaccca

SEQ ID NO: 129556 - DNA, 20 bp, human
ggagctgctgtggagtctat

SEQ ID NO: 129557 - DNA, 20 bp, human
gctgagtacaggggacccgg

SEQ ID NO: 129558 - DNA, 20 bp, human
ggtccgcctgaaatcaacct

SEQ ID NO: 129559 - DNA, 20 bp, human
gggacccgggggtacaagta

SEQ ID NO: 129560 - DNA, 20 bp, human
gagcccaggttgatttcagg

SEQ ID NO: 129561 - DNA, 20 bp, human
ggagcaggcccagaatgagg

SEQ ID NO: 129562 - DNA, 20 bp, human
gacaccggcggccagaagca

SEQ ID NO: 129563 - DNA, 20 bp, human
gaagagcaggcattgcccaa

SEQ ID NO: 129564 - DNA, 20 bp, human
gcttctggccgccggtgtct

SEQ ID NO: 129565 - DNA, 20 bp, human
gaggaggctgagggccgaca

SEQ ID NO: 129566 - DNA, 20 bp, human
gcccctccctccccacgagg

SEQ ID NO: 129567 - DNA, 20 bp, human
gctgtctgggccgcctcgtg

SEQ ID NO: 129568 - DNA, 20 bp, human
gcgaggcggcccagacaggc

SEQ ID NO: 129569 - DNA, 20 bp, human
gcgcagcgctcgaggtgctc

SEQ ID NO: 129570 - DNA, 20 bp, human
ggaggaagtctggatcaatt

SEQ ID NO: 129571 - DNA, 20 bp, human
gtccagctcgaagcccatgg

SEQ ID NO: 129572 - DNA, 20 bp, human
ggatcaattaggctcagtcc

SEQ ID NO: 129573 - DNA, 20 bp, human
ggcagccggcgcagaagacg

SEQ ID NO: 129574 - DNA, 20 bp, human
gctgggccgcctcgtgggga

SEQ ID NO: 129575 - DNA, 20 bp, human
gtgaggataaggcgcttgag

SEQ ID NO: 129576 - DNA, 20 bp, human
gcggctgcggccactcggtc

SEQ ID NO: 129577 - DNA, 20 bp, human
gtcgggtcctcgcctggagg

SEQ ID NO: 129578 - DNA, 20 bp, human
ggtcaggctgcacgagctgg

SEQ ID NO: 129579 - DNA, 20 bp, human
gggacaagtgctcaaaaaat

SEQ ID NO: 129580 - DNA, 20 bp, human
gccgcgggcatggtcgattg

SEQ ID NO: 129581 - DNA, 20 bp, human
gctcgtgcagcctgaccgag

SEQ ID NO: 129582 - DNA, 20 bp, human
gaccgcagggtaagcaaagg

SEQ ID NO: 129583 - DNA, 20 bp, human
gtcctgctgcatagtgagga

SEQ ID NO: 129584 - DNA, 20 bp, human
ggaaggatgcccaattccaa

SEQ ID NO: 129585 - DNA, 20 bp, human
gacttcgtcggcgacctcgg

SEQ ID NO: 129586 - DNA, 20 bp, human
ggccgggagaccgccagcgg

SEQ ID NO: 129587 - DNA, 20 bp, human
ggtccgaagcctgagcgggg

SEQ ID NO: 129588 - DNA, 20 bp, human
gggacgctgcttaggaaccg

SEQ ID NO: 129589 - DNA, 20 bp, human
gcgtgaggcctgacacaaag

SEQ ID NO: 129590 - DNA, 20 bp, human
gggacgcaccgaccgaggga

SEQ ID NO: 129591 - DNA, 20 bp, human
gcagcccgttccacgctgaa

SEQ ID NO: 129592 - DNA, 20 bp, human
gtccccggctctgacatcac

SEQ ID NO: 129593 - DNA, 20 bp, human
gctcgggacgcaccgaccga

SEQ ID NO: 129594 - DNA, 20 bp, human
gggaccggggcctgtggatt

SEQ ID NO: 129595 - DNA, 20 bp, human
gggggccagacggggagtgt

SEQ ID NO: 129596 - DNA, 20 bp, human
gggagcgcgacgccccccag

SEQ ID NO: 129597 - DNA, 20 bp, human
gcggccgtggtcaccaggaa

SEQ ID NO: 129598 - DNA, 20 bp, human
gccccagaggaaggaaagtt

SEQ ID NO: 129599 - DNA, 20 bp, human
gcgcgacgccccccagagga

SEQ ID NO: 129600 - DNA, 20 bp, human
gagtgtcagttgctcggcgg

SEQ ID NO: 129601 - DNA, 20 bp, human
gacgggacggacggtgatgg

SEQ ID NO: 129602 - DNA, 20 bp, human
ggtccccttcctggtgacca

SEQ ID NO: 129603 - DNA, 20 bp, human
gtgccgcgagggacgccccc

SEQ ID NO: 129604 - DNA, 20 bp, human
gcgggccgctgttacctgag

SEQ ID NO: 129605 - DNA, 20 bp, human
gcgcccgggggcgtccctcg

SEQ ID NO: 129606 - DNA, 20 bp, human
gcacaaagtccggggaccag

SEQ ID NO: 129607 - DNA, 20 bp, human
ggactggacagccgaggacg

SEQ ID NO: 129608 - DNA, 20 bp, human
gtcaggctggggctcgaagt

SEQ ID NO: 129609 - DNA, 20 bp, human
gcccggactttgtgagtcag

SEQ ID NO: 129610 - DNA, 20 bp, human
ggaggaggactggacagccg

SEQ ID NO: 129611 - DNA, 20 bp, human
gtcctcctcgcagaccccgg

SEQ ID NO: 129612 - DNA, 20 bp, human
ggggcctcagactccagtcg

SEQ ID NO: 129613 - DNA, 20 bp, human
gtcagactccagtcgaggag

SEQ ID NO: 129614 - DNA, 20 bp, human
gacagccgaggacggggcga

SEQ ID NO: 129615 - DNA, 20 bp, human
gctgatggagagagacgtga

SEQ ID NO: 129616 - DNA, 20 bp, human
gtcagacccaagagggacct

SEQ ID NO: 129617 - DNA, 20 bp, human
ggtgggacccagcggagaca

SEQ ID NO: 129618 - DNA, 20 bp, human
gcccacccaggtacaccggg

SEQ ID NO: 129619 - DNA, 20 bp, human
gcccgccgcccggtgtacct

SEQ ID NO: 129620 - DNA, 20 bp, human
gcccaagagggacctaggtt

SEQ ID NO: 129621 - DNA, 20 bp, human
gccagcggagacagggccag

SEQ ID NO: 129622 - DNA, 20 bp, human
ggccaggcaggttcggcctg

SEQ ID NO: 129623 - DNA, 20 bp, human
ggacagggccaggggcggtg

SEQ ID NO: 129624 - DNA, 20 bp, human
ggcggcgggcgtgcagcgag

SEQ ID NO: 129625 - DNA, 20 bp, human
gacgcccacccaggtacacc

SEQ ID NO: 129626 - DNA, 20 bp, human
gtaagcacagggagaaggac

SEQ ID NO: 129627 - DNA, 20 bp, human
gagacctctggttaagcaca

SEQ ID NO: 129628 - DNA, 20 bp, human
gtcgtccaagagggcctcat

SEQ ID NO: 129629 - DNA, 20 bp, human
ggctaatccagtccaccacc

SEQ ID NO: 129630 - DNA, 20 bp, human
gtggtggactggattagctg

SEQ ID NO: 129631 - DNA, 20 bp, human
ggcctcattgtccaacccat

SEQ ID NO: 129632 - DNA, 20 bp, human
gtggattagctgcggagccc

SEQ ID NO: 129633 - DNA, 20 bp, human
gcaaagtacttgtgtccggg

SEQ ID NO: 129634 - DNA, 20 bp, human
gtctccctgtgcttaaccag

SEQ ID NO: 129635 - DNA, 20 bp, human
ggtgccatcctccatcaagg

SEQ ID NO: 129636 - DNA, 20 bp, human
gcaccaagttggaacatcct

SEQ ID NO: 129637 - DNA, 20 bp, human
gtagcgcatggcctggttag

SEQ ID NO: 129638 - DNA, 20 bp, human
gtaccctccttccaccaagt

SEQ ID NO: 129639 - DNA, 20 bp, human
gttccaaggatgttccaact

SEQ ID NO: 129640 - DNA, 20 bp, human
gtgggtagaaagagatacag

SEQ ID NO: 129641 - DNA, 20 bp, human
gtggagggcgaggtcataga

SEQ ID NO: 129642 - DNA, 20 bp, human
ggaaattggaagagcacaag

SEQ ID NO: 129643 - DNA, 20 bp, human
gcaagcctttgaaggaccaa

SEQ ID NO: 129644 - DNA, 20 bp, human
ggcggtgctcccaagtagtc

SEQ ID NO: 129645 - DNA, 20 bp, human
gtcatagaggggacaggggg

SEQ ID NO: 129646 - DNA, 20 bp, human
gaagagactgtgccccaggt

SEQ ID NO: 129647 - DNA, 20 bp, human
gggaggccatccctgcagcg

SEQ ID NO: 129648 - DNA, 20 bp, human
ggagctgcagagcaaagacg

SEQ ID NO: 129649 - DNA, 20 bp, human
gaggtggctgtggtgacctg

SEQ ID NO: 129650 - DNA, 20 bp, human
gtgggtctcagggacattcg

SEQ ID NO: 129651 - DNA, 20 bp, human
ggtctcagggacattcgagg

SEQ ID NO: 129652 - DNA, 20 bp, human
ggctctggcaccccgctgca

SEQ ID NO: 129653 - DNA, 20 bp, human
gcctggggtaacctggagac

SEQ ID NO: 129654 - DNA, 20 bp, human
ggagccaggagctctcggcg

SEQ ID NO: 129655 - DNA, 20 bp, human
gagtggctccacaattcctt

SEQ ID NO: 129656 - DNA, 20 bp, human
gggcccgcgaatccaggtag

SEQ ID NO: 129657 - DNA, 20 bp, human
gcatggccagctatccttac

SEQ ID NO: 129658 - DNA, 20 bp, human
gacgccccaaatgagatcgg

SEQ ID NO: 129659 - DNA, 20 bp, human
gccggcaggtgagtgtgtga

SEQ ID NO: 129660 - DNA, 20 bp, human
gcgagtgagcgacgtcaagg

SEQ ID NO: 129661 - DNA, 20 bp, human
gccgcgaatccaggtagcgg

SEQ ID NO: 129662 - DNA, 20 bp, human
ggcgccagcctggacctgtg

SEQ ID NO: 129663 - DNA, 20 bp, human
gacacactcacctgccggta

SEQ ID NO: 129664 - DNA, 20 bp, human
ggctgaagcgaacccatcgt

SEQ ID NO: 129665 - DNA, 20 bp, human
ggggcatcagccatgaccgg

SEQ ID NO: 129666 - DNA, 20 bp, human
gcaggaccaagtccagatac

SEQ ID NO: 129667 - DNA, 20 bp, human
gtgtagacagagatgagctg

SEQ ID NO: 129668 - DNA, 20 bp, human
gcacgcgcttcaacttcggt

SEQ ID NO: 129669 - DNA, 20 bp, human
gtgatgagctgcagacggtc

SEQ ID NO: 129670 - DNA, 20 bp, human
gggtacacgcgcttcaactt

SEQ ID NO: 129671 - DNA, 20 bp, human
ggaaacctgactgcgccctg

SEQ ID NO: 129672 - DNA, 20 bp, human
gttctcctcagggcgcagtc

SEQ ID NO: 129673 - DNA, 20 bp, human
gcgggctgcggagcacccag

SEQ ID NO: 129674 - DNA, 20 bp, human
ggcgtggtgagtatgcggtg

SEQ ID NO: 129675 - DNA, 20 bp, human
gtcctcgcgtggtgagtatg

SEQ ID NO: 129676 - DNA, 20 bp, human
gcgatcaactgagaaatccc

SEQ ID NO: 129677 - DNA, 20 bp, human
gttcatggaaaagagcacca

SEQ ID NO: 129678 - DNA, 20 bp, human
gcaagtggaacccacccctg

SEQ ID NO: 129679 - DNA, 20 bp, human
gcgggacccagggtgacggt

SEQ ID NO: 129680 - DNA, 20 bp, human
gaaggtcatgaagcagtcgg

SEQ ID NO: 129681 - DNA, 20 bp, human
gacaacaactccaagcacac

SEQ ID NO: 129682 - DNA, 20 bp, human
gggttccacttgctctcgaa

SEQ ID NO: 129683 - DNA, 20 bp, human
gcagctttgctgaggcccaa

SEQ ID NO: 129684 - DNA, 20 bp, human
gccaccccaaccgtcaccct

SEQ ID NO: 129685 - DNA, 20 bp, human
gggttgccatcgaacttctc

SEQ ID NO: 129686 - DNA, 20 bp, human
gcgcgggagatgtccaccct

SEQ ID NO: 129687 - DNA, 20 bp, human
gcacctcggtgcagaagtct

SEQ ID NO: 129688 - DNA, 20 bp, human
gggccaccgcagcaaaccgg

SEQ ID NO: 129689 - DNA, 20 bp, human
gggcccccggccagtcagaa

SEQ ID NO: 129690 - DNA, 20 bp, human
ggaggcgtcgagctgcacct

SEQ ID NO: 129691 - DNA, 20 bp, human
ggcagcagcccctcagaccc

SEQ ID NO: 129692 - DNA, 20 bp, human
gcagaccccggactgcaaga

SEQ ID NO: 129693 - DNA, 20 bp, human
gccggccagtcagaaaggcg

SEQ ID NO: 129694 - DNA, 20 bp, human
ggccgcctagcgcaccctca

SEQ ID NO: 129695 - DNA, 20 bp, human
gagtccgagagtgggcacag

SEQ ID NO: 129696 - DNA, 20 bp, human
gctgctgctagtggaggcgg

SEQ ID NO: 129697 - DNA, 20 bp, human
gacccagaggcggtgtgagg

SEQ ID NO: 129698 - DNA, 20 bp, human
gtgtgaggcggagggaccgt

SEQ ID NO: 129699 - DNA, 20 bp, human
gccgctgctgctagtggagg

SEQ ID NO: 129700 - DNA, 20 bp, human
gcgaccgcaccgcgggacta

SEQ ID NO: 129701 - DNA, 20 bp, human
gaggcggagggaccgtcggg

SEQ ID NO: 129702 - DNA, 20 bp, human
ggggcgcgcaacttcctcgg

SEQ ID NO: 129703 - DNA, 20 bp, human
gcagaggcggtgtgaggcgg

SEQ ID NO: 129704 - DNA, 20 bp, human
gggcgggcgcgcaacttcct

SEQ ID NO: 129705 - DNA, 20 bp, human
ggagcggcccccgagacccg

SEQ ID NO: 129706 - DNA, 20 bp, human
ggtcagagccggcaacaaat

SEQ ID NO: 129707 - DNA, 20 bp, human
gaaatgggacccggcagcag

SEQ ID NO: 129708 - DNA, 20 bp, human
gccagccccgctccaggatg

SEQ ID NO: 129709 - DNA, 20 bp, human
ggccggcaacaaatgggacc

SEQ ID NO: 129710 - DNA, 20 bp, human
gccctcccgcggggcttcgg

SEQ ID NO: 129711 - DNA, 20 bp, human
gtgttgccggctctgactcg

SEQ ID NO: 129712 - DNA, 20 bp, human
ggaacactgcgcccccaata

SEQ ID NO: 129713 - DNA, 20 bp, human
ggcggcaggagaggctctca

SEQ ID NO: 129714 - DNA, 20 bp, human
ggagggagcgggcgcacgag

SEQ ID NO: 129715 - DNA, 20 bp, human
ggcccgggaccagggacccc

SEQ ID NO: 129716 - DNA, 20 bp, human
gcctgggtgtccccgtgacg

SEQ ID NO: 129717 - DNA, 20 bp, human
gtgcagcccgagctcgaggg

SEQ ID NO: 129718 - DNA, 20 bp, human
gaggcctcctgagacccggg

SEQ ID NO: 129719 - DNA, 20 bp, human
gctccgcgctgcctcgtcac

SEQ ID NO: 129720 - DNA, 20 bp, human
ggcgggcagaacgggaaccg

SEQ ID NO: 129721 - DNA, 20 bp, human
gcgggcccatcccgccgcag

SEQ ID NO: 129722 - DNA, 20 bp, human
gggtctcaggaggcctgcgg

SEQ ID NO: 129723 - DNA, 20 bp, human
gtacgcaggtccacacccgg

SEQ ID NO: 129724 - DNA, 20 bp, human
gtccccgtgacgaggcagcg

SEQ ID NO: 129725 - DNA, 20 bp, human
ggtggagggagtgggtccga

SEQ ID NO: 129726 - DNA, 20 bp, human
ggccagcgggaactgtgtag

SEQ ID NO: 129727 - DNA, 20 bp, human
gcgaggagcctgaggacatg

SEQ ID NO: 129728 - DNA, 20 bp, human
ggcctccacgcagagagtga

SEQ ID NO: 129729 - DNA, 20 bp, human
gcgctggcagcacgcaacag

SEQ ID NO: 129730 - DNA, 20 bp, human
gacccctacacagttcccgc

SEQ ID NO: 129731 - DNA, 20 bp, human
gagtcctccacgggcagcgt

SEQ ID NO: 129732 - DNA, 20 bp, human
gcagcgggctgacgaaatga

SEQ ID NO: 129733 - DNA, 20 bp, human
ggctgcgtctaacaggctcg

SEQ ID NO: 129734 - DNA, 20 bp, human
gggctcactgacagaaccaa

SEQ ID NO: 129735 - DNA, 20 bp, human
gccggcgcgctgcgtctaac

SEQ ID NO: 129736 - DNA, 20 bp, human
gagatcaccctctcaatgaa

SEQ ID NO: 129737 - DNA, 20 bp, human
gggcagaggactgggaaccg

SEQ ID NO: 129738 - DNA, 20 bp, human
ggcaggcgacagcgacccct

SEQ ID NO: 129739 - DNA, 20 bp, human
gggcgacagcgacccctggg

SEQ ID NO: 129740 - DNA, 20 bp, human
gcgggccaaatcccctaagg

SEQ ID NO: 129741 - DNA, 20 bp, human
gggagcagcctcagcgccag

SEQ ID NO: 129742 - DNA, 20 bp, human
gtgtttaggctaaagtccac

SEQ ID NO: 129743 - DNA, 20 bp, human
ggcgatgtggcaatccgtct

SEQ ID NO: 129744 - DNA, 20 bp, human
gaccgcggcagcgggataag

SEQ ID NO: 129745 - DNA, 20 bp, human
gctgggcgccgctgccactg

SEQ ID NO: 129746 - DNA, 20 bp, human
gtgcggctgcatgggtcggt

SEQ ID NO: 129747 - DNA, 20 bp, human
gccgcctcggacacgctcac

SEQ ID NO: 129748 - DNA, 20 bp, human
gatgagcccgggcaaatgtg

SEQ ID NO: 129749 - DNA, 20 bp, human
ggcagagggcccactcagaa

SEQ ID NO: 129750 - DNA, 20 bp, human
gggtcttgcgcactgagtga

SEQ ID NO: 129751 - DNA, 20 bp, human
gagctgggaaggagcatgcg

SEQ ID NO: 129752 - DNA, 20 bp, human
gctattgcggctgcatgggt

SEQ ID NO: 129753 - DNA, 20 bp, human
gggaacccgggggaagatgg

SEQ ID NO: 129754 - DNA, 20 bp, human
gggactcgcgggctcaagct

SEQ ID NO: 129755 - DNA, 20 bp, human
gtcggttcccggagtgatgg

SEQ ID NO: 129756 - DNA, 20 bp, human
gcaatctcagggccacacac

SEQ ID NO: 129757 - DNA, 20 bp, human
ggcccgcgtggtgcctcctg

SEQ ID NO: 129758 - DNA, 20 bp, human
gcgcgtggtgcctcctgagg

SEQ ID NO: 129759 - DNA, 20 bp, human
gtctataggtccggttccgg

SEQ ID NO: 129760 - DNA, 20 bp, human
gttgcgtgtgtcagagacgg

SEQ ID NO: 129761 - DNA, 20 bp, human
gcccagatctcttcatccgg

SEQ ID NO: 129762 - DNA, 20 bp, human
ggaggtaacgaacagctcgg

SEQ ID NO: 129763 - DNA, 20 bp, human
gccggaccgccgcggaaact

SEQ ID NO: 129764 - DNA, 20 bp, human
ggcccccggatgaagagatc

SEQ ID NO: 129765 - DNA, 20 bp, human
ggaaccggacctatagagcc

SEQ ID NO: 129766 - DNA, 20 bp, human
gagagaacgccgcagaccag

SEQ ID NO: 129767 - DNA, 20 bp, human
gcccaacgcgaggctgcctg

SEQ ID NO: 129768 - DNA, 20 bp, human
gcagccgttaagccccggga

SEQ ID NO: 129769 - DNA, 20 bp, human
gggaggcaggacattgactg

SEQ ID NO: 129770 - DNA, 20 bp, human
ggtcggccgggcgcactagg

SEQ ID NO: 129771 - DNA, 20 bp, human
ggcggcccagggcaagattc

SEQ ID NO: 129772 - DNA, 20 bp, human
ggggtgtgctggcggacgta

SEQ ID NO: 129773 - DNA, 20 bp, human
gacgtagggcctcaccgtcg

SEQ ID NO: 129774 - DNA, 20 bp, human
gtgaccccgcagagacgctg

SEQ ID NO: 129775 - DNA, 20 bp, human
gactatctggggaccggtaa

SEQ ID NO: 129776 - DNA, 20 bp, human
ggtcgctgaatgccgcgggt

SEQ ID NO: 129777 - DNA, 20 bp, human
ggaacatggcggcggccacc

SEQ ID NO: 129778 - DNA, 20 bp, human
gcggtgccgggcgaacatgg

SEQ ID NO: 129779 - DNA, 20 bp, human
gaggcgcagcactcacccgg

SEQ ID NO: 129780 - DNA, 20 bp, human
gacgccagcgggaaagagcg

SEQ ID NO: 129781 - DNA, 20 bp, human
gaccggcgtcacgtgaagtg

SEQ ID NO: 129782 - DNA, 20 bp, human
ggaggaggcggtattcgaga

SEQ ID NO: 129783 - DNA, 20 bp, human
gagctgcacgctccgagtca

SEQ ID NO: 129784 - DNA, 20 bp, human
gcggcgttgcgaggacccca

SEQ ID NO: 129785 - DNA, 20 bp, human
ggctgccaagacccccgggt

SEQ ID NO: 129786 - DNA, 20 bp, human
gcctggtagggcaagtcgga

SEQ ID NO: 129787 - DNA, 20 bp, human
gtcggagggtaccaaagggt

SEQ ID NO: 129788 - DNA, 20 bp, human
ggcaagtcggagggtaccaa

SEQ ID NO: 129789 - DNA, 20 bp, human
gcgccgagcggtgagtgctc

SEQ ID NO: 129790 - DNA, 20 bp, human
gccaaacaccctgggagcag

SEQ ID NO: 129791 - DNA, 20 bp, human
gctccttaaacacttgaaag

SEQ ID NO: 129792 - DNA, 20 bp, human
gactcaggtctagagggacg

SEQ ID NO: 129793 - DNA, 20 bp, human
gcaagtgtccagggactcca

SEQ ID NO: 129794 - DNA, 20 bp, human
ggaaagaggcagaggttcgg

SEQ ID NO: 129795 - DNA, 20 bp, human
gccgtgaactcaggtctaga

SEQ ID NO: 129796 - DNA, 20 bp, human
ggacactcctgcgaccaggt

SEQ ID NO: 129797 - DNA, 20 bp, human
gcgaagtgggctgacatcac

SEQ ID NO: 129798 - DNA, 20 bp, human
gagtgggctgacatcacagg

SEQ ID NO: 129799 - DNA, 20 bp, human
ggcccggtggagcttccact

SEQ ID NO: 129800 - DNA, 20 bp, human
gactggagaacagagacacg

SEQ ID NO: 129801 - DNA, 20 bp, human
ggctccagcccgcagccgag

SEQ ID NO: 129802 - DNA, 20 bp, human
ggagcgctgaaagcctaata

SEQ ID NO: 129803 - DNA, 20 bp, human
ggccgagtggaagctccacc

SEQ ID NO: 129804 - DNA, 20 bp, human
gccggtaccaggaccctatt

SEQ ID NO: 129805 - DNA, 20 bp, human
gggaggacactcctgcgacc

SEQ ID NO: 129806 - DNA, 20 bp, human
ggcctgaggtccgaaaggtg

SEQ ID NO: 129807 - DNA, 20 bp, human
gggatacgtgcagctgtggg

SEQ ID NO: 129808 - DNA, 20 bp, human
gaggtgaggcagcgtgtgta

SEQ ID NO: 129809 - DNA, 20 bp, human
gcaggagcctgaggtccgaa

SEQ ID NO: 129810 - DNA, 20 bp, human
gtacgtgcagctgtgggcgg

SEQ ID NO: 129811 - DNA, 20 bp, human
gctcctgagctgcgaagcgg

SEQ ID NO: 129812 - DNA, 20 bp, human
gaggctcctgagctgcgaag

SEQ ID NO: 129813 - DNA, 20 bp, human
ggacagcggcgactcggccg

SEQ ID NO: 129814 - DNA, 20 bp, human
gaggggatacgtgcagctgt

SEQ ID NO: 129815 - DNA, 20 bp, human
gccacctgggacagggccaa

SEQ ID NO: 129816 - DNA, 20 bp, human
ggagcctcgagactgcgcga

SEQ ID NO: 129817 - DNA, 20 bp, human
ggcctagggggaggagacaa

SEQ ID NO: 129818 - DNA, 20 bp, human
gccgccctcgcgcagtctcg

SEQ ID NO: 129819 - DNA, 20 bp, human
ggcacagccgctcgcccccg

SEQ ID NO: 129820 - DNA, 20 bp, human
gcgcggcgccggctgctgac

SEQ ID NO: 129821 - DNA, 20 bp, human
gggcgggaccggtcacgcgg

SEQ ID NO: 129822 - DNA, 20 bp, human
gtgcgcggggccaagggcgg

SEQ ID NO: 129823 - DNA, 20 bp, human
gtcggcgcgcgggaaagttg

SEQ ID NO: 129824 - DNA, 20 bp, human
gccatggcgttagtgagaac

SEQ ID NO: 129825 - DNA, 20 bp, human
gtggcgttagtgagaacagg

SEQ ID NO: 129826 - DNA, 20 bp, human
gagcggatcatgttgacggg

SEQ ID NO: 129827 - DNA, 20 bp, human
gcgcgtgatgggccctcaca

SEQ ID NO: 129828 - DNA, 20 bp, human
ggcccgagctcgtcctaaac

SEQ ID NO: 129829 - DNA, 20 bp, human
gggcagcgggtcctacgagg

SEQ ID NO: 129830 - DNA, 20 bp, human
gctctgacagccctcctcgt

SEQ ID NO: 129831 - DNA, 20 bp, human
ggtcagagcctcatggagta

SEQ ID NO: 129832 - DNA, 20 bp, human
gggctcccccgaccctgtga

SEQ ID NO: 129833 - DNA, 20 bp, human
ggagagtggcctgcgagcgc

SEQ ID NO: 129834 - DNA, 20 bp, human
gtggtggaaatgctcccaag

SEQ ID NO: 129835 - DNA, 20 bp, human
ggatgggccctcacagggtc

SEQ ID NO: 129836 - DNA, 20 bp, human
gcgactagggccgcgcgtac

SEQ ID NO: 129837 - DNA, 20 bp, human
gtccttggcagggcacgtgc

SEQ ID NO: 129838 - DNA, 20 bp, human
gccacgttgaggagccgact

SEQ ID NO: 129839 - DNA, 20 bp, human
ggtcctcggggtccttggca

SEQ ID NO: 129840 - DNA, 20 bp, human
gcactaaccaactaatgtaa

SEQ ID NO: 129841 - DNA, 20 bp, human
gacgtcttggatgggttctg

SEQ ID NO: 129842 - DNA, 20 bp, human
gtcgtggagactggaaagac

SEQ ID NO: 129843 - DNA, 20 bp, human
ggtgattgggaaagacggtg

SEQ ID NO: 129844 - DNA, 20 bp, human
gttggcagggcacgtgcggg

SEQ ID NO: 129845 - DNA, 20 bp, human
gtcggtaaatagtggtccca

SEQ ID NO: 129846 - DNA, 20 bp, human
gtgggtgggtgtctatgaca

SEQ ID NO: 129847 - DNA, 20 bp, human
gttgaccgggagaaacgaga

SEQ ID NO: 129848 - DNA, 20 bp, human
ggctcccgggatcttaagtg

SEQ ID NO: 129849 - DNA, 20 bp, human
gagatcctgggggagctctc

SEQ ID NO: 129850 - DNA, 20 bp, human
gttctgtcttgctggagggt

SEQ ID NO: 129851 - DNA, 20 bp, human
gggtcggctttgggcggaac

SEQ ID NO: 129852 - DNA, 20 bp, human
gggagctctcgggctcgtgg

SEQ ID NO: 129853 - DNA, 20 bp, human
gggaagacttaagatcctgg

SEQ ID NO: 129854 - DNA, 20 bp, human
ggatgggtaatgaggtctcg

SEQ ID NO: 129855 - DNA, 20 bp, human
gcagcaagacagaagctcac

SEQ ID NO: 129856 - DNA, 20 bp, human
gggctgccgtggaagacgtt

SEQ ID NO: 129857 - DNA, 20 bp, human
gcaagaaccaccgtcaaccc

SEQ ID NO: 129858 - DNA, 20 bp, human
gggcagccccagcgcagcat

SEQ ID NO: 129859 - DNA, 20 bp, human
ggaaagcccaacgtcttcca

SEQ ID NO: 129860 - DNA, 20 bp, human
ggaccctggagttacaatgg

SEQ ID NO: 129861 - DNA, 20 bp, human
gcggcgcccatgctgcgctg

SEQ ID NO: 129862 - DNA, 20 bp, human
gggagcctcgcggcatagtg

SEQ ID NO: 129863 - DNA, 20 bp, human
gttccacctcacagttaggt

SEQ ID NO: 129864 - DNA, 20 bp, human
gcccagtcggagcccctctt

SEQ ID NO: 129865 - DNA, 20 bp, human
gcgccgccattgtaactcca

SEQ ID NO: 129866 - DNA, 20 bp, human
ggtcgacctggggcctctcg

SEQ ID NO: 129867 - DNA, 20 bp, human
gatgtctaggagctcgaagg

SEQ ID NO: 129868 - DNA, 20 bp, human
gggcggcggtgcgcactctg

SEQ ID NO: 129869 - DNA, 20 bp, human
gtcgggcgggcgggagagag

SEQ ID NO: 129870 - DNA, 20 bp, human
gggtcgagcctgggcagtac

SEQ ID NO: 129871 - DNA, 20 bp, human
gggcggtgcgcactctgcgg

SEQ ID NO: 129872 - DNA, 20 bp, human
gcttcagcgcggagctccaa

SEQ ID NO: 129873 - DNA, 20 bp, human
ggcctgggcagtacaggcgg

SEQ ID NO: 129874 - DNA, 20 bp, human
gccgcagattcaggacgacc

SEQ ID NO: 129875 - DNA, 20 bp, human
ggaggagctgaggaaccgag

SEQ ID NO: 129876 - DNA, 20 bp, human
gaggccgaggacgtcggagc

SEQ ID NO: 129877 - DNA, 20 bp, human
ggacgctccgggacgatgtg

SEQ ID NO: 129878 - DNA, 20 bp, human
gtcctttgcggcgctagggt

SEQ ID NO: 129879 - DNA, 20 bp, human
gctgggataagacgagccca

SEQ ID NO: 129880 - DNA, 20 bp, human
gagagatcagggtccctcga

SEQ ID NO: 129881 - DNA, 20 bp, human
ggctgggccacgagacgccg

SEQ ID NO: 129882 - DNA, 20 bp, human
gagggctgcactggacttgt

SEQ ID NO: 129883 - DNA, 20 bp, human
gcctagcgccgcaaaggacc

SEQ ID NO: 129884 - DNA, 20 bp, human
ggagacgccgcggcaggtgg

SEQ ID NO: 129885 - DNA, 20 bp, human
gtcgctgccccacatcgtcc

SEQ ID NO: 129886 - DNA, 20 bp, human
gcgcgcggatcacctccggg

SEQ ID NO: 129887 - DNA, 20 bp, human
gtcgggaccacccgaacccg

SEQ ID NO: 129888 - DNA, 20 bp, human
gccttcccgtccccagctca

SEQ ID NO: 129889 - DNA, 20 bp, human
gcaggtccagctgacgccag

SEQ ID NO: 129890 - DNA, 20 bp, human
ggacgggcgagaactgatga

SEQ ID NO: 129891 - DNA, 20 bp, human
gcaggccgcagacaccgcgg

SEQ ID NO: 129892 - DNA, 20 bp, human
gtggtcccgagcagccacgc

SEQ ID NO: 129893 - DNA, 20 bp, human
gccacccgaacccgcggcca

SEQ ID NO: 129894 - DNA, 20 bp, human
ggtcctcgcgagcggcccag

SEQ ID NO: 129895 - DNA, 20 bp, human
gggacgagtactaccgcggt

SEQ ID NO: 129896 - DNA, 20 bp, human
gctcctgtagatggaaccag

SEQ ID NO: 129897 - DNA, 20 bp, human
gtgtgggatcatccccagac

SEQ ID NO: 129898 - DNA, 20 bp, human
gtctgctcccaggggacgag

SEQ ID NO: 129899 - DNA, 20 bp, human
gcacctctggttccatctac

SEQ ID NO: 129900 - DNA, 20 bp, human
ggggccattcctgcagtgtg

SEQ ID NO: 129901 - DNA, 20 bp, human
gtgcctggtacatacctgaa

SEQ ID NO: 129902 - DNA, 20 bp, human
gcagttccttgcctcacctc

SEQ ID NO: 129903 - DNA, 20 bp, human
gacatacctgaatggctgca

SEQ ID NO: 129904 - DNA, 20 bp, human
gtgcgccccgctgacctcag

SEQ ID NO: 129905 - DNA, 20 bp, human
gctcccaggggacgagcgga

SEQ ID NO: 129906 - DNA, 20 bp, human
gaccgccgacgacgggacac

SEQ ID NO: 129907 - DNA, 20 bp, human
gaagcgggtgaaggcgtcca

SEQ ID NO: 129908 - DNA, 20 bp, human
gtcagccggtgtcccgtcgt

SEQ ID NO: 129909 - DNA, 20 bp, human
gcaaaggccacgagtcgcac

SEQ ID NO: 129910 - DNA, 20 bp, human
gccggagagcaaagttagga

SEQ ID NO: 129911 - DNA, 20 bp, human
gtccatggcttctagcccaa

SEQ ID NO: 129912 - DNA, 20 bp, human
gccccctcagcggataacct

SEQ ID NO: 129913 - DNA, 20 bp, human
gtgggactgaccgttccctg

SEQ ID NO: 129914 - DNA, 20 bp, human
gggcggtctcgaggcggcta

SEQ ID NO: 129915 - DNA, 20 bp, human
ggtcgtcggcggtctcgagg

SEQ ID NO: 129916 - DNA, 20 bp, human
gcgaagtcagtttaggctac

SEQ ID NO: 129917 - DNA, 20 bp, human
ggtgtaggtgcggcccgaat

SEQ ID NO: 129918 - DNA, 20 bp, human
ggaatggagaccaaacgcca

SEQ ID NO: 129919 - DNA, 20 bp, human
gtgagcactgaagcggaccc

SEQ ID NO: 129920 - DNA, 20 bp, human
ggactctgcccccagagctg

SEQ ID NO: 129921 - DNA, 20 bp, human
gtgactaggggcgggaagtg

SEQ ID NO: 129922 - DNA, 20 bp, human
gaaaggaatcatctcaacag

SEQ ID NO: 129923 - DNA, 20 bp, human
gcgacagtgtcctcactggg

SEQ ID NO: 129924 - DNA, 20 bp, human
ggtgtggggacacggaaact

SEQ ID NO: 129925 - DNA, 20 bp, human
gcgaatggcagcacggtgtg

SEQ ID NO: 129926 - DNA, 20 bp, human
gcggcgctggagtcgtacag

SEQ ID NO: 129927 - DNA, 20 bp, human
ggggccgggaccgcctggtg

SEQ ID NO: 129928 - DNA, 20 bp, human
gtgacgtcacggagttgcca

SEQ ID NO: 129929 - DNA, 20 bp, human
gttgccatggcgtcgctgag

SEQ ID NO: 129930 - DNA, 20 bp, human
gtccgagctaggctcaaatg

SEQ ID NO: 129931 - DNA, 20 bp, human
gggccaaactctaggacctc

SEQ ID NO: 129932 - DNA, 20 bp, human
ggggaccgcctggtgaggca

SEQ ID NO: 129933 - DNA, 20 bp, human
gacataaatgtccaatgcta

SEQ ID NO: 129934 - DNA, 20 bp, human
gctggagtcgtacaggggcc

SEQ ID NO: 129935 - DNA, 20 bp, human
gtgagcttgggccaaactct

SEQ ID NO: 129936 - DNA, 20 bp, human
gggagacctcccttcaaacg

SEQ ID NO: 129937 - DNA, 20 bp, human
gtgctcgctgaccccaggcg

SEQ ID NO: 129938 - DNA, 20 bp, human
gccttcaaacgtggcgtcgt

SEQ ID NO: 129939 - DNA, 20 bp, human
gggggtcagcgagcaaggac

SEQ ID NO: 129940 - DNA, 20 bp, human
ggggcagagcgtgactgtgg

SEQ ID NO: 129941 - DNA, 20 bp, human
gtgcggcttctgtcataaag

SEQ ID NO: 129942 - DNA, 20 bp, human
gttgtgtcccgggctcacag

SEQ ID NO: 129943 - DNA, 20 bp, human
gcagtacacgcaggaaacta

SEQ ID NO: 129944 - DNA, 20 bp, human
ggccgagggtagtctcaaga

SEQ ID NO: 129945 - DNA, 20 bp, human
gcagcgagcaaggacgggcg

SEQ ID NO: 129946 - DNA, 20 bp, human
gcgggtctcccagggtttgg

SEQ ID NO: 129947 - DNA, 20 bp, human
gctcctacccctgactgtcc

SEQ ID NO: 129948 - DNA, 20 bp, human
gacgcgggcctggacagtca

SEQ ID NO: 129949 - DNA, 20 bp, human
ggaattcggcgggtctccca

SEQ ID NO: 129950 - DNA, 20 bp, human
gctgtgcttgaaagaaaggg

SEQ ID NO: 129951 - DNA, 20 bp, human
gggcccctatccccaaggtt

SEQ ID NO: 129952 - DNA, 20 bp, human
gagctcctgggcgtctctct

SEQ ID NO: 129953 - DNA, 20 bp, human
gctggagcgtaagacacaac

SEQ ID NO: 129954 - DNA, 20 bp, human
gtggcaggaggcggttgtag

SEQ ID NO: 129955 - DNA, 20 bp, human
ggaaaacagaagcggtaggt

SEQ ID NO: 129956 - DNA, 20 bp, human
gagagcagccgagccaggta

SEQ ID NO: 129957 - DNA, 20 bp, human
ggctgaggccgtgagggagt

SEQ ID NO: 129958 - DNA, 20 bp, human
gaagatggcgtcctcggagc

SEQ ID NO: 129959 - DNA, 20 bp, human
gctcagaaagatggcgtcct

SEQ ID NO: 129960 - DNA, 20 bp, human
gcgagccaggtaaggggagt

SEQ ID NO: 129961 - DNA, 20 bp, human
gcagcggcggttgattagtc

SEQ ID NO: 129962 - DNA, 20 bp, human
gttcccggctgtcccctccg

SEQ ID NO: 129963 - DNA, 20 bp, human
ggagggagtgggaaccctaa

SEQ ID NO: 129964 - DNA, 20 bp, human
gcaagctcaagtgggaccag

SEQ ID NO: 129965 - DNA, 20 bp, human
ggagaaacctcgcccagcgg

SEQ ID NO: 129966 - DNA, 20 bp, human
gtctctggggaactcaccag

SEQ ID NO: 129967 - DNA, 20 bp, human
gggcgccgcagcctgtcgta

SEQ ID NO: 129968 - DNA, 20 bp, human
gtgtcgtacggtccttctgt

SEQ ID NO: 129969 - DNA, 20 bp, human
gagtcacgtactcctggtag

SEQ ID NO: 129970 - DNA, 20 bp, human
ggtgggtctgtcggtgccga

SEQ ID NO: 129971 - DNA, 20 bp, human
ggcaccgacagacccacaga

SEQ ID NO: 129972 - DNA, 20 bp, human
gtggagaagctgcggctcct

SEQ ID NO: 129973 - DNA, 20 bp, human
gacgggcagcccaggtcctc

SEQ ID NO: 129974 - DNA, 20 bp, human
gcacgtactcctggtagcgg

SEQ ID NO: 129975 - DNA, 20 bp, human
gaggaccgtacgacaggctg

SEQ ID NO: 129976 - DNA, 20 bp, human
ggaggaaggctgtagtgtcg

SEQ ID NO: 129977 - DNA, 20 bp, human
ggccgaagcggacagggaat

SEQ ID NO: 129978 - DNA, 20 bp, human
ggcctcctacggcaagtcgg

SEQ ID NO: 129979 - DNA, 20 bp, human
gtgtagtgtcggggccgaag

SEQ ID NO: 129980 - DNA, 20 bp, human
ggaggaggtcccgcctccta

SEQ ID NO: 129981 - DNA, 20 bp, human
ggtcggggccgaagcggaca

SEQ ID NO: 129982 - DNA, 20 bp, human
gcccgcctcctacggcaagt

SEQ ID NO: 129983 - DNA, 20 bp, human
ggaagcggacagggaattgg

SEQ ID NO: 129984 - DNA, 20 bp, human
gctacagccttcctcagcgg

SEQ ID NO: 129985 - DNA, 20 bp, human
gggacgaggcacacaaggac

SEQ ID NO: 129986 - DNA, 20 bp, human
gagccttggtaatccagatt

SEQ ID NO: 129987 - DNA, 20 bp, human
gagccgaatctggattacca

SEQ ID NO: 129988 - DNA, 20 bp, human
gtactacgtggaatgcagag

SEQ ID NO: 129989 - DNA, 20 bp, human
gcaaggcttccggaactcgc

SEQ ID NO: 129990 - DNA, 20 bp, human
ggacaagccgaagagccgaa

SEQ ID NO: 129991 - DNA, 20 bp, human
gtttgcactccggctctcta

SEQ ID NO: 129992 - DNA, 20 bp, human
ggctaaagcgcagttctcgt

SEQ ID NO: 129993 - DNA, 20 bp, human
gtccggaagcctgcgagttc

SEQ ID NO: 129994 - DNA, 20 bp, human
gtagggcagacactgacctt

SEQ ID NO: 129995 - DNA, 20 bp, human
gtccggctcctgcgtcgctc

SEQ ID NO: 129996 - DNA, 20 bp, human
gcccccgagccccctgaggg

SEQ ID NO: 129997 - DNA, 20 bp, human
gggtcccccgagccccctga

SEQ ID NO: 129998 - DNA, 20 bp, human
gtcacctcgcctcccggcag

SEQ ID NO: 129999 - DNA, 20 bp, human
gcctctgcagcccccctcag

SEQ ID NO: 130000 - DNA, 20 bp, human
gaaagactcacctcgcctcc

SEQ ID NO: 130001 - DNA, 20 bp, human
gggcccaggtcctcagacgt

SEQ ID NO: 130002 - DNA, 20 bp, human
gccggccgtggaccttctgg

SEQ ID NO: 130003 - DNA, 20 bp, human
gccggctcgctgctgcgcag

SEQ ID NO: 130004 - DNA, 20 bp, human
ggaggcggccgacctcctgg

SEQ ID NO: 130005 - DNA, 20 bp, human
ggctagggccaggtattcca

SEQ ID NO: 130006 - DNA, 20 bp, human
ggcagagactgtcaccggag

SEQ ID NO: 130007 - DNA, 20 bp, human
gtgcagagatgggagaaccc

SEQ ID NO: 130008 - DNA, 20 bp, human
gcctagtctgggatatgtag

SEQ ID NO: 130009 - DNA, 20 bp, human
ggagttaagagtcggtgaca

SEQ ID NO: 130010 - DNA, 20 bp, human
gagggagttcgatcaaccat

SEQ ID NO: 130011 - DNA, 20 bp, human
gggcttgtcggaccagtgag

SEQ ID NO: 130012 - DNA, 20 bp, human
ggggaggtggccaacctcca

SEQ ID NO: 130013 - DNA, 20 bp, human
gatgggagaaccctggaggt

SEQ ID NO: 130014 - DNA, 20 bp, human
ggagtcggtgacagggcaaa

SEQ ID NO: 130015 - DNA, 20 bp, human
gtttccgcagagactgtcac

SEQ ID NO: 130016 - DNA, 20 bp, human
ggccgcgccgcacgacccgc

SEQ ID NO: 130017 - DNA, 20 bp, human
gctccggtgacttaagggga

SEQ ID NO: 130018 - DNA, 20 bp, human
gtgagcgcctgaccccgagg

SEQ ID NO: 130019 - DNA, 20 bp, human
gtccgcgactacggtcccat

SEQ ID NO: 130020 - DNA, 20 bp, human
ggtcgcggaggcctctgcag

SEQ ID NO: 130021 - DNA, 20 bp, human
gggctgcgcggggctaggta

SEQ ID NO: 130022 - DNA, 20 bp, human
gggtgccccggcgggtcgtg

SEQ ID NO: 130023 - DNA, 20 bp, human
gcggggtcaggcgctcaccg

SEQ ID NO: 130024 - DNA, 20 bp, human
gcagaggcgcaggctggaag

SEQ ID NO: 130025 - DNA, 20 bp, human
ggacccgcgaggccaccgca

SEQ ID NO: 130026 - DNA, 20 bp, human
ggtgatgtcatagtaaggag

SEQ ID NO: 130027 - DNA, 20 bp, human
gcacctgtgatgtcatagta

SEQ ID NO: 130028 - DNA, 20 bp, human
ggtgatgaaggagataccga

SEQ ID NO: 130029 - DNA, 20 bp, human
gacaggtgggcagacccata

SEQ ID NO: 130030 - DNA, 20 bp, human
gatgaaggagataccgaggg

SEQ ID NO: 130031 - DNA, 20 bp, human
ggcttcctacagaaacccta

SEQ ID NO: 130032 - DNA, 20 bp, human
gggtatctccttcatcacca

SEQ ID NO: 130033 - DNA, 20 bp, human
gagacccatagggtttctgt

SEQ ID NO: 130034 - DNA, 20 bp, human
ggcagataaggctgttgcca

SEQ ID NO: 130035 - DNA, 20 bp, human
gggagtcttgttaaaaactt

SEQ ID NO: 130036 - DNA, 20 bp, human
ggtgcacagcgggttctcag

SEQ ID NO: 130037 - DNA, 20 bp, human
gcgctcacgtcagggctggg

SEQ ID NO: 130038 - DNA, 20 bp, human
gggtgtaggcgctcacgtca

SEQ ID NO: 130039 - DNA, 20 bp, human
gccgagcggagaacagttcc

SEQ ID NO: 130040 - DNA, 20 bp, human
gggtgggcaagtaagcacgg

SEQ ID NO: 130041 - DNA, 20 bp, human
ggcgccccgctcggcagctg

SEQ ID NO: 130042 - DNA, 20 bp, human
gccgagtacccggagctcca

SEQ ID NO: 130043 - DNA, 20 bp, human
gaggcgctcacgtcagggct

SEQ ID NO: 130044 - DNA, 20 bp, human
ggaacggcgcgcgccccgct

SEQ ID NO: 130045 - DNA, 20 bp, human
ggcgggagagcgcgcagaga

SEQ ID NO: 130046 - DNA, 20 bp, human
ggacaggacaccaacgagga

SEQ ID NO: 130047 - DNA, 20 bp, human
gggggtgtctcggtcggaaa

SEQ ID NO: 130048 - DNA, 20 bp, human
gtggtgacaggacaccaacg

SEQ ID NO: 130049 - DNA, 20 bp, human
gacaccaacgaggagggtga

SEQ ID NO: 130050 - DNA, 20 bp, human
ggctccttcaccctcctcgt

SEQ ID NO: 130051 - DNA, 20 bp, human
gcgcaagacagccagcgcca

SEQ ID NO: 130052 - DNA, 20 bp, human
gccgcggtccgggcactggg

SEQ ID NO: 130053 - DNA, 20 bp, human
ggcagcagcactgccaacgg

SEQ ID NO: 130054 - DNA, 20 bp, human
gtctccagcacccgcggtcc

SEQ ID NO: 130055 - DNA, 20 bp, human
ggccgcgtctccagcacccg

SEQ ID NO: 130056 - DNA, 20 bp, human
gcgccagtgtgcctccgact

SEQ ID NO: 130057 - DNA, 20 bp, human
ggcgccaccgcgcagcacta

SEQ ID NO: 130058 - DNA, 20 bp, human
gggaagccgttccgagtcgg

SEQ ID NO: 130059 - DNA, 20 bp, human
ggtgtgcctccgactcggaa

SEQ ID NO: 130060 - DNA, 20 bp, human
gcgcggaagccgttccgagt

SEQ ID NO: 130061 - DNA, 20 bp, human
gtggcgcggttagagagacc

SEQ ID NO: 130062 - DNA, 20 bp, human
gtccgcggccggggcagcga

SEQ ID NO: 130063 - DNA, 20 bp, human
gtccgcgggtccacgccagg

SEQ ID NO: 130064 - DNA, 20 bp, human
ggcggcgggcgggatgagtg

SEQ ID NO: 130065 - DNA, 20 bp, human
gcgctcggcacagcagtacg

SEQ ID NO: 130066 - DNA, 20 bp, human
gtcagtgcgatgggaaactc

SEQ ID NO: 130067 - DNA, 20 bp, human
ggggcgtgaggcgcagaacc

SEQ ID NO: 130068 - DNA, 20 bp, human
gtgactccatgagtagccag

SEQ ID NO: 130069 - DNA, 20 bp, human
gccccaggaacagcagcccg

SEQ ID NO: 130070 - DNA, 20 bp, human
ggaggcgcagaacccggctg

SEQ ID NO: 130071 - DNA, 20 bp, human
ggcgatgggaaactcgggct

SEQ ID NO: 130072 - DNA, 20 bp, human
ggaagccaggctgtgagggc

SEQ ID NO: 130073 - DNA, 20 bp, human
gtggcaggagcagcaacccc

SEQ ID NO: 130074 - DNA, 20 bp, human
ggcaggctctccgttaagtg

SEQ ID NO: 130075 - DNA, 20 bp, human
gaactcgggctgggtctctg

SEQ ID NO: 130076 - DNA, 20 bp, human
gcccagtgcgcagggaaagt

SEQ ID NO: 130077 - DNA, 20 bp, human
gaaggtccctaaagtatctc

SEQ ID NO: 130078 - DNA, 20 bp, human
ggcgcgggtgaggcgggacc

SEQ ID NO: 130079 - DNA, 20 bp, human
gttgcagctgaggttccagc

SEQ ID NO: 130080 - DNA, 20 bp, human
gcaagaacagcatctcctgg

SEQ ID NO: 130081 - DNA, 20 bp, human
gcgccaagaacagcatctcc

SEQ ID NO: 130082 - DNA, 20 bp, human
gaacagcatctcctggcggg

SEQ ID NO: 130083 - DNA, 20 bp, human
ggcgcagggaaagtcgggct

SEQ ID NO: 130084 - DNA, 20 bp, human
gagtcgggctggggttctgc

SEQ ID NO: 130085 - DNA, 20 bp, human
gcccgactttccctgcgcac

SEQ ID NO: 130086 - DNA, 20 bp, human
gaagccgccagaccaagctt

SEQ ID NO: 130087 - DNA, 20 bp, human
gtgagtatagttaccgcgtg

SEQ ID NO: 130088 - DNA, 20 bp, human
gcacgtggaagatgcactcg

SEQ ID NO: 130089 - DNA, 20 bp, human
gcgcggtaactatactcacg

SEQ ID NO: 130090 - DNA, 20 bp, human
gtgcacctggaggaggatcc

SEQ ID NO: 130091 - DNA, 20 bp, human
ggaggatccaggtccgcacg

SEQ ID NO: 130092 - DNA, 20 bp, human
gatgatagacggaaatcaag

SEQ ID NO: 130093 - DNA, 20 bp, human
gttggggaggggctgaagag

SEQ ID NO: 130094 - DNA, 20 bp, human
gatccatgaatgggacaatg

SEQ ID NO: 130095 - DNA, 20 bp, human
gtagttaccgcgtgcggacc

SEQ ID NO: 130096 - DNA, 20 bp, human
gttcagctctagatccacgg

SEQ ID NO: 130097 - DNA, 20 bp, human
ggtggatctagagctgaaga

SEQ ID NO: 130098 - DNA, 20 bp, human
ggcgcctgcgcagtgggagt

SEQ ID NO: 130099 - DNA, 20 bp, human
ggctcaggcaaggggtccga

SEQ ID NO: 130100 - DNA, 20 bp, human
gcagagtcctaaggcctcac

SEQ ID NO: 130101 - DNA, 20 bp, human
gagctctagatccacggggg

SEQ ID NO: 130102 - DNA, 20 bp, human
gagcaaatgaggcagaatta

SEQ ID NO: 130103 - DNA, 20 bp, human
ggagggtctttggcaggcgg

SEQ ID NO: 130104 - DNA, 20 bp, human
ggttggactgaaatagggtg

SEQ ID NO: 130105 - DNA, 20 bp, human
gaggagggtccagtggacta

SEQ ID NO: 130106 - DNA, 20 bp, human
gcgaagatggcggagaacag

SEQ ID NO: 130107 - DNA, 20 bp, human
ggtcgcgccggcaagagcag

SEQ ID NO: 130108 - DNA, 20 bp, human
gccggcaagagcagcgggag

SEQ ID NO: 130109 - DNA, 20 bp, human
gcggccggaaacccagcagg

SEQ ID NO: 130110 - DNA, 20 bp, human
gcggagaacagcggtcgcgc

SEQ ID NO: 130111 - DNA, 20 bp, human
gtgtgcgtggcacctagaga

SEQ ID NO: 130112 - DNA, 20 bp, human
gttcggagaggtagacgggt

SEQ ID NO: 130113 - DNA, 20 bp, human
gtagccgaaccccttcggag

SEQ ID NO: 130114 - DNA, 20 bp, human
gcggacgtgacgcaaggcgg

SEQ ID NO: 130115 - DNA, 20 bp, human
ggggaaagccctgacatgta

SEQ ID NO: 130116 - DNA, 20 bp, human
gtagtccagtcccaagatgg

SEQ ID NO: 130117 - DNA, 20 bp, human
gcaaggccaaccacactcaa

SEQ ID NO: 130118 - DNA, 20 bp, human
ggcggtgagtggggagctcg

SEQ ID NO: 130119 - DNA, 20 bp, human
gggttcctcagactccccgg

SEQ ID NO: 130120 - DNA, 20 bp, human
gcttgactcgggcgttgcac

SEQ ID NO: 130121 - DNA, 20 bp, human
gccatgaagaaggcggtgag

SEQ ID NO: 130122 - DNA, 20 bp, human
gctcggggctctggatgctc

SEQ ID NO: 130123 - DNA, 20 bp, human
gctgaggtgtgggaagccga

SEQ ID NO: 130124 - DNA, 20 bp, human
gcagctacccataaccagtg

SEQ ID NO: 130125 - DNA, 20 bp, human
gggcctcgcccctgaggtgt

SEQ ID NO: 130126 - DNA, 20 bp, human
ggcgcagtctattaacatca

SEQ ID NO: 130127 - DNA, 20 bp, human
gtaagtcggccttcccaaca

SEQ ID NO: 130128 - DNA, 20 bp, human
ggaaggccgacttaacgaag

SEQ ID NO: 130129 - DNA, 20 bp, human
gcaagagcaacgagggtatg

SEQ ID NO: 130130 - DNA, 20 bp, human
gggtcaatgagaggactaag

SEQ ID NO: 130131 - DNA, 20 bp, human
gtgctgaacaagagcaacga

SEQ ID NO: 130132 - DNA, 20 bp, human
gtaatagactgcgccatgtt

SEQ ID NO: 130133 - DNA, 20 bp, human
gtaacgaagaggaagtctct

SEQ ID NO: 130134 - DNA, 20 bp, human
gtaagaaaaactgggttagg

SEQ ID NO: 130135 - DNA, 20 bp, human
ggggcgcgagaagtacgcgt

SEQ ID NO: 130136 - DNA, 20 bp, human
ggcacgcgagggcccagatg

SEQ ID NO: 130137 - DNA, 20 bp, human
gctgaaggaagaacgtgagt

SEQ ID NO: 130138 - DNA, 20 bp, human
gggcagcgggtgagtgaaca

SEQ ID NO: 130139 - DNA, 20 bp, human
gcctactgggtgcgagacaa

SEQ ID NO: 130140 - DNA, 20 bp, human
ggggaagagtactgagactg

SEQ ID NO: 130141 - DNA, 20 bp, human
gcttgagaggtagccctgag

SEQ ID NO: 130142 - DNA, 20 bp, human
gggaagaacgtgagtaggtt

SEQ ID NO: 130143 - DNA, 20 bp, human
ggagtactgagactgaggcg

SEQ ID NO: 130144 - DNA, 20 bp, human
gggttaggatttcggttgag

SEQ ID NO: 130145 - DNA, 20 bp, human
gtaagggaacagggtcggta

SEQ ID NO: 130146 - DNA, 20 bp, human
gatccagatcttctgcaacc

SEQ ID NO: 130147 - DNA, 20 bp, human
gtccgtgggtttaaaggtgg

SEQ ID NO: 130148 - DNA, 20 bp, human
gttccagagggcctgaagaa

SEQ ID NO: 130149 - DNA, 20 bp, human
gccaaggcaggtccagtggg

SEQ ID NO: 130150 - DNA, 20 bp, human
gaacctctagaataaaaggt

SEQ ID NO: 130151 - DNA, 20 bp, human
gcccccaaggcaggtccagt

SEQ ID NO: 130152 - DNA, 20 bp, human
gtacatcccccacttaacaa

SEQ ID NO: 130153 - DNA, 20 bp, human
gggcaagttctggatttcgc

SEQ ID NO: 130154 - DNA, 20 bp, human
gacgtacccttgttaagtgg

SEQ ID NO: 130155 - DNA, 20 bp, human
gggttgtcgtgtgcattaaa

SEQ ID NO: 130156 - DNA, 20 bp, human
gctcggttcggtcgcgttac

SEQ ID NO: 130157 - DNA, 20 bp, human
gggatcttaggagagatcgt

SEQ ID NO: 130158 - DNA, 20 bp, human
gggaccggcgctacagtcgc

SEQ ID NO: 130159 - DNA, 20 bp, human
gggtcccggccacaagctgt

SEQ ID NO: 130160 - DNA, 20 bp, human
gcaaggcagggagggatctt

SEQ ID NO: 130161 - DNA, 20 bp, human
gttcggtcgcgttacagggc

SEQ ID NO: 130162 - DNA, 20 bp, human
gacaagctgtcggctcggtt

SEQ ID NO: 130163 - DNA, 20 bp, human
gcggccacaagctgtcggct

SEQ ID NO: 130164 - DNA, 20 bp, human
gaaagaacgccggagcgctg

SEQ ID NO: 130165 - DNA, 20 bp, human
gtgagtcccgggggtaacta

SEQ ID NO: 130166 - DNA, 20 bp, human
gcccagccaagccggagagg

SEQ ID NO: 130167 - DNA, 20 bp, human
gcgggccgggccattgtgtg

SEQ ID NO: 130168 - DNA, 20 bp, human
gccgccgacccccggaacaa

SEQ ID NO: 130169 - DNA, 20 bp, human
gtcgtccgctcggaaagctc

SEQ ID NO: 130170 - DNA, 20 bp, human
gcggaaagctctgggatgct

SEQ ID NO: 130171 - DNA, 20 bp, human
gctgggtgcccgtggaccac

SEQ ID NO: 130172 - DNA, 20 bp, human
gagccgagtgcagaagatct

SEQ ID NO: 130173 - DNA, 20 bp, human
ggggcctggtggcgagagcg

SEQ ID NO: 130174 - DNA, 20 bp, human
gtgcgcggagccgggttgca

SEQ ID NO: 130175 - DNA, 20 bp, human
gggctctgcgtcagttccaa

SEQ ID NO: 130176 - DNA, 20 bp, human
gcccgggatggcgtccccac

SEQ ID NO: 130177 - DNA, 20 bp, human
gggcgcagtccgactcatcc

SEQ ID NO: 130178 - DNA, 20 bp, human
gcgggccgcccattgctgta

SEQ ID NO: 130179 - DNA, 20 bp, human
ggcatccagatcttcttcag

SEQ ID NO: 130180 - DNA, 20 bp, human
gcagggtcctccccagactg

SEQ ID NO: 130181 - DNA, 20 bp, human
gccagcagcctccccagtca

SEQ ID NO: 130182 - DNA, 20 bp, human
gccggctgctgggttggaag

SEQ ID NO: 130183 - DNA, 20 bp, human
gtctggccaccatcacctcg

SEQ ID NO: 130184 - DNA, 20 bp, human
ggttctgtgtcaattcccgt

SEQ ID NO: 130185 - DNA, 20 bp, human
ggaggtgcaccgggatgggt

SEQ ID NO: 130186 - DNA, 20 bp, human
gaggtccaccgcggccatgg

SEQ ID NO: 130187 - DNA, 20 bp, human
gtccaccgcggccatggcgg

SEQ ID NO: 130188 - DNA, 20 bp, human
gagagtcggacacacccccg

SEQ ID NO: 130189 - DNA, 20 bp, human
gcatggcggcggccgaaaca

SEQ ID NO: 130190 - DNA, 20 bp, human
gacctcccgaggagtccccg

SEQ ID NO: 130191 - DNA, 20 bp, human
gcgcggggcaggacctcccg

SEQ ID NO: 130192 - DNA, 20 bp, human
ggtcgcttcagaaccaggaa

SEQ ID NO: 130193 - DNA, 20 bp, human
gagagcgggggacagacccg

SEQ ID NO: 130194 - DNA, 20 bp, human
gagcttctccaggtccaccg

SEQ ID NO: 130195 - DNA, 20 bp, human
gccgaggccacgcgagcgga

SEQ ID NO: 130196 - DNA, 20 bp, human
gcttgagaaaccccagggat

SEQ ID NO: 130197 - DNA, 20 bp, human
ggggatggtggcagatactc

SEQ ID NO: 130198 - DNA, 20 bp, human
gtcctgtagtgtggggatgg

SEQ ID NO: 130199 - DNA, 20 bp, human
ggaccacctaatcttcagag

SEQ ID NO: 130200 - DNA, 20 bp, human
gaggaggaaacccacgccag

SEQ ID NO: 130201 - DNA, 20 bp, human
gcaggggcaagcacaaactc

SEQ ID NO: 130202 - DNA, 20 bp, human
gcgcatggcttagggatgga

SEQ ID NO: 130203 - DNA, 20 bp, human
gaggtcgagagtcctctcgt

SEQ ID NO: 130204 - DNA, 20 bp, human
ggaacagtgtgccgatccct

SEQ ID NO: 130205 - DNA, 20 bp, human
gcccttctgagtgaggtctg

SEQ ID NO: 130206 - DNA, 20 bp, human
ggaggagagctaagactaaa

SEQ ID NO: 130207 - DNA, 20 bp, human
gatctgcaagaaagcagcgg

SEQ ID NO: 130208 - DNA, 20 bp, human
gatataagcacgcggcaggg

SEQ ID NO: 130209 - DNA, 20 bp, human
gtgagtgccagggtagggtc

SEQ ID NO: 130210 - DNA, 20 bp, human
gatgggcagggcagtcgtga

SEQ ID NO: 130211 - DNA, 20 bp, human
gaacagaaaagcagcatcat

SEQ ID NO: 130212 - DNA, 20 bp, human
gcgtatataagcacgcggca

SEQ ID NO: 130213 - DNA, 20 bp, human
ggagtgaggtgggaaggtat

SEQ ID NO: 130214 - DNA, 20 bp, human
ggcagattgtccttgggaaa

SEQ ID NO: 130215 - DNA, 20 bp, human
gctaagactaaaaggcaaga

SEQ ID NO: 130216 - DNA, 20 bp, human
gtagtgggagagcctgactg

SEQ ID NO: 130217 - DNA, 20 bp, human
gatgccactagctaaaggaa

SEQ ID NO: 130218 - DNA, 20 bp, human
gaaaggaacggcaattagac

SEQ ID NO: 130219 - DNA, 20 bp, human
gggctagagccacctcagtc

SEQ ID NO: 130220 - DNA, 20 bp, human
gggtggagatgcccaaggta

SEQ ID NO: 130221 - DNA, 20 bp, human
gtcaagatgccactagctaa

SEQ ID NO: 130222 - DNA, 20 bp, human
gaggctgcaaagctcagact

SEQ ID NO: 130223 - DNA, 20 bp, human
gagctcagacttggtatagt

SEQ ID NO: 130224 - DNA, 20 bp, human
gccagaggttaagacagcaa

SEQ ID NO: 130225 - DNA, 20 bp, human
gttgccgttcctttagctag

SEQ ID NO: 130226 - DNA, 20 bp, human
gacgactcccgggcccccaa

SEQ ID NO: 130227 - DNA, 20 bp, human
gccgaggggagccgcacgtc

SEQ ID NO: 130228 - DNA, 20 bp, human
gccgggtgcgcagcaggcaa

SEQ ID NO: 130229 - DNA, 20 bp, human
gagaagcccgcgcccggaag

SEQ ID NO: 130230 - DNA, 20 bp, human
gttccgagtcaggcgcgcgc

SEQ ID NO: 130231 - DNA, 20 bp, human
gggggcggcggttccgagtc

SEQ ID NO: 130232 - DNA, 20 bp, human
ggtcgtccgcgtccatggcg

SEQ ID NO: 130233 - DNA, 20 bp, human
gcccctcggcctcctcgcca

SEQ ID NO: 130234 - DNA, 20 bp, human
gggcaggggtacctgcgggg

SEQ ID NO: 130235 - DNA, 20 bp, human
ggggtgaccggagagaagag

SEQ ID NO: 130236 - DNA, 20 bp, human
gagcggagccgcggtccgga

SEQ ID NO: 130237 - DNA, 20 bp, human
gcctggggcataggacctac

SEQ ID NO: 130238 - DNA, 20 bp, human
gctggaagcggcgcgaatgg

SEQ ID NO: 130239 - DNA, 20 bp, human
gtaggacctacgggcaactg

SEQ ID NO: 130240 - DNA, 20 bp, human
gtgcacagcgagcggagccg

SEQ ID NO: 130241 - DNA, 20 bp, human
gggtcctatgccccaggcgg

SEQ ID NO: 130242 - DNA, 20 bp, human
ggcaggaagtggcggtgcga

SEQ ID NO: 130243 - DNA, 20 bp, human
ggcagctcgagcccagtccg

SEQ ID NO: 130244 - DNA, 20 bp, human
gcgcagcgagaggccctgac

SEQ ID NO: 130245 - DNA, 20 bp, human
gggatgggcgccgccgcctg

SEQ ID NO: 130246 - DNA, 20 bp, human
ggtccgcgctgcagtgcgaa

SEQ ID NO: 130247 - DNA, 20 bp, human
ggcattacggtgaggaccag

SEQ ID NO: 130248 - DNA, 20 bp, human
gccgacgctgggaacgccgg

SEQ ID NO: 130249 - DNA, 20 bp, human
gcgaagggctcgaagatggc

SEQ ID NO: 130250 - DNA, 20 bp, human
gagtgcgaagggctcgaaga

SEQ ID NO: 130251 - DNA, 20 bp, human
gccagggccagcaaggagtc

SEQ ID NO: 130252 - DNA, 20 bp, human
ggcgtcgcagtagccgacaa

SEQ ID NO: 130253 - DNA, 20 bp, human
gcgctccggtgcagggacca

SEQ ID NO: 130254 - DNA, 20 bp, human
ggccggttggcagagctacg

SEQ ID NO: 130255 - DNA, 20 bp, human
ggcgcggggctggaacactg

SEQ ID NO: 130256 - DNA, 20 bp, human
ggccgacgcggcgtacatgg

SEQ ID NO: 130257 - DNA, 20 bp, human
gacctctcggggaaatatag

SEQ ID NO: 130258 - DNA, 20 bp, human
gttccccgagaggtgcgagg

SEQ ID NO: 130259 - DNA, 20 bp, human
ggaaggcctgcggcgctgtg

SEQ ID NO: 130260 - DNA, 20 bp, human
gcggtgcacgaactcatacg

SEQ ID NO: 130261 - DNA, 20 bp, human
gtggtgctaatgggccgacg

SEQ ID NO: 130262 - DNA, 20 bp, human
gcgagaggtgcgaggcggct

SEQ ID NO: 130263 - DNA, 20 bp, human
gccatctcgccgcaggaggt

SEQ ID NO: 130264 - DNA, 20 bp, human
ggcgcgctcctggtgctaat

SEQ ID NO: 130265 - DNA, 20 bp, human
ggcctctatatttccccgag

SEQ ID NO: 130266 - DNA, 20 bp, human
gcctggcaccgaggactcga

SEQ ID NO: 130267 - DNA, 20 bp, human
gtggtgagcggtgaattccc

SEQ ID NO: 130268 - DNA, 20 bp, human
gccttgcgggcaccacagag

SEQ ID NO: 130269 - DNA, 20 bp, human
gcaccgaggactcgagggag

SEQ ID NO: 130270 - DNA, 20 bp, human
gtgtggtgcccgcaaggacc

SEQ ID NO: 130271 - DNA, 20 bp, human
gccgagcaggacccaaggcg

SEQ ID NO: 130272 - DNA, 20 bp, human
gccaaggacccgaccgtcaa

SEQ ID NO: 130273 - DNA, 20 bp, human
gggacttgtgcgggaaatgt

SEQ ID NO: 130274 - DNA, 20 bp, human
ggtccgctccctcgagtcct

SEQ ID NO: 130275 - DNA, 20 bp, human
gcccccctcatcaggacctc

SEQ ID NO: 130276 - DNA, 20 bp, human
gtggagacagctgaatagag

SEQ ID NO: 130277 - DNA, 20 bp, human
gtcgagggagaaggcaagac

SEQ ID NO: 130278 - DNA, 20 bp, human
gcccgggaagaaccatgaag

SEQ ID NO: 130279 - DNA, 20 bp, human
gttcccgggtcccaactcga

SEQ ID NO: 130280 - DNA, 20 bp, human
ggcattgttgggcagaagag

SEQ ID NO: 130281 - DNA, 20 bp, human
gggagctgggaaccacagtc

SEQ ID NO: 130282 - DNA, 20 bp, human
gggtcccaactcgagggaga

SEQ ID NO: 130283 - DNA, 20 bp, human
gtaaccagctgatctaagag

SEQ ID NO: 130284 - DNA, 20 bp, human
gtgcattatggggcagaagt

SEQ ID NO: 130285 - DNA, 20 bp, human
ggcagggctgcctcccaaaa

SEQ ID NO: 130286 - DNA, 20 bp, human
gggtctcagaatgtggctca

SEQ ID NO: 130287 - DNA, 20 bp, human
gggagctgggaaccacagtc

SEQ ID NO: 130288 - DNA, 20 bp, human
gatcggcctctgaaagtcac

SEQ ID NO: 130289 - DNA, 20 bp, human
ggaagctcctgataagattg

SEQ ID NO: 130290 - DNA, 20 bp, human
gctggaaaggtctcagaatg

SEQ ID NO: 130291 - DNA, 20 bp, human
gaaagaagttaagctgacta

SEQ ID NO: 130292 - DNA, 20 bp, human
gcttctctgtttgggatcag

SEQ ID NO: 130293 - DNA, 20 bp, human
ggggcagccacaatcttatc

SEQ ID NO: 130294 - DNA, 20 bp, human
gcccgggaagaaccatgaag

SEQ ID NO: 130295 - DNA, 20 bp, human
ggggaaccggtgactttcag

SEQ ID NO: 130296 - DNA, 20 bp, human
gtggagagatgaacccctga

SEQ ID NO: 130297 - DNA, 20 bp, human
gagtgtagaacagggcagtc

SEQ ID NO: 130298 - DNA, 20 bp, human
gatgaacccctgagggctca

SEQ ID NO: 130299 - DNA, 20 bp, human
gggttttcgtcgcttctgcc

SEQ ID NO: 130300 - DNA, 20 bp, human
gcactacttgagtgtagaac

SEQ ID NO: 130301 - DNA, 20 bp, human
gcaccatctggaaagagtga

SEQ ID NO: 130302 - DNA, 20 bp, human
gagggtgagaaaagttagaa

SEQ ID NO: 130303 - DNA, 20 bp, human
gtgagcagctgaccaccatc

SEQ ID NO: 130304 - DNA, 20 bp, human
gctcaagtagtgggtgtgcc

SEQ ID NO: 130305 - DNA, 20 bp, human
gatctctccaaggaggaacc

SEQ ID NO: 130306 - DNA, 20 bp, human
gacggggcgggctgctactc

SEQ ID NO: 130307 - DNA, 20 bp, human
gcaggcgctacgaggtgcgg

SEQ ID NO: 130308 - DNA, 20 bp, human
gtcacgccgtggagcatgag

SEQ ID NO: 130309 - DNA, 20 bp, human
gaactgcgaagtggtgtcgt

SEQ ID NO: 130310 - DNA, 20 bp, human
gcgcgcaggcgcggccgacg

SEQ ID NO: 130311 - DNA, 20 bp, human
ggcgcgggagccggactgag

SEQ ID NO: 130312 - DNA, 20 bp, human
ggtgccggccctctccgaga

SEQ ID NO: 130313 - DNA, 20 bp, human
ggaaagggaaaactgcgaag

SEQ ID NO: 130314 - DNA, 20 bp, human
ggcgctcgcaccgctcagtc

SEQ ID NO: 130315 - DNA, 20 bp, human
ggggcaggcgctacgaggtg

SEQ ID NO: 130316 - DNA, 20 bp, human
ggtgccggaccatcacgagg

SEQ ID NO: 130317 - DNA, 20 bp, human
ggccgtgccggaccatcacg

SEQ ID NO: 130318 - DNA, 20 bp, human
gccccgtccagagtcctctg

SEQ ID NO: 130319 - DNA, 20 bp, human
gggtgcttctcgtccatcgg

SEQ ID NO: 130320 - DNA, 20 bp, human
gaccatcacgaggcggtgag

SEQ ID NO: 130321 - DNA, 20 bp, human
gtgctaatggagttgtagta

SEQ ID NO: 130322 - DNA, 20 bp, human
gacggccgccaagcacgggg

SEQ ID NO: 130323 - DNA, 20 bp, human
gacaactccattagcaaggt

SEQ ID NO: 130324 - DNA, 20 bp, human
ggccactcaccgcctcgtga

SEQ ID NO: 130325 - DNA, 20 bp, human
gaggcagcccaccttgctaa

SEQ ID NO: 130326 - DNA, 20 bp, human
gggctgtttggggccggggt

SEQ ID NO: 130327 - DNA, 20 bp, human
gtcggccgccgtgctcttct

SEQ ID NO: 130328 - DNA, 20 bp, human
gacccagggcggactcgcag

SEQ ID NO: 130329 - DNA, 20 bp, human
ggctccggcgatggcaccca

SEQ ID NO: 130330 - DNA, 20 bp, human
ggccacggccgagaagagca

SEQ ID NO: 130331 - DNA, 20 bp, human
gacggccgagaagagcacgg

SEQ ID NO: 130332 - DNA, 20 bp, human
ggctcggccacagaagccgg

SEQ ID NO: 130333 - DNA, 20 bp, human
gagcaagcggcatggcgttc

SEQ ID NO: 130334 - DNA, 20 bp, human
gccggcgatggcacccaggg

SEQ ID NO: 130335 - DNA, 20 bp, human
gccacagaagccggcgggaa

SEQ ID NO: 130336 - DNA, 20 bp, human
gggccccgcggcggagaagg

SEQ ID NO: 130337 - DNA, 20 bp, human
gccccgggcggagaaaacag

SEQ ID NO: 130338 - DNA, 20 bp, human
gtgtctagcacgctcagtcc

SEQ ID NO: 130339 - DNA, 20 bp, human
gggcaggacgaacccacaga

SEQ ID NO: 130340 - DNA, 20 bp, human
ggagcgcccggctgaggaga

SEQ ID NO: 130341 - DNA, 20 bp, human
ggatgcagagtctccccggg

SEQ ID NO: 130342 - DNA, 20 bp, human
ggaggcgaggacgggacagg

SEQ ID NO: 130343 - DNA, 20 bp, human
gcgtgaagaagggacacaaa

SEQ ID NO: 130344 - DNA, 20 bp, human
gggggatgcagagtctcccc

SEQ ID NO: 130345 - DNA, 20 bp, human
gggacagcggagtaactacg

SEQ ID NO: 130346 - DNA, 20 bp, human
ggggagctcgggccaatcag

SEQ ID NO: 130347 - DNA, 20 bp, human
ggcttgtgaatggctagatt

SEQ ID NO: 130348 - DNA, 20 bp, human
gcagagggacggccccagaa

SEQ ID NO: 130349 - DNA, 20 bp, human
gggacggccccagaatggca

SEQ ID NO: 130350 - DNA, 20 bp, human
ggcggaccggggcaaggaaa

SEQ ID NO: 130351 - DNA, 20 bp, human
gcgcggcgctccaaggaagg

SEQ ID NO: 130352 - DNA, 20 bp, human
ggctccctcagcccgagtcg

SEQ ID NO: 130353 - DNA, 20 bp, human
gcatgggtcaggagagaata

SEQ ID NO: 130354 - DNA, 20 bp, human
gctggggccgtccctctgat

SEQ ID NO: 130355 - DNA, 20 bp, human
gtagttaccatgccattctg

SEQ ID NO: 130356 - DNA, 20 bp, human
ggagtgccggcggaacccgg

SEQ ID NO: 130357 - DNA, 20 bp, human
gcccatactcacccacgcgg

SEQ ID NO: 130358 - DNA, 20 bp, human
gccaggtggcccggggtcgg

SEQ ID NO: 130359 - DNA, 20 bp, human
ggcggtggtggcgagagtgc

SEQ ID NO: 130360 - DNA, 20 bp, human
ggtcagagcgcgaacggcgg

SEQ ID NO: 130361 - DNA, 20 bp, human
ggtggtggcgagagtgccgg

SEQ ID NO: 130362 - DNA, 20 bp, human
gggaggccccgcggaataaa

SEQ ID NO: 130363 - DNA, 20 bp, human
gatactcacccacgcggtgg

SEQ ID NO: 130364 - DNA, 20 bp, human
gcgagagtgccggcggaacc

SEQ ID NO: 130365 - DNA, 20 bp, human
gcctcctggtcaggagtcct

SEQ ID NO: 130366 - DNA, 20 bp, human
ggggcgggagcaagacaaat

SEQ ID NO: 130367 - DNA, 20 bp, human
ggaaaggatggccggcctgg

SEQ ID NO: 130368 - DNA, 20 bp, human
gggagaaaggatggccggcc

SEQ ID NO: 130369 - DNA, 20 bp, human
gtggcacagaaatcagacca

SEQ ID NO: 130370 - DNA, 20 bp, human
gcattcgggccacaatgtct

SEQ ID NO: 130371 - DNA, 20 bp, human
gagacctcgtggggaaacta

SEQ ID NO: 130372 - DNA, 20 bp, human
gtgggcggggcttaccgtgg

SEQ ID NO: 130373 - DNA, 20 bp, human
ggtacgcagtcgcggtacac

SEQ ID NO: 130374 - DNA, 20 bp, human
gaaagtaagagaggctggta

SEQ ID NO: 130375 - DNA, 20 bp, human
gcaggaccaaccgcgccgcc

SEQ ID NO: 130376 - DNA, 20 bp, human
ggccagacccgccagcccag

SEQ ID NO: 130377 - DNA, 20 bp, human
gaaaccggcgctcccgacag

SEQ ID NO: 130378 - DNA, 20 bp, human
gtgtcctcaagaacccgggt

SEQ ID NO: 130379 - DNA, 20 bp, human
gcgcgccaggcactgaatac

SEQ ID NO: 130380 - DNA, 20 bp, human
ggccgctgggctggcgggtc

SEQ ID NO: 130381 - DNA, 20 bp, human
gggcccggtgctcccctgtc

SEQ ID NO: 130382 - DNA, 20 bp, human
gagccacacaggttgagatg

SEQ ID NO: 130383 - DNA, 20 bp, human
gcctcgtgaaaggctcccga

SEQ ID NO: 130384 - DNA, 20 bp, human
gcaagaacccgggtggggat

SEQ ID NO: 130385 - DNA, 20 bp, human
gcgagatggagatgagggtt

SEQ ID NO: 130386 - DNA, 20 bp, human
gcaggcgcagcgctccgatt

SEQ ID NO: 130387 - DNA, 20 bp, human
gcccgccccaggatgtgacg

SEQ ID NO: 130388 - DNA, 20 bp, human
ggtcgcggccgcgcaacgtc

SEQ ID NO: 130389 - DNA, 20 bp, human
gggctcgcgagtctccgtct

SEQ ID NO: 130390 - DNA, 20 bp, human
gcgacgcccgacgccaacgc

SEQ ID NO: 130391 - DNA, 20 bp, human
gttcggcgcggctcatggtc

SEQ ID NO: 130392 - DNA, 20 bp, human
gccgtcggcgcgcagtggtg

SEQ ID NO: 130393 - DNA, 20 bp, human
gctgcagcgcgagcacactg

SEQ ID NO: 130394 - DNA, 20 bp, human
gctacctgccctaccccaga

SEQ ID NO: 130395 - DNA, 20 bp, human
ggcgcaacgtccggcaccag

SEQ ID NO: 130396 - DNA, 20 bp, human
ggtcgagctgggttccaagg

SEQ ID NO: 130397 - DNA, 20 bp, human
gcccgtcgagctgggttcca

SEQ ID NO: 130398 - DNA, 20 bp, human
ggttccaaggcggctggcgg

SEQ ID NO: 130399 - DNA, 20 bp, human
gtgggttccaaggcggctgg

SEQ ID NO: 130400 - DNA, 20 bp, human
ggccaaggagcgctcacctg

SEQ ID NO: 130401 - DNA, 20 bp, human
gctgacaggctcaatcacca

SEQ ID NO: 130402 - DNA, 20 bp, human
gcagcgaggacgcactgtag

SEQ ID NO: 130403 - DNA, 20 bp, human
gataagagtgtgggcggatg

SEQ ID NO: 130404 - DNA, 20 bp, human
gcctgcgcgcagggtcagct

SEQ ID NO: 130405 - DNA, 20 bp, human
ggtcaaattgataagagtgt

SEQ ID NO: 130406 - DNA, 20 bp, human
gcatgggcagtccccttcat

SEQ ID NO: 130407 - DNA, 20 bp, human
ggtgtcaagtgcctatgaag

SEQ ID NO: 130408 - DNA, 20 bp, human
gcacttgactttcacttcat

SEQ ID NO: 130409 - DNA, 20 bp, human
ggagtaaaagatgacgagac

SEQ ID NO: 130410 - DNA, 20 bp, human
ggccaacaactgttcgagac

SEQ ID NO: 130411 - DNA, 20 bp, human
gacagcagcgcgtaatctcg

SEQ ID NO: 130412 - DNA, 20 bp, human
gctatgcgtgatagtaatac

SEQ ID NO: 130413 - DNA, 20 bp, human
gcaaactttgggagtaaggt

SEQ ID NO: 130414 - DNA, 20 bp, human
gtttactcccgtgaggtcct

SEQ ID NO: 130415 - DNA, 20 bp, human
ggtcatcttttactcccgtg

SEQ ID NO: 130416 - DNA, 20 bp, human
gcggccgaggtgctgtagaa

SEQ ID NO: 130417 - DNA, 20 bp, human
gtcggtctgactgctcctgg

SEQ ID NO: 130418 - DNA, 20 bp, human
gctgggggctccgaacccgt

SEQ ID NO: 130419 - DNA, 20 bp, human
ggcgagtccagactctccgt

SEQ ID NO: 130420 - DNA, 20 bp, human
gcgcgcttcgaggataccgg

SEQ ID NO: 130421 - DNA, 20 bp, human
ggtctctccggaaacaaatg

SEQ ID NO: 130422 - DNA, 20 bp, human
gacatctcggacgacgtgtt

SEQ ID NO: 130423 - DNA, 20 bp, human
gccggacgcacaggagccgg

SEQ ID NO: 130424 - DNA, 20 bp, human
gaggctgcaggagcggtgat

SEQ ID NO: 130425 - DNA, 20 bp, human
gccgaacccgtgggtggaga

SEQ ID NO: 130426 - DNA, 20 bp, human
gggtccccaactggccacag

SEQ ID NO: 130427 - DNA, 20 bp, human
ggaagtcccagagtagagac

SEQ ID NO: 130428 - DNA, 20 bp, human
gtcgcagtggagtgaagacc

SEQ ID NO: 130429 - DNA, 20 bp, human
gctgagttctgcagtcgcag

SEQ ID NO: 130430 - DNA, 20 bp, human
gcctgaaacagaggtggtaa

SEQ ID NO: 130431 - DNA, 20 bp, human
gtcttcctctgtggccagtt

SEQ ID NO: 130432 - DNA, 20 bp, human
gatccacacctgccattcaa

SEQ ID NO: 130433 - DNA, 20 bp, human
gaccagcatcatgaagtgga

SEQ ID NO: 130434 - DNA, 20 bp, human
ggatggacctgaaacagagg

SEQ ID NO: 130435 - DNA, 20 bp, human
gtgcccaagcagcccttgaa

SEQ ID NO: 130436 - DNA, 20 bp, human
ggaaaaagccaacctacagg

SEQ ID NO: 130437 - DNA, 20 bp, human
gatggaaaaagccaacctac

SEQ ID NO: 130438 - DNA, 20 bp, human
gcaggcagggtactttctat

SEQ ID NO: 130439 - DNA, 20 bp, human
gctaccctgatagaatacag

SEQ ID NO: 130440 - DNA, 20 bp, human
gcctggcacatcctcagtga

SEQ ID NO: 130441 - DNA, 20 bp, human
gcacaacgatcacacaacat

SEQ ID NO: 130442 - DNA, 20 bp, human
gtggtggaaaggaggtgtac

SEQ ID NO: 130443 - DNA, 20 bp, human
gattctatcagggtagaatg

SEQ ID NO: 130444 - DNA, 20 bp, human
gctgctgttggtcagttaga

SEQ ID NO: 130445 - DNA, 20 bp, human
gtcagggtagaatggggata

SEQ ID NO: 130446 - DNA, 20 bp, human
ggtcactcactgggccatgg

SEQ ID NO: 130447 - DNA, 20 bp, human
gacgcgcggaggacgagtga

SEQ ID NO: 130448 - DNA, 20 bp, human
gccagtgagtgactcgccag

SEQ ID NO: 130449 - DNA, 20 bp, human
gacgctgcagagcctcggcc

SEQ ID NO: 130450 - DNA, 20 bp, human
ggtgcgcgcccggcttctgg

SEQ ID NO: 130451 - DNA, 20 bp, human
gcatgcctgcgcggccgaga

SEQ ID NO: 130452 - DNA, 20 bp, human
gtcccagtcacggccaaatg

SEQ ID NO: 130453 - DNA, 20 bp, human
gtgagctcaggcgaccccca

SEQ ID NO: 130454 - DNA, 20 bp, human
ggaagagcggcgacgcgcgg

SEQ ID NO: 130455 - DNA, 20 bp, human
gctcgacgcgctgcaaccca

SEQ ID NO: 130456 - DNA, 20 bp, human
ggctacgggaggacctggag

SEQ ID NO: 130457 - DNA, 20 bp, human
ggcccagctacgggaggacc

SEQ ID NO: 130458 - DNA, 20 bp, human
gacggacggccgcccagcta

SEQ ID NO: 130459 - DNA, 20 bp, human
gagaagggagctgctgtctg

SEQ ID NO: 130460 - DNA, 20 bp, human
ggaccggctgcagtctcaga

SEQ ID NO: 130461 - DNA, 20 bp, human
ggcggaggaaactgcatcga

SEQ ID NO: 130462 - DNA, 20 bp, human
ggggtagctcttacctgggg

SEQ ID NO: 130463 - DNA, 20 bp, human
gaggaaactgcatcgacgga

SEQ ID NO: 130464 - DNA, 20 bp, human
ggtcccggggatggtccgtc

SEQ ID NO: 130465 - DNA, 20 bp, human
gctggggagccaggctaggt

SEQ ID NO: 130466 - DNA, 20 bp, human
ggctggatttcttacgggat

SEQ ID NO: 130467 - DNA, 20 bp, human
gcggagtcggaccgcaaact

SEQ ID NO: 130468 - DNA, 20 bp, human
gcagagttgccagaagaaaa

SEQ ID NO: 130469 - DNA, 20 bp, human
gaggcaaagtgacaggctat

SEQ ID NO: 130470 - DNA, 20 bp, human
gcactgattccgggtcgcgg

SEQ ID NO: 130471 - DNA, 20 bp, human
ggcactgactggtttcaagt

SEQ ID NO: 130472 - DNA, 20 bp, human
gctggaaggctgtaggtcga

SEQ ID NO: 130473 - DNA, 20 bp, human
gcaccgtacggcgggagagt

SEQ ID NO: 130474 - DNA, 20 bp, human
gccagtcagtgccaactggg

SEQ ID NO: 130475 - DNA, 20 bp, human
ggagacaagcaggtaactcg

SEQ ID NO: 130476 - DNA, 20 bp, human
gaagcctccggagcgcacgt

SEQ ID NO: 130477 - DNA, 20 bp, human
gagaatgcggaacaccgcgc

SEQ ID NO: 130478 - DNA, 20 bp, human
gtcggtgattcggtcaacga

SEQ ID NO: 130479 - DNA, 20 bp, human
gctgccgacgtgcgctccgg

SEQ ID NO: 130480 - DNA, 20 bp, human
gtccggaggcttgcagaatg

SEQ ID NO: 130481 - DNA, 20 bp, human
gcaccgcgcgggcaggaaca

SEQ ID NO: 130482 - DNA, 20 bp, human
gcgactgccgacgtgcgctc

SEQ ID NO: 130483 - DNA, 20 bp, human
gagcagacgagagaacaagt

SEQ ID NO: 130484 - DNA, 20 bp, human
gctcgccgactgggagctgg

SEQ ID NO: 130485 - DNA, 20 bp, human
gtccgcattctgcaagcctc

SEQ ID NO: 130486 - DNA, 20 bp, human
ggaaccaacttgctgttgag

SEQ ID NO: 130487 - DNA, 20 bp, human
gaggggcgggacaagggcaa

SEQ ID NO: 130488 - DNA, 20 bp, human
gcgttgtgctggagacagtg

SEQ ID NO: 130489 - DNA, 20 bp, human
gccagcaggatgactgaacc

SEQ ID NO: 130490 - DNA, 20 bp, human
gcagcccctcaacagcaagt

SEQ ID NO: 130491 - DNA, 20 bp, human
gggaagggccaagatccctc

SEQ ID NO: 130492 - DNA, 20 bp, human
gaaagacataggctgacacc

SEQ ID NO: 130493 - DNA, 20 bp, human
ggatgactgaaccaggagct

SEQ ID NO: 130494 - DNA, 20 bp, human
gcttgacaatataaagacat

SEQ ID NO: 130495 - DNA, 20 bp, human
gtgcctggacaatggagcca

SEQ ID NO: 130496 - DNA, 20 bp, human
ggaggaggaagcgctcccta

SEQ ID NO: 130497 - DNA, 20 bp, human
gccggccccgggcctcatct

SEQ ID NO: 130498 - DNA, 20 bp, human
gctcttggcatgatacccag

SEQ ID NO: 130499 - DNA, 20 bp, human
gcgtactagcgacggccgta

SEQ ID NO: 130500 - DNA, 20 bp, human
gaacaccgagatgaggcccg

SEQ ID NO: 130501 - DNA, 20 bp, human
gaagctagctggcccggcag

SEQ ID NO: 130502 - DNA, 20 bp, human
gtccgtagccggggtgtagg

SEQ ID NO: 130503 - DNA, 20 bp, human
gtgcgcaggcgtactagcga

SEQ ID NO: 130504 - DNA, 20 bp, human
gacagccaccgcctacaccc

SEQ ID NO: 130505 - DNA, 20 bp, human
gaccgcctacaccccggcta

SEQ ID NO: 130506 - DNA, 20 bp, human
gatagagcggcgggacatag

SEQ ID NO: 130507 - DNA, 20 bp, human
gccaggcaagcagcatagag

SEQ ID NO: 130508 - DNA, 20 bp, human
gtccgagtcgaaggaggctg

SEQ ID NO: 130509 - DNA, 20 bp, human
ggcgggacatagtggcaggg

SEQ ID NO: 130510 - DNA, 20 bp, human
gcggcccacgtggtgacccg

SEQ ID NO: 130511 - DNA, 20 bp, human
gctccaccgggcgctcctag

SEQ ID NO: 130512 - DNA, 20 bp, human
gagccgctccgagtcgaagg

SEQ ID NO: 130513 - DNA, 20 bp, human
ggctggactggggatcccag

SEQ ID NO: 130514 - DNA, 20 bp, human
ggcggcgggacatagtggca

SEQ ID NO: 130515 - DNA, 20 bp, human
gggcaagcagcatagagcgg

SEQ ID NO: 130516 - DNA, 20 bp, human
ggaacctcggcagtgctgga

SEQ ID NO: 130517 - DNA, 20 bp, human
gggcctggagagcaaaagta

SEQ ID NO: 130518 - DNA, 20 bp, human
gcaggattccagcttccaag

SEQ ID NO: 130519 - DNA, 20 bp, human
gtgcagggcaagacatagat

SEQ ID NO: 130520 - DNA, 20 bp, human
ggagcaaagctacacaggtt

SEQ ID NO: 130521 - DNA, 20 bp, human
gaggatccagaggacaccct

SEQ ID NO: 130522 - DNA, 20 bp, human
gaggaggagacataagagct

SEQ ID NO: 130523 - DNA, 20 bp, human
gggataagggaaggaatctg

SEQ ID NO: 130524 - DNA, 20 bp, human
gagctacacaggttaggtgg

SEQ ID NO: 130525 - DNA, 20 bp, human
gctgccgaggttctctgccg

SEQ ID NO: 130526 - DNA, 20 bp, human
gcagagtcctgggaccacat

SEQ ID NO: 130527 - DNA, 20 bp, human
gctgaccgggagagtgtgga

SEQ ID NO: 130528 - DNA, 20 bp, human
gtggagacccagaatgaaga

SEQ ID NO: 130529 - DNA, 20 bp, human
gtacccagcactaactactt

SEQ ID NO: 130530 - DNA, 20 bp, human
gatgactggtataataacga

SEQ ID NO: 130531 - DNA, 20 bp, human
ggaagaccataacaaaggac

SEQ ID NO: 130532 - DNA, 20 bp, human
gacttgggcattgtgctaaa

SEQ ID NO: 130533 - DNA, 20 bp, human
gaaagtgaaagcactcggat

SEQ ID NO: 130534 - DNA, 20 bp, human
gccataacaaaggacaggca

SEQ ID NO: 130535 - DNA, 20 bp, human
gtgcccaagtagttagtgct

SEQ ID NO: 130536 - DNA, 20 bp, human
gggaggggttcctagttcta

SEQ ID NO: 130537 - DNA, 20 bp, human
gtgccagatgagggagatat

SEQ ID NO: 130538 - DNA, 20 bp, human
gatgagggagatataggagt

SEQ ID NO: 130539 - DNA, 20 bp, human
gaggatccctaacaaaagat

SEQ ID NO: 130540 - DNA, 20 bp, human
gcccagagagaagagagccc

SEQ ID NO: 130541 - DNA, 20 bp, human
gctagggctagggagagtga

SEQ ID NO: 130542 - DNA, 20 bp, human
gctgggaatatgccagatga

SEQ ID NO: 130543 - DNA, 20 bp, human
gtgcaagtgggaccagactc

SEQ ID NO: 130544 - DNA, 20 bp, human
gagggagatataggagtagg

SEQ ID NO: 130545 - DNA, 20 bp, human
ggttcctagttctagggcag

SEQ ID NO: 130546 - DNA, 20 bp, human
gcacgcgccagggtgcacag

SEQ ID NO: 130547 - DNA, 20 bp, human
gcaaacgccggcctagagtg

SEQ ID NO: 130548 - DNA, 20 bp, human
ggagcgggaggtggaaaccg

SEQ ID NO: 130549 - DNA, 20 bp, human
gagcggccggccccgagcga

SEQ ID NO: 130550 - DNA, 20 bp, human
gagagcgagcgcgaaggaga

SEQ ID NO: 130551 - DNA, 20 bp, human
gttgctgccgggggtcagag

SEQ ID NO: 130552 - DNA, 20 bp, human
gcgctgcgccggctccacgg

SEQ ID NO: 130553 - DNA, 20 bp, human
ggacttggctggcggagggg

SEQ ID NO: 130554 - DNA, 20 bp, human
gcacggtggagatgatactc

SEQ ID NO: 130555 - DNA, 20 bp, human
gctgccgggggtcagagcgg

SEQ ID NO: 130556 - DNA, 20 bp, human
gctccagaaggcagcggtct

SEQ ID NO: 130557 - DNA, 20 bp, human
gctagacagcgtccagggtc

SEQ ID NO: 130558 - DNA, 20 bp, human
gtgtaagcgcggccagaccc

SEQ ID NO: 130559 - DNA, 20 bp, human
ggtcgaaggaagcctagcag

SEQ ID NO: 130560 - DNA, 20 bp, human
gagcggtctgagtgacagta

SEQ ID NO: 130561 - DNA, 20 bp, human
gcgggatgcactgggcggga

SEQ ID NO: 130562 - DNA, 20 bp, human
gtgcgctgggacaaggtgag

SEQ ID NO: 130563 - DNA, 20 bp, human
ggaggacgcccggctggacc

SEQ ID NO: 130564 - DNA, 20 bp, human
gctcaactagacagcgtcca

SEQ ID NO: 130565 - DNA, 20 bp, human
gcagaccgctggctcgtcgt

SEQ ID NO: 130566 - DNA, 20 bp, human
gtctctgggcgaagtgactg

SEQ ID NO: 130567 - DNA, 20 bp, human
gggctccgctgggataaggt

SEQ ID NO: 130568 - DNA, 20 bp, human
ggaaagagcagactgtgtgg

SEQ ID NO: 130569 - DNA, 20 bp, human
gtccccagcggaccaggtcc

SEQ ID NO: 130570 - DNA, 20 bp, human
gagcccgcggggcgctgggt

SEQ ID NO: 130571 - DNA, 20 bp, human
gggaccaggtccgggtctct

SEQ ID NO: 130572 - DNA, 20 bp, human
gagccaggacccagacatct

SEQ ID NO: 130573 - DNA, 20 bp, human
gcaggaaagagcagactgtg

SEQ ID NO: 130574 - DNA, 20 bp, human
gcagtggctccgctgggata

SEQ ID NO: 130575 - DNA, 20 bp, human
gtgggactgttgttctctcg

SEQ ID NO: 130576 - DNA, 20 bp, human
gcccgagggacccaggataa

SEQ ID NO: 130577 - DNA, 20 bp, human
gtcgcttgggccgcattcca

SEQ ID NO: 130578 - DNA, 20 bp, human
gccccttcacctacacgcag

SEQ ID NO: 130579 - DNA, 20 bp, human
gcgtcgctgggcctcggaca

SEQ ID NO: 130580 - DNA, 20 bp, human
gccaagcgaaaaggccaccg

SEQ ID NO: 130581 - DNA, 20 bp, human
gtgggagatgacctcgacgt

SEQ ID NO: 130582 - DNA, 20 bp, human
ggcgcttctccgctgcgtgt

SEQ ID NO: 130583 - DNA, 20 bp, human
gctccgctgcgtgtaggtga

SEQ ID NO: 130584 - DNA, 20 bp, human
gggcccggcttacctcggtc

SEQ ID NO: 130585 - DNA, 20 bp, human
gcgccggcggcgctcactgt

SEQ ID NO: 130586 - DNA, 20 bp, human
ggccgctcggctgactctct

SEQ ID NO: 130587 - DNA, 20 bp, human
ggccgagagagtcagccgag

SEQ ID NO: 130588 - DNA, 20 bp, human
gagtcagccgagcggccgcg

SEQ ID NO: 130589 - DNA, 20 bp, human
gccctacgaggaccagcggc

SEQ ID NO: 130590 - DNA, 20 bp, human
gtcctctccgcgcggccgct

SEQ ID NO: 130591 - DNA, 20 bp, human
ggccaggaggcgccatggag

SEQ ID NO: 130592 - DNA, 20 bp, human
ggggatggggctcccctcca

SEQ ID NO: 130593 - DNA, 20 bp, human
gccccggagggcggcgatcg

SEQ ID NO: 130594 - DNA, 20 bp, human
gaggaccagcggccggccgg

SEQ ID NO: 130595 - DNA, 20 bp, human
gacgaggaccagcggccggc

SEQ ID NO: 130596 - DNA, 20 bp, human
ggagcccgcggcaagcgcct

SEQ ID NO: 130597 - DNA, 20 bp, human
gcagcgggcgtcgtcgccac

SEQ ID NO: 130598 - DNA, 20 bp, human
gcactgcagggcgagggtcc

SEQ ID NO: 130599 - DNA, 20 bp, human
gacgtaggccttgggcgcgg

SEQ ID NO: 130600 - DNA, 20 bp, human
ggctgggctgcccagcacgt

SEQ ID NO: 130601 - DNA, 20 bp, human
gcgcccaaggcctacgtgct

SEQ ID NO: 130602 - DNA, 20 bp, human
ggcgccagcctggaggtctt

SEQ ID NO: 130603 - DNA, 20 bp, human
gggccgtgccgaagacctcc

SEQ ID NO: 130604 - DNA, 20 bp, human
gcgctggcgcaggtagagcg

SEQ ID NO: 130605 - DNA, 20 bp, human
ggcctccagctccgcggcca

SEQ ID NO: 130606 - DNA, 20 bp, human
gcccgcaggccagacagagg

SEQ ID NO: 130607 - DNA, 20 bp, human
gcgcaacagaagcaggtccg

SEQ ID NO: 130608 - DNA, 20 bp, human
gacaggctggacctcggaag

SEQ ID NO: 130609 - DNA, 20 bp, human
ggaggccgggggcttgacag

SEQ ID NO: 130610 - DNA, 20 bp, human
ggtcccagggtcgggagtca

SEQ ID NO: 130611 - DNA, 20 bp, human
ggctgctccatggcgggatc

SEQ ID NO: 130612 - DNA, 20 bp, human
ggcacagcccgatcccgcca

SEQ ID NO: 130613 - DNA, 20 bp, human
ggccatggagcagccgagga

SEQ ID NO: 130614 - DNA, 20 bp, human
gcgccagtcgcaacagaagc

SEQ ID NO: 130615 - DNA, 20 bp, human
ggcgggatcgggctgtgcct

SEQ ID NO: 130616 - DNA, 20 bp, human
ggagagctgctcaccagagg

SEQ ID NO: 130617 - DNA, 20 bp, human
ggattctggacacaccatga

SEQ ID NO: 130618 - DNA, 20 bp, human
gacttggtctctacctcctc

SEQ ID NO: 130619 - DNA, 20 bp, human
ggacacaccatgacggaact

SEQ ID NO: 130620 - DNA, 20 bp, human
gtcccggtgggtccgtgatg

SEQ ID NO: 130621 - DNA, 20 bp, human
gtaggtaagtgataggagct

SEQ ID NO: 130622 - DNA, 20 bp, human
gcacttacctagttccgtca

SEQ ID NO: 130623 - DNA, 20 bp, human
gggtagcagtagcaacttgc

SEQ ID NO: 130624 - DNA, 20 bp, human
gagccacatcacggacccac

SEQ ID NO: 130625 - DNA, 20 bp, human
gtccagaatcggcggattct

SEQ ID NO: 130626 - DNA, 20 bp, human
ggccgctgcctgagccaggg

SEQ ID NO: 130627 - DNA, 20 bp, human
ggaatccatgaagacgaagt

SEQ ID NO: 130628 - DNA, 20 bp, human
gagctcgcgctgcgcctccc

SEQ ID NO: 130629 - DNA, 20 bp, human
gccccggcgagcacgcggcc

SEQ ID NO: 130630 - DNA, 20 bp, human
gtgctcgccggggaccgggg

SEQ ID NO: 130631 - DNA, 20 bp, human
ggcttcaagtaactctcgag

SEQ ID NO: 130632 - DNA, 20 bp, human
gctgggccgctgcctgagcc

SEQ ID NO: 130633 - DNA, 20 bp, human
gcaagtaactctcgagtggc

SEQ ID NO: 130634 - DNA, 20 bp, human
gccggtccccggcgagcacg

SEQ ID NO: 130635 - DNA, 20 bp, human
gcagtcaccaccacgcagct

SEQ ID NO: 130636 - DNA, 20 bp, human
gtcccagcgagcggcaagtg

SEQ ID NO: 130637 - DNA, 20 bp, human
gtccctcctcctggagacgg

SEQ ID NO: 130638 - DNA, 20 bp, human
gcaggaggtggagatccctc

SEQ ID NO: 130639 - DNA, 20 bp, human
ggccggtccgggtgcaaggt

SEQ ID NO: 130640 - DNA, 20 bp, human
gcgcagagtactcacaagtc

SEQ ID NO: 130641 - DNA, 20 bp, human
gagaggtccgactagcccca

SEQ ID NO: 130642 - DNA, 20 bp, human
gccgtccagggagataggta

SEQ ID NO: 130643 - DNA, 20 bp, human
gccccgggctccccacgtgg

SEQ ID NO: 130644 - DNA, 20 bp, human
gctccccgggaacggacctg

SEQ ID NO: 130645 - DNA, 20 bp, human
gccacagctgtcactaatcg

SEQ ID NO: 130646 - DNA, 20 bp, human
gcactcgctcgctcagaggg

SEQ ID NO: 130647 - DNA, 20 bp, human
ggcgccactcgctcgctcag

SEQ ID NO: 130648 - DNA, 20 bp, human
ggccatgatctctggagtaa

SEQ ID NO: 130649 - DNA, 20 bp, human
gaggtgttcgatgtgaccaa

SEQ ID NO: 130650 - DNA, 20 bp, human
ggatctctggagtaaaggtt

SEQ ID NO: 130651 - DNA, 20 bp, human
gcaagcagcagcaggttgag

SEQ ID NO: 130652 - DNA, 20 bp, human
gatggctgccgaggatgtgg

SEQ ID NO: 130653 - DNA, 20 bp, human
gggttgggccgcgctaggca

SEQ ID NO: 130654 - DNA, 20 bp, human
gacccaagcgatctggagag

SEQ ID NO: 130655 - DNA, 20 bp, human
ggcttggagacaaaagaagg

SEQ ID NO: 130656 - DNA, 20 bp, human
gagtccaggcgacgcgggag

SEQ ID NO: 130657 - DNA, 20 bp, human
gctgggggcctaccggctgt

SEQ ID NO: 130658 - DNA, 20 bp, human
gcgtgaagctaggcaccctg

SEQ ID NO: 130659 - DNA, 20 bp, human
ggcgagagcagcaacgacgg

SEQ ID NO: 130660 - DNA, 20 bp, human
gcgctggcgggcagtgatgg

SEQ ID NO: 130661 - DNA, 20 bp, human
gaagtcttcgacgtgaccaa

SEQ ID NO: 130662 - DNA, 20 bp, human
gaggcgctggcgggcagtga

SEQ ID NO: 130663 - DNA, 20 bp, human
ggtgatggggacgtgaagct

SEQ ID NO: 130664 - DNA, 20 bp, human
gtacggcccgggtgaggagt

SEQ ID NO: 130665 - DNA, 20 bp, human
gacggcggcagcgagagtcc

SEQ ID NO: 130666 - DNA, 20 bp, human
ggcagtcgcctccagaacac

SEQ ID NO: 130667 - DNA, 20 bp, human
gaagcggcgagtctccatgg

SEQ ID NO: 130668 - DNA, 20 bp, human
gggcgggacccgtgttctgg

SEQ ID NO: 130669 - DNA, 20 bp, human
gcggaagcggcgagtctcca

SEQ ID NO: 130670 - DNA, 20 bp, human
gcaacaagcacggtgtagac

SEQ ID NO: 130671 - DNA, 20 bp, human
gtgcggcgggacccgtgttc

SEQ ID NO: 130672 - DNA, 20 bp, human
gcggcgagtctccatggcgg

SEQ ID NO: 130673 - DNA, 20 bp, human
gcggggctcgccaacaagca

SEQ ID NO: 130674 - DNA, 20 bp, human
gagccccgggaggcagaaat

SEQ ID NO: 130675 - DNA, 20 bp, human
gtgtaagtgcacggtggccg

SEQ ID NO: 130676 - DNA, 20 bp, human
gagatacatgagacagtcag

SEQ ID NO: 130677 - DNA, 20 bp, human
gttctttagaagctcacggg

SEQ ID NO: 130678 - DNA, 20 bp, human
gacatgagacagtcagtggc

SEQ ID NO: 130679 - DNA, 20 bp, human
ggacgacctccccaaagaga

SEQ ID NO: 130680 - DNA, 20 bp, human
gacccaaggaggctatgata

SEQ ID NO: 130681 - DNA, 20 bp, human
gctgtctcatgtatctgcaa

SEQ ID NO: 130682 - DNA, 20 bp, human
ggagcttctaaagaataaag

SEQ ID NO: 130683 - DNA, 20 bp, human
gcatgtatctgcaagggccg

SEQ ID NO: 130684 - DNA, 20 bp, human
gaagccgccacaaaacatca

SEQ ID NO: 130685 - DNA, 20 bp, human
gccgcctacggaaaaaatcc

SEQ ID NO: 130686 - DNA, 20 bp, human
gcagagaggcggatgcatgt

SEQ ID NO: 130687 - DNA, 20 bp, human
gggcagctcttaggaacctc

SEQ ID NO: 130688 - DNA, 20 bp, human
gtcctggtgcctgctgaggc

SEQ ID NO: 130689 - DNA, 20 bp, human
ggcatctacactaacaccgt

SEQ ID NO: 130690 - DNA, 20 bp, human
ggctgaggcaggcagctctt

SEQ ID NO: 130691 - DNA, 20 bp, human
gacgccaatgcctaccttaa

SEQ ID NO: 130692 - DNA, 20 bp, human
gtaggataggctggagccca

SEQ ID NO: 130693 - DNA, 20 bp, human
gtgtgggagcaaagagcttt

SEQ ID NO: 130694 - DNA, 20 bp, human
gtttgggcagcctttaaggt

SEQ ID NO: 130695 - DNA, 20 bp, human
gcgggccgggttcataggat

SEQ ID NO: 130696 - DNA, 20 bp, human
gcgcgcggggtagaaggtga

SEQ ID NO: 130697 - DNA, 20 bp, human
gcgcggcggatcctgcccag

SEQ ID NO: 130698 - DNA, 20 bp, human
gggaatgacaggcatccgct

SEQ ID NO: 130699 - DNA, 20 bp, human
gggcatcgcgcacagaaaaa

SEQ ID NO: 130700 - DNA, 20 bp, human
gttggcgagcgctacctctg

SEQ ID NO: 130701 - DNA, 20 bp, human
gagaaggtgaggggacccgg

SEQ ID NO: 130702 - DNA, 20 bp, human
gtgtccccgcagcccggcag

SEQ ID NO: 130703 - DNA, 20 bp, human
gccgcgcgggtctcccagcc

SEQ ID NO: 130704 - DNA, 20 bp, human
ggagacccgcgcggggtaga

SEQ ID NO: 130705 - DNA, 20 bp, human
gatctgcatagaggaatgac

SEQ ID NO: 130706 - DNA, 20 bp, human
gccgaggcggccaaggtcac

SEQ ID NO: 130707 - DNA, 20 bp, human
gccgcgtcggaggacgggag

SEQ ID NO: 130708 - DNA, 20 bp, human
ggccaaggtcaccggcgagg

SEQ ID NO: 130709 - DNA, 20 bp, human
ggatgtcctggaatgtctgg

SEQ ID NO: 130710 - DNA, 20 bp, human
gcatggccgcgtcggaggac

SEQ ID NO: 130711 - DNA, 20 bp, human
ggagctggagaaagacgccg

SEQ ID NO: 130712 - DNA, 20 bp, human
gagagcatccgaggcggcca

SEQ ID NO: 130713 - DNA, 20 bp, human
ggctgcagccaggcgcatcc

SEQ ID NO: 130714 - DNA, 20 bp, human
gctgttcttggagcatctgt

SEQ ID NO: 130715 - DNA, 20 bp, human
ggccgggcccatggccgcgt

SEQ ID NO: 130716 - DNA, 20 bp, human
gctgctgcctggcggccaac

SEQ ID NO: 130717 - DNA, 20 bp, human
ggagccggctggacagtgta

SEQ ID NO: 130718 - DNA, 20 bp, human
gccatgcacggacacaaagg

SEQ ID NO: 130719 - DNA, 20 bp, human
gggaacaggctcccccgtgg

SEQ ID NO: 130720 - DNA, 20 bp, human
gtactgtaaccggatcccca

SEQ ID NO: 130721 - DNA, 20 bp, human
ggagcccttggcccccgggg

SEQ ID NO: 130722 - DNA, 20 bp, human
gccggagcccttggcccccg

SEQ ID NO: 130723 - DNA, 20 bp, human
ggggcccagccaagtctcgg

SEQ ID NO: 130724 - DNA, 20 bp, human
gcaggtaggatttccgggag

SEQ ID NO: 130725 - DNA, 20 bp, human
gctctccgccccccgagact

SEQ ID NO: 130726 - DNA, 20 bp, human
gggtcggcgatatggaagat

SEQ ID NO: 130727 - DNA, 20 bp, human
gcaccgcgggaagatggcgt

SEQ ID NO: 130728 - DNA, 20 bp, human
ggtcatgtcggaatccgagt

SEQ ID NO: 130729 - DNA, 20 bp, human
gctgggtgcgaccgtcatgt

SEQ ID NO: 130730 - DNA, 20 bp, human
gcggaggtgagacgtctaag

SEQ ID NO: 130731 - DNA, 20 bp, human
gggccgtgcgaaccccgaac

SEQ ID NO: 130732 - DNA, 20 bp, human
gccgctaggtaaccataaag

SEQ ID NO: 130733 - DNA, 20 bp, human
gggaagatggcgttggaggt

SEQ ID NO: 130734 - DNA, 20 bp, human
ggcgttggaggtcggcgata

SEQ ID NO: 130735 - DNA, 20 bp, human
gcgcgggaagatggcgttgg

SEQ ID NO: 130736 - DNA, 20 bp, human
ggcagttgccgtgttctgga

SEQ ID NO: 130737 - DNA, 20 bp, human
gggtggcgacagtgctatga

SEQ ID NO: 130738 - DNA, 20 bp, human
gtgcatggtggcaaaaaaat

SEQ ID NO: 130739 - DNA, 20 bp, human
gcttgccaagaaacttagga

SEQ ID NO: 130740 - DNA, 20 bp, human
gcatacaaaagatctagaca

SEQ ID NO: 130741 - DNA, 20 bp, human
gttggcaagcaaataattgt

SEQ ID NO: 130742 - DNA, 20 bp, human
gacatgcagttgccgtgttc

SEQ ID NO: 130743 - DNA, 20 bp, human
gagcaaataattgtaggtct

SEQ ID NO: 130744 - DNA, 20 bp, human
gatgagggccttccagaaca

SEQ ID NO: 130745 - DNA, 20 bp, human
gacttgcagaaagtgctagg

SEQ ID NO: 130746 - DNA, 20 bp, human
ggcaacccctggctcgtccc

SEQ ID NO: 130747 - DNA, 20 bp, human
gcaggggttgctcagagtaa

SEQ ID NO: 130748 - DNA, 20 bp, human
gtggaagcaggtgagaatgg

SEQ ID NO: 130749 - DNA, 20 bp, human
gggagcgggcaacgacggtg

SEQ ID NO: 130750 - DNA, 20 bp, human
gagctcatgcgcagtatgtg

SEQ ID NO: 130751 - DNA, 20 bp, human
gagactggagcgggcaacga

SEQ ID NO: 130752 - DNA, 20 bp, human
gagttgaggtctgggaagta

SEQ ID NO: 130753 - DNA, 20 bp, human
gtgagcccgggacgagccag

SEQ ID NO: 130754 - DNA, 20 bp, human
ggagctctggaataactggg

SEQ ID NO: 130755 - DNA, 20 bp, human
gctggaataactgggagggt

SEQ ID NO: 130756 - DNA, 20 bp, human
ggggttcgggcccgtaaggc

SEQ ID NO: 130757 - DNA, 20 bp, human
gggcccgaaccctcgtgtga

SEQ ID NO: 130758 - DNA, 20 bp, human
ggtaaggctggcgaaagaaa

SEQ ID NO: 130759 - DNA, 20 bp, human
gacgagggttcgggcccgta

SEQ ID NO: 130760 - DNA, 20 bp, human
gtgcagtacctaagccggag

SEQ ID NO: 130761 - DNA, 20 bp, human
gctctaccccgctccggctt

SEQ ID NO: 130762 - DNA, 20 bp, human
ggtactgcacccttcacacg

SEQ ID NO: 130763 - DNA, 20 bp, human
gcgtcaagggtgaaaggtca

SEQ ID NO: 130764 - DNA, 20 bp, human
gaagggtgcagtacctaagc

SEQ ID NO: 130765 - DNA, 20 bp, human
gaggccaggccgctgctcag

SEQ ID NO: 130766 - DNA, 20 bp, human
ggggaacgcacctctcggag

SEQ ID NO: 130767 - DNA, 20 bp, human
gaggcagggaaagcaactgg

SEQ ID NO: 130768 - DNA, 20 bp, human
gccaaccggcgagcagaact

SEQ ID NO: 130769 - DNA, 20 bp, human
gtcagcgccggaggtaggca

SEQ ID NO: 130770 - DNA, 20 bp, human
gatagccagaagactcggac

SEQ ID NO: 130771 - DNA, 20 bp, human
gctgcggggaggtgcttccg

SEQ ID NO: 130772 - DNA, 20 bp, human
ggcacctctcggagaggaga

SEQ ID NO: 130773 - DNA, 20 bp, human
gtagtggggaacgcacctct

SEQ ID NO: 130774 - DNA, 20 bp, human
ggaaagtgctggcctctagt

SEQ ID NO: 130775 - DNA, 20 bp, human
ggggcgccggcaggaaacga

SEQ ID NO: 130776 - DNA, 20 bp, human
gcgtaggcccgggccgttag

SEQ ID NO: 130777 - DNA, 20 bp, human
gtgccaggccgtgccagtcg

SEQ ID NO: 130778 - DNA, 20 bp, human
gagccgccgcggagacaatg

SEQ ID NO: 130779 - DNA, 20 bp, human
ggctcgccgcactggaagtc

SEQ ID NO: 130780 - DNA, 20 bp, human
ggaggtgacacggcttccag

SEQ ID NO: 130781 - DNA, 20 bp, human
gccgccctcggtgcccctaa

SEQ ID NO: 130782 - DNA, 20 bp, human
gcgtcccagggaagtcgcag

SEQ ID NO: 130783 - DNA, 20 bp, human
gcggtgcccgacttccagtg

SEQ ID NO: 130784 - DNA, 20 bp, human
ggggccgttaggggcaccga

SEQ ID NO: 130785 - DNA, 20 bp, human
gcaatgcggcgagtctggga

SEQ ID NO: 130786 - DNA, 20 bp, human
gctgatgtcgtaactagggg

SEQ ID NO: 130787 - DNA, 20 bp, human
gagcggagtgagtgactaga

SEQ ID NO: 130788 - DNA, 20 bp, human
gtgcgcaggcagccgtaaca

SEQ ID NO: 130789 - DNA, 20 bp, human
gcagcccatgttagtgatgg

SEQ ID NO: 130790 - DNA, 20 bp, human
gcagatccgggacctgatgg

SEQ ID NO: 130791 - DNA, 20 bp, human
ggcgcagcccatgttagtga

SEQ ID NO: 130792 - DNA, 20 bp, human
gctcccgctgaggaggagtg

SEQ ID NO: 130793 - DNA, 20 bp, human
gcccgcgggcagccttgtta

SEQ ID NO: 130794 - DNA, 20 bp, human
gggggcgaagacgaactcta

SEQ ID NO: 130795 - DNA, 20 bp, human
gtagggtccagttaccctcc

SEQ ID NO: 130796 - DNA, 20 bp, human
gcctcagcaaagtccctgtt

SEQ ID NO: 130797 - DNA, 20 bp, human
gcaattaagacaacctacag

SEQ ID NO: 130798 - DNA, 20 bp, human
gtcaaaccatcagcctctgt

SEQ ID NO: 130799 - DNA, 20 bp, human
gttgctactttgcactgcac

SEQ ID NO: 130800 - DNA, 20 bp, human
ggacaacctacagaggctga

SEQ ID NO: 130801 - DNA, 20 bp, human
gaagtgggtccggtgaatcc

SEQ ID NO: 130802 - DNA, 20 bp, human
gagagaagagcctgccaaac

SEQ ID NO: 130803 - DNA, 20 bp, human
gtatcctaggaactcttaga

SEQ ID NO: 130804 - DNA, 20 bp, human
gaaatgctccaggatatcct

SEQ ID NO: 130805 - DNA, 20 bp, human
gctggactatgactgatttt

SEQ ID NO: 130806 - DNA, 20 bp, human
ggacgcagcagccaaagcag

SEQ ID NO: 130807 - DNA, 20 bp, human
gagggtgacctgacataacc

SEQ ID NO: 130808 - DNA, 20 bp, human
ggctgtcaccggtaaggagg

SEQ ID NO: 130809 - DNA, 20 bp, human
ggagaagttgtctaacccgg

SEQ ID NO: 130810 - DNA, 20 bp, human
gcccagcccctccgtcccgg

SEQ ID NO: 130811 - DNA, 20 bp, human
gcccagagccgccgggacgg

SEQ ID NO: 130812 - DNA, 20 bp, human
ggggcagacgtaggagacct

SEQ ID NO: 130813 - DNA, 20 bp, human
ggtggggcagctaacggatg

SEQ ID NO: 130814 - DNA, 20 bp, human
ggccccagctgtcaccggta

SEQ ID NO: 130815 - DNA, 20 bp, human
gggacttggagtgaccatgg

SEQ ID NO: 130816 - DNA, 20 bp, human
gagtacaacgccgggccgtg

SEQ ID NO: 130817 - DNA, 20 bp, human
ggcgccgcgcctgagaccgg

SEQ ID NO: 130818 - DNA, 20 bp, human
gcgcctggctccccacggcc

SEQ ID NO: 130819 - DNA, 20 bp, human
gaatggaggaggcccagcgg

SEQ ID NO: 130820 - DNA, 20 bp, human
gcgcggccgagtacaacgcc

SEQ ID NO: 130821 - DNA, 20 bp, human
gggcgtgggcccagtcccac

SEQ ID NO: 130822 - DNA, 20 bp, human
gcgggacaaggcggaggcga

SEQ ID NO: 130823 - DNA, 20 bp, human
gcggcacccaggcccgggac

SEQ ID NO: 130824 - DNA, 20 bp, human
gcggccgcccagcgtctcgg

SEQ ID NO: 130825 - DNA, 20 bp, human
gggtcagggtcgggtcgcac

SEQ ID NO: 130826 - DNA, 20 bp, human
gtggcgccgagcaccctctc

SEQ ID NO: 130827 - DNA, 20 bp, human
gtcgccgccccggcccgaga

SEQ ID NO: 130828 - DNA, 20 bp, human
ggcgctaggagagttgacat

SEQ ID NO: 130829 - DNA, 20 bp, human
gcgcagctgcagcacagtca

SEQ ID NO: 130830 - DNA, 20 bp, human
gaccactcgcgcgaaaccat

SEQ ID NO: 130831 - DNA, 20 bp, human
ggggccccggcccggagtag

SEQ ID NO: 130832 - DNA, 20 bp, human
gactgggctgtcacccgcgg

SEQ ID NO: 130833 - DNA, 20 bp, human
gccccgcggtacacaccggt

SEQ ID NO: 130834 - DNA, 20 bp, human
gccatgcggccacgaccgga

SEQ ID NO: 130835 - DNA, 20 bp, human
gcggcccaggccagttccac

SEQ ID NO: 130836 - DNA, 20 bp, human
ggcagccgggacgcagacgg

SEQ ID NO: 130837 - DNA, 20 bp, human
ggagccagggcgaggaagtc

SEQ ID NO: 130838 - DNA, 20 bp, human
ggcgctggaggaaggagatg

SEQ ID NO: 130839 - DNA, 20 bp, human
gccgggaggtggatgaatgt

SEQ ID NO: 130840 - DNA, 20 bp, human
ggatacccccagccccggga

SEQ ID NO: 130841 - DNA, 20 bp, human
gggaagtcgggacccgtatt

SEQ ID NO: 130842 - DNA, 20 bp, human
gcccctcgcggcccgtcggg

SEQ ID NO: 130843 - DNA, 20 bp, human
gcccgccgaggcctgacccc

SEQ ID NO: 130844 - DNA, 20 bp, human
gcggcccccccaaccccggg

SEQ ID NO: 130845 - DNA, 20 bp, human
gcacaggctaaagccggcac

SEQ ID NO: 130846 - DNA, 20 bp, human
gcggtgagcgggaacccgac

SEQ ID NO: 130847 - DNA, 20 bp, human
gcggtggaaccgccagtccg

SEQ ID NO: 130848 - DNA, 20 bp, human
ggccgaactgggcgtcaggt

SEQ ID NO: 130849 - DNA, 20 bp, human
gccgagacacgagccgaact

SEQ ID NO: 130850 - DNA, 20 bp, human
gtcaggtcggggagccggtc

SEQ ID NO: 130851 - DNA, 20 bp, human
gctcccgcggcggtagaggc

SEQ ID NO: 130852 - DNA, 20 bp, human
ggccgccgccttccacccgg

SEQ ID NO: 130853 - DNA, 20 bp, human
gccgggctggaggtgatggg

SEQ ID NO: 130854 - DNA, 20 bp, human
ggtggacgatgcagctcccg

SEQ ID NO: 130855 - DNA, 20 bp, human
gcccgacctgacgcccagtt

SEQ ID NO: 130856 - DNA, 20 bp, human
ggcggctgcctcagacaata

SEQ ID NO: 130857 - DNA, 20 bp, human
gcccggatacagctctgaaa

SEQ ID NO: 130858 - DNA, 20 bp, human
gaaattgcacagcgcgaggg

SEQ ID NO: 130859 - DNA, 20 bp, human
gtactaaggaatccgtgagg

SEQ ID NO: 130860 - DNA, 20 bp, human
gctgctttccctattgtctg

SEQ ID NO: 130861 - DNA, 20 bp, human
gacttactaaggaatccgtg

SEQ ID NO: 130862 - DNA, 20 bp, human
gtctagaagtcagggccggt

SEQ ID NO: 130863 - DNA, 20 bp, human
gagtgtatccgaggcctctg

SEQ ID NO: 130864 - DNA, 20 bp, human
gcagaaattgcacagcgcga

SEQ ID NO: 130865 - DNA, 20 bp, human
ggcctcggatacacttacta

SEQ ID NO: 130866 - DNA, 20 bp, human
gcaactgcgatggccgcggt

SEQ ID NO: 130867 - DNA, 20 bp, human
gagccggtgccgctaggagt

SEQ ID NO: 130868 - DNA, 20 bp, human
gtggtgaatggtgccgaccg

SEQ ID NO: 130869 - DNA, 20 bp, human
gcgcgctggcttcctagaac

SEQ ID NO: 130870 - DNA, 20 bp, human
gccgaagccgggagctcctg

SEQ ID NO: 130871 - DNA, 20 bp, human
gcgcagggcccatccgccgg

SEQ ID NO: 130872 - DNA, 20 bp, human
gcctccaactgcgatggccg

SEQ ID NO: 130873 - DNA, 20 bp, human
gtacacagggggttggtgaa

SEQ ID NO: 130874 - DNA, 20 bp, human
gggggggtgagtagcgtcca

SEQ ID NO: 130875 - DNA, 20 bp, human
gactttgcgcccactcctag

SEQ ID NO: 130876 - DNA, 20 bp, human
gggctccgggaacagaccca

SEQ ID NO: 130877 - DNA, 20 bp, human
gccaatggggaccctctcta

SEQ ID NO: 130878 - DNA, 20 bp, human
gctgtcgggctgctagccgg

SEQ ID NO: 130879 - DNA, 20 bp, human
gagagcctgcgctcgccagg

SEQ ID NO: 130880 - DNA, 20 bp, human
gagaggggcggtccgtagag

SEQ ID NO: 130881 - DNA, 20 bp, human
gaggcgacctcaagaaaaga

SEQ ID NO: 130882 - DNA, 20 bp, human
gcgggggaacttgaaattgt

SEQ ID NO: 130883 - DNA, 20 bp, human
ggggctgtcgggctgctagc

SEQ ID NO: 130884 - DNA, 20 bp, human
gaaggcagtgatgagcgggt

SEQ ID NO: 130885 - DNA, 20 bp, human
gggcagcgctaggcgccagg

SEQ ID NO: 130886 - DNA, 20 bp, human
gcagcgctgggcaggcggtt

SEQ ID NO: 130887 - DNA, 20 bp, human
gcccagcgctgaggcctgac

SEQ ID NO: 130888 - DNA, 20 bp, human
ggccggaggcgaccacgatg

SEQ ID NO: 130889 - DNA, 20 bp, human
gtggggccgagagcgtgtgt

SEQ ID NO: 130890 - DNA, 20 bp, human
gatgtggaaccggagcgacc

SEQ ID NO: 130891 - DNA, 20 bp, human
gcgggtgagtccggtcggag

SEQ ID NO: 130892 - DNA, 20 bp, human
gtcgctccggttccacatcg

SEQ ID NO: 130893 - DNA, 20 bp, human
gcgcgctcgccctaccggag

SEQ ID NO: 130894 - DNA, 20 bp, human
gcgtgggagcgcacagtgtc

SEQ ID NO: 130895 - DNA, 20 bp, human
ggccgcgctccgggtcgctc

SEQ ID NO: 130896 - DNA, 20 bp, human
gtgtgcgcgtcccggtcccg

SEQ ID NO: 130897 - DNA, 20 bp, human
gtgctcaaagtggcggagcg

SEQ ID NO: 130898 - DNA, 20 bp, human
gtgcgcgccggcgagagcag

SEQ ID NO: 130899 - DNA, 20 bp, human
gtcgccggcgcgcacacacc

SEQ ID NO: 130900 - DNA, 20 bp, human
gcacggaggcactctcggtc

SEQ ID NO: 130901 - DNA, 20 bp, human
gtccactaggcagcgacctt

SEQ ID NO: 130902 - DNA, 20 bp, human
gaccgggcactcgcgcacgg

SEQ ID NO: 130903 - DNA, 20 bp, human
gcacaccgggcactcgcgca

SEQ ID NO: 130904 - DNA, 20 bp, human
gtctcgatctgtagcgagga

SEQ ID NO: 130905 - DNA, 20 bp, human
gctcggagctgcatgagttc

SEQ ID NO: 130906 - DNA, 20 bp, human
gtggccaccaggcgcatcgg

SEQ ID NO: 130907 - DNA, 20 bp, human
gcgtccgagcgactgaggag

SEQ ID NO: 130908 - DNA, 20 bp, human
gcacgtccgaagtcaggctg

SEQ ID NO: 130909 - DNA, 20 bp, human
gtggtggccagactccaagt

SEQ ID NO: 130910 - DNA, 20 bp, human
ggtctggccaccaggcgcat

SEQ ID NO: 130911 - DNA, 20 bp, human
gccaccaggcgcatcggtgg

SEQ ID NO: 130912 - DNA, 20 bp, human
gagactccaagtgggaccgg

SEQ ID NO: 130913 - DNA, 20 bp, human
gggagcgctgaacccgaagg

SEQ ID NO: 130914 - DNA, 20 bp, human
gcacgggcggacactcggcc

SEQ ID NO: 130915 - DNA, 20 bp, human
ggtcaggctgcggcagggtt

SEQ ID NO: 130916 - DNA, 20 bp, human
gcacggcccagccccgaccg

SEQ ID NO: 130917 - DNA, 20 bp, human
ggccggcagacgcagtacac

SEQ ID NO: 130918 - DNA, 20 bp, human
ggaagcgggtaacgtcgtag

SEQ ID NO: 130919 - DNA, 20 bp, human
gcggggcgcccggaatgcgg

SEQ ID NO: 130920 - DNA, 20 bp, human
ggtgcgacgcctgcaaggac

SEQ ID NO: 130921 - DNA, 20 bp, human
gcagaggccgggcatccgga

SEQ ID NO: 130922 - DNA, 20 bp, human
gattccgggcgccccggtcg

SEQ ID NO: 130923 - DNA, 20 bp, human
gccgcgacccagctgacagg

SEQ ID NO: 130924 - DNA, 20 bp, human
ggggcgggggcgccaagcac

SEQ ID NO: 130925 - DNA, 20 bp, human
gggcgcccggaatgcggcgg

SEQ ID NO: 130926 - DNA, 20 bp, human
gtccaggaccaaccgacaga

SEQ ID NO: 130927 - DNA, 20 bp, human
gcaggggaccgaagcagcgg

SEQ ID NO: 130928 - DNA, 20 bp, human
gaagcgcaaggcaatagcag

SEQ ID NO: 130929 - DNA, 20 bp, human
ggagcggcgcagccggagtg

SEQ ID NO: 130930 - DNA, 20 bp, human
ggggccgtgaggtgagctcg

SEQ ID NO: 130931 - DNA, 20 bp, human
gagctcaggctcgggcccta

SEQ ID NO: 130932 - DNA, 20 bp, human
gcaatcagcgccgcccgagg

SEQ ID NO: 130933 - DNA, 20 bp, human
gccccgctcgcccagcctgg

SEQ ID NO: 130934 - DNA, 20 bp, human
ggggctacccgcaagagtgg

SEQ ID NO: 130935 - DNA, 20 bp, human
gggggtgcgggtaagcccta

SEQ ID NO: 130936 - DNA, 20 bp, human
ggccatccggccctccgcag

SEQ ID NO: 130937 - DNA, 20 bp, human
gctgcggcgcccagacaata

SEQ ID NO: 130938 - DNA, 20 bp, human
gtcgcgtcagggctggccgg

SEQ ID NO: 130939 - DNA, 20 bp, human
gggatggctgtcaaacctgg

SEQ ID NO: 130940 - DNA, 20 bp, human
gaggccgagtcggtaagagg

SEQ ID NO: 130941 - DNA, 20 bp, human
gatagggccggcgagttacg

SEQ ID NO: 130942 - DNA, 20 bp, human
ggagccctcaagctcgctca

SEQ ID NO: 130943 - DNA, 20 bp, human
gggaccctgagcgagcttga

SEQ ID NO: 130944 - DNA, 20 bp, human
gggggcccggcgtcgcgtca

SEQ ID NO: 130945 - DNA, 20 bp, human
gctccgcaggggggtaagga

SEQ ID NO: 130946 - DNA, 20 bp, human
ggctggctggctgtcccccc

SEQ ID NO: 130947 - DNA, 20 bp, human
gggccgggtggtgaatgggc

SEQ ID NO: 130948 - DNA, 20 bp, human
gccggggccgggtggtgaat

SEQ ID NO: 130949 - DNA, 20 bp, human
gcctgggcggagggatcccc

SEQ ID NO: 130950 - DNA, 20 bp, human
gacaccagcgacaagacaga

SEQ ID NO: 130951 - DNA, 20 bp, human
gggagggaactcttcttcat

SEQ ID NO: 130952 - DNA, 20 bp, human
gcaggccccgggccggaatc

SEQ ID NO: 130953 - DNA, 20 bp, human
gccccgggccggaatcggga

SEQ ID NO: 130954 - DNA, 20 bp, human
gcaccagcccattcaccacc

SEQ ID NO: 130955 - DNA, 20 bp, human
ggcaggggggcgccccgaag

SEQ ID NO: 130956 - DNA, 20 bp, human
ggcgcgcgcctggatctcgt

SEQ ID NO: 130957 - DNA, 20 bp, human
gccgaggcccaacgagatcc

SEQ ID NO: 130958 - DNA, 20 bp, human
gagctccatcccggcaactt

SEQ ID NO: 130959 - DNA, 20 bp, human
gtcccgcgcgagcctcccgc

SEQ ID NO: 130960 - DNA, 20 bp, human
gcgggcagcctgaggagttg

SEQ ID NO: 130961 - DNA, 20 bp, human
gtggtggcgcgcgagttcca

SEQ ID NO: 130962 - DNA, 20 bp, human
gtatagtccctgcccgcggg

SEQ ID NO: 130963 - DNA, 20 bp, human
ggcagggactatatttcctc

SEQ ID NO: 130964 - DNA, 20 bp, human
gccgaggcacaactttgccg

SEQ ID NO: 130965 - DNA, 20 bp, human
gaactcgcgcgccaccaggt

SEQ ID NO: 130966 - DNA, 20 bp, human
gtgtggctgccgcctcatcg

SEQ ID NO: 130967 - DNA, 20 bp, human
gcgcggccccccctgggatg

SEQ ID NO: 130968 - DNA, 20 bp, human
gggctcaggcaggccacccg

SEQ ID NO: 130969 - DNA, 20 bp, human
gactggagacagacccctct

SEQ ID NO: 130970 - DNA, 20 bp, human
gcccgcgagctgccccgatg

SEQ ID NO: 130971 - DNA, 20 bp, human
ggcgagctgccccgatgagg

SEQ ID NO: 130972 - DNA, 20 bp, human
gtgggatcgcggccccccct

SEQ ID NO: 130973 - DNA, 20 bp, human
gtcccgccccatcccagggg

SEQ ID NO: 130974 - DNA, 20 bp, human
gctcactcgcacacgcaccc

SEQ ID NO: 130975 - DNA, 20 bp, human
gctgcaaacttgcacggctc

SEQ ID NO: 130976 - DNA, 20 bp, human
ggaaagaggagtgggaaact

SEQ ID NO: 130977 - DNA, 20 bp, human
ggcggactcgagtctcaacc

SEQ ID NO: 130978 - DNA, 20 bp, human
gtggagatcagacggtgtgg

SEQ ID NO: 130979 - DNA, 20 bp, human
ggctgaggcggacacttctg

SEQ ID NO: 130980 - DNA, 20 bp, human
ggaaggttaggggaatccag

SEQ ID NO: 130981 - DNA, 20 bp, human
gtggcggagcccagtcccga

SEQ ID NO: 130982 - DNA, 20 bp, human
gtgggagcatcgagcactag

SEQ ID NO: 130983 - DNA, 20 bp, human
ggggcccggtccgggagtgc

SEQ ID NO: 130984 - DNA, 20 bp, human
gccgaaggtgagctctcgac

SEQ ID NO: 130985 - DNA, 20 bp, human
gagacggtgtgggggtgcgg

SEQ ID NO: 130986 - DNA, 20 bp, human
gggcggctgcaacgaggatt

SEQ ID NO: 130987 - DNA, 20 bp, human
gagccatcggcgtgcggcgg

SEQ ID NO: 130988 - DNA, 20 bp, human
ggccagacgagcgctaccac

SEQ ID NO: 130989 - DNA, 20 bp, human
gggcagcaagaggaagatgg

SEQ ID NO: 130990 - DNA, 20 bp, human
gctgcgcgcccgcgcctcag

SEQ ID NO: 130991 - DNA, 20 bp, human
gccagcggcgcggcccaggt

SEQ ID NO: 130992 - DNA, 20 bp, human
gcgctaccactggcagcaag

SEQ ID NO: 130993 - DNA, 20 bp, human
ggccagtggtagcgctcgtc

SEQ ID NO: 130994 - DNA, 20 bp, human
gaatggtccacaggcgccag

SEQ ID NO: 130995 - DNA, 20 bp, human
gcgcaggcccgaggcacggc

SEQ ID NO: 130996 - DNA, 20 bp, human
gccggcttagttaggagcta

SEQ ID NO: 130997 - DNA, 20 bp, human
gaagttcccgaagcttccgg

SEQ ID NO: 130998 - DNA, 20 bp, human
ggccccaggcaggtatcggg

SEQ ID NO: 130999 - DNA, 20 bp, human
gtcctaactaagccggccac

SEQ ID NO: 131000 - DNA, 20 bp, human
gcgttggaggagattcagga

SEQ ID NO: 131001 - DNA, 20 bp, human
gtccggtggccggcttagtt

SEQ ID NO: 131002 - DNA, 20 bp, human
ggtggcctctgatgagaaga

SEQ ID NO: 131003 - DNA, 20 bp, human
gcggaagttcccgaagcttc

SEQ ID NO: 131004 - DNA, 20 bp, human
gcctgcgaggcaagccccta

SEQ ID NO: 131005 - DNA, 20 bp, human
gtctgatgagaagagggcgg

SEQ ID NO: 131006 - DNA, 20 bp, human
ggcgacagagccccgctctc

SEQ ID NO: 131007 - DNA, 20 bp, human
gccgtctctcctcgaatgaa

SEQ ID NO: 131008 - DNA, 20 bp, human
gaatgaaaggaaacaacctc

SEQ ID NO: 131009 - DNA, 20 bp, human
ggcttacgcctagacttcgg

SEQ ID NO: 131010 - DNA, 20 bp, human
gagcggggctctgtcgccgg

SEQ ID NO: 131011 - DNA, 20 bp, human
gaggagagaagcgccaatga

SEQ ID NO: 131012 - DNA, 20 bp, human
ggccaagcgcctacaatgag

SEQ ID NO: 131013 - DNA, 20 bp, human
gggaatgaggaaaaactccg

SEQ ID NO: 131014 - DNA, 20 bp, human
gccagcagtgcctgagagcg

SEQ ID NO: 131015 - DNA, 20 bp, human
ggccccctcccccgaagtct

SEQ ID NO: 131016 - DNA, 20 bp, human
gggccgtggtagctacctcc

SEQ ID NO: 131017 - DNA, 20 bp, human
gcgtggtagctacctccggg

SEQ ID NO: 131018 - DNA, 20 bp, human
gtagtcgttgacacaggccg

SEQ ID NO: 131019 - DNA, 20 bp, human
gactgcgagcgcgcaaacgg

SEQ ID NO: 131020 - DNA, 20 bp, human
ggactaaagctccagtacag

SEQ ID NO: 131021 - DNA, 20 bp, human
ggagctaccgcgaggaggag

SEQ ID NO: 131022 - DNA, 20 bp, human
ggcgcgctcgcagtcttcgc

SEQ ID NO: 131023 - DNA, 20 bp, human
gaggttaacagccggagaag

SEQ ID NO: 131024 - DNA, 20 bp, human
ggcgcgacatgagcctggtc

SEQ ID NO: 131025 - DNA, 20 bp, human
gtctgagggcgccgctgtac

SEQ ID NO: 131026 - DNA, 20 bp, human
gcgaggttcccggcggtacg

SEQ ID NO: 131027 - DNA, 20 bp, human
ggcctcagcggaggctcgtc

SEQ ID NO: 131028 - DNA, 20 bp, human
gggactgcgaagcgcctcag

SEQ ID NO: 131029 - DNA, 20 bp, human
gagcatgaggaggtccctgt

SEQ ID NO: 131030 - DNA, 20 bp, human
gaccggacgagcctccgctg

SEQ ID NO: 131031 - DNA, 20 bp, human
gggcgctacccagacaacca

SEQ ID NO: 131032 - DNA, 20 bp, human
ggaaccggccgccacgtccg

SEQ ID NO: 131033 - DNA, 20 bp, human
gctgcgaagcgcctcagcgg

SEQ ID NO: 131034 - DNA, 20 bp, human
gccgtgtgcctcggacgtgg

SEQ ID NO: 131035 - DNA, 20 bp, human
gaggcgagcgaggttcccgg

SEQ ID NO: 131036 - DNA, 20 bp, human
gcagcctggacccttgctgc

SEQ ID NO: 131037 - DNA, 20 bp, human
gctggcgcgctagagtaact

SEQ ID NO: 131038 - DNA, 20 bp, human
gaagagggaagaacaaacgg

SEQ ID NO: 131039 - DNA, 20 bp, human
gtaggtacttctactcacag

SEQ ID NO: 131040 - DNA, 20 bp, human
gcactttgcaatgctagcgg

SEQ ID NO: 131041 - DNA, 20 bp, human
gagcaaagaggagctgatag

SEQ ID NO: 131042 - DNA, 20 bp, human
gcatgccaacgtgaaagacg

SEQ ID NO: 131043 - DNA, 20 bp, human
gccgaggccaactccagcaa

SEQ ID NO: 131044 - DNA, 20 bp, human
gctggagttggcctcggaat

SEQ ID NO: 131045 - DNA, 20 bp, human
ggagaaaattgaggtctcta

SEQ ID NO: 131046 - DNA, 20 bp, human
gaagctggaagagacctatg

SEQ ID NO: 131047 - DNA, 20 bp, human
gctcagggccagtcaggatc

SEQ ID NO: 131048 - DNA, 20 bp, human
gctgttggctggggacagta

SEQ ID NO: 131049 - DNA, 20 bp, human
ggcactctcaggtagggacc

SEQ ID NO: 131050 - DNA, 20 bp, human
gccgcaaagcccagccccat

SEQ ID NO: 131051 - DNA, 20 bp, human
gaacacctgggcctgaactg

SEQ ID NO: 131052 - DNA, 20 bp, human
ggggacagtagggtctctgt

SEQ ID NO: 131053 - DNA, 20 bp, human
gactggggagatacattctg

SEQ ID NO: 131054 - DNA, 20 bp, human
gacctggctctacttgctgt

SEQ ID NO: 131055 - DNA, 20 bp, human
gtcactaagggaaaggacga

SEQ ID NO: 131056 - DNA, 20 bp, human
gtcagcaggcggctcaggta

SEQ ID NO: 131057 - DNA, 20 bp, human
ggccgccgttgcttgaatgg

SEQ ID NO: 131058 - DNA, 20 bp, human
gacacacactgacagctata

SEQ ID NO: 131059 - DNA, 20 bp, human
gtccaccattcaagcaacgg

SEQ ID NO: 131060 - DNA, 20 bp, human
gacagctatagggcaggcgg

SEQ ID NO: 131061 - DNA, 20 bp, human
gggaggaaacaacaactctc

SEQ ID NO: 131062 - DNA, 20 bp, human
ggaatggtggagccgaagct

SEQ ID NO: 131063 - DNA, 20 bp, human
ggcaggcggctcaggtacgg

SEQ ID NO: 131064 - DNA, 20 bp, human
gtcgccgctcgcgggcgtgg

SEQ ID NO: 131065 - DNA, 20 bp, human
gtctgcggcggagggatccg

SEQ ID NO: 131066 - DNA, 20 bp, human
ggtctcccgcaaggtggagg

SEQ ID NO: 131067 - DNA, 20 bp, human
gaggccgccggagtccggag

SEQ ID NO: 131068 - DNA, 20 bp, human
ggctcgcgtctcccgcaagg

SEQ ID NO: 131069 - DNA, 20 bp, human
gcacgcacggagttcatcca

SEQ ID NO: 131070 - DNA, 20 bp, human
gctgcgccgcctccaccttg

SEQ ID NO: 131071 - DNA, 20 bp, human
gcccgctcgcgtctcccgca

SEQ ID NO: 131072 - DNA, 20 bp, human
gtgccatcaggtaactgcag

SEQ ID NO: 131073 - DNA, 20 bp, human
ggagaggtacgcggaatccg

SEQ ID NO: 131074 - DNA, 20 bp, human
gcacccctgcagttacctga

SEQ ID NO: 131075 - DNA, 20 bp, human
ggggcgggcgcgactggttc

SEQ ID NO: 131076 - DNA, 20 bp, human
gcgccgcgcggagctctggt

SEQ ID NO: 131077 - DNA, 20 bp, human
gtcacaagagggccagacct

SEQ ID NO: 131078 - DNA, 20 bp, human
gccatcccaagaaccgacta

SEQ ID NO: 131079 - DNA, 20 bp, human
gggacactcacagccttagt

SEQ ID NO: 131080 - DNA, 20 bp, human
ggcctgggcgatctccccgg

SEQ ID NO: 131081 - DNA, 20 bp, human
ggcaatggggtggtaatcac

SEQ ID NO: 131082 - DNA, 20 bp, human
ggctagccccaaagtccggt

SEQ ID NO: 131083 - DNA, 20 bp, human
gaatcttaaggagcacgggg

SEQ ID NO: 131084 - DNA, 20 bp, human
gtcttgggatgggaccgggc

SEQ ID NO: 131085 - DNA, 20 bp, human
gggagcacggggtggcaatg

SEQ ID NO: 131086 - DNA, 20 bp, human
gggcggcgaccggagcgcga

SEQ ID NO: 131087 - DNA, 20 bp, human
gcgggcggcggcacattcct

SEQ ID NO: 131088 - DNA, 20 bp, human
gacggcagaagtgagctgga

SEQ ID NO: 131089 - DNA, 20 bp, human
gactcacggcagaagtgagc

SEQ ID NO: 131090 - DNA, 20 bp, human
gtgagccccactcggaaagt

SEQ ID NO: 131091 - DNA, 20 bp, human
ggtcagatgtaactacgatc

SEQ ID NO: 131092 - DNA, 20 bp, human
gggccgccacctgctttcta

SEQ ID NO: 131093 - DNA, 20 bp, human
ggcggcacattcctgggaaa

SEQ ID NO: 131094 - DNA, 20 bp, human
gctttctaaggaggaactcg

SEQ ID NO: 131095 - DNA, 20 bp, human
gccactcggaaagtaggcag

SEQ ID NO: 131096 - DNA, 20 bp, human
gcaagtgtctgctcgggaca

SEQ ID NO: 131097 - DNA, 20 bp, human
gagaatcccaaagccccccg

SEQ ID NO: 131098 - DNA, 20 bp, human
gtctgaaggcggatggacca

SEQ ID NO: 131099 - DNA, 20 bp, human
gtgtggtcccctctccccgg

SEQ ID NO: 131100 - DNA, 20 bp, human
gcccaaagccccccggggag

SEQ ID NO: 131101 - DNA, 20 bp, human
gatcttccaagtgtctgctc

SEQ ID NO: 131102 - DNA, 20 bp, human
gtcactgggctagctactca

SEQ ID NO: 131103 - DNA, 20 bp, human
gctgcagatggaggtttcaa

SEQ ID NO: 131104 - DNA, 20 bp, human
gccaggccaggcaggcgcga

SEQ ID NO: 131105 - DNA, 20 bp, human
gtgccaaaaagtaccaggcc

SEQ ID NO: 131106 - DNA, 20 bp, human
ggagcgactgcaggcaaacc

SEQ ID NO: 131107 - DNA, 20 bp, human
gtccagcgtcatcctgaagg

SEQ ID NO: 131108 - DNA, 20 bp, human
gtctagcgcaggctcacctg

SEQ ID NO: 131109 - DNA, 20 bp, human
ggccgcggccagggaaacgg

SEQ ID NO: 131110 - DNA, 20 bp, human
gctttggcggcggcccagtc

SEQ ID NO: 131111 - DNA, 20 bp, human
ggaggatgagctgcccgact

SEQ ID NO: 131112 - DNA, 20 bp, human
gcgctcaccttaacccccgg

SEQ ID NO: 131113 - DNA, 20 bp, human
gcaggatgacgctggacgtg

SEQ ID NO: 131114 - DNA, 20 bp, human
gacgaccctaaggacgtcat

SEQ ID NO: 131115 - DNA, 20 bp, human
gggcggcgggcgacaaccca

SEQ ID NO: 131116 - DNA, 20 bp, human
gctgatgcgccacaaggtcc

SEQ ID NO: 131117 - DNA, 20 bp, human
gcttgcgagcgctcactgaa

SEQ ID NO: 131118 - DNA, 20 bp, human
gcgcgcggctggaaacggag

SEQ ID NO: 131119 - DNA, 20 bp, human
gtcggagctccgggaccttg

SEQ ID NO: 131120 - DNA, 20 bp, human
gcttgtggcgcatcaggacg

SEQ ID NO: 131121 - DNA, 20 bp, human
ggagaggccgagccaagcgg

SEQ ID NO: 131122 - DNA, 20 bp, human
gttgcatcctcaccgaggaa

SEQ ID NO: 131123 - DNA, 20 bp, human
gccgagccgtcccaacccag

SEQ ID NO: 131124 - DNA, 20 bp, human
gcccggcagctcggagctcc

SEQ ID NO: 131125 - DNA, 20 bp, human
gggctctgggtcccggcaga

SEQ ID NO: 131126 - DNA, 20 bp, human
gtcgcgtagcacctcgtcgg

SEQ ID NO: 131127 - DNA, 20 bp, human
gctgggagcggcaatgcggg

SEQ ID NO: 131128 - DNA, 20 bp, human
gtcgtgccgagcgcgggact

SEQ ID NO: 131129 - DNA, 20 bp, human
gatggcctggagggctccga

SEQ ID NO: 131130 - DNA, 20 bp, human
ggacatgaaatcccccgacg

SEQ ID NO: 131131 - DNA, 20 bp, human
gtggactgcgtggagcgcac

SEQ ID NO: 131132 - DNA, 20 bp, human
ggggactgggagcggcaatg

SEQ ID NO: 131133 - DNA, 20 bp, human
ggtccaccttgaggatggag

SEQ ID NO: 131134 - DNA, 20 bp, human
ggtgctacgcgagggcgagt

SEQ ID NO: 131135 - DNA, 20 bp, human
gccctcgcgtagcacctcgt

SEQ ID NO: 131136 - DNA, 20 bp, human
gcgagcggcggaacatgtaa

SEQ ID NO: 131137 - DNA, 20 bp, human
ggctctgtctgcgcgctggg

SEQ ID NO: 131138 - DNA, 20 bp, human
gcggctaccgtgctcaagga

SEQ ID NO: 131139 - DNA, 20 bp, human
gggcaccgacaccacctcac

SEQ ID NO: 131140 - DNA, 20 bp, human
gaacctcggggcgcccatga

SEQ ID NO: 131141 - DNA, 20 bp, human
gctcggggcgcccatgacgg

SEQ ID NO: 131142 - DNA, 20 bp, human
gcagcgcgcagacagagccc

SEQ ID NO: 131143 - DNA, 20 bp, human
gcccaggggagcaagagaac

SEQ ID NO: 131144 - DNA, 20 bp, human
ggagctttccgcgaacctcg

SEQ ID NO: 131145 - DNA, 20 bp, human
ggtgctgagggccgcggtgt

SEQ ID NO: 131146 - DNA, 20 bp, human
gaccgagccgagccaggcta

SEQ ID NO: 131147 - DNA, 20 bp, human
gggcgctcttacctagaggt

SEQ ID NO: 131148 - DNA, 20 bp, human
gagctcccggggaaaagcaa

SEQ ID NO: 131149 - DNA, 20 bp, human
gcggcgggagagtctggata

SEQ ID NO: 131150 - DNA, 20 bp, human
gacggggcgctcttacctag

SEQ ID NO: 131151 - DNA, 20 bp, human
gcggtggcctcaggcttagg

SEQ ID NO: 131152 - DNA, 20 bp, human
gttacctagaggtggggggg

SEQ ID NO: 131153 - DNA, 20 bp, human
gggccgggcggacactcgcg

SEQ ID NO: 131154 - DNA, 20 bp, human
ggagctcggcagaaacccgt

SEQ ID NO: 131155 - DNA, 20 bp, human
gcccttagcctggctcggct

SEQ ID NO: 131156 - DNA, 20 bp, human
gccgcccggagcctttgagg

SEQ ID NO: 131157 - DNA, 20 bp, human
gctcgctccgagcctagagc

SEQ ID NO: 131158 - DNA, 20 bp, human
gctagagccggcagctcggg

SEQ ID NO: 131159 - DNA, 20 bp, human
gctgagggaggtgggtccta

SEQ ID NO: 131160 - DNA, 20 bp, human
gagcctagagccggcagctc

SEQ ID NO: 131161 - DNA, 20 bp, human
ggcccctccccgggcattgg

SEQ ID NO: 131162 - DNA, 20 bp, human
ggccaaggagggtctctgat

SEQ ID NO: 131163 - DNA, 20 bp, human
ggggaggtgggtcctaagga

SEQ ID NO: 131164 - DNA, 20 bp, human
gtggagaagataaggtctac

SEQ ID NO: 131165 - DNA, 20 bp, human
gggagggcccgagctagcgg

SEQ ID NO: 131166 - DNA, 20 bp, human
gaagctggcgcccagtgatg

SEQ ID NO: 131167 - DNA, 20 bp, human
ggctttcacggctgctggaa

SEQ ID NO: 131168 - DNA, 20 bp, human
gccctccgcagcgcaaccgg

SEQ ID NO: 131169 - DNA, 20 bp, human
gcacggctgctggaagggca

SEQ ID NO: 131170 - DNA, 20 bp, human
ggggctcacggagggagaca

SEQ ID NO: 131171 - DNA, 20 bp, human
gtggctgtttgccccatcac

SEQ ID NO: 131172 - DNA, 20 bp, human
gcccctcgggccgcaatggt

SEQ ID NO: 131173 - DNA, 20 bp, human
gcggcggcgccagcgtagag

SEQ ID NO: 131174 - DNA, 20 bp, human
gcactcctggcacacggagt

SEQ ID NO: 131175 - DNA, 20 bp, human
ggggcaaaggctaggcgcta

SEQ ID NO: 131176 - DNA, 20 bp, human
gcccctgccacctgtctcat

SEQ ID NO: 131177 - DNA, 20 bp, human
gcttctgcctatgagacagg

SEQ ID NO: 131178 - DNA, 20 bp, human
gacgccaccggagacgggac

SEQ ID NO: 131179 - DNA, 20 bp, human
gggcgacacgccaccggaga

SEQ ID NO: 131180 - DNA, 20 bp, human
gggtcgaagaggtcagtagg

SEQ ID NO: 131181 - DNA, 20 bp, human
ggaagcctgagctcgtgagg

SEQ ID NO: 131182 - DNA, 20 bp, human
ggccgaagcctgagctcgtg

SEQ ID NO: 131183 - DNA, 20 bp, human
gggtcgggactaagactacg

SEQ ID NO: 131184 - DNA, 20 bp, human
gtagggggcgtgctacgacc

SEQ ID NO: 131185 - DNA, 20 bp, human
gtcggccccctcacgagctc

SEQ ID NO: 131186 - DNA, 20 bp, human
gtacagcgactccccgagct

SEQ ID NO: 131187 - DNA, 20 bp, human
ggttgtgcgcggccgttcca

SEQ ID NO: 131188 - DNA, 20 bp, human
ggcgattcggagcattccgt

SEQ ID NO: 131189 - DNA, 20 bp, human
gccgccggccccgggtacgg

SEQ ID NO: 131190 - DNA, 20 bp, human
gcggccgcgcacaacgccat

SEQ ID NO: 131191 - DNA, 20 bp, human
gggagagggaggcgatgagg

SEQ ID NO: 131192 - DNA, 20 bp, human
ggccgttccaggggattatg

SEQ ID NO: 131193 - DNA, 20 bp, human
gggcggagagggaggcgatg

SEQ ID NO: 131194 - DNA, 20 bp, human
ggaatcgccacataatcccc

SEQ ID NO: 131195 - DNA, 20 bp, human
gcgctgccgggcagagcggg

SEQ ID NO: 131196 - DNA, 20 bp, human
gggcggcgaagggtccgggt

SEQ ID NO: 131197 - DNA, 20 bp, human
gagcgcggcgaggcaagcag

SEQ ID NO: 131198 - DNA, 20 bp, human
gccggctccacctcccccat

SEQ ID NO: 131199 - DNA, 20 bp, human
ggcggctacccgcagcccaa

SEQ ID NO: 131200 - DNA, 20 bp, human
gacccgcagcccaaaggcgt

SEQ ID NO: 131201 - DNA, 20 bp, human
gcggactagggagggaacga

SEQ ID NO: 131202 - DNA, 20 bp, human
gcgggcgtctctgtgaatcc

SEQ ID NO: 131203 - DNA, 20 bp, human
gagacgcccggcccgcgcga

SEQ ID NO: 131204 - DNA, 20 bp, human
gggggtatagatctaaagaa

SEQ ID NO: 131205 - DNA, 20 bp, human
gacggcgtgcggagcctcgg

SEQ ID NO: 131206 - DNA, 20 bp, human
ggctgcccgggggggatgag

SEQ ID NO: 131207 - DNA, 20 bp, human
gcctgggctccgggagatag

SEQ ID NO: 131208 - DNA, 20 bp, human
ggagcccaggactcacgtgg

SEQ ID NO: 131209 - DNA, 20 bp, human
ggtgcttacgggaattggag

SEQ ID NO: 131210 - DNA, 20 bp, human
gcagcactatgttcctgggt

SEQ ID NO: 131211 - DNA, 20 bp, human
gggctcccgggcatttaaag

SEQ ID NO: 131212 - DNA, 20 bp, human
gcggcagcagaggtctgtcc

SEQ ID NO: 131213 - DNA, 20 bp, human
ggctcggggaggggtattgt

SEQ ID NO: 131214 - DNA, 20 bp, human
ggcatttaaaggggacgcgg

SEQ ID NO: 131215 - DNA, 20 bp, human
gtgtcagagtcggggacgga

SEQ ID NO: 131216 - DNA, 20 bp, human
gcggtcgggctagagaagag

SEQ ID NO: 131217 - DNA, 20 bp, human
gccacccgcgaggagatctg

SEQ ID NO: 131218 - DNA, 20 bp, human
gaccatgcctcagaaaccaa

SEQ ID NO: 131219 - DNA, 20 bp, human
gcgtagccgaggaacaaggg

SEQ ID NO: 131220 - DNA, 20 bp, human
gagccgtagccgaggaacaa

SEQ ID NO: 131221 - DNA, 20 bp, human
gccggctccaccccgagggt

SEQ ID NO: 131222 - DNA, 20 bp, human
gaggcatcggacccaatcgg

SEQ ID NO: 131223 - DNA, 20 bp, human
ggcatggtcaggactagatg

SEQ ID NO: 131224 - DNA, 20 bp, human
gggtgctgcagttggcggtc

SEQ ID NO: 131225 - DNA, 20 bp, human
gtgcgagctgggcttgtgag

SEQ ID NO: 131226 - DNA, 20 bp, human
gcggtcgggctagagaagag

SEQ ID NO: 131227 - DNA, 20 bp, human
gccacccgcgaggagatctg

SEQ ID NO: 131228 - DNA, 20 bp, human
gaccatgcctcagaaaccaa

SEQ ID NO: 131229 - DNA, 20 bp, human
gcgtagccgaggaacaaggg

SEQ ID NO: 131230 - DNA, 20 bp, human
gagccgtagccgaggaacaa

SEQ ID NO: 131231 - DNA, 20 bp, human
gccggctccaccccgagggt

SEQ ID NO: 131232 - DNA, 20 bp, human
gaggcatcggacccaatcgg

SEQ ID NO: 131233 - DNA, 20 bp, human
ggcatggtcaggactagatg

SEQ ID NO: 131234 - DNA, 20 bp, human
gggtgctgcagttggcggtc

SEQ ID NO: 131235 - DNA, 20 bp, human
gtgcgagctgggcttgtgag

SEQ ID NO: 131236 - DNA, 20 bp, human
gacggggcgggcggactctc

SEQ ID NO: 131237 - DNA, 20 bp, human
ggccaggctccgaggacccg

SEQ ID NO: 131238 - DNA, 20 bp, human
ggctgagtgcggccgcgacg

SEQ ID NO: 131239 - DNA, 20 bp, human
ggttgcacccgggctgagtg

SEQ ID NO: 131240 - DNA, 20 bp, human
gggattctgcaggaattgga

SEQ ID NO: 131241 - DNA, 20 bp, human
gcaggcgccaaagtcgccgt

SEQ ID NO: 131242 - DNA, 20 bp, human
gctgcacttgcgttgcaccc

SEQ ID NO: 131243 - DNA, 20 bp, human
gactctcgggcgctcagagc

SEQ ID NO: 131244 - DNA, 20 bp, human
gttctgcaggaattggaggg

SEQ ID NO: 131245 - DNA, 20 bp, human
gccatggaggcgtccgccta

SEQ ID NO: 131246 - DNA, 20 bp, human
gccagccatacaggactcgt

SEQ ID NO: 131247 - DNA, 20 bp, human
gggatcccggcgtgagggaa

SEQ ID NO: 131248 - DNA, 20 bp, human
gctatatacgggcggaaagg

SEQ ID NO: 131249 - DNA, 20 bp, human
gatcaaggcttcctatatac

SEQ ID NO: 131250 - DNA, 20 bp, human
gggaccttcagctttctcag

SEQ ID NO: 131251 - DNA, 20 bp, human
gttcctatatacgggcggaa

SEQ ID NO: 131252 - DNA, 20 bp, human
gctaggctctgctggtagta

SEQ ID NO: 131253 - DNA, 20 bp, human
gagctgaaggtccttacctg

SEQ ID NO: 131254 - DNA, 20 bp, human
gtgcagcctgggcaccctca

SEQ ID NO: 131255 - DNA, 20 bp, human
gctcgtaggcagaggaattg

SEQ ID NO: 131256 - DNA, 20 bp, human
gatgtggacatcgactccga

SEQ ID NO: 131257 - DNA, 20 bp, human
gcctgggtcaaacctagcag

SEQ ID NO: 131258 - DNA, 20 bp, human
gctgaggtcctgggcgggaa

SEQ ID NO: 131259 - DNA, 20 bp, human
gggacctgcgggcatgccag

SEQ ID NO: 131260 - DNA, 20 bp, human
ggcgaaggagggtggaaccg

SEQ ID NO: 131261 - DNA, 20 bp, human
gggagagacgaagccccttg

SEQ ID NO: 131262 - DNA, 20 bp, human
gcagctggggccacgggtca

SEQ ID NO: 131263 - DNA, 20 bp, human
gaggagggtggaaccgggga

SEQ ID NO: 131264 - DNA, 20 bp, human
gaggaggaacatggcggtgg

SEQ ID NO: 131265 - DNA, 20 bp, human
ggacagggatgaatgagcga

SEQ ID NO: 131266 - DNA, 20 bp, human
gcgggtcgaagagcgcacgg

SEQ ID NO: 131267 - DNA, 20 bp, human
ggtcgaagagcgcacggcgg

SEQ ID NO: 131268 - DNA, 20 bp, human
ggccacgggcctcccagtct

SEQ ID NO: 131269 - DNA, 20 bp, human
gcagtcagcgagcaggacag

SEQ ID NO: 131270 - DNA, 20 bp, human
gcgggcctaggagcgactct

SEQ ID NO: 131271 - DNA, 20 bp, human
gtcttcgacccggaagtgca

SEQ ID NO: 131272 - DNA, 20 bp, human
ggcgactctcggtcgtgcag

SEQ ID NO: 131273 - DNA, 20 bp, human
gactctcggtcgtgcagcgg

SEQ ID NO: 131274 - DNA, 20 bp, human
gacgtccgcccgcaggccac

SEQ ID NO: 131275 - DNA, 20 bp, human
gagtgcacggcgcctcttcc

SEQ ID NO: 131276 - DNA, 20 bp, human
gcgcgggcgagcgaaggagg

SEQ ID NO: 131277 - DNA, 20 bp, human
gcggctgagtcactgcatcc

SEQ ID NO: 131278 - DNA, 20 bp, human
gggcctcacggtgggacccc

SEQ ID NO: 131279 - DNA, 20 bp, human
gtgcccggtggtcggctgag

SEQ ID NO: 131280 - DNA, 20 bp, human
gccccgggcactgaggacgg

SEQ ID NO: 131281 - DNA, 20 bp, human
gctctagcccagatctcaga

SEQ ID NO: 131282 - DNA, 20 bp, human
gggaccccgggcactgagga

SEQ ID NO: 131283 - DNA, 20 bp, human
gccgcccagcgccctgaggg

SEQ ID NO: 131284 - DNA, 20 bp, human
gtcgcccccggcctcacggt

SEQ ID NO: 131285 - DNA, 20 bp, human
ggactcagccgtctgagatc

SEQ ID NO: 131286 - DNA, 20 bp, human
gagcccaaggagccacaacg

SEQ ID NO: 131287 - DNA, 20 bp, human
gccgccgccaacagagccca

SEQ ID NO: 131288 - DNA, 20 bp, human
ggggtggggcaaccctctgg

SEQ ID NO: 131289 - DNA, 20 bp, human
gtcagcacagcgccaaggga

SEQ ID NO: 131290 - DNA, 20 bp, human
gcgcgagctcgggaggaagg

SEQ ID NO: 131291 - DNA, 20 bp, human
gcccgcgggcagcctcgttg

SEQ ID NO: 131292 - DNA, 20 bp, human
gctggaggcagcgcgcccgc

SEQ ID NO: 131293 - DNA, 20 bp, human
gcccctcagcacagcgccaa

SEQ ID NO: 131294 - DNA, 20 bp, human
ggggaaggaagcaaaggaca

SEQ ID NO: 131295 - DNA, 20 bp, human
ggaaagtcgccggcgacgga

SEQ ID NO: 131296 - DNA, 20 bp, human
gccgcccgctgggctaaatg

SEQ ID NO: 131297 - DNA, 20 bp, human
gagaacaatctgcagacggg

SEQ ID NO: 131298 - DNA, 20 bp, human
ggcggcgcgaagctgctcca

SEQ ID NO: 131299 - DNA, 20 bp, human
gcccagagatgtccaatcac

SEQ ID NO: 131300 - DNA, 20 bp, human
gcccagaacaatctgcagac

SEQ ID NO: 131301 - DNA, 20 bp, human
gcgaagctgctccatggctg

SEQ ID NO: 131302 - DNA, 20 bp, human
gacaatctgcagacgggcgg

SEQ ID NO: 131303 - DNA, 20 bp, human
ggttccccgcgccgcagcca

SEQ ID NO: 131304 - DNA, 20 bp, human
ggcctgtgattggacatctc

SEQ ID NO: 131305 - DNA, 20 bp, human
gcgagccccgcgcagcccaa

SEQ ID NO: 131306 - DNA, 20 bp, human
gtaccttctggagctgcgag

SEQ ID NO: 131307 - DNA, 20 bp, human
gcaggccatggagacgctca

SEQ ID NO: 131308 - DNA, 20 bp, human
gagcccctcgcagctccaga

SEQ ID NO: 131309 - DNA, 20 bp, human
gtcacaaaaggctacctcgt

SEQ ID NO: 131310 - DNA, 20 bp, human
gtggagacgctcagggcact

SEQ ID NO: 131311 - DNA, 20 bp, human
gggtaggagcctgcaagtcg

SEQ ID NO: 131312 - DNA, 20 bp, human
gtgtgtgaagaagtcaggag

SEQ ID NO: 131313 - DNA, 20 bp, human
gagatcacaggacccagggt

SEQ ID NO: 131314 - DNA, 20 bp, human
gcttgcaggctcctaccttc

SEQ ID NO: 131315 - DNA, 20 bp, human
gcaggacccagggtagggtg

SEQ ID NO: 131316 - DNA, 20 bp, human
gaaagctcgcagggaggaca

SEQ ID NO: 131317 - DNA, 20 bp, human
gtctgcgtggatgagctccc

SEQ ID NO: 131318 - DNA, 20 bp, human
ggggaacatcgtctcaccag

SEQ ID NO: 131319 - DNA, 20 bp, human
gcagtccaggtgggcaccct

SEQ ID NO: 131320 - DNA, 20 bp, human
ggtcacggggtgactaactg

SEQ ID NO: 131321 - DNA, 20 bp, human
gctgagtagccgggatctgg

SEQ ID NO: 131322 - DNA, 20 bp, human
gtggatgagctccccggcag

SEQ ID NO: 131323 - DNA, 20 bp, human
gctgcagcagaacggtcacg

SEQ ID NO: 131324 - DNA, 20 bp, human
gggacagcagccggacgcct

SEQ ID NO: 131325 - DNA, 20 bp, human
gacagggagagacctctgcg

SEQ ID NO: 131326 - DNA, 20 bp, human
gtgagagaccgagcaggacc

SEQ ID NO: 131327 - DNA, 20 bp, human
ggacccggcgcgaggatggg

SEQ ID NO: 131328 - DNA, 20 bp, human
gctcagagccgcacactccg

SEQ ID NO: 131329 - DNA, 20 bp, human
gagcaggcgggcttcagagt

SEQ ID NO: 131330 - DNA, 20 bp, human
gccctggcgagcggcgtcgg

SEQ ID NO: 131331 - DNA, 20 bp, human
gcaggacccggcgcgaggat

SEQ ID NO: 131332 - DNA, 20 bp, human
gtgagggcatgatccaggcg

SEQ ID NO: 131333 - DNA, 20 bp, human
gcctcgcgccgggtcctgct

SEQ ID NO: 131334 - DNA, 20 bp, human
gcagaaacaaaaggaccccg

SEQ ID NO: 131335 - DNA, 20 bp, human
gctctctctgccggccgggt

SEQ ID NO: 131336 - DNA, 20 bp, human
gcggacgggatgggtagcag

SEQ ID NO: 131337 - DNA, 20 bp, human
gcgtcccggaaccagagacg

SEQ ID NO: 131338 - DNA, 20 bp, human
gttcctgcgcgggactgcca

SEQ ID NO: 131339 - DNA, 20 bp, human
gcctgagaggacctcaccca

SEQ ID NO: 131340 - DNA, 20 bp, human
gactgccaaggcacgaccac

SEQ ID NO: 131341 - DNA, 20 bp, human
gacccgccgggactgcccaa

SEQ ID NO: 131342 - DNA, 20 bp, human
gggccccgctggagcttcta

SEQ ID NO: 131343 - DNA, 20 bp, human
gcgggccctagaagctccag

SEQ ID NO: 131344 - DNA, 20 bp, human
gggaaggctgccaggcccag

SEQ ID NO: 131345 - DNA, 20 bp, human
gtacgcacgcgcctccggct

SEQ ID NO: 131346 - DNA, 20 bp, human
gcatgaggcagacccctaag

SEQ ID NO: 131347 - DNA, 20 bp, human
gctgagagcaaagctctgca

SEQ ID NO: 131348 - DNA, 20 bp, human
gtagcatgaactcttgtaag

SEQ ID NO: 131349 - DNA, 20 bp, human
ggctatacaaagttcctctt

SEQ ID NO: 131350 - DNA, 20 bp, human
gttgtatgtgttctatcact

SEQ ID NO: 131351 - DNA, 20 bp, human
gtgcaaggtttgaatgctgc

SEQ ID NO: 131352 - DNA, 20 bp, human
gtcattttggcattgtgcag

SEQ ID NO: 131353 - DNA, 20 bp, human
gtattactgcatattttcag

SEQ ID NO: 131354 - DNA, 20 bp, human
gttcagacatttggggcaaa

SEQ ID NO: 131355 - DNA, 20 bp, human
gattttgtggttcagacatt

SEQ ID NO: 131356 - DNA, 20 bp, human
ggacggctggccaccatgca

SEQ ID NO: 131357 - DNA, 20 bp, human
gtactgctggtggccaccac

SEQ ID NO: 131358 - DNA, 20 bp, human
gattatgaggctgcttatag

SEQ ID NO: 131359 - DNA, 20 bp, human
gatctgtgagggctccaacg

SEQ ID NO: 131360 - DNA, 20 bp, human
ggctccaacggggcctgtgg

SEQ ID NO: 131361 - DNA, 20 bp, human
gctgcaggagccgtgcatgg

SEQ ID NO: 131362 - DNA, 20 bp, human
gagagcctggtgacagaccc

SEQ ID NO: 131363 - DNA, 20 bp, human
gggatacctgggcccggtag

SEQ ID NO: 131364 - DNA, 20 bp, human
gttgctggctgggatggaag

SEQ ID NO: 131365 - DNA, 20 bp, human
gcactgaccagaaaaaggag

SEQ ID NO: 131366 - DNA, 20 bp, human
gcacagagatgaccacacca

SEQ ID NO: 131367 - DNA, 20 bp, human
ggtgcctggttccacccggg

SEQ ID NO: 131368 - DNA, 20 bp, human
gatgccccccgggtggaacc

SEQ ID NO: 131369 - DNA, 20 bp, human
gttctcagatgccccccggg

SEQ ID NO: 131370 - DNA, 20 bp, human
gaaccaggcactggcactac

SEQ ID NO: 131371 - DNA, 20 bp, human
gactacaggttgccctggtg

SEQ ID NO: 131372 - DNA, 20 bp, human
gctggcactacaggttgccc

SEQ ID NO: 131373 - DNA, 20 bp, human
ggccagtgcctggttccacc

SEQ ID NO: 131374 - DNA, 20 bp, human
gaacctgtagtgccagtgcc

SEQ ID NO: 131375 - DNA, 20 bp, human
gacagttctcagatgccccc

SEQ ID NO: 131376 - DNA, 20 bp, human
ggctgggacgctggttctag

SEQ ID NO: 131377 - DNA, 20 bp, human
ggccagcagcttcttgatcg

SEQ ID NO: 131378 - DNA, 20 bp, human
gtagaggcagctgtcacggg

SEQ ID NO: 131379 - DNA, 20 bp, human
gggagcacttctgaagcagt

SEQ ID NO: 131380 - DNA, 20 bp, human
gaaccagcgtcccagcgatg

SEQ ID NO: 131381 - DNA, 20 bp, human
gtaatcagtactctaaaagg

SEQ ID NO: 131382 - DNA, 20 bp, human
gttatggggcagagaaacgg

SEQ ID NO: 131383 - DNA, 20 bp, human
gttctagaggcagctgtcac

SEQ ID NO: 131384 - DNA, 20 bp, human
gtcacgggaggtgagtgaac

SEQ ID NO: 131385 - DNA, 20 bp, human
gctgaagcagtaggcagcac

SEQ ID NO: 131386 - DNA, 20 bp, human
gagcccagccaggtttccac

SEQ ID NO: 131387 - DNA, 20 bp, human
gaggagggcccagatcccac

SEQ ID NO: 131388 - DNA, 20 bp, human
gtgggtgttcccagggtcag

SEQ ID NO: 131389 - DNA, 20 bp, human
gcagagctgggaattgtggg

SEQ ID NO: 131390 - DNA, 20 bp, human
gccccagtggccacaagtca

SEQ ID NO: 131391 - DNA, 20 bp, human
gccacgggcagttctgaggt

SEQ ID NO: 131392 - DNA, 20 bp, human
gggagcttgtccaggaatgt

SEQ ID NO: 131393 - DNA, 20 bp, human
gatcccactggagataccga

SEQ ID NO: 131394 - DNA, 20 bp, human
ggatgctgggtccccaagtc

SEQ ID NO: 131395 - DNA, 20 bp, human
gcagtggccacaagtcaggg

SEQ ID NO: 131396 - DNA, 20 bp, human
gacgccacctcaccagcgca

SEQ ID NO: 131397 - DNA, 20 bp, human
gtccgcggacgccaaccggt

SEQ ID NO: 131398 - DNA, 20 bp, human
gtgcccgtgcgctggtgagg

SEQ ID NO: 131399 - DNA, 20 bp, human
gaggtggcgtccgttctacc

SEQ ID NO: 131400 - DNA, 20 bp, human
ggcgcggaacgggagcgacc

SEQ ID NO: 131401 - DNA, 20 bp, human
gcagccaggtgccagagact

SEQ ID NO: 131402 - DNA, 20 bp, human
gcgggagcgaccgggtagaa

SEQ ID NO: 131403 - DNA, 20 bp, human
ggcgtgcccgtgcgctggtg

SEQ ID NO: 131404 - DNA, 20 bp, human
gggctctgcatggcgcggaa

SEQ ID NO: 131405 - DNA, 20 bp, human
gcaggggcagccgcccggag

SEQ ID NO: 131406 - DNA, 20 bp, human
ggaagagagagggaccgtgg

SEQ ID NO: 131407 - DNA, 20 bp, human
gacgcctgcgccctgaggtc

SEQ ID NO: 131408 - DNA, 20 bp, human
ggcggctcgtgaggtgatgg

SEQ ID NO: 131409 - DNA, 20 bp, human
gcctgagcggagggatctag

SEQ ID NO: 131410 - DNA, 20 bp, human
ggggggaaggaggccctagt

SEQ ID NO: 131411 - DNA, 20 bp, human
gccgcgagcgcccgacctca

SEQ ID NO: 131412 - DNA, 20 bp, human
ggccgcggctcgtgaggtga

SEQ ID NO: 131413 - DNA, 20 bp, human
ggagcggagggatctagcgg

SEQ ID NO: 131414 - DNA, 20 bp, human
gtccttggagaaggtaacgt

SEQ ID NO: 131415 - DNA, 20 bp, human
gtcactggcccgctccctgg

SEQ ID NO: 131416 - DNA, 20 bp, human
gaggagtagcttacctctgg

SEQ ID NO: 131417 - DNA, 20 bp, human
gtccctgacagcggccgcgg

SEQ ID NO: 131418 - DNA, 20 bp, human
gagactgtgcgggacagggt

SEQ ID NO: 131419 - DNA, 20 bp, human
gggtgcagctgacaccaaga

SEQ ID NO: 131420 - DNA, 20 bp, human
gtcgtagtcgaactcaggtg

SEQ ID NO: 131421 - DNA, 20 bp, human
ggaccgctcccgggttccat

SEQ ID NO: 131422 - DNA, 20 bp, human
gccccaggcctgagaggaaa

SEQ ID NO: 131423 - DNA, 20 bp, human
gcaggcggccaatggaaccc

SEQ ID NO: 131424 - DNA, 20 bp, human
gagggaggagctaatagaag

SEQ ID NO: 131425 - DNA, 20 bp, human
ggccgctgtcagggaagcgc

SEQ ID NO: 131426 - DNA, 20 bp, human
gccgagccgaggcgggatgg

SEQ ID NO: 131427 - DNA, 20 bp, human
gggagatgctcgcctcggct

SEQ ID NO: 131428 - DNA, 20 bp, human
gaggcagggagtgccgagag

SEQ ID NO: 131429 - DNA, 20 bp, human
gcggtgggagatgctcgcct

SEQ ID NO: 131430 - DNA, 20 bp, human
gggtcggcgaagggaccccg

SEQ ID NO: 131431 - DNA, 20 bp, human
gccgccgagccgaggcggga

SEQ ID NO: 131432 - DNA, 20 bp, human
gcccgaagcaggagactgcg

SEQ ID NO: 131433 - DNA, 20 bp, human
gacggctgcgccagggaggg

SEQ ID NO: 131434 - DNA, 20 bp, human
gggagtgccgagagcggact

SEQ ID NO: 131435 - DNA, 20 bp, human
ggagcgagccaggaccgcgg

SEQ ID NO: 131436 - DNA, 20 bp, human
ggcggacagtgcggaactaa

SEQ ID NO: 131437 - DNA, 20 bp, human
ggctgacagacgcaagatgg

SEQ ID NO: 131438 - DNA, 20 bp, human
ggccgaagccaagttcccgg

SEQ ID NO: 131439 - DNA, 20 bp, human
ggctactgggatccacggag

SEQ ID NO: 131440 - DNA, 20 bp, human
ggagcccgggactgcaaagg

SEQ ID NO: 131441 - DNA, 20 bp, human
gatagggagtccggaggtag

SEQ ID NO: 131442 - DNA, 20 bp, human
gcgcaagatggcggacagtg

SEQ ID NO: 131443 - DNA, 20 bp, human
gggcagggaggctaactgga

SEQ ID NO: 131444 - DNA, 20 bp, human
gggggctgcagctgtctcat

SEQ ID NO: 131445 - DNA, 20 bp, human
gggcagggtgctctcgtagg

SEQ ID NO: 131446 - DNA, 20 bp, human
gcgccaggtgtgcggaccac

SEQ ID NO: 131447 - DNA, 20 bp, human
ggcggccgcggcgtcttaag

SEQ ID NO: 131448 - DNA, 20 bp, human
gctccgccaaccggccccag

SEQ ID NO: 131449 - DNA, 20 bp, human
gtcgcagtgagggccgatgt

SEQ ID NO: 131450 - DNA, 20 bp, human
gacgggcccggctgtagcgg

SEQ ID NO: 131451 - DNA, 20 bp, human
gagcggcgcccagtgcagga

SEQ ID NO: 131452 - DNA, 20 bp, human
ggccgggcccgtcacgtgaa

SEQ ID NO: 131453 - DNA, 20 bp, human
ggtgacgggcccggctgtag

SEQ ID NO: 131454 - DNA, 20 bp, human
gggctcctgagtgctgccag

SEQ ID NO: 131455 - DNA, 20 bp, human
gggccgccgccgctacagcc

SEQ ID NO: 131456 - DNA, 20 bp, human
gtagcagctcctggatgggt

SEQ ID NO: 131457 - DNA, 20 bp, human
gcaggagctgctacacattg

SEQ ID NO: 131458 - DNA, 20 bp, human
ggctgctacacattgaggaa

SEQ ID NO: 131459 - DNA, 20 bp, human
ggctcctggatgggttgggt

SEQ ID NO: 131460 - DNA, 20 bp, human
gtaaacccactagactataa

SEQ ID NO: 131461 - DNA, 20 bp, human
gtcagccattatagtctagt

SEQ ID NO: 131462 - DNA, 20 bp, human
gatgggtgtaagctcctctg

SEQ ID NO: 131463 - DNA, 20 bp, human
gacaaggccaactatttgtt

SEQ ID NO: 131464 - DNA, 20 bp, human
gaggtgtaaatcaaggtcta

SEQ ID NO: 131465 - DNA, 20 bp, human
ggaaggggcagaatgaatgc

SEQ ID NO: 131466 - DNA, 20 bp, human
gctcagagggcgagctggag

SEQ ID NO: 131467 - DNA, 20 bp, human
ggaccgcggggcagacgtag

SEQ ID NO: 131468 - DNA, 20 bp, human
gcgatcgtaggactcaaact

SEQ ID NO: 131469 - DNA, 20 bp, human
gtagccccggagggagtgta

SEQ ID NO: 131470 - DNA, 20 bp, human
gcaagagatgcaacagtagg

SEQ ID NO: 131471 - DNA, 20 bp, human
gcaagatcgcggggtcccta

SEQ ID NO: 131472 - DNA, 20 bp, human
gtcggtccagcagccggacg

SEQ ID NO: 131473 - DNA, 20 bp, human
gcgaagtgcctggtggaggg

SEQ ID NO: 131474 - DNA, 20 bp, human
gggtccctagggcaacgggg

SEQ ID NO: 131475 - DNA, 20 bp, human
gggtgctgtagaggcactgg

SEQ ID NO: 131476 - DNA, 20 bp, human
gtcaccagcgtcccccgcgc

SEQ ID NO: 131477 - DNA, 20 bp, human
gcgccaccgctcactcactt

SEQ ID NO: 131478 - DNA, 20 bp, human
gccccggctcggaaccaaga

SEQ ID NO: 131479 - DNA, 20 bp, human
ggggacgctggtgaccaaga

SEQ ID NO: 131480 - DNA, 20 bp, human
gcggcgcgaagacctgggtg

SEQ ID NO: 131481 - DNA, 20 bp, human
gggccaaagtgagtgagcgg

SEQ ID NO: 131482 - DNA, 20 bp, human
ggcagtcctgggagccctgt

SEQ ID NO: 131483 - DNA, 20 bp, human
gggacggtgcctcaaccggg

SEQ ID NO: 131484 - DNA, 20 bp, human
gtcagggaccgggaccctaa

SEQ ID NO: 131485 - DNA, 20 bp, human
ggcgggacggtgcctcaacc

SEQ ID NO: 131486 - DNA, 20 bp, human
gcgggagagttgacttccgg

SEQ ID NO: 131487 - DNA, 20 bp, human
gcatctccgcacccgcaagg

SEQ ID NO: 131488 - DNA, 20 bp, human
gtccgctcctcggaacatcc

SEQ ID NO: 131489 - DNA, 20 bp, human
gggttgcaggccctcaacaa

SEQ ID NO: 131490 - DNA, 20 bp, human
gtcttggttacgggtcctaa

SEQ ID NO: 131491 - DNA, 20 bp, human
gttcaaggcaggggaccgtt

SEQ ID NO: 131492 - DNA, 20 bp, human
gatccgggagagttgacttc

SEQ ID NO: 131493 - DNA, 20 bp, human
gtaaactgaatgataaggaa

SEQ ID NO: 131494 - DNA, 20 bp, human
gccctcaacaagggatttca

SEQ ID NO: 131495 - DNA, 20 bp, human
ggctggttctgtcctccttg

SEQ ID NO: 131496 - DNA, 20 bp, human
gtcggcttcactcacagtcc

SEQ ID NO: 131497 - DNA, 20 bp, human
gctcgtgtcacccgcggagt

SEQ ID NO: 131498 - DNA, 20 bp, human
gcgggcagggtaagaggaac

SEQ ID NO: 131499 - DNA, 20 bp, human
ggctccagctgacccgggaa

SEQ ID NO: 131500 - DNA, 20 bp, human
gcggagtcggacaagatgtc

SEQ ID NO: 131501 - DNA, 20 bp, human
ggtgggctgaactgaggcgg

SEQ ID NO: 131502 - DNA, 20 bp, human
gttgggccccatgatctcgt

SEQ ID NO: 131503 - DNA, 20 bp, human
gagcccggaaagctccgagg

SEQ ID NO: 131504 - DNA, 20 bp, human
gccacgacccacgagatcat

SEQ ID NO: 131505 - DNA, 20 bp, human
gccgcccagcacagtgtcac

SEQ ID NO: 131506 - DNA, 20 bp, human
gtaactgcccagctcggtag

SEQ ID NO: 131507 - DNA, 20 bp, human
ggccaggtggaacggcaggt

SEQ ID NO: 131508 - DNA, 20 bp, human
gcaccgccaggtggaacggc

SEQ ID NO: 131509 - DNA, 20 bp, human
gcgcttccggtgagcgacag

SEQ ID NO: 131510 - DNA, 20 bp, human
gcagggcctggagacccgtg

SEQ ID NO: 131511 - DNA, 20 bp, human
gccagctcggtaggggaatg

SEQ ID NO: 131512 - DNA, 20 bp, human
gctatactgctggaacttgg

SEQ ID NO: 131513 - DNA, 20 bp, human
gccgggagagaaaggagcat

SEQ ID NO: 131514 - DNA, 20 bp, human
gggaagtgacgtgacaatcg

SEQ ID NO: 131515 - DNA, 20 bp, human
ggatgggacagtctccgggt

SEQ ID NO: 131516 - DNA, 20 bp, human
gagcgccaggaacccggcag

SEQ ID NO: 131517 - DNA, 20 bp, human
gtgggcaaatcccctaaagt

SEQ ID NO: 131518 - DNA, 20 bp, human
ggccgccgggtgggcgtagg

SEQ ID NO: 131519 - DNA, 20 bp, human
gggccgtgcccacaagttgc

SEQ ID NO: 131520 - DNA, 20 bp, human
gcagagcgcgcaggtccggg

SEQ ID NO: 131521 - DNA, 20 bp, human
gggaacccggcaggggtatg

SEQ ID NO: 131522 - DNA, 20 bp, human
gtctcctctgccaaaaccca

SEQ ID NO: 131523 - DNA, 20 bp, human
ggtgttggttggtacatata

SEQ ID NO: 131524 - DNA, 20 bp, human
ggactgtcgatcgcgccggg

SEQ ID NO: 131525 - DNA, 20 bp, human
ggtccgcgggatgtgcgtcc

SEQ ID NO: 131526 - DNA, 20 bp, human
ggggaaccaccaaggagtca

SEQ ID NO: 131527 - DNA, 20 bp, human
ggccgcgggcctacccggaa

SEQ ID NO: 131528 - DNA, 20 bp, human
ggacgagcgcgggccttgga

SEQ ID NO: 131529 - DNA, 20 bp, human
gagggcaggacaatgacgtg

SEQ ID NO: 131530 - DNA, 20 bp, human
gcggctggacgtgggaccac

SEQ ID NO: 131531 - DNA, 20 bp, human
gcggaacggcgcgtgggccc

SEQ ID NO: 131532 - DNA, 20 bp, human
gacgcaggaggtgaataggg

SEQ ID NO: 131533 - DNA, 20 bp, human
gcctacccggaacggcgcgt

SEQ ID NO: 131534 - DNA, 20 bp, human
gtgtcagggcatcctgtcag

SEQ ID NO: 131535 - DNA, 20 bp, human
gggaggcgatccgaaggaca

SEQ ID NO: 131536 - DNA, 20 bp, human
gatcccccgggcgtcgggga

SEQ ID NO: 131537 - DNA, 20 bp, human
gctcgggatcccccgggcgt

SEQ ID NO: 131538 - DNA, 20 bp, human
ggcaggcggcgcgcaaaggg

SEQ ID NO: 131539 - DNA, 20 bp, human
gaacgcgccggcgggatccc

SEQ ID NO: 131540 - DNA, 20 bp, human
gtggagctgcgaggtcatag

SEQ ID NO: 131541 - DNA, 20 bp, human
gcgcgtacctgcgctgcagg

SEQ ID NO: 131542 - DNA, 20 bp, human
gtcggcgcctgggatcccgc

SEQ ID NO: 131543 - DNA, 20 bp, human
ggctgcaggcggcgcgcaaa

SEQ ID NO: 131544 - DNA, 20 bp, human
gccgcggtaggggagggtca

SEQ ID NO: 131545 - DNA, 20 bp, human
gcgccggcgcgtttctgggt

SEQ ID NO: 131546 - DNA, 20 bp, human
gagcgctgcgctccgccgag

SEQ ID NO: 131547 - DNA, 20 bp, human
ggcgggcgcggaaattccca

SEQ ID NO: 131548 - DNA, 20 bp, human
ggagcgcgggcccgggacgt

SEQ ID NO: 131549 - DNA, 20 bp, human
ggggcccggcccagaccgag

SEQ ID NO: 131550 - DNA, 20 bp, human
gtcccagggacgcgcgaccc

SEQ ID NO: 131551 - DNA, 20 bp, human
ggcatgagcgcgccaggcgg

SEQ ID NO: 131552 - DNA, 20 bp, human
gagcgcagcgctcggctcac

SEQ ID NO: 131553 - DNA, 20 bp, human
ggccgagctgggccggacgg

SEQ ID NO: 131554 - DNA, 20 bp, human
gctccccacggcctggacac

SEQ ID NO: 131555 - DNA, 20 bp, human
ggctgcgtctcggctcccca

SEQ ID NO: 131556 - DNA, 20 bp, human
ggaggctcgagggtccctag

SEQ ID NO: 131557 - DNA, 20 bp, human
ggcggcgagaggccatagac

SEQ ID NO: 131558 - DNA, 20 bp, human
ggctcgagggtccctagggg

SEQ ID NO: 131559 - DNA, 20 bp, human
gttgcgtcccaccaccccta

SEQ ID NO: 131560 - DNA, 20 bp, human
ggtccggcgagtcggagcag

SEQ ID NO: 131561 - DNA, 20 bp, human
ggcggatgcgtccccatcgt

SEQ ID NO: 131562 - DNA, 20 bp, human
ggcagaggggcgaggctcga

SEQ ID NO: 131563 - DNA, 20 bp, human
gtcgcgtcggtccggcgagt

SEQ ID NO: 131564 - DNA, 20 bp, human
gtgaggccatcgcgtcggtc

SEQ ID NO: 131565 - DNA, 20 bp, human
gcaaggcccatgcccgtcta

SEQ ID NO: 131566 - DNA, 20 bp, human
gagtgtctgcccgaacccag

SEQ ID NO: 131567 - DNA, 20 bp, human
ggccagtgaatgtacctaca

SEQ ID NO: 131568 - DNA, 20 bp, human
ggcagaagtcgcttattaca

SEQ ID NO: 131569 - DNA, 20 bp, human
ggtctgcccgaacccagagg

SEQ ID NO: 131570 - DNA, 20 bp, human
gagcaggagaatcgcccgtg

SEQ ID NO: 131571 - DNA, 20 bp, human
gtcctggggagagtactctg

SEQ ID NO: 131572 - DNA, 20 bp, human
gctctttgctccccacctct

SEQ ID NO: 131573 - DNA, 20 bp, human
ggcagatcgtagccggcctg

SEQ ID NO: 131574 - DNA, 20 bp, human
ggtgctcgccctgggtctcg

SEQ ID NO: 131575 - DNA, 20 bp, human
gttggtggtgggaagcgcga

SEQ ID NO: 131576 - DNA, 20 bp, human
gggccgagcctagcacagtg

SEQ ID NO: 131577 - DNA, 20 bp, human
gcagtgaggacgggaaagaa

SEQ ID NO: 131578 - DNA, 20 bp, human
ggcgcaatgtgcgcaggaag

SEQ ID NO: 131579 - DNA, 20 bp, human
gcggggccgcagccagcttg

SEQ ID NO: 131580 - DNA, 20 bp, human
gttgcgcctcaagctggctg

SEQ ID NO: 131581 - DNA, 20 bp, human
gcgcacattgcgcctcaagc

SEQ ID NO: 131582 - DNA, 20 bp, human
ggaagcggcgcaggcggtct

SEQ ID NO: 131583 - DNA, 20 bp, human
ggctcgggcggaggccggcc

SEQ ID NO: 131584 - DNA, 20 bp, human
ggtagtgtccggaacccggg

SEQ ID NO: 131585 - DNA, 20 bp, human
gaagcggcctgtggagcccc

SEQ ID NO: 131586 - DNA, 20 bp, human
ggaactgaggagcatctaag

SEQ ID NO: 131587 - DNA, 20 bp, human
gagcacatcgcgagctgcta

SEQ ID NO: 131588 - DNA, 20 bp, human
ggccgagaagcctagagtag

SEQ ID NO: 131589 - DNA, 20 bp, human
ggaagcctagagtagagggc

SEQ ID NO: 131590 - DNA, 20 bp, human
gtagagtagagggcaggtag

SEQ ID NO: 131591 - DNA, 20 bp, human
gctccgcagctgggaatcac

SEQ ID NO: 131592 - DNA, 20 bp, human
gtctgggccaccagcaagta

SEQ ID NO: 131593 - DNA, 20 bp, human
gctgaggagcatctaagggg

SEQ ID NO: 131594 - DNA, 20 bp, human
ggtccaccgagccactactg

SEQ ID NO: 131595 - DNA, 20 bp, human
gctcaatagccggggaactg

SEQ ID NO: 131596 - DNA, 20 bp, human
gtggcggccatggaactcac

SEQ ID NO: 131597 - DNA, 20 bp, human
gcggcgcgacgcgcactcac

SEQ ID NO: 131598 - DNA, 20 bp, human
gaaacgctcgggccaaggag

SEQ ID NO: 131599 - DNA, 20 bp, human
ggcgacctctcagggaatca

SEQ ID NO: 131600 - DNA, 20 bp, human
gccgcgggaggtccggacac

SEQ ID NO: 131601 - DNA, 20 bp, human
gcgggaggtccggacactgg

SEQ ID NO: 131602 - DNA, 20 bp, human
gcactcaccggtgagttcca

SEQ ID NO: 131603 - DNA, 20 bp, human
ggacagtgcccaggaattgt

SEQ ID NO: 131604 - DNA, 20 bp, human
gattccctgagaggtcgctg

SEQ ID NO: 131605 - DNA, 20 bp, human
ggaagaaccttagggagacc

SEQ ID NO: 131606 - DNA, 20 bp, human
gcctggccgccaccttccta

SEQ ID NO: 131607 - DNA, 20 bp, human
gggaggcccctaagcaagtg

SEQ ID NO: 131608 - DNA, 20 bp, human
ggtggcggccagggatgagg

SEQ ID NO: 131609 - DNA, 20 bp, human
gtgagtgaggggacactgtc

SEQ ID NO: 131610 - DNA, 20 bp, human
gctggagaccatgcaaagtg

SEQ ID NO: 131611 - DNA, 20 bp, human
gttccgccttaggaaggtgg

SEQ ID NO: 131612 - DNA, 20 bp, human
gggctggtaatgaaatggag

SEQ ID NO: 131613 - DNA, 20 bp, human
gacagtcggaggtacctgag

SEQ ID NO: 131614 - DNA, 20 bp, human
gagtgcggaatggagccggg

SEQ ID NO: 131615 - DNA, 20 bp, human
gcaactggctggtaatgaaa

SEQ ID NO: 131616 - DNA, 20 bp, human
ggcgccccgaagcgggaaaa

SEQ ID NO: 131617 - DNA, 20 bp, human
gacctacccgagagttccta

SEQ ID NO: 131618 - DNA, 20 bp, human
gcccgaagcgggaaaaaggc

SEQ ID NO: 131619 - DNA, 20 bp, human
gcctagggttgcgcagctgg

SEQ ID NO: 131620 - DNA, 20 bp, human
gcgcaaccctaggaactctc

SEQ ID NO: 131621 - DNA, 20 bp, human
gaccctaggaactctcgggt

SEQ ID NO: 131622 - DNA, 20 bp, human
gttggccacagtcgcagccc

SEQ ID NO: 131623 - DNA, 20 bp, human
gttcccgcttcggggcgccg

SEQ ID NO: 131624 - DNA, 20 bp, human
gggcgccggggctgcgactg

SEQ ID NO: 131625 - DNA, 20 bp, human
ggcagaccctccaaccccgg

SEQ ID NO: 131626 - DNA, 20 bp, human
ggcccgtcgtacctgatggt

SEQ ID NO: 131627 - DNA, 20 bp, human
ggggtagcttgcacctcgtg

SEQ ID NO: 131628 - DNA, 20 bp, human
gcgtcgtacctgatggtagg

SEQ ID NO: 131629 - DNA, 20 bp, human
gttccgcgggagggagagtt

SEQ ID NO: 131630 - DNA, 20 bp, human
gggccgcccgtcgtacctga

SEQ ID NO: 131631 - DNA, 20 bp, human
gctcccgcggaagggaagcg

SEQ ID NO: 131632 - DNA, 20 bp, human
gtcttccgagcggcacccag

SEQ ID NO: 131633 - DNA, 20 bp, human
gggcatcgccgcaccttcac

SEQ ID NO: 131634 - DNA, 20 bp, human
gacgcaccgcagcggagaga

SEQ ID NO: 131635 - DNA, 20 bp, human
gtacctaactctccctcccg

SEQ ID NO: 131636 - DNA, 20 bp, human
ggcagggcgaggctccaggt

SEQ ID NO: 131637 - DNA, 20 bp, human
gggacacgctaggctggatg

SEQ ID NO: 131638 - DNA, 20 bp, human
ggcctagcgtgtccacgatg

SEQ ID NO: 131639 - DNA, 20 bp, human
ggtcgaagtggggccagtag

SEQ ID NO: 131640 - DNA, 20 bp, human
gtctgaggtggggaccataa

SEQ ID NO: 131641 - DNA, 20 bp, human
gcggaagcgcggctgcagca

SEQ ID NO: 131642 - DNA, 20 bp, human
ggccagagcggaacacggag

SEQ ID NO: 131643 - DNA, 20 bp, human
gatgcggaaccgaccccacc

SEQ ID NO: 131644 - DNA, 20 bp, human
gctacctggagccggaagcg

SEQ ID NO: 131645 - DNA, 20 bp, human
gtggcgttattgcttagagg

SEQ ID NO: 131646 - DNA, 20 bp, human
gctacagtgataggacagga

SEQ ID NO: 131647 - DNA, 20 bp, human
gggagcgggcgagacggcca

SEQ ID NO: 131648 - DNA, 20 bp, human
gacaggagggcgggaactca

SEQ ID NO: 131649 - DNA, 20 bp, human
gtgtaggaggggccgaccag

SEQ ID NO: 131650 - DNA, 20 bp, human
gtccccgcgctcgaaggagg

SEQ ID NO: 131651 - DNA, 20 bp, human
gcggctgccggaagcgggtc

SEQ ID NO: 131652 - DNA, 20 bp, human
gccgagtgggggcgtcatgg

SEQ ID NO: 131653 - DNA, 20 bp, human
gccggaagcgggtctggagc

SEQ ID NO: 131654 - DNA, 20 bp, human
gcctcctacagtgataggac

SEQ ID NO: 131655 - DNA, 20 bp, human
ggggtctggagcgggcgaga

SEQ ID NO: 131656 - DNA, 20 bp, human
ggacagtcgcagcccggctg

SEQ ID NO: 131657 - DNA, 20 bp, human
gagggctgcagttgagtagt

SEQ ID NO: 131658 - DNA, 20 bp, human
ggtttgaggagggtatcact

SEQ ID NO: 131659 - DNA, 20 bp, human
gcggtgacggccatgtttac

SEQ ID NO: 131660 - DNA, 20 bp, human
gagtctgaagccggtaaaca

SEQ ID NO: 131661 - DNA, 20 bp, human
gcgtcaccgacagcctcagc

SEQ ID NO: 131662 - DNA, 20 bp, human
gtaggtgaaatacgagcaag

SEQ ID NO: 131663 - DNA, 20 bp, human
gtgccaagacagtcgcagcc

SEQ ID NO: 131664 - DNA, 20 bp, human
ggtcaatcagcccctgaccc

SEQ ID NO: 131665 - DNA, 20 bp, human
ggcacgggttaggacactgt

SEQ ID NO: 131666 - DNA, 20 bp, human
gaggtaggaggccataggag

SEQ ID NO: 131667 - DNA, 20 bp, human
ggaccgccaacgccacacac

SEQ ID NO: 131668 - DNA, 20 bp, human
gtaggctgtgaggggttcag

SEQ ID NO: 131669 - DNA, 20 bp, human
ggcaatgtggctcctgtgtg

SEQ ID NO: 131670 - DNA, 20 bp, human
ggggccaagcctagcactgt

SEQ ID NO: 131671 - DNA, 20 bp, human
gcccctcacagcctagggac

SEQ ID NO: 131672 - DNA, 20 bp, human
gctggtgggttgggggacgt

SEQ ID NO: 131673 - DNA, 20 bp, human
ggcgttggcggtcttggcat

SEQ ID NO: 131674 - DNA, 20 bp, human
gctcctgtgtgtggcgttgg

SEQ ID NO: 131675 - DNA, 20 bp, human
gtactacgccagcaggattg

SEQ ID NO: 131676 - DNA, 20 bp, human
gagaccgtccatccagagga

SEQ ID NO: 131677 - DNA, 20 bp, human
ggagacaggtagcagtacgg

SEQ ID NO: 131678 - DNA, 20 bp, human
gtgtcgcacggtcagatcat

SEQ ID NO: 131679 - DNA, 20 bp, human
gagcgagaccgtccatccag

SEQ ID NO: 131680 - DNA, 20 bp, human
ggacgccgcgcgcttcgtca

SEQ ID NO: 131681 - DNA, 20 bp, human
gcgcgcgcttcgtcacggag

SEQ ID NO: 131682 - DNA, 20 bp, human
ggactgcagactatcacatc

SEQ ID NO: 131683 - DNA, 20 bp, human
ggctcgctgaggtagatgtt

SEQ ID NO: 131684 - DNA, 20 bp, human
gtgggctccaccaagcactg

SEQ ID NO: 131685 - DNA, 20 bp, human
gcctgctgcaaagaaccgaa

SEQ ID NO: 131686 - DNA, 20 bp, human
gggggcgttccggaattgag

SEQ ID NO: 131687 - DNA, 20 bp, human
gacaggcaggaccacctccg

SEQ ID NO: 131688 - DNA, 20 bp, human
gactgaagcgatagccggga

SEQ ID NO: 131689 - DNA, 20 bp, human
ggcggccgggcaggtattgg

SEQ ID NO: 131690 - DNA, 20 bp, human
gtggcttaggaataccctcc

SEQ ID NO: 131691 - DNA, 20 bp, human
gaccagtgcgcggagggtgt

SEQ ID NO: 131692 - DNA, 20 bp, human
ggcagcggccgggcaggtat

SEQ ID NO: 131693 - DNA, 20 bp, human
gtcccgagtgtgcaagcatg

SEQ ID NO: 131694 - DNA, 20 bp, human
gaagtgcccaggcctgtagt

SEQ ID NO: 131695 - DNA, 20 bp, human
gctgggcacttgctatccat

SEQ ID NO: 131696 - DNA, 20 bp, human
ggctgggtagttaccggagg

SEQ ID NO: 131697 - DNA, 20 bp, human
gtgggacccaggcgtgcgac

SEQ ID NO: 131698 - DNA, 20 bp, human
ggaccctggctcacctgcaa

SEQ ID NO: 131699 - DNA, 20 bp, human
ggcaatggcacccggaagtg

SEQ ID NO: 131700 - DNA, 20 bp, human
gaggttcgccaggagacctg

SEQ ID NO: 131701 - DNA, 20 bp, human
ggggtgaggggaataccggg

SEQ ID NO: 131702 - DNA, 20 bp, human
gctgggcccggattcccctg

SEQ ID NO: 131703 - DNA, 20 bp, human
gcgccaatctcaatacccag

SEQ ID NO: 131704 - DNA, 20 bp, human
gcgaagccgcaggggaatcc

SEQ ID NO: 131705 - DNA, 20 bp, human
gaccggggggtgaggttctc

SEQ ID NO: 131706 - DNA, 20 bp, human
ggcgcgccccgcaacagaag

SEQ ID NO: 131707 - DNA, 20 bp, human
gcgccccgcaacagaagggg

SEQ ID NO: 131708 - DNA, 20 bp, human
ggcgccagcgatgtgctccg

SEQ ID NO: 131709 - DNA, 20 bp, human
ggaaggggtggcggaggata

SEQ ID NO: 131710 - DNA, 20 bp, human
gcgagcgcatacagacaccc

SEQ ID NO: 131711 - DNA, 20 bp, human
gagtaggcccgcatgctggt

SEQ ID NO: 131712 - DNA, 20 bp, human
gctgtatgcgctcgaggcgg

SEQ ID NO: 131713 - DNA, 20 bp, human
ggtgccacggagcacatcgc

SEQ ID NO: 131714 - DNA, 20 bp, human
gtggggaagaggaaaacctg

SEQ ID NO: 131715 - DNA, 20 bp, human
gtgtgcgcctgcgccagggt

SEQ ID NO: 131716 - DNA, 20 bp, human
gggaaggccctgcttgagga

SEQ ID NO: 131717 - DNA, 20 bp, human
gggctcttcccaaatgagag

SEQ ID NO: 131718 - DNA, 20 bp, human
ggggcaaaaaacggaatcgt

SEQ ID NO: 131719 - DNA, 20 bp, human
gccttgcacagggtccacag

SEQ ID NO: 131720 - DNA, 20 bp, human
gaagtggggctcgggtcccg

SEQ ID NO: 131721 - DNA, 20 bp, human
gggttggggaccccgatggg

SEQ ID NO: 131722 - DNA, 20 bp, human
ggggcggcggggtccggatg

SEQ ID NO: 131723 - DNA, 20 bp, human
ggaccccgatgggcgggccc

SEQ ID NO: 131724 - DNA, 20 bp, human
ggggcggccccacttctggg

SEQ ID NO: 131725 - DNA, 20 bp, human
gtgcccgggcccgcccatcg

SEQ ID NO: 131726 - DNA, 20 bp, human
gctgccagtagctcctagag

SEQ ID NO: 131727 - DNA, 20 bp, human
gctgcctctctaggagctac

SEQ ID NO: 131728 - DNA, 20 bp, human
gatgaggagttaggaaatcc

SEQ ID NO: 131729 - DNA, 20 bp, human
ggtccctgaagtcagatcaa

SEQ ID NO: 131730 - DNA, 20 bp, human
gtatcgcagtgggacgagta

SEQ ID NO: 131731 - DNA, 20 bp, human
gccccactatctaggagact

SEQ ID NO: 131732 - DNA, 20 bp, human
gacacagcctgctggccagt

SEQ ID NO: 131733 - DNA, 20 bp, human
gctgagaaatatcagcaggt

SEQ ID NO: 131734 - DNA, 20 bp, human
ggacgggatgctatctggaa

SEQ ID NO: 131735 - DNA, 20 bp, human
gtatcattcagggtcaatgt

SEQ ID NO: 131736 - DNA, 20 bp, human
gtgtgtagccgcagccccgg

SEQ ID NO: 131737 - DNA, 20 bp, human
ggggctgcggctacacacct

SEQ ID NO: 131738 - DNA, 20 bp, human
ggcggctacacacctaggtg

SEQ ID NO: 131739 - DNA, 20 bp, human
ggctgctccggccaccgtgg

SEQ ID NO: 131740 - DNA, 20 bp, human
gaccgcagcgaagaagaggg

SEQ ID NO: 131741 - DNA, 20 bp, human
gctacacacctaggtgcggt

SEQ ID NO: 131742 - DNA, 20 bp, human
ggccaccgcagcgaagaaga

SEQ ID NO: 131743 - DNA, 20 bp, human
ggagcagccggaagctagca

SEQ ID NO: 131744 - DNA, 20 bp, human
gcccgaagcccaccgcacct

SEQ ID NO: 131745 - DNA, 20 bp, human
gcggccgccatgctagcttc

SEQ ID NO: 131746 - DNA, 20 bp, human
gatgtccaaatagtagctgg

SEQ ID NO: 131747 - DNA, 20 bp, human
gccactgggttgatgacatg

SEQ ID NO: 131748 - DNA, 20 bp, human
gcctcggaccaacccaacct

SEQ ID NO: 131749 - DNA, 20 bp, human
ggaggagactgtggagattg

SEQ ID NO: 131750 - DNA, 20 bp, human
ggcttcctccagctactatt

SEQ ID NO: 131751 - DNA, 20 bp, human
gtgggttgatgacatggggg

SEQ ID NO: 131752 - DNA, 20 bp, human
gacccagtggagtcccggct

SEQ ID NO: 131753 - DNA, 20 bp, human
gggttggtccgaggagactg

SEQ ID NO: 131754 - DNA, 20 bp, human
gggctagggagggaccctga

SEQ ID NO: 131755 - DNA, 20 bp, human
gggaggaagctgagtcaaag

SEQ ID NO: 131756 - DNA, 20 bp, human
gttcagcgggaaggaggtga

SEQ ID NO: 131757 - DNA, 20 bp, human
gacaggacgagcagagcaag

SEQ ID NO: 131758 - DNA, 20 bp, human
ggaagtagccgcaggcatgg

SEQ ID NO: 131759 - DNA, 20 bp, human
ggccgggccccaggagcaac

SEQ ID NO: 131760 - DNA, 20 bp, human
gagggcgcgagatctgacca

SEQ ID NO: 131761 - DNA, 20 bp, human
gttggagatcagctgcccca

SEQ ID NO: 131762 - DNA, 20 bp, human
gggtaggcggaagtagccgc

SEQ ID NO: 131763 - DNA, 20 bp, human
gatagccgccgccatgcctg

SEQ ID NO: 131764 - DNA, 20 bp, human
gaagggtggcccccagtatc

SEQ ID NO: 131765 - DNA, 20 bp, human
ggtcgcgtgggggttctgca

SEQ ID NO: 131766 - DNA, 20 bp, human
ggcgcccgccccagttatca

SEQ ID NO: 131767 - DNA, 20 bp, human
gtgggggccggaccacctag

SEQ ID NO: 131768 - DNA, 20 bp, human
gggccggaccacctagtggt

SEQ ID NO: 131769 - DNA, 20 bp, human
gctcggctcaggacactgaa

SEQ ID NO: 131770 - DNA, 20 bp, human
gacctagtggtggggatctg

SEQ ID NO: 131771 - DNA, 20 bp, human
ggaagggttggaataagagg

SEQ ID NO: 131772 - DNA, 20 bp, human
gaggagtgtggtctgtggga

SEQ ID NO: 131773 - DNA, 20 bp, human
ggggagccgccatgataact

SEQ ID NO: 131774 - DNA, 20 bp, human
gtgtcctgagccgaggagtg

SEQ ID NO: 131775 - DNA, 20 bp, human
gtgtggagcgcggcttgcag

SEQ ID NO: 131776 - DNA, 20 bp, human
gcagggccggaagcagacga

SEQ ID NO: 131777 - DNA, 20 bp, human
ggcccaaggaccactcccga

SEQ ID NO: 131778 - DNA, 20 bp, human
gagagccccaccaggccaca

SEQ ID NO: 131779 - DNA, 20 bp, human
ggctgcggcatggaagtact

SEQ ID NO: 131780 - DNA, 20 bp, human
gctgcaggctccctcgggag

SEQ ID NO: 131781 - DNA, 20 bp, human
gccctaagcatacctagcaa

SEQ ID NO: 131782 - DNA, 20 bp, human
ggggtcaagtgacgtaccca

SEQ ID NO: 131783 - DNA, 20 bp, human
gggccggaagcagacgaggg

SEQ ID NO: 131784 - DNA, 20 bp, human
ggtgacctgggtcataatcc

SEQ ID NO: 131785 - DNA, 20 bp, human
ggagaagtcgctctgaccca

SEQ ID NO: 131786 - DNA, 20 bp, human
gggcttgctggcttcaacta

SEQ ID NO: 131787 - DNA, 20 bp, human
ggctcgtgccagtgtcccgt

SEQ ID NO: 131788 - DNA, 20 bp, human
ggcacgagcgccatgatggg

SEQ ID NO: 131789 - DNA, 20 bp, human
gcccagcagacggtctacgt

SEQ ID NO: 131790 - DNA, 20 bp, human
gctggcacgagcgccatgat

SEQ ID NO: 131791 - DNA, 20 bp, human
gacaggagtgggtagcccac

SEQ ID NO: 131792 - DNA, 20 bp, human
gtgggtagcccacgggacac

SEQ ID NO: 131793 - DNA, 20 bp, human
ggaagccagcaagccggacc

SEQ ID NO: 131794 - DNA, 20 bp, human
ggtacgtgaggtatacgggt

SEQ ID NO: 131795 - DNA, 20 bp, human
gccagcccaaaggacatgac

SEQ ID NO: 131796 - DNA, 20 bp, human
gcgcgggacctagatcagta

SEQ ID NO: 131797 - DNA, 20 bp, human
ggtcccagccgataaatctg

SEQ ID NO: 131798 - DNA, 20 bp, human
gtgcaggcagctgggaaccg

SEQ ID NO: 131799 - DNA, 20 bp, human
ggccgcgcgggaacccttgg

SEQ ID NO: 131800 - DNA, 20 bp, human
gcggctcgccctactgatct

SEQ ID NO: 131801 - DNA, 20 bp, human
gcagagcaaagcgcacggga

SEQ ID NO: 131802 - DNA, 20 bp, human
gtctagtgtctgacctcctc

SEQ ID NO: 131803 - DNA, 20 bp, human
ggaagccggacgcccgagag

SEQ ID NO: 131804 - DNA, 20 bp, human
gcacgccgcgcgggaaccct

SEQ ID NO: 131805 - DNA, 20 bp, human
ggctctgacgccggtaaggg

SEQ ID NO: 131806 - DNA, 20 bp, human
gtgctccactcagcatggtc

SEQ ID NO: 131807 - DNA, 20 bp, human
gccgacctacaaggccccag

SEQ ID NO: 131808 - DNA, 20 bp, human
gagctcggccacgggtggcg

SEQ ID NO: 131809 - DNA, 20 bp, human
ggcgaggctgcggtgaggcc

SEQ ID NO: 131810 - DNA, 20 bp, human
ggcaggacgggggagaccgg

SEQ ID NO: 131811 - DNA, 20 bp, human
gaccgcagcctcgccacccg

SEQ ID NO: 131812 - DNA, 20 bp, human
ggaccggggcaagaagactg

SEQ ID NO: 131813 - DNA, 20 bp, human
gggccagcgagttacctgag

SEQ ID NO: 131814 - DNA, 20 bp, human
gcagcgtgctccactcagca

SEQ ID NO: 131815 - DNA, 20 bp, human
ggtcctcgccgggcgcacag

SEQ ID NO: 131816 - DNA, 20 bp, human
ggcgggaccgcagggcggag

SEQ ID NO: 131817 - DNA, 20 bp, human
ggtgggtaaactccactcca

SEQ ID NO: 131818 - DNA, 20 bp, human
gccagacccgtgccctggag

SEQ ID NO: 131819 - DNA, 20 bp, human
ggcgcgcccggccgctccca

SEQ ID NO: 131820 - DNA, 20 bp, human
ggagggcgagcggaccaagt

SEQ ID NO: 131821 - DNA, 20 bp, human
gtcccggctgcgcgcaaggt

SEQ ID NO: 131822 - DNA, 20 bp, human
gagtcggtgcgcagccccag

SEQ ID NO: 131823 - DNA, 20 bp, human
gtgggcctccctgagaacac

SEQ ID NO: 131824 - DNA, 20 bp, human
ggcccagcctctagggagga

SEQ ID NO: 131825 - DNA, 20 bp, human
ggacccgccccggacctagg

SEQ ID NO: 131826 - DNA, 20 bp, human
ggttcggcacgtaggacgga

SEQ ID NO: 131827 - DNA, 20 bp, human
gtcctcgagaccctcaacgt

SEQ ID NO: 131828 - DNA, 20 bp, human
gtacagttcggcacgtagga

SEQ ID NO: 131829 - DNA, 20 bp, human
gtaccgatagaccggaagtg

SEQ ID NO: 131830 - DNA, 20 bp, human
gacaccatcgtcaaatccgt

SEQ ID NO: 131831 - DNA, 20 bp, human
gggccctgggaaagagatct

SEQ ID NO: 131832 - DNA, 20 bp, human
gcgaatactcaaggatccag

SEQ ID NO: 131833 - DNA, 20 bp, human
gtagagacacatattcccca

SEQ ID NO: 131834 - DNA, 20 bp, human
gtggcggggtgctcaaagat

SEQ ID NO: 131835 - DNA, 20 bp, human
gaggcgggaaccaggcctcg

SEQ ID NO: 131836 - DNA, 20 bp, human
ggaaatactaaactatactg

SEQ ID NO: 131837 - DNA, 20 bp, human
gcaggcgtcgcggtttgtca

SEQ ID NO: 131838 - DNA, 20 bp, human
gtaacgggtaatcattctat

SEQ ID NO: 131839 - DNA, 20 bp, human
gaccctggtaacaggcgtcg

SEQ ID NO: 131840 - DNA, 20 bp, human
gctgtgggacacctctccaa

SEQ ID NO: 131841 - DNA, 20 bp, human
ggggtaatcattctataggt

SEQ ID NO: 131842 - DNA, 20 bp, human
gccgttagaactgagagaag

SEQ ID NO: 131843 - DNA, 20 bp, human
gccaatgggagaagaggcta

SEQ ID NO: 131844 - DNA, 20 bp, human
gggctggttaccctggtaac

SEQ ID NO: 131845 - DNA, 20 bp, human
ggcctcttctcccattggag

SEQ ID NO: 131846 - DNA, 20 bp, human
ggagacgggaaaactgacca

SEQ ID NO: 131847 - DNA, 20 bp, human
gttcggagcctagccagaga

SEQ ID NO: 131848 - DNA, 20 bp, human
ggggaaaactgaccaaggtg

SEQ ID NO: 131849 - DNA, 20 bp, human
gggaaactcgaacctcaaga

SEQ ID NO: 131850 - DNA, 20 bp, human
gtggcgtctctccgttgcta

SEQ ID NO: 131851 - DNA, 20 bp, human
gaaatagactgtgcagagcg

SEQ ID NO: 131852 - DNA, 20 bp, human
gagttgagagaagaccagtt

SEQ ID NO: 131853 - DNA, 20 bp, human
gggacctgggtgctccaaac

SEQ ID NO: 131854 - DNA, 20 bp, human
gaaagttgttaccctagcaa

SEQ ID NO: 131855 - DNA, 20 bp, human
gtagtcattattaatgggaa

SEQ ID NO: 131856 - DNA, 20 bp, human
gacactcctagggccagagg

SEQ ID NO: 131857 - DNA, 20 bp, human
ggagggaggaagcgccagag

SEQ ID NO: 131858 - DNA, 20 bp, human
gttcagagtcggagggacag

SEQ ID NO: 131859 - DNA, 20 bp, human
gcgacgctcagacactccta

SEQ ID NO: 131860 - DNA, 20 bp, human
gcagacactcctagggccag

SEQ ID NO: 131861 - DNA, 20 bp, human
gctctcgcttcagagtcgga

SEQ ID NO: 131862 - DNA, 20 bp, human
ggggcaagatccccgcacag

SEQ ID NO: 131863 - DNA, 20 bp, human
gccgggcacgcagcgagcca

SEQ ID NO: 131864 - DNA, 20 bp, human
gcgcaaacagaagcaagcgg

SEQ ID NO: 131865 - DNA, 20 bp, human
ggcgagttgagagaagcgga

SEQ ID NO: 131866 - DNA, 20 bp, human
gcctcgcagatggtaagtca

SEQ ID NO: 131867 - DNA, 20 bp, human
gaactgccttgcggaatcag

SEQ ID NO: 131868 - DNA, 20 bp, human
gtcagaccctctgagcaaag

SEQ ID NO: 131869 - DNA, 20 bp, human
gggtgtcgtggcctcgcaga

SEQ ID NO: 131870 - DNA, 20 bp, human
gacgacttctggggcttatg

SEQ ID NO: 131871 - DNA, 20 bp, human
gggaggaggcaattgcagag

SEQ ID NO: 131872 - DNA, 20 bp, human
gtgggcacaaaatctattgt

SEQ ID NO: 131873 - DNA, 20 bp, human
gtatttaaggaggatcctgg

SEQ ID NO: 131874 - DNA, 20 bp, human
gtgcgctctgctcggtgtcg

SEQ ID NO: 131875 - DNA, 20 bp, human
gaagtcatggacgacttctg

SEQ ID NO: 131876 - DNA, 20 bp, human
gtaggagtaactggtaatac

SEQ ID NO: 131877 - DNA, 20 bp, human
gctcagatatctagcaacag

SEQ ID NO: 131878 - DNA, 20 bp, human
gaaaaggaagggctcagaat

SEQ ID NO: 131879 - DNA, 20 bp, human
gggctcagaataggagtaac

SEQ ID NO: 131880 - DNA, 20 bp, human
gttagacctactattcagag

SEQ ID NO: 131881 - DNA, 20 bp, human
gatagaaggtaaagcataag

SEQ ID NO: 131882 - DNA, 20 bp, human
gaagtgactgacaatcagag

SEQ ID NO: 131883 - DNA, 20 bp, human
gaaatagagctgtgctgaaa

SEQ ID NO: 131884 - DNA, 20 bp, human
gaaggtaaagcataagtgga

SEQ ID NO: 131885 - DNA, 20 bp, human
gagtttctcaagttcagctt

SEQ ID NO: 131886 - DNA, 20 bp, human
gagaccctgcctggacaggc

SEQ ID NO: 131887 - DNA, 20 bp, human
gcgccaggcacaagacacgt

SEQ ID NO: 131888 - DNA, 20 bp, human
gggacacccggcgcactgca

SEQ ID NO: 131889 - DNA, 20 bp, human
gaccccgggtgagacaatag

SEQ ID NO: 131890 - DNA, 20 bp, human
ggtcttgtgcctggcgacgt

SEQ ID NO: 131891 - DNA, 20 bp, human
ggccgcagagcgagcccggg

SEQ ID NO: 131892 - DNA, 20 bp, human
ggtgcctgcctgtccaggca

SEQ ID NO: 131893 - DNA, 20 bp, human
gcagcagccgccccgccctc

SEQ ID NO: 131894 - DNA, 20 bp, human
gacctcggctgcctccactc

SEQ ID NO: 131895 - DNA, 20 bp, human
ggtctgtgcggagcctggag

SEQ ID NO: 131896 - DNA, 20 bp, human
ggatgccgtctacaagctag

SEQ ID NO: 131897 - DNA, 20 bp, human
ggtagacggcatccccatga

SEQ ID NO: 131898 - DNA, 20 bp, human
gcgtgccactagcttgtaga

SEQ ID NO: 131899 - DNA, 20 bp, human
gtcaggaagatatatgcgtc

SEQ ID NO: 131900 - DNA, 20 bp, human
ggaatgaaataattagctca

SEQ ID NO: 131901 - DNA, 20 bp, human
ggggaacgtgatgcttccac

SEQ ID NO: 131902 - DNA, 20 bp, human
gttatttcattcatgtctac

SEQ ID NO: 131903 - DNA, 20 bp, human
gtgttatcaaatgcaatctg

SEQ ID NO: 131904 - DNA, 20 bp, human
gatctgtggtgtcagctagc

SEQ ID NO: 131905 - DNA, 20 bp, human
gtgagatcgtgtttcatttc

SEQ ID NO: 131906 - DNA, 20 bp, human
gccacctacagcgggaactt

SEQ ID NO: 131907 - DNA, 20 bp, human
gcccatcgcaccgtctgcaa

SEQ ID NO: 131908 - DNA, 20 bp, human
ggcaaaggtaccacctacag

SEQ ID NO: 131909 - DNA, 20 bp, human
ggtacctaagttcccgctgt

SEQ ID NO: 131910 - DNA, 20 bp, human
gaaaatacagcggaacttaa

SEQ ID NO: 131911 - DNA, 20 bp, human
gggcgcgagagagtggatcg

SEQ ID NO: 131912 - DNA, 20 bp, human
gtaaagactgtaaaatacag

SEQ ID NO: 131913 - DNA, 20 bp, human
gggcttgtagggtggaatga

SEQ ID NO: 131914 - DNA, 20 bp, human
gccggaagttccgtgttgtg

SEQ ID NO: 131915 - DNA, 20 bp, human
ggaacactcgggacagggag

SEQ ID NO: 131916 - DNA, 20 bp, human
ggtctcccagcgtcggcccg

SEQ ID NO: 131917 - DNA, 20 bp, human
ggcggggctgggacccgatg

SEQ ID NO: 131918 - DNA, 20 bp, human
gcagcagcccgacacctcag

SEQ ID NO: 131919 - DNA, 20 bp, human
gagaggccagaggcaggcga

SEQ ID NO: 131920 - DNA, 20 bp, human
gctgcggccgctgaggtgtc

SEQ ID NO: 131921 - DNA, 20 bp, human
gaagcaaaggaagagcgagg

SEQ ID NO: 131922 - DNA, 20 bp, human
gctcctagctgcagaggcga

SEQ ID NO: 131923 - DNA, 20 bp, human
ggagagggtgcggcgatcgc

SEQ ID NO: 131924 - DNA, 20 bp, human
ggccgcggccgctgggactg

SEQ ID NO: 131925 - DNA, 20 bp, human
gaaactgggagtagaagcaa

SEQ ID NO: 131926 - DNA, 20 bp, human
gactcaccttggagagccca

SEQ ID NO: 131927 - DNA, 20 bp, human
ggcgccccccggcccctggg

SEQ ID NO: 131928 - DNA, 20 bp, human
gcacacgggcgcgggttcgg

SEQ ID NO: 131929 - DNA, 20 bp, human
ggccagacgcccccaccggc

SEQ ID NO: 131930 - DNA, 20 bp, human
gggctggcgcgcgcgcacac

SEQ ID NO: 131931 - DNA, 20 bp, human
gcgtgctctgtcggcctgtg

SEQ ID NO: 131932 - DNA, 20 bp, human
ggtcggcctgtgcggcgctg

SEQ ID NO: 131933 - DNA, 20 bp, human
gggcgggaggtgatcgagag

SEQ ID NO: 131934 - DNA, 20 bp, human
gaggataaccgcctaccggc

SEQ ID NO: 131935 - DNA, 20 bp, human
gaggcggttatcctccaagc

SEQ ID NO: 131936 - DNA, 20 bp, human
gcctcccctgacgcagccag

SEQ ID NO: 131937 - DNA, 20 bp, human
gggctgaggcgcgaggatac

SEQ ID NO: 131938 - DNA, 20 bp, human
gcggcgatcgcttaccgtcc

SEQ ID NO: 131939 - DNA, 20 bp, human
gggacggccccgggcctcta

SEQ ID NO: 131940 - DNA, 20 bp, human
gcctgccagctgcgccggga

SEQ ID NO: 131941 - DNA, 20 bp, human
gggaccccgctgccgtacag

SEQ ID NO: 131942 - DNA, 20 bp, human
gaccaggggcctcctctgta

SEQ ID NO: 131943 - DNA, 20 bp, human
gctctagtcagcgctcggag

SEQ ID NO: 131944 - DNA, 20 bp, human
ggacccggctcgctagactc

SEQ ID NO: 131945 - DNA, 20 bp, human
gtcgccgctggctgcgtcag

SEQ ID NO: 131946 - DNA, 20 bp, human
gatttagacgcacactgggt

SEQ ID NO: 131947 - DNA, 20 bp, human
gggggtctgactcggaatag

SEQ ID NO: 131948 - DNA, 20 bp, human
gcaggctgactaatactcac

SEQ ID NO: 131949 - DNA, 20 bp, human
gctctgcatctggatatgaa

SEQ ID NO: 131950 - DNA, 20 bp, human
gagatcgtttggtatcactg

SEQ ID NO: 131951 - DNA, 20 bp, human
gagtgttgcagttaccagga

SEQ ID NO: 131952 - DNA, 20 bp, human
gtcttgaagcatgcacttgt

SEQ ID NO: 131953 - DNA, 20 bp, human
ggcaatacctgataaagcag

SEQ ID NO: 131954 - DNA, 20 bp, human
gatgaaacacagacattcgg

SEQ ID NO: 131955 - DNA, 20 bp, human
gaatagtggcacttccttct

SEQ ID NO: 131956 - DNA, 20 bp, human
gcccctgacaaggaaaggag

SEQ ID NO: 131957 - DNA, 20 bp, human
gggcagagccgccgccaagg

SEQ ID NO: 131958 - DNA, 20 bp, human
gaacaggacttggggagtag

SEQ ID NO: 131959 - DNA, 20 bp, human
gagctcccagttctaaagag

SEQ ID NO: 131960 - DNA, 20 bp, human
gggaggaccacaccatgcaa

SEQ ID NO: 131961 - DNA, 20 bp, human
gcagaagcctatggatctgg

SEQ ID NO: 131962 - DNA, 20 bp, human
gttaccagaacagcataaca

SEQ ID NO: 131963 - DNA, 20 bp, human
gagaacagcataacaagggc

SEQ ID NO: 131964 - DNA, 20 bp, human
ggcctttccttgctcatgag

SEQ ID NO: 131965 - DNA, 20 bp, human
gaccgaggcccccttggcgg

SEQ ID NO: 131966 - DNA, 20 bp, human
gcgccgcgcgtcctgaggag

SEQ ID NO: 131967 - DNA, 20 bp, human
ggggccaaaagccactcctc

SEQ ID NO: 131968 - DNA, 20 bp, human
gaaacggtcaataaacgctg

SEQ ID NO: 131969 - DNA, 20 bp, human
gagccactcctcaggacgcg

SEQ ID NO: 131970 - DNA, 20 bp, human
gactgcgcggggcgaggctg

SEQ ID NO: 131971 - DNA, 20 bp, human
gagaatcactgtaacgcgga

SEQ ID NO: 131972 - DNA, 20 bp, human
ggagcaaaaagcctgcgctc

SEQ ID NO: 131973 - DNA, 20 bp, human
gctggggttgtgagcagtgt

SEQ ID NO: 131974 - DNA, 20 bp, human
gatcactgtaacgcggaagg

SEQ ID NO: 131975 - DNA, 20 bp, human
gagcgatttaccaaaggcaa

SEQ ID NO: 131976 - DNA, 20 bp, human
gccagcagctggagcggagt

SEQ ID NO: 131977 - DNA, 20 bp, human
ggcagctggagcggagttgg

SEQ ID NO: 131978 - DNA, 20 bp, human
ggcccgagcacacacacccg

SEQ ID NO: 131979 - DNA, 20 bp, human
gagggcggcaggctagctgt

SEQ ID NO: 131980 - DNA, 20 bp, human
gagctcgtcggcaactccgg

SEQ ID NO: 131981 - DNA, 20 bp, human
gaggatggcggggatctcac

SEQ ID NO: 131982 - DNA, 20 bp, human
gagtgacaggaagagagtcg

SEQ ID NO: 131983 - DNA, 20 bp, human
gggaggaagcccgagctcgt

SEQ ID NO: 131984 - DNA, 20 bp, human
ggccggcgggcggggtaggt

SEQ ID NO: 131985 - DNA, 20 bp, human
gtgcagcgcgggccccgcag

SEQ ID NO: 131986 - DNA, 20 bp, human
gccgccccgtggctccaccg

SEQ ID NO: 131987 - DNA, 20 bp, human
gggcttcgaatagtaccgag

SEQ ID NO: 131988 - DNA, 20 bp, human
gcattgtgcggggcagaatg

SEQ ID NO: 131989 - DNA, 20 bp, human
gaggccgctcggaaccgtgg

SEQ ID NO: 131990 - DNA, 20 bp, human
gggacggtcggggcagaatg

SEQ ID NO: 131991 - DNA, 20 bp, human
gggacccggccacccggcta

SEQ ID NO: 131992 - DNA, 20 bp, human
gccaagccaagcccgccccg

SEQ ID NO: 131993 - DNA, 20 bp, human
ggccaggccgctcggaaccg

SEQ ID NO: 131994 - DNA, 20 bp, human
gatagtaccgaggggcgccc

SEQ ID NO: 131995 - DNA, 20 bp, human
ggcttggcttggtgtgacgg

SEQ ID NO: 131996 - DNA, 20 bp, human
gctccgtgtgagggcgtgag

SEQ ID NO: 131997 - DNA, 20 bp, human
gcatccagcccacgctctgt

SEQ ID NO: 131998 - DNA, 20 bp, human
gccaccattcgtcagctggt

SEQ ID NO: 131999 - DNA, 20 bp, human
ggtgctggtagtgagccggg

SEQ ID NO: 132000 - DNA, 20 bp, human
gagcgctgcccacagagcgt

SEQ ID NO: 132001 - DNA, 20 bp, human
gcgctgggcgtggccgaggg

SEQ ID NO: 132002 - DNA, 20 bp, human
gcccatggccctccgtgtga

SEQ ID NO: 132003 - DNA, 20 bp, human
ggcaccccaagccaacccag

SEQ ID NO: 132004 - DNA, 20 bp, human
gcagtcacaggcgaccacag

SEQ ID NO: 132005 - DNA, 20 bp, human
gggccgctcacgccctcaca

SEQ ID NO: 132006 - DNA, 20 bp, human
ggagtccgggcagagcttga

SEQ ID NO: 132007 - DNA, 20 bp, human
gagcttgagggcagttggtg

SEQ ID NO: 132008 - DNA, 20 bp, human
ggagggcagttggtgcggtc

SEQ ID NO: 132009 - DNA, 20 bp, human
gggcagagcttgagggcagt

SEQ ID NO: 132010 - DNA, 20 bp, human
gccatagcttgaaagttcgg

SEQ ID NO: 132011 - DNA, 20 bp, human
gcagtcagctcggcttgtct

SEQ ID NO: 132012 - DNA, 20 bp, human
gcagagagcgaatcccccag

SEQ ID NO: 132013 - DNA, 20 bp, human
ggagcagaggtgttaaaaag

SEQ ID NO: 132014 - DNA, 20 bp, human
ggttggttcttacaccccgg

SEQ ID NO: 132015 - DNA, 20 bp, human
gcggagaagtccagtcagct

SEQ ID NO: 132016 - DNA, 20 bp, human
gcgctcggcgacaggaagtg

SEQ ID NO: 132017 - DNA, 20 bp, human
gcagcaaacgccgaactccc

SEQ ID NO: 132018 - DNA, 20 bp, human
ggcggggggagatggaaccc

SEQ ID NO: 132019 - DNA, 20 bp, human
gtcctcgagggcctcaccac

SEQ ID NO: 132020 - DNA, 20 bp, human
ggtcatagtagactacttcg

SEQ ID NO: 132021 - DNA, 20 bp, human
ggaactcccgggaaagcaac

SEQ ID NO: 132022 - DNA, 20 bp, human
gctggaggggtcaaatcccg

SEQ ID NO: 132023 - DNA, 20 bp, human
gcgggaaaacgcgtcagcag

SEQ ID NO: 132024 - DNA, 20 bp, human
gcggtctgcacttctctccc

SEQ ID NO: 132025 - DNA, 20 bp, human
gcgagggcctcaccaccggg

SEQ ID NO: 132026 - DNA, 20 bp, human
gctgcgattcgggtgaccgt

SEQ ID NO: 132027 - DNA, 20 bp, human
gacagggcgtcctgtgtcag

SEQ ID NO: 132028 - DNA, 20 bp, human
ggcgcagagccgcccagcag

SEQ ID NO: 132029 - DNA, 20 bp, human
gtggggcgcggtggtcccga

SEQ ID NO: 132030 - DNA, 20 bp, human
ggacctgaccctacgacaca

SEQ ID NO: 132031 - DNA, 20 bp, human
gtatccgggtaacctctgct

SEQ ID NO: 132032 - DNA, 20 bp, human
gtccgtgagcgtgggcatca

SEQ ID NO: 132033 - DNA, 20 bp, human
gcaggacgccctgtgtcgta

SEQ ID NO: 132034 - DNA, 20 bp, human
gccagcctgggctcctccgg

SEQ ID NO: 132035 - DNA, 20 bp, human
gagcaagctggggaccgtcg

SEQ ID NO: 132036 - DNA, 20 bp, human
gggtgtttcagcccccccag

SEQ ID NO: 132037 - DNA, 20 bp, human
gagagaagcagatgtcttgg

SEQ ID NO: 132038 - DNA, 20 bp, human
ggtcttgggggagcctccac

SEQ ID NO: 132039 - DNA, 20 bp, human
ggacacgggaccctgtgaga

SEQ ID NO: 132040 - DNA, 20 bp, human
gggacctcgctcaggaccgt

SEQ ID NO: 132041 - DNA, 20 bp, human
gagcagaacagatagagggg

SEQ ID NO: 132042 - DNA, 20 bp, human
gtggaaggggagcccctggg

SEQ ID NO: 132043 - DNA, 20 bp, human
gctggataaataagagccag

SEQ ID NO: 132044 - DNA, 20 bp, human
gaaaggagagtccttctcac

SEQ ID NO: 132045 - DNA, 20 bp, human
ggggtgtactctgcagcacc

SEQ ID NO: 132046 - DNA, 20 bp, human
gcatgggaaggaggccggta

SEQ ID NO: 132047 - DNA, 20 bp, human
gttcctgccgcaaccgtccg

SEQ ID NO: 132048 - DNA, 20 bp, human
gggaagtcggcccccgagag

SEQ ID NO: 132049 - DNA, 20 bp, human
gggcgtaagggtcgagagag

SEQ ID NO: 132050 - DNA, 20 bp, human
gagtcggcccccgagagcgg

SEQ ID NO: 132051 - DNA, 20 bp, human
gctcaggccgcggacggttg

SEQ ID NO: 132052 - DNA, 20 bp, human
gagcccaccgccgctctcgg

SEQ ID NO: 132053 - DNA, 20 bp, human
gggcccccgagagcggcggt

SEQ ID NO: 132054 - DNA, 20 bp, human
ggctgcttacatggttgatg

SEQ ID NO: 132055 - DNA, 20 bp, human
ggccggtatggggagctcca

SEQ ID NO: 132056 - DNA, 20 bp, human
ggcagcagcaagggcagtag

SEQ ID NO: 132057 - DNA, 20 bp, human
gcccaggaccacccagatgt

SEQ ID NO: 132058 - DNA, 20 bp, human
gcgggctcaggctccgaaga

SEQ ID NO: 132059 - DNA, 20 bp, human
gcaggctccgaagagggctg

SEQ ID NO: 132060 - DNA, 20 bp, human
gatgctggcggcagcagcaa

SEQ ID NO: 132061 - DNA, 20 bp, human
ggtggtcctgggtactcact

SEQ ID NO: 132062 - DNA, 20 bp, human
ggccaacccgagacaaaggt

SEQ ID NO: 132063 - DNA, 20 bp, human
gactcacctcaacccccagg

SEQ ID NO: 132064 - DNA, 20 bp, human
gccctctttgtgtcttgagg

SEQ ID NO: 132065 - DNA, 20 bp, human
gctcactcacctcaaccccc

SEQ ID NO: 132066 - DNA, 20 bp, human
gaatccacgccaggccacga

SEQ ID NO: 132067 - DNA, 20 bp, human
gaacgctcggaatccacgcc

SEQ ID NO: 132068 - DNA, 20 bp, human
gcctccgtcgtggcctggcg

SEQ ID NO: 132069 - DNA, 20 bp, human
gggctttacctggtacatcg

SEQ ID NO: 132070 - DNA, 20 bp, human
gtttacctggtacatcgggg

SEQ ID NO: 132071 - DNA, 20 bp, human
gtctgtgccggccggccagg

SEQ ID NO: 132072 - DNA, 20 bp, human
ggttcggaaaaaacgcagtc

SEQ ID NO: 132073 - DNA, 20 bp, human
gcgcgccaccccgatgtacc

SEQ ID NO: 132074 - DNA, 20 bp, human
gacgcgcggcggcccgttgc

SEQ ID NO: 132075 - DNA, 20 bp, human
ggggcacctgggccagcaac

SEQ ID NO: 132076 - DNA, 20 bp, human
ggaggaggcccgagaggagt

SEQ ID NO: 132077 - DNA, 20 bp, human
gcgagaggagtcggtggcag

SEQ ID NO: 132078 - DNA, 20 bp, human
ggcgagtcggaggacaactg

SEQ ID NO: 132079 - DNA, 20 bp, human
gcggaaggccgagggcgagt

SEQ ID NO: 132080 - DNA, 20 bp, human
gagccgggcgtctgctgcag

SEQ ID NO: 132081 - DNA, 20 bp, human
gaggcggggggtgctctcac

SEQ ID NO: 132082 - DNA, 20 bp, human
gcgccgacatcctggaggtt

SEQ ID NO: 132083 - DNA, 20 bp, human
gcccgcagccaggagtaaag

SEQ ID NO: 132084 - DNA, 20 bp, human
gggtcgggcagcgctgagaa

SEQ ID NO: 132085 - DNA, 20 bp, human
gctgagggcgctgccgggac

SEQ ID NO: 132086 - DNA, 20 bp, human
gagaggcttggtcaacatgg

SEQ ID NO: 132087 - DNA, 20 bp, human
gtcgcccagggtgactctcc

SEQ ID NO: 132088 - DNA, 20 bp, human
gcccaggctcagtagcattg

SEQ ID NO: 132089 - DNA, 20 bp, human
ggccccctcctgggtaaggg

SEQ ID NO: 132090 - DNA, 20 bp, human
gtgcgtaggaggcaaggatc

SEQ ID NO: 132091 - DNA, 20 bp, human
ggcgcgggaggcccctgtag

SEQ ID NO: 132092 - DNA, 20 bp, human
gtacctggagtcgatctgtg

SEQ ID NO: 132093 - DNA, 20 bp, human
gctggagtcgatctgtgagg

SEQ ID NO: 132094 - DNA, 20 bp, human
gaggcggtgtcctgcgaaga

SEQ ID NO: 132095 - DNA, 20 bp, human
ggttgaccaagcctctacag

SEQ ID NO: 132096 - DNA, 20 bp, human
gtcgagaaggcgtaccaggt

SEQ ID NO: 132097 - DNA, 20 bp, human
gcgactcaccgggagcccgt

SEQ ID NO: 132098 - DNA, 20 bp, human
ggacaaggagagcttcgaga

SEQ ID NO: 132099 - DNA, 20 bp, human
gcgggagcccgtcggcgatg

SEQ ID NO: 132100 - DNA, 20 bp, human
ggcttcggcacggtctacgc

SEQ ID NO: 132101 - DNA, 20 bp, human
gggcggcgtggaccacctcc

SEQ ID NO: 132102 - DNA, 20 bp, human
gcctgcagccaaggcggaca

SEQ ID NO: 132103 - DNA, 20 bp, human
ggcccggcggtccgactcac

SEQ ID NO: 132104 - DNA, 20 bp, human
gcaaggcgcgcgagaaaccc

SEQ ID NO: 132105 - DNA, 20 bp, human
gtggcgcctcgggcagaacg

SEQ ID NO: 132106 - DNA, 20 bp, human
gctcttccgcgtcgtccccg

SEQ ID NO: 132107 - DNA, 20 bp, human
gcccggcccgccctgttgtg

SEQ ID NO: 132108 - DNA, 20 bp, human
gtgcgcttctcccagccggg

SEQ ID NO: 132109 - DNA, 20 bp, human
gtgggcccgggggcacccct

SEQ ID NO: 132110 - DNA, 20 bp, human
gtggggtgtctccctcccag

SEQ ID NO: 132111 - DNA, 20 bp, human
gagagccaggaccccatggg

SEQ ID NO: 132112 - DNA, 20 bp, human
ggctcgcagtccccacaaca

SEQ ID NO: 132113 - DNA, 20 bp, human
gcgagaggtatcagccgggc

SEQ ID NO: 132114 - DNA, 20 bp, human
gtaatgcacctgacaccccg

SEQ ID NO: 132115 - DNA, 20 bp, human
gtcaggtgcattaggccgag

SEQ ID NO: 132116 - DNA, 20 bp, human
ggcttgtacggcaactggag

SEQ ID NO: 132117 - DNA, 20 bp, human
ggcttctaaaggggcttgta

SEQ ID NO: 132118 - DNA, 20 bp, human
gtgattccttccccgatggt

SEQ ID NO: 132119 - DNA, 20 bp, human
gcatggcggggcttctaaag

SEQ ID NO: 132120 - DNA, 20 bp, human
gagcaataggaagtacacat

SEQ ID NO: 132121 - DNA, 20 bp, human
gagaatgacatgcccaccat

SEQ ID NO: 132122 - DNA, 20 bp, human
gggacgcagcaggtagccag

SEQ ID NO: 132123 - DNA, 20 bp, human
ggttcagggaccgtcctagt

SEQ ID NO: 132124 - DNA, 20 bp, human
gaatcgatggcagcactgtg

SEQ ID NO: 132125 - DNA, 20 bp, human
gggaccgtcctagtgggtaa

SEQ ID NO: 132126 - DNA, 20 bp, human
gggccgcggcgccaccatgg

SEQ ID NO: 132127 - DNA, 20 bp, human
ggcctgtcgcaccgccatgg

SEQ ID NO: 132128 - DNA, 20 bp, human
gctcacctggatctcctgac

SEQ ID NO: 132129 - DNA, 20 bp, human
gtcggcctgtcaggagatcc

SEQ ID NO: 132130 - DNA, 20 bp, human
gcgggtcctaagccgagcgg

SEQ ID NO: 132131 - DNA, 20 bp, human
gcgccagcccggccaccgac

SEQ ID NO: 132132 - DNA, 20 bp, human
gcagcccggccaccgactgg

SEQ ID NO: 132133 - DNA, 20 bp, human
gacaggccgagaccgcccgc

SEQ ID NO: 132134 - DNA, 20 bp, human
gggccgggtcctaagccgag

SEQ ID NO: 132135 - DNA, 20 bp, human
gcgccggtcacaacaaactt

SEQ ID NO: 132136 - DNA, 20 bp, human
gcacttaccaagacccagga

SEQ ID NO: 132137 - DNA, 20 bp, human
gacacaccatgaggctctcc

SEQ ID NO: 132138 - DNA, 20 bp, human
gaggccagcagaaaggtctc

SEQ ID NO: 132139 - DNA, 20 bp, human
ggtcctcaaggtgaacgggg

SEQ ID NO: 132140 - DNA, 20 bp, human
gtggaagaggccaagggtaa

SEQ ID NO: 132141 - DNA, 20 bp, human
gttgtcacttaccaagaccc

SEQ ID NO: 132142 - DNA, 20 bp, human
ggattcatggaagaggccaa

SEQ ID NO: 132143 - DNA, 20 bp, human
gctctcagggatccaatcac

SEQ ID NO: 132144 - DNA, 20 bp, human
gtgctgatacacacaccatg

SEQ ID NO: 132145 - DNA, 20 bp, human
gcaagtcctcaaggtgaacg

SEQ ID NO: 132146 - DNA, 20 bp, human
gcctcgccggcggactgcag

SEQ ID NO: 132147 - DNA, 20 bp, human
gcgcagtcacccaggtccag

SEQ ID NO: 132148 - DNA, 20 bp, human
gcagtccgggaccccacaaa

SEQ ID NO: 132149 - DNA, 20 bp, human
gcgcgcacggcagcccggag

SEQ ID NO: 132150 - DNA, 20 bp, human
gcccgtccgctgcagtccgc

SEQ ID NO: 132151 - DNA, 20 bp, human
gtgcgtaactccctcgccgg

SEQ ID NO: 132152 - DNA, 20 bp, human
ggtgggtgaagcaaccagtc

SEQ ID NO: 132153 - DNA, 20 bp, human
gacgcacgtcctgattctcc

SEQ ID NO: 132154 - DNA, 20 bp, human
gacgtgcgtaactccctcgc

SEQ ID NO: 132155 - DNA, 20 bp, human
gctgggtgactgcggccact

SEQ ID NO: 132156 - DNA, 20 bp, human
gaacctggcaggagatccat

SEQ ID NO: 132157 - DNA, 20 bp, human
gcctgggacaccacttctct

SEQ ID NO: 132158 - DNA, 20 bp, human
gtaggaggcaaggtgtgaga

SEQ ID NO: 132159 - DNA, 20 bp, human
gagctggagcaagcgcatgc

SEQ ID NO: 132160 - DNA, 20 bp, human
gaagctccaaatgtacctac

SEQ ID NO: 132161 - DNA, 20 bp, human
gaatgtgagaggagttggtg

SEQ ID NO: 132162 - DNA, 20 bp, human
ggaaccaggagcagggtggc

SEQ ID NO: 132163 - DNA, 20 bp, human
gagaaatgtgctgggcacct

SEQ ID NO: 132164 - DNA, 20 bp, human
ggcttctcttctaggaggca

SEQ ID NO: 132165 - DNA, 20 bp, human
gtttgttggcccccaactgc

SEQ ID NO: 132166 - DNA, 20 bp, human
gcagcagctgcagccggagg

SEQ ID NO: 132167 - DNA, 20 bp, human
gccgcggcgggcgcaggata

SEQ ID NO: 132168 - DNA, 20 bp, human
gggggtaaaccactcggtaa

SEQ ID NO: 132169 - DNA, 20 bp, human
ggcgggcgcaggatacgggc

SEQ ID NO: 132170 - DNA, 20 bp, human
gggaggtccagggctgactc

SEQ ID NO: 132171 - DNA, 20 bp, human
gggcgacccccggcaaccta

SEQ ID NO: 132172 - DNA, 20 bp, human
gcgccaggacagaggaccct

SEQ ID NO: 132173 - DNA, 20 bp, human
gccgggccggggtgtagaga

SEQ ID NO: 132174 - DNA, 20 bp, human
gggcagccgcatccccccgg

SEQ ID NO: 132175 - DNA, 20 bp, human
gcccggcctcgggagcacgg

SEQ ID NO: 132176 - DNA, 20 bp, human
gcaagtggcttggcgagggg

SEQ ID NO: 132177 - DNA, 20 bp, human
gcgatgccaccgctccggaa

SEQ ID NO: 132178 - DNA, 20 bp, human
gcgaaaggcgtgcaagggtg

SEQ ID NO: 132179 - DNA, 20 bp, human
ggagacagcgcacaagccag

SEQ ID NO: 132180 - DNA, 20 bp, human
gggcagcccatggagcgcaa

SEQ ID NO: 132181 - DNA, 20 bp, human
ggcgggaaagagccaaaccc

SEQ ID NO: 132182 - DNA, 20 bp, human
ggagtgcacacggggccgaa

SEQ ID NO: 132183 - DNA, 20 bp, human
ggccccccaacgccagggtt

SEQ ID NO: 132184 - DNA, 20 bp, human
ggggtgggaggtaacgggac

SEQ ID NO: 132185 - DNA, 20 bp, human
gaacgggacgggcgcgacca

SEQ ID NO: 132186 - DNA, 20 bp, human
gctatccaggcgcccgaccc

SEQ ID NO: 132187 - DNA, 20 bp, human
gtcggttgcgcgggagacta

SEQ ID NO: 132188 - DNA, 20 bp, human
gaggcgcccgaccccggaag

SEQ ID NO: 132189 - DNA, 20 bp, human
gagggaccaagacaacccgg

SEQ ID NO: 132190 - DNA, 20 bp, human
gcctgctgggggaacacctg

SEQ ID NO: 132191 - DNA, 20 bp, human
gccggagccggcagctatcc

SEQ ID NO: 132192 - DNA, 20 bp, human
gccaccagccacggtatcgg

SEQ ID NO: 132193 - DNA, 20 bp, human
gcaggtgagcgccgcttccg

SEQ ID NO: 132194 - DNA, 20 bp, human
gggggaaggtggaactagag

SEQ ID NO: 132195 - DNA, 20 bp, human
gaccgtggctggtgggaccg

SEQ ID NO: 132196 - DNA, 20 bp, human
gtaacaggccgtggttagga

SEQ ID NO: 132197 - DNA, 20 bp, human
ggttaggaaggacggagaag

SEQ ID NO: 132198 - DNA, 20 bp, human
gcgattaacaggccgtggtt

SEQ ID NO: 132199 - DNA, 20 bp, human
gtctccgtccttcctaacca

SEQ ID NO: 132200 - DNA, 20 bp, human
gtacccggagtgaagcggcc

SEQ ID NO: 132201 - DNA, 20 bp, human
gttggctacccggagtgaag

SEQ ID NO: 132202 - DNA, 20 bp, human
gaacccggccgcttcactcc

SEQ ID NO: 132203 - DNA, 20 bp, human
gccgggcttacctgaggaca

SEQ ID NO: 132204 - DNA, 20 bp, human
gcacatctgaaaaaaaaacg

SEQ ID NO: 132205 - DNA, 20 bp, human
gaagagagccaggccgctga

SEQ ID NO: 132206 - DNA, 20 bp, human
gccgggaaccggggaccgag

SEQ ID NO: 132207 - DNA, 20 bp, human
gagcgaggcgcagagagagc

SEQ ID NO: 132208 - DNA, 20 bp, human
gctgcgcctcgctccgactc

SEQ ID NO: 132209 - DNA, 20 bp, human
gactccggcgcgcaccaagc

SEQ ID NO: 132210 - DNA, 20 bp, human
ggagcagtgcaggcgagggg

SEQ ID NO: 132211 - DNA, 20 bp, human
ggcgcaactggtcttggtag

SEQ ID NO: 132212 - DNA, 20 bp, human
gctccgtctggccggaggac

SEQ ID NO: 132213 - DNA, 20 bp, human
gcaactggtcttggtagcgg

SEQ ID NO: 132214 - DNA, 20 bp, human
ggggaacccgcgcccgagcc

SEQ ID NO: 132215 - DNA, 20 bp, human
gcgtctggccggaggaccgg

SEQ ID NO: 132216 - DNA, 20 bp, human
ggagcgggtcaggcagaacg

SEQ ID NO: 132217 - DNA, 20 bp, human
gggcggcgcttgttgttcgg

SEQ ID NO: 132218 - DNA, 20 bp, human
gctgcctgacccgctcccag

SEQ ID NO: 132219 - DNA, 20 bp, human
gggcgcttgttgttcggcgg

SEQ ID NO: 132220 - DNA, 20 bp, human
gcagccgccactcacacgac

SEQ ID NO: 132221 - DNA, 20 bp, human
gctgcccgtcgtgtgagtgg

SEQ ID NO: 132222 - DNA, 20 bp, human
ggggctgcccgtcgtgtgag

SEQ ID NO: 132223 - DNA, 20 bp, human
ggacgggcagcccctgggag

SEQ ID NO: 132224 - DNA, 20 bp, human
gcaacaagcgccgccggcca

SEQ ID NO: 132225 - DNA, 20 bp, human
ggccggcggcgcttgttgtt

SEQ ID NO: 132226 - DNA, 20 bp, human
gggcacgttcccagactcac

SEQ ID NO: 132227 - DNA, 20 bp, human
gacagatgggaaaactgcag

SEQ ID NO: 132228 - DNA, 20 bp, human
ggaggcccagactcccgtgt

SEQ ID NO: 132229 - DNA, 20 bp, human
gctgcaaggctcaagtctca

SEQ ID NO: 132230 - DNA, 20 bp, human
gggagaggtagaggagctca

SEQ ID NO: 132231 - DNA, 20 bp, human
gccttgtactggacagaatc

SEQ ID NO: 132232 - DNA, 20 bp, human
gaggacatctggagatcctg

SEQ ID NO: 132233 - DNA, 20 bp, human
gtaacccaggttcacgaggt

SEQ ID NO: 132234 - DNA, 20 bp, human
gcgtgcctggcttgaactca

SEQ ID NO: 132235 - DNA, 20 bp, human
gcgttcccagactcacaggc

SEQ ID NO: 132236 - DNA, 20 bp, human
gcacagccacagagcctcaa

SEQ ID NO: 132237 - DNA, 20 bp, human
ggcctaggacgcttggtcaa

SEQ ID NO: 132238 - DNA, 20 bp, human
ggcggctcagaaagatctct

SEQ ID NO: 132239 - DNA, 20 bp, human
gtcccggctaaaggacgagg

SEQ ID NO: 132240 - DNA, 20 bp, human
gggctcccggctaaaggacg

SEQ ID NO: 132241 - DNA, 20 bp, human
gtgattggggcggggatcca

SEQ ID NO: 132242 - DNA, 20 bp, human
gaagggaaagagtagtgaga

SEQ ID NO: 132243 - DNA, 20 bp, human
gctttgcctttgaggctctg

SEQ ID NO: 132244 - DNA, 20 bp, human
gcaaccatttgggcacagaa

SEQ ID NO: 132245 - DNA, 20 bp, human
gtcccctgcggagcagagct

SEQ ID NO: 132246 - DNA, 20 bp, human
gccgggagcgagtgcaggga

SEQ ID NO: 132247 - DNA, 20 bp, human
ggccgccgggagcgagtgca

SEQ ID NO: 132248 - DNA, 20 bp, human
gcctggagccttagcggcgg

SEQ ID NO: 132249 - DNA, 20 bp, human
gggtgacgcgaagagccgcc

SEQ ID NO: 132250 - DNA, 20 bp, human
ggcacctggagccttagcgg

SEQ ID NO: 132251 - DNA, 20 bp, human
ggccccaggtactcacgctg

SEQ ID NO: 132252 - DNA, 20 bp, human
gagggcaggttaagagagtg

SEQ ID NO: 132253 - DNA, 20 bp, human
gggtactcacgctgcggtag

SEQ ID NO: 132254 - DNA, 20 bp, human
gaccgcagcgtgagtacctg

SEQ ID NO: 132255 - DNA, 20 bp, human
gcgcgtcacccccgccgcta

SEQ ID NO: 132256 - DNA, 20 bp, human
gtgacttctggacgtggtca

SEQ ID NO: 132257 - DNA, 20 bp, human
gttcagcgagatggaaggaa

SEQ ID NO: 132258 - DNA, 20 bp, human
gtgagggtcttggcagacag

SEQ ID NO: 132259 - DNA, 20 bp, human
gacacactgacttctggacg

SEQ ID NO: 132260 - DNA, 20 bp, human
gggctggatgctatagacgc

SEQ ID NO: 132261 - DNA, 20 bp, human
gcttccttcagcgagatgga

SEQ ID NO: 132262 - DNA, 20 bp, human
gcccagtacacagcaagggg

SEQ ID NO: 132263 - DNA, 20 bp, human
gacatcgaggacagtaagta

SEQ ID NO: 132264 - DNA, 20 bp, human
gacttggtgctcgtgcaagg

SEQ ID NO: 132265 - DNA, 20 bp, human
gcgatgtcccaggggaggat

SEQ ID NO: 132266 - DNA, 20 bp, human
gagctgtgacgacgcggccc

SEQ ID NO: 132267 - DNA, 20 bp, human
gttccgggctccgactccct

SEQ ID NO: 132268 - DNA, 20 bp, human
gggctccgggagcgccccta

SEQ ID NO: 132269 - DNA, 20 bp, human
gcggaagctggagccacctg

SEQ ID NO: 132270 - DNA, 20 bp, human
gccgctcactcacccgcagg

SEQ ID NO: 132271 - DNA, 20 bp, human
ggagcgtacgggaagtgagg

SEQ ID NO: 132272 - DNA, 20 bp, human
ggggagcgcccctagggagt

SEQ ID NO: 132273 - DNA, 20 bp, human
gacaaggttgagcgagtcgt

SEQ ID NO: 132274 - DNA, 20 bp, human
gcgggaagtgaagagcgtac

SEQ ID NO: 132275 - DNA, 20 bp, human
ggaagagcgtacgggaagtg

SEQ ID NO: 132276 - DNA, 20 bp, human
gcagctcggccaaaaacctt

SEQ ID NO: 132277 - DNA, 20 bp, human
gcccacagctggtgatatgg

SEQ ID NO: 132278 - DNA, 20 bp, human
ggactaagaaccatcctgag

SEQ ID NO: 132279 - DNA, 20 bp, human
gcagcccctcacagcaccat

SEQ ID NO: 132280 - DNA, 20 bp, human
gatggttcttagtctctcca

SEQ ID NO: 132281 - DNA, 20 bp, human
gggccgagctgggtttatct

SEQ ID NO: 132282 - DNA, 20 bp, human
ggggccctactgaggaatca

SEQ ID NO: 132283 - DNA, 20 bp, human
gcctccctggcgatcttctg

SEQ ID NO: 132284 - DNA, 20 bp, human
gctcagagggggccctactg

SEQ ID NO: 132285 - DNA, 20 bp, human
gtgggccccagaagatcgcc

SEQ ID NO: 132286 - DNA, 20 bp, human
gcttagttgccggagctgaa

SEQ ID NO: 132287 - DNA, 20 bp, human
gcaaagagctggcaggagac

SEQ ID NO: 132288 - DNA, 20 bp, human
ggctccgcgccgttcagctc

SEQ ID NO: 132289 - DNA, 20 bp, human
gttgccggagctgaacggcg

SEQ ID NO: 132290 - DNA, 20 bp, human
ggcgcggcgcgcttagttgc

SEQ ID NO: 132291 - DNA, 20 bp, human
gagcggcgctttttacgacg

SEQ ID NO: 132292 - DNA, 20 bp, human
ggccctcgcggctctcgtta

SEQ ID NO: 132293 - DNA, 20 bp, human
gcaggcggcccaccttggag

SEQ ID NO: 132294 - DNA, 20 bp, human
gctgaggcctagagggaacg

SEQ ID NO: 132295 - DNA, 20 bp, human
ggccttaacgagagccgcga

SEQ ID NO: 132296 - DNA, 20 bp, human
gagggcccggatggacggag

SEQ ID NO: 132297 - DNA, 20 bp, human
ggcggaaccggagctccggg

SEQ ID NO: 132298 - DNA, 20 bp, human
ggggcacggagggacaaccc

SEQ ID NO: 132299 - DNA, 20 bp, human
gcccaagtggacccgaggag

SEQ ID NO: 132300 - DNA, 20 bp, human
gcgggcccagcggggatgga

SEQ ID NO: 132301 - DNA, 20 bp, human
ggacgcagggcccggatgga

SEQ ID NO: 132302 - DNA, 20 bp, human
gcacggagggacaacccggg

SEQ ID NO: 132303 - DNA, 20 bp, human
gagcggcgcgagaggcgacg

SEQ ID NO: 132304 - DNA, 20 bp, human
ggctgcggaaccggagctcc

SEQ ID NO: 132305 - DNA, 20 bp, human
gcgaggccaggcccgagacg

SEQ ID NO: 132306 - DNA, 20 bp, human
gcgcgagcgaggccgtggga

SEQ ID NO: 132307 - DNA, 20 bp, human
gggagccgcagtccgagggt

SEQ ID NO: 132308 - DNA, 20 bp, human
ggcgctgtgagaggcggtag

SEQ ID NO: 132309 - DNA, 20 bp, human
ggcgcaggcgctgtgagagg

SEQ ID NO: 132310 - DNA, 20 bp, human
gggaaggagccgcagtccga

SEQ ID NO: 132311 - DNA, 20 bp, human
gtatcggcggcagctgtgag

SEQ ID NO: 132312 - DNA, 20 bp, human
ggactcctgacaggttctgg

SEQ ID NO: 132313 - DNA, 20 bp, human
gagcagaggactcaagacaa

SEQ ID NO: 132314 - DNA, 20 bp, human
ggccgcgcaggcgctgtgag

SEQ ID NO: 132315 - DNA, 20 bp, human
ggtctcgtggaggtccaccg

SEQ ID NO: 132316 - DNA, 20 bp, human
gggccccaggcacactgcat

SEQ ID NO: 132317 - DNA, 20 bp, human
gcatgcccggcagcgagcga

SEQ ID NO: 132318 - DNA, 20 bp, human
gcggccgctcctaccaccct

SEQ ID NO: 132319 - DNA, 20 bp, human
ggctcggctcggggagaaaa

SEQ ID NO: 132320 - DNA, 20 bp, human
gctgcccagggtggtaggag

SEQ ID NO: 132321 - DNA, 20 bp, human
gcatcgggcagacccgccgg

SEQ ID NO: 132322 - DNA, 20 bp, human
ggcagacccgccggaggagg

SEQ ID NO: 132323 - DNA, 20 bp, human
gcggtgttgcaaagtcaggg

SEQ ID NO: 132324 - DNA, 20 bp, human
ggtttgcagccacctcgccg

SEQ ID NO: 132325 - DNA, 20 bp, human
gcgaggtggctgcaaactcg

SEQ ID NO: 132326 - DNA, 20 bp, human
gcggatcgagaggaaggtcg

SEQ ID NO: 132327 - DNA, 20 bp, human
gtggcccgtgggataccaag

SEQ ID NO: 132328 - DNA, 20 bp, human
ggaggattacaggagatcag

SEQ ID NO: 132329 - DNA, 20 bp, human
gccccggcctcgggttccag

SEQ ID NO: 132330 - DNA, 20 bp, human
gcggtggccggaccctcccg

SEQ ID NO: 132331 - DNA, 20 bp, human
gggcgggcggatcgagagga

SEQ ID NO: 132332 - DNA, 20 bp, human
gcagggggtgagccctcctc

SEQ ID NO: 132333 - DNA, 20 bp, human
gaggagggctgggcacttag

SEQ ID NO: 132334 - DNA, 20 bp, human
gggtactcgtccaggctcat

SEQ ID NO: 132335 - DNA, 20 bp, human
gccggcactgcgcctcggga

SEQ ID NO: 132336 - DNA, 20 bp, human
ggcctcagctctgggaagta

SEQ ID NO: 132337 - DNA, 20 bp, human
gggtggacggccttacctgt

SEQ ID NO: 132338 - DNA, 20 bp, human
ggtgctactgcacaggtgga

SEQ ID NO: 132339 - DNA, 20 bp, human
gtagggtgctactgcacagg

SEQ ID NO: 132340 - DNA, 20 bp, human
gaagtagggtgctactgcac

SEQ ID NO: 132341 - DNA, 20 bp, human
gcttctcagacccacaggta

SEQ ID NO: 132342 - DNA, 20 bp, human
gcctcaaactccaaaggcca

SEQ ID NO: 132343 - DNA, 20 bp, human
gcaaactccaaaggccaggg

SEQ ID NO: 132344 - DNA, 20 bp, human
gccgtaccctcaaactccaa

SEQ ID NO: 132345 - DNA, 20 bp, human
gaaggccagggtggcctgca

SEQ ID NO: 132346 - DNA, 20 bp, human
ggcgcacagacaccacatgt

SEQ ID NO: 132347 - DNA, 20 bp, human
gataatggtgctgaacgcaa

SEQ ID NO: 132348 - DNA, 20 bp, human
gcagttccccatcgacggga

SEQ ID NO: 132349 - DNA, 20 bp, human
gggtactcctccacggtcat

SEQ ID NO: 132350 - DNA, 20 bp, human
gctgaaacataggaaaacat

SEQ ID NO: 132351 - DNA, 20 bp, human
ggcgatgcggtactcctcca

SEQ ID NO: 132352 - DNA, 20 bp, human
gaaacatagggataacgtct

SEQ ID NO: 132353 - DNA, 20 bp, human
gtcgatggggaactgcaagt

SEQ ID NO: 132354 - DNA, 20 bp, human
gcatcgtgcctagaggccag

SEQ ID NO: 132355 - DNA, 20 bp, human
gcctccacggtcattggcag

SEQ ID NO: 132356 - DNA, 20 bp, human
gtgcagagggctcccaacgg

SEQ ID NO: 132357 - DNA, 20 bp, human
ggaccgcctccggccccgaa

SEQ ID NO: 132358 - DNA, 20 bp, human
gactcgcgcgtctagaggag

SEQ ID NO: 132359 - DNA, 20 bp, human
gaggcgggccgtgcaggtga

SEQ ID NO: 132360 - DNA, 20 bp, human
ggcgcccccggtcacctcgg

SEQ ID NO: 132361 - DNA, 20 bp, human
gggcgctcggagtccgttcg

SEQ ID NO: 132362 - DNA, 20 bp, human
gggcggcagccgaggcgagc

SEQ ID NO: 132363 - DNA, 20 bp, human
gggccgcgggacatcccctt

SEQ ID NO: 132364 - DNA, 20 bp, human
ggtgtcccccgaggtgaccg

SEQ ID NO: 132365 - DNA, 20 bp, human
ggcagccgaggcgagcgggg

SEQ ID NO: 132366 - DNA, 20 bp, human
gggcgggtgagacgctgcga

SEQ ID NO: 132367 - DNA, 20 bp, human
gcgctcggcgcgctggtacc

SEQ ID NO: 132368 - DNA, 20 bp, human
ggtgctcgtcatgcgcaatg

SEQ ID NO: 132369 - DNA, 20 bp, human
gcagccgcctcagcacacac

SEQ ID NO: 132370 - DNA, 20 bp, human
gcgagtccttaagagacccg

SEQ ID NO: 132371 - DNA, 20 bp, human
gggtgagacgctgcgacggg

SEQ ID NO: 132372 - DNA, 20 bp, human
gcatgcgcaatgtggcgctg

SEQ ID NO: 132373 - DNA, 20 bp, human
ggcgcgctggtacccgggag

SEQ ID NO: 132374 - DNA, 20 bp, human
gggcctcggagcctcggatg

SEQ ID NO: 132375 - DNA, 20 bp, human
gcgcatgacgagcacctggc

SEQ ID NO: 132376 - DNA, 20 bp, human
gcggtttctaaggctccgga

SEQ ID NO: 132377 - DNA, 20 bp, human
gccatggacgccttcaaggg

SEQ ID NO: 132378 - DNA, 20 bp, human
ggatccggggccggtttcta

SEQ ID NO: 132379 - DNA, 20 bp, human
gaggcgggccccatgtcatg

SEQ ID NO: 132380 - DNA, 20 bp, human
gctaaggctccggacggcgc

SEQ ID NO: 132381 - DNA, 20 bp, human
gagactctgccggcgccgtc

SEQ ID NO: 132382 - DNA, 20 bp, human
gcgcagggactgctggaacc

SEQ ID NO: 132383 - DNA, 20 bp, human
gcgctggcggagttctcgag

SEQ ID NO: 132384 - DNA, 20 bp, human
gccgcaggtcgcagccaggg

SEQ ID NO: 132385 - DNA, 20 bp, human
gcctccatggacgccttcaa

SEQ ID NO: 132386 - DNA, 20 bp, human
ggagcgacggaccagatctg

SEQ ID NO: 132387 - DNA, 20 bp, human
ggcgcacacgcacacccctc

SEQ ID NO: 132388 - DNA, 20 bp, human
gaggctcaagcgaaaaagtc

SEQ ID NO: 132389 - DNA, 20 bp, human
gtccggagacggaaagtcag

SEQ ID NO: 132390 - DNA, 20 bp, human
gagcgggcaaacgaagacat

SEQ ID NO: 132391 - DNA, 20 bp, human
gacatgggatgtgggcagaa

SEQ ID NO: 132392 - DNA, 20 bp, human
gtgcccccgtctcctccgga

SEQ ID NO: 132393 - DNA, 20 bp, human
gaagcgcggagccgcagatc

SEQ ID NO: 132394 - DNA, 20 bp, human
gtctggtccgtcgctcgcct

SEQ ID NO: 132395 - DNA, 20 bp, human
ggcttggcttgagaactcgg

SEQ ID NO: 132396 - DNA, 20 bp, human
gggagtccacgggtgcactg

SEQ ID NO: 132397 - DNA, 20 bp, human
gcaagttccgaaggagtcca

SEQ ID NO: 132398 - DNA, 20 bp, human
gcagggtgctgaagtcgaga

SEQ ID NO: 132399 - DNA, 20 bp, human
gtccgaaatctagccgccac

SEQ ID NO: 132400 - DNA, 20 bp, human
gcgagaccgagcgagaaagc

SEQ ID NO: 132401 - DNA, 20 bp, human
ggcgggggacgaaaggaaca

SEQ ID NO: 132402 - DNA, 20 bp, human
gcccggtagccggtaagtgg

SEQ ID NO: 132403 - DNA, 20 bp, human
gtgagggtgccaagttccga

SEQ ID NO: 132404 - DNA, 20 bp, human
gcacatccctgcgggataga

SEQ ID NO: 132405 - DNA, 20 bp, human
gagggaagccagaccgtggc

SEQ ID NO: 132406 - DNA, 20 bp, human
ggcgctcctggactctcgga

SEQ ID NO: 132407 - DNA, 20 bp, human
gaaagcgccctggaatccca

SEQ ID NO: 132408 - DNA, 20 bp, human
gcttcgcgaggcagggagta

SEQ ID NO: 132409 - DNA, 20 bp, human
gcaggagcgcccgagcggag

SEQ ID NO: 132410 - DNA, 20 bp, human
gggctgggggtggcagtacg

SEQ ID NO: 132411 - DNA, 20 bp, human
gtcgggcgctcctggactct

SEQ ID NO: 132412 - DNA, 20 bp, human
gagacttgaaaccaggatag

SEQ ID NO: 132413 - DNA, 20 bp, human
gggggtggcagtacgcggtg

SEQ ID NO: 132414 - DNA, 20 bp, human
ggctgcggcggcgatctaga

SEQ ID NO: 132415 - DNA, 20 bp, human
ggggcacccggccggagtgg

SEQ ID NO: 132416 - DNA, 20 bp, human
gagggcagcggtccaaggtg

SEQ ID NO: 132417 - DNA, 20 bp, human
gaggaccaggactagggcga

SEQ ID NO: 132418 - DNA, 20 bp, human
ggggcgagggcagcggtcca

SEQ ID NO: 132419 - DNA, 20 bp, human
gcggcgcggagggatctccg

SEQ ID NO: 132420 - DNA, 20 bp, human
gatctccgcgggagccgttg

SEQ ID NO: 132421 - DNA, 20 bp, human
ggccatacgcccagtaacgg

SEQ ID NO: 132422 - DNA, 20 bp, human
gtgaggtgctaggtgtgcgg

SEQ ID NO: 132423 - DNA, 20 bp, human
gcgtatggcgtacagacacg

SEQ ID NO: 132424 - DNA, 20 bp, human
ggtccttgcacctcagcccg

SEQ ID NO: 132425 - DNA, 20 bp, human
gtggcgtacagacacgaggc

SEQ ID NO: 132426 - DNA, 20 bp, human
ggcgcggagctgggcgactg

SEQ ID NO: 132427 - DNA, 20 bp, human
gccagaagcaaggcccccga

SEQ ID NO: 132428 - DNA, 20 bp, human
gtggggagcgaacccaggac

SEQ ID NO: 132429 - DNA, 20 bp, human
gcacgcacccagggatgcga

SEQ ID NO: 132430 - DNA, 20 bp, human
gtgagtactggccccggttg

SEQ ID NO: 132431 - DNA, 20 bp, human
gctcgcgcacaggtgagtac

SEQ ID NO: 132432 - DNA, 20 bp, human
gtgagctcggtcttcccctg

SEQ ID NO: 132433 - DNA, 20 bp, human
gctggagcatgtgggccccg

SEQ ID NO: 132434 - DNA, 20 bp, human
gctgcctccctcgcatccct

SEQ ID NO: 132435 - DNA, 20 bp, human
ggcaggccagggtcgctcgg

SEQ ID NO: 132436 - DNA, 20 bp, human
ggtgtgcttaccaaacaact

SEQ ID NO: 132437 - DNA, 20 bp, human
ggaagtggccggcgtcatca

SEQ ID NO: 132438 - DNA, 20 bp, human
gtttaaagggaggatttgga

SEQ ID NO: 132439 - DNA, 20 bp, human
gggtttttaaagggaggatt

SEQ ID NO: 132440 - DNA, 20 bp, human
gcggccaaagcggtttttaa

SEQ ID NO: 132441 - DNA, 20 bp, human
gcaaagcggtttttaaaggg

SEQ ID NO: 132442 - DNA, 20 bp, human
gcgccggccacttccacaga

SEQ ID NO: 132443 - DNA, 20 bp, human
gtggccggcgtcatcatggc

SEQ ID NO: 132444 - DNA, 20 bp, human
ggcaaaagaggcagggggac

SEQ ID NO: 132445 - DNA, 20 bp, human
ggaggtgcatggttcgtatc

SEQ ID NO: 132446 - DNA, 20 bp, human
gccccggccgaacacgtcca

SEQ ID NO: 132447 - DNA, 20 bp, human
gcacgtccacggtcacatgt

SEQ ID NO: 132448 - DNA, 20 bp, human
gggaccggcccaagagcata

SEQ ID NO: 132449 - DNA, 20 bp, human
gcacatgttggctcagttgg

SEQ ID NO: 132450 - DNA, 20 bp, human
gggtctgggcccagcaccac

SEQ ID NO: 132451 - DNA, 20 bp, human
ggctcagttggtggtagtag

SEQ ID NO: 132452 - DNA, 20 bp, human
gggcctggcgctcgtcccag

SEQ ID NO: 132453 - DNA, 20 bp, human
ggcagccggtgcccgaaatt

SEQ ID NO: 132454 - DNA, 20 bp, human
gggcacaaagcgctcgtagt

SEQ ID NO: 132455 - DNA, 20 bp, human
ggtgtgccaggctgtacaga

SEQ ID NO: 132456 - DNA, 20 bp, human
ggcggctctggcggtcgtgg

SEQ ID NO: 132457 - DNA, 20 bp, human
gtccgcaaaggggccgagga

SEQ ID NO: 132458 - DNA, 20 bp, human
ggcagcggctctggcggtcg

SEQ ID NO: 132459 - DNA, 20 bp, human
ggctattgggagggcagtgg

SEQ ID NO: 132460 - DNA, 20 bp, human
gccctttgcggagcactccg

SEQ ID NO: 132461 - DNA, 20 bp, human
gggaccgcgccacaccaaag

SEQ ID NO: 132462 - DNA, 20 bp, human
gcgcccgccccgctgctgtc

SEQ ID NO: 132463 - DNA, 20 bp, human
gcgggggaggagctcgggac

SEQ ID NO: 132464 - DNA, 20 bp, human
gatcgctattgggagggcag

SEQ ID NO: 132465 - DNA, 20 bp, human
gggcgcggtccccactcgag

SEQ ID NO: 132466 - DNA, 20 bp, human
gtctctagcttcggaaggag

SEQ ID NO: 132467 - DNA, 20 bp, human
ggccgcttcgcgttcggcgg

SEQ ID NO: 132468 - DNA, 20 bp, human
gctgctgcgccggccatggt

SEQ ID NO: 132469 - DNA, 20 bp, human
ggccgctgcacatttcggtg

SEQ ID NO: 132470 - DNA, 20 bp, human
gacccccacactcccgacag

SEQ ID NO: 132471 - DNA, 20 bp, human
gtgtacagtggcgagtgtag

SEQ ID NO: 132472 - DNA, 20 bp, human
gacgggaaaccgcagaaggt

SEQ ID NO: 132473 - DNA, 20 bp, human
gtcgagcgctgttctcgctc

SEQ ID NO: 132474 - DNA, 20 bp, human
ggagttggaggcggagaaga

SEQ ID NO: 132475 - DNA, 20 bp, human
gctccttggccaagtcacca

SEQ ID NO: 132476 - DNA, 20 bp, human
gtggcacaggaagagatcat

SEQ ID NO: 132477 - DNA, 20 bp, human
ggcacaggacatggccgagg

SEQ ID NO: 132478 - DNA, 20 bp, human
ggaccagcttgcacaggaca

SEQ ID NO: 132479 - DNA, 20 bp, human
ggccggcggggtcagttcag

SEQ ID NO: 132480 - DNA, 20 bp, human
gaccaggagaaacctggcac

SEQ ID NO: 132481 - DNA, 20 bp, human
gctaggatgtgggctcactc

SEQ ID NO: 132482 - DNA, 20 bp, human
gcttgcacaggacatggccg

SEQ ID NO: 132483 - DNA, 20 bp, human
gtcatggggtcttggcccag

SEQ ID NO: 132484 - DNA, 20 bp, human
gcgagtggaggccctgtacc

SEQ ID NO: 132485 - DNA, 20 bp, human
gtggaggccctgtaccagga

SEQ ID NO: 132486 - DNA, 20 bp, human
gccttcctctggcttaacag

SEQ ID NO: 132487 - DNA, 20 bp, human
gtcaggacgaaggcacccag

SEQ ID NO: 132488 - DNA, 20 bp, human
ggccaccactgttaagccag

SEQ ID NO: 132489 - DNA, 20 bp, human
gaagagcgagctccatccag

SEQ ID NO: 132490 - DNA, 20 bp, human
ggcagtgggcttggtactcc

SEQ ID NO: 132491 - DNA, 20 bp, human
ggaatggaaccacggagggt

SEQ ID NO: 132492 - DNA, 20 bp, human
gcagctctgggcatcacgga

SEQ ID NO: 132493 - DNA, 20 bp, human
gtaatccacaacacaaccaa

SEQ ID NO: 132494 - DNA, 20 bp, human
gcacggaaggtgcgtccgag

SEQ ID NO: 132495 - DNA, 20 bp, human
gctcccaggacagggaatgg

SEQ ID NO: 132496 - DNA, 20 bp, human
gatacccaggtaagaccctg

SEQ ID NO: 132497 - DNA, 20 bp, human
gttgctaacagacaaatcaa

SEQ ID NO: 132498 - DNA, 20 bp, human
gaggtaagttaactttagat

SEQ ID NO: 132499 - DNA, 20 bp, human
ggaaccccagggtcttacct

SEQ ID NO: 132500 - DNA, 20 bp, human
gtcataaacactgaacccca

SEQ ID NO: 132501 - DNA, 20 bp, human
ggatctcatccgggactatc

SEQ ID NO: 132502 - DNA, 20 bp, human
gggtaatgaagtaaagtgac

SEQ ID NO: 132503 - DNA, 20 bp, human
gtccttcttccagatagtcc

SEQ ID NO: 132504 - DNA, 20 bp, human
gctagctcatatttggaaca

SEQ ID NO: 132505 - DNA, 20 bp, human
ggaagttcaagatctcatcc

SEQ ID NO: 132506 - DNA, 20 bp, human
gcggcgggcgccgggaagaa

SEQ ID NO: 132507 - DNA, 20 bp, human
ggaaaggaacatggctcctg

SEQ ID NO: 132508 - DNA, 20 bp, human
gcctcggccgtgagctccgt

SEQ ID NO: 132509 - DNA, 20 bp, human
gaggcgcacagcgccgagcg

SEQ ID NO: 132510 - DNA, 20 bp, human
gtggacgtagagtggcgccc

SEQ ID NO: 132511 - DNA, 20 bp, human
gcaggccccgctgctcgcag

SEQ ID NO: 132512 - DNA, 20 bp, human
gcgactggagttcaccatcg

SEQ ID NO: 132513 - DNA, 20 bp, human
gtcactggcgtccggcgcgc

SEQ ID NO: 132514 - DNA, 20 bp, human
gagttcaccatcgcggtcac

SEQ ID NO: 132515 - DNA, 20 bp, human
ggccgggagcacgacgagag

SEQ ID NO: 132516 - DNA, 20 bp, human
gggtgcccactctcagctag

SEQ ID NO: 132517 - DNA, 20 bp, human
gggtcatgcagcactaccat

SEQ ID NO: 132518 - DNA, 20 bp, human
gcatcagaggtaccagatag

SEQ ID NO: 132519 - DNA, 20 bp, human
gtcttcctctagctgagagt

SEQ ID NO: 132520 - DNA, 20 bp, human
gggagaactgtccccctatc

SEQ ID NO: 132521 - DNA, 20 bp, human
gatatctgtcaaggcatcag

SEQ ID NO: 132522 - DNA, 20 bp, human
gggaatgtgatctgaagaag

SEQ ID NO: 132523 - DNA, 20 bp, human
gaccccaaagtgacaccgaa

SEQ ID NO: 132524 - DNA, 20 bp, human
gagaggccccgtgctggaga

SEQ ID NO: 132525 - DNA, 20 bp, human
gctgggatattagaatcagg

SEQ ID NO: 132526 - DNA, 20 bp, human
ggcggtgaggggtcctctta

SEQ ID NO: 132527 - DNA, 20 bp, human
ggtggcaccgaggcggtgag

SEQ ID NO: 132528 - DNA, 20 bp, human
gcatggctgaggcgtcacgg

SEQ ID NO: 132529 - DNA, 20 bp, human
gcgtcacggtggcaccgagg

SEQ ID NO: 132530 - DNA, 20 bp, human
ggtgtagtgcaggtccgcca

SEQ ID NO: 132531 - DNA, 20 bp, human
gcctcaggcgaacgaacggg

SEQ ID NO: 132532 - DNA, 20 bp, human
gcggcctcaggcgaacgaac

SEQ ID NO: 132533 - DNA, 20 bp, human
gcgccatggctgaggcgtca

SEQ ID NO: 132534 - DNA, 20 bp, human
gaggcgtcacggtggcaccg

SEQ ID NO: 132535 - DNA, 20 bp, human
gtgcaggtccgccatggctg

SEQ ID NO: 132536 - DNA, 20 bp, human
gatccgggcgcgctacgagg

SEQ ID NO: 132537 - DNA, 20 bp, human
ggcccggagccaggtccatc

SEQ ID NO: 132538 - DNA, 20 bp, human
gtgtccggcgcgcagtacat

SEQ ID NO: 132539 - DNA, 20 bp, human
gcccctcgcgggcgacacat

SEQ ID NO: 132540 - DNA, 20 bp, human
gcggagcgaagagcacgttg

SEQ ID NO: 132541 - DNA, 20 bp, human
gcacgcagctgcccagatcg

SEQ ID NO: 132542 - DNA, 20 bp, human
gcggcggcgcctgatggacc

SEQ ID NO: 132543 - DNA, 20 bp, human
gacaggggccgggcccaagg

SEQ ID NO: 132544 - DNA, 20 bp, human
gcagcccgcgcgcatggccc

SEQ ID NO: 132545 - DNA, 20 bp, human
gctggggcgccgtcggacag

SEQ ID NO: 132546 - DNA, 20 bp, human
gcaggcccacgcccagaagg

SEQ ID NO: 132547 - DNA, 20 bp, human
gagccgcacggaccacgtca

SEQ ID NO: 132548 - DNA, 20 bp, human
gcgcccagaaggaggagagc

SEQ ID NO: 132549 - DNA, 20 bp, human
ggtgccccgcgaggaaccgg

SEQ ID NO: 132550 - DNA, 20 bp, human
gcgggaggcggccgacgctc

SEQ ID NO: 132551 - DNA, 20 bp, human
gaggcccaggccaggcgccc

SEQ ID NO: 132552 - DNA, 20 bp, human
gctccctgacgtggtccgtg

SEQ ID NO: 132553 - DNA, 20 bp, human
gctgggccgcagactgagga

SEQ ID NO: 132554 - DNA, 20 bp, human
gcgcgctgggccgcagactg

SEQ ID NO: 132555 - DNA, 20 bp, human
ggcgccggcccaggagaagc

SEQ ID NO: 132556 - DNA, 20 bp, human
ggagtgagttacctgcgtgg

SEQ ID NO: 132557 - DNA, 20 bp, human
gcagcctgcagccaccacgc

SEQ ID NO: 132558 - DNA, 20 bp, human
ggctgggacacaaacgagtt

SEQ ID NO: 132559 - DNA, 20 bp, human
gaatccgtggacatgttatc

SEQ ID NO: 132560 - DNA, 20 bp, human
gcgtgagtgagttacctgcg

SEQ ID NO: 132561 - DNA, 20 bp, human
gtctctctgtcaagaatccg

SEQ ID NO: 132562 - DNA, 20 bp, human
gtaaccagataacatgtcca

SEQ ID NO: 132563 - DNA, 20 bp, human
gttctcctttgggacatcga

SEQ ID NO: 132564 - DNA, 20 bp, human
gtaacgttctggtgaacaaa

SEQ ID NO: 132565 - DNA, 20 bp, human
gttacctgcgtggtggctgc

SEQ ID NO: 132566 - DNA, 20 bp, human
ggccagcgagtcgcagtccc

SEQ ID NO: 132567 - DNA, 20 bp, human
gtcgcagctggctctagtgc

SEQ ID NO: 132568 - DNA, 20 bp, human
gcagctctcccgggacgaag

SEQ ID NO: 132569 - DNA, 20 bp, human
gtagagccagctgcgagcgg

SEQ ID NO: 132570 - DNA, 20 bp, human
ggaatgatgaaatctcccac

SEQ ID NO: 132571 - DNA, 20 bp, human
ggtgctggagctcggctcct

SEQ ID NO: 132572 - DNA, 20 bp, human
gtggctctagtgctggagct

SEQ ID NO: 132573 - DNA, 20 bp, human
gcattgaaaagccagttctg

SEQ ID NO: 132574 - DNA, 20 bp, human
gtcactttgtgggtgccggt

SEQ ID NO: 132575 - DNA, 20 bp, human
ggtgccgcggatcccagcac

SEQ ID NO: 132576 - DNA, 20 bp, human
ggagctgaccgagcactcgg

SEQ ID NO: 132577 - DNA, 20 bp, human
gtgcagcacggagggaagaa

SEQ ID NO: 132578 - DNA, 20 bp, human
gtcatgcagccggagctccg

SEQ ID NO: 132579 - DNA, 20 bp, human
gattcgcgtagacagtgaag

SEQ ID NO: 132580 - DNA, 20 bp, human
gatactcaagcgaaggtaaa

SEQ ID NO: 132581 - DNA, 20 bp, human
ggtgctcggtcagctcgcgc

SEQ ID NO: 132582 - DNA, 20 bp, human
gcaactaggatggaaatgtt

SEQ ID NO: 132583 - DNA, 20 bp, human
gcgcgaatctggcactgaaa

SEQ ID NO: 132584 - DNA, 20 bp, human
gctgctggcaggtggggcgc

SEQ ID NO: 132585 - DNA, 20 bp, human
gaatgtggtgatccgtcccg

SEQ ID NO: 132586 - DNA, 20 bp, human
gtcccggtggactgtagagg

SEQ ID NO: 132587 - DNA, 20 bp, human
ggcatcccggtggactgtag

SEQ ID NO: 132588 - DNA, 20 bp, human
gtgtgacaggaggtcatcaa

SEQ ID NO: 132589 - DNA, 20 bp, human
gagacgcggccgcatcccgg

SEQ ID NO: 132590 - DNA, 20 bp, human
gcagcccagtagctcagacg

SEQ ID NO: 132591 - DNA, 20 bp, human
gctcagacgcggccgcatcc

SEQ ID NO: 132592 - DNA, 20 bp, human
ggcggcccggagctgcgact

SEQ ID NO: 132593 - DNA, 20 bp, human
gcggccgcgtctgagctact

SEQ ID NO: 132594 - DNA, 20 bp, human
ggtgggacttgggaagtcgg

SEQ ID NO: 132595 - DNA, 20 bp, human
ggagcccgagtcgcagctcc

SEQ ID NO: 132596 - DNA, 20 bp, human
ggcaatctggctcacactga

SEQ ID NO: 132597 - DNA, 20 bp, human
gctggaggctctctccgtga

SEQ ID NO: 132598 - DNA, 20 bp, human
ggccttaaacaaaagctgag

SEQ ID NO: 132599 - DNA, 20 bp, human
ggaaaaggcttggttaagaa

SEQ ID NO: 132600 - DNA, 20 bp, human
gatgactgacgtggagtctg

SEQ ID NO: 132601 - DNA, 20 bp, human
gaggctctctccgtgaagga

SEQ ID NO: 132602 - DNA, 20 bp, human
ggtctggtaaggcattccgg

SEQ ID NO: 132603 - DNA, 20 bp, human
gaaatctgaggttccgtctg

SEQ ID NO: 132604 - DNA, 20 bp, human
gagagagcctccagtttgag

SEQ ID NO: 132605 - DNA, 20 bp, human
ggctagatcaaaaacacaac

SEQ ID NO: 132606 - DNA, 20 bp, human
gtcggcagcccaggtcgcca

SEQ ID NO: 132607 - DNA, 20 bp, human
gcggctgagggacaaagatc

SEQ ID NO: 132608 - DNA, 20 bp, human
gcaggtgagcaggagccggg

SEQ ID NO: 132609 - DNA, 20 bp, human
gcccgttgccttggcgacct

SEQ ID NO: 132610 - DNA, 20 bp, human
ggcccaggtcgccaaggcaa

SEQ ID NO: 132611 - DNA, 20 bp, human
gaggtaagccctcaatacat

SEQ ID NO: 132612 - DNA, 20 bp, human
gcgggcgctaggctgccccg

SEQ ID NO: 132613 - DNA, 20 bp, human
gccctccccgggatccccgg

SEQ ID NO: 132614 - DNA, 20 bp, human
gcgcgagtgccgcgggagtt

SEQ ID NO: 132615 - DNA, 20 bp, human
ggcgctacggcggctcggat

SEQ ID NO: 132616 - DNA, 20 bp, human
gcacactgttgggttgtcag

SEQ ID NO: 132617 - DNA, 20 bp, human
gactgagtggtcaagaactt

SEQ ID NO: 132618 - DNA, 20 bp, human
gtgcgggaccatggaatgag

SEQ ID NO: 132619 - DNA, 20 bp, human
gaaggtgcggctggaatcgg

SEQ ID NO: 132620 - DNA, 20 bp, human
ggaagccagccagtagccag

SEQ ID NO: 132621 - DNA, 20 bp, human
gcagtagccaggggttggaa

SEQ ID NO: 132622 - DNA, 20 bp, human
ggacagaagccatggaacat

SEQ ID NO: 132623 - DNA, 20 bp, human
ggggtctgctccacactgtt

SEQ ID NO: 132624 - DNA, 20 bp, human
gacctcctggagccccaatc

SEQ ID NO: 132625 - DNA, 20 bp, human
gccagccagtagccaggggt

SEQ ID NO: 132626 - DNA, 20 bp, human
gcccggctagtgcggaatcc

SEQ ID NO: 132627 - DNA, 20 bp, human
gctccggcgctgaccgactc

SEQ ID NO: 132628 - DNA, 20 bp, human
gatcacgagggaccgagaga

SEQ ID NO: 132629 - DNA, 20 bp, human
gccgcagcgggataaccttg

SEQ ID NO: 132630 - DNA, 20 bp, human
gctgcaaagacgaagagatc

SEQ ID NO: 132631 - DNA, 20 bp, human
gacgaagagatccggagcca

SEQ ID NO: 132632 - DNA, 20 bp, human
gcagggcggcgcaggatcca

SEQ ID NO: 132633 - DNA, 20 bp, human
gagggtggaatcaatcacga

SEQ ID NO: 132634 - DNA, 20 bp, human
gggaggcgcattgaggattg

SEQ ID NO: 132635 - DNA, 20 bp, human
gacagcagctgcacgcgccg

SEQ ID NO: 132636 - DNA, 20 bp, human
gcccagcgcagctctccgaa

SEQ ID NO: 132637 - DNA, 20 bp, human
gtcactgctcacaggaccag

SEQ ID NO: 132638 - DNA, 20 bp, human
ggtcgagcaggatgttgata

SEQ ID NO: 132639 - DNA, 20 bp, human
ggaacagggtcactgctcac

SEQ ID NO: 132640 - DNA, 20 bp, human
ggactggagcagggacaacg

SEQ ID NO: 132641 - DNA, 20 bp, human
gtgggagtctacattctgat

SEQ ID NO: 132642 - DNA, 20 bp, human
gttgcctgctgtgtcggaga

SEQ ID NO: 132643 - DNA, 20 bp, human
ggaatcatgagggggttcgg

SEQ ID NO: 132644 - DNA, 20 bp, human
gtgtccttctccgacacagc

SEQ ID NO: 132645 - DNA, 20 bp, human
gcgcagctctccgaagggca

SEQ ID NO: 132646 - DNA, 20 bp, human
ggggcgtccggaacagtcga

SEQ ID NO: 132647 - DNA, 20 bp, human
gtcacgggagtcctccgccc

SEQ ID NO: 132648 - DNA, 20 bp, human
gggctgttgcagaagaagag

SEQ ID NO: 132649 - DNA, 20 bp, human
gtctccgggaggggcgagta

SEQ ID NO: 132650 - DNA, 20 bp, human
gacgggccgttccccctcac

SEQ ID NO: 132651 - DNA, 20 bp, human
ggcggaggactcccgtgagg

SEQ ID NO: 132652 - DNA, 20 bp, human
ggccctggcgaacagagcag

SEQ ID NO: 132653 - DNA, 20 bp, human
gaacagtcgacggcagactc

SEQ ID NO: 132654 - DNA, 20 bp, human
gggaggccacgggacccctc

SEQ ID NO: 132655 - DNA, 20 bp, human
gcacggaggaaggactgtca

SEQ ID NO: 132656 - DNA, 20 bp, human
gtctcctggagaactagaag

SEQ ID NO: 132657 - DNA, 20 bp, human
gactcgggtgacgatggcaa

SEQ ID NO: 132658 - DNA, 20 bp, human
gggcaggtggcgatgtggac

SEQ ID NO: 132659 - DNA, 20 bp, human
ggagtttgagggtgtagcag

SEQ ID NO: 132660 - DNA, 20 bp, human
gacctgcgtctggagtcccg

SEQ ID NO: 132661 - DNA, 20 bp, human
gttctcggcaggtggcgatg

SEQ ID NO: 132662 - DNA, 20 bp, human
gccagcgacgccgtgcaggt

SEQ ID NO: 132663 - DNA, 20 bp, human
gctcgctggctccacagtcc

SEQ ID NO: 132664 - DNA, 20 bp, human
gccaggcccggcggccgctg

SEQ ID NO: 132665 - DNA, 20 bp, human
gaacgggactcgggtgacga

SEQ ID NO: 132666 - DNA, 20 bp, human
ggcggaggccaataacccct

SEQ ID NO: 132667 - DNA, 20 bp, human
gccaatctgggagccccgaa

SEQ ID NO: 132668 - DNA, 20 bp, human
gggctacacccccaaaacta

SEQ ID NO: 132669 - DNA, 20 bp, human
gcccggacccaggatggcgg

SEQ ID NO: 132670 - DNA, 20 bp, human
gtgaaactatggcatcccga

SEQ ID NO: 132671 - DNA, 20 bp, human
gggtacaagtgagggaagat

SEQ ID NO: 132672 - DNA, 20 bp, human
gcatcctgggtccgggctga

SEQ ID NO: 132673 - DNA, 20 bp, human
gtcctgctccgaggggttat

SEQ ID NO: 132674 - DNA, 20 bp, human
ggagtatccagtgcccttcg

SEQ ID NO: 132675 - DNA, 20 bp, human
gcaggaccctgtagttttag

SEQ ID NO: 132676 - DNA, 20 bp, human
gcgcacggagaggcttgagg

SEQ ID NO: 132677 - DNA, 20 bp, human
gacgaacagtccggtgaggg

SEQ ID NO: 132678 - DNA, 20 bp, human
gtcgtctagtcgctccctct

SEQ ID NO: 132679 - DNA, 20 bp, human
gagcgactagacgaacagtc

SEQ ID NO: 132680 - DNA, 20 bp, human
gggagctagggcactcgtag

SEQ ID NO: 132681 - DNA, 20 bp, human
gctagacgaacagtccggtg

SEQ ID NO: 132682 - DNA, 20 bp, human
gctcacggaactgcaggtaa

SEQ ID NO: 132683 - DNA, 20 bp, human
ggcccgcacggagaggcttg

SEQ ID NO: 132684 - DNA, 20 bp, human
ggagagggtccggctcccca

SEQ ID NO: 132685 - DNA, 20 bp, human
ggctcctggcgtcgcccaga

SEQ ID NO: 132686 - DNA, 20 bp, human
ggccagcgggtctcgggagg

SEQ ID NO: 132687 - DNA, 20 bp, human
gcgcgggagccggccagtta

SEQ ID NO: 132688 - DNA, 20 bp, human
gtcctgagcgtccaaaccgg

SEQ ID NO: 132689 - DNA, 20 bp, human
gagccggccagttagggaca

SEQ ID NO: 132690 - DNA, 20 bp, human
gggctccggggcgatgacag

SEQ ID NO: 132691 - DNA, 20 bp, human
gcgcggcaggtgaacggcgt

SEQ ID NO: 132692 - DNA, 20 bp, human
gcgacccggcaaccttcagg

SEQ ID NO: 132693 - DNA, 20 bp, human
gggccagttagggacaggga

SEQ ID NO: 132694 - DNA, 20 bp, human
ggcaggtgaacggcgtggga

SEQ ID NO: 132695 - DNA, 20 bp, human
gcgtgaccgcgcctcacccc

SEQ ID NO: 132696 - DNA, 20 bp, human
gcgccgcactccgaaaggga

SEQ ID NO: 132697 - DNA, 20 bp, human
gcactccgaaagggacggtt

SEQ ID NO: 132698 - DNA, 20 bp, human
ggcgcgcgccgcactccgaa

SEQ ID NO: 132699 - DNA, 20 bp, human
gccagcgtcggcgtgacggt

SEQ ID NO: 132700 - DNA, 20 bp, human
ggtcaaatgcgggccctcga

SEQ ID NO: 132701 - DNA, 20 bp, human
gtggcccagcgtcggcgtga

SEQ ID NO: 132702 - DNA, 20 bp, human
gacaagcggctgcagcaatc

SEQ ID NO: 132703 - DNA, 20 bp, human
ggttgagtgacagcttacct

SEQ ID NO: 132704 - DNA, 20 bp, human
gccggccctccagacccggg

SEQ ID NO: 132705 - DNA, 20 bp, human
gaggagcgcgcgcttcgatc

SEQ ID NO: 132706 - DNA, 20 bp, human
gccggccgcgcattgtcctc

SEQ ID NO: 132707 - DNA, 20 bp, human
ggcactgctcgggacgtcag

SEQ ID NO: 132708 - DNA, 20 bp, human
gtgcacccgaggacaatgcg

SEQ ID NO: 132709 - DNA, 20 bp, human
gtgcaaaagcgtctctgaca

SEQ ID NO: 132710 - DNA, 20 bp, human
gccggccacgggcccaagcg

SEQ ID NO: 132711 - DNA, 20 bp, human
gacaatgcgcggccggccac

SEQ ID NO: 132712 - DNA, 20 bp, human
gcacgggcccaagcgcggcg

SEQ ID NO: 132713 - DNA, 20 bp, human
ggcgattcgagtccgcagcc

SEQ ID NO: 132714 - DNA, 20 bp, human
gagggagcagcgagggacgg

SEQ ID NO: 132715 - DNA, 20 bp, human
ggagcgtgcagagagaagct

SEQ ID NO: 132716 - DNA, 20 bp, human
ggccagagagggacgaacca

SEQ ID NO: 132717 - DNA, 20 bp, human
gagagagggacgaaccaggg

SEQ ID NO: 132718 - DNA, 20 bp, human
ggccagggtgctctggaaag

SEQ ID NO: 132719 - DNA, 20 bp, human
ggctgcagggagccctcacg

SEQ ID NO: 132720 - DNA, 20 bp, human
ggagtgcgtggtccgcgtga

SEQ ID NO: 132721 - DNA, 20 bp, human
gtggctcagggtggacgact

SEQ ID NO: 132722 - DNA, 20 bp, human
gacgccaaggcggtcttgag

SEQ ID NO: 132723 - DNA, 20 bp, human
ggccactccaatcgaggtaa

SEQ ID NO: 132724 - DNA, 20 bp, human
gcatccccggggatgagggg

SEQ ID NO: 132725 - DNA, 20 bp, human
gacgcggaccacgcactcta

SEQ ID NO: 132726 - DNA, 20 bp, human
gaagacggcgagcaacaggt

SEQ ID NO: 132727 - DNA, 20 bp, human
ggcttcgcccgcgagtccag

SEQ ID NO: 132728 - DNA, 20 bp, human
gcaacaggtgggcagaacac

SEQ ID NO: 132729 - DNA, 20 bp, human
gtcgcctgcctctggactcg

SEQ ID NO: 132730 - DNA, 20 bp, human
gaagtcggtcataccgaaga

SEQ ID NO: 132731 - DNA, 20 bp, human
gcagaggcaggcgagcagct

SEQ ID NO: 132732 - DNA, 20 bp, human
ggaggaggtgaccgggtgtg

SEQ ID NO: 132733 - DNA, 20 bp, human
gggggtgagggcgggatagg

SEQ ID NO: 132734 - DNA, 20 bp, human
gcgcggggtgagggcgggat

SEQ ID NO: 132735 - DNA, 20 bp, human
gggacgcccggccttccctg

SEQ ID NO: 132736 - DNA, 20 bp, human
gaagttaccgtcctgcatgg

SEQ ID NO: 132737 - DNA, 20 bp, human
ggacaggacgtgaagatagt

SEQ ID NO: 132738 - DNA, 20 bp, human
gtgcatggcggcaggtccac

SEQ ID NO: 132739 - DNA, 20 bp, human
gggcggacgtgatagtgtga

SEQ ID NO: 132740 - DNA, 20 bp, human
gcggggtccctgcttggaca

SEQ ID NO: 132741 - DNA, 20 bp, human
gtcaggagccggcctcactg

SEQ ID NO: 132742 - DNA, 20 bp, human
gggccgagactgccagaggt

SEQ ID NO: 132743 - DNA, 20 bp, human
gcagcagccgcggcacaacg

SEQ ID NO: 132744 - DNA, 20 bp, human
ggggtgtgtgactcagtgtg

SEQ ID NO: 132745 - DNA, 20 bp, human
gcttcagggagagggcctcg

SEQ ID NO: 132746 - DNA, 20 bp, human
gacacctcggccgtcagcag

SEQ ID NO: 132747 - DNA, 20 bp, human
ggcacgcgccgggccaggga

SEQ ID NO: 132748 - DNA, 20 bp, human
gtcccagaggccactgctga

SEQ ID NO: 132749 - DNA, 20 bp, human
gcgggccagggatggagtcc

SEQ ID NO: 132750 - DNA, 20 bp, human
ggctcgtgagagaagcccag

SEQ ID NO: 132751 - DNA, 20 bp, human
ggctgacggccgaggtgtcc

SEQ ID NO: 132752 - DNA, 20 bp, human
gaggagtcggaggtcagcgt

SEQ ID NO: 132753 - DNA, 20 bp, human
ggctggagagtaggagtcgg

SEQ ID NO: 132754 - DNA, 20 bp, human
gggtggggataagcctagga

SEQ ID NO: 132755 - DNA, 20 bp, human
gtgagggccgggtcagggtt

SEQ ID NO: 132756 - DNA, 20 bp, human
gtgcgggcaggaacacgagg

SEQ ID NO: 132757 - DNA, 20 bp, human
gcgagggccgagggtctcgt

SEQ ID NO: 132758 - DNA, 20 bp, human
ggagtgcgggcaggaacacg

SEQ ID NO: 132759 - DNA, 20 bp, human
gaggcggggcaggaaagccg

SEQ ID NO: 132760 - DNA, 20 bp, human
ggaggcggcaccatgggcaa

SEQ ID NO: 132761 - DNA, 20 bp, human
ggggagcagcaggcgagtgc

SEQ ID NO: 132762 - DNA, 20 bp, human
gtcgacgccggccgcggagg

SEQ ID NO: 132763 - DNA, 20 bp, human
ggccgggaaaagcaaatgga

SEQ ID NO: 132764 - DNA, 20 bp, human
gagccccctctactgcccag

SEQ ID NO: 132765 - DNA, 20 bp, human
ggctctcccaccacccccgg

SEQ ID NO: 132766 - DNA, 20 bp, human
ggcgatgcccccaggtccct

SEQ ID NO: 132767 - DNA, 20 bp, human
gggaatggtggatatttatg

SEQ ID NO: 132768 - DNA, 20 bp, human
gtggaagttcaggtaagcca

SEQ ID NO: 132769 - DNA, 20 bp, human
gaaaatgagtcggataacca

SEQ ID NO: 132770 - DNA, 20 bp, human
gtccctgggagagctgcttc

SEQ ID NO: 132771 - DNA, 20 bp, human
gggataaccagggaaagttc

SEQ ID NO: 132772 - DNA, 20 bp, human
gtcacctcagaagaggcaaa

SEQ ID NO: 132773 - DNA, 20 bp, human
gctgggttatatgatctctt

SEQ ID NO: 132774 - DNA, 20 bp, human
gccagggctcaggccttggg

SEQ ID NO: 132775 - DNA, 20 bp, human
gaagccttttgcctcttctg

SEQ ID NO: 132776 - DNA, 20 bp, human
gggtgctgcagggccaccgg

SEQ ID NO: 132777 - DNA, 20 bp, human
ggcccaagcagagccagcta

SEQ ID NO: 132778 - DNA, 20 bp, human
ggacggtgctgcagggccac

SEQ ID NO: 132779 - DNA, 20 bp, human
gctgcttgggccgcgaggga

SEQ ID NO: 132780 - DNA, 20 bp, human
gccaccggaggcaccaagcc

SEQ ID NO: 132781 - DNA, 20 bp, human
gggaccgggagtcaggccca

SEQ ID NO: 132782 - DNA, 20 bp, human
gaagcagagccagctagggg

SEQ ID NO: 132783 - DNA, 20 bp, human
gagccggggcgtgacagccg

SEQ ID NO: 132784 - DNA, 20 bp, human
gggtgtgtgtccgccgggct

SEQ ID NO: 132785 - DNA, 20 bp, human
gggctctgcttgggccgcga

SEQ ID NO: 132786 - DNA, 20 bp, human
gccagcgcgcccgctcacct

SEQ ID NO: 132787 - DNA, 20 bp, human
gcgacggcgctgcctgcccg

SEQ ID NO: 132788 - DNA, 20 bp, human
gtcctggcacctgacaacag

SEQ ID NO: 132789 - DNA, 20 bp, human
gtcctgagggccagccggga

SEQ ID NO: 132790 - DNA, 20 bp, human
gggtgtgagtgacagatgca

SEQ ID NO: 132791 - DNA, 20 bp, human
gcagccgaaggacaccgtca

SEQ ID NO: 132792 - DNA, 20 bp, human
gtgagcgggcgcgctggtcc

SEQ ID NO: 132793 - DNA, 20 bp, human
ggagatcctgagggccagcc

SEQ ID NO: 132794 - DNA, 20 bp, human
gctggctgctgccaagtccg

SEQ ID NO: 132795 - DNA, 20 bp, human
gagagtccccaggacgcgct

SEQ ID NO: 132796 - DNA, 20 bp, human
gaaccccctacccagatgtc

SEQ ID NO: 132797 - DNA, 20 bp, human
gtcctgcctgacatctgggt

SEQ ID NO: 132798 - DNA, 20 bp, human
ggactgggaaagggattatc

SEQ ID NO: 132799 - DNA, 20 bp, human
gtgcctgacatctgggtagg

SEQ ID NO: 132800 - DNA, 20 bp, human
gagcgacacgagccctgaca

SEQ ID NO: 132801 - DNA, 20 bp, human
gcctgcagccaggtaggtac

SEQ ID NO: 132802 - DNA, 20 bp, human
gcaatctgtctgttccccag

SEQ ID NO: 132803 - DNA, 20 bp, human
ggacagatcgtgacctctct

SEQ ID NO: 132804 - DNA, 20 bp, human
gaggagtcctattcagactg

SEQ ID NO: 132805 - DNA, 20 bp, human
ggacacgagccctgacacgg

SEQ ID NO: 132806 - DNA, 20 bp, human
gggaggcccatggtgtacga

SEQ ID NO: 132807 - DNA, 20 bp, human
gggagcagccccacacggta

SEQ ID NO: 132808 - DNA, 20 bp, human
gggcgaccgtcgtacaccat

SEQ ID NO: 132809 - DNA, 20 bp, human
gcgacggtcgccgcaggtcc

SEQ ID NO: 132810 - DNA, 20 bp, human
gcacacggtaggggcggagg

SEQ ID NO: 132811 - DNA, 20 bp, human
ggaacagaagcagaccggga

SEQ ID NO: 132812 - DNA, 20 bp, human
gatccgggagcagccccaca

SEQ ID NO: 132813 - DNA, 20 bp, human
gtgggctctcgcctaggcgg

SEQ ID NO: 132814 - DNA, 20 bp, human
gcagccccacacggtagggg

SEQ ID NO: 132815 - DNA, 20 bp, human
ggagagctgaacctgcatcc

SEQ ID NO: 132816 - DNA, 20 bp, human
gacccacctcgcggtctcgg

SEQ ID NO: 132817 - DNA, 20 bp, human
gagacccggtccaattgctg

SEQ ID NO: 132818 - DNA, 20 bp, human
gacgagtccccactaacagg

SEQ ID NO: 132819 - DNA, 20 bp, human
ggaccgcgaggtgggtggat

SEQ ID NO: 132820 - DNA, 20 bp, human
gctcgcggtgtggaccctca

SEQ ID NO: 132821 - DNA, 20 bp, human
ggcctccgagaccgcgaggt

SEQ ID NO: 132822 - DNA, 20 bp, human
gggaaggggagaagcatccc

SEQ ID NO: 132823 - DNA, 20 bp, human
gccaccgcggccattagacc

SEQ ID NO: 132824 - DNA, 20 bp, human
gacccgatccacccacctcg

SEQ ID NO: 132825 - DNA, 20 bp, human
ggcgctgcagccccagcaat

SEQ ID NO: 132826 - DNA, 20 bp, human
gagctgtgctgctcacaggt

SEQ ID NO: 132827 - DNA, 20 bp, human
gtagctcacttgggagagaa

SEQ ID NO: 132828 - DNA, 20 bp, human
gcttgagggaaccccaatag

SEQ ID NO: 132829 - DNA, 20 bp, human
gctacttagttgagtaaggt

SEQ ID NO: 132830 - DNA, 20 bp, human
gcctgtggcccccattccag

SEQ ID NO: 132831 - DNA, 20 bp, human
gagaaaggcgggtggagccg

SEQ ID NO: 132832 - DNA, 20 bp, human
gctaactacttagttgagta

SEQ ID NO: 132833 - DNA, 20 bp, human
gggttcccagtggggcttaa

SEQ ID NO: 132834 - DNA, 20 bp, human
gaactgagatgaccagtctc

SEQ ID NO: 132835 - DNA, 20 bp, human
gattggggttccctcaaggc

SEQ ID NO: 132836 - DNA, 20 bp, human
gtgggtccaacggtcttcag

SEQ ID NO: 132837 - DNA, 20 bp, human
gtcggtctgccagcaccccg

SEQ ID NO: 132838 - DNA, 20 bp, human
gggaggcagcgtgggacccg

SEQ ID NO: 132839 - DNA, 20 bp, human
gggaaggcagtgtgtccccg

SEQ ID NO: 132840 - DNA, 20 bp, human
gcagtggccgccgccgacag

SEQ ID NO: 132841 - DNA, 20 bp, human
gacacgccaaggatctcacg

SEQ ID NO: 132842 - DNA, 20 bp, human
ggaccgacgtgcaaaacagt

SEQ ID NO: 132843 - DNA, 20 bp, human
ggatctcacgaggcatacaa

SEQ ID NO: 132844 - DNA, 20 bp, human
gacggggtgcgttcgctaca

SEQ ID NO: 132845 - DNA, 20 bp, human
ggaacgcaccccgttagaga

SEQ ID NO: 132846 - DNA, 20 bp, human
gcggcctggggatacaactc

SEQ ID NO: 132847 - DNA, 20 bp, human
gaactctggagtcctctgag

SEQ ID NO: 132848 - DNA, 20 bp, human
gctggctctttacctctcag

SEQ ID NO: 132849 - DNA, 20 bp, human
gtcaaggcttggagtctcca

SEQ ID NO: 132850 - DNA, 20 bp, human
gactgaggccgagcctccat

SEQ ID NO: 132851 - DNA, 20 bp, human
ggtctccaaggcacccatgg

SEQ ID NO: 132852 - DNA, 20 bp, human
ggaacaaacaagacggcctg

SEQ ID NO: 132853 - DNA, 20 bp, human
gacaacacagccactctcaa

SEQ ID NO: 132854 - DNA, 20 bp, human
gaggttcctcccaactacct

SEQ ID NO: 132855 - DNA, 20 bp, human
gcaagccttgaatccagtgt

SEQ ID NO: 132856 - DNA, 20 bp, human
gcagggcctggcactcataa

SEQ ID NO: 132857 - DNA, 20 bp, human
gccccgtggatgacactgac

SEQ ID NO: 132858 - DNA, 20 bp, human
gacctgtcagtgtcatccac

SEQ ID NO: 132859 - DNA, 20 bp, human
gagaagctggccccgaccct

SEQ ID NO: 132860 - DNA, 20 bp, human
gggagggtcaaacacatcac

SEQ ID NO: 132861 - DNA, 20 bp, human
gatgggtcttgagaaaccca

SEQ ID NO: 132862 - DNA, 20 bp, human
gtatccgtaatatgagaaga

SEQ ID NO: 132863 - DNA, 20 bp, human
gaaacagcttctagagctct

SEQ ID NO: 132864 - DNA, 20 bp, human
gactcataagggcctaaaca

SEQ ID NO: 132865 - DNA, 20 bp, human
gtggctgctactgtgggctt

SEQ ID NO: 132866 - DNA, 20 bp, human
gtcccagcacagagcagtgg

SEQ ID NO: 132867 - DNA, 20 bp, human
gtattcagtgggagaggtag

SEQ ID NO: 132868 - DNA, 20 bp, human
gggagactgacggccactga

SEQ ID NO: 132869 - DNA, 20 bp, human
gtaccatgctaggagactga

SEQ ID NO: 132870 - DNA, 20 bp, human
gcgggttgctcctattcagt

SEQ ID NO: 132871 - DNA, 20 bp, human
gtcaagggaaccctcttccc

SEQ ID NO: 132872 - DNA, 20 bp, human
gctgaaggctctttgcagag

SEQ ID NO: 132873 - DNA, 20 bp, human
gctgctctgtgctgggatca

SEQ ID NO: 132874 - DNA, 20 bp, human
gttggccagccagagctctc

SEQ ID NO: 132875 - DNA, 20 bp, human
ggcagatcatgaacatgaaa

SEQ ID NO: 132876 - DNA, 20 bp, human
gggtgcacaaggagcataaa

SEQ ID NO: 132877 - DNA, 20 bp, human
gggctccctgagatcagagg

SEQ ID NO: 132878 - DNA, 20 bp, human
gtggctgagtcaggagcacc

SEQ ID NO: 132879 - DNA, 20 bp, human
gggataggagaaggagccta

SEQ ID NO: 132880 - DNA, 20 bp, human
gactggcctcagggtcaccc

SEQ ID NO: 132881 - DNA, 20 bp, human
gtgtggtggatgccaaacac

SEQ ID NO: 132882 - DNA, 20 bp, human
ggagcaccgggaagaatttg

SEQ ID NO: 132883 - DNA, 20 bp, human
gcaaaggaacaccagcacgt

SEQ ID NO: 132884 - DNA, 20 bp, human
gggagatttcatcccaggtt

SEQ ID NO: 132885 - DNA, 20 bp, human
gccgctggctcaggcaaaac

SEQ ID NO: 132886 - DNA, 20 bp, human
gggtctgagatgcgctccag

SEQ ID NO: 132887 - DNA, 20 bp, human
gtcgcacactggcaggggag

SEQ ID NO: 132888 - DNA, 20 bp, human
gtgcacacactagggagtcc

SEQ ID NO: 132889 - DNA, 20 bp, human
gcagcaacataggtctcaga

SEQ ID NO: 132890 - DNA, 20 bp, human
gcacactagggagtccggga

SEQ ID NO: 132891 - DNA, 20 bp, human
gacccaaagccaggagtcct

SEQ ID NO: 132892 - DNA, 20 bp, human
gccatgttgcgggttctggg

SEQ ID NO: 132893 - DNA, 20 bp, human
ggcgaggcagcgtgaagctg

SEQ ID NO: 132894 - DNA, 20 bp, human
gacctcccatgcacacacta

SEQ ID NO: 132895 - DNA, 20 bp, human
gcctggaggattccatctca

SEQ ID NO: 132896 - DNA, 20 bp, human
gccaagggcaggcatcccag

SEQ ID NO: 132897 - DNA, 20 bp, human
ggtgcggcgggaccaatgaa

SEQ ID NO: 132898 - DNA, 20 bp, human
gccttggtggccccaccagg

SEQ ID NO: 132899 - DNA, 20 bp, human
gtgagcacagagagcaccgt

SEQ ID NO: 132900 - DNA, 20 bp, human
gactcttcagagtcagtggg

SEQ ID NO: 132901 - DNA, 20 bp, human
gcagagagcaccgtaggctg

SEQ ID NO: 132902 - DNA, 20 bp, human
gcgtccctggcaacccactg

SEQ ID NO: 132903 - DNA, 20 bp, human
gctgggccagtgcagaatgg

SEQ ID NO: 132904 - DNA, 20 bp, human
gctctgcagctcgggtccgg

SEQ ID NO: 132905 - DNA, 20 bp, human
ggaggtcctgtaccagcgga

SEQ ID NO: 132906 - DNA, 20 bp, human
ggatcctgactgaaagctag

SEQ ID NO: 132907 - DNA, 20 bp, human
gctctcgctaaagatcgcta

SEQ ID NO: 132908 - DNA, 20 bp, human
gctaagtccggagctgaaaa

SEQ ID NO: 132909 - DNA, 20 bp, human
gctgaaagctagaggcattg

SEQ ID NO: 132910 - DNA, 20 bp, human
ggaggagcctgaagattctc

SEQ ID NO: 132911 - DNA, 20 bp, human
gtccacgtgatgacacccaa

SEQ ID NO: 132912 - DNA, 20 bp, human
gaccattgggtgtcatcacg

SEQ ID NO: 132913 - DNA, 20 bp, human
gagcattcaaaacggcggtg

SEQ ID NO: 132914 - DNA, 20 bp, human
gatgcctctagctttcagtc

SEQ ID NO: 132915 - DNA, 20 bp, human
ggtaggaggggctaaaatgt

SEQ ID NO: 132916 - DNA, 20 bp, human
gtccaaagccgcctccgcca

SEQ ID NO: 132917 - DNA, 20 bp, human
ggcgcgcgaacacgggagaa

SEQ ID NO: 132918 - DNA, 20 bp, human
gcgctcgggttgctcttctg

SEQ ID NO: 132919 - DNA, 20 bp, human
gcgcgggagcgcgcgaacac

SEQ ID NO: 132920 - DNA, 20 bp, human
gtctcgtaactcgctccgca

SEQ ID NO: 132921 - DNA, 20 bp, human
ggaattcccggccgctgcaa

SEQ ID NO: 132922 - DNA, 20 bp, human
gggccgctgcaaggggtgag

SEQ ID NO: 132923 - DNA, 20 bp, human
gagcgagttacgagaattcc

SEQ ID NO: 132924 - DNA, 20 bp, human
gacaagggagttgaggtcgg

SEQ ID NO: 132925 - DNA, 20 bp, human
gggaagagccagggaccatt

SEQ ID NO: 132926 - DNA, 20 bp, human
gctcaggagcaggaatgatg

SEQ ID NO: 132927 - DNA, 20 bp, human
gccctaacaggtcaagtcca

SEQ ID NO: 132928 - DNA, 20 bp, human
gcagggagcaaccaggtcca

SEQ ID NO: 132929 - DNA, 20 bp, human
ggccatgagactgagtcctc

SEQ ID NO: 132930 - DNA, 20 bp, human
gggccccaggtagagaccag

SEQ ID NO: 132931 - DNA, 20 bp, human
gcctgttagggtccttgtgg

SEQ ID NO: 132932 - DNA, 20 bp, human
gctgagtcagaggagcatgg

SEQ ID NO: 132933 - DNA, 20 bp, human
gtggagggcctcatccacca

SEQ ID NO: 132934 - DNA, 20 bp, human
gctccaggcaactgagtcag

SEQ ID NO: 132935 - DNA, 20 bp, human
gggtccagggcagtgctgga

SEQ ID NO: 132936 - DNA, 20 bp, human
gagggcctacaagccgagga

SEQ ID NO: 132937 - DNA, 20 bp, human
gaagcagggcctacaagccg

SEQ ID NO: 132938 - DNA, 20 bp, human
ggccgaggagggctgtttaa

SEQ ID NO: 132939 - DNA, 20 bp, human
ggtcctgagcagggccaacc

SEQ ID NO: 132940 - DNA, 20 bp, human
gacagccctcctcggcttgt

SEQ ID NO: 132941 - DNA, 20 bp, human
gaatagctccgggtgagctc

SEQ ID NO: 132942 - DNA, 20 bp, human
gggagcccaagcctccgcac

SEQ ID NO: 132943 - DNA, 20 bp, human
gaggctcaggcaagccgtgg

SEQ ID NO: 132944 - DNA, 20 bp, human
ggggctgtttaaaggcgcag

SEQ ID NO: 132945 - DNA, 20 bp, human
ggcggccataaccaagtacc

SEQ ID NO: 132946 - DNA, 20 bp, human
gccatcatcggagaacatag

SEQ ID NO: 132947 - DNA, 20 bp, human
gtggcagcgacggtcccagt

SEQ ID NO: 132948 - DNA, 20 bp, human
ggcctggagtgaagctggaa

SEQ ID NO: 132949 - DNA, 20 bp, human
gcatgctggtcctatcccac

SEQ ID NO: 132950 - DNA, 20 bp, human
gtctggctgagtggcagcga

SEQ ID NO: 132951 - DNA, 20 bp, human
gtgttctccgatgatggtgg

SEQ ID NO: 132952 - DNA, 20 bp, human
gcagtgtctgcagagcatgt

SEQ ID NO: 132953 - DNA, 20 bp, human
ggcgacggtcccagtgggat

SEQ ID NO: 132954 - DNA, 20 bp, human
gtgctgtggtcgctggtggt

SEQ ID NO: 132955 - DNA, 20 bp, human
gagtgtgatagctggaatca

SEQ ID NO: 132956 - DNA, 20 bp, human
gggactcaggacgggctgtg

SEQ ID NO: 132957 - DNA, 20 bp, human
gcccgtcctgagtcccagag

SEQ ID NO: 132958 - DNA, 20 bp, human
gcccttgaaattaccccagg

SEQ ID NO: 132959 - DNA, 20 bp, human
ggaagccagggcttaactaa

SEQ ID NO: 132960 - DNA, 20 bp, human
gtcaatatgtcagtgggaga

SEQ ID NO: 132961 - DNA, 20 bp, human
gggaaagtgaggctccttca

SEQ ID NO: 132962 - DNA, 20 bp, human
gtaggacagttctccgtcaa

SEQ ID NO: 132963 - DNA, 20 bp, human
ggacagttctccgtcaaggg

SEQ ID NO: 132964 - DNA, 20 bp, human
ggcgaaactcaatatgtcag

SEQ ID NO: 132965 - DNA, 20 bp, human
ggctgcctgaaagacaagca

SEQ ID NO: 132966 - DNA, 20 bp, human
gtgtgcaaccagaggagcgc

SEQ ID NO: 132967 - DNA, 20 bp, human
gctgctggctcaggtgtgac

SEQ ID NO: 132968 - DNA, 20 bp, human
gcagcagtttgtgcaaccag

SEQ ID NO: 132969 - DNA, 20 bp, human
gcctccgattaggaaatgga

SEQ ID NO: 132970 - DNA, 20 bp, human
ggagtgcccaaagcatggct

SEQ ID NO: 132971 - DNA, 20 bp, human
gaaccagaggagcgcaggca

SEQ ID NO: 132972 - DNA, 20 bp, human
gaaccctgcctgcgctcctc

SEQ ID NO: 132973 - DNA, 20 bp, human
gagccaggctcgcgcatcct

SEQ ID NO: 132974 - DNA, 20 bp, human
gacacttgtctggggtgggt

SEQ ID NO: 132975 - DNA, 20 bp, human
ggctggtctcagtcttcaca

SEQ ID NO: 132976 - DNA, 20 bp, human
gggacttcctgcctctgcaa

SEQ ID NO: 132977 - DNA, 20 bp, human
gagagagactccttcaacag

SEQ ID NO: 132978 - DNA, 20 bp, human
gatgatgaggacaaacccgg

SEQ ID NO: 132979 - DNA, 20 bp, human
gtgaggacaaacccggaggt

SEQ ID NO: 132980 - DNA, 20 bp, human
ggtgtggagagcccaagagg

SEQ ID NO: 132981 - DNA, 20 bp, human
gcacagaccatggatccggg

SEQ ID NO: 132982 - DNA, 20 bp, human
gaggccaggccacacctcaa

SEQ ID NO: 132983 - DNA, 20 bp, human
gccgatgatgaggacaaacc

SEQ ID NO: 132984 - DNA, 20 bp, human
gcccccgactgcctttgcag

SEQ ID NO: 132985 - DNA, 20 bp, human
ggacaaacccggaggtgggg

SEQ ID NO: 132986 - DNA, 20 bp, human
gcccgcgaggtcactcacct

SEQ ID NO: 132987 - DNA, 20 bp, human
gagaagtgctgagtaagccg

SEQ ID NO: 132988 - DNA, 20 bp, human
ggaggcacgcgagagaggaa

SEQ ID NO: 132989 - DNA, 20 bp, human
gtgagcacttagaggagcac

SEQ ID NO: 132990 - DNA, 20 bp, human
ggggcctaaagaggcactga

SEQ ID NO: 132991 - DNA, 20 bp, human
gcggagcgccgaggaagttg

SEQ ID NO: 132992 - DNA, 20 bp, human
gcggccaatggggcctaaag

SEQ ID NO: 132993 - DNA, 20 bp, human
ggtttgtttgcggaagtagg

SEQ ID NO: 132994 - DNA, 20 bp, human
gagacacacggaggagactg

SEQ ID NO: 132995 - DNA, 20 bp, human
gtactgagggagacacacgg

SEQ ID NO: 132996 - DNA, 20 bp, human
gctgaattcaccccccagtc

SEQ ID NO: 132997 - DNA, 20 bp, human
gtaaccgcgggtccaggtgc

SEQ ID NO: 132998 - DNA, 20 bp, human
gggaggtcgggaccccggag

SEQ ID NO: 132999 - DNA, 20 bp, human
gctgcgcgcgggctgtgtcc

SEQ ID NO: 133000 - DNA, 20 bp, human
gagcagctctggcaggcggc

SEQ ID NO: 133001 - DNA, 20 bp, human
gctgtcggcgagaagcagtc

SEQ ID NO: 133002 - DNA, 20 bp, human
gaacagcgctaggatccttg

SEQ ID NO: 133003 - DNA, 20 bp, human
gccccagctctgagctctta

SEQ ID NO: 133004 - DNA, 20 bp, human
gcggaggctcgcagtgctgt

SEQ ID NO: 133005 - DNA, 20 bp, human
gcctccagcatcaccagggg

SEQ ID NO: 133006 - DNA, 20 bp, human
gctctgggctcccgggataa

SEQ ID NO: 133007 - DNA, 20 bp, human
gccccgagcggctcctggag

SEQ ID NO: 133008 - DNA, 20 bp, human
gcccgagtgtcggttcactg

SEQ ID NO: 133009 - DNA, 20 bp, human
gttcactgtggagacagcgg

SEQ ID NO: 133010 - DNA, 20 bp, human
gactgtggagacagcggtgg

SEQ ID NO: 133011 - DNA, 20 bp, human
gggtgctgggcctagacaag

SEQ ID NO: 133012 - DNA, 20 bp, human
ggagacagcggtggcggagt

SEQ ID NO: 133013 - DNA, 20 bp, human
gctggcaaggcccccggagg

SEQ ID NO: 133014 - DNA, 20 bp, human
gggactggatcggtacgttg

SEQ ID NO: 133015 - DNA, 20 bp, human
ggtcggggtggtcgaaggag

SEQ ID NO: 133016 - DNA, 20 bp, human
gaagagcccgagagccggta

SEQ ID NO: 133017 - DNA, 20 bp, human
gccggtacggaagggcggct

SEQ ID NO: 133018 - DNA, 20 bp, human
gcccgagagccggtacggaa

SEQ ID NO: 133019 - DNA, 20 bp, human
ggtgcgagaccagtccgcag

SEQ ID NO: 133020 - DNA, 20 bp, human
ggagagccggtacggaaggg

SEQ ID NO: 133021 - DNA, 20 bp, human
gaccggaagagcccgagagc

SEQ ID NO: 133022 - DNA, 20 bp, human
gccagtccgcaggggcgact

SEQ ID NO: 133023 - DNA, 20 bp, human
gtctcgggacacggacacaa

SEQ ID NO: 133024 - DNA, 20 bp, human
ggagcggcgcaaccaggtac

SEQ ID NO: 133025 - DNA, 20 bp, human
gcggcaggactgacagggaa

SEQ ID NO: 133026 - DNA, 20 bp, human
ggactctcctatgaaggtaa

SEQ ID NO: 133027 - DNA, 20 bp, human
gcactggaactgaagagggg

SEQ ID NO: 133028 - DNA, 20 bp, human
ggggtggcctttaccttcat

SEQ ID NO: 133029 - DNA, 20 bp, human
gtcagtcactggaactgaag

SEQ ID NO: 133030 - DNA, 20 bp, human
gccccatctgggaaacacca

SEQ ID NO: 133031 - DNA, 20 bp, human
gaagagtgactctcctatga

SEQ ID NO: 133032 - DNA, 20 bp, human
gtgacgattcaggaagaccc

SEQ ID NO: 133033 - DNA, 20 bp, human
gcatatatcagaccatcaga

SEQ ID NO: 133034 - DNA, 20 bp, human
gggcagttagactctgaatt

SEQ ID NO: 133035 - DNA, 20 bp, human
gtgacatgggggtgatgaag

SEQ ID NO: 133036 - DNA, 20 bp, human
ggctcagacgaaggtctcca

SEQ ID NO: 133037 - DNA, 20 bp, human
gcaactcaggaaacaaggag

SEQ ID NO: 133038 - DNA, 20 bp, human
gtggaggtctgctcagacga

SEQ ID NO: 133039 - DNA, 20 bp, human
gaagcaccagtaattggcag

SEQ ID NO: 133040 - DNA, 20 bp, human
gacaatcaagcaccagtaat

SEQ ID NO: 133041 - DNA, 20 bp, human
gcacagtgtcagctacctaa

SEQ ID NO: 133042 - DNA, 20 bp, human
ggacttgtgtcaatatacgg

SEQ ID NO: 133043 - DNA, 20 bp, human
gccatggaggttctcagcac

SEQ ID NO: 133044 - DNA, 20 bp, human
ggtagacttgtgtcaatata

SEQ ID NO: 133045 - DNA, 20 bp, human
ggttcttcaggaatagtcct

SEQ ID NO: 133046 - DNA, 20 bp, human
gtggattatgagctacgaat

SEQ ID NO: 133047 - DNA, 20 bp, human
gacgaatgggcagtcgaatg

SEQ ID NO: 133048 - DNA, 20 bp, human
gtccatagagatctagagtt

SEQ ID NO: 133049 - DNA, 20 bp, human
ggatctagagttgggtggag

SEQ ID NO: 133050 - DNA, 20 bp, human
ggagggggctaaacaaatgg

SEQ ID NO: 133051 - DNA, 20 bp, human
gacaacaaggagtatcccaa

SEQ ID NO: 133052 - DNA, 20 bp, human
gccctagcggcgagtccctt

SEQ ID NO: 133053 - DNA, 20 bp, human
gtataggcatggggacaaca

SEQ ID NO: 133054 - DNA, 20 bp, human
gtagcaaggtgttataaaaa

SEQ ID NO: 133055 - DNA, 20 bp, human
gctagatctctatggaattt

SEQ ID NO: 133056 - DNA, 20 bp, human
gtacttacaattagtaaaca

SEQ ID NO: 133057 - DNA, 20 bp, human
gagtaaacaaggttccgagc

SEQ ID NO: 133058 - DNA, 20 bp, human
gaggaaatgtcttgtggcct

SEQ ID NO: 133059 - DNA, 20 bp, human
gagtttcagctaaaagacta

SEQ ID NO: 133060 - DNA, 20 bp, human
gtatgcatgttgacttatgc

SEQ ID NO: 133061 - DNA, 20 bp, human
gagtatttagaaacaagata

SEQ ID NO: 133062 - DNA, 20 bp, human
gcaaatgaaaactacgtgaa

SEQ ID NO: 133063 - DNA, 20 bp, human
gtacactactttgaaaagcc

SEQ ID NO: 133064 - DNA, 20 bp, human
gctttgaaaagcctggcatt

SEQ ID NO: 133065 - DNA, 20 bp, human
gttgatgaggattcaaggct

SEQ ID NO: 133066 - DNA, 20 bp, human
gcaacttgaggtagggaata

SEQ ID NO: 133067 - DNA, 20 bp, human
ggggaaaaaggatagcccaa

SEQ ID NO: 133068 - DNA, 20 bp, human
gctggtgacaagaaaagggc

SEQ ID NO: 133069 - DNA, 20 bp, human
gcttggctggtgacaagaaa

SEQ ID NO: 133070 - DNA, 20 bp, human
gaaaccagcttattgccaaa

SEQ ID NO: 133071 - DNA, 20 bp, human
gcctggttccttataagtag

SEQ ID NO: 133072 - DNA, 20 bp, human
gatgttgaaccctgaccaag

SEQ ID NO: 133073 - DNA, 20 bp, human
gactaaagagcaaaagctag

SEQ ID NO: 133074 - DNA, 20 bp, human
gtttccctttggcaataagc

SEQ ID NO: 133075 - DNA, 20 bp, human
gaataaagttccacttggtc

SEQ ID NO: 133076 - DNA, 20 bp, human
gctctgcgcgctgaccggac

SEQ ID NO: 133077 - DNA, 20 bp, human
gcgccatctgcgggtctccc

SEQ ID NO: 133078 - DNA, 20 bp, human
gttagttcatatctgttcag

SEQ ID NO: 133079 - DNA, 20 bp, human
gagagaaaaagtgattaaaa

SEQ ID NO: 133080 - DNA, 20 bp, human
ggcagacgcggcgctgcgct

SEQ ID NO: 133081 - DNA, 20 bp, human
ggcgccgcgggctctttggc

SEQ ID NO: 133082 - DNA, 20 bp, human
gagtgcatttcctctcgggc

SEQ ID NO: 133083 - DNA, 20 bp, human
gtgggcggctccggactttc

SEQ ID NO: 133084 - DNA, 20 bp, human
gatttcctctcgggccggcc

SEQ ID NO: 133085 - DNA, 20 bp, human
gaactgagtgcatttcctct

SEQ ID NO: 133086 - DNA, 20 bp, human
gggcagcgcatacactacaa

SEQ ID NO: 133087 - DNA, 20 bp, human
ggctgcaagttgggctgcag

SEQ ID NO: 133088 - DNA, 20 bp, human
gacccgaaggtgaggtcggt

SEQ ID NO: 133089 - DNA, 20 bp, human
ggacagggcagggggcgatg

SEQ ID NO: 133090 - DNA, 20 bp, human
gcccgaagtcgcttctgaca

SEQ ID NO: 133091 - DNA, 20 bp, human
ggcggcggcagctgcaagtt

SEQ ID NO: 133092 - DNA, 20 bp, human
gtttagcgggagaaatatca

SEQ ID NO: 133093 - DNA, 20 bp, human
gggctggggacccgaaggtg

SEQ ID NO: 133094 - DNA, 20 bp, human
gctttccagaccctgaataa

SEQ ID NO: 133095 - DNA, 20 bp, human
gttcccaccgacctcacctt

SEQ ID NO: 133096 - DNA, 20 bp, human
gcgggtgctggacggacgga

SEQ ID NO: 133097 - DNA, 20 bp, human
ggtgctctggcctcactctc

SEQ ID NO: 133098 - DNA, 20 bp, human
gagcacccgcccggagagtg

SEQ ID NO: 133099 - DNA, 20 bp, human
ggcgccaggttgtaagaatc

SEQ ID NO: 133100 - DNA, 20 bp, human
gtctggcctcactctccggg

SEQ ID NO: 133101 - DNA, 20 bp, human
gtgtggacctcataccagat

SEQ ID NO: 133102 - DNA, 20 bp, human
gcggcgtccagggggtccgg

SEQ ID NO: 133103 - DNA, 20 bp, human
gagataggcgcgaacgcctc

SEQ ID NO: 133104 - DNA, 20 bp, human
gcgggcgggtgctggacgga

SEQ ID NO: 133105 - DNA, 20 bp, human
gcggccatgacggcgacccg

SEQ ID NO: 133106 - DNA, 20 bp, human
gcggccggagctgacccagt

SEQ ID NO: 133107 - DNA, 20 bp, human
ggtgcggcgcagctccgact

SEQ ID NO: 133108 - DNA, 20 bp, human
gcggcgcagctccgactcgg

SEQ ID NO: 133109 - DNA, 20 bp, human
gagctgcgccgcacgcccag

SEQ ID NO: 133110 - DNA, 20 bp, human
gctgcagacgacggagaaaa

SEQ ID NO: 133111 - DNA, 20 bp, human
gcggggcgggcgctaggtgg

SEQ ID NO: 133112 - DNA, 20 bp, human
gagctgacccagtgggccac

SEQ ID NO: 133113 - DNA, 20 bp, human
gtccggccggcgggtccggg

SEQ ID NO: 133114 - DNA, 20 bp, human
gagcggccgcccggacccgc

SEQ ID NO: 133115 - DNA, 20 bp, human
gactcggcggcgcggaaaag

SEQ ID NO: 133116 - DNA, 20 bp, human
ggtgtgggcgaccgcgctga

SEQ ID NO: 133117 - DNA, 20 bp, human
ggccattgtgcggtgcattg

SEQ ID NO: 133118 - DNA, 20 bp, human
gccccctcaggccccggtag

SEQ ID NO: 133119 - DNA, 20 bp, human
gcagacccgggtccctggta

SEQ ID NO: 133120 - DNA, 20 bp, human
gtgggtctccagggagccta

SEQ ID NO: 133121 - DNA, 20 bp, human
gggcgctgctgaccttacca

SEQ ID NO: 133122 - DNA, 20 bp, human
gcggcggtcgggccattgtg

SEQ ID NO: 133123 - DNA, 20 bp, human
ggcctaggggtcgggaatgg

SEQ ID NO: 133124 - DNA, 20 bp, human
ggcccgaccgccgccactac

SEQ ID NO: 133125 - DNA, 20 bp, human
gcgccactaccggggcctga

SEQ ID NO: 133126 - DNA, 20 bp, human
ggagatcctacaggagtcca

SEQ ID NO: 133127 - DNA, 20 bp, human
gtcctacaggagtccagggc

SEQ ID NO: 133128 - DNA, 20 bp, human
gggaaggagcaagccgtggt

SEQ ID NO: 133129 - DNA, 20 bp, human
ggggccctcccagctgtcac

SEQ ID NO: 133130 - DNA, 20 bp, human
gtccagccctggactcctgt

SEQ ID NO: 133131 - DNA, 20 bp, human
ggagcaagccgtggtaggtc

SEQ ID NO: 133132 - DNA, 20 bp, human
ggtcacaggcacgtgtccca

SEQ ID NO: 133133 - DNA, 20 bp, human
gctcagagctgagatcctac

SEQ ID NO: 133134 - DNA, 20 bp, human
gtggagagaaaacctctgcg

SEQ ID NO: 133135 - DNA, 20 bp, human
gacagaaacccgacctacca

SEQ ID NO: 133136 - DNA, 20 bp, human
gcgcgggtcgcagcacagtg

SEQ ID NO: 133137 - DNA, 20 bp, human
gtcaggaccgcggcactcac

SEQ ID NO: 133138 - DNA, 20 bp, human
ggccagcagggctctcatgg

SEQ ID NO: 133139 - DNA, 20 bp, human
gaggtcggggcgctagacgg

SEQ ID NO: 133140 - DNA, 20 bp, human
gcggcactcaccggtggctg

SEQ ID NO: 133141 - DNA, 20 bp, human
gctagacggcggctctgcaa

SEQ ID NO: 133142 - DNA, 20 bp, human
gcgcgccagcagggctctca

SEQ ID NO: 133143 - DNA, 20 bp, human
gcggcggctgcacggagtca

SEQ ID NO: 133144 - DNA, 20 bp, human
gtgcggggacaggtggaccc

SEQ ID NO: 133145 - DNA, 20 bp, human
ggcgaggtcggggcgctaga

SEQ ID NO: 133146 - DNA, 20 bp, human
gggagctgccctcgcgacat

SEQ ID NO: 133147 - DNA, 20 bp, human
gcgggtgacccatgtcgcga

SEQ ID NO: 133148 - DNA, 20 bp, human
ggtgcagggaccccgcgcac

SEQ ID NO: 133149 - DNA, 20 bp, human
ggaaggagagaagacgtgca

SEQ ID NO: 133150 - DNA, 20 bp, human
gacacctgcgtcccaggtag

SEQ ID NO: 133151 - DNA, 20 bp, human
gcgagggcagctcctgtgcg

SEQ ID NO: 133152 - DNA, 20 bp, human
gcctccttcctgaggccaga

SEQ ID NO: 133153 - DNA, 20 bp, human
ggaacagggtctaattgagg

SEQ ID NO: 133154 - DNA, 20 bp, human
gcagcccctacctgggacgc

SEQ ID NO: 133155 - DNA, 20 bp, human
ggggttgtcagaggatgagt

SEQ ID NO: 133156 - DNA, 20 bp, human
gcgagtcacctggagcattc

SEQ ID NO: 133157 - DNA, 20 bp, human
gcctgcggaatgggatgcag

SEQ ID NO: 133158 - DNA, 20 bp, human
gcagtccggtagcagtacca

SEQ ID NO: 133159 - DNA, 20 bp, human
gaaaaaatcaaggtccaggg

SEQ ID NO: 133160 - DNA, 20 bp, human
ggggacatgtaaccctgtgt

SEQ ID NO: 133161 - DNA, 20 bp, human
gcgggagcgaggcagatctt

SEQ ID NO: 133162 - DNA, 20 bp, human
ggctgctccagcagatggat

SEQ ID NO: 133163 - DNA, 20 bp, human
gtgaaaaaaatcaaggtcca

SEQ ID NO: 133164 - DNA, 20 bp, human
gcctggagcattctggcatg

SEQ ID NO: 133165 - DNA, 20 bp, human
gaccagcggggctaaaccac

SEQ ID NO: 133166 - DNA, 20 bp, human
gaggctcctggcctactcag

SEQ ID NO: 133167 - DNA, 20 bp, human
gccgcggtgactaacaacag

SEQ ID NO: 133168 - DNA, 20 bp, human
gcagcgagggcacttgagaa

SEQ ID NO: 133169 - DNA, 20 bp, human
ggcctgctccgggctctgag

SEQ ID NO: 133170 - DNA, 20 bp, human
gaggacgccccacctcggag

SEQ ID NO: 133171 - DNA, 20 bp, human
gagaggcggcgcccctgagt

SEQ ID NO: 133172 - DNA, 20 bp, human
ggcgccgcctctccgaggtg

SEQ ID NO: 133173 - DNA, 20 bp, human
ggagcgagaccgccggccgg

SEQ ID NO: 133174 - DNA, 20 bp, human
gccctgcggctgcgcagcga

SEQ ID NO: 133175 - DNA, 20 bp, human
ggccgtggagcgatgacccg

SEQ ID NO: 133176 - DNA, 20 bp, human
gagcattgtgcggtcatggt

SEQ ID NO: 133177 - DNA, 20 bp, human
ggccagatgtactgctaccc

SEQ ID NO: 133178 - DNA, 20 bp, human
ggacgtccaggagcaccgag

SEQ ID NO: 133179 - DNA, 20 bp, human
gtgcggggcgcagcattgtg

SEQ ID NO: 133180 - DNA, 20 bp, human
ggcgcagcattgtgcggtca

SEQ ID NO: 133181 - DNA, 20 bp, human
ggccggggtagcagtacatc

SEQ ID NO: 133182 - DNA, 20 bp, human
gagtagccagctcccaaaca

SEQ ID NO: 133183 - DNA, 20 bp, human
gccgccaggccgctcaggaa

SEQ ID NO: 133184 - DNA, 20 bp, human
gcccgggaacaggcgaggtc

SEQ ID NO: 133185 - DNA, 20 bp, human
gcatccgcgagactgggtaa

SEQ ID NO: 133186 - DNA, 20 bp, human
gtgtccgacagcctcaagaa

SEQ ID NO: 133187 - DNA, 20 bp, human
ggcacatcctctatacacag

SEQ ID NO: 133188 - DNA, 20 bp, human
gcggccatctgggctcatct

SEQ ID NO: 133189 - DNA, 20 bp, human
gcagccgaggctgccagtcg

SEQ ID NO: 133190 - DNA, 20 bp, human
gtgaatggtgcgctttgagg

SEQ ID NO: 133191 - DNA, 20 bp, human
ggtgcgctttgaggcggcgg

SEQ ID NO: 133192 - DNA, 20 bp, human
gccgaggctgccagtcgcgg

SEQ ID NO: 133193 - DNA, 20 bp, human
gaagccgagccggtcagccg

SEQ ID NO: 133194 - DNA, 20 bp, human
gcgagccagcgccccgactc

SEQ ID NO: 133195 - DNA, 20 bp, human
gaggctgtcggacacgcaca

SEQ ID NO: 133196 - DNA, 20 bp, human
gctgcctggccaaaccacac

SEQ ID NO: 133197 - DNA, 20 bp, human
ggaccacaggcccccatggc

SEQ ID NO: 133198 - DNA, 20 bp, human
gacacaggcgcctggatcct

SEQ ID NO: 133199 - DNA, 20 bp, human
gaaggaggccagccaggagg

SEQ ID NO: 133200 - DNA, 20 bp, human
ggataggccttcaccttggg

SEQ ID NO: 133201 - DNA, 20 bp, human
ggggaggagggtgatttaca

SEQ ID NO: 133202 - DNA, 20 bp, human
gtgctggagcaccaggtggt

SEQ ID NO: 133203 - DNA, 20 bp, human
gtgcctgccatgggggcctg

SEQ ID NO: 133204 - DNA, 20 bp, human
gtacaaggcagatgggcctc

SEQ ID NO: 133205 - DNA, 20 bp, human
gggtggccctggctgagtgc

SEQ ID NO: 133206 - DNA, 20 bp, human
gaagtctctgcgccaaggag

SEQ ID NO: 133207 - DNA, 20 bp, human
gtggtcggtccgggacagac

SEQ ID NO: 133208 - DNA, 20 bp, human
ggacccacggagccctgacg

SEQ ID NO: 133209 - DNA, 20 bp, human
gcggtccgggacagactggc

SEQ ID NO: 133210 - DNA, 20 bp, human
ggcgccgtcggtccccgtca

SEQ ID NO: 133211 - DNA, 20 bp, human
ggcagggtctccaccacggt

SEQ ID NO: 133212 - DNA, 20 bp, human
gtagtctggcagggagcggt

SEQ ID NO: 133213 - DNA, 20 bp, human
gtccgggacagactggcggg

SEQ ID NO: 133214 - DNA, 20 bp, human
gttcattacggagacgatcg

SEQ ID NO: 133215 - DNA, 20 bp, human
gcccggaccgaccagagcct

SEQ ID NO: 133216 - DNA, 20 bp, human
gcgggaggcgagaacgagga

SEQ ID NO: 133217 - DNA, 20 bp, human
gaacgaggagggaggctcgg

SEQ ID NO: 133218 - DNA, 20 bp, human
ggcgtacacactgggtctcc

SEQ ID NO: 133219 - DNA, 20 bp, human
gcagcaggcgatgactgcag

SEQ ID NO: 133220 - DNA, 20 bp, human
gggcgggcgggagcatcctc

SEQ ID NO: 133221 - DNA, 20 bp, human
gccgtagcctgggcaggttg

SEQ ID NO: 133222 - DNA, 20 bp, human
gctgtgcgcgcgggaggcag

SEQ ID NO: 133223 - DNA, 20 bp, human
gcagctccaggcaaagtgac

SEQ ID NO: 133224 - DNA, 20 bp, human
ggtgtgagagatcttgttgg

SEQ ID NO: 133225 - DNA, 20 bp, human
gcccgccctcaactgaggta

SEQ ID NO: 133226 - DNA, 20 bp, human
gtgagtagcgacagcaccgg

SEQ ID NO: 133227 - DNA, 20 bp, human
gcgatcccgctcgcacggag

SEQ ID NO: 133228 - DNA, 20 bp, human
ggctactcaagtgagtcccg

SEQ ID NO: 133229 - DNA, 20 bp, human
gtgcggtgcagggacctgaa

SEQ ID NO: 133230 - DNA, 20 bp, human
ggtcctggtcatgaaagtct

SEQ ID NO: 133231 - DNA, 20 bp, human
gcgagtccatgcccgacggg

SEQ ID NO: 133232 - DNA, 20 bp, human
gtctagcccggggggtgggt

SEQ ID NO: 133233 - DNA, 20 bp, human
gtgcccggcagtcccaccca

SEQ ID NO: 133234 - DNA, 20 bp, human
gacttgagtagcgacagcac

SEQ ID NO: 133235 - DNA, 20 bp, human
gggacctgaatggaccgcgg

SEQ ID NO: 133236 - DNA, 20 bp, human
gccatcggagggagtcggcg

SEQ ID NO: 133237 - DNA, 20 bp, human
ggccccggctctgagcgagg

SEQ ID NO: 133238 - DNA, 20 bp, human
ggggtctgcacgcggggaca

SEQ ID NO: 133239 - DNA, 20 bp, human
gggcgagcgaagaaacttag

SEQ ID NO: 133240 - DNA, 20 bp, human
ggccgcctcgctcagagccg

SEQ ID NO: 133241 - DNA, 20 bp, human
ggctgggaggctatggctag

SEQ ID NO: 133242 - DNA, 20 bp, human
ggggaagcaaagaacaccct

SEQ ID NO: 133243 - DNA, 20 bp, human
gtagcggcgcgggagggagt

SEQ ID NO: 133244 - DNA, 20 bp, human
gcggctcgccccgggaccct

SEQ ID NO: 133245 - DNA, 20 bp, human
gggtgcgacccccagctgga

SEQ ID NO: 133246 - DNA, 20 bp, human
ggccagctgctgtagaagag

SEQ ID NO: 133247 - DNA, 20 bp, human
gagctgctgtagaagagggg

SEQ ID NO: 133248 - DNA, 20 bp, human
gcctcaggagtggctagggt

SEQ ID NO: 133249 - DNA, 20 bp, human
gggatgaggaaaggagtcta

SEQ ID NO: 133250 - DNA, 20 bp, human
gaggaaacaagccagtgcaa

SEQ ID NO: 133251 - DNA, 20 bp, human
gcatctagagggcagaggta

SEQ ID NO: 133252 - DNA, 20 bp, human
gtgaactccacccccaataa

SEQ ID NO: 133253 - DNA, 20 bp, human
gcggagggaagcagtaagaa

SEQ ID NO: 133254 - DNA, 20 bp, human
gtaagctagagagaaccagg

SEQ ID NO: 133255 - DNA, 20 bp, human
ggcttccagatccttaccgt

SEQ ID NO: 133256 - DNA, 20 bp, human
gggcagcgcgcacatctcgg

SEQ ID NO: 133257 - DNA, 20 bp, human
gccgggcagcgcgcacatct

SEQ ID NO: 133258 - DNA, 20 bp, human
gcggtaacgctgggcaacgt

SEQ ID NO: 133259 - DNA, 20 bp, human
ggtgcgcgctgcccggacag

SEQ ID NO: 133260 - DNA, 20 bp, human
gtgaacggcgcgggtccaca

SEQ ID NO: 133261 - DNA, 20 bp, human
gaggcagtcgacccgcctaa

SEQ ID NO: 133262 - DNA, 20 bp, human
gcgaggcgggcggtcctcca

SEQ ID NO: 133263 - DNA, 20 bp, human
gatgcaggccgccctcgcag

SEQ ID NO: 133264 - DNA, 20 bp, human
gccgccaggtacgcggagtc

SEQ ID NO: 133265 - DNA, 20 bp, human
ggttgcccagcgttaccgtg

SEQ ID NO: 133266 - DNA, 20 bp, human
gccgggagcaagcgcaacgg

SEQ ID NO: 133267 - DNA, 20 bp, human
ggcagacgagcgggacccgg

SEQ ID NO: 133268 - DNA, 20 bp, human
gcgcccgggagcaagcgcaa

SEQ ID NO: 133269 - DNA, 20 bp, human
gggctgaggcggcagacgag

SEQ ID NO: 133270 - DNA, 20 bp, human
ggcacaggccaggaccgccc

SEQ ID NO: 133271 - DNA, 20 bp, human
ggaccgggacgggacgtgag

SEQ ID NO: 133272 - DNA, 20 bp, human
gcgtctcgggtggtcactgg

SEQ ID NO: 133273 - DNA, 20 bp, human
gcagtcaggcgtactcgcac

SEQ ID NO: 133274 - DNA, 20 bp, human
ggaagtcgcagcgacccgag

SEQ ID NO: 133275 - DNA, 20 bp, human
gggcgccgacaagatcgagg

SEQ ID NO: 133276 - DNA, 20 bp, human
ggcgctgagtgacccgagtc

SEQ ID NO: 133277 - DNA, 20 bp, human
ggcagcccgcgtcccgactc

SEQ ID NO: 133278 - DNA, 20 bp, human
gcggcggcggagggcgtgag

SEQ ID NO: 133279 - DNA, 20 bp, human
gaccccggagcccaaacccg

SEQ ID NO: 133280 - DNA, 20 bp, human
gcaagggccgtcaagagaga

SEQ ID NO: 133281 - DNA, 20 bp, human
gcccaccgcacggaccggag

SEQ ID NO: 133282 - DNA, 20 bp, human
gggaaggtcaggggtcgtgt

SEQ ID NO: 133283 - DNA, 20 bp, human
gaagtagcgagcgccggcgg

SEQ ID NO: 133284 - DNA, 20 bp, human
ggtgacccgagtcgggacgc

SEQ ID NO: 133285 - DNA, 20 bp, human
ggccaggacgcagaccccct

SEQ ID NO: 133286 - DNA, 20 bp, human
gagacgagcggggaagagca

SEQ ID NO: 133287 - DNA, 20 bp, human
gagcagaagccccagacgag

SEQ ID NO: 133288 - DNA, 20 bp, human
gattatgggaccctgaagag

SEQ ID NO: 133289 - DNA, 20 bp, human
gggaccctgaagagcggccg

SEQ ID NO: 133290 - DNA, 20 bp, human
gtggccacggccgctcttca

SEQ ID NO: 133291 - DNA, 20 bp, human
gaggaggtcagtgctttcgg

SEQ ID NO: 133292 - DNA, 20 bp, human
ggagaagtgctcttctaggg

SEQ ID NO: 133293 - DNA, 20 bp, human
gagaaagcaggttgtggcgg

SEQ ID NO: 133294 - DNA, 20 bp, human
ggatcccctaaggccccgtg

SEQ ID NO: 133295 - DNA, 20 bp, human
ggctgccgagaaaggaactt

SEQ ID NO: 133296 - DNA, 20 bp, human
ggcctgcattcccacaatag

SEQ ID NO: 133297 - DNA, 20 bp, human
gacgctggaagcatctgctc

SEQ ID NO: 133298 - DNA, 20 bp, human
gtgcttccagcgtgcttatc

SEQ ID NO: 133299 - DNA, 20 bp, human
gtcggggctgccgctattgt

SEQ ID NO: 133300 - DNA, 20 bp, human
gtgtgggaatgcaggcgctg

SEQ ID NO: 133301 - DNA, 20 bp, human
gtaatagtcctagtaaaaga

SEQ ID NO: 133302 - DNA, 20 bp, human
gagcatgagccaagttctgg

SEQ ID NO: 133303 - DNA, 20 bp, human
ggccgctattgtgggaatgc

SEQ ID NO: 133304 - DNA, 20 bp, human
gcaattcaggctttatagtg

SEQ ID NO: 133305 - DNA, 20 bp, human
ggttctataatcatatctca

SEQ ID NO: 133306 - DNA, 20 bp, human
gcgcggcagggcagcgtgtg

SEQ ID NO: 133307 - DNA, 20 bp, human
ggtcagcacaggggcagatg

SEQ ID NO: 133308 - DNA, 20 bp, human
gtcagactcggtcccagagg

SEQ ID NO: 133309 - DNA, 20 bp, human
ggtggggctgcgatcggcat

SEQ ID NO: 133310 - DNA, 20 bp, human
gcagcgtgtggggctgcgat

SEQ ID NO: 133311 - DNA, 20 bp, human
gctttcacgtgtcagcacag

SEQ ID NO: 133312 - DNA, 20 bp, human
ggcgcggggtgcccctgctc

SEQ ID NO: 133313 - DNA, 20 bp, human
gtgacccactgaccccccgt

SEQ ID NO: 133314 - DNA, 20 bp, human
gccgcgcccgcccgtgagga

SEQ ID NO: 133315 - DNA, 20 bp, human
gcctcaccttcctcacgggc

SEQ ID NO: 133316 - DNA, 20 bp, human
gtcggccccctgggtaagaa

SEQ ID NO: 133317 - DNA, 20 bp, human
gattccttggtggccctgga

SEQ ID NO: 133318 - DNA, 20 bp, human
gggctgcgtcagggattcct

SEQ ID NO: 133319 - DNA, 20 bp, human
gctgccccttcttacccagg

SEQ ID NO: 133320 - DNA, 20 bp, human
gtgcgtcagggattccttgg

SEQ ID NO: 133321 - DNA, 20 bp, human
gagccgggcctgcttcacgg

SEQ ID NO: 133322 - DNA, 20 bp, human
gctggccctggccaggtgac

SEQ ID NO: 133323 - DNA, 20 bp, human
gctgacgcagccgcctccca

SEQ ID NO: 133324 - DNA, 20 bp, human
gccctggagggtggataggc

SEQ ID NO: 133325 - DNA, 20 bp, human
ggaaggccggtgggcctctg

SEQ ID NO: 133326 - DNA, 20 bp, human
ggcggtcccaggaagtgcgg

SEQ ID NO: 133327 - DNA, 20 bp, human
ggagtccagccgctaggcac

SEQ ID NO: 133328 - DNA, 20 bp, human
gggccagagccgggcgactg

SEQ ID NO: 133329 - DNA, 20 bp, human
gggagcgcaccggtgcctag

SEQ ID NO: 133330 - DNA, 20 bp, human
gccgctgcgccgcagtccgc

SEQ ID NO: 133331 - DNA, 20 bp, human
gtcccggtgcaggagcgcac

SEQ ID NO: 133332 - DNA, 20 bp, human
ggacgccggcggcccgatag

SEQ ID NO: 133333 - DNA, 20 bp, human
gaaagcgggacgcccggcag

SEQ ID NO: 133334 - DNA, 20 bp, human
ggccacctgcccgcggactg

SEQ ID NO: 133335 - DNA, 20 bp, human
gcgccgccgccgcacttcct

SEQ ID NO: 133336 - DNA, 20 bp, human
gtttgtgcaggcgggtctgc

SEQ ID NO: 133337 - DNA, 20 bp, human
gttcgtccccggacacgccg

SEQ ID NO: 133338 - DNA, 20 bp, human
gacgcacgcaatccagccat

SEQ ID NO: 133339 - DNA, 20 bp, human
gggagcagcatcatcaaggt

SEQ ID NO: 133340 - DNA, 20 bp, human
gtccaaggacggctgagggt

SEQ ID NO: 133341 - DNA, 20 bp, human
gcgaggacgcggctttgtgc

SEQ ID NO: 133342 - DNA, 20 bp, human
gggcgggcgcgctatgacag

SEQ ID NO: 133343 - DNA, 20 bp, human
gacgcgggggcgcgaggacg

SEQ ID NO: 133344 - DNA, 20 bp, human
gctggattgcgtgcgtgggt

SEQ ID NO: 133345 - DNA, 20 bp, human
gacagcggcggggtttccaa

SEQ ID NO: 133346 - DNA, 20 bp, human
gtggtgttggcttagggtct

SEQ ID NO: 133347 - DNA, 20 bp, human
gtgcgtgtgggactcaaggt

SEQ ID NO: 133348 - DNA, 20 bp, human
ggagttcatgtagctggtgt

SEQ ID NO: 133349 - DNA, 20 bp, human
gcccctgcgtgtgggactca

SEQ ID NO: 133350 - DNA, 20 bp, human
gtgcccgcgttggcttcaca

SEQ ID NO: 133351 - DNA, 20 bp, human
gcccacacgcagggggagtt

SEQ ID NO: 133352 - DNA, 20 bp, human
gagaccaggcctttcattct

SEQ ID NO: 133353 - DNA, 20 bp, human
gatcttccctgctgcccgga

SEQ ID NO: 133354 - DNA, 20 bp, human
ggagcccagaatgaaaggcc

SEQ ID NO: 133355 - DNA, 20 bp, human
gagaaaggacgagatcctct

SEQ ID NO: 133356 - DNA, 20 bp, human
gaggagctctgggattccag

SEQ ID NO: 133357 - DNA, 20 bp, human
gacttgccatcaggagaacg

SEQ ID NO: 133358 - DNA, 20 bp, human
gcgggtcgggacagctggga

SEQ ID NO: 133359 - DNA, 20 bp, human
gcccgccacgtcccccgtag

SEQ ID NO: 133360 - DNA, 20 bp, human
ggtgtcccgcagagacccgg

SEQ ID NO: 133361 - DNA, 20 bp, human
gtcgggacagctgggacggt

SEQ ID NO: 133362 - DNA, 20 bp, human
gtgatggcaagtcccctacg

SEQ ID NO: 133363 - DNA, 20 bp, human
gtggctccgcggctctgacc

SEQ ID NO: 133364 - DNA, 20 bp, human
gtgaatcaacggaaggacag

SEQ ID NO: 133365 - DNA, 20 bp, human
gagagtgtcccgcagagacc

SEQ ID NO: 133366 - DNA, 20 bp, human
gcgtctgtgcagagaagcgg

SEQ ID NO: 133367 - DNA, 20 bp, human
gaggctgggccggagagagt

SEQ ID NO: 133368 - DNA, 20 bp, human
gcacacagaagtgcagccgg

SEQ ID NO: 133369 - DNA, 20 bp, human
gctgggactgagcagattaa

SEQ ID NO: 133370 - DNA, 20 bp, human
ggtgatgatcactgagtgag

SEQ ID NO: 133371 - DNA, 20 bp, human
gggggactgtgagtgctagt

SEQ ID NO: 133372 - DNA, 20 bp, human
gctgggctggtacacaagct

SEQ ID NO: 133373 - DNA, 20 bp, human
gggcatgtctgtacactggg

SEQ ID NO: 133374 - DNA, 20 bp, human
ggattaagggagtggagcgg

SEQ ID NO: 133375 - DNA, 20 bp, human
gcacctgtgtatggacccgc

SEQ ID NO: 133376 - DNA, 20 bp, human
gggttgtatgcggaggactg

SEQ ID NO: 133377 - DNA, 20 bp, human
ggtggcaagttaccacttag

SEQ ID NO: 133378 - DNA, 20 bp, human
ggaccgaggcgctagagtca

SEQ ID NO: 133379 - DNA, 20 bp, human
gagagcaaacattggattag

SEQ ID NO: 133380 - DNA, 20 bp, human
gcagcctgcccgaggagtgc

SEQ ID NO: 133381 - DNA, 20 bp, human
gaccataggagggggtcacg

SEQ ID NO: 133382 - DNA, 20 bp, human
ggcctcgtgaccccctccta

SEQ ID NO: 133383 - DNA, 20 bp, human
gacgaggccatcgtgccagt

SEQ ID NO: 133384 - DNA, 20 bp, human
gcaggagaaaccataggagg

SEQ ID NO: 133385 - DNA, 20 bp, human
ggtcccagcactcctcgggc

SEQ ID NO: 133386 - DNA, 20 bp, human
gggctgggcaccacactgtc

SEQ ID NO: 133387 - DNA, 20 bp, human
gagtagctgcccaaacccac

SEQ ID NO: 133388 - DNA, 20 bp, human
gtcgaagaagactgttcagg

SEQ ID NO: 133389 - DNA, 20 bp, human
gagaagccaaacagtttcaa

SEQ ID NO: 133390 - DNA, 20 bp, human
gagctagcttcaaagaacga

SEQ ID NO: 133391 - DNA, 20 bp, human
gtgacagtcacctgacagtg

SEQ ID NO: 133392 - DNA, 20 bp, human
gcaaaagaggtatagctggt

SEQ ID NO: 133393 - DNA, 20 bp, human
gttcaagggcagggtagtgc

SEQ ID NO: 133394 - DNA, 20 bp, human
gagaaacagtatgcaagatg

SEQ ID NO: 133395 - DNA, 20 bp, human
ggaggtatagctggttggct

SEQ ID NO: 133396 - DNA, 20 bp, human
gtgagctccagctgtgccag

SEQ ID NO: 133397 - DNA, 20 bp, human
gcgttggcggcggactctca

SEQ ID NO: 133398 - DNA, 20 bp, human
ggccgctagcacctgcgcgt

SEQ ID NO: 133399 - DNA, 20 bp, human
ggccaacgcgcaggtgctag

SEQ ID NO: 133400 - DNA, 20 bp, human
gctcagggctcgggtgcctc

SEQ ID NO: 133401 - DNA, 20 bp, human
gcggcggactctcagggctc

SEQ ID NO: 133402 - DNA, 20 bp, human
gagggcgcccggatgacctg

SEQ ID NO: 133403 - DNA, 20 bp, human
gtggtgtccccaggtcatcc

SEQ ID NO: 133404 - DNA, 20 bp, human
gggtgcgcggtggcatgact

SEQ ID NO: 133405 - DNA, 20 bp, human
gaggcccttggggatcgcta

SEQ ID NO: 133406 - DNA, 20 bp, human
gaggtggacaccctgaagga

SEQ ID NO: 133407 - DNA, 20 bp, human
ggggctcgaaggggtcggtg

SEQ ID NO: 133408 - DNA, 20 bp, human
ggagaggacccaggtacaca

SEQ ID NO: 133409 - DNA, 20 bp, human
ggcgctggctccgtctgcca

SEQ ID NO: 133410 - DNA, 20 bp, human
gggactaaggtaggggatgg

SEQ ID NO: 133411 - DNA, 20 bp, human
gagtgcaggttcccacctag

SEQ ID NO: 133412 - DNA, 20 bp, human
gagatggatggccctcaggg

SEQ ID NO: 133413 - DNA, 20 bp, human
gcccggaaggctccgacctg

SEQ ID NO: 133414 - DNA, 20 bp, human
gggctccgtctgccagggtg

SEQ ID NO: 133415 - DNA, 20 bp, human
gcttggctccggaacccccg

SEQ ID NO: 133416 - DNA, 20 bp, human
gcgaggccgaggcccctcag

SEQ ID NO: 133417 - DNA, 20 bp, human
gagaagctggggcccaccgg

SEQ ID NO: 133418 - DNA, 20 bp, human
ggtctgcagctacctccggt

SEQ ID NO: 133419 - DNA, 20 bp, human
gaggcgtctgcagctacctc

SEQ ID NO: 133420 - DNA, 20 bp, human
ggtctggacaggctgaacga

SEQ ID NO: 133421 - DNA, 20 bp, human
gccccccacctacccctgag

SEQ ID NO: 133422 - DNA, 20 bp, human
gcagcgctggatgaggtcag

SEQ ID NO: 133423 - DNA, 20 bp, human
ggtgggccccagcttctgtc

SEQ ID NO: 133424 - DNA, 20 bp, human
gggacaggctgaacgagggt

SEQ ID NO: 133425 - DNA, 20 bp, human
ggctgcgtgggtgctgatgg

SEQ ID NO: 133426 - DNA, 20 bp, human
gcagcctggaaggtgcgtgt

SEQ ID NO: 133427 - DNA, 20 bp, human
ggcctgcgcgcggctaggag

SEQ ID NO: 133428 - DNA, 20 bp, human
gtggggctgggtctcggagt

SEQ ID NO: 133429 - DNA, 20 bp, human
ggtggcaaagagggcttaca

SEQ ID NO: 133430 - DNA, 20 bp, human
ggccgcgcgcaggcgcacta

SEQ ID NO: 133431 - DNA, 20 bp, human
ggtcaggcggggatacagcc

SEQ ID NO: 133432 - DNA, 20 bp, human
gtaggaggggccgtcaggcg

SEQ ID NO: 133433 - DNA, 20 bp, human
gagggagcgattacgaccta

SEQ ID NO: 133434 - DNA, 20 bp, human
ggcggctaggaggggccgtc

SEQ ID NO: 133435 - DNA, 20 bp, human
ggcaggatgcaggtaacata

SEQ ID NO: 133436 - DNA, 20 bp, human
gggaggctgaggccataggg

SEQ ID NO: 133437 - DNA, 20 bp, human
gggaggttggtgtggagcac

SEQ ID NO: 133438 - DNA, 20 bp, human
gtatctaccatgggaccagg

SEQ ID NO: 133439 - DNA, 20 bp, human
ggagagacccctgcagagta

SEQ ID NO: 133440 - DNA, 20 bp, human
gtgcaggccctcagctcacg

SEQ ID NO: 133441 - DNA, 20 bp, human
gaagaccctgcagacatcag

SEQ ID NO: 133442 - DNA, 20 bp, human
gctgggaggctgaggccata

SEQ ID NO: 133443 - DNA, 20 bp, human
ggagcctgccccgtgagctg

SEQ ID NO: 133444 - DNA, 20 bp, human
ggtcttacgctatctaccat

SEQ ID NO: 133445 - DNA, 20 bp, human
ggacggagcgagtcatctac

SEQ ID NO: 133446 - DNA, 20 bp, human
ggagacagaagtgcccggtg

SEQ ID NO: 133447 - DNA, 20 bp, human
gtcatgtcaggatggagatc

SEQ ID NO: 133448 - DNA, 20 bp, human
gagtaggtgccgcaaggagc

SEQ ID NO: 133449 - DNA, 20 bp, human
gtgagggcttcgagcagatg

SEQ ID NO: 133450 - DNA, 20 bp, human
gggcggctgcggtcccgagc

SEQ ID NO: 133451 - DNA, 20 bp, human
gggagatccggcagcacgag

SEQ ID NO: 133452 - DNA, 20 bp, human
gtccgctcgccggctccttg

SEQ ID NO: 133453 - DNA, 20 bp, human
gtctcggcctccccccatga

SEQ ID NO: 133454 - DNA, 20 bp, human
ggcggccgcccggtcatgtc

SEQ ID NO: 133455 - DNA, 20 bp, human
ggggaaaggaacctgctccg

SEQ ID NO: 133456 - DNA, 20 bp, human
ggctgtgggtcccggattag

SEQ ID NO: 133457 - DNA, 20 bp, human
ggattagcggcggcatggga

SEQ ID NO: 133458 - DNA, 20 bp, human
gggcctggctctgactctgg

SEQ ID NO: 133459 - DNA, 20 bp, human
gcggcatgggacggttgagt

SEQ ID NO: 133460 - DNA, 20 bp, human
gggcgtggcctggcggtcta

SEQ ID NO: 133461 - DNA, 20 bp, human
gcgcagcagggcctcggtac

SEQ ID NO: 133462 - DNA, 20 bp, human
ggtgggtcccggattagcgg

SEQ ID NO: 133463 - DNA, 20 bp, human
gcggttgagttggcaggtgg

SEQ ID NO: 133464 - DNA, 20 bp, human
gggtacaggtcacctgagac

SEQ ID NO: 133465 - DNA, 20 bp, human
gcagttgctgcaccagcgtg

SEQ ID NO: 133466 - DNA, 20 bp, human
ggcagccccgtgtggcacac

SEQ ID NO: 133467 - DNA, 20 bp, human
ggccccacgagacgctcact

SEQ ID NO: 133468 - DNA, 20 bp, human
ggccgagtgagcgtctcgtg

SEQ ID NO: 133469 - DNA, 20 bp, human
gggagtggccgcaccgactg

SEQ ID NO: 133470 - DNA, 20 bp, human
ggctgcctgtgtgccacacg

SEQ ID NO: 133471 - DNA, 20 bp, human
ggcctcaggcacggtgctct

SEQ ID NO: 133472 - DNA, 20 bp, human
gtcagatgtcgggcctggaa

SEQ ID NO: 133473 - DNA, 20 bp, human
gggaccctcggcctcaggca

SEQ ID NO: 133474 - DNA, 20 bp, human
gcaacacggagtgggccgac

SEQ ID NO: 133475 - DNA, 20 bp, human
gctcagagccccagtcggtg

SEQ ID NO: 133476 - DNA, 20 bp, human
gggtgaggtaccagtaaaag

SEQ ID NO: 133477 - DNA, 20 bp, human
gaggcgggcacgatctctgg

SEQ ID NO: 133478 - DNA, 20 bp, human
gcggcaggtgcaggtactgg

SEQ ID NO: 133479 - DNA, 20 bp, human
gcggcgtcctggaggaaggc

SEQ ID NO: 133480 - DNA, 20 bp, human
gaggtgggcgatgccttcat

SEQ ID NO: 133481 - DNA, 20 bp, human
ggagaggcgggcacgatctc

SEQ ID NO: 133482 - DNA, 20 bp, human
gtgcaggtactggcggaggt

SEQ ID NO: 133483 - DNA, 20 bp, human
gagtgccggcagggattgca

SEQ ID NO: 133484 - DNA, 20 bp, human
gtggcccgcagctggtcccg

SEQ ID NO: 133485 - DNA, 20 bp, human
gtaaaagtggcaccaggcaa

SEQ ID NO: 133486 - DNA, 20 bp, human
gagatgcaaaggtcactctc

SEQ ID NO: 133487 - DNA, 20 bp, human
gcagccacctcagcatgcag

SEQ ID NO: 133488 - DNA, 20 bp, human
gaaccaaagcggatcagaga

SEQ ID NO: 133489 - DNA, 20 bp, human
ggtggtagcacatagaatgt

SEQ ID NO: 133490 - DNA, 20 bp, human
gagccagcatggaaccaaag

SEQ ID NO: 133491 - DNA, 20 bp, human
gcaagaaacctccatagaag

SEQ ID NO: 133492 - DNA, 20 bp, human
gaccagttgggttgaaatag

SEQ ID NO: 133493 - DNA, 20 bp, human
gccggctacctgctcatctt

SEQ ID NO: 133494 - DNA, 20 bp, human
gccactgacaccctggtaag

SEQ ID NO: 133495 - DNA, 20 bp, human
gcgacctgctgtagaaaagg

SEQ ID NO: 133496 - DNA, 20 bp, human
gccaggaagcagctccgacg

SEQ ID NO: 133497 - DNA, 20 bp, human
gttagcgcagtatggagtcg

SEQ ID NO: 133498 - DNA, 20 bp, human
gcatactgcgctaaccaagt

SEQ ID NO: 133499 - DNA, 20 bp, human
gcgcgtctggccccgctcta

SEQ ID NO: 133500 - DNA, 20 bp, human
gcagacgcgcgccccggaac

SEQ ID NO: 133501 - DNA, 20 bp, human
gccgtgggcgcggactgcgc

SEQ ID NO: 133502 - DNA, 20 bp, human
gcgggcggcgacatggagga

SEQ ID NO: 133503 - DNA, 20 bp, human
gccgctctagggagccgcgt

SEQ ID NO: 133504 - DNA, 20 bp, human
ggcggcccggtcccaccatg

SEQ ID NO: 133505 - DNA, 20 bp, human
gctctggacacgcgccaggg

SEQ ID NO: 133506 - DNA, 20 bp, human
gtgcctcagccctcagacgg

SEQ ID NO: 133507 - DNA, 20 bp, human
gacgcggccgcgctggagca

SEQ ID NO: 133508 - DNA, 20 bp, human
gcgagcctctgtgggagccg

SEQ ID NO: 133509 - DNA, 20 bp, human
gcgggcagccgagcctctgt

SEQ ID NO: 133510 - DNA, 20 bp, human
gtcccgacgtcagccctcag

SEQ ID NO: 133511 - DNA, 20 bp, human
ggccgtcgcggacgccgctc

SEQ ID NO: 133512 - DNA, 20 bp, human
gcgccgctgagggctgacgt

SEQ ID NO: 133513 - DNA, 20 bp, human
ggagacgccgaggagctcgt

SEQ ID NO: 133514 - DNA, 20 bp, human
gtgagggctgaggcagcgtg

SEQ ID NO: 133515 - DNA, 20 bp, human
ggtgcgcgggctggccgtcg

SEQ ID NO: 133516 - DNA, 20 bp, human
gaagtccaggctgcacccag

SEQ ID NO: 133517 - DNA, 20 bp, human
gccagagcgaggggagcgag

SEQ ID NO: 133518 - DNA, 20 bp, human
gggcctagaaggctccccta

SEQ ID NO: 133519 - DNA, 20 bp, human
ggaaaggacaggagtcccta

SEQ ID NO: 133520 - DNA, 20 bp, human
ggcgagaggcgcggagagtt

SEQ ID NO: 133521 - DNA, 20 bp, human
gagcattgtactcacatccg

SEQ ID NO: 133522 - DNA, 20 bp, human
ggaccccgcaacgactgccc

SEQ ID NO: 133523 - DNA, 20 bp, human
gaagggaagcgtgtaaggtg

SEQ ID NO: 133524 - DNA, 20 bp, human
gtccctgcacgcccagagag

SEQ ID NO: 133525 - DNA, 20 bp, human
ggagaaaagggaagcgtgta

SEQ ID NO: 133526 - DNA, 20 bp, human
gcccatacctgtgagatagt

SEQ ID NO: 133527 - DNA, 20 bp, human
gggaagtgaaatcgacgtcg

SEQ ID NO: 133528 - DNA, 20 bp, human
gggcctcgccgcctagccgg

SEQ ID NO: 133529 - DNA, 20 bp, human
ggggtcaatgaaaacaaacg

SEQ ID NO: 133530 - DNA, 20 bp, human
ggatccggcccctttcatcc

SEQ ID NO: 133531 - DNA, 20 bp, human
gatgggggctcgtgtgatga

SEQ ID NO: 133532 - DNA, 20 bp, human
gaccaactatctcacaggta

SEQ ID NO: 133533 - DNA, 20 bp, human
gggcttacccgggaatgtct

SEQ ID NO: 133534 - DNA, 20 bp, human
gcgcgggcccagacattccc

SEQ ID NO: 133535 - DNA, 20 bp, human
gggctgctgagaaggcgggt

SEQ ID NO: 133536 - DNA, 20 bp, human
ggagagagaccgtaagagac

SEQ ID NO: 133537 - DNA, 20 bp, human
gagaatgagacagagactta

SEQ ID NO: 133538 - DNA, 20 bp, human
ggaacagcagcgtgggcggc

SEQ ID NO: 133539 - DNA, 20 bp, human
gcctcttgcccccccgtcac

SEQ ID NO: 133540 - DNA, 20 bp, human
gtgttctcccctcccaatcc

SEQ ID NO: 133541 - DNA, 20 bp, human
gctttgtctcctgtctctta

SEQ ID NO: 133542 - DNA, 20 bp, human
gttttattgtcagactcaca

SEQ ID NO: 133543 - DNA, 20 bp, human
ggacagcagctaagagacaa

SEQ ID NO: 133544 - DNA, 20 bp, human
gcagagaggaaagagaaact

SEQ ID NO: 133545 - DNA, 20 bp, human
gcagggaaagaccagcagag

SEQ ID NO: 133546 - DNA, 20 bp, human
gacggcacgggggcccgcgg

SEQ ID NO: 133547 - DNA, 20 bp, human
gcttacgggatcaccagggg

SEQ ID NO: 133548 - DNA, 20 bp, human
gggcggctagggatcagaca

SEQ ID NO: 133549 - DNA, 20 bp, human
gggctagggatcagacatgg

SEQ ID NO: 133550 - DNA, 20 bp, human
gggtggtcaccggacaccgg

SEQ ID NO: 133551 - DNA, 20 bp, human
ggttgggctccgcctggagg

SEQ ID NO: 133552 - DNA, 20 bp, human
ggctgcaggagcacagaccc

SEQ ID NO: 133553 - DNA, 20 bp, human
gctgccgccgcggctgccga

SEQ ID NO: 133554 - DNA, 20 bp, human
gggcggtggtcaccggacac

SEQ ID NO: 133555 - DNA, 20 bp, human
gtcccgtaagtccaggaccg

SEQ ID NO: 133556 - DNA, 20 bp, human
gctctgcctgggaaagatgc

SEQ ID NO: 133557 - DNA, 20 bp, human
gacaggggactctggaggtg

SEQ ID NO: 133558 - DNA, 20 bp, human
gacagcatcagccctgacag

SEQ ID NO: 133559 - DNA, 20 bp, human
gcctccagagtcccctgtca

SEQ ID NO: 133560 - DNA, 20 bp, human
gaatcagtcatctctccggc

SEQ ID NO: 133561 - DNA, 20 bp, human
ggaaggctgggctctggtca

SEQ ID NO: 133562 - DNA, 20 bp, human
ggcgccagggacctgccagc

SEQ ID NO: 133563 - DNA, 20 bp, human
ggtggccctgaaatccccgg

SEQ ID NO: 133564 - DNA, 20 bp, human
gcagccctgacaggggactc

SEQ ID NO: 133565 - DNA, 20 bp, human
gccaggctcacgcggcagac

SEQ ID NO: 133566 - DNA, 20 bp, human
gccgcgctcggcgaacatgg

SEQ ID NO: 133567 - DNA, 20 bp, human
gccatcccggcacaccccgt

SEQ ID NO: 133568 - DNA, 20 bp, human
gcatggcggcggcgacggtc

SEQ ID NO: 133569 - DNA, 20 bp, human
gtgggaggagggcttcacgg

SEQ ID NO: 133570 - DNA, 20 bp, human
gccccgtaggaccaatgctc

SEQ ID NO: 133571 - DNA, 20 bp, human
ggctccgcgctcggcgaaca

SEQ ID NO: 133572 - DNA, 20 bp, human
ggaagaagacgcggccatcc

SEQ ID NO: 133573 - DNA, 20 bp, human
gggctgggaggagggcttca

SEQ ID NO: 133574 - DNA, 20 bp, human
ggcggcggcgacggtcgggc

SEQ ID NO: 133575 - DNA, 20 bp, human
gacctgagcattggtcctac

SEQ ID NO: 133576 - DNA, 20 bp, human
gggccctacgtgggtcggag

SEQ ID NO: 133577 - DNA, 20 bp, human
gggcgagtcgagggttcagg

SEQ ID NO: 133578 - DNA, 20 bp, human
gccgtggcgccgcctgcgac

SEQ ID NO: 133579 - DNA, 20 bp, human
gccgggtccgggccctacgt

SEQ ID NO: 133580 - DNA, 20 bp, human
gcccgggcccggcgagtcga

SEQ ID NO: 133581 - DNA, 20 bp, human
gacgagctgccggtcgcagg

SEQ ID NO: 133582 - DNA, 20 bp, human
gcccccgggccgaggatgtg

SEQ ID NO: 133583 - DNA, 20 bp, human
gagccgcgcagacaaaggac

SEQ ID NO: 133584 - DNA, 20 bp, human
gcctccagccgcgcagacaa

SEQ ID NO: 133585 - DNA, 20 bp, human
gagccagccggtgaacccgt

SEQ ID NO: 133586 - DNA, 20 bp, human
gtggcagcagcatcgagtag

SEQ ID NO: 133587 - DNA, 20 bp, human
gcaacaagtgtagacaaggt

SEQ ID NO: 133588 - DNA, 20 bp, human
gagcgcaggcgcagcgggtt

SEQ ID NO: 133589 - DNA, 20 bp, human
gcatcgagtagcggccgctt

SEQ ID NO: 133590 - DNA, 20 bp, human
ggcggcaagaggaacagaca

SEQ ID NO: 133591 - DNA, 20 bp, human
ggacaaggtgggtgcatcaa

SEQ ID NO: 133592 - DNA, 20 bp, human
gggtgagggagtagaatgtg

SEQ ID NO: 133593 - DNA, 20 bp, human
gtccgcaacaagtgtagaca

SEQ ID NO: 133594 - DNA, 20 bp, human
gttcctaacagggttagagt

SEQ ID NO: 133595 - DNA, 20 bp, human
ggtgtgccccggagagcctg

SEQ ID NO: 133596 - DNA, 20 bp, human
gggagaacaccaagacgcca

SEQ ID NO: 133597 - DNA, 20 bp, human
gcagaaaggatgcaaggcgg

SEQ ID NO: 133598 - DNA, 20 bp, human
gcggaggctgcagtcgggaa

SEQ ID NO: 133599 - DNA, 20 bp, human
gagcaggcgaggaatcgccg

SEQ ID NO: 133600 - DNA, 20 bp, human
gtcccggcagtcagacatgt

SEQ ID NO: 133601 - DNA, 20 bp, human
gggccaggacgccggacgtg

SEQ ID NO: 133602 - DNA, 20 bp, human
gagcggccagaaaggatgca

SEQ ID NO: 133603 - DNA, 20 bp, human
ggggtcgtccggactaaaca

SEQ ID NO: 133604 - DNA, 20 bp, human
gccgaggcgtgacgtcagaa

SEQ ID NO: 133605 - DNA, 20 bp, human
gggaaggtcagggtggtcca

SEQ ID NO: 133606 - DNA, 20 bp, human
ggtcggccaagtggtcccgg

SEQ ID NO: 133607 - DNA, 20 bp, human
gaccgccggggagagagcct

SEQ ID NO: 133608 - DNA, 20 bp, human
gactggacgcggcaccaagg

SEQ ID NO: 133609 - DNA, 20 bp, human
gcttgggctccggattgcag

SEQ ID NO: 133610 - DNA, 20 bp, human
gcggattgcagagggccggg

SEQ ID NO: 133611 - DNA, 20 bp, human
ggccgggcgggaactccgcg

SEQ ID NO: 133612 - DNA, 20 bp, human
ggcccaggctctctccccgg

SEQ ID NO: 133613 - DNA, 20 bp, human
gcggggtcagcagggactcg

SEQ ID NO: 133614 - DNA, 20 bp, human
gcgccccaaggagaccgccg

SEQ ID NO: 133615 - DNA, 20 bp, human
gtcgctgggacgctctccga

SEQ ID NO: 133616 - DNA, 20 bp, human
gtactgcggtgtggactcga

SEQ ID NO: 133617 - DNA, 20 bp, human
ggcctccagactgcagactg

SEQ ID NO: 133618 - DNA, 20 bp, human
gctgagaagagaggtcccgg

SEQ ID NO: 133619 - DNA, 20 bp, human
ggcggggacccgggctactg

SEQ ID NO: 133620 - DNA, 20 bp, human
gagcccggccgggggacggt

SEQ ID NO: 133621 - DNA, 20 bp, human
gatgggaccactgtccccct

SEQ ID NO: 133622 - DNA, 20 bp, human
gcggtgtggactcgagggct

SEQ ID NO: 133623 - DNA, 20 bp, human
gccttcccaggcctcttctt

SEQ ID NO: 133624 - DNA, 20 bp, human
ggcctgggaagggcgctcct

SEQ ID NO: 133625 - DNA, 20 bp, human
gccagcccaagaagaggcct

SEQ ID NO: 133626 - DNA, 20 bp, human
gctccagtcgaacccgacaa

SEQ ID NO: 133627 - DNA, 20 bp, human
gagcccaggcagccgttgtc

SEQ ID NO: 133628 - DNA, 20 bp, human
gccgcgacgacgacacctcc

SEQ ID NO: 133629 - DNA, 20 bp, human
ggagccgtcgcagcgccggg

SEQ ID NO: 133630 - DNA, 20 bp, human
gagccggcgcgatccagacg

SEQ ID NO: 133631 - DNA, 20 bp, human
gagccgttgtcgggttcgac

SEQ ID NO: 133632 - DNA, 20 bp, human
gggccgggcgagaagttgtg

SEQ ID NO: 133633 - DNA, 20 bp, human
ggggtaggtgaagcccgggt

SEQ ID NO: 133634 - DNA, 20 bp, human
gcgtccgcgaccaggaggat

SEQ ID NO: 133635 - DNA, 20 bp, human
gtggaccggaccctacccgg

SEQ ID NO: 133636 - DNA, 20 bp, human
ggcgccctgcagccgccgtc

SEQ ID NO: 133637 - DNA, 20 bp, human
ggcgggagcaccgggaactt

SEQ ID NO: 133638 - DNA, 20 bp, human
gagcggtggctacaactccc

SEQ ID NO: 133639 - DNA, 20 bp, human
gctcccgcccctcgccccag

SEQ ID NO: 133640 - DNA, 20 bp, human
ggactccgacccccgagacg

SEQ ID NO: 133641 - DNA, 20 bp, human
gcgcggaaccccaagcgggg

SEQ ID NO: 133642 - DNA, 20 bp, human
ggcggcgctcgcaggtcggg

SEQ ID NO: 133643 - DNA, 20 bp, human
ggggcgcggaaccccaagcg

SEQ ID NO: 133644 - DNA, 20 bp, human
gggggggacccggggacctc

SEQ ID NO: 133645 - DNA, 20 bp, human
gctccgtccccactgcggag

SEQ ID NO: 133646 - DNA, 20 bp, human
gaggtcactgcatcagctga

SEQ ID NO: 133647 - DNA, 20 bp, human
gcgatgtgcttaagcctgag

SEQ ID NO: 133648 - DNA, 20 bp, human
gtgatgcagtgacctcagtc

SEQ ID NO: 133649 - DNA, 20 bp, human
gattcggcgcgtgacaactg

SEQ ID NO: 133650 - DNA, 20 bp, human
ggcgctgcacagactagcaa

SEQ ID NO: 133651 - DNA, 20 bp, human
gtgtgagtgtccccaaagaa

SEQ ID NO: 133652 - DNA, 20 bp, human
gcagccagagaggtccaccg

SEQ ID NO: 133653 - DNA, 20 bp, human
ggctgatgtatctgactctg

SEQ ID NO: 133654 - DNA, 20 bp, human
gcatatgcagtcaaagttgg

SEQ ID NO: 133655 - DNA, 20 bp, human
gggtccaccgaggtgagaag

SEQ ID NO: 133656 - DNA, 20 bp, human
ggactctcccgccccagatg

SEQ ID NO: 133657 - DNA, 20 bp, human
gggcggcggcgccacatctg

SEQ ID NO: 133658 - DNA, 20 bp, human
gctcccggctgggtgtcacg

SEQ ID NO: 133659 - DNA, 20 bp, human
gcaggaatgaaactccctcc

SEQ ID NO: 133660 - DNA, 20 bp, human
gggccctacctagaagactt

SEQ ID NO: 133661 - DNA, 20 bp, human
gtgtcacggggctcgtgtga

SEQ ID NO: 133662 - DNA, 20 bp, human
gggcggcgccacatctgggg

SEQ ID NO: 133663 - DNA, 20 bp, human
gcacggggctcgtgtgacgg

SEQ ID NO: 133664 - DNA, 20 bp, human
gtgagttcccctaattctag

SEQ ID NO: 133665 - DNA, 20 bp, human
gccctccaggtgggagcaca

SEQ ID NO: 133666 - DNA, 20 bp, human
gggagggcctggaactgtgt

SEQ ID NO: 133667 - DNA, 20 bp, human
ggagcgcaggagggtcgtat

SEQ ID NO: 133668 - DNA, 20 bp, human
gcgcccggcaggaagtcgag

SEQ ID NO: 133669 - DNA, 20 bp, human
gggaccggggcgaccgagga

SEQ ID NO: 133670 - DNA, 20 bp, human
gccctgcggggtgaggaccg

SEQ ID NO: 133671 - DNA, 20 bp, human
gggtgccggcagtcacgctg

SEQ ID NO: 133672 - DNA, 20 bp, human
gccgcgtcgcggcagcacct

SEQ ID NO: 133673 - DNA, 20 bp, human
gcctaatgcagggagataag

SEQ ID NO: 133674 - DNA, 20 bp, human
gcgagtccgggccagctgag

SEQ ID NO: 133675 - DNA, 20 bp, human
gctccctgcattaggctgag

SEQ ID NO: 133676 - DNA, 20 bp, human
gcgcgctgtagtggccgtcg

SEQ ID NO: 133677 - DNA, 20 bp, human
ggaggccgccgtctgttcga

SEQ ID NO: 133678 - DNA, 20 bp, human
gacagccttcgaacagacgg

SEQ ID NO: 133679 - DNA, 20 bp, human
ggaacagacggcggcctcga

SEQ ID NO: 133680 - DNA, 20 bp, human
ggcgctgaagacagtcgagt

SEQ ID NO: 133681 - DNA, 20 bp, human
gtgtgccctggcactaagac

SEQ ID NO: 133682 - DNA, 20 bp, human
gcagtcgagtgggactcagt

SEQ ID NO: 133683 - DNA, 20 bp, human
gccgcgcggccgcgctgtag

SEQ ID NO: 133684 - DNA, 20 bp, human
gccgcggggaaccgtgaagt

SEQ ID NO: 133685 - DNA, 20 bp, human
gggtgccagtcttagtgcca

SEQ ID NO: 133686 - DNA, 20 bp, human
gatggagcaggacaactcca

SEQ ID NO: 133687 - DNA, 20 bp, human
gtctggctgggagttaggga

SEQ ID NO: 133688 - DNA, 20 bp, human
ggactgcgggtgaaatgagg

SEQ ID NO: 133689 - DNA, 20 bp, human
gatcgcacagctacccactt

SEQ ID NO: 133690 - DNA, 20 bp, human
gcaggcccacatgccctaaa

SEQ ID NO: 133691 - DNA, 20 bp, human
ggtgggaagagaggtctggc

SEQ ID NO: 133692 - DNA, 20 bp, human
gtgatgaaagctacccaagt

SEQ ID NO: 133693 - DNA, 20 bp, human
gcctgactgcgggtgaaatg

SEQ ID NO: 133694 - DNA, 20 bp, human
gccttcttcatgagcaggtc

SEQ ID NO: 133695 - DNA, 20 bp, human
ggcgggtgaacgtataacac

SEQ ID NO: 133696 - DNA, 20 bp, human
gcccaagtctagagaaggag

SEQ ID NO: 133697 - DNA, 20 bp, human
ggcagccgggaccctctact

SEQ ID NO: 133698 - DNA, 20 bp, human
gggagtgggttggtgtgcag

SEQ ID NO: 133699 - DNA, 20 bp, human
gggcacacacccagccggac

SEQ ID NO: 133700 - DNA, 20 bp, human
gggtcccggctgcaccaaag

SEQ ID NO: 133701 - DNA, 20 bp, human
gtgcagggcggactcttccc

SEQ ID NO: 133702 - DNA, 20 bp, human
gcctaggaggacaagctgtg

SEQ ID NO: 133703 - DNA, 20 bp, human
gctgttgggggtctccccgg

SEQ ID NO: 133704 - DNA, 20 bp, human
gaggaaacctctggcccccg

SEQ ID NO: 133705 - DNA, 20 bp, human
ggctcctggacctgtccggc

SEQ ID NO: 133706 - DNA, 20 bp, human
gctcccgtgcgagggtccgg

SEQ ID NO: 133707 - DNA, 20 bp, human
gcgccgccggaccctcgcac

SEQ ID NO: 133708 - DNA, 20 bp, human
gcgcctcccgtgcgagggtc

SEQ ID NO: 133709 - DNA, 20 bp, human
gggtcgccccagaccttcgg

SEQ ID NO: 133710 - DNA, 20 bp, human
ggatgagtcttggggaacgg

SEQ ID NO: 133711 - DNA, 20 bp, human
ggagcggcgcaaccagcgag

SEQ ID NO: 133712 - DNA, 20 bp, human
gctctaaagggagcgatgca

SEQ ID NO: 133713 - DNA, 20 bp, human
gtcgctccctttagagacag

SEQ ID NO: 133714 - DNA, 20 bp, human
ggagggcccgctccaggcaa

SEQ ID NO: 133715 - DNA, 20 bp, human
gcggctcctaacctcctccg

SEQ ID NO: 133716 - DNA, 20 bp, human
gccgcggggcccatagtcac

SEQ ID NO: 133717 - DNA, 20 bp, human
gcagctccggacacacctgt

SEQ ID NO: 133718 - DNA, 20 bp, human
gacaccgggtcctgtcccca

SEQ ID NO: 133719 - DNA, 20 bp, human
gcgcagaccgcggcttcctc

SEQ ID NO: 133720 - DNA, 20 bp, human
gctaggcgtccggagacacc

SEQ ID NO: 133721 - DNA, 20 bp, human
gtggcctcccgcacaggact

SEQ ID NO: 133722 - DNA, 20 bp, human
ggcggctgcaggcgagaact

SEQ ID NO: 133723 - DNA, 20 bp, human
gagaggggcggcccagcata

SEQ ID NO: 133724 - DNA, 20 bp, human
gggcttcctccggccgccat

SEQ ID NO: 133725 - DNA, 20 bp, human
gggacaggacccggtgtctc

SEQ ID NO: 133726 - DNA, 20 bp, human
ggccgctcgatcccagtccc

SEQ ID NO: 133727 - DNA, 20 bp, human
gctgaatcggaggaaggtaa

SEQ ID NO: 133728 - DNA, 20 bp, human
ggcctgggactgggatcgag

SEQ ID NO: 133729 - DNA, 20 bp, human
gtgagacaggaccctgggta

SEQ ID NO: 133730 - DNA, 20 bp, human
gagaggagaggcctcctaag

SEQ ID NO: 133731 - DNA, 20 bp, human
gcagagggaggactattggg

SEQ ID NO: 133732 - DNA, 20 bp, human
gggagaggcctcctaagggg

SEQ ID NO: 133733 - DNA, 20 bp, human
gcctcaggcccacccggtcg

SEQ ID NO: 133734 - DNA, 20 bp, human
gaggggcggtgggctcaaga

SEQ ID NO: 133735 - DNA, 20 bp, human
gtcctccgattcaggagcag

SEQ ID NO: 133736 - DNA, 20 bp, human
gtcaggggctatgacttcta

SEQ ID NO: 133737 - DNA, 20 bp, human
ggtctgattccaggttccgt

SEQ ID NO: 133738 - DNA, 20 bp, human
gtatgacttctacggtctta

SEQ ID NO: 133739 - DNA, 20 bp, human
ggactgggaagtctgattcc

SEQ ID NO: 133740 - DNA, 20 bp, human
gtataaacaaggcagtaatc

SEQ ID NO: 133741 - DNA, 20 bp, human
gtcaaacacactgaaagctg

SEQ ID NO: 133742 - DNA, 20 bp, human
gagaaccctaaacccaggac

SEQ ID NO: 133743 - DNA, 20 bp, human
gaagctggtaattttcacag

SEQ ID NO: 133744 - DNA, 20 bp, human
ggaggaacccaggactgagc

SEQ ID NO: 133745 - DNA, 20 bp, human
gctctacaaatgttaaaagt

SEQ ID NO: 133746 - DNA, 20 bp, human
ggcgagcaccgatagcaagg

SEQ ID NO: 133747 - DNA, 20 bp, human
gggcgagagcgacgcaaggt

SEQ ID NO: 133748 - DNA, 20 bp, human
gcctggaagcgagctcccag

SEQ ID NO: 133749 - DNA, 20 bp, human
gagcgacgcaaggtcggctg

SEQ ID NO: 133750 - DNA, 20 bp, human
gagctcgcttccaggtaggg

SEQ ID NO: 133751 - DNA, 20 bp, human
gcaagtccaggtactcccgg

SEQ ID NO: 133752 - DNA, 20 bp, human
gtcgcggcgcgagtcccctg

SEQ ID NO: 133753 - DNA, 20 bp, human
gctgccggggaggggagaac

SEQ ID NO: 133754 - DNA, 20 bp, human
gctccggcgagagcgacgca

SEQ ID NO: 133755 - DNA, 20 bp, human
gggagcgagcaccgatagca

SEQ ID NO: 133756 - DNA, 20 bp, human
ggagagtccggggatcccgg

SEQ ID NO: 133757 - DNA, 20 bp, human
gggatgtcgccgggagaggt

SEQ ID NO: 133758 - DNA, 20 bp, human
gcagtcgcggccgggacatc

SEQ ID NO: 133759 - DNA, 20 bp, human
gctcaagccgagctcggaga

SEQ ID NO: 133760 - DNA, 20 bp, human
ggccgcagcgcccgatgtcc

SEQ ID NO: 133761 - DNA, 20 bp, human
gccctcggctcggggaccct

SEQ ID NO: 133762 - DNA, 20 bp, human
ggaacgtcacgggagcccac

SEQ ID NO: 133763 - DNA, 20 bp, human
ggggcgcgggctgagagtcc

SEQ ID NO: 133764 - DNA, 20 bp, human
ggactggcccccgggatccc

SEQ ID NO: 133765 - DNA, 20 bp, human
ggctgagagtccggggatcc

SEQ ID NO: 133766 - DNA, 20 bp, human
gggcagttgtccaagctcca

SEQ ID NO: 133767 - DNA, 20 bp, human
ggggagggtcgtgtccggta

SEQ ID NO: 133768 - DNA, 20 bp, human
gctccagggagggtcgtgtc

SEQ ID NO: 133769 - DNA, 20 bp, human
gccccagcgcgccagtcccg

SEQ ID NO: 133770 - DNA, 20 bp, human
ggccgcggccgagcagtagg

SEQ ID NO: 133771 - DNA, 20 bp, human
gtgtccggtagggcgtccgg

SEQ ID NO: 133772 - DNA, 20 bp, human
ggaagccaccatagtccccc

SEQ ID NO: 133773 - DNA, 20 bp, human
gccggtgcagcgtccgaggt

SEQ ID NO: 133774 - DNA, 20 bp, human
gcagaagagtgaagcctcga

SEQ ID NO: 133775 - DNA, 20 bp, human
gggcgaggagctgcggatgg

SEQ ID NO: 133776 - DNA, 20 bp, human
ggcgttctcggctacaagga

SEQ ID NO: 133777 - DNA, 20 bp, human
ggagcatacagaagcgttct

SEQ ID NO: 133778 - DNA, 20 bp, human
gccagcagcagggctccgac

SEQ ID NO: 133779 - DNA, 20 bp, human
gccgcggggaacgggaaccc

SEQ ID NO: 133780 - DNA, 20 bp, human
ggacagacgaggccgaggta

SEQ ID NO: 133781 - DNA, 20 bp, human
ggccatgcggtacaacgaga

SEQ ID NO: 133782 - DNA, 20 bp, human
gtgagcacccggcctccgag

SEQ ID NO: 133783 - DNA, 20 bp, human
gagacacgggcgccgggacg

SEQ ID NO: 133784 - DNA, 20 bp, human
gcgttccccgcggagccatg

SEQ ID NO: 133785 - DNA, 20 bp, human
ggcatgaggggccccaagaa

SEQ ID NO: 133786 - DNA, 20 bp, human
gcgaggggcgctcccggccg

SEQ ID NO: 133787 - DNA, 20 bp, human
gcctgagactgcccggcttc

SEQ ID NO: 133788 - DNA, 20 bp, human
gagaaaaggggaaacctgaa

SEQ ID NO: 133789 - DNA, 20 bp, human
gtgttggaactggggtaaag

SEQ ID NO: 133790 - DNA, 20 bp, human
gaggctgggtcggagaggag

SEQ ID NO: 133791 - DNA, 20 bp, human
ggcgaggcgaggggcgctcc

SEQ ID NO: 133792 - DNA, 20 bp, human
gggtctcggggaggtaagcg

SEQ ID NO: 133793 - DNA, 20 bp, human
ggctgaggggctgccgcggc

SEQ ID NO: 133794 - DNA, 20 bp, human
gacaacaggaagcggcgccc

SEQ ID NO: 133795 - DNA, 20 bp, human
ggagaggatgaggtgtgtca

SEQ ID NO: 133796 - DNA, 20 bp, human
gcccgggtcgcggaggggaa

SEQ ID NO: 133797 - DNA, 20 bp, human
ggagccccgggccggtagag

SEQ ID NO: 133798 - DNA, 20 bp, human
gaccctccggtcccccactg

SEQ ID NO: 133799 - DNA, 20 bp, human
ggccgcggcgctcacgtgag

SEQ ID NO: 133800 - DNA, 20 bp, human
ggcacgacggagcccccgta

SEQ ID NO: 133801 - DNA, 20 bp, human
gccgggccgcggtggagcga

SEQ ID NO: 133802 - DNA, 20 bp, human
gggcgccgcttcccctctac

SEQ ID NO: 133803 - DNA, 20 bp, human
gcgacccggggggcgacgag

SEQ ID NO: 133804 - DNA, 20 bp, human
ggagggcccaggcgaggcga

SEQ ID NO: 133805 - DNA, 20 bp, human
gcggccgctcgtcgcccccc

SEQ ID NO: 133806 - DNA, 20 bp, human
gtcacggtgacagcccgccc

SEQ ID NO: 133807 - DNA, 20 bp, human
ggctgtcaccgtgaggcggg

SEQ ID NO: 133808 - DNA, 20 bp, human
ggccgggatggtcagcgccc

SEQ ID NO: 133809 - DNA, 20 bp, human
gaaacagagccgggccggga

SEQ ID NO: 133810 - DNA, 20 bp, human
gcttcagtccgctcctggag

SEQ ID NO: 133811 - DNA, 20 bp, human
gggaagccccagcctgatgt

SEQ ID NO: 133812 - DNA, 20 bp, human
gagtcaagcccctccaggag

SEQ ID NO: 133813 - DNA, 20 bp, human
ggaatcaggtatgtaatagg

SEQ ID NO: 133814 - DNA, 20 bp, human
ggccgcttgtaaacagagcc

SEQ ID NO: 133815 - DNA, 20 bp, human
gcggcggaagcatttcagag

SEQ ID NO: 133816 - DNA, 20 bp, human
gtggccagagtcgtacaggt

SEQ ID NO: 133817 - DNA, 20 bp, human
gacacagtggctgttcccca

SEQ ID NO: 133818 - DNA, 20 bp, human
gcaccgtgcccgggatgtag

SEQ ID NO: 133819 - DNA, 20 bp, human
gagggcggggcagtcagcgt

SEQ ID NO: 133820 - DNA, 20 bp, human
gccccggggcgttcagaccc

SEQ ID NO: 133821 - DNA, 20 bp, human
gcgtacaggtcggcaagtct

SEQ ID NO: 133822 - DNA, 20 bp, human
ggtcggctcctcacctaccg

SEQ ID NO: 133823 - DNA, 20 bp, human
gcctgagctgcacggacaca

SEQ ID NO: 133824 - DNA, 20 bp, human
ggttcagaccccggtaggtg

SEQ ID NO: 133825 - DNA, 20 bp, human
gatccggccgaaagtctgag

SEQ ID NO: 133826 - DNA, 20 bp, human
ggccgtggcgaggagacaat

SEQ ID NO: 133827 - DNA, 20 bp, human
gggtcgtcagagcgcggagg

SEQ ID NO: 133828 - DNA, 20 bp, human
gccacagcgcaccgggccgg

SEQ ID NO: 133829 - DNA, 20 bp, human
ggccaagttgaagccccccg

SEQ ID NO: 133830 - DNA, 20 bp, human
ggccgggccgtgggtctccc

SEQ ID NO: 133831 - DNA, 20 bp, human
ggggggtcgtcagagcgcgg

SEQ ID NO: 133832 - DNA, 20 bp, human
gtacaaagaaggggagagtc

SEQ ID NO: 133833 - DNA, 20 bp, human
gcggcccgcggatggagctg

SEQ ID NO: 133834 - DNA, 20 bp, human
gtgggccgcccacagcgcac

SEQ ID NO: 133835 - DNA, 20 bp, human
gcaccccgcagctccatccg

SEQ ID NO: 133836 - DNA, 20 bp, human
gggcccaagaaacttcgggg

SEQ ID NO: 133837 - DNA, 20 bp, human
gttcttgggcccccggcagc

SEQ ID NO: 133838 - DNA, 20 bp, human
gcctgggcggccagagatgt

SEQ ID NO: 133839 - DNA, 20 bp, human
gtggccgggcgtagacgcgg

SEQ ID NO: 133840 - DNA, 20 bp, human
gcagccggcgggacagaacg

SEQ ID NO: 133841 - DNA, 20 bp, human
gctggttcgggagacctcaa

SEQ ID NO: 133842 - DNA, 20 bp, human
ggcgcggcgctggaagcgag

SEQ ID NO: 133843 - DNA, 20 bp, human
ggcctggccgggcgtagacg

SEQ ID NO: 133844 - DNA, 20 bp, human
gggaagagcctgggcaaatg

SEQ ID NO: 133845 - DNA, 20 bp, human
gccggcgtcggggaggaaag

SEQ ID NO: 133846 - DNA, 20 bp, human
ggagtgagttcaggaatcct

SEQ ID NO: 133847 - DNA, 20 bp, human
gctaggcagctgggacacca

SEQ ID NO: 133848 - DNA, 20 bp, human
gatggaagctatgccctcag

SEQ ID NO: 133849 - DNA, 20 bp, human
gctggaagccaagaggtcgc

SEQ ID NO: 133850 - DNA, 20 bp, human
gttcaggaatcctcgggaca

SEQ ID NO: 133851 - DNA, 20 bp, human
gaggaaagtgccttgtcccg

SEQ ID NO: 133852 - DNA, 20 bp, human
gcactggaccagcgacctct

SEQ ID NO: 133853 - DNA, 20 bp, human
ggtacttactggaagccaag

SEQ ID NO: 133854 - DNA, 20 bp, human
gagtcagcaggagtgagttc

SEQ ID NO: 133855 - DNA, 20 bp, human
gggtcgctggtccagtgctc

SEQ ID NO: 133856 - DNA, 20 bp, human
ggaattacagattcctgcgt

SEQ ID NO: 133857 - DNA, 20 bp, human
gattgtcgttgcacctacgc

SEQ ID NO: 133858 - DNA, 20 bp, human
ggactatgtgaatacccagg

SEQ ID NO: 133859 - DNA, 20 bp, human
gaaggtgtagtcaaagaaac

SEQ ID NO: 133860 - DNA, 20 bp, human
gactacaccttaaatactaa

SEQ ID NO: 133861 - DNA, 20 bp, human
gtaaatgtttgttgaggatc

SEQ ID NO: 133862 - DNA, 20 bp, human
ggttagaaaaataccctcaa

SEQ ID NO: 133863 - DNA, 20 bp, human
gaatactaaagggcaggcac

SEQ ID NO: 133864 - DNA, 20 bp, human
gaccttaaatactaaagggc

SEQ ID NO: 133865 - DNA, 20 bp, human
ggcctgccctttagtattta

SEQ ID NO: 133866 - DNA, 20 bp, human
gagcagcagaatgagaccgg

SEQ ID NO: 133867 - DNA, 20 bp, human
gggaggggacttacttgcag

SEQ ID NO: 133868 - DNA, 20 bp, human
gcacaggtaagcaagggtat

SEQ ID NO: 133869 - DNA, 20 bp, human
gcggaacaattggctcccac

SEQ ID NO: 133870 - DNA, 20 bp, human
ggatactggggaggagtcac

SEQ ID NO: 133871 - DNA, 20 bp, human
ggactcctccccagtatcca

SEQ ID NO: 133872 - DNA, 20 bp, human
ggacccctcacacacataac

SEQ ID NO: 133873 - DNA, 20 bp, human
gtggctcccacaggtaagca

SEQ ID NO: 133874 - DNA, 20 bp, human
gtgttccgtggatactgggg

SEQ ID NO: 133875 - DNA, 20 bp, human
gccagtatccacggaacaat

SEQ ID NO: 133876 - DNA, 20 bp, human
gaactggcctcagggagcaa

SEQ ID NO: 133877 - DNA, 20 bp, human
ggaaaggagcccgggcctgg

SEQ ID NO: 133878 - DNA, 20 bp, human
gcagcgggcgaaaggagccc

SEQ ID NO: 133879 - DNA, 20 bp, human
gcgtaccggtcgcctggtcc

SEQ ID NO: 133880 - DNA, 20 bp, human
gggtgccgggaccaggcgac

SEQ ID NO: 133881 - DNA, 20 bp, human
ggaccggtacgcaaacctcc

SEQ ID NO: 133882 - DNA, 20 bp, human
gccgcccagtgagtgaacac

SEQ ID NO: 133883 - DNA, 20 bp, human
gcaatacctatcagcaccag

SEQ ID NO: 133884 - DNA, 20 bp, human
gggcctggaggtttgcgtac

SEQ ID NO: 133885 - DNA, 20 bp, human
ggaaaacctccggaagctgt

SEQ ID NO: 133886 - DNA, 20 bp, human
gcctgggctctgtgagactg

SEQ ID NO: 133887 - DNA, 20 bp, human
gggctgcagagtgtctcctc

SEQ ID NO: 133888 - DNA, 20 bp, human
gggtcagccggagtgagtgt

SEQ ID NO: 133889 - DNA, 20 bp, human
gcatgtaaggcaggtgcccc

SEQ ID NO: 133890 - DNA, 20 bp, human
gaggaattggataggcacag

SEQ ID NO: 133891 - DNA, 20 bp, human
gaattcctgtcactcctggg

SEQ ID NO: 133892 - DNA, 20 bp, human
gactactgagggagagattc

SEQ ID NO: 133893 - DNA, 20 bp, human
gtgaaggtaagggcctcttg

SEQ ID NO: 133894 - DNA, 20 bp, human
gagcattgcccaagcctccc

SEQ ID NO: 133895 - DNA, 20 bp, human
ggggaagaagttgaaggtaa

SEQ ID NO: 133896 - DNA, 20 bp, human
gcgcgtcccgaagacgactc

SEQ ID NO: 133897 - DNA, 20 bp, human
gctgggcgcgcactcaccga

SEQ ID NO: 133898 - DNA, 20 bp, human
gaccgacggactgcagcgaa

SEQ ID NO: 133899 - DNA, 20 bp, human
ggcccgggaccggttcgctg

SEQ ID NO: 133900 - DNA, 20 bp, human
ggactccggctgccacgacc

SEQ ID NO: 133901 - DNA, 20 bp, human
gccaggtcctggctgggtag

SEQ ID NO: 133902 - DNA, 20 bp, human
gtggcagccggagtcgtctt

SEQ ID NO: 133903 - DNA, 20 bp, human
gcgggccccacgctttgacc

SEQ ID NO: 133904 - DNA, 20 bp, human
ggcctttcgctgcagtccgt

SEQ ID NO: 133905 - DNA, 20 bp, human
ggaagccgcgaggcgagcgg

SEQ ID NO: 133906 - DNA, 20 bp, human
gagaaagcaggagacctcaa

SEQ ID NO: 133907 - DNA, 20 bp, human
gttccggccaagcacacttc

SEQ ID NO: 133908 - DNA, 20 bp, human
gcccacagcgacagcaagtg

SEQ ID NO: 133909 - DNA, 20 bp, human
gagtgtggctagtgacgagg

SEQ ID NO: 133910 - DNA, 20 bp, human
gaagcaactggggtaagctg

SEQ ID NO: 133911 - DNA, 20 bp, human
gtagcagactggtgatgagg

SEQ ID NO: 133912 - DNA, 20 bp, human
ggcaagtgtggctagtgacg

SEQ ID NO: 133913 - DNA, 20 bp, human
gaggagtgtgccaaagccag

SEQ ID NO: 133914 - DNA, 20 bp, human
gaaaggctaccaagcaaggg

SEQ ID NO: 133915 - DNA, 20 bp, human
gatgtagcagactggtgatg

SEQ ID NO: 133916 - DNA, 20 bp, human
gtgggacgtccggttgaccg

SEQ ID NO: 133917 - DNA, 20 bp, human
gcagctgttcctgggacgtc

SEQ ID NO: 133918 - DNA, 20 bp, human
ggtggcaaaaccatctgtag

SEQ ID NO: 133919 - DNA, 20 bp, human
gagtcgcggcagctgttcct

SEQ ID NO: 133920 - DNA, 20 bp, human
ggcgtctcagttgagctggg

SEQ ID NO: 133921 - DNA, 20 bp, human
gaccagcttggaaaccgtcc

SEQ ID NO: 133922 - DNA, 20 bp, human
gagtcccaggaagtgagaag

SEQ ID NO: 133923 - DNA, 20 bp, human
gtccggttgaccgcggtgag

SEQ ID NO: 133924 - DNA, 20 bp, human
gtctgaaaaccccagaaggg

SEQ ID NO: 133925 - DNA, 20 bp, human
ggccactcaccgcggtcaac

SEQ ID NO: 133926 - DNA, 20 bp, human
gcctcgaaggctgtcctcac

SEQ ID NO: 133927 - DNA, 20 bp, human
gggccaaagaggccatccag

SEQ ID NO: 133928 - DNA, 20 bp, human
gccaaggacacggtgtccac

SEQ ID NO: 133929 - DNA, 20 bp, human
gctggataccaccaagtcta

SEQ ID NO: 133930 - DNA, 20 bp, human
ggtggccaaagggaccgtac

SEQ ID NO: 133931 - DNA, 20 bp, human
ggtgtccacaccggcctgta

SEQ ID NO: 133932 - DNA, 20 bp, human
gcgtgtccttggtgccggtg

SEQ ID NO: 133933 - DNA, 20 bp, human
gcgaggtgtccagaccccct

SEQ ID NO: 133934 - DNA, 20 bp, human
gggctaagggggccgtccaa

SEQ ID NO: 133935 - DNA, 20 bp, human
ggtacccatgaccatagact

SEQ ID NO: 133936 - DNA, 20 bp, human
ggcactcacctgggcgcgag

SEQ ID NO: 133937 - DNA, 20 bp, human
gcgagcagctataagaaggg

SEQ ID NO: 133938 - DNA, 20 bp, human
gtaagaagggcgggcgggac

SEQ ID NO: 133939 - DNA, 20 bp, human
ggtgtggagactcgagcctg

SEQ ID NO: 133940 - DNA, 20 bp, human
gagaggagctccagataggg

SEQ ID NO: 133941 - DNA, 20 bp, human
gcaccctagacggctggagg

SEQ ID NO: 133942 - DNA, 20 bp, human
gactgcccaagcaccctaga

SEQ ID NO: 133943 - DNA, 20 bp, human
gtaccacctccagccgtcta

SEQ ID NO: 133944 - DNA, 20 bp, human
gccagccgtctagggtgctt

SEQ ID NO: 133945 - DNA, 20 bp, human
gggcgaggaccaggcctcag

SEQ ID NO: 133946 - DNA, 20 bp, human
gagcgacactcaccctccgg

SEQ ID NO: 133947 - DNA, 20 bp, human
ggagtgctgcagtgactgca

SEQ ID NO: 133948 - DNA, 20 bp, human
gggaggctctgctcggatcg

SEQ ID NO: 133949 - DNA, 20 bp, human
gagggtgagtgtcgctgctg

SEQ ID NO: 133950 - DNA, 20 bp, human
gtggaaagagtacccagcaa

SEQ ID NO: 133951 - DNA, 20 bp, human
gacccagcaagggagagcct

SEQ ID NO: 133952 - DNA, 20 bp, human
gccaccggcgaaagagatcc

SEQ ID NO: 133953 - DNA, 20 bp, human
gtcggacgcggacaccaagg

SEQ ID NO: 133954 - DNA, 20 bp, human
ggaggtctgcagcgcagctt

SEQ ID NO: 133955 - DNA, 20 bp, human
gttggagctctgccgccgga

SEQ ID NO: 133956 - DNA, 20 bp, human
gagtagtcgggactcgacag

SEQ ID NO: 133957 - DNA, 20 bp, human
gcggccgaacggccacccag

SEQ ID NO: 133958 - DNA, 20 bp, human
gaggcttgatggagagtgac

SEQ ID NO: 133959 - DNA, 20 bp, human
ggagtcccgactactacgag

SEQ ID NO: 133960 - DNA, 20 bp, human
gcacggccgatgcgagggtc

SEQ ID NO: 133961 - DNA, 20 bp, human
gatgagccggaccctcgcat

SEQ ID NO: 133962 - DNA, 20 bp, human
ggcagctaaagcctggtcta

SEQ ID NO: 133963 - DNA, 20 bp, human
gaggggcacggccgatgcga

SEQ ID NO: 133964 - DNA, 20 bp, human
gttacccgcggtgcatggtg

SEQ ID NO: 133965 - DNA, 20 bp, human
gccagcctctcgtagtagtc

SEQ ID NO: 133966 - DNA, 20 bp, human
gtagtcggcaccagaggcaa

SEQ ID NO: 133967 - DNA, 20 bp, human
ggggtgctagtcggcaccag

SEQ ID NO: 133968 - DNA, 20 bp, human
gggcaagggtgcgaggacca

SEQ ID NO: 133969 - DNA, 20 bp, human
gagggtgcgaggaccacggc

SEQ ID NO: 133970 - DNA, 20 bp, human
gcactcgcacaagtggaccg

SEQ ID NO: 133971 - DNA, 20 bp, human
gctgcccgctgccaccccct

SEQ ID NO: 133972 - DNA, 20 bp, human
ggtggctgcgattcctcggg

SEQ ID NO: 133973 - DNA, 20 bp, human
gacgtgtgaccgcgcctagg

SEQ ID NO: 133974 - DNA, 20 bp, human
ggtccgggcgaccccaagcc

SEQ ID NO: 133975 - DNA, 20 bp, human
gtgggaaaggtgacaagcgg

SEQ ID NO: 133976 - DNA, 20 bp, human
gagtagctaaacctcatcaa

SEQ ID NO: 133977 - DNA, 20 bp, human
ggcaccttttccctttgatg

SEQ ID NO: 133978 - DNA, 20 bp, human
ggtttagctactctgctgtg

SEQ ID NO: 133979 - DNA, 20 bp, human
gtgagccattgactaagaag

SEQ ID NO: 133980 - DNA, 20 bp, human
gattgactaagaagaggaga

SEQ ID NO: 133981 - DNA, 20 bp, human
gttggaatactgcagtagaa

SEQ ID NO: 133982 - DNA, 20 bp, human
gtgcttaccccgaattaaca

SEQ ID NO: 133983 - DNA, 20 bp, human
gttcattgctcatcctgcaa

SEQ ID NO: 133984 - DNA, 20 bp, human
gcttctgcatgtgtaatcac

SEQ ID NO: 133985 - DNA, 20 bp, human
ggacattttcctaacaggga

SEQ ID NO: 133986 - DNA, 20 bp, human
gagcgcagcgtagcaaatcc

SEQ ID NO: 133987 - DNA, 20 bp, human
gcgcggagacaggaaaccgg

SEQ ID NO: 133988 - DNA, 20 bp, human
gcaggctggttgttccaggg

SEQ ID NO: 133989 - DNA, 20 bp, human
ggaagcccccctgtgaagag

SEQ ID NO: 133990 - DNA, 20 bp, human
gtaaaacgctgggctcccct

SEQ ID NO: 133991 - DNA, 20 bp, human
ggcggccgcacctacctcaa

SEQ ID NO: 133992 - DNA, 20 bp, human
ggaccccgggcgcctcatca

SEQ ID NO: 133993 - DNA, 20 bp, human
gcgggcggaaccgagaagcc

SEQ ID NO: 133994 - DNA, 20 bp, human
ggtcagtggcctcgtagcag

SEQ ID NO: 133995 - DNA, 20 bp, human
ggcgcgtcgcagcgcggtcc

SEQ ID NO: 133996 - DNA, 20 bp, human
gtgtcagggagaactttccg

SEQ ID NO: 133997 - DNA, 20 bp, human
gaagctaatccggagaaccc

SEQ ID NO: 133998 - DNA, 20 bp, human
gccctcaagagacaagagta

SEQ ID NO: 133999 - DNA, 20 bp, human
gcccgcccggcagtgtcccg

SEQ ID NO: 134000 - DNA, 20 bp, human
gtagctcggacggcaagcgg

SEQ ID NO: 134001 - DNA, 20 bp, human
ggagatggatcgctccggat

SEQ ID NO: 134002 - DNA, 20 bp, human
ggagcccagaggcaccgccc

SEQ ID NO: 134003 - DNA, 20 bp, human
gaccaccagcctagctcgga

SEQ ID NO: 134004 - DNA, 20 bp, human
ggagctaccgcgttagagca

SEQ ID NO: 134005 - DNA, 20 bp, human
ggccctgccctgctctaacg

SEQ ID NO: 134006 - DNA, 20 bp, human
ggcaggaaggcggcgaccag

SEQ ID NO: 134007 - DNA, 20 bp, human
gcagcgcggtggtctcggcc

SEQ ID NO: 134008 - DNA, 20 bp, human
ggtgtgtgcgagcctggcga

SEQ ID NO: 134009 - DNA, 20 bp, human
gcgctccggggccgctctga

SEQ ID NO: 134010 - DNA, 20 bp, human
gggctccatcgcgcggactc

SEQ ID NO: 134011 - DNA, 20 bp, human
ggcacactcagaccctcgcc

SEQ ID NO: 134012 - DNA, 20 bp, human
ggagccgcacgcccacaccc

SEQ ID NO: 134013 - DNA, 20 bp, human
gcggagcggccgcagcgcgg

SEQ ID NO: 134014 - DNA, 20 bp, human
gggaagctgatcggcaaggt

SEQ ID NO: 134015 - DNA, 20 bp, human
gcgatcctgcgcggtctacg

SEQ ID NO: 134016 - DNA, 20 bp, human
gcagcgcctggagccacaca

SEQ ID NO: 134017 - DNA, 20 bp, human
gcaggctccggatccctgtg

SEQ ID NO: 134018 - DNA, 20 bp, human
gcgtgcgggaagcgccctag

SEQ ID NO: 134019 - DNA, 20 bp, human
gcgcgctgcgcgtaccccta

SEQ ID NO: 134020 - DNA, 20 bp, human
gtgacagtgtgagcccgggt

SEQ ID NO: 134021 - DNA, 20 bp, human
gtcaccacgacactaccccg

SEQ ID NO: 134022 - DNA, 20 bp, human
gcggccacggggtagtgtcg

SEQ ID NO: 134023 - DNA, 20 bp, human
gggatgcagggcgatcttgg

SEQ ID NO: 134024 - DNA, 20 bp, human
gcagcatgagcgccccgagg

SEQ ID NO: 134025 - DNA, 20 bp, human
gcggccgtagcgacctcggg

SEQ ID NO: 134026 - DNA, 20 bp, human
ggtgttgtatgaagtcttac

SEQ ID NO: 134027 - DNA, 20 bp, human
gtaaccactactaccaaata

SEQ ID NO: 134028 - DNA, 20 bp, human
gtcttacgggtgtttagctg

SEQ ID NO: 134029 - DNA, 20 bp, human
ggaacagttgcagtaggtgg

SEQ ID NO: 134030 - DNA, 20 bp, human
gtgggaacagttgcagtagg

SEQ ID NO: 134031 - DNA, 20 bp, human
gccaaatatggtaacataat

SEQ ID NO: 134032 - DNA, 20 bp, human
gttaccatatttggtagtag

SEQ ID NO: 134033 - DNA, 20 bp, human
gttatgggaacagttgcagt

SEQ ID NO: 134034 - DNA, 20 bp, human
gactctgtcacccagtttat

SEQ ID NO: 134035 - DNA, 20 bp, human
gcgaaatctgtttcttacct

SEQ ID NO: 134036 - DNA, 20 bp, human
gggacgatcggccgacccgg

SEQ ID NO: 134037 - DNA, 20 bp, human
gccgcatggccgaggtatgg

SEQ ID NO: 134038 - DNA, 20 bp, human
ggggccgcatggccgaggta

SEQ ID NO: 134039 - DNA, 20 bp, human
gtgctgctggccgaagcgaa

SEQ ID NO: 134040 - DNA, 20 bp, human
gccgaggtatgggggacgat

SEQ ID NO: 134041 - DNA, 20 bp, human
gcctgcgagcgccgccgggt

SEQ ID NO: 134042 - DNA, 20 bp, human
gccctgggaacgacctgaat

SEQ ID NO: 134043 - DNA, 20 bp, human
gtatgggccaggcatcagtt

SEQ ID NO: 134044 - DNA, 20 bp, human
gagggctggaaacttcgcga

SEQ ID NO: 134045 - DNA, 20 bp, human
ggcgggagcgcggatccggg

SEQ ID NO: 134046 - DNA, 20 bp, human
gcgcagctgagtgaggtcgt

SEQ ID NO: 134047 - DNA, 20 bp, human
gtgagtgaggtcgtcggtgg

SEQ ID NO: 134048 - DNA, 20 bp, human
gctggccaggtgagtagtgg

SEQ ID NO: 134049 - DNA, 20 bp, human
gagctgagtgaggtcgtcgg

SEQ ID NO: 134050 - DNA, 20 bp, human
gcgcgtaacgcagctgagtg

SEQ ID NO: 134051 - DNA, 20 bp, human
gctcgagggccgaatatggg

SEQ ID NO: 134052 - DNA, 20 bp, human
gcctggccagccccgcggaa

SEQ ID NO: 134053 - DNA, 20 bp, human
ggcaattctggggaagaccc

SEQ ID NO: 134054 - DNA, 20 bp, human
gcacccagacagggattcca

SEQ ID NO: 134055 - DNA, 20 bp, human
ggccgagcctcgcgggacag

SEQ ID NO: 134056 - DNA, 20 bp, human
gggccggcgggcgggagaca

SEQ ID NO: 134057 - DNA, 20 bp, human
gcctccccgggatctcacct

SEQ ID NO: 134058 - DNA, 20 bp, human
gcaacccaggtgagatcccg

SEQ ID NO: 134059 - DNA, 20 bp, human
gcggaggctgaggccgcagg

SEQ ID NO: 134060 - DNA, 20 bp, human
ggagggtcggaggctcgagg

SEQ ID NO: 134061 - DNA, 20 bp, human
ggccgagacccggtcaaccc

SEQ ID NO: 134062 - DNA, 20 bp, human
ggccccgaggaggtcatggt

SEQ ID NO: 134063 - DNA, 20 bp, human
gcgcgcctggatcccagctc

SEQ ID NO: 134064 - DNA, 20 bp, human
gtgccagcctggcccggaga

SEQ ID NO: 134065 - DNA, 20 bp, human
gcctggatcccagctccgga

SEQ ID NO: 134066 - DNA, 20 bp, human
ggcctccagcagaaccagga

SEQ ID NO: 134067 - DNA, 20 bp, human
gagtaaaagaccgaagaagg

SEQ ID NO: 134068 - DNA, 20 bp, human
ggtcagagtcccaaagacat

SEQ ID NO: 134069 - DNA, 20 bp, human
gtgttcagctggaaggatcc

SEQ ID NO: 134070 - DNA, 20 bp, human
gagtggcctccagcagaacc

SEQ ID NO: 134071 - DNA, 20 bp, human
ggagagagtgcccagctgga

SEQ ID NO: 134072 - DNA, 20 bp, human
ggagaagatagagggaagtg

SEQ ID NO: 134073 - DNA, 20 bp, human
gcaaggccctggcaacggtt

SEQ ID NO: 134074 - DNA, 20 bp, human
gtcccttggttccaaggccc

SEQ ID NO: 134075 - DNA, 20 bp, human
ggctgacccaaccgttgcca

SEQ ID NO: 134076 - DNA, 20 bp, human
gcaagtgagcagatcctccg

SEQ ID NO: 134077 - DNA, 20 bp, human
ggcctgcgtgaactcatcag

SEQ ID NO: 134078 - DNA, 20 bp, human
gggagtccctggtgcctcgg

SEQ ID NO: 134079 - DNA, 20 bp, human
gcgcatacggagggctacgt

SEQ ID NO: 134080 - DNA, 20 bp, human
gcccttcccggccagacggc

SEQ ID NO: 134081 - DNA, 20 bp, human
gtgagatctggtggtccccg

SEQ ID NO: 134082 - DNA, 20 bp, human
gacgcatcgaaggggtccca

SEQ ID NO: 134083 - DNA, 20 bp, human
gagcctataacgcatacgga

SEQ ID NO: 134084 - DNA, 20 bp, human
gcagatcctccgaggcacca

SEQ ID NO: 134085 - DNA, 20 bp, human
ggaactggatggtccgggtg

SEQ ID NO: 134086 - DNA, 20 bp, human
gtcgaggtaaagtgacactg

SEQ ID NO: 134087 - DNA, 20 bp, human
gtgcagcaccttccggaatt

SEQ ID NO: 134088 - DNA, 20 bp, human
gcgagggcggcaagtaccag

SEQ ID NO: 134089 - DNA, 20 bp, human
gaggtgctgcacagctgtgg

SEQ ID NO: 134090 - DNA, 20 bp, human
gctgccggaggtgggataca

SEQ ID NO: 134091 - DNA, 20 bp, human
gctgggcgcccaattccgga

SEQ ID NO: 134092 - DNA, 20 bp, human
gactgacactgccccgaggg

SEQ ID NO: 134093 - DNA, 20 bp, human
gccgcctgggcgcccaattc

SEQ ID NO: 134094 - DNA, 20 bp, human
gagctggaaagtgtcctcgg

SEQ ID NO: 134095 - DNA, 20 bp, human
gctaccgtgtatcccacctc

SEQ ID NO: 134096 - DNA, 20 bp, human
gtcgagagggcagctcccac

SEQ ID NO: 134097 - DNA, 20 bp, human
gcgctgtcctgccttcgaga

SEQ ID NO: 134098 - DNA, 20 bp, human
gcaggtacttggatctccag

SEQ ID NO: 134099 - DNA, 20 bp, human
gctggttcagaaagcctcac

SEQ ID NO: 134100 - DNA, 20 bp, human
gcggagaggtagccgcagag

SEQ ID NO: 134101 - DNA, 20 bp, human
gcgcagtggcgcgagcgcag

SEQ ID NO: 134102 - DNA, 20 bp, human
gcagaagcgtgcccagagga

SEQ ID NO: 134103 - DNA, 20 bp, human
ggcgagcgcagcggctacgc

SEQ ID NO: 134104 - DNA, 20 bp, human
gggcactgcctgccgggact

SEQ ID NO: 134105 - DNA, 20 bp, human
gctatgcaccaaaaggccaa

SEQ ID NO: 134106 - DNA, 20 bp, human
gcagaggatagacacagctt

SEQ ID NO: 134107 - DNA, 20 bp, human
gtaagacagcctcggattcc

SEQ ID NO: 134108 - DNA, 20 bp, human
gagactcataattcttgatt

SEQ ID NO: 134109 - DNA, 20 bp, human
gcaaacactaactttggcag

SEQ ID NO: 134110 - DNA, 20 bp, human
gagagaagaaaggactgttt

SEQ ID NO: 134111 - DNA, 20 bp, human
ggactgttttggtttattca

SEQ ID NO: 134112 - DNA, 20 bp, human
gtcaatgtaaataggaacct

SEQ ID NO: 134113 - DNA, 20 bp, human
gaaaagcagcctggaatccg

SEQ ID NO: 134114 - DNA, 20 bp, human
gcttgctttgggactctaga

SEQ ID NO: 134115 - DNA, 20 bp, human
gtttcttctgtaagcaccac

SEQ ID NO: 134116 - DNA, 20 bp, human
gcagccgcggaggggaatca

SEQ ID NO: 134117 - DNA, 20 bp, human
gcggcagtcgggccagaccc

SEQ ID NO: 134118 - DNA, 20 bp, human
gtaggactccagcccaagac

SEQ ID NO: 134119 - DNA, 20 bp, human
gagctggagaaggacgacag

SEQ ID NO: 134120 - DNA, 20 bp, human
gcgtaaagtcgcagagtcct

SEQ ID NO: 134121 - DNA, 20 bp, human
gaggcgccggcgggcactag

SEQ ID NO: 134122 - DNA, 20 bp, human
ggtctgagtgcgttggtcgg

SEQ ID NO: 134123 - DNA, 20 bp, human
gctgcggccccgaagtggaa

SEQ ID NO: 134124 - DNA, 20 bp, human
gcgcggctgcggccccgaag

SEQ ID NO: 134125 - DNA, 20 bp, human
gagaagttgtctgagtgcgt

SEQ ID NO: 134126 - DNA, 20 bp, human
gcgctcgggagcggaaacag

SEQ ID NO: 134127 - DNA, 20 bp, human
ggacaaggtccagagagccg

SEQ ID NO: 134128 - DNA, 20 bp, human
gcagtctagaggcgcagaag

SEQ ID NO: 134129 - DNA, 20 bp, human
gtctgcgcctctagactgcc

SEQ ID NO: 134130 - DNA, 20 bp, human
ggtcagccggaaaagggtct

SEQ ID NO: 134131 - DNA, 20 bp, human
ggtgtggagggcaacttgtg

SEQ ID NO: 134132 - DNA, 20 bp, human
ggagcagcaaacacaacctg

SEQ ID NO: 134133 - DNA, 20 bp, human
ggccgcgggtgttggcgcaa

SEQ ID NO: 134134 - DNA, 20 bp, human
gtgtcattcgaatggttctg

SEQ ID NO: 134135 - DNA, 20 bp, human
gcgcaaggcgttttcaggca

SEQ ID NO: 134136 - DNA, 20 bp, human
gcgggaagcgacacctgaag

SEQ ID NO: 134137 - DNA, 20 bp, human
ggagggcctagcatagacgt

SEQ ID NO: 134138 - DNA, 20 bp, human
ggctgcagccacgggtaagg

SEQ ID NO: 134139 - DNA, 20 bp, human
gtggcagtcacggggcagac

SEQ ID NO: 134140 - DNA, 20 bp, human
gtaggacctcggctcgctca

SEQ ID NO: 134141 - DNA, 20 bp, human
gcagtcacggggcagacggg

SEQ ID NO: 134142 - DNA, 20 bp, human
gggaagccacgctaggacct

SEQ ID NO: 134143 - DNA, 20 bp, human
gctgaagtggaacggaaact

SEQ ID NO: 134144 - DNA, 20 bp, human
ggcagctgcagccacgggta

SEQ ID NO: 134145 - DNA, 20 bp, human
gggtgtgcctggcagtcacg

SEQ ID NO: 134146 - DNA, 20 bp, human
gggacaaggcgcccaagcgg

SEQ ID NO: 134147 - DNA, 20 bp, human
gtccggacaaggcgcccaag

SEQ ID NO: 134148 - DNA, 20 bp, human
ggctgtagaacaggacgcac

SEQ ID NO: 134149 - DNA, 20 bp, human
gtacttcacctccttcccgt

SEQ ID NO: 134150 - DNA, 20 bp, human
gctgactcgtgggtctacga

SEQ ID NO: 134151 - DNA, 20 bp, human
gaggtgaagtaactgcgctg

SEQ ID NO: 134152 - DNA, 20 bp, human
ggattggtgggaacacgctc

SEQ ID NO: 134153 - DNA, 20 bp, human
gttcccagatgcctacggga

SEQ ID NO: 134154 - DNA, 20 bp, human
ggcgtcctgttctacagcta

SEQ ID NO: 134155 - DNA, 20 bp, human
gccggccatagctgtagaac

SEQ ID NO: 134156 - DNA, 20 bp, human
gagcccgggtgcctagcact

SEQ ID NO: 134157 - DNA, 20 bp, human
gaggcacccgggctcttctg

SEQ ID NO: 134158 - DNA, 20 bp, human
gctagcactcggcagctcac

SEQ ID NO: 134159 - DNA, 20 bp, human
gtaagtgcgcgcaagtctgg

SEQ ID NO: 134160 - DNA, 20 bp, human
gtgccgagtgctaggcaccc

SEQ ID NO: 134161 - DNA, 20 bp, human
gaccgacagccccaccccaa

SEQ ID NO: 134162 - DNA, 20 bp, human
ggggcccccgagggaatcca

SEQ ID NO: 134163 - DNA, 20 bp, human
ggacagacacaaagacggag

SEQ ID NO: 134164 - DNA, 20 bp, human
gtgggcgggaccgggtacct

SEQ ID NO: 134165 - DNA, 20 bp, human
gcttacctgccatgggagaa

SEQ ID NO: 134166 - DNA, 20 bp, human
gacgccgggtctagttgtac

SEQ ID NO: 134167 - DNA, 20 bp, human
gtcctggctgcacttcacgg

SEQ ID NO: 134168 - DNA, 20 bp, human
gggtctagttgtactggcag

SEQ ID NO: 134169 - DNA, 20 bp, human
gcaccggggacgccagacgc

SEQ ID NO: 134170 - DNA, 20 bp, human
gcacgcagagcgaaacgaaa

SEQ ID NO: 134171 - DNA, 20 bp, human
ggcctgccccgcagaatgct

SEQ ID NO: 134172 - DNA, 20 bp, human
gggtggttgcagaagttccg

SEQ ID NO: 134173 - DNA, 20 bp, human
ggtctgcactgcagacgcag

SEQ ID NO: 134174 - DNA, 20 bp, human
gtgggtctctggcgtttcta

SEQ ID NO: 134175 - DNA, 20 bp, human
gccgagggcgtcgtcagggg

SEQ ID NO: 134176 - DNA, 20 bp, human
gagtgactcagacatcttca

SEQ ID NO: 134177 - DNA, 20 bp, human
ggtctgagtcacttcttcaa

SEQ ID NO: 134178 - DNA, 20 bp, human
gaatgttaaacacaaggaca

SEQ ID NO: 134179 - DNA, 20 bp, human
gcacttcttcaaaggttgcc

SEQ ID NO: 134180 - DNA, 20 bp, human
gtgtaactcaacatgctcct

SEQ ID NO: 134181 - DNA, 20 bp, human
ggtgttacaaccagttagat

SEQ ID NO: 134182 - DNA, 20 bp, human
gtttaaagtaccaatctaac

SEQ ID NO: 134183 - DNA, 20 bp, human
gacatcttcatggcctctaa

SEQ ID NO: 134184 - DNA, 20 bp, human
gttgccaggttggaaaacaa

SEQ ID NO: 134185 - DNA, 20 bp, human
gtatttactcttacctttag

SEQ ID NO: 134186 - DNA, 20 bp, human
gcgcggtcacgtgggatggc

SEQ ID NO: 134187 - DNA, 20 bp, human
gcgcgccccaactcactcag

SEQ ID NO: 134188 - DNA, 20 bp, human
gcaccgctaaaggaaagggg

SEQ ID NO: 134189 - DNA, 20 bp, human
gaggtggccgaccagaccgt

SEQ ID NO: 134190 - DNA, 20 bp, human
ggccccaactcactcagcgg

SEQ ID NO: 134191 - DNA, 20 bp, human
gggcccaccgctaaaggaaa

SEQ ID NO: 134192 - DNA, 20 bp, human
ggcggtagcacgagggaact

SEQ ID NO: 134193 - DNA, 20 bp, human
ggtccaaactcatcacgcgg

SEQ ID NO: 134194 - DNA, 20 bp, human
gctccaggcagaatctctaa

SEQ ID NO: 134195 - DNA, 20 bp, human
gtcacgcggcggtagcacga

SEQ ID NO: 134196 - DNA, 20 bp, human
gtaggcgggaccaggcagat

SEQ ID NO: 134197 - DNA, 20 bp, human
gaggccaagccagtcatcat

SEQ ID NO: 134198 - DNA, 20 bp, human
gcgtggccttgaaaatgtag

SEQ ID NO: 134199 - DNA, 20 bp, human
gtggtcgaagaacaacagaa

SEQ ID NO: 134200 - DNA, 20 bp, human
ggacggagcttaggtgatgg

SEQ ID NO: 134201 - DNA, 20 bp, human
gggccttgaaaatgtagagg

SEQ ID NO: 134202 - DNA, 20 bp, human
gaccgggtgtagcaacccca

SEQ ID NO: 134203 - DNA, 20 bp, human
ggtgatggaggcaaagtgaa

SEQ ID NO: 134204 - DNA, 20 bp, human
gtgagacggagcttaggtga

SEQ ID NO: 134205 - DNA, 20 bp, human
gtacaaaacttagcagaccg

SEQ ID NO: 134206 - DNA, 20 bp, human
ggcagggacggtgcaccgga

SEQ ID NO: 134207 - DNA, 20 bp, human
ggtgagcagggacggtgcac

SEQ ID NO: 134208 - DNA, 20 bp, human
gcacggagggtcctacgctc

SEQ ID NO: 134209 - DNA, 20 bp, human
ggtgccagggtgaccgggta

SEQ ID NO: 134210 - DNA, 20 bp, human
gtaggaccctccgtgctcca

SEQ ID NO: 134211 - DNA, 20 bp, human
gacggcgggatcgagcaaat

SEQ ID NO: 134212 - DNA, 20 bp, human
ggcaggcctggtggtgagca

SEQ ID NO: 134213 - DNA, 20 bp, human
gtctggccatggagcacgga

SEQ ID NO: 134214 - DNA, 20 bp, human
gggacggtgcaccggacggc

SEQ ID NO: 134215 - DNA, 20 bp, human
gattgatgcggtccaggtcg

SEQ ID NO: 134216 - DNA, 20 bp, human
gcgggtgtgagagggtacta

SEQ ID NO: 134217 - DNA, 20 bp, human
gcgcgggtgcgggtgtgaga

SEQ ID NO: 134218 - DNA, 20 bp, human
ggtctgatggtggccctggg

SEQ ID NO: 134219 - DNA, 20 bp, human
ggcagggagttgtctgatgg

SEQ ID NO: 134220 - DNA, 20 bp, human
gacaacgacacctatagata

SEQ ID NO: 134221 - DNA, 20 bp, human
ggcacgtcgcacacagacat

SEQ ID NO: 134222 - DNA, 20 bp, human
ggtgacactaggtgagaatt

SEQ ID NO: 134223 - DNA, 20 bp, human
ggtcgggggaacgtgacact

SEQ ID NO: 134224 - DNA, 20 bp, human
ggtgagggatcgtgaggcgc

SEQ ID NO: 134225 - DNA, 20 bp, human
gtactaggggtttgcatgca

SEQ ID NO: 134226 - DNA, 20 bp, human
gagagcgcgagcggagctgg

SEQ ID NO: 134227 - DNA, 20 bp, human
gtagggtgtgtgagtgacgg

SEQ ID NO: 134228 - DNA, 20 bp, human
ggggacgggcagtcaggtgt

SEQ ID NO: 134229 - DNA, 20 bp, human
gctggcgatgtccgcgaggg

SEQ ID NO: 134230 - DNA, 20 bp, human
gagagctcgcctcgcatggt

SEQ ID NO: 134231 - DNA, 20 bp, human
gcatagagccccctctccta

SEQ ID NO: 134232 - DNA, 20 bp, human
gagcccggagcaggtaggac

SEQ ID NO: 134233 - DNA, 20 bp, human
gactggagggaccttaggag

SEQ ID NO: 134234 - DNA, 20 bp, human
ggaaggagaggtccgggcat

SEQ ID NO: 134235 - DNA, 20 bp, human
gccctccctcgtcaggaccg

SEQ ID NO: 134236 - DNA, 20 bp, human
gacaggagaaggtacactgt

SEQ ID NO: 134237 - DNA, 20 bp, human
gccggccttgccttgttcca

SEQ ID NO: 134238 - DNA, 20 bp, human
gcttaccgtggaacaaggca

SEQ ID NO: 134239 - DNA, 20 bp, human
ggacggcaaggaatcaggtc

SEQ ID NO: 134240 - DNA, 20 bp, human
gacccaatgtccccttaccg

SEQ ID NO: 134241 - DNA, 20 bp, human
gtccacggtaaggggacatt

SEQ ID NO: 134242 - DNA, 20 bp, human
ggtccccttaccgtggaaca

SEQ ID NO: 134243 - DNA, 20 bp, human
ggaacgaagtaggtcagggg

SEQ ID NO: 134244 - DNA, 20 bp, human
gtaatagacggcaaggaatc

SEQ ID NO: 134245 - DNA, 20 bp, human
gtatgggcggggacaggaga

SEQ ID NO: 134246 - DNA, 20 bp, human
gtgcagccctaaccttccca

SEQ ID NO: 134247 - DNA, 20 bp, human
gaccagccctagtggatctg

SEQ ID NO: 134248 - DNA, 20 bp, human
gttctcgcagccggaggaat

SEQ ID NO: 134249 - DNA, 20 bp, human
gacagtagggaaccgagaag

SEQ ID NO: 134250 - DNA, 20 bp, human
ggcctgccccagatccacta

SEQ ID NO: 134251 - DNA, 20 bp, human
gcggggccatccctagacag

SEQ ID NO: 134252 - DNA, 20 bp, human
gagcgctcttcggacctctg

SEQ ID NO: 134253 - DNA, 20 bp, human
gcaacaaccgcggggaggag

SEQ ID NO: 134254 - DNA, 20 bp, human
gttggagctgcccattcctc

SEQ ID NO: 134255 - DNA, 20 bp, human
gggaagaagcgaacgcgagt

SEQ ID NO: 134256 - DNA, 20 bp, human
gagacaggcgaggtgtatgt

SEQ ID NO: 134257 - DNA, 20 bp, human
ggccaggccaagctcttcgt

SEQ ID NO: 134258 - DNA, 20 bp, human
gcagcaggaccagagcaccg

SEQ ID NO: 134259 - DNA, 20 bp, human
gcaggccagcaggcggttag

SEQ ID NO: 134260 - DNA, 20 bp, human
gtagtggtgcatgagcagac

SEQ ID NO: 134261 - DNA, 20 bp, human
ggcagcggcatggcaggctg

SEQ ID NO: 134262 - DNA, 20 bp, human
gcctgctggggtgagcatca

SEQ ID NO: 134263 - DNA, 20 bp, human
gtgctcatgcaccactaggt

SEQ ID NO: 134264 - DNA, 20 bp, human
gagtactgcccaggccgtgg

SEQ ID NO: 134265 - DNA, 20 bp, human
gcggctcatggccaacgagg

SEQ ID NO: 134266 - DNA, 20 bp, human
ggcgccagactggagcggga

SEQ ID NO: 134267 - DNA, 20 bp, human
ggcgcgcggagcggagaccg

SEQ ID NO: 134268 - DNA, 20 bp, human
gggggcgacggaggactgag

SEQ ID NO: 134269 - DNA, 20 bp, human
ggcagctctggctcccgcgg

SEQ ID NO: 134270 - DNA, 20 bp, human
ggctctcagggggcacccgg

SEQ ID NO: 134271 - DNA, 20 bp, human
gcgctgtcgccggctctcag

SEQ ID NO: 134272 - DNA, 20 bp, human
ggccggcggtgtctctcctg

SEQ ID NO: 134273 - DNA, 20 bp, human
gccgccctcccgctccagtc

SEQ ID NO: 134274 - DNA, 20 bp, human
gcgagagcttgggagcggta

SEQ ID NO: 134275 - DNA, 20 bp, human
gtgagctgcatggtgaaata

SEQ ID NO: 134276 - DNA, 20 bp, human
gccgggccagcccagtgtgt

SEQ ID NO: 134277 - DNA, 20 bp, human
ggtttgcccgggccccatca

SEQ ID NO: 134278 - DNA, 20 bp, human
gccatcagggcacccctcgg

SEQ ID NO: 134279 - DNA, 20 bp, human
ggccgccgccgcccacacac

SEQ ID NO: 134280 - DNA, 20 bp, human
ggctccgcgagtccgccgag

SEQ ID NO: 134281 - DNA, 20 bp, human
ggccccatcagggcacccct

SEQ ID NO: 134282 - DNA, 20 bp, human
gggactcgcggagcccttag

SEQ ID NO: 134283 - DNA, 20 bp, human
gcgcagagacgggggtccag

SEQ ID NO: 134284 - DNA, 20 bp, human
ggcgccgacgggcagggata

SEQ ID NO: 134285 - DNA, 20 bp, human
gccccgctcgcacgtcccca

SEQ ID NO: 134286 - DNA, 20 bp, human
ggcacacggcttaccatctc

SEQ ID NO: 134287 - DNA, 20 bp, human
gaccatctcaggcagctctc

SEQ ID NO: 134288 - DNA, 20 bp, human
gggagcctggcagtgtccag

SEQ ID NO: 134289 - DNA, 20 bp, human
gctggagcctaggccctcat

SEQ ID NO: 134290 - DNA, 20 bp, human
gcccggcccaccttacaaac

SEQ ID NO: 134291 - DNA, 20 bp, human
gtccagagggctcagggact

SEQ ID NO: 134292 - DNA, 20 bp, human
gtggtctctgagctccggtg

SEQ ID NO: 134293 - DNA, 20 bp, human
gacttgatgatgctccaggt

SEQ ID NO: 134294 - DNA, 20 bp, human
gacccagtccctgagccctc

SEQ ID NO: 134295 - DNA, 20 bp, human
ggcaccctgcttgccaatgt

SEQ ID NO: 134296 - DNA, 20 bp, human
gcggccgccgctacccagag

SEQ ID NO: 134297 - DNA, 20 bp, human
gtacccagagaggcgcgcag

SEQ ID NO: 134298 - DNA, 20 bp, human
ggcccagctagggacgaaag

SEQ ID NO: 134299 - DNA, 20 bp, human
gaggcgccgagagcgctccc

SEQ ID NO: 134300 - DNA, 20 bp, human
gtgatgccaagcgggcacag

SEQ ID NO: 134301 - DNA, 20 bp, human
ggcgcctctctgggtagcgg

SEQ ID NO: 134302 - DNA, 20 bp, human
gcgccgagagcgctccccgg

SEQ ID NO: 134303 - DNA, 20 bp, human
gagtgtctcggcaagggtgg

SEQ ID NO: 134304 - DNA, 20 bp, human
ggggcgtccaggtgggacgt

SEQ ID NO: 134305 - DNA, 20 bp, human
gggcagcccgggagctccgg

SEQ ID NO: 134306 - DNA, 20 bp, human
gcaccgggagcagccagaaa

SEQ ID NO: 134307 - DNA, 20 bp, human
gctcccggtgggactgacaa

SEQ ID NO: 134308 - DNA, 20 bp, human
ggaggcgaggaccccatcac

SEQ ID NO: 134309 - DNA, 20 bp, human
gtgcggctccaccagacccg

SEQ ID NO: 134310 - DNA, 20 bp, human
gggtctccgggtaacagctg

SEQ ID NO: 134311 - DNA, 20 bp, human
gctgttacccggagaccgag

SEQ ID NO: 134312 - DNA, 20 bp, human
gtccgcgcgaagggaaactc

SEQ ID NO: 134313 - DNA, 20 bp, human
gtcctcgcctcggggtctgg

SEQ ID NO: 134314 - DNA, 20 bp, human
ggctcgggctccgcgcgcag

SEQ ID NO: 134315 - DNA, 20 bp, human
gggtcaaggacgagccgagt

SEQ ID NO: 134316 - DNA, 20 bp, human
gctcggcgcacggagctcgg

SEQ ID NO: 134317 - DNA, 20 bp, human
gtcggcggctgaagagtgag

SEQ ID NO: 134318 - DNA, 20 bp, human
gcgggagctcgggcaaatcc

SEQ ID NO: 134319 - DNA, 20 bp, human
ggtgcaggtaccgagctcgg

SEQ ID NO: 134320 - DNA, 20 bp, human
gcccctcctcggccacacaa

SEQ ID NO: 134321 - DNA, 20 bp, human
gacctgcacgtccgccgcca

SEQ ID NO: 134322 - DNA, 20 bp, human
ggcggaggagggatccgacg

SEQ ID NO: 134323 - DNA, 20 bp, human
gcccgggcgccatcgagcct

SEQ ID NO: 134324 - DNA, 20 bp, human
ggggcgccatcgagccttgg

SEQ ID NO: 134325 - DNA, 20 bp, human
ggccttggcggcggacgtgc

SEQ ID NO: 134326 - DNA, 20 bp, human
gagtaggctccagggcaagg

SEQ ID NO: 134327 - DNA, 20 bp, human
gcccacagcacggcagcagt

SEQ ID NO: 134328 - DNA, 20 bp, human
gcagctcttgcctacctggt

SEQ ID NO: 134329 - DNA, 20 bp, human
ggctctgtgagacgtgctcc

SEQ ID NO: 134330 - DNA, 20 bp, human
gtgtcggcccagcctgacga

SEQ ID NO: 134331 - DNA, 20 bp, human
ggaaagccaacgccagcctc

SEQ ID NO: 134332 - DNA, 20 bp, human
gcgggcttgttgggatgagt

SEQ ID NO: 134333 - DNA, 20 bp, human
ggcagtgggctgctgtcacc

SEQ ID NO: 134334 - DNA, 20 bp, human
gtgttgggatgagtcggact

SEQ ID NO: 134335 - DNA, 20 bp, human
ggagcacggtgtcccccaag

SEQ ID NO: 134336 - DNA, 20 bp, human
gggaactctccggcgaagga

SEQ ID NO: 134337 - DNA, 20 bp, human
gccagcagataggcgagcag

SEQ ID NO: 134338 - DNA, 20 bp, human
gctcgccgcgatggctccga

SEQ ID NO: 134339 - DNA, 20 bp, human
gggcggtcggagcaagccat

SEQ ID NO: 134340 - DNA, 20 bp, human
gcaagccatcggagccatcg

SEQ ID NO: 134341 - DNA, 20 bp, human
gcctccgggagacctccatg

SEQ ID NO: 134342 - DNA, 20 bp, human
ggccgccagtgccagcagat

SEQ ID NO: 134343 - DNA, 20 bp, human
gtctccggcgaaggagggcg

SEQ ID NO: 134344 - DNA, 20 bp, human
gcttgctccgaccgccacac

SEQ ID NO: 134345 - DNA, 20 bp, human
gcgcggacgagcccgtgtgg

SEQ ID NO: 134346 - DNA, 20 bp, human
ggcggcgcgaggagccatcc

SEQ ID NO: 134347 - DNA, 20 bp, human
ggcggcgcggcgagtgcatg

SEQ ID NO: 134348 - DNA, 20 bp, human
gtgtgcgggtccatctacca

SEQ ID NO: 134349 - DNA, 20 bp, human
gaaccgacgctggatctcca

SEQ ID NO: 134350 - DNA, 20 bp, human
gcagcccgcgcacgcccgga

SEQ ID NO: 134351 - DNA, 20 bp, human
gggcgcccgacagctgatag

SEQ ID NO: 134352 - DNA, 20 bp, human
gtgcagctggaccccggcca

SEQ ID NO: 134353 - DNA, 20 bp, human
gccagggcgaagttgttggt

SEQ ID NO: 134354 - DNA, 20 bp, human
ggctgcggagcgtgacacag

SEQ ID NO: 134355 - DNA, 20 bp, human
gcgtgacacagcgggctgtc

SEQ ID NO: 134356 - DNA, 20 bp, human
ggtgtggcgtccccagacag

SEQ ID NO: 134357 - DNA, 20 bp, human
gtcctgctgtcaggctaccg

SEQ ID NO: 134358 - DNA, 20 bp, human
gggccaagaaacgctagtct

SEQ ID NO: 134359 - DNA, 20 bp, human
gagttccaggagccaggtat

SEQ ID NO: 134360 - DNA, 20 bp, human
gggagcttccaggttaggca

SEQ ID NO: 134361 - DNA, 20 bp, human
gaagttggagcttccaggtt

SEQ ID NO: 134362 - DNA, 20 bp, human
gacggtggtcacgccaagag

SEQ ID NO: 134363 - DNA, 20 bp, human
gaggagcagcatagccacca

SEQ ID NO: 134364 - DNA, 20 bp, human
gaccccggtagcctgacagc

SEQ ID NO: 134365 - DNA, 20 bp, human
ggggacccacatatgagcat

SEQ ID NO: 134366 - DNA, 20 bp, human
gcgcgggcggtcgctacctg

SEQ ID NO: 134367 - DNA, 20 bp, human
ggctacctgcggccgagcca

SEQ ID NO: 134368 - DNA, 20 bp, human
gcgcagagggcagcgggctt

SEQ ID NO: 134369 - DNA, 20 bp, human
gcagcgcgtcgtactcgcag

SEQ ID NO: 134370 - DNA, 20 bp, human
gcgcaggcgtggccgatgcc

SEQ ID NO: 134371 - DNA, 20 bp, human
gaagtgcgtcagcacgcggt

SEQ ID NO: 134372 - DNA, 20 bp, human
gggccccacctcaccttcac

SEQ ID NO: 134373 - DNA, 20 bp, human
gtgggcagcatgaggcccgg

SEQ ID NO: 134374 - DNA, 20 bp, human
gcatgaggcccggaggggag

SEQ ID NO: 134375 - DNA, 20 bp, human
gtgggcatggtgctcctcgt

SEQ ID NO: 134376 - DNA, 20 bp, human
gcggagatgccaactacaca

SEQ ID NO: 134377 - DNA, 20 bp, human
gggcactcaccgtgtgtagt

SEQ ID NO: 134378 - DNA, 20 bp, human
ggccctggcgcgagccttag

SEQ ID NO: 134379 - DNA, 20 bp, human
gtccccaggaccggcgggta

SEQ ID NO: 134380 - DNA, 20 bp, human
gccaggaccggcgggtacgg

SEQ ID NO: 134381 - DNA, 20 bp, human
gaccccgaagaactttctgg

SEQ ID NO: 134382 - DNA, 20 bp, human
gctttctggaggcgccccta

SEQ ID NO: 134383 - DNA, 20 bp, human
ggcccctaaggctcgcgcca

SEQ ID NO: 134384 - DNA, 20 bp, human
ggatgctgggatcgggtgtc

SEQ ID NO: 134385 - DNA, 20 bp, human
gtcgcgccagggcacagacc

SEQ ID NO: 134386 - DNA, 20 bp, human
gctgggatggaagaactacc

SEQ ID NO: 134387 - DNA, 20 bp, human
gcagataagaggtgtttgct

SEQ ID NO: 134388 - DNA, 20 bp, human
ggaggaaaataaagtttcaa

SEQ ID NO: 134389 - DNA, 20 bp, human
gtcagttattgctccttccc

SEQ ID NO: 134390 - DNA, 20 bp, human
gagcagtttcatgaacgaag

SEQ ID NO: 134391 - DNA, 20 bp, human
gatttaatacattcaggttg

SEQ ID NO: 134392 - DNA, 20 bp, human
gacagaatcgtttaccaagc

SEQ ID NO: 134393 - DNA, 20 bp, human
gcatggtatttaatacattc

SEQ ID NO: 134394 - DNA, 20 bp, human
gttttatattgttccaggga

SEQ ID NO: 134395 - DNA, 20 bp, human
gatttctctgtcagcctgct

SEQ ID NO: 134396 - DNA, 20 bp, human
ggctggagggaagaacacaa

SEQ ID NO: 134397 - DNA, 20 bp, human
gtatcacagccaaatgaaga

SEQ ID NO: 134398 - DNA, 20 bp, human
gtcttccctccagcaaccaa

SEQ ID NO: 134399 - DNA, 20 bp, human
gcagcaaccaaaggcactgg

SEQ ID NO: 134400 - DNA, 20 bp, human
gtcctcctaatgggagatag

SEQ ID NO: 134401 - DNA, 20 bp, human
gagtggggagtcagagaatg

SEQ ID NO: 134402 - DNA, 20 bp, human
gtggagcacgggctccaaag

SEQ ID NO: 134403 - DNA, 20 bp, human
gagtgcctttggttgctgga

SEQ ID NO: 134404 - DNA, 20 bp, human
ggggaagaacacaatggatc

SEQ ID NO: 134405 - DNA, 20 bp, human
ggggtaggagatttaaagtg

SEQ ID NO: 134406 - DNA, 20 bp, human
gttcgctccgagaccgcggt

SEQ ID NO: 134407 - DNA, 20 bp, human
gatctccttggacttgaatg

SEQ ID NO: 134408 - DNA, 20 bp, human
ggagcgaaacccgatctcct

SEQ ID NO: 134409 - DNA, 20 bp, human
ggctccgagaccgcggtcgg

SEQ ID NO: 134410 - DNA, 20 bp, human
gccatcaagcggtgcatgga

SEQ ID NO: 134411 - DNA, 20 bp, human
gctgcctccgaccgcggtct

SEQ ID NO: 134412 - DNA, 20 bp, human
ggtctgcctgcctccgaccg

SEQ ID NO: 134413 - DNA, 20 bp, human
gctgacgtcagcgctagacg

SEQ ID NO: 134414 - DNA, 20 bp, human
gacattgggctgcccggcgg

SEQ ID NO: 134415 - DNA, 20 bp, human
gcgccggccggagccccccc

SEQ ID NO: 134416 - DNA, 20 bp, human
gccaacaaacactcccaccg

SEQ ID NO: 134417 - DNA, 20 bp, human
gtcgccgccggcaggtaaag

SEQ ID NO: 134418 - DNA, 20 bp, human
gaagcaagtagcgccaatct

SEQ ID NO: 134419 - DNA, 20 bp, human
ggtagcgccaatctaggcag

SEQ ID NO: 134420 - DNA, 20 bp, human
gtcacagccgctgcctagat

SEQ ID NO: 134421 - DNA, 20 bp, human
gaggccgggccagttagatt

SEQ ID NO: 134422 - DNA, 20 bp, human
gtggaggttcaacttcaaca

SEQ ID NO: 134423 - DNA, 20 bp, human
ggtgaataccctgactccta

SEQ ID NO: 134424 - DNA, 20 bp, human
gtcgaaatggtagtgccggg

SEQ ID NO: 134425 - DNA, 20 bp, human
gccgggccagttagatttgg

SEQ ID NO: 134426 - DNA, 20 bp, human
gaagcaagtagcgccaatct

SEQ ID NO: 134427 - DNA, 20 bp, human
ggtagcgccaatctaggcag

SEQ ID NO: 134428 - DNA, 20 bp, human
gtcacagccgctgcctagat

SEQ ID NO: 134429 - DNA, 20 bp, human
gaggccgggccagttagatt

SEQ ID NO: 134430 - DNA, 20 bp, human
gtggaggttcaacttcaaca

SEQ ID NO: 134431 - DNA, 20 bp, human
ggtgaataccctgactccta

SEQ ID NO: 134432 - DNA, 20 bp, human
gtcgaaatggtagtgccggg

SEQ ID NO: 134433 - DNA, 20 bp, human
gtcgccgccggcaggtaaag

SEQ ID NO: 134434 - DNA, 20 bp, human
gccgggccagttagatttgg

SEQ ID NO: 134435 - DNA, 20 bp, human
gccgcggtgggagtgtttgt

SEQ ID NO: 134436 - DNA, 20 bp, human
gctgtgcatgaagacttcag

SEQ ID NO: 134437 - DNA, 20 bp, human
gttcagagggtactcaatgc

SEQ ID NO: 134438 - DNA, 20 bp, human
gcatgcacagaggtgcatca

SEQ ID NO: 134439 - DNA, 20 bp, human
gaaagaatgttggtgatatg

SEQ ID NO: 134440 - DNA, 20 bp, human
gtctgcaggtaagttcctgg

SEQ ID NO: 134441 - DNA, 20 bp, human
gtggcttatattagggatag

SEQ ID NO: 134442 - DNA, 20 bp, human
gtattctgcaggtaagttcc

SEQ ID NO: 134443 - DNA, 20 bp, human
gtttatgagcatcaacatta

SEQ ID NO: 134444 - DNA, 20 bp, human
ggttggtgatatgtggaatc

SEQ ID NO: 134445 - DNA, 20 bp, human
gtgttgatgctcataaagtt

SEQ ID NO: 134446 - DNA, 20 bp, human
gggaaatgaaagatgaggta

SEQ ID NO: 134447 - DNA, 20 bp, human
gccatgcatgtagaggagtt

SEQ ID NO: 134448 - DNA, 20 bp, human
gaaatatcatggacagaggt

SEQ ID NO: 134449 - DNA, 20 bp, human
gacccacccagctcgagtct

SEQ ID NO: 134450 - DNA, 20 bp, human
gaaagctcagaaaatactaa

SEQ ID NO: 134451 - DNA, 20 bp, human
gggcaaaggaaacttagagt

SEQ ID NO: 134452 - DNA, 20 bp, human
ggcccagactcgagctgggt

SEQ ID NO: 134453 - DNA, 20 bp, human
gttcaactccatgcatgtag

SEQ ID NO: 134454 - DNA, 20 bp, human
gactcgagctgggtgggtct

SEQ ID NO: 134455 - DNA, 20 bp, human
gttggtatgaggattagcaa

SEQ ID NO: 134456 - DNA, 20 bp, human
ggtgcgtgaagagaagctga

SEQ ID NO: 134457 - DNA, 20 bp, human
gagtagaaaagaggacacgg

SEQ ID NO: 134458 - DNA, 20 bp, human
ggtcctgaccgtctcgggtg

SEQ ID NO: 134459 - DNA, 20 bp, human
ggccctacagaggtactatt

SEQ ID NO: 134460 - DNA, 20 bp, human
ggagaatcgaaactaagctg

SEQ ID NO: 134461 - DNA, 20 bp, human
gtggggcctcggagatcggg

SEQ ID NO: 134462 - DNA, 20 bp, human
gaccttgcccaactgctcag

SEQ ID NO: 134463 - DNA, 20 bp, human
gccagggtcctgaccgtctc

SEQ ID NO: 134464 - DNA, 20 bp, human
gtgctggggcctcggagatc

SEQ ID NO: 134465 - DNA, 20 bp, human
ggtttctccactgagcagtt

SEQ ID NO: 134466 - DNA, 20 bp, human
ggccatggcagtcaccgccc

SEQ ID NO: 134467 - DNA, 20 bp, human
gcggagtcccgaagatgcaa

SEQ ID NO: 134468 - DNA, 20 bp, human
ggcctgggcggtgactgcca

SEQ ID NO: 134469 - DNA, 20 bp, human
ggcccaggcagcccgcagga

SEQ ID NO: 134470 - DNA, 20 bp, human
gtccgtgagccaggccttag

SEQ ID NO: 134471 - DNA, 20 bp, human
ggtgtcgtagggctgaacta

SEQ ID NO: 134472 - DNA, 20 bp, human
ggaggacgcgctccttcctg

SEQ ID NO: 134473 - DNA, 20 bp, human
ggcgcgcggacctgcagcca

SEQ ID NO: 134474 - DNA, 20 bp, human
gcggcgtgtgacagcctccg

SEQ ID NO: 134475 - DNA, 20 bp, human
gcgtgtgacagcctccgggg

SEQ ID NO: 134476 - DNA, 20 bp, human
gaactcggcccggaacttcc

SEQ ID NO: 134477 - DNA, 20 bp, human
gaaggtgcggctagaaactg

SEQ ID NO: 134478 - DNA, 20 bp, human
gcaacgtgtcttgtaaggtg

SEQ ID NO: 134479 - DNA, 20 bp, human
gggtcccatccacgtcgaag

SEQ ID NO: 134480 - DNA, 20 bp, human
gtatcagtcccgagcactag

SEQ ID NO: 134481 - DNA, 20 bp, human
gttcagcgccgtgaggacgt

SEQ ID NO: 134482 - DNA, 20 bp, human
gcgtgccaacgtgtcttgta

SEQ ID NO: 134483 - DNA, 20 bp, human
ggctatcgaccacccagggt

SEQ ID NO: 134484 - DNA, 20 bp, human
ggtcgaagaggcagagcgct

SEQ ID NO: 134485 - DNA, 20 bp, human
gtgctcgggactgatagacc

SEQ ID NO: 134486 - DNA, 20 bp, human
gcgatgagcaacaaattcct

SEQ ID NO: 134487 - DNA, 20 bp, human
ggctcaacacagttctaagt

SEQ ID NO: 134488 - DNA, 20 bp, human
gattttggttgcaggtccag

SEQ ID NO: 134489 - DNA, 20 bp, human
gatttgttgctcatcgtgat

SEQ ID NO: 134490 - DNA, 20 bp, human
gtacttttaacaggatactg

SEQ ID NO: 134491 - DNA, 20 bp, human
gacgattacatgaaagctct

SEQ ID NO: 134492 - DNA, 20 bp, human
ggatactggggagttttgca

SEQ ID NO: 134493 - DNA, 20 bp, human
gagagagctgcttaaatgca

SEQ ID NO: 134494 - DNA, 20 bp, human
ggcatggtcaacccattttc

SEQ ID NO: 134495 - DNA, 20 bp, human
gaaaagattaatcctaaaag

SEQ ID NO: 134496 - DNA, 20 bp, human
ggcgcgcgcgcgaagcaagg

SEQ ID NO: 134497 - DNA, 20 bp, human
ggctttggcggcgccagcag

SEQ ID NO: 134498 - DNA, 20 bp, human
gccccgcagcgcagctttgg

SEQ ID NO: 134499 - DNA, 20 bp, human
ggtggcctcaaacacaaact

SEQ ID NO: 134500 - DNA, 20 bp, human
gcagccccgcagcgcagctt

SEQ ID NO: 134501 - DNA, 20 bp, human
gacagctgtcccgatcctca

SEQ ID NO: 134502 - DNA, 20 bp, human
ggtgtctggatagcggataa

SEQ ID NO: 134503 - DNA, 20 bp, human
gcttcagcaaggcgagaact

SEQ ID NO: 134504 - DNA, 20 bp, human
gacaggagtccaacactctc

SEQ ID NO: 134505 - DNA, 20 bp, human
gtctggatagcggataaggg

SEQ ID NO: 134506 - DNA, 20 bp, human
gaacagagctgggcccccac

SEQ ID NO: 134507 - DNA, 20 bp, human
gtgtggtgctggcggcgacg

SEQ ID NO: 134508 - DNA, 20 bp, human
gccgcagggttctgacacca

SEQ ID NO: 134509 - DNA, 20 bp, human
gtgcggggctcgggttcttg

SEQ ID NO: 134510 - DNA, 20 bp, human
gtcctgaaggagcacgcggt

SEQ ID NO: 134511 - DNA, 20 bp, human
gagtgacgactgaagcgggg

SEQ ID NO: 134512 - DNA, 20 bp, human
gggaagtgacgactgaagcg

SEQ ID NO: 134513 - DNA, 20 bp, human
gctgcgggtctaacagagct

SEQ ID NO: 134514 - DNA, 20 bp, human
gggtgtccccgaggcgacgg

SEQ ID NO: 134515 - DNA, 20 bp, human
ggggctcgaggcgcaaagca

SEQ ID NO: 134516 - DNA, 20 bp, human
gcgccacagatccgaacagt

SEQ ID NO: 134517 - DNA, 20 bp, human
gccctgcccgacccactgtt

SEQ ID NO: 134518 - DNA, 20 bp, human
gtctgctagaaggaaggtag

SEQ ID NO: 134519 - DNA, 20 bp, human
gctagcagaaatggcggctg

SEQ ID NO: 134520 - DNA, 20 bp, human
gttccttctagcagaaatgg

SEQ ID NO: 134521 - DNA, 20 bp, human
gcgagtggtgttgtcatccg

SEQ ID NO: 134522 - DNA, 20 bp, human
ggcgagagtcttctaatccg

SEQ ID NO: 134523 - DNA, 20 bp, human
ggaaggaaggtagaggatga

SEQ ID NO: 134524 - DNA, 20 bp, human
gaccttccttctagcagaaa

SEQ ID NO: 134525 - DNA, 20 bp, human
ggaggacgaagttcagtctt

SEQ ID NO: 134526 - DNA, 20 bp, human
gtagtatacagtctgctctc

SEQ ID NO: 134527 - DNA, 20 bp, human
ggaaactgaattctgggtga

SEQ ID NO: 134528 - DNA, 20 bp, human
ggaacttgagattgaaaata

SEQ ID NO: 134529 - DNA, 20 bp, human
gttgttgttaattcttccac

SEQ ID NO: 134530 - DNA, 20 bp, human
gtagcagttttagagctaat

SEQ ID NO: 134531 - DNA, 20 bp, human
gtcaaaacagtctacaaaca

SEQ ID NO: 134532 - DNA, 20 bp, human
gaaaaagcgaaactgaattc

SEQ ID NO: 134533 - DNA, 20 bp, human
gctcaagttccagatctaac

SEQ ID NO: 134534 - DNA, 20 bp, human
gtatacagtctgctctctgg

SEQ ID NO: 134535 - DNA, 20 bp, human
gaaataataacagtacctct

SEQ ID NO: 134536 - DNA, 20 bp, human
gtccgggcgcgaacgctata

SEQ ID NO: 134537 - DNA, 20 bp, human
gcggaccaggacgagtagag

SEQ ID NO: 134538 - DNA, 20 bp, human
gatcctgtggcatcatacaa

SEQ ID NO: 134539 - DNA, 20 bp, human
gtgcgcatcgggtgagacgc

SEQ ID NO: 134540 - DNA, 20 bp, human
gaggcagcagatttaaccca

SEQ ID NO: 134541 - DNA, 20 bp, human
gcgtggccgtaagagccaag

SEQ ID NO: 134542 - DNA, 20 bp, human
gtaagtgggcacgaacgcgg

SEQ ID NO: 134543 - DNA, 20 bp, human
ggtgagacgctggctgcttg

SEQ ID NO: 134544 - DNA, 20 bp, human
ggaacgctatagggcagcta

SEQ ID NO: 134545 - DNA, 20 bp, human
ggctgcttgcggctagtgga

SEQ ID NO: 134546 - DNA, 20 bp, human
gggatcgggtgttgcatcca

SEQ ID NO: 134547 - DNA, 20 bp, human
ggcctcaaggcgcacccaag

SEQ ID NO: 134548 - DNA, 20 bp, human
gccaatgggagttcaggagg

SEQ ID NO: 134549 - DNA, 20 bp, human
gcgagatcgctgcaacactg

SEQ ID NO: 134550 - DNA, 20 bp, human
gcagccaatgggagttcagg

SEQ ID NO: 134551 - DNA, 20 bp, human
gtgggtgcgccttgaggccg

SEQ ID NO: 134552 - DNA, 20 bp, human
gccactccggggcctccagg

SEQ ID NO: 134553 - DNA, 20 bp, human
gagcggggctcgcagtcttc

SEQ ID NO: 134554 - DNA, 20 bp, human
gaatgccgtgggtctcaaag

SEQ ID NO: 134555 - DNA, 20 bp, human
ggccccttgggtgcgccttg

SEQ ID NO: 134556 - DNA, 20 bp, human
gcgcggtgtcccgattttag

SEQ ID NO: 134557 - DNA, 20 bp, human
gaatggacgcggccactaag

SEQ ID NO: 134558 - DNA, 20 bp, human
ggccgcggggcgcctcccag

SEQ ID NO: 134559 - DNA, 20 bp, human
gggctggtactgctgttcag

SEQ ID NO: 134560 - DNA, 20 bp, human
gacgcggccactaagcggag

SEQ ID NO: 134561 - DNA, 20 bp, human
gagggagaagtgtcagcttc

SEQ ID NO: 134562 - DNA, 20 bp, human
gcaggcatcgcgaggcgtgg

SEQ ID NO: 134563 - DNA, 20 bp, human
gtgcagagcaggtgtccgtg

SEQ ID NO: 134564 - DNA, 20 bp, human
gtcgcagctacggcgaggag

SEQ ID NO: 134565 - DNA, 20 bp, human
ggaacagcagtaccagccgc

SEQ ID NO: 134566 - DNA, 20 bp, human
gaaagcggccggatgtgtgg

SEQ ID NO: 134567 - DNA, 20 bp, human
gactgcgcggcacgacgctg

SEQ ID NO: 134568 - DNA, 20 bp, human
gcttgggcgctgtagatgtg

SEQ ID NO: 134569 - DNA, 20 bp, human
gtggaaagcggccggatgtg

SEQ ID NO: 134570 - DNA, 20 bp, human
gcgcctagacccgccaccca

SEQ ID NO: 134571 - DNA, 20 bp, human
gcccatggcacagcgcccac

SEQ ID NO: 134572 - DNA, 20 bp, human
ggctgtagatgtgtggatgg

SEQ ID NO: 134573 - DNA, 20 bp, human
gcagccacctgccaagaccg

SEQ ID NO: 134574 - DNA, 20 bp, human
ggtcgagcgcgcagcggcaa

SEQ ID NO: 134575 - DNA, 20 bp, human
gtgcgtgggatagcagctgt

SEQ ID NO: 134576 - DNA, 20 bp, human
ggtagaagcatcgaaagcgt

SEQ ID NO: 134577 - DNA, 20 bp, human
gagaggtgttaccggaacgg

SEQ ID NO: 134578 - DNA, 20 bp, human
gagcatcgaaagcgttggag

SEQ ID NO: 134579 - DNA, 20 bp, human
gtggagaggtgttaccggaa

SEQ ID NO: 134580 - DNA, 20 bp, human
gaccggaacggcggcgacaa

SEQ ID NO: 134581 - DNA, 20 bp, human
ggcagtgggaacccccttgt

SEQ ID NO: 134582 - DNA, 20 bp, human
ggcgtagtcagagcctcaaa

SEQ ID NO: 134583 - DNA, 20 bp, human
gagcgttggagaggtgttac

SEQ ID NO: 134584 - DNA, 20 bp, human
gggtgttcccgaactagagt

SEQ ID NO: 134585 - DNA, 20 bp, human
ggaacccccttcccacaagg

SEQ ID NO: 134586 - DNA, 20 bp, human
gtcgcagtaggagtcgagat

SEQ ID NO: 134587 - DNA, 20 bp, human
gcaatcgtgccagtcgcagt

SEQ ID NO: 134588 - DNA, 20 bp, human
gggagcagttctgagtctcc

SEQ ID NO: 134589 - DNA, 20 bp, human
gagaagtagaagtcgctcaa

SEQ ID NO: 134590 - DNA, 20 bp, human
gtcaacgtggaaatcttagt

SEQ ID NO: 134591 - DNA, 20 bp, human
gggaacagtcataagcataa

SEQ ID NO: 134592 - DNA, 20 bp, human
gtgaggctaaagaacaagag

SEQ ID NO: 134593 - DNA, 20 bp, human
gtctcaaaggtctggtaaga

SEQ ID NO: 134594 - DNA, 20 bp, human
gcatagtcgatcgcgatccg

SEQ ID NO: 134595 - DNA, 20 bp, human
gtcaggatgatagattaaaa

SEQ ID NO: 134596 - DNA, 20 bp, human
ggtgcttgcccggctggagg

SEQ ID NO: 134597 - DNA, 20 bp, human
gctgccggctctggacgtgg

SEQ ID NO: 134598 - DNA, 20 bp, human
gggtgagggggcgggtccaa

SEQ ID NO: 134599 - DNA, 20 bp, human
ggctcatggcgcacagccag

SEQ ID NO: 134600 - DNA, 20 bp, human
ggccgcgggggctcacaagt

SEQ ID NO: 134601 - DNA, 20 bp, human
gtggtctccagcccattctg

SEQ ID NO: 134602 - DNA, 20 bp, human
ggtccaaaggagaggtcaat

SEQ ID NO: 134603 - DNA, 20 bp, human
gagccgggcaagcaccccga

SEQ ID NO: 134604 - DNA, 20 bp, human
ggtgcgccatgagcagaccg

SEQ ID NO: 134605 - DNA, 20 bp, human
gccaagccgggtggccttcg

SEQ ID NO: 134606 - DNA, 20 bp, human
gccaggccggcacccaggat

SEQ ID NO: 134607 - DNA, 20 bp, human
gccagggcttgcccgtccga

SEQ ID NO: 134608 - DNA, 20 bp, human
ggttgcaggcggggcacctc

SEQ ID NO: 134609 - DNA, 20 bp, human
gtcacggccacttccgacca

SEQ ID NO: 134610 - DNA, 20 bp, human
gtggctcgagagcccccctg

SEQ ID NO: 134611 - DNA, 20 bp, human
gcggccacttccgaccaggg

SEQ ID NO: 134612 - DNA, 20 bp, human
gcatcttcctgccctcggac

SEQ ID NO: 134613 - DNA, 20 bp, human
gggacccctgacccaggtta

SEQ ID NO: 134614 - DNA, 20 bp, human
gggtcccctgcccaggacca

SEQ ID NO: 134615 - DNA, 20 bp, human
gggtccgtaacctgggtcag

SEQ ID NO: 134616 - DNA, 20 bp, human
ggctgcacggccatggacgt

SEQ ID NO: 134617 - DNA, 20 bp, human
gggacgagctcctgcagcag

SEQ ID NO: 134618 - DNA, 20 bp, human
gaagcgcgtgggcagcacgt

SEQ ID NO: 134619 - DNA, 20 bp, human
ggagggcctcgggaaggaca

SEQ ID NO: 134620 - DNA, 20 bp, human
gctcagagagggcctcggga

SEQ ID NO: 134621 - DNA, 20 bp, human
gcaagaagccaagtgaggtc

SEQ ID NO: 134622 - DNA, 20 bp, human
gtcgtcggcgcccacgtcca

SEQ ID NO: 134623 - DNA, 20 bp, human
gtccaggaggccgacttcgt

SEQ ID NO: 134624 - DNA, 20 bp, human
ggtgggcgccgacgagttcg

SEQ ID NO: 134625 - DNA, 20 bp, human
ggcgctcaagaagccaagtg

SEQ ID NO: 134626 - DNA, 20 bp, human
gaacacggtcaggagggcta

SEQ ID NO: 134627 - DNA, 20 bp, human
gagcacaggtacatggagta

SEQ ID NO: 134628 - DNA, 20 bp, human
gacatgttcccgactcaccg

SEQ ID NO: 134629 - DNA, 20 bp, human
gaggagacgcataagagcac

SEQ ID NO: 134630 - DNA, 20 bp, human
ggcagtgaaagagtccaaag

SEQ ID NO: 134631 - DNA, 20 bp, human
gtcaccgtggcagttccgtc

SEQ ID NO: 134632 - DNA, 20 bp, human
gacttcaaggagtaaagcac

SEQ ID NO: 134633 - DNA, 20 bp, human
ggcataagagcacaggtaca

SEQ ID NO: 134634 - DNA, 20 bp, human
gggctagggcagctgaattc

SEQ ID NO: 134635 - DNA, 20 bp, human
ggtaatacagttgtaggtgg

SEQ ID NO: 134636 - DNA, 20 bp, human
gtccggtgggagggaacatc

SEQ ID NO: 134637 - DNA, 20 bp, human
gctgctgtgacgtacaggtg

SEQ ID NO: 134638 - DNA, 20 bp, human
ggctggacactcgatccggt

SEQ ID NO: 134639 - DNA, 20 bp, human
gatgaaggtaggccactggg

SEQ ID NO: 134640 - DNA, 20 bp, human
ggcaccccgagcatgaaggt

SEQ ID NO: 134641 - DNA, 20 bp, human
gtacgtcacagcagggggaa

SEQ ID NO: 134642 - DNA, 20 bp, human
gagggggaaaggagttgcaa

SEQ ID NO: 134643 - DNA, 20 bp, human
gctgcctgggagagtaggct

SEQ ID NO: 134644 - DNA, 20 bp, human
gttgggcaccccgagcatga

SEQ ID NO: 134645 - DNA, 20 bp, human
ggacactcgatccggtggga

SEQ ID NO: 134646 - DNA, 20 bp, human
gcccatgtgagcaggggatt

SEQ ID NO: 134647 - DNA, 20 bp, human
ggagaaggccgagggtccaa

SEQ ID NO: 134648 - DNA, 20 bp, human
gcctttggtgaggcagctag

SEQ ID NO: 134649 - DNA, 20 bp, human
ggggcagcccaggctacaag

SEQ ID NO: 134650 - DNA, 20 bp, human
gtggaagctctggtgcagca

SEQ ID NO: 134651 - DNA, 20 bp, human
gtggtgcagcatggtaagtc

SEQ ID NO: 134652 - DNA, 20 bp, human
ggtcaggagcccgggtcaca

SEQ ID NO: 134653 - DNA, 20 bp, human
gcaagagggacgtggcccag

SEQ ID NO: 134654 - DNA, 20 bp, human
gggactcaggggctccactg

SEQ ID NO: 134655 - DNA, 20 bp, human
gcagggctctcccttgaggt

SEQ ID NO: 134656 - DNA, 20 bp, human
gagcccaacacaagactgtc

SEQ ID NO: 134657 - DNA, 20 bp, human
gagcccataagactagtaag

SEQ ID NO: 134658 - DNA, 20 bp, human
gattgagttgcatcattgtg

SEQ ID NO: 134659 - DNA, 20 bp, human
gcacttagtattttatagtg

SEQ ID NO: 134660 - DNA, 20 bp, human
gtactttgcagagcataagg

SEQ ID NO: 134661 - DNA, 20 bp, human
gtgccacttactagtcttat

SEQ ID NO: 134662 - DNA, 20 bp, human
gttgccggacagtcttgtgt

SEQ ID NO: 134663 - DNA, 20 bp, human
gtgttctttggcacatcaag

SEQ ID NO: 134664 - DNA, 20 bp, human
gagcttagatgcttggaatt

SEQ ID NO: 134665 - DNA, 20 bp, human
gatttactttgcagagcata

SEQ ID NO: 134666 - DNA, 20 bp, human
gcactgcagcagtaacgtcg

SEQ ID NO: 134667 - DNA, 20 bp, human
gtgcagcgggcgaggagcga

SEQ ID NO: 134668 - DNA, 20 bp, human
gggtccgccgcctgcagcag

SEQ ID NO: 134669 - DNA, 20 bp, human
gccccgcgaccacaccccgg

SEQ ID NO: 134670 - DNA, 20 bp, human
ggtcgcggcgggttgcgggt

SEQ ID NO: 134671 - DNA, 20 bp, human
gccagaaacgaaggcagcag

SEQ ID NO: 134672 - DNA, 20 bp, human
gtgcagcagtaacgtcgcgg

SEQ ID NO: 134673 - DNA, 20 bp, human
gcgtttgggagactagccag

SEQ ID NO: 134674 - DNA, 20 bp, human
gagcgggcgaggagcgacgg

SEQ ID NO: 134675 - DNA, 20 bp, human
ggcgtcgcgtcgtcgtgcag

SEQ ID NO: 134676 - DNA, 20 bp, human
gccgcgcctgggtaagtatc

SEQ ID NO: 134677 - DNA, 20 bp, human
gccgcgctccggaagtgaag

SEQ ID NO: 134678 - DNA, 20 bp, human
gtcccgggccaccaaaggag

SEQ ID NO: 134679 - DNA, 20 bp, human
ggggcacgcggagtgaggac

SEQ ID NO: 134680 - DNA, 20 bp, human
gccgggcgccaggctactca

SEQ ID NO: 134681 - DNA, 20 bp, human
gcggccagaccaccagctaa

SEQ ID NO: 134682 - DNA, 20 bp, human
gagaggcagggactgatacg

SEQ ID NO: 134683 - DNA, 20 bp, human
gccaaagtggatgcacgaag

SEQ ID NO: 134684 - DNA, 20 bp, human
gtagcacaggcagggtggac

SEQ ID NO: 134685 - DNA, 20 bp, human
gcctgggtaagtatcgggca

SEQ ID NO: 134686 - DNA, 20 bp, human
gtccccagagggctctccgg

SEQ ID NO: 134687 - DNA, 20 bp, human
gccacgtgctgcgcgagcga

SEQ ID NO: 134688 - DNA, 20 bp, human
ggcagaggcgccgcacgggg

SEQ ID NO: 134689 - DNA, 20 bp, human
gcccgcagagaccccacggg

SEQ ID NO: 134690 - DNA, 20 bp, human
ggacgggggtcgggcacccc

SEQ ID NO: 134691 - DNA, 20 bp, human
gcagcctgtgaatgcgagca

SEQ ID NO: 134692 - DNA, 20 bp, human
gaaggtaacagacccacctg

SEQ ID NO: 134693 - DNA, 20 bp, human
gatgtgggcgtgcggagagg

SEQ ID NO: 134694 - DNA, 20 bp, human
gtcgccctgctcgcattcac

SEQ ID NO: 134695 - DNA, 20 bp, human
ggctctccgggggctatgcg

SEQ ID NO: 134696 - DNA, 20 bp, human
gcgtggcgcagtcagcacgg

SEQ ID NO: 134697 - DNA, 20 bp, human
ggaccaccacacgtctatgg

SEQ ID NO: 134698 - DNA, 20 bp, human
gccagctccgtacctgccgg

SEQ ID NO: 134699 - DNA, 20 bp, human
gtccggcttggaggcacctc

SEQ ID NO: 134700 - DNA, 20 bp, human
gcgcgaccaccacacgtcta

SEQ ID NO: 134701 - DNA, 20 bp, human
gtcgcgctgcgcgggaactc

SEQ ID NO: 134702 - DNA, 20 bp, human
gagccgccatagacgtgtgg

SEQ ID NO: 134703 - DNA, 20 bp, human
ggaggcacctccggcaggta

SEQ ID NO: 134704 - DNA, 20 bp, human
gccgcctccagggaaaccta

SEQ ID NO: 134705 - DNA, 20 bp, human
ggtgctgggtgtgatctagt

SEQ ID NO: 134706 - DNA, 20 bp, human
gccgctgctagaggcagaaa

SEQ ID NO: 134707 - DNA, 20 bp, human
gtaatcctgcaaggtgacaa

SEQ ID NO: 134708 - DNA, 20 bp, human
gccgctaacggcatcgagtc

SEQ ID NO: 134709 - DNA, 20 bp, human
gaccccggcgccgctgctag

SEQ ID NO: 134710 - DNA, 20 bp, human
gccggcccaggcgggtcacg

SEQ ID NO: 134711 - DNA, 20 bp, human
ggacgccccgtgacccgcct

SEQ ID NO: 134712 - DNA, 20 bp, human
gagcggcgagaagccgaggt

SEQ ID NO: 134713 - DNA, 20 bp, human
gcgcgctgcgacgccaacct

SEQ ID NO: 134714 - DNA, 20 bp, human
gtagtctatcaggtggacgt

SEQ ID NO: 134715 - DNA, 20 bp, human
gccaggccaaggagacgcag

SEQ ID NO: 134716 - DNA, 20 bp, human
ggcgagcgccaggcaagctg

SEQ ID NO: 134717 - DNA, 20 bp, human
gcagggtgcgcgctcagacg

SEQ ID NO: 134718 - DNA, 20 bp, human
ggcacctggagaggcgtggg

SEQ ID NO: 134719 - DNA, 20 bp, human
gcgcgtccacgtccaggctc

SEQ ID NO: 134720 - DNA, 20 bp, human
gcagcagggagcccgagata

SEQ ID NO: 134721 - DNA, 20 bp, human
gtggtcaccggcatcccgga

SEQ ID NO: 134722 - DNA, 20 bp, human
gcccaagatcagcgccaagg

SEQ ID NO: 134723 - DNA, 20 bp, human
gccggcaccagtcctgcaaa

SEQ ID NO: 134724 - DNA, 20 bp, human
ggacacaggcctgagtgact

SEQ ID NO: 134725 - DNA, 20 bp, human
ggtagcagccgcagcttgcc

SEQ ID NO: 134726 - DNA, 20 bp, human
gaggcgagcggggcactggg

SEQ ID NO: 134727 - DNA, 20 bp, human
ggcagaccgtagccccaatg

SEQ ID NO: 134728 - DNA, 20 bp, human
gggtcgggcggtagaaaaaa

SEQ ID NO: 134729 - DNA, 20 bp, human
ggcgggctgctgggcaaaag

SEQ ID NO: 134730 - DNA, 20 bp, human
gagggctgcgggagcaagta

SEQ ID NO: 134731 - DNA, 20 bp, human
gtgattcgaggtggagactg

SEQ ID NO: 134732 - DNA, 20 bp, human
gcgggctgcagacacaccgg

SEQ ID NO: 134733 - DNA, 20 bp, human
gcggtgagcgggggaaactg

SEQ ID NO: 134734 - DNA, 20 bp, human
ggagggacaagaggtcgtcg

SEQ ID NO: 134735 - DNA, 20 bp, human
gctggcccggggccgagtca

SEQ ID NO: 134736 - DNA, 20 bp, human
gggcgcggcatagcccggct

SEQ ID NO: 134737 - DNA, 20 bp, human
ggcctgccgcagggagaaga

SEQ ID NO: 134738 - DNA, 20 bp, human
gcggaactcggagctcggag

SEQ ID NO: 134739 - DNA, 20 bp, human
ggcagtccgggtcttctcac

SEQ ID NO: 134740 - DNA, 20 bp, human
ggagcgggaatcagcagtcc

SEQ ID NO: 134741 - DNA, 20 bp, human
gcttggcctgtgagaagacc

SEQ ID NO: 134742 - DNA, 20 bp, human
gtgtccgccggagcgggaag

SEQ ID NO: 134743 - DNA, 20 bp, human
gcagtctcaagcctgccgca

SEQ ID NO: 134744 - DNA, 20 bp, human
gtcggcggcgcggcatagcc

SEQ ID NO: 134745 - DNA, 20 bp, human
ggagcgaggcctgggtgcgc

SEQ ID NO: 134746 - DNA, 20 bp, human
gcagcgctttaagatttccg

SEQ ID NO: 134747 - DNA, 20 bp, human
ggcgctctgcgtttccattt

SEQ ID NO: 134748 - DNA, 20 bp, human
gcaggagcccgtccccacag

SEQ ID NO: 134749 - DNA, 20 bp, human
gggctatggagggacggtga

SEQ ID NO: 134750 - DNA, 20 bp, human
gcgacgggcgaagaaacgac

SEQ ID NO: 134751 - DNA, 20 bp, human
gcaactcagaaggctatgga

SEQ ID NO: 134752 - DNA, 20 bp, human
gtcagaaggctatggaggga

SEQ ID NO: 134753 - DNA, 20 bp, human
gcacagaggggtgggaagac

SEQ ID NO: 134754 - DNA, 20 bp, human
gggccgcatggacacagagg

SEQ ID NO: 134755 - DNA, 20 bp, human
ggctgcgcacgtgtttcagc

SEQ ID NO: 134756 - DNA, 20 bp, human
ggagcctcgcatccatcgga

SEQ ID NO: 134757 - DNA, 20 bp, human
gagaggaaaccctcatgagg

SEQ ID NO: 134758 - DNA, 20 bp, human
gcatccatcggagggagccg

SEQ ID NO: 134759 - DNA, 20 bp, human
ggcaccgcatctgagaggaa

SEQ ID NO: 134760 - DNA, 20 bp, human
gaaccgagcctcgcatccat

SEQ ID NO: 134761 - DNA, 20 bp, human
gagtccccggctccctccga

SEQ ID NO: 134762 - DNA, 20 bp, human
gctcaggtaggcaactgcac

SEQ ID NO: 134763 - DNA, 20 bp, human
gagtccagttagtcgcggtc

SEQ ID NO: 134764 - DNA, 20 bp, human
gagaccctggccccctcatg

SEQ ID NO: 134765 - DNA, 20 bp, human
gagggggtttgccttccacg

SEQ ID NO: 134766 - DNA, 20 bp, human
gggtgcatggagtccagagg

SEQ ID NO: 134767 - DNA, 20 bp, human
ggccgccacatgctctgggg

SEQ ID NO: 134768 - DNA, 20 bp, human
ggccgccccagagcatgtgg

SEQ ID NO: 134769 - DNA, 20 bp, human
gaagatacgggtgagaggag

SEQ ID NO: 134770 - DNA, 20 bp, human
gggtcatggccaggagctct

SEQ ID NO: 134771 - DNA, 20 bp, human
gggcttgtgggaggtcacat

SEQ ID NO: 134772 - DNA, 20 bp, human
gcccgactaaagatgtaaca

SEQ ID NO: 134773 - DNA, 20 bp, human
gtgcacacctgcaaagatac

SEQ ID NO: 134774 - DNA, 20 bp, human
gctgcaaagatacgggtgag

SEQ ID NO: 134775 - DNA, 20 bp, human
gtaacataggaagttaacac

SEQ ID NO: 134776 - DNA, 20 bp, human
gagaccatggagaacgggtg

SEQ ID NO: 134777 - DNA, 20 bp, human
gtcagttcagcatagcggag

SEQ ID NO: 134778 - DNA, 20 bp, human
gggatccgatcggatcggag

SEQ ID NO: 134779 - DNA, 20 bp, human
gcaactgtgcgaaccagacc

SEQ ID NO: 134780 - DNA, 20 bp, human
gggagcggatccgatcggat

SEQ ID NO: 134781 - DNA, 20 bp, human
gggagggagcgagcgcccag

SEQ ID NO: 134782 - DNA, 20 bp, human
gcttctcgatgagcctgctc

SEQ ID NO: 134783 - DNA, 20 bp, human
gcctagtgtcgggagcaagg

SEQ ID NO: 134784 - DNA, 20 bp, human
gcttgctcagttcagcatag

SEQ ID NO: 134785 - DNA, 20 bp, human
gtgtgtgttaggggaacaag

SEQ ID NO: 134786 - DNA, 20 bp, human
ggagctgcttctactaaggt

SEQ ID NO: 134787 - DNA, 20 bp, human
ggtgagtgcatgaatgtgag

SEQ ID NO: 134788 - DNA, 20 bp, human
gtgggaaccagtgtgtaact

SEQ ID NO: 134789 - DNA, 20 bp, human
ggagagatgtggattgtaaa

SEQ ID NO: 134790 - DNA, 20 bp, human
gtctctccccagttacacac

SEQ ID NO: 134791 - DNA, 20 bp, human
ggtggactgccctccaatgt

SEQ ID NO: 134792 - DNA, 20 bp, human
gatgtggattgtaaagggtg

SEQ ID NO: 134793 - DNA, 20 bp, human
gagccagggggagcccacat

SEQ ID NO: 134794 - DNA, 20 bp, human
gccatctttgacaactcagt

SEQ ID NO: 134795 - DNA, 20 bp, human
gctccaatgtgggctccccc

SEQ ID NO: 134796 - DNA, 20 bp, human
gcgagtcggtgggtaccgtg

SEQ ID NO: 134797 - DNA, 20 bp, human
gcggaccggaaccctcccca

SEQ ID NO: 134798 - DNA, 20 bp, human
gggcggccccagtcagacgc

SEQ ID NO: 134799 - DNA, 20 bp, human
gaacaggcagggccagaccc

SEQ ID NO: 134800 - DNA, 20 bp, human
ggcagccccaaagcctgaac

SEQ ID NO: 134801 - DNA, 20 bp, human
gccgctgcggctctagctcg

SEQ ID NO: 134802 - DNA, 20 bp, human
gggagctggtccctggacag

SEQ ID NO: 134803 - DNA, 20 bp, human
ggcgagcaggcggctcacag

SEQ ID NO: 134804 - DNA, 20 bp, human
gtccctggacagaggcgcac

SEQ ID NO: 134805 - DNA, 20 bp, human
gcccaaagcctgaacaggca

SEQ ID NO: 134806 - DNA, 20 bp, human
gtgccctggccgagacactg

SEQ ID NO: 134807 - DNA, 20 bp, human
gatcccgagggccccctccg

SEQ ID NO: 134808 - DNA, 20 bp, human
gtgcctcagtgtctcggcca

SEQ ID NO: 134809 - DNA, 20 bp, human
gccgcaggaagcatctgcct

SEQ ID NO: 134810 - DNA, 20 bp, human
gcgggcatcggacgcggaca

SEQ ID NO: 134811 - DNA, 20 bp, human
gtccgatgcccgctcctcca

SEQ ID NO: 134812 - DNA, 20 bp, human
gcagggtagagagcgcttgc

SEQ ID NO: 134813 - DNA, 20 bp, human
gcgtcgcgctgggaatgccc

SEQ ID NO: 134814 - DNA, 20 bp, human
ggcgggttaggatctgggtc

SEQ ID NO: 134815 - DNA, 20 bp, human
ggcagcgggtcgccccgacg

SEQ ID NO: 134816 - DNA, 20 bp, human
gcgtagcgcggccttggtgg

SEQ ID NO: 134817 - DNA, 20 bp, human
gattcagggaccccaagatg

SEQ ID NO: 134818 - DNA, 20 bp, human
gcgggtgcatcaggaacagg

SEQ ID NO: 134819 - DNA, 20 bp, human
gcaagatgaggcacattaca

SEQ ID NO: 134820 - DNA, 20 bp, human
ggagcgtagcgcggccttgg

SEQ ID NO: 134821 - DNA, 20 bp, human
gggagagcgtagcgcggcct

SEQ ID NO: 134822 - DNA, 20 bp, human
gaacagacgcgaagagggta

SEQ ID NO: 134823 - DNA, 20 bp, human
gggccgggtgcatcaggaac

SEQ ID NO: 134824 - DNA, 20 bp, human
gggattacaacgcctctcta

SEQ ID NO: 134825 - DNA, 20 bp, human
gagtccctttaaccagatgg

SEQ ID NO: 134826 - DNA, 20 bp, human
gcggggctgggcccaaatgt

SEQ ID NO: 134827 - DNA, 20 bp, human
gcgggatgcagccttggacg

SEQ ID NO: 134828 - DNA, 20 bp, human
gcactccgtgacccgggata

SEQ ID NO: 134829 - DNA, 20 bp, human
gcagcactcggtgttctcat

SEQ ID NO: 134830 - DNA, 20 bp, human
gtggaccgggcggggtgatc

SEQ ID NO: 134831 - DNA, 20 bp, human
gccgtgacccgggatagggc

SEQ ID NO: 134832 - DNA, 20 bp, human
gaggctgtgccgggggtaga

SEQ ID NO: 134833 - DNA, 20 bp, human
gagggcgcccgccgcatcta

SEQ ID NO: 134834 - DNA, 20 bp, human
gacctgggcgcccaccacgt

SEQ ID NO: 134835 - DNA, 20 bp, human
gtagggccgggatgcagcct

SEQ ID NO: 134836 - DNA, 20 bp, human
gctgcaggcaggtccccaca

SEQ ID NO: 134837 - DNA, 20 bp, human
gcagagggcagtgacccggg

SEQ ID NO: 134838 - DNA, 20 bp, human
gcaagcacctgagggacgaa

SEQ ID NO: 134839 - DNA, 20 bp, human
gactgggactccgggaccga

SEQ ID NO: 134840 - DNA, 20 bp, human
gtggttacgcctcccagcaa

SEQ ID NO: 134841 - DNA, 20 bp, human
gcccggatggcccccggtat

SEQ ID NO: 134842 - DNA, 20 bp, human
gaaatgcccgggtcccgagg

SEQ ID NO: 134843 - DNA, 20 bp, human
gtcccgaggcggcagagatg

SEQ ID NO: 134844 - DNA, 20 bp, human
gccagcaatggcgccaccat

SEQ ID NO: 134845 - DNA, 20 bp, human
gtgaagttatgggggctcta

SEQ ID NO: 134846 - DNA, 20 bp, human
ggacagcctgaagcaaacaa

SEQ ID NO: 134847 - DNA, 20 bp, human
gaggcgcgtctaacaagtgc

SEQ ID NO: 134848 - DNA, 20 bp, human
gccacaggtatgtaactcgg

SEQ ID NO: 134849 - DNA, 20 bp, human
gggcctcaggcaatgcccat

SEQ ID NO: 134850 - DNA, 20 bp, human
ggagaaagatgacagcccac

SEQ ID NO: 134851 - DNA, 20 bp, human
gtgggcattgttcacagcga

SEQ ID NO: 134852 - DNA, 20 bp, human
gccccccaactgggaaatcc

SEQ ID NO: 134853 - DNA, 20 bp, human
gttccgggacagccacgtga

SEQ ID NO: 134854 - DNA, 20 bp, human
gtcaggcgccaagaagccac

SEQ ID NO: 134855 - DNA, 20 bp, human
gactggctgtctgctgtgac

SEQ ID NO: 134856 - DNA, 20 bp, human
gatgcaggccgcagtcacta

SEQ ID NO: 134857 - DNA, 20 bp, human
ggcagtcactagggctgcag

SEQ ID NO: 134858 - DNA, 20 bp, human
gggagaacactacagtccag

SEQ ID NO: 134859 - DNA, 20 bp, human
ggagcttccaacacaaacac

SEQ ID NO: 134860 - DNA, 20 bp, human
gtcagctgatgcaggccggt

SEQ ID NO: 134861 - DNA, 20 bp, human
gggacctgcgaaaccaaata

SEQ ID NO: 134862 - DNA, 20 bp, human
gaacactacagtccagggga

SEQ ID NO: 134863 - DNA, 20 bp, human
gtggagtggacgtcattgcc

SEQ ID NO: 134864 - DNA, 20 bp, human
ggcggcgactcgctcgttcc

SEQ ID NO: 134865 - DNA, 20 bp, human
gcaatgacgtccactccaac

SEQ ID NO: 134866 - DNA, 20 bp, human
gcttctaccccggggaagga

SEQ ID NO: 134867 - DNA, 20 bp, human
gggggcgtcacggcgacgtt

SEQ ID NO: 134868 - DNA, 20 bp, human
gtccccggggtagaagtcca

SEQ ID NO: 134869 - DNA, 20 bp, human
gccggaactcctcccctggt

SEQ ID NO: 134870 - DNA, 20 bp, human
gggaggcctggccctagcgg

SEQ ID NO: 134871 - DNA, 20 bp, human
ggagtagtaggagcccctcg

SEQ ID NO: 134872 - DNA, 20 bp, human
ggttcgggcgacctgccgag

SEQ ID NO: 134873 - DNA, 20 bp, human
gcaccccccgtgggaaaagg

SEQ ID NO: 134874 - DNA, 20 bp, human
gcgcatgggtcccaggtcca

SEQ ID NO: 134875 - DNA, 20 bp, human
ggcagccagcacgtcatggg

SEQ ID NO: 134876 - DNA, 20 bp, human
gtgagtgcccgatcccgccg

SEQ ID NO: 134877 - DNA, 20 bp, human
gaggaaaggaccatcgctca

SEQ ID NO: 134878 - DNA, 20 bp, human
gctgcggagtgagccaatca

SEQ ID NO: 134879 - DNA, 20 bp, human
gtcaggtggacggacagagt

SEQ ID NO: 134880 - DNA, 20 bp, human
gtgcaggccgccatgacacc

SEQ ID NO: 134881 - DNA, 20 bp, human
gcgcgtgccgggtgtcatgg

SEQ ID NO: 134882 - DNA, 20 bp, human
gcccgccgtggcagaaggaa

SEQ ID NO: 134883 - DNA, 20 bp, human
gtcccggaaagtaaagagat

SEQ ID NO: 134884 - DNA, 20 bp, human
gcacgagcagcagtacctgc

SEQ ID NO: 134885 - DNA, 20 bp, human
gagatcggaagtcaggtgga

SEQ ID NO: 134886 - DNA, 20 bp, human
gggagagcctgagaagatcg

SEQ ID NO: 134887 - DNA, 20 bp, human
gaacatgactcgggcggtgg

SEQ ID NO: 134888 - DNA, 20 bp, human
gtcgcggaacatgactcggg

SEQ ID NO: 134889 - DNA, 20 bp, human
gagatcgcggaacatgactc

SEQ ID NO: 134890 - DNA, 20 bp, human
gtcgggcagcgccgaagaag

SEQ ID NO: 134891 - DNA, 20 bp, human
gagggccccaaagtaacctc

SEQ ID NO: 134892 - DNA, 20 bp, human
gcatgttccgcgatcttctc

SEQ ID NO: 134893 - DNA, 20 bp, human
ggaatgaagccagtgaagat

SEQ ID NO: 134894 - DNA, 20 bp, human
gcgtggcgggaggcactcct

SEQ ID NO: 134895 - DNA, 20 bp, human
gccacggcgaggctgcggtt

SEQ ID NO: 134896 - DNA, 20 bp, human
gtacaggctacaggactcag

SEQ ID NO: 134897 - DNA, 20 bp, human
gctgaaccgccttcacaggg

SEQ ID NO: 134898 - DNA, 20 bp, human
gaggcggttcagacacacgc

SEQ ID NO: 134899 - DNA, 20 bp, human
gtctaccgacaaaatggagt

SEQ ID NO: 134900 - DNA, 20 bp, human
gactggagggaaccgcgggg

SEQ ID NO: 134901 - DNA, 20 bp, human
gcaagcccttgtggcgtcgg

SEQ ID NO: 134902 - DNA, 20 bp, human
gctgcggctccggagagatg

SEQ ID NO: 134903 - DNA, 20 bp, human
ggcttgaagtcagtaagtag

SEQ ID NO: 134904 - DNA, 20 bp, human
ggcctcctccgacgccacaa

SEQ ID NO: 134905 - DNA, 20 bp, human
gggagaaaggactaagacac

SEQ ID NO: 134906 - DNA, 20 bp, human
gcgtcgtccggctactctaa

SEQ ID NO: 134907 - DNA, 20 bp, human
gtagcagtgggtggctgcgt

SEQ ID NO: 134908 - DNA, 20 bp, human
ggcagggcgcagccatggcg

SEQ ID NO: 134909 - DNA, 20 bp, human
ggaaactgaacgggccgcaa

SEQ ID NO: 134910 - DNA, 20 bp, human
gccacccactgctaaggacg

SEQ ID NO: 134911 - DNA, 20 bp, human
gcagccgagagcaactcccc

SEQ ID NO: 134912 - DNA, 20 bp, human
gtgtcccagcggggagactg

SEQ ID NO: 134913 - DNA, 20 bp, human
ggctaggatgcaaactatgg

SEQ ID NO: 134914 - DNA, 20 bp, human
gacgtggagaatggctagag

SEQ ID NO: 134915 - DNA, 20 bp, human
gctcgctaggatgcaaacta

SEQ ID NO: 134916 - DNA, 20 bp, human
gcggaaccgtctgcccagag

SEQ ID NO: 134917 - DNA, 20 bp, human
gctcccggtcactacaacaa

SEQ ID NO: 134918 - DNA, 20 bp, human
ggcccgcgggacaggctcca

SEQ ID NO: 134919 - DNA, 20 bp, human
gtccggagctccggaactcg

SEQ ID NO: 134920 - DNA, 20 bp, human
gaactcggggaagagcgtcc

SEQ ID NO: 134921 - DNA, 20 bp, human
ggatggcctcagccacggta

SEQ ID NO: 134922 - DNA, 20 bp, human
gcctcagccacggtaaggac

SEQ ID NO: 134923 - DNA, 20 bp, human
gcgcgggacaggctccaggg

SEQ ID NO: 134924 - DNA, 20 bp, human
ggatggcagagagtgagata

SEQ ID NO: 134925 - DNA, 20 bp, human
gccggtcactacaacaacgg

SEQ ID NO: 134926 - DNA, 20 bp, human
gcctgtaaagagaggacggg

SEQ ID NO: 134927 - DNA, 20 bp, human
gagccctgtaaagagaggac

SEQ ID NO: 134928 - DNA, 20 bp, human
ggatggcagagagtgagata

SEQ ID NO: 134929 - DNA, 20 bp, human
gacggacgccccgggacgag

SEQ ID NO: 134930 - DNA, 20 bp, human
gccgccagccctgtaaagag

SEQ ID NO: 134931 - DNA, 20 bp, human
gtgtgtggccacagctgacc

SEQ ID NO: 134932 - DNA, 20 bp, human
ggaggacgggaggtatgcgc

SEQ ID NO: 134933 - DNA, 20 bp, human
gcggaaccgtctgcccagag

SEQ ID NO: 134934 - DNA, 20 bp, human
ggcccgcgggacaggctcca

SEQ ID NO: 134935 - DNA, 20 bp, human
gggggctcaggacccggcta

SEQ ID NO: 134936 - DNA, 20 bp, human
gcaggttgccgtctaggtag

SEQ ID NO: 134937 - DNA, 20 bp, human
ggtagcggttgtgcttgctg

SEQ ID NO: 134938 - DNA, 20 bp, human
gcagctgcgacgcggctaag

SEQ ID NO: 134939 - DNA, 20 bp, human
gtgacactgcagctgcgacg

SEQ ID NO: 134940 - DNA, 20 bp, human
gaggctgggtcggaaggtga

SEQ ID NO: 134941 - DNA, 20 bp, human
gagcacaaccgctacctaga

SEQ ID NO: 134942 - DNA, 20 bp, human
gaactgtcaggttgccgtct

SEQ ID NO: 134943 - DNA, 20 bp, human
ggagcgattactgtcatcag

SEQ ID NO: 134944 - DNA, 20 bp, human
gcttcctgcacgcctcggag

SEQ ID NO: 134945 - DNA, 20 bp, human
gccctggcgaaagtagtgga

SEQ ID NO: 134946 - DNA, 20 bp, human
gggagcgcagctgagactgg

SEQ ID NO: 134947 - DNA, 20 bp, human
gggcaggtggaactgcgtag

SEQ ID NO: 134948 - DNA, 20 bp, human
ggcgcccagcttgacttgaa

SEQ ID NO: 134949 - DNA, 20 bp, human
ggtgcagggtcctacagagg

SEQ ID NO: 134950 - DNA, 20 bp, human
gcgcggagcgcagctgagac

SEQ ID NO: 134951 - DNA, 20 bp, human
gcgcaggggtcgcactccag

SEQ ID NO: 134952 - DNA, 20 bp, human
ggcgggcgacagggaatgtg

SEQ ID NO: 134953 - DNA, 20 bp, human
gggagcgcgttcggcctgtg

SEQ ID NO: 134954 - DNA, 20 bp, human
gtgggtgcagggtcctacag

SEQ ID NO: 134955 - DNA, 20 bp, human
gtctggaaagaatctgaggg

SEQ ID NO: 134956 - DNA, 20 bp, human
ggctcctgtccccataggat

SEQ ID NO: 134957 - DNA, 20 bp, human
gctgtggcataggctttgga

SEQ ID NO: 134958 - DNA, 20 bp, human
ggggcgtggcagcggtagtg

SEQ ID NO: 134959 - DNA, 20 bp, human
gcttcccacggcgtgtccca

SEQ ID NO: 134960 - DNA, 20 bp, human
gcaagagctgtctgtggcat

SEQ ID NO: 134961 - DNA, 20 bp, human
gctgcatgattcagagggcg

SEQ ID NO: 134962 - DNA, 20 bp, human
ggagctgctatggctgattc

SEQ ID NO: 134963 - DNA, 20 bp, human
gctctggaactcacaaaagc

SEQ ID NO: 134964 - DNA, 20 bp, human
gggcagacggcgagctgcta

SEQ ID NO: 134965 - DNA, 20 bp, human
gacacgccgtgggaaggggt

SEQ ID NO: 134966 - DNA, 20 bp, human
gcgcctgcccgtcctcccca

SEQ ID NO: 134967 - DNA, 20 bp, human
gcaagctctcccccaggtgg

SEQ ID NO: 134968 - DNA, 20 bp, human
gggctggccatggtaaggtg

SEQ ID NO: 134969 - DNA, 20 bp, human
ggcaggctcggccactgcgg

SEQ ID NO: 134970 - DNA, 20 bp, human
ggtcagggctggccatggta

SEQ ID NO: 134971 - DNA, 20 bp, human
gcaagaccctccccgaggag

SEQ ID NO: 134972 - DNA, 20 bp, human
gagcgcaggggacaggcccg

SEQ ID NO: 134973 - DNA, 20 bp, human
gcacgggagggtctgagggt

SEQ ID NO: 134974 - DNA, 20 bp, human
gcccaaagccccgggagaac

SEQ ID NO: 134975 - DNA, 20 bp, human
ggacgggcaggcggccggat

SEQ ID NO: 134976 - DNA, 20 bp, human
ggccagtggcagaggagcgg

SEQ ID NO: 134977 - DNA, 20 bp, human
gggctggggcgcagagccag

SEQ ID NO: 134978 - DNA, 20 bp, human
gatgggcacggtgggagtcc

SEQ ID NO: 134979 - DNA, 20 bp, human
gtgtgaccccggcggtgata

SEQ ID NO: 134980 - DNA, 20 bp, human
gcgtggatggtgcaaggtca

SEQ ID NO: 134981 - DNA, 20 bp, human
gggcacggtgggagtcccgg

SEQ ID NO: 134982 - DNA, 20 bp, human
ggctccgtgtgtgaccccgg

SEQ ID NO: 134983 - DNA, 20 bp, human
ggcggctgcggccccactgg

SEQ ID NO: 134984 - DNA, 20 bp, human
ggtccgggcggtaggagcgt

SEQ ID NO: 134985 - DNA, 20 bp, human
gtcaccgccggggtcacaca

SEQ ID NO: 134986 - DNA, 20 bp, human
ggcggcgacggctacaccat

SEQ ID NO: 134987 - DNA, 20 bp, human
gcccacgccgcggctctcag

SEQ ID NO: 134988 - DNA, 20 bp, human
ggcagcggcgaaagcagcgg

SEQ ID NO: 134989 - DNA, 20 bp, human
gcgacggctacaccatgggc

SEQ ID NO: 134990 - DNA, 20 bp, human
gtgtgtgcctgcgcactcgg

SEQ ID NO: 134991 - DNA, 20 bp, human
gcgggggggcgcgcacgtgt

SEQ ID NO: 134992 - DNA, 20 bp, human
ggccgggcgacccccgacaa

SEQ ID NO: 134993 - DNA, 20 bp, human
gacacacgcgcacgaggagt

SEQ ID NO: 134994 - DNA, 20 bp, human
gctccccgggccgccaacaa

SEQ ID NO: 134995 - DNA, 20 bp, human
gctctcaggggcaggtgcgc

SEQ ID NO: 134996 - DNA, 20 bp, human
ggcaggtctggcagctacag

SEQ ID NO: 134997 - DNA, 20 bp, human
gctcttcccggcaccactat

SEQ ID NO: 134998 - DNA, 20 bp, human
ggcagcagcaagagcaggtc

SEQ ID NO: 134999 - DNA, 20 bp, human
ggcgagtgaggacctacagt

SEQ ID NO: 135000 - DNA, 20 bp, human
gccggcaccactattggcag

SEQ ID NO: 135001 - DNA, 20 bp, human
gttggaccccttcaactcac

SEQ ID NO: 135002 - DNA, 20 bp, human
gtcaaaacctctgccaatag

SEQ ID NO: 135003 - DNA, 20 bp, human
ggcacttcccgtgagttgaa

SEQ ID NO: 135004 - DNA, 20 bp, human
ggtttggagcgaccattctc

SEQ ID NO: 135005 - DNA, 20 bp, human
gctggcactgcagcacctct

SEQ ID NO: 135006 - DNA, 20 bp, human
gcgggttcccgggccgacat

SEQ ID NO: 135007 - DNA, 20 bp, human
gcagccgcggcgcacagtcg

SEQ ID NO: 135008 - DNA, 20 bp, human
gccgcaggcatccccgggag

SEQ ID NO: 135009 - DNA, 20 bp, human
gagcggccgtgcccacgcgg

SEQ ID NO: 135010 - DNA, 20 bp, human
gggaggccttacccatgcag

SEQ ID NO: 135011 - DNA, 20 bp, human
gcagtccagggtccagtaaa

SEQ ID NO: 135012 - DNA, 20 bp, human
gaatcaccaggagccagcgt

SEQ ID NO: 135013 - DNA, 20 bp, human
gccagtaaatggagttagtg

SEQ ID NO: 135014 - DNA, 20 bp, human
gcgcggcgcacagtcgggga

SEQ ID NO: 135015 - DNA, 20 bp, human
gtctgggcgcatctgaggag

SEQ ID NO: 135016 - DNA, 20 bp, human
ggtgtcgccatggccccggg

SEQ ID NO: 135017 - DNA, 20 bp, human
gccgggcagggtcagaggat

SEQ ID NO: 135018 - DNA, 20 bp, human
gggcaggcccacgggatgga

SEQ ID NO: 135019 - DNA, 20 bp, human
gtgagtgtcgccatggcccc

SEQ ID NO: 135020 - DNA, 20 bp, human
ggaggcagaagccggaggcc

SEQ ID NO: 135021 - DNA, 20 bp, human
gggaccaccctccatcccgt

SEQ ID NO: 135022 - DNA, 20 bp, human
gggcggccacgcacttccgg

SEQ ID NO: 135023 - DNA, 20 bp, human
gacgctggggttccaggacc

SEQ ID NO: 135024 - DNA, 20 bp, human
gacgaagctgagtgtcgcca

SEQ ID NO: 135025 - DNA, 20 bp, human
gggaatggagcggagttatg

SEQ ID NO: 135026 - DNA, 20 bp, human
gcgcgcacgggaggacggag

SEQ ID NO: 135027 - DNA, 20 bp, human
ggaggggccgcgcgcacggg

SEQ ID NO: 135028 - DNA, 20 bp, human
gagcggggaggacacgtggt

SEQ ID NO: 135029 - DNA, 20 bp, human
gcccggcgggcccgcaacaa

SEQ ID NO: 135030 - DNA, 20 bp, human
gcgctaaggtgccgcaacca

SEQ ID NO: 135031 - DNA, 20 bp, human
ggggcccgcaacaaaggcgg

SEQ ID NO: 135032 - DNA, 20 bp, human
gggtctccctgccggctccg

SEQ ID NO: 135033 - DNA, 20 bp, human
ggaaatccgaacgcgcccgg

SEQ ID NO: 135034 - DNA, 20 bp, human
ggcgcggttccgcggagaaa

SEQ ID NO: 135035 - DNA, 20 bp, human
gcccgcaacaaaggcggcgg

SEQ ID NO: 135036 - DNA, 20 bp, human
gctgccggcgatggagtggt

SEQ ID NO: 135037 - DNA, 20 bp, human
gaggtctgccggcgatggag

SEQ ID NO: 135038 - DNA, 20 bp, human
gacagcagccagagccgaag

SEQ ID NO: 135039 - DNA, 20 bp, human
ggaatctgcagtaggtctgc

SEQ ID NO: 135040 - DNA, 20 bp, human
ggtccagagtagccaagcac

SEQ ID NO: 135041 - DNA, 20 bp, human
gacctgcctgaaacactgag

SEQ ID NO: 135042 - DNA, 20 bp, human
gtagcccaccactccatcgc

SEQ ID NO: 135043 - DNA, 20 bp, human
ggcccagctccgagctacag

SEQ ID NO: 135044 - DNA, 20 bp, human
gtagctcgccgcttcggctc

SEQ ID NO: 135045 - DNA, 20 bp, human
ggccagaccccgagcccaag

SEQ ID NO: 135046 - DNA, 20 bp, human
gcgagacaatgagaggggga

SEQ ID NO: 135047 - DNA, 20 bp, human
gcttcctcgggtcagactac

SEQ ID NO: 135048 - DNA, 20 bp, human
gcgctcggcgaggcgttcag

SEQ ID NO: 135049 - DNA, 20 bp, human
gggaatgcggctccgtgtac

SEQ ID NO: 135050 - DNA, 20 bp, human
gctcgccccgcggagggata

SEQ ID NO: 135051 - DNA, 20 bp, human
gccgcgccagctcccgtaca

SEQ ID NO: 135052 - DNA, 20 bp, human
gacggaacccccgggagcag

SEQ ID NO: 135053 - DNA, 20 bp, human
gtcgccgagcgaaaagataa

SEQ ID NO: 135054 - DNA, 20 bp, human
gtcagaggcgagacaatgag

SEQ ID NO: 135055 - DNA, 20 bp, human
gcctcgggtcagactaccgg

SEQ ID NO: 135056 - DNA, 20 bp, human
gcgcagaccttggtcgtccc

SEQ ID NO: 135057 - DNA, 20 bp, human
gccttggtcgtccccggcgg

SEQ ID NO: 135058 - DNA, 20 bp, human
gcgactgtggagactctcag

SEQ ID NO: 135059 - DNA, 20 bp, human
gatcgggagattcgggacca

SEQ ID NO: 135060 - DNA, 20 bp, human
gtattgagactggccccgtg

SEQ ID NO: 135061 - DNA, 20 bp, human
gggcgacgactgtgagatag

SEQ ID NO: 135062 - DNA, 20 bp, human
ggcgcggaatcgggagattc

SEQ ID NO: 135063 - DNA, 20 bp, human
gtcgccgtgcacaggtgcca

SEQ ID NO: 135064 - DNA, 20 bp, human
gggctggttggcgcggaatc

SEQ ID NO: 135065 - DNA, 20 bp, human
gcagcccaaaactggcgcgg

SEQ ID NO: 135066 - DNA, 20 bp, human
ggaagcaggacgttctcacc

SEQ ID NO: 135067 - DNA, 20 bp, human
ggtggggttccggaatgagc

SEQ ID NO: 135068 - DNA, 20 bp, human
gtctaggcgccgaggaactc

SEQ ID NO: 135069 - DNA, 20 bp, human
gagggagcagaaatctcgag

SEQ ID NO: 135070 - DNA, 20 bp, human
gtcccaaacgccctgaatgg

SEQ ID NO: 135071 - DNA, 20 bp, human
gttcggcctagactgcgagg

SEQ ID NO: 135072 - DNA, 20 bp, human
gtctcgagaggacgctctcc

SEQ ID NO: 135073 - DNA, 20 bp, human
gctccgcggaccgtgacagg

SEQ ID NO: 135074 - DNA, 20 bp, human
gcggaggagctgcagatctt

SEQ ID NO: 135075 - DNA, 20 bp, human
gacatggtcgcccaagccag

SEQ ID NO: 135076 - DNA, 20 bp, human
ggcgccccgccccccatcgg

SEQ ID NO: 135077 - DNA, 20 bp, human
gccctctcccagcttgaagg

SEQ ID NO: 135078 - DNA, 20 bp, human
gggcgcgaccggcggaacaa

SEQ ID NO: 135079 - DNA, 20 bp, human
gggtaccaggacttggagac

SEQ ID NO: 135080 - DNA, 20 bp, human
gccagctccggcgcgaccgg

SEQ ID NO: 135081 - DNA, 20 bp, human
gggtggtcactgtctcttag

SEQ ID NO: 135082 - DNA, 20 bp, human
gaacccagctccggcgcgac

SEQ ID NO: 135083 - DNA, 20 bp, human
gtacacctgggccatcgctt

SEQ ID NO: 135084 - DNA, 20 bp, human
gccagcttgaaggaggtacc

SEQ ID NO: 135085 - DNA, 20 bp, human
gcgccggagggagatcccca

SEQ ID NO: 135086 - DNA, 20 bp, human
gttgaagcgggtgagtagag

SEQ ID NO: 135087 - DNA, 20 bp, human
gcgggaaacgctgtttgaag

SEQ ID NO: 135088 - DNA, 20 bp, human
gttgcgcgcgcgggagtcag

SEQ ID NO: 135089 - DNA, 20 bp, human
gcctgtctcgggaagacaga

SEQ ID NO: 135090 - DNA, 20 bp, human
ggtgggcctggtagggaacg

SEQ ID NO: 135091 - DNA, 20 bp, human
gaggggaaaaagggagttcg

SEQ ID NO: 135092 - DNA, 20 bp, human
gacggcggcgtaggctgtgg

SEQ ID NO: 135093 - DNA, 20 bp, human
gtcagtaaagcagtgctctg

SEQ ID NO: 135094 - DNA, 20 bp, human
gcccgggggcgcgcaggaga

SEQ ID NO: 135095 - DNA, 20 bp, human
ggctgtgagatgctctcaga

SEQ ID NO: 135096 - DNA, 20 bp, human
gcagccaggccgcgctactc

SEQ ID NO: 135097 - DNA, 20 bp, human
ggctcgaacgtgcttgatgg

SEQ ID NO: 135098 - DNA, 20 bp, human
ggcgcggtgagtggggtcca

SEQ ID NO: 135099 - DNA, 20 bp, human
gggcgcgccgcgcggtgagt

SEQ ID NO: 135100 - DNA, 20 bp, human
ggggaaacggggtcagctgg

SEQ ID NO: 135101 - DNA, 20 bp, human
ggcaggcgcgcggggattgg

SEQ ID NO: 135102 - DNA, 20 bp, human
ggagtggggtccagggaaac

SEQ ID NO: 135103 - DNA, 20 bp, human
gaggccgcgctactcgggat

SEQ ID NO: 135104 - DNA, 20 bp, human
gcgcggggattggcgggatg

SEQ ID NO: 135105 - DNA, 20 bp, human
gagcgagttgcggcgatggg

SEQ ID NO: 135106 - DNA, 20 bp, human
gcaacggaggcgacgcacta

SEQ ID NO: 135107 - DNA, 20 bp, human
ggagcaaagacgtttcccgc

SEQ ID NO: 135108 - DNA, 20 bp, human
gaagctggtccgccatggtg

SEQ ID NO: 135109 - DNA, 20 bp, human
gcagcgctgccgcaccatgg

SEQ ID NO: 135110 - DNA, 20 bp, human
gccgttggctgagagttcta

SEQ ID NO: 135111 - DNA, 20 bp, human
gtgagagaggggttagaggc

SEQ ID NO: 135112 - DNA, 20 bp, human
gtcccagcgctgccgcacca

SEQ ID NO: 135113 - DNA, 20 bp, human
gagataaagctggtccgcca

SEQ ID NO: 135114 - DNA, 20 bp, human
gcctccgcgcccggtctccg

SEQ ID NO: 135115 - DNA, 20 bp, human
gctgtggctgtgattgagag

SEQ ID NO: 135116 - DNA, 20 bp, human
gagaggagagaccggccagt

SEQ ID NO: 135117 - DNA, 20 bp, human
gaccaggtctagctgcgggg

SEQ ID NO: 135118 - DNA, 20 bp, human
gctagaggaggcccctagag

SEQ ID NO: 135119 - DNA, 20 bp, human
gcacccgagctaggtctctg

SEQ ID NO: 135120 - DNA, 20 bp, human
gtctagctgcggggtggcag

SEQ ID NO: 135121 - DNA, 20 bp, human
ggagccccagccccgcgacg

SEQ ID NO: 135122 - DNA, 20 bp, human
gggcccgctgggcacagcaa

SEQ ID NO: 135123 - DNA, 20 bp, human
ggacccagacaaaccgagag

SEQ ID NO: 135124 - DNA, 20 bp, human
gctagacctggtgtcgggag

SEQ ID NO: 135125 - DNA, 20 bp, human
gccccggcgacttcctctct

SEQ ID NO: 135126 - DNA, 20 bp, human
gctctgtgtcagcagccggg

SEQ ID NO: 135127 - DNA, 20 bp, human
gggtgactggagtttgaccc

SEQ ID NO: 135128 - DNA, 20 bp, human
gggccagccctgtacaacca

SEQ ID NO: 135129 - DNA, 20 bp, human
gcagcgaccgggaccaccag

SEQ ID NO: 135130 - DNA, 20 bp, human
gtgtcccagacagcgcaggt

SEQ ID NO: 135131 - DNA, 20 bp, human
ggtcgaccacgacgacgcgg

SEQ ID NO: 135132 - DNA, 20 bp, human
gcagagcccgacccgcggcc

SEQ ID NO: 135133 - DNA, 20 bp, human
gggtaacctgttccccccca

SEQ ID NO: 135134 - DNA, 20 bp, human
gagcagccgggcgggcgctc

SEQ ID NO: 135135 - DNA, 20 bp, human
ggaaccgcccggccgcgggt

SEQ ID NO: 135136 - DNA, 20 bp, human
gcagcgccgagatcacggag

SEQ ID NO: 135137 - DNA, 20 bp, human
gctcatcaggaagcgcgggg

SEQ ID NO: 135138 - DNA, 20 bp, human
gccaggcagcgccgagatca

SEQ ID NO: 135139 - DNA, 20 bp, human
gaagatggcggacatctccc

SEQ ID NO: 135140 - DNA, 20 bp, human
ggcccctcaggtccacgagg

SEQ ID NO: 135141 - DNA, 20 bp, human
ggccgcctcgtggacctgag

SEQ ID NO: 135142 - DNA, 20 bp, human
gtctaagatgggtggagacc

SEQ ID NO: 135143 - DNA, 20 bp, human
gctccctggacgaactcatc

SEQ ID NO: 135144 - DNA, 20 bp, human
gcttgctcggcggagcaaga

SEQ ID NO: 135145 - DNA, 20 bp, human
gttcctgatgagttcgtcca

SEQ ID NO: 135146 - DNA, 20 bp, human
gggctctcgcgagtctgggt

SEQ ID NO: 135147 - DNA, 20 bp, human
gccccgagcccctccgtcgg

SEQ ID NO: 135148 - DNA, 20 bp, human
gctcagagacatggagccgt

SEQ ID NO: 135149 - DNA, 20 bp, human
ggctaccacctctgcttcag

SEQ ID NO: 135150 - DNA, 20 bp, human
ggcgccgccctaccccagtc

SEQ ID NO: 135151 - DNA, 20 bp, human
gacccgggccaggccctgcg

SEQ ID NO: 135152 - DNA, 20 bp, human
gcactcgccgcgcctgactg

SEQ ID NO: 135153 - DNA, 20 bp, human
ggagcgcgcctcttgatgga

SEQ ID NO: 135154 - DNA, 20 bp, human
ggccgcgcctgactggggta

SEQ ID NO: 135155 - DNA, 20 bp, human
gccgccccgagcccctccgt

SEQ ID NO: 135156 - DNA, 20 bp, human
gtgggctcgggcagcttgaa

SEQ ID NO: 135157 - DNA, 20 bp, human
gggcagcttgaagggcgaga

SEQ ID NO: 135158 - DNA, 20 bp, human
gtgctgctccgtgggtgagt

SEQ ID NO: 135159 - DNA, 20 bp, human
gtatggcgccggagcggctg

SEQ ID NO: 135160 - DNA, 20 bp, human
gcgcaaatatggcgccggag

SEQ ID NO: 135161 - DNA, 20 bp, human
gtggcgccaaatcgcaaata

SEQ ID NO: 135162 - DNA, 20 bp, human
gagcaagccccgcaacttga

SEQ ID NO: 135163 - DNA, 20 bp, human
gctccccgcgcgccgagagg

SEQ ID NO: 135164 - DNA, 20 bp, human
gtctccgccttcaagttgcg

SEQ ID NO: 135165 - DNA, 20 bp, human
gcttgaaggcggagagcgcc

SEQ ID NO: 135166 - DNA, 20 bp, human
gggcggacgaacgggcagga

SEQ ID NO: 135167 - DNA, 20 bp, human
gacgcagtagctccctgaag

SEQ ID NO: 135168 - DNA, 20 bp, human
gcgtagcgacgcgggaagtc

SEQ ID NO: 135169 - DNA, 20 bp, human
ggccccagcggcggcaatgg

SEQ ID NO: 135170 - DNA, 20 bp, human
gccctgaagcggaggcgaag

SEQ ID NO: 135171 - DNA, 20 bp, human
gatcctggtgagcgggacag

SEQ ID NO: 135172 - DNA, 20 bp, human
gcagtagctccctgaagcgg

SEQ ID NO: 135173 - DNA, 20 bp, human
gtaagccccagcggcggcaa

SEQ ID NO: 135174 - DNA, 20 bp, human
ggggagctgcgaggagaccg

SEQ ID NO: 135175 - DNA, 20 bp, human
gggtcagaccgtagcgacgc

SEQ ID NO: 135176 - DNA, 20 bp, human
ggcagcgcactgccgcgtag

SEQ ID NO: 135177 - DNA, 20 bp, human
gcgcgcgcctacacagggtg

SEQ ID NO: 135178 - DNA, 20 bp, human
gcaggtcctcaacaagaggg

SEQ ID NO: 135179 - DNA, 20 bp, human
gagcacgctcaaggccggga

SEQ ID NO: 135180 - DNA, 20 bp, human
gagcgggacgccccgagagg

SEQ ID NO: 135181 - DNA, 20 bp, human
gctcaaggccgggatggcgg

SEQ ID NO: 135182 - DNA, 20 bp, human
gggaagcgggacgccccgag

SEQ ID NO: 135183 - DNA, 20 bp, human
gatgtgggcgtggacccgga

SEQ ID NO: 135184 - DNA, 20 bp, human
gcatgcgcgcgcacagtcgg

SEQ ID NO: 135185 - DNA, 20 bp, human
gcaggtccctcctcctctcg

SEQ ID NO: 135186 - DNA, 20 bp, human
ggtagcgtgtggcctccacc

SEQ ID NO: 135187 - DNA, 20 bp, human
gcctcgctccctgactggag

SEQ ID NO: 135188 - DNA, 20 bp, human
ggaggccacacgctaccccg

SEQ ID NO: 135189 - DNA, 20 bp, human
ggcaagcgctcggcaaatgg

SEQ ID NO: 135190 - DNA, 20 bp, human
gggctgccagcgaagcggac

SEQ ID NO: 135191 - DNA, 20 bp, human
ggggtgcagacgggaagttg

SEQ ID NO: 135192 - DNA, 20 bp, human
gggattcgaacccgcagggt

SEQ ID NO: 135193 - DNA, 20 bp, human
ggtgtgggtgtgggtcccgg

SEQ ID NO: 135194 - DNA, 20 bp, human
ggtagccgcgggacctagct

SEQ ID NO: 135195 - DNA, 20 bp, human
gggtcccgcggctacccgag

SEQ ID NO: 135196 - DNA, 20 bp, human
gattctgttaacggtagtgg

SEQ ID NO: 135197 - DNA, 20 bp, human
gcctctccggattctgttaa

SEQ ID NO: 135198 - DNA, 20 bp, human
ggcagaatggtggacctcgg

SEQ ID NO: 135199 - DNA, 20 bp, human
gcggattctgttaacggtag

SEQ ID NO: 135200 - DNA, 20 bp, human
gaaggagtagccccaaagga

SEQ ID NO: 135201 - DNA, 20 bp, human
ggtagagttgcggaagaacc

SEQ ID NO: 135202 - DNA, 20 bp, human
gttgggatccgttgagtgat

SEQ ID NO: 135203 - DNA, 20 bp, human
ggtcgcacgcggagctcgag

SEQ ID NO: 135204 - DNA, 20 bp, human
ggaatggtggacctcggtgg

SEQ ID NO: 135205 - DNA, 20 bp, human
gacggtagtggtggcttgtt

SEQ ID NO: 135206 - DNA, 20 bp, human
gagcagggatcagacgagag

SEQ ID NO: 135207 - DNA, 20 bp, human
gcaatgcagccgccagactg

SEQ ID NO: 135208 - DNA, 20 bp, human
gcgtcaacggcccttcgcag

SEQ ID NO: 135209 - DNA, 20 bp, human
gaaccgagaagggatcgtaa

SEQ ID NO: 135210 - DNA, 20 bp, human
ggtctggcggctgcattgct

SEQ ID NO: 135211 - DNA, 20 bp, human
gacgacggagaaaccgagaa

SEQ ID NO: 135212 - DNA, 20 bp, human
gatcttagaagacagtacca

SEQ ID NO: 135213 - DNA, 20 bp, human
gtgtagcagtgactgggcca

SEQ ID NO: 135214 - DNA, 20 bp, human
gcactggaccgctcctagaa

SEQ ID NO: 135215 - DNA, 20 bp, human
gtaccaaggtaacaaacacc

SEQ ID NO: 135216 - DNA, 20 bp, human
gacgcggcgggtacctctag

SEQ ID NO: 135217 - DNA, 20 bp, human
gatggaactggcggacgtgg

SEQ ID NO: 135218 - DNA, 20 bp, human
gaagctgggggtggagccgg

SEQ ID NO: 135219 - DNA, 20 bp, human
ggacgacgaggaagacgccg

SEQ ID NO: 135220 - DNA, 20 bp, human
gcctgccaggactgagatcc

SEQ ID NO: 135221 - DNA, 20 bp, human
ggtacccgccgcgtaacaca

SEQ ID NO: 135222 - DNA, 20 bp, human
ggtagcgctgcggttggcag

SEQ ID NO: 135223 - DNA, 20 bp, human
gagcccgacgaaaactgcag

SEQ ID NO: 135224 - DNA, 20 bp, human
gggatggctcagaacctagg

SEQ ID NO: 135225 - DNA, 20 bp, human
gcccacctcgcccctcacag

SEQ ID NO: 135226 - DNA, 20 bp, human
gccgactgacaaggccccaa

SEQ ID NO: 135227 - DNA, 20 bp, human
gggacaagcgatccccgcgc

SEQ ID NO: 135228 - DNA, 20 bp, human
ggcccacccaccgactgaca

SEQ ID NO: 135229 - DNA, 20 bp, human
gagtcgcgatcctgaggtaa

SEQ ID NO: 135230 - DNA, 20 bp, human
gccgcttccgcctcaaccat

SEQ ID NO: 135231 - DNA, 20 bp, human
ggatactcacccgttacctc

SEQ ID NO: 135232 - DNA, 20 bp, human
gaacgggtgagtatcccgcg

SEQ ID NO: 135233 - DNA, 20 bp, human
ggtcgctcgcgcagcctcct

SEQ ID NO: 135234 - DNA, 20 bp, human
ggcaggcccgtcatcttcag

SEQ ID NO: 135235 - DNA, 20 bp, human
gagttgtagtcgcgatcctg

SEQ ID NO: 135236 - DNA, 20 bp, human
gagactcttggggccggggt

SEQ ID NO: 135237 - DNA, 20 bp, human
gggccaagctagtcacccgg

SEQ ID NO: 135238 - DNA, 20 bp, human
gccagagtcggtccccgggt

SEQ ID NO: 135239 - DNA, 20 bp, human
gctccaacacagactcgcag

SEQ ID NO: 135240 - DNA, 20 bp, human
gaagctagtcacccgggggt

SEQ ID NO: 135241 - DNA, 20 bp, human
gacagactcgcagaggaagg

SEQ ID NO: 135242 - DNA, 20 bp, human
ggaaggaggaggactttcgg

SEQ ID NO: 135243 - DNA, 20 bp, human
gggtagagaaatagtatgtg

SEQ ID NO: 135244 - DNA, 20 bp, human
gccgcagctgcggggagatg

SEQ ID NO: 135245 - DNA, 20 bp, human
gtgctgcggcccacttcgaa

SEQ ID NO: 135246 - DNA, 20 bp, human
gcagcgcggagcgaacgcag

SEQ ID NO: 135247 - DNA, 20 bp, human
gagggaaactccgagcgaga

SEQ ID NO: 135248 - DNA, 20 bp, human
gaaactccgagcgagacgga

SEQ ID NO: 135249 - DNA, 20 bp, human
gcccaatgctccccaaacgg

SEQ ID NO: 135250 - DNA, 20 bp, human
gctgcgagaatcaaaaccag

SEQ ID NO: 135251 - DNA, 20 bp, human
ggttcgctccgcgctgctgg

SEQ ID NO: 135252 - DNA, 20 bp, human
gcaggcctggcgcgctccaa

SEQ ID NO: 135253 - DNA, 20 bp, human
gacctggtcgagcctcgcat

SEQ ID NO: 135254 - DNA, 20 bp, human
gaatcaaaaccagaggtcag

SEQ ID NO: 135255 - DNA, 20 bp, human
gccagtgaggctgacggaag

SEQ ID NO: 135256 - DNA, 20 bp, human
ggcaggcggcacatcactct

SEQ ID NO: 135257 - DNA, 20 bp, human
gtcccgctggaaaagctgta

SEQ ID NO: 135258 - DNA, 20 bp, human
gccacccccaggcggcccag

SEQ ID NO: 135259 - DNA, 20 bp, human
ggttggactggctccaaggt

SEQ ID NO: 135260 - DNA, 20 bp, human
gtggccagcggtggctcttg

SEQ ID NO: 135261 - DNA, 20 bp, human
gcaccccaaggagggtcagg

SEQ ID NO: 135262 - DNA, 20 bp, human
gcaaggagggtcaggaggcg

SEQ ID NO: 135263 - DNA, 20 bp, human
gcgtggctgagaccatccgg

SEQ ID NO: 135264 - DNA, 20 bp, human
ggaagggattgtcctcagca

SEQ ID NO: 135265 - DNA, 20 bp, human
gcagtggcattggccagcgg

SEQ ID NO: 135266 - DNA, 20 bp, human
gggcccgcgtcagtcacctc

SEQ ID NO: 135267 - DNA, 20 bp, human
gcgcgcctcgcactgcctca

SEQ ID NO: 135268 - DNA, 20 bp, human
gagggccgcgcgaaccccag

SEQ ID NO: 135269 - DNA, 20 bp, human
gggctcctgcgagaagcaag

SEQ ID NO: 135270 - DNA, 20 bp, human
ggcgtccaggcgctcccgtg

SEQ ID NO: 135271 - DNA, 20 bp, human
gcggccttcagccagcgctg

SEQ ID NO: 135272 - DNA, 20 bp, human
gggcaagccccagggatccg

SEQ ID NO: 135273 - DNA, 20 bp, human
ggaggcagcggcaagcccca

SEQ ID NO: 135274 - DNA, 20 bp, human
ggatacaccagacgcgccag

SEQ ID NO: 135275 - DNA, 20 bp, human
gttggggccgcggatccctg

SEQ ID NO: 135276 - DNA, 20 bp, human
gcagggttctcccgagaggg

SEQ ID NO: 135277 - DNA, 20 bp, human
gggccagggttctcccgaga

SEQ ID NO: 135278 - DNA, 20 bp, human
ggtcccagcgtcctccctct

SEQ ID NO: 135279 - DNA, 20 bp, human
gaggccccagtcacagagaa

SEQ ID NO: 135280 - DNA, 20 bp, human
gtaagccacggagaactcta

SEQ ID NO: 135281 - DNA, 20 bp, human
gaactcttctcggccgatca

SEQ ID NO: 135282 - DNA, 20 bp, human
gggggagtagaagcccaatg

SEQ ID NO: 135283 - DNA, 20 bp, human
ggaggtttgagtttgaagac

SEQ ID NO: 135284 - DNA, 20 bp, human
ggggaggccgcgggcaacgg

SEQ ID NO: 135285 - DNA, 20 bp, human
gtcccgagagggaggacgct

SEQ ID NO: 135286 - DNA, 20 bp, human
gtgaatcgcgtggtgactcc

SEQ ID NO: 135287 - DNA, 20 bp, human
ggtgcgcttgcgcgcggaag

SEQ ID NO: 135288 - DNA, 20 bp, human
gccagcctggatcttgaggt

SEQ ID NO: 135289 - DNA, 20 bp, human
gaagaggccggtggtgctgg

SEQ ID NO: 135290 - DNA, 20 bp, human
gagacaagcctggactcaag

SEQ ID NO: 135291 - DNA, 20 bp, human
gggtaggggaatataagggt

SEQ ID NO: 135292 - DNA, 20 bp, human
gggcgccgacctcaagatcc

SEQ ID NO: 135293 - DNA, 20 bp, human
gcgtggactgcctggataag

SEQ ID NO: 135294 - DNA, 20 bp, human
ggtgagtggaacgtctcttg

SEQ ID NO: 135295 - DNA, 20 bp, human
ggactgcctggataagaggc

SEQ ID NO: 135296 - DNA, 20 bp, human
gcaggtggccacatggatcc

SEQ ID NO: 135297 - DNA, 20 bp, human
gcgcggcgaggccaatccca

SEQ ID NO: 135298 - DNA, 20 bp, human
gggcgaggccaatcccaggg

SEQ ID NO: 135299 - DNA, 20 bp, human
ggctgggcaggttccgccac

SEQ ID NO: 135300 - DNA, 20 bp, human
gttcgtgagacttggagtcg

SEQ ID NO: 135301 - DNA, 20 bp, human
gtcgcgagcggggagatgag

SEQ ID NO: 135302 - DNA, 20 bp, human
gcccgaaactgtccaaacta

SEQ ID NO: 135303 - DNA, 20 bp, human
gccgcgggattccataagag

SEQ ID NO: 135304 - DNA, 20 bp, human
gcggtacacgccggaagtag

SEQ ID NO: 135305 - DNA, 20 bp, human
gagactggcgtccggtgtgc

SEQ ID NO: 135306 - DNA, 20 bp, human
ggcggcttctcaggcggtgg

SEQ ID NO: 135307 - DNA, 20 bp, human
ggatagaacctctagtctcg

SEQ ID NO: 135308 - DNA, 20 bp, human
ggtggagagattgaagatgg

SEQ ID NO: 135309 - DNA, 20 bp, human
gaaactcccccagaaccacg

SEQ ID NO: 135310 - DNA, 20 bp, human
gatggcggcttctcaggcgg

SEQ ID NO: 135311 - DNA, 20 bp, human
gctcgtggagagattgaaga

SEQ ID NO: 135312 - DNA, 20 bp, human
gcggagccgcgtggttctgg

SEQ ID NO: 135313 - DNA, 20 bp, human
gtagtatggacctagagcaa

SEQ ID NO: 135314 - DNA, 20 bp, human
gaccgggaaagtcagtagta

SEQ ID NO: 135315 - DNA, 20 bp, human
gtcccaggcatcatcataac

SEQ ID NO: 135316 - DNA, 20 bp, human
ggcacctcggcgccggacag

SEQ ID NO: 135317 - DNA, 20 bp, human
gggctcccccgaaatctgga

SEQ ID NO: 135318 - DNA, 20 bp, human
gagctccatccagatttcgg

SEQ ID NO: 135319 - DNA, 20 bp, human
ggccggctccggctcagtcc

SEQ ID NO: 135320 - DNA, 20 bp, human
ggttccggccccgtacccgg

SEQ ID NO: 135321 - DNA, 20 bp, human
ggccgcgaccgcgagggaca

SEQ ID NO: 135322 - DNA, 20 bp, human
gcggcagatgtcccgcacct

SEQ ID NO: 135323 - DNA, 20 bp, human
ggcagcgcctgcccaacccc

SEQ ID NO: 135324 - DNA, 20 bp, human
ggtacccggaggcccagccg

SEQ ID NO: 135325 - DNA, 20 bp, human
gcgcgggccgggctgaagtg

SEQ ID NO: 135326 - DNA, 20 bp, human
gggaagcaaggaccgaccga

SEQ ID NO: 135327 - DNA, 20 bp, human
gtgtcccatagcgcgaggcg

SEQ ID NO: 135328 - DNA, 20 bp, human
gggtggtgctggcggatcgg

SEQ ID NO: 135329 - DNA, 20 bp, human
ggtaccgtcctcaggagcag

SEQ ID NO: 135330 - DNA, 20 bp, human
gcgtcctccgcgccttccgt

SEQ ID NO: 135331 - DNA, 20 bp, human
gcgaggcgcggaggcgaagc

SEQ ID NO: 135332 - DNA, 20 bp, human
ggcaaggaccgaccgacgga

SEQ ID NO: 135333 - DNA, 20 bp, human
gaggcacgagtaccgtcctc

SEQ ID NO: 135334 - DNA, 20 bp, human
gggaaggcgcggaggacgga

SEQ ID NO: 135335 - DNA, 20 bp, human
gaaggtgagccgtagttaca

SEQ ID NO: 135336 - DNA, 20 bp, human
ggccagcggggcttccgcag

SEQ ID NO: 135337 - DNA, 20 bp, human
ggacagcccggggcgagtgg

SEQ ID NO: 135338 - DNA, 20 bp, human
gcgcccgcctgattcccctg

SEQ ID NO: 135339 - DNA, 20 bp, human
gttccgcaggggaatcaggc

SEQ ID NO: 135340 - DNA, 20 bp, human
gtcccctgcggaagccccgc

SEQ ID NO: 135341 - DNA, 20 bp, human
gcgcagacacctagccagcg

SEQ ID NO: 135342 - DNA, 20 bp, human
gccagctgtgccactcttgg

SEQ ID NO: 135343 - DNA, 20 bp, human
ggcgcctgggaacaaaggtg

SEQ ID NO: 135344 - DNA, 20 bp, human
gggaggtttgaggagccact

SEQ ID NO: 135345 - DNA, 20 bp, human
gcggagaggacgcgctctgg

SEQ ID NO: 135346 - DNA, 20 bp, human
gggtgttgccgagtgcgagg

SEQ ID NO: 135347 - DNA, 20 bp, human
gtgaggtaccgagacggaag

SEQ ID NO: 135348 - DNA, 20 bp, human
gtggggagaagcccaacgga

SEQ ID NO: 135349 - DNA, 20 bp, human
ggacagctgaggtaccgaga

SEQ ID NO: 135350 - DNA, 20 bp, human
gggaaggaggctgacagcag

SEQ ID NO: 135351 - DNA, 20 bp, human
gctgtactgggtaaagactg

SEQ ID NO: 135352 - DNA, 20 bp, human
gaccgagacggaaggggaga

SEQ ID NO: 135353 - DNA, 20 bp, human
ggacaggagggaatgtctcg

SEQ ID NO: 135354 - DNA, 20 bp, human
ggggaactggaggagatccg

SEQ ID NO: 135355 - DNA, 20 bp, human
gggagccagagagctgtact

SEQ ID NO: 135356 - DNA, 20 bp, human
gccgggacggttggagaaga

SEQ ID NO: 135357 - DNA, 20 bp, human
ggaaggcggctcccggaagg

SEQ ID NO: 135358 - DNA, 20 bp, human
gaagtaaccgggttcctgaa

SEQ ID NO: 135359 - DNA, 20 bp, human
gagagcgcggccgggacggt

SEQ ID NO: 135360 - DNA, 20 bp, human
gtcctgaacggcagaggtta

SEQ ID NO: 135361 - DNA, 20 bp, human
gctgcctccgccatgcacgg

SEQ ID NO: 135362 - DNA, 20 bp, human
gcggactcaggactccgaac

SEQ ID NO: 135363 - DNA, 20 bp, human
ggaagaaggcggctcccgga

SEQ ID NO: 135364 - DNA, 20 bp, human
ggcatgcgctgtcccccgag

SEQ ID NO: 135365 - DNA, 20 bp, human
gcgaggtctgagcacctagg

SEQ ID NO: 135366 - DNA, 20 bp, human
ggactgtgcagccggcgcat

SEQ ID NO: 135367 - DNA, 20 bp, human
gttcccggcctggtaagtgt

SEQ ID NO: 135368 - DNA, 20 bp, human
gtaggagctcgagaaccgtt

SEQ ID NO: 135369 - DNA, 20 bp, human
gcgtggtattctgggaacgt

SEQ ID NO: 135370 - DNA, 20 bp, human
gcgggaacgaaactggggta

SEQ ID NO: 135371 - DNA, 20 bp, human
gattctgggaacgtcggaga

SEQ ID NO: 135372 - DNA, 20 bp, human
gcctggtaagtgtgggaaca

SEQ ID NO: 135373 - DNA, 20 bp, human
gaaacgaggatcagatctaa

SEQ ID NO: 135374 - DNA, 20 bp, human
gccaggccgggaacgaaact

SEQ ID NO: 135375 - DNA, 20 bp, human
ggtgcagccggcgcatggga

SEQ ID NO: 135376 - DNA, 20 bp, human
gggagccccaaagagtgtgt

SEQ ID NO: 135377 - DNA, 20 bp, human
ggagcggggcaggaacccgt

SEQ ID NO: 135378 - DNA, 20 bp, human
gatccgcacggtaggctggt

SEQ ID NO: 135379 - DNA, 20 bp, human
gcggtaggctggttggcgta

SEQ ID NO: 135380 - DNA, 20 bp, human
gcaccgcggagcagacgcgg

SEQ ID NO: 135381 - DNA, 20 bp, human
gagtcaccgcggagcagacg

SEQ ID NO: 135382 - DNA, 20 bp, human
gcgtacggcatctcgcccag

SEQ ID NO: 135383 - DNA, 20 bp, human
gtggcgccgcgcagtcaccg

SEQ ID NO: 135384 - DNA, 20 bp, human
gggagtcgcttacctattat

SEQ ID NO: 135385 - DNA, 20 bp, human
ggtgagctccgtgatccgca

SEQ ID NO: 135386 - DNA, 20 bp, human
ggtggcagcgatccgcgggc

SEQ ID NO: 135387 - DNA, 20 bp, human
gggcgggtggcagcgatccg

SEQ ID NO: 135388 - DNA, 20 bp, human
gccgcgggctggcgacgtag

SEQ ID NO: 135389 - DNA, 20 bp, human
ggccggacactcaggtggta

SEQ ID NO: 135390 - DNA, 20 bp, human
gcgggctggcgacgtagagg

SEQ ID NO: 135391 - DNA, 20 bp, human
gcttccggcggcgctggtgg

SEQ ID NO: 135392 - DNA, 20 bp, human
gaagcagaagcgcggagcaa

SEQ ID NO: 135393 - DNA, 20 bp, human
gttaggaaagatgagctgtg

SEQ ID NO: 135394 - DNA, 20 bp, human
gcgattagtacagaacctct

SEQ ID NO: 135395 - DNA, 20 bp, human
gcttgcccaagccgccgctg

SEQ ID NO: 135396 - DNA, 20 bp, human
gagggtcttaactcttgtcc

SEQ ID NO: 135397 - DNA, 20 bp, human
gcatagccccttgagataga

SEQ ID NO: 135398 - DNA, 20 bp, human
gagtagccatctatctcaag

SEQ ID NO: 135399 - DNA, 20 bp, human
gggacaagtgctaagtattg

SEQ ID NO: 135400 - DNA, 20 bp, human
gttcttccgtctcccaggtt

SEQ ID NO: 135401 - DNA, 20 bp, human
gttggggtaagtggtcttga

SEQ ID NO: 135402 - DNA, 20 bp, human
ggcctgaaattcttaaagga

SEQ ID NO: 135403 - DNA, 20 bp, human
gtgggaagtgtttacacttg

SEQ ID NO: 135404 - DNA, 20 bp, human
gcgtgcttcttccgtctccc

SEQ ID NO: 135405 - DNA, 20 bp, human
gtaactcttgtccaggctgg

SEQ ID NO: 135406 - DNA, 20 bp, human
ggacgctgaatcacagagaa

SEQ ID NO: 135407 - DNA, 20 bp, human
gcgacgaggaggagacgtac

SEQ ID NO: 135408 - DNA, 20 bp, human
ggaggctgccatggacgacg

SEQ ID NO: 135409 - DNA, 20 bp, human
gcggatgctgaagactccat

SEQ ID NO: 135410 - DNA, 20 bp, human
gcgcggagaaggggtgcgag

SEQ ID NO: 135411 - DNA, 20 bp, human
gagccgcgaatggggacggg

SEQ ID NO: 135412 - DNA, 20 bp, human
ggggttctcgcgcggagaag

SEQ ID NO: 135413 - DNA, 20 bp, human
gtcggagcagcagcgatgaa

SEQ ID NO: 135414 - DNA, 20 bp, human
gtgaagggccgggccgatac

SEQ ID NO: 135415 - DNA, 20 bp, human
gacagagaagggcagagtct

SEQ ID NO: 135416 - DNA, 20 bp, human
gatccaggcgggggaccctg

SEQ ID NO: 135417 - DNA, 20 bp, human
gctactttgggataaagcgt

SEQ ID NO: 135418 - DNA, 20 bp, human
gtggcaggtacatcacctac

SEQ ID NO: 135419 - DNA, 20 bp, human
gagctactgcaccagccggt

SEQ ID NO: 135420 - DNA, 20 bp, human
gtccggcccagtgagacggc

SEQ ID NO: 135421 - DNA, 20 bp, human
gctcggccgtctcacctgtc

SEQ ID NO: 135422 - DNA, 20 bp, human
gcagcaggcgggcagcacac

SEQ ID NO: 135423 - DNA, 20 bp, human
gatcatccggcccagtgaga

SEQ ID NO: 135424 - DNA, 20 bp, human
ggtccgagatggctgaccct

SEQ ID NO: 135425 - DNA, 20 bp, human
gcacctcagtgcctgtccct

SEQ ID NO: 135426 - DNA, 20 bp, human
gtgaggagcctggcgtctag

SEQ ID NO: 135427 - DNA, 20 bp, human
gtgtttgcgggtctccgcgc

SEQ ID NO: 135428 - DNA, 20 bp, human
gcgcaggcgcaagataagct

SEQ ID NO: 135429 - DNA, 20 bp, human
gggccggcggagccgaggaa

SEQ ID NO: 135430 - DNA, 20 bp, human
ggtgagcacgtggagaggca

SEQ ID NO: 135431 - DNA, 20 bp, human
gtaagcaagcaagcaggtaa

SEQ ID NO: 135432 - DNA, 20 bp, human
gagcgacactacgactcgcg

SEQ ID NO: 135433 - DNA, 20 bp, human
gcgcctgcgccgtaacccag

SEQ ID NO: 135434 - DNA, 20 bp, human
ggggcgcagcggggtcgctg

SEQ ID NO: 135435 - DNA, 20 bp, human
gtctaggggcaatgtctgag

SEQ ID NO: 135436 - DNA, 20 bp, human
ggtggattcccagggactgt

SEQ ID NO: 135437 - DNA, 20 bp, human
gggagaggggtccccagagt

SEQ ID NO: 135438 - DNA, 20 bp, human
gcgtgctctagggagatctg

SEQ ID NO: 135439 - DNA, 20 bp, human
ggattcccagggactgtcgg

SEQ ID NO: 135440 - DNA, 20 bp, human
ggcaggacgagtaggagttg

SEQ ID NO: 135441 - DNA, 20 bp, human
gcacacctccgacagtccct

SEQ ID NO: 135442 - DNA, 20 bp, human
gtgtttccggtggattccca

SEQ ID NO: 135443 - DNA, 20 bp, human
ggcaactggctgcctgagag

SEQ ID NO: 135444 - DNA, 20 bp, human
ggagatctgcggagaaaagt

SEQ ID NO: 135445 - DNA, 20 bp, human
gggcgtctaagtgtttccgg

SEQ ID NO: 135446 - DNA, 20 bp, human
gtgagagcgcgaccacagtt

SEQ ID NO: 135447 - DNA, 20 bp, human
ggtgcacgtactcccaactg

SEQ ID NO: 135448 - DNA, 20 bp, human
gcccctagcgtggacaagac

SEQ ID NO: 135449 - DNA, 20 bp, human
ggggccacgagagcagcaga

SEQ ID NO: 135450 - DNA, 20 bp, human
gtccggtcttgtccacgcta

SEQ ID NO: 135451 - DNA, 20 bp, human
ggaggaagaggctaacctcg

SEQ ID NO: 135452 - DNA, 20 bp, human
gcaccaggacctgctggtag

SEQ ID NO: 135453 - DNA, 20 bp, human
ggtacgtgcaccccctagcg

SEQ ID NO: 135454 - DNA, 20 bp, human
gccatgacaaaaggccaccc

SEQ ID NO: 135455 - DNA, 20 bp, human
ggcaggccacaagagctggg

SEQ ID NO: 135456 - DNA, 20 bp, human
ggttcttccaatagcggccc

SEQ ID NO: 135457 - DNA, 20 bp, human
gttcacggttcttccaatag

SEQ ID NO: 135458 - DNA, 20 bp, human
gccggctcgtaagtcccgtc

SEQ ID NO: 135459 - DNA, 20 bp, human
gacagggagtccgatcacag

SEQ ID NO: 135460 - DNA, 20 bp, human
gtcccggaggatatgacgac

SEQ ID NO: 135461 - DNA, 20 bp, human
gggagagggcagggtgatcc

SEQ ID NO: 135462 - DNA, 20 bp, human
gtaagtcccgtcgggctcca

SEQ ID NO: 135463 - DNA, 20 bp, human
gcagttccggcactacgaga

SEQ ID NO: 135464 - DNA, 20 bp, human
ggattccagacaagattggg

SEQ ID NO: 135465 - DNA, 20 bp, human
gggagcaagcgcggaaggct

SEQ ID NO: 135466 - DNA, 20 bp, human
gggggcgatgagccgatcct

SEQ ID NO: 135467 - DNA, 20 bp, human
ggatcctccagcccaacggg

SEQ ID NO: 135468 - DNA, 20 bp, human
gcgatgagccgatccttggg

SEQ ID NO: 135469 - DNA, 20 bp, human
gcggctcatcgccccccgtt

SEQ ID NO: 135470 - DNA, 20 bp, human
gggcggggcaaacccgccca

SEQ ID NO: 135471 - DNA, 20 bp, human
gcgccggctgcggagggcct

SEQ ID NO: 135472 - DNA, 20 bp, human
ggcggcggtggcggacactt

SEQ ID NO: 135473 - DNA, 20 bp, human
ggcgggttgaaggagtccag

SEQ ID NO: 135474 - DNA, 20 bp, human
ggcaagatcctccagcccaa

SEQ ID NO: 135475 - DNA, 20 bp, human
gtcatcgccccccgttgggc

SEQ ID NO: 135476 - DNA, 20 bp, human
gggaggcttggcccggccat

SEQ ID NO: 135477 - DNA, 20 bp, human
gaacagctggaggcttggcc

SEQ ID NO: 135478 - DNA, 20 bp, human
gagaatttggaaacaaagtg

SEQ ID NO: 135479 - DNA, 20 bp, human
ggcattcatagttcactgca

SEQ ID NO: 135480 - DNA, 20 bp, human
gtggaaacaaagtgaggtct

SEQ ID NO: 135481 - DNA, 20 bp, human
gtgtcccgcagagagcccta

SEQ ID NO: 135482 - DNA, 20 bp, human
gccggccatagggctctctg

SEQ ID NO: 135483 - DNA, 20 bp, human
ggacagacgtgggtgagtaa

SEQ ID NO: 135484 - DNA, 20 bp, human
gtctgtcccaggctggacac

SEQ ID NO: 135485 - DNA, 20 bp, human
gacagatggacaacagctgg

SEQ ID NO: 135486 - DNA, 20 bp, human
gcgggttgtatttggaaacg

SEQ ID NO: 135487 - DNA, 20 bp, human
gaggggaacaggctcaccga

SEQ ID NO: 135488 - DNA, 20 bp, human
gtgtaggtaagcgaattggc

SEQ ID NO: 135489 - DNA, 20 bp, human
ggctgtgtaggtaagcgaat

SEQ ID NO: 135490 - DNA, 20 bp, human
ggagtttttccgtgctgtgt

SEQ ID NO: 135491 - DNA, 20 bp, human
gtctcgacacctggactagc

SEQ ID NO: 135492 - DNA, 20 bp, human
gaggtgtcgagaccaacttc

SEQ ID NO: 135493 - DNA, 20 bp, human
gaattaacatgtctaagtat

SEQ ID NO: 135494 - DNA, 20 bp, human
gatgtaccagcgccggaagt

SEQ ID NO: 135495 - DNA, 20 bp, human
gggactagccgggttgtatt

SEQ ID NO: 135496 - DNA, 20 bp, human
gcgtacagggatgatcatgg

SEQ ID NO: 135497 - DNA, 20 bp, human
gtcacttgtggcaagatcgt

SEQ ID NO: 135498 - DNA, 20 bp, human
gcagcgtacagggatgatca

SEQ ID NO: 135499 - DNA, 20 bp, human
gggaatagggcggaggccaa

SEQ ID NO: 135500 - DNA, 20 bp, human
gacagggatgatcatggcgg

SEQ ID NO: 135501 - DNA, 20 bp, human
gaagatcgtcggcaacaagt

SEQ ID NO: 135502 - DNA, 20 bp, human
ggcaggccgagtacaccgag

SEQ ID NO: 135503 - DNA, 20 bp, human
gcacaagtgaagcagcgtac

SEQ ID NO: 135504 - DNA, 20 bp, human
gcgggcctgaagctgctcat

SEQ ID NO: 135505 - DNA, 20 bp, human
ggcgaggtttgcaggacatg

SEQ ID NO: 135506 - DNA, 20 bp, human
gtacgtgcctggccaggaag

SEQ ID NO: 135507 - DNA, 20 bp, human
ggcgccggatccgcggacgg

SEQ ID NO: 135508 - DNA, 20 bp, human
ggctactagcgccggatccg

SEQ ID NO: 135509 - DNA, 20 bp, human
gctagcgccggatccgcgga

SEQ ID NO: 135510 - DNA, 20 bp, human
gagtcctacgggcgagtgga

SEQ ID NO: 135511 - DNA, 20 bp, human
gcctacgggcgagtggacgg

SEQ ID NO: 135512 - DNA, 20 bp, human
ggcagagccgtgcctcttcc

SEQ ID NO: 135513 - DNA, 20 bp, human
gggagttagtagcccctggt

SEQ ID NO: 135514 - DNA, 20 bp, human
ggccattttcccggaagaac

SEQ ID NO: 135515 - DNA, 20 bp, human
gtcaccgccgtccgcggatc

SEQ ID NO: 135516 - DNA, 20 bp, human
ggatgccgcagatgtgttag

SEQ ID NO: 135517 - DNA, 20 bp, human
gcacgtgggacactctacgg

SEQ ID NO: 135518 - DNA, 20 bp, human
gggacacgtgggacactcta

SEQ ID NO: 135519 - DNA, 20 bp, human
gctcgccgctaacacatctg

SEQ ID NO: 135520 - DNA, 20 bp, human
gcagcgaggggagcaatctg

SEQ ID NO: 135521 - DNA, 20 bp, human
ggatagttcgctgaagaaca

SEQ ID NO: 135522 - DNA, 20 bp, human
gcaagtccagggacctctcg

SEQ ID NO: 135523 - DNA, 20 bp, human
gagaggtccctggacttggg

SEQ ID NO: 135524 - DNA, 20 bp, human
gcgcctccttggcactcggg

SEQ ID NO: 135525 - DNA, 20 bp, human
ggaagaggaagcggacacgt

SEQ ID NO: 135526 - DNA, 20 bp, human
ggcgccgatcccgactgtag

SEQ ID NO: 135527 - DNA, 20 bp, human
gactcccggcgaacggtgcg

SEQ ID NO: 135528 - DNA, 20 bp, human
ggagtgaaggctgatcccag

SEQ ID NO: 135529 - DNA, 20 bp, human
gccgctgctggctctagggt

SEQ ID NO: 135530 - DNA, 20 bp, human
gtccatgctgctcacgaagg

SEQ ID NO: 135531 - DNA, 20 bp, human
gtccgggcaacgccccctca

SEQ ID NO: 135532 - DNA, 20 bp, human
gaggcacgcagggagcgtca

SEQ ID NO: 135533 - DNA, 20 bp, human
gctgcaagactcccggcgaa

SEQ ID NO: 135534 - DNA, 20 bp, human
gagcggctgacagctcctct

SEQ ID NO: 135535 - DNA, 20 bp, human
gacgtccatgctgctcacga

SEQ ID NO: 135536 - DNA, 20 bp, human
ggcgatccgcgtcctagaaa

SEQ ID NO: 135537 - DNA, 20 bp, human
gatccgcgtcctagaaaggg

SEQ ID NO: 135538 - DNA, 20 bp, human
gccgaaactctggggtagag

SEQ ID NO: 135539 - DNA, 20 bp, human
gttcccgcgacggcttccta

SEQ ID NO: 135540 - DNA, 20 bp, human
gggacggggaggcaaagact

SEQ ID NO: 135541 - DNA, 20 bp, human
gatcgccaccgaagaagacg

SEQ ID NO: 135542 - DNA, 20 bp, human
gaaatgctgtctgaacgtgg

SEQ ID NO: 135543 - DNA, 20 bp, human
ggcgtcctagaaagggcggt

SEQ ID NO: 135544 - DNA, 20 bp, human
gagggcggtgggctccacct

SEQ ID NO: 135545 - DNA, 20 bp, human
gccgcctcccagcaccaaag

SEQ ID NO: 135546 - DNA, 20 bp, human
gctggggcccgggggctcat

SEQ ID NO: 135547 - DNA, 20 bp, human
ggggcgacgagatcaccaga

SEQ ID NO: 135548 - DNA, 20 bp, human
gtctctcccaggcaacatgt

SEQ ID NO: 135549 - DNA, 20 bp, human
gactcccagaggtggttgaa

SEQ ID NO: 135550 - DNA, 20 bp, human
gcgcccggcgcggagaccga

SEQ ID NO: 135551 - DNA, 20 bp, human
gatgttgaaatgactcccag

SEQ ID NO: 135552 - DNA, 20 bp, human
gactgacacgcggaccctgg

SEQ ID NO: 135553 - DNA, 20 bp, human
gtccgcgtgtcagtcccctc

SEQ ID NO: 135554 - DNA, 20 bp, human
gggtccctggaacggatgga

SEQ ID NO: 135555 - DNA, 20 bp, human
gaccagaggggactgacacg

SEQ ID NO: 135556 - DNA, 20 bp, human
gtacccgcgggctgcagaga

SEQ ID NO: 135557 - DNA, 20 bp, human
gaacatggccgccgcctgag

SEQ ID NO: 135558 - DNA, 20 bp, human
gggcctcccaggcccggata

SEQ ID NO: 135559 - DNA, 20 bp, human
ggtccgcgcgtcgggtgtag

SEQ ID NO: 135560 - DNA, 20 bp, human
gcgccgcctgagaggagagc

SEQ ID NO: 135561 - DNA, 20 bp, human
gaggcccggatagggcaggt

SEQ ID NO: 135562 - DNA, 20 bp, human
ggcggcagggactgcgtggt

SEQ ID NO: 135563 - DNA, 20 bp, human
gcaggcggcggccatgttgc

SEQ ID NO: 135564 - DNA, 20 bp, human
ggcaacggcccagttacccg

SEQ ID NO: 135565 - DNA, 20 bp, human
gctgcagcccgcgggtaact

SEQ ID NO: 135566 - DNA, 20 bp, human
gcctgtaagtgggccggagc

SEQ ID NO: 135567 - DNA, 20 bp, human
gtagcaagccggggaacccg

SEQ ID NO: 135568 - DNA, 20 bp, human
ggaacccggggaaccagtgg

SEQ ID NO: 135569 - DNA, 20 bp, human
gggttccccggcttgctacc

SEQ ID NO: 135570 - DNA, 20 bp, human
gtaccaggctccctgcggag

SEQ ID NO: 135571 - DNA, 20 bp, human
ggcagagcgctatcctccac

SEQ ID NO: 135572 - DNA, 20 bp, human
ggcagcccggtagcaagccg

SEQ ID NO: 135573 - DNA, 20 bp, human
gtgatcgcgtcaaagtagga

SEQ ID NO: 135574 - DNA, 20 bp, human
ggcactgatcgcgtcaaagt

SEQ ID NO: 135575 - DNA, 20 bp, human
gccgaaaggcaaggaaggac

SEQ ID NO: 135576 - DNA, 20 bp, human
ggtgccggccggcaaggaaa

SEQ ID NO: 135577 - DNA, 20 bp, human
ggccggcaaggaaagggtga

SEQ ID NO: 135578 - DNA, 20 bp, human
ggggtgacggcagagaacgc

SEQ ID NO: 135579 - DNA, 20 bp, human
ggtgcgcgcttctcccgagg

SEQ ID NO: 135580 - DNA, 20 bp, human
gctgcagccgaagtgccggc

SEQ ID NO: 135581 - DNA, 20 bp, human
gtcggtgcgcgcttctcccg

SEQ ID NO: 135582 - DNA, 20 bp, human
gcctggtgccgcgtgcaggt

SEQ ID NO: 135583 - DNA, 20 bp, human
gacgggcggcagtcaagcgc

SEQ ID NO: 135584 - DNA, 20 bp, human
ggcgcgcaccgacctgcacg

SEQ ID NO: 135585 - DNA, 20 bp, human
gcaaacgcccctcaaaccag

SEQ ID NO: 135586 - DNA, 20 bp, human
gggcggcccaggaaaactac

SEQ ID NO: 135587 - DNA, 20 bp, human
gctgggcttcctcaagtcgg

SEQ ID NO: 135588 - DNA, 20 bp, human
ggcccaggggagaaacggta

SEQ ID NO: 135589 - DNA, 20 bp, human
gaccaatagggagctccggg

SEQ ID NO: 135590 - DNA, 20 bp, human
gcagcaggtaaggcttgacc

SEQ ID NO: 135591 - DNA, 20 bp, human
ggtactgggcttcctcaagt

SEQ ID NO: 135592 - DNA, 20 bp, human
ggcactaagtgtcctaataa

SEQ ID NO: 135593 - DNA, 20 bp, human
gaaaacgctatcgtagacgg

SEQ ID NO: 135594 - DNA, 20 bp, human
ggtacatttcaagttggtcg

SEQ ID NO: 135595 - DNA, 20 bp, human
gagcccagtacatttcaagt

SEQ ID NO: 135596 - DNA, 20 bp, human
gtggtgcgtgatacgagcgg

SEQ ID NO: 135597 - DNA, 20 bp, human
ggcgtggtgcgtgatacgag

SEQ ID NO: 135598 - DNA, 20 bp, human
gcaccgtccggatcccccct

SEQ ID NO: 135599 - DNA, 20 bp, human
gcgactgggacgggaccaag

SEQ ID NO: 135600 - DNA, 20 bp, human
gccccccttggcagtttgag

SEQ ID NO: 135601 - DNA, 20 bp, human
ggcgcacccggagctgtgga

SEQ ID NO: 135602 - DNA, 20 bp, human
gtgccaaggggggatccgga

SEQ ID NO: 135603 - DNA, 20 bp, human
gtccaccaggacgaacatcc

SEQ ID NO: 135604 - DNA, 20 bp, human
gcaggccgggatgttcgtcc

SEQ ID NO: 135605 - DNA, 20 bp, human
ggaggagctgaacaagaagt

SEQ ID NO: 135606 - DNA, 20 bp, human
ggcggcgcatcggcgctgag

SEQ ID NO: 135607 - DNA, 20 bp, human
gtctgccccggctgcgggaa

SEQ ID NO: 135608 - DNA, 20 bp, human
ggtaggccctgggagaactc

SEQ ID NO: 135609 - DNA, 20 bp, human
ggcggccctggaggagacgg

SEQ ID NO: 135610 - DNA, 20 bp, human
gggtgatgttgtgcacgtag

SEQ ID NO: 135611 - DNA, 20 bp, human
gcgtgttgcaggagaagcgg

SEQ ID NO: 135612 - DNA, 20 bp, human
ggcgatggagcagcagtcgg

SEQ ID NO: 135613 - DNA, 20 bp, human
gagtgggagctgccgggagt

SEQ ID NO: 135614 - DNA, 20 bp, human
gtgcgggaacgggctgatcg

SEQ ID NO: 135615 - DNA, 20 bp, human
gtgctgtgcgcagaaacctt

SEQ ID NO: 135616 - DNA, 20 bp, human
gggagcggcgtgcgtaatgt

SEQ ID NO: 135617 - DNA, 20 bp, human
ggccccgccgcggcgaacac

SEQ ID NO: 135618 - DNA, 20 bp, human
ggcgcggaaccgccgagaga

SEQ ID NO: 135619 - DNA, 20 bp, human
ggcggaaactctcggagcac

SEQ ID NO: 135620 - DNA, 20 bp, human
ggcgcaggcgcgggccggtg

SEQ ID NO: 135621 - DNA, 20 bp, human
ggcgaggaaccctctctcgg

SEQ ID NO: 135622 - DNA, 20 bp, human
gtcgaggtgcagcaggtcaa

SEQ ID NO: 135623 - DNA, 20 bp, human
gtaatgtcggcactttgctg

SEQ ID NO: 135624 - DNA, 20 bp, human
gctttgctggggccgcggag

SEQ ID NO: 135625 - DNA, 20 bp, human
gagagggttcctcgcactcg

SEQ ID NO: 135626 - DNA, 20 bp, human
gcttggtgaggtggacggga

SEQ ID NO: 135627 - DNA, 20 bp, human
gccccagcgccgctggctcc

SEQ ID NO: 135628 - DNA, 20 bp, human
gcggtgacctgaagaggcgc

SEQ ID NO: 135629 - DNA, 20 bp, human
ggtgtgtgtcctcggcggcc

SEQ ID NO: 135630 - DNA, 20 bp, human
gagcaagcggtgacctgaag

SEQ ID NO: 135631 - DNA, 20 bp, human
ggcctgggaactagagcaag

SEQ ID NO: 135632 - DNA, 20 bp, human
gggtgattctcatccactag

SEQ ID NO: 135633 - DNA, 20 bp, human
gggcgccggccgtcgctgta

SEQ ID NO: 135634 - DNA, 20 bp, human
gctcaccgtacagcgacggc

SEQ ID NO: 135635 - DNA, 20 bp, human
gcgaaggggcgacgggacct

SEQ ID NO: 135636 - DNA, 20 bp, human
gctggggctcccggcccctc

SEQ ID NO: 135637 - DNA, 20 bp, human
gcccaggctttggcttctag

SEQ ID NO: 135638 - DNA, 20 bp, human
gcgatgacctgaagaggcac

SEQ ID NO: 135639 - DNA, 20 bp, human
gcccgcctaggtgctggtcc

SEQ ID NO: 135640 - DNA, 20 bp, human
ggcctaggtgctggtccggg

SEQ ID NO: 135641 - DNA, 20 bp, human
ggggtgaagtcaccttgtgt

SEQ ID NO: 135642 - DNA, 20 bp, human
gccgggtagaggctcgagct

SEQ ID NO: 135643 - DNA, 20 bp, human
gctcaaaggtccccaacaca

SEQ ID NO: 135644 - DNA, 20 bp, human
gtcgcttcctgtgcctcttc

SEQ ID NO: 135645 - DNA, 20 bp, human
gatcgcttgctctcgttccc

SEQ ID NO: 135646 - DNA, 20 bp, human
gctgtccaggggatctccag

SEQ ID NO: 135647 - DNA, 20 bp, human
gggccgagtccgcagacctc

SEQ ID NO: 135648 - DNA, 20 bp, human
ggacctcgggaacttctgga

SEQ ID NO: 135649 - DNA, 20 bp, human
gtggaaggcacgaaggacat

SEQ ID NO: 135650 - DNA, 20 bp, human
gcctggagcccggtgaccat

SEQ ID NO: 135651 - DNA, 20 bp, human
gggtgggccgcacctcgatg

SEQ ID NO: 135652 - DNA, 20 bp, human
gggagggttgcatgaaaggg

SEQ ID NO: 135653 - DNA, 20 bp, human
ggccaacggtcccccagcca

SEQ ID NO: 135654 - DNA, 20 bp, human
ggctgcagcgcccatggctg

SEQ ID NO: 135655 - DNA, 20 bp, human
gcccatggctgggggaccgt

SEQ ID NO: 135656 - DNA, 20 bp, human
ggcgcctcatctctcctcat

SEQ ID NO: 135657 - DNA, 20 bp, human
gctgcagacgtccgaaacct

SEQ ID NO: 135658 - DNA, 20 bp, human
gctcacaggtctataccgtg

SEQ ID NO: 135659 - DNA, 20 bp, human
gctataccgtggggcagggt

SEQ ID NO: 135660 - DNA, 20 bp, human
gtggtcactgggctccaaat

SEQ ID NO: 135661 - DNA, 20 bp, human
gagtcgaagagcgcagtgtt

SEQ ID NO: 135662 - DNA, 20 bp, human
gcagtgttcggttgacggtt

SEQ ID NO: 135663 - DNA, 20 bp, human
gggggcctctcccttcagac

SEQ ID NO: 135664 - DNA, 20 bp, human
gtcaggaggagtgatcctga

SEQ ID NO: 135665 - DNA, 20 bp, human
ggagcgcagtgttcggttga

SEQ ID NO: 135666 - DNA, 20 bp, human
ggaagagccgcgaccgagag

SEQ ID NO: 135667 - DNA, 20 bp, human
gggagcgcgggaccaagcgg

SEQ ID NO: 135668 - DNA, 20 bp, human
gccaagcggcggcgaaggag

SEQ ID NO: 135669 - DNA, 20 bp, human
gagcctcccgagacaggtaa

SEQ ID NO: 135670 - DNA, 20 bp, human
gcggcggcctctctcggtcg

SEQ ID NO: 135671 - DNA, 20 bp, human
gagaggagcgcgggaccaag

SEQ ID NO: 135672 - DNA, 20 bp, human
ggacgctcggcggcctctct

SEQ ID NO: 135673 - DNA, 20 bp, human
gcgcccttacctgtctcggg

SEQ ID NO: 135674 - DNA, 20 bp, human
gaggaggtcttgggacaacc

SEQ ID NO: 135675 - DNA, 20 bp, human
gggaggctgctctctgaggg

SEQ ID NO: 135676 - DNA, 20 bp, human
ggtgatccaaccccactgaa

SEQ ID NO: 135677 - DNA, 20 bp, human
gaagctggggcagataggat

SEQ ID NO: 135678 - DNA, 20 bp, human
gggcaggaaacccttcagtg

SEQ ID NO: 135679 - DNA, 20 bp, human
gagcagtgagggccctagcg

SEQ ID NO: 135680 - DNA, 20 bp, human
ggttccggacacccacgcgg

SEQ ID NO: 135681 - DNA, 20 bp, human
gggggccgcaagcggcatgg

SEQ ID NO: 135682 - DNA, 20 bp, human
gggaggcactcacggcttag

SEQ ID NO: 135683 - DNA, 20 bp, human
gcccgttccggacacccacg

SEQ ID NO: 135684 - DNA, 20 bp, human
ggagagaagctggggcagat

SEQ ID NO: 135685 - DNA, 20 bp, human
gtgggacgagggttgaagac

SEQ ID NO: 135686 - DNA, 20 bp, human
ggcttcgtcccgcggagtcc

SEQ ID NO: 135687 - DNA, 20 bp, human
gggaaagcggcgccgccgtg

SEQ ID NO: 135688 - DNA, 20 bp, human
gcggacacctgcgagcctgg

SEQ ID NO: 135689 - DNA, 20 bp, human
ggagagtttgcagaactgag

SEQ ID NO: 135690 - DNA, 20 bp, human
gcgtccaggaggccccacgg

SEQ ID NO: 135691 - DNA, 20 bp, human
ggccagggcaaccgaactcg

SEQ ID NO: 135692 - DNA, 20 bp, human
gcaggcagccagcacaggtt

SEQ ID NO: 135693 - DNA, 20 bp, human
ggacgtgtgaagcgagctga

SEQ ID NO: 135694 - DNA, 20 bp, human
gggtggaccctcagggtcgg

SEQ ID NO: 135695 - DNA, 20 bp, human
gacctgaagcctggactccg

SEQ ID NO: 135696 - DNA, 20 bp, human
gcggggtcgactgacggtaa

SEQ ID NO: 135697 - DNA, 20 bp, human
gcctcggaaacggaagtgag

SEQ ID NO: 135698 - DNA, 20 bp, human
gtggtgagtgggtacccggg

SEQ ID NO: 135699 - DNA, 20 bp, human
gagatggtgagtgggtaccc

SEQ ID NO: 135700 - DNA, 20 bp, human
ggctgcggaagatggtgagt

SEQ ID NO: 135701 - DNA, 20 bp, human
gaccgtggctcggcagaaac

SEQ ID NO: 135702 - DNA, 20 bp, human
gcttggcgcagaagtggaaa

SEQ ID NO: 135703 - DNA, 20 bp, human
gaggttacccgtcaaggaaa

SEQ ID NO: 135704 - DNA, 20 bp, human
ggaaagtgcaacgttctgtg

SEQ ID NO: 135705 - DNA, 20 bp, human
gtggggtctaagggatggaa

SEQ ID NO: 135706 - DNA, 20 bp, human
gtgctgcgggtgcagtctca

SEQ ID NO: 135707 - DNA, 20 bp, human
gcgtggcgcgtgcagcccta

SEQ ID NO: 135708 - DNA, 20 bp, human
gaatcgaacgttgagcaggg

SEQ ID NO: 135709 - DNA, 20 bp, human
gtccgactgggccgacggtt

SEQ ID NO: 135710 - DNA, 20 bp, human
gccccaaccgtcggcccagt

SEQ ID NO: 135711 - DNA, 20 bp, human
ggaacgttgagcagggcggt

SEQ ID NO: 135712 - DNA, 20 bp, human
gggtggtgcggagtgccgag

SEQ ID NO: 135713 - DNA, 20 bp, human
gaggcactcccaggacagat

SEQ ID NO: 135714 - DNA, 20 bp, human
gtcccgtccaccaactcccg

SEQ ID NO: 135715 - DNA, 20 bp, human
ggcgcgtgcgcactgggaga

SEQ ID NO: 135716 - DNA, 20 bp, human
gccgccaaggagtcacaaga

SEQ ID NO: 135717 - DNA, 20 bp, human
gcgcgctccgctgcagtgaa

SEQ ID NO: 135718 - DNA, 20 bp, human
gtcactcaccagatgtgcgg

SEQ ID NO: 135719 - DNA, 20 bp, human
gcggcggctcgtccaagcgg

SEQ ID NO: 135720 - DNA, 20 bp, human
ggtaccctcgggccaatcag

SEQ ID NO: 135721 - DNA, 20 bp, human
gcgcggcccgggccgctagg

SEQ ID NO: 135722 - DNA, 20 bp, human
ggtgcggcggctcgtccaag

SEQ ID NO: 135723 - DNA, 20 bp, human
gtggcccgagggtacggagg

SEQ ID NO: 135724 - DNA, 20 bp, human
gcaggaggcgcagagcatgt

SEQ ID NO: 135725 - DNA, 20 bp, human
gctcgtccaagcggtggaag

SEQ ID NO: 135726 - DNA, 20 bp, human
gagtggtgaacgcgatgggt

SEQ ID NO: 135727 - DNA, 20 bp, human
gggggagagaggggtaaaag

SEQ ID NO: 135728 - DNA, 20 bp, human
gtgaacgcgatgggtcggcg

SEQ ID NO: 135729 - DNA, 20 bp, human
gcgcgatgggtcggcgggga

SEQ ID NO: 135730 - DNA, 20 bp, human
gtaaaagtggtgaacgcgat

SEQ ID NO: 135731 - DNA, 20 bp, human
gcgagtgtcagggccggccg

SEQ ID NO: 135732 - DNA, 20 bp, human
gcgatagcgagtgtcagggc

SEQ ID NO: 135733 - DNA, 20 bp, human
gaggcacgaggtacagtagg

SEQ ID NO: 135734 - DNA, 20 bp, human
gctgccgaactgctcctcat

SEQ ID NO: 135735 - DNA, 20 bp, human
gaggccgagaagcgccgccc

SEQ ID NO: 135736 - DNA, 20 bp, human
gtgggcaccccgagaccatg

SEQ ID NO: 135737 - DNA, 20 bp, human
gagcgccacgagcttcccca

SEQ ID NO: 135738 - DNA, 20 bp, human
gcatctccccgactaaggac

SEQ ID NO: 135739 - DNA, 20 bp, human
gaggaacatctccccgacta

SEQ ID NO: 135740 - DNA, 20 bp, human
ggagaccatggggaagctcg

SEQ ID NO: 135741 - DNA, 20 bp, human
gcattggaaacgccggactt

SEQ ID NO: 135742 - DNA, 20 bp, human
gggacaggccgacccccagc

SEQ ID NO: 135743 - DNA, 20 bp, human
gcggcgccgagagctctcgg

SEQ ID NO: 135744 - DNA, 20 bp, human
ggtcggcctgtccttagtcg

SEQ ID NO: 135745 - DNA, 20 bp, human
gagaggatcaggctaccagt

SEQ ID NO: 135746 - DNA, 20 bp, human
gcggctcccgcgccatgggg

SEQ ID NO: 135747 - DNA, 20 bp, human
gtacccaagggccaaactag

SEQ ID NO: 135748 - DNA, 20 bp, human
gtggccagcagctccgtggg

SEQ ID NO: 135749 - DNA, 20 bp, human
gcgggcgcgctgcctcgctc

SEQ ID NO: 135750 - DNA, 20 bp, human
ggcgctgcctcgctccggcc

SEQ ID NO: 135751 - DNA, 20 bp, human
gtgctggccaggccggagcg

SEQ ID NO: 135752 - DNA, 20 bp, human
gcaccatcgagccgggaaga

SEQ ID NO: 135753 - DNA, 20 bp, human
gaggcttctggcactcaggt

SEQ ID NO: 135754 - DNA, 20 bp, human
ggggaagatggcaccgccca

SEQ ID NO: 135755 - DNA, 20 bp, human
gcactagaagcggagagtcg

SEQ ID NO: 135756 - DNA, 20 bp, human
gtgggcaccccgagaccatg

SEQ ID NO: 135757 - DNA, 20 bp, human
gagcgccacgagcttcccca

SEQ ID NO: 135758 - DNA, 20 bp, human
gcatctccccgactaaggac

SEQ ID NO: 135759 - DNA, 20 bp, human
ggagcttccccatggtctcg

SEQ ID NO: 135760 - DNA, 20 bp, human
gcattggaaacgccggactt

SEQ ID NO: 135761 - DNA, 20 bp, human
gaggaacatctccccgacta

SEQ ID NO: 135762 - DNA, 20 bp, human
gcggcgccgagagctctcgg

SEQ ID NO: 135763 - DNA, 20 bp, human
gggacaggccgacccccagc

SEQ ID NO: 135764 - DNA, 20 bp, human
gtgagggcgagctgggaaag

SEQ ID NO: 135765 - DNA, 20 bp, human
ggtgcccagcggcgactgcg

SEQ ID NO: 135766 - DNA, 20 bp, human
gggcttgtcattctgacccg

SEQ ID NO: 135767 - DNA, 20 bp, human
ggacgctgtgaggaatcccc

SEQ ID NO: 135768 - DNA, 20 bp, human
gtcggtgggtactgtcgcgg

SEQ ID NO: 135769 - DNA, 20 bp, human
gggctcggtgggtactgtcg

SEQ ID NO: 135770 - DNA, 20 bp, human
gcgaaggagatgcgacacca

SEQ ID NO: 135771 - DNA, 20 bp, human
ggcaggaaagggaacacggg

SEQ ID NO: 135772 - DNA, 20 bp, human
gctggcaggttggtcgtgag

SEQ ID NO: 135773 - DNA, 20 bp, human
gcaacctgccagacgctgtg

SEQ ID NO: 135774 - DNA, 20 bp, human
gtggcgaccacgctgagatc

SEQ ID NO: 135775 - DNA, 20 bp, human
gccaggagctttggctcggt

SEQ ID NO: 135776 - DNA, 20 bp, human
gcatcagagagcgccggaag

SEQ ID NO: 135777 - DNA, 20 bp, human
ggtgtctacacgcccctcct

SEQ ID NO: 135778 - DNA, 20 bp, human
ggtaagcggggccgcgaagt

SEQ ID NO: 135779 - DNA, 20 bp, human
gggggccgcgaagttggaga

SEQ ID NO: 135780 - DNA, 20 bp, human
ggaagacatgtgccaaggag

SEQ ID NO: 135781 - DNA, 20 bp, human
ggcgctctctgatgacgcac

SEQ ID NO: 135782 - DNA, 20 bp, human
gtggaggcaggttctcccgg

SEQ ID NO: 135783 - DNA, 20 bp, human
gacatccctccctagctcag

SEQ ID NO: 135784 - DNA, 20 bp, human
gtccgagaatgaagagtaag

SEQ ID NO: 135785 - DNA, 20 bp, human
ggcgaagttggagagggttg

SEQ ID NO: 135786 - DNA, 20 bp, human
gcatggtgcggttcaagcac

SEQ ID NO: 135787 - DNA, 20 bp, human
gcacgccggaccggagagcg

SEQ ID NO: 135788 - DNA, 20 bp, human
ggcctccgcgctctccggtc

SEQ ID NO: 135789 - DNA, 20 bp, human
gggcactgggagggtctgga

SEQ ID NO: 135790 - DNA, 20 bp, human
gggcgatcgtgtcccgtacg

SEQ ID NO: 135791 - DNA, 20 bp, human
ggctaaaaggaggggcccga

SEQ ID NO: 135792 - DNA, 20 bp, human
gagcagagcgctaaaaggag

SEQ ID NO: 135793 - DNA, 20 bp, human
gttcgcagagcaggtacctg

SEQ ID NO: 135794 - DNA, 20 bp, human
gtacgaggctgctcagaact

SEQ ID NO: 135795 - DNA, 20 bp, human
ggcgcagccgcctgctccat

SEQ ID NO: 135796 - DNA, 20 bp, human
gcccgttcaggaccccggcg

SEQ ID NO: 135797 - DNA, 20 bp, human
gcgggcctcgcgcgcctgga

SEQ ID NO: 135798 - DNA, 20 bp, human
gaagcagccagccagctcgt

SEQ ID NO: 135799 - DNA, 20 bp, human
gtaattacccgggccgaggg

SEQ ID NO: 135800 - DNA, 20 bp, human
ggggcagggcgcccacgagc

SEQ ID NO: 135801 - DNA, 20 bp, human
gcccgcgccggggtcctgaa

SEQ ID NO: 135802 - DNA, 20 bp, human
gagggcgcccacgagctggc

SEQ ID NO: 135803 - DNA, 20 bp, human
gaagagagtaagcacgggag

SEQ ID NO: 135804 - DNA, 20 bp, human
ggtgagtgggagaggacgag

SEQ ID NO: 135805 - DNA, 20 bp, human
gagagtaagcacgggagggg

SEQ ID NO: 135806 - DNA, 20 bp, human
ggtcggtagtgagaagccgg

SEQ ID NO: 135807 - DNA, 20 bp, human
gctagaaggaatgcttccgg

SEQ ID NO: 135808 - DNA, 20 bp, human
gcatgaagcccaggagtaag

SEQ ID NO: 135809 - DNA, 20 bp, human
gcttctaggaaaggtggagt

SEQ ID NO: 135810 - DNA, 20 bp, human
ggaatgaggagagccagcat

SEQ ID NO: 135811 - DNA, 20 bp, human
gtcaggggtcttctcacctc

SEQ ID NO: 135812 - DNA, 20 bp, human
gctcacgcaggcggtatacc

SEQ ID NO: 135813 - DNA, 20 bp, human
gtactcctgggcttcatggg

SEQ ID NO: 135814 - DNA, 20 bp, human
gcaagggaaagtagcactac

SEQ ID NO: 135815 - DNA, 20 bp, human
gcattccttcccaaagccac

SEQ ID NO: 135816 - DNA, 20 bp, human
gcggcgaggcactcacgagg

SEQ ID NO: 135817 - DNA, 20 bp, human
gcccagggcgcggagttgac

SEQ ID NO: 135818 - DNA, 20 bp, human
gctcacagctcggaggtcta

SEQ ID NO: 135819 - DNA, 20 bp, human
gtgacaagggcccctaggaa

SEQ ID NO: 135820 - DNA, 20 bp, human
gattcgcccagaagcctcta

SEQ ID NO: 135821 - DNA, 20 bp, human
ggtcgccgctcacagctcgg

SEQ ID NO: 135822 - DNA, 20 bp, human
gggcggagcgcgcttgaccc

SEQ ID NO: 135823 - DNA, 20 bp, human
ggggcgcagcgtgaccgcag

SEQ ID NO: 135824 - DNA, 20 bp, human
gtacgactcgcgttcttcag

SEQ ID NO: 135825 - DNA, 20 bp, human
ggcccgcagaagtttcccgg

SEQ ID NO: 135826 - DNA, 20 bp, human
gaacaaacaactcacgaatc

SEQ ID NO: 135827 - DNA, 20 bp, human
gtgagtagaagtgaaactat

SEQ ID NO: 135828 - DNA, 20 bp, human
gttataaaggatggagcact

SEQ ID NO: 135829 - DNA, 20 bp, human
gggctccctgttataaagga

SEQ ID NO: 135830 - DNA, 20 bp, human
gcagaggctccctgttataa

SEQ ID NO: 135831 - DNA, 20 bp, human
ggaaactgtagtgaaagtga

SEQ ID NO: 135832 - DNA, 20 bp, human
gcattaatttagacagtcag

SEQ ID NO: 135833 - DNA, 20 bp, human
gcgtgagttgtttgttgctc

SEQ ID NO: 135834 - DNA, 20 bp, human
gtgctccatcctttataaca

SEQ ID NO: 135835 - DNA, 20 bp, human
gagaaacttttctcttagtt

SEQ ID NO: 135836 - DNA, 20 bp, human
gagagcagccgggctgccag

SEQ ID NO: 135837 - DNA, 20 bp, human
gacgatgaatgggcctcggg

SEQ ID NO: 135838 - DNA, 20 bp, human
gcgcgggagatcagctctag

SEQ ID NO: 135839 - DNA, 20 bp, human
gaggcggccgcggtgaactg

SEQ ID NO: 135840 - DNA, 20 bp, human
gcgggaggcagcgaattctg

SEQ ID NO: 135841 - DNA, 20 bp, human
gttcgcggcgacggcggggt

SEQ ID NO: 135842 - DNA, 20 bp, human
gggcggtggtagcgcctcag

SEQ ID NO: 135843 - DNA, 20 bp, human
gggtcgggccccaagactcg

SEQ ID NO: 135844 - DNA, 20 bp, human
gcggcggggtgggtgaggtc

SEQ ID NO: 135845 - DNA, 20 bp, human
gcggtgagtgctatctttcg

SEQ ID NO: 135846 - DNA, 20 bp, human
ggtgccgccgcatccataca

SEQ ID NO: 135847 - DNA, 20 bp, human
gtagagtcgctctgagtgga

SEQ ID NO: 135848 - DNA, 20 bp, human
gacatagcctgagggagagt

SEQ ID NO: 135849 - DNA, 20 bp, human
ggcctgagggagagtcggaa

SEQ ID NO: 135850 - DNA, 20 bp, human
ggagagtcggaaaggtgatg

SEQ ID NO: 135851 - DNA, 20 bp, human
ggcactactggcgacctacc

SEQ ID NO: 135852 - DNA, 20 bp, human
gcgacgggaaggggaatccc

SEQ ID NO: 135853 - DNA, 20 bp, human
ggggattctgtgacacttgg

SEQ ID NO: 135854 - DNA, 20 bp, human
gccgctcgccgcgccgctct

SEQ ID NO: 135855 - DNA, 20 bp, human
gccccgcaggccgcaaggcc

SEQ ID NO: 135856 - DNA, 20 bp, human
ggcctcgatgggaggaatgt

SEQ ID NO: 135857 - DNA, 20 bp, human
gcagcacgaggtagcacagg

SEQ ID NO: 135858 - DNA, 20 bp, human
gggaggaggtagaaccctct

SEQ ID NO: 135859 - DNA, 20 bp, human
gactgttgtaggacaggagg

SEQ ID NO: 135860 - DNA, 20 bp, human
gctgtcctacaacagtctca

SEQ ID NO: 135861 - DNA, 20 bp, human
gtcggcagaggaacagcacg

SEQ ID NO: 135862 - DNA, 20 bp, human
gatgggaggaatgtcggcag

SEQ ID NO: 135863 - DNA, 20 bp, human
gctgaagcatgcaagcaccg

SEQ ID NO: 135864 - DNA, 20 bp, human
gtaagggacaggttgggcat

SEQ ID NO: 135865 - DNA, 20 bp, human
gaggaagacgcctcgatggg

SEQ ID NO: 135866 - DNA, 20 bp, human
gcttcggggactaactgcaa

SEQ ID NO: 135867 - DNA, 20 bp, human
gtatcaggggtcgggaccaa

SEQ ID NO: 135868 - DNA, 20 bp, human
ggttagtccccgaagagaac

SEQ ID NO: 135869 - DNA, 20 bp, human
ggagaaaacatgggtaaaaa

SEQ ID NO: 135870 - DNA, 20 bp, human
gattaggaaaaaaaaccctg

SEQ ID NO: 135871 - DNA, 20 bp, human
gcccgaagagaactggcagt

SEQ ID NO: 135872 - DNA, 20 bp, human
gtggctcatagtcgtatcag

SEQ ID NO: 135873 - DNA, 20 bp, human
gcaagggtaagtgagtggtt

SEQ ID NO: 135874 - DNA, 20 bp, human
gtaattaacacaatttagct

SEQ ID NO: 135875 - DNA, 20 bp, human
gatgattgttggcgtttata

SEQ ID NO: 135876 - DNA, 20 bp, human
gctgtggaggtgccactaat

SEQ ID NO: 135877 - DNA, 20 bp, human
gctttaggtaagcctattag

SEQ ID NO: 135878 - DNA, 20 bp, human
gcatggagggatttctctgc

SEQ ID NO: 135879 - DNA, 20 bp, human
gtgctggcttgatgatctcg

SEQ ID NO: 135880 - DNA, 20 bp, human
gcacagagaatgagagctat

SEQ ID NO: 135881 - DNA, 20 bp, human
gtcataggcggtatcccaaa

SEQ ID NO: 135882 - DNA, 20 bp, human
gttgttttaacttttcatgg

SEQ ID NO: 135883 - DNA, 20 bp, human
gaggcattcagtctcctatg

SEQ ID NO: 135884 - DNA, 20 bp, human
gtgaccttgtcaagttttat

SEQ ID NO: 135885 - DNA, 20 bp, human
gatcttgttttaacttttca

SEQ ID NO: 135886 - DNA, 20 bp, human
ggtactctagaaagaaccct

SEQ ID NO: 135887 - DNA, 20 bp, human
ggcccgcctaaactcttcct

SEQ ID NO: 135888 - DNA, 20 bp, human
gatttagcgggtgaagggag

SEQ ID NO: 135889 - DNA, 20 bp, human
ggagtgggtgccagacgtaa

SEQ ID NO: 135890 - DNA, 20 bp, human
ggcatgcgtgcaggatccct

SEQ ID NO: 135891 - DNA, 20 bp, human
gaccctaggaagagtttagg

SEQ ID NO: 135892 - DNA, 20 bp, human
gcgggtgagtgaaatttgta

SEQ ID NO: 135893 - DNA, 20 bp, human
gagaaccctaggaagagttt

SEQ ID NO: 135894 - DNA, 20 bp, human
gcggtggaccagctgcgtaa

SEQ ID NO: 135895 - DNA, 20 bp, human
gatcccgggcccgttacgtc

SEQ ID NO: 135896 - DNA, 20 bp, human
gtaaaagcagatggtgactg

SEQ ID NO: 135897 - DNA, 20 bp, human
gtgcttttaacagcccgggg

SEQ ID NO: 135898 - DNA, 20 bp, human
ggaagaagccattcgatctc

SEQ ID NO: 135899 - DNA, 20 bp, human
gtcttgctcctgagatcgaa

SEQ ID NO: 135900 - DNA, 20 bp, human
gatctgcttttaacagcccg

SEQ ID NO: 135901 - DNA, 20 bp, human
gttccctgggtggggtggac

SEQ ID NO: 135902 - DNA, 20 bp, human
gctttcctggggtgggcgtt

SEQ ID NO: 135903 - DNA, 20 bp, human
gtggcgttagtcgctttgcc

SEQ ID NO: 135904 - DNA, 20 bp, human
gactaacgccaagccaagct

SEQ ID NO: 135905 - DNA, 20 bp, human
gcagcaaaggaatgcgaggg

SEQ ID NO: 135906 - DNA, 20 bp, human
ggcgccccgcacgcacatga

SEQ ID NO: 135907 - DNA, 20 bp, human
gagcgaagcgcacccattac

SEQ ID NO: 135908 - DNA, 20 bp, human
gccgcacgcacatgacggct

SEQ ID NO: 135909 - DNA, 20 bp, human
gggcttggcttacctgtaat

SEQ ID NO: 135910 - DNA, 20 bp, human
gggccaagccccccctccga

SEQ ID NO: 135911 - DNA, 20 bp, human
gccaactagcaggaaacctt

SEQ ID NO: 135912 - DNA, 20 bp, human
gctgggtgtttccttcggag

SEQ ID NO: 135913 - DNA, 20 bp, human
gaaaaattcaggcccagcaa

SEQ ID NO: 135914 - DNA, 20 bp, human
gtgaggcgggcgcgcgtgcg

SEQ ID NO: 135915 - DNA, 20 bp, human
ggcctttcctggggtgggcc

SEQ ID NO: 135916 - DNA, 20 bp, human
gtattggggctcactacccg

SEQ ID NO: 135917 - DNA, 20 bp, human
ggaagggagcggcatgctgg

SEQ ID NO: 135918 - DNA, 20 bp, human
gcagttggtggtgtcgacag

SEQ ID NO: 135919 - DNA, 20 bp, human
ggtaggagggcaaccagtag

SEQ ID NO: 135920 - DNA, 20 bp, human
gtggtggtgtcgacagtggt

SEQ ID NO: 135921 - DNA, 20 bp, human
gagtgtgggcgtttggtatc

SEQ ID NO: 135922 - DNA, 20 bp, human
ggtagaagggagcggcatgc

SEQ ID NO: 135923 - DNA, 20 bp, human
gacacaggcagtgcagcctc

SEQ ID NO: 135924 - DNA, 20 bp, human
gacagcaaggcgagccccag

SEQ ID NO: 135925 - DNA, 20 bp, human
gcctcagtaggtaaagcatg

SEQ ID NO: 135926 - DNA, 20 bp, human
gcaatccaaggaggaacacc

SEQ ID NO: 135927 - DNA, 20 bp, human
gttggcctggtgttcctcct

SEQ ID NO: 135928 - DNA, 20 bp, human
ggcccacgcccacccgagga

SEQ ID NO: 135929 - DNA, 20 bp, human
gtggtgttggtcgcttggcc

SEQ ID NO: 135930 - DNA, 20 bp, human
ggggttgggcttacctgctg

SEQ ID NO: 135931 - DNA, 20 bp, human
gtgacgtttcctccttggat

SEQ ID NO: 135932 - DNA, 20 bp, human
gtgcacgcgcatgctgcacg

SEQ ID NO: 135933 - DNA, 20 bp, human
ggaaaaggtcaagcctagca

SEQ ID NO: 135934 - DNA, 20 bp, human
gtctctcgcgttcccttgct

SEQ ID NO: 135935 - DNA, 20 bp, human
ggagaggaaacgccaatcca

SEQ ID NO: 135936 - DNA, 20 bp, human
gaggctctgaggcaccagga

SEQ ID NO: 135937 - DNA, 20 bp, human
gttggagactggtagacact

SEQ ID NO: 135938 - DNA, 20 bp, human
gcaggtagtgagaattgaat

SEQ ID NO: 135939 - DNA, 20 bp, human
ggtacctgtagacatcacat

SEQ ID NO: 135940 - DNA, 20 bp, human
gcactgtgatgcattatcag

SEQ ID NO: 135941 - DNA, 20 bp, human
gtggtggcatggttggagac

SEQ ID NO: 135942 - DNA, 20 bp, human
gatactagcgcgcaccctcc

SEQ ID NO: 135943 - DNA, 20 bp, human
gcactgttggctttgttgta

SEQ ID NO: 135944 - DNA, 20 bp, human
gcctgtagacatcacattgg

SEQ ID NO: 135945 - DNA, 20 bp, human
gaggaaggctctgaggcacc

SEQ ID NO: 135946 - DNA, 20 bp, human
gcaagcggtggctccactgg

SEQ ID NO: 135947 - DNA, 20 bp, human
gggagaaaccagcctgtcag

SEQ ID NO: 135948 - DNA, 20 bp, human
gcacaacaaaagccagatgt

SEQ ID NO: 135949 - DNA, 20 bp, human
gattaaagaagccaaactgt

SEQ ID NO: 135950 - DNA, 20 bp, human
ggcttctttaatgtgagacc

SEQ ID NO: 135951 - DNA, 20 bp, human
ggattcatgcacagaagcgg

SEQ ID NO: 135952 - DNA, 20 bp, human
ggaatcactgtggtgaagaa

SEQ ID NO: 135953 - DNA, 20 bp, human
gtccaaggtgggacggctca

SEQ ID NO: 135954 - DNA, 20 bp, human
gcctcctgtaaagaactgca

SEQ ID NO: 135955 - DNA, 20 bp, human
gcgaactagtgttccaaggt

SEQ ID NO: 135956 - DNA, 20 bp, human
gattattataattaacggcg

SEQ ID NO: 135957 - DNA, 20 bp, human
gaaatattcaaaatggcgga

SEQ ID NO: 135958 - DNA, 20 bp, human
ggatgagagttcagccgcgg

SEQ ID NO: 135959 - DNA, 20 bp, human
gtattcaaaatggcggacgg

SEQ ID NO: 135960 - DNA, 20 bp, human
gcaagatgagagttcagccg

SEQ ID NO: 135961 - DNA, 20 bp, human
gttcgggcacggcggcgagg

SEQ ID NO: 135962 - DNA, 20 bp, human
ggaggagggccggtgccgac

SEQ ID NO: 135963 - DNA, 20 bp, human
gccgctcgccgtctgcccgt

SEQ ID NO: 135964 - DNA, 20 bp, human
gccccgccgcggacccgctc

SEQ ID NO: 135965 - DNA, 20 bp, human
ggccgtgcccgaacccgagc

SEQ ID NO: 135966 - DNA, 20 bp, human
gagaagagctagtcacaggg

SEQ ID NO: 135967 - DNA, 20 bp, human
ggggtggaaagtggattaag

SEQ ID NO: 135968 - DNA, 20 bp, human
gatcagaagagctagtcaca

SEQ ID NO: 135969 - DNA, 20 bp, human
gttcttaagcgaaaagaggg

SEQ ID NO: 135970 - DNA, 20 bp, human
gattcagttgaagattgcta

SEQ ID NO: 135971 - DNA, 20 bp, human
ggaaaagaggggggttgcgt

SEQ ID NO: 135972 - DNA, 20 bp, human
gcagtgactatgttctaggt

SEQ ID NO: 135973 - DNA, 20 bp, human
gactagctcttctgattcag

SEQ ID NO: 135974 - DNA, 20 bp, human
gggagcagagagtccaaaca

SEQ ID NO: 135975 - DNA, 20 bp, human
gagaggggggttgcgtaggg

SEQ ID NO: 135976 - DNA, 20 bp, human
gagggctcggcccccagaga

SEQ ID NO: 135977 - DNA, 20 bp, human
gctcggcccccagagagggt

SEQ ID NO: 135978 - DNA, 20 bp, human
gcatgctgcccgccccgcca

SEQ ID NO: 135979 - DNA, 20 bp, human
gatggttcactccagcatgg

SEQ ID NO: 135980 - DNA, 20 bp, human
gaggcaccagcccccttacc

SEQ ID NO: 135981 - DNA, 20 bp, human
gggacccggcatgggagaga

SEQ ID NO: 135982 - DNA, 20 bp, human
gtgcctgatgtggaaagaga

SEQ ID NO: 135983 - DNA, 20 bp, human
gcctcatgtggagaaccagt

SEQ ID NO: 135984 - DNA, 20 bp, human
gccctgccggaagtcactca

SEQ ID NO: 135985 - DNA, 20 bp, human
ggtcctctgagcagtggcac

SEQ ID NO: 135986 - DNA, 20 bp, human
gagctagtagactacagagt

SEQ ID NO: 135987 - DNA, 20 bp, human
gctcaggtccctcaaatgaa

SEQ ID NO: 135988 - DNA, 20 bp, human
gcagttagatgagctagaat

SEQ ID NO: 135989 - DNA, 20 bp, human
gctcaaccctatacacaggt

SEQ ID NO: 135990 - DNA, 20 bp, human
gcccagccttctaagcctca

SEQ ID NO: 135991 - DNA, 20 bp, human
gcgttatctgataagagaag

SEQ ID NO: 135992 - DNA, 20 bp, human
ggggctggagtgagatagag

SEQ ID NO: 135993 - DNA, 20 bp, human
ggacctgaggcccacaagga

SEQ ID NO: 135994 - DNA, 20 bp, human
gccccctcaaccctatacac

SEQ ID NO: 135995 - DNA, 20 bp, human
gatacacaggtgggacttag

SEQ ID NO: 135996 - DNA, 20 bp, human
gacagtggcggcgacggctc

SEQ ID NO: 135997 - DNA, 20 bp, human
ggcagcggagcgcgcgacag

SEQ ID NO: 135998 - DNA, 20 bp, human
ggcggagcgcgcgacagtgg

SEQ ID NO: 135999 - DNA, 20 bp, human
gctgccactccccagaccgg

SEQ ID NO: 136000 - DNA, 20 bp, human
gggcggcggccgggaactgg

SEQ ID NO: 136001 - DNA, 20 bp, human
gaactggaggaaggagaccc

SEQ ID NO: 136002 - DNA, 20 bp, human
ggacaggtgtcactgcgcgt

SEQ ID NO: 136003 - DNA, 20 bp, human
gaaaccctggaaaagaatga

SEQ ID NO: 136004 - DNA, 20 bp, human
gggagaccctggcttcgcag

SEQ ID NO: 136005 - DNA, 20 bp, human
ggatctgggataagaaaccc

SEQ ID NO: 136006 - DNA, 20 bp, human
ggcccgcagacggagcggag

SEQ ID NO: 136007 - DNA, 20 bp, human
ggcggcccgcacctagaaca

SEQ ID NO: 136008 - DNA, 20 bp, human
gcgacatggccgggcccaag

SEQ ID NO: 136009 - DNA, 20 bp, human
ggcagcacagcgcaccactt

SEQ ID NO: 136010 - DNA, 20 bp, human
ggaagctgatgcaccacgag

SEQ ID NO: 136011 - DNA, 20 bp, human
gacgcgcgcctggtgcacca

SEQ ID NO: 136012 - DNA, 20 bp, human
ggcccacgcgggcgcggcat

SEQ ID NO: 136013 - DNA, 20 bp, human
gccggccgagccgacgacgg

SEQ ID NO: 136014 - DNA, 20 bp, human
gacccccagtggctacccac

SEQ ID NO: 136015 - DNA, 20 bp, human
ggcaccggccgagccgacga

SEQ ID NO: 136016 - DNA, 20 bp, human
ggcctggtgcagggcgacta

SEQ ID NO: 136017 - DNA, 20 bp, human
ggccggcgctgccaagagag

SEQ ID NO: 136018 - DNA, 20 bp, human
gtcaccgcgctgtcccacgg

SEQ ID NO: 136019 - DNA, 20 bp, human
gtggcagcgccggctcgcag

SEQ ID NO: 136020 - DNA, 20 bp, human
gtgcacgccgagccgcccgg

SEQ ID NO: 136021 - DNA, 20 bp, human
ggagcagcaacagaaggcgt

SEQ ID NO: 136022 - DNA, 20 bp, human
gggctcggcgtgcacgatgg

SEQ ID NO: 136023 - DNA, 20 bp, human
gccgccgccgtgggacagcg

SEQ ID NO: 136024 - DNA, 20 bp, human
gagtccggctccgagagtca

SEQ ID NO: 136025 - DNA, 20 bp, human
gtaccgcgaagcgcagagcc

SEQ ID NO: 136026 - DNA, 20 bp, human
ggcgagtagagcagactctg

SEQ ID NO: 136027 - DNA, 20 bp, human
gagtagagcagactctgcgg

SEQ ID NO: 136028 - DNA, 20 bp, human
gccatggccgccagcaacgg

SEQ ID NO: 136029 - DNA, 20 bp, human
gcgcagggccccgacgtgaa

SEQ ID NO: 136030 - DNA, 20 bp, human
ggctgttccccggcaggtag

SEQ ID NO: 136031 - DNA, 20 bp, human
gcggtaggcgcccgaggtca

SEQ ID NO: 136032 - DNA, 20 bp, human
gagggccccgacgtgaaggg

SEQ ID NO: 136033 - DNA, 20 bp, human
ggaggacgggtccccccggt

SEQ ID NO: 136034 - DNA, 20 bp, human
gctctggaccatcttgacag

SEQ ID NO: 136035 - DNA, 20 bp, human
ggcccccggccatggacggg

SEQ ID NO: 136036 - DNA, 20 bp, human
gagaatgctgtagggattcg

SEQ ID NO: 136037 - DNA, 20 bp, human
ggagtccgcatggactaggg

SEQ ID NO: 136038 - DNA, 20 bp, human
ggcagagtccgcatggacta

SEQ ID NO: 136039 - DNA, 20 bp, human
ggctgtggccatggtcggtg

SEQ ID NO: 136040 - DNA, 20 bp, human
gcccgcaccgtagatgtcaa

SEQ ID NO: 136041 - DNA, 20 bp, human
gagcctggcttcaccgtgag

SEQ ID NO: 136042 - DNA, 20 bp, human
gggccagtgtggaggaccat

SEQ ID NO: 136043 - DNA, 20 bp, human
gtccgcatggactagggagg

SEQ ID NO: 136044 - DNA, 20 bp, human
gtggaactgagaatgctgta

SEQ ID NO: 136045 - DNA, 20 bp, human
gaggggatcctcaccgacca

SEQ ID NO: 136046 - DNA, 20 bp, human
gggctggtgtgtgcaggtcc

SEQ ID NO: 136047 - DNA, 20 bp, human
gccgaaacgctgcatgtcgg

SEQ ID NO: 136048 - DNA, 20 bp, human
gcggcgctctgcgcggtcag

SEQ ID NO: 136049 - DNA, 20 bp, human
gctagagctgtcggagaagc

SEQ ID NO: 136050 - DNA, 20 bp, human
gcgcgcggggctagagctgt

SEQ ID NO: 136051 - DNA, 20 bp, human
gtcccggtgcggggaactgc

SEQ ID NO: 136052 - DNA, 20 bp, human
gttagaggagtgcatcccgt

SEQ ID NO: 136053 - DNA, 20 bp, human
ggacaaaacgtgcctcgctg

SEQ ID NO: 136054 - DNA, 20 bp, human
gggcgtggggcgcttaccgg

SEQ ID NO: 136055 - DNA, 20 bp, human
ggtgtgtgcaggtcccggtg

SEQ ID NO: 136056 - DNA, 20 bp, human
gtgccgaggtctgcagctag

SEQ ID NO: 136057 - DNA, 20 bp, human
ggccgacccgcgggacctgg

SEQ ID NO: 136058 - DNA, 20 bp, human
gtgccgctagctgcagacct

SEQ ID NO: 136059 - DNA, 20 bp, human
ggctagcggcaagcggagtc

SEQ ID NO: 136060 - DNA, 20 bp, human
gccgttcagactgacagcag

SEQ ID NO: 136061 - DNA, 20 bp, human
gcgagcaacgctggtggtgg

SEQ ID NO: 136062 - DNA, 20 bp, human
gggagcgcgtagccgagatc

SEQ ID NO: 136063 - DNA, 20 bp, human
gtcaggcgtacagagtccgg

SEQ ID NO: 136064 - DNA, 20 bp, human
gccggggcgctggtccgtag

SEQ ID NO: 136065 - DNA, 20 bp, human
ggcagctcgagcaacgctgg

SEQ ID NO: 136066 - DNA, 20 bp, human
ggaggagagacagcagctag

SEQ ID NO: 136067 - DNA, 20 bp, human
gacgcgccggggactcgcag

SEQ ID NO: 136068 - DNA, 20 bp, human
gaggagaggggttcagacag

SEQ ID NO: 136069 - DNA, 20 bp, human
ggcgccgggagagaacgcgg

SEQ ID NO: 136070 - DNA, 20 bp, human
gagagaacgcgggggagaca

SEQ ID NO: 136071 - DNA, 20 bp, human
gagggtggcagcgggtgaca

SEQ ID NO: 136072 - DNA, 20 bp, human
gcagcgggtgacatggaatc

SEQ ID NO: 136073 - DNA, 20 bp, human
ggcgcacagcacggtcagta

SEQ ID NO: 136074 - DNA, 20 bp, human
ggagcataattaccgctcta

SEQ ID NO: 136075 - DNA, 20 bp, human
ggcagcgctcacttggagag

SEQ ID NO: 136076 - DNA, 20 bp, human
gtggggaggtggtcatgaca

SEQ ID NO: 136077 - DNA, 20 bp, human
gaggcaagtgagcttcgacg

SEQ ID NO: 136078 - DNA, 20 bp, human
gtgaaatgagggcttgcgaa

SEQ ID NO: 136079 - DNA, 20 bp, human
ggaagctcacttgcctcctc

SEQ ID NO: 136080 - DNA, 20 bp, human
gaaggctagtgggtgggact

SEQ ID NO: 136081 - DNA, 20 bp, human
gcgcaagccctcatttcacc

SEQ ID NO: 136082 - DNA, 20 bp, human
ggtgagcttcgacggggttg

SEQ ID NO: 136083 - DNA, 20 bp, human
gcactagccccactccaacc

SEQ ID NO: 136084 - DNA, 20 bp, human
gcttcgacggggttggggtg

SEQ ID NO: 136085 - DNA, 20 bp, human
gccgggggcctggtgaaatg

SEQ ID NO: 136086 - DNA, 20 bp, human
gagcacagcagtaggaccag

SEQ ID NO: 136087 - DNA, 20 bp, human
gcaggcttagagggtaggta

SEQ ID NO: 136088 - DNA, 20 bp, human
gaaggtcaggcttagagggt

SEQ ID NO: 136089 - DNA, 20 bp, human
gcgatggaggttgcaagata

SEQ ID NO: 136090 - DNA, 20 bp, human
gcagggggatgcaagagcgg

SEQ ID NO: 136091 - DNA, 20 bp, human
ggggaggtctggggcgatgg

SEQ ID NO: 136092 - DNA, 20 bp, human
ggagcgagaagcacgatccc

SEQ ID NO: 136093 - DNA, 20 bp, human
gctcccaagaggcctcataa

SEQ ID NO: 136094 - DNA, 20 bp, human
gcgggtgctgagtagtaggg

SEQ ID NO: 136095 - DNA, 20 bp, human
ggaggttgcaagataaggtc

SEQ ID NO: 136096 - DNA, 20 bp, human
gagcccggctccgcccccca

SEQ ID NO: 136097 - DNA, 20 bp, human
gctcgccccctccaggcggt

SEQ ID NO: 136098 - DNA, 20 bp, human
ggtgggggtgatgggccatg

SEQ ID NO: 136099 - DNA, 20 bp, human
gcataattgctcatttcacc

SEQ ID NO: 136100 - DNA, 20 bp, human
ggggggacggtgcagggttc

SEQ ID NO: 136101 - DNA, 20 bp, human
gtgatgtcctgggacttctc

SEQ ID NO: 136102 - DNA, 20 bp, human
ggtggagagcaactccaatg

SEQ ID NO: 136103 - DNA, 20 bp, human
gcaaaacccggagaagtccc

SEQ ID NO: 136104 - DNA, 20 bp, human
gcgccgtatgagttatgtgg

SEQ ID NO: 136105 - DNA, 20 bp, human
gctgggttgatcctctgacc

SEQ ID NO: 136106 - DNA, 20 bp, human
gcgccgccagaggacatctc

SEQ ID NO: 136107 - DNA, 20 bp, human
gtgtccggccatgggtggaa

SEQ ID NO: 136108 - DNA, 20 bp, human
ggcctgtgtccggccatggg

SEQ ID NO: 136109 - DNA, 20 bp, human
gcacccgcagcggctctggt

SEQ ID NO: 136110 - DNA, 20 bp, human
gtaggaactgatggccctcg

SEQ ID NO: 136111 - DNA, 20 bp, human
gggtggaatggcacccgcag

SEQ ID NO: 136112 - DNA, 20 bp, human
gatcggcctgcgagtaccct

SEQ ID NO: 136113 - DNA, 20 bp, human
gagggcctgtgtccggccat

SEQ ID NO: 136114 - DNA, 20 bp, human
ggtactcgcaggccgatgtg

SEQ ID NO: 136115 - DNA, 20 bp, human
ggcgggtgccattccaccca

SEQ ID NO: 136116 - DNA, 20 bp, human
gctcgggctccggtaagtag

SEQ ID NO: 136117 - DNA, 20 bp, human
gcccggaccccgctacttac

SEQ ID NO: 136118 - DNA, 20 bp, human
gaaatccaagtagcagaagg

SEQ ID NO: 136119 - DNA, 20 bp, human
gcccgcggcgaaggcggctc

SEQ ID NO: 136120 - DNA, 20 bp, human
gggtggccgccagacacccg

SEQ ID NO: 136121 - DNA, 20 bp, human
gggctgggcagagccgaagg

SEQ ID NO: 136122 - DNA, 20 bp, human
gtagcctgcggagccccctt

SEQ ID NO: 136123 - DNA, 20 bp, human
ggagatgaatctctaatcgg

SEQ ID NO: 136124 - DNA, 20 bp, human
ggcgcgggcggtgcagcatg

SEQ ID NO: 136125 - DNA, 20 bp, human
ggcagacaaagaagccagtg

SEQ ID NO: 136126 - DNA, 20 bp, human
gcataagctgtatccatggg

SEQ ID NO: 136127 - DNA, 20 bp, human
gataatgatccaagaggaag

SEQ ID NO: 136128 - DNA, 20 bp, human
ggtggaaatttcctattggt

SEQ ID NO: 136129 - DNA, 20 bp, human
ggcagcacatcagagcataa

SEQ ID NO: 136130 - DNA, 20 bp, human
ggttcttataatgatccaag

SEQ ID NO: 136131 - DNA, 20 bp, human
gatttgtggaaatttcctat

SEQ ID NO: 136132 - DNA, 20 bp, human
ggtcaaatacgtaaacagta

SEQ ID NO: 136133 - DNA, 20 bp, human
gagagatatatagtcaatgt

SEQ ID NO: 136134 - DNA, 20 bp, human
gcattttaaaaaggtagatg

SEQ ID NO: 136135 - DNA, 20 bp, human
gcaaactgtaatgccaccca

SEQ ID NO: 136136 - DNA, 20 bp, human
gtggtgatgatagcgatggt

SEQ ID NO: 136137 - DNA, 20 bp, human
gagctctaccatcaagtgag

SEQ ID NO: 136138 - DNA, 20 bp, human
gtcagaataagagcatagag

SEQ ID NO: 136139 - DNA, 20 bp, human
ggggcattcccctcacttga

SEQ ID NO: 136140 - DNA, 20 bp, human
gttggagaaatagaggccag

SEQ ID NO: 136141 - DNA, 20 bp, human
gtgtagtgaacattccacac

SEQ ID NO: 136142 - DNA, 20 bp, human
gactcaagttggagaaatag

SEQ ID NO: 136143 - DNA, 20 bp, human
gcatctgataattaagaaag

SEQ ID NO: 136144 - DNA, 20 bp, human
gtgtagatataattactcat

SEQ ID NO: 136145 - DNA, 20 bp, human
gggaattcctcttttgtata

SEQ ID NO: 136146 - DNA, 20 bp, human
gcacgcggcgccgactgaca

SEQ ID NO: 136147 - DNA, 20 bp, human
gaggactccggcactatgag

SEQ ID NO: 136148 - DNA, 20 bp, human
gagcggcggcggcaggactc

SEQ ID NO: 136149 - DNA, 20 bp, human
gggcccgcgtcggagacctg

SEQ ID NO: 136150 - DNA, 20 bp, human
gagagccaccagcccgcacg

SEQ ID NO: 136151 - DNA, 20 bp, human
gcccaggttcgggtaccccg

SEQ ID NO: 136152 - DNA, 20 bp, human
gcgcactgcgagcactggac

SEQ ID NO: 136153 - DNA, 20 bp, human
ggtcggcgccgcgtgcgggc

SEQ ID NO: 136154 - DNA, 20 bp, human
gtcaccgacccaccctagaa

SEQ ID NO: 136155 - DNA, 20 bp, human
gctcgcagtgcgcaggcgtg

SEQ ID NO: 136156 - DNA, 20 bp, human
gtgtgcgcgcggagctacct

SEQ ID NO: 136157 - DNA, 20 bp, human
gcgccgctcggcgaacctcc

SEQ ID NO: 136158 - DNA, 20 bp, human
gcccaaccgcaggcacgcag

SEQ ID NO: 136159 - DNA, 20 bp, human
gaccccaaagcggagagcag

SEQ ID NO: 136160 - DNA, 20 bp, human
gtgcactggtccccaaccgc

SEQ ID NO: 136161 - DNA, 20 bp, human
gcggcgcaccggagaaacct

SEQ ID NO: 136162 - DNA, 20 bp, human
ggcactctgcctacccctcg

SEQ ID NO: 136163 - DNA, 20 bp, human
gtgctgcggctgctgcgcac

SEQ ID NO: 136164 - DNA, 20 bp, human
gcgcgacccggtccctgcac

SEQ ID NO: 136165 - DNA, 20 bp, human
gagaactgccagcgaggagg

SEQ ID NO: 136166 - DNA, 20 bp, human
gtgcgcagcgccggaagcgg

SEQ ID NO: 136167 - DNA, 20 bp, human
gcacggcgtgggacgacatc

SEQ ID NO: 136168 - DNA, 20 bp, human
gcagcagcatgggacagtca

SEQ ID NO: 136169 - DNA, 20 bp, human
gtaaggcccggcagcttggg

SEQ ID NO: 136170 - DNA, 20 bp, human
gcgaagactaggccgagggt

SEQ ID NO: 136171 - DNA, 20 bp, human
gagctgcgcagcgccggaag

SEQ ID NO: 136172 - DNA, 20 bp, human
ggtggaggacacagcagcat

SEQ ID NO: 136173 - DNA, 20 bp, human
ggctcccgctgtaaaactgt

SEQ ID NO: 136174 - DNA, 20 bp, human
ggcccagcaaaagccctgaa

SEQ ID NO: 136175 - DNA, 20 bp, human
gagtcagggagggtaaggcc

SEQ ID NO: 136176 - DNA, 20 bp, human
gtgttcacgcgaggctgcac

SEQ ID NO: 136177 - DNA, 20 bp, human
gctgcacgggtcgcaacatc

SEQ ID NO: 136178 - DNA, 20 bp, human
gcagcagcatgggacagtca

SEQ ID NO: 136179 - DNA, 20 bp, human
gtaaggcccggcagcttggg

SEQ ID NO: 136180 - DNA, 20 bp, human
gcgaagactaggccgagggt

SEQ ID NO: 136181 - DNA, 20 bp, human
gagctgcgcagcgccggaag

SEQ ID NO: 136182 - DNA, 20 bp, human
ggtggaggacacagcagcat

SEQ ID NO: 136183 - DNA, 20 bp, human
ggctcccgctgtaaaactgt

SEQ ID NO: 136184 - DNA, 20 bp, human
ggcccagcaaaagccctgaa

SEQ ID NO: 136185 - DNA, 20 bp, human
gagtcagggagggtaaggcc

SEQ ID NO: 136186 - DNA, 20 bp, human
gtccggacggggagcaaccg

SEQ ID NO: 136187 - DNA, 20 bp, human
ggcacatcgagggccacgta

SEQ ID NO: 136188 - DNA, 20 bp, human
gacgcgccgccgggtccgag

SEQ ID NO: 136189 - DNA, 20 bp, human
ggagcgccgggatccggacg

SEQ ID NO: 136190 - DNA, 20 bp, human
gtcccggcgctctctcccac

SEQ ID NO: 136191 - DNA, 20 bp, human
ggcccgggctcgagaatcaa

SEQ ID NO: 136192 - DNA, 20 bp, human
gacacgcccctcggacccgg

SEQ ID NO: 136193 - DNA, 20 bp, human
ggcctcaggacctcctcagc

SEQ ID NO: 136194 - DNA, 20 bp, human
ggtctggacgccccgcctgt

SEQ ID NO: 136195 - DNA, 20 bp, human
gggaggaggagagcagccga

SEQ ID NO: 136196 - DNA, 20 bp, human
gtcccggagagcaagaacgg

SEQ ID NO: 136197 - DNA, 20 bp, human
gaaccagctgcggaggaagg

SEQ ID NO: 136198 - DNA, 20 bp, human
ggaagaggcagaagaggtcg

SEQ ID NO: 136199 - DNA, 20 bp, human
ggctcaacaacaacccgagg

SEQ ID NO: 136200 - DNA, 20 bp, human
gctcggccaggaggcgaccc

SEQ ID NO: 136201 - DNA, 20 bp, human
gggcgctcaacaacaacccg

SEQ ID NO: 136202 - DNA, 20 bp, human
gtacgacaaagcgatcgtcc

SEQ ID NO: 136203 - DNA, 20 bp, human
ggcgcagctcccattcatta

SEQ ID NO: 136204 - DNA, 20 bp, human
gcaccaccttctgcagttgg

SEQ ID NO: 136205 - DNA, 20 bp, human
gaggctgctgcggatagtgg

SEQ ID NO: 136206 - DNA, 20 bp, human
gcgcggggaccatgcagcgg

SEQ ID NO: 136207 - DNA, 20 bp, human
gcgacgggacgcgctgggac

SEQ ID NO: 136208 - DNA, 20 bp, human
ggtccctccgaggaccctgg

SEQ ID NO: 136209 - DNA, 20 bp, human
gagcgggagcgcccacccca

SEQ ID NO: 136210 - DNA, 20 bp, human
ggcctgggaggtgagtcacg

SEQ ID NO: 136211 - DNA, 20 bp, human
gcagcaggaagtctgtgcgg

SEQ ID NO: 136212 - DNA, 20 bp, human
ggcgctgggaccggcgtcgg

SEQ ID NO: 136213 - DNA, 20 bp, human
gtccgcgccacgtgactccg

SEQ ID NO: 136214 - DNA, 20 bp, human
gcccaacacccgggtcccca

SEQ ID NO: 136215 - DNA, 20 bp, human
gactcacctcccaggccagg

SEQ ID NO: 136216 - DNA, 20 bp, human
gcgtcagctggtgctctccg

SEQ ID NO: 136217 - DNA, 20 bp, human
gagaaggagaaacttcccga

SEQ ID NO: 136218 - DNA, 20 bp, human
gcggctcgccagaccctggg

SEQ ID NO: 136219 - DNA, 20 bp, human
gggctgcgcaaactaagtta

SEQ ID NO: 136220 - DNA, 20 bp, human
ggcgcgggcccggtgagacc

SEQ ID NO: 136221 - DNA, 20 bp, human
gagggctgcacctctaaaca

SEQ ID NO: 136222 - DNA, 20 bp, human
gggccagctcccgcatggtg

SEQ ID NO: 136223 - DNA, 20 bp, human
gggtgcgcgtccctgtttag

SEQ ID NO: 136224 - DNA, 20 bp, human
gccccgcaccacctgcccgg

SEQ ID NO: 136225 - DNA, 20 bp, human
ggctcgcaccccgatctcaa

SEQ ID NO: 136226 - DNA, 20 bp, human
gcagcgcacagcagcggagt

SEQ ID NO: 136227 - DNA, 20 bp, human
gacactcgagccctaggagg

SEQ ID NO: 136228 - DNA, 20 bp, human
gtaaacactcgagccctagg

SEQ ID NO: 136229 - DNA, 20 bp, human
gtggcctttggggccgaagt

SEQ ID NO: 136230 - DNA, 20 bp, human
gacgcccacttcggccccaa

SEQ ID NO: 136231 - DNA, 20 bp, human
gccctacaaaggccgtctcg

SEQ ID NO: 136232 - DNA, 20 bp, human
gggaacccagcgcacagcag

SEQ ID NO: 136233 - DNA, 20 bp, human
ggctcgcggccggatgggga

SEQ ID NO: 136234 - DNA, 20 bp, human
ggggcagtgggtccctacaa

SEQ ID NO: 136235 - DNA, 20 bp, human
ggcgagccgcacgcccactt

SEQ ID NO: 136236 - DNA, 20 bp, human
gacctggccggaccaaacag

SEQ ID NO: 136237 - DNA, 20 bp, human
ggtccctccatgctcctccg

SEQ ID NO: 136238 - DNA, 20 bp, human
gtgcgatgccaagtccccgg

SEQ ID NO: 136239 - DNA, 20 bp, human
gcggccaggtcccgggatcc

SEQ ID NO: 136240 - DNA, 20 bp, human
gagctgcgatgccaagtccc

SEQ ID NO: 136241 - DNA, 20 bp, human
gagctggcggcccggatccc

SEQ ID NO: 136242 - DNA, 20 bp, human
ggacttggcatcgcagctgg

SEQ ID NO: 136243 - DNA, 20 bp, human
gcgggagagagctcgtcgtg

SEQ ID NO: 136244 - DNA, 20 bp, human
gtgaagctgctggagatctc

SEQ ID NO: 136245 - DNA, 20 bp, human
gcgcagggcgatgcccagga

SEQ ID NO: 136246 - DNA, 20 bp, human
gcaccagcagagcctccggg

SEQ ID NO: 136247 - DNA, 20 bp, human
gtggactcctcacctcccgg

SEQ ID NO: 136248 - DNA, 20 bp, human
ggctccgggccccccttggg

SEQ ID NO: 136249 - DNA, 20 bp, human
ggctggtgcaggccccgcat

SEQ ID NO: 136250 - DNA, 20 bp, human
gtgaaccagccccccaaggg

SEQ ID NO: 136251 - DNA, 20 bp, human
ggccacggcatcccctggat

SEQ ID NO: 136252 - DNA, 20 bp, human
gacggcatcccctggatcgg

SEQ ID NO: 136253 - DNA, 20 bp, human
ggtgcaggccccgcattgga

SEQ ID NO: 136254 - DNA, 20 bp, human
gggcagccaggccgcagctg

SEQ ID NO: 136255 - DNA, 20 bp, human
ggctccatggtcaagctcat

SEQ ID NO: 136256 - DNA, 20 bp, human
ggggcgaacgccgaaggagg

SEQ ID NO: 136257 - DNA, 20 bp, human
gcgcgcagcgccaaacccca

SEQ ID NO: 136258 - DNA, 20 bp, human
gtgcccggaacccgagtccg

SEQ ID NO: 136259 - DNA, 20 bp, human
gcggcgttcgccccacggac

SEQ ID NO: 136260 - DNA, 20 bp, human
gcagggacagccgcggactc

SEQ ID NO: 136261 - DNA, 20 bp, human
ggcccccagcgctaggaggg

SEQ ID NO: 136262 - DNA, 20 bp, human
gactcttgcgagggatctcg

SEQ ID NO: 136263 - DNA, 20 bp, human
gtgcgcggctggggacctga

SEQ ID NO: 136264 - DNA, 20 bp, human
gcaaaccccagggacagccg

SEQ ID NO: 136265 - DNA, 20 bp, human
gccaggtcccgggacccgga

SEQ ID NO: 136266 - DNA, 20 bp, human
gcaagagggggcaaagagta

SEQ ID NO: 136267 - DNA, 20 bp, human
gcgcggacctggggattaat

SEQ ID NO: 136268 - DNA, 20 bp, human
gcgcggagcgtgtgacgctg

SEQ ID NO: 136269 - DNA, 20 bp, human
gcagaaacgggtgaaggaag

SEQ ID NO: 136270 - DNA, 20 bp, human
ggggtccgcggacagcgtca

SEQ ID NO: 136271 - DNA, 20 bp, human
gagaagactctcgctagata

SEQ ID NO: 136272 - DNA, 20 bp, human
gagacggggttctcacaagt

SEQ ID NO: 136273 - DNA, 20 bp, human
gggcccccgggcctgagacg

SEQ ID NO: 136274 - DNA, 20 bp, human
gagcagctatgggggtccaa

SEQ ID NO: 136275 - DNA, 20 bp, human
gcgaagccaccaggcccaag

SEQ ID NO: 136276 - DNA, 20 bp, human
ggagtgagccaactcaccta

SEQ ID NO: 136277 - DNA, 20 bp, human
ggccaactcacctaaggaaa

SEQ ID NO: 136278 - DNA, 20 bp, human
gtcagtggtaggtaaggaag

SEQ ID NO: 136279 - DNA, 20 bp, human
gataaggtcagtggtaggta

SEQ ID NO: 136280 - DNA, 20 bp, human
gcacttgggtcataggctaa

SEQ ID NO: 136281 - DNA, 20 bp, human
gaagcagaatgcagaaatgc

SEQ ID NO: 136282 - DNA, 20 bp, human
gaaggggccttaacctctgc

SEQ ID NO: 136283 - DNA, 20 bp, human
gcgaatgacagaaacagttg

SEQ ID NO: 136284 - DNA, 20 bp, human
gtgcttaattccctttcctt

SEQ ID NO: 136285 - DNA, 20 bp, human
ggcctatgacccaagtgaat

SEQ ID NO: 136286 - DNA, 20 bp, human
ggaactgacggggtcccaga

SEQ ID NO: 136287 - DNA, 20 bp, human
gtggccgcaggtcagagtac

SEQ ID NO: 136288 - DNA, 20 bp, human
gacccaagcgccccaggcgg

SEQ ID NO: 136289 - DNA, 20 bp, human
gggctcgcgtccactcgagt

SEQ ID NO: 136290 - DNA, 20 bp, human
gctaccggagcgcgcactag

SEQ ID NO: 136291 - DNA, 20 bp, human
ggcggcgtggcgcccctctc

SEQ ID NO: 136292 - DNA, 20 bp, human
gcctcgaggacaccggagag

SEQ ID NO: 136293 - DNA, 20 bp, human
ggggtcggcctcgaggacac

SEQ ID NO: 136294 - DNA, 20 bp, human
gcctggaagccgggacgcac

SEQ ID NO: 136295 - DNA, 20 bp, human
gctctgacctgcggccacgg

SEQ ID NO: 136296 - DNA, 20 bp, human
gggagccaggaaagtagtcc

SEQ ID NO: 136297 - DNA, 20 bp, human
gccaggccactaaacaccac

SEQ ID NO: 136298 - DNA, 20 bp, human
ggtgacatcgaggtgagctg

SEQ ID NO: 136299 - DNA, 20 bp, human
gctggggactgtagtaagac

SEQ ID NO: 136300 - DNA, 20 bp, human
gttcagttcactctcagtaa

SEQ ID NO: 136301 - DNA, 20 bp, human
gggagttgaaaaagcttgac

SEQ ID NO: 136302 - DNA, 20 bp, human
gacagagcacacactcatgc

SEQ ID NO: 136303 - DNA, 20 bp, human
gcaggaataatagcatctga

SEQ ID NO: 136304 - DNA, 20 bp, human
gtattcctgtaaggggggat

SEQ ID NO: 136305 - DNA, 20 bp, human
gttcaggagctggatggcgt

SEQ ID NO: 136306 - DNA, 20 bp, human
ggagggaacactcacaacaa

SEQ ID NO: 136307 - DNA, 20 bp, human
gtactggtatcatgagatga

SEQ ID NO: 136308 - DNA, 20 bp, human
gatgttggggttatcatcta

SEQ ID NO: 136309 - DNA, 20 bp, human
gtttactgcagtgcaaatac

SEQ ID NO: 136310 - DNA, 20 bp, human
gtggtcctcgcatttcctta

SEQ ID NO: 136311 - DNA, 20 bp, human
ggaggctttatgctattggt

SEQ ID NO: 136312 - DNA, 20 bp, human
gaatgaatgacacacatgtt

SEQ ID NO: 136313 - DNA, 20 bp, human
gtttgaaagtgagtatcagg

SEQ ID NO: 136314 - DNA, 20 bp, human
gcaatagcataaagcctcct

SEQ ID NO: 136315 - DNA, 20 bp, human
gagctccttaaggaaatgcg

SEQ ID NO: 136316 - DNA, 20 bp, human
gagatggcggggaacgactg

SEQ ID NO: 136317 - DNA, 20 bp, human
gggtaacggagcgcatcgca

SEQ ID NO: 136318 - DNA, 20 bp, human
gccccgcgggcaaaactggg

SEQ ID NO: 136319 - DNA, 20 bp, human
gctgagggtaccccacaccg

SEQ ID NO: 136320 - DNA, 20 bp, human
gagatagttgaggaagaagg

SEQ ID NO: 136321 - DNA, 20 bp, human
gtgcagccgcggctggaaga

SEQ ID NO: 136322 - DNA, 20 bp, human
ggcacccagcgccagcctga

SEQ ID NO: 136323 - DNA, 20 bp, human
ggcacgcgccgggagacctc

SEQ ID NO: 136324 - DNA, 20 bp, human
ggccagcgagcgagcaaggg

SEQ ID NO: 136325 - DNA, 20 bp, human
gagacacggcgcaggaaagt

SEQ ID NO: 136326 - DNA, 20 bp, human
gacaggctcttccttcccga

SEQ ID NO: 136327 - DNA, 20 bp, human
ggagggagagagcccctaaa

SEQ ID NO: 136328 - DNA, 20 bp, human
gttgcctaggcgtgcacgag

SEQ ID NO: 136329 - DNA, 20 bp, human
ggtactggcttaggtcggag

SEQ ID NO: 136330 - DNA, 20 bp, human
ggatgggtgcacacaccggg

SEQ ID NO: 136331 - DNA, 20 bp, human
gggcaggtactggcttaggt

SEQ ID NO: 136332 - DNA, 20 bp, human
ggtgcccctcgtgcacgcct

SEQ ID NO: 136333 - DNA, 20 bp, human
gagcccctaaaaggcataag

SEQ ID NO: 136334 - DNA, 20 bp, human
ggcagcaccggtgagcaaca

SEQ ID NO: 136335 - DNA, 20 bp, human
gcaggacaggctaaagttca

SEQ ID NO: 136336 - DNA, 20 bp, human
gccagaagacctctgagtga

SEQ ID NO: 136337 - DNA, 20 bp, human
ggcaactcaccctcactcag

SEQ ID NO: 136338 - DNA, 20 bp, human
gtggccctctccagccccaa

SEQ ID NO: 136339 - DNA, 20 bp, human
ggtgtgctgggcaatcttct

SEQ ID NO: 136340 - DNA, 20 bp, human
gtggcgaaaggcaaaggtag

SEQ ID NO: 136341 - DNA, 20 bp, human
gaggggtggtatcaagtctg

SEQ ID NO: 136342 - DNA, 20 bp, human
gtctgcaaataagagacctg

SEQ ID NO: 136343 - DNA, 20 bp, human
gggacaaactaagagaaact

SEQ ID NO: 136344 - DNA, 20 bp, human
ggcacctgcaaggcatgaag

SEQ ID NO: 136345 - DNA, 20 bp, human
gtagtctttaccccagagac

SEQ ID NO: 136346 - DNA, 20 bp, human
ggcctggcgcgggtgagcag

SEQ ID NO: 136347 - DNA, 20 bp, human
ggcgcgggtgagcagtggaa

SEQ ID NO: 136348 - DNA, 20 bp, human
gctgggaagctgggttctcg

SEQ ID NO: 136349 - DNA, 20 bp, human
gggaagctgggttctcgcgg

SEQ ID NO: 136350 - DNA, 20 bp, human
gccgtacagccgggaaagtg

SEQ ID NO: 136351 - DNA, 20 bp, human
ggggccgctcccaaatatcg

SEQ ID NO: 136352 - DNA, 20 bp, human
gggctacttccaacatccca

SEQ ID NO: 136353 - DNA, 20 bp, human
gcgggtaagcgttcagtgtg

SEQ ID NO: 136354 - DNA, 20 bp, human
gccgcgccaggcgcgtctcg

SEQ ID NO: 136355 - DNA, 20 bp, human
gccctccactcagggctcgg

SEQ ID NO: 136356 - DNA, 20 bp, human
gtacaaggacactcaacctc

SEQ ID NO: 136357 - DNA, 20 bp, human
gtgaggcttgcagctaagga

SEQ ID NO: 136358 - DNA, 20 bp, human
gcctgctggtggaaactcaa

SEQ ID NO: 136359 - DNA, 20 bp, human
gatcagcccagataagtaca

SEQ ID NO: 136360 - DNA, 20 bp, human
gaggtgctgtcttcacaggc

SEQ ID NO: 136361 - DNA, 20 bp, human
ggacatgaggcttgcagcta

SEQ ID NO: 136362 - DNA, 20 bp, human
gtgccagaccataggccgta

SEQ ID NO: 136363 - DNA, 20 bp, human
ggacagaacagtcctcccta

SEQ ID NO: 136364 - DNA, 20 bp, human
gggagactagggcctcctgc

SEQ ID NO: 136365 - DNA, 20 bp, human
ggttccagctgccagaccat

SEQ ID NO: 136366 - DNA, 20 bp, human
gccatctgcagcgcagcggc

SEQ ID NO: 136367 - DNA, 20 bp, human
gagttgtccaggaagcgcac

SEQ ID NO: 136368 - DNA, 20 bp, human
gcccagcgcgcagcaccggg

SEQ ID NO: 136369 - DNA, 20 bp, human
ggctctgaggagctaccagg

SEQ ID NO: 136370 - DNA, 20 bp, human
gcagatggcggaaatggatc

SEQ ID NO: 136371 - DNA, 20 bp, human
ggtacttgccagcatttcaa

SEQ ID NO: 136372 - DNA, 20 bp, human
gtgggaagcggtgggcatag

SEQ ID NO: 136373 - DNA, 20 bp, human
gaagcggtgggcatagggga

SEQ ID NO: 136374 - DNA, 20 bp, human
gcgcggcgcgtacaccaggt

SEQ ID NO: 136375 - DNA, 20 bp, human
gcgtgactcgactaacatct

SEQ ID NO: 136376 - DNA, 20 bp, human
gcgcgcgcgcctctctgtcg

SEQ ID NO: 136377 - DNA, 20 bp, human
gctcggcgcacgatcacggg

SEQ ID NO: 136378 - DNA, 20 bp, human
gccatttgcagagaagaccg

SEQ ID NO: 136379 - DNA, 20 bp, human
gaagccgcgccacgacagag

SEQ ID NO: 136380 - DNA, 20 bp, human
ggtcgtggcgcggcttcccg

SEQ ID NO: 136381 - DNA, 20 bp, human
gggaaggccgctgacccgag

SEQ ID NO: 136382 - DNA, 20 bp, human
gaagggcgctccccagcggg

SEQ ID NO: 136383 - DNA, 20 bp, human
gctcgccaggcggagaggag

SEQ ID NO: 136384 - DNA, 20 bp, human
gcagcgctcgccaggcggag

SEQ ID NO: 136385 - DNA, 20 bp, human
gagcggccttccgtcatgaa

SEQ ID NO: 136386 - DNA, 20 bp, human
gcagtggcagggaacaagaa

SEQ ID NO: 136387 - DNA, 20 bp, human
ggaagaggatcggctaagag

SEQ ID NO: 136388 - DNA, 20 bp, human
gtggttcctcgcagcttaaa

SEQ ID NO: 136389 - DNA, 20 bp, human
gatctatgactgaagaggat

SEQ ID NO: 136390 - DNA, 20 bp, human
gagggcagcttgagcatcgt

SEQ ID NO: 136391 - DNA, 20 bp, human
gtaatgaggaatacacagga

SEQ ID NO: 136392 - DNA, 20 bp, human
ggccttgtgcaaatcacaca

SEQ ID NO: 136393 - DNA, 20 bp, human
gttagaatctatgactgaag

SEQ ID NO: 136394 - DNA, 20 bp, human
ggaggaatacacaggaggga

SEQ ID NO: 136395 - DNA, 20 bp, human
gggcatcgttagagtagcat

SEQ ID NO: 136396 - DNA, 20 bp, human
gagtgagcccaagaaatcca

SEQ ID NO: 136397 - DNA, 20 bp, human
gcactgtgaatacttggcca

SEQ ID NO: 136398 - DNA, 20 bp, human
gcaagaaatccagggcagaa

SEQ ID NO: 136399 - DNA, 20 bp, human
gatgagttgatagataacag

SEQ ID NO: 136400 - DNA, 20 bp, human
ggaagaagacatggcagact

SEQ ID NO: 136401 - DNA, 20 bp, human
gcttcttgcctcgaaggagt

SEQ ID NO: 136402 - DNA, 20 bp, human
gtctagcctaaagtagaaat

SEQ ID NO: 136403 - DNA, 20 bp, human
ggagttggctgagggatccc

SEQ ID NO: 136404 - DNA, 20 bp, human
gatttcttgggctcacttag

SEQ ID NO: 136405 - DNA, 20 bp, human
gcctacagagcccataaaga

SEQ ID NO: 136406 - DNA, 20 bp, human
gccggccttagtgactgggg

SEQ ID NO: 136407 - DNA, 20 bp, human
gagtcactaaggccggcccg

SEQ ID NO: 136408 - DNA, 20 bp, human
gccggcccgcggccggacac

SEQ ID NO: 136409 - DNA, 20 bp, human
gcctccgctccgccagtgtc

SEQ ID NO: 136410 - DNA, 20 bp, human
gcccgccggcgagcaaggta

SEQ ID NO: 136411 - DNA, 20 bp, human
gcggccggacactggcggag

SEQ ID NO: 136412 - DNA, 20 bp, human
gacgtcgggcacgtagacgc

SEQ ID NO: 136413 - DNA, 20 bp, human
gccccagcgcccgggtcacg

SEQ ID NO: 136414 - DNA, 20 bp, human
gcgcgctgggagagctccgg

SEQ ID NO: 136415 - DNA, 20 bp, human
gggcgagcaaggtaagggag

SEQ ID NO: 136416 - DNA, 20 bp, human
ggcgtgcagctggagccccg

SEQ ID NO: 136417 - DNA, 20 bp, human
ggtctccggtctccgccccg

SEQ ID NO: 136418 - DNA, 20 bp, human
gcctagcaacgggaggagaa

SEQ ID NO: 136419 - DNA, 20 bp, human
gcacctaacggtaatcaaca

SEQ ID NO: 136420 - DNA, 20 bp, human
gcggttcagaccattgtcaa

SEQ ID NO: 136421 - DNA, 20 bp, human
gcaatgacaaccgcagtctc

SEQ ID NO: 136422 - DNA, 20 bp, human
ggaaagcaaaaggcacctaa

SEQ ID NO: 136423 - DNA, 20 bp, human
gagaccggagaccggggact

SEQ ID NO: 136424 - DNA, 20 bp, human
gttcagaccattgtcaaagg

SEQ ID NO: 136425 - DNA, 20 bp, human
ggaaagtcaaacccagtccc

SEQ ID NO: 136426 - DNA, 20 bp, human
gaaaggaaaacgagtcccta

SEQ ID NO: 136427 - DNA, 20 bp, human
gccaccgcacgaggcaagtg

SEQ ID NO: 136428 - DNA, 20 bp, human
gcgggcgcgtgtgcgtgagg

SEQ ID NO: 136429 - DNA, 20 bp, human
ggccggaagaaccaacctgc

SEQ ID NO: 136430 - DNA, 20 bp, human
ggatgctgtagcgtcctcac

SEQ ID NO: 136431 - DNA, 20 bp, human
gaacctgctggcagccggtg

SEQ ID NO: 136432 - DNA, 20 bp, human
ggagcgcgcggaaacaggct

SEQ ID NO: 136433 - DNA, 20 bp, human
gggagtttaaggctaaccct

SEQ ID NO: 136434 - DNA, 20 bp, human
ggggagacgagtgtatccgc

SEQ ID NO: 136435 - DNA, 20 bp, human
ggtctcgtttcacttaaagg

SEQ ID NO: 136436 - DNA, 20 bp, human
ggaaggagtggcaccagagt

SEQ ID NO: 136437 - DNA, 20 bp, human
ggtcggggtcaaggaaccgg

SEQ ID NO: 136438 - DNA, 20 bp, human
gccgggtggggtctcctcgg

SEQ ID NO: 136439 - DNA, 20 bp, human
gaggagcagctgcaagcaca

SEQ ID NO: 136440 - DNA, 20 bp, human
ggaagacagaaaggcgagat

SEQ ID NO: 136441 - DNA, 20 bp, human
gaaaagttatggagacaggg

SEQ ID NO: 136442 - DNA, 20 bp, human
gccaggcccagtccccgggt

SEQ ID NO: 136443 - DNA, 20 bp, human
gaacagccccagtcaactat

SEQ ID NO: 136444 - DNA, 20 bp, human
gtccccgggtggggtctcct

SEQ ID NO: 136445 - DNA, 20 bp, human
gagaattagaagagcagggg

SEQ ID NO: 136446 - DNA, 20 bp, human
gcgcgcgagcgtcggagaca

SEQ ID NO: 136447 - DNA, 20 bp, human
gcaagccggagccagagacg

SEQ ID NO: 136448 - DNA, 20 bp, human
gggtcccctgggatgaggaa

SEQ ID NO: 136449 - DNA, 20 bp, human
ggggatctaggctctaggag

SEQ ID NO: 136450 - DNA, 20 bp, human
gcggtgcgcccgggattcta

SEQ ID NO: 136451 - DNA, 20 bp, human
ggggtcaggaagggggatct

SEQ ID NO: 136452 - DNA, 20 bp, human
ggagctccagacacccgccg

SEQ ID NO: 136453 - DNA, 20 bp, human
ggctcgccaaggggtcccca

SEQ ID NO: 136454 - DNA, 20 bp, human
gggctctaggaggggtcccg

SEQ ID NO: 136455 - DNA, 20 bp, human
ggcggagcccgcgcgagcgt

SEQ ID NO: 136456 - DNA, 20 bp, human
gagttggcgagtctcccggt

SEQ ID NO: 136457 - DNA, 20 bp, human
ggctcggctctaggacgtgt

SEQ ID NO: 136458 - DNA, 20 bp, human
gaggacgtgtcgggctgcac

SEQ ID NO: 136459 - DNA, 20 bp, human
gtagagccgagccggcgccg

SEQ ID NO: 136460 - DNA, 20 bp, human
ggtcgggctgcacgggtcgg

SEQ ID NO: 136461 - DNA, 20 bp, human
gctgccggaggtagcacata

SEQ ID NO: 136462 - DNA, 20 bp, human
gcctgaagccgatggagcag

SEQ ID NO: 136463 - DNA, 20 bp, human
gcacagggcaccgcaaagga

SEQ ID NO: 136464 - DNA, 20 bp, human
gcgtgtcgggctgcacgggt

SEQ ID NO: 136465 - DNA, 20 bp, human
ggcgagtctcccggtgggaa

SEQ ID NO: 136466 - DNA, 20 bp, human
gcctgcccggattcctgaca

SEQ ID NO: 136467 - DNA, 20 bp, human
gacatggtgtagtgcaggca

SEQ ID NO: 136468 - DNA, 20 bp, human
ggcagggtggggaaaggacg

SEQ ID NO: 136469 - DNA, 20 bp, human
gatccgggcaggcaccgagc

SEQ ID NO: 136470 - DNA, 20 bp, human
gcctagggtgtgggggtcta

SEQ ID NO: 136471 - DNA, 20 bp, human
gctctccaccccccaggtaa

SEQ ID NO: 136472 - DNA, 20 bp, human
gtcctgacatggtgtagtgc

SEQ ID NO: 136473 - DNA, 20 bp, human
gaggtattaccgggagccta

SEQ ID NO: 136474 - DNA, 20 bp, human
gctcccagacgggagggaag

SEQ ID NO: 136475 - DNA, 20 bp, human
gaatcgacccggggaagagg

SEQ ID NO: 136476 - DNA, 20 bp, human
ggcttggtccggcagttggt

SEQ ID NO: 136477 - DNA, 20 bp, human
gccgtcgggagcattaccta

SEQ ID NO: 136478 - DNA, 20 bp, human
ggagcccagaagcgagcgac

SEQ ID NO: 136479 - DNA, 20 bp, human
gcaaccctgcctgggatccg

SEQ ID NO: 136480 - DNA, 20 bp, human
gggtccggcagttggtcggt

SEQ ID NO: 136481 - DNA, 20 bp, human
gggagcagcggcgtggacta

SEQ ID NO: 136482 - DNA, 20 bp, human
gcaagcgcccgaccaaccag

SEQ ID NO: 136483 - DNA, 20 bp, human
gaggagggcagaactcctgt

SEQ ID NO: 136484 - DNA, 20 bp, human
ggttggtcgggcgcttggtc

SEQ ID NO: 136485 - DNA, 20 bp, human
gtggcccaccgaccaactgc

SEQ ID NO: 136486 - DNA, 20 bp, human
gatttacggggtctcccgga

SEQ ID NO: 136487 - DNA, 20 bp, human
gtcaccgactctggccctcc

SEQ ID NO: 136488 - DNA, 20 bp, human
gtctcccggagggccagagt

SEQ ID NO: 136489 - DNA, 20 bp, human
gtacctacctgggataacgg

SEQ ID NO: 136490 - DNA, 20 bp, human
ggcgccggaagtacctacct

SEQ ID NO: 136491 - DNA, 20 bp, human
gcgccgccgttatcccaggt

SEQ ID NO: 136492 - DNA, 20 bp, human
gaagtacctacctgggataa

SEQ ID NO: 136493 - DNA, 20 bp, human
ggagcggacggctgcattta

SEQ ID NO: 136494 - DNA, 20 bp, human
ggataacggcggcgagcgga

SEQ ID NO: 136495 - DNA, 20 bp, human
gcgctcgccgccgttatccc

SEQ ID NO: 136496 - DNA, 20 bp, human
gcggcgcccaggccaagcta

SEQ ID NO: 136497 - DNA, 20 bp, human
gacgtgcgtcggacaggaca

SEQ ID NO: 136498 - DNA, 20 bp, human
gcggagcccaacgactctca

SEQ ID NO: 136499 - DNA, 20 bp, human
gcaggcactatggacagggt

SEQ ID NO: 136500 - DNA, 20 bp, human
ggacagggcgcggccacatg

SEQ ID NO: 136501 - DNA, 20 bp, human
gggcggtggcgtctgcaaaa

SEQ ID NO: 136502 - DNA, 20 bp, human
gccgcgccttgagagtcgtt

SEQ ID NO: 136503 - DNA, 20 bp, human
gggtccttgggcaccagcaa

SEQ ID NO: 136504 - DNA, 20 bp, human
ggccgcccgcccgacctcaa

SEQ ID NO: 136505 - DNA, 20 bp, human
ggtccgacgcacgtgctcgg

SEQ ID NO: 136506 - DNA, 20 bp, human
gggagaggcgcagcatccac

SEQ ID NO: 136507 - DNA, 20 bp, human
ggaggcgcagcatccacagg

SEQ ID NO: 136508 - DNA, 20 bp, human
gctctccgaacgcaacatga

SEQ ID NO: 136509 - DNA, 20 bp, human
ggaccccgcgatgagggcgg

SEQ ID NO: 136510 - DNA, 20 bp, human
gacggaccccgcgatgaggg

SEQ ID NO: 136511 - DNA, 20 bp, human
gccatctccccagcactgag

SEQ ID NO: 136512 - DNA, 20 bp, human
gacccatctggggccgacac

SEQ ID NO: 136513 - DNA, 20 bp, human
gcatcggccgcagaaggtcc

SEQ ID NO: 136514 - DNA, 20 bp, human
ggaagacggaccccgcgatg

SEQ ID NO: 136515 - DNA, 20 bp, human
gatccccggatacccatctg

SEQ ID NO: 136516 - DNA, 20 bp, human
gccgggcccatggtgagcgg

SEQ ID NO: 136517 - DNA, 20 bp, human
gaccggcacgggcgcgacac

SEQ ID NO: 136518 - DNA, 20 bp, human
ggacccgggcccatggtgag

SEQ ID NO: 136519 - DNA, 20 bp, human
gctaccggcacgggcgctac

SEQ ID NO: 136520 - DNA, 20 bp, human
gagcagactgcggcggaggt

SEQ ID NO: 136521 - DNA, 20 bp, human
ggcggtggcagcggcgctac

SEQ ID NO: 136522 - DNA, 20 bp, human
gcacgctgaaggaagtactt

SEQ ID NO: 136523 - DNA, 20 bp, human
ggccccacgcaaagcacgag

SEQ ID NO: 136524 - DNA, 20 bp, human
gacgggcgcgacacaggctc

SEQ ID NO: 136525 - DNA, 20 bp, human
gaagtccaagcagactgcgg

SEQ ID NO: 136526 - DNA, 20 bp, human
ggagcaggcccggagatcta

SEQ ID NO: 136527 - DNA, 20 bp, human
ggagtacctagtggccgccc

SEQ ID NO: 136528 - DNA, 20 bp, human
gggaatatcagagtacctag

SEQ ID NO: 136529 - DNA, 20 bp, human
ggaagtgccaccaaatcagg

SEQ ID NO: 136530 - DNA, 20 bp, human
gcagcgtcgctgccggtctc

SEQ ID NO: 136531 - DNA, 20 bp, human
gtcgcggaaaagccccgagg

SEQ ID NO: 136532 - DNA, 20 bp, human
gctccggcggagacggactc

SEQ ID NO: 136533 - DNA, 20 bp, human
ggtccgtctccgccggagac

SEQ ID NO: 136534 - DNA, 20 bp, human
ggaaacttccgcaccaccga

SEQ ID NO: 136535 - DNA, 20 bp, human
gcttgtatcaatgccatcgg

SEQ ID NO: 136536 - DNA, 20 bp, human
gtacaagacgcgcttggtgg

SEQ ID NO: 136537 - DNA, 20 bp, human
gaagaggacgggtcgagtgc

SEQ ID NO: 136538 - DNA, 20 bp, human
gccaagcgcgtcttgtacgt

SEQ ID NO: 136539 - DNA, 20 bp, human
gagcaggaggggttgctagg

SEQ ID NO: 136540 - DNA, 20 bp, human
gcaggtgcgtgaacccgaga

SEQ ID NO: 136541 - DNA, 20 bp, human
ggtgagcaggaggggttgct

SEQ ID NO: 136542 - DNA, 20 bp, human
ggagtgaacgcgacccccaa

SEQ ID NO: 136543 - DNA, 20 bp, human
gcgcaaaagcagaggcccaa

SEQ ID NO: 136544 - DNA, 20 bp, human
gtgaggacagtgggaaacct

SEQ ID NO: 136545 - DNA, 20 bp, human
gcagccttgccacacacctc

SEQ ID NO: 136546 - DNA, 20 bp, human
gcggccgagcggcttcccgt

SEQ ID NO: 136547 - DNA, 20 bp, human
gcgcgggtcgggcgggacac

SEQ ID NO: 136548 - DNA, 20 bp, human
gggtcgggcgggacacgggc

SEQ ID NO: 136549 - DNA, 20 bp, human
ggtcagatcgcagagaggga

SEQ ID NO: 136550 - DNA, 20 bp, human
gcgctccagtgctccgaggg

SEQ ID NO: 136551 - DNA, 20 bp, human
gagcgcagcgccagcatcgc

SEQ ID NO: 136552 - DNA, 20 bp, human
gtacacgagcgggttcccgg

SEQ ID NO: 136553 - DNA, 20 bp, human
gcggcccgggcacgagggag

SEQ ID NO: 136554 - DNA, 20 bp, human
ggaggcccagagctcggcat

SEQ ID NO: 136555 - DNA, 20 bp, human
ggtgtggaggagaaagctca

SEQ ID NO: 136556 - DNA, 20 bp, human
gagtccctgcgtacgaaagc

SEQ ID NO: 136557 - DNA, 20 bp, human
ggtttaccgtctttccctcg

SEQ ID NO: 136558 - DNA, 20 bp, human
ggactgcggcctgaactcta

SEQ ID NO: 136559 - DNA, 20 bp, human
gcgcacaagctgtaacatgg

SEQ ID NO: 136560 - DNA, 20 bp, human
gtgccaggactgagttgtgg

SEQ ID NO: 136561 - DNA, 20 bp, human
gggaggtgtgcgcctgagtg

SEQ ID NO: 136562 - DNA, 20 bp, human
gcaaaatgcgtcagtgaggg

SEQ ID NO: 136563 - DNA, 20 bp, human
gaacatggcggcagcgactg

SEQ ID NO: 136564 - DNA, 20 bp, human
gctcccccacaactcagtcc

SEQ ID NO: 136565 - DNA, 20 bp, human
gtgccgcacaagctgtaaca

SEQ ID NO: 136566 - DNA, 20 bp, human
gcccagttcctccagaagcg

SEQ ID NO: 136567 - DNA, 20 bp, human
gcgacccggaagcagaagtc

SEQ ID NO: 136568 - DNA, 20 bp, human
gcgggtcggagccatggcgg

SEQ ID NO: 136569 - DNA, 20 bp, human
ggcccagtccaagaccatga

SEQ ID NO: 136570 - DNA, 20 bp, human
ggccaacttcctgcaatcag

SEQ ID NO: 136571 - DNA, 20 bp, human
gtcaagtcctgttaaccccg

SEQ ID NO: 136572 - DNA, 20 bp, human
gctgggcggttagactaggg

SEQ ID NO: 136573 - DNA, 20 bp, human
gttcccttcggcgcaggtgt

SEQ ID NO: 136574 - DNA, 20 bp, human
gtaaagttctcggccgtctt

SEQ ID NO: 136575 - DNA, 20 bp, human
gaagcagaagtcgggagcgt

SEQ ID NO: 136576 - DNA, 20 bp, human
ggccatagcgaagccggcgg

SEQ ID NO: 136577 - DNA, 20 bp, human
gtccgccgccggcttcgcta

SEQ ID NO: 136578 - DNA, 20 bp, human
gctggtctccaagtaaacgt

SEQ ID NO: 136579 - DNA, 20 bp, human
ggccgccatagcgaagccgg

SEQ ID NO: 136580 - DNA, 20 bp, human
gcggccgagacggcccccag

SEQ ID NO: 136581 - DNA, 20 bp, human
gggcaattcccccagattcc

SEQ ID NO: 136582 - DNA, 20 bp, human
gtctccaagtaaacgttggg

SEQ ID NO: 136583 - DNA, 20 bp, human
gtcccctctcaaccctctgg

SEQ ID NO: 136584 - DNA, 20 bp, human
ggcttggacgcgggcgatgg

SEQ ID NO: 136585 - DNA, 20 bp, human
gcgtggagcagcggccgaga

SEQ ID NO: 136586 - DNA, 20 bp, human
gagcgagcacgaaaaaacaa

SEQ ID NO: 136587 - DNA, 20 bp, human
gcggctgacaactcagacca

SEQ ID NO: 136588 - DNA, 20 bp, human
gcacagcgagacgtgaagta

SEQ ID NO: 136589 - DNA, 20 bp, human
gaacagacgggggacggtcc

SEQ ID NO: 136590 - DNA, 20 bp, human
gcgggacaggcggttcactg

SEQ ID NO: 136591 - DNA, 20 bp, human
ggtagagactactcattcaa

SEQ ID NO: 136592 - DNA, 20 bp, human
gtccgggcagaaccagagta

SEQ ID NO: 136593 - DNA, 20 bp, human
ggagacgtgaagtacggaag

SEQ ID NO: 136594 - DNA, 20 bp, human
ggaaactcgcgaacagacgg

SEQ ID NO: 136595 - DNA, 20 bp, human
gtcgcttccccatggcggag

SEQ ID NO: 136596 - DNA, 20 bp, human
ggtgtaaggcgaaactacct

SEQ ID NO: 136597 - DNA, 20 bp, human
gggatactgcgagtgaacag

SEQ ID NO: 136598 - DNA, 20 bp, human
gctttgggccagcggaagtt

SEQ ID NO: 136599 - DNA, 20 bp, human
gaaagaaggaccctgcacgg

SEQ ID NO: 136600 - DNA, 20 bp, human
gactcggctgccaaacggaa

SEQ ID NO: 136601 - DNA, 20 bp, human
gaagtggtgaagcccaagta

SEQ ID NO: 136602 - DNA, 20 bp, human
ggaaggaggtgaggcggtaa

SEQ ID NO: 136603 - DNA, 20 bp, human
ggtaaaagaaggaccctgca

SEQ ID NO: 136604 - DNA, 20 bp, human
gaaggggcgttctctctctt

SEQ ID NO: 136605 - DNA, 20 bp, human
gacggctgtgctagacgaag

SEQ ID NO: 136606 - DNA, 20 bp, human
gtcacgagtaaacacaataa

SEQ ID NO: 136607 - DNA, 20 bp, human
gggaggaggagcgggcgcca

SEQ ID NO: 136608 - DNA, 20 bp, human
gtgcttggcgcagcgagtgt

SEQ ID NO: 136609 - DNA, 20 bp, human
gctcctcccggggtttgtag

SEQ ID NO: 136610 - DNA, 20 bp, human
gctccgctacaaaccccggg

SEQ ID NO: 136611 - DNA, 20 bp, human
ggcgcagagaagggaaagta

SEQ ID NO: 136612 - DNA, 20 bp, human
gttctactggagaccacttt

SEQ ID NO: 136613 - DNA, 20 bp, human
gcccacacacacactcccaa

SEQ ID NO: 136614 - DNA, 20 bp, human
ggtttgtagcggaggaggag

SEQ ID NO: 136615 - DNA, 20 bp, human
gctcctccgctacaaacccc

SEQ ID NO: 136616 - DNA, 20 bp, human
gctccgtctggaggaccggg

SEQ ID NO: 136617 - DNA, 20 bp, human
ggaccgggaggagagtatag

SEQ ID NO: 136618 - DNA, 20 bp, human
gggagaactgagcgaaggaa

SEQ ID NO: 136619 - DNA, 20 bp, human
gtaaagggagaactgagcga

SEQ ID NO: 136620 - DNA, 20 bp, human
gtagcgtgcgggggcccgca

SEQ ID NO: 136621 - DNA, 20 bp, human
gagaaccgcgctgggagata

SEQ ID NO: 136622 - DNA, 20 bp, human
gggcccccgcacgctaggtg

SEQ ID NO: 136623 - DNA, 20 bp, human
ggcgagccgcacctagcgtg

SEQ ID NO: 136624 - DNA, 20 bp, human
gggagggccgcccacgacgg

SEQ ID NO: 136625 - DNA, 20 bp, human
gtcacctgcagcggccgctc

SEQ ID NO: 136626 - DNA, 20 bp, human
ggggcggtatcggaccgggt

SEQ ID NO: 136627 - DNA, 20 bp, human
gggctggagtccaggaggaa

SEQ ID NO: 136628 - DNA, 20 bp, human
ggaggagcggagtcgtacag

SEQ ID NO: 136629 - DNA, 20 bp, human
gacaggggagaggatcaagg

SEQ ID NO: 136630 - DNA, 20 bp, human
gcgtacaggggagaggatca

SEQ ID NO: 136631 - DNA, 20 bp, human
gtgtcagcgtagggagagtg

SEQ ID NO: 136632 - DNA, 20 bp, human
ggcgggtgagtgaaggccgg

SEQ ID NO: 136633 - DNA, 20 bp, human
gcgggtgggcgcggtagagt

SEQ ID NO: 136634 - DNA, 20 bp, human
gtagtggagtcgggatgcga

SEQ ID NO: 136635 - DNA, 20 bp, human
gggagaggatcaaggtggaa

SEQ ID NO: 136636 - DNA, 20 bp, human
gccagctccaaggaagaagt

SEQ ID NO: 136637 - DNA, 20 bp, human
gccttggagctggagatgag

SEQ ID NO: 136638 - DNA, 20 bp, human
gagtgagggcgagagtacca

SEQ ID NO: 136639 - DNA, 20 bp, human
gggtcattgacggccagtga

SEQ ID NO: 136640 - DNA, 20 bp, human
gccacggcccacttcttcct

SEQ ID NO: 136641 - DNA, 20 bp, human
ggcattcggaaagaacagag

SEQ ID NO: 136642 - DNA, 20 bp, human
gcctcccctaaactaggata

SEQ ID NO: 136643 - DNA, 20 bp, human
gggcctcatgcctattccac

SEQ ID NO: 136644 - DNA, 20 bp, human
gggctgggcacccgtggaat

SEQ ID NO: 136645 - DNA, 20 bp, human
ggattacccacgcccggcca

SEQ ID NO: 136646 - DNA, 20 bp, human
gccttggagctggagatgag

SEQ ID NO: 136647 - DNA, 20 bp, human
gccagctccaaggaagaagt

SEQ ID NO: 136648 - DNA, 20 bp, human
gggacatgccggcattgtaa

SEQ ID NO: 136649 - DNA, 20 bp, human
gaaaggcaggtcctcgagga

SEQ ID NO: 136650 - DNA, 20 bp, human
gagtgagggcgagagtacca

SEQ ID NO: 136651 - DNA, 20 bp, human
gggctgggcacccgtggaat

SEQ ID NO: 136652 - DNA, 20 bp, human
gggccaaatcagggacatgc

SEQ ID NO: 136653 - DNA, 20 bp, human
gggtcattgacggccagtga

SEQ ID NO: 136654 - DNA, 20 bp, human
gagcataagagggaactata

SEQ ID NO: 136655 - DNA, 20 bp, human
gtctgcagagcgggatgagt

SEQ ID NO: 136656 - DNA, 20 bp, human
gcagttgtaggcgtggacgt

SEQ ID NO: 136657 - DNA, 20 bp, human
ggtggagccaggcacagcgt

SEQ ID NO: 136658 - DNA, 20 bp, human
gcagctatagggccacataa

SEQ ID NO: 136659 - DNA, 20 bp, human
gtcgaggctaatcacttcag

SEQ ID NO: 136660 - DNA, 20 bp, human
gggccacataagggaacctc

SEQ ID NO: 136661 - DNA, 20 bp, human
gccctgcctccgggatgaaa

SEQ ID NO: 136662 - DNA, 20 bp, human
gttaccccctttcatcccgg

SEQ ID NO: 136663 - DNA, 20 bp, human
ggatcatgccagggttgagg

SEQ ID NO: 136664 - DNA, 20 bp, human
ggccctatagctgttactga

SEQ ID NO: 136665 - DNA, 20 bp, human
ggagacttcagttgtaggcg

SEQ ID NO: 136666 - DNA, 20 bp, human
ggagcgaccctgggacacgg

SEQ ID NO: 136667 - DNA, 20 bp, human
ggcattgccttgagggccta

SEQ ID NO: 136668 - DNA, 20 bp, human
gcccgtgccctaggccctca

SEQ ID NO: 136669 - DNA, 20 bp, human
ggagggggagcataacacag

SEQ ID NO: 136670 - DNA, 20 bp, human
gcgggcagtgtaggaatggg

SEQ ID NO: 136671 - DNA, 20 bp, human
gcacaggggcaagagcgtcc

SEQ ID NO: 136672 - DNA, 20 bp, human
gctgaagagcgagttcatgg

SEQ ID NO: 136673 - DNA, 20 bp, human
gtgcagacccggaggtgagg

SEQ ID NO: 136674 - DNA, 20 bp, human
ggggagcccggactgcggcg

SEQ ID NO: 136675 - DNA, 20 bp, human
gcccccagcgagtagggacc

SEQ ID NO: 136676 - DNA, 20 bp, human
gcccgcagcttcgggtcctc

SEQ ID NO: 136677 - DNA, 20 bp, human
gcctcaggcggctgttgctc

SEQ ID NO: 136678 - DNA, 20 bp, human
gagctagagagcagtggtct

SEQ ID NO: 136679 - DNA, 20 bp, human
gcggtggcggcgctagggac

SEQ ID NO: 136680 - DNA, 20 bp, human
gcggctgctccgggtaagtg

SEQ ID NO: 136681 - DNA, 20 bp, human
gatccgggcgttggagaggg

SEQ ID NO: 136682 - DNA, 20 bp, human
gagagagcgggtcccggaga

SEQ ID NO: 136683 - DNA, 20 bp, human
ggcaggtccctggtcggccg

SEQ ID NO: 136684 - DNA, 20 bp, human
gcgcggggccgcgctagagg

SEQ ID NO: 136685 - DNA, 20 bp, human
gatcatccgggcgttggaga

SEQ ID NO: 136686 - DNA, 20 bp, human
ggcggcggccgaatcggcaa

SEQ ID NO: 136687 - DNA, 20 bp, human
gcgggcggtgtaaacagccc

SEQ ID NO: 136688 - DNA, 20 bp, human
gccgagcggcttctgctcaa

SEQ ID NO: 136689 - DNA, 20 bp, human
ggggagggagaagatgtcta

SEQ ID NO: 136690 - DNA, 20 bp, human
gtgccgggcggccttacctg

SEQ ID NO: 136691 - DNA, 20 bp, human
gcgcaactgctaggggaacg

SEQ ID NO: 136692 - DNA, 20 bp, human
gccttacctgaggcaaggga

SEQ ID NO: 136693 - DNA, 20 bp, human
gggttgcaaaaggagccgag

SEQ ID NO: 136694 - DNA, 20 bp, human
ggcggccttacctgaggcaa

SEQ ID NO: 136695 - DNA, 20 bp, human
gggaagcggcggctgagtca

SEQ ID NO: 136696 - DNA, 20 bp, human
gtcggggaaaggcccagcgg

SEQ ID NO: 136697 - DNA, 20 bp, human
gcggcggcgggagacacact

SEQ ID NO: 136698 - DNA, 20 bp, human
gggccacggaggaacggcgg

SEQ ID NO: 136699 - DNA, 20 bp, human
gagagggtcgcgagcctctc

SEQ ID NO: 136700 - DNA, 20 bp, human
gaaaggccacggaggaacgg

SEQ ID NO: 136701 - DNA, 20 bp, human
gcgccggccgcccttcccgg

SEQ ID NO: 136702 - DNA, 20 bp, human
gtcccggcggcgaagtctcg

SEQ ID NO: 136703 - DNA, 20 bp, human
ggacgacgccgagaaggggg

SEQ ID NO: 136704 - DNA, 20 bp, human
gcgctccggcccagctctcg

SEQ ID NO: 136705 - DNA, 20 bp, human
gcacacggcgaaaaaggcca

SEQ ID NO: 136706 - DNA, 20 bp, human
ggcctgcgggagccctctcc

SEQ ID NO: 136707 - DNA, 20 bp, human
gcctagggctccggcaaggg

SEQ ID NO: 136708 - DNA, 20 bp, human
ggggcggttaacggccgcac

SEQ ID NO: 136709 - DNA, 20 bp, human
ggagcctagggctccggcaa

SEQ ID NO: 136710 - DNA, 20 bp, human
gctccggcaagggcggttaa

SEQ ID NO: 136711 - DNA, 20 bp, human
ggcactaggttgcctggaga

SEQ ID NO: 136712 - DNA, 20 bp, human
gggcacgagcgatcagcact

SEQ ID NO: 136713 - DNA, 20 bp, human
ggcttcggtagaggaacccg

SEQ ID NO: 136714 - DNA, 20 bp, human
gctgatcgctcgtgccggtg

SEQ ID NO: 136715 - DNA, 20 bp, human
ggcggcggttgagggtgagg

SEQ ID NO: 136716 - DNA, 20 bp, human
gcgagcgcccaaggcgcaca

SEQ ID NO: 136717 - DNA, 20 bp, human
gtgaggcccgcggagaccag

SEQ ID NO: 136718 - DNA, 20 bp, human
ggtagggaccgagggctatg

SEQ ID NO: 136719 - DNA, 20 bp, human
ggccgagacgaggctcacat

SEQ ID NO: 136720 - DNA, 20 bp, human
gagggcctggtagggaccga

SEQ ID NO: 136721 - DNA, 20 bp, human
gcagggactggggggatatg

SEQ ID NO: 136722 - DNA, 20 bp, human
gcctcacccctggtctccgc

SEQ ID NO: 136723 - DNA, 20 bp, human
gaggcaaggaggccgagacg

SEQ ID NO: 136724 - DNA, 20 bp, human
gccgagccgagggcctggta

SEQ ID NO: 136725 - DNA, 20 bp, human
gcgggattagagggctgacg

SEQ ID NO: 136726 - DNA, 20 bp, human
gccggcctcgcgcctttcac

SEQ ID NO: 136727 - DNA, 20 bp, human
ggacgcaaggtgccggtgaa

SEQ ID NO: 136728 - DNA, 20 bp, human
gcaggaggcggtaacgggac

SEQ ID NO: 136729 - DNA, 20 bp, human
gcaattgggacccttcccag

SEQ ID NO: 136730 - DNA, 20 bp, human
gcgcgaccgacgcaaggtgc

SEQ ID NO: 136731 - DNA, 20 bp, human
gccgcggcgcgaccgacgca

SEQ ID NO: 136732 - DNA, 20 bp, human
ggcacacggtccccaagcat

SEQ ID NO: 136733 - DNA, 20 bp, human
ggccggccaggaggcggtaa

SEQ ID NO: 136734 - DNA, 20 bp, human
gtaacgggacgggagctgtg

SEQ ID NO: 136735 - DNA, 20 bp, human
ggcatggcggagaagccgta

SEQ ID NO: 136736 - DNA, 20 bp, human
gactcgaggcagcttgtcag

SEQ ID NO: 136737 - DNA, 20 bp, human
gacttggacttagcaactcg

SEQ ID NO: 136738 - DNA, 20 bp, human
ggtgagcctggcattcccac

SEQ ID NO: 136739 - DNA, 20 bp, human
gcctggcattcccactggtg

SEQ ID NO: 136740 - DNA, 20 bp, human
ggatgagtcagatgaggcgg

SEQ ID NO: 136741 - DNA, 20 bp, human
ggaaaacagtcaactagcca

SEQ ID NO: 136742 - DNA, 20 bp, human
gaagttctttgaggacagtg

SEQ ID NO: 136743 - DNA, 20 bp, human
gactaaagcttagaatacag

SEQ ID NO: 136744 - DNA, 20 bp, human
ggagagttgaaaactacaga

SEQ ID NO: 136745 - DNA, 20 bp, human
gggcagcccttgccttgtcc

SEQ ID NO: 136746 - DNA, 20 bp, human
ggcccgtaggggaaacgcag

SEQ ID NO: 136747 - DNA, 20 bp, human
ggacccggcggcagtagccg

SEQ ID NO: 136748 - DNA, 20 bp, human
gctccgcgagctcgccgggt

SEQ ID NO: 136749 - DNA, 20 bp, human
ggctcaggctccgagcacgg

SEQ ID NO: 136750 - DNA, 20 bp, human
gtgattatcacatgacccgg

SEQ ID NO: 136751 - DNA, 20 bp, human
ggcgctgaactgagcccacc

SEQ ID NO: 136752 - DNA, 20 bp, human
gcaggctccgagcacggcgg

SEQ ID NO: 136753 - DNA, 20 bp, human
gagcccacccggcgagctcg

SEQ ID NO: 136754 - DNA, 20 bp, human
ggaactctggccgcccgtag

SEQ ID NO: 136755 - DNA, 20 bp, human
ggggctgtctcaggacgagg

SEQ ID NO: 136756 - DNA, 20 bp, human
gggtgcggcccgaagaccag

SEQ ID NO: 136757 - DNA, 20 bp, human
ggagctcaccaggtgcgcca

SEQ ID NO: 136758 - DNA, 20 bp, human
gcgcacctggtgagctccgg

SEQ ID NO: 136759 - DNA, 20 bp, human
ggggcacccaaaccaggatg

SEQ ID NO: 136760 - DNA, 20 bp, human
gggagctcctggcccggacg

SEQ ID NO: 136761 - DNA, 20 bp, human
ggaagaccagaggatagcaa

SEQ ID NO: 136762 - DNA, 20 bp, human
gacgcccgcgaaggctgttg

SEQ ID NO: 136763 - DNA, 20 bp, human
ggcagaacagggtcctgagg

SEQ ID NO: 136764 - DNA, 20 bp, human
gggcgagggcagtcaatgag

SEQ ID NO: 136765 - DNA, 20 bp, human
gcagggtcctgaggcggcgt

SEQ ID NO: 136766 - DNA, 20 bp, human
gcaggcttccagctgcgcgg

SEQ ID NO: 136767 - DNA, 20 bp, human
gagatccgagacgacggaga

SEQ ID NO: 136768 - DNA, 20 bp, human
gtcaaggccgagcgcagtct

SEQ ID NO: 136769 - DNA, 20 bp, human
gggtcgtgagcagctcgtcg

SEQ ID NO: 136770 - DNA, 20 bp, human
gcagcctgcggccacattca

SEQ ID NO: 136771 - DNA, 20 bp, human
gctgcgctcggccttgaatg

SEQ ID NO: 136772 - DNA, 20 bp, human
gcagggacgtagccatccag

SEQ ID NO: 136773 - DNA, 20 bp, human
gccgaagcaagcagtcaaag

SEQ ID NO: 136774 - DNA, 20 bp, human
gcttcggagatccgagacga

SEQ ID NO: 136775 - DNA, 20 bp, human
gattagctaacggaggacgg

SEQ ID NO: 136776 - DNA, 20 bp, human
gccgccgcggtctcacaaag

SEQ ID NO: 136777 - DNA, 20 bp, human
gcgagccgatccgagccggg

SEQ ID NO: 136778 - DNA, 20 bp, human
gagccgctggtgccccggtt

SEQ ID NO: 136779 - DNA, 20 bp, human
gggtgagcgggagagttcag

SEQ ID NO: 136780 - DNA, 20 bp, human
gggagagcgatcagcaggtg

SEQ ID NO: 136781 - DNA, 20 bp, human
gggcacctcccggctcggat

SEQ ID NO: 136782 - DNA, 20 bp, human
ggtcggtactgagccgcagg

SEQ ID NO: 136783 - DNA, 20 bp, human
gcccggcgacgcggcacggt

SEQ ID NO: 136784 - DNA, 20 bp, human
ggtactgagccgcaggcggc

SEQ ID NO: 136785 - DNA, 20 bp, human
ggattcttcttgcccaaccg

SEQ ID NO: 136786 - DNA, 20 bp, human
gggaagttgtcaggattcgg

SEQ ID NO: 136787 - DNA, 20 bp, human
gacgctgggtcgggatgacc

SEQ ID NO: 136788 - DNA, 20 bp, human
gtgtcaggattcggaggtga

SEQ ID NO: 136789 - DNA, 20 bp, human
ggcaagaaggggctgtccac

SEQ ID NO: 136790 - DNA, 20 bp, human
gcgcggagcgcggggcgcta

SEQ ID NO: 136791 - DNA, 20 bp, human
gagggctagacggtaagggt

SEQ ID NO: 136792 - DNA, 20 bp, human
gggaagcggggccgtcggta

SEQ ID NO: 136793 - DNA, 20 bp, human
ggccggcggacatggcgcgg

SEQ ID NO: 136794 - DNA, 20 bp, human
gttgggctgcgacaggacag

SEQ ID NO: 136795 - DNA, 20 bp, human
gacccagggtgagatggtgg

SEQ ID NO: 136796 - DNA, 20 bp, human
gcagagggcgcagcctttag

SEQ ID NO: 136797 - DNA, 20 bp, human
ggaggcctggagtctggcga

SEQ ID NO: 136798 - DNA, 20 bp, human
gggcggggcctagatcgcag

SEQ ID NO: 136799 - DNA, 20 bp, human
gcgcggaggagctcaaacgt

SEQ ID NO: 136800 - DNA, 20 bp, human
gggagtctggcgagggactt

SEQ ID NO: 136801 - DNA, 20 bp, human
gcgcagcctttaggggaaga

SEQ ID NO: 136802 - DNA, 20 bp, human
ggaggatggtgaacgagcca

SEQ ID NO: 136803 - DNA, 20 bp, human
gagcgaagccccagagggga

SEQ ID NO: 136804 - DNA, 20 bp, human
ggagctgtgtgcctgaatcc

SEQ ID NO: 136805 - DNA, 20 bp, human
gaaataagcgaagccccaga

SEQ ID NO: 136806 - DNA, 20 bp, human
ggttgggccacactcaacgt

SEQ ID NO: 136807 - DNA, 20 bp, human
ggtgctgtccaaaggcgaca

SEQ ID NO: 136808 - DNA, 20 bp, human
ggagcgagtcgtgaccggtt

SEQ ID NO: 136809 - DNA, 20 bp, human
gcccgctgccgggtagaggt
